United States Patent 11,640,849 (METHODS FOR HISTOLOGICAL DIAGNOSIS AND TREATMENT OF DISEASES) - sequence listing, part 18

SEQ ID NO: 699366 - protein, 24 aa, Mycobacterium
LVVAEWPTSSGFSLDPVAAQRVSD

SEQ ID NO: 699367 - protein, 17 aa, Mycobacterium
LVVAGLRADFHLVEQYR

SEQ ID NO: 699368 - protein, 26 aa, Mycobacterium
LVVALERLGRWCVPGPVAESIAVAPV

SEQ ID NO: 699369 - protein, 25 aa, Mycobacterium
LVVALERLGRWCVPGPVTESIAVAP

SEQ ID NO: 699370 - protein, 23 aa, Mycobacterium
LVVALERLGYWGVPGPVTESIAV

SEQ ID NO: 699371 - protein, 17 aa, Mycobacterium
LVVALLCRGHVLLEGVP

SEQ ID NO: 699372 - protein, 18 aa, Mycobacterium
LVVALLCRGHVLLEGVPG

SEQ ID NO: 699373 - protein, 19 aa, Mycobacterium
LVVAPAARRRGIGSAMVRE

SEQ ID NO: 699374 - protein, 28 aa, Mycobacterium
LVVDTDLRWRVVTALARAGVIDADGTAT

SEQ ID NO: 699375 - protein, 27 aa, Mycobacterium
LVVEFPGLLGRAAFRAVDDVSFGIGRG

SEQ ID NO: 699376 - protein, 17 aa, Mycobacterium
LVVFPELSLSGYRADAQ

SEQ ID NO: 699377 - protein, 23 aa, Mycobacterium
LVVFRQLLLWPIDKSGKIIGEDS

SEQ ID NO: 699378 - protein, 25 aa, Mycobacterium
LVVGAGAWWHGWSRDDYDALAGAVA

SEQ ID NO: 699379 - protein, 24 aa, Mycobacterium
LVVGCGESGILAGVRLKQANIPFT

SEQ ID NO: 699380 - protein, 29 aa, Mycobacterium
LVVGGQKWLRAGWGTGFTKLSDRMLERMD

SEQ ID NO: 699381 - protein, 31 aa, Mycobacterium
LVVGPAAWWHGWERTDWDRLAGAVVAGHVIE

SEQ ID NO: 699382 - protein, 24 aa, Mycobacterium
LVVGPELLASAATDLTRIEQAIGA

SEQ ID NO: 699383 - protein, 18 aa, Mycobacterium
LVVGRASQRWGQEVVALV

SEQ ID NO: 699384 - protein, 24 aa, Mycobacterium
LVVGRERNVLLALMLSSQEQYSAD

SEQ ID NO: 699385 - protein, 18 aa, Mycobacterium
LVVGRGWANGVVELRDRF

SEQ ID NO: 699386 - protein, 18 aa, Mycobacterium
LVVHDWGSALGFYRALRY

SEQ ID NO: 699387 - protein, 17 aa, Mycobacterium
LVVHGGPGLPHSYLRSL

SEQ ID NO: 699388 - protein, 17 aa, Mycobacterium
LVVIAGLQDGLWPNTIP

SEQ ID NO: 699389 - protein, 17 aa, Mycobacterium
LVVIAGLQEGLWPNTIP

SEQ ID NO: 699390 - protein, 18 aa, Mycobacterium
LVVIAGLQEGLWPNTVPR

SEQ ID NO: 699391 - protein, 19 aa, Mycobacterium
LVVIDGKVVAAAIRRPAEI

SEQ ID NO: 699392 - protein, 18 aa, Mycobacterium
LVVIDGKVVAAALRMPAE

SEQ ID NO: 699393 - protein, 17 aa, Mycobacterium
LVVIDWCAREARHRDAQ

SEQ ID NO: 699394 - protein, 19 aa, Mycobacterium
LVVIFSPDHYNGFFYKAMP

SEQ ID NO: 699395 - protein, 18 aa, Mycobacterium
LVVLPALFAAIITSAGGV

SEQ ID NO: 699396 - protein, 21 aa, Mycobacterium
LVVPGGVPAGFSFTPGLHDIP

SEQ ID NO: 699397 - protein, 17 aa, Mycobacterium
LVVPIQLGAQWLQRAIR

SEQ ID NO: 699398 - protein, 17 aa, Mycobacterium
LVVPIWDIGLQNLGVPT

SEQ ID NO: 699399 - protein, 25 aa, Mycobacterium
LVVQEWVRFGWFFLVTRRDPRGLAE

SEQ ID NO: 699400 - protein, 26 aa, Mycobacterium
LVVQRLSLRGGLVLDFDDYNEIVISC

SEQ ID NO: 699401 - protein, 18 aa, Mycobacterium
LVVRAGTVYKARLQPADP

SEQ ID NO: 699402 - protein, 17 aa, Mycobacterium
LVVRCLGPSYPQLAEGP

SEQ ID NO: 699403 - protein, 24 aa, Mycobacterium
LVVRGDSVFCARLRPVEAPLEVPV

SEQ ID NO: 699404 - protein, 19 aa, Mycobacterium
LVVRGGVVHNARLAPAPPL

SEQ ID NO: 699405 - protein, 18 aa, Mycobacterium
LVVRKRGTTAFMQPGGKI

SEQ ID NO: 699406 - protein, 26 aa, Mycobacterium
LVVRNRFGDFVARLDMGWPDHKVGIE

SEQ ID NO: 699407 - protein, 19 aa, Mycobacterium
LVVRRRITFLAKSEYFTGT

SEQ ID NO: 699408 - protein, 20 aa, Mycobacterium
LVVSAGFMRILGPQFLSKFH

SEQ ID NO: 699409 - protein, 17 aa, Mycobacterium
LVVSKVRGTFEKFSGEI

SEQ ID NO: 699410 - protein, 23 aa, Mycobacterium
LVVTCGARGARYVGVDGELDVAA

SEQ ID NO: 699411 - protein, 17 aa, Mycobacterium
LVVVPARGVERWLSQRL

SEQ ID NO: 699412 - protein, 20 aa, Mycobacterium
LVVVPLDPALPVSDQRARAE

SEQ ID NO: 699413 - protein, 17 aa, Mycobacterium
LVVVVDVPGYLPGVDQE

SEQ ID NO: 699414 - protein, 18 aa, Mycobacterium
LVWEGAGGDALRQRTGAD

SEQ ID NO: 699415 - protein, 25 aa, Mycobacterium
LVWGDSRIGNVIYRDFRPVAVLDWE

SEQ ID NO: 699416 - protein, 37 aa, Mycobacterium
LVWGEATLRIAPEVASGLPWYAGQAVLEPTDLTAEEI

SEQ ID NO: 699417 - protein, 23 aa, Mycobacterium
LVWNTLLALGFEWGVALQHLEIG

SEQ ID NO: 699418 - protein, 24 aa, Mycobacterium
LVWNTLLALLFEWGVALQHLEIGK

SEQ ID NO: 699419 - protein, 17 aa, Mycobacterium
LVWPRGVLETMAKVRAK

SEQ ID NO: 699420 - protein, 20 aa, Mycobacterium
LVYARPFAAFRNHYAVTVAG

SEQ ID NO: 699421 - protein, 31 aa, Mycobacterium; identical to SEQ ID NO: 82549

SEQ ID NO: 699422 - protein, 24 aa, Mycobacterium
LVYDIPLGLSLTAALKRTVIDETY

SEQ ID NO: 699423 - protein, 18 aa, Mycobacterium
LVYDPAFLTLAWERVRTN

SEQ ID NO: 699424 - protein, 18 aa, Mycobacterium
LVYELAFGKLGLQRVHGS

SEQ ID NO: 699425 - protein, 31 aa, Mycobacterium
LVYEPPHRVVFSWDIGPTWQLEADPAKASEV

SEQ ID NO: 699426 - protein, 26 aa, Mycobacterium
LVYERGGWYFTSRVLEWDSVPSRHPL

SEQ ID NO: 699427 - protein, 17 aa, Mycobacterium
LVYLPRDRYTTVVRLEM

SEQ ID NO: 699428 - protein, 18 aa, Mycobacterium
LVYNEYVRLLGLIADGLA

SEQ ID NO: 699429 - protein, 17 aa, Mycobacterium
LVYPHKPQMAAWLNQWA

SEQ ID NO: 699430 - protein, 17 aa, Mycobacterium
LVYYYFPTMDDLFVEVL

SEQ ID NO: 699431 - protein, 18 aa, Mycobacterium
LWAANLSGLQGWIRLFVN

SEQ ID NO: 699432 - protein, 24 aa, Mycobacterium
LWAATFLRRRGAAADAVLLNPERT

SEQ ID NO: 699433 - protein, 23 aa, Mycobacterium
LWAATFLRRRGAAADAVLLNPQH

SEQ ID NO: 699434 - protein, 21 aa, Mycobacterium
LWAATFLRRRGASACAVLLNP

SEQ ID NO: 699435 - protein, 21 aa, Mycobacterium
LWAELSRSLPAPWRVEALVQL

SEQ ID NO: 699436 - protein, 17 aa, Mycobacterium
LWAGVAVSDIEFVQFHP

SEQ ID NO: 699437 - protein, 18 aa, Mycobacterium
LWAGVAVSDLEFIQFHPT

SEQ ID NO: 699438 - protein, 19 aa, Mycobacterium
LWAIAPRAVATVVEECHDV

SEQ ID NO: 699439 - protein, 26 aa, Mycobacterium
LWAIMVSLAELWRSVGVVPDAVIGHS

SEQ ID NO: 699440 - protein, 24 aa, Mycobacterium
LWAKELRDGTLLSPELHELRTKCY

SEQ ID NO: 699441 - protein, 18 aa, Mycobacterium
LWAKSSDHQLIYLRNESD

SEQ ID NO: 699442 - protein, 20 aa, Mycobacterium
LWAPAYLPRKTHRSRELTWY

SEQ ID NO: 699443 - protein, 29 aa, Mycobacterium
LWARFPALPWPYRVVDLAAAVLRPVRGVR

SEQ ID NO: 699444 - protein, 21 aa, Mycobacterium
LWARLHGRDVWQEPCADVDDV

SEQ ID NO: 699445 - protein, 18 aa, Mycobacterium
LWARLHGRDVWQEPCDDV

SEQ ID NO: 699446 - protein, 39 aa, Mycobacterium
LWARQWSAAGGDLWRVPSGWRVGEWAPATFRLHAGDRTD

SEQ ID NO: 699447 - protein, 20 aa, Mycobacterium
LWASMIEHRKVLAARLSELD

SEQ ID NO: 699448 - protein, 25 aa, Mycobacterium
LWATWCGPCRMVSPALEQLAAERAG

SEQ ID NO: 699449 - protein, 20 aa, Mycobacterium
LWCGYTWQYWLATRSVKPEE

SEQ ID NO: 699450 - protein, 18 aa, Mycobacterium
LWCTPPVLESSLRMPPGV

SEQ ID NO: 699451 - protein, 18 aa, Mycobacterium
LWDAAEWSVQAQLNYLRR

SEQ ID NO: 699452 - protein, 18 aa, Mycobacterium
LWDAAEWSVQVQLNHLRG

SEQ ID NO: 699453 - protein, 18 aa, Mycobacterium
LWDASVIFASYPHFYELK

SEQ ID NO: 699454 - protein, 17 aa, Mycobacterium
LWDAVWDYFDIRAASPP

SEQ ID NO: 699455 - protein, 24 aa, Mycobacterium
LWDAVWRPANPLAHATAEQRERYL

SEQ ID NO: 699456 - protein, 18 aa, Mycobacterium
LWDGRASIDLAVATGAQW

SEQ ID NO: 699457 - protein, 18 aa, Mycobacterium
LWDISMHALYARMGAVLT

SEQ ID NO: 699458 - protein, 19 aa, Mycobacterium
LWDQLRALGLARLTGAEES

SEQ ID NO: 699459 - protein, 18 aa, Mycobacterium
LWDRELYRFVSDHREGQR

SEQ ID NO: 699460 - protein, 19 aa, Mycobacterium
LWDRIRHADVPVAVSDRLT

SEQ ID NO: 699461 - protein, 19 aa, Mycobacterium
LWDVSAKIGVTVLGTSPGY

SEQ ID NO: 699462 - protein, 21 aa, Mycobacterium
LWEGKGSESANDFLKTHNSTA

SEQ ID NO: 699463 - protein, 17 aa, Mycobacterium
LWEHPKEKLSHYSDRTV

SEQ ID NO: 699464 - protein, 18 aa, Mycobacterium
LWEIWVIEGLSDNRWAML

SEQ ID NO: 699465 - protein, 17 aa, Mycobacterium
LWEQHGFGVLLVTHDVD

SEQ ID NO: 699466 - protein, 21 aa, Mycobacterium
LWEVPCQVALPCATQNELDGK

SEQ ID NO: 699467 - protein, 22 aa, Mycobacterium
LWFEALAGICAHVKAGGGGLTP

SEQ ID NO: 699468 - protein, 21 aa, Mycobacterium
LWFEALAGICAHVQAGGGGLT

SEQ ID NO: 699469 - protein, 20 aa, Mycobacterium
LWFEVLKPMSSECAGREIAH

SEQ ID NO: 699470 - protein, 21 aa, Mycobacterium
LWGACARLRRTNCIQEGGDDA

SEQ ID NO: 699471 - protein, 18 aa, Mycobacterium
LWGAKVFVTASRGKWDTL

SEQ ID NO: 699472 - protein, 18 aa, Mycobacterium
LWGDARVGNVLYRDFRPV

SEQ ID NO: 699473 - protein, 21 aa, Mycobacterium
LWGDGGTFCAGADLKAFGTPV

SEQ ID NO: 699474 - protein, 21 aa, Mycobacterium
LWGGGRLDPRPAPDEVVAVYR

SEQ ID NO: 699475 - protein, 18 aa, Mycobacterium
LWGGPFMLKGVMRVDDAK

SEQ ID NO: 699476 - protein, 19 aa, Mycobacterium
LWGGYATHLHLPFDSMPLP

SEQ ID NO: 699477 - protein, 19 aa, Mycobacterium
LWGNIHAVEAFLPRLREQG

SEQ ID NO: 699478 - protein, 22 aa, Mycobacterium
LWGPARLMRTAPISREMILNYV

SEQ ID NO: 699479 - protein, 23 aa, Mycobacterium
LWGQAPSGWPLRVDRGTARAQYA

SEQ ID NO: 699480 - protein, 19 aa, Mycobacterium
LWGQGWPLGVDRAIAPVQH

SEQ ID NO: 699481 - protein, 22 aa, Mycobacterium
LWGTGGSVWFHKNVMVVEEDID

SEQ ID NO: 699482 - protein, 17 aa, Mycobacterium
LWGVPVVLNQGLGAKTG

SEQ ID NO: 699483 - protein, 17 aa, Mycobacterium
LWHASTLLREHRGDGHV

SEQ ID NO: 699484 - protein, 17 aa, Mycobacterium
LWHNGRLFTARPCIVAI

SEQ ID NO: 699485 - protein, 20 aa, Mycobacterium
LWHPRAHLSAAWKDGDDAGR

SEQ ID NO: 699486 - protein, 21 aa, Mycobacterium
LWHRRDRLRPSVPVDGAVLLL

SEQ ID NO: 699487 - protein, 19 aa, Mycobacterium
LWHVPVSTPSRAGRLRRQH

SEQ ID NO: 699488 - protein, 18 aa, Mycobacterium
LWIHGGPLASWNAWHWRW

SEQ ID NO: 699489 - protein, 22 aa, Mycobacterium
LWIKSPANMLGYWGSPERTGEV

SEQ ID NO: 699490 - protein, 19 aa, Mycobacterium
LWINEPRPLLMNLEQEAEL

SEQ ID NO: 699491 - protein, 17 aa, Mycobacterium
LWISAGMTPRVDPLDQY

SEQ ID NO: 699492 - protein, 20 aa, Mycobacterium
LWKAARRAGHDVGRDQVARL

SEQ ID NO: 699493 - protein, 20 aa, Mycobacterium
LWKAARRAGYDVGRDQVARL

SEQ ID NO: 699494 - protein, 27 aa, Mycobacterium
LWKAGPALACGNAFILKPSERDPSVPV

SEQ ID NO: 699495 - protein, 22 aa, Mycobacterium
LWKDLDESWEALSRNPLVKHLI

SEQ ID NO: 699496 - protein, 26 aa, Mycobacterium
LWKDNYCVYGAHKLWKTARRAGYDVG

SEQ ID NO: 699497 - protein, 20 aa, Mycobacterium
LWKSARRAGHDVGRDQVARH

SEQ ID NO: 699498 - protein, 19 aa, Mycobacterium
LWLAEHGWEVVGVDISDTA

SEQ ID NO: 699499 - protein, 25 aa, Mycobacterium
LWLCESAHLPVIWATQVLESLAKSG

SEQ ID NO: 699500 - protein, 22 aa, Mycobacterium
LWLELARKFLPEALPRRFGNVY

SEQ ID NO: 699501 - protein, 21 aa, Mycobacterium
LWLFTLRAQSWTADYGTTANY

SEQ ID NO: 699502 - protein, 27 aa, Mycobacterium
LWLLNHSKGKAVLHLDGPGYYWYSSPG

SEQ ID NO: 699503 - protein, 18 aa, Mycobacterium
LWLLRGGDPDRPGMLPPA

SEQ ID NO: 699504 - protein, 19 aa, Mycobacterium
LWLLRGGDPRRPGMLPGEI

SEQ ID NO: 699505 - protein, 19 aa, Mycobacterium
LWLNESFATFASVLCQAES

SEQ ID NO: 699506 - protein, 19 aa, Mycobacterium
LWLNESFATFASVLCQSEA

SEQ ID NO: 699507 - protein, 18 aa, Mycobacterium
LWLQPGVDQSEALRTAGL

SEQ ID NO: 699508 - protein, 17 aa, Mycobacterium
LWLRSESNISVIEHGSD

SEQ ID NO: 699509 - protein, 17 aa, Mycobacterium
LWLRSESNISVIEHGSP

SEQ ID NO: 699510 - protein, 19 aa, Mycobacterium
LWLSAPRPLLATAEADDLG

SEQ ID NO: 699511 - protein, 17 aa, Mycobacterium
LWLSIIDKLGLPFTDVF

SEQ ID NO: 699512 - protein, 20 aa, Mycobacterium
LWMFKEWNPHDYVPWSDGRN

SEQ ID NO: 699513 - protein, 17 aa, Mycobacterium
LWNACTAVFTDERQRGY

SEQ ID NO: 699514 - protein, 22 aa, Mycobacterium
LWNADGPIDFTGRYFTLEHARL

SEQ ID NO: 699515 - protein, 18 aa, Mycobacterium
LWNSGFGNTGLFNSGSAG

SEQ ID NO: 699516 - protein, 19 aa, Mycobacterium
LWPDRVGEMSIRLIDGKAV

SEQ ID NO: 699517 - protein, 27 aa, Mycobacterium
LWPHPPEALAPRYVDAMGGIDRVVELA

SEQ ID NO: 699518 - protein, 28 aa, Mycobacterium
LWPHPPEALAPRYVEAMGGIDRVVDLAQ

SEQ ID NO: 699519 - protein, 20 aa, Mycobacterium
LWPIKKKYGNKISWADLITY

SEQ ID NO: 699520 - protein, 18 aa, Mycobacterium
LWPPREPGGYTLIVDGGA

SEQ ID NO: 699521 - protein, 19 aa, Mycobacterium
LWPVGTRWADNDMFGHLNN

SEQ ID NO: 699522 - protein, 23 aa, Mycobacterium
LWPYPDGSGYNFSDAANAGITDV

SEQ ID NO: 699523 - protein, 20 aa, Mycobacterium
LWQNHIEHILADWVGELAVP

SEQ ID NO: 699524 - protein, 24 aa, Mycobacterium
LWQRDLRCSPGYQDQRRALRRHYA

SEQ ID NO: 699525 - protein, 20 aa, Mycobacterium
LWQRRHAILRNFPIIGHLRF

SEQ ID NO: 699526 - protein, 19 aa, Mycobacterium
LWRAAGRRRRWLVAAHIPP

SEQ ID NO: 699527 - protein, 21 aa, Mycobacterium
LWRAIPEVLSRAEVTQLQAIW

SEQ ID NO: 699528 - protein, 17 aa, Mycobacterium
LWRDYFDLFDFLVKAPL

SEQ ID NO: 699529 - protein, 25 aa, Mycobacterium
LWRDYFDMFDMFKATLRGLIAIPLP

SEQ ID NO: 699530 - protein, 18 aa, Mycobacterium
LWRGQRLQTLTSLPELVA

SEQ ID NO: 699531 - protein, 19 aa, Mycobacterium
LWRGQRLRALAALPELIAA

SEQ ID NO: 699532 - protein, 20 aa, Mycobacterium
LWRMTHPGKDFRFVADEDTL

SEQ ID NO: 699533 - protein, 17 aa, Mycobacterium
LWRSYGVTPDAVIGHSM

SEQ ID NO: 699534 - protein, 19 aa, Mycobacterium
LWRVAKLDLERAGAEVILV

SEQ ID NO: 699535 - protein, 20 aa, Mycobacterium
LWSAAAAWRALATQYTDISD

SEQ ID NO: 699536 - protein, 20 aa, Mycobacterium
LWSAPIKEFPTLKIALSEGG

SEQ ID NO: 699537 - protein, 24 aa, Mycobacterium
LWSEQRGAFQRVYQRFTDFLRHGN

SEQ ID NO: 699538 - protein, 17 aa, Mycobacterium
LWSESWYADFVDAAQGL

SEQ ID NO: 699539 - protein, 17 aa, Mycobacterium
LWSESWYADFVDAPQGL

SEQ ID NO: 699540 - protein, 36 aa, Mycobacterium
LWSGARELLRTMSYYEMKNRAGVVGERGLGPLLGSL

SEQ ID NO: 699541 - protein, 31 aa, Mycobacterium
LWSGIMPERAIACSFNLEYLLVGGRDARGDD

SEQ ID NO: 699542 - protein, 23 aa, Mycobacterium
LWSKASGLDLVRLGTTASTDEIT

SEQ ID NO: 699543 - protein, 24 aa, Mycobacterium
LWSKASGLDLVRLGTTASTEEITD

SEQ ID NO: 699544 - protein, 24 aa, Mycobacterium
LWSPGRPGGSWATPDEVLDIVDHL

SEQ ID NO: 699545 - protein, 17 aa, Mycobacterium
LWSSCGRCEYCRTGWET

SEQ ID NO: 699546 - protein, 18 aa, Mycobacterium
LWSSSVIVPTEPEPPYKW

SEQ ID NO: 699547 - protein, 29 aa, Mycobacterium
LWSTLLARRALRLPWNVTPCAVIPLGWPI

SEQ ID NO: 699548 - protein, 18 aa, Mycobacterium
LWTAMPLFHLSAAPIVLA

SEQ ID NO: 699549 - protein, 19 aa, Mycobacterium
LWTFPRAAWERELLPGAQV

SEQ ID NO: 699550 - protein, 18 aa, Mycobacterium
LWTFPRVAWERELLPGAQ

SEQ ID NO: 699551 - protein, 17 aa, Mycobacterium
LWTGVGLVRGGAGTALV

SEQ ID NO: 699552 - protein, 23 aa, Mycobacterium
LWTKDVRAAMDFYTTVVGLMPVR

SEQ ID NO: 699553 - protein, 18 aa, Mycobacterium
LWTLPMFHCNGWCFTWAV

SEQ ID NO: 699554 - protein, 26 aa, Mycobacterium
LWTLRGAEESLCFAGANLIPLRGAPE

SEQ ID NO: 699555 - protein, 20 aa, Mycobacterium
LWTLRGAEQSLCFAGANLIP

SEQ ID NO: 699556 - protein, 18 aa, Mycobacterium
LWTPASFRRRGIYLDRYD

SEQ ID NO: 699557 - protein, 24 aa, Mycobacterium
LWTPKWLIEKFVDFQIPEDMLGEY

SEQ ID NO: 699558 - protein, 19 aa, Mycobacterium
LWTSWAHHATRCIVLARTG

SEQ ID NO: 699559 - protein, 18 aa, Mycobacterium
LWVALGFAAADSDDEVAF

SEQ ID NO: 699560 - protein, 19 aa, Mycobacterium
LWVDGLLAGRYSRLETAAP

SEQ ID NO: 699561 - protein, 24 aa, Mycobacterium
LWVKERGEKICIIFEGRDAAGKGG

SEQ ID NO: 699562 - protein, 17 aa, Mycobacterium
LWVQARIDRRGRQIELL

SEQ ID NO: 699563 - protein, 17 aa, Mycobacterium
LWVSAGMTPRVDPLDQY

SEQ ID NO: 699564 - protein, 25 aa, Mycobacterium
LWVSEPFSGPGTGFWAKLEAHNPNG

SEQ ID NO: 699565 - protein, 18 aa, Mycobacterium
LWWPDFPGNNMFNSYGNL

SEQ ID NO: 699566 - protein, 25 aa, Mycobacterium
LWYEIGRLPLRWEHPESTDITANYT

SEQ ID NO: 699567 - protein, 24 aa, Mycobacterium
LWYIREVDPAVLLLTGLTRDGVYL

SEQ ID NO: 699568 - protein, 21 aa, Mycobacterium
LWYIREVDPTTLLLTGLTRDG

SEQ ID NO: 699569 - protein, 23 aa, Mycobacterium
LWYNTEGLPYFSVGMGNFGVQIA

SEQ ID NO: 699570 - protein, 18 aa, Mycobacterium
LWYQVVLGFLNLHVLGQD

SEQ ID NO: 699571 - protein, 17 aa, Mycobacterium
LYAAALLVDQRTTTRNL

SEQ ID NO: 699572 - protein, 19 aa, Mycobacterium
LYAAARVSVRLGQYNLSRA

SEQ ID NO: 699573 - protein, 18 aa, Mycobacterium
LYAAGATAIYPPGTVIAD

SEQ ID NO: 699574 - protein, 20 aa, Mycobacterium
LYAALSIMALLIGRLRRPEN

SEQ ID NO: 699575 - protein, 23 aa, Mycobacterium
LYAARSRVRYAVEDARDAGFAVG

SEQ ID NO: 699576 - protein, 20 aa, Mycobacterium
LYAASEWLHRETTRIGQTLA

SEQ ID NO: 699577 - protein, 18 aa, Mycobacterium
LYADWPRKARAVVGNLRY

SEQ ID NO: 699578 - protein, 23 aa, Mycobacterium
LYAEPKPKGFGFSDTAFRIFVLM

SEQ ID NO: 699579 - protein, 27 aa, Mycobacterium
LYAGLRSGLGMALLPIIGWLPDGIAPV

SEQ ID NO: 699580 - protein, 23 aa, Mycobacterium
LYAHPRAGALVAMESRARLFPRG

SEQ ID NO: 699581 - protein, 22 aa, Mycobacterium
LYAHPRSGALVAMESRSRLFPR

SEQ ID NO: 699582 - protein, 23 aa, Mycobacterium
LYAHPRTGALVAMESRSRIFPRG

SEQ ID NO: 699583 - protein, 26 aa, Mycobacterium
LYAHQGRLKYCYNFLGIDHYMVAATK

SEQ ID NO: 699584 - protein, 25 aa, Mycobacterium
LYAPQRWKYLTSGLLGLQRGTDAGD

SEQ ID NO: 699585 - protein, 27 aa, Mycobacterium
LYAPSPPARCTLHWGADRPARLRVPVI

SEQ ID NO: 699586 - protein, 19 aa, Mycobacterium
LYAQFPRFLTEVARVLRPN

SEQ ID NO: 699587 - protein, 19 aa, Mycobacterium
LYATIGFDLRGRRFAPFYV

SEQ ID NO: 699588 - protein, 19 aa, Mycobacterium
LYATSEWLHRETTRIGQTL

SEQ ID NO: 699589 - protein, 18 aa, Mycobacterium
LYAVAGFPGADWARNARA

SEQ ID NO: 699590 - protein, 17 aa, Mycobacterium
LYCAGKFALNGMSEALA

SEQ ID NO: 699591 - protein, 23 aa, Mycobacterium
LYDADFLRMCRAIGGVVVSQAGC

SEQ ID NO: 699592 - protein, 18 aa, Mycobacterium
LYDAFTINPILLLEETGL

SEQ ID NO: 699593 - protein, 23 aa, Mycobacterium
LYDDLKPLLQFIVAGGLPTTVKA

SEQ ID NO: 699594 - protein, 23 aa, Mycobacterium
LYDDLKPLLTFIVAGGLATTVKA

SEQ ID NO: 699595 - protein, 23 aa, Mycobacterium
LYDELRGLSPVAGYRDWPPGTVP

SEQ ID NO: 699596 - protein, 18 aa, Mycobacterium
LYDGFARVRYRIFGTHDT

SEQ ID NO: 699597 - protein, 18 aa, Mycobacterium
LYDGFTYLTIAWLEALGI

SEQ ID NO: 699598 - protein, 18 aa, Mycobacterium
LYDMAAWQLDVFLDDAAG

SEQ ID NO: 699599 - protein, 22 aa, Mycobacterium
LYDNAQAFARQWISAWQLPLEW

SEQ ID NO: 699600 - protein, 17 aa, Mycobacterium
LYDPMPFGLSVDEFMQY

SEQ ID NO: 699601 - protein, 18 aa, Mycobacterium
LYDRLPVFAEAFDEVADE

SEQ ID NO: 699602 - protein, 24 aa, Mycobacterium
LYDRPANSFVMSFLGPVAKLNGIL

SEQ ID NO: 699603 - protein, 18 aa, Mycobacterium
LYDVLSWVHREYGPVPIY

SEQ ID NO: 699604 - protein, 25 aa, Mycobacterium
LYDVVSAWQRTLLVVSHDRELLEHV

SEQ ID NO: 699605 - protein, 31 aa, Mycobacterium; identical to SEQ ID NO: 203240

SEQ ID NO: 699606 - protein, 28 aa, Mycobacterium
LYEELFSRFGAVRVVRPVEWARSNRHTG

SEQ ID NO: 699607 - protein, 18 aa, Mycobacterium
LYEERYVLLVPPDMVPAG

SEQ ID NO: 699608 - protein, 25 aa, Mycobacterium
LYEFIRARHGVALFSSDGSTVDEVV

SEQ ID NO: 699609 - protein, 23 aa, Mycobacterium
LYEHARPGMVVGLAGAGGDFTLP

SEQ ID NO: 699610 - protein, 22 aa, Mycobacterium
LYEHELRWWTAPDRHDDGIPEA

SEQ ID NO: 699611 - protein, 24 aa, Mycobacterium
LYEHPANVFVAGFIGSPTMNFFPA

SEQ ID NO: 699612 - protein, 24 aa, Mycobacterium
LYEKLGFRRVPVMAIKRRNAINEP

SEQ ID NO: 699613 - protein, 25 aa, Mycobacterium
LYELLADEIVMQWITPRWDLPATYE

SEQ ID NO: 699614 - protein, 24 aa, Mycobacterium
LYELLKLRVEVFVVEQACPYPELD

SEQ ID NO: 699615 - protein, 24 aa, Mycobacterium
LYELLKLRVEVFVVEQATPYPELD

SEQ ID NO: 699616 - protein, 18 aa, Mycobacterium
LYELLRYADYQQFDSSIY

SEQ ID NO: 699617 - protein, 18 aa, Mycobacterium
LYELLRYADYTQFDSDLY

SEQ ID NO: 699618 - protein, 20 aa, Mycobacterium
LYEPATARRLIGWLHRIIDA

SEQ ID NO: 699619 - protein, 17 aa, Mycobacterium
LYEQAAISAADIDVAVL

SEQ ID NO: 699620 - protein, 20 aa, Mycobacterium
LYEREVRFYTDIAPSLGGPV

SEQ ID NO: 699621 - protein, 26 aa, Mycobacterium
LYERIAPRPVSPWAQALRLALIDVAP

SEQ ID NO: 699622 - protein, 19 aa, Mycobacterium
LYERVLRHKAEVVRPLAET

SEQ ID NO: 699623 - protein, 19 aa, Mycobacterium
LYESGRLLLDEMITKRYRL

SEQ ID NO: 699624 - protein, 19 aa, Mycobacterium
LYESGRLLLDEMVTKRYAL

SEQ ID NO: 699625 - protein, 31 aa, Mycobacterium
LYETIRGSLLPGLRIGLLHGRLPSEQKDAVM

SEQ ID NO: 699626 - protein, 25 aa, Mycobacterium
LYEVGDRASHHFAWIQRGDESRSIK

SEQ ID NO: 699627 - protein, 18 aa, Mycobacterium
LYEYFLGNFARAEGRRGG

SEQ ID NO: 699628 - protein, 17 aa, Mycobacterium
LYFELDGTFPNHEANPL

SEQ ID NO: 699629 - protein, 17 aa, Mycobacterium
LYFGGNMETFVPLGGQV

SEQ ID NO: 699630 - protein, 17 aa, Mycobacterium
LYFGRLEYEKGVHDAIA

SEQ ID NO: 699631 - protein, 17 aa, Mycobacterium
LYFPSENHWILSPQHAK

SEQ ID NO: 699632 - protein, 17 aa, Mycobacterium
LYFPVMGANEIWRIDPD

SEQ ID NO: 699633 - protein, 25 aa, Mycobacterium
LYFRTKRWPDVLAQFPEATPWRHPE

SEQ ID NO: 699634 - protein, 17 aa, Mycobacterium
LYFSVSVTTRAPRPGEV

SEQ ID NO: 699635 - protein, 31 aa, Mycobacterium
LYGERNWGAGFPERWWWGQAHDFDGADVSVA

SEQ ID NO: 699636 - protein, 22 aa, Mycobacterium
LYGFGDRETRDLFLTLLSVSGV

SEQ ID NO: 699637 - protein, 18 aa, Mycobacterium
LYGGCVVMVPYLETRTPR

SEQ ID NO: 699638 - protein, 18 aa, Mycobacterium
LYGHEKVKLLDGGRKKWE

SEQ ID NO: 699639 - protein, 17 aa, Mycobacterium
LYGHQDVKLLDGGRKKW

SEQ ID NO: 699640 - protein, 25 aa, Mycobacterium
LYGHSMGGLLAYLMARRLVRNSAHP

SEQ ID NO: 699641 - protein, 21 aa, Mycobacterium
LYGIPMPPGLVSHAPQGVHHG

SEQ ID NO: 699642 - protein, 17 aa, Mycobacterium
LYGLALPTAVAVAGDVS

SEQ ID NO: 699643 - protein, 18 aa, Mycobacterium
LYGLEVFGAQVTVVSDIR

SEQ ID NO: 699644 - protein, 19 aa, Mycobacterium
LYGLRKSRARQRAQELLDQ

SEQ ID NO: 699645 - protein, 17 aa, Mycobacterium
LYGPLPIAAVTSVANFR

SEQ ID NO: 699646 - protein, 17 aa, Mycobacterium
LYGPLPVAAVTSVTTYC

SEQ ID NO: 699647 - protein, 18 aa, Mycobacterium
LYGRCAHRGVLLADGHID

SEQ ID NO: 699648 - protein, 26 aa, Mycobacterium
LYGRPKRRVSTGGGIPGETPVEAEIA

SEQ ID NO: 699649 - protein, 17 aa, Mycobacterium
LYGSFLPGTEQNLQRAL

SEQ ID NO: 699650 - protein, 18 aa, Mycobacterium
LYGSIFPAVWNFQLALHT

SEQ ID NO: 699651 - protein, 17 aa, Mycobacterium
LYGTEVWNRMSRAEQIE

SEQ ID NO: 699652 - protein, 27 aa, Mycobacterium
LYHALRASNRIAIERGTAFGGFEKSKY

SEQ ID NO: 699653 - protein, 17 aa, Mycobacterium
LYHCALPPMGSWLPTYV

SEQ ID NO: 699654 - protein, 25 aa, Mycobacterium
LYHPDHPEWGFAGYVHHFIDKPTIA

SEQ ID NO: 699655 - protein, 17 aa, Mycobacterium
LYHPQPLRGKKLDRYYG

SEQ ID NO: 699656 - protein, 28 aa, Mycobacterium
LYHYEVGPRTFGPYEIPLFSFPGPGFAN

SEQ ID NO: 699657 - protein, 19 aa, Mycobacterium
LYIEIQLMYASLVHGSALQ

SEQ ID NO: 699658 - protein, 25 aa, Mycobacterium
LYIHWPVALSTDFVRIDDMNDRIDE

SEQ ID NO: 699659 - protein, 18 aa, Mycobacterium
LYILGAGMHPWGKWGNDF

SEQ ID NO: 699660 - protein, 25 aa, Mycobacterium
LYIQLYLGGFGLELSDIEALRTFKS

SEQ ID NO: 699661 - protein, 18 aa, Mycobacterium
LYISYLRKKIDNGRAPMI

SEQ ID NO: 699662 - protein, 18 aa, Mycobacterium
LYISYLRKKIDNGREPMI

SEQ ID NO: 699663 - protein, 19 aa, Mycobacterium
LYISYLRKKIDTGREPMIH

SEQ ID NO: 699664 - protein, 25 aa, Mycobacterium
LYKEYSLRPPKGVLLYGPPGCGKTL

SEQ ID NO: 699665 - protein, 18 aa, Mycobacterium
LYKFTAYKDEYEVARLLT

SEQ ID NO: 699666 - protein, 23 aa, Mycobacterium
LYKSAYALDTAWRTHMPPNATLI

SEQ ID NO: 699667 - protein, 29 aa, Mycobacterium
LYLAGETRFGLPWVVGQVISEHTPDSYDE

SEQ ID NO: 699668 - protein, 18 aa, Mycobacterium
LYLCNDCTTQLENMLDQI

SEQ ID NO: 699669 - protein, 17 aa, Mycobacterium
LYLDGIVGRYSARQIED

SEQ ID NO: 699670 - protein, 22 aa, Mycobacterium
LYLEGCEWYRRYGMTDSVLPPT

SEQ ID NO: 699671 - protein, 23 aa, Mycobacterium
LYLGLWKRRDLLETAKVEGDTAA

SEQ ID NO: 699672 - protein, 24 aa, Mycobacterium
LYLGQRVAVLTSRPGRIKKIVDVD

SEQ ID NO: 699673 - protein, 24 aa, Mycobacterium
LYLMPWSTMFPLGISAATIGIAEG

SEQ ID NO: 699674 - protein, 25 aa, Mycobacterium
LYLMPWSTMFPLGISAATIGIAEGA

SEQ ID NO: 699675 - protein, 24 aa, Mycobacterium
LYLMPWSTMFPLGISSATIGIAEG

SEQ ID NO: 699676 - protein, 20 aa, Mycobacterium
LYLPAELRGSLAAPATYLDE

SEQ ID NO: 699677 - protein, 25 aa, Mycobacterium
LYLPIRPGTDLALLNGILRVLVQDG

SEQ ID NO: 699678 - protein, 24 aa, Mycobacterium
LYLPVFAEGALFYVGDPHMAMGDG

SEQ ID NO: 699679 - protein, 26 aa, Mycobacterium
LYLQLYLGGFGLELSDIEALRTWGSL

SEQ ID NO: 699680 - protein, 26 aa, Mycobacterium
LYLQLYLGGFGLELSDIESLRTWGSK

SEQ ID NO: 699681 - protein, 17 aa, Mycobacterium
LYLRACESRSPAPILGD

SEQ ID NO: 699682 - protein, 18 aa, Mycobacterium
LYLRDLVLALQWVRENIA

SEQ ID NO: 699683 - protein, 25 aa, Mycobacterium
LYLRDLVSALRWVRENIAAFGGDPD

SEQ ID NO: 699684 - protein, 26 aa, Mycobacterium
LYLRMDEFPARLVIVPGEHDRLQVSG

SEQ ID NO: 699685 - protein, 22 aa, Mycobacterium
LYLRRVTLYRAMFGTPEEHNRR

SEQ ID NO: 699686 - protein, 19 aa, Mycobacterium
LYLSGLGAYGRWLRRPGRF

SEQ ID NO: 699687 - protein, 17 aa, Mycobacterium
LYLTDVIAILRGDGLAI

SEQ ID NO: 699688 - protein, 20 aa, Mycobacterium
LYLTDVISILRGDGRAIHAR

SEQ ID NO: 699689 - protein, 22 aa, Mycobacterium
LYMAGAKLDSLVPLGPPVMDVA

SEQ ID NO: 699690 - protein, 21 aa, Mycobacterium
LYMAGARLDSLVPLGPPVMDV

SEQ ID NO: 699691 - protein, 21 aa, Mycobacterium
LYMAGSRLGFETNVVQLHQVL

SEQ ID NO: 699692 - protein, 19 aa, Mycobacterium
LYNAPSMRELDTWAIDRVH

SEQ ID NO: 699693 - protein, 20 aa, Mycobacterium
LYNGLCRYDDAFAAARRACE

SEQ ID NO: 699694 - protein, 20 aa, Mycobacterium
LYNTQPWRWVADGARLDLFL

SEQ ID NO: 699695 - protein, 20 aa, Mycobacterium
LYPAELARRAKTLGEAAGLE

SEQ ID NO: 699696 - protein, 17 aa, Mycobacterium
LYPAWRGRGLATRAVDL

SEQ ID NO: 699697 - protein, 17 aa, Mycobacterium
LYPDFTALDFIGPYEVL

SEQ ID NO: 699698 - protein, 20 aa, Mycobacterium
LYPDSLRTMGYDVGSAGFEL

SEQ ID NO: 699699 - protein, 18 aa, Mycobacterium
LYPGDPGLIGGDFSGIVT

SEQ ID NO: 699700 - protein, 34 aa, Mycobacterium
LYPGLTRAEAWPVLCKHLAIIGADGRDPFATLTE

SEQ ID NO: 699701 - protein, 34 aa, Mycobacterium
LYPGLTRAEAWPVLCQHLALVAADGRDPVATLSE

SEQ ID NO: 699702 - protein, 17 aa, Mycobacterium
LYPHRHAIAGLQAAAAI

SEQ ID NO: 699703 - protein, 25 aa, Mycobacterium
LYPIPRYRLEETLSRYPDDAQYIWV

SEQ ID NO: 699704 - protein, 22 aa, Mycobacterium
LYPLVRRSIRVGAESFSLKALE

SEQ ID NO: 699705 - protein, 22 aa, Mycobacterium
LYPMGCAIGALRQVPSLAAPGL

SEQ ID NO: 699706 - protein, 17 aa, Mycobacterium
LYPNLSFVHNWPKVADS

SEQ ID NO: 699707 - protein, 23 aa, Mycobacterium
LYPPEGFGAPKNRRGHAAGTDPG

SEQ ID NO: 699708 - protein, 19 aa, Mycobacterium
LYPPEGFGAPKNRRGHASG

SEQ ID NO: 699709 - protein, 25 aa, Mycobacterium
LYPRKGVSELTRFTPDAVVEKYGLT

SEQ ID NO: 699710 - protein, 25 aa, Mycobacterium
LYPRKGVSELTRFTPEAVQEKYGLT

SEQ ID NO: 699711 - protein, 18 aa, Mycobacterium
LYPRLLPIAREWWTRLGR

SEQ ID NO: 699712 - protein, 18 aa, Mycobacterium
LYPRLSPGGFCIVDDYHA

SEQ ID NO: 699713 - protein, 19 aa, Mycobacterium
LYPRLSPGGFCIVDDYHAI

SEQ ID NO: 699714 - protein, 26 aa, Mycobacterium
LYPVRRMVFVGGLLPVPGHSFVEHLA

SEQ ID NO: 699715 - protein, 21 aa, Mycobacterium
LYPVVRKSFRVGAESVSLKAL

SEQ ID NO: 699716 - protein, 30 aa, Mycobacterium
LYQASWRLTPFFWQEIDEGILPALYAAATP

SEQ ID NO: 699717 - protein, 22 aa, Mycobacterium
LYQCTSRMLALIFSNREQGAVY

SEQ ID NO: 699718 - protein, 22 aa, Mycobacterium
LYQGWDMHPGHLVTRWLATFAF

SEQ ID NO: 699719 - protein, 26 aa, Mycobacterium
LYQIARGAPLPAFRDVTLGGNAVATA

SEQ ID NO: 699720 - protein, 18 aa, Mycobacterium
LYQLYLRVMRRVGHYRWF

SEQ ID NO: 699721 - protein, 18 aa, Mycobacterium
LYQPGTWGPNAIHQLIAP

SEQ ID NO: 699722 - protein, 19 aa, Mycobacterium
LYQPLRIAVVQSHPLAAQD

SEQ ID NO: 699723 - protein, 17 aa, Mycobacterium
LYQRGLQAGQQFLQTWN

SEQ ID NO: 699724 - protein, 17 aa, Mycobacterium
LYQRVLRANILVLCGPI

SEQ ID NO: 699725 - protein, 18 aa, Mycobacterium
LYQYTVRLLTGIAANPER

SEQ ID NO: 699726 - protein, 17 aa, Mycobacterium
LYQYTVRLLTGIADNPE

SEQ ID NO: 699727 - protein, 18 aa, Mycobacterium
LYQYTVRLLTGIARNPER

SEQ ID NO: 699728 - protein, 18 aa, Mycobacterium
LYQYTVRLLTGIASDPER

SEQ ID NO: 699729 - protein, 23 aa, Mycobacterium
LYRAALKLRPSLWRDAGEVTWLD

SEQ ID NO: 699730 - protein, 17 aa, Mycobacterium
LYRAANDPLIWAQHPSS

SEQ ID NO: 699731 - protein, 17 aa, Mycobacterium
LYRALRLLADCGRGEVI

SEQ ID NO: 699732 - protein, 18 aa, Mycobacterium
LYRALRLLADCGRGEVIG

SEQ ID NO: 699733 - protein, 26 aa, Mycobacterium
LYRARDILRAGGRISLGTDWPAAGYF

SEQ ID NO: 699734 - protein, 23 aa, Mycobacterium
LYRDFRPVAVLDWEMVTLGPREL

SEQ ID NO: 699735 - protein, 24 aa, Mycobacterium
LYRDFRPVAVLDWEMVTLGPRELD

SEQ ID NO: 699736 - protein, 18 aa, Mycobacterium
LYRDWELIDVLAATVANA

SEQ ID NO: 699737 - protein, 19 aa, Mycobacterium
LYREGWGVVAAMRTPERGM

SEQ ID NO: 699738 - protein, 20 aa, Mycobacterium
LYREGWRVVAAMRTPDRAMP

SEQ ID NO: 699739 - protein, 23 aa, Mycobacterium
LYRELPDEVPVPFEIPVLYRDDD

SEQ ID NO: 699740 - protein, 19 aa, Mycobacterium
LYRELPEEVPVPFDIPVLH

SEQ ID NO: 699741 - protein, 18 aa, Mycobacterium
LYRFELMGTTDDVFAVRA

SEQ ID NO: 699742 - protein, 26 aa, Mycobacterium
LYRFPRLKVAVIEAGSKWLFPLLEQL

SEQ ID NO: 699743 - protein, 18 aa, Mycobacterium
LYRGAPFGVGCFVGVWQP

SEQ ID NO: 699744 - protein, 20 aa, Mycobacterium
LYRGDTFSCTSIDGGGHPIH

SEQ ID NO: 699745 - protein, 18 aa, Mycobacterium
LYRLSETFAGQREVLSAA

SEQ ID NO: 699746 - protein, 18 aa, Mycobacterium
LYRLTPRTGRTHQLRVHM

SEQ ID NO: 699747 - protein, 20 aa, Mycobacterium
LYRLVARTRYRVFGRYDTCP

SEQ ID NO: 699748 - protein, 21 aa, Mycobacterium
LYRLYELRLRQGLAATSSELP

SEQ ID NO: 699749 - protein, 21 aa, Mycobacterium
LYRMWYCARGAQYSIYHAVSE

SEQ ID NO: 699750 - protein, 38 aa, Mycobacterium
LYRMYRAADGYVFLAAPLPREWPALTKAMSPYVDLHAD

SEQ ID NO: 699751 - protein, 22 aa, Mycobacterium
LYRNDERNFWALSRHEDVLKGF

SEQ ID NO: 699752 - protein, 17 aa, Mycobacterium
LYRPGGDALTALAVAVE

SEQ ID NO: 699753 - protein, 26 aa, Mycobacterium
LYRQELRRVFAPSWLFLAHADQFHRP

SEQ ID NO: 699754 - protein, 18 aa, Mycobacterium
LYRRGAYLPAEYRADLAC

SEQ ID NO: 699755 - protein, 22 aa, Mycobacterium
LYRRMSGRGIAMIDTIQGPPRT

SEQ ID NO: 699756 - protein, 23 aa, Mycobacterium
LYRRPANTFVAGFIGSPSMNLVP

SEQ ID NO: 699757 - protein, 31 aa, Mycobacterium
LYRRRIAPGGFRYGAMFGVEIQFWVFEETLI

SEQ ID NO: 699758 - protein, 19 aa, Mycobacterium
LYRSPAIRFGGARVLELAG

SEQ ID NO: 699759 - protein, 26 aa, Mycobacterium
LYRTATDEFLRYFSVNQQLSRTVTRD

SEQ ID NO: 699760 - protein, 21 aa, Mycobacterium
LYRTEMDGFIAANFDSPLSLL

SEQ ID NO: 699761 - protein, 20 aa, Mycobacterium
LYRVAYECVEDLAADAVVYA

SEQ ID NO: 699762 - protein, 25 aa, Mycobacterium
LYRVPRLKVAVIEAGSKWLFPLLDQ

SEQ ID NO: 699763 - protein, 17 aa, Mycobacterium
LYRVVIKDHMEPFAAGL

SEQ ID NO: 699764 - protein, 17 aa, Mycobacterium
LYRYRRLLEAQRAAKLA

SEQ ID NO: 699765 - protein, 18 aa, Mycobacterium
LYSFSFAPNASWTRTYAR

SEQ ID NO: 699766 - protein, 25 aa, Mycobacterium
LYSFSFDLNAHWSRLWSGQPEILDY

SEQ ID NO: 699767 - protein, 17 aa, Mycobacterium
LYSHIAWLRTIKDKISF

SEQ ID NO: 699768 - protein, 25 aa, Mycobacterium
LYSLAYQAFQTWPMLGAVIAGATGG

SEQ ID NO: 699769 - protein, 17 aa, Mycobacterium
LYSLSGHVARPGQYEAP

SEQ ID NO: 699770 - protein, 18 aa, Mycobacterium
LYSRIGACTQEFGTLATW

SEQ ID NO: 699771 - protein, 18 aa, Mycobacterium
LYSRTATFAHEFGAALSV

SEQ ID NO: 699772 - protein, 25 aa, Mycobacterium
LYSYSFDLNAHWSRLWSGQKEILEY

SEQ ID NO: 699773 - protein, 23 aa, Mycobacterium
LYTALKPLLQFIVAGGLPTTVKA

SEQ ID NO: 699774 - protein, 26 aa, Mycobacterium
LYTKCAELGLPLCINTGLPGPPIPGE

SEQ ID NO: 699775 - protein, 25 aa, Mycobacterium
LYTPTHWKYLTSGLLGLARGTDAGD

SEQ ID NO: 699776 - protein, 25 aa, Mycobacterium
LYTQRPSWPGGIAVGKTAVSSSMID

SEQ ID NO: 699777 - protein, 22 aa, Mycobacterium
LYTRALVGLCAMQVGVTERALK

SEQ ID NO: 699778 - protein, 23 aa, Mycobacterium
LYTSGPALLPWEAARPSGMQGAL

SEQ ID NO: 699779 - protein, 17 aa, Mycobacterium
LYTSLLRRAITTAHLAL

SEQ ID NO: 699780 - protein, 17 aa, Mycobacterium
LYVAASHRPELQSLARL

SEQ ID NO: 699781 - protein, 23 aa, Mycobacterium
LYVCGRVKDLLIVAGRNIHPQDV

SEQ ID NO: 699782 - protein, 17 aa, Mycobacterium
LYVDMPVPALAARGPDD

SEQ ID NO: 699783 - protein, 20 aa, Mycobacterium
LYVHVPFCVTRCGYCDFNTY

SEQ ID NO: 699784 - protein, 17 aa, Mycobacterium
LYVLPQFDARFMWQAKR

SEQ ID NO: 699785 - protein, 24 aa, Mycobacterium
LYVPWSERTGKHWLGSFTTTFRYN

SEQ ID NO: 699786 - protein, 26 aa, Mycobacterium
LYVPWSERTGKRWLGSFITTFRFNEV

SEQ ID NO: 699787 - protein, 24 aa, Mycobacterium
LYVPWSERTGKRWLGSFTTTFRFN

SEQ ID NO: 699788 - protein, 24 aa, Mycobacterium
LYVPWSERTGKRWLGSFTTTFRYN

SEQ ID NO: 699789 - protein, 32 aa, Mycobacterium
LYVTAEPGGPCLRLLGFERIELEPGASRRLRI

SEQ ID NO: 699790 - protein, 18 aa, Mycobacterium
LYVTGRIADLITIDGHNH

SEQ ID NO: 699791 - protein, 18 aa, Mycobacterium
LYVTGRIADLIVIDGHNH

SEQ ID NO: 699792 - protein, 19 aa, Mycobacterium
LYVTGRIADMVTVGGRNHY

SEQ ID NO: 699793 - protein, 24 aa, Mycobacterium
LYVVGRIKDVLIIRGRNHYPEDIE

SEQ ID NO: 699794 - protein, 18 aa, Mycobacterium
LYVYARETVGYALVIGGG

SEQ ID NO: 699795 - protein, 17 aa, Mycobacterium
LYWIGRYVERADDTARI

SEQ ID NO: 699796 - protein, 24 aa, Mycobacterium
LYWLGEGVVPLLRERGLFEAGPKQ

SEQ ID NO: 699797 - protein, 19 aa, Mycobacterium
LYWMYSVASCVKWTEPVFP

SEQ ID NO: 699798 - protein, 20 aa, Mycobacterium
LYYIHGFLRARMQLLHDEAV

SEQ ID NO: 699799 - protein, 27 aa, Mycobacterium
LYYIHGFLRERMRILQDEFIKRGQEGP

SEQ ID NO: 699800 - protein, 27 aa, Mycobacterium
LYYIHGFLRERMRILQEEFIKRGQEGP

SEQ ID NO: 699801 - protein, 18 aa, Mycobacterium
LYYNEKFDFWALSRFAEV

SEQ ID NO: 699802 - protein, 18 aa, Mycobacterium
LYYNERHGFWGLSRYADV

SEQ ID NO: 699803 - protein, 25 aa, Mycobacterium
LYYPNFITTLPYLGQVLLQGGVPGP

SEQ ID NO: 699804 - protein, 25 aa, Mycobacterium
LYYRRAKAWAAAFADPRRELLTVAD

SEQ ID NO: 699805 - protein, 17 aa, Mycobacterium
MAAAAADLAGVNSAIAA

SEQ ID NO: 699806 - protein, 17 aa, Mycobacterium
MAAAAAFSSLADELSTT

SEQ ID NO: 699807 - protein, 23 aa, Mycobacterium
MAAAAAPYARWLSAAAGHASGAA

SEQ ID NO: 699808 - protein, 17 aa, Mycobacterium
MAAAAAPYMGWLTAAAV

SEQ ID NO: 699809 - protein, 20 aa, Mycobacterium
MAAAAAPYVAWMRSTAAQAE

SEQ ID NO: 699810 - protein, 20 aa, Mycobacterium
MAAAAAPYVAWMTATAAQAE

SEQ ID NO: 699811 - protein, 20 aa, Mycobacterium
MAAAAAPYVGWMHSTAAQAE

SEQ ID NO: 699812 - protein, 21 aa, Mycobacterium
MAAAAAPYVTWMRATAAQAEQ

SEQ ID NO: 699813 - protein, 21 aa, Mycobacterium
MAAAAQPLVAWLTDTAESSAL

SEQ ID NO: 699814 - protein, 21 aa, Mycobacterium
MAAAASPFVTWLAATAAQAEQ

SEQ ID NO: 699815 - protein, 25 aa, Mycobacterium
MAAAGRPAGMPMMPMPMGAGAGAGG

SEQ ID NO: 699816 - protein, 22 aa, Mycobacterium
MAAAGWVIHVDRFPNPNNREHL

SEQ ID NO: 699817 - protein, 30 aa, Mycobacterium
MAAALPRPARRLPLLGAWIAELLDRNSRDQ

SEQ ID NO: 699818 - protein, 24 aa, Mycobacterium
MAAALRAGGPVPLDHVDPFVDGCA

SEQ ID NO: 699819 - protein, 27 aa, Mycobacterium
MAAAQREVWTGAQLRRLLAERAGLELS

SEQ ID NO: 699820 - protein, 19 aa, Mycobacterium
MAAARLGLGPLRRVRPDVV

SEQ ID NO: 699821 - protein, 17 aa, Mycobacterium
MAAARPDHVWALDYQHD

SEQ ID NO: 699822 - protein, 19 aa, Mycobacterium
MAAARPDLAYEIVALDTVM

SEQ ID NO: 699823 - protein, 20 aa, Mycobacterium
MAAARTKIRPDWDAEVLDAM

SEQ ID NO: 699824 - protein, 21 aa, Mycobacterium
MAAAVEPYVAWASTTAAQAGQ

SEQ ID NO: 699825 - protein, 20 aa, Mycobacterium
MAAAVMPYIAWMTATAEQCQ

SEQ ID NO: 699826 - protein, 21 aa, Mycobacterium
MAAAVPLPLAHTVELNAGTID

SEQ ID NO: 699827 - protein, 18 aa, Mycobacterium
MAACGKLGARMVLMNTGF

SEQ ID NO: 699828 - protein, 18 aa, Mycobacterium
MAACGLQDFVHFEVADVM

SEQ ID NO: 699829 - protein, 17 aa, Mycobacterium
MAADAGLTSSSWARGPH

SEQ ID NO: 699830 - protein, 20 aa, Mycobacterium
MAADATAFFDYLAARPEVSG

SEQ ID NO: 699831 - protein, 21 aa, Mycobacterium
MAADFYLQIADVMPDEAAEVV

SEQ ID NO: 699832 - protein, 33 aa, Mycobacterium
MAADLGKARLVGAMSVPPTWEGSIPKGLSTSAM

SEQ ID NO: 699833 - protein, 20 aa, Mycobacterium
MAADMAVDFKDTGITTVSIW

SEQ ID NO: 699834 - protein, 21 aa, Mycobacterium
MAADMAVDFRDAGVASLSIWM

SEQ ID NO: 699835 - protein, 20 aa, Mycobacterium
MAADMAVDFRGTGVATVSVW

SEQ ID NO: 699836 - protein, 20 aa, Mycobacterium
MAADMAYDFRDVGIAAVSIW

SEQ ID NO: 699837 - protein, 18 aa, Mycobacterium
MAADSGVRLEVLKVDGGI

SEQ ID NO: 699838 - protein, 19 aa, Mycobacterium
MAAEFSAPIELESLPYQVA

SEQ ID NO: 699839 - protein, 22 aa, Mycobacterium
MAAELAESLFFSRDTQPDILVV

SEQ ID NO: 699840 - protein, 20 aa, Mycobacterium
MAAELYRRHQVFSRALDECD

SEQ ID NO: 699841 - protein, 24 aa, Mycobacterium
MAAEPPESAAHLIVAAAANRAPSA

SEQ ID NO: 699842 - protein, 20 aa, Mycobacterium
MAAGELIGCFGLTEPDVGSD

SEQ ID NO: 699843 - protein, 19 aa, Mycobacterium
MAAGRRGPQALSLKLIDAP

SEQ ID NO: 699844 - protein, 19 aa, Mycobacterium
MAAGSPFALAHTFGQTGPF

SEQ ID NO: 699845 - protein, 20 aa, Mycobacterium
MAAGSPFALAHTFGQTGPFR

SEQ ID NO: 699846 - protein, 19 aa, Mycobacterium
MAAGTPFALAHTFGQTGPF

SEQ ID NO: 699847 - protein, 20 aa, Mycobacterium
MAAGTPFALAHTFGQTGPFR

SEQ ID NO: 699848 - protein, 22 aa, Mycobacterium
MAAHCLRVMVELSPDAGTGTAD

SEQ ID NO: 699849 - protein, 21 aa, Mycobacterium
MAALAAMWRSFGIAPNVTIGH

SEQ ID NO: 699850 - protein, 29 aa, Mycobacterium
MAALQIIGMCNWVAWWFHKDDATSAEIVA

SEQ ID NO: 699851 - protein, 21 aa, Mycobacterium
MAALRVGGRIVVMAYQSLEDR

SEQ ID NO: 699852 - protein, 17 aa, Mycobacterium
MAAMLSAGITPVVREYG

SEQ ID NO: 699853 - protein, 22 aa, Mycobacterium
MAANARGAWLVCQAAGRVLLDQ

SEQ ID NO: 699854 - protein, 19 aa, Mycobacterium
MAARAHLRRKFLTARVAIS

SEQ ID NO: 699855 - protein, 22 aa, Mycobacterium
MAARGIGFLGWNTRFRGFESNF

SEQ ID NO: 699856 - protein, 17 aa, Mycobacterium
MAARPGERELVAATRRR

SEQ ID NO: 699857 - protein, 18 aa, Mycobacterium
MAARRHMIQFGTTVDQLA

SEQ ID NO: 699858 - protein, 22 aa, Mycobacterium
MAARSLAQFGLTWDATRLAGQA

SEQ ID NO: 699859 - protein, 20 aa, Mycobacterium
MAASCPGTRMVLGGYSQGAA

SEQ ID NO: 699860 - protein, 19 aa, Mycobacterium
MAASLVHRAEAAGFKAIAV

SEQ ID NO: 699861 - protein, 21 aa, Mycobacterium
MAASMGEFLLAAGTKGKRHAL

SEQ ID NO: 699862 - protein, 17 aa, Mycobacterium
MAATDCVLRAVLRPGDH

SEQ ID NO: 699863 - protein, 18 aa, Mycobacterium
MAAVQLARHWGVEVFVTA

SEQ ID NO: 699864 - protein, 20 aa, Mycobacterium
MAAVQLARRWGLEVFATASR

SEQ ID NO: 699865 - protein, 19 aa, Mycobacterium
MAAVQWGKLVVNLNNSVNA

SEQ ID NO: 699866 - protein, 25 aa, Mycobacterium
MAAYARSRFTDPLLLSYSREIAALV

SEQ ID NO: 699867 - protein, 17 aa, Mycobacterium
MACRLPGGIGSPEELWE

SEQ ID NO: 699868 - protein, 23 aa, Mycobacterium
MADAGWAAVSWPREYGGRGASVL

SEQ ID NO: 699869 - protein, 20 aa, Mycobacterium
MADARLSARLYTREHGADDP

SEQ ID NO: 699870 - protein, 25 aa, Mycobacterium
MADATAGSVFACFVRPQFQGRGVGS

SEQ ID NO: 699871 - protein, 17 aa, Mycobacterium
MADCFDLALDEVTFSYE

SEQ ID NO: 699872 - protein, 24 aa, Mycobacterium
MADCLAGTYLRWVAQNNSPRFTLS

SEQ ID NO: 699873 - protein, 18 aa, Mycobacterium
MADDFAVALDELLDATKR

SEQ ID NO: 699874 - protein, 23 aa, Mycobacterium
MADDGWVRPQLLEYLRTAPDFYF

SEQ ID NO: 699875 - protein, 17 aa, Mycobacterium
MADDLAPDWPREIGYAV

SEQ ID NO: 699876 - protein, 17 aa, Mycobacterium
MADEGRNDIRIEAALAK

SEQ ID NO: 699877 - protein, 18 aa, Mycobacterium
MADEGRNDIRIEAALAKL

SEQ ID NO: 699878 - protein, 17 aa, Mycobacterium
MADELGQRIALDAPVQR

SEQ ID NO: 699879 - protein, 18 aa, Mycobacterium
MADFCRPDWMVMVDADWV

SEQ ID NO: 699880 - protein, 34 aa, Mycobacterium
MADHVFSRFSIPAWSARIGFQMLDPVKTIKGRLD

SEQ ID NO: 699881 - protein, 21 aa, Mycobacterium
MADIRARHGVILTELNIGGGH

SEQ ID NO: 699882 - protein, 17 aa, Mycobacterium
MADLAPRYFDQRELAVI

SEQ ID NO: 699883 - protein, 18 aa, Mycobacterium
MADPRWLDPTVDPNDRKP

SEQ ID NO: 699884 - protein, 18 aa, Mycobacterium
MADPRWLDPTVDPNERTP

SEQ ID NO: 699885 - protein, 19 aa, Mycobacterium
MADRLGPMVDRVPPEQLLK

SEQ ID NO: 699886 - protein, 23 aa, Mycobacterium
MADWLEAFVPLRTHVLVRFGRWQ

SEQ ID NO: 699887 - protein, 24 aa, Mycobacterium
MADWLEAFVPLRVHVLVRFGRWAD

SEQ ID NO: 699888 - protein, 20 aa, Mycobacterium
MAEAIGFHLNRGVLASAPRA

SEQ ID NO: 699889 - protein, 25 aa, Mycobacterium
MAEALRVIFPPGFAERIGADAVDEL

SEQ ID NO: 699890 - protein, 18 aa, Mycobacterium
MAEATLFVSSTIWNTEPA

SEQ ID NO: 699891 - protein, 19 aa, Mycobacterium
MAEEITCLEVASAISESAL

SEQ ID NO: 699892 - protein, 23 aa, Mycobacterium
MAEERRRCPADDIVTRLVQADVS

SEQ ID NO: 699893 - protein, 23 aa, Mycobacterium
MAEEVMAPLGPVLVKAMGIGPGM

SEQ ID NO: 699894 - protein, 18 aa, Mycobacterium
MAEFAKYAVAQVRRGVIA

SEQ ID NO: 699895 - protein, 24 aa, Mycobacterium
MAEGLADLALYAAVGEDWGLWAQE

SEQ ID NO: 699896 - protein, 18 aa, Mycobacterium
MAEGRPGSDVDITLNSSA

SEQ ID NO: 699897 - protein, 23 aa, Mycobacterium
MAEIAADNVAGWPAGRTFPVTVR

SEQ ID NO: 699898 - protein, 19 aa, Mycobacterium
MAEILLPVVRDALAQADLR

SEQ ID NO: 699899 - protein, 18 aa, Mycobacterium
MAEIRAIADRVVVLRDGG

SEQ ID NO: 699900 - protein, 19 aa, Mycobacterium
MAELGWICVSINYCKSPRS

SEQ ID NO: 699901 - protein, 31 aa, Mycobacterium
MAELTFADAFGADFFAPWGRLAEVRTPTIAA

SEQ ID NO: 699902 - protein, 22 aa, Mycobacterium
MAELVTRASVVVQRYAGRVDKF

SEQ ID NO: 699903 - protein, 20 aa, Mycobacterium
MAEMHFAAKFLRVPEAGHLI

SEQ ID NO: 699904 - protein, 18 aa, Mycobacterium
MAEMWLMYYELIQQRRDD

SEQ ID NO: 699905 - protein, 25 aa, Mycobacterium
MAEPAWRVTPNIAIKDERPIGDDFV

SEQ ID NO: 699906 - protein, 20 aa, Mycobacterium
MAEPMRARFPAAPDTMSVLV

SEQ ID NO: 699907 - protein, 19 aa, Mycobacterium
MAERFAVSRATVRSALVPL

SEQ ID NO: 699908 - protein, 17 aa, Mycobacterium
MAERGRLGLPLDTVAIS

SEQ ID NO: 699909 - protein, 18 aa, Mycobacterium
MAERLRERPGAKGLITAN

SEQ ID NO: 699910 - protein, 17 aa, Mycobacterium
MAESLRPDLVIMDVKMP

SEQ ID NO: 699911 - protein, 17 aa, Mycobacterium
MAETFAVSRSTLRSALL

SEQ ID NO: 699912 - protein, 20 aa, Mycobacterium
MAETVARRGGIVILPQDLPV

SEQ ID NO: 699913 - protein, 20 aa, Mycobacterium
MAETVARRGGLVVLPQDLPI

SEQ ID NO: 699914 - protein, 19 aa, Mycobacterium
MAEVAAFGERQRLAIRLHD

SEQ ID NO: 699915 - protein, 20 aa, Mycobacterium
MAFAKGIGGDSHFFSSSTQD

SEQ ID NO: 699916 - protein, 20 aa, Mycobacterium
MAFAYDGAWAEYTVAQAAGL

SEQ ID NO: 699917 - protein, 17 aa, Mycobacterium
MAFDPAFGPAVSRLSGE

SEQ ID NO: 699918 - protein, 17 aa, Mycobacterium
MAFKVAGSQALKKAAQA

SEQ ID NO: 699919 - protein, 17 aa, Mycobacterium
MAFRISWSRVTERATRF

SEQ ID NO: 699920 - protein, 22 aa, Mycobacterium
MAFTQKAIRVMKTVSRPHGFNV

SEQ ID NO: 699921 - protein, 18 aa, Mycobacterium
MAFYNFPLRLLKRTRDAD

SEQ ID NO: 699922 - protein, 18 aa, Mycobacterium
MAFYNFPLRLLKRTWDAE

SEQ ID NO: 699923 - protein, 20 aa, Mycobacterium
MAFYRVGEAFIEVVASGAEP

SEQ ID NO: 699924 - protein, 19 aa, Mycobacterium
MAGAELLLGVRRRPGKAAT

SEQ ID NO: 699925 - protein, 29 aa, Mycobacterium
MAGALKNVYAISVGMGYSLGIGENTRALV

SEQ ID NO: 699926 - protein, 23 aa, Mycobacterium
MAGARLESMIPLGPPVMDVALNI

SEQ ID NO: 699927 - protein, 19 aa, Mycobacterium
MAGCDVVYYCVVDARMWLR

SEQ ID NO: 699928 - protein, 18 aa, Mycobacterium
MAGDRIATIGNRGNSTGP

SEQ ID NO: 699929 - protein, 17 aa, Mycobacterium
MAGEGFGDPAPAGLSPS

SEQ ID NO: 699930 - protein, 17 aa, Mycobacterium
MAGELRIKVGPVTVPDD

SEQ ID NO: 699931 - protein, 24 aa, Mycobacterium
MAGFPVTVKGLSRFTDPAESRAVI

SEQ ID NO: 699932 - protein, 24 aa, Mycobacterium
MAGFPVTVKGLSRFTDPAESRTVI

SEQ ID NO: 699933 - protein, 25 aa, Mycobacterium
MAGGAGGRGGSLLGDGGAGAPGAAS

SEQ ID NO: 699934 - protein, 19 aa, Mycobacterium
MAGGESFTFHLPAYHRDEI

SEQ ID NO: 699935 - protein, 19 aa, Mycobacterium
MAGGRPMYERPDGRRFDHD

SEQ ID NO: 699936 - protein, 20 aa, Mycobacterium
MAGISWLADFVERSPFAQAF

SEQ ID NO: 699937 - protein, 19 aa, Mycobacterium
MAGLARRFPSGVGQDYIDR

SEQ ID NO: 699938 - protein, 19 aa, Mycobacterium
MAGLDFGYSQTKWVGEQLA

SEQ ID NO: 699939 - protein, 20 aa, Mycobacterium
MAGLDLGDVLGIISGSERIH

SEQ ID NO: 699940 - protein, 18 aa, Mycobacterium
MAGLIASGAVDFDIAATY

SEQ ID NO: 699941 - protein, 20 aa, Mycobacterium
MAGLIRRMSDNPGRYQIATG

SEQ ID NO: 699942 - protein, 18 aa, Mycobacterium
MAGLKPLVEGGRLTAAMA

SEQ ID NO: 699943 - protein, 18 aa, Mycobacterium
MAGLTFADAFDADFFAAW

SEQ ID NO: 699944 - protein, 18 aa, Mycobacterium
MAGLTFADAFDADFFAPW

SEQ ID NO: 699945 - protein, 18 aa, Mycobacterium
MAGMATCTLSHLIESSES

SEQ ID NO: 699946 - protein, 18 aa, Mycobacterium
MAGMATCTLTHLIESNES

SEQ ID NO: 699947 - protein, 18 aa, Mycobacterium
MAGMLDRALQCGMRPEQI

SEQ ID NO: 699948 - protein, 18 aa, Mycobacterium
MAGNFSFGDYFKREAIEL

SEQ ID NO: 699949 - protein, 17 aa, Mycobacterium
MAGNFSFGDYFKREAIR

SEQ ID NO: 699950 - protein, 17 aa, Mycobacterium
MAGNFSFGDYFKRGAIE

SEQ ID NO: 699951 - protein, 17 aa, Mycobacterium
MAGNFSFGDYFKRRAIE

SEQ ID NO: 699952 - protein, 18 aa, Mycobacterium
MAGPAARIAAIAGAADRL

SEQ ID NO: 699953 - protein, 19 aa, Mycobacterium
MAGPLMAVMSQMGGMAFGS

SEQ ID NO: 699954 - protein, 18 aa, Mycobacterium
MAGRALVHRAVCEQLIDH

SEQ ID NO: 699955 - protein, 17 aa, Mycobacterium
MAGRESTCRPVVANSQR

SEQ ID NO: 699956 - protein, 22 aa, Mycobacterium
MAGSLLRQAMMAALGGRQGPAH

SEQ ID NO: 699957 - protein, 22 aa, Mycobacterium
MAGSVCPVEVMKRCIDEMHMAG

SEQ ID NO: 699958 - protein, 21 aa, Mycobacterium
MAGTPSFMWLEVDDVVRDCLA

SEQ ID NO: 699959 - protein, 25 aa, Mycobacterium
MAGVITAEIGAPIAFAQRAQVGLPA

SEQ ID NO: 699960 - protein, 18 aa, Mycobacterium
MAGVLCGQLAIGTVPHPS

SEQ ID NO: 699961 - protein, 29 aa, Mycobacterium
MAGVLDLAHTIVLVSSPAMDSARSASATL

SEQ ID NO: 699962 - protein, 18 aa, Mycobacterium
MAGVPWVGAICVDYPGTL

SEQ ID NO: 699963 - protein, 18 aa, Mycobacterium
MAGWPAVERAARAVVDDG

SEQ ID NO: 699964 - protein, 19 aa, Mycobacterium
MAHALARRGLNVVLLARRQ

SEQ ID NO: 699965 - protein, 19 aa, Mycobacterium
MAHMFVKSGYQRGCLAGKF

SEQ ID NO: 699966 - protein, 24 aa, Mycobacterium
MAHRISLRPEMWVRRVQGADVVEE

SEQ ID NO: 699967 - protein, 28 aa, Mycobacterium
MAHYSMGWIPLWARLAAVAPNLLNTVTH

SEQ ID NO: 699968 - protein, 18 aa, Mycobacterium
MAHYWSLRQTDLRDLQRR

SEQ ID NO: 699969 - protein, 18 aa, Mycobacterium
MAIAGFLAINHLWRGQIT

SEQ ID NO: 699970 - protein, 19 aa, Mycobacterium
MAIDAKYAVAQARRGVLGD

SEQ ID NO: 699971 - protein, 20 aa, Mycobacterium
MAIGSCRLPTIAAVNGAAVG

SEQ ID NO: 699972 - protein, 21 aa, Mycobacterium
MAILRRFADVYGVTVMLPAAH

SEQ ID NO: 699973 - protein, 20 aa, Mycobacterium
MAIPEEYGGAGIPDYRYNVV

SEQ ID NO: 699974 - protein, 33 aa, Mycobacterium
MAISAGLARHVLCFRTLWEATFGQLVKEGKMSP

SEQ ID NO: 699975 - protein, 31 aa, Mycobacterium
MAKAAPGCGVSWNLLAGIGRIESGHANNGAT

SEQ ID NO: 699976 - protein, 18 aa, Mycobacterium
MAKACALEPTGMSALLGG

SEQ ID NO: 699977 - protein, 28 aa, Mycobacterium
MAKHFLRHPRLLGALPVLRDANKIPASY

SEQ ID NO: 699978 - protein, 18 aa, Mycobacterium
MAKLAFTGLLPMSASEAL

SEQ ID NO: 699979 - protein, 17 aa, Mycobacterium
MAKLIIKLINSVAEIVN

SEQ ID NO: 699980 - protein, 18 aa, Mycobacterium
MAKLYPDTDVLVFGHSHI

SEQ ID NO: 699981 - protein, 17 aa, Mycobacterium
MAKRLAADPRPMRFHGA

SEQ ID NO: 699982 - protein, 18 aa, Mycobacterium
MAKSTLLAMSHSLAAELG

SEQ ID NO: 699983 - protein, 26 aa, Mycobacterium
MALAGITCVGEFHYLHHLPGGTRYDD

SEQ ID NO: 699984 - protein, 17 aa, Mycobacterium
MALAGLAGRAIAGTMGA

SEQ ID NO: 699985 - protein, 19 aa, Mycobacterium
MALAHLWAAGLPWDRDLAP

SEQ ID NO: 699986 - protein, 17 aa, Mycobacterium
MALALLESGVRPDLVCG

SEQ ID NO: 699987 - protein, 19 aa, Mycobacterium
MALARLGRRRHRHCSHENE

SEQ ID NO: 699988 - protein, 21 aa, Mycobacterium
MALDKDHVWLNGQVTPIDQLD

SEQ ID NO: 699989 - protein, 19 aa, Mycobacterium
MALIADRLRPGGVLHAATD

SEQ ID NO: 699990 - protein, 17 aa, Mycobacterium
MALIHKRAHGVAVVVFE

SEQ ID NO: 699991 - protein, 19 aa, Mycobacterium
MALLGARAAGKIILDGVFN

SEQ ID NO: 699992 - protein, 23 aa, Mycobacterium
MALLRKGGICVLTGITPFTEPPV

SEQ ID NO: 699993 - protein, 17 aa, Mycobacterium
MALRAAEYGRTVVVLTI

SEQ ID NO: 699994 - protein, 24 aa, Mycobacterium
MALRRKFSASGFMMDVRRYGATYA

SEQ ID NO: 699995 - protein, 25 aa, Mycobacterium
MALRVWRRRPSMTMEAWNDPTLLKF

SEQ ID NO: 699996 - protein, 19 aa, Mycobacterium
MALSEAMGAQFDRIQQEAL

SEQ ID NO: 699997 - protein, 19 aa, Mycobacterium
MALSHLWAAGIPWDADLPP

SEQ ID NO: 699998 - protein, 23 aa, Mycobacterium
MAMAAAAAPYVAWASATMTLAEQ

SEQ ID NO: 699999 - protein, 22 aa, Mycobacterium
MAMAAAAAPYVAWIQQTAAQAA

SEQ ID NO: 700000 - protein, 25 aa, Mycobacterium
MAMAAAVAPYANWLSAAAARAAGAA

SEQ ID NO: 700001 - protein, 23 aa, Mycobacterium
MAMDAKMPFQIEIGTKGGEQAPW

SEQ ID NO: 700002 - protein, 20 aa, Mycobacterium
MAMDFRVRINSAFSIDLPVL

SEQ ID NO: 700003 - protein, 17 aa, Mycobacterium
MAMGNPDPMGFVDASDV

SEQ ID NO: 700004 - protein, 25 aa, Mycobacterium
MAMLQAVQPYLIWLRETAQQAQQMA

SEQ ID NO: 700005 - protein, 20 aa, Mycobacterium
MAMLTRREVEVLRLMAAGRT

SEQ ID NO: 700006 - protein, 17 aa, Mycobacterium
MAMRGIRKPGAVTTTSA

SEQ ID NO: 700007 - protein, 20 aa, Mycobacterium
MANAAFYYGALRSLSEDDRP

SEQ ID NO: 700008 - protein, 24 aa, Mycobacterium
MANPAFKSAMRSAGTVIGREITRS

SEQ ID NO: 700009 - protein, 19 aa, Mycobacterium
MANSCRHRGTMLCRTEMGN

SEQ ID NO: 700010 - protein, 18 aa, Mycobacterium
MANTVEWTVQEFTPADEV

SEQ ID NO: 700011 - protein, 18 aa, Mycobacterium
MAPALRKTLGVPLFQEQL

SEQ ID NO: 700012 - protein, 30 aa, Mycobacterium
MAPEKRPAPLPFLSIKKIEVHYRPRAVVGI

SEQ ID NO: 700013 - protein, 26 aa, Mycobacterium
MAPELRGTEIARHFDLVGFDPRGVGH

SEQ ID NO: 700014 - protein, 24 aa, Mycobacterium
MAPGARPGPVPKPGVRTPRVGNNP

SEQ ID NO: 700015 - protein, 18 aa, Mycobacterium
MAPGQPDLVCDFWTELGR

SEQ ID NO: 700016 - protein, 25 aa, Mycobacterium
MAPGRMPSKWGAYIDDMAGFDAEFF

SEQ ID NO: 700017 - protein, 17 aa, Mycobacterium
MAPLFPLVVIVHADEEV

SEQ ID NO: 700018 - protein, 19 aa, Mycobacterium
MAPLFPLVVIVYADVEVRL

SEQ ID NO: 700019 - protein, 24 aa, Mycobacterium
MAPLTLAGIPGFLSTVPPPFNIVI

SEQ ID NO: 700020 - protein, 23 aa, Mycobacterium
MAPLTLAGVPGFLSTVPPPFNIV

SEQ ID NO: 700021 - protein, 19 aa, Mycobacterium
MAPMFPLVIIVHADPEVRV

SEQ ID NO: 700022 - protein, 18 aa, Mycobacterium
MAPMTGWAGGEEQLLAVL

SEQ ID NO: 700023 - protein, 19 aa, Mycobacterium
MAPMTGWAGSEDELLDVLR

SEQ ID NO: 700024 - protein, 29 aa, Mycobacterium
MAPNGGLLSRFPGLSLPALGLDFYGGTPS

SEQ ID NO: 700025 - protein, 19 aa, Mycobacterium
MAPPGLLYCATRKDVEFYA

SEQ ID NO: 700026 - protein, 19 aa, Mycobacterium
MAPTTGWAGTEDDLVELLG

SEQ ID NO: 700027 - protein, 19 aa, Mycobacterium
MAPTTGWAGTEDELLAVLR

SEQ ID NO: 700028 - protein, 17 aa, Mycobacterium
MAPVLAAEKARWAPSAG

SEQ ID NO: 700029 - protein, 23 aa, Mycobacterium
MAQAFPASRFTGIDFSEQAIATG

SEQ ID NO: 700030 - protein, 22 aa, Mycobacterium
MAQAFPASRFTGVDFSDEAIAT

SEQ ID NO: 700031 - protein, 26 aa, Mycobacterium
MAQAFPRSRFTGIDFSDAAVAAGAAE

SEQ ID NO: 700032 - protein, 17 aa, Mycobacterium
MAQALGGTVARTGTSEY

SEQ ID NO: 700033 - protein, 17 aa, Mycobacterium
MAQARVVIGDWKHDYNH

SEQ ID NO: 700034 - protein, 24 aa, Mycobacterium
MAQCLRGGTRAELDKIVLTASGGP

SEQ ID NO: 700035 - protein, 21 aa, Mycobacterium
MAQERLGALAGGLGGPPPGQP

SEQ ID NO: 700036 - protein, 23 aa, Mycobacterium
MAQERLGSLAGGFGPPPGQPPAP

SEQ ID NO: 700037 - protein, 19 aa, Mycobacterium
MAQGLGMPALARVLSWASV

SEQ ID NO: 700038 - protein, 24 aa, Mycobacterium
MAQGMACRTRFYDQFFLDATRGGI

SEQ ID NO: 700039 - protein, 19 aa, Mycobacterium
MAQIDLRVTTLGPKGVDVV

SEQ ID NO: 700040 - protein, 19 aa, Mycobacterium
MAQIGLRVTTLGPKGVDLV

SEQ ID NO: 700041 - protein, 32 aa, Mycobacterium
MAQLIAQRGVPWILMHWRSKDFIHTPATRNYR

SEQ ID NO: 700042 - protein, 25 aa, Mycobacterium
MAQPGGLRGSFALYRAIPQDRADNR

SEQ ID NO: 700043 - protein, 19 aa, Mycobacterium
MAQRIKPRKTIELDASHAS

SEQ ID NO: 700044 - protein, 17 aa, Mycobacterium
MAQVALDAFRRAQRVDS

SEQ ID NO: 700045 - protein, 18 aa, Mycobacterium
MAQVITWFSLDPGSGFTY

SEQ ID NO: 700046 - protein, 22 aa, Mycobacterium
MAQYLLAIIFQRYRLHLRPGWQ

SEQ ID NO: 700047 - protein, 21 aa, Mycobacterium
MARAFPASRFTGVDFSDEAIA

SEQ ID NO: 700048 - protein, 25 aa, Mycobacterium
MARDEGRWAVRWVSTGLHPKLGEHQ

SEQ ID NO: 700049 - protein, 25 aa, Mycobacterium
MARECVAAGWLLSLSGTVTFRNARD

SEQ ID NO: 700050 - protein, 20 aa, Mycobacterium
MARGQYWIHPALPELVENAL

SEQ ID NO: 700051 - protein, 19 aa, Mycobacterium
MARGTAWLDTGTFDSLLDA

SEQ ID NO: 700052 - protein, 17 aa, Mycobacterium
MARLRAWADEGGPVLEE

SEQ ID NO: 700053 - protein, 23 aa, Mycobacterium
MARPEEMASIVAFLLSDDSSMIT

SEQ ID NO: 700054 - protein, 19 aa, Mycobacterium
MARPPERFTDGLLRALEDR

SEQ ID NO: 700055 - protein, 20 aa, Mycobacterium
MARQYGRDGVVAWQRALNDA

SEQ ID NO: 700056 - protein, 17 aa, Mycobacterium
MARRLGVEIDMVQTTWA

SEQ ID NO: 700057 - protein, 23 aa, Mycobacterium
MARRMGDGLVHLHLADGNGASTD

SEQ ID NO: 700058 - protein, 20 aa, Mycobacterium
MARSMDLYAAMSIADGNLDP

SEQ ID NO: 700059 - protein, 24 aa, Mycobacterium
MARSRSGGQFDPRVVDAFLADADA

SEQ ID NO: 700060 - protein, 25 aa, Mycobacterium
MARVFPNLFATHRVRAVDDYASHLL

SEQ ID NO: 700061 - protein, 25 aa, Mycobacterium
MARVFPNLFATHRVRAVDDYPSHLL

SEQ ID NO: 700062 - protein, 25 aa, Mycobacterium
MASAAAPYAGWLGLAAARATTAAAQ

SEQ ID NO: 700063 - protein, 23 aa, Mycobacterium
MASAAAPYLKWLTTAAAQAGQAA

SEQ ID NO: 700064 - protein, 25 aa, Mycobacterium
MASAAKLKATFAAGDREGERIAAAI

SEQ ID NO: 700065 - protein, 23 aa, Mycobacterium
MASAAQPYLVWLTTASVQAEQAA

SEQ ID NO: 700066 - protein, 22 aa, Mycobacterium
MASAIPAGRLGSVADIGNAALF

SEQ ID NO: 700067 - protein, 18 aa, Mycobacterium
MASELAPFAPPPKTSTPD

SEQ ID NO: 700068 - protein, 17 aa, Mycobacterium
MASERGWGSTMVLTEPD

SEQ ID NO: 700069 - protein, 20 aa, Mycobacterium
MASGEMIGAIAMTEPGTGSD

SEQ ID NO: 700070 - protein, 21 aa, Mycobacterium
MASGLSAQFAVFAALAGAGDH

SEQ ID NO: 700071 - protein, 19 aa, Mycobacterium
MASHGYTATKFGVRGLTKS

SEQ ID NO: 700072 - protein, 17 aa, Mycobacterium
MASKSLRPLPVAHKEMS

SEQ ID NO: 700073 - protein, 19 aa, Mycobacterium
MASLKPAFKEDGVIHAGNS

SEQ ID NO: 700074 - protein, 21 aa, Mycobacterium
MASLRSGECDLALAGGVTVMG

SEQ ID NO: 700075 - protein, 21 aa, Mycobacterium
MASMCSLSAHTTAGWSNTFVG

SEQ ID NO: 700076 - protein, 27 aa, Mycobacterium
MASPGYPCYRNILSALGCEVVEIPCGP

SEQ ID NO: 700077 - protein, 22 aa, Mycobacterium
MASRWLDYHAAVAFSVTGDTLP

SEQ ID NO: 700078 - protein, 19 aa, Mycobacterium
MASSLPPMLTGLLGAGVGM

SEQ ID NO: 700079 - protein, 18 aa, Mycobacterium
MASVAAYTWLSTRGGGNV

SEQ ID NO: 700080 - protein, 23 aa, Mycobacterium
MASVGIGWRACAPVPTARPPGRI

SEQ ID NO: 700081 - protein, 22 aa, Mycobacterium
MATAASGYLAWLRTSAGQAEQT

SEQ ID NO: 700082 - protein, 18 aa, Mycobacterium
MATALARIEGRPIGVLAN

SEQ ID NO: 700083 - protein, 17 aa, Mycobacterium
MATALGIPVENLTATLQ

SEQ ID NO: 700084 - protein, 17 aa, Mycobacterium
MATAVEPYITWMHTTAA

SEQ ID NO: 700085 - protein, 17 aa, Mycobacterium
MATAVLPGMVERRRGDV

SEQ ID NO: 700086 - protein, 19 aa, Mycobacterium
MATDPAGAFFGLWQPLGHR

SEQ ID NO: 700087 - protein, 17 aa, Mycobacterium
MATFLRFATGIAGPKPQ

SEQ ID NO: 700088 - protein, 22 aa, Mycobacterium
MATGEIRATMALTEPGGGSDLQ

SEQ ID NO: 700089 - protein, 23 aa, Mycobacterium
MATGELLGCFGLTEPDAGSDPAA

SEQ ID NO: 700090 - protein, 23 aa, Mycobacterium
MATGELRATMALTEPGGGSDLQS

SEQ ID NO: 700091 - protein, 18 aa, Mycobacterium
MATGETRGSFSMSEPELG

SEQ ID NO: 700092 - protein, 27 aa, Mycobacterium
MATLGRPEVDLGYFLFFDRVYSAGIGL

SEQ ID NO: 700093 - protein, 19 aa, Mycobacterium
MATPDTMVGCPKRITIGDR

SEQ ID NO: 700094 - protein, 17 aa, Mycobacterium
MATRFDPAAAWAMAARE

SEQ ID NO: 700095 - protein, 26 aa, Mycobacterium
MATRGCPLFDLAILVSYWMEPDDPAG

SEQ ID NO: 700096 - protein, 22 aa, Mycobacterium
MATRGVAFLGWNTRFRGFESNF

SEQ ID NO: 700097 - protein, 22 aa, Mycobacterium
MATRGVGFLGWNTRYRGFESSF

SEQ ID NO: 700098 - protein, 24 aa, Mycobacterium
MATRPECIEVLFAEVAEGAGADPR

SEQ ID NO: 700099 - protein, 26 aa, Mycobacterium
MATTWPDKRIDLYFPGERPLTAYHPR

SEQ ID NO: 700100 - protein, 18 aa, Mycobacterium
MATVELDWHWATRTGGAV

SEQ ID NO: 700101 - protein, 29 aa, Mycobacterium
MATVFKLPFGEIPGQVFIGMRTSDVLTHA

SEQ ID NO: 700102 - protein, 19 aa, Mycobacterium
MATVKARYAGGLNGKKLEA

SEQ ID NO: 700103 - protein, 19 aa, Mycobacterium
MAVAACRDAIADAGLTPAD

SEQ ID NO: 700104 - protein, 18 aa, Mycobacterium
MAVAYRLTGSVADAEDLV

SEQ ID NO: 700105 - protein, 20 aa, Mycobacterium
MAVCRKWDVLATVIGEVTDG

SEQ ID NO: 700106 - protein, 20 aa, Mycobacterium
MAVCRKWDVLATVIGEVTEG

SEQ ID NO: 700107 - protein, 25 aa, Mycobacterium
MAVDDWPLLRWRMREYEHGRWGREI

SEQ ID NO: 700108 - protein, 26 aa, Mycobacterium
MAVDDWPLLRWRMRQYRHGRWGTHIV

SEQ ID NO: 700109 - protein, 26 aa, Mycobacterium
MAVEDWPLLRWRMRQYRHGRWGTHIV

SEQ ID NO: 700110 - protein, 20 aa, Mycobacterium
MAVERIELFVDALLKGGRPA

SEQ ID NO: 700111 - protein, 19 aa, Mycobacterium
MAVERIELFVEALLKGGRP

SEQ ID NO: 700112 - protein, 20 aa, Mycobacterium
MAVFVSALLAGRVVPPAQLA

SEQ ID NO: 700113 - protein, 29 aa, Mycobacterium
MAVIGRERFAEFLAGFHLIDEHFRTAPLE

SEQ ID NO: 700114 - protein, 31 aa, Mycobacterium
MAVIPHVVRLAGRWLRPGGRFAVEHDDTTAR

SEQ ID NO: 700115 - protein, 19 aa, Mycobacterium
MAVLCGWLQGAAQGRVAMA

SEQ ID NO: 700116 - protein, 19 aa, Mycobacterium
MAVMCGASLIFQYDVTAAD

SEQ ID NO: 700117 - protein, 17 aa, Mycobacterium
MAVPPNLVPFVERIGLS

SEQ ID NO: 700118 - protein, 18 aa, Mycobacterium
MAVPQGWTQAAPAMRLVS

SEQ ID NO: 700119 - protein, 17 aa, Mycobacterium
MAVRTRFFDDFFLNAAR

SEQ ID NO: 700120 - protein, 22 aa, Mycobacterium
MAVSRAGDWFGSPVNLASRVTG

SEQ ID NO: 700121 - protein, 21 aa, Mycobacterium
MAVVICRDVRDLYAYLSHQLG

SEQ ID NO: 700122 - protein, 20 aa, Mycobacterium
MAWARGHRSDWDYFAAEAGD

SEQ ID NO: 700123 - protein, 27 aa, Mycobacterium
MAWDYPLGLVAPAGFALHVRRYLHESP

SEQ ID NO: 700124 - protein, 27 aa, Mycobacterium
MAYERVTLYGLPLVARRRIGYGQVDPE

SEQ ID NO: 700125 - protein, 25 aa, Mycobacterium
MAYERVTLYGLPLVARRRVGLARIE

SEQ ID NO: 700126 - protein, 25 aa, Mycobacterium
MAYERVTLYGLPLVARRRVGYARIE

SEQ ID NO: 700127 - protein, 19 aa, Mycobacterium
MAYLAEWDAGSALGDGMRD

SEQ ID NO: 700128 - protein, 17 aa, Mycobacterium
MAYLRAQSLGFMDEDLV

SEQ ID NO: 700129 - protein, 21 aa, Mycobacterium
MCAAAPLLLAEGGTMLVVHSE

SEQ ID NO: 700130 - protein, 17 aa, Mycobacterium
MCADCAREYHDPADRRF

SEQ ID NO: 700131 - protein, 17 aa, Mycobacterium
MCDVRFAAAGAKFATAF

SEQ ID NO: 700132 - protein, 17 aa, Mycobacterium
MCGAGTPVVDGHPAGVF

SEQ ID NO: 700133 - protein, 17 aa, Mycobacterium
MCGGTFAGISHRRPCST

SEQ ID NO: 700134 - protein, 19 aa, Mycobacterium
MCGNGVRVFAHYLRASGLE

SEQ ID NO: 700135 - protein, 20 aa, Mycobacterium
MCGNGVRVFAHYLRASGLED

SEQ ID NO: 700136 - protein, 20 aa, Mycobacterium
MCGNGVRVFAHYLRASGMEG

SEQ ID NO: 700137 - protein, 25 aa, Mycobacterium
MCGQASKNAALACMAAFSNTDFRED

SEQ ID NO: 700138 - protein, 17 aa, Mycobacterium
MCGVTAVSDERIVRADD

SEQ ID NO: 700139 - protein, 26 aa, Mycobacterium
MCHISHVYACGASLYFTVVAGQRGNP

SEQ ID NO: 700140 - protein, 21 aa, Mycobacterium
MCHWPRGTTLAKLHRGVPRSR

SEQ ID NO: 700141 - protein, 19 aa, Mycobacterium
MCIAPFELFAEIAGFRSAS

SEQ ID NO: 700142 - protein, 17 aa, Mycobacterium
MCISTTYGPGDWAPTPH

SEQ ID NO: 700143 - protein, 29 aa, Mycobacterium
MCIVNPLRLGYRYSSWVTIRVAGRTRAEE

SEQ ID NO: 700144 - protein, 28 aa, Mycobacterium
MCLPVARTGVKLTSWIAGDQIQYLDTGQ

SEQ ID NO: 700145 - protein, 17 aa, Mycobacterium
MCMIPRQVAEELGQPLP

SEQ ID NO: 700146 - protein, 26 aa, Mycobacterium
MCPICRKEQLTLVSWVFGEHLGAVSG

SEQ ID NO: 700147 - protein, 25 aa, Mycobacterium
MCQDTGTAIVHAWRGRHVLTDGRDA

SEQ ID NO: 700148 - protein, 19 aa, Mycobacterium
MCRNGRGFIAGVFGAALVG

SEQ ID NO: 700149 - protein, 18 aa, Mycobacterium
MCRNGRGFVAGVFAAAVL

SEQ ID NO: 700150 - protein, 20 aa, Mycobacterium
MCRTENRAALIGYLPTGYPD

SEQ ID NO: 700151 - protein, 20 aa, Mycobacterium
MCSDIPKVLHTLGGRSMLAH

SEQ ID NO: 700152 - protein, 17 aa, Mycobacterium
MCTPLPRQGEVEDVANM

SEQ ID NO: 700153 - protein, 20 aa, Mycobacterium
MCVCRACYLLFTDARAELRY

SEQ ID NO: 700154 - protein, 19 aa, Mycobacterium
MCVCRACYLLFTDSEAELR

SEQ ID NO: 700155 - protein, 19 aa, Mycobacterium
MCVCRACYLLFTHDHAELR

SEQ ID NO: 700156 - protein, 20 aa, Mycobacterium
MCVSMSAPLAPRSGPPPIGV

SEQ ID NO: 700157 - protein, 17 aa, Mycobacterium
MDAAGLFDERYDEIPDL

SEQ ID NO: 700158 - protein, 26 aa, Mycobacterium
MDAAWACYEAWAWLQLGHGDIALVYG

SEQ ID NO: 700159 - protein, 19 aa, Mycobacterium
MDAAWALFEAYIKILTGEV

SEQ ID NO: 700160 - protein, 18 aa, Mycobacterium
MDAAWALYEAYIKILSGQ

SEQ ID NO: 700161 - protein, 18 aa, Mycobacterium
MDAAWALYEAYIKLLTGE

SEQ ID NO: 700162 - protein, 19 aa, Mycobacterium
MDAAWALYEAYIKLLTGEV

SEQ ID NO: 700163 - protein, 19 aa, Mycobacterium
MDAETRFYFVHSYAAQQWE

SEQ ID NO: 700164 - protein, 18 aa, Mycobacterium
MDAEVAALGRSMGTRTKD

SEQ ID NO: 700165 - protein, 19 aa, Mycobacterium
MDAFQEFYHAPVLHANQSP

SEQ ID NO: 700166 - protein, 22 aa, Mycobacterium
MDAGCYAVHMARTFGGGTPEVV

SEQ ID NO: 700167 - protein, 22 aa, Mycobacterium
MDAGCYAVHMARTFGGRSPEVV

SEQ ID NO: 700168 - protein, 34 aa, Mycobacterium; identical to SEQ ID NO: 100941

SEQ ID NO: 700169 - protein, 23 aa, Mycobacterium
MDAPSSRRTKAWGAAVRALSPNQ

SEQ ID NO: 700170 - protein, 19 aa, Mycobacterium
MDARLYWPGEGEVTPDELI

SEQ ID NO: 700171 - protein, 26 aa, Mycobacterium
MDASQRWITLAFTWTGLRALGVPDDA

SEQ ID NO: 700172 - protein, 23 aa, Mycobacterium
MDCGERWAVFTAGMGVDGDVVAA

SEQ ID NO: 700173 - protein, 17 aa, Mycobacterium
MDCHLMIENPDRWAPPY

SEQ ID NO: 700174 - protein, 19 aa, Mycobacterium
MDCPLRSRCTTARDGRSMT

SEQ ID NO: 700175 - protein, 25 aa, Mycobacterium
MDCPSCPDGVLACWGFARVRRVHGV

SEQ ID NO: 700176 - protein, 28 aa, Mycobacterium
MDDARLIEWCRWLGCVCVSVEYRLAPES

SEQ ID NO: 700177 - protein, 23 aa, Mycobacterium
MDDARWDSVIAVNLLAPQRLTEG

SEQ ID NO: 700178 - protein, 23 aa, Mycobacterium
MDDARWDSVVAVNLLAPLRLTEG

SEQ ID NO: 700179 - protein, 22 aa, Mycobacterium
MDDGRCGPILGASADDPATDWA

SEQ ID NO: 700180 - protein, 19 aa, Mycobacterium
MDDMLELRPAGLSSGQKQR

SEQ ID NO: 700181 - protein, 19 aa, Mycobacterium
MDDNFFRGELIYVFDGDDA

SEQ ID NO: 700182 - protein, 18 aa, Mycobacterium
MDDPLPWLLADRRAARVT

SEQ ID NO: 700183 - protein, 26 aa, Mycobacterium
MDEARMVVLMQRFGLDRIIVNSAADW

SEQ ID NO: 700184 - protein, 26 aa, Mycobacterium
MDEARMVVLMQRFGLERIIVNSAADW

SEQ ID NO: 700185 - protein, 24 aa, Mycobacterium
MDEFKAIIRWIQTRGHYSALNVFK

SEQ ID NO: 700186 - protein, 23 aa, Mycobacterium
MDEFPVSRLPTVEQLLLITSTTG

SEQ ID NO: 700187 - protein, 23 aa, Mycobacterium
MDEGLRFAIREGGRTVGAGRVVK

SEQ ID NO: 700188 - protein, 17 aa, Mycobacterium
MDEIPMLLQPGILSIAW

SEQ ID NO: 700189 - protein, 25 aa, Mycobacterium
MDFIVPSRGLIGFRTDFLTLTRGTG

SEQ ID NO: 700190 - protein, 17 aa, Mycobacterium
MDFMRDVLLWGRLIDKY

SEQ ID NO: 700191 - protein, 20 aa, Mycobacterium
MDFSPGYFRRAMDTLPKSGS

SEQ ID NO: 700192 - protein, 24 aa, Mycobacterium
MDFSVGRGEIFGFLGPSGAGKSTT

SEQ ID NO: 700193 - protein, 25 aa, Mycobacterium
MDFVVPSRGLIGWRTDFLTETRGTG

SEQ ID NO: 700194 - protein, 21 aa, Mycobacterium
MDGAELRKAFDAAGIQYGPAF

SEQ ID NO: 700195 - protein, 17 aa, Mycobacterium
MDGAVVLSTDCSRIVRA

SEQ ID NO: 700196 - protein, 18 aa, Mycobacterium
MDGAWALYEAYIKILTGE

SEQ ID NO: 700197 - protein, 24 aa, Mycobacterium
MDGKAATISVVWTNSGSAAATEKW

SEQ ID NO: 700198 - protein, 22 aa, Mycobacterium
MDGLLERMLAVWSDIGTWTRPH

SEQ ID NO: 700199 - protein, 18 aa, Mycobacterium
MDGLRQFHRNFGYGLAGR

SEQ ID NO: 700200 - protein, 24 aa, Mycobacterium
MDGLRRFNENLGYGLLGRRIERSP

SEQ ID NO: 700201 - protein, 26 aa, Mycobacterium
MDGNGRWARARGLPRTEGHKMGEATM

SEQ ID NO: 700202 - protein, 19 aa, Mycobacterium
MDGNGRWATQRGLGRTEGH

SEQ ID NO: 700203 - protein, 21 aa, Mycobacterium
MDGNGRWATQRGLGRTEGHKM

SEQ ID NO: 700204 - protein, 19 aa, Mycobacterium
MDGNGRWATQRGLRRTEGH

SEQ ID NO: 700205 - protein, 18 aa, Mycobacterium
MDGQCLFGPVLVDPPTGA

SEQ ID NO: 700206 - protein, 18 aa, Mycobacterium
MDGWYEWQANPDAVPGQK

SEQ ID NO: 700207 - protein, 17 aa, Mycobacterium
MDIALAIVDGVDGAISH

SEQ ID NO: 700208 - protein, 20 aa, Mycobacterium
MDIDTIYVWTHDSIGLGEDG

SEQ ID NO: 700209 - protein, 24 aa, Mycobacterium
MDKADGVYHLFGLLAKLAVLPKLT

SEQ ID NO: 700210 - protein, 17 aa, Mycobacterium
MDKITLTLREYRDGDLE

SEQ ID NO: 700211 - protein, 29 aa, Mycobacterium
MDKIVGYAGEIGMRVILDHHRSSKGAGPN

SEQ ID NO: 700212 - protein, 17 aa, Mycobacterium
MDLAGFDAWLARWQALR

SEQ ID NO: 700213 - protein, 21 aa, Mycobacterium
MDLAIKTGRPLIGINEGAGAR

SEQ ID NO: 700214 - protein, 29 aa, Mycobacterium
MDLALGKLGLRPGMTLLDVGCGWGGTMRR

SEQ ID NO: 700215 - protein, 17 aa, Mycobacterium
MDLFLTPTFRGYLANYG

SEQ ID NO: 700216 - protein, 17 aa, Mycobacterium
MDLGGAPLFGPVGAAAA

SEQ ID NO: 700217 - protein, 22 aa, Mycobacterium
MDLPRLGKSLVGYVTPAEGGPE

SEQ ID NO: 700218 - protein, 19 aa, Mycobacterium
MDLRAVFRPVSGYCARVEH

SEQ ID NO: 700219 - protein, 20 aa, Mycobacterium
MDLSRPVVFGHEFVGRIAAY

SEQ ID NO: 700220 - protein, 27 aa, Mycobacterium
MDLVIKESLRLVAPVPLVMRKTVTDTL

SEQ ID NO: 700221 - protein, 33 aa, Mycobacterium
MDLYLRIAPELFLKRCIVGGFDRVFELNRVFRN

SEQ ID NO: 700222 - protein, 18 aa, Mycobacterium
MDLYWPGRLDGCAQPVVQ

SEQ ID NO: 700223 - protein, 25 aa, Mycobacterium
MDLYWPGRLEGCAEPAEQREAFAWH

SEQ ID NO: 700224 - protein, 21 aa, Mycobacterium
MDMLRRLCARAGRDVDDLHCA

SEQ ID NO: 700225 - protein, 17 aa, Mycobacterium
MDMRWKFQSESLGANLS

SEQ ID NO: 700226 - protein, 17 aa, Mycobacterium
MDMTRRLASVIPGATTT

SEQ ID NO: 700227 - protein, 23 aa, Mycobacterium
MDNLKFVIDNGIHAVVGTTGFTW

SEQ ID NO: 700228 - protein, 25 aa, Mycobacterium
MDPACGCGNFIIVAFRELRDLELRI

SEQ ID NO: 700229 - protein, 25 aa, Mycobacterium
MDPELIPKLMSAGVIEVAPLAYMRG

SEQ ID NO: 700230 - protein, 23 aa, Mycobacterium
MDPELIPKLMTAGVIEVAPLAYM

SEQ ID NO: 700231 - protein, 26 aa, Mycobacterium
MDPGLPAGRVEFMLADAAPAAVIVSA

SEQ ID NO: 700232 - protein, 17 aa, Mycobacterium
MDPKLYLVWAKANTSAG

SEQ ID NO: 700233 - protein, 18 aa, Mycobacterium
MDPLVEYAARLGVSDAVT

SEQ ID NO: 700234 - protein, 27 aa, Mycobacterium
MDPQHRILLETAWRAVEHSGYAPTDLA

SEQ ID NO: 700235 - protein, 25 aa, Mycobacterium
MDPQHRILMETAWRAVEHSGIAPTS

SEQ ID NO: 700236 - protein, 26 aa, Mycobacterium
MDPQHRLLLETAWRAIEHSGTAPSEL

SEQ ID NO: 700237 - protein, 27 aa, Mycobacterium
MDPQHRLLLETAWRAVEHSGIAPTDLA

SEQ ID NO: 700238 - protein, 26 aa, Mycobacterium
MDPQHRMLLELSWEALERAGIDPARL

SEQ ID NO: 700239 - protein, 26 aa, Mycobacterium
MDPQHRMLLELSWEALERAGIDPSGL

SEQ ID NO: 700240 - protein, 26 aa, Mycobacterium
MDPQHRMLLELSWEALERSGIDPTGL

SEQ ID NO: 700241 - protein, 26 aa, Mycobacterium
MDPQHRMLLEVAWEALEHAGIQPDSL

SEQ ID NO: 700242 - protein, 26 aa, Mycobacterium
MDPQQRIALELTWEALENARIPASSL

SEQ ID NO: 700243 - protein, 26 aa, Mycobacterium
MDPQQRLALEVSWEALEHAGIPPRSL

SEQ ID NO: 700244 - protein, 25 aa, Mycobacterium
MDPQQRLILEIAWETLESASIDPQS

SEQ ID NO: 700245 - protein, 25 aa, Mycobacterium
MDPQQRLLIEVAWEALEDAGVAPHT

SEQ ID NO: 700246 - protein, 26 aa, Mycobacterium
MDPQQRLLLEVAWEALEHAGIPPSSL

SEQ ID NO: 700247 - protein, 26 aa, Mycobacterium
MDPQQRLLLEVAWEALEHAGIPPTSL

SEQ ID NO: 700248 - protein, 26 aa, Mycobacterium
MDPQQRLLLEVAWEALENAGINPRSL

SEQ ID NO: 700249 - protein, 26 aa, Mycobacterium
MDPQQRLMLEIAWEGLERAGYSPAAL

SEQ ID NO: 700250 - protein, 26 aa, Mycobacterium
MDPQQRMFLELSWEALERAGIEPGGL

SEQ ID NO: 700251 - protein, 18 aa, Mycobacterium
MDPSFSEKSLGFKSFSDF

SEQ ID NO: 700252 - protein, 18 aa, Mycobacterium
MDQPYPIAMAKLGQALAA

SEQ ID NO: 700253 - protein, 18 aa, Mycobacterium
MDQRCAGGAMAVAVTDAR

SEQ ID NO: 700254 - protein, 21 aa, Mycobacterium
MDRDTMRWWIAHHSDAAEQLL

SEQ ID NO: 700255 - protein, 17 aa, Mycobacterium
MDRILGAAVELLDAEGA

SEQ ID NO: 700256 - protein, 18 aa, Mycobacterium
MDRINFRNMRAVSQVRNQ

SEQ ID NO: 700257 - protein, 21 aa, Mycobacterium
MDRLFRAAFRAGPGAALDAGA

SEQ ID NO: 700258 - protein, 23 aa, Mycobacterium
MDRLLERMLSVWSGADADAGVCT

SEQ ID NO: 700259 - protein, 24 aa, Mycobacterium
MDRLRREPDFVIPLVEELLRYEPP

SEQ ID NO: 700260 - protein, 19 aa, Mycobacterium
MDRMHALEALFPAVTASGI

SEQ ID NO: 700261 - protein, 26 aa, Mycobacterium
MDRMLRLRPEIFRELRRECTEMLTAG

SEQ ID NO: 700262 - protein, 19 aa, Mycobacterium
MDRVICGDVGYGKTEIAVR

SEQ ID NO: 700263 - protein, 25 aa, Mycobacterium
MDRVREVIGFPARFIADKKDTELRE

SEQ ID NO: 700264 - protein, 19 aa, Mycobacterium
MDRVVCGDVGYGKTEIAVR

SEQ ID NO: 700265 - protein, 19 aa, Mycobacterium
MDRWVFPYAGTDSHDTYAI

SEQ ID NO: 700266 - protein, 25 aa, Mycobacterium
MDSRLWRMLLAPGRGIGKLVTGAVG

SEQ ID NO: 700267 - protein, 26 aa, Mycobacterium
MDSRLWRMLLAPGRGIGRLVTGAMGL

SEQ ID NO: 700268 - protein, 17 aa, Mycobacterium
MDSVWRGALPADNGFEY

SEQ ID NO: 700269 - protein, 17 aa, Mycobacterium
MDSYRAALVESWNTFLE

SEQ ID NO: 700270 - protein, 17 aa, Mycobacterium
MDTFSKWVSPARLAVTQ

SEQ ID NO: 700271 - protein, 17 aa, Mycobacterium
MDTGDWRRMFARAEERS

SEQ ID NO: 700272 - protein, 23 aa, Mycobacterium
MDTRTPEARYCIRAYFEEISARF

SEQ ID NO: 700273 - protein, 17 aa, Mycobacterium
MDTRYLREHSAKKMSHL

SEQ ID NO: 700274 - protein, 17 aa, Mycobacterium
MDTRYLREHSAKKMSHQ

SEQ ID NO: 700275 - protein, 25 aa, Mycobacterium
MDVALHRLPVTFVLDRAGITGSDGA

SEQ ID NO: 700276 - protein, 18 aa, Mycobacterium
MDVLASAVAMGWSPYYPQ

SEQ ID NO: 700277 - protein, 17 aa, Mycobacterium
MDVPFGFYACSIATDRL

SEQ ID NO: 700278 - protein, 18 aa, Mycobacterium
MDVRFLPNPHWVDELRPR

SEQ ID NO: 700279 - protein, 24 aa, Mycobacterium
MDVTCLRIGSCFEKPWDARSLWTW

SEQ ID NO: 700280 - protein, 17 aa, Mycobacterium
MDWRILKFRPATTPGVA

SEQ ID NO: 700281 - protein, 29 aa, Mycobacterium
MDWRLLMRRCPRRSFTIVGDLAQRRSPAG

SEQ ID NO: 700282 - protein, 25 aa, Mycobacterium
MDYEALRLLGSVGIAKAARGEVDVA

SEQ ID NO: 700283 - protein, 18 aa, Mycobacterium
MDYPRVADVALYLLDDVL

SEQ ID NO: 700284 - protein, 21 aa, Mycobacterium
MDYRYPAGAVRRLDDALLALY

SEQ ID NO: 700285 - protein, 21 aa, Mycobacterium
MDYRYPPGAVRRLDDALLAVF

SEQ ID NO: 700286 - protein, 29 aa, Mycobacterium
MEAACAPGEWGMAAVTGMGQRAAGALVAE

SEQ ID NO: 700287 - protein, 17 aa, Mycobacterium
MEAALGIPAGNLAATLD

SEQ ID NO: 700288 - protein, 32 aa, Mycobacterium
MEACKESLERLGLDYVDLYLIHWPVPARGEYV

SEQ ID NO: 700289 - protein, 19 aa, Mycobacterium
MEADWESSYLLTLRSAWQA

SEQ ID NO: 700290 - protein, 25 aa, Mycobacterium
MEAMRLRPIASFIIRVAAKDFEFHG

SEQ ID NO: 700291 - protein, 18 aa, Mycobacterium
MEAVGWSGARLSRLERSE

SEQ ID NO: 700292 - protein, 18 aa, Mycobacterium
MEAVLRVRVRNFPAFIVI

SEQ ID NO: 700293 - protein, 26 aa, Mycobacterium
MEAYNMAVAWNLPVVFVCKDNKWGIT

SEQ ID NO: 700294 - protein, 31 aa, Mycobacterium
MECAELLDWPAKLRLLDGFRHRENLSWSAPR

SEQ ID NO: 700295 - protein, 30 aa, Mycobacterium; identical to SEQ ID NO: 100953

SEQ ID NO: 700296 - protein, 25 aa, Mycobacterium
MECIELLSDYALVCIDEFELDDPGN

SEQ ID NO: 700297 - protein, 22 aa, Mycobacterium
MECSTVPGGVALQVHRYLAEGG

SEQ ID NO: 700298 - protein, 20 aa, Mycobacterium
MECYHCSSIHPELVDVLPEF

SEQ ID NO: 700299 - protein, 17 aa, Mycobacterium
MEDGLRLGAGHYYATSD

SEQ ID NO: 700300 - protein, 17 aa, Mycobacterium
MEDGLRLGASHYYATAD

SEQ ID NO: 700301 - protein, 17 aa, Mycobacterium
MEDGLRLGASHYYATSD

SEQ ID NO: 700302 - protein, 26 aa, Mycobacterium
MEDLALLVKLDWLFTGSGDRWTENSD

SEQ ID NO: 700303 - protein, 27 aa, Mycobacterium
MEDLILRRCHVVLGRGRFFPPLFPPEG

SEQ ID NO: 700304 - protein, 19 aa, Mycobacterium
MEDYLILGACNPALAHRAL

SEQ ID NO: 700305 - protein, 18 aa, Mycobacterium
MEEGLRFQVLAPVVRTRK

SEQ ID NO: 700306 - protein, 19 aa, Mycobacterium
MEELIAAFLTVLFPGLEIV

SEQ ID NO: 700307 - protein, 18 aa, Mycobacterium
MEERGLALFDMFTYFNEL

SEQ ID NO: 700308 - protein, 22 aa, Mycobacterium
MEFKATTLAGLGARSLTTLRAV

SEQ ID NO: 700309 - protein, 34 aa, Mycobacterium
MEFKPGQGGWQLSRRTAEMLLALSSSRVSSPTPG

SEQ ID NO: 700310 - protein, 22 aa, Mycobacterium
MEGAELRKAFDAIGIQYGPAFS

SEQ ID NO: 700311 - protein, 24 aa, Mycobacterium
MEGGHCIDGSLAVLRMMRALGVRY

SEQ ID NO: 700312 - protein, 20 aa, Mycobacterium
MEGRNDWAVHVALWQADGDG

SEQ ID NO: 700313 - protein, 27 aa, Mycobacterium
MEGSLRGTYRLTVCKPGSGDAPSVAYR

SEQ ID NO: 700314 - protein, 17 aa, Mycobacterium
MEHMGWRSPRQTRLEQA

SEQ ID NO: 700315 - protein, 17 aa, Mycobacterium
MEIAYLAGLARRRQRVL

SEQ ID NO: 700316 - protein, 17 aa, Mycobacterium
MEIGVGIHGERGVDRAP

SEQ ID NO: 700317 - protein, 21 aa, Mycobacterium
MEIRTTLTLPPFGVKDGIIPL

SEQ ID NO: 700318 - protein, 24 aa, Mycobacterium
MEKIWAPKAAGAWRLHEATAGKEL

SEQ ID NO: 700319 - protein, 17 aa, Mycobacterium
MEKLELVGLGGDEKKFP

SEQ ID NO: 700320 - protein, 24 aa, Mycobacterium
MELADWRAAVTYARTLDGIDHSRI

SEQ ID NO: 700321 - protein, 18 aa, Mycobacterium
MELAHEFFRPLGEHLRAS

SEQ ID NO: 700322 - protein, 17 aa, Mycobacterium
MELAHGLVAIAENDVTY

SEQ ID NO: 700323 - protein, 25 aa, Mycobacterium
MELEAICRYNLPIVTVILNNSGVYR

SEQ ID NO: 700324 - protein, 17 aa, Mycobacterium
MELLDAYGIPTAGAPGF

SEQ ID NO: 700325 - protein, 18 aa, Mycobacterium
MELLLCCDIVLAADTALI

SEQ ID NO: 700326 - protein, 21 aa, Mycobacterium
MELPRPLKALIAKTDPGVANP

SEQ ID NO: 700327 - protein, 26 aa, Mycobacterium
MELRVGCRRVEEPISGLKCYRIASKI

SEQ ID NO: 700328 - protein, 18 aa, Mycobacterium
MELVPWLREGQWGAPLLF

SEQ ID NO: 700329 - protein, 19 aa, Mycobacterium
MEMEKARGISITSTALQFP

SEQ ID NO: 700330 - protein, 21 aa, Mycobacterium
MEMEKARGISITSTVLQFPYR

SEQ ID NO: 700331 - protein, 20 aa, Mycobacterium
MEMWAQDAVAMYGYAASSAM

SEQ ID NO: 700332 - protein, 23 aa, Mycobacterium
MENARGAAIADLRSRKGRRESVF

SEQ ID NO: 700333 - protein, 25 aa, Mycobacterium
MENFGVSRSEIWPRVDEALAAVGLN

SEQ ID NO: 700334 - protein, 24 aa, Mycobacterium
MENKDLRLGYDVVPGRDGAIARND

SEQ ID NO: 700335 - protein, 26 aa, Mycobacterium
MENNVMELWSLLSITAPGLFPNPAKF

SEQ ID NO: 700336 - protein, 17 aa, Mycobacterium
MENRWLPMKRTALALNH

SEQ ID NO: 700337 - protein, 18 aa, Mycobacterium
MENWHPLGVVGVITAFNF

SEQ ID NO: 700338 - protein, 18 aa, Mycobacterium
MEPRRFASASAQNMLSPT

SEQ ID NO: 700339 - protein, 18 aa, Mycobacterium
MEPWDGPASVCFTDGTIV

SEQ ID NO: 700340 - protein, 18 aa, Mycobacterium
MEPWDGPASVCFTDGTVI

SEQ ID NO: 700341 - protein, 27 aa, Mycobacterium
MEPYPIIRKMFATFGIDALAKEGLQKQ

SEQ ID NO: 700342 - protein, 22 aa, Mycobacterium
MEQLEAFCRGVLSRAESSEAVG

SEQ ID NO: 700343 - protein, 23 aa, Mycobacterium
MEQRAQQAFGEIMDLAVSLGGTI

SEQ ID NO: 700344 - protein, 20 aa, Mycobacterium
MEQYFARFGGVRDYLRDVVD

SEQ ID NO: 700345 - protein, 18 aa, Mycobacterium
MERARKVLSEALGDSESP

SEQ ID NO: 700346 - protein, 24 aa, Mycobacterium
MERFNLDAVEAFELLTRLSQKSNT

SEQ ID NO: 700347 - protein, 17 aa, Mycobacterium
MERHRATITLGWPQQGK

SEQ ID NO: 700348 - protein, 18 aa, Mycobacterium
MERLLAAAVARTIAQWRR

SEQ ID NO: 700349 - protein, 29 aa, Mycobacterium
MERLTPRLPLPEWAPALSVAQRLQLGEAN

SEQ ID NO: 700350 - protein, 18 aa, Mycobacterium
MERMAAEFATGFTTAVLR

SEQ ID NO: 700351 - protein, 18 aa, Mycobacterium
MERRILLSRVPELPEHIA

SEQ ID NO: 700352 - protein, 17 aa, Mycobacterium
MERVSRFRAQGIVVDVT

SEQ ID NO: 700353 - protein, 29 aa, Mycobacterium
MERYADFGLPEWSWPFIAESWRRSDPHVY

SEQ ID NO: 700354 - protein, 18 aa, Mycobacterium
MESFGKKVEAGWVNVLRS

SEQ ID NO: 700355 - protein, 23 aa, Mycobacterium
MESLDPSIYWMGMHHSRLIKRDS

SEQ ID NO: 700356 - protein, 18 aa, Mycobacterium
MESVKLFAAEVLPAVHDM

SEQ ID NO: 700357 - protein, 18 aa, Mycobacterium
METALRAWENVSFPEGAA

SEQ ID NO: 700358 - protein, 28 aa, Mycobacterium
METRIAIAGLITRFPGLTLAIAPEELRL

SEQ ID NO: 700359 - protein, 17 aa, Mycobacterium
METTWLLDPSIPLPEVF

SEQ ID NO: 700360 - protein, 21 aa, Mycobacterium
METVLRAKVDAAWNLHELTCD

SEQ ID NO: 700361 - protein, 21 aa, Mycobacterium
METVLRAKVDAAWNLHELTRD

SEQ ID NO: 700362 - protein, 17 aa, Mycobacterium
MEVAQAFAGAATKTEPK

SEQ ID NO: 700363 - protein, 17 aa, Mycobacterium
MEVDAGGAAVLIRTLPL

SEQ ID NO: 700364 - protein, 17 aa, Mycobacterium
MEVDGFSLPAGVKVAPS

SEQ ID NO: 700365 - protein, 18 aa, Mycobacterium
MEVGPTCHYVMGGIEVDP

SEQ ID NO: 700366 - protein, 19 aa, Mycobacterium
MEVGPTCHYVMGGIEVDPD

SEQ ID NO: 700367 - protein, 25 aa, Mycobacterium
MEVLGCAQLSAPIRYLGTDETRIYA

SEQ ID NO: 700368 - protein, 19 aa, Mycobacterium
MEVPQLMFREPVLATLEEE

SEQ ID NO: 700369 - protein, 17 aa, Mycobacterium
MEVPRHRLDTGTWGTMG

SEQ ID NO: 700370 - protein, 22 aa, Mycobacterium
MEVSQNTLLGWYRKNGMPEEAL

SEQ ID NO: 700371 - protein, 18 aa, Mycobacterium
MEVVDLRSLNPLDFDTVA

SEQ ID NO: 700372 - protein, 20 aa, Mycobacterium
MEVVGRFLALLELYRSRAVA

SEQ ID NO: 700373 - protein, 22 aa, Mycobacterium
MEWDVRNGVIIRKARAHGLATP

SEQ ID NO: 700374 - protein, 17 aa, Mycobacterium
MEWQRILHERGWAAPAW

SEQ ID NO: 700375 - protein, 24 aa, Mycobacterium
MEYIYCPWHQWGFELATGTTAVKP

SEQ ID NO: 700376 - protein, 17 aa, Mycobacterium
MFAGAGAAPMLDAAAAW

SEQ ID NO: 700377 - protein, 17 aa, Mycobacterium
MFARAETPPALPFPQTP

SEQ ID NO: 700378 - protein, 17 aa, Mycobacterium
MFAVLPTIVASDMRRRR

SEQ ID NO: 700379 - protein, 23 aa, Mycobacterium
MFAWTDTEIAPWTVVKSNDKKRA

SEQ ID NO: 700380 - protein, 21 aa, Mycobacterium
MFCGCANRFGGEPNTQVCPVC

SEQ ID NO: 700381 - protein, 18 aa, Mycobacterium
MFCGCPTTFGAEPNTQIC

SEQ ID NO: 700382 - protein, 18 aa, Mycobacterium
MFDRVVVAKDADLFEHYY

SEQ ID NO: 700383 - protein, 19 aa, Mycobacterium
MFDTLLVYENFPLDGLTAG

SEQ ID NO: 700384 - protein, 19 aa, Mycobacterium
MFDTLLVYENFPMNGLSSS

SEQ ID NO: 700385 - protein, 17 aa, Mycobacterium
MFDTRLMRLEDEMAEGR

SEQ ID NO: 700386 - protein, 21 aa, Mycobacterium
MFEAVASFMLVEHANGAMFDP

SEQ ID NO: 700387 - protein, 23 aa, Mycobacterium
MFEYCVTRLVWSYLQDAANPHRR

SEQ ID NO: 700388 - protein, 23 aa, Mycobacterium
MFGEARLSAALSQCAGLPAEAVV

SEQ ID NO: 700389 - protein, 18 aa, Mycobacterium
MFGEKLPAGFGFSDTAFR

SEQ ID NO: 700390 - protein, 17 aa, Mycobacterium
MFGELSIFDPEPRRSEA

SEQ ID NO: 700391 - protein, 19 aa, Mycobacterium
MFGNVIRLLPPLTISDELL

SEQ ID NO: 700392 - protein, 21 aa, Mycobacterium
MFGSEAWRVAQAHSRHSSVYF

SEQ ID NO: 700393 - protein, 25 aa, Mycobacterium
MFGSRAIYQDGWWACTRLDKAPWDF

SEQ ID NO: 700394 - protein, 17 aa, Mycobacterium
MFHMADFSAVLAGNLSG

SEQ ID NO: 700395 - protein, 18 aa, Mycobacterium
MFHRRAVELISYAVKYER

SEQ ID NO: 700396 - protein, 19 aa, Mycobacterium
MFIFIGAEPRTEWLDGVVV

SEQ ID NO: 700397 - protein, 24 aa, Mycobacterium
MFKIKHERTADCVVAGYRVHKSGG

SEQ ID NO: 700398 - protein, 22 aa, Mycobacterium
MFLEFARGAVLVAHNAGFDIGF

SEQ ID NO: 700399 - protein, 18 aa, Mycobacterium
MFLEQYWGGPRTYSDQRG

SEQ ID NO: 700400 - protein, 18 aa, Mycobacterium
MFLEQYWGGPRTYSDRRG

SEQ ID NO: 700401 - protein, 18 aa, Mycobacterium
MFLEQYWGGPRTYSEQRG

SEQ ID NO: 700402 - protein, 18 aa, Mycobacterium
MFLTCKFGIEAMLATGGG

SEQ ID NO: 700403 - protein, 19 aa, Mycobacterium
MFNCTGWKIGWACGPQELI

SEQ ID NO: 700404 - protein, 17 aa, Mycobacterium
MFNELWPGFDPDEVPIG

SEQ ID NO: 700405 - protein, 19 aa, Mycobacterium
MFNELWPGFDPGEVPIGSI

SEQ ID NO: 700406 - protein, 24 aa, Mycobacterium
MFNMCLHRGMQLCRAEMGNASNFR

SEQ ID NO: 700407 - protein, 21 aa, Mycobacterium
MFNQFCYLQLSGARAREPDDQ

SEQ ID NO: 700408 - protein, 26 aa, Mycobacterium
MFPGEQEILFPAGSKFYVVNKTIDPH

SEQ ID NO: 700409 - protein, 24 aa, Mycobacterium
MFPKARTSILAAYEAGVKIAVGTD

SEQ ID NO: 700410 - protein, 18 aa, Mycobacterium
MFQMKFYAVALLRSRGSL

SEQ ID NO: 700411 - protein, 18 aa, Mycobacterium
MFQMPPALDRAWHTHGYY

SEQ ID NO: 700412 - protein, 24 aa, Mycobacterium
MFQMPPALERAWHTHGYYGSVSHN

SEQ ID NO: 700413 - protein, 25 aa, Mycobacterium
MFRDPRLDAALVERLAPGGLLAVSA

SEQ ID NO: 700414 - protein, 21 aa, Mycobacterium
MFRFGCVAGGASLYAPQAQNN

SEQ ID NO: 700415 - protein, 17 aa, Mycobacterium
MFSAAVWSSNQDKLRPK

SEQ ID NO: 700416 - protein, 19 aa, Mycobacterium
MFSAMGMSAFAARAQRELA

SEQ ID NO: 700417 - protein, 17 aa, Mycobacterium
MFSGAGLGPMLAASAAW

SEQ ID NO: 700418 - protein, 18 aa, Mycobacterium
MFSKYIFGGILDRHPGLR

SEQ ID NO: 700419 - protein, 17 aa, Mycobacterium
MFSRLGVDDQRELRRIL

SEQ ID NO: 700420 - protein, 22 aa, Mycobacterium
MFTCARTAGWSAHIMEQKRLGK

SEQ ID NO: 700421 - protein, 42 aa, Mycobacterium
MFTIAEFEIPISLETTICLIYVPFVGCVLHVSVTVPITTEHV

SEQ ID NO: 700422 - protein, 19 aa, Mycobacterium
MFTLGFRFKPWPSARSIAD

SEQ ID NO: 700423 - protein, 24 aa, Mycobacterium
MFTLGFRFKPWRSAKSIADGADIK

SEQ ID NO: 700424 - protein, 24 aa, Mycobacterium
MFTLGFRFKPWRSAKSIADGASIK

SEQ ID NO: 700425 - protein, 24 aa, Mycobacterium
MFTLRVDDRLRAALRGDKVASNQT

SEQ ID NO: 700426 - protein, 22 aa, Mycobacterium
MFTQLRAAGLLSTVPLAVLALG

SEQ ID NO: 700427 - protein, 20 aa, Mycobacterium
MFTRMLKLPDAVRHSYDLSS

SEQ ID NO: 700428 - protein, 18 aa, Mycobacterium
MFTRMLKLPESIRNSYDV

SEQ ID NO: 700429 - protein, 19 aa, Mycobacterium
MFVAALKPIEWRYDNDPAW

SEQ ID NO: 700430 - protein, 17 aa, Mycobacterium
MFVEAGLPEGVLSIVPG

SEQ ID NO: 700431 - protein, 26 aa, Mycobacterium
MFVLRELRAALHFNALSLSGVTPIEA

SEQ ID NO: 700432 - protein, 19 aa, Mycobacterium
MFVNPWGLWWQEVSASDIC

SEQ ID NO: 700433 - protein, 24 aa, Mycobacterium
MFVPHLLGPLLLGQGIHLVKGFYR

SEQ ID NO: 700434 - protein, 18 aa, Mycobacterium
MFVRMLKLPEAVRISYDV

SEQ ID NO: 700435 - protein, 20 aa, Mycobacterium
MFYNLGLAGRAMRRIGAVEF

SEQ ID NO: 700436 - protein, 19 aa, Mycobacterium
MGAAALHFGNVAEMKTGEG

SEQ ID NO: 700437 - protein, 29 aa, Mycobacterium
MGAAEKCSILYLESRCVSLARALGSQGVQ

SEQ ID NO: 700438 - protein, 25 aa, Mycobacterium
MGAAGLRSATLVAIASANYIARRLD

SEQ ID NO: 700439 - protein, 24 aa, Mycobacterium
MGAAPRYLGVPGEDTLLGRGVSSC

SEQ ID NO: 700440 - protein, 18 aa, Mycobacterium
MGACRRAGFEPDYVVSRV

SEQ ID NO: 700441 - protein, 20 aa, Mycobacterium
MGADGLRAATLTAIASANYV

SEQ ID NO: 700442 - protein, 20 aa, Mycobacterium
MGADGLRTASLNAIASANYI

SEQ ID NO: 700443 - protein, 22 aa, Mycobacterium
MGADHIRPAMAINKEIDLRFVL

SEQ ID NO: 700444 - protein, 18 aa, Mycobacterium
MGADRIRPAMAINKEIDL

SEQ ID NO: 700445 - protein, 25 aa, Mycobacterium
MGADVRLDASGFGIEFKDSWRNAIE

SEQ ID NO: 700446 - protein, 23 aa, Mycobacterium
MGAEADALCGAGYGQRSSDRTNS

SEQ ID NO: 700447 - protein, 23 aa, Mycobacterium
MGAEADALCGAGYGQRSSERTNS

SEQ ID NO: 700448 - protein, 20 aa, Mycobacterium
MGAEGLRAASLTAITSANYI

SEQ ID NO: 700449 - protein, 20 aa, Mycobacterium
MGAEHARLLVSEGAKVVIGD

SEQ ID NO: 700450 - protein, 27 aa, Mycobacterium
MGAEPRPRVSIFLSIFDAHVQRSPVSG

SEQ ID NO: 700451 - protein, 24 aa, Mycobacterium
MGAFPTDRGWDVAGLFDPDPDSVG

SEQ ID NO: 700452 - protein, 17 aa, Mycobacterium
MGAGAWGTALAKVLADA

SEQ ID NO: 700453 - protein, 18 aa, Mycobacterium
MGAGAWGTALAKVLVEAG

SEQ ID NO: 700454 - protein, 22 aa, Mycobacterium
MGAGDWWPLRDERIPPDVSMSA

SEQ ID NO: 700455 - protein, 20 aa, Mycobacterium
MGAGEGYDFGSLIDAGQVDI

SEQ ID NO: 700456 - protein, 20 aa, Mycobacterium
MGAGITQVFAASGRDVVVLE

SEQ ID NO: 700457 - protein, 18 aa, Mycobacterium
MGAIKPRPMAVGDQVVVR

SEQ ID NO: 700458 - protein, 20 aa, Mycobacterium
MGAIKPRPVALGAEIVVRPT

SEQ ID NO: 700459 - protein, 17 aa, Mycobacterium
MGAIVLDAIEAHAHRLQ

SEQ ID NO: 700460 - protein, 20 aa, Mycobacterium
MGAKPGNSWVPYGGGTRRCV

SEQ ID NO: 700461 - protein, 18 aa, Mycobacterium
MGALDWGDLFFDIDANRM

SEQ ID NO: 700462 - protein, 20 aa, Mycobacterium
MGALHAWCLAAQRPELVSAL

SEQ ID NO: 700463 - protein, 19 aa, Mycobacterium
MGALHAWCLAARHPDLVSA

SEQ ID NO: 700464 - protein, 20 aa, Mycobacterium
MGALHSWCLAAERPGLVSAL

SEQ ID NO: 700465 - protein, 20 aa, Mycobacterium
MGALHSWCLAAQRPDLVSAL

SEQ ID NO: 700466 - protein, 22 aa, Mycobacterium
MGALRRAGHRVAPFKVGPDFID

SEQ ID NO: 700467 - protein, 25 aa, Mycobacterium
MGALRTAAVLARLNQRNGFDCPGCA

SEQ ID NO: 700468 - protein, 17 aa, Mycobacterium
MGALVAFEVARRLETAD

SEQ ID NO: 700469 - protein, 19 aa, Mycobacterium
MGANIVRRVAKDGHECVVY

SEQ ID NO: 700470 - protein, 30 aa, Mycobacterium
MGAPMATKMTEWPGGVTVFDIRTDAMTPLA

SEQ ID NO: 700471 - protein, 26 aa, Mycobacterium
MGAPMATKMTEWPGGVTVYDIRTEAM

SEQ ID NO: 700472 - protein, 26 aa, Mycobacterium
MGAPSRALVRFGFAAGDGLRKLAGTP

SEQ ID NO: 700473 - protein, 18 aa, Mycobacterium
MGAQAYQCLPAYRAEADR

SEQ ID NO: 700474 - protein, 20 aa, Mycobacterium
MGASGAWTGSVWLTTEEAET

SEQ ID NO: 700475 - protein, 20 aa, Mycobacterium
MGASHARLLVQEGAKVVIGD

SEQ ID NO: 700476 - protein, 17 aa, Mycobacterium
MGATLARGGMNPVTGRR

SEQ ID NO: 700477 - protein, 17 aa, Mycobacterium
MGAWGGLYQHLHDAVTA

SEQ ID NO: 700478 - protein, 27 aa, Mycobacterium
MGAYAPVPWLPDEVYRDIVGNIVEPVA

SEQ ID NO: 700479 - protein, 20 aa, Mycobacterium
MGAYHGKWGFDEFSHRKSVL

SEQ ID NO: 700480 - protein, 21 aa, Mycobacterium
MGCAVIWSYLELFGTDRLASL

SEQ ID NO: 700481 - protein, 22 aa, Mycobacterium
MGCELAVRMAISGARVVGISLA

SEQ ID NO: 700482 - protein, 31 aa, Mycobacterium
MGCGDTCPYFPGVTYRDWKLPDPAGQALEVV

SEQ ID NO: 700483 - protein, 19 aa, Mycobacterium
MGCHERLRASAAPGGASVV

SEQ ID NO: 700484 - protein, 18 aa, Mycobacterium
MGDALFGTTDSWLLWNLT

SEQ ID NO: 700485 - protein, 17 aa, Mycobacterium
MGDARWITVVSPEDAEG

SEQ ID NO: 700486 - protein, 25 aa, Mycobacterium
MGDDRIRPAMAIGKEVDLRFVFGYT

SEQ ID NO: 700487 - protein, 19 aa, Mycobacterium
MGDEVIRLAPLPFVHANRM

SEQ ID NO: 700488 - protein, 21 aa, Mycobacterium
MGDFPLYLDLFAARHGFGPRI

SEQ ID NO: 700489 - protein, 17 aa, Mycobacterium
MGDGLMAVFADPTTAVR

SEQ ID NO: 700490 - protein, 19 aa, Mycobacterium
MGDGSWEDLVSFVVTQPER

SEQ ID NO: 700491 - protein, 19 aa, Mycobacterium
MGDGWKGVSGEAAHHDLDA

SEQ ID NO: 700492 - protein, 18 aa, Mycobacterium
MGDLKFWGDFDGRGLVIL

SEQ ID NO: 700493 - protein, 19 aa, Mycobacterium
MGDLSCGDGVWAGRSGPHR

SEQ ID NO: 700494 - protein, 24 aa, Mycobacterium
MGDLSRRRWWPLAEALTADRLQMM

SEQ ID NO: 700495 - protein, 24 aa, Mycobacterium
MGDLSRRRWWPLTEILTTDRLDRM

SEQ ID NO: 700496 - protein, 21 aa, Mycobacterium
MGDPVWCPLPGTKIEGLYISF

SEQ ID NO: 700497 - protein, 18 aa, Mycobacterium
MGDSHVGLQARLMSQALR

SEQ ID NO: 700498 - protein, 19 aa, Mycobacterium
MGEAFVHRTGHGIGLSVHE

SEQ ID NO: 700499 - protein, 27 aa, Mycobacterium
MGEALLSGLLRAGRQVKDMVVAEKFPE

SEQ ID NO: 700500 - protein, 18 aa, Mycobacterium
MGEENLEPAWSFGPEGQR

SEQ ID NO: 700501 - protein, 21 aa, Mycobacterium
MGEGNRPPWSIGEPQPEIAAL

SEQ ID NO: 700502 - protein, 27 aa, Mycobacterium
MGEHLQLLKGWHPVASVSNGEKRWDAQ

SEQ ID NO: 700503 - protein, 20 aa, Mycobacterium
MGEIFHLFGGLDVRPSLRSM

SEQ ID NO: 700504 - protein, 34 aa, Mycobacterium
MGERVVGLELARALVKEWLGLEFDPQSASAAKVN

SEQ ID NO: 700505 - protein, 24 aa, Mycobacterium
MGESKLNRYGVWKGGPVTPEQART

SEQ ID NO: 700506 - protein, 32 aa, Mycobacterium
MGEVRRAIDVLRFFGSAGWRPSGETLPSTMPN

SEQ ID NO: 700507 - protein, 33 aa, Mycobacterium
MGEVRRYFRDCSWAVKVPRRLKDLNSQLAKARA

SEQ ID NO: 700508 - protein, 20 aa, Mycobacterium
MGEVRRYFRDHGWSLKVPRR

SEQ ID NO: 700509 - protein, 17 aa, Mycobacterium
MGEVYLAQHPRLPRREA

SEQ ID NO: 700510 - protein, 19 aa, Mycobacterium
MGFARKAADRIIFMADGAI

SEQ ID NO: 700511 - protein, 19 aa, Mycobacterium
MGFCTPQEYVLFLRQTPIF

SEQ ID NO: 700512 - protein, 28 aa, Mycobacterium
MGFDIGCFTPIFVMSRITGWTAHVMEQT

SEQ ID NO: 700513 - protein, 19 aa, Mycobacterium
MGFVDARAFDSLPTEQRRR

SEQ ID NO: 700514 - protein, 18 aa, Mycobacterium
MGGAKPGSGVGYRHGPGG

SEQ ID NO: 700515 - protein, 20 aa, Mycobacterium
MGGAQARRLCPHAVVVPPRM

SEQ ID NO: 700516 - protein, 17 aa, Mycobacterium
MGGARALEWAVTYPDSV

SEQ ID NO: 700517 - protein, 19 aa, Mycobacterium
MGGAVRFFAGRLVKAAERE

SEQ ID NO: 700518 - protein, 23 aa, Mycobacterium
MGGEGAPWIGMAPFVSENHLFQN

SEQ ID NO: 700519 - protein, 22 aa, Mycobacterium
MGGGEVAAYCARKGVERIRSVV

SEQ ID NO: 700520 - protein, 21 aa, Mycobacterium
MGGGIAQVLALNGFKVQIADV

SEQ ID NO: 700521 - protein, 17 aa, Mycobacterium
MGGGTCYALPDPVVAEG

SEQ ID NO: 700522 - protein, 20 aa, Mycobacterium
MGGGVPIRVAIAVNADSFGT

SEQ ID NO: 700523 - protein, 18 aa, Mycobacterium
MGGNSAWRAIAGPTPRLN

SEQ ID NO: 700524 - protein, 19 aa, Mycobacterium
MGGQLWRGVSERLADRGLR

SEQ ID NO: 700525 - protein, 17 aa, Mycobacterium
MGGRSGRLHTGHCLLRL

SEQ ID NO: 700526 - protein, 22 aa, Mycobacterium
MGGRTRLEVVDPRAAKRLAATV

SEQ ID NO: 700527 - protein, 19 aa, Mycobacterium
MGGSCSIHPADATDPVAAQ

SEQ ID NO: 700528 - protein, 17 aa, Mycobacterium
MGGSIPFIAEFARAFPA

SEQ ID NO: 700529 - protein, 17 aa, Mycobacterium
MGGTGYPTFPAPVLAAL

SEQ ID NO: 700530 - protein, 32 aa, Mycobacterium
MGGWKTSGIGARFGGPEGLRKYCRIETVVAPR

SEQ ID NO: 700531 - protein, 25 aa, Mycobacterium
MGGWKTSGIGARFGGVDGVRKFCKQ

SEQ ID NO: 700532 - protein, 18 aa, Mycobacterium
MGHNRAGRRRWKRIAVSV

SEQ ID NO: 700533 - protein, 19 aa, Mycobacterium
MGHRLTIAMTRWQATVNWV

SEQ ID NO: 700534 - protein, 21 aa, Mycobacterium
MGHSGGCELVMRMAADGRGAD

SEQ ID NO: 700535 - protein, 22 aa, Mycobacterium
MGHSPAGLFGYSHMLGGFAGGQ

SEQ ID NO: 700536 - protein, 25 aa, Mycobacterium
MGHVKRALVRTGFLAGDALRMLAGT

SEQ ID NO: 700537 - protein, 25 aa, Mycobacterium
MGIETEFGVTCTFHGHRRLSPDEVA

SEQ ID NO: 700538 - protein, 17 aa, Mycobacterium
MGIFRRVNKPTYDDAAR

SEQ ID NO: 700539 - protein, 34 aa, Mycobacterium
MGIHAERILKLFGHKELNKVVSFCGPEQEYFLVD

SEQ ID NO: 700540 - protein, 22 aa, Mycobacterium
MGIPAEAGGAIGTPKKPQGQRR

SEQ ID NO: 700541 - protein, 18 aa, Mycobacterium
MGIPANFAAPAANFMADH

SEQ ID NO: 700542 - protein, 17 aa, Mycobacterium
MGIPELAAYNATKWGII

SEQ ID NO: 700543 - protein, 18 aa, Mycobacterium
MGIPQFIASIGQQLTFGS

SEQ ID NO: 700544 - protein, 17 aa, Mycobacterium
MGIPTAGGLHFAGRVGT

SEQ ID NO: 700545 - protein, 27 aa, Mycobacterium
MGIPVEGGLRYAGRVGTGFTERELSSL

SEQ ID NO: 700546 - protein, 17 aa, Mycobacterium
MGIQYLLLRSGPLTMPP

SEQ ID NO: 700547 - protein, 17 aa, Mycobacterium
MGIQYLLLRSGPMTMPP

SEQ ID NO: 700548 - protein, 21 aa, Mycobacterium
MGITAKGAWVSVRRHLSEMEI

SEQ ID NO: 700549 - protein, 17 aa, Mycobacterium
MGKAMLNDSTMGRIKLT

SEQ ID NO: 700550 - protein, 18 aa, Mycobacterium
MGKGVQLFLPDGSTSQAP

SEQ ID NO: 700551 - protein, 18 aa, Mycobacterium
MGKRCLLGANAGLGISLG

SEQ ID NO: 700552 - protein, 25 aa, Mycobacterium
MGKSLYLRDPIFAEWIDKVDSYVQE

SEQ ID NO: 700553 - protein, 27 aa, Mycobacterium
MGKVFALRPHFEWRGLGFISQSALRLH

SEQ ID NO: 700554 - protein, 27 aa, Mycobacterium
MGKVFALRPHFEWRGLGFISQSALRLS

SEQ ID NO: 700555 - protein, 21 aa, Mycobacterium
MGLAAAHCFADDGARVALVGR

SEQ ID NO: 700556 - protein, 19 aa, Mycobacterium
MGLAAARCLADEGARVAVV

SEQ ID NO: 700557 - protein, 17 aa, Mycobacterium
MGLAGFEEYLETKLIAT

SEQ ID NO: 700558 - protein, 17 aa, Mycobacterium
MGLAPMVISQIFRIIAD

SEQ ID NO: 700559 - protein, 17 aa, Mycobacterium
MGLARAAALPVIVVGDI

SEQ ID NO: 700560 - protein, 19 aa, Mycobacterium
MGLASCPVTEPLEIAETRA

SEQ ID NO: 700561 - protein, 20 aa, Mycobacterium
MGLASCPVTEPLEIAETRES

SEQ ID NO: 700562 - protein, 18 aa, Mycobacterium
MGLATARCLADEGARVAV

SEQ ID NO: 700563 - protein, 17 aa, Mycobacterium
MGLCSEVRRVRASELLD

SEQ ID NO: 700564 - protein, 32 aa, Mycobacterium
MGLDHKLTLGAWFKPALYALRTARRVRGTRLD

SEQ ID NO: 700565 - protein, 17 aa, Mycobacterium
MGLDRAAGAMLVARSDE

SEQ ID NO: 700566 - protein, 25 aa, Mycobacterium
MGLEGAVRLGFRKELAAAADEVERQ

SEQ ID NO: 700567 - protein, 25 aa, Mycobacterium
MGLEGAVRLGLRKELEAIADESARE

SEQ ID NO: 700568 - protein, 17 aa, Mycobacterium
MGLFGYAIPQEWGGLGL

SEQ ID NO: 700569 - protein, 18 aa, Mycobacterium
MGLFGYAIPQQWGGLGLN

SEQ ID NO: 700570 - protein, 22 aa, Mycobacterium
MGLGRATNNWSFPTRKELDRMA

SEQ ID NO: 700571 - protein, 26 aa, Mycobacterium
MGLIKECARRFPGGQMIFDLPPSWFA

SEQ ID NO: 700572 - protein, 19 aa, Mycobacterium
MGLKASATCELTFGQHGVP

SEQ ID NO: 700573 - protein, 22 aa, Mycobacterium
MGLLKPFLKGWHRAEVRGLDDF

SEQ ID NO: 700574 - protein, 22 aa, Mycobacterium
MGLLRAPCRVVYVIDEPDTRGF

SEQ ID NO: 700575 - protein, 20 aa, Mycobacterium
MGLMLGEYWDLTALSADCAA

SEQ ID NO: 700576 - protein, 17 aa, Mycobacterium
MGLPMAVNLTKAGHTVA

SEQ ID NO: 700577 - protein, 20 aa, Mycobacterium
MGLRADRVLHASSAGTGILS

SEQ ID NO: 700578 - protein, 18 aa, Mycobacterium
MGLSLPILAPGGVAAALT

SEQ ID NO: 700579 - protein, 19 aa, Mycobacterium
MGLTPARTRHEAVLTDAIS

SEQ ID NO: 700580 - protein, 19 aa, Mycobacterium
MGLVERWLLNTQFPEKRLA

SEQ ID NO: 700581 - protein, 18 aa, Mycobacterium
MGLVHGGVYCSMVESMAS

SEQ ID NO: 700582 - protein, 24 aa, Mycobacterium
MGLVSESCCLGVDRFTRVRDVATT

SEQ ID NO: 700583 - protein, 24 aa, Mycobacterium
MGMAAAVEVCLRRRSMGHRLGIRE

SEQ ID NO: 700584 - protein, 26 aa, Mycobacterium
MGMELFCAGTHPFARWSAQQLTDAPR

SEQ ID NO: 700585 - protein, 17 aa, Mycobacterium
MGMFSMACRFDVMPVNP

SEQ ID NO: 700586 - protein, 25 aa, Mycobacterium
MGMGGSIPFIAEFAAAFPQAKILVT

SEQ ID NO: 700587 - protein, 25 aa, Mycobacterium
MGMGGSIPFIAEFAEAFPDAKILVT

SEQ ID NO: 700588 - protein, 18 aa, Mycobacterium
MGMLFRKQLVMFGPREVL

SEQ ID NO: 700589 - protein, 24 aa, Mycobacterium
MGMLFRRKLVMFGPREVLLTSDEP

SEQ ID NO: 700590 - protein, 22 aa, Mycobacterium
MGMLYRRNLVMFGPREVLLTSD

SEQ ID NO: 700591 - protein, 21 aa, Mycobacterium
MGMMGFLIVPMCRAMSTVSVT

SEQ ID NO: 700592 - protein, 20 aa, Mycobacterium
MGMREARHHPLVAALKEFDS

SEQ ID NO: 700593 - protein, 18 aa, Mycobacterium
MGMVGAMITWWIRHPEQS

SEQ ID NO: 700594 - protein, 26 aa, Mycobacterium
MGNALARLELRVALEEILKRFPEWEV

SEQ ID NO: 700595 - protein, 18 aa, Mycobacterium
MGNLMFSNALARRLPDGV

SEQ ID NO: 700596 - protein, 17 aa, Mycobacterium
MGNPILCDLILIRSALS

SEQ ID NO: 700597 - protein, 31 aa, Mycobacterium
MGNPQILWRQAYDRGPARKPGQLSWGTGSTP

SEQ ID NO: 700598 - protein, 20 aa, Mycobacterium
MGPDGLRAASLTAIASANYL

SEQ ID NO: 700599 - protein, 24 aa, Mycobacterium
MGPEGRAAIGLGDAVVRISVGLEG

SEQ ID NO: 700600 - protein, 24 aa, Mycobacterium
MGPEGRAAIGLGDGVVRISVGLES

SEQ ID NO: 700601 - protein, 26 aa, Mycobacterium
MGPFHQWPTGSGFEYFYGFVGGEANQ

SEQ ID NO: 700602 - protein, 24 aa, Mycobacterium
MGPFLERMGLTVGWITEESTAEER

SEQ ID NO: 700603 - protein, 20 aa, Mycobacterium
MGPKALRITGEYADGTLPYL

SEQ ID NO: 700604 - protein, 22 aa, Mycobacterium
MGPLDGWLRRLGVIEASRENAA

SEQ ID NO: 700605 - protein, 23 aa, Mycobacterium
MGPLDGWLRRLGVIEASRENAAA

SEQ ID NO: 700606 - protein, 26 aa, Mycobacterium
MGPLLKALGLTVGWITADSTADERRE

SEQ ID NO: 700607 - protein, 26 aa, Mycobacterium
MGPLLRRAGVIFIRRNIGANPLYKYV

SEQ ID NO: 700608 - protein, 25 aa, Mycobacterium
MGPLMRRAGMIFIRRNIAGDPLYKY

SEQ ID NO: 700609 - protein, 18 aa, Mycobacterium
MGPMQFLPSTWNHYASDG

SEQ ID NO: 700610 - protein, 20 aa, Mycobacterium
MGPTLSMRGIDNAAYYHLVD

SEQ ID NO: 700611 - protein, 25 aa, Mycobacterium
MGPVLWRVVDWAGYEAALAVLRNAH

SEQ ID NO: 700612 - protein, 17 aa, Mycobacterium
MGPYGWLGLDFAIAEVD

SEQ ID NO: 700613 - protein, 17 aa, Mycobacterium
MGQDWGGPIGMAVSVER

SEQ ID NO: 700614 - protein, 17 aa, Mycobacterium
MGQDWGGPISMAVAVER

SEQ ID NO: 700615 - protein, 18 aa, Mycobacterium
MGQNADYFVRLMAGLGDA

SEQ ID NO: 700616 - protein, 23 aa, Mycobacterium
MGRAEAKSGAAVRDGDGRTYAGA

SEQ ID NO: 700617 - protein, 18 aa, Mycobacterium
MGRATSGVQGMRFNADDR

SEQ ID NO: 700618 - protein, 18 aa, Mycobacterium
MGRATSGVQGMRFNEDDR

SEQ ID NO: 700619 - protein, 18 aa, Mycobacterium
MGRATSGVQGMRFNEEDQ

SEQ ID NO: 700620 - protein, 19 aa, Mycobacterium
MGRATSGVQGMRFNGEDDL

SEQ ID NO: 700621 - protein, 19 aa, Mycobacterium
MGRAWRCGQIDAAVGAAGL

SEQ ID NO: 700622 - protein, 30 aa, Mycobacterium
MGRDGMLGVGWPKEFGGRGFGPIEQQIFVN

SEQ ID NO: 700623 - protein, 30 aa, Mycobacterium
MGREVGPRVAARFGKVLLELGGNNAAIVTP

SEQ ID NO: 700624 - protein, 27 aa, Mycobacterium
MGREVGPRVAARFGRVLLELGGNNAAI

SEQ ID NO: 700625 - protein, 27 aa, Mycobacterium
MGREVGPRVAARFGRVLLELGGNNAAV

SEQ ID NO: 700626 - protein, 22 aa, Mycobacterium
MGREVVRMFPVPPMALRLRTAV

SEQ ID NO: 700627 - protein, 25 aa, Mycobacterium
MGRGKRALVRAGFLAGDALRMLAGT

SEQ ID NO: 700628 - protein, 32 aa, Mycobacterium
MGRIDPRTRWLLRELVHALLVKKDHAAAGKIV

SEQ ID NO: 700629 - protein, 17 aa, Mycobacterium
MGRIDPRTRWLLRELVY

SEQ ID NO: 700630 - protein, 29 aa, Mycobacterium
MGRMGQAFAGLQGRELWHKTIGLVGFGAV

SEQ ID NO: 700631 - protein, 21 aa, Mycobacterium
MGRNGGGWAHYVGQEKCRPVT

SEQ ID NO: 700632 - protein, 18 aa, Mycobacterium
MGRPEEYAKLVAAIVDNP

SEQ ID NO: 700633 - protein, 19 aa, Mycobacterium
MGRRFGREGMRVVLADVLA

SEQ ID NO: 700634 - protein, 20 aa, Mycobacterium
MGRVAGRGFAAYGTAKAALA

SEQ ID NO: 700635 - protein, 24 aa, Mycobacterium
MGSCTEGLWYGVPMVAMPQAVDQP

SEQ ID NO: 700636 - protein, 17 aa, Mycobacterium
MGSGLPSLPSMPGGGSG

SEQ ID NO: 700637 - protein, 17 aa, Mycobacterium
MGSHGAFRSESLGLGAV

SEQ ID NO: 700638 - protein, 34 aa, Mycobacterium
MGSLPRLAAASGKNLGPRYGVIPTVMTRPLSAGY

SEQ ID NO: 700639 - protein, 19 aa, Mycobacterium
MGSRPLLICRGHGIVSASR

SEQ ID NO: 700640 - protein, 18 aa, Mycobacterium
MGSYPYEDLYMLPAARQF

SEQ ID NO: 700641 - protein, 20 aa, Mycobacterium
MGTAAASYLGWLNAAAAHAE

SEQ ID NO: 700642 - protein, 24 aa, Mycobacterium
MGTAKAAFVAVEFDEYGAGQGPRL

SEQ ID NO: 700643 - protein, 20 aa, Mycobacterium
MGTFRLEPGQALVLDIAPPD

SEQ ID NO: 700644 - protein, 18 aa, Mycobacterium
MGTRKSPRLWIVTRGAQQ

SEQ ID NO: 700645 - protein, 22 aa, Mycobacterium
MGTSYLLPRIVGAGVARELMLT

SEQ ID NO: 700646 - protein, 19 aa, Mycobacterium
MGVADGERYSLGDVTLEFR

SEQ ID NO: 700647 - protein, 24 aa, Mycobacterium
MGVAKAAFVAVEFDEYGAGQGPRL

SEQ ID NO: 700648 - protein, 20 aa, Mycobacterium
MGVDLARYGLDEPIGNVDSN

SEQ ID NO: 700649 - protein, 19 aa, Mycobacterium
MGVERGWQATMVLTEPDAG

SEQ ID NO: 700650 - protein, 18 aa, Mycobacterium
MGVHRCIGMHLARQQIRI

SEQ ID NO: 700651 - protein, 17 aa, Mycobacterium
MGVHVIAGRAELIDPTP

SEQ ID NO: 700652 - protein, 17 aa, Mycobacterium
MGVIPLQFPKGQSASSL

SEQ ID NO: 700653 - protein, 19 aa, Mycobacterium
MGVKAGLDPGVMIEVLNAG

SEQ ID NO: 700654 - protein, 23 aa, Mycobacterium
MGVLYGRGELLSAMPPFLTGGSM

SEQ ID NO: 700655 - protein, 25 aa, Mycobacterium
MGVMLTRYPDLFGALVCSVPLLDMK

SEQ ID NO: 700656 - protein, 17 aa, Mycobacterium
MGVNVLGVMAGTRDAAR

SEQ ID NO: 700657 - protein, 19 aa, Mycobacterium
MGVSGCARECAEARSKDVG

SEQ ID NO: 700658 - protein, 24 aa, Mycobacterium
MGVSPARLRQVLDAPVFGTVATID

SEQ ID NO: 700659 - protein, 26 aa, Mycobacterium
MGVSTCATCDGFFFRDQDIVVVGGGD

SEQ ID NO: 700660 - protein, 27 aa, Mycobacterium
MGVVAKRLWRDSGLKPADIQTAFIYDH

SEQ ID NO: 700661 - protein, 17 aa, Mycobacterium
MGVVPAKGLFGVPDGSR

SEQ ID NO: 700662 - protein, 18 aa, Mycobacterium
MGWEEWKAGVEFDGAHHW

SEQ ID NO: 700663 - protein, 21 aa, Mycobacterium
MGWETWKVGVEYDGEHHWGDA

SEQ ID NO: 700664 - protein, 23 aa, Mycobacterium
MGWSPDRYQKWLANALPQLLLRP

SEQ ID NO: 700665 - protein, 18 aa, Mycobacterium
MGYAFGAGIGCAFARPGR

SEQ ID NO: 700666 - protein, 23 aa, Mycobacterium
MGYKELPGSLGAALADMENSELV

SEQ ID NO: 700667 - protein, 17 aa, Mycobacterium
MGYPTAFVERLARRIFN

SEQ ID NO: 700668 - protein, 20 aa, Mycobacterium
MGYRQHLLRSILPLRESGLT

SEQ ID NO: 700669 - protein, 17 aa, Mycobacterium
MHAAAPCPVEIKKQMMD

SEQ ID NO: 700670 - protein, 20 aa, Mycobacterium
MHAAGLWTAFSGFLSGFPVV

SEQ ID NO: 700671 - protein, 23 aa, Mycobacterium
MHAKCPMAWTDTYGGHWVAAGSH

SEQ ID NO: 700672 - protein, 17 aa, Mycobacterium
MHALAVRTAVPLMDKSD

SEQ ID NO: 700673 - protein, 19 aa, Mycobacterium
MHALSIPTTRSLAVVGTGR

SEQ ID NO: 700674 - protein, 17 aa, Mycobacterium
MHAPMVEKALARGTHVF

SEQ ID NO: 700675 - protein, 17 aa, Mycobacterium
MHAPNGIDVFFDNVGGE

SEQ ID NO: 700676 - protein, 17 aa, Mycobacterium
MHARSGLTEEVRRSTVD

SEQ ID NO: 700677 - protein, 18 aa, Mycobacterium
MHARTSGLADYFALDEPD

SEQ ID NO: 700678 - protein, 24 aa, Mycobacterium
MHAVAAGLAVHFVSPTAIEDDLAA

SEQ ID NO: 700679 - protein, 19 aa, Mycobacterium
MHDIDWFEAWAALRGAILL

SEQ ID NO: 700680 - protein, 20 aa, Mycobacterium
MHDLVAFSMLYGGVDSQRPW

SEQ ID NO: 700681 - protein, 29 aa, Mycobacterium
MHDWCISRQLWWGHRIPIWHGPDGETVCV

SEQ ID NO: 700682 - protein, 29 aa, Mycobacterium
MHDWCISRQLWWGHRIPIWHGPGGEIVCL

SEQ ID NO: 700683 - protein, 29 aa, Mycobacterium
MHDWCISRQLWWGHRIPIWHGPNGETVCV

SEQ ID NO: 700684 - protein, 31 aa, Mycobacterium
MHDWCISRQLWWGHRIPIWYGPDGEKVCVGP

SEQ ID NO: 700685 - protein, 32 aa, Mycobacterium
MHDWCISRQLWWGHRIPIWYGPGGEQVCVGPD

SEQ ID NO: 700686 - protein, 31 aa, Mycobacterium
MHDWCISRQLWWGHRIPIWYGPNGEKVCVGP

SEQ ID NO: 700687 - protein, 20 aa, Mycobacterium
MHELDVRDSLGLPAPTDPVT

SEQ ID NO: 700688 - protein, 18 aa, Mycobacterium
MHELIGGTSIDWRDGLRR

SEQ ID NO: 700689 - protein, 18 aa, Mycobacterium
MHGAAQWAAFISLCGGRP

SEQ ID NO: 700690 - protein, 29 aa, Mycobacterium
MHGAEPNMRWRTFCNRLLAIADRLDVSTV

SEQ ID NO: 700691 - protein, 23 aa, Mycobacterium
MHGIPRVFRWSRGVDIERFAPSA

SEQ ID NO: 700692 - protein, 22 aa, Mycobacterium
MHGRVELELIAWRLYTTTRTVH

SEQ ID NO: 700693 - protein, 26 aa, Mycobacterium
MHGVEPNMRWRTFCAELLNIADKLNV

SEQ ID NO: 700694 - protein, 26 aa, Mycobacterium
MHGVEPNMRWRTFCAELVAIADKLNV

SEQ ID NO: 700695 - protein, 17 aa, Mycobacterium
MHIALAAARLAAHAAVF

SEQ ID NO: 700696 - protein, 20 aa, Mycobacterium
MHKLTAPTLLTWGRDDRVSP

SEQ ID NO: 700697 - protein, 17 aa, Mycobacterium
MHLARVEIAIAFEELLA

SEQ ID NO: 700698 - protein, 18 aa, Mycobacterium
MHLTEMSIAYGMTETSPV

SEQ ID NO: 700699 - protein, 18 aa, Mycobacterium
MHLVSPWLDLTARPVQEV

SEQ ID NO: 700700 - protein, 21 aa, Mycobacterium
MHLYFKRAHGSAHLLGTPQQL

SEQ ID NO: 700701 - protein, 21 aa, Mycobacterium
MHLYFKRAHGSTHLLASPPEL

SEQ ID NO: 700702 - protein, 21 aa, Mycobacterium
MHLYFKRAHGSTHLLDSPRNL

SEQ ID NO: 700703 - protein, 23 aa, Mycobacterium
MHNRGGTVFRLLTSGPIRVGDEV

SEQ ID NO: 700704 - protein, 18 aa, Mycobacterium
MHPAVCAAVSALSYEGRL

SEQ ID NO: 700705 - protein, 23 aa, Mycobacterium
MHPAVCAAVSMLSYEGRLQSHAA

SEQ ID NO: 700706 - protein, 17 aa, Mycobacterium
MHPHSRGTVRLAGLTAE

SEQ ID NO: 700707 - protein, 19 aa, Mycobacterium
MHPLGFPSIHSGAWDDFFA

SEQ ID NO: 700708 - protein, 19 aa, Mycobacterium
MHPLIPDDFVFRSATDDSV

SEQ ID NO: 700709 - protein, 17 aa, Mycobacterium
MHPQYVLENGVDFAHFK

SEQ ID NO: 700710 - protein, 27 aa, Mycobacterium
MHPRVRWSASVKLPFALKTLGKTTEWF

SEQ ID NO: 700711 - protein, 20 aa, Mycobacterium
MHPTGYRFARGHRLRLQVSG

SEQ ID NO: 700712 - protein, 20 aa, Mycobacterium
MHQRGVPFTEGFGMTETAPM

SEQ ID NO: 700713 - protein, 17 aa, Mycobacterium
MHRRLAAVIEARVPESA

SEQ ID NO: 700714 - protein, 18 aa, Mycobacterium
MHRRLTDRFDAVIIPGVT

SEQ ID NO: 700715 - protein, 18 aa, Mycobacterium
MHSAFAMLAGLRRRDETG

SEQ ID NO: 700716 - protein, 22 aa, Mycobacterium
MHSRCPVAWTETYDGHWVAAGS

SEQ ID NO: 700717 - protein, 17 aa, Mycobacterium
MHSRSGLTEEVRASTVD

SEQ ID NO: 700718 - protein, 17 aa, Mycobacterium
MHSRVSGLGDYLAVDEQ

SEQ ID NO: 700719 - protein, 17 aa, Mycobacterium
MHTEMWQHPATVDNVAT

SEQ ID NO: 700720 - protein, 17 aa, Mycobacterium
MHVVEPMIVNWPVPPVQ

SEQ ID NO: 700721 - protein, 22 aa, Mycobacterium
MIADRELETWLVVDMSASLDFG

SEQ ID NO: 700722 - protein, 19 aa, Mycobacterium
MIAELAVAYAEIERSQDIW

SEQ ID NO: 700723 - protein, 24 aa, Mycobacterium
MIAEVRRLLDRASRWFLANRQQPL

SEQ ID NO: 700724 - protein, 23 aa, Mycobacterium
MIAIARYFKRSGIVPPRDLVWAF

SEQ ID NO: 700725 - protein, 18 aa, Mycobacterium
MIALCKSAGFSLDEIQLL

SEQ ID NO: 700726 - protein, 18 aa, Mycobacterium
MIALELWAAVHGVAALLI

SEQ ID NO: 700727 - protein, 20 aa, Mycobacterium
MIALKEVVRIAADEAGVAPP

SEQ ID NO: 700728 - protein, 18 aa, Mycobacterium
MIAQKWGFTRTQLDEYSV

SEQ ID NO: 700729 - protein, 24 aa, Mycobacterium
MIARIVAELRTGRGAVIPAVAVAD

SEQ ID NO: 700730 - protein, 17 aa, Mycobacterium
MIASYEFLRLLEHRLQL

SEQ ID NO: 700731 - protein, 24 aa, Mycobacterium
MIATKWGFSRTRLDEYSAQSHERA

SEQ ID NO: 700732 - protein, 26 aa, Mycobacterium
MICDASFPTYMLTHWVRDRPSGRLTV

SEQ ID NO: 700733 - protein, 24 aa, Mycobacterium
MICDSSFPTYLLAHWARDRAEGRM

SEQ ID NO: 700734 - protein, 19 aa, Mycobacterium
MIDELKVGTRLMLSGEVKY

SEQ ID NO: 700735 - protein, 20 aa, Mycobacterium
MIDEYGFSAIKLKGGVFAPE

SEQ ID NO: 700736 - protein, 21 aa, Mycobacterium
MIDIRLDSVVDLDLFKHLHRA

SEQ ID NO: 700737 - protein, 24 aa, Mycobacterium
MIDLEDWAAVALRTLLEPGAHDYA

SEQ ID NO: 700738 - protein, 23 aa, Mycobacterium
MIDPDAWAFVWVVDPPLFEPADE

SEQ ID NO: 700739 - protein, 19 aa, Mycobacterium
MIDRIDARLTTLAMASPKM

SEQ ID NO: 700740 - protein, 33 aa, Mycobacterium
MIDVSSIKELCRRWYPRIYFGQPTKGLAHRALA

SEQ ID NO: 700741 - protein, 35 aa, Mycobacterium
MIDVSSIKELCRRWYPRIYFGQPVKGLAHRALADI

SEQ ID NO: 700742 - protein, 24 aa, Mycobacterium
MIEAKAVVISDPFMAAAPVLEERG

SEQ ID NO: 700743 - protein, 21 aa, Mycobacterium
MIEAMCERSYRTAQTVTNHSD

SEQ ID NO: 700744 - protein, 24 aa, Mycobacterium
MIEMFRGGPDFILHQYRKYGPVYY

SEQ ID NO: 700745 - protein, 20 aa, Mycobacterium
MIEPEVMMEIFARHPGFVHS

SEQ ID NO: 700746 - protein, 44 aa, Mycobacterium
MIEPIEFPELLRLRRWCSGTSNRWCEMRVRIDGRKGGLVESEAF

SEQ ID NO: 700747 - protein, 25 aa, Mycobacterium
MIEPVAALAYRFAQSSTVLFLGRHV

SEQ ID NO: 700748 - protein, 26 aa, Mycobacterium
MIEQIWREFFGALAAEGVQFVTVALV

SEQ ID NO: 700749 - protein, 24 aa, Mycobacterium
MIESLRSGGKVIFFGNGGSAQDAG

SEQ ID NO: 700750 - protein, 24 aa, Mycobacterium
MIFCANPSAGFFILGPTMAQSLYA

SEQ ID NO: 700751 - protein, 24 aa, Mycobacterium
MIFTTDRPIIFAYHGYPWLIHRLT

SEQ ID NO: 700752 - protein, 20 aa, Mycobacterium
MIFYRNMVEAGLEIAPNQAV

SEQ ID NO: 700753 - protein, 17 aa, Mycobacterium
MIGAIAMTEPGTGSDLQ

SEQ ID NO: 700754 - protein, 17 aa, Mycobacterium
MIGATGRVYLSGTEADV

SEQ ID NO: 700755 - protein, 20 aa, Mycobacterium
MIGDIKPGVRGVGVIVPGTN

SEQ ID NO: 700756 - protein, 17 aa, Mycobacterium
MIGESRGQWYLRQMLGS

SEQ ID NO: 700757 - protein, 31 aa, Mycobacterium
MIGGGTSYEALRFGIASDMGRHGLVIQEGLG

SEQ ID NO: 700758 - protein, 24 aa, Mycobacterium
MIGKPGAGLCPVRGHSNVQGDRTM

SEQ ID NO: 700759 - protein, 24 aa, Mycobacterium
MIGKPGAGVCPVRGHSNVQGDRTM

SEQ ID NO: 700760 - protein, 18 aa, Mycobacterium
MIGRAFASAARRALSELC

SEQ ID NO: 700761 - protein, 23 aa, Mycobacterium
MIGRIKGVWTPRQQRVVGEDGFM

SEQ ID NO: 700762 - protein, 23 aa, Mycobacterium
MIGRVAPVERLRLVNSGTEATMS

SEQ ID NO: 700763 - protein, 29 aa, Mycobacterium
MIGSFRYLFPRLRPGGVYIVEDVCANYWT

SEQ ID NO: 700764 - protein, 24 aa, Mycobacterium
MIHESFVKMLHLGAGSYAATEAIN

SEQ ID NO: 700765 - protein, 31 aa, Mycobacterium
MIHGADPWWDIAIRLLIKYANLRLMTSAWSP

SEQ ID NO: 700766 - protein, 19 aa, Mycobacterium
MIHGADPWWDVAIRLLIKY

SEQ ID NO: 700767 - protein, 23 aa, Mycobacterium
MIHPVGACATAAVSLEEGVDKIR

SEQ ID NO: 700768 - protein, 19 aa, Mycobacterium
MIIGLRMITPAGVLDLGRV

SEQ ID NO: 700769 - protein, 18 aa, Mycobacterium
MIIMPLQAATQWDAFSHV

SEQ ID NO: 700770 - protein, 18 aa, Mycobacterium
MIKFRVASNARRRREDGS

SEQ ID NO: 700771 - protein, 23 aa, Mycobacterium
MIKGERPTFSGSWYQAESAMAEP

SEQ ID NO: 700772 - protein, 19 aa, Mycobacterium
MIKGERPTLSGKWYTTESA

SEQ ID NO: 700773 - protein, 24 aa, Mycobacterium
MILGRPRAGLSYETLLATVEQRLP

SEQ ID NO: 700774 - protein, 17 aa, Mycobacterium
MILPPIAHEVRVISIAQ

SEQ ID NO: 700775 - protein, 24 aa, Mycobacterium
MILRGGYNIFAIEVERVLLEMPEV

SEQ ID NO: 700776 - protein, 17 aa, Mycobacterium
MIMELLDAYGIPTAGAP

SEQ ID NO: 700777 - protein, 19 aa, Mycobacterium
MIMLPRTRLGDAHSITDAA

SEQ ID NO: 700778 - protein, 19 aa, Mycobacterium
MINACPATRLVLGGYSLGA

SEQ ID NO: 700779 - protein, 24 aa, Mycobacterium
MINNEFIRRWLADLVAETGSGPGA

SEQ ID NO: 700780 - protein, 24 aa, Mycobacterium
MIPAPTLPMLLPLKDIGVPQPIVD

SEQ ID NO: 700781 - protein, 27 aa, Mycobacterium
MIPDKGRILTAMSVFFFGLVDAPNHLA

SEQ ID NO: 700782 - protein, 18 aa, Mycobacterium
MIPVGRWGRPEELAHAVA

SEQ ID NO: 700783 - protein, 25 aa, Mycobacterium
MIQASFPVECWKQPKVPDTGATSLD

SEQ ID NO: 700784 - protein, 19 aa, Mycobacterium
MIRDFCAQLLDPLVGSGHF

SEQ ID NO: 700785 - protein, 17 aa, Mycobacterium
MIRGTVTNIGLRANDFT

SEQ ID NO: 700786 - protein, 25 aa, Mycobacterium
MIRKGAMKGTTWIKAYEDANVDIGL

SEQ ID NO: 700787 - protein, 25 aa, Mycobacterium
MIRKGAMKSTDWIAAYENQNVDIGL

SEQ ID NO: 700788 - protein, 24 aa, Mycobacterium
MIRLLRLPIAVQRRVAAGVLSAGH

SEQ ID NO: 700789 - protein, 26 aa, Mycobacterium
MIRLLRLPIPVQRRVAAGVLSAGHAR

SEQ ID NO: 700790 - protein, 22 aa, Mycobacterium
MIRMRRLSDRFVRVKNTRAADS

SEQ ID NO: 700791 - protein, 20 aa, Mycobacterium
MIRRATARWRHHGLELELAD

SEQ ID NO: 700792 - protein, 18 aa, Mycobacterium
MIRRGTGGSMVLISSMQG

SEQ ID NO: 700793 - protein, 19 aa, Mycobacterium
MIRVGSLVRMSDLAAHPVV

SEQ ID NO: 700794 - protein, 25 aa, Mycobacterium
MIRVKEMWESIKIVEQCLDRLRPGP

SEQ ID NO: 700795 - protein, 23 aa, Mycobacterium
MIRVNGIHPTNCNTHLLQNEGMY

SEQ ID NO: 700796 - protein, 20 aa, Mycobacterium
MISAQWGLSRTRLDEYSAQS

SEQ ID NO: 700797 - protein, 18 aa, Mycobacterium
MISKRLISEYVHALATEL

SEQ ID NO: 700798 - protein, 17 aa, Mycobacterium
MISQGAGGSIVLISSAA

SEQ ID NO: 700799 - protein, 22 aa, Mycobacterium
MISRMIGLLLHKGCYGRLVADP

SEQ ID NO: 700800 - protein, 17 aa, Mycobacterium
MITAGPDGAMWFTINQG

SEQ ID NO: 700801 - protein, 24 aa, Mycobacterium
MITALARLGGHPVAVVANQPKVLA

SEQ ID NO: 700802 - protein, 19 aa, Mycobacterium
MITETLRYPIQAFTDVGQR

SEQ ID NO: 700803 - protein, 27 aa, Mycobacterium
MITFLIRKGVRFVRCPGWSDYYPNHKG

SEQ ID NO: 700804 - protein, 29 aa, Mycobacterium
MIVDEPFMLPAHIDFAALRVKFDNGTLPP

SEQ ID NO: 700805 - protein, 24 aa, Mycobacterium
MIVDGRGGPQFLPFGAATAGGDTI

SEQ ID NO: 700806 - protein, 18 aa, Mycobacterium
MIVDSGGVLGTMPANVLG

SEQ ID NO: 700807 - protein, 18 aa, Mycobacterium
MIVSCYYGLALVLNAVDL

SEQ ID NO: 700808 - protein, 19 aa, Mycobacterium
MIVTPELTQILSVMSDPYM

SEQ ID NO: 700809 - protein, 19 aa, Mycobacterium
MIVVARHFRRAGIVPPRDL

SEQ ID NO: 700810 - protein, 17 aa, Mycobacterium
MIWIMNWVEIKRGLEAV

SEQ ID NO: 700811 - protein, 18 aa, Mycobacterium
MIYMAWSMSGRGAQEGRT

SEQ ID NO: 700812 - protein, 23 aa, Mycobacterium
MIYREVEGLPKGSVKAVIDAFGE

SEQ ID NO: 700813 - protein, 22 aa, Mycobacterium
MIYREVEGLPKGSVKAVIDAYG

SEQ ID NO: 700814 - protein, 23 aa, Mycobacterium
MIYREVEGLPKGSVKAVIDAYGE

SEQ ID NO: 700815 - protein, 19 aa, Mycobacterium
MIYWDVRPSNKFPTVEVRV

SEQ ID NO: 700816 - protein, 17 aa, Mycobacterium
MKAAALFRSQFEPTEYG

SEQ ID NO: 700817 - protein, 23 aa, Mycobacterium
MKAEGTFEYQALLFIPKHAPFDL

SEQ ID NO: 700818 - protein, 24 aa, Mycobacterium
MKAEGTFEYQALLFIPSHAQHDLF

SEQ ID NO: 700819 - protein, 17 aa, Mycobacterium
MKALWARPKDEVSADEY

SEQ ID NO: 700820 - protein, 20 aa, Mycobacterium
MKANGGGRFVFISSSAGIFG

SEQ ID NO: 700821 - protein, 17 aa, Mycobacterium
MKANRYLHDHGISHRTL

SEQ ID NO: 700822 - protein, 19 aa, Mycobacterium
MKARAVPINVNYRYRHNEL

SEQ ID NO: 700823 - protein, 21 aa, Mycobacterium
MKATLPRAFVIGADGSTTVDT

SEQ ID NO: 700824 - protein, 19 aa, Mycobacterium
MKAYPLWLSGGCMPGKLMP

SEQ ID NO: 700825 - protein, 27 aa, Mycobacterium
MKDFAFRPEPMLARMRAVFADHVLVEL

SEQ ID NO: 700826 - protein, 22 aa, Mycobacterium
MKDMVGMMIVVARHFRRAGIVP

SEQ ID NO: 700827 - protein, 19 aa, Mycobacterium
MKDMVGMMIVVARQLKRAG

SEQ ID NO: 700828 - protein, 17 aa, Mycobacterium
MKDRPALHMVERARSRG

SEQ ID NO: 700829 - protein, 18 aa, Mycobacterium
MKEAGFLAAHSSMSADEA

SEQ ID NO: 700830 - protein, 28 aa, Mycobacterium
MKECHGLQCGFCTPGFVTSITALLRDNP

SEQ ID NO: 700831 - protein, 18 aa, Mycobacterium
MKELTLDVASLVFMGHEP

SEQ ID NO: 700832 - protein, 24 aa, Mycobacterium
MKEQDGVKFLCPVPGYDRHFAITE

SEQ ID NO: 700833 - protein, 20 aa, Mycobacterium
MKFYGVALFRSRGVLPSRLR

SEQ ID NO: 700834 - protein, 20 aa, Mycobacterium
MKGLEFRCVGVAGVGAKFVP

SEQ ID NO: 700835 - protein, 17 aa, Mycobacterium
MKGNLAKAAGLFNAPAS

SEQ ID NO: 700836 - protein, 18 aa, Mycobacterium
MKGNLAKAAGLFNAPASQ

SEQ ID NO: 700837 - protein, 19 aa, Mycobacterium
MKGNLAKAAGLFNAPASQV

SEQ ID NO: 700838 - protein, 17 aa, Mycobacterium
MKGNLNKAAGLFAAPAS

SEQ ID NO: 700839 - protein, 17 aa, Mycobacterium
MKGNLSKAAGLFNAPAS

SEQ ID NO: 700840 - protein, 21 aa, Mycobacterium
MKHIFEGNWIYLAHESQVANP

SEQ ID NO: 700841 - protein, 21 aa, Mycobacterium
MKHIFEGNWVYLAHESQVPNP

SEQ ID NO: 700842 - protein, 18 aa, Mycobacterium
MKHLRAGYWRQVRAQLVV

SEQ ID NO: 700843 - protein, 18 aa, Mycobacterium
MKHMDLGERMWRCEDFVL

SEQ ID NO: 700844 - protein, 20 aa, Mycobacterium
MKIEHARFAGGLHLAGFNTG

SEQ ID NO: 700845 - protein, 21 aa, Mycobacterium
MKIHHCIADGIAAAQLLSYLS

SEQ ID NO: 700846 - protein, 17 aa, Mycobacterium
MKIPAGTVGSVYGYHRG

SEQ ID NO: 700847 - protein, 21 aa, Mycobacterium
MKISHPIVFGHAVRTFYKDAF

SEQ ID NO: 700848 - protein, 27 aa, Mycobacterium
MKIVTCHLGGALPMVLERAHRQVTEWE

SEQ ID NO: 700849 - protein, 20 aa, Mycobacterium
MKKAVAYLLPYIEAEKKPGD

SEQ ID NO: 700850 - protein, 18 aa, Mycobacterium
MKKAWGPVRVAIAAEQLK

SEQ ID NO: 700851 - protein, 17 aa, Mycobacterium
MKKLNWFGKTFVSASEA

SEQ ID NO: 700852 - protein, 17 aa, Mycobacterium
MKKRRGALPGDPSGPNG

SEQ ID NO: 700853 - protein, 17 aa, Mycobacterium
MKLAGAGADVFMPVRNL

SEQ ID NO: 700854 - protein, 18 aa, Mycobacterium
MKLAHRLGVPFVDADALH

SEQ ID NO: 700855 - protein, 17 aa, Mycobacterium
MKLALVHLQLQMGDQAG

SEQ ID NO: 700856 - protein, 23 aa, Mycobacterium
MKLEPGLTLALEPWFGRGTDRLT

SEQ ID NO: 700857 - protein, 20 aa, Mycobacterium
MKLESARLMVYHAAARAERG

SEQ ID NO: 700858 - protein, 19 aa, Mycobacterium
MKLGTEHLVDSTVYLMAHP

SEQ ID NO: 700859 - protein, 25 aa, Mycobacterium
MKLPMLSDWRRPQAELDESSRAAAL

SEQ ID NO: 700860 - protein, 26 aa, Mycobacterium
MKLTHEIVHFSQFILTEIFPGGWLPT

SEQ ID NO: 700861 - protein, 17 aa, Mycobacterium
MKMEIPVLAEVDGTVSK

SEQ ID NO: 700862 - protein, 17 aa, Mycobacterium
MKNVDSFYATAEALQAN

SEQ ID NO: 700863 - protein, 25 aa, Mycobacterium
MKPIAESFGPVALPPTDPRYVDGGP

SEQ ID NO: 700864 - protein, 30 aa, Mycobacterium
MKPKLDVLDFWSMVKPELAGMHGLCTQVTA

SEQ ID NO: 700865 - protein, 19 aa, Mycobacterium
MKPKLDVLDYWELVQRELP

SEQ ID NO: 700866 - protein, 22 aa, Mycobacterium
MKPKLDVVDYWSIIRAELPAVR

SEQ ID NO: 700867 - protein, 25 aa, Mycobacterium
MKPKMDVLEYWNIIRPELPGLRGLC

SEQ ID NO: 700868 - protein, 17 aa, Mycobacterium
MKPQGRLFLYGFSDGHV

SEQ ID NO: 700869 - protein, 19 aa, Mycobacterium
MKPTGWFQVAWSDEIAIGD

SEQ ID NO: 700870 - protein, 22 aa, Mycobacterium
MKPTVWATGCNSWYLTEDGSVD

SEQ ID NO: 700871 - protein, 20 aa, Mycobacterium
MKPWMGEVFDTAYIPDPAQR

SEQ ID NO: 700872 - protein, 21 aa, Mycobacterium
MKPWMGEVFDTAYIPERAQRR

SEQ ID NO: 700873 - protein, 23 aa, Mycobacterium
MKQGEGFLAHMHDPFAAAVALDP

SEQ ID NO: 700874 - protein, 18 aa, Mycobacterium
MKQMSGIEAIRLLHAAQG

SEQ ID NO: 700875 - protein, 17 aa, Mycobacterium
MKQRLISLDAIEITVID

SEQ ID NO: 700876 - protein, 20 aa, Mycobacterium
MKRFHLLLAGASWMAEYGNP

SEQ ID NO: 700877 - protein, 21 aa, Mycobacterium
MKRFHLLLAGASWVAEYGNPD

SEQ ID NO: 700878 - protein, 18 aa, Mycobacterium
MKRHRPQSLVQRLIEPAE

SEQ ID NO: 700879 - protein, 21 aa, Mycobacterium
MKRPKVPIHIAVGTPIEPTLP

SEQ ID NO: 700880 - protein, 24 aa, Mycobacterium
MKRRIDIACGLVVRPEVVFLDEPT

SEQ ID NO: 700881 - protein, 20 aa, Mycobacterium
MKRVCAPGGLVAARDADYAG

SEQ ID NO: 700882 - protein, 19 aa, Mycobacterium
MKSDHGLALPRRLQIEFSQ

SEQ ID NO: 700883 - protein, 20 aa, Mycobacterium
MKSVHRILRNFKMPGFTVPE

SEQ ID NO: 700884 - protein, 17 aa, Mycobacterium
MKTELGYQPKWTTIGAF

SEQ ID NO: 700885 - protein, 26 aa, Mycobacterium
MKTFLVRPAPVPSRFGGSRSMGLPEF

SEQ ID NO: 700886 - protein, 24 aa, Mycobacterium
MKVGLRRGKIIAVRPEHDHGAPSY

SEQ ID NO: 700887 - protein, 24 aa, Mycobacterium
MKVHHCIADGIAAMHMLAGLSDDG

SEQ ID NO: 700888 - protein, 24 aa, Mycobacterium
MKWGMRRLALQTAIQTVLAEFDAA

SEQ ID NO: 700889 - protein, 23 aa, Mycobacterium
MKWLEWAHCRGMSTDLFFSPDHE

SEQ ID NO: 700890 - protein, 17 aa, Mycobacterium
MKWNMGWMHDTLGYLGR

SEQ ID NO: 700891 - protein, 17 aa, Mycobacterium
MKWNMGWMNDTLAYISR

SEQ ID NO: 700892 - protein, 17 aa, Mycobacterium
MKWNMGWMNDTLEFIKR

SEQ ID NO: 700893 - protein, 17 aa, Mycobacterium
MKYPAVWMTGEYAKGEV

SEQ ID NO: 700894 - protein, 20 aa, Mycobacterium
MLAAAAAWDALAAELQSTAS

SEQ ID NO: 700895 - protein, 19 aa, Mycobacterium
MLAAAAAWDGLAAELHSTA

SEQ ID NO: 700896 - protein, 20 aa, Mycobacterium
MLAAAASWEALAADLANTAS

SEQ ID NO: 700897 - protein, 31 aa, Mycobacterium
MLAATGIRPNLDFPTGPAYHLMGFDIGSFTP

SEQ ID NO: 700898 - protein, 23 aa, Mycobacterium
MLAAVAPYTSWLGAVSAMAEETA

SEQ ID NO: 700899 - protein, 17 aa, Mycobacterium
MLACADVTLAPGPHETF

SEQ ID NO: 700900 - protein, 25 aa, Mycobacterium
MLACARLGAMHSVVFAGFSASALKA

SEQ ID NO: 700901 - protein, 27 aa, Mycobacterium
MLACARLGATHSVVFGGFAAHELAARI

SEQ ID NO: 700902 - protein, 18 aa, Mycobacterium
MLACRVGDDIFAYRDHCP

SEQ ID NO: 700903 - protein, 17 aa, Mycobacterium
MLADPLAGIGPGLGQFI

SEQ ID NO: 700904 - protein, 17 aa, Mycobacterium
MLADRGLVISAGKMSGL

SEQ ID NO: 700905 - protein, 20 aa, Mycobacterium
MLADTGLGWDATRLASQAAL

SEQ ID NO: 700906 - protein, 17 aa, Mycobacterium
MLAEAGWGLTETKDREY

SEQ ID NO: 700907 - protein, 17 aa, Mycobacterium
MLAEHRLPGLLVTKPSG

SEQ ID NO: 700908 - protein, 19 aa, Mycobacterium
MLAFLQKRPPSWVKADPAS

SEQ ID NO: 700909 - protein, 17 aa, Mycobacterium
MLAGGCGLFDRAILQSG

SEQ ID NO: 700910 - protein, 19 aa, Mycobacterium
MLAGPGVERGLLGPREVER

SEQ ID NO: 700911 - protein, 24 aa, Mycobacterium
MLAGSAKRSYWWAGTATLGVAKII

SEQ ID NO: 700912 - protein, 17 aa, Mycobacterium
MLAGYWAANRVMGHLGW

SEQ ID NO: 700913 - protein, 22 aa, Mycobacterium
MLAHIRRARAIQARIEDARLGE

SEQ ID NO: 700914 - protein, 20 aa, Mycobacterium
MLAMMVMRLAAQMPIVESPK

SEQ ID NO: 700915 - protein, 20 aa, Mycobacterium
MLANRPKFDSKRLVRDDDVP

SEQ ID NO: 700916 - protein, 26 aa, Mycobacterium
MLAPFPPVRPMLRLLTKLGTAEALRV

SEQ ID NO: 700917 - protein, 19 aa, Mycobacterium
MLAPNGVGVLYARRQLLSE

SEQ ID NO: 700918 - protein, 25 aa, Mycobacterium
MLAPRKLRSIVVLALPRGGIPVGRE

SEQ ID NO: 700919 - protein, 18 aa, Mycobacterium
MLAQRLGAWVPLQEVPEV

SEQ ID NO: 700920 - protein, 24 aa, Mycobacterium
MLARCVIGLQWIPENILHFVGTRA

SEQ ID NO: 700921 - protein, 22 aa, Mycobacterium
MLARLERRLGVQLFDRHGKRLA

SEQ ID NO: 700922 - protein, 18 aa, Mycobacterium
MLASARFRAGLKKIPGAT

SEQ ID NO: 700923 - protein, 19 aa, Mycobacterium
MLASRLSQVVGREVPPMEV

SEQ ID NO: 700924 - protein, 22 aa, Mycobacterium
MLATAGPFVEWLETTAAQAKES

SEQ ID NO: 700925 - protein, 22 aa, Mycobacterium
MLATVGRFYARWSHLTADTEEE

SEQ ID NO: 700926 - protein, 27 aa, Mycobacterium
MLATVSRWLPTPALDALRRRVFGLPKP

SEQ ID NO: 700927 - protein, 20 aa, Mycobacterium
MLAVLLDFFNYFAALTASRR

SEQ ID NO: 700928 - protein, 20 aa, Mycobacterium
MLAVSLSAYEHWLADETACL

SEQ ID NO: 700929 - protein, 23 aa, Mycobacterium
MLCAHRRGPFGVGHWNRQVEAWL

SEQ ID NO: 700930 - protein, 24 aa, Mycobacterium
MLCGGRLSVGIGVGGRHEDYHAVG

SEQ ID NO: 700931 - protein, 18 aa, Mycobacterium
MLCYSRCFEHVNVVTTRQ

SEQ ID NO: 700932 - protein, 21 aa, Mycobacterium
MLDAAAAWQGLAKELASAADS

SEQ ID NO: 700933 - protein, 22 aa, Mycobacterium
MLDAFHPGRIDLGIGRSGRRAR

SEQ ID NO: 700934 - protein, 19 aa, Mycobacterium
MLDALCADQDIAAIVDGGA

SEQ ID NO: 700935 - protein, 18 aa, Mycobacterium
MLDAMKPITDRAPITDAL

SEQ ID NO: 700936 - protein, 18 aa, Mycobacterium
MLDAQRFRAARVVIDIGV

SEQ ID NO: 700937 - protein, 26 aa, Mycobacterium
MLDEIPGTAVPLVFAMLGENGVHAPL

SEQ ID NO: 700938 - protein, 18 aa, Mycobacterium
MLDHIALRRREGLAAVLV

SEQ ID NO: 700939 - protein, 24 aa, Mycobacterium
MLDLGFLPDIERILALAPSADAGR

SEQ ID NO: 700940 - protein, 20 aa, Mycobacterium
MLDLGFLPDIERILRQIPAD

SEQ ID NO: 700941 - protein, 20 aa, Mycobacterium
MLDLGFLPDIERILRQIPAE

SEQ ID NO: 700942 - protein, 19 aa, Mycobacterium
MLDLGFLPDIERILRQIPE

SEQ ID NO: 700943 - protein, 18 aa, Mycobacterium
MLDLKILLNVAFDGEKLS

SEQ ID NO: 700944 - protein, 20 aa, Mycobacterium
MLDLKVLLNHVFDGEKLSDE

SEQ ID NO: 700945 - protein, 17 aa, Mycobacterium
MLDMRRTFDELVIQHAG

SEQ ID NO: 700946 - protein, 18 aa, Mycobacterium
MLDPEERTASLALRNGGP

SEQ ID NO: 700947 - protein, 18 aa, Mycobacterium
MLDRRFLDEAGWDPRTRV

SEQ ID NO: 700948 - protein, 25 aa, Mycobacterium
MLDRTRPLWQGIWVDRYRDGSAMIV

SEQ ID NO: 700949 - protein, 28 aa, Mycobacterium
MLDSAYLGHVIVLWSWALKQPAVGNAES

SEQ ID NO: 700950 - protein, 27 aa, Mycobacterium
MLDVLRFWLDLGIDGFRLDAVPYLFER

SEQ ID NO: 700951 - protein, 24 aa, Mycobacterium
MLDYFCYVWLVEGGERGRSAVTDE

SEQ ID NO: 700952 - protein, 18 aa, Mycobacterium
MLEAAVIAGLTSEGVDAL

SEQ ID NO: 700953 - protein, 19 aa, Mycobacterium
MLEAEGFRGGMLEMDDPEH

SEQ ID NO: 700954 - protein, 18 aa, Mycobacterium
MLEAPYTGSVVKISPVRS

SEQ ID NO: 700955 - protein, 17 aa, Mycobacterium
MLELLLRELDVAPGDVI

SEQ ID NO: 700956 - protein, 17 aa, Mycobacterium
MLELLLRELDVAPGDVV

SEQ ID NO: 700957 - protein, 20 aa, Mycobacterium
MLELPIYRALVAARGETQEV

SEQ ID NO: 700958 - protein, 29 aa, Mycobacterium
MLEMAACGAKVLMLRCVEYARRHNIPVHV

SEQ ID NO: 700959 - protein, 17 aa, Mycobacterium
MLEMAGFFGHEGHGLVH

SEQ ID NO: 700960 - protein, 18 aa, Mycobacterium
MLEQMGWIVVRVVAEDRP

SEQ ID NO: 700961 - protein, 17 aa, Mycobacterium
MLERARANEKITFLTNT

SEQ ID NO: 700962 - protein, 17 aa, Mycobacterium
MLERHGGTDLTDPRRAL

SEQ ID NO: 700963 - protein, 17 aa, Mycobacterium
MLERQRGDLIFVGSDVA

SEQ ID NO: 700964 - protein, 25 aa, Mycobacterium
MLESLDCWPVNFALLGKGNTVSHEG

SEQ ID NO: 700965 - protein, 25 aa, Mycobacterium
MLEVLRRWPELRADMDATVEARGDF

SEQ ID NO: 700966 - protein, 26 aa, Mycobacterium
MLFADVTLSPGFRERWFSWANPAETM

SEQ ID NO: 700967 - protein, 18 aa, Mycobacterium
MLFAPELALARAWTMVAR

SEQ ID NO: 700968 - protein, 20 aa, Mycobacterium
MLFHAWHLYSDLGLNVVLPV

SEQ ID NO: 700969 - protein, 19 aa, Mycobacterium
MLFPHLYGPLPIAAVTSVA

SEQ ID NO: 700970 - protein, 19 aa, Mycobacterium
MLFTHAKITAGARVLVQGV

SEQ ID NO: 700971 - protein, 22 aa, Mycobacterium
MLFTNWPRPVLTTAEGDEMQAA

SEQ ID NO: 700972 - protein, 17 aa, Mycobacterium
MLFVPDRVGGLQVTEGP

SEQ ID NO: 700973 - protein, 23 aa, Mycobacterium
MLGAAEPYIAWLSATSAQAEQTA

SEQ ID NO: 700974 - protein, 18 aa, Mycobacterium
MLGAIAVPLNFRLTAAEI

SEQ ID NO: 700975 - protein, 17 aa, Mycobacterium
MLGAIAVPLNFRLTPTE

SEQ ID NO: 700976 - protein, 25 aa, Mycobacterium
MLGCKTGEGFRRWSPADIAEMNNRL

SEQ ID NO: 700977 - protein, 20 aa, Mycobacterium
MLGDILRGWTPDDARQAEWR

SEQ ID NO: 700978 - protein, 17 aa, Mycobacterium
MLGDLAAAWRSLQAGTP

SEQ ID NO: 700979 - protein, 18 aa, Mycobacterium
MLGDVWEWTASPLRPWPG

SEQ ID NO: 700980 - protein, 26 aa, Mycobacterium
MLGEMPGVAVPLVFRLLGETGVHAPV

SEQ ID NO: 700981 - protein, 17 aa, Mycobacterium
MLGGAAEHRAQIAQEYR

SEQ ID NO: 700982 - protein, 17 aa, Mycobacterium
MLGGLPLGQLANAGGGN

SEQ ID NO: 700983 - protein, 20 aa, Mycobacterium
MLGKRRVWISAIVQPSEIDE

SEQ ID NO: 700984 - protein, 18 aa, Mycobacterium
MLGPSGVGVLYGRRALLE

SEQ ID NO: 700985 - protein, 18 aa, Mycobacterium
MLGRPPLKSATREEQLRA

SEQ ID NO: 700986 - protein, 18 aa, Mycobacterium
MLGSPNAGYFVLDGDQSA

SEQ ID NO: 700987 - protein, 17 aa, Mycobacterium
MLGSVMGAMLGPLGGIV

SEQ ID NO: 700988 - protein, 19 aa, Mycobacterium
MLGVALSAYEHWLSDESVP

SEQ ID NO: 700989 - protein, 20 aa, Mycobacterium
MLGVALSAYEHWLSDESVPL

SEQ ID NO: 700990 - protein, 20 aa, Mycobacterium
MLGVALSAYENWLADESVSL

SEQ ID NO: 700991 - protein, 19 aa, Mycobacterium
MLGVPRADAPFLLEWGNHG

SEQ ID NO: 700992 - protein, 19 aa, Mycobacterium
MLHALALGADWIWLADDDG

SEQ ID NO: 700993 - protein, 21 aa, Mycobacterium
MLHALALGADWVWLADDDGRP

SEQ ID NO: 700994 - protein, 24 aa, Mycobacterium
MLHAMLTAAGRRSVLCGNIGDPVL

SEQ ID NO: 700995 - protein, 24 aa, Mycobacterium
MLHAMLTAAGRRSVLCGNIGSPVL

SEQ ID NO: 700996 - protein, 19 aa, Mycobacterium
MLHGEPVTAFAFYERSLAL

SEQ ID NO: 700997 - protein, 22 aa, Mycobacterium
MLHGRASLRPDDIAFTFTDYTN

SEQ ID NO: 700998 - protein, 21 aa, Mycobacterium
MLHGRASLRPHDVAYTFTDYQ

SEQ ID NO: 700999 - protein, 27 aa, Mycobacterium
MLHPLSAPMTLRWLTDRFAGLPLTEHV

SEQ ID NO: 701000 - protein, 26 aa, Mycobacterium
MLHPLSAPMTLRWLTDRFEGRPLTEH

SEQ ID NO: 701001 - protein, 20 aa, Mycobacterium
MLHQLRRAAPQVDFRAVNDR

SEQ ID NO: 701002 - protein, 20 aa, Mycobacterium
MLHRVSRLLALVTNRVLNGD

SEQ ID NO: 701003 - protein, 19 aa, Mycobacterium
MLHSAPMYRAFRPDLPNPK

SEQ ID NO: 701004 - protein, 21 aa, Mycobacterium
MLHSPPMYRAFRPDLAEPTRE

SEQ ID NO: 701005 - protein, 22 aa, Mycobacterium
MLHSPPMYRAFRPDLKEPTRAD

SEQ ID NO: 701006 - protein, 29 aa, Mycobacterium
MLHVVGFRDGKAFYRNRFVRTDGLLEENA

SEQ ID NO: 701007 - protein, 18 aa, Mycobacterium
MLIFRPAPGLGRAETPIE

SEQ ID NO: 701008 - protein, 18 aa, Mycobacterium
MLIGIPVVYTSDYLVPEE

SEQ ID NO: 701009 - protein, 20 aa, Mycobacterium
MLIRRGEEWVAKAVEALAVD

SEQ ID NO: 701010 - protein, 18 aa, Mycobacterium
MLIVPGSMRVRAQAEAEG

SEQ ID NO: 701011 - protein, 18 aa, Mycobacterium
MLIVPGSMRVRAQAESEG

SEQ ID NO: 701012 - protein, 24 aa, Mycobacterium
MLKRIAAVPDISRRDLSSIDFILQ

SEQ ID NO: 701013 - protein, 22 aa, Mycobacterium
MLKTRLRTGLPAATLSARERER

SEQ ID NO: 701014 - protein, 23 aa, Mycobacterium
MLKTYVPDRWVYRTLTVNYRTPA

SEQ ID NO: 701015 - protein, 24 aa, Mycobacterium
MLKVLTRWPELRGDMDANVDARQE

SEQ ID NO: 701016 - protein, 18 aa, Mycobacterium
MLLARQGFQVIVQDTRGQ

SEQ ID NO: 701017 - protein, 18 aa, Mycobacterium
MLLASPQLVGYVSELPAP

SEQ ID NO: 701018 - protein, 17 aa, Mycobacterium
MLLDAGRLQDGEPHLAG

SEQ ID NO: 701019 - protein, 18 aa, Mycobacterium
MLLEFGVVSHRYRHAVGE

SEQ ID NO: 701020 - protein, 36 aa, Mycobacterium
MLLEPGLGFFPWGMVDQHFIKRGRFGRLVVGMQASG

SEQ ID NO: 701021 - protein, 23 aa, Mycobacterium
MLLGRPLMAWMFQRFLHNLRRYS

SEQ ID NO: 701022 - protein, 18 aa, Mycobacterium
MLLGSGVLQLGIRSPVAV

SEQ ID NO: 701023 - protein, 29 aa, Mycobacterium
MLLHGFGSFWWSWRHQLRGLTGARVVAVD

SEQ ID NO: 701024 - protein, 17 aa, Mycobacterium
MLLHGGGTVHWLEPPAG

SEQ ID NO: 701025 - protein, 17 aa, Mycobacterium
MLLHPAGVLGLSDGGAH

SEQ ID NO: 701026 - protein, 17 aa, Mycobacterium
MLLHQAFAQVEQFTGMP

SEQ ID NO: 701027 - protein, 20 aa, Mycobacterium
MLLLWIRGVRFMYTVDPLLA

SEQ ID NO: 701028 - protein, 21 aa, Mycobacterium
MLLMRAGREYALKRALAKLDG

SEQ ID NO: 701029 - protein, 21 aa, Mycobacterium
MLLMRAGREYALKRALAKLSD

SEQ ID NO: 701030 - protein, 20 aa, Mycobacterium
MLLQPGILGIAWGTAIRQLA

SEQ ID NO: 701031 - protein, 19 aa, Mycobacterium
MLLQPGVLGIAWGTAIRQL

SEQ ID NO: 701032 - protein, 26 aa, Mycobacterium
MLLQPGVLSLAWGSVVRQLAAGLDIE

SEQ ID NO: 701033 - protein, 26 aa, Mycobacterium
MLLSEHIRLLAAFDHRHIFIDPTPDA

SEQ ID NO: 701034 - protein, 26 aa, Mycobacterium
MLMAALRLNIPAVFVSGGPMEGGRAT

SEQ ID NO: 701035 - protein, 18 aa, Mycobacterium
MLMAQRMKMLGLPPNLRS

SEQ ID NO: 701036 - protein, 26 aa, Mycobacterium
MLMERFSINAAEAFTVIRTLSQDFNT

SEQ ID NO: 701037 - protein, 26 aa, Mycobacterium
MLMERYRIDAGQAFEVLKKLSQGANT

SEQ ID NO: 701038 - protein, 19 aa, Mycobacterium
MLMFPLCGGRMTLMSPLSF

SEQ ID NO: 701039 - protein, 25 aa, Mycobacterium
MLMIPPFMHGAAQWASYTAITMGGK

SEQ ID NO: 701040 - protein, 18 aa, Mycobacterium
MLMPCFAQLYSDLGITKS

SEQ ID NO: 701041 - protein, 26 aa, Mycobacterium
MLNELDRVGGRYGLQTMCEGGGTANV

SEQ ID NO: 701042 - protein, 23 aa, Mycobacterium
MLNPCPMLTLGGLVVDEETGAVQ

SEQ ID NO: 701043 - protein, 22 aa, Mycobacterium
MLNQHAKWLATSRELPWRRPIA

SEQ ID NO: 701044 - protein, 19 aa, Mycobacterium
MLNRAIALAATRRALTVHP

SEQ ID NO: 701045 - protein, 23 aa, Mycobacterium
MLNRARHELLLGAARDPDLAETA

SEQ ID NO: 701046 - protein, 22 aa, Mycobacterium
MLNRARHELLLNAVRDPELSGP

SEQ ID NO: 701047 - protein, 18 aa, Mycobacterium
MLNVKIGGARRCAAQSWS

SEQ ID NO: 701048 - protein, 18 aa, Mycobacterium
MLPDAALAQPAVWEALID

SEQ ID NO: 701049 - protein, 33 aa, Mycobacterium
MLPEAIVAMLACARLGLMHSVVFAGFSAAALRA

SEQ ID NO: 701050 - protein, 19 aa, Mycobacterium
MLPEPMVGSVILRVACSAF

SEQ ID NO: 701051 - protein, 20 aa, Mycobacterium
MLPHFVEFAGQNIIDAFVGP

SEQ ID NO: 701052 - protein, 17 aa, Mycobacterium
MLPKAIDAGVRIACGTD

SEQ ID NO: 701053 - protein, 20 aa, Mycobacterium
MLPLLNRGASIVLTGSTAAY

SEQ ID NO: 701054 - protein, 25 aa, Mycobacterium
MLPLPARATVTWSLTGALQLMLFPE

SEQ ID NO: 701055 - protein, 37 aa, Mycobacterium
MLPNGELVKRCYAEILPAARPGALFIDSSTISVDDAR

SEQ ID NO: 701056 - protein, 19 aa, Mycobacterium
MLPNNAVEYFVSYYDYYQP

SEQ ID NO: 701057 - protein, 25 aa, Mycobacterium
MLPNWVEYPEFLFGINELGAIYAGI

SEQ ID NO: 701058 - protein, 20 aa, Mycobacterium
MLPPGVSTLSWLDAAQLPLA

SEQ ID NO: 701059 - protein, 20 aa, Mycobacterium
MLQAAAAWDGLAAELSSAAD

SEQ ID NO: 701060 - protein, 21 aa, Mycobacterium
MLQAAAAWDGLAEELGTAAQS

SEQ ID NO: 701061 - protein, 21 aa, Mycobacterium
MLQAAAGWEAFAISLETQADE

SEQ ID NO: 701062 - protein, 18 aa, Mycobacterium
MLQDLGLLRKYKGQLLLT

SEQ ID NO: 701063 - protein, 24 aa, Mycobacterium
MLQDRDMLIFAWGATVPMIAHAAG

SEQ ID NO: 701064 - protein, 20 aa, Mycobacterium
MLQIPDKFFRAVLAEQGSFE

SEQ ID NO: 701065 - protein, 23 aa, Mycobacterium
MLQMGFAEDVERILADTPEYKQV

SEQ ID NO: 701066 - protein, 18 aa, Mycobacterium
MLQQGWQRLVASILDCDK

SEQ ID NO: 701067 - protein, 18 aa, Mycobacterium
MLQRAEARLHPKDFGPIE

SEQ ID NO: 701068 - protein, 21 aa, Mycobacterium
MLQRCVDGLLASGAVDEVVVV

SEQ ID NO: 701069 - protein, 24 aa, Mycobacterium
MLQRREAWEIIDYVNRLSDPSALA

SEQ ID NO: 701070 - protein, 23 aa, Mycobacterium
MLQRREAWEIVDYVNRLTDPSAL

SEQ ID NO: 701071 - protein, 18 aa, Mycobacterium
MLQRSCGSDDLAHAENGW

SEQ ID NO: 701072 - protein, 23 aa, Mycobacterium
MLQSVQPYLLWLRETALQSAQMA

SEQ ID NO: 701073 - protein, 21 aa, Mycobacterium
MLRAARFVAQLGFAVAPRVRE

SEQ ID NO: 701074 - protein, 21 aa, Mycobacterium
MLRAARFVSQLGFAVAPRVRD

SEQ ID NO: 701075 - protein, 21 aa, Mycobacterium
MLRAARFVSQLGFSVAPRVLE

SEQ ID NO: 701076 - protein, 21 aa, Mycobacterium
MLRAARFVSQLGFTVAPRVLE

SEQ ID NO: 701077 - protein, 21 aa, Mycobacterium
MLRAARFVSQLGFTVAPRVRA

SEQ ID NO: 701078 - protein, 21 aa, Mycobacterium
MLRAARFVSQLGFTVAPRVRR

SEQ ID NO: 701079 - protein, 21 aa, Mycobacterium
MLRAARFVSQLGFTVAPRVRT

SEQ ID NO: 701080 - protein, 23 aa, Mycobacterium
MLRADLRAAAVFATDTARSCAEW

SEQ ID NO: 701081 - protein, 19 aa, Mycobacterium
MLRAECARLNRAGLTTCSE

SEQ ID NO: 701082 - protein, 22 aa, Mycobacterium
MLRAGRRALVMQVDIFGDSADE

SEQ ID NO: 701083 - protein, 26 aa, Mycobacterium
MLRAMGLPDLPVFVLECAILADRVIV

SEQ ID NO: 701084 - protein, 27 aa, Mycobacterium
MLRAMRPDLTIGFFLHIPFPPVELFMQ

SEQ ID NO: 701085 - protein, 19 aa, Mycobacterium
MLRANAALAARTGVPDENI

SEQ ID NO: 701086 - protein, 18 aa, Mycobacterium
MLRANAKLAAGTGVPEES

SEQ ID NO: 701087 - protein, 17 aa, Mycobacterium
MLRANAKLAASAGVAPE

SEQ ID NO: 701088 - protein, 18 aa, Mycobacterium
MLRANAKLAASTGVPEES

SEQ ID NO: 701089 - protein, 18 aa, Mycobacterium
MLRANSKLAARTGVPEES

SEQ ID NO: 701090 - protein, 19 aa, Mycobacterium
MLRASWRRLGGHAAALLPG

SEQ ID NO: 701091 - protein, 18 aa, Mycobacterium
MLRAVGMGDADWAKPQIG

SEQ ID NO: 701092 - protein, 18 aa, Mycobacterium
MLRAVGMVDEDFAKAQIG

SEQ ID NO: 701093 - protein, 20 aa, Mycobacterium
MLRDLCLTLGVTVVASTHDP

SEQ ID NO: 701094 - protein, 23 aa, Mycobacterium
MLREAIKIIRELFGGHLVNFTGD

SEQ ID NO: 701095 - protein, 19 aa, Mycobacterium
MLREALIRRMYRRSSAEGQ

SEQ ID NO: 701096 - protein, 18 aa, Mycobacterium
MLREARVPAARMGKPSEI

SEQ ID NO: 701097 - protein, 27 aa, Mycobacterium
MLREFHRVLRPAGALVLSRMHPTGDWL

SEQ ID NO: 701098 - protein, 20 aa, Mycobacterium
MLREYIEAMRELWTKEEAAY

SEQ ID NO: 701099 - protein, 20 aa, Mycobacterium
MLREYIEAMRRLWEEEEASY

SEQ ID NO: 701100 - protein, 21 aa, Mycobacterium
MLRHMWRFWYQVPMSLPVIGP

SEQ ID NO: 701101 - protein, 21 aa, Mycobacterium
MLRHRGPQLLPAVFSKVQERC

SEQ ID NO: 701102 - protein, 21 aa, Mycobacterium
MLRKAGERFGFAVEAMSLVAE

SEQ ID NO: 701103 - protein, 21 aa, Mycobacterium
MLRKNKCFSLAASRGKGQRVP

SEQ ID NO: 701104 - protein, 21 aa, Mycobacterium
MLRKRAAPLIAKYRLGGEHRE

SEQ ID NO: 701105 - protein, 17 aa, Mycobacterium
MLRLCVDDDGAGGWTLH

SEQ ID NO: 701106 - protein, 26 aa, Mycobacterium
MLRMLRPDLTIGFFLHIPFPPVELFL

SEQ ID NO: 701107 - protein, 27 aa, Mycobacterium
MLRMLRPDLTIGFFLHIPFPPVELFMQ

SEQ ID NO: 701108 - protein, 26 aa, Mycobacterium
MLRMLRPDVTIGFFLHIPFPPVELFM

SEQ ID NO: 701109 - protein, 23 aa, Mycobacterium
MLRQGVLTEGWRLNPGSDPVAAE

SEQ ID NO: 701110 - protein, 25 aa, Mycobacterium
MLRRTTPMKLFWAREYSDYHPEQPG

SEQ ID NO: 701111 - protein, 21 aa, Mycobacterium
MLRTELRSLASTHVRLGDVRG

SEQ ID NO: 701112 - protein, 18 aa, Mycobacterium
MLRTLLGERLPQYMVPAA

SEQ ID NO: 701113 - protein, 17 aa, Mycobacterium
MLRVHVGGLAHVCRAVL

SEQ ID NO: 701114 - protein, 21 aa, Mycobacterium
MLRVLRFLLGAGYAPTVVDLP

SEQ ID NO: 701115 - protein, 22 aa, Mycobacterium
MLRYSPHSWQRVTLFERAKLAR

SEQ ID NO: 701116 - protein, 24 aa, Mycobacterium
MLSGGRLTVGLGIGGREEDYRAVG

SEQ ID NO: 701117 - protein, 19 aa, Mycobacterium
MLSGVPNLVFALGYTNISW

SEQ ID NO: 701118 - protein, 18 aa, Mycobacterium
MLSHLLHAIAKVAPQHLA

SEQ ID NO: 701119 - protein, 18 aa, Mycobacterium
MLSLVGKDMAHWVDRPLE

SEQ ID NO: 701120 - protein, 18 aa, Mycobacterium
MLSNRLAYALNLMGPALT

SEQ ID NO: 701121 - protein, 17 aa, Mycobacterium
MLSPTGRCHAFDVAADG

SEQ ID NO: 701122 - protein, 23 aa, Mycobacterium
MLSQLNYRASAYLNDGAEPRRHP

SEQ ID NO: 701123 - protein, 18 aa, Mycobacterium
MLSWVRVIRTGPGALADD

SEQ ID NO: 701124 - protein, 17 aa, Mycobacterium
MLTAACPGLIFTSPNAL

SEQ ID NO: 701125 - protein, 26 aa, Mycobacterium
MLTCAIRPSGIWGRGDQTMFRKLFES

SEQ ID NO: 701126 - protein, 24 aa, Mycobacterium
MLTCAIRPSGIWGTGDQLMFRKLF

SEQ ID NO: 701127 - protein, 23 aa, Mycobacterium
MLTDGRFIGFVVARRQRALLGVA

SEQ ID NO: 701128 - protein, 24 aa, Mycobacterium
MLTFLKGRLQVVDHLKRYPEVFDI

SEQ ID NO: 701129 - protein, 21 aa, Mycobacterium
MLTGAAERWFAPGFVDREPGT

SEQ ID NO: 701130 - protein, 17 aa, Mycobacterium
MLTGIRVEINGDTVVLA

SEQ ID NO: 701131 - protein, 18 aa, Mycobacterium
MLTGIRVEISGDTVVLAA

SEQ ID NO: 701132 - protein, 19 aa, Mycobacterium
MLTGIRVEISGEKVVLAAT

SEQ ID NO: 701133 - protein, 19 aa, Mycobacterium
MLTKGEFDAAATLLEPAAA

SEQ ID NO: 701134 - protein, 35 aa, Mycobacterium
MLTLPETFGLYLERAWPRHRRLSGTVDAATATIVA

SEQ ID NO: 701135 - protein, 25 aa, Mycobacterium
MLTMGLGGGYVTEWVGDPAAVTEYN

SEQ ID NO: 701136 - protein, 22 aa, Mycobacterium
MLTMGLGGGYVTSWVGDPAAVT

SEQ ID NO: 701137 - protein, 18 aa, Mycobacterium
MLTPRRFGGYAVAPRTVV

SEQ ID NO: 701138 - protein, 21 aa, Mycobacterium
MLTRRRIFVPMLRVTAIEPGS

SEQ ID NO: 701139 - protein, 20 aa, Mycobacterium
MLTRYWHAFAAKDVPAALAC

SEQ ID NO: 701140 - protein, 18 aa, Mycobacterium
MLVARLAVLASRHEALRL

SEQ ID NO: 701141 - protein, 25 aa, Mycobacterium
MLVGARLNWLLGHGDAPQWNPDAKF

SEQ ID NO: 701142 - protein, 20 aa, Mycobacterium
MLVNPWGLWWQEITASDICV

SEQ ID NO: 701143 - protein, 19 aa, Mycobacterium
MLVNPWGLWWQELTASDIC

SEQ ID NO: 701144 - protein, 19 aa, Mycobacterium
MLVQHLLERGLRVEIPGVD

SEQ ID NO: 701145 - protein, 22 aa, Mycobacterium
MLVQRPDGVYGRIVPVAEPLDQ

SEQ ID NO: 701146 - protein, 25 aa, Mycobacterium
MLVRANVGTIWFRVRVAGHPTHPRE

SEQ ID NO: 701147 - protein, 23 aa, Mycobacterium
MLVRPDAHLAWRGAHDDPTGLDR

SEQ ID NO: 701148 - protein, 20 aa, Mycobacterium
MLVRRLRSAINAEKLQCIGT

SEQ ID NO: 701149 - protein, 19 aa, Mycobacterium
MLVVPGSMRVRAQAEDEGL

SEQ ID NO: 701150 - protein, 24 aa, Mycobacterium
MLVYGVDEMAAFNLLKSLSQVRNM

SEQ ID NO: 701151 - protein, 18 aa, Mycobacterium
MLVYRLNADAAFDVLKWR

SEQ ID NO: 701152 - protein, 23 aa, Mycobacterium
MLYKKSSVLFGLDLAKRDIAKGH

SEQ ID NO: 701153 - protein, 21 aa, Mycobacterium
MLYPGVPGLASAARNSAGFGA

SEQ ID NO: 701154 - protein, 17 aa, Mycobacterium
MLYPTSFLKGRGLGKSC

SEQ ID NO: 701155 - protein, 18 aa, Mycobacterium
MMADCFDLTLDEVKFSYE

SEQ ID NO: 701156 - protein, 19 aa, Mycobacterium
MMADCFDLTLDEVKFSYEL

SEQ ID NO: 701157 - protein, 27 aa, Mycobacterium
MMADCFDLTLDEVRFSYELGACTKDVD

SEQ ID NO: 701158 - protein, 25 aa, Mycobacterium
MMADSQRTIVCWAMGLTQHKHAVPS

SEQ ID NO: 701159 - protein, 19 aa, Mycobacterium
MMAELCRELGLPLVVDAAQ

SEQ ID NO: 701160 - protein, 19 aa, Mycobacterium
MMAHREIVRAGYAYVAISA

SEQ ID NO: 701161 - protein, 18 aa, Mycobacterium
MMALGIIDECHRLCVDYA

SEQ ID NO: 701162 - protein, 21 aa, Mycobacterium
MMANAAFYYGVLRTLSEEDRP

SEQ ID NO: 701163 - protein, 18 aa, Mycobacterium
MMAQRVGVWVPLDEVPDV

SEQ ID NO: 701164 - protein, 22 aa, Mycobacterium
MMARLRTGQPLGPVPLVEEAAV

SEQ ID NO: 701165 - protein, 17 aa, Mycobacterium
MMCDIRIASQRASFAES

SEQ ID NO: 701166 - protein, 21 aa, Mycobacterium
MMDKLRTAGPWESEQTHDSLR

SEQ ID NO: 701167 - protein, 22 aa, Mycobacterium
MMDKLRTAGPWESEQTHDSLRR

SEQ ID NO: 701168 - protein, 19 aa, Mycobacterium
MMDVRRYGATYANYVGKPL

SEQ ID NO: 701169 - protein, 25 aa, Mycobacterium
MMEAYKDKPTIVLPGTGGSVSGTAV

SEQ ID NO: 701170 - protein, 27 aa, Mycobacterium
MMEGLRICARIAQAPALRGLLGPVARP

SEQ ID NO: 701171 - protein, 17 aa, Mycobacterium
MMFLPGVIVAMWGGQVR

SEQ ID NO: 701172 - protein, 18 aa, Mycobacterium
MMFLPGVIVSMWGGQVRS

SEQ ID NO: 701173 - protein, 19 aa, Mycobacterium
MMGDGVIDFGAVTAMVRAA

SEQ ID NO: 701174 - protein, 18 aa, Mycobacterium
MMGFALMRYVWKIEPVAS

SEQ ID NO: 701175 - protein, 20 aa, Mycobacterium
MMGLAGGWRKRGADITFAQL

SEQ ID NO: 701176 - protein, 31 aa, Mycobacterium
MMGPFAGVYAHCFGGIAARYTLDIPGALKNF

SEQ ID NO: 701177 - protein, 23 aa, Mycobacterium
MMGVLRAPCRVVYVIDEPDIRGF

SEQ ID NO: 701178 - protein, 24 aa, Mycobacterium
MMHKIKCPTLLTWGRDDRVSPPDM

SEQ ID NO: 701179 - protein, 17 aa, Mycobacterium
MMILSVLNFKYFRKLNS

SEQ ID NO: 701180 - protein, 17 aa, Mycobacterium
MMIPEAWENATTMGAAE

SEQ ID NO: 701181 - protein, 19 aa, Mycobacterium
MMKTAWGPVRVAIAAEQAK

SEQ ID NO: 701182 - protein, 19 aa, Mycobacterium
MMLEAPYTGSVVKISPVRT

SEQ ID NO: 701183 - protein, 17 aa, Mycobacterium
MMLHPAGVLGLSDGGAH

SEQ ID NO: 701184 - protein, 23 aa, Mycobacterium
MMLIGSACRDEAQFGPDAGEFNI

SEQ ID NO: 701185 - protein, 25 aa, Mycobacterium
MMLQQRIAERTKLLSQLEQAKMQEQ

SEQ ID NO: 701186 - protein, 22 aa, Mycobacterium
MMMWSFRGMGMWSDERGVNMLD

SEQ ID NO: 701187 - protein, 21 aa, Mycobacterium
MMNAGVAAVRMFSDDGICVHD

SEQ ID NO: 701188 - protein, 25 aa, Mycobacterium
MMPDTRVGTTFGHEFIGVVEKVGPS

SEQ ID NO: 701189 - protein, 22 aa, Mycobacterium
MMPGLDGFEFIAAIRADPVLAA

SEQ ID NO: 701190 - protein, 17 aa, Mycobacterium
MMRNNKRVLSKHQILDR

SEQ ID NO: 701191 - protein, 22 aa, Mycobacterium
MMRRMGSGLTHLHLTDGTGASV

SEQ ID NO: 701192 - protein, 21 aa, Mycobacterium
MMSELGARLFAIWETTPYNGH

SEQ ID NO: 701193 - protein, 25 aa, Mycobacterium
MMSQMAGQMGMPFGRKNTRKAAKGK

SEQ ID NO: 701194 - protein, 19 aa, Mycobacterium
MMSRASWAWTRRLHSKADR

SEQ ID NO: 701195 - protein, 25 aa, Mycobacterium
MMSSMAGQMGMGFGRKSATRKAAKS

SEQ ID NO: 701196 - protein, 17 aa, Mycobacterium
MMSSMLGGMGIPGLGRK

SEQ ID NO: 701197 - protein, 20 aa, Mycobacterium
MMSVLTGLGLKSFGAEGEDF

SEQ ID NO: 701198 - protein, 26 aa, Mycobacterium
MMTDGRWDPGKDFAMVTARETAPTQK

SEQ ID NO: 701199 - protein, 21 aa, Mycobacterium
MMTLAGGWRKRGSRVTFAQLA

SEQ ID NO: 701200 - protein, 24 aa, Mycobacterium
MMTLEGTNTWVLRAPGSDEIVIVD

SEQ ID NO: 701201 - protein, 20 aa, Mycobacterium
MMVFFDLWISAGMTPRVDPL

SEQ ID NO: 701202 - protein, 18 aa, Mycobacterium
MMVLCELLGVPYADRDEF

SEQ ID NO: 701203 - protein, 19 aa, Mycobacterium
MMVLGPFGETFGRVRDVVI

SEQ ID NO: 701204 - protein, 21 aa, Mycobacterium
MMVMLARLVARTTLRLPAQRI

SEQ ID NO: 701205 - protein, 17 aa, Mycobacterium
MNAALGITEQGFNSGDA

SEQ ID NO: 701206 - protein, 17 aa, Mycobacterium
MNAALGITEQGFSSGDA

SEQ ID NO: 701207 - protein, 18 aa, Mycobacterium
MNADGWGVGFFDAGVPRR

SEQ ID NO: 701208 - protein, 19 aa, Mycobacterium
MNADGWGVGFFDGGVPRRW

SEQ ID NO: 701209 - protein, 34 aa, Mycobacterium
MNAGGILASICFPSFPGFAARLFATDDPDFSIAL

SEQ ID NO: 701210 - protein, 34 aa, Mycobacterium
MNAGGILASICFPSFPGFAGRLFATEDPDFSVAL

SEQ ID NO: 701211 - protein, 33 aa, Mycobacterium
MNAGGILASICFPSFPGFAGRRFATDDPDFSLA

SEQ ID NO: 701212 - protein, 34 aa, Mycobacterium
MNAGGILGSMCFPSFPGFAGRLFATEDPEFSLAL

SEQ ID NO: 701213 - protein, 18 aa, Mycobacterium
MNAMMWVRGFAADYDDWA

SEQ ID NO: 701214 - protein, 18 aa, Mycobacterium
MNAMMWVRGFAADYDEWA

SEQ ID NO: 701215 - protein, 18 aa, Mycobacterium
MNAVSLKLFDEAIARERD

SEQ ID NO: 701216 - protein, 20 aa, Mycobacterium
MNCKLLLEIGPRPVLTAAAL

SEQ ID NO: 701217 - protein, 25 aa, Mycobacterium
MNCRPLPVFLFDGAVLSERVIAPTV

SEQ ID NO: 701218 - protein, 17 aa, Mycobacterium
MNCRVLLEIGPRPVLTA

SEQ ID NO: 701219 - protein, 17 aa, Mycobacterium
MNDPDIHSSVWDWDTAS

SEQ ID NO: 701220 - protein, 22 aa, Mycobacterium
MNDVKAALARRTNPDGLTGSAA

SEQ ID NO: 701221 - protein, 25 aa, Mycobacterium
MNEALRLVTPLPFNIRSTVRDTDLL

SEQ ID NO: 701222 - protein, 22 aa, Mycobacterium
MNEIRWDIRPSPHLGTIEVRIF

SEQ ID NO: 701223 - protein, 21 aa, Mycobacterium
MNEMAALDFNTIRLAYSSEML

SEQ ID NO: 701224 - protein, 23 aa, Mycobacterium
MNEQELRFIVGHELGHALSGHAV

SEQ ID NO: 701225 - protein, 26 aa, Mycobacterium
MNERFPFAVPRYQRSYAWGDEAVGFF

SEQ ID NO: 701226 - protein, 24 aa, Mycobacterium
MNESLRMVTPLPFNMRMAVRDTEL

SEQ ID NO: 701227 - protein, 24 aa, Mycobacterium
MNESLRMVTPLPFNMRQAIRDTEL

SEQ ID NO: 701228 - protein, 28 aa, Mycobacterium
MNETMLISAPIFHAWGLGCLQISTPLRA

SEQ ID NO: 701229 - protein, 17 aa, Mycobacterium
MNGAHHFNEVILDNACV

SEQ ID NO: 701230 - protein, 29 aa, Mycobacterium
MNGGFFPSVREYSSLYGLSDRRQAMLPAH

SEQ ID NO: 701231 - protein, 18 aa, Mycobacterium
MNGGFFPSVREYSVRYGL

SEQ ID NO: 701232 - protein, 18 aa, Mycobacterium
MNGTDAWAPSPAAAHGDF

SEQ ID NO: 701233 - protein, 18 aa, Mycobacterium
MNHKFDLQFDVAYHGPEV

SEQ ID NO: 701234 - protein, 18 aa, Mycobacterium
MNIIGSFAPVLSVLPTAV

SEQ ID NO: 701235 - protein, 22 aa, Mycobacterium
MNKAKGLSRVRIWDGSTPWLIT

SEQ ID NO: 701236 - protein, 18 aa, Mycobacterium
MNKGDWAMVLLPLLHRDP

SEQ ID NO: 701237 - protein, 17 aa, Mycobacterium
MNKGLAESRGYARELAE

SEQ ID NO: 701238 - protein, 23 aa, Mycobacterium
MNLAVVIRATWAVARVLTDRSPA

SEQ ID NO: 701239 - protein, 23 aa, Mycobacterium
MNLAVVLRATWALARVLAEQPGP

SEQ ID NO: 701240 - protein, 24 aa, Mycobacterium
MNLAVVLRTTWAVAQVLKEHGLGE

SEQ ID NO: 701241 - protein, 19 aa, Mycobacterium
MNNAGVMFTPFGRTAEGFE

SEQ ID NO: 701242 - protein, 21 aa, Mycobacterium
MNNRLEGHLVRLLHPRNTGPV

SEQ ID NO: 701243 - protein, 20 aa, Mycobacterium
MNPDWPLPLFDLARIASDRG

SEQ ID NO: 701244 - protein, 30 aa, Mycobacterium
MNPNGGLLSRFAGLTLPSLGVDFYGSTPAD

SEQ ID NO: 701245 - protein, 22 aa, Mycobacterium
MNPNGGLYSRFDGLTLASMGKS

SEQ ID NO: 701246 - protein, 27 aa, Mycobacterium
MNPNHYLAVAIDYLFSHRGGWAAQTAV

SEQ ID NO: 701247 - protein, 37 aa, Mycobacterium
MNQFIVFDFTIPRLKSGILLGTRWGEPGASMVPAPGD

SEQ ID NO: 701248 - protein, 24 aa, Mycobacterium
MNQKDVLEYGRFLGSQYREGAEAE

SEQ ID NO: 701249 - protein, 18 aa, Mycobacterium
MNRPGRYLVSSGMLGRHR

SEQ ID NO: 701250 - protein, 17 aa, Mycobacterium
MNSAVFFLLGLYALLIT

SEQ ID NO: 701251 - protein, 17 aa, Mycobacterium
MNSCGLEVLGLPEYAKS

SEQ ID NO: 701252 - protein, 20 aa, Mycobacterium
MNSEIIRWQTPLAYMRRIAK

SEQ ID NO: 701253 - protein, 17 aa, Mycobacterium
MNTEALSGLGLLANPVS

SEQ ID NO: 701254 - protein, 17 aa, Mycobacterium
MNTEVTSGLGLLLNPVA

SEQ ID NO: 701255 - protein, 22 aa, Mycobacterium
MNTGLLPFALGPVYISNSPSGV

SEQ ID NO: 701256 - protein, 27 aa, Mycobacterium
MNTHGTIGFPMQSAFDAAHAARGGAMG

SEQ ID NO: 701257 - protein, 23 aa, Mycobacterium
MNTRGRAAMKLARPPEKFTDGLL

SEQ ID NO: 701258 - protein, 17 aa, Mycobacterium
MNTRLQVEHPVTEETTG

SEQ ID NO: 701259 - protein, 17 aa, Mycobacterium
MNVCSAAADLLWSRVIK

SEQ ID NO: 701260 - protein, 19 aa, Mycobacterium
MNVLLRRTFQATLQLTGQV

SEQ ID NO: 701261 - protein, 18 aa, Mycobacterium
MNVLWVFGTVEQRDVARL

SEQ ID NO: 701262 - protein, 22 aa, Mycobacterium
MNVRDFRPAFAQAFHTTLYQFV

SEQ ID NO: 701263 - protein, 23 aa, Mycobacterium
MPAAHFMAVFGPYVARLDQILHR

SEQ ID NO: 701264 - protein, 34 aa, Mycobacterium
MPAALGATMHSCFGPRFVLGLGRGDAGAFRGMGI

SEQ ID NO: 701265 - protein, 17 aa, Mycobacterium
MPAALLRSQFDALEPLG

SEQ ID NO: 701266 - protein, 19 aa, Mycobacterium
MPACGDLTPWAQRGVMLLN

SEQ ID NO: 701267 - protein, 17 aa, Mycobacterium
MPADEAHRLCLRPLPFL

SEQ ID NO: 701268 - protein, 25 aa, Mycobacterium
MPAEAVLRMALVGSHERLTAQRAYE

SEQ ID NO: 701269 - protein, 21 aa, Mycobacterium
MPAFIRFMLRKVIKAPEFLRL

SEQ ID NO: 701270 - protein, 18 aa, Mycobacterium
MPAGLWRRVTEKFDPAHV

SEQ ID NO: 701271 - protein, 25 aa, Mycobacterium
MPAGNGTPGLTGRDTGGPGGPGADG

SEQ ID NO: 701272 - protein, 25 aa, Mycobacterium
MPAHHSAHFRLNYQSDFAEMYDLYR

SEQ ID NO: 701273 - protein, 21 aa, Mycobacterium
MPAIDRDAPPPAPRDDERAWL

SEQ ID NO: 701274 - protein, 25 aa, Mycobacterium
MPAIRAVSCSIALTRNYPYNGSLMV

SEQ ID NO: 701275 - protein, 17 aa, Mycobacterium
MPAKPAGVVAIFPTVTA

SEQ ID NO: 701276 - protein, 18 aa, Mycobacterium
MPALAAGCTVVIKPSELT

SEQ ID NO: 701277 - protein, 20 aa, Mycobacterium
MPALARVLSWASVGVDPAAT

SEQ ID NO: 701278 - protein, 25 aa, Mycobacterium
MPALDAFLHYRMIDVSSIKELCRRW

SEQ ID NO: 701279 - protein, 26 aa, Mycobacterium
MPALDAFLHYRMIDVSSIKELCRRWY

SEQ ID NO: 701280 - protein, 26 aa, Mycobacterium
MPALDSFLHYRMIDVSSIKELCRRWY

SEQ ID NO: 701281 - protein, 18 aa, Mycobacterium
MPALHLLPLAAALDVLPV

SEQ ID NO: 701282 - protein, 22 aa, Mycobacterium
MPALHLLPLAGVLGVLPVLATG

SEQ ID NO: 701283 - protein, 25 aa, Mycobacterium
MPALKEIDGWLGLSLLVDRQSGTCI

SEQ ID NO: 701284 - protein, 20 aa, Mycobacterium
MPAMGLEFYGATPSNSGYQL

SEQ ID NO: 701285 - protein, 21 aa, Mycobacterium
MPARERRGLVRALDAFTAAGG

SEQ ID NO: 701286 - protein, 27 aa, Mycobacterium
MPARLARGLSVLHLRLAESRPNDLAYA

SEQ ID NO: 701287 - protein, 22 aa, Mycobacterium
MPAVIKNAIDWLSRPFGNGALK

SEQ ID NO: 701288 - protein, 20 aa, Mycobacterium
MPAVPCARAARRPHPVHRDR

SEQ ID NO: 701289 - protein, 25 aa, Mycobacterium
MPAYLSTSLFAFWIVDSAYSLDGRR

SEQ ID NO: 701290 - protein, 22 aa, Mycobacterium
MPDAMAVRTRFFDAFFQDATRA

SEQ ID NO: 701291 - protein, 27 aa, Mycobacterium
MPDATWARLGANLAQRPGAVAGRTATL

SEQ ID NO: 701292 - protein, 35 aa, Mycobacterium
MPDAVAFAKGWVTECLRAAYPLGHGHGPVSALFRL

SEQ ID NO: 701293 - protein, 18 aa, Mycobacterium
MPDDAKRLMHLMQSVVMV

SEQ ID NO: 701294 - protein, 25 aa, Mycobacterium
MPDDARLAVLLAGWCGLRKGEVFAL

SEQ ID NO: 701295 - protein, 20 aa, Mycobacterium
MPDDPVLHGAALVYSSDTTV

SEQ ID NO: 701296 - protein, 20 aa, Mycobacterium
MPDERTYFWIARTTTAEPSR

SEQ ID NO: 701297 - protein, 17 aa, Mycobacterium
MPDERTYFWVARTTTTE

SEQ ID NO: 701298 - protein, 17 aa, Mycobacterium
MPDGPAMLDCLEFDDLL

SEQ ID NO: 701299 - protein, 25 aa, Mycobacterium
MPDHLRVAVLLGAFVGLRVAEVAAL

SEQ ID NO: 701300 - protein, 22 aa, Mycobacterium
MPDIWWQFRNAIQKAPKVDVGR

SEQ ID NO: 701301 - protein, 23 aa, Mycobacterium
MPDPPRRLLVGPDAYRYATAAGR

SEQ ID NO: 701302 - protein, 18 aa, Mycobacterium
MPDPVPVILLSRLAVDRT

SEQ ID NO: 701303 - protein, 24 aa, Mycobacterium
MPDRVKCLHVLIAHSLAKGAGVNP

SEQ ID NO: 701304 - protein, 24 aa, Mycobacterium
MPDRVKCLHVLIAHSLAKGPGCNP

SEQ ID NO: 701305 - protein, 25 aa, Mycobacterium
MPDRVKCLHVLIGHSLAVGPGVNPL

SEQ ID NO: 701306 - protein, 22 aa, Mycobacterium
MPDYPSMEAWTLATALLSRTER

SEQ ID NO: 701307 - protein, 21 aa, Mycobacterium
MPEAISVFLAPPSWEDLKARL

SEQ ID NO: 701308 - protein, 21 aa, Mycobacterium
MPEDLRVSLKVEGAVAELPSE

SEQ ID NO: 701309 - protein, 21 aa, Mycobacterium
MPEEFGGGGLIDFRYNTIITE

SEQ ID NO: 701310 - protein, 26 aa, Mycobacterium
MPEELRPNDEWVLFGYDPLFQAFRDD

SEQ ID NO: 701311 - protein, 17 aa, Mycobacterium
MPEEWARLAQGHLPSAV

SEQ ID NO: 701312 - protein, 20 aa, Mycobacterium
MPEFAARSAFDAGARYAARG

SEQ ID NO: 701313 - protein, 19 aa, Mycobacterium
MPELHKLTPALGVLQDRGF

SEQ ID NO: 701314 - protein, 21 aa, Mycobacterium
MPELMSHLLWSRIGAQCDASI

SEQ ID NO: 701315 - protein, 18 aa, Mycobacterium
MPELRCLILTSYTSDEAM

SEQ ID NO: 701316 - protein, 21 aa, Mycobacterium
MPEMPLIKFLDGYETIEELEK

SEQ ID NO: 701317 - protein, 23 aa, Mycobacterium
MPENPAEMVVGWVGDILSEHGNE

SEQ ID NO: 701318 - protein, 23 aa, Mycobacterium
MPEPDDWVLVHVGFAMAKIDETE

SEQ ID NO: 701319 - protein, 22 aa, Mycobacterium
MPEPFAFSMVLPLAVPGHDRGT

SEQ ID NO: 701320 - protein, 17 aa, Mycobacterium
MPEPFRVAREMLRVLKP

SEQ ID NO: 701321 - protein, 31 aa, Mycobacterium
MPERLRLMVTLASWCALRFGETVELRRSDID

SEQ ID NO: 701322 - protein, 22 aa, Mycobacterium
MPEVLEVRGEVFFRVADFQALN

SEQ ID NO: 701323 - protein, 21 aa, Mycobacterium
MPFDADMSGWSLIYLGVLSKY

SEQ ID NO: 701324 - protein, 23 aa, Mycobacterium
MPFERARTRLLLGQLQRRLRQKA

SEQ ID NO: 701325 - protein, 17 aa, Mycobacterium
MPFGCRMGICQSCVVGL

SEQ ID NO: 701326 - protein, 24 aa, Mycobacterium
MPFILRGVALLGIDSVQMPIGPRR

SEQ ID NO: 701327 - protein, 24 aa, Mycobacterium
MPFILRGVALLGMDSVLMPIGPRR

SEQ ID NO: 701328 - protein, 20 aa, Mycobacterium
MPGAQWFPGTEINYVDQVMR

SEQ ID NO: 701329 - protein, 20 aa, Mycobacterium
MPGCGHYVAAKFGVVGLTNS

SEQ ID NO: 701330 - protein, 22 aa, Mycobacterium
MPGFARLWRGFARVSLEQLSNE

SEQ ID NO: 701331 - protein, 20 aa, Mycobacterium
MPGGMRFAYVGAEHAGVPYL

SEQ ID NO: 701332 - protein, 23 aa, Mycobacterium
MPGGWPIELGQMLRYAVDKNYDK

SEQ ID NO: 701333 - protein, 25 aa, Mycobacterium
MPGGYPIELGMTIRLARDKNYDLLL

SEQ ID NO: 701334 - protein, 27 aa, Mycobacterium
MPGGYSFPIVREWLASRVAQIPTYTEK

SEQ ID NO: 701335 - protein, 17 aa, Mycobacterium
MPGGYTFHAFRTALSAR

SEQ ID NO: 701336 - protein, 22 aa, Mycobacterium
MPGKVMKTRGKIAAGAPIAEVL

SEQ ID NO: 701337 - protein, 22 aa, Mycobacterium
MPGLLSAALEAWITELGEVEQT

SEQ ID NO: 701338 - protein, 17 aa, Mycobacterium
MPGLPAGQIELDLVVPR

SEQ ID NO: 701339 - protein, 31 aa, Mycobacterium
MPGLPPLSGGMVGFFAYDMVRRLERLPNLAV

SEQ ID NO: 701340 - protein, 22 aa, Mycobacterium
MPGMAGLPPGFPDLSNMPKGLD

SEQ ID NO: 701341 - protein, 21 aa, Mycobacterium
MPGMDGFGVLRRLRADGVDAP

SEQ ID NO: 701342 - protein, 19 aa, Mycobacterium
MPGMGDMPGMEGMMSEEDM

SEQ ID NO: 701343 - protein, 21 aa, Mycobacterium
MPGQAPAIISRAEWGADESLR

SEQ ID NO: 701344 - protein, 24 aa, Mycobacterium
MPGREDWAVHIALWQRSVGVDGGL

SEQ ID NO: 701345 - protein, 19 aa, Mycobacterium
MPGRLRAAQKVFASTGGLH

SEQ ID NO: 701346 - protein, 17 aa, Mycobacterium
MPGRVGGLSRPRRGGPS

SEQ ID NO: 701347 - protein, 17 aa, Mycobacterium
MPGSAGLLARTSLMAQL

SEQ ID NO: 701348 - protein, 23 aa, Mycobacterium
MPGSRWFPGAKLNYVDQVKRNAR

SEQ ID NO: 701349 - protein, 18 aa, Mycobacterium
MPGTSYWYAHTDQWRYDG

SEQ ID NO: 701350 - protein, 22 aa, Mycobacterium
MPGVRGGTVVLGFERGSDLVAA

SEQ ID NO: 701351 - protein, 21 aa, Mycobacterium
MPGVTAALKRTASSMSTAADI

SEQ ID NO: 701352 - protein, 21 aa, Mycobacterium
MPHDRLVKRQLTFGYTYEELN

SEQ ID NO: 701353 - protein, 19 aa, Mycobacterium
MPHGEALLFDGRVHTVEAV

SEQ ID NO: 701354 - protein, 18 aa, Mycobacterium
MPHGGFGASGFGKDMSDY

SEQ ID NO: 701355 - protein, 18 aa, Mycobacterium
MPHGGFGASGFGKDMSQY

SEQ ID NO: 701356 - protein, 18 aa, Mycobacterium
MPHGQFRTSTAVVQDLMQ

SEQ ID NO: 701357 - protein, 17 aa, Mycobacterium
MPHLRSGVRGDLHAHID

SEQ ID NO: 701358 - protein, 17 aa, Mycobacterium
MPHPDWRGSTEDRDTAF

SEQ ID NO: 701359 - protein, 23 aa, Mycobacterium
MPHQPRFPFFDYPYIVVLVELAE

SEQ ID NO: 701360 - protein, 20 aa, Mycobacterium
MPHRGRLNVLANIVGKPYSQ

SEQ ID NO: 701361 - protein, 18 aa, Mycobacterium
MPHVKRLEGPKGNPIYQV

SEQ ID NO: 701362 - protein, 17 aa, Mycobacterium
MPIAREVDAVINHGSSV

SEQ ID NO: 701363 - protein, 19 aa, Mycobacterium
MPIFDALRPPGDVADGFVH

SEQ ID NO: 701364 - protein, 25 aa, Mycobacterium
MPIGQALRQISFRFAADDDQFMTIA

SEQ ID NO: 701365 - protein, 19 aa, Mycobacterium
MPIGTKWRAGSAGESRADT

SEQ ID NO: 701366 - protein, 24 aa, Mycobacterium
MPIHMRLPKLKGFRNRFRTEYEIV

SEQ ID NO: 701367 - protein, 19 aa, Mycobacterium
MPILTMFDKQIQVRMGQAN

SEQ ID NO: 701368 - protein, 17 aa, Mycobacterium
MPISAMLEATSLDAIRL

SEQ ID NO: 701369 - protein, 18 aa, Mycobacterium
MPISGLVGLEVWARGFSP

SEQ ID NO: 701370 - protein, 20 aa, Mycobacterium
MPIVTDEAIRDWVKLAVNRA

SEQ ID NO: 701371 - protein, 18 aa, Mycobacterium
MPIWEFPTKFDAICKPEW

SEQ ID NO: 701372 - protein, 19 aa, Mycobacterium
MPKAVLWRQHDIYMNAMGG

SEQ ID NO: 701373 - protein, 21 aa, Mycobacterium
MPKGVLWRQHDIFMTSFGGRN

SEQ ID NO: 701374 - protein, 19 aa, Mycobacterium
MPKNVRWHGKTVYTGVWKT

SEQ ID NO: 701375 - protein, 22 aa, Mycobacterium
MPLAEALARWARDILAQRAEPA

SEQ ID NO: 701376 - protein, 22 aa, Mycobacterium
MPLAEAVTGYAIAGVRSGEQVK

SEQ ID NO: 701377 - protein, 17 aa, Mycobacterium
MPLHPAGEVRAMRNLLR

SEQ ID NO: 701378 - protein, 17 aa, Mycobacterium
MPLLEGFHSVLTSPISF

SEQ ID NO: 701379 - protein, 18 aa, Mycobacterium
MPLLKREGRMLAIKGERA

SEQ ID NO: 701380 - protein, 19 aa, Mycobacterium
MPLMNAVGITSESVYLSPA

SEQ ID NO: 701381 - protein, 20 aa, Mycobacterium
MPLQAASQWDALSHVYYDEQ

SEQ ID NO: 701382 - protein, 20 aa, Mycobacterium
MPLQAATQWDAFSHVYYEGK

SEQ ID NO: 701383 - protein, 20 aa, Mycobacterium
MPLQAATQWDALSHVYYDDL

SEQ ID NO: 701384 - protein, 26 aa, Mycobacterium
MPLSASQLRSWFAYRLDGPSPVNNIP

SEQ ID NO: 701385 - protein, 23 aa, Mycobacterium
MPLSHVYGLEWLIATLSSGGIGY

SEQ ID NO: 701386 - protein, 21 aa, Mycobacterium
MPLSRVDTLLVDEWDAMIDVN

SEQ ID NO: 701387 - protein, 21 aa, Mycobacterium
MPLTIRIPFGGGIGAVEHHSE

SEQ ID NO: 701388 - protein, 18 aa, Mycobacterium
MPLVSEITALLRAGFYGD

SEQ ID NO: 701389 - protein, 19 aa, Mycobacterium
MPLVSEITALLRLGYYGAG

SEQ ID NO: 701390 - protein, 23 aa, Mycobacterium
MPLWMLAVALGKWLPSPSDVVRG

SEQ ID NO: 701391 - protein, 20 aa, Mycobacterium
MPLYHCAQLDNFLITDVYLG

SEQ ID NO: 701392 - protein, 17 aa, Mycobacterium
MPMMPPGAMGAGGTGGS

SEQ ID NO: 701393 - protein, 18 aa, Mycobacterium
MPMQLPVVGGHEGAGVVV

SEQ ID NO: 701394 - protein, 26 aa, Mycobacterium
MPNQGFRRPMWWRLLDGDRPVVHVTQ

SEQ ID NO: 701395 - protein, 21 aa, Mycobacterium
MPNSLPGHWTGHVTLARRVGG

SEQ ID NO: 701396 - protein, 23 aa, Mycobacterium
MPNSVDWALAWFATTRIGAVAVP

SEQ ID NO: 701397 - protein, 19 aa, Mycobacterium
MPNVRAMDFLGEPAVEIGP

SEQ ID NO: 701398 - protein, 19 aa, Mycobacterium
MPPAEAIALGMQRLGRNAI

SEQ ID NO: 701399 - protein, 22 aa, Mycobacterium
MPPDRKFRAAVARSHRRTAAAL

SEQ ID NO: 701400 - protein, 23 aa, Mycobacterium
MPPEPLDAAILFAPVGDLVLPAM

SEQ ID NO: 701401 - protein, 19 aa, Mycobacterium
MPPIARLLGMQLEDIEFGT

SEQ ID NO: 701402 - protein, 24 aa, Mycobacterium
MPPIPHRRRMFAGGRLEINEPLRL

SEQ ID NO: 701403 - protein, 25 aa, Mycobacterium
MPPIRIAVDLPDRFAGVSYAPGTAA

SEQ ID NO: 701404 - protein, 20 aa, Mycobacterium
MPPLPVWFAGRDTVLKFLAE

SEQ ID NO: 701405 - protein, 20 aa, Mycobacterium
MPPLPVWFTGRDPVLRFLAA

SEQ ID NO: 701406 - protein, 17 aa, Mycobacterium
MPPPKLAGIHERGGVPI

SEQ ID NO: 701407 - protein, 24 aa, Mycobacterium
MPPRDGRIFFRLLVDDEILLNRTT

SEQ ID NO: 701408 - protein, 28 aa, Mycobacterium
MPQPMRTGIRFIGKWAMGEYPYHDLYML

SEQ ID NO: 701409 - protein, 18 aa, Mycobacterium
MPQVEWLRNTAALAEQAG

SEQ ID NO: 701410 - protein, 21 aa, Mycobacterium
MPRADRAALAPMHEGRADVIG

SEQ ID NO: 701411 - protein, 19 aa, Mycobacterium
MPRDGGSADVRWFDVEPCY

SEQ ID NO: 701412 - protein, 18 aa, Mycobacterium
MPRFKRPIDPVRWQAPPV

SEQ ID NO: 701413 - protein, 19 aa, Mycobacterium
MPRYLPTIRAWQLSRVSAP

SEQ ID NO: 701414 - protein, 17 aa, Mycobacterium
MPSDHAYGQIIFDGQCR

SEQ ID NO: 701415 - protein, 17 aa, Mycobacterium
MPSGYAYGKSFRTVKTC

SEQ ID NO: 701416 - protein, 25 aa, Mycobacterium
MPSLRAVPTGGDWVRTTMVRKLQQL

SEQ ID NO: 701417 - protein, 17 aa, Mycobacterium
MPSLVYTGARTPVMDHL

SEQ ID NO: 701418 - protein, 18 aa, Mycobacterium
MPSSDVDSALSWRDDLDG

SEQ ID NO: 701419 - protein, 19 aa, Mycobacterium
MPSYLRYGAYPYIVVVRES

SEQ ID NO: 701420 - protein, 25 aa, Mycobacterium
MPTLVEWQVLPGAWVQVFLDPDRAG

SEQ ID NO: 701421 - protein, 28 aa, Mycobacterium
MPTNVPRWLSLPARLVMQSLIGRVRLPS

SEQ ID NO: 701422 - protein, 20 aa, Mycobacterium
MPTPVWTRGEFVALQERLGK

SEQ ID NO: 701423 - protein, 19 aa, Mycobacterium
MPTTCPECDTPLAPAKEGD

SEQ ID NO: 701424 - protein, 18 aa, Mycobacterium
MPTVTALPVDPVLVVEKL

SEQ ID NO: 701425 - protein, 18 aa, Mycobacterium
MPVDEAWKSVQLLTDKVL

SEQ ID NO: 701426 - protein, 19 aa, Mycobacterium
MPVDEAWKSVQLLTDKVLP

SEQ ID NO: 701427 - protein, 20 aa, Mycobacterium
MPVELRDGYQQSIVRAAAPG

SEQ ID NO: 701428 - protein, 20 aa, Mycobacterium
MPVELREGYQQSIVRAAAPG

SEQ ID NO: 701429 - protein, 21 aa, Mycobacterium
MPVELREGYQRSIVRAAAPGA

SEQ ID NO: 701430 - protein, 24 aa, Mycobacterium
MPVGEALRQISFRLAADDDQFVTL

SEQ ID NO: 701431 - protein, 24 aa, Mycobacterium
MPVGGRSSFYTDWYGPATNNDGPP

SEQ ID NO: 701432 - protein, 18 aa, Mycobacterium
MPVIPAAHAAYVIMTSGS

SEQ ID NO: 701433 - protein, 23 aa, Mycobacterium
MPVLERLYHCGGVELPQQVRDGF

SEQ ID NO: 701434 - protein, 18 aa, Mycobacterium
MPVNAFSGTHGWGYDGVL

SEQ ID NO: 701435 - protein, 18 aa, Mycobacterium
MPVNSFAGSHGWGYDGVL

SEQ ID NO: 701436 - protein, 17 aa, Mycobacterium
MPVNSFAGTHGWGYDGV

SEQ ID NO: 701437 - protein, 19 aa, Mycobacterium
MPVPMMNILNGGAHADTSV

SEQ ID NO: 701438 - protein, 27 aa, Mycobacterium
MPVPNKNIRLVIEWLDRYSDSLSLASL

SEQ ID NO: 701439 - protein, 19 aa, Mycobacterium
MPVPYWVIRVAGRDNGGMR

SEQ ID NO: 701440 - protein, 24 aa, Mycobacterium
MPVVELRSGGLGVREIKRIAKAVG

SEQ ID NO: 701441 - protein, 17 aa, Mycobacterium
MPWRVHLFTPVDGIPGV

SEQ ID NO: 701442 - protein, 26 aa, Mycobacterium
MPYGHFGDGCMHVRIDLPLDRPGGVA

SEQ ID NO: 701443 - protein, 22 aa, Mycobacterium
MPYLKAWFELLGLRAGPVRPPV

SEQ ID NO: 701444 - protein, 17 aa, Mycobacterium
MPYVEACHHMYGGEFGQ

SEQ ID NO: 701445 - protein, 17 aa, Mycobacterium
MPYVEACHHMYGGEYGQ

SEQ ID NO: 701446 - protein, 18 aa, Mycobacterium
MPYVEACHHMYGGQYGQG

SEQ ID NO: 701447 - protein, 26 aa, Mycobacterium
MPYWESVEPFPLPAEAGVEPDPRRAR

SEQ ID NO: 701448 - protein, 30 aa, Mycobacterium
MPYWESVEPFPLPGEAGVAPDPRRARMDVA

SEQ ID NO: 701449 - protein, 23 aa, Mycobacterium
MPYWESVEPFPLPQEAGVEPDPR

SEQ ID NO: 701450 - protein, 18 aa, Mycobacterium
MQAHNAIALQVARQGIVL

SEQ ID NO: 701451 - protein, 17 aa, Mycobacterium
MQALRTGTDTALFCAGI

SEQ ID NO: 701452 - protein, 19 aa, Mycobacterium
MQASVCNRPAPPPPVPPPA

SEQ ID NO: 701453 - protein, 26 aa, Mycobacterium
MQATLPGGTPFNWGSDAAAANRGIGG

SEQ ID NO: 701454 - protein, 26 aa, Mycobacterium
MQATLPGGTPFNWGSDSAAARRGIGG

SEQ ID NO: 701455 - protein, 17 aa, Mycobacterium
MQDAAAALAEFDVPAEV

SEQ ID NO: 701456 - protein, 17 aa, Mycobacterium
MQDLRIDLIQMMENAGH

SEQ ID NO: 701457 - protein, 18 aa, Mycobacterium
MQDYFATKARLFRRDSPQ

SEQ ID NO: 701458 - protein, 28 aa, Mycobacterium
MQEINLRGTFLLTKACVPHLQKSANPHV

SEQ ID NO: 701459 - protein, 18 aa, Mycobacterium
MQEMLYPTSFLKGRGLGK

SEQ ID NO: 701460 - protein, 17 aa, Mycobacterium
MQENWGFTELAAKTRAE

SEQ ID NO: 701461 - protein, 17 aa, Mycobacterium
MQEVCPDAWLLNYTNPM

SEQ ID NO: 701462 - protein, 24 aa, Mycobacterium
MQFIPETWGHFGVDANNDGKVDPD

SEQ ID NO: 701463 - protein, 22 aa, Mycobacterium
MQFISETWRLYGVDANNDGIVS

SEQ ID NO: 701464 - protein, 23 aa, Mycobacterium
MQGAEMRVAPTLQQMRPLRGGPS

SEQ ID NO: 701465 - protein, 18 aa, Mycobacterium
MQGLDLFCKIFVDPGDLV

SEQ ID NO: 701466 - protein, 26 aa, Mycobacterium
MQGLLRSKGFCWIASRDDIAAIWSQA

SEQ ID NO: 701467 - protein, 17 aa, Mycobacterium
MQGRRGAAPEVRYISAT

SEQ ID NO: 701468 - protein, 18 aa, Mycobacterium
MQGTVWLTRCSNYFRAPN

SEQ ID NO: 701469 - protein, 17 aa, Mycobacterium
MQHGYSSLVREAHVVLS

SEQ ID NO: 701470 - protein, 25 aa, Mycobacterium
MQHNGGVFLPPWGKVEQWLLSVQHD

SEQ ID NO: 701471 - protein, 17 aa, Mycobacterium
MQIGERLGLPPADIDVL

SEQ ID NO: 701472 - protein, 18 aa, Mycobacterium
MQIMFARGVEFGVETRGC

SEQ ID NO: 701473 - protein, 22 aa, Mycobacterium
MQITDLATWLAGLEKKATAKSV

SEQ ID NO: 701474 - protein, 22 aa, Mycobacterium
MQKDYRPGTLRQKLFDAESPQV

SEQ ID NO: 701475 - protein, 17 aa, Mycobacterium
MQKLAALGPAAPTASQL

SEQ ID NO: 701476 - protein, 20 aa, Mycobacterium
MQKLGLEWLHRLISEPRRLA

SEQ ID NO: 701477 - protein, 18 aa, Mycobacterium
MQLADWAAAVAYARTLPG

SEQ ID NO: 701478 - protein, 23 aa, Mycobacterium
MQLARPAVGYGVLESRVESGRVD

SEQ ID NO: 701479 - protein, 23 aa, Mycobacterium
MQLARPGVGYGVLESRVESGRVD

SEQ ID NO: 701480 - protein, 21 aa, Mycobacterium
MQLATPILEWQGPGIHPAHAA

SEQ ID NO: 701481 - protein, 25 aa, Mycobacterium
MQLGFKRQAMIGIRCSGDTTEVADR

SEQ ID NO: 701482 - protein, 17 aa, Mycobacterium
MQLPIGSVIVNRNIPSY

SEQ ID NO: 701483 - protein, 18 aa, Mycobacterium
MQLSCPDMIAAGAGSIIN

SEQ ID NO: 701484 - protein, 24 aa, Mycobacterium
MQMAQMPMQMMSGIASAPQGLMQG

SEQ ID NO: 701485 - protein, 23 aa, Mycobacterium
MQMGTNHFGHFELTRLLVPQLAA

SEQ ID NO: 701486 - protein, 18 aa, Mycobacterium
MQNGYLLLMRVGDGSHLA

SEQ ID NO: 701487 - protein, 24 aa, Mycobacterium
MQNLALFTKFWRKALPTLSNSAFM

SEQ ID NO: 701488 - protein, 18 aa, Mycobacterium
MQPFMIHYTASKHAVAGM

SEQ ID NO: 701489 - protein, 18 aa, Mycobacterium
MQPFMIHYTASKHAVTGL

SEQ ID NO: 701490 - protein, 28 aa, Mycobacterium
MQPPPPAGCTGRAPPGVGGGAGATFEEE

SEQ ID NO: 701491 - protein, 17 aa, Mycobacterium
MQPRFDNRVSLDPRVTD

SEQ ID NO: 701492 - protein, 23 aa, Mycobacterium
MQPVELPSGWAPVTGGFVGAAAA

SEQ ID NO: 701493 - protein, 17 aa, Mycobacterium
MQQCWPASEVVRLDDIY

SEQ ID NO: 701494 - protein, 19 aa, Mycobacterium
MQQPHCYLLTYGQGRRTSA

SEQ ID NO: 701495 - protein, 18 aa, Mycobacterium
MQQRWPIVMVDEFQDTDP

SEQ ID NO: 701496 - protein, 17 aa, Mycobacterium
MQRGQVGALAMAWTGPG

SEQ ID NO: 701497 - protein, 18 aa, Mycobacterium
MQRIKGINPFLGPFGALF

SEQ ID NO: 701498 - protein, 24 aa, Mycobacterium
MQRLGMANLDWLVVRDLVMIESAT

SEQ ID NO: 701499 - protein, 23 aa, Mycobacterium
MQRPSMRGVPFSFVRVDRAGNMS

SEQ ID NO: 701500 - protein, 17 aa, Mycobacterium
MQRRMAKMLQRAVEEVS

SEQ ID NO: 701501 - protein, 17 aa, Mycobacterium
MQSCVLCHVTTTTELID

SEQ ID NO: 701502 - protein, 22 aa, Mycobacterium
MQSGRFAFRPGPIFTNLLLADE

SEQ ID NO: 701503 - protein, 22 aa, Mycobacterium
MQSGRFAFRSGPIFTNLLLADE

SEQ ID NO: 701504 - protein, 23 aa, Mycobacterium
MQTSSANLGDWIASRLVQPKAKA

SEQ ID NO: 701505 - protein, 17 aa, Mycobacterium
MQVKDVGGPLGLLRMGL

SEQ ID NO: 701506 - protein, 22 aa, Mycobacterium
MQVSLHWPYSANVHCEIDVDDN

SEQ ID NO: 701507 - protein, 24 aa, Mycobacterium
MQVVSRARAAGVHCRPRDIFVEQT

SEQ ID NO: 701508 - protein, 25 aa, Mycobacterium
MQVVSRARAAGVICRPRDVFVEQTV

SEQ ID NO: 701509 - protein, 26 aa, Mycobacterium
MQYCPPSLPGMDKLWGTTVFQCPFCH

SEQ ID NO: 701510 - protein, 22 aa, Mycobacterium
MRAAAIAKLGFDYAAVADLNPS

SEQ ID NO: 701511 - protein, 21 aa, Mycobacterium
MRAAEVSFIRDCAEMAARSSL

SEQ ID NO: 701512 - protein, 17 aa, Mycobacterium
MRAAGIQGVRRGKRVRT

SEQ ID NO: 701513 - protein, 20 aa, Mycobacterium
MRAAIDIARGRGWLGDDVLG

SEQ ID NO: 701514 - protein, 17 aa, Mycobacterium
MRAAPLLGDDRESLVRQ

SEQ ID NO: 701515 - protein, 18 aa, Mycobacterium
MRAARELFKAGLRTPKGV

SEQ ID NO: 701516 - protein, 19 aa, Mycobacterium
MRAAVEAAENWGTYVTVHA

SEQ ID NO: 701517 - protein, 19 aa, Mycobacterium
MRADIAAVGRRVMAACGLQ

SEQ ID NO: 701518 - protein, 17 aa, Mycobacterium
MRADLVVARTAMAHAAW

SEQ ID NO: 701519 - protein, 19 aa, Mycobacterium
MRADVTVGSFLSGGIDSTA

SEQ ID NO: 701520 - protein, 18 aa, Mycobacterium
MRAFDLGSVTGFVRRIDG

SEQ ID NO: 701521 - protein, 18 aa, Mycobacterium
MRAGDEVVVLPVGKHTRI

SEQ ID NO: 701522 - protein, 24 aa, Mycobacterium
MRAGIPTLILWIWIEQPIWLAQIK

SEQ ID NO: 701523 - protein, 25 aa, Mycobacterium
MRAGIPTLILWIWIEQPIWLAQIKR

SEQ ID NO: 701524 - protein, 17 aa, Mycobacterium
MRAGYLVGCDGGRSVVR

SEQ ID NO: 701525 - protein, 17 aa, Mycobacterium
MRAIEPGGLVDQLLAED

SEQ ID NO: 701526 - protein, 25 aa, Mycobacterium
MRAILDRFGARWRRDDLGVVVTEIA

SEQ ID NO: 701527 - protein, 17 aa, Mycobacterium
MRAIPAFFEPGPRLETM

SEQ ID NO: 701528 - protein, 17 aa, Mycobacterium
MRAIRGSHIGMVSQNAL

SEQ ID NO: 701529 - protein, 17 aa, Mycobacterium
MRAIVGFAAETGDASGD

SEQ ID NO: 701530 - protein, 17 aa, Mycobacterium
MRAKAIARLGFGYEDVA

SEQ ID NO: 701531 - protein, 18 aa, Mycobacterium
MRALKHRITHAASGSYFQ

SEQ ID NO: 701532 - protein, 23 aa, Mycobacterium
MRALPEKYRTAVYYADVEGRTFR

SEQ ID NO: 701533 - protein, 18 aa, Mycobacterium
MRANALDAQRRWQKILGP

SEQ ID NO: 701534 - protein, 18 aa, Mycobacterium
MRASGGGKLVHIGSRSGF

SEQ ID NO: 701535 - protein, 17 aa, Mycobacterium
MRATTALALRIAHRRTH

SEQ ID NO: 701536 - protein, 19 aa, Mycobacterium
MRAVKSAFDPTGFLNPAVL

SEQ ID NO: 701537 - protein, 17 aa, Mycobacterium
MRAVLGAVVAVHAGGGR

SEQ ID NO: 701538 - protein, 20 aa, Mycobacterium
MRAWTQSMERWCDVHSASPF

SEQ ID NO: 701539 - protein, 18 aa, Mycobacterium
MRCAHVLTDDAGYLYTRY

SEQ ID NO: 701540 - protein, 18 aa, Mycobacterium
MRCRGYQALTRFLHGEYP

SEQ ID NO: 701541 - protein, 17 aa, Mycobacterium
MRCTCPSIDSCTCGIHT

SEQ ID NO: 701542 - protein, 17 aa, Mycobacterium
MRDAFTFNVATAHALTT

SEQ ID NO: 701543 - protein, 19 aa, Mycobacterium
MRDDVTWAADVLELMADDA

SEQ ID NO: 701544 - protein, 18 aa, Mycobacterium
MRDEGYAAATSRRVAAEA

SEQ ID NO: 701545 - protein, 18 aa, Mycobacterium
MRDEIGELGVQVLRAVKA

SEQ ID NO: 701546 - protein, 21 aa, Mycobacterium
MRDELARLLQFVLDLLADYGL

SEQ ID NO: 701547 - protein, 27 aa, Mycobacterium
MRDELRSLLRFILDLLGDYGLTDFYLE

SEQ ID NO: 701548 - protein, 26 aa, Mycobacterium
MRDELRSLLRFVLDLLSDYGLTDFYL

SEQ ID NO: 701549 - protein, 18 aa, Mycobacterium
MRDMAGRFEVHAQTVEDE

SEQ ID NO: 701550 - protein, 18 aa, Mycobacterium
MRDPEERTASLALRDGGP

SEQ ID NO: 701551 - protein, 20 aa, Mycobacterium
MRDPRSCVVISSMGTSMGHS

SEQ ID NO: 701552 - protein, 17 aa, Mycobacterium
MRDSRGFDFTGYKRTSL

SEQ ID NO: 701553 - protein, 24 aa, Mycobacterium
MRDWLSRWLRTRGFSVEVDPIGNL

SEQ ID NO: 701554 - protein, 23 aa, Mycobacterium
MRDWVACLVCPLTEHLAVLGNPT

SEQ ID NO: 701555 - protein, 17 aa, Mycobacterium
MREAERFLAADGSDCGI

SEQ ID NO: 701556 - protein, 19 aa, Mycobacterium
MREAVLHFAVYAGWPKASR

SEQ ID NO: 701557 - protein, 18 aa, Mycobacterium
MREEGYAAATSRRVAAEA

SEQ ID NO: 701558 - protein, 20 aa, Mycobacterium
MRELARRFGVDEVMVNPVAS

SEQ ID NO: 701559 - protein, 18 aa, Mycobacterium
MRELIVGSGPELRSAAAW

SEQ ID NO: 701560 - protein, 26 aa, Mycobacterium
MREMGWRGACKRRRVRTTIADPAATR

SEQ ID NO: 701561 - protein, 22 aa, Mycobacterium
MREQALRFGADLRMEDVDAVQL

SEQ ID NO: 701562 - protein, 22 aa, Mycobacterium
MREQALRFGADLRMEDVEAVSL

SEQ ID NO: 701563 - protein, 22 aa, Mycobacterium
MREQALRFGADLRMEDVESVSL

SEQ ID NO: 701564 - protein, 30 aa, Mycobacterium
MRERLPNLRLWNFYGQTEMAPLASALGPDE

SEQ ID NO: 701565 - protein, 25 aa, Mycobacterium
MRETFRAIGVNLMFDHIKESLHEFG

SEQ ID NO: 701566 - protein, 17 aa, Mycobacterium
MREVFGFDYSEIASTVG

SEQ ID NO: 701567 - protein, 21 aa, Mycobacterium
MREVLARRLSEWGRPDMTLAA

SEQ ID NO: 701568 - protein, 24 aa, Mycobacterium
MRFAREVADRIVVMDAGRIIEDAP

SEQ ID NO: 701569 - protein, 17 aa, Mycobacterium
MRFDPAAVRFVLLDLAE

SEQ ID NO: 701570 - protein, 20 aa, Mycobacterium
MRFIKSRAAFVDKVRQAEDT

SEQ ID NO: 701571 - protein, 17 aa, Mycobacterium
MRFKDGRELALPVTGVF

SEQ ID NO: 701572 - protein, 31 aa, Mycobacterium
MRFSAGRPPDWDQWWEWGPVFLCSNNNKRGV

SEQ ID NO: 701573 - protein, 32 aa, Mycobacterium
MRFSAGRPPTWDRWWEWGPVFLCSNNNKRGVS

SEQ ID NO: 701574 - protein, 30 aa, Mycobacterium
MRFYRLAQTLLWQWMWDRITAAATDRAQQA

SEQ ID NO: 701575 - protein, 18 aa, Mycobacterium
MRGARFTPYLSVPGAENA

SEQ ID NO: 701576 - protein, 17 aa, Mycobacterium
MRGELDFAQSLHQRVAT

SEQ ID NO: 701577 - protein, 19 aa, Mycobacterium
MRGGLVGNEEFIAWEPFSH

SEQ ID NO: 701578 - protein, 24 aa, Mycobacterium
MRGHGRGGVRIALMMTVGEDPAGS

SEQ ID NO: 701579 - protein, 24 aa, Mycobacterium
MRGIDRFGGIFAQVYGMTESTGSV

SEQ ID NO: 701580 - protein, 17 aa, Mycobacterium
MRGMFLMVEAVRQLRGE

SEQ ID NO: 701581 - protein, 24 aa, Mycobacterium
MRGPSSIWYRIRINLQHIPPEARP

SEQ ID NO: 701582 - protein, 25 aa, Mycobacterium
MRGPSSIWYRIRINLQHVAEDQRPP

SEQ ID NO: 701583 - protein, 25 aa, Mycobacterium
MRGPSSIWYRIRINLQHVPEDQRPP

SEQ ID NO: 701584 - protein, 25 aa, Mycobacterium
MRGPSSIWYRIRINLQHVPEGERPP

SEQ ID NO: 701585 - protein, 24 aa, Mycobacterium
MRGPSSIWYRIRINLQHVPPDQRP

SEQ ID NO: 701586 - protein, 24 aa, Mycobacterium
MRGPSSIWYRIRVNLQHVPVDERP

SEQ ID NO: 701587 - protein, 17 aa, Mycobacterium
MRGRLQLHHVRAKFLGA

SEQ ID NO: 701588 - protein, 23 aa, Mycobacterium
MRGRTLYVVPFCMGPLDAEDPKL

SEQ ID NO: 701589 - protein, 23 aa, Mycobacterium
MRGTHKIRVVWQGSTTISGATLY

SEQ ID NO: 701590 - protein, 18 aa, Mycobacterium
MRGTYTFHRRVLQLLQWH

SEQ ID NO: 701591 - protein, 21 aa, Mycobacterium
MRGVERLPVILGYPHDIASTM

SEQ ID NO: 701592 - protein, 20 aa, Mycobacterium
MRHAAAYWRAKSKAGDTVDA

SEQ ID NO: 701593 - protein, 20 aa, Mycobacterium
MRHAASYWRGLSKAGKAVDA

SEQ ID NO: 701594 - protein, 20 aa, Mycobacterium
MRHAASYWRGLSKAGKTVDA

SEQ ID NO: 701595 - protein, 20 aa, Mycobacterium
MRHAASYWRGLSKEGKAVDA

SEQ ID NO: 701596 - protein, 20 aa, Mycobacterium
MRHAASYWRGLSKEGKTVDA

SEQ ID NO: 701597 - protein, 21 aa, Mycobacterium
MRHFFEVAGYLHIRGVYPASE

SEQ ID NO: 701598 - protein, 21 aa, Mycobacterium
MRHGKDLTWSQVVMAANTPML

SEQ ID NO: 701599 - protein, 21 aa, Mycobacterium
MRHGKELTWSQVLMAANTPML

SEQ ID NO: 701600 - protein, 20 aa, Mycobacterium
MRHGMYWSGDLAYRDADGWI

SEQ ID NO: 701601 - protein, 19 aa, Mycobacterium
MRHIKRLFAEMARTGTEVF

SEQ ID NO: 701602 - protein, 18 aa, Mycobacterium
MRHSPAVCTTLRTVLDDV

SEQ ID NO: 701603 - protein, 27 aa, Mycobacterium
MRHTGPALSPFNAWTLVKGLETLDLRV

SEQ ID NO: 701604 - protein, 17 aa, Mycobacterium
MRHTMAYKQGTDLLSDI

SEQ ID NO: 701605 - protein, 19 aa, Mycobacterium
MRIAEPTGFLGGDQTPDPR

SEQ ID NO: 701606 - protein, 17 aa, Mycobacterium
MRIGGFRAFGRDEVTGW

SEQ ID NO: 701607 - protein, 17 aa, Mycobacterium
MRILDHPDFAVADLSSL

SEQ ID NO: 701608 - protein, 24 aa, Mycobacterium
MRINGVNRLACKVLMRDLLPKKAG

SEQ ID NO: 701609 - protein, 23 aa, Mycobacterium
MRINGVNRLACKVLMRDLLPKKP

SEQ ID NO: 701610 - protein, 24 aa, Mycobacterium
MRINGVNRLACKVLMRDLLPKKPG

SEQ ID NO: 701611 - protein, 23 aa, Mycobacterium
MRINGVNRLACKVLMRDLLPKNP

SEQ ID NO: 701612 - protein, 24 aa, Mycobacterium
MRINGVNRLACKVLMRDMLPKNPN

SEQ ID NO: 701613 - protein, 28 aa, Mycobacterium
MRIPELPTDLVIIGGGFVSAEFAHVFSA

SEQ ID NO: 701614 - protein, 18 aa, Mycobacterium
MRIPNRFAMAPMTRRASP

SEQ ID NO: 701615 - protein, 22 aa, Mycobacterium
MRKGALPPGLSVPAQGGGSGTG

SEQ ID NO: 701616 - protein, 35 aa, Mycobacterium
MRKKRLMDLIHLWLIHRFKAEIVYYVTPTEDNIYQ

SEQ ID NO: 701617 - protein, 24 aa, Mycobacterium
MRKLDPRGAIVVIEAEHLCMAMRG

SEQ ID NO: 701618 - protein, 28 aa, Mycobacterium
MRKLLAQEWVRFGWYFLITRRDPAGLRE

SEQ ID NO: 701619 - protein, 23 aa, Mycobacterium
MRKPRFGHGVVAQFAPGVRLLGC

SEQ ID NO: 701620 - protein, 18 aa, Mycobacterium
MRKQGAGWIVNIGSVTGV

SEQ ID NO: 701621 - protein, 18 aa, Mycobacterium
MRKRAAWESTWEIQRRED

SEQ ID NO: 701622 - protein, 17 aa, Mycobacterium
MRKRTGFPLPNGGNGIF

SEQ ID NO: 701623 - protein, 17 aa, Mycobacterium
MRKVVGYAKRHLAQRPQ

SEQ ID NO: 701624 - protein, 18 aa, Mycobacterium
MRLDLRLTSERGRLKPDD

SEQ ID NO: 701625 - protein, 18 aa, Mycobacterium
MRLGAYPAVLQKNSLVAK

SEQ ID NO: 701626 - protein, 27 aa, Mycobacterium
MRLHPGFKSSWPLLRVVETLPHASNGF

SEQ ID NO: 701627 - protein, 18 aa, Mycobacterium
MRLIKEEIFGPVGCVIPF

SEQ ID NO: 701628 - protein, 17 aa, Mycobacterium
MRLKDAGFQVADQPNAV

SEQ ID NO: 701629 - protein, 26 aa, Mycobacterium
MRLLCQEPMMFVCRPDHRLAQRRHVT

SEQ ID NO: 701630 - protein, 22 aa, Mycobacterium
MRLLGVTCLEELSAKHVTQLQR

SEQ ID NO: 701631 - protein, 22 aa, Mycobacterium
MRLLGVTCLEELSPRHVTQLRR

SEQ ID NO: 701632 - protein, 18 aa, Mycobacterium
MRLLRAAVVVALARDDIG

SEQ ID NO: 701633 - protein, 21 aa, Mycobacterium
MRLNELLDRIPLMTRNIAHSD

SEQ ID NO: 701634 - protein, 26 aa, Mycobacterium
MRLPELPGRVLIVGSGFIAAEFAHVF

SEQ ID NO: 701635 - protein, 28 aa, Mycobacterium
MRLQDRPRWQLTASVAFDEWAAAVTATR

SEQ ID NO: 701636 - protein, 21 aa, Mycobacterium
MRLQLSAQVGDGWHDVHLDSS

SEQ ID NO: 701637 - protein, 20 aa, Mycobacterium
MRLQLSAQVGDSWHDVHLDS

SEQ ID NO: 701638 - protein, 25 aa, Mycobacterium
MRLSMYVLNAAFYKPALLSRDAEAL

SEQ ID NO: 701639 - protein, 25 aa, Mycobacterium
MRLSTRPQHPIPIYLATLSPAMLRL

SEQ ID NO: 701640 - protein, 17 aa, Mycobacterium
MRLTLPAVGAWPEEEVL

SEQ ID NO: 701641 - protein, 18 aa, Mycobacterium
MRLTMRCHDLLKSSQAPG

SEQ ID NO: 701642 - protein, 19 aa, Mycobacterium
MRMIRRPAHDAARYDQVWK

SEQ ID NO: 701643 - protein, 21 aa, Mycobacterium
MRMVTRDGAARWLGDLAVSSS

SEQ ID NO: 701644 - protein, 19 aa, Mycobacterium
MRMWERLESAWGPARDVRD

SEQ ID NO: 701645 - protein, 17 aa, Mycobacterium
MRNEARFRVVLTMPQPA

SEQ ID NO: 701646 - protein, 18 aa, Mycobacterium
MRNPVRFQQAIARAGAQT

SEQ ID NO: 701647 - protein, 18 aa, Mycobacterium
MRNPVRFQQAITHAFNGA

SEQ ID NO: 701648 - protein, 18 aa, Mycobacterium
MRNQGAGWIVNIGSVTGL

SEQ ID NO: 701649 - protein, 17 aa, Mycobacterium
MRNRGAELWRWLQDGAQ

SEQ ID NO: 701650 - protein, 23 aa, Mycobacterium
MRNRVDLLVGHGRFIDPHTIMVE

SEQ ID NO: 701651 - protein, 18 aa, Mycobacterium
MRNRVTWTVTKWDPPHEV

SEQ ID NO: 701652 - protein, 18 aa, Mycobacterium
MRNRVTWTVTKWDPPREV

SEQ ID NO: 701653 - protein, 22 aa, Mycobacterium
MRPDGYCNIVGRIKDVVIRGGE

SEQ ID NO: 701654 - protein, 18 aa, Mycobacterium
MRPEFDRHGVHFTVVSGA

SEQ ID NO: 701655 - protein, 18 aa, Mycobacterium
MRPELLVRMFESIDNLTM

SEQ ID NO: 701656 - protein, 18 aa, Mycobacterium
MRPFVKREVMPGELDGDR

SEQ ID NO: 701657 - protein, 21 aa, Mycobacterium
MRPGACAFDDVVAWSGHQPAP

SEQ ID NO: 701658 - protein, 20 aa, Mycobacterium
MRPGDSLLLGTDLVKDLERL

SEQ ID NO: 701659 - protein, 20 aa, Mycobacterium
MRPGDSLLLGTDLVKDTGRL

SEQ ID NO: 701660 - protein, 24 aa, Mycobacterium
MRPHDPPWCRPLLGVRRGVTHDAC

SEQ ID NO: 701661 - protein, 26 aa, Mycobacterium
MRPLPESWAELGFLIAVRPDRRRNAT

SEQ ID NO: 701662 - protein, 25 aa, Mycobacterium
MRPSALRRLGLDDAHVRYPGLCHVE

SEQ ID NO: 701663 - protein, 19 aa, Mycobacterium
MRPSSSRDTAFFWDGVKAH

SEQ ID NO: 701664 - protein, 20 aa, Mycobacterium
MRQGYGRFVFVSSSAGNFGQ

SEQ ID NO: 701665 - protein, 18 aa, Mycobacterium
MRQHFQAWQLSQFLHGEQ

SEQ ID NO: 701666 - protein, 31 aa, Mycobacterium
MRQLVKVGVFLPERFGFVFVGAAEMAGCIVF

SEQ ID NO: 701667 - protein, 19 aa, Mycobacterium
MRQQLTLEIFRPHYTPNTV

SEQ ID NO: 701668 - protein, 28 aa, Mycobacterium
MRQRAPWRPELMPADPTWPVQAQRVINR

SEQ ID NO: 701669 - protein, 23 aa, Mycobacterium
MRQREPADWFLLVGSGSGEVIHA

SEQ ID NO: 701670 - protein, 19 aa, Mycobacterium
MRQRIATAAARLVASRGLA

SEQ ID NO: 701671 - protein, 17 aa, Mycobacterium
MRQRVMIAMAIALNPAL

SEQ ID NO: 701672 - protein, 21 aa, Mycobacterium
MRQVWPGAKMLNAYSLTEAGA

SEQ ID NO: 701673 - protein, 20 aa, Mycobacterium
MRRAYDKWWAAELEAQQQIE

SEQ ID NO: 701674 - protein, 24 aa, Mycobacterium
MRRCPAWGATTLWIGSGERPKAGA

SEQ ID NO: 701675 - protein, 20 aa, Mycobacterium
MRRDLRFEIVTANGAPAVAL

SEQ ID NO: 701676 - protein, 30 aa, Mycobacterium
MRRELAALVARSPFGQGAAWPVVETVQRDG

SEQ ID NO: 701677 - protein, 32 aa, Mycobacterium
MRRELSALVARSAFGQGSAWPVVQTVQRDGIC

SEQ ID NO: 701678 - protein, 19 aa, Mycobacterium
MRRHCTMYLTYWTAGDTRN

SEQ ID NO: 701679 - protein, 18 aa, Mycobacterium
MRRHGYKGAFEMAATVDY

SEQ ID NO: 701680 - protein, 20 aa, Mycobacterium
MRRISPSMIRMFARLDIRQR

SEQ ID NO: 701681 - protein, 21 aa, Mycobacterium
MRRIVPARALSPISSVAGRKG

SEQ ID NO: 701682 - protein, 21 aa, Mycobacterium
MRRKLAERGLAAGRAAAEGSA

SEQ ID NO: 701683 - protein, 18 aa, Mycobacterium
MRRLRSRFYDGMRERHGI

SEQ ID NO: 701684 - protein, 24 aa, Mycobacterium
MRRLWKGEMIFNHDGPMGRYPVLF

SEQ ID NO: 701685 - protein, 20 aa, Mycobacterium
MRRLYPVVGRFFARQTYEIS

SEQ ID NO: 701686 - protein, 20 aa, Mycobacterium
MRRMEHDGLLPVPLDELVYI

SEQ ID NO: 701687 - protein, 23 aa, Mycobacterium
MRRMLDDGYTHFVELGPHPVLAA

SEQ ID NO: 701688 - protein, 22 aa, Mycobacterium
MRRMPPAVRRFWLGRAELDAIF

SEQ ID NO: 701689 - protein, 18 aa, Mycobacterium
MRRMRAAAAKLVNAEITD

SEQ ID NO: 701690 - protein, 25 aa, Mycobacterium
MRRRIDIACGLVVEPQVAFLDEPTT

SEQ ID NO: 701691 - protein, 25 aa, Mycobacterium
MRRRIDIACGLVVQPQVAFLDEPTT

SEQ ID NO: 701692 - protein, 19 aa, Mycobacterium
MRRRWRIVLVDEFQDTDPI

SEQ ID NO: 701693 - protein, 23 aa, Mycobacterium
MRRSGLAKARWCIAGNYRSRLIR

SEQ ID NO: 701694 - protein, 19 aa, Mycobacterium
MRRSHPECFLRGAYTPVLA

SEQ ID NO: 701695 - protein, 24 aa, Mycobacterium
MRRSYRAERFLGIIDKVRAAIPHA

SEQ ID NO: 701696 - protein, 24 aa, Mycobacterium
MRRSYRSERFLSIIDKVRSAMPDA

SEQ ID NO: 701697 - protein, 17 aa, Mycobacterium
MRRTARLLPQMLPGTDF

SEQ ID NO: 701698 - protein, 18 aa, Mycobacterium
MRRTLWLVGVEDLPFIQS

SEQ ID NO: 701699 - protein, 19 aa, Mycobacterium
MRRVCAPGGIVAVRDADYA

SEQ ID NO: 701700 - protein, 19 aa, Mycobacterium
MRRVIPGSVREVRLKAVPS

SEQ ID NO: 701701 - protein, 22 aa, Mycobacterium
MRRVVHPLARMLASRLAARRRR

SEQ ID NO: 701702 - protein, 20 aa, Mycobacterium
MRRYHLLLAGASWVAEYGDP

SEQ ID NO: 701703 - protein, 19 aa, Mycobacterium
MRSAVGLGARGIRINCTGP

SEQ ID NO: 701704 - protein, 17 aa, Mycobacterium
MRSDCLGVYAPMPAWAD

SEQ ID NO: 701705 - protein, 17 aa, Mycobacterium
MRSELEHKLGISAVDIY

SEQ ID NO: 701706 - protein, 22 aa, Mycobacterium
MRSEPGRFGLVGANGGIMSKYS

SEQ ID NO: 701707 - protein, 31 aa, Mycobacterium
MRSGAENQLRFSAPRKLDLSLLVAALPEGYN

SEQ ID NO: 701708 - protein, 23 aa, Mycobacterium
MRSGRPGPVLIDLPLDVQLAEIE

SEQ ID NO: 701709 - protein, 18 aa, Mycobacterium
MRSICDRIAGFPGPVIAA

SEQ ID NO: 701710 - protein, 22 aa, Mycobacterium
MRSILNRYGARWESDGPGVVTT

SEQ ID NO: 701711 - protein, 18 aa, Mycobacterium
MRSKRYFRLLDALDAMVA

SEQ ID NO: 701712 - protein, 19 aa, Mycobacterium
MRSLSEFWGPQGYPGVLFV

SEQ ID NO: 701713 - protein, 22 aa, Mycobacterium
MRSMPGPPGTGWLIDSPVVARL

SEQ ID NO: 701714 - protein, 26 aa, Mycobacterium
MRSNAVDLEHRWERVLGRRRLAELRV

SEQ ID NO: 701715 - protein, 21 aa, Mycobacterium
MRSPGRYLYHDVVLVRTPATA

SEQ ID NO: 701716 - protein, 17 aa, Mycobacterium
MRSRFFDEFFLEAAASG

SEQ ID NO: 701717 - protein, 30 aa, Mycobacterium
MRSYLIGIARLDFLPAPVSALFGGWNLFMT

SEQ ID NO: 701718 - protein, 19 aa, Mycobacterium
MRTAAVALKRTREVQSAVP

SEQ ID NO: 701719 - protein, 21 aa, Mycobacterium
MRTALKSARLEPSDIDYIEAH

SEQ ID NO: 701720 - protein, 17 aa, Mycobacterium
MRTAVNLLLDRLPGLRL

SEQ ID NO: 701721 - protein, 19 aa, Mycobacterium
MRTFALLGVHSLVAVTAVT

SEQ ID NO: 701722 - protein, 17 aa, Mycobacterium
MRTFGGLLMAQSFVASS

SEQ ID NO: 701723 - protein, 33 aa, Mycobacterium
MRTFSKAYGLAGLRVGYAIGHPDVIVALDKVYV

SEQ ID NO: 701724 - protein, 26 aa, Mycobacterium
MRTGRRLAGWALRRARAAEPRLQARV

SEQ ID NO: 701725 - protein, 20 aa, Mycobacterium
MRTGVVGLGLALPGLALTGG

SEQ ID NO: 701726 - protein, 18 aa, Mycobacterium
MRTSRRYRVPPMPFSLSP

SEQ ID NO: 701727 - protein, 21 aa, Mycobacterium
MRTWFGFGVAGNFAGHLEQAG

SEQ ID NO: 701728 - protein, 18 aa, Mycobacterium
MRTWQTAHVMKRRRGNLA

SEQ ID NO: 701729 - protein, 17 aa, Mycobacterium
MRVAQEVGERLPRVQEM

SEQ ID NO: 701730 - protein, 23 aa, Mycobacterium
MRVEALLRYPVKSMLGETVDALA

SEQ ID NO: 701731 - protein, 20 aa, Mycobacterium
MRVGGDWYLVTPLDGDGTIG

SEQ ID NO: 701732 - protein, 17 aa, Mycobacterium
MRVGLRVGKIVTVDPEH

SEQ ID NO: 701733 - protein, 26 aa, Mycobacterium
MRVGMARPRGGMGMLPRALERSLVAA

SEQ ID NO: 701734 - protein, 17 aa, Mycobacterium
MRVGSDVLVDNAFRLLN

SEQ ID NO: 701735 - protein, 17 aa, Mycobacterium
MRVIEWFIGATTQRRYE

SEQ ID NO: 701736 - protein, 18 aa, Mycobacterium
MRVPLEGGGRLVVELTPD

SEQ ID NO: 701737 - protein, 18 aa, Mycobacterium
MRVPLEGGGRLVVELTPE

SEQ ID NO: 701738 - protein, 26 aa, Mycobacterium
MRVRHRLSKLLLRHGIVYYDGKAWTE

SEQ ID NO: 701739 - protein, 24 aa, Mycobacterium
MRVRHRLSKLLLRHGRVYSGGQAW

SEQ ID NO: 701740 - protein, 24 aa, Mycobacterium
MRVRHRLSKLLLRQGRVYSGGPAW

SEQ ID NO: 701741 - protein, 30 aa, Mycobacterium
MRVSHPIVFGHAVKIFYKDAFEKHQKLFDE

SEQ ID NO: 701742 - protein, 23 aa, Mycobacterium
MRVTRPRIAVLRSVYAHPHADTD

SEQ ID NO: 701743 - protein, 23 aa, Mycobacterium
MRVYANFLAQYSIRVNSVHPAGV

SEQ ID NO: 701744 - protein, 19 aa, Mycobacterium
MRVYPELDTSSGDVTAITQ

SEQ ID NO: 701745 - protein, 18 aa, Mycobacterium
MRWECARCGEARGAKDYA

SEQ ID NO: 701746 - protein, 20 aa, Mycobacterium
MRWGGARGGVRVHDGLARGR

SEQ ID NO: 701747 - protein, 22 aa, Mycobacterium
MRWKGKRPSVRGVVMNPVDHPH

SEQ ID NO: 701748 - protein, 23 aa, Mycobacterium
MRWTLLAMIQEFARHAGHGDILR

SEQ ID NO: 701749 - protein, 24 aa, Mycobacterium
MRWVGSRPRMWSSVIKEFDIAEQM

SEQ ID NO: 701750 - protein, 20 aa, Mycobacterium
MRWYSFDPFSRIPREQATVG

SEQ ID NO: 701751 - protein, 17 aa, Mycobacterium
MRYGTASCLPRYPRTLT

SEQ ID NO: 701752 - protein, 18 aa, Mycobacterium
MRYLMEIPPLSELATEDV

SEQ ID NO: 701753 - protein, 17 aa, Mycobacterium
MRYRSGGPFADAVAAVR

SEQ ID NO: 701754 - protein, 17 aa, Mycobacterium
MRYVWKIEPVASMTDDE

SEQ ID NO: 701755 - protein, 23 aa, Mycobacterium
MSAAAAPYVSWLNAAAVRAGEAA

SEQ ID NO: 701756 - protein, 23 aa, Mycobacterium
MSAAGALGLMKIVLAVEHGVVPP

SEQ ID NO: 701757 - protein, 25 aa, Mycobacterium
MSAAQLRQWFQFRIDGPNPVNNVPF

SEQ ID NO: 701758 - protein, 26 aa, Mycobacterium
MSAAVSLRVPTFIRYDLRADGDDLQV

SEQ ID NO: 701759 - protein, 22 aa, Mycobacterium
MSAFCSFPQVLGHEVVADVVAL

SEQ ID NO: 701760 - protein, 19 aa, Mycobacterium
MSAFKWTALGHREIADMLT

SEQ ID NO: 701761 - protein, 18 aa, Mycobacterium
MSAGESVLLLFGSANRDE

SEQ ID NO: 701762 - protein, 20 aa, Mycobacterium
MSAGQHRMWFVQAVDPGSAL

SEQ ID NO: 701763 - protein, 25 aa, Mycobacterium
MSAHLRAAHHLSLCPECAAEVDAQS

SEQ ID NO: 701764 - protein, 18 aa, Mycobacterium
MSAHPSLLYPLADLVDER

SEQ ID NO: 701765 - protein, 28 aa, Mycobacterium
MSAKIIWDVAFYWGFIGLLYMNNRYARV

SEQ ID NO: 701766 - protein, 19 aa, Mycobacterium
MSALCWMDLICGDAASALA

SEQ ID NO: 701767 - protein, 18 aa, Mycobacterium
MSALPNLGAVVNFGVGYD

SEQ ID NO: 701768 - protein, 21 aa, Mycobacterium
MSALRAVTLVPGYGAAKAGII

SEQ ID NO: 701769 - protein, 18 aa, Mycobacterium
MSAPYVQGASIDFVDTIE

SEQ ID NO: 701770 - protein, 18 aa, Mycobacterium
MSAPYVQGATIDFVDTIE

SEQ ID NO: 701771 - protein, 19 aa, Mycobacterium
MSARFARRDVEVAGTRIER

SEQ ID NO: 701772 - protein, 24 aa, Mycobacterium
MSARFPGTQILAAFGQTEMSPVTC

SEQ ID NO: 701773 - protein, 17 aa, Mycobacterium
MSARVPLQVALSAEDHA

SEQ ID NO: 701774 - protein, 23 aa, Mycobacterium
MSASEVEECWQLLRQSVHSVSYE

SEQ ID NO: 701775 - protein, 17 aa, Mycobacterium
MSAVAYGLACLELEAGD

SEQ ID NO: 701776 - protein, 19 aa, Mycobacterium
MSAVRAIPYVLARPPGVVT

SEQ ID NO: 701777 - protein, 26 aa, Mycobacterium
MSCAERLDPALARWMSEHTTFPNSMV

SEQ ID NO: 701778 - protein, 18 aa, Mycobacterium
MSCATLRELFSIAMRYFA

SEQ ID NO: 701779 - protein, 21 aa, Mycobacterium
MSCVLHCNGARFDVVVLAAEV

SEQ ID NO: 701780 - protein, 17 aa, Mycobacterium
MSDAAAQMWSRTELTPA

SEQ ID NO: 701781 - protein, 34 aa, Mycobacterium
MSDEEWDAVIAVHLRGHFLLTRNAAAYWRSKAKA

SEQ ID NO: 701782 - protein, 22 aa, Mycobacterium
MSDEITELFGPGLAETAVIRNG

SEQ ID NO: 701783 - protein, 17 aa, Mycobacterium
MSDEITELFGPGLAETT

SEQ ID NO: 701784 - protein, 24 aa, Mycobacterium
MSDEITELFGPGLSEIRVIRNGID

SEQ ID NO: 701785 - protein, 31 aa, Mycobacterium
MSDFPLIPARVETWAGLVFVNLDLDAMPLIE

SEQ ID NO: 701786 - protein, 25 aa, Mycobacterium
MSDGKWDPGKDFAMVSARETGPTQK

SEQ ID NO: 701787 - protein, 21 aa, Mycobacterium
MSDHRRILATLSMADDKETLG

SEQ ID NO: 701788 - protein, 24 aa, Mycobacterium
MSDIGMPVGLTFAGRSYDDAALLT

SEQ ID NO: 701789 - protein, 21 aa, Mycobacterium
MSDLTIPFDVVVSGVRKQPYS

SEQ ID NO: 701790 - protein, 19 aa, Mycobacterium
MSDRRRCPAQHPSESPVAA

SEQ ID NO: 701791 - protein, 21 aa, Mycobacterium
MSDVAASYVGWLSASGAHAEQ

SEQ ID NO: 701792 - protein, 19 aa, Mycobacterium
MSDVAGRAASLPVPKSTSC

SEQ ID NO: 701793 - protein, 24 aa, Mycobacterium
MSDVIRLARHARHYLAVFDGGQAL

SEQ ID NO: 701794 - protein, 24 aa, Mycobacterium
MSDVIRLARHARHYLAVFDKGKAL

SEQ ID NO: 701795 - protein, 24 aa, Mycobacterium
MSDVIRLGRHANHYLAIFDDGKAL

SEQ ID NO: 701796 - protein, 24 aa, Mycobacterium
MSDVWRLICQNCDLGMATLLTLAS

SEQ ID NO: 701797 - protein, 18 aa, Mycobacterium
MSEAFFVLSGTWRLYNGE

SEQ ID NO: 701798 - protein, 17 aa, Mycobacterium
MSEALAPGAARVVGVDW

SEQ ID NO: 701799 - protein, 25 aa, Mycobacterium
MSEALRLTTDYLKTRKQFGVTLNKF

SEQ ID NO: 701800 - protein, 18 aa, Mycobacterium
MSEFEYWGVPGPDLTVTS

SEQ ID NO: 701801 - protein, 17 aa, Mycobacterium
MSEGELFIIGRIEDLLI

SEQ ID NO: 701802 - protein, 23 aa, Mycobacterium
MSEIKPRYVVLAAAKVGGILANS

SEQ ID NO: 701803 - protein, 17 aa, Mycobacterium
MSELSCVATACHPRDAR

SEQ ID NO: 701804 - protein, 17 aa, Mycobacterium
MSELSCVATVSHPREAR

SEQ ID NO: 701805 - protein, 21 aa, Mycobacterium
MSEMMRLLAVKTRRRDRISAD

SEQ ID NO: 701806 - protein, 17 aa, Mycobacterium
MSERLVTHGALPIEVPT

SEQ ID NO: 701807 - protein, 23 aa, Mycobacterium
MSEVIRLARHAHHYLAIFDKGKA

SEQ ID NO: 701808 - protein, 24 aa, Mycobacterium
MSEVIRLARHAHHYLAIFDKGKAL

SEQ ID NO: 701809 - protein, 24 aa, Mycobacterium
MSEVIRLGRHAHHYLAIFDKGKAL

SEQ ID NO: 701810 - protein, 17 aa, Mycobacterium
MSFAPRDVAGLAAAVRA

SEQ ID NO: 701811 - protein, 17 aa, Mycobacterium
MSFDSGYLPRPGEPGAQ

SEQ ID NO: 701812 - protein, 19 aa, Mycobacterium
MSFLPRSTHEWDQMGRASR

SEQ ID NO: 701813 - protein, 23 aa, Mycobacterium
MSFRRLFVDLGVFARNELRVPEN

SEQ ID NO: 701814 - protein, 17 aa, Mycobacterium
MSFSASAIWRIRRAAPL

SEQ ID NO: 701815 - protein, 22 aa, Mycobacterium
MSFVFAVPEFLTTAAQDAAAIG

SEQ ID NO: 701816 - protein, 17 aa, Mycobacterium
MSGAGSALMGIGSSRGD

SEQ ID NO: 701817 - protein, 24 aa, Mycobacterium
MSGFPVTVKGLSRFTDAAESRTVI

SEQ ID NO: 701818 - protein, 20 aa, Mycobacterium
MSGGIAFVLGLDPRRVNTAM

SEQ ID NO: 701819 - protein, 20 aa, Mycobacterium
MSGGMPAAAFGGRADIMDRL

SEQ ID NO: 701820 - protein, 18 aa, Mycobacterium
MSGGNPFYALELAHTHVN

SEQ ID NO: 701821 - protein, 23 aa, Mycobacterium
MSGIPGPLAIPSMEYPSAAAAAD

SEQ ID NO: 701822 - protein, 18 aa, Mycobacterium
MSGLEPLASGAPVLVAGG

SEQ ID NO: 701823 - protein, 22 aa, Mycobacterium
MSGLKTPHVFTVPGEHDSVDDA

SEQ ID NO: 701824 - protein, 18 aa, Mycobacterium
MSGLVADIAFDATISTLS

SEQ ID NO: 701825 - protein, 21 aa, Mycobacterium
MSGPMARELMVALVRAGVTAT

SEQ ID NO: 701826 - protein, 26 aa, Mycobacterium
MSGQPLDWFCLFSSGAALLGSPGQGA

SEQ ID NO: 701827 - protein, 20 aa, Mycobacterium
MSGVARILLDRGGLVSGSDA

SEQ ID NO: 701828 - protein, 19 aa, Mycobacterium
MSGVARILLDRGGQVSGSD

SEQ ID NO: 701829 - protein, 22 aa, Mycobacterium
MSGVGSLFRPGGNLSQALDAAL

SEQ ID NO: 701830 - protein, 36 aa, Mycobacterium
MSGYLLARGVLRADAPRPAPVREWHAMAVEHVRRAL

SEQ ID NO: 701831 - protein, 19 aa, Mycobacterium
MSHGDRTDWYVGRVHALFR

SEQ ID NO: 701832 - protein, 22 aa, Mycobacterium
MSHIMGRGVLYGTLGNGGTAYF

SEQ ID NO: 701833 - protein, 21 aa, Mycobacterium
MSHLAGRLTLMGTLSGGGTAY

SEQ ID NO: 701834 - protein, 19 aa, Mycobacterium
MSINVFRHRGVIAVFHEAA

SEQ ID NO: 701835 - protein, 19 aa, Mycobacterium
MSIPEFAGFKVISGVGGVV

SEQ ID NO: 701836 - protein, 26 aa, Mycobacterium
MSIQDWPLMRWRMREYRHGRWARKFV

SEQ ID NO: 701837 - protein, 29 aa, Mycobacterium
MSISVAFHEPARWSGWLLYTHESTQVGAG

SEQ ID NO: 701838 - protein, 20 aa, Mycobacterium
MSITDARASELLADRRARGP

SEQ ID NO: 701839 - protein, 25 aa, Mycobacterium
MSKAFAFAGGRLGYLAAAPAVIDAL

SEQ ID NO: 701840 - protein, 25 aa, Mycobacterium
MSKAFAFAGGRLGYLVAAPAVIDAL

SEQ ID NO: 701841 - protein, 26 aa, Mycobacterium
MSKAFAFAGGRLGYLVATPALIDALL

SEQ ID NO: 701842 - protein, 26 aa, Mycobacterium
MSKAFAFAGGRLGYLVATPALVDAML

SEQ ID NO: 701843 - protein, 20 aa, Mycobacterium
MSKHEKWRGDGIDMRQACNC

SEQ ID NO: 701844 - protein, 19 aa, Mycobacterium
MSKQGRWQEMSALIDDDVL

SEQ ID NO: 701845 - protein, 18 aa, Mycobacterium
MSKSRGNLVLVSQLRRDG

SEQ ID NO: 701846 - protein, 18 aa, Mycobacterium
MSLAELWEPAARMAENGL

SEQ ID NO: 701847 - protein, 22 aa, Mycobacterium
MSLASWLRTRFVDRSTRDGNQI

SEQ ID NO: 701848 - protein, 25 aa, Mycobacterium
MSLDERLHHLFARMPDARVHLYGKD

SEQ ID NO: 701849 - protein, 25 aa, Mycobacterium
MSLDERLHHLFARMPEAKVHLYGKA

SEQ ID NO: 701850 - protein, 17 aa, Mycobacterium
MSLEEFERIQSTNVTGV

SEQ ID NO: 701851 - protein, 17 aa, Mycobacterium
MSLELGDRVGLVGHNGA

SEQ ID NO: 701852 - protein, 18 aa, Mycobacterium
MSLFLPVSPFVELLDIRA

SEQ ID NO: 701853 - protein, 18 aa, Mycobacterium
MSLFTQWVPAEWAAEPHT

SEQ ID NO: 701854 - protein, 17 aa, Mycobacterium
MSLFYRHAVPLAVEVTR

SEQ ID NO: 701855 - protein, 21 aa, Mycobacterium
MSLLDRWYAAIGHELHTLGGK

SEQ ID NO: 701856 - protein, 21 aa, Mycobacterium
MSLRSPGRFLATADRLVELWK

SEQ ID NO: 701857 - protein, 23 aa, Mycobacterium
MSLSVTCPRDLVLNAPVKLAEGT

SEQ ID NO: 701858 - protein, 22 aa, Mycobacterium
MSLVTPWLMAVPDRFSLMHGDY

SEQ ID NO: 701859 - protein, 25 aa, Mycobacterium
MSMARAAAPYIAWLRTMAEQAEQAS

SEQ ID NO: 701860 - protein, 23 aa, Mycobacterium
MSMARKLYHGCDVWLNNPLRPLE

SEQ ID NO: 701861 - protein, 22 aa, Mycobacterium
MSMARYLYFGCDVWLNNPLRPL

SEQ ID NO: 701862 - protein, 24 aa, Mycobacterium
MSMRFFKSREALLDKAKRAEDAGF

SEQ ID NO: 701863 - protein, 17 aa, Mycobacterium
MSNEGFGYIPWGVFLPR

SEQ ID NO: 701864 - protein, 20 aa, Mycobacterium
MSNLFGFNAPAIAAAEFQYE

SEQ ID NO: 701865 - protein, 23 aa, Mycobacterium
MSNLGLHLAMRAAGIDVRTTSVG

SEQ ID NO: 701866 - protein, 22 aa, Mycobacterium
MSNLGLHLAMRAAGVTVRTTAV

SEQ ID NO: 701867 - protein, 22 aa, Mycobacterium
MSNSLPGQWTAHVTLARRVGGG

SEQ ID NO: 701868 - protein, 27 aa, Mycobacterium
MSPAEWRKFAERASLYAAREKARQLGV

SEQ ID NO: 701869 - protein, 17 aa, Mycobacterium
MSPAGGVGINLAVADAV

SEQ ID NO: 701870 - protein, 27 aa, Mycobacterium
MSPAPQAPLGMFARISPAGVVAAPAAA

SEQ ID NO: 701871 - protein, 19 aa, Mycobacterium
MSPDGKRVFVGRSGHDRID

SEQ ID NO: 701872 - protein, 23 aa, Mycobacterium
MSPELPAVIDRYLADDVSRFLAA

SEQ ID NO: 701873 - protein, 20 aa, Mycobacterium
MSPELRSNVDVVRGDITDAQ

SEQ ID NO: 701874 - protein, 22 aa, Mycobacterium
MSPGERLLGLDLANGGHLTHGM

SEQ ID NO: 701875 - protein, 33 aa, Mycobacterium
MSPGIGRAGVVGRLSVPPGWAAAAPEIRSVATV

SEQ ID NO: 701876 - protein, 23 aa, Mycobacterium
MSPICPNVIWAMDFQFDTTADGR

SEQ ID NO: 701877 - protein, 17 aa, Mycobacterium
MSPIGGVGINLAIQDAV

SEQ ID NO: 701878 - protein, 17 aa, Mycobacterium
MSPIGGVGINLAVADAV

SEQ ID NO: 701879 - protein, 17 aa, Mycobacterium
MSPIGVFRAIDRVGLDV

SEQ ID NO: 701880 - protein, 19 aa, Mycobacterium
MSPLSFVRRPGRWIRELAA

SEQ ID NO: 701881 - protein, 25 aa, Mycobacterium
MSPPGKDLWWFWTGLTPSYPEDGWD

SEQ ID NO: 701882 - protein, 25 aa, Mycobacterium
MSPRAKAPGMPLAAWLAERTDEQLV

SEQ ID NO: 701883 - protein, 17 aa, Mycobacterium
MSPRVGMTLSGRYRLQR

SEQ ID NO: 701884 - protein, 23 aa, Mycobacterium
MSPVDWVRFAANFAGERVLKRTA

SEQ ID NO: 701885 - protein, 25 aa, Mycobacterium
MSPVEQIRMSLAIAGWPKARRKARE

SEQ ID NO: 701886 - protein, 19 aa, Mycobacterium
MSPVTCMLLGDDALRKLGS

SEQ ID NO: 701887 - protein, 23 aa, Mycobacterium
MSQIPISAAMLVGKEYGFTSPTA

SEQ ID NO: 701888 - protein, 17 aa, Mycobacterium
MSQLLASHTGALVAPGQ

SEQ ID NO: 701889 - protein, 20 aa, Mycobacterium
MSQSRACARTRGKSDPIDAL

SEQ ID NO: 701890 - protein, 20 aa, Mycobacterium
MSRAFASSCNTTFAELASRM

SEQ ID NO: 701891 - protein, 20 aa, Mycobacterium
MSRARELLDTTTLTIAAVAR

SEQ ID NO: 701892 - protein, 24 aa, Mycobacterium
MSRELGIQYARQGIRVNALCPGPV

SEQ ID NO: 701893 - protein, 24 aa, Mycobacterium
MSRELGVQYARQGIRVNALCPGPV

SEQ ID NO: 701894 - protein, 25 aa, Mycobacterium
MSRFAEIWRRGGTLDGVRVVSPETM

SEQ ID NO: 701895 - protein, 21 aa, Mycobacterium
MSRFVDLFAAVRVRLREAVDR

SEQ ID NO: 701896 - protein, 19 aa, Mycobacterium
MSRGAIFHHFRDKDALFFA

SEQ ID NO: 701897 - protein, 20 aa, Mycobacterium
MSRGAIFHHFRDKDALFFAL

SEQ ID NO: 701898 - protein, 25 aa, Mycobacterium
MSRGRTSPDWANMVGPFGGITAAVL

SEQ ID NO: 701899 - protein, 24 aa, Mycobacterium
MSRIRGARIGTVFQDPMSALTPVY

SEQ ID NO: 701900 - protein, 23 aa, Mycobacterium
MSRIRGNVIGTVFQDPMSALTPV

SEQ ID NO: 701901 - protein, 25 aa, Mycobacterium
MSRLARGRARLRVLLADHQAALPAG

SEQ ID NO: 701902 - protein, 19 aa, Mycobacterium
MSRLTGWLTPEARAGLDAV

SEQ ID NO: 701903 - protein, 28 aa, Mycobacterium
MSRPAAWSAEGFLPFLPTDAQDRLLDSV

SEQ ID NO: 701904 - protein, 21 aa, Mycobacterium
MSRPAFPNIVSSGWHLHQSLG

SEQ ID NO: 701905 - protein, 22 aa, Mycobacterium
MSRPDLPVLVRAAATEQPLPDE

SEQ ID NO: 701906 - protein, 18 aa, Mycobacterium
MSRREFLAKATGAGAAAF

SEQ ID NO: 701907 - protein, 25 aa, Mycobacterium
MSRRELIRHTAWFGAAVALTVTGGE

SEQ ID NO: 701908 - protein, 25 aa, Mycobacterium
MSRSSPRVGDGFIRLDEAGVVTFAS

SEQ ID NO: 701909 - protein, 27 aa, Mycobacterium
MSRSSPRVGDGFIRLDVSGGVKYASPN

SEQ ID NO: 701910 - protein, 25 aa, Mycobacterium
MSRSSPRVGDGFIRLNEGGEVVFAS

SEQ ID NO: 701911 - protein, 28 aa, Mycobacterium
MSRSTPRAGDGFIRLDVDGVAIYASPNA

SEQ ID NO: 701912 - protein, 31 aa, Mycobacterium
MSRSTPRAGDGFIRLDVNGVVAYASPNAVSA

SEQ ID NO: 701913 - protein, 31 aa, Mycobacterium
MSRSTPRAGDGFIRLNVDGVVAYASPNALSA

SEQ ID NO: 701914 - protein, 31 aa, Mycobacterium
MSRSTPRVGDGFIRLDVKGVVDYASPNALSA

SEQ ID NO: 701915 - protein, 19 aa, Mycobacterium
MSRTGPFIVGDRVQLTDAK

SEQ ID NO: 701916 - protein, 22 aa, Mycobacterium
MSRWRATVNWAGSRPVSAELAV

SEQ ID NO: 701917 - protein, 18 aa, Mycobacterium
MSSAERRAILSFLESGVD

SEQ ID NO: 701918 - protein, 17 aa, Mycobacterium
MSSDEFLALAGSADPVS

SEQ ID NO: 701919 - protein, 19 aa, Mycobacterium
MSSEDAWAMIKVTPMIGVN

SEQ ID NO: 701920 - protein, 24 aa, Mycobacterium
MSSLRLVVCGGSAVPVSLMRTFEE

SEQ ID NO: 701921 - protein, 17 aa, Mycobacterium
MSSRAYRSGGVLVPAEH

SEQ ID NO: 701922 - protein, 26 aa, Mycobacterium
MSSRGYRAMAAIPRLQFAHVDLLVRS

SEQ ID NO: 701923 - protein, 27 aa, Mycobacterium
MSSRGYRAMAGIPRLQFAHVDLLVRNF

SEQ ID NO: 701924 - protein, 19 aa, Mycobacterium
MSSRLVARYLAKYVTKSLA

SEQ ID NO: 701925 - protein, 25 aa, Mycobacterium
MSSVPPSVWGGVAAVRFREVVERWN

SEQ ID NO: 701926 - protein, 24 aa, Mycobacterium
MSSYGFLRSRLDGSVSEPTVGDVL

SEQ ID NO: 701927 - protein, 23 aa, Mycobacterium
MSSYGFLRTRLDGSVQESTVGDV

SEQ ID NO: 701928 - protein, 18 aa, Mycobacterium
MSTERRMLLRAFGAQIVL

SEQ ID NO: 701929 - protein, 19 aa, Mycobacterium
MSTGPWLRRRKGAEIVDRF

SEQ ID NO: 701930 - protein, 22 aa, Mycobacterium
MSTNEGSLWGGRFADGPSDALA

SEQ ID NO: 701931 - protein, 17 aa, Mycobacterium
MSTRVRAYMALLMEGWS

SEQ ID NO: 701932 - protein, 20 aa, Mycobacterium
MSVAAGYAPRAVVAPIVGSF

SEQ ID NO: 701933 - protein, 20 aa, Mycobacterium
MSVAAKRAEAMLADEPMSAE

SEQ ID NO: 701934 - protein, 19 aa, Mycobacterium
MSVASGYAPRAIVAPIVGA

SEQ ID NO: 701935 - protein, 20 aa, Mycobacterium
MSVASGYAPRAIVTPIVGAV

SEQ ID NO: 701936 - protein, 20 aa, Mycobacterium
MSVAYRLTGTIADAEDIVQD

SEQ ID NO: 701937 - protein, 19 aa, Mycobacterium
MSVAYRLTGTVADAEDIVQ

SEQ ID NO: 701938 - protein, 27 aa, Mycobacterium
MSVDERARAGLFLAMQYPIEVTGVSMS

SEQ ID NO: 701939 - protein, 27 aa, Mycobacterium
MSVDERARAGLFLAMQYPVEVPGVSMS

SEQ ID NO: 701940 - protein, 19 aa, Mycobacterium
MSVFLPDRLAFPIVGAGEM

SEQ ID NO: 701941 - protein, 25 aa, Mycobacterium
MSVGELEPGPGVGHVQTAEHFAVRD

SEQ ID NO: 701942 - protein, 26 aa, Mycobacterium
MSVGPPWKVQVDEWLVDPAPDLVEGA

SEQ ID NO: 701943 - protein, 24 aa, Mycobacterium
MSVHVRGSVVLQRLREKNLAGDDG

SEQ ID NO: 701944 - protein, 18 aa, Mycobacterium
MSVKAHRGLTHYRRLASS

SEQ ID NO: 701945 - protein, 17 aa, Mycobacterium
MSVPPGWDPLPSAAGAK

SEQ ID NO: 701946 - protein, 17 aa, Mycobacterium
MSVPQGWTEAAPAIRTL

SEQ ID NO: 701947 - protein, 18 aa, Mycobacterium
MSVPQGWTQAAPAMRLVS

SEQ ID NO: 701948 - protein, 24 aa, Mycobacterium
MSWERVTDKFGWLAEPFCDDALRA

SEQ ID NO: 701949 - protein, 20 aa, Mycobacterium
MSYAQWLNRYVELSIGDGDS

SEQ ID NO: 701950 - protein, 22 aa, Mycobacterium
MSYICAGHPYPLVVSPNASPVF

SEQ ID NO: 701951 - protein, 26 aa, Mycobacterium
MSYQWPKDRQSVSWTLVSSSLLRSLE

SEQ ID NO: 701952 - protein, 17 aa, Mycobacterium
MTAAGWDPKVVRFPDPG

SEQ ID NO: 701953 - protein, 22 aa, Mycobacterium
MTAAITPYLEWMRTTGAQAEEA

SEQ ID NO: 701954 - protein, 17 aa, Mycobacterium
MTAEQRGTVALMHGERE

SEQ ID NO: 701955 - protein, 18 aa, Mycobacterium
MTAEVLGAVLPGAIAEVI

SEQ ID NO: 701956 - protein, 18 aa, Mycobacterium
MTAEVRFADGHTGRVRCS

SEQ ID NO: 701957 - protein, 21 aa, Mycobacterium
MTAIPGFPNFFTVLGPNSPTG

SEQ ID NO: 701958 - protein, 21 aa, Mycobacterium
MTALDWTQWRVTKKAEDSQRR

SEQ ID NO: 701959 - protein, 17 aa, Mycobacterium
MTALELVAAYTSGELSP

SEQ ID NO: 701960 - protein, 19 aa, Mycobacterium
MTALFLKTLGIGPEGEGET

SEQ ID NO: 701961 - protein, 17 aa, Mycobacterium
MTAPGDFIELVQGIPGG

SEQ ID NO: 701962 - protein, 18 aa, Mycobacterium
MTARSGAINPVLEPLVAV

SEQ ID NO: 701963 - protein, 21 aa, Mycobacterium
MTASLAEYFGLGGPLVTHAEA

SEQ ID NO: 701964 - protein, 19 aa, Mycobacterium
MTAVGRLFADLGAEVTVVR

SEQ ID NO: 701965 - protein, 22 aa, Mycobacterium
MTAVWRMMAARSFDDLAGELEI

SEQ ID NO: 701966 - protein, 18 aa, Mycobacterium
MTAWFDWLRRFAQGLPPE

SEQ ID NO: 701967 - protein, 17 aa, Mycobacterium
MTAWGPLWLCGRKSSNS

SEQ ID NO: 701968 - protein, 17 aa, Mycobacterium
MTAYDSGARSLITALKS

SEQ ID NO: 701969 - protein, 17 aa, Mycobacterium
MTCFLTPDGRPFFCGTY

SEQ ID NO: 701970 - protein, 17 aa, Mycobacterium
MTCKAITDALLDGDAAA

SEQ ID NO: 701971 - protein, 25 aa, Mycobacterium
MTDDELKAFFVLMGVASNDTTRHAS

SEQ ID NO: 701972 - protein, 19 aa, Mycobacterium
MTDEEWDAVIAVHLRGHFL

SEQ ID NO: 701973 - protein, 17 aa, Mycobacterium
MTDFRFYVPLAKAAEAA

SEQ ID NO: 701974 - protein, 19 aa, Mycobacterium
MTDKVCTVVRLALTGSLTV

SEQ ID NO: 701975 - protein, 17 aa, Mycobacterium
MTDLGPIPSWRDDLAAG

SEQ ID NO: 701976 - protein, 17 aa, Mycobacterium
MTDLRSSSVYSRTRDAQ

SEQ ID NO: 701977 - protein, 23 aa, Mycobacterium
MTDRRFAYMVAELRPHRLWPNIL

SEQ ID NO: 701978 - protein, 19 aa, Mycobacterium
MTDVEPLPVDVHRDVAEQT

SEQ ID NO: 701979 - protein, 17 aa, Mycobacterium
MTEHGWEADEWPDLYQR

SEQ ID NO: 701980 - protein, 20 aa, Mycobacterium
MTELTGRAALPGYTGAADRL

SEQ ID NO: 701981 - protein, 24 aa, Mycobacterium
MTERTRILGHVIFAIFPDNPDDPN

SEQ ID NO: 701982 - protein, 21 aa, Mycobacterium
MTETARLADYVLPAATQFEKA

SEQ ID NO: 701983 - protein, 18 aa, Mycobacterium
MTETSPLATMAWPPPGTP

SEQ ID NO: 701984 - protein, 19 aa, Mycobacterium
MTETSPLATMAWPPPGTPE

SEQ ID NO: 701985 - protein, 20 aa, Mycobacterium
MTFEVAWRILQSTPVTATGL

SEQ ID NO: 701986 - protein, 19 aa, Mycobacterium
MTFNHAGIEFSLRPARRAV

SEQ ID NO: 701987 - protein, 29 aa, Mycobacterium
MTGAEPVWTARGWEPRFGLDLPADSNGYG

SEQ ID NO: 701988 - protein, 21 aa, Mycobacterium
MTGALRPGTFIRLDETAAALG

SEQ ID NO: 701989 - protein, 25 aa, Mycobacterium
MTGCASIFHAIRCALALAAMVGEPQ

SEQ ID NO: 701990 - protein, 20 aa, Mycobacterium
MTGEPLAPVWESTAAAQAQG

SEQ ID NO: 701991 - protein, 17 aa, Mycobacterium
MTGFADQAAVAWQLASS

SEQ ID NO: 701992 - protein, 24 aa, Mycobacterium
MTGFPVTVKGLSRFTDPAESKAVI

SEQ ID NO: 701993 - protein, 17 aa, Mycobacterium
MTGFRVSRGGWYGLDPV

SEQ ID NO: 701994 - protein, 18 aa, Mycobacterium
MTGGMCWEALNNIAAAEH

SEQ ID NO: 701995 - protein, 20 aa, Mycobacterium
MTGGRLTLGVGIGISPQEYD

SEQ ID NO: 701996 - protein, 18 aa, Mycobacterium
MTGHNVLHALGFDSFGLP

SEQ ID NO: 701997 - protein, 30 aa, Mycobacterium
MTGPRDARHSFSFSGLKTAVARYLEKHGVE

SEQ ID NO: 701998 - protein, 27 aa, Mycobacterium
MTGPSGRPAIVMAHGFAGTRDTGLLDY

SEQ ID NO: 701999 - protein, 25 aa, Mycobacterium
MTGRRPVIFYTNGFEHWIWDDTGGY

SEQ ID NO: 702000 - protein, 23 aa, Mycobacterium
MTGRVEGKVAFISGAARGQGRSH

SEQ ID NO: 702001 - protein, 17 aa, Mycobacterium
MTGTLCWGEASEQVTGT

SEQ ID NO: 702002 - protein, 19 aa, Mycobacterium
MTGTLCWGEEIHQVSGNSG

SEQ ID NO: 702003 - protein, 17 aa, Mycobacterium
MTGVFDLWQEDARVLLE

SEQ ID NO: 702004 - protein, 27 aa, Mycobacterium
MTHHLDRAFAVLAHLGDPIAWSAPLRW

SEQ ID NO: 702005 - protein, 24 aa, Mycobacterium
MTHPDGRSAFALWFTGGIFVNQDG

SEQ ID NO: 702006 - protein, 25 aa, Mycobacterium
MTIADWKGQWGQRPNAQIAVETDPE

SEQ ID NO: 702007 - protein, 24 aa, Mycobacterium
MTIDEFAPQISFFFYTHGDFFEEI

SEQ ID NO: 702008 - protein, 17 aa, Mycobacterium
MTIDLMFNAIADVMPDL

SEQ ID NO: 702009 - protein, 17 aa, Mycobacterium
MTIGTGFVGRSSIGENL

SEQ ID NO: 702010 - protein, 23 aa, Mycobacterium
MTKEQRLALGPMHHGRADVIGGG

SEQ ID NO: 702011 - protein, 26 aa, Mycobacterium
MTKSLRAGKIFLDWSQNNGSKTTIAP

SEQ ID NO: 702012 - protein, 18 aa, Mycobacterium
MTLAQWLRKNLVSKAAHD

SEQ ID NO: 702013 - protein, 23 aa, Mycobacterium
MTLARERHGVFAFTGNTRHRVEV

SEQ ID NO: 702014 - protein, 22 aa, Mycobacterium
MTLARERHGVFVFTGNTRHRVE

SEQ ID NO: 702015 - protein, 20 aa, Mycobacterium
MTLDFSTEWAEYHRAGAPQL

SEQ ID NO: 702016 - protein, 20 aa, Mycobacterium
MTLDLRQMWDVLGTGDHISE

SEQ ID NO: 702017 - protein, 18 aa, Mycobacterium
MTLEMGKPLAEARGEITY

SEQ ID NO: 702018 - protein, 18 aa, Mycobacterium
MTLEMGKPLPESRGEVAY

SEQ ID NO: 702019 - protein, 17 aa, Mycobacterium
MTLEMGKTLTSARAEVL

SEQ ID NO: 702020 - protein, 26 aa, Mycobacterium
MTLGAYRWLRPSGRRSAKEIAAEFST

SEQ ID NO: 702021 - protein, 18 aa, Mycobacterium
MTLGQEFGAFAVTILEDA

SEQ ID NO: 702022 - protein, 26 aa, Mycobacterium
MTLGSYRWLRPSGRRSAKEIAAEFST

SEQ ID NO: 702023 - protein, 24 aa, Mycobacterium
MTLHRTSRRWAIADLAEAAAGAEK

SEQ ID NO: 702024 - protein, 25 aa, Mycobacterium
MTLKDAPAWARRLYSRLTHYATKPG

SEQ ID NO: 702025 - protein, 23 aa, Mycobacterium
MTLKDVDEVIAFAREIGAPTDLS

SEQ ID NO: 702026 - protein, 24 aa, Mycobacterium
MTLLPTVRGAFCLVFADENTLYAA

SEQ ID NO: 702027 - protein, 23 aa, Mycobacterium
MTLPPDLQAASALDTGAGSAPVH

SEQ ID NO: 702028 - protein, 17 aa, Mycobacterium
MTLQKWLRQADIEEGTK

SEQ ID NO: 702029 - protein, 17 aa, Mycobacterium
MTLYGFGDRETRDLFLT

SEQ ID NO: 702030 - protein, 17 aa, Mycobacterium
MTLYGFVDGDARDLFLT

SEQ ID NO: 702031 - protein, 25 aa, Mycobacterium
MTMGHPVVMGRLTWESLPASVRPLP

SEQ ID NO: 702032 - protein, 25 aa, Mycobacterium
MTMLANRISHAFDFRGPSMAIDTAC

SEQ ID NO: 702033 - protein, 20 aa, Mycobacterium
MTMYAGWRAVIAGFVARRLG

SEQ ID NO: 702034 - protein, 20 aa, Mycobacterium
MTMYAGWRAVIAGFVARRLS

SEQ ID NO: 702035 - protein, 19 aa, Mycobacterium
MTMYAGWRAVVAAFVADRL

SEQ ID NO: 702036 - protein, 17 aa, Mycobacterium
MTNAVTPYVSWVTAAGV

SEQ ID NO: 702037 - protein, 25 aa, Mycobacterium
MTNHAAGWVRMDFIVPSRGLIGFRT

SEQ ID NO: 702038 - protein, 35 aa, Mycobacterium; identical to SEQ ID NO: 82724

SEQ ID NO: 702039 - protein, 26 aa, Mycobacterium
MTNLNPVWRVGFQVREALRANTSGRD

SEQ ID NO: 702040 - protein, 17 aa, Mycobacterium
MTNPAGLADQAAASGQA

SEQ ID NO: 702041 - protein, 25 aa, Mycobacterium
MTNPDWLPTIRRAAALVTDTGGMTC

SEQ ID NO: 702042 - protein, 17 aa, Mycobacterium
MTNRSRISRARRTLTEL

SEQ ID NO: 702043 - protein, 17 aa, Mycobacterium
MTPAFLRVFGFRGGTAR

SEQ ID NO: 702044 - protein, 17 aa, Mycobacterium
MTPEHLARLAATAGSTT

SEQ ID NO: 702045 - protein, 20 aa, Mycobacterium
MTPFSTWRMPSETAPQERIF

SEQ ID NO: 702046 - protein, 23 aa, Mycobacterium
MTPGCTKEACHFRDLAAEFAAAG

SEQ ID NO: 702047 - protein, 24 aa, Mycobacterium
MTPGCTKQACDFRDSLAELNEAGL

SEQ ID NO: 702048 - protein, 18 aa, Mycobacterium
MTPGERLLGLDLANGGHL

SEQ ID NO: 702049 - protein, 23 aa, Mycobacterium
MTPGERLLGLDLANGGHLTHGMK

SEQ ID NO: 702050 - protein, 28 aa, Mycobacterium
MTPGHFRHAWRLPHADPLAYLDIDHFAR

SEQ ID NO: 702051 - protein, 28 aa, Mycobacterium
MTPLTNWRIPGPELKFEERWMPPTHVET

SEQ ID NO: 702052 - protein, 23 aa, Mycobacterium
MTPPALMKAILKAPADLLWNGGI

SEQ ID NO: 702053 - protein, 19 aa, Mycobacterium
MTQGRFALYSSEPAAPETE

SEQ ID NO: 702054 - protein, 17 aa, Mycobacterium
MTQRDPWVNMLRTTLAA

SEQ ID NO: 702055 - protein, 17 aa, Mycobacterium
MTQRNYFGGAWIGCDGQ

SEQ ID NO: 702056 - protein, 24 aa, Mycobacterium
MTRALSILTTYPFPNETLEKWLRG

SEQ ID NO: 702057 - protein, 22 aa, Mycobacterium
MTRARAGGHILNSAVEELKGLR

SEQ ID NO: 702058 - protein, 17 aa, Mycobacterium
MTRELAERGVLTGERGS

SEQ ID NO: 702059 - protein, 19 aa, Mycobacterium
MTRFARGWHCLGLAETFLD

SEQ ID NO: 702060 - protein, 17 aa, Mycobacterium
MTRFRPYLVGERSSYVY

SEQ ID NO: 702061 - protein, 22 aa, Mycobacterium
MTRFSGAFEHACPGQTLNYTPN

SEQ ID NO: 702062 - protein, 17 aa, Mycobacterium
MTRHWLVMETTGNGGEA

SEQ ID NO: 702063 - protein, 25 aa, Mycobacterium
MTRQLRAGKVFVDWSQNSGSKTTVA

SEQ ID NO: 702064 - protein, 25 aa, Mycobacterium
MTRRAVYMYGAFLPRGPLGQVGAGL

SEQ ID NO: 702065 - protein, 17 aa, Mycobacterium
MTRRDPWVNMLRTTVAA

SEQ ID NO: 702066 - protein, 22 aa, Mycobacterium
MTRRKDEITEWLIRETGGTVAK

SEQ ID NO: 702067 - protein, 22 aa, Mycobacterium
MTRRPAALVIQGEPGIGKTTRW

SEQ ID NO: 702068 - protein, 26 aa, Mycobacterium
MTRSLRAGKVFLDWSQNNGSKTTIAP

SEQ ID NO: 702069 - protein, 25 aa, Mycobacterium
MTRSSPVFSAWTLQLYLRYEAAIAD

SEQ ID NO: 702070 - protein, 24 aa, Mycobacterium
MTRSVYRFAAPMPDTMSPVMRERA

SEQ ID NO: 702071 - protein, 18 aa, Mycobacterium
MTRTFILGRAEQWQLDLY

SEQ ID NO: 702072 - protein, 17 aa, Mycobacterium
MTRTFVLGRAADWQLEI

SEQ ID NO: 702073 - protein, 24 aa, Mycobacterium
MTRVIWKFIKDMLILPHLDINLDY

SEQ ID NO: 702074 - protein, 18 aa, Mycobacterium
MTSALGIVHSRFSTNTFP

SEQ ID NO: 702075 - protein, 21 aa, Mycobacterium
MTSARLARIAPISREMVLNFV

SEQ ID NO: 702076 - protein, 17 aa, Mycobacterium
MTSFSPGYRSVWHRDPQ

SEQ ID NO: 702077 - protein, 19 aa, Mycobacterium
MTSFYDWYADLPVAAPQVF

SEQ ID NO: 702078 - protein, 21 aa, Mycobacterium
MTSRAIRWVLVEGTTGAGDAI

SEQ ID NO: 702079 - protein, 23 aa, Mycobacterium
MTSRARWKIEVAGELDVDLEPTI

SEQ ID NO: 702080 - protein, 25 aa, Mycobacterium
MTSRPCPTCRGVGTVIPDPCHQCMG

SEQ ID NO: 702081 - protein, 26 aa, Mycobacterium
MTSRPCPTCRGVGVVIPDPCHQCMGD

SEQ ID NO: 702082 - protein, 23 aa, Mycobacterium
MTSRPCPVCGGVGEVIPDPCHRC

SEQ ID NO: 702083 - protein, 22 aa, Mycobacterium
MTSRPCPVCGGVGEVIPNPCNR

SEQ ID NO: 702084 - protein, 17 aa, Mycobacterium
MTSRWCYRSEVRANWKL

SEQ ID NO: 702085 - protein, 27 aa, Mycobacterium
MTTEIRYPLNLIHLATVMWFDGPALGN

SEQ ID NO: 702086 - protein, 18 aa, Mycobacterium
MTTFGFILGEVFRRVTGR

SEQ ID NO: 702087 - protein, 18 aa, Mycobacterium
MTTLPAVMARWLAGVLPG

SEQ ID NO: 702088 - protein, 17 aa, Mycobacterium
MTTLVGGLRVLDVNHGG

SEQ ID NO: 702089 - protein, 25 aa, Mycobacterium
MTTLYACRAALPAMVEQGHGVIVNV

SEQ ID NO: 702090 - protein, 25 aa, Mycobacterium
MTTPKWVHNRIQPIAIRDVLHYLVA

SEQ ID NO: 702091 - protein, 24 aa, Mycobacterium
MTTPKWVHNRIQPIAVHDALYYLV

SEQ ID NO: 702092 - protein, 25 aa, Mycobacterium
MTTPKWVHNRIQPIAVRDILHYLVQ

SEQ ID NO: 702093 - protein, 19 aa, Mycobacterium
MTTPRARLLANIVKNTETL

SEQ ID NO: 702094 - protein, 20 aa, Mycobacterium
MTTWSRGRVTLVGDAGYCPG

SEQ ID NO: 702095 - protein, 26 aa, Mycobacterium
MTVADKFGGGGLLGFLEKLGTQLNVW

SEQ ID NO: 702096 - protein, 31 aa, Mycobacterium
MTVADWRGHWGRRPNALIGMEVDPTVFFDRF

SEQ ID NO: 702097 - protein, 32 aa, Mycobacterium
MTVFELRGRLLIIDCGVLFPGHNEPGVDLILP

SEQ ID NO: 702098 - protein, 18 aa, Mycobacterium
MTVGALSVPHSWITAPAT

SEQ ID NO: 702099 - protein, 17 aa, Mycobacterium
MTVGLEPVQLVNADGEP

SEQ ID NO: 702100 - protein, 17 aa, Mycobacterium
MTVHAGLRREHLSLAAG

SEQ ID NO: 702101 - protein, 17 aa, Mycobacterium
MTVHSWAGTNLLGGGDG

SEQ ID NO: 702102 - protein, 17 aa, Mycobacterium
MTVLKSVYPTNGTTAPR

SEQ ID NO: 702103 - protein, 17 aa, Mycobacterium
MTVLVGGLRALGANHGG

SEQ ID NO: 702104 - protein, 18 aa, Mycobacterium
MTVLVGGLRALGANHGGS

SEQ ID NO: 702105 - protein, 18 aa, Mycobacterium
MTVLVGGLRALGANHGSS

SEQ ID NO: 702106 - protein, 19 aa, Mycobacterium
MTVNPRFGPRLSIPNLADL

SEQ ID NO: 702107 - protein, 18 aa, Mycobacterium
MTVPPPLIAANRAQLAAL

SEQ ID NO: 702108 - protein, 17 aa, Mycobacterium
MTVPPPLIAANRSQLMA

SEQ ID NO: 702109 - protein, 17 aa, Mycobacterium
MTVPPPVIAANRAQLMA

SEQ ID NO: 702110 - protein, 24 aa, Mycobacterium
MTVPPPVILANRMQLMSLVATNFF

SEQ ID NO: 702111 - protein, 18 aa, Mycobacterium
MTVPPVRFIKTIGDAVMF

SEQ ID NO: 702112 - protein, 19 aa, Mycobacterium
MTVRYSGYAVKGFTRSDMR

SEQ ID NO: 702113 - protein, 29 aa, Mycobacterium
MTVSLALEGVGLGTVWGRQVATSMLAAAG

SEQ ID NO: 702114 - protein, 17 aa, Mycobacterium
MTVYRLVHNGELPAVRV

SEQ ID NO: 702115 - protein, 17 aa, Mycobacterium
MTWEYPAHLYLKRAKSD

SEQ ID NO: 702116 - protein, 24 aa, Mycobacterium
MTWKGRPDPALGEWWSRIGELVTE

SEQ ID NO: 702117 - protein, 24 aa, Mycobacterium
MTWLLSRWTCVFGTPACKGTVVDR

SEQ ID NO: 702118 - protein, 24 aa, Mycobacterium
MTWLLSRWTCVFGTPACQGTVEGR

SEQ ID NO: 702119 - protein, 23 aa, Mycobacterium
MTWRGRPDPTLGEWWSQISELVE

SEQ ID NO: 702120 - protein, 20 aa, Mycobacterium
MTYDMIHKGMTVDRAEVRAG

SEQ ID NO: 702121 - protein, 26 aa, Mycobacterium
MTYFPDPFVGQGWRSGAFESQTSPPA

SEQ ID NO: 702122 - protein, 18 aa, Mycobacterium
MTYQAWQAQWNQAMESLV

SEQ ID NO: 702123 - protein, 20 aa, Mycobacterium
MVAAAAAWNGLADELAGAAA

SEQ ID NO: 702124 - protein, 20 aa, Mycobacterium
MVAAAMPQVEWLRNTAALAE

SEQ ID NO: 702125 - protein, 22 aa, Mycobacterium
MVAAAVMPHVAWATTMAAQAEQ

SEQ ID NO: 702126 - protein, 28 aa, Mycobacterium
MVAACLKWEGGYVWACKNYDGDVQSDAI

SEQ ID NO: 702127 - protein, 28 aa, Mycobacterium
MVAACLKWEGGYVWACKNYDGDVQSDLV

SEQ ID NO: 702128 - protein, 27 aa, Mycobacterium
MVAACLKWEGGYVWACKNYDGDVQSDT

SEQ ID NO: 702129 - protein, 28 aa, Mycobacterium
MVAACLKWEGGYVWACKNYDGDVQSDTV

SEQ ID NO: 702130 - protein, 17 aa, Mycobacterium
MVAAFAAPSGGAWPPSR

SEQ ID NO: 702131 - protein, 26 aa, Mycobacterium
MVAAITVGLSRGWPLPKSVRYGIAAG

SEQ ID NO: 702132 - protein, 20 aa, Mycobacterium
MVAARRAAGRIVDMLDAGDR

SEQ ID NO: 702133 - protein, 19 aa, Mycobacterium
MVAAVLPFASWLSATASVA

SEQ ID NO: 702134 - protein, 24 aa, Mycobacterium
MVADGDLAGWGRYPECVAGQPGTP

SEQ ID NO: 702135 - protein, 18 aa, Mycobacterium
MVADGFGELCDWLIENID

SEQ ID NO: 702136 - protein, 22 aa, Mycobacterium
MVADSFHLPIVFLADNPGMLPG

SEQ ID NO: 702137 - protein, 23 aa, Mycobacterium
MVADSFHLPIVFLADNPGMLPGS

SEQ ID NO: 702138 - protein, 21 aa, Mycobacterium
MVADTRFAKGFDFERRVRHFA

SEQ ID NO: 702139 - protein, 24 aa, Mycobacterium
MVAEPLRLLDCARPVNGAVAVVLT

SEQ ID NO: 702140 - protein, 17 aa, Mycobacterium
MVAFPVTQWTRWRQPVI

SEQ ID NO: 702141 - protein, 17 aa, Mycobacterium
MVAGAKYRGEFEERLKA

SEQ ID NO: 702142 - protein, 24 aa, Mycobacterium
MVAGAKYRGEFEERLKAVLDEIKN

SEQ ID NO: 702143 - protein, 21 aa, Mycobacterium
MVAGPGLRIYLAVAGGLHADE

SEQ ID NO: 702144 - protein, 28 aa, Mycobacterium
MVAGTGCALHLVEPLGFDLSEPKLRRAG

SEQ ID NO: 702145 - protein, 23 aa, Mycobacterium
MVAHARARLVAKMSYTNIGFALA

SEQ ID NO: 702146 - protein, 23 aa, Mycobacterium
MVAHHIPALISLTGSVRAGHEIT

SEQ ID NO: 702147 - protein, 17 aa, Mycobacterium
MVALAGMRREQELPHGL

SEQ ID NO: 702148 - protein, 17 aa, Mycobacterium
MVALGCRKPINDDGASR

SEQ ID NO: 702149 - protein, 17 aa, Mycobacterium
MVALSCDYRVMRSDRGF

SEQ ID NO: 702150 - protein, 19 aa, Mycobacterium
MVAPLTFLAIAGRRVQLEI

SEQ ID NO: 702151 - protein, 18 aa, Mycobacterium
MVAPVVWVPKGLQVQVLS

SEQ ID NO: 702152 - protein, 23 aa, Mycobacterium
MVAQLCRELGLPLVIDAAQALGQ

SEQ ID NO: 702153 - protein, 20 aa, Mycobacterium
MVAREGRLRTALAELKHHDF

SEQ ID NO: 702154 - protein, 24 aa, Mycobacterium
MVAREGRLRTALAELKNHNFDYVF

SEQ ID NO: 702155 - protein, 25 aa, Mycobacterium
MVARENRLRTALAHLDSLDFDCVFI

SEQ ID NO: 702156 - protein, 17 aa, Mycobacterium
MVARGHGSIVNITTLAA

SEQ ID NO: 702157 - protein, 18 aa, Mycobacterium
MVARRGATELSLRELARE

SEQ ID NO: 702158 - protein, 17 aa, Mycobacterium
MVASHTWDLLGAQSAGY

SEQ ID NO: 702159 - protein, 18 aa, Mycobacterium
MVAVEAMPYFARALFALS

SEQ ID NO: 702160 - protein, 18 aa, Mycobacterium
MVCGAIEMGIPWLTTYAF

SEQ ID NO: 702161 - protein, 23 aa, Mycobacterium
MVCSEAFLQVALDNMRIHGGIGF

SEQ ID NO: 702162 - protein, 23 aa, Mycobacterium
MVDAERALAMGLINRVVPPERLM

SEQ ID NO: 702163 - protein, 25 aa, Mycobacterium
MVDAHGPEEVWDRFIRVLTERIEAG

SEQ ID NO: 702164 - protein, 21 aa, Mycobacterium
MVDGKVIALVRARTDEEARAR

SEQ ID NO: 702165 - protein, 17 aa, Mycobacterium
MVDGWKAHQHQRLTERG

SEQ ID NO: 702166 - protein, 17 aa, Mycobacterium
MVDLGLPLWDDTLATPE

SEQ ID NO: 702167 - protein, 19 aa, Mycobacterium
MVDQCPSTRLVLGGFSQGA

SEQ ID NO: 702168 - protein, 17 aa, Mycobacterium
MVDRPCFEVEFSDGTVL

SEQ ID NO: 702169 - protein, 19 aa, Mycobacterium
MVDSLRAALRKSPASVRQD

SEQ ID NO: 702170 - protein, 25 aa, Mycobacterium
MVDTCKRLLDTYADVIHLPMDIVAA

SEQ ID NO: 702171 - protein, 23 aa, Mycobacterium
MVDVRFPVQYVIRPHTREHQDHR

SEQ ID NO: 702172 - protein, 18 aa, Mycobacterium
MVEACAAARTPLLGVCLG

SEQ ID NO: 702173 - protein, 19 aa, Mycobacterium
MVEAGWFAGHEDTIGMEVE

SEQ ID NO: 702174 - protein, 17 aa, Mycobacterium
MVEEPFSGFKGEHVEMP

SEQ ID NO: 702175 - protein, 18 aa, Mycobacterium
MVELRRPASVDSDALADH

SEQ ID NO: 702176 - protein, 26 aa, Mycobacterium
MVEPEKYIAAGLWRSADTLEELAVQI

SEQ ID NO: 702177 - protein, 32 aa, Mycobacterium
MVESDFGPAVARRVARWMVVFLQRPGGQAQFS

SEQ ID NO: 702178 - protein, 21 aa, Mycobacterium
MVEVLKRFYVAETAYLGSDDK

SEQ ID NO: 702179 - protein, 22 aa, Mycobacterium
MVFGANTYRAFAQMLAESTEES

SEQ ID NO: 702180 - protein, 18 aa, Mycobacterium
MVFHEITEPAILEAAANP

SEQ ID NO: 702181 - protein, 18 aa, Mycobacterium
MVFHEITEQAILAAAQDP

SEQ ID NO: 702182 - protein, 18 aa, Mycobacterium
MVGALCGPDDAIYPALAL

SEQ ID NO: 702183 - protein, 21 aa, Mycobacterium
MVGKCGAPLLAEEGEGGDDRL

SEQ ID NO: 702184 - protein, 22 aa, Mycobacterium
MVGLAALWRTVGVTPRAVVGHS

SEQ ID NO: 702185 - protein, 21 aa, Mycobacterium
MVGPCYDMRVDGTPLRVVVLP

SEQ ID NO: 702186 - protein, 17 aa, Mycobacterium
MVGRIAGAWRHRQPRAE

SEQ ID NO: 702187 - protein, 19 aa, Mycobacterium
MVHCRHVLFLNAVRAIVGG

SEQ ID NO: 702188 - protein, 19 aa, Mycobacterium
MVHGFSLLWLNDAIDTDRD

SEQ ID NO: 702189 - protein, 21 aa, Mycobacterium
MVHNLTGWPAAVVRCGTSPGG

SEQ ID NO: 702190 - protein, 17 aa, Mycobacterium
MVHRLKRAVGERVDVVG

SEQ ID NO: 702191 - protein, 18 aa, Mycobacterium
MVHRLLGLGLAKGHGAAD

SEQ ID NO: 702192 - protein, 19 aa, Mycobacterium
MVHRSIFRLAFPGGKPRPK

SEQ ID NO: 702193 - protein, 20 aa, Mycobacterium
MVHRVLRTEFAAGVIDYPAH

SEQ ID NO: 702194 - protein, 22 aa, Mycobacterium
MVIDLLLKRAEELGVEIRYEHG

SEQ ID NO: 702195 - protein, 17 aa, Mycobacterium
MVIDLRIDRPRFMVFGE

SEQ ID NO: 702196 - protein, 30 aa, Mycobacterium
MVIEGLKAMLAAFADRVCVVGQSVGADQVM

SEQ ID NO: 702197 - protein, 21 aa, Mycobacterium
MVIGGQVALDFEVAARAQSMA

SEQ ID NO: 702198 - protein, 20 aa, Mycobacterium
MVIKDGRFGPYVTDGETNAS

SEQ ID NO: 702199 - protein, 21 aa, Mycobacterium
MVIPMAYARDGEFLLMHGSSG

SEQ ID NO: 702200 - protein, 23 aa, Mycobacterium
MVISGFPNLFVVNGPGSPSVLTQ

SEQ ID NO: 702201 - protein, 17 aa, Mycobacterium
MVKAYAGFGTFKEGTNL

SEQ ID NO: 702202 - protein, 23 aa, Mycobacterium
MVKNLSIRLGVPCFPDDPLRFTG

SEQ ID NO: 702203 - protein, 17 aa, Mycobacterium
MVKTALDEFGKVDGVVS

SEQ ID NO: 702204 - protein, 19 aa, Mycobacterium
MVLAAFEWGTQRGTWRAGE

SEQ ID NO: 702205 - protein, 17 aa, Mycobacterium
MVLAIEICQAMIGELEN

SEQ ID NO: 702206 - protein, 18 aa, Mycobacterium
MVLAPPFVSEAFHHHTRL

SEQ ID NO: 702207 - protein, 25 aa, Mycobacterium
MVLDELLPLLASMGMDTTRVGFLGW

SEQ ID NO: 702208 - protein, 17 aa, Mycobacterium
MVLDNWAVYAGWVHLAA

SEQ ID NO: 702209 - protein, 19 aa, Mycobacterium
MVLERAHRQVTEWEATQCP

SEQ ID NO: 702210 - protein, 17 aa, Mycobacterium
MVLFSAQPVRSGADLQQ

SEQ ID NO: 702211 - protein, 17 aa, Mycobacterium
MVLGELPAGSVIGTSSP

SEQ ID NO: 702212 - protein, 17 aa, Mycobacterium
MVLHSDLTRDDLAGVRV

SEQ ID NO: 702213 - protein, 20 aa, Mycobacterium
MVLLAAWLAMRFGELTELRR

SEQ ID NO: 702214 - protein, 20 aa, Mycobacterium
MVLNEALAQWAGEHPSFSQA

SEQ ID NO: 702215 - protein, 19 aa, Mycobacterium
MVLPELRALAKEIGVEGAS

SEQ ID NO: 702216 - protein, 20 aa, Mycobacterium
MVLPELRALANEVGVKGTSG

SEQ ID NO: 702217 - protein, 17 aa, Mycobacterium
MVLPELRALANQVGVKG

SEQ ID NO: 702218 - protein, 25 aa, Mycobacterium
MVLPERASSFIGHMLDLEMLLMLRG

SEQ ID NO: 702219 - protein, 25 aa, Mycobacterium
MVLPPLMHGAAQWSVMTAITTGQSV

SEQ ID NO: 702220 - protein, 17 aa, Mycobacterium
MVLPVLFHLLWHRRLGV

SEQ ID NO: 702221 - protein, 17 aa, Mycobacterium
MVLRLAAGMEKRTAEHG

SEQ ID NO: 702222 - protein, 19 aa, Mycobacterium
MVLRLWGQLAEHLVDTRQL

SEQ ID NO: 702223 - protein, 17 aa, Mycobacterium
MVLRRAAGLPVEAKDRD

SEQ ID NO: 702224 - protein, 20 aa, Mycobacterium
MVMADLSWLDGNPVAVAPRS

SEQ ID NO: 702225 - protein, 25 aa, Mycobacterium
MVMASQRTIICWAMGLTQHSHAVAT

SEQ ID NO: 702226 - protein, 19 aa, Mycobacterium
MVMENRWLPMKQTALALNH

SEQ ID NO: 702227 - protein, 19 aa, Mycobacterium
MVMENRWLPMKRTALALNH

SEQ ID NO: 702228 - protein, 19 aa, Mycobacterium
MVMLALPGAVFVYNGEELG

SEQ ID NO: 702229 - protein, 19 aa, Mycobacterium
MVMPLSFHLGYHGLPIPGL

SEQ ID NO: 702230 - protein, 21 aa, Mycobacterium
MVMRLLAFGLRAHRLSDLDGK

SEQ ID NO: 702231 - protein, 18 aa, Mycobacterium
MVNGGQVCVCPDYVFVPD

SEQ ID NO: 702232 - protein, 27 aa, Mycobacterium
MVNLMRWKLEHELGYAITHRIPMQMPN

SEQ ID NO: 702233 - protein, 24 aa, Mycobacterium
MVNVLCAPGVWARHRKLANSAPAL

SEQ ID NO: 702234 - protein, 24 aa, Mycobacterium
MVNVLCAPGVWSRYRKVAQTAPAL

SEQ ID NO: 702235 - protein, 27 aa, Mycobacterium
MVNVVCSVGLWARYRKLAVTARALIIR

SEQ ID NO: 702236 - protein, 17 aa, Mycobacterium
MVPASVTDPSWLAELPA

SEQ ID NO: 702237 - protein, 18 aa, Mycobacterium
MVPEAIIAMLACARLGAM

SEQ ID NO: 702238 - protein, 20 aa, Mycobacterium
MVPEDRKLSGAVLSMSVLDN

SEQ ID NO: 702239 - protein, 24 aa, Mycobacterium
MVPFTIDDYTAWRLLEGLDDIGLT

SEQ ID NO: 702240 - protein, 22 aa, Mycobacterium
MVPRIKIPLPTGAIASVRVGPS

SEQ ID NO: 702241 - protein, 23 aa, Mycobacterium
MVPTAGRLARYWQLLPNVGAHAF

SEQ ID NO: 702242 - protein, 22 aa, Mycobacterium
MVPTNVFYQLSFHEGSRYPLDR

SEQ ID NO: 702243 - protein, 21 aa, Mycobacterium
MVQPGLLSWRDVARVMSENPA

SEQ ID NO: 702244 - protein, 18 aa, Mycobacterium
MVQRGAGGSIVLTSSVAG

SEQ ID NO: 702245 - protein, 31 aa, Mycobacterium
MVQRNCVVPMQLCHHFAPAMVERGRGGIVLF

SEQ ID NO: 702246 - protein, 18 aa, Mycobacterium
MVRACAAEQTPLLGVCLG

SEQ ID NO: 702247 - protein, 19 aa, Mycobacterium
MVRALLHGAYRYRWHHAVA

SEQ ID NO: 702248 - protein, 24 aa, Mycobacterium
MVRGSRALASWFAITRPPIGAEVA

SEQ ID NO: 702249 - protein, 18 aa, Mycobacterium
MVRHPIPPMIHGATQSAT

SEQ ID NO: 702250 - protein, 21 aa, Mycobacterium
MVRMPAFGLDGPWRNNVGFAQ

SEQ ID NO: 702251 - protein, 25 aa, Mycobacterium
MVRNAICAVTGWSQADVVVSVPDVG

SEQ ID NO: 702252 - protein, 17 aa, Mycobacterium
MVRRDRSLLPMAIEEGL

SEQ ID NO: 702253 - protein, 38 aa, Mycobacterium
MVRRGLDPFTFRIAQTVGWRLWMGVAFGLTSDPDELRE

SEQ ID NO: 702254 - protein, 23 aa, Mycobacterium
MVRRILRSMFAVGIDRDAAPPEP

SEQ ID NO: 702255 - protein, 21 aa, Mycobacterium
MVRRILRSMFAVGVDRWEPAP

SEQ ID NO: 702256 - protein, 26 aa, Mycobacterium
MVSAALWPVHAWRSDYMTDEDFTFFE

SEQ ID NO: 702257 - protein, 17 aa, Mycobacterium
MVSAARGYKCVLTMPDT

SEQ ID NO: 702258 - protein, 29 aa, Mycobacterium
MVSAASAWNRLASELSFTADGYERVIKAL

SEQ ID NO: 702259 - protein, 22 aa, Mycobacterium
MVSGRASFELVQKAVMAGIPAM

SEQ ID NO: 702260 - protein, 24 aa, Mycobacterium
MVSKRMISEYVHYLATELTPLGIR

SEQ ID NO: 702261 - protein, 24 aa, Mycobacterium
MVSLARTLISYGIEPDAVIGHSQG

SEQ ID NO: 702262 - protein, 20 aa, Mycobacterium
MVSSCKTFKGVLYGEMNPRE

SEQ ID NO: 702263 - protein, 22 aa, Mycobacterium
MVSWLPLFHDMGMIGFLTVPMY

SEQ ID NO: 702264 - protein, 27 aa, Mycobacterium
MVTAYACNGVDDEAWFFGNQADGDIDI

SEQ ID NO: 702265 - protein, 19 aa, Mycobacterium
MVTDFSFSDILTATRAIVQ

SEQ ID NO: 702266 - protein, 25 aa, Mycobacterium
MVTEWLKRVGEFRVDERAARRPPSS

SEQ ID NO: 702267 - protein, 19 aa, Mycobacterium
MVTEWLKRVPEFRVDAAAA

SEQ ID NO: 702268 - protein, 27 aa, Mycobacterium
MVTGDPHLRFYAGMPIRTAEGHALGTI

SEQ ID NO: 702269 - protein, 18 aa, Mycobacterium
MVTLKIARFNPENPDAAG

SEQ ID NO: 702270 - protein, 18 aa, Mycobacterium
MVTLKIARFNPESPDDAG

SEQ ID NO: 702271 - protein, 31 aa, Mycobacterium
MVTTKLKLSMFVLNAAFYKPALLSRDLGDLD

SEQ ID NO: 702272 - protein, 22 aa, Mycobacterium
MVVCRYGRYLAMAARDGEEMVI

SEQ ID NO: 702273 - protein, 17 aa, Mycobacterium
MVVGVWISKLFPQKMFK

SEQ ID NO: 702274 - protein, 22 aa, Mycobacterium
MVVHGRGGIILTVSPAGAASDQ

SEQ ID NO: 702275 - protein, 21 aa, Mycobacterium
MVVNRLPGLVVVDDLDRPVAV

SEQ ID NO: 702276 - protein, 23 aa, Mycobacterium
MVVPELQRRGLFRSAYEASTLRG

SEQ ID NO: 702277 - protein, 19 aa, Mycobacterium
MVVQLLDAWGVDITPEMAH

SEQ ID NO: 702278 - protein, 20 aa, Mycobacterium
MVVRLLAFGLRAHRLDDVDG

SEQ ID NO: 702279 - protein, 21 aa, Mycobacterium
MVVRLLAFGLRAHRLSDVDGE

SEQ ID NO: 702280 - protein, 24 aa, Mycobacterium
MVVTLRPGATMNFTELLDFCAARM

SEQ ID NO: 702281 - protein, 20 aa, Mycobacterium
MVVTVDRGRWGCVLGNDPGR

SEQ ID NO: 702282 - protein, 17 aa, Mycobacterium
MVYKLVEIDGIPVAKRS

SEQ ID NO: 702283 - protein, 17 aa, Mycobacterium
MVYPRVHPAPMETCGAV

SEQ ID NO: 702284 - protein, 22 aa, Mycobacterium
MVYVTMPPLFVVKAGDERIYCQ

SEQ ID NO: 702285 - protein, 19 aa, Mycobacterium
MWAARRSGLYYALINTHLT

SEQ ID NO: 702286 - protein, 17 aa, Mycobacterium
MWANAWLAGKAAPDDLL

SEQ ID NO: 702287 - protein, 18 aa, Mycobacterium
MWANGIKAPLGLGQAGQF

SEQ ID NO: 702288 - protein, 20 aa, Mycobacterium
MWAQDAAAMYCYAAGSTAAT

SEQ ID NO: 702289 - protein, 18 aa, Mycobacterium
MWAQDAAAMYGYAAQTAP

SEQ ID NO: 702290 - protein, 18 aa, Mycobacterium
MWAQDAMAMYGYAGSSAA

SEQ ID NO: 702291 - protein, 17 aa, Mycobacterium
MWAQDIVAMDGYAGTSA

SEQ ID NO: 702292 - protein, 20 aa, Mycobacterium
MWAQDVTAMVGYHSTSSAAA

SEQ ID NO: 702293 - protein, 17 aa, Mycobacterium
MWDAFAQEYLAPVRPLE

SEQ ID NO: 702294 - protein, 18 aa, Mycobacterium
MWEKVIFNLLSNALKFTF

SEQ ID NO: 702295 - protein, 17 aa, Mycobacterium
MWELPRDTTGTLGAVDA

SEQ ID NO: 702296 - protein, 18 aa, Mycobacterium
MWESIKIIEQCLDKLKPG

SEQ ID NO: 702297 - protein, 18 aa, Mycobacterium
MWESIKIVEQCLDKLKPG

SEQ ID NO: 702298 - protein, 18 aa, Mycobacterium
MWETIVLNLLSNAVKYTL

SEQ ID NO: 702299 - protein, 19 aa, Mycobacterium
MWFTEAYWPEFRRVDFLRA

SEQ ID NO: 702300 - protein, 18 aa, Mycobacterium
MWGSRPYAYLGITVPQFP

SEQ ID NO: 702301 - protein, 17 aa, Mycobacterium
MWGTRPYAYLGITVPKF

SEQ ID NO: 702302 - protein, 21 aa, Mycobacterium
MWPDGFCRQLLDQGYRVIRFD

SEQ ID NO: 702303 - protein, 23 aa, Mycobacterium
MWREMWDLSDQCWAQMNTTLMSL

SEQ ID NO: 702304 - protein, 26 aa, Mycobacterium
MWREVYKLRQPVLLIWGREDRVNPLD

SEQ ID NO: 702305 - protein, 21 aa, Mycobacterium
MWRLADRQLDTFIGRGSAEFL

SEQ ID NO: 702306 - protein, 18 aa, Mycobacterium
MWRPYTVKDRNLFTGQNP

SEQ ID NO: 702307 - protein, 19 aa, Mycobacterium
MWRQIPGAQFARVPGRRGG

SEQ ID NO: 702308 - protein, 20 aa, Mycobacterium
MWRWSVESVPQFWRALWEFF

SEQ ID NO: 702309 - protein, 17 aa, Mycobacterium
MWSMLVIARDLLSMLAD

SEQ ID NO: 702310 - protein, 24 aa, Mycobacterium
MWTSLIAYADWVWLAVRTNPDAKK

SEQ ID NO: 702311 - protein, 17 aa, Mycobacterium
MWVQDAIAMDTYASASA

SEQ ID NO: 702312 - protein, 23 aa, Mycobacterium
MYAAAGRYVLDRAIFDALRRINR

SEQ ID NO: 702313 - protein, 27 aa, Mycobacterium
MYAAICVAATLVVRGCDHASLLVRDGD

SEQ ID NO: 702314 - protein, 21 aa, Mycobacterium
MYAFDPCAPFGGYKNSGIGRE

SEQ ID NO: 702315 - protein, 17 aa, Mycobacterium
MYAGAGVGPLVSAAAAW

SEQ ID NO: 702316 - protein, 26 aa, Mycobacterium
MYAGWREVIAGFVARRCDCKTTDLLP

SEQ ID NO: 702317 - protein, 25 aa, Mycobacterium
MYAGWREVIAGFVARRLDCKPTDLV

SEQ ID NO: 702318 - protein, 18 aa, Mycobacterium
MYALGEMQPRFDNRVSLD

SEQ ID NO: 702319 - protein, 24 aa, Mycobacterium
MYALGRSAFQLGVLERGLQMTAEY

SEQ ID NO: 702320 - protein, 18 aa, Mycobacterium
MYALMNLPPGQRPDPSQL

SEQ ID NO: 702321 - protein, 19 aa, Mycobacterium
MYALNFLDKGIGFTKAATG

SEQ ID NO: 702322 - protein, 19 aa, Mycobacterium
MYAMFAGFFHGAAMVAAQG

SEQ ID NO: 702323 - protein, 18 aa, Mycobacterium
MYAQHGFVRAGEDFVDDG

SEQ ID NO: 702324 - protein, 18 aa, Mycobacterium
MYARRLGPKRARLLNPLA

SEQ ID NO: 702325 - protein, 18 aa, Mycobacterium
MYDCGFVNSVVPRDKLED

SEQ ID NO: 702326 - protein, 17 aa, Mycobacterium
MYDCNFLNKVVERDQLE

SEQ ID NO: 702327 - protein, 17 aa, Mycobacterium
MYDCNFLNKVVPRDRLE

SEQ ID NO: 702328 - protein, 17 aa, Mycobacterium
MYECGFVNSVVPREKLE

SEQ ID NO: 702329 - protein, 19 aa, Mycobacterium
MYEEIRVGVLAYMAYHEQN

SEQ ID NO: 702330 - protein, 17 aa, Mycobacterium
MYEGAVVRGTNLPADVL

SEQ ID NO: 702331 - protein, 17 aa, Mycobacterium
MYELIAGLEKWRPQPWL

SEQ ID NO: 702332 - protein, 17 aa, Mycobacterium
MYFGAELVKITPMDFLG

SEQ ID NO: 702333 - protein, 17 aa, Mycobacterium
MYFGAELVKVTPMDFLR

SEQ ID NO: 702334 - protein, 25 aa, Mycobacterium
MYFHFKSKHALAVAIIESQVEDGAA

SEQ ID NO: 702335 - protein, 17 aa, Mycobacterium
MYGFAPICLALSNVYGP

SEQ ID NO: 702336 - protein, 17 aa, Mycobacterium
MYGGFRLALRGDELHAA

SEQ ID NO: 702337 - protein, 24 aa, Mycobacterium
MYGIPEARGLIYSEYIRLIEMIAE

SEQ ID NO: 702338 - protein, 27 aa, Mycobacterium
MYGRELNWVQQWWSGVFETADGYVTVL

SEQ ID NO: 702339 - protein, 21 aa, Mycobacterium
MYHALTWGPLVREIVYAATGK

SEQ ID NO: 702340 - protein, 25 aa, Mycobacterium
MYLQGGRLHFCYNFLGEYEQTLAAP

SEQ ID NO: 702341 - protein, 17 aa, Mycobacterium
MYLTGYNIGEWDIRDLA

SEQ ID NO: 702342 - protein, 19 aa, Mycobacterium
MYPHGRRTTVQPGPLGAEL

SEQ ID NO: 702343 - protein, 29 aa, Mycobacterium
MYPIYATCVELGIPIFVCAGIPGPRLPFR

SEQ ID NO: 702344 - protein, 20 aa, Mycobacterium
MYPLQRFVHWMGDDDIAGAK

SEQ ID NO: 702345 - protein, 25 aa, Mycobacterium
MYPSYREIAALPLAERVAEMRKPEV

SEQ ID NO: 702346 - protein, 21 aa, Mycobacterium
MYQHGGAGFDGLPGEPPDIPP

SEQ ID NO: 702347 - protein, 24 aa, Mycobacterium
MYRDFRPVAVLDWEMVTLGPRELD

SEQ ID NO: 702348 - protein, 26 aa, Mycobacterium
MYREAKARIGDPVLAWADIQADPQRR

SEQ ID NO: 702349 - protein, 26 aa, Mycobacterium
MYREAKARLGDPVLAWADIQADPERR

SEQ ID NO: 702350 - protein, 26 aa, Mycobacterium
MYREAKARLGDPVLAWADIQADPQRR

SEQ ID NO: 702351 - protein, 27 aa, Mycobacterium
MYRLYEMRLRQGLSVKRSELPRHIAVL

SEQ ID NO: 702352 - protein, 18 aa, Mycobacterium
MYSNYGFTALAEAVAQES

SEQ ID NO: 702353 - protein, 18 aa, Mycobacterium
MYSNYGFTVLAEAVQRES

SEQ ID NO: 702354 - protein, 21 aa, Mycobacterium
MYTVKGIKLAINYGLNKVRFP

SEQ ID NO: 702355 - protein, 17 aa, Mycobacterium
MYVELRPSVTTPEPPWQ

SEQ ID NO: 702356 - protein, 30 aa, Mycobacterium
MYVGSLAILRRPRAGLSYETLLATVEQRLP

SEQ ID NO: 702357 - protein, 23 aa, Mycobacterium
MYVHALLRYPVKSMLGEAVATLF

SEQ ID NO: 702358 - protein, 23 aa, Mycobacterium
MYVLSGRMRLVLGDRDFAIAPGE

SEQ ID NO: 702359 - protein, 25 aa, Mycobacterium
MYVSLELAHSMSLYASMSIADGNLD

SEQ ID NO: 702360 - protein, 20 aa, Mycobacterium
MYYLDMGWPDLMVAVEYDGE

SEQ ID NO: 702361 - protein, 19 aa, Mycobacterium
MYYRHRGYAPFSLPSAFTD

SEQ ID NO: 702362 - protein, 19 aa, Mycobacterium
NAAAAARTTGLLAAAEDEV

SEQ ID NO: 702363 - protein, 20 aa, Mycobacterium
NAAALPFRYTVNGYRGCTHA

SEQ ID NO: 702364 - protein, 25 aa, Mycobacterium
NAAAVLPTTVLQAAGADEVSAAVAA

SEQ ID NO: 702365 - protein, 19 aa, Mycobacterium
NAAAVRSMWTTVREKVRER

SEQ ID NO: 702366 - protein, 28 aa, Mycobacterium
NAACGGRFALGLGLSHDWIINGQLGLPY

SEQ ID NO: 702367 - protein, 22 aa, Mycobacterium
NAADGRLVLHLEDGAIDSIIAA

SEQ ID NO: 702368 - protein, 17 aa, Mycobacterium
NAAEAFETFLQTKYVGQ

SEQ ID NO: 702369 - protein, 21 aa, Mycobacterium
NAAEAQPGWAARNPQQRARVL

SEQ ID NO: 702370 - protein, 17 aa, Mycobacterium
NAAFYYGLVRSIADSDA

SEQ ID NO: 702371 - protein, 30 aa, Mycobacterium
NAAGDVPTLFAWRILDYWNWTNRPDRNHYE

SEQ ID NO: 702372 - protein, 18 aa, Mycobacterium
NAAGLGVDAVIFGSGCAD

SEQ ID NO: 702373 - protein, 24 aa, Mycobacterium
NAAGLPSLMVLTGVSSARDAVHAD

SEQ ID NO: 702374 - protein, 30 aa, Mycobacterium
NAAGQDCPDWVPGELWIGGRGIARGYRGKP

SEQ ID NO: 702375 - protein, 17 aa, Mycobacterium
NAAGSVFLTRPSLAHFI

SEQ ID NO: 702376 - protein, 18 aa, Mycobacterium
NAAIGFPLVTGPPELSTP

SEQ ID NO: 702377 - protein, 29 aa, Mycobacterium
NAAIVRPLLRFFFRSWFRVEVSGVENLPS

SEQ ID NO: 702378 - protein, 24 aa, Mycobacterium
NAAKLPSLMVLTGVSSARDAVYAD

SEQ ID NO: 702379 - protein, 23 aa, Mycobacterium
NAAKRYGDFVALDHVDFVVPAGS

SEQ ID NO: 702380 - protein, 24 aa, Mycobacterium
NAALALAAVEAFFGAGAQRQLDVE

SEQ ID NO: 702381 - protein, 17 aa, Mycobacterium
NAAPARYTANPSVAEGW

SEQ ID NO: 702382 - protein, 21 aa, Mycobacterium
NAAQCAMVFQEDALLPWRTAL

SEQ ID NO: 702383 - protein, 21 aa, Mycobacterium
NAAQEPVWGAGDFVAYLDTSS

SEQ ID NO: 702384 - protein, 30 aa, Mycobacterium
NAAQPIWWLVRALEFGQDFQTFIKELFTNP

SEQ ID NO: 702385 - protein, 17 aa, Mycobacterium
NAARAPVLVGIDGSPAS

SEQ ID NO: 702386 - protein, 17 aa, Mycobacterium
NAARLAIDSGFDAVEIH

SEQ ID NO: 702387 - protein, 17 aa, Mycobacterium
NAARLAIEAGFDAVEIH

SEQ ID NO: 702388 - protein, 18 aa, Mycobacterium
NAARLGLAGWPRAAEESI

SEQ ID NO: 702389 - protein, 22 aa, Mycobacterium
NAARLGLSGWPRAAEESIVARD

SEQ ID NO: 702390 - protein, 20 aa, Mycobacterium
NAASAFRVVRDHVTSVFRHD

SEQ ID NO: 702391 - protein, 17 aa, Mycobacterium
NAASFPGALTVEQDIAS

SEQ ID NO: 702392 - protein, 27 aa, Mycobacterium
NAASVGGRLSVPVSWSAASTPAPVLGQ

SEQ ID NO: 702393 - protein, 23 aa, Mycobacterium
NAATLEFGDLVSAGVVDPAKVTR

SEQ ID NO: 702394 - protein, 17 aa, Mycobacterium
NACRVVDDTGADCPDWV

SEQ ID NO: 702395 - protein, 22 aa, Mycobacterium
NADATIWLSRRSEPMPFYRRNV

SEQ ID NO: 702396 - protein, 26 aa, Mycobacterium
NADFARAVADAGLTWIGPPVAAIESM

SEQ ID NO: 702397 - protein, 22 aa, Mycobacterium
NADGLFGVLTNVVWTSHGPCSV

SEQ ID NO: 702398 - protein, 19 aa, Mycobacterium
NADGLFTAVVQERGTGDVL

SEQ ID NO: 702399 - protein, 22 aa, Mycobacterium
NADGTPCSDIGTAGPGGATGQI

SEQ ID NO: 702400 - protein, 24 aa, Mycobacterium
NADIAMAFERYRIVTGDDELEADC

SEQ ID NO: 702401 - protein, 22 aa, Mycobacterium
NADIAMAFERYRIVTGDDSLEQ

SEQ ID NO: 702402 - protein, 18 aa, Mycobacterium
NADLPWELDVTPDNPDAQ

SEQ ID NO: 702403 - protein, 20 aa, Mycobacterium
NADPRLALRPVAGADMHRRV

SEQ ID NO: 702404 - protein, 20 aa, Mycobacterium
NADTGFTWGRTEPGWDDRKP

SEQ ID NO: 702405 - protein, 22 aa, Mycobacterium
NADVMLRYNFPGAGLTDDALRT

SEQ ID NO: 702406 - protein, 34 aa, Mycobacterium
NADVPMMIVAVGFAERIGAVLPELAELLHQPLVT

SEQ ID NO: 702407 - protein, 23 aa, Mycobacterium
NAEDARYLLAAAVEKGTDAVVVT

SEQ ID NO: 702408 - protein, 17 aa, Mycobacterium
NAEKVFTRWMVAGDAAL

SEQ ID NO: 702409 - protein, 24 aa, Mycobacterium
NAELKTLMLDYAFINADLVWFHVA

SEQ ID NO: 702410 - protein, 26 aa, Mycobacterium
NAELRQRCPVAWNENYDGFWYLSSYE

SEQ ID NO: 702411 - protein, 19 aa, Mycobacterium
NAEPAWSTFMGAYWQIGSA

SEQ ID NO: 702412 - protein, 17 aa, Mycobacterium
NAERLQWLRSAGAQTVI

SEQ ID NO: 702413 - protein, 18 aa, Mycobacterium
NAERMRHGMYWSGDLAYR

SEQ ID NO: 702414 - protein, 21 aa, Mycobacterium
NAETLRDGWVHTGDVGYLDHD

SEQ ID NO: 702415 - protein, 24 aa, Mycobacterium
NAEVAGPLLRRKFRLSKNTMAPLR

SEQ ID NO: 702416 - protein, 20 aa, Mycobacterium
NAEVKAEFLAAGEEYKEWYE

SEQ ID NO: 702417 - protein, 21 aa, Mycobacterium
NAFADRAARELIPLGEKTVKR

SEQ ID NO: 702418 - protein, 23 aa, Mycobacterium
NAFGDKVLPLYLPTGLPSCEGLI

SEQ ID NO: 702419 - protein, 20 aa, Mycobacterium
NAFGGFRIPGAVRIPTQFMV

SEQ ID NO: 702420 - protein, 25 aa, Mycobacterium
NAFMRGIESPMFFTANTIDQPGKQI

SEQ ID NO: 702421 - protein, 18 aa, Mycobacterium
NAFPTVCEQLSKSGLAQP

SEQ ID NO: 702422 - protein, 22 aa, Mycobacterium
NAFRKGNVVSIALIHGKTNWTK

SEQ ID NO: 702423 - protein, 31 aa, Mycobacterium
NAFRRKEISVEEIMASPVLNYPLRQYMFCAP

SEQ ID NO: 702424 - protein, 19 aa, Mycobacterium
NAFVLRGGVPVFVDIRPDT

SEQ ID NO: 702425 - protein, 17 aa, Mycobacterium
NAFWPITGELFGFDAAA

SEQ ID NO: 702426 - protein, 19 aa, Mycobacterium
NAGCPAGENIQAWLADARA

SEQ ID NO: 702427 - protein, 20 aa, Mycobacterium
NAGCVWINDHIPIISEMPHG

SEQ ID NO: 702428 - protein, 20 aa, Mycobacterium
NAGDKVVVWYPAANRDPAVF

SEQ ID NO: 702429 - protein, 26 aa, Mycobacterium
NAGFARACADAGLVFVGPPPDAIDAM

SEQ ID NO: 702430 - protein, 25 aa, Mycobacterium
NAGFGLGIHRCIGMHLARVEIAIAF

SEQ ID NO: 702431 - protein, 20 aa, Mycobacterium
NAGGALRFTLTNNRPAETER

SEQ ID NO: 702432 - protein, 25 aa, Mycobacterium
NAGGLFGVLTNVVWTNRGPCAIEGF

SEQ ID NO: 702433 - protein, 20 aa, Mycobacterium
NAGGLFLAWVDRVVAPGNPA

SEQ ID NO: 702434 - protein, 21 aa, Mycobacterium
NAGGLFLGWVDRVVAQADPTA

SEQ ID NO: 702435 - protein, 22 aa, Mycobacterium
NAGGLFLSWVDRLIGPADRDGE

SEQ ID NO: 702436 - protein, 24 aa, Mycobacterium
NAGKDLSFVPLRPERVVEVRYDHM

SEQ ID NO: 702437 - protein, 19 aa, Mycobacterium
NAGKLIVVVLPDFGERYLS

SEQ ID NO: 702438 - protein, 20 aa, Mycobacterium
NAGKLIVVVLPDFGERYLST

SEQ ID NO: 702439 - protein, 20 aa, Mycobacterium
NAGKLVVVVLPDFGERYLST

SEQ ID NO: 702440 - protein, 18 aa, Mycobacterium
NAGKLVVVVLPSFGERYL

SEQ ID NO: 702441 - protein, 28 aa, Mycobacterium
NAGLLFGSGGFGGFGGFGSGGGSGGNGG

SEQ ID NO: 702442 - protein, 17 aa, Mycobacterium
NAGLPFTHVDVVEAHGT

SEQ ID NO: 702443 - protein, 19 aa, Mycobacterium
NAGLRRFVFTSSYATVDRR

SEQ ID NO: 702444 - protein, 27 aa, Mycobacterium
NAGLWNRAELFGGLSVITPAELHTLAA

SEQ ID NO: 702445 - protein, 18 aa, Mycobacterium
NAGMPLAVVRPHRTEEVQ

SEQ ID NO: 702446 - protein, 27 aa, Mycobacterium
NAGPDRSILRPASWDIDLPDQFTAAER

SEQ ID NO: 702447 - protein, 26 aa, Mycobacterium
NAGQAAELFGWLGPYPDAVVGSSAAI

SEQ ID NO: 702448 - protein, 19 aa, Mycobacterium
NAGQFGEPGTGGSGGNGGK

SEQ ID NO: 702449 - protein, 17 aa, Mycobacterium
NAGQLCISIERIYVEKD

SEQ ID NO: 702450 - protein, 18 aa, Mycobacterium
NAGQLCISIERIYVERAV

SEQ ID NO: 702451 - protein, 24 aa, Mycobacterium
NAGRSQMAMGFFRHLAADRATVYS

SEQ ID NO: 702452 - protein, 23 aa, Mycobacterium
NAGRVWPRHRRGINCAMTSAPVV

SEQ ID NO: 702453 - protein, 22 aa, Mycobacterium
NAGSARDLRVALLSVPEGSTAY

SEQ ID NO: 702454 - protein, 18 aa, Mycobacterium
NAGTLRWDDQLTVTDRGK

SEQ ID NO: 702455 - protein, 17 aa, Mycobacterium
NAGTPGWAMSRAAAQHA

SEQ ID NO: 702456 - protein, 22 aa, Mycobacterium
NAGVGGFAWLTLGSVARREAMP

SEQ ID NO: 702457 - protein, 19 aa, Mycobacterium
NAGVHACAVIMSSEPLTDA

SEQ ID NO: 702458 - protein, 19 aa, Mycobacterium
NAGVIYPGLAQRMSAGTGI

SEQ ID NO: 702459 - protein, 18 aa, Mycobacterium
NAGVKWPNDVMVGPRKLA

SEQ ID NO: 702460 - protein, 17 aa, Mycobacterium
NAGVLLITHYTRILRYI

SEQ ID NO: 702461 - protein, 19 aa, Mycobacterium
NAGVTWVARLGEITDDDLD

SEQ ID NO: 702462 - protein, 18 aa, Mycobacterium
NAGVYAFDVAALRSALSR

SEQ ID NO: 702463 - protein, 17 aa, Mycobacterium
NAGVYAFEITALQSALS

SEQ ID NO: 702464 - protein, 18 aa, Mycobacterium
NAHLRAAHHLSMCPQCAA

SEQ ID NO: 702465 - protein, 20 aa, Mycobacterium
NAHTLAAIAGRLTEFPRCAA

SEQ ID NO: 702466 - protein, 24 aa, Mycobacterium
NAHVRRLLIEAAWHHRASYRNPGP

SEQ ID NO: 702467 - protein, 24 aa, Mycobacterium
NAHVRRLLIEAAWHHRTVHPASTI

SEQ ID NO: 702468 - protein, 20 aa, Mycobacterium
NAHWRPEHYYAPGTQITAEA

SEQ ID NO: 702469 - protein, 18 aa, Mycobacterium
NAHYCYARVTSVDTSAVE

SEQ ID NO: 702470 - protein, 17 aa, Mycobacterium
NAIACKQSSILMEHPHG

SEQ ID NO: 702471 - protein, 17 aa, Mycobacterium
NAIADRWINHYDRMRAQ

SEQ ID NO: 702472 - protein, 36 aa, Mycobacterium
NAIAIRSIGCGFGLVKAQEKLGCGESVDRHEREVHM

SEQ ID NO: 702473 - protein, 17 aa, Mycobacterium
NAIAVIGMAGRFPGAQS

SEQ ID NO: 702474 - protein, 18 aa, Mycobacterium
NAIFELWSGIMPERAIAC

SEQ ID NO: 702475 - protein, 25 aa, Mycobacterium
NAIGDSPLGAWVRSLGVDGDQVISV

SEQ ID NO: 702476 - protein, 18 aa, Mycobacterium
NAIKVARLATGRPAVVAF

SEQ ID NO: 702477 - protein, 18 aa, Mycobacterium
NAIRDFIETTGIPFLPMS

SEQ ID NO: 702478 - protein, 18 aa, Mycobacterium
NAIREALELLRGEGLITR

SEQ ID NO: 702479 - protein, 27 aa, Mycobacterium
NAIRLYKRMFIPGIENLVFMGFAQAVP

SEQ ID NO: 702480 - protein, 17 aa, Mycobacterium
NAISGFLNTGGATPANL

SEQ ID NO: 702481 - protein, 24 aa, Mycobacterium
NAISGRVAFALGLEGPAVAIDTAC

SEQ ID NO: 702482 - protein, 24 aa, Mycobacterium
NAISGRVAFALGLEGPAVAVDTAC

SEQ ID NO: 702483 - protein, 17 aa, Mycobacterium
NAITHGVLAFADNPAQW

SEQ ID NO: 702484 - protein, 17 aa, Mycobacterium
NAIWKARTQDVGYLDLA

SEQ ID NO: 702485 - protein, 17 aa, Mycobacterium
NAIWKARTQDVGYLDLT

SEQ ID NO: 702486 - protein, 18 aa, Mycobacterium
NAIWKARTQDVGYLDLTG

SEQ ID NO: 702487 - protein, 24 aa, Mycobacterium
NAIYKRWHCGELDVPLPGGESAND

SEQ ID NO: 702488 - protein, 19 aa, Mycobacterium
NAKARLLRDNIVVVENLSI

SEQ ID NO: 702489 - protein, 24 aa, Mycobacterium
NAKDEARRNWIISALARGGDIGSL

SEQ ID NO: 702490 - protein, 17 aa, Mycobacterium
NAKGVSLIGEFNHWGGN

SEQ ID NO: 702491 - protein, 19 aa, Mycobacterium
NAKLASLPVGMAGRAALGF

SEQ ID NO: 702492 - protein, 26 aa, Mycobacterium
NAKQRLRECWLWSRAYTISGGSSEMM

SEQ ID NO: 702493 - protein, 17 aa, Mycobacterium
NAKRFRIQDAIWRGVYY

SEQ ID NO: 702494 - protein, 24 aa, Mycobacterium
NAKRYRLAELALRDRVPMVMLLEG

SEQ ID NO: 702495 - protein, 34 aa, Mycobacterium
NAKRYRLAELALRSKIPLVMLLEGAGFRAAAGEH

SEQ ID NO: 702496 - protein, 26 aa, Mycobacterium
NALAKARGSWALAVLEHGTGRIAVAA

SEQ ID NO: 702497 - protein, 17 aa, Mycobacterium
NALARIPDELSFVEAAP

SEQ ID NO: 702498 - protein, 19 aa, Mycobacterium
NALARKFCERGGCAFLGEH

SEQ ID NO: 702499 - protein, 17 aa, Mycobacterium
NALARRLLVKRYGAAVL

SEQ ID NO: 702500 - protein, 19 aa, Mycobacterium
NALCSVYGHLHIPRTTWHD

SEQ ID NO: 702501 - protein, 18 aa, Mycobacterium
NALDTKWGAITGRNIRGL

SEQ ID NO: 702502 - protein, 33 aa, Mycobacterium
NALDVYFALSLHIRGVVVLEHMDTVMPASGEAR

SEQ ID NO: 702503 - protein, 24 aa, Mycobacterium
NALEKFPGCAVVISHDRWFLDRTC

SEQ ID NO: 702504 - protein, 17 aa, Mycobacterium
NALFWQEYRADPAEFWF

SEQ ID NO: 702505 - protein, 17 aa, Mycobacterium
NALGQRGESGWRAIGLP

SEQ ID NO: 702506 - protein, 18 aa, Mycobacterium
NALIEARVGTVIYGVADP

SEQ ID NO: 702507 - protein, 21 aa, Mycobacterium
NALIKAREAFAATGLPSVADD

SEQ ID NO: 702508 - protein, 20 aa, Mycobacterium
NALIKAREGVKHTGLACVAD

SEQ ID NO: 702509 - protein, 23 aa, Mycobacterium
NALKRAGFGTLRLPESLGGAGFT

SEQ ID NO: 702510 - protein, 22 aa, Mycobacterium
NALLGRPLIGNGANGAPGADGQ

SEQ ID NO: 702511 - protein, 21 aa, Mycobacterium
NALLTRAFVRLMFRHRHRRWR

SEQ ID NO: 702512 - protein, 21 aa, Mycobacterium
NALNEVCRFSDPLAYRLAVAE

SEQ ID NO: 702513 - protein, 20 aa, Mycobacterium
NALNKYGFRHSVLTRPPSAG

SEQ ID NO: 702514 - protein, 24 aa, Mycobacterium
NALPKVSWVLPGFLLSEHPALPVS

SEQ ID NO: 702515 - protein, 18 aa, Mycobacterium
NALPSGGQLGVFDRSHYE

SEQ ID NO: 702516 - protein, 19 aa, Mycobacterium
NALPYRWIDVQPEMIRVGS

SEQ ID NO: 702517 - protein, 18 aa, Mycobacterium
NALSAALRDQFFAALAAA

SEQ ID NO: 702518 - protein, 26 aa, Mycobacterium
NALSKARFEFRWEDQFNLSLDPDTAR

SEQ ID NO: 702519 - protein, 18 aa, Mycobacterium
NALTGVFGDLNLDAVPGL

SEQ ID NO: 702520 - protein, 19 aa, Mycobacterium
NALTKLFVAGLFATANAAL

SEQ ID NO: 702521 - protein, 18 aa, Mycobacterium
NALVLRQRLRLRGVAAEI

SEQ ID NO: 702522 - protein, 32 aa, Mycobacterium
NAMIADGILDRFPRPDVVLGQHVGPLPAGMIA

SEQ ID NO: 702523 - protein, 23 aa, Mycobacterium
NAMLAGLAPRFGVGVVATTGAHF

SEQ ID NO: 702524 - protein, 24 aa, Mycobacterium
NAMLVVRLDFHLDRLVMAVYSHCQ

SEQ ID NO: 702525 - protein, 17 aa, Mycobacterium
NAMPIVMAEAIDISNAV

SEQ ID NO: 702526 - protein, 25 aa, Mycobacterium
NAMPPLDHRAPGPALALLADPRVTV

SEQ ID NO: 702527 - protein, 25 aa, Mycobacterium
NAMRLRTLIQAAWNEMFTGIDVLLA

SEQ ID NO: 702528 - protein, 23 aa, Mycobacterium
NAMTDRALREFVVATPYVEAKDW

SEQ ID NO: 702529 - protein, 25 aa, Mycobacterium
NANCAIAVAAGRRKVPVVNGALVSG

SEQ ID NO: 702530 - protein, 26 aa, Mycobacterium
NANECCRLRKVVPLSKALSGYSAWVT

SEQ ID NO: 702531 - protein, 18 aa, Mycobacterium
NANGRIPFETALLSEVLA

SEQ ID NO: 702532 - protein, 18 aa, Mycobacterium
NAPAIAAVEADYEQMWAQ

SEQ ID NO: 702533 - protein, 25 aa, Mycobacterium
NAPALKLYLGDSFEGVITIEIVDGR

SEQ ID NO: 702534 - protein, 27 aa, Mycobacterium
NAPAQSLFGRPLIGDGANATTPGGNGG

SEQ ID NO: 702535 - protein, 18 aa, Mycobacterium
NAPARALLGHPLIPTDGS

SEQ ID NO: 702536 - protein, 26 aa, Mycobacterium
NAPDIPRERFTALTRLDHNRAISQLA

SEQ ID NO: 702537 - protein, 18 aa, Mycobacterium
NAPFKFAPENGLAYFENL

SEQ ID NO: 702538 - protein, 24 aa, Mycobacterium
NAPIADVILVWCADEATGGMSAVL

SEQ ID NO: 702539 - protein, 19 aa, Mycobacterium
NAPLISFDEAFGLVKINAI

SEQ ID NO: 702540 - protein, 23 aa, Mycobacterium
NAPLPAWTHRRFFVDGEGQDSKA

SEQ ID NO: 702541 - protein, 18 aa, Mycobacterium
NAPMLVGAGVSALAKGRF

SEQ ID NO: 702542 - protein, 24 aa, Mycobacterium
NAPRMLGSVGLWLSGEIAAGRIRD

SEQ ID NO: 702543 - protein, 25 aa, Mycobacterium
NAPSELLFGRMMIGNGADATEAGTA

SEQ ID NO: 702544 - protein, 42 aa, Mycobacterium
NAPTEPADMPGVWAVMAWARRQPMYSDPAMRTTVNPQAQLPV

SEQ ID NO: 702545 - protein, 28 aa, Mycobacterium
NAPTQALFGRPLIGNGADGAAGTGQAGA

SEQ ID NO: 702546 - protein, 26 aa, Mycobacterium
NAPTQALLDRPLIGNGANGAAGTGAN

SEQ ID NO: 702547 - protein, 19 aa, Mycobacterium
NAQAALRIEQVEQMVLEQF

SEQ ID NO: 702548 - protein, 26 aa, Mycobacterium
NAQELYFPVCFELAVTKGPPAPDDRE

SEQ ID NO: 702549 - protein, 19 aa, Mycobacterium
NAQESWPKYFSRPEPDTSS

SEQ ID NO: 702550 - protein, 19 aa, Mycobacterium
NAQLWRFIVLDGPEQRAAV

SEQ ID NO: 702551 - protein, 19 aa, Mycobacterium
NAQLWRFVVLDAPEQRAAV

SEQ ID NO: 702552 - protein, 19 aa, Mycobacterium
NAQLWRFVVLDASEQRAAV

SEQ ID NO: 702553 - protein, 25 aa, Mycobacterium
NAQSGSIGLGFAIPVDQAKRIADEL

SEQ ID NO: 702554 - protein, 21 aa, Mycobacterium
NARADIRVVIVYGGHEIFCAG

SEQ ID NO: 702555 - protein, 23 aa, Mycobacterium
NARAFPRHLPIQLVVADRLRDLR

SEQ ID NO: 702556 - protein, 23 aa, Mycobacterium
NARALVYNAEFAPRVAAIRDRLP

SEQ ID NO: 702557 - protein, 25 aa, Mycobacterium
NARDATQIFGGYGFMNEYSVARHYR

SEQ ID NO: 702558 - protein, 25 aa, Mycobacterium
NARETWPGDGWVTAAAHERFLNRYG

SEQ ID NO: 702559 - protein, 20 aa, Mycobacterium
NARFALIERMGHDLPEPVWK

SEQ ID NO: 702560 - protein, 23 aa, Mycobacterium
NARFCHECGAPIGAADTRAEYKQ

SEQ ID NO: 702561 - protein, 28 aa, Mycobacterium
NARFTIHAGEAFGLPSIHEAIAFCGADR

SEQ ID NO: 702562 - protein, 29 aa, Mycobacterium
NARGEGFLYPRITGYLAQRLQVEDWYRRH

SEQ ID NO: 702563 - protein, 24 aa, Mycobacterium
NARGGRLSRQSAWQVLQDAAECAG

SEQ ID NO: 702564 - protein, 25 aa, Mycobacterium
NARGGRLSRQSAWQVLQDAAERAGI

SEQ ID NO: 702565 - protein, 21 aa, Mycobacterium
NARGGRLSRQSAWQVLQDAAG

SEQ ID NO: 702566 - protein, 24 aa, Mycobacterium
NARGGRLSRQSAWQVLQDSAERAG

SEQ ID NO: 702567 - protein, 19 aa, Mycobacterium
NARGPLIVIGRVGSYCGSV

SEQ ID NO: 702568 - protein, 23 aa, Mycobacterium
NARIRLEPPLTLLKHYFPDSATG

SEQ ID NO: 702569 - protein, 23 aa, Mycobacterium
NARKCAMFTGAALAGFAKYLHRC

SEQ ID NO: 702570 - protein, 18 aa, Mycobacterium
NARLAVNVGVITKSCAAA

SEQ ID NO: 702571 - protein, 23 aa, Mycobacterium
NARLRPRIGVMLQGGGGYPAARA

SEQ ID NO: 702572 - protein, 21 aa, Mycobacterium
NARRAVFYFSHPVEEDRAEFA

SEQ ID NO: 702573 - protein, 24 aa, Mycobacterium
NARRGRLGLSVADYRREMGELFAP

SEQ ID NO: 702574 - protein, 24 aa, Mycobacterium
NARRSRLGLGVAEYRHTMAQLFAP

SEQ ID NO: 702575 - protein, 23 aa, Mycobacterium
NARTEALRQLGLTPGHEHDTVSA

SEQ ID NO: 702576 - protein, 18 aa, Mycobacterium
NARVLALAADNSMPLLER

SEQ ID NO: 702577 - protein, 21 aa, Mycobacterium
NARYCLGRPGWAEDLQHGLAM

SEQ ID NO: 702578 - protein, 18 aa, Mycobacterium
NASDLAWHKLSVQPYAAM

SEQ ID NO: 702579 - protein, 18 aa, Mycobacterium
NASKVVLGELVIDEGTYT

SEQ ID NO: 702580 - protein, 21 aa, Mycobacterium
NASLFGFGGAGGVGGISGNDT

SEQ ID NO: 702581 - protein, 23 aa, Mycobacterium
NASLHGLAGWVDVKGPVVATAIS

SEQ ID NO: 702582 - protein, 23 aa, Mycobacterium
NASLHGLAGWVDVKPAVVSAAIA

SEQ ID NO: 702583 - protein, 17 aa, Mycobacterium
NASLMTCEPLRYRPQWA

SEQ ID NO: 702584 - protein, 23 aa, Mycobacterium
NASRFGIQDAIWRGVYYTPEGAR

SEQ ID NO: 702585 - protein, 24 aa, Mycobacterium
NASRWGRYPLRAHVTVTAPGGLVT

SEQ ID NO: 702586 - protein, 22 aa, Mycobacterium
NASVARRVWAHAGLADRATCLT

SEQ ID NO: 702587 - protein, 17 aa, Mycobacterium
NATAALVRFSDQFGIPV

SEQ ID NO: 702588 - protein, 25 aa, Mycobacterium
NATAGTDRYGGYGGDGGGGGGGGYG

SEQ ID NO: 702589 - protein, 22 aa, Mycobacterium
NATANCFPMIQISGSSRRSIVD

SEQ ID NO: 702590 - protein, 20 aa, Mycobacterium
NATGLPLDLAVEKLVTSPLG

SEQ ID NO: 702591 - protein, 24 aa, Mycobacterium
NATLIKKFRGGMGAVTEHLLQMFT

SEQ ID NO: 702592 - protein, 28 aa, Mycobacterium
NATLLKRFTKKFAVKRGAMAAGKLLPAG

SEQ ID NO: 702593 - protein, 20 aa, Mycobacterium
NATMYGLCGSVWGSDEVAAR

SEQ ID NO: 702594 - protein, 18 aa, Mycobacterium
NATPEFAAKVVAINYLGP

SEQ ID NO: 702595 - protein, 23 aa, Mycobacterium
NATPGPDGWIRAVGYHDSVAGEL

SEQ ID NO: 702596 - protein, 22 aa, Mycobacterium
NATPKARMARKLRTKKGKAAYS

SEQ ID NO: 702597 - protein, 24 aa, Mycobacterium
NATPKTCVFEYVYLARPDSMLDGR

SEQ ID NO: 702598 - protein, 23 aa, Mycobacterium
NATRATSRFRLVSARELGQPIKP

SEQ ID NO: 702599 - protein, 21 aa, Mycobacterium
NATRIPMTWFEVDQVPLWAKV

SEQ ID NO: 702600 - protein, 21 aa, Mycobacterium
NATSSIAAFGGDGGAGGDAGH

SEQ ID NO: 702601 - protein, 23 aa, Mycobacterium
NATSVPQLWLLGSSMYSAHLAAA

SEQ ID NO: 702602 - protein, 20 aa, Mycobacterium
NATTNCFPMIQISGSSNRAL

SEQ ID NO: 702603 - protein, 18 aa, Mycobacterium
NATVGKLLGFRVVTSNNL

SEQ ID NO: 702604 - protein, 22 aa, Mycobacterium
NATVLVCYMGVNGRDGTVFDSS

SEQ ID NO: 702605 - protein, 19 aa, Mycobacterium
NAVAAAFRDNGFRRGTIVA

SEQ ID NO: 702606 - protein, 18 aa, Mycobacterium
NAVACGRSVQAGYEGLSR

SEQ ID NO: 702607 - protein, 17 aa, Mycobacterium
NAVACGRSVQPGYEGLS

SEQ ID NO: 702608 - protein, 25 aa, Mycobacterium
NAVAHLTRYVGWLIGVEDAWLPQDF

SEQ ID NO: 702609 - protein, 27 aa, Mycobacterium
NAVAPGPILTDWARPVLTSAGIATDDP

SEQ ID NO: 702610 - protein, 17 aa, Mycobacterium
NAVAPGVTLTPMVATRL

SEQ ID NO: 702611 - protein, 24 aa, Mycobacterium
NAVARTHLHFEVVPGLAATSAVPT

SEQ ID NO: 702612 - protein, 17 aa, Mycobacterium
NAVCAPGQHSLEDGVTI

SEQ ID NO: 702613 - protein, 21 aa, Mycobacterium
NAVCSGFLFAINTAHALAQRD

SEQ ID NO: 702614 - protein, 20 aa, Mycobacterium
NAVEELMRYLSIIQTGQRRV

SEQ ID NO: 702615 - protein, 20 aa, Mycobacterium
NAVEELMRYLSIVHSQVDRV

SEQ ID NO: 702616 - protein, 19 aa, Mycobacterium
NAVELFAQYDLILDGTDNF

SEQ ID NO: 702617 - protein, 29 aa, Mycobacterium
NAVGRARKSFVCGFHGWTYGLDGTCTHIR

SEQ ID NO: 702618 - protein, 24 aa, Mycobacterium
NAVHELMRYYPIVFGTIRETVEDV

SEQ ID NO: 702619 - protein, 24 aa, Mycobacterium
NAVLALAAVEAFFGAGADRQLDVE

SEQ ID NO: 702620 - protein, 17 aa, Mycobacterium
NAVLASLGASSVGENVK

SEQ ID NO: 702621 - protein, 23 aa, Mycobacterium
NAVLGGSCTVVIGVEHAHTIASF

SEQ ID NO: 702622 - protein, 21 aa, Mycobacterium
NAVLKRYWYHAWWFYPHSIVR

SEQ ID NO: 702623 - protein, 19 aa, Mycobacterium
NAVLSEILGFYGLSYWYAE

SEQ ID NO: 702624 - protein, 22 aa, Mycobacterium
NAVMHRPELVRSWASDVVGLFD

SEQ ID NO: 702625 - protein, 19 aa, Mycobacterium
NAVNIRWSLAEIGYSLRES

SEQ ID NO: 702626 - protein, 19 aa, Mycobacterium
NAVNLGLTPLVRYRAGAVT

SEQ ID NO: 702627 - protein, 17 aa, Mycobacterium
NAVRAIVGGPGLRRLRT

SEQ ID NO: 702628 - protein, 25 aa, Mycobacterium
NAVRARLARFLFRGNAADKLVGALS

SEQ ID NO: 702629 - protein, 25 aa, Mycobacterium
NAVRDWPKPLGFVWGLDDPVATTNV

SEQ ID NO: 702630 - protein, 17 aa, Mycobacterium
NAVRIGKLVKRFQRVLE

SEQ ID NO: 702631 - protein, 19 aa, Mycobacterium
NAVRLRGPIARDVIAQHTS

SEQ ID NO: 702632 - protein, 24 aa, Mycobacterium
NAVVGRPVAEYGFEPMRFDEMRRG

SEQ ID NO: 702633 - protein, 19 aa, Mycobacterium
NAVVGRPVSEYGFEPVRFD

SEQ ID NO: 702634 - protein, 20 aa, Mycobacterium
NAYCPGVVGTDMWVEIDQRF

SEQ ID NO: 702635 - protein, 19 aa, Mycobacterium
NAYHGPGWRNRVGDIARSW

SEQ ID NO: 702636 - protein, 19 aa, Mycobacterium
NAYHPGWRITEFARGATVT

SEQ ID NO: 702637 - protein, 17 aa, Mycobacterium
NAYLRLYPDDVITARFV

SEQ ID NO: 702638 - protein, 19 aa, Mycobacterium
NAYREALAVIGEWAEADAA

SEQ ID NO: 702639 - protein, 19 aa, Mycobacterium
NAYRHCRGTYALTVPFLQR

SEQ ID NO: 702640 - protein, 17 aa, Mycobacterium
NAYRVVAPHVPFGGIGY

SEQ ID NO: 702641 - protein, 24 aa, Mycobacterium
NAYTGGRWKILMIATEERYMLMQN

SEQ ID NO: 702642 - protein, 22 aa, Mycobacterium
NCALESFGFKTFGFAFGREDVW

SEQ ID NO: 702643 - protein, 19 aa, Mycobacterium
NCDCDLGAFATIVPCGITD

SEQ ID NO: 702644 - protein, 18 aa, Mycobacterium
NCDIKTLALSAGVDRTAF

SEQ ID NO: 702645 - protein, 19 aa, Mycobacterium
NCDPAKFDGSIGVYGTSSP

SEQ ID NO: 702646 - protein, 17 aa, Mycobacterium
NCEEFGIRLHPMGDAEQ

SEQ ID NO: 702647 - protein, 18 aa, Mycobacterium
NCEEFGIRLHPMGDVEQG

SEQ ID NO: 702648 - protein, 18 aa, Mycobacterium
NCGDRLNFRGQFYRHTLM

SEQ ID NO: 702649 - protein, 21 aa, Mycobacterium
NCGEGWGYSGIFAKVNGGGFL

SEQ ID NO: 702650 - protein, 17 aa, Mycobacterium
NCGVGFAPCRQSDHDVL

SEQ ID NO: 702651 - protein, 19 aa, Mycobacterium
NCLAALGCRVVELDCGPET

SEQ ID NO: 702652 - protein, 17 aa, Mycobacterium
NCLAVRVRLLGRAITSV

SEQ ID NO: 702653 - protein, 26 aa, Mycobacterium
NCLDIDRWSRAGWRVYALGRRLERQN

SEQ ID NO: 702654 - protein, 21 aa, Mycobacterium
NCPQERVSLHTALKAITIDAA

SEQ ID NO: 702655 - protein, 21 aa, Mycobacterium
NCPVVTPATLFDEWFPANKLV

SEQ ID NO: 702656 - protein, 36 aa, Mycobacterium
NCRAARLFGAADACRRRMGQVLFKIHQPDYEASVAG

SEQ ID NO: 702657 - protein, 18 aa, Mycobacterium
NCRSDVLYKGALQADPES

SEQ ID NO: 702658 - protein, 26 aa, Mycobacterium
NCTFRRTSLWHSEFRQCSLLGSTFTD

SEQ ID NO: 702659 - protein, 23 aa, Mycobacterium
NCTNCGPRFTIIASLPYDRASTT

SEQ ID NO: 702660 - protein, 19 aa, Mycobacterium
NCVCPGTIVTASFTEALKD

SEQ ID NO: 702661 - protein, 19 aa, Mycobacterium
NCVCPGTIVTASFTEQLKD

SEQ ID NO: 702662 - protein, 19 aa, Mycobacterium
NCVCPGTIVTASFTEQLND

SEQ ID NO: 702663 - protein, 18 aa, Mycobacterium
NCVEHAYRGFVAGTMVVE

SEQ ID NO: 702664 - protein, 19 aa, Mycobacterium
NCWRVNELIDPSVLVPGAA

SEQ ID NO: 702665 - protein, 23 aa, Mycobacterium
NCYPAHVKDLFGLEWTPEDEDMS

SEQ ID NO: 702666 - protein, 26 aa, Mycobacterium
NDAARAAWRGVFSGFETPTLVGTPGL

SEQ ID NO: 702667 - protein, 19 aa, Mycobacterium
NDAKLSFLGRKMVQVRLVG

SEQ ID NO: 702668 - protein, 19 aa, Mycobacterium
NDALRRITNSPARPAGPLT

SEQ ID NO: 702669 - protein, 18 aa, Mycobacterium
NDARRAVRVESEKVGRWR

SEQ ID NO: 702670 - protein, 19 aa, Mycobacterium
NDATRRWCRADGMAKAVPA

SEQ ID NO: 702671 - protein, 18 aa, Mycobacterium
NDAVVAWHRARGCDIPDL

SEQ ID NO: 702672 - protein, 23 aa, Mycobacterium
NDAWRLSDVSAIAVPWQFGPVIE

SEQ ID NO: 702673 - protein, 22 aa, Mycobacterium
NDCMPTCAGGAVTSQVLHWNGT

SEQ ID NO: 702674 - protein, 20 aa, Mycobacterium
NDCPAELWNRLDAQAIAAEH

SEQ ID NO: 702675 - protein, 19 aa, Mycobacterium
NDCPAELWSALDAQALAAE

SEQ ID NO: 702676 - protein, 24 aa, Mycobacterium
NDCPAELWSALDPHAIAAENGVAA

SEQ ID NO: 702677 - protein, 23 aa, Mycobacterium
NDCPAELWSALDPKAIATEHGAA

SEQ ID NO: 702678 - protein, 25 aa, Mycobacterium
NDDFVAAIWGCFLGGIVPVPVAPNV

SEQ ID NO: 702679 - protein, 18 aa, Mycobacterium
NDDGLWFFLNEVWPLVLA

SEQ ID NO: 702680 - protein, 24 aa, Mycobacterium
NDEIKELLLQTAIYCGVPDANSAF

SEQ ID NO: 702681 - protein, 24 aa, Mycobacterium
NDEIKELLMHLAIYVGVPEVNYAF

SEQ ID NO: 702682 - protein, 18 aa, Mycobacterium
NDELKFWALSRHQDVLQG

SEQ ID NO: 702683 - protein, 17 aa, Mycobacterium
NDELVRLAVKAHSLHAE

SEQ ID NO: 702684 - protein, 18 aa, Mycobacterium
NDEVICFEPMTAPTDALR

SEQ ID NO: 702685 - protein, 25 aa, Mycobacterium
NDEVRKRFLPGIINGSERWCQGFSE

SEQ ID NO: 702686 - protein, 17 aa, Mycobacterium
NDFAEVFAKNLQELALA

SEQ ID NO: 702687 - protein, 18 aa, Mycobacterium
NDFAGFFAAHPSLERVVF

SEQ ID NO: 702688 - protein, 19 aa, Mycobacterium
NDFEYRWPGGAQDAEVIFT

SEQ ID NO: 702689 - protein, 28 aa, Mycobacterium
NDFHGGCHWTGFNKVWWYYAQPEYRDCL

SEQ ID NO: 702690 - protein, 20 aa, Mycobacterium
NDFMAPFAPSGRFERLSISH

SEQ ID NO: 702691 - protein, 17 aa, Mycobacterium
NDFPLFWDPQLLEHDVH

SEQ ID NO: 702692 - protein, 17 aa, Mycobacterium
NDFPLFWDPTLLEHDVH

SEQ ID NO: 702693 - protein, 18 aa, Mycobacterium
NDGAMTFAAVNGAPALVL

SEQ ID NO: 702694 - protein, 25 aa, Mycobacterium
NDGFAAELLEWLRNRLAHYKCPRSL

SEQ ID NO: 702695 - protein, 19 aa, Mycobacterium
NDGLIPWDIGGPQPVVEQL

SEQ ID NO: 702696 - protein, 22 aa, Mycobacterium
NDGRFAMYTKMHHALIDGVSAM

SEQ ID NO: 702697 - protein, 21 aa, Mycobacterium
NDGRIKFILFRHEQAAGFAAA

SEQ ID NO: 702698 - protein, 23 aa, Mycobacterium
NDGTLWCEKPMYIQLDFLVRRFA

SEQ ID NO: 702699 - protein, 24 aa, Mycobacterium
NDHHRLEPSLPWGGIKESGSGKDA

SEQ ID NO: 702700 - protein, 24 aa, Mycobacterium
NDHTIRATILIAEFPPRNADPDPI

SEQ ID NO: 702701 - protein, 17 aa, Mycobacterium
NDHWSGFRPDRIKALAE

SEQ ID NO: 702702 - protein, 20 aa, Mycobacterium
NDIDPEWAFQDLGFDSVKAT

SEQ ID NO: 702703 - protein, 17 aa, Mycobacterium
NDIDRWRQFAFGVLGFA

SEQ ID NO: 702704 - protein, 17 aa, Mycobacterium
NDIEDIFWLQSTIAQEL

SEQ ID NO: 702705 - protein, 26 aa, Mycobacterium
NDIEVAYRDGVRWVKGLQRLPDDATL

SEQ ID NO: 702706 - protein, 25 aa, Mycobacterium
NDIFITIIMGLVFQTKYLNGLASTA

SEQ ID NO: 702707 - protein, 17 aa, Mycobacterium
NDIGGWSVVVRGAAQVL

SEQ ID NO: 702708 - protein, 19 aa, Mycobacterium
NDILAAIFRRASDRVSAET

SEQ ID NO: 702709 - protein, 26 aa, Mycobacterium
NDIPGYKIAAVFGEVFGLTVRSRHIG

SEQ ID NO: 702710 - protein, 21 aa, Mycobacterium
NDIQTAILYDHFTPYTLLQLE

SEQ ID NO: 702711 - protein, 25 aa, Mycobacterium
NDISELAFGLGIVREHAELIAQGEE

SEQ ID NO: 702712 - protein, 20 aa, Mycobacterium
NDIWVLPGGLTRVALVEGSR

SEQ ID NO: 702713 - protein, 18 aa, Mycobacterium
NDKFHAYIEDRRREPRDD

SEQ ID NO: 702714 - protein, 25 aa, Mycobacterium
NDKIRCPWHGFDFDPFTGEAAGGPD

SEQ ID NO: 702715 - protein, 18 aa, Mycobacterium
NDKRAIVAVVDLPSQAYG

SEQ ID NO: 702716 - protein, 26 aa, Mycobacterium
NDKRMADAFLRMGPGWRDVVLPRLAA

SEQ ID NO: 702717 - protein, 29 aa, Mycobacterium
NDLAMAGAVPSWISAAFVLEEGFGIAELK

SEQ ID NO: 702718 - protein, 30 aa, Mycobacterium
NDLAMAGAVPSWISAAFVLEEGFPIAELKE

SEQ ID NO: 702719 - protein, 23 aa, Mycobacterium
NDLFARDWALRRFAGISNLPAAP

SEQ ID NO: 702720 - protein, 23 aa, Mycobacterium
NDLGRLAILDWLLSGPGDRWQNM

SEQ ID NO: 702721 - protein, 18 aa, Mycobacterium
NDLGRVCRPGTVKVEDYS

SEQ ID NO: 702722 - protein, 18 aa, Mycobacterium
NDLGRVCRPGTVRVDDYS

SEQ ID NO: 702723 - protein, 17 aa, Mycobacterium
NDLIQLKLLRDYATNAP

SEQ ID NO: 702724 - protein, 19 aa, Mycobacterium
NDLLPGPLTKVFRGNLSIV

SEQ ID NO: 702725 - protein, 17 aa, Mycobacterium
NDLNKAWDAYKAAENRL

SEQ ID NO: 702726 - protein, 26 aa, Mycobacterium
NDLNWKSRPYLAWPAYGQSKLANLLF

SEQ ID NO: 702727 - protein, 18 aa, Mycobacterium
NDLPSWGTLTAHEKQMTM

SEQ ID NO: 702728 - protein, 30 aa, Mycobacterium
NDLRDGEPILPLAPSRLAVIGPFAEEPRHQ

SEQ ID NO: 702729 - protein, 25 aa, Mycobacterium
NDLRQRIGMVFQHFNLFPHRNVVDN

SEQ ID NO: 702730 - protein, 22 aa, Mycobacterium
NDLRWHDLRHSGAVLAAATGAT

SEQ ID NO: 702731 - protein, 17 aa, Mycobacterium
NDLSFTRGSFRVRGDTV

SEQ ID NO: 702732 - protein, 25 aa, Mycobacterium
NDMGRWPELREAFSKAIAAHDRDHW

SEQ ID NO: 702733 - protein, 23 aa, Mycobacterium
NDMRRLLVSLARRLRDADLPPVS

SEQ ID NO: 702734 - protein, 20 aa, Mycobacterium
NDMVCGWAGSLACADGINVI

SEQ ID NO: 702735 - protein, 23 aa, Mycobacterium
NDNGGWQLGSRVFSGKDKTVGPS

SEQ ID NO: 702736 - protein, 19 aa, Mycobacterium
NDNRYGLGAGVWTVDVGRA

SEQ ID NO: 702737 - protein, 22 aa, Mycobacterium
NDPARLAGWWAEQFGGATRELL

SEQ ID NO: 702738 - protein, 18 aa, Mycobacterium
NDPAYLNAFGQLLAALGR

SEQ ID NO: 702739 - protein, 21 aa, Mycobacterium
NDPDIRCAILTGAGGYFCAGM

SEQ ID NO: 702740 - protein, 25 aa, Mycobacterium
NDPDWQRFHLIGAMNPVYFALLARR

SEQ ID NO: 702741 - protein, 17 aa, Mycobacterium
NDPEFRRGWNQRSEELN

SEQ ID NO: 702742 - protein, 17 aa, Mycobacterium
NDPEILHYLPLPVPYTV

SEQ ID NO: 702743 - protein, 23 aa, Mycobacterium
NDPEIRTCILTGAGGYFCSGMDL

SEQ ID NO: 702744 - protein, 22 aa, Mycobacterium
NDPELPELAGLDVVVTDLGIEQ

SEQ ID NO: 702745 - protein, 21 aa, Mycobacterium
NDPEVRVCILTGAGGYFCAGA

SEQ ID NO: 702746 - protein, 23 aa, Mycobacterium
NDPHAMALFNQFLDGQLAEIQQV

SEQ ID NO: 702747 - protein, 25 aa, Mycobacterium
NDPMYAMKMLTGYDANGSAAPQPGQ

SEQ ID NO: 702748 - protein, 19 aa, Mycobacterium
NDPNVLGGYLGGLVGAKTG

SEQ ID NO: 702749 - protein, 24 aa, Mycobacterium
NDPQRLAGIAQWLMQFTPDIEQLI

SEQ ID NO: 702750 - protein, 18 aa, Mycobacterium
NDPQVWLDAIDEIETFAP

SEQ ID NO: 702751 - protein, 22 aa, Mycobacterium
NDPRMARILFVESGAESLLRQL

SEQ ID NO: 702752 - protein, 19 aa, Mycobacterium
NDPSMARILFVESGAEPLL

SEQ ID NO: 702753 - protein, 34 aa, Mycobacterium
NDPWYRMRMAPSIFRHVWSVLRIACEGFNKHVPL

SEQ ID NO: 702754 - protein, 17 aa, Mycobacterium
NDPYRGGTHLNDVSFIR

SEQ ID NO: 702755 - protein, 25 aa, Mycobacterium
NDQVATLFRMWLRDAVRRVADGCLE

SEQ ID NO: 702756 - protein, 25 aa, Mycobacterium
NDRALELLEAVGLPEPQMRLHAYPH

SEQ ID NO: 702757 - protein, 22 aa, Mycobacterium
NDRARVAAALGTVVDGVRAKRA

SEQ ID NO: 702758 - protein, 20 aa, Mycobacterium
NDRASCKFMKMITPAALLRC

SEQ ID NO: 702759 - protein, 19 aa, Mycobacterium
NDRASCKYMKMITPAALLR

SEQ ID NO: 702760 - protein, 17 aa, Mycobacterium
NDRASCTYMKMITPAAL

SEQ ID NO: 702761 - protein, 18 aa, Mycobacterium
NDRCRRLRPYAELLVDGF

SEQ ID NO: 702762 - protein, 21 aa, Mycobacterium
NDRDRLVVIVAGYRAELDQFL

SEQ ID NO: 702763 - protein, 21 aa, Mycobacterium
NDRGACLAGVVIDDGVLPRVV

SEQ ID NO: 702764 - protein, 27 aa, Mycobacterium
NDRGEFDGKLWISMDFVDGTDAASLLR

SEQ ID NO: 702765 - protein, 17 aa, Mycobacterium
NDRGWRSLGDMGHVDQD

SEQ ID NO: 702766 - protein, 17 aa, Mycobacterium
NDRGWRSLGDMGYVDRD

SEQ ID NO: 702767 - protein, 17 aa, Mycobacterium
NDRQWLALCGCVGASAL

SEQ ID NO: 702768 - protein, 17 aa, Mycobacterium
NDRRRLGFLEAQGGGTI

SEQ ID NO: 702769 - protein, 18 aa, Mycobacterium
NDRRRLGFLEAQGGGTIL

SEQ ID NO: 702770 - protein, 23 aa, Mycobacterium
NDRSGPSAGRGRRAAAGRAPPRP

SEQ ID NO: 702771 - protein, 26 aa, Mycobacterium
NDRWHSLARLAIRDDIYASLRSLCFD

SEQ ID NO: 702772 - protein, 17 aa, Mycobacterium
NDSARWHQQLAFRDALR

SEQ ID NO: 702773 - protein, 18 aa, Mycobacterium
NDSEYGLCAAVFSRDLAH

SEQ ID NO: 702774 - protein, 22 aa, Mycobacterium
NDSRVPPAIGYPLGAQEGDVNL

SEQ ID NO: 702775 - protein, 26 aa, Mycobacterium
NDTERWWLDRMVSVIANSAGIRAEDL

SEQ ID NO: 702776 - protein, 21 aa, Mycobacterium
NDTVLRWRQVMNAMFGGTTDH

SEQ ID NO: 702777 - protein, 18 aa, Mycobacterium
NDVDAALDEIRWGNEQGC

SEQ ID NO: 702778 - protein, 18 aa, Mycobacterium
NDVDYRFVSPLDDNTESD

SEQ ID NO: 702779 - protein, 19 aa, Mycobacterium
NDVETIYGLVGIPITDLAR

SEQ ID NO: 702780 - protein, 21 aa, Mycobacterium
NDVFLKDIWPSASEIEETIAS

SEQ ID NO: 702781 - protein, 23 aa, Mycobacterium
NDVGFAFARQFARRGYDLIVTDS

SEQ ID NO: 702782 - protein, 23 aa, Mycobacterium
NDVGRWPELRAVLTEKFASQDRD

SEQ ID NO: 702783 - protein, 17 aa, Mycobacterium
NDVLCLTGASLTRDLYI

SEQ ID NO: 702784 - protein, 22 aa, Mycobacterium
NDVLLQICLDYIDRVFGAGSEL

SEQ ID NO: 702785 - protein, 24 aa, Mycobacterium
NDVLNCLEKSPGHDISSLRLVACG

SEQ ID NO: 702786 - protein, 24 aa, Mycobacterium
NDVMRSLGLPTMFPTIGGHEGSGI

SEQ ID NO: 702787 - protein, 17 aa, Mycobacterium
NDVPFRFHYEGPGGLLD

SEQ ID NO: 702788 - protein, 17 aa, Mycobacterium
NDVPFRFHYEGPGGLLG

SEQ ID NO: 702789 - protein, 18 aa, Mycobacterium
NDVPMLGWAGLGVAMGNA

SEQ ID NO: 702790 - protein, 25 aa, Mycobacterium
NDVPRSAQNFRFFADHARLSAGEAL

SEQ ID NO: 702791 - protein, 22 aa, Mycobacterium
NDVRALAAWWAEVLGWPAEDTD

SEQ ID NO: 702792 - protein, 20 aa, Mycobacterium
NDVRVRQAVNYAIDPEALNR

SEQ ID NO: 702793 - protein, 28 aa, Mycobacterium
NDVTRWPELRAALTAAFAAHDRDHWAKV

SEQ ID NO: 702794 - protein, 20 aa, Mycobacterium
NDVWREVLPPAQTRAAREMV

SEQ ID NO: 702795 - protein, 20 aa, Mycobacterium
NDWTENRGTVAISRADTLGI

SEQ ID NO: 702796 - protein, 23 aa, Mycobacterium
NDWVLIKLAGPGVVRLVEIDTSY

SEQ ID NO: 702797 - protein, 23 aa, Mycobacterium
NDYDLSSLFLLASTAALFSPSIK

SEQ ID NO: 702798 - protein, 26 aa, Mycobacterium
NDYLDLVSDFARHAAIALALAAGREH

SEQ ID NO: 702799 - protein, 23 aa, Mycobacterium
NDYPQMLLRVGWAPINADPLPST

SEQ ID NO: 702800 - protein, 23 aa, Mycobacterium
NDYQRYGGVEFYSAIAQGSPERD

SEQ ID NO: 702801 - protein, 23 aa, Mycobacterium
NDYQRYGGVEFYSAIAQSSPERD

SEQ ID NO: 702802 - protein, 23 aa, Mycobacterium
NDYTVKDLRTWHGTVLAAAAFAD

SEQ ID NO: 702803 - protein, 23 aa, Mycobacterium
NDYYDDMAWLALAIERAGRLAGV

SEQ ID NO: 702804 - protein, 17 aa, Mycobacterium
NEAAAGWLARLCAAHTI

SEQ ID NO: 702805 - protein, 24 aa, Mycobacterium
NEAAFKLSRLTGRTKLVAAQEGFH

SEQ ID NO: 702806 - protein, 26 aa, Mycobacterium
NEAAPYLAAHGWRLNSASIRDLFAAN

SEQ ID NO: 702807 - protein, 17 aa, Mycobacterium
NEACEIRTGDLRSADEA

SEQ ID NO: 702808 - protein, 18 aa, Mycobacterium
NEAEFSAASFERGETPIR

SEQ ID NO: 702809 - protein, 17 aa, Mycobacterium
NEAELMAHFGVSRPTLR

SEQ ID NO: 702810 - protein, 21 aa, Mycobacterium
NEAFAAQAVACARELGLDEEI

SEQ ID NO: 702811 - protein, 23 aa, Mycobacterium
NEAFASVVLKFQKDLGIPDEKLN

SEQ ID NO: 702812 - protein, 22 aa, Mycobacterium
NEAFASVVLKFQKDLNIPDEKL

SEQ ID NO: 702813 - protein, 20 aa, Mycobacterium
NEAFASVVLSWARVHEPDMA

SEQ ID NO: 702814 - protein, 20 aa, Mycobacterium
NEAFASVVLSWARVHEPDMD

SEQ ID NO: 702815 - protein, 18 aa, Mycobacterium
NEAFGLAGSTAMYNKSIL

SEQ ID NO: 702816 - protein, 23 aa, Mycobacterium
NEAKAMCRACPRRWACARDAVES

SEQ ID NO: 702817 - protein, 24 aa, Mycobacterium
NEALRMVTPLPFNFREAVRDTELL

SEQ ID NO: 702818 - protein, 19 aa, Mycobacterium
NEARTVFTDVLTWALTERA

SEQ ID NO: 702819 - protein, 23 aa, Mycobacterium
NEAVPYLSDRGWLLTSTPLPELR

SEQ ID NO: 702820 - protein, 21 aa, Mycobacterium
NEAYWLGPRPAEHGPNDPGGV

SEQ ID NO: 702821 - protein, 34 aa, Mycobacterium
NECCRLRKVVPLKKALNGYAAWVTGLRRVESPTR

SEQ ID NO: 702822 - protein, 22 aa, Mycobacterium
NECCRLRKVVPLTNALRGYAAW

SEQ ID NO: 702823 - protein, 22 aa, Mycobacterium
NEDEVDAFLDLVEAELTRLIEE

SEQ ID NO: 702824 - protein, 22 aa, Mycobacterium
NEDEVDAFLDLVENELARLIEE

SEQ ID NO: 702825 - protein, 22 aa, Mycobacterium
NEDEVDAFLDLVENELSRLIEE

SEQ ID NO: 702826 - protein, 24 aa, Mycobacterium
NEDFEGWAKWVAVGGALAIHDVFP

SEQ ID NO: 702827 - protein, 19 aa, Mycobacterium
NEDFLWRLADEQLNRFVAK

SEQ ID NO: 702828 - protein, 23 aa, Mycobacterium
NEDFSKLIIEGDAAWDTIDDYVK

SEQ ID NO: 702829 - protein, 22 aa, Mycobacterium
NEDPNARFAFGLRLLTDGIAAH

SEQ ID NO: 702830 - protein, 26 aa, Mycobacterium
NEEGSRFKPSMMGSAVFTGTLDLEEA

SEQ ID NO: 702831 - protein, 20 aa, Mycobacterium
NEELIKAGVMVAGEGLTDPE

SEQ ID NO: 702832 - protein, 19 aa, Mycobacterium
NEELKFWALSRHQDVLQGF

SEQ ID NO: 702833 - protein, 28 aa, Mycobacterium
NEEQRRWAAMGIERGWQATMVLTEPDAG

SEQ ID NO: 702834 - protein, 28 aa, Mycobacterium
NEFDRLRRGGIQWADMRGYAYDRRDVSG

SEQ ID NO: 702835 - protein, 24 aa, Mycobacterium
NEFDYLEMWAQDVAAMVGYHGGAS

SEQ ID NO: 702836 - protein, 23 aa, Mycobacterium
NEFLDTFVPLTFIGNHDVTRIAS

SEQ ID NO: 702837 - protein, 20 aa, Mycobacterium
NEFVAPWGMFTAAEFALIAR

SEQ ID NO: 702838 - protein, 19 aa, Mycobacterium
NEGACGACTVLVDGTHMNS

SEQ ID NO: 702839 - protein, 30 aa, Mycobacterium
NEGDVFCSVVRRVALPDAFFAIDGMIETFL

SEQ ID NO: 702840 - protein, 29 aa, Mycobacterium
NEGDVFCSVVRRVALPDAFFAIDGQTETF

SEQ ID NO: 702841 - protein, 30 aa, Mycobacterium
NEGDVFCSVVRRVALPDAFFALDGQTETFL

SEQ ID NO: 702842 - protein, 27 aa, Mycobacterium
NEGDVFCSVVRRVALPDSFFAIDGQIE

SEQ ID NO: 702843 - protein, 27 aa, Mycobacterium
NEGDVFCSVVRRVALPDSFFAIDGQLE

SEQ ID NO: 702844 - protein, 27 aa, Mycobacterium
NEGDVFCSVVRRVALPDSFFAVDGQIE

SEQ ID NO: 702845 - protein, 27 aa, Mycobacterium
NEGDVFCSVVRRVVLPDSFFAIDGQTE

SEQ ID NO: 702846 - protein, 27 aa, Mycobacterium
NEGFGYIPRGVFLPRTARLLTADKLVD

SEQ ID NO: 702847 - protein, 27 aa, Mycobacterium
NEGFGYIPWGVFLPRTARLLAADERVD

SEQ ID NO: 702848 - protein, 17 aa, Mycobacterium
NEGQWALGNREPLNDTE

SEQ ID NO: 702849 - protein, 21 aa, Mycobacterium
NEGVSLWVVRSVDIVATSPAE

SEQ ID NO: 702850 - protein, 19 aa, Mycobacterium
NEHARKLGLDWPADALTMI

SEQ ID NO: 702851 - protein, 18 aa, Mycobacterium
NEHHRGRRPAVWSPGEYL

SEQ ID NO: 702852 - protein, 22 aa, Mycobacterium
NEHKRHRYAFTPFGGGAHKCLG

SEQ ID NO: 702853 - protein, 26 aa, Mycobacterium
NEHQRYGLELGKPGARVDRFSEGLQV

SEQ ID NO: 702854 - protein, 30 aa, Mycobacterium
NEHRPDLAILDVRMPPTFTDEGIRAAALLR

SEQ ID NO: 702855 - protein, 20 aa, Mycobacterium
NEHWSALATMILPVGGAPYV

SEQ ID NO: 702856 - protein, 22 aa, Mycobacterium
NEHYRLTVDPARGGAVASLVQD

SEQ ID NO: 702857 - protein, 23 aa, Mycobacterium
NEIACPFHDWRWGGDGRCKQVPY

SEQ ID NO: 702858 - protein, 17 aa, Mycobacterium
NEIAEFERIAAQRGADM

SEQ ID NO: 702859 - protein, 21 aa, Mycobacterium
NEIARAAGVGVSIADTALPIP

SEQ ID NO: 702860 - protein, 30 aa, Mycobacterium
NEIDLDTAEKLVWVEGNTTYVLIRRENLPL

SEQ ID NO: 702861 - protein, 18 aa, Mycobacterium
NEIDVWQPLHVVSLVHTG

SEQ ID NO: 702862 - protein, 23 aa, Mycobacterium
NEIFDIANSLGFVTEPIAAEDWF

SEQ ID NO: 702863 - protein, 24 aa, Mycobacterium
NEIGRRLAPEPVLHGALAPGAIIA

SEQ ID NO: 702864 - protein, 37 aa, Mycobacterium
NEIKARLAVANALALQFGWRLFAPILRTATGLDELTD

SEQ ID NO: 702865 - protein, 23 aa, Mycobacterium
NEILGDGLLVFFGVPNTDGEAAE

SEQ ID NO: 702866 - protein, 32 aa, Mycobacterium
NEILRDGWRSVKRVPLAQALKSVRRYDFQQAY

SEQ ID NO: 702867 - protein, 18 aa, Mycobacterium
NEIQIVVTILSLDPNDLY

SEQ ID NO: 702868 - protein, 17 aa, Mycobacterium
NEIQVVVTILSLDPNDL

SEQ ID NO: 702869 - protein, 21 aa, Mycobacterium
NEIRWDIRPSPALGTVEVRIF

SEQ ID NO: 702870 - protein, 19 aa, Mycobacterium
NEIRWDIRPSPHLGTIELR

SEQ ID NO: 702871 - protein, 18 aa, Mycobacterium
NEKLHWALANVWRQLAAD

SEQ ID NO: 702872 - protein, 36 aa, Mycobacterium
NEKPVLLCRKVLIELLAWQFASPVRWIETQDLLFTE

SEQ ID NO: 702873 - protein, 24 aa, Mycobacterium
NELAFKLSRLTGRTKLVAAQESFH

SEQ ID NO: 702874 - protein, 22 aa, Mycobacterium
NELAQACGLGVLLEEERLPVAP

SEQ ID NO: 702875 - protein, 24 aa, Mycobacterium
NELAQRVAAVAGFLRQRLIGDYSV

SEQ ID NO: 702876 - protein, 24 aa, Mycobacterium
NELAQRVAAVAGFLRQRLTGDYTV

SEQ ID NO: 702877 - protein, 22 aa, Mycobacterium
NELDMPRLDPVAIQDNLTTIAD

SEQ ID NO: 702878 - protein, 24 aa, Mycobacterium
NELDRRALEFGGRVYTAKDSRVSA

SEQ ID NO: 702879 - protein, 21 aa, Mycobacterium
NELFAVLAYGEIAAFYRLTDE

SEQ ID NO: 702880 - protein, 18 aa, Mycobacterium
NELIAYFVAADVMLVTPL

SEQ ID NO: 702881 - protein, 17 aa, Mycobacterium
NELKHRAGDTFCEIVPR

SEQ ID NO: 702882 - protein, 25 aa, Mycobacterium
NELLGVPIEEGWKMSAMLTLGYPRG

SEQ ID NO: 702883 - protein, 25 aa, Mycobacterium
NELLGVPIEQGWTMSAMVAFGYPLG

SEQ ID NO: 702884 - protein, 24 aa, Mycobacterium
NELLGVPVEEGWTMSAMLALGYPR

SEQ ID NO: 702885 - protein, 26 aa, Mycobacterium
NELLRRLKGLPGFGEQKARIFLALLG

SEQ ID NO: 702886 - protein, 22 aa, Mycobacterium
NELPAQPLLRITGFGYDRAATE

SEQ ID NO: 702887 - protein, 22 aa, Mycobacterium
NELPEAYPLKMIGMREPRSENS

SEQ ID NO: 702888 - protein, 24 aa, Mycobacterium
NELPPGGCSLHLAPVAFSAGRRIQ

SEQ ID NO: 702889 - protein, 20 aa, Mycobacterium
NELPPGLADFDLSKLKFPGK

SEQ ID NO: 702890 - protein, 20 aa, Mycobacterium
NELPPGLADFDLSKLKFPGN

SEQ ID NO: 702891 - protein, 19 aa, Mycobacterium
NELRACAVYEEAMREPLAR

SEQ ID NO: 702892 - protein, 17 aa, Mycobacterium
NELRQATILEVQRARTV

SEQ ID NO: 702893 - protein, 35 aa, Mycobacterium
NELRVFLDGAVAKWWIPERWAFIAEVPRTSVGKYD

SEQ ID NO: 702894 - protein, 19 aa, Mycobacterium
NELRWRTTISNHRPEVLRK

SEQ ID NO: 702895 - protein, 21 aa, Mycobacterium
NELRYPATLFSDGMPSTSTIL

SEQ ID NO: 702896 - protein, 19 aa, Mycobacterium
NELSAAFGDELARLQDGFA

SEQ ID NO: 702897 - protein, 19 aa, Mycobacterium
NELTARITALTDALHRDEV

SEQ ID NO: 702898 - protein, 21 aa, Mycobacterium
NELTSSLGWKPENVVEIPVSA

SEQ ID NO: 702899 - protein, 20 aa, Mycobacterium
NELWEFTPSGLMARREASIN

SEQ ID NO: 702900 - protein, 19 aa, Mycobacterium
NEMLGCAVAWFTRDQSAPG

SEQ ID NO: 702901 - protein, 19 aa, Mycobacterium
NEMLGCAVSWFTRDESAPG

SEQ ID NO: 702902 - protein, 25 aa, Mycobacterium
NEMPSRAYVSAFGFKGPDQQKPAGV

SEQ ID NO: 702903 - protein, 25 aa, Mycobacterium
NENHLRIAVLLDDGTALSFVDQRTF

SEQ ID NO: 702904 - protein, 26 aa, Mycobacterium
NENLYRYCTEFGFPDPFSGMKKSISA

SEQ ID NO: 702905 - protein, 25 aa, Mycobacterium
NENYIWKARTVGVGYLDLTGCMALG

SEQ ID NO: 702906 - protein, 21 aa, Mycobacterium
NEPERAYLIFGNDAFGLPPQD

SEQ ID NO: 702907 - protein, 20 aa, Mycobacterium
NEPFKSFWLTPKQHMEALAE

SEQ ID NO: 702908 - protein, 17 aa, Mycobacterium
NEPGGIGGRVEFRTDVF

SEQ ID NO: 702909 - protein, 23 aa, Mycobacterium
NEPGYLPGFGMLPAHMVREVAKT

SEQ ID NO: 702910 - protein, 22 aa, Mycobacterium
NEPIAVVGMACRLPGGIDSPET

SEQ ID NO: 702911 - protein, 17 aa, Mycobacterium
NEPLRLGEAATRHSEVV

SEQ ID NO: 702912 - protein, 17 aa, Mycobacterium
NEPPTGWALATPQQPLW

SEQ ID NO: 702913 - protein, 23 aa, Mycobacterium
NEPPWVVAGGIGMLIRVPGARAT

SEQ ID NO: 702914 - protein, 19 aa, Mycobacterium
NEPQIWLGNVGQVGDSSDF

SEQ ID NO: 702915 - protein, 25 aa, Mycobacterium
NEPSWQLAIGVLEAFDHPLMSLLPQ

SEQ ID NO: 702916 - protein, 22 aa, Mycobacterium
NEPYVRLYPRQVVKQADLVLAM

SEQ ID NO: 702917 - protein, 19 aa, Mycobacterium
NEQAKRGVIGWDRTLTEAQ

SEQ ID NO: 702918 - protein, 24 aa, Mycobacterium
NEQGSCWRIRLAHDDAAKFDAALA

SEQ ID NO: 702919 - protein, 25 aa, Mycobacterium
NEQRLAANVAERFGIPLAALHFFPA

SEQ ID NO: 702920 - protein, 19 aa, Mycobacterium
NEQYISVGVGRDYSDVTPL

SEQ ID NO: 702921 - protein, 17 aa, Mycobacterium
NERFEAFQHAISQTFVP

SEQ ID NO: 702922 - protein, 22 aa, Mycobacterium
NERFLDAELSEFGKVIDLNTTR

SEQ ID NO: 702923 - protein, 33 aa, Mycobacterium
NERIEIRDGRMWLPDRPGLGFTLSDQMRALTRE

SEQ ID NO: 702924 - protein, 18 aa, Mycobacterium
NERLEFLGDAVLGLTITD

SEQ ID NO: 702925 - protein, 33 aa, Mycobacterium
NERPESAADEIVRWATPVTCFQRTALQDYELSG

SEQ ID NO: 702926 - protein, 17 aa, Mycobacterium
NERWLSTLHRVRPPVVD

SEQ ID NO: 702927 - protein, 18 aa, Mycobacterium
NERYRLRVDAARGGGVTS

SEQ ID NO: 702928 - protein, 17 aa, Mycobacterium
NESAERLLAARIDPARR

SEQ ID NO: 702929 - protein, 25 aa, Mycobacterium
NESATRPVHFVQMWIVPDQTGIAPS

SEQ ID NO: 702930 - protein, 23 aa, Mycobacterium
NESKRASKLMARMYSALETAYPA

SEQ ID NO: 702931 - protein, 29 aa, Mycobacterium
NESLLLPLLRPLFNRWFRVDVTGVENIPA

SEQ ID NO: 702932 - protein, 21 aa, Mycobacterium
NESRCTRKLVMWEATKRIEQR

SEQ ID NO: 702933 - protein, 29 aa, Mycobacterium
NESRLTFLAVRRWYGWSAGRIINLDIGGG

SEQ ID NO: 702934 - protein, 23 aa, Mycobacterium
NETAYAWKSVLERGSSSGPVGMI

SEQ ID NO: 702935 - protein, 20 aa, Mycobacterium
NETAYAWSTILARGATSGPV

SEQ ID NO: 702936 - protein, 26 aa, Mycobacterium
NETEAFKKFGKSWMKVSDRLAERIRE

SEQ ID NO: 702937 - protein, 17 aa, Mycobacterium
NETLEKWLRGDYGNMTA

SEQ ID NO: 702938 - protein, 20 aa, Mycobacterium
NETPPYFVLIERALRDEGTS

SEQ ID NO: 702939 - protein, 23 aa, Mycobacterium
NETQTGWMIKKFVHTARRYRTAK

SEQ ID NO: 702940 - protein, 23 aa, Mycobacterium
NETRPGDRWRLSSPHGGFHVDRD

SEQ ID NO: 702941 - protein, 22 aa, Mycobacterium
NETRTGDLWLFRGRSRPDRAIQ

SEQ ID NO: 702942 - protein, 22 aa, Mycobacterium
NETRTGDRWRLASPHGGLHVDR

SEQ ID NO: 702943 - protein, 21 aa, Mycobacterium
NEVALEKMIFGTDIALNGVIN

SEQ ID NO: 702944 - protein, 23 aa, Mycobacterium
NEVELAKLGGYYAPEQVDVNVTH

SEQ ID NO: 702945 - protein, 26 aa, Mycobacterium
NEVFDLRPGAIIRDLDLLRPIYAQTA

SEQ ID NO: 702946 - protein, 21 aa, Mycobacterium
NEVILESAFVPDAMVFGEIGN

SEQ ID NO: 702947 - protein, 26 aa, Mycobacterium
NEVLERSLVHLGLKHYFLVDFPQEPG

SEQ ID NO: 702948 - protein, 20 aa, Mycobacterium
NEVLPHIYFAVKDVLNTAQS

SEQ ID NO: 702949 - protein, 18 aa, Mycobacterium
NEVLQCYLDLVLDGLVAR

SEQ ID NO: 702950 - protein, 21 aa, Mycobacterium
NEVLRRAAAYLSQANLPGKGS

SEQ ID NO: 702951 - protein, 20 aa, Mycobacterium
NEVLRRAAAYLSQSNLPGKE

SEQ ID NO: 702952 - protein, 17 aa, Mycobacterium
NEVPVRTPGTLAFAPTI

SEQ ID NO: 702953 - protein, 36 aa, Mycobacterium
NEVRMGMRVEAVWKPREEWGFGIDNIEYFRPTGEPD

SEQ ID NO: 702954 - protein, 18 aa, Mycobacterium
NEVRQRWLTAGIQVVTVS

SEQ ID NO: 702955 - protein, 22 aa, Mycobacterium
NEVSVRALIDFTIDTFGRLDIV

SEQ ID NO: 702956 - protein, 24 aa, Mycobacterium
NEVYRLAKHLDEKVARIHVEALGG

SEQ ID NO: 702957 - protein, 20 aa, Mycobacterium
NEVYRLPKHLDEKVARIHVE

SEQ ID NO: 702958 - protein, 21 aa, Mycobacterium
NEVYRLPKHLDEKVARIHVEA

SEQ ID NO: 702959 - protein, 22 aa, Mycobacterium
NEVYRLPKHLDEKVARIHVEAL

SEQ ID NO: 702960 - protein, 24 aa, Mycobacterium
NEVYRVPTSYPFRDGETDGAAAAA

SEQ ID NO: 702961 - protein, 26 aa, Mycobacterium
NEWLPRLAAGDAIGCFGLTEPDFGSN

SEQ ID NO: 702962 - protein, 22 aa, Mycobacterium
NEYLDGLLPLLAGEPANATGET

SEQ ID NO: 702963 - protein, 20 aa, Mycobacterium
NEYLMFDAMGFGRPLDFKPM

SEQ ID NO: 702964 - protein, 21 aa, Mycobacterium
NEYVAGWIKRGPSGVIGTNKK

SEQ ID NO: 702965 - protein, 21 aa, Mycobacterium
NFAAPRYGFKPAVIPHPPAGG

SEQ ID NO: 702966 - protein, 17 aa, Mycobacterium
NFADGWNNFNLSLQRDI

SEQ ID NO: 702967 - protein, 25 aa, Mycobacterium
NFAIGAVLCMHFAKQAARFFDSAEV

SEQ ID NO: 702968 - protein, 20 aa, Mycobacterium
NFALEYCLREEKLPASELAG

SEQ ID NO: 702969 - protein, 20 aa, Mycobacterium
NFASHLFQSFAHVPGYSEWL

SEQ ID NO: 702970 - protein, 21 aa, Mycobacterium
NFCKTNGAFDPRTMGTVPNVG

SEQ ID NO: 702971 - protein, 17 aa, Mycobacterium
NFCLHVMALTQIQQNTP

SEQ ID NO: 702972 - protein, 20 aa, Mycobacterium
NFDASGALLTLAPPVAAAWN

SEQ ID NO: 702973 - protein, 31 aa, Mycobacterium
NFDPGRDKLDFGWFKAHEFDVTEVAGSTKIA

SEQ ID NO: 702974 - protein, 20 aa, Mycobacterium
NFDPIYSWPKPVQKPYPPMY

SEQ ID NO: 702975 - protein, 19 aa, Mycobacterium
NFDRGYRSAWWPSTLPTLI

SEQ ID NO: 702976 - protein, 30 aa, Mycobacterium
NFDRSYRLAWWPTRLPTLIVSGAADRIVTQ

SEQ ID NO: 702977 - protein, 20 aa, Mycobacterium
NFEAGPALRFMSGNLCHQIE

SEQ ID NO: 702978 - protein, 20 aa, Mycobacterium
NFEGGWLLRFMSGNLCHQIE

SEQ ID NO: 702979 - protein, 25 aa, Mycobacterium
NFELNEHFAMLATLAGLVSTDTNAN

SEQ ID NO: 702980 - protein, 18 aa, Mycobacterium
NFELWCFAVSSINGCPDC

SEQ ID NO: 702981 - protein, 18 aa, Mycobacterium
NFELWSFAVSSVNGCSHC

SEQ ID NO: 702982 - protein, 22 aa, Mycobacterium
NFEYGLKCILDHAARLIEEKPA

SEQ ID NO: 702983 - protein, 19 aa, Mycobacterium
NFFDYMALLTVGRGGRFVR

SEQ ID NO: 702984 - protein, 17 aa, Mycobacterium
NFFLFGLTESQVEKVKA

SEQ ID NO: 702985 - protein, 19 aa, Mycobacterium
NFFNPRPGTPFGDLEVLPA

SEQ ID NO: 702986 - protein, 21 aa, Mycobacterium
NFGGVRPPWSIGEPQPEIRKL

SEQ ID NO: 702987 - protein, 18 aa, Mycobacterium
NFGPEFEWVVLADPEGNA

SEQ ID NO: 702988 - protein, 26 aa, Mycobacterium
NFGSGNRGNGNFGFGNVVGDNNFGFG

SEQ ID NO: 702989 - protein, 24 aa, Mycobacterium
NFGVDGLRFLTPVKPGDALTVTLT

SEQ ID NO: 702990 - protein, 20 aa, Mycobacterium
NFHAGCPVLAVSVEDLPEEH

SEQ ID NO: 702991 - protein, 17 aa, Mycobacterium
NFHAWTFEGMALGQPDY

SEQ ID NO: 702992 - protein, 26 aa, Mycobacterium
NFHDLGRLGGWAILAAVAPQGSAAQA

SEQ ID NO: 702993 - protein, 17 aa, Mycobacterium
NFHSWTFEGMALGQPDL

SEQ ID NO: 702994 - protein, 18 aa, Mycobacterium
NFHVTGFTSAVGVSELAQ

SEQ ID NO: 702995 - protein, 17 aa, Mycobacterium
NFKMPGFTVPEFRRKAV

SEQ ID NO: 702996 - protein, 23 aa, Mycobacterium
NFKPGTLTSLGFNYANLHALNPH

SEQ ID NO: 702997 - protein, 23 aa, Mycobacterium
NFKVDRPGTVTLTFTPADGSEPI

SEQ ID NO: 702998 - protein, 20 aa, Mycobacterium
NFLARSTSGIPEWMDRLGHR

SEQ ID NO: 702999 - protein, 26 aa, Mycobacterium
NFLDGARAYVRFAIGHPGHYAVMFDW

SEQ ID NO: 703000 - protein, 21 aa, Mycobacterium
NFLGAPYWVGRGFGLNLSVVT

SEQ ID NO: 703001 - protein, 20 aa, Mycobacterium
NFLGEPRVVIGPLYETKTRT

SEQ ID NO: 703002 - protein, 17 aa, Mycobacterium
NFLKGMFGIGDIGGANG

SEQ ID NO: 703003 - protein, 19 aa, Mycobacterium
NFLLLGYQRCHVHDGRVSG

SEQ ID NO: 703004 - protein, 24 aa, Mycobacterium
NFLNPRPGTPFGDLEVLPAGEALK

SEQ ID NO: 703005 - protein, 23 aa, Mycobacterium
NFLNPRPGTPFGDLEVLPASDAL

SEQ ID NO: 703006 - protein, 23 aa, Mycobacterium
NFLNPRPGTPFGDLEVLPVPEAL

SEQ ID NO: 703007 - protein, 23 aa, Mycobacterium
NFLNPRPGTPFGDLEVLPVSEAL

SEQ ID NO: 703008 - protein, 25 aa, Mycobacterium
NFLPAARRRLGIELDDVRKINPDII

SEQ ID NO: 703009 - protein, 23 aa, Mycobacterium
NFLPRATAGLLPWRDRLDAGAHW

SEQ ID NO: 703010 - protein, 17 aa, Mycobacterium
NFMFWPTTCHILEVIPQ

SEQ ID NO: 703011 - protein, 19 aa, Mycobacterium
NFMLLIWEPGWFLTYHYWP

SEQ ID NO: 703012 - protein, 22 aa, Mycobacterium
NFMTQSAFRWMVLGHREIADML

SEQ ID NO: 703013 - protein, 17 aa, Mycobacterium
NFNGALARFGVDRRQGW

SEQ ID NO: 703014 - protein, 19 aa, Mycobacterium
NFNPPAAMAGRITVAEAEK

SEQ ID NO: 703015 - protein, 19 aa, Mycobacterium
NFNPPAAMAGRITVVEAER

SEQ ID NO: 703016 - protein, 20 aa, Mycobacterium
NFPGCAVVISHDRWFLDRTC

SEQ ID NO: 703017 - protein, 18 aa, Mycobacterium
NFPGHGWEAKFFAAYGVA

SEQ ID NO: 703018 - protein, 18 aa, Mycobacterium
NFPGMGLVERWLLNTQFP

SEQ ID NO: 703019 - protein, 22 aa, Mycobacterium
NFPGMGMVERWLLKTQFPETTL

SEQ ID NO: 703020 - protein, 22 aa, Mycobacterium
NFPQLRGKCLANYTSDPVFRAG

SEQ ID NO: 703021 - protein, 19 aa, Mycobacterium
NFPYRYPWRDVERQLQRMA

SEQ ID NO: 703022 - protein, 19 aa, Mycobacterium
NFQALKIMLREGQYDCVVG

SEQ ID NO: 703023 - protein, 27 aa, Mycobacterium
NFQDHFGFDCVWEFPEKVQGGTQVGAA

SEQ ID NO: 703024 - protein, 17 aa, Mycobacterium
NFQSYAGAGGFGGFGGT

SEQ ID NO: 703025 - protein, 23 aa, Mycobacterium
NFRCPYHGWTYRNDGRLTGLPFH

SEQ ID NO: 703026 - protein, 23 aa, Mycobacterium
NFRGLLPAFAERFRCLVLEFPGF

SEQ ID NO: 703027 - protein, 18 aa, Mycobacterium
NFRPGVLDRLGFSEEVLQ

SEQ ID NO: 703028 - protein, 19 aa, Mycobacterium
NFSAAPLEWVPVPEGRLVL

SEQ ID NO: 703029 - protein, 28 aa, Mycobacterium
NFSCTVGGCAACKLKVISGAVAVDEPNC

SEQ ID NO: 703030 - protein, 18 aa, Mycobacterium
NFSFEYCDVLADFTRIVV

SEQ ID NO: 703031 - protein, 19 aa, Mycobacterium
NFSNVPPALSVPFSAFPRP

SEQ ID NO: 703032 - protein, 22 aa, Mycobacterium
NFSPRVFDNFAITWEAVREQNP

SEQ ID NO: 703033 - protein, 18 aa, Mycobacterium
NFSPRVMANFGLEWDAVR

SEQ ID NO: 703034 - protein, 24 aa, Mycobacterium
NFSPRVMTNFGLDWDAVRAANPGA

SEQ ID NO: 703035 - protein, 19 aa, Mycobacterium
NFSVYPLEWVPVPEGRLVL

SEQ ID NO: 703036 - protein, 18 aa, Mycobacterium
NFTDGWLRTGDLGTLSQA

SEQ ID NO: 703037 - protein, 25 aa, Mycobacterium
NFTEVFRLPIQMALVNRRFEFTAIT

SEQ ID NO: 703038 - protein, 26 aa, Mycobacterium
NFTNICYTGCRFCAFAQRKGDADAYS

SEQ ID NO: 703039 - protein, 23 aa, Mycobacterium
NFVAYRGGSPVGRISAAIDSAYV

SEQ ID NO: 703040 - protein, 24 aa, Mycobacterium
NFWSNAVIFCGHFPDGAEKFTVTD

SEQ ID NO: 703041 - protein, 18 aa, Mycobacterium
NFYHMLATRYGYGAEADR

SEQ ID NO: 703042 - protein, 25 aa, Mycobacterium
NGAAYSCFTPSPSMGVPALRSLADD

SEQ ID NO: 703043 - protein, 17 aa, Mycobacterium
NGACVGAGLGLALGADI

SEQ ID NO: 703044 - protein, 22 aa, Mycobacterium
NGAGGMGGWGGAGGQAGLIGNG

SEQ ID NO: 703045 - protein, 24 aa, Mycobacterium
NGAGLKVGFLTAIESEEPVTEDEA

SEQ ID NO: 703046 - protein, 23 aa, Mycobacterium
NGAGLPSLMVLTGVNSAIDAIWA

SEQ ID NO: 703047 - protein, 21 aa, Mycobacterium
NGAGLRPGLLDELEAGATPTD

SEQ ID NO: 703048 - protein, 22 aa, Mycobacterium
NGALARFGVDRRQGWPALNLFY

SEQ ID NO: 703049 - protein, 24 aa, Mycobacterium
NGANGQTGGYIHGASGGSGGASGA

SEQ ID NO: 703050 - protein, 24 aa, Mycobacterium
NGAQRAVRHVFSLLAAGRSVLTHC

SEQ ID NO: 703051 - protein, 24 aa, Mycobacterium
NGARAGCLLLVYPNVIAVERQLRI

SEQ ID NO: 703052 - protein, 17 aa, Mycobacterium
NGARLVTYVITGERGSG

SEQ ID NO: 703053 - protein, 23 aa, Mycobacterium
NGARPFLFTDTVGFVRHLPTQLV

SEQ ID NO: 703054 - protein, 21 aa, Mycobacterium
NGARPKALLLPLGPLAEHNIR

SEQ ID NO: 703055 - protein, 23 aa, Mycobacterium
NGARQKFSRPCYVQNINSKRLMT

SEQ ID NO: 703056 - protein, 25 aa, Mycobacterium
NGATVERLSYWLARPHGAPPNGATA

SEQ ID NO: 703057 - protein, 21 aa, Mycobacterium
NGAVHGGCLGLLFDTIFGTGS

SEQ ID NO: 703058 - protein, 20 aa, Mycobacterium
NGCGDRLVLLPGVNGSALRD

SEQ ID NO: 703059 - protein, 23 aa, Mycobacterium
NGCGLPADISRRSGLANMKHRAE

SEQ ID NO: 703060 - protein, 24 aa, Mycobacterium
NGCMATSGSLIRWFQTLIGGAELT

SEQ ID NO: 703061 - protein, 17 aa, Mycobacterium
NGDCGTCTAVVDGRCVK

SEQ ID NO: 703062 - protein, 18 aa, Mycobacterium
NGDERWRAVLQRFGEVTE

SEQ ID NO: 703063 - protein, 17 aa, Mycobacterium
NGDGLQGFGGWNSGSGN

SEQ ID NO: 703064 - protein, 30 aa, Mycobacterium
NGDLIKKLLPILAPIVLAYIGKQFSQQNAP

SEQ ID NO: 703065 - protein, 23 aa, Mycobacterium
NGDPAGGLVYAFGAPIAANIALG

SEQ ID NO: 703066 - protein, 23 aa, Mycobacterium
NGDPSAPGAPTWRPYDASRATLV

SEQ ID NO: 703067 - protein, 18 aa, Mycobacterium
NGDVTGLVRSHLKATLKH

SEQ ID NO: 703068 - protein, 19 aa, Mycobacterium
NGEARVLVATDVAARGVHV

SEQ ID NO: 703069 - protein, 32 aa, Mycobacterium
NGEEAHWARRGGYVLCSFVPASLPAHELDSSD

SEQ ID NO: 703070 - protein, 21 aa, Mycobacterium
NGEIAPAHLVLGLFSDPSGLA

SEQ ID NO: 703071 - protein, 24 aa, Mycobacterium
NGELPAVRVGRSFRVHAKAVHDLL

SEQ ID NO: 703072 - protein, 24 aa, Mycobacterium
NGELPAVRVGRSFRVHAKAVNDLL

SEQ ID NO: 703073 - protein, 24 aa, Mycobacterium
NGEPFWFPNWTRLVYAGDGLFCSE

SEQ ID NO: 703074 - protein, 25 aa, Mycobacterium
NGEPGWKLTGQKVWTSAAQNAHWGV

SEQ ID NO: 703075 - protein, 20 aa, Mycobacterium
NGEPHIGHAYEYVATDAVAR

SEQ ID NO: 703076 - protein, 24 aa, Mycobacterium
NGERTGNVCLVTLGLNMFSRGVDP

SEQ ID NO: 703077 - protein, 22 aa, Mycobacterium
NGESMGAVARELHYTDVSALYT

SEQ ID NO: 703078 - protein, 18 aa, Mycobacterium
NGESVFFLLGNRNVESVV

SEQ ID NO: 703079 - protein, 28 aa, Mycobacterium
NGETMAMLGRPLIGNGADGAPGQAGADG

SEQ ID NO: 703080 - protein, 21 aa, Mycobacterium
NGEVRLGRLASILRDKRIPLE

SEQ ID NO: 703081 - protein, 23 aa, Mycobacterium
NGEWRIGRLRAYWELPAMMRQFL

SEQ ID NO: 703082 - protein, 18 aa, Mycobacterium
NGFALILVGHVTKDGAIA

SEQ ID NO: 703083 - protein, 20 aa, Mycobacterium
NGFEHWIWDDTGGYPPREIQ

SEQ ID NO: 703084 - protein, 23 aa, Mycobacterium
NGFFYRLMPPFCIGTAAAGVGDY

SEQ ID NO: 703085 - protein, 17 aa, Mycobacterium
NGFPPLPTYFMNGTGPG

SEQ ID NO: 703086 - protein, 21 aa, Mycobacterium
NGFQVLCEAGLLPGALTRNEN

SEQ ID NO: 703087 - protein, 21 aa, Mycobacterium
NGGAASLLFGNGGSGGDGGVG

SEQ ID NO: 703088 - protein, 28 aa, Mycobacterium
NGGAGGAAGWWGRGGIGGQGGTGGEAGG

SEQ ID NO: 703089 - protein, 28 aa, Mycobacterium
NGGAGGATGWFGSTGMTGAGGAGGHGGN

SEQ ID NO: 703090 - protein, 25 aa, Mycobacterium
NGGAGGGGLWFGNGGAGGIGGFDAH

SEQ ID NO: 703091 - protein, 29 aa, Mycobacterium
NGGAGGNAIAFAGSTSFSSASGGAGGTGA

SEQ ID NO: 703092 - protein, 27 aa, Mycobacterium
NGGAGGSAGLWGAGGAGGAGGAGATPG

SEQ ID NO: 703093 - protein, 26 aa, Mycobacterium
NGGAGGSAGLWGHGGNGGIGGAGGAG

SEQ ID NO: 703094 - protein, 22 aa, Mycobacterium
NGGAGHDGHIGGGAGGTGGAGG

SEQ ID NO: 703095 - protein, 20 aa, Mycobacterium
NGGAGLGILGEAGGNGGGGG

SEQ ID NO: 703096 - protein, 24 aa, Mycobacterium
NGGDGAVGTFFGGTGAGGNGGHGG

SEQ ID NO: 703097 - protein, 23 aa, Mycobacterium
NGGDGGHSGWLYGNGGNGGNTGN

SEQ ID NO: 703098 - protein, 17 aa, Mycobacterium
NGGDPGAGGALGKGGAG

SEQ ID NO: 703099 - protein, 17 aa, Mycobacterium
NGGEYDADLVLRPELAP

SEQ ID NO: 703100 - protein, 21 aa, Mycobacterium
NGGGGGNAFLLGAGGAGGVGG

SEQ ID NO: 703101 - protein, 19 aa, Mycobacterium
NGGGVILGFGNYAGDVLHF

SEQ ID NO: 703102 - protein, 25 aa, Mycobacterium
NGGILERYTGLYIPFMDVSFDGATP

SEQ ID NO: 703103 - protein, 19 aa, Mycobacterium
NGGKGGNAILIGDGGNGGN

SEQ ID NO: 703104 - protein, 17 aa, Mycobacterium
NGGKWGSQWLVDNRPDL

SEQ ID NO: 703105 - protein, 25 aa, Mycobacterium
NGGLFREMITLPVLSKDFREAVLDA

SEQ ID NO: 703106 - protein, 23 aa, Mycobacterium
NGGLGVAVTKSWGMVDNRTISAI

SEQ ID NO: 703107 - protein, 24 aa, Mycobacterium
NGGLGVAVTKSWGMVDNRTISAIT

SEQ ID NO: 703108 - protein, 24 aa, Mycobacterium
NGGLGVAVTKSWGMVDNRTVSAVT

SEQ ID NO: 703109 - protein, 26 aa, Mycobacterium
NGGLLLPLGLRRLRVYASTRNARYCH

SEQ ID NO: 703110 - protein, 18 aa, Mycobacterium
NGGLLLRDLDLPDFTDYA

SEQ ID NO: 703111 - protein, 21 aa, Mycobacterium
NGGLLSRFAGLSLPSLGVEFF

SEQ ID NO: 703112 - protein, 22 aa, Mycobacterium
NGGLMLPLGVRQIRAYASTRNA

SEQ ID NO: 703113 - protein, 20 aa, Mycobacterium
NGGMPGRITVQYKFTQPGEG

SEQ ID NO: 703114 - protein, 17 aa, Mycobacterium
NGGNGFLGGTGGAGGSG

SEQ ID NO: 703115 - protein, 31 aa, Mycobacterium
NGGNGGAGGNGFLGAPAFSSNPGGNGGNGGA

SEQ ID NO: 703116 - protein, 25 aa, Mycobacterium
NGGNGGKGADGWVQAYDPAGPVGSK

SEQ ID NO: 703117 - protein, 20 aa, Mycobacterium
NGGNGGLLFGNGGAGGNGGD

SEQ ID NO: 703118 - protein, 28 aa, Mycobacterium
NGGNGGNAGAFALFGNGGNGGNGGVGVV

SEQ ID NO: 703119 - protein, 21 aa, Mycobacterium
NGGNGGNGWVQAYDPNGPAGT

SEQ ID NO: 703120 - protein, 23 aa, Mycobacterium
NGGNGGQSGWLYGNGGDGGNSGS

SEQ ID NO: 703121 - protein, 24 aa, Mycobacterium
NGGNGGVGGTGFIGGNGGNGGGGV

SEQ ID NO: 703122 - protein, 25 aa, Mycobacterium
NGGPKPLRRAIAWYRDHDRLRCGDE

SEQ ID NO: 703123 - protein, 25 aa, Mycobacterium
NGGRIRLQPQLGWEANEPDELAQVV

SEQ ID NO: 703124 - protein, 25 aa, Mycobacterium
NGGRLRLQPQRSWEVNEPSELDKVL

SEQ ID NO: 703125 - protein, 24 aa, Mycobacterium
NGGSGAHGGWLIGNAGNGGDSGGG

SEQ ID NO: 703126 - protein, 25 aa, Mycobacterium
NGGSGGLGGNAWLLGSGGTGGTGGA

SEQ ID NO: 703127 - protein, 26 aa, Mycobacterium
NGGSGGRAALLYGVGGDGGAGGAGGD

SEQ ID NO: 703128 - protein, 19 aa, Mycobacterium
NGGSLNFGFGNAGLGNVGV

SEQ ID NO: 703129 - protein, 24 aa, Mycobacterium
NGGTGGAALGWFGNGGAGGDGGAG

SEQ ID NO: 703130 - protein, 22 aa, Mycobacterium
NGGTGGLLFGDGGHGYDGSAAG

SEQ ID NO: 703131 - protein, 24 aa, Mycobacterium
NGGTGGLLFGNGGNGGMGGTATLG

SEQ ID NO: 703132 - protein, 20 aa, Mycobacterium
NGGTGGNGFVGGAGGSGGSG

SEQ ID NO: 703133 - protein, 20 aa, Mycobacterium
NGGTVALHWPPSLHQDIARL

SEQ ID NO: 703134 - protein, 25 aa, Mycobacterium
NGGVGGRGGVLFGDGGIGGAGGGGG

SEQ ID NO: 703135 - protein, 25 aa, Mycobacterium
NGGVLQRFTGLYVPVLDVLFNGATP

SEQ ID NO: 703136 - protein, 24 aa, Mycobacterium
NGGVRNSDNLSYDGIIGNGGTGGN

SEQ ID NO: 703137 - protein, 28 aa, Mycobacterium
NGGVTLPLLLPIGLGFVVLDVPFDGILV

SEQ ID NO: 703138 - protein, 27 aa, Mycobacterium
NGGYAEFCTAPAFLSAKVPDGVSSEVA

SEQ ID NO: 703139 - protein, 24 aa, Mycobacterium
NGHFYGVGLINWWDPKGTRSTLEE

SEQ ID NO: 703140 - protein, 27 aa, Mycobacterium
NGHHWLKDVYIQDGLLRLGSETVEDRV

SEQ ID NO: 703141 - protein, 17 aa, Mycobacterium
NGHLHLPALRAALEREV

SEQ ID NO: 703142 - protein, 19 aa, Mycobacterium
NGHPFLYPRLVCPVCHDGE

SEQ ID NO: 703143 - protein, 25 aa, Mycobacterium
NGHSYGVGLINWWDPAGARRTLSEL

SEQ ID NO: 703144 - protein, 24 aa, Mycobacterium
NGHVRRLLVEAAWHHKPRYHVGAV

SEQ ID NO: 703145 - protein, 21 aa, Mycobacterium
NGIAMAPPLGAHRLVAETVLD

SEQ ID NO: 703146 - protein, 19 aa, Mycobacterium
NGIDIQWGILIKRRVSAHE

SEQ ID NO: 703147 - protein, 25 aa, Mycobacterium
NGIDLRAGVRVVRLDTFAHLVYADD

SEQ ID NO: 703148 - protein, 24 aa, Mycobacterium
NGIDVSIRGPERIALTGSNGAGKS

SEQ ID NO: 703149 - protein, 17 aa, Mycobacterium
NGIKIFGPGGRKLDDDT

SEQ ID NO: 703150 - protein, 17 aa, Mycobacterium
NGIKIFGPGGRKLDDGT

SEQ ID NO: 703151 - protein, 25 aa, Mycobacterium
NGILASMCFPTFTGFSARHLNMHRE

SEQ ID NO: 703152 - protein, 17 aa, Mycobacterium
NGIPLIVDNTIATPYLI

SEQ ID NO: 703153 - protein, 17 aa, Mycobacterium
NGIRIVTDGAVLILRPE

SEQ ID NO: 703154 - protein, 17 aa, Mycobacterium
NGISNRLLGMGPMTGNV

SEQ ID NO: 703155 - protein, 22 aa, Mycobacterium
NGISRDGKTAGSRLPSDHSTGT

SEQ ID NO: 703156 - protein, 18 aa, Mycobacterium
NGKDLGISFHNYLYNFNP

SEQ ID NO: 703157 - protein, 18 aa, Mycobacterium
NGKDLGISFHNYLYNFSE

SEQ ID NO: 703158 - protein, 24 aa, Mycobacterium
NGKELERFSPFDGTLPRELSLRSP

SEQ ID NO: 703159 - protein, 18 aa, Mycobacterium
NGKPEFVENFFTFIAEDI

SEQ ID NO: 703160 - protein, 17 aa, Mycobacterium
NGKRFCVLVDADRNRHL

SEQ ID NO: 703161 - protein, 23 aa, Mycobacterium
NGKRLPVPLYPGFDTLGTLEYIT

SEQ ID NO: 703162 - protein, 21 aa, Mycobacterium
NGKTSVCRIIDALLMALHRRT

SEQ ID NO: 703163 - protein, 25 aa, Mycobacterium
NGLAAELRSAALSYGSALSSLTSEE

SEQ ID NO: 703164 - protein, 17 aa, Mycobacterium
NGLAASYVSGYLATDPP

SEQ ID NO: 703165 - protein, 25 aa, Mycobacterium
NGLACADGVVIPTECEYFSLRGLAL

SEQ ID NO: 703166 - protein, 20 aa, Mycobacterium
NGLARPGEILACTDSHTCAG

SEQ ID NO: 703167 - protein, 20 aa, Mycobacterium
NGLASFGMSMGQQLTFGPGG

SEQ ID NO: 703168 - protein, 29 aa, Mycobacterium
NGLCVRFLTDWAGPEAMVKKLSIRLGVPC

SEQ ID NO: 703169 - protein, 27 aa, Mycobacterium
NGLCVRFLTDWAGPEAMVKNLSIRLGV

SEQ ID NO: 703170 - protein, 23 aa, Mycobacterium
NGLDLVREFGIRADPALWQEVLV

SEQ ID NO: 703171 - protein, 18 aa, Mycobacterium
NGLDRGGNISAWAAATLT

SEQ ID NO: 703172 - protein, 19 aa, Mycobacterium
NGLEVLRYGGLETGAVPSP

SEQ ID NO: 703173 - protein, 20 aa, Mycobacterium
NGLEVLRYGGLETGAVPSPF

SEQ ID NO: 703174 - protein, 30 aa, Mycobacterium
NGLEVRGPQRWRVKANWKIAAENFAGDMYH

SEQ ID NO: 703175 - protein, 22 aa, Mycobacterium
NGLEVWGSYNGALLIQSNFVPA

SEQ ID NO: 703176 - protein, 27 aa, Mycobacterium
NGLFLSLPWFYRAGYDVLLYTLPFHGL

SEQ ID NO: 703177 - protein, 23 aa, Mycobacterium
NGLGGPIFRYLLTNKKMYEAVGL

SEQ ID NO: 703178 - protein, 17 aa, Mycobacterium
NGLGRDGRRWRALFERP

SEQ ID NO: 703179 - protein, 17 aa, Mycobacterium
NGLKKAGVLVAIDDFGT

SEQ ID NO: 703180 - protein, 17 aa, Mycobacterium
NGLKPNGLLVLRIPDRD

SEQ ID NO: 703181 - protein, 31 aa, Mycobacterium
NGLKQELPPDFKLPPGVFGPDYDTTDEPAKT

SEQ ID NO: 703182 - protein, 17 aa, Mycobacterium
NGLLDRTTAAFPVDNGK

SEQ ID NO: 703183 - protein, 23 aa, Mycobacterium
NGLLGRPGAQPGPIGPVPAVAVV

SEQ ID NO: 703184 - protein, 33 aa, Mycobacterium
NGLLRGMPAGALGRRGAAGGYVNKYGFRYSVLT

SEQ ID NO: 703185 - protein, 20 aa, Mycobacterium
NGLLTTVCYQFGDAKPVYAL

SEQ ID NO: 703186 - protein, 23 aa, Mycobacterium
NGLLTTVCYRLGDDAPVYALEGS

SEQ ID NO: 703187 - protein, 27 aa, Mycobacterium
NGLPEDPEWLLAHLADFGTARCENHYN

SEQ ID NO: 703188 - protein, 27 aa, Mycobacterium
NGLPEDPEWLLAHLADFGTVRCENHYN

SEQ ID NO: 703189 - protein, 26 aa, Mycobacterium
NGLPLTLWLARFLKFIQTEIFPGGHP

SEQ ID NO: 703190 - protein, 21 aa, Mycobacterium
NGLVWSEFTLGAAYEGPPGHV

SEQ ID NO: 703191 - protein, 25 aa, Mycobacterium
NGMAARTRFFDDFFLDAARAGVRQF

SEQ ID NO: 703192 - protein, 19 aa, Mycobacterium
NGMDPLWRDLHTITAPTLL

SEQ ID NO: 703193 - protein, 17 aa, Mycobacterium
NGMIPHIVFANGVDGYF

SEQ ID NO: 703194 - protein, 26 aa, Mycobacterium
NGMQPETLVCFDWLLEAFSHLGVAAP

SEQ ID NO: 703195 - protein, 24 aa, Mycobacterium
NGMSWDLRCGSMFEPVAGERFDLI

SEQ ID NO: 703196 - protein, 23 aa, Mycobacterium
NGNMFRDYVEWRAQNPSDDLVTE

SEQ ID NO: 703197 - protein, 24 aa, Mycobacterium
NGNMFRDYVEWRGRNPSNDLVTEL

SEQ ID NO: 703198 - protein, 17 aa, Mycobacterium
NGNPILCDLILIRSALS

SEQ ID NO: 703199 - protein, 17 aa, Mycobacterium
NGPAGIFLARYGDHLKR

SEQ ID NO: 703200 - protein, 17 aa, Mycobacterium
NGPRTGPASVIWDKGTK

SEQ ID NO: 703201 - protein, 27 aa, Mycobacterium
NGPTEALLGRPLIGNGADGTAPGQAGG

SEQ ID NO: 703202 - protein, 26 aa, Mycobacterium
NGPWIADRLLELGVELAHITICGDRP

SEQ ID NO: 703203 - protein, 24 aa, Mycobacterium
NGPWLADRLLELGVELSHITLCGD

SEQ ID NO: 703204 - protein, 22 aa, Mycobacterium
NGQAAARAWWLLRAAGVSNVRI

SEQ ID NO: 703205 - protein, 19 aa, Mycobacterium
NGQAAWGGYSAFDVTGGSQ

SEQ ID NO: 703206 - protein, 19 aa, Mycobacterium
NGQFVPFLPARLGRSAMKA

SEQ ID NO: 703207 - protein, 18 aa, Mycobacterium
NGQGGWPMTCFLTPDGRP

SEQ ID NO: 703208 - protein, 28 aa, Mycobacterium
NGQKLWASGAMYADWCLLLARTDPNAPK

SEQ ID NO: 703209 - protein, 17 aa, Mycobacterium
NGQKVWTSLALQSQWCF

SEQ ID NO: 703210 - protein, 18 aa, Mycobacterium
NGQLPVEFVDRAVRRLLL

SEQ ID NO: 703211 - protein, 23 aa, Mycobacterium
NGQQRPGPTYNIYARDTEDAFVK

SEQ ID NO: 703212 - protein, 26 aa, Mycobacterium
NGQSTFPLTIDALGIPTTLNLPMDGI

SEQ ID NO: 703213 - protein, 25 aa, Mycobacterium
NGQSWLATLWSEFGPNANIWNTIAS

SEQ ID NO: 703214 - protein, 24 aa, Mycobacterium
NGQTLFEICARLTTKHGISSSRQA

SEQ ID NO: 703215 - protein, 30 aa, Mycobacterium
NGQTLIDLNVRWRKGQTLDPDWKIEQDGWV

SEQ ID NO: 703216 - protein, 20 aa, Mycobacterium
NGRDAVIRWLSQHREQSPYP

SEQ ID NO: 703217 - protein, 20 aa, Mycobacterium
NGRDGTVFDSSYERGAPVDF

SEQ ID NO: 703218 - protein, 21 aa, Mycobacterium
NGREWGHFGFDEYLETKAAMG

SEQ ID NO: 703219 - protein, 24 aa, Mycobacterium
NGRGGVVLADKWKAGPVNYLGMVI

SEQ ID NO: 703220 - protein, 21 aa, Mycobacterium
NGRGIPDYVERCSGLRNLKTR

SEQ ID NO: 703221 - protein, 23 aa, Mycobacterium
NGRIGAKLLRFPAALLTTTGRKS

SEQ ID NO: 703222 - protein, 24 aa, Mycobacterium
NGRIRKGQQVAWMREVDGHPVITN

SEQ ID NO: 703223 - protein, 20 aa, Mycobacterium
NGRLDAATMITHRYPMDEFD

SEQ ID NO: 703224 - protein, 22 aa, Mycobacterium
NGRPEPFGAPLAGYGALPDDAR

SEQ ID NO: 703225 - protein, 25 aa, Mycobacterium
NGRPRRAGVSSFGFTGTNAHVLIEE

SEQ ID NO: 703226 - protein, 26 aa, Mycobacterium
NGRPRRAGVSSFGFTGTNAHVLIEEA

SEQ ID NO: 703227 - protein, 22 aa, Mycobacterium
NGRQRWCVRLVQGGGFAGPLLD

SEQ ID NO: 703228 - protein, 20 aa, Mycobacterium
NGRTGTLLLHLLAHRAGRRL

SEQ ID NO: 703229 - protein, 21 aa, Mycobacterium
NGRTVFGVRGRREITPLGTVI

SEQ ID NO: 703230 - protein, 32 aa, Mycobacterium
NGSAFVDAWLLRACAKLGIRLVHSAPGRPQGR

SEQ ID NO: 703231 - protein, 19 aa, Mycobacterium
NGSGEAIGGAPGAGGTGAV

SEQ ID NO: 703232 - protein, 18 aa, Mycobacterium
NGSGGRGGDGYTSTDPTL

SEQ ID NO: 703233 - protein, 18 aa, Mycobacterium
NGSGGWRIANRAGGANVN

SEQ ID NO: 703234 - protein, 17 aa, Mycobacterium
NGSGMAWVEGSVVATAG

SEQ ID NO: 703235 - protein, 20 aa, Mycobacterium
NGSIKARHLGSGQTVRLPAH

SEQ ID NO: 703236 - protein, 17 aa, Mycobacterium
NGSKAWITHGGRADFYT

SEQ ID NO: 703237 - protein, 26 aa, Mycobacterium
NGSLPYEVFPELGAKSNKRTRRRDAE

SEQ ID NO: 703238 - protein, 21 aa, Mycobacterium
NGSPRAAGRLLSLVEGEQRDE

SEQ ID NO: 703239 - protein, 22 aa, Mycobacterium
NGSPRAAGRLLSLVEGERRDEV

SEQ ID NO: 703240 - protein, 25 aa, Mycobacterium
NGSQIPLCLDTGHLLIGGTDPLELA

SEQ ID NO: 703241 - protein, 17 aa, Mycobacterium
NGSRRTFVCPFHGWCWA

SEQ ID NO: 703242 - protein, 22 aa, Mycobacterium
NGSSWIFPLFNDFEDLYKKMPQ

SEQ ID NO: 703243 - protein, 22 aa, Mycobacterium
NGSSWIFPLFNDFEELAKKMPQ

SEQ ID NO: 703244 - protein, 23 aa, Mycobacterium
NGSSWIFPLFRDFADLYKKMPQN

SEQ ID NO: 703245 - protein, 21 aa, Mycobacterium
NGTCVAGGFEMLGLTDIRVAV

SEQ ID NO: 703246 - protein, 17 aa, Mycobacterium
NGTCVAGGFEMLSSTDI

SEQ ID NO: 703247 - protein, 24 aa, Mycobacterium
NGTDAGMQYCWVIRLTGDHITEVI

SEQ ID NO: 703248 - protein, 22 aa, Mycobacterium
NGTDLIALYCEDFGDGRSFVSA

SEQ ID NO: 703249 - protein, 24 aa, Mycobacterium
NGTDPRGVFGISLTTRRRPPTASD

SEQ ID NO: 703250 - protein, 32 aa, Mycobacterium
NGTEFLNKAVIKWAAQMEIFFTRSRPYKKNDQ

SEQ ID NO: 703251 - protein, 27 aa, Mycobacterium
NGTGARRARCSVSVRGRVLEIIEDLPP

SEQ ID NO: 703252 - protein, 17 aa, Mycobacterium
NGTGVWITACRYDFLIP

SEQ ID NO: 703253 - protein, 17 aa, Mycobacterium
NGTIAPRDARHSYAVLR

SEQ ID NO: 703254 - protein, 17 aa, Mycobacterium
NGTKRWNTGVHRATHDL

SEQ ID NO: 703255 - protein, 24 aa, Mycobacterium
NGTLREQLCGWVEAGIPRVKMKVG

SEQ ID NO: 703256 - protein, 20 aa, Mycobacterium
NGTMRRLHNAVALGLIDIDE

SEQ ID NO: 703257 - protein, 20 aa, Mycobacterium
NGTMRRLHNAVALGLIDIEE

SEQ ID NO: 703258 - protein, 20 aa, Mycobacterium
NGTMRRLHNAVALGLIDINE

SEQ ID NO: 703259 - protein, 21 aa, Mycobacterium
NGTMRRLHNAVALGLIDINEF

SEQ ID NO: 703260 - protein, 19 aa, Mycobacterium
NGTSRWLVAVRMVSEGVDV

SEQ ID NO: 703261 - protein, 18 aa, Mycobacterium
NGTVMLRMPLHPVAIELL

SEQ ID NO: 703262 - protein, 27 aa, Mycobacterium
NGTVVQHWTVSHLKPSTDTIPYQPVGT

SEQ ID NO: 703263 - protein, 21 aa, Mycobacterium
NGVDELARLWALPTTPGAPAP

SEQ ID NO: 703264 - protein, 18 aa, Mycobacterium
NGVDGYFPGPARWACSAL

SEQ ID NO: 703265 - protein, 23 aa, Mycobacterium
NGVDGYFPGPARWATQALAANAP

SEQ ID NO: 703266 - protein, 19 aa, Mycobacterium
NGVDGYFPGPARWQTSELA

SEQ ID NO: 703267 - protein, 25 aa, Mycobacterium
NGVEMLMPCFARLYEELGITKADIG

SEQ ID NO: 703268 - protein, 26 aa, Mycobacterium
NGVERMAGLIPAEYQDFAAPVFEEFR

SEQ ID NO: 703269 - protein, 23 aa, Mycobacterium
NGVFRCGGAWVRAHRRQLATVVT

SEQ ID NO: 703270 - protein, 18 aa, Mycobacterium
NGVFTRLPVRTAAGSRLA

SEQ ID NO: 703271 - protein, 23 aa, Mycobacterium
NGVHGWRSPALPEFDPFWRDVEV

SEQ ID NO: 703272 - protein, 23 aa, Mycobacterium
NGVKLPGGLWIVTERAVATESGE

SEQ ID NO: 703273 - protein, 17 aa, Mycobacterium
NGVPRLLCMTRMSTFAE

SEQ ID NO: 703274 - protein, 20 aa, Mycobacterium
NGVPRPRLAPAKLADSLVGV

SEQ ID NO: 703275 - protein, 17 aa, Mycobacterium
NGVPRRRQGAGVATEIA

SEQ ID NO: 703276 - protein, 17 aa, Mycobacterium
NGVRIARKSLQQRRTTW

SEQ ID NO: 703277 - protein, 28 aa, Mycobacterium
NGVSNSRIVVGGLWGNGGHGGTGGTGSA

SEQ ID NO: 703278 - protein, 23 aa, Mycobacterium
NGVTGVRIGFSFLQIPVGPSSFL

SEQ ID NO: 703279 - protein, 18 aa, Mycobacterium
NGVVDAYLRLGALVTPAQ

SEQ ID NO: 703280 - protein, 19 aa, Mycobacterium
NGVVGRRAAECAFSHAGLR

SEQ ID NO: 703281 - protein, 28 aa, Mycobacterium
NGVWKIALRRCTIEWMISGDSSVLGSGA

SEQ ID NO: 703282 - protein, 23 aa, Mycobacterium
NGVYRCGFAGSQRAYERAYDRLF

SEQ ID NO: 703283 - protein, 18 aa, Mycobacterium
NGWHTDVTFVDRIPKASV

SEQ ID NO: 703284 - protein, 17 aa, Mycobacterium
NGWPMPLPDELKEDLKS

SEQ ID NO: 703285 - protein, 18 aa, Mycobacterium
NGWPMPLPEELRDDLKST

SEQ ID NO: 703286 - protein, 19 aa, Mycobacterium
NGWRNADLIPGTRINRNAM

SEQ ID NO: 703287 - protein, 28 aa, Mycobacterium
NGYCVRFLTDWAGPEAMVKKLSIRLGVP

SEQ ID NO: 703288 - protein, 28 aa, Mycobacterium
NGYCVRFLTDWAGPEAMVKNLSIRLGVP

SEQ ID NO: 703289 - protein, 24 aa, Mycobacterium
NGYDAGFVDSFWKIVRAYQSEQTP

SEQ ID NO: 703290 - protein, 24 aa, Mycobacterium
NGYLGHYLALEWLERLDKTEGKLI

SEQ ID NO: 703291 - protein, 23 aa, Mycobacterium
NGYSRLQWAVLNWNVNAIALYDA

SEQ ID NO: 703292 - protein, 23 aa, Mycobacterium
NGYSRLSWAVLDWNVNAIALYDG

SEQ ID NO: 703293 - protein, 24 aa, Mycobacterium
NGYTRLSWAVLNWNSDALALYDGI

SEQ ID NO: 703294 - protein, 24 aa, Mycobacterium
NGYTRLSWAVLNWNSNAIAVYDAV

SEQ ID NO: 703295 - protein, 24 aa, Mycobacterium
NHAGRITAPRGWELVRHAGPLPTH

SEQ ID NO: 703296 - protein, 24 aa, Mycobacterium
NHALDYLGAKGWQLEGVPLAELFR

SEQ ID NO: 703297 - protein, 17 aa, Mycobacterium
NHAPLAFADTARRLDAL

SEQ ID NO: 703298 - protein, 24 aa, Mycobacterium
NHAQGFAYACRMLQVHGRVYVPAK

SEQ ID NO: 703299 - protein, 25 aa, Mycobacterium
NHDDWRWVIDIDLWGSIHAVEAFVP

SEQ ID NO: 703300 - protein, 18 aa, Mycobacterium
NHDLTFRGDFPLNTAGGQ

SEQ ID NO: 703301 - protein, 23 aa, Mycobacterium
NHESPELAGFVATAPIDARRHRE

SEQ ID NO: 703302 - protein, 20 aa, Mycobacterium
NHFEAIALVQKVAFALPDKY

SEQ ID NO: 703303 - protein, 25 aa, Mycobacterium
NHFFVCSTHDWILFFTTQGRVYRAK

SEQ ID NO: 703304 - protein, 27 aa, Mycobacterium
NHFKDDFLDYWAFLAFASVRGGRRTAG

SEQ ID NO: 703305 - protein, 17 aa, Mycobacterium
NHFRFIRDHQKHVKKIA

SEQ ID NO: 703306 - protein, 23 aa, Mycobacterium
NHGAGALAIRLARHHPEVPVGVN

SEQ ID NO: 703307 - protein, 24 aa, Mycobacterium
NHGFDMAAPFGGYKRSGNGREWGP

SEQ ID NO: 703308 - protein, 22 aa, Mycobacterium
NHGKSVMHFGCRCQRGATRRPC

SEQ ID NO: 703309 - protein, 25 aa, Mycobacterium
NHGLGRAVPQYGFRPNFVVRPPAAG

SEQ ID NO: 703310 - protein, 23 aa, Mycobacterium
NHGRGRLAGRLLGSVGAAVVNRA

SEQ ID NO: 703311 - protein, 34 aa, Mycobacterium
NHGWRDYGARVGIWRMIESLDRHGIRPSVLLNSM

SEQ ID NO: 703312 - protein, 19 aa, Mycobacterium
NHHARWRSALVDSLQEAFF

SEQ ID NO: 703313 - protein, 23 aa, Mycobacterium
NHHPSICPYGLFDTADGAVQIAV

SEQ ID NO: 703314 - protein, 18 aa, Mycobacterium
NHIRWRDDPPQGQWQPLP

SEQ ID NO: 703315 - protein, 18 aa, Mycobacterium
NHKGSTWVLSLSGGRLIA

SEQ ID NO: 703316 - protein, 17 aa, Mycobacterium
NHKGSTWVLSLSGGRLV

SEQ ID NO: 703317 - protein, 19 aa, Mycobacterium
NHLACLRGCGLVVAVPEGR

SEQ ID NO: 703318 - protein, 17 aa, Mycobacterium
NHLGHFVLTDALLPSLL

SEQ ID NO: 703319 - protein, 35 aa, Mycobacterium
NHLGMAYNHAGDWEHMMKIWEGVMPAAGDGQAATA

SEQ ID NO: 703320 - protein, 21 aa, Mycobacterium
NHLGPTLSMRGIDNAAYYRLV

SEQ ID NO: 703321 - protein, 20 aa, Mycobacterium
NHLIQLLALTAMEEPVNFSP

SEQ ID NO: 703322 - protein, 17 aa, Mycobacterium
NHLKGVVMFDGVANNAT

SEQ ID NO: 703323 - protein, 27 aa, Mycobacterium
NHLMLTVFFDLGWPCRPIDYGAIRHLE

SEQ ID NO: 703324 - protein, 23 aa, Mycobacterium
NHLQTLRLYAEWCDLADLREGDR

SEQ ID NO: 703325 - protein, 17 aa, Mycobacterium
NHLWGGRVTYRVRRLDG

SEQ ID NO: 703326 - protein, 23 aa, Mycobacterium
NHLWRRIRAANLPVALSDRLTLD

SEQ ID NO: 703327 - protein, 22 aa, Mycobacterium
NHPELLAGSLLDVARIVRSVTN

SEQ ID NO: 703328 - protein, 25 aa, Mycobacterium
NHPGLPRLINMYGITETTVHASFRE

SEQ ID NO: 703329 - protein, 17 aa, Mycobacterium
NHPVRDRIPVLIAALGP

SEQ ID NO: 703330 - protein, 17 aa, Mycobacterium
NHRAIDALSHVGVKTNV

SEQ ID NO: 703331 - protein, 22 aa, Mycobacterium
NHRAIDALSHVGVRSAVKMPSQ

SEQ ID NO: 703332 - protein, 23 aa, Mycobacterium
NHRKEMRAEIAYYAERFREEQRR

SEQ ID NO: 703333 - protein, 22 aa, Mycobacterium
NHRKEMRAEIAYYAQRLREDQR

SEQ ID NO: 703334 - protein, 17 aa, Mycobacterium
NHRLSGWLFSRAATVNA

SEQ ID NO: 703335 - protein, 20 aa, Mycobacterium
NHRPEVIGGVLADECAALLE

SEQ ID NO: 703336 - protein, 22 aa, Mycobacterium
NHRPEVRGGVLAEECAAPLEAF

SEQ ID NO: 703337 - protein, 19 aa, Mycobacterium
NHRVGRFVVDVAFPAVKVA

SEQ ID NO: 703338 - protein, 20 aa, Mycobacterium
NHSDAGLFGSVAQLVKVRSG

SEQ ID NO: 703339 - protein, 20 aa, Mycobacterium
NHSFRHGRPLGELSAAETVR

SEQ ID NO: 703340 - protein, 23 aa, Mycobacterium
NHSPGAVAFIRRARRMLPGDPEF

SEQ ID NO: 703341 - protein, 25 aa, Mycobacterium
NHSQWYIDRFRSMARDGADLAGEAR

SEQ ID NO: 703342 - protein, 19 aa, Mycobacterium
NHTELWSWVTRYRTELTVR

SEQ ID NO: 703343 - protein, 26 aa, Mycobacterium
NHTRIRRLFAKALRRGRIEELRPRIV

SEQ ID NO: 703344 - protein, 21 aa, Mycobacterium
NHTRRIVGFDTFAGFPSLADQ

SEQ ID NO: 703345 - protein, 31 aa, Mycobacterium
NHTSFPYVFCDATFCKVRIGAHVVSQALVVA

SEQ ID NO: 703346 - protein, 24 aa, Mycobacterium
NHTYARLRWESGYHPLAGEPGGDR

SEQ ID NO: 703347 - protein, 27 aa, Mycobacterium
NHVADRFGLRPMIQFGARVDHIAFDED

SEQ ID NO: 703348 - protein, 25 aa, Mycobacterium
NHVLPAWDVCCGLYAALAVVTAVSR

SEQ ID NO: 703349 - protein, 24 aa, Mycobacterium
NHVLPAWDVCCGVYAALAVVAAVC

SEQ ID NO: 703350 - protein, 18 aa, Mycobacterium
NHVPFPGMVADFITTARA

SEQ ID NO: 703351 - protein, 24 aa, Mycobacterium
NHVPSRAGLLVAVQERFTAGLDVS

SEQ ID NO: 703352 - protein, 19 aa, Mycobacterium
NHVRLVFEIAKDVRIDGPI

SEQ ID NO: 703353 - protein, 27 aa, Mycobacterium
NHVRVYVPFGYEWYGYFVRRLAERPAN

SEQ ID NO: 703354 - protein, 26 aa, Mycobacterium
NHYDCRSTRRLRDWLMNRAIECGVPP

SEQ ID NO: 703355 - protein, 24 aa, Mycobacterium
NHYLRLTGLENLQFFASLYEKQTE

SEQ ID NO: 703356 - protein, 20 aa, Mycobacterium
NHYPIGWAMAFNTPYKLFKR

SEQ ID NO: 703357 - protein, 20 aa, Mycobacterium
NIAAALALQGLRVLVIDLDP

SEQ ID NO: 703358 - protein, 22 aa, Mycobacterium
NIADILLRVALGIIVFPTDRLD

SEQ ID NO: 703359 - protein, 18 aa, Mycobacterium
NIADTFIAMGWEVADGPE

SEQ ID NO: 703360 - protein, 20 aa, Mycobacterium
NIAFPKPPVFQRGYSEDEVD

SEQ ID NO: 703361 - protein, 31 aa, Mycobacterium
NIAGLPFPLSSAMLPRFLYTKEIGKRLNNFS

SEQ ID NO: 703362 - protein, 26 aa, Mycobacterium
NIAKACARAGARFIHVSTDYVFGGDH

SEQ ID NO: 703363 - protein, 17 aa, Mycobacterium
NIALGMFNSPSSGYVLT

SEQ ID NO: 703364 - protein, 19 aa, Mycobacterium
NIALPSIYYAHRRKVFRRD

SEQ ID NO: 703365 - protein, 19 aa, Mycobacterium
NIAMPDWMGAAATNYSGPQ

SEQ ID NO: 703366 - protein, 23 aa, Mycobacterium
NIAPRPTTPFAQALRLALIDAAP

SEQ ID NO: 703367 - protein, 17 aa, Mycobacterium
NIAQLSIHLFERKGDTD

SEQ ID NO: 703368 - protein, 23 aa, Mycobacterium
NIARVAAKLAAAGWPLTGVDPGA

SEQ ID NO: 703369 - protein, 27 aa, Mycobacterium
NIARVAARLAAAGWPLAGITHPPEAAE

SEQ ID NO: 703370 - protein, 23 aa, Mycobacterium
NIARWPVGRPFAAAPKMAQITLE

SEQ ID NO: 703371 - protein, 17 aa, Mycobacterium
NIARYGLPESGWTLFSA

SEQ ID NO: 703372 - protein, 18 aa, Mycobacterium
NIATLATVFGDGNAVSVK

SEQ ID NO: 703373 - protein, 23 aa, Mycobacterium
NIAVKARSAAMISLKTVIVNAPD

SEQ ID NO: 703374 - protein, 24 aa, Mycobacterium
NIAYPLRVAGWTADKRNARVAELL

SEQ ID NO: 703375 - protein, 26 aa, Mycobacterium
NICRPHAPASMPTRPLLEITAGYVKR

SEQ ID NO: 703376 - protein, 22 aa, Mycobacterium
NICYTGCRFCAFAQRKGDADAF

SEQ ID NO: 703377 - protein, 22 aa, Mycobacterium
NICYTGCRFCAFAQRKGDADAY

SEQ ID NO: 703378 - protein, 18 aa, Mycobacterium
NIDCRPGQMRLCATDRYM

SEQ ID NO: 703379 - protein, 19 aa, Mycobacterium
NIDECRELIEAIAQRLHAP

SEQ ID NO: 703380 - protein, 17 aa, Mycobacterium
NIDLAGAEAMLLMRAGR

SEQ ID NO: 703381 - protein, 18 aa, Mycobacterium
NIDLSFPYLDTAATRTIG

SEQ ID NO: 703382 - protein, 24 aa, Mycobacterium
NIDLSVSLLELFRTGMAGYVDLVD

SEQ ID NO: 703383 - protein, 25 aa, Mycobacterium
NIDPKWREAGIFPILSEGALRATLG

SEQ ID NO: 703384 - protein, 25 aa, Mycobacterium
NIDSRGRFPGRYRVEVLANLSRVCS

SEQ ID NO: 703385 - protein, 36 aa, Mycobacterium
NIEAGHDFTYRFSVPDPGTYWAHPHVGLEEDMGLYL

SEQ ID NO: 703386 - protein, 25 aa, Mycobacterium
NIEIPRLMENLNISRIVQIDPDTGE

SEQ ID NO: 703387 - protein, 19 aa, Mycobacterium
NIEPCWYFDQKLLGYLETV

SEQ ID NO: 703388 - protein, 18 aa, Mycobacterium
NIETSELRRGQTVRLNEA

SEQ ID NO: 703389 - protein, 27 aa, Mycobacterium
NIFCGSCYFCARGLYSNCHNVNPNATA

SEQ ID NO: 703390 - protein, 21 aa, Mycobacterium
NIFGDPTFNDTIFKRTTGLAY

SEQ ID NO: 703391 - protein, 25 aa, Mycobacterium
NIGEALAVELARRGHHLIITARREE

SEQ ID NO: 703392 - protein, 25 aa, Mycobacterium
NIGEFPRILATAAELREPHRVSRYL

SEQ ID NO: 703393 - protein, 20 aa, Mycobacterium
NIGIGVDFHGRVHKPMAKVL

SEQ ID NO: 703394 - protein, 21 aa, Mycobacterium
NIGKLPMAWVDPAAADHRVVL

SEQ ID NO: 703395 - protein, 17 aa, Mycobacterium
NIGLGLLGSNLVGVGGA

SEQ ID NO: 703396 - protein, 22 aa, Mycobacterium
NIGLLAKFMPNFLFVPDAALPL

SEQ ID NO: 703397 - protein, 20 aa, Mycobacterium
NIGNPAPFGFEAPDVIMRDI

SEQ ID NO: 703398 - protein, 24 aa, Mycobacterium
NIGPETFPTITIVGPTIDIGVGGT

SEQ ID NO: 703399 - protein, 21 aa, Mycobacterium
NIGRLPMAWIDPGTADLRSVL

SEQ ID NO: 703400 - protein, 22 aa, Mycobacterium
NIGRLPMAWVDPAAADSRTVVA

SEQ ID NO: 703401 - protein, 25 aa, Mycobacterium
NIGTGPWAPRLAWLTPPIDDPAFLD

SEQ ID NO: 703402 - protein, 19 aa, Mycobacterium
NIGVREFVDDGAIDPDHAS

SEQ ID NO: 703403 - protein, 19 aa, Mycobacterium
NIHVLKQMVTRVIFGPPKY

SEQ ID NO: 703404 - protein, 20 aa, Mycobacterium
NIIVPAMPIWMGVRSSVMQR

SEQ ID NO: 703405 - protein, 27 aa, Mycobacterium
NIKADAMFPARAFDALVALVVGAAAKN

SEQ ID NO: 703406 - protein, 24 aa, Mycobacterium
NIKIPAALDPLGILPDSVRILPDG

SEQ ID NO: 703407 - protein, 18 aa, Mycobacterium
NIKRVAKVRSCSVSDITV

SEQ ID NO: 703408 - protein, 23 aa, Mycobacterium
NILKNALRCAGMVASEKIRFELA

SEQ ID NO: 703409 - protein, 27 aa, Mycobacterium
NILLSSRFPMWMAWGPDLTFFCNDAYR

SEQ ID NO: 703410 - protein, 18 aa, Mycobacterium
NILPDDFTILDAIFAVYA

SEQ ID NO: 703411 - protein, 24 aa, Mycobacterium
NILPPRGVGVIELRGESVTPGYIT

SEQ ID NO: 703412 - protein, 21 aa, Mycobacterium
NILSHEGAALGGSTTAGGAGT

SEQ ID NO: 703413 - protein, 29 aa, Mycobacterium
NILTRSRFSVPVSGEALGFKSDANTTPVL

SEQ ID NO: 703414 - protein, 20 aa, Mycobacterium
NINDCGRYGLADNAGTVLVG

SEQ ID NO: 703415 - protein, 24 aa, Mycobacterium
NINDCGRYGLADTAGKVLVGEPTD

SEQ ID NO: 703416 - protein, 22 aa, Mycobacterium
NINPGQRYGFRVYGPFDPAAGH

SEQ ID NO: 703417 - protein, 23 aa, Mycobacterium
NIPDADGGLDFSIVGSSPEALVT

SEQ ID NO: 703418 - protein, 19 aa, Mycobacterium
NIPDAWRTVGPFKDDLSGL

SEQ ID NO: 703419 - protein, 17 aa, Mycobacterium
NIPEAPPALLVGIHSGA

SEQ ID NO: 703420 - protein, 25 aa, Mycobacterium
NIPEGEVIMGYGYDETVMPGGRTLH

SEQ ID NO: 703421 - protein, 26 aa, Mycobacterium
NIPFVFSAWTIRLLSHLPQRAVVGLA

SEQ ID NO: 703422 - protein, 17 aa, Mycobacterium
NIPGAPADLDWEATLAY

SEQ ID NO: 703423 - protein, 18 aa, Mycobacterium
NIPKLAMFSFTQVDETYP

SEQ ID NO: 703424 - protein, 23 aa, Mycobacterium
NIPKNPFDAIPYVRKLVGDVLHG

SEQ ID NO: 703425 - protein, 20 aa, Mycobacterium
NIPLTAHFLGGAAIADSPER

SEQ ID NO: 703426 - protein, 18 aa, Mycobacterium
NIPPLVAVAQQLGIGGDD

SEQ ID NO: 703427 - protein, 18 aa, Mycobacterium
NIPPLVAVAQQLGLQGGD

SEQ ID NO: 703428 - protein, 17 aa, Mycobacterium
NIPRLRRALGRVDTIVV

SEQ ID NO: 703429 - protein, 22 aa, Mycobacterium
NIPVDIPIYLDLGSLALNGFTI

SEQ ID NO: 703430 - protein, 19 aa, Mycobacterium
NIQHADLLVVQRGEKVTVE

SEQ ID NO: 703431 - protein, 24 aa, Mycobacterium
NIQHADLLVVRKGEKVTVEVTVIV

SEQ ID NO: 703432 - protein, 18 aa, Mycobacterium
NIRCYRHGRRPGKLLIKP

SEQ ID NO: 703433 - protein, 24 aa, Mycobacterium
NIRFLSGDYWDFWDHTVPISDRSL

SEQ ID NO: 703434 - protein, 22 aa, Mycobacterium
NIRIPGAPAFSIGYSQDAAAAV

SEQ ID NO: 703435 - protein, 17 aa, Mycobacterium
NIRLRNLLLDDVSGGYT

SEQ ID NO: 703436 - protein, 27 aa, Mycobacterium
NISAQRAGYFGTLPQDFMLSGHSAGGG

SEQ ID NO: 703437 - protein, 18 aa, Mycobacterium
NISPLVVWLGSAESRDVT

SEQ ID NO: 703438 - protein, 22 aa, Mycobacterium
NITFEDWRRVIDVNLNGVFHTV

SEQ ID NO: 703439 - protein, 17 aa, Mycobacterium
NITGARYKRDFTPLDPE

SEQ ID NO: 703440 - protein, 27 aa, Mycobacterium
NITGRPAISVPLHWTDRGLPLGVQLVG

SEQ ID NO: 703441 - protein, 26 aa, Mycobacterium
NITGRPAVTLPLHWTADGLPLGVQFV

SEQ ID NO: 703442 - protein, 19 aa, Mycobacterium
NITLAEGGLGWAAMLGDRA

SEQ ID NO: 703443 - protein, 17 aa, Mycobacterium
NIVAQMCERGHADKMVL

SEQ ID NO: 703444 - protein, 23 aa, Mycobacterium
NIVLLRADAPWERLNVADTVKVP

SEQ ID NO: 703445 - protein, 17 aa, Mycobacterium
NIVSPFWAVLGFGRASA

SEQ ID NO: 703446 - protein, 24 aa, Mycobacterium
NIWSNAVIFCGHFPDGAEKFTKTD

SEQ ID NO: 703447 - protein, 24 aa, Mycobacterium
NIYEPPRFFEAFLRGRAHTEPPDL

SEQ ID NO: 703448 - protein, 25 aa, Mycobacterium
NIYEPPRFFEAFLRGRAHTEPPDLT

SEQ ID NO: 703449 - protein, 25 aa, Mycobacterium
NIYEPPRFFEAFLRGRAYTEPPDLT

SEQ ID NO: 703450 - protein, 22 aa, Mycobacterium
NIYLPNGMTVPLINYTVQGLPN

SEQ ID NO: 703451 - protein, 26 aa, Mycobacterium
NKAKAGVTNVEFRKGTIEDIPLPDAA

SEQ ID NO: 703452 - protein, 27 aa, Mycobacterium
NKALADFAHRGWIRLEGKSVLISDSER

SEQ ID NO: 703453 - protein, 23 aa, Mycobacterium
NKALRVGYVAAFSVPANQLPQKV

SEQ ID NO: 703454 - protein, 24 aa, Mycobacterium
NKAPLSFPMKGWNVAMDFPNKPGV

SEQ ID NO: 703455 - protein, 20 aa, Mycobacterium
NKARSVACWAHTAHSVDSTQ

SEQ ID NO: 703456 - protein, 25 aa, Mycobacterium
NKAVACARRIAELDPYLPVEVVTGG

SEQ ID NO: 703457 - protein, 18 aa, Mycobacterium
NKAYFIAAAFPSACGKTN

SEQ ID NO: 703458 - protein, 27 aa, Mycobacterium
NKDYSCLDGDCPSFVAVRPGRTESSET

SEQ ID NO: 703459 - protein, 19 aa, Mycobacterium
NKEALFLRALDRYYERYMD

SEQ ID NO: 703460 - protein, 18 aa, Mycobacterium
NKFDAVLGGGRRDEERSR

SEQ ID NO: 703461 - protein, 25 aa, Mycobacterium
NKFVFANADAFSWRETFESLVPVDG

SEQ ID NO: 703462 - protein, 24 aa, Mycobacterium
NKGPQYAAMFGWPEPYADGADKKD

SEQ ID NO: 703463 - protein, 24 aa, Mycobacterium
NKGPQYTAVFGWPEPYADGADKLD

SEQ ID NO: 703464 - protein, 22 aa, Mycobacterium
NKGRQYAAMFGWPEPLADGADK

SEQ ID NO: 703465 - protein, 17 aa, Mycobacterium
NKGVILVRVSGYGQTGP

SEQ ID NO: 703466 - protein, 23 aa, Mycobacterium
NKGVRGRGGIPYEPYREQVDRLY

SEQ ID NO: 703467 - protein, 20 aa, Mycobacterium
NKHMIFPKPGVDLSNPDNFA

SEQ ID NO: 703468 - protein, 26 aa, Mycobacterium
NKHPWRLKQNYAYDIGMMRRSRVTEG

SEQ ID NO: 703469 - protein, 24 aa, Mycobacterium
NKHVAFGYGVHFCMGAALARMEVG

SEQ ID NO: 703470 - protein, 17 aa, Mycobacterium
NKIAIIVGMAESVAAGE

SEQ ID NO: 703471 - protein, 18 aa, Mycobacterium
NKILELARAYGIEPSEFD

SEQ ID NO: 703472 - protein, 23 aa, Mycobacterium
NKISWADLIIFAGNVALESMGFK

SEQ ID NO: 703473 - protein, 24 aa, Mycobacterium
NKITWGNACRFFSWDPFARTDRER

SEQ ID NO: 703474 - protein, 17 aa, Mycobacterium
NKKWVWAGADVIEPEFT

SEQ ID NO: 703475 - protein, 17 aa, Mycobacterium
NKLKLRIGAASTPWGLG

SEQ ID NO: 703476 - protein, 24 aa, Mycobacterium
NKLKPEFIKDISIGSLIYDDERQD

SEQ ID NO: 703477 - protein, 17 aa, Mycobacterium
NKLKYYERIGACKANAA

SEQ ID NO: 703478 - protein, 21 aa, Mycobacterium
NKLLRYRQGTFIGRVVAAMQA

SEQ ID NO: 703479 - protein, 21 aa, Mycobacterium
NKLMIKWQKFMGMTEEGRLRN

SEQ ID NO: 703480 - protein, 20 aa, Mycobacterium
NKLPVSLRVDPFGSITDDGM

SEQ ID NO: 703481 - protein, 25 aa, Mycobacterium
NKLRWPENLWLGVSVEDRRHLDRID

SEQ ID NO: 703482 - protein, 22 aa, Mycobacterium
NKLSGRHIPGLRQVIGCVFQDF

SEQ ID NO: 703483 - protein, 23 aa, Mycobacterium
NKMLPDMKKFMLSQGETLANGPY

SEQ ID NO: 703484 - protein, 29 aa, Mycobacterium
NKMTYENAMRWYSFDPFTHISREQATVGA

SEQ ID NO: 703485 - protein, 19 aa, Mycobacterium
NKNGLPWASAQLEDLTGGI

SEQ ID NO: 703486 - protein, 19 aa, Mycobacterium
NKPEYWLSQQGRLTHPMVL

SEQ ID NO: 703487 - protein, 22 aa, Mycobacterium
NKPPVCRTEYYINRSFAAVGRL

SEQ ID NO: 703488 - protein, 24 aa, Mycobacterium
NKPVRMRIALDVRAGFGAEPMGDL

SEQ ID NO: 703489 - protein, 25 aa, Mycobacterium
NKQGWKTEIWILVSPTMINKGVRGR

SEQ ID NO: 703490 - protein, 21 aa, Mycobacterium
NKQRPVSMFLRALARDLNAST

SEQ ID NO: 703491 - protein, 24 aa, Mycobacterium
NKRIWGTGVEPVFANSGMPGTATP

SEQ ID NO: 703492 - protein, 23 aa, Mycobacterium
NKRLAWTACRTFLAINGQWISAP

SEQ ID NO: 703493 - protein, 23 aa, Mycobacterium
NKRLRVRFMTDRLVFESQMDKEI

SEQ ID NO: 703494 - protein, 25 aa, Mycobacterium
NKRLSWEQVTDWDFVCDQLAAATPW

SEQ ID NO: 703495 - protein, 17 aa, Mycobacterium
NKRMVSQCMGSVGPAGM

SEQ ID NO: 703496 - protein, 20 aa, Mycobacterium
NKRTGVNFFTSMFGRTLLDT

SEQ ID NO: 703497 - protein, 19 aa, Mycobacterium
NKRVEAEAKKIAARLDVAA

SEQ ID NO: 703498 - protein, 17 aa, Mycobacterium
NKRVEAEAKRIAARLDV

SEQ ID NO: 703499 - protein, 42 aa, Mycobacterium
NKRWRSARIGAEIGVAGPCGRILVKGEPGWEIVPEVAPLPGE

SEQ ID NO: 703500 - protein, 29 aa, Mycobacterium
NKRWRSARIGAEIGVAGPCGRVLTRGEPG

SEQ ID NO: 703501 - protein, 17 aa, Mycobacterium
NKSEWLPPIARGEMICA

SEQ ID NO: 703502 - protein, 18 aa, Mycobacterium
NKSRLLAVAMGDVTSPGL

SEQ ID NO: 703503 - protein, 26 aa, Mycobacterium
NKSVRAWRLPMGFTAWPPWRPGVLFT

SEQ ID NO: 703504 - protein, 19 aa, Mycobacterium
NKTCKKCGNTWRTYEEKET

SEQ ID NO: 703505 - protein, 28 aa, Mycobacterium
NKTPAQLILRWHIELGHVVIPKTCSPQR

SEQ ID NO: 703506 - protein, 25 aa, Mycobacterium
NKVARFPKFDWPRIDAPSVRSGANI

SEQ ID NO: 703507 - protein, 31 aa, Mycobacterium
NKVARFPKFDWPRIDAPYLRPGADIEALEAS

SEQ ID NO: 703508 - protein, 18 aa, Mycobacterium
NKVLGAWPITASFPGGNE

SEQ ID NO: 703509 - protein, 20 aa, Mycobacterium
NKVLKGVSFKVARGSATTIL

SEQ ID NO: 703510 - protein, 25 aa, Mycobacterium
NKVPGARCALAWSLETAVLAREHNN

SEQ ID NO: 703511 - protein, 25 aa, Mycobacterium
NKVPGARCALAWSVETATLAREHNN

SEQ ID NO: 703512 - protein, 24 aa, Mycobacterium
NKVRFPAPVPVGSRVRAQSSLVGV

SEQ ID NO: 703513 - protein, 25 aa, Mycobacterium
NKVRFPAPVPVGSRVRAQSSLVGVE

SEQ ID NO: 703514 - protein, 25 aa, Mycobacterium
NKVRFPAPVPVGSRVRAQSSLVSVD

SEQ ID NO: 703515 - protein, 24 aa, Mycobacterium
NKVSELPAGHGLNAATLTYGDLAA

SEQ ID NO: 703516 - protein, 24 aa, Mycobacterium
NKVSELPAGQGFNAATLEYGDLIG

SEQ ID NO: 703517 - protein, 23 aa, Mycobacterium
NKYRLIFEKLRLKAGDRLLDVGC

SEQ ID NO: 703518 - protein, 24 aa, Mycobacterium
NKYRLIFEKLRLQPGDRLLDVGCG

SEQ ID NO: 703519 - protein, 24 aa, Mycobacterium
NKYRLVFEKLRLKPGDRLLDVGCG

SEQ ID NO: 703520 - protein, 18 aa, Mycobacterium
NKYSLSRRVARFLTEHAW

SEQ ID NO: 703521 - protein, 24 aa, Mycobacterium
NLAAEVSGCLRVGKARNNSADTGL

SEQ ID NO: 703522 - protein, 19 aa, Mycobacterium
NLAAGPFAAMLDRARDAIV

SEQ ID NO: 703523 - protein, 25 aa, Mycobacterium
NLAAHAEHFWTWAIDMLGHGYTDKP

SEQ ID NO: 703524 - protein, 25 aa, Mycobacterium
NLAAHGEHFWTWSIDMLGHGYTDKP

SEQ ID NO: 703525 - protein, 17 aa, Mycobacterium
NLAAVRWFERNRTACGP

SEQ ID NO: 703526 - protein, 24 aa, Mycobacterium
NLADWLNDHGWRATAQNSIDEMHR

SEQ ID NO: 703527 - protein, 24 aa, Mycobacterium
NLAEFPRVQWLAAARRALTAAPYD

SEQ ID NO: 703528 - protein, 21 aa, Mycobacterium
NLAFPRARRRTLIALVGALAD

SEQ ID NO: 703529 - protein, 19 aa, Mycobacterium
NLAGLSFPFLREKIHGRSN

SEQ ID NO: 703530 - protein, 23 aa, Mycobacterium
NLAHWPGFLVLYYAALRPLHDDG

SEQ ID NO: 703531 - protein, 21 aa, Mycobacterium
NLAHWPGMLVLYYTALQPLHD

SEQ ID NO: 703532 - protein, 19 aa, Mycobacterium
NLAKACAAVDAGLIHISTD

SEQ ID NO: 703533 - protein, 18 aa, Mycobacterium
NLALGWPETEGLSIVGVA

SEQ ID NO: 703534 - protein, 17 aa, Mycobacterium
NLALLNVRTELHRVAGR

SEQ ID NO: 703535 - protein, 23 aa, Mycobacterium
NLAPELFAGVLAQVPFVDPVTTI

SEQ ID NO: 703536 - protein, 20 aa, Mycobacterium
NLAPSMTIGTGFVGRSSIGE

SEQ ID NO: 703537 - protein, 23 aa, Mycobacterium
NLAPSMTIGTGFVGRSSIGENLQ

SEQ ID NO: 703538 - protein, 26 aa, Mycobacterium
NLAQRPRFVAALLDYFNARFDPMTAD

SEQ ID NO: 703539 - protein, 22 aa, Mycobacterium
NLARGKSGVVLYVVPHVAVGEM

SEQ ID NO: 703540 - protein, 28 aa, Mycobacterium
NLARGRFSFVAGMGYRPEEYHAAGKDWS

SEQ ID NO: 703541 - protein, 25 aa, Mycobacterium
NLARREIAEALTVLTARLRNPRIAG

SEQ ID NO: 703542 - protein, 26 aa, Mycobacterium
NLARRELSEALKILACRMPDARVSGP

SEQ ID NO: 703543 - protein, 19 aa, Mycobacterium
NLASRVIGYHALRVAVPRE

SEQ ID NO: 703544 - protein, 17 aa, Mycobacterium
NLATPWIAAERGYIDGV

SEQ ID NO: 703545 - protein, 23 aa, Mycobacterium
NLATRRLAAWAERAKVVLVEGTL

SEQ ID NO: 703546 - protein, 19 aa, Mycobacterium
NLAVSCPDATLAESRKLLH

SEQ ID NO: 703547 - protein, 25 aa, Mycobacterium
NLAWKLAAVIHGWAGEALLQSYSTE

SEQ ID NO: 703548 - protein, 26 aa, Mycobacterium
NLCAEVLLRCYMRTFSEVAGRLIQSA

SEQ ID NO: 703549 - protein, 19 aa, Mycobacterium
NLCVRQMARRCPDAADPRP

SEQ ID NO: 703550 - protein, 20 aa, Mycobacterium
NLDAGATVYGMRARNDIIEM

SEQ ID NO: 703551 - protein, 22 aa, Mycobacterium
NLDELRMLVAGFLMAGTDTTRH

SEQ ID NO: 703552 - protein, 22 aa, Mycobacterium
NLDELRMLVAGFLMAGTDTTRN

SEQ ID NO: 703553 - protein, 22 aa, Mycobacterium
NLDEVRLITGIEVVDEATQRDA

SEQ ID NO: 703554 - protein, 21 aa, Mycobacterium
NLDEVRLLVDIDVVDEDSQKE

SEQ ID NO: 703555 - protein, 20 aa, Mycobacterium
NLDEVRLLVDIDVVDGESQR

SEQ ID NO: 703556 - protein, 21 aa, Mycobacterium
NLDEVRLLVDIDVVDPASQRA

SEQ ID NO: 703557 - protein, 20 aa, Mycobacterium
NLDGALVCTRAVYRKMAKRG

SEQ ID NO: 703558 - protein, 24 aa, Mycobacterium
NLDGIFGLLSNVVWTNFGPCAVEG

SEQ ID NO: 703559 - protein, 35 aa, Mycobacterium
NLDIAAGAGRSVWTLLRRRNGVLPAIEQALHTTGL

SEQ ID NO: 703560 - protein, 18 aa, Mycobacterium
NLDLRRELARRGIQPSPN

SEQ ID NO: 703561 - protein, 17 aa, Mycobacterium
NLDMGLGSILGRRPTAL

SEQ ID NO: 703562 - protein, 22 aa, Mycobacterium
NLDMSRLLVIAFDIVGHCDIRT

SEQ ID NO: 703563 - protein, 24 aa, Mycobacterium
NLDNAKSWVEGMANSLPATSQQDR

SEQ ID NO: 703564 - protein, 17 aa, Mycobacterium
NLDVYKKVLAINLVGTF

SEQ ID NO: 703565 - protein, 17 aa, Mycobacterium
NLEALALAESWDNGKPI

SEQ ID NO: 703566 - protein, 25 aa, Mycobacterium
NLEIVDLRSLVPLDFATIAESISRT

SEQ ID NO: 703567 - protein, 22 aa, Mycobacterium
NLELPGAWMGGWMSIIDGAETM

SEQ ID NO: 703568 - protein, 24 aa, Mycobacterium
NLEPALPAVEGFHLGYIRSQPGKR

SEQ ID NO: 703569 - protein, 18 aa, Mycobacterium
NLERAAAVNSRLGGHIVQ

SEQ ID NO: 703570 - protein, 28 aa, Mycobacterium
NLERAAAVNSRLGGHIVQGHVDGTGSVI

SEQ ID NO: 703571 - protein, 19 aa, Mycobacterium
NLESIALAESWDNGKPIRE

SEQ ID NO: 703572 - protein, 17 aa, Mycobacterium
NLEVWAQGIGSIIDTAV

SEQ ID NO: 703573 - protein, 20 aa, Mycobacterium
NLFELFKIQQVFGGEEFPEL

SEQ ID NO: 703574 - protein, 23 aa, Mycobacterium
NLFGAGIPINFDRAVTNGRVKAG

SEQ ID NO: 703575 - protein, 20 aa, Mycobacterium
NLFLDMVRRRGRIRMEALPE

SEQ ID NO: 703576 - protein, 27 aa, Mycobacterium
NLFLRDLVMALRWVRDNVAAFGGDPGN

SEQ ID NO: 703577 - protein, 23 aa, Mycobacterium
NLFLRDVVLALQWVHDNIGTFGG

SEQ ID NO: 703578 - protein, 20 aa, Mycobacterium
NLFRDPVEAASYVADPEAAL

SEQ ID NO: 703579 - protein, 27 aa, Mycobacterium
NLFRRLRDGRRVVGHKIGLTSEPMQIL

SEQ ID NO: 703580 - protein, 18 aa, Mycobacterium
NLFVPQPSVADWMQLEYY

SEQ ID NO: 703581 - protein, 27 aa, Mycobacterium
NLGAPGFDGAKWVCSTPLRAKHEHHQD

SEQ ID NO: 703582 - protein, 28 aa, Mycobacterium
NLGDVLRRYPMVVCPEMNLGQLSLLLRG

SEQ ID NO: 703583 - protein, 23 aa, Mycobacterium
NLGEIRHAPYYAAKMVPGDLGTK

SEQ ID NO: 703584 - protein, 19 aa, Mycobacterium
NLGEVLARYPKVVVPEMNL

SEQ ID NO: 703585 - protein, 23 aa, Mycobacterium
NLGFKRTLLMTTGLRGSGIIEEL

SEQ ID NO: 703586 - protein, 26 aa, Mycobacterium
NLGGRWADSFGGLVYDATGITEPEGL

SEQ ID NO: 703587 - protein, 20 aa, Mycobacterium
NLGGYKCTLFANPTNGAVIV

SEQ ID NO: 703588 - protein, 23 aa, Mycobacterium
NLGHLEAAAGIAGFAKAVLALQH

SEQ ID NO: 703589 - protein, 23 aa, Mycobacterium
NLGHLEAAAGIAGFIKAVLAVQR

SEQ ID NO: 703590 - protein, 24 aa, Mycobacterium
NLGHLEAAAGIAGFMKSVLAVGHG

SEQ ID NO: 703591 - protein, 22 aa, Mycobacterium
NLGHLEAAAGITSFIKATLAVA

SEQ ID NO: 703592 - protein, 17 aa, Mycobacterium
NLGKLLAKRGSVMATAL

SEQ ID NO: 703593 - protein, 26 aa, Mycobacterium
NLGLRDVIFALQWVRDNIAAFGGDPS

SEQ ID NO: 703594 - protein, 19 aa, Mycobacterium
NLGPNARRLHYLSVPPKAA

SEQ ID NO: 703595 - protein, 36 aa, Mycobacterium
NLGTHFDAAFARLEAGEQFTVVGFSAGSLVVNDFMR

SEQ ID NO: 703596 - protein, 18 aa, Mycobacterium
NLGVRRIGVSPVYDGYPP

SEQ ID NO: 703597 - protein, 25 aa, Mycobacterium
NLGWKLAAAVHGWAPSGLLDTYHGE

SEQ ID NO: 703598 - protein, 26 aa, Mycobacterium
NLGYGDPRYGYSTAPANVPTPFGLFP

SEQ ID NO: 703599 - protein, 23 aa, Mycobacterium
NLHAEGYDGAPLHGADADGVAPP

SEQ ID NO: 703600 - protein, 20 aa, Mycobacterium
NLHAYLRGFALEVMANSDNV

SEQ ID NO: 703601 - protein, 21 aa, Mycobacterium
NLHEGPVRHEGRFYNMNLVPT

SEQ ID NO: 703602 - protein, 20 aa, Mycobacterium
NLHEGPVRHEGRFYQMNLIP

SEQ ID NO: 703603 - protein, 17 aa, Mycobacterium
NLHGTDVVAEWADRIRG

SEQ ID NO: 703604 - protein, 26 aa, Mycobacterium
NLHGWQWRLEDGRCLTTRGHQLRSSR

SEQ ID NO: 703605 - protein, 21 aa, Mycobacterium
NLHPGELLVAIEIPVGPQLHR

SEQ ID NO: 703606 - protein, 25 aa, Mycobacterium
NLHSSRRLLALCLRGRNLGEGRRRH

SEQ ID NO: 703607 - protein, 24 aa, Mycobacterium
NLIDARFPIQYVIRPQGGAAAPGA

SEQ ID NO: 703608 - protein, 20 aa, Mycobacterium
NLIDPSAWEFVWVVDPPLFE

SEQ ID NO: 703609 - protein, 20 aa, Mycobacterium
NLIHGLFVVCDFTRTDRVAD

SEQ ID NO: 703610 - protein, 17 aa, Mycobacterium
NLIPVTLELGGKSPNLF

SEQ ID NO: 703611 - protein, 25 aa, Mycobacterium
NLISPLWFAIRAYRQMQTQDGVGCI

SEQ ID NO: 703612 - protein, 25 aa, Mycobacterium
NLISPLWFAIRAYRQMRTQDGVGCI

SEQ ID NO: 703613 - protein, 26 aa, Mycobacterium
NLITAPQYAGWDIFYSLFTGNPTTIL

SEQ ID NO: 703614 - protein, 17 aa, Mycobacterium
NLKDIDVSFPLGVLTSV

SEQ ID NO: 703615 - protein, 26 aa, Mycobacterium
NLKGPFRLSALIGERMVADGGGRIIN

SEQ ID NO: 703616 - protein, 26 aa, Mycobacterium
NLKGPFRLSALIGERMVADGGGSIVN

SEQ ID NO: 703617 - protein, 25 aa, Mycobacterium
NLKGPFRLSALVGERMAAAGRGSII

SEQ ID NO: 703618 - protein, 25 aa, Mycobacterium
NLKGPFRLSALVGERMVAAGGGSII

SEQ ID NO: 703619 - protein, 22 aa, Mycobacterium
NLKGPFRLSASIATKMAAGAGG

SEQ ID NO: 703620 - protein, 17 aa, Mycobacterium
NLKGRRETASQWSALPG

SEQ ID NO: 703621 - protein, 23 aa, Mycobacterium
NLKQHCVPSRFSLAADSPEALIE

SEQ ID NO: 703622 - protein, 24 aa, Mycobacterium
NLKRYAHAQLRGGAEVIEICDTNE

SEQ ID NO: 703623 - protein, 23 aa, Mycobacterium
NLKSRHPRSLRVCTLLRKPDALG

SEQ ID NO: 703624 - protein, 24 aa, Mycobacterium
NLLDDITAWGWAQAPPRRLVFAAD

SEQ ID NO: 703625 - protein, 26 aa, Mycobacterium
NLLDHLCCPVGYAVKSDSLFGAEKPL

SEQ ID NO: 703626 - protein, 21 aa, Mycobacterium
NLLEFRLAQHGHDVVGFAVHV

SEQ ID NO: 703627 - protein, 25 aa, Mycobacterium
NLLEQIGMALLPFAPELTPFFLEAG

SEQ ID NO: 703628 - protein, 22 aa, Mycobacterium
NLLGEEGMGFIYLMQNLPQERI

SEQ ID NO: 703629 - protein, 17 aa, Mycobacterium
NLLGGLAQHSYVLPGSG

SEQ ID NO: 703630 - protein, 20 aa, Mycobacterium
NLLGGLPIAGMPNRGGASGL

SEQ ID NO: 703631 - protein, 24 aa, Mycobacterium
NLLGWPSINVPAGFTSDGLPIGVQ

SEQ ID NO: 703632 - protein, 21 aa, Mycobacterium
NLLGWSFGGVVAHEIAIELQR

SEQ ID NO: 703633 - protein, 23 aa, Mycobacterium
NLLHRDEMPYFSPTGMPYDHVAP

SEQ ID NO: 703634 - protein, 19 aa, Mycobacterium
NLLLCSAVDHGTLSRGLPA

SEQ ID NO: 703635 - protein, 18 aa, Mycobacterium
NLLLDLQALFGLSYLFVS

SEQ ID NO: 703636 - protein, 19 aa, Mycobacterium
NLLLIHGYPFNSWDWSLIW

SEQ ID NO: 703637 - protein, 33 aa, Mycobacterium
NLLLLQGLLPRMAAAGFGRVVAVSSVYAHRART

SEQ ID NO: 703638 - protein, 20 aa, Mycobacterium
NLLLRKALDAVAPRGRSRPF

SEQ ID NO: 703639 - protein, 21 aa, Mycobacterium
NLLQGRYGWLEAGIIDQSEGT

SEQ ID NO: 703640 - protein, 20 aa, Mycobacterium
NLLREIFDIDVPVGVIVSPA

SEQ ID NO: 703641 - protein, 20 aa, Mycobacterium
NLLREVFGVDVPVGVIVSPA

SEQ ID NO: 703642 - protein, 22 aa, Mycobacterium
NLLRRIGAERTVVVVEHDMDFM

SEQ ID NO: 703643 - protein, 20 aa, Mycobacterium
NLLSAEWQAGVSHHVVLSVV

SEQ ID NO: 703644 - protein, 27 aa, Mycobacterium
NLLTQASPYAWVGMSWFDTVEYQMRHM

SEQ ID NO: 703645 - protein, 26 aa, Mycobacterium
NLLVELGFPGTRWVNFRAPRFGAMMT

SEQ ID NO: 703646 - protein, 18 aa, Mycobacterium
NLLWPLRSPEESWRVIDE

SEQ ID NO: 703647 - protein, 19 aa, Mycobacterium
NLMAIMSRVTWGAEPDQVS

SEQ ID NO: 703648 - protein, 30 aa, Mycobacterium
NLMAITPKASWPWVRTLLHSVFDQPDKESV

SEQ ID NO: 703649 - protein, 17 aa, Mycobacterium
NLMEIRTTLTLPPFGVK

SEQ ID NO: 703650 - protein, 28 aa, Mycobacterium
NLMFPMRAVKHWNRWCEGAGIGDVARLV

SEQ ID NO: 703651 - protein, 26 aa, Mycobacterium
NLMHVPVNWLKIDRSFIADVLDNERT

SEQ ID NO: 703652 - protein, 19 aa, Mycobacterium
NLMTRVPRKGLPTIAKRLG

SEQ ID NO: 703653 - protein, 25 aa, Mycobacterium
NLNGPFYLCRAALPRLLERGGNIVN

SEQ ID NO: 703654 - protein, 23 aa, Mycobacterium
NLNLNRIVVCLEQALVDVGVLDS

SEQ ID NO: 703655 - protein, 19 aa, Mycobacterium
NLNPVWKVGFQIREALRAN

SEQ ID NO: 703656 - protein, 23 aa, Mycobacterium
NLPAKRLRILALLDPPVESLMLT

SEQ ID NO: 703657 - protein, 24 aa, Mycobacterium
NLPAPDIFDGNAWTREGVATVPTS

SEQ ID NO: 703658 - protein, 21 aa, Mycobacterium
NLPDMFTRLMLSLVATGVAPG

SEQ ID NO: 703659 - protein, 23 aa, Mycobacterium
NLPESFSALPLGDLRDEPNGRKS

SEQ ID NO: 703660 - protein, 20 aa, Mycobacterium
NLPFPMLADIKRELVAATGV

SEQ ID NO: 703661 - protein, 21 aa, Mycobacterium
NLPGDRPRPPIADHRGEQVAM

SEQ ID NO: 703662 - protein, 26 aa, Mycobacterium
NLPGLRWPDLSLQGGRLAWSAVRDGL

SEQ ID NO: 703663 - protein, 28 aa, Mycobacterium
NLPLLEPLRAIPFIGRPLADLIQPDLRV

SEQ ID NO: 703664 - protein, 27 aa, Mycobacterium
NLPLLRPGDRVHVSWSPDASRVLPAAD

SEQ ID NO: 703665 - protein, 22 aa, Mycobacterium
NLPMDGILVPAGPYTATIPDLG

SEQ ID NO: 703666 - protein, 25 aa, Mycobacterium
NLPMPQAAIDWAIRDTMPKWAMELI

SEQ ID NO: 703667 - protein, 22 aa, Mycobacterium
NLPNEQYFVDGWFRTGDAARRD

SEQ ID NO: 703668 - protein, 20 aa, Mycobacterium
NLPPAWIGVGTLDLFHQECL

SEQ ID NO: 703669 - protein, 24 aa, Mycobacterium
NLPPGAWPHTGWYAEWVSGQDIFD

SEQ ID NO: 703670 - protein, 20 aa, Mycobacterium
NLPPGCPFTPRCPLAVDECS

SEQ ID NO: 703671 - protein, 20 aa, Mycobacterium
NLPPPLVGFVGREAELAELK

SEQ ID NO: 703672 - protein, 28 aa, Mycobacterium
NLPPWHSCRGFGKEAPVFVMERVMDLIA

SEQ ID NO: 703673 - protein, 31 aa, Mycobacterium
NLPRVNARGGPGGAPGCWQPLTHDLWPAPEL

SEQ ID NO: 703674 - protein, 21 aa, Mycobacterium
NLPRVNARGGPGGAPGCWQRV

SEQ ID NO: 703675 - protein, 22 aa, Mycobacterium
NLPSIIDGVAFIKDVGNPHGGL

SEQ ID NO: 703676 - protein, 19 aa, Mycobacterium
NLPSPYGRHRWPVYSDPDD

SEQ ID NO: 703677 - protein, 24 aa, Mycobacterium
NLPSRLADGILHGCGTSDMKSGDA

SEQ ID NO: 703678 - protein, 17 aa, Mycobacterium
NLPTPSGNTFEWDQDST

SEQ ID NO: 703679 - protein, 18 aa, Mycobacterium
NLPTRPAVPVLSGVLLTG

SEQ ID NO: 703680 - protein, 17 aa, Mycobacterium
NLPWLPDHTVLGSVVLP

SEQ ID NO: 703681 - protein, 26 aa, Mycobacterium
NLPYLGGRYARFIDHLETFVAGFRTY

SEQ ID NO: 703682 - protein, 26 aa, Mycobacterium
NLQAAVLRARLDWLGENNLARSILAR

SEQ ID NO: 703683 - protein, 26 aa, Mycobacterium
NLQEIKTLFAQCIRGDVSVLIGSTEK

SEQ ID NO: 703684 - protein, 18 aa, Mycobacterium
NLQLATGIVNIWTAAAEP

SEQ ID NO: 703685 - protein, 25 aa, Mycobacterium
NLRAHIRAATLLVPGWVERGRGYFL

SEQ ID NO: 703686 - protein, 19 aa, Mycobacterium
NLRCPTCFADSSPDLRHVV

SEQ ID NO: 703687 - protein, 21 aa, Mycobacterium
NLRDACRRKNIRIVAEAPIPQ

SEQ ID NO: 703688 - protein, 17 aa, Mycobacterium
NLRDILITLGYDIDKPW

SEQ ID NO: 703689 - protein, 23 aa, Mycobacterium
NLRDILITLGYDIDKPWRKLTKR

SEQ ID NO: 703690 - protein, 24 aa, Mycobacterium
NLRDLPFTLTYLFDDDGSAHLAGM

SEQ ID NO: 703691 - protein, 18 aa, Mycobacterium
NLRDSSVRGALRPLEIIQ

SEQ ID NO: 703692 - protein, 17 aa, Mycobacterium
NLRGRHLAVHRAGGTEK

SEQ ID NO: 703693 - protein, 20 aa, Mycobacterium
NLRIVFVEHAFTWILPLMWR

SEQ ID NO: 703694 - protein, 23 aa, Mycobacterium
NLRLETLAAHWGVEQLKAHDAYD

SEQ ID NO: 703695 - protein, 22 aa, Mycobacterium
NLRLETLAAHWGVIQERPHDAF

SEQ ID NO: 703696 - protein, 20 aa, Mycobacterium
NLRLLPAFDGLWYGLAPVSL

SEQ ID NO: 703697 - protein, 28 aa, Mycobacterium
NLRLRDGRWYWHWDPAFLGKPHDDPFVR

SEQ ID NO: 703698 - protein, 26 aa, Mycobacterium
NLRLRDGRWYWHWDPAMMTAPGDDPE

SEQ ID NO: 703699 - protein, 26 aa, Mycobacterium
NLRLRDGRWYWHWDPAMMTAPLDDPD

SEQ ID NO: 703700 - protein, 25 aa, Mycobacterium
NLRPARAAVVAPSFTEPADALTAAG

SEQ ID NO: 703701 - protein, 26 aa, Mycobacterium
NLRPTRAGAVPTIWNDVMHYLEKNPG

SEQ ID NO: 703702 - protein, 19 aa, Mycobacterium
NLRRLLGLFEQLRDRSQLI

SEQ ID NO: 703703 - protein, 27 aa, Mycobacterium
NLRRSGRIGGAKAWLGTALALKPLLRI

SEQ ID NO: 703704 - protein, 24 aa, Mycobacterium
NLRSACRRKGIRIVAEAAIAQTAQ

SEQ ID NO: 703705 - protein, 22 aa, Mycobacterium
NLRVARVLYDFITNEALPGTGV

SEQ ID NO: 703706 - protein, 23 aa, Mycobacterium
NLRVARVLYDFVNEEALPGTDID

SEQ ID NO: 703707 - protein, 21 aa, Mycobacterium
NLRVLLKNRIVPVGIPTNNVF

SEQ ID NO: 703708 - protein, 18 aa, Mycobacterium
NLSDAGVSWKVYNSKLLG

SEQ ID NO: 703709 - protein, 24 aa, Mycobacterium
NLSDLPGRVIAAFGNGAPATTVTA

SEQ ID NO: 703710 - protein, 18 aa, Mycobacterium
NLSDLRGAVDTVLASGKR

SEQ ID NO: 703711 - protein, 22 aa, Mycobacterium
NLSDMFTRMVLSIAATGVAPRS

SEQ ID NO: 703712 - protein, 21 aa, Mycobacterium
NLSGGRFLLGLGASGPQVIEG

SEQ ID NO: 703713 - protein, 19 aa, Mycobacterium
NLSGLKAAVAIAGPEAATD

SEQ ID NO: 703714 - protein, 21 aa, Mycobacterium
NLSGLQGWIRLFVNIGSPAQL

SEQ ID NO: 703715 - protein, 17 aa, Mycobacterium
NLSGTWRTLRAAVPAMI

SEQ ID NO: 703716 - protein, 21 aa, Mycobacterium
NLSIRDGWWDEWFDGENGWEI

SEQ ID NO: 703717 - protein, 20 aa, Mycobacterium
NLSIRDGWWDEWYDGENGWE

SEQ ID NO: 703718 - protein, 24 aa, Mycobacterium
NLSMPPPLVHRVLAGSARRHREDV

SEQ ID NO: 703719 - protein, 23 aa, Mycobacterium
NLSNGRFLLGLGASGPQVIEGLH

SEQ ID NO: 703720 - protein, 18 aa, Mycobacterium
NLSTRLRMAALAMGTDEP

SEQ ID NO: 703721 - protein, 22 aa, Mycobacterium
NLTAKRPAVFIFNHRNQVDPVI

SEQ ID NO: 703722 - protein, 26 aa, Mycobacterium
NLTALPTCPPLVIWDLTTPQPPQSDL

SEQ ID NO: 703723 - protein, 20 aa, Mycobacterium
NLTAWLYRILHNTWINLYRK

SEQ ID NO: 703724 - protein, 26 aa, Mycobacterium
NLTGRPAISVPLHWTDEGLPLGVQFV

SEQ ID NO: 703725 - protein, 26 aa, Mycobacterium
NLTGRPAISVPLHWTPAGLPLGVQFV

SEQ ID NO: 703726 - protein, 26 aa, Mycobacterium
NLTGRPAISVPLHWTQNGLPLGVQFV

SEQ ID NO: 703727 - protein, 17 aa, Mycobacterium
NLTGTWRTLRATVPPMI

SEQ ID NO: 703728 - protein, 17 aa, Mycobacterium
NLTKAKEQPLWRVLVAL

SEQ ID NO: 703729 - protein, 28 aa, Mycobacterium
NLTMDICRPCLGLAFRMHVTAATMHGLS

SEQ ID NO: 703730 - protein, 26 aa, Mycobacterium
NLTPAAVRRWSRMRPLATAATFPASA

SEQ ID NO: 703731 - protein, 19 aa, Mycobacterium
NLTPEWLDVRRGLSRESVD

SEQ ID NO: 703732 - protein, 17 aa, Mycobacterium
NLVAATWHRSHGTDGLL

SEQ ID NO: 703733 - protein, 17 aa, Mycobacterium
NLVAGQFVALFGSADRY

SEQ ID NO: 703734 - protein, 19 aa, Mycobacterium
NLVDVCSTLGVANAAAAVP

SEQ ID NO: 703735 - protein, 30 aa, Mycobacterium
NLVMGANVQVVWEKFCRYFDVEPRYLPMAE

SEQ ID NO: 703736 - protein, 30 aa, Mycobacterium
NLVMGSNVQVVWEKFCRYFDVEARYLPMEK

SEQ ID NO: 703737 - protein, 30 aa, Mycobacterium
NLVMGSNVQVVWEKFCRYFDVEPRYLPMAK

SEQ ID NO: 703738 - protein, 17 aa, Mycobacterium
NLVNARYLRICVLTQYK

SEQ ID NO: 703739 - protein, 18 aa, Mycobacterium
NLVNPWWGAATVMKGAAE

SEQ ID NO: 703740 - protein, 18 aa, Mycobacterium
NLVPRLFNLDRDFIQEIR

SEQ ID NO: 703741 - protein, 18 aa, Mycobacterium
NLVPWEWSVMRRIRDGRT

SEQ ID NO: 703742 - protein, 23 aa, Mycobacterium
NLVREHFTLLAAIVRDHDGAVVK

SEQ ID NO: 703743 - protein, 29 aa, Mycobacterium
NLVSPDLVRRLCWDWEAAPDPFEAVEAFL

SEQ ID NO: 703744 - protein, 29 aa, Mycobacterium
NLVSPDLVRRLCWDWEGAPDPFEAVETFL

SEQ ID NO: 703745 - protein, 28 aa, Mycobacterium
NLVSPELVRRLCWEWAGPRQGAADAIDE

SEQ ID NO: 703746 - protein, 20 aa, Mycobacterium
NLVSRGWVCVSLNYRVSPLH

SEQ ID NO: 703747 - protein, 25 aa, Mycobacterium
NLVSRSECLALIGAGVDDWGGVSPL

SEQ ID NO: 703748 - protein, 20 aa, Mycobacterium
NLVTEFAYPLPVAVICRMLG

SEQ ID NO: 703749 - protein, 18 aa, Mycobacterium
NLWKAQRVLQSAGAGVLD

SEQ ID NO: 703750 - protein, 26 aa, Mycobacterium
NLYAGRAIVYLRRFDPHEWVRLVRDE

SEQ ID NO: 703751 - protein, 24 aa, Mycobacterium
NLYDLDCSHIAPANVYGPRQDPHG

SEQ ID NO: 703752 - protein, 19 aa, Mycobacterium
NLYGISWNPLTTIAVLQRI

SEQ ID NO: 703753 - protein, 19 aa, Mycobacterium
NLYGISWNPVNTMLALQRI

SEQ ID NO: 703754 - protein, 18 aa, Mycobacterium
NLYGLAWNPMTLIGVLQN

SEQ ID NO: 703755 - protein, 21 aa, Mycobacterium
NLYLRDLVLALQWVHDNIGAF

SEQ ID NO: 703756 - protein, 21 aa, Mycobacterium
NLYLRDLVLALQWVRDNIAGF

SEQ ID NO: 703757 - protein, 21 aa, Mycobacterium
NLYLRDLVLALQWVRDNIAQF

SEQ ID NO: 703758 - protein, 20 aa, Mycobacterium
NLYLRDLVMALQWIQDNIAE

SEQ ID NO: 703759 - protein, 26 aa, Mycobacterium
NLYLRDLVMALRWVRDNIASFGGNPD

SEQ ID NO: 703760 - protein, 18 aa, Mycobacterium
NLYVSEWLLGGRYTKLTV

SEQ ID NO: 703761 - protein, 20 aa, Mycobacterium
NMAAGPFAAMLDRARDAIVG

SEQ ID NO: 703762 - protein, 25 aa, Mycobacterium
NMAERRLGGLEGKTAALVGAGAMGA

SEQ ID NO: 703763 - protein, 26 aa, Mycobacterium
NMAERRLGGLSGRTAVLVGAGAMGAL

SEQ ID NO: 703764 - protein, 18 aa, Mycobacterium
NMARAVVGALPFVTRSES

SEQ ID NO: 703765 - protein, 17 aa, Mycobacterium
NMCRMLTADTEFHGTAL

SEQ ID NO: 703766 - protein, 24 aa, Mycobacterium
NMDDARWDSVIAVNLLAPLRLTEG

SEQ ID NO: 703767 - protein, 25 aa, Mycobacterium
NMDEKRWDAVIAVNLLAPQRLTEGL

SEQ ID NO: 703768 - protein, 24 aa, Mycobacterium
NMDESRWDSVIAVNLLAPLRLAEE

SEQ ID NO: 703769 - protein, 24 aa, Mycobacterium
NMDTEVLSGLGLIANPVSAVPVIA

SEQ ID NO: 703770 - protein, 17 aa, Mycobacterium
NMFPFRADRLFGAGQSL

SEQ ID NO: 703771 - protein, 22 aa, Mycobacterium
NMKPSVIRRLGLTYDALKEFNP

SEQ ID NO: 703772 - protein, 18 aa, Mycobacterium
NMLAAELDSAATAYDTVI

SEQ ID NO: 703773 - protein, 20 aa, Mycobacterium
NMLFHSVLPYFAGVETTSAT

SEQ ID NO: 703774 - protein, 24 aa, Mycobacterium
NMLFTNWPRPVLATRQGDELQAAA

SEQ ID NO: 703775 - protein, 24 aa, Mycobacterium
NMLFTNWPRPVLTTAEGDEMQAAA

SEQ ID NO: 703776 - protein, 26 aa, Mycobacterium
NMLKAFSFDIGYRIAHHDDLTTPPPV

SEQ ID NO: 703777 - protein, 19 aa, Mycobacterium
NMLLEFGVISRRYLHATGE

SEQ ID NO: 703778 - protein, 28 aa, Mycobacterium
NMNAVSRWLFRRVLTKFVGAKGFSTPER

SEQ ID NO: 703779 - protein, 18 aa, Mycobacterium
NMRARMNAALGITEQGFS

SEQ ID NO: 703780 - protein, 17 aa, Mycobacterium
NMRARMNTALGITEQGF

SEQ ID NO: 703781 - protein, 18 aa, Mycobacterium
NMRARMYSALGITEQGFS

SEQ ID NO: 703782 - protein, 18 aa, Mycobacterium
NMRARTYAALGITEQGFN

SEQ ID NO: 703783 - protein, 25 aa, Mycobacterium
NMSEPRLAEEIFVLADLARQKARAA

SEQ ID NO: 703784 - protein, 20 aa, Mycobacterium
NMSGDPFSHLALRRAGDPRE

SEQ ID NO: 703785 - protein, 18 aa, Mycobacterium
NMSPEFGSTAAIFPIDDV

SEQ ID NO: 703786 - protein, 17 aa, Mycobacterium
NMSPEFGSTAAIFPIDE

SEQ ID NO: 703787 - protein, 18 aa, Mycobacterium
NMSPEFGSTAAIFPIDEE

SEQ ID NO: 703788 - protein, 18 aa, Mycobacterium
NMSPEFGSTAAIFPVDEE

SEQ ID NO: 703789 - protein, 27 aa, Mycobacterium
NMTPKTVRRWSGMRALASAVTFPADAP

SEQ ID NO: 703790 - protein, 22 aa, Mycobacterium
NMVRARPVAKVPLQQAQGLVLA

SEQ ID NO: 703791 - protein, 19 aa, Mycobacterium
NMYLTRAGGDYVTHNLVNV

SEQ ID NO: 703792 - protein, 17 aa, Mycobacterium
NMYRNMANVPGLLDTYM

SEQ ID NO: 703793 - protein, 26 aa, Mycobacterium
NNADFNKYVSYFCPSERSGLGDASQL

SEQ ID NO: 703794 - protein, 27 aa, Mycobacterium
NNAFRVPSLKPFSGTSFQHIRDAIELS

SEQ ID NO: 703795 - protein, 17 aa, Mycobacterium
NNAFRVPSMKPFANTTF

SEQ ID NO: 703796 - protein, 17 aa, Mycobacterium
NNANYAWIQHILSKLAP

SEQ ID NO: 703797 - protein, 27 aa, Mycobacterium
NNAYIQPRFPGAVPQGLFTPEQFWPIT

SEQ ID NO: 703798 - protein, 18 aa, Mycobacterium
NNDALLFDGLPWVSKAQE

SEQ ID NO: 703799 - protein, 22 aa, Mycobacterium
NNDIPLWLSYRADTSGVAVPKQ

SEQ ID NO: 703800 - protein, 21 aa, Mycobacterium
NNDPRLGRILFVESATEPLLR

SEQ ID NO: 703801 - protein, 19 aa, Mycobacterium
NNELRIVGAYYTLDTGIVT

SEQ ID NO: 703802 - protein, 24 aa, Mycobacterium
NNFDRSGPVFLYRVPPQDFTDRAA

SEQ ID NO: 703803 - protein, 23 aa, Mycobacterium
NNFEAWTALASWGEITSRPDIGL

SEQ ID NO: 703804 - protein, 17 aa, Mycobacterium
NNFNYKDMDPFGYACPL

SEQ ID NO: 703805 - protein, 17 aa, Mycobacterium
NNFRFLVRERHGGSPQI

SEQ ID NO: 703806 - protein, 19 aa, Mycobacterium
NNGFFYRGVGQGSLHFAIT

SEQ ID NO: 703807 - protein, 23 aa, Mycobacterium
NNGGFPEFPLPLGNPKKSTSSDM

SEQ ID NO: 703808 - protein, 23 aa, Mycobacterium
NNGGFPEFPLPLGNPQESSRSDM

SEQ ID NO: 703809 - protein, 18 aa, Mycobacterium
NNGIQRIVMLTGDHPDTA

SEQ ID NO: 703810 - protein, 19 aa, Mycobacterium
NNGVLGWPRRKLSKAVLSL

SEQ ID NO: 703811 - protein, 24 aa, Mycobacterium
NNHEYRTAWGYLGGPMRAMYSTGL

SEQ ID NO: 703812 - protein, 25 aa, Mycobacterium
NNHGQCEWIPPDLLDRGQHRTNTYH

SEQ ID NO: 703813 - protein, 25 aa, Mycobacterium
NNHGQCEWIPPQLLDRGQHRTNTYH

SEQ ID NO: 703814 - protein, 26 aa, Mycobacterium
NNHNGRQRWCVRLFQGGGFGGPLLDG

SEQ ID NO: 703815 - protein, 27 aa, Mycobacterium
NNIAMVECLIAFGMLGVDVMLLNNALA

SEQ ID NO: 703816 - protein, 17 aa, Mycobacterium
NNIGFGLTGDNQMGIGA

SEQ ID NO: 703817 - protein, 18 aa, Mycobacterium
NNIGFGLTGNNQVGINFA

SEQ ID NO: 703818 - protein, 26 aa, Mycobacterium
NNIGQLSMWQLPRDQTGDIGVSNNNG

SEQ ID NO: 703819 - protein, 17 aa, Mycobacterium
NNIGVPFAPYLYTVSTL

SEQ ID NO: 703820 - protein, 19 aa, Mycobacterium
NNITGHWLAARGGLGIAPL

SEQ ID NO: 703821 - protein, 17 aa, Mycobacterium
NNIWRPSPGSVYPTLQL

SEQ ID NO: 703822 - protein, 22 aa, Mycobacterium
NNKGKIALGYDADFAIFEPESA

SEQ ID NO: 703823 - protein, 23 aa, Mycobacterium
NNLARLAQYLPLLSEVEQKILGC

SEQ ID NO: 703824 - protein, 31 aa, Mycobacterium
NNLEISVVQLLRIGAALADPATLPDAIDTAR

SEQ ID NO: 703825 - protein, 28 aa, Mycobacterium
NNLGGRWADKFGALVFDATGITTPVELK

SEQ ID NO: 703826 - protein, 25 aa, Mycobacterium
NNLKEIDVAFPLGVLTSVTGVSGSG

SEQ ID NO: 703827 - protein, 24 aa, Mycobacterium
NNMGTPFLPQWACEPEDVAAAVCW

SEQ ID NO: 703828 - protein, 20 aa, Mycobacterium
NNNIGFGLTGDGQFGIGGLN

SEQ ID NO: 703829 - protein, 19 aa, Mycobacterium
NNNIGFGLTGDGQIGIGGL

SEQ ID NO: 703830 - protein, 27 aa, Mycobacterium
NNNWFAAYAYWYFKLYGHQDVKLLDGG

SEQ ID NO: 703831 - protein, 33 aa, Mycobacterium
NNNWFAAYAYWYFKLYGHRDVKLLDGGRKKWEL

SEQ ID NO: 703832 - protein, 20 aa, Mycobacterium
NNPDVDACFVVRSQSVHRIQ

SEQ ID NO: 703833 - protein, 19 aa, Mycobacterium
NNPECHLMVVLVDERPEEV

SEQ ID NO: 703834 - protein, 17 aa, Mycobacterium
NNPFRVFTSMLATGDSR

SEQ ID NO: 703835 - protein, 19 aa, Mycobacterium
NNPKLKAPLLDYLASDGIV

SEQ ID NO: 703836 - protein, 18 aa, Mycobacterium
NNPMPTLVEWQVLPGAWV

SEQ ID NO: 703837 - protein, 26 aa, Mycobacterium
NNPVLPQRVPMEFCKLSEAETENIIG

SEQ ID NO: 703838 - protein, 17 aa, Mycobacterium
NNPWARQRFTREVDSAA

SEQ ID NO: 703839 - protein, 18 aa, Mycobacterium
NNQMGFGGLNSGSGNLGF

SEQ ID NO: 703840 - protein, 22 aa, Mycobacterium
NNQPGLVVLLTFGTGIGSAVIN

SEQ ID NO: 703841 - protein, 25 aa, Mycobacterium
NNREVRWRPESFWDSGTSVDVKVNT

SEQ ID NO: 703842 - protein, 19 aa, Mycobacterium
NNRLLAIEWQQQRLPESVS

SEQ ID NO: 703843 - protein, 18 aa, Mycobacterium
NNSCTFCIVPSLRGKEAD

SEQ ID NO: 703844 - protein, 25 aa, Mycobacterium
NNSSGLFHTGIRVSGAFNTGFQQSG

SEQ ID NO: 703845 - protein, 17 aa, Mycobacterium
NNTCTFCIVPSLRGKEI

SEQ ID NO: 703846 - protein, 18 aa, Mycobacterium
NNTCTFCIVPSLRGKEVD

SEQ ID NO: 703847 - protein, 23 aa, Mycobacterium
NNTSYGLAGYVWGDEDAAVTVAR

SEQ ID NO: 703848 - protein, 20 aa, Mycobacterium
NNVAGARFARIGEIDLDDLF

SEQ ID NO: 703849 - protein, 21 aa, Mycobacterium
NNVFTPWTYDTWSTVYNQLEA

SEQ ID NO: 703850 - protein, 18 aa, Mycobacterium
NNVGIGLTGDGRVGFGSL

SEQ ID NO: 703851 - protein, 27 aa, Mycobacterium
NNVPFNGILHPLERITAIAPNPLTGGM

SEQ ID NO: 703852 - protein, 25 aa, Mycobacterium
NNVREALEIARQCRTLLGANGITLE

SEQ ID NO: 703853 - protein, 19 aa, Mycobacterium
NNVYIFPAMGLAVTAAQAT

SEQ ID NO: 703854 - protein, 23 aa, Mycobacterium
NNWESVFGGPAWTRVTEPDGNPG

SEQ ID NO: 703855 - protein, 24 aa, Mycobacterium
NNYAAFSRWCSGKGLVLSPTEFVD

SEQ ID NO: 703856 - protein, 25 aa, Mycobacterium
NNYAGRDEIAAWLTAAAGEYTYTSE

SEQ ID NO: 703857 - protein, 22 aa, Mycobacterium
NNYYDDMAWLALALERAARIAG

SEQ ID NO: 703858 - protein, 18 aa, Mycobacterium
NPAAARRHFESIPTTDKK

SEQ ID NO: 703859 - protein, 20 aa, Mycobacterium
NPAAELLTVISHREVIDRGL

SEQ ID NO: 703860 - protein, 24 aa, Mycobacterium
NPAALESFPGWLHDGDIVTLQVEG

SEQ ID NO: 703861 - protein, 19 aa, Mycobacterium
NPADPCGMLHATSQGDLGD

SEQ ID NO: 703862 - protein, 29 aa, Mycobacterium
NPAEACYRAELAALPGVRVLHGYTQSGGG

SEQ ID NO: 703863 - protein, 24 aa, Mycobacterium
NPAFSGEVYVPFGRSPAMPLSERK

SEQ ID NO: 703864 - protein, 18 aa, Mycobacterium
NPAGIPVRVVHAGIDTGR

SEQ ID NO: 703865 - protein, 17 aa, Mycobacterium
NPAHGLTLLSLDRAVLE

SEQ ID NO: 703866 - protein, 24 aa, Mycobacterium
NPAHWHDFFASWPLLYVSHLMSLV

SEQ ID NO: 703867 - protein, 26 aa, Mycobacterium
NPAKLAELQRLWLIEATKYNVVPLDD

SEQ ID NO: 703868 - protein, 20 aa, Mycobacterium
NPALEALGWDPPRFTTTAWQ

SEQ ID NO: 703869 - protein, 17 aa, Mycobacterium
NPALLTPGMWVQFQAAD

SEQ ID NO: 703870 - protein, 21 aa, Mycobacterium
NPALNAVVIRWFDHARETASA

SEQ ID NO: 703871 - protein, 21 aa, Mycobacterium
NPAQAPLCRNVRLTPDGAGKD

SEQ ID NO: 703872 - protein, 19 aa, Mycobacterium
NPAQFGLGDVANWISYGAS

SEQ ID NO: 703873 - protein, 17 aa, Mycobacterium
NPAQWLAARGWVVEPVR

SEQ ID NO: 703874 - protein, 19 aa, Mycobacterium
NPATLAYARSRFTIAAKAA

SEQ ID NO: 703875 - protein, 26 aa, Mycobacterium
NPATVRRFIDRFAKFNLSQSAIRPSY

SEQ ID NO: 703876 - protein, 18 aa, Mycobacterium
NPAWLHRCAETNRHANDA

SEQ ID NO: 703877 - protein, 21 aa, Mycobacterium
NPAYVSWLISQSMLADANEIS

SEQ ID NO: 703878 - protein, 21 aa, Mycobacterium
NPCFPEYRFDHLDADNATGWV

SEQ ID NO: 703879 - protein, 24 aa, Mycobacterium
NPCPPGVVGEIYMRPGAGSAPTYR

SEQ ID NO: 703880 - protein, 23 aa, Mycobacterium
NPCPPGVVGEIYMRPGPDSAPTY

SEQ ID NO: 703881 - protein, 17 aa, Mycobacterium
NPDAAGWQSFRVPCLPS

SEQ ID NO: 703882 - protein, 24 aa, Mycobacterium
NPDCPKPRTGIILAAKEFLTDYQG

SEQ ID NO: 703883 - protein, 23 aa, Mycobacterium
NPDDLRPGAMVFRPTAGPVDLRD

SEQ ID NO: 703884 - protein, 19 aa, Mycobacterium
NPDEIGWTAAFLASPLSSY

SEQ ID NO: 703885 - protein, 21 aa, Mycobacterium
NPDEIKVMYLVIPTLGETTEE

SEQ ID NO: 703886 - protein, 24 aa, Mycobacterium
NPDHTAVAIALLFENFTSVLVGTS

SEQ ID NO: 703887 - protein, 22 aa, Mycobacterium
NPDMIELIAKWRTGASKYGLAA

SEQ ID NO: 703888 - protein, 17 aa, Mycobacterium
NPDPSALAHHVGLAVAY

SEQ ID NO: 703889 - protein, 18 aa, Mycobacterium
NPDRCIFEVSVFELYPKG

SEQ ID NO: 703890 - protein, 21 aa, Mycobacterium
NPDRQVVFFGIGFETTAPANA

SEQ ID NO: 703891 - protein, 21 aa, Mycobacterium
NPDSFPGWLRDGDVVTLEVEG

SEQ ID NO: 703892 - protein, 20 aa, Mycobacterium
NPDVGLVLREVGLEVLGTAR

SEQ ID NO: 703893 - protein, 17 aa, Mycobacterium
NPDWIPVAHDVARRMAD

SEQ ID NO: 703894 - protein, 21 aa, Mycobacterium
NPEALRLQLLDALAGKMRTRS

SEQ ID NO: 703895 - protein, 24 aa, Mycobacterium
NPEAWRWYREHIGGGKTPIVDTWW

SEQ ID NO: 703896 - protein, 26 aa, Mycobacterium
NPEDDRGWCFTGWFDTSGSQALLGYQ

SEQ ID NO: 703897 - protein, 27 aa, Mycobacterium
NPEDILRVGDWVLVHVGFAMAKIDERE

SEQ ID NO: 703898 - protein, 20 aa, Mycobacterium
NPELRQGYLAQMIDEVRHTN

SEQ ID NO: 703899 - protein, 20 aa, Mycobacterium
NPERHVVFFAVGFETTAPST

SEQ ID NO: 703900 - protein, 24 aa, Mycobacterium
NPESRLLTIILMRCGLRVGDATKI

SEQ ID NO: 703901 - protein, 20 aa, Mycobacterium
NPESVLWRYDKCELETYTAL

SEQ ID NO: 703902 - protein, 32 aa, Mycobacterium
NPETHQIVLWCMGEAHAAVVLDALSRRYGVSV

SEQ ID NO: 703903 - protein, 32 aa, Mycobacterium
NPETHQIVLWCMGEAHAGVVLDALANRYGVTV

SEQ ID NO: 703904 - protein, 26 aa, Mycobacterium
NPFAVAIARFRLLVAALHAAGDSSIE

SEQ ID NO: 703905 - protein, 22 aa, Mycobacterium
NPFEDLDLLVLAAVVVSLGALG

SEQ ID NO: 703906 - protein, 19 aa, Mycobacterium
NPFFAWLWKTLSTHETESV

SEQ ID NO: 703907 - protein, 21 aa, Mycobacterium
NPFLYRQGRWKSYYERLRNEA

SEQ ID NO: 703908 - protein, 20 aa, Mycobacterium
NPFMTRVLLDAGIPSTCAVE

SEQ ID NO: 703909 - protein, 17 aa, Mycobacterium
NPFPLNALGCLIRSITL

SEQ ID NO: 703910 - protein, 20 aa, Mycobacterium
NPFSRARIDASVAELRAERD

SEQ ID NO: 703911 - protein, 17 aa, Mycobacterium
NPFTEWLDKMAGLTQQV

SEQ ID NO: 703912 - protein, 25 aa, Mycobacterium
NPGAPCGRAVPGRGAAAADHDRLPR

SEQ ID NO: 703913 - protein, 17 aa, Mycobacterium
NPGAVVRYICARLENPD

SEQ ID NO: 703914 - protein, 30 aa, Mycobacterium
NPGDPICSGGLRWASHLSYVPGLTNKAASF

SEQ ID NO: 703915 - protein, 25 aa, Mycobacterium
NPGERLRVSVELEFENAEQIFTATR

SEQ ID NO: 703916 - protein, 28 aa, Mycobacterium
NPGGGYKPEGAWAFAVVQAVVKTIAEWV

SEQ ID NO: 703917 - protein, 24 aa, Mycobacterium
NPGGSGITGEIGGSGTNGSPATLP

SEQ ID NO: 703918 - protein, 17 aa, Mycobacterium
NPGIWVFHCHNTYHQEA

SEQ ID NO: 703919 - protein, 18 aa, Mycobacterium
NPGMKIAVLPGGFEEGIL

SEQ ID NO: 703920 - protein, 24 aa, Mycobacterium
NPGMMAALISFWMTPDSVYLSPAP

SEQ ID NO: 703921 - protein, 25 aa, Mycobacterium
NPGPWKESLRLLAEEVMPRLNARIA

SEQ ID NO: 703922 - protein, 23 aa, Mycobacterium
NPGQWLTHCHNIYHGEAGMMTVV

SEQ ID NO: 703923 - protein, 25 aa, Mycobacterium
NPGTRLDELTARLAATGTTVVTVAA

SEQ ID NO: 703924 - protein, 18 aa, Mycobacterium
NPGYFRRAMDSLPKSGSR

SEQ ID NO: 703925 - protein, 21 aa, Mycobacterium
NPGYTGLHFMAAYELEECWQL

SEQ ID NO: 703926 - protein, 17 aa, Mycobacterium
NPGYVRTPLVTKQIADQ

SEQ ID NO: 703927 - protein, 18 aa, Mycobacterium
NPHANGGLLLRDLDLPDF

SEQ ID NO: 703928 - protein, 26 aa, Mycobacterium
NPHDVVLFPAWVRFSPLKPSHLDPPH

SEQ ID NO: 703929 - protein, 17 aa, Mycobacterium
NPHLAFGGHGIHYCLGA

SEQ ID NO: 703930 - protein, 19 aa, Mycobacterium
NPHVARLLGTYEIGIPGEP

SEQ ID NO: 703931 - protein, 24 aa, Mycobacterium
NPIAEWLDKLGLFGKRSYEKFVPA

SEQ ID NO: 703932 - protein, 23 aa, Mycobacterium
NPIEGVAAWIDGRLDLAFDDAVK

SEQ ID NO: 703933 - protein, 17 aa, Mycobacterium
NPIELGLGIGKAADAAS

SEQ ID NO: 703934 - protein, 17 aa, Mycobacterium
NPIIFNLPATVEMATPN

SEQ ID NO: 703935 - protein, 18 aa, Mycobacterium
NPIPLLVPCHRVLAADRS

SEQ ID NO: 703936 - protein, 20 aa, Mycobacterium
NPIQRMWAGWLPPFATIEHV

SEQ ID NO: 703937 - protein, 17 aa, Mycobacterium
NPITAWKALSEGNERFV

SEQ ID NO: 703938 - protein, 17 aa, Mycobacterium
NPIYIPRNHLVEEALTA

SEQ ID NO: 703939 - protein, 23 aa, Mycobacterium
NPKKIVGCGALHVLWADLGEIRT

SEQ ID NO: 703940 - protein, 23 aa, Mycobacterium
NPKPICYAVAFDPDGWKITSNEL

SEQ ID NO: 703941 - protein, 23 aa, Mycobacterium
NPKPLGMPLQYMVSGMAVRATNK

SEQ ID NO: 703942 - protein, 23 aa, Mycobacterium
NPKPLGMPLQYMVSGMAVRATNR

SEQ ID NO: 703943 - protein, 23 aa, Mycobacterium
NPKPSDRMPYAWNADYPARIGVM

SEQ ID NO: 703944 - protein, 24 aa, Mycobacterium
NPLAARLSPSFAHGGNPLRSLFLE

SEQ ID NO: 703945 - protein, 25 aa, Mycobacterium
NPLAISLRLGRGIAHQLKPHDPVHH

SEQ ID NO: 703946 - protein, 19 aa, Mycobacterium
NPLAPRPDRTYLITGGLGA

SEQ ID NO: 703947 - protein, 22 aa, Mycobacterium
NPLEWLDDKFCHYIEDRRREPR

SEQ ID NO: 703948 - protein, 18 aa, Mycobacterium
NPLFGGIVAHGYLVVSLA

SEQ ID NO: 703949 - protein, 18 aa, Mycobacterium
NPLFSVPISPRLRDAAAA

SEQ ID NO: 703950 - protein, 20 aa, Mycobacterium
NPLGAFGIGGDFGMADLGQI

SEQ ID NO: 703951 - protein, 23 aa, Mycobacterium
NPLGKGRRVVWSVTLPCGTCDRC

SEQ ID NO: 703952 - protein, 19 aa, Mycobacterium
NPLHLAFKTYHPFDGDGML

SEQ ID NO: 703953 - protein, 19 aa, Mycobacterium
NPLHPLALPLLRPKQVIML

SEQ ID NO: 703954 - protein, 26 aa, Mycobacterium
NPLILRIGAIILHPYIELYLGESFFS

SEQ ID NO: 703955 - protein, 17 aa, Mycobacterium
NPLKEVIRGKRLIVVDD

SEQ ID NO: 703956 - protein, 20 aa, Mycobacterium
NPLPYRIVFERVKTLPDHAN

SEQ ID NO: 703957 - protein, 22 aa, Mycobacterium
NPLPYRRLLTLVRALDTGQLQV

SEQ ID NO: 703958 - protein, 18 aa, Mycobacterium
NPLQGVAVDAAYLRSVLD

SEQ ID NO: 703959 - protein, 18 aa, Mycobacterium
NPLQWLNDKFHAYIEDRR

SEQ ID NO: 703960 - protein, 20 aa, Mycobacterium
NPLRKVVLARALRLTADAPL

SEQ ID NO: 703961 - protein, 18 aa, Mycobacterium
NPLRTVGALLDARQAHPN

SEQ ID NO: 703962 - protein, 18 aa, Mycobacterium
NPLSPFVFDGTRVLLDGE

SEQ ID NO: 703963 - protein, 24 aa, Mycobacterium
NPMHPAFKVYHPFDGDGMLHVVGF

SEQ ID NO: 703964 - protein, 31 aa, Mycobacterium
NPMIGYRGCYRYIKEPDLFALELSALARARE

SEQ ID NO: 703965 - protein, 17 aa, Mycobacterium
NPMIVTWPQRINDGGGL

SEQ ID NO: 703966 - protein, 23 aa, Mycobacterium
NPMLAKRVGAWVPLEEVPEVWAA

SEQ ID NO: 703967 - protein, 22 aa, Mycobacterium
NPMWEGFGYPGAPRIEPGGDEA

SEQ ID NO: 703968 - protein, 31 aa, Mycobacterium
NPNFTGRSWPLADVRLLAPILASKVIAVGKN

SEQ ID NO: 703969 - protein, 27 aa, Mycobacterium
NPNHFLAVAIDYLFAHRPEWAAETAVG

SEQ ID NO: 703970 - protein, 21 aa, Mycobacterium
NPNHFLAVAIEYLYTHRPSWP

SEQ ID NO: 703971 - protein, 27 aa, Mycobacterium
NPNLRPLRRGPFYAVRMVLSDLGTCGG

SEQ ID NO: 703972 - protein, 24 aa, Mycobacterium
NPNLRPLVKGPFYAVKMVLSDLGT

SEQ ID NO: 703973 - protein, 24 aa, Mycobacterium
NPNLRPLVNGPFYAVKVVLSDLGT

SEQ ID NO: 703974 - protein, 22 aa, Mycobacterium
NPNTCRPAVAAGPTGPTHTGCA

SEQ ID NO: 703975 - protein, 26 aa, Mycobacterium
NPNWDCPKLRVGAGSFITPVRIYDID

SEQ ID NO: 703976 - protein, 23 aa, Mycobacterium
NPPDELKYDFGLIDDALSKLADR

SEQ ID NO: 703977 - protein, 17 aa, Mycobacterium
NPPDRPWNLPAAVNSLF

SEQ ID NO: 703978 - protein, 28 aa, Mycobacterium
NPPEPLELPGPMGSVVPTGFRSQRSTVR

SEQ ID NO: 703979 - protein, 20 aa, Mycobacterium
NPPFYRWFPDAELNTCANAL

SEQ ID NO: 703980 - protein, 21 aa, Mycobacterium
NPPFYRWFPDAELNTCANALD

SEQ ID NO: 703981 - protein, 23 aa, Mycobacterium
NPPMIRLPIPPMIHGATQSATWM

SEQ ID NO: 703982 - protein, 22 aa, Mycobacterium
NPPMIRYPIPPMIHGATQSSTW

SEQ ID NO: 703983 - protein, 18 aa, Mycobacterium
NPPNEQWPRPAVSEQTLR

SEQ ID NO: 703984 - protein, 19 aa, Mycobacterium
NPPPMAWANFTQGDRPYAG

SEQ ID NO: 703985 - protein, 20 aa, Mycobacterium
NPPPPPTCCPPADPDPAVNQ

SEQ ID NO: 703986 - protein, 20 aa, Mycobacterium
NPPPTGWSSARCREGRQVSW

SEQ ID NO: 703987 - protein, 42 aa, Mycobacterium
NPQAQLPVPTVASAVLDPTQIVNWLIYQPLHAAGQQFWVVSP

SEQ ID NO: 703988 - protein, 20 aa, Mycobacterium
NPQPGTTICTTWDVTDFRGE

SEQ ID NO: 703989 - protein, 24 aa, Mycobacterium
NPQQRARVLAKFVDLVRAEIDDLA

SEQ ID NO: 703990 - protein, 24 aa, Mycobacterium
NPQRRARVLMKFIDLVNQNADELA

SEQ ID NO: 703991 - protein, 25 aa, Mycobacterium
NPQRSAAHLQAFITYANHAQELAVY

SEQ ID NO: 703992 - protein, 17 aa, Mycobacterium
NPQSWKLLRGKVALPSH

SEQ ID NO: 703993 - protein, 23 aa, Mycobacterium
NPQYRIAVADARTRRDGRSIEVI

SEQ ID NO: 703994 - protein, 24 aa, Mycobacterium
NPRFCEGDALLVWIPLNAANIVGG

SEQ ID NO: 703995 - protein, 22 aa, Mycobacterium
NPRHDIPRMLDLYRAGRLKLDE

SEQ ID NO: 703996 - protein, 19 aa, Mycobacterium
NPRIKSVSFVGSTPIAQYV

SEQ ID NO: 703997 - protein, 20 aa, Mycobacterium
NPRIVYCSISGYGPTGQHAS

SEQ ID NO: 703998 - protein, 23 aa, Mycobacterium
NPRKVRLKTLSWGAAPATDVLLR

SEQ ID NO: 703999 - protein, 19 aa, Mycobacterium
NPRLLPWRRALANVTFALP

SEQ ID NO: 704000 - protein, 21 aa, Mycobacterium
NPRLREFALREGLADAWLRMA

SEQ ID NO: 704001 - protein, 25 aa, Mycobacterium
NPRLVWCAISGYGPDGPYEKRKAFD

SEQ ID NO: 704002 - protein, 26 aa, Mycobacterium
NPRNRCYFCKSHLYTAIRELPTCDGA

SEQ ID NO: 704003 - protein, 18 aa, Mycobacterium
NPRPEFVERIRLHQLAVG

SEQ ID NO: 704004 - protein, 25 aa, Mycobacterium
NPRQWKLAVAGAYHLVGEEPPTTGL

SEQ ID NO: 704005 - protein, 23 aa, Mycobacterium
NPRTRSGIMGVELLDTTPDWERF

SEQ ID NO: 704006 - protein, 24 aa, Mycobacterium
NPRTRSGIMTIELLDTTPDWDTFR

SEQ ID NO: 704007 - protein, 23 aa, Mycobacterium
NPRWDKRFLGKHLITAHPMGGCA

SEQ ID NO: 704008 - protein, 25 aa, Mycobacterium
NPSIWPEGKIRSVFEPVVKTTVIAP

SEQ ID NO: 704009 - protein, 25 aa, Mycobacterium
NPSLTIAAFARRAAHELRKEDLATP

SEQ ID NO: 704010 - protein, 20 aa, Mycobacterium
NPSRLCDWCAHQSLCPAFGG

SEQ ID NO: 704011 - protein, 17 aa, Mycobacterium
NPSWGTFYSLDDPWITS

SEQ ID NO: 704012 - protein, 20 aa, Mycobacterium
NPTCGACFGYHMGVLGPGEV

SEQ ID NO: 704013 - protein, 18 aa, Mycobacterium
NPTCPTGRIEVAAGSGPV

SEQ ID NO: 704014 - protein, 24 aa, Mycobacterium
NPTGKFVLGGPMGDAGLTGRKIIV

SEQ ID NO: 704015 - protein, 17 aa, Mycobacterium
NPTLPAFIDAIRFATKR

SEQ ID NO: 704016 - protein, 20 aa, Mycobacterium
NPTVSDWARLIAARSADSKA

SEQ ID NO: 704017 - protein, 25 aa, Mycobacterium
NPVAKLMWRICRIDGPPSRYRSEPA

SEQ ID NO: 704018 - protein, 20 aa, Mycobacterium
NPVARFLGIVNMLTNKFETN

SEQ ID NO: 704019 - protein, 22 aa, Mycobacterium
NPVCTAAALAVLRVLASDNLVR

SEQ ID NO: 704020 - protein, 21 aa, Mycobacterium
NPVCVAAALAVLRVLDEQDLV

SEQ ID NO: 704021 - protein, 26 aa, Mycobacterium
NPVEAVAAWIDARLDLAFDENVKADL

SEQ ID NO: 704022 - protein, 26 aa, Mycobacterium
NPVFNRLPVRWLYLPWAAEGWKREGV

SEQ ID NO: 704023 - protein, 24 aa, Mycobacterium
NPVLECLRAGVPATALYVALGSEA

SEQ ID NO: 704024 - protein, 24 aa, Mycobacterium
NPVLEWITGTALVPVRERLSAEDW

SEQ ID NO: 704025 - protein, 17 aa, Mycobacterium
NPVLRVMLGHLLKPGRL

SEQ ID NO: 704026 - protein, 20 aa, Mycobacterium
NPVLVRRRFDATAMFVSLFA

SEQ ID NO: 704027 - protein, 28 aa, Mycobacterium
NPVNPMRVAWELSNRLPANAIVTADSGS

SEQ ID NO: 704028 - protein, 17 aa, Mycobacterium
NPVNVFVAGFIGSPAMN

SEQ ID NO: 704029 - protein, 33 aa, Mycobacterium
NPVPGLLRWLPRLWPSWRIEFWEDRYEEQFRQC

SEQ ID NO: 704030 - protein, 26 aa, Mycobacterium
NPVPKPVAVPVLWLGAAERVSAIVEM

SEQ ID NO: 704031 - protein, 17 aa, Mycobacterium
NPVPRQVLVPVLPPNAD

SEQ ID NO: 704032 - protein, 28 aa, Mycobacterium
NPVRLAEAIARFGPIFAQYYGQSEAPMA

SEQ ID NO: 704033 - protein, 24 aa, Mycobacterium
NPVRRIGAQIAEVLCRHRGGRAAR

SEQ ID NO: 704034 - protein, 25 aa, Mycobacterium
NPVSALVSFEVFIREPLRAAMGLTP

SEQ ID NO: 704035 - protein, 34 aa, Mycobacterium
NPVSALVSFEVFIRPALRLAMGLPDPRRPQRTAV

SEQ ID NO: 704036 - protein, 30 aa, Mycobacterium
NPVSALVSFEVFIRPALRSAMGLPDPDRPH

SEQ ID NO: 704037 - protein, 33 aa, Mycobacterium
NPVSALVSFEVFIRPALRTAMGLPDPERPHRSA

SEQ ID NO: 704038 - protein, 33 aa, Mycobacterium
NPVSALVSFEVFLRPALRAAMGLTDTQRPRRTA

SEQ ID NO: 704039 - protein, 28 aa, Mycobacterium
NPVSALVSFEVFVRAPLRAAMGHPEPER

SEQ ID NO: 704040 - protein, 33 aa, Mycobacterium
NPVSALVVFEIMVRPLIRLSLGKRQPMRRIVQA

SEQ ID NO: 704041 - protein, 24 aa, Mycobacterium
NPVSIGYRLARGILHNATKADTEA

SEQ ID NO: 704042 - protein, 23 aa, Mycobacterium
NPVTIGYRLARGILHNLKTADPA

SEQ ID NO: 704043 - protein, 21 aa, Mycobacterium
NPVVLPTVWDAWSARLAANAG

SEQ ID NO: 704044 - protein, 24 aa, Mycobacterium
NPVYRLITVILMRCGLRITDALRL

SEQ ID NO: 704045 - protein, 19 aa, Mycobacterium
NPYLTFAVLLAAGLRGIEK

SEQ ID NO: 704046 - protein, 19 aa, Mycobacterium
NPYLTFAVLLAAGLRGVEK

SEQ ID NO: 704047 - protein, 20 aa, Mycobacterium
NPYLTFAVLLAAGLRGVEKG

SEQ ID NO: 704048 - protein, 19 aa, Mycobacterium
NPYMPTDLPAWYDVVMTHY

SEQ ID NO: 704049 - protein, 27 aa, Mycobacterium
NPYRFAHGAARPGVWRGPSSPPRFDDV

SEQ ID NO: 704050 - protein, 22 aa, Mycobacterium
NPYTFRKVFRGMAVARENRLPI

SEQ ID NO: 704051 - protein, 30 aa, Mycobacterium
NQAEYILKFDWLSISGLTARIYIGHIDGLG

SEQ ID NO: 704052 - protein, 17 aa, Mycobacterium
NQAIQWPLVELQTEAQM

SEQ ID NO: 704053 - protein, 21 aa, Mycobacterium
NQALCSDVGYAVRLEPGVQSP

SEQ ID NO: 704054 - protein, 26 aa, Mycobacterium
NQAQYCSVICPFIVQGLVSVPVGTAL

SEQ ID NO: 704055 - protein, 20 aa, Mycobacterium
NQARLHGYRAAMEEAGAAVV

SEQ ID NO: 704056 - protein, 19 aa, Mycobacterium
NQASAIRQDIDWLDYLENP

SEQ ID NO: 704057 - protein, 28 aa, Mycobacterium
NQASFADRACAAWRAAGRSGQPRLHASV

SEQ ID NO: 704058 - protein, 24 aa, Mycobacterium
NQDPACPAGTFVAPDAIRNPDGSN

SEQ ID NO: 704059 - protein, 21 aa, Mycobacterium
NQEFGSLASWLVDVVNILTGH

SEQ ID NO: 704060 - protein, 19 aa, Mycobacterium
NQERALLARGFKYGTAPGA

SEQ ID NO: 704061 - protein, 29 aa, Mycobacterium
NQGEVCTCPSRALVHASIYDEFIARAITR

SEQ ID NO: 704062 - protein, 23 aa, Mycobacterium
NQGEVCTCPSRGLIQADIYDRFL

SEQ ID NO: 704063 - protein, 23 aa, Mycobacterium
NQGEVCTCPSRSLIQADIFDDFL

SEQ ID NO: 704064 - protein, 21 aa, Mycobacterium
NQGFLRCVAALARAADAIGET

SEQ ID NO: 704065 - protein, 24 aa, Mycobacterium
NQGLRLAKTLTPWPAAGGQRIAAA

SEQ ID NO: 704066 - protein, 18 aa, Mycobacterium
NQHGWQWSAGCGTDAAPY

SEQ ID NO: 704067 - protein, 27 aa, Mycobacterium
NQHVKWLTSSAALTWRRPIASLNYLLT

SEQ ID NO: 704068 - protein, 19 aa, Mycobacterium
NQINNVLAFPGVFRGALAA

SEQ ID NO: 704069 - protein, 19 aa, Mycobacterium
NQIVAMAAAWLGVEEPEIE

SEQ ID NO: 704070 - protein, 25 aa, Mycobacterium
NQLADFTLTVGFYQLVCDFLNTFGV

SEQ ID NO: 704071 - protein, 17 aa, Mycobacterium
NQLARLELSMMLERLLK

SEQ ID NO: 704072 - protein, 17 aa, Mycobacterium
NQLELLAAQVLAFAQTN

SEQ ID NO: 704073 - protein, 17 aa, Mycobacterium
NQLERIGSALSAANLTA

SEQ ID NO: 704074 - protein, 18 aa, Mycobacterium
NQLGCVNARVVYVASGTD

SEQ ID NO: 704075 - protein, 17 aa, Mycobacterium
NQLGLAMQTFMKHPDQW

SEQ ID NO: 704076 - protein, 23 aa, Mycobacterium
NQLKRLKVGTSRRFSGASRKSLV

SEQ ID NO: 704077 - protein, 20 aa, Mycobacterium
NQLLDWPGLAAREVACSAWP

SEQ ID NO: 704078 - protein, 22 aa, Mycobacterium
NQLSRLGGYHWRDEDSATAEPV

SEQ ID NO: 704079 - protein, 23 aa, Mycobacterium
NQLSRLKVGAARRFSATDRNTLA

SEQ ID NO: 704080 - protein, 19 aa, Mycobacterium
NQLVPRLATRWTAIDDHHW

SEQ ID NO: 704081 - protein, 17 aa, Mycobacterium
NQMGIGALNTGLANTGF

SEQ ID NO: 704082 - protein, 18 aa, Mycobacterium
NQNLQYWREAIRTAPHLL

SEQ ID NO: 704083 - protein, 20 aa, Mycobacterium
NQNYGGFWFLTSYEAVSQAA

SEQ ID NO: 704084 - protein, 20 aa, Mycobacterium
NQPGFLGFQLLRPVKGEDRY

SEQ ID NO: 704085 - protein, 22 aa, Mycobacterium
NQPGVVAITGWLVRPTRQDDAR

SEQ ID NO: 704086 - protein, 22 aa, Mycobacterium
NQPVRQPVCDLVHFTVGPRPLA

SEQ ID NO: 704087 - protein, 18 aa, Mycobacterium
NQQWDRARARRMCRELEQ

SEQ ID NO: 704088 - protein, 17 aa, Mycobacterium
NQRELLRLWADYLDMPP

SEQ ID NO: 704089 - protein, 18 aa, Mycobacterium
NQRGQVIPVEITVYEDRS

SEQ ID NO: 704090 - protein, 19 aa, Mycobacterium
NQRGVLCCPVELTLQVPES

SEQ ID NO: 704091 - protein, 20 aa, Mycobacterium
NQRLQAQILRDAPQRARVVA

SEQ ID NO: 704092 - protein, 17 aa, Mycobacterium
NQRLRLETTTEKLTTRV

SEQ ID NO: 704093 - protein, 17 aa, Mycobacterium
NQRLRLETTTERLTTRV

SEQ ID NO: 704094 - protein, 20 aa, Mycobacterium
NQRLRVGFLAGSYEKSDELL

SEQ ID NO: 704095 - protein, 20 aa, Mycobacterium
NQRPRVIAVDAVPDDVASTW

SEQ ID NO: 704096 - protein, 26 aa, Mycobacterium
NQRRGRRWSMADAFLHPVAHRPNLTI

SEQ ID NO: 704097 - protein, 26 aa, Mycobacterium
NQRRGRRWSMADAFLHPVAHRPNLTV

SEQ ID NO: 704098 - protein, 25 aa, Mycobacterium
NQRRGRRWSMADAFLHPVAHRRNLT

SEQ ID NO: 704099 - protein, 22 aa, Mycobacterium
NQRRLAYVAAILADAGQVVLVP

SEQ ID NO: 704100 - protein, 17 aa, Mycobacterium
NQSELEAALAPVSELAD

SEQ ID NO: 704101 - protein, 18 aa, Mycobacterium
NQSSWELVTDALARSRSG

SEQ ID NO: 704102 - protein, 17 aa, Mycobacterium
NQTMVLAAPAGVSADDV

SEQ ID NO: 704103 - protein, 23 aa, Mycobacterium
NQTRVLAPRSRYDEVVDGIVGMV

SEQ ID NO: 704104 - protein, 24 aa, Mycobacterium
NQVWSRMAAKYGVTNPVPPWKTSL

SEQ ID NO: 704105 - protein, 19 aa, Mycobacterium
NQWKAHTGYVPGLTNQAAN

SEQ ID NO: 704106 - protein, 24 aa, Mycobacterium
NQWPAMGAEAYRTLRDYRQAADVC

SEQ ID NO: 704107 - protein, 23 aa, Mycobacterium
NQWYHRPDYLAIMRDCGFTRMGV

SEQ ID NO: 704108 - protein, 19 aa, Mycobacterium
NQYWHPYRLGGRAIGTVRT

SEQ ID NO: 704109 - protein, 22 aa, Mycobacterium
NQYYDDMAWLALAMQRASELLG

SEQ ID NO: 704110 - protein, 19 aa, Mycobacterium
NRAAYKFIDYDVNPDGFTE

SEQ ID NO: 704111 - protein, 23 aa, Mycobacterium
NRACLRPPAVQALRAMLSGPPPG

SEQ ID NO: 704112 - protein, 33 aa, Mycobacterium
NRAEEVAVRQGLRWTQRMRRSLPELVAPWEEPF

SEQ ID NO: 704113 - protein, 20 aa, Mycobacterium
NRALMAAGLVDRVQVTLFPV

SEQ ID NO: 704114 - protein, 24 aa, Mycobacterium
NRALSATEALAWGLVTEVAESTEL

SEQ ID NO: 704115 - protein, 20 aa, Mycobacterium
NRALSATKRLVWSGLGSSVE

SEQ ID NO: 704116 - protein, 19 aa, Mycobacterium
NRALVLAALAAREGGTSTV

SEQ ID NO: 704117 - protein, 19 aa, Mycobacterium
NRALVLAALAAREGSSRIS

SEQ ID NO: 704118 - protein, 25 aa, Mycobacterium
NRALVSALWWVQWRITKSPEDAQRR

SEQ ID NO: 704119 - protein, 26 aa, Mycobacterium
NRAMRLEALPGWTWGPRSRRTSATPR

SEQ ID NO: 704120 - protein, 20 aa, Mycobacterium
NRAPLSFPIPGWNICVDFPI

SEQ ID NO: 704121 - protein, 20 aa, Mycobacterium
NRAPLSFPMAGWNVAMDFPN

SEQ ID NO: 704122 - protein, 18 aa, Mycobacterium
NRAQLMALIATNFLGQNA

SEQ ID NO: 704123 - protein, 22 aa, Mycobacterium
NRAQLMALVATNFFGQNTPAIM

SEQ ID NO: 704124 - protein, 17 aa, Mycobacterium
NRARGSVIFSEPLARLT

SEQ ID NO: 704125 - protein, 19 aa, Mycobacterium
NRARLMMLVATNIFGQNTP

SEQ ID NO: 704126 - protein, 24 aa, Mycobacterium
NRARRTALVSANWLGQHSAAIADV

SEQ ID NO: 704127 - protein, 25 aa, Mycobacterium
NRASAWIAEGLFGYLAPGAQDQLLD

SEQ ID NO: 704128 - protein, 29 aa, Mycobacterium
NRAVLARSWVPVSIPGLFAAQATRTPDAV

SEQ ID NO: 704129 - protein, 30 aa, Mycobacterium
NRAVLARSWVPVSIPGLFAAQVVRTPDAVA

SEQ ID NO: 704130 - protein, 17 aa, Mycobacterium
NRAVTLITIEAGGHEWP

SEQ ID NO: 704131 - protein, 21 aa, Mycobacterium
NRAYTPWYLVRYWRLLKFKLA

SEQ ID NO: 704132 - protein, 25 aa, Mycobacterium
NRCLPRFVRRFPFNVLLADVDRRIR

SEQ ID NO: 704133 - protein, 18 aa, Mycobacterium
NRCPVTTECLTWALESGQ

SEQ ID NO: 704134 - protein, 20 aa, Mycobacterium
NRCSPSFYADMKSYRPTADI

SEQ ID NO: 704135 - protein, 25 aa, Mycobacterium
NRDDTSAFAGEWFRTGDALVQDEDG

SEQ ID NO: 704136 - protein, 25 aa, Mycobacterium
NRDEHRWQRPEVFDIFRERIPHISF

SEQ ID NO: 704137 - protein, 29 aa, Mycobacterium
NRDLLRQLLPIVLPIVLAYIGNQLGSGEG

SEQ ID NO: 704138 - protein, 17 aa, Mycobacterium
NRDLMRLALPVIKADYR

SEQ ID NO: 704139 - protein, 17 aa, Mycobacterium
NRDVRWFDIEPCYVYHP

SEQ ID NO: 704140 - protein, 18 aa, Mycobacterium
NRDVRWFDIEPCYVYHPL

SEQ ID NO: 704141 - protein, 22 aa, Mycobacterium
NREGQDWLLRHCAANQLPVQRE

SEQ ID NO: 704142 - protein, 17 aa, Mycobacterium
NREHIVEAFNALKKLAM

SEQ ID NO: 704143 - protein, 17 aa, Mycobacterium
NREKLPYILRLFDIQGL

SEQ ID NO: 704144 - protein, 24 aa, Mycobacterium
NREKLTEIPVLWAYARDLYQTPGF

SEQ ID NO: 704145 - protein, 23 aa, Mycobacterium
NRELAPRLKAVVATSTELQERDA

SEQ ID NO: 704146 - protein, 24 aa, Mycobacterium
NRELPGLDIATAWLRAHEPLDYVP

SEQ ID NO: 704147 - protein, 21 aa, Mycobacterium
NRELRKRCLLQLHEAIESEKE

SEQ ID NO: 704148 - protein, 19 aa, Mycobacterium
NREPSEWLTMTADTLLAQS

SEQ ID NO: 704149 - protein, 23 aa, Mycobacterium
NRERKPFWWSHFDRLNNPVDEWA

SEQ ID NO: 704150 - protein, 25 aa, Mycobacterium
NRFDHGVFMYMEFEPGRPLVGTLEY

SEQ ID NO: 704151 - protein, 17 aa, Mycobacterium
NRFGVDEHVVFTGGVPW

SEQ ID NO: 704152 - protein, 19 aa, Mycobacterium
NRFIKAATFEGVMARGTVS

SEQ ID NO: 704153 - protein, 27 aa, Mycobacterium
NRFRCSRLGSGLAEMFPGLTSVDVADV

SEQ ID NO: 704154 - protein, 21 aa, Mycobacterium
NRGACLWTGDYLNTGDGIQLI

SEQ ID NO: 704155 - protein, 23 aa, Mycobacterium
NRGAELWRWLQDGAQLYVCGTAD

SEQ ID NO: 704156 - protein, 23 aa, Mycobacterium
NRGDISLDIGVMILVQLVGAGGE

SEQ ID NO: 704157 - protein, 29 aa, Mycobacterium
NRGEIARRVFRTCRELGIATVAVYSDADA

SEQ ID NO: 704158 - protein, 24 aa, Mycobacterium
NRGFLRAVAALARAAKLIGEDHEY

SEQ ID NO: 704159 - protein, 24 aa, Mycobacterium
NRGFLRCVAALARAADAIGETDEY

SEQ ID NO: 704160 - protein, 26 aa, Mycobacterium
NRGFRVEFNSALGPYKGGLRFHPSVY

SEQ ID NO: 704161 - protein, 22 aa, Mycobacterium
NRGGPFAGVPFLIKDLAQDYAG

SEQ ID NO: 704162 - protein, 20 aa, Mycobacterium
NRGHCAAIHLNMPVGRPTKE

SEQ ID NO: 704163 - protein, 19 aa, Mycobacterium
NRGIEYWAGHQWEPHKTPK

SEQ ID NO: 704164 - protein, 21 aa, Mycobacterium
NRGKRSVGIDVSKPEGQEVLY

SEQ ID NO: 704165 - protein, 21 aa, Mycobacterium
NRGKRSVGIDVSTPGGQEVIY

SEQ ID NO: 704166 - protein, 17 aa, Mycobacterium
NRGKRSVGLALDNSEAR

SEQ ID NO: 704167 - protein, 18 aa, Mycobacterium
NRGLRFLADQVLRRYPVR

SEQ ID NO: 704168 - protein, 17 aa, Mycobacterium
NRGLRYGVKTMFSTSGK

SEQ ID NO: 704169 - protein, 19 aa, Mycobacterium
NRGNLNFGSGNRGNGNFGF

SEQ ID NO: 704170 - protein, 18 aa, Mycobacterium
NRGPRPADIIGVTDDDLA

SEQ ID NO: 704171 - protein, 22 aa, Mycobacterium
NRGQFSAVISLDLRRFNELHSL

SEQ ID NO: 704172 - protein, 22 aa, Mycobacterium
NRGRLYAAVQAFFDFIEHDSQG

SEQ ID NO: 704173 - protein, 24 aa, Mycobacterium
NRGRRWPTWPWSDFGLKLQPATDS

SEQ ID NO: 704174 - protein, 20 aa, Mycobacterium
NRGTVAISRADTLGIGAAPL

SEQ ID NO: 704175 - protein, 30 aa, Mycobacterium
NRGVALGDLRLCGGQRLSTFRTYTYPLMDR

SEQ ID NO: 704176 - protein, 18 aa, Mycobacterium
NRGVDKFICAMGVGDGQL

SEQ ID NO: 704177 - protein, 24 aa, Mycobacterium
NRGWCAWMPAIARLFPDAKVIACV

SEQ ID NO: 704178 - protein, 25 aa, Mycobacterium
NRGWCAWMPAIARLFPEAKVIACVR

SEQ ID NO: 704179 - protein, 22 aa, Mycobacterium
NRGWRDFLMRYSVNELQVLTKV

SEQ ID NO: 704180 - protein, 27 aa, Mycobacterium
NRHFSFGLGIHRCIGSNVARVVFKSML

SEQ ID NO: 704181 - protein, 26 aa, Mycobacterium
NRHLAAAGWTCLGWPVEHGGRGATVS

SEQ ID NO: 704182 - protein, 23 aa, Mycobacterium
NRHLYEHICWIDSRSPELLVARI

SEQ ID NO: 704183 - protein, 34 aa, Mycobacterium
NRHPQRIALRFDDLQFTFGEFDAAAARVATLLER

SEQ ID NO: 704184 - protein, 19 aa, Mycobacterium
NRHRLVLTIHHVVLDGWSV

SEQ ID NO: 704185 - protein, 18 aa, Mycobacterium
NRHSIAIRDYLVVTRSVD

SEQ ID NO: 704186 - protein, 17 aa, Mycobacterium
NRIAVRFQYECRDRSGQ

SEQ ID NO: 704187 - protein, 26 aa, Mycobacterium
NRIDMMLDRRVDGLILGDARSDDHTV

SEQ ID NO: 704188 - protein, 25 aa, Mycobacterium
NRIEVAADLRTDWSRPLEAAGFDVE

SEQ ID NO: 704189 - protein, 20 aa, Mycobacterium
NRIISCFSMTEPQGGADPKV

SEQ ID NO: 704190 - protein, 21 aa, Mycobacterium
NRIKAVASVTGYYRDHETDLF

SEQ ID NO: 704191 - protein, 20 aa, Mycobacterium
NRIPEDFPDPDAFRPDRYNK

SEQ ID NO: 704192 - protein, 24 aa, Mycobacterium
NRIQPLRLHYARTLQIWAASLESR

SEQ ID NO: 704193 - protein, 22 aa, Mycobacterium
NRIRTAEQWFRREEELGRKRGR

SEQ ID NO: 704194 - protein, 19 aa, Mycobacterium
NRITFSPGLDAPVNPFHTR

SEQ ID NO: 704195 - protein, 21 aa, Mycobacterium
NRITGSLGVRFARSCETVVTL

SEQ ID NO: 704196 - protein, 19 aa, Mycobacterium
NRIVPIIPDEARTFGMDSW

SEQ ID NO: 704197 - protein, 24 aa, Mycobacterium
NRIVRRLLAAAGFPVEALVRTDIG

SEQ ID NO: 704198 - protein, 25 aa, Mycobacterium
NRIVRRLLAAAGFPVEALVRTDIGP

SEQ ID NO: 704199 - protein, 25 aa, Mycobacterium
NRIVRRLLGAAGFPVEALVRTDIGP

SEQ ID NO: 704200 - protein, 19 aa, Mycobacterium
NRIYRVMVDLGLPLWDDTL

SEQ ID NO: 704201 - protein, 24 aa, Mycobacterium
NRKFTELDRMIGFHDGKKWVATTG

SEQ ID NO: 704202 - protein, 26 aa, Mycobacterium
NRKGETSLVKFHWKPVAGVHSLVWEE

SEQ ID NO: 704203 - protein, 25 aa, Mycobacterium
NRKYRLLGPLSEFGVWITRRQRASV

SEQ ID NO: 704204 - protein, 17 aa, Mycobacterium
NRLAGAVLIGRDRQMVA

SEQ ID NO: 704205 - protein, 18 aa, Mycobacterium
NRLARFLIAGGVRPGDKV

SEQ ID NO: 704206 - protein, 24 aa, Mycobacterium
NRLASAPMITEWCQLPEKTDPRTY

SEQ ID NO: 704207 - protein, 20 aa, Mycobacterium
NRLDCMPLAIELAAARVRAL

SEQ ID NO: 704208 - protein, 25 aa, Mycobacterium
NRLDSELIGNVSIRVVDIGKPDAWE

SEQ ID NO: 704209 - protein, 19 aa, Mycobacterium
NRLFTLEWEPVPLPTAAGL

SEQ ID NO: 704210 - protein, 19 aa, Mycobacterium
NRLGAIAVPVNFRMTPPEI

SEQ ID NO: 704211 - protein, 23 aa, Mycobacterium
NRLGDALSLLVIAEESLHKWQRL

SEQ ID NO: 704212 - protein, 19 aa, Mycobacterium
NRLGFSYPEVAAINPGIVY

SEQ ID NO: 704213 - protein, 17 aa, Mycobacterium
NRLGGAVYAKARNLVPH

SEQ ID NO: 704214 - protein, 19 aa, Mycobacterium
NRLGPTINFRGIDNSAYYR

SEQ ID NO: 704215 - protein, 25 aa, Mycobacterium
NRLGQRGPTEFGWDLETYAKRVEAF

SEQ ID NO: 704216 - protein, 18 aa, Mycobacterium
NRLHAQKALLVWLLENRR

SEQ ID NO: 704217 - protein, 18 aa, Mycobacterium
NRLHAQKALLVWLLERGR

SEQ ID NO: 704218 - protein, 18 aa, Mycobacterium
NRLHAQKALLVWLLERNS

SEQ ID NO: 704219 - protein, 17 aa, Mycobacterium
NRLHAQKALLVWLLERS

SEQ ID NO: 704220 - protein, 18 aa, Mycobacterium
NRLHAQKALLVWLLERSQ

SEQ ID NO: 704221 - protein, 21 aa, Mycobacterium
NRLIKHPKLRQGSAAWPAHNG

SEQ ID NO: 704222 - protein, 17 aa, Mycobacterium
NRLKLGGVKITLDGSPQ

SEQ ID NO: 704223 - protein, 20 aa, Mycobacterium
NRLKTAAGHRALRVDHIGST

SEQ ID NO: 704224 - protein, 19 aa, Mycobacterium
NRLLEFVVRQESRLNWAVG

SEQ ID NO: 704225 - protein, 18 aa, Mycobacterium
NRLLLADLLRRHPEINDI

SEQ ID NO: 704226 - protein, 27 aa, Mycobacterium
NRLLPDRLAHIANRWKAIAFSTFQYQL

SEQ ID NO: 704227 - protein, 17 aa, Mycobacterium
NRLLPTLLDKHGVSTEQ

SEQ ID NO: 704228 - protein, 21 aa, Mycobacterium
NRLPDATLWSVMERLQPANAT

SEQ ID NO: 704229 - protein, 22 aa, Mycobacterium
NRLPHAAAIAGFLAAGRTVAMI

SEQ ID NO: 704230 - protein, 23 aa, Mycobacterium
NRLPPVHTFAGINLSFGIMGPIF

SEQ ID NO: 704231 - protein, 26 aa, Mycobacterium
NRLPRIECRGGLAARRTAPDTVHLVS

SEQ ID NO: 704232 - protein, 20 aa, Mycobacterium
NRLRCWHIEGMLCIGDAAHA

SEQ ID NO: 704233 - protein, 17 aa, Mycobacterium
NRLRIGRDAVDQHVVFL

SEQ ID NO: 704234 - protein, 24 aa, Mycobacterium
NRLRRWYRDGLLCIGDAAHAMSPV

SEQ ID NO: 704235 - protein, 19 aa, Mycobacterium
NRLRTALADLDDLDFDYVF

SEQ ID NO: 704236 - protein, 24 aa, Mycobacterium
NRLSADPAIRVLLLEAGRGDRNLW

SEQ ID NO: 704237 - protein, 17 aa, Mycobacterium
NRLTLDVVVRQGGRVSA

SEQ ID NO: 704238 - protein, 22 aa, Mycobacterium
NRLTLWGRRLLGEAITQAQHVL

SEQ ID NO: 704239 - protein, 19 aa, Mycobacterium
NRLTREWFHSGRATYHVAG

SEQ ID NO: 704240 - protein, 19 aa, Mycobacterium
NRLTTPIQFAFREATEDTV

SEQ ID NO: 704241 - protein, 18 aa, Mycobacterium
NRLVGILHGCLRHHTHYD

SEQ ID NO: 704242 - protein, 24 aa, Mycobacterium
NRLVGILHGCLRHHTLYDEDRAWA

SEQ ID NO: 704243 - protein, 18 aa, Mycobacterium
NRLVGILHGCLRHHTPYS

SEQ ID NO: 704244 - protein, 20 aa, Mycobacterium
NRLVTQVGYHCRFIGAFQEA

SEQ ID NO: 704245 - protein, 18 aa, Mycobacterium
NRLWRPRLRRTLEGMEVT

SEQ ID NO: 704246 - protein, 19 aa, Mycobacterium
NRLYRGRGDLVLLHIDPAR

SEQ ID NO: 704247 - protein, 20 aa, Mycobacterium
NRMAGCFAAGALATGCEHEV

SEQ ID NO: 704248 - protein, 20 aa, Mycobacterium
NRMFAWAGATASWPNRTDSG

SEQ ID NO: 704249 - protein, 23 aa, Mycobacterium
NRMICDPYPRLLVARDTVNQGAA

SEQ ID NO: 704250 - protein, 19 aa, Mycobacterium
NRMMRKWLSANNFLGQASP

SEQ ID NO: 704251 - protein, 24 aa, Mycobacterium
NRMPFPLTAWAVRLLTRLPQRGIT

SEQ ID NO: 704252 - protein, 26 aa, Mycobacterium
NRMRWPHGRMRYYIAMLAELSQLRTL

SEQ ID NO: 704253 - protein, 29 aa, Mycobacterium
NRMRWPRGRRRYDIAMALEAAKLRPLPFR

SEQ ID NO: 704254 - protein, 28 aa, Mycobacterium
NRMSWPHGRLRYYLAMLAELSQLRLLPF

SEQ ID NO: 704255 - protein, 27 aa, Mycobacterium
NRMTLTCPFHGWTFRNDGALLKVKDPD

SEQ ID NO: 704256 - protein, 29 aa, Mycobacterium
NRMTWPHGRLRYYIAMLVELSQLRPLPFR

SEQ ID NO: 704257 - protein, 21 aa, Mycobacterium
NRMYRYGMELIAAKRAAPTDD

SEQ ID NO: 704258 - protein, 21 aa, Mycobacterium
NRNQGAFGFSEPCADCRGTGS

SEQ ID NO: 704259 - protein, 21 aa, Mycobacterium
NRPAARNALSRDLIRATYTAL

SEQ ID NO: 704260 - protein, 21 aa, Mycobacterium
NRPAETERLLGISTSAAEQAR

SEQ ID NO: 704261 - protein, 19 aa, Mycobacterium
NRPALRVSPHVDVTAADLG

SEQ ID NO: 704262 - protein, 19 aa, Mycobacterium
NRPANTFVAAFMGSPPMNL

SEQ ID NO: 704263 - protein, 19 aa, Mycobacterium
NRPDCIYLGAAGHVLGTGA

SEQ ID NO: 704264 - protein, 35 aa, Mycobacterium
NRPDFPPTLMSRLLLEAGVTPWITLSCRDRNRVVL

SEQ ID NO: 704265 - protein, 28 aa, Mycobacterium
NRPDRMNSWGGGLARAFYECIDRAEADP

SEQ ID NO: 704266 - protein, 22 aa, Mycobacterium
NRPEARNAFNLAVAKGLAEAVD

SEQ ID NO: 704267 - protein, 21 aa, Mycobacterium
NRPEARNAFNLAVAQGLADAM

SEQ ID NO: 704268 - protein, 19 aa, Mycobacterium
NRPEARNALGSELIEALFT

SEQ ID NO: 704269 - protein, 24 aa, Mycobacterium
NRPEFLEITWACQLSGLYYTAVNT

SEQ ID NO: 704270 - protein, 23 aa, Mycobacterium
NRPEFLEITWGCQLSGLYYTPVN

SEQ ID NO: 704271 - protein, 27 aa, Mycobacterium
NRPEFVIALRAIWRLGAAAVLISPAWK

SEQ ID NO: 704272 - protein, 27 aa, Mycobacterium
NRPEFVVALRAIWRLGAAAVLLSPAWK

SEQ ID NO: 704273 - protein, 17 aa, Mycobacterium
NRPEKLNAISVDLNEEL

SEQ ID NO: 704274 - protein, 17 aa, Mycobacterium
NRPEVLMIIGAGQTQGY

SEQ ID NO: 704275 - protein, 19 aa, Mycobacterium
NRPEVLMIIGAGQTRGYRR

SEQ ID NO: 704276 - protein, 19 aa, Mycobacterium
NRPGPRGFLGQPIPIEGLY

SEQ ID NO: 704277 - protein, 23 aa, Mycobacterium
NRPGYLRFDFNWQGALSDDQRSQ

SEQ ID NO: 704278 - protein, 23 aa, Mycobacterium
NRPGYLRFDFNWQGALSDEQRTQ

SEQ ID NO: 704279 - protein, 23 aa, Mycobacterium
NRPGYLRFDFNWQGPLSDDQRTQ

SEQ ID NO: 704280 - protein, 23 aa, Mycobacterium
NRPGYLRFDFNWQGPLSEEQRTQ

SEQ ID NO: 704281 - protein, 27 aa, Mycobacterium
NRPHAYRFGTVGWPFPATEVKIAGDGE

SEQ ID NO: 704282 - protein, 19 aa, Mycobacterium
NRPIVDFSLTHSYVAAPVM

SEQ ID NO: 704283 - protein, 25 aa, Mycobacterium
NRPKAIEFFAGIGLARMGLEKAGFQ

SEQ ID NO: 704284 - protein, 28 aa, Mycobacterium
NRPLLERDLRYAWWNNHCVVDAAIGTFI

SEQ ID NO: 704285 - protein, 22 aa, Mycobacterium
NRPPAVLWRMREHLDFRMVRIG

SEQ ID NO: 704286 - protein, 20 aa, Mycobacterium
NRPRCPVNDMLRDGMHQTAI

SEQ ID NO: 704287 - protein, 20 aa, Mycobacterium
NRPREYARVLSPLHRLLRDI

SEQ ID NO: 704288 - protein, 21 aa, Mycobacterium
NRPRKSLDWKTPAEVFEEQLR

SEQ ID NO: 704289 - protein, 21 aa, Mycobacterium
NRPRPEASTGDRERYQAQWVT

SEQ ID NO: 704290 - protein, 19 aa, Mycobacterium
NRPSERVLVIIPTYNEREN

SEQ ID NO: 704291 - protein, 24 aa, Mycobacterium
NRPWRPDVVHAHDWLVAHPAIALA

SEQ ID NO: 704292 - protein, 22 aa, Mycobacterium
NRQEIKQALLALHRAAERGAEG

SEQ ID NO: 704293 - protein, 25 aa, Mycobacterium
NRQRLRAAVMAFFDFVEHDSQGYRL

SEQ ID NO: 704294 - protein, 17 aa, Mycobacterium
NRRAEATLFPRANSWYM

SEQ ID NO: 704295 - protein, 17 aa, Mycobacterium
NRRAEAWFRSGPGRGVR

SEQ ID NO: 704296 - protein, 20 aa, Mycobacterium
NRRARELLAELELDIDPRSQ

SEQ ID NO: 704297 - protein, 26 aa, Mycobacterium
NRRFAEATSRVAARGATVWVQDYQLQ

SEQ ID NO: 704298 - protein, 23 aa, Mycobacterium
NRRGCRRPGPHPAGRRGDPAPRR

SEQ ID NO: 704299 - protein, 23 aa, Mycobacterium
NRRGELDMSVVMVIANHPDLADA

SEQ ID NO: 704300 - protein, 20 aa, Mycobacterium
NRRGPLFWPTTCRITEFVPE

SEQ ID NO: 704301 - protein, 38 aa, Mycobacterium
NRRIKRLLGGAWELWWLKTPLPGVVWCNTPHMTGFDGA

SEQ ID NO: 704302 - protein, 24 aa, Mycobacterium
NRRLLEAICGYLGIVTRLTNSWDY

SEQ ID NO: 704303 - protein, 24 aa, Mycobacterium
NRRLLRPCYLAALSSLKNSPASRT

SEQ ID NO: 704304 - protein, 20 aa, Mycobacterium
NRRPARGVVVWSDAIEDDEI

SEQ ID NO: 704305 - protein, 23 aa, Mycobacterium
NRRPPCGIKTWLDRFEDDEITVV

SEQ ID NO: 704306 - protein, 26 aa, Mycobacterium
NRRRAEVSLGEILAWIEHNAHRELSL

SEQ ID NO: 704307 - protein, 27 aa, Mycobacterium
NRRRLELTRSFSLAAINPMALVQLRTT

SEQ ID NO: 704308 - protein, 22 aa, Mycobacterium
NRRRLIEFCLLATQYDALAATI

SEQ ID NO: 704309 - protein, 25 aa, Mycobacterium
NRRRRRGRRGRGRGRGEQGANDGQD

SEQ ID NO: 704310 - protein, 25 aa, Mycobacterium
NRRRRRGRRGRGRGRGEQGGPDGQN

SEQ ID NO: 704311 - protein, 33 aa, Mycobacterium
NRRTYVCPFHGWCWGLDGHNTFVLRPEAFAEEN

SEQ ID NO: 704312 - protein, 19 aa, Mycobacterium
NRRYALGPRLIRLGEVANR

SEQ ID NO: 704313 - protein, 19 aa, Mycobacterium
NRSACVRIPITGSNPKAKR

SEQ ID NO: 704314 - protein, 18 aa, Mycobacterium
NRSACVRIPITGTNPKAK

SEQ ID NO: 704315 - protein, 25 aa, Mycobacterium
NRSAFGVLECAPYRGIQGIDNKVIS

SEQ ID NO: 704316 - protein, 18 aa, Mycobacterium
NRSGHLVQLLAEVIGADH

SEQ ID NO: 704317 - protein, 17 aa, Mycobacterium
NRSGPLPAVAAIDGAVL

SEQ ID NO: 704318 - protein, 17 aa, Mycobacterium
NRSLDCVDDDLASSAHF

SEQ ID NO: 704319 - protein, 17 aa, Mycobacterium
NRSLDCVDDELAGAAHF

SEQ ID NO: 704320 - protein, 17 aa, Mycobacterium
NRSLDCVDDELASSAHF

SEQ ID NO: 704321 - protein, 17 aa, Mycobacterium
NRSLDCVDDELATSGHF

SEQ ID NO: 704322 - protein, 17 aa, Mycobacterium
NRSRIATRLKQVRTGKR

SEQ ID NO: 704323 - protein, 17 aa, Mycobacterium
NRSRLCRQIARRVRDEV

SEQ ID NO: 704324 - protein, 27 aa, Mycobacterium
NRSVDWAQVFPEWGLAGNAAFVVAPRA

SEQ ID NO: 704325 - protein, 18 aa, Mycobacterium
NRSWNCGFEGPSDDTGVN

SEQ ID NO: 704326 - protein, 18 aa, Mycobacterium
NRSWNCGVEGPTDDPAIN

SEQ ID NO: 704327 - protein, 18 aa, Mycobacterium
NRSWNCGVEGPTDDPDIA

SEQ ID NO: 704328 - protein, 22 aa, Mycobacterium
NRTAANYHLAWAMAAMSMRRPT

SEQ ID NO: 704329 - protein, 20 aa, Mycobacterium
NRTAFCEGYAAASGNDPRDS

SEQ ID NO: 704330 - protein, 17 aa, Mycobacterium
NRTDRPGHLTGRARVGR

SEQ ID NO: 704331 - protein, 25 aa, Mycobacterium
NRTGLREEWARRITEAELLTAMTPE

SEQ ID NO: 704332 - protein, 24 aa, Mycobacterium
NRTKLSEMPVLWAYARDLFQTPGF

SEQ ID NO: 704333 - protein, 17 aa, Mycobacterium
NRTNQHWIAELSQGEDA

SEQ ID NO: 704334 - protein, 22 aa, Mycobacterium
NRTTGGLYRWEGRYLRGDDQRA

SEQ ID NO: 704335 - protein, 25 aa, Mycobacterium
NRTVAYRNGRRWILDGEPVQGTAAA

SEQ ID NO: 704336 - protein, 17 aa, Mycobacterium
NRVAFVVDDIFSRDPWR

SEQ ID NO: 704337 - protein, 17 aa, Mycobacterium
NRVAHWLIGQGIGAEDR

SEQ ID NO: 704338 - protein, 17 aa, Mycobacterium
NRVECAVAYQAVLLCGA

SEQ ID NO: 704339 - protein, 26 aa, Mycobacterium
NRVEVAVDLRHDWPTALREAGFDPSA

SEQ ID NO: 704340 - protein, 24 aa, Mycobacterium
NRVGDTTRGMWVSGPIDPAKPNSW

SEQ ID NO: 704341 - protein, 19 aa, Mycobacterium
NRVGLDHIAFRLTTRDELD

SEQ ID NO: 704342 - protein, 20 aa, Mycobacterium
NRVGLDHIAFRVGSIDELNS

SEQ ID NO: 704343 - protein, 25 aa, Mycobacterium
NRVKTWLQFPQWFYLDLPVNTMVAP

SEQ ID NO: 704344 - protein, 25 aa, Mycobacterium
NRVKTWLQFPQWFYLNIPVNTMVAP

SEQ ID NO: 704345 - protein, 26 aa, Mycobacterium
NRVLPLLGGLAVMFGVLPPLPTTTRF

SEQ ID NO: 704346 - protein, 19 aa, Mycobacterium
NRVLVPFGVEADAYLVPAE

SEQ ID NO: 704347 - protein, 25 aa, Mycobacterium
NRVPRWWSVRELIAAFLSLRDSVVL

SEQ ID NO: 704348 - protein, 22 aa, Mycobacterium
NRVREVAAFIPGAMRGITSEKQ

SEQ ID NO: 704349 - protein, 25 aa, Mycobacterium
NRVRHVPVLDGKKLIGIVSIGDVVK

SEQ ID NO: 704350 - protein, 29 aa, Mycobacterium
NRVRHVPVLDGKKLIGIVSIGDVVKTRMQ

SEQ ID NO: 704351 - protein, 19 aa, Mycobacterium
NRVRLMVLVATNFFGQNTP

SEQ ID NO: 704352 - protein, 25 aa, Mycobacterium
NRVYLRCGMVPAPTDVLWDNHREQP

SEQ ID NO: 704353 - protein, 17 aa, Mycobacterium
NRWAILIKIHHCVADGV

SEQ ID NO: 704354 - protein, 19 aa, Mycobacterium
NRWGASFGTDVPRPLWPGS

SEQ ID NO: 704355 - protein, 19 aa, Mycobacterium
NRWHPDIPPVVTVKRGDTF

SEQ ID NO: 704356 - protein, 20 aa, Mycobacterium
NRWPHFGGRVARMAVHSALS

SEQ ID NO: 704357 - protein, 18 aa, Mycobacterium
NRWRNEVLLHNRAANRWD

SEQ ID NO: 704358 - protein, 19 aa, Mycobacterium
NRWSFKILVPPGYTGSFGP

SEQ ID NO: 704359 - protein, 19 aa, Mycobacterium
NRYFSPCADRFSDLLLAVN

SEQ ID NO: 704360 - protein, 25 aa, Mycobacterium
NRYGDFIARIDMGWEDLKVGVEFDG

SEQ ID NO: 704361 - protein, 20 aa, Mycobacterium
NRYLDCWDHPARVNGKRNGY

SEQ ID NO: 704362 - protein, 20 aa, Mycobacterium
NRYLPRFIRQFPFNVLLHDL

SEQ ID NO: 704363 - protein, 24 aa, Mycobacterium
NRYLRMVAAVTMGKSFASRGFTGA

SEQ ID NO: 704364 - protein, 28 aa, Mycobacterium
NRYLYPRVEVEVGFILNADLPGAGCTED

SEQ ID NO: 704365 - protein, 19 aa, Mycobacterium
NRYPIGLPPDVEDWRTAGP

SEQ ID NO: 704366 - protein, 19 aa, Mycobacterium
NRYPVGLPPNVPDWRTLGA

SEQ ID NO: 704367 - protein, 19 aa, Mycobacterium
NRYQPSVLWNDIGYPPKSN

SEQ ID NO: 704368 - protein, 20 aa, Mycobacterium
NRYVPEPDLVLFHDDGQRCL

SEQ ID NO: 704369 - protein, 17 aa, Mycobacterium
NSAACREAFRALELMVV

SEQ ID NO: 704370 - protein, 26 aa, Mycobacterium
NSADSAEYWHWVTLVQQAIVVITRDG

SEQ ID NO: 704371 - protein, 23 aa, Mycobacterium
NSAEYRGALQVATRQELVQRIGR

SEQ ID NO: 704372 - protein, 19 aa, Mycobacterium
NSAFRIAAEVLPEFDEHPG

SEQ ID NO: 704373 - protein, 24 aa, Mycobacterium
NSAGPCLEGWMLLSALAQETSRLR

SEQ ID NO: 704374 - protein, 27 aa, Mycobacterium
NSAGRYRPFYLRNLLDAVQGRTLDEAV

SEQ ID NO: 704375 - protein, 27 aa, Mycobacterium
NSAGRYRPFYLRNLLDAVQGRTLEEAV

SEQ ID NO: 704376 - protein, 29 aa, Mycobacterium
NSAGRYRPFYLRNLLDAVQGRTLRDAVEG

SEQ ID NO: 704377 - protein, 25 aa, Mycobacterium
NSAGRYRPFYLRNLLDVVQGRKLSD

SEQ ID NO: 704378 - protein, 27 aa, Mycobacterium
NSAHVPRHMFIPFGMGKHKCIGDSFAI

SEQ ID NO: 704379 - protein, 18 aa, Mycobacterium
NSAIARFAGPTAGSLPLK

SEQ ID NO: 704380 - protein, 34 aa, Mycobacterium
NSARPDSSIFGLSWAMAAPAWVAVAIPEPTTPKP

SEQ ID NO: 704381 - protein, 23 aa, Mycobacterium
NSARREAQFRRALESRDVIGQAK

SEQ ID NO: 704382 - protein, 25 aa, Mycobacterium
NSARSQLAAAAWRAQSPIPAESAGT

SEQ ID NO: 704383 - protein, 27 aa, Mycobacterium
NSASGDLAVKVLRGHARVASASGSVDI

SEQ ID NO: 704384 - protein, 27 aa, Mycobacterium
NSASVPWLRVGGLSALTVVGFAVAASS

SEQ ID NO: 704385 - protein, 21 aa, Mycobacterium
NSATGWPRRGSPNTRSATTAA

SEQ ID NO: 704386 - protein, 20 aa, Mycobacterium
NSCDCRKPGTGMLVRAAAEH

SEQ ID NO: 704387 - protein, 24 aa, Mycobacterium
NSCICAAVNDWLLDRWLDPDPTNR

SEQ ID NO: 704388 - protein, 25 aa, Mycobacterium
NSCRECPSCLAGLEQFCERGMVGTY

SEQ ID NO: 704389 - protein, 23 aa, Mycobacterium
NSDARLSVLNTEFMALANHRKTI

SEQ ID NO: 704390 - protein, 21 aa, Mycobacterium
NSDGFPEFPLPLGNPKDSTRS

SEQ ID NO: 704391 - protein, 18 aa, Mycobacterium
NSDGLYLLQRVRDEAHRF

SEQ ID NO: 704392 - protein, 18 aa, Mycobacterium
NSDIRWFDIEPCYVYHPL

SEQ ID NO: 704393 - protein, 24 aa, Mycobacterium
NSDKARSTMAWHRAVAADELHTAE

SEQ ID NO: 704394 - protein, 23 aa, Mycobacterium
NSDLDLVGCYAWSPDKVGRDAGE

SEQ ID NO: 704395 - protein, 24 aa, Mycobacterium
NSDPTRPGIRSTLLTVADLDATVI

SEQ ID NO: 704396 - protein, 23 aa, Mycobacterium
NSEGACPVCNGAGVIYTDLGVMA

SEQ ID NO: 704397 - protein, 25 aa, Mycobacterium
NSELYPVLCGSAFKNKGVQPMLDAV

SEQ ID NO: 704398 - protein, 25 aa, Mycobacterium
NSEWIKRYAPRYVTGLQLGTSGDDG

SEQ ID NO: 704399 - protein, 23 aa, Mycobacterium
NSEYAGYFDIDWDLDEHGRIVLP

SEQ ID NO: 704400 - protein, 19 aa, Mycobacterium
NSFGAFVPKGITLRIYGDA

SEQ ID NO: 704401 - protein, 21 aa, Mycobacterium
NSFGAFVPKGITLRVYGDAND

SEQ ID NO: 704402 - protein, 21 aa, Mycobacterium
NSFGLRLAVLGPLENADLVGL

SEQ ID NO: 704403 - protein, 18 aa, Mycobacterium
NSFLEILYGYEWELTKSP

SEQ ID NO: 704404 - protein, 35 aa, Mycobacterium
NSFSKYFAMTGWRLGWLLVPEKLRRAVDCLTGNFT

SEQ ID NO: 704405 - protein, 30 aa, Mycobacterium
NSFSKYYAMTGWRLGWLLVPAELRRAVDRL

SEQ ID NO: 704406 - protein, 26 aa, Mycobacterium
NSGAQRATHEWLCVRTDPDAVRHRGI

SEQ ID NO: 704407 - protein, 25 aa, Mycobacterium
NSGAQRATHEWLCVRTDPTTARHRG

SEQ ID NO: 704408 - protein, 23 aa, Mycobacterium
NSGDPSWPDAITMIEKANAAGGD

SEQ ID NO: 704409 - protein, 25 aa, Mycobacterium
NSGIRDAFNLGWKLAAVVRGQAGDA

SEQ ID NO: 704410 - protein, 37 aa, Mycobacterium
NSGNRNNGYFWRADDRGQFGFDFGITMPGIPLNIGVN

SEQ ID NO: 704411 - protein, 25 aa, Mycobacterium
NSGNTLPGLFGHRMDDPDFWVAGAT

SEQ ID NO: 704412 - protein, 18 aa, Mycobacterium
NSGSFVYGIGNTAMTGFS

SEQ ID NO: 704413 - protein, 18 aa, Mycobacterium
NSGTGNWGIGNSGNSYNT

SEQ ID NO: 704414 - protein, 19 aa, Mycobacterium
NSGTGNWGIGNSGNYNTGV

SEQ ID NO: 704415 - protein, 18 aa, Mycobacterium
NSGTGNWGIGNSGSHNSG

SEQ ID NO: 704416 - protein, 19 aa, Mycobacterium
NSGTGNWGIGNSGSLNTGF

SEQ ID NO: 704417 - protein, 19 aa, Mycobacterium
NSGTGNWGIGNSGSYNTGI

SEQ ID NO: 704418 - protein, 17 aa, Mycobacterium
NSGVPLILLLSLLSFVP

SEQ ID NO: 704419 - protein, 23 aa, Mycobacterium
NSHGLRLADLVFVGLGAIPTTTS

SEQ ID NO: 704420 - protein, 18 aa, Mycobacterium
NSHVAFGFGTHFCLGNQL

SEQ ID NO: 704421 - protein, 18 aa, Mycobacterium
NSIALFAEYIEWRASHPS

SEQ ID NO: 704422 - protein, 24 aa, Mycobacterium
NSIDRPGGLPWDGVTARAIQDTAA

SEQ ID NO: 704423 - protein, 20 aa, Mycobacterium
NSIDTAAGWLAPLGGVHLRS

SEQ ID NO: 704424 - protein, 27 aa, Mycobacterium
NSIDWAYAVLACWKLGAVPQPLSARMP

SEQ ID NO: 704425 - protein, 25 aa, Mycobacterium
NSIECPEEAEAILAEILALLGRSWS

SEQ ID NO: 704426 - protein, 24 aa, Mycobacterium
NSIGGFRNAMTFVLTGLNIEAKAE

SEQ ID NO: 704427 - protein, 24 aa, Mycobacterium
NSIGGFRNSMTFVLTGLDIEAKAD

SEQ ID NO: 704428 - protein, 23 aa, Mycobacterium
NSIRARADRVISWLERSGTDVLA

SEQ ID NO: 704429 - protein, 24 aa, Mycobacterium
NSIRMMSMAGRWRKRGADITFAQL

SEQ ID NO: 704430 - protein, 25 aa, Mycobacterium
NSIRSRLPRVLDWLARTDVDVLAMQ

SEQ ID NO: 704431 - protein, 18 aa, Mycobacterium
NSISGLSVPSAWTVSAPA

SEQ ID NO: 704432 - protein, 18 aa, Mycobacterium
NSKCLRASAGSIFSIPVI

SEQ ID NO: 704433 - protein, 30 aa, Mycobacterium
NSKIAEWFEARWTDRFSLPITGEIIQLISE

SEQ ID NO: 704434 - protein, 19 aa, Mycobacterium
NSLARAIRFGHKVIEAAWS

SEQ ID NO: 704435 - protein, 35 aa, Mycobacterium
NSLCAGSGSGLRELKCGYHGWTWDLTGELRRVPNR

SEQ ID NO: 704436 - protein, 31 aa, Mycobacterium
NSLEELIFWQIWSSLALKPERPWLELNSRDP

SEQ ID NO: 704437 - protein, 19 aa, Mycobacterium
NSLGGWVAFELERRGRART

SEQ ID NO: 704438 - protein, 17 aa, Mycobacterium
NSLGPMMIMLPRTRLGD

SEQ ID NO: 704439 - protein, 25 aa, Mycobacterium
NSLIPGPNNWWGFQPNDYKIIFHDL

SEQ ID NO: 704440 - protein, 22 aa, Mycobacterium
NSLKIYRANAIRSFTHVRRDHY

SEQ ID NO: 704441 - protein, 22 aa, Mycobacterium
NSLLRRVFRPFIVKRILEIAAV

SEQ ID NO: 704442 - protein, 19 aa, Mycobacterium
NSLPGQWTAHVTIARRVGG

SEQ ID NO: 704443 - protein, 20 aa, Mycobacterium
NSLPPFAIETPMLRRQQSEG

SEQ ID NO: 704444 - protein, 23 aa, Mycobacterium
NSLRAVTLGGDWVGADLARRLAR

SEQ ID NO: 704445 - protein, 29 aa, Mycobacterium
NSLSDLLVFGRRAGLGAADYVKSLTSRPQ

SEQ ID NO: 704446 - protein, 31 aa, Mycobacterium
NSLSDLLVFGRRAGLGAADYVRALPDRPKVS

SEQ ID NO: 704447 - protein, 30 aa, Mycobacterium; identical to SEQ ID NO: 203686

SEQ ID NO: 704448 - protein, 30 aa, Mycobacterium; identical to SEQ ID NO: 82885

SEQ ID NO: 704449 - protein, 28 aa, Mycobacterium
NSLSDLLVFGRRAGLGASDYVRSLDNRP

SEQ ID NO: 704450 - protein, 18 aa, Mycobacterium
NSLYTSLELMSGFEPHRP

SEQ ID NO: 704451 - protein, 18 aa, Mycobacterium
NSMEAVGGPSTWRLGGAF

SEQ ID NO: 704452 - protein, 18 aa, Mycobacterium
NSMEAVGGRSTWRLGGAF

SEQ ID NO: 704453 - protein, 18 aa, Mycobacterium
NSMKRAGAGVPLVHSTPM

SEQ ID NO: 704454 - protein, 18 aa, Mycobacterium
NSMLFRLLRPAIARPVME

SEQ ID NO: 704455 - protein, 23 aa, Mycobacterium
NSMNCLTEALGLALPGNGSVLAT

SEQ ID NO: 704456 - protein, 23 aa, Mycobacterium
NSMNCLTEALGLAPPGNGTTLAT

SEQ ID NO: 704457 - protein, 23 aa, Mycobacterium
NSMNCLVEALGLALPGNGSLLAT

SEQ ID NO: 704458 - protein, 29 aa, Mycobacterium
NSNALALAEAWKPATLRIVSKAEPGGLVE

SEQ ID NO: 704459 - protein, 18 aa, Mycobacterium
NSNKRIIVLDTIYDDFVT

SEQ ID NO: 704460 - protein, 25 aa, Mycobacterium
NSNYILLGMILEWCDAQYGTGRDIR

SEQ ID NO: 704461 - protein, 18 aa, Mycobacterium
NSPCPIKRRRARRGSGEL

SEQ ID NO: 704462 - protein, 25 aa, Mycobacterium
NSPDGYRTEVEWATQMSYSGIYVHS

SEQ ID NO: 704463 - protein, 20 aa, Mycobacterium
NSPGFLGFQLLRPVKGEDRY

SEQ ID NO: 704464 - protein, 24 aa, Mycobacterium
NSPHVVAVGFTFDPATHIARVITT

SEQ ID NO: 704465 - protein, 18 aa, Mycobacterium
NSPHVVAVGFTFDPTTHI

SEQ ID NO: 704466 - protein, 25 aa, Mycobacterium
NSPNGYRTEVDWATQMSYSGVFVHS

SEQ ID NO: 704467 - protein, 17 aa, Mycobacterium
NSPRFALSTGDGLNHVL

SEQ ID NO: 704468 - protein, 31 aa, Mycobacterium
NSPSAPWPGHFTITPSECRVILLDAAPSVLP

SEQ ID NO: 704469 - protein, 26 aa, Mycobacterium
NSPYGACPECLGLGIRKEVDPDLVVP

SEQ ID NO: 704470 - protein, 19 aa, Mycobacterium
NSQGVPWMGSYVTANGDPT

SEQ ID NO: 704471 - protein, 23 aa, Mycobacterium
NSQLRLSGCVLRRVELQCASTLK

SEQ ID NO: 704472 - protein, 18 aa, Mycobacterium
NSQPWRWAAEGSRLEPTL

SEQ ID NO: 704473 - protein, 17 aa, Mycobacterium
NSQPWRWVAASGAVDLF

SEQ ID NO: 704474 - protein, 17 aa, Mycobacterium
NSQPWRWVVERNANVYA

SEQ ID NO: 704475 - protein, 23 aa, Mycobacterium
NSRFMFDYIPPVFKGQYAESEQE

SEQ ID NO: 704476 - protein, 30 aa, Mycobacterium
NSRFTIHAGEGFGLPSIHEAIAFCGADRLG

SEQ ID NO: 704477 - protein, 18 aa, Mycobacterium
NSRMAEAITIAREVAEQV

SEQ ID NO: 704478 - protein, 18 aa, Mycobacterium
NSRMGEAITIARGTAAAV

SEQ ID NO: 704479 - protein, 20 aa, Mycobacterium
NSRPEFRVLRQAATAVRYWL

SEQ ID NO: 704480 - protein, 22 aa, Mycobacterium
NSRTAGHRWAWQTKSWSHGQVD

SEQ ID NO: 704481 - protein, 19 aa, Mycobacterium
NSRVLKWIVDRIEHRAGGQ

SEQ ID NO: 704482 - protein, 19 aa, Mycobacterium
NSRVLKWIVERIEHRAGGR

SEQ ID NO: 704483 - protein, 23 aa, Mycobacterium
NSRVRVADVFVGRVRAIGLKNWI

SEQ ID NO: 704484 - protein, 20 aa, Mycobacterium
NSRVSTNWMPQITRPTQADF

SEQ ID NO: 704485 - protein, 18 aa, Mycobacterium
NSSMPVHRYRSFTDEVEK

SEQ ID NO: 704486 - protein, 18 aa, Mycobacterium
NSSPLQALQDLTLNAINA

SEQ ID NO: 704487 - protein, 22 aa, Mycobacterium
NSSVMKLVIERLYSCSGLLNEN

SEQ ID NO: 704488 - protein, 23 aa, Mycobacterium
NSSYRMEQGFTFELNLAGVADEH

SEQ ID NO: 704489 - protein, 23 aa, Mycobacterium
NSSYRMEQGFTFELNLAGVSDEH

SEQ ID NO: 704490 - protein, 20 aa, Mycobacterium
NSTCGACFGYHMGVVGPGEV

SEQ ID NO: 704491 - protein, 23 aa, Mycobacterium
NSTCLNCGSALGFSLDQMALLVI

SEQ ID NO: 704492 - protein, 17 aa, Mycobacterium
NSTELLEIGAIRPILAG

SEQ ID NO: 704493 - protein, 31 aa, Mycobacterium
NSTGELPTLFAWRIADYWKWTRYPDPADYQL

SEQ ID NO: 704494 - protein, 24 aa, Mycobacterium
NSTGMCAALGLLAAIISGRGGQVD

SEQ ID NO: 704495 - protein, 25 aa, Mycobacterium
NSTGMCAALGLLAMIVSGRGGQVDV

SEQ ID NO: 704496 - protein, 19 aa, Mycobacterium
NSTNPIHWSNATHACTCEV

SEQ ID NO: 704497 - protein, 24 aa, Mycobacterium
NSTRTRFSFEMGIAQLGGHAIVVD

SEQ ID NO: 704498 - protein, 21 aa, Mycobacterium
NSTYRIPLFAFRGTPTGIDAR

SEQ ID NO: 704499 - protein, 22 aa, Mycobacterium
NSVAPGYIWGETLQGYFNHQAG

SEQ ID NO: 704500 - protein, 27 aa, Mycobacterium
NSVDAVLVAQAWHWFDPELAVKEVSRV

SEQ ID NO: 704501 - protein, 25 aa, Mycobacterium
NSVDAVLVAQAWHWVDPERAIPEVA

SEQ ID NO: 704502 - protein, 17 aa, Mycobacterium
NSVELRHSFFYADGAED

SEQ ID NO: 704503 - protein, 20 aa, Mycobacterium
NSVEVADAFVPVIDGKEQVG

SEQ ID NO: 704504 - protein, 23 aa, Mycobacterium
NSVFPGQLNSFGVGNSGTGNLGF

SEQ ID NO: 704505 - protein, 32 aa, Mycobacterium
NSVINFAWAEARYFLPPLPPLPGLALQTTTDA

SEQ ID NO: 704506 - protein, 24 aa, Mycobacterium
NSVKYRVQRAIKRRGRPLTDDRLD

SEQ ID NO: 704507 - protein, 18 aa, Mycobacterium
NSVLCTNESVLIAEDAVA

SEQ ID NO: 704508 - protein, 19 aa, Mycobacterium
NSVNLGWSAWAIDWLTQTP

SEQ ID NO: 704509 - protein, 20 aa, Mycobacterium
NSVPPFACHVLGVIWNSPSA

SEQ ID NO: 704510 - protein, 26 aa, Mycobacterium
NSVPSAWRLGVRMLAQGTLAWGSLTG

SEQ ID NO: 704511 - protein, 21 aa, Mycobacterium
NSVTPWYGFFVNVGVGSVEID

SEQ ID NO: 704512 - protein, 24 aa, Mycobacterium
NSVVHFFGPYAYRSVFHSTTPEEE

SEQ ID NO: 704513 - protein, 20 aa, Mycobacterium
NSWPQARLTLALSPATLPKM

SEQ ID NO: 704514 - protein, 19 aa, Mycobacterium
NSWQARVSYRAEATITGSG

SEQ ID NO: 704515 - protein, 31 aa, Mycobacterium; identical to SEQ ID NO: 82892

SEQ ID NO: 704516 - protein, 24 aa, Mycobacterium
NSYEIYRLDAVPGTEKLPYSLKVL

SEQ ID NO: 704517 - protein, 19 aa, Mycobacterium
NSYFGGLVHGLWRGGIGTT

SEQ ID NO: 704518 - protein, 20 aa, Mycobacterium
NSYGRAGLRAAATTALDASR

SEQ ID NO: 704519 - protein, 18 aa, Mycobacterium
NSYLRRHDTFRSWFEDAG

SEQ ID NO: 704520 - protein, 31 aa, Mycobacterium
NSYVFAAELFPRMAIPQSWYDAGIAHRADDF

SEQ ID NO: 704521 - protein, 18 aa, Mycobacterium
NTAAWARALGRIVAAVPG

SEQ ID NO: 704522 - protein, 22 aa, Mycobacterium
NTAELKRIWTSSAHRRQGLAGR

SEQ ID NO: 704523 - protein, 17 aa, Mycobacterium
NTAGGSMARRLRLNSRM

SEQ ID NO: 704524 - protein, 19 aa, Mycobacterium
NTAGLAWAVNLGCVDLNPH

SEQ ID NO: 704525 - protein, 18 aa, Mycobacterium
NTAPAMLLTVGFPPTAAA

SEQ ID NO: 704526 - protein, 23 aa, Mycobacterium
NTAQAFTDGWFRTGDLGALDADG

SEQ ID NO: 704527 - protein, 25 aa, Mycobacterium
NTASELFAGQGIRAVGIDLILREAG

SEQ ID NO: 704528 - protein, 25 aa, Mycobacterium
NTASRRPAAAYAFSKLAIALFTREL

SEQ ID NO: 704529 - protein, 28 aa, Mycobacterium
NTATGGFRSGDMSGFFNTAAGGSSYTGV

SEQ ID NO: 704530 - protein, 18 aa, Mycobacterium
NTAWQAGKTVTFMPKPLF

SEQ ID NO: 704531 - protein, 21 aa, Mycobacterium
NTAYHPWLRRIAAQHRGDVLD

SEQ ID NO: 704532 - protein, 27 aa, Mycobacterium
NTCAAALPHLVARGGGSLVNISSSAGI

SEQ ID NO: 704533 - protein, 21 aa, Mycobacterium
NTCSDVAAAMHALIDGVVVDS

SEQ ID NO: 704534 - protein, 25 aa, Mycobacterium
NTDDLIRWAIAHERAAEACGQARAD

SEQ ID NO: 704535 - protein, 24 aa, Mycobacterium
NTDEPYTALAVVWSFLLDTSAGLG

SEQ ID NO: 704536 - protein, 26 aa, Mycobacterium
NTDHRPEILLSFGFVPKMESEVGLID

SEQ ID NO: 704537 - protein, 26 aa, Mycobacterium
NTDHRPEILLSFGFVPKMESRVGLIN

SEQ ID NO: 704538 - protein, 17 aa, Mycobacterium
NTDWEWIEAAADAVTTA

SEQ ID NO: 704539 - protein, 23 aa, Mycobacterium
NTEARIAGDMGIYAQTLMLAMTA

SEQ ID NO: 704540 - protein, 19 aa, Mycobacterium
NTEAWQRCAHFTEVRESGG

SEQ ID NO: 704541 - protein, 19 aa, Mycobacterium
NTEAWQRCAHFTEVRNSGG

SEQ ID NO: 704542 - protein, 25 aa, Mycobacterium
NTEAYLRYFLRGVLESGAVDEPTFR

SEQ ID NO: 704543 - protein, 28 aa, Mycobacterium
NTFAEVWHFPPWFGRNAAAFDDFMRDLD

SEQ ID NO: 704544 - protein, 18 aa, Mycobacterium
NTFEAGAVWASRNGGPDQ

SEQ ID NO: 704545 - protein, 17 aa, Mycobacterium
NTFEVIGPWEIDRGPQL

SEQ ID NO: 704546 - protein, 26 aa, Mycobacterium
NTGDRPALAISLWAQYMLDNFATVAE

SEQ ID NO: 704547 - protein, 33 aa, Mycobacterium
NTGEMNNGIFYRGVGQGNFYFSITTPDLTLPPL

SEQ ID NO: 704548 - protein, 19 aa, Mycobacterium
NTGGISWEQVVNGDAALGA

SEQ ID NO: 704549 - protein, 18 aa, Mycobacterium
NTGGLLLVTHDRWFLDEI

SEQ ID NO: 704550 - protein, 18 aa, Mycobacterium
NTGGLLLVTHDRWFLDEV

SEQ ID NO: 704551 - protein, 22 aa, Mycobacterium
NTGIALDPDWLFDIQVKRIHEY

SEQ ID NO: 704552 - protein, 26 aa, Mycobacterium
NTGIPGVLGPTISGRNSGFFNVGTAV

SEQ ID NO: 704553 - protein, 21 aa, Mycobacterium
NTGLRGIYRGVARAAGLPPLV

SEQ ID NO: 704554 - protein, 25 aa, Mycobacterium
NTGPVDGNRNFGFGNWGNANLGSGN

SEQ ID NO: 704555 - protein, 24 aa, Mycobacterium
NTGRRAGEEIAEIYAGLPESAQEP

SEQ ID NO: 704556 - protein, 24 aa, Mycobacterium
NTHGVSWLPLYHDMGLSMIGFPAV

SEQ ID NO: 704557 - protein, 24 aa, Mycobacterium
NTHVPEFLERIGIGAPEVEQDMIN

SEQ ID NO: 704558 - protein, 25 aa, Mycobacterium
NTHVRAGSVSKVFVAAMILQLVAEG

SEQ ID NO: 704559 - protein, 19 aa, Mycobacterium
NTIGLRLATLGPLENADYI

SEQ ID NO: 704560 - protein, 18 aa, Mycobacterium
NTIGYQILSEGLNFDASG

SEQ ID NO: 704561 - protein, 17 aa, Mycobacterium
NTIKSAIVDAWRGLTSN

SEQ ID NO: 704562 - protein, 18 aa, Mycobacterium
NTIPRGGVLATQRLLDEL

SEQ ID NO: 704563 - protein, 22 aa, Mycobacterium
NTIRWAWAPGDVAMWDNRATQH

SEQ ID NO: 704564 - protein, 18 aa, Mycobacterium
NTKASWKAFQKMSRTNWG

SEQ ID NO: 704565 - protein, 18 aa, Mycobacterium
NTKLRLLAERVVGDPDGR

SEQ ID NO: 704566 - protein, 22 aa, Mycobacterium
NTKRYMHHYNFPPYSTGETGRV

SEQ ID NO: 704567 - protein, 24 aa, Mycobacterium
NTLCPHLARPVPFIYPLQTRFDRA

SEQ ID NO: 704568 - protein, 18 aa, Mycobacterium
NTLFRRILVEQRAALAEV

SEQ ID NO: 704569 - protein, 24 aa, Mycobacterium
NTLILAALGWKGFWVGGQDLAVTV

SEQ ID NO: 704570 - protein, 17 aa, Mycobacterium
NTLLVCTDFGPGSMTES

SEQ ID NO: 704571 - protein, 19 aa, Mycobacterium
NTLPYGFDFSRPVSRFEEA

SEQ ID NO: 704572 - protein, 20 aa, Mycobacterium
NTLPYGFDFSRPVSRFEEAL

SEQ ID NO: 704573 - protein, 24 aa, Mycobacterium
NTLREISIELSVFGSEGRQGKLDA

SEQ ID NO: 704574 - protein, 21 aa, Mycobacterium
NTMLPDVRFAPNPADEPPERD

SEQ ID NO: 704575 - protein, 22 aa, Mycobacterium
NTMMWTASTIKLAMVVDLLTRA

SEQ ID NO: 704576 - protein, 27 aa, Mycobacterium
NTMNSRGRFAMKMARPPERFTDGLLRA

SEQ ID NO: 704577 - protein, 20 aa, Mycobacterium
NTNGIYVCRAIVSHRMPDGV

SEQ ID NO: 704578 - protein, 18 aa, Mycobacterium
NTNLKIAHRLVVGDDREA

SEQ ID NO: 704579 - protein, 23 aa, Mycobacterium
NTNPAMLGGIFGLSSNGANIGNI

SEQ ID NO: 704580 - protein, 30 aa, Mycobacterium
NTPAPLPCTPRGIVHLLRRYDVELAGAHVV

SEQ ID NO: 704581 - protein, 24 aa, Mycobacterium
NTPDEAFEAWKRCSAGRPCDYTGL

SEQ ID NO: 704582 - protein, 23 aa, Mycobacterium
NTPEAQAAVLSALRSALDEAGDV

SEQ ID NO: 704583 - protein, 18 aa, Mycobacterium
NTPEELYPLTGTKSLTLD

SEQ ID NO: 704584 - protein, 24 aa, Mycobacterium
NTPEGLYPLTAIKDLPLNTSVANG

SEQ ID NO: 704585 - protein, 18 aa, Mycobacterium
NTPEGLYPLTQIKDLPLT

SEQ ID NO: 704586 - protein, 22 aa, Mycobacterium
NTPELRARIAATIEALKPDVVI

SEQ ID NO: 704587 - protein, 31 aa, Mycobacterium; identical to SEQ ID NO: 82897

SEQ ID NO: 704588 - protein, 18 aa, Mycobacterium
NTPHVPIPYVYPVDLRFL

SEQ ID NO: 704589 - protein, 18 aa, Mycobacterium
NTPKAIAALDGWATDALD

SEQ ID NO: 704590 - protein, 23 aa, Mycobacterium
NTPKALAALDGWATDALEYGGHD

SEQ ID NO: 704591 - protein, 27 aa, Mycobacterium
NTPLKRWQLCLDVNLTGVFLVTKAVIP

SEQ ID NO: 704592 - protein, 17 aa, Mycobacterium
NTPRNFAKRGVRSIVLP

SEQ ID NO: 704593 - protein, 22 aa, Mycobacterium
NTPRNFARRGIRSYVLPSSASF

SEQ ID NO: 704594 - protein, 28 aa, Mycobacterium
NTPTQALLGRPLIGNGANGTTVNGVGTP

SEQ ID NO: 704595 - protein, 26 aa, Mycobacterium
NTPVVWRGPMLHRALQQFLADVFWGD

SEQ ID NO: 704596 - protein, 24 aa, Mycobacterium
NTPWGCISCAYGWQAAVGTLTQLR

SEQ ID NO: 704597 - protein, 18 aa, Mycobacterium
NTQDWRWLVITDPDKRAA

SEQ ID NO: 704598 - protein, 25 aa, Mycobacterium
NTQICPVCLGLPGSLPVVNEKAVES

SEQ ID NO: 704599 - protein, 25 aa, Mycobacterium
NTQVCPVCLGLPGSLPVLNQSAVES

SEQ ID NO: 704600 - protein, 25 aa, Mycobacterium
NTQVCPVCLGLPGSLPVLNQTAVES

SEQ ID NO: 704601 - protein, 25 aa, Mycobacterium
NTQVCPVCLGLPGSLPVLNQVAVES

SEQ ID NO: 704602 - protein, 28 aa, Mycobacterium
NTQVCPVCLGLPGSLPVLNRAAVESAIR

SEQ ID NO: 704603 - protein, 28 aa, Mycobacterium
NTQVCPVCLGLPGSLPVLNRTAVESAIR

SEQ ID NO: 704604 - protein, 24 aa, Mycobacterium
NTRARRLTVLGQFFRFARNRRVVL

SEQ ID NO: 704605 - protein, 23 aa, Mycobacterium
NTREVLEITGLAPLIEHRVDGVT

SEQ ID NO: 704606 - protein, 19 aa, Mycobacterium
NTRFPNSMVDRITPVTTPE

SEQ ID NO: 704607 - protein, 17 aa, Mycobacterium
NTRGSGLASAYAAVCSG

SEQ ID NO: 704608 - protein, 25 aa, Mycobacterium
NTSHFRCPYHGWTYRNTGTLAGVPA

SEQ ID NO: 704609 - protein, 22 aa, Mycobacterium
NTSILDISWAYNILSDAPTTLN

SEQ ID NO: 704610 - protein, 25 aa, Mycobacterium
NTSPHLQAAVAFKNFQYTAAAQKVW

SEQ ID NO: 704611 - protein, 18 aa, Mycobacterium
NTSRASYFVWTYLKSTGD

SEQ ID NO: 704612 - protein, 17 aa, Mycobacterium
NTSSAAGIFGNFGQTNY

SEQ ID NO: 704613 - protein, 18 aa, Mycobacterium
NTSSFGIGFANGGVTGNV

SEQ ID NO: 704614 - protein, 25 aa, Mycobacterium
NTSWDEAKFEICAHRWVHVGESGYG

SEQ ID NO: 704615 - protein, 22 aa, Mycobacterium
NTTCSYPQVIAALNAQDPQFGK

SEQ ID NO: 704616 - protein, 29 aa, Mycobacterium
NTTDWPDNGKAAGYLFSWTNEASSGPEAH

SEQ ID NO: 704617 - protein, 28 aa, Mycobacterium
NTTFGVEALLRWRVGGVEIPAGEIVALA

SEQ ID NO: 704618 - protein, 18 aa, Mycobacterium
NTTFLEWYGEFDCEPAVL

SEQ ID NO: 704619 - protein, 19 aa, Mycobacterium
NTTIPTKRSETFTTADDNQ

SEQ ID NO: 704620 - protein, 22 aa, Mycobacterium
NTTKPWFAIGGIDAQRLPDVLD

SEQ ID NO: 704621 - protein, 24 aa, Mycobacterium
NTTQLRPLIGVALQEVALDLWMSP

SEQ ID NO: 704622 - protein, 22 aa, Mycobacterium
NTTRRPAPMLGEHNEEILRELG

SEQ ID NO: 704623 - protein, 17 aa, Mycobacterium
NTVAWLVSEDARYITGV

SEQ ID NO: 704624 - protein, 21 aa, Mycobacterium
NTVCMAGLWSVWKPNNAAAPL

SEQ ID NO: 704625 - protein, 19 aa, Mycobacterium
NTVDWQFAATVGERLARPG

SEQ ID NO: 704626 - protein, 20 aa, Mycobacterium
NTVIPGPIRTPGLEGLAPDG

SEQ ID NO: 704627 - protein, 25 aa, Mycobacterium
NTVKYRVGRAVARRGRDIGGDRLDV

SEQ ID NO: 704628 - protein, 17 aa, Mycobacterium
NTVLAPVVGEAIRRQGG

SEQ ID NO: 704629 - protein, 19 aa, Mycobacterium
NTVLARWIPKDDPAQVAKQ

SEQ ID NO: 704630 - protein, 18 aa, Mycobacterium
NTVLEFSNTVTRVHEDPR

SEQ ID NO: 704631 - protein, 20 aa, Mycobacterium
NTVLWGGYTWEYWRATRSVR

SEQ ID NO: 704632 - protein, 20 aa, Mycobacterium
NTVLWGGYTWEYWRDTRSIK

SEQ ID NO: 704633 - protein, 25 aa, Mycobacterium
NTVNIGKFNLCFGGIGLSTHAFYES

SEQ ID NO: 704634 - protein, 17 aa, Mycobacterium
NTVPLRIKMTAPDYAGL

SEQ ID NO: 704635 - protein, 18 aa, Mycobacterium
NTVPLRIRLNAASYAALL

SEQ ID NO: 704636 - protein, 18 aa, Mycobacterium
NTVPRGGVLGTQRLLDEL

SEQ ID NO: 704637 - protein, 18 aa, Mycobacterium
NTVPRGGVLGTQRLLDVL

SEQ ID NO: 704638 - protein, 18 aa, Mycobacterium
NTVQRFFVEYARRRGSVL

SEQ ID NO: 704639 - protein, 24 aa, Mycobacterium
NTVRYRLKRITDFTGRDPMQPRDA

SEQ ID NO: 704640 - protein, 24 aa, Mycobacterium
NTVRYRLKRITDFTGRDPTQPRDA

SEQ ID NO: 704641 - protein, 24 aa, Mycobacterium
NTVRYRLKRITDFTGRDPTSPRDA

SEQ ID NO: 704642 - protein, 24 aa, Mycobacterium
NTVRYRLKRITDFTGRDPTVPRDA

SEQ ID NO: 704643 - protein, 30 aa, Mycobacterium
NTVVWKPASTVPVLAIRFAQALTEAGLPAG

SEQ ID NO: 704644 - protein, 23 aa, Mycobacterium
NTVWKPTVPLGYGRTYTLTVASR

SEQ ID NO: 704645 - protein, 19 aa, Mycobacterium
NTVWSTGCDSWYLGADGVP

SEQ ID NO: 704646 - protein, 21 aa, Mycobacterium
NTWDCPAHVYLRRALTSTELW

SEQ ID NO: 704647 - protein, 25 aa, Mycobacterium
NTWIKRFLAGEFVGGGWTEANNGTL

SEQ ID NO: 704648 - protein, 17 aa, Mycobacterium
NTWMYRRNGGEGLGGTF

SEQ ID NO: 704649 - protein, 18 aa, Mycobacterium
NTYARLALGIGVHDITAG

SEQ ID NO: 704650 - protein, 23 aa, Mycobacterium
NTYDLSSLFLLASTAALFSTSIK

SEQ ID NO: 704651 - protein, 23 aa, Mycobacterium
NTYDLWFTPWAPRSNTNGLGATP

SEQ ID NO: 704652 - protein, 20 aa, Mycobacterium
NTYSRLALGIGVHDITAGYR

SEQ ID NO: 704653 - protein, 18 aa, Mycobacterium
NTYSRLALGVGVHDITAG

SEQ ID NO: 704654 - protein, 18 aa, Mycobacterium
NTYYDWFLDHDFIAFYGT

SEQ ID NO: 704655 - protein, 25 aa, Mycobacterium
NVAAAFRRSAARPAVHAVVDALRDH

SEQ ID NO: 704656 - protein, 20 aa, Mycobacterium
NVAAALPTTGILAAGADDVS

SEQ ID NO: 704657 - protein, 18 aa, Mycobacterium
NVAAEVKPAAVVLATSAY

SEQ ID NO: 704658 - protein, 17 aa, Mycobacterium
NVAAFAFHGHVTKSDYD

SEQ ID NO: 704659 - protein, 18 aa, Mycobacterium
NVAAGLCHSDLHLTDGDM

SEQ ID NO: 704660 - protein, 25 aa, Mycobacterium
NVAAKRYPAILAMTSLNDTRVYYVE

SEQ ID NO: 704661 - protein, 22 aa, Mycobacterium
NVADNGLCFGRLDTLDDARLYI

SEQ ID NO: 704662 - protein, 23 aa, Mycobacterium
NVAELEALVALTHCLVVDLDRKL

SEQ ID NO: 704663 - protein, 19 aa, Mycobacterium
NVAGAKRCADEAVSVTTGW

SEQ ID NO: 704664 - protein, 17 aa, Mycobacterium
NVAGMVSVFGRRTDVEG

SEQ ID NO: 704665 - protein, 18 aa, Mycobacterium
NVAGRWLIKSSKLTRLRE

SEQ ID NO: 704666 - protein, 23 aa, Mycobacterium
NVAISCDGCSVSVSGVSHTVEIL

SEQ ID NO: 704667 - protein, 17 aa, Mycobacterium
NVAISRAQYAAVVVRSE

SEQ ID NO: 704668 - protein, 25 aa, Mycobacterium
NVALSVPVSGTWIDIRFSLPPNTVD

SEQ ID NO: 704669 - protein, 22 aa, Mycobacterium
NVANCLLAVALLDAVDVSPEQA

SEQ ID NO: 704670 - protein, 23 aa, Mycobacterium
NVANCLVALAILDAVGVSPEQAS

SEQ ID NO: 704671 - protein, 18 aa, Mycobacterium
NVAPLFHTRYEPIWRLCS

SEQ ID NO: 704672 - protein, 30 aa, Mycobacterium
NVAPMSAALCKRLLWDSAIHHYTPRQVAAL

SEQ ID NO: 704673 - protein, 33 aa, Mycobacterium
NVARAEWLQALADLCRKREIILIVDDVQMGCGR

SEQ ID NO: 704674 - protein, 25 aa, Mycobacterium
NVARFPTFDWPRIDAPYIRPDADMD

SEQ ID NO: 704675 - protein, 26 aa, Mycobacterium
NVATSREGGRFVGRAAGDDSFDAEQS

SEQ ID NO: 704676 - protein, 20 aa, Mycobacterium
NVAVSLGRSRLVVVDCDTTE

SEQ ID NO: 704677 - protein, 20 aa, Mycobacterium
NVCASYRLTGTVDVGRLHRA

SEQ ID NO: 704678 - protein, 17 aa, Mycobacterium
NVCVSYRVTGGVDVERL

SEQ ID NO: 704679 - protein, 22 aa, Mycobacterium
NVDADLCAKVAAGLGLPAPKGN

SEQ ID NO: 704680 - protein, 26 aa, Mycobacterium
NVDAFMEVCRKWDVLATVIGEVTDSG

SEQ ID NO: 704681 - protein, 22 aa, Mycobacterium
NVDAYRPLALELVAQLGKVDVL

SEQ ID NO: 704682 - protein, 23 aa, Mycobacterium
NVDGELPPGVSAKDIILAVIAKI

SEQ ID NO: 704683 - protein, 21 aa, Mycobacterium
NVDGGLMLRRGPDYSAMLEPA

SEQ ID NO: 704684 - protein, 24 aa, Mycobacterium
NVDGIKLGPSFKFQFTPLKKTGGT

SEQ ID NO: 704685 - protein, 17 aa, Mycobacterium
NVDKSWIGTNVRDVISA

SEQ ID NO: 704686 - protein, 21 aa, Mycobacterium
NVDLAIPVTGFIDGIAVQPFS

SEQ ID NO: 704687 - protein, 18 aa, Mycobacterium
NVDRSSLVALDFGNSWSD

SEQ ID NO: 704688 - protein, 22 aa, Mycobacterium
NVEAFKHWGLMPRMLMAATERD

SEQ ID NO: 704689 - protein, 25 aa, Mycobacterium
NVEAKRYPAILAMTSLNDTRVYYVE

SEQ ID NO: 704690 - protein, 27 aa, Mycobacterium
NVEASHCYPHFSRFLAEVVRVLRPGGY

SEQ ID NO: 704691 - protein, 20 aa, Mycobacterium
NVELFPQHLDAIVNIPNPVW

SEQ ID NO: 704692 - protein, 26 aa, Mycobacterium
NVELLADVVNRVWFLDAVRGEADVYN

SEQ ID NO: 704693 - protein, 26 aa, Mycobacterium
NVELLADVVNRVWFLDAVRGEVDVYN

SEQ ID NO: 704694 - protein, 45 aa, Mycobacterium
NVEPGDFVILNWRAVCGQCRACKRGRPSYCFDTFNAEQKMTLTDG

SEQ ID NO: 704695 - protein, 25 aa, Mycobacterium
NVEQWPAMIDWLLDQHLRFRRAIQA

SEQ ID NO: 704696 - protein, 27 aa, Mycobacterium
NVETLMACPLRWMLERHGGTDLTDPRR

SEQ ID NO: 704697 - protein, 27 aa, Mycobacterium
NVFANELSFVFGLRPGTPVGELTDPLR

SEQ ID NO: 704698 - protein, 24 aa, Mycobacterium
NVFDLEELAAWAARIRTEIGADAQ

SEQ ID NO: 704699 - protein, 25 aa, Mycobacterium
NVFGPLRIARAFAPILKANGGGAIV

SEQ ID NO: 704700 - protein, 20 aa, Mycobacterium
NVFHNLGSLLRQNGINHDQT

SEQ ID NO: 704701 - protein, 23 aa, Mycobacterium
NVFPRAIWDRELTWLAARRPTPH

SEQ ID NO: 704702 - protein, 23 aa, Mycobacterium
NVFPRPVEDALAFLPQVSDVAVV

SEQ ID NO: 704703 - protein, 17 aa, Mycobacterium
NVFRIDPVHTFIETCRR

SEQ ID NO: 704704 - protein, 23 aa, Mycobacterium
NVFSESFVPPVLAAPAGPSGGRI

SEQ ID NO: 704705 - protein, 25 aa, Mycobacterium
NVFTRPGPQLPLAVVHGVSVGLLIC

SEQ ID NO: 704706 - protein, 19 aa, Mycobacterium
NVGAAVCWELMRTRTARRM

SEQ ID NO: 704707 - protein, 18 aa, Mycobacterium
NVGCSLHLVPVAFTGGRR

SEQ ID NO: 704708 - protein, 22 aa, Mycobacterium
NVGEGLVGFARPGDGDVGVTSV

SEQ ID NO: 704709 - protein, 17 aa, Mycobacterium
NVGFAVFAKPKIDEDSD

SEQ ID NO: 704710 - protein, 28 aa, Mycobacterium
NVGGMSAGLWPSVMQNNLPGSAGLDAGL

SEQ ID NO: 704711 - protein, 18 aa, Mycobacterium
NVGIGDLDFFSRVPHGGG

SEQ ID NO: 704712 - protein, 24 aa, Mycobacterium
NVGNPRPGQSVAVVGLGGVGMAAV

SEQ ID NO: 704713 - protein, 19 aa, Mycobacterium
NVGNPRWHMVGHIQRNKAR

SEQ ID NO: 704714 - protein, 24 aa, Mycobacterium
NVGQPRPGQTVAVVGLGGVGMAAL

SEQ ID NO: 704715 - protein, 18 aa, Mycobacterium
NVGRLAVNLAEGTDLAFG

SEQ ID NO: 704716 - protein, 29 aa, Mycobacterium
NVGTMTARRVCVVGSLNMDLTFAVTTLPR

SEQ ID NO: 704717 - protein, 19 aa, Mycobacterium
NVGVARFGRIGSIELDDLF

SEQ ID NO: 704718 - protein, 23 aa, Mycobacterium
NVHARMIKDFVERRGLNRELEAL

SEQ ID NO: 704719 - protein, 17 aa, Mycobacterium
NVIAWASSGHVGFKGSR

SEQ ID NO: 704720 - protein, 19 aa, Mycobacterium
NVIAWQAGGWVHGDVLDIG

SEQ ID NO: 704721 - protein, 20 aa, Mycobacterium
NVIDPLDWVDMFGADALRFT

SEQ ID NO: 704722 - protein, 30 aa, Mycobacterium
NVIDPLDWVELFGADALRFTLARGASPGGD

SEQ ID NO: 704723 - protein, 19 aa, Mycobacterium
NVIDRLKVSLSVMAADPTR

SEQ ID NO: 704724 - protein, 23 aa, Mycobacterium
NVIEVGRVLLIFAGRSDGFGLRI

SEQ ID NO: 704725 - protein, 19 aa, Mycobacterium
NVIGCGALHVLWSDLGEVR

SEQ ID NO: 704726 - protein, 17 aa, Mycobacterium
NVIGSRPDGWWKDRGRA

SEQ ID NO: 704727 - protein, 18 aa, Mycobacterium
NVIHWRGAVRPYRGTIPR

SEQ ID NO: 704728 - protein, 17 aa, Mycobacterium
NVIKGRLVIDEHTRQSL

SEQ ID NO: 704729 - protein, 24 aa, Mycobacterium
NVIPGRAKLQYAMRAVEADSLREL

SEQ ID NO: 704730 - protein, 24 aa, Mycobacterium
NVIRQGRKAWTLFVGISQSPRNDF

SEQ ID NO: 704731 - protein, 17 aa, Mycobacterium
NVIRTTLLLATRTSPPY

SEQ ID NO: 704732 - protein, 29 aa, Mycobacterium
NVISRKCGVPYLYRFELMGTPDDVEAVRA

SEQ ID NO: 704733 - protein, 19 aa, Mycobacterium
NVIVPGDSFVSWEVEEDDL

SEQ ID NO: 704734 - protein, 17 aa, Mycobacterium
NVIYRWAKSGDLSAALA

SEQ ID NO: 704735 - protein, 25 aa, Mycobacterium
NVKAGGGACPIRFRCVGCDHFRTNI

SEQ ID NO: 704736 - protein, 25 aa, Mycobacterium
NVKAGGGACPVRFRCVGCDHFRTNI

SEQ ID NO: 704737 - protein, 18 aa, Mycobacterium
NVKPGRVLFELSYPDEKI

SEQ ID NO: 704738 - protein, 19 aa, Mycobacterium
NVKPGRVLFELSYPDEKTA

SEQ ID NO: 704739 - protein, 19 aa, Mycobacterium
NVKPGRVLFELSYPNEETA

SEQ ID NO: 704740 - protein, 19 aa, Mycobacterium
NVKRGDVVKAVIVRTVKER

SEQ ID NO: 704741 - protein, 26 aa, Mycobacterium
NVKRWRDGQMALRWCAAGMVEAGKQF

SEQ ID NO: 704742 - protein, 22 aa, Mycobacterium
NVLALKAGWNFGETTEAFAITY

SEQ ID NO: 704743 - protein, 24 aa, Mycobacterium
NVLARAIVRLSLSYVSMPPEADHN

SEQ ID NO: 704744 - protein, 20 aa, Mycobacterium
NVLCTPGVWVRHRKLANTAP

SEQ ID NO: 704745 - protein, 26 aa, Mycobacterium
NVLERPRVGTLFVIPGRGDTLRINGS

SEQ ID NO: 704746 - protein, 22 aa, Mycobacterium
NVLFEMEARKAAGRETLFVIDD

SEQ ID NO: 704747 - protein, 25 aa, Mycobacterium
NVLFGRPLVSIGFAQPSWAQFSASE

SEQ ID NO: 704748 - protein, 18 aa, Mycobacterium
NVLGGYGIHLKLCSTPRS

SEQ ID NO: 704749 - protein, 17 aa, Mycobacterium
NVLGGYGVRLRWSSLPR

SEQ ID NO: 704750 - protein, 17 aa, Mycobacterium
NVLGGYGVRLRWSSVPR

SEQ ID NO: 704751 - protein, 24 aa, Mycobacterium
NVLGWPSINVPAGFTADGLPIGVQ

SEQ ID NO: 704752 - protein, 19 aa, Mycobacterium
NVLPARGVGVIELRGESVT

SEQ ID NO: 704753 - protein, 26 aa, Mycobacterium
NVLPGRWSFQIVEEFDDMYWSLFREH

SEQ ID NO: 704754 - protein, 31 aa, Mycobacterium
NVLQRTRCPYFRAEEPLPWGCNKRTPGTGCS

SEQ ID NO: 704755 - protein, 17 aa, Mycobacterium
NVLSPRSSLLVLGDGRN

SEQ ID NO: 704756 - protein, 18 aa, Mycobacterium
NVLTFAGKLWSRIVAEVG

SEQ ID NO: 704757 - protein, 20 aa, Mycobacterium
NVLTRARWVAAAIGERLGVT

SEQ ID NO: 704758 - protein, 18 aa, Mycobacterium
NVLVYSAIDGWRRQMVEH

SEQ ID NO: 704759 - protein, 26 aa, Mycobacterium
NVLYGRWTFQVVEEFDDNYWSPFRDH

SEQ ID NO: 704760 - protein, 19 aa, Mycobacterium
NVMGTVRAWAAAGVPPRDC

SEQ ID NO: 704761 - protein, 17 aa, Mycobacterium
NVMLLRACRHRLQRAGF

SEQ ID NO: 704762 - protein, 18 aa, Mycobacterium
NVMLNRGIYQACQRAPKL

SEQ ID NO: 704763 - protein, 24 aa, Mycobacterium
NVMPQWAGSSWYELRYTDPHNADR

SEQ ID NO: 704764 - protein, 24 aa, Mycobacterium
NVMPQWAGSSWYELRYTDPHNSER

SEQ ID NO: 704765 - protein, 20 aa, Mycobacterium
NVNGIYVCRAIVSHRMPDGV

SEQ ID NO: 704766 - protein, 26 aa, Mycobacterium
NVNMLGCYYCNLFAAECMERNAGDTT

SEQ ID NO: 704767 - protein, 19 aa, Mycobacterium
NVNPEWRDIVAAAEALGQP

SEQ ID NO: 704768 - protein, 22 aa, Mycobacterium
NVPDMFTRLILSLVATGIAPRS

SEQ ID NO: 704769 - protein, 23 aa, Mycobacterium
NVPGLRALVRAVIYWGQEALAFG

SEQ ID NO: 704770 - protein, 33 aa, Mycobacterium
NVPITPIWVCPLRLRHPSGWPLYPIQPDRTYVN

SEQ ID NO: 704771 - protein, 18 aa, Mycobacterium
NVPIVLVCAHRATREAIT

SEQ ID NO: 704772 - protein, 24 aa, Mycobacterium
NVPMPQAAVDWAIRDTMPKWAKQL

SEQ ID NO: 704773 - protein, 20 aa, Mycobacterium
NVPPFPGLDTFEGTSVHTAR

SEQ ID NO: 704774 - protein, 25 aa, Mycobacterium
NVPPQRRGIGFVFQHYAAFKHLTVR

SEQ ID NO: 704775 - protein, 24 aa, Mycobacterium
NVPRECYRTRDGRWIALSGATTAT

SEQ ID NO: 704776 - protein, 24 aa, Mycobacterium
NVQAGLRTDYLFRIANHRGGIVLG

SEQ ID NO: 704777 - protein, 23 aa, Mycobacterium
NVQAGLRTDYLFRLANHRGGIVL

SEQ ID NO: 704778 - protein, 23 aa, Mycobacterium
NVQAGLRTDYLFRLANQRGGIVL

SEQ ID NO: 704779 - protein, 25 aa, Mycobacterium
NVQDLTCCWDDIIAGSGEIECRREG

SEQ ID NO: 704780 - protein, 24 aa, Mycobacterium
NVQEPGSLVDYVIMGQVLTAGAGQ

SEQ ID NO: 704781 - protein, 28 aa, Mycobacterium
NVQFHWLRIEDVPEIWRRLESVGLSSIE

SEQ ID NO: 704782 - protein, 24 aa, Mycobacterium
NVQKGIEPCIARAKAYAPYADLIW

SEQ ID NO: 704783 - protein, 29 aa, Mycobacterium
NVQLKLGAELVILPRFELDTFLGSIANYR

SEQ ID NO: 704784 - protein, 23 aa, Mycobacterium
NVRARRGVVLAMGSFAYNEAMVT

SEQ ID NO: 704785 - protein, 18 aa, Mycobacterium
NVREALNIARECRTLLGA

SEQ ID NO: 704786 - protein, 18 aa, Mycobacterium
NVRELAVYWVARQIGCSW

SEQ ID NO: 704787 - protein, 21 aa, Mycobacterium
NVRGDVVARCMRLIADGTVDR

SEQ ID NO: 704788 - protein, 18 aa, Mycobacterium
NVRLDRRWLVDGGRVTAV

SEQ ID NO: 704789 - protein, 17 aa, Mycobacterium
NVRLLRTGANLGYGSAV

SEQ ID NO: 704790 - protein, 25 aa, Mycobacterium
NVRPGALHRLGFDYAALAAHNPRLV

SEQ ID NO: 704791 - protein, 25 aa, Mycobacterium
NVRTHSLHDPARWKYVHLGNHTLHG

SEQ ID NO: 704792 - protein, 22 aa, Mycobacterium
NVRVPRANLLNRYADVAEDGTY

SEQ ID NO: 704793 - protein, 18 aa, Mycobacterium
NVRYFPSLLPEVSDEDPA

SEQ ID NO: 704794 - protein, 28 aa, Mycobacterium
NVRYRTGWKGRWVRQLTDLVAEKLPDCR

SEQ ID NO: 704795 - protein, 18 aa, Mycobacterium
NVSGGIDAPAVWMMAHRE

SEQ ID NO: 704796 - protein, 24 aa, Mycobacterium
NVSHELRTPLMLILEPARRLLEST

SEQ ID NO: 704797 - protein, 27 aa, Mycobacterium
NVSIPWHRHGRKIWDVIAVEGATTQMV

SEQ ID NO: 704798 - protein, 28 aa, Mycobacterium
NVSRLFAERCIDGLVANEERLRELAESS

SEQ ID NO: 704799 - protein, 25 aa, Mycobacterium
NVSVKIDKGEFVFLIGPSGSGKSTF

SEQ ID NO: 704800 - protein, 18 aa, Mycobacterium
NVSVPVFVARAGGGIIED

SEQ ID NO: 704801 - protein, 19 aa, Mycobacterium
NVSYFFDPRALTISVSITE

SEQ ID NO: 704802 - protein, 26 aa, Mycobacterium
NVTCFSYRGSIDFGFVTTPEVADDID

SEQ ID NO: 704803 - protein, 19 aa, Mycobacterium
NVTLESIWHECLEPRARHS

SEQ ID NO: 704804 - protein, 18 aa, Mycobacterium
NVTPCAVIPLGWPIGKYG

SEQ ID NO: 704805 - protein, 26 aa, Mycobacterium
NVTRMLELVQHFGRPMRARRRGGIVL

SEQ ID NO: 704806 - protein, 24 aa, Mycobacterium
NVTRMLQLVQHFARPMRSRGRGGI

SEQ ID NO: 704807 - protein, 25 aa, Mycobacterium
NVVCKTAGVGGPWKFDADSVSLAVM

SEQ ID NO: 704808 - protein, 18 aa, Mycobacterium
NVVDGVRFALVRKERFGR

SEQ ID NO: 704809 - protein, 19 aa, Mycobacterium
NVVDYLTGRGWRVSTRPRR

SEQ ID NO: 704810 - protein, 20 aa, Mycobacterium
NVVEELMRYLSIVHSQVDRV

SEQ ID NO: 704811 - protein, 24 aa, Mycobacterium
NVVGALAVPPSWTAAAPVRLLTAA

SEQ ID NO: 704812 - protein, 17 aa, Mycobacterium
NVVLGFPTLAGYLNNTG

SEQ ID NO: 704813 - protein, 22 aa, Mycobacterium
NVVLTPHVTWFTADTMTRYLHH

SEQ ID NO: 704814 - protein, 19 aa, Mycobacterium
NVVMHRPELVRTWVSDVVG

SEQ ID NO: 704815 - protein, 20 aa, Mycobacterium
NVVTAWRLLGSVDPRLRPHR

SEQ ID NO: 704816 - protein, 19 aa, Mycobacterium
NVVTLCFECAVDPITTTKT

SEQ ID NO: 704817 - protein, 18 aa, Mycobacterium
NVVVGGKCDPSTLRIQPA

SEQ ID NO: 704818 - protein, 23 aa, Mycobacterium
NVWACVVIFCGHFPDGAEKFTPE

SEQ ID NO: 704819 - protein, 22 aa, Mycobacterium
NVWAHAIIFCGHFPDQTWTFTE

SEQ ID NO: 704820 - protein, 20 aa, Mycobacterium
NVWGAVLARIDMGWEEWLVG

SEQ ID NO: 704821 - protein, 22 aa, Mycobacterium
NVWSLHGYHECLRRLGRDAEAA

SEQ ID NO: 704822 - protein, 22 aa, Mycobacterium
NVWSLHGYHECLTRLGRDAEAV

SEQ ID NO: 704823 - protein, 28 aa, Mycobacterium
NVYCGQCPYCLAGRLGQCAAMLGYGSNF

SEQ ID NO: 704824 - protein, 23 aa, Mycobacterium
NVYRSELLFRHGIDPYLPGTQLD

SEQ ID NO: 704825 - protein, 22 aa, Mycobacterium
NVYRSELLFRHRIDPYRAGQRI

SEQ ID NO: 704826 - protein, 22 aa, Mycobacterium
NVYRSELLFRHRIDPYRSGQRI

SEQ ID NO: 704827 - protein, 19 aa, Mycobacterium
NWAKPIVMQSSWARQGDPA

SEQ ID NO: 704828 - protein, 23 aa, Mycobacterium
NWALWRDAGDWERFATVWHPVDG

SEQ ID NO: 704829 - protein, 19 aa, Mycobacterium
NWEAGGWGDVAQGMVAVTS

SEQ ID NO: 704830 - protein, 26 aa, Mycobacterium
NWETFHIAQLLPWVEANFRTYAEYDG

SEQ ID NO: 704831 - protein, 21 aa, Mycobacterium
NWFKHAVFYEVLVRAFYDSNA

SEQ ID NO: 704832 - protein, 18 aa, Mycobacterium
NWGDARVGNIIFSDSLAA

SEQ ID NO: 704833 - protein, 17 aa, Mycobacterium
NWHQIDPALPFGGYKQS

SEQ ID NO: 704834 - protein, 21 aa, Mycobacterium
NWHRIAREWIYGEPPATELGI

SEQ ID NO: 704835 - protein, 22 aa, Mycobacterium
NWIKEFDPRFNVRYRDDKSYPA

SEQ ID NO: 704836 - protein, 23 aa, Mycobacterium
NWIKEFDPRFNVRYRDDKSYPVL

SEQ ID NO: 704837 - protein, 18 aa, Mycobacterium
NWKLFIDAFVEFYHAPIL

SEQ ID NO: 704838 - protein, 17 aa, Mycobacterium
NWLAKRLGLKRIRIEIL

SEQ ID NO: 704839 - protein, 21 aa, Mycobacterium
NWLANDVFRPVVAIWDHIQHD

SEQ ID NO: 704840 - protein, 24 aa, Mycobacterium
NWLDTTGLRRGFMTMRWTYSQPTE

SEQ ID NO: 704841 - protein, 19 aa, Mycobacterium
NWLGIKSQWLNSVVRRSGS

SEQ ID NO: 704842 - protein, 19 aa, Mycobacterium
NWMHGCAVGGGVHAEPVAG

SEQ ID NO: 704843 - protein, 18 aa, Mycobacterium
NWMRAREALIKTDVFGAK

SEQ ID NO: 704844 - protein, 18 aa, Mycobacterium
NWMRAREALIKTDVFGDP

SEQ ID NO: 704845 - protein, 18 aa, Mycobacterium
NWMRAREALIKTDVFGSE

SEQ ID NO: 704846 - protein, 18 aa, Mycobacterium
NWMRAREALIKTDVFGTE

SEQ ID NO: 704847 - protein, 18 aa, Mycobacterium
NWMRAREALIKTEIFGTE

SEQ ID NO: 704848 - protein, 24 aa, Mycobacterium
NWNHARLNPYAQRRADHEVTVEEI

SEQ ID NO: 704849 - protein, 20 aa, Mycobacterium
NWNLTPGDLATIWRGGCIIR

SEQ ID NO: 704850 - protein, 27 aa, Mycobacterium
NWNSDVAQAFHWVRHALRRPLAPGSSV

SEQ ID NO: 704851 - protein, 19 aa, Mycobacterium
NWNSLPLKLFAGGNAKFWD

SEQ ID NO: 704852 - protein, 26 aa, Mycobacterium
NWPAKRAGTATALWHLSERLTGTTFP

SEQ ID NO: 704853 - protein, 18 aa, Mycobacterium
NWPALPVAMADTIVPDFP

SEQ ID NO: 704854 - protein, 22 aa, Mycobacterium
NWPEGEGGFMLGSHKPGTECER

SEQ ID NO: 704855 - protein, 22 aa, Mycobacterium
NWPEGTGGIMLGSHRPGGEWAL

SEQ ID NO: 704856 - protein, 17 aa, Mycobacterium
NWPELFGAKADQLRSIF

SEQ ID NO: 704857 - protein, 23 aa, Mycobacterium
NWQARRYSPWLAYSQSKLANLLF

SEQ ID NO: 704858 - protein, 18 aa, Mycobacterium
NWQLAHDILAPAFTREAM

SEQ ID NO: 704859 - protein, 20 aa, Mycobacterium
NWRAELKGPLVPVDDLAQKI

SEQ ID NO: 704860 - protein, 30 aa, Mycobacterium
NWRGKAVLLKLIWRMFRARVFGDRMAAIGQ

SEQ ID NO: 704861 - protein, 19 aa, Mycobacterium
NWRVPLAGPDGRQVLLEDI

SEQ ID NO: 704862 - protein, 25 aa, Mycobacterium
NWSARRAATAVALWELSEQLTGAKF

SEQ ID NO: 704863 - protein, 25 aa, Mycobacterium
NWSIRRLASLVGHGRARAMLLAAEK

SEQ ID NO: 704864 - protein, 19 aa, Mycobacterium
NWSIRRLSSLVGHGRARAM

SEQ ID NO: 704865 - protein, 25 aa, Mycobacterium
NWSIRRLSSLVGHGRARAMLLTAEK

SEQ ID NO: 704866 - protein, 19 aa, Mycobacterium
NWSIRRLSSLVGHGRASAM

SEQ ID NO: 704867 - protein, 25 aa, Mycobacterium
NWSIRRLTSLVGYGRARAMLLAAEP

SEQ ID NO: 704868 - protein, 23 aa, Mycobacterium
NWTFGGAYSDEWTLKFTDPATIA

SEQ ID NO: 704869 - protein, 29 aa, Mycobacterium
NWTLLKWLDEPCTFYDWRSSETGKPRVHP

SEQ ID NO: 704870 - protein, 19 aa, Mycobacterium
NWVGGWTDFSGRQVTVGGL

SEQ ID NO: 704871 - protein, 25 aa, Mycobacterium
NWVRAETLLHLGVMPPGFVGASLNP

SEQ ID NO: 704872 - protein, 17 aa, Mycobacterium
NWWEAMAADALRDDITD

SEQ ID NO: 704873 - protein, 22 aa, Mycobacterium
NWWEWHELIGPLAADGYRVLCP

SEQ ID NO: 704874 - protein, 20 aa, Mycobacterium
NYAKALRMFAVLPTVVAADM

SEQ ID NO: 704875 - protein, 22 aa, Mycobacterium
NYALGGPVPWRAEKLQGVGTVH

SEQ ID NO: 704876 - protein, 23 aa, Mycobacterium
NYAPRPVLDLPWDIADSPPGRAV

SEQ ID NO: 704877 - protein, 24 aa, Mycobacterium
NYARTRHNLGFMVADLLAGRLGSK

SEQ ID NO: 704878 - protein, 17 aa, Mycobacterium
NYATAWAALHGHGSLRA

SEQ ID NO: 704879 - protein, 22 aa, Mycobacterium
NYCPHEGGPLCSGRARGRNIVD

SEQ ID NO: 704880 - protein, 18 aa, Mycobacterium
NYDDFFKRCYDIMPEDGR

SEQ ID NO: 704881 - protein, 28 aa, Mycobacterium
NYDMSMARFLYWGCDIWLNNPLRPLEAC

SEQ ID NO: 704882 - protein, 27 aa, Mycobacterium
NYDMSMARLLYWGCDVWLNNPLRPLEA

SEQ ID NO: 704883 - protein, 33 aa, Mycobacterium
NYDNGILWRSDYRAQGGFSYAIGLVPITTSLNL

SEQ ID NO: 704884 - protein, 21 aa, Mycobacterium
NYEVPEAMAAEVEEALPGSRT

SEQ ID NO: 704885 - protein, 17 aa, Mycobacterium
NYFMTIRAGECHVIMAA

SEQ ID NO: 704886 - protein, 22 aa, Mycobacterium
NYFSPLRLIRGFAPGMVERRSG

SEQ ID NO: 704887 - protein, 20 aa, Mycobacterium
NYGDCFSYALAKVSGQPLLF

SEQ ID NO: 704888 - protein, 25 aa, Mycobacterium
NYGGLQFKPATWARYGGVGNPAAAS

SEQ ID NO: 704889 - protein, 25 aa, Mycobacterium
NYGGLSVYSGEWWHFDGPGAGVDRP

SEQ ID NO: 704890 - protein, 23 aa, Mycobacterium
NYGSLEIFTGVDLAIDRGSRVVV

SEQ ID NO: 704891 - protein, 21 aa, Mycobacterium
NYIPRPRYRTVSAVEGTALAL

SEQ ID NO: 704892 - protein, 17 aa, Mycobacterium
NYLHSFAPMPYQPVGEG

SEQ ID NO: 704893 - protein, 19 aa, Mycobacterium
NYLLLAEIVRLVSGKSLPD

SEQ ID NO: 704894 - protein, 23 aa, Mycobacterium
NYLLPRGLAIVATRGAERQANDI

SEQ ID NO: 704895 - protein, 22 aa, Mycobacterium
NYLNSWKRLGFSDEDVAKPGSD

SEQ ID NO: 704896 - protein, 18 aa, Mycobacterium
NYLQVFRGFHRFLEVRKA

SEQ ID NO: 704897 - protein, 20 aa, Mycobacterium
NYLRRAVVALIGLGANPAED

SEQ ID NO: 704898 - protein, 26 aa, Mycobacterium
NYNNGFLWRGDYQGLVQLSYKVTIPE

SEQ ID NO: 704899 - protein, 24 aa, Mycobacterium
NYNPWDQRLCLIPDADLYSAVAGG

SEQ ID NO: 704900 - protein, 17 aa, Mycobacterium
NYPKPGYTWTAMGPANA

SEQ ID NO: 704901 - protein, 23 aa, Mycobacterium
NYPRGRELPIAEQIATQWRALTD

SEQ ID NO: 704902 - protein, 25 aa, Mycobacterium
NYRARRFYQKNGFQLDGRSFAWTLV

SEQ ID NO: 704903 - protein, 18 aa, Mycobacterium
NYRICGSTIAVADAGESA

SEQ ID NO: 704904 - protein, 29 aa, Mycobacterium
NYRIFQNFELEFSDRLNILVGDNDIGKST

SEQ ID NO: 704905 - protein, 21 aa, Mycobacterium
NYRKNWKRLGFTDSDIGHPGS

SEQ ID NO: 704906 - protein, 21 aa, Mycobacterium
NYRLMPKHSIGMALDDCHDGY

SEQ ID NO: 704907 - protein, 22 aa, Mycobacterium
NYRNNWKRLGFGEDEVARPGSD

SEQ ID NO: 704908 - protein, 21 aa, Mycobacterium
NYRNNWKRLGFSDDDVTRPGS

SEQ ID NO: 704909 - protein, 18 aa, Mycobacterium
NYRVAGYRVDVGFPGPKV

SEQ ID NO: 704910 - protein, 21 aa, Mycobacterium
NYSAAFPKCRAVVHHGGTGTT

SEQ ID NO: 704911 - protein, 28 aa, Mycobacterium
NYSLARWRKADAALGRPVISNQVHFSLA

SEQ ID NO: 704912 - protein, 28 aa, Mycobacterium
NYSLARWRKADAALGRPVVSNQVHFSLA

SEQ ID NO: 704913 - protein, 25 aa, Mycobacterium
NYSMFDLAYGYAREGMTAYVDLQER

SEQ ID NO: 704914 - protein, 17 aa, Mycobacterium
NYSMVFDSYAEVPAQVS

SEQ ID NO: 704915 - protein, 24 aa, Mycobacterium
NYSNGTAGPGAWGNNVTTSIGDAN

SEQ ID NO: 704916 - protein, 24 aa, Mycobacterium
NYTPCVAAGDWLFLAGQLPTEFGD

SEQ ID NO: 704917 - protein, 22 aa, Mycobacterium
NYTQRLFPGMRVKYVSTEEFTN

SEQ ID NO: 704918 - protein, 22 aa, Mycobacterium
NYVIKHARLIPVDRRSGHDAFD

SEQ ID NO: 704919 - protein, 18 aa, Mycobacterium
NYVMLEFGHPMHAHDSSL

SEQ ID NO: 704920 - protein, 26 aa, Mycobacterium
NYVPELLVRGAPHFREVANWDPHYHV

SEQ ID NO: 704921 - protein, 24 aa, Mycobacterium
NYVPRPLLDLPWDIEESPSGMAVA

SEQ ID NO: 704922 - protein, 23 aa, Mycobacterium
NYVSRLLAKLGMERRTQAAVFAA

SEQ ID NO: 704923 - protein, 19 aa, Mycobacterium
PAAAAHPSLPRGALLQIAV

SEQ ID NO: 704924 - protein, 19 aa, Mycobacterium
PAAAAHPSLPRGALLQVAL

SEQ ID NO: 704925 - protein, 17 aa, Mycobacterium
PAAAAHPSLPRGSLLQV

SEQ ID NO: 704926 - protein, 21 aa, Mycobacterium
PAAAARYAANPAQAIADAHLT

SEQ ID NO: 704927 - protein, 23 aa, Mycobacterium
PAAAECLRTVPMSRPDTGLLTYR

SEQ ID NO: 704928 - protein, 25 aa, Mycobacterium
PAAAELGVGFVPYSPLGRGFLTGTV

SEQ ID NO: 704929 - protein, 18 aa, Mycobacterium
PAAAEVFAAVDAAGIPVV

SEQ ID NO: 704930 - protein, 18 aa, Mycobacterium
PAAAGGLYASRDRRLHHH

SEQ ID NO: 704931 - protein, 19 aa, Mycobacterium
PAAAGIQMPARPAVIWKAI

SEQ ID NO: 704932 - protein, 19 aa, Mycobacterium
PAAAKAVVWATAAELASLM

SEQ ID NO: 704933 - protein, 18 aa, Mycobacterium
PAAALAFLRRLHDETRRI

SEQ ID NO: 704934 - protein, 22 aa, Mycobacterium
PAAALFVRPSIPMTGGRSNGLP

SEQ ID NO: 704935 - protein, 17 aa, Mycobacterium
PAAALGEMARVLRPGGR

SEQ ID NO: 704936 - protein, 23 aa, Mycobacterium
PAAALHPSWRFKAWNQQWQRLFQ

SEQ ID NO: 704937 - protein, 28 aa, Mycobacterium
PAAALTVRLAFDWAQLKPGDKVLIHAAS

SEQ ID NO: 704938 - protein, 26 aa, Mycobacterium
PAAALTVRLSFDWAQVKSGDKVLIHA

SEQ ID NO: 704939 - protein, 21 aa, Mycobacterium
PAAAMHPAWGMSETCSGVVYS

SEQ ID NO: 704940 - protein, 27 aa, Mycobacterium
PAAAPARRGGSLTSMVLPELRAMAKEI

SEQ ID NO: 704941 - protein, 29 aa, Mycobacterium
PAAASPWWLQRRLLLCGIRATSPAVDVTN

SEQ ID NO: 704942 - protein, 24 aa, Mycobacterium
PAAATPRPASARIAPPARPAPPPE

SEQ ID NO: 704943 - protein, 17 aa, Mycobacterium
PAADEPRPLLNGGGPGE

SEQ ID NO: 704944 - protein, 25 aa, Mycobacterium
PAADGLRAGQAMKRAMETAGLDPKD

SEQ ID NO: 704945 - protein, 25 aa, Mycobacterium
PAADGRYIACAALEEKFWQRLVTLV

SEQ ID NO: 704946 - protein, 20 aa, Mycobacterium
PAADYLRVGLRRLEYRGYDS

SEQ ID NO: 704947 - protein, 17 aa, Mycobacterium
PAAEGVLGLELPDIQEV

SEQ ID NO: 704948 - protein, 23 aa, Mycobacterium
PAAEIRRAAMLAGNLPAVAAAAV

SEQ ID NO: 704949 - protein, 24 aa, Mycobacterium
PAAELRFGLYGSLSHPLEAPALSG

SEQ ID NO: 704950 - protein, 21 aa, Mycobacterium
PAAELWTHIARRLRGQPRAEA

SEQ ID NO: 704951 - protein, 17 aa, Mycobacterium
PAAEMLTAISHREVIDR

SEQ ID NO: 704952 - protein, 21 aa, Mycobacterium
PAAEMPRLFERFHRVETVQAR

SEQ ID NO: 704953 - protein, 21 aa, Mycobacterium
PAAEPRIVVGGSERSDSSRPA

SEQ ID NO: 704954 - protein, 25 aa, Mycobacterium
PAAERLAACGAREVIVTNTLPIGEE

SEQ ID NO: 704955 - protein, 25 aa, Mycobacterium
PAAERLAACGAREVIVTNTLPITEA

SEQ ID NO: 704956 - protein, 25 aa, Mycobacterium
PAAERLAACGAREVIVTNTLPITEQ

SEQ ID NO: 704957 - protein, 25 aa, Mycobacterium
PAAERLAGCGAREVIVTNTLPIGEE

SEQ ID NO: 704958 - protein, 18 aa, Mycobacterium
PAAERLANCGAREVLVTN

SEQ ID NO: 704959 - protein, 22 aa, Mycobacterium
PAAERPRMIAVDAVPTTLADMF

SEQ ID NO: 704960 - protein, 29 aa, Mycobacterium
PAAERTGLVAFSLHFPWSQQLPVHSLDGT

SEQ ID NO: 704961 - protein, 22 aa, Mycobacterium
PAAETPLTMLLLGQVFADAGLP

SEQ ID NO: 704962 - protein, 31 aa, Mycobacterium
PAAGDARPDWELICGVARHLGFGDAFDHKSS

SEQ ID NO: 704963 - protein, 21 aa, Mycobacterium
PAAGGRLLAPIKPTKLIHTAG

SEQ ID NO: 704964 - protein, 17 aa, Mycobacterium
PAAGMVRPRELAVEFAA

SEQ ID NO: 704965 - protein, 19 aa, Mycobacterium
PAAGRRCRGARWPPATRPV

SEQ ID NO: 704966 - protein, 26 aa, Mycobacterium
PAAGVWALCHSLAFDVSVWEIFGALL

SEQ ID NO: 704967 - protein, 23 aa, Mycobacterium
PAAHARFPARRSRIDDLLSGSGW

SEQ ID NO: 704968 - protein, 20 aa, Mycobacterium
PAAHDLPGRVGVGVEEVIDV

SEQ ID NO: 704969 - protein, 18 aa, Mycobacterium
PAAHWSFETKQIHAGQQP

SEQ ID NO: 704970 - protein, 19 aa, Mycobacterium
PAAIARLSQAIAVDAVHGV

SEQ ID NO: 704971 - protein, 23 aa, Mycobacterium
PAAIKYQLPIRQWVFRSDSERKT

SEQ ID NO: 704972 - protein, 21 aa, Mycobacterium
PAAIRLGLLSGHYRADRFWSP

SEQ ID NO: 704973 - protein, 21 aa, Mycobacterium
PAAIRLGSRVARDFASGWATA

SEQ ID NO: 704974 - protein, 18 aa, Mycobacterium
PAAIVLARTGRVWRAEVM

SEQ ID NO: 704975 - protein, 18 aa, Mycobacterium
PAAKHLLREDDIPWVRVR

SEQ ID NO: 704976 - protein, 23 aa, Mycobacterium
PAAKILDPFGCENMRYKWRKWLE

SEQ ID NO: 704977 - protein, 25 aa, Mycobacterium
PAALDAGAAPAGWGAAPSQAAGISK

SEQ ID NO: 704978 - protein, 23 aa, Mycobacterium
PAALDRLAGMFPDHDVLITDDRS

SEQ ID NO: 704979 - protein, 19 aa, Mycobacterium
PAALEAFASLSDRDALAIL

SEQ ID NO: 704980 - protein, 20 aa, Mycobacterium
PAALEFSRAVIRPGHRNSRA

SEQ ID NO: 704981 - protein, 17 aa, Mycobacterium
PAALEWIVSQLLDALDF

SEQ ID NO: 704982 - protein, 30 aa, Mycobacterium
PAALGCPADQVWWEIWQQISPMLVSVLDTG

SEQ ID NO: 704983 - protein, 17 aa, Mycobacterium
PAALLRCLVEGADEVHV

SEQ ID NO: 704984 - protein, 18 aa, Mycobacterium
PAALLRCLVEGADEVHVD

SEQ ID NO: 704985 - protein, 23 aa, Mycobacterium
PAALREARRGMALAASLKLPLVL

SEQ ID NO: 704986 - protein, 25 aa, Mycobacterium
PAALRKAGTALSEFGIEGIHTNIGF

SEQ ID NO: 704987 - protein, 20 aa, Mycobacterium
PAALRPFLLVASFVNPHDIV

SEQ ID NO: 704988 - protein, 18 aa, Mycobacterium
PAALVSERDVVRVVATGK

SEQ ID NO: 704989 - protein, 24 aa, Mycobacterium
PAAMAALRPGGRVAVMAYQSLEDK

SEQ ID NO: 704990 - protein, 20 aa, Mycobacterium
PAAMKMAFRISWSRVTERAT

SEQ ID NO: 704991 - protein, 26 aa, Mycobacterium
PAAMRYCLTEDALVRLPFGQSVRIGD

SEQ ID NO: 704992 - protein, 27 aa, Mycobacterium
PAANEVYAWAAGRFVLHARTYRVDGAQ

SEQ ID NO: 704993 - protein, 21 aa, Mycobacterium
PAAPDRPRIVVSRTRPPAIAL

SEQ ID NO: 704994 - protein, 23 aa, Mycobacterium
PAAPGARIRFMLADAAPVAAVTT

SEQ ID NO: 704995 - protein, 29 aa, Mycobacterium
PAAPMTVRCVDVWSLPCRTEPLTCSAAVA

SEQ ID NO: 704996 - protein, 24 aa, Mycobacterium
PAAPPAPAAPPWPPTPPAPPVATP

SEQ ID NO: 704997 - protein, 19 aa, Mycobacterium
PAAPPFPYTGVKLAAINLN

SEQ ID NO: 704998 - protein, 32 aa, Mycobacterium
PAAPPRFAEEIAWWVWWCWDQQLRKIEPSLLA

SEQ ID NO: 704999 - protein, 23 aa, Mycobacterium
PAAPRLHALVIYDASQLCAGRWN

SEQ ID NO: 705000 - protein, 20 aa, Mycobacterium
PAAPWRHRRHWISAKPTAAA

SEQ ID NO: 705001 - protein, 22 aa, Mycobacterium
PAAPYLHLFLARGRVSVEGIGE

SEQ ID NO: 705002 - protein, 17 aa, Mycobacterium
PAAQARLLATIEVHGEA

SEQ ID NO: 705003 - protein, 18 aa, Mycobacterium
PAAQWFPGVELNYVAQML

SEQ ID NO: 705004 - protein, 24 aa, Mycobacterium
PAARAAENILGYTIGNDVSARDHQ

SEQ ID NO: 705005 - protein, 17 aa, Mycobacterium
PAARAAWQQVLDGFDTP

SEQ ID NO: 705006 - protein, 23 aa, Mycobacterium
PAARAGEMLNLVAAYASDPIDPR

SEQ ID NO: 705007 - protein, 23 aa, Mycobacterium
PAARFCPTGGITPANMGDYLASP

SEQ ID NO: 705008 - protein, 17 aa, Mycobacterium
PAARRIDGAYGDRNLVC

SEQ ID NO: 705009 - protein, 25 aa, Mycobacterium
PAARRRLAAILAHHGLAVVTMNAFP

SEQ ID NO: 705010 - protein, 20 aa, Mycobacterium
PAARVWELLVDVEGWPAWTK

SEQ ID NO: 705011 - protein, 19 aa, Mycobacterium
PAARYRRWLAALRGQARLV

SEQ ID NO: 705012 - protein, 22 aa, Mycobacterium
PAASALPFRFTVNGYRGCTHAC

SEQ ID NO: 705013 - protein, 19 aa, Mycobacterium
PAATREMIKTGGFDAVCFT

SEQ ID NO: 705014 - protein, 27 aa, Mycobacterium
PAATSWRKLDPWLRHTFSDARQQLPLT

SEQ ID NO: 705015 - protein, 18 aa, Mycobacterium
PAAVAPCTGPRHWWGGQL

SEQ ID NO: 705016 - protein, 25 aa, Mycobacterium
PAAVDDVWAATQWVAAHAEELGGDA

SEQ ID NO: 705017 - protein, 26 aa, Mycobacterium
PAAVECFKSGSPMNVMGFAVKTADDY

SEQ ID NO: 705018 - protein, 20 aa, Mycobacterium
PAAVEDVWAATRWVADNADQ

SEQ ID NO: 705019 - protein, 24 aa, Mycobacterium
PAAVINRLPVRYTFDNRYFNDTYE

SEQ ID NO: 705020 - protein, 24 aa, Mycobacterium
PAAVRLKFARDVLAELEIRKRRRG

SEQ ID NO: 705021 - protein, 28 aa, Mycobacterium
PAAVSPWWLQRRLLLAGIRATSPAVDVT

SEQ ID NO: 705022 - protein, 29 aa, Mycobacterium
PAAVSPWWLQRRLMLCGIRAISPAVDATN

SEQ ID NO: 705023 - protein, 19 aa, Mycobacterium
PAAVVIDCVARESSVAQAV

SEQ ID NO: 705024 - protein, 25 aa, Mycobacterium
PAAWDLGIRCCADIFEQLGGALEVN

SEQ ID NO: 705025 - protein, 23 aa, Mycobacterium
PAAWRVRARLLAAVPLLRDHSVT

SEQ ID NO: 705026 - protein, 17 aa, Mycobacterium
PACAALAAQRPDRADTL

SEQ ID NO: 705027 - protein, 19 aa, Mycobacterium
PACHLVPIDTCYEFVGRLR

SEQ ID NO: 705028 - protein, 20 aa, Mycobacterium
PACWMDELLYARAATIYAGS

SEQ ID NO: 705029 - protein, 17 aa, Mycobacterium
PADAAWTDTDWAGRSVE

SEQ ID NO: 705030 - protein, 18 aa, Mycobacterium
PADAGGTVGAARKAQGAR

SEQ ID NO: 705031 - protein, 18 aa, Mycobacterium
PADAISIADVLRCIDGPL

SEQ ID NO: 705032 - protein, 19 aa, Mycobacterium
PADAQCVLELGCGEGVFGA

SEQ ID NO: 705033 - protein, 18 aa, Mycobacterium
PADARCLVHESMAPGLTA

SEQ ID NO: 705034 - protein, 19 aa, Mycobacterium
PADARLRIKRRRTERERLQ

SEQ ID NO: 705035 - protein, 23 aa, Mycobacterium
PADARPGGVPVWSPYIRGERTPF

SEQ ID NO: 705036 - protein, 18 aa, Mycobacterium
PADAYWLLRHAIACPDPV

SEQ ID NO: 705037 - protein, 17 aa, Mycobacterium
PADCVGNACNGRDGGLI

SEQ ID NO: 705038 - protein, 19 aa, Mycobacterium
PADCVNALAALTSDPLVDE

SEQ ID NO: 705039 - protein, 22 aa, Mycobacterium
PADDKGAGIAVFLVPADTPGVD

SEQ ID NO: 705040 - protein, 20 aa, Mycobacterium
PADDKGPGIAVFLVPADAAG

SEQ ID NO: 705041 - protein, 18 aa, Mycobacterium
PADDPDYLAAQRDLAAAN

SEQ ID NO: 705042 - protein, 18 aa, Mycobacterium
PADDPLAVYAERLSTGIL

SEQ ID NO: 705043 - protein, 19 aa, Mycobacterium
PADDPRIWPNIVGEQLGWD

SEQ ID NO: 705044 - protein, 23 aa, Mycobacterium
PADDPRLAPGYAATGDPQIDEVA

SEQ ID NO: 705045 - protein, 18 aa, Mycobacterium
PADEAIGPGDRWILEQIR

SEQ ID NO: 705046 - protein, 18 aa, Mycobacterium
PADEAIGPGDRWIVDQIR

SEQ ID NO: 705047 - protein, 24 aa, Mycobacterium
PADEAIGPGDRWIVEQIRATAPKA

SEQ ID NO: 705048 - protein, 18 aa, Mycobacterium
PADEAIGPGDRWIYQQIR

SEQ ID NO: 705049 - protein, 18 aa, Mycobacterium
PADEDWFDDADPWSGEVY

SEQ ID NO: 705050 - protein, 24 aa, Mycobacterium
PADEGEALFNAALRYFNGGLGVEI

SEQ ID NO: 705051 - protein, 24 aa, Mycobacterium
PADERRLYARMMEVFAGFLEHTDH

SEQ ID NO: 705052 - protein, 24 aa, Mycobacterium
PADESIGPGDRWIIEQIAATAPKV

SEQ ID NO: 705053 - protein, 20 aa, Mycobacterium
PADFDGWAVSGWSWAEVRDH

SEQ ID NO: 705054 - protein, 18 aa, Mycobacterium
PADFDVCPIILTQPDEDQ

SEQ ID NO: 705055 - protein, 17 aa, Mycobacterium
PADFKYWPAENGVVMKT

SEQ ID NO: 705056 - protein, 22 aa, Mycobacterium
PADFLHGRWLVLRRGKRTVAGV

SEQ ID NO: 705057 - protein, 17 aa, Mycobacterium
PADFVKVSYWSHRGKLD

SEQ ID NO: 705058 - protein, 30 aa, Mycobacterium
PADGASNWYLEFARLAPLMEKDTHYEVDLR

SEQ ID NO: 705059 - protein, 22 aa, Mycobacterium
PADGDPVWLRFYGCNPRHHALA

SEQ ID NO: 705060 - protein, 29 aa, Mycobacterium
PADGFKVIATRSRLMARLAGQGAMALLEL

SEQ ID NO: 705061 - protein, 29 aa, Mycobacterium
PADGFLPTLLDWCRKNDVVFIADEVQTGF

SEQ ID NO: 705062 - protein, 30 aa, Mycobacterium
PADGGVRLSGRWSWATGVMDGNWIIVGTLC

SEQ ID NO: 705063 - protein, 26 aa, Mycobacterium
PADGGVRLTGRWSWATGAMAADWVMV

SEQ ID NO: 705064 - protein, 25 aa, Mycobacterium
PADGGVRVTGRWAWATGAMDADWMI

SEQ ID NO: 705065 - protein, 23 aa, Mycobacterium
PADHFTSVVSFTMLHHVPTVELQ

SEQ ID NO: 705066 - protein, 28 aa, Mycobacterium
PADIAEFLLEWCPRRFEGRPDDAASLCF

SEQ ID NO: 705067 - protein, 27 aa, Mycobacterium
PADIAEIVAFLAGPARWVNGQVIYANG

SEQ ID NO: 705068 - protein, 20 aa, Mycobacterium
PADIFKKVFVEGAGGEVVAD

SEQ ID NO: 705069 - protein, 23 aa, Mycobacterium
PADLAELLWSFAPSPRSRPADAS

SEQ ID NO: 705070 - protein, 22 aa, Mycobacterium
PADLKALWRIGINVFVETFGTH

SEQ ID NO: 705071 - protein, 31 aa, Mycobacterium
PADLLAHCLRQLVARSGVDPVQIDDVIAGAV

SEQ ID NO: 705072 - protein, 26 aa, Mycobacterium
PADLNFLWLPLAHAFGKVMLSLPLLI

SEQ ID NO: 705073 - protein, 23 aa, Mycobacterium
PADLPHGFAVRYQAASRPLQVGG

SEQ ID NO: 705074 - protein, 27 aa, Mycobacterium
PADLPLCALMTAWVRGRARPEAAAQVR

SEQ ID NO: 705075 - protein, 21 aa, Mycobacterium
PADLPSGLSMEILHEKNFLAA

SEQ ID NO: 705076 - protein, 23 aa, Mycobacterium
PADLRIPFDPREVITRIVDGSEF

SEQ ID NO: 705077 - protein, 22 aa, Mycobacterium
PADLRVGMRVRPVFFDYPEHDV

SEQ ID NO: 705078 - protein, 20 aa, Mycobacterium
PADLVPLLFAHTTYKTYAEG

SEQ ID NO: 705079 - protein, 26 aa, Mycobacterium
PADMAGLCKQVGMTLVKSVGGASGPL

SEQ ID NO: 705080 - protein, 19 aa, Mycobacterium
PADMRERYQRPGVAEQAQQ

SEQ ID NO: 705081 - protein, 19 aa, Mycobacterium
PADNARLVTTLTRHPGGAT

SEQ ID NO: 705082 - protein, 18 aa, Mycobacterium
PADNVWASGAATAAFDAF

SEQ ID NO: 705083 - protein, 28 aa, Mycobacterium
PADPTVWTTAAWWRRVRDTQRSDIITVD

SEQ ID NO: 705084 - protein, 19 aa, Mycobacterium
PADRARIVAEPQLIPRAVE

SEQ ID NO: 705085 - protein, 31 aa, Mycobacterium
PADRFACCTDFADAFARAARRVEHPIASAST

SEQ ID NO: 705086 - protein, 17 aa, Mycobacterium
PADRGWFSNWQNQTVPL

SEQ ID NO: 705087 - protein, 25 aa, Mycobacterium
PADRHPHCAWTVIIDEAYPEVKGIP

SEQ ID NO: 705088 - protein, 25 aa, Mycobacterium
PADRHPHCAWTVIIDESYPEAQAIP

SEQ ID NO: 705089 - protein, 18 aa, Mycobacterium
PADRMVGAPGDGWAVAMT

SEQ ID NO: 705090 - protein, 23 aa, Mycobacterium
PADSRLLLMWGAANRDPRQFNSA

SEQ ID NO: 705091 - protein, 21 aa, Mycobacterium
PADTMVRLCVAAINRDDSDEI

SEQ ID NO: 705092 - protein, 28 aa, Mycobacterium
PADTRLPLTWIALLCGRIRASLAASTGV

SEQ ID NO: 705093 - protein, 25 aa, Mycobacterium
PADTRWHPVNALPPMAFDHGPMVTH

SEQ ID NO: 705094 - protein, 25 aa, Mycobacterium
PADVANRLAVRRGWVAAELAMFSGE

SEQ ID NO: 705095 - protein, 20 aa, Mycobacterium
PADVAVLTFRLSQLCEHTAA

SEQ ID NO: 705096 - protein, 19 aa, Mycobacterium
PADVCGYGPIPAAVARTMV

SEQ ID NO: 705097 - protein, 20 aa, Mycobacterium
PADVIDGWLVAVPELHSLRA

SEQ ID NO: 705098 - protein, 18 aa, Mycobacterium
PADVPGIERLVRDAFALY

SEQ ID NO: 705099 - protein, 26 aa, Mycobacterium
PADVPHNWVGAPGYLDTVTWRRQATP

SEQ ID NO: 705100 - protein, 23 aa, Mycobacterium
PADVQKFATFFLMMDPPEHTVYR

SEQ ID NO: 705101 - protein, 25 aa, Mycobacterium
PADVRLRLLQTLDLFGIALGVAAFR

SEQ ID NO: 705102 - protein, 17 aa, Mycobacterium
PADVVVYATGFGSMNGW

SEQ ID NO: 705103 - protein, 21 aa, Mycobacterium
PADVWLRLEGGTIRGGVQQID

SEQ ID NO: 705104 - protein, 24 aa, Mycobacterium
PADYAGKWVIFFSHPADFTPVCTS

SEQ ID NO: 705105 - protein, 28 aa, Mycobacterium
PADYGTYGGLFIRMSWHSAGTYRIHDGR

SEQ ID NO: 705106 - protein, 19 aa, Mycobacterium
PAEAFPGLLEQQLGGSLYE

SEQ ID NO: 705107 - protein, 27 aa, Mycobacterium
PAEAIRAAQIAKVYCARATRTVCETAI

SEQ ID NO: 705108 - protein, 24 aa, Mycobacterium
PAEAKRPGTGQTLGQSITVGITNL

SEQ ID NO: 705109 - protein, 23 aa, Mycobacterium
PAEAPGFDWSGWVQGLGTTPDTV

SEQ ID NO: 705110 - protein, 30 aa, Mycobacterium
PAEARTALAGRLPVYMVPAAVLGLDALPLT

SEQ ID NO: 705111 - protein, 21 aa, Mycobacterium
PAEAVADCRRAWASLADRRKR

SEQ ID NO: 705112 - protein, 22 aa, Mycobacterium
PAEAVVAAAHWVRDELDYLPGT

SEQ ID NO: 705113 - protein, 25 aa, Mycobacterium
PAEEISVPFAIDVLHWDENVLVVDK

SEQ ID NO: 705114 - protein, 17 aa, Mycobacterium
PAEESWETGPYLRFAPR

SEQ ID NO: 705115 - protein, 17 aa, Mycobacterium
PAEFGPIRVRFLGINAR

SEQ ID NO: 705116 - protein, 18 aa, Mycobacterium
PAEFTDAVVQHWGPPPGE

SEQ ID NO: 705117 - protein, 23 aa, Mycobacterium
PAEGFDIIATRTRLMKRLSGQGA

SEQ ID NO: 705118 - protein, 26 aa, Mycobacterium
PAEGLRVIAIRSRLMARMAGQGAVAL

SEQ ID NO: 705119 - protein, 21 aa, Mycobacterium
PAEHVLSLVVHHIASDHWSAG

SEQ ID NO: 705120 - protein, 24 aa, Mycobacterium
PAEIREFLEGYVIGQDSAKRTLAV

SEQ ID NO: 705121 - protein, 26 aa, Mycobacterium
PAEKEAWTGLVSLILLMPGRLEAPLR

SEQ ID NO: 705122 - protein, 29 aa, Mycobacterium
PAEKLWQIADRLGVEIPRDRGYGHGKLVE

SEQ ID NO: 705123 - protein, 27 aa, Mycobacterium
PAELAATAAQWSALSSQLVGTPPTSGQ

SEQ ID NO: 705124 - protein, 18 aa, Mycobacterium
PAELAAVASAVLYESRGD

SEQ ID NO: 705125 - protein, 29 aa, Mycobacterium
PAELADAVVEHWGPPPGHLFVDRSRDPDG

SEQ ID NO: 705126 - protein, 19 aa, Mycobacterium
PAELAGLWELPGGKVTPGE

SEQ ID NO: 705127 - protein, 23 aa, Mycobacterium
PAELARFLRLHLGIRTKQETRYL

SEQ ID NO: 705128 - protein, 18 aa, Mycobacterium
PAELDLAAEFSVSRNTVR

SEQ ID NO: 705129 - protein, 23 aa, Mycobacterium
PAELERVLARSAGILGIELGAEA

SEQ ID NO: 705130 - protein, 19 aa, Mycobacterium
PAELEWTLARTDHVDADTE

SEQ ID NO: 705131 - protein, 18 aa, Mycobacterium
PAELFGLDNVVLFPHIGS

SEQ ID NO: 705132 - protein, 17 aa, Mycobacterium
PAELFIDPSHTYRLRFA

SEQ ID NO: 705133 - protein, 21 aa, Mycobacterium
PAELGVRMHVRVQSLTDSLNE

SEQ ID NO: 705134 - protein, 26 aa, Mycobacterium
PAELHFLGAVLWRRGLHRVLREFVDR

SEQ ID NO: 705135 - protein, 24 aa, Mycobacterium
PAELKMLKQKGFRVLAMTPDSTAC

SEQ ID NO: 705136 - protein, 22 aa, Mycobacterium
PAELLPAGLSPVFSAAESSTGA

SEQ ID NO: 705137 - protein, 25 aa, Mycobacterium
PAELRGRWTRMLTHCRRARLMAYRV

SEQ ID NO: 705138 - protein, 20 aa, Mycobacterium
PAELTDAVTHHWGPPPGDLF

SEQ ID NO: 705139 - protein, 19 aa, Mycobacterium
PAELTRAAGELARSCHTTV

SEQ ID NO: 705140 - protein, 22 aa, Mycobacterium
PAELVDRWGPDRAMINAYGPTE

SEQ ID NO: 705141 - protein, 18 aa, Mycobacterium
PAELVLLPGAAAALAALN

SEQ ID NO: 705142 - protein, 31 aa, Mycobacterium; identical to SEQ ID NO: 101432

SEQ ID NO: 705143 - protein, 20 aa, Mycobacterium
PAEPTAWIAEGLLIYLPAEA

SEQ ID NO: 705144 - protein, 21 aa, Mycobacterium
PAEPTTAFPSMRSEQDDPDAA

SEQ ID NO: 705145 - protein, 20 aa, Mycobacterium
PAEQLRLWVDSLLSATDGKL

SEQ ID NO: 705146 - protein, 30 aa, Mycobacterium
PAERADFGWRVVDALGWPASRLDEAIEAAA

SEQ ID NO: 705147 - protein, 20 aa, Mycobacterium
PAERELAARFGVARETVRQA

SEQ ID NO: 705148 - protein, 19 aa, Mycobacterium
PAERERFLAAVDALADLPA

SEQ ID NO: 705149 - protein, 21 aa, Mycobacterium
PAERLRYAPGQFLTLRVPSDR

SEQ ID NO: 705150 - protein, 25 aa, Mycobacterium
PAERQRLKFVVLVPHRGARIRLRAL

SEQ ID NO: 705151 - protein, 17 aa, Mycobacterium
PAERVAAEFAHRFATEH

SEQ ID NO: 705152 - protein, 19 aa, Mycobacterium
PAERYRRWLSVLRGQARVV

SEQ ID NO: 705153 - protein, 19 aa, Mycobacterium
PAESSWRALDPQLRETFLG

SEQ ID NO: 705154 - protein, 28 aa, Mycobacterium
PAETFACSFRLTGRLFRRRPQESQILLV

SEQ ID NO: 705155 - protein, 28 aa, Mycobacterium
PAETGVTVPFVIDWEGVEAAELVALTET

SEQ ID NO: 705156 - protein, 23 aa, Mycobacterium
PAETRFNRDFSRFEAGARPAFTD

SEQ ID NO: 705157 - protein, 21 aa, Mycobacterium
PAEVADAYFALMDHLGTDGLL

SEQ ID NO: 705158 - protein, 25 aa, Mycobacterium
PAEVPARLEALGALGGLDRAALHSQ

SEQ ID NO: 705159 - protein, 26 aa, Mycobacterium
PAEVPARLEALGALGGLDRYALSSQA

SEQ ID NO: 705160 - protein, 25 aa, Mycobacterium
PAEVQRLPLNVTWVNLTTGRSGSAT

SEQ ID NO: 705161 - protein, 19 aa, Mycobacterium
PAEVWARVMPAVIDELTRW

SEQ ID NO: 705162 - protein, 21 aa, Mycobacterium
PAEVYPRLQAAQRRAPVAIGP

SEQ ID NO: 705163 - protein, 18 aa, Mycobacterium
PAEWAHSTLSRFRGIGVS

SEQ ID NO: 705164 - protein, 17 aa, Mycobacterium
PAFAAAAGFPRPILHGL

SEQ ID NO: 705165 - protein, 18 aa, Mycobacterium
PAFADIPAGWQTVYGEAD

SEQ ID NO: 705166 - protein, 20 aa, Mycobacterium
PAFAEHLVRLGITSVSVNPD

SEQ ID NO: 705167 - protein, 25 aa, Mycobacterium
PAFALGDYEWILAFEAPELDRIVDL

SEQ ID NO: 705168 - protein, 25 aa, Mycobacterium
PAFALGDYEWILAFEAPELHRIVDL

SEQ ID NO: 705169 - protein, 26 aa, Mycobacterium
PAFALGDYEWLLAFEAPELYRIVDLM

SEQ ID NO: 705170 - protein, 17 aa, Mycobacterium
PAFAQAFHTTLYQFVLD

SEQ ID NO: 705171 - protein, 17 aa, Mycobacterium
PAFARLTALVRRTAGDD

SEQ ID NO: 705172 - protein, 19 aa, Mycobacterium
PAFDSRLMKLEDEMKGDRY

SEQ ID NO: 705173 - protein, 30 aa, Mycobacterium
PAFEGRRLRDWAARCIPSPTGYLYTQVTDW

SEQ ID NO: 705174 - protein, 17 aa, Mycobacterium
PAFEGVGAMGGFDDVAL

SEQ ID NO: 705175 - protein, 20 aa, Mycobacterium
PAFEVDWAGCKRVHMQNVAG

SEQ ID NO: 705176 - protein, 17 aa, Mycobacterium
PAFEWYYQSGLSVIMPV

SEQ ID NO: 705177 - protein, 19 aa, Mycobacterium
PAFFGVRPHAVIKGGGIVW

SEQ ID NO: 705178 - protein, 28 aa, Mycobacterium
PAFFGVRPHAVIKGGMIAWAAMGDANAS

SEQ ID NO: 705179 - protein, 23 aa, Mycobacterium
PAFGDLLGGMAIAGGIAAALYRK

SEQ ID NO: 705180 - protein, 23 aa, Mycobacterium
PAFGDSIGGMFIAGGISAALLHR

SEQ ID NO: 705181 - protein, 24 aa, Mycobacterium
PAFGDSIGGMFIAGGISAALLHRE

SEQ ID NO: 705182 - protein, 20 aa, Mycobacterium
PAFGGTLPPYPGWPDQIDDG

SEQ ID NO: 705183 - protein, 18 aa, Mycobacterium
PAFGKLLSSFPWPLNKTT

SEQ ID NO: 705184 - protein, 27 aa, Mycobacterium
PAFGTPSYFAQLAFAVFHVVALPITVP

SEQ ID NO: 705185 - protein, 23 aa, Mycobacterium
PAFIRFMLRRVLKAPEFLKLDVV

SEQ ID NO: 705186 - protein, 24 aa, Mycobacterium
PAFLLNEMLVWGFTGQVISALLDV

SEQ ID NO: 705187 - protein, 24 aa, Mycobacterium
PAFLLNEMLVWGFTGQVISAMLDV

SEQ ID NO: 705188 - protein, 19 aa, Mycobacterium
PAFRGIVGLAVTESGAARA

SEQ ID NO: 705189 - protein, 27 aa, Mycobacterium
PAFVDVPAGWRVVFGAADRAACLDNIE

SEQ ID NO: 705190 - protein, 17 aa, Mycobacterium
PAFVGVHNRIDPQRHPQ

SEQ ID NO: 705191 - protein, 25 aa, Mycobacterium
PAFVRRMLGQLIPYPERVDMIRHRV

SEQ ID NO: 705192 - protein, 22 aa, Mycobacterium
PAGAASATFSARLVGAAGSAVA

SEQ ID NO: 705193 - protein, 26 aa, Mycobacterium
PAGAFFGLWQPLGHRGFEIIGEAGAA

SEQ ID NO: 705194 - protein, 24 aa, Mycobacterium
PAGAGGHGGDAGWLGNGGAGGTGG

SEQ ID NO: 705195 - protein, 21 aa, Mycobacterium
PAGAMVGLWQPLAHKGFQLVG

SEQ ID NO: 705196 - protein, 34 aa, Mycobacterium
PAGARDFQRFLIGKLRDIREVVATASLDDTSKAT

SEQ ID NO: 705197 - protein, 23 aa, Mycobacterium
PAGARLSGIDWVRFGQLQRHELG

SEQ ID NO: 705198 - protein, 18 aa, Mycobacterium
PAGARPPASARRFRDVMI

SEQ ID NO: 705199 - protein, 17 aa, Mycobacterium
PAGATWTDTGWAGRSVE

SEQ ID NO: 705200 - protein, 22 aa, Mycobacterium
PAGAYFKGGINPVTVWVSTEYV

SEQ ID NO: 705201 - protein, 19 aa, Mycobacterium
PAGCSPRLLSEQGGREDLA

SEQ ID NO: 705202 - protein, 24 aa, Mycobacterium
PAGDRPLGGLLVMDEAQNFAPARG

SEQ ID NO: 705203 - protein, 24 aa, Mycobacterium
PAGEALKAVGAFRLALPRTMLRFA

SEQ ID NO: 705204 - protein, 18 aa, Mycobacterium
PAGEGVSYGHTWIAPHDT

SEQ ID NO: 705205 - protein, 18 aa, Mycobacterium
PAGEIKRVMGGVPATEAV

SEQ ID NO: 705206 - protein, 21 aa, Mycobacterium
PAGEPDLSFDVIVLGAGPVGE

SEQ ID NO: 705207 - protein, 17 aa, Mycobacterium
PAGEWMPAVIAAADERL

SEQ ID NO: 705208 - protein, 20 aa, Mycobacterium
PAGFERLVGLGIIRLEDDHA

SEQ ID NO: 705209 - protein, 17 aa, Mycobacterium
PAGGDIRRALALVSTRA

SEQ ID NO: 705210 - protein, 19 aa, Mycobacterium
PAGGEIVLFDRSWYNRAGV

SEQ ID NO: 705211 - protein, 17 aa, Mycobacterium
PAGGVGINLAVADAVAA

SEQ ID NO: 705212 - protein, 25 aa, Mycobacterium
PAGHYTLRAAIDWQQHKPNGSHLVD

SEQ ID NO: 705213 - protein, 25 aa, Mycobacterium
PAGHYTLRASVDWQQHKPNGAHVVN

SEQ ID NO: 705214 - protein, 17 aa, Mycobacterium
PAGIFLARYDDRLRRAQ

SEQ ID NO: 705215 - protein, 20 aa, Mycobacterium
PAGIFLARYGDHLKRAEQMA

SEQ ID NO: 705216 - protein, 25 aa, Mycobacterium
PAGIGARYTVHWKIGSVPVGGLIEV

SEQ ID NO: 705217 - protein, 18 aa, Mycobacterium
PAGIKWAADCGQLCVKFS

SEQ ID NO: 705218 - protein, 24 aa, Mycobacterium
PAGIVALRTSFGGSRIVDMLVGDP

SEQ ID NO: 705219 - protein, 17 aa, Mycobacterium
PAGIWTYEAHRVAAKRP

SEQ ID NO: 705220 - protein, 23 aa, Mycobacterium
PAGLAVYRRGRRLRFMIKAEMQQ

SEQ ID NO: 705221 - protein, 17 aa, Mycobacterium
PAGLPVCVTVTLVDGLV

SEQ ID NO: 705222 - protein, 20 aa, Mycobacterium
PAGLRRAAVSSFGLSGTNAH

SEQ ID NO: 705223 - protein, 17 aa, Mycobacterium
PAGMLRARREAEALAVS

SEQ ID NO: 705224 - protein, 18 aa, Mycobacterium
PAGMMLALLLARAGIDVT

SEQ ID NO: 705225 - protein, 24 aa, Mycobacterium
PAGNRPLGGLLVMDEAQNFAPSSH

SEQ ID NO: 705226 - protein, 25 aa, Mycobacterium
PAGPDLRDVSGWTLDRPPHHLESSV

SEQ ID NO: 705227 - protein, 27 aa, Mycobacterium
PAGPFDRWPTGLGFERFYGFLGGDTSQ

SEQ ID NO: 705228 - protein, 23 aa, Mycobacterium
PAGPGPWPGVIMFPDAGGVRETF

SEQ ID NO: 705229 - protein, 18 aa, Mycobacterium
PAGPIVGQAWQFLKELRL

SEQ ID NO: 705230 - protein, 19 aa, Mycobacterium
PAGPMAVLLRNSMTSDDAL

SEQ ID NO: 705231 - protein, 31 aa, Mycobacterium
PAGPRPFLRMEGTAVFRWAAFEMGKVGQQAM

SEQ ID NO: 705232 - protein, 17 aa, Mycobacterium
PAGPSVLLLAAHVLAMD

SEQ ID NO: 705233 - protein, 20 aa, Mycobacterium
PAGPVAIRIYWPPSHSDGQT

SEQ ID NO: 705234 - protein, 19 aa, Mycobacterium
PAGQEVLDYLNFVADRLDL

SEQ ID NO: 705235 - protein, 22 aa, Mycobacterium
PAGQLRPLFDFAGSSCTSAVWS

SEQ ID NO: 705236 - protein, 18 aa, Mycobacterium
PAGQPCFTDGRTLFVSRD

SEQ ID NO: 705237 - protein, 28 aa, Mycobacterium
PAGQPLFPLAFCRECGQEFLVVNLDRGR

SEQ ID NO: 705238 - protein, 18 aa, Mycobacterium
PAGQPVCYLAPGPAGNGD

SEQ ID NO: 705239 - protein, 20 aa, Mycobacterium
PAGRAVLGVEWTRAPAYAVV

SEQ ID NO: 705240 - protein, 18 aa, Mycobacterium
PAGRCKRLAQAFGSADRR

SEQ ID NO: 705241 - protein, 22 aa, Mycobacterium
PAGRELLALAALKNGLTRRDVA

SEQ ID NO: 705242 - protein, 24 aa, Mycobacterium
PAGRGRRLPVFYSDLTGPVEQCSV

SEQ ID NO: 705243 - protein, 17 aa, Mycobacterium
PAGRPEQQVAILAVRLE

SEQ ID NO: 705244 - protein, 17 aa, Mycobacterium
PAGRQRLMMITGSRASA

SEQ ID NO: 705245 - protein, 28 aa, Mycobacterium
PAGRRATLAGGFFWLYNVISFPQYSIVF

SEQ ID NO: 705246 - protein, 20 aa, Mycobacterium
PAGRRLARRAGHELGSGTGL

SEQ ID NO: 705247 - protein, 18 aa, Mycobacterium
PAGRVIWPEQVFRQVREL

SEQ ID NO: 705248 - protein, 23 aa, Mycobacterium
PAGSDLRRALALVKTLDELDSLL

SEQ ID NO: 705249 - protein, 23 aa, Mycobacterium
PAGSDVRRALALVKTLSELDDLL

SEQ ID NO: 705250 - protein, 17 aa, Mycobacterium
PAGSPVPGVGGKGGNPG

SEQ ID NO: 705251 - protein, 20 aa, Mycobacterium
PAGTALWFDCNIMHGSGSNI

SEQ ID NO: 705252 - protein, 22 aa, Mycobacterium
PAGTAVKAGRVGGGASAAAAAV

SEQ ID NO: 705253 - protein, 18 aa, Mycobacterium
PAGTEGNWVGGWTDFSGR

SEQ ID NO: 705254 - protein, 25 aa, Mycobacterium
PAGTGTRVAWQWTLHPKSGVSAPLL

SEQ ID NO: 705255 - protein, 23 aa, Mycobacterium
PAGTLYRYRTRTFLHGTVTRETT

SEQ ID NO: 705256 - protein, 34 aa, Mycobacterium
PAGVARQAWQPRWLKWALAISRQGAFDHSGIPST

SEQ ID NO: 705257 - protein, 18 aa, Mycobacterium
PAGVFSWQPPAALIEELS

SEQ ID NO: 705258 - protein, 17 aa, Mycobacterium
PAGVFSWQPPSALVVAL

SEQ ID NO: 705259 - protein, 18 aa, Mycobacterium
PAGVFSWSPPAALVTALS

SEQ ID NO: 705260 - protein, 18 aa, Mycobacterium
PAGWPTQRVIGGPGSARV

SEQ ID NO: 705261 - protein, 18 aa, Mycobacterium
PAGWSHFDADRWELFHIA

SEQ ID NO: 705262 - protein, 17 aa, Mycobacterium
PAHAIARRYHMIVDGQS

SEQ ID NO: 705263 - protein, 30 aa, Mycobacterium
PAHEVDGLFIPRAPTEFGIKDNPKLRATAA

SEQ ID NO: 705264 - protein, 18 aa, Mycobacterium
PAHKELFDRAWKSPDVIE

SEQ ID NO: 705265 - protein, 25 aa, Mycobacterium
PAHLAEELVRIIGVLRGMQLKKVPS

SEQ ID NO: 705266 - protein, 18 aa, Mycobacterium
PAHLEWLDAEIAAGNILI

SEQ ID NO: 705267 - protein, 18 aa, Mycobacterium
PAHMPRAGLPEEIGPVVA

SEQ ID NO: 705268 - protein, 24 aa, Mycobacterium
PAHPDARIEFVLKDAAPVAAVSSA

SEQ ID NO: 705269 - protein, 19 aa, Mycobacterium
PAHPEFHLDNPLNYMTPEL

SEQ ID NO: 705270 - protein, 26 aa, Mycobacterium
PAHRELRLLAADMVFDLPVVGEAARK

SEQ ID NO: 705271 - protein, 20 aa, Mycobacterium
PAHSAARMEFVLSDAAPSAV

SEQ ID NO: 705272 - protein, 19 aa, Mycobacterium
PAHTEFRKLVSRGFTPRQV

SEQ ID NO: 705273 - protein, 26 aa, Mycobacterium
PAHTREMIKTGGFDAVCFTSSSTVRN

SEQ ID NO: 705274 - protein, 18 aa, Mycobacterium
PAHVWDEIGWQGRETVGD

SEQ ID NO: 705275 - protein, 25 aa, Mycobacterium
PAHWPWATHWLRLWRNTIGHSPPAT

SEQ ID NO: 705276 - protein, 17 aa, Mycobacterium
PAIAQVCVVGAPDEKWG

SEQ ID NO: 705277 - protein, 26 aa, Mycobacterium
PAIARSREVWLMVSGAGKADAAAAAI

SEQ ID NO: 705278 - protein, 24 aa, Mycobacterium
PAIAYTCKRCRGNSIRATHIEPLL

SEQ ID NO: 705279 - protein, 23 aa, Mycobacterium
PAIDAEALLPVPDARSVAGQVVL

SEQ ID NO: 705280 - protein, 20 aa, Mycobacterium
PAIDAMRRFITAGVSIGERL

SEQ ID NO: 705281 - protein, 17 aa, Mycobacterium
PAIDRVVRRVCSPYYRL

SEQ ID NO: 705282 - protein, 23 aa, Mycobacterium
PAIEELLRWLSIVSTALPRITTT

SEQ ID NO: 705283 - protein, 17 aa, Mycobacterium
PAIGFAAGLGAFPAVGA

SEQ ID NO: 705284 - protein, 29 aa, Mycobacterium
PAIHRLSGVTLHLPFAVADYVDFYASEHH

SEQ ID NO: 705285 - protein, 21 aa, Mycobacterium
PAIKGMWTVPVFGNPTGITYS

SEQ ID NO: 705286 - protein, 26 aa, Mycobacterium
PAIKIPGQGFVDLPLPTTIPGASVLN

SEQ ID NO: 705287 - protein, 19 aa, Mycobacterium
PAILEKVKRCNIIVPAMPI

SEQ ID NO: 705288 - protein, 21 aa, Mycobacterium
PAILELYKLGQLNLDDMVTRE

SEQ ID NO: 705289 - protein, 27 aa, Mycobacterium
PAILIPALVGHGGWERLQRFAVITQFT

SEQ ID NO: 705290 - protein, 25 aa, Mycobacterium
PAILKGWIDRVFVKGFAYGIADPEN

SEQ ID NO: 705291 - protein, 27 aa, Mycobacterium
PAILMPLRAREEVVGVIAIARGADEPP

SEQ ID NO: 705292 - protein, 17 aa, Mycobacterium
PAINVGVSVSRVGGAAQ

SEQ ID NO: 705293 - protein, 17 aa, Mycobacterium
PAIPKEVPQEFVSYVPQ

SEQ ID NO: 705294 - protein, 24 aa, Mycobacterium
PAIQCEVWEGFIFVNLDPHNTEPL

SEQ ID NO: 705295 - protein, 20 aa, Mycobacterium
PAIQFERRWVTWGQIAESAR

SEQ ID NO: 705296 - protein, 21 aa, Mycobacterium
PAIRARWERRLAQVGPARLHA

SEQ ID NO: 705297 - protein, 24 aa, Mycobacterium
PAIRKELANVLALRELNRLNNARA

SEQ ID NO: 705298 - protein, 19 aa, Mycobacterium
PAIRTRLAADLQILKQIAR

SEQ ID NO: 705299 - protein, 19 aa, Mycobacterium
PAISKRVLLAEPRGYCAGV

SEQ ID NO: 705300 - protein, 19 aa, Mycobacterium
PAITALHFVGAGMRILEIV

SEQ ID NO: 705301 - protein, 18 aa, Mycobacterium
PAIVSGWHNRQWAHHVPV

SEQ ID NO: 705302 - protein, 21 aa, Mycobacterium
PAKDRPRVIAVDAVPDEVGAT

SEQ ID NO: 705303 - protein, 20 aa, Mycobacterium
PAKDYREWFATLPAELADAV

SEQ ID NO: 705304 - protein, 23 aa, Mycobacterium
PAKHLWTRTSLRPDDVDVAELYD

SEQ ID NO: 705305 - protein, 23 aa, Mycobacterium
PAKLKEGYANFAIDEPPLKLVLF

SEQ ID NO: 705306 - protein, 23 aa, Mycobacterium
PAKLKRLIIDLIDKENWSASGTD

SEQ ID NO: 705307 - protein, 19 aa, Mycobacterium
PAKLPAIRQQIWTLIRAAK

SEQ ID NO: 705308 - protein, 19 aa, Mycobacterium
PAKLPAIRQQIWTLMRAAK

SEQ ID NO: 705309 - protein, 18 aa, Mycobacterium
PAKLPGKTLKALQNTKIQ

SEQ ID NO: 705310 - protein, 20 aa, Mycobacterium
PAKLRSWVREGYGWLQPRLS

SEQ ID NO: 705311 - protein, 19 aa, Mycobacterium
PAKMKLAVTGCPRNCAEAL

SEQ ID NO: 705312 - protein, 19 aa, Mycobacterium
PAKQGYLIATLRDFMADDD

SEQ ID NO: 705313 - protein, 27 aa, Mycobacterium
PAKRRRFPVEIVRRTRAAVGPDFIICY

SEQ ID NO: 705314 - protein, 19 aa, Mycobacterium
PAKRRYEVLRALNDDRLAD

SEQ ID NO: 705315 - protein, 18 aa, Mycobacterium
PAKVIAMCNQKGGVGKTT

SEQ ID NO: 705316 - protein, 19 aa, Mycobacterium
PAKVKPGYANFVVADPPLK

SEQ ID NO: 705317 - protein, 17 aa, Mycobacterium
PALAAAERAKVVVIGSN

SEQ ID NO: 705318 - protein, 17 aa, Mycobacterium
PALAAGCTVVLKAAPDT

SEQ ID NO: 705319 - protein, 17 aa, Mycobacterium
PALAAGCTVVLKGAPDT

SEQ ID NO: 705320 - protein, 19 aa, Mycobacterium
PALADAYRADARRTAQRAH

SEQ ID NO: 705321 - protein, 22 aa, Mycobacterium
PALAEAAADLFLLPSGDDLVLV

SEQ ID NO: 705322 - protein, 23 aa, Mycobacterium
PALAESWDSVGLVCGDPDQQIDT

SEQ ID NO: 705323 - protein, 19 aa, Mycobacterium
PALAGPVLIGGEGRLAEPL

SEQ ID NO: 705324 - protein, 25 aa, Mycobacterium
PALAGRRVELVFSPFDLESIEVRYR

SEQ ID NO: 705325 - protein, 19 aa, Mycobacterium
PALAGVRVDSGFRAGSVIS

SEQ ID NO: 705326 - protein, 20 aa, Mycobacterium
PALAGVRVDSGFRAGSVISH

SEQ ID NO: 705327 - protein, 29 aa, Mycobacterium
PALAKLWAQACAWEPLAPKTLRLLQVGGA

SEQ ID NO: 705328 - protein, 26 aa, Mycobacterium
PALAKLWAQACEWEPVTPKSLRLLQV

SEQ ID NO: 705329 - protein, 26 aa, Mycobacterium
PALAKLWAQACEWEPVTPKTLRLLQV

SEQ ID NO: 705330 - protein, 19 aa, Mycobacterium
PALAKLWTQACDWEPVTPK

SEQ ID NO: 705331 - protein, 24 aa, Mycobacterium
PALALDVWLSYELRRAGFDSDAVW

SEQ ID NO: 705332 - protein, 25 aa, Mycobacterium
PALALDVWVAYELRRAGLEPDAVWP

SEQ ID NO: 705333 - protein, 25 aa, Mycobacterium
PALAPAIRVPVRFSIAEHEKVWQND

SEQ ID NO: 705334 - protein, 19 aa, Mycobacterium
PALARAVVNLHRRYRITTA

SEQ ID NO: 705335 - protein, 22 aa, Mycobacterium
PALARLGLAVIRGLLLDLVATD

SEQ ID NO: 705336 - protein, 17 aa, Mycobacterium
PALASALVTAIDHVGIA

SEQ ID NO: 705337 - protein, 20 aa, Mycobacterium
PALASRGFSHDDFGAVADIV

SEQ ID NO: 705338 - protein, 23 aa, Mycobacterium
PALDASLLLAVLTRFLPPDDPRI

SEQ ID NO: 705339 - protein, 23 aa, Mycobacterium
PALDDVRFTHRWAGAIDTNTRFC

SEQ ID NO: 705340 - protein, 22 aa, Mycobacterium
PALDGFVPFPSVRADEYRRAGY

SEQ ID NO: 705341 - protein, 25 aa, Mycobacterium
PALDLRAGIACQLRGFGITSIDVDP

SEQ ID NO: 705342 - protein, 19 aa, Mycobacterium
PALDRMVDVFAKMRGVETA

SEQ ID NO: 705343 - protein, 18 aa, Mycobacterium
PALEAAMRTWEPAGPPSH

SEQ ID NO: 705344 - protein, 20 aa, Mycobacterium
PALEFDRRAAWGYKLDIASG

SEQ ID NO: 705345 - protein, 17 aa, Mycobacterium
PALEIIRTAPGISTVSS

SEQ ID NO: 705346 - protein, 19 aa, Mycobacterium
PALEKAWHTHGYYGSVNHN

SEQ ID NO: 705347 - protein, 18 aa, Mycobacterium
PALEMRIAEPTGFLGGDQ

SEQ ID NO: 705348 - protein, 17 aa, Mycobacterium
PALFDMFQYFNGVTASR

SEQ ID NO: 705349 - protein, 17 aa, Mycobacterium
PALFDMFQYFNGVTESR

SEQ ID NO: 705350 - protein, 18 aa, Mycobacterium
PALFSLPLAVDRASLDSL

SEQ ID NO: 705351 - protein, 19 aa, Mycobacterium
PALHCRLVDCDGSSEAVDL

SEQ ID NO: 705352 - protein, 25 aa, Mycobacterium
PALHMPDRILAAAVCYQSAREPRPY

SEQ ID NO: 705353 - protein, 23 aa, Mycobacterium
PALIAEAGGDPWAINQSLQAGQP

SEQ ID NO: 705354 - protein, 19 aa, Mycobacterium
PALILNRSHRCAAPLADAI

SEQ ID NO: 705355 - protein, 18 aa, Mycobacterium
PALITGGGRGIGRAIAIR

SEQ ID NO: 705356 - protein, 24 aa, Mycobacterium
PALLRKRPDPMAGMDDAPQSIEPL

SEQ ID NO: 705357 - protein, 32 aa, Mycobacterium
PALLRSCAEAMLVRHPNLRASFFQGNLTRPVA

SEQ ID NO: 705358 - protein, 21 aa, Mycobacterium
PALLSRLAYQLADRLVFSTIR

SEQ ID NO: 705359 - protein, 24 aa, Mycobacterium
PALLSVSFGTDWSWVAKAHEAGIP

SEQ ID NO: 705360 - protein, 24 aa, Mycobacterium
PALLSVSFGTDWSWVDKAHDAGIV

SEQ ID NO: 705361 - protein, 19 aa, Mycobacterium
PALLTRAARVISMTTGSGW

SEQ ID NO: 705362 - protein, 18 aa, Mycobacterium
PALLWVHGGGTIMGHASQ

SEQ ID NO: 705363 - protein, 17 aa, Mycobacterium
PALPLIADRDVRARQAH

SEQ ID NO: 705364 - protein, 23 aa, Mycobacterium
PALPRRIGRCALASQVIEGDGGV

SEQ ID NO: 705365 - protein, 20 aa, Mycobacterium
PALPVLGMTGSVFFEEAGRL

SEQ ID NO: 705366 - protein, 20 aa, Mycobacterium
PALQDWAKWGQARHNYFLRA

SEQ ID NO: 705367 - protein, 24 aa, Mycobacterium
PALQPETRLAAPLLAKGLPACPGV

SEQ ID NO: 705368 - protein, 18 aa, Mycobacterium
PALQVLLYPITDWVSETR

SEQ ID NO: 705369 - protein, 20 aa, Mycobacterium
PALRALRRGGRFVTIGFASG

SEQ ID NO: 705370 - protein, 19 aa, Mycobacterium
PALRCRLVDCDGSPQAVQA

SEQ ID NO: 705371 - protein, 25 aa, Mycobacterium
PALRGKFLAGLHCARDAAVESRVAL

SEQ ID NO: 705372 - protein, 28 aa, Mycobacterium
PALRGYRKMVTKLLARRGDSPSLTARLR

SEQ ID NO: 705373 - protein, 19 aa, Mycobacterium
PALRISGRRRLSRLVENVG

SEQ ID NO: 705374 - protein, 17 aa, Mycobacterium
PALRSHCVVAAVRSATV

SEQ ID NO: 705375 - protein, 19 aa, Mycobacterium
PALRSSCVVAAVRSATVGM

SEQ ID NO: 705376 - protein, 17 aa, Mycobacterium
PALSYAIRQLETELDVT

SEQ ID NO: 705377 - protein, 19 aa, Mycobacterium
PALTFAPLTWKMVLVSLGS

SEQ ID NO: 705378 - protein, 17 aa, Mycobacterium
PALTPREAAEWMVTAAR

SEQ ID NO: 705379 - protein, 25 aa, Mycobacterium
PALTRSGIRILRIGMPYPLDPQIVS

SEQ ID NO: 705380 - protein, 19 aa, Mycobacterium
PALTSRGFGADDFDRVAEL

SEQ ID NO: 705381 - protein, 19 aa, Mycobacterium
PALVDWLAERFPKCVVSYA

SEQ ID NO: 705382 - protein, 20 aa, Mycobacterium
PALVFAHGGGFVFCDLDSHD

SEQ ID NO: 705383 - protein, 18 aa, Mycobacterium
PALVFGLQCAAFLERLDP

SEQ ID NO: 705384 - protein, 17 aa, Mycobacterium
PALVGRKVELVFDPFDL

SEQ ID NO: 705385 - protein, 18 aa, Mycobacterium
PALVQATARYHDLVTGLL

SEQ ID NO: 705386 - protein, 21 aa, Mycobacterium
PALVVTINFLGLRHFTEALIP

SEQ ID NO: 705387 - protein, 23 aa, Mycobacterium
PALWIPDVGGPVFDAVGNLLSAT

SEQ ID NO: 705388 - protein, 21 aa, Mycobacterium
PALWTSCGHDPVAVLGAVKPA

SEQ ID NO: 705389 - protein, 22 aa, Mycobacterium
PALYAEHWEPLWAACAQAGLVI

SEQ ID NO: 705390 - protein, 21 aa, Mycobacterium
PALYAEHWEPLWAACEDTGVV

SEQ ID NO: 705391 - protein, 17 aa, Mycobacterium
PAMARRLQERYGEQARI

SEQ ID NO: 705392 - protein, 23 aa, Mycobacterium
PAMDSGWRKVLLVCRAAGGDEVI

SEQ ID NO: 705393 - protein, 17 aa, Mycobacterium
PAMEISERMGVLPEIEA

SEQ ID NO: 705394 - protein, 24 aa, Mycobacterium
PAMFADVRRGLAIAEVVRAATVTD

SEQ ID NO: 705395 - protein, 25 aa, Mycobacterium
PAMFADVRRGLTIAAVVHAATVTDT

SEQ ID NO: 705396 - protein, 21 aa, Mycobacterium
PAMHTEMWLHPATVDNVATLR

SEQ ID NO: 705397 - protein, 21 aa, Mycobacterium
PAMIRRAGERLARYGNRVRLV

SEQ ID NO: 705398 - protein, 18 aa, Mycobacterium
PAMLCCAKSTGVLEASSD

SEQ ID NO: 705399 - protein, 28 aa, Mycobacterium
PAMPAECLLDRNALIMGYSGVYSSFLKH

SEQ ID NO: 705400 - protein, 24 aa, Mycobacterium
PAMPDTRVAFMLTDAAPIVALTTA

SEQ ID NO: 705401 - protein, 21 aa, Mycobacterium
PAMRISHCRPPGSDRDVVLMH

SEQ ID NO: 705402 - protein, 23 aa, Mycobacterium
PAMRLCHHLHGGMGMDITYPMDR

SEQ ID NO: 705403 - protein, 26 aa, Mycobacterium
PAMSKFEVLVAMAFVAFADAPVDIAV

SEQ ID NO: 705404 - protein, 17 aa, Mycobacterium
PANDVLLQICLDYIDRV

SEQ ID NO: 705405 - protein, 20 aa, Mycobacterium
PANFGRLCTKGAAHAELMAA

SEQ ID NO: 705406 - protein, 24 aa, Mycobacterium
PANLSRLNPFALQPAPGNNNVGMG

SEQ ID NO: 705407 - protein, 26 aa, Mycobacterium
PANNVEFFFLRPKDIAIYVGSGELDL

SEQ ID NO: 705408 - protein, 24 aa, Mycobacterium
PANPYGAALVWPRATSESGHRPGR

SEQ ID NO: 705409 - protein, 21 aa, Mycobacterium
PANQVEFFFLRPKDIAIYVGS

SEQ ID NO: 705410 - protein, 26 aa, Mycobacterium
PANRLYRGRCDLVVLSVALNLLDCPV

SEQ ID NO: 705411 - protein, 25 aa, Mycobacterium
PANRRAWEALGRWEKPFLAIFGARD

SEQ ID NO: 705412 - protein, 25 aa, Mycobacterium
PANSEPRTGLSMGEHAAITTKQMGI

SEQ ID NO: 705413 - protein, 29 aa, Mycobacterium
PANTKCYCRLHWRALCSPDCGPNRVRLER

SEQ ID NO: 705414 - protein, 26 aa, Mycobacterium
PANTKSYCRLHHLIKTFRPGWTDTQH

SEQ ID NO: 705415 - protein, 26 aa, Mycobacterium
PANVDAYRRALEWLGHNASCVARTPQ

SEQ ID NO: 705416 - protein, 24 aa, Mycobacterium
PANWPRVLDVWRANLLGSSSKGNE

SEQ ID NO: 705417 - protein, 24 aa, Mycobacterium
PANWPRVLNVWRANLLGSSSKGNE

SEQ ID NO: 705418 - protein, 19 aa, Mycobacterium
PAPARIWLRPDGEVPDDPV

SEQ ID NO: 705419 - protein, 23 aa, Mycobacterium
PAPARPATLLGWLQADIAANAVR

SEQ ID NO: 705420 - protein, 19 aa, Mycobacterium
PAPARPLRDYAGVYASDYW

SEQ ID NO: 705421 - protein, 19 aa, Mycobacterium
PAPARRTGGHPAKRTFQAL

SEQ ID NO: 705422 - protein, 33 aa, Mycobacterium
PAPATPWLATTVRLAWRAKLMISASVDARIRLR

SEQ ID NO: 705423 - protein, 18 aa, Mycobacterium
PAPAVPKAPAARAAPAEP

SEQ ID NO: 705424 - protein, 18 aa, Mycobacterium
PAPDDVWEELLAAAQPRE

SEQ ID NO: 705425 - protein, 26 aa, Mycobacterium
PAPDGVKLAAGWLVERAGFGKGYPGE

SEQ ID NO: 705426 - protein, 22 aa, Mycobacterium
PAPDMFPSEHLLRLRQAAEEKY

SEQ ID NO: 705427 - protein, 28 aa, Mycobacterium
PAPDPGKWAGFELHRSITITEEFTLGVG

SEQ ID NO: 705428 - protein, 22 aa, Mycobacterium
PAPDRFLVGLAVLGLIATASED

SEQ ID NO: 705429 - protein, 18 aa, Mycobacterium
PAPDRLLVGLAVLNMFSS

SEQ ID NO: 705430 - protein, 21 aa, Mycobacterium
PAPDTPWAAAVLGELITEHTD

SEQ ID NO: 705431 - protein, 33 aa, Mycobacterium
PAPEDVPLLQHWVPRAGAEFGAHAQNWIDVPPA

SEQ ID NO: 705432 - protein, 23 aa, Mycobacterium
PAPEFAVSVLRLDGEQLGHEIDA

SEQ ID NO: 705433 - protein, 23 aa, Mycobacterium
PAPEGFLAAASRLGVDPDEMYMI

SEQ ID NO: 705434 - protein, 24 aa, Mycobacterium
PAPELEILGNLGLLIGGGFDTTTA

SEQ ID NO: 705435 - protein, 25 aa, Mycobacterium
PAPELEILGNLGLVIGGGFDTTTAL

SEQ ID NO: 705436 - protein, 21 aa, Mycobacterium
PAPELLPLAAVGWPDGSVLPL

SEQ ID NO: 705437 - protein, 24 aa, Mycobacterium
PAPERTKLPVIPWVVSAKSLSALS

SEQ ID NO: 705438 - protein, 22 aa, Mycobacterium
PAPERVGPVIGITGPPGAGKST

SEQ ID NO: 705439 - protein, 19 aa, Mycobacterium
PAPEVLGAAQWVQIPADAT

SEQ ID NO: 705440 - protein, 23 aa, Mycobacterium
PAPEVPGAQFIDARGCLATPGLV

SEQ ID NO: 705441 - protein, 19 aa, Mycobacterium
PAPFFAQRKIFITGANGFI

SEQ ID NO: 705442 - protein, 17 aa, Mycobacterium
PAPFLPNRVQLQTMLDV

SEQ ID NO: 705443 - protein, 19 aa, Mycobacterium
PAPGFLGALQKWCTDNGAV

SEQ ID NO: 705444 - protein, 25 aa, Mycobacterium
PAPGGVKLAAGWLVEHAGFGKGYPD

SEQ ID NO: 705445 - protein, 19 aa, Mycobacterium
PAPGHTPGSSVLWLDAGQP

SEQ ID NO: 705446 - protein, 20 aa, Mycobacterium
PAPGRANVAVGIPTFNRPAD

SEQ ID NO: 705447 - protein, 20 aa, Mycobacterium
PAPGRANVAVGIPTFNRPSD

SEQ ID NO: 705448 - protein, 18 aa, Mycobacterium
PAPGSTNWDTPRRIEMSF

SEQ ID NO: 705449 - protein, 23 aa, Mycobacterium
PAPHHRPYWGLHGVFPASMGRPE

SEQ ID NO: 705450 - protein, 18 aa, Mycobacterium
PAPIETFPVLSQSVVHRE

SEQ ID NO: 705451 - protein, 20 aa, Mycobacterium
PAPIWLPALTLTYLGGAKPR

SEQ ID NO: 705452 - protein, 25 aa, Mycobacterium
PAPLAHPGLVCDVAIGQSTLATQRV

SEQ ID NO: 705453 - protein, 25 aa, Mycobacterium
PAPLAHPGLVCDVAIGQSTLVTQRV

SEQ ID NO: 705454 - protein, 31 aa, Mycobacterium
PAPLARSAMTAFDWFSWRLNKKVEDTQRREL

SEQ ID NO: 705455 - protein, 18 aa, Mycobacterium
PAPLLGEHNHELLAKLGL

SEQ ID NO: 705456 - protein, 19 aa, Mycobacterium
PAPLNEWIMEQLLMIDALK

SEQ ID NO: 705457 - protein, 19 aa, Mycobacterium
PAPLPEVFNHWYGPIPPIK

SEQ ID NO: 705458 - protein, 23 aa, Mycobacterium
PAPLPRQVFAVGLNYDDHATESG

SEQ ID NO: 705459 - protein, 18 aa, Mycobacterium
PAPLRLLLVGGNTVVEDG

SEQ ID NO: 705460 - protein, 19 aa, Mycobacterium
PAPLRTGDVLPIGDRSQDY

SEQ ID NO: 705461 - protein, 26 aa, Mycobacterium
PAPLSRNALATAWWMYWRMTKEAEAA

SEQ ID NO: 705462 - protein, 24 aa, Mycobacterium
PAPLTDPAELAWLFYTSGTTGKSK

SEQ ID NO: 705463 - protein, 18 aa, Mycobacterium
PAPLYLQLQVWSRGTIAL

SEQ ID NO: 705464 - protein, 22 aa, Mycobacterium
PAPMPPEIADHVAAVALFGKPS

SEQ ID NO: 705465 - protein, 17 aa, Mycobacterium
PAPPEFVTDVGRKQDAA

SEQ ID NO: 705466 - protein, 21 aa, Mycobacterium
PAPPMKGVVTDWWATEDTIPG

SEQ ID NO: 705467 - protein, 20 aa, Mycobacterium
PAPPRAAFQPGVHYNRFGKP

SEQ ID NO: 705468 - protein, 23 aa, Mycobacterium
PAPQARLGLIAAIRDAGLDCHVM

SEQ ID NO: 705469 - protein, 23 aa, Mycobacterium
PAPQKARVDLCALSSAGDVETVA

SEQ ID NO: 705470 - protein, 19 aa, Mycobacterium
PAPQRLPADLIEQGHTIPV

SEQ ID NO: 705471 - protein, 19 aa, Mycobacterium
PAPRCRVCNAQLTSPTAIM

SEQ ID NO: 705472 - protein, 19 aa, Mycobacterium
PAPRGHRVLAPGMSSGRVL

SEQ ID NO: 705473 - protein, 25 aa, Mycobacterium
PAPRIVAGIPVCLCGSSEVEVARDR

SEQ ID NO: 705474 - protein, 25 aa, Mycobacterium
PAPRIVAGVPVCLCSTTEVDAARER

SEQ ID NO: 705475 - protein, 28 aa, Mycobacterium
PAPRLEDCVLRAAHWRSARDGLDGMAVD

SEQ ID NO: 705476 - protein, 19 aa, Mycobacterium
PAPRLLRARRVHLSAEVGL

SEQ ID NO: 705477 - protein, 17 aa, Mycobacterium
PAPRLVPLVEEIAPRSA

SEQ ID NO: 705478 - protein, 24 aa, Mycobacterium
PAPRRWRSPAPLWGDASFDSVAPA

SEQ ID NO: 705479 - protein, 27 aa, Mycobacterium
PAPRYAFLGVRGCDLAAIATLDRVLGR

SEQ ID NO: 705480 - protein, 21 aa, Mycobacterium
PAPRYAGTRVQRVEDGRLLTG

SEQ ID NO: 705481 - protein, 19 aa, Mycobacterium
PAPSAVVAHLGCRRVASDT

SEQ ID NO: 705482 - protein, 17 aa, Mycobacterium
PAPTALHRHTPRTLRLV

SEQ ID NO: 705483 - protein, 17 aa, Mycobacterium
PAPTAPAGSTWPSTNPV

SEQ ID NO: 705484 - protein, 18 aa, Mycobacterium
PAPTEPRRGVAIVNSPLV

SEQ ID NO: 705485 - protein, 18 aa, Mycobacterium
PAPTMGFAGTVPTKTAAA

SEQ ID NO: 705486 - protein, 19 aa, Mycobacterium
PAPTPRPSVPVGEYADVLL

SEQ ID NO: 705487 - protein, 19 aa, Mycobacterium
PAPTPRRPVHDVLEIRRGA

SEQ ID NO: 705488 - protein, 20 aa, Mycobacterium
PAPTYPWQRQRFWLDERNAA

SEQ ID NO: 705489 - protein, 20 aa, Mycobacterium
PAPVARFLANWVREAGPKIV

SEQ ID NO: 705490 - protein, 22 aa, Mycobacterium
PAPVARFLARWVGRAGTKILEP

SEQ ID NO: 705491 - protein, 23 aa, Mycobacterium
PAPVARFLARWVREAGPRILEPS

SEQ ID NO: 705492 - protein, 24 aa, Mycobacterium
PAPVIAASLFARFASRQEDSPAMK

SEQ ID NO: 705493 - protein, 17 aa, Mycobacterium
PAPVLRVTRITHRNDPV

SEQ ID NO: 705494 - protein, 19 aa, Mycobacterium
PAPVPGLHGPRSFALPEFD

SEQ ID NO: 705495 - protein, 19 aa, Mycobacterium
PAPVRVYVTGVGRGQGWRS

SEQ ID NO: 705496 - protein, 24 aa, Mycobacterium
PAPVSGRLGDWCNYGGDKTWPAPQ

SEQ ID NO: 705497 - protein, 17 aa, Mycobacterium
PAPVVSKAPAARAAPAE

SEQ ID NO: 705498 - protein, 18 aa, Mycobacterium
PAQADWLDPMIALAFAAA

SEQ ID NO: 705499 - protein, 20 aa, Mycobacterium
PAQAIAQVCELNWQLRGQAT

SEQ ID NO: 705500 - protein, 20 aa, Mycobacterium
PAQAIAQVCELTWQLRGQAT

SEQ ID NO: 705501 - protein, 19 aa, Mycobacterium
PAQALTLLAERGLRRVLTE

SEQ ID NO: 705502 - protein, 25 aa, Mycobacterium
PAQARALYEKNWLRLISDVDYAPVP

SEQ ID NO: 705503 - protein, 24 aa, Mycobacterium
PAQARELFIRRALVEGDWHTRHHF

SEQ ID NO: 705504 - protein, 19 aa, Mycobacterium
PAQELGFMYGRSFRDLDGH

SEQ ID NO: 705505 - protein, 24 aa, Mycobacterium
PAQEPAAQVPPGWSPPQPYPGQWP

SEQ ID NO: 705506 - protein, 23 aa, Mycobacterium
PAQGCTYWNGPAMESGDYKDLDE

SEQ ID NO: 705507 - protein, 30 aa, Mycobacterium
PAQGSGVFREWLTDFARQWGNFLDTPESFS

SEQ ID NO: 705508 - protein, 24 aa, Mycobacterium
PAQHPLGRLAIRRITDATTAPDPM

SEQ ID NO: 705509 - protein, 20 aa, Mycobacterium
PAQISDLGAAFHAAGRCTAE

SEQ ID NO: 705510 - protein, 25 aa, Mycobacterium
PAQLHEWLRQAGFGVPRRIPILRIP

SEQ ID NO: 705511 - protein, 18 aa, Mycobacterium
PAQLKAVLLLVAEYGIPK

SEQ ID NO: 705512 - protein, 24 aa, Mycobacterium
PAQLPLPVLIAGWLRSRAEADEAE

SEQ ID NO: 705513 - protein, 23 aa, Mycobacterium
PAQLPWRPPAGRVRSGVLRCIPE

SEQ ID NO: 705514 - protein, 23 aa, Mycobacterium
PAQLRPALERAFASGLPAVVNVL

SEQ ID NO: 705515 - protein, 18 aa, Mycobacterium
PAQMAAIVDWEMGTVGDP

SEQ ID NO: 705516 - protein, 23 aa, Mycobacterium
PAQPWAGVLACDSWKSASPQKRV

SEQ ID NO: 705517 - protein, 18 aa, Mycobacterium
PAQQRARIGMVLQDPDAQ

SEQ ID NO: 705518 - protein, 23 aa, Mycobacterium
PAQRPVWVGDFWDMFAAGHLLEL

SEQ ID NO: 705519 - protein, 22 aa, Mycobacterium
PAQRRYPAWPASYDASLRVPWR

SEQ ID NO: 705520 - protein, 24 aa, Mycobacterium
PAQVDMRCLLIIGSSQTQWYSAAV

SEQ ID NO: 705521 - protein, 23 aa, Mycobacterium
PAQVRAGFRLGEPAAGELGVRDG

SEQ ID NO: 705522 - protein, 24 aa, Mycobacterium
PAQVVPQDLLGAINAPVLALTGRP

SEQ ID NO: 705523 - protein, 26 aa, Mycobacterium
PAQWLPGARELRAWVLAAGSPEADRY

SEQ ID NO: 705524 - protein, 26 aa, Mycobacterium
PAQYWRAVIKAYFDAFGSHRALTVAL

SEQ ID NO: 705525 - protein, 17 aa, Mycobacterium
PARALRRAEVARPRKAF

SEQ ID NO: 705526 - protein, 32 aa, Mycobacterium
PARAPSIDVFAGWRITSRQGGWFVAAGVGSDW

SEQ ID NO: 705527 - protein, 26 aa, Mycobacterium
PARARMQRRWSIVMVDEFQDTDPVQW

SEQ ID NO: 705528 - protein, 23 aa, Mycobacterium
PARARPGLYPIRAQLRIAAEEAP

SEQ ID NO: 705529 - protein, 24 aa, Mycobacterium
PARDAPGVVCRWCGREEPSMRCAR

SEQ ID NO: 705530 - protein, 17 aa, Mycobacterium
PARDGGWWVLGVGAPAM

SEQ ID NO: 705531 - protein, 20 aa, Mycobacterium
PARDSGCWMGFSIYPDTKMD

SEQ ID NO: 705532 - protein, 30 aa, Mycobacterium
PARDSIRIFPVSARSGSALHEVAGRYAKQL

SEQ ID NO: 705533 - protein, 25 aa, Mycobacterium
PARELLPHRLVRAALTRAARSEAAL

SEQ ID NO: 705534 - protein, 23 aa, Mycobacterium
PARFIPMALPVIWDAQACATEVR

SEQ ID NO: 705535 - protein, 20 aa, Mycobacterium
PARFREVLDQAAAAGGVHII

SEQ ID NO: 705536 - protein, 21 aa, Mycobacterium
PARGIQLFIELWKAQLAETEM

SEQ ID NO: 705537 - protein, 30 aa, Mycobacterium
PARIALDLLHRAGIEWDPALPCVAELDANA

SEQ ID NO: 705538 - protein, 17 aa, Mycobacterium
PARIAVIGMGRLGGGEL

SEQ ID NO: 705539 - protein, 19 aa, Mycobacterium
PARIEFVLGDSAPIAVVTN

SEQ ID NO: 705540 - protein, 24 aa, Mycobacterium
PARKNARQHLAFGRGIHSCPGAPL

SEQ ID NO: 705541 - protein, 24 aa, Mycobacterium
PARKNARQHLSFGRGIHSCPGAPL

SEQ ID NO: 705542 - protein, 24 aa, Mycobacterium
PARKRRMFDLLVRMGYKEIEVGFP

SEQ ID NO: 705543 - protein, 20 aa, Mycobacterium
PARLFPGSWSQWSADPSRPV

SEQ ID NO: 705544 - protein, 20 aa, Mycobacterium
PARLSTKHALALTNRGTATT

SEQ ID NO: 705545 - protein, 20 aa, Mycobacterium
PARMFGLYPRKGIVSPGADA

SEQ ID NO: 705546 - protein, 19 aa, Mycobacterium
PARMFGRMLGCDMGLNPPF

SEQ ID NO: 705547 - protein, 19 aa, Mycobacterium
PARMGCPVADAPAFSAVNG

SEQ ID NO: 705548 - protein, 24 aa, Mycobacterium
PARMLRTAWTDEWARPDTPEPLGM

SEQ ID NO: 705549 - protein, 24 aa, Mycobacterium
PARMLRTAWTDEWARPENPDPLGM

SEQ ID NO: 705550 - protein, 23 aa, Mycobacterium
PARMLRTAWTDEWERPEKPDPLG

SEQ ID NO: 705551 - protein, 18 aa, Mycobacterium
PARMPVARPTSWRVPDTD

SEQ ID NO: 705552 - protein, 33 aa, Mycobacterium
PARNGSDLPAGWKVGEGMAIAMIATVPPRGHVA

SEQ ID NO: 705553 - protein, 30 aa, Mycobacterium
PARNVGFVGVRWPSTLWRDEPIPDFPATPA

SEQ ID NO: 705554 - protein, 20 aa, Mycobacterium
PARPRPPRRLDHDLRPGHPD

SEQ ID NO: 705555 - protein, 23 aa, Mycobacterium
PARPVVVGPITFLALSKAVGGAV

SEQ ID NO: 705556 - protein, 27 aa, Mycobacterium
PARPWVCLLCPLAVFAPRHAANLLRLK

SEQ ID NO: 705557 - protein, 27 aa, Mycobacterium
PARPWVCLLCPLAVFAPRHAVNLLRLK

SEQ ID NO: 705558 - protein, 25 aa, Mycobacterium
PARQLRWVAAPVFHRRGEVLGALGV

SEQ ID NO: 705559 - protein, 24 aa, Mycobacterium
PARRAEVLAAPGFGKYFTDHMVSI

SEQ ID NO: 705560 - protein, 19 aa, Mycobacterium
PARRCCPLTAGELGDVGRP

SEQ ID NO: 705561 - protein, 24 aa, Mycobacterium
PARRCVPRGCGSWAGHSRRSGPAH

SEQ ID NO: 705562 - protein, 19 aa, Mycobacterium
PARREVRTSLVPDAFGGNM

SEQ ID NO: 705563 - protein, 17 aa, Mycobacterium
PARRLRTLIGSYVILIV

SEQ ID NO: 705564 - protein, 21 aa, Mycobacterium
PARRRLRHRGVRPAGGIARRR

SEQ ID NO: 705565 - protein, 26 aa, Mycobacterium
PARRRRRGRRGRGRGRGEQGGGEGSD

SEQ ID NO: 705566 - protein, 18 aa, Mycobacterium
PARRRRRRRAGSRGVRGS

SEQ ID NO: 705567 - protein, 24 aa, Mycobacterium
PARSRAQLALGGRRILHPQCLHTH

SEQ ID NO: 705568 - protein, 17 aa, Mycobacterium
PARTGCIECGECMTGCR

SEQ ID NO: 705569 - protein, 22 aa, Mycobacterium
PARTKAALVARAIQDGYVDVAD

SEQ ID NO: 705570 - protein, 17 aa, Mycobacterium
PARTWFTAMKPIANNFG

SEQ ID NO: 705571 - protein, 20 aa, Mycobacterium
PARVFFCNSGTEANELAFKL

SEQ ID NO: 705572 - protein, 22 aa, Mycobacterium
PARVRAAVLAALRAAHPYEEPA

SEQ ID NO: 705573 - protein, 19 aa, Mycobacterium
PARVRAVFHYVRSGRTVAP

SEQ ID NO: 705574 - protein, 27 aa, Mycobacterium
PARYRIDRLAPEGARAMLSAQFKAGKS

SEQ ID NO: 705575 - protein, 26 aa, Mycobacterium
PASAAPAVPWPPWPPLPPVPPTPPSP

SEQ ID NO: 705576 - protein, 20 aa, Mycobacterium
PASADRPALWIVEEDGREQK

SEQ ID NO: 705577 - protein, 29 aa, Mycobacterium
PASAGMAPWLTCFPGFGMLTVGGALGSAA

SEQ ID NO: 705578 - protein, 35 aa, Mycobacterium
PASAHVRALFDLARLIEILLRWNLDDTTDGPRIKY

SEQ ID NO: 705579 - protein, 22 aa, Mycobacterium
PASALLYRAGQRKLIGGQEDQL

SEQ ID NO: 705580 - protein, 18 aa, Mycobacterium
PASAMCVAFGGASSFGIF

SEQ ID NO: 705581 - protein, 24 aa, Mycobacterium
PASAPARGLTSWLVDALRSAIADG

SEQ ID NO: 705582 - protein, 20 aa, Mycobacterium
PASARLFVASALAQAGLLLV

SEQ ID NO: 705583 - protein, 20 aa, Mycobacterium
PASARLFVASALARLGPLLV

SEQ ID NO: 705584 - protein, 18 aa, Mycobacterium
PASAVALLRAMRAHGYDL

SEQ ID NO: 705585 - protein, 20 aa, Mycobacterium
PASDALRLEPTVDWIEAALP

SEQ ID NO: 705586 - protein, 22 aa, Mycobacterium
PASDAPVLLGFDGSASAAPAVE

SEQ ID NO: 705587 - protein, 18 aa, Mycobacterium
PASDKSPGIAVFLVPAQS

SEQ ID NO: 705588 - protein, 19 aa, Mycobacterium
PASDLGGFFVKPTVLTGVD

SEQ ID NO: 705589 - protein, 24 aa, Mycobacterium
PASEALKAVAAFRLALPRTMLRFA

SEQ ID NO: 705590 - protein, 18 aa, Mycobacterium
PASERLAARLQRYRNIGL

SEQ ID NO: 705591 - protein, 26 aa, Mycobacterium
PASESMAAKVAPYVSWLYTTATQTKQ

SEQ ID NO: 705592 - protein, 26 aa, Mycobacterium
PASESMAASAAPYVGWLYRTAEQTQQ

SEQ ID NO: 705593 - protein, 17 aa, Mycobacterium
PASFRRGRASRRGRYFD

SEQ ID NO: 705594 - protein, 20 aa, Mycobacterium
PASFVRFELSLNVVETAEPQ

SEQ ID NO: 705595 - protein, 25 aa, Mycobacterium
PASFYRLGPDGKRQPAHFDGLPVEF

SEQ ID NO: 705596 - protein, 19 aa, Mycobacterium
PASGAAHLLADWTCADDHA

SEQ ID NO: 705597 - protein, 19 aa, Mycobacterium
PASGAAHLLAEWTCAGGDS

SEQ ID NO: 705598 - protein, 19 aa, Mycobacterium
PASGGRLVGKDGSPLDLDG

SEQ ID NO: 705599 - protein, 17 aa, Mycobacterium
PASGGVVLTGRLSLAAQ

SEQ ID NO: 705600 - protein, 24 aa, Mycobacterium
PASGIHRLRFDTATYFAAQQVSSL

SEQ ID NO: 705601 - protein, 29 aa, Mycobacterium
PASGRPLAMPRLDMVTGLYYLTTEVDGDT

SEQ ID NO: 705602 - protein, 29 aa, Mycobacterium
PASGRPLAMPRLDMVTGLYYLTTEVEGDK

SEQ ID NO: 705603 - protein, 22 aa, Mycobacterium
PASGWICGVVGVHPWQVAFADS

SEQ ID NO: 705604 - protein, 24 aa, Mycobacterium
PASIKDRWLLRNRPHAVLDGLRLA

SEQ ID NO: 705605 - protein, 24 aa, Mycobacterium
PASIKDRWLLRNRPHLVLDGLRLA

SEQ ID NO: 705606 - protein, 19 aa, Mycobacterium
PASILMLFAPGAPREAYFE

SEQ ID NO: 705607 - protein, 17 aa, Mycobacterium
PASIPWDTVLEYWTTIL

SEQ ID NO: 705608 - protein, 23 aa, Mycobacterium
PASKLVRLGLCLSSISRGELDAG

SEQ ID NO: 705609 - protein, 25 aa, Mycobacterium
PASLEEARPLFPHHLDTIVNVPAPT

SEQ ID NO: 705610 - protein, 25 aa, Mycobacterium
PASLREARRGMALAAELCLPLVLVI

SEQ ID NO: 705611 - protein, 18 aa, Mycobacterium
PASLRICHPIVVAAELDE

SEQ ID NO: 705612 - protein, 17 aa, Mycobacterium
PASLRRDFGLVVHWANL

SEQ ID NO: 705613 - protein, 18 aa, Mycobacterium
PASLRRDGGLVVHWANLS

SEQ ID NO: 705614 - protein, 19 aa, Mycobacterium
PASMARNAVLASLGASSVG

SEQ ID NO: 705615 - protein, 22 aa, Mycobacterium
PASMPARVAVSVFSIEFLVHAW

SEQ ID NO: 705616 - protein, 25 aa, Mycobacterium
PASNITRLPVRYTFDNRYFNDTYEG

SEQ ID NO: 705617 - protein, 23 aa, Mycobacterium
PASPEAVFSVGLFEPPLLGLTIR

SEQ ID NO: 705618 - protein, 18 aa, Mycobacterium
PASPGPHPVVVYFHGGGW

SEQ ID NO: 705619 - protein, 26 aa, Mycobacterium
PASPTRFASRYRVGAAAPGATITTDR

SEQ ID NO: 705620 - protein, 17 aa, Mycobacterium
PASQFAIVLPRRDGVEY

SEQ ID NO: 705621 - protein, 24 aa, Mycobacterium
PASRAAENILGYTIANDVSARDQQ

SEQ ID NO: 705622 - protein, 17 aa, Mycobacterium
PASRFAVRAFDWLTWRL

SEQ ID NO: 705623 - protein, 25 aa, Mycobacterium
PASRLVRLGLCLSRISRDELSAGLA

SEQ ID NO: 705624 - protein, 22 aa, Mycobacterium
PASRPAPCADDLLPESESRLAL

SEQ ID NO: 705625 - protein, 19 aa, Mycobacterium
PASRSGYRLEQLVSDTGAV

SEQ ID NO: 705626 - protein, 18 aa, Mycobacterium
PASRSVLCKGVDETGITF

SEQ ID NO: 705627 - protein, 37 aa, Mycobacterium; identical to SEQ ID NO: 90310

SEQ ID NO: 705628 - protein, 24 aa, Mycobacterium
PASRVGPASAFAWLPQRHSDVDRP

SEQ ID NO: 705629 - protein, 26 aa, Mycobacterium
PASSLADWLRRGGVKAALVRPDRTVM

SEQ ID NO: 705630 - protein, 25 aa, Mycobacterium
PASSWAERKRMFALERSSWADYNSA

SEQ ID NO: 705631 - protein, 24 aa, Mycobacterium
PASTIKVLLAMTVLDHLRPDSFAR

SEQ ID NO: 705632 - protein, 18 aa, Mycobacterium
PASVLGEAIDRLLLETDQ

SEQ ID NO: 705633 - protein, 20 aa, Mycobacterium
PASYKRGRVIGAEGRDLGDF

SEQ ID NO: 705634 - protein, 27 aa, Mycobacterium
PASYPPATWPLGVAFLRNYDVRVIDGA

SEQ ID NO: 705635 - protein, 18 aa, Mycobacterium
PATCALGRLTSVAAATAL

SEQ ID NO: 705636 - protein, 26 aa, Mycobacterium
PATDKRARFRAALESGRLQRFPGAFS

SEQ ID NO: 705637 - protein, 21 aa, Mycobacterium
PATEFAGFLWVALDPGATLDI

SEQ ID NO: 705638 - protein, 21 aa, Mycobacterium
PATEFAGFLWVSLHPAARLDV

SEQ ID NO: 705639 - protein, 25 aa, Mycobacterium
PATEFKRKPHWLPAHFSADGSTRIP

SEQ ID NO: 705640 - protein, 18 aa, Mycobacterium
PATEFTLQAWSGAIIGLG

SEQ ID NO: 705641 - protein, 26 aa, Mycobacterium
PATEIPMGFGYPIDRPDLPAVTEKGS

SEQ ID NO: 705642 - protein, 24 aa, Mycobacterium
PATGECRACGGKLVARPVSGRGTV

SEQ ID NO: 705643 - protein, 23 aa, Mycobacterium
PATGELLGTVGIAGPDDVGAAVA

SEQ ID NO: 705644 - protein, 19 aa, Mycobacterium
PATGFPLMALFSGLHDECE

SEQ ID NO: 705645 - protein, 26 aa, Mycobacterium
PATGGELKVRFFASARSQGRKLAFRG

SEQ ID NO: 705646 - protein, 21 aa, Mycobacterium
PATGGFGGRGGRLFGSPGAQG

SEQ ID NO: 705647 - protein, 19 aa, Mycobacterium
PATGPVPLALAQRPAELRA

SEQ ID NO: 705648 - protein, 19 aa, Mycobacterium
PATGVAFALVHNRLLTPLV

SEQ ID NO: 705649 - protein, 31 aa, Mycobacterium
PATHIGGLWWILTCLMRGGLCITGGENTPSL

SEQ ID NO: 705650 - protein, 20 aa, Mycobacterium
PATIGSYRSALNWLGDNASC

SEQ ID NO: 705651 - protein, 26 aa, Mycobacterium
PATIKRFADRFARFNLQEKVIRPSYG

SEQ ID NO: 705652 - protein, 29 aa, Mycobacterium
PATLARFAQRFARFHLHPRALRPSYGLAE

SEQ ID NO: 705653 - protein, 25 aa, Mycobacterium
PATLDRFCKRFAPYNFREHMMRPSY

SEQ ID NO: 705654 - protein, 25 aa, Mycobacterium
PATLERFADRFAHFNFRDNMLRPSY

SEQ ID NO: 705655 - protein, 19 aa, Mycobacterium
PATLFPIPNPFVIGTDLVI

SEQ ID NO: 705656 - protein, 24 aa, Mycobacterium
PATLKYLHQICAAAETNGFEAVLT

SEQ ID NO: 705657 - protein, 18 aa, Mycobacterium
PATLRLHATGEIGPVEVP

SEQ ID NO: 705658 - protein, 30 aa, Mycobacterium
PATLTDLVFAWRACRAVKSNAIVIVADGAT

SEQ ID NO: 705659 - protein, 30 aa, Mycobacterium
PATLTDLVFAWRSCRAVKSNAIVIVADGAT

SEQ ID NO: 705660 - protein, 19 aa, Mycobacterium
PATMGYPSFHNDYWNPLWK

SEQ ID NO: 705661 - protein, 24 aa, Mycobacterium
PATPEPVAALILGELRTAVATEGV

SEQ ID NO: 705662 - protein, 23 aa, Mycobacterium
PATPFALALRMLVIALKNNEILN

SEQ ID NO: 705663 - protein, 24 aa, Mycobacterium
PATPIDWSQPFPPAAATSPPPSVE

SEQ ID NO: 705664 - protein, 17 aa, Mycobacterium
PATPVVIGRDVAGPRES

SEQ ID NO: 705665 - protein, 19 aa, Mycobacterium
PATPWQHSRFWVTDRSAMS

SEQ ID NO: 705666 - protein, 25 aa, Mycobacterium
PATPYLSLWARLRRFTVADLDTELY

SEQ ID NO: 705667 - protein, 17 aa, Mycobacterium
PATQLHWTGHDHPDVAV

SEQ ID NO: 705668 - protein, 24 aa, Mycobacterium
PATRAVVIYLEYLGITLGELLDAR

SEQ ID NO: 705669 - protein, 24 aa, Mycobacterium
PATRAVVIYLEYRGTTLDDLLDAR

SEQ ID NO: 705670 - protein, 18 aa, Mycobacterium
PATRFAVVDVEIGQEGYR

SEQ ID NO: 705671 - protein, 19 aa, Mycobacterium
PATRIPLHGRIEVDEPYVL

SEQ ID NO: 705672 - protein, 24 aa, Mycobacterium
PATRIPLHGRIEVDQPYVLVLPTY

SEQ ID NO: 705673 - protein, 20 aa, Mycobacterium
PATRSLRALGPIGWIAARAG

SEQ ID NO: 705674 - protein, 20 aa, Mycobacterium
PATRSYRYVDYWGTAVTAFD

SEQ ID NO: 705675 - protein, 24 aa, Mycobacterium
PATRSYRYVDYWGTAVTAFDLHAP

SEQ ID NO: 705676 - protein, 25 aa, Mycobacterium
PATRSYRYVDYWGTAVTAFDLHAPH

SEQ ID NO: 705677 - protein, 26 aa, Mycobacterium
PATSELDWFCAFSSAAALVGSPGQGA

SEQ ID NO: 705678 - protein, 17 aa, Mycobacterium
PATSIPVVVARGASAAG

SEQ ID NO: 705679 - protein, 17 aa, Mycobacterium
PATTADEIVRWATPVTS

SEQ ID NO: 705680 - protein, 24 aa, Mycobacterium
PATTAEAFRGGWFHTGDLGRIDAD

SEQ ID NO: 705681 - protein, 17 aa, Mycobacterium
PATTHRAMWALGDYAVL

SEQ ID NO: 705682 - protein, 17 aa, Mycobacterium
PATTKAALVARAIQDGL

SEQ ID NO: 705683 - protein, 19 aa, Mycobacterium
PATVAAFCNTVRTPGGGSH

SEQ ID NO: 705684 - protein, 23 aa, Mycobacterium
PATVDMRCLLIIGSTQTRWQRTT

SEQ ID NO: 705685 - protein, 18 aa, Mycobacterium
PATWSGAGVVASHATATE

SEQ ID NO: 705686 - protein, 17 aa, Mycobacterium
PATWTYTSWGTFYRALL

SEQ ID NO: 705687 - protein, 20 aa, Mycobacterium
PAVADIAGRVAFYPDKAEIT

SEQ ID NO: 705688 - protein, 17 aa, Mycobacterium
PAVAGADRHPGWHALRK

SEQ ID NO: 705689 - protein, 17 aa, Mycobacterium
PAVAHAVFFGMGSDGTV

SEQ ID NO: 705690 - protein, 18 aa, Mycobacterium
PAVAHWNLARFAETLLPL

SEQ ID NO: 705691 - protein, 18 aa, Mycobacterium
PAVALAFDEASRRGVGLV

SEQ ID NO: 705692 - protein, 19 aa, Mycobacterium
PAVAPDMADPGIADPGLSD

SEQ ID NO: 705693 - protein, 25 aa, Mycobacterium
PAVARWIRRVCRPTQWLELRFVGSR

SEQ ID NO: 705694 - protein, 20 aa, Mycobacterium
PAVCSGAAIVPAKFSASNFL

SEQ ID NO: 705695 - protein, 17 aa, Mycobacterium
PAVDGRGGGKADTAQGS

SEQ ID NO: 705696 - protein, 26 aa, Mycobacterium
PAVDRAILRVAVWELLHAEDVPEPVA

SEQ ID NO: 705697 - protein, 26 aa, Mycobacterium
PAVDRAILRVAVWELLYADDVPEPVA

SEQ ID NO: 705698 - protein, 27 aa, Mycobacterium
PAVDRAVLRVAVWELLHAVDVPEPVAV

SEQ ID NO: 705699 - protein, 19 aa, Mycobacterium
PAVEDCAVFGIPAADGEAI

SEQ ID NO: 705700 - protein, 21 aa, Mycobacterium
PAVEELLRWLSIVQTSIPRIT

SEQ ID NO: 705701 - protein, 17 aa, Mycobacterium
PAVEGMASINLQLRPYQ

SEQ ID NO: 705702 - protein, 18 aa, Mycobacterium
PAVEYSMIAEVRRLLDRA

SEQ ID NO: 705703 - protein, 23 aa, Mycobacterium
PAVFAGEIIDRFIAQPPQTPAAP

SEQ ID NO: 705704 - protein, 18 aa, Mycobacterium
PAVFAGEIVDRFIAETPA

SEQ ID NO: 705705 - protein, 20 aa, Mycobacterium
PAVGALLSMLTKLSGGKAVA

SEQ ID NO: 705706 - protein, 19 aa, Mycobacterium
PAVGGGWIGYLSYPDPGAD

SEQ ID NO: 705707 - protein, 17 aa, Mycobacterium
PAVGRAGVLLRRHGGVA

SEQ ID NO: 705708 - protein, 19 aa, Mycobacterium
PAVHQFRRAGLRADHQRRG

SEQ ID NO: 705709 - protein, 23 aa, Mycobacterium
PAVHRFPGSMAKRVQALAQAVVD

SEQ ID NO: 705710 - protein, 21 aa, Mycobacterium
PAVIDPEWERSPGSITDNHVF

SEQ ID NO: 705711 - protein, 18 aa, Mycobacterium
PAVKDRLFPTAFGPATID

SEQ ID NO: 705712 - protein, 23 aa, Mycobacterium
PAVKRLLDLVPRRVNPTPTHRVN

SEQ ID NO: 705713 - protein, 17 aa, Mycobacterium
PAVKRRVDRMLADGVIR

SEQ ID NO: 705714 - protein, 17 aa, Mycobacterium
PAVKVIVLRGAGRAFSG

SEQ ID NO: 705715 - protein, 24 aa, Mycobacterium
PAVLCIRVARALLPDVPHIAVFDT

SEQ ID NO: 705716 - protein, 22 aa, Mycobacterium
PAVLLLKAVGLAAQRFGEFNGF

SEQ ID NO: 705717 - protein, 17 aa, Mycobacterium
PAVLPSFKIDFEDYWAF

SEQ ID NO: 705718 - protein, 19 aa, Mycobacterium
PAVLRCVPGDIVAIDTRDG

SEQ ID NO: 705719 - protein, 20 aa, Mycobacterium
PAVLSALSWEDYCAADAGTP

SEQ ID NO: 705720 - protein, 18 aa, Mycobacterium
PAVLTKIKAADIVIVSTP

SEQ ID NO: 705721 - protein, 18 aa, Mycobacterium
PAVNGEKTLSIALDGEMG

SEQ ID NO: 705722 - protein, 22 aa, Mycobacterium
PAVNNFEGWTALASWGEITTRT

SEQ ID NO: 705723 - protein, 24 aa, Mycobacterium
PAVPAARVRFILDDASPVAVVTTA

SEQ ID NO: 705724 - protein, 23 aa, Mycobacterium
PAVPSARIEFVLSDAAPVAAVTT

SEQ ID NO: 705725 - protein, 22 aa, Mycobacterium
PAVPSPYAFRLADPDTDAEMIA

SEQ ID NO: 705726 - protein, 18 aa, Mycobacterium
PAVQGGRIATVWHGHLDW

SEQ ID NO: 705727 - protein, 18 aa, Mycobacterium
PAVREAIKRLTAAGLVEV

SEQ ID NO: 705728 - protein, 20 aa, Mycobacterium
PAVRECVRALAAANLLGVGW

SEQ ID NO: 705729 - protein, 20 aa, Mycobacterium
PAVRGFEVLEQLAFDERRLR

SEQ ID NO: 705730 - protein, 17 aa, Mycobacterium
PAVRGVVHAAGVEAGAL

SEQ ID NO: 705731 - protein, 20 aa, Mycobacterium
PAVRWVKYPFLQSHPQYELA

SEQ ID NO: 705732 - protein, 23 aa, Mycobacterium
PAVRWVRYPFLGTHPQYELAKRQ

SEQ ID NO: 705733 - protein, 20 aa, Mycobacterium
PAVRWWPIAVSVARDTGILS

SEQ ID NO: 705734 - protein, 21 aa, Mycobacterium
PAVSAWNWLETVPGGWRRALA

SEQ ID NO: 705735 - protein, 17 aa, Mycobacterium
PAVSCRAALFGSDVPTF

SEQ ID NO: 705736 - protein, 21 aa, Mycobacterium
PAVSELLRFITTPRCTQAMIR

SEQ ID NO: 705737 - protein, 17 aa, Mycobacterium
PAVSFCSRGVLSACPPY

SEQ ID NO: 705738 - protein, 18 aa, Mycobacterium
PAVSGLVERGARTGEIAG

SEQ ID NO: 705739 - protein, 17 aa, Mycobacterium
PAVSIKHLRVIRGKHSA

SEQ ID NO: 705740 - protein, 18 aa, Mycobacterium
PAVSRLSGELTVRLRTYE

SEQ ID NO: 705741 - protein, 19 aa, Mycobacterium
PAVSVLDVLPTRVVPPSYS

SEQ ID NO: 705742 - protein, 18 aa, Mycobacterium
PAVTAGVCMNILLNHEVP

SEQ ID NO: 705743 - protein, 17 aa, Mycobacterium
PAVTLRLAFGGDVRGYD

SEQ ID NO: 705744 - protein, 20 aa, Mycobacterium
PAVVARLGVELPELRHLHEV

SEQ ID NO: 705745 - protein, 19 aa, Mycobacterium
PAVVARLLGVLGVTDAESY

SEQ ID NO: 705746 - protein, 26 aa, Mycobacterium
PAVWMRLVVLGVKFREAYGVDARVTD

SEQ ID NO: 705747 - protein, 18 aa, Mycobacterium
PAVWMYGGGAGFANILYH

SEQ ID NO: 705748 - protein, 18 aa, Mycobacterium
PAWARSTFKRMPATEQAL

SEQ ID NO: 705749 - protein, 22 aa, Mycobacterium
PAWATDRYATMAGRAADIDTVY

SEQ ID NO: 705750 - protein, 21 aa, Mycobacterium
PAWCGEALSTVTGRRRRADDV

SEQ ID NO: 705751 - protein, 19 aa, Mycobacterium
PAWQLLGVVDQYWQSGPAP

SEQ ID NO: 705752 - protein, 20 aa, Mycobacterium
PAWQRLLTDYFLPADKYPAI

SEQ ID NO: 705753 - protein, 18 aa, Mycobacterium
PAWVPGRLLAAVLDVTWR

SEQ ID NO: 705754 - protein, 26 aa, Mycobacterium
PAYAASMAPKLVSFGHEIDREVGIGA

SEQ ID NO: 705755 - protein, 24 aa, Mycobacterium
PAYAELKPDHWLVEVCREEMLRLG

SEQ ID NO: 705756 - protein, 21 aa, Mycobacterium
PAYALPLFVRVVESMAHTTTF

SEQ ID NO: 705757 - protein, 27 aa, Mycobacterium
PAYARAFEPKIRWEAAVFEESPGIDAA

SEQ ID NO: 705758 - protein, 18 aa, Mycobacterium
PAYDESWDDILLQRLRAA

SEQ ID NO: 705759 - protein, 19 aa, Mycobacterium
PAYDESWDDILLQRLRTAA

SEQ ID NO: 705760 - protein, 19 aa, Mycobacterium
PAYDITALLAAHPSSVNGA

SEQ ID NO: 705761 - protein, 23 aa, Mycobacterium
PAYGRLRPVTDLASVLVADNPGL

SEQ ID NO: 705762 - protein, 19 aa, Mycobacterium
PAYNLTLFLSQLAQGDLRA

SEQ ID NO: 705763 - protein, 20 aa, Mycobacterium
PAYNPWDQRLCAVPDADMFR

SEQ ID NO: 705764 - protein, 21 aa, Mycobacterium
PAYRAGLAGGMPGGFDDARFE

SEQ ID NO: 705765 - protein, 18 aa, Mycobacterium
PAYRELLQEFLFKLDLDE

SEQ ID NO: 705766 - protein, 25 aa, Mycobacterium
PAYRGVLELHGWGDLQTELHRLSRA

SEQ ID NO: 705767 - protein, 23 aa, Mycobacterium
PAYRPVLAAHGWEDLQPELNALS

SEQ ID NO: 705768 - protein, 24 aa, Mycobacterium
PAYRPVLEAHGWGDLQPELNAMSK

SEQ ID NO: 705769 - protein, 18 aa, Mycobacterium
PAYTGTLTLRYRRPTALE

SEQ ID NO: 705770 - protein, 19 aa, Mycobacterium
PAYTLPWTVRPFAPGELDE

SEQ ID NO: 705771 - protein, 24 aa, Mycobacterium
PAYVRRAPLLDGIDEFDADFFGFP

SEQ ID NO: 705772 - protein, 22 aa, Mycobacterium
PCAPADPRDCMCPAATKRRYLG

SEQ ID NO: 705773 - protein, 20 aa, Mycobacterium
PCAPGALGQLALTGGMNPYL

SEQ ID NO: 705774 - protein, 28 aa, Mycobacterium
PCCVVPLGWPRGRYGPTTRRPVAEVMHL

SEQ ID NO: 705775 - protein, 18 aa, Mycobacterium
PCDATKYISHFPSTRTIW

SEQ ID NO: 705776 - protein, 19 aa, Mycobacterium
PCDNYERFIFGRGPSGQAE

SEQ ID NO: 705777 - protein, 20 aa, Mycobacterium
PCDTPLLPPDSWERAEEFVQ

SEQ ID NO: 705778 - protein, 17 aa, Mycobacterium
PCEPAPWSIDWTAPDRE

SEQ ID NO: 705779 - protein, 25 aa, Mycobacterium
PCEPDELRSLFLFEALTDEQLAVLC

SEQ ID NO: 705780 - protein, 17 aa, Mycobacterium
PCFRQIYSELGITKSDI

SEQ ID NO: 705781 - protein, 22 aa, Mycobacterium
PCGAGNGGTWFGLYSAGGPGGP

SEQ ID NO: 705782 - protein, 19 aa, Mycobacterium
PCGELRRYPYGHFDIYHDP

SEQ ID NO: 705783 - protein, 20 aa, Mycobacterium
PCGLADLCERTDLPRATAHR

SEQ ID NO: 705784 - protein, 20 aa, Mycobacterium
PCGPATRFQPTVQMLAELDP

SEQ ID NO: 705785 - protein, 19 aa, Mycobacterium
PCHRFRYCAPQPRKYTFVG

SEQ ID NO: 705786 - protein, 17 aa, Mycobacterium
PCIGLLSGGISRAELQE

SEQ ID NO: 705787 - protein, 18 aa, Mycobacterium
PCLQRLQPMLSEDHSTAE

SEQ ID NO: 705788 - protein, 19 aa, Mycobacterium
PCLRAFCDTVLAQDREPRV

SEQ ID NO: 705789 - protein, 20 aa, Mycobacterium
PCNQLPAPVRALSKALPMLK

SEQ ID NO: 705790 - protein, 18 aa, Mycobacterium
PCPCGSPFPTIDVVGRTD

SEQ ID NO: 705791 - protein, 26 aa, Mycobacterium
PCPGPLGERAQWWWYQPFEPQPPPSA

SEQ ID NO: 705792 - protein, 20 aa, Mycobacterium
PCPPAGTGTHHYRFTLYQLP

SEQ ID NO: 705793 - protein, 19 aa, Mycobacterium
PCPRRELADFPPVGRPPAT

SEQ ID NO: 705794 - protein, 17 aa, Mycobacterium
PCPSVPPTACLPASGVP

SEQ ID NO: 705795 - protein, 17 aa, Mycobacterium
PCPVLSYQCAIDAVSSR

SEQ ID NO: 705796 - protein, 18 aa, Mycobacterium
PCQPKNVMFMYCTAKPED

SEQ ID NO: 705797 - protein, 20 aa, Mycobacterium
PCRICGTPVRTAELEGRNLF

SEQ ID NO: 705798 - protein, 18 aa, Mycobacterium
PCRLCATTVRTAELEGRN

SEQ ID NO: 705799 - protein, 18 aa, Mycobacterium
PCRLSTKHALALTNRGTA

SEQ ID NO: 705800 - protein, 20 aa, Mycobacterium
PCSALDPISTLAIEDLIAEL

SEQ ID NO: 705801 - protein, 20 aa, Mycobacterium
PCSALDPISTLAIEDLISEL

SEQ ID NO: 705802 - protein, 19 aa, Mycobacterium
PCSALDPISTMAIEDLISE

SEQ ID NO: 705803 - protein, 24 aa, Mycobacterium
PCSGLSFSAGGGRFARVFLGEARG

SEQ ID NO: 705804 - protein, 22 aa, Mycobacterium
PCSGMDLGALVAHIGGLALAFD

SEQ ID NO: 705805 - protein, 25 aa, Mycobacterium
PCSHPHCCSVGYLLRDDGGRWRSLV

SEQ ID NO: 705806 - protein, 19 aa, Mycobacterium
PCTGLGALRRRPEARWRRQ

SEQ ID NO: 705807 - protein, 23 aa, Mycobacterium
PCTMCAGALVLARVGRLVFGAWE

SEQ ID NO: 705808 - protein, 22 aa, Mycobacterium
PCTMCAGALVLARVGRVVFGAW

SEQ ID NO: 705809 - protein, 22 aa, Mycobacterium
PCTMCAGALVLARVSRLVFGAW

SEQ ID NO: 705810 - protein, 23 aa, Mycobacterium
PCTMCAGALVLSRIGRLVFGAWE

SEQ ID NO: 705811 - protein, 24 aa, Mycobacterium
PCVIKSADGRVVWDNDAYSFLSGP

SEQ ID NO: 705812 - protein, 26 aa, Mycobacterium
PCVITAADGRVVWDNDVYAFLTGEAP

SEQ ID NO: 705813 - protein, 17 aa, Mycobacterium
PCVRCNERIKFSALASR

SEQ ID NO: 705814 - protein, 29 aa, Mycobacterium
PCWGFGPKPRLAGFWIRRQAHEHAVHHAD

SEQ ID NO: 705815 - protein, 19 aa, Mycobacterium
PCWKVHLDTGLASDDTPAG

SEQ ID NO: 705816 - protein, 18 aa, Mycobacterium
PCYRGPEDLAAIESIPLS

SEQ ID NO: 705817 - protein, 23 aa, Mycobacterium
PDAAEFAEAVFQVCDDLAAQLQA

SEQ ID NO: 705818 - protein, 22 aa, Mycobacterium
PDAAEGFILDGYPRSVEQAGAL

SEQ ID NO: 705819 - protein, 18 aa, Mycobacterium
PDAAGGLHLVFDFSVALW

SEQ ID NO: 705820 - protein, 18 aa, Mycobacterium
PDAAGIRALAGLWRSLTR

SEQ ID NO: 705821 - protein, 25 aa, Mycobacterium
PDAAGWRLAADWRADSHAPPWARRF

SEQ ID NO: 705822 - protein, 18 aa, Mycobacterium
PDAAKAMRTVLESVPPVT

SEQ ID NO: 705823 - protein, 23 aa, Mycobacterium
PDAARRVRRVWSGIRTEVLGGQY

SEQ ID NO: 705824 - protein, 24 aa, Mycobacterium
PDAARVVAVRARLMAGLPAGGAMV

SEQ ID NO: 705825 - protein, 18 aa, Mycobacterium
PDAAYWVENLCAPVLFPA

SEQ ID NO: 705826 - protein, 24 aa, Mycobacterium
PDACIRLGADFTFGSTLWQLADSH

SEQ ID NO: 705827 - protein, 18 aa, Mycobacterium
PDACLKLEAEIYHKFASG

SEQ ID NO: 705828 - protein, 24 aa, Mycobacterium
PDACTRYLGGLFAAGAAGVVVELG

SEQ ID NO: 705829 - protein, 19 aa, Mycobacterium
PDADGSVIFGFNRLSIIDI

SEQ ID NO: 705830 - protein, 26 aa, Mycobacterium
PDADLRPGLLVQLAFAAADFGFQQWV

SEQ ID NO: 705831 - protein, 20 aa, Mycobacterium
PDADLVFFFDRRELPLVVSG

SEQ ID NO: 705832 - protein, 27 aa, Mycobacterium
PDADPALILRELWDLHVEFGMQQPHCY

SEQ ID NO: 705833 - protein, 25 aa, Mycobacterium
PDADPRVVSALEMTFFGALMHAGSG

SEQ ID NO: 705834 - protein, 19 aa, Mycobacterium
PDADPSLAWRRISKSRRPI

SEQ ID NO: 705835 - protein, 25 aa, Mycobacterium
PDADYRTRWTIPIGLREADLTVAHN

SEQ ID NO: 705836 - protein, 27 aa, Mycobacterium
PDAEAAADCWSCFYQSRCALRALTLDP

SEQ ID NO: 705837 - protein, 23 aa, Mycobacterium
PDAELLGMLGLIIGGGFDTTTAL

SEQ ID NO: 705838 - protein, 18 aa, Mycobacterium
PDAELLVSVAKAYVAERA

SEQ ID NO: 705839 - protein, 25 aa, Mycobacterium
PDAENKTRFVIVDAIGVTEHPFVEP

SEQ ID NO: 705840 - protein, 20 aa, Mycobacterium
PDAEWGEIVVAFVVTNGTPV

SEQ ID NO: 705841 - protein, 18 aa, Mycobacterium
PDAFERLVRLQVIRVDGE

SEQ ID NO: 705842 - protein, 22 aa, Mycobacterium
PDAFGGVAVSVWAVPPGYVAGE

SEQ ID NO: 705843 - protein, 19 aa, Mycobacterium
PDAFIQLALQLAYGRLHPD

SEQ ID NO: 705844 - protein, 25 aa, Mycobacterium
PDAFLRAVVDFDLPEPGSYATGMAF

SEQ ID NO: 705845 - protein, 22 aa, Mycobacterium
PDAFTRLAARFLGPAVSGVQPV

SEQ ID NO: 705846 - protein, 18 aa, Mycobacterium
PDAGEPWAVQKLYYNHGF

SEQ ID NO: 705847 - protein, 18 aa, Mycobacterium
PDAGFSRFTERARAAVVH

SEQ ID NO: 705848 - protein, 25 aa, Mycobacterium
PDAGHWSVPPSRRFIPEDQTVAEET

SEQ ID NO: 705849 - protein, 24 aa, Mycobacterium
PDAGHWSVPPSRRFLPEDRTVARE

SEQ ID NO: 705850 - protein, 25 aa, Mycobacterium
PDAGLRPAWITDLHNVFGSAAAESI

SEQ ID NO: 705851 - protein, 18 aa, Mycobacterium
PDAGRILLSRARRECDPV

SEQ ID NO: 705852 - protein, 33 aa, Mycobacterium
PDAGWSRTDHYAWIAGLLLDLGIDSIDEVEAAL

SEQ ID NO: 705853 - protein, 18 aa, Mycobacterium
PDAHAVWVGDVLIRAEAT

SEQ ID NO: 705854 - protein, 23 aa, Mycobacterium
PDAHGEVFPFVFTAARLTEHHTA

SEQ ID NO: 705855 - protein, 17 aa, Mycobacterium
PDAHIVDLDGGFVAPAF

SEQ ID NO: 705856 - protein, 17 aa, Mycobacterium
PDAIAFARDEREIVERG

SEQ ID NO: 705857 - protein, 21 aa, Mycobacterium
PDAIIPPTFLTTAGRWAPAGV

SEQ ID NO: 705858 - protein, 21 aa, Mycobacterium
PDAIMDLRDALLGASPEFLDP

SEQ ID NO: 705859 - protein, 18 aa, Mycobacterium
PDAIRLLDRVGLGNRAQH

SEQ ID NO: 705860 - protein, 20 aa, Mycobacterium
PDAKEWLAFGPEVLGMEAVE

SEQ ID NO: 705861 - protein, 22 aa, Mycobacterium
PDAKEWRQLVAAMEGTLRLHSH

SEQ ID NO: 705862 - protein, 20 aa, Mycobacterium
PDAKFLWSHRDPAKVMGSVC

SEQ ID NO: 705863 - protein, 17 aa, Mycobacterium
PDALAFGCAEDGIRTTW

SEQ ID NO: 705864 - protein, 17 aa, Mycobacterium
PDALAHWTLPRLVGTAV

SEQ ID NO: 705865 - protein, 20 aa, Mycobacterium
PDALLQWLLAARRDLLAALS

SEQ ID NO: 705866 - protein, 24 aa, Mycobacterium
PDALLRRRKISMIKSIYPGQTATL

SEQ ID NO: 705867 - protein, 21 aa, Mycobacterium
PDALLTRGLYQYKPDLPFSPG

SEQ ID NO: 705868 - protein, 20 aa, Mycobacterium
PDALLTRGLYQYRPQLPFVL

SEQ ID NO: 705869 - protein, 21 aa, Mycobacterium
PDALLTRGLYQYRPQLPFVLG

SEQ ID NO: 705870 - protein, 17 aa, Mycobacterium
PDALNAFNEALYDEVTD

SEQ ID NO: 705871 - protein, 18 aa, Mycobacterium
PDALNAYTPEIGRRLGEA

SEQ ID NO: 705872 - protein, 18 aa, Mycobacterium
PDALRAADLLAEQWDVAA

SEQ ID NO: 705873 - protein, 18 aa, Mycobacterium
PDALRPGYGLAEATLFVT

SEQ ID NO: 705874 - protein, 26 aa, Mycobacterium
PDALVGPCWPAVFSAIGSAVTETGIP

SEQ ID NO: 705875 - protein, 27 aa, Mycobacterium
PDALVGRCWPAVFAAIGSAATEAGFPV

SEQ ID NO: 705876 - protein, 17 aa, Mycobacterium
PDALWAIISDVANWDKW

SEQ ID NO: 705877 - protein, 20 aa, Mycobacterium
PDALWPAAVFTLTTLLDDPV

SEQ ID NO: 705878 - protein, 18 aa, Mycobacterium
PDAMAGLIATMIGTPDRY

SEQ ID NO: 705879 - protein, 22 aa, Mycobacterium
PDAMTVVGAVFRPNGNLSQALD

SEQ ID NO: 705880 - protein, 19 aa, Mycobacterium
PDANSIAWLLWHSARVQDL

SEQ ID NO: 705881 - protein, 18 aa, Mycobacterium
PDAPAVVWGLDNEDGAWS

SEQ ID NO: 705882 - protein, 24 aa, Mycobacterium
PDAPELKARVKSLGLEVVESAQFK

SEQ ID NO: 705883 - protein, 23 aa, Mycobacterium
PDAPKHRGISCLILDLQSPGVRV

SEQ ID NO: 705884 - protein, 18 aa, Mycobacterium
PDAPKLPAVVGYEVAGTV

SEQ ID NO: 705885 - protein, 24 aa, Mycobacterium
PDAPKRKGISYFLLDMTSPGVDVR

SEQ ID NO: 705886 - protein, 18 aa, Mycobacterium
PDAPLALCLHGFPDTPYG

SEQ ID NO: 705887 - protein, 27 aa, Mycobacterium
PDAPLPLTQRLVAIFGDRLNKLDESVK

SEQ ID NO: 705888 - protein, 18 aa, Mycobacterium
PDAPLRLPLGADAVERIE

SEQ ID NO: 705889 - protein, 17 aa, Mycobacterium
PDAPMLSRDDILYMHDL

SEQ ID NO: 705890 - protein, 20 aa, Mycobacterium
PDAPPGTVCCALLPDVQAER

SEQ ID NO: 705891 - protein, 29 aa, Mycobacterium
PDAPRCRYCGGRICPVCLEGMVSCDCCAA

SEQ ID NO: 705892 - protein, 21 aa, Mycobacterium
PDAPRIGGITPFLRFATLASH

SEQ ID NO: 705893 - protein, 25 aa, Mycobacterium
PDAPTASGFWHWAVADLPVSVTELP

SEQ ID NO: 705894 - protein, 25 aa, Mycobacterium
PDAPTASGFWHWAVANLPADVTELA

SEQ ID NO: 705895 - protein, 25 aa, Mycobacterium
PDAPTASGFWHWAVANLPADVTELP

SEQ ID NO: 705896 - protein, 23 aa, Mycobacterium
PDAPTASGFWHWAVANLPATVTQ

SEQ ID NO: 705897 - protein, 17 aa, Mycobacterium
PDAPTLCEGWTTRDLAA

SEQ ID NO: 705898 - protein, 22 aa, Mycobacterium
PDAPYLHLFVPRGTVTLEGAGA

SEQ ID NO: 705899 - protein, 25 aa, Mycobacterium
PDAQRRVQRVWSDIRTEVLGGQYLD

SEQ ID NO: 705900 - protein, 22 aa, Mycobacterium
PDAQYAALIGCCAAICRRLGVP

SEQ ID NO: 705901 - protein, 18 aa, Mycobacterium
PDARAAIVRLHLQDRPVE

SEQ ID NO: 705902 - protein, 18 aa, Mycobacterium
PDARCFLVNSGQIAEDMP

SEQ ID NO: 705903 - protein, 23 aa, Mycobacterium
PDARDCQAVWAPAKRRAKSSIVS

SEQ ID NO: 705904 - protein, 25 aa, Mycobacterium
PDARFGWPKRNGFVQPMVDAELLAG

SEQ ID NO: 705905 - protein, 21 aa, Mycobacterium
PDARGIYYGRLTEMTSTDFQV

SEQ ID NO: 705906 - protein, 19 aa, Mycobacterium
PDARISLPALNIVAEGRSI

SEQ ID NO: 705907 - protein, 17 aa, Mycobacterium
PDARITVSPLGFVAEGR

SEQ ID NO: 705908 - protein, 21 aa, Mycobacterium
PDARPPVCKIMDYGKFKYETA

SEQ ID NO: 705909 - protein, 21 aa, Mycobacterium
PDARVALPTREDQALIYRLSG

SEQ ID NO: 705910 - protein, 21 aa, Mycobacterium
PDARVSLPTREDQALIYRLSG

SEQ ID NO: 705911 - protein, 21 aa, Mycobacterium
PDARVSTPLHWDEVAGCRPEA

SEQ ID NO: 705912 - protein, 17 aa, Mycobacterium
PDARVSTPLHWDEVPDC

SEQ ID NO: 705913 - protein, 20 aa, Mycobacterium
PDARVSTPLHWHEVADCDPQ

SEQ ID NO: 705914 - protein, 17 aa, Mycobacterium
PDARVSTPLRWDEVAGC

SEQ ID NO: 705915 - protein, 17 aa, Mycobacterium
PDASGAWSQGRVALGHR

SEQ ID NO: 705916 - protein, 25 aa, Mycobacterium
PDATLRYAGYIGWRGTVALSALSEP

SEQ ID NO: 705917 - protein, 20 aa, Mycobacterium
PDATMGAGWARGVTVVLTPP

SEQ ID NO: 705918 - protein, 19 aa, Mycobacterium
PDATRLIPMLSDVQPEIFF

SEQ ID NO: 705919 - protein, 17 aa, Mycobacterium
PDAVAIVLFTSGTTSQP

SEQ ID NO: 705920 - protein, 19 aa, Mycobacterium
PDAVARCRSAWMTLRDRRI

SEQ ID NO: 705921 - protein, 27 aa, Mycobacterium
PDAVIAHCRSRLAGFKTPKQIFTVAEL

SEQ ID NO: 705922 - protein, 21 aa, Mycobacterium
PDAVLKVIVESAVLLSGTDES

SEQ ID NO: 705923 - protein, 26 aa, Mycobacterium
PDAVMWACTSGSFVFGPEGAREQAAG

SEQ ID NO: 705924 - protein, 18 aa, Mycobacterium
PDAVPEFVGDIYDLACRR

SEQ ID NO: 705925 - protein, 19 aa, Mycobacterium
PDAVRRAAGAAARALGTAK

SEQ ID NO: 705926 - protein, 22 aa, Mycobacterium
PDAWLLNYTNPMAMNVTYLHHI

SEQ ID NO: 705927 - protein, 22 aa, Mycobacterium
PDAWTLDGYLRHGGYRGLRTAL

SEQ ID NO: 705928 - protein, 21 aa, Mycobacterium
PDAYKAIWDFAGQTATSRHIP

SEQ ID NO: 705929 - protein, 18 aa, Mycobacterium
PDAYRYATAAGRDLLAVD

SEQ ID NO: 705930 - protein, 20 aa, Mycobacterium
PDCAAELVCANGVSADRAIL

SEQ ID NO: 705931 - protein, 31 aa, Mycobacterium
PDCARGRLCSGCGRGRISTAVAAAVPGIPIG

SEQ ID NO: 705932 - protein, 23 aa, Mycobacterium
PDCGLRRAEVVGVPVRQAITALD

SEQ ID NO: 705933 - protein, 19 aa, Mycobacterium
PDCHIRWHDVWDHPLQTAT

SEQ ID NO: 705934 - protein, 19 aa, Mycobacterium
PDCKSNVLYKGALQGDPAS

SEQ ID NO: 705935 - protein, 17 aa, Mycobacterium
PDCPYPVTWDEADAKLR

SEQ ID NO: 705936 - protein, 22 aa, Mycobacterium
PDCTPVPVFLQRSPHFRPPEDP

SEQ ID NO: 705937 - protein, 23 aa, Mycobacterium
PDCVPELCTSQILVTEFLDGQAF

SEQ ID NO: 705938 - protein, 17 aa, Mycobacterium
PDCVVYNPMWIDVDELV

SEQ ID NO: 705939 - protein, 20 aa, Mycobacterium
PDDASVRFLLTAGAIGSLYK

SEQ ID NO: 705940 - protein, 17 aa, Mycobacterium
PDDAVTWVLDPIDGTVN

SEQ ID NO: 705941 - protein, 19 aa, Mycobacterium
PDDAYCAGPRAMPGLVPTS

SEQ ID NO: 705942 - protein, 19 aa, Mycobacterium
PDDDAWPLLLQTARESDPG

SEQ ID NO: 705943 - protein, 22 aa, Mycobacterium
PDDEIEVGIGIHGEPGRDRVPL

SEQ ID NO: 705944 - protein, 19 aa, Mycobacterium
PDDEVPGFVAEIAERTGEF

SEQ ID NO: 705945 - protein, 26 aa, Mycobacterium
PDDFRSTNVIACLTRKSGTEVKARTC

SEQ ID NO: 705946 - protein, 19 aa, Mycobacterium
PDDGCCSHGAFLSDADDRA

SEQ ID NO: 705947 - protein, 18 aa, Mycobacterium
PDDGIQIGWTPRHAVVVH

SEQ ID NO: 705948 - protein, 23 aa, Mycobacterium
PDDGRTVIHLNPFAAQGDNSYFP

SEQ ID NO: 705949 - protein, 18 aa, Mycobacterium
PDDIAGIAVFLASRASTY

SEQ ID NO: 705950 - protein, 32 aa, Mycobacterium
PDDIARLAHRVLRHRLILGFEAASARITPDVV

SEQ ID NO: 705951 - protein, 21 aa, Mycobacterium
PDDKPRHLLGISEPDDLFAAV

SEQ ID NO: 705952 - protein, 25 aa, Mycobacterium
PDDKWRGIEAPVMIVASGKDHGVYQ

SEQ ID NO: 705953 - protein, 21 aa, Mycobacterium
PDDLLPEWVLPPEDIPFIYPD

SEQ ID NO: 705954 - protein, 24 aa, Mycobacterium
PDDPEFRAPWSLAKKKRRSSPLSP

SEQ ID NO: 705955 - protein, 24 aa, Mycobacterium
PDDPEIRAPWSLSKPKRRSSPSSR

SEQ ID NO: 705956 - protein, 24 aa, Mycobacterium
PDDPRIDAALLIPSIRGAIPATDP

SEQ ID NO: 705957 - protein, 26 aa, Mycobacterium
PDDPRPRLLGALAMASVRIALDDWLV

SEQ ID NO: 705958 - protein, 31 aa, Mycobacterium
PDDPVRLSLHLGRRHRIGGLPGYVAVCDLLH

SEQ ID NO: 705959 - protein, 19 aa, Mycobacterium
PDDRLIPLVAGLSELLPWV

SEQ ID NO: 705960 - protein, 23 aa, Mycobacterium
PDDRVDTEFYFKFLRSPDGNGIT

SEQ ID NO: 705961 - protein, 18 aa, Mycobacterium
PDDSRFVYLSDVLPTAWQ

SEQ ID NO: 705962 - protein, 20 aa, Mycobacterium
PDDTGLRKPFAHGYENKHGV

SEQ ID NO: 705963 - protein, 23 aa, Mycobacterium
PDDTPWGGKPVRKLQLPRDAVLV

SEQ ID NO: 705964 - protein, 23 aa, Mycobacterium
PDDTPWGGKPVRKLQLPRDTSLV

SEQ ID NO: 705965 - protein, 18 aa, Mycobacterium
PDDVWRGHCDREIAEHAL

SEQ ID NO: 705966 - protein, 18 aa, Mycobacterium
PDDYIEMINPLWTTKELR

SEQ ID NO: 705967 - protein, 18 aa, Mycobacterium
PDEAMLISGGRVKGNAPF

SEQ ID NO: 705968 - protein, 23 aa, Mycobacterium
PDEANFEYGLDCILDHAGRLIDE

SEQ ID NO: 705969 - protein, 24 aa, Mycobacterium
PDEANPALGVRGIRISFANPGLLD

SEQ ID NO: 705970 - protein, 19 aa, Mycobacterium
PDEAPAPAADPGFGLSTVP

SEQ ID NO: 705971 - protein, 19 aa, Mycobacterium
PDEAWSRYGSYVMNETAEY

SEQ ID NO: 705972 - protein, 23 aa, Mycobacterium
PDEDRPRIFGIFDQILKALAPEA

SEQ ID NO: 705973 - protein, 22 aa, Mycobacterium
PDEEARIAIVKYHLRDRPLEGI

SEQ ID NO: 705974 - protein, 23 aa, Mycobacterium
PDEFARRLPLMAAKRVFSEPIAL

SEQ ID NO: 705975 - protein, 17 aa, Mycobacterium
PDEFSGKILAPAHLPQE

SEQ ID NO: 705976 - protein, 24 aa, Mycobacterium
PDEGAAAVIMCRADIAHKFTDKPV

SEQ ID NO: 705977 - protein, 23 aa, Mycobacterium
PDEGAAAVIMCRADIAHKYTDKP

SEQ ID NO: 705978 - protein, 23 aa, Mycobacterium
PDEGAAAVIMCRADMAEKFTDKP

SEQ ID NO: 705979 - protein, 24 aa, Mycobacterium
PDEGAAAVIMCRADMAHKFTDKPV

SEQ ID NO: 705980 - protein, 24 aa, Mycobacterium
PDEGAAAVIMCRADMAHTFTDKPV

SEQ ID NO: 705981 - protein, 23 aa, Mycobacterium
PDEGAAAVVMCRADIAHRYTAKP

SEQ ID NO: 705982 - protein, 23 aa, Mycobacterium
PDEGWRFVNRLARRIAANPLDLI

SEQ ID NO: 705983 - protein, 34 aa, Mycobacterium
PDEHRDRIGALWSRFSAVAARNPHAWNRDAVTAQ

SEQ ID NO: 705984 - protein, 26 aa, Mycobacterium
PDEHTCLYHYAWVRDRLLMVSLADVA

SEQ ID NO: 705985 - protein, 24 aa, Mycobacterium
PDEIHLPGIFVQRVVALTPEQAAH

SEQ ID NO: 705986 - protein, 27 aa, Mycobacterium
PDEKARYGFAIAPELVRTVLRDREPDW

SEQ ID NO: 705987 - protein, 21 aa, Mycobacterium
PDEKFRYGFEIPAALVRTVLR

SEQ ID NO: 705988 - protein, 18 aa, Mycobacterium
PDELACIRNAVRITDAAM

SEQ ID NO: 705989 - protein, 19 aa, Mycobacterium
PDELACIRSAVRITDEAMV

SEQ ID NO: 705990 - protein, 17 aa, Mycobacterium
PDELAWHVLQFDADMKA

SEQ ID NO: 705991 - protein, 19 aa, Mycobacterium
PDELLGLLVDERVNVLSQT

SEQ ID NO: 705992 - protein, 18 aa, Mycobacterium
PDELLHCGADVVVADLSD

SEQ ID NO: 705993 - protein, 23 aa, Mycobacterium
PDELRAWKAEHPGAVVVSYVNTT

SEQ ID NO: 705994 - protein, 22 aa, Mycobacterium
PDELRTLFLFEALTEAQLAVLC

SEQ ID NO: 705995 - protein, 22 aa, Mycobacterium
PDELSLRWFGNEGEFDGPDLIL

SEQ ID NO: 705996 - protein, 19 aa, Mycobacterium
PDELTGLYLYLASEASSYM

SEQ ID NO: 705997 - protein, 24 aa, Mycobacterium
PDEPEALGLLALVLLTEARRPART

SEQ ID NO: 705998 - protein, 24 aa, Mycobacterium
PDEQAGAILFLLSDLSNYVTGQTL

SEQ ID NO: 705999 - protein, 24 aa, Mycobacterium
PDERGMRTVMCIINGQLRPVLVRD

SEQ ID NO: 706000 - protein, 24 aa, Mycobacterium
PDERGMRTVMCIMNGQLRPVLVRD

SEQ ID NO: 706001 - protein, 20 aa, Mycobacterium
PDERIKFMVSDAGPVAVLTT

SEQ ID NO: 706002 - protein, 21 aa, Mycobacterium
PDERIRITVVPTFVDEPRWRR

SEQ ID NO: 706003 - protein, 25 aa, Mycobacterium
PDERLGEVGRAFLVTRPGAQLDEQS

SEQ ID NO: 706004 - protein, 24 aa, Mycobacterium
PDERLGEVGRAFVVTRPGADLDEQ

SEQ ID NO: 706005 - protein, 27 aa, Mycobacterium
PDERLGEVPWAFVVRGDESVSEAGLVS

SEQ ID NO: 706006 - protein, 20 aa, Mycobacterium
PDERLKTVLNSLVEHLHAFI

SEQ ID NO: 706007 - protein, 20 aa, Mycobacterium
PDERYKLCSTVHTKIAVVRS

SEQ ID NO: 706008 - protein, 18 aa, Mycobacterium
PDESCAKDAAAVDPSAPR

SEQ ID NO: 706009 - protein, 25 aa, Mycobacterium
PDESRPPFWQDMVELGWLGLHIDER

SEQ ID NO: 706010 - protein, 24 aa, Mycobacterium
PDETALRLLANWHEGGEQGSRAAS

SEQ ID NO: 706011 - protein, 23 aa, Mycobacterium
PDETNFEYGLGCILDHASWLIEE

SEQ ID NO: 706012 - protein, 23 aa, Mycobacterium
PDETNFEYGLTCILDHASRLIDE

SEQ ID NO: 706013 - protein, 23 aa, Mycobacterium
PDETTRVALPWRHGTDAVIAELV

SEQ ID NO: 706014 - protein, 18 aa, Mycobacterium
PDEVAGVVGFLVSDAAAS

SEQ ID NO: 706015 - protein, 23 aa, Mycobacterium
PDEVHLPGIFVQRVVELSPDQAA

SEQ ID NO: 706016 - protein, 25 aa, Mycobacterium
PDEVPEFLAEYGWRLVEQAGPDELV

SEQ ID NO: 706017 - protein, 20 aa, Mycobacterium
PDEVWLRYRASVAHGLTLWL

SEQ ID NO: 706018 - protein, 17 aa, Mycobacterium
PDEWDWHGFPGARYRFD

SEQ ID NO: 706019 - protein, 17 aa, Mycobacterium
PDEYAALALSIVENQML

SEQ ID NO: 706020 - protein, 26 aa, Mycobacterium
PDEYARLLTYRVELLAHHAATIDSDV

SEQ ID NO: 706021 - protein, 23 aa, Mycobacterium
PDFADERFTRWFGRRPATAGPPA

SEQ ID NO: 706022 - protein, 20 aa, Mycobacterium
PDFAGSCYVHVQKYVHDMGS

SEQ ID NO: 706023 - protein, 20 aa, Mycobacterium
PDFAYNFLKVEWRTIQHYGV

SEQ ID NO: 706024 - protein, 20 aa, Mycobacterium
PDFGKVVGWTELPIAGGELH

SEQ ID NO: 706025 - protein, 24 aa, Mycobacterium
PDFHKHPKYLAAQGTGPWGAFDLT

SEQ ID NO: 706026 - protein, 18 aa, Mycobacterium
PDFIEGITAFFEKRPPSF

SEQ ID NO: 706027 - protein, 22 aa, Mycobacterium
PDFIICYRMSMADYVEGGQSWD

SEQ ID NO: 706028 - protein, 20 aa, Mycobacterium
PDFPIVLSVGERRAYTANDI

SEQ ID NO: 706029 - protein, 18 aa, Mycobacterium
PDFQAGRITTAFIDERPQ

SEQ ID NO: 706030 - protein, 23 aa, Mycobacterium
PDFRIPAIAQWALRIPGLTAAIE

SEQ ID NO: 706031 - protein, 20 aa, Mycobacterium
PDFRLLIDTMHVVRSGSSAA

SEQ ID NO: 706032 - protein, 19 aa, Mycobacterium
PDFRRFGGSSGVEFRNTAL

SEQ ID NO: 706033 - protein, 17 aa, Mycobacterium
PDFSGLELPAFQQMFWR

SEQ ID NO: 706034 - protein, 21 aa, Mycobacterium
PDFYAGDPYPAYRELRATAPV

SEQ ID NO: 706035 - protein, 17 aa, Mycobacterium
PDFYKLDPGDPMTLDAS

SEQ ID NO: 706036 - protein, 23 aa, Mycobacterium
PDGADAFAISPVRFDAGTAAVDS

SEQ ID NO: 706037 - protein, 24 aa, Mycobacterium
PDGADALVLPGGFPEQFTAELSAN

SEQ ID NO: 706038 - protein, 25 aa, Mycobacterium
PDGAGWRVVAALAHHAPRDSRTTTF

SEQ ID NO: 706039 - protein, 26 aa, Mycobacterium
PDGAHFECWTMLGAWAEQTSRIQIGA

SEQ ID NO: 706040 - protein, 21 aa, Mycobacterium
PDGALMRRAAYGLATVILREL

SEQ ID NO: 706041 - protein, 17 aa, Mycobacterium
PDGAPLLVSRTGYTGEL

SEQ ID NO: 706042 - protein, 22 aa, Mycobacterium
PDGDRGWHLAVVRHGQLASAGV

SEQ ID NO: 706043 - protein, 17 aa, Mycobacterium
PDGDRWIRTIVRNRNQI

SEQ ID NO: 706044 - protein, 25 aa, Mycobacterium
PDGEFSEWQRLYLFSRSDTIYGGSN

SEQ ID NO: 706045 - protein, 23 aa, Mycobacterium
PDGEIMLLMGFVNLAGELGIKLE

SEQ ID NO: 706046 - protein, 20 aa, Mycobacterium
PDGEPVEWWIADGVLSAEPI

SEQ ID NO: 706047 - protein, 23 aa, Mycobacterium
PDGERILNWRQLYDLDTLPEHLV

SEQ ID NO: 706048 - protein, 20 aa, Mycobacterium
PDGFEHKSRVLAEHCKDVGT

SEQ ID NO: 706049 - protein, 17 aa, Mycobacterium
PDGGFGWSNAGLVAGDG

SEQ ID NO: 706050 - protein, 28 aa, Mycobacterium
PDGGILARFPGFYIPFLDVPFTGATPPN

SEQ ID NO: 706051 - protein, 28 aa, Mycobacterium
PDGGLIRRVPWPLAEATYDLLVPSGKGL

SEQ ID NO: 706052 - protein, 18 aa, Mycobacterium
PDGGRGYLSKIFNDAWMS

SEQ ID NO: 706053 - protein, 18 aa, Mycobacterium
PDGGRGYLSKIFNDGWMS

SEQ ID NO: 706054 - protein, 19 aa, Mycobacterium
PDGGRGYLSKVFNDAWMSS

SEQ ID NO: 706055 - protein, 17 aa, Mycobacterium
PDGGRLPSAVWAPYGLA

SEQ ID NO: 706056 - protein, 17 aa, Mycobacterium
PDGGTCQQADGRVAYLS

SEQ ID NO: 706057 - protein, 19 aa, Mycobacterium
PDGGVTVVDWKTGEPPRGP

SEQ ID NO: 706058 - protein, 18 aa, Mycobacterium
PDGGWGSFVSDLEVVHIG

SEQ ID NO: 706059 - protein, 26 aa, Mycobacterium
PDGHWLEPLTTLAYIAGFTERVRLST

SEQ ID NO: 706060 - protein, 23 aa, Mycobacterium
PDGIPAIDLRSGFLECGKPFERA

SEQ ID NO: 706061 - protein, 24 aa, Mycobacterium
PDGIRHEIRYAGIVAELVDVSKNA

SEQ ID NO: 706062 - protein, 27 aa, Mycobacterium
PDGISFCRRRHDLPGLEFVQGDAEDLP

SEQ ID NO: 706063 - protein, 21 aa, Mycobacterium
PDGKLAWAGLSALTPDSDFDQ

SEQ ID NO: 706064 - protein, 23 aa, Mycobacterium
PDGKTCAVAFTFDVDAESPLLTT

SEQ ID NO: 706065 - protein, 26 aa, Mycobacterium
PDGLAARIVADLGISADDMYDTLGTT

SEQ ID NO: 706066 - protein, 17 aa, Mycobacterium
PDGLAITAVPARHGPAD

SEQ ID NO: 706067 - protein, 20 aa, Mycobacterium
PDGLCSATLHLPDQPGPAVV

SEQ ID NO: 706068 - protein, 19 aa, Mycobacterium
PDGLFGVVCDVTDNDAVDR

SEQ ID NO: 706069 - protein, 19 aa, Mycobacterium
PDGLGAMMQVMLRGAAPEN

SEQ ID NO: 706070 - protein, 21 aa, Mycobacterium
PDGLPSVFVYDGYPGGAGFAE

SEQ ID NO: 706071 - protein, 26 aa, Mycobacterium
PDGLTVPRPAVFFDFDGTLSEIVDDP

SEQ ID NO: 706072 - protein, 24 aa, Mycobacterium
PDGPDGPCMVGLWRARDPGELMAI

SEQ ID NO: 706073 - protein, 22 aa, Mycobacterium
PDGPESPLFWATVGGNGLTGII

SEQ ID NO: 706074 - protein, 17 aa, Mycobacterium
PDGPGWYYPPTVITDIT

SEQ ID NO: 706075 - protein, 19 aa, Mycobacterium
PDGPIPLRIYRPTDATDAS

SEQ ID NO: 706076 - protein, 24 aa, Mycobacterium
PDGPRAVIEVGLIGGRTRANLASH

SEQ ID NO: 706077 - protein, 20 aa, Mycobacterium
PDGPRLSFGIGRHDGAVGQL

SEQ ID NO: 706078 - protein, 21 aa, Mycobacterium
PDGPSLGGFVCPVTVTSADRW

SEQ ID NO: 706079 - protein, 28 aa, Mycobacterium
PDGQPRWPTFGIRLSARPGIPPTHPVHG

SEQ ID NO: 706080 - protein, 19 aa, Mycobacterium
PDGRCKSFAAAADGTVLAE

SEQ ID NO: 706081 - protein, 25 aa, Mycobacterium
PDGRHIAWVQARSDVRPVDVNVLAV

SEQ ID NO: 706082 - protein, 21 aa, Mycobacterium
PDGRLGKGILFLHVHAFARYY

SEQ ID NO: 706083 - protein, 20 aa, Mycobacterium
PDGRLVFNAFLPREGYVPDA

SEQ ID NO: 706084 - protein, 17 aa, Mycobacterium
PDGRLVHAALRINGSTV

SEQ ID NO: 706085 - protein, 20 aa, Mycobacterium
PDGRPIVGFVGRLAPEKHVE

SEQ ID NO: 706086 - protein, 17 aa, Mycobacterium
PDGRPRYVTAIDAETAT

SEQ ID NO: 706087 - protein, 29 aa, Mycobacterium
PDGRPSELGAFLRARRDAVTPEDAGLAAG

SEQ ID NO: 706088 - protein, 26 aa, Mycobacterium
PDGRRLRLLGFERVELEPGATRRVTT

SEQ ID NO: 706089 - protein, 25 aa, Mycobacterium
PDGRTLYFCDTWTGEIWCYDYDLDT

SEQ ID NO: 706090 - protein, 17 aa, Mycobacterium
PDGRYSHQLTIYIFRYG

SEQ ID NO: 706091 - protein, 18 aa, Mycobacterium
PDGSAGWAFAAATVEIIN

SEQ ID NO: 706092 - protein, 18 aa, Mycobacterium
PDGSLQHPPVPAVWQDKE

SEQ ID NO: 706093 - protein, 18 aa, Mycobacterium
PDGSLRDAGLPNVTAAQL

SEQ ID NO: 706094 - protein, 20 aa, Mycobacterium
PDGSPSWSDPRHVLRRQLAK

SEQ ID NO: 706095 - protein, 19 aa, Mycobacterium
PDGSSIVAHVERWAKVRGD

SEQ ID NO: 706096 - protein, 19 aa, Mycobacterium
PDGTAFPTLPAMKRITLNV

SEQ ID NO: 706097 - protein, 21 aa, Mycobacterium
PDGTCPVRLFTPAGPGPWPGV

SEQ ID NO: 706098 - protein, 38 aa, Mycobacterium
PDGTFKKTIRYFKLEKWMAWQRYLLRGGDMDIDTWSDY

SEQ ID NO: 706099 - protein, 24 aa, Mycobacterium
PDGTGWRWQTWHLYPTGSGGSVVY

SEQ ID NO: 706100 - protein, 21 aa, Mycobacterium
PDGTLRLALDAALSSPSGLGV

SEQ ID NO: 706101 - protein, 22 aa, Mycobacterium
PDGTLWSIPIVFDMSADEIARL

SEQ ID NO: 706102 - protein, 24 aa, Mycobacterium
PDGTRIAYLAPWQNRLNIWVENVD

SEQ ID NO: 706103 - protein, 17 aa, Mycobacterium
PDGTRVFEVDLPKVLEF

SEQ ID NO: 706104 - protein, 18 aa, Mycobacterium
PDGTRWLGISSVRVAAQA

SEQ ID NO: 706105 - protein, 20 aa, Mycobacterium
PDGTWIDRGGAWIGPGQDRI

SEQ ID NO: 706106 - protein, 25 aa, Mycobacterium
PDGVAAWLVLCCRALTAGAQEALSI

SEQ ID NO: 706107 - protein, 20 aa, Mycobacterium
PDGVGAFLAWGDPSLYDSTL

SEQ ID NO: 706108 - protein, 21 aa, Mycobacterium
PDGVLMRRAAFGLATEIGREL

SEQ ID NO: 706109 - protein, 21 aa, Mycobacterium
PDGVLMRRAAYGLATAIAAEL

SEQ ID NO: 706110 - protein, 18 aa, Mycobacterium
PDGVLVVWIDLADRRPFT

SEQ ID NO: 706111 - protein, 25 aa, Mycobacterium
PDGVRCVVQFFPSHDVYSWDAVTLA

SEQ ID NO: 706112 - protein, 24 aa, Mycobacterium
PDGVRLPENVRMASADDTIPADER

SEQ ID NO: 706113 - protein, 18 aa, Mycobacterium
PDGVVAWAGDPAAGAGIV

SEQ ID NO: 706114 - protein, 19 aa, Mycobacterium
PDGWRVVFGEADRAACLEY

SEQ ID NO: 706115 - protein, 19 aa, Mycobacterium
PDGWWKDREGAMVALVERL

SEQ ID NO: 706116 - protein, 21 aa, Mycobacterium
PDGWWKDRHGAMVALVDRLDR

SEQ ID NO: 706117 - protein, 19 aa, Mycobacterium
PDGWWKDRHGAMVALVHRL

SEQ ID NO: 706118 - protein, 21 aa, Mycobacterium
PDGWWRDRRGAMARLVAQLER

SEQ ID NO: 706119 - protein, 20 aa, Mycobacterium
PDGYLTMKINAVEALSAMLT

SEQ ID NO: 706120 - protein, 22 aa, Mycobacterium
PDGYPIVLTHGFVCSIRVWAYQ

SEQ ID NO: 706121 - protein, 19 aa, Mycobacterium
PDGYVAWAAGEFGPVAQAG

SEQ ID NO: 706122 - protein, 28 aa, Mycobacterium
PDHAVKLWRHWDHCALHWFPGSHVLHVS

SEQ ID NO: 706123 - protein, 17 aa, Mycobacterium
PDHDKGFYHAWRMLAPA

SEQ ID NO: 706124 - protein, 24 aa, Mycobacterium
PDHDVTIGLVFRARMAEPDLLPKL

SEQ ID NO: 706125 - protein, 24 aa, Mycobacterium
PDHDVTIGLVFRARMSEPELLPQL

SEQ ID NO: 706126 - protein, 19 aa, Mycobacterium
PDHELRRIAALCAAFDVDG

SEQ ID NO: 706127 - protein, 19 aa, Mycobacterium
PDHEREIFNVIGPGPTENP

SEQ ID NO: 706128 - protein, 25 aa, Mycobacterium
PDHGLPGVPGMPAGTLKRASSVVPR

SEQ ID NO: 706129 - protein, 25 aa, Mycobacterium
PDHGRAAVAWVIARTFGDYVTSKVA

SEQ ID NO: 706130 - protein, 27 aa, Mycobacterium
PDHIPPNALVCFPPPPASGSMTKASVA

SEQ ID NO: 706131 - protein, 19 aa, Mycobacterium
PDHLAGLRGIDLVRRTLEE

SEQ ID NO: 706132 - protein, 24 aa, Mycobacterium
PDHPNIRRSSGQRLLSYRHERHRY

SEQ ID NO: 706133 - protein, 28 aa, Mycobacterium
PDHQRWLGTRLPFYANWIRLKSYWGTAD

SEQ ID NO: 706134 - protein, 20 aa, Mycobacterium
PDHRYLMAISSLDPTSAGAA

SEQ ID NO: 706135 - protein, 17 aa, Mycobacterium
PDHSAPLLVSVFLDKDF

SEQ ID NO: 706136 - protein, 24 aa, Mycobacterium
PDHSEKLAAWLLERQPKVVTGEHW

SEQ ID NO: 706137 - protein, 18 aa, Mycobacterium
PDHTVGWTLVGDAAEHQW

SEQ ID NO: 706138 - protein, 22 aa, Mycobacterium
PDHVLPGAPVMPVPDKIVEVVL

SEQ ID NO: 706139 - protein, 17 aa, Mycobacterium
PDIAPWISGSSSRVIDT

SEQ ID NO: 706140 - protein, 17 aa, Mycobacterium
PDIDGLTGFAGPVLHTA

SEQ ID NO: 706141 - protein, 18 aa, Mycobacterium
PDIDRLTAALTRVRDGVQ

SEQ ID NO: 706142 - protein, 23 aa, Mycobacterium
PDIDRLTAVLGRIRDGVTFCSVC

SEQ ID NO: 706143 - protein, 17 aa, Mycobacterium
PDIEAAVLVPAKTLGEA

SEQ ID NO: 706144 - protein, 17 aa, Mycobacterium
PDIFGSVGMTGINGQYV

SEQ ID NO: 706145 - protein, 23 aa, Mycobacterium
PDIFVEFSRWRGLSADGRCKAFA

SEQ ID NO: 706146 - protein, 17 aa, Mycobacterium
PDIGGRLRAGRSRNDQV

SEQ ID NO: 706147 - protein, 18 aa, Mycobacterium
PDIGPLFYEPTVLADVTP

SEQ ID NO: 706148 - protein, 18 aa, Mycobacterium
PDIGRAILERRFSATYSA

SEQ ID NO: 706149 - protein, 19 aa, Mycobacterium
PDIKMLAPIPAGDPDKGQL

SEQ ID NO: 706150 - protein, 20 aa, Mycobacterium
PDILGQAGTAWQVFPNFQIG

SEQ ID NO: 706151 - protein, 23 aa, Mycobacterium
PDIMGRLAAIRARGGTVVVVDPR

SEQ ID NO: 706152 - protein, 17 aa, Mycobacterium
PDIPGLDSFQGAVVHTA

SEQ ID NO: 706153 - protein, 26 aa, Mycobacterium
PDIPISRIPIVLSLGSDSTSLNTAIG

SEQ ID NO: 706154 - protein, 23 aa, Mycobacterium
PDIPRVSPPVIVKYVTDLQLLGL

SEQ ID NO: 706155 - protein, 22 aa, Mycobacterium
PDIPVVVWWPDIAPAVPAQDPL

SEQ ID NO: 706156 - protein, 18 aa, Mycobacterium
PDIRIGLAELGTVYMGAH

SEQ ID NO: 706157 - protein, 20 aa, Mycobacterium
PDIRPKYLFVGMLHQHQGQR

SEQ ID NO: 706158 - protein, 17 aa, Mycobacterium
PDISGLVRAIGFRDPAK

SEQ ID NO: 706159 - protein, 19 aa, Mycobacterium
PDISGSGLIESPRKARELW

SEQ ID NO: 706160 - protein, 19 aa, Mycobacterium
PDISPRWPAMTKPVIGAIN

SEQ ID NO: 706161 - protein, 17 aa, Mycobacterium
PDITVARERLGWQPRVD

SEQ ID NO: 706162 - protein, 21 aa, Mycobacterium
PDIVEALRVMIERARAVHADQ

SEQ ID NO: 706163 - protein, 20 aa, Mycobacterium
PDIVGRLDLLLSEADRRDAR

SEQ ID NO: 706164 - protein, 30 aa, Mycobacterium
PDIVVAAGFMKILGAGFLSRFPGRVLNSHP

SEQ ID NO: 706165 - protein, 23 aa, Mycobacterium
PDKALRERVFRIYNEHIADLQER

SEQ ID NO: 706166 - protein, 23 aa, Mycobacterium
PDKDIPHVSAPVIVKYITDLELL

SEQ ID NO: 706167 - protein, 29 aa, Mycobacterium
PDKEVTSAIRWVLGRKRIRSGIRLVGTVA

SEQ ID NO: 706168 - protein, 25 aa, Mycobacterium
PDKIRTGARVHVHWADEPQGAITDI

SEQ ID NO: 706169 - protein, 20 aa, Mycobacterium
PDKLKRLVAQISEKPESVQH

SEQ ID NO: 706170 - protein, 20 aa, Mycobacterium
PDKPIIFAYHGYPWLIHRLA

SEQ ID NO: 706171 - protein, 30 aa, Mycobacterium
PDKPVHVLGHDWGSVAMWEAICDPELEHRF

SEQ ID NO: 706172 - protein, 18 aa, Mycobacterium
PDKPWFSYVCPGAGHAPH

SEQ ID NO: 706173 - protein, 21 aa, Mycobacterium
PDKRATVAYVMNKMGSGLLGS

SEQ ID NO: 706174 - protein, 17 aa, Mycobacterium
PDKRGKSARAFRALVRE

SEQ ID NO: 706175 - protein, 18 aa, Mycobacterium
PDKVAVLVSVELCSLTHK

SEQ ID NO: 706176 - protein, 18 aa, Mycobacterium
PDKVLHVTALVERTAQIV

SEQ ID NO: 706177 - protein, 17 aa, Mycobacterium
PDLACSGLRFAYDGLIP

SEQ ID NO: 706178 - protein, 23 aa, Mycobacterium
PDLAELAFRASVVVVNETEARSW

SEQ ID NO: 706179 - protein, 20 aa, Mycobacterium
PDLAEPLALLATALEVSVEV

SEQ ID NO: 706180 - protein, 19 aa, Mycobacterium
PDLAFKQLIMEAGADIAIL

SEQ ID NO: 706181 - protein, 19 aa, Mycobacterium
PDLAGAAVWGLVRSAQTEH

SEQ ID NO: 706182 - protein, 17 aa, Mycobacterium
PDLAGPVLISEDAAIGL

SEQ ID NO: 706183 - protein, 23 aa, Mycobacterium
PDLAGRGGLYLQDCGIGEAAPHA

SEQ ID NO: 706184 - protein, 20 aa, Mycobacterium
PDLAHILRVHFSVVEELQRA

SEQ ID NO: 706185 - protein, 17 aa, Mycobacterium
PDLALQGGRLHWSAVSE

SEQ ID NO: 706186 - protein, 21 aa, Mycobacterium
PDLALRPLGGAVIWANDDLFA

SEQ ID NO: 706187 - protein, 20 aa, Mycobacterium
PDLALRPLGGAVIWANDESF

SEQ ID NO: 706188 - protein, 17 aa, Mycobacterium
PDLAPPVAVQRPMTDTG

SEQ ID NO: 706189 - protein, 20 aa, Mycobacterium
PDLARCIVRMESRRHSRPAV

SEQ ID NO: 706190 - protein, 24 aa, Mycobacterium
PDLARWRHAIDVAARRWVASTGAE

SEQ ID NO: 706191 - protein, 30 aa, Mycobacterium
PDLAVRWNCKAGKCGSCSAEINGRPRLMCM

SEQ ID NO: 706192 - protein, 19 aa, Mycobacterium
PDLAYEFLPVVWRVIQHYG

SEQ ID NO: 706193 - protein, 19 aa, Mycobacterium
PDLDLVGCWVHSADKSGHD

SEQ ID NO: 706194 - protein, 17 aa, Mycobacterium
PDLDPDWGVLNPLILRI

SEQ ID NO: 706195 - protein, 24 aa, Mycobacterium
PDLDPGELIAAGWDQLHRQLDAYL

SEQ ID NO: 706196 - protein, 26 aa, Mycobacterium
PDLDRPATGLLFFLASSRILNRRKGV

SEQ ID NO: 706197 - protein, 18 aa, Mycobacterium
PDLDVAPIEAVFRKGAYC

SEQ ID NO: 706198 - protein, 19 aa, Mycobacterium
PDLELAAGVGDVATITRGG

SEQ ID NO: 706199 - protein, 18 aa, Mycobacterium
PDLELVGVRVYDAGKAGV

SEQ ID NO: 706200 - protein, 23 aa, Mycobacterium
PDLFLPLRYGRVALAERMPRRFY

SEQ ID NO: 706201 - protein, 20 aa, Mycobacterium
PDLFNRFTHDAFWRDPERIP

SEQ ID NO: 706202 - protein, 18 aa, Mycobacterium
PDLGGRLRAGRSRNDQVA

SEQ ID NO: 706203 - protein, 25 aa, Mycobacterium
PDLGIDWPLPVTMVSPRDAGAGSWS

SEQ ID NO: 706204 - protein, 19 aa, Mycobacterium
PDLGQFGVWLPTRSIEPEL

SEQ ID NO: 706205 - protein, 18 aa, Mycobacterium
PDLGRAPADLSILPNTGA

SEQ ID NO: 706206 - protein, 22 aa, Mycobacterium
PDLGRFGVWLGSRSITPGLARR

SEQ ID NO: 706207 - protein, 18 aa, Mycobacterium
PDLGRLVARIAGLHQMST

SEQ ID NO: 706208 - protein, 18 aa, Mycobacterium
PDLGRNEPCWCGSGRKYK

SEQ ID NO: 706209 - protein, 19 aa, Mycobacterium
PDLGRWCADHPELASWAQL

SEQ ID NO: 706210 - protein, 17 aa, Mycobacterium
PDLGRYGSFGRGVTPAQ

SEQ ID NO: 706211 - protein, 18 aa, Mycobacterium
PDLIETWISFKRENEILP

SEQ ID NO: 706212 - protein, 27 aa, Mycobacterium
PDLIPNMVSEIIRWQTPLAYMRRVAKK

SEQ ID NO: 706213 - protein, 21 aa, Mycobacterium
PDLIRGVFYAGWDPGGVPVKY

SEQ ID NO: 706214 - protein, 22 aa, Mycobacterium
PDLIRMATHAFHYLTIFGDDGR

SEQ ID NO: 706215 - protein, 25 aa, Mycobacterium
PDLLAGRALAGFGLTEPGAGSDAGS

SEQ ID NO: 706216 - protein, 23 aa, Mycobacterium
PDLLARWMCFMLSDAADFVCGSV

SEQ ID NO: 706217 - protein, 17 aa, Mycobacterium
PDLLDVVFLDNDDWDRL

SEQ ID NO: 706218 - protein, 22 aa, Mycobacterium
PDLLLLGALCHDIGKGRGGDHS

SEQ ID NO: 706219 - protein, 20 aa, Mycobacterium
PDLLLLGALVHDIGKGRGGD

SEQ ID NO: 706220 - protein, 22 aa, Mycobacterium
PDLLPGDGREALEHSAERGWEG

SEQ ID NO: 706221 - protein, 25 aa, Mycobacterium
PDLLPKIFYVNWFRRDSGGKFLWPG

SEQ ID NO: 706222 - protein, 23 aa, Mycobacterium
PDLLTETTRDVWLVTGRGEHVPV

SEQ ID NO: 706223 - protein, 26 aa, Mycobacterium
PDLLVFKELRIFGSLGVDYPAYQSAI

SEQ ID NO: 706224 - protein, 27 aa, Mycobacterium
PDLLVFKELRVLGSLGVDYPAYQSAIE

SEQ ID NO: 706225 - protein, 23 aa, Mycobacterium
PDLLVQEALRLGQDRSRAAQLGE

SEQ ID NO: 706226 - protein, 17 aa, Mycobacterium
PDLMPRLTKYEPAGPDA

SEQ ID NO: 706227 - protein, 19 aa, Mycobacterium
PDLMPTGAPTRFRSGWING

SEQ ID NO: 706228 - protein, 17 aa, Mycobacterium
PDLPAHSTVAMIAGMAA

SEQ ID NO: 706229 - protein, 17 aa, Mycobacterium
PDLPDWYFTAEDIADTL

SEQ ID NO: 706230 - protein, 29 aa, Mycobacterium
PDLPGWLRRRRPAHAIDLLRAALGDVAGE

SEQ ID NO: 706231 - protein, 21 aa, Mycobacterium
PDLPLACVLEGGTWAAGRALA

SEQ ID NO: 706232 - protein, 21 aa, Mycobacterium
PDLPPEAVLGVLAHSHSVIAE

SEQ ID NO: 706233 - protein, 17 aa, Mycobacterium
PDLPPSHHYLAAYRWLD

SEQ ID NO: 706234 - protein, 24 aa, Mycobacterium
PDLPSNRLSAVSVRVRELCDKYDL

SEQ ID NO: 706235 - protein, 21 aa, Mycobacterium
PDLPSRLAALRGPVSAVLATP

SEQ ID NO: 706236 - protein, 25 aa, Mycobacterium
PDLPYDEAEKFFLARLDEWDDVIAA

SEQ ID NO: 706237 - protein, 25 aa, Mycobacterium
PDLQICVAEFPLSSPENAARYGLPA

SEQ ID NO: 706238 - protein, 29 aa, Mycobacterium
PDLQKARKVCARIREDARDVAVILDVTVS

SEQ ID NO: 706239 - protein, 21 aa, Mycobacterium
PDLQLWVGACLYKGGVDIYRM

SEQ ID NO: 706240 - protein, 19 aa, Mycobacterium
PDLQPGSSIMPGKVNPVIP

SEQ ID NO: 706241 - protein, 18 aa, Mycobacterium
PDLRGCVGGGAPITAELG

SEQ ID NO: 706242 - protein, 21 aa, Mycobacterium
PDLRGVFAGMHLGHTRADMYR

SEQ ID NO: 706243 - protein, 22 aa, Mycobacterium
PDLRIPFDPREVIARIVDGSEF

SEQ ID NO: 706244 - protein, 17 aa, Mycobacterium
PDLRLAAMGGPEDVIAG

SEQ ID NO: 706245 - protein, 20 aa, Mycobacterium
PDLRLLGALPTLYDSRTTHT

SEQ ID NO: 706246 - protein, 21 aa, Mycobacterium
PDLRPISAPQRLRSGWLNGIK

SEQ ID NO: 706247 - protein, 17 aa, Mycobacterium
PDLRPVAGVAEWQLTAT

SEQ ID NO: 706248 - protein, 17 aa, Mycobacterium
PDLRQLVLRDGSGTITT

SEQ ID NO: 706249 - protein, 33 aa, Mycobacterium
PDLRREVHNAARRARVASRVLALLPTVAKDQAL

SEQ ID NO: 706250 - protein, 17 aa, Mycobacterium
PDLRRLEAAIVAQDSAL

SEQ ID NO: 706251 - protein, 18 aa, Mycobacterium
PDLSCARAVVVGNGNVAV

SEQ ID NO: 706252 - protein, 17 aa, Mycobacterium
PDLSGVLVIGVSQSGGS

SEQ ID NO: 706253 - protein, 22 aa, Mycobacterium
PDLSKQLVIWNFGGLKLPTVTQ

SEQ ID NO: 706254 - protein, 25 aa, Mycobacterium
PDLTAGRALAGFGLTEPGAGSDAGS

SEQ ID NO: 706255 - protein, 18 aa, Mycobacterium
PDLTKLGLIPADGIMLLA

SEQ ID NO: 706256 - protein, 19 aa, Mycobacterium
PDLTLGPFLRPLYAAPGVQ

SEQ ID NO: 706257 - protein, 20 aa, Mycobacterium
PDLTPALSSMVFVVRPPTAT

SEQ ID NO: 706258 - protein, 25 aa, Mycobacterium
PDLTSSSFARYLADYIHEQGWQTYG

SEQ ID NO: 706259 - protein, 23 aa, Mycobacterium
PDLTTWLTQWDIRGTAPSPEAIE

SEQ ID NO: 706260 - protein, 18 aa, Mycobacterium
PDLVAALDELEELSCQLP

SEQ ID NO: 706261 - protein, 18 aa, Mycobacterium
PDLVCDFWTELGRNLTAR

SEQ ID NO: 706262 - protein, 19 aa, Mycobacterium
PDLVFAEAASLGLDIELET

SEQ ID NO: 706263 - protein, 18 aa, Mycobacterium
PDLVKPIVPSGDCRVMTK

SEQ ID NO: 706264 - protein, 17 aa, Mycobacterium
PDLVLPVHFDLSDPTTA

SEQ ID NO: 706265 - protein, 27 aa, Mycobacterium
PDLVMARHPVKWGLGFGLPEPTTLPYI

SEQ ID NO: 706266 - protein, 20 aa, Mycobacterium
PDLVRRVFPTAIRIDSGGAV

SEQ ID NO: 706267 - protein, 31 aa, Mycobacterium
PDLVVSAGFMKILGPQFLSRFYGRVINTHPA

SEQ ID NO: 706268 - protein, 17 aa, Mycobacterium
PDLWLRAISDYRITFTG

SEQ ID NO: 706269 - protein, 21 aa, Mycobacterium
PDMADRVAALAAHATPERLLR

SEQ ID NO: 706270 - protein, 20 aa, Mycobacterium
PDMAEFLVRAGIDSVSLNPD

SEQ ID NO: 706271 - protein, 23 aa, Mycobacterium
PDMAEFLVRCGIDSISLNPDVVV

SEQ ID NO: 706272 - protein, 19 aa, Mycobacterium
PDMFTRLMLSLVATGIAPG

SEQ ID NO: 706273 - protein, 19 aa, Mycobacterium
PDMFTRMMLSLVATGIAPG

SEQ ID NO: 706274 - protein, 24 aa, Mycobacterium
PDMGELICAAIVFAGPPQTPQTLS

SEQ ID NO: 706275 - protein, 21 aa, Mycobacterium
PDMHDFWSDEFIRDFFKNFIR

SEQ ID NO: 706276 - protein, 17 aa, Mycobacterium
PDMKIVTCHLGGALPMV

SEQ ID NO: 706277 - protein, 21 aa, Mycobacterium
PDMKLEMPLIDFFSRGGSLKS

SEQ ID NO: 706278 - protein, 23 aa, Mycobacterium
PDMLTAITGRWTTGSARTATEVH

SEQ ID NO: 706279 - protein, 22 aa, Mycobacterium
PDMPAKPGPPVADISTGLYAAL

SEQ ID NO: 706280 - protein, 19 aa, Mycobacterium
PDMPLGLEHICLRRINWLP

SEQ ID NO: 706281 - protein, 26 aa, Mycobacterium
PDMPQIRVGLAYGQVLSRFGDLYGTV

SEQ ID NO: 706282 - protein, 23 aa, Mycobacterium
PDMVKRRRGHIINIASLSGVIPL

SEQ ID NO: 706283 - protein, 19 aa, Mycobacterium
PDNELRRIAALCAAFDVDG

SEQ ID NO: 706284 - protein, 30 aa, Mycobacterium
PDNGAAFWRELCAATAPSLAGTRYSVLALG

SEQ ID NO: 706285 - protein, 20 aa, Mycobacterium
PDNILCLDVRRGIEQTSAHE

SEQ ID NO: 706286 - protein, 19 aa, Mycobacterium
PDNKGNWIGNLLKDIGAAL

SEQ ID NO: 706287 - protein, 18 aa, Mycobacterium
PDNPEHVMYVWVDALTNY

SEQ ID NO: 706288 - protein, 18 aa, Mycobacterium
PDNPVLFTRMSDAQYQTV

SEQ ID NO: 706289 - protein, 24 aa, Mycobacterium
PDNQWLRVWEIPGAAHADNYTIQV

SEQ ID NO: 706290 - protein, 22 aa, Mycobacterium
PDNRAWRLARALGLSDDTTGDQ

SEQ ID NO: 706291 - protein, 25 aa, Mycobacterium
PDNRVRRYVCLSGPDQGGCGRLTVV

SEQ ID NO: 706292 - protein, 17 aa, Mycobacterium
PDNSAALRAEVAARPKM

SEQ ID NO: 706293 - protein, 20 aa, Mycobacterium
PDNTGLDWPALGAVDYLYVS

SEQ ID NO: 706294 - protein, 17 aa, Mycobacterium
PDPAAAMAAWRSALNDA

SEQ ID NO: 706295 - protein, 18 aa, Mycobacterium
PDPAAKRPLFTDFAPRLL

SEQ ID NO: 706296 - protein, 20 aa, Mycobacterium
PDPACARGTLGRVEAALAEA

SEQ ID NO: 706297 - protein, 17 aa, Mycobacterium
PDPALLMQGMWVQFRAV

SEQ ID NO: 706298 - protein, 19 aa, Mycobacterium
PDPALYIRALVRFVEGAQE

SEQ ID NO: 706299 - protein, 19 aa, Mycobacterium
PDPARMAAFLGRHPETVAA

SEQ ID NO: 706300 - protein, 18 aa, Mycobacterium
PDPASFTPIPFIKEGLAL

SEQ ID NO: 706301 - protein, 21 aa, Mycobacterium
PDPAWWTARGFVVVNADSRGC

SEQ ID NO: 706302 - protein, 19 aa, Mycobacterium
PDPCHRCGGDGRVRARRDI

SEQ ID NO: 706303 - protein, 25 aa, Mycobacterium
PDPDHLVHLQFRRFAGCPICNLHLR

SEQ ID NO: 706304 - protein, 18 aa, Mycobacterium
PDPDLLLLFSALELLHAW

SEQ ID NO: 706305 - protein, 27 aa, Mycobacterium
PDPDRLGCVYTRGGGFLSGVADFDAGF

SEQ ID NO: 706306 - protein, 32 aa, Mycobacterium
PDPDRLNVELPFPCVWVAPWSPDAAIEPLRHS

SEQ ID NO: 706307 - protein, 25 aa, Mycobacterium
PDPDSRAAVCLRFANDVLAELDTRK

SEQ ID NO: 706308 - protein, 19 aa, Mycobacterium
PDPDWWFDDDRIYGPSGIS

SEQ ID NO: 706309 - protein, 25 aa, Mycobacterium
PDPECVEGWGAPALEKERVKPKPSG

SEQ ID NO: 706310 - protein, 23 aa, Mycobacterium
PDPEGRFDYRWHDGARWTDQVSH

SEQ ID NO: 706311 - protein, 23 aa, Mycobacterium
PDPEGYIEFHVRAVPGGLVSGDI

SEQ ID NO: 706312 - protein, 18 aa, Mycobacterium
PDPEPAFAASPAVPAGIA

SEQ ID NO: 706313 - protein, 19 aa, Mycobacterium
PDPERPHRSAVLAESLTSP

SEQ ID NO: 706314 - protein, 23 aa, Mycobacterium
PDPESFTPIPFIKEGLAIVHCDP

SEQ ID NO: 706315 - protein, 25 aa, Mycobacterium
PDPEVVRALDMLFILHADHEQNCST

SEQ ID NO: 706316 - protein, 19 aa, Mycobacterium
PDPFCEIESSLLRHLTTDH

SEQ ID NO: 706317 - protein, 23 aa, Mycobacterium
PDPFRWDCFRFGIVQSSGHFTFY

SEQ ID NO: 706318 - protein, 17 aa, Mycobacterium
PDPGDLSFIMVGAPNNP

SEQ ID NO: 706319 - protein, 27 aa, Mycobacterium
PDPGHAFPALALCLKFAAAGDDPVLLT

SEQ ID NO: 706320 - protein, 26 aa, Mycobacterium
PDPGHAFPALALCLKFLAAGDQPTLL

SEQ ID NO: 706321 - protein, 21 aa, Mycobacterium
PDPGIRRAILVAASMSVREHG

SEQ ID NO: 706322 - protein, 22 aa, Mycobacterium
PDPGIRRAILVAASMSVREHGV

SEQ ID NO: 706323 - protein, 18 aa, Mycobacterium
PDPGQARDLAFVMFSGAG

SEQ ID NO: 706324 - protein, 20 aa, Mycobacterium
PDPHAGEIPVAYVTVAANTQ

SEQ ID NO: 706325 - protein, 23 aa, Mycobacterium
PDPHSCLSSFSWTKDKLILVTLR

SEQ ID NO: 706326 - protein, 24 aa, Mycobacterium
PDPHTPWNATRLGRLIAEKTDFPP

SEQ ID NO: 706327 - protein, 17 aa, Mycobacterium
PDPIVIVGMAIEAPGGV

SEQ ID NO: 706328 - protein, 32 aa, Mycobacterium
PDPKKRLRTVEAWEVLPDFASVNWHEPGSPEL

SEQ ID NO: 706329 - protein, 23 aa, Mycobacterium
PDPKRLEPYTALIADELNVKSVE

SEQ ID NO: 706330 - protein, 19 aa, Mycobacterium
PDPKYAPGYLNEFGGHFEI

SEQ ID NO: 706331 - protein, 20 aa, Mycobacterium
PDPKYPAGYLNEFGGHFQIT

SEQ ID NO: 706332 - protein, 17 aa, Mycobacterium
PDPLALRRAQRKSSQLT

SEQ ID NO: 706333 - protein, 19 aa, Mycobacterium
PDPLHLSLVFGISHNTARR

SEQ ID NO: 706334 - protein, 23 aa, Mycobacterium
PDPLVPRPAATVMLVRDTPEGIK

SEQ ID NO: 706335 - protein, 23 aa, Mycobacterium
PDPLWKLNLAVMQRFLTFMTVAL

SEQ ID NO: 706336 - protein, 18 aa, Mycobacterium
PDPLYCAGARVVSQHPVN

SEQ ID NO: 706337 - protein, 25 aa, Mycobacterium
PDPMPTRLLKFHAPEIVFGIDSMAE

SEQ ID NO: 706338 - protein, 24 aa, Mycobacterium
PDPMSRSLAERWQVGVAKLLEQQY

SEQ ID NO: 706339 - protein, 20 aa, Mycobacterium
PDPNLNLPVVLGGNMMQYNW

SEQ ID NO: 706340 - protein, 24 aa, Mycobacterium
PDPNTPWNATRLGRLIVERTDMPP

SEQ ID NO: 706341 - protein, 18 aa, Mycobacterium
PDPPLTLPNDPGWPEGSS

SEQ ID NO: 706342 - protein, 25 aa, Mycobacterium
PDPQFRPAELNKRVGTVEMFTATTA

SEQ ID NO: 706343 - protein, 21 aa, Mycobacterium
PDPQMSLPITLGGTMAKYDWT

SEQ ID NO: 706344 - protein, 24 aa, Mycobacterium
PDPQWPGGALIAVQFVLNYEEGAE

SEQ ID NO: 706345 - protein, 23 aa, Mycobacterium
PDPRAADIVETWARVLDQLERDP

SEQ ID NO: 706346 - protein, 20 aa, Mycobacterium
PDPRASDIVETWTHVLDLLE

SEQ ID NO: 706347 - protein, 25 aa, Mycobacterium
PDPRASHVVETWADVLDRLERDPMD

SEQ ID NO: 706348 - protein, 19 aa, Mycobacterium
PDPRGGYPPEQGGYPPQQG

SEQ ID NO: 706349 - protein, 22 aa, Mycobacterium
PDPRTLAALEMTFFGALVNAGS

SEQ ID NO: 706350 - protein, 18 aa, Mycobacterium
PDPSAKRPLFTDFAPRLL

SEQ ID NO: 706351 - protein, 20 aa, Mycobacterium
PDPTPAVLVHGDFRMGNLIV

SEQ ID NO: 706352 - protein, 18 aa, Mycobacterium
PDPTVLGDAVFYLMEPVE

SEQ ID NO: 706353 - protein, 20 aa, Mycobacterium
PDPVGEVLRGYTLPNGLQLR

SEQ ID NO: 706354 - protein, 18 aa, Mycobacterium
PDPVPAVFFGGSSGSAGP

SEQ ID NO: 706355 - protein, 24 aa, Mycobacterium
PDPVVTPAICADVVNEDKKNDKLD

SEQ ID NO: 706356 - protein, 17 aa, Mycobacterium
PDPWAIGALPGLTPTAA

SEQ ID NO: 706357 - protein, 18 aa, Mycobacterium
PDPWAVRILPRRWRVPAV

SEQ ID NO: 706358 - protein, 18 aa, Mycobacterium
PDPWPKARHHKRRFLQPG

SEQ ID NO: 706359 - protein, 17 aa, Mycobacterium
PDPWPKARHHKRRLLQP

SEQ ID NO: 706360 - protein, 18 aa, Mycobacterium
PDPWPKARHHKRRLLQPD

SEQ ID NO: 706361 - protein, 26 aa, Mycobacterium
PDPWTTRPGFPWPGRPAPLHPNAAGM

SEQ ID NO: 706362 - protein, 21 aa, Mycobacterium
PDPYLRAAALLGVEPRDCLAI

SEQ ID NO: 706363 - protein, 19 aa, Mycobacterium
PDPYLRAAELLALDPSDCL

SEQ ID NO: 706364 - protein, 31 aa, Mycobacterium
PDPYLRAAELLGVPVARCLAVEDSVTGTTAA

SEQ ID NO: 706365 - protein, 18 aa, Mycobacterium
PDPYLTPGLTELSSQAGF

SEQ ID NO: 706366 - protein, 19 aa, Mycobacterium
PDPYLTPGLTELSSQAGFD

SEQ ID NO: 706367 - protein, 17 aa, Mycobacterium
PDQFDWLATRLEIARKL

SEQ ID NO: 706368 - protein, 18 aa, Mycobacterium
PDQFLPFSHFGHGILTWH

SEQ ID NO: 706369 - protein, 19 aa, Mycobacterium
PDQHLAAKLAELFRTKRFR

SEQ ID NO: 706370 - protein, 18 aa, Mycobacterium
PDQIGVGVFNVVTGFTNH

SEQ ID NO: 706371 - protein, 20 aa, Mycobacterium
PDQLARLAGRLMDCLNPDGR

SEQ ID NO: 706372 - protein, 25 aa, Mycobacterium
PDQLLAYNCSPSFNWKKHLDDATIA

SEQ ID NO: 706373 - protein, 25 aa, Mycobacterium
PDQLLSYNCSPSFNWKQHLDDSTIA

SEQ ID NO: 706374 - protein, 19 aa, Mycobacterium
PDQLVALPTPSTPGLTNTG

SEQ ID NO: 706375 - protein, 23 aa, Mycobacterium
PDQMPDLRPIAGAALAASAAFMR

SEQ ID NO: 706376 - protein, 18 aa, Mycobacterium
PDQPAVNNFEGWTALASW

SEQ ID NO: 706377 - protein, 23 aa, Mycobacterium
PDQRAAPLVPIYLGDDITDEDAF

SEQ ID NO: 706378 - protein, 24 aa, Mycobacterium
PDQRLGEVGRAFVVPRPGANLDEA

SEQ ID NO: 706379 - protein, 24 aa, Mycobacterium
PDQSGMYELEFPAPQLSSSDGRGP

SEQ ID NO: 706380 - protein, 17 aa, Mycobacterium
PDQSRRLLVLAAAEPLG

SEQ ID NO: 706381 - protein, 23 aa, Mycobacterium
PDQWRRLAADPSLMPTAVEEMLR

SEQ ID NO: 706382 - protein, 17 aa, Mycobacterium
PDRAAEMVVEIRQVLGL

SEQ ID NO: 706383 - protein, 22 aa, Mycobacterium
PDRALWRLDLFTAEDTAWLTRM

SEQ ID NO: 706384 - protein, 18 aa, Mycobacterium
PDRCIAGACIAQLAPELS

SEQ ID NO: 706385 - protein, 17 aa, Mycobacterium
PDRCIAGADIAQRAPEL

SEQ ID NO: 706386 - protein, 24 aa, Mycobacterium
PDRDAPGVVAAWMQAGGQLATTEI

SEQ ID NO: 706387 - protein, 24 aa, Mycobacterium
PDRDAPRVIAAWLLAGGQLASDQI

SEQ ID NO: 706388 - protein, 17 aa, Mycobacterium
PDRDLCAQREVVDAFFA

SEQ ID NO: 706389 - protein, 19 aa, Mycobacterium
PDRDWDGSRICVGGQSAGG

SEQ ID NO: 706390 - protein, 33 aa, Mycobacterium
PDRERPRVSALIAIDRVHGWGAQKNNDQPDGRP

SEQ ID NO: 706391 - protein, 19 aa, Mycobacterium
PDRFIPFAGADVMSGTSGL

SEQ ID NO: 706392 - protein, 21 aa, Mycobacterium
PDRFPGAITAPVAPRASVSAY

SEQ ID NO: 706393 - protein, 18 aa, Mycobacterium
PDRFPGVIGAPVVPPVRA

SEQ ID NO: 706394 - protein, 18 aa, Mycobacterium
PDRFPRPTRSWHVTFDAA

SEQ ID NO: 706395 - protein, 17 aa, Mycobacterium
PDRFRVMGPDETASNRL

SEQ ID NO: 706396 - protein, 18 aa, Mycobacterium
PDRHEIFDVNAIRADFPI

SEQ ID NO: 706397 - protein, 19 aa, Mycobacterium
PDRHPPLLFFMNVPDPKTA

SEQ ID NO: 706398 - protein, 19 aa, Mycobacterium
PDRHRYAADNMWTCASADE

SEQ ID NO: 706399 - protein, 17 aa, Mycobacterium
PDRIAHILADAQPRLVI

SEQ ID NO: 706400 - protein, 18 aa, Mycobacterium
PDRIDSLIAGPGRDVRGL

SEQ ID NO: 706401 - protein, 18 aa, Mycobacterium
PDRIRIEAAWTKLCGVCP

SEQ ID NO: 706402 - protein, 21 aa, Mycobacterium
PDRISQLWAALIEMISAGVLR

SEQ ID NO: 706403 - protein, 30 aa, Mycobacterium
PDRKDVAALLRWLADGHFVLLGYQRCPVRD

SEQ ID NO: 706404 - protein, 21 aa, Mycobacterium
PDRLAKMGGVFDTVGTHGQVI

SEQ ID NO: 706405 - protein, 20 aa, Mycobacterium
PDRLPGVGVSSRIPALPEMG

SEQ ID NO: 706406 - protein, 23 aa, Mycobacterium
PDRLRGTINVVLPVPGDVRGLSA

SEQ ID NO: 706407 - protein, 21 aa, Mycobacterium
PDRLTTPLIRRDGQLRPCDWD

SEQ ID NO: 706408 - protein, 18 aa, Mycobacterium
PDRMSSRILGMGDVLSLI

SEQ ID NO: 706409 - protein, 18 aa, Mycobacterium
PDRNLALELVRVTEAGAM

SEQ ID NO: 706410 - protein, 20 aa, Mycobacterium
PDRNLFMPMAFHLGYHSLPI

SEQ ID NO: 706411 - protein, 19 aa, Mycobacterium
PDRPVIFAYHGYPWLIHRL

SEQ ID NO: 706412 - protein, 18 aa, Mycobacterium
PDRPVIVFAGDGAMQMNG

SEQ ID NO: 706413 - protein, 26 aa, Mycobacterium
PDRPVPRLLAAGLLRRIDDDTVILPR

SEQ ID NO: 706414 - protein, 26 aa, Mycobacterium
PDRPVPRLLAAGLLRRLDEDTVILPR

SEQ ID NO: 706415 - protein, 19 aa, Mycobacterium
PDRQLPSEGMTRGAIQVPP

SEQ ID NO: 706416 - protein, 23 aa, Mycobacterium
PDRQRLENVVIRFAGDSGDGMQL

SEQ ID NO: 706417 - protein, 19 aa, Mycobacterium
PDRRACEIVAQLYRRLHVP

SEQ ID NO: 706418 - protein, 18 aa, Mycobacterium
PDRRDWRLVREVLVAETD

SEQ ID NO: 706419 - protein, 22 aa, Mycobacterium
PDRRVRIVSQLVWPGRSADECL

SEQ ID NO: 706420 - protein, 23 aa, Mycobacterium
PDRTSAPILRRVFGDRIPASVPS

SEQ ID NO: 706421 - protein, 24 aa, Mycobacterium
PDRVDTVLRAKVDAAWNLHELTRD

SEQ ID NO: 706422 - protein, 19 aa, Mycobacterium
PDRVFRLPENVSFEAGAGL

SEQ ID NO: 706423 - protein, 19 aa, Mycobacterium
PDRVLPDKVRASFADMARV

SEQ ID NO: 706424 - protein, 19 aa, Mycobacterium
PDRVVFTWDIGPTWQPETD

SEQ ID NO: 706425 - protein, 21 aa, Mycobacterium
PDSAADRFAPRPAAGLEPIRA

SEQ ID NO: 706426 - protein, 18 aa, Mycobacterium
PDSADWLHRLRIVGIDLR

SEQ ID NO: 706427 - protein, 22 aa, Mycobacterium
PDSAKRLRIIGQIQDLMARDYI

SEQ ID NO: 706428 - protein, 19 aa, Mycobacterium
PDSALPPLEFVEVATGPMV

SEQ ID NO: 706429 - protein, 25 aa, Mycobacterium
PDSARARNVLAFKLNPLVIKELPLP

SEQ ID NO: 706430 - protein, 25 aa, Mycobacterium
PDSARWRIGDDVAHPELGHGWVQGA

SEQ ID NO: 706431 - protein, 20 aa, Mycobacterium
PDSGAAWLLPRLIGLVRTRQ

SEQ ID NO: 706432 - protein, 23 aa, Mycobacterium
PDSGATWLLPRLAGVARAKRMLL

SEQ ID NO: 706433 - protein, 25 aa, Mycobacterium
PDSGATWLLPRLVGLARARRMLLLG

SEQ ID NO: 706434 - protein, 23 aa, Mycobacterium
PDSGSTWLVPRLVGLARARRMLL

SEQ ID NO: 706435 - protein, 26 aa, Mycobacterium
PDSGWIRTWLDTVLELPWNITTEDSA

SEQ ID NO: 706436 - protein, 20 aa, Mycobacterium
PDSGYVYRTAWRVATGDIGS

SEQ ID NO: 706437 - protein, 22 aa, Mycobacterium
PDSHLPDVRRLAADLRIAGAEL

SEQ ID NO: 706438 - protein, 23 aa, Mycobacterium
PDSILRALAMNRFAKSPILVGGQ

SEQ ID NO: 706439 - protein, 17 aa, Mycobacterium
PDSLIIMLGGWKQYTGN

SEQ ID NO: 706440 - protein, 23 aa, Mycobacterium
PDSLLRRLKQYSGRLATEAVSAM

SEQ ID NO: 706441 - protein, 18 aa, Mycobacterium
PDSLTWKIFGDWRGLLQG

SEQ ID NO: 706442 - protein, 23 aa, Mycobacterium
PDSPRPRGFWAIGAHRDVVDISR

SEQ ID NO: 706443 - protein, 17 aa, Mycobacterium
PDSPWLADTWRDRFEQM

SEQ ID NO: 706444 - protein, 22 aa, Mycobacterium
PDSRAPLLAILRGAATHEESTT

SEQ ID NO: 706445 - protein, 21 aa, Mycobacterium
PDSRASLLGILRGAATHDESA

SEQ ID NO: 706446 - protein, 24 aa, Mycobacterium
PDSSGNPYLAFAAMLMAGIDGIKK

SEQ ID NO: 706447 - protein, 25 aa, Mycobacterium
PDSSGNPYLAFAAMLMAGIDGIKKK

SEQ ID NO: 706448 - protein, 25 aa, Mycobacterium
PDSSGNPYLAFAAMLMAGIDGIKNK

SEQ ID NO: 706449 - protein, 24 aa, Mycobacterium
PDSSGNPYLAFAAMLMAGLDGIKN

SEQ ID NO: 706450 - protein, 19 aa, Mycobacterium
PDSTLSFFRRALELRKRRV

SEQ ID NO: 706451 - protein, 19 aa, Mycobacterium
PDSTLSFFRRALQLRREHD

SEQ ID NO: 706452 - protein, 17 aa, Mycobacterium
PDSTVMVPFDIDADVSM

SEQ ID NO: 706453 - protein, 18 aa, Mycobacterium
PDSVADLLALREGATSVL

SEQ ID NO: 706454 - protein, 19 aa, Mycobacterium
PDSWQCGLLTDGITEHRLA

SEQ ID NO: 706455 - protein, 20 aa, Mycobacterium
PDSYLAYGFAVHNCTAPIYK

SEQ ID NO: 706456 - protein, 30 aa, Mycobacterium
PDTAFLELCPFAAWGTKFPVGGSVVVGIGI

SEQ ID NO: 706457 - protein, 21 aa, Mycobacterium
PDTANGIPVFLSEDSKEGPKA

SEQ ID NO: 706458 - protein, 21 aa, Mycobacterium
PDTANGIPVFLSEDSKEGPRA

SEQ ID NO: 706459 - protein, 19 aa, Mycobacterium
PDTARACHVRTTLEVAERV

SEQ ID NO: 706460 - protein, 17 aa, Mycobacterium
PDTATAEDVASSWQRLV

SEQ ID NO: 706461 - protein, 18 aa, Mycobacterium
PDTCAIVNPARLVFELAR

SEQ ID NO: 706462 - protein, 18 aa, Mycobacterium
PDTEFFWNGLRENKLLIQ

SEQ ID NO: 706463 - protein, 24 aa, Mycobacterium
PDTEIGRLVPFVEWLRDAYPEQVI

SEQ ID NO: 706464 - protein, 19 aa, Mycobacterium
PDTEIKAALQALPEEFRMA

SEQ ID NO: 706465 - protein, 20 aa, Mycobacterium
PDTFRLGAVGDGWRVAMTTL

SEQ ID NO: 706466 - protein, 24 aa, Mycobacterium
PDTFTGRLPHRFADRAPHVVDTDD

SEQ ID NO: 706467 - protein, 17 aa, Mycobacterium
PDTFVAPIAKAPVVLVV

SEQ ID NO: 706468 - protein, 17 aa, Mycobacterium
PDTFWSGVDKIVADLTP

SEQ ID NO: 706469 - protein, 18 aa, Mycobacterium
PDTGFVAVIHRWASTGDL

SEQ ID NO: 706470 - protein, 18 aa, Mycobacterium
PDTHLPRARLRLRQVDHL

SEQ ID NO: 706471 - protein, 19 aa, Mycobacterium
PDTKLIVMIGEIGGDAEER

SEQ ID NO: 706472 - protein, 20 aa, Mycobacterium
PDTKLIVMIGEIGGDAEERA

SEQ ID NO: 706473 - protein, 18 aa, Mycobacterium
PDTKNPLYADAMKRSDEA

SEQ ID NO: 706474 - protein, 28 aa, Mycobacterium
PDTKVAPAYRSSVSMSISASAATSSVRE

SEQ ID NO: 706475 - protein, 18 aa, Mycobacterium
PDTLLGWLQSDIGADRVR

SEQ ID NO: 706476 - protein, 18 aa, Mycobacterium
PDTLLGWLQSDLAANQVR

SEQ ID NO: 706477 - protein, 20 aa, Mycobacterium
PDTLRSRRTWTLMERTEIEA

SEQ ID NO: 706478 - protein, 21 aa, Mycobacterium
PDTNTAVAIGARMLHEQIMSA

SEQ ID NO: 706479 - protein, 28 aa, Mycobacterium
PDTPEIAQFQWRTKVYWVNGTHSRSSVD

SEQ ID NO: 706480 - protein, 23 aa, Mycobacterium
PDTPEVRGDLAAFYGSIATADAA

SEQ ID NO: 706481 - protein, 19 aa, Mycobacterium
PDTPRSVLRSLSLHASTDP

SEQ ID NO: 706482 - protein, 23 aa, Mycobacterium
PDTRARHAVLMVHGFTDYFFNTE

SEQ ID NO: 706483 - protein, 25 aa, Mycobacterium
PDTRAVHALYECCGSVTWARKVAAT

SEQ ID NO: 706484 - protein, 23 aa, Mycobacterium
PDTRWHPVSDLPPMAFDHGPMVE

SEQ ID NO: 706485 - protein, 28 aa, Mycobacterium
PDTYHWAAWRLGKPVIDHWWQTETGWAI

SEQ ID NO: 706486 - protein, 24 aa, Mycobacterium
PDTYRGRGIGIMRGLMQDVTIAHD

SEQ ID NO: 706487 - protein, 18 aa, Mycobacterium
PDTYTAFQSRADRVKDDL

SEQ ID NO: 706488 - protein, 18 aa, Mycobacterium
PDVAELLPELTLAQKWDL

SEQ ID NO: 706489 - protein, 22 aa, Mycobacterium
PDVAKGGWIGEFQKGTITWLNQ

SEQ ID NO: 706490 - protein, 19 aa, Mycobacterium
PDVAKLYYFHEIVRVTPRM

SEQ ID NO: 706491 - protein, 25 aa, Mycobacterium
PDVALDTAMRVFWRSGYAHTSTEDL

SEQ ID NO: 706492 - protein, 17 aa, Mycobacterium
PDVAPLVELLSGPVGRV

SEQ ID NO: 706493 - protein, 25 aa, Mycobacterium
PDVARIAVLLSPWMEPEPVCVALTR

SEQ ID NO: 706494 - protein, 28 aa, Mycobacterium
PDVCAPPYRAVIEYRKPIKFGEDVVITW

SEQ ID NO: 706495 - protein, 25 aa, Mycobacterium
PDVDAAAFTRAWRADYFERVSSLTQ

SEQ ID NO: 706496 - protein, 18 aa, Mycobacterium
PDVDARILLDMIGGTVMM

SEQ ID NO: 706497 - protein, 21 aa, Mycobacterium
PDVDARPALVVATPGAEPRAA

SEQ ID NO: 706498 - protein, 19 aa, Mycobacterium
PDVDFRSIVQWLHAATLFL

SEQ ID NO: 706499 - protein, 18 aa, Mycobacterium
PDVDGFDSAVWAYFGEAE

SEQ ID NO: 706500 - protein, 20 aa, Mycobacterium
PDVDGRLSLPPNQVGRQQAI

SEQ ID NO: 706501 - protein, 17 aa, Mycobacterium
PDVFYWAHATFFVGTIH

SEQ ID NO: 706502 - protein, 18 aa, Mycobacterium
PDVFYWAHATFFVGTLHV

SEQ ID NO: 706503 - protein, 22 aa, Mycobacterium
PDVGMPVCRTGFTTGDACGSVT

SEQ ID NO: 706504 - protein, 32 aa, Mycobacterium
PDVHASLPVMVWIPGGAFVFGAGQLELYSGAR

SEQ ID NO: 706505 - protein, 20 aa, Mycobacterium
PDVHCVLIRSSGRHFCTGGN

SEQ ID NO: 706506 - protein, 19 aa, Mycobacterium
PDVHSGEVPVVYLVLREGA

SEQ ID NO: 706507 - protein, 32 aa, Mycobacterium
PDVIAHGMLTMGLGAGFFSAWSGDPGAVTRYA

SEQ ID NO: 706508 - protein, 27 aa, Mycobacterium
PDVIAHGMLTMGLGAGFLSAWSGDPGA

SEQ ID NO: 706509 - protein, 25 aa, Mycobacterium
PDVIAHGMLTMGLGAGFVSAWSGDP

SEQ ID NO: 706510 - protein, 19 aa, Mycobacterium
PDVIDGAWAPVPHSPDDSG

SEQ ID NO: 706511 - protein, 17 aa, Mycobacterium
PDVIIGRYIPNLVPRLF

SEQ ID NO: 706512 - protein, 17 aa, Mycobacterium
PDVIIGRYIPNLVPRPF

SEQ ID NO: 706513 - protein, 17 aa, Mycobacterium
PDVLTAWMDASVVDEND

SEQ ID NO: 706514 - protein, 18 aa, Mycobacterium
PDVLVAMNPAALKANIGD

SEQ ID NO: 706515 - protein, 18 aa, Mycobacterium
PDVMAQVVGFHLNRGVLA

SEQ ID NO: 706516 - protein, 24 aa, Mycobacterium
PDVMLGIVEVLRLVTDRGDAVVVN

SEQ ID NO: 706517 - protein, 23 aa, Mycobacterium
PDVMMGIVEMLRLVTDRGDTVIV

SEQ ID NO: 706518 - protein, 27 aa, Mycobacterium
PDVNYAVRFGFWGAEEEGLLGSTNYVE

SEQ ID NO: 706519 - protein, 18 aa, Mycobacterium
PDVPAEWITGVRILSDDP

SEQ ID NO: 706520 - protein, 17 aa, Mycobacterium
PDVPAWTSVLASRRPDR

SEQ ID NO: 706521 - protein, 19 aa, Mycobacterium
PDVPGGPPAHIMGSGQTYG

SEQ ID NO: 706522 - protein, 22 aa, Mycobacterium
PDVPIELIWRNGRPPAGLIVRN

SEQ ID NO: 706523 - protein, 32 aa, Mycobacterium
PDVPLLCAEEVDRACAPWGLLAEDKQATLVAG

SEQ ID NO: 706524 - protein, 17 aa, Mycobacterium
PDVPLVVSEVNFERDVA

SEQ ID NO: 706525 - protein, 18 aa, Mycobacterium
PDVRARAKLLAMTLDEDD

SEQ ID NO: 706526 - protein, 19 aa, Mycobacterium
PDVREAWHAVAGKDVPDTP

SEQ ID NO: 706527 - protein, 20 aa, Mycobacterium
PDVRPRVLLLGSGELSRELA

SEQ ID NO: 706528 - protein, 17 aa, Mycobacterium
PDVRRILTEAADASRAT

SEQ ID NO: 706529 - protein, 17 aa, Mycobacterium
PDVRRLRDVPANLRRGS

SEQ ID NO: 706530 - protein, 24 aa, Mycobacterium
PDVRSRIQLMIDFMATRTAFFDEF

SEQ ID NO: 706531 - protein, 18 aa, Mycobacterium
PDVSLAFYRALEDGKEPL

SEQ ID NO: 706532 - protein, 19 aa, Mycobacterium
PDVTLSCPIHAYYGDDDEI

SEQ ID NO: 706533 - protein, 20 aa, Mycobacterium
PDVTRLLLDRVLSTHNIGES

SEQ ID NO: 706534 - protein, 20 aa, Mycobacterium
PDVTRLLLDRVLSTQNVGES

SEQ ID NO: 706535 - protein, 21 aa, Mycobacterium
PDVVALAPLLGVWVGEGTGEY

SEQ ID NO: 706536 - protein, 21 aa, Mycobacterium
PDVVARLLVSLYLGVRQTSEL

SEQ ID NO: 706537 - protein, 17 aa, Mycobacterium
PDVVEGIVSFLQKRVPR

SEQ ID NO: 706538 - protein, 19 aa, Mycobacterium
PDVVITIYSGDSWAPDAPN

SEQ ID NO: 706539 - protein, 24 aa, Mycobacterium
PDVWEKRATLSLLYAEKNHAPHGR

SEQ ID NO: 706540 - protein, 21 aa, Mycobacterium
PDVYIAALGPQLLRLAGRRTQ

SEQ ID NO: 706541 - protein, 18 aa, Mycobacterium
PDVYLPVDVRPTLYDLTV

SEQ ID NO: 706542 - protein, 22 aa, Mycobacterium
PDWLEVQPHFGGAIICALAHLG

SEQ ID NO: 706543 - protein, 17 aa, Mycobacterium
PDWPQPAQEGGSYRIEV

SEQ ID NO: 706544 - protein, 23 aa, Mycobacterium
PDWPRHPSPLGGYRVIVDGLPTY

SEQ ID NO: 706545 - protein, 17 aa, Mycobacterium
PDWPSCAGYAAPSAPPG

SEQ ID NO: 706546 - protein, 29 aa, Mycobacterium
PDWVNTIFLSTRFKAWRVGGYNEYLYTFF

SEQ ID NO: 706547 - protein, 29 aa, Mycobacterium
PDWVNTIFLSTRFRAWRVGGYNEYLYTFF

SEQ ID NO: 706548 - protein, 29 aa, Mycobacterium
PDYEPLCRRLVMSVPFFKAVQRPNVSVLT

SEQ ID NO: 706549 - protein, 20 aa, Mycobacterium
PDYFTHWGGAFKYAASLLGL

SEQ ID NO: 706550 - protein, 24 aa, Mycobacterium
PDYFTHWGGAFKYAASVLGLPIGS

SEQ ID NO: 706551 - protein, 19 aa, Mycobacterium
PDYLHAFAALWDSEDLDDW

SEQ ID NO: 706552 - protein, 21 aa, Mycobacterium
PDYLPGTSLPPGIRATADAAE

SEQ ID NO: 706553 - protein, 20 aa, Mycobacterium
PDYMIGSSFGSIIGSLVARA

SEQ ID NO: 706554 - protein, 20 aa, Mycobacterium
PDYPAALYADYLPRYLRGIS

SEQ ID NO: 706555 - protein, 20 aa, Mycobacterium
PDYRAGCKRILNSDTYYRGI

SEQ ID NO: 706556 - protein, 26 aa, Mycobacterium
PDYRAGCKRLLGSATYYKAIENRKTE

SEQ ID NO: 706557 - protein, 23 aa, Mycobacterium
PDYWRAAQDLGFGQLALLLPTCP

SEQ ID NO: 706558 - protein, 21 aa, Mycobacterium
PEAAARYAADPAQAIADADLN

SEQ ID NO: 706559 - protein, 21 aa, Mycobacterium
PEAAARYAANPAQAIADAHLT

SEQ ID NO: 706560 - protein, 26 aa, Mycobacterium
PEAADRMCIAIALDATMDVPLQQPLG

SEQ ID NO: 706561 - protein, 17 aa, Mycobacterium
PEAAEGFRAFKQKDSPD

SEQ ID NO: 706562 - protein, 18 aa, Mycobacterium
PEAAGYWPAAAVANYAMS

SEQ ID NO: 706563 - protein, 32 aa, Mycobacterium
PEAAHPVPLHDCFAALEWLHGHAGELGVDPAR

SEQ ID NO: 706564 - protein, 24 aa, Mycobacterium
PEAAKAMAYACEFIANSLQDNAAA

SEQ ID NO: 706565 - protein, 25 aa, Mycobacterium
PEAAKLRLPVQWVSRPTAEQRRRYT

SEQ ID NO: 706566 - protein, 24 aa, Mycobacterium
PEAALRPADIVNIGYVVNVIDDRA

SEQ ID NO: 706567 - protein, 28 aa, Mycobacterium
PEAASDEWTDWRWNRILIEGSNCRDIID

SEQ ID NO: 706568 - protein, 24 aa, Mycobacterium
PEAAVECLARIVVELVGDEPFVLA

SEQ ID NO: 706569 - protein, 19 aa, Mycobacterium
PEAAWKLASDLSRFDEWMT

SEQ ID NO: 706570 - protein, 24 aa, Mycobacterium
PEACILGMGAIKARPVAVDNEIVS

SEQ ID NO: 706571 - protein, 27 aa, Mycobacterium
PEADIAALHRFGLPLVVIDPLNQPTTR

SEQ ID NO: 706572 - protein, 18 aa, Mycobacterium
PEADRMRLFEAFVGAAEQ

SEQ ID NO: 706573 - protein, 24 aa, Mycobacterium
PEADWPDVVRRWRAAYFAALEEAR

SEQ ID NO: 706574 - protein, 18 aa, Mycobacterium
PEAFAVAREAAWRVLDQR

SEQ ID NO: 706575 - protein, 22 aa, Mycobacterium
PEAFDSIPTVMLRRMAWYWARI

SEQ ID NO: 706576 - protein, 24 aa, Mycobacterium
PEAFKRLLDINVLGVFHTVRATLP

SEQ ID NO: 706577 - protein, 21 aa, Mycobacterium
PEAFPPMAVSVSIADDIDISR

SEQ ID NO: 706578 - protein, 23 aa, Mycobacterium
PEAGEIAVHFEVFMPMQETDLRL

SEQ ID NO: 706579 - protein, 22 aa, Mycobacterium
PEAGHKGFSLFVVERDMEGFTR

SEQ ID NO: 706580 - protein, 23 aa, Mycobacterium
PEAGHKGFSLFVVERGMEGFTRG

SEQ ID NO: 706581 - protein, 19 aa, Mycobacterium
PEAGNAFDALMLDELEAAW

SEQ ID NO: 706582 - protein, 17 aa, Mycobacterium
PEAGNFGYRVSRYELDL

SEQ ID NO: 706583 - protein, 22 aa, Mycobacterium
PEAGRLLYSLVRATRPATVVEF

SEQ ID NO: 706584 - protein, 26 aa, Mycobacterium
PEAHEFYIRDVLLDWSRDDPNHLEVQ

SEQ ID NO: 706585 - protein, 25 aa, Mycobacterium
PEAHRARRQLIEFLAESTRAAALSE

SEQ ID NO: 706586 - protein, 19 aa, Mycobacterium
PEAIAIRYGERQWSWADWS

SEQ ID NO: 706587 - protein, 19 aa, Mycobacterium
PEAIALRRCDGTSALPYSE

SEQ ID NO: 706588 - protein, 20 aa, Mycobacterium
PEAIDPVLLDLLRLGTYQLL

SEQ ID NO: 706589 - protein, 25 aa, Mycobacterium
PEAIPDRRLELMLVCAHPAIAANCR

SEQ ID NO: 706590 - protein, 20 aa, Mycobacterium
PEAITVFLAPPSWQDLEARL

SEQ ID NO: 706591 - protein, 30 aa, Mycobacterium
PEAIVAMLACARLGVMHSVVFAGFSASALR

SEQ ID NO: 706592 - protein, 21 aa, Mycobacterium
PEAKALYLSAGYRPLYDQTLT

SEQ ID NO: 706593 - protein, 20 aa, Mycobacterium
PEAKGVKNRVHFDVYTRAVA

SEQ ID NO: 706594 - protein, 21 aa, Mycobacterium
PEAKSQLAWVDIDTVLVGTDF

SEQ ID NO: 706595 - protein, 17 aa, Mycobacterium
PEALAGLGGADPAQLLP

SEQ ID NO: 706596 - protein, 20 aa, Mycobacterium
PEALAIEYDGQWNSWARVGA

SEQ ID NO: 706597 - protein, 23 aa, Mycobacterium
PEALEMIERIRAIGADVVVDCGD

SEQ ID NO: 706598 - protein, 22 aa, Mycobacterium
PEALETWPLELFAESLPRHLEI

SEQ ID NO: 706599 - protein, 23 aa, Mycobacterium
PEALETWPLGLFAESLPRHLEII

SEQ ID NO: 706600 - protein, 35 aa, Mycobacterium
PEALETWPLSMFQRFLPRHLEIIYEINRRFLDQVR

SEQ ID NO: 706601 - protein, 20 aa, Mycobacterium
PEALLHRIKQYSGRLSTEAV

SEQ ID NO: 706602 - protein, 20 aa, Mycobacterium
PEALLPVAAPNWNYLHIHND

SEQ ID NO: 706603 - protein, 17 aa, Mycobacterium
PEALNAFNEALYDATAE

SEQ ID NO: 706604 - protein, 17 aa, Mycobacterium
PEALNAFNEALYDATAQ

SEQ ID NO: 706605 - protein, 25 aa, Mycobacterium
PEALQMPSIHTKYWYPLFEAACENK

SEQ ID NO: 706606 - protein, 26 aa, Mycobacterium
PEALQMPSIHTKYWYRLFEAVCESKT

SEQ ID NO: 706607 - protein, 22 aa, Mycobacterium
PEALRAFGTRECVEADQALQDF

SEQ ID NO: 706608 - protein, 18 aa, Mycobacterium
PEALRSLYRLVCGAEPLT

SEQ ID NO: 706609 - protein, 20 aa, Mycobacterium
PEALRTVAAFTDMVSSRGTI

SEQ ID NO: 706610 - protein, 18 aa, Mycobacterium
PEALRWLANQSCITLHMW

SEQ ID NO: 706611 - protein, 20 aa, Mycobacterium
PEALSGEGSRRALIAARATD

SEQ ID NO: 706612 - protein, 20 aa, Mycobacterium
PEALTVFLAPPSWEDLEARL

SEQ ID NO: 706613 - protein, 17 aa, Mycobacterium
PEAMFLYTEECRALGLP

SEQ ID NO: 706614 - protein, 25 aa, Mycobacterium
PEAMLDRLALTPARVEGIADGLRQV

SEQ ID NO: 706615 - protein, 17 aa, Mycobacterium
PEAMPLIADPVIAEEAD

SEQ ID NO: 706616 - protein, 19 aa, Mycobacterium
PEAMPLLEYLEAVPDDIAW

SEQ ID NO: 706617 - protein, 17 aa, Mycobacterium
PEAPGYVTVPWDAVEVW

SEQ ID NO: 706618 - protein, 21 aa, Mycobacterium
PEAPVISAIVFEQFPISALTD

SEQ ID NO: 706619 - protein, 21 aa, Mycobacterium
PEAQLDRFLLKLNVPLPPREQ

SEQ ID NO: 706620 - protein, 21 aa, Mycobacterium
PEAQLDRFLLKLNVTLPPRDA

SEQ ID NO: 706621 - protein, 21 aa, Mycobacterium
PEAQLDRFLLKLNVTLPPRDS

SEQ ID NO: 706622 - protein, 21 aa, Mycobacterium
PEAQLDRFLLKLTVPLPPRDQ

SEQ ID NO: 706623 - protein, 22 aa, Mycobacterium
PEAQRLLGQIKAIWRINELLNW

SEQ ID NO: 706624 - protein, 19 aa, Mycobacterium
PEAQRYGVAVGEPKFDDDD

SEQ ID NO: 706625 - protein, 20 aa, Mycobacterium
PEARAVWEAIFAKYAAPGMC

SEQ ID NO: 706626 - protein, 21 aa, Mycobacterium
PEAREKPFATLRQLLAVHETA

SEQ ID NO: 706627 - protein, 17 aa, Mycobacterium
PEARGAWVESNHYVTED

SEQ ID NO: 706628 - protein, 25 aa, Mycobacterium
PEARLEVLDGLGLDYTIMFPTLASL

SEQ ID NO: 706629 - protein, 24 aa, Mycobacterium
PEARLEVMDGLGLDYTLMFPTLAS

SEQ ID NO: 706630 - protein, 17 aa, Mycobacterium
PEARLSGEPEYKRNLTL

SEQ ID NO: 706631 - protein, 21 aa, Mycobacterium
PEARPELGLSAFVFMAEEAAK

SEQ ID NO: 706632 - protein, 17 aa, Mycobacterium
PEARPPALITGGGMISP

SEQ ID NO: 706633 - protein, 23 aa, Mycobacterium
PEARRAAHRAGYRGAMYPWQSGS

SEQ ID NO: 706634 - protein, 26 aa, Mycobacterium
PEARRFRRFLTHEVWPAIRDTGSYST

SEQ ID NO: 706635 - protein, 32 aa, Mycobacterium
PEARRRGWSAGRFSFNVAEGRCATCQGEGFVA

SEQ ID NO: 706636 - protein, 18 aa, Mycobacterium
PEASVARAADQLRRRGAR

SEQ ID NO: 706637 - protein, 19 aa, Mycobacterium
PEATAATIVDGWLHTGDVV

SEQ ID NO: 706638 - protein, 23 aa, Mycobacterium
PEATATTFADGWLHTGDVVRVDD

SEQ ID NO: 706639 - protein, 19 aa, Mycobacterium
PEATAVIFTADRVAVSYRD

SEQ ID NO: 706640 - protein, 18 aa, Mycobacterium
PEATLNVEPVRPYPSSSP

SEQ ID NO: 706641 - protein, 17 aa, Mycobacterium
PEATPWRHPELKAAGAA

SEQ ID NO: 706642 - protein, 19 aa, Mycobacterium
PEATRIVAWTDNQHELTVE

SEQ ID NO: 706643 - protein, 27 aa, Mycobacterium
PEATWLRTGDSGFFFDGELFIIGRIKD

SEQ ID NO: 706644 - protein, 18 aa, Mycobacterium
PEATYRCYDLMARKVIPH

SEQ ID NO: 706645 - protein, 19 aa, Mycobacterium
PEAVGHLLSAFVAITPLDP

SEQ ID NO: 706646 - protein, 18 aa, Mycobacterium
PEAVPGFRRLTHAIHAEG

SEQ ID NO: 706647 - protein, 19 aa, Mycobacterium
PEAVPSNWVTFFGAEDVDK

SEQ ID NO: 706648 - protein, 19 aa, Mycobacterium
PEAVQHWNVDKAGLDDLLD

SEQ ID NO: 706649 - protein, 23 aa, Mycobacterium
PEAVRGALLGGYFAGLLDRTVLE

SEQ ID NO: 706650 - protein, 27 aa, Mycobacterium
PEAVRYEAWSFPDFQTGADALRAVTQT

SEQ ID NO: 706651 - protein, 33 aa, Mycobacterium
PEAYTASWTRPVSTWWPWRGRTVHIARAPVPDA

SEQ ID NO: 706652 - protein, 17 aa, Mycobacterium
PEAYTWLTAELANLRLA

SEQ ID NO: 706653 - protein, 17 aa, Mycobacterium
PECAAVIAEVWTLLDGE

SEQ ID NO: 706654 - protein, 17 aa, Mycobacterium
PECELVIVVGSKNSSNS

SEQ ID NO: 706655 - protein, 17 aa, Mycobacterium
PECQSPLFLDVDASDRT

SEQ ID NO: 706656 - protein, 37 aa, Mycobacterium
PECYDYAGHVLFAWHLPELWRRFTITMRRTLRKELKA

SEQ ID NO: 706657 - protein, 38 aa, Mycobacterium
PECYDYAGHVLFTWHLPELWRRFTITLRRALRKSLKAA

SEQ ID NO: 706658 - protein, 19 aa, Mycobacterium
PEDAVIKLGRGHRYRFDYD

SEQ ID NO: 706659 - protein, 22 aa, Mycobacterium
PEDAWSRRGLRSNGSEFTIATI

SEQ ID NO: 706660 - protein, 20 aa, Mycobacterium
PEDCHFCAQSGLFESPVRSA

SEQ ID NO: 706661 - protein, 25 aa, Mycobacterium
PEDCHFCSQSGLFASPVRSAWLDVP

SEQ ID NO: 706662 - protein, 17 aa, Mycobacterium
PEDEGGYNRPENRGDEQ

SEQ ID NO: 706663 - protein, 20 aa, Mycobacterium
PEDERAALLASELATRRPLV

SEQ ID NO: 706664 - protein, 25 aa, Mycobacterium
PEDFRMWVCLHEVTHRVQFRANPWL

SEQ ID NO: 706665 - protein, 23 aa, Mycobacterium
PEDIAAACAFFISEEAGYITGQI

SEQ ID NO: 706666 - protein, 21 aa, Mycobacterium
PEDIAAAVVRIIEKPRVQVTV

SEQ ID NO: 706667 - protein, 22 aa, Mycobacterium
PEDIAATCSFLISEEAGYITGQ

SEQ ID NO: 706668 - protein, 23 aa, Mycobacterium
PEDIADAVAWLASDQSRLVTATQ

SEQ ID NO: 706669 - protein, 31 aa, Mycobacterium
PEDIKRSAIPILCREALEAAAWDAYASKAHT

SEQ ID NO: 706670 - protein, 19 aa, Mycobacterium
PEDILALPLNCLHRDKDGS

SEQ ID NO: 706671 - protein, 23 aa, Mycobacterium
PEDKNIRIAPTFPSLPDLRNAVD

SEQ ID NO: 706672 - protein, 24 aa, Mycobacterium
PEDKNIRIAPTFPSLPDVRDAIDG

SEQ ID NO: 706673 - protein, 23 aa, Mycobacterium
PEDLDFFRRLSLDLISIPTDIVA

SEQ ID NO: 706674 - protein, 17 aa, Mycobacterium
PEDLHALLIAENVSVLS

SEQ ID NO: 706675 - protein, 23 aa, Mycobacterium
PEDLVGMCLFLLGDQASWITGQI

SEQ ID NO: 706676 - protein, 17 aa, Mycobacterium
PEDLVWTVVSPPLVIEF

SEQ ID NO: 706677 - protein, 25 aa, Mycobacterium
PEDPAEGFAAMWADLRRPELRQLER

SEQ ID NO: 706678 - protein, 24 aa, Mycobacterium
PEDPEMRDSVSFWVVDDRGEIGLP

SEQ ID NO: 706679 - protein, 19 aa, Mycobacterium
PEDPLKFTAETAGKAKMAG

SEQ ID NO: 706680 - protein, 24 aa, Mycobacterium
PEDQARVILFLACELSAFVTGHTI

SEQ ID NO: 706681 - protein, 23 aa, Mycobacterium
PEDRRLPTVLFQTTVTKLRDLLA

SEQ ID NO: 706682 - protein, 24 aa, Mycobacterium
PEDSRLLTRELFYTAVTRAQTRVR

SEQ ID NO: 706683 - protein, 21 aa, Mycobacterium
PEDVAGVLAEYGWRETEQAGA

SEQ ID NO: 706684 - protein, 25 aa, Mycobacterium
PEDVAQHFVEFLRAGGIEVVTMGSH

SEQ ID NO: 706685 - protein, 19 aa, Mycobacterium
PEDVKKWWNSLSQEQRDQL

SEQ ID NO: 706686 - protein, 28 aa, Mycobacterium
PEDWPIMPVDTVNFWLKPVGFFDRNPSL

SEQ ID NO: 706687 - protein, 28 aa, Mycobacterium
PEDWPVMPADTVSFWLKPVGFFDRNPSL

SEQ ID NO: 706688 - protein, 28 aa, Mycobacterium
PEDWPVMPCHYTGFKLKPVGFFDGNPAL

SEQ ID NO: 706689 - protein, 17 aa, Mycobacterium
PEDYAQWFPESHPPTAE

SEQ ID NO: 706690 - protein, 20 aa, Mycobacterium
PEDYPEGGLIELTRDRVRGI

SEQ ID NO: 706691 - protein, 34 aa, Mycobacterium
PEEAEERFLAGLPLPYIPSARDIAYSIAFLASPR

SEQ ID NO: 706692 - protein, 20 aa, Mycobacterium
PEEAEEWGGAADEPFDPNYH

SEQ ID NO: 706693 - protein, 18 aa, Mycobacterium
PEEALPVVVFYHGGGFCL

SEQ ID NO: 706694 - protein, 24 aa, Mycobacterium
PEECPGFRSGGAFDDAGFAQFAEW

SEQ ID NO: 706695 - protein, 18 aa, Mycobacterium
PEEDHSVVVLAQRARNRL

SEQ ID NO: 706696 - protein, 24 aa, Mycobacterium
PEEDRPEFLAALGAEQPDGARVGA

SEQ ID NO: 706697 - protein, 21 aa, Mycobacterium
PEEDRRVWRTALIRKLTTKYA

SEQ ID NO: 706698 - protein, 20 aa, Mycobacterium
PEEFGGSGASVWEQTVVREE

SEQ ID NO: 706699 - protein, 25 aa, Mycobacterium
PEEGFGRFTPRARNVIVVAHNLAHD

SEQ ID NO: 706700 - protein, 21 aa, Mycobacterium
PEEGMWEIFEWGAVSEADLAV

SEQ ID NO: 706701 - protein, 18 aa, Mycobacterium
PEEIAVFISWLVSAENSY

SEQ ID NO: 706702 - protein, 21 aa, Mycobacterium
PEEIRIAQSLGLTSVAMTGGM

SEQ ID NO: 706703 - protein, 26 aa, Mycobacterium
PEEIWRKPADTFVAKALGQPEINLLD

SEQ ID NO: 706704 - protein, 26 aa, Mycobacterium
PEELDRFLVAVTFRIGRLGVPVIAEF

SEQ ID NO: 706705 - protein, 21 aa, Mycobacterium
PEELKGAAPRIWYEDGAYMVG

SEQ ID NO: 706706 - protein, 28 aa, Mycobacterium
PEELMNVFAYPFATWRVYLHPTQRAVVD

SEQ ID NO: 706707 - protein, 21 aa, Mycobacterium
PEELRAVLIGERVSVLTQTPS

SEQ ID NO: 706708 - protein, 24 aa, Mycobacterium
PEELRPDDEWVLFDYDAVSQAFRD

SEQ ID NO: 706709 - protein, 19 aa, Mycobacterium
PEELSWVTPHSFRRTVATV

SEQ ID NO: 706710 - protein, 20 aa, Mycobacterium
PEELVFRVNYLGGDMPTFTL

SEQ ID NO: 706711 - protein, 25 aa, Mycobacterium
PEENFREMLPLGGWEITYLGPTTYR

SEQ ID NO: 706712 - protein, 21 aa, Mycobacterium
PEEPHWYLAVIGSDPAVRGQG

SEQ ID NO: 706713 - protein, 43 aa, Mycobacterium
PEEPKGTPVFAWKGETLEEYWWAAEQMLTWPGEPANMILDDGG

SEQ ID NO: 706714 - protein, 24 aa, Mycobacterium
PEEQAGAILFLLSDLSGYVTGQTL

SEQ ID NO: 706715 - protein, 23 aa, Mycobacterium
PEEQAGAILFLLSDLSSYITGQT

SEQ ID NO: 706716 - protein, 18 aa, Mycobacterium
PEEQCAALDRFAKAGPAL

SEQ ID NO: 706717 - protein, 26 aa, Mycobacterium
PEERRQLELDSGVPVLTVLRTAYDTN

SEQ ID NO: 706718 - protein, 17 aa, Mycobacterium
PEESMGLIKQCANRFAG

SEQ ID NO: 706719 - protein, 20 aa, Mycobacterium
PEETLCWLYEMMVVTRELDA

SEQ ID NO: 706720 - protein, 23 aa, Mycobacterium
PEETLSLRFEQIFHQAPASESLL

SEQ ID NO: 706721 - protein, 24 aa, Mycobacterium
PEEVGAACAFLCSEQAGYISGVSL

SEQ ID NO: 706722 - protein, 18 aa, Mycobacterium
PEEVLRTLIETELAARDA

SEQ ID NO: 706723 - protein, 24 aa, Mycobacterium
PEEVLSLRFEQIFHQAPASSDSLL

SEQ ID NO: 706724 - protein, 18 aa, Mycobacterium
PEEVSHGPSHLGIIAHTE

SEQ ID NO: 706725 - protein, 21 aa, Mycobacterium
PEEVTRAVLFLVDEASSHITG

SEQ ID NO: 706726 - protein, 19 aa, Mycobacterium
PEFAEDWVNLVALAVNEEN

SEQ ID NO: 706727 - protein, 20 aa, Mycobacterium
PEFAEHGGLFFAAASASSRF

SEQ ID NO: 706728 - protein, 19 aa, Mycobacterium
PEFAELWSRHEVAVRRLQR

SEQ ID NO: 706729 - protein, 24 aa, Mycobacterium
PEFAIEMGRLGGLGVLNGEGLIGR

SEQ ID NO: 706730 - protein, 26 aa, Mycobacterium
PEFASYAPGLWRYWAEHLDPNRARQD

SEQ ID NO: 706731 - protein, 32 aa, Mycobacterium
PEFDTEFAVAWRLGREAILFVGERAAELTRPG

SEQ ID NO: 706732 - protein, 27 aa, Mycobacterium
PEFEKEAWLSMVMLEWGSCGQIATAIP

SEQ ID NO: 706733 - protein, 27 aa, Mycobacterium
PEFEKEAWLSMVMLEWGSCGQLAVECR

SEQ ID NO: 706734 - protein, 27 aa, Mycobacterium
PEFEKEAWLSMVMLEWGSCGQVATAAT

SEQ ID NO: 706735 - protein, 27 aa, Mycobacterium
PEFEKEAWLSMVMLEWGSCGQVATAIP

SEQ ID NO: 706736 - protein, 27 aa, Mycobacterium
PEFEKEAWLSMVMLEWGSCGQVAVTGP

SEQ ID NO: 706737 - protein, 20 aa, Mycobacterium
PEFEKKLEWIREFVREEVEP

SEQ ID NO: 706738 - protein, 17 aa, Mycobacterium
PEFFAAMRELCDEFDAL

SEQ ID NO: 706739 - protein, 17 aa, Mycobacterium
PEFFAAMRELCDRHDAL

SEQ ID NO: 706740 - protein, 25 aa, Mycobacterium
PEFINRLDDVIIFDGLNPEELVQIV

SEQ ID NO: 706741 - protein, 25 aa, Mycobacterium
PEFINRLDDVLIFDGLNPEELVQIV

SEQ ID NO: 706742 - protein, 20 aa, Mycobacterium
PEFIRELPEPITAPTQLDTV

SEQ ID NO: 706743 - protein, 21 aa, Mycobacterium
PEFLDELRVAGAEVVPIRVYR

SEQ ID NO: 706744 - protein, 17 aa, Mycobacterium
PEFLSWTRSVRNLLNAP

SEQ ID NO: 706745 - protein, 17 aa, Mycobacterium
PEFQFQVFLDEVRLPAD

SEQ ID NO: 706746 - protein, 17 aa, Mycobacterium
PEFRFTEAVSFMVDCKD

SEQ ID NO: 706747 - protein, 20 aa, Mycobacterium
PEFRGEKDFEGIIVHPQNWP

SEQ ID NO: 706748 - protein, 25 aa, Mycobacterium
PEFRTSPRPLPMVVESDARRPADRF

SEQ ID NO: 706749 - protein, 25 aa, Mycobacterium
PEFSDLFTAFPSFAGLRPMFDTRLM

SEQ ID NO: 706750 - protein, 23 aa, Mycobacterium
PEFTEPLSARFGDLTVLTSPPNT

SEQ ID NO: 706751 - protein, 20 aa, Mycobacterium
PEFTVAWPTGEIGGMGLEGA

SEQ ID NO: 706752 - protein, 20 aa, Mycobacterium
PEFVAPVVAYLCTEECADNG

SEQ ID NO: 706753 - protein, 19 aa, Mycobacterium
PEFVEFATANEVARKEYLR

SEQ ID NO: 706754 - protein, 26 aa, Mycobacterium
PEFYALEAEMLWPRMWQMACRLEEIP

SEQ ID NO: 706755 - protein, 20 aa, Mycobacterium
PEGASAIVFRDVDHAPELAA

SEQ ID NO: 706756 - protein, 18 aa, Mycobacterium
PEGATDWIAPDVDPDAMA

SEQ ID NO: 706757 - protein, 19 aa, Mycobacterium
PEGELAAAIDEFFGGFEAF

SEQ ID NO: 706758 - protein, 25 aa, Mycobacterium
PEGELYFPGSPILSVHGTFAECVLL

SEQ ID NO: 706759 - protein, 17 aa, Mycobacterium
PEGEPFATLPSMMRITL

SEQ ID NO: 706760 - protein, 22 aa, Mycobacterium
PEGEPRFTVAALDLGIKTNTPR

SEQ ID NO: 706761 - protein, 24 aa, Mycobacterium
PEGETILLVHGWPDSHHLWDGVAP

SEQ ID NO: 706762 - protein, 24 aa, Mycobacterium
PEGETPRWGKMVAPGMYGPNHQHF

SEQ ID NO: 706763 - protein, 20 aa, Mycobacterium
PEGETRGWGVFAHGFTLGKD

SEQ ID NO: 706764 - protein, 17 aa, Mycobacterium
PEGFLERQVPRWLSELD

SEQ ID NO: 706765 - protein, 20 aa, Mycobacterium
PEGFLSSHLVAGVEPGTVVR

SEQ ID NO: 706766 - protein, 21 aa, Mycobacterium
PEGFLSTHLVAGVAPGTIVRL

SEQ ID NO: 706767 - protein, 20 aa, Mycobacterium
PEGFLSTHLVAGVEPGTVVR

SEQ ID NO: 706768 - protein, 20 aa, Mycobacterium
PEGFLSTHLVAGVERGTIVR

SEQ ID NO: 706769 - protein, 20 aa, Mycobacterium
PEGFLSTHLVGGVEPGAIVR

SEQ ID NO: 706770 - protein, 28 aa, Mycobacterium
PEGFQWRGLYVERLCLAVPRGHRLASRS

SEQ ID NO: 706771 - protein, 34 aa, Mycobacterium
PEGFVPLRVKHVIPETRDAVSIVLDVPRGSAARF

SEQ ID NO: 706772 - protein, 28 aa, Mycobacterium
PEGGLIKAAWIEDWRLPAAPPGAVKIVV

SEQ ID NO: 706773 - protein, 23 aa, Mycobacterium
PEGGWYRETWRSELTVNQTSLPA

SEQ ID NO: 706774 - protein, 19 aa, Mycobacterium
PEGHFAIYLGDAFERVVAD

SEQ ID NO: 706775 - protein, 18 aa, Mycobacterium
PEGILVVWIELAEHRSFT

SEQ ID NO: 706776 - protein, 27 aa, Mycobacterium
PEGKHAASAFAMWFPIEGGADYGQAKV

SEQ ID NO: 706777 - protein, 20 aa, Mycobacterium
PEGKIRTVYEPVVKTTIIAP

SEQ ID NO: 706778 - protein, 18 aa, Mycobacterium
PEGKQIFGRLVAAADAVF

SEQ ID NO: 706779 - protein, 21 aa, Mycobacterium
PEGLAAIPAIRVDIGSGTGEF

SEQ ID NO: 706780 - protein, 24 aa, Mycobacterium
PEGLARLAGELGIAQRVTFLPPQS

SEQ ID NO: 706781 - protein, 17 aa, Mycobacterium
PEGLDAEYLRWHTLDHR

SEQ ID NO: 706782 - protein, 17 aa, Mycobacterium
PEGLGYARLPATDRTLT

SEQ ID NO: 706783 - protein, 18 aa, Mycobacterium
PEGLLERQLTGWTRRAHV

SEQ ID NO: 706784 - protein, 26 aa, Mycobacterium
PEGLPYRWPHPWLLDKKSAAQQQQRV

SEQ ID NO: 706785 - protein, 26 aa, Mycobacterium
PEGLPYRWPHPWLVDRKSAAQQQERV

SEQ ID NO: 706786 - protein, 19 aa, Mycobacterium
PEGLRPDDAMIMFTGGTTG

SEQ ID NO: 706787 - protein, 20 aa, Mycobacterium
PEGLSWLYNFVKAQGERNYG

SEQ ID NO: 706788 - protein, 21 aa, Mycobacterium
PEGMVPIRVKMTIKGDQLSYD

SEQ ID NO: 706789 - protein, 28 aa, Mycobacterium
PEGPEVQLGISLGRRWWGQHVTSEALGL

SEQ ID NO: 706790 - protein, 23 aa, Mycobacterium
PEGPGSVAGMAADPVTVAASNNP

SEQ ID NO: 706791 - protein, 21 aa, Mycobacterium
PEGPLFCGGAGAAGMTPAGES

SEQ ID NO: 706792 - protein, 27 aa, Mycobacterium
PEGPPGLPRFTVVAFDLGIKTNTPRNF

SEQ ID NO: 706793 - protein, 33 aa, Mycobacterium
PEGPRPYLRIEGTSVFRWAAFEMGKVGQRAMEA

SEQ ID NO: 706794 - protein, 26 aa, Mycobacterium
PEGPVVKHLFGLLSVLRDGGYHEPEI

SEQ ID NO: 706795 - protein, 22 aa, Mycobacterium
PEGPWLRTGDLGFISEGQLFIV

SEQ ID NO: 706796 - protein, 20 aa, Mycobacterium
PEGPWLRTGDLGFVSEGELF

SEQ ID NO: 706797 - protein, 25 aa, Mycobacterium
PEGQSLLRLTARASLTEADMERVHE

SEQ ID NO: 706798 - protein, 26 aa, Mycobacterium
PEGRAYDFGIRWGAALAGRFRRLVHY

SEQ ID NO: 706799 - protein, 23 aa, Mycobacterium
PEGRGQVLARFAQWLIDNTGRIE

SEQ ID NO: 706800 - protein, 17 aa, Mycobacterium
PEGRLATEVLLTLNRAS

SEQ ID NO: 706801 - protein, 25 aa, Mycobacterium
PEGSDRPERFIAMTNAERSPTFYRF

SEQ ID NO: 706802 - protein, 19 aa, Mycobacterium
PEGTIVFCGVHFMAETAKI

SEQ ID NO: 706803 - protein, 20 aa, Mycobacterium
PEGTYLAWLDCRDLGISEQD

SEQ ID NO: 706804 - protein, 21 aa, Mycobacterium
PEGVFDWTVVDWRVHEENVAR

SEQ ID NO: 706805 - protein, 27 aa, Mycobacterium
PEGVGAWLVLCCRAIRAGAQEALTIAD

SEQ ID NO: 706806 - protein, 35 aa, Mycobacterium
PEGVPPAALRPEPRLPAPAGWPFGEDFPRTCGTGR

SEQ ID NO: 706807 - protein, 29 aa, Mycobacterium
PEGWDYQDCPDCTRVVNEWVIERNRNYLM

SEQ ID NO: 706808 - protein, 18 aa, Mycobacterium
PEGYAWDALNGKDLLDRD

SEQ ID NO: 706809 - protein, 17 aa, Mycobacterium
PEGYKLTVNHAVRVTWG

SEQ ID NO: 706810 - protein, 17 aa, Mycobacterium
PEGYLLAAREITARHGA

SEQ ID NO: 706811 - protein, 28 aa, Mycobacterium
PEGYPQTAPYEWWDWHDAYGEHEPSRWF

SEQ ID NO: 706812 - protein, 19 aa, Mycobacterium
PEHAAAMVVRALVDKPARI

SEQ ID NO: 706813 - protein, 18 aa, Mycobacterium
PEHAEALEQLGIAAFELV

SEQ ID NO: 706814 - protein, 18 aa, Mycobacterium
PEHARQGALNSMLGCTGD

SEQ ID NO: 706815 - protein, 17 aa, Mycobacterium
PEHDCGAPIPGRIFAGP

SEQ ID NO: 706816 - protein, 21 aa, Mycobacterium
PEHEERIAGAFGYWRESGRFI

SEQ ID NO: 706817 - protein, 19 aa, Mycobacterium
PEHFELGGLGVEMEVDVVE

SEQ ID NO: 706818 - protein, 18 aa, Mycobacterium
PEHFKFMEVCGGHTHTIY

SEQ ID NO: 706819 - protein, 17 aa, Mycobacterium
PEHGPGMDLWVGGGLST

SEQ ID NO: 706820 - protein, 21 aa, Mycobacterium
PEHHPPMRAFLAVPITIRGTV

SEQ ID NO: 706821 - protein, 17 aa, Mycobacterium
PEHIATIFVGGLKHLPI

SEQ ID NO: 706822 - protein, 17 aa, Mycobacterium
PEHLAGVKGMDLVRRVL

SEQ ID NO: 706823 - protein, 24 aa, Mycobacterium
PEHLARACARVGARLIHVSTDYVF

SEQ ID NO: 706824 - protein, 19 aa, Mycobacterium
PEHLARLAATAGSTTTPLS

SEQ ID NO: 706825 - protein, 17 aa, Mycobacterium
PEHLDFFTDKALVDDPY

SEQ ID NO: 706826 - protein, 25 aa, Mycobacterium
PEHLIKADMTWLLSHWTCVFGTPAC

SEQ ID NO: 706827 - protein, 17 aa, Mycobacterium
PEHMLSAPADSIVATPV

SEQ ID NO: 706828 - protein, 18 aa, Mycobacterium
PEHPAFYWYAERISEQRG

SEQ ID NO: 706829 - protein, 17 aa, Mycobacterium
PEHPDHVMYVWVDALTN

SEQ ID NO: 706830 - protein, 26 aa, Mycobacterium
PEHPWLLRFFDRISWYPVSAEELLDL

SEQ ID NO: 706831 - protein, 18 aa, Mycobacterium
PEHPYPAAVEDVWAATRW

SEQ ID NO: 706832 - protein, 21 aa, Mycobacterium
PEHPYPVWVEQGGPATIVPMF

SEQ ID NO: 706833 - protein, 20 aa, Mycobacterium
PEHRHMRSLLNKAFTPRAIQ

SEQ ID NO: 706834 - protein, 27 aa, Mycobacterium
PEHRPGIPYPEWNMWTESFMPDHVAVL

SEQ ID NO: 706835 - protein, 24 aa, Mycobacterium
PEHSEVLLGKAIRGRRDSLVIATK

SEQ ID NO: 706836 - protein, 22 aa, Mycobacterium
PEHTAAAIALLFENFTTVFVGA

SEQ ID NO: 706837 - protein, 22 aa, Mycobacterium
PEHTAAAIALLFENFTTVFVGP

SEQ ID NO: 706838 - protein, 20 aa, Mycobacterium
PEHTDHAGAAERLRNQLNAG

SEQ ID NO: 706839 - protein, 21 aa, Mycobacterium
PEHTEKVTLWKLLDVRERTGI

SEQ ID NO: 706840 - protein, 23 aa, Mycobacterium
PEHVCTGVGRLLMTAARERLRRV

SEQ ID NO: 706841 - protein, 23 aa, Mycobacterium
PEHVPAELISRVSGRDHRASFVQ

SEQ ID NO: 706842 - protein, 22 aa, Mycobacterium
PEHVPAELVSRVSGRDHRASFV

SEQ ID NO: 706843 - protein, 18 aa, Mycobacterium
PEHYLPWTRSNDHDRDLL

SEQ ID NO: 706844 - protein, 19 aa, Mycobacterium
PEIAELAHILPRPPHSDPA

SEQ ID NO: 706845 - protein, 22 aa, Mycobacterium
PEIALAWAVHDIGIWTARTWDY

SEQ ID NO: 706846 - protein, 17 aa, Mycobacterium
PEIARAYVTALRDLLRA

SEQ ID NO: 706847 - protein, 17 aa, Mycobacterium
PEIARAYVTALRQLMRA

SEQ ID NO: 706848 - protein, 21 aa, Mycobacterium
PEIAVGFNVQVPLDIPLSGHL

SEQ ID NO: 706849 - protein, 17 aa, Mycobacterium
PEIDPLFAQLKAHGIRL

SEQ ID NO: 706850 - protein, 20 aa, Mycobacterium
PEIEVGKGFSGVMETFDNTR

SEQ ID NO: 706851 - protein, 18 aa, Mycobacterium
PEIHAFYEAFSPRFEEAI

SEQ ID NO: 706852 - protein, 17 aa, Mycobacterium
PEIKREVLFAGPVLRPS

SEQ ID NO: 706853 - protein, 25 aa, Mycobacterium
PEILALRGRQMRNFWATLMLSQGTP

SEQ ID NO: 706854 - protein, 20 aa, Mycobacterium
PEILERADARIRKEEQVISA

SEQ ID NO: 706855 - protein, 21 aa, Mycobacterium
PEINSLRIFAGTGSGPMLAAA

SEQ ID NO: 706856 - protein, 20 aa, Mycobacterium
PEINSLRMFGGAGSAPMLSA

SEQ ID NO: 706857 - protein, 20 aa, Mycobacterium
PEINSLRMFIGAGSAPMLQA

SEQ ID NO: 706858 - protein, 20 aa, Mycobacterium
PEINSLRMFNGAGSTPMLQA

SEQ ID NO: 706859 - protein, 20 aa, Mycobacterium
PEINSLRMYTGAGAAPMMAA

SEQ ID NO: 706860 - protein, 20 aa, Mycobacterium
PEINSVRIFAGAGPQPMLAA

SEQ ID NO: 706861 - protein, 20 aa, Mycobacterium
PEINSVRMFAGAGAAPMLDA

SEQ ID NO: 706862 - protein, 19 aa, Mycobacterium
PEIPGFFRDSRHLAIHVDS

SEQ ID NO: 706863 - protein, 20 aa, Mycobacterium
PEIPPGFLFLDPPDHTRLRK

SEQ ID NO: 706864 - protein, 17 aa, Mycobacterium
PEIPPLFVMSWIDGSSL

SEQ ID NO: 706865 - protein, 25 aa, Mycobacterium
PEIQARLDAGLTFERKVFDELAALH

SEQ ID NO: 706866 - protein, 18 aa, Mycobacterium
PEIQRIQALIERLDESPI

SEQ ID NO: 706867 - protein, 18 aa, Mycobacterium
PEIREVRRSDFCGHYIGE

SEQ ID NO: 706868 - protein, 17 aa, Mycobacterium
PEIRLFPREHRRRRAAA

SEQ ID NO: 706869 - protein, 30 aa, Mycobacterium
PEISPLQARCGWAIGWKKDAFFGRDALLAE

SEQ ID NO: 706870 - protein, 17 aa, Mycobacterium
PEITPVVFSRPAGRVAQ

SEQ ID NO: 706871 - protein, 21 aa, Mycobacterium
PEIVAAVLPRPLEPAAEPLVR

SEQ ID NO: 706872 - protein, 17 aa, Mycobacterium
PEIVDFVLATSIPERIC

SEQ ID NO: 706873 - protein, 22 aa, Mycobacterium
PEIVERIPLRSCQRRGASIDVI

SEQ ID NO: 706874 - protein, 20 aa, Mycobacterium
PEIVTKLVVWNIVGGVYGSF

SEQ ID NO: 706875 - protein, 19 aa, Mycobacterium
PEIWARLMRALGVVDDAEL

SEQ ID NO: 706876 - protein, 23 aa, Mycobacterium
PEIWARLVRALGFVTDDDLRPLR

SEQ ID NO: 706877 - protein, 21 aa, Mycobacterium
PEIWARLVRALGVVDDADLQP

SEQ ID NO: 706878 - protein, 21 aa, Mycobacterium
PEIWARLVRALGVVDDADLRP

SEQ ID NO: 706879 - protein, 22 aa, Mycobacterium
PEIWARLVRALGVVDEAELQPL

SEQ ID NO: 706880 - protein, 19 aa, Mycobacterium
PEIWARLVRALGVVGDAEL

SEQ ID NO: 706881 - protein, 24 aa, Mycobacterium
PEIYRAPMSYPFRDAEFGGKELAT

SEQ ID NO: 706882 - protein, 24 aa, Mycobacterium
PEKAAEGFAAFQAFHAKAASALLA

SEQ ID NO: 706883 - protein, 20 aa, Mycobacterium
PEKAASAWGEALASGTAKRD

SEQ ID NO: 706884 - protein, 21 aa, Mycobacterium
PEKAFAEWRRVLAPDATLIAD

SEQ ID NO: 706885 - protein, 28 aa, Mycobacterium
PEKEFLAPRVRALWGGKPGRPLAWHSLG

SEQ ID NO: 706886 - protein, 19 aa, Mycobacterium
PEKEKWALPGGGLGADEDL

SEQ ID NO: 706887 - protein, 20 aa, Mycobacterium
PEKELRRLSRFIDVCEKTAK

SEQ ID NO: 706888 - protein, 23 aa, Mycobacterium
PEKLEIKTALWGQIDQAAPPDTI

SEQ ID NO: 706889 - protein, 18 aa, Mycobacterium
PEKLELCRGLGAQITINY

SEQ ID NO: 706890 - protein, 21 aa, Mycobacterium
PEKLKRLVAQISEKPESVQHH

SEQ ID NO: 706891 - protein, 22 aa, Mycobacterium
PEKLSGVPWRDDVEVARGDLSD

SEQ ID NO: 706892 - protein, 19 aa, Mycobacterium
PEKPELILLDNFPVWQTQM

SEQ ID NO: 706893 - protein, 20 aa, Mycobacterium
PEKQFTLFFDDVRVPAENLI

SEQ ID NO: 706894 - protein, 20 aa, Mycobacterium
PEKQFTLFFDDVRVPGDNLI

SEQ ID NO: 706895 - protein, 17 aa, Mycobacterium
PEKRRAQTVLPLLHAFR

SEQ ID NO: 706896 - protein, 27 aa, Mycobacterium
PEKVARFLFGLARRYGPNWLAGAQLAL

SEQ ID NO: 706897 - protein, 27 aa, Mycobacterium
PEKVWARPGLRLPPLDLAGCREIVIVG

SEQ ID NO: 706898 - protein, 20 aa, Mycobacterium
PEKVWPWLVDPDRLRQWSPA

SEQ ID NO: 706899 - protein, 18 aa, Mycobacterium
PEKVWRLLTEPALMKLWW

SEQ ID NO: 706900 - protein, 21 aa, Mycobacterium
PEKYRTFWTQFGRVLKEGLLS

SEQ ID NO: 706901 - protein, 20 aa, Mycobacterium
PELADKVLVAGVVDGRNIWR

SEQ ID NO: 706902 - protein, 17 aa, Mycobacterium
PELADLDHGCWRGNSLG

SEQ ID NO: 706903 - protein, 20 aa, Mycobacterium
PELADLLLARAMNVPELTPL

SEQ ID NO: 706904 - protein, 18 aa, Mycobacterium
PELADLLLGKVVGGLAPL

SEQ ID NO: 706905 - protein, 17 aa, Mycobacterium
PELAERVYGRLGTVADR

SEQ ID NO: 706906 - protein, 18 aa, Mycobacterium
PELAFAEHRSCAKAQTLV

SEQ ID NO: 706907 - protein, 18 aa, Mycobacterium
PELAFAEHRSCAKTQALV

SEQ ID NO: 706908 - protein, 18 aa, Mycobacterium
PELAGRWELPGGKVAAGE

SEQ ID NO: 706909 - protein, 25 aa, Mycobacterium
PELAIARWGIAYAVGPNYNKAWEAF

SEQ ID NO: 706910 - protein, 19 aa, Mycobacterium
PELAKLAGRLTVFQRTPPW

SEQ ID NO: 706911 - protein, 17 aa, Mycobacterium
PELAMALGSAAARRLGR

SEQ ID NO: 706912 - protein, 20 aa, Mycobacterium
PELARHAAHVIAERTGIGQH

SEQ ID NO: 706913 - protein, 18 aa, Mycobacterium
PELARLSLNIAATHHDSR

SEQ ID NO: 706914 - protein, 17 aa, Mycobacterium
PELARLTLNIAATHHDW

SEQ ID NO: 706915 - protein, 22 aa, Mycobacterium
PELATLMAHVKLALKDDLLAGE

SEQ ID NO: 706916 - protein, 27 aa, Mycobacterium
PELATLMAHVKLGLKDDLLASDAPDQE

SEQ ID NO: 706917 - protein, 26 aa, Mycobacterium
PELAYFEVLHELKLIVDLMYEGGIAR

SEQ ID NO: 706918 - protein, 20 aa, Mycobacterium
PELDAAFAFLQNGAGAVPGP

SEQ ID NO: 706919 - protein, 19 aa, Mycobacterium
PELDERSAAAMCYTSGTTG

SEQ ID NO: 706920 - protein, 20 aa, Mycobacterium
PELDGVLVNGVRVARGSRVR

SEQ ID NO: 706921 - protein, 23 aa, Mycobacterium
PELDLAAWARAFPLLVPVFDAAR

SEQ ID NO: 706922 - protein, 22 aa, Mycobacterium
PELDPGLANKVRAVAVFGNPGN

SEQ ID NO: 706923 - protein, 24 aa, Mycobacterium
PELEFKPGTRFEYSNSNYLLLAEI

SEQ ID NO: 706924 - protein, 17 aa, Mycobacterium
PELEVPIWADAPDDVCF

SEQ ID NO: 706925 - protein, 20 aa, Mycobacterium
PELFGAYLYSRAQSVMGGTS

SEQ ID NO: 706926 - protein, 18 aa, Mycobacterium
PELFLRRRGTAVMSSPIK

SEQ ID NO: 706927 - protein, 20 aa, Mycobacterium
PELFREYFGTVIPAGDNKFS

SEQ ID NO: 706928 - protein, 22 aa, Mycobacterium
PELGLDSMMAMNLLRDAKALVR

SEQ ID NO: 706929 - protein, 24 aa, Mycobacterium
PELGLKRENIVFISGIGCSSRFPY

SEQ ID NO: 706930 - protein, 22 aa, Mycobacterium
PELGRFGVWLGSRSITPELAGQ

SEQ ID NO: 706931 - protein, 18 aa, Mycobacterium
PELGRYDVTVAITQYEQD

SEQ ID NO: 706932 - protein, 18 aa, Mycobacterium
PELHELRTKCYWPVPWGN

SEQ ID NO: 706933 - protein, 18 aa, Mycobacterium
PELHGNILCIGFGGGMAA

SEQ ID NO: 706934 - protein, 35 aa, Mycobacterium
PELHLLGSVLWRRAMGLVLGGWVRAGDCTEIDAIR

SEQ ID NO: 706935 - protein, 26 aa, Mycobacterium
PELIPNMVSEIIRWQTPLAHMRRIAK

SEQ ID NO: 706936 - protein, 17 aa, Mycobacterium
PELIPVMGTAEALRGPF

SEQ ID NO: 706937 - protein, 23 aa, Mycobacterium
PELISRWAAYWPPGATEAAFRWA

SEQ ID NO: 706938 - protein, 23 aa, Mycobacterium
PELIYLVRFPLGVRSAMSKLGAT

SEQ ID NO: 706939 - protein, 19 aa, Mycobacterium
PELKLCMIHGADPWWDIAI

SEQ ID NO: 706940 - protein, 19 aa, Mycobacterium
PELKLCMIHGADPWWDVAI

SEQ ID NO: 706941 - protein, 22 aa, Mycobacterium
PELKNLPAGVARVVVAADDAAR

SEQ ID NO: 706942 - protein, 22 aa, Mycobacterium
PELKNLPTGIARVVLAADNANK

SEQ ID NO: 706943 - protein, 20 aa, Mycobacterium
PELLAAGVPVGMGVDGVASN

SEQ ID NO: 706944 - protein, 22 aa, Mycobacterium
PELLCYPGDLNQVWTNIIDNAI

SEQ ID NO: 706945 - protein, 17 aa, Mycobacterium
PELLDIVSRDNRRIYDM

SEQ ID NO: 706946 - protein, 17 aa, Mycobacterium
PELLDIVSRDNRRVYDM

SEQ ID NO: 706947 - protein, 20 aa, Mycobacterium
PELLDRLDIVVASVHSKLSM

SEQ ID NO: 706948 - protein, 21 aa, Mycobacterium
PELLERFLSACAVPMYHGYGP

SEQ ID NO: 706949 - protein, 18 aa, Mycobacterium
PELLGAFVEEVLRYEPPF

SEQ ID NO: 706950 - protein, 20 aa, Mycobacterium
PELLGLYPLSLSTRTQVLKG

SEQ ID NO: 706951 - protein, 27 aa, Mycobacterium
PELLQPMGIVHGGVYCSMIESMASVAA

SEQ ID NO: 706952 - protein, 23 aa, Mycobacterium
PELLRALIHPSLRPKTLTPKRDL

SEQ ID NO: 706953 - protein, 30 aa, Mycobacterium
PELLSLLRRRIKPLVKRRTKALVAAELPAK

SEQ ID NO: 706954 - protein, 20 aa, Mycobacterium
PELLVARFGDQVTCQPFAGS

SEQ ID NO: 706955 - protein, 24 aa, Mycobacterium
PELMTLEKIAAWAITEPDSGSDAF

SEQ ID NO: 706956 - protein, 18 aa, Mycobacterium
PELPEARFNQPELLVPTF

SEQ ID NO: 706957 - protein, 24 aa, Mycobacterium
PELPEFRTAWECYYQHMQRVGAEL

SEQ ID NO: 706958 - protein, 18 aa, Mycobacterium
PELPEHIASELVRIIGVL

SEQ ID NO: 706959 - protein, 25 aa, Mycobacterium
PELPEHLVIVGSGFVAAEFAHVFSS

SEQ ID NO: 706960 - protein, 17 aa, Mycobacterium
PELPESFVIKPTHGSGA

SEQ ID NO: 706961 - protein, 20 aa, Mycobacterium
PELPPPLRRLVLEGQAGVKR

SEQ ID NO: 706962 - protein, 18 aa, Mycobacterium
PELPRALPRFTRDLRQLW

SEQ ID NO: 706963 - protein, 27 aa, Mycobacterium
PELPRGFKHRPCHLSLAWTKPKTKAGA

SEQ ID NO: 706964 - protein, 28 aa, Mycobacterium
PELPTTVMPFILRGATLAGIDSVLLPIE

SEQ ID NO: 706965 - protein, 17 aa, Mycobacterium
PELPVTGYADLVRAVKK

SEQ ID NO: 706966 - protein, 28 aa, Mycobacterium
PELPWLARKRIQDDWGVSDEVMRDLVNA

SEQ ID NO: 706967 - protein, 17 aa, Mycobacterium
PELPWPDPDGWLSTVGA

SEQ ID NO: 706968 - protein, 25 aa, Mycobacterium
PELQAKLLADFGAWLDVTGDAYFNT

SEQ ID NO: 706969 - protein, 20 aa, Mycobacterium
PELQGRGVVRTEYTQNTLRE

SEQ ID NO: 706970 - protein, 20 aa, Mycobacterium
PELQRRGRYWLDYPDGTLRE

SEQ ID NO: 706971 - protein, 20 aa, Mycobacterium
PELQRRLWAVSEELTGVSYP

SEQ ID NO: 706972 - protein, 21 aa, Mycobacterium
PELRGPLAGVPFLIKDLDQEY

SEQ ID NO: 706973 - protein, 21 aa, Mycobacterium
PELRHACGLGTGRLFVEDVTD

SEQ ID NO: 706974 - protein, 20 aa, Mycobacterium
PELRHLRFDEVLDRLDEYGD

SEQ ID NO: 706975 - protein, 21 aa, Mycobacterium
PELRKKLTPTYAFGCKRPSMH

SEQ ID NO: 706976 - protein, 19 aa, Mycobacterium
PELRRAHERELLDNYRGRL

SEQ ID NO: 706977 - protein, 17 aa, Mycobacterium
PELRRLEAAIVAQDSSL

SEQ ID NO: 706978 - protein, 24 aa, Mycobacterium
PELRRRGRARAVGDPTTLRQRLFG

SEQ ID NO: 706979 - protein, 20 aa, Mycobacterium
PELRTPWPSQALKDLLVLLA

SEQ ID NO: 706980 - protein, 19 aa, Mycobacterium
PELSGLLEIGVRYLSRQTG

SEQ ID NO: 706981 - protein, 22 aa, Mycobacterium
PELSPPRVFGALRINVDGREVH

SEQ ID NO: 706982 - protein, 19 aa, Mycobacterium
PELSRACAAAGITFVGPGA

SEQ ID NO: 706983 - protein, 19 aa, Mycobacterium
PELSRARELLNWNPEIGLR

SEQ ID NO: 706984 - protein, 22 aa, Mycobacterium
PELTAACGAALMADDPAVTPLR

SEQ ID NO: 706985 - protein, 23 aa, Mycobacterium
PELTAACGTALMADDPAVQPLRA

SEQ ID NO: 706986 - protein, 23 aa, Mycobacterium
PELTGRDAVMEWLSEHRKQSPYP

SEQ ID NO: 706987 - protein, 28 aa, Mycobacterium
PELTGTFNWAIDWFDAIARGNDRPALWI

SEQ ID NO: 706988 - protein, 21 aa, Mycobacterium
PELVALLAGRRIAVLTGAGLS

SEQ ID NO: 706989 - protein, 19 aa, Mycobacterium
PELVAPVVGLLAHESCPVT

SEQ ID NO: 706990 - protein, 18 aa, Mycobacterium
PELVEKLVVWNIVGGVYG

SEQ ID NO: 706991 - protein, 19 aa, Mycobacterium
PELVGTFTVLLVENILPDA

SEQ ID NO: 706992 - protein, 20 aa, Mycobacterium
PELVGTFTVLLVENILPEAP

SEQ ID NO: 706993 - protein, 17 aa, Mycobacterium
PELVGTFTVLLVENIQP

SEQ ID NO: 706994 - protein, 21 aa, Mycobacterium
PELVKSAASVKVFQRTPGWVL

SEQ ID NO: 706995 - protein, 20 aa, Mycobacterium
PELVQLLLACLARGVMAFLA

SEQ ID NO: 706996 - protein, 20 aa, Mycobacterium
PELVSRWAAYMPPAPTQAFF

SEQ ID NO: 706997 - protein, 21 aa, Mycobacterium
PELVSRWAAYMPPGPTQAFFR

SEQ ID NO: 706998 - protein, 19 aa, Mycobacterium
PELVVTIGSMSKSFWGGMR

SEQ ID NO: 706999 - protein, 20 aa, Mycobacterium
PELVWKYRQLYRKGAYLPAE

SEQ ID NO: 707000 - protein, 20 aa, Mycobacterium
PELYDADVLTTRFSVGSFDA

SEQ ID NO: 707001 - protein, 23 aa, Mycobacterium
PELYRLATMGEWRSGSNVDSALD

SEQ ID NO: 707002 - protein, 19 aa, Mycobacterium
PELYWAARGAGPGFFGVVT

SEQ ID NO: 707003 - protein, 17 aa, Mycobacterium
PEMAEYVSTIFTEVIVA

SEQ ID NO: 707004 - protein, 17 aa, Mycobacterium
PEMAQLPGAHLVHGDKG

SEQ ID NO: 707005 - protein, 31 aa, Mycobacterium
PEMHLFTALGYRQYLFWTWAIYSGRLLHGRL

SEQ ID NO: 707006 - protein, 30 aa, Mycobacterium
PEMLSYELVRTVLRDGRFVTARGLGLDLQG

SEQ ID NO: 707007 - protein, 22 aa, Mycobacterium
PEMPRTASLDILLRRNPRGGPL

SEQ ID NO: 707008 - protein, 18 aa, Mycobacterium
PEMREWLRNWIAKATGVS

SEQ ID NO: 707009 - protein, 22 aa, Mycobacterium
PEMRVELGFTGGPGFNAEGLVY

SEQ ID NO: 707010 - protein, 17 aa, Mycobacterium
PEMTTLVGGLRVLDVNH

SEQ ID NO: 707011 - protein, 22 aa, Mycobacterium
PEMVSGLMADLMAFAGRTDIPI

SEQ ID NO: 707012 - protein, 21 aa, Mycobacterium
PENATPAYLGFNLFGHAIARA

SEQ ID NO: 707013 - protein, 17 aa, Mycobacterium
PENAVELFAQYDLILDG

SEQ ID NO: 707014 - protein, 25 aa, Mycobacterium
PENDMYPRLVVAVVRAVGDAAMDTY

SEQ ID NO: 707015 - protein, 22 aa, Mycobacterium
PENELEFFFFVLAFAGSDTTKN

SEQ ID NO: 707016 - protein, 21 aa, Mycobacterium
PENFFLFGLTVEEVQRLVHEG

SEQ ID NO: 707017 - protein, 22 aa, Mycobacterium
PENGCRMGICHTCTRRKTSGTV

SEQ ID NO: 707018 - protein, 18 aa, Mycobacterium
PENIKDELISGGNIAKFV

SEQ ID NO: 707019 - protein, 24 aa, Mycobacterium
PENKAALADWTWGRQSVDLLAQSP

SEQ ID NO: 707020 - protein, 20 aa, Mycobacterium
PENKAALDDWSWGRQSVDLL

SEQ ID NO: 707021 - protein, 18 aa, Mycobacterium
PENLDGLRKVLARREDGR

SEQ ID NO: 707022 - protein, 35 aa, Mycobacterium
PENLPRVNARGGPGGAPGCWQKISRDLWPAPELVM

SEQ ID NO: 707023 - protein, 25 aa, Mycobacterium
PENPKPLGMPLQYMVSGMAVAATHK

SEQ ID NO: 707024 - protein, 25 aa, Mycobacterium
PENPKPLGMPLQYMVSGMAVRATNR

SEQ ID NO: 707025 - protein, 20 aa, Mycobacterium
PENPYGLSLRQRNTPLRTES

SEQ ID NO: 707026 - protein, 17 aa, Mycobacterium
PENSGRELFTMPSEAVK

SEQ ID NO: 707027 - protein, 19 aa, Mycobacterium
PENTIRWNWERGDVAIWDN

SEQ ID NO: 707028 - protein, 18 aa, Mycobacterium
PENVIAIDAVPGFGTLAD

SEQ ID NO: 707029 - protein, 20 aa, Mycobacterium
PENVRFGIDYAPGASELLQY

SEQ ID NO: 707030 - protein, 26 aa, Mycobacterium
PENVWWSDLYWVFEIITDVIGGRSKI

SEQ ID NO: 707031 - protein, 23 aa, Mycobacterium
PENWRTSFEVDMMGTVGLVDAAL

SEQ ID NO: 707032 - protein, 17 aa, Mycobacterium
PEPAELCVVGDADQSIY

SEQ ID NO: 707033 - protein, 24 aa, Mycobacterium
PEPAELLVAVARLRLLARAAGITE

SEQ ID NO: 707034 - protein, 18 aa, Mycobacterium
PEPAIGQAMIRRAGADVT

SEQ ID NO: 707035 - protein, 26 aa, Mycobacterium
PEPALRLVAVARLRLLCRAAGITEVS

SEQ ID NO: 707036 - protein, 25 aa, Mycobacterium
PEPAPRLGEHTDLYRSRNCHHGSEA

SEQ ID NO: 707037 - protein, 22 aa, Mycobacterium
PEPDARMARPMSVRRFDGTPTT

SEQ ID NO: 707038 - protein, 18 aa, Mycobacterium
PEPDAVLRTIARYRVTNY

SEQ ID NO: 707039 - protein, 19 aa, Mycobacterium
PEPDEFIWDRPIRRSLAFG

SEQ ID NO: 707040 - protein, 20 aa, Mycobacterium
PEPDEFIWDRPIRRSLAFGR

SEQ ID NO: 707041 - protein, 27 aa, Mycobacterium
PEPDLPLRFALNLSVFVGVTAEGTQLI

SEQ ID NO: 707042 - protein, 25 aa, Mycobacterium
PEPDLPSWRSAIDVATREWVAGTAD

SEQ ID NO: 707043 - protein, 22 aa, Mycobacterium
PEPDRENWRVLGIVHLADTREQ

SEQ ID NO: 707044 - protein, 23 aa, Mycobacterium
PEPEAYVTWDYCRGYADASLNEA

SEQ ID NO: 707045 - protein, 24 aa, Mycobacterium
PEPELPLRFAVNLSVFVATTPEGA

SEQ ID NO: 707046 - protein, 20 aa, Mycobacterium
PEPFTIYAHHPGVMLAGAMH

SEQ ID NO: 707047 - protein, 19 aa, Mycobacterium
PEPGHALSPDLHVDHHMYL

SEQ ID NO: 707048 - protein, 24 aa, Mycobacterium
PEPGHKAAPSWLDKAGFTPFSGIA

SEQ ID NO: 707049 - protein, 24 aa, Mycobacterium
PEPGQTLCSTWDLTDWQGNPIRLG

SEQ ID NO: 707050 - protein, 27 aa, Mycobacterium
PEPGQTLCSTWDLTDWRGKPIRIGFAV

SEQ ID NO: 707051 - protein, 21 aa, Mycobacterium
PEPHPAIPATPWQHTRHWITA

SEQ ID NO: 707052 - protein, 20 aa, Mycobacterium
PEPHRRPLQVIAESARTLTD

SEQ ID NO: 707053 - protein, 21 aa, Mycobacterium
PEPIALPGAQARVFLGELAGS

SEQ ID NO: 707054 - protein, 20 aa, Mycobacterium
PEPKYGLAVTGIADPKRLLR

SEQ ID NO: 707055 - protein, 17 aa, Mycobacterium
PEPLFVDSFAERLVLGS

SEQ ID NO: 707056 - protein, 20 aa, Mycobacterium
PEPLGKVGEVARQARAAGFS

SEQ ID NO: 707057 - protein, 21 aa, Mycobacterium
PEPLGMPLQYMVSGMAVAATH

SEQ ID NO: 707058 - protein, 21 aa, Mycobacterium
PEPLGRFSAITREWFTNTFAA

SEQ ID NO: 707059 - protein, 23 aa, Mycobacterium
PEPLKASVLLAWDQAIRRVRGRG

SEQ ID NO: 707060 - protein, 25 aa, Mycobacterium
PEPLKYGLVGAWSRRITHEHRLVYR

SEQ ID NO: 707061 - protein, 21 aa, Mycobacterium
PEPLPAKMLFISAGSGITPII

SEQ ID NO: 707062 - protein, 20 aa, Mycobacterium
PEPLPAPVADQWQDRALCAQ

SEQ ID NO: 707063 - protein, 21 aa, Mycobacterium
PEPLPGKLLFISAGSGITPII

SEQ ID NO: 707064 - protein, 20 aa, Mycobacterium
PEPLPPKLLFISAGSGITPV

SEQ ID NO: 707065 - protein, 22 aa, Mycobacterium
PEPLPTPIVAFAVRHSGAVAGI

SEQ ID NO: 707066 - protein, 18 aa, Mycobacterium
PEPLRPGADQSISGVAGI

SEQ ID NO: 707067 - protein, 19 aa, Mycobacterium
PEPMPAPVADQWQDRALCA

SEQ ID NO: 707068 - protein, 21 aa, Mycobacterium
PEPNVFPGARFAGTAEQRDAR

SEQ ID NO: 707069 - protein, 17 aa, Mycobacterium
PEPPLRIVGEQQVVDEA

SEQ ID NO: 707070 - protein, 24 aa, Mycobacterium
PEPPRYAFIGVRACDLAAINKLNG

SEQ ID NO: 707071 - protein, 20 aa, Mycobacterium
PEPPYKWIPIMIDPPDHAKW

SEQ ID NO: 707072 - protein, 20 aa, Mycobacterium
PEPQRDALAVAFGLGVGQTP

SEQ ID NO: 707073 - protein, 21 aa, Mycobacterium
PEPRALSWTVYSVPRIPPGAY

SEQ ID NO: 707074 - protein, 23 aa, Mycobacterium
PEPRGAAIPPGRPGGRPWTYTPP

SEQ ID NO: 707075 - protein, 17 aa, Mycobacterium
PEPRLVQAAQRCVTALL

SEQ ID NO: 707076 - protein, 19 aa, Mycobacterium
PEPRRIAYRHLDNWLDHYL

SEQ ID NO: 707077 - protein, 28 aa, Mycobacterium
PEPRTFSLRVARLLADRVGDFDLVHDNQ

SEQ ID NO: 707078 - protein, 27 aa, Mycobacterium
PEPRTFTLRAARLLAERTADFDVVHDN

SEQ ID NO: 707079 - protein, 25 aa, Mycobacterium
PEPRYRPSRKLADFVRCRDQTCRFP

SEQ ID NO: 707080 - protein, 19 aa, Mycobacterium
PEPTRAAALGTDLHLELAV

SEQ ID NO: 707081 - protein, 17 aa, Mycobacterium
PEPTVGSPIDWNSPAPL

SEQ ID NO: 707082 - protein, 19 aa, Mycobacterium
PEPVAPPSPIMEPLAQPEG

SEQ ID NO: 707083 - protein, 20 aa, Mycobacterium
PEPVDASALDWLVDGQRTLP

SEQ ID NO: 707084 - protein, 17 aa, Mycobacterium
PEPVLALIGKDLPPVSG

SEQ ID NO: 707085 - protein, 18 aa, Mycobacterium
PEPWRDVDGLLVPTPFDQ

SEQ ID NO: 707086 - protein, 24 aa, Mycobacterium
PEPWRSKYFLNRNVGELIYYDAPD

SEQ ID NO: 707087 - protein, 25 aa, Mycobacterium
PEPWRVEALVLLAFSAYVRGDGPLA

SEQ ID NO: 707088 - protein, 20 aa, Mycobacterium
PEPYASGALVGVHGSWNRQP

SEQ ID NO: 707089 - protein, 18 aa, Mycobacterium
PEPYRLLVGGYRDLVQRI

SEQ ID NO: 707090 - protein, 22 aa, Mycobacterium
PEQARRLLVQTAERCFAENGLD

SEQ ID NO: 707091 - protein, 17 aa, Mycobacterium
PEQGLPYQRMAPVPPVH

SEQ ID NO: 707092 - protein, 20 aa, Mycobacterium
PEQHGGGGLGVIELSIVAEE

SEQ ID NO: 707093 - protein, 21 aa, Mycobacterium
PEQIDRLLVPLLRGDEWWALG

SEQ ID NO: 707094 - protein, 17 aa, Mycobacterium
PEQIGAFARLPSPSDPL

SEQ ID NO: 707095 - protein, 29 aa, Mycobacterium
PEQLFAAGWSACFLSAMGVTAPKHNVKLP

SEQ ID NO: 707096 - protein, 18 aa, Mycobacterium
PEQLGMNDVKSWIAFGAS

SEQ ID NO: 707097 - protein, 18 aa, Mycobacterium
PEQLLAAIERYRATSIMG

SEQ ID NO: 707098 - protein, 20 aa, Mycobacterium
PEQLNAFNRTMCEEMARAWH

SEQ ID NO: 707099 - protein, 25 aa, Mycobacterium
PEQLPWVQLVAEWRADARGLKVDRA

SEQ ID NO: 707100 - protein, 17 aa, Mycobacterium
PEQPVPIYVSGFGPKGV

SEQ ID NO: 707101 - protein, 19 aa, Mycobacterium
PEQQLAILAVRLEMAAVYL

SEQ ID NO: 707102 - protein, 23 aa, Mycobacterium
PEQRARPGARAALFGMTEAFGPY

SEQ ID NO: 707103 - protein, 18 aa, Mycobacterium
PEQRRQRALGGFATFFGD

SEQ ID NO: 707104 - protein, 19 aa, Mycobacterium
PEQSHLLLVYTAVPGSESR

SEQ ID NO: 707105 - protein, 26 aa, Mycobacterium
PEQTAETFKNGWLRTGDVAREDEDGF

SEQ ID NO: 707106 - protein, 19 aa, Mycobacterium
PEQTTAVSILDRLLHHATV

SEQ ID NO: 707107 - protein, 24 aa, Mycobacterium
PEQVREILEPLGLSQEEPHGTQAR

SEQ ID NO: 707108 - protein, 20 aa, Mycobacterium
PEQVVDCTFLEHLFSTTRDS

SEQ ID NO: 707109 - protein, 21 aa, Mycobacterium
PEQVWTQWVSYSFDVSVWEIW

SEQ ID NO: 707110 - protein, 19 aa, Mycobacterium
PEQYWPLTGLTSLTVGQSM

SEQ ID NO: 707111 - protein, 23 aa, Mycobacterium
PERAARRLVHIPLGRFAEPEELA

SEQ ID NO: 707112 - protein, 17 aa, Mycobacterium
PERAMGIARRIRTGAIG

SEQ ID NO: 707113 - protein, 23 aa, Mycobacterium
PERARLGALARHIADELTRRAPR

SEQ ID NO: 707114 - protein, 24 aa, Mycobacterium
PERCARVAGLAVRHARLKSIAAKD

SEQ ID NO: 707115 - protein, 23 aa, Mycobacterium
PERCARVAGLAVRHARLRHVAPA

SEQ ID NO: 707116 - protein, 24 aa, Mycobacterium
PERCARVAGLAVRHARLRSIAPSD

SEQ ID NO: 707117 - protein, 24 aa, Mycobacterium
PERCARVAGLAVRHARLRYVAPAD

SEQ ID NO: 707118 - protein, 23 aa, Mycobacterium
PERDGKRPGGIELDRRVYPLRKR

SEQ ID NO: 707119 - protein, 23 aa, Mycobacterium
PERDRQAIAMGRRGRPEEQAGAI

SEQ ID NO: 707120 - protein, 23 aa, Mycobacterium
PERDRTAIAMGRRGTPEEQAGAI

SEQ ID NO: 707121 - protein, 17 aa, Mycobacterium
PERELAEQLGVNRTSLR

SEQ ID NO: 707122 - protein, 17 aa, Mycobacterium
PERELATRLGVSRDTVR

SEQ ID NO: 707123 - protein, 26 aa, Mycobacterium
PERFLGDLEKCWSLLLTGILQPDRID

SEQ ID NO: 707124 - protein, 24 aa, Mycobacterium
PERFLLDLEKSWLIILGGILQADR

SEQ ID NO: 707125 - protein, 26 aa, Mycobacterium
PERFQWWKVLGTLWWGVGLAAQAKSY

SEQ ID NO: 707126 - protein, 18 aa, Mycobacterium
PERGEEILHSAVVQQLAT

SEQ ID NO: 707127 - protein, 20 aa, Mycobacterium
PERGYFLDQSFRMHPDVCRA

SEQ ID NO: 707128 - protein, 18 aa, Mycobacterium
PERICADLASALAQVPRG

SEQ ID NO: 707129 - protein, 17 aa, Mycobacterium
PERITFHGNNKSVAELT

SEQ ID NO: 707130 - protein, 17 aa, Mycobacterium
PERITLHGNNKSVAELT

SEQ ID NO: 707131 - protein, 24 aa, Mycobacterium
PERKRLGFSAVRCTVSLAGDADEA

SEQ ID NO: 707132 - protein, 17 aa, Mycobacterium
PERLEECIHAFSSALRD

SEQ ID NO: 707133 - protein, 18 aa, Mycobacterium
PERLPAAEALSWGLVSAV

SEQ ID NO: 707134 - protein, 20 aa, Mycobacterium
PERLPADHPLAAHYDVYQWL

SEQ ID NO: 707135 - protein, 25 aa, Mycobacterium
PERLRAGAEVADFGCGSGHAVNLMA

SEQ ID NO: 707136 - protein, 23 aa, Mycobacterium
PERLRSSFINGIKHWPVDYRGGH

SEQ ID NO: 707137 - protein, 17 aa, Mycobacterium
PERMCLLGHEWMPASER

SEQ ID NO: 707138 - protein, 20 aa, Mycobacterium
PERNRTGVIEGLRRSGDPAQ

SEQ ID NO: 707139 - protein, 17 aa, Mycobacterium
PERPIPGPLKWDLTMGV

SEQ ID NO: 707140 - protein, 29 aa, Mycobacterium
PERPTPGPLKWDLTMGVATDTRESLANSG

SEQ ID NO: 707141 - protein, 28 aa, Mycobacterium
PERPTPGPLKWNLTLGVATDTRESLANS

SEQ ID NO: 707142 - protein, 18 aa, Mycobacterium
PERPTWRAKVRNLPSLDA

SEQ ID NO: 707143 - protein, 23 aa, Mycobacterium
PERQARYLIDIARAHLLTRSGRG

SEQ ID NO: 707144 - protein, 22 aa, Mycobacterium
PERQARYLVDMARAHLLTRSGR

SEQ ID NO: 707145 - protein, 21 aa, Mycobacterium
PERQIIFRVPWIRDDGAVEIN

SEQ ID NO: 707146 - protein, 17 aa, Mycobacterium
PERQVSFEPSVSSLYSA

SEQ ID NO: 707147 - protein, 20 aa, Mycobacterium
PERRAPRFDGDVSELPDRAC

SEQ ID NO: 707148 - protein, 24 aa, Mycobacterium
PERRLPGEVAHRGAFGRAQALDSR

SEQ ID NO: 707149 - protein, 20 aa, Mycobacterium
PERRRGMAVVISDFLGPINW

SEQ ID NO: 707150 - protein, 20 aa, Mycobacterium
PERRRMFCVDAGDLAATVAL

SEQ ID NO: 707151 - protein, 26 aa, Mycobacterium
PERTPHVLGCIYSVFTEGYWATGGPS

SEQ ID NO: 707152 - protein, 27 aa, Mycobacterium
PERTRMWWRPAESIPNDPVLNCCVLTY

SEQ ID NO: 707153 - protein, 26 aa, Mycobacterium
PERVASYRAAGYWTGRSIGSLLRQAA

SEQ ID NO: 707154 - protein, 26 aa, Mycobacterium
PERVKEIFRKAAIDLGRHEFFQGSGL

SEQ ID NO: 707155 - protein, 22 aa, Mycobacterium
PERVKENFELFDFELDDSDMAA

SEQ ID NO: 707156 - protein, 25 aa, Mycobacterium
PERVLFRRIAVFLGGFDLDAAQAVA

SEQ ID NO: 707157 - protein, 20 aa, Mycobacterium
PERVLRNAFTAAWDGRTPDD

SEQ ID NO: 707158 - protein, 19 aa, Mycobacterium
PERVWSLVCDVELMPTLSN

SEQ ID NO: 707159 - protein, 18 aa, Mycobacterium
PERYAKQLAQHWAAKSTV

SEQ ID NO: 707160 - protein, 20 aa, Mycobacterium
PERYIPLAILPTWDIDACVA

SEQ ID NO: 707161 - protein, 18 aa, Mycobacterium
PESAAGIFRGFRSDAGEQ

SEQ ID NO: 707162 - protein, 17 aa, Mycobacterium
PESACRDLAREADDVVC

SEQ ID NO: 707163 - protein, 22 aa, Mycobacterium
PESDGRDGLVLPVMGTVEAGSR

SEQ ID NO: 707164 - protein, 26 aa, Mycobacterium
PESDVYWCTADIGWVTGHSYIVYGPL

SEQ ID NO: 707165 - protein, 21 aa, Mycobacterium
PESEPMIIGKAFGVKINANIG

SEQ ID NO: 707166 - protein, 25 aa, Mycobacterium
PESEPMIIGRAFRVKVNAGIGSPPD

SEQ ID NO: 707167 - protein, 23 aa, Mycobacterium
PESESRLALPRWLAESLPAPLPR

SEQ ID NO: 707168 - protein, 20 aa, Mycobacterium
PESFDAAGFAAYLSAQQDLG

SEQ ID NO: 707169 - protein, 18 aa, Mycobacterium
PESFSRQVLQSFIDNAPE

SEQ ID NO: 707170 - protein, 19 aa, Mycobacterium
PESFWQLLVDGVDTIGEVP

SEQ ID NO: 707171 - protein, 18 aa, Mycobacterium
PESGAFLRQFLASPPGQR

SEQ ID NO: 707172 - protein, 22 aa, Mycobacterium
PESGCRMGICHTCTRRKTSGTV

SEQ ID NO: 707173 - protein, 19 aa, Mycobacterium
PESGPGWHIGVLPLQDGTT

SEQ ID NO: 707174 - protein, 25 aa, Mycobacterium
PESGYRPSVGLAEFVRMRDLTCRFP

SEQ ID NO: 707175 - protein, 19 aa, Mycobacterium
PESHAMFVALAYAKLNGVR

SEQ ID NO: 707176 - protein, 18 aa, Mycobacterium
PESLDGLRKVLRQRDDGR

SEQ ID NO: 707177 - protein, 18 aa, Mycobacterium
PESLFLLLFTSGTTGASK

SEQ ID NO: 707178 - protein, 18 aa, Mycobacterium
PESLIIMLGGWKQYTGRS

SEQ ID NO: 707179 - protein, 20 aa, Mycobacterium
PESLNSFNRTMCEEMRQIWH

SEQ ID NO: 707180 - protein, 25 aa, Mycobacterium
PESLPDDFILYWGFLATAQVLTGRY

SEQ ID NO: 707181 - protein, 17 aa, Mycobacterium
PESLSIYNVQGRSVSRD

SEQ ID NO: 707182 - protein, 20 aa, Mycobacterium
PESLVGRLADFLLESMPVQI

SEQ ID NO: 707183 - protein, 24 aa, Mycobacterium
PESLWRECAELGLLTLGLDEASGG

SEQ ID NO: 707184 - protein, 19 aa, Mycobacterium
PESMVSFTIAGTGAPYHTV

SEQ ID NO: 707185 - protein, 18 aa, Mycobacterium
PESMVYSSAFVLCAGRDD

SEQ ID NO: 707186 - protein, 28 aa, Mycobacterium
PESPLPDLKPRWERPTTAPDSETPSITQ

SEQ ID NO: 707187 - protein, 19 aa, Mycobacterium
PESPPGWNPADHERSDEYF

SEQ ID NO: 707188 - protein, 18 aa, Mycobacterium
PESPRPVVQIPLGGDLIH

SEQ ID NO: 707189 - protein, 24 aa, Mycobacterium
PESPRPVVQIPLGNDLIHAPTGAV

SEQ ID NO: 707190 - protein, 19 aa, Mycobacterium
PESPRPVVQVPLGNDLIHA

SEQ ID NO: 707191 - protein, 22 aa, Mycobacterium
PESPRQLFRDHIYGCFIEDDFG

SEQ ID NO: 707192 - protein, 24 aa, Mycobacterium
PESQDPRVAWAFEGISYDERLGDF

SEQ ID NO: 707193 - protein, 22 aa, Mycobacterium
PESQVPWPGVVMYPDAGGVRGT

SEQ ID NO: 707194 - protein, 24 aa, Mycobacterium
PESRFPAQIEQIYAAALWAQEQNG

SEQ ID NO: 707195 - protein, 25 aa, Mycobacterium
PESRLMLETAGERPHYMPLFVAPQP

SEQ ID NO: 707196 - protein, 25 aa, Mycobacterium
PESRRAYTRVLLKLGGEMFGGGQVG

SEQ ID NO: 707197 - protein, 21 aa, Mycobacterium
PESTFSFFRHIIKLRKERAEF

SEQ ID NO: 707198 - protein, 19 aa, Mycobacterium
PESTRWLQVKTRHEPERTV

SEQ ID NO: 707199 - protein, 17 aa, Mycobacterium
PESVAIVLFTSGTTSQP

SEQ ID NO: 707200 - protein, 18 aa, Mycobacterium
PESVEFYEAALLDALARR

SEQ ID NO: 707201 - protein, 36 aa, Mycobacterium
PESVFPGIEHWPARAVKDHRRVLVALKKHDDKAART

SEQ ID NO: 707202 - protein, 17 aa, Mycobacterium
PESVTAWSQRSSQLREW

SEQ ID NO: 707203 - protein, 20 aa, Mycobacterium
PETAELLYGTALLAEGGTPE

SEQ ID NO: 707204 - protein, 17 aa, Mycobacterium
PETAQGIFVNFANVLTT

SEQ ID NO: 707205 - protein, 18 aa, Mycobacterium
PETAQGIFVNFANVVTTA

SEQ ID NO: 707206 - protein, 18 aa, Mycobacterium
PETDEMYTLFPRLAPGRA

SEQ ID NO: 707207 - protein, 23 aa, Mycobacterium
PETDHPRRAAVSSFGMGGTNAHI

SEQ ID NO: 707208 - protein, 21 aa, Mycobacterium
PETFPGTVAVIPRFQELIAPY

SEQ ID NO: 707209 - protein, 23 aa, Mycobacterium
PETGEKALLLGNFVKRILDVSAS

SEQ ID NO: 707210 - protein, 23 aa, Mycobacterium
PETGERVLLLGHFVKSFVGLKDT

SEQ ID NO: 707211 - protein, 25 aa, Mycobacterium
PETGLDLFAGLGLLQSVGEPVEVGA

SEQ ID NO: 707212 - protein, 20 aa, Mycobacterium
PETGYAHTFLTQFREVAAEC

SEQ ID NO: 707213 - protein, 25 aa, Mycobacterium
PETHSRTDIRWHPSALDREYRWDST

SEQ ID NO: 707214 - protein, 18 aa, Mycobacterium
PETIELWNKISTIEDPEW

SEQ ID NO: 707215 - protein, 21 aa, Mycobacterium
PETIMHFLLSGARPWRRSLKT

SEQ ID NO: 707216 - protein, 17 aa, Mycobacterium
PETKIIVMIGEIGGDAE

SEQ ID NO: 707217 - protein, 23 aa, Mycobacterium
PETKSFGGIEMLKQATVQMSSMS

SEQ ID NO: 707218 - protein, 18 aa, Mycobacterium
PETLARYVVQKGSITVDG

SEQ ID NO: 707219 - protein, 20 aa, Mycobacterium
PETLGAWVIKCNPSRTPVEA

SEQ ID NO: 707220 - protein, 24 aa, Mycobacterium
PETLSGAGLSDGWAVVVDGGGAPL

SEQ ID NO: 707221 - protein, 20 aa, Mycobacterium
PETPAAVVAFASWPQQVVLR

SEQ ID NO: 707222 - protein, 20 aa, Mycobacterium
PETPALPPTRVPEMLTPGRT

SEQ ID NO: 707223 - protein, 21 aa, Mycobacterium
PETPTAVVAFASWPQQCVLRG

SEQ ID NO: 707224 - protein, 22 aa, Mycobacterium
PETQRAVPLGPLYRKSGSLRGF

SEQ ID NO: 707225 - protein, 19 aa, Mycobacterium
PETRAHVAEMLRGNLLSRK

SEQ ID NO: 707226 - protein, 21 aa, Mycobacterium
PETREIWSFGSGYGGNALLGK

SEQ ID NO: 707227 - protein, 25 aa, Mycobacterium
PETRGHEFLQFLAAVRAELTDPLTP

SEQ ID NO: 707228 - protein, 20 aa, Mycobacterium
PETRRAPGFRGDVANDQERH

SEQ ID NO: 707229 - protein, 21 aa, Mycobacterium
PETRTRAVLMIAIEHESPDRL

SEQ ID NO: 707230 - protein, 27 aa, Mycobacterium
PETTRYEAWSFPDFSTGVAALRAITQT

SEQ ID NO: 707231 - protein, 23 aa, Mycobacterium
PETVIPYYPYFSFVQRPFEMRPE

SEQ ID NO: 707232 - protein, 18 aa, Mycobacterium
PETVLDIAGQVGYDGLPS

SEQ ID NO: 707233 - protein, 25 aa, Mycobacterium
PETVRRLCWDWQPPADGDATAAVEA

SEQ ID NO: 707234 - protein, 23 aa, Mycobacterium
PETVVTPGIYVDRVLDLSAIPET

SEQ ID NO: 707235 - protein, 24 aa, Mycobacterium
PETYWWAHATFQMMVHRLAEHWDV

SEQ ID NO: 707236 - protein, 24 aa, Mycobacterium
PEVAAAWDRVFWIMADTLIALERN

SEQ ID NO: 707237 - protein, 20 aa, Mycobacterium
PEVAAGARWYCVDGCGSSGV

SEQ ID NO: 707238 - protein, 17 aa, Mycobacterium
PEVAAVLSPLDLALPEF

SEQ ID NO: 707239 - protein, 18 aa, Mycobacterium
PEVACALHRGLLQGLAGP

SEQ ID NO: 707240 - protein, 17 aa, Mycobacterium
PEVAELVVFQRTPNFVV

SEQ ID NO: 707241 - protein, 29 aa, Mycobacterium
PEVAELWRRGSVIGSWLLDLTAIALHESP

SEQ ID NO: 707242 - protein, 18 aa, Mycobacterium
PEVAFAMVQLGLAFDDMN

SEQ ID NO: 707243 - protein, 21 aa, Mycobacterium
PEVAKAYQLLAPESRTASIEY

SEQ ID NO: 707244 - protein, 17 aa, Mycobacterium
PEVAKRESLGFRAALRD

SEQ ID NO: 707245 - protein, 26 aa, Mycobacterium
PEVAMSLPLGAGRLTREWLPDDPPGR

SEQ ID NO: 707246 - protein, 22 aa, Mycobacterium
PEVARAWSTYAPTVVRLPDGRV

SEQ ID NO: 707247 - protein, 23 aa, Mycobacterium
PEVARPWSSYAPTVVKLPDGSVK

SEQ ID NO: 707248 - protein, 22 aa, Mycobacterium
PEVARWLCPALPNAVDRKDMRH

SEQ ID NO: 707249 - protein, 21 aa, Mycobacterium
PEVDGFVWHCFIPNIEPGQRY

SEQ ID NO: 707250 - protein, 20 aa, Mycobacterium
PEVDPAELIAADWPTLHRRI

SEQ ID NO: 707251 - protein, 17 aa, Mycobacterium
PEVESWADFFAAQRKHK

SEQ ID NO: 707252 - protein, 25 aa, Mycobacterium
PEVEYAREGYDMFIGMLDGMKEESV

SEQ ID NO: 707253 - protein, 18 aa, Mycobacterium
PEVFFPAVPADAWTELVT

SEQ ID NO: 707254 - protein, 19 aa, Mycobacterium
PEVHSALLSAGPGPGPLLA

SEQ ID NO: 707255 - protein, 25 aa, Mycobacterium
PEVIADGPIPLARLIPAGVDTRGNT

SEQ ID NO: 707256 - protein, 25 aa, Mycobacterium
PEVIADGPIPLARLIPAGVDVRGNA

SEQ ID NO: 707257 - protein, 21 aa, Mycobacterium
PEVIARIAAGVAHGNAKLSRV

SEQ ID NO: 707258 - protein, 19 aa, Mycobacterium
PEVIASPTPAAAGRVQAWV

SEQ ID NO: 707259 - protein, 17 aa, Mycobacterium
PEVIAYLEAENDYADRM

SEQ ID NO: 707260 - protein, 20 aa, Mycobacterium
PEVIEATALGVDDPEWGARL

SEQ ID NO: 707261 - protein, 25 aa, Mycobacterium
PEVIKASGAADGWWVGSELMGTIFM

SEQ ID NO: 707262 - protein, 20 aa, Mycobacterium
PEVINAALALWGPADLARLW

SEQ ID NO: 707263 - protein, 21 aa, Mycobacterium
PEVITRIAAGVAEGNAKLSRV

SEQ ID NO: 707264 - protein, 27 aa, Mycobacterium
PEVIVAVALPRSARLVVALLAIAKTGA

SEQ ID NO: 707265 - protein, 21 aa, Mycobacterium
PEVKEAWHAVAGRDMPDTPRP

SEQ ID NO: 707266 - protein, 26 aa, Mycobacterium
PEVKKWLSEVLPNFPVYAHMLGNFSV

SEQ ID NO: 707267 - protein, 18 aa, Mycobacterium
PEVLAAGARRIVVVRAIT

SEQ ID NO: 707268 - protein, 20 aa, Mycobacterium
PEVLARLTAQRAHWPVGTLQ

SEQ ID NO: 707269 - protein, 20 aa, Mycobacterium
PEVLASARFREGLKNIPGAT

SEQ ID NO: 707270 - protein, 24 aa, Mycobacterium
PEVLAVAGRDLASIGSAISQANVA

SEQ ID NO: 707271 - protein, 17 aa, Mycobacterium
PEVLAYVVDVIRATRQS

SEQ ID NO: 707272 - protein, 22 aa, Mycobacterium
PEVLDRLTPRLAPPDWSPDSPS

SEQ ID NO: 707273 - protein, 18 aa, Mycobacterium
PEVLIPIQCEYYALEGVG

SEQ ID NO: 707274 - protein, 19 aa, Mycobacterium
PEVLIPIQCEYYALEGVGQ

SEQ ID NO: 707275 - protein, 26 aa, Mycobacterium
PEVLRRNLIESPAWYTAYTPYQPEIS

SEQ ID NO: 707276 - protein, 17 aa, Mycobacterium
PEVLRSWVSALSGKIER

SEQ ID NO: 707277 - protein, 22 aa, Mycobacterium
PEVLSYHLVRSVLRDARFQIPP

SEQ ID NO: 707278 - protein, 26 aa, Mycobacterium
PEVLTKPRWFFSFAKTLRPPDLRVPN

SEQ ID NO: 707279 - protein, 20 aa, Mycobacterium
PEVMSRWLATVLPGGAAPEV

SEQ ID NO: 707280 - protein, 19 aa, Mycobacterium
PEVNSLRMFTGAGSAPMLD

SEQ ID NO: 707281 - protein, 21 aa, Mycobacterium
PEVPDGVPWWDPLADNAVDPA

SEQ ID NO: 707282 - protein, 21 aa, Mycobacterium
PEVPEPLAGRMTVAVRYAAVG

SEQ ID NO: 707283 - protein, 20 aa, Mycobacterium
PEVPGATVIDGRGCLATPGL

SEQ ID NO: 707284 - protein, 17 aa, Mycobacterium
PEVPGPESLPWVAPHLA

SEQ ID NO: 707285 - protein, 20 aa, Mycobacterium
PEVPLVLGVADAVRAAGIAC

SEQ ID NO: 707286 - protein, 17 aa, Mycobacterium
PEVPTAWSAEGLIIYLP

SEQ ID NO: 707287 - protein, 18 aa, Mycobacterium
PEVPVFALTTGPRWPDVS

SEQ ID NO: 707288 - protein, 22 aa, Mycobacterium
PEVQRVWSHFMQKWIDYTAASI

SEQ ID NO: 707289 - protein, 19 aa, Mycobacterium
PEVRAHALAIGDDLVGRGV

SEQ ID NO: 707290 - protein, 30 aa, Mycobacterium
PEVRDLRRMGSCALDLCAVAAGRLDAYFED

SEQ ID NO: 707291 - protein, 21 aa, Mycobacterium
PEVRELWEARVHEAAAATQGP

SEQ ID NO: 707292 - protein, 19 aa, Mycobacterium
PEVRHVFDSIKLGKTVPTP

SEQ ID NO: 707293 - protein, 20 aa, Mycobacterium
PEVRIGASLVHLGHAARLWS

SEQ ID NO: 707294 - protein, 27 aa, Mycobacterium
PEVRNGGTWDALARCEAGGNWSINTGN

SEQ ID NO: 707295 - protein, 31 aa, Mycobacterium
PEVRQLMLLDAPSVLGWAGFRDVAQRYSLGM

SEQ ID NO: 707296 - protein, 20 aa, Mycobacterium
PEVRRRWREAQDMLVQSWAD

SEQ ID NO: 707297 - protein, 19 aa, Mycobacterium
PEVSFYPWRDGGLGDQQTL

SEQ ID NO: 707298 - protein, 17 aa, Mycobacterium
PEVSYGNPLPGRRAAIG

SEQ ID NO: 707299 - protein, 18 aa, Mycobacterium
PEVTAALHEREWLRSDAL

SEQ ID NO: 707300 - protein, 22 aa, Mycobacterium
PEVVARIAGPEADEARVIAATM

SEQ ID NO: 707301 - protein, 35 aa, Mycobacterium
PEVVAVEAIKVFAAVAFQAGELVLLGVPQTVDAAA

SEQ ID NO: 707302 - protein, 21 aa, Mycobacterium
PEVVDRFAPGRVMVNAYGPTE

SEQ ID NO: 707303 - protein, 23 aa, Mycobacterium
PEVVEATLALPVHELIADGEAIA

SEQ ID NO: 707304 - protein, 20 aa, Mycobacterium
PEVVEATLALPVTDLIADAE

SEQ ID NO: 707305 - protein, 19 aa, Mycobacterium
PEVVEFWQGRENRLHNRIR

SEQ ID NO: 707306 - protein, 20 aa, Mycobacterium
PEVVIPMLVPDGAHTYPDGA

SEQ ID NO: 707307 - protein, 20 aa, Mycobacterium
PEVVRRSGVDPAAIDDIIFA

SEQ ID NO: 707308 - protein, 20 aa, Mycobacterium
PEVVRRSGVDPTAIDDIIFA

SEQ ID NO: 707309 - protein, 27 aa, Mycobacterium
PEVVTKPSWLWSFGKGMNIPDLRVPNQ

SEQ ID NO: 707310 - protein, 21 aa, Mycobacterium
PEVVTRLVLVDVVPRYEKGGS

SEQ ID NO: 707311 - protein, 17 aa, Mycobacterium
PEVVVFPGGIGTRQLIH

SEQ ID NO: 707312 - protein, 18 aa, Mycobacterium
PEVWSALVEFGLPGLAVD

SEQ ID NO: 707313 - protein, 23 aa, Mycobacterium
PEVYRMPASYPLRDEPGLTGEEA

SEQ ID NO: 707314 - protein, 20 aa, Mycobacterium
PEWARQLGWVEDFVREECEP

SEQ ID NO: 707315 - protein, 29 aa, Mycobacterium
PEWDVARKSYRPAWCTVREIQPEIKATAT

SEQ ID NO: 707316 - protein, 27 aa, Mycobacterium
PEWHSGEWTDWKWNSMLIEGSNCREII

SEQ ID NO: 707317 - protein, 21 aa, Mycobacterium
PEWLDRIQIKYMNPVIKPLAG

SEQ ID NO: 707318 - protein, 18 aa, Mycobacterium
PEWLWAAAHRLGIGPEAA

SEQ ID NO: 707319 - protein, 22 aa, Mycobacterium
PEWPQMLLRALIFRLAVHALHP

SEQ ID NO: 707320 - protein, 24 aa, Mycobacterium
PEWSPQCRWMHQFGPLRQGTRTLN

SEQ ID NO: 707321 - protein, 28 aa, Mycobacterium
PEWWAERRRLALAAVEQWAAEHDIAAGM

SEQ ID NO: 707322 - protein, 18 aa, Mycobacterium
PEYAEVRGSVRLQGTELL

SEQ ID NO: 707323 - protein, 18 aa, Mycobacterium
PEYGPCWHLGVLPLQDGG

SEQ ID NO: 707324 - protein, 19 aa, Mycobacterium
PEYMVPAAVMVIDALPLTA

SEQ ID NO: 707325 - protein, 20 aa, Mycobacterium
PEYPKGITVPAIVDVPTGAV

SEQ ID NO: 707326 - protein, 21 aa, Mycobacterium
PEYQRRYLIPAGRTLSTTELE

SEQ ID NO: 707327 - protein, 19 aa, Mycobacterium
PEYRCITPTLPMGAHTSPM

SEQ ID NO: 707328 - protein, 18 aa, Mycobacterium
PEYTRALVALSRGGSDAS

SEQ ID NO: 707329 - protein, 21 aa, Mycobacterium
PFAAGEVFEALSVLQSSEAYT

SEQ ID NO: 707330 - protein, 18 aa, Mycobacterium
PFAALPFTEVRTAKLESN

SEQ ID NO: 707331 - protein, 18 aa, Mycobacterium
PFAAPRTAFNANITGHRN

SEQ ID NO: 707332 - protein, 17 aa, Mycobacterium
PFAAPRTVFNASISGRR

SEQ ID NO: 707333 - protein, 26 aa, Mycobacterium
PFAARAQCAFMGWPASLHEPLRQWVK

SEQ ID NO: 707334 - protein, 20 aa, Mycobacterium
PFAARCTRIEQGIKNGFSGN

SEQ ID NO: 707335 - protein, 18 aa, Mycobacterium
PFAATAIGLAVFLDTKAN

SEQ ID NO: 707336 - protein, 23 aa, Mycobacterium
PFACKRPIIDQGYYETFNRDNVT

SEQ ID NO: 707337 - protein, 23 aa, Mycobacterium
PFACKRPIIDQGYYETYNRDNVS

SEQ ID NO: 707338 - protein, 19 aa, Mycobacterium
PFADEVFDAVTISFGLRNV

SEQ ID NO: 707339 - protein, 19 aa, Mycobacterium
PFAEKMAGAGLATVARETE

SEQ ID NO: 707340 - protein, 24 aa, Mycobacterium
PFAEPAHWDGFLRGLTPFSASQGV

SEQ ID NO: 707341 - protein, 18 aa, Mycobacterium
PFAEPGWFRTDDLGAVDE

SEQ ID NO: 707342 - protein, 18 aa, Mycobacterium
PFAGFGVADLAGRLQQIL

SEQ ID NO: 707343 - protein, 24 aa, Mycobacterium
PFAGGARACIGEHFARLETTLALA

SEQ ID NO: 707344 - protein, 29 aa, Mycobacterium
PFAGHPTVGAAWWLRDRGTPIKTLQVPAG

SEQ ID NO: 707345 - protein, 24 aa, Mycobacterium
PFAGHPTVGASWWLRENGRPINTL

SEQ ID NO: 707346 - protein, 23 aa, Mycobacterium
PFAGPVRTCIGCRRRELAVELLR

SEQ ID NO: 707347 - protein, 18 aa, Mycobacterium
PFAGRLLGDMGAEVLKIE

SEQ ID NO: 707348 - protein, 19 aa, Mycobacterium
PFAGSWGYQVTSYYAPTSR

SEQ ID NO: 707349 - protein, 21 aa, Mycobacterium
PFAKAAYRIGRVEDIGRGVAR

SEQ ID NO: 707350 - protein, 17 aa, Mycobacterium
PFAKREVMPGGLAGAEL

SEQ ID NO: 707351 - protein, 17 aa, Mycobacterium
PFALGAMTFGEDFGAVG

SEQ ID NO: 707352 - protein, 17 aa, Mycobacterium
PFANAFSHLPLREQLVA

SEQ ID NO: 707353 - protein, 21 aa, Mycobacterium
PFAPGCQRIEFGVKTGFSGDH

SEQ ID NO: 707354 - protein, 34 aa, Mycobacterium
PFAPLCQPDCPGLCPDCGIPLATAEPGHGHEKID

SEQ ID NO: 707355 - protein, 19 aa, Mycobacterium
PFAPPGWPSPKGRDEVRTY

SEQ ID NO: 707356 - protein, 18 aa, Mycobacterium
PFAPPRLAAPLWVSLLET

SEQ ID NO: 707357 - protein, 21 aa, Mycobacterium
PFAQKRFCGAEGIENVGTASA

SEQ ID NO: 707358 - protein, 22 aa, Mycobacterium
PFAQKRFCGAEGIENVTNASAF

SEQ ID NO: 707359 - protein, 23 aa, Mycobacterium
PFAQKRFCGAEGIENVTSASGFR

SEQ ID NO: 707360 - protein, 23 aa, Mycobacterium
PFAQKRFCGAEGIENVTTASAFR

SEQ ID NO: 707361 - protein, 18 aa, Mycobacterium
PFARFGVPNLAVRLQRLL

SEQ ID NO: 707362 - protein, 17 aa, Mycobacterium
PFARLAGQREWLRRPPP

SEQ ID NO: 707363 - protein, 18 aa, Mycobacterium
PFASFGVPYLAARLQQVL

SEQ ID NO: 707364 - protein, 19 aa, Mycobacterium
PFATPRTMLNVAIGGARRC

SEQ ID NO: 707365 - protein, 24 aa, Mycobacterium
PFAVLRLQYQVARLPLQLIEDQVM

SEQ ID NO: 707366 - protein, 18 aa, Mycobacterium
PFCGRGSVQQRIERYGVL

SEQ ID NO: 707367 - protein, 25 aa, Mycobacterium
PFCTAEHIRLLSAIVPHLQQALRIH

SEQ ID NO: 707368 - protein, 21 aa, Mycobacterium
PFDAAVDCYGAFIVEDPPEGL

SEQ ID NO: 707369 - protein, 21 aa, Mycobacterium
PFDAAVDCYGAFIVEEPPEGM

SEQ ID NO: 707370 - protein, 32 aa, Mycobacterium
PFDDAWRTQMSFVIAVPDFIGAAATELANIGS

SEQ ID NO: 707371 - protein, 23 aa, Mycobacterium
PFDEAWLQAAFDEFYARRARGAQ

SEQ ID NO: 707372 - protein, 35 aa, Mycobacterium
PFDGDGMLHMVGFRDGKAFYRNRFVRTDALAAENE

SEQ ID NO: 707373 - protein, 20 aa, Mycobacterium
PFDGDGMLHVVGFRDGKAFY

SEQ ID NO: 707374 - protein, 21 aa, Mycobacterium
PFDGDGMLHVVGFRDGKAFYR

SEQ ID NO: 707375 - protein, 18 aa, Mycobacterium
PFDKDRDGFVFGEAGALM

SEQ ID NO: 707376 - protein, 19 aa, Mycobacterium
PFDKDRDGFVFGEAGAMMI

SEQ ID NO: 707377 - protein, 26 aa, Mycobacterium
PFDKNRDGFVFGEAGALMVIETEEHA

SEQ ID NO: 707378 - protein, 26 aa, Mycobacterium
PFDLDGRWVGEASFLLPTDLPLGYHR

SEQ ID NO: 707379 - protein, 21 aa, Mycobacterium
PFDLDGRWVGEASFVLPGDLP

SEQ ID NO: 707380 - protein, 22 aa, Mycobacterium
PFDLGELVARLHALLRRASHTE

SEQ ID NO: 707381 - protein, 19 aa, Mycobacterium
PFDLLARTRFRVTVNTDNR

SEQ ID NO: 707382 - protein, 19 aa, Mycobacterium
PFDLLLQLIFAHRLDVTEV

SEQ ID NO: 707383 - protein, 17 aa, Mycobacterium
PFDLRTLLSGGRVQATM

SEQ ID NO: 707384 - protein, 24 aa, Mycobacterium
PFDPHLRPGGVIDVAREMAPATRR

SEQ ID NO: 707385 - protein, 25 aa, Mycobacterium
PFDPHLRPGGVIDVRHELAPATRLK

SEQ ID NO: 707386 - protein, 23 aa, Mycobacterium
PFDPHLRPGGVIDVSHELEPGTR

SEQ ID NO: 707387 - protein, 24 aa, Mycobacterium
PFDPTRWQPVPGFEDLTDITYHRN

SEQ ID NO: 707388 - protein, 21 aa, Mycobacterium
PFDSTVCPYKTSFPNNHYYLY

SEQ ID NO: 707389 - protein, 18 aa, Mycobacterium
PFDTRLVSFFGQPVAVVI

SEQ ID NO: 707390 - protein, 24 aa, Mycobacterium
PFDVGMTGLLGFRSGYDALEDTEV

SEQ ID NO: 707391 - protein, 22 aa, Mycobacterium
PFDYLPRRLRRSMGKASKPLPE

SEQ ID NO: 707392 - protein, 27 aa, Mycobacterium
PFEAGFAVRLIVWFPSDREVVVALFSA

SEQ ID NO: 707393 - protein, 18 aa, Mycobacterium
PFEDGGWIWFDITTDTAV

SEQ ID NO: 707394 - protein, 19 aa, Mycobacterium
PFEDGGWIWFDITTDTEVN

SEQ ID NO: 707395 - protein, 19 aa, Mycobacterium
PFENRGWFDGVDCADPDQR

SEQ ID NO: 707396 - protein, 18 aa, Mycobacterium
PFEPFAVAAVELAAEGLI

SEQ ID NO: 707397 - protein, 18 aa, Mycobacterium
PFEPFAVAAVELADEGLI

SEQ ID NO: 707398 - protein, 17 aa, Mycobacterium
PFEPFAVAAVELAEEGL

SEQ ID NO: 707399 - protein, 25 aa, Mycobacterium
PFEVRRRIEFFVSQFEFLDAAACTL

SEQ ID NO: 707400 - protein, 19 aa, Mycobacterium
PFEVYADGIDLVIFEEFGA

SEQ ID NO: 707401 - protein, 25 aa, Mycobacterium
PFEYWRQRLKTMKGQWAPFQSLIEL

SEQ ID NO: 707402 - protein, 19 aa, Mycobacterium
PFEYWRRHLKTMKGQWAPF

SEQ ID NO: 707403 - protein, 24 aa, Mycobacterium
PFFAEEICGFNPSPKRQFSSDQAR

SEQ ID NO: 707404 - protein, 17 aa, Mycobacterium
PFFCVVDLHAITIPQDP

SEQ ID NO: 707405 - protein, 19 aa, Mycobacterium
PFFEFLTDLLDGWVAYFAE

SEQ ID NO: 707406 - protein, 25 aa, Mycobacterium
PFFEFLTDLLDVWVAYFAEHPQDRA

SEQ ID NO: 707407 - protein, 22 aa, Mycobacterium
PFFGDRRKAFLEDLAIVTGGQV

SEQ ID NO: 707408 - protein, 22 aa, Mycobacterium
PFFGDRRKAFLEDLAIVTNAQV

SEQ ID NO: 707409 - protein, 21 aa, Mycobacterium
PFFGDRRKAFLEDLAVVTGGQ

SEQ ID NO: 707410 - protein, 20 aa, Mycobacterium
PFFGSLLEFITSGPVVAAIV

SEQ ID NO: 707411 - protein, 19 aa, Mycobacterium
PFFHGHGLVAVLLSTLAGG

SEQ ID NO: 707412 - protein, 23 aa, Mycobacterium
PFFPELARTGLHVIGCANRYTLG

SEQ ID NO: 707413 - protein, 20 aa, Mycobacterium
PFFPNLPSWISLRLLENRTF

SEQ ID NO: 707414 - protein, 23 aa, Mycobacterium
PFFRAWRDHGWRAPADSGPGSAR

SEQ ID NO: 707415 - protein, 19 aa, Mycobacterium
PFFTRLWASSTAHRHDVGN

SEQ ID NO: 707416 - protein, 17 aa, Mycobacterium
PFGAEVHHVNPTCGDEV

SEQ ID NO: 707417 - protein, 19 aa, Mycobacterium
PFGAFGMGDLGQIFTQLGQ

SEQ ID NO: 707418 - protein, 25 aa, Mycobacterium
PFGAYVMKHVDEIGGVPVVMRALLD

SEQ ID NO: 707419 - protein, 24 aa, Mycobacterium
PFGELTFPLPSTELPYLHPVTVVN

SEQ ID NO: 707420 - protein, 21 aa, Mycobacterium
PFGELVFPLPSTDLPYLHPVT

SEQ ID NO: 707421 - protein, 20 aa, Mycobacterium
PFGGAYRLIDFVLSNLVNAR

SEQ ID NO: 707422 - protein, 21 aa, Mycobacterium
PFGGAYRLIDFVLSNLVNARF

SEQ ID NO: 707423 - protein, 26 aa, Mycobacterium
PFGGFKLSGLGREGGGIGGLHQYMEP

SEQ ID NO: 707424 - protein, 19 aa, Mycobacterium
PFGGGYRLIDFVLSNLVNA

SEQ ID NO: 707425 - protein, 18 aa, Mycobacterium
PFGGPGRAPTMLVTDISM

SEQ ID NO: 707426 - protein, 19 aa, Mycobacterium
PFGGSWGYQVTSYYAPTSR

SEQ ID NO: 707427 - protein, 29 aa, Mycobacterium
PFGGVKRSGFGRELGRYGIDEFVNKKLIR

SEQ ID NO: 707428 - protein, 20 aa, Mycobacterium
PFGHGDPWAAMRAAVHRATS

SEQ ID NO: 707429 - protein, 17 aa, Mycobacterium
PFGHLWSLGQPVKIVNP

SEQ ID NO: 707430 - protein, 20 aa, Mycobacterium
PFGHSDPWAAMRAAVHRRTP

SEQ ID NO: 707431 - protein, 17 aa, Mycobacterium
PFGHYDGLLTWLRGLVP

SEQ ID NO: 707432 - protein, 21 aa, Mycobacterium
PFGIVPLEAMACGVPVVATAV

SEQ ID NO: 707433 - protein, 17 aa, Mycobacterium
PFGLLDCDVPIDGSIAV

SEQ ID NO: 707434 - protein, 23 aa, Mycobacterium
PFGLSPFQIFPVRASVKCSNAVS

SEQ ID NO: 707435 - protein, 26 aa, Mycobacterium
PFGMLFGFAGYHAFTHRPTYRALKAQ

SEQ ID NO: 707436 - protein, 24 aa, Mycobacterium
PFGMMIGFRGHHAFGHRPTYRRIK

SEQ ID NO: 707437 - protein, 22 aa, Mycobacterium
PFGPAQQIGKAWAGNLAVTDPM

SEQ ID NO: 707438 - protein, 27 aa, Mycobacterium
PFGPVMTARAPWLRRAGLLGPNSTQER

SEQ ID NO: 707439 - protein, 22 aa, Mycobacterium
PFGRPLRNVRCRIVSPSGRDCL

SEQ ID NO: 707440 - protein, 24 aa, Mycobacterium
PFGRPLRNVRCRVVAPSGRDCLDW

SEQ ID NO: 707441 - protein, 18 aa, Mycobacterium
PFGSQTVMGPAWPNVDEE

SEQ ID NO: 707442 - protein, 25 aa, Mycobacterium
PFGSYAGRLYQYWRRNLDPERYRRD

SEQ ID NO: 707443 - protein, 18 aa, Mycobacterium
PFGTPEFIDRIVTGGVNQ

SEQ ID NO: 707444 - protein, 34 aa, Mycobacterium
PFGTPTFTGRSWPLADVRLLAPILASKVVCVGKN

SEQ ID NO: 707445 - protein, 30 aa, Mycobacterium
PFGYQLVDIPFKFHHPMWREHCEVDLDYHI

SEQ ID NO: 707446 - protein, 23 aa, Mycobacterium
PFHCPDCAASYCGDHWNWREFDD

SEQ ID NO: 707447 - protein, 18 aa, Mycobacterium
PFHDWRWGGDGKCKLVPY

SEQ ID NO: 707448 - protein, 20 aa, Mycobacterium
PFHHMVVIYALFPNIVLSVT

SEQ ID NO: 707449 - protein, 19 aa, Mycobacterium
PFHRARLAAAAAKIEKAAF

SEQ ID NO: 707450 - protein, 26 aa, Mycobacterium
PFHRPKLPGIPGIKDFKGHAFHSSRW

SEQ ID NO: 707451 - protein, 19 aa, Mycobacterium
PFIARAVIDALKIHPNVNA

SEQ ID NO: 707452 - protein, 24 aa, Mycobacterium
PFIHTRPRYFAQIIGELLYWIGED

SEQ ID NO: 707453 - protein, 23 aa, Mycobacterium
PFILRGVALLGMESVLMAIGPRR

SEQ ID NO: 707454 - protein, 24 aa, Mycobacterium
PFIQQESWHAWAHQVVLDHLAEQG

SEQ ID NO: 707455 - protein, 19 aa, Mycobacterium
PFITFRVWHPLSHDRMEIL

SEQ ID NO: 707456 - protein, 20 aa, Mycobacterium
PFITFRVWHPLSHDRMEILS

SEQ ID NO: 707457 - protein, 17 aa, Mycobacterium
PFKVVRGPVQFNHEPLV

SEQ ID NO: 707458 - protein, 17 aa, Mycobacterium
PFLAEWVEQGNDDDANA

SEQ ID NO: 707459 - protein, 20 aa, Mycobacterium
PFLAGPVFASAYHLPVPEDD

SEQ ID NO: 707460 - protein, 20 aa, Mycobacterium
PFLDLSAGYVRRAVAQFPHQ

SEQ ID NO: 707461 - protein, 18 aa, Mycobacterium
PFLDRRRTETRSYCDELA

SEQ ID NO: 707462 - protein, 23 aa, Mycobacterium
PFLEGYTSLGFLAAQTATIDLTL

SEQ ID NO: 707463 - protein, 17 aa, Mycobacterium
PFLGYNVGDYFAHWINV

SEQ ID NO: 707464 - protein, 31 aa, Mycobacterium
PFLHGRPGGLLRLQVPVARRTLWDDAIRSIE

SEQ ID NO: 707465 - protein, 21 aa, Mycobacterium
PFLHKDLYKEYSLRPPKGVLL

SEQ ID NO: 707466 - protein, 31 aa, Mycobacterium
PFLHKDLYQEYSLRPPKGVLLYGPPGCGKTL

SEQ ID NO: 707467 - protein, 27 aa, Mycobacterium
PFLHKELYREYALRPPKGVLLYGPPGC

SEQ ID NO: 707468 - protein, 31 aa, Mycobacterium; identical to SEQ ID NO: 203982

SEQ ID NO: 707469 - protein, 17 aa, Mycobacterium
PFLLKLRPDIPVVGSKF

SEQ ID NO: 707470 - protein, 23 aa, Mycobacterium
PFLLRLRPDIPIVGSKFTLALVA

SEQ ID NO: 707471 - protein, 19 aa, Mycobacterium
PFLLTRRPESYGALTEPVD

SEQ ID NO: 707472 - protein, 30 aa, Mycobacterium
PFLNPLLVWDFRLPRVVSINVSGHKYGLTY

SEQ ID NO: 707473 - protein, 18 aa, Mycobacterium
PFLPTVAVSAVISEVGTD

SEQ ID NO: 707474 - protein, 17 aa, Mycobacterium
PFLRMADSFQGRYAAEG

SEQ ID NO: 707475 - protein, 18 aa, Mycobacterium
PFLYAGAITALIRDFLHR

SEQ ID NO: 707476 - protein, 19 aa, Mycobacterium
PFMEFTPGYVLRSIDELPK

SEQ ID NO: 707477 - protein, 18 aa, Mycobacterium
PFMGEKYAAVTGGPLFRN

SEQ ID NO: 707478 - protein, 18 aa, Mycobacterium
PFMGIMGVAFSQDRDLTA

SEQ ID NO: 707479 - protein, 19 aa, Mycobacterium
PFMIGRPASDPAYFPYYAK

SEQ ID NO: 707480 - protein, 19 aa, Mycobacterium
PFNFPFFLNIVKVLPALAA

SEQ ID NO: 707481 - protein, 33 aa, Mycobacterium
PFPATARLTGRWLRGRLPTAYDWTRGLPWVDKK

SEQ ID NO: 707482 - protein, 28 aa, Mycobacterium
PFPATARLTGRWMRGRLPTVSDLTRGLP

SEQ ID NO: 707483 - protein, 23 aa, Mycobacterium
PFPDNSTLDWDRFGSCDYLYVSH

SEQ ID NO: 707484 - protein, 31 aa, Mycobacterium
PFPEAFHLHKACAVVWCYTGDPAAAEEVFAP

SEQ ID NO: 707485 - protein, 21 aa, Mycobacterium
PFPHMRFPNDWIAHDEDNDAV

SEQ ID NO: 707486 - protein, 27 aa, Mycobacterium
PFPKACPAPGVMQGCLESTSGLIMGID

SEQ ID NO: 707487 - protein, 17 aa, Mycobacterium
PFPLAQFMGDVYAAALL

SEQ ID NO: 707488 - protein, 23 aa, Mycobacterium
PFPSLRMRTTLGVAHWQLEGRIS

SEQ ID NO: 707489 - protein, 17 aa, Mycobacterium
PFPTAQSYRAWADAAAE

SEQ ID NO: 707490 - protein, 33 aa, Mycobacterium
PFPTTARLTGRWLRGRLPTLNDWIRGIPLVDSK

SEQ ID NO: 707491 - protein, 28 aa, Mycobacterium
PFPTTARLTGRWLRGRLPVASDFTRGIP

SEQ ID NO: 707492 - protein, 21 aa, Mycobacterium
PFQAFTDRPLIGNGVAGAPGT

SEQ ID NO: 707493 - protein, 26 aa, Mycobacterium
PFQISCGSCYMCDRQLYTQCETTQVR

SEQ ID NO: 707494 - protein, 25 aa, Mycobacterium
PFQLFRILFEVIRGGGLDPSSGVAL

SEQ ID NO: 707495 - protein, 17 aa, Mycobacterium
PFRDYLGWLGGWDSQSG

SEQ ID NO: 707496 - protein, 24 aa, Mycobacterium
PFRLRGKDLLAYRRRVQMVFQDPY

SEQ ID NO: 707497 - protein, 19 aa, Mycobacterium
PFRLRVVRRPTVGYDGTAN

SEQ ID NO: 707498 - protein, 19 aa, Mycobacterium
PFRNELVRVIGRERDRLRA

SEQ ID NO: 707499 - protein, 25 aa, Mycobacterium
PFRPFPRSVVHGEWALSPKPPWFVS

SEQ ID NO: 707500 - protein, 24 aa, Mycobacterium
PFRPRERLYRSGDVGRRLPSGEIE

SEQ ID NO: 707501 - protein, 21 aa, Mycobacterium
PFRRWKRETYRGGSSDPLIVT

SEQ ID NO: 707502 - protein, 21 aa, Mycobacterium
PFRSAVGFVFLDLARDPRLCA

SEQ ID NO: 707503 - protein, 21 aa, Mycobacterium
PFRTEVERLGRIVFGDTFEVD

SEQ ID NO: 707504 - protein, 19 aa, Mycobacterium
PFRVAREMLRVLKPGGRIA

SEQ ID NO: 707505 - protein, 25 aa, Mycobacterium
PFSAIRQALTWAMVRTGVMGSVMRW

SEQ ID NO: 707506 - protein, 19 aa, Mycobacterium
PFSALCAYDTHQLAGAADE

SEQ ID NO: 707507 - protein, 21 aa, Mycobacterium
PFSALCWGERIAFDNPDSLTL

SEQ ID NO: 707508 - protein, 19 aa, Mycobacterium
PFSEPGWFRTDDLGVLDDS

SEQ ID NO: 707509 - protein, 27 aa, Mycobacterium
PFSFADCARCVVDLLDGLGIDRAHFVG

SEQ ID NO: 707510 - protein, 19 aa, Mycobacterium
PFSGLDWSCASWLHDHEIA

SEQ ID NO: 707511 - protein, 18 aa, Mycobacterium
PFSLPASEKIAVLEDYSG

SEQ ID NO: 707512 - protein, 23 aa, Mycobacterium
PFSMAMGSLKVADAVTVSFEGRR

SEQ ID NO: 707513 - protein, 29 aa, Mycobacterium
PFSQETVNGWFKRVYDLGLPLNIHANGDG

SEQ ID NO: 707514 - protein, 23 aa, Mycobacterium
PFSSLCWGERIAFDNPDNLTLLG

SEQ ID NO: 707515 - protein, 24 aa, Mycobacterium
PFSSLCWGERIAFDNPDNLTLLGA

SEQ ID NO: 707516 - protein, 22 aa, Mycobacterium
PFSSLCWGERIAFDNPDSLTLL

SEQ ID NO: 707517 - protein, 18 aa, Mycobacterium
PFSTHVLNVLHLLLPAGE

SEQ ID NO: 707518 - protein, 31 aa, Mycobacterium
PFSTRRLTECLTRGATRFGWNRRNPAPAATR

SEQ ID NO: 707519 - protein, 18 aa, Mycobacterium
PFTAAGWVLDLTPEERRR

SEQ ID NO: 707520 - protein, 25 aa, Mycobacterium
PFTARFGVPLPRGLREEAGDMSWAS

SEQ ID NO: 707521 - protein, 29 aa, Mycobacterium
PFTAVGELWKAISPHLSPISNIVSMLNNH

SEQ ID NO: 707522 - protein, 22 aa, Mycobacterium
PFTDGRWLLSHNGIVDRAVLPR

SEQ ID NO: 707523 - protein, 22 aa, Mycobacterium
PFTDGRWLLSHNGIVDRAVLPV

SEQ ID NO: 707524 - protein, 20 aa, Mycobacterium
PFTDLNFPYGVAVDNAGNVY

SEQ ID NO: 707525 - protein, 21 aa, Mycobacterium
PFTDQMAWLFSRLIGDRPGWG

SEQ ID NO: 707526 - protein, 25 aa, Mycobacterium
PFTDWPDPWVLVGALAQVTTRLRFV

SEQ ID NO: 707527 - protein, 25 aa, Mycobacterium
PFTEELVMWWNFVGRSHDEIVAYRE

SEQ ID NO: 707528 - protein, 25 aa, Mycobacterium
PFTGLADPHGLAFDSVDTCYVVDHV

SEQ ID NO: 707529 - protein, 26 aa, Mycobacterium
PFTGLNFPAGVAVDLNGNIYVADLNN

SEQ ID NO: 707530 - protein, 19 aa, Mycobacterium
PFTHFNRTHVAPPLIISEE

SEQ ID NO: 707531 - protein, 20 aa, Mycobacterium
PFTLGARMYRTGDVVRRTPD

SEQ ID NO: 707532 - protein, 20 aa, Mycobacterium
PFTPECVRIEQGVKTGFSGD

SEQ ID NO: 707533 - protein, 24 aa, Mycobacterium
PFTPRMFADLVIRSSAGGDRFGLR

SEQ ID NO: 707534 - protein, 17 aa, Mycobacterium
PFTSLALAPEAASSYLL

SEQ ID NO: 707535 - protein, 19 aa, Mycobacterium
PFTVIAHHRKLMVAAAVHE

SEQ ID NO: 707536 - protein, 25 aa, Mycobacterium
PFTVTRPDGLPVWIYQFKISPHPTI

SEQ ID NO: 707537 - protein, 25 aa, Mycobacterium
PFTVTRPDGLPVWIYQFKISTHPTI

SEQ ID NO: 707538 - protein, 25 aa, Mycobacterium
PFTVTRPDGLPVWIYQFKVSPHRGI

SEQ ID NO: 707539 - protein, 19 aa, Mycobacterium
PFTYLRPGTVLGDDGKLGA

SEQ ID NO: 707540 - protein, 17 aa, Mycobacterium
PFVALIMGGSGTPIPPP

SEQ ID NO: 707541 - protein, 19 aa, Mycobacterium
PFVALPVFPSRLFRHSSVY

SEQ ID NO: 707542 - protein, 19 aa, Mycobacterium
PFVDEVPKLVAGRRRRTST

SEQ ID NO: 707543 - protein, 19 aa, Mycobacterium
PFVDLYAPLNFMVSLHTAM

SEQ ID NO: 707544 - protein, 26 aa, Mycobacterium
PFVECQSRLLAAYAVGRYALPSTDEM

SEQ ID NO: 707545 - protein, 19 aa, Mycobacterium
PFVEINAAFYPKREGKLPP

SEQ ID NO: 707546 - protein, 28 aa, Mycobacterium
PFVEQMMNKRVCVRIVAQRARSWDHRKL

SEQ ID NO: 707547 - protein, 29 aa, Mycobacterium
PFVEQMMNKRVCVRIVARRARSWDHRKLG

SEQ ID NO: 707548 - protein, 23 aa, Mycobacterium
PFVEVYLAREWARCGDLDGAIAH

SEQ ID NO: 707549 - protein, 24 aa, Mycobacterium
PFVLPPPVLEKMRFIHTVIDEITS

SEQ ID NO: 707550 - protein, 25 aa, Mycobacterium
PFVLPVAVLEKMRFVHTVVDQVTQA

SEQ ID NO: 707551 - protein, 21 aa, Mycobacterium
PFVLSLRFVVIALTHNIILNS

SEQ ID NO: 707552 - protein, 19 aa, Mycobacterium
PFVPFDIADDYLRYVDGKR

SEQ ID NO: 707553 - protein, 18 aa, Mycobacterium
PFVPFDPATDYRRYVDGK

SEQ ID NO: 707554 - protein, 18 aa, Mycobacterium
PFVRLHQPSAFYGVNSLP

SEQ ID NO: 707555 - protein, 26 aa, Mycobacterium
PFWDACVQAGIPVCMHASDSGYAQYL

SEQ ID NO: 707556 - protein, 20 aa, Mycobacterium
PFWDALRCGDALDRVDVPVL

SEQ ID NO: 707557 - protein, 25 aa, Mycobacterium
PFWQACIKAGIPVSMHASDSGYSEF

SEQ ID NO: 707558 - protein, 25 aa, Mycobacterium
PFWQACIRAGIPVSMHASDSGYSEF

SEQ ID NO: 707559 - protein, 25 aa, Mycobacterium
PFWQACVKAGIPVAMHASDSGYAQY

SEQ ID NO: 707560 - protein, 24 aa, Mycobacterium
PFWRAHGLSGTGFASRERICEVYD

SEQ ID NO: 707561 - protein, 19 aa, Mycobacterium
PFWRANGFSGQALSDRGPV

SEQ ID NO: 707562 - protein, 17 aa, Mycobacterium
PFYAAAVELGMPLGVHG

SEQ ID NO: 707563 - protein, 17 aa, Mycobacterium
PFYDPWFAKARAAGAIE

SEQ ID NO: 707564 - protein, 17 aa, Mycobacterium
PFYHDLGLMMGICQSVL

SEQ ID NO: 707565 - protein, 17 aa, Mycobacterium
PGAAALLHRGCAGLAEV

SEQ ID NO: 707566 - protein, 25 aa, Mycobacterium
PGAADARWLSDVAGIERSWLVEPGL

SEQ ID NO: 707567 - protein, 19 aa, Mycobacterium
PGAAHRVERADGPAAAMAG

SEQ ID NO: 707568 - protein, 25 aa, Mycobacterium
PGAALAERRCMLYAGTTVVAGTAVA

SEQ ID NO: 707569 - protein, 17 aa, Mycobacterium
PGAALLFVSPRERHLLK

SEQ ID NO: 707570 - protein, 17 aa, Mycobacterium
PGAALWVLIDDVADPVI

SEQ ID NO: 707571 - protein, 18 aa, Mycobacterium
PGAARVAAQIAYLPDVAA

SEQ ID NO: 707572 - protein, 21 aa, Mycobacterium
PGACDSTLLIAERVQPYDDVW

SEQ ID NO: 707573 - protein, 21 aa, Mycobacterium
PGACDSTLLIAERVQSYADVW

SEQ ID NO: 707574 - protein, 19 aa, Mycobacterium
PGACNRDARKFADPNSFRP

SEQ ID NO: 707575 - protein, 19 aa, Mycobacterium
PGACYTRTGGFVDRVGDFD

SEQ ID NO: 707576 - protein, 19 aa, Mycobacterium
PGADAARMIVTPELTQILS

SEQ ID NO: 707577 - protein, 25 aa, Mycobacterium
PGADAWCVAALAAVLVQENLCDEAF

SEQ ID NO: 707578 - protein, 23 aa, Mycobacterium
PGADEARIADYCAGSVAHFDWLV

SEQ ID NO: 707579 - protein, 25 aa, Mycobacterium
PGADFELAQGFLLTEGIIAGRDDVL

SEQ ID NO: 707580 - protein, 18 aa, Mycobacterium
PGADGWIRAIGYHEQVAG

SEQ ID NO: 707581 - protein, 19 aa, Mycobacterium
PGADRLAAEANRRRRELLR

SEQ ID NO: 707582 - protein, 20 aa, Mycobacterium
PGADRLAAEANRRRRELLRR

SEQ ID NO: 707583 - protein, 19 aa, Mycobacterium
PGADRLASEANRRRRELLR

SEQ ID NO: 707584 - protein, 17 aa, Mycobacterium
PGADRWGICDFEISNNA

SEQ ID NO: 707585 - protein, 22 aa, Mycobacterium
PGADSLLRMRLDLVECATGVSK

SEQ ID NO: 707586 - protein, 26 aa, Mycobacterium
PGAEALRPPNWIPWEERIRPGDLGPG

SEQ ID NO: 707587 - protein, 23 aa, Mycobacterium
PGAEAMLSHFRFYTSSTQYGTFD

SEQ ID NO: 707588 - protein, 33 aa, Mycobacterium
PGAEGWRTTETWPPPGVVYREFALRADGQLGDD

SEQ ID NO: 707589 - protein, 18 aa, Mycobacterium
PGAELDLDLRLESVSEGV

SEQ ID NO: 707590 - protein, 25 aa, Mycobacterium
PGAEVDLLIHLPVIALLANTAHPLD

SEQ ID NO: 707591 - protein, 20 aa, Mycobacterium
PGAFCPLTASVSGHAIDYAM

SEQ ID NO: 707592 - protein, 19 aa, Mycobacterium
PGAGAALAAVAGRTTSSAG

SEQ ID NO: 707593 - protein, 19 aa, Mycobacterium
PGAGFAMLLAACVAISRFA

SEQ ID NO: 707594 - protein, 19 aa, Mycobacterium
PGAGGALGKGGAGSVEGAS

SEQ ID NO: 707595 - protein, 17 aa, Mycobacterium
PGAGRGFARELHKQLTA

SEQ ID NO: 707596 - protein, 23 aa, Mycobacterium
PGAGTRMKLARNMLTFTIYAAVG

SEQ ID NO: 707597 - protein, 29 aa, Mycobacterium
PGAGVFVLDSWLRPVPPGTVGELYVAGTG

SEQ ID NO: 707598 - protein, 23 aa, Mycobacterium
PGAGYVYRTSWRLATTDIDEHMR

SEQ ID NO: 707599 - protein, 19 aa, Mycobacterium
PGAHVLRLDITDQWSVEAA

SEQ ID NO: 707600 - protein, 23 aa, Mycobacterium
PGAKPAAKWFLALIARERGEEDA

SEQ ID NO: 707601 - protein, 17 aa, Mycobacterium
PGAKRPLVLDIPLFVSD

SEQ ID NO: 707602 - protein, 17 aa, Mycobacterium
PGALAAVLQTLREQCAG

SEQ ID NO: 707603 - protein, 23 aa, Mycobacterium
PGALAPGAGEVWEVSYASREVPL

SEQ ID NO: 707604 - protein, 20 aa, Mycobacterium
PGALARFVAAVPPHILVVLD

SEQ ID NO: 707605 - protein, 29 aa, Mycobacterium
PGALMRFTTARSWLSQWGLDTAQVDAGDA

SEQ ID NO: 707606 - protein, 23 aa, Mycobacterium
PGALPDFIGLAFRVTPPQGTGPW

SEQ ID NO: 707607 - protein, 24 aa, Mycobacterium
PGALPDFVGLAFRLTPPEPAGKPW

SEQ ID NO: 707608 - protein, 25 aa, Mycobacterium
PGALRDLTMPAGMTVGMVPTQGAAD

SEQ ID NO: 707609 - protein, 24 aa, Mycobacterium
PGALREARRGMALAAGLQLPLVLV

SEQ ID NO: 707610 - protein, 21 aa, Mycobacterium
PGALRGGAGVPGLGGGAGTNP

SEQ ID NO: 707611 - protein, 23 aa, Mycobacterium
PGALRQARRGMRLAADLDLPLVT

SEQ ID NO: 707612 - protein, 19 aa, Mycobacterium
PGANFDLVMLPALDAPPEA

SEQ ID NO: 707613 - protein, 22 aa, Mycobacterium
PGAPADLDWEATLAYRRELWSY

SEQ ID NO: 707614 - protein, 21 aa, Mycobacterium
PGAPEELWDVLSLNDVPDDEI

SEQ ID NO: 707615 - protein, 20 aa, Mycobacterium
PGAPIARAEVRVSLERILAR

SEQ ID NO: 707616 - protein, 18 aa, Mycobacterium
PGAPIRFEVCARSWPDGE

SEQ ID NO: 707617 - protein, 21 aa, Mycobacterium
PGAPLARAEGRISLERILDRM

SEQ ID NO: 707618 - protein, 20 aa, Mycobacterium
PGAPLARAETRVALERLLDR

SEQ ID NO: 707619 - protein, 21 aa, Mycobacterium
PGAPRRAGDALLVFSSGTTGL

SEQ ID NO: 707620 - protein, 18 aa, Mycobacterium
PGAPRVGLAQVYGAPGTA

SEQ ID NO: 707621 - protein, 17 aa, Mycobacterium
PGAQEMLDALVAAEVPM

SEQ ID NO: 707622 - protein, 17 aa, Mycobacterium
PGAQFTPVAVYVGGRLI

SEQ ID NO: 707623 - protein, 17 aa, Mycobacterium
PGAQGFRAGDAGNGGVG

SEQ ID NO: 707624 - protein, 21 aa, Mycobacterium
PGARALRFWEVMYPSPPPGLA

SEQ ID NO: 707625 - protein, 25 aa, Mycobacterium
PGARDTRAGGAVRAGPAIAAGPAGA

SEQ ID NO: 707626 - protein, 21 aa, Mycobacterium
PGAREYLVLGGGLNRAAASAI

SEQ ID NO: 707627 - protein, 21 aa, Mycobacterium
PGARIAAIFPDGPMRYHGTIY

SEQ ID NO: 707628 - protein, 19 aa, Mycobacterium
PGARITFAEWIGRARSVAT

SEQ ID NO: 707629 - protein, 17 aa, Mycobacterium
PGARLQRLVLWRHLLTW

SEQ ID NO: 707630 - protein, 17 aa, Mycobacterium
PGARLVLFDGMGHDLPE

SEQ ID NO: 707631 - protein, 32 aa, Mycobacterium
PGARMYRTGDLVFWGADGQLVYVGRADEQVKI

SEQ ID NO: 707632 - protein, 20 aa, Mycobacterium
PGARMYRTGDLVSWGADGQL

SEQ ID NO: 707633 - protein, 26 aa, Mycobacterium
PGARSPRPATVWIAQDGSHRLVRANV

SEQ ID NO: 707634 - protein, 23 aa, Mycobacterium
PGARVPFRRVHLSTGDHFDLYDT

SEQ ID NO: 707635 - protein, 18 aa, Mycobacterium
PGASAIVVLTRWHPDDLA

SEQ ID NO: 707636 - protein, 21 aa, Mycobacterium
PGATEAAFRWASSRDGQNKVL

SEQ ID NO: 707637 - protein, 25 aa, Mycobacterium
PGATVKILVCEPQWVTDGYVDLNSV

SEQ ID NO: 707638 - protein, 18 aa, Mycobacterium
PGATVLLRLDQDVPEDVR

SEQ ID NO: 707639 - protein, 17 aa, Mycobacterium
PGATWATDLVSVPDRLR

SEQ ID NO: 707640 - protein, 27 aa, Mycobacterium
PGAVEEVLRWASPVAYWTRTAKVDVEM

SEQ ID NO: 707641 - protein, 35 aa, Mycobacterium
PGAVIFDLPVGGWGQRPTAEFGYLACDAAVSDQDP

SEQ ID NO: 707642 - protein, 17 aa, Mycobacterium
PGAVIGRMVMGARGMAI

SEQ ID NO: 707643 - protein, 19 aa, Mycobacterium
PGAVIVVDNVIRWIGEEGP

SEQ ID NO: 707644 - protein, 18 aa, Mycobacterium
PGAVLVVGQGGKVAFHQA

SEQ ID NO: 707645 - protein, 20 aa, Mycobacterium
PGAVSAWVDLHAKFGKLPFE

SEQ ID NO: 707646 - protein, 17 aa, Mycobacterium
PGAWNFRDVADSTAALR

SEQ ID NO: 707647 - protein, 17 aa, Mycobacterium
PGAWPGLAQAEQLHGKE

SEQ ID NO: 707648 - protein, 25 aa, Mycobacterium
PGAWRAEALALLAVSAYVRGDGVLA

SEQ ID NO: 707649 - protein, 24 aa, Mycobacterium
PGAWSLIEAAGFWQELSAELEQSA

SEQ ID NO: 707650 - protein, 25 aa, Mycobacterium
PGAYHAKDGFSLAFSEIGQAVSWLY

SEQ ID NO: 707651 - protein, 22 aa, Mycobacterium
PGAYVAGWIKRGPTGFIGTNKS

SEQ ID NO: 707652 - protein, 19 aa, Mycobacterium
PGAYWLPRRLGGTAPTVEE

SEQ ID NO: 707653 - protein, 21 aa, Mycobacterium
PGCDHEIRSGTAHVVVWPTGS

SEQ ID NO: 707654 - protein, 22 aa, Mycobacterium
PGCMTTKWGGFVSDVDAFDADF

SEQ ID NO: 707655 - protein, 26 aa, Mycobacterium
PGDAAPELGYRPSAELERFIRCRDMT

SEQ ID NO: 707656 - protein, 23 aa, Mycobacterium
PGDALFFGHGLNIHFDLIKPPAD

SEQ ID NO: 707657 - protein, 21 aa, Mycobacterium
PGDAPVGLIVRNRLPHAAAIA

SEQ ID NO: 707658 - protein, 18 aa, Mycobacterium
PGDAYWLLRHAIACPDPV

SEQ ID NO: 707659 - protein, 19 aa, Mycobacterium
PGDDAWCTALRTDVAPLLL

SEQ ID NO: 707660 - protein, 27 aa, Mycobacterium
PGDDRVASLFLWHFVEEVEHRSSALII

SEQ ID NO: 707661 - protein, 19 aa, Mycobacterium
PGDDVLWRMTHPGKDFRFV

SEQ ID NO: 707662 - protein, 21 aa, Mycobacterium
PGDEATRRWMERFIDYATAKS

SEQ ID NO: 707663 - protein, 25 aa, Mycobacterium
PGDELPPLWHWVALPQWCSSSALSS

SEQ ID NO: 707664 - protein, 22 aa, Mycobacterium
PGDERAWTALGFTVDDREIQIG

SEQ ID NO: 707665 - protein, 17 aa, Mycobacterium
PGDEWPALLEKITAADI

SEQ ID NO: 707666 - protein, 17 aa, Mycobacterium
PGDEWPAVLTKIKAADI

SEQ ID NO: 707667 - protein, 17 aa, Mycobacterium
PGDFVILNWRAVCGQCR

SEQ ID NO: 707668 - protein, 22 aa, Mycobacterium
PGDGFFFAPTVFRVNGRPTELC

SEQ ID NO: 707669 - protein, 18 aa, Mycobacterium
PGDGLGIAGDEVLIVARD

SEQ ID NO: 707670 - protein, 22 aa, Mycobacterium
PGDGRRLVAFLGSTIGNFTPGP

SEQ ID NO: 707671 - protein, 24 aa, Mycobacterium
PGDGWRVAMGTLTFERGVSTLGNQ

SEQ ID NO: 707672 - protein, 17 aa, Mycobacterium
PGDHIVIPDDAYGGTFR

SEQ ID NO: 707673 - protein, 17 aa, Mycobacterium
PGDHVIIPTDAYGGTFR

SEQ ID NO: 707674 - protein, 18 aa, Mycobacterium
PGDIKSVLLSEEQIRTRT

SEQ ID NO: 707675 - protein, 22 aa, Mycobacterium
PGDIRIGMRVRPVFCDYPEHDV

SEQ ID NO: 707676 - protein, 17 aa, Mycobacterium
PGDKVVLTFQDPSGGSR

SEQ ID NO: 707677 - protein, 24 aa, Mycobacterium
PGDKWIYEQIKLVAPRTTLIAIVT

SEQ ID NO: 707678 - protein, 18 aa, Mycobacterium
PGDLAVWDGHVAMVVGDG

SEQ ID NO: 707679 - protein, 23 aa, Mycobacterium
PGDLRIPFDPREVIARIVDGSEF

SEQ ID NO: 707680 - protein, 20 aa, Mycobacterium
PGDPARLGPTLADAAKAAEQ

SEQ ID NO: 707681 - protein, 20 aa, Mycobacterium
PGDPLLCLDPIFQAIPDQKA

SEQ ID NO: 707682 - protein, 24 aa, Mycobacterium
PGDPSIFVTPPFWIRSREQVEDDP

SEQ ID NO: 707683 - protein, 19 aa, Mycobacterium
PGDPWAWHEVAALPRHAMR

SEQ ID NO: 707684 - protein, 18 aa, Mycobacterium
PGDQMLMYGSTMFLVQVI

SEQ ID NO: 707685 - protein, 28 aa, Mycobacterium
PGDRLCIPVPFYHCFGMVMGNLGCTTHG

SEQ ID NO: 707686 - protein, 35 aa, Mycobacterium
PGDRLLDVGCGWGGMARYAARRGVRVIGATLSAEQ

SEQ ID NO: 707687 - protein, 32 aa, Mycobacterium
PGDRLLDVGCGWGGMVRYAARHGVKVLGVTLS

SEQ ID NO: 707688 - protein, 33 aa, Mycobacterium
PGDRLLDVGCGWGGMVRYAARRGVHVLGATLSA

SEQ ID NO: 707689 - protein, 21 aa, Mycobacterium
PGDRLTVAMDFARWAPPVRGA

SEQ ID NO: 707690 - protein, 25 aa, Mycobacterium
PGDRQRLATRLGYSETVFVDLPAPG

SEQ ID NO: 707691 - protein, 25 aa, Mycobacterium
PGDRWIYEQIRAVAPRTTLIAIVTK

SEQ ID NO: 707692 - protein, 23 aa, Mycobacterium
PGDSLRRSADFAATRSSVEPRQL

SEQ ID NO: 707693 - protein, 27 aa, Mycobacterium
PGDTALRRHFNWVRAWYDFAVPDIGRS

SEQ ID NO: 707694 - protein, 18 aa, Mycobacterium
PGDTLAIHLVDLTPARTW

SEQ ID NO: 707695 - protein, 23 aa, Mycobacterium
PGDTRLGLTWISLLHGRTRASLA

SEQ ID NO: 707696 - protein, 28 aa, Mycobacterium
PGDVERFARRFGCVVIDGFGSTEGGVAI

SEQ ID NO: 707697 - protein, 24 aa, Mycobacterium
PGDVLQCYLELVLDGLVARLASGE

SEQ ID NO: 707698 - protein, 20 aa, Mycobacterium
PGDVLQPQWLARAVRAYIRD

SEQ ID NO: 707699 - protein, 27 aa, Mycobacterium
PGDVVAACGKWTMTAGRATARVHLTNS

SEQ ID NO: 707700 - protein, 17 aa, Mycobacterium
PGDVVAAVCAAAGACES

SEQ ID NO: 707701 - protein, 17 aa, Mycobacterium
PGDVVAILGVGGLGHLG

SEQ ID NO: 707702 - protein, 19 aa, Mycobacterium
PGDVVVRCADLYRGALPTL

SEQ ID NO: 707703 - protein, 19 aa, Mycobacterium
PGDVWGPGSVWVRSPIAEM

SEQ ID NO: 707704 - protein, 22 aa, Mycobacterium
PGDVYRRLRVVGRVDDPSGAVL

SEQ ID NO: 707705 - protein, 18 aa, Mycobacterium
PGDWESWYIEWRALADRI

SEQ ID NO: 707706 - protein, 18 aa, Mycobacterium
PGDWLPRQWPVEVIELKP

SEQ ID NO: 707707 - protein, 18 aa, Mycobacterium
PGDWYVIHSYAGYENKVK

SEQ ID NO: 707708 - protein, 19 aa, Mycobacterium
PGDYESWRYVAPIQRAAWS

SEQ ID NO: 707709 - protein, 18 aa, Mycobacterium
PGEAGWGNAMRWLLTGDE

SEQ ID NO: 707710 - protein, 18 aa, Mycobacterium
PGEAWCLRLAEAARATAS

SEQ ID NO: 707711 - protein, 21 aa, Mycobacterium
PGECAQPWPHLGGGHRRDRFG

SEQ ID NO: 707712 - protein, 23 aa, Mycobacterium
PGECCRLRKVAPLGKALRGYSAW

SEQ ID NO: 707713 - protein, 23 aa, Mycobacterium
PGECCRLRKVVPLRQALSNFSAW

SEQ ID NO: 707714 - protein, 24 aa, Mycobacterium
PGECCRLRKVVPLRRVLSGYSAWV

SEQ ID NO: 707715 - protein, 24 aa, Mycobacterium
PGECCRLRKVVPLSKTLRGYSAWV

SEQ ID NO: 707716 - protein, 24 aa, Mycobacterium
PGECCRLRKVVPLTNALKGYSAWV

SEQ ID NO: 707717 - protein, 17 aa, Mycobacterium
PGEEGWEGARTMIDEGV

SEQ ID NO: 707718 - protein, 27 aa, Mycobacterium
PGEFLSPKWRKMWKPVVCAVQGMCTAG

SEQ ID NO: 707719 - protein, 28 aa, Mycobacterium
PGEGGGWLARRDLIPLGYLGDAEKTART

SEQ ID NO: 707720 - protein, 21 aa, Mycobacterium
PGEHTCGDLPIAVQIDDDTAL

SEQ ID NO: 707721 - protein, 18 aa, Mycobacterium
PGEIAFTPGVVARTRAAL

SEQ ID NO: 707722 - protein, 24 aa, Mycobacterium
PGEICVAGPLVAGGYWGLPEQTAE

SEQ ID NO: 707723 - protein, 19 aa, Mycobacterium
PGEILPCDGELELNAGREV

SEQ ID NO: 707724 - protein, 18 aa, Mycobacterium
PGEINRFVFAMPEQLGRV

SEQ ID NO: 707725 - protein, 24 aa, Mycobacterium
PGEISGGMRKRAGLARSLVLDPQI

SEQ ID NO: 707726 - protein, 25 aa, Mycobacterium
PGELDWPGTWADRSGRSRGPSIPGH

SEQ ID NO: 707727 - protein, 19 aa, Mycobacterium
PGELHGMMLDMRRTFDEMV

SEQ ID NO: 707728 - protein, 22 aa, Mycobacterium
PGELMASALPIARQLFGNDVAL

SEQ ID NO: 707729 - protein, 22 aa, Mycobacterium
PGELRVASYASPFDVRHQTIIH

SEQ ID NO: 707730 - protein, 17 aa, Mycobacterium
PGEMDYHALNAMLNLYD

SEQ ID NO: 707731 - protein, 22 aa, Mycobacterium
PGEPLIPIVRMVQAIDAAEHRK

SEQ ID NO: 707732 - protein, 26 aa, Mycobacterium
PGEPPRPAWDRPLPPPGGQWGYGPIN

SEQ ID NO: 707733 - protein, 22 aa, Mycobacterium
PGEPRGTSWHPHRGFETVTYMI

SEQ ID NO: 707734 - protein, 22 aa, Mycobacterium
PGEPRKAAVLGSPIAHSRSPQL

SEQ ID NO: 707735 - protein, 22 aa, Mycobacterium
PGERGVRVVPVMVPDRITDTEG

SEQ ID NO: 707736 - protein, 19 aa, Mycobacterium
PGERTRAGLALLQACGTNV

SEQ ID NO: 707737 - protein, 22 aa, Mycobacterium
PGERTRAGLALLQARGTNVLVL

SEQ ID NO: 707738 - protein, 21 aa, Mycobacterium
PGESAPGFLACDDDAGTLDML

SEQ ID NO: 707739 - protein, 18 aa, Mycobacterium
PGESHLGGFAAADEVLQF

SEQ ID NO: 707740 - protein, 26 aa, Mycobacterium
PGETHGELLWRDKLVWAGRPNTHHVR

SEQ ID NO: 707741 - protein, 18 aa, Mycobacterium
PGETWPHRLAEAAAVTVG

SEQ ID NO: 707742 - protein, 21 aa, Mycobacterium
PGEVFAAVLAEAKARGYTLEE

SEQ ID NO: 707743 - protein, 25 aa, Mycobacterium
PGEVPARLEALGALGGLDRAALHSQ

SEQ ID NO: 707744 - protein, 21 aa, Mycobacterium
PGEVPDGWRVIGRVRASHAGA

SEQ ID NO: 707745 - protein, 24 aa, Mycobacterium
PGEVQRFPADISLARSIGFEPQVD

SEQ ID NO: 707746 - protein, 22 aa, Mycobacterium
PGEVVGLLVPRSGEAIIGLLAI

SEQ ID NO: 707747 - protein, 26 aa, Mycobacterium
PGEVWTQAGSLVFDITVWEIFGALLH

SEQ ID NO: 707748 - protein, 18 aa, Mycobacterium
PGEWRREPVPGIPEAANT

SEQ ID NO: 707749 - protein, 22 aa, Mycobacterium
PGFAEAFLPGGRAPKPGERFSL

SEQ ID NO: 707750 - protein, 22 aa, Mycobacterium
PGFAEAFLPGGRAPRPGELFTF

SEQ ID NO: 707751 - protein, 17 aa, Mycobacterium
PGFCLTVSAPGFLNGLV

SEQ ID NO: 707752 - protein, 22 aa, Mycobacterium
PGFDVPYYWWTFNMPTDHGEVA

SEQ ID NO: 707753 - protein, 22 aa, Mycobacterium
PGFDVPYYWWTFNMPTDHGEVE

SEQ ID NO: 707754 - protein, 19 aa, Mycobacterium
PGFDVSRDLPKLGYKGVES

SEQ ID NO: 707755 - protein, 19 aa, Mycobacterium
PGFEPRIDLPFDIGGACVL

SEQ ID NO: 707756 - protein, 21 aa, Mycobacterium
PGFHLDFKALIPNNIIALQTG

SEQ ID NO: 707757 - protein, 27 aa, Mycobacterium
PGFHPDDWDSAAVLEHWSKELFDQDGS

SEQ ID NO: 707758 - protein, 20 aa, Mycobacterium
PGFLGSALLPRILKRTDSTA

SEQ ID NO: 707759 - protein, 18 aa, Mycobacterium
PGFLIKRGSKSLMDTATK

SEQ ID NO: 707760 - protein, 20 aa, Mycobacterium
PGFMVPTAIVGLDRVPLTAN

SEQ ID NO: 707761 - protein, 17 aa, Mycobacterium
PGFPGMVAPPATRASGV

SEQ ID NO: 707762 - protein, 19 aa, Mycobacterium
PGFQQIRVTVTVAGPDTDA

SEQ ID NO: 707763 - protein, 17 aa, Mycobacterium
PGFRAAKGFEPVALCAR

SEQ ID NO: 707764 - protein, 21 aa, Mycobacterium
PGFSADSWRPLAELVAVGEFE

SEQ ID NO: 707765 - protein, 19 aa, Mycobacterium
PGFTALDFIGPYESLRWLP

SEQ ID NO: 707766 - protein, 26 aa, Mycobacterium
PGFTVPEFRRKAVIIAVGGIYDPRIH

SEQ ID NO: 707767 - protein, 26 aa, Mycobacterium
PGFTVPEFRRKAVIIAVGGVYDPRIH

SEQ ID NO: 707768 - protein, 18 aa, Mycobacterium
PGGAAWLDVIERIPQRLR

SEQ ID NO: 707769 - protein, 17 aa, Mycobacterium
PGGAGFAARGFRTLARW

SEQ ID NO: 707770 - protein, 18 aa, Mycobacterium
PGGAIVVHRAALGGRAGD

SEQ ID NO: 707771 - protein, 25 aa, Mycobacterium
PGGAMPLPFAGGSWVTWERGDGTDG

SEQ ID NO: 707772 - protein, 26 aa, Mycobacterium
PGGANLRAAWLTMIAVASTHQGKGLW

SEQ ID NO: 707773 - protein, 18 aa, Mycobacterium
PGGAPERRAWGLDAQTLA

SEQ ID NO: 707774 - protein, 23 aa, Mycobacterium
PGGARSGLRAAVDILDDIDDIHI

SEQ ID NO: 707775 - protein, 24 aa, Mycobacterium
PGGARSGLRSAIEILDSVEDIHIA

SEQ ID NO: 707776 - protein, 24 aa, Mycobacterium
PGGARSGLRSAIEILDSVEDIHVA

SEQ ID NO: 707777 - protein, 17 aa, Mycobacterium
PGGATTRDQTAPQTGAP

SEQ ID NO: 707778 - protein, 25 aa, Mycobacterium
PGGCAGLRYNLFFDDRALDGDLTAE

SEQ ID NO: 707779 - protein, 25 aa, Mycobacterium
PGGCAGLRYNLFFDDRSLDGDLIAE

SEQ ID NO: 707780 - protein, 25 aa, Mycobacterium
PGGCAGLRYNLFFDDRTLDGDLTVD

SEQ ID NO: 707781 - protein, 20 aa, Mycobacterium
PGGDAAMIWTLRPQLGDMVE

SEQ ID NO: 707782 - protein, 20 aa, Mycobacterium
PGGDAEGCFVYRTMDDLDAI

SEQ ID NO: 707783 - protein, 26 aa, Mycobacterium
PGGDPGRLFGRMLGCDLGVNPPFEMD

SEQ ID NO: 707784 - protein, 19 aa, Mycobacterium
PGGEAVPMRLSTRPEHAIP

SEQ ID NO: 707785 - protein, 18 aa, Mycobacterium
PGGEAVWHAVEQQMHWTR

SEQ ID NO: 707786 - protein, 17 aa, Mycobacterium
PGGECLHNLGYWDGGEW

SEQ ID NO: 707787 - protein, 21 aa, Mycobacterium
PGGEGRLRLTDPGDMLTTGIE

SEQ ID NO: 707788 - protein, 24 aa, Mycobacterium
PGGELRYIVFNLKTMPGVTDAQKL

SEQ ID NO: 707789 - protein, 19 aa, Mycobacterium
PGGELRYLEHIASAGARGR

SEQ ID NO: 707790 - protein, 17 aa, Mycobacterium
PGGEVWFERTGGGTGLP

SEQ ID NO: 707791 - protein, 17 aa, Mycobacterium
PGGGARNFAAFGVDKQT

SEQ ID NO: 707792 - protein, 19 aa, Mycobacterium
PGGGGARFRSTSLKDGSSK

SEQ ID NO: 707793 - protein, 18 aa, Mycobacterium
PGGGRLLDDPAFARKLAD

SEQ ID NO: 707794 - protein, 20 aa, Mycobacterium
PGGGVTIVIPGHENVTLPHA

SEQ ID NO: 707795 - protein, 17 aa, Mycobacterium
PGGGYACMVRDPGGQLI

SEQ ID NO: 707796 - protein, 35 aa, Mycobacterium
PGGHCKGVCLGGYLLQGGYGWNSRIYGPACESVLG

SEQ ID NO: 707797 - protein, 28 aa, Mycobacterium
PGGHFLYTDFRLPFGIDAWETALADAPM

SEQ ID NO: 707798 - protein, 18 aa, Mycobacterium
PGGHIFRPEMFIRDLDGI

SEQ ID NO: 707799 - protein, 20 aa, Mycobacterium
PGGHVFRPDMFVLDLDGIIA

SEQ ID NO: 707800 - protein, 18 aa, Mycobacterium
PGGIAERIVGPLARAALE

SEQ ID NO: 707801 - protein, 27 aa, Mycobacterium
PGGIPPEFGEVLCWARDEQWDQVIRLI

SEQ ID NO: 707802 - protein, 18 aa, Mycobacterium
PGGIRFAYLSAPQAAVPF

SEQ ID NO: 707803 - protein, 17 aa, Mycobacterium
PGGKACFVMLDEETQAL

SEQ ID NO: 707804 - protein, 29 aa, Mycobacterium
PGGKTRKGGACSCGWRTPPFDPVGDRAKA

SEQ ID NO: 707805 - protein, 18 aa, Mycobacterium
PGGLAILSYTVWLGPFGG

SEQ ID NO: 707806 - protein, 18 aa, Mycobacterium
PGGLAVLSYTVWLGPFGG

SEQ ID NO: 707807 - protein, 20 aa, Mycobacterium
PGGLGGWLYGNNGPAGTGSP

SEQ ID NO: 707808 - protein, 19 aa, Mycobacterium
PGGLPDWISQADFDVYVDE

SEQ ID NO: 707809 - protein, 18 aa, Mycobacterium
PGGLRINGAKTWISNARR

SEQ ID NO: 707810 - protein, 22 aa, Mycobacterium
PGGLRRRHVQTLADLGPADLRR

SEQ ID NO: 707811 - protein, 17 aa, Mycobacterium
PGGLRWVAVHQADGYDP

SEQ ID NO: 707812 - protein, 21 aa, Mycobacterium
PGGLSTWLDPSINDFWTTYQT

SEQ ID NO: 707813 - protein, 17 aa, Mycobacterium
PGGLTVFDVRAEAMEPF

SEQ ID NO: 707814 - protein, 17 aa, Mycobacterium
PGGNFLYTDARSVQDVA

SEQ ID NO: 707815 - protein, 25 aa, Mycobacterium
PGGNGGAGGILWGNGGAGATGAAGQ

SEQ ID NO: 707816 - protein, 26 aa, Mycobacterium
PGGPFGPRPGFGFGPGPAQRRALHSA

SEQ ID NO: 707817 - protein, 18 aa, Mycobacterium
PGGPGRLSNIVFMGMGEP

SEQ ID NO: 707818 - protein, 19 aa, Mycobacterium
PGGPLARVEGRVSIERILD

SEQ ID NO: 707819 - protein, 21 aa, Mycobacterium
PGGPLLRPVRRAGPDHPGRPR

SEQ ID NO: 707820 - protein, 26 aa, Mycobacterium
PGGPRMSICAWRVGPTSSTRCCSPTG

SEQ ID NO: 707821 - protein, 18 aa, Mycobacterium
PGGQLRYLEHVASAGARG

SEQ ID NO: 707822 - protein, 17 aa, Mycobacterium
PGGQRWLGYTANNREYA

SEQ ID NO: 707823 - protein, 25 aa, Mycobacterium
PGGQTQFAAPVWLPRAQRPTIRQVQ

SEQ ID NO: 707824 - protein, 22 aa, Mycobacterium
PGGQTQFAAPVWMPRAKRNSIR

SEQ ID NO: 707825 - protein, 24 aa, Mycobacterium
PGGQTQFAAPVWMPRARRDSIREV

SEQ ID NO: 707826 - protein, 26 aa, Mycobacterium
PGGRAPRPGELFTFPDHADTLEKIAA

SEQ ID NO: 707827 - protein, 26 aa, Mycobacterium
PGGRDELWRFTPLKRLRGLHDGSATP

SEQ ID NO: 707828 - protein, 28 aa, Mycobacterium
PGGRDELWRFTPLRRLRGLHDGTAVATA

SEQ ID NO: 707829 - protein, 23 aa, Mycobacterium
PGGRHVFTVPVVWTRATTEARAR

SEQ ID NO: 707830 - protein, 17 aa, Mycobacterium
PGGRIAILTSYVPDLPP

SEQ ID NO: 707831 - protein, 21 aa, Mycobacterium
PGGRKDYRSGTAATLGQPTQR

SEQ ID NO: 707832 - protein, 20 aa, Mycobacterium
PGGRKSSSANGWEKLEQDVK

SEQ ID NO: 707833 - protein, 19 aa, Mycobacterium
PGGRLFMREGHPMLDTIDE

SEQ ID NO: 707834 - protein, 17 aa, Mycobacterium
PGGRRELEELVGRLMSY

SEQ ID NO: 707835 - protein, 18 aa, Mycobacterium
PGGRRFRRAVLRGRGPAA

SEQ ID NO: 707836 - protein, 18 aa, Mycobacterium
PGGRYAIHELGLMPDDLS

SEQ ID NO: 707837 - protein, 17 aa, Mycobacterium
PGGSHSWFAGYRGDLAF

SEQ ID NO: 707838 - protein, 29 aa, Mycobacterium
PGGSHSWFAGYRGDLAFASLIVGGGSSEY

SEQ ID NO: 707839 - protein, 21 aa, Mycobacterium
PGGSPRNVIAVSITTLTAHGG

SEQ ID NO: 707840 - protein, 21 aa, Mycobacterium
PGGSVIIQFVVKTLVGILDWG

SEQ ID NO: 707841 - protein, 20 aa, Mycobacterium
PGGSVVVGFQAMHTGAYSEP

SEQ ID NO: 707842 - protein, 18 aa, Mycobacterium
PGGTGHDGGVPGGGGGAG

SEQ ID NO: 707843 - protein, 27 aa, Mycobacterium
PGGTGTFSWPGAYGTWWQADPSADLIL

SEQ ID NO: 707844 - protein, 21 aa, Mycobacterium
PGGTPRPVFDDDLWDFTDVVG

SEQ ID NO: 707845 - protein, 18 aa, Mycobacterium
PGGTRGPLLERLGLPEPS

SEQ ID NO: 707846 - protein, 20 aa, Mycobacterium
PGGTRIGERLTDLPVTVYSD

SEQ ID NO: 707847 - protein, 18 aa, Mycobacterium
PGGTRLRVTYSRFDPSIP

SEQ ID NO: 707848 - protein, 27 aa, Mycobacterium
PGGVRGWEALRSLGCRISWAQTLAPAQ

SEQ ID NO: 707849 - protein, 20 aa, Mycobacterium
PGGWEWDLRRLVASIWVAGR

SEQ ID NO: 707850 - protein, 24 aa, Mycobacterium
PGGWPEPLRSTALAGRAPAKSAGQ

SEQ ID NO: 707851 - protein, 27 aa, Mycobacterium
PGGWRNLPSAFQVKAFRDATGETQEVR

SEQ ID NO: 707852 - protein, 24 aa, Mycobacterium
PGGWWPPLMLEPGWVSDNHSRFDV

SEQ ID NO: 707853 - protein, 23 aa, Mycobacterium
PGGYLKAAVDFALDRDDYGPGLR

SEQ ID NO: 707854 - protein, 23 aa, Mycobacterium
PGGYLKAAVDFALERDDYGPELR

SEQ ID NO: 707855 - protein, 17 aa, Mycobacterium
PGHAAEFDDTVVALSIR

SEQ ID NO: 707856 - protein, 26 aa, Mycobacterium
PGHADYAGMLKFGFDDARPVLERASA

SEQ ID NO: 707857 - protein, 19 aa, Mycobacterium
PGHAGAAVLRRMRLQPAGH

SEQ ID NO: 707858 - protein, 18 aa, Mycobacterium
PGHHRDATELAILHSDNP

SEQ ID NO: 707859 - protein, 23 aa, Mycobacterium
PGHICPISMTYAVVPALRYNPEL

SEQ ID NO: 707860 - protein, 32 aa, Mycobacterium
PGHIHLYQKFGFWPRFLTGLLAKTAAEPATVS

SEQ ID NO: 707861 - protein, 18 aa, Mycobacterium
PGHLTGRARVGRAGRRRA

SEQ ID NO: 707862 - protein, 26 aa, Mycobacterium
PGHLVTRWLATFAFFRAAMAAAAPRL

SEQ ID NO: 707863 - protein, 26 aa, Mycobacterium
PGHLVTRWLATFTFFRAALGVAAPRL

SEQ ID NO: 707864 - protein, 18 aa, Mycobacterium
PGHMCPISMTYAVVPALR

SEQ ID NO: 707865 - protein, 17 aa, Mycobacterium
PGHPDHVVYVWVDALTN

SEQ ID NO: 707866 - protein, 24 aa, Mycobacterium
PGHPESLVNWDALAAMSGTIVLLM

SEQ ID NO: 707867 - protein, 23 aa, Mycobacterium
PGHPESLVNWNALAALSGTIVLL

SEQ ID NO: 707868 - protein, 24 aa, Mycobacterium
PGHPESLVNWNALGAMSGTIVLLM

SEQ ID NO: 707869 - protein, 25 aa, Mycobacterium
PGHPEVRLPADYALQVPADYIDVLR

SEQ ID NO: 707870 - protein, 22 aa, Mycobacterium
PGHPRVLSIAQFWHRAAEHERI

SEQ ID NO: 707871 - protein, 33 aa, Mycobacterium
PGHQRAGGGVPRPVCAGFDRIRGLVCHGRGRQR

SEQ ID NO: 707872 - protein, 22 aa, Mycobacterium
PGHSRWYIERFRAMARAGDDLF

SEQ ID NO: 707873 - protein, 21 aa, Mycobacterium
PGHSRWYIERFRAMARAGEDL

SEQ ID NO: 707874 - protein, 19 aa, Mycobacterium
PGHTCPISMTYAVVPALRY

SEQ ID NO: 707875 - protein, 19 aa, Mycobacterium
PGHTPYRKLVMPFFTAPAV

SEQ ID NO: 707876 - protein, 23 aa, Mycobacterium
PGHTRGSVVFGIEVDSENGPVDV

SEQ ID NO: 707877 - protein, 22 aa, Mycobacterium
PGHVCPISMTYAVVPALRYNPE

SEQ ID NO: 707878 - protein, 22 aa, Mycobacterium
PGHVGAAWRGSWHGGLEFTTKC

SEQ ID NO: 707879 - protein, 21 aa, Mycobacterium
PGHVGAAWRGTWHGGLEFTKK

SEQ ID NO: 707880 - protein, 26 aa, Mycobacterium
PGHVHGGVCALVLDHVLGAAAHQPGR

SEQ ID NO: 707881 - protein, 34 aa, Mycobacterium
PGHVHGGVCAMILDHVLGAAVHQPGRPAVTGTLT

SEQ ID NO: 707882 - protein, 17 aa, Mycobacterium
PGHWTVSSELSMDLSPD

SEQ ID NO: 707883 - protein, 17 aa, Mycobacterium
PGIAGRIVVLDPGHNGA

SEQ ID NO: 707884 - protein, 22 aa, Mycobacterium
PGIARKRCGKGFAYYAANGDVL

SEQ ID NO: 707885 - protein, 23 aa, Mycobacterium
PGIDAAPQFPPRLRVDNAGRLAT

SEQ ID NO: 707886 - protein, 18 aa, Mycobacterium
PGIDPTFKALLDAFPMTF

SEQ ID NO: 707887 - protein, 19 aa, Mycobacterium
PGIEIALPFERPLYQPPTE

SEQ ID NO: 707888 - protein, 22 aa, Mycobacterium
PGIFAGRMVLFSAQPVRSGADL

SEQ ID NO: 707889 - protein, 27 aa, Mycobacterium
PGIGLKVGDIFAGYTIVRLLGAGGMGE

SEQ ID NO: 707890 - protein, 27 aa, Mycobacterium
PGIGSGGYRLTALFSNVLNLPDSAKVK

SEQ ID NO: 707891 - protein, 21 aa, Mycobacterium
PGIIAHGLCTMAFTSWAVLTE

SEQ ID NO: 707892 - protein, 31 aa, Mycobacterium
PGIKAGSDVLPWLPARGVYLLVERGSASPDP

SEQ ID NO: 707893 - protein, 17 aa, Mycobacterium
PGILMVFCTARVYDGFG

SEQ ID NO: 707894 - protein, 23 aa, Mycobacterium
PGILRHLEEVLTLLIGAGFTGED

SEQ ID NO: 707895 - protein, 24 aa, Mycobacterium
PGIPRLGVPPLRMSDAGLGVTNPG

SEQ ID NO: 707896 - protein, 24 aa, Mycobacterium
PGIQFKDLTPLLADARGLRVVTDA

SEQ ID NO: 707897 - protein, 18 aa, Mycobacterium
PGIRPRAAGAPRWSGRSA

SEQ ID NO: 707898 - protein, 25 aa, Mycobacterium
PGIRRRVAADLQILKRFAQAVELAK

SEQ ID NO: 707899 - protein, 24 aa, Mycobacterium
PGIRRRVAADLQILKRGARLVEFA

SEQ ID NO: 707900 - protein, 24 aa, Mycobacterium
PGIRRRVAADLQILQRFAQAVELA

SEQ ID NO: 707901 - protein, 18 aa, Mycobacterium
PGIRRVFDAPGLLSTLAP

SEQ ID NO: 707902 - protein, 25 aa, Mycobacterium
PGISTRLAAGMLMKGMTSEYLVRRT

SEQ ID NO: 707903 - protein, 17 aa, Mycobacterium
PGITPGTNWERFQAKAR

SEQ ID NO: 707904 - protein, 24 aa, Mycobacterium
PGITRTSIAIAMHELVAFRMTPLL

SEQ ID NO: 707905 - protein, 30 aa, Mycobacterium
PGKGNAMGPAFWEEMPDVFGTLDDDPDVRA

SEQ ID NO: 707906 - protein, 23 aa, Mycobacterium
PGKGNAMGPAFWSELPELFPELD

SEQ ID NO: 707907 - protein, 23 aa, Mycobacterium
PGKGNAMGPAFWSELPEVFAALD

SEQ ID NO: 707908 - protein, 24 aa, Mycobacterium
PGKGNAMGPAFWSELPVVFRELDA

SEQ ID NO: 707909 - protein, 32 aa, Mycobacterium
PGKGNAMGPAFWSEMPELFAALDADPEVRAIV

SEQ ID NO: 707910 - protein, 32 aa, Mycobacterium
PGKGNAMGPAFWSEMPEVFASLDADREVRAIV

SEQ ID NO: 707911 - protein, 24 aa, Mycobacterium
PGKGPAFVRTKLKNVVSGKVVDKT

SEQ ID NO: 707912 - protein, 24 aa, Mycobacterium
PGKHRLMTWRGGYHGDTFTPMSVC

SEQ ID NO: 707913 - protein, 18 aa, Mycobacterium
PGKIRLLSLAAGDFASAG

SEQ ID NO: 707914 - protein, 24 aa, Mycobacterium
PGKKVKRLSLLSGGEKSLTAVAML

SEQ ID NO: 707915 - protein, 19 aa, Mycobacterium
PGKLPAIRQQIWTLMRAAK

SEQ ID NO: 707916 - protein, 18 aa, Mycobacterium
PGKLPARTCIGVTALALD

SEQ ID NO: 707917 - protein, 18 aa, Mycobacterium
PGKLPDPAPVVLSDEPVE

SEQ ID NO: 707918 - protein, 19 aa, Mycobacterium
PGKMPWLVGENLRKQGVTI

SEQ ID NO: 707919 - protein, 19 aa, Mycobacterium
PGKPGDRATLSFTIADPSG

SEQ ID NO: 707920 - protein, 20 aa, Mycobacterium
PGKPWFAIGGIDQERLPEVL

SEQ ID NO: 707921 - protein, 29 aa, Mycobacterium
PGKRAPTVKLCESDENFVPLNDGYNWKGD

SEQ ID NO: 707922 - protein, 25 aa, Mycobacterium
PGKRPRSSMAPTFVFDGAPAEHSSL

SEQ ID NO: 707923 - protein, 24 aa, Mycobacterium
PGKRPRSSMAPTLVFERAESGKRG

SEQ ID NO: 707924 - protein, 24 aa, Mycobacterium
PGKRPRSTMAPTLIFDHDGGERGP

SEQ ID NO: 707925 - protein, 21 aa, Mycobacterium
PGKRRLKIAVITRSIHVEASP

SEQ ID NO: 707926 - protein, 18 aa, Mycobacterium
PGKVRRVRLLPSDPPATR

SEQ ID NO: 707927 - protein, 26 aa, Mycobacterium
PGLAARLDLPEGWSYEPRVLAETLRV

SEQ ID NO: 707928 - protein, 26 aa, Mycobacterium
PGLAARLNLPHGWAYQPRVLTEELRV

SEQ ID NO: 707929 - protein, 19 aa, Mycobacterium
PGLADALAIALANGGPDST

SEQ ID NO: 707930 - protein, 25 aa, Mycobacterium
PGLAHGGVCALVLDHMLGEAASQGL

SEQ ID NO: 707931 - protein, 19 aa, Mycobacterium
PGLAKTRLAATVGDQTAAD

SEQ ID NO: 707932 - protein, 19 aa, Mycobacterium
PGLAPLRCRLPSLPQGPNP

SEQ ID NO: 707933 - protein, 20 aa, Mycobacterium
PGLAPLRLPSPVTTAPRVLR

SEQ ID NO: 707934 - protein, 22 aa, Mycobacterium
PGLAQARPWTNRDLTTMTHVPG

SEQ ID NO: 707935 - protein, 19 aa, Mycobacterium
PGLAQRMSAGRGILHSEKN

SEQ ID NO: 707936 - protein, 19 aa, Mycobacterium
PGLARAVVNLHRRYRITTA

SEQ ID NO: 707937 - protein, 18 aa, Mycobacterium
PGLARFLPDLSRRLLDEP

SEQ ID NO: 707938 - protein, 18 aa, Mycobacterium
PGLARLIANRFRRALPPA

SEQ ID NO: 707939 - protein, 19 aa, Mycobacterium
PGLARSGGDLLAADVNGLW

SEQ ID NO: 707940 - protein, 19 aa, Mycobacterium
PGLARVGFVRSVRAPEFEG

SEQ ID NO: 707941 - protein, 30 aa, Mycobacterium
PGLASAARNSAGFGAPRYGVKPIVMPKPVS

SEQ ID NO: 707942 - protein, 22 aa, Mycobacterium
PGLATEWAKWNGLRPFVGSLTM

SEQ ID NO: 707943 - protein, 17 aa, Mycobacterium
PGLAVVIPGDLDDAAPL

SEQ ID NO: 707944 - protein, 21 aa, Mycobacterium
PGLDLRAGIACQLKDLGVTAI

SEQ ID NO: 707945 - protein, 18 aa, Mycobacterium
PGLDLRAGIACQLKGLGV

SEQ ID NO: 707946 - protein, 24 aa, Mycobacterium
PGLEGGVAEFGRWHTRVRGAKEVL

SEQ ID NO: 707947 - protein, 20 aa, Mycobacterium
PGLELDPAVTQRVLGAADPV

SEQ ID NO: 707948 - protein, 21 aa, Mycobacterium
PGLEPESLLTFIERHGVTAVA

SEQ ID NO: 707949 - protein, 19 aa, Mycobacterium
PGLESSPFVATPISRESLS

SEQ ID NO: 707950 - protein, 20 aa, Mycobacterium
PGLFRLRERMLTALLDAGFT

SEQ ID NO: 707951 - protein, 21 aa, Mycobacterium
PGLGASPSWHAFAIDQSGIAF

SEQ ID NO: 707952 - protein, 21 aa, Mycobacterium
PGLGASPSWHAFAIDQTGIAF

SEQ ID NO: 707953 - protein, 20 aa, Mycobacterium
PGLGCVAAPIGDPGQAVAAV

SEQ ID NO: 707954 - protein, 19 aa, Mycobacterium
PGLGFAKTAEHNWALLHAL

SEQ ID NO: 707955 - protein, 19 aa, Mycobacterium
PGLGFAKTGQHNWALLHAL

SEQ ID NO: 707956 - protein, 18 aa, Mycobacterium
PGLGRFVRRHSGSRWVDK

SEQ ID NO: 707957 - protein, 18 aa, Mycobacterium
PGLGRKAPIYVLEDAPWS

SEQ ID NO: 707958 - protein, 25 aa, Mycobacterium
PGLGVRPSKRYRYLLIASPAGAYFK

SEQ ID NO: 707959 - protein, 23 aa, Mycobacterium
PGLHAYRGPWQYETLTREMLLDC

SEQ ID NO: 707960 - protein, 23 aa, Mycobacterium
PGLHRPRTLLGKRLNDLVRATYA

SEQ ID NO: 707961 - protein, 23 aa, Mycobacterium
PGLHRPRTLLGKRLNDLVRDTYA

SEQ ID NO: 707962 - protein, 23 aa, Mycobacterium
PGLHRPRTLLGKRLNDLVRDTYG

SEQ ID NO: 707963 - protein, 23 aa, Mycobacterium
PGLHRPRTLLGKRLNDLVRDTYS

SEQ ID NO: 707964 - protein, 23 aa, Mycobacterium
PGLHRPRTLLGQRLNDLVKDTYS

SEQ ID NO: 707965 - protein, 22 aa, Mycobacterium
PGLHRPRTLLGQRLNDLVRDTY

SEQ ID NO: 707966 - protein, 24 aa, Mycobacterium
PGLHRPRTLLGQRLNELVKDTYSE

SEQ ID NO: 707967 - protein, 19 aa, Mycobacterium
PGLIDELGTLTWRQLDERS

SEQ ID NO: 707968 - protein, 17 aa, Mycobacterium
PGLIEAYRDRLPIEDSW

SEQ ID NO: 707969 - protein, 18 aa, Mycobacterium
PGLLDELEAGATPTDDEA

SEQ ID NO: 707970 - protein, 17 aa, Mycobacterium
PGLLDMILAMGGGELGD

SEQ ID NO: 707971 - protein, 17 aa, Mycobacterium
PGLLLSRVNRLQPFDGY

SEQ ID NO: 707972 - protein, 19 aa, Mycobacterium
PGLLNWRGVARVMSENPAR

SEQ ID NO: 707973 - protein, 18 aa, Mycobacterium
PGLLRFTSGFGQTTALVM

SEQ ID NO: 707974 - protein, 24 aa, Mycobacterium
PGLLTRFAGYTGLPASGQTTGQLG

SEQ ID NO: 707975 - protein, 27 aa, Mycobacterium
PGLMPLAVDEMIRWVTPVKEFMRTATA

SEQ ID NO: 707976 - protein, 22 aa, Mycobacterium
PGLPEHPGHDIAARQMRGFGGM

SEQ ID NO: 707977 - protein, 24 aa, Mycobacterium
PGLPHYYLSALQRLAGEREVIFWD

SEQ ID NO: 707978 - protein, 30 aa, Mycobacterium
PGLPPLSGGMVGLFAYDMVRRLERLPELAV

SEQ ID NO: 707979 - protein, 18 aa, Mycobacterium
PGLPRLINMYGATETTVH

SEQ ID NO: 707980 - protein, 20 aa, Mycobacterium
PGLPRMINMYGITETTVHAS

SEQ ID NO: 707981 - protein, 17 aa, Mycobacterium
PGLPWDDPGTIDRRHHP

SEQ ID NO: 707982 - protein, 26 aa, Mycobacterium
PGLPYLGLEHRAAWVEAEADGTITSM

SEQ ID NO: 707983 - protein, 19 aa, Mycobacterium
PGLQEKPLSIALREIHADL

SEQ ID NO: 707984 - protein, 19 aa, Mycobacterium
PGLQEKPLSIALREIHGDL

SEQ ID NO: 707985 - protein, 22 aa, Mycobacterium
PGLQLSTGVAVAFPRSPFVTAA

SEQ ID NO: 707986 - protein, 23 aa, Mycobacterium
PGLRAALDTGPWRRWISGRAAQL

SEQ ID NO: 707987 - protein, 17 aa, Mycobacterium
PGLRAALHERRPWRRWI

SEQ ID NO: 707988 - protein, 28 aa, Mycobacterium
PGLRALARLGIYWAQEALAFGMTKRPNV

SEQ ID NO: 707989 - protein, 28 aa, Mycobacterium
PGLRALARLGLYWAQEALAFGMTKRPNA

SEQ ID NO: 707990 - protein, 18 aa, Mycobacterium
PGLRDFAIAAAMVRGRQT

SEQ ID NO: 707991 - protein, 23 aa, Mycobacterium
PGLRETGFWRFVSDPEDDPSESQ

SEQ ID NO: 707992 - protein, 19 aa, Mycobacterium
PGLRLDSRELWPAQLDAGL

SEQ ID NO: 707993 - protein, 20 aa, Mycobacterium
PGLRLPQIIRTVLDGYADRP

SEQ ID NO: 707994 - protein, 18 aa, Mycobacterium
PGLRPRDVGWSLATTRAA

SEQ ID NO: 707995 - protein, 17 aa, Mycobacterium
PGLRQALGLAEDGTDDR

SEQ ID NO: 707996 - protein, 18 aa, Mycobacterium
PGLRQARVPGRLEQVDRG

SEQ ID NO: 707997 - protein, 17 aa, Mycobacterium
PGLRRLAPMAFVRFRID

SEQ ID NO: 707998 - protein, 21 aa, Mycobacterium
PGLRRTAAIGATFSAADYLDA

SEQ ID NO: 707999 - protein, 32 aa, Mycobacterium
PGLRTGRHLSDCAPWLWEAHVRHGDAGPAQTE

SEQ ID NO: 708000 - protein, 27 aa, Mycobacterium
PGLRVGWFEGGIAWVPWALQDAEHLVA

SEQ ID NO: 708001 - protein, 20 aa, Mycobacterium
PGLRVSVPLPNSAGEMYTTA

SEQ ID NO: 708002 - protein, 21 aa, Mycobacterium
PGLRVTQTFIARAQAHATLAQ

SEQ ID NO: 708003 - protein, 23 aa, Mycobacterium
PGLRWPDLALQAGRLTWSAVRDA

SEQ ID NO: 708004 - protein, 23 aa, Mycobacterium
PGLRWPDLALQGGRLDWPAVRAA

SEQ ID NO: 708005 - protein, 17 aa, Mycobacterium
PGLSDMLGGGPLGSDPL

SEQ ID NO: 708006 - protein, 27 aa, Mycobacterium
PGLSGRVVFGMRVFRMMEDRLAHHLLS

SEQ ID NO: 708007 - protein, 17 aa, Mycobacterium
PGLSMAGLLGRNIEDAA

SEQ ID NO: 708008 - protein, 18 aa, Mycobacterium
PGLSPAHSELRAWAVSST

SEQ ID NO: 708009 - protein, 26 aa, Mycobacterium
PGLSSTRFVACPFGEPGARMYRTGDL

SEQ ID NO: 708010 - protein, 17 aa, Mycobacterium
PGLTAGWVPLHKLSQWL

SEQ ID NO: 708011 - protein, 18 aa, Mycobacterium
PGLTIPGKLDKLGYKGID

SEQ ID NO: 708012 - protein, 18 aa, Mycobacterium
PGLTRLRSAYTLATLSNA

SEQ ID NO: 708013 - protein, 17 aa, Mycobacterium
PGLTWADIDHYRSITKL

SEQ ID NO: 708014 - protein, 20 aa, Mycobacterium
PGLVDPRINAPIPAQPTIPL

SEQ ID NO: 708015 - protein, 25 aa, Mycobacterium
PGLVHGGVCALVLDHLLGEAASQGR

SEQ ID NO: 708016 - protein, 17 aa, Mycobacterium
PGLVNALVQMRIDGQPA

SEQ ID NO: 708017 - protein, 22 aa, Mycobacterium
PGLWANLACRKRFIADKLTESL

SEQ ID NO: 708018 - protein, 19 aa, Mycobacterium
PGLWCSPGLSNSYLLTTAD

SEQ ID NO: 708019 - protein, 25 aa, Mycobacterium
PGLYPCPPFARLAGQDKWLLRPPPL

SEQ ID NO: 708020 - protein, 19 aa, Mycobacterium
PGMAEVYRDTRFIDAQSAE

SEQ ID NO: 708021 - protein, 18 aa, Mycobacterium
PGMARELFDAEPVFAETV

SEQ ID NO: 708022 - protein, 18 aa, Mycobacterium
PGMARELFDTEPVFAETV

SEQ ID NO: 708023 - protein, 19 aa, Mycobacterium
PGMARELFETEPVFADTLN

SEQ ID NO: 708024 - protein, 20 aa, Mycobacterium
PGMDGFGVLRRLRADGIDAP

SEQ ID NO: 708025 - protein, 24 aa, Mycobacterium
PGMELRIAPSEGRRSGEREIGEVE

SEQ ID NO: 708026 - protein, 17 aa, Mycobacterium
PGMGHGMMGPGMMGPTN

SEQ ID NO: 708027 - protein, 23 aa, Mycobacterium
PGMGMPGLGGGIPGLSSLGGGGM

SEQ ID NO: 708028 - protein, 30 aa, Mycobacterium
PGMGRLFYDAFPSFRAEVERCADLFDKQFG

SEQ ID NO: 708029 - protein, 19 aa, Mycobacterium
PGMIDWLSHYGVPFDSTVC

SEQ ID NO: 708030 - protein, 21 aa, Mycobacterium
PGMIERRAGGILISGSAAGNS

SEQ ID NO: 708031 - protein, 20 aa, Mycobacterium
PGMLTEWLELPGAAERIASW

SEQ ID NO: 708032 - protein, 25 aa, Mycobacterium
PGMMFPDRWIPNLADQVRAAALAGG

SEQ ID NO: 708033 - protein, 20 aa, Mycobacterium
PGMMGVPIPIPATGGNQTGS

SEQ ID NO: 708034 - protein, 18 aa, Mycobacterium
PGMNGIDVCRVLRADSGV

SEQ ID NO: 708035 - protein, 18 aa, Mycobacterium
PGMNGIDVCRVLRSDSGV

SEQ ID NO: 708036 - protein, 24 aa, Mycobacterium
PGMPPRPGAPGMPGMPGAPGAPGM

SEQ ID NO: 708037 - protein, 19 aa, Mycobacterium
PGMSRELFDTEPLFAETLR

SEQ ID NO: 708038 - protein, 17 aa, Mycobacterium
PGMTVLDIGCGWGACLD

SEQ ID NO: 708039 - protein, 23 aa, Mycobacterium
PGMVARRAGGILISGSAAGNSPI

SEQ ID NO: 708040 - protein, 21 aa, Mycobacterium
PGMVERRAGGILISGSAAGNS

SEQ ID NO: 708041 - protein, 23 aa, Mycobacterium
PGMVMKAPVWGAALDEICSAETL

SEQ ID NO: 708042 - protein, 24 aa, Mycobacterium
PGMVMKAPVWGAALDEICSPETLL

SEQ ID NO: 708043 - protein, 23 aa, Mycobacterium
PGMVRAAAATMFFGETAESLAAG

SEQ ID NO: 708044 - protein, 23 aa, Mycobacterium
PGMVRAAAATMFFGETAQTLAAG

SEQ ID NO: 708045 - protein, 21 aa, Mycobacterium
PGMYGRVGLIQTMREVSQELM

SEQ ID NO: 708046 - protein, 17 aa, Mycobacterium
PGNADWLRAHGVVPIAY

SEQ ID NO: 708047 - protein, 22 aa, Mycobacterium
PGNARSGLRAAMDILGNIEGIH

SEQ ID NO: 708048 - protein, 18 aa, Mycobacterium
PGNDAVQLQLFWDYQFNL

SEQ ID NO: 708049 - protein, 26 aa, Mycobacterium
PGNGFLPRLINTWAAKRARAGKTFFG

SEQ ID NO: 708050 - protein, 20 aa, Mycobacterium
PGNHMPSLPATWTVFDPEKG

SEQ ID NO: 708051 - protein, 25 aa, Mycobacterium
PGNNVEFFFLRPKDIAIYVGSGQLD

SEQ ID NO: 708052 - protein, 23 aa, Mycobacterium
PGNPRVLSIAQFWHRAAANELIS

SEQ ID NO: 708053 - protein, 21 aa, Mycobacterium
PGNPWYQLAVRGMQASSLREL

SEQ ID NO: 708054 - protein, 22 aa, Mycobacterium
PGNRAPLSFPMAGWNVAMDFPN

SEQ ID NO: 708055 - protein, 25 aa, Mycobacterium
PGNRYSATTPAEWGSTALTAAKDAG

SEQ ID NO: 708056 - protein, 25 aa, Mycobacterium
PGNSGVGIVEGWRGTVVHRVEVDES

SEQ ID NO: 708057 - protein, 17 aa, Mycobacterium
PGNSIQVVVSFDVPPGA

SEQ ID NO: 708058 - protein, 18 aa, Mycobacterium
PGNSLFINVNCWGKLVTG

SEQ ID NO: 708059 - protein, 27 aa, Mycobacterium
PGNSLFINVNCWGRLVTGVGAALGKGA

SEQ ID NO: 708060 - protein, 27 aa, Mycobacterium
PGNSLFITVNCWGRLVSGVGAALGKGA

SEQ ID NO: 708061 - protein, 24 aa, Mycobacterium
PGNSVPRFHITWGTGPGLVEIFAR

SEQ ID NO: 708062 - protein, 21 aa, Mycobacterium
PGNTFVGPRFGLYGRTQPTWR

SEQ ID NO: 708063 - protein, 25 aa, Mycobacterium
PGNTPLDYLSWLLGSTGNNTNPAML

SEQ ID NO: 708064 - protein, 17 aa, Mycobacterium
PGNVFVHAMLDREAGKA

SEQ ID NO: 708065 - protein, 21 aa, Mycobacterium
PGNVIRLGAAIGDTVTAGQPL

SEQ ID NO: 708066 - protein, 20 aa, Mycobacterium
PGNVIRLGADVGDAVTAGQP

SEQ ID NO: 708067 - protein, 19 aa, Mycobacterium
PGNVLSRRQLLEIVRDGPW

SEQ ID NO: 708068 - protein, 24 aa, Mycobacterium
PGNYRFGLDGSVGFVDFGCIKVVP

SEQ ID NO: 708069 - protein, 19 aa, Mycobacterium
PGNYRYAVNNSFGFGGHNV

SEQ ID NO: 708070 - protein, 17 aa, Mycobacterium
PGPAAARLAELLAGPTD

SEQ ID NO: 708071 - protein, 21 aa, Mycobacterium
PGPAANTARAWIDSMTARAQL

SEQ ID NO: 708072 - protein, 18 aa, Mycobacterium
PGPADCYSAAGYRRIVAL

SEQ ID NO: 708073 - protein, 18 aa, Mycobacterium
PGPAELLVAVHACGVCRT

SEQ ID NO: 708074 - protein, 17 aa, Mycobacterium
PGPAGMQAFGFVRALSR

SEQ ID NO: 708075 - protein, 21 aa, Mycobacterium
PGPAGSIAVRIYWPPIDSGTS

SEQ ID NO: 708076 - protein, 21 aa, Mycobacterium
PGPAPQLGMPPARWAADARSL

SEQ ID NO: 708077 - protein, 17 aa, Mycobacterium
PGPCGPASRGLYLVNAI

SEQ ID NO: 708078 - protein, 19 aa, Mycobacterium
PGPDASWRFLCWTAAFRSS

SEQ ID NO: 708079 - protein, 18 aa, Mycobacterium
PGPDAYKVLKKGSGQQEV

SEQ ID NO: 708080 - protein, 19 aa, Mycobacterium
PGPDDVHRAVREGREGNLV

SEQ ID NO: 708081 - protein, 23 aa, Mycobacterium
PGPDRVPLLALLRATPLTEDQIK

SEQ ID NO: 708082 - protein, 23 aa, Mycobacterium
PGPDRVPLLALLRRRLTDDEVRA

SEQ ID NO: 708083 - protein, 20 aa, Mycobacterium
PGPDRVPLLALLTRRLTNDE

SEQ ID NO: 708084 - protein, 20 aa, Mycobacterium
PGPDRVPLMALLRSTPLTED

SEQ ID NO: 708085 - protein, 18 aa, Mycobacterium
PGPDRVSACRKLADTFGA

SEQ ID NO: 708086 - protein, 24 aa, Mycobacterium
PGPEARFLTKVRHSAFYATSLDYL

SEQ ID NO: 708087 - protein, 17 aa, Mycobacterium
PGPFGVQVRPGAGVDGA

SEQ ID NO: 708088 - protein, 32 aa, Mycobacterium
PGPFNSMASFLWWKLEPAIAELERLDGTVVIT

SEQ ID NO: 708089 - protein, 19 aa, Mycobacterium
PGPFSLMAAAVAWDALAAE

SEQ ID NO: 708090 - protein, 19 aa, Mycobacterium
PGPFVPSVIASALISAHDP

SEQ ID NO: 708091 - protein, 31 aa, Mycobacterium
PGPGEVLVKVAFCGICHSDLSLINGTFPAQK

SEQ ID NO: 708092 - protein, 17 aa, Mycobacterium
PGPGFAMLRREGVRLLV

SEQ ID NO: 708093 - protein, 19 aa, Mycobacterium
PGPGFARFVASMRRLQDLA

SEQ ID NO: 708094 - protein, 18 aa, Mycobacterium
PGPGFGRFLTAMRRAQDL

SEQ ID NO: 708095 - protein, 19 aa, Mycobacterium
PGPGFGRFVAAMRAVQDLA

SEQ ID NO: 708096 - protein, 18 aa, Mycobacterium
PGPGFGRFVAAMRRLQDL

SEQ ID NO: 708097 - protein, 27 aa, Mycobacterium
PGPGLPRSCAVYGASVLVLPDAALDAV

SEQ ID NO: 708098 - protein, 25 aa, Mycobacterium
PGPGSRGLGPWGPNSARPDSSIFGL

SEQ ID NO: 708099 - protein, 25 aa, Mycobacterium
PGPGTVFLNVNWSFKAPVRPGDVIT

SEQ ID NO: 708100 - protein, 18 aa, Mycobacterium
PGPHGQRRTVVIAGDGSF

SEQ ID NO: 708101 - protein, 25 aa, Mycobacterium
PGPIAVDVRRWFEKNTHRAMVNRLE

SEQ ID NO: 708102 - protein, 21 aa, Mycobacterium
PGPKKPLYWRGARLAGNYPLS

SEQ ID NO: 708103 - protein, 18 aa, Mycobacterium
PGPLGRIRDWGIGLVTTA

SEQ ID NO: 708104 - protein, 19 aa, Mycobacterium
PGPLKALLREAVRDTVFID

SEQ ID NO: 708105 - protein, 29 aa, Mycobacterium
PGPLMARLDLPRVWRLTRGAGQRVAVIDT

SEQ ID NO: 708106 - protein, 18 aa, Mycobacterium
PGPLRAGDVLPVGPHTDD

SEQ ID NO: 708107 - protein, 17 aa, Mycobacterium
PGPMLAAAAAWDGLASD

SEQ ID NO: 708108 - protein, 22 aa, Mycobacterium
PGPMRAVVKAVPILKPVVPDPG

SEQ ID NO: 708109 - protein, 27 aa, Mycobacterium
PGPNVDLPVPPGWQLTQDSGTSYGGIV

SEQ ID NO: 708110 - protein, 19 aa, Mycobacterium
PGPPLRFFDVAGPERTRRD

SEQ ID NO: 708111 - protein, 21 aa, Mycobacterium
PGPPPAPAIVEPGAGQGDTPP

SEQ ID NO: 708112 - protein, 23 aa, Mycobacterium
PGPPRPGYLPTIIDGAAQHGLPP

SEQ ID NO: 708113 - protein, 22 aa, Mycobacterium
PGPPRPGYLPTIIDGAVQHGLP

SEQ ID NO: 708114 - protein, 18 aa, Mycobacterium
PGPPTVELLFREDFNAYG

SEQ ID NO: 708115 - protein, 18 aa, Mycobacterium
PGPPYAGPAGKDFVPFGM

SEQ ID NO: 708116 - protein, 23 aa, Mycobacterium
PGPQLYRAGPMFNPPHYGEPEAF

SEQ ID NO: 708117 - protein, 22 aa, Mycobacterium
PGPRGSIVKLMYAELAKEIGRL

SEQ ID NO: 708118 - protein, 22 aa, Mycobacterium
PGPRTDMFWNGFEMDGCYPASI

SEQ ID NO: 708119 - protein, 19 aa, Mycobacterium
PGPSELLVAVRACGVCRTD

SEQ ID NO: 708120 - protein, 20 aa, Mycobacterium
PGPSGGRLIDDPAFSRKLAD

SEQ ID NO: 708121 - protein, 25 aa, Mycobacterium
PGPSIACSRWGMLSPEGQCKTFDVS

SEQ ID NO: 708122 - protein, 24 aa, Mycobacterium
PGPTALLAPAWVPWDQRVRPGDLS

SEQ ID NO: 708123 - protein, 23 aa, Mycobacterium
PGPTALLAPQWVPWEERVRPGDL

SEQ ID NO: 708124 - protein, 23 aa, Mycobacterium
PGPTGERADWWWYDPFQPQPPPT

SEQ ID NO: 708125 - protein, 24 aa, Mycobacterium
PGPTGERADWWWYDPFQPQPPPTT

SEQ ID NO: 708126 - protein, 23 aa, Mycobacterium
PGPTGERAQWWWYDPFQPQPPPT

SEQ ID NO: 708127 - protein, 26 aa, Mycobacterium
PGPTLYEWAQSLALLGDPSHSGPRAI

SEQ ID NO: 708128 - protein, 32 aa, Mycobacterium
PGPTRLYEVLRVCMYGDLLFDITGSDPPVDGA

SEQ ID NO: 708129 - protein, 18 aa, Mycobacterium
PGPVQFVLLDGWKDLYLP

SEQ ID NO: 708130 - protein, 25 aa, Mycobacterium
PGPWAFLCVIAGRFRHGAKANRSPK

SEQ ID NO: 708131 - protein, 21 aa, Mycobacterium
PGPWLRTGDLGAFSEGELFII

SEQ ID NO: 708132 - protein, 31 aa, Mycobacterium
PGPYPWKNHRNAWRPAHIHFSLFGTEFTQRM

SEQ ID NO: 708133 - protein, 31 aa, Mycobacterium
PGPYPWRNHRNAWRPAHIHFSVFGTAFTQRL

SEQ ID NO: 708134 - protein, 20 aa, Mycobacterium
PGQAPEGVFLLRTVEDCLTI

SEQ ID NO: 708135 - protein, 17 aa, Mycobacterium
PGQARLVAYYTTTGNAG

SEQ ID NO: 708136 - protein, 21 aa, Mycobacterium
PGQDTNLYWAIQPHQFVRFEG

SEQ ID NO: 708137 - protein, 17 aa, Mycobacterium
PGQFEWLGLDPTNDQLI

SEQ ID NO: 708138 - protein, 17 aa, Mycobacterium
PGQFLTLKIPSEQTGSV

SEQ ID NO: 708139 - protein, 18 aa, Mycobacterium
PGQFRIGPHTDFGTVTVL

SEQ ID NO: 708140 - protein, 25 aa, Mycobacterium
PGQGMPNFRRNGVLMAKHGIYDPRQ

SEQ ID NO: 708141 - protein, 26 aa, Mycobacterium
PGQGSQWLGMGIELLDTAPVFAQQIQ

SEQ ID NO: 708142 - protein, 17 aa, Mycobacterium
PGQHIRRAGEDVTAGTT

SEQ ID NO: 708143 - protein, 19 aa, Mycobacterium
PGQILVLGGGEARDLDLPE

SEQ ID NO: 708144 - protein, 19 aa, Mycobacterium
PGQLAAYFCSGIGNRSGSG

SEQ ID NO: 708145 - protein, 19 aa, Mycobacterium
PGQLNAFNRTMCEEMARAW

SEQ ID NO: 708146 - protein, 17 aa, Mycobacterium
PGQLSVSGLVELGRDPA

SEQ ID NO: 708147 - protein, 18 aa, Mycobacterium
PGQLVIREVYGDWSAQRG

SEQ ID NO: 708148 - protein, 20 aa, Mycobacterium
PGQLVVSGWSAGAGIAAVVC

SEQ ID NO: 708149 - protein, 19 aa, Mycobacterium
PGQMHVFQLGAPMVPEASR

SEQ ID NO: 708150 - protein, 19 aa, Mycobacterium
PGQNALGLFDAVRRSKLTF

SEQ ID NO: 708151 - protein, 24 aa, Mycobacterium
PGQPKLAVILSKFDVLRALRDVEG

SEQ ID NO: 708152 - protein, 19 aa, Mycobacterium
PGQPVPDWFCESTDLTELA

SEQ ID NO: 708153 - protein, 25 aa, Mycobacterium
PGQRIPRKWLDSGVIIQAETLEELA

SEQ ID NO: 708154 - protein, 26 aa, Mycobacterium
PGQRIPRKWLDSGVIVMADTLEELAA

SEQ ID NO: 708155 - protein, 26 aa, Mycobacterium
PGQRIPRKWLESGVIISADTLEELAQ

SEQ ID NO: 708156 - protein, 25 aa, Mycobacterium
PGQRIPRKWLESGVIITADTLAELA

SEQ ID NO: 708157 - protein, 19 aa, Mycobacterium
PGQRIRIRFINAASDTTFR

SEQ ID NO: 708158 - protein, 20 aa, Mycobacterium
PGQTCWRTARADKFAPIVDA

SEQ ID NO: 708159 - protein, 26 aa, Mycobacterium
PGQTMSLEMWVKWSGYAGTNSPIKLQ

SEQ ID NO: 708160 - protein, 17 aa, Mycobacterium
PGQTVGPFFGYALPFDR

SEQ ID NO: 708161 - protein, 18 aa, Mycobacterium
PGQTVRLHWAYPRRPFET

SEQ ID NO: 708162 - protein, 18 aa, Mycobacterium
PGQVAAFLGVLLGGGTVV

SEQ ID NO: 708163 - protein, 18 aa, Mycobacterium
PGQVLGLTFTRKAAGQLL

SEQ ID NO: 708164 - protein, 17 aa, Mycobacterium
PGQVRTRMSAHVKEAPL

SEQ ID NO: 708165 - protein, 21 aa, Mycobacterium
PGQVWSQWHSMVFDVSVWEVW

SEQ ID NO: 708166 - protein, 28 aa, Mycobacterium
PGRAGRQWRARIGIVLQEVSDAGMLTVG

SEQ ID NO: 708167 - protein, 19 aa, Mycobacterium
PGRAIGRLTDLGWGARLRR

SEQ ID NO: 708168 - protein, 22 aa, Mycobacterium
PGRAPTGLVALRMITIDQADQL

SEQ ID NO: 708169 - protein, 17 aa, Mycobacterium
PGRARSGGRLVRQPQRL

SEQ ID NO: 708170 - protein, 23 aa, Mycobacterium
PGRDDWAVHIALWQRPAGDPTNG

SEQ ID NO: 708171 - protein, 23 aa, Mycobacterium
PGRDDWAVHIALWQRPSDGQREI

SEQ ID NO: 708172 - protein, 21 aa, Mycobacterium
PGRDPIPGVSFAFVSNSSPWT

SEQ ID NO: 708173 - protein, 24 aa, Mycobacterium
PGRDPRPAFTTATFAAGVEKVADL

SEQ ID NO: 708174 - protein, 20 aa, Mycobacterium
PGRDSLRTLVPVSVRAVDHF

SEQ ID NO: 708175 - protein, 20 aa, Mycobacterium
PGRDSLRTLVPVSVRGVNQF

SEQ ID NO: 708176 - protein, 19 aa, Mycobacterium
PGREPVGGVHFAFVSNSSP

SEQ ID NO: 708177 - protein, 24 aa, Mycobacterium
PGRFIPCGILPLFDVAEAAKEVKR

SEQ ID NO: 708178 - protein, 22 aa, Mycobacterium
PGRFLPMGLPILWDPELCAKEI

SEQ ID NO: 708179 - protein, 23 aa, Mycobacterium
PGRGDTALRWERLAELTEIDVVA

SEQ ID NO: 708180 - protein, 19 aa, Mycobacterium
PGRHRVIQAVVAFPDAAAA

SEQ ID NO: 708181 - protein, 18 aa, Mycobacterium
PGRIGYWQVGVPPSGPMD

SEQ ID NO: 708182 - protein, 19 aa, Mycobacterium
PGRIVPFVIALVELEEGVR

SEQ ID NO: 708183 - protein, 19 aa, Mycobacterium
PGRKVGWRTALDAWFDVIK

SEQ ID NO: 708184 - protein, 18 aa, Mycobacterium
PGRLDLRVTALVNDVVIG

SEQ ID NO: 708185 - protein, 19 aa, Mycobacterium
PGRLHRLGGMLASVGGLAP

SEQ ID NO: 708186 - protein, 20 aa, Mycobacterium
PGRLPRPVLTDLQWAIREGR

SEQ ID NO: 708187 - protein, 22 aa, Mycobacterium
PGRLQLPAMLVLVAPDCYGDSM

SEQ ID NO: 708188 - protein, 28 aa, Mycobacterium
PGRLRPSRRPRLGVRGHRRRPGHRVDRA

SEQ ID NO: 708189 - protein, 18 aa, Mycobacterium
PGRLRRLISEQIAVILRR

SEQ ID NO: 708190 - protein, 23 aa, Mycobacterium
PGRLSSKFWKLLGASTERNQARS

SEQ ID NO: 708191 - protein, 24 aa, Mycobacterium
PGRLSSRFWKLLGASTEKDRSRSL

SEQ ID NO: 708192 - protein, 24 aa, Mycobacterium
PGRLSSRFWRLLGASTEKNRNRSL

SEQ ID NO: 708193 - protein, 24 aa, Mycobacterium
PGRLSSRFWRLLGASTEKNRSRSL

SEQ ID NO: 708194 - protein, 18 aa, Mycobacterium
PGRMENWDYPDMARESGT

SEQ ID NO: 708195 - protein, 21 aa, Mycobacterium
PGRMNRPNWAAHLFAPTHARV

SEQ ID NO: 708196 - protein, 17 aa, Mycobacterium
PGRPAGLDKGYFVQPTV

SEQ ID NO: 708197 - protein, 21 aa, Mycobacterium
PGRPMPAFIVRRASESALDGA

SEQ ID NO: 708198 - protein, 23 aa, Mycobacterium
PGRPMPAFIVRRASESVLDSAVK

SEQ ID NO: 708199 - protein, 21 aa, Mycobacterium
PGRPPLMFRAVRQMDRGGTRH

SEQ ID NO: 708200 - protein, 22 aa, Mycobacterium
PGRPPLMFRAVRQMDRGGTRHY

SEQ ID NO: 708201 - protein, 19 aa, Mycobacterium
PGRPVFALVDLRGQSPDEV

SEQ ID NO: 708202 - protein, 17 aa, Mycobacterium
PGRPVHIYLQFDGLEEA

SEQ ID NO: 708203 - protein, 19 aa, Mycobacterium
PGRQRFSGQIVHPQHWPED

SEQ ID NO: 708204 - protein, 20 aa, Mycobacterium
PGRQRLRIAVLTRSIQRECS

SEQ ID NO: 708205 - protein, 21 aa, Mycobacterium
PGRQRLRIAVVTRSVQRESSP

SEQ ID NO: 708206 - protein, 19 aa, Mycobacterium
PGRQRLYWSSEGERRTAGP

SEQ ID NO: 708207 - protein, 21 aa, Mycobacterium
PGRRAAWLVIDVRDVAAVHAA

SEQ ID NO: 708208 - protein, 23 aa, Mycobacterium
PGRRGGRVAALIGDTARVVTYAP

SEQ ID NO: 708209 - protein, 29 aa, Mycobacterium
PGRRGLSTRWRPVLEPVLEKLAAEQLIVD

SEQ ID NO: 708210 - protein, 22 aa, Mycobacterium
PGRRHLCGRPRHRSGRRAHLTQ

SEQ ID NO: 708211 - protein, 24 aa, Mycobacterium
PGRRLYELAARIPIGTADRYTVLS

SEQ ID NO: 708212 - protein, 21 aa, Mycobacterium
PGRRPGTSSARDDILASARKL

SEQ ID NO: 708213 - protein, 19 aa, Mycobacterium
PGRRTCHALIVGVLAGAAI

SEQ ID NO: 708214 - protein, 21 aa, Mycobacterium
PGRRYEYLDSDGYAAYTAAST

SEQ ID NO: 708215 - protein, 24 aa, Mycobacterium
PGRSIAVATARRFAKATLELGGKS

SEQ ID NO: 708216 - protein, 26 aa, Mycobacterium
PGRSLGHPFLEQWRGREAELAADEAA

SEQ ID NO: 708217 - protein, 25 aa, Mycobacterium
PGRTRERRRVRTLATVTGNPAGTAL

SEQ ID NO: 708218 - protein, 18 aa, Mycobacterium
PGRWILGGFFASRYALGY

SEQ ID NO: 708219 - protein, 20 aa, Mycobacterium
PGRYADPWGAIRAKLGEPRP

SEQ ID NO: 708220 - protein, 24 aa, Mycobacterium
PGRYRLVVARACPWANRTSIVRRL

SEQ ID NO: 708221 - protein, 24 aa, Mycobacterium
PGRYTRRGLPSGCLIISGDDGSAD

SEQ ID NO: 708222 - protein, 17 aa, Mycobacterium
PGSAAAEAAEKAAGKPA

SEQ ID NO: 708223 - protein, 19 aa, Mycobacterium
PGSAICFISSVAGMGWEND

SEQ ID NO: 708224 - protein, 23 aa, Mycobacterium
PGSAIICPWPLRPRCESRRDRKR

SEQ ID NO: 708225 - protein, 22 aa, Mycobacterium
PGSAKFDLVASFADDGKTLGGF

SEQ ID NO: 708226 - protein, 19 aa, Mycobacterium
PGSAPIHDVDYWKKGLRHS

SEQ ID NO: 708227 - protein, 22 aa, Mycobacterium
PGSAPLLAAVAAWDGLAAELRS

SEQ ID NO: 708228 - protein, 27 aa, Mycobacterium
PGSAPLVQAARAWGRLANELNATAASY

SEQ ID NO: 708229 - protein, 22 aa, Mycobacterium
PGSAPMLAAMAAWDDVSAEMLL

SEQ ID NO: 708230 - protein, 25 aa, Mycobacterium
PGSARPEQQLALLAVRLEMAAVYRR

SEQ ID NO: 708231 - protein, 18 aa, Mycobacterium
PGSASGYHAMTFGHLVGE

SEQ ID NO: 708232 - protein, 27 aa, Mycobacterium
PGSASMMAAAWAWNLLAAELDSAANDY

SEQ ID NO: 708233 - protein, 26 aa, Mycobacterium
PGSASMMAAAWAWNMLAAELDSAATA

SEQ ID NO: 708234 - protein, 17 aa, Mycobacterium
PGSAVTSFISWRNHIRD

SEQ ID NO: 708235 - protein, 25 aa, Mycobacterium
PGSDFELAQGFLLTEGVIAGRDDVL

SEQ ID NO: 708236 - protein, 17 aa, Mycobacterium
PGSDHQLAFVNTLCSSV

SEQ ID NO: 708237 - protein, 26 aa, Mycobacterium
PGSDPFGVAFAERYSEGIVPQGISAE

SEQ ID NO: 708238 - protein, 22 aa, Mycobacterium
PGSDSLLRMRLDLAECATGVTK

SEQ ID NO: 708239 - protein, 22 aa, Mycobacterium
PGSDSLLRMRLDLEECATGVTK

SEQ ID NO: 708240 - protein, 19 aa, Mycobacterium
PGSDSLYWVGDTAALLDEV

SEQ ID NO: 708241 - protein, 22 aa, Mycobacterium
PGSEAWRLQLRQVDRLVESIVE

SEQ ID NO: 708242 - protein, 20 aa, Mycobacterium
PGSELFTVAPNFAFEHAAVR

SEQ ID NO: 708243 - protein, 18 aa, Mycobacterium
PGSFRRGRASRRGRYFDI

SEQ ID NO: 708244 - protein, 19 aa, Mycobacterium
PGSFVPRTASERGVVVEDR

SEQ ID NO: 708245 - protein, 26 aa, Mycobacterium
PGSGCAALGGYARYHAILGASEHCVA

SEQ ID NO: 708246 - protein, 36 aa, Mycobacterium
PGSGGIRGPIGLGFRTPCIVISPYSRGPLMVHDTFD

SEQ ID NO: 708247 - protein, 25 aa, Mycobacterium
PGSGKTRFALRIATELLADGTVDKI

SEQ ID NO: 708248 - protein, 19 aa, Mycobacterium
PGSGLDWRCASWLHDHEVA

SEQ ID NO: 708249 - protein, 25 aa, Mycobacterium
PGSGPMLAAALAWDGLSTELSSAAA

SEQ ID NO: 708250 - protein, 25 aa, Mycobacterium
PGSGPMLAAAMAWDELAAALQSTAD

SEQ ID NO: 708251 - protein, 26 aa, Mycobacterium
PGSGSRRGMSGSHGSYGQPGGSGADG

SEQ ID NO: 708252 - protein, 19 aa, Mycobacterium
PGSHMVAFPSLWSVIDEAT

SEQ ID NO: 708253 - protein, 23 aa, Mycobacterium
PGSIDRPDAWWRGLRLRVESSPQ

SEQ ID NO: 708254 - protein, 20 aa, Mycobacterium
PGSIDRPEVWWHTRKLKAEA

SEQ ID NO: 708255 - protein, 17 aa, Mycobacterium
PGSIIDVVDIDLPAERD

SEQ ID NO: 708256 - protein, 18 aa, Mycobacterium
PGSINCLATRGFPKTGDS

SEQ ID NO: 708257 - protein, 18 aa, Mycobacterium
PGSIRHRARITGPAVRRG

SEQ ID NO: 708258 - protein, 30 aa, Mycobacterium
PGSKATVTDLRWLRERGLAAGIAAHAAAGR

SEQ ID NO: 708259 - protein, 18 aa, Mycobacterium
PGSLLAFPVADLAEHLIA

SEQ ID NO: 708260 - protein, 22 aa, Mycobacterium
PGSLPGRVSYHLNLTGPSIAVS

SEQ ID NO: 708261 - protein, 20 aa, Mycobacterium
PGSLRALGRDEIGSLYKAVG

SEQ ID NO: 708262 - protein, 23 aa, Mycobacterium
PGSMSARVAVSVFSIEFLVHAWD

SEQ ID NO: 708263 - protein, 23 aa, Mycobacterium
PGSPAEPVLAAWGITTDGKPVFV

SEQ ID NO: 708264 - protein, 29 aa, Mycobacterium
PGSPLKFLVRAAGWPGGRTRVLGECHPHG

SEQ ID NO: 708265 - protein, 24 aa, Mycobacterium
PGSPRGRRGLVAGFDAVAVRAPRR

SEQ ID NO: 708266 - protein, 18 aa, Mycobacterium
PGSQRLTAALKRLGAPEP

SEQ ID NO: 708267 - protein, 19 aa, Mycobacterium
PGSRFLIRPVAAVLQPVFW

SEQ ID NO: 708268 - protein, 25 aa, Mycobacterium
PGSRFRIATPPGMRITIADLSVGEI

SEQ ID NO: 708269 - protein, 19 aa, Mycobacterium
PGSRPTLAELDRFVRSEIA

SEQ ID NO: 708270 - protein, 23 aa, Mycobacterium
PGSRRRVAFVFPGQGSQWPSMGV

SEQ ID NO: 708271 - protein, 38 aa, Mycobacterium
PGSRVAVLLPAHWQTAAVLFGIWWIGAEVVLSGEADIA

SEQ ID NO: 708272 - protein, 17 aa, Mycobacterium
PGSRVVRRSMRLAGSIY

SEQ ID NO: 708273 - protein, 24 aa, Mycobacterium
PGSRWRCVNIPAISTAGVPDALGR

SEQ ID NO: 708274 - protein, 27 aa, Mycobacterium
PGSSHAWRPDVVHAHDWLVAHPAIALA

SEQ ID NO: 708275 - protein, 19 aa, Mycobacterium
PGSTTQWAARLVGSHVSGQ

SEQ ID NO: 708276 - protein, 18 aa, Mycobacterium
PGSVVLWTNCHHPFYDEN

SEQ ID NO: 708277 - protein, 17 aa, Mycobacterium
PGSWDGIAGNPPYIRFG

SEQ ID NO: 708278 - protein, 24 aa, Mycobacterium
PGSYHCGLTFQFAHGPYASSAAHS

SEQ ID NO: 708279 - protein, 26 aa, Mycobacterium
PGTAAVALFRPAAVAVHLAPPRGSPR

SEQ ID NO: 708280 - protein, 20 aa, Mycobacterium
PGTALWLYAHPLRGSLNDHL

SEQ ID NO: 708281 - protein, 24 aa, Mycobacterium
PGTDAWCMAALAAVLVQENLCDEA

SEQ ID NO: 708282 - protein, 19 aa, Mycobacterium
PGTDGRLRTALNRVSSEEH

SEQ ID NO: 708283 - protein, 19 aa, Mycobacterium
PGTDMARSAEQFHLDGGHV

SEQ ID NO: 708284 - protein, 18 aa, Mycobacterium
PGTDVAVMLGLAYVLATE

SEQ ID NO: 708285 - protein, 26 aa, Mycobacterium
PGTEIRLAARPELIRLAGNGELKVTV

SEQ ID NO: 708286 - protein, 19 aa, Mycobacterium
PGTFTGDLVAGWTPLYKNE

SEQ ID NO: 708287 - protein, 18 aa, Mycobacterium
PGTGPGYHAIHFAAQGYS

SEQ ID NO: 708288 - protein, 17 aa, Mycobacterium
PGTGPGYHAIHYASQGF

SEQ ID NO: 708289 - protein, 27 aa, Mycobacterium
PGTGQAGGDGGLLIGNGGAGGSGAAGQ

SEQ ID NO: 708290 - protein, 28 aa, Mycobacterium
PGTGQNGGDGGWLIGNGGNGGSGAPGGN

SEQ ID NO: 708291 - protein, 17 aa, Mycobacterium
PGTGSSVAQGWMSDHDD

SEQ ID NO: 708292 - protein, 19 aa, Mycobacterium
PGTGSSVYQGWMSGHDDAI

SEQ ID NO: 708293 - protein, 19 aa, Mycobacterium
PGTIAGVLHNVRRAPKRVR

SEQ ID NO: 708294 - protein, 17 aa, Mycobacterium
PGTICGPVISARQRDRI

SEQ ID NO: 708295 - protein, 18 aa, Mycobacterium
PGTKGKLILLTSGTTGTP

SEQ ID NO: 708296 - protein, 19 aa, Mycobacterium
PGTLEAWGLGADALGGLNP

SEQ ID NO: 708297 - protein, 17 aa, Mycobacterium
PGTLIRQKIEVVVLTGI

SEQ ID NO: 708298 - protein, 18 aa, Mycobacterium
PGTNLPIQLGQIQTATSS

SEQ ID NO: 708299 - protein, 17 aa, Mycobacterium
PGTPAALNLGGIANLTV

SEQ ID NO: 708300 - protein, 19 aa, Mycobacterium
PGTPAFSVGYVQDSGGNLT

SEQ ID NO: 708301 - protein, 22 aa, Mycobacterium
PGTPEWQALAAPHQEFMAAAGD

SEQ ID NO: 708302 - protein, 17 aa, Mycobacterium
PGTPFGDLEVLPASEAL

SEQ ID NO: 708303 - protein, 17 aa, Mycobacterium
PGTPGAPGRGWSPSPDA

SEQ ID NO: 708304 - protein, 20 aa, Mycobacterium
PGTPPRWSAKPAGRAAAAGG

SEQ ID NO: 708305 - protein, 17 aa, Mycobacterium
PGTPVPPSGQWDRSSPA

SEQ ID NO: 708306 - protein, 18 aa, Mycobacterium
PGTPVVVVGHSFGAGLAM

SEQ ID NO: 708307 - protein, 25 aa, Mycobacterium
PGTRAAMRAGIYWIHETVGFAMTKQ

SEQ ID NO: 708308 - protein, 17 aa, Mycobacterium
PGTRFRIGTPAGIRVTV

SEQ ID NO: 708309 - protein, 26 aa, Mycobacterium
PGTRIGKSFLLLFGVLPFGFDDITVA

SEQ ID NO: 708310 - protein, 17 aa, Mycobacterium
PGTRLPTVRDLAGQLGV

SEQ ID NO: 708311 - protein, 19 aa, Mycobacterium
PGTRSAVVIDVDRIADACG

SEQ ID NO: 708312 - protein, 17 aa, Mycobacterium
PGTSAWITLSYAAAVKP

SEQ ID NO: 708313 - protein, 26 aa, Mycobacterium
PGTSFARWSSLLAEHAKDPAVLEQAG

SEQ ID NO: 708314 - protein, 25 aa, Mycobacterium
PGTSIACSRWGMLSPEGQCKTFDAD

SEQ ID NO: 708315 - protein, 20 aa, Mycobacterium
PGTTLWRRGMRDASAAAAPW

SEQ ID NO: 708316 - protein, 18 aa, Mycobacterium
PGTVLDLARETGYENLPA

SEQ ID NO: 708317 - protein, 18 aa, Mycobacterium
PGTVTSWQPTAAAREVAR

SEQ ID NO: 708318 - protein, 21 aa, Mycobacterium
PGTYVAGWIKRGPTGFIGTNK

SEQ ID NO: 708319 - protein, 20 aa, Mycobacterium
PGVAKAHFELWCFAVSSING

SEQ ID NO: 708320 - protein, 17 aa, Mycobacterium
PGVAVTLSSVFDHCQAR

SEQ ID NO: 708321 - protein, 24 aa, Mycobacterium
PGVDAWCEVDFVFPEGGTGVSTNS

SEQ ID NO: 708322 - protein, 24 aa, Mycobacterium
PGVDEMRMFGGLAFLIGGHMAVAV

SEQ ID NO: 708323 - protein, 21 aa, Mycobacterium
PGVDPRKVVLWGSSFSGSHVL

SEQ ID NO: 708324 - protein, 22 aa, Mycobacterium
PGVELWALAVSTSYGGSSVPAR

SEQ ID NO: 708325 - protein, 17 aa, Mycobacterium
PGVEVRPIISMNGGHHF

SEQ ID NO: 708326 - protein, 18 aa, Mycobacterium
PGVFRGALDAGARRITEE

SEQ ID NO: 708327 - protein, 24 aa, Mycobacterium
PGVFSGHVRLCLGYTEPEGGSDIA

SEQ ID NO: 708328 - protein, 20 aa, Mycobacterium
PGVGRPDLDVTRNFYTTSSC

SEQ ID NO: 708329 - protein, 24 aa, Mycobacterium
PGVGTCPMGTVAQKGDGAFEISKG

SEQ ID NO: 708330 - protein, 19 aa, Mycobacterium
PGVHGGWVQALALGYRVAM

SEQ ID NO: 708331 - protein, 20 aa, Mycobacterium
PGVIAGVVVDTAWFKGNYPP

SEQ ID NO: 708332 - protein, 17 aa, Mycobacterium
PGVKALSGVDLTVPAGS

SEQ ID NO: 708333 - protein, 29 aa, Mycobacterium
PGVKLSERFLLADIHLDWAVDRGGTTGWI

SEQ ID NO: 708334 - protein, 18 aa, Mycobacterium
PGVLERYLQPWLGADGQA

SEQ ID NO: 708335 - protein, 19 aa, Mycobacterium
PGVLRCANGVVLVAAATPV

SEQ ID NO: 708336 - protein, 20 aa, Mycobacterium
PGVLSARWSGSHGDDAGNTA

SEQ ID NO: 708337 - protein, 20 aa, Mycobacterium
PGVLSARWSGTHGNDAANTE

SEQ ID NO: 708338 - protein, 20 aa, Mycobacterium
PGVLSARWSGVHGDDAANTA

SEQ ID NO: 708339 - protein, 21 aa, Mycobacterium
PGVNCSPPLAPAGMRTSPVGS

SEQ ID NO: 708340 - protein, 26 aa, Mycobacterium
PGVNGWARPEFRGVVRVFAFAFTRYR

SEQ ID NO: 708341 - protein, 23 aa, Mycobacterium
PGVPDDLPYVWPRSDRERRVPIT

SEQ ID NO: 708342 - protein, 18 aa, Mycobacterium
PGVPDGRGLALFVSGDNL

SEQ ID NO: 708343 - protein, 21 aa, Mycobacterium
PGVPEFLAPEVALLQAGVEVD

SEQ ID NO: 708344 - protein, 21 aa, Mycobacterium
PGVPEHVGIYIGGGQVIHAPQ

SEQ ID NO: 708345 - protein, 23 aa, Mycobacterium
PGVPGNRGLALFISGDNLRKGAA

SEQ ID NO: 708346 - protein, 26 aa, Mycobacterium
PGVPGRSVTRWGAFLDDVAGFDCDFF

SEQ ID NO: 708347 - protein, 26 aa, Mycobacterium
PGVPGRSVTRWGAFLDDVGGFDCDFF

SEQ ID NO: 708348 - protein, 17 aa, Mycobacterium
PGVPLVAAVLRNGEIVW

SEQ ID NO: 708349 - protein, 24 aa, Mycobacterium
PGVPMVFPPWFERFQIKYINPALK

SEQ ID NO: 708350 - protein, 17 aa, Mycobacterium
PGVPNGQPVKGRLTMPP

SEQ ID NO: 708351 - protein, 24 aa, Mycobacterium
PGVQRFDYFRLLDRIVHQQADISE

SEQ ID NO: 708352 - protein, 21 aa, Mycobacterium
PGVRAKVRFHGRLVDAFVLER

SEQ ID NO: 708353 - protein, 17 aa, Mycobacterium
PGVRLDGAVIFDGVKVE

SEQ ID NO: 708354 - protein, 22 aa, Mycobacterium
PGVRLDGAVIFDGVKVEAGSVI

SEQ ID NO: 708355 - protein, 17 aa, Mycobacterium
PGVRLRGTVSFVPDDGG

SEQ ID NO: 708356 - protein, 20 aa, Mycobacterium
PGVRVPVRFTLGEHDNVFRA

SEQ ID NO: 708357 - protein, 19 aa, Mycobacterium
PGVRYRAFDLFEPGRPRMH

SEQ ID NO: 708358 - protein, 27 aa, Mycobacterium
PGVSCVKPAGALYAFPRLDPEVYDIAD

SEQ ID NO: 708359 - protein, 18 aa, Mycobacterium
PGVSIPLVQLRLQRDDGS

SEQ ID NO: 708360 - protein, 17 aa, Mycobacterium
PGVSTLGRFTGRGRTEE

SEQ ID NO: 708361 - protein, 18 aa, Mycobacterium
PGVTGEVYMRPSPGSTPT

SEQ ID NO: 708362 - protein, 18 aa, Mycobacterium
PGVTGRLLIGGQMAAPCY

SEQ ID NO: 708363 - protein, 17 aa, Mycobacterium
PGVTNWCETLGHRKGYL

SEQ ID NO: 708364 - protein, 27 aa, Mycobacterium
PGVTPRMWDWWFGWHGTDTRRYKLWHP

SEQ ID NO: 708365 - protein, 23 aa, Mycobacterium
PGVTRFLPQLAQLLLDETPQLDT

SEQ ID NO: 708366 - protein, 22 aa, Mycobacterium
PGVVMRPLMRLFDRAGRALYGA

SEQ ID NO: 708367 - protein, 19 aa, Mycobacterium
PGVVRYASDFEALRDRSDV

SEQ ID NO: 708368 - protein, 24 aa, Mycobacterium
PGVVTSMFGGLVRNLADQLGVELD

SEQ ID NO: 708369 - protein, 23 aa, Mycobacterium
PGWAEDLQHGLAMARSADPMSYA

SEQ ID NO: 708370 - protein, 21 aa, Mycobacterium
PGWDVLGAPVALPFGIAPTGF

SEQ ID NO: 708371 - protein, 21 aa, Mycobacterium
PGWGRRLVQQYARACLHLIRD

SEQ ID NO: 708372 - protein, 23 aa, Mycobacterium
PGWMQKAGLEWLYRLASEPRRLA

SEQ ID NO: 708373 - protein, 40 aa, Mycobacterium
PGYAHRSGLTASRFLACPFGGPGSRMYRTGDLVQWGEDGQ

SEQ ID NO: 708374 - protein, 18 aa, Mycobacterium
PGYDLTYDDVFIMPNRSE

SEQ ID NO: 708375 - protein, 19 aa, Mycobacterium
PGYDLTYNDVFIMPNRSEV

SEQ ID NO: 708376 - protein, 19 aa, Mycobacterium
PGYDLTYNDVFIMPNRSLV

SEQ ID NO: 708377 - protein, 19 aa, Mycobacterium
PGYERCRPWNVVAPVEPAA

SEQ ID NO: 708378 - protein, 25 aa, Mycobacterium
PGYGEMFAALGFGDLVRSARTGATR

SEQ ID NO: 708379 - protein, 24 aa, Mycobacterium
PGYGEMFSALGFDRLVGAARAGAS

SEQ ID NO: 708380 - protein, 19 aa, Mycobacterium
PGYHYPIAVLTMARGEARF

SEQ ID NO: 708381 - protein, 17 aa, Mycobacterium
PGYKGQDIFARGVSPEQ

SEQ ID NO: 708382 - protein, 18 aa, Mycobacterium
PGYLDWALRLTEPGAVIV

SEQ ID NO: 708383 - protein, 18 aa, Mycobacterium
PGYLRAAHGITVPGRHQL

SEQ ID NO: 708384 - protein, 20 aa, Mycobacterium
PGYLRLEASKVWPKEDGSPT

SEQ ID NO: 708385 - protein, 19 aa, Mycobacterium
PGYPGGTVKTGNWVTDQFQ

SEQ ID NO: 708386 - protein, 18 aa, Mycobacterium
PGYPRARKQFMLDDVRPT

SEQ ID NO: 708387 - protein, 25 aa, Mycobacterium
PGYPRTGPTVLFLGRFDEPRKGMAV

SEQ ID NO: 708388 - protein, 23 aa, Mycobacterium
PGYPTEGLLQWFVGSDDVAGMTF

SEQ ID NO: 708389 - protein, 20 aa, Mycobacterium
PGYRAGGPAGYADEDRFVSR

SEQ ID NO: 708390 - protein, 22 aa, Mycobacterium
PGYRKLAAGSHMLFYRVTTQGF

SEQ ID NO: 708391 - protein, 17 aa, Mycobacterium
PGYRLKVRTTRTEGRLD

SEQ ID NO: 708392 - protein, 17 aa, Mycobacterium
PGYRYLRARGNSIEGGT

SEQ ID NO: 708393 - protein, 31 aa, Mycobacterium
PGYTAGDTDLAWARITYWRALLTSAVDLPPH

SEQ ID NO: 708394 - protein, 31 aa, Mycobacterium
PGYTAGDTDLAWARITYWRALLTSAVDLTPH

SEQ ID NO: 708395 - protein, 26 aa, Mycobacterium
PGYTVPDFRRKAVVIAVGGVYDPRIH

SEQ ID NO: 708396 - protein, 20 aa, Mycobacterium
PGYYKRPEVTASVFDADGYY

SEQ ID NO: 708397 - protein, 22 aa, Mycobacterium
PGYYKRPEVTASVFDRDGYYHT

SEQ ID NO: 708398 - protein, 26 aa, Mycobacterium
PHAAARASIRRRFERIDRTFDEQAAE

SEQ ID NO: 708399 - protein, 18 aa, Mycobacterium
PHAAEAMECFGGNGYVED

SEQ ID NO: 708400 - protein, 30 aa, Mycobacterium
PHADLPRLLSLYKRGELKLKELITKTYRLE

SEQ ID NO: 708401 - protein, 19 aa, Mycobacterium
PHADPARAAEVRWHADGDM

SEQ ID NO: 708402 - protein, 24 aa, Mycobacterium
PHADVPKLLSAGAAAVFPTGTPLD

SEQ ID NO: 708403 - protein, 24 aa, Mycobacterium
PHADVPKLLSAGAAAVFPTGTSLD

SEQ ID NO: 708404 - protein, 19 aa, Mycobacterium
PHAELLAVISHREVIDRGL

SEQ ID NO: 708405 - protein, 17 aa, Mycobacterium
PHAGEFARLAGAPPGPD

SEQ ID NO: 708406 - protein, 23 aa, Mycobacterium
PHAGGLTFDFARLDPDDVLDLDV

SEQ ID NO: 708407 - protein, 18 aa, Mycobacterium
PHAHRVAAVELYPGEEAL

SEQ ID NO: 708408 - protein, 19 aa, Mycobacterium
PHALGVTDHLAFRVQTYGE

SEQ ID NO: 708409 - protein, 23 aa, Mycobacterium
PHALLGNAFHAWVQRFYGAESLF

SEQ ID NO: 708410 - protein, 25 aa, Mycobacterium
PHALLGNAFHSWVQKFYGAECLFDL

SEQ ID NO: 708411 - protein, 28 aa, Mycobacterium
PHALQLIMDSLRYWVIEMHVDGFRFDLA

SEQ ID NO: 708412 - protein, 29 aa, Mycobacterium
PHALQLIMDSLRYWVLEMHVDGFRFDLAA

SEQ ID NO: 708413 - protein, 20 aa, Mycobacterium
PHALQLIMDSLRYWVTEMHV

SEQ ID NO: 708414 - protein, 18 aa, Mycobacterium
PHAMRLRQAAILGDQREA

SEQ ID NO: 708415 - protein, 22 aa, Mycobacterium
PHAPIAEYFVWFGDEYHVDETD

SEQ ID NO: 708416 - protein, 23 aa, Mycobacterium
PHAPIAEYFVWFGDEYRIDETDR

SEQ ID NO: 708417 - protein, 18 aa, Mycobacterium
PHAQLGNAFHTWVQQFYG

SEQ ID NO: 708418 - protein, 18 aa, Mycobacterium
PHARPGMSAAEIADKLNW

SEQ ID NO: 708419 - protein, 19 aa, Mycobacterium
PHARVRYTTIQNWSNNVYN

SEQ ID NO: 708420 - protein, 21 aa, Mycobacterium
PHAWSSAPNFAFDLAARRTSD

SEQ ID NO: 708421 - protein, 24 aa, Mycobacterium
PHCPSSPVLPGIVWYSAETQPEGW

SEQ ID NO: 708422 - protein, 18 aa, Mycobacterium
PHCQEMFEAVVAGATDPE

SEQ ID NO: 708423 - protein, 21 aa, Mycobacterium
PHDAEFRRHCLLQLHKAMAES

SEQ ID NO: 708424 - protein, 20 aa, Mycobacterium
PHDAEYLFDQFIDLMAGEHH

SEQ ID NO: 708425 - protein, 17 aa, Mycobacterium
PHDEWQPLPTWFGRLNG

SEQ ID NO: 708426 - protein, 19 aa, Mycobacterium
PHDFYRPNHQSVYEAILDL

SEQ ID NO: 708427 - protein, 19 aa, Mycobacterium
PHDGCCSHGAFLSDDDDRA

SEQ ID NO: 708428 - protein, 18 aa, Mycobacterium
PHDGRPDIRIGLAELGTV

SEQ ID NO: 708429 - protein, 26 aa, Mycobacterium
PHDIVLFPAWVRRNPLKPSLLDPPPV

SEQ ID NO: 708430 - protein, 26 aa, Mycobacterium
PHDIVLFPAWVRRSPVEPSPLDPPAV

SEQ ID NO: 708431 - protein, 22 aa, Mycobacterium
PHDLGPRFTFVTADVTDEDAVA

SEQ ID NO: 708432 - protein, 22 aa, Mycobacterium
PHDLWPKQYPAATARAVTTASA

SEQ ID NO: 708433 - protein, 21 aa, Mycobacterium
PHDRAAAPIVVLGASGIVGTG

SEQ ID NO: 708434 - protein, 17 aa, Mycobacterium
PHDRDPFSPPAAGVAGD

SEQ ID NO: 708435 - protein, 19 aa, Mycobacterium
PHDTRPNAPAAYGDNRCSL

SEQ ID NO: 708436 - protein, 37 aa, Mycobacterium
PHDYYWRAGMELRPAPSRLRFDSMWTQSRRDILEPWM

SEQ ID NO: 708437 - protein, 18 aa, Mycobacterium
PHEAVVVGPLHFEPTSAV

SEQ ID NO: 708438 - protein, 24 aa, Mycobacterium
PHEECEVLVGLGMRTRADGRTLLL

SEQ ID NO: 708439 - protein, 17 aa, Mycobacterium
PHEEVARERGHRSAMAR

SEQ ID NO: 708440 - protein, 18 aa, Mycobacterium
PHEGAPLCRGLIGGTNES

SEQ ID NO: 708441 - protein, 18 aa, Mycobacterium
PHEGWAFVTDEIDEGRPV

SEQ ID NO: 708442 - protein, 23 aa, Mycobacterium
PHEPLRFVLAAGQPVPLRRMLPA

SEQ ID NO: 708443 - protein, 21 aa, Mycobacterium
PHERIPRIVKEIGASSVHVST

SEQ ID NO: 708444 - protein, 20 aa, Mycobacterium
PHERWLRAVAAGGQGRYNCA

SEQ ID NO: 708445 - protein, 20 aa, Mycobacterium
PHESIPRLVKMIEDGALPVH

SEQ ID NO: 708446 - protein, 25 aa, Mycobacterium
PHETRLLLRKSLRLLRDKQLWFRTA

SEQ ID NO: 708447 - protein, 24 aa, Mycobacterium
PHETRLLLRKSLRLLRDKQNGPKV

SEQ ID NO: 708448 - protein, 20 aa, Mycobacterium
PHEVELRKKVKAYLKEHDTE

SEQ ID NO: 708449 - protein, 18 aa, Mycobacterium
PHFCIGAPLARLEAAVAL

SEQ ID NO: 708450 - protein, 17 aa, Mycobacterium
PHFDAGIAGKVMHSTGD

SEQ ID NO: 708451 - protein, 20 aa, Mycobacterium
PHFDGYPIVLIRLAAIEPDE

SEQ ID NO: 708452 - protein, 17 aa, Mycobacterium
PHFGWPTAVVSGGRDLI

SEQ ID NO: 708453 - protein, 19 aa, Mycobacterium
PHGAHCPSCNIDYDRDFER

SEQ ID NO: 708454 - protein, 18 aa, Mycobacterium
PHGAWTFYATTPGPQSCA

SEQ ID NO: 708455 - protein, 19 aa, Mycobacterium
PHGDYRFGQQIVVSHDGGD

SEQ ID NO: 708456 - protein, 18 aa, Mycobacterium
PHGECFLFDGRVHTYEAV

SEQ ID NO: 708457 - protein, 22 aa, Mycobacterium
PHGESGKVIGIRVFSRDDDDDL

SEQ ID NO: 708458 - protein, 21 aa, Mycobacterium
PHGESGKVIGIRVFSREDDDE

SEQ ID NO: 708459 - protein, 24 aa, Mycobacterium
PHGFGISALLPYVMRYNLPTRVPE

SEQ ID NO: 708460 - protein, 21 aa, Mycobacterium
PHGGPDPRGGYPPEAGGYPPQ

SEQ ID NO: 708461 - protein, 27 aa, Mycobacterium
PHGGWKGSGLGSRFGGVDGLRKYCRTE

SEQ ID NO: 708462 - protein, 18 aa, Mycobacterium
PHGIPVSHTEEFNRVLLD

SEQ ID NO: 708463 - protein, 18 aa, Mycobacterium
PHGKVARDYGVFNEDAGY

SEQ ID NO: 708464 - protein, 29 aa, Mycobacterium
PHGLNAGGFFGVLTNVVWTNRGPCAVEGF

SEQ ID NO: 708465 - protein, 18 aa, Mycobacterium
PHGLPGTYLAGFFEMRPL

SEQ ID NO: 708466 - protein, 25 aa, Mycobacterium
PHGPVKFPGVPTWFSRTPGKVRGPA

SEQ ID NO: 708467 - protein, 25 aa, Mycobacterium
PHGPVRFPGVPTWFSQTPGRIAGPA

SEQ ID NO: 708468 - protein, 25 aa, Mycobacterium
PHGPVRFPGVPTWFSQTPGRVAGPA

SEQ ID NO: 708469 - protein, 24 aa, Mycobacterium
PHGRLRTPVFNFIAPKVAGLPFSG

SEQ ID NO: 708470 - protein, 17 aa, Mycobacterium
PHGRRWGSVLGPQPDGL

SEQ ID NO: 708471 - protein, 31 aa, Mycobacterium
PHGSIPVLRPEWPRAALSVGDLGWSDTVPAR

SEQ ID NO: 708472 - protein, 17 aa, Mycobacterium
PHGWGHGIDGTRLAVAN

SEQ ID NO: 708473 - protein, 23 aa, Mycobacterium
PHGWGHKGTGGWTVANKAGGANV

SEQ ID NO: 708474 - protein, 24 aa, Mycobacterium
PHHAPRITLALLHFGEEPRELTAH

SEQ ID NO: 708475 - protein, 19 aa, Mycobacterium
PHHGIDFVTILAPEERANL

SEQ ID NO: 708476 - protein, 17 aa, Mycobacterium
PHHIEVVHAPDLHFLIF

SEQ ID NO: 708477 - protein, 25 aa, Mycobacterium
PHHLPRLGEEGVFPASMGRPEYPTP

SEQ ID NO: 708478 - protein, 24 aa, Mycobacterium
PHHPHARIAFMLTDTTPAAVLTTT

SEQ ID NO: 708479 - protein, 24 aa, Mycobacterium
PHHPIRLAAFGPRALLPATVLARW

SEQ ID NO: 708480 - protein, 24 aa, Mycobacterium
PHHPPTRIAFMLTDTTPTAIITTT

SEQ ID NO: 708481 - protein, 19 aa, Mycobacterium
PHHRGLREPFGAEVHHVNP

SEQ ID NO: 708482 - protein, 18 aa, Mycobacterium
PHHRVVLRQQIFGYTYEE

SEQ ID NO: 708483 - protein, 19 aa, Mycobacterium
PHHRVVLRQQIFGYTYEEL

SEQ ID NO: 708484 - protein, 25 aa, Mycobacterium
PHHTHPVRFVWVRDLTTRRALLDAL

SEQ ID NO: 708485 - protein, 24 aa, Mycobacterium
PHHTRLRKIISRGFTPRAIGRLEA

SEQ ID NO: 708486 - protein, 24 aa, Mycobacterium
PHHTRLRKIISRGFTPRAIGRLRD

SEQ ID NO: 708487 - protein, 23 aa, Mycobacterium
PHHTRLRKIISRGFTPRAVGRLR

SEQ ID NO: 708488 - protein, 19 aa, Mycobacterium
PHHTRPVRFVWLQHPGTRA

SEQ ID NO: 708489 - protein, 25 aa, Mycobacterium
PHHTRPVRFVWLQSHATRIALLDAM

SEQ ID NO: 708490 - protein, 23 aa, Mycobacterium
PHHTRPVRFVWLQTPAVRARLLD

SEQ ID NO: 708491 - protein, 23 aa, Mycobacterium
PHHTRPVRFVWLQTRDIRLRLLD

SEQ ID NO: 708492 - protein, 22 aa, Mycobacterium
PHHTRPVRFVWVQDGALRVGLL

SEQ ID NO: 708493 - protein, 22 aa, Mycobacterium
PHHTRPVRFVWVQDSETRTRLL

SEQ ID NO: 708494 - protein, 17 aa, Mycobacterium
PHIAFGCGEHSCVGAQL

SEQ ID NO: 708495 - protein, 20 aa, Mycobacterium
PHIAVAPDLVASAANQLERI

SEQ ID NO: 708496 - protein, 17 aa, Mycobacterium
PHIEAMCERENRVVIRC

SEQ ID NO: 708497 - protein, 27 aa, Mycobacterium
PHIEKRFSMPWSHPARRMREFVAALHA

SEQ ID NO: 708498 - protein, 25 aa, Mycobacterium
PHIGPFRVPGIPAFIDPEHDRPRPT

SEQ ID NO: 708499 - protein, 20 aa, Mycobacterium
PHIHCDLRFGTEGTAASAND

SEQ ID NO: 708500 - protein, 25 aa, Mycobacterium
PHILSGSGWHTALFGMQHESAYPAT

SEQ ID NO: 708501 - protein, 20 aa, Mycobacterium
PHIMRLFSALELLHACALVH

SEQ ID NO: 708502 - protein, 18 aa, Mycobacterium
PHIPEVRGPVSTQDLVGF

SEQ ID NO: 708503 - protein, 24 aa, Mycobacterium
PHIPTTRYIPAFKLTRSSAAYWRG

SEQ ID NO: 708504 - protein, 19 aa, Mycobacterium
PHIPWDRLPVEVVKESIPW

SEQ ID NO: 708505 - protein, 28 aa, Mycobacterium
PHIPWDRLPVEVVREARPWGRNGRPRIA

SEQ ID NO: 708506 - protein, 24 aa, Mycobacterium
PHIPWERLPIEVVRETVPWQRNGK

SEQ ID NO: 708507 - protein, 24 aa, Mycobacterium
PHIREQLAWCYGRVEIMRCRGYQA

SEQ ID NO: 708508 - protein, 24 aa, Mycobacterium
PHISAALRAGEPVGGMNFHRYPVA

SEQ ID NO: 708509 - protein, 17 aa, Mycobacterium
PHITRRFDMPWSSPAAR

SEQ ID NO: 708510 - protein, 29 aa, Mycobacterium
PHKPDMAAWLNEWATGFARATPDCLHTAT

SEQ ID NO: 708511 - protein, 26 aa, Mycobacterium
PHKPDMAAWLNQWAREFARNTPDCLS

SEQ ID NO: 708512 - protein, 30 aa, Mycobacterium
PHKTVLSLEFARLAGYYLAEGHACLTNGCE

SEQ ID NO: 708513 - protein, 22 aa, Mycobacterium
PHLACLDPRLTVADLAALDVAA

SEQ ID NO: 708514 - protein, 20 aa, Mycobacterium
PHLAGTAVRPVARMSAATAA

SEQ ID NO: 708515 - protein, 18 aa, Mycobacterium
PHLATSFWFALGEPEVAR

SEQ ID NO: 708516 - protein, 17 aa, Mycobacterium
PHLCSRAFITEQYDRYV

SEQ ID NO: 708517 - protein, 18 aa, Mycobacterium
PHLEWQLRRRVLALGNVE

SEQ ID NO: 708518 - protein, 20 aa, Mycobacterium
PHLFDRDGVDFATGPPPPAL

SEQ ID NO: 708519 - protein, 17 aa, Mycobacterium
PHLGLIVGKSVGSAVDR

SEQ ID NO: 708520 - protein, 18 aa, Mycobacterium
PHLGTSFWFAFGSPDQAR

SEQ ID NO: 708521 - protein, 17 aa, Mycobacterium
PHLNRRHTIFGEVTDPD

SEQ ID NO: 708522 - protein, 25 aa, Mycobacterium
PHLPERHPARHWRGRFREADVAARA

SEQ ID NO: 708523 - protein, 17 aa, Mycobacterium
PHLPVRVRDGVGLVGPL

SEQ ID NO: 708524 - protein, 21 aa, Mycobacterium
PHLPWPFGALNFAARMLRPSP

SEQ ID NO: 708525 - protein, 19 aa, Mycobacterium
PHLQANWTWAPSALDHEQV

SEQ ID NO: 708526 - protein, 18 aa, Mycobacterium
PHLQCISFDLPAVTDITR

SEQ ID NO: 708527 - protein, 21 aa, Mycobacterium
PHLRGLHKPLLPEGIAQPEDV

SEQ ID NO: 708528 - protein, 25 aa, Mycobacterium
PHLRQARAGAHVVTLAPPLNMNPHW

SEQ ID NO: 708529 - protein, 19 aa, Mycobacterium
PHLRVLHGYTRDAHGTDLV

SEQ ID NO: 708530 - protein, 27 aa, Mycobacterium
PHLVEAWESAWPVARWHRYLRAQLEGA

SEQ ID NO: 708531 - protein, 23 aa, Mycobacterium
PHLVPVVFALPVGRSDVLYTAVD

SEQ ID NO: 708532 - protein, 19 aa, Mycobacterium
PHLVTTWEYDWPVARWRNH

SEQ ID NO: 708533 - protein, 32 aa, Mycobacterium
PHLYSRTAAFATEFADALSIADLVFVLDVYGA

SEQ ID NO: 708534 - protein, 17 aa, Mycobacterium
PHMPLIGSGGIRTGMDA

SEQ ID NO: 708535 - protein, 23 aa, Mycobacterium
PHMRRRFARHLAERDVRLLDVEA

SEQ ID NO: 708536 - protein, 17 aa, Mycobacterium
PHMSWLDVFAIGSVLPG

SEQ ID NO: 708537 - protein, 25 aa, Mycobacterium
PHMTVAGNMEFCLKNAGLSKDERRR

SEQ ID NO: 708538 - protein, 22 aa, Mycobacterium
PHNELACGMAEVVKAGFIADPV

SEQ ID NO: 708539 - protein, 27 aa, Mycobacterium
PHNERLYCIPATIDLAGAEIELVSMVA

SEQ ID NO: 708540 - protein, 23 aa, Mycobacterium
PHNLFPLVFDMLFRGETPRINGD

SEQ ID NO: 708541 - protein, 17 aa, Mycobacterium
PHPDEFEALAGRCPVFR

SEQ ID NO: 708542 - protein, 18 aa, Mycobacterium
PHPELLRAWDLPTTADGL

SEQ ID NO: 708543 - protein, 18 aa, Mycobacterium
PHPEWGPGLTNLEYAPLA

SEQ ID NO: 708544 - protein, 18 aa, Mycobacterium
PHPGDGNPVLGFVTYGKV

SEQ ID NO: 708545 - protein, 19 aa, Mycobacterium
PHPHLDPDTLAPMTPVTIP

SEQ ID NO: 708546 - protein, 21 aa, Mycobacterium
PHPIQGIGAGFVPPVLDLALV

SEQ ID NO: 708547 - protein, 21 aa, Mycobacterium
PHPIQGIGAGFVPPVLDMGLV

SEQ ID NO: 708548 - protein, 20 aa, Mycobacterium
PHPKLPGTIYTAAEEIEAAG

SEQ ID NO: 708549 - protein, 20 aa, Mycobacterium
PHPKLPGTVFTAAKELEEAG

SEQ ID NO: 708550 - protein, 27 aa, Mycobacterium
PHPLAHLRAFVLIPWLDVDPDATLTVA

SEQ ID NO: 708551 - protein, 19 aa, Mycobacterium
PHPLFSAFIRAAMEYKAAE

SEQ ID NO: 708552 - protein, 22 aa, Mycobacterium
PHPMFVPWLVGPLLTGDGIHLV

SEQ ID NO: 708553 - protein, 18 aa, Mycobacterium
PHPPHWLVELLAQRLTTL

SEQ ID NO: 708554 - protein, 24 aa, Mycobacterium
PHPPRRVWDAIINPSSWWESPEQS

SEQ ID NO: 708555 - protein, 26 aa, Mycobacterium
PHPRAEVFESLRFVLNGEQIRPLEVS

SEQ ID NO: 708556 - protein, 20 aa, Mycobacterium
PHPRAIHDFYGFPRELFDVE

SEQ ID NO: 708557 - protein, 26 aa, Mycobacterium
PHPRAPFRYLGMLPWVGAVADYLGEY

SEQ ID NO: 708558 - protein, 17 aa, Mycobacterium
PHPRASVLQPLRIGVDV

SEQ ID NO: 708559 - protein, 19 aa, Mycobacterium
PHPTLCVIHGFMGSPYLAN

SEQ ID NO: 708560 - protein, 24 aa, Mycobacterium
PHPTSRRELLAALTKRGREVVRQV

SEQ ID NO: 708561 - protein, 26 aa, Mycobacterium
PHPTSRRELLAALTTRGRDVVHQVTA

SEQ ID NO: 708562 - protein, 22 aa, Mycobacterium
PHPWDELWLDAAVRHPTRDQWW

SEQ ID NO: 708563 - protein, 26 aa, Mycobacterium
PHPYFPRLRLELDKGLGWKAEVEAAL

SEQ ID NO: 708564 - protein, 25 aa, Mycobacterium
PHQAARASIRRRFERIDRTFDQQAA

SEQ ID NO: 708565 - protein, 27 aa, Mycobacterium
PHQCARLAQRSALAVGRLGGTGEQYSG

SEQ ID NO: 708566 - protein, 25 aa, Mycobacterium
PHQDCLPAPLVDQARAADDDGEHAR

SEQ ID NO: 708567 - protein, 26 aa, Mycobacterium
PHQIPRAGNMLSVFFTDGPVTDFASA

SEQ ID NO: 708568 - protein, 19 aa, Mycobacterium
PHQLLRSWYIAYFQLPWLP

SEQ ID NO: 708569 - protein, 17 aa, Mycobacterium
PHQRLALECAWEAFERG

SEQ ID NO: 708570 - protein, 19 aa, Mycobacterium
PHQVLTAFAARRMRRPVKL

SEQ ID NO: 708571 - protein, 18 aa, Mycobacterium
PHQVRGYFNTVFDARLSD

SEQ ID NO: 708572 - protein, 26 aa, Mycobacterium
PHRAHAAVCTPRFCAHREGDALTVEH

SEQ ID NO: 708573 - protein, 17 aa, Mycobacterium
PHRICRYLEDLAGDYHR

SEQ ID NO: 708574 - protein, 24 aa, Mycobacterium
PHRKIAGPGVEWYIMPGSHKPMRR

SEQ ID NO: 708575 - protein, 26 aa, Mycobacterium
PHRQRLAALVCLFLLGTEEPRDAVEA

SEQ ID NO: 708576 - protein, 18 aa, Mycobacterium
PHRRAHPRLGDDESSCQQ

SEQ ID NO: 708577 - protein, 19 aa, Mycobacterium
PHRRITWNRLREVGDSVPD

SEQ ID NO: 708578 - protein, 18 aa, Mycobacterium
PHRVCRYLEDLAGDYHRF

SEQ ID NO: 708579 - protein, 19 aa, Mycobacterium
PHRVLRTGLVERLESGSPV

SEQ ID NO: 708580 - protein, 18 aa, Mycobacterium
PHRVPGYRDVVAEVRTEL

SEQ ID NO: 708581 - protein, 21 aa, Mycobacterium
PHRVVCGGISILDRWDTTADP

SEQ ID NO: 708582 - protein, 20 aa, Mycobacterium
PHRWLQPGALVAIIEDTRPT

SEQ ID NO: 708583 - protein, 20 aa, Mycobacterium
PHRWPALSAKAFEVYHVGAT

SEQ ID NO: 708584 - protein, 30 aa, Mycobacterium
PHRYFPRLRLELDKGFGWKAEVEAALERLL

SEQ ID NO: 708585 - protein, 23 aa, Mycobacterium
PHRYSQRELTDFFVSIPEFADYE

SEQ ID NO: 708586 - protein, 23 aa, Mycobacterium
PHRYSQRELTDFFVSIPEFEGYE

SEQ ID NO: 708587 - protein, 25 aa, Mycobacterium
PHSDVPKLLAAGAAAVFPTGTPLDD

SEQ ID NO: 708588 - protein, 17 aa, Mycobacterium
PHSGHLLAGTALSVISG

SEQ ID NO: 708589 - protein, 21 aa, Mycobacterium
PHSHFTFLEALRLQGTESQRA

SEQ ID NO: 708590 - protein, 19 aa, Mycobacterium
PHSIRHATVFGAFDAVEAG

SEQ ID NO: 708591 - protein, 20 aa, Mycobacterium
PHSIRHATVFGAFDAVPAGG

SEQ ID NO: 708592 - protein, 19 aa, Mycobacterium
PHSRAVMRAMTVAALTVDV

SEQ ID NO: 708593 - protein, 21 aa, Mycobacterium
PHSRGTVRLAGLTAEVPPVVN

SEQ ID NO: 708594 - protein, 23 aa, Mycobacterium
PHSRKCRCARLVYANSMHVDIVP

SEQ ID NO: 708595 - protein, 20 aa, Mycobacterium
PHSRRASLRPARATQKATAS

SEQ ID NO: 708596 - protein, 20 aa, Mycobacterium
PHSVPGQWTPHVTLARRVPS

SEQ ID NO: 708597 - protein, 21 aa, Mycobacterium
PHSWLKGAVTQVVRAGVGRTA

SEQ ID NO: 708598 - protein, 24 aa, Mycobacterium
PHTDGGFCGLKVVRAEQIRRLPDA

SEQ ID NO: 708599 - protein, 20 aa, Mycobacterium
PHTEPVIGVRPRRRGTPEDG

SEQ ID NO: 708600 - protein, 24 aa, Mycobacterium
PHTFKEAHVRMVLRSGRRDVDEIR

SEQ ID NO: 708601 - protein, 19 aa, Mycobacterium
PHTKLDLIRYYLSVAEGAL

SEQ ID NO: 708602 - protein, 25 aa, Mycobacterium
PHTKPPDFWAWLIAAVKAIDPDVLF

SEQ ID NO: 708603 - protein, 25 aa, Mycobacterium
PHTKPPDFWSWLIGQVKTIHPDVLF

SEQ ID NO: 708604 - protein, 24 aa, Mycobacterium
PHTKPPNFWAWLIAEVKNEDPDIL

SEQ ID NO: 708605 - protein, 25 aa, Mycobacterium
PHTKPPNFWAWLIAQAKGIDPDVLF

SEQ ID NO: 708606 - protein, 24 aa, Mycobacterium
PHTKPPNFWAWLIGEVKNIDPDVL

SEQ ID NO: 708607 - protein, 25 aa, Mycobacterium
PHTKPPNFWAWLIGQIKAVDPDVLF

SEQ ID NO: 708608 - protein, 19 aa, Mycobacterium
PHTRPPIGELLRGYEATVP

SEQ ID NO: 708609 - protein, 21 aa, Mycobacterium
PHTRRFLAERAQHLASPPQVL

SEQ ID NO: 708610 - protein, 20 aa, Mycobacterium
PHTSELLAAGADEVSTAVAA

SEQ ID NO: 708611 - protein, 25 aa, Mycobacterium
PHTVRPEYAPGWLAVTEDPAALLGL

SEQ ID NO: 708612 - protein, 19 aa, Mycobacterium
PHVARRVLREFALQVPVGV

SEQ ID NO: 708613 - protein, 17 aa, Mycobacterium
PHVARWVAEDVEFHGQI

SEQ ID NO: 708614 - protein, 19 aa, Mycobacterium
PHVREMTADAPLMLDHLSD

SEQ ID NO: 708615 - protein, 21 aa, Mycobacterium
PHVRRVLLLCWRDTGHPQGGG

SEQ ID NO: 708616 - protein, 17 aa, Mycobacterium
PHVSIGLVAADGGPLVW

SEQ ID NO: 708617 - protein, 17 aa, Mycobacterium
PHVSIGLVAGREMVRVS

SEQ ID NO: 708618 - protein, 17 aa, Mycobacterium
PHVSLAIGGLSIIEGPV

SEQ ID NO: 708619 - protein, 17 aa, Mycobacterium
PHVSVGLVAGDGGAALW

SEQ ID NO: 708620 - protein, 21 aa, Mycobacterium
PHVVAANRFALLTLIATNFFG

SEQ ID NO: 708621 - protein, 29 aa, Mycobacterium
PHVVRRFGELTARLYALEALLARGTAIID

SEQ ID NO: 708622 - protein, 20 aa, Mycobacterium
PHVVRTPLLAARWGDAERPL

SEQ ID NO: 708623 - protein, 22 aa, Mycobacterium
PHVYEARWPVRMADVDSGGRLR

SEQ ID NO: 708624 - protein, 21 aa, Mycobacterium
PHWALLTALARHASQTAVQAE

SEQ ID NO: 708625 - protein, 24 aa, Mycobacterium
PHWDARRGAVMASERVTLYGLPLV

SEQ ID NO: 708626 - protein, 25 aa, Mycobacterium
PHWHPMDLLVLLFGVGLAWAQSPHP

SEQ ID NO: 708627 - protein, 25 aa, Mycobacterium
PHWRSATCRVLAAAKGSRTANAGPV

SEQ ID NO: 708628 - protein, 28 aa, Mycobacterium
PHWTETVASWAARFPDQVVEWFTQRKTP

SEQ ID NO: 708629 - protein, 20 aa, Mycobacterium
PHYAGGLVAAEVEVLRVLTA

SEQ ID NO: 708630 - protein, 21 aa, Mycobacterium
PHYAGRLVADEIRVLEQLTSS

SEQ ID NO: 708631 - protein, 22 aa, Mycobacterium
PHYAYKLEWLAALRDNAQKWLA

SEQ ID NO: 708632 - protein, 17 aa, Mycobacterium
PHYGELKGPSCFTAPLI

SEQ ID NO: 708633 - protein, 25 aa, Mycobacterium
PHYQYKLRWLSALRDTAAGWLADAP

SEQ ID NO: 708634 - protein, 26 aa, Mycobacterium
PHYRPSAKLAAFVRARDLFCRYPGCN

SEQ ID NO: 708635 - protein, 19 aa, Mycobacterium
PHYTYKLDWLAALKDTAEG

SEQ ID NO: 708636 - protein, 24 aa, Mycobacterium
PHYTYKLEWLAALRDTAAGWLRDD

SEQ ID NO: 708637 - protein, 19 aa, Mycobacterium
PIAALGHWVHVYVDRVSRK

SEQ ID NO: 708638 - protein, 25 aa, Mycobacterium
PIADEIRAAIAVRHGVTIRDLLLVQ

SEQ ID NO: 708639 - protein, 17 aa, Mycobacterium
PIADGGFDIALRAARTN

SEQ ID NO: 708640 - protein, 17 aa, Mycobacterium
PIADLRRSIGRDLAADI

SEQ ID NO: 708641 - protein, 21 aa, Mycobacterium
PIADLVGGKAWIVYGYQGEPL

SEQ ID NO: 708642 - protein, 24 aa, Mycobacterium
PIADSAVTLGDWPMGIPREIATGA

SEQ ID NO: 708643 - protein, 18 aa, Mycobacterium
PIAEAIKSITAAVAGDRL

SEQ ID NO: 708644 - protein, 19 aa, Mycobacterium
PIAEALALIAEEGYSAVAL

SEQ ID NO: 708645 - protein, 30 aa, Mycobacterium
PIAERAKWVTFPIAALQGWAESHHTALRAV

SEQ ID NO: 708646 - protein, 18 aa, Mycobacterium
PIAFALRDVIPGTDLTSV

SEQ ID NO: 708647 - protein, 23 aa, Mycobacterium
PIAFNRPVWRVDLFGSTESPPGT

SEQ ID NO: 708648 - protein, 17 aa, Mycobacterium
PIAGLCNSAGFGTSGVF

SEQ ID NO: 708649 - protein, 18 aa, Mycobacterium
PIAGLCNSAGFGTSGVFH

SEQ ID NO: 708650 - protein, 18 aa, Mycobacterium
PIAIVAVSCRFPGAPNPE

SEQ ID NO: 708651 - protein, 22 aa, Mycobacterium
PIAIVGMSCRYPGGIESPDDLW

SEQ ID NO: 708652 - protein, 18 aa, Mycobacterium
PIAKRLYEQAAISAADID

SEQ ID NO: 708653 - protein, 18 aa, Mycobacterium
PIALEFLLQLLAPLDVAM

SEQ ID NO: 708654 - protein, 26 aa, Mycobacterium
PIANRLGDKDGLGFYQLMEQLARERL

SEQ ID NO: 708655 - protein, 20 aa, Mycobacterium
PIAPDAGDWVFTKWRYSAFH

SEQ ID NO: 708656 - protein, 25 aa, Mycobacterium
PIAPSRYAGRRVLITGGGSGIGQAC

SEQ ID NO: 708657 - protein, 20 aa, Mycobacterium
PIAQGGMQWVGRAELVAAVA

SEQ ID NO: 708658 - protein, 20 aa, Mycobacterium
PIARDLASHRIRVMTIAPGL

SEQ ID NO: 708659 - protein, 23 aa, Mycobacterium
PIARHLQGMWVSWLHEFDDGQLG

SEQ ID NO: 708660 - protein, 22 aa, Mycobacterium
PIARSVLDAALLLDATTTVPGP

SEQ ID NO: 708661 - protein, 26 aa, Mycobacterium
PIARYRCYLRAQGLWSERLEERVIGR

SEQ ID NO: 708662 - protein, 17 aa, Mycobacterium
PIASFRRSYPVSIPALS

SEQ ID NO: 708663 - protein, 18 aa, Mycobacterium
PIASRAALLGQLEEVTAR

SEQ ID NO: 708664 - protein, 18 aa, Mycobacterium
PIAVLAPRSPSDCFDIAI

SEQ ID NO: 708665 - protein, 19 aa, Mycobacterium
PIAVVGIGCRLAGDISTPG

SEQ ID NO: 708666 - protein, 18 aa, Mycobacterium
PICSGGGNIMAHVSYIDA

SEQ ID NO: 708667 - protein, 17 aa, Mycobacterium
PIDAAGQLIRWSDDYAV

SEQ ID NO: 708668 - protein, 17 aa, Mycobacterium
PIDAAGQLVQWSDDYRI

SEQ ID NO: 708669 - protein, 23 aa, Mycobacterium
PIDAVVCAYVARYAERRPSDITV

SEQ ID NO: 708670 - protein, 19 aa, Mycobacterium
PIDCHLMIDNPDRWAPGYA

SEQ ID NO: 708671 - protein, 18 aa, Mycobacterium
PIDDVYAVCAPLVDKTMD

SEQ ID NO: 708672 - protein, 22 aa, Mycobacterium
PIDEAPHAYEIFQKKQDGAVKI

SEQ ID NO: 708673 - protein, 25 aa, Mycobacterium
PIDEISVLVPDDFVGAVMGDLSGRR

SEQ ID NO: 708674 - protein, 25 aa, Mycobacterium
PIDEISVLVPDDFVGAVMGDLSSRR

SEQ ID NO: 708675 - protein, 39 aa, Mycobacterium
PIDFKEALWLRRWCSATSNRWCQMRVRLDGRDGGLVESE

SEQ ID NO: 708676 - protein, 20 aa, Mycobacterium
PIDGNYHWQGTVFDPLPPDS

SEQ ID NO: 708677 - protein, 26 aa, Mycobacterium
PIDLARLGEWRDRITSFPADFSNVGI

SEQ ID NO: 708678 - protein, 18 aa, Mycobacterium
PIDLEALGASGYVTYNEA

SEQ ID NO: 708679 - protein, 24 aa, Mycobacterium
PIDLRGDWPTALRAAGLDAAAPTA

SEQ ID NO: 708680 - protein, 20 aa, Mycobacterium
PIDLRQDWPTALQEAGFDAS

SEQ ID NO: 708681 - protein, 31 aa, Mycobacterium
PIDPADVVPADIGMFVDRHALALGPGTALLD

SEQ ID NO: 708682 - protein, 25 aa, Mycobacterium
PIDPWGGSYYVEWLTHQLAERARAH

SEQ ID NO: 708683 - protein, 24 aa, Mycobacterium
PIDPWGGSYYVEWLTHQLAQKARA

SEQ ID NO: 708684 - protein, 25 aa, Mycobacterium
PIDPWGGSYYVEWLTYQLAEKARGH

SEQ ID NO: 708685 - protein, 22 aa, Mycobacterium
PIDRIVSLGAFEHFADGAGDAG

SEQ ID NO: 708686 - protein, 20 aa, Mycobacterium
PIDVPRCLYADYHGESGSGI

SEQ ID NO: 708687 - protein, 20 aa, Mycobacterium
PIDYDDFRPFYARTEKLLRV

SEQ ID NO: 708688 - protein, 22 aa, Mycobacterium
PIEAIFKLHPWEWVLDDEFGQH

SEQ ID NO: 708689 - protein, 19 aa, Mycobacterium
PIEDRLDAFLLHNLPHSVA

SEQ ID NO: 708690 - protein, 25 aa, Mycobacterium
PIEEGKPCWLLGLLFSDENGCEGHS

SEQ ID NO: 708691 - protein, 23 aa, Mycobacterium
PIEFPFVYRGQRLHLRVSGRAAD

SEQ ID NO: 708692 - protein, 26 aa, Mycobacterium
PIEILPVTGLPEFRPGDDLGAAIAAA

SEQ ID NO: 708693 - protein, 24 aa, Mycobacterium
PIEKELRYDCTLARVEGRKVFMTG

SEQ ID NO: 708694 - protein, 29 aa, Mycobacterium
PIELNGGVIGAFAAWTPVHRTLDDTDETV

SEQ ID NO: 708695 - protein, 20 aa, Mycobacterium
PIELTLEMAAEAGLSVDEKG

SEQ ID NO: 708696 - protein, 17 aa, Mycobacterium
PIEPGPTLYEWAQSLAL

SEQ ID NO: 708697 - protein, 20 aa, Mycobacterium
PIERLRAQMLAAIDDSPDLR

SEQ ID NO: 708698 - protein, 18 aa, Mycobacterium
PIERLVEAINPPRSPSRN

SEQ ID NO: 708699 - protein, 23 aa, Mycobacterium
PIERTCDFLEWFLDNVPITPIWL

SEQ ID NO: 708700 - protein, 23 aa, Mycobacterium
PIESIFKLYPWEWMIDDDFGSHA

SEQ ID NO: 708701 - protein, 17 aa, Mycobacterium
PIEWARAGRPLPSEYTS

SEQ ID NO: 708702 - protein, 25 aa, Mycobacterium
PIEYMEGPYRYRGMLGGQPVTAFAF

SEQ ID NO: 708703 - protein, 24 aa, Mycobacterium
PIFEEWEADFGRTFLLGDDPHKRA

SEQ ID NO: 708704 - protein, 19 aa, Mycobacterium
PIFRHSGVIFLRRKLDDPL

SEQ ID NO: 708705 - protein, 19 aa, Mycobacterium
PIFSVRISPRLRDTAALLA

SEQ ID NO: 708706 - protein, 24 aa, Mycobacterium
PIFSVYGRNAWKSRLRSHPDVASA

SEQ ID NO: 708707 - protein, 22 aa, Mycobacterium
PIFVMSRITGWTAHIIEQTASN

SEQ ID NO: 708708 - protein, 19 aa, Mycobacterium
PIFYLPEKAQDVWGEALAT

SEQ ID NO: 708709 - protein, 18 aa, Mycobacterium
PIGAARLSAFSVLLEMLG

SEQ ID NO: 708710 - protein, 20 aa, Mycobacterium
PIGASGLRQVHELVRQLRGE

SEQ ID NO: 708711 - protein, 25 aa, Mycobacterium
PIGAWPVVPVPTGFLDWQRQIGQEI

SEQ ID NO: 708712 - protein, 21 aa, Mycobacterium
PIGDHRIGIVVGDCVGRGLPA

SEQ ID NO: 708713 - protein, 22 aa, Mycobacterium
PIGDHRVLVLAGRIHAYEGHDL

SEQ ID NO: 708714 - protein, 18 aa, Mycobacterium
PIGEALRLWYDLLSRSGL

SEQ ID NO: 708715 - protein, 18 aa, Mycobacterium
PIGEALRLWYELLTESAL

SEQ ID NO: 708716 - protein, 20 aa, Mycobacterium
PIGGGLWVPVYHPELRIAPP

SEQ ID NO: 708717 - protein, 17 aa, Mycobacterium
PIGLINAIGYPIAADAA

SEQ ID NO: 708718 - protein, 18 aa, Mycobacterium
PIGLPKPSDWEVADEPVG

SEQ ID NO: 708719 - protein, 24 aa, Mycobacterium
PIGRLEELMPIYSELLSLLADSGA

SEQ ID NO: 708720 - protein, 20 aa, Mycobacterium
PIGRNPWRGPPVPYDTPVTN

SEQ ID NO: 708721 - protein, 24 aa, Mycobacterium
PIGRPELTAMFGTRPVILWHRSFH

SEQ ID NO: 708722 - protein, 24 aa, Mycobacterium
PIGRPLPGTALFVLDRWLRQLPTE

SEQ ID NO: 708723 - protein, 25 aa, Mycobacterium
PIGRTGEFLEWFLGNVPITPIWVCP

SEQ ID NO: 708724 - protein, 21 aa, Mycobacterium
PIGSPIAGAAMFVLDKWLQPV

SEQ ID NO: 708725 - protein, 19 aa, Mycobacterium
PIGTPLPAWSLTADQAILT

SEQ ID NO: 708726 - protein, 37 aa, Mycobacterium
PIGVPLAHLGFFVLDGWLRPVPEGVVGELYVAGRGLA

SEQ ID NO: 708727 - protein, 19 aa, Mycobacterium
PIHAECAGLTYLVDDLDGA

SEQ ID NO: 708728 - protein, 18 aa, Mycobacterium
PIHAGGLRYHGMAPALSH

SEQ ID NO: 708729 - protein, 26 aa, Mycobacterium
PIHGPRAEVMLSLRGPTPTGLARSLA

SEQ ID NO: 708730 - protein, 24 aa, Mycobacterium
PIHHREPGPIPALLESPDVTIELI

SEQ ID NO: 708731 - protein, 27 aa, Mycobacterium
PIHKKRFTWNLLGSHKGREGIVMAPVA

SEQ ID NO: 708732 - protein, 18 aa, Mycobacterium
PIHQFTVAASELYNTRLE

SEQ ID NO: 708733 - protein, 19 aa, Mycobacterium
PIHRGRRQQLWLVTITDDQ

SEQ ID NO: 708734 - protein, 19 aa, Mycobacterium
PIHVAQQQALVAINSPVQD

SEQ ID NO: 708735 - protein, 17 aa, Mycobacterium
PIHVPSPLLGLLVAASW

SEQ ID NO: 708736 - protein, 27 aa, Mycobacterium
PIIACTAEILANVALREGRDADIGLCV

SEQ ID NO: 708737 - protein, 24 aa, Mycobacterium
PIIAEHAKHLFVFQRTPNYSVPAG

SEQ ID NO: 708738 - protein, 19 aa, Mycobacterium
PIICGHEFSGWVVELGDGV

SEQ ID NO: 708739 - protein, 25 aa, Mycobacterium
PIIEPGCLDLLFRGEIPEGVDPASL

SEQ ID NO: 708740 - protein, 24 aa, Mycobacterium
PIIEPGCLDLLFRGEVPEGVDPAS

SEQ ID NO: 708741 - protein, 22 aa, Mycobacterium
PIINTREGLAWVAQQASLEVHV

SEQ ID NO: 708742 - protein, 17 aa, Mycobacterium
PIITLARTFMIQPTHIR

SEQ ID NO: 708743 - protein, 25 aa, Mycobacterium
PIIVPGCLDVLFRGEIPAGVDPASL

SEQ ID NO: 708744 - protein, 25 aa, Mycobacterium
PIKASRPGMQIAVGGCLAQKDRHIV

SEQ ID NO: 708745 - protein, 19 aa, Mycobacterium
PIKMLLRLALDAGAGILYR

SEQ ID NO: 708746 - protein, 27 aa, Mycobacterium
PIKMLLRLALEAGPGILYRLHLDLASL

SEQ ID NO: 708747 - protein, 23 aa, Mycobacterium
PIKQRFVELLPQLAILDAGGSSE

SEQ ID NO: 708748 - protein, 17 aa, Mycobacterium
PIKRARTTFTYLAVATM

SEQ ID NO: 708749 - protein, 22 aa, Mycobacterium
PIKRRRARRGSGELLREEILDA

SEQ ID NO: 708750 - protein, 18 aa, Mycobacterium
PILAAWGVTTAGKPVFVG

SEQ ID NO: 708751 - protein, 24 aa, Mycobacterium
PILADAPGVVWAIDFQFDSTVDGK

SEQ ID NO: 708752 - protein, 20 aa, Mycobacterium
PILAHAPAPLPVTMGARTIS

SEQ ID NO: 708753 - protein, 19 aa, Mycobacterium
PILAKLMVLEDQWNTDFQK

SEQ ID NO: 708754 - protein, 23 aa, Mycobacterium
PILDEFDFAFVVDRHDPLYEDIA

SEQ ID NO: 708755 - protein, 23 aa, Mycobacterium
PILDELRELGTVLGVARDAEVLA

SEQ ID NO: 708756 - protein, 22 aa, Mycobacterium
PILELRTSWRNPPRALHLANAI

SEQ ID NO: 708757 - protein, 23 aa, Mycobacterium
PILEPGSGIALMLSLVPSAEPMS

SEQ ID NO: 708758 - protein, 24 aa, Mycobacterium
PILEPLRAIPVIGNPLADLVEPNL

SEQ ID NO: 708759 - protein, 24 aa, Mycobacterium
PILHGLCSYGMVLKAVVDSALDGD

SEQ ID NO: 708760 - protein, 19 aa, Mycobacterium
PILHGLCSYGVAGRALLAE

SEQ ID NO: 708761 - protein, 17 aa, Mycobacterium
PILHGLCTYGMTCKAIT

SEQ ID NO: 708762 - protein, 24 aa, Mycobacterium
PILIGHSLGGFVIQRYLEERSAPA

SEQ ID NO: 708763 - protein, 19 aa, Mycobacterium
PILLLSGWQDLFLDQTLEQ

SEQ ID NO: 708764 - protein, 23 aa, Mycobacterium
PILLPRIVASVFELEPDCRRIMF

SEQ ID NO: 708765 - protein, 18 aa, Mycobacterium
PILLVCGQLTVRRAIATA

SEQ ID NO: 708766 - protein, 20 aa, Mycobacterium
PILQRVMRGGNQLAYLDSGA

SEQ ID NO: 708767 - protein, 17 aa, Mycobacterium
PILRGAADFDLELIETR

SEQ ID NO: 708768 - protein, 17 aa, Mycobacterium
PILRNAELSKLICVDPD

SEQ ID NO: 708769 - protein, 19 aa, Mycobacterium
PILTPGLAYYAREFDETAG

SEQ ID NO: 708770 - protein, 19 aa, Mycobacterium
PILTPGLSYYARNFDDTAS

SEQ ID NO: 708771 - protein, 21 aa, Mycobacterium
PILVCRKAHVTTFYMAKQMGF

SEQ ID NO: 708772 - protein, 18 aa, Mycobacterium
PIMPMKPIVLPGVGETTA

SEQ ID NO: 708773 - protein, 28 aa, Mycobacterium
PIMPPQMLHMILPRKDYEIVEDSWDVVG

SEQ ID NO: 708774 - protein, 17 aa, Mycobacterium
PIMTFRRTAARDCELGG

SEQ ID NO: 708775 - protein, 19 aa, Mycobacterium
PIMVYSCSRLGRVANPPSF

SEQ ID NO: 708776 - protein, 25 aa, Mycobacterium
PINFGRPAAGITEFGHLCLDAPDVR

SEQ ID NO: 708777 - protein, 23 aa, Mycobacterium
PINGIHWELAWLPKIPSPQQCWA

SEQ ID NO: 708778 - protein, 24 aa, Mycobacterium
PINISGPEPLSWQAASIAPESACT

SEQ ID NO: 708779 - protein, 24 aa, Mycobacterium
PINISGPEPLSWQAVSIAPESACT

SEQ ID NO: 708780 - protein, 25 aa, Mycobacterium
PINISGPEPLSWRAASIAPESACTS

SEQ ID NO: 708781 - protein, 22 aa, Mycobacterium
PINMFEFARPVIEACGENWPRV

SEQ ID NO: 708782 - protein, 22 aa, Mycobacterium
PINMFEFARPVVQACGEPFPKF

SEQ ID NO: 708783 - protein, 21 aa, Mycobacterium
PINMFEFARPVVTACGESWPR

SEQ ID NO: 708784 - protein, 26 aa, Mycobacterium
PINPEAWRWYRMAFGKDKTPIVDTWW

SEQ ID NO: 708785 - protein, 18 aa, Mycobacterium
PINVAAFMLPDITTPEIT

SEQ ID NO: 708786 - protein, 18 aa, Mycobacterium
PIPAAPQWGQLECNAANG

SEQ ID NO: 708787 - protein, 22 aa, Mycobacterium
PIPCPHTLELALGVSLGVFRLL

SEQ ID NO: 708788 - protein, 24 aa, Mycobacterium
PIPDSRGGPPLPPATALTDVMARL

SEQ ID NO: 708789 - protein, 28 aa, Mycobacterium
PIPEGKNEFGWIWSHCRHYLFDPWFDVE

SEQ ID NO: 708790 - protein, 21 aa, Mycobacterium
PIPGLLPGFGHVGLGGSLGWA

SEQ ID NO: 708791 - protein, 20 aa, Mycobacterium
PIPGMELRISPTHRSADDGV

SEQ ID NO: 708792 - protein, 18 aa, Mycobacterium
PIPLILGGSGRRMMELVR

SEQ ID NO: 708793 - protein, 18 aa, Mycobacterium
PIPLPGMVAGELSISAGG

SEQ ID NO: 708794 - protein, 24 aa, Mycobacterium
PIPLPIKTSYAWAAARHGGDDPAA

SEQ ID NO: 708795 - protein, 24 aa, Mycobacterium
PIPLPIKTSYAWGAARHCGDDPVR

SEQ ID NO: 708796 - protein, 24 aa, Mycobacterium
PIPLPVKTSYAWAAARHCGDDPLR

SEQ ID NO: 708797 - protein, 17 aa, Mycobacterium
PIPMSVLEKLELGEHNA

SEQ ID NO: 708798 - protein, 17 aa, Mycobacterium
PIPPIAFQLLWYPSTMW

SEQ ID NO: 708799 - protein, 23 aa, Mycobacterium
PIPRAGGIGAPRIRDVELVQMVA

SEQ ID NO: 708800 - protein, 26 aa, Mycobacterium
PIPRPPSIRDSLCFLDHMRNCQEAVG

SEQ ID NO: 708801 - protein, 20 aa, Mycobacterium
PIPTTGFAPFQFSSQQVALH

SEQ ID NO: 708802 - protein, 25 aa, Mycobacterium
PIPVPMAYYSFGGWKSSLFGDTHAH

SEQ ID NO: 708803 - protein, 26 aa, Mycobacterium
PIPVRLRDGAEFYLRPILPGDSQRLA

SEQ ID NO: 708804 - protein, 22 aa, Mycobacterium
PIQAATGRPLIGNGTPGDAGSG

SEQ ID NO: 708805 - protein, 18 aa, Mycobacterium
PIQAFRAWMEGPIMPPEG

SEQ ID NO: 708806 - protein, 26 aa, Mycobacterium
PIQQVTGVTLGWRWDAAVEAILLFTQ

SEQ ID NO: 708807 - protein, 19 aa, Mycobacterium
PIQRIWAGWAPTFGILEHV

SEQ ID NO: 708808 - protein, 21 aa, Mycobacterium
PIQRMWAGWLPSFGILEHVGR

SEQ ID NO: 708809 - protein, 20 aa, Mycobacterium
PIQSIYGWRGASATNLPRFT

SEQ ID NO: 708810 - protein, 19 aa, Mycobacterium
PIQVTELDGILDIYPTLSD

SEQ ID NO: 708811 - protein, 19 aa, Mycobacterium
PIRDPRTGHVIGIVDVSGP

SEQ ID NO: 708812 - protein, 19 aa, Mycobacterium
PIRDPRTGQVIGVVDVSGP

SEQ ID NO: 708813 - protein, 19 aa, Mycobacterium
PIREPTFQYGPFVMNSKSE

SEQ ID NO: 708814 - protein, 20 aa, Mycobacterium
PIREPVFHYGPFVMNSKSEL

SEQ ID NO: 708815 - protein, 41 aa, Mycobacterium
PIREPVTRRILGVIDLTCRARQADPLLFVLAKSAGSQIEDR

SEQ ID NO: 708816 - protein, 32 aa, Mycobacterium
PIRGEFPAVVTLDLCRLDQLFSLDEVSGQAVF

SEQ ID NO: 708817 - protein, 19 aa, Mycobacterium
PIRHFFRDSTWWPRVPQTT

SEQ ID NO: 708818 - protein, 27 aa, Mycobacterium
PIRHGAPLGAPCWIDLTTSDVDRAQDF

SEQ ID NO: 708819 - protein, 20 aa, Mycobacterium
PIRHWLRTGELLEWAYELVA

SEQ ID NO: 708820 - protein, 23 aa, Mycobacterium
PIRKRISAGSSLKFCVVAEGIAD

SEQ ID NO: 708821 - protein, 18 aa, Mycobacterium
PIRLFEIGSSAGLNLRAD

SEQ ID NO: 708822 - protein, 19 aa, Mycobacterium
PIRLIAAFIEHLQVRPEAT

SEQ ID NO: 708823 - protein, 17 aa, Mycobacterium
PIRLPDRTWPEKAITTA

SEQ ID NO: 708824 - protein, 18 aa, Mycobacterium
PIRLRTVAAAVFTRPEIA

SEQ ID NO: 708825 - protein, 17 aa, Mycobacterium
PIRLRTVASATFTRPEI

SEQ ID NO: 708826 - protein, 19 aa, Mycobacterium
PIRMEVEKRVPAPHEEGEE

SEQ ID NO: 708827 - protein, 25 aa, Mycobacterium
PIRQIFFRFGEVIIEVVGAPDAVGD

SEQ ID NO: 708828 - protein, 22 aa, Mycobacterium
PIRVRDGTLLLLRPVLPGDSER

SEQ ID NO: 708829 - protein, 17 aa, Mycobacterium
PIRVYRPAVPGPLPTVV

SEQ ID NO: 708830 - protein, 18 aa, Mycobacterium
PISAMLFRTRAARRHRAL

SEQ ID NO: 708831 - protein, 28 aa, Mycobacterium
PISAPGMRRMLEGWLPAAAAAGITTVFD

SEQ ID NO: 708832 - protein, 23 aa, Mycobacterium
PISDEARAALGIEGDATEMTPPA

SEQ ID NO: 708833 - protein, 25 aa, Mycobacterium
PISFRPLERTQIRAMGLLKGACAQV

SEQ ID NO: 708834 - protein, 21 aa, Mycobacterium
PISGHKQSGWGGERGRKGIEA

SEQ ID NO: 708835 - protein, 27 aa, Mycobacterium
PISGLKCYRIASKIIKGQGLGGTDDEW

SEQ ID NO: 708836 - protein, 20 aa, Mycobacterium
PISHHTILFGAAWEQTFTDI

SEQ ID NO: 708837 - protein, 25 aa, Mycobacterium
PISHLTVGGLRDWLLDTAARDDSAA

SEQ ID NO: 708838 - protein, 18 aa, Mycobacterium
PISMALREVREWAQNTKD

SEQ ID NO: 708839 - protein, 20 aa, Mycobacterium
PISPEVRDVLGLDSDVVEMT

SEQ ID NO: 708840 - protein, 20 aa, Mycobacterium
PISRTAFLHVDYRKVTPIDT

SEQ ID NO: 708841 - protein, 19 aa, Mycobacterium
PISSRGASVLARRVAQQLE

SEQ ID NO: 708842 - protein, 20 aa, Mycobacterium
PISTLPMAVPVNLRADADGA

SEQ ID NO: 708843 - protein, 22 aa, Mycobacterium
PISVWWTEIFRVLRPGGSYFAQ

SEQ ID NO: 708844 - protein, 18 aa, Mycobacterium
PISYWKLSDREIAQHYAS

SEQ ID NO: 708845 - protein, 19 aa, Mycobacterium
PITCSLGVPTRHLDLQFLA

SEQ ID NO: 708846 - protein, 26 aa, Mycobacterium
PITDGRWSCVQWGKLTPPFVGDAPVT

SEQ ID NO: 708847 - protein, 25 aa, Mycobacterium
PITDGRWSCVRWGTKTPPFCAEVDS

SEQ ID NO: 708848 - protein, 27 aa, Mycobacterium
PITDGRWSCVRWGTLSPPFYPEAGADP

SEQ ID NO: 708849 - protein, 21 aa, Mycobacterium
PITGFPGWSHYGASKAAQLGF

SEQ ID NO: 708850 - protein, 18 aa, Mycobacterium
PITLARFGVPTVLPASVL

SEQ ID NO: 708851 - protein, 18 aa, Mycobacterium
PITPEFVERVIAQQAERG

SEQ ID NO: 708852 - protein, 26 aa, Mycobacterium
PITPELRGRLVFAWRATGPMSPAARA

SEQ ID NO: 708853 - protein, 17 aa, Mycobacterium
PITPGTVKHVWDVVRRV

SEQ ID NO: 708854 - protein, 25 aa, Mycobacterium
PITQGSLVRFLMRTGQPAAVAREVV

SEQ ID NO: 708855 - protein, 22 aa, Mycobacterium
PITSRIAYAAAHVVPKSSADNI

SEQ ID NO: 708856 - protein, 20 aa, Mycobacterium
PITVGGGGILKLPLTGEISN

SEQ ID NO: 708857 - protein, 18 aa, Mycobacterium
PITVPVLLALTERFGLPT

SEQ ID NO: 708858 - protein, 17 aa, Mycobacterium
PIVAAALDYTKRHLDTA

SEQ ID NO: 708859 - protein, 23 aa, Mycobacterium
PIVAHIFRTHFWFTEERLRTSSD

SEQ ID NO: 708860 - protein, 29 aa, Mycobacterium
PIVAHIFRTHFWFVEERLRTLADPVSAAW

SEQ ID NO: 708861 - protein, 18 aa, Mycobacterium
PIVANVDTFRCWLDEERE

SEQ ID NO: 708862 - protein, 19 aa, Mycobacterium
PIVCGLNLTETIAMTPEHL

SEQ ID NO: 708863 - protein, 24 aa, Mycobacterium
PIVDSSVLLGDWLIQLPREVTVPA

SEQ ID NO: 708864 - protein, 20 aa, Mycobacterium
PIVESEFWAFPRSCNPTGGL

SEQ ID NO: 708865 - protein, 17 aa, Mycobacterium
PIVNRLPPLSDIVDGLI

SEQ ID NO: 708866 - protein, 17 aa, Mycobacterium
PIVPFSGGFLLQDRAKF

SEQ ID NO: 708867 - protein, 19 aa, Mycobacterium
PIVPVIVWGAHRIWTKDHP

SEQ ID NO: 708868 - protein, 29 aa, Mycobacterium
PIVRLAGRWLRPGGLIGIEHDDTTSRETM

SEQ ID NO: 708869 - protein, 19 aa, Mycobacterium
PIVTTGYLREAFVGRDADL

SEQ ID NO: 708870 - protein, 26 aa, Mycobacterium
PIVVLRKAPQPELARKFVALVTAETG

SEQ ID NO: 708871 - protein, 28 aa, Mycobacterium
PIWEFPTKFGEICRPDWIPEGTRVVNEL

SEQ ID NO: 708872 - protein, 17 aa, Mycobacterium
PIWEGEDGVIAWLLSGP

SEQ ID NO: 708873 - protein, 19 aa, Mycobacterium
PIWLIDGYAGPGWYQSDDN

SEQ ID NO: 708874 - protein, 18 aa, Mycobacterium
PIWSSWYAGRPVLVTAND

SEQ ID NO: 708875 - protein, 25 aa, Mycobacterium
PIYECKDGYVRLCVMAPRQWRGLRR

SEQ ID NO: 708876 - protein, 17 aa, Mycobacterium
PIYKRLRDEAPLYYNDK

SEQ ID NO: 708877 - protein, 18 aa, Mycobacterium
PIYNFRYPNMLRLHYEKK

SEQ ID NO: 708878 - protein, 26 aa, Mycobacterium
PIYNLLLTLLFEWGVAVHDMDIDAIR

SEQ ID NO: 708879 - protein, 19 aa, Mycobacterium
PIYPGDTFLAGAKILRHYG

SEQ ID NO: 708880 - protein, 22 aa, Mycobacterium
PIYYNERHDFWALSRHSDVERA

SEQ ID NO: 708881 - protein, 22 aa, Mycobacterium
PIYYNERYNFWALSRHADVEKA

SEQ ID NO: 708882 - protein, 25 aa, Mycobacterium
PKAALKRIANAYIDFADSNPALYDA

SEQ ID NO: 708883 - protein, 19 aa, Mycobacterium
PKAARAVITMLRDAKLVDR

SEQ ID NO: 708884 - protein, 20 aa, Mycobacterium
PKAASFLGGNGYSLNSHTQA

SEQ ID NO: 708885 - protein, 18 aa, Mycobacterium
PKAASKWSRKSMAERSGL

SEQ ID NO: 708886 - protein, 20 aa, Mycobacterium
PKADAILMFLPQWRMPELDP

SEQ ID NO: 708887 - protein, 19 aa, Mycobacterium
PKADIGIAGAHSFGGKIQR

SEQ ID NO: 708888 - protein, 18 aa, Mycobacterium
PKAEIAERVDNLLEVVGL

SEQ ID NO: 708889 - protein, 19 aa, Mycobacterium
PKAGCATSVEISRQGGRAA

SEQ ID NO: 708890 - protein, 17 aa, Mycobacterium
PKAGLSIAMGFAPDDEL

SEQ ID NO: 708891 - protein, 18 aa, Mycobacterium
PKAHIKQIGSYVLDVHLH

SEQ ID NO: 708892 - protein, 19 aa, Mycobacterium
PKANSWYMGANVPGKPRVF

SEQ ID NO: 708893 - protein, 20 aa, Mycobacterium
PKAPALCCGDRTMTYRELDR

SEQ ID NO: 708894 - protein, 23 aa, Mycobacterium
PKAPFLRTVAVWGPSDQAWTTTI

SEQ ID NO: 708895 - protein, 25 aa, Mycobacterium
PKAPTRGAPLCAFRETSRILAGLPD

SEQ ID NO: 708896 - protein, 21 aa, Mycobacterium
PKARAALEFFQQMLTDVSKIV

SEQ ID NO: 708897 - protein, 17 aa, Mycobacterium
PKARALRPYAEKLITHA

SEQ ID NO: 708898 - protein, 20 aa, Mycobacterium
PKARALRPYAEKLITHAKKG

SEQ ID NO: 708899 - protein, 21 aa, Mycobacterium
PKAREEPFAALRQLLAVHETA

SEQ ID NO: 708900 - protein, 17 aa, Mycobacterium
PKAREKAFTELRQLLAV

SEQ ID NO: 708901 - protein, 23 aa, Mycobacterium
PKARFFRMLTSWVGGGYRVPDED

SEQ ID NO: 708902 - protein, 23 aa, Mycobacterium
PKARPNMKMKAFANLTREISAAN

SEQ ID NO: 708903 - protein, 20 aa, Mycobacterium
PKASAGLGVGEVGYLITGVK

SEQ ID NO: 708904 - protein, 31 aa, Mycobacterium
PKASVMTHYRWLRGMSGIGDMALRLRPDDVL

SEQ ID NO: 708905 - protein, 25 aa, Mycobacterium
PKATAEAFAGGWFHSGDLVRQDEEG

SEQ ID NO: 708906 - protein, 18 aa, Mycobacterium
PKATVYRLLQHLVSQGFV

SEQ ID NO: 708907 - protein, 22 aa, Mycobacterium
PKAVHPLVWRLVAPVFNPLAAF

SEQ ID NO: 708908 - protein, 28 aa, Mycobacterium
PKAVSPWWLQRRLLLSGIRAISPAVDVT

SEQ ID NO: 708909 - protein, 25 aa, Mycobacterium
PKAYRAVGIHPLRGFFAFLTSPHYR

SEQ ID NO: 708910 - protein, 36 aa, Mycobacterium
PKDAWRNNSGWWGHHVGGAEYLRWLADNDYPLAPVE

SEQ ID NO: 708911 - protein, 20 aa, Mycobacterium
PKDFDYVLNLAVAKSGSWDK

SEQ ID NO: 708912 - protein, 19 aa, Mycobacterium
PKDHPRNLLRNKVPITVSI

SEQ ID NO: 708913 - protein, 26 aa, Mycobacterium
PKDILQGQCTFSWPPKIDLPGYKPTT

SEQ ID NO: 708914 - protein, 18 aa, Mycobacterium
PKDIVFCSRVQRSPSGKA

SEQ ID NO: 708915 - protein, 23 aa, Mycobacterium
PKDPGTVCGPLISARQRDRVQGY

SEQ ID NO: 708916 - protein, 19 aa, Mycobacterium
PKDVIPVMVQEGSVIYDRA

SEQ ID NO: 708917 - protein, 27 aa, Mycobacterium
PKDVLQAQCTFSWPPQMDLPGYKPNTK

SEQ ID NO: 708918 - protein, 17 aa, Mycobacterium
PKEARAWTIHQGDTAPK

SEQ ID NO: 708919 - protein, 23 aa, Mycobacterium
PKEGESIEILKGVNLTVNSGETH

SEQ ID NO: 708920 - protein, 18 aa, Mycobacterium
PKEHGGGGGSIWQQTVLR

SEQ ID NO: 708921 - protein, 19 aa, Mycobacterium
PKEHGGGGGSIWQQTVLRE

SEQ ID NO: 708922 - protein, 24 aa, Mycobacterium
PKEILRASRRWCEPNYHITHWTTM

SEQ ID NO: 708923 - protein, 24 aa, Mycobacterium
PKELLRTAVLAFLTYIDRNRASWM

SEQ ID NO: 708924 - protein, 18 aa, Mycobacterium
PKEMPARVLMAQAALEAG

SEQ ID NO: 708925 - protein, 25 aa, Mycobacterium
PKEPTRGAPLCAFRETSRILAGLPD

SEQ ID NO: 708926 - protein, 20 aa, Mycobacterium
PKESMRIISDIFAYTSAKMP

SEQ ID NO: 708927 - protein, 20 aa, Mycobacterium
PKESVDFFRSCFRDRDRRVA

SEQ ID NO: 708928 - protein, 32 aa, Mycobacterium
PKETLGFFCGIGIPITEIWGMSELSCVATASH

SEQ ID NO: 708929 - protein, 18 aa, Mycobacterium
PKETLPWQDVIPVSETNV

SEQ ID NO: 708930 - protein, 20 aa, Mycobacterium
PKFDALEALELIGTHKVTWL

SEQ ID NO: 708931 - protein, 30 aa, Mycobacterium
PKFFGIRPEVVFKGGFPAWSVMGEANASLM

SEQ ID NO: 708932 - protein, 24 aa, Mycobacterium
PKFFYLKRKVLDSAPFPEPAEIRG

SEQ ID NO: 708933 - protein, 19 aa, Mycobacterium
PKFMVFGEISLRATAKAAE

SEQ ID NO: 708934 - protein, 17 aa, Mycobacterium
PKFPALQQAGVRYRWDG

SEQ ID NO: 708935 - protein, 18 aa, Mycobacterium
PKFSLAPVGAALGEKLGR

SEQ ID NO: 708936 - protein, 18 aa, Mycobacterium
PKFSPAREALDNPSYRLV

SEQ ID NO: 708937 - protein, 25 aa, Mycobacterium
PKFVCALPSEFFAAVRAELDERGIT

SEQ ID NO: 708938 - protein, 20 aa, Mycobacterium
PKFVSGEYIGSIAMSEPAAG

SEQ ID NO: 708939 - protein, 22 aa, Mycobacterium
PKFYAELCERLGVDVPHDDDAP

SEQ ID NO: 708940 - protein, 18 aa, Mycobacterium
PKGAILTHDNLRWNAINV

SEQ ID NO: 708941 - protein, 17 aa, Mycobacterium
PKGAKEFGTRTETKNVN

SEQ ID NO: 708942 - protein, 21 aa, Mycobacterium
PKGALVHRLIRSGRSLFTAHT

SEQ ID NO: 708943 - protein, 20 aa, Mycobacterium
PKGALVHRLIRTGRSLFTAH

SEQ ID NO: 708944 - protein, 18 aa, Mycobacterium
PKGAMLNHGQTLRMYEEW

SEQ ID NO: 708945 - protein, 20 aa, Mycobacterium
PKGAQWDAAMRYWQQLHTDP

SEQ ID NO: 708946 - protein, 19 aa, Mycobacterium
PKGERRRRALISAAADLLR

SEQ ID NO: 708947 - protein, 21 aa, Mycobacterium
PKGEYGAGDMVIWDSGSYETE

SEQ ID NO: 708948 - protein, 24 aa, Mycobacterium
PKGEYGGGEVHIWDTGTYETEKFR

SEQ ID NO: 708949 - protein, 22 aa, Mycobacterium
PKGIVVPAGLPNRVHPFVQEIA

SEQ ID NO: 708950 - protein, 17 aa, Mycobacterium
PKGLAHRALADIHESIR

SEQ ID NO: 708951 - protein, 17 aa, Mycobacterium
PKGLIGPAGEAAVRAGI

SEQ ID NO: 708952 - protein, 25 aa, Mycobacterium
PKGPDKMEVWAWTIVDRSMPEEVRD

SEQ ID NO: 708953 - protein, 19 aa, Mycobacterium
PKGQHWRLLSSVKELDPAW

SEQ ID NO: 708954 - protein, 19 aa, Mycobacterium
PKGQLWDAAVAEWDSLRTD

SEQ ID NO: 708955 - protein, 21 aa, Mycobacterium
PKGRLRHPLEASHTVGELIEA

SEQ ID NO: 708956 - protein, 17 aa, Mycobacterium
PKGRPMVWTVTKLQPMR

SEQ ID NO: 708957 - protein, 32 aa, Mycobacterium
PKGSARKLAMEFARFLGLPPMQPRMNVTDIAD

SEQ ID NO: 708958 - protein, 17 aa, Mycobacterium
PKGSLYVTRPMIGPYVA

SEQ ID NO: 708959 - protein, 19 aa, Mycobacterium
PKGTAALMPAAIETFSEGL

SEQ ID NO: 708960 - protein, 19 aa, Mycobacterium
PKGTLLIRAAELMGIQIPR

SEQ ID NO: 708961 - protein, 17 aa, Mycobacterium
PKGWLLIDFEGEPGQPL

SEQ ID NO: 708962 - protein, 18 aa, Mycobacterium
PKHARRCVFWEVDPATLG

SEQ ID NO: 708963 - protein, 18 aa, Mycobacterium
PKHARRCVFWEVDPSTVA

SEQ ID NO: 708964 - protein, 20 aa, Mycobacterium
PKHIRYEIFGPPGTTADISY

SEQ ID NO: 708965 - protein, 19 aa, Mycobacterium
PKHLCAAEAVDIITGAGDH

SEQ ID NO: 708966 - protein, 20 aa, Mycobacterium
PKHMGVMFGAPGGDYCHGLL

SEQ ID NO: 708967 - protein, 20 aa, Mycobacterium
PKHPDLRLTPARSLDQQAQD

SEQ ID NO: 708968 - protein, 24 aa, Mycobacterium
PKHRHDWTDYTACVDFSAVKGGRL

SEQ ID NO: 708969 - protein, 17 aa, Mycobacterium
PKHTRWLPGSYRYRDVV

SEQ ID NO: 708970 - protein, 24 aa, Mycobacterium
PKIASGELHFSIGYSEPGAGTDLA

SEQ ID NO: 708971 - protein, 21 aa, Mycobacterium
PKIAVLRSICEDIGRDPDSIV

SEQ ID NO: 708972 - protein, 17 aa, Mycobacterium
PKIDPFPVLAGMVGVTS

SEQ ID NO: 708973 - protein, 21 aa, Mycobacterium
PKIFFQIYWLGGRDAIAERVE

SEQ ID NO: 708974 - protein, 20 aa, Mycobacterium
PKIFFQVYWLGGRDAIAERV

SEQ ID NO: 708975 - protein, 18 aa, Mycobacterium
PKIGHLPYLLTLPGHGFY

SEQ ID NO: 708976 - protein, 18 aa, Mycobacterium
PKIGRARPLAERSVGTPD

SEQ ID NO: 708977 - protein, 25 aa, Mycobacterium
PKIIDLQLRGCFAMTETGHGSDVQS

SEQ ID NO: 708978 - protein, 24 aa, Mycobacterium
PKIINLDIRGCFAMTETGHGSDVQ

SEQ ID NO: 708979 - protein, 19 aa, Mycobacterium
PKIKGVSFVGSTPIAKYVY

SEQ ID NO: 708980 - protein, 19 aa, Mycobacterium
PKINVLTCTEVQRATGDGH

SEQ ID NO: 708981 - protein, 21 aa, Mycobacterium
PKIRLGRFADGPTYWADGDTV

SEQ ID NO: 708982 - protein, 21 aa, Mycobacterium
PKIRLGRFASGPTYWADGETV

SEQ ID NO: 708983 - protein, 21 aa, Mycobacterium
PKIRLGRFATGPTYWADGETV

SEQ ID NO: 708984 - protein, 19 aa, Mycobacterium
PKIRVVTTALRVRRAHPDS

SEQ ID NO: 708985 - protein, 19 aa, Mycobacterium
PKISELLVIARTFLADTLG

SEQ ID NO: 708986 - protein, 20 aa, Mycobacterium
PKITAANFTDGWLRTGDLGT

SEQ ID NO: 708987 - protein, 23 aa, Mycobacterium
PKITKVFRWDRAINLQSPGQFVA

SEQ ID NO: 708988 - protein, 24 aa, Mycobacterium
PKKARLVLDAAVLKDTMVLEYVWP

SEQ ID NO: 708989 - protein, 26 aa, Mycobacterium
PKKPKKWIARRHWGRFNKFRNDQWVF

SEQ ID NO: 708990 - protein, 19 aa, Mycobacterium
PKKQLGITFILIDFTSPGI

SEQ ID NO: 708991 - protein, 21 aa, Mycobacterium
PKKQVRCVYVAVGQKGTTIAS

SEQ ID NO: 708992 - protein, 18 aa, Mycobacterium
PKLAAALRQLELTVKRKL

SEQ ID NO: 708993 - protein, 21 aa, Mycobacterium
PKLAKKLGLERQWLHARSLAF

SEQ ID NO: 708994 - protein, 21 aa, Mycobacterium
PKLAKRLGLQRQWLHARSLAF

SEQ ID NO: 708995 - protein, 21 aa, Mycobacterium
PKLAQGIAFVASRRWTTSRLA

SEQ ID NO: 708996 - protein, 20 aa, Mycobacterium
PKLARTRSWPTLEVNGQLLV

SEQ ID NO: 708997 - protein, 22 aa, Mycobacterium
PKLDAAALLHRLSLKVPARHFV

SEQ ID NO: 708998 - protein, 22 aa, Mycobacterium
PKLDAAALLHRLSLKVPVRHFV

SEQ ID NO: 708999 - protein, 21 aa, Mycobacterium
PKLDAAALLHRLSVTTPVRHF

SEQ ID NO: 709000 - protein, 19 aa, Mycobacterium
PKLDFPVPRLARGFLKYAP

SEQ ID NO: 709001 - protein, 19 aa, Mycobacterium
PKLGCYGIQRIHLLRNVMI

SEQ ID NO: 709002 - protein, 18 aa, Mycobacterium
PKLGGHRAVLMPGTGSDD

SEQ ID NO: 709003 - protein, 17 aa, Mycobacterium
PKLGRAAVSRGCLATID

SEQ ID NO: 709004 - protein, 17 aa, Mycobacterium
PKLIAACEWLDRHRHSQ

SEQ ID NO: 709005 - protein, 18 aa, Mycobacterium
PKLIEAFNEIRGYGVKLE

SEQ ID NO: 709006 - protein, 21 aa, Mycobacterium
PKLIEHLTRVNAAKSETLTAL

SEQ ID NO: 709007 - protein, 18 aa, Mycobacterium
PKLIYARLSAYGGNGPEG

SEQ ID NO: 709008 - protein, 19 aa, Mycobacterium
PKLLERADIGASPASVTAV

SEQ ID NO: 709009 - protein, 20 aa, Mycobacterium
PKLLGPLLIAEGVHLVKGFY

SEQ ID NO: 709010 - protein, 19 aa, Mycobacterium
PKLLTPAPFFDATVVTAIE

SEQ ID NO: 709011 - protein, 24 aa, Mycobacterium
PKLMELHDGPFILAGWSLGAVLAY

SEQ ID NO: 709012 - protein, 18 aa, Mycobacterium
PKLMLTGPIPATAKVLHK

SEQ ID NO: 709013 - protein, 20 aa, Mycobacterium
PKLNVLPIYGGQSYVVQLAG

SEQ ID NO: 709014 - protein, 21 aa, Mycobacterium
PKLPALSSPLWRSRGQIRDEL

SEQ ID NO: 709015 - protein, 21 aa, Mycobacterium
PKLPGIDGITSFGGHAFHTSR

SEQ ID NO: 709016 - protein, 21 aa, Mycobacterium
PKLPGIEGLGTFRGHAFHTSR

SEQ ID NO: 709017 - protein, 17 aa, Mycobacterium
PKLPGTVYTAAEEIEEA

SEQ ID NO: 709018 - protein, 17 aa, Mycobacterium
PKLPGTVYTAAKELEEA

SEQ ID NO: 709019 - protein, 22 aa, Mycobacterium
PKLPPNTSIPMSWSATLTGVDS

SEQ ID NO: 709020 - protein, 17 aa, Mycobacterium
PKLPPPASQVWRSRRRI

SEQ ID NO: 709021 - protein, 19 aa, Mycobacterium
PKLRARQLISQWEQHRRGI

SEQ ID NO: 709022 - protein, 19 aa, Mycobacterium
PKLRGVDRLPPGEPVTAAD

SEQ ID NO: 709023 - protein, 20 aa, Mycobacterium
PKLSRRILHQLYLGYPDSAA

SEQ ID NO: 709024 - protein, 17 aa, Mycobacterium
PKLSSRLGVLTRTNSES

SEQ ID NO: 709025 - protein, 18 aa, Mycobacterium
PKLTLCELLPRGVLDDTM

SEQ ID NO: 709026 - protein, 19 aa, Mycobacterium
PKLTTVLFAAMSRDLHRAR

SEQ ID NO: 709027 - protein, 20 aa, Mycobacterium
PKLVNVLKLRSGLAEIAGLA

SEQ ID NO: 709028 - protein, 21 aa, Mycobacterium
PKLWRDWCPPGYDAREDLAHL

SEQ ID NO: 709029 - protein, 24 aa, Mycobacterium
PKLYLDFYSGLFASSFQPAEDAPE

SEQ ID NO: 709030 - protein, 25 aa, Mycobacterium
PKMASGELIGAIAMTEAGTGSDLQS

SEQ ID NO: 709031 - protein, 18 aa, Mycobacterium
PKMAVTIKADGRATIETY

SEQ ID NO: 709032 - protein, 24 aa, Mycobacterium
PKMMAHGSPAWVWNLSSIGGVAAV

SEQ ID NO: 709033 - protein, 26 aa, Mycobacterium
PKMSKFEVLTAMAFAAFADAPIDVAV

SEQ ID NO: 709034 - protein, 26 aa, Mycobacterium
PKMSKFEVVTAMAFAAFADAPVDVAV

SEQ ID NO: 709035 - protein, 24 aa, Mycobacterium
PKMVSGEMVIAVAMTEPGTGSDLQ

SEQ ID NO: 709036 - protein, 25 aa, Mycobacterium
PKNPRLGARPRIKGLRLRATDVDWT

SEQ ID NO: 709037 - protein, 17 aa, Mycobacterium
PKNVFLAANVVPLVASQ

SEQ ID NO: 709038 - protein, 17 aa, Mycobacterium
PKNVRWRDKTVYTGIWK

SEQ ID NO: 709039 - protein, 18 aa, Mycobacterium
PKPAATVVLIRDGAVGVE

SEQ ID NO: 709040 - protein, 23 aa, Mycobacterium
PKPADLVAALALPVPSLVISQLL

SEQ ID NO: 709041 - protein, 23 aa, Mycobacterium
PKPAELHPFVPLTGPRHNAPATP

SEQ ID NO: 709042 - protein, 19 aa, Mycobacterium
PKPAGPITHAHLKRLISRI

SEQ ID NO: 709043 - protein, 20 aa, Mycobacterium
PKPALQWYWDCYVPSHDDRA

SEQ ID NO: 709044 - protein, 17 aa, Mycobacterium
PKPATPIASERVDTTAP

SEQ ID NO: 709045 - protein, 19 aa, Mycobacterium
PKPAWNLLIDCVSAPRATL

SEQ ID NO: 709046 - protein, 17 aa, Mycobacterium
PKPDLGRYGSFGRGVTP

SEQ ID NO: 709047 - protein, 18 aa, Mycobacterium
PKPDWRYNGFWRALFGFP

SEQ ID NO: 709048 - protein, 20 aa, Mycobacterium
PKPEALAAIEQIRQGGTEID

SEQ ID NO: 709049 - protein, 20 aa, Mycobacterium
PKPFAFSMVLPLAVPGHDRG

SEQ ID NO: 709050 - protein, 19 aa, Mycobacterium
PKPFLCAVNGVGVGIGATI

SEQ ID NO: 709051 - protein, 22 aa, Mycobacterium
PKPGRPRFRIPDEIDDENHVVR

SEQ ID NO: 709052 - protein, 19 aa, Mycobacterium
PKPGVSVIPLPGSAPAVED

SEQ ID NO: 709053 - protein, 17 aa, Mycobacterium
PKPKAVHPLVWRLVAPV

SEQ ID NO: 709054 - protein, 25 aa, Mycobacterium
PKPKRLTLFLLPMDRPGFTVRPIPS

SEQ ID NO: 709055 - protein, 19 aa, Mycobacterium
PKPKRRKGVGFATQPSDAF

SEQ ID NO: 709056 - protein, 19 aa, Mycobacterium
PKPLFYRQPIYYMSNHLSF

SEQ ID NO: 709057 - protein, 22 aa, Mycobacterium
PKPLGMPLQYMVSGMAVAATHK

SEQ ID NO: 709058 - protein, 22 aa, Mycobacterium
PKPLGMPLQYMVSGMAVRATNK

SEQ ID NO: 709059 - protein, 22 aa, Mycobacterium
PKPLHDFYIAYRAVVRAKVDCV

SEQ ID NO: 709060 - protein, 18 aa, Mycobacterium
PKPLICAVNGLGVGIGAT

SEQ ID NO: 709061 - protein, 17 aa, Mycobacterium
PKPLSLDLIREMMDWAA

SEQ ID NO: 709062 - protein, 25 aa, Mycobacterium
PKPPAVPAGLAWRRPVDAVADQCPP

SEQ ID NO: 709063 - protein, 21 aa, Mycobacterium
PKPPILYRIGGKDVDVTGGGW

SEQ ID NO: 709064 - protein, 20 aa, Mycobacterium
PKPPPQRITLTLPAIARSRE

SEQ ID NO: 709065 - protein, 19 aa, Mycobacterium
PKPPPQRITLTLPAVQRSR

SEQ ID NO: 709066 - protein, 23 aa, Mycobacterium
PKPPPRRITLTLPAVQRSREVWL

SEQ ID NO: 709067 - protein, 19 aa, Mycobacterium
PKPPREWHEIDGVVIPAPF

SEQ ID NO: 709068 - protein, 19 aa, Mycobacterium
PKPPRVLNGLSDVRAFFHN

SEQ ID NO: 709069 - protein, 20 aa, Mycobacterium
PKPRSGSLLRSMDLQTITLE

SEQ ID NO: 709070 - protein, 17 aa, Mycobacterium
PKPRTGSLLKSMTLETV

SEQ ID NO: 709071 - protein, 20 aa, Mycobacterium
PKPSAGLGVGEVGYLITGVK

SEQ ID NO: 709072 - protein, 20 aa, Mycobacterium
PKPTPIWGVPDGNRLLVITD

SEQ ID NO: 709073 - protein, 19 aa, Mycobacterium
PKPVALPPVPPVPPAPPLP

SEQ ID NO: 709074 - protein, 36 aa, Mycobacterium
PKPVEIIGNLLPPALKWKAFFKRQASNPKYLQDGDI

SEQ ID NO: 709075 - protein, 17 aa, Mycobacterium
PKPVVNNAVRFAFWTAE

SEQ ID NO: 709076 - protein, 21 aa, Mycobacterium
PKQFERARVVVFAGDHGVARA

SEQ ID NO: 709077 - protein, 18 aa, Mycobacterium
PKRAEWHGFFKHHELEFD

SEQ ID NO: 709078 - protein, 18 aa, Mycobacterium
PKRELDWMRRLSGEIDRP

SEQ ID NO: 709079 - protein, 30 aa, Mycobacterium
PKRIPSFPDLPGIHVLRNFDESLALRREAA

SEQ ID NO: 709080 - protein, 28 aa, Mycobacterium
PKRLDRGGLLHWARPIAPLILNASSRGG

SEQ ID NO: 709081 - protein, 29 aa, Mycobacterium
PKRLHWYVPKSIRLIDVFKGLSPEFVRRS

SEQ ID NO: 709082 - protein, 21 aa, Mycobacterium
PKRLTLFLIPMDRPGFTVRPI

SEQ ID NO: 709083 - protein, 19 aa, Mycobacterium
PKRRDEVLGAFDDERLADI

SEQ ID NO: 709084 - protein, 20 aa, Mycobacterium
PKRRELLRDMGIDHVYDSRG

SEQ ID NO: 709085 - protein, 17 aa, Mycobacterium
PKRSLLYEQTFDDYQRL

SEQ ID NO: 709086 - protein, 20 aa, Mycobacterium
PKRTLPLVVRYADIWHTFLS

SEQ ID NO: 709087 - protein, 17 aa, Mycobacterium
PKRTSLEVSCLIKGSTL

SEQ ID NO: 709088 - protein, 20 aa, Mycobacterium
PKRVALMASREDHCLLDLLW

SEQ ID NO: 709089 - protein, 24 aa, Mycobacterium
PKRVRELLELTSRWHSTLLDRHRP

SEQ ID NO: 709090 - protein, 18 aa, Mycobacterium
PKRYEFVDELPKNSYGKV

SEQ ID NO: 709091 - protein, 25 aa, Mycobacterium
PKSAVDELGRWATLHYPGAVQTHFW

SEQ ID NO: 709092 - protein, 17 aa, Mycobacterium
PKSETRRVFDMVTRRYW

SEQ ID NO: 709093 - protein, 18 aa, Mycobacterium
PKSGPVLLTDARSVPLAV

SEQ ID NO: 709094 - protein, 17 aa, Mycobacterium
PKSILLANHGLHIEILI

SEQ ID NO: 709095 - protein, 21 aa, Mycobacterium
PKSLWCLPVAGGEAYEVCQMP

SEQ ID NO: 709096 - protein, 18 aa, Mycobacterium
PKSNYAVPGLYFYDNDVV

SEQ ID NO: 709097 - protein, 25 aa, Mycobacterium
PKSRRFSPTASWGCCCRPSTSSRNT

SEQ ID NO: 709098 - protein, 19 aa, Mycobacterium
PKSRYTGWDADGGYAEFTT

SEQ ID NO: 709099 - protein, 24 aa, Mycobacterium
PKSSLDHFGPVRLTSPRVVLASNR

SEQ ID NO: 709100 - protein, 34 aa, Mycobacterium
PKSVPIPQFLAACYDAGLSWVHFPEGMGGLGVSR

SEQ ID NO: 709101 - protein, 17 aa, Mycobacterium
PKSYLPTYREFYERRQM

SEQ ID NO: 709102 - protein, 22 aa, Mycobacterium
PKTAEGLRAWVGVGGSPESVVR

SEQ ID NO: 709103 - protein, 24 aa, Mycobacterium
PKTAETAAEFGLRVDVQPETAAVG

SEQ ID NO: 709104 - protein, 24 aa, Mycobacterium
PKTAETAVEFGLRVDVQPETAAVG

SEQ ID NO: 709105 - protein, 27 aa, Mycobacterium
PKTARPEALAGPLWTIAEGLRVVDGAL

SEQ ID NO: 709106 - protein, 23 aa, Mycobacterium
PKTEDWINIGYFIFERGVFDYLE

SEQ ID NO: 709107 - protein, 19 aa, Mycobacterium
PKTGVLVLDPPQPRVTPKG

SEQ ID NO: 709108 - protein, 23 aa, Mycobacterium
PKTLIQHLIRWVISSGQFESDVT

SEQ ID NO: 709109 - protein, 22 aa, Mycobacterium
PKTLIQHLIRWVISSQQFESKV

SEQ ID NO: 709110 - protein, 24 aa, Mycobacterium
PKTLIQHLIRWVITSGEFDEHVGE

SEQ ID NO: 709111 - protein, 17 aa, Mycobacterium
PKTMEAFVKKFGEDLVL

SEQ ID NO: 709112 - protein, 28 aa, Mycobacterium
PKTSGSRGFHIYARIAPRWEFRQVRLAA

SEQ ID NO: 709113 - protein, 21 aa, Mycobacterium
PKTSGSRGFHIYARISRDWPY

SEQ ID NO: 709114 - protein, 18 aa, Mycobacterium
PKTSLVLADDDWETFVPM

SEQ ID NO: 709115 - protein, 19 aa, Mycobacterium
PKTTLGFLKPQVAIIGHGD

SEQ ID NO: 709116 - protein, 21 aa, Mycobacterium
PKTVGLRGIYRGVAKAAGLPR

SEQ ID NO: 709117 - protein, 19 aa, Mycobacterium
PKTYMGPLINERQRDKVDG

SEQ ID NO: 709118 - protein, 18 aa, Mycobacterium
PKTYPLIVVDVTSDSHPF

SEQ ID NO: 709119 - protein, 19 aa, Mycobacterium
PKVAASMLALARDLRSPSA

SEQ ID NO: 709120 - protein, 18 aa, Mycobacterium
PKVARVVLDAAVLKDTLV

SEQ ID NO: 709121 - protein, 23 aa, Mycobacterium
PKVATGEVHVCFGVTEPGAGLDT

SEQ ID NO: 709122 - protein, 22 aa, Mycobacterium
PKVAVINCEQFEVCIQRRQGFE

SEQ ID NO: 709123 - protein, 18 aa, Mycobacterium
PKVEARVGLINWLIQDPG

SEQ ID NO: 709124 - protein, 22 aa, Mycobacterium
PKVFDYLSSLEWIRTQQNLAII

SEQ ID NO: 709125 - protein, 22 aa, Mycobacterium
PKVFDYLSSLEWVRTQQNLAII

SEQ ID NO: 709126 - protein, 32 aa, Mycobacterium
PKVIDVLKWTDRVCRESGWHYEVWSGTNPTEL

SEQ ID NO: 709127 - protein, 21 aa, Mycobacterium
PKVKLPTPVTKVGEVSGGVAP

SEQ ID NO: 709128 - protein, 19 aa, Mycobacterium
PKVLASLLMEFNDRLLERL

SEQ ID NO: 709129 - protein, 23 aa, Mycobacterium
PKVLRSGRRAMVMQVDIFGDGDG

SEQ ID NO: 709130 - protein, 20 aa, Mycobacterium
PKVLRVGWCTVVTLTDSGPQ

SEQ ID NO: 709131 - protein, 17 aa, Mycobacterium
PKVMADFTVREARQFGF

SEQ ID NO: 709132 - protein, 22 aa, Mycobacterium
PKVPELPAAFAHFRSDTGAQVY

SEQ ID NO: 709133 - protein, 19 aa, Mycobacterium
PKVRAMELIEEMEKTRRGL

SEQ ID NO: 709134 - protein, 18 aa, Mycobacterium
PKVRKMRADIERQVKAGE

SEQ ID NO: 709135 - protein, 21 aa, Mycobacterium
PKVRLVPFVHRLIAPLVEHDK

SEQ ID NO: 709136 - protein, 21 aa, Mycobacterium
PKVRRLRRLAGLWLAGQDQRW

SEQ ID NO: 709137 - protein, 19 aa, Mycobacterium
PKVSAQWQAQVALFADQPG

SEQ ID NO: 709138 - protein, 20 aa, Mycobacterium
PKVTGSWLLHRATASRDVDW

SEQ ID NO: 709139 - protein, 19 aa, Mycobacterium
PKVVLDFPVSRRTSPQLMT

SEQ ID NO: 709140 - protein, 18 aa, Mycobacterium
PKVVSLYGTEVWNRMSRA

SEQ ID NO: 709141 - protein, 20 aa, Mycobacterium
PKVYWTVFGLSAFRAAKQDL

SEQ ID NO: 709142 - protein, 23 aa, Mycobacterium
PKWAKSLRPGWQKERQRNFHSWT

SEQ ID NO: 709143 - protein, 19 aa, Mycobacterium
PKWDSRYGVLHDRVSELLP

SEQ ID NO: 709144 - protein, 20 aa, Mycobacterium
PKWDSRYGVLHDRVSELLPM

SEQ ID NO: 709145 - protein, 18 aa, Mycobacterium
PKWSDGHRSVRLMRHPIQ

SEQ ID NO: 709146 - protein, 20 aa, Mycobacterium
PKWVGRCANCGTWGTVDEVA

SEQ ID NO: 709147 - protein, 20 aa, Mycobacterium
PKYAPDWVRTVPMWAESSKR

SEQ ID NO: 709148 - protein, 17 aa, Mycobacterium
PKYGFRPTVMARPPFGG

SEQ ID NO: 709149 - protein, 17 aa, Mycobacterium
PKYRRLTTAEVRAGLYQ

SEQ ID NO: 709150 - protein, 19 aa, Mycobacterium
PKYSAAETLSALAAARGHG

SEQ ID NO: 709151 - protein, 20 aa, Mycobacterium
PKYTPDWVRTVPIWAEASRR

SEQ ID NO: 709152 - protein, 23 aa, Mycobacterium
PLAAFCDALGALGINVNVRDYSE

SEQ ID NO: 709153 - protein, 23 aa, Mycobacterium
PLAAGCPGELLVRGPEQMLGYLD

SEQ ID NO: 709154 - protein, 17 aa, Mycobacterium
PLAALGLVSVRNMANPM

SEQ ID NO: 709155 - protein, 28 aa, Mycobacterium
PLAALHFFPAAALELGWLQSQVTSAAEN

SEQ ID NO: 709156 - protein, 25 aa, Mycobacterium
PLAALKRPGSFLARQVPQFLRLLES

SEQ ID NO: 709157 - protein, 17 aa, Mycobacterium
PLAALTRLISERIAAAD

SEQ ID NO: 709158 - protein, 26 aa, Mycobacterium
PLAAPVAGCPDVEIVFARGTTEAPGL

SEQ ID NO: 709159 - protein, 17 aa, Mycobacterium
PLAAQWLIRVFLALWYW

SEQ ID NO: 709160 - protein, 17 aa, Mycobacterium
PLAASWHSNKFVNPATD

SEQ ID NO: 709161 - protein, 17 aa, Mycobacterium
PLAAVVCEDHALAGHRR

SEQ ID NO: 709162 - protein, 17 aa, Mycobacterium
PLACAAALAVIDTIERE

SEQ ID NO: 709163 - protein, 27 aa, Mycobacterium
PLACGALGRSGTPVASWMMNKADLLVV

SEQ ID NO: 709164 - protein, 28 aa, Mycobacterium
PLACLSEARFGIVFGSVGAARDCLEATL

SEQ ID NO: 709165 - protein, 17 aa, Mycobacterium
PLACVLCAVEQLPDLDG

SEQ ID NO: 709166 - protein, 26 aa, Mycobacterium
PLADAVVAMFARFPVGQGRRMFETAI

SEQ ID NO: 709167 - protein, 18 aa, Mycobacterium
PLADGWLYHDRAILVPCD

SEQ ID NO: 709168 - protein, 21 aa, Mycobacterium
PLADLVEVAHYWRTRYDWRKF

SEQ ID NO: 709169 - protein, 20 aa, Mycobacterium
PLADPHFWTMSGSVRVAAIC

SEQ ID NO: 709170 - protein, 18 aa, Mycobacterium
PLADQWLSIAQAFAGPPG

SEQ ID NO: 709171 - protein, 25 aa, Mycobacterium
PLADRGCRLQMLALYRAGRTADALE

SEQ ID NO: 709172 - protein, 17 aa, Mycobacterium
PLADVSFSAVESSPVGP

SEQ ID NO: 709173 - protein, 19 aa, Mycobacterium
PLAEALLAEPGRWDLSSLL

SEQ ID NO: 709174 - protein, 20 aa, Mycobacterium
PLAEHRARISYARDQLAVLD

SEQ ID NO: 709175 - protein, 19 aa, Mycobacterium
PLAELGLNSLMAMAIRREA

SEQ ID NO: 709176 - protein, 23 aa, Mycobacterium
PLAELPQRLAAFDGALLPGGADV

SEQ ID NO: 709177 - protein, 19 aa, Mycobacterium
PLAEVAPAFIVGGTADAIL

SEQ ID NO: 709178 - protein, 22 aa, Mycobacterium
PLAEVRAALGIAASESAHPAGH

SEQ ID NO: 709179 - protein, 17 aa, Mycobacterium
PLAEYHRLWEPKIPLGR

SEQ ID NO: 709180 - protein, 28 aa, Mycobacterium
PLAFASLDRWPGTVAEYLSTMFDPSLTF

SEQ ID NO: 709181 - protein, 25 aa, Mycobacterium
PLAGLHFFPAPALPAGMLSTLATKA

SEQ ID NO: 709182 - protein, 19 aa, Mycobacterium
PLAHFVSCLVYLPRDRYTT

SEQ ID NO: 709183 - protein, 24 aa, Mycobacterium
PLAHLRAFVMIPWLAIDPDAQLTV

SEQ ID NO: 709184 - protein, 24 aa, Mycobacterium
PLAHPALVCDVAIGQSTLVTQRVK

SEQ ID NO: 709185 - protein, 23 aa, Mycobacterium
PLAHWQPRLLAVRSPNAPIVDDA

SEQ ID NO: 709186 - protein, 23 aa, Mycobacterium
PLAKEPRPVLLIVADGMSAAVAT

SEQ ID NO: 709187 - protein, 18 aa, Mycobacterium
PLAKRPTISNGYLKAYNR

SEQ ID NO: 709188 - protein, 18 aa, Mycobacterium
PLALEQNGDWTLSWDQWR

SEQ ID NO: 709189 - protein, 18 aa, Mycobacterium
PLALERQVCFALAVTNRA

SEQ ID NO: 709190 - protein, 17 aa, Mycobacterium
PLALIDVREPVEWDINR

SEQ ID NO: 709191 - protein, 17 aa, Mycobacterium
PLALLFGVRCGTALPGL

SEQ ID NO: 709192 - protein, 29 aa, Mycobacterium
PLALSLIRPRQVIMLGRPTLHRSVSTLLA

SEQ ID NO: 709193 - protein, 19 aa, Mycobacterium
PLAMHLRTGVAMLSYADDL

SEQ ID NO: 709194 - protein, 19 aa, Mycobacterium
PLAMHLRTGVAMLSYSDDL

SEQ ID NO: 709195 - protein, 20 aa, Mycobacterium
PLANALAVRGIARYSLGLPG

SEQ ID NO: 709196 - protein, 18 aa, Mycobacterium
PLANIAIVVQGGRNLARR

SEQ ID NO: 709197 - protein, 19 aa, Mycobacterium
PLANMAITVCSGRGLSHRA

SEQ ID NO: 709198 - protein, 18 aa, Mycobacterium
PLANMAITVHSGRNLVRR

SEQ ID NO: 709199 - protein, 18 aa, Mycobacterium
PLANMAITVQGGRNLARR

SEQ ID NO: 709200 - protein, 19 aa, Mycobacterium
PLAPEVRGELHAMMLDMRR

SEQ ID NO: 709201 - protein, 20 aa, Mycobacterium
PLAPHGLPGHLVGFVEALRA

SEQ ID NO: 709202 - protein, 20 aa, Mycobacterium
PLAPHGLPGHLVGFVEALRG

SEQ ID NO: 709203 - protein, 29 aa, Mycobacterium
PLAPHLAEELWLRLGHAVSLAHGPFPEAD

SEQ ID NO: 709204 - protein, 28 aa, Mycobacterium
PLAPHLAEELWLRLGHTTSLAHGPFPVA

SEQ ID NO: 709205 - protein, 19 aa, Mycobacterium
PLAPLRLRIGVHTGEVQLR

SEQ ID NO: 709206 - protein, 25 aa, Mycobacterium
PLAPMPHPWFQLIFEGGEQKTTELA

SEQ ID NO: 709207 - protein, 20 aa, Mycobacterium
PLAPVAAAGRAGAPLPTRTE

SEQ ID NO: 709208 - protein, 24 aa, Mycobacterium
PLAPVLPLIRRLLIDDAADSGVIV

SEQ ID NO: 709209 - protein, 26 aa, Mycobacterium
PLAQAFDHFGWLGGFFAMDLPATSVL

SEQ ID NO: 709210 - protein, 36 aa, Mycobacterium
PLARIAVKAALTRLGCPYVWGAKGPNQFDCSGLVHW

SEQ ID NO: 709211 - protein, 22 aa, Mycobacterium
PLARIERGLLFGIVPTAAGVLA

SEQ ID NO: 709212 - protein, 18 aa, Mycobacterium
PLARILMAGMTFDELPFG

SEQ ID NO: 709213 - protein, 18 aa, Mycobacterium
PLARLWATALAGLVDIGY

SEQ ID NO: 709214 - protein, 24 aa, Mycobacterium
PLARRPALIRSLRATSWGASSIAS

SEQ ID NO: 709215 - protein, 21 aa, Mycobacterium
PLASAGLDDLVSWLGPTVQRY

SEQ ID NO: 709216 - protein, 18 aa, Mycobacterium
PLASLVRDYHRPMVNFAR

SEQ ID NO: 709217 - protein, 18 aa, Mycobacterium
PLASLVRDYHRQMVNFAR

SEQ ID NO: 709218 - protein, 20 aa, Mycobacterium
PLASRVIVVGVCMGDDRIRP

SEQ ID NO: 709219 - protein, 18 aa, Mycobacterium
PLASTLSIDAGNGADGVN

SEQ ID NO: 709220 - protein, 19 aa, Mycobacterium
PLASVFKLYVLLAAGTAIN

SEQ ID NO: 709221 - protein, 17 aa, Mycobacterium
PLATALANHYDICRVTE

SEQ ID NO: 709222 - protein, 24 aa, Mycobacterium
PLATMAGYHLGWWDVNGSGTGGWS

SEQ ID NO: 709223 - protein, 25 aa, Mycobacterium
PLATPGVAVGDHFELLAMGSTASSQ

SEQ ID NO: 709224 - protein, 18 aa, Mycobacterium
PLAWHFAFHQCRDVPEFL

SEQ ID NO: 709225 - protein, 18 aa, Mycobacterium
PLCEEPLDPAGHICVRTN

SEQ ID NO: 709226 - protein, 25 aa, Mycobacterium
PLCGGLPPDIAWPYLQRVGEVVLPE

SEQ ID NO: 709227 - protein, 18 aa, Mycobacterium
PLCLEGWRGIPVHRVPSV

SEQ ID NO: 709228 - protein, 17 aa, Mycobacterium
PLCPECYDYAGHVLFAW

SEQ ID NO: 709229 - protein, 18 aa, Mycobacterium
PLCPLGVSPIDFSHTTRL

SEQ ID NO: 709230 - protein, 19 aa, Mycobacterium
PLCVAHLRALAAGDGAALD

SEQ ID NO: 709231 - protein, 21 aa, Mycobacterium
PLCYVDPYLPIESFRRRDEAR

SEQ ID NO: 709232 - protein, 17 aa, Mycobacterium
PLDAAQIAGVYAAYEAL

SEQ ID NO: 709233 - protein, 19 aa, Mycobacterium
PLDALALAIRRIRATNISA

SEQ ID NO: 709234 - protein, 18 aa, Mycobacterium
PLDDALRLLEAHLAEIDL

SEQ ID NO: 709235 - protein, 25 aa, Mycobacterium
PLDDFRKVLDLNVTRMMELVQHYAR

SEQ ID NO: 709236 - protein, 23 aa, Mycobacterium
PLDDGRTLLTFAYGTKAPADNDL

SEQ ID NO: 709237 - protein, 22 aa, Mycobacterium
PLDEAPHAYEIFQKKQDGAVKV

SEQ ID NO: 709238 - protein, 18 aa, Mycobacterium
PLDETGCPEVIDAGGKWV

SEQ ID NO: 709239 - protein, 25 aa, Mycobacterium
PLDEVSGWDSVYLLKLITALEQQTG

SEQ ID NO: 709240 - protein, 18 aa, Mycobacterium
PLDGFRVLDFTQNIAGPL

SEQ ID NO: 709241 - protein, 17 aa, Mycobacterium
PLDGLVIAAGFSGHGFK

SEQ ID NO: 709242 - protein, 18 aa, Mycobacterium
PLDGPWASGVRRIATEAG

SEQ ID NO: 709243 - protein, 25 aa, Mycobacterium
PLDKTRPLWEMYLAEGLAKNRVAIY

SEQ ID NO: 709244 - protein, 25 aa, Mycobacterium
PLDKTRPLWEMYLVEGLAGNRIAVY

SEQ ID NO: 709245 - protein, 26 aa, Mycobacterium
PLDLALPEFVCLRILSMYPGMSSAEL

SEQ ID NO: 709246 - protein, 18 aa, Mycobacterium
PLDLVAGQLASLIDARTV

SEQ ID NO: 709247 - protein, 21 aa, Mycobacterium
PLDNPWLLLIELARDSDPTDD

SEQ ID NO: 709248 - protein, 21 aa, Mycobacterium
PLDPDGLMARTLAPRPENESI

SEQ ID NO: 709249 - protein, 21 aa, Mycobacterium
PLDPRCRAASAMAGREQGRRE

SEQ ID NO: 709250 - protein, 17 aa, Mycobacterium
PLDPRRIEVLKNAAGEL

SEQ ID NO: 709251 - protein, 24 aa, Mycobacterium
PLDQRYPLWGIWVLEGLSDGNVAI

SEQ ID NO: 709252 - protein, 18 aa, Mycobacterium
PLDRCDPDLLGHDDHGPY

SEQ ID NO: 709253 - protein, 17 aa, Mycobacterium
PLDRGAAGIALLASMPP

SEQ ID NO: 709254 - protein, 24 aa, Mycobacterium
PLDRGIREMVILRVGTLSGSAYER

SEQ ID NO: 709255 - protein, 34 aa, Mycobacterium
PLDRLAHTDIVSWARYPLGVVHEFVKRGNDIHGM

SEQ ID NO: 709256 - protein, 27 aa, Mycobacterium
PLDRLIAFGRERICFVHAHHELLSEAN

SEQ ID NO: 709257 - protein, 27 aa, Mycobacterium
PLDRLIAFGRERICFVHAHRELLSEAG

SEQ ID NO: 709258 - protein, 21 aa, Mycobacterium
PLDRPFAWALIKLDGADTALL

SEQ ID NO: 709259 - protein, 18 aa, Mycobacterium
PLDRSHTAAIIWSDRSDG

SEQ ID NO: 709260 - protein, 25 aa, Mycobacterium
PLDRSRPLWEMWVIEGVAGTDCHHD

SEQ ID NO: 709261 - protein, 24 aa, Mycobacterium
PLDRSRPLWEMYFVEGLAGGRIAV

SEQ ID NO: 709262 - protein, 25 aa, Mycobacterium
PLDRSRPLWEMYLIEGLADGRIAVL

SEQ ID NO: 709263 - protein, 24 aa, Mycobacterium
PLDRSRPLWEMYLVEGLSKNRLAI

SEQ ID NO: 709264 - protein, 24 aa, Mycobacterium
PLDRTRPLWEMYIADGLADNKIAV

SEQ ID NO: 709265 - protein, 17 aa, Mycobacterium
PLDTAGVLREARRSAAV

SEQ ID NO: 709266 - protein, 19 aa, Mycobacterium
PLDVARWLRGRSMACDWLV

SEQ ID NO: 709267 - protein, 20 aa, Mycobacterium
PLDVLRRALPAGIACVQNAY

SEQ ID NO: 709268 - protein, 24 aa, Mycobacterium
PLDWAVELDERWVIVGPNGAGKTS

SEQ ID NO: 709269 - protein, 17 aa, Mycobacterium
PLDWLVSKFAREVPGVA

SEQ ID NO: 709270 - protein, 24 aa, Mycobacterium
PLDWTVELDERWVIVGPNGAGKTS

SEQ ID NO: 709271 - protein, 24 aa, Mycobacterium
PLEARVGHHYQMAGTYLVGREKVR

SEQ ID NO: 709272 - protein, 17 aa, Mycobacterium
PLEAWTMLRDNAAAVLV

SEQ ID NO: 709273 - protein, 17 aa, Mycobacterium
PLEDCYAALRWLSVQGW

SEQ ID NO: 709274 - protein, 19 aa, Mycobacterium
PLEEGVRAYDLFKNKKDKC

SEQ ID NO: 709275 - protein, 24 aa, Mycobacterium
PLEELAGAFLLVWTTTPWTLPSNL

SEQ ID NO: 709276 - protein, 23 aa, Mycobacterium
PLEEWDLRAAALGGNSHSLVAAF

SEQ ID NO: 709277 - protein, 29 aa, Mycobacterium
PLEEYHRLWEPKIPLGRIGRPEELTGLYL

SEQ ID NO: 709278 - protein, 19 aa, Mycobacterium
PLEGFKMIDPTCGSGHFLL

SEQ ID NO: 709279 - protein, 25 aa, Mycobacterium
PLEGLRVIDLTAFWAGPAATHLLAA

SEQ ID NO: 709280 - protein, 27 aa, Mycobacterium
PLEGQPLAKPFAWALIKLDGADTSLLH

SEQ ID NO: 709281 - protein, 20 aa, Mycobacterium
PLEHGHVIQVFGLPNMRTVL

SEQ ID NO: 709282 - protein, 24 aa, Mycobacterium
PLEILEAGCGLDWPLDLEGVDYRL

SEQ ID NO: 709283 - protein, 26 aa, Mycobacterium
PLEIPCDLALLAIGFEGVEHMPLLDD

SEQ ID NO: 709284 - protein, 19 aa, Mycobacterium
PLEIPHYVDHLAAFLDAIG

SEQ ID NO: 709285 - protein, 25 aa, Mycobacterium
PLERFGVMLDRYLGFMALDPPTARL

SEQ ID NO: 709286 - protein, 20 aa, Mycobacterium
PLERGREAFESRNRPGHRPG

SEQ ID NO: 709287 - protein, 18 aa, Mycobacterium
PLERIEVRMAGPATDVTA

SEQ ID NO: 709288 - protein, 19 aa, Mycobacterium
PLERLHLVPPPGMSPEMVK

SEQ ID NO: 709289 - protein, 24 aa, Mycobacterium
PLERLKVAIQLLFESSRPDPAAKR

SEQ ID NO: 709290 - protein, 21 aa, Mycobacterium
PLERSKPLWEMWVIEGVGGSA

SEQ ID NO: 709291 - protein, 20 aa, Mycobacterium
PLESTGIFLIYAALYQLAKH

SEQ ID NO: 709292 - protein, 20 aa, Mycobacterium
PLEVLIAVVNRLGWTHGCEL

SEQ ID NO: 709293 - protein, 25 aa, Mycobacterium
PLFAECVELGVPFCTQVGHTGPLRP

SEQ ID NO: 709294 - protein, 19 aa, Mycobacterium
PLFAKRARVALGDDGARQR

SEQ ID NO: 709295 - protein, 23 aa, Mycobacterium
PLFCLPPGGGLSWIYRNLGAYLD

SEQ ID NO: 709296 - protein, 20 aa, Mycobacterium
PLFDGSGWNPAACADCGASV

SEQ ID NO: 709297 - protein, 17 aa, Mycobacterium
PLFLERKGYNSAVLQVQ

SEQ ID NO: 709298 - protein, 20 aa, Mycobacterium
PLFQSHMWDGSAVPIDENLS

SEQ ID NO: 709299 - protein, 20 aa, Mycobacterium
PLFTDFAPRLLVSHPSEVKV

SEQ ID NO: 709300 - protein, 22 aa, Mycobacterium
PLFTDFAPRLLVSHPSEVKVAH

SEQ ID NO: 709301 - protein, 22 aa, Mycobacterium
PLFTDFAPRLLVTHPAEVKVAH

SEQ ID NO: 709302 - protein, 23 aa, Mycobacterium
PLFTDFAPRLLVTHPAEVKVAHA

SEQ ID NO: 709303 - protein, 20 aa, Mycobacterium
PLGALRIVGNLIRRPAARKR

SEQ ID NO: 709304 - protein, 17 aa, Mycobacterium
PLGARMMPSVGRRMQRA

SEQ ID NO: 709305 - protein, 23 aa, Mycobacterium
PLGARPFAREQYRNKFVTLADGV

SEQ ID NO: 709306 - protein, 23 aa, Mycobacterium
PLGATGLAQCAELTWQLRGDADK

SEQ ID NO: 709307 - protein, 27 aa, Mycobacterium
PLGATGLAQCCELTWQLRGTADRRQVD

SEQ ID NO: 709308 - protein, 17 aa, Mycobacterium
PLGAWVVDQRNRFAQGT

SEQ ID NO: 709309 - protein, 18 aa, Mycobacterium
PLGDAVGYAVRFTDQVSE

SEQ ID NO: 709310 - protein, 17 aa, Mycobacterium
PLGDYWLAGLHAAAQKR

SEQ ID NO: 709311 - protein, 26 aa, Mycobacterium
PLGEAEAALEFYDLSHPWGHGAPAWP

SEQ ID NO: 709312 - protein, 19 aa, Mycobacterium
PLGELLRHRYEISTPSRDL

SEQ ID NO: 709313 - protein, 24 aa, Mycobacterium
PLGETITSPGLREIVLNDLIGAPG

SEQ ID NO: 709314 - protein, 23 aa, Mycobacterium
PLGEYPGEFWAYARNKVIVAARI

SEQ ID NO: 709315 - protein, 24 aa, Mycobacterium
PLGGASVDYWAAIADRWSLELTVV

SEQ ID NO: 709316 - protein, 21 aa, Mycobacterium
PLGGASVDYWGAIAERHQIDL

SEQ ID NO: 709317 - protein, 18 aa, Mycobacterium
PLGGGRINIGIGYVNSYR

SEQ ID NO: 709318 - protein, 19 aa, Mycobacterium
PLGGGRNARIWFAVYNVLH

SEQ ID NO: 709319 - protein, 17 aa, Mycobacterium
PLGGQAWEDAGRLVETQ

SEQ ID NO: 709320 - protein, 23 aa, Mycobacterium
PLGGTDIRWTGSFTEGVRGTGPV

SEQ ID NO: 709321 - protein, 21 aa, Mycobacterium
PLGHHRWEFPARAGEDDQKLV

SEQ ID NO: 709322 - protein, 21 aa, Mycobacterium
PLGIIPLLLLDMWEHAFYLQY

SEQ ID NO: 709323 - protein, 23 aa, Mycobacterium
PLGIIPLLLLDMWEHAFYLQYKN

SEQ ID NO: 709324 - protein, 18 aa, Mycobacterium
PLGKARITLRLHDLDGGG

SEQ ID NO: 709325 - protein, 21 aa, Mycobacterium
PLGKLGLFGALTLPGASIPFK

SEQ ID NO: 709326 - protein, 26 aa, Mycobacterium
PLGKRLCHFYRGVGVTIYEGYGLTET

SEQ ID NO: 709327 - protein, 20 aa, Mycobacterium
PLGLAFARDGRLLVCDSPRG

SEQ ID NO: 709328 - protein, 22 aa, Mycobacterium
PLGLGMPEFMCLRMLNENPGRT

SEQ ID NO: 709329 - protein, 18 aa, Mycobacterium
PLGLRVLRNIERVVREEM

SEQ ID NO: 709330 - protein, 25 aa, Mycobacterium
PLGLTLPEFVCLRILSASPGLSSAE

SEQ ID NO: 709331 - protein, 31 aa, Mycobacterium
PLGNLAFFVLDGWLRPVPVGVVGELYVAGGG

SEQ ID NO: 709332 - protein, 22 aa, Mycobacterium
PLGPEARRSGYLKVRDRQSYQF

SEQ ID NO: 709333 - protein, 18 aa, Mycobacterium
PLGPFGFSGWVGPEPHGA

SEQ ID NO: 709334 - protein, 18 aa, Mycobacterium
PLGPGGPSLVWFGRITPE

SEQ ID NO: 709335 - protein, 20 aa, Mycobacterium
PLGPIRLRIGVHTGDIQLRD

SEQ ID NO: 709336 - protein, 17 aa, Mycobacterium
PLGPLGVTMRLYAPRPE

SEQ ID NO: 709337 - protein, 25 aa, Mycobacterium
PLGRRIQPGVGRRMQRSWLDFARDN

SEQ ID NO: 709338 - protein, 23 aa, Mycobacterium
PLGRRPSTVVIFGGRSEIGLEVA

SEQ ID NO: 709339 - protein, 30 aa, Mycobacterium
PLGSKMNRFFLRGALVARLLSEAAWKQYPQ

SEQ ID NO: 709340 - protein, 17 aa, Mycobacterium
PLGSWLAELPDERLITL

SEQ ID NO: 709341 - protein, 17 aa, Mycobacterium
PLGSWLAELSDERLIRL

SEQ ID NO: 709342 - protein, 19 aa, Mycobacterium
PLGTHFPAEVPAAIDELAH

SEQ ID NO: 709343 - protein, 29 aa, Mycobacterium
PLGTRLCHFYRGIGLTIYEGYGLTETSAA

SEQ ID NO: 709344 - protein, 18 aa, Mycobacterium
PLGVVAAIVPWNIPLLTT

SEQ ID NO: 709345 - protein, 20 aa, Mycobacterium
PLGVVGVIAPWNFPMPIACW

SEQ ID NO: 709346 - protein, 18 aa, Mycobacterium
PLGVVGVITPFNFPIAIP

SEQ ID NO: 709347 - protein, 19 aa, Mycobacterium
PLGYQLIDIPLKFHHPMWR

SEQ ID NO: 709348 - protein, 20 aa, Mycobacterium
PLHAECAGLIYLASELDGYP

SEQ ID NO: 709349 - protein, 25 aa, Mycobacterium
PLHAMLKERLELTGDLDVVSLVIEK

SEQ ID NO: 709350 - protein, 19 aa, Mycobacterium
PLHDIRHVGEPEIDALTLG

SEQ ID NO: 709351 - protein, 20 aa, Mycobacterium
PLHGRWSHRSKFHGPSGLGY

SEQ ID NO: 709352 - protein, 17 aa, Mycobacterium
PLHGVPFTVKDSIDTAD

SEQ ID NO: 709353 - protein, 19 aa, Mycobacterium
PLHHREPGPALALLRHRGV

SEQ ID NO: 709354 - protein, 20 aa, Mycobacterium
PLHLPFELPEAATAAEVGFA

SEQ ID NO: 709355 - protein, 17 aa, Mycobacterium
PLHPALKYYHPFDGDGM

SEQ ID NO: 709356 - protein, 20 aa, Mycobacterium
PLHPEFRTVPMVWYIPPLSP

SEQ ID NO: 709357 - protein, 19 aa, Mycobacterium
PLHPLALRLAHPKQVIMLG

SEQ ID NO: 709358 - protein, 19 aa, Mycobacterium
PLHPVSAVLAGLVEAPQGH

SEQ ID NO: 709359 - protein, 18 aa, Mycobacterium
PLHRGRSLHGNWSATDLM

SEQ ID NO: 709360 - protein, 17 aa, Mycobacterium
PLHRLLGDILRRGIAEG

SEQ ID NO: 709361 - protein, 18 aa, Mycobacterium
PLHSSISFSVRHLVVSKV

SEQ ID NO: 709362 - protein, 17 aa, Mycobacterium
PLHSVAGEVLMRQGDRA

SEQ ID NO: 709363 - protein, 19 aa, Mycobacterium
PLHTTAVLAWMGYDAPEFD

SEQ ID NO: 709364 - protein, 17 aa, Mycobacterium
PLHWLHTAGIPGDSAVA

SEQ ID NO: 709365 - protein, 18 aa, Mycobacterium
PLHYERFSPPPVVDGLPF

SEQ ID NO: 709366 - protein, 23 aa, Mycobacterium
PLHYPDYIEAVWIVEGHGQLIDR

SEQ ID NO: 709367 - protein, 17 aa, Mycobacterium
PLIAERGLTLIGFAVSN

SEQ ID NO: 709368 - protein, 18 aa, Mycobacterium
PLIARAHLLLRFDGAKWI

SEQ ID NO: 709369 - protein, 17 aa, Mycobacterium
PLIESMIAAHRIIGSLV

SEQ ID NO: 709370 - protein, 22 aa, Mycobacterium
PLIGELCYQCIHSIKAGIKDAI

SEQ ID NO: 709371 - protein, 17 aa, Mycobacterium
PLIGERGLTLIGFAVCN

SEQ ID NO: 709372 - protein, 21 aa, Mycobacterium
PLIGNEGYFPPAFTIGDYRAR

SEQ ID NO: 709373 - protein, 21 aa, Mycobacterium
PLIHGAAQWSVMTAITTGQSV

SEQ ID NO: 709374 - protein, 21 aa, Mycobacterium
PLIHGAAQWTVMTALTTGQTV

SEQ ID NO: 709375 - protein, 20 aa, Mycobacterium
PLIHGACRLLSIPLRHVYAA

SEQ ID NO: 709376 - protein, 25 aa, Mycobacterium
PLIKSLDLPGGMGQHFFFDAGNGDC

SEQ ID NO: 709377 - protein, 19 aa, Mycobacterium
PLINIHHSFLPAFIGASPY

SEQ ID NO: 709378 - protein, 19 aa, Mycobacterium
PLINRLPLRLVYAPWAADA

SEQ ID NO: 709379 - protein, 31 aa, Mycobacterium
PLIRVLRVALYPTKIVLDFADDRIAQIERAL

SEQ ID NO: 709380 - protein, 17 aa, Mycobacterium
PLISDAMLRVFFEAYAI

SEQ ID NO: 709381 - protein, 17 aa, Mycobacterium
PLISELVEKPMGPSVQP

SEQ ID NO: 709382 - protein, 26 aa, Mycobacterium
PLITPEMYRLIGINAGRHAKGATPSP

SEQ ID NO: 709383 - protein, 19 aa, Mycobacterium
PLIVDEAWGAHLPFHEELP

SEQ ID NO: 709384 - protein, 19 aa, Mycobacterium
PLIVDEAWGAHLPFHENLP

SEQ ID NO: 709385 - protein, 18 aa, Mycobacterium
PLIVSWPAGIAARGEVRD

SEQ ID NO: 709386 - protein, 23 aa, Mycobacterium
PLIYSCQELHPLPTGTVMGIPAS

SEQ ID NO: 709387 - protein, 22 aa, Mycobacterium
PLKAGARLLLKHGTRTVPAIIG

SEQ ID NO: 709388 - protein, 21 aa, Mycobacterium
PLKAIFPVMAARDFYRDAATM

SEQ ID NO: 709389 - protein, 19 aa, Mycobacterium
PLKGKPPNVYGFPLNKARA

SEQ ID NO: 709390 - protein, 19 aa, Mycobacterium
PLKLVGIADIVALYSNLDE

SEQ ID NO: 709391 - protein, 20 aa, Mycobacterium
PLKNSRTGSIYIVKPKMHGP

SEQ ID NO: 709392 - protein, 17 aa, Mycobacterium
PLKPGKGPIALRVHLGT

SEQ ID NO: 709393 - protein, 18 aa, Mycobacterium
PLKYRLAYTADLEATFTP

SEQ ID NO: 709394 - protein, 24 aa, Mycobacterium
PLLAEERRLLLAAMGRARRQLLVT

SEQ ID NO: 709395 - protein, 24 aa, Mycobacterium
PLLAELYRRGGVELTPEVRGRFQQ

SEQ ID NO: 709396 - protein, 17 aa, Mycobacterium
PLLANVETYRCWLDDER

SEQ ID NO: 709397 - protein, 19 aa, Mycobacterium
PLLAPLRAKFEPIMAQTDQ

SEQ ID NO: 709398 - protein, 17 aa, Mycobacterium
PLLAPSLVDSVVSVGHS

SEQ ID NO: 709399 - protein, 26 aa, Mycobacterium
PLLASARGVAAWAFAESRQPWDADGV

SEQ ID NO: 709400 - protein, 29 aa, Mycobacterium
PLLCEEEVDRACAPWGLLGEDKQATLVAG

SEQ ID NO: 709401 - protein, 18 aa, Mycobacterium
PLLDELVDLLGRNKAADE

SEQ ID NO: 709402 - protein, 19 aa, Mycobacterium
PLLDFCGFAKQGAVIREAF

SEQ ID NO: 709403 - protein, 18 aa, Mycobacterium
PLLDLPLDIEESPSGIAV

SEQ ID NO: 709404 - protein, 18 aa, Mycobacterium
PLLDLPWDIADSPPGRIL

SEQ ID NO: 709405 - protein, 17 aa, Mycobacterium
PLLDPALGAALYAAKHI

SEQ ID NO: 709406 - protein, 24 aa, Mycobacterium
PLLDRVPIPLTYSSQFVRVDDLFV

SEQ ID NO: 709407 - protein, 19 aa, Mycobacterium
PLLEHPAALHASIREESFF

SEQ ID NO: 709408 - protein, 23 aa, Mycobacterium
PLLEPLRGVPFIGNTLADLVQPD

SEQ ID NO: 709409 - protein, 17 aa, Mycobacterium
PLLEPLRNLGLGALADQ

SEQ ID NO: 709410 - protein, 19 aa, Mycobacterium
PLLERARRAGRAVVLTSDH

SEQ ID NO: 709411 - protein, 17 aa, Mycobacterium
PLLERIRKGDIDPTIIV

SEQ ID NO: 709412 - protein, 22 aa, Mycobacterium
PLLFDHLFGMTVIMAGRTISRT

SEQ ID NO: 709413 - protein, 19 aa, Mycobacterium
PLLFPGSWSPSGIATPVEG

SEQ ID NO: 709414 - protein, 20 aa, Mycobacterium
PLLFSDGGGDIFAVDPMLAP

SEQ ID NO: 709415 - protein, 33 aa, Mycobacterium
PLLFVHGGWHGAWCWEHFQDFFADAGYRTVAVS

SEQ ID NO: 709416 - protein, 19 aa, Mycobacterium
PLLGCYGDPVLHVGPAGAG

SEQ ID NO: 709417 - protein, 23 aa, Mycobacterium
PLLGELHRATGLVVHLAVLDGAD

SEQ ID NO: 709418 - protein, 23 aa, Mycobacterium
PLLGELHRATGLVVHLAVLDGPD

SEQ ID NO: 709419 - protein, 17 aa, Mycobacterium
PLLGFLFNGRRYSTPVA

SEQ ID NO: 709420 - protein, 17 aa, Mycobacterium
PLLGIPIAVKDDVDVAG

SEQ ID NO: 709421 - protein, 17 aa, Mycobacterium
PLLGLPMAHPGAVDVVY

SEQ ID NO: 709422 - protein, 19 aa, Mycobacterium
PLLGPGETVGESWDAEIVP

SEQ ID NO: 709423 - protein, 18 aa, Mycobacterium
PLLGTWQSVVLIDLNRDN

SEQ ID NO: 709424 - protein, 23 aa, Mycobacterium
PLLIAEAGGDPWAIDQSLQAGRP

SEQ ID NO: 709425 - protein, 25 aa, Mycobacterium
PLLIDWRAPAAQAFYIATSAHPENT

SEQ ID NO: 709426 - protein, 19 aa, Mycobacterium
PLLIVPRHEVRVMRKERKG

SEQ ID NO: 709427 - protein, 22 aa, Mycobacterium
PLLKDRGGGRIINFYSIDADDG

SEQ ID NO: 709428 - protein, 19 aa, Mycobacterium
PLLLARAADILGIGLRALA

SEQ ID NO: 709429 - protein, 24 aa, Mycobacterium
PLLLDWRAPAARAFYTATGANPEG

SEQ ID NO: 709430 - protein, 26 aa, Mycobacterium
PLLLDWRAPMARPFYVATAANPENMR

SEQ ID NO: 709431 - protein, 21 aa, Mycobacterium
PLLLEMPMAYTARALEDSTCL

SEQ ID NO: 709432 - protein, 18 aa, Mycobacterium
PLLLLPLLRCMAPVPVLL

SEQ ID NO: 709433 - protein, 19 aa, Mycobacterium
PLLLLTWKLAAGLAAGCTF

SEQ ID NO: 709434 - protein, 17 aa, Mycobacterium
PLLLPRLAANLFEIEPR

SEQ ID NO: 709435 - protein, 18 aa, Mycobacterium
PLLLPVPNGLDFKHAALT

SEQ ID NO: 709436 - protein, 17 aa, Mycobacterium
PLLLPVPNGLDFRHAAL

SEQ ID NO: 709437 - protein, 18 aa, Mycobacterium
PLLNRITAGVGVRALNGT

SEQ ID NO: 709438 - protein, 17 aa, Mycobacterium
PLLPSVPTWVRELTHEP

SEQ ID NO: 709439 - protein, 19 aa, Mycobacterium
PLLQARGAFRTEYAGATLR

SEQ ID NO: 709440 - protein, 21 aa, Mycobacterium
PLLQFREMLQDLGLLRKYKGQ

SEQ ID NO: 709441 - protein, 21 aa, Mycobacterium
PLLQMSWKVAPALAAGCTMVA

SEQ ID NO: 709442 - protein, 24 aa, Mycobacterium
PLLQREIGEIAAAAYAGEATVLAA

SEQ ID NO: 709443 - protein, 25 aa, Mycobacterium
PLLREGFGVAGLDPAAARVRVRSLV

SEQ ID NO: 709444 - protein, 27 aa, Mycobacterium
PLLRELSSWEGLQRWCDHLVTMVRETQ

SEQ ID NO: 709445 - protein, 18 aa, Mycobacterium
PLLRIWDKHHRPIADLAG

SEQ ID NO: 709446 - protein, 19 aa, Mycobacterium
PLLRQFPVLVPTGVDFMKN

SEQ ID NO: 709447 - protein, 18 aa, Mycobacterium
PLLRVSGVRLLHWHSAPS

SEQ ID NO: 709448 - protein, 18 aa, Mycobacterium
PLLSARAQLFLAEGAIPG

SEQ ID NO: 709449 - protein, 18 aa, Mycobacterium
PLLSELDVRAVLPTIRVP

SEQ ID NO: 709450 - protein, 27 aa, Mycobacterium
PLLTALRCADVPFAAVPIAEPVRTNIA

SEQ ID NO: 709451 - protein, 24 aa, Mycobacterium
PLLTPRLSAPWVDLLTPLPRQLAI

SEQ ID NO: 709452 - protein, 18 aa, Mycobacterium
PLLVACDLQRPGAVNQLQ

SEQ ID NO: 709453 - protein, 19 aa, Mycobacterium
PLLVADLAYVRGMVHRQLG

SEQ ID NO: 709454 - protein, 20 aa, Mycobacterium
PLLVESKMAPLFPLVVIVHA

SEQ ID NO: 709455 - protein, 21 aa, Mycobacterium
PLLVPVLRAGLGMVDQAHELI

SEQ ID NO: 709456 - protein, 25 aa, Mycobacterium
PLMADAGVPWVLMHWRSVAADRPHA

SEQ ID NO: 709457 - protein, 23 aa, Mycobacterium
PLMCAAHYGRIVLTSSIGGLYGN

SEQ ID NO: 709458 - protein, 18 aa, Mycobacterium
PLMEAIVLSGRIVDIRPV

SEQ ID NO: 709459 - protein, 18 aa, Mycobacterium
PLMGADGYFALINQTEHV

SEQ ID NO: 709460 - protein, 22 aa, Mycobacterium
PLMHAAGMWTAFAALLNGQTVI

SEQ ID NO: 709461 - protein, 27 aa, Mycobacterium
PLMLETWKVAPALAWGNTVVLKPAEDT

SEQ ID NO: 709462 - protein, 19 aa, Mycobacterium
PLMLGGSWAHALAPELTLR

SEQ ID NO: 709463 - protein, 19 aa, Mycobacterium
PLMLRLAGRKNWYAAAIEH

SEQ ID NO: 709464 - protein, 20 aa, Mycobacterium
PLMNRRRALTALAVGMGAGV

SEQ ID NO: 709465 - protein, 19 aa, Mycobacterium
PLMPCGRCRQLLLEHGGPE

SEQ ID NO: 709466 - protein, 29 aa, Mycobacterium
PLMPPQMLHMILPRKDYEIVEDSWNVVGL

SEQ ID NO: 709467 - protein, 17 aa, Mycobacterium
PLMPQLIRSWLGRRSQT

SEQ ID NO: 709468 - protein, 17 aa, Mycobacterium
PLMSDAMLRVFFEAYEI

SEQ ID NO: 709469 - protein, 24 aa, Mycobacterium
PLMSNEIFGPILPVLTVNSLDEAI

SEQ ID NO: 709470 - protein, 23 aa, Mycobacterium
PLMYQRIADLPGFSSANLSHLRH

SEQ ID NO: 709471 - protein, 19 aa, Mycobacterium
PLNGCMYVLPAHHDPRFVE

SEQ ID NO: 709472 - protein, 19 aa, Mycobacterium
PLNGSIRFGIIPTVAPYVL

SEQ ID NO: 709473 - protein, 24 aa, Mycobacterium
PLNIPVVIHLPFQGLLVPPHPITA

SEQ ID NO: 709474 - protein, 25 aa, Mycobacterium
PLNLLSDLNAFLGIQTIHGQYPDLD

SEQ ID NO: 709475 - protein, 22 aa, Mycobacterium
PLNLQRWLLPRSIKETFNAPTE

SEQ ID NO: 709476 - protein, 18 aa, Mycobacterium
PLNLVVGLVEELRRRNPD

SEQ ID NO: 709477 - protein, 18 aa, Mycobacterium
PLNLVVLPAVAAFAAGNR

SEQ ID NO: 709478 - protein, 26 aa, Mycobacterium
PLNMNPHWLGAHPSYTLSKYGMTLLS

SEQ ID NO: 709479 - protein, 33 aa, Mycobacterium
PLNPEAVWWGKRVLGLPIHDNWWQTETGGIMIA

SEQ ID NO: 709480 - protein, 17 aa, Mycobacterium
PLNSQLRRLPLVIVANG

SEQ ID NO: 709481 - protein, 18 aa, Mycobacterium
PLNVALCPEDHAWSYVFL

SEQ ID NO: 709482 - protein, 18 aa, Mycobacterium
PLNYAKAALLAATEDDPV

SEQ ID NO: 709483 - protein, 23 aa, Mycobacterium
PLPAELRGRYDLVSEDRALRDIH

SEQ ID NO: 709484 - protein, 18 aa, Mycobacterium
PLPAERWREYCLSSVTTH

SEQ ID NO: 709485 - protein, 19 aa, Mycobacterium
PLPAMPVAHGLGLGFDPPV

SEQ ID NO: 709486 - protein, 22 aa, Mycobacterium
PLPAPARWAMRIPGGKALQRLL

SEQ ID NO: 709487 - protein, 18 aa, Mycobacterium
PLPAPGIGSGGYRLTALF

SEQ ID NO: 709488 - protein, 17 aa, Mycobacterium
PLPAPVIDVIYDGPDLA

SEQ ID NO: 709489 - protein, 24 aa, Mycobacterium
PLPASGRTAERWQRLAQLAEEDIA

SEQ ID NO: 709490 - protein, 26 aa, Mycobacterium
PLPASGRTAERWQRLASLAEENIVAA

SEQ ID NO: 709491 - protein, 17 aa, Mycobacterium
PLPATRTAGQAGVPVLR

SEQ ID NO: 709492 - protein, 31 aa, Mycobacterium
PLPAVMTAYRIGFRFIWEQTLAAARASGMPT

SEQ ID NO: 709493 - protein, 27 aa, Mycobacterium
PLPCTPRGIVHLLRRFEVEIAGAHVAV

SEQ ID NO: 709494 - protein, 26 aa, Mycobacterium
PLPCTPRGIVHLLRRYDVEIAGAHVV

SEQ ID NO: 709495 - protein, 26 aa, Mycobacterium
PLPCTPRGIVHLLRRYDVPIAGAHVV

SEQ ID NO: 709496 - protein, 22 aa, Mycobacterium
PLPCTPRGIVYLLRRYDVKLDG

SEQ ID NO: 709497 - protein, 18 aa, Mycobacterium
PLPDGFGATFVEYRDWLE

SEQ ID NO: 709498 - protein, 24 aa, Mycobacterium
PLPDPRLDKLAELFGSERIVPAPV

SEQ ID NO: 709499 - protein, 21 aa, Mycobacterium
PLPDYLRRYPVFYAGPAKTPS

SEQ ID NO: 709500 - protein, 24 aa, Mycobacterium
PLPEAPATCDLAALPARDKLAQLL

SEQ ID NO: 709501 - protein, 22 aa, Mycobacterium
PLPETIGGLAVELSDPSGMPVR

SEQ ID NO: 709502 - protein, 26 aa, Mycobacterium
PLPFPPEPLASIGIQATRWSLDRADH

SEQ ID NO: 709503 - protein, 23 aa, Mycobacterium
PLPGDDFIAPAWWGELYRGRPVV

SEQ ID NO: 709504 - protein, 26 aa, Mycobacterium
PLPGERESAGVLGWLHSVARSHVEVA

SEQ ID NO: 709505 - protein, 19 aa, Mycobacterium
PLPGEVADKFHATFDALLY

SEQ ID NO: 709506 - protein, 26 aa, Mycobacterium
PLPGGLPIELGMSIRLARDKNYDLLL

SEQ ID NO: 709507 - protein, 26 aa, Mycobacterium
PLPGGYPIELGMTIRLARDKNYDLLL

SEQ ID NO: 709508 - protein, 18 aa, Mycobacterium
PLPGKAERGVDYHAGLLQ

SEQ ID NO: 709509 - protein, 18 aa, Mycobacterium
PLPGMPFGQLAGNGGNGV

SEQ ID NO: 709510 - protein, 21 aa, Mycobacterium
PLPGPRLPHDMAFTENYAILN

SEQ ID NO: 709511 - protein, 18 aa, Mycobacterium
PLPGRSALELEDEVRASL

SEQ ID NO: 709512 - protein, 21 aa, Mycobacterium
PLPHARLVVSAWRHRTADLLS

SEQ ID NO: 709513 - protein, 22 aa, Mycobacterium
PLPHQFRAGIHTDYGAFTVVSA

SEQ ID NO: 709514 - protein, 26 aa, Mycobacterium
PLPKKRRNMFAQLGIERVDYKDTSTL

SEQ ID NO: 709515 - protein, 17 aa, Mycobacterium
PLPKRRLNETLDRYPGA

SEQ ID NO: 709516 - protein, 17 aa, Mycobacterium
PLPKRRLNETLDRYPNA

SEQ ID NO: 709517 - protein, 17 aa, Mycobacterium
PLPKSGEVVIEVKAFGI

SEQ ID NO: 709518 - protein, 24 aa, Mycobacterium
PLPLPLKTSYAWAQARRDGDDPAA

SEQ ID NO: 709519 - protein, 25 aa, Mycobacterium
PLPLPLKTSYAWAQARRDRDDPELQ

SEQ ID NO: 709520 - protein, 24 aa, Mycobacterium
PLPLPVKTSYAWAEARHCGDDPEQ

SEQ ID NO: 709521 - protein, 20 aa, Mycobacterium
PLPLRMALGTGNLEIRTDAV

SEQ ID NO: 709522 - protein, 21 aa, Mycobacterium
PLPLSCGWPTARRRDAGEPAS

SEQ ID NO: 709523 - protein, 18 aa, Mycobacterium
PLPLSWGEYRPGTLTTGR

SEQ ID NO: 709524 - protein, 24 aa, Mycobacterium
PLPLTGRLVKFALFQTRDEQFYLF

SEQ ID NO: 709525 - protein, 31 aa, Mycobacterium
PLPPAFAAAIGIRPGQRKHFTSAHGQTAVTW

SEQ ID NO: 709526 - protein, 23 aa, Mycobacterium
PLPPEGASAIVFRDTAHAAELAA

SEQ ID NO: 709527 - protein, 22 aa, Mycobacterium
PLPPEGASAIVFRDTDHAAELA

SEQ ID NO: 709528 - protein, 26 aa, Mycobacterium
PLPPERRGSFGIPLPGVVQHRIVDTA

SEQ ID NO: 709529 - protein, 19 aa, Mycobacterium
PLPPKRAGLLIRAMYRIAK

SEQ ID NO: 709530 - protein, 19 aa, Mycobacterium
PLPPKRAGLLVGALYRIAK

SEQ ID NO: 709531 - protein, 23 aa, Mycobacterium
PLPPRWDGFCLLQVDLTDAVSIA

SEQ ID NO: 709532 - protein, 17 aa, Mycobacterium
PLPRAHALTAPLLLVHG

SEQ ID NO: 709533 - protein, 25 aa, Mycobacterium
PLPRKNIDTGMGIERVACLLQGVDN

SEQ ID NO: 709534 - protein, 21 aa, Mycobacterium
PLPSDPRWAGEIVYTDVRDAT

SEQ ID NO: 709535 - protein, 19 aa, Mycobacterium
PLPSKWYIQFGEPIDTTDY

SEQ ID NO: 709536 - protein, 31 aa, Mycobacterium
PLPSLGFFVLDGWLRPVPVGVVGELYVAGGG

SEQ ID NO: 709537 - protein, 17 aa, Mycobacterium
PLPSTWWNPGMAGSDTR

SEQ ID NO: 709538 - protein, 19 aa, Mycobacterium
PLPSWTRRSYLLDLSAQAQ

SEQ ID NO: 709539 - protein, 27 aa, Mycobacterium
PLPTGPRRTSWPLAFKPSTYLGLLKLG

SEQ ID NO: 709540 - protein, 18 aa, Mycobacterium
PLPTLLVCGSHTTGATTQ

SEQ ID NO: 709541 - protein, 22 aa, Mycobacterium
PLPTVWPGSAYPLGATYDGAGT

SEQ ID NO: 709542 - protein, 23 aa, Mycobacterium
PLPTWTHRRLWLSGGGQESPTHG

SEQ ID NO: 709543 - protein, 26 aa, Mycobacterium
PLPTYPFERERLWMSPPRSVLDKPVQ

SEQ ID NO: 709544 - protein, 18 aa, Mycobacterium
PLPVEMICHILGIDRSEY

SEQ ID NO: 709545 - protein, 18 aa, Mycobacterium
PLPVFCASLRTAEPELLE

SEQ ID NO: 709546 - protein, 21 aa, Mycobacterium
PLPVPWAVQAVDRIPKQRYYD

SEQ ID NO: 709547 - protein, 22 aa, Mycobacterium
PLQEVPEVWAAVTSVFRDYGYR

SEQ ID NO: 709548 - protein, 18 aa, Mycobacterium
PLQHGFRQLLNPFFHPKR

SEQ ID NO: 709549 - protein, 18 aa, Mycobacterium
PLQLCERLSDITGATVYL

SEQ ID NO: 709550 - protein, 23 aa, Mycobacterium
PLQMRGCGQIHALSSGYAAAGSF

SEQ ID NO: 709551 - protein, 24 aa, Mycobacterium
PLQNLFLALTFEWGIALHGVDLGR

SEQ ID NO: 709552 - protein, 17 aa, Mycobacterium
PLQRACLNAALERQEPW

SEQ ID NO: 709553 - protein, 34 aa, Mycobacterium
PLQRARHIGAALNVGVKDFGFFWVTAVTTDGTIV

SEQ ID NO: 709554 - protein, 18 aa, Mycobacterium
PLQRASESLALLITTGFL

SEQ ID NO: 709555 - protein, 25 aa, Mycobacterium
PLQRLKKNLGPWWDFLVTDVTLGTS

SEQ ID NO: 709556 - protein, 18 aa, Mycobacterium
PLQRVARFASRLRAGKVM

SEQ ID NO: 709557 - protein, 23 aa, Mycobacterium
PLQSLEQQLLAAINAPTQTLLGR

SEQ ID NO: 709558 - protein, 17 aa, Mycobacterium
PLQTAMTKILPALAAGA

SEQ ID NO: 709559 - protein, 25 aa, Mycobacterium
PLQTLEQDLLAGINAPSQMLTGRPL

SEQ ID NO: 709560 - protein, 25 aa, Mycobacterium
PLRAEAAFEYAARLGYDGVELMVWG

SEQ ID NO: 709561 - protein, 26 aa, Mycobacterium
PLRAEAAFEYAARLGYDGVELMVWSE

SEQ ID NO: 709562 - protein, 20 aa, Mycobacterium
PLRAESLAGLAPALIAVAGF

SEQ ID NO: 709563 - protein, 25 aa, Mycobacterium
PLRAPRWLPTPARRRARAAVAAMRA

SEQ ID NO: 709564 - protein, 22 aa, Mycobacterium
PLRARHFVRWLTIWNDTVDAMY

SEQ ID NO: 709565 - protein, 19 aa, Mycobacterium
PLRAVLLALAFEWGVALHG

SEQ ID NO: 709566 - protein, 26 aa, Mycobacterium
PLRAYRPPTRRWGSVLGIQPDGLEVF

SEQ ID NO: 709567 - protein, 19 aa, Mycobacterium
PLRDERIPPDVSMSAGYVP

SEQ ID NO: 709568 - protein, 17 aa, Mycobacterium
PLREAFRRAHAGAVGSG

SEQ ID NO: 709569 - protein, 18 aa, Mycobacterium
PLREAGFRAAPPSEAHSP

SEQ ID NO: 709570 - protein, 18 aa, Mycobacterium
PLREAWRDGAHAYLGMAV

SEQ ID NO: 709571 - protein, 29 aa, Mycobacterium
PLREIHDRMPLMLGADSWDSWLDPDRELD

SEQ ID NO: 709572 - protein, 25 aa, Mycobacterium
PLRGEFGAVVSLDLRRLDALHHLDE

SEQ ID NO: 709573 - protein, 20 aa, Mycobacterium
PLRHDHVLGIGGASVSLARA

SEQ ID NO: 709574 - protein, 17 aa, Mycobacterium
PLRHSPLGYGLLLNKPD

SEQ ID NO: 709575 - protein, 17 aa, Mycobacterium
PLRIGILGAARIAPMAL

SEQ ID NO: 709576 - protein, 19 aa, Mycobacterium
PLRIKLPAHVAANFEGLVV

SEQ ID NO: 709577 - protein, 27 aa, Mycobacterium
PLRINPWALVGHQSYWDSIFFKRDAPS

SEQ ID NO: 709578 - protein, 23 aa, Mycobacterium
PLRIQFWVCGVFEVHDGRITLWR

SEQ ID NO: 709579 - protein, 24 aa, Mycobacterium
PLRKSLAGYAAWVTGLRRVDAPTR

SEQ ID NO: 709580 - protein, 25 aa, Mycobacterium
PLRLFAGGIAKLWDPANIDFSRDSA

SEQ ID NO: 709581 - protein, 19 aa, Mycobacterium
PLRLRGMSAMLTRIKKRLT

SEQ ID NO: 709582 - protein, 27 aa, Mycobacterium
PLRMRPRADESFKDLLARVRRTTLDGM

SEQ ID NO: 709583 - protein, 18 aa, Mycobacterium
PLRNAIFTLPAVKGNRPQ

SEQ ID NO: 709584 - protein, 26 aa, Mycobacterium
PLRNILLAIMFEWGIALQGWESQQRS

SEQ ID NO: 709585 - protein, 24 aa, Mycobacterium
PLRNLLLAAVFEWGIGLHDYYSER

SEQ ID NO: 709586 - protein, 18 aa, Mycobacterium
PLRPASCRFIPTCSQYAV

SEQ ID NO: 709587 - protein, 23 aa, Mycobacterium
PLRPGEGPWRLGEGPWREGEGQW

SEQ ID NO: 709588 - protein, 17 aa, Mycobacterium
PLRPWRAALAEALATMG

SEQ ID NO: 709589 - protein, 20 aa, Mycobacterium
PLRQRVAGIIDMLYDGLTAS

SEQ ID NO: 709590 - protein, 21 aa, Mycobacterium
PLRRLPFGLSATRDHLTRLAG

SEQ ID NO: 709591 - protein, 19 aa, Mycobacterium
PLRRMLPALESMDLEVINE

SEQ ID NO: 709592 - protein, 27 aa, Mycobacterium
PLRRRRVRLGLFGLIPLKLHAWQVLYR

SEQ ID NO: 709593 - protein, 21 aa, Mycobacterium
PLRSETVSVWGLPEAATVQVG

SEQ ID NO: 709594 - protein, 20 aa, Mycobacterium
PLRVDCGIGDRFYFATRQFV

SEQ ID NO: 709595 - protein, 19 aa, Mycobacterium
PLRYGELTAALGVASGERA

SEQ ID NO: 709596 - protein, 30 aa, Mycobacterium
PLRYRLIDIPWRLHHPMWLQDCPVDLDYHL

SEQ ID NO: 709597 - protein, 26 aa, Mycobacterium
PLSAAQLRTWFAYQIEGPSEVNNIPF

SEQ ID NO: 709598 - protein, 19 aa, Mycobacterium
PLSAARIAEEFGVSKRTIE

SEQ ID NO: 709599 - protein, 18 aa, Mycobacterium
PLSAHREWIDSCYAAGTA

SEQ ID NO: 709600 - protein, 24 aa, Mycobacterium
PLSAKLELLAAVAATGVREVEATA

SEQ ID NO: 709601 - protein, 21 aa, Mycobacterium
PLSALLHVARTVARRAERSAW

SEQ ID NO: 709602 - protein, 24 aa, Mycobacterium
PLSALRPSQVKAWVAGLKKADVAP

SEQ ID NO: 709603 - protein, 25 aa, Mycobacterium
PLSASQLRSWFAYRVDGPSWVNNIP

SEQ ID NO: 709604 - protein, 23 aa, Mycobacterium
PLSCAIAAVSVGVVDGRVRVDLP

SEQ ID NO: 709605 - protein, 32 aa, Mycobacterium
PLSCAIGAPVLFGRASVVFARLVVPTVELLAL

SEQ ID NO: 709606 - protein, 27 aa, Mycobacterium
PLSCLNEARFGIVFGALGAARDSLQAA

SEQ ID NO: 709607 - protein, 26 aa, Mycobacterium
PLSCPADYQLLLALRAYADVVLVGAG

SEQ ID NO: 709608 - protein, 18 aa, Mycobacterium
PLSDARQAHEYGQTGHAR

SEQ ID NO: 709609 - protein, 20 aa, Mycobacterium
PLSDFCWPSLATPESQERQS

SEQ ID NO: 709610 - protein, 20 aa, Mycobacterium
PLSDLRRFGGARVSLADLDL

SEQ ID NO: 709611 - protein, 23 aa, Mycobacterium
PLSENRFKVELLKRVVEKQLTVV

SEQ ID NO: 709612 - protein, 18 aa, Mycobacterium
PLSPRRAGLLTRAMYRIA

SEQ ID NO: 709613 - protein, 18 aa, Mycobacterium
PLSQTWRDGAFAYLGMSV

SEQ ID NO: 709614 - protein, 19 aa, Mycobacterium
PLSREFRGLLDRVPPADPA

SEQ ID NO: 709615 - protein, 19 aa, Mycobacterium
PLSREFRGLLDRVPPADSD

SEQ ID NO: 709616 - protein, 19 aa, Mycobacterium
PLSREFRGLLDRVPPANPD

SEQ ID NO: 709617 - protein, 19 aa, Mycobacterium
PLSSAERRAIQGFLESGVD

SEQ ID NO: 709618 - protein, 18 aa, Mycobacterium
PLSSAERSAILSFLESGV

SEQ ID NO: 709619 - protein, 19 aa, Mycobacterium
PLSSMPSHRVLAVLRGEKE

SEQ ID NO: 709620 - protein, 25 aa, Mycobacterium
PLSSVARLSGWLAVRDGLVWLERGC

SEQ ID NO: 709621 - protein, 17 aa, Mycobacterium
PLSTVYYWMFGGWLRKR

SEQ ID NO: 709622 - protein, 25 aa, Mycobacterium
PLSVPPSWAPPAPVASPLPSALGGT

SEQ ID NO: 709623 - protein, 18 aa, Mycobacterium
PLSVTMEMAIYVSNPNLL

SEQ ID NO: 709624 - protein, 17 aa, Mycobacterium
PLSVVSIYGGRAYEPQI

SEQ ID NO: 709625 - protein, 18 aa, Mycobacterium
PLTAAALPPDHIGGLTYT

SEQ ID NO: 709626 - protein, 22 aa, Mycobacterium
PLTADMGLGMFLVRFAGHCRRS

SEQ ID NO: 709627 - protein, 18 aa, Mycobacterium
PLTAHFIGGCPIGDSPET

SEQ ID NO: 709628 - protein, 17 aa, Mycobacterium
PLTAHFLGGAVIGDNAD

SEQ ID NO: 709629 - protein, 18 aa, Mycobacterium
PLTALAIARTMRELDPTH

SEQ ID NO: 709630 - protein, 18 aa, Mycobacterium
PLTALERLAGPDIRAVAV

SEQ ID NO: 709631 - protein, 24 aa, Mycobacterium
PLTANAYLGAWGIVECLTARADIV

SEQ ID NO: 709632 - protein, 21 aa, Mycobacterium
PLTAVAKKLDWVRGLAVDAGR

SEQ ID NO: 709633 - protein, 20 aa, Mycobacterium
PLTAWAVRALTRLPQRGVAM

SEQ ID NO: 709634 - protein, 18 aa, Mycobacterium
PLTDAVHRVCYKGLSVDD

SEQ ID NO: 709635 - protein, 17 aa, Mycobacterium
PLTELAGRWSVERGLVL

SEQ ID NO: 709636 - protein, 18 aa, Mycobacterium
PLTESAAWNHDWSTTSVV

SEQ ID NO: 709637 - protein, 21 aa, Mycobacterium
PLTEVVCCGPAGPEVELAIVS

SEQ ID NO: 709638 - protein, 26 aa, Mycobacterium
PLTFLQRPALWFDVMDRVRATHTAAP

SEQ ID NO: 709639 - protein, 25 aa, Mycobacterium
PLTGEKSLPLAISVSQGVQILHNAI

SEQ ID NO: 709640 - protein, 19 aa, Mycobacterium
PLTGIPCSVEILTAICVAT

SEQ ID NO: 709641 - protein, 19 aa, Mycobacterium
PLTGPRDSPEFVTAYLDNA

SEQ ID NO: 709642 - protein, 19 aa, Mycobacterium
PLTHDLWPAPELVMDSGNS

SEQ ID NO: 709643 - protein, 26 aa, Mycobacterium
PLTHFTQIFVLPTFVRGGTNVMLPGL

SEQ ID NO: 709644 - protein, 25 aa, Mycobacterium
PLTHLAFFVLDGWMRQVPAGVVGEL

SEQ ID NO: 709645 - protein, 30 aa, Mycobacterium
PLTKVFRGNLSIVRTETWRRDGAGVVSGAV

SEQ ID NO: 709646 - protein, 27 aa, Mycobacterium
PLTLKPEVCWQLPIRRTQEWITRPDDT

SEQ ID NO: 709647 - protein, 18 aa, Mycobacterium
PLTMTKLKFFKFIMDEIF

SEQ ID NO: 709648 - protein, 23 aa, Mycobacterium
PLTNAGLAGGFGTGGTGGTGGTG

SEQ ID NO: 709649 - protein, 24 aa, Mycobacterium
PLTNALKGYSAWVTGIRRVEAPTR

SEQ ID NO: 709650 - protein, 26 aa, Mycobacterium
PLTNLSLQCKLPISPSQAMGMMQQAQ

SEQ ID NO: 709651 - protein, 19 aa, Mycobacterium
PLTPDHWLYDMFVHTRGLA

SEQ ID NO: 709652 - protein, 20 aa, Mycobacterium
PLTPPDMIARIVAELRTGRG

SEQ ID NO: 709653 - protein, 24 aa, Mycobacterium
PLTPRFTGTLTIRYLRATPLGDLR

SEQ ID NO: 709654 - protein, 25 aa, Mycobacterium
PLTRAADHSKLWFAIAAGLLATKRP

SEQ ID NO: 709655 - protein, 28 aa, Mycobacterium
PLTRAADHSKLWFAMAAGLLASRSQSAQ

SEQ ID NO: 709656 - protein, 19 aa, Mycobacterium
PLTRGPWGAAMGGQNVGGL

SEQ ID NO: 709657 - protein, 23 aa, Mycobacterium
PLTSGVWRGDWGQPQGRSAISDI

SEQ ID NO: 709658 - protein, 17 aa, Mycobacterium
PLTSLIRPIPYVGTPLA

SEQ ID NO: 709659 - protein, 17 aa, Mycobacterium
PLTSQLVAIGFTRLAHR

SEQ ID NO: 709660 - protein, 20 aa, Mycobacterium
PLTVRLGERPTLMFDNPTMM

SEQ ID NO: 709661 - protein, 24 aa, Mycobacterium
PLTVYYHGGGWLLGSVDSHDAATR

SEQ ID NO: 709662 - protein, 19 aa, Mycobacterium
PLVAAALYYAVMARGGYTS

SEQ ID NO: 709663 - protein, 29 aa, Mycobacterium
PLVAEAGVPWVLMHWRPVSDDNPHQVPNY

SEQ ID NO: 709664 - protein, 29 aa, Mycobacterium
PLVAEAGVVWVLMHWRPVSAANPHQVPQY

SEQ ID NO: 709665 - protein, 17 aa, Mycobacterium
PLVDNLRHDDPFLVCAD

SEQ ID NO: 709666 - protein, 20 aa, Mycobacterium
PLVDSAVSLGDWPVAVPREI

SEQ ID NO: 709667 - protein, 19 aa, Mycobacterium
PLVDYLGDMAWYLDLITQK

SEQ ID NO: 709668 - protein, 17 aa, Mycobacterium
PLVEVLKTGARTGGDVG

SEQ ID NO: 709669 - protein, 19 aa, Mycobacterium
PLVGGLPLDAGWASLQLLT

SEQ ID NO: 709670 - protein, 26 aa, Mycobacterium
PLVHACAEAGTPLLGVCLGHQAIGVA

SEQ ID NO: 709671 - protein, 18 aa, Mycobacterium
PLVHCRIGQALYPTPPFA

SEQ ID NO: 709672 - protein, 20 aa, Mycobacterium
PLVHPVLGLIGFVPRPVAAA

SEQ ID NO: 709673 - protein, 32 aa, Mycobacterium
PLVILLHGFGSFWWSWRHQLRGLTSARVVAVD

SEQ ID NO: 709674 - protein, 31 aa, Mycobacterium
PLVILLHGFGSFWWSWRHQLTGLRDARVVAV

SEQ ID NO: 709675 - protein, 31 aa, Mycobacterium
PLVILLHGFGSFWWSWRHQLTGLSGARLVAV

SEQ ID NO: 709676 - protein, 18 aa, Mycobacterium
PLVILLHGFPESWYSWRH

SEQ ID NO: 709677 - protein, 33 aa, Mycobacterium
PLVLLLHGFGSFWWSWRHQLGALPGARVVAVDL

SEQ ID NO: 709678 - protein, 17 aa, Mycobacterium
PLVMLVGPPPMRCPAMP

SEQ ID NO: 709679 - protein, 19 aa, Mycobacterium
PLVNLKVTLLDGAFHEVDS

SEQ ID NO: 709680 - protein, 18 aa, Mycobacterium
PLVPCRFGDIPVATQDSI

SEQ ID NO: 709681 - protein, 20 aa, Mycobacterium
PLVPRPAATVMLVRDAEPDS

SEQ ID NO: 709682 - protein, 24 aa, Mycobacterium
PLVRAAVGFTNLWTYPGEPDTFCD

SEQ ID NO: 709683 - protein, 26 aa, Mycobacterium
PLVRAVGIDFFVRWASGELRSEDVDL

SEQ ID NO: 709684 - protein, 18 aa, Mycobacterium
PLVRCPQCKSLETEMTSE

SEQ ID NO: 709685 - protein, 18 aa, Mycobacterium
PLVRDALARGDLRADSDT

SEQ ID NO: 709686 - protein, 25 aa, Mycobacterium
PLVREMAAAIGRDMAALGVHQGLSP

SEQ ID NO: 709687 - protein, 17 aa, Mycobacterium
PLVRIQLQRVRIEGMAP

SEQ ID NO: 709688 - protein, 18 aa, Mycobacterium
PLVRIQLQRVRIEGMAPF

SEQ ID NO: 709689 - protein, 18 aa, Mycobacterium
PLVRLAGIYVSRATAEDA

SEQ ID NO: 709690 - protein, 25 aa, Mycobacterium
PLVRLREIVEGLPLHEQELVSRGLQ

SEQ ID NO: 709691 - protein, 19 aa, Mycobacterium
PLVRRGEPLATPGLDAARD

SEQ ID NO: 709692 - protein, 18 aa, Mycobacterium
PLVRSAMTALDWTQWRVT

SEQ ID NO: 709693 - protein, 24 aa, Mycobacterium
PLVSARGRLFARMGGATTSILLPT

SEQ ID NO: 709694 - protein, 30 aa, Mycobacterium
PLVSSFSMPGGIYAPMIHPWSSGRDLYFNL

SEQ ID NO: 709695 - protein, 29 aa, Mycobacterium
PLVVDGVMYVTGWDGWFWALDAKTGQQLW

SEQ ID NO: 709696 - protein, 20 aa, Mycobacterium
PLVVLIHGGAWQSKLGADVF

SEQ ID NO: 709697 - protein, 25 aa, Mycobacterium
PLWALWRFGTDPGFTRISMEFMALA

SEQ ID NO: 709698 - protein, 19 aa, Mycobacterium
PLWDRLDELKARFGDAKGE

SEQ ID NO: 709699 - protein, 18 aa, Mycobacterium
PLWELHVIEGLEGKQFAI

SEQ ID NO: 709700 - protein, 19 aa, Mycobacterium
PLWEMWVIEGLRGGDALSV

SEQ ID NO: 709701 - protein, 21 aa, Mycobacterium
PLWHLPGMQLGVVTWPPAPGA

SEQ ID NO: 709702 - protein, 29 aa, Mycobacterium
PLWHTRGRILEGCAWFDAIPIDDASEHQV

SEQ ID NO: 709703 - protein, 20 aa, Mycobacterium
PLWHYNFLRRPPIPPDSDLI

SEQ ID NO: 709704 - protein, 17 aa, Mycobacterium
PLWNAYSFLALYAPKVG

SEQ ID NO: 709705 - protein, 19 aa, Mycobacterium
PLWNESWYFDFVDTAAGFG

SEQ ID NO: 709706 - protein, 25 aa, Mycobacterium
PLWQRMGAEIAMAIADVIRGGELRR

SEQ ID NO: 709707 - protein, 20 aa, Mycobacterium
PLWTACTSLAGGTPVHYLCD

SEQ ID NO: 709708 - protein, 25 aa, Mycobacterium
PLWYAWPNHMKLFFNNKGVVAKATD

SEQ ID NO: 709709 - protein, 18 aa, Mycobacterium
PLYEIGARLTRLITSTRD

SEQ ID NO: 709710 - protein, 25 aa, Mycobacterium
PLYGDCAFLEKWPGVPVGNEEGEII

SEQ ID NO: 709711 - protein, 17 aa, Mycobacterium
PLYIGGGPANFTRIADL

SEQ ID NO: 709712 - protein, 23 aa, Mycobacterium
PLYLEEALRLGVRQASIISINWA

SEQ ID NO: 709713 - protein, 24 aa, Mycobacterium
PLYLGCGPAGFKRIARLNAGWLSM

SEQ ID NO: 709714 - protein, 23 aa, Mycobacterium
PLYMAGAKLDSLVPLGPPVMDVA

SEQ ID NO: 709715 - protein, 20 aa, Mycobacterium
PLYQRWAKLWEGLLLACQPG

SEQ ID NO: 709716 - protein, 17 aa, Mycobacterium
PLYRPSRGLPPVGSGLA

SEQ ID NO: 709717 - protein, 25 aa, Mycobacterium
PLYRTLRAGEFIKIVQSGCNAAGES

SEQ ID NO: 709718 - protein, 23 aa, Mycobacterium
PLYTPEELYPLTGVKSLTLNASV

SEQ ID NO: 709719 - protein, 25 aa, Mycobacterium
PLYYLEMPPALFAPIVENLAAADLV

SEQ ID NO: 709720 - protein, 25 aa, Mycobacterium
PLYYLEMPPALFAPIVENLAKADLL

SEQ ID NO: 709721 - protein, 21 aa, Mycobacterium
PLYYNERHNFWGISRYADVDA

SEQ ID NO: 709722 - protein, 23 aa, Mycobacterium
PMADIWWRFREAITSAPALDIGA

SEQ ID NO: 709723 - protein, 23 aa, Mycobacterium
PMADRGRGGIVIFGSGAGLAGAP

SEQ ID NO: 709724 - protein, 17 aa, Mycobacterium
PMADTVLRYELMGRLLP

SEQ ID NO: 709725 - protein, 26 aa, Mycobacterium
PMADWLEAFVPLRIHVLVRFGRWDDL

SEQ ID NO: 709726 - protein, 22 aa, Mycobacterium
PMAELLAGHGLEAIARADDDRR

SEQ ID NO: 709727 - protein, 21 aa, Mycobacterium
PMAFDEFSIVLIIQEEAQRVP

SEQ ID NO: 709728 - protein, 22 aa, Mycobacterium
PMAGGDLRGGRFARLSDVGELL

SEQ ID NO: 709729 - protein, 28 aa, Mycobacterium
PMAGTGWLHGWRLTFGGADIAWEGALAT

SEQ ID NO: 709730 - protein, 22 aa, Mycobacterium
PMAKDVDRMLCQIVAEHGGLDP

SEQ ID NO: 709731 - protein, 23 aa, Mycobacterium
PMALRLRTAVAILSYGDDLVFGI

SEQ ID NO: 709732 - protein, 24 aa, Mycobacterium
PMAMRPFLGYHVGDYFQHWLNIGT

SEQ ID NO: 709733 - protein, 18 aa, Mycobacterium
PMAPGLACAPFVAVSNST

SEQ ID NO: 709734 - protein, 20 aa, Mycobacterium
PMAPGLACRPFVAVSNSSET

SEQ ID NO: 709735 - protein, 17 aa, Mycobacterium
PMAPNFDDSLAFLAAQD

SEQ ID NO: 709736 - protein, 26 aa, Mycobacterium
PMAREPRCPFAPPPDVMALAESRPLS

SEQ ID NO: 709737 - protein, 26 aa, Mycobacterium
PMATSEGWSGLPIIANYADWQEERAR

SEQ ID NO: 709738 - protein, 18 aa, Mycobacterium
PMAVCANGAVIYDPSTDR

SEQ ID NO: 709739 - protein, 28 aa, Mycobacterium
PMCGVLAGRARFTPQLTLAYRDAVAVAD

SEQ ID NO: 709740 - protein, 17 aa, Mycobacterium
PMCPHCRSLDWDTVESS

SEQ ID NO: 709741 - protein, 17 aa, Mycobacterium
PMCPHCRSLEWDTIEAS

SEQ ID NO: 709742 - protein, 27 aa, Mycobacterium
PMCRKAVMKSQPWILAYEDHNVDTGLG

SEQ ID NO: 709743 - protein, 19 aa, Mycobacterium
PMDSAWRGALPPENGFVHL

SEQ ID NO: 709744 - protein, 19 aa, Mycobacterium
PMDVMRRLYDWAGDPLTPD

SEQ ID NO: 709745 - protein, 24 aa, Mycobacterium
PMEAARIGVTGWQITRTGGRVLSS

SEQ ID NO: 709746 - protein, 22 aa, Mycobacterium
PMEEIDLLLFRALSACNRLVCL

SEQ ID NO: 709747 - protein, 22 aa, Mycobacterium
PMEELIAAFLPVLFPGLEVVEH

SEQ ID NO: 709748 - protein, 19 aa, Mycobacterium
PMEHKAYLHRSGRTARAGS

SEQ ID NO: 709749 - protein, 23 aa, Mycobacterium
PMEIADAVAFLVSEHATFITGSE

SEQ ID NO: 709750 - protein, 23 aa, Mycobacterium
PMERAAACPFAPPPQMLDMNKAK

SEQ ID NO: 709751 - protein, 22 aa, Mycobacterium
PMERSAGCPFAPPRQMLDMNAV

SEQ ID NO: 709752 - protein, 20 aa, Mycobacterium
PMEVPAGALIFGRRSIAGSL

SEQ ID NO: 709753 - protein, 20 aa, Mycobacterium
PMFETMAAFMLVEHANGAMF

SEQ ID NO: 709754 - protein, 24 aa, Mycobacterium
PMFHCNGWGWPYAATGMGARHIVL

SEQ ID NO: 709755 - protein, 20 aa, Mycobacterium
PMFIRMAWHAAGTYRVGDGR

SEQ ID NO: 709756 - protein, 20 aa, Mycobacterium
PMFKGYTCIKGRALPEIHNN

SEQ ID NO: 709757 - protein, 19 aa, Mycobacterium
PMFKLRRYFPPDARPGAQI

SEQ ID NO: 709758 - protein, 24 aa, Mycobacterium
PMFLFRGGAPIKEFARNFKPPLSW

SEQ ID NO: 709759 - protein, 19 aa, Mycobacterium
PMFVPKLLGPLLIAEGVHL

SEQ ID NO: 709760 - protein, 19 aa, Mycobacterium
PMFVPWLVGPLLTGEGIHL

SEQ ID NO: 709761 - protein, 24 aa, Mycobacterium
PMGAREFQRFLLAKQREITAVVDE

SEQ ID NO: 709762 - protein, 25 aa, Mycobacterium
PMGGPGRGFGGFGFGFDPGAGFGFG

SEQ ID NO: 709763 - protein, 20 aa, Mycobacterium
PMGIPPNFAAPAANFMADHV

SEQ ID NO: 709764 - protein, 19 aa, Mycobacterium
PMGLIGVIGPWNYPLTNSF

SEQ ID NO: 709765 - protein, 17 aa, Mycobacterium
PMGLPELTSTKWIVWGD

SEQ ID NO: 709766 - protein, 17 aa, Mycobacterium
PMGLPELTSTKWIVWGE

SEQ ID NO: 709767 - protein, 19 aa, Mycobacterium
PMGMMPMPMGMGGAGAGMP

SEQ ID NO: 709768 - protein, 21 aa, Mycobacterium
PMGQRWRGIQDIDPRVLTRDR

SEQ ID NO: 709769 - protein, 22 aa, Mycobacterium
PMGRVAAELADLVVVTDDNPRG

SEQ ID NO: 709770 - protein, 19 aa, Mycobacterium
PMGSRGAGEIGIVGSAAAV

SEQ ID NO: 709771 - protein, 18 aa, Mycobacterium
PMGSRGAGEIGIVGSASA

SEQ ID NO: 709772 - protein, 29 aa, Mycobacterium
PMGTEALALLRLPLLLPTLRLLGRVGGPL

SEQ ID NO: 709773 - protein, 25 aa, Mycobacterium
PMGTVADIYRHFGLTLTDEARAAMA

SEQ ID NO: 709774 - protein, 19 aa, Mycobacterium
PMGVFEFPGYAAGTRGVAE

SEQ ID NO: 709775 - protein, 17 aa, Mycobacterium
PMHEKIVGRIAVSDLAR

SEQ ID NO: 709776 - protein, 19 aa, Mycobacterium
PMHLHRHTFEITHVAGTPT

SEQ ID NO: 709777 - protein, 21 aa, Mycobacterium
PMHRCRALGAAVGGYLATLDK

SEQ ID NO: 709778 - protein, 17 aa, Mycobacterium
PMHVGGLQLFEPPPGAG

SEQ ID NO: 709779 - protein, 21 aa, Mycobacterium
PMIAELCRELGLPLIVDAAQA

SEQ ID NO: 709780 - protein, 18 aa, Mycobacterium
PMIAEYDLPTVDLLPSNT

SEQ ID NO: 709781 - protein, 21 aa, Mycobacterium
PMIASNRVRPIIGSRLPIGQA

SEQ ID NO: 709782 - protein, 19 aa, Mycobacterium
PMIGGLGYVLAPGAAAYML

SEQ ID NO: 709783 - protein, 19 aa, Mycobacterium
PMIGLLAAAAFDFLDETCW

SEQ ID NO: 709784 - protein, 20 aa, Mycobacterium
PMIPVYIFYSMFGFQRTGDG

SEQ ID NO: 709785 - protein, 25 aa, Mycobacterium
PMIRKGAMKNSTWIKAYEDANVDIG

SEQ ID NO: 709786 - protein, 25 aa, Mycobacterium
PMIRKGAMKNTAWIKAYEDANVDTG

SEQ ID NO: 709787 - protein, 24 aa, Mycobacterium
PMIRKGAMKNTTWIKAYEDANVDI

SEQ ID NO: 709788 - protein, 17 aa, Mycobacterium
PMIVWGAHRIWPKDHPR

SEQ ID NO: 709789 - protein, 18 aa, Mycobacterium
PMKAIPAFFEPEPRIKVM

SEQ ID NO: 709790 - protein, 29 aa, Mycobacterium
PMKKTPRRLCLRITLGSGRNKVTATFFNA

SEQ ID NO: 709791 - protein, 20 aa, Mycobacterium
PMLAAAAAWDGLASDLDSAA

SEQ ID NO: 709792 - protein, 21 aa, Mycobacterium
PMLAAAAAWEALAAQLHAAAA

SEQ ID NO: 709793 - protein, 17 aa, Mycobacterium
PMLAAAAAWQELAAELQ

SEQ ID NO: 709794 - protein, 17 aa, Mycobacterium
PMLAGAFAVAWEWDNTE

SEQ ID NO: 709795 - protein, 23 aa, Mycobacterium
PMLAQRLGAWVPLDEVPDVWEGV

SEQ ID NO: 709796 - protein, 23 aa, Mycobacterium
PMLAQRLGAWVPLEEVPEVWHAV

SEQ ID NO: 709797 - protein, 22 aa, Mycobacterium
PMLAQRLGVWVPLNEVPDVWEA

SEQ ID NO: 709798 - protein, 21 aa, Mycobacterium
PMLAQRVGAWVPLDEVPEVWE

SEQ ID NO: 709799 - protein, 21 aa, Mycobacterium
PMLDAATAWDSMASELGVAAS

SEQ ID NO: 709800 - protein, 27 aa, Mycobacterium
PMLDLAQRLGVDWSMIYAGRHPDSLPF

SEQ ID NO: 709801 - protein, 18 aa, Mycobacterium
PMLELVPDDAIWRPQARW

SEQ ID NO: 709802 - protein, 23 aa, Mycobacterium
PMLFDMLKLPGMDVDLSKLLHGE

SEQ ID NO: 709803 - protein, 21 aa, Mycobacterium
PMLGQRVGAWVPLDEVPDVWE

SEQ ID NO: 709804 - protein, 18 aa, Mycobacterium
PMLGVPFSGFGLHHDPNV

SEQ ID NO: 709805 - protein, 23 aa, Mycobacterium
PMLHELHRATGLVVHLSILDGAD

SEQ ID NO: 709806 - protein, 19 aa, Mycobacterium
PMLLGKLRVPAGVVSVRPI

SEQ ID NO: 709807 - protein, 17 aa, Mycobacterium
PMLLPRIVASAFSAEPR

SEQ ID NO: 709808 - protein, 20 aa, Mycobacterium
PMLLQPGILSIAWGTAIRQL

SEQ ID NO: 709809 - protein, 26 aa, Mycobacterium
PMLLQPGVLSLAWGSVIRQMAAGLGI

SEQ ID NO: 709810 - protein, 26 aa, Mycobacterium
PMLLQPGVLSLAWGSVVRQLAAGLGV

SEQ ID NO: 709811 - protein, 30 aa, Mycobacterium
PMLPARLVRSGGLLSEWLLWRATKDADDAQ

SEQ ID NO: 709812 - protein, 25 aa, Mycobacterium
PMLPPEINSLLMFNGAGSAPMLQAA

SEQ ID NO: 709813 - protein, 19 aa, Mycobacterium
PMLPPLAPHPPIPPPPSPP

SEQ ID NO: 709814 - protein, 21 aa, Mycobacterium
PMLQAAASWQRLADELTSAAA

SEQ ID NO: 709815 - protein, 21 aa, Mycobacterium
PMLQAATAWDGLSAELGSAAS

SEQ ID NO: 709816 - protein, 21 aa, Mycobacterium
PMLSAAAAWDGLAAELQAAAT

SEQ ID NO: 709817 - protein, 21 aa, Mycobacterium
PMLTAAAAWDVLAAELQATAS

SEQ ID NO: 709818 - protein, 29 aa, Mycobacterium
PMMAAAAAWNRLAVELGTTAASFESVVTQ

SEQ ID NO: 709819 - protein, 29 aa, Mycobacterium
PMMARNLLESFTLLSNVSRLFAERCIDGL

SEQ ID NO: 709820 - protein, 29 aa, Mycobacterium
PMMARNVLESFKLLTNVSRLFAERCIVGL

SEQ ID NO: 709821 - protein, 40 aa, Mycobacterium
PMMARNVLESFTLLANVSKLFAAKCIDGLIANDQHIREQA

SEQ ID NO: 709822 - protein, 23 aa, Mycobacterium
PMMDELGARLFAIWETTPYNGHW

SEQ ID NO: 709823 - protein, 18 aa, Mycobacterium
PMMFIKGHANSHGFVNPR

SEQ ID NO: 709824 - protein, 24 aa, Mycobacterium
PMMVRDFQRVIGMEARAQMLDQAG

SEQ ID NO: 709825 - protein, 18 aa, Mycobacterium
PMNCPMHHLIYRARGRSY

SEQ ID NO: 709826 - protein, 18 aa, Mycobacterium
PMNCPMHHLIYRSRGRSY

SEQ ID NO: 709827 - protein, 30 aa, Mycobacterium
PMNPNGGLFARFPGLSLPSMGLDFYGSTPD

SEQ ID NO: 709828 - protein, 29 aa, Mycobacterium
PMNPNGGLLSRFVGLNVPSLGLDFYGSTP

SEQ ID NO: 709829 - protein, 18 aa, Mycobacterium
PMNPNGGVLARFPDLTLP

SEQ ID NO: 709830 - protein, 22 aa, Mycobacterium
PMPELMSDLLWSRIGAQCDATI

SEQ ID NO: 709831 - protein, 17 aa, Mycobacterium
PMPQFGPFARSYLAGLL

SEQ ID NO: 709832 - protein, 26 aa, Mycobacterium
PMQPKLDVLDFWSIIRPELPSISGLC

SEQ ID NO: 709833 - protein, 33 aa, Mycobacterium
PMQRRFAEAAAFQCGFCTAGLVVTASTFGDDEL

SEQ ID NO: 709834 - protein, 20 aa, Mycobacterium
PMRADIRLLGAILGDTVREQ

SEQ ID NO: 709835 - protein, 23 aa, Mycobacterium
PMRADIRLLGAILGDTVREQNGD

SEQ ID NO: 709836 - protein, 23 aa, Mycobacterium
PMRADIRLLGAILGDTVREQNGR

SEQ ID NO: 709837 - protein, 21 aa, Mycobacterium
PMRAFLGVPIMIRGTVFGHLY

SEQ ID NO: 709838 - protein, 19 aa, Mycobacterium
PMRARVETVFVRRADAALS

SEQ ID NO: 709839 - protein, 21 aa, Mycobacterium
PMRDIATLVGVSFQRVSQLAA

SEQ ID NO: 709840 - protein, 22 aa, Mycobacterium
PMREDIRLLGAILGDTVREQNG

SEQ ID NO: 709841 - protein, 21 aa, Mycobacterium
PMREDIRLLGTILGDTVREQN

SEQ ID NO: 709842 - protein, 18 aa, Mycobacterium
PMRLASRMQGAVSMIGVK

SEQ ID NO: 709843 - protein, 22 aa, Mycobacterium
PMRLSTRPEHAIPIYLAALSPA

SEQ ID NO: 709844 - protein, 26 aa, Mycobacterium
PMRLTLALLPGMRARGSGHIVNVSTV

SEQ ID NO: 709845 - protein, 24 aa, Mycobacterium
PMRPDRYVRIAAAMRREGMGMTSG

SEQ ID NO: 709846 - protein, 17 aa, Mycobacterium
PMRPWKTEQLGGGYQIS

SEQ ID NO: 709847 - protein, 18 aa, Mycobacterium
PMRQRLRTAAGRATATAQ

SEQ ID NO: 709848 - protein, 25 aa, Mycobacterium
PMRRGPWWYYARSFEGKQYAVHCRC

SEQ ID NO: 709849 - protein, 24 aa, Mycobacterium
PMRTARLLGSLAITEPSVSGSNLR

SEQ ID NO: 709850 - protein, 25 aa, Mycobacterium
PMRTYRIGAILLDLQDPTRIVGRLT

SEQ ID NO: 709851 - protein, 28 aa, Mycobacterium
PMRYDPRPSAVNVYRFWQELNGGKRAAA

SEQ ID NO: 709852 - protein, 26 aa, Mycobacterium
PMRYEPRPAAVDVYRFWQERNGGRRT

SEQ ID NO: 709853 - protein, 25 aa, Mycobacterium
PMRYVVSVLLCPNGSGGSRWIHDEV

SEQ ID NO: 709854 - protein, 22 aa, Mycobacterium
PMSAMLHGAVMEGSWGSEATPV

SEQ ID NO: 709855 - protein, 18 aa, Mycobacterium
PMSARFVINDGQHRRAAI

SEQ ID NO: 709856 - protein, 26 aa, Mycobacterium
PMSFEWKDRETLLYALGVGAGIDDLS

SEQ ID NO: 709857 - protein, 20 aa, Mycobacterium
PMSGLRCRDGVWTGRSGPHR

SEQ ID NO: 709858 - protein, 30 aa, Mycobacterium
PMSISVAFHEPVRWDGWLLYTHESTQVGAG

SEQ ID NO: 709859 - protein, 19 aa, Mycobacterium
PMSRLGVAASRRLVATAMT

SEQ ID NO: 709860 - protein, 26 aa, Mycobacterium
PMTAAMSAMWAGWVEVDRLAVLTVSA

SEQ ID NO: 709861 - protein, 18 aa, Mycobacterium
PMTDLLLGLIRRGTTQDL

SEQ ID NO: 709862 - protein, 17 aa, Mycobacterium
PMTGALVLTIGRVVAGR

SEQ ID NO: 709863 - protein, 18 aa, Mycobacterium
PMTGWTLVDWDGIRNFAG

SEQ ID NO: 709864 - protein, 30 aa, Mycobacterium
PMTISVAFHEPVHWDGWLLYSHESTQVGAG

SEQ ID NO: 709865 - protein, 30 aa, Mycobacterium
PMTISVAFHEPVRWDGWLLYTHESTQVGAG

SEQ ID NO: 709866 - protein, 18 aa, Mycobacterium
PMTLSGFDEICRLPVDDP

SEQ ID NO: 709867 - protein, 30 aa, Mycobacterium
PMTVSVSFHEPVTWGGWLLYTHESTQVGSG

SEQ ID NO: 709868 - protein, 21 aa, Mycobacterium
PMVAAASAWSGLAAELTSAAN

SEQ ID NO: 709869 - protein, 24 aa, Mycobacterium
PMVADGRVRPIIGARLPIQQAGDA

SEQ ID NO: 709870 - protein, 21 aa, Mycobacterium
PMVDQIRFFAGAARVLEGKSA

SEQ ID NO: 709871 - protein, 18 aa, Mycobacterium
PMVGVLIAIGDGRPYNTA

SEQ ID NO: 709872 - protein, 25 aa, Mycobacterium
PMVHGYPLTPFVRLAFAGDITSSLT

SEQ ID NO: 709873 - protein, 18 aa, Mycobacterium
PMVHYLHRPVPRDELIAF

SEQ ID NO: 709874 - protein, 20 aa, Mycobacterium
PMVRDVRRIGSAALDLCMVA

SEQ ID NO: 709875 - protein, 19 aa, Mycobacterium
PMVRLARYAAGVAAHPSVH

SEQ ID NO: 709876 - protein, 18 aa, Mycobacterium
PMVYARSAAAILIDESRE

SEQ ID NO: 709877 - protein, 19 aa, Mycobacterium
PMWERLEGAWGPARDVRDR

SEQ ID NO: 709878 - protein, 24 aa, Mycobacterium
PMWPEAVLAAAAWFQGDNDRGSPM

SEQ ID NO: 709879 - protein, 20 aa, Mycobacterium
PMYLFRGDVPVKEFAQVMPQ

SEQ ID NO: 709880 - protein, 18 aa, Mycobacterium
PMYLKVEARYAVAAEGAL

SEQ ID NO: 709881 - protein, 24 aa, Mycobacterium
PMYPALPLSTGVAVWQEEQGGEVL

SEQ ID NO: 709882 - protein, 18 aa, Mycobacterium
PMYREDFVLALPSGHPLA

SEQ ID NO: 709883 - protein, 17 aa, Mycobacterium
PNAAFLGHISRVLPSLG

SEQ ID NO: 709884 - protein, 23 aa, Mycobacterium
PNACGKSTLLRGFARLLTPSAGR

SEQ ID NO: 709885 - protein, 21 aa, Mycobacterium
PNACTRFLLVGPPGPPPARTG

SEQ ID NO: 709886 - protein, 22 aa, Mycobacterium
PNADELATWLSGLRGSRVSLRV

SEQ ID NO: 709887 - protein, 20 aa, Mycobacterium
PNAELTEFIRWRDLTCRFPG

SEQ ID NO: 709888 - protein, 18 aa, Mycobacterium
PNAFPVVCEQLRKSGLAK

SEQ ID NO: 709889 - protein, 28 aa, Mycobacterium
PNAFRRKEISVEEILASPALNYPLTQYM

SEQ ID NO: 709890 - protein, 24 aa, Mycobacterium
PNAFRRKEISVEEILASPTLNHPL

SEQ ID NO: 709891 - protein, 25 aa, Mycobacterium
PNAGDACVLWCTAIRHTVLTGEIDV

SEQ ID NO: 709892 - protein, 17 aa, Mycobacterium
PNAGFAALVSHVREVTL

SEQ ID NO: 709893 - protein, 24 aa, Mycobacterium
PNAGLRRLTLSGIRDHLAEIVASR

SEQ ID NO: 709894 - protein, 19 aa, Mycobacterium
PNANGRIPFETALLSEALA

SEQ ID NO: 709895 - protein, 17 aa, Mycobacterium
PNAPAAYGDNRCSLTQV

SEQ ID NO: 709896 - protein, 21 aa, Mycobacterium
PNAPALVLLHGFPTSSYMFRH

SEQ ID NO: 709897 - protein, 19 aa, Mycobacterium
PNAPMLVGGGVSALAPGRF

SEQ ID NO: 709898 - protein, 20 aa, Mycobacterium
PNARMSWQQVTDWDFVCEQL

SEQ ID NO: 709899 - protein, 20 aa, Mycobacterium
PNARPPVCKIMDYGKYKYEA

SEQ ID NO: 709900 - protein, 20 aa, Mycobacterium
PNARPPVCKIMDYGKYKYET

SEQ ID NO: 709901 - protein, 23 aa, Mycobacterium
PNARTRFVLVGLPGRPPARTGAD

SEQ ID NO: 709902 - protein, 22 aa, Mycobacterium
PNARTRFVLVGLPGTPPPATGA

SEQ ID NO: 709903 - protein, 17 aa, Mycobacterium
PNCGDWVMVEGYSHELS

SEQ ID NO: 709904 - protein, 18 aa, Mycobacterium
PNCHADLRIADGKLDATL

SEQ ID NO: 709905 - protein, 20 aa, Mycobacterium
PNCKSDVLYKGALQGDPDSR

SEQ ID NO: 709906 - protein, 17 aa, Mycobacterium
PNCRRGDTVNCLRIQLM

SEQ ID NO: 709907 - protein, 17 aa, Mycobacterium
PNDIDERAFWPAYQDAY

SEQ ID NO: 709908 - protein, 26 aa, Mycobacterium
PNDQVALFLRHLWATDGSVRWDAKVG

SEQ ID NO: 709909 - protein, 18 aa, Mycobacterium
PNDVGSTWVEPVATKDTI

SEQ ID NO: 709910 - protein, 18 aa, Mycobacterium
PNDYKIIFHDLLQEYNSY

SEQ ID NO: 709911 - protein, 18 aa, Mycobacterium
PNEDELPAARAAHVAGVP

SEQ ID NO: 709912 - protein, 33 aa, Mycobacterium
PNEEGAICIKLPLPPGTLPTVWGDDQRYISSYL

SEQ ID NO: 709913 - protein, 29 aa, Mycobacterium
PNEIVLPILERIGAFGLLVPREYGGSGLS

SEQ ID NO: 709914 - protein, 27 aa, Mycobacterium
PNEKYRYGFEIAPELVRTVLRDDEPDW

SEQ ID NO: 709915 - protein, 25 aa, Mycobacterium
PNELRQRIGMVFQHFNLFPHRSVLA

SEQ ID NO: 709916 - protein, 21 aa, Mycobacterium
PNEPYLRLLLEEPSHALLRSV

SEQ ID NO: 709917 - protein, 20 aa, Mycobacterium
PNEQLMWWACESDPDTARAC

SEQ ID NO: 709918 - protein, 25 aa, Mycobacterium
PNFAAGRLSYFLGVRGPAVVSDTAC

SEQ ID NO: 709919 - protein, 19 aa, Mycobacterium
PNFAFDLCVEQSTPAQREG

SEQ ID NO: 709920 - protein, 24 aa, Mycobacterium
PNFAIGAVLSMHFAKQAAKYFESV

SEQ ID NO: 709921 - protein, 25 aa, Mycobacterium
PNFAIGAVLSMHFAKQAAPFFDSAE

SEQ ID NO: 709922 - protein, 25 aa, Mycobacterium
PNFAIGAVLSMHFAKQAARFFESVE

SEQ ID NO: 709923 - protein, 23 aa, Mycobacterium
PNFAIGAVLSMHFAQQAAKHFES

SEQ ID NO: 709924 - protein, 18 aa, Mycobacterium
PNFAYALFAKRLRRQAKP

SEQ ID NO: 709925 - protein, 19 aa, Mycobacterium
PNFAYAMLAKRLRRHAKPG

SEQ ID NO: 709926 - protein, 17 aa, Mycobacterium
PNFAYSLFAKRLRNQAK

SEQ ID NO: 709927 - protein, 19 aa, Mycobacterium
PNFFAVFGPYGYVGSSYFA

SEQ ID NO: 709928 - protein, 20 aa, Mycobacterium
PNFFTVFGPYGYVGSSYFAL

SEQ ID NO: 709929 - protein, 26 aa, Mycobacterium
PNFGGGPLPGLGTMPASTAGWEAPGG

SEQ ID NO: 709930 - protein, 17 aa, Mycobacterium
PNFLVIVADDLGFSDIG

SEQ ID NO: 709931 - protein, 22 aa, Mycobacterium
PNFPDGGLYKFRVHGADGSVVD

SEQ ID NO: 709932 - protein, 19 aa, Mycobacterium
PNGACGRAFGKGSVHGFDL

SEQ ID NO: 709933 - protein, 17 aa, Mycobacterium
PNGARRAIAAGLHAIEY

SEQ ID NO: 709934 - protein, 17 aa, Mycobacterium
PNGARRAVAAGLRSIEY

SEQ ID NO: 709935 - protein, 19 aa, Mycobacterium
PNGARTNLLNGTFDIDSDT

SEQ ID NO: 709936 - protein, 22 aa, Mycobacterium
PNGCGVLGRTHCSVLIAERQRL

SEQ ID NO: 709937 - protein, 28 aa, Mycobacterium
PNGDGKGFVDYVLWGEDGLPLAIVEAKR

SEQ ID NO: 709938 - protein, 20 aa, Mycobacterium
PNGDPHVGHAYEYIATDAIA

SEQ ID NO: 709939 - protein, 20 aa, Mycobacterium
PNGEALPCPAAHELARGLSL

SEQ ID NO: 709940 - protein, 19 aa, Mycobacterium
PNGEGEPIVQVAGEASQTS

SEQ ID NO: 709941 - protein, 27 aa, Mycobacterium
PNGELIPRLPGPMVRTGMSVYDWMCWR

SEQ ID NO: 709942 - protein, 20 aa, Mycobacterium
PNGFCGLPVQKTCPHANACL

SEQ ID NO: 709943 - protein, 27 aa, Mycobacterium
PNGGLLSRFPGLSMPAMGLEFYGATPS

SEQ ID NO: 709944 - protein, 18 aa, Mycobacterium
PNGGWRLITTQLNNERVM

SEQ ID NO: 709945 - protein, 18 aa, Mycobacterium
PNGHGIVALIALGILEHF

SEQ ID NO: 709946 - protein, 25 aa, Mycobacterium
PNGIVPRVIPLASMDIAKGGLLGGV

SEQ ID NO: 709947 - protein, 17 aa, Mycobacterium
PNGLPQLLLVAGAELSA

SEQ ID NO: 709948 - protein, 19 aa, Mycobacterium
PNGPALPGNEAFGISHMLP

SEQ ID NO: 709949 - protein, 21 aa, Mycobacterium
PNGSAICFISSVAGMGWENDL

SEQ ID NO: 709950 - protein, 22 aa, Mycobacterium
PNGSPYVTPLVRKLATEHDIDL

SEQ ID NO: 709951 - protein, 18 aa, Mycobacterium
PNGTGWRITGQKVWTSYA

SEQ ID NO: 709952 - protein, 20 aa, Mycobacterium
PNHFSIFGPYGYNGSSYFTL

SEQ ID NO: 709953 - protein, 20 aa, Mycobacterium
PNHFSVFGPYGYNGSSYFAL

SEQ ID NO: 709954 - protein, 23 aa, Mycobacterium
PNHGAADPGGFWDANGNPIDGGP

SEQ ID NO: 709955 - protein, 17 aa, Mycobacterium
PNHLSFGRGAHFCLGAS

SEQ ID NO: 709956 - protein, 17 aa, Mycobacterium
PNHQSVYEAILDLYGRG

SEQ ID NO: 709957 - protein, 21 aa, Mycobacterium
PNHTWLRGSWEHQEVDPRLPF

SEQ ID NO: 709958 - protein, 18 aa, Mycobacterium
PNIIEHWYAGGPALAAWR

SEQ ID NO: 709959 - protein, 21 aa, Mycobacterium
PNINIRLSIEWLDAFADSMPL

SEQ ID NO: 709960 - protein, 27 aa, Mycobacterium
PNIRQHLSLGHGLHFCLGASLARLEVL

SEQ ID NO: 709961 - protein, 21 aa, Mycobacterium
PNIRYLPALGKVVFRRDFPQE

SEQ ID NO: 709962 - protein, 25 aa, Mycobacterium
PNISSTRWRTVIDHKSLRYFFESAL

SEQ ID NO: 709963 - protein, 19 aa, Mycobacterium
PNITVCVGGGIGTPERAAE

SEQ ID NO: 709964 - protein, 24 aa, Mycobacterium
PNKGELFAELGWDNTGRGKARFEK

SEQ ID NO: 709965 - protein, 18 aa, Mycobacterium
PNKHHFVYDLSPFGLDNP

SEQ ID NO: 709966 - protein, 20 aa, Mycobacterium
PNKHLAFGYGVHFCLGAALA

SEQ ID NO: 709967 - protein, 33 aa, Mycobacterium
PNKHLSFGYGVHFCLGAALARMEINSFFTELIP

SEQ ID NO: 709968 - protein, 32 aa, Mycobacterium
PNKHVAFGYGVHFCLGAALARMEINSFFAELI

SEQ ID NO: 709969 - protein, 32 aa, Mycobacterium
PNKHVAFGYGVHFCLGAALARMEINSFFSELL

SEQ ID NO: 709970 - protein, 23 aa, Mycobacterium
PNKRSVFLDVIPWALTRKTEHEA

SEQ ID NO: 709971 - protein, 19 aa, Mycobacterium
PNLAARFVEQFGEPVQVLS

SEQ ID NO: 709972 - protein, 19 aa, Mycobacterium
PNLAEAFLALVEASWDAEA

SEQ ID NO: 709973 - protein, 23 aa, Mycobacterium
PNLDEVRLLVGIDVIDTQSQHAA

SEQ ID NO: 709974 - protein, 23 aa, Mycobacterium
PNLDEVRLLVGIDVVDAESQRAA

SEQ ID NO: 709975 - protein, 17 aa, Mycobacterium
PNLDFPTGPAYHLMGFD

SEQ ID NO: 709976 - protein, 17 aa, Mycobacterium
PNLDFPTGPAYYLMGFD

SEQ ID NO: 709977 - protein, 25 aa, Mycobacterium
PNLDMHPSMRLRIEHYLQHRDSPYL

SEQ ID NO: 709978 - protein, 24 aa, Mycobacterium
PNLEILIYHGWYLLYRYWPTSHNT

SEQ ID NO: 709979 - protein, 19 aa, Mycobacterium
PNLFAKLGVSSVDYKDTNT

SEQ ID NO: 709980 - protein, 19 aa, Mycobacterium
PNLFIKIPATTAGMAAITA

SEQ ID NO: 709981 - protein, 19 aa, Mycobacterium
PNLFPGVSISADLGNGPGI

SEQ ID NO: 709982 - protein, 20 aa, Mycobacterium
PNLGQELLDLVNAPTQTLFN

SEQ ID NO: 709983 - protein, 21 aa, Mycobacterium
PNLGRYGVWTAGAVTPKQAAE

SEQ ID NO: 709984 - protein, 21 aa, Mycobacterium
PNLHWPFEYVDGLAGFMPRIG

SEQ ID NO: 709985 - protein, 19 aa, Mycobacterium
PNLHWPLEYVDSFAGMFPR

SEQ ID NO: 709986 - protein, 19 aa, Mycobacterium
PNLIPTGAVVPTQLITVSG

SEQ ID NO: 709987 - protein, 19 aa, Mycobacterium
PNLKFVPLPWPDYYGKAPK

SEQ ID NO: 709988 - protein, 27 aa, Mycobacterium
PNLKPGDALFFGHGLNIHFNLIKPPAD

SEQ ID NO: 709989 - protein, 30 aa, Mycobacterium
PNLKPGDALFFGHGLNVHFGLIKPPADVTV

SEQ ID NO: 709990 - protein, 24 aa, Mycobacterium
PNLLECGRGLAAARGASLRWVEAN

SEQ ID NO: 709991 - protein, 19 aa, Mycobacterium
PNLLIKIPATEAGVPAIAS

SEQ ID NO: 709992 - protein, 20 aa, Mycobacterium
PNLPRARGALHGVTTRNFSP

SEQ ID NO: 709993 - protein, 20 aa, Mycobacterium
PNLPSGYAVADWLSVANLRA

SEQ ID NO: 709994 - protein, 20 aa, Mycobacterium
PNLRARFLGRGLPHPVQVVP

SEQ ID NO: 709995 - protein, 18 aa, Mycobacterium
PNLRAVNFVIDGILGQGV

SEQ ID NO: 709996 - protein, 19 aa, Mycobacterium
PNLRAVNFVIDGILGQGVA

SEQ ID NO: 709997 - protein, 18 aa, Mycobacterium
PNLRGRINMASMAAAEMG

SEQ ID NO: 709998 - protein, 21 aa, Mycobacterium
PNLRPVGALGPMTSHYCRDVD

SEQ ID NO: 709999 - protein, 29 aa, Mycobacterium
PNLRVVFIEGGFTWAMPVMSRMDQMWQAR

SEQ ID NO: 710000 - protein, 17 aa, Mycobacterium
PNLVAGFCEDFGEPVQV

SEQ ID NO: 710001 - protein, 17 aa, Mycobacterium
PNLVPFVERIGLSAESY

SEQ ID NO: 710002 - protein, 21 aa, Mycobacterium
PNMDATWRKTLLVCSTTGGDP

SEQ ID NO: 710003 - protein, 33 aa, Mycobacterium
PNMGAVDFVACLGSWNHRVFDVHGIYHQDTYDF

SEQ ID NO: 710004 - protein, 26 aa, Mycobacterium
PNMPKSVVINPYFDWGVDRPPSHDYA

SEQ ID NO: 710005 - protein, 22 aa, Mycobacterium
PNMPNLAALAARGAMRHLDPVF

SEQ ID NO: 710006 - protein, 17 aa, Mycobacterium
PNNLMVVDTVVWTADPL

SEQ ID NO: 710007 - protein, 21 aa, Mycobacterium
PNNLRYLTALGRDVDLPSTEI

SEQ ID NO: 710008 - protein, 25 aa, Mycobacterium
PNNWTSVFGGPAWTRVVEPDGQPGQ

SEQ ID NO: 710009 - protein, 25 aa, Mycobacterium
PNNWTSVFGGSAWTRVVEPDGNPGQ

SEQ ID NO: 710010 - protein, 21 aa, Mycobacterium
PNPAVMAWEIVRDITELWPAL

SEQ ID NO: 710011 - protein, 17 aa, Mycobacterium
PNPCVRCNERIKFSALA

SEQ ID NO: 710012 - protein, 24 aa, Mycobacterium
PNPEAWPGWVDGLSRRTALGRLGE

SEQ ID NO: 710013 - protein, 18 aa, Mycobacterium
PNPHLGFGQGVHYCLGAN

SEQ ID NO: 710014 - protein, 23 aa, Mycobacterium
PNPKATVALLRRVEDVLDVEVPL

SEQ ID NO: 710015 - protein, 17 aa, Mycobacterium
PNPLDPRCRAASAMAGR

SEQ ID NO: 710016 - protein, 26 aa, Mycobacterium
PNPQFSALGARALWTLDRITDQVDRL

SEQ ID NO: 710017 - protein, 17 aa, Mycobacterium
PNPRLARDLAVGLVELI

SEQ ID NO: 710018 - protein, 23 aa, Mycobacterium
PNPSDWNAVQAYNQEAWYNNTLK

SEQ ID NO: 710019 - protein, 24 aa, Mycobacterium
PNPSRLCSWCAHQSLCPAFGGTLP

SEQ ID NO: 710020 - protein, 18 aa, Mycobacterium
PNPVEYYLASLLSCQVVT

SEQ ID NO: 710021 - protein, 20 aa, Mycobacterium
PNPWCAQGAIVGASLASHND

SEQ ID NO: 710022 - protein, 25 aa, Mycobacterium
PNQGFLRCVAALARAADDIGETDEY

SEQ ID NO: 710023 - protein, 20 aa, Mycobacterium
PNQHGIVGNGWYFRELGEVL

SEQ ID NO: 710024 - protein, 24 aa, Mycobacterium
PNQLAGVVGPLFRSALRSAEVRRR

SEQ ID NO: 710025 - protein, 33 aa, Mycobacterium
PNQLGTFLYWMLWKRPGLDIYLLKSNLRLLPAF

SEQ ID NO: 710026 - protein, 21 aa, Mycobacterium
PNRAAYKFIDYEVDPKGFTET

SEQ ID NO: 710027 - protein, 23 aa, Mycobacterium
PNRAEFLEITWGAQLSGLYYTPV

SEQ ID NO: 710028 - protein, 19 aa, Mycobacterium
PNRARELTVTVGLIADLKV

SEQ ID NO: 710029 - protein, 25 aa, Mycobacterium
PNRGFLRCVAALARAADTIGEPDEY

SEQ ID NO: 710030 - protein, 25 aa, Mycobacterium
PNRGFLRCVAALARAADTIGETDEY

SEQ ID NO: 710031 - protein, 17 aa, Mycobacterium
PNRIVAWGSSFSGGHVL

SEQ ID NO: 710032 - protein, 25 aa, Mycobacterium
PNRPLLRPYLRGCLLESVRLWPTTP

SEQ ID NO: 710033 - protein, 17 aa, Mycobacterium
PNRPLVAACPITVRDPA

SEQ ID NO: 710034 - protein, 23 aa, Mycobacterium
PNRPRRAGVSSFGISGTNAHVII

SEQ ID NO: 710035 - protein, 18 aa, Mycobacterium
PNRSLDCVDDELATAGHF

SEQ ID NO: 710036 - protein, 18 aa, Mycobacterium
PNRSLDCVDEDLATSAHF

SEQ ID NO: 710037 - protein, 28 aa, Mycobacterium
PNRTVRNHLRWIAATHRIASRRVDDVVD

SEQ ID NO: 710038 - protein, 19 aa, Mycobacterium
PNSCQFAVALFGLLRAGAV

SEQ ID NO: 710039 - protein, 18 aa, Mycobacterium
PNSCTPTHLVICEKDRVL

SEQ ID NO: 710040 - protein, 38 aa, Mycobacterium
PNSFFFTTPMEWQQRLWPTEEFELARSRVPVVLPETDL

SEQ ID NO: 710041 - protein, 18 aa, Mycobacterium
PNSFWRIDIAPVTRTVMH

SEQ ID NO: 710042 - protein, 32 aa, Mycobacterium
PNSGGGAWNRLEYRPLEGFVYAITPFNFTAIA

SEQ ID NO: 710043 - protein, 19 aa, Mycobacterium
PNSGTYWAHPHTGLDEDTG

SEQ ID NO: 710044 - protein, 21 aa, Mycobacterium
PNSHMAFGFGTHFCLGNQLAR

SEQ ID NO: 710045 - protein, 22 aa, Mycobacterium
PNSRQSWPTHFKKRSTDADTSA

SEQ ID NO: 710046 - protein, 18 aa, Mycobacterium
PNSSAWSPFSRQPVMGPA

SEQ ID NO: 710047 - protein, 18 aa, Mycobacterium
PNSTIARLGGDEFVVVPD

SEQ ID NO: 710048 - protein, 19 aa, Mycobacterium
PNSTSWLQVIWDLLTGSGP

SEQ ID NO: 710049 - protein, 17 aa, Mycobacterium
PNTELPADFGLPECPRW

SEQ ID NO: 710050 - protein, 20 aa, Mycobacterium
PNTFIPFDVDSGVLRAAGDA

SEQ ID NO: 710051 - protein, 20 aa, Mycobacterium
PNTHGFAMLRALRAIEERDV

SEQ ID NO: 710052 - protein, 19 aa, Mycobacterium
PNTIPRGGVLATQRLLDEL

SEQ ID NO: 710053 - protein, 26 aa, Mycobacterium
PNTRMNEIRLWLPYDEVLPRRQPPSV

SEQ ID NO: 710054 - protein, 22 aa, Mycobacterium
PNVARSLLLYRYRRLPEARRAA

SEQ ID NO: 710055 - protein, 20 aa, Mycobacterium
PNVARWIRRFAGHAVSPEKA

SEQ ID NO: 710056 - protein, 21 aa, Mycobacterium
PNVHAAPVMRMSSGQTVTIDA

SEQ ID NO: 710057 - protein, 19 aa, Mycobacterium
PNVKTGPEYGDWANEAHTA

SEQ ID NO: 710058 - protein, 17 aa, Mycobacterium
PNVLAALIITPELQQDD

SEQ ID NO: 710059 - protein, 27 aa, Mycobacterium
PNVNIRLAIDWLDRWADDMPLSLLGTV

SEQ ID NO: 710060 - protein, 17 aa, Mycobacterium
PNVPAQHAIQVALGGHQ

SEQ ID NO: 710061 - protein, 18 aa, Mycobacterium
PNVPHVLIEPGVRTGIPL

SEQ ID NO: 710062 - protein, 19 aa, Mycobacterium
PNVPNAYQVIVSKANGTGI

SEQ ID NO: 710063 - protein, 18 aa, Mycobacterium
PNVRFAHRHQVDRLIVEG

SEQ ID NO: 710064 - protein, 18 aa, Mycobacterium
PNVRPSLIPDRDAAQARI

SEQ ID NO: 710065 - protein, 26 aa, Mycobacterium
PNVWPREVPELAPLVEEYTAQMRRVA

SEQ ID NO: 710066 - protein, 21 aa, Mycobacterium
PNWHCRLPGYPYAGPDPDGFM

SEQ ID NO: 710067 - protein, 17 aa, Mycobacterium
PNWLEALTRYLVEGYAR

SEQ ID NO: 710068 - protein, 17 aa, Mycobacterium
PNWSITMIERLDGAAAE

SEQ ID NO: 710069 - protein, 25 aa, Mycobacterium
PNYSTVYDWYEMTFNNGAIPFGGNT

SEQ ID NO: 710070 - protein, 17 aa, Mycobacterium
PPAAAPRRSRTVAPLSG

SEQ ID NO: 710071 - protein, 17 aa, Mycobacterium
PPAAKLRSYELFAQYVI

SEQ ID NO: 710072 - protein, 30 aa, Mycobacterium
PPAATRLRLRAGWTMLGLRLHRGDADVIAG

SEQ ID NO: 710073 - protein, 17 aa, Mycobacterium
PPACLAATLEMGCNDDV

SEQ ID NO: 710074 - protein, 17 aa, Mycobacterium
PPADLVREFALPVPSLV

SEQ ID NO: 710075 - protein, 20 aa, Mycobacterium
PPADMAAAFEVDIHDYRGRR

SEQ ID NO: 710076 - protein, 22 aa, Mycobacterium
PPADRGVVMAGLMADSRGVGAD

SEQ ID NO: 710077 - protein, 21 aa, Mycobacterium
PPADWEPGRKVGWRTALDAWF

SEQ ID NO: 710078 - protein, 19 aa, Mycobacterium
PPAEAESLLALMDPEDSEP

SEQ ID NO: 710079 - protein, 28 aa, Mycobacterium
PPAEALDEWAAMGATGWSAAEVLPLVQR

SEQ ID NO: 710080 - protein, 20 aa, Mycobacterium
PPAEEAARWLARLREGKPEM

SEQ ID NO: 710081 - protein, 18 aa, Mycobacterium
PPAELDWVEPLLAATTTL

SEQ ID NO: 710082 - protein, 18 aa, Mycobacterium
PPAELVWVEPILEATTTL

SEQ ID NO: 710083 - protein, 22 aa, Mycobacterium
PPAETLRSLGLPAMSPTIGGHE

SEQ ID NO: 710084 - protein, 27 aa, Mycobacterium
PPAFHAWRAFARYSPVLPAGRIVGAGT

SEQ ID NO: 710085 - protein, 21 aa, Mycobacterium
PPAFVSPVVGYLCTEESTDNG

SEQ ID NO: 710086 - protein, 20 aa, Mycobacterium
PPAGEIGRRIGPPWRDGQSV

SEQ ID NO: 710087 - protein, 17 aa, Mycobacterium
PPAGHFVNQYAIDLAHN

SEQ ID NO: 710088 - protein, 17 aa, Mycobacterium
PPAGPALGLNLGNWCQH

SEQ ID NO: 710089 - protein, 18 aa, Mycobacterium
PPAGTLTGIAKRELRGVT

SEQ ID NO: 710090 - protein, 17 aa, Mycobacterium
PPAGTRARDRWEALVAL

SEQ ID NO: 710091 - protein, 25 aa, Mycobacterium
PPAIAVNRVRLLALIATNFFGQNTP

SEQ ID NO: 710092 - protein, 23 aa, Mycobacterium
PPAIFRWTDRDTLLYALGVGAGT

SEQ ID NO: 710093 - protein, 24 aa, Mycobacterium
PPAILKGWFDRVLTNEFAYGDVDS

SEQ ID NO: 710094 - protein, 21 aa, Mycobacterium
PPALDRAWHTHGYYGSVSHNV

SEQ ID NO: 710095 - protein, 24 aa, Mycobacterium
PPALENAWHARGYYGSVSHNVKAV

SEQ ID NO: 710096 - protein, 24 aa, Mycobacterium
PPALFIPRMITRDVVIRGTELTAG

SEQ ID NO: 710097 - protein, 20 aa, Mycobacterium
PPAMLTFGGGVHYCLGAHLA

SEQ ID NO: 710098 - protein, 19 aa, Mycobacterium
PPANYRAPQAYRMPPSLDE

SEQ ID NO: 710099 - protein, 23 aa, Mycobacterium
PPAPALRPAGTVPLAQTTSPPQL

SEQ ID NO: 710100 - protein, 17 aa, Mycobacterium
PPAPARPPGPSASPSPP

SEQ ID NO: 710101 - protein, 25 aa, Mycobacterium
PPAPEVPSPYAFRLADPDADAEKIA

SEQ ID NO: 710102 - protein, 18 aa, Mycobacterium
PPAPGGYGGGQGYEQGYR

SEQ ID NO: 710103 - protein, 18 aa, Mycobacterium
PPAPGRLRHLVVVEEAHR

SEQ ID NO: 710104 - protein, 24 aa, Mycobacterium
PPAPGVPGAPVFGDAGVATPPVPG

SEQ ID NO: 710105 - protein, 22 aa, Mycobacterium
PPAPPIPIHFNQGTSGFFNMGP

SEQ ID NO: 710106 - protein, 20 aa, Mycobacterium
PPAPPRPGLGAGPHVGEAGG

SEQ ID NO: 710107 - protein, 24 aa, Mycobacterium
PPAPPRWQDCTDFDLDFHMRRVAA

SEQ ID NO: 710108 - protein, 18 aa, Mycobacterium
PPAPRLAGLVVSPHTRSS

SEQ ID NO: 710109 - protein, 18 aa, Mycobacterium
PPAQAYREAVELFVAAEQ

SEQ ID NO: 710110 - protein, 20 aa, Mycobacterium
PPARAATCPVCGRETKVDPS

SEQ ID NO: 710111 - protein, 17 aa, Mycobacterium
PPARADLGWQIVDATQW

SEQ ID NO: 710112 - protein, 34 aa, Mycobacterium
PPARDRLPFSGLRVLDMTTFWAGPSCTHILGMLG

SEQ ID NO: 710113 - protein, 20 aa, Mycobacterium
PPARPLPRRRACRRVDGHQP

SEQ ID NO: 710114 - protein, 24 aa, Mycobacterium
PPARVFRLKGVVAVRHRTAVHEYV

SEQ ID NO: 710115 - protein, 19 aa, Mycobacterium
PPARWERHTTFREHEGGTL

SEQ ID NO: 710116 - protein, 18 aa, Mycobacterium
PPASLVLFSPLIDLTFGL

SEQ ID NO: 710117 - protein, 18 aa, Mycobacterium
PPATVVMARRARPPRQQP

SEQ ID NO: 710118 - protein, 20 aa, Mycobacterium
PPATYFSGGKIQWILDNVPG

SEQ ID NO: 710119 - protein, 21 aa, Mycobacterium
PPATYFSGGKLQWILDNVDGV

SEQ ID NO: 710120 - protein, 21 aa, Mycobacterium
PPATYFSGGKLQWILENVDGV

SEQ ID NO: 710121 - protein, 18 aa, Mycobacterium
PPAVPGFADFAYAVADLE

SEQ ID NO: 710122 - protein, 18 aa, Mycobacterium
PPAWIGVGTLDLFHDEDL

SEQ ID NO: 710123 - protein, 17 aa, Mycobacterium
PPAWVVVAEDPDAVSAG

SEQ ID NO: 710124 - protein, 27 aa, Mycobacterium
PPCAGTDCGCDRCHIGLNSRAGSSTVR

SEQ ID NO: 710125 - protein, 19 aa, Mycobacterium
PPCCVEPPAAAPVSPASPA

SEQ ID NO: 710126 - protein, 17 aa, Mycobacterium
PPCGGKSSYVREEAKGG

SEQ ID NO: 710127 - protein, 29 aa, Mycobacterium
PPCPACQAGDYSLCWSFTDGVLSPGIHTG

SEQ ID NO: 710128 - protein, 23 aa, Mycobacterium
PPCPCTGRSGFGIHHGVDRFDGR

SEQ ID NO: 710129 - protein, 18 aa, Mycobacterium
PPCQPKNVMFMYCTASAE

SEQ ID NO: 710130 - protein, 18 aa, Mycobacterium
PPCVNADGTPCSDIGTAG

SEQ ID NO: 710131 - protein, 23 aa, Mycobacterium
PPDARISISPLGFVAEGRSLIGS

SEQ ID NO: 710132 - protein, 24 aa, Mycobacterium
PPDARISVAPLGFVAEGRSLIGSY

SEQ ID NO: 710133 - protein, 19 aa, Mycobacterium
PPDARITLSPLGFVAEGRS

SEQ ID NO: 710134 - protein, 20 aa, Mycobacterium
PPDAVCTVAAVPTDTAGSTG

SEQ ID NO: 710135 - protein, 18 aa, Mycobacterium
PPDAVGEIWVHGENVADG

SEQ ID NO: 710136 - protein, 17 aa, Mycobacterium
PPDDPRLVPGYSATGDP

SEQ ID NO: 710137 - protein, 23 aa, Mycobacterium
PPDELKPIRHAWLARGGAVQTRV

SEQ ID NO: 710138 - protein, 20 aa, Mycobacterium
PPDEPVAIVAPDPRWPARYR

SEQ ID NO: 710139 - protein, 20 aa, Mycobacterium
PPDGRLVLCLHGFPDSAWGW

SEQ ID NO: 710140 - protein, 34 aa, Mycobacterium
PPDHAVKLWEHWDRCALHWFPGSHVLHVSQLDYL

SEQ ID NO: 710141 - protein, 22 aa, Mycobacterium
PPDHKWARRSRIVTARELAQTP

SEQ ID NO: 710142 - protein, 17 aa, Mycobacterium
PPDIELIGMLNLLIGGG

SEQ ID NO: 710143 - protein, 18 aa, Mycobacterium
PPDLNWSGWERKRQHVMT

SEQ ID NO: 710144 - protein, 26 aa, Mycobacterium
PPDLPRPANATIRRFVPHAAVLERAT

SEQ ID NO: 710145 - protein, 18 aa, Mycobacterium
PPDNWELIVSDVADSELP

SEQ ID NO: 710146 - protein, 23 aa, Mycobacterium
PPDPEGIAFDPGRQRLYWSSEGE

SEQ ID NO: 710147 - protein, 21 aa, Mycobacterium
PPDPIPAVFFGGSSAAAGPVA

SEQ ID NO: 710148 - protein, 18 aa, Mycobacterium
PPDRWAGDFDDLLSTHIT

SEQ ID NO: 710149 - protein, 23 aa, Mycobacterium
PPDRWPDALLLLGDQIYADDLSP

SEQ ID NO: 710150 - protein, 18 aa, Mycobacterium
PPDSRFVYLSDVLPTAWQ

SEQ ID NO: 710151 - protein, 22 aa, Mycobacterium
PPDWQGDASDAYGLRNTEQQQR

SEQ ID NO: 710152 - protein, 25 aa, Mycobacterium
PPDWQPRQGMFVQMAALGKMPFYVR

SEQ ID NO: 710153 - protein, 17 aa, Mycobacterium
PPEAAAWLASAIDAAYG

SEQ ID NO: 710154 - protein, 23 aa, Mycobacterium
PPEAELRLLDSIIPLSAEGSRFA

SEQ ID NO: 710155 - protein, 18 aa, Mycobacterium
PPEAIDWLLPAGARDVLD

SEQ ID NO: 710156 - protein, 19 aa, Mycobacterium
PPEAIDWLLPTGARNVLDL

SEQ ID NO: 710157 - protein, 21 aa, Mycobacterium
PPEALGPRYVDAMGGIDRVVE

SEQ ID NO: 710158 - protein, 19 aa, Mycobacterium
PPEDWLLKAHNGEWVVDVL

SEQ ID NO: 710159 - protein, 17 aa, Mycobacterium
PPEEVYRFWRDLENLPR

SEQ ID NO: 710160 - protein, 26 aa, Mycobacterium
PPEFADRVADGWIKAQAYRLQTFGTV

SEQ ID NO: 710161 - protein, 24 aa, Mycobacterium
PPEGAPVLGGRARRDVGLPLEGLR

SEQ ID NO: 710162 - protein, 18 aa, Mycobacterium
PPEINSARIFSGAGSGPL

SEQ ID NO: 710163 - protein, 20 aa, Mycobacterium
PPEINSGLMYAGPGSGSMLA

SEQ ID NO: 710164 - protein, 20 aa, Mycobacterium
PPEIRRQAFEHIAAAATLRR

SEQ ID NO: 710165 - protein, 22 aa, Mycobacterium
PPEKIRAGGLGFLPKDGGRVVV

SEQ ID NO: 710166 - protein, 22 aa, Mycobacterium
PPELETRIAILRKKAQMDRLDV

SEQ ID NO: 710167 - protein, 26 aa, Mycobacterium
PPELIPFSGPARKALELTVREALRLG

SEQ ID NO: 710168 - protein, 19 aa, Mycobacterium
PPELRRRGAARERAAELAT

SEQ ID NO: 710169 - protein, 21 aa, Mycobacterium
PPELYAWLHYEPIPDRDDLAK

SEQ ID NO: 710170 - protein, 24 aa, Mycobacterium
PPELYAWLRYDPIPVRDDLAKALV

SEQ ID NO: 710171 - protein, 21 aa, Mycobacterium
PPEMKSGYRALAREANGVTEY

SEQ ID NO: 710172 - protein, 23 aa, Mycobacterium
PPEPARPAALLCRMPGGGWVLSR

SEQ ID NO: 710173 - protein, 18 aa, Mycobacterium
PPEPCAAGERGQVAGIAP

SEQ ID NO: 710174 - protein, 17 aa, Mycobacterium
PPEPGGYSLIVDGRAEV

SEQ ID NO: 710175 - protein, 29 aa, Mycobacterium
PPERAAAGWDVVDAAGWPAERLREAVEAA

SEQ ID NO: 710176 - protein, 19 aa, Mycobacterium
PPERELAARLGVSRDTVRE

SEQ ID NO: 710177 - protein, 25 aa, Mycobacterium
PPERLIPGPLVWDLTTGVATDTPES

SEQ ID NO: 710178 - protein, 19 aa, Mycobacterium
PPERVVGSSVGLIYRDGSL

SEQ ID NO: 710179 - protein, 21 aa, Mycobacterium
PPESLPIKGFLSFDDTRADVL

SEQ ID NO: 710180 - protein, 23 aa, Mycobacterium
PPESLPIKGFLSFDLARVDVVAE

SEQ ID NO: 710181 - protein, 17 aa, Mycobacterium
PPESPVIFIKPNTSIIG

SEQ ID NO: 710182 - protein, 19 aa, Mycobacterium
PPETARLIGFHGAATAAEM

SEQ ID NO: 710183 - protein, 19 aa, Mycobacterium
PPETARLIGFHGAATDAEM

SEQ ID NO: 710184 - protein, 19 aa, Mycobacterium
PPEVATLRYFWPRLSPGAF

SEQ ID NO: 710185 - protein, 26 aa, Mycobacterium
PPEVETLRYFWPRLSPGAFVLLDDYA

SEQ ID NO: 710186 - protein, 18 aa, Mycobacterium
PPEVFEKLTPEYVAPIVS

SEQ ID NO: 710187 - protein, 21 aa, Mycobacterium
PPEVKSVGLGNVNGVTLGYTS

SEQ ID NO: 710188 - protein, 28 aa, Mycobacterium
PPEVMRRLTSELPLPVNAIARPDQSDPA

SEQ ID NO: 710189 - protein, 18 aa, Mycobacterium
PPEVRRRYAKLIEAAEYL

SEQ ID NO: 710190 - protein, 19 aa, Mycobacterium
PPEVVAAVMEWARDADDEI

SEQ ID NO: 710191 - protein, 19 aa, Mycobacterium
PPEVYGGAGVHVTELVARL

SEQ ID NO: 710192 - protein, 19 aa, Mycobacterium
PPEVYGGAGVHVTELVSHL

SEQ ID NO: 710193 - protein, 19 aa, Mycobacterium
PPEVYGGAGVHVTELVSQL

SEQ ID NO: 710194 - protein, 18 aa, Mycobacterium
PPFAQRVPDRLWALQRKL

SEQ ID NO: 710195 - protein, 18 aa, Mycobacterium
PPFAQWIPDRLWALQRRL

SEQ ID NO: 710196 - protein, 22 aa, Mycobacterium
PPFELDGRWIGEASFVLPADLP

SEQ ID NO: 710197 - protein, 19 aa, Mycobacterium
PPFEWDIAIDVGDMSGAHH

SEQ ID NO: 710198 - protein, 18 aa, Mycobacterium
PPFGSAVFAVTARHGDLQ

SEQ ID NO: 710199 - protein, 25 aa, Mycobacterium
PPFGSRGLRARLRHSARNVDELIDL

SEQ ID NO: 710200 - protein, 18 aa, Mycobacterium
PPFIPGMEVAGTVRSAPE

SEQ ID NO: 710201 - protein, 25 aa, Mycobacterium
PPFPLYMAGARLDSLVPLGPPVMDV

SEQ ID NO: 710202 - protein, 17 aa, Mycobacterium
PPFQGTVTLSFLIHGDP

SEQ ID NO: 710203 - protein, 19 aa, Mycobacterium
PPFRVVRGPVQFNHEPLTT

SEQ ID NO: 710204 - protein, 19 aa, Mycobacterium
PPFSCPIDDVYAVCAPLVD

SEQ ID NO: 710205 - protein, 20 aa, Mycobacterium
PPFVLHRMRQSLAIQPVAIG

SEQ ID NO: 710206 - protein, 23 aa, Mycobacterium
PPFVRPNLANNWYRYVGDPAVPE

SEQ ID NO: 710207 - protein, 23 aa, Mycobacterium
PPFWRPPPPPPIWLPPPPPPPPF

SEQ ID NO: 710208 - protein, 24 aa, Mycobacterium
PPFYDPWFAKARTTGAIESREMDE

SEQ ID NO: 710209 - protein, 20 aa, Mycobacterium
PPGAAWHVGGPFGRGSSRWD

SEQ ID NO: 710210 - protein, 19 aa, Mycobacterium
PPGAFWLPRRLGGGAPTPE

SEQ ID NO: 710211 - protein, 23 aa, Mycobacterium
PPGATGVAQCYELFNQLRGEAEN

SEQ ID NO: 710212 - protein, 19 aa, Mycobacterium
PPGCGKTYIAKAVSGELGA

SEQ ID NO: 710213 - protein, 19 aa, Mycobacterium
PPGDVLVFLSGEREIRDTS

SEQ ID NO: 710214 - protein, 18 aa, Mycobacterium
PPGHVLVVDAGGQAFGHW

SEQ ID NO: 710215 - protein, 23 aa, Mycobacterium
PPGHVRLAVKACGVCGTDREFRA

SEQ ID NO: 710216 - protein, 17 aa, Mycobacterium
PPGIGIAPLRHAIAAQR

SEQ ID NO: 710217 - protein, 18 aa, Mycobacterium
PPGINPCKAKQWGIDSFL

SEQ ID NO: 710218 - protein, 26 aa, Mycobacterium
PPGKHAASAFALWFPIEGGADYGDAK

SEQ ID NO: 710219 - protein, 32 aa, Mycobacterium
PPGKHAVSAFSLWFPLSEEISGYGALKTEMGR

SEQ ID NO: 710220 - protein, 17 aa, Mycobacterium
PPGKHVAVVACMDARLD

SEQ ID NO: 710221 - protein, 20 aa, Mycobacterium
PPGKVWRLLTEPDLLRLWWA

SEQ ID NO: 710222 - protein, 19 aa, Mycobacterium
PPGLEMIAALYACARIGVI

SEQ ID NO: 710223 - protein, 40 aa, Mycobacterium
PPGLEMVAAFYACARIGVIAVPVSPPLPMSFESGLAKLAF

SEQ ID NO: 710224 - protein, 19 aa, Mycobacterium
PPGLLMSLGFAPQWVPGYL

SEQ ID NO: 710225 - protein, 20 aa, Mycobacterium
PPGLNPGGIEPWGISNFQIF

SEQ ID NO: 710226 - protein, 23 aa, Mycobacterium
PPGLPPFVLCTNVSTLPPIRTPE

SEQ ID NO: 710227 - protein, 17 aa, Mycobacterium
PPGPHLLVLARGPEGYR

SEQ ID NO: 710228 - protein, 24 aa, Mycobacterium
PPGPKTSWLGEIVVHGEDIRRPLG

SEQ ID NO: 710229 - protein, 27 aa, Mycobacterium
PPGPPFSEFDRTAGFGIYGTAKAALNR

SEQ ID NO: 710230 - protein, 29 aa, Mycobacterium
PPGPPFSEFDRTAGFGIYGTVKAALNRLT

SEQ ID NO: 710231 - protein, 17 aa, Mycobacterium
PPGPPGRHAAALGPVST

SEQ ID NO: 710232 - protein, 18 aa, Mycobacterium
PPGPPMPEPPPAPPAPPE

SEQ ID NO: 710233 - protein, 27 aa, Mycobacterium
PPGPPRFAHELAWWVYTCWREGLRRID

SEQ ID NO: 710234 - protein, 19 aa, Mycobacterium
PPGPPVDVIVCHKFLDPRL

SEQ ID NO: 710235 - protein, 24 aa, Mycobacterium
PPGPRAFGNLLIQRATLRGFIVLD

SEQ ID NO: 710236 - protein, 18 aa, Mycobacterium
PPGPRFGVDGTLERFIRV

SEQ ID NO: 710237 - protein, 17 aa, Mycobacterium
PPGPTVARRAMQDIEVD

SEQ ID NO: 710238 - protein, 17 aa, Mycobacterium
PPGRALDLGCGEGADAL

SEQ ID NO: 710239 - protein, 24 aa, Mycobacterium
PPGRGDKPVTHWTTAEILGALQSG

SEQ ID NO: 710240 - protein, 25 aa, Mycobacterium
PPGRGRARHRWYLRLLFARPTSRKV

SEQ ID NO: 710241 - protein, 22 aa, Mycobacterium
PPGRLPGHRERLGQQVVEALAV

SEQ ID NO: 710242 - protein, 17 aa, Mycobacterium
PPGRPLWLGSIKSNIGH

SEQ ID NO: 710243 - protein, 25 aa, Mycobacterium
PPGRRAVAMLRDWLATELADAGATI

SEQ ID NO: 710244 - protein, 29 aa, Mycobacterium
PPGRSDLEIGWQIAPAMWGHGYGSEAGHA

SEQ ID NO: 710245 - protein, 22 aa, Mycobacterium
PPGSRAAICVGFAHHVLEELET

SEQ ID NO: 710246 - protein, 17 aa, Mycobacterium
PPGSWTKYGRLLREPVG

SEQ ID NO: 710247 - protein, 18 aa, Mycobacterium
PPGSWTRFGRWLREPVGP

SEQ ID NO: 710248 - protein, 18 aa, Mycobacterium
PPGTRPTRRQFLTRNRLV

SEQ ID NO: 710249 - protein, 18 aa, Mycobacterium
PPGTVFLGIAGPIDTHVA

SEQ ID NO: 710250 - protein, 27 aa, Mycobacterium
PPGTWTAALIGAWWPAPSTALRAGAQH

SEQ ID NO: 710251 - protein, 19 aa, Mycobacterium
PPHELTLVIILEADVVPSD

SEQ ID NO: 710252 - protein, 19 aa, Mycobacterium
PPHGPEFVGTFCELAELVM

SEQ ID NO: 710253 - protein, 19 aa, Mycobacterium
PPHGPVCRVDRAVKDGEVL

SEQ ID NO: 710254 - protein, 19 aa, Mycobacterium
PPHLPSCVDSLHLATLVDV

SEQ ID NO: 710255 - protein, 17 aa, Mycobacterium
PPHRRRRGCCGIPVIVQ

SEQ ID NO: 710256 - protein, 22 aa, Mycobacterium
PPHWNLVADRIVDGWPDGHPDH

SEQ ID NO: 710257 - protein, 21 aa, Mycobacterium
PPIANGEVIWCQGFSEPEAGS

SEQ ID NO: 710258 - protein, 26 aa, Mycobacterium
PPIAVRIYWPAGFESAGELPLVLYYH

SEQ ID NO: 710259 - protein, 20 aa, Mycobacterium
PPICRVCQMPAVFPRIDVNE

SEQ ID NO: 710260 - protein, 19 aa, Mycobacterium
PPIGHLPYLLTLPGHGFYW

SEQ ID NO: 710261 - protein, 20 aa, Mycobacterium
PPILLCHGNPTWSFLYRHII

SEQ ID NO: 710262 - protein, 20 aa, Mycobacterium
PPIMVNGVDWFRSMGSEKSP

SEQ ID NO: 710263 - protein, 24 aa, Mycobacterium
PPIPCYPGDLNQVWTNIIDNAIAA

SEQ ID NO: 710264 - protein, 18 aa, Mycobacterium
PPIPWSYMEAYIRAYQAL

SEQ ID NO: 710265 - protein, 18 aa, Mycobacterium
PPIRRLASDRFARQHRAE

SEQ ID NO: 710266 - protein, 20 aa, Mycobacterium
PPISAGSGWRKRKQPKYEDL

SEQ ID NO: 710267 - protein, 19 aa, Mycobacterium
PPISAGSGWRKRKQQKYED

SEQ ID NO: 710268 - protein, 17 aa, Mycobacterium
PPISAVRRFQVWVNTGA

SEQ ID NO: 710269 - protein, 20 aa, Mycobacterium
PPIVLFTLQGMDNFQGMTRQ

SEQ ID NO: 710270 - protein, 17 aa, Mycobacterium
PPKDWTEPGFMGLGMIY

SEQ ID NO: 710271 - protein, 25 aa, Mycobacterium
PPKELLRTAVLAFLNYIDANRASWM

SEQ ID NO: 710272 - protein, 22 aa, Mycobacterium
PPKERPRVIAVDAIPNDVGSTW

SEQ ID NO: 710273 - protein, 29 aa, Mycobacterium
PPKFFPPAMKRWWLYRRLADVAALEHYTA

SEQ ID NO: 710274 - protein, 18 aa, Mycobacterium
PPKGIAYFSMEFGVAEVL

SEQ ID NO: 710275 - protein, 21 aa, Mycobacterium
PPKGQHWRLLSSVKELDPAWV

SEQ ID NO: 710276 - protein, 24 aa, Mycobacterium
PPKNRNPLGAGMPGMAGLPPGFPD

SEQ ID NO: 710277 - protein, 20 aa, Mycobacterium
PPKPSMRIISDIFGYTSAKM

SEQ ID NO: 710278 - protein, 20 aa, Mycobacterium
PPKRRSGRLAALVDAATGLL

SEQ ID NO: 710279 - protein, 18 aa, Mycobacterium
PPKVRRDLEHFAWDPPVV

SEQ ID NO: 710280 - protein, 18 aa, Mycobacterium
PPLAGSLLIGGEGRVAEP

SEQ ID NO: 710281 - protein, 18 aa, Mycobacterium
PPLAGSLLIGGEGRVVEP

SEQ ID NO: 710282 - protein, 30 aa, Mycobacterium
PPLARSAMTAFDWYCWRLNKKVEDTQRRQL

SEQ ID NO: 710283 - protein, 18 aa, Mycobacterium
PPLCIDMTAADYFADTLD

SEQ ID NO: 710284 - protein, 18 aa, Mycobacterium
PPLCIDVEAADFYVDTLD

SEQ ID NO: 710285 - protein, 21 aa, Mycobacterium
PPLDDASIWLARLREGQPDEG

SEQ ID NO: 710286 - protein, 18 aa, Mycobacterium
PPLFEEIPEQLLPQLGKF

SEQ ID NO: 710287 - protein, 17 aa, Mycobacterium
PPLGHLLASAHDVVREA

SEQ ID NO: 710288 - protein, 26 aa, Mycobacterium
PPLKFDVALPLAHIGEFERRASELIA

SEQ ID NO: 710289 - protein, 17 aa, Mycobacterium
PPLKLVLLENPGKGGSI

SEQ ID NO: 710290 - protein, 17 aa, Mycobacterium
PPLLARAHHGSVSKEQR

SEQ ID NO: 710291 - protein, 19 aa, Mycobacterium
PPLLLRMVEAGQLGKKSGR

SEQ ID NO: 710292 - protein, 25 aa, Mycobacterium
PPLLPRPWYSYTLTGLIGALKDGQG

SEQ ID NO: 710293 - protein, 23 aa, Mycobacterium
PPLNMDPRWVGAHVGHTVGKYAE

SEQ ID NO: 710294 - protein, 27 aa, Mycobacterium
PPLNMNPRWLGAHPAYTLSKYGMTLLS

SEQ ID NO: 710295 - protein, 19 aa, Mycobacterium
PPLPATRLLPRQVPNRKDA

SEQ ID NO: 710296 - protein, 23 aa, Mycobacterium
PPLPELPLLYFGIPANDQLEQYW

SEQ ID NO: 710297 - protein, 19 aa, Mycobacterium
PPLPEPLPVGPTRRAPLGL

SEQ ID NO: 710298 - protein, 22 aa, Mycobacterium
PPLPFADEAFDLVISRHPITVW

SEQ ID NO: 710299 - protein, 17 aa, Mycobacterium
PPLPHGLLITHVNLGLD

SEQ ID NO: 710300 - protein, 19 aa, Mycobacterium
PPLPHPPRRVPVVGDVFGF

SEQ ID NO: 710301 - protein, 21 aa, Mycobacterium
PPLPPWQATPTVISPPRPSAA

SEQ ID NO: 710302 - protein, 17 aa, Mycobacterium
PPLPTYFLPNNRGKKSV

SEQ ID NO: 710303 - protein, 19 aa, Mycobacterium
PPLPYQRVKALRLDTEGRP

SEQ ID NO: 710304 - protein, 21 aa, Mycobacterium
PPLQQLLRLLPGCKAPSSSGG

SEQ ID NO: 710305 - protein, 25 aa, Mycobacterium
PPLQRLALDRVLLRAGADGPATDQR

SEQ ID NO: 710306 - protein, 17 aa, Mycobacterium
PPLRALLGLPITVRGAD

SEQ ID NO: 710307 - protein, 24 aa, Mycobacterium
PPLREVSDTLALRQALADGVIDCV

SEQ ID NO: 710308 - protein, 19 aa, Mycobacterium
PPLRGPVTFDQRWRDLTFL

SEQ ID NO: 710309 - protein, 18 aa, Mycobacterium
PPLRLAIIDYLAKHPHSS

SEQ ID NO: 710310 - protein, 18 aa, Mycobacterium
PPLRLCTDNGAMIASFAA

SEQ ID NO: 710311 - protein, 17 aa, Mycobacterium
PPLRVTQPYVDRLEVWC

SEQ ID NO: 710312 - protein, 20 aa, Mycobacterium
PPLSKEFLCDTAASDDLWIL

SEQ ID NO: 710313 - protein, 19 aa, Mycobacterium
PPLSLWARLPGFTVADLDA

SEQ ID NO: 710314 - protein, 28 aa, Mycobacterium
PPLTMKPDVCWQLPIRRSQEWVTRPDGT

SEQ ID NO: 710315 - protein, 24 aa, Mycobacterium
PPLTYRDALRIARAVVANPSTQLR

SEQ ID NO: 710316 - protein, 20 aa, Mycobacterium
PPLYAEHWEPLWAACADAGL

SEQ ID NO: 710317 - protein, 21 aa, Mycobacterium
PPMIRYPIPPMIHGATQSATW

SEQ ID NO: 710318 - protein, 21 aa, Mycobacterium
PPMKWNAWGDPAAAKPLSEGI

SEQ ID NO: 710319 - protein, 21 aa, Mycobacterium
PPMRLEPKMLPNGSQDNGEIL

SEQ ID NO: 710320 - protein, 19 aa, Mycobacterium
PPMTVPWLIGVARHKLADH

SEQ ID NO: 710321 - protein, 21 aa, Mycobacterium
PPMVRYPIPPMIHGATQSATW

SEQ ID NO: 710322 - protein, 22 aa, Mycobacterium
PPMVRYPIPPMIHGATQSATWM

SEQ ID NO: 710323 - protein, 22 aa, Mycobacterium
PPNAGTLIRLFHAETTELEVDT

SEQ ID NO: 710324 - protein, 26 aa, Mycobacterium
PPNDWQSVFGGPAWTRITDGPLQGQW

SEQ ID NO: 710325 - protein, 18 aa, Mycobacterium
PPNGTGTHRYRFTLYQLP

SEQ ID NO: 710326 - protein, 22 aa, Mycobacterium
PPNHPPMRTFLGVPVRTRDKVF

SEQ ID NO: 710327 - protein, 19 aa, Mycobacterium
PPNMCYAGVPVKANRSTHG

SEQ ID NO: 710328 - protein, 24 aa, Mycobacterium
PPNTRCALGLYVGAGMTAGQVWFD

SEQ ID NO: 710329 - protein, 25 aa, Mycobacterium
PPNVLSARHFDAWWRKQRLKTPDLL

SEQ ID NO: 710330 - protein, 20 aa, Mycobacterium
PPPAPPRWEPDADFELDYHM

SEQ ID NO: 710331 - protein, 18 aa, Mycobacterium
PPPAPRALLALLKGPPPN

SEQ ID NO: 710332 - protein, 18 aa, Mycobacterium
PPPASVFVNLELAEDTYA

SEQ ID NO: 710333 - protein, 18 aa, Mycobacterium
PPPDINWIVVRMTDAPGN

SEQ ID NO: 710334 - protein, 25 aa, Mycobacterium
PPPDPGQICYLGFTSGTTGEPKGAM

SEQ ID NO: 710335 - protein, 23 aa, Mycobacterium
PPPDQCPLCPSPTGLTSEVPARD

SEQ ID NO: 710336 - protein, 23 aa, Mycobacterium
PPPESLPIAGMVSFDETRVAVTA

SEQ ID NO: 710337 - protein, 23 aa, Mycobacterium
PPPETLDFWQWVNASDEDAPIEP

SEQ ID NO: 710338 - protein, 17 aa, Mycobacterium
PPPFTSWQPPGVPPVPP

SEQ ID NO: 710339 - protein, 17 aa, Mycobacterium
PPPFVPDEHQLRVMLDV

SEQ ID NO: 710340 - protein, 17 aa, Mycobacterium
PPPGCSAAVAPVGQVGL

SEQ ID NO: 710341 - protein, 23 aa, Mycobacterium
PPPGELWEPGPVLAQPPDPDGSV

SEQ ID NO: 710342 - protein, 18 aa, Mycobacterium
PPPGSRGRMEGLLVDLWD

SEQ ID NO: 710343 - protein, 17 aa, Mycobacterium
PPPHALQFAMFSSPELG

SEQ ID NO: 710344 - protein, 17 aa, Mycobacterium
PPPIAVIDIIFGAFLSQ

SEQ ID NO: 710345 - protein, 23 aa, Mycobacterium
PPPIREIPLLLGGSGERKTLPLV

SEQ ID NO: 710346 - protein, 20 aa, Mycobacterium
PPPKTTVTFSDGRTAPFTVV

SEQ ID NO: 710347 - protein, 17 aa, Mycobacterium
PPPLAWAVNEMIICANP

SEQ ID NO: 710348 - protein, 17 aa, Mycobacterium
PPPLGPRDAALVKAMQA

SEQ ID NO: 710349 - protein, 26 aa, Mycobacterium
PPPPGFSEGFSDRWFATEQGIKNLFG

SEQ ID NO: 710350 - protein, 23 aa, Mycobacterium
PPPPPPRWRPRPAEPVAPAEPVE

SEQ ID NO: 710351 - protein, 28 aa, Mycobacterium
PPPPPPTTRMRWPLGSVQVNRYFGGNGH

SEQ ID NO: 710352 - protein, 26 aa, Mycobacterium
PPPPRGGEEPRWIYYSSGTTAAPKGA

SEQ ID NO: 710353 - protein, 18 aa, Mycobacterium
PPPPWFADSVGAARQVVE

SEQ ID NO: 710354 - protein, 19 aa, Mycobacterium
PPPQCKPEDIAKLQAKVDD

SEQ ID NO: 710355 - protein, 18 aa, Mycobacterium
PPPRAPHPTPPTTSTACG

SEQ ID NO: 710356 - protein, 17 aa, Mycobacterium
PPPRAVDRAVALLAAAR

SEQ ID NO: 710357 - protein, 21 aa, Mycobacterium
PPPRLMLFCGMSIGYEDPSVD

SEQ ID NO: 710358 - protein, 19 aa, Mycobacterium
PPPRRWLTATWSITASSTP

SEQ ID NO: 710359 - protein, 22 aa, Mycobacterium
PPPTASAGTGWRKRKQQKYEDV

SEQ ID NO: 710360 - protein, 17 aa, Mycobacterium
PPPTFAEVSFSTYRPDP

SEQ ID NO: 710361 - protein, 21 aa, Mycobacterium
PPPTLKVAMNYIGGFRNTMTM

SEQ ID NO: 710362 - protein, 21 aa, Mycobacterium
PPPTRGSLCTFRETARTLAGL

SEQ ID NO: 710363 - protein, 24 aa, Mycobacterium
PPPVARFLVDWAVRDPGHAVLEPS

SEQ ID NO: 710364 - protein, 18 aa, Mycobacterium
PPPVHGATYQLEYGTATL

SEQ ID NO: 710365 - protein, 23 aa, Mycobacterium
PPPVPLDAAILFAPVGDLVLPAC

SEQ ID NO: 710366 - protein, 23 aa, Mycobacterium
PPPVPLDAAILFAPVGELVLPAL

SEQ ID NO: 710367 - protein, 24 aa, Mycobacterium
PPPVPLDAAILFAPVGELVLPALA

SEQ ID NO: 710368 - protein, 18 aa, Mycobacterium
PPPWGIRRDALGVHALST

SEQ ID NO: 710369 - protein, 25 aa, Mycobacterium
PPPWLDPGQWWALVRVGCAGRLLYS

SEQ ID NO: 710370 - protein, 25 aa, Mycobacterium
PPPWLEPGQWWALVRVGCAGGLVYS

SEQ ID NO: 710371 - protein, 19 aa, Mycobacterium
PPPYPGWPADYGVADADIE

SEQ ID NO: 710372 - protein, 18 aa, Mycobacterium
PPQADWLDPMIALSFAAA

SEQ ID NO: 710373 - protein, 25 aa, Mycobacterium
PPQDFSGIVGHRFIYTYANGWQYEM

SEQ ID NO: 710374 - protein, 17 aa, Mycobacterium
PPQGDWLRRYTASCSPV

SEQ ID NO: 710375 - protein, 26 aa, Mycobacterium
PPQPLTRPRIVVFAGDHGVTKSGVSA

SEQ ID NO: 710376 - protein, 18 aa, Mycobacterium
PPQRSWRAAASGLIDAIV

SEQ ID NO: 710377 - protein, 25 aa, Mycobacterium
PPQWLPGPRELRAWTLAAGTPEADR

SEQ ID NO: 710378 - protein, 17 aa, Mycobacterium
PPRALVLLHLDGSADRP

SEQ ID NO: 710379 - protein, 17 aa, Mycobacterium
PPRAVAIVRQIGSALDA

SEQ ID NO: 710380 - protein, 17 aa, Mycobacterium
PPRAVPRAHRFPSGPVS

SEQ ID NO: 710381 - protein, 17 aa, Mycobacterium
PPRCFVDTIATDGVTSL

SEQ ID NO: 710382 - protein, 26 aa, Mycobacterium
PPRCGWSVPCAKSWAPSKARSRGWPI

SEQ ID NO: 710383 - protein, 21 aa, Mycobacterium
PPRDPLVLRMMVPPLPPPPPS

SEQ ID NO: 710384 - protein, 19 aa, Mycobacterium
PPRDVTALAAAVCAVLADP

SEQ ID NO: 710385 - protein, 17 aa, Mycobacterium
PPREGLATYRIDVGKRH

SEQ ID NO: 710386 - protein, 26 aa, Mycobacterium
PPREPFPGITIKLLWEGDNGAKAVVT

SEQ ID NO: 710387 - protein, 17 aa, Mycobacterium
PPRESRIDWGIADRSAH

SEQ ID NO: 710388 - protein, 17 aa, Mycobacterium
PPRGFGLDGQRPRAAGE

SEQ ID NO: 710389 - protein, 26 aa, Mycobacterium
PPRIPIPMPVMRAAARLNDLAARLLR

SEQ ID NO: 710390 - protein, 19 aa, Mycobacterium
PPRITLCCMRFGNDDEQLG

SEQ ID NO: 710391 - protein, 18 aa, Mycobacterium
PPRLAAMTTAAARVGHPD

SEQ ID NO: 710392 - protein, 24 aa, Mycobacterium
PPRLAEAWDSVGLVCGDPDDKLES

SEQ ID NO: 710393 - protein, 23 aa, Mycobacterium
PPRLAEPWDSVGLVCGDPDDAVE

SEQ ID NO: 710394 - protein, 19 aa, Mycobacterium
PPRLRIWLRANGEVTDDPL

SEQ ID NO: 710395 - protein, 17 aa, Mycobacterium
PPRLSRYSLSTSSLSAH

SEQ ID NO: 710396 - protein, 18 aa, Mycobacterium
PPRLSRYSVAHAQTRGTD

SEQ ID NO: 710397 - protein, 28 aa, Mycobacterium
PPRPAKEGEEVLDFGALPPELNSARMYS

SEQ ID NO: 710398 - protein, 30 aa, Mycobacterium
PPRPEAPRRPGPPPPATTWRSPSPPAAPQP

SEQ ID NO: 710399 - protein, 20 aa, Mycobacterium
PPRRAAAAAGRIQAAPLRQR

SEQ ID NO: 710400 - protein, 18 aa, Mycobacterium
PPRRKRLDPARQAAFDVL

SEQ ID NO: 710401 - protein, 17 aa, Mycobacterium
PPRRLDHDLRPGHPDLS

SEQ ID NO: 710402 - protein, 20 aa, Mycobacterium
PPRRRCLEAQIMDWSDDVAY

SEQ ID NO: 710403 - protein, 20 aa, Mycobacterium
PPRRRFHPRGPDGPEMAFYR

SEQ ID NO: 710404 - protein, 21 aa, Mycobacterium
PPRRRHTLAFLRAIRPTAPVY

SEQ ID NO: 710405 - protein, 23 aa, Mycobacterium
PPRTAREFREFADLMPSPVIGEN

SEQ ID NO: 710406 - protein, 24 aa, Mycobacterium
PPRVKVPALLRGYLRLGAQVCGEP

SEQ ID NO: 710407 - protein, 26 aa, Mycobacterium
PPRVPPTPATWGWMLQLYGLRSSRSW

SEQ ID NO: 710408 - protein, 22 aa, Mycobacterium
PPRVRAALLHMVWRHELLIDLG

SEQ ID NO: 710409 - protein, 25 aa, Mycobacterium
PPRWLPGPRELRAWALAAGSPEADR

SEQ ID NO: 710410 - protein, 23 aa, Mycobacterium
PPRWLPGPRELRTWTLAAGSPEA

SEQ ID NO: 710411 - protein, 18 aa, Mycobacterium
PPRWSGELYLELHRGTYT

SEQ ID NO: 710412 - protein, 25 aa, Mycobacterium
PPSAELRSEVAIVCQLARTLLGPDH

SEQ ID NO: 710413 - protein, 18 aa, Mycobacterium
PPSALFRLVNPVMGLLLR

SEQ ID NO: 710414 - protein, 18 aa, Mycobacterium
PPSAVTLVPPFPPVPAEP

SEQ ID NO: 710415 - protein, 20 aa, Mycobacterium
PPSDFAEQWVEVINTAADCG

SEQ ID NO: 710416 - protein, 19 aa, Mycobacterium
PPSEEWSAHPVIVAVVEDL

SEQ ID NO: 710417 - protein, 18 aa, Mycobacterium
PPSGALSGIAKREMRGVP

SEQ ID NO: 710418 - protein, 23 aa, Mycobacterium
PPSGDPLRRWGPFPPEGPHPERS

SEQ ID NO: 710419 - protein, 24 aa, Mycobacterium
PPSGLSKLLFRAPISMFRANLGWM

SEQ ID NO: 710420 - protein, 19 aa, Mycobacterium
PPSHPFRRMSIPDDSVLFS

SEQ ID NO: 710421 - protein, 24 aa, Mycobacterium
PPSIPGDSGGPVWTPTSQGYAQII

SEQ ID NO: 710422 - protein, 19 aa, Mycobacterium
PPSLGLLTINALVAAPEVL

SEQ ID NO: 710423 - protein, 18 aa, Mycobacterium
PPSPDIVQLFGRGVSLQQ

SEQ ID NO: 710424 - protein, 19 aa, Mycobacterium
PPSPFPVITNPAGGFGTLA

SEQ ID NO: 710425 - protein, 22 aa, Mycobacterium
PPSPKPPVAPMVTGAPPTPTPP

SEQ ID NO: 710426 - protein, 20 aa, Mycobacterium
PPSPPRRLVFEVTPTLDRAI

SEQ ID NO: 710427 - protein, 27 aa, Mycobacterium
PPSPPTLLWPIGVPFSDGLNTLAQFKV

SEQ ID NO: 710428 - protein, 19 aa, Mycobacterium
PPSPRRGPVKRAPKPAKPA

SEQ ID NO: 710429 - protein, 21 aa, Mycobacterium
PPSQANFIWLPLGARTTDFTE

SEQ ID NO: 710430 - protein, 22 aa, Mycobacterium
PPSQANFVWLPLAERTLDFVAR

SEQ ID NO: 710431 - protein, 21 aa, Mycobacterium
PPSQANFVWLPLEDRTTDFVT

SEQ ID NO: 710432 - protein, 24 aa, Mycobacterium
PPSQEWTRYPALTVIISELQRAQQ

SEQ ID NO: 710433 - protein, 24 aa, Mycobacterium
PPSQSNFVWLPLGSRTMDFTEQAA

SEQ ID NO: 710434 - protein, 22 aa, Mycobacterium
PPSSGLPSWAIAGLARQDLLLS

SEQ ID NO: 710435 - protein, 20 aa, Mycobacterium
PPSTPICSSVLEVAHAPKAA

SEQ ID NO: 710436 - protein, 28 aa, Mycobacterium
PPSVADEFTRLALFLSTPAARHITGQTL

SEQ ID NO: 710437 - protein, 37 aa, Mycobacterium
PPSVPRLLHPVARALARPGLRLNYLSIVGLLDPRLRA

SEQ ID NO: 710438 - protein, 20 aa, Mycobacterium
PPSYEQRPPAPGGYGAQGYD

SEQ ID NO: 710439 - protein, 18 aa, Mycobacterium
PPTAFGIEKSRVGEAVVV

SEQ ID NO: 710440 - protein, 20 aa, Mycobacterium
PPTARGWEVVAGDEIWNWTD

SEQ ID NO: 710441 - protein, 24 aa, Mycobacterium
PPTARVVAILDFLARHPHDRFGLS

SEQ ID NO: 710442 - protein, 22 aa, Mycobacterium
PPTDTFPVLALLARRLSNDEAK

SEQ ID NO: 710443 - protein, 22 aa, Mycobacterium
PPTDTFPVLALLARRLSNDEVK

SEQ ID NO: 710444 - protein, 21 aa, Mycobacterium
PPTFISCAEIDPCRDEAIDYA

SEQ ID NO: 710445 - protein, 31 aa, Mycobacterium
PPTGFQRLLWRLPITLFRAHLGFLVTKRIML

SEQ ID NO: 710446 - protein, 17 aa, Mycobacterium
PPTGWALATPQQPLWWH

SEQ ID NO: 710447 - protein, 18 aa, Mycobacterium
PPTHKVWAAESGFLFPVL

SEQ ID NO: 710448 - protein, 25 aa, Mycobacterium
PPTKRELAATYVLRMPLDMSSVKVR

SEQ ID NO: 710449 - protein, 26 aa, Mycobacterium
PPTLFRAELMLAWLADVTAGAPDHGT

SEQ ID NO: 710450 - protein, 21 aa, Mycobacterium
PPTLLGSLLLDAGVTPWITLS

SEQ ID NO: 710451 - protein, 19 aa, Mycobacterium
PPTLLPRGVENWPVTVSYD

SEQ ID NO: 710452 - protein, 18 aa, Mycobacterium
PPTLLPVGVDGWPVTVSG

SEQ ID NO: 710453 - protein, 18 aa, Mycobacterium
PPTLLPVGVDGWPVTVSN

SEQ ID NO: 710454 - protein, 21 aa, Mycobacterium
PPTLRALGRRKKIGLGPRSHV

SEQ ID NO: 710455 - protein, 17 aa, Mycobacterium
PPTPPAPAAVAPAPAAP

SEQ ID NO: 710456 - protein, 19 aa, Mycobacterium
PPTPRGAAIEARLYAEDPA

SEQ ID NO: 710457 - protein, 21 aa, Mycobacterium
PPTQYRIAPSAAIAPPPPGIV

SEQ ID NO: 710458 - protein, 25 aa, Mycobacterium
PPTTARPAGMPPWDATPVTGIQRVD

SEQ ID NO: 710459 - protein, 27 aa, Mycobacterium
PPTTFPKWLGRSWIRSAMLRYGENPHQ

SEQ ID NO: 710460 - protein, 19 aa, Mycobacterium
PPVAAAWNPLVDSLSAPAS

SEQ ID NO: 710461 - protein, 21 aa, Mycobacterium
PPVDELEHFIDLIARIESAAA

SEQ ID NO: 710462 - protein, 19 aa, Mycobacterium
PPVGALRLRAPRPIEPWEG

SEQ ID NO: 710463 - protein, 17 aa, Mycobacterium
PPVGIEITHRAVGTNLV

SEQ ID NO: 710464 - protein, 17 aa, Mycobacterium
PPVIPRGVCDPIAGLHA

SEQ ID NO: 710465 - protein, 18 aa, Mycobacterium
PPVLFWMHGGGMVIGNRH

SEQ ID NO: 710466 - protein, 25 aa, Mycobacterium
PPVLRKLVWRLPARLQPKPEAVAWA

SEQ ID NO: 710467 - protein, 26 aa, Mycobacterium
PPVLRRHILENPAWYTAYTPYQPEIS

SEQ ID NO: 710468 - protein, 26 aa, Mycobacterium
PPVLRRNIIENPAWYTAYTPYQPEIS

SEQ ID NO: 710469 - protein, 27 aa, Mycobacterium
PPVLYELPHGLPFTELLALHGVPADQV

SEQ ID NO: 710470 - protein, 26 aa, Mycobacterium
PPVLYELPHGLPFTELLALHGVSPEA

SEQ ID NO: 710471 - protein, 17 aa, Mycobacterium
PPVNVCVGGGRRVHVSG

SEQ ID NO: 710472 - protein, 18 aa, Mycobacterium
PPVPELRSGRSARENLLA

SEQ ID NO: 710473 - protein, 24 aa, Mycobacterium
PPVPRRELAGGAWLEVHHEWLGRA

SEQ ID NO: 710474 - protein, 17 aa, Mycobacterium
PPVPTGDGAALDFSIDA

SEQ ID NO: 710475 - protein, 20 aa, Mycobacterium
PPVRELMGYQWSRRDEWLHR

SEQ ID NO: 710476 - protein, 29 aa, Mycobacterium
PPVRELMGYRWSRRDEWLHRRFGDLVRFV

SEQ ID NO: 710477 - protein, 20 aa, Mycobacterium
PPVRTLMGYQWSRRDEWLHR

SEQ ID NO: 710478 - protein, 32 aa, Mycobacterium
PPVSRYVLEAAGFALAKICDRSDFPRIAALIR

SEQ ID NO: 710479 - protein, 17 aa, Mycobacterium
PPVVFWPPNRGQYLSAL

SEQ ID NO: 710480 - protein, 17 aa, Mycobacterium
PPVVKDKFLAASSSDTV

SEQ ID NO: 710481 - protein, 23 aa, Mycobacterium
PPVVTRSTRRILLPDRNEIGRNI

SEQ ID NO: 710482 - protein, 18 aa, Mycobacterium
PPWAAEAFPDVAEDVRQS

SEQ ID NO: 710483 - protein, 17 aa, Mycobacterium
PPWDPGAALVVRSDIEA

SEQ ID NO: 710484 - protein, 17 aa, Mycobacterium
PPWDSFPRSEPYVVVLV

SEQ ID NO: 710485 - protein, 18 aa, Mycobacterium
PPWELHVIEGLEGGRFAL

SEQ ID NO: 710486 - protein, 19 aa, Mycobacterium
PPWFVRAGLDVRRTEYPSS

SEQ ID NO: 710487 - protein, 28 aa, Mycobacterium
PPWLRRWARDGYAWAQPRFSPVARSALP

SEQ ID NO: 710488 - protein, 21 aa, Mycobacterium
PPWLRRWVRDGYAWVQPRLSP

SEQ ID NO: 710489 - protein, 20 aa, Mycobacterium
PPWLRRWVRDGYGWLQPRLS

SEQ ID NO: 710490 - protein, 22 aa, Mycobacterium
PPWLRRWVRDGYGWVQPRLSPI

SEQ ID NO: 710491 - protein, 18 aa, Mycobacterium
PPWPYTFNLCVSNVPGPR

SEQ ID NO: 710492 - protein, 17 aa, Mycobacterium
PPWQGGGNMIADVTLQR

SEQ ID NO: 710493 - protein, 25 aa, Mycobacterium
PPWSAADLHRARGYAERIYGLIEGQ

SEQ ID NO: 710494 - protein, 18 aa, Mycobacterium
PPWSIGQPQPEILKLIEQ

SEQ ID NO: 710495 - protein, 25 aa, Mycobacterium
PPWTLRAALPAALLSAADSMWSDEE

SEQ ID NO: 710496 - protein, 21 aa, Mycobacterium
PPWVAPGEWWALIRVGCAGRL

SEQ ID NO: 710497 - protein, 19 aa, Mycobacterium
PPWVLPRTNVEFGALAKRA

SEQ ID NO: 710498 - protein, 18 aa, Mycobacterium
PPWWLKPANKVFIQLSRL

SEQ ID NO: 710499 - protein, 19 aa, Mycobacterium
PPYDLTYDDVFVVPNHSDV

SEQ ID NO: 710500 - protein, 18 aa, Mycobacterium
PPYDLTYNDVFVVPGRSE

SEQ ID NO: 710501 - protein, 17 aa, Mycobacterium
PPYFDGMGRQPQPVTDI

SEQ ID NO: 710502 - protein, 18 aa, Mycobacterium
PPYFDVPDVFTGFGDGGS

SEQ ID NO: 710503 - protein, 18 aa, Mycobacterium
PPYGFLVAALNRYRRLDE

SEQ ID NO: 710504 - protein, 18 aa, Mycobacterium
PPYHLARQLLSLDHLSSG

SEQ ID NO: 710505 - protein, 23 aa, Mycobacterium
PPYRVAPGIDCVPPGDLPRRGAH

SEQ ID NO: 710506 - protein, 18 aa, Mycobacterium
PPYSEGAWQRLTMACRQQ

SEQ ID NO: 710507 - protein, 17 aa, Mycobacterium
PQAAKWVVRVVLSLVYW

SEQ ID NO: 710508 - protein, 28 aa, Mycobacterium
PQAALLVRLLAERAGFCVIAGDPNQTVF

SEQ ID NO: 710509 - protein, 21 aa, Mycobacterium
PQAARDLCSRTEIFILAESLG

SEQ ID NO: 710510 - protein, 23 aa, Mycobacterium
PQAARIWLLQALTGRRASEILML

SEQ ID NO: 710511 - protein, 18 aa, Mycobacterium
PQAARRWGVAAGDRVAVE

SEQ ID NO: 710512 - protein, 20 aa, Mycobacterium
PQAEHGWHQHRVLDGIGHNV

SEQ ID NO: 710513 - protein, 29 aa, Mycobacterium
PQAFDGLRLAGRPVRRPDLTIATEDHNVP

SEQ ID NO: 710514 - protein, 28 aa, Mycobacterium
PQAFDGLRLAGRPVRRPDLTLATEDHNV

SEQ ID NO: 710515 - protein, 24 aa, Mycobacterium
PQAFDGLRLAGRQVRRPDLTIATE

SEQ ID NO: 710516 - protein, 23 aa, Mycobacterium
PQAFDGLRLAGRRVRRPDLTIAT

SEQ ID NO: 710517 - protein, 27 aa, Mycobacterium
PQAGDPGRLFGRMLGCDLGMNPPFEMD

SEQ ID NO: 710518 - protein, 24 aa, Mycobacterium
PQAGMPPGLVRRSTKEAEGQKGAA

SEQ ID NO: 710519 - protein, 17 aa, Mycobacterium
PQAGPLWGIPVAVKDIY

SEQ ID NO: 710520 - protein, 25 aa, Mycobacterium
PQALLGNAFHSWVQRFYGAELLFDL

SEQ ID NO: 710521 - protein, 19 aa, Mycobacterium
PQALRIWFGVTPVPRRNGK

SEQ ID NO: 710522 - protein, 23 aa, Mycobacterium
PQANELAIDFALAANHRVEEIGP

SEQ ID NO: 710523 - protein, 20 aa, Mycobacterium
PQANSALEFDRAAAHGYRFD

SEQ ID NO: 710524 - protein, 17 aa, Mycobacterium
PQAPALLFLHGSGGHAE

SEQ ID NO: 710525 - protein, 21 aa, Mycobacterium
PQAPIPLPFADIAVVTRRSRR

SEQ ID NO: 710526 - protein, 31 aa, Mycobacterium
PQAPRPEPPVARPAPEPPPRPAPEPVAPPPP

SEQ ID NO: 710527 - protein, 24 aa, Mycobacterium
PQAQRRIRRVWANIRTEVLGGQYL

SEQ ID NO: 710528 - protein, 25 aa, Mycobacterium
PQARARAGWLWSRRRGIVAGLAASA

SEQ ID NO: 710529 - protein, 22 aa, Mycobacterium
PQARRRGIATAMVRAALAKTGG

SEQ ID NO: 710530 - protein, 25 aa, Mycobacterium
PQATAGAPAHDWLTLTGGAIGYGIP

SEQ ID NO: 710531 - protein, 28 aa, Mycobacterium
PQAYREFLTEIGYLLPAPEDFTITTSGV

SEQ ID NO: 710532 - protein, 17 aa, Mycobacterium
PQCGVVLDTDPDHHHDQ

SEQ ID NO: 710533 - protein, 23 aa, Mycobacterium
PQCRLRADAILRRRTDRLPLGAP

SEQ ID NO: 710534 - protein, 24 aa, Mycobacterium
PQDCAAATLFLCTDAASYITGTTI

SEQ ID NO: 710535 - protein, 17 aa, Mycobacterium
PQDGAVITGWDYPSCEA

SEQ ID NO: 710536 - protein, 24 aa, Mycobacterium
PQDGPLVICGHGFPDSAHTWRLLG

SEQ ID NO: 710537 - protein, 29 aa, Mycobacterium
PQDGRAVVLLHGWPENWWMWHKVIPALAA

SEQ ID NO: 710538 - protein, 26 aa, Mycobacterium
PQDIEWVIADGAVWLVQARPITTLGS

SEQ ID NO: 710539 - protein, 30 aa, Mycobacterium
PQDIRIAWRAWLQMRVRIVDEYNRIPTRTQ

SEQ ID NO: 710540 - protein, 25 aa, Mycobacterium
PQDLRRRIALRQSVEMVRTTMEYFE

SEQ ID NO: 710541 - protein, 22 aa, Mycobacterium
PQDPGTLCGPVISARQQARILG

SEQ ID NO: 710542 - protein, 22 aa, Mycobacterium
PQDPGTLCGPVISEVQRNRVMG

SEQ ID NO: 710543 - protein, 22 aa, Mycobacterium
PQDPGTLCGPVISQRQLDRVTG

SEQ ID NO: 710544 - protein, 26 aa, Mycobacterium
PQDPRPRLVGALAMAVVRIALDDWLG

SEQ ID NO: 710545 - protein, 26 aa, Mycobacterium
PQEALPRWRRIMEGLRHSKTRDAEAI

SEQ ID NO: 710546 - protein, 27 aa, Mycobacterium
PQEAPPRWRRLAEGLLHSRSRDAEAIH

SEQ ID NO: 710547 - protein, 19 aa, Mycobacterium
PQEDRRKLFDWSNQMVGNQ

SEQ ID NO: 710548 - protein, 25 aa, Mycobacterium
PQEISARVLMKLKRDAESYLGEDIT

SEQ ID NO: 710549 - protein, 21 aa, Mycobacterium
PQELAKFFILLIGAGNETTRN

SEQ ID NO: 710550 - protein, 23 aa, Mycobacterium
PQETRTRLALLRGGLPRPQTQIV

SEQ ID NO: 710551 - protein, 32 aa, Mycobacterium
PQEVLGRGLVVRRLDMLPVECVARGYLTGSGL

SEQ ID NO: 710552 - protein, 19 aa, Mycobacterium
PQEWHWDKDAAVRRLSEAY

SEQ ID NO: 710553 - protein, 26 aa, Mycobacterium
PQFCEGRGPFRWVALSGDPKDIHATD

SEQ ID NO: 710554 - protein, 20 aa, Mycobacterium
PQFHPSYRQASVVRREIGVP

SEQ ID NO: 710555 - protein, 17 aa, Mycobacterium
PQFKPKPLFYRQPIYYM

SEQ ID NO: 710556 - protein, 24 aa, Mycobacterium
PQFNFPAPAHWYFPTQADGSVNAN

SEQ ID NO: 710557 - protein, 26 aa, Mycobacterium
PQFNKFGNFRGWAAAHGRHSNIGYDA

SEQ ID NO: 710558 - protein, 23 aa, Mycobacterium
PQFNKFGNFRGWAKAHGKHSNIG

SEQ ID NO: 710559 - protein, 20 aa, Mycobacterium
PQFQRWSISLLSWILNPERG

SEQ ID NO: 710560 - protein, 17 aa, Mycobacterium
PQFSRASALLAQALDPF

SEQ ID NO: 710561 - protein, 18 aa, Mycobacterium
PQFSRASALLAQALDPFS

SEQ ID NO: 710562 - protein, 19 aa, Mycobacterium
PQFTIAWPTGEIGGMGLEG

SEQ ID NO: 710563 - protein, 25 aa, Mycobacterium
PQFYAELLKGLGLDGADLPAQNDIS

SEQ ID NO: 710564 - protein, 19 aa, Mycobacterium
PQGAFGFRHNPIHLMTIDG

SEQ ID NO: 710565 - protein, 19 aa, Mycobacterium
PQGAFGFRHNPIHVMTVDG

SEQ ID NO: 710566 - protein, 24 aa, Mycobacterium
PQGAPRPRNVFDISSIPWTRFTGF

SEQ ID NO: 710567 - protein, 17 aa, Mycobacterium
PQGCLTFSLGHDPDKLP

SEQ ID NO: 710568 - protein, 24 aa, Mycobacterium
PQGELAGAYLLVWTTTPWTLPSNL

SEQ ID NO: 710569 - protein, 19 aa, Mycobacterium
PQGELAWMFLQSTSDGGDL

SEQ ID NO: 710570 - protein, 23 aa, Mycobacterium
PQGELRVAIPVFVGIDYASRVGA

SEQ ID NO: 710571 - protein, 18 aa, Mycobacterium
PQGEPFATLPSMMHITLN

SEQ ID NO: 710572 - protein, 24 aa, Mycobacterium
PQGKRLGKTSGWVHRASVKAKGVH

SEQ ID NO: 710573 - protein, 19 aa, Mycobacterium
PQGLIPGFLMPPGDGSTGL

SEQ ID NO: 710574 - protein, 24 aa, Mycobacterium
PQGQALVFWDCYRPHDVQVKMFQV

SEQ ID NO: 710575 - protein, 24 aa, Mycobacterium
PQGRACAEHPMVLVDQLSKGGSHR

SEQ ID NO: 710576 - protein, 25 aa, Mycobacterium
PQGRLRAPVFNFIAPRLAGLPFSGA

SEQ ID NO: 710577 - protein, 22 aa, Mycobacterium
PQGRPILCTEYMARPLGSTVPD

SEQ ID NO: 710578 - protein, 20 aa, Mycobacterium
PQGRTAFFTAPYLADGPGGE

SEQ ID NO: 710579 - protein, 23 aa, Mycobacterium
PQGRTRFRPHFFPFTEPSAEVDI

SEQ ID NO: 710580 - protein, 18 aa, Mycobacterium
PQGTRLGKTSGWVHRASV

SEQ ID NO: 710581 - protein, 18 aa, Mycobacterium
PQGTVGEIWVHGDNVAMG

SEQ ID NO: 710582 - protein, 21 aa, Mycobacterium
PQGTVLRWAQLFGNPLTWSDL

SEQ ID NO: 710583 - protein, 29 aa, Mycobacterium
PQGVLRLAVRVWRRRPSMTMEAWNDPTLL

SEQ ID NO: 710584 - protein, 21 aa, Mycobacterium
PQGVSGLNAVVSWPAEEWGRD

SEQ ID NO: 710585 - protein, 17 aa, Mycobacterium
PQGWMKALRAYNQSDPY

SEQ ID NO: 710586 - protein, 17 aa, Mycobacterium
PQGWPKHPTYSGWLDSP

SEQ ID NO: 710587 - protein, 26 aa, Mycobacterium
PQHDPLFPLEWADRLEHYFVDVRLHT

SEQ ID NO: 710588 - protein, 17 aa, Mycobacterium
PQHELDLGLTPYCAPAE

SEQ ID NO: 710589 - protein, 25 aa, Mycobacterium
PQHFLYSKLMCWVALDRAIAMVDAL

SEQ ID NO: 710590 - protein, 24 aa, Mycobacterium
PQHGAELGLPMWPVSARTPAGLAA

SEQ ID NO: 710591 - protein, 20 aa, Mycobacterium
PQHGEPFLSAWTPVAQPQTI

SEQ ID NO: 710592 - protein, 17 aa, Mycobacterium
PQHHDMGLISAYLFIPL

SEQ ID NO: 710593 - protein, 22 aa, Mycobacterium
PQHIADAVAFLLSDQAAHITMH

SEQ ID NO: 710594 - protein, 21 aa, Mycobacterium
PQHPLRVVIHTAAVLHDAVLT

SEQ ID NO: 710595 - protein, 20 aa, Mycobacterium
PQHRGLREPFGAEVFHVNPV

SEQ ID NO: 710596 - protein, 17 aa, Mycobacterium
PQHRLFLQCAWHALEDA

SEQ ID NO: 710597 - protein, 25 aa, Mycobacterium
PQHRSIDLTLRWHRVGHDVLLVDSG

SEQ ID NO: 710598 - protein, 24 aa, Mycobacterium
PQHSWSQCHSYAFDYSVWEIFAAL

SEQ ID NO: 710599 - protein, 25 aa, Mycobacterium
PQHSWSQCHSYAFDYSVWEIFAALL

SEQ ID NO: 710600 - protein, 24 aa, Mycobacterium
PQHTRLRKIISRAFTPRAIERLRE

SEQ ID NO: 710601 - protein, 24 aa, Mycobacterium
PQHTRLRKIISRAFTPRAIERLRG

SEQ ID NO: 710602 - protein, 24 aa, Mycobacterium
PQHTRLRKIISRGFTPRAIGRLED

SEQ ID NO: 710603 - protein, 24 aa, Mycobacterium
PQHTRLRKIISRGFTPRAVGRLED

SEQ ID NO: 710604 - protein, 32 aa, Mycobacterium
PQHVPILLVCASRAGRELITRTGVTRFMPVYP

SEQ ID NO: 710605 - protein, 22 aa, Mycobacterium
PQHWGGGIAHGVERALAVVRAM

SEQ ID NO: 710606 - protein, 18 aa, Mycobacterium
PQIAAAGETMCFPGNVPH

SEQ ID NO: 710607 - protein, 17 aa, Mycobacterium
PQIANPAGTEWQAAAVA

SEQ ID NO: 710608 - protein, 22 aa, Mycobacterium
PQIDEWRQLRHVPVGGEALPGE

SEQ ID NO: 710609 - protein, 21 aa, Mycobacterium
PQIDLRVGSWYVSTHPESHFV

SEQ ID NO: 710610 - protein, 17 aa, Mycobacterium
PQIFPVNFVVQRRTILF

SEQ ID NO: 710611 - protein, 19 aa, Mycobacterium
PQIGGLDDWLALRSLQHGV

SEQ ID NO: 710612 - protein, 25 aa, Mycobacterium
PQILSESGWHTALFGMQHETSFPDR

SEQ ID NO: 710613 - protein, 18 aa, Mycobacterium
PQIPGIEEVSTWLDRHRP

SEQ ID NO: 710614 - protein, 17 aa, Mycobacterium
PQIPGIEQVSTWLERHR

SEQ ID NO: 710615 - protein, 17 aa, Mycobacterium
PQIQIAPALAWLRDHFG

SEQ ID NO: 710616 - protein, 21 aa, Mycobacterium
PQIRADLLASVDVIRADATEA

SEQ ID NO: 710617 - protein, 20 aa, Mycobacterium
PQIREMIGFELKRRHTLEFA

SEQ ID NO: 710618 - protein, 18 aa, Mycobacterium
PQITADWSKILVLSTPED

SEQ ID NO: 710619 - protein, 17 aa, Mycobacterium
PQKGGSWRDTKCSSPLG

SEQ ID NO: 710620 - protein, 17 aa, Mycobacterium
PQKPRYVVKPATAEEVS

SEQ ID NO: 710621 - protein, 17 aa, Mycobacterium
PQLAAAGSRLAAARQAA

SEQ ID NO: 710622 - protein, 19 aa, Mycobacterium
PQLARLAAAGGFRNWDSMV

SEQ ID NO: 710623 - protein, 20 aa, Mycobacterium
PQLARLAAIGGFRKWDRMVK

SEQ ID NO: 710624 - protein, 28 aa, Mycobacterium
PQLARLAAIGGFRNWDAMVGRYLSDPRL

SEQ ID NO: 710625 - protein, 18 aa, Mycobacterium
PQLASADGRGPVLVHALQ

SEQ ID NO: 710626 - protein, 17 aa, Mycobacterium
PQLATIGGLRFARRSSN

SEQ ID NO: 710627 - protein, 24 aa, Mycobacterium
PQLDAKILWQLKRALPGQFTRALG

SEQ ID NO: 710628 - protein, 24 aa, Mycobacterium
PQLDAKILWQLKRTMPGTFTHAMG

SEQ ID NO: 710629 - protein, 21 aa, Mycobacterium
PQLDAKLVWHLKRHIPNPYRW

SEQ ID NO: 710630 - protein, 18 aa, Mycobacterium
PQLGFRVEYDTAAFDKTA

SEQ ID NO: 710631 - protein, 18 aa, Mycobacterium
PQLIAAAHWEAIDNFERE

SEQ ID NO: 710632 - protein, 25 aa, Mycobacterium
PQLIERPADLTAEWLTDILGHGQVE

SEQ ID NO: 710633 - protein, 19 aa, Mycobacterium
PQLKIIANVAVGYDNIDVD

SEQ ID NO: 710634 - protein, 17 aa, Mycobacterium
PQLLAARHRIVLHEVGR

SEQ ID NO: 710635 - protein, 19 aa, Mycobacterium
PQLLCAAVELPLDQAEVRS

SEQ ID NO: 710636 - protein, 21 aa, Mycobacterium
PQLLGEQGWYSALFGMQHETS

SEQ ID NO: 710637 - protein, 19 aa, Mycobacterium
PQLPALRVPPAEFRNILRS

SEQ ID NO: 710638 - protein, 25 aa, Mycobacterium
PQLPEHFRQLAVDRLEVLAGDKSEP

SEQ ID NO: 710639 - protein, 33 aa, Mycobacterium
PQLPFLRQGCAAWNVPKAADWVRGVSDAAMPAL

SEQ ID NO: 710640 - protein, 17 aa, Mycobacterium
PQLPGWLETHSWNRPEW

SEQ ID NO: 710641 - protein, 22 aa, Mycobacterium
PQLPKIGERFLGTVVKTTDFGA

SEQ ID NO: 710642 - protein, 19 aa, Mycobacterium
PQLPLACVLEGGTWAAGRA

SEQ ID NO: 710643 - protein, 19 aa, Mycobacterium
PQLPYYSATSFDPRERPRC

SEQ ID NO: 710644 - protein, 25 aa, Mycobacterium
PQLRFGDGDTATWAERADKLAAAPH

SEQ ID NO: 710645 - protein, 19 aa, Mycobacterium
PQLRFQIGRWEYRDLIRES

SEQ ID NO: 710646 - protein, 17 aa, Mycobacterium
PQLRISDIGLWGSSEPV

SEQ ID NO: 710647 - protein, 25 aa, Mycobacterium
PQLRKYRSGGVGTHYYNTVRAAMGA

SEQ ID NO: 710648 - protein, 17 aa, Mycobacterium
PQLRMSGYNLAAIAAGL

SEQ ID NO: 710649 - protein, 22 aa, Mycobacterium
PQLRVDAVLSVARRAASLNWHA

SEQ ID NO: 710650 - protein, 25 aa, Mycobacterium
PQLSLLRLGATLGFTVVALDRPGHG

SEQ ID NO: 710651 - protein, 17 aa, Mycobacterium
PQLSLVPERIDSFGDDS

SEQ ID NO: 710652 - protein, 24 aa, Mycobacterium
PQLSRTAAVWHLCTPISGRLRDTS

SEQ ID NO: 710653 - protein, 21 aa, Mycobacterium
PQLVGGCRPISVSALLDHGWK

SEQ ID NO: 710654 - protein, 17 aa, Mycobacterium
PQLVGYVSELPRPGSYC

SEQ ID NO: 710655 - protein, 25 aa, Mycobacterium
PQLVPAWMIVTAWTRLCEHGTLSQV

SEQ ID NO: 710656 - protein, 20 aa, Mycobacterium
PQMECLAVLSAQPGISNVEI

SEQ ID NO: 710657 - protein, 20 aa, Mycobacterium
PQMRERRSGVVVNVTSSTTL

SEQ ID NO: 710658 - protein, 18 aa, Mycobacterium
PQMRLHAYPHQLSGGQRQ

SEQ ID NO: 710659 - protein, 25 aa, Mycobacterium
PQMSEVLPLLYLHGLSTSDFGPALE

SEQ ID NO: 710660 - protein, 17 aa, Mycobacterium
PQNAIAFIAELPRAQRD

SEQ ID NO: 710661 - protein, 22 aa, Mycobacterium
PQNKRIVFRFMVSPVEVGGQEH

SEQ ID NO: 710662 - protein, 25 aa, Mycobacterium
PQNLSDAGISWKVYNSKLLGGLNDT

SEQ ID NO: 710663 - protein, 26 aa, Mycobacterium
PQNRVRRYVCLKGPDHGGCGRLTVVA

SEQ ID NO: 710664 - protein, 18 aa, Mycobacterium
PQNTTWADMLAIWKAADN

SEQ ID NO: 710665 - protein, 17 aa, Mycobacterium
PQNTTWDDMLAIWKVAD

SEQ ID NO: 710666 - protein, 17 aa, Mycobacterium
PQNTTWQDMLAVWQTAD

SEQ ID NO: 710667 - protein, 25 aa, Mycobacterium
PQPAQAKCPLTLFVLEREAGPDCVW

SEQ ID NO: 710668 - protein, 18 aa, Mycobacterium
PQPELARLIDQGLVRSEV

SEQ ID NO: 710669 - protein, 21 aa, Mycobacterium
PQPEWEVAVGRLGHAIADHQD

SEQ ID NO: 710670 - protein, 17 aa, Mycobacterium
PQPGAAVLMTRDYQADP

SEQ ID NO: 710671 - protein, 18 aa, Mycobacterium
PQPGKSLILRYGPGVGQA

SEQ ID NO: 710672 - protein, 18 aa, Mycobacterium
PQPGPGTVKVKVGFNGIC

SEQ ID NO: 710673 - protein, 18 aa, Mycobacterium
PQPGVAVRMLTSGTTGPP

SEQ ID NO: 710674 - protein, 17 aa, Mycobacterium
PQPIAWPGSSDRNFYDR

SEQ ID NO: 710675 - protein, 23 aa, Mycobacterium
PQPICRYCRSHDLGVRDVSGRAT

SEQ ID NO: 710676 - protein, 17 aa, Mycobacterium
PQPIRRPPILIGGDGEK

SEQ ID NO: 710677 - protein, 21 aa, Mycobacterium
PQPLPRLSIVALPGHGPEDVV

SEQ ID NO: 710678 - protein, 19 aa, Mycobacterium
PQPMPAPRFSRTVPSRPRP

SEQ ID NO: 710679 - protein, 18 aa, Mycobacterium
PQPMQTFTELLSRTRDFA

SEQ ID NO: 710680 - protein, 25 aa, Mycobacterium
PQPPMRPDLLATFELSELEKYYTPE

SEQ ID NO: 710681 - protein, 17 aa, Mycobacterium
PQPRLLVLNEPLATELG

SEQ ID NO: 710682 - protein, 19 aa, Mycobacterium
PQPRLTAYRQLDRWLDHYL

SEQ ID NO: 710683 - protein, 24 aa, Mycobacterium
PQPSDFLHGRWLVLRRGKRNIAGV

SEQ ID NO: 710684 - protein, 23 aa, Mycobacterium
PQPTSVQGQWQWVPQQPQGPQSA

SEQ ID NO: 710685 - protein, 29 aa, Mycobacterium
PQPVEAWDGVRPCHRFRYCAPQPRRYTIV

SEQ ID NO: 710686 - protein, 25 aa, Mycobacterium
PQPVGFPGIVPVIGGASLPIRNVGP

SEQ ID NO: 710687 - protein, 20 aa, Mycobacterium
PQPVLQRLAALAGRRQQGSE

SEQ ID NO: 710688 - protein, 18 aa, Mycobacterium
PQPVWRPILETLTENFSR

SEQ ID NO: 710689 - protein, 17 aa, Mycobacterium
PQPWSGVRHCHGFTHCS

SEQ ID NO: 710690 - protein, 19 aa, Mycobacterium
PQQGEPFLSNWTPVSQPQT

SEQ ID NO: 710691 - protein, 20 aa, Mycobacterium
PQQGNLIFSYFVGVDNNAHM

SEQ ID NO: 710692 - protein, 18 aa, Mycobacterium
PQQGRPGEEYGREDDRYG

SEQ ID NO: 710693 - protein, 20 aa, Mycobacterium
PQQNMWWWDVLRHGRNSEYA

SEQ ID NO: 710694 - protein, 32 aa, Mycobacterium
PQQRAWLKLVRPLVITEGFALLSVPTPFVQNE

SEQ ID NO: 710695 - protein, 21 aa, Mycobacterium
PQQRAWLTLVKPLTMAEGFAL

SEQ ID NO: 710696 - protein, 19 aa, Mycobacterium
PQQRRRERRGASRDQGGPS

SEQ ID NO: 710697 - protein, 22 aa, Mycobacterium
PQQRVALRVAWRALEGTGINPD

SEQ ID NO: 710698 - protein, 23 aa, Mycobacterium
PQQRVALRVAWRALENAGINPDT

SEQ ID NO: 710699 - protein, 22 aa, Mycobacterium
PQQRVLLEVCWQALEHAGIDPT

SEQ ID NO: 710700 - protein, 23 aa, Mycobacterium
PQQRVSLRVAWRALENSGINPDD

SEQ ID NO: 710701 - protein, 20 aa, Mycobacterium
PQRAASVGFASGQLGEKPSD

SEQ ID NO: 710702 - protein, 21 aa, Mycobacterium
PQRAKGAFVYGLTQLDVRDGG

SEQ ID NO: 710703 - protein, 19 aa, Mycobacterium
PQRAQAVAIVRRTVPGATD

SEQ ID NO: 710704 - protein, 28 aa, Mycobacterium
PQREALKAALQFPAFAGPVFDSLTTDSF

SEQ ID NO: 710705 - protein, 21 aa, Mycobacterium
PQRFQVTASRFGRSVDVAAAV

SEQ ID NO: 710706 - protein, 19 aa, Mycobacterium
PQRGIRLDHNIIRCPNQVY

SEQ ID NO: 710707 - protein, 18 aa, Mycobacterium
PQRGRISTWPQPEAFNGV

SEQ ID NO: 710708 - protein, 21 aa, Mycobacterium
PQRKARLAVLAKNQQFINDAP

SEQ ID NO: 710709 - protein, 20 aa, Mycobacterium
PQRLEMSAGMSNDLESAVKH

SEQ ID NO: 710710 - protein, 25 aa, Mycobacterium
PQRLPILCGLDLTRKVAMTPQHLAR

SEQ ID NO: 710711 - protein, 21 aa, Mycobacterium
PQRNIEGWVAKKRPGSAADKA

SEQ ID NO: 710712 - protein, 24 aa, Mycobacterium
PQRPQRPQLVLARIARAVPALLWP

SEQ ID NO: 710713 - protein, 20 aa, Mycobacterium
PQRRARVMMRFIELVNKHND

SEQ ID NO: 710714 - protein, 19 aa, Mycobacterium
PQRRATLRATLTIPSPEGV

SEQ ID NO: 710715 - protein, 22 aa, Mycobacterium
PQRRELLRTMGIEHVYDSRSTE

SEQ ID NO: 710716 - protein, 21 aa, Mycobacterium
PQRREVGRGRAGRLVAPDAGF

SEQ ID NO: 710717 - protein, 20 aa, Mycobacterium
PQRRLVFRSDIPKLPRPLPR

SEQ ID NO: 710718 - protein, 21 aa, Mycobacterium
PQRRPHGAHSYYVPAQLFPTA

SEQ ID NO: 710719 - protein, 22 aa, Mycobacterium
PQRRPHGAHSYYVPAQLFPTAD

SEQ ID NO: 710720 - protein, 23 aa, Mycobacterium
PQRRPILHLPSHWPWAQQWLTLW

SEQ ID NO: 710721 - protein, 18 aa, Mycobacterium
PQRTAELATEYGVGSSIA

SEQ ID NO: 710722 - protein, 17 aa, Mycobacterium
PQRTKVITLMGFNPDSA

SEQ ID NO: 710723 - protein, 21 aa, Mycobacterium
PQRTRMVLVARAQRSALTEIA

SEQ ID NO: 710724 - protein, 21 aa, Mycobacterium
PQRVAHRDVLCPLIEAALKAK

SEQ ID NO: 710725 - protein, 23 aa, Mycobacterium
PQRVDAVLRAKVDGAWNLHEATR

SEQ ID NO: 710726 - protein, 18 aa, Mycobacterium
PQRVMCFQDSLQALLPWR

SEQ ID NO: 710727 - protein, 19 aa, Mycobacterium
PQRWAEPTPAPGWTIAHQI

SEQ ID NO: 710728 - protein, 23 aa, Mycobacterium
PQRWSELTPAPGWSIAHQIAHLL

SEQ ID NO: 710729 - protein, 18 aa, Mycobacterium
PQSAAARQPSPLPSVGPT

SEQ ID NO: 710730 - protein, 39 aa, Mycobacterium
PQSAKRVAGIGGLYGDFFNFYACDVTLKVDGLQPGGPVR

SEQ ID NO: 710731 - protein, 18 aa, Mycobacterium
PQSLHLYFVRGGRYDADV

SEQ ID NO: 710732 - protein, 21 aa, Mycobacterium
PQSLLTWKLSGPTTVNAIITA

SEQ ID NO: 710733 - protein, 24 aa, Mycobacterium
PQSLPFTGDLTVAAVLGIAPVLDA

SEQ ID NO: 710734 - protein, 26 aa, Mycobacterium
PQSLVWKYFGDNRMFLIGPRPAVLQN

SEQ ID NO: 710735 - protein, 20 aa, Mycobacterium
PQSLVWRYFGDNRMYLIGPR

SEQ ID NO: 710736 - protein, 26 aa, Mycobacterium
PQSRRELACATDLIGYHTYLNRIPVR

SEQ ID NO: 710737 - protein, 20 aa, Mycobacterium
PQSRRSWAVLGEMAELGADA

SEQ ID NO: 710738 - protein, 24 aa, Mycobacterium
PQSVELRVAAALENLAVLRTLVAA

SEQ ID NO: 710739 - protein, 22 aa, Mycobacterium
PQTAPYEWWEWHDAYGEHAPSR

SEQ ID NO: 710740 - protein, 21 aa, Mycobacterium
PQTFIPYLLDLHRQGKFPFDK

SEQ ID NO: 710741 - protein, 18 aa, Mycobacterium
PQTFSDLGPTYVKLGQII

SEQ ID NO: 710742 - protein, 17 aa, Mycobacterium
PQTGGVLVHRLMTSTDE

SEQ ID NO: 710743 - protein, 19 aa, Mycobacterium
PQTGSAYAVPRLVPVGDGG

SEQ ID NO: 710744 - protein, 25 aa, Mycobacterium
PQTLDGPNALSFVRQRHDLPRGDLD

SEQ ID NO: 710745 - protein, 17 aa, Mycobacterium
PQTMAFRGPTLPTDRQR

SEQ ID NO: 710746 - protein, 22 aa, Mycobacterium
PQTMWIEPLWKALLSNKAILAV

SEQ ID NO: 710747 - protein, 17 aa, Mycobacterium
PQTPYLLIRGTARVEEG

SEQ ID NO: 710748 - protein, 39 aa, Mycobacterium
PQTQIPLVDEWGMPLIRLDMGWEAAKIAVEYDGAHHQEN

SEQ ID NO: 710749 - protein, 26 aa, Mycobacterium
PQTRAECPTGIVGEIWVHGENVCAGY

SEQ ID NO: 710750 - protein, 23 aa, Mycobacterium
PQTRLPQRLFIKTQLGTVHDLPE

SEQ ID NO: 710751 - protein, 20 aa, Mycobacterium
PQTRQRWLVLTLPEQSDDVW

SEQ ID NO: 710752 - protein, 24 aa, Mycobacterium
PQTSDFLHGRWLVLRRGKRNIAGV

SEQ ID NO: 710753 - protein, 18 aa, Mycobacterium
PQVAEVFYRGDIDQRMVQ

SEQ ID NO: 710754 - protein, 19 aa, Mycobacterium
PQVDFIWVTGGPKIVALAN

SEQ ID NO: 710755 - protein, 22 aa, Mycobacterium
PQVDLRVGSWFVSTHPTSHFVT

SEQ ID NO: 710756 - protein, 17 aa, Mycobacterium
PQVEAVRGFADDVAERI

SEQ ID NO: 710757 - protein, 18 aa, Mycobacterium
PQVHRLRAAEHPRPEYVL

SEQ ID NO: 710758 - protein, 21 aa, Mycobacterium
PQVHTLLDFHFRPHVTAASGK

SEQ ID NO: 710759 - protein, 20 aa, Mycobacterium
PQVHVIRNGIDVTRWVFAPR

SEQ ID NO: 710760 - protein, 19 aa, Mycobacterium
PQVIERVWQTSGATAGLLS

SEQ ID NO: 710761 - protein, 19 aa, Mycobacterium
PQVIGRVFVGGGLPVDTYT

SEQ ID NO: 710762 - protein, 18 aa, Mycobacterium
PQVKRWVDRFTGHAISPE

SEQ ID NO: 710763 - protein, 25 aa, Mycobacterium
PQVLAGRYRLCLGYTEPEGGSDIAT

SEQ ID NO: 710764 - protein, 18 aa, Mycobacterium
PQVLVRIGLAPALDEVPP

SEQ ID NO: 710765 - protein, 20 aa, Mycobacterium
PQVLWRGGQVYIARVHGSRA

SEQ ID NO: 710766 - protein, 19 aa, Mycobacterium
PQVMDVYFLAGADDFILHV

SEQ ID NO: 710767 - protein, 19 aa, Mycobacterium
PQVPFKNVFLHGLIRDEFG

SEQ ID NO: 710768 - protein, 17 aa, Mycobacterium
PQVPGAMSTRPFLDLSA

SEQ ID NO: 710769 - protein, 17 aa, Mycobacterium
PQVPSPPGFGAANTPTD

SEQ ID NO: 710770 - protein, 17 aa, Mycobacterium
PQVQLRWTGHDDPDVVV

SEQ ID NO: 710771 - protein, 25 aa, Mycobacterium
PQVRDVPIAHGWCGVLAVPRDWEAS

SEQ ID NO: 710772 - protein, 25 aa, Mycobacterium
PQVRKRFGIRWNLADETAYRTLLRA

SEQ ID NO: 710773 - protein, 23 aa, Mycobacterium
PQVSDLRESGCMTANTRILRADT

SEQ ID NO: 710774 - protein, 19 aa, Mycobacterium
PQVVEGWYGQSFPKPLART

SEQ ID NO: 710775 - protein, 24 aa, Mycobacterium
PQVVEGWYGRPFPKPLARTREYID

SEQ ID NO: 710776 - protein, 18 aa, Mycobacterium
PQVVKEIAPVPVLAAGGI

SEQ ID NO: 710777 - protein, 25 aa, Mycobacterium
PQVWAMRYTLERLIRGKDTIAATGN

SEQ ID NO: 710778 - protein, 19 aa, Mycobacterium
PQVWDVLEEVIAEHPVLLN

SEQ ID NO: 710779 - protein, 18 aa, Mycobacterium
PQVWDVLEEVISEHPVLL

SEQ ID NO: 710780 - protein, 25 aa, Mycobacterium
PQWNEEIKGLWVLARYDDGRPSQLR

SEQ ID NO: 710781 - protein, 25 aa, Mycobacterium
PQWNEEVKGLWVLARYDDGRPSQLR

SEQ ID NO: 710782 - protein, 19 aa, Mycobacterium
PQWRDVHAGDYVRVPADVP

SEQ ID NO: 710783 - protein, 17 aa, Mycobacterium
PQWRFVAEWTSKGEILT

SEQ ID NO: 710784 - protein, 17 aa, Mycobacterium
PQWTYRAQWSPEYREYF

SEQ ID NO: 710785 - protein, 22 aa, Mycobacterium
PQYDIPQLLSMYRAGKLNLDDM

SEQ ID NO: 710786 - protein, 19 aa, Mycobacterium
PQYEQRPPAPGGYGGQGYD

SEQ ID NO: 710787 - protein, 18 aa, Mycobacterium
PQYETWKHTQLVIDVVPG

SEQ ID NO: 710788 - protein, 19 aa, Mycobacterium
PQYGPPPLLLRMVEAGRLG

SEQ ID NO: 710789 - protein, 20 aa, Mycobacterium
PQYGPPPLLLRMVEAGRLGK

SEQ ID NO: 710790 - protein, 20 aa, Mycobacterium
PQYMGINWVGPAIMRHGTAA

SEQ ID NO: 710791 - protein, 20 aa, Mycobacterium
PQYMGINWVGPAIMRYGTPA

SEQ ID NO: 710792 - protein, 22 aa, Mycobacterium
PQYMGINWVGPALMRYGTAEQK

SEQ ID NO: 710793 - protein, 22 aa, Mycobacterium
PQYMGINWVGPALMRYGTEEQK

SEQ ID NO: 710794 - protein, 18 aa, Mycobacterium
PQYQAWKHTQLVIDVVPG

SEQ ID NO: 710795 - protein, 20 aa, Mycobacterium
PQYRGRGLATIMIAEALRST

SEQ ID NO: 710796 - protein, 17 aa, Mycobacterium
PQYRISVADARNRRDGR

SEQ ID NO: 710797 - protein, 19 aa, Mycobacterium
PRAACPPMGCRITVSSFRF

SEQ ID NO: 710798 - protein, 26 aa, Mycobacterium
PRAAFAAATRGGWRAGGVRDGVSGTL

SEQ ID NO: 710799 - protein, 20 aa, Mycobacterium
PRAAFIGSHLRALACAGRKF

SEQ ID NO: 710800 - protein, 19 aa, Mycobacterium
PRAAIEPLVLMVAPLAPHL

SEQ ID NO: 710801 - protein, 21 aa, Mycobacterium
PRAALEVTRADGWAWATAEGT

SEQ ID NO: 710802 - protein, 17 aa, Mycobacterium
PRAANTMVHVFAEPAAV

SEQ ID NO: 710803 - protein, 17 aa, Mycobacterium
PRAAVAMGKALFYRQIE

SEQ ID NO: 710804 - protein, 20 aa, Mycobacterium
PRAAVLTVLARLGFGPDADG

SEQ ID NO: 710805 - protein, 21 aa, Mycobacterium
PRAAWERELLPGAQVVLAPTA

SEQ ID NO: 710806 - protein, 17 aa, Mycobacterium
PRADAYVASAAHPGRPD

SEQ ID NO: 710807 - protein, 23 aa, Mycobacterium
PRADELRKLLADRASDLLLVEDD

SEQ ID NO: 710808 - protein, 23 aa, Mycobacterium
PRADIPRLLSLYREGKLLLDETV

SEQ ID NO: 710809 - protein, 19 aa, Mycobacterium
PRADLPIPEGVQMTGQTSV

SEQ ID NO: 710810 - protein, 23 aa, Mycobacterium
PRADPDLPWPGRLPAPSPAVLLD

SEQ ID NO: 710811 - protein, 19 aa, Mycobacterium
PRADRPAAKHLLREDDIPW

SEQ ID NO: 710812 - protein, 25 aa, Mycobacterium
PRAEAALYRSCPDITTVVLADSAHC

SEQ ID NO: 710813 - protein, 24 aa, Mycobacterium
PRAEAPPRILALATDSDYQSVAAR

SEQ ID NO: 710814 - protein, 19 aa, Mycobacterium
PRAEEALAYCDKFSLDDLP

SEQ ID NO: 710815 - protein, 22 aa, Mycobacterium
PRAELPDRLGTHLTRHTGPGVE

SEQ ID NO: 710816 - protein, 20 aa, Mycobacterium
PRAERDRVFEIVKQRAPGFA

SEQ ID NO: 710817 - protein, 19 aa, Mycobacterium
PRAEWGGRRFPPTDRLSPE

SEQ ID NO: 710818 - protein, 21 aa, Mycobacterium
PRAFLGYAIECVLDLRDGTGW

SEQ ID NO: 710819 - protein, 26 aa, Mycobacterium
PRAGELCAPVRFLVRRDSVVMELTAR

SEQ ID NO: 710820 - protein, 20 aa, Mycobacterium
PRAGNAIILGDFNIFQTQDK

SEQ ID NO: 710821 - protein, 18 aa, Mycobacterium
PRAGTRVVPRPASSSYAQ

SEQ ID NO: 710822 - protein, 18 aa, Mycobacterium
PRAGTRVVPRSATSSYAQ

SEQ ID NO: 710823 - protein, 18 aa, Mycobacterium
PRAIAAFRQLAGGTDPVE

SEQ ID NO: 710824 - protein, 19 aa, Mycobacterium
PRAKPEDKGPWFDRTPIVD

SEQ ID NO: 710825 - protein, 19 aa, Mycobacterium
PRAKVASLTELLRIAHSQM

SEQ ID NO: 710826 - protein, 18 aa, Mycobacterium
PRALAAAGGRPVLLAGGI

SEQ ID NO: 710827 - protein, 26 aa, Mycobacterium
PRALGLPRMRRVLLVDGQLVADPAGR

SEQ ID NO: 710828 - protein, 20 aa, Mycobacterium
PRALLGVGAHDIIGVEAKNL

SEQ ID NO: 710829 - protein, 19 aa, Mycobacterium
PRALLKRNVLDSIACAIGS

SEQ ID NO: 710830 - protein, 24 aa, Mycobacterium
PRALLPATVLARWFRTERVRALYG

SEQ ID NO: 710831 - protein, 25 aa, Mycobacterium
PRAMCAAEISELVKELGGLSVILGA

SEQ ID NO: 710832 - protein, 21 aa, Mycobacterium
PRANDALLQMCLKYIDDVFGA

SEQ ID NO: 710833 - protein, 18 aa, Mycobacterium
PRAPCGQPAMTVGVHVPL

SEQ ID NO: 710834 - protein, 24 aa, Mycobacterium
PRAPEPHPGLLVTPVALAVKLKRR

SEQ ID NO: 710835 - protein, 26 aa, Mycobacterium
PRAPRGGPLQGVRVVELTKVWAGPYA

SEQ ID NO: 710836 - protein, 26 aa, Mycobacterium
PRAPRVGEPEFLPLVRRLGRFLPTDV

SEQ ID NO: 710837 - protein, 19 aa, Mycobacterium
PRAQLCIPADRFIDHDLTT

SEQ ID NO: 710838 - protein, 20 aa, Mycobacterium
PRAQRAALGPMHEGRVDVIG

SEQ ID NO: 710839 - protein, 19 aa, Mycobacterium
PRAQVPPIQAFRQRFGEHF

SEQ ID NO: 710840 - protein, 20 aa, Mycobacterium
PRARAARVIDRLEGVIPGIT

SEQ ID NO: 710841 - protein, 20 aa, Mycobacterium
PRARGVTQLRELLPLVDGGA

SEQ ID NO: 710842 - protein, 19 aa, Mycobacterium
PRARHSSVTNRGVLPDADG

SEQ ID NO: 710843 - protein, 17 aa, Mycobacterium
PRARLNILAANGSRMLA

SEQ ID NO: 710844 - protein, 25 aa, Mycobacterium
PRARVSARPSPACHADSPHARRGTT

SEQ ID NO: 710845 - protein, 17 aa, Mycobacterium
PRASIAIVAPSAESDPL

SEQ ID NO: 710846 - protein, 25 aa, Mycobacterium
PRASVLQPLRIGVDVNRFRRRVFVY

SEQ ID NO: 710847 - protein, 18 aa, Mycobacterium
PRATFLLMQAVHPVMVAA

SEQ ID NO: 710848 - protein, 21 aa, Mycobacterium
PRATPELLDIVSRDNRRIYDM

SEQ ID NO: 710849 - protein, 21 aa, Mycobacterium
PRATPELLDIVSRDNRRVYDM

SEQ ID NO: 710850 - protein, 20 aa, Mycobacterium
PRATRPSAFRTARRGAVEIQ

SEQ ID NO: 710851 - protein, 21 aa, Mycobacterium
PRAVAEYGQLVSLFPLQKALP

SEQ ID NO: 710852 - protein, 24 aa, Mycobacterium
PRAVAKGFTCLRDMADPGARHCLA

SEQ ID NO: 710853 - protein, 19 aa, Mycobacterium
PRAVLAGLAARYGELGLAP

SEQ ID NO: 710854 - protein, 18 aa, Mycobacterium
PRAVQYLFRRQLASTPTE

SEQ ID NO: 710855 - protein, 19 aa, Mycobacterium
PRAVSGVAKIVRRAPAVLP

SEQ ID NO: 710856 - protein, 17 aa, Mycobacterium
PRAYFALLEGCNHGQTV

SEQ ID NO: 710857 - protein, 21 aa, Mycobacterium
PRAYHEFGPLAAHLRFIERSS

SEQ ID NO: 710858 - protein, 25 aa, Mycobacterium
PRAYRGGTVPGFPNLFITSAPNYSP

SEQ ID NO: 710859 - protein, 19 aa, Mycobacterium
PRCAEAIVAVLAVIKTGAA

SEQ ID NO: 710860 - protein, 19 aa, Mycobacterium
PRCEQRRAAHLVGDDGVDL

SEQ ID NO: 710861 - protein, 25 aa, Mycobacterium
PRCGHCVACATQGLTPCEPGSAANS

SEQ ID NO: 710862 - protein, 18 aa, Mycobacterium
PRCRDAAEAERERRQEAT

SEQ ID NO: 710863 - protein, 18 aa, Mycobacterium
PRCSAFLAPTMVARLVQT

SEQ ID NO: 710864 - protein, 19 aa, Mycobacterium
PRCTKSRQALARLEEAGIN

SEQ ID NO: 710865 - protein, 24 aa, Mycobacterium
PRDAAVAAIVEWLATRENTAPTAG

SEQ ID NO: 710866 - protein, 23 aa, Mycobacterium
PRDAEGMTSWLTGLRGSRVSLRV

SEQ ID NO: 710867 - protein, 20 aa, Mycobacterium
PRDALALALDQERAVTDQVS

SEQ ID NO: 710868 - protein, 20 aa, Mycobacterium
PRDALLRLLVDVQYTRNDLS

SEQ ID NO: 710869 - protein, 28 aa, Mycobacterium
PRDAVLFELDLPRVLAFKAETLDKQGAT

SEQ ID NO: 710870 - protein, 19 aa, Mycobacterium
PRDAWLIDRATLQPGPTFI

SEQ ID NO: 710871 - protein, 18 aa, Mycobacterium
PRDCGLGAVKVIGKVLQR

SEQ ID NO: 710872 - protein, 36 aa, Mycobacterium
PRDDWVPAEGIPGYKHIKIKEAYGLTKANEADKLVN

SEQ ID NO: 710873 - protein, 22 aa, Mycobacterium
PRDEAVAAIVDWVNRRENVSPT

SEQ ID NO: 710874 - protein, 25 aa, Mycobacterium
PRDEAVEMIVRWIADRINEVPTAET

SEQ ID NO: 710875 - protein, 19 aa, Mycobacterium
PRDELIAFFVAADVMLVTP

SEQ ID NO: 710876 - protein, 24 aa, Mycobacterium
PRDELPKAAGLAIAERGGVLTDLS

SEQ ID NO: 710877 - protein, 29 aa, Mycobacterium
PRDFDRLALPGWAWPDVLDSFRAIETDLD

SEQ ID NO: 710878 - protein, 21 aa, Mycobacterium
PRDFPKNGWVVSALQAAWSAI

SEQ ID NO: 710879 - protein, 22 aa, Mycobacterium
PRDGDALGWIAFQLRDALSTGR

SEQ ID NO: 710880 - protein, 20 aa, Mycobacterium
PRDGGGYGITAQWDDDIHHA

SEQ ID NO: 710881 - protein, 20 aa, Mycobacterium
PRDGLLRLLVDVQYTRNDLS

SEQ ID NO: 710882 - protein, 19 aa, Mycobacterium
PRDGRFGSGPSKVRPEQLQ

SEQ ID NO: 710883 - protein, 33 aa, Mycobacterium
PRDGVLLLSRFSFRVRYLWFRAWVNSPAGARLG

SEQ ID NO: 710884 - protein, 22 aa, Mycobacterium
PRDISNAVLFLASDEARYVTGL

SEQ ID NO: 710885 - protein, 24 aa, Mycobacterium
PRDKRMEIALTYIYGIGRTRSKEI

SEQ ID NO: 710886 - protein, 24 aa, Mycobacterium
PRDKRMEIALTYIYGIGRTRSNEI

SEQ ID NO: 710887 - protein, 22 aa, Mycobacterium
PRDKRMEVALTYIYGIGRTRSN

SEQ ID NO: 710888 - protein, 20 aa, Mycobacterium
PRDLAARLARSGLTVPESSI

SEQ ID NO: 710889 - protein, 25 aa, Mycobacterium
PRDLCAKGPCGAAAEFVVLDAEGAI

SEQ ID NO: 710890 - protein, 18 aa, Mycobacterium
PRDLKHGYLPMLHGHCLA

SEQ ID NO: 710891 - protein, 23 aa, Mycobacterium
PRDLKLRVISWGAAPAPDALLRE

SEQ ID NO: 710892 - protein, 21 aa, Mycobacterium
PRDLNKIALPWPITVRATAAS

SEQ ID NO: 710893 - protein, 23 aa, Mycobacterium
PRDLPFTLTYLFDEGSFDEGSFD

SEQ ID NO: 710894 - protein, 30 aa, Mycobacterium
PRDPDLAYEFLRPELRTIQPYGVQVDNRIY

SEQ ID NO: 710895 - protein, 22 aa, Mycobacterium
PRDPRATPIVTEPEQAVPIPGH

SEQ ID NO: 710896 - protein, 18 aa, Mycobacterium
PRDPRIDAAILRATAELL

SEQ ID NO: 710897 - protein, 23 aa, Mycobacterium
PRDRAKVLRRFAAILDERHNFLK

SEQ ID NO: 710898 - protein, 20 aa, Mycobacterium
PRDRGWPVDDLLSVSDLEGW

SEQ ID NO: 710899 - protein, 18 aa, Mycobacterium
PRDRLRDVLARYGSEDPV

SEQ ID NO: 710900 - protein, 21 aa, Mycobacterium
PRDRMPIFPVPEGHDPASWLH

SEQ ID NO: 710901 - protein, 20 aa, Mycobacterium
PRDRMPIFPVPEGHDQASWL

SEQ ID NO: 710902 - protein, 20 aa, Mycobacterium
PRDSLLRLLVDVQYTRNDMS

SEQ ID NO: 710903 - protein, 19 aa, Mycobacterium
PRDSWLLNRAHIQPGEQFA

SEQ ID NO: 710904 - protein, 18 aa, Mycobacterium
PRDVTTWVCHPGGPRVIE

SEQ ID NO: 710905 - protein, 20 aa, Mycobacterium
PRDVVAGAIARRLRESGDQC

SEQ ID NO: 710906 - protein, 22 aa, Mycobacterium
PRDYRARFVFFGTGYYNYDEPY

SEQ ID NO: 710907 - protein, 17 aa, Mycobacterium
PREAAAWLASAVEGAYR

SEQ ID NO: 710908 - protein, 23 aa, Mycobacterium
PREAAVAAIVDWISRRENATPTA

SEQ ID NO: 710909 - protein, 17 aa, Mycobacterium
PREAIPAAGGRVEVLSP

SEQ ID NO: 710910 - protein, 20 aa, Mycobacterium
PREAREPGGKTIRFAYNRTP

SEQ ID NO: 710911 - protein, 19 aa, Mycobacterium
PREARLGSVGKLLPGLEGK

SEQ ID NO: 710912 - protein, 25 aa, Mycobacterium
PREELRMMPAFLLAMGLKVGRGMGV

SEQ ID NO: 710913 - protein, 20 aa, Mycobacterium
PREEVKPKVADYLAANPQVK

SEQ ID NO: 710914 - protein, 18 aa, Mycobacterium
PREFAWAVGEPERPAAAW

SEQ ID NO: 710915 - protein, 18 aa, Mycobacterium
PREFGGGDASVWEQTVVR

SEQ ID NO: 710916 - protein, 20 aa, Mycobacterium
PREFYDLVVEVALIRPGPIQ

SEQ ID NO: 710917 - protein, 21 aa, Mycobacterium
PREGKTVLFLGRYDEPRKGMD

SEQ ID NO: 710918 - protein, 26 aa, Mycobacterium
PRELEAWKRTLFRFVQQLYFRRRKTV

SEQ ID NO: 710919 - protein, 20 aa, Mycobacterium
PRELESWVSFGDVRHLEPGH

SEQ ID NO: 710920 - protein, 20 aa, Mycobacterium
PRELESWVSFGDVRQLEPGH

SEQ ID NO: 710921 - protein, 20 aa, Mycobacterium
PRELHALLSAERVSVLTQTP

SEQ ID NO: 710922 - protein, 18 aa, Mycobacterium
PRELKQKFYELLASRLAD

SEQ ID NO: 710923 - protein, 32 aa, Mycobacterium
PRELMRKIVIELLAWQFASPVRWIETQDLLFI

SEQ ID NO: 710924 - protein, 21 aa, Mycobacterium
PRELNGLLRLRGEGRIDCRAP

SEQ ID NO: 710925 - protein, 21 aa, Mycobacterium
PRELQPMWRRAIETPAAQQAI

SEQ ID NO: 710926 - protein, 24 aa, Mycobacterium
PRELRRLNAILRRRNKILQSGPDI

SEQ ID NO: 710927 - protein, 24 aa, Mycobacterium
PRELVARIRAMLRRPRTVATPTSA

SEQ ID NO: 710928 - protein, 21 aa, Mycobacterium
PRELVKWEVSGWLATTTAQSR

SEQ ID NO: 710929 - protein, 17 aa, Mycobacterium
PRELVSMITALRAHNEF

SEQ ID NO: 710930 - protein, 26 aa, Mycobacterium
PRELYRLGLESVPFLLSVGDLLLAWL

SEQ ID NO: 710931 - protein, 26 aa, Mycobacterium
PREPRGGPLEGVRVVELTKVWAGPYA

SEQ ID NO: 710932 - protein, 31 aa, Mycobacterium; identical to SEQ ID NO: 83321

SEQ ID NO: 710933 - protein, 19 aa, Mycobacterium
PREREVLGLMAEGHSNTGI

SEQ ID NO: 710934 - protein, 22 aa, Mycobacterium
PRERIPAVFDWLYSWFSEPDYR

SEQ ID NO: 710935 - protein, 26 aa, Mycobacterium
PRERKVNAAWRLDDRGVFSDSHGTLL

SEQ ID NO: 710936 - protein, 19 aa, Mycobacterium
PRERLALMMALLARPRLWK

SEQ ID NO: 710937 - protein, 18 aa, Mycobacterium
PRESLVLVTVVGGSLGCV

SEQ ID NO: 710938 - protein, 19 aa, Mycobacterium
PRETHGPAKVIAMCNQKGG

SEQ ID NO: 710939 - protein, 22 aa, Mycobacterium
PRETLWRPPVLTMSAMEGTGLE

SEQ ID NO: 710940 - protein, 19 aa, Mycobacterium
PRETWLRLRLTDAGLPPDS

SEQ ID NO: 710941 - protein, 21 aa, Mycobacterium
PREVFDLLEHAPIDVAVMTAP

SEQ ID NO: 710942 - protein, 18 aa, Mycobacterium
PREVKHFVHPELGTLELH

SEQ ID NO: 710943 - protein, 20 aa, Mycobacterium
PREVLPVVVIFDHEEVGSAS

SEQ ID NO: 710944 - protein, 19 aa, Mycobacterium
PREVPHIAVATRLSGLEPL

SEQ ID NO: 710945 - protein, 19 aa, Mycobacterium
PREVVARVRAMLRRPRRAP

SEQ ID NO: 710946 - protein, 19 aa, Mycobacterium
PREWADWATRTAMPSLRIP

SEQ ID NO: 710947 - protein, 20 aa, Mycobacterium
PREWGDWATRAAMPSLRIPD

SEQ ID NO: 710948 - protein, 20 aa, Mycobacterium
PREYGGLGLDHAYQRAFNAE

SEQ ID NO: 710949 - protein, 20 aa, Mycobacterium
PRFAGPATFARLPRLDQVTK

SEQ ID NO: 710950 - protein, 19 aa, Mycobacterium
PRFASAESRMANRAELVAV

SEQ ID NO: 710951 - protein, 25 aa, Mycobacterium
PRFASGELIGALAMTEPGAGSDLRA

SEQ ID NO: 710952 - protein, 24 aa, Mycobacterium
PRFDEKLAECDRVVYTVGFEQRKL

SEQ ID NO: 710953 - protein, 25 aa, Mycobacterium
PRFDFTADVPWQWNPASPAFSYFMN

SEQ ID NO: 710954 - protein, 18 aa, Mycobacterium
PRFDPARQRVTGALVDPA

SEQ ID NO: 710955 - protein, 19 aa, Mycobacterium
PRFDPARQRVTGVLLDADG

SEQ ID NO: 710956 - protein, 18 aa, Mycobacterium
PRFEPARQRVTGVLLAPR

SEQ ID NO: 710957 - protein, 17 aa, Mycobacterium
PRFGPGKGLGVIPREGY

SEQ ID NO: 710958 - protein, 18 aa, Mycobacterium
PRFGQHVAAVVHPRDGAR

SEQ ID NO: 710959 - protein, 18 aa, Mycobacterium
PRFGQHVAAVVHPREGTR

SEQ ID NO: 710960 - protein, 26 aa, Mycobacterium
PRFHPDIPSRFAVIPRRGGTEDIRWF

SEQ ID NO: 710961 - protein, 20 aa, Mycobacterium
PRFHSGWINGIKKFDTAYCP

SEQ ID NO: 710962 - protein, 17 aa, Mycobacterium
PRFLGPLGIAHRASVVR

SEQ ID NO: 710963 - protein, 20 aa, Mycobacterium
PRFLHSFPPMPLQYKGLMTS

SEQ ID NO: 710964 - protein, 19 aa, Mycobacterium
PRFNHPNVHAIHRDIRTVI

SEQ ID NO: 710965 - protein, 17 aa, Mycobacterium
PRFPNWDQDATAIADGY

SEQ ID NO: 710966 - protein, 20 aa, Mycobacterium
PRFRRYLQDLGLWSQSLEDR

SEQ ID NO: 710967 - protein, 22 aa, Mycobacterium
PRFRYTAVLAGEIERAWQQQWA

SEQ ID NO: 710968 - protein, 19 aa, Mycobacterium
PRFSRTRPATPSAPALPGD

SEQ ID NO: 710969 - protein, 17 aa, Mycobacterium
PRFTIAAIPPRNDPRDV

SEQ ID NO: 710970 - protein, 26 aa, Mycobacterium
PRFYPDMPSRFAILPRRGGTHDIRWF

SEQ ID NO: 710971 - protein, 26 aa, Mycobacterium
PRFYPDMPSRFAVIPRRGLSGDIRWF

SEQ ID NO: 710972 - protein, 26 aa, Mycobacterium
PRFYPDMPSRFAVIPRRGSTADIRWF

SEQ ID NO: 710973 - protein, 18 aa, Mycobacterium
PRGAAFSWYTYSPTRVRH

SEQ ID NO: 710974 - protein, 20 aa, Mycobacterium
PRGAEMWSAYASLSDAHTRH

SEQ ID NO: 710975 - protein, 20 aa, Mycobacterium
PRGAGGPGAQMLGSGAGQAP

SEQ ID NO: 710976 - protein, 19 aa, Mycobacterium
PRGAKTAAMVDEFTAAGGR

SEQ ID NO: 710977 - protein, 18 aa, Mycobacterium
PRGALLQVALGERPSLEQ

SEQ ID NO: 710978 - protein, 23 aa, Mycobacterium
PRGAQYMGVNWVGPIIMRHGTEE

SEQ ID NO: 710979 - protein, 20 aa, Mycobacterium
PRGASFSWYSYAPTRLRYPY

SEQ ID NO: 710980 - protein, 17 aa, Mycobacterium
PRGAVVLTHGAGGSCHS

SEQ ID NO: 710981 - protein, 17 aa, Mycobacterium
PRGAVVVVTGGEPRLPF

SEQ ID NO: 710982 - protein, 24 aa, Mycobacterium
PRGDEWRPAPEFEPPADVDTPADR

SEQ ID NO: 710983 - protein, 21 aa, Mycobacterium
PRGDGGFGYDPVFVPDGSDRT

SEQ ID NO: 710984 - protein, 19 aa, Mycobacterium
PRGDLDIMIIALRAPADGP

SEQ ID NO: 710985 - protein, 19 aa, Mycobacterium
PRGDTEWKPPPHLERNRPR

SEQ ID NO: 710986 - protein, 19 aa, Mycobacterium
PRGDTQWARNVRAAGVVEL

SEQ ID NO: 710987 - protein, 18 aa, Mycobacterium
PRGDVLELIDDIKDAIPG

SEQ ID NO: 710988 - protein, 24 aa, Mycobacterium
PRGDVPVDVVIPYERGDLVARIHT

SEQ ID NO: 710989 - protein, 24 aa, Mycobacterium
PRGDYSLGAFAAWLRDLLDELGIR

SEQ ID NO: 710990 - protein, 33 aa, Mycobacterium
PRGEQGRLRAGARHKVIPALAGETGMHDDPAAR

SEQ ID NO: 710991 - protein, 20 aa, Mycobacterium
PRGGGPGPHFHRGMSEAFYV

SEQ ID NO: 710992 - protein, 19 aa, Mycobacterium
PRGGHFAAFEQPDLFVEDV

SEQ ID NO: 710993 - protein, 19 aa, Mycobacterium
PRGGHFAAFEQPELFVEDV

SEQ ID NO: 710994 - protein, 22 aa, Mycobacterium
PRGGTLRLMRPLFAAGLGGRLG

SEQ ID NO: 710995 - protein, 20 aa, Mycobacterium
PRGHNVWQIKSGKTAPSVSK

SEQ ID NO: 710996 - protein, 17 aa, Mycobacterium
PRGIPVVVLAGQVDLDN

SEQ ID NO: 710997 - protein, 21 aa, Mycobacterium
PRGKFATAVLITSEGSGRAGA

SEQ ID NO: 710998 - protein, 19 aa, Mycobacterium
PRGKRQFRRAVLDRDAGTV

SEQ ID NO: 710999 - protein, 17 aa, Mycobacterium
PRGLAEWIRLRRLGRRE

SEQ ID NO: 711000 - protein, 24 aa, Mycobacterium
PRGLEGAAALWGLAQKAMMTYPQA

SEQ ID NO: 711001 - protein, 19 aa, Mycobacterium
PRGLLVCFGTASGPIPSID

SEQ ID NO: 711002 - protein, 17 aa, Mycobacterium
PRGNTQWARNARAAGEI

SEQ ID NO: 711003 - protein, 18 aa, Mycobacterium
PRGPGMERSDLLEANGAI

SEQ ID NO: 711004 - protein, 18 aa, Mycobacterium
PRGPHLGYTNVSFRVDDL

SEQ ID NO: 711005 - protein, 21 aa, Mycobacterium
PRGPLRGRHVIVTGASSGIGR

SEQ ID NO: 711006 - protein, 26 aa, Mycobacterium
PRGPRLPRWVQALLMLTHGSHFVAAC

SEQ ID NO: 711007 - protein, 17 aa, Mycobacterium
PRGPVSVQPNSLVTWGS

SEQ ID NO: 711008 - protein, 20 aa, Mycobacterium
PRGREVLHRLIATCDVIAEN

SEQ ID NO: 711009 - protein, 20 aa, Mycobacterium
PRGREVSVEREVFPALLSDP

SEQ ID NO: 711010 - protein, 20 aa, Mycobacterium
PRGREVSVEREVFPSLLSDP

SEQ ID NO: 711011 - protein, 17 aa, Mycobacterium
PRGRIEFARNGGYINTD

SEQ ID NO: 711012 - protein, 21 aa, Mycobacterium
PRGRMDGTLAYFLIVATADSR

SEQ ID NO: 711013 - protein, 19 aa, Mycobacterium
PRGRNRYSLNHLAADLDAV

SEQ ID NO: 711014 - protein, 18 aa, Mycobacterium
PRGRTHLQFRRFAGCPIC

SEQ ID NO: 711015 - protein, 19 aa, Mycobacterium
PRGRTVEVMEWFAEPFAAR

SEQ ID NO: 711016 - protein, 27 aa, Mycobacterium
PRGSAARFGYQAGQFLTLLVRVDGREY

SEQ ID NO: 711017 - protein, 18 aa, Mycobacterium
PRGSAPAELWLVDTGPGT

SEQ ID NO: 711018 - protein, 21 aa, Mycobacterium
PRGSAPAQLWRVHDGTGVVGR

SEQ ID NO: 711019 - protein, 24 aa, Mycobacterium
PRGSEWLRVAAIRLPRISNSTDVE

SEQ ID NO: 711020 - protein, 18 aa, Mycobacterium
PRGSPRCPTRLHEQRQSL

SEQ ID NO: 711021 - protein, 18 aa, Mycobacterium
PRGSQLGAWASHQSQPIA

SEQ ID NO: 711022 - protein, 26 aa, Mycobacterium
PRGTMANCLVAIGMDLDIDGVRARLD

SEQ ID NO: 711023 - protein, 17 aa, Mycobacterium
PRGTTEFGTRTETKNVN

SEQ ID NO: 711024 - protein, 17 aa, Mycobacterium
PRGVFSRQLVLGENLDT

SEQ ID NO: 711025 - protein, 18 aa, Mycobacterium
PRGVFSRQLVLGENLDTE

SEQ ID NO: 711026 - protein, 21 aa, Mycobacterium
PRGVLEIAYRCPNGEPAVVKT

SEQ ID NO: 711027 - protein, 20 aa, Mycobacterium
PRGVLTRRGALLEGETQTVG

SEQ ID NO: 711028 - protein, 20 aa, Mycobacterium
PRGVNRWAVSLAYLTDLLFA

SEQ ID NO: 711029 - protein, 19 aa, Mycobacterium
PRGVNVFCVAPGIMIKEQM

SEQ ID NO: 711030 - protein, 23 aa, Mycobacterium
PRGVPGEFCTRGYSVMAGYWNDP

SEQ ID NO: 711031 - protein, 17 aa, Mycobacterium
PRGVRFAAGHAEAVFVS

SEQ ID NO: 711032 - protein, 18 aa, Mycobacterium
PRGYLGSGVRWFRRHPWQ

SEQ ID NO: 711033 - protein, 25 aa, Mycobacterium
PRGYWEPRKAIILNERILHRNGSSR

SEQ ID NO: 711034 - protein, 19 aa, Mycobacterium
PRHEYTRELLAARPRVDDA

SEQ ID NO: 711035 - protein, 26 aa, Mycobacterium
PRHGEVGRARAGRLVAPDLGFGEDTE

SEQ ID NO: 711036 - protein, 20 aa, Mycobacterium
PRHHLDAVAVIESRRSVPRH

SEQ ID NO: 711037 - protein, 28 aa, Mycobacterium
PRHIEWKHGVCQALGWPHADQADIATAW

SEQ ID NO: 711038 - protein, 25 aa, Mycobacterium
PRHIGLRSKFFDEFFINATNSGCKQ

SEQ ID NO: 711039 - protein, 25 aa, Mycobacterium
PRHIIDVKTAIAWARANVDKFGGDR

SEQ ID NO: 711040 - protein, 17 aa, Mycobacterium
PRHIPLQRLPLPRPTAA

SEQ ID NO: 711041 - protein, 19 aa, Mycobacterium
PRHLACVQLSGVRFGSITP

SEQ ID NO: 711042 - protein, 19 aa, Mycobacterium
PRHLRPRSNTVILRETKVL

SEQ ID NO: 711043 - protein, 18 aa, Mycobacterium
PRHLRPRSNTVILRETQV

SEQ ID NO: 711044 - protein, 20 aa, Mycobacterium
PRHPHFVKLVARCANVEGVG

SEQ ID NO: 711045 - protein, 34 aa, Mycobacterium
PRHPLRLAAFGPRAALPATMMARWFRTEQARALF

SEQ ID NO: 711046 - protein, 32 aa, Mycobacterium
PRHPLRLAAFGPRAALPATVMARWFRTEQARA

SEQ ID NO: 711047 - protein, 28 aa, Mycobacterium
PRHQLRACLAPRCVLYFVKEHPRREWCT

SEQ ID NO: 711048 - protein, 26 aa, Mycobacterium
PRHSRACAVADAAMRVHYRHAHRAYT

SEQ ID NO: 711049 - protein, 19 aa, Mycobacterium
PRHTTGWIRIGDDGHTVYC

SEQ ID NO: 711050 - protein, 17 aa, Mycobacterium
PRHVMPVHGTWRMLRAN

SEQ ID NO: 711051 - protein, 18 aa, Mycobacterium
PRIADLVTVAATRRPEAV

SEQ ID NO: 711052 - protein, 19 aa, Mycobacterium
PRIAEKFAELTSEVPGLDA

SEQ ID NO: 711053 - protein, 17 aa, Mycobacterium
PRIAERFTELAREIPGL

SEQ ID NO: 711054 - protein, 17 aa, Mycobacterium
PRIAERFTELTREVPGL

SEQ ID NO: 711055 - protein, 19 aa, Mycobacterium
PRIALVSATGSVRMGQQVG

SEQ ID NO: 711056 - protein, 17 aa, Mycobacterium
PRIALVSTMTGQLAAAG

SEQ ID NO: 711057 - protein, 24 aa, Mycobacterium
PRIAQDFDATVCWMADEESLEPGR

SEQ ID NO: 711058 - protein, 17 aa, Mycobacterium
PRIAQGLTAQARLQRAP

SEQ ID NO: 711059 - protein, 17 aa, Mycobacterium
PRIDLLINNAGVMYPPK

SEQ ID NO: 711060 - protein, 20 aa, Mycobacterium
PRIDLPFDIGGACVLLVDGL

SEQ ID NO: 711061 - protein, 17 aa, Mycobacterium
PRIDVLLNNAGRMASKI

SEQ ID NO: 711062 - protein, 27 aa, Mycobacterium
PRIFKRIRPAFRYDRSLAVITAARNFG

SEQ ID NO: 711063 - protein, 27 aa, Mycobacterium
PRIFKRIRPGFRYERSLAVITAARDYG

SEQ ID NO: 711064 - protein, 20 aa, Mycobacterium
PRIGHLPYLLTLPGHGFYWF

SEQ ID NO: 711065 - protein, 25 aa, Mycobacterium
PRIGPRAARVVSIFLDGATLHAMIS

SEQ ID NO: 711066 - protein, 19 aa, Mycobacterium
PRIGRACDEIRPGYRKLAA

SEQ ID NO: 711067 - protein, 19 aa, Mycobacterium
PRIGRLLFSAKLSNEVVVR

SEQ ID NO: 711068 - protein, 21 aa, Mycobacterium
PRIGRRAAEAVTVFLDGATVH

SEQ ID NO: 711069 - protein, 19 aa, Mycobacterium
PRIGRRFLNAGLGFGGGCL

SEQ ID NO: 711070 - protein, 24 aa, Mycobacterium
PRIGSPRWDSAIIGLDCETKVLDE

SEQ ID NO: 711071 - protein, 19 aa, Mycobacterium
PRIGTANSRINFLHPKDTG

SEQ ID NO: 711072 - protein, 18 aa, Mycobacterium
PRIIRAGRHLARPKRYAA

SEQ ID NO: 711073 - protein, 17 aa, Mycobacterium
PRILHALPVVGRALDAL

SEQ ID NO: 711074 - protein, 17 aa, Mycobacterium
PRILRPGPVSAERIAEV

SEQ ID NO: 711075 - protein, 20 aa, Mycobacterium
PRIPASDFRFSRFAENDPLK

SEQ ID NO: 711076 - protein, 22 aa, Mycobacterium
PRIPDELRLTAPGYLAYAQDLL

SEQ ID NO: 711077 - protein, 23 aa, Mycobacterium
PRIPEDLAFAESRIRPSTIAAED

SEQ ID NO: 711078 - protein, 21 aa, Mycobacterium
PRIPLPEILPHNLVLSNVPGP

SEQ ID NO: 711079 - protein, 25 aa, Mycobacterium
PRIPPERLRYAPGQFLTLRVPSERT

SEQ ID NO: 711080 - protein, 22 aa, Mycobacterium
PRIRAAGVPLICQVHNIRQAAR

SEQ ID NO: 711081 - protein, 27 aa, Mycobacterium
PRIRLLVEVLIRTGLRIGDATRLALDC

SEQ ID NO: 711082 - protein, 21 aa, Mycobacterium
PRIRNLECGPTGFDDVRSPNG

SEQ ID NO: 711083 - protein, 18 aa, Mycobacterium
PRIRTLTVIEYSDAVIDW

SEQ ID NO: 711084 - protein, 26 aa, Mycobacterium
PRITALMCTADILALSAMDYLRGHGI

SEQ ID NO: 711085 - protein, 20 aa, Mycobacterium
PRITALSDLWFEAARLGGFD

SEQ ID NO: 711086 - protein, 21 aa, Mycobacterium
PRIVREFPFNLMLWDLDRRIR

SEQ ID NO: 711087 - protein, 24 aa, Mycobacterium
PRIVSGELYGSFLPGTPQNLQLAL

SEQ ID NO: 711088 - protein, 19 aa, Mycobacterium
PRIYKGLAGVVVDTTAISK

SEQ ID NO: 711089 - protein, 22 aa, Mycobacterium
PRKAAIAEGGWVLPYLPKPWGR

SEQ ID NO: 711090 - protein, 20 aa, Mycobacterium
PRKAFGQNFVHDANTVRRIV

SEQ ID NO: 711091 - protein, 24 aa, Mycobacterium
PRKARAVVGNLRYVAGRHPEDALL

SEQ ID NO: 711092 - protein, 19 aa, Mycobacterium
PRKARRVIDLVRGRSVSDA

SEQ ID NO: 711093 - protein, 19 aa, Mycobacterium
PRKAVPRIMLRAFQGIGGL

SEQ ID NO: 711094 - protein, 27 aa, Mycobacterium
PRKDRWHSLARLAIRDDIYGALRSLCF

SEQ ID NO: 711095 - protein, 19 aa, Mycobacterium
PRKIFDLLEHAPIDVAVVT

SEQ ID NO: 711096 - protein, 29 aa, Mycobacterium
PRKIPPGSGWRKFIYAISFRQINLGESPR

SEQ ID NO: 711097 - protein, 20 aa, Mycobacterium
PRKMDALTRILEVEEGDAMI

SEQ ID NO: 711098 - protein, 21 aa, Mycobacterium
PRKPEPAPVRPGHSYLITGGF

SEQ ID NO: 711099 - protein, 19 aa, Mycobacterium
PRKPGRVMAIASADTPLKG

SEQ ID NO: 711100 - protein, 28 aa, Mycobacterium
PRKQPPGNLWRWELSPVNAELTTVTHTY

SEQ ID NO: 711101 - protein, 24 aa, Mycobacterium
PRKRGEILRSVFETITARADDIAA

SEQ ID NO: 711102 - protein, 17 aa, Mycobacterium
PRKSCPDERLGRPRVPE

SEQ ID NO: 711103 - protein, 19 aa, Mycobacterium
PRKSFGQNFVHDANTVRRI

SEQ ID NO: 711104 - protein, 21 aa, Mycobacterium
PRKSRPSQRRRLTVDRKSFGF

SEQ ID NO: 711105 - protein, 17 aa, Mycobacterium
PRKVFDLLEHAHIDVAV

SEQ ID NO: 711106 - protein, 21 aa, Mycobacterium
PRLAAPDWLAGPFTVAQQLEF

SEQ ID NO: 711107 - protein, 21 aa, Mycobacterium
PRLAAQQRVWFRCRKHLPDDP

SEQ ID NO: 711108 - protein, 20 aa, Mycobacterium
PRLADAPVIETITGLRPDRP

SEQ ID NO: 711109 - protein, 25 aa, Mycobacterium
PRLADGIDIVGAWAEKVGLDVALAR

SEQ ID NO: 711110 - protein, 24 aa, Mycobacterium
PRLADGIDIVGGWAEKVGLDVALA

SEQ ID NO: 711111 - protein, 25 aa, Mycobacterium
PRLADGIDIVGGWAGKVGLDVALAR

SEQ ID NO: 711112 - protein, 20 aa, Mycobacterium
PRLADRAVLDVVGLDALPSE

SEQ ID NO: 711113 - protein, 28 aa, Mycobacterium
PRLAEIAYCGIRAGFGATVVTTIAAMEQ

SEQ ID NO: 711114 - protein, 23 aa, Mycobacterium
PRLAESWDSVGLVCGDPADVVDS

SEQ ID NO: 711115 - protein, 23 aa, Mycobacterium
PRLAESWDSVGLVCGDPGEPVES

SEQ ID NO: 711116 - protein, 26 aa, Mycobacterium
PRLAFPTASGRAVFFARPHLLPDEMP

SEQ ID NO: 711117 - protein, 21 aa, Mycobacterium
PRLAFRLVLTPAIRRIAESES

SEQ ID NO: 711118 - protein, 22 aa, Mycobacterium
PRLAGADSLAGWSAVTDAVHGE

SEQ ID NO: 711119 - protein, 18 aa, Mycobacterium
PRLAGIHFTGSTRTFQHL

SEQ ID NO: 711120 - protein, 19 aa, Mycobacterium
PRLAGSMAAEARQLAPTMA

SEQ ID NO: 711121 - protein, 20 aa, Mycobacterium
PRLAIDSGLRTDALGRLLTD

SEQ ID NO: 711122 - protein, 18 aa, Mycobacterium
PRLAIPRRADPRTKVPAG

SEQ ID NO: 711123 - protein, 27 aa, Mycobacterium
PRLAKISARVCAPVGVSVHGRRGVGVT

SEQ ID NO: 711124 - protein, 17 aa, Mycobacterium
PRLARDLAVGLVELIHP

SEQ ID NO: 711125 - protein, 19 aa, Mycobacterium
PRLARKVNVEGTRNLLRAA

SEQ ID NO: 711126 - protein, 19 aa, Mycobacterium
PRLAVLEAMGDHPHADTET

SEQ ID NO: 711127 - protein, 18 aa, Mycobacterium
PRLAVLEAVDAHPHADTE

SEQ ID NO: 711128 - protein, 21 aa, Mycobacterium
PRLDHSATVLAPFADFDQVMQ

SEQ ID NO: 711129 - protein, 24 aa, Mycobacterium
PRLEEFRGSITIEFGGRTIAATER

SEQ ID NO: 711130 - protein, 17 aa, Mycobacterium
PRLEGFPDRSAAVTRFE

SEQ ID NO: 711131 - protein, 18 aa, Mycobacterium
PRLEIIRLVGTLDPGSDF

SEQ ID NO: 711132 - protein, 18 aa, Mycobacterium
PRLELMDQLGVDRSLMFP

SEQ ID NO: 711133 - protein, 20 aa, Mycobacterium
PRLEPFRSVIDGMLRSDLDA

SEQ ID NO: 711134 - protein, 19 aa, Mycobacterium
PRLERRAVGALINVGIMTP

SEQ ID NO: 711135 - protein, 18 aa, Mycobacterium
PRLFRLAVFDVLINNADR

SEQ ID NO: 711136 - protein, 20 aa, Mycobacterium
PRLFVTLGTIYPYRFDALVD

SEQ ID NO: 711137 - protein, 23 aa, Mycobacterium
PRLGDMGLVPAMTVKCAVALVKS

SEQ ID NO: 711138 - protein, 20 aa, Mycobacterium
PRLGELLTGMLCEMGDRGSD

SEQ ID NO: 711139 - protein, 25 aa, Mycobacterium
PRLGFGDEFLACFADQAARKPQSAA

SEQ ID NO: 711140 - protein, 19 aa, Mycobacterium
PRLGGHVERLRRDLTDLDT

SEQ ID NO: 711141 - protein, 17 aa, Mycobacterium
PRLGLLVELAAAAGLIA

SEQ ID NO: 711142 - protein, 20 aa, Mycobacterium
PRLGNHVARLRADLASLETI

SEQ ID NO: 711143 - protein, 17 aa, Mycobacterium
PRLIEEFVRPTLAGNKI

SEQ ID NO: 711144 - protein, 17 aa, Mycobacterium
PRLIFGSVKGFNDDSTW

SEQ ID NO: 711145 - protein, 23 aa, Mycobacterium
PRLIRARHGVILGSGGFEHNEQM

SEQ ID NO: 711146 - protein, 25 aa, Mycobacterium
PRLIRARRGVILACGGFEHNEQMRV

SEQ ID NO: 711147 - protein, 20 aa, Mycobacterium
PRLIRARRGVILASGGFEHN

SEQ ID NO: 711148 - protein, 22 aa, Mycobacterium
PRLLCASCALTTVRPNDADPAG

SEQ ID NO: 711149 - protein, 20 aa, Mycobacterium
PRLLDLRPWETLALAKPNLL

SEQ ID NO: 711150 - protein, 21 aa, Mycobacterium
PRLLRTARQRLAAFITPIPIR

SEQ ID NO: 711151 - protein, 20 aa, Mycobacterium
PRLLRVSARLPATGSNKVLK

SEQ ID NO: 711152 - protein, 26 aa, Mycobacterium
PRLNPRRAAVVAPGFTEPEAVLADAG

SEQ ID NO: 711153 - protein, 20 aa, Mycobacterium
PRLNSAMVRLMGSDLLTVRV

SEQ ID NO: 711154 - protein, 21 aa, Mycobacterium
PRLPAELRAAFPTAAEIAPQW

SEQ ID NO: 711155 - protein, 21 aa, Mycobacterium
PRLPDGTPFPTLYYLTHPALT

SEQ ID NO: 711156 - protein, 23 aa, Mycobacterium
PRLPEVIAAGARRIVVVRAITAA

SEQ ID NO: 711157 - protein, 24 aa, Mycobacterium
PRLPLDRPALDAALADRQAFSGAA

SEQ ID NO: 711158 - protein, 19 aa, Mycobacterium
PRLPLPTKIAIEVQEPISA

SEQ ID NO: 711159 - protein, 21 aa, Mycobacterium
PRLPPSQARVLLMAALTAELP

SEQ ID NO: 711160 - protein, 17 aa, Mycobacterium
PRLPQMPATPEQIDMLA

SEQ ID NO: 711161 - protein, 17 aa, Mycobacterium
PRLPVLGDYYEPWTYDY

SEQ ID NO: 711162 - protein, 18 aa, Mycobacterium
PRLPVSDLLAEPLQANGF

SEQ ID NO: 711163 - protein, 20 aa, Mycobacterium
PRLQGRFAGVPFLIKDLDQE

SEQ ID NO: 711164 - protein, 23 aa, Mycobacterium
PRLRAAYDDALSRFDVLVMPTTP

SEQ ID NO: 711165 - protein, 22 aa, Mycobacterium
PRLRECARLVTAVQGRSIGQIF

SEQ ID NO: 711166 - protein, 21 aa, Mycobacterium
PRLRELAILRIARRRNCEYEW

SEQ ID NO: 711167 - protein, 20 aa, Mycobacterium
PRLRELAILRVAKTRRSAFF

SEQ ID NO: 711168 - protein, 25 aa, Mycobacterium
PRLRHACGLGTGGLFVDDVAETAPP

SEQ ID NO: 711169 - protein, 24 aa, Mycobacterium
PRLRMRHAPFRIGFLERDAWLRCM

SEQ ID NO: 711170 - protein, 21 aa, Mycobacterium
PRLRMRHAPFRIGYLERDAWL

SEQ ID NO: 711171 - protein, 19 aa, Mycobacterium
PRLRMRHMPFRITPIERDA

SEQ ID NO: 711172 - protein, 19 aa, Mycobacterium
PRLRMRHMPFRITPIHRDA

SEQ ID NO: 711173 - protein, 21 aa, Mycobacterium
PRLRPPQARVLLMAALAAQRP

SEQ ID NO: 711174 - protein, 19 aa, Mycobacterium
PRLRSTVVSVILLDRPPDW

SEQ ID NO: 711175 - protein, 21 aa, Mycobacterium
PRLRVANGLSADRLRTQLAVI

SEQ ID NO: 711176 - protein, 21 aa, Mycobacterium
PRLSDGIEIVGRWAETVGLDV

SEQ ID NO: 711177 - protein, 21 aa, Mycobacterium
PRLSDVADYLLRDVLELGDPG

SEQ ID NO: 711178 - protein, 20 aa, Mycobacterium
PRLSEALAIARELRFGLDDL

SEQ ID NO: 711179 - protein, 20 aa, Mycobacterium
PRLSGKRIIVDPGRGGSDHG

SEQ ID NO: 711180 - protein, 18 aa, Mycobacterium
PRLSGNNTDGIWVEQADG

SEQ ID NO: 711181 - protein, 21 aa, Mycobacterium
PRLSILFWSMGDVPLAHQVLG

SEQ ID NO: 711182 - protein, 26 aa, Mycobacterium
PRLSKIFTKGIVKWGIGDVRDIEHWN

SEQ ID NO: 711183 - protein, 18 aa, Mycobacterium
PRLTPALRQPTVDDMSEP

SEQ ID NO: 711184 - protein, 19 aa, Mycobacterium
PRLTSHWVSATASARDIPF

SEQ ID NO: 711185 - protein, 23 aa, Mycobacterium
PRLVELPGVVSVVLGGSRATNTH

SEQ ID NO: 711186 - protein, 20 aa, Mycobacterium
PRLVGPDVRAVLEAVGDCSV

SEQ ID NO: 711187 - protein, 20 aa, Mycobacterium
PRLVKPEILASNRFRAGLAK

SEQ ID NO: 711188 - protein, 19 aa, Mycobacterium
PRLVPPWQPMTALVEAASL

SEQ ID NO: 711189 - protein, 17 aa, Mycobacterium
PRLVRLTHRGSRLAKNP

SEQ ID NO: 711190 - protein, 21 aa, Mycobacterium
PRLVRRRALTYNVSLLLVLLR

SEQ ID NO: 711191 - protein, 23 aa, Mycobacterium
PRLVYCAMSGFGLDGPDSNLPGY

SEQ ID NO: 711192 - protein, 18 aa, Mycobacterium
PRLWEIVNNMPGNKDRYI

SEQ ID NO: 711193 - protein, 19 aa, Mycobacterium
PRLWLSPAGRATCPPAALT

SEQ ID NO: 711194 - protein, 17 aa, Mycobacterium
PRMAALQIIGMCNWVAW

SEQ ID NO: 711195 - protein, 25 aa, Mycobacterium
PRMASGETKVVFAITEPDAGSNTRQ

SEQ ID NO: 711196 - protein, 24 aa, Mycobacterium
PRMATGECRGAFSMSEPELGSDVA

SEQ ID NO: 711197 - protein, 23 aa, Mycobacterium
PRMATGEVIGCFGLTEPDFGSNP

SEQ ID NO: 711198 - protein, 22 aa, Mycobacterium
PRMKANVGIRRRLAPLLENDRN

SEQ ID NO: 711199 - protein, 21 aa, Mycobacterium
PRMLFALPRYREGTAERLRMP

SEQ ID NO: 711200 - protein, 24 aa, Mycobacterium
PRMLSALHRRRLPGVMRFGQSALR

SEQ ID NO: 711201 - protein, 26 aa, Mycobacterium
PRMLWEAIRSGFRFDAMVDRLALADP

SEQ ID NO: 711202 - protein, 28 aa, Mycobacterium
PRMRRDLPLLYRLCSGITGGIQIRNQGT

SEQ ID NO: 711203 - protein, 17 aa, Mycobacterium
PRMSTYLVALVAGPYAV

SEQ ID NO: 711204 - protein, 19 aa, Mycobacterium
PRMVDPLLEPTKRPPNMCY

SEQ ID NO: 711205 - protein, 17 aa, Mycobacterium
PRNADYYLLSSLVQTFH

SEQ ID NO: 711206 - protein, 19 aa, Mycobacterium
PRNALAEWLLPRSPAIRKV

SEQ ID NO: 711207 - protein, 24 aa, Mycobacterium
PRNANRWAVALGYLTNVLFGRPLV

SEQ ID NO: 711208 - protein, 19 aa, Mycobacterium
PRNDFTALFGTVADDPESY

SEQ ID NO: 711209 - protein, 21 aa, Mycobacterium
PRNDIPKMLKLWDSGQINLDG

SEQ ID NO: 711210 - protein, 20 aa, Mycobacterium
PRNFAKRGVRSIVLPSSATF

SEQ ID NO: 711211 - protein, 18 aa, Mycobacterium
PRNILTFSHGAHHCLGAA

SEQ ID NO: 711212 - protein, 18 aa, Mycobacterium
PRNLGAIVRSVAAFGGHG

SEQ ID NO: 711213 - protein, 18 aa, Mycobacterium
PRNLKLRALSWGAAPASD

SEQ ID NO: 711214 - protein, 22 aa, Mycobacterium
PRNLKLRFLSWGAAPASDTLLR

SEQ ID NO: 711215 - protein, 20 aa, Mycobacterium
PRNLWAEPIDMLRYSPHSWQ

SEQ ID NO: 711216 - protein, 17 aa, Mycobacterium
PRNVEVFQQDPPRHRVD

SEQ ID NO: 711217 - protein, 34 aa, Mycobacterium
PRNVPWFPADIDHWTVRWVVMHLIEELSRHAGHA

SEQ ID NO: 711218 - protein, 18 aa, Mycobacterium
PRPAAFAGVGGYFDALSW

SEQ ID NO: 711219 - protein, 25 aa, Mycobacterium
PRPAARTGAKLGPFLVPATLGAPEG

SEQ ID NO: 711220 - protein, 17 aa, Mycobacterium
PRPAATVMLVRDDPGGI

SEQ ID NO: 711221 - protein, 19 aa, Mycobacterium
PRPAAVDGVNARVGRGVSL

SEQ ID NO: 711222 - protein, 17 aa, Mycobacterium
PRPADMSQVPAVTPEST

SEQ ID NO: 711223 - protein, 18 aa, Mycobacterium
PRPAIATSSRYLGTALHF

SEQ ID NO: 711224 - protein, 20 aa, Mycobacterium
PRPAQLIVREAYNDWTENRG

SEQ ID NO: 711225 - protein, 21 aa, Mycobacterium
PRPARPELVVLCDVSGSVAGF

SEQ ID NO: 711226 - protein, 19 aa, Mycobacterium
PRPARSVLDLGKIEATGFW

SEQ ID NO: 711227 - protein, 20 aa, Mycobacterium
PRPARVGPQASLPRRVVDSS

SEQ ID NO: 711228 - protein, 20 aa, Mycobacterium
PRPARVGTCTLPDAREFPDD

SEQ ID NO: 711229 - protein, 17 aa, Mycobacterium
PRPATPVADAEAVLNDW

SEQ ID NO: 711230 - protein, 17 aa, Mycobacterium
PRPCEPFPMGGRLPAPL

SEQ ID NO: 711231 - protein, 27 aa, Mycobacterium
PRPDAFPLIITHGWPGSIVEFQKVIAP

SEQ ID NO: 711232 - protein, 17 aa, Mycobacterium
PRPDPGPERSITTTTDE

SEQ ID NO: 711233 - protein, 19 aa, Mycobacterium
PRPDVIEGIVSFLEKRPPQ

SEQ ID NO: 711234 - protein, 25 aa, Mycobacterium
PRPDWPAEAIVVGPLHFEPTDQLLK

SEQ ID NO: 711235 - protein, 19 aa, Mycobacterium
PRPEAVPQRFYLDAEPSGF

SEQ ID NO: 711236 - protein, 20 aa, Mycobacterium
PRPEDAPSHFAAAGRYVLDR

SEQ ID NO: 711237 - protein, 21 aa, Mycobacterium
PRPELFTLSAERLLEMAKAVV

SEQ ID NO: 711238 - protein, 20 aa, Mycobacterium
PRPETEALLEWARAQRLAPR

SEQ ID NO: 711239 - protein, 21 aa, Mycobacterium
PRPETESLLEWALAQPLSGSA

SEQ ID NO: 711240 - protein, 20 aa, Mycobacterium
PRPETESLLEWAVAQQLPRD

SEQ ID NO: 711241 - protein, 18 aa, Mycobacterium
PRPFVEVPARAGVGHGVS

SEQ ID NO: 711242 - protein, 21 aa, Mycobacterium
PRPGDLTLRERAMVETSALTD

SEQ ID NO: 711243 - protein, 25 aa, Mycobacterium
PRPGELCAPVRFLVREDTVVMELTA

SEQ ID NO: 711244 - protein, 20 aa, Mycobacterium
PRPGIIDALARLRIEGQAPP

SEQ ID NO: 711245 - protein, 21 aa, Mycobacterium
PRPGKGPEFLIAMTVTVPPGT

SEQ ID NO: 711246 - protein, 19 aa, Mycobacterium
PRPGLATAAAEHGWPVLSL

SEQ ID NO: 711247 - protein, 17 aa, Mycobacterium
PRPGLVNALVQMRIDGQ

SEQ ID NO: 711248 - protein, 19 aa, Mycobacterium
PRPGMSTLFSPSRSTFGVD

SEQ ID NO: 711249 - protein, 18 aa, Mycobacterium
PRPGNLLRRVPHQANRVV

SEQ ID NO: 711250 - protein, 20 aa, Mycobacterium
PRPGPGEVLLKVAACGVCGS

SEQ ID NO: 711251 - protein, 20 aa, Mycobacterium
PRPGRELYDLVADPGEANNL

SEQ ID NO: 711252 - protein, 19 aa, Mycobacterium
PRPGVALITLNRPERMNSM

SEQ ID NO: 711253 - protein, 18 aa, Mycobacterium
PRPGYGAAVHAGVEAATT

SEQ ID NO: 711254 - protein, 24 aa, Mycobacterium
PRPLGKARWAGGVDCVGGATLADV

SEQ ID NO: 711255 - protein, 32 aa, Mycobacterium
PRPLHWHVACARLRLAVAWMQLYRKWQSGDLI

SEQ ID NO: 711256 - protein, 17 aa, Mycobacterium
PRPLILFGASMGGMLAY

SEQ ID NO: 711257 - protein, 19 aa, Mycobacterium
PRPLPDPFIVAATQNPIEY

SEQ ID NO: 711258 - protein, 21 aa, Mycobacterium
PRPLPEGLFGPDRVNVADQRR

SEQ ID NO: 711259 - protein, 20 aa, Mycobacterium
PRPLPSHRSARRRAMTAPIW

SEQ ID NO: 711260 - protein, 17 aa, Mycobacterium
PRPLQFDGHEHLIDSTQ

SEQ ID NO: 711261 - protein, 27 aa, Mycobacterium
PRPLRAVPDDGYPHWEAVCQDNVGWVY

SEQ ID NO: 711262 - protein, 20 aa, Mycobacterium
PRPLRVPLLIAADGSRGRAV

SEQ ID NO: 711263 - protein, 25 aa, Mycobacterium
PRPLSCAIAAISVGVVDGRIRVDLP

SEQ ID NO: 711264 - protein, 25 aa, Mycobacterium
PRPLSCAIAAVSVGVVDGRVRVDLP

SEQ ID NO: 711265 - protein, 19 aa, Mycobacterium
PRPLWPGSDEPILGNRLRQ

SEQ ID NO: 711266 - protein, 18 aa, Mycobacterium
PRPPAPLHLLRLATMLPL

SEQ ID NO: 711267 - protein, 32 aa, Mycobacterium
PRPPAPLHLVRLATMLPWAPLVPFVHDGVISS

SEQ ID NO: 711268 - protein, 20 aa, Mycobacterium
PRPPLAQGEAKFVGDPVALV

SEQ ID NO: 711269 - protein, 19 aa, Mycobacterium
PRPPMPIGGPPPTPPAAPE

SEQ ID NO: 711270 - protein, 19 aa, Mycobacterium
PRPPRETWESHPLYQQLDA

SEQ ID NO: 711271 - protein, 17 aa, Mycobacterium
PRPPTPPAPAAVAPAPA

SEQ ID NO: 711272 - protein, 19 aa, Mycobacterium
PRPQFVHRMRLHQMAAGAC

SEQ ID NO: 711273 - protein, 22 aa, Mycobacterium
PRPQGPASFLFLDPPDHTRLRG

SEQ ID NO: 711274 - protein, 25 aa, Mycobacterium
PRPQLTRTAAVWHLYTPITATLRER

SEQ ID NO: 711275 - protein, 19 aa, Mycobacterium
PRPQPPLDIWLGGSAPAAF

SEQ ID NO: 711276 - protein, 19 aa, Mycobacterium
PRPQVPTTQAFRRVFGDRF

SEQ ID NO: 711277 - protein, 23 aa, Mycobacterium
PRPRAPLAAATIWAIDDFTADNG

SEQ ID NO: 711278 - protein, 25 aa, Mycobacterium
PRPREATAHGALHWAPHHDAGLSAR

SEQ ID NO: 711279 - protein, 17 aa, Mycobacterium
PRPRGHQNLPAFTHQRR

SEQ ID NO: 711280 - protein, 24 aa, Mycobacterium
PRPSDFLHGRWLVLRRGKRTVAGI

SEQ ID NO: 711281 - protein, 24 aa, Mycobacterium
PRPSEIRSSIDLEELLTTWTAGFP

SEQ ID NO: 711282 - protein, 19 aa, Mycobacterium
PRPSGPVTRAHLKRLIARL

SEQ ID NO: 711283 - protein, 25 aa, Mycobacterium
PRPSRYTWDGAKWVERFDFQWDCYM

SEQ ID NO: 711284 - protein, 20 aa, Mycobacterium
PRPSSTTTLWVRDRARRPVD

SEQ ID NO: 711285 - protein, 24 aa, Mycobacterium
PRPSWGHPKYDPIWAAATKHDITV

SEQ ID NO: 711286 - protein, 17 aa, Mycobacterium
PRPSWGNPKYDPIWAAA

SEQ ID NO: 711287 - protein, 17 aa, Mycobacterium
PRPTFTTATFAAGVQKI

SEQ ID NO: 711288 - protein, 17 aa, Mycobacterium
PRPTLGVEWEFALVDAR

SEQ ID NO: 711289 - protein, 20 aa, Mycobacterium
PRPTTVINRWLRLLPASGAP

SEQ ID NO: 711290 - protein, 20 aa, Mycobacterium
PRPVHDWFVAVSEAMALEEY

SEQ ID NO: 711291 - protein, 21 aa, Mycobacterium
PRPVVQIPLGNHLIHAPTGAV

SEQ ID NO: 711292 - protein, 18 aa, Mycobacterium
PRPVWTRLVSDLLTVGTK

SEQ ID NO: 711293 - protein, 20 aa, Mycobacterium
PRPYHPMINFFDGGAPPLSQ

SEQ ID NO: 711294 - protein, 20 aa, Mycobacterium
PRPYLPLATLVVRGKPTDTP

SEQ ID NO: 711295 - protein, 17 aa, Mycobacterium
PRPYVWTKTADQILDSI

SEQ ID NO: 711296 - protein, 18 aa, Mycobacterium
PRQAVALVAAARWITAAS

SEQ ID NO: 711297 - protein, 20 aa, Mycobacterium
PRQAWDLGYQNLKMMSDYRS

SEQ ID NO: 711298 - protein, 20 aa, Mycobacterium
PRQHLAFSVGTHFCLGSALA

SEQ ID NO: 711299 - protein, 18 aa, Mycobacterium
PRQICAQQTMAFARASDA

SEQ ID NO: 711300 - protein, 27 aa, Mycobacterium
PRQIQFYCVDMGGGGLIYVEDLPHVGG

SEQ ID NO: 711301 - protein, 20 aa, Mycobacterium
PRQKFNPLVRLDSVNGGSVE

SEQ ID NO: 711302 - protein, 17 aa, Mycobacterium
PRQKFNPLVRLDTVNGK

SEQ ID NO: 711303 - protein, 17 aa, Mycobacterium
PRQLAPVAHLAFDEPAK

SEQ ID NO: 711304 - protein, 26 aa, Mycobacterium
PRQLEKVWGPPSCPATFVDHNFKPGG

SEQ ID NO: 711305 - protein, 19 aa, Mycobacterium
PRQLIEHLGRNGVFTEKWG

SEQ ID NO: 711306 - protein, 19 aa, Mycobacterium
PRQLIRVMLDHAVARGEVP

SEQ ID NO: 711307 - protein, 25 aa, Mycobacterium
PRQLLLIHCGRLSVEKHVDRSIGAL

SEQ ID NO: 711308 - protein, 22 aa, Mycobacterium
PRQLPPPILVAGAGNKLLTLAA

SEQ ID NO: 711309 - protein, 24 aa, Mycobacterium
PRQLRRWHPGYGIVLTGPSADRFL

SEQ ID NO: 711310 - protein, 18 aa, Mycobacterium
PRQLRWVAAPDRLPPLGV

SEQ ID NO: 711311 - protein, 18 aa, Mycobacterium
PRQLRWVVPPDRLPPRGV

SEQ ID NO: 711312 - protein, 17 aa, Mycobacterium
PRQMPGTSYWYAHTDQW

SEQ ID NO: 711313 - protein, 26 aa, Mycobacterium
PRQQTLRASLEWSHGLLTDTERVLFR

SEQ ID NO: 711314 - protein, 19 aa, Mycobacterium
PRQRGHRAFGRGVSGKALF

SEQ ID NO: 711315 - protein, 21 aa, Mycobacterium
PRQRLAIEYAERFATDHASLN

SEQ ID NO: 711316 - protein, 21 aa, Mycobacterium
PRQSLREFLGPMITGLDDYPF

SEQ ID NO: 711317 - protein, 21 aa, Mycobacterium
PRQSLREFLGPMVTGLDDYPF

SEQ ID NO: 711318 - protein, 20 aa, Mycobacterium
PRQTDLPTWIAALGSPETFR

SEQ ID NO: 711319 - protein, 25 aa, Mycobacterium
PRQVPEIPVATRLSGLEPLNIDEDS

SEQ ID NO: 711320 - protein, 27 aa, Mycobacterium
PRRAAATAFQRWTSMLADSLRDAGAAE

SEQ ID NO: 711321 - protein, 20 aa, Mycobacterium
PRRAAELASGLVARELDKRV

SEQ ID NO: 711322 - protein, 17 aa, Mycobacterium
PRRAAVSSFGLGGTNAH

SEQ ID NO: 711323 - protein, 18 aa, Mycobacterium
PRRAEPRTAVPAGAVGLA

SEQ ID NO: 711324 - protein, 17 aa, Mycobacterium
PRRAEPRTKVPVGAVGL

SEQ ID NO: 711325 - protein, 24 aa, Mycobacterium
PRRAKRLHECAVVIASEYDDVVPR

SEQ ID NO: 711326 - protein, 20 aa, Mycobacterium
PRRATVTVRMLLTHTSGETG

SEQ ID NO: 711327 - protein, 17 aa, Mycobacterium
PRRAYRLVLARAAVASG

SEQ ID NO: 711328 - protein, 21 aa, Mycobacterium
PRRELPPGLAEQLDLPYAGMV

SEQ ID NO: 711329 - protein, 21 aa, Mycobacterium
PRRELPTPWWESGTPATPAAP

SEQ ID NO: 711330 - protein, 18 aa, Mycobacterium
PRRERRGASRDAGSTDRA

SEQ ID NO: 711331 - protein, 28 aa, Mycobacterium
PRRFEVIAIGITPQGSWVLTDGNPDALA

SEQ ID NO: 711332 - protein, 21 aa, Mycobacterium
PRRGEVTLTRLVDAVSEDRGR

SEQ ID NO: 711333 - protein, 18 aa, Mycobacterium
PRRGFRPAYYDVRAETAL

SEQ ID NO: 711334 - protein, 25 aa, Mycobacterium
PRRGGGRARPGLRGNAIGPPGQSRG

SEQ ID NO: 711335 - protein, 19 aa, Mycobacterium
PRRGQGLPLEGIRVLDLGV

SEQ ID NO: 711336 - protein, 18 aa, Mycobacterium
PRRGVAIVNSPLVHIGGV

SEQ ID NO: 711337 - protein, 19 aa, Mycobacterium
PRRHGKWLVLPTDGPALLI

SEQ ID NO: 711338 - protein, 23 aa, Mycobacterium
PRRHPGRRSPLWHQRQRAAQLLD

SEQ ID NO: 711339 - protein, 19 aa, Mycobacterium
PRRIIGYANAYDFWNMWRV

SEQ ID NO: 711340 - protein, 18 aa, Mycobacterium
PRRIMGIEYESIVDHPRG

SEQ ID NO: 711341 - protein, 24 aa, Mycobacterium
PRRIPEMVDYYLARTSHGSTLSAV

SEQ ID NO: 711342 - protein, 18 aa, Mycobacterium
PRRIQAFRNGRLVIDTER

SEQ ID NO: 711343 - protein, 21 aa, Mycobacterium
PRRLEEISAVSAFELPSADDI

SEQ ID NO: 711344 - protein, 20 aa, Mycobacterium
PRRLEVAVVEGRQSVDSLQP

SEQ ID NO: 711345 - protein, 23 aa, Mycobacterium
PRRLGAFRHFLRPALLQNETAVH

SEQ ID NO: 711346 - protein, 25 aa, Mycobacterium
PRRLHPSAYPFLAAIDHGLSEVPML

SEQ ID NO: 711347 - protein, 20 aa, Mycobacterium
PRRLKGLGADDARELGLAQL

SEQ ID NO: 711348 - protein, 24 aa, Mycobacterium
PRRLLPRLRPAGTHLGTVTRAAAE

SEQ ID NO: 711349 - protein, 17 aa, Mycobacterium
PRRLRPHPIFRPVRGNI

SEQ ID NO: 711350 - protein, 22 aa, Mycobacterium
PRRLRSTAAMRRLVAQTSLEPR

SEQ ID NO: 711351 - protein, 17 aa, Mycobacterium
PRRNAARERLVLEGDVP

SEQ ID NO: 711352 - protein, 30 aa, Mycobacterium
PRRNVATFWRKRTWFEGGYEPSITLNFMPM

SEQ ID NO: 711353 - protein, 18 aa, Mycobacterium
PRRPQPRVSRRQWLQRGL

SEQ ID NO: 711354 - protein, 22 aa, Mycobacterium
PRRRADLDAGTFEHRCPVGGEE

SEQ ID NO: 711355 - protein, 21 aa, Mycobacterium
PRRRAILGMRFYDCLTQREIA

SEQ ID NO: 711356 - protein, 25 aa, Mycobacterium
PRRRECGLCSITTLVYEGDRLAGVE

SEQ ID NO: 711357 - protein, 20 aa, Mycobacterium
PRRRERRASTRQAGAPVAEK

SEQ ID NO: 711358 - protein, 17 aa, Mycobacterium
PRRRGGGARCRVCNAAL

SEQ ID NO: 711359 - protein, 24 aa, Mycobacterium
PRRRIEHKSRYVSYPLIDTSVALA

SEQ ID NO: 711360 - protein, 20 aa, Mycobacterium
PRRRQGAGVATEIALARQDS

SEQ ID NO: 711361 - protein, 18 aa, Mycobacterium
PRRRSPVEWLRSTNHSPG

SEQ ID NO: 711362 - protein, 22 aa, Mycobacterium
PRRSCLVAVALVVCWCARAAGP

SEQ ID NO: 711363 - protein, 24 aa, Mycobacterium
PRRSIPLPVSYLLAAIGTVKGKLR

SEQ ID NO: 711364 - protein, 19 aa, Mycobacterium
PRRSKGLAGALDFANIPPT

SEQ ID NO: 711365 - protein, 26 aa, Mycobacterium
PRRSRGRPALPMDRILGAAVELLDAE

SEQ ID NO: 711366 - protein, 17 aa, Mycobacterium
PRRSVVIVPGCHIDSMR

SEQ ID NO: 711367 - protein, 22 aa, Mycobacterium
PRRTLDGWQEWAKQRGHRGLAY

SEQ ID NO: 711368 - protein, 22 aa, Mycobacterium
PRRVKRLEGWLDDLIPQLLNDL

SEQ ID NO: 711369 - protein, 18 aa, Mycobacterium
PRRVRGFLGDALVFDTTA

SEQ ID NO: 711370 - protein, 21 aa, Mycobacterium
PRRVRRPDEPLRIGVGGPVGS

SEQ ID NO: 711371 - protein, 19 aa, Mycobacterium
PRRVYLRVAADVAGAYIDM

SEQ ID NO: 711372 - protein, 19 aa, Mycobacterium
PRRWPGQAPEGVFLLRTVE

SEQ ID NO: 711373 - protein, 18 aa, Mycobacterium
PRRYLMTAPQFFAVDYVI

SEQ ID NO: 711374 - protein, 22 aa, Mycobacterium
PRRYPRMRVILSHGGGFLPYAA

SEQ ID NO: 711375 - protein, 30 aa, Mycobacterium
PRRYRGRDFCWWLGVLGKWDMAAPPRGAEH

SEQ ID NO: 711376 - protein, 19 aa, Mycobacterium
PRSAARVRADFGAWLETHF

SEQ ID NO: 711377 - protein, 19 aa, Mycobacterium
PRSAFPAHLIDVKRAIAWV

SEQ ID NO: 711378 - protein, 20 aa, Mycobacterium
PRSARVVVVGVCMEPDAITP

SEQ ID NO: 711379 - protein, 20 aa, Mycobacterium
PRSDEADVEMALDAAHAAAP

SEQ ID NO: 711380 - protein, 20 aa, Mycobacterium
PRSDLARYGIAPRYPADFVL

SEQ ID NO: 711381 - protein, 27 aa, Mycobacterium
PRSDLARYGIAPTYPMDFVLDVINNRL

SEQ ID NO: 711382 - protein, 19 aa, Mycobacterium
PRSEIVTFLAAREAAHHRL

SEQ ID NO: 711383 - protein, 25 aa, Mycobacterium
PRSERRPAPEPNWYGASSGNYGSPQ

SEQ ID NO: 711384 - protein, 18 aa, Mycobacterium
PRSGAYVLDVEDPYYGGH

SEQ ID NO: 711385 - protein, 19 aa, Mycobacterium
PRSGDGAGIMLQVPDAFLR

SEQ ID NO: 711386 - protein, 18 aa, Mycobacterium
PRSGRWQGLAKTECGLHA

SEQ ID NO: 711387 - protein, 21 aa, Mycobacterium
PRSGTFRAARIVAIGDCHARF

SEQ ID NO: 711388 - protein, 18 aa, Mycobacterium
PRSGTTLMHALMSVDPGA

SEQ ID NO: 711389 - protein, 20 aa, Mycobacterium
PRSIKFVCLLTCPEGIAAVQ

SEQ ID NO: 711390 - protein, 21 aa, Mycobacterium
PRSLAEFYVRLIGGEITADEG

SEQ ID NO: 711391 - protein, 25 aa, Mycobacterium
PRSLAYDRAWWFARFVADTFGAPKL

SEQ ID NO: 711392 - protein, 27 aa, Mycobacterium
PRSLEIVSCPSCGRAQVDVYRLANEVS

SEQ ID NO: 711393 - protein, 29 aa, Mycobacterium
PRSLFPDFSELLAGFPSFAGPRVAAESRL

SEQ ID NO: 711394 - protein, 26 aa, Mycobacterium
PRSLGVTLWAQRLMPLGLAEALGRAL

SEQ ID NO: 711395 - protein, 29 aa, Mycobacterium
PRSLLERLPRLKLITIVGMNLPNLDLAAA

SEQ ID NO: 711396 - protein, 21 aa, Mycobacterium
PRSLLLPGIRIGNRFRGGPNR

SEQ ID NO: 711397 - protein, 18 aa, Mycobacterium
PRSLQDMLLPAGPATAGT

SEQ ID NO: 711398 - protein, 19 aa, Mycobacterium
PRSLSWAIQEMILGANPAV

SEQ ID NO: 711399 - protein, 19 aa, Mycobacterium
PRSNIFVVFNSVQNQLVSP

SEQ ID NO: 711400 - protein, 25 aa, Mycobacterium
PRSNLARYGIAPTYPLDFAADVKNN

SEQ ID NO: 711401 - protein, 23 aa, Mycobacterium
PRSNYTKSLRMFAVLPTIVAADM

SEQ ID NO: 711402 - protein, 32 aa, Mycobacterium
PRSPAIRKVLWRLPDALLPGTDTDPWVIAVNP

SEQ ID NO: 711403 - protein, 22 aa, Mycobacterium
PRSPRCRRGAVATDIVSREADD

SEQ ID NO: 711404 - protein, 21 aa, Mycobacterium
PRSRMGRIAWSWFRHPVKSHE

SEQ ID NO: 711405 - protein, 24 aa, Mycobacterium
PRSRPCVATALTLYSEILDRIEGD

SEQ ID NO: 711406 - protein, 19 aa, Mycobacterium
PRSRRELVAELTAHGEGVV

SEQ ID NO: 711407 - protein, 20 aa, Mycobacterium
PRSRRISARRVVEMAPTVRR

SEQ ID NO: 711408 - protein, 20 aa, Mycobacterium
PRSRSPLRLATWNVNSIRSR

SEQ ID NO: 711409 - protein, 20 aa, Mycobacterium
PRSRVELVAGATSRLKRFRV

SEQ ID NO: 711410 - protein, 20 aa, Mycobacterium
PRSRVGRIAWSWFRHPVKSH

SEQ ID NO: 711411 - protein, 18 aa, Mycobacterium
PRSSHFSSTLGLTMTLLD

SEQ ID NO: 711412 - protein, 17 aa, Mycobacterium
PRSSLLVLGDGRNNYRN

SEQ ID NO: 711413 - protein, 24 aa, Mycobacterium
PRSTEVLAALGLPTEMDYMGYADS

SEQ ID NO: 711414 - protein, 22 aa, Mycobacterium
PRSTRPFATYRIAVGKRHKIGP

SEQ ID NO: 711415 - protein, 17 aa, Mycobacterium
PRSVAAFPAPWLVTDKY

SEQ ID NO: 711416 - protein, 19 aa, Mycobacterium
PRSVAFNVQAFRVAVRPQT

SEQ ID NO: 711417 - protein, 20 aa, Mycobacterium
PRTAEAMADLAPRYFDQREL

SEQ ID NO: 711418 - protein, 20 aa, Mycobacterium
PRTAEYPDYRGYAGQVAAGA

SEQ ID NO: 711419 - protein, 21 aa, Mycobacterium
PRTAPVWPPTSYRVGPPQPSD

SEQ ID NO: 711420 - protein, 20 aa, Mycobacterium
PRTAQPGGLSTWLDPSINDF

SEQ ID NO: 711421 - protein, 19 aa, Mycobacterium
PRTDFHAEVLRMQKATNAV

SEQ ID NO: 711422 - protein, 21 aa, Mycobacterium
PRTDIAFGGLAGRLHYDADHF

SEQ ID NO: 711423 - protein, 24 aa, Mycobacterium
PRTDYSLGAFAVWLRDFLDELGVS

SEQ ID NO: 711424 - protein, 23 aa, Mycobacterium
PRTDYSLGAFAVWLRDLLDELGV

SEQ ID NO: 711425 - protein, 17 aa, Mycobacterium
PRTEAVSAFAQKHSKDI

SEQ ID NO: 711426 - protein, 21 aa, Mycobacterium
PRTGASLFEPYLAMLQASPSG

SEQ ID NO: 711427 - protein, 17 aa, Mycobacterium
PRTGFIDAIVRIVQHGR

SEQ ID NO: 711428 - protein, 21 aa, Mycobacterium
PRTGLWLLLLAKGGGDTGVSA

SEQ ID NO: 711429 - protein, 17 aa, Mycobacterium
PRTGRHLGNFPQAFTHL

SEQ ID NO: 711430 - protein, 18 aa, Mycobacterium
PRTGRHLGNFPQAFTHLA

SEQ ID NO: 711431 - protein, 17 aa, Mycobacterium
PRTGRQLGNFPQAFTHL

SEQ ID NO: 711432 - protein, 17 aa, Mycobacterium
PRTGSLLRTMDLQTVTL

SEQ ID NO: 711433 - protein, 19 aa, Mycobacterium
PRTGTTILFDLLAQDPALR

SEQ ID NO: 711434 - protein, 20 aa, Mycobacterium
PRTGYLAVHDRLDYQILAEI

SEQ ID NO: 711435 - protein, 21 aa, Mycobacterium
PRTHPHPILFVGGMSVAAARR

SEQ ID NO: 711436 - protein, 21 aa, Mycobacterium
PRTHVALRLLAKAKRLRGTPL

SEQ ID NO: 711437 - protein, 26 aa, Mycobacterium
PRTIPAAELAGGFSTIAGRRSAGRVE

SEQ ID NO: 711438 - protein, 21 aa, Mycobacterium
PRTKRGVISYAARDIGERLDA

SEQ ID NO: 711439 - protein, 19 aa, Mycobacterium
PRTLEAMLAAGAHVEDISV

SEQ ID NO: 711440 - protein, 20 aa, Mycobacterium
PRTLIGWTSRFLGMVQPGDE

SEQ ID NO: 711441 - protein, 19 aa, Mycobacterium
PRTLPRGTVAVARGARSLT

SEQ ID NO: 711442 - protein, 21 aa, Mycobacterium
PRTLRDARIGYIGFGHIGRTS

SEQ ID NO: 711443 - protein, 24 aa, Mycobacterium
PRTLRLDQLIRLYVDHQLDVIVRR

SEQ ID NO: 711444 - protein, 24 aa, Mycobacterium
PRTLRLDQLIRLYVNHQLDVIIRR

SEQ ID NO: 711445 - protein, 21 aa, Mycobacterium
PRTLTEIARELGLAKSSVSNL

SEQ ID NO: 711446 - protein, 25 aa, Mycobacterium
PRTNEPPWLWPAEIASVLLAGPAER

SEQ ID NO: 711447 - protein, 25 aa, Mycobacterium
PRTNEPPWLWPAELASVLLAGPAEQ

SEQ ID NO: 711448 - protein, 22 aa, Mycobacterium
PRTNLGNMRAMLTFTPSSTYTR

SEQ ID NO: 711449 - protein, 24 aa, Mycobacterium
PRTPCRTFSAFLGLSHWIHTFTQA

SEQ ID NO: 711450 - protein, 19 aa, Mycobacterium
PRTPEAVVAMLAVLKTGAA

SEQ ID NO: 711451 - protein, 20 aa, Mycobacterium
PRTPLLSNLLGISGEMKAAP

SEQ ID NO: 711452 - protein, 21 aa, Mycobacterium
PRTPRHGFFLLSLQRDVDATL

SEQ ID NO: 711453 - protein, 23 aa, Mycobacterium
PRTPSPDELPAWINTEAIELTDP

SEQ ID NO: 711454 - protein, 19 aa, Mycobacterium
PRTQEVFDDLGIAPAINSG

SEQ ID NO: 711455 - protein, 19 aa, Mycobacterium
PRTRLHSQLDFGGTSQGSK

SEQ ID NO: 711456 - protein, 24 aa, Mycobacterium
PRTRMGRMAWSWLRHPVKSREFPA

SEQ ID NO: 711457 - protein, 27 aa, Mycobacterium
PRTRPNGVRSWPRLVPDMDIAAVQEDW

SEQ ID NO: 711458 - protein, 21 aa, Mycobacterium
PRTRRLPVKPSVGFNYLASQH

SEQ ID NO: 711459 - protein, 21 aa, Mycobacterium
PRTRSAAPLPRSGNTVADITA

SEQ ID NO: 711460 - protein, 24 aa, Mycobacterium
PRTSEAPDPLALARRIAAALNAPD

SEQ ID NO: 711461 - protein, 22 aa, Mycobacterium
PRTSGLARRAAPAVQPRCGVTR

SEQ ID NO: 711462 - protein, 19 aa, Mycobacterium
PRTSLPFAGHPIVGVSWWL

SEQ ID NO: 711463 - protein, 24 aa, Mycobacterium
PRTTARIGSWMRAALGAAELRSLR

SEQ ID NO: 711464 - protein, 22 aa, Mycobacterium
PRTTEGHWLLKLHGSVDQPEKI

SEQ ID NO: 711465 - protein, 20 aa, Mycobacterium
PRTTIGWKGLINDPGMDGTF

SEQ ID NO: 711466 - protein, 19 aa, Mycobacterium
PRTVALTVYGDLETATLRE

SEQ ID NO: 711467 - protein, 19 aa, Mycobacterium
PRTVALTVYGDLETSTLRE

SEQ ID NO: 711468 - protein, 20 aa, Mycobacterium
PRTVSALEMTFFGALVNAGS

SEQ ID NO: 711469 - protein, 21 aa, Mycobacterium
PRTYLGLGVDGFPNLFVVTGP

SEQ ID NO: 711470 - protein, 20 aa, Mycobacterium
PRTYLGLSVDGFPNLFLISG

SEQ ID NO: 711471 - protein, 22 aa, Mycobacterium
PRTYLLSGLLRCGRCGNRLYSQ

SEQ ID NO: 711472 - protein, 20 aa, Mycobacterium
PRVAEDLRHFSLSLRTEVTT

SEQ ID NO: 711473 - protein, 20 aa, Mycobacterium
PRVAEQLERGGLRPGRRSAL

SEQ ID NO: 711474 - protein, 17 aa, Mycobacterium
PRVAEVFASGAISYRLV

SEQ ID NO: 711475 - protein, 17 aa, Mycobacterium
PRVALVSATGSVRMGRE

SEQ ID NO: 711476 - protein, 26 aa, Mycobacterium
PRVAQDFDATVCWMADSGVLEPGRDY

SEQ ID NO: 711477 - protein, 25 aa, Mycobacterium
PRVAQEFDATVCWMADGAALEPGRD

SEQ ID NO: 711478 - protein, 27 aa, Mycobacterium
PRVARTATHLFLFAGYVEQFRGWGPTL

SEQ ID NO: 711479 - protein, 19 aa, Mycobacterium
PRVATLLGSFETSSCALGM

SEQ ID NO: 711480 - protein, 17 aa, Mycobacterium
PRVAVPTLILHRDNPDF

SEQ ID NO: 711481 - protein, 20 aa, Mycobacterium
PRVAWERELLPGAQVVLAPT

SEQ ID NO: 711482 - protein, 26 aa, Mycobacterium
PRVDEARAALSWWRHRQSIIETGISP

SEQ ID NO: 711483 - protein, 18 aa, Mycobacterium
PRVDLALHGDADRFLDAL

SEQ ID NO: 711484 - protein, 18 aa, Mycobacterium
PRVDRFFAAIEAEMLYAL

SEQ ID NO: 711485 - protein, 19 aa, Mycobacterium
PRVEGGVLRAGPDFRRRSC

SEQ ID NO: 711486 - protein, 25 aa, Mycobacterium
PRVFKRIRPAFTYQRSLDVLTAARQ

SEQ ID NO: 711487 - protein, 18 aa, Mycobacterium
PRVFMLFIGGFGVYLDIC

SEQ ID NO: 711488 - protein, 24 aa, Mycobacterium
PRVFRRIRPAFSYERSLSVITAAR

SEQ ID NO: 711489 - protein, 18 aa, Mycobacterium
PRVGARFVGYNEHEAFGQ

SEQ ID NO: 711490 - protein, 18 aa, Mycobacterium
PRVGLAQQILEAVATPGV

SEQ ID NO: 711491 - protein, 18 aa, Mycobacterium
PRVHAGLLADTRKPEHLA

SEQ ID NO: 711492 - protein, 21 aa, Mycobacterium
PRVHRWARGVDVLRFAPSARD

SEQ ID NO: 711493 - protein, 21 aa, Mycobacterium
PRVHRWARGVDVLRFAPSGRD

SEQ ID NO: 711494 - protein, 20 aa, Mycobacterium
PRVIPEGARAVFFVVEADRR

SEQ ID NO: 711495 - protein, 18 aa, Mycobacterium
PRVIVCLGATAAQSLLGA

SEQ ID NO: 711496 - protein, 17 aa, Mycobacterium
PRVKDGRIEIVSAVESF

SEQ ID NO: 711497 - protein, 17 aa, Mycobacterium
PRVKRTLTASGLRQLIA

SEQ ID NO: 711498 - protein, 26 aa, Mycobacterium
PRVLAPSALVGRLRAVVCAPDGAVDD

SEQ ID NO: 711499 - protein, 26 aa, Mycobacterium
PRVLDELTRAAARWVPGAQEAGITVT

SEQ ID NO: 711500 - protein, 23 aa, Mycobacterium
PRVLQFKPGLLLNRDLCEDVLDR

SEQ ID NO: 711501 - protein, 25 aa, Mycobacterium
PRVLQFKPGLLLSRELCEDVLDRLE

SEQ ID NO: 711502 - protein, 23 aa, Mycobacterium
PRVLQIRALVLGGAMDWLQDNQA

SEQ ID NO: 711503 - protein, 25 aa, Mycobacterium
PRVLQIRALVLGTALDWIKSNHSTG

SEQ ID NO: 711504 - protein, 25 aa, Mycobacterium
PRVLQIRALVLGTALDWLADNTASS

SEQ ID NO: 711505 - protein, 23 aa, Mycobacterium
PRVLQIRALVLGTAMDWLADNTA

SEQ ID NO: 711506 - protein, 25 aa, Mycobacterium
PRVLSAAALVGRLRGVVCAPDGTVD

SEQ ID NO: 711507 - protein, 17 aa, Mycobacterium
PRVLSDWLDGGRGDLDP

SEQ ID NO: 711508 - protein, 21 aa, Mycobacterium
PRVMANFGLEWDAVRAANPHA

SEQ ID NO: 711509 - protein, 19 aa, Mycobacterium
PRVNPDLLRHITHRREADR

SEQ ID NO: 711510 - protein, 34 aa, Mycobacterium
PRVNRELGELITFAIRIPLEIDMVVDLRIDKPKF

SEQ ID NO: 711511 - protein, 29 aa, Mycobacterium
PRVPAPLFRSSMKTVEWLFWRSTKRVENE

SEQ ID NO: 711512 - protein, 28 aa, Mycobacterium
PRVPEDLAFAESRIRPSTIAAEDLLHDI

SEQ ID NO: 711513 - protein, 17 aa, Mycobacterium
PRVPGMEPLVMGGLGLA

SEQ ID NO: 711514 - protein, 20 aa, Mycobacterium
PRVPMEGRFIYAGVADRLVH

SEQ ID NO: 711515 - protein, 22 aa, Mycobacterium
PRVPTLPGQDVFRGDQHHSSAH

SEQ ID NO: 711516 - protein, 24 aa, Mycobacterium
PRVQLLTRDGCTICERVHARLGEL

SEQ ID NO: 711517 - protein, 23 aa, Mycobacterium
PRVRGICPDAAYVGAPFMISERI

SEQ ID NO: 711518 - protein, 27 aa, Mycobacterium
PRVRRFWPRRYRRSSFYWKLISLDRRF

SEQ ID NO: 711519 - protein, 18 aa, Mycobacterium
PRVSFLIEDGDTYDTLRG

SEQ ID NO: 711520 - protein, 19 aa, Mycobacterium
PRVSLTVLDSDDWYTHVTV

SEQ ID NO: 711521 - protein, 17 aa, Mycobacterium
PRVSPLAYFDIDGKLIV

SEQ ID NO: 711522 - protein, 17 aa, Mycobacterium
PRVSPMLADDLSGAPAT

SEQ ID NO: 711523 - protein, 22 aa, Mycobacterium
PRVSRAAFERGLLVETSGPKDE

SEQ ID NO: 711524 - protein, 18 aa, Mycobacterium
PRVSVPVYPARVTTEGHI

SEQ ID NO: 711525 - protein, 25 aa, Mycobacterium
PRVTDCAGLRRVFCSGEVLPYDVQE

SEQ ID NO: 711526 - protein, 18 aa, Mycobacterium
PRVTLPYTASAWEAVVAL

SEQ ID NO: 711527 - protein, 17 aa, Mycobacterium
PRVTLPYTDAAWASIVD

SEQ ID NO: 711528 - protein, 18 aa, Mycobacterium
PRVTLPYTDEAWHTICEV

SEQ ID NO: 711529 - protein, 18 aa, Mycobacterium
PRVTLPYTDEAWQTICDV

SEQ ID NO: 711530 - protein, 21 aa, Mycobacterium
PRVTRKLGDLITFVIHIPLSI

SEQ ID NO: 711531 - protein, 21 aa, Mycobacterium
PRVTYVRWAGLPSHPHHDRAR

SEQ ID NO: 711532 - protein, 19 aa, Mycobacterium
PRVVCHPTESYGMRITDPS

SEQ ID NO: 711533 - protein, 25 aa, Mycobacterium
PRVVGKARAADILLTDRVVEASEAL

SEQ ID NO: 711534 - protein, 19 aa, Mycobacterium
PRVVICVDDPHPPYSFVQV

SEQ ID NO: 711535 - protein, 20 aa, Mycobacterium
PRVVQLAVLVDRGHRELPLR

SEQ ID NO: 711536 - protein, 19 aa, Mycobacterium
PRVVVGVTVGRECHPVVTP

SEQ ID NO: 711537 - protein, 23 aa, Mycobacterium
PRVWEKLKAAIEFTVSHESDEMK

SEQ ID NO: 711538 - protein, 23 aa, Mycobacterium
PRVWEKLKAGIEFAIANEADEAT

SEQ ID NO: 711539 - protein, 23 aa, Mycobacterium
PRVWEKLKAGIEFTISHETDEMK

SEQ ID NO: 711540 - protein, 25 aa, Mycobacterium
PRVWFGEQWITSVLDLYRENIRYFP

SEQ ID NO: 711541 - protein, 20 aa, Mycobacterium
PRVYAAVALHPTRAGNLTDE

SEQ ID NO: 711542 - protein, 19 aa, Mycobacterium
PRVYPCRTCATPVEVDNLV

SEQ ID NO: 711543 - protein, 17 aa, Mycobacterium
PRWKDHPIWKLTFGSQH

SEQ ID NO: 711544 - protein, 18 aa, Mycobacterium
PRWKGVSGADMLRHVGDL

SEQ ID NO: 711545 - protein, 24 aa, Mycobacterium
PRWLAESLPAPLPRGTVAVLSGAR

SEQ ID NO: 711546 - protein, 24 aa, Mycobacterium
PRWLARKMAALALGSSDLPVCCSN

SEQ ID NO: 711547 - protein, 21 aa, Mycobacterium
PRWLPEKICWLLSDEYHANEG

SEQ ID NO: 711548 - protein, 18 aa, Mycobacterium
PRWLVKHLPEHAREAVMF

SEQ ID NO: 711549 - protein, 17 aa, Mycobacterium
PRWPAMTKPVIGAINGA

SEQ ID NO: 711550 - protein, 19 aa, Mycobacterium
PRWRQFAFGVLGFAQGSGP

SEQ ID NO: 711551 - protein, 24 aa, Mycobacterium
PRWSDPSLAALTWLANPQRLQNFF

SEQ ID NO: 711552 - protein, 38 aa, Mycobacterium
PRWSLELAGGALMDLGCYGVHVLRRFGVPSILSATAVQ

SEQ ID NO: 711553 - protein, 21 aa, Mycobacterium
PRWSPQTRKMFVRGPVQAGTN

SEQ ID NO: 711554 - protein, 22 aa, Mycobacterium
PRWTELKSRVRDYLGTKIEFRL

SEQ ID NO: 711555 - protein, 17 aa, Mycobacterium
PRWTVRRILADALPAER

SEQ ID NO: 711556 - protein, 17 aa, Mycobacterium
PRWVDSLLVRRHAELHV

SEQ ID NO: 711557 - protein, 17 aa, Mycobacterium
PRYAAFFEQTYRLLPRD

SEQ ID NO: 711558 - protein, 21 aa, Mycobacterium
PRYADLPATLLDMLAEQVERR

SEQ ID NO: 711559 - protein, 21 aa, Mycobacterium
PRYAELIKRTQWWGRQMTIWG

SEQ ID NO: 711560 - protein, 25 aa, Mycobacterium
PRYAFLGVRGCDLAAIATLDRVLGG

SEQ ID NO: 711561 - protein, 26 aa, Mycobacterium
PRYAVGCKRPGFHNGYLSTFNRDNVQ

SEQ ID NO: 711562 - protein, 34 aa, Mycobacterium
PRYDELIARTQWWGRQMLIWGVHVHVGISSKHKV

SEQ ID NO: 711563 - protein, 19 aa, Mycobacterium
PRYDPALLRDGDSRNVVDA

SEQ ID NO: 711564 - protein, 17 aa, Mycobacterium
PRYDVIGARFAAWPQIS

SEQ ID NO: 711565 - protein, 22 aa, Mycobacterium
PRYEETVFLPALVPSPSAFSER

SEQ ID NO: 711566 - protein, 19 aa, Mycobacterium
PRYEVKWDGLQRVHMQNVA

SEQ ID NO: 711567 - protein, 26 aa, Mycobacterium
PRYGEFRYAINNSFGFGGHNVALAFG

SEQ ID NO: 711568 - protein, 22 aa, Mycobacterium
PRYHPACHAAAWPLVGGCDGPT

SEQ ID NO: 711569 - protein, 19 aa, Mycobacterium
PRYLNYRKTSIYGGSNEVQ

SEQ ID NO: 711570 - protein, 19 aa, Mycobacterium
PRYLRDLRELCRRHDVLLV

SEQ ID NO: 711571 - protein, 20 aa, Mycobacterium
PRYLSKSGVVAVGEIGYDSM

SEQ ID NO: 711572 - protein, 25 aa, Mycobacterium
PRYNPWDERLCLAPNGDLFKTIRAG

SEQ ID NO: 711573 - protein, 25 aa, Mycobacterium
PRYNPWDQRMCLIPDADLYEAISAG

SEQ ID NO: 711574 - protein, 25 aa, Mycobacterium
PRYNPWDQRMCLIPDADLYNAIAAG

SEQ ID NO: 711575 - protein, 25 aa, Mycobacterium
PRYNPWDQRMCLVLDKDIFEGISSG

SEQ ID NO: 711576 - protein, 17 aa, Mycobacterium
PRYQALVSDCMAMPEPA

SEQ ID NO: 711577 - protein, 19 aa, Mycobacterium
PRYQIVMGERRWRAAQEAG

SEQ ID NO: 711578 - protein, 19 aa, Mycobacterium
PRYQLVMGERRWRAAQQAG

SEQ ID NO: 711579 - protein, 19 aa, Mycobacterium
PRYRAQRSVEEYGKIVDYL

SEQ ID NO: 711580 - protein, 22 aa, Mycobacterium
PRYRIEAAEALIADVPPPRDSV

SEQ ID NO: 711581 - protein, 23 aa, Mycobacterium
PRYRRIGDEFGMIAHEQGICGCH

SEQ ID NO: 711582 - protein, 20 aa, Mycobacterium
PRYSAASVRLHPDIRLYCAI

SEQ ID NO: 711583 - protein, 33 aa, Mycobacterium
PRYSGHAIAGVSGFGFGGANAHIVVREVLPIDL

SEQ ID NO: 711584 - protein, 32 aa, Mycobacterium
PRYSGKAIAGVSGFGFGGANAHVVMREVLAGD

SEQ ID NO: 711585 - protein, 21 aa, Mycobacterium
PRYTLWAAWHRSGLQSRWLTA

SEQ ID NO: 711586 - protein, 21 aa, Mycobacterium
PRYTPSAGLADFVRCRDLTCR

SEQ ID NO: 711587 - protein, 17 aa, Mycobacterium
PRYVDLRPFAVNDGNDI

SEQ ID NO: 711588 - protein, 19 aa, Mycobacterium
PRYYGMMPRGVRLRANMIR

SEQ ID NO: 711589 - protein, 18 aa, Mycobacterium
PSAAASRYQQLRSHLAEL

SEQ ID NO: 711590 - protein, 24 aa, Mycobacterium
PSAACPPEAAGLLFSEANDIAGIT

SEQ ID NO: 711591 - protein, 23 aa, Mycobacterium
PSAADVLGSWPWPALGSVTAHIC

SEQ ID NO: 711592 - protein, 17 aa, Mycobacterium
PSAAIRLLQEFHAAPLN

SEQ ID NO: 711593 - protein, 20 aa, Mycobacterium
PSAAPRVIGLPGPATAMSDD

SEQ ID NO: 711594 - protein, 18 aa, Mycobacterium
PSAARVAIGPNLTGKTTT

SEQ ID NO: 711595 - protein, 19 aa, Mycobacterium
PSACIQLGGDFAFNAAAWQ

SEQ ID NO: 711596 - protein, 17 aa, Mycobacterium
PSADRFLTYPGYGRHDE

SEQ ID NO: 711597 - protein, 20 aa, Mycobacterium
PSAEEIVAWCRERLAHFKCP

SEQ ID NO: 711598 - protein, 20 aa, Mycobacterium
PSAFVSNFLGMWAPQLQAGD

SEQ ID NO: 711599 - protein, 19 aa, Mycobacterium
PSAGHPITIEPTKGRVQVR

SEQ ID NO: 711600 - protein, 23 aa, Mycobacterium
PSAGSPLAWLLTLAHRRAVDRVR

SEQ ID NO: 711601 - protein, 19 aa, Mycobacterium
PSAGVRRRYPWGAQEPCDA

SEQ ID NO: 711602 - protein, 23 aa, Mycobacterium
PSAIRLGLFSGHYREDRFWSNEV

SEQ ID NO: 711603 - protein, 17 aa, Mycobacterium
PSAIRRLGLTYDSLKEF

SEQ ID NO: 711604 - protein, 17 aa, Mycobacterium
PSALAMLAPTTFDVETV

SEQ ID NO: 711605 - protein, 18 aa, Mycobacterium
PSALKAAEMLAEEWDVSA

SEQ ID NO: 711606 - protein, 18 aa, Mycobacterium
PSALLRIAAKRGGRIRGV

SEQ ID NO: 711607 - protein, 23 aa, Mycobacterium
PSALPDYVSGLLIADEIRHLLPA

SEQ ID NO: 711608 - protein, 19 aa, Mycobacterium
PSALPLTGERTIPGLAEEN

SEQ ID NO: 711609 - protein, 20 aa, Mycobacterium
PSALQLAVRMARTLNTSLRV

SEQ ID NO: 711610 - protein, 20 aa, Mycobacterium
PSAPQHRAPGLGPSAQPPSA

SEQ ID NO: 711611 - protein, 17 aa, Mycobacterium
PSAPREVRHAQGETEVP

SEQ ID NO: 711612 - protein, 25 aa, Mycobacterium
PSAPVAGLDLRWAAVDLDGRRSTVT

SEQ ID NO: 711613 - protein, 17 aa, Mycobacterium
PSAPVVDPVPPVPAAPP

SEQ ID NO: 711614 - protein, 18 aa, Mycobacterium
PSAQFGFGARLLVDGIGQ

SEQ ID NO: 711615 - protein, 21 aa, Mycobacterium
PSARAGEMLNLVASYAADPLD

SEQ ID NO: 711616 - protein, 24 aa, Mycobacterium
PSARAPWEIARPVGADGALAKEFT

SEQ ID NO: 711617 - protein, 27 aa, Mycobacterium
PSARIKRFIKTFVMFAAEHPDLIRIMD

SEQ ID NO: 711618 - protein, 26 aa, Mycobacterium
PSARLRVAPTASWMFEYYPMREVREL

SEQ ID NO: 711619 - protein, 19 aa, Mycobacterium
PSARLVVGMSLGGLTALRL

SEQ ID NO: 711620 - protein, 21 aa, Mycobacterium
PSARSKRVLLQGWEQFDEKVD

SEQ ID NO: 711621 - protein, 19 aa, Mycobacterium
PSARYRRWLAALRGHARVV

SEQ ID NO: 711622 - protein, 18 aa, Mycobacterium
PSASINFVTCHDGFTLND

SEQ ID NO: 711623 - protein, 19 aa, Mycobacterium
PSASINFVTCHDGFTLNDL

SEQ ID NO: 711624 - protein, 23 aa, Mycobacterium
PSASPRGGPLVLWASQTGTAEEF

SEQ ID NO: 711625 - protein, 17 aa, Mycobacterium
PSASYLHLFVARGRLGL

SEQ ID NO: 711626 - protein, 18 aa, Mycobacterium
PSATCSWPTVYGPDDDPP

SEQ ID NO: 711627 - protein, 18 aa, Mycobacterium
PSAVAALGIREWDAVSLI

SEQ ID NO: 711628 - protein, 25 aa, Mycobacterium
PSAVADMMLYLSWSMAGRGAQEGRT

SEQ ID NO: 711629 - protein, 17 aa, Mycobacterium
PSAVAISCEGRRWSYRE

SEQ ID NO: 711630 - protein, 18 aa, Mycobacterium
PSAVDGRFAVPQILGDSE

SEQ ID NO: 711631 - protein, 18 aa, Mycobacterium
PSAVTTAVRWLARGTDPS

SEQ ID NO: 711632 - protein, 20 aa, Mycobacterium
PSAWIAEGLLIYLPASAQEQ

SEQ ID NO: 711633 - protein, 20 aa, Mycobacterium
PSAWSAEGLVVYLPDDAQDA

SEQ ID NO: 711634 - protein, 20 aa, Mycobacterium
PSCADLYARDTWQLVHAGAS

SEQ ID NO: 711635 - protein, 18 aa, Mycobacterium
PSCGACRYCSSGRPALCP

SEQ ID NO: 711636 - protein, 24 aa, Mycobacterium
PSCGKCPTCQAGLRNLCDLGAGLL

SEQ ID NO: 711637 - protein, 19 aa, Mycobacterium
PSCPGWTARDLVAHLGGVH

SEQ ID NO: 711638 - protein, 19 aa, Mycobacterium
PSDAGGLVIRTSDGLEAEN

SEQ ID NO: 711639 - protein, 20 aa, Mycobacterium
PSDAVGESRGLRQPTGTTVA

SEQ ID NO: 711640 - protein, 27 aa, Mycobacterium
PSDDPCAFSFSGLKTAVARYVEAHPDF

SEQ ID NO: 711641 - protein, 36 aa, Mycobacterium
PSDDVPEHRRYLGKHLPYYANWHRLKSYWATADNNY

SEQ ID NO: 711642 - protein, 23 aa, Mycobacterium
PSDEFPVPAVLEVRGEVFFRVAD

SEQ ID NO: 711643 - protein, 23 aa, Mycobacterium
PSDEIYCAGAHVLGIHALAPLFE

SEQ ID NO: 711644 - protein, 20 aa, Mycobacterium
PSDEQGFHWNDPEFGIVWPL

SEQ ID NO: 711645 - protein, 25 aa, Mycobacterium
PSDEVPARVAGLVERLKAAEKELER

SEQ ID NO: 711646 - protein, 24 aa, Mycobacterium
PSDFRLWVCLHEVAHRVQFTANPW

SEQ ID NO: 711647 - protein, 23 aa, Mycobacterium
PSDGRPDEWLQWLHAEHYPALLA

SEQ ID NO: 711648 - protein, 23 aa, Mycobacterium
PSDKNRFIGIPAAFPKLFRSEVD

SEQ ID NO: 711649 - protein, 24 aa, Mycobacterium
PSDLFRKHFWGCFIDDEHGLTNRH

SEQ ID NO: 711650 - protein, 21 aa, Mycobacterium
PSDLPAFCAAILKQFAQATAG

SEQ ID NO: 711651 - protein, 21 aa, Mycobacterium
PSDLPGGPDIPGLDDPSLKPA

SEQ ID NO: 711652 - protein, 23 aa, Mycobacterium
PSDLRVPFDPREVIARIVDGSEF

SEQ ID NO: 711653 - protein, 25 aa, Mycobacterium
PSDLWSAATGLGWTGLALAEDVGGS

SEQ ID NO: 711654 - protein, 18 aa, Mycobacterium
PSDPDWAGEIVYTDVQTA

SEQ ID NO: 711655 - protein, 24 aa, Mycobacterium
PSDRHPHCAWTVIIDDANPAVPEP

SEQ ID NO: 711656 - protein, 33 aa, Mycobacterium
PSDRLLNLLHYVKWYLDGTLTFRRSCAHGVCGS

SEQ ID NO: 711657 - protein, 25 aa, Mycobacterium
PSDRPAMVIADGFFAFLTKEQIIAT

SEQ ID NO: 711658 - protein, 20 aa, Mycobacterium
PSDRTGSVARCYSLCSSPFT

SEQ ID NO: 711659 - protein, 22 aa, Mycobacterium
PSDRTGSVARCYSLSSSPTTDD

SEQ ID NO: 711660 - protein, 19 aa, Mycobacterium
PSDVALWEINEAFASVPIA

SEQ ID NO: 711661 - protein, 23 aa, Mycobacterium
PSDVLQCYLDLVLDGLVARLASG

SEQ ID NO: 711662 - protein, 37 aa, Mycobacterium
PSDVLRLGYNFKDWDLRTAFTWKFLRAATAEQITASV

SEQ ID NO: 711663 - protein, 23 aa, Mycobacterium
PSDWGRCVLTIGVFDGVHRGHAE

SEQ ID NO: 711664 - protein, 28 aa, Mycobacterium
PSDWLDNTMETWKRLCDPVAEQVSTMWT

SEQ ID NO: 711665 - protein, 21 aa, Mycobacterium
PSEADIAKWHGAAKHEALRAL

SEQ ID NO: 711666 - protein, 24 aa, Mycobacterium
PSEDIRTAARWIGTAANWMSCWTM

SEQ ID NO: 711667 - protein, 24 aa, Mycobacterium
PSEDRLDWARRVLAAARSERGVFA

SEQ ID NO: 711668 - protein, 24 aa, Mycobacterium
PSEDWSRPGRMWWSVPPGVDQFHT

SEQ ID NO: 711669 - protein, 23 aa, Mycobacterium
PSEFAKRMVGYAAIVFASNDPIM

SEQ ID NO: 711670 - protein, 17 aa, Mycobacterium
PSEHEYGNGVAIFTRDG

SEQ ID NO: 711671 - protein, 25 aa, Mycobacterium
PSEKEIDRRAALGIGLTSPELATLM

SEQ ID NO: 711672 - protein, 20 aa, Mycobacterium
PSEPSAWLVEGLLIYLPADA

SEQ ID NO: 711673 - protein, 20 aa, Mycobacterium
PSEQTGSVARCYSLSSSPHL

SEQ ID NO: 711674 - protein, 18 aa, Mycobacterium
PSERELASSLRVGRMTVR

SEQ ID NO: 711675 - protein, 24 aa, Mycobacterium
PSERGIEGIERMRLVRDDIAGRVQ

SEQ ID NO: 711676 - protein, 19 aa, Mycobacterium
PSERTRDYFAARARGGVGL

SEQ ID NO: 711677 - protein, 19 aa, Mycobacterium
PSEVARLGYLAGIVATILR

SEQ ID NO: 711678 - protein, 17 aa, Mycobacterium
PSEVIAHQHLKDRDRWR

SEQ ID NO: 711679 - protein, 35 aa, Mycobacterium
PSEVRMGMRVQAVWKPEEEWGLGIDNIDYFRPTGE

SEQ ID NO: 711680 - protein, 18 aa, Mycobacterium
PSFAASFVDHGELTLPTR

SEQ ID NO: 711681 - protein, 18 aa, Mycobacterium
PSFADVPAGWRVVFGEAS

SEQ ID NO: 711682 - protein, 21 aa, Mycobacterium
PSFAGLRPMFDTRLMRLEDEM

SEQ ID NO: 711683 - protein, 26 aa, Mycobacterium
PSFDLATQVMLPFPLILSEATGELIG

SEQ ID NO: 711684 - protein, 19 aa, Mycobacterium
PSFIELRTIIGYPAPKLMN

SEQ ID NO: 711685 - protein, 20 aa, Mycobacterium
PSFVMSNSFANQVIAQIELW

SEQ ID NO: 711686 - protein, 19 aa, Mycobacterium
PSFVVRGSGCSRVVDANLS

SEQ ID NO: 711687 - protein, 24 aa, Mycobacterium
PSGAAALRWWARMARDPLATYASL

SEQ ID NO: 711688 - protein, 18 aa, Mycobacterium
PSGAGDCSAGRAGAGASG

SEQ ID NO: 711689 - protein, 17 aa, Mycobacterium
PSGCGKSTILRALAGLL

SEQ ID NO: 711690 - protein, 17 aa, Mycobacterium
PSGCGKSTILRVLAGLE

SEQ ID NO: 711691 - protein, 24 aa, Mycobacterium
PSGCGKSTLLRMIVGLEDITSGDM

SEQ ID NO: 711692 - protein, 19 aa, Mycobacterium
PSGCGKSTTLRMLAGLETV

SEQ ID NO: 711693 - protein, 24 aa, Mycobacterium
PSGCGKTTLIRCIVGTQIVTSGRV

SEQ ID NO: 711694 - protein, 19 aa, Mycobacterium
PSGCRFRTRCWKATDICAQ

SEQ ID NO: 711695 - protein, 24 aa, Mycobacterium
PSGDGLHVGHPLGYIATDVYARFH

SEQ ID NO: 711696 - protein, 25 aa, Mycobacterium
PSGDGLHVGHPLGYIATDVYARYYR

SEQ ID NO: 711697 - protein, 19 aa, Mycobacterium
PSGDTRAFLGSRIGVRRGA

SEQ ID NO: 711698 - protein, 27 aa, Mycobacterium
PSGECSIEPWVFMNWRRASYYLYLNEV

SEQ ID NO: 711699 - protein, 24 aa, Mycobacterium
PSGEGLHVGHPLGYIATDVYARYF

SEQ ID NO: 711700 - protein, 25 aa, Mycobacterium
PSGEGLHVGHPLGYIATDVYARYFR

SEQ ID NO: 711701 - protein, 22 aa, Mycobacterium
PSGFMLFGTVDHGAWITKAGID

SEQ ID NO: 711702 - protein, 18 aa, Mycobacterium
PSGFTSSVAAIWGPGGSV

SEQ ID NO: 711703 - protein, 17 aa, Mycobacterium
PSGFVKLVADAKHGELL

SEQ ID NO: 711704 - protein, 19 aa, Mycobacterium
PSGGYARTFLTQMEQVLGT

SEQ ID NO: 711705 - protein, 21 aa, Mycobacterium
PSGHRWMLSGPVGVRVPVEAI

SEQ ID NO: 711706 - protein, 20 aa, Mycobacterium
PSGHTADLADWLSSRQPELV

SEQ ID NO: 711707 - protein, 17 aa, Mycobacterium
PSGKALRMACYTAGPMA

SEQ ID NO: 711708 - protein, 20 aa, Mycobacterium
PSGKLPITFPKSEADMPHPD

SEQ ID NO: 711709 - protein, 18 aa, Mycobacterium
PSGLAIAAVAGFPSGKHV

SEQ ID NO: 711710 - protein, 18 aa, Mycobacterium
PSGLRHELFYGQKVVPGS

SEQ ID NO: 711711 - protein, 20 aa, Mycobacterium
PSGMGTVRFQIGLDGKLKAL

SEQ ID NO: 711712 - protein, 21 aa, Mycobacterium
PSGNVKLAMSHVVPDLIQKVA

SEQ ID NO: 711713 - protein, 21 aa, Mycobacterium
PSGNVKLAMSHVVPDLVQKVV

SEQ ID NO: 711714 - protein, 20 aa, Mycobacterium
PSGPMPAAPGAPVESAPGRA

SEQ ID NO: 711715 - protein, 19 aa, Mycobacterium
PSGPVHLVALPRFPEPGSA

SEQ ID NO: 711716 - protein, 21 aa, Mycobacterium
PSGQSYSSFVLIPLLNFAVRR

SEQ ID NO: 711717 - protein, 25 aa, Mycobacterium
PSGRFANALRLCFASTPPERIREGI

SEQ ID NO: 711718 - protein, 26 aa, Mycobacterium
PSGRIKISHGRRLVIDGPDFKCDGPI

SEQ ID NO: 711719 - protein, 19 aa, Mycobacterium
PSGRLMAMIHEGRTETAQY

SEQ ID NO: 711720 - protein, 19 aa, Mycobacterium
PSGRLPITFPADLDQTPRP

SEQ ID NO: 711721 - protein, 21 aa, Mycobacterium
PSGRVELDLFASVFRYAMELT

SEQ ID NO: 711722 - protein, 22 aa, Mycobacterium
PSGSGRLLVAVRFGTTRLLDNV

SEQ ID NO: 711723 - protein, 24 aa, Mycobacterium
PSGSHLLPALIRRYESAKASGTPK

SEQ ID NO: 711724 - protein, 25 aa, Mycobacterium
PSGTEPKLKCYLEVRCAVAVDLAAA

SEQ ID NO: 711725 - protein, 26 aa, Mycobacterium
PSGVLLNVCLSYRISGEVDLARLHDA

SEQ ID NO: 711726 - protein, 25 aa, Mycobacterium
PSGWGHFADDRWELFHIDADRSQCH

SEQ ID NO: 711727 - protein, 18 aa, Mycobacterium
PSGWRNLPSQDQVVVYRD

SEQ ID NO: 711728 - protein, 18 aa, Mycobacterium
PSGYFAWEAAGLRWLAGV

SEQ ID NO: 711729 - protein, 26 aa, Mycobacterium
PSHEGRIGNIGTRSGGAMVYGNFVGR

SEQ ID NO: 711730 - protein, 23 aa, Mycobacterium
PSHELLRQFVIQRFMARVFNANE

SEQ ID NO: 711731 - protein, 19 aa, Mycobacterium
PSHLAGGYAQNAFAFNYLG

SEQ ID NO: 711732 - protein, 18 aa, Mycobacterium
PSHVRFCSSAFDGPTDAG

SEQ ID NO: 711733 - protein, 26 aa, Mycobacterium
PSHWPWAQQWLTLWRNTIGYSPPTAA

SEQ ID NO: 711734 - protein, 20 aa, Mycobacterium
PSHYPLRSVFHAAGVIDDAM

SEQ ID NO: 711735 - protein, 18 aa, Mycobacterium
PSIDEWPLQVDKPLSAAY

SEQ ID NO: 711736 - protein, 18 aa, Mycobacterium
PSIDVTFAGAADFAGSAI

SEQ ID NO: 711737 - protein, 18 aa, Mycobacterium
PSIEIQFTPARVIMQDFT

SEQ ID NO: 711738 - protein, 17 aa, Mycobacterium
PSIGCAPCTAKPADGAD

SEQ ID NO: 711739 - protein, 20 aa, Mycobacterium
PSIGCAPCTSKPIPGADPRS

SEQ ID NO: 711740 - protein, 17 aa, Mycobacterium
PSIGCAPCTTKPAAGAD

SEQ ID NO: 711741 - protein, 20 aa, Mycobacterium
PSIGYGIRYEFGIFRQEISD

SEQ ID NO: 711742 - protein, 20 aa, Mycobacterium
PSIIRKGQGGSIVLVSSSQG

SEQ ID NO: 711743 - protein, 17 aa, Mycobacterium
PSILLTGIIVNKLGQRF

SEQ ID NO: 711744 - protein, 19 aa, Mycobacterium
PSILMPLMNAVGITSESVY

SEQ ID NO: 711745 - protein, 18 aa, Mycobacterium
PSILWRPDSSTVRDTAIV

SEQ ID NO: 711746 - protein, 20 aa, Mycobacterium
PSIPALLEKGTRVFADGVYL

SEQ ID NO: 711747 - protein, 17 aa, Mycobacterium
PSIPYSWNPKYPARIGV

SEQ ID NO: 711748 - protein, 19 aa, Mycobacterium
PSIYSALAEQCRRLDALGI

SEQ ID NO: 711749 - protein, 26 aa, Mycobacterium
PSKDLLRLPMRVRTAIRQTRDVLTGV

SEQ ID NO: 711750 - protein, 21 aa, Mycobacterium
PSKEVLAAAVYVDCVTRYQQA

SEQ ID NO: 711751 - protein, 19 aa, Mycobacterium
PSKIPALLKGRRLKKPLIA

SEQ ID NO: 711752 - protein, 23 aa, Mycobacterium
PSKREFRASPAFDSEAAGLMWAH

SEQ ID NO: 711753 - protein, 29 aa, Mycobacterium
PSKRRIHGVIFFPQWIRVHGERTVCYQNE

SEQ ID NO: 711754 - protein, 25 aa, Mycobacterium
PSKSLLRPVLAVADARRVDGAREAV

SEQ ID NO: 711755 - protein, 31 aa, Mycobacterium
PSLAELFAQIGMRPGMRGGEFAMTMPVSPAV

SEQ ID NO: 711756 - protein, 23 aa, Mycobacterium
PSLAELFAQIGMRPGSRNGEFAM

SEQ ID NO: 711757 - protein, 18 aa, Mycobacterium
PSLARAGAKVNMLQRSPS

SEQ ID NO: 711758 - protein, 17 aa, Mycobacterium
PSLARPFIECLREGHDH

SEQ ID NO: 711759 - protein, 17 aa, Mycobacterium
PSLASRLTGAGQRVAVV

SEQ ID NO: 711760 - protein, 21 aa, Mycobacterium
PSLCLKLQLLDARVHDFSYIS

SEQ ID NO: 711761 - protein, 17 aa, Mycobacterium
PSLDDVFLSMTTDPSEA

SEQ ID NO: 711762 - protein, 17 aa, Mycobacterium
PSLDDVFLSMTTDPSES

SEQ ID NO: 711763 - protein, 17 aa, Mycobacterium
PSLDEMVNFAAAMEREG

SEQ ID NO: 711764 - protein, 23 aa, Mycobacterium
PSLDIGLPWRQYRSVQDGIAGFS

SEQ ID NO: 711765 - protein, 21 aa, Mycobacterium
PSLDIGLTWQQYRTVQRGLAG

SEQ ID NO: 711766 - protein, 24 aa, Mycobacterium
PSLDLAFRICAVFDLPVEAVFSRE

SEQ ID NO: 711767 - protein, 27 aa, Mycobacterium
PSLDLAFRICDVFGLPVEAVFSRTAFT

SEQ ID NO: 711768 - protein, 17 aa, Mycobacterium
PSLEAYQDFPGGGTRTL

SEQ ID NO: 711769 - protein, 17 aa, Mycobacterium
PSLGFTRHLKPVIRRGL

SEQ ID NO: 711770 - protein, 18 aa, Mycobacterium
PSLGRSGAFDILLAAYSL

SEQ ID NO: 711771 - protein, 17 aa, Mycobacterium
PSLGSYVFYPRVRAPRT

SEQ ID NO: 711772 - protein, 19 aa, Mycobacterium
PSLGVEFFGATPADTIYPT

SEQ ID NO: 711773 - protein, 25 aa, Mycobacterium
PSLHAGHLVPLLALRRFQRAGHRPI

SEQ ID NO: 711774 - protein, 24 aa, Mycobacterium
PSLHAGHLVPLLTLRRFQQAGHRP

SEQ ID NO: 711775 - protein, 20 aa, Mycobacterium
PSLIAGFAGTVFWKSDDLEL

SEQ ID NO: 711776 - protein, 20 aa, Mycobacterium
PSLIRRAAGYFDRAVVTRVY

SEQ ID NO: 711777 - protein, 22 aa, Mycobacterium
PSLKGPFAGVPFLLKDLGQEYR

SEQ ID NO: 711778 - protein, 19 aa, Mycobacterium
PSLNAVYPTTDWHERETYD

SEQ ID NO: 711779 - protein, 22 aa, Mycobacterium
PSLPAGYALEVFQAAGANRVLE

SEQ ID NO: 711780 - protein, 17 aa, Mycobacterium
PSLPFGLSKKARYNIDI

SEQ ID NO: 711781 - protein, 17 aa, Mycobacterium
PSLPKAVGIPHTVLLTG

SEQ ID NO: 711782 - protein, 23 aa, Mycobacterium
PSLPQWFAGTWHRAAVLRYGENP

SEQ ID NO: 711783 - protein, 26 aa, Mycobacterium
PSLQRGCAWSGDGWDVQQTVLNRPVT

SEQ ID NO: 711784 - protein, 23 aa, Mycobacterium
PSLQWLRPFAPAFRPRWRDPSRD

SEQ ID NO: 711785 - protein, 21 aa, Mycobacterium
PSLRFEPGEHGVLNLVLDSPG

SEQ ID NO: 711786 - protein, 19 aa, Mycobacterium
PSLRGRSTILKTLRRAEGK

SEQ ID NO: 711787 - protein, 25 aa, Mycobacterium
PSLRPELLESLLFPREAINSAAYKQ

SEQ ID NO: 711788 - protein, 20 aa, Mycobacterium
PSLRQNICFLYHVLGGGTGD

SEQ ID NO: 711789 - protein, 18 aa, Mycobacterium
PSLRRRGAARERAQELAG

SEQ ID NO: 711790 - protein, 26 aa, Mycobacterium
PSLRTRCAGAWLWSGRRGIVAGLAAA

SEQ ID NO: 711791 - protein, 18 aa, Mycobacterium
PSLSGPGRRSVTRRLRKL

SEQ ID NO: 711792 - protein, 19 aa, Mycobacterium
PSLSGRTFVYKGMLTTPQL

SEQ ID NO: 711793 - protein, 26 aa, Mycobacterium
PSLTRSLSFFTVFPWVKEPLTNWLRG

SEQ ID NO: 711794 - protein, 33 aa, Mycobacterium
PSLVGLEPGCPFAPRCPLVIDECRAQEPELLQV

SEQ ID NO: 711795 - protein, 23 aa, Mycobacterium
PSLVIRIAPPVGRQLDWMVCRTV

SEQ ID NO: 711796 - protein, 18 aa, Mycobacterium
PSLVPLVAQNRMRLNELL

SEQ ID NO: 711797 - protein, 25 aa, Mycobacterium
PSLVRLRPAPSLGLPAPLSELAVRP

SEQ ID NO: 711798 - protein, 22 aa, Mycobacterium
PSLYASYALLHKVVRLMRVHGV

SEQ ID NO: 711799 - protein, 18 aa, Mycobacterium
PSLYAVYPTTDWHERETY

SEQ ID NO: 711800 - protein, 20 aa, Mycobacterium
PSLYNTQPWLWVTDGTGLDL

SEQ ID NO: 711801 - protein, 19 aa, Mycobacterium
PSLYSALAEQCRRLDALGI

SEQ ID NO: 711802 - protein, 29 aa, Mycobacterium
PSLYSALAEQCRRLDALGIDYEIVPGVPA

SEQ ID NO: 711803 - protein, 29 aa, Mycobacterium
PSLYSALAEQCRRLDALGIDYEIVPGVPS

SEQ ID NO: 711804 - protein, 20 aa, Mycobacterium
PSLYSALAEQCRRLDALGIG

SEQ ID NO: 711805 - protein, 19 aa, Mycobacterium
PSLYSAVAEQCRRLDVLGI

SEQ ID NO: 711806 - protein, 23 aa, Mycobacterium
PSMAKSYGGFVLKTNELRSVQYF

SEQ ID NO: 711807 - protein, 25 aa, Mycobacterium
PSMDSSWRKLLLVCEAVAEPGDVEA

SEQ ID NO: 711808 - protein, 19 aa, Mycobacterium
PSMFADVRRELAVKAVAQA

SEQ ID NO: 711809 - protein, 17 aa, Mycobacterium
PSMFADVRRELAVRAVA

SEQ ID NO: 711810 - protein, 23 aa, Mycobacterium
PSMGMANTRFGRNVAPSKGRPEQ

SEQ ID NO: 711811 - protein, 20 aa, Mycobacterium
PSMGQLPLSGGVPGGGAAGL

SEQ ID NO: 711812 - protein, 17 aa, Mycobacterium
PSMRAAGAGRIVLVSSA

SEQ ID NO: 711813 - protein, 17 aa, Mycobacterium
PSMRCEFEMAEDHDHDL

SEQ ID NO: 711814 - protein, 23 aa, Mycobacterium
PSMRSLLRMQHRILGGTRRVFRA

SEQ ID NO: 711815 - protein, 25 aa, Mycobacterium
PSMWVQLRAAGLLDHGVSVLALGGE

SEQ ID NO: 711816 - protein, 22 aa, Mycobacterium
PSNGDRKFLWLLNHSKGKAVLH

SEQ ID NO: 711817 - protein, 24 aa, Mycobacterium
PSNLMIDPGLGFAKAGQHNWTLLH

SEQ ID NO: 711818 - protein, 17 aa, Mycobacterium
PSNRLAQIAGRVSALCD

SEQ ID NO: 711819 - protein, 19 aa, Mycobacterium
PSNTLAPFLGFLGGAAAAD

SEQ ID NO: 711820 - protein, 25 aa, Mycobacterium
PSPDLWQRYLGILFDGLRPEGAHPL

SEQ ID NO: 711821 - protein, 17 aa, Mycobacterium
PSPELPSAPVVDPVPPV

SEQ ID NO: 711822 - protein, 28 aa, Mycobacterium
PSPFGPGRPGWHIECAAIALSRVGSGLD

SEQ ID NO: 711823 - protein, 27 aa, Mycobacterium
PSPFGPGRPGWHVECAAIAMTRIGNVL

SEQ ID NO: 711824 - protein, 18 aa, Mycobacterium
PSPGSVYPTLQLLDDEGL

SEQ ID NO: 711825 - protein, 24 aa, Mycobacterium
PSPGTPERGWLRTGDLGFVSEGEM

SEQ ID NO: 711826 - protein, 19 aa, Mycobacterium
PSPHVDWSAGTVRVLTEPV

SEQ ID NO: 711827 - protein, 18 aa, Mycobacterium
PSPHWRPVSRHGRWNWTR

SEQ ID NO: 711828 - protein, 25 aa, Mycobacterium
PSPIGIRPVFRSGNLVGHLITFGVV

SEQ ID NO: 711829 - protein, 17 aa, Mycobacterium
PSPIVVMGVCGAGKTTV

SEQ ID NO: 711830 - protein, 20 aa, Mycobacterium
PSPLEWGCVRFSIIQRADHF

SEQ ID NO: 711831 - protein, 20 aa, Mycobacterium
PSPLLGLLVAASWRARLQPL

SEQ ID NO: 711832 - protein, 18 aa, Mycobacterium
PSPLRAGDRLPVGAHTPD

SEQ ID NO: 711833 - protein, 18 aa, Mycobacterium
PSPLVTRIDGMRERLFQA

SEQ ID NO: 711834 - protein, 21 aa, Mycobacterium
PSPMARIDLRGAELTAARLRA

SEQ ID NO: 711835 - protein, 18 aa, Mycobacterium
PSPNDIDPEWAFQDLGFD

SEQ ID NO: 711836 - protein, 34 aa, Mycobacterium
PSPPTLLWPIGVPFSDGLNSLAVFKVKRLDRQTW

SEQ ID NO: 711837 - protein, 32 aa, Mycobacterium
PSPPTPRLFLDIPNPLASIALPPPASLVAPTS

SEQ ID NO: 711838 - protein, 24 aa, Mycobacterium
PSPQARLALISAIRDAGLSCHVMV

SEQ ID NO: 711839 - protein, 23 aa, Mycobacterium
PSPRGRVTLHWGPRHDAHLLVPE

SEQ ID NO: 711840 - protein, 23 aa, Mycobacterium
PSPSDVCEPLFRVWPVSGRTAEA

SEQ ID NO: 711841 - protein, 22 aa, Mycobacterium
PSPTNWWSLTPGNYTAIIKQTL

SEQ ID NO: 711842 - protein, 20 aa, Mycobacterium
PSPTNWWSLTPGNYTTILKQ

SEQ ID NO: 711843 - protein, 24 aa, Mycobacterium
PSPTPGFEVMYLLSDCDAENVEQL

SEQ ID NO: 711844 - protein, 19 aa, Mycobacterium
PSPWDWAREQAEKYEQSGG

SEQ ID NO: 711845 - protein, 19 aa, Mycobacterium
PSPWDWSREQADKYAASGG

SEQ ID NO: 711846 - protein, 24 aa, Mycobacterium
PSPYRLGTWSALPHLRTRDCEAEV

SEQ ID NO: 711847 - protein, 24 aa, Mycobacterium
PSQECSLGVWPLSARSSAGLSAQA

SEQ ID NO: 711848 - protein, 29 aa, Mycobacterium
PSQGGWSWENFCWLMARVGPLSTPQVAER

SEQ ID NO: 711849 - protein, 25 aa, Mycobacterium
PSQGLPMRNVLAVVAGTKVSVALTV

SEQ ID NO: 711850 - protein, 20 aa, Mycobacterium
PSQHWEVVRIEVPATLARYI

SEQ ID NO: 711851 - protein, 21 aa, Mycobacterium
PSQWPKFAAALVADTPVRGAM

SEQ ID NO: 711852 - protein, 23 aa, Mycobacterium
PSQYEGFGIPPLEAMSQGCPVVC

SEQ ID NO: 711853 - protein, 22 aa, Mycobacterium
PSRAFKPFYMYGTVGENNPPTE

SEQ ID NO: 711854 - protein, 17 aa, Mycobacterium
PSRALVTGAARGIGRSV

SEQ ID NO: 711855 - protein, 21 aa, Mycobacterium
PSRARYLMLRLLERAGEQRVA

SEQ ID NO: 711856 - protein, 17 aa, Mycobacterium
PSRATDVGFRLPAPNGV

SEQ ID NO: 711857 - protein, 23 aa, Mycobacterium
PSRDIPRFVALWQAGRLPVESLV

SEQ ID NO: 711858 - protein, 21 aa, Mycobacterium
PSRDKATVCVAGRNADGRLHV

SEQ ID NO: 711859 - protein, 17 aa, Mycobacterium
PSRDLSYTPLVQVSFAW

SEQ ID NO: 711860 - protein, 20 aa, Mycobacterium
PSREDALLCGDFYDVVQTAD

SEQ ID NO: 711861 - protein, 22 aa, Mycobacterium
PSRELAVPILRSSPEGLSDTLA

SEQ ID NO: 711862 - protein, 25 aa, Mycobacterium
PSRGFPRPRFDDGYGRYDGDDYEDP

SEQ ID NO: 711863 - protein, 26 aa, Mycobacterium
PSRGFPRPRFDDGYGRYEGRDYDDPR

SEQ ID NO: 711864 - protein, 18 aa, Mycobacterium
PSRGRLPLNSQLRRLPLV

SEQ ID NO: 711865 - protein, 28 aa, Mycobacterium
PSRGRRWDEVFTRAGLQVRLYPDGGARI

SEQ ID NO: 711866 - protein, 21 aa, Mycobacterium
PSRGWFELADAILAAGNDPST

SEQ ID NO: 711867 - protein, 20 aa, Mycobacterium
PSRGWFELADAITAAGRDPQ

SEQ ID NO: 711868 - protein, 20 aa, Mycobacterium
PSRGWFELADALTAAGADLE

SEQ ID NO: 711869 - protein, 24 aa, Mycobacterium
PSRGWFELAEAITAAGADPETHAV

SEQ ID NO: 711870 - protein, 25 aa, Mycobacterium
PSRIPGPWNPAAWGMSLSQRTIEDE

SEQ ID NO: 711871 - protein, 29 aa, Mycobacterium
PSRKPVPGHGWRLALLKATFGLVNVGPSP

SEQ ID NO: 711872 - protein, 21 aa, Mycobacterium
PSRLDGNACVALFEGRGTASL

SEQ ID NO: 711873 - protein, 19 aa, Mycobacterium
PSRLDLPSIHSGYWDPFFA

SEQ ID NO: 711874 - protein, 28 aa, Mycobacterium
PSRLGRAAMRAFDWVSWRLNKKVEDAQR

SEQ ID NO: 711875 - protein, 20 aa, Mycobacterium
PSRLLRPSMVLRVMTKSRRA

SEQ ID NO: 711876 - protein, 23 aa, Mycobacterium
PSRLTDACLTRFGSTTDDHRLKW

SEQ ID NO: 711877 - protein, 22 aa, Mycobacterium
PSRLTKARLHFVSGKGGTGKST

SEQ ID NO: 711878 - protein, 24 aa, Mycobacterium
PSRLVNLSSAFGLIAVPYQGAYST

SEQ ID NO: 711879 - protein, 18 aa, Mycobacterium
PSRPHWVELNSPFRPDRR

SEQ ID NO: 711880 - protein, 25 aa, Mycobacterium
PSRPIELWRSAGWLTPYGARAVSAA

SEQ ID NO: 711881 - protein, 24 aa, Mycobacterium
PSRQGACVRATWLKVVPDQLSRSL

SEQ ID NO: 711882 - protein, 25 aa, Mycobacterium
PSRREGSQWLALLLEPPSNAVAPGT

SEQ ID NO: 711883 - protein, 21 aa, Mycobacterium
PSRREPFTGARLVQALRRAGF

SEQ ID NO: 711884 - protein, 21 aa, Mycobacterium
PSRRSRFWADRPVTVEPATDG

SEQ ID NO: 711885 - protein, 17 aa, Mycobacterium
PSRRTAERLGFTYEGTF

SEQ ID NO: 711886 - protein, 20 aa, Mycobacterium
PSRRWGTNRIALRCADEQID

SEQ ID NO: 711887 - protein, 24 aa, Mycobacterium
PSRSEAFPLVILEAMAWAVPVAAS

SEQ ID NO: 711888 - protein, 24 aa, Mycobacterium
PSRSRANFAYYARRALARHPDALS

SEQ ID NO: 711889 - protein, 20 aa, Mycobacterium
PSRVDPGLTRYIAQRRQADR

SEQ ID NO: 711890 - protein, 20 aa, Mycobacterium
PSRVLSIRWWDMKSAKQREW

SEQ ID NO: 711891 - protein, 21 aa, Mycobacterium
PSRVREMILATAFVPPQGSAI

SEQ ID NO: 711892 - protein, 19 aa, Mycobacterium
PSRVWPLLERNKAALADIG

SEQ ID NO: 711893 - protein, 19 aa, Mycobacterium
PSRVWPLLQRKKSALAAIG

SEQ ID NO: 711894 - protein, 24 aa, Mycobacterium
PSRYRVRDFLQWAAAGGHTGPITI

SEQ ID NO: 711895 - protein, 19 aa, Mycobacterium
PSSAKGRYLKKVVVSTTTG

SEQ ID NO: 711896 - protein, 23 aa, Mycobacterium
PSSCEVGTCGTCIGQVVEGSARL

SEQ ID NO: 711897 - protein, 25 aa, Mycobacterium
PSSEMQLHLACFAAFDDIGSVIHSH

SEQ ID NO: 711898 - protein, 20 aa, Mycobacterium
PSSERMMHCLVYRARPDAQA

SEQ ID NO: 711899 - protein, 26 aa, Mycobacterium
PSSGEKPWDVWEFRPPNPTGKTVIAV

SEQ ID NO: 711900 - protein, 17 aa, Mycobacterium
PSSIAMAAAVAPYLAWI

SEQ ID NO: 711901 - protein, 18 aa, Mycobacterium
PSSIAREIVGPGVLIGRS

SEQ ID NO: 711902 - protein, 17 aa, Mycobacterium
PSSLALPLALYRAVTAF

SEQ ID NO: 711903 - protein, 26 aa, Mycobacterium
PSSQLFLGSGVMPWRATVGSGVNVAL

SEQ ID NO: 711904 - protein, 18 aa, Mycobacterium
PSSSKKPVVLIGGLNGAG

SEQ ID NO: 711905 - protein, 17 aa, Mycobacterium
PSSTGWGVEKIAQAWET

SEQ ID NO: 711906 - protein, 20 aa, Mycobacterium
PSSVTPFGHKFGCAPDAAAG

SEQ ID NO: 711907 - protein, 24 aa, Mycobacterium
PSSYLSDIYVSIGMIEIDSENRLF

SEQ ID NO: 711908 - protein, 17 aa, Mycobacterium
PSTALLIDFRDLAIRPV

SEQ ID NO: 711909 - protein, 21 aa, Mycobacterium
PSTDAILTCRLIDRPLRPSFV

SEQ ID NO: 711910 - protein, 20 aa, Mycobacterium
PSTDAILTCRLIDRPLRPTF

SEQ ID NO: 711911 - protein, 17 aa, Mycobacterium
PSTELKRDVALNLIGAI

SEQ ID NO: 711912 - protein, 17 aa, Mycobacterium
PSTFQVLPWKTSDGNHY

SEQ ID NO: 711913 - protein, 21 aa, Mycobacterium
PSTGGSWDAAAAWPDIIRVAA

SEQ ID NO: 711914 - protein, 21 aa, Mycobacterium
PSTGNHHIWAGVAVTDLVNGT

SEQ ID NO: 711915 - protein, 25 aa, Mycobacterium
PSTGRPLLPVPGDWLARRRAGDEIT

SEQ ID NO: 711916 - protein, 24 aa, Mycobacterium
PSTGTNLWGAFGLLAEMMREGRSG

SEQ ID NO: 711917 - protein, 19 aa, Mycobacterium
PSTGTNLWGAFGLLAEMVS

SEQ ID NO: 711918 - protein, 24 aa, Mycobacterium
PSTKEGFGLAAMEALAAGRPVVTR

SEQ ID NO: 711919 - protein, 23 aa, Mycobacterium
PSTLGAKFARWLTGVLDAAEPIA

SEQ ID NO: 711920 - protein, 21 aa, Mycobacterium
PSTLGYKGFPKSCCTSLNEII

SEQ ID NO: 711921 - protein, 17 aa, Mycobacterium
PSTLVYWRKRIAASARP

SEQ ID NO: 711922 - protein, 20 aa, Mycobacterium
PSTPGDLLFHIRAETMDVCF

SEQ ID NO: 711923 - protein, 22 aa, Mycobacterium
PSTPRTGSARVHYHVPLHLAPP

SEQ ID NO: 711924 - protein, 23 aa, Mycobacterium
PSTPSFPPPPLVPADPPVPPSPP

SEQ ID NO: 711925 - protein, 17 aa, Mycobacterium
PSTPWPTYPLMYRVSAA

SEQ ID NO: 711926 - protein, 33 aa, Mycobacterium
PSTRPGLSYQLAEGIALLSKVDWRARGLHDLGR

SEQ ID NO: 711927 - protein, 25 aa, Mycobacterium
PSTVADMMIYLAWTMGGRGAQEGRS

SEQ ID NO: 711928 - protein, 25 aa, Mycobacterium
PSTVADMMIYLTWTMDGRGAHEGRT

SEQ ID NO: 711929 - protein, 25 aa, Mycobacterium
PSTVADMMLYLAWSMAGRGAQEGRT

SEQ ID NO: 711930 - protein, 26 aa, Mycobacterium
PSTVADMMLYLAWSMAGRGAREGRTA

SEQ ID NO: 711931 - protein, 19 aa, Mycobacterium
PSTVDPIAGIPITAVIGDQ

SEQ ID NO: 711932 - protein, 20 aa, Mycobacterium
PSTWMPATRVTRSDWRELFA

SEQ ID NO: 711933 - protein, 27 aa, Mycobacterium
PSTYAWWHERWRLINVLRKRDRILQSA

SEQ ID NO: 711934 - protein, 18 aa, Mycobacterium
PSTYLGLLKLGWIGAKVL

SEQ ID NO: 711935 - protein, 20 aa, Mycobacterium
PSVAAVLAAIVWTKEVWLAT

SEQ ID NO: 711936 - protein, 20 aa, Mycobacterium
PSVAELDKWVIYVPREHTEP

SEQ ID NO: 711937 - protein, 19 aa, Mycobacterium
PSVAHALRNHFWFVEQALR

SEQ ID NO: 711938 - protein, 19 aa, Mycobacterium
PSVAPLCAADIDRAAKRIA

SEQ ID NO: 711939 - protein, 24 aa, Mycobacterium
PSVARRLRLKPGERAVFVERLRYL

SEQ ID NO: 711940 - protein, 30 aa, Mycobacterium; identical to SEQ ID NO: 83385

SEQ ID NO: 711941 - protein, 25 aa, Mycobacterium
PSVDEPFSALAFKIAVHPFFGKLTY

SEQ ID NO: 711942 - protein, 20 aa, Mycobacterium
PSVDYMYSFDPDWSRDWQWS

SEQ ID NO: 711943 - protein, 21 aa, Mycobacterium
PSVEAAREWYFSDAYQAAAKI

SEQ ID NO: 711944 - protein, 19 aa, Mycobacterium
PSVEIQFTPARVIMQDFTG

SEQ ID NO: 711945 - protein, 19 aa, Mycobacterium
PSVEIQFTPARVVMQDFTG

SEQ ID NO: 711946 - protein, 20 aa, Mycobacterium
PSVFASNFAGMWSAQLRAGD

SEQ ID NO: 711947 - protein, 21 aa, Mycobacterium
PSVFDREWPLRVGDIDRTGRL

SEQ ID NO: 711948 - protein, 19 aa, Mycobacterium
PSVGAVLGALVWNKEVWLA

SEQ ID NO: 711949 - protein, 17 aa, Mycobacterium
PSVGMSQPWDFVLVRSP

SEQ ID NO: 711950 - protein, 18 aa, Mycobacterium
PSVPDHISLWGLRLNITQ

SEQ ID NO: 711951 - protein, 19 aa, Mycobacterium
PSVPLRSSDQLGLPSDAKE

SEQ ID NO: 711952 - protein, 26 aa, Mycobacterium
PSVPMKRGGIRLSVTAAHTFAEIDRA

SEQ ID NO: 711953 - protein, 17 aa, Mycobacterium
PSVPRHIEWKHGVCQAL

SEQ ID NO: 711954 - protein, 30 aa, Mycobacterium
PSVRARVVVEAGIAQGWYKFVGDAGQIVSL

SEQ ID NO: 711955 - protein, 20 aa, Mycobacterium
PSVRLAALARLFSVATQPTH

SEQ ID NO: 711956 - protein, 23 aa, Mycobacterium
PSVRLAELARLFSVATQPTHRAL

SEQ ID NO: 711957 - protein, 20 aa, Mycobacterium
PSVRLSELARLFGASTTPTH

SEQ ID NO: 711958 - protein, 19 aa, Mycobacterium
PSVSARVAVEAGIAQCWHK

SEQ ID NO: 711959 - protein, 23 aa, Mycobacterium
PSVTRRLLGAAFGCRVGNYYGSS

SEQ ID NO: 711960 - protein, 17 aa, Mycobacterium
PSVVARIAAERAAGATW

SEQ ID NO: 711961 - protein, 17 aa, Mycobacterium
PSWAWKRIAKSRRPVGA

SEQ ID NO: 711962 - protein, 29 aa, Mycobacterium
PSWSAYWRVEPRPDGSLAPDGPVIDAIED

SEQ ID NO: 711963 - protein, 24 aa, Mycobacterium
PSWVSDLQTVMSIFGTPFFASTSL

SEQ ID NO: 711964 - protein, 20 aa, Mycobacterium
PSWWPVARVGVVTRAARAVA

SEQ ID NO: 711965 - protein, 25 aa, Mycobacterium
PSYALRRRAKALGAIGQFELFLIAA

SEQ ID NO: 711966 - protein, 24 aa, Mycobacterium
PSYALRRRAKALGSIGQLELFLIT

SEQ ID NO: 711967 - protein, 19 aa, Mycobacterium
PSYAMDVCLSSRKGDHNHA

SEQ ID NO: 711968 - protein, 20 aa, Mycobacterium
PSYDLNLFLSGIEQAINGDP

SEQ ID NO: 711969 - protein, 20 aa, Mycobacterium
PSYDVNLFLDGVRQALDGDP

SEQ ID NO: 711970 - protein, 18 aa, Mycobacterium
PSYELMRDCDTLLTVGSS

SEQ ID NO: 711971 - protein, 21 aa, Mycobacterium
PSYEVPKSYVATVLGSVPRGL

SEQ ID NO: 711972 - protein, 19 aa, Mycobacterium
PSYEVPKTYIATVAGTIPR

SEQ ID NO: 711973 - protein, 18 aa, Mycobacterium
PSYGLAEATLFVSTTPMD

SEQ ID NO: 711974 - protein, 18 aa, Mycobacterium
PSYGLAEATLFVSTTPSA

SEQ ID NO: 711975 - protein, 26 aa, Mycobacterium
PSYLPPVGIGEVMRAAGLGEVVESRN

SEQ ID NO: 711976 - protein, 23 aa, Mycobacterium
PSYPPEAIDWLLADSGSRRLEVL

SEQ ID NO: 711977 - protein, 19 aa, Mycobacterium
PSYRAMLPGAFGTRAEGNG

SEQ ID NO: 711978 - protein, 24 aa, Mycobacterium
PSYRVHSLHGYFLRPGDAKERTVF

SEQ ID NO: 711979 - protein, 22 aa, Mycobacterium
PSYSESFGLVAIEAQACGTPVV

SEQ ID NO: 711980 - protein, 23 aa, Mycobacterium
PSYSESFGLVAIEAQACGTPVVA

SEQ ID NO: 711981 - protein, 23 aa, Mycobacterium
PSYTRGYIGTALRLLERKIAQQP

SEQ ID NO: 711982 - protein, 18 aa, Mycobacterium
PSYTRGYVGTALRLLERK

SEQ ID NO: 711983 - protein, 20 aa, Mycobacterium
PSYVRICSALPRTETFKVLK

SEQ ID NO: 711984 - protein, 19 aa, Mycobacterium
PTAAAAWQLARMNLAKITH

SEQ ID NO: 711985 - protein, 26 aa, Mycobacterium
PTAADDVRAGWDWLPEASGLPPERIV

SEQ ID NO: 711986 - protein, 32 aa, Mycobacterium
PTAADDVRAGWDWLPGACGLSPERMVVVADSA

SEQ ID NO: 711987 - protein, 20 aa, Mycobacterium
PTAALTDVWRALRASMRSVL

SEQ ID NO: 711988 - protein, 27 aa, Mycobacterium
PTAAPGWPTRPGWPNTLAGDGRTEIPH

SEQ ID NO: 711989 - protein, 25 aa, Mycobacterium
PTAAPRWVVDPDFNLDFHVRRVRVS

SEQ ID NO: 711990 - protein, 17 aa, Mycobacterium
PTAARPGKLVRGRQPAP

SEQ ID NO: 711991 - protein, 19 aa, Mycobacterium
PTAAVLGALGADEVSAAVA

SEQ ID NO: 711992 - protein, 17 aa, Mycobacterium
PTAAVTLLRLQAVEVVS

SEQ ID NO: 711993 - protein, 20 aa, Mycobacterium
PTAAYVLDSWLRPVPAGVAG

SEQ ID NO: 711994 - protein, 17 aa, Mycobacterium
PTACGLATFSAALAGGL

SEQ ID NO: 711995 - protein, 18 aa, Mycobacterium
PTADAAVLMTRDYQADPL

SEQ ID NO: 711996 - protein, 19 aa, Mycobacterium
PTADFFKKTGFIRANHENA

SEQ ID NO: 711997 - protein, 19 aa, Mycobacterium
PTADIGLGFVTSLPAYNLT

SEQ ID NO: 711998 - protein, 21 aa, Mycobacterium
PTADMLSAILVSLPSYDVNLF

SEQ ID NO: 711999 - protein, 22 aa, Mycobacterium
PTADSGRGWVYIVANNFDRSSP

SEQ ID NO: 712000 - protein, 19 aa, Mycobacterium
PTAEAVAAWQVVSGITSAA

SEQ ID NO: 712001 - protein, 17 aa, Mycobacterium
PTAELLAAGTDEVSEAI

SEQ ID NO: 712002 - protein, 19 aa, Mycobacterium
PTAFWFWGGYEQQRFEEAA

SEQ ID NO: 712003 - protein, 21 aa, Mycobacterium
PTAGECARCLTPLDGTVQVRL

SEQ ID NO: 712004 - protein, 26 aa, Mycobacterium
PTAGFARGTLVGSLTVPPSWASATPA

SEQ ID NO: 712005 - protein, 18 aa, Mycobacterium
PTAGHQGGQGGMGGTGGD

SEQ ID NO: 712006 - protein, 20 aa, Mycobacterium
PTAGLPFHFQEWREWERFVS

SEQ ID NO: 712007 - protein, 24 aa, Mycobacterium
PTAGLPIGGWFGAPSPFAGVGTGP

SEQ ID NO: 712008 - protein, 18 aa, Mycobacterium
PTAGRYLLYLDFKVDDTM

SEQ ID NO: 712009 - protein, 18 aa, Mycobacterium
PTAGYRRNLGYTIDKLFV

SEQ ID NO: 712010 - protein, 19 aa, Mycobacterium
PTAHLLLDRFVNLQVGDWV

SEQ ID NO: 712011 - protein, 23 aa, Mycobacterium
PTAKAAVDMAIWDALGRSLDLSV

SEQ ID NO: 712012 - protein, 25 aa, Mycobacterium
PTAKRLAAGYGHWVYSIRAGGGAVP

SEQ ID NO: 712013 - protein, 17 aa, Mycobacterium
PTALERILSQHTGTGRG

SEQ ID NO: 712014 - protein, 19 aa, Mycobacterium
PTALIPRGSGPVAALPAGP

SEQ ID NO: 712015 - protein, 21 aa, Mycobacterium
PTALLAPPWVPWERRVQPGDL

SEQ ID NO: 712016 - protein, 21 aa, Mycobacterium
PTALRPAMHLGLRVLAQGTPA

SEQ ID NO: 712017 - protein, 23 aa, Mycobacterium
PTALRRRAVRGWLLAAGARDLTD

SEQ ID NO: 712018 - protein, 22 aa, Mycobacterium
PTALRYARLGLVFDPDHFELGR

SEQ ID NO: 712019 - protein, 26 aa, Mycobacterium
PTALSIHGYALFQYANVLARLGDFRA

SEQ ID NO: 712020 - protein, 19 aa, Mycobacterium
PTALTWEIYRDTVIEQCEQ

SEQ ID NO: 712021 - protein, 17 aa, Mycobacterium
PTALVSMNNAMTIGTLK

SEQ ID NO: 712022 - protein, 24 aa, Mycobacterium
PTANAFSGTIAWVQIDLGADSHDH

SEQ ID NO: 712023 - protein, 27 aa, Mycobacterium
PTANPCGVCESCTALAPNAPGSIDVVE

SEQ ID NO: 712024 - protein, 22 aa, Mycobacterium
PTANVRWGNNVAILAGDYLFAT

SEQ ID NO: 712025 - protein, 18 aa, Mycobacterium
PTAPALMGNTVVWKPSVT

SEQ ID NO: 712026 - protein, 20 aa, Mycobacterium
PTAPFWFVGSLGELEAVAAH

SEQ ID NO: 712027 - protein, 26 aa, Mycobacterium
PTAPKLKGGFPGMAGLPGGMPAGFPD

SEQ ID NO: 712028 - protein, 19 aa, Mycobacterium
PTAPVLWSLLASNPDGDFV

SEQ ID NO: 712029 - protein, 20 aa, Mycobacterium
PTAPVTRLRLQAIEVVSAEA

SEQ ID NO: 712030 - protein, 18 aa, Mycobacterium
PTAQFGYEAAASAGTEFA

SEQ ID NO: 712031 - protein, 17 aa, Mycobacterium
PTARAAFGAVLDALASV

SEQ ID NO: 712032 - protein, 22 aa, Mycobacterium
PTARASEMLGLVASYSANPLDP

SEQ ID NO: 712033 - protein, 22 aa, Mycobacterium
PTARCTTVGVPIDYDKPGGAQA

SEQ ID NO: 712034 - protein, 22 aa, Mycobacterium
PTARFCTQFIKLGLGGCDIGVS

SEQ ID NO: 712035 - protein, 24 aa, Mycobacterium
PTARRAVAYAARFLTADRAVVLTA

SEQ ID NO: 712036 - protein, 18 aa, Mycobacterium
PTARRILEHFELDGYFEV

SEQ ID NO: 712037 - protein, 23 aa, Mycobacterium
PTARSIPWAKAVDESGRFRSREE

SEQ ID NO: 712038 - protein, 23 aa, Mycobacterium
PTARSIPWSKAVDESGRFRSREE

SEQ ID NO: 712039 - protein, 17 aa, Mycobacterium
PTARSMAYFSLGYLLKR

SEQ ID NO: 712040 - protein, 24 aa, Mycobacterium
PTASIDIWWCQGFSEPEAGSDLAS

SEQ ID NO: 712041 - protein, 25 aa, Mycobacterium
PTASPRWVVDPDFNLDFHVRRVRVT

SEQ ID NO: 712042 - protein, 26 aa, Mycobacterium
PTASPRWVVDPDFNLEFHVRRMRVAE

SEQ ID NO: 712043 - protein, 25 aa, Mycobacterium
PTATAFPWRRQSAVVQWYVETPSSG

SEQ ID NO: 712044 - protein, 17 aa, Mycobacterium
PTATLRLNCHLHTADGQ

SEQ ID NO: 712045 - protein, 23 aa, Mycobacterium
PTATMRLVCYLREDGGQQHAYGV

SEQ ID NO: 712046 - protein, 27 aa, Mycobacterium
PTATPCGVCDSCVALAPNGPGNMDVTE

SEQ ID NO: 712047 - protein, 21 aa, Mycobacterium
PTAVIPRGAGPAVALPVASAS

SEQ ID NO: 712048 - protein, 18 aa, Mycobacterium
PTAVKWQLLMSAWLDLPG

SEQ ID NO: 712049 - protein, 21 aa, Mycobacterium
PTAWIAEGLFGYLPPEAQDRL

SEQ ID NO: 712050 - protein, 22 aa, Mycobacterium
PTAWIAEGLFGYLPPEAQDRLL

SEQ ID NO: 712051 - protein, 21 aa, Mycobacterium
PTAWLAEGLLMYLPAEAQDKL

SEQ ID NO: 712052 - protein, 17 aa, Mycobacterium
PTAWSAEGLLMYLPPDA

SEQ ID NO: 712053 - protein, 19 aa, Mycobacterium
PTCAFLCRTAESALDVSAQ

SEQ ID NO: 712054 - protein, 36 aa, Mycobacterium
PTCATCGGPSCGLRMCKSCRGAFGSVQARLRTIGVL

SEQ ID NO: 712055 - protein, 23 aa, Mycobacterium
PTCGIRLLPGVAVPADVNPDSHC

SEQ ID NO: 712056 - protein, 23 aa, Mycobacterium
PTCGRSYDIGTEYFVVAGKPDEI

SEQ ID NO: 712057 - protein, 23 aa, Mycobacterium
PTCGSGHFLLGAFARLHQRWQRE

SEQ ID NO: 712058 - protein, 19 aa, Mycobacterium
PTCHYVMGGIEVDPDTAAG

SEQ ID NO: 712059 - protein, 20 aa, Mycobacterium
PTCPGHRRGAFGAGHTALDA

SEQ ID NO: 712060 - protein, 17 aa, Mycobacterium
PTDDWGLAISKRLEWHN

SEQ ID NO: 712061 - protein, 25 aa, Mycobacterium
PTDGGYRITASWRFCSGQHHADWGL

SEQ ID NO: 712062 - protein, 23 aa, Mycobacterium
PTDHPDQRSCIGLHGPNNPCDGH

SEQ ID NO: 712063 - protein, 23 aa, Mycobacterium
PTDIQTAVLYDHFTPFTLIQLEE

SEQ ID NO: 712064 - protein, 17 aa, Mycobacterium
PTDKLRCSATRYDPGGG

SEQ ID NO: 712065 - protein, 28 aa, Mycobacterium
PTDLFGDWLALARLRLLRATVPSAPELL

SEQ ID NO: 712066 - protein, 31 aa, Mycobacterium
PTDPEWWVHVAGEMVEHFELLLNNLLTDPAA

SEQ ID NO: 712067 - protein, 33 aa, Mycobacterium
PTDQALWLEWVFDPAQQWQFPDFSFGQERKWGR

SEQ ID NO: 712068 - protein, 18 aa, Mycobacterium
PTDRAVALIDELEGDRGF

SEQ ID NO: 712069 - protein, 18 aa, Mycobacterium
PTDRELAAGDVLWTDISI

SEQ ID NO: 712070 - protein, 23 aa, Mycobacterium
PTDRGGPDYGRFVEAVRTLQDHT

SEQ ID NO: 712071 - protein, 17 aa, Mycobacterium
PTDRLALLGSRLRGGAT

SEQ ID NO: 712072 - protein, 26 aa, Mycobacterium
PTDTIPNWFFRPLWHRRDRLRPSVPV

SEQ ID NO: 712073 - protein, 24 aa, Mycobacterium
PTDVAATIGRLWAKVADDQGPDSD

SEQ ID NO: 712074 - protein, 24 aa, Mycobacterium
PTEAEWEKACVWDPEIGARRRFPW

SEQ ID NO: 712075 - protein, 18 aa, Mycobacterium
PTEAFRKTFGENFFYILY

SEQ ID NO: 712076 - protein, 24 aa, Mycobacterium
PTECCIKGPHTFLGYTDAEDDEYA

SEQ ID NO: 712077 - protein, 25 aa, Mycobacterium
PTECCRLRKVVPLTKALRGYSAWVT

SEQ ID NO: 712078 - protein, 25 aa, Mycobacterium
PTEHCRQCLAARLRWQRGAGLGEIY

SEQ ID NO: 712079 - protein, 25 aa, Mycobacterium
PTEHLKVQWALAAARHGIALDPRFS

SEQ ID NO: 712080 - protein, 21 aa, Mycobacterium
PTEHPLRAVIHTAAVIDDAVV

SEQ ID NO: 712081 - protein, 20 aa, Mycobacterium
PTELQGGLLMQVENVHERLR

SEQ ID NO: 712082 - protein, 21 aa, Mycobacterium
PTELVKAAGTVEALREVKDAG

SEQ ID NO: 712083 - protein, 24 aa, Mycobacterium
PTEPGVPDFARWGDSAPFVAQAEY

SEQ ID NO: 712084 - protein, 23 aa, Mycobacterium
PTEPTCRAPLGAVLGARSGDKGG

SEQ ID NO: 712085 - protein, 24 aa, Mycobacterium
PTERGRLKVRADLQVPDHPDVFAA

SEQ ID NO: 712086 - protein, 20 aa, Mycobacterium
PTERLGAEAVELAIAMVGGG

SEQ ID NO: 712087 - protein, 18 aa, Mycobacterium
PTERLPVVTARKVVFDEI

SEQ ID NO: 712088 - protein, 25 aa, Mycobacterium
PTERRMCAIYSHLFGKERVGLDDSF

SEQ ID NO: 712089 - protein, 20 aa, Mycobacterium
PTESALKFVGAATFEALSGN

SEQ ID NO: 712090 - protein, 23 aa, Mycobacterium
PTETEVWRWYLIDKNAPDDVRDW

SEQ ID NO: 712091 - protein, 25 aa, Mycobacterium
PTETRCEGGPCPLDDAGRPVVEILT

SEQ ID NO: 712092 - protein, 18 aa, Mycobacterium
PTEVSKWWHSLTPGQQDR

SEQ ID NO: 712093 - protein, 19 aa, Mycobacterium
PTEYFPAKREAAWAKFEPK

SEQ ID NO: 712094 - protein, 21 aa, Mycobacterium
PTEYYKVEWVGFSGNGISYRS

SEQ ID NO: 712095 - protein, 25 aa, Mycobacterium
PTFADTPSGWRVVFGEASRADCLEY

SEQ ID NO: 712096 - protein, 19 aa, Mycobacterium
PTFARPLRPLAPVAQLALG

SEQ ID NO: 712097 - protein, 17 aa, Mycobacterium
PTFASAVPYREPRDQHE

SEQ ID NO: 712098 - protein, 18 aa, Mycobacterium
PTFCHVPFGILIGAVTDK

SEQ ID NO: 712099 - protein, 23 aa, Mycobacterium
PTFEVVARPGAWEEYFKYGNPDG

SEQ ID NO: 712100 - protein, 21 aa, Mycobacterium
PTFGIRLSSRPGIPPTHPVHG

SEQ ID NO: 712101 - protein, 25 aa, Mycobacterium
PTFLHSFAPMPFKPVARDGKPGLQE

SEQ ID NO: 712102 - protein, 18 aa, Mycobacterium
PTFLRVFGLRSMRGRAVQ

SEQ ID NO: 712103 - protein, 17 aa, Mycobacterium
PTFPTPRPTASPPGPTA

SEQ ID NO: 712104 - protein, 19 aa, Mycobacterium
PTFQKGLAHHVAAWRAARL

SEQ ID NO: 712105 - protein, 19 aa, Mycobacterium
PTFRMLAALSGRVPLISIV

SEQ ID NO: 712106 - protein, 17 aa, Mycobacterium
PTFSYRFADHVRYLDAW

SEQ ID NO: 712107 - protein, 20 aa, Mycobacterium
PTFTRRGIATDLMRAQLHQI

SEQ ID NO: 712108 - protein, 21 aa, Mycobacterium
PTFVQGLAFILVRKRLMQLMG

SEQ ID NO: 712109 - protein, 19 aa, Mycobacterium
PTFYFYFKSKDAVLLSLLE

SEQ ID NO: 712110 - protein, 19 aa, Mycobacterium
PTGAFYLKLNDRYDGPLTE

SEQ ID NO: 712111 - protein, 21 aa, Mycobacterium
PTGALGEPVWRRYRREDRAAL

SEQ ID NO: 712112 - protein, 25 aa, Mycobacterium
PTGAVLLQLRWWCLEGRHDPVDELE

SEQ ID NO: 712113 - protein, 20 aa, Mycobacterium
PTGCGKTYLAQTLAKMLNVP

SEQ ID NO: 712114 - protein, 26 aa, Mycobacterium
PTGCRFAARCAHAFSKCTQPPPLEDR

SEQ ID NO: 712115 - protein, 24 aa, Mycobacterium
PTGDAELLIIGWGSSYGPIGEACR

SEQ ID NO: 712116 - protein, 24 aa, Mycobacterium
PTGDAELLLIGWGSSYGPIGEACR

SEQ ID NO: 712117 - protein, 24 aa, Mycobacterium
PTGDAELLLLGWGSSYGPIGEACR

SEQ ID NO: 712118 - protein, 26 aa, Mycobacterium
PTGDPRRARVTLRMLLTHTSGIAGDL

SEQ ID NO: 712119 - protein, 19 aa, Mycobacterium
PTGDVVLWFHGTPGGRRQL

SEQ ID NO: 712120 - protein, 18 aa, Mycobacterium
PTGDYLIWRELLDYSAKS

SEQ ID NO: 712121 - protein, 18 aa, Mycobacterium
PTGGDWVRPELARRLRAE

SEQ ID NO: 712122 - protein, 20 aa, Mycobacterium
PTGGFSAVFNDYGTVNPTSG

SEQ ID NO: 712123 - protein, 18 aa, Mycobacterium
PTGHGIRTSAQLRCGLDT

SEQ ID NO: 712124 - protein, 19 aa, Mycobacterium
PTGIGMLTVFEELFWGDAG

SEQ ID NO: 712125 - protein, 17 aa, Mycobacterium
PTGIRMLIKAGAELAAQ

SEQ ID NO: 712126 - protein, 18 aa, Mycobacterium
PTGIRMLIKAGAELAGHY

SEQ ID NO: 712127 - protein, 25 aa, Mycobacterium
PTGIYTADIMDFWRPNYRSTALVDG

SEQ ID NO: 712128 - protein, 24 aa, Mycobacterium
PTGKARPGYLPVLRAYDYAGDEVV

SEQ ID NO: 712129 - protein, 20 aa, Mycobacterium
PTGLGMLTAFEEMFWGDAGI

SEQ ID NO: 712130 - protein, 19 aa, Mycobacterium
PTGLGMLTVFEELFWGDAG

SEQ ID NO: 712131 - protein, 19 aa, Mycobacterium
PTGLIPGMRTGGMREDTHF

SEQ ID NO: 712132 - protein, 19 aa, Mycobacterium
PTGLPRLAPATFRYDPADP

SEQ ID NO: 712133 - protein, 18 aa, Mycobacterium
PTGLRLDPAVAISELQQA

SEQ ID NO: 712134 - protein, 19 aa, Mycobacterium
PTGPCLAGQVVVIDIVDPP

SEQ ID NO: 712135 - protein, 23 aa, Mycobacterium
PTGPKPRTGSLFRSMDLETVTLE

SEQ ID NO: 712136 - protein, 24 aa, Mycobacterium
PTGPRAADIDRVWPTLDITAHRST

SEQ ID NO: 712137 - protein, 20 aa, Mycobacterium
PTGQHWRLLSTIKELDPSWA

SEQ ID NO: 712138 - protein, 19 aa, Mycobacterium
PTGQHWRLLSTVKELDPSW

SEQ ID NO: 712139 - protein, 19 aa, Mycobacterium
PTGQPHHFFMDRFTEAFRT

SEQ ID NO: 712140 - protein, 23 aa, Mycobacterium
PTGQRGGPMDVPRGTNAPATIDG

SEQ ID NO: 712141 - protein, 25 aa, Mycobacterium
PTGQRLRLLESLDLFGVAIAIEALR

SEQ ID NO: 712142 - protein, 17 aa, Mycobacterium
PTGRAAKFLALQQEVIK

SEQ ID NO: 712143 - protein, 17 aa, Mycobacterium
PTGRGWEVLAGDEVWNW

SEQ ID NO: 712144 - protein, 24 aa, Mycobacterium
PTGRICASTDAWVVRNADIVICVV

SEQ ID NO: 712145 - protein, 18 aa, Mycobacterium
PTGSFMFLGPTGVGKTEL

SEQ ID NO: 712146 - protein, 22 aa, Mycobacterium
PTGTRPDTWLQWLHAEHYPALL

SEQ ID NO: 712147 - protein, 35 aa, Mycobacterium
PTGTVGDLLPILGIPGQMAQNFTNLLPAGSVPELV

SEQ ID NO: 712148 - protein, 17 aa, Mycobacterium
PTGVAAWQLAKLNLAKM

SEQ ID NO: 712149 - protein, 18 aa, Mycobacterium
PTGWEPGSLDAAHTVLAS

SEQ ID NO: 712150 - protein, 22 aa, Mycobacterium
PTGWRPSELGAHAVPVGSPGTT

SEQ ID NO: 712151 - protein, 23 aa, Mycobacterium
PTGYSWGPLAWMLLAQALGQRGM

SEQ ID NO: 712152 - protein, 17 aa, Mycobacterium
PTGYTLSRREFLSDEEL

SEQ ID NO: 712153 - protein, 22 aa, Mycobacterium
PTHDRCCHWIREALDRTHTSWD

SEQ ID NO: 712154 - protein, 20 aa, Mycobacterium
PTHEHPLVWTHRSGRKSLVL

SEQ ID NO: 712155 - protein, 18 aa, Mycobacterium
PTHFPVTVTAEFTGDQLT

SEQ ID NO: 712156 - protein, 19 aa, Mycobacterium
PTHGLSFDCFAGLSPPIIE

SEQ ID NO: 712157 - protein, 20 aa, Mycobacterium
PTHGPFFPQCGGISDQTVSE

SEQ ID NO: 712158 - protein, 20 aa, Mycobacterium
PTHGTVIPKQIGVTTSTPGT

SEQ ID NO: 712159 - protein, 18 aa, Mycobacterium
PTHPELLELAGAVGAAIA

SEQ ID NO: 712160 - protein, 19 aa, Mycobacterium
PTHPVHGPVSLGIAAVETL

SEQ ID NO: 712161 - protein, 20 aa, Mycobacterium
PTHTEFRKLVSRGFTPRQVT

SEQ ID NO: 712162 - protein, 25 aa, Mycobacterium
PTHTGCARTGAAVAAVAAYAAGTAV

SEQ ID NO: 712163 - protein, 17 aa, Mycobacterium
PTIDCFFVVSLRTDVVT

SEQ ID NO: 712164 - protein, 18 aa, Mycobacterium
PTIEAWSGLVTAADAPAE

SEQ ID NO: 712165 - protein, 30 aa, Mycobacterium
PTIGAPRWDTAIIGLDWDTAVLDERLAQRT

SEQ ID NO: 712166 - protein, 29 aa, Mycobacterium
PTIGAPRWNTAIVGLDWETTVLDERLRRR

SEQ ID NO: 712167 - protein, 27 aa, Mycobacterium
PTIGECSRCLTAIEGRVRVALTELFAY

SEQ ID NO: 712168 - protein, 17 aa, Mycobacterium
PTIKGILPVIDINIGNP

SEQ ID NO: 712169 - protein, 20 aa, Mycobacterium
PTIKGIWCVPVYSNPTGATY

SEQ ID NO: 712170 - protein, 20 aa, Mycobacterium
PTIKGMWTVPVFGNPTGVTY

SEQ ID NO: 712171 - protein, 27 aa, Mycobacterium
PTINGKELWGARAAFDFLDAGEDREKI

SEQ ID NO: 712172 - protein, 18 aa, Mycobacterium
PTIPGWRAETLGDDIAWM

SEQ ID NO: 712173 - protein, 26 aa, Mycobacterium
PTIPSIPLPFGLFLSSPEMQQGVASL

SEQ ID NO: 712174 - protein, 20 aa, Mycobacterium
PTISAHWSCDNWDVMAAEVA

SEQ ID NO: 712175 - protein, 18 aa, Mycobacterium
PTISNGYLKAYNRNNVTL

SEQ ID NO: 712176 - protein, 27 aa, Mycobacterium
PTITARLNFQLAFGARVGQRLAEAREQ

SEQ ID NO: 712177 - protein, 26 aa, Mycobacterium
PTITARLNFQLAFGTRVGQRLTDARQ

SEQ ID NO: 712178 - protein, 17 aa, Mycobacterium
PTITCLIEDGLTYDTLR

SEQ ID NO: 712179 - protein, 17 aa, Mycobacterium
PTIVGAFTLPEITTPVI

SEQ ID NO: 712180 - protein, 30 aa, Mycobacterium
PTIYRRWPDIRWVIAEVLTVRISDVLAAVP

SEQ ID NO: 712181 - protein, 19 aa, Mycobacterium
PTIYRRWPTQAAMVESAIA

SEQ ID NO: 712182 - protein, 20 aa, Mycobacterium
PTKFWADVCKHMDLDELADD

SEQ ID NO: 712183 - protein, 22 aa, Mycobacterium
PTKFWADVCRHIDRPDLAEDPR

SEQ ID NO: 712184 - protein, 22 aa, Mycobacterium
PTKFWADVCRHIDRPELADDPR

SEQ ID NO: 712185 - protein, 22 aa, Mycobacterium
PTKFWADVCRHMDLEHYIDDPR

SEQ ID NO: 712186 - protein, 29 aa, Mycobacterium
PTKGIFTSNFGYRWGVLHAGIDLANSIGT

SEQ ID NO: 712187 - protein, 30 aa, Mycobacterium; identical to SEQ ID NO: 83401

SEQ ID NO: 712188 - protein, 17 aa, Mycobacterium
PTKHEYGNGVAIFTRDG

SEQ ID NO: 712189 - protein, 23 aa, Mycobacterium
PTKKIPLVLSYAMAALGSAKSRL

SEQ ID NO: 712190 - protein, 26 aa, Mycobacterium
PTKLWTIADLGGWSAADPQLFDKSTG

SEQ ID NO: 712191 - protein, 17 aa, Mycobacterium
PTLAPLADEAWVAVRAL

SEQ ID NO: 712192 - protein, 24 aa, Mycobacterium
PTLASHWRRVLGGYTLLDVAHKVV

SEQ ID NO: 712193 - protein, 19 aa, Mycobacterium
PTLDDLPLREDLRGKSPYG

SEQ ID NO: 712194 - protein, 18 aa, Mycobacterium
PTLDEFRRLPGRCHELDG

SEQ ID NO: 712195 - protein, 19 aa, Mycobacterium
PTLDRILLGTALRQLSDEH

SEQ ID NO: 712196 - protein, 24 aa, Mycobacterium
PTLEARLAHRVGLREDVKRIPLFG

SEQ ID NO: 712197 - protein, 23 aa, Mycobacterium
PTLEELSPMLAIIPLQLLAMQLA

SEQ ID NO: 712198 - protein, 21 aa, Mycobacterium
PTLELRTSWRNPPSTLHVANA

SEQ ID NO: 712199 - protein, 22 aa, Mycobacterium
PTLELVGCFAWSKDKVGRDAGE

SEQ ID NO: 712200 - protein, 22 aa, Mycobacterium
PTLELVGCYAWSGDKVGKDVGE

SEQ ID NO: 712201 - protein, 20 aa, Mycobacterium
PTLEVQLRKSIAFDTVGFDV

SEQ ID NO: 712202 - protein, 26 aa, Mycobacterium
PTLGCPEIDQFFARRVSLVYDAATTG

SEQ ID NO: 712203 - protein, 25 aa, Mycobacterium
PTLGDRAVGAWLYSKRHGIVTGLAA

SEQ ID NO: 712204 - protein, 28 aa, Mycobacterium
PTLGGPARRAVSRWMAENGVGLLEDAMV

SEQ ID NO: 712205 - protein, 26 aa, Mycobacterium
PTLHDAYRALKAWGLPVSDHTAQVTG

SEQ ID NO: 712206 - protein, 28 aa, Mycobacterium
PTLHSALLVRFGEIFGHGLTTWLDNAAA

SEQ ID NO: 712207 - protein, 20 aa, Mycobacterium
PTLILWVGADQPVWAAAVKR

SEQ ID NO: 712208 - protein, 20 aa, Mycobacterium
PTLIRGRRGVILASGGFEHN

SEQ ID NO: 712209 - protein, 26 aa, Mycobacterium
PTLIVAPYFRSAIEAAIDGWRRVVVT

SEQ ID NO: 712210 - protein, 25 aa, Mycobacterium
PTLIVAPYFRSAIEDAIDGWRRVVV

SEQ ID NO: 712211 - protein, 17 aa, Mycobacterium
PTLKALVEAGAKVVVTA

SEQ ID NO: 712212 - protein, 19 aa, Mycobacterium
PTLKGEFARTVNLTDMHIG

SEQ ID NO: 712213 - protein, 17 aa, Mycobacterium
PTLKGGPDYGRFIDALR

SEQ ID NO: 712214 - protein, 19 aa, Mycobacterium
PTLKLHYVRIIPAQITGRR

SEQ ID NO: 712215 - protein, 17 aa, Mycobacterium
PTLKVKRNVVAEKFASD

SEQ ID NO: 712216 - protein, 24 aa, Mycobacterium
PTLLDEGQRLLIFLPLAHVLARSL

SEQ ID NO: 712217 - protein, 18 aa, Mycobacterium
PTLLHTWFELLSPEQIVM

SEQ ID NO: 712218 - protein, 18 aa, Mycobacterium
PTLLLLRHLLRFGEHARM

SEQ ID NO: 712219 - protein, 19 aa, Mycobacterium
PTLLPAHTPAVVIGDSAVA

SEQ ID NO: 712220 - protein, 18 aa, Mycobacterium
PTLLPAIERFCADKTRAE

SEQ ID NO: 712221 - protein, 20 aa, Mycobacterium
PTLLRCRLLECELTEESPGR

SEQ ID NO: 712222 - protein, 20 aa, Mycobacterium
PTLLRKGERLLVFLPLAHVL

SEQ ID NO: 712223 - protein, 21 aa, Mycobacterium
PTLLRKGERLLVFLPLAHVLA

SEQ ID NO: 712224 - protein, 26 aa, Mycobacterium
PTLLRPGQRLLVFLPLAHVLARSLTL

SEQ ID NO: 712225 - protein, 25 aa, Mycobacterium
PTLLRRLVIMGGAFGPDTNPMAEWN

SEQ ID NO: 712226 - protein, 17 aa, Mycobacterium
PTLLTPGQRLLVFLPLA

SEQ ID NO: 712227 - protein, 17 aa, Mycobacterium
PTLMAFKKGKLVFKQAG

SEQ ID NO: 712228 - protein, 24 aa, Mycobacterium
PTLMGRPVLVGGMGGRGVVAGASY

SEQ ID NO: 712229 - protein, 26 aa, Mycobacterium
PTLNLKEWKAEWGVVDPQEARGALTT

SEQ ID NO: 712230 - protein, 26 aa, Mycobacterium
PTLNLKEWRAEWGISEEHDARGSLTK

SEQ ID NO: 712231 - protein, 24 aa, Mycobacterium
PTLNPVRWARAGWNATTAVAATAA

SEQ ID NO: 712232 - protein, 17 aa, Mycobacterium
PTLPGWLEEDLAAAVRA

SEQ ID NO: 712233 - protein, 25 aa, Mycobacterium
PTLPLCRQQRTLLMSKKMYAVSRNP

SEQ ID NO: 712234 - protein, 18 aa, Mycobacterium
PTLPLSMTEIAEAVGVNP

SEQ ID NO: 712235 - protein, 17 aa, Mycobacterium
PTLQARLTQLTWRVMPF

SEQ ID NO: 712236 - protein, 24 aa, Mycobacterium
PTLRGEKIGALAITEPGGGSDVGH

SEQ ID NO: 712237 - protein, 25 aa, Mycobacterium
PTLRHRLRLGVLAALDQRIAVRYAL

SEQ ID NO: 712238 - protein, 17 aa, Mycobacterium
PTLSGFWHWAVANLPAE

SEQ ID NO: 712239 - protein, 21 aa, Mycobacterium
PTLSSLMAWPTEHLTNAADYW

SEQ ID NO: 712240 - protein, 20 aa, Mycobacterium
PTLVIWLAYSEELCEQAASE

SEQ ID NO: 712241 - protein, 19 aa, Mycobacterium
PTLVVSVPRVFEKVYNTAE

SEQ ID NO: 712242 - protein, 17 aa, Mycobacterium
PTLWQMVRREALSAKDS

SEQ ID NO: 712243 - protein, 20 aa, Mycobacterium
PTLYRPPSRPEVITRLDEDG

SEQ ID NO: 712244 - protein, 24 aa, Mycobacterium
PTMDRRNRKVLTFVLDSGMPGLTQ

SEQ ID NO: 712245 - protein, 17 aa, Mycobacterium
PTMIALELWAAVHGVAA

SEQ ID NO: 712246 - protein, 20 aa, Mycobacterium
PTMRGLKEIYTAGASAVVDP

SEQ ID NO: 712247 - protein, 18 aa, Mycobacterium
PTMRHLPTAEPTPWHVPG

SEQ ID NO: 712248 - protein, 17 aa, Mycobacterium
PTMRLMSGNLCHQIEHH

SEQ ID NO: 712249 - protein, 19 aa, Mycobacterium
PTMRVLRTGLAARIDEQDA

SEQ ID NO: 712250 - protein, 20 aa, Mycobacterium
PTMSLTCVFDHRIADGAQAA

SEQ ID NO: 712251 - protein, 25 aa, Mycobacterium
PTMVRDFQRIIGMEARVQIQGQAGK

SEQ ID NO: 712252 - protein, 18 aa, Mycobacterium
PTNCRLLDPAEAFLNTGT

SEQ ID NO: 712253 - protein, 25 aa, Mycobacterium
PTNDARFLFHPAMKELTLDVASLVF

SEQ ID NO: 712254 - protein, 22 aa, Mycobacterium
PTNFPGERPAFGTPSYFAQLAF

SEQ ID NO: 712255 - protein, 21 aa, Mycobacterium
PTNIFNPGAWLGVRDIIGGLN

SEQ ID NO: 712256 - protein, 28 aa, Mycobacterium
PTNIPSPILPLAFSRWVFARTEPGLPNP

SEQ ID NO: 712257 - protein, 18 aa, Mycobacterium
PTNLCVQVRGELASEEVE

SEQ ID NO: 712258 - protein, 27 aa, Mycobacterium
PTNLMDWEDFERLLLDLGRHELGLRSL

SEQ ID NO: 712259 - protein, 23 aa, Mycobacterium
PTNPEIVEKFGFGQRGALHCWAN

SEQ ID NO: 712260 - protein, 18 aa, Mycobacterium
PTNVNVVLLSFPQTFSGY

SEQ ID NO: 712261 - protein, 22 aa, Mycobacterium
PTNYRLLASILTGYVARHPDAA

SEQ ID NO: 712262 - protein, 24 aa, Mycobacterium
PTPAAVGIPARFAEVVGKTPDNVA

SEQ ID NO: 712263 - protein, 19 aa, Mycobacterium
PTPAGLFPQFDPLTVAGQL

SEQ ID NO: 712264 - protein, 20 aa, Mycobacterium
PTPALLWIHGGGYVIGTAQQ

SEQ ID NO: 712265 - protein, 17 aa, Mycobacterium
PTPAPCGRTPLVAKGLT

SEQ ID NO: 712266 - protein, 17 aa, Mycobacterium
PTPAPGWTIAHQVGHLL

SEQ ID NO: 712267 - protein, 17 aa, Mycobacterium
PTPAVPSPYAFRLADPD

SEQ ID NO: 712268 - protein, 22 aa, Mycobacterium
PTPCSVQALLAIASETLPPGVV

SEQ ID NO: 712269 - protein, 22 aa, Mycobacterium
PTPDSPRGWVYIVANNFDRSGP

SEQ ID NO: 712270 - protein, 23 aa, Mycobacterium
PTPDSPTGWVYIVADSFTRRDPV

SEQ ID NO: 712271 - protein, 24 aa, Mycobacterium
PTPEDRLRPVIVHDAKELVYQTPA

SEQ ID NO: 712272 - protein, 19 aa, Mycobacterium
PTPEPFGGAAPEETGLITR

SEQ ID NO: 712273 - protein, 18 aa, Mycobacterium
PTPFGFGLWTSHTTPIYL

SEQ ID NO: 712274 - protein, 20 aa, Mycobacterium
PTPFNLLGIDRWIRNFFYLT

SEQ ID NO: 712275 - protein, 24 aa, Mycobacterium
PTPFNLLGIDRWVRNFFYLTYFDS

SEQ ID NO: 712276 - protein, 20 aa, Mycobacterium
PTPFVPAGVFDLWGLPADDQ

SEQ ID NO: 712277 - protein, 17 aa, Mycobacterium
PTPGHAVGLSFSVAPDV

SEQ ID NO: 712278 - protein, 17 aa, Mycobacterium
PTPGLARHRVKATHSDS

SEQ ID NO: 712279 - protein, 19 aa, Mycobacterium
PTPGLKHRGARRIVTGGTP

SEQ ID NO: 712280 - protein, 18 aa, Mycobacterium
PTPGRRLFGPAVTISYFP

SEQ ID NO: 712281 - protein, 18 aa, Mycobacterium
PTPILTHLRFDITRSVTD

SEQ ID NO: 712282 - protein, 22 aa, Mycobacterium
PTPKLICYRVDRTGRLHRLGHV

SEQ ID NO: 712283 - protein, 26 aa, Mycobacterium
PTPLKPGGLSLLSRFLIALEQAGSQL

SEQ ID NO: 712284 - protein, 20 aa, Mycobacterium
PTPLMLPGFAARAALGEFAD

SEQ ID NO: 712285 - protein, 20 aa, Mycobacterium
PTPLRLFPARTLKAERAGDY

SEQ ID NO: 712286 - protein, 26 aa, Mycobacterium
PTPLTWPVGIAGDFKGVLDRRTGKFI

SEQ ID NO: 712287 - protein, 18 aa, Mycobacterium
PTPPDWPSCAGYAAPSAP

SEQ ID NO: 712288 - protein, 17 aa, Mycobacterium
PTPPKARNPLMQGMPGM

SEQ ID NO: 712289 - protein, 17 aa, Mycobacterium
PTPPLPIPQDLSPNDLM

SEQ ID NO: 712290 - protein, 18 aa, Mycobacterium
PTPPRLVWINGPTPHQHH

SEQ ID NO: 712291 - protein, 24 aa, Mycobacterium
PTPQARLGLIAAIRDAGLDCHVMV

SEQ ID NO: 712292 - protein, 24 aa, Mycobacterium
PTPQTRLGLITAIREAGLGCHVMV

SEQ ID NO: 712293 - protein, 20 aa, Mycobacterium
PTPRDMAALIERWQTSRGSL

SEQ ID NO: 712294 - protein, 21 aa, Mycobacterium
PTPRGRYTIPTPYGGPQLPIE

SEQ ID NO: 712295 - protein, 21 aa, Mycobacterium
PTPRLPVTHSKILRMIDSVRA

SEQ ID NO: 712296 - protein, 20 aa, Mycobacterium
PTPRRALSDVVQWSDAQATC

SEQ ID NO: 712297 - protein, 40 aa, Mycobacterium
PTPRRTNNPWIRFHVPRQWPPWRLVAGIPTTTIAQTIADL

SEQ ID NO: 712298 - protein, 17 aa, Mycobacterium
PTPSGVIVTRWAQDPFA

SEQ ID NO: 712299 - protein, 19 aa, Mycobacterium
PTPSGWEVTTHGGRRGTGI

SEQ ID NO: 712300 - protein, 19 aa, Mycobacterium
PTPSGWEVTTHGGRRGTGL

SEQ ID NO: 712301 - protein, 23 aa, Mycobacterium
PTPTRRLTITVGLIADLKVINPF

SEQ ID NO: 712302 - protein, 29 aa, Mycobacterium
PTPVTINFSIPWTVAVTLVAGRLTPVEVN

SEQ ID NO: 712303 - protein, 24 aa, Mycobacterium
PTPWGPGRPGWHLECSAMARTYLG

SEQ ID NO: 712304 - protein, 26 aa, Mycobacterium
PTQALLGRPLIGNGTDGAPGTGADGG

SEQ ID NO: 712305 - protein, 27 aa, Mycobacterium
PTQCARLAQRAALGIARTGGAGENGSG

SEQ ID NO: 712306 - protein, 20 aa, Mycobacterium
PTQDSMCSWFTYSTPDANKD

SEQ ID NO: 712307 - protein, 17 aa, Mycobacterium
PTQFGFFATVPMPHLDQ

SEQ ID NO: 712308 - protein, 23 aa, Mycobacterium
PTQKEIFIPGGQMFRDLTRLSAA

SEQ ID NO: 712309 - protein, 23 aa, Mycobacterium
PTQLCAFTAGVLRAEATHEPGYY

SEQ ID NO: 712310 - protein, 19 aa, Mycobacterium
PTQLLDVWRRDDVPADAPV

SEQ ID NO: 712311 - protein, 19 aa, Mycobacterium
PTQLTWKVYRDTVIEQCEQ

SEQ ID NO: 712312 - protein, 17 aa, Mycobacterium
PTQMKWSDMAAMRSSLI

SEQ ID NO: 712313 - protein, 23 aa, Mycobacterium
PTQREAFDLFPANLTRGLVMTRN

SEQ ID NO: 712314 - protein, 19 aa, Mycobacterium
PTQTLAGLAAPAAALGSVA

SEQ ID NO: 712315 - protein, 27 aa, Mycobacterium
PTQTLGFPVALGLELVGPAFSTAAAAG

SEQ ID NO: 712316 - protein, 23 aa, Mycobacterium
PTQWPKFAAALLAQTPVRGAMGF

SEQ ID NO: 712317 - protein, 22 aa, Mycobacterium
PTRAFAGFRTERRFSESETHAV

SEQ ID NO: 712318 - protein, 18 aa, Mycobacterium
PTREGDVVWVPVDTQKRA

SEQ ID NO: 712319 - protein, 23 aa, Mycobacterium
PTRFKRKEHWLPAHFTGDSSAVM

SEQ ID NO: 712320 - protein, 17 aa, Mycobacterium
PTRFYLPYDDVVAPLEL

SEQ ID NO: 712321 - protein, 19 aa, Mycobacterium
PTRLEFHDYLSWAADKVGA

SEQ ID NO: 712322 - protein, 24 aa, Mycobacterium
PTRNAWAPVASWFRHRGARISMVP

SEQ ID NO: 712323 - protein, 18 aa, Mycobacterium
PTRPARAGWARVNPVTGH

SEQ ID NO: 712324 - protein, 22 aa, Mycobacterium
PTRPARAGWSRVNPVTGHEEFP

SEQ ID NO: 712325 - protein, 22 aa, Mycobacterium
PTRPEIARLLDFYEHQMRLHAI

SEQ ID NO: 712326 - protein, 21 aa, Mycobacterium
PTRPHPLFAAFIGAAIDYKAA

SEQ ID NO: 712327 - protein, 35 aa, Mycobacterium
PTRPMSWDRVVDKFWWLAGPFCERALGDEIIAAVA

SEQ ID NO: 712328 - protein, 21 aa, Mycobacterium
PTRQGQWWYYARTFEGKQYRV

SEQ ID NO: 712329 - protein, 20 aa, Mycobacterium
PTRRGDWWYYGRSFQGKQYG

SEQ ID NO: 712330 - protein, 19 aa, Mycobacterium
PTRRKSRKPAAKAAPAVLV

SEQ ID NO: 712331 - protein, 17 aa, Mycobacterium
PTRRPVPLRLRDWNEVY

SEQ ID NO: 712332 - protein, 19 aa, Mycobacterium
PTRRVPLGLIAGARSGDKG

SEQ ID NO: 712333 - protein, 25 aa, Mycobacterium
PTRRVRFLPYGIAVSVLDSGPDSNP

SEQ ID NO: 712334 - protein, 20 aa, Mycobacterium
PTRVQSAGVARTFVAARDET

SEQ ID NO: 712335 - protein, 28 aa, Mycobacterium
PTRVVGATGVMLGRPCYQIEFSDGTTIV

SEQ ID NO: 712336 - protein, 21 aa, Mycobacterium
PTRVWGVPATGLWAHKLGDQR

SEQ ID NO: 712337 - protein, 21 aa, Mycobacterium
PTSAADWKTAAALDPQTYDPK

SEQ ID NO: 712338 - protein, 24 aa, Mycobacterium
PTSAEFRKLLAEWKAAGRASKDVD

SEQ ID NO: 712339 - protein, 25 aa, Mycobacterium
PTSAKLRRRAVRIVRDAAGVDEETA

SEQ ID NO: 712340 - protein, 24 aa, Mycobacterium
PTSARRAVPLAVMIAAADDEDLRG

SEQ ID NO: 712341 - protein, 24 aa, Mycobacterium
PTSDAGAVVSAWLADARVRKISFT

SEQ ID NO: 712342 - protein, 25 aa, Mycobacterium
PTSDFPRYPLNILSDLNTLMSLGQH

SEQ ID NO: 712343 - protein, 19 aa, Mycobacterium
PTSGAAWVAGHDVCAAPES

SEQ ID NO: 712344 - protein, 17 aa, Mycobacterium
PTSSMGRLFDAVSALAG

SEQ ID NO: 712345 - protein, 27 aa, Mycobacterium
PTSTPCGTCESCVALAPNGSGNVDVIE

SEQ ID NO: 712346 - protein, 31 aa, Mycobacterium
PTSVARGLSRFRYGPGAFKVDFAIEDGVPWT

SEQ ID NO: 712347 - protein, 26 aa, Mycobacterium
PTSVPTFRPGAQFKAVVSGAQKLPAD

SEQ ID NO: 712348 - protein, 26 aa, Mycobacterium
PTSVQRLEALPGWPTGPLSPVHISAA

SEQ ID NO: 712349 - protein, 17 aa, Mycobacterium
PTSVREFDGTPTTIHSL

SEQ ID NO: 712350 - protein, 17 aa, Mycobacterium
PTSVTWSADGSTLLVTA

SEQ ID NO: 712351 - protein, 19 aa, Mycobacterium
PTTAACPEYAYVPDQDAPA

SEQ ID NO: 712352 - protein, 19 aa, Mycobacterium
PTTAEVFAANGPFVGTAQQ

SEQ ID NO: 712353 - protein, 26 aa, Mycobacterium
PTTAPRWVVDPDFNLDFHLRRVRVPE

SEQ ID NO: 712354 - protein, 23 aa, Mycobacterium
PTTDGAYWWAREMTPEMMQRNSP

SEQ ID NO: 712355 - protein, 28 aa, Mycobacterium
PTTDGRWSCVRWATLTPPFHPEPDVQPV

SEQ ID NO: 712356 - protein, 24 aa, Mycobacterium
PTTDVFDGWRIVGYAIHGPTDTLR

SEQ ID NO: 712357 - protein, 18 aa, Mycobacterium
PTTELITGLYGYRIPLVY

SEQ ID NO: 712358 - protein, 19 aa, Mycobacterium
PTTELMYAWHLPDAIEAMV

SEQ ID NO: 712359 - protein, 23 aa, Mycobacterium
PTTFREKWTWAHLRTGAEGMNPF

SEQ ID NO: 712360 - protein, 31 aa, Mycobacterium
PTTGVWTSGFGYRWGVLHAGIDIANAIGTPV

SEQ ID NO: 712361 - protein, 17 aa, Mycobacterium
PTTHVRFADLHRARRWR

SEQ ID NO: 712362 - protein, 17 aa, Mycobacterium
PTTIIVGEFDPLRDDGL

SEQ ID NO: 712363 - protein, 21 aa, Mycobacterium
PTTKHIPAFRLTRSSAAYWRG

SEQ ID NO: 712364 - protein, 21 aa, Mycobacterium
PTTLEQWLWRNAARLLGLSGA

SEQ ID NO: 712365 - protein, 18 aa, Mycobacterium
PTTLGWFAAEQAYLREQH

SEQ ID NO: 712366 - protein, 24 aa, Mycobacterium
PTTLRLEPGITCVVGPNGSGKSNV

SEQ ID NO: 712367 - protein, 26 aa, Mycobacterium
PTTLRLLDELGLWERFAALPFSEVRK

SEQ ID NO: 712368 - protein, 18 aa, Mycobacterium
PTTMLLGLWYDDEFVRTA

SEQ ID NO: 712369 - protein, 19 aa, Mycobacterium
PTTMSLMRFFRFIVTEIYP

SEQ ID NO: 712370 - protein, 18 aa, Mycobacterium
PTTPRFVGHGHLLVATHL

SEQ ID NO: 712371 - protein, 20 aa, Mycobacterium
PTTRDGHRQSLTAIVREAHR

SEQ ID NO: 712372 - protein, 19 aa, Mycobacterium
PTTRFTRRDIEPFGKLVAT

SEQ ID NO: 712373 - protein, 21 aa, Mycobacterium
PTTWWCAPFEVDGDIGAVFAF

SEQ ID NO: 712374 - protein, 18 aa, Mycobacterium
PTVAEWSADGALMVAVDW

SEQ ID NO: 712375 - protein, 17 aa, Mycobacterium
PTVAGAVPTIWNDVDRY

SEQ ID NO: 712376 - protein, 17 aa, Mycobacterium
PTVAGAVPTIWNDVRHF

SEQ ID NO: 712377 - protein, 18 aa, Mycobacterium
PTVAPGRTRERRRVRTLA

SEQ ID NO: 712378 - protein, 24 aa, Mycobacterium
PTVDAMLAQCCEWERELAAAAPDN

SEQ ID NO: 712379 - protein, 18 aa, Mycobacterium
PTVFATNFAGMWSPQIRT

SEQ ID NO: 712380 - protein, 22 aa, Mycobacterium
PTVGGRLLSPVGGYRDDTALAR

SEQ ID NO: 712381 - protein, 23 aa, Mycobacterium
PTVGLDPVLRVDLWQQFNDLAAK

SEQ ID NO: 712382 - protein, 21 aa, Mycobacterium
PTVGSPIDWNSPAPLGSTGAL

SEQ ID NO: 712383 - protein, 26 aa, Mycobacterium
PTVGVPWLAAFAERSKFAEAFKASEQ

SEQ ID NO: 712384 - protein, 23 aa, Mycobacterium
PTVICGPTAWPASATADILSWYR

SEQ ID NO: 712385 - protein, 26 aa, Mycobacterium
PTVMLRRMAWYWARIWIEVTPVRVLW

SEQ ID NO: 712386 - protein, 24 aa, Mycobacterium
PTVPAARIEFVLGDAAPIAAVTTA

SEQ ID NO: 712387 - protein, 17 aa, Mycobacterium
PTVPALPPRMVPLSDSL

SEQ ID NO: 712388 - protein, 27 aa, Mycobacterium
PTVPGLPNRRRIAVVTVHGPIVSGRGG

SEQ ID NO: 712389 - protein, 22 aa, Mycobacterium
PTVPRFSRAALRSVGINAEGES

SEQ ID NO: 712390 - protein, 26 aa, Mycobacterium
PTVPSIPLPFGLWIGSPQMQQGVASL

SEQ ID NO: 712391 - protein, 26 aa, Mycobacterium
PTVPSIPLPFGMWIGGAQMQQGVGSL

SEQ ID NO: 712392 - protein, 20 aa, Mycobacterium
PTVPYRFGATPAEIVSAAPT

SEQ ID NO: 712393 - protein, 19 aa, Mycobacterium
PTVRKRAFDGLTHRNIDDL

SEQ ID NO: 712394 - protein, 18 aa, Mycobacterium
PTVTLLWPPREPGGYTLI

SEQ ID NO: 712395 - protein, 19 aa, Mycobacterium
PTVTMKVGFLPPPDFEATT

SEQ ID NO: 712396 - protein, 19 aa, Mycobacterium
PTVYRLLLRSGPPIVERFE

SEQ ID NO: 712397 - protein, 17 aa, Mycobacterium
PTWAGVAYVCFIVDAHS

SEQ ID NO: 712398 - protein, 22 aa, Mycobacterium
PTWESLHAVFAHLIADEANRLP

SEQ ID NO: 712399 - protein, 20 aa, Mycobacterium
PTWMLKVRHDYFKGPESMFE

SEQ ID NO: 712400 - protein, 22 aa, Mycobacterium
PTWQELWIELMSSFTTAEGFVY

SEQ ID NO: 712401 - protein, 25 aa, Mycobacterium
PTYAFARRRFWLLSESVGGRDTAGL

SEQ ID NO: 712402 - protein, 24 aa, Mycobacterium
PTYAFERRRFWLAGDGTTVDAAGL

SEQ ID NO: 712403 - protein, 23 aa, Mycobacterium
PTYAFQRRHYWLAAPTPTPATVS

SEQ ID NO: 712404 - protein, 26 aa, Mycobacterium
PTYAVPRLLARNGLSLQEFDFYEIHE

SEQ ID NO: 712405 - protein, 17 aa, Mycobacterium
PTYEGWTTLAAMAAITE

SEQ ID NO: 712406 - protein, 22 aa, Mycobacterium
PTYEVGALLAGAAVVRADSLTQ

SEQ ID NO: 712407 - protein, 22 aa, Mycobacterium
PTYGFARQRFWLGEGTRHDIEH

SEQ ID NO: 712408 - protein, 19 aa, Mycobacterium
PTYGLAETVVYVSTRTPAQ

SEQ ID NO: 712409 - protein, 19 aa, Mycobacterium
PTYHERMVWGQGDGSGLRA

SEQ ID NO: 712410 - protein, 21 aa, Mycobacterium
PTYKIRIVLETANSRASGVDL

SEQ ID NO: 712411 - protein, 22 aa, Mycobacterium
PTYPEDRLNYILSDSDPKIVLR

SEQ ID NO: 712412 - protein, 24 aa, Mycobacterium
PTYPEDRLSFILGDADAKLVLREP

SEQ ID NO: 712413 - protein, 23 aa, Mycobacterium
PTYPFEHRQYWFSDSREPVAAAP

SEQ ID NO: 712414 - protein, 17 aa, Mycobacterium
PTYREFYEKRQIAAGDD

SEQ ID NO: 712415 - protein, 20 aa, Mycobacterium
PTYRLIKVTDIYAGTTPGSK

SEQ ID NO: 712416 - protein, 17 aa, Mycobacterium
PTYRYVGTTAKSRDGWD

SEQ ID NO: 712417 - protein, 19 aa, Mycobacterium
PTYWFANSVEELRTVLETS

SEQ ID NO: 712418 - protein, 17 aa, Mycobacterium
PVAAAVRTGLDTFLGMV

SEQ ID NO: 712419 - protein, 17 aa, Mycobacterium
PVAADRPLIMAIVNRTP

SEQ ID NO: 712420 - protein, 25 aa, Mycobacterium
PVAADRRCGPGLYSRQVAYAASLVA

SEQ ID NO: 712421 - protein, 23 aa, Mycobacterium
PVAAFEFLFGILVFDLPTHIMQI

SEQ ID NO: 712422 - protein, 18 aa, Mycobacterium
PVAARARLRRARPSRGWA

SEQ ID NO: 712423 - protein, 17 aa, Mycobacterium
PVAAYRHAAARVFETMA

SEQ ID NO: 712424 - protein, 18 aa, Mycobacterium
PVAAYSASKWAVRGLTKA

SEQ ID NO: 712425 - protein, 23 aa, Mycobacterium
PVADLARRAAMRSPLQVGVGIGA

SEQ ID NO: 712426 - protein, 24 aa, Mycobacterium
PVADLFMIGAAYRRYAIKRPHVYR

SEQ ID NO: 712427 - protein, 24 aa, Mycobacterium
PVADPALVPLFFVAREARKYVKVV

SEQ ID NO: 712428 - protein, 28 aa, Mycobacterium
PVADYRGARVAVEWPPELQVLVRELAGE

SEQ ID NO: 712429 - protein, 24 aa, Mycobacterium
PVAELWKIADRVGAEIPTDRGYGH

SEQ ID NO: 712430 - protein, 23 aa, Mycobacterium
PVAERNEAIYIWHDVLGREPFFD

SEQ ID NO: 712431 - protein, 17 aa, Mycobacterium
PVAESLLALGLPGLSVN

SEQ ID NO: 712432 - protein, 18 aa, Mycobacterium
PVAEYARRCGVDEALIRS

SEQ ID NO: 712433 - protein, 21 aa, Mycobacterium
PVAEYWPEFAANGKEKLTVRD

SEQ ID NO: 712434 - protein, 19 aa, Mycobacterium
PVAFARLTGLRAIDRQDCE

SEQ ID NO: 712435 - protein, 23 aa, Mycobacterium
PVAFLARPARWLHLLASTPHTFS

SEQ ID NO: 712436 - protein, 29 aa, Mycobacterium
PVAGELPLNCAIGAPVLFGRANVVFTRLV

SEQ ID NO: 712437 - protein, 18 aa, Mycobacterium
PVAGPVMSRIGWFVESRL

SEQ ID NO: 712438 - protein, 25 aa, Mycobacterium
PVAGRRDAICTIARISSTPMDRPSG

SEQ ID NO: 712439 - protein, 18 aa, Mycobacterium
PVAGWFQFQPLWDDVIRT

SEQ ID NO: 712440 - protein, 17 aa, Mycobacterium
PVAHPWRTMPNNAMTPH

SEQ ID NO: 712441 - protein, 21 aa, Mycobacterium
PVAHSRPSIDVTFAGAADFAG

SEQ ID NO: 712442 - protein, 17 aa, Mycobacterium
PVAIQTFCPYKGICSYY

SEQ ID NO: 712443 - protein, 24 aa, Mycobacterium
PVAIRAKVAAAFKGEDAAPASAAT

SEQ ID NO: 712444 - protein, 23 aa, Mycobacterium
PVAKRLPGFTVIKHRGRKSGRAY

SEQ ID NO: 712445 - protein, 17 aa, Mycobacterium
PVALAVTLEAVRRAEKL

SEQ ID NO: 712446 - protein, 17 aa, Mycobacterium
PVALCARTPDRLERAAA

SEQ ID NO: 712447 - protein, 17 aa, Mycobacterium
PVALRLSVGSLFDNIVW

SEQ ID NO: 712448 - protein, 19 aa, Mycobacterium
PVALRRLRRQLLRAEEAAG

SEQ ID NO: 712449 - protein, 18 aa, Mycobacterium
PVAMFKMTDEAGGDDKLL

SEQ ID NO: 712450 - protein, 27 aa, Mycobacterium
PVAMMLSAAMLLRWLGERAGSGRALVG

SEQ ID NO: 712451 - protein, 25 aa, Mycobacterium
PVAMPDGRVHGVWLWTGSTAPHTVP

SEQ ID NO: 712452 - protein, 18 aa, Mycobacterium
PVANPALYLYAAISPEGD

SEQ ID NO: 712453 - protein, 24 aa, Mycobacterium
PVAPGLYSWLPLGLRVLRRIEGIV

SEQ ID NO: 712454 - protein, 23 aa, Mycobacterium
PVAPGLYSWLPLGLRVLRRIERI

SEQ ID NO: 712455 - protein, 18 aa, Mycobacterium
PVAPVVPLFISGFLSSRK

SEQ ID NO: 712456 - protein, 19 aa, Mycobacterium
PVAQYWPEFAANGKEKLTV

SEQ ID NO: 712457 - protein, 23 aa, Mycobacterium
PVARFRGCPFHNAAVESAGELSA

SEQ ID NO: 712458 - protein, 24 aa, Mycobacterium
PVARGSALFLRRGAQPEGQVWSPT

SEQ ID NO: 712459 - protein, 23 aa, Mycobacterium
PVASLLRDRFLTLVATGGADLDW

SEQ ID NO: 712460 - protein, 26 aa, Mycobacterium
PVASLTVGGFRDWLLDAACRDDAAAR

SEQ ID NO: 712461 - protein, 18 aa, Mycobacterium
PVATRLSGLEPLNISDDS

SEQ ID NO: 712462 - protein, 18 aa, Mycobacterium
PVAVGLALAGKRKGLDRV

SEQ ID NO: 712463 - protein, 25 aa, Mycobacterium
PVAVKQGWMCCVGSAWMHLSTGVVG

SEQ ID NO: 712464 - protein, 18 aa, Mycobacterium
PVAVLAPRSPADCFEVAV

SEQ ID NO: 712465 - protein, 18 aa, Mycobacterium
PVAVLGAGTLGRRIALTF

SEQ ID NO: 712466 - protein, 18 aa, Mycobacterium
PVAVSVALEAVRRAAGLA

SEQ ID NO: 712467 - protein, 18 aa, Mycobacterium
PVAYAAVGPSFWGDGMYP

SEQ ID NO: 712468 - protein, 18 aa, Mycobacterium
PVAYAAVGPSFWGDGQYP

SEQ ID NO: 712469 - protein, 19 aa, Mycobacterium
PVCAARGGLLGRPGPHRRY

SEQ ID NO: 712470 - protein, 22 aa, Mycobacterium
PVCAASVRIFNERAAAGGATVV

SEQ ID NO: 712471 - protein, 17 aa, Mycobacterium
PVCALVFGPSAPLRLLL

SEQ ID NO: 712472 - protein, 21 aa, Mycobacterium
PVCGCGGLIRPDIVWFGEALP

SEQ ID NO: 712473 - protein, 21 aa, Mycobacterium
PVCGCGGLIRPDIVWFGEPLP

SEQ ID NO: 712474 - protein, 50 aa, Mycobacterium
PVCLEGMVSCDCCAAPICKRCANKPKVDLWLCPACATLRRATRREARQHG

SEQ ID NO: 712475 - protein, 18 aa, Mycobacterium
PVCQLRRSTGQRCGPVGT

SEQ ID NO: 712476 - protein, 19 aa, Mycobacterium
PVCTSEFMTFASMQQEFAA

SEQ ID NO: 712477 - protein, 19 aa, Mycobacterium
PVDAGGLVFQTRRRVYPIG

SEQ ID NO: 712478 - protein, 23 aa, Mycobacterium
PVDDCYAALLWLARQPWVDPDRI

SEQ ID NO: 712479 - protein, 27 aa, Mycobacterium
PVDELLSLSNLDGWGRISDAGGFITDA

SEQ ID NO: 712480 - protein, 24 aa, Mycobacterium
PVDEWPGLLRRLVSEQVSLILRRT

SEQ ID NO: 712481 - protein, 23 aa, Mycobacterium
PVDGGYIFNGRWQFSSGTDHCDW

SEQ ID NO: 712482 - protein, 24 aa, Mycobacterium
PVDGGYLFNGRWQFSSGTDHCDWI

SEQ ID NO: 712483 - protein, 24 aa, Mycobacterium
PVDGLPSIFVYDGYPGGAGFADRG

SEQ ID NO: 712484 - protein, 24 aa, Mycobacterium
PVDGLPTIFVYDGYPGGAGFAARG

SEQ ID NO: 712485 - protein, 23 aa, Mycobacterium
PVDGRPGMWGPHGYTPVTQQPTP

SEQ ID NO: 712486 - protein, 29 aa, Mycobacterium
PVDGVGLLRAEFMLTEALGGRHPRDLIAR

SEQ ID NO: 712487 - protein, 19 aa, Mycobacterium
PVDGWLRGRGWDVTTATFA

SEQ ID NO: 712488 - protein, 19 aa, Mycobacterium
PVDHGFALDQHRPGCRLEI

SEQ ID NO: 712489 - protein, 25 aa, Mycobacterium
PVDIKKQMIDWWGPIVDEYYASSEA

SEQ ID NO: 712490 - protein, 18 aa, Mycobacterium
PVDLLFNGGIGTYVKSSG

SEQ ID NO: 712491 - protein, 25 aa, Mycobacterium
PVDLNWPQLRARTRAVAARLQQVTQ

SEQ ID NO: 712492 - protein, 22 aa, Mycobacterium
PVDLRDDWPAALRANGFDASQP

SEQ ID NO: 712493 - protein, 27 aa, Mycobacterium
PVDLREDWPAALRAAGFDATRPTAWLA

SEQ ID NO: 712494 - protein, 18 aa, Mycobacterium
PVDNPFFAWLWKTLSTHE

SEQ ID NO: 712495 - protein, 18 aa, Mycobacterium
PVDPDWLYTEYIVRQRSC

SEQ ID NO: 712496 - protein, 21 aa, Mycobacterium
PVDPRAGWIVDFGKIKDACKP

SEQ ID NO: 712497 - protein, 24 aa, Mycobacterium
PVDPSLPALLLVSGGTTGLPKLIA

SEQ ID NO: 712498 - protein, 18 aa, Mycobacterium
PVDPTLLFDGMFALVQHS

SEQ ID NO: 712499 - protein, 24 aa, Mycobacterium
PVDQLRLAPTLDWIEAALPQQNTS

SEQ ID NO: 712500 - protein, 21 aa, Mycobacterium
PVDRLTGWAWVPLTTDTARNA

SEQ ID NO: 712501 - protein, 20 aa, Mycobacterium
PVDRRPLWIERIEQAEASRP

SEQ ID NO: 712502 - protein, 19 aa, Mycobacterium
PVDTCAMGAFDAHGRLRSA

SEQ ID NO: 712503 - protein, 21 aa, Mycobacterium
PVDVAELIAYFASPASNAVTG

SEQ ID NO: 712504 - protein, 20 aa, Mycobacterium
PVEAFGPLGAIFAADQPSSS

SEQ ID NO: 712505 - protein, 20 aa, Mycobacterium
PVEAREAYLQSISRAAAPDA

SEQ ID NO: 712506 - protein, 19 aa, Mycobacterium
PVEAREGYLQSVVRAAAPG

SEQ ID NO: 712507 - protein, 20 aa, Mycobacterium
PVEDCPEVAGIMYTEESLAV

SEQ ID NO: 712508 - protein, 23 aa, Mycobacterium
PVEDRGRRYIAMVLVDSSGAEVV

SEQ ID NO: 712509 - protein, 23 aa, Mycobacterium
PVEERYRVAITVADVTRAQLVRL

SEQ ID NO: 712510 - protein, 17 aa, Mycobacterium
PVEETRQMLGLAAAELY

SEQ ID NO: 712511 - protein, 17 aa, Mycobacterium
PVEETRQMLGLAAAEVY

SEQ ID NO: 712512 - protein, 23 aa, Mycobacterium
PVEFKRKSALTFGATHTAATTDE

SEQ ID NO: 712513 - protein, 25 aa, Mycobacterium
PVEFSLPPRRIVEIMLDNMNANQSM

SEQ ID NO: 712514 - protein, 19 aa, Mycobacterium
PVEGARTWVGLAGTMTTLS

SEQ ID NO: 712515 - protein, 25 aa, Mycobacterium
PVEGAWDHYSFRVGNLLFLMLSDRN

SEQ ID NO: 712516 - protein, 30 aa, Mycobacterium
PVEGGYKITGRWQFGSGVWHSSWASVAAVV

SEQ ID NO: 712517 - protein, 19 aa, Mycobacterium
PVEGLPYEFHSCDVRDDES

SEQ ID NO: 712518 - protein, 24 aa, Mycobacterium
PVEGRDGYLRSVHRAAAPGASYFV

SEQ ID NO: 712519 - protein, 19 aa, Mycobacterium
PVEGRDGYLSSVHRAAAPG

SEQ ID NO: 712520 - protein, 18 aa, Mycobacterium
PVEGWGLYEHGALGRHDP

SEQ ID NO: 712521 - protein, 20 aa, Mycobacterium
PVEGYTKWLENMAADERIEV

SEQ ID NO: 712522 - protein, 25 aa, Mycobacterium
PVEHHAVLDAVQWLADHEGAEVTWL

SEQ ID NO: 712523 - protein, 18 aa, Mycobacterium
PVEHKAYLHRSGRTARAG

SEQ ID NO: 712524 - protein, 19 aa, Mycobacterium
PVEHLRKVVEWARERGALV

SEQ ID NO: 712525 - protein, 19 aa, Mycobacterium
PVEHPLGAVIHAAGVLSDG

SEQ ID NO: 712526 - protein, 25 aa, Mycobacterium
PVEIKKQMIDWWGPIIDEYYASSEA

SEQ ID NO: 712527 - protein, 24 aa, Mycobacterium
PVEIKKQMIDWWGPIVDEYYASSE

SEQ ID NO: 712528 - protein, 24 aa, Mycobacterium
PVEIKKQMMDWWGPIIDEYYASSE

SEQ ID NO: 712529 - protein, 24 aa, Mycobacterium
PVEIKKQMMDWWGPIVDEYYASSE

SEQ ID NO: 712530 - protein, 19 aa, Mycobacterium
PVEKVWDVLVSRELTASQV

SEQ ID NO: 712531 - protein, 18 aa, Mycobacterium
PVELAWKRVRDGKLGTRN

SEQ ID NO: 712532 - protein, 26 aa, Mycobacterium
PVEPQIYLCGGAGFVDAVRGQLAARG

SEQ ID NO: 712533 - protein, 19 aa, Mycobacterium
PVEQRAAVVAVDMQGYSIA

SEQ ID NO: 712534 - protein, 17 aa, Mycobacterium
PVEQRARFLEAIADNLD

SEQ ID NO: 712535 - protein, 20 aa, Mycobacterium
PVERARTLWVALGFAAADSD

SEQ ID NO: 712536 - protein, 24 aa, Mycobacterium
PVERTCEFLEWFLGNVPIAPIWLC

SEQ ID NO: 712537 - protein, 26 aa, Mycobacterium
PVERVLRVAERLMRTGIDVLHLADTI

SEQ ID NO: 712538 - protein, 20 aa, Mycobacterium
PVESMWIVFDQKYRNSYVFA

SEQ ID NO: 712539 - protein, 21 aa, Mycobacterium
PVESVEPGFSLAVEHDGGYHL

SEQ ID NO: 712540 - protein, 20 aa, Mycobacterium
PVETSRPFRLTAISEHKRMY

SEQ ID NO: 712541 - protein, 32 aa, Mycobacterium
PVEVHEFLLALGIPICEGYGMTECTCAGTINR

SEQ ID NO: 712542 - protein, 17 aa, Mycobacterium
PVEWKRDQALKFGATHV

SEQ ID NO: 712543 - protein, 17 aa, Mycobacterium
PVEWVRFAANTVGERVV

SEQ ID NO: 712544 - protein, 19 aa, Mycobacterium
PVEYEVIALAGNVTASDVL

SEQ ID NO: 712545 - protein, 21 aa, Mycobacterium
PVFATEARFPAAEEVVVDWPH

SEQ ID NO: 712546 - protein, 23 aa, Mycobacterium
PVFCAKLADLAIRVDVLEVLEHR

SEQ ID NO: 712547 - protein, 19 aa, Mycobacterium
PVFEKWFAEALAAKSLVII

SEQ ID NO: 712548 - protein, 19 aa, Mycobacterium
PVFHTARLAPQAAEALAAE

SEQ ID NO: 712549 - protein, 38 aa, Mycobacterium
PVFHTRIGRIGLLVCWDIWFPETARIVAQQGADIICIP

SEQ ID NO: 712550 - protein, 23 aa, Mycobacterium
PVFNAPFSNFWLTPRQHRDALRK

SEQ ID NO: 712551 - protein, 23 aa, Mycobacterium
PVFNEPFAGFWLTPKQHQDALAE

SEQ ID NO: 712552 - protein, 24 aa, Mycobacterium
PVFPGETLTTLIWRTEPGKAVYRT

SEQ ID NO: 712553 - protein, 23 aa, Mycobacterium
PVFPMAIRAYRRFVAAGDHDGAD

SEQ ID NO: 712554 - protein, 18 aa, Mycobacterium
PVFPSRLFRHSSVYVRDD

SEQ ID NO: 712555 - protein, 22 aa, Mycobacterium
PVFPTYRLDHQFEVIRRVGELT

SEQ ID NO: 712556 - protein, 17 aa, Mycobacterium
PVFRAPQAVVLSRLADI

SEQ ID NO: 712557 - protein, 19 aa, Mycobacterium
PVFRQRWLLCEQPTGQIPE

SEQ ID NO: 712558 - protein, 18 aa, Mycobacterium
PVFRSRESLIAFFEKMNR

SEQ ID NO: 712559 - protein, 18 aa, Mycobacterium
PVFVKRYDNAVNRLLQAD

SEQ ID NO: 712560 - protein, 24 aa, Mycobacterium
PVFYFPEKADDVWGDALRAGAAKR

SEQ ID NO: 712561 - protein, 21 aa, Mycobacterium
PVGALVVFEVMVRPLIRLALG

SEQ ID NO: 712562 - protein, 26 aa, Mycobacterium
PVGARTVWGVGIAPSITTASLRAVVS

SEQ ID NO: 712563 - protein, 22 aa, Mycobacterium
PVGDHRVLVLAGRIHAYEGHDL

SEQ ID NO: 712564 - protein, 19 aa, Mycobacterium
PVGDPRPPLLPLDEHGRAK

SEQ ID NO: 712565 - protein, 20 aa, Mycobacterium
PVGDSGFYFVSRWDLVVEAT

SEQ ID NO: 712566 - protein, 22 aa, Mycobacterium
PVGEALRQISLRLAADDDQFMT

SEQ ID NO: 712567 - protein, 17 aa, Mycobacterium
PVGEGAEGLSTFMTPEE

SEQ ID NO: 712568 - protein, 19 aa, Mycobacterium
PVGEGLRLDDVSAHPQAGA

SEQ ID NO: 712569 - protein, 21 aa, Mycobacterium
PVGFACQSFAALSLDPPLVLF

SEQ ID NO: 712570 - protein, 25 aa, Mycobacterium
PVGFAGRAALGFGKRLTGKSRDEVQ

SEQ ID NO: 712571 - protein, 17 aa, Mycobacterium
PVGGMGAIYRQIAAELG

SEQ ID NO: 712572 - protein, 26 aa, Mycobacterium
PVGGWPEPLRSAALAGRAPAKPVGQL

SEQ ID NO: 712573 - protein, 27 aa, Mycobacterium
PVGGWRCRPDAAFGYRAAETAGADAAI

SEQ ID NO: 712574 - protein, 20 aa, Mycobacterium
PVGIRADCLGVQDPLPAWAE

SEQ ID NO: 712575 - protein, 17 aa, Mycobacterium
PVGKVLPVRLTSRGRRS

SEQ ID NO: 712576 - protein, 26 aa, Mycobacterium
PVGLARFCSLRSWLSQWSYDDARGDG

SEQ ID NO: 712577 - protein, 26 aa, Mycobacterium
PVGLARFCTLRSWLSQWSYDDARGDG

SEQ ID NO: 712578 - protein, 23 aa, Mycobacterium
PVGLGEVIRAAGIGEVIESRCEA

SEQ ID NO: 712579 - protein, 17 aa, Mycobacterium
PVGLLGIMGVEYHAHTW

SEQ ID NO: 712580 - protein, 18 aa, Mycobacterium
PVGLRFAHRRHRHGHDPS

SEQ ID NO: 712581 - protein, 18 aa, Mycobacterium
PVGMFKMVDDGGGDDKVL

SEQ ID NO: 712582 - protein, 24 aa, Mycobacterium
PVGNAGNITAYWKGYSEYHRDGVS

SEQ ID NO: 712583 - protein, 25 aa, Mycobacterium
PVGNAGNITAYWKGYTEYHHDGVID

SEQ ID NO: 712584 - protein, 24 aa, Mycobacterium
PVGNAGNITAYWKGYTEYHHEGLI

SEQ ID NO: 712585 - protein, 24 aa, Mycobacterium
PVGNAGNITAYWKGYTEYHRDGII

SEQ ID NO: 712586 - protein, 24 aa, Mycobacterium
PVGNAGNITAYWKGYTEYHRDGVI

SEQ ID NO: 712587 - protein, 20 aa, Mycobacterium
PVGNAGNITAYWRGYNEYHR

SEQ ID NO: 712588 - protein, 17 aa, Mycobacterium
PVGPCLLITPWNFPMAM

SEQ ID NO: 712589 - protein, 23 aa, Mycobacterium
PVGPGLYSWLPLGLRVLRNIERV

SEQ ID NO: 712590 - protein, 17 aa, Mycobacterium
PVGPPVLMVHPMMMSAD

SEQ ID NO: 712591 - protein, 23 aa, Mycobacterium
PVGPSGFRWPHAITGTGDLLLVA

SEQ ID NO: 712592 - protein, 21 aa, Mycobacterium
PVGPSSFLGFTIPQFNYPAPA

SEQ ID NO: 712593 - protein, 23 aa, Mycobacterium
PVGPWLRTGDLGVMFEDELFITG

SEQ ID NO: 712594 - protein, 18 aa, Mycobacterium
PVGQIWCASMMLEHLGER

SEQ ID NO: 712595 - protein, 20 aa, Mycobacterium
PVGVGLRVMGRRLFRTYPFE

SEQ ID NO: 712596 - protein, 31 aa, Mycobacterium
PVGVLLGVMPWNFPVYQIARFAAPNLVLGNT

SEQ ID NO: 712597 - protein, 22 aa, Mycobacterium
PVHAECAGLIYLAAELDGHPMC

SEQ ID NO: 712598 - protein, 23 aa, Mycobacterium
PVHCDVWNGFVFINFDTEPRQSL

SEQ ID NO: 712599 - protein, 23 aa, Mycobacterium
PVHCDVWNGFVFINFDTQPRQSL

SEQ ID NO: 712600 - protein, 25 aa, Mycobacterium
PVHECDRLGWLATERKAIAACPLTW

SEQ ID NO: 712601 - protein, 21 aa, Mycobacterium
PVHFDARYAAATEWQKMLVDS

SEQ ID NO: 712602 - protein, 21 aa, Mycobacterium
PVHGVCSLDAIAAGTTGDVLV

SEQ ID NO: 712603 - protein, 19 aa, Mycobacterium
PVHGVCSLDAIGGDTRGDV

SEQ ID NO: 712604 - protein, 21 aa, Mycobacterium
PVHGVCSLDAIGVHTTGDALV

SEQ ID NO: 712605 - protein, 18 aa, Mycobacterium
PVHIAMRVLAPALALGNA

SEQ ID NO: 712606 - protein, 26 aa, Mycobacterium
PVHLLARAEWDRVIGVNLTGTFLVAK

SEQ ID NO: 712607 - protein, 23 aa, Mycobacterium
PVHPAHPLAVAFGQVVVDRDDVH

SEQ ID NO: 712608 - protein, 23 aa, Mycobacterium
PVHQIPQPIAWPGSSDRNFYDRS

SEQ ID NO: 712609 - protein, 17 aa, Mycobacterium
PVHQLPQPIAWPGSSDR

SEQ ID NO: 712610 - protein, 18 aa, Mycobacterium
PVHRAAVTVTEWGLRGTR

SEQ ID NO: 712611 - protein, 18 aa, Mycobacterium
PVHRDWRLNERHYGALQG

SEQ ID NO: 712612 - protein, 20 aa, Mycobacterium
PVHRVPAIMFPKVSTLPLGV

SEQ ID NO: 712613 - protein, 19 aa, Mycobacterium
PVHSVRLAGLVAHQEILFG

SEQ ID NO: 712614 - protein, 23 aa, Mycobacterium
PVHSVRLAGLVAHQEILFGTEGE

SEQ ID NO: 712615 - protein, 19 aa, Mycobacterium
PVHSVRLAGLVAHQEVLFG

SEQ ID NO: 712616 - protein, 17 aa, Mycobacterium
PVHSYSKDGAMRVTNVS

SEQ ID NO: 712617 - protein, 20 aa, Mycobacterium
PVHTRRGKPVIPAWEDVLLG

SEQ ID NO: 712618 - protein, 19 aa, Mycobacterium
PVHVARKVALLNILAGAMR

SEQ ID NO: 712619 - protein, 24 aa, Mycobacterium
PVHVDTWGGWIWINMDPGAEPLRD

SEQ ID NO: 712620 - protein, 18 aa, Mycobacterium
PVHWREWTPEALAEAAER

SEQ ID NO: 712621 - protein, 21 aa, Mycobacterium
PVHYLETWDTYALSRFDDIWN

SEQ ID NO: 712622 - protein, 19 aa, Mycobacterium
PVIAANRAQLMALIATNFL

SEQ ID NO: 712623 - protein, 18 aa, Mycobacterium
PVIAANRAQLMALVATNF

SEQ ID NO: 712624 - protein, 17 aa, Mycobacterium
PVIADFNRVYAFYDELM

SEQ ID NO: 712625 - protein, 18 aa, Mycobacterium
PVIADIAGAGSHPADNIE

SEQ ID NO: 712626 - protein, 20 aa, Mycobacterium
PVIAELRRKLVVSAAETGMQ

SEQ ID NO: 712627 - protein, 17 aa, Mycobacterium
PVIDLAMQISHLPRHMG

SEQ ID NO: 712628 - protein, 24 aa, Mycobacterium
PVIDLKSDFLASGTPFSRPVQGTD

SEQ ID NO: 712629 - protein, 23 aa, Mycobacterium
PVIDRLATIVSMAMGYEPEDVPR

SEQ ID NO: 712630 - protein, 17 aa, Mycobacterium
PVIGGLAPLAGEANLGA

SEQ ID NO: 712631 - protein, 21 aa, Mycobacterium
PVIGRDGIDLGRFWYEQRYQS

SEQ ID NO: 712632 - protein, 19 aa, Mycobacterium
PVIGTPILRREDVRRAYGA

SEQ ID NO: 712633 - protein, 32 aa, Mycobacterium
PVIGTVMRQGYKLGDQILRHAMVGVVDTVDDE

SEQ ID NO: 712634 - protein, 29 aa, Mycobacterium
PVIGTVMRQGYKLGDQVLRHALVGVIDTV

SEQ ID NO: 712635 - protein, 24 aa, Mycobacterium
PVIHSCQILDPGIGVGRIEVISEE

SEQ ID NO: 712636 - protein, 20 aa, Mycobacterium
PVIKMFGEGGGRQVADSLSR

SEQ ID NO: 712637 - protein, 17 aa, Mycobacterium
PVIKSFGGIEMLQQATV

SEQ ID NO: 712638 - protein, 23 aa, Mycobacterium
PVILSAMPFFWIGGLLAAMGALH

SEQ ID NO: 712639 - protein, 18 aa, Mycobacterium
PVILWHRSFHELIANDGA

SEQ ID NO: 712640 - protein, 19 aa, Mycobacterium
PVINVPRHPLRLAAFGPRA

SEQ ID NO: 712641 - protein, 18 aa, Mycobacterium
PVIPEVVNQVAFEVIGND

SEQ ID NO: 712642 - protein, 17 aa, Mycobacterium
PVIPPAFEGVAYLTSTT

SEQ ID NO: 712643 - protein, 18 aa, Mycobacterium
PVIPPAILDCGVAYHTSD

SEQ ID NO: 712644 - protein, 17 aa, Mycobacterium
PVIPSHEVSGVVSAVAD

SEQ ID NO: 712645 - protein, 18 aa, Mycobacterium
PVIRSFEPGEDWFWDYAE

SEQ ID NO: 712646 - protein, 21 aa, Mycobacterium
PVIVDLCTGSGALAIALADRW

SEQ ID NO: 712647 - protein, 22 aa, Mycobacterium
PVIYKPRVIGDFLVNGNRPVSG

SEQ ID NO: 712648 - protein, 17 aa, Mycobacterium
PVKAAAKKLAFVEDRAI

SEQ ID NO: 712649 - protein, 17 aa, Mycobacterium
PVKAAAKQLAFVEDRTI

SEQ ID NO: 712650 - protein, 23 aa, Mycobacterium
PVKAAPDPPWGLRAPPATAAPAD

SEQ ID NO: 712651 - protein, 23 aa, Mycobacterium
PVKARKCVFCAKKDQAIDYKDTA

SEQ ID NO: 712652 - protein, 22 aa, Mycobacterium
PVKARKCVFCAKKDQKIDYKDT

SEQ ID NO: 712653 - protein, 21 aa, Mycobacterium
PVKDLLPLTPLQQGLLFHSDA

SEQ ID NO: 712654 - protein, 19 aa, Mycobacterium
PVKPAPPFVPGHEGCGTVV

SEQ ID NO: 712655 - protein, 19 aa, Mycobacterium
PVKQKYGSKISWADLIIFA

SEQ ID NO: 712656 - protein, 23 aa, Mycobacterium
PVKRLVRVIREFRPHVMTTYDEN

SEQ ID NO: 712657 - protein, 21 aa, Mycobacterium
PVKSVTKTRCDVLVTAEAGTQ

SEQ ID NO: 712658 - protein, 25 aa, Mycobacterium
PVKTRKCAFCTKKALNIDYKDTNLL

SEQ ID NO: 712659 - protein, 23 aa, Mycobacterium
PVKTRKCVFCAKKDQAIDYKDTA

SEQ ID NO: 712660 - protein, 23 aa, Mycobacterium
PVKTRKCVFCAKNDQSIDYKDTA

SEQ ID NO: 712661 - protein, 23 aa, Mycobacterium
PVKTRKCVFCSKKGKNQVIDYKD

SEQ ID NO: 712662 - protein, 23 aa, Mycobacterium
PVKTRKCVFCSKKGQTIDYKDTA

SEQ ID NO: 712663 - protein, 25 aa, Mycobacterium
PVKVRRLRRLAGLWLSEQDARWESV

SEQ ID NO: 712664 - protein, 17 aa, Mycobacterium
PVLAAPPVRGGLPTAVP

SEQ ID NO: 712665 - protein, 18 aa, Mycobacterium
PVLACALAHGVLPDLSDL

SEQ ID NO: 712666 - protein, 22 aa, Mycobacterium
PVLAELALRGRLDIEALVTRRI

SEQ ID NO: 712667 - protein, 28 aa, Mycobacterium
PVLAEWFLRRFSLLDSLYMVPPPRIIGR

SEQ ID NO: 712668 - protein, 17 aa, Mycobacterium
PVLAGAFAVAWEWENTE

SEQ ID NO: 712669 - protein, 18 aa, Mycobacterium
PVLAGPPGSHDLLLISPI

SEQ ID NO: 712670 - protein, 25 aa, Mycobacterium
PVLAICAAVQVLGHWYETSSGERVD

SEQ ID NO: 712671 - protein, 24 aa, Mycobacterium
PVLALLKITGDWQKFKGLPGAEGT

SEQ ID NO: 712672 - protein, 19 aa, Mycobacterium
PVLAQAVLRMLGDVHRVDV

SEQ ID NO: 712673 - protein, 20 aa, Mycobacterium
PVLARELLPERALMGDASAI

SEQ ID NO: 712674 - protein, 18 aa, Mycobacterium
PVLCKTFVHPAVGPVSVN

SEQ ID NO: 712675 - protein, 26 aa, Mycobacterium
PVLDHVAGRPYGLWVHGNNDTVGAAN

SEQ ID NO: 712676 - protein, 19 aa, Mycobacterium
PVLDRAAVVVGRLVGGEPG

SEQ ID NO: 712677 - protein, 28 aa, Mycobacterium
PVLDRLPLRCVLGAPLLFGAGRGVTLVR

SEQ ID NO: 712678 - protein, 23 aa, Mycobacterium
PVLECLRAGVPATALYVALGAEA

SEQ ID NO: 712679 - protein, 23 aa, Mycobacterium
PVLECLRAGVPATALYVALGTDT

SEQ ID NO: 712680 - protein, 23 aa, Mycobacterium
PVLECLRAGVPSTALYVALGVEA

SEQ ID NO: 712681 - protein, 23 aa, Mycobacterium
PVLECLRAKVPATALYVALGTDA

SEQ ID NO: 712682 - protein, 23 aa, Mycobacterium
PVLECLRTGVPATALYVAVGADN

SEQ ID NO: 712683 - protein, 19 aa, Mycobacterium
PVLEILRGVSVNSLSARIL

SEQ ID NO: 712684 - protein, 17 aa, Mycobacterium
PVLERASARETAARVAV

SEQ ID NO: 712685 - protein, 25 aa, Mycobacterium
PVLFGRGSAVFARLVVPTGELLALH

SEQ ID NO: 712686 - protein, 17 aa, Mycobacterium
PVLGGMGNASWVQLSGH

SEQ ID NO: 712687 - protein, 23 aa, Mycobacterium
PVLGRLPVRLIYLPWAAQAWTRS

SEQ ID NO: 712688 - protein, 24 aa, Mycobacterium
PVLGSVMRRGYKVGDVVVRHAMVG

SEQ ID NO: 712689 - protein, 26 aa, Mycobacterium
PVLGVCVGMQILFARGVEFGVESTGC

SEQ ID NO: 712690 - protein, 25 aa, Mycobacterium
PVLGVCVGMQILFARGVEFSVETEG

SEQ ID NO: 712691 - protein, 19 aa, Mycobacterium
PVLGVCVGMQILFDSGIEF

SEQ ID NO: 712692 - protein, 27 aa, Mycobacterium
PVLGVCVGMQILFERGVEFGVETAGCG

SEQ ID NO: 712693 - protein, 19 aa, Mycobacterium
PVLGVPRHPLRLAAFGPRA

SEQ ID NO: 712694 - protein, 23 aa, Mycobacterium
PVLKLLKITGDWQKFKGLPGAEG

SEQ ID NO: 712695 - protein, 22 aa, Mycobacterium
PVLKRTWGPEGLRMAEEADEVQ

SEQ ID NO: 712696 - protein, 18 aa, Mycobacterium
PVLLAFTQRRLFAVVTLT

SEQ ID NO: 712697 - protein, 20 aa, Mycobacterium
PVLLREVLDTAGISIDDIDH

SEQ ID NO: 712698 - protein, 26 aa, Mycobacterium
PVLMRICDALGIGIGDLFEYPAAPIV

SEQ ID NO: 712699 - protein, 27 aa, Mycobacterium
PVLPEWRLEQLDVYMIHPFQLSFSTLI

SEQ ID NO: 712700 - protein, 17 aa, Mycobacterium
PVLPRQRVLVISTGSEL

SEQ ID NO: 712701 - protein, 32 aa, Mycobacterium
PVLPRRLRELIVLRTAYLMDCAYELGQHRDVA

SEQ ID NO: 712702 - protein, 20 aa, Mycobacterium
PVLRACGFDTPYPPARLEKW

SEQ ID NO: 712703 - protein, 20 aa, Mycobacterium
PVLRACGFDTPYPPARLERL

SEQ ID NO: 712704 - protein, 34 aa, Mycobacterium
PVLRACGFDTPYPPARLERLWLPGPDRLLDCVER

SEQ ID NO: 712705 - protein, 24 aa, Mycobacterium
PVLRDRLSSLWLRSEAQRLTSKRS

SEQ ID NO: 712706 - protein, 25 aa, Mycobacterium
PVLREQRGGLIIQFSSMGGRVGGSP

SEQ ID NO: 712707 - protein, 18 aa, Mycobacterium
PVLRGQVMWCQLFSEPGA

SEQ ID NO: 712708 - protein, 17 aa, Mycobacterium
PVLSIGFCGPTHDERSW

SEQ ID NO: 712709 - protein, 19 aa, Mycobacterium
PVLTAALRRARTRIRLGEW

SEQ ID NO: 712710 - protein, 18 aa, Mycobacterium
PVLTELRFDIARSEGERG

SEQ ID NO: 712711 - protein, 22 aa, Mycobacterium
PVLTHYGVGLWVPEVGGAVDPG

SEQ ID NO: 712712 - protein, 22 aa, Mycobacterium
PVLTLPHGVFGDRARTLGLRVV

SEQ ID NO: 712713 - protein, 22 aa, Mycobacterium
PVLVKASAGGGGRGMRIVSELD

SEQ ID NO: 712714 - protein, 24 aa, Mycobacterium
PVLVRSGAEWMPNFIDLLQRKLSR

SEQ ID NO: 712715 - protein, 18 aa, Mycobacterium
PVLYELPYGLPFSELLAL

SEQ ID NO: 712716 - protein, 18 aa, Mycobacterium
PVMGDAGLPILGHIIELF

SEQ ID NO: 712717 - protein, 22 aa, Mycobacterium
PVMLDMLRWHGAEEVEHKAVAF

SEQ ID NO: 712718 - protein, 19 aa, Mycobacterium
PVMQGRTALYGPRHLLQVI

SEQ ID NO: 712719 - protein, 20 aa, Mycobacterium
PVMRAAMGGAVRFFAGRLVK

SEQ ID NO: 712720 - protein, 20 aa, Mycobacterium
PVMRAAMGGAVRFFSGRLVK

SEQ ID NO: 712721 - protein, 25 aa, Mycobacterium
PVMRIKPGTVLTLWTEDAYGGRITS

SEQ ID NO: 712722 - protein, 30 aa, Mycobacterium
PVMRVVCPLRGWRDGRRLTPGPTVVGPGVE

SEQ ID NO: 712723 - protein, 22 aa, Mycobacterium
PVMSARAPWLERMGRLDKGRRT

SEQ ID NO: 712724 - protein, 24 aa, Mycobacterium
PVMSDAAEALAEFEVPFEVGVVSA

SEQ ID NO: 712725 - protein, 27 aa, Mycobacterium
PVMTWLFAWCFARRGWAERSATLRREG

SEQ ID NO: 712726 - protein, 27 aa, Mycobacterium
PVMTWLFSWCFARRGWAERARLLRQEG

SEQ ID NO: 712727 - protein, 24 aa, Mycobacterium
PVMVKAQVKTGGRGKAGGVKYAAT

SEQ ID NO: 712728 - protein, 26 aa, Mycobacterium
PVNAEVELAWQILDPVLDNWAADGKP

SEQ ID NO: 712729 - protein, 20 aa, Mycobacterium
PVNCATAPLPTGRRVAEFGA

SEQ ID NO: 712730 - protein, 22 aa, Mycobacterium
PVNDGWRLVGVLDMGWERYKVA

SEQ ID NO: 712731 - protein, 26 aa, Mycobacterium
PVNGEMLIAIAGRVARAVVAESPGVQ

SEQ ID NO: 712732 - protein, 19 aa, Mycobacterium
PVNGTAFAVTPTLRESYSE

SEQ ID NO: 712733 - protein, 18 aa, Mycobacterium
PVNGTVFAVTPTLREAYA

SEQ ID NO: 712734 - protein, 31 aa, Mycobacterium
PVNHDGRLRLGARVRPGWFAQTHHHAGLMDR

SEQ ID NO: 712735 - protein, 22 aa, Mycobacterium
PVNLPALRLTGLQAAVAAAVSS

SEQ ID NO: 712736 - protein, 18 aa, Mycobacterium
PVNPRPGLATAAAEHGWP

SEQ ID NO: 712737 - protein, 17 aa, Mycobacterium
PVNVTRSVAALALPGGV

SEQ ID NO: 712738 - protein, 17 aa, Mycobacterium
PVNWKPDNSAALRAEVA

SEQ ID NO: 712739 - protein, 24 aa, Mycobacterium
PVNWPRVLTVWRANLIGSSGKGGE

SEQ ID NO: 712740 - protein, 26 aa, Mycobacterium
PVNYWRSGDDIVIWVGIPESKTWWRN

SEQ ID NO: 712741 - protein, 23 aa, Mycobacterium
PVPAAALRPTFVYRHRQIADDLA

SEQ ID NO: 712742 - protein, 19 aa, Mycobacterium
PVPAGFCRALTGDAVADKG

SEQ ID NO: 712743 - protein, 23 aa, Mycobacterium
PVPAGVSPLEFLFVLESTDYGAL

SEQ ID NO: 712744 - protein, 23 aa, Mycobacterium
PVPALVRGYLRLGARVCGEPAHD

SEQ ID NO: 712745 - protein, 17 aa, Mycobacterium
PVPAYGVSTGFGALATR

SEQ ID NO: 712746 - protein, 18 aa, Mycobacterium
PVPDGPDAGAAWHYGDPL

SEQ ID NO: 712747 - protein, 23 aa, Mycobacterium
PVPDPRYPFLGVHLTPRVDGEVL

SEQ ID NO: 712748 - protein, 19 aa, Mycobacterium
PVPDVPTWDSVVASRRPDR

SEQ ID NO: 712749 - protein, 22 aa, Mycobacterium
PVPECQSPLFLHVDADDRDHVR

SEQ ID NO: 712750 - protein, 19 aa, Mycobacterium
PVPEIASTLLVGRSTVYRA

SEQ ID NO: 712751 - protein, 26 aa, Mycobacterium
PVPERGDMGLIPAMTVKCPVALVKSI

SEQ ID NO: 712752 - protein, 26 aa, Mycobacterium
PVPERGEMGLVPAMTVKCAVALIKSV

SEQ ID NO: 712753 - protein, 23 aa, Mycobacterium
PVPETLPDWFVREHDLMSEDEAL

SEQ ID NO: 712754 - protein, 17 aa, Mycobacterium
PVPEWIVVGAGTGGTSA

SEQ ID NO: 712755 - protein, 23 aa, Mycobacterium
PVPEYRFPGLLPGDRWCVTALNW

SEQ ID NO: 712756 - protein, 18 aa, Mycobacterium
PVPFAEAVGQDFHEITPG

SEQ ID NO: 712757 - protein, 18 aa, Mycobacterium
PVPFAHPLWVMFSSGTTG

SEQ ID NO: 712758 - protein, 25 aa, Mycobacterium
PVPFEVYADGISLVVFEEFGAGAAA

SEQ ID NO: 712759 - protein, 25 aa, Mycobacterium
PVPFEVYADGISLVVFEEFGSGAAA

SEQ ID NO: 712760 - protein, 17 aa, Mycobacterium
PVPGEALESWLGAIARR

SEQ ID NO: 712761 - protein, 18 aa, Mycobacterium
PVPGKPALLLGAFDLGGL

SEQ ID NO: 712762 - protein, 24 aa, Mycobacterium
PVPGSMLRPMFTYRHRQLADDLAA

SEQ ID NO: 712763 - protein, 19 aa, Mycobacterium
PVPGVVMYPDVGGFRPTFQ

SEQ ID NO: 712764 - protein, 26 aa, Mycobacterium
PVPHRPIAEYFVWFGGEYDVTNEDRL

SEQ ID NO: 712765 - protein, 25 aa, Mycobacterium
PVPHRPVAEYFVWFKDEYEISESDR

SEQ ID NO: 712766 - protein, 17 aa, Mycobacterium
PVPKILKLIPVAKKLFP

SEQ ID NO: 712767 - protein, 17 aa, Mycobacterium
PVPLPARGAGPGHPLQI

SEQ ID NO: 712768 - protein, 26 aa, Mycobacterium
PVPLPTYPFQHHRYWLTTGPGNDAAG

SEQ ID NO: 712769 - protein, 20 aa, Mycobacterium
PVPLRDGTQLMLRPVLPGDS

SEQ ID NO: 712770 - protein, 17 aa, Mycobacterium
PVPMLVMAHGLGAVRTM

SEQ ID NO: 712771 - protein, 26 aa, Mycobacterium
PVPNKNIRLVIEWIDRYAEALPLTVI

SEQ ID NO: 712772 - protein, 26 aa, Mycobacterium
PVPPPRPELATAFPPSPPSPPLPAAP

SEQ ID NO: 712773 - protein, 18 aa, Mycobacterium
PVPPSPPSPTAWAAPPLP

SEQ ID NO: 712774 - protein, 19 aa, Mycobacterium
PVPQRQALATAFGQASGPA

SEQ ID NO: 712775 - protein, 17 aa, Mycobacterium
PVPRADPDLPWPGRLPA

SEQ ID NO: 712776 - protein, 20 aa, Mycobacterium
PVPRLARGFLKYAPGGQLAA

SEQ ID NO: 712777 - protein, 26 aa, Mycobacterium
PVPSDLLCVGTDWSASQGDSAATPPA

SEQ ID NO: 712778 - protein, 18 aa, Mycobacterium
PVPSSMVLVSPWLDVGMT

SEQ ID NO: 712779 - protein, 19 aa, Mycobacterium
PVPTCPGWTLKQLLRHVGR

SEQ ID NO: 712780 - protein, 17 aa, Mycobacterium
PVPTGRKVPQAWLESGV

SEQ ID NO: 712781 - protein, 18 aa, Mycobacterium
PVPTHPIPLLIGGHSEAA

SEQ ID NO: 712782 - protein, 18 aa, Mycobacterium
PVPTNFTSSLLLGSSAQV

SEQ ID NO: 712783 - protein, 20 aa, Mycobacterium
PVPTPKLLALIGERAPEADV

SEQ ID NO: 712784 - protein, 24 aa, Mycobacterium
PVPVAYHTFGGWKASGFGDLNQHG

SEQ ID NO: 712785 - protein, 18 aa, Mycobacterium
PVPVGVVADVHYAGAPDR

SEQ ID NO: 712786 - protein, 25 aa, Mycobacterium
PVPVSYHTFGGWKRSGFGDLNQHGP

SEQ ID NO: 712787 - protein, 26 aa, Mycobacterium
PVPYVYPVDLRYLLSPPVSATECTNP

SEQ ID NO: 712788 - protein, 18 aa, Mycobacterium
PVQAGGRLGEWLAGTFAA

SEQ ID NO: 712789 - protein, 28 aa, Mycobacterium
PVQARAGWAVGWKKDAFWGREALTQEKT

SEQ ID NO: 712790 - protein, 25 aa, Mycobacterium
PVQEKAWRAGRFWWDCTQSADPGAH

SEQ ID NO: 712791 - protein, 18 aa, Mycobacterium
PVQHRVGAEWAANRIGVA

SEQ ID NO: 712792 - protein, 20 aa, Mycobacterium
PVQIILNDLVLEWRTVEFDP

SEQ ID NO: 712793 - protein, 26 aa, Mycobacterium
PVQIVPVHAALPWSERVATPAEFDSI

SEQ ID NO: 712794 - protein, 18 aa, Mycobacterium
PVQLIWGDCDSVIPVSHA

SEQ ID NO: 712795 - protein, 19 aa, Mycobacterium
PVQPGGVPCWISGTVNDAV

SEQ ID NO: 712796 - protein, 17 aa, Mycobacterium
PVQRARIAEEMRARFGR

SEQ ID NO: 712797 - protein, 26 aa, Mycobacterium
PVQRTWPELIPLLASGRLDVDGIFTT

SEQ ID NO: 712798 - protein, 17 aa, Mycobacterium
PVQRVAQALPLLKPPFP

SEQ ID NO: 712799 - protein, 20 aa, Mycobacterium
PVQSCVLCHVTTTMELIDRG

SEQ ID NO: 712800 - protein, 19 aa, Mycobacterium
PVQVFGKLPSWAGDMTYEP

SEQ ID NO: 712801 - protein, 26 aa, Mycobacterium
PVQVLGFREHASWALASDTLEFVDLE

SEQ ID NO: 712802 - protein, 20 aa, Mycobacterium
PVQVRDGTVLYLRPVLPGDI

SEQ ID NO: 712803 - protein, 30 aa, Mycobacterium
PVQYTCKGADVAPPLVWSAPLGAALVVDDP

SEQ ID NO: 712804 - protein, 17 aa, Mycobacterium
PVRACPFDWSAQSRLAR

SEQ ID NO: 712805 - protein, 20 aa, Mycobacterium
PVRADFSPALTLRSLTTATA

SEQ ID NO: 712806 - protein, 26 aa, Mycobacterium
PVRAPRWLPTPARRRAAHAVAEMRQV

SEQ ID NO: 712807 - protein, 30 aa, Mycobacterium
PVREALMRALLRLAARRQPHEIAMATYRNG

SEQ ID NO: 712808 - protein, 25 aa, Mycobacterium
PVRGDYRIAVLSLKGGVGKTTTTFS

SEQ ID NO: 712809 - protein, 17 aa, Mycobacterium
PVRGSTSGEVFRSGRPL

SEQ ID NO: 712810 - protein, 20 aa, Mycobacterium
PVRHGSDVVAVLTHQTSLAP

SEQ ID NO: 712811 - protein, 24 aa, Mycobacterium
PVRIDRFEVLAVRRNGDVVDVDVV

SEQ ID NO: 712812 - protein, 19 aa, Mycobacterium
PVRIDRFSPDPSIRREDFY

SEQ ID NO: 712813 - protein, 20 aa, Mycobacterium
PVRIRDGTQLLLRPVLPGDS

SEQ ID NO: 712814 - protein, 31 aa, Mycobacterium
PVRLEPEWLKPTAYMMAKFGMTLCALGIAEE

SEQ ID NO: 712815 - protein, 26 aa, Mycobacterium
PVRLRFGDQELYKFRVASNSRRRSPE

SEQ ID NO: 712816 - protein, 18 aa, Mycobacterium
PVRLRLFSLIASHAGGEA

SEQ ID NO: 712817 - protein, 25 aa, Mycobacterium
PVRLRSGWLNGIKHWQVDYRGDAAK

SEQ ID NO: 712818 - protein, 25 aa, Mycobacterium
PVRLWSRIGRRPIFAAGNSNGDIEM

SEQ ID NO: 712819 - protein, 33 aa, Mycobacterium
PVRNVLRLLGPLLRPILRAVFVVQRRLEGRGPY

SEQ ID NO: 712820 - protein, 26 aa, Mycobacterium
PVRPGDVWTAQFAQLGLVTTRFAAGE

SEQ ID NO: 712821 - protein, 20 aa, Mycobacterium
PVRPGEWRTLGLFAAADDER

SEQ ID NO: 712822 - protein, 18 aa, Mycobacterium
PVRPLLRLLAELGTSEAI

SEQ ID NO: 712823 - protein, 19 aa, Mycobacterium
PVRPRRWLEIRYLDSVPDA

SEQ ID NO: 712824 - protein, 25 aa, Mycobacterium
PVRRAEGVGEAWLQEQLDIERRHCF

SEQ ID NO: 712825 - protein, 26 aa, Mycobacterium
PVRRGGRFAVALGMGGMGYSFGAGIG

SEQ ID NO: 712826 - protein, 19 aa, Mycobacterium
PVRRGRIPINATVPAVPPA

SEQ ID NO: 712827 - protein, 17 aa, Mycobacterium
PVRRHARSWHQYSEPNP

SEQ ID NO: 712828 - protein, 23 aa, Mycobacterium
PVRRLPGYLMRFRRGSRMMTTGD

SEQ ID NO: 712829 - protein, 33 aa, Mycobacterium
PVRRRIFHLEIGRAHAPWFHWGTTAVVARLVQQ

SEQ ID NO: 712830 - protein, 33 aa, Mycobacterium
PVRRRIFQLEIARAHTPWYHWGTTSVVARLVRQ

SEQ ID NO: 712831 - protein, 21 aa, Mycobacterium
PVRRRVIRGWLLAGGATGLTD

SEQ ID NO: 712832 - protein, 23 aa, Mycobacterium
PVRRRVIRRWLLAGGATGLTDKQ

SEQ ID NO: 712833 - protein, 18 aa, Mycobacterium
PVRSLVWIQGVLRDVPTA

SEQ ID NO: 712834 - protein, 19 aa, Mycobacterium
PVRTCVGCRKRELAVELLR

SEQ ID NO: 712835 - protein, 21 aa, Mycobacterium
PVRTDRALIMAIVNRTPDSFY

SEQ ID NO: 712836 - protein, 25 aa, Mycobacterium
PVRVDRFDVLAARRGGDGVVDLDVE

SEQ ID NO: 712837 - protein, 18 aa, Mycobacterium
PVRVECLTYAIVNDERDG

SEQ ID NO: 712838 - protein, 18 aa, Mycobacterium
PVRVGAKVRARAQISDVA

SEQ ID NO: 712839 - protein, 22 aa, Mycobacterium
PVRVKDRCCSTGSTVAPGPAVA

SEQ ID NO: 712840 - protein, 17 aa, Mycobacterium
PVRWRPDNPDSIVDKNA

SEQ ID NO: 712841 - protein, 18 aa, Mycobacterium
PVSAEWDRINGGIYGDSR

SEQ ID NO: 712842 - protein, 18 aa, Mycobacterium
PVSALGLPSLGLAAATPL

SEQ ID NO: 712843 - protein, 32 aa, Mycobacterium; identical to SEQ ID NO: 102308

SEQ ID NO: 712844 - protein, 22 aa, Mycobacterium
PVSANAYLGAWGITEALRSGAD

SEQ ID NO: 712845 - protein, 23 aa, Mycobacterium
PVSANAYLGAWGITEALRSGADV

SEQ ID NO: 712846 - protein, 24 aa, Mycobacterium
PVSARGMARLSRLIGDGCGPLYAM

SEQ ID NO: 712847 - protein, 22 aa, Mycobacterium
PVSDLRASLPTAVLAPAADGLA

SEQ ID NO: 712848 - protein, 18 aa, Mycobacterium
PVSDPHPPIWIGGNTSSA

SEQ ID NO: 712849 - protein, 24 aa, Mycobacterium
PVSEALKAVGAFRLALPRTMLRFA

SEQ ID NO: 712850 - protein, 17 aa, Mycobacterium
PVSEELAWAAVQSEMLT

SEQ ID NO: 712851 - protein, 23 aa, Mycobacterium
PVSELRSGGLGIRDVKRLSKMTG

SEQ ID NO: 712852 - protein, 24 aa, Mycobacterium
PVSELRSGGLGIRDVKRLSKVTGI

SEQ ID NO: 712853 - protein, 17 aa, Mycobacterium
PVSESWRQQPGTPVYGK

SEQ ID NO: 712854 - protein, 20 aa, Mycobacterium
PVSGAGRFGAPRAAPTRSGA

SEQ ID NO: 712855 - protein, 18 aa, Mycobacterium
PVSGAGRFGAPRSAPTRS

SEQ ID NO: 712856 - protein, 21 aa, Mycobacterium
PVSGLHCVIDLNAMEVLRVED

SEQ ID NO: 712857 - protein, 19 aa, Mycobacterium
PVSGVGRFGPPRAAPTRSG

SEQ ID NO: 712858 - protein, 22 aa, Mycobacterium
PVSHGARPAWRGRRFERGTCAT

SEQ ID NO: 712859 - protein, 20 aa, Mycobacterium
PVSIAELFAAQAARAPEAVA

SEQ ID NO: 712860 - protein, 17 aa, Mycobacterium
PVSKLVWVFAERISRAN

SEQ ID NO: 712861 - protein, 24 aa, Mycobacterium
PVSLREARRGMALAAELRLPLVLM

SEQ ID NO: 712862 - protein, 18 aa, Mycobacterium
PVSLRLSDIRALLDRHLA

SEQ ID NO: 712863 - protein, 17 aa, Mycobacterium
PVSLRMLRRTLSLEMAY

SEQ ID NO: 712864 - protein, 18 aa, Mycobacterium
PVSLRRHAPILGAHTAEV

SEQ ID NO: 712865 - protein, 25 aa, Mycobacterium
PVSMLIPRVVGFKITGERRPGVTAT

SEQ ID NO: 712866 - protein, 26 aa, Mycobacterium
PVSMLIPRVVGFKLSGEIKPGVTATD

SEQ ID NO: 712867 - protein, 20 aa, Mycobacterium
PVSPASMRKFFNAFAPYGLP

SEQ ID NO: 712868 - protein, 20 aa, Mycobacterium
PVSRGFERFYGFMGGETDQW

SEQ ID NO: 712869 - protein, 23 aa, Mycobacterium
PVSRLTTALALAEWIEEHEPVCE

SEQ ID NO: 712870 - protein, 24 aa, Mycobacterium
PVSRNRRLTVASGRLEDYRTVRAR

SEQ ID NO: 712871 - protein, 24 aa, Mycobacterium
PVSRPRIIMLLGGLRELTAITVEE

SEQ ID NO: 712872 - protein, 19 aa, Mycobacterium
PVSRSVLCKGVDETGITFF

SEQ ID NO: 712873 - protein, 27 aa, Mycobacterium
PVSRVLPIWSEWVRRWPTPSATAAATA

SEQ ID NO: 712874 - protein, 23 aa, Mycobacterium
PVSRWTRELGELSTPRELKVDLD

SEQ ID NO: 712875 - protein, 19 aa, Mycobacterium
PVSSCPFDWSAAGRLARLS

SEQ ID NO: 712876 - protein, 24 aa, Mycobacterium
PVSSGEPLLGIWQSVVLVDLNQDN

SEQ ID NO: 712877 - protein, 17 aa, Mycobacterium
PVSSSIFRAIGKMADVT

SEQ ID NO: 712878 - protein, 24 aa, Mycobacterium
PVSVAGLVAIPWAQGDRSGVAFRA

SEQ ID NO: 712879 - protein, 21 aa, Mycobacterium
PVSVPDWLVPQHFSGSVGSVM

SEQ ID NO: 712880 - protein, 26 aa, Mycobacterium
PVSWRSRELLTRIGSVFQNPEHQFLT

SEQ ID NO: 712881 - protein, 25 aa, Mycobacterium
PVSYTDFLGGFGIEGLELREWKRLL

SEQ ID NO: 712882 - protein, 18 aa, Mycobacterium
PVTAFAFYERSLALYRDW

SEQ ID NO: 712883 - protein, 27 aa, Mycobacterium
PVTAPRWLGLPARLALQALIGRVRVPG

SEQ ID NO: 712884 - protein, 23 aa, Mycobacterium
PVTARPLVRLGIPTSAPERMRLG

SEQ ID NO: 712885 - protein, 23 aa, Mycobacterium
PVTEFAPVPGMGWMFVADPDGNH

SEQ ID NO: 712886 - protein, 22 aa, Mycobacterium
PVTESDPAWAQEWAQRVAKHRE

SEQ ID NO: 712887 - protein, 24 aa, Mycobacterium
PVTIGIWLDANWGKRQFRMNIKGP

SEQ ID NO: 712888 - protein, 22 aa, Mycobacterium
PVTIGYRLARGIVHNLTTADPA

SEQ ID NO: 712889 - protein, 21 aa, Mycobacterium
PVTIRPGVLFRSSELSGLTPA

SEQ ID NO: 712890 - protein, 18 aa, Mycobacterium
PVTNGPVWVLAGFGAQHR

SEQ ID NO: 712891 - protein, 24 aa, Mycobacterium
PVTPAPRYAGTRVQRVEDGRLLTG

SEQ ID NO: 712892 - protein, 18 aa, Mycobacterium
PVTPEAYVAYGVSRLFPA

SEQ ID NO: 712893 - protein, 19 aa, Mycobacterium
PVTPVALKAAQPVQVSPPR

SEQ ID NO: 712894 - protein, 17 aa, Mycobacterium
PVTPWQHTQFWVEDRSG

SEQ ID NO: 712895 - protein, 21 aa, Mycobacterium
PVTQWTRWRQPVIGMPTTPRF

SEQ ID NO: 712896 - protein, 22 aa, Mycobacterium
PVTRAAFFVLDEWLRPVPAGVV

SEQ ID NO: 712897 - protein, 17 aa, Mycobacterium
PVTRAELDVAWTTDPAQ

SEQ ID NO: 712898 - protein, 22 aa, Mycobacterium
PVTRAVAPGGLVDQITMEGGLL

SEQ ID NO: 712899 - protein, 24 aa, Mycobacterium
PVTRIGMGIPYTWAKMQMTWSGQR

SEQ ID NO: 712900 - protein, 24 aa, Mycobacterium
PVTTEAYLGYALWRLSPTVMKVIA

SEQ ID NO: 712901 - protein, 20 aa, Mycobacterium
PVTTIAWRLAHLIVGVLGAR

SEQ ID NO: 712902 - protein, 21 aa, Mycobacterium
PVTTLRLAMHAVEAGLREIAE

SEQ ID NO: 712903 - protein, 25 aa, Mycobacterium
PVTTLRLAMHAVEIGMREVFDAGTQ

SEQ ID NO: 712904 - protein, 20 aa, Mycobacterium
PVTTLRLAMYAVEAGLREIA

SEQ ID NO: 712905 - protein, 26 aa, Mycobacterium
PVTTLRRFSVARVRLSDLHTVARAFD

SEQ ID NO: 712906 - protein, 25 aa, Mycobacterium
PVTTPLRLAQGGAMLVGANTGSSVT

SEQ ID NO: 712907 - protein, 21 aa, Mycobacterium
PVTVAVLRFSGDRSPRAVASR

SEQ ID NO: 712908 - protein, 19 aa, Mycobacterium
PVTVCHWGDATATDLEGYR

SEQ ID NO: 712909 - protein, 19 aa, Mycobacterium
PVTVDARRVGVWRFMSLRH

SEQ ID NO: 712910 - protein, 24 aa, Mycobacterium
PVTWAVELDERWVVIGPNGAGKTS

SEQ ID NO: 712911 - protein, 24 aa, Mycobacterium
PVTWSVELDERWVVLGPNGAGKTS

SEQ ID NO: 712912 - protein, 20 aa, Mycobacterium
PVVAAGGFFDGRGLAAALSY

SEQ ID NO: 712913 - protein, 22 aa, Mycobacterium
PVVAEFTAFLSGLTLREPQIPL

SEQ ID NO: 712914 - protein, 20 aa, Mycobacterium
PVVAEPFAMWVLEDDFADGR

SEQ ID NO: 712915 - protein, 19 aa, Mycobacterium
PVVAFRLAKDRGYTEFDVS

SEQ ID NO: 712916 - protein, 17 aa, Mycobacterium
PVVAGKPGRALIEDALA

SEQ ID NO: 712917 - protein, 18 aa, Mycobacterium
PVVALARPPLMALIGPRL

SEQ ID NO: 712918 - protein, 25 aa, Mycobacterium
PVVAMHAGTIVMLWPAQDAADAAGA

SEQ ID NO: 712919 - protein, 18 aa, Mycobacterium
PVVAPCRVVYVVDEQDRR

SEQ ID NO: 712920 - protein, 27 aa, Mycobacterium
PVVARGWRTPLRFLFIDGGHTEDAANR

SEQ ID NO: 712921 - protein, 27 aa, Mycobacterium
PVVARGWRTPLRFLFIDGGHTEEAAQR

SEQ ID NO: 712922 - protein, 25 aa, Mycobacterium
PVVARPRPARPLPVHVGGPSRAAQA

SEQ ID NO: 712923 - protein, 21 aa, Mycobacterium
PVVATPIIRWLHGLGGNVGEF

SEQ ID NO: 712924 - protein, 17 aa, Mycobacterium
PVVCAVHGMCTAGALYF

SEQ ID NO: 712925 - protein, 23 aa, Mycobacterium
PVVDGHPAGVFSWEPPADLVVAL

SEQ ID NO: 712926 - protein, 19 aa, Mycobacterium
PVVDHITGRVAITAQNHGF

SEQ ID NO: 712927 - protein, 23 aa, Mycobacterium
PVVECLRAGVPATALYVALGTDA

SEQ ID NO: 712928 - protein, 19 aa, Mycobacterium
PVVERLLAPRHSCRIHWVA

SEQ ID NO: 712929 - protein, 20 aa, Mycobacterium
PVVERNASVYIWHDVERREP

SEQ ID NO: 712930 - protein, 20 aa, Mycobacterium
PVVERNASVYLWHDVEGRAP

SEQ ID NO: 712931 - protein, 18 aa, Mycobacterium
PVVFFCQNNQWAISEPVR

SEQ ID NO: 712932 - protein, 18 aa, Mycobacterium
PVVFLAYSGEARWRDSAG

SEQ ID NO: 712933 - protein, 31 aa, Mycobacterium
PVVGTVMRRGYRVGEQVIRHAMVGVVDTVPD

SEQ ID NO: 712934 - protein, 17 aa, Mycobacterium
PVVGYLCTEESTDNGSV

SEQ ID NO: 712935 - protein, 19 aa, Mycobacterium
PVVHDDLRPGWAQHDLCGL

SEQ ID NO: 712936 - protein, 18 aa, Mycobacterium
PVVIEAPDGITFAVQSPT

SEQ ID NO: 712937 - protein, 18 aa, Mycobacterium
PVVIEAPEGITFAVQAPT

SEQ ID NO: 712938 - protein, 18 aa, Mycobacterium
PVVLAAMIVVRLQTVVSR

SEQ ID NO: 712939 - protein, 19 aa, Mycobacterium
PVVLAKLMTGYTTLMVTGT

SEQ ID NO: 712940 - protein, 34 aa, Mycobacterium
PVVLLHGWPQTWYAWRKVIPLLAGEFEVIVPDLR

SEQ ID NO: 712941 - protein, 25 aa, Mycobacterium
PVVLSGDMTKYDWLINGEPYSKTKP

SEQ ID NO: 712942 - protein, 23 aa, Mycobacterium
PVVMPRAELIKRIGAGADSALAD

SEQ ID NO: 712943 - protein, 25 aa, Mycobacterium
PVVNNAVRFAFWTAEEDGLAGSLEY

SEQ ID NO: 712944 - protein, 18 aa, Mycobacterium
PVVPAGAPGALRWLPVDP

SEQ ID NO: 712945 - protein, 17 aa, Mycobacterium
PVVPPQLHSRGFSEDPK

SEQ ID NO: 712946 - protein, 24 aa, Mycobacterium
PVVRANRALAIGFRDGHAAGLAAL

SEQ ID NO: 712947 - protein, 30 aa, Mycobacterium
PVVREMGNGGLLLPLGVRRLRSHASTRNAR

SEQ ID NO: 712948 - protein, 20 aa, Mycobacterium
PVVRERFGIGWSGVDEASYR

SEQ ID NO: 712949 - protein, 20 aa, Mycobacterium
PVVRGEACADSFYAALESAV

SEQ ID NO: 712950 - protein, 17 aa, Mycobacterium
PVVRHVAGLAAGMYHYD

SEQ ID NO: 712951 - protein, 25 aa, Mycobacterium
PVVSRELFIRHALVEGEWQTRHHFF

SEQ ID NO: 712952 - protein, 17 aa, Mycobacterium
PVVSWMYESEIYRRLSL

SEQ ID NO: 712953 - protein, 24 aa, Mycobacterium
PVVTAPHYRLFALDTEPPKPGLVR

SEQ ID NO: 712954 - protein, 27 aa, Mycobacterium
PVVTAVNGFCVGGGIGLVGNSDVIVAS

SEQ ID NO: 712955 - protein, 18 aa, Mycobacterium
PVVTPAKLFEQWFPASKL

SEQ ID NO: 712956 - protein, 27 aa, Mycobacterium
PVVTPGVFRWRVVVPPRGTWQAEVVAE

SEQ ID NO: 712957 - protein, 24 aa, Mycobacterium
PVVVDGRLAGIVSIGDVVKTRMEE

SEQ ID NO: 712958 - protein, 19 aa, Mycobacterium
PVVVLPWEVAFSAVQRSLL

SEQ ID NO: 712959 - protein, 29 aa, Mycobacterium
PVVVSGGICDGRGLAAVLAMGGAAAAMGT

SEQ ID NO: 712960 - protein, 20 aa, Mycobacterium
PVVWALFEWGRRHLPGRNRL

SEQ ID NO: 712961 - protein, 24 aa, Mycobacterium
PVWGDVELAWRLDAAGHYGPPRRW

SEQ ID NO: 712962 - protein, 17 aa, Mycobacterium
PVWISGPQYETWKHTQL

SEQ ID NO: 712963 - protein, 20 aa, Mycobacterium
PVWPMIVLRTPKGWTGPKMV

SEQ ID NO: 712964 - protein, 20 aa, Mycobacterium
PVWPMIVLRTPKGWTGPKVV

SEQ ID NO: 712965 - protein, 19 aa, Mycobacterium
PVWSYRDRSLLGLTDDHRL

SEQ ID NO: 712966 - protein, 18 aa, Mycobacterium
PVWVKGFGEHVPFKTPTY

SEQ ID NO: 712967 - protein, 26 aa, Mycobacterium
PVYLEIGVSHGFAFRRIAADEKTAID

SEQ ID NO: 712968 - protein, 19 aa, Mycobacterium
PVYLSGRARDLWTAGDETA

SEQ ID NO: 712969 - protein, 25 aa, Mycobacterium
PVYQCRICRRTAPFSVRGVCPALGC

SEQ ID NO: 712970 - protein, 18 aa, Mycobacterium
PVYRQLRDAAPVYHAADT

SEQ ID NO: 712971 - protein, 17 aa, Mycobacterium
PVYRVAAKLRLMADELT

SEQ ID NO: 712972 - protein, 19 aa, Mycobacterium
PVYYMPQWDTFALSRFEDI

SEQ ID NO: 712973 - protein, 25 aa, Mycobacterium
PWAEVGRAQFFADLGVSMITAEQGL

SEQ ID NO: 712974 - protein, 25 aa, Mycobacterium
PWAEVGRAQFFADLGVSMITVEQGL

SEQ ID NO: 712975 - protein, 25 aa, Mycobacterium
PWALKYRLAGHRSLSVGDVVVIGET

SEQ ID NO: 712976 - protein, 18 aa, Mycobacterium
PWAPPEVHEHRFSTVDEV

SEQ ID NO: 712977 - protein, 17 aa, Mycobacterium
PWAPRWTAPALGQHTEE

SEQ ID NO: 712978 - protein, 19 aa, Mycobacterium
PWAPSDIDPLTFTWAETVP

SEQ ID NO: 712979 - protein, 21 aa, Mycobacterium
PWAQPEPRRPRTLDEMIEVAE

SEQ ID NO: 712980 - protein, 17 aa, Mycobacterium
PWAQRGVLLLNRVLTVR

SEQ ID NO: 712981 - protein, 20 aa, Mycobacterium
PWARLGVNVDADFEPLYIIS

SEQ ID NO: 712982 - protein, 18 aa, Mycobacterium
PWASGTRHVIRQEPIGVV

SEQ ID NO: 712983 - protein, 21 aa, Mycobacterium
PWASTAQRIVLVWRTQTGEHR

SEQ ID NO: 712984 - protein, 22 aa, Mycobacterium
PWATEICKEETPALVDLAPGHA

SEQ ID NO: 712985 - protein, 31 aa, Mycobacterium
PWATKDVIGAYRFLQRVWRLVIDENTGEILV

SEQ ID NO: 712986 - protein, 19 aa, Mycobacterium
PWAVFDLSLGRAMYSGFTM

SEQ ID NO: 712987 - protein, 23 aa, Mycobacterium
PWDADLPPVRACPEGERRALCGQ

SEQ ID NO: 712988 - protein, 18 aa, Mycobacterium
PWDGMQWAPLPAALERLG

SEQ ID NO: 712989 - protein, 23 aa, Mycobacterium
PWDGRSHYLAAIYRTDLAERVDA

SEQ ID NO: 712990 - protein, 19 aa, Mycobacterium
PWDKKGYKMPGGTPSSPAL

SEQ ID NO: 712991 - protein, 21 aa, Mycobacterium
PWDPPEEKFYPVIDGLLDAWR

SEQ ID NO: 712992 - protein, 19 aa, Mycobacterium
PWDQRWTRPQYRSDPSQNI

SEQ ID NO: 712993 - protein, 21 aa, Mycobacterium
PWDRGRNFAQMGGDDWDPEQS

SEQ ID NO: 712994 - protein, 25 aa, Mycobacterium
PWDRLCVERDGPVALPLPDFPNTVM

SEQ ID NO: 712995 - protein, 19 aa, Mycobacterium
PWDTLADAKARAAAHPDGM

SEQ ID NO: 712996 - protein, 29 aa, Mycobacterium
PWEGAGDFYRDWARHGGIVSNGFLEAWYP

SEQ ID NO: 712997 - protein, 21 aa, Mycobacterium
PWEGFRPLRVSAVRWESSRVV

SEQ ID NO: 712998 - protein, 18 aa, Mycobacterium
PWEGMPTPYKYLGAEIKR

SEQ ID NO: 712999 - protein, 32 aa, Mycobacterium
PWEIDRGPQLFAYDVWWHRDFDTVITSEWAAP

SEQ ID NO: 713000 - protein, 18 aa, Mycobacterium
PWELARPAYQDSTGAGAL

SEQ ID NO: 713001 - protein, 17 aa, Mycobacterium
PWEMRITGMRARLGGAR

SEQ ID NO: 713002 - protein, 20 aa, Mycobacterium
PWEPWLHALPVEFASAEQVF

SEQ ID NO: 713003 - protein, 19 aa, Mycobacterium
PWEPWLHALPVEFDSADQV

SEQ ID NO: 713004 - protein, 19 aa, Mycobacterium
PWEPWLHALPVEFDSAEQV

SEQ ID NO: 713005 - protein, 19 aa, Mycobacterium
PWEPWLHALPVEFDSEAKV

SEQ ID NO: 713006 - protein, 20 aa, Mycobacterium
PWEPWVHALPVEFASAQEVY

SEQ ID NO: 713007 - protein, 18 aa, Mycobacterium
PWFAQAYTRALDWANASQ

SEQ ID NO: 713008 - protein, 29 aa, Mycobacterium
PWFLDAYRRAWDWADSVGWRPLRPGALRR

SEQ ID NO: 713009 - protein, 21 aa, Mycobacterium
PWFLDAYRRAWEWADSTGWRP

SEQ ID NO: 713010 - protein, 25 aa, Mycobacterium
PWFLDAYRRAWQWADTTGWRPAGPR

SEQ ID NO: 713011 - protein, 23 aa, Mycobacterium
PWFSYKRLNGATHFPQLELPARV

SEQ ID NO: 713012 - protein, 20 aa, Mycobacterium
PWFSYVCPGAGHAPHHVFAE

SEQ ID NO: 713013 - protein, 19 aa, Mycobacterium
PWGAFDMSLGKAMYAGFTI

SEQ ID NO: 713014 - protein, 19 aa, Mycobacterium
PWGAFDMSLGKAMYAGFTL

SEQ ID NO: 713015 - protein, 27 aa, Mycobacterium
PWGQLAMPGLHKFRLMELVDVLMAVPP

SEQ ID NO: 713016 - protein, 41 aa, Mycobacterium
PWGREVIGTASGVVRFIGVDGYRWMIRCVVNGPHETIDALT

SEQ ID NO: 713017 - protein, 40 aa, Mycobacterium
PWGREVIGTASGVVRFIGVDGYRWMVRCVVNGPHETIDTL

SEQ ID NO: 713018 - protein, 24 aa, Mycobacterium
PWGSLQRWATTRPKSAIIKRTELL

SEQ ID NO: 713019 - protein, 18 aa, Mycobacterium
PWGSRFPQITIRDQVAAD

SEQ ID NO: 713020 - protein, 18 aa, Mycobacterium
PWGVWGGEILDRGSIVAR

SEQ ID NO: 713021 - protein, 32 aa, Mycobacterium
PWHGLRLTGRSRPDWPSVPTFDDGVLVWARLD

SEQ ID NO: 713022 - protein, 19 aa, Mycobacterium
PWHNWEFDITTGQSVADPT

SEQ ID NO: 713023 - protein, 22 aa, Mycobacterium
PWHRHRDPLARRGAATNQPVRQ

SEQ ID NO: 713024 - protein, 21 aa, Mycobacterium
PWKQLRGAIEAVFASWNSPRA

SEQ ID NO: 713025 - protein, 19 aa, Mycobacterium
PWLADHVVDDACLLPGMAY

SEQ ID NO: 713026 - protein, 19 aa, Mycobacterium
PWLAGYLGPEVMDLNRRIK

SEQ ID NO: 713027 - protein, 18 aa, Mycobacterium
PWLAGYLGPEVMELNRRI

SEQ ID NO: 713028 - protein, 20 aa, Mycobacterium
PWLICVHGAEMGRAALDLML

SEQ ID NO: 713029 - protein, 19 aa, Mycobacterium
PWLLSPAFQRPMLNSPKFA

SEQ ID NO: 713030 - protein, 20 aa, Mycobacterium
PWLPDEVYRDIVANIVEPVA

SEQ ID NO: 713031 - protein, 17 aa, Mycobacterium
PWLPEPVRVAYDDSDKD

SEQ ID NO: 713032 - protein, 19 aa, Mycobacterium
PWLRDLAKRFARWRLSIGR

SEQ ID NO: 713033 - protein, 21 aa, Mycobacterium
PWLRPMEAFTLSIARDTARAV

SEQ ID NO: 713034 - protein, 25 aa, Mycobacterium
PWLSRKRIQQEWGIGDEVMRDLVNI

SEQ ID NO: 713035 - protein, 25 aa, Mycobacterium
PWLSRKRIQQEWGISDEVMRDLVNA

SEQ ID NO: 713036 - protein, 24 aa, Mycobacterium
PWLTDLTGAIGLTGHAWNSNGDGI

SEQ ID NO: 713037 - protein, 20 aa, Mycobacterium
PWLTRKRIQQEWGVSDEVMR

SEQ ID NO: 713038 - protein, 19 aa, Mycobacterium
PWLVCVHGAEMGRAGLDLM

SEQ ID NO: 713039 - protein, 18 aa, Mycobacterium
PWLVCVHGTEMGRAPLDL

SEQ ID NO: 713040 - protein, 21 aa, Mycobacterium
PWMAELIDEFELTKPPAEQAE

SEQ ID NO: 713041 - protein, 25 aa, Mycobacterium
PWNFPMTIAAWGFAPALAAGCAVLL

SEQ ID NO: 713042 - protein, 28 aa, Mycobacterium
PWNPEVLRVCAALELLHTCALIHDDVID

SEQ ID NO: 713043 - protein, 18 aa, Mycobacterium
PWPAAWPPASKGRPYTLL

SEQ ID NO: 713044 - protein, 18 aa, Mycobacterium
PWPARAFLAELAAKHNHY

SEQ ID NO: 713045 - protein, 20 aa, Mycobacterium
PWPDRVDTYLADGITAESVD

SEQ ID NO: 713046 - protein, 18 aa, Mycobacterium
PWPDSRLSQAPTLHLGGT

SEQ ID NO: 713047 - protein, 24 aa, Mycobacterium
PWPREEGRRKFGFYGDDAAAAQWV

SEQ ID NO: 713048 - protein, 19 aa, Mycobacterium
PWPRMSHADRMAKVEQLAA

SEQ ID NO: 713049 - protein, 18 aa, Mycobacterium
PWPTYPLMYRVSAAHEEG

SEQ ID NO: 713050 - protein, 19 aa, Mycobacterium
PWPTYPLMYRVSSAHEEGG

SEQ ID NO: 713051 - protein, 18 aa, Mycobacterium
PWPTYPTLFRVASAHEEG

SEQ ID NO: 713052 - protein, 18 aa, Mycobacterium
PWQAEMEDAFGFTETIDQ

SEQ ID NO: 713053 - protein, 18 aa, Mycobacterium
PWQARYRALGDMVGALDA

SEQ ID NO: 713054 - protein, 23 aa, Mycobacterium
PWQETRPGFFGSDVHVRKEPVGV

SEQ ID NO: 713055 - protein, 18 aa, Mycobacterium
PWRALRVAGVIPAPVRDR

SEQ ID NO: 713056 - protein, 17 aa, Mycobacterium
PWRDRLAAVLADLPDDM

SEQ ID NO: 713057 - protein, 21 aa, Mycobacterium
PWRKLPKRQRNWILFTEEQPT

SEQ ID NO: 713058 - protein, 26 aa, Mycobacterium
PWRNHRNAWRPAHIHFSVFGTAFPQR

SEQ ID NO: 713059 - protein, 23 aa, Mycobacterium
PWRQRAAAVLAELPDDIADYKGI

SEQ ID NO: 713060 - protein, 17 aa, Mycobacterium
PWRRPGVSAWQILVSEF

SEQ ID NO: 713061 - protein, 24 aa, Mycobacterium
PWRRTEERRKFGFYVGFPDDDGPA

SEQ ID NO: 713062 - protein, 27 aa, Mycobacterium
PWSEWLPQQRWYAGRNRELAAAEPGAV

SEQ ID NO: 713063 - protein, 17 aa, Mycobacterium
PWSGFNYYLGDYKSTVA

SEQ ID NO: 713064 - protein, 21 aa, Mycobacterium
PWSPDAMVWPLLAVIDDCLAE

SEQ ID NO: 713065 - protein, 23 aa, Mycobacterium
PWSPEAMTWPLLEVIDTVLDEPW

SEQ ID NO: 713066 - protein, 24 aa, Mycobacterium
PWSQDGRSGIAYRAEAITATDPAT

SEQ ID NO: 713067 - protein, 23 aa, Mycobacterium
PWSQDGRSGIAYRAETITGGADP

SEQ ID NO: 713068 - protein, 18 aa, Mycobacterium
PWTGQVFKVTGGSIQRLK

SEQ ID NO: 713069 - protein, 19 aa, Mycobacterium
PWTLPMRRRNEVAVPIDPA

SEQ ID NO: 713070 - protein, 23 aa, Mycobacterium
PWTMPDPLLPIAVAPRAKTDEDK

SEQ ID NO: 713071 - protein, 24 aa, Mycobacterium
PWTMPEPLLPIAIQAHAKTDEDKL

SEQ ID NO: 713072 - protein, 23 aa, Mycobacterium
PWTMPEPLLPVAIAAHAKTDEDK

SEQ ID NO: 713073 - protein, 23 aa, Mycobacterium
PWTMPEPLLPVAIQAHAKTDEDK

SEQ ID NO: 713074 - protein, 17 aa, Mycobacterium
PWTTKLWVYDLRTNQHF

SEQ ID NO: 713075 - protein, 21 aa, Mycobacterium
PWVPAEPWAPGDLGVPVCDGP

SEQ ID NO: 713076 - protein, 18 aa, Mycobacterium
PWVPDLVHAHDWLVAHPA

SEQ ID NO: 713077 - protein, 28 aa, Mycobacterium
PWVPPKVMAPHLWRFLLYQPVVASAGVP

SEQ ID NO: 713078 - protein, 20 aa, Mycobacterium
PWVRAAALDGAYLGQFALPA

SEQ ID NO: 713079 - protein, 23 aa, Mycobacterium
PWWHPIRLAHQMAYLDIISNGRY

SEQ ID NO: 713080 - protein, 20 aa, Mycobacterium
PWWLKYVNKVMIGLSKVGVG

SEQ ID NO: 713081 - protein, 26 aa, Mycobacterium
PWYPLLRLPVNLARSAAALTLPGGID

SEQ ID NO: 713082 - protein, 28 aa, Mycobacterium
PYAAERLSSVGFPFPDTRVRVVDADGGV

SEQ ID NO: 713083 - protein, 19 aa, Mycobacterium
PYAAMFWHSFRAEIALACG

SEQ ID NO: 713084 - protein, 17 aa, Mycobacterium
PYAARPAYDDTIQAECG

SEQ ID NO: 713085 - protein, 18 aa, Mycobacterium
PYAARVIAIMLGLPEEEW

SEQ ID NO: 713086 - protein, 23 aa, Mycobacterium
PYAEFANLLGLTGIRCDDPAKIG

SEQ ID NO: 713087 - protein, 17 aa, Mycobacterium
PYAEMYWSPAQMLAHTT

SEQ ID NO: 713088 - protein, 21 aa, Mycobacterium
PYAEVFCRAVGGWAADVLDGK

SEQ ID NO: 713089 - protein, 18 aa, Mycobacterium
PYAGFDWDTYLKFWDLVA

SEQ ID NO: 713090 - protein, 25 aa, Mycobacterium
PYAGRSLVLAKLWMRGYRRMLRVRV

SEQ ID NO: 713091 - protein, 17 aa, Mycobacterium
PYAGTWLLSSSVLADHV

SEQ ID NO: 713092 - protein, 24 aa, Mycobacterium
PYAKLLRDIPFRVGAVVQPPAHYA

SEQ ID NO: 713093 - protein, 23 aa, Mycobacterium
PYARLVSGFHCVIDLNSMELLRI

SEQ ID NO: 713094 - protein, 23 aa, Mycobacterium
PYARPPVGPLRFRAPQPAQPWSG

SEQ ID NO: 713095 - protein, 24 aa, Mycobacterium
PYASISIAHGIRRFEFMIHADETD

SEQ ID NO: 713096 - protein, 17 aa, Mycobacterium
PYASWLSAAATQAVAAA

SEQ ID NO: 713097 - protein, 31 aa, Mycobacterium
PYATRQLWRGMKPPARVLAAYAKAIEEQPRI

SEQ ID NO: 713098 - protein, 17 aa, Mycobacterium
PYAVLPASQVVRFIVPR

SEQ ID NO: 713099 - protein, 24 aa, Mycobacterium
PYAVLPASQVVRFIVPRYVQDDPS

SEQ ID NO: 713100 - protein, 29 aa, Mycobacterium
PYCALACAELLYRAGLPRALYAIVPGPGS

SEQ ID NO: 713101 - protein, 30 aa, Mycobacterium
PYCALACAELLYRAGLPRALYAIVPGPGSV

SEQ ID NO: 713102 - protein, 19 aa, Mycobacterium
PYCGLGCIQDRIHRLGVLE

SEQ ID NO: 713103 - protein, 19 aa, Mycobacterium
PYCGSPYSFLPQLCAGDII

SEQ ID NO: 713104 - protein, 18 aa, Mycobacterium
PYCLGGMHHWLANWRLRA

SEQ ID NO: 713105 - protein, 18 aa, Mycobacterium
PYCLTGMHHWLANWQLRA

SEQ ID NO: 713106 - protein, 20 aa, Mycobacterium
PYDEPWGWMQPTRHAYGALL

SEQ ID NO: 713107 - protein, 33 aa, Mycobacterium
PYDLAVKLLPVWRHWISAALPHIRGPRVLEVSF

SEQ ID NO: 713108 - protein, 27 aa, Mycobacterium
PYDLPAAMPGFGWPTAVLSGGRDLTTP

SEQ ID NO: 713109 - protein, 24 aa, Mycobacterium
PYDPHLRPGGVIDVTREMASATRR

SEQ ID NO: 713110 - protein, 22 aa, Mycobacterium
PYEAGDPHLLEWVHIAEIDSFL

SEQ ID NO: 713111 - protein, 18 aa, Mycobacterium
PYEAMKLRLLNAGHQGLC

SEQ ID NO: 713112 - protein, 24 aa, Mycobacterium
PYEDAIALAANWIWERGQEEDLAP

SEQ ID NO: 713113 - protein, 19 aa, Mycobacterium
PYEEPAFDIFTLVPPPAGV

SEQ ID NO: 713114 - protein, 18 aa, Mycobacterium
PYEIRVLGPDGAPAEPGV

SEQ ID NO: 713115 - protein, 27 aa, Mycobacterium
PYENEWGWTWPLNRRVLYNRASADPQG

SEQ ID NO: 713116 - protein, 17 aa, Mycobacterium
PYEPGYRVLDGIRAALG

SEQ ID NO: 713117 - protein, 17 aa, Mycobacterium
PYEPWPGVRDATTPGPT

SEQ ID NO: 713118 - protein, 31 aa, Mycobacterium
PYERSSCFWQRIAYLYSRFDDLIAEASEIGE

SEQ ID NO: 713119 - protein, 33 aa, Mycobacterium
PYERSTCFWQRIAYLYSRFDALIAEADDPDESA

SEQ ID NO: 713120 - protein, 27 aa, Mycobacterium
PYERSTCFWQRIAYLYSRLDELITDTA

SEQ ID NO: 713121 - protein, 18 aa, Mycobacterium
PYESCNLGSINLARMITN

SEQ ID NO: 713122 - protein, 18 aa, Mycobacterium
PYESCNLGSINLARMVGA

SEQ ID NO: 713123 - protein, 18 aa, Mycobacterium
PYESFSTSVQRFIEQAAA

SEQ ID NO: 713124 - protein, 19 aa, Mycobacterium
PYEVELCVAEVAHYGESKP

SEQ ID NO: 713125 - protein, 18 aa, Mycobacterium
PYEVPAIDVLPMAPAPSG

SEQ ID NO: 713126 - protein, 20 aa, Mycobacterium
PYFDDLFLMAADRRHLSVER

SEQ ID NO: 713127 - protein, 21 aa, Mycobacterium
PYFDDLFLMAAEQRFLSVERI

SEQ ID NO: 713128 - protein, 21 aa, Mycobacterium
PYFDDLFLMAAERRFLSVERV

SEQ ID NO: 713129 - protein, 18 aa, Mycobacterium
PYFDHLRSKCPVTQATPF

SEQ ID NO: 713130 - protein, 19 aa, Mycobacterium
PYFDHLRSKCPVVREPHYG

SEQ ID NO: 713131 - protein, 17 aa, Mycobacterium
PYFEAYTIVADVLRDAP

SEQ ID NO: 713132 - protein, 19 aa, Mycobacterium
PYFSLAMLPGGRRLHRRAP

SEQ ID NO: 713133 - protein, 17 aa, Mycobacterium
PYFSLAMLPGGRRRASV

SEQ ID NO: 713134 - protein, 19 aa, Mycobacterium
PYGAAGFAVLERTIAALRA

SEQ ID NO: 713135 - protein, 22 aa, Mycobacterium
PYGAALPWPASGGEGARPAARP

SEQ ID NO: 713136 - protein, 22 aa, Mycobacterium
PYGAALPWPASSAEGARPGRKA

SEQ ID NO: 713137 - protein, 19 aa, Mycobacterium
PYGAITPSVCNLRPTSRGH

SEQ ID NO: 713138 - protein, 25 aa, Mycobacterium
PYGAPFPNNACRVVNAAGQDCPDWV

SEQ ID NO: 713139 - protein, 18 aa, Mycobacterium
PYGEGWLVDLEAASAADL

SEQ ID NO: 713140 - protein, 18 aa, Mycobacterium
PYGGIPLTGDLGDQQAAM

SEQ ID NO: 713141 - protein, 19 aa, Mycobacterium
PYGLAGSNQLAWVSQTAAN

SEQ ID NO: 713142 - protein, 21 aa, Mycobacterium
PYGLAGSRALAWVSQTVSNIV

SEQ ID NO: 713143 - protein, 18 aa, Mycobacterium
PYGLAYSATLIWVSQTAT

SEQ ID NO: 713144 - protein, 18 aa, Mycobacterium
PYGPDGWQLYDLASDPGE

SEQ ID NO: 713145 - protein, 17 aa, Mycobacterium
PYGPFVPALPEASFASC

SEQ ID NO: 713146 - protein, 19 aa, Mycobacterium
PYGPSVPALYGLIAQAWMH

SEQ ID NO: 713147 - protein, 20 aa, Mycobacterium
PYGPSVPALYGLIAQAWMHE

SEQ ID NO: 713148 - protein, 21 aa, Mycobacterium
PYGRFREMRESGCPVAHSEHY

SEQ ID NO: 713149 - protein, 28 aa, Mycobacterium
PYGRGFPFSLVFAGLYAARGYHVVLQSV

SEQ ID NO: 713150 - protein, 17 aa, Mycobacterium
PYGRLWATILQHRFGGS

SEQ ID NO: 713151 - protein, 18 aa, Mycobacterium
PYGTPGWVELLPDSGYWL

SEQ ID NO: 713152 - protein, 19 aa, Mycobacterium
PYGTVLVIGAWNFPFALTL

SEQ ID NO: 713153 - protein, 20 aa, Mycobacterium
PYGVDWSKPVARFEEAMATH

SEQ ID NO: 713154 - protein, 18 aa, Mycobacterium
PYGVDWSKPVARFEEGLA

SEQ ID NO: 713155 - protein, 18 aa, Mycobacterium
PYGVEWTKPVARFVEALA

SEQ ID NO: 713156 - protein, 18 aa, Mycobacterium
PYHAAAFGISDLGTKGGL

SEQ ID NO: 713157 - protein, 17 aa, Mycobacterium
PYHAWTYDNSGRLVGLP

SEQ ID NO: 713158 - protein, 19 aa, Mycobacterium
PYHDAFLLEDARRFRAELD

SEQ ID NO: 713159 - protein, 20 aa, Mycobacterium
PYISGLSLNLAITVQVPETG

SEQ ID NO: 713160 - protein, 17 aa, Mycobacterium
PYIWPFDGDIAIGRTAL

SEQ ID NO: 713161 - protein, 18 aa, Mycobacterium
PYKDRPGQDVLLQSMAGI

SEQ ID NO: 713162 - protein, 26 aa, Mycobacterium
PYKRPRYIELVTEFPLTDTQKIAKAR

SEQ ID NO: 713163 - protein, 20 aa, Mycobacterium
PYKRVLADLIAKGVHIELCG

SEQ ID NO: 713164 - protein, 20 aa, Mycobacterium
PYLADACTTAIMADDPVMDD

SEQ ID NO: 713165 - protein, 18 aa, Mycobacterium
PYLAPALGRDNLTVITAA

SEQ ID NO: 713166 - protein, 17 aa, Mycobacterium
PYLARGAADLVPTAQLL

SEQ ID NO: 713167 - protein, 17 aa, Mycobacterium
PYLDPFLGTGTRRRYDT

SEQ ID NO: 713168 - protein, 20 aa, Mycobacterium
PYLDTVLFILGITRGEIEAA

SEQ ID NO: 713169 - protein, 19 aa, Mycobacterium
PYLDTVLFLLGVTRGEIEA

SEQ ID NO: 713170 - protein, 26 aa, Mycobacterium
PYLELTPDPWLVAVFREEMESFGRTP

SEQ ID NO: 713171 - protein, 23 aa, Mycobacterium
PYLGEKICAAIVFNGPELSLAEL

SEQ ID NO: 713172 - protein, 23 aa, Mycobacterium
PYLHLPAELIGGGTREIQLNIIA

SEQ ID NO: 713173 - protein, 17 aa, Mycobacterium
PYLIAVHDVTAEWADAE

SEQ ID NO: 713174 - protein, 27 aa, Mycobacterium
PYLKGTNYVNSWKRLGFTDSDVADPGS

SEQ ID NO: 713175 - protein, 23 aa, Mycobacterium
PYLLHRHPQFWPNPEGFDPDRFL

SEQ ID NO: 713176 - protein, 17 aa, Mycobacterium
PYLPLLRYRTGDSARLV

SEQ ID NO: 713177 - protein, 18 aa, Mycobacterium
PYLPSHPQYDLAKRQMSG

SEQ ID NO: 713178 - protein, 28 aa, Mycobacterium
PYLQRACAWAACGRSAFNAGDIPELAHR

SEQ ID NO: 713179 - protein, 28 aa, Mycobacterium
PYLQRACDWAVCGRAAFNAREIPEIAER

SEQ ID NO: 713180 - protein, 19 aa, Mycobacterium
PYLRDVFRGAPGEFDCMSD

SEQ ID NO: 713181 - protein, 19 aa, Mycobacterium
PYLTLRLTGVAAITVDVQR

SEQ ID NO: 713182 - protein, 17 aa, Mycobacterium
PYLVPLIDREMLRPTYV

SEQ ID NO: 713183 - protein, 22 aa, Mycobacterium
PYLYLRHRRPYLLPAGGSSPLG

SEQ ID NO: 713184 - protein, 17 aa, Mycobacterium
PYMTGFPGRSLLSAGRR

SEQ ID NO: 713185 - protein, 19 aa, Mycobacterium
PYNLLGWSFGGVVAHDVAV

SEQ ID NO: 713186 - protein, 20 aa, Mycobacterium
PYNLLGWSFGGVVAHEVAIE

SEQ ID NO: 713187 - protein, 19 aa, Mycobacterium
PYNPGHLMVVPYRRVSELE

SEQ ID NO: 713188 - protein, 29 aa, Mycobacterium
PYNRKSRFPHRWWWVVLTEEPFPRFSVVR

SEQ ID NO: 713189 - protein, 20 aa, Mycobacterium
PYPAGHSGLLYRIARHGLVV

SEQ ID NO: 713190 - protein, 24 aa, Mycobacterium
PYPDRSGGVLPGYGGSKAALEHLT

SEQ ID NO: 713191 - protein, 21 aa, Mycobacterium
PYPEASRVLLRDSVLDAMREL

SEQ ID NO: 713192 - protein, 22 aa, Mycobacterium
PYPELSTGMLLRPVKPPPSEGW

SEQ ID NO: 713193 - protein, 18 aa, Mycobacterium
PYPELSTGMLLRPVQPPP

SEQ ID NO: 713194 - protein, 24 aa, Mycobacterium
PYPIIRKLFSTFGIDTMAKEALDK

SEQ ID NO: 713195 - protein, 22 aa, Mycobacterium
PYPLCARLRDHGPLHLPEANFV

SEQ ID NO: 713196 - protein, 19 aa, Mycobacterium
PYPLYARIRAQGPVQLPAN

SEQ ID NO: 713197 - protein, 22 aa, Mycobacterium
PYPMFRRLRDEAPLYYNAQHDF

SEQ ID NO: 713198 - protein, 19 aa, Mycobacterium
PYPMPLDDCEAGLRFLFEH

SEQ ID NO: 713199 - protein, 19 aa, Mycobacterium
PYPPIMCALIGAPREDWQK

SEQ ID NO: 713200 - protein, 21 aa, Mycobacterium
PYPRARITLWPDEPGPEVSPA

SEQ ID NO: 713201 - protein, 18 aa, Mycobacterium
PYPTELRELLAATLPPAS

SEQ ID NO: 713202 - protein, 19 aa, Mycobacterium
PYPTYRRLRDESPLYYNER

SEQ ID NO: 713203 - protein, 19 aa, Mycobacterium
PYPVPIICALLGAPREDWQ

SEQ ID NO: 713204 - protein, 21 aa, Mycobacterium
PYPVWKRMRDEAPLYYNEKYN

SEQ ID NO: 713205 - protein, 18 aa, Mycobacterium
PYPYFARKRSEGGVFHGT

SEQ ID NO: 713206 - protein, 22 aa, Mycobacterium
PYPYFKELRRTPVAKVADKTYV

SEQ ID NO: 713207 - protein, 20 aa, Mycobacterium
PYQADGFSWLATLYAHGLGG

SEQ ID NO: 713208 - protein, 19 aa, Mycobacterium
PYQEWLDAGLFQLDELPPG

SEQ ID NO: 713209 - protein, 24 aa, Mycobacterium
PYQGFQLGSLWYISLDYINHQTSL

SEQ ID NO: 713210 - protein, 19 aa, Mycobacterium
PYQGFQLGSMWYVSLDYIN

SEQ ID NO: 713211 - protein, 18 aa, Mycobacterium
PYQIGAEPERTDWKKRMI

SEQ ID NO: 713212 - protein, 18 aa, Mycobacterium
PYQRLAFTYPMPRTPDLD

SEQ ID NO: 713213 - protein, 26 aa, Mycobacterium
PYQYRVSPRYEIPCTVTGTVSADGHT

SEQ ID NO: 713214 - protein, 18 aa, Mycobacterium
PYRAAMEQGLIYTRLGNP

SEQ ID NO: 713215 - protein, 19 aa, Mycobacterium
PYRASRSAFAFKDTLSAGI

SEQ ID NO: 713216 - protein, 23 aa, Mycobacterium
PYRDEAIPAPRGHKVPKPGDTGG

SEQ ID NO: 713217 - protein, 19 aa, Mycobacterium
PYRDWLCATDPDLSEEIDG

SEQ ID NO: 713218 - protein, 25 aa, Mycobacterium
PYRGLKKLRAAGVLGAGRTVAVTGI

SEQ ID NO: 713219 - protein, 23 aa, Mycobacterium
PYRGVEAAQRLATRRNRLLAAGL

SEQ ID NO: 713220 - protein, 18 aa, Mycobacterium
PYRKLGRNQLRIGMFPAV

SEQ ID NO: 713221 - protein, 22 aa, Mycobacterium
PYRLDLPPDFVWVEADLPKLLA

SEQ ID NO: 713222 - protein, 26 aa, Mycobacterium
PYRLGIPGMYICSAATPPGPGAHGMC

SEQ ID NO: 713223 - protein, 25 aa, Mycobacterium
PYRLSDGPSLLTSWDRSIPASDVTL

SEQ ID NO: 713224 - protein, 20 aa, Mycobacterium
PYRQARQCCGRSRFANAALR

SEQ ID NO: 713225 - protein, 18 aa, Mycobacterium
PYRQRPTPIPTLEQAISA

SEQ ID NO: 713226 - protein, 21 aa, Mycobacterium
PYRRYLTWLADRDVPAARAAW

SEQ ID NO: 713227 - protein, 23 aa, Mycobacterium
PYRVFTPFFRRWSELGWPSPART

SEQ ID NO: 713228 - protein, 18 aa, Mycobacterium
PYRYRVTSRYEIPCTVSG

SEQ ID NO: 713229 - protein, 29 aa, Mycobacterium
PYSCREGACSACACTVRRGEVRMLRNDTL

SEQ ID NO: 713230 - protein, 20 aa, Mycobacterium
PYSEFPRFHQLMAEESGAMY

SEQ ID NO: 713231 - protein, 21 aa, Mycobacterium
PYSEYPRFHRLMAEQSGEVFD

SEQ ID NO: 713232 - protein, 20 aa, Mycobacterium
PYSPLGRGWLTGRVQSRDNI

SEQ ID NO: 713233 - protein, 18 aa, Mycobacterium
PYSPPEHAFKMVPSSLGI

SEQ ID NO: 713234 - protein, 25 aa, Mycobacterium
PYSPVGSALLCRWNDGDDGLGPVRW

SEQ ID NO: 713235 - protein, 26 aa, Mycobacterium
PYSVCLPSTFRPGRALPLTLLLHSLA

SEQ ID NO: 713236 - protein, 24 aa, Mycobacterium
PYSVLVAAFMVWIASYGRQRDMVV

SEQ ID NO: 713237 - protein, 21 aa, Mycobacterium
PYTDANWRGFFTLTGLTDLLT

SEQ ID NO: 713238 - protein, 23 aa, Mycobacterium
PYTFESRPDFALRKRVAAEAARL

SEQ ID NO: 713239 - protein, 18 aa, Mycobacterium
PYTGAPMKQVHQGRGITM

SEQ ID NO: 713240 - protein, 18 aa, Mycobacterium
PYTILAIGPPRSMRDVFD

SEQ ID NO: 713241 - protein, 19 aa, Mycobacterium
PYTIVRATPFYEFAVGLAD

SEQ ID NO: 713242 - protein, 19 aa, Mycobacterium
PYTYLRPGTVLGDDGKLGA

SEQ ID NO: 713243 - protein, 17 aa, Mycobacterium
PYVAYGFQTQVDDTEVT

SEQ ID NO: 713244 - protein, 18 aa, Mycobacterium
PYVERLRLAIAGHPAPDS

SEQ ID NO: 713245 - protein, 26 aa, Mycobacterium
PYVGDWAGALAREWAAETPDVVHAYG

SEQ ID NO: 713246 - protein, 23 aa, Mycobacterium
PYVGRLSLVRVFSGTIRPDTTVH

SEQ ID NO: 713247 - protein, 25 aa, Mycobacterium
PYVINPRMVRGLDYYTKTTFEFVHD

SEQ ID NO: 713248 - protein, 17 aa, Mycobacterium
PYVIYSQILAATRNVIV

SEQ ID NO: 713249 - protein, 23 aa, Mycobacterium
PYVLKAAYWMAARSGIEGDGVDL

SEQ ID NO: 713250 - protein, 18 aa, Mycobacterium
PYVLKLAGRGWRDACRAD

SEQ ID NO: 713251 - protein, 20 aa, Mycobacterium
PYVRGDCLVAFDAPLVVTNP

SEQ ID NO: 713252 - protein, 24 aa, Mycobacterium
PYVRRRGEYLYNFWRDATNSRGLW

SEQ ID NO: 713253 - protein, 21 aa, Mycobacterium
PYVVRRGEYLYNFWRDAANPR

SEQ ID NO: 713254 - protein, 26 aa, Mycobacterium
PYYAKCVELGIPLSIHTSANWTRTRP

SEQ ID NO: 713255 - protein, 18 aa, Mycobacterium
PYYEALRQRCPVTRESHH

SEQ ID NO: 713256 - protein, 18 aa, Mycobacterium
PYYEALRRQCPVTREGHH

SEQ ID NO: 713257 - protein, 19 aa, Mycobacterium
PYYHYRVVIDGDPGTELIL

SEQ ID NO: 713258 - protein, 17 aa, Mycobacterium
PYYQRLRDEAPLYRNDE

SEQ ID NO: 713259 - protein, 18 aa, Mycobacterium
PYYVCVLAALGRLPDLVH

SEQ ID NO: 713260 - protein, 27 aa, Mycobacterium
QAAAAGEPWGSIARNILKYSPDQIAQV

SEQ ID NO: 713261 - protein, 19 aa, Mycobacterium
QAAAASWAQPVEMLGAMMP

SEQ ID NO: 713262 - protein, 20 aa, Mycobacterium
QAAADTPFFVWMNMTHMHLR

SEQ ID NO: 713263 - protein, 19 aa, Mycobacterium
QAAADWVRRHRKPAFLHLS

SEQ ID NO: 713264 - protein, 26 aa, Mycobacterium
QAAAERCGRIALPRRAHVSVLTGSEP

SEQ ID NO: 713265 - protein, 23 aa, Mycobacterium
QAAAEWFARILFSLFSTPSPIRD

SEQ ID NO: 713266 - protein, 21 aa, Mycobacterium
QAAAIHEMFVNTLSMSSGSYA

SEQ ID NO: 713267 - protein, 17 aa, Mycobacterium
QAAALARSTVFTEETLE

SEQ ID NO: 713268 - protein, 17 aa, Mycobacterium
QAAALTRHHRLVTRALE

SEQ ID NO: 713269 - protein, 25 aa, Mycobacterium
QAAAQRLPFLPIRAGLGSDVRSFWG

SEQ ID NO: 713270 - protein, 25 aa, Mycobacterium
QAAAQRLPFLPIRAGLGSSVPDFWE

SEQ ID NO: 713271 - protein, 17 aa, Mycobacterium
QAAARFGERDALYADGS

SEQ ID NO: 713272 - protein, 19 aa, Mycobacterium
QAAAVGQTFGRPLATMRDY

SEQ ID NO: 713273 - protein, 23 aa, Mycobacterium
QAACSFCELTIVVQFGTMPYEQA

SEQ ID NO: 713274 - protein, 24 aa, Mycobacterium
QAADAAGFDAVWASEFYSRSGSIS

SEQ ID NO: 713275 - protein, 25 aa, Mycobacterium
QAADLLERVSILLAPFDADEWESPS

SEQ ID NO: 713276 - protein, 18 aa, Mycobacterium
QAADMLAGALLFETADED

SEQ ID NO: 713277 - protein, 17 aa, Mycobacterium
QAAELFADHVGRAPDVS

SEQ ID NO: 713278 - protein, 17 aa, Mycobacterium
QAAELKVPAALAVDSVR

SEQ ID NO: 713279 - protein, 18 aa, Mycobacterium
QAAELKVPAALAVDSVRY

SEQ ID NO: 713280 - protein, 22 aa, Mycobacterium
QAAESIGGLGIVTDVRDGGQVD

SEQ ID NO: 713281 - protein, 20 aa, Mycobacterium
QAAESLHFDLNVVIEGDDGE

SEQ ID NO: 713282 - protein, 19 aa, Mycobacterium
QAAETFAILNIAKAGDHIV

SEQ ID NO: 713283 - protein, 22 aa, Mycobacterium
QAAETFAILNLACAGDHIVSSP

SEQ ID NO: 713284 - protein, 18 aa, Mycobacterium
QAAFKPTRPRVMSVAGRA

SEQ ID NO: 713285 - protein, 22 aa, Mycobacterium
QAAGALNLFGLRANAFDDEAET

SEQ ID NO: 713286 - protein, 22 aa, Mycobacterium
QAAGIARRTLFRYYASKNAIPW

SEQ ID NO: 713287 - protein, 25 aa, Mycobacterium
QAAGSMPIFALYGIPHRDCGSYASG

SEQ ID NO: 713288 - protein, 21 aa, Mycobacterium
QAAGVPVAFLTAWYGLSDLAG

SEQ ID NO: 713289 - protein, 18 aa, Mycobacterium
QAAGWLARLCDVHTIVVV

SEQ ID NO: 713290 - protein, 23 aa, Mycobacterium
QAAHACGDPGLVFLDTINRANPV

SEQ ID NO: 713291 - protein, 19 aa, Mycobacterium
QAAHGCELVLVLGGDGTFL

SEQ ID NO: 713292 - protein, 18 aa, Mycobacterium
QAAHVWTRTTLRPADVDV

SEQ ID NO: 713293 - protein, 19 aa, Mycobacterium
QAAIWCFTNGMALDTRPLN

SEQ ID NO: 713294 - protein, 23 aa, Mycobacterium
QAAKLGAWGIIASVQPNFDALWG

SEQ ID NO: 713295 - protein, 22 aa, Mycobacterium
QAALFHQQFVQLMSGGAGQYAA

SEQ ID NO: 713296 - protein, 22 aa, Mycobacterium
QAALKDGFRVFGELAPHPLLTH

SEQ ID NO: 713297 - protein, 22 aa, Mycobacterium
QAALKDGFRVFGELSPHPLLTH

SEQ ID NO: 713298 - protein, 20 aa, Mycobacterium
QAALKMAVNAGARVIATTRK

SEQ ID NO: 713299 - protein, 25 aa, Mycobacterium
QAALLARALGDWIGGRGRLVTFSVQ

SEQ ID NO: 713300 - protein, 24 aa, Mycobacterium
QAALRRLAVLIARDTPPSDVFTAV

SEQ ID NO: 713301 - protein, 21 aa, Mycobacterium
QAANMAVLWHLPVVIVVESVP

SEQ ID NO: 713302 - protein, 18 aa, Mycobacterium
QAANSSISRGFVKTLSTA

SEQ ID NO: 713303 - protein, 20 aa, Mycobacterium
QAAPAMRLVSSLLPTNLAAA

SEQ ID NO: 713304 - protein, 20 aa, Mycobacterium
QAAPAMRLVSSVLSTNLAAA

SEQ ID NO: 713305 - protein, 19 aa, Mycobacterium
QAAPGMLYPGVPGLASAAR

SEQ ID NO: 713306 - protein, 22 aa, Mycobacterium
QAAPRRPVIRPVPVDDSGFDVQ

SEQ ID NO: 713307 - protein, 19 aa, Mycobacterium
QAAQFHDQFVAAMTSAAGA

SEQ ID NO: 713308 - protein, 30 aa, Mycobacterium
QAAQMLPPKGRRWLNKKLGLDNVFLEFDTA

SEQ ID NO: 713309 - protein, 23 aa, Mycobacterium
QAAQYPRIRVFRGGDQGTEERRR

SEQ ID NO: 713310 - protein, 22 aa, Mycobacterium
QAARIWLLQAMTGRRASEILML

SEQ ID NO: 713311 - protein, 24 aa, Mycobacterium
QAARKLFAERGFHGTTLADITSAA

SEQ ID NO: 713312 - protein, 24 aa, Mycobacterium
QAARKLFAERGFHGTTVADITSAA

SEQ ID NO: 713313 - protein, 17 aa, Mycobacterium
QAARLGQWGVIASVQPN

SEQ ID NO: 713314 - protein, 24 aa, Mycobacterium
QAARPRLGALAYRMLGSLADAEDV

SEQ ID NO: 713315 - protein, 26 aa, Mycobacterium
QAARRCLDRSGLDPAELGLVIYAGVY

SEQ ID NO: 713316 - protein, 31 aa, Mycobacterium
QAARRDTSQWGWTWPLNRRVLYNRASADPRG

SEQ ID NO: 713317 - protein, 26 aa, Mycobacterium
QAARRGGEWLDWFDAEGIAGVGMGMI

SEQ ID NO: 713318 - protein, 24 aa, Mycobacterium
QAASLRPEIRAMRIQQLRNEIEQI

SEQ ID NO: 713319 - protein, 30 aa, Mycobacterium
QAATDWQDFLAFRGRELCPGGRLVVLTMAL

SEQ ID NO: 713320 - protein, 22 aa, Mycobacterium
QAATFQQRFVQALTAGASAYAG

SEQ ID NO: 713321 - protein, 26 aa, Mycobacterium
QAATHGRFQLGLGLGAPVIEGPSYGL

SEQ ID NO: 713322 - protein, 21 aa, Mycobacterium
QAAVACWKLGAVPQPLSARLP

SEQ ID NO: 713323 - protein, 19 aa, Mycobacterium
QAAVWARENIDGVLPDRLE

SEQ ID NO: 713324 - protein, 31 aa, Mycobacterium
QAAYACASAWLDALVTWRRASGLPAAVINWG

SEQ ID NO: 713325 - protein, 28 aa, Mycobacterium
QAAYMLACSILERIAFRLAPNAGPTTKV

SEQ ID NO: 713326 - protein, 22 aa, Mycobacterium
QACAANTRMLVHRSLFDEAVAN

SEQ ID NO: 713327 - protein, 20 aa, Mycobacterium
QACEGMCGAEFLSGDKSRVL

SEQ ID NO: 713328 - protein, 17 aa, Mycobacterium
QACGVCHTDLTYREGGI

SEQ ID NO: 713329 - protein, 27 aa, Mycobacterium
QADAALLRGVWWPALHATRKVPPHRQR

SEQ ID NO: 713330 - protein, 24 aa, Mycobacterium
QADARLCPLEMWDALVEVTGRIDV

SEQ ID NO: 713331 - protein, 36 aa, Mycobacterium
QADAYRAISLLLRRPPGREAFPGDVFYLHSRLLERC

SEQ ID NO: 713332 - protein, 27 aa, Mycobacterium
QADEFTCSSCFLVHHRSRLASEKNGMM

SEQ ID NO: 713333 - protein, 27 aa, Mycobacterium
QADEFTCSSCFLVHHRSRLASEKNGQL

SEQ ID NO: 713334 - protein, 28 aa, Mycobacterium
QADEFTCSSCFLVHHRSRLASEKNGVMI

SEQ ID NO: 713335 - protein, 27 aa, Mycobacterium
QADEFTCSSCFLVQHRSRLASEKNGLM

SEQ ID NO: 713336 - protein, 27 aa, Mycobacterium
QADEFTCSSCFLVQHRSRLASEKNGVM

SEQ ID NO: 713337 - protein, 28 aa, Mycobacterium
QADEFTCSSCFLVQHRSRLASEKNGVMI

SEQ ID NO: 713338 - protein, 20 aa, Mycobacterium
QADFGWRVIDAGGWPASRLD

SEQ ID NO: 713339 - protein, 32 aa, Mycobacterium
QADFWFDPLCPWCWITSRWILEVEKVRDIEVH

SEQ ID NO: 713340 - protein, 17 aa, Mycobacterium
QADGLGGLDIVVNNAGI

SEQ ID NO: 713341 - protein, 26 aa, Mycobacterium
QADLDYWRPLMADLPEPLELPGPNGS

SEQ ID NO: 713342 - protein, 25 aa, Mycobacterium
QADLPGFRPPTAIGHTGELLSMRIG

SEQ ID NO: 713343 - protein, 30 aa, Mycobacterium
QADLPRLADRLDLPAGWSYQPRVLTEELRV

SEQ ID NO: 713344 - protein, 24 aa, Mycobacterium
QADLRDARLRLAADDLVSRRADFD

SEQ ID NO: 713345 - protein, 23 aa, Mycobacterium
QADNCKLVSWPIATLAPNGIRTA

SEQ ID NO: 713346 - protein, 23 aa, Mycobacterium
QADPEQAASMWASYFPDTEAGLD

SEQ ID NO: 713347 - protein, 24 aa, Mycobacterium
QADRFWADFCTRLGRTDLIEDERF

SEQ ID NO: 713348 - protein, 27 aa, Mycobacterium
QADRHWPALCRVVGRPEWLADPRYGDA

SEQ ID NO: 713349 - protein, 23 aa, Mycobacterium
QADRSKWRLVGPMHLAETREQAE

SEQ ID NO: 713350 - protein, 17 aa, Mycobacterium
QADSHWTSDGIAVGSAT

SEQ ID NO: 713351 - protein, 24 aa, Mycobacterium
QAEAAYRRGLSWSDAADTIDLGEY

SEQ ID NO: 713352 - protein, 27 aa, Mycobacterium
QAEEVKHHLTVLWADFFTPEHFEQFPN

SEQ ID NO: 713353 - protein, 21 aa, Mycobacterium
QAEGGAFYGPRGFYEAAGGGV

SEQ ID NO: 713354 - protein, 18 aa, Mycobacterium
QAEGGWAGIAWPTEYGGK

SEQ ID NO: 713355 - protein, 21 aa, Mycobacterium
QAEGLGQLYIRLLTDNFEEAV

SEQ ID NO: 713356 - protein, 23 aa, Mycobacterium
QAEIARWPRGVPVRLHPRMQALT

SEQ ID NO: 713357 - protein, 24 aa, Mycobacterium
QAEIKRPGTDVSLISYGRSVHDAL

SEQ ID NO: 713358 - protein, 19 aa, Mycobacterium
QAELAWMFLQSMCEGGDLD

SEQ ID NO: 713359 - protein, 18 aa, Mycobacterium
QAELAWMFMQSMCEGGDL

SEQ ID NO: 713360 - protein, 26 aa, Mycobacterium
QAELVGRMSVPQSWGVATAVANHAGA

SEQ ID NO: 713361 - protein, 20 aa, Mycobacterium
QAEPLCVLMLPGAEAEVAAV

SEQ ID NO: 713362 - protein, 25 aa, Mycobacterium
QAERAEEFLARWGLGESEGNPPQGT

SEQ ID NO: 713363 - protein, 25 aa, Mycobacterium
QAESIRKFCILPVDFTVLTGELTPT

SEQ ID NO: 713364 - protein, 25 aa, Mycobacterium
QAESIRRFRILPVDFTVLTGELTPT

SEQ ID NO: 713365 - protein, 17 aa, Mycobacterium
QAESLWAELSRSLPAPW

SEQ ID NO: 713366 - protein, 24 aa, Mycobacterium
QAETFPGLRLLVLNDRLAESLGLD

SEQ ID NO: 713367 - protein, 19 aa, Mycobacterium
QAFAADMAFLRNCGIHPVV

SEQ ID NO: 713368 - protein, 25 aa, Mycobacterium
QAFATMGCLYPGRIFLGVGTGEALN

SEQ ID NO: 713369 - protein, 27 aa, Mycobacterium
QAFDGLRLAGRPVRRPDLTIATEDHNV

SEQ ID NO: 713370 - protein, 28 aa, Mycobacterium
QAFDGLRLAGRPVRRPDLTIATEDHNVP

SEQ ID NO: 713371 - protein, 27 aa, Mycobacterium
QAFDGLRLAGRPVRRPDLTLATEDHNV

SEQ ID NO: 713372 - protein, 17 aa, Mycobacterium
QAFEHIAAAATLRRPVT

SEQ ID NO: 713373 - protein, 25 aa, Mycobacterium
QAFGAGRRADGHWVLPELSTELASP

SEQ ID NO: 713374 - protein, 24 aa, Mycobacterium
QAFGLRMLDRFDVDWVQYGYDDAA

SEQ ID NO: 713375 - protein, 23 aa, Mycobacterium
QAFMVDEGWLPQSYLPDTYPYVA

SEQ ID NO: 713376 - protein, 17 aa, Mycobacterium
QAFPDAHCELDFTTPLE

SEQ ID NO: 713377 - protein, 22 aa, Mycobacterium
QAFRDIEFHPAILRDVSQVTAG

SEQ ID NO: 713378 - protein, 17 aa, Mycobacterium
QAFRHDIEYRIAHHADL

SEQ ID NO: 713379 - protein, 34 aa, Mycobacterium
QAFRYAQLRLAPARLTHCMRWLGAASRAQDIAVD

SEQ ID NO: 713380 - protein, 22 aa, Mycobacterium
QAFTFAGGKLGYMIAAPNIINT

SEQ ID NO: 713381 - protein, 18 aa, Mycobacterium
QAFVEWRGQTRSELTEVG

SEQ ID NO: 713382 - protein, 17 aa, Mycobacterium
QAFVLGRALALQFHPEV

SEQ ID NO: 713383 - protein, 20 aa, Mycobacterium
QAGAARFIGFFATRTRFGLC

SEQ ID NO: 713384 - protein, 19 aa, Mycobacterium
QAGAIAFASPLSYPLVADQ

SEQ ID NO: 713385 - protein, 17 aa, Mycobacterium
QAGALDFIPAKRVGTAE

SEQ ID NO: 713386 - protein, 17 aa, Mycobacterium
QAGALEFIPAKRVGTAE

SEQ ID NO: 713387 - protein, 23 aa, Mycobacterium
QAGATRLRTDWDRIRELAAERGR

SEQ ID NO: 713388 - protein, 17 aa, Mycobacterium
QAGAYLQALAMTPSLPE

SEQ ID NO: 713389 - protein, 24 aa, Mycobacterium
QAGDAEAAFAHFGRRFDDLNTEIT

SEQ ID NO: 713390 - protein, 24 aa, Mycobacterium
QAGDAEAAFAHFGRRFDDLSTEVT

SEQ ID NO: 713391 - protein, 24 aa, Mycobacterium
QAGDLNLPLSYRFDPGSSDDGVTV

SEQ ID NO: 713392 - protein, 19 aa, Mycobacterium
QAGDRVALLSATRYEWPIL

SEQ ID NO: 713393 - protein, 24 aa, Mycobacterium
QAGEIYFEGGYSFEYLNDPSKTAA

SEQ ID NO: 713394 - protein, 24 aa, Mycobacterium
QAGEIYFEGGYSFEYLNDPTKTAA

SEQ ID NO: 713395 - protein, 24 aa, Mycobacterium
QAGEIYFEGGYSFEYLNDPTKTAS

SEQ ID NO: 713396 - protein, 26 aa, Mycobacterium
QAGGAGGSAGLWGAGGAGGAGGSATT

SEQ ID NO: 713397 - protein, 24 aa, Mycobacterium
QAGGKRFRPLFTVLSAQLGPEPDA

SEQ ID NO: 713398 - protein, 18 aa, Mycobacterium
QAGIKATHGHVWKLQNEF

SEQ ID NO: 713399 - protein, 25 aa, Mycobacterium
QAGKDYLIFPALSLRRWRRTLTANA

SEQ ID NO: 713400 - protein, 24 aa, Mycobacterium
QAGLAMLAPIWGYKPLLDTDDATA

SEQ ID NO: 713401 - protein, 24 aa, Mycobacterium
QAGLAMLAPIWGYKPLLDTDDGTA

SEQ ID NO: 713402 - protein, 20 aa, Mycobacterium
QAGLVGTNWFGQNTPGIIAL

SEQ ID NO: 713403 - protein, 25 aa, Mycobacterium
QAGMYRTGPAWAFQHSGIEPDMMVI

SEQ ID NO: 713404 - protein, 26 aa, Mycobacterium
QAGNIARLSWLAAGFPEEVPGVTVDR

SEQ ID NO: 713405 - protein, 17 aa, Mycobacterium
QAGNIGRNAWLAAGYPE

SEQ ID NO: 713406 - protein, 22 aa, Mycobacterium
QAGNMPAALTVLVDAPAVIADG

SEQ ID NO: 713407 - protein, 18 aa, Mycobacterium
QAGNTGFFNSGFTNTGLF

SEQ ID NO: 713408 - protein, 21 aa, Mycobacterium
QAGPHPLRGYGLAARSLLAAR

SEQ ID NO: 713409 - protein, 18 aa, Mycobacterium
QAGQEFLRTWSYPDYLAA

SEQ ID NO: 713410 - protein, 25 aa, Mycobacterium
QAGRGRPAKRFRLTAAGRAKLNHAY

SEQ ID NO: 713411 - protein, 24 aa, Mycobacterium
QAGRGRPAKRYRLTAGGRAKLDHA

SEQ ID NO: 713412 - protein, 22 aa, Mycobacterium
QAGRLAEHMRFLGQVDDAGKAS

SEQ ID NO: 713413 - protein, 17 aa, Mycobacterium
QAGSSPRGVRFAAENAE

SEQ ID NO: 713414 - protein, 17 aa, Mycobacterium
QAGSVQVNCQLVFDHDV

SEQ ID NO: 713415 - protein, 27 aa, Mycobacterium
QAGTAGKGGLFGGSGSAGKAGATGAAG

SEQ ID NO: 713416 - protein, 18 aa, Mycobacterium
QAGTSLWSGAMQMGASAV

SEQ ID NO: 713417 - protein, 24 aa, Mycobacterium
QAGTWLRDYFHGLIDKRRSRPGED

SEQ ID NO: 713418 - protein, 24 aa, Mycobacterium
QAGVEGFALFMTWLAHARSSVDDA

SEQ ID NO: 713419 - protein, 24 aa, Mycobacterium
QAGVSRPTLYRWFADKQALLEAFG

SEQ ID NO: 713420 - protein, 25 aa, Mycobacterium
QAGVSRPTLYRWFASKEELLATFSR

SEQ ID NO: 713421 - protein, 26 aa, Mycobacterium
QAGVSRPTLYRWFASKEELLSAFSSY

SEQ ID NO: 713422 - protein, 24 aa, Mycobacterium
QAGVSRPTLYRWFSSKQDLLDAFV

SEQ ID NO: 713423 - protein, 17 aa, Mycobacterium
QAGVWRGPSADAFVAAY

SEQ ID NO: 713424 - protein, 18 aa, Mycobacterium
QAHAEWDKSFEAWAAREP

SEQ ID NO: 713425 - protein, 27 aa, Mycobacterium
QAHIPGRARISAALAHIDKAAFTRADV

SEQ ID NO: 713426 - protein, 24 aa, Mycobacterium
QAHLASLLGKLSCDELDALTKALA

SEQ ID NO: 713427 - protein, 18 aa, Mycobacterium
QAHLEWFSQKQVDWIHRL

SEQ ID NO: 713428 - protein, 17 aa, Mycobacterium
QAHLLDCLVDAQLRDPQ

SEQ ID NO: 713429 - protein, 17 aa, Mycobacterium
QAHLPYLVYLRHPTTGG

SEQ ID NO: 713430 - protein, 19 aa, Mycobacterium
QAHLTRLPGWAAHVRWSAE

SEQ ID NO: 713431 - protein, 24 aa, Mycobacterium
QAHPGRFILGIGAGHPEIDSGVAY

SEQ ID NO: 713432 - protein, 28 aa, Mycobacterium
QAIAFKIARMEARAHAARTAYYDAAALM

SEQ ID NO: 713433 - protein, 19 aa, Mycobacterium
QAIAFKIARMEARAHTARA

SEQ ID NO: 713434 - protein, 23 aa, Mycobacterium
QAIEDHLRYSLGRPAALLEPKHY

SEQ ID NO: 713435 - protein, 17 aa, Mycobacterium
QAIEMSDMLLGKQGIDP

SEQ ID NO: 713436 - protein, 25 aa, Mycobacterium
QAIGHLPQGLGIIGLLIDEPKPLRL

SEQ ID NO: 713437 - protein, 23 aa, Mycobacterium
QAIIARLAKAYLRTQVRDPWLRR

SEQ ID NO: 713438 - protein, 24 aa, Mycobacterium
QAIKACPPGRVDVIANYTAFLNLN

SEQ ID NO: 713439 - protein, 24 aa, Mycobacterium
QAIKEAGWWRLMLAEEIGGMAAPP

SEQ ID NO: 713440 - protein, 18 aa, Mycobacterium
QAILGRPLIGDGADGITN

SEQ ID NO: 713441 - protein, 17 aa, Mycobacterium
QAILKVRSHYGIATSRQ

SEQ ID NO: 713442 - protein, 17 aa, Mycobacterium
QAILRYGENPHQQAALY

SEQ ID NO: 713443 - protein, 20 aa, Mycobacterium
QAIPLPRHHLDAVAVIESRR

SEQ ID NO: 713444 - protein, 20 aa, Mycobacterium
QAIPNICLQMLLRGRNTVGY

SEQ ID NO: 713445 - protein, 22 aa, Mycobacterium
QAIRAGMSLGIMGDLAVGVHPN

SEQ ID NO: 713446 - protein, 18 aa, Mycobacterium
QAIREMKKKGLPINPNSV

SEQ ID NO: 713447 - protein, 18 aa, Mycobacterium
QAIRRRAFTRALRITGSP

SEQ ID NO: 713448 - protein, 21 aa, Mycobacterium
QAKALAAGRAWGQRLEAPATD

SEQ ID NO: 713449 - protein, 21 aa, Mycobacterium
QAKIDHVLAMEVLYNNMDAYN

SEQ ID NO: 713450 - protein, 18 aa, Mycobacterium
QAKIRAGASVEQLAAAAG

SEQ ID NO: 713451 - protein, 18 aa, Mycobacterium
QAKIRAGASVEQVAAASG

SEQ ID NO: 713452 - protein, 19 aa, Mycobacterium
QAKLQLAVLAARLRAAGAR

SEQ ID NO: 713453 - protein, 20 aa, Mycobacterium
QAKLRLAVLAGQLRSAGVRV

SEQ ID NO: 713454 - protein, 17 aa, Mycobacterium
QAKPVEVVPQFGVAEAL

SEQ ID NO: 713455 - protein, 37 aa, Mycobacterium
QAKQALTEAVLWPLQHPDTFARLGVEPPRGVLLYGPP

SEQ ID NO: 713456 - protein, 22 aa, Mycobacterium
QAKRFPQIVFRTSSIEPTDHGY

SEQ ID NO: 713457 - protein, 18 aa, Mycobacterium
QAKRLSWQTPFTDVLDWS

SEQ ID NO: 713458 - protein, 23 aa, Mycobacterium
QAKTRADELLEQFDLVAAADRRL

SEQ ID NO: 713459 - protein, 31 aa, Mycobacterium
QAKVDMPAFLPNLPVNMPAQMTLPQDLPALA

SEQ ID NO: 713460 - protein, 25 aa, Mycobacterium
QAKVVAERRLWLAVLRAQAELEVEV

SEQ ID NO: 713461 - protein, 17 aa, Mycobacterium
QALAAIHRAEPPTDIGL

SEQ ID NO: 713462 - protein, 18 aa, Mycobacterium
QALAEGLARVSLTMIATR

SEQ ID NO: 713463 - protein, 24 aa, Mycobacterium
QALAPRPSDWLVIWDQTLPEGSEA

SEQ ID NO: 713464 - protein, 18 aa, Mycobacterium
QALARACTAEFARDTRRR

SEQ ID NO: 713465 - protein, 17 aa, Mycobacterium
QALARRGHEVRVHTALP

SEQ ID NO: 713466 - protein, 18 aa, Mycobacterium
QALGDALTQYQFGGDGQA

SEQ ID NO: 713467 - protein, 19 aa, Mycobacterium
QALGQMCVLGTFSEYTVVP

SEQ ID NO: 713468 - protein, 23 aa, Mycobacterium
QALHSGAMPGGWAAAPTPGPTVS

SEQ ID NO: 713469 - protein, 28 aa, Mycobacterium
QALIALARRRINVIWAMLRDHTHYHEPD

SEQ ID NO: 713470 - protein, 23 aa, Mycobacterium
QALIDLALRLRQRIADLDQVAAI

SEQ ID NO: 713471 - protein, 27 aa, Mycobacterium
QALINRYPRVCGMTGTALAAGEQLRQF

SEQ ID NO: 713472 - protein, 17 aa, Mycobacterium
QALKPGDYVVVQVSKDP

SEQ ID NO: 713473 - protein, 20 aa, Mycobacterium
QALLGIPMRVAVLGALRSTL

SEQ ID NO: 713474 - protein, 20 aa, Mycobacterium
QALLGRPLIGDGADGSPGQP

SEQ ID NO: 713475 - protein, 23 aa, Mycobacterium
QALLGRPLIGDGADGTAPGQAGG

SEQ ID NO: 713476 - protein, 21 aa, Mycobacterium
QALLGRPLIGDGADGTAPGQG

SEQ ID NO: 713477 - protein, 20 aa, Mycobacterium
QALLGRPLIGDGATGAAGQN

SEQ ID NO: 713478 - protein, 20 aa, Mycobacterium
QALLGRPLIGDGTAGAPGQN

SEQ ID NO: 713479 - protein, 22 aa, Mycobacterium
QALLGRPLIGNGADGATVGGIG

SEQ ID NO: 713480 - protein, 21 aa, Mycobacterium
QALLGRPLIGNGADGSAPGQA

SEQ ID NO: 713481 - protein, 23 aa, Mycobacterium
QALLGRPLIGNGADGTAPGQAGG

SEQ ID NO: 713482 - protein, 21 aa, Mycobacterium
QALLGRPLIGNGTNGTAANPN

SEQ ID NO: 713483 - protein, 25 aa, Mycobacterium
QALLVRSLVAWFWDEPLRAPLIRHG

SEQ ID NO: 713484 - protein, 26 aa, Mycobacterium
QALLYCVVLHRFLRWRQPGYSARRHI

SEQ ID NO: 713485 - protein, 31 aa, Mycobacterium
QALLYSVVLHRFLRWRLPDYHPDRHLGGVLY

SEQ ID NO: 713486 - protein, 26 aa, Mycobacterium
QALLYVVVLHRFLRWRQPGYDPRRHL

SEQ ID NO: 713487 - protein, 17 aa, Mycobacterium
QALMCDVRFAAAGAKFT

SEQ ID NO: 713488 - protein, 21 aa, Mycobacterium
QALMCDVRFAAGGAKFAAVFA

SEQ ID NO: 713489 - protein, 24 aa, Mycobacterium
QALNLRPGAPLLRETSVLPAGRPG

SEQ ID NO: 713490 - protein, 20 aa, Mycobacterium
QALNVARMRLLGATVVSVQS

SEQ ID NO: 713491 - protein, 17 aa, Mycobacterium
QALPALLESGRGVVVNF

SEQ ID NO: 713492 - protein, 17 aa, Mycobacterium
QALPCGDYGLVIDGQLV

SEQ ID NO: 713493 - protein, 34 aa, Mycobacterium
QALPDARPTVWLGVPRVWHKIKVGIETKLDTEAT

SEQ ID NO: 713494 - protein, 25 aa, Mycobacterium
QALQRLGQGGGFFSFGIMHYYMTGI

SEQ ID NO: 713495 - protein, 26 aa, Mycobacterium
QALQSLPGLSGFNLGIGNIGTGNIGS

SEQ ID NO: 713496 - protein, 21 aa, Mycobacterium
QALRVSNRLGVAMPAHCTSTG

SEQ ID NO: 713497 - protein, 17 aa, Mycobacterium
QALSAILLECTMAGLAT

SEQ ID NO: 713498 - protein, 23 aa, Mycobacterium
QALSELRLAGVDGPYSVLLAADV

SEQ ID NO: 713499 - protein, 23 aa, Mycobacterium
QALSELRLAGVDGPYSVLLSADV

SEQ ID NO: 713500 - protein, 24 aa, Mycobacterium
QALSELRLAGVDGPYSVLLSAEEY

SEQ ID NO: 713501 - protein, 24 aa, Mycobacterium
QALSELRLAGVDGPYSVLLSAETY

SEQ ID NO: 713502 - protein, 26 aa, Mycobacterium
QALSVRAVAFHDQFARALDAGANSYA

SEQ ID NO: 713503 - protein, 20 aa, Mycobacterium
QALTGRPLIANGANAATGSG

SEQ ID NO: 713504 - protein, 21 aa, Mycobacterium
QALTGRPLIGNGANGAPGTGA

SEQ ID NO: 713505 - protein, 20 aa, Mycobacterium
QALTGRPLIGNGTPGAAGSG

SEQ ID NO: 713506 - protein, 19 aa, Mycobacterium
QALTGRPLIGNGTPGAAGT

SEQ ID NO: 713507 - protein, 20 aa, Mycobacterium
QALTGRPLIGNGTPGATGSG

SEQ ID NO: 713508 - protein, 17 aa, Mycobacterium
QALTRAIHKLPIKARII

SEQ ID NO: 713509 - protein, 17 aa, Mycobacterium
QALVREGLRNVAAGANP

SEQ ID NO: 713510 - protein, 26 aa, Mycobacterium
QALYPRLLPIARDWWGKLGRDAPWPG

SEQ ID NO: 713511 - protein, 25 aa, Mycobacterium
QALYREGFFGLSFPREYGGQELPPV

SEQ ID NO: 713512 - protein, 25 aa, Mycobacterium
QALYREGFFGLSWPREYGGRELAPV

SEQ ID NO: 713513 - protein, 18 aa, Mycobacterium
QAMGLVWYYANSNPAMSR

SEQ ID NO: 713514 - protein, 17 aa, Mycobacterium
QAMKAARVLSLAQDTAD

SEQ ID NO: 713515 - protein, 17 aa, Mycobacterium
QAMLDMPLEEFQRIQDT

SEQ ID NO: 713516 - protein, 21 aa, Mycobacterium
QAMLEALGWTVIRVSAGLLHG

SEQ ID NO: 713517 - protein, 18 aa, Mycobacterium
QAMLECTDVQPAFSKRPA

SEQ ID NO: 713518 - protein, 34 aa, Mycobacterium
QAMLECTDVQPLFRKHPAFFGGLTNLAWSFDNDV

SEQ ID NO: 713519 - protein, 22 aa, Mycobacterium
QAMLPKAIAAGVRIACGTDAPA

SEQ ID NO: 713520 - protein, 34 aa, Mycobacterium
QAMLYAKAAMEVCRKIAPDILLGIPYAREELDLE

SEQ ID NO: 713521 - protein, 28 aa, Mycobacterium
QAMRLRDLLKFDFYFADSAAFRANIAEE

SEQ ID NO: 713522 - protein, 20 aa, Mycobacterium
QANADLWLTFAQDYRDETGS

SEQ ID NO: 713523 - protein, 24 aa, Mycobacterium
QANSRTVWVPVDFEHGALRERLLA

SEQ ID NO: 713524 - protein, 21 aa, Mycobacterium
QANYKEWYPRTPGSGDKLTID

SEQ ID NO: 713525 - protein, 22 aa, Mycobacterium
QAPELLPALGKASADVIGNLPH

SEQ ID NO: 713526 - protein, 23 aa, Mycobacterium
QAPERLRTLFAERGVFRHLAESD

SEQ ID NO: 713527 - protein, 17 aa, Mycobacterium
QAPFSLNPVDWVTGAWR

SEQ ID NO: 713528 - protein, 17 aa, Mycobacterium
QAPHCILNTRISRNRRF

SEQ ID NO: 713529 - protein, 24 aa, Mycobacterium
QAPLAPIRLCIGIHTGEVAQPRDD

SEQ ID NO: 713530 - protein, 21 aa, Mycobacterium
QAPLIRWDRRDALQDQFLRKL

SEQ ID NO: 713531 - protein, 22 aa, Mycobacterium
QAPSGRNRQRWDFVVVDDPRLR

SEQ ID NO: 713532 - protein, 26 aa, Mycobacterium
QAQAAFQPYLAWMGTVIAMAQQRAAA

SEQ ID NO: 713533 - protein, 18 aa, Mycobacterium
QAQAQCGGTLILETDGDQ

SEQ ID NO: 713534 - protein, 24 aa, Mycobacterium
QAQATRLTEWLKLALDEPELLKTL

SEQ ID NO: 713535 - protein, 21 aa, Mycobacterium
QAQGIPPQFLVDILTNLRTDR

SEQ ID NO: 713536 - protein, 25 aa, Mycobacterium
QAQIWRPNVYRQLGLLPTNSARYVT

SEQ ID NO: 713537 - protein, 23 aa, Mycobacterium
QAQLCVVELGRLHGPLLGDPTLA

SEQ ID NO: 713538 - protein, 19 aa, Mycobacterium
QAQQAEWRRGSLPPGRLGW

SEQ ID NO: 713539 - protein, 25 aa, Mycobacterium
QAQSLGQRFAQALAAGAGSYSSAEA

SEQ ID NO: 713540 - protein, 19 aa, Mycobacterium
QAQWNQAMESLVRAYQSMA

SEQ ID NO: 713541 - protein, 20 aa, Mycobacterium
QARAAAFAYETAFAETVPPP

SEQ ID NO: 713542 - protein, 20 aa, Mycobacterium
QARALRFWEVMYPSPPPGLA

SEQ ID NO: 713543 - protein, 18 aa, Mycobacterium
QARARAAGWRVLLADELG

SEQ ID NO: 713544 - protein, 18 aa, Mycobacterium
QARARVAAQLAAREPNRQ

SEQ ID NO: 713545 - protein, 18 aa, Mycobacterium
QARASGRSLLVGRKPMSH

SEQ ID NO: 713546 - protein, 18 aa, Mycobacterium
QARDERFGAVTGYQGTLA

SEQ ID NO: 713547 - protein, 22 aa, Mycobacterium
QARDRGATMIFTRTKRTAQKVA

SEQ ID NO: 713548 - protein, 17 aa, Mycobacterium
QAREFYAHFNFEPSPTD

SEQ ID NO: 713549 - protein, 17 aa, Mycobacterium
QARELLEPFGDRVSIAA

SEQ ID NO: 713550 - protein, 23 aa, Mycobacterium
QARELLLDRVIELAVERRGAAST

SEQ ID NO: 713551 - protein, 24 aa, Mycobacterium
QARFGDGWVKLVGDWIDRGIGDLA

SEQ ID NO: 713552 - protein, 23 aa, Mycobacterium
QARFGSVFIKAGFSSMDMGTSYL

SEQ ID NO: 713553 - protein, 24 aa, Mycobacterium
QARFLPDGTIEFLGRVDNQLKIRG

SEQ ID NO: 713554 - protein, 23 aa, Mycobacterium
QARFLTLASLKWVLRNRAYTPWY

SEQ ID NO: 713555 - protein, 22 aa, Mycobacterium
QARGFRATIAVGDRISSSTVAA

SEQ ID NO: 713556 - protein, 19 aa, Mycobacterium
QARGKGGLVRVTWAEATEM

SEQ ID NO: 713557 - protein, 21 aa, Mycobacterium
QARIAIPRQVHLPWGTVSLPR

SEQ ID NO: 713558 - protein, 37 aa, Mycobacterium
QARIEFKLRDWLFARQRYWGEPFPIVYDADGRPHALD

SEQ ID NO: 713559 - protein, 19 aa, Mycobacterium
QARIKWLMADKSKDYDDIV

SEQ ID NO: 713560 - protein, 19 aa, Mycobacterium
QARIKWLMADKSKGYDDLV

SEQ ID NO: 713561 - protein, 18 aa, Mycobacterium
QARKSFIDSVKGTAKEVV

SEQ ID NO: 713562 - protein, 21 aa, Mycobacterium
QARLAAVSMFGRLGRPAEVAD

SEQ ID NO: 713563 - protein, 27 aa, Mycobacterium
QARLAVEVFEAAFAMTVPPPAVAANRA

SEQ ID NO: 713564 - protein, 19 aa, Mycobacterium
QARLDASRILFSDSILPVD

SEQ ID NO: 713565 - protein, 25 aa, Mycobacterium
QARLHRWRFNLVTGEVREERLFESV

SEQ ID NO: 713566 - protein, 18 aa, Mycobacterium
QARMFWKSMSAVEAKHIV

SEQ ID NO: 713567 - protein, 23 aa, Mycobacterium
QARNFQAVIALGDRIGTATVAAS

SEQ ID NO: 713568 - protein, 18 aa, Mycobacterium
QARNRFDAAWNHQNGDHP

SEQ ID NO: 713569 - protein, 27 aa, Mycobacterium
QARPPARLIGWTARFLGMVHPGDEVDF

SEQ ID NO: 713570 - protein, 27 aa, Mycobacterium
QARPPARLIGWTARFLGMVRPGDEVAF

SEQ ID NO: 713571 - protein, 27 aa, Mycobacterium
QARPPARLVGWTARFLGMVRPGDEVDF

SEQ ID NO: 713572 - protein, 21 aa, Mycobacterium
QARPRLDADLAEIIAGSDDPR

SEQ ID NO: 713573 - protein, 23 aa, Mycobacterium
QARRAELVAGLFAAATEPEQTFL

SEQ ID NO: 713574 - protein, 25 aa, Mycobacterium
QARRCMDCGIPFCHSGSAGCPLGNL

SEQ ID NO: 713575 - protein, 24 aa, Mycobacterium
QARRRGIGAAMARTALAEGGPGAR

SEQ ID NO: 713576 - protein, 23 aa, Mycobacterium
QARRRLGQMWSEMDVIEVDEQIV

SEQ ID NO: 713577 - protein, 18 aa, Mycobacterium
QARRVARLLAEIPGAQIL

SEQ ID NO: 713578 - protein, 23 aa, Mycobacterium
QARSRLLMMTNFLHLWRTSDTTA

SEQ ID NO: 713579 - protein, 17 aa, Mycobacterium
QARSVAVDVLRPLLDEL

SEQ ID NO: 713580 - protein, 17 aa, Mycobacterium
QARVGKIFGSFNVVLAP

SEQ ID NO: 713581 - protein, 21 aa, Mycobacterium
QARVGSYLRYGAYPYAIAIRE

SEQ ID NO: 713582 - protein, 21 aa, Mycobacterium
QARVGSYLRYGAYPYAIAVRE

SEQ ID NO: 713583 - protein, 17 aa, Mycobacterium
QARYGLQTMCIGGGQGL

SEQ ID NO: 713584 - protein, 19 aa, Mycobacterium
QARYWSRDSVAAAMKVVAA

SEQ ID NO: 713585 - protein, 21 aa, Mycobacterium
QASACILCECNCGIVVQVRDR

SEQ ID NO: 713586 - protein, 17 aa, Mycobacterium
QASCNKDYSCLDGDCPS

SEQ ID NO: 713587 - protein, 17 aa, Mycobacterium
QASGNDDVIAWRGDRRF

SEQ ID NO: 713588 - protein, 21 aa, Mycobacterium
QASLPRPPALSSRPDPGSAAK

SEQ ID NO: 713589 - protein, 18 aa, Mycobacterium
QASMALASLRDAWAKSPQ

SEQ ID NO: 713590 - protein, 38 aa, Mycobacterium
QASRCMDCGIPFCHNGCPLGNLIPEWNDLVYRDRWRDA

SEQ ID NO: 713591 - protein, 24 aa, Mycobacterium
QASRKFPRAARRIIMQQAKLQLPK

SEQ ID NO: 713592 - protein, 29 aa, Mycobacterium
QASRLEAIGMQLQRSHSFFVGDPQIGKTL

SEQ ID NO: 713593 - protein, 18 aa, Mycobacterium
QASRPGHFMPASLLESQF

SEQ ID NO: 713594 - protein, 24 aa, Mycobacterium
QASSDGRPGLRIEGRNYPEDTGPG

SEQ ID NO: 713595 - protein, 28 aa, Mycobacterium
QASSRYPGGLALRFARVVRYRDDKGPAD

SEQ ID NO: 713596 - protein, 20 aa, Mycobacterium
QASYRSAEHLGFDELIDPRE

SEQ ID NO: 713597 - protein, 23 aa, Mycobacterium
QATAGAPAHDWLTLTGGAIGYGI

SEQ ID NO: 713598 - protein, 17 aa, Mycobacterium
QATAGRLAAERASVSDE

SEQ ID NO: 713599 - protein, 18 aa, Mycobacterium
QATEEFRVPPAGTLGRHF

SEQ ID NO: 713600 - protein, 17 aa, Mycobacterium
QATFGYTQNWVVRTLTA

SEQ ID NO: 713601 - protein, 25 aa, Mycobacterium
QATFRKLQVGNRVELARYAIEHGLD

SEQ ID NO: 713602 - protein, 25 aa, Mycobacterium
QATGARAAFLIRFGTGVLPEPKTIL

SEQ ID NO: 713603 - protein, 22 aa, Mycobacterium
QATKRLRLGTLVTGIHYRHPAV

SEQ ID NO: 713604 - protein, 20 aa, Mycobacterium
QATLPRVITDACEILLILKD

SEQ ID NO: 713605 - protein, 23 aa, Mycobacterium
QATLRRELHLSLGVEWAPVDPGT

SEQ ID NO: 713606 - protein, 26 aa, Mycobacterium
QATMGFRPAPLFEVLAKRMGVSADDR

SEQ ID NO: 713607 - protein, 17 aa, Mycobacterium
QATNALRGEKDSDRPFA

SEQ ID NO: 713608 - protein, 37 aa, Mycobacterium
QATRCMDCGIPFCHNGCPLGNLIPEWNDLVRQGRWRD

SEQ ID NO: 713609 - protein, 29 aa, Mycobacterium
QATRLRDLLKFDFYFADSATFRDHIAEEM

SEQ ID NO: 713610 - protein, 21 aa, Mycobacterium
QATVLKANWQRAAKVLGSARP

SEQ ID NO: 713611 - protein, 21 aa, Mycobacterium
QATVLKANWQRAAKVLGSSRP

SEQ ID NO: 713612 - protein, 18 aa, Mycobacterium
QATVLRWVSQFGNPLTWA

SEQ ID NO: 713613 - protein, 20 aa, Mycobacterium
QATWWQGRALAAGRQIHASL

SEQ ID NO: 713614 - protein, 31 aa, Mycobacterium
QAVACGLARHVLCFRTLWEATHGELMKQGKI

SEQ ID NO: 713615 - protein, 35 aa, Mycobacterium
QAVARVVDHWAMFESIRFDLNLVIAGDDGEHVTIV

SEQ ID NO: 713616 - protein, 17 aa, Mycobacterium
QAVAWASAYRRGSYGET

SEQ ID NO: 713617 - protein, 18 aa, Mycobacterium
QAVELSWNALWAQVCAVG

SEQ ID NO: 713618 - protein, 19 aa, Mycobacterium
QAVGQLGQLGQLFTAPLAA

SEQ ID NO: 713619 - protein, 28 aa, Mycobacterium
QAVISALTSQGWRGPASAAMLGAAEPYI

SEQ ID NO: 713620 - protein, 20 aa, Mycobacterium
QAVKLLAPKRVQGLLPGVVK

SEQ ID NO: 713621 - protein, 20 aa, Mycobacterium
QAVKLPWDLPERDMALILRG

SEQ ID NO: 713622 - protein, 21 aa, Mycobacterium
QAVLGRPLIGDGANGSPNTGA

SEQ ID NO: 713623 - protein, 18 aa, Mycobacterium
QAVMCADVGHLALAHDYT

SEQ ID NO: 713624 - protein, 30 aa, Mycobacterium
QAVMTFAKPYAEWRGMFAGNGMLLPRSVTA

SEQ ID NO: 713625 - protein, 26 aa, Mycobacterium
QAVPMWPEMPMMTSMSAWQEEDGRQV

SEQ ID NO: 713626 - protein, 18 aa, Mycobacterium
QAVRFCVADAAVAVRGLA

SEQ ID NO: 713627 - protein, 18 aa, Mycobacterium
QAVRRCVATAVQRARAGA

SEQ ID NO: 713628 - protein, 22 aa, Mycobacterium
QAVRRMVRDAGYEQPLVSRTHA

SEQ ID NO: 713629 - protein, 18 aa, Mycobacterium
QAVRSCLIFAVQVDGQDV

SEQ ID NO: 713630 - protein, 27 aa, Mycobacterium
QAVSFWRAVQTRVWRGRPDPARDARAT

SEQ ID NO: 713631 - protein, 25 aa, Mycobacterium
QAVSRVSDVWAMFDTLRFDLNVVAA

SEQ ID NO: 713632 - protein, 18 aa, Mycobacterium
QAVVDAWQRRGIDGTVTL

SEQ ID NO: 713633 - protein, 31 aa, Mycobacterium
QAVVFRHGLQLFGAMGFTWENDVQFALKRAK

SEQ ID NO: 713634 - protein, 19 aa, Mycobacterium
QAVVISWGDPVLPGAPQFD

SEQ ID NO: 713635 - protein, 17 aa, Mycobacterium
QAVVSFDHAYHGRTNLT

SEQ ID NO: 713636 - protein, 19 aa, Mycobacterium
QAVYRPEFDDTDGTSRGTV

SEQ ID NO: 713637 - protein, 26 aa, Mycobacterium
QAWAEGRFDREISPISAPVLDENKRP

SEQ ID NO: 713638 - protein, 20 aa, Mycobacterium
QAWWDRAGPLLAEVFDDEKF

SEQ ID NO: 713639 - protein, 18 aa, Mycobacterium
QAYAEAFLSAAATNPTVA

SEQ ID NO: 713640 - protein, 24 aa, Mycobacterium
QAYAPRRQKHCLLNADGWGVGFFD

SEQ ID NO: 713641 - protein, 28 aa, Mycobacterium
QAYEDLAWFCIRAWRFGAPASLGAGGLG

SEQ ID NO: 713642 - protein, 19 aa, Mycobacterium
QAYHVAGTYFGRLLSNLVA

SEQ ID NO: 713643 - protein, 24 aa, Mycobacterium
QAYIDALMPMVWTACEREDFVPEV

SEQ ID NO: 713644 - protein, 18 aa, Mycobacterium
QAYLDFARANPAVYDAMF

SEQ ID NO: 713645 - protein, 23 aa, Mycobacterium
QAYPDRIVLGLGVGYPEQAAAVG

SEQ ID NO: 713646 - protein, 26 aa, Mycobacterium
QAYQFPMGLGLVSQFFGRYFSPDEAR

SEQ ID NO: 713647 - protein, 29 aa, Mycobacterium
QAYQRLANQLMAFHDQFAQALTAGASAYT

SEQ ID NO: 713648 - protein, 40 aa, Mycobacterium
QAYQVVSAQAAAFHQRFVVALAAAAGSYGRAESAGAAVLQ

SEQ ID NO: 713649 - protein, 22 aa, Mycobacterium
QAYRLFSVLNHRGESLSDADLL

SEQ ID NO: 713650 - protein, 18 aa, Mycobacterium
QAYRVLSIHAADFHGSFV

SEQ ID NO: 713651 - protein, 17 aa, Mycobacterium
QAYSMTMYAGWRAVIAG

SEQ ID NO: 713652 - protein, 18 aa, Mycobacterium
QAYVTRQARWVDFDNDYK

SEQ ID NO: 713653 - protein, 19 aa, Mycobacterium
QAYYTGYGVAPAIKRTYQR

SEQ ID NO: 713654 - protein, 17 aa, Mycobacterium
QCAEVVGILQTVFDFTA

SEQ ID NO: 713655 - protein, 21 aa, Mycobacterium
QCAFPGYLDGHQGVWMAPPEL

SEQ ID NO: 713656 - protein, 19 aa, Mycobacterium
QCAGGGWLCDGVWSAPSPP

SEQ ID NO: 713657 - protein, 21 aa, Mycobacterium
QCAPDHPWVRAHPEWFTELPD

SEQ ID NO: 713658 - protein, 17 aa, Mycobacterium
QCAYPGLIDQEYLDGLR

SEQ ID NO: 713659 - protein, 23 aa, Mycobacterium
QCDGGLRTARDVVVAMLLGAEEY

SEQ ID NO: 713660 - protein, 18 aa, Mycobacterium
QCDHRGFSSRSFCADEFA

SEQ ID NO: 713661 - protein, 20 aa, Mycobacterium
QCDIRVTWDSEWDVRIEIPD

SEQ ID NO: 713662 - protein, 24 aa, Mycobacterium
QCDLRVVAPDAFFQFPTSKYGLAL

SEQ ID NO: 713663 - protein, 22 aa, Mycobacterium
QCGELLAGLAVHAERMSENLDA

SEQ ID NO: 713664 - protein, 26 aa, Mycobacterium
QCGGCGAVATGWCDACTDDLTVADDQ

SEQ ID NO: 713665 - protein, 20 aa, Mycobacterium
QCGLDSCKVLINFNRCGAVA

SEQ ID NO: 713666 - protein, 21 aa, Mycobacterium
QCGPPPWPPRKHIFGSVNRNR

SEQ ID NO: 713667 - protein, 17 aa, Mycobacterium
QCGSCTVLVDGRRVTSC

SEQ ID NO: 713668 - protein, 18 aa, Mycobacterium
QCHSLAFDFAVWEIFGSL

SEQ ID NO: 713669 - protein, 18 aa, Mycobacterium
QCHSLAFDFSVWEIFGSL

SEQ ID NO: 713670 - protein, 26 aa, Mycobacterium
QCHSLAFDFSVWEIWGALLHGGHLVV

SEQ ID NO: 713671 - protein, 18 aa, Mycobacterium
QCHSLAFDFSVWEVFGSL

SEQ ID NO: 713672 - protein, 20 aa, Mycobacterium
QCHSLAFDYSVWEIWAPLLY

SEQ ID NO: 713673 - protein, 32 aa, Mycobacterium
QCHSLAFDYSVWEIWGALLYGGRLLVVPDAVV

SEQ ID NO: 713674 - protein, 18 aa, Mycobacterium
QCHSYAFDYSVWEIFGAL

SEQ ID NO: 713675 - protein, 20 aa, Mycobacterium
QCLDRLRPGPTMIEDRKLAW

SEQ ID NO: 713676 - protein, 17 aa, Mycobacterium
QCLIKAEPRPSWGDPKY

SEQ ID NO: 713677 - protein, 24 aa, Mycobacterium
QCLISSAGSVEWLCVPRPDSPSVF

SEQ ID NO: 713678 - protein, 17 aa, Mycobacterium
QCLNAGLGFGGGCLPKD

SEQ ID NO: 713679 - protein, 20 aa, Mycobacterium
QCRQTHGFDLVRAHLEMARR

SEQ ID NO: 713680 - protein, 31 aa, Mycobacterium
QCRRLRPDFAVGLQPARWGTGFILGTDRWGP

SEQ ID NO: 713681 - protein, 21 aa, Mycobacterium
QCSCPFCFSRSSISALESAPA

SEQ ID NO: 713682 - protein, 19 aa, Mycobacterium
QCSDFLAFDARGLADGREY

SEQ ID NO: 713683 - protein, 18 aa, Mycobacterium
QCSWSVSGTGQFLPGEGA

SEQ ID NO: 713684 - protein, 23 aa, Mycobacterium
QCTNVNRIAMWLAQVGHESAGFN

SEQ ID NO: 713685 - protein, 24 aa, Mycobacterium
QCTSEGRPGCGECRACTTTMAGTH

SEQ ID NO: 713686 - protein, 21 aa, Mycobacterium
QCVAELHGSWLGAGADAEREY

SEQ ID NO: 713687 - protein, 25 aa, Mycobacterium
QCVAIARAVFFGARVLILDEPTAAL

SEQ ID NO: 713688 - protein, 28 aa, Mycobacterium
QCVDDTIAAMITKLLAWHRENPGRQPAL

SEQ ID NO: 713689 - protein, 18 aa, Mycobacterium
QCVPLAPEVFKLVGEEAL

SEQ ID NO: 713690 - protein, 18 aa, Mycobacterium
QCVPLAPEVLQLVGEEAL

SEQ ID NO: 713691 - protein, 18 aa, Mycobacterium
QCVRSCRWLTLDLRHLEF

SEQ ID NO: 713692 - protein, 18 aa, Mycobacterium
QCWDRGRITRGLDRLRQA

SEQ ID NO: 713693 - protein, 20 aa, Mycobacterium
QCYVGASFLRPVECAQRHRI

SEQ ID NO: 713694 - protein, 19 aa, Mycobacterium
QCYVGASFMRPVECAERHG

SEQ ID NO: 713695 - protein, 20 aa, Mycobacterium
QCYVGASFMRPVECAERHRI

SEQ ID NO: 713696 - protein, 18 aa, Mycobacterium
QDAAAIAEICRRLDGIPL

SEQ ID NO: 713697 - protein, 24 aa, Mycobacterium
QDAAFGGLCAWYSIIHTPADRLAG

SEQ ID NO: 713698 - protein, 27 aa, Mycobacterium
QDACVNAGIPAVAFWAAVPHYVSQPPN

SEQ ID NO: 713699 - protein, 17 aa, Mycobacterium
QDACVQAGIPAVTFWAA

SEQ ID NO: 713700 - protein, 18 aa, Mycobacterium
QDAEWIRTRVTDVVQDAH

SEQ ID NO: 713701 - protein, 24 aa, Mycobacterium
QDAFGDKVLPLYLPAGAGLIGLLS

SEQ ID NO: 713702 - protein, 21 aa, Mycobacterium
QDAFGNFLARVVFPNRTRQLS

SEQ ID NO: 713703 - protein, 19 aa, Mycobacterium
QDAGLVLRVAAAAAHAGLP

SEQ ID NO: 713704 - protein, 17 aa, Mycobacterium
QDAILTRWREWSHHTKN

SEQ ID NO: 713705 - protein, 23 aa, Mycobacterium
QDAKPVIGTVMRQGYQLGEHVLR

SEQ ID NO: 713706 - protein, 22 aa, Mycobacterium
QDALPGYGWVFPLGGGRINIGI

SEQ ID NO: 713707 - protein, 22 aa, Mycobacterium
QDAPRWGFSPLIALNGPVSLTG

SEQ ID NO: 713708 - protein, 25 aa, Mycobacterium
QDATVEVAIRLGVDPRKADQMVRGT

SEQ ID NO: 713709 - protein, 25 aa, Mycobacterium
QDAYPIYPCRDGYVRLCVMAPRQWR

SEQ ID NO: 713710 - protein, 17 aa, Mycobacterium
QDCEARVIITESVLAPV

SEQ ID NO: 713711 - protein, 20 aa, Mycobacterium
QDCLSLWSGWVPLEPAEGWD

SEQ ID NO: 713712 - protein, 24 aa, Mycobacterium
QDCRFQIAGANWWGTTGGQAQAQC

SEQ ID NO: 713713 - protein, 22 aa, Mycobacterium
QDCTRFAVNLLHSGGESAARVF

SEQ ID NO: 713714 - protein, 19 aa, Mycobacterium
QDCVPDLSGQPFLLTAGFF

SEQ ID NO: 713715 - protein, 22 aa, Mycobacterium
QDDDGQRWGRPVAAVTGPDGAV

SEQ ID NO: 713716 - protein, 23 aa, Mycobacterium
QDDSRVSFRIGDAHVSIADDATK

SEQ ID NO: 713717 - protein, 23 aa, Mycobacterium
QDEARMIMRNVWSPVSQQAGSGL

SEQ ID NO: 713718 - protein, 19 aa, Mycobacterium
QDELVRWFDDAGVNIVYLT

SEQ ID NO: 713719 - protein, 24 aa, Mycobacterium
QDENPRLLLVVAELPMPMQNVNDE

SEQ ID NO: 713720 - protein, 20 aa, Mycobacterium
QDERGRYVLRTSSQVPFLVR

SEQ ID NO: 713721 - protein, 24 aa, Mycobacterium
QDEVSAAIAALFGAHAQEYQAISA

SEQ ID NO: 713722 - protein, 29 aa, Mycobacterium
QDEVSAAIAAQFSGHGLAYQQLSTQVGVF

SEQ ID NO: 713723 - protein, 24 aa, Mycobacterium
QDEVSAAIAGFFSGHAQQFQTLSA

SEQ ID NO: 713724 - protein, 24 aa, Mycobacterium
QDEWPARLRRLIVEQASVILRRTV

SEQ ID NO: 713725 - protein, 17 aa, Mycobacterium
QDFFFRKIARDQGGALL

SEQ ID NO: 713726 - protein, 18 aa, Mycobacterium
QDFLDKVPHAEFVELSNA

SEQ ID NO: 713727 - protein, 18 aa, Mycobacterium
QDFSELWRTLAADLGVAG

SEQ ID NO: 713728 - protein, 38 aa, Mycobacterium
QDFSLFHVLRFGFRPSKIAFLAWHAWHDSELGTWPPGF

SEQ ID NO: 713729 - protein, 17 aa, Mycobacterium
QDFSLFHVLRYGFRPSK

SEQ ID NO: 713730 - protein, 38 aa, Mycobacterium
QDFSLFQVLRFGFRPSKVAFLAWHAWHDVGAGDWPPGF

SEQ ID NO: 713731 - protein, 24 aa, Mycobacterium
QDFTEWLRRFFDVDDVRRSDVVLA

SEQ ID NO: 713732 - protein, 32 aa, Mycobacterium
QDFVHLSLMVLRAMGIPAHYVSGYLHPKHNAA

SEQ ID NO: 713733 - protein, 20 aa, Mycobacterium
QDFWSDDSVDHFLATGETVR

SEQ ID NO: 713734 - protein, 20 aa, Mycobacterium
QDFYATVFGWTFESAGPEYG

SEQ ID NO: 713735 - protein, 18 aa, Mycobacterium
QDFYGTVFGWTFESAGPE

SEQ ID NO: 713736 - protein, 30 aa, Mycobacterium
QDGKLGVGWPKEFGGLGFGPIEQSIFVNEA

SEQ ID NO: 713737 - protein, 21 aa, Mycobacterium
QDGMLALARLQRKMRLVESPY

SEQ ID NO: 713738 - protein, 24 aa, Mycobacterium
QDGNRPAMEVLLLGGQPIRERVVA

SEQ ID NO: 713739 - protein, 26 aa, Mycobacterium
QDGPGWWAAREAIEWTAEAQRQPGLA

SEQ ID NO: 713740 - protein, 24 aa, Mycobacterium
QDGQVWLRGEVCPYVVFEQLKEPY

SEQ ID NO: 713741 - protein, 21 aa, Mycobacterium
QDGRRCITMTVLADVPTGDVI

SEQ ID NO: 713742 - protein, 23 aa, Mycobacterium
QDGSPPYVVRWLVTGHEATVYPG

SEQ ID NO: 713743 - protein, 22 aa, Mycobacterium
QDHARSLWRAHLADLDGPTLLA

SEQ ID NO: 713744 - protein, 24 aa, Mycobacterium
QDHDARFGAVSGYTGTLSRLPAPP

SEQ ID NO: 713745 - protein, 18 aa, Mycobacterium
QDHKSVLGLLETLDGAPS

SEQ ID NO: 713746 - protein, 24 aa, Mycobacterium
QDHPAFGCVWEYDVALEPRNTGSE

SEQ ID NO: 713747 - protein, 24 aa, Mycobacterium
QDHPRIDCVWEYRQPLEPRNNGAE

SEQ ID NO: 713748 - protein, 23 aa, Mycobacterium
QDHRISEDMLRGWQIHTEGAFTL

SEQ ID NO: 713749 - protein, 17 aa, Mycobacterium
QDIAPLFRKRPSSLHGS

SEQ ID NO: 713750 - protein, 19 aa, Mycobacterium
QDIDEALFAKVNLVAQRIG

SEQ ID NO: 713751 - protein, 22 aa, Mycobacterium
QDIEARGGFVAARDHVAERIAE

SEQ ID NO: 713752 - protein, 24 aa, Mycobacterium
QDILPPEVFEKLTPDFVAPVVAYL

SEQ ID NO: 713753 - protein, 18 aa, Mycobacterium
QDILPPEVFEKLTPEYVA

SEQ ID NO: 713754 - protein, 24 aa, Mycobacterium
QDILPPEVFEKLTPEYVAPVVAYL

SEQ ID NO: 713755 - protein, 22 aa, Mycobacterium
QDIPAMLALWRAGRLPVEKLKS

SEQ ID NO: 713756 - protein, 20 aa, Mycobacterium
QDIQTAFIYDHFTPFVFTQL

SEQ ID NO: 713757 - protein, 21 aa, Mycobacterium
QDIQTAFIYDHFTPFVFTQLE

SEQ ID NO: 713758 - protein, 22 aa, Mycobacterium
QDIRVAAELALPHRRRRDPFDD

SEQ ID NO: 713759 - protein, 18 aa, Mycobacterium
QDISGGTIFAYWVANPTA

SEQ ID NO: 713760 - protein, 17 aa, Mycobacterium
QDIVFGMRAFEFLENRL

SEQ ID NO: 713761 - protein, 19 aa, Mycobacterium
QDKGPWAVFDLSLGRAMYS

SEQ ID NO: 713762 - protein, 25 aa, Mycobacterium
QDKIARIGIRVADVLDEQVLAEKIE

SEQ ID NO: 713763 - protein, 25 aa, Mycobacterium
QDKIARIGIRVADVLDREVLTHKVE

SEQ ID NO: 713764 - protein, 21 aa, Mycobacterium
QDLAKRIALRHSVDMVRTAME

SEQ ID NO: 713765 - protein, 20 aa, Mycobacterium
QDLARRIALRHSVDMVRVTM

SEQ ID NO: 713766 - protein, 19 aa, Mycobacterium
QDLDGAFVAPGFVDSHIHL

SEQ ID NO: 713767 - protein, 21 aa, Mycobacterium
QDLEQRMQNVLARATTVDADI

SEQ ID NO: 713768 - protein, 29 aa, Mycobacterium
QDLERERCLLFVACTRAREELLVTWHGQP

SEQ ID NO: 713769 - protein, 17 aa, Mycobacterium
QDLIGRGVLAVRGRGLW

SEQ ID NO: 713770 - protein, 18 aa, Mycobacterium
QDLKDLRAVITYLTSDEG

SEQ ID NO: 713771 - protein, 24 aa, Mycobacterium
QDLLAATVIYRFLFAHADLDPALS

SEQ ID NO: 713772 - protein, 21 aa, Mycobacterium
QDLLNRACVVVDHVSVGETNV

SEQ ID NO: 713773 - protein, 22 aa, Mycobacterium
QDLLQFCLLLLVAGNETTRNLI

SEQ ID NO: 713774 - protein, 17 aa, Mycobacterium
QDLPFDRVVDAVSPVRT

SEQ ID NO: 713775 - protein, 23 aa, Mycobacterium
QDLPGDSFIGPRFGQVGRTQPVR

SEQ ID NO: 713776 - protein, 24 aa, Mycobacterium
QDLPGDTFVGPRFGYLGRTQPVGR

SEQ ID NO: 713777 - protein, 29 aa, Mycobacterium
QDLPLDQYWFWNLRNTVRFDKAIAAAVTR

SEQ ID NO: 713778 - protein, 25 aa, Mycobacterium
QDLRAAEDALWRWMAAAALVRSRAD

SEQ ID NO: 713779 - protein, 31 aa, Mycobacterium
QDLRAAEDALWRWMSAAALVRARGDGGVVLA

SEQ ID NO: 713780 - protein, 17 aa, Mycobacterium
QDLRAALRTAVPDGADV

SEQ ID NO: 713781 - protein, 24 aa, Mycobacterium
QDLRLDFEDGYGWRGDSTEDADAR

SEQ ID NO: 713782 - protein, 23 aa, Mycobacterium
QDLRRRVALRQSVEMVRTSMEFF

SEQ ID NO: 713783 - protein, 24 aa, Mycobacterium
QDLSELLWSFAPPARPRPATLAEI

SEQ ID NO: 713784 - protein, 21 aa, Mycobacterium
QDLTGRPLIGNGTPAPAGSGA

SEQ ID NO: 713785 - protein, 21 aa, Mycobacterium
QDLTGRPLVGNGANGVPGTGA

SEQ ID NO: 713786 - protein, 18 aa, Mycobacterium
QDLVALCRQALKLVTEQW

SEQ ID NO: 713787 - protein, 27 aa, Mycobacterium
QDMGFPFTPGHEIAGWVDSIGSQVPAS

SEQ ID NO: 713788 - protein, 29 aa, Mycobacterium
QDMRCKWRKWLYFQCNWKVAMEAFNETYH

SEQ ID NO: 713789 - protein, 17 aa, Mycobacterium
QDNLGLTYLFISHDLSV

SEQ ID NO: 713790 - protein, 22 aa, Mycobacterium
QDNRLTSALGIVHSRFSTNTFP

SEQ ID NO: 713791 - protein, 25 aa, Mycobacterium
QDPAHFGRFRRLIPTLFMFRQSDEV

SEQ ID NO: 713792 - protein, 24 aa, Mycobacterium
QDPALRAPLTWEVDEPCPVPQPAT

SEQ ID NO: 713793 - protein, 30 aa, Mycobacterium
QDPARRSLLHWQCVDPIPPATTEALRTDPR

SEQ ID NO: 713794 - protein, 17 aa, Mycobacterium
QDPATLCGPVISDKQRK

SEQ ID NO: 713795 - protein, 24 aa, Mycobacterium
QDPDLRAPLTWEVDAPCPVPAPET

SEQ ID NO: 713796 - protein, 28 aa, Mycobacterium
QDPEKWNVFDPVLIRWRLQAGDRTAQLV

SEQ ID NO: 713797 - protein, 25 aa, Mycobacterium
QDPELRAPLTWEVDEPCPVPQPETY

SEQ ID NO: 713798 - protein, 21 aa, Mycobacterium
QDPEQRAALVADIELVTSQLP

SEQ ID NO: 713799 - protein, 24 aa, Mycobacterium
QDPESRPALMEFVTKATRVATPEE

SEQ ID NO: 713800 - protein, 27 aa, Mycobacterium
QDPFDAVVCSLVLCSVTDQLGVLQHLR

SEQ ID NO: 713801 - protein, 19 aa, Mycobacterium
QDPGLPFTVRIASTGENLA

SEQ ID NO: 713802 - protein, 23 aa, Mycobacterium
QDPHLRARLPVRQAAERLNRYLR

SEQ ID NO: 713803 - protein, 22 aa, Mycobacterium
QDPLGRLAIRRITDATKGTDPL

SEQ ID NO: 713804 - protein, 22 aa, Mycobacterium
QDPLGRLAIRRITDATNGVDPL

SEQ ID NO: 713805 - protein, 21 aa, Mycobacterium
QDPRILMWAKQYEVLNQVNPG

SEQ ID NO: 713806 - protein, 17 aa, Mycobacterium
QDPRLPFGGCGQSGIGR

SEQ ID NO: 713807 - protein, 17 aa, Mycobacterium
QDPRYDVIGARFAAWPQ

SEQ ID NO: 713808 - protein, 17 aa, Mycobacterium
QDPYAYWDFLREQSPVY

SEQ ID NO: 713809 - protein, 17 aa, Mycobacterium
QDQGPWGAFDMSLGKAM

SEQ ID NO: 713810 - protein, 17 aa, Mycobacterium
QDQHGHCEITFDNVRVP

SEQ ID NO: 713811 - protein, 23 aa, Mycobacterium
QDQPGHCEIIYDNVRVPVTNLLG

SEQ ID NO: 713812 - protein, 25 aa, Mycobacterium
QDRGFKVALVTDGRMSGASGKVPAA

SEQ ID NO: 713813 - protein, 23 aa, Mycobacterium
QDRHFRLDWSRPHDVGRKAIAQN

SEQ ID NO: 713814 - protein, 19 aa, Mycobacterium
QDRLIAWTVLGQIQPPIGH

SEQ ID NO: 713815 - protein, 24 aa, Mycobacterium
QDRMPVLYCKTGVRSAEALAALKK

SEQ ID NO: 713816 - protein, 24 aa, Mycobacterium
QDRPADRPLWLGSIKSNIGHTSAA

SEQ ID NO: 713817 - protein, 23 aa, Mycobacterium
QDRRGAAEPLGLRVDTSPAQLRA

SEQ ID NO: 713818 - protein, 19 aa, Mycobacterium
QDRSNCFIFADGAAAVVVG

SEQ ID NO: 713819 - protein, 18 aa, Mycobacterium
QDRSNCFIFADGAAGVVV

SEQ ID NO: 713820 - protein, 19 aa, Mycobacterium
QDRTNCFIFADGAAGVVVG

SEQ ID NO: 713821 - protein, 20 aa, Mycobacterium
QDRTSLVGFVVWQDNMHEDL

SEQ ID NO: 713822 - protein, 28 aa, Mycobacterium
QDRWQIRWRLGWSFACLEHNVLLLDACP

SEQ ID NO: 713823 - protein, 32 aa, Mycobacterium
QDSALSPRGYRAMAVIPRLQFAHADLLVRSFG

SEQ ID NO: 713824 - protein, 25 aa, Mycobacterium
QDSALSPRGYRAMSGIPRLQFSHTD

SEQ ID NO: 713825 - protein, 19 aa, Mycobacterium
QDSAYAWAYNVEKGNKTRI

SEQ ID NO: 713826 - protein, 21 aa, Mycobacterium
QDSDPRWPLLQAERSALLSLN

SEQ ID NO: 713827 - protein, 25 aa, Mycobacterium
QDSERARRCHEFLGRLQQTAAAGPA

SEQ ID NO: 713828 - protein, 26 aa, Mycobacterium
QDSGLPVIVLRTSRFFPEQDDNDRVR

SEQ ID NO: 713829 - protein, 22 aa, Mycobacterium
QDSGPWAAFDLSLGRAMYSGFT

SEQ ID NO: 713830 - protein, 23 aa, Mycobacterium
QDSLAGHMLIEFMQNLPRAELFA

SEQ ID NO: 713831 - protein, 24 aa, Mycobacterium
QDSNRPALEVLLLGGKPIREPVFH

SEQ ID NO: 713832 - protein, 17 aa, Mycobacterium
QDSRLLTRELFYTAVTR

SEQ ID NO: 713833 - protein, 22 aa, Mycobacterium
QDSRLPLRPANFVSGLESMPVV

SEQ ID NO: 713834 - protein, 23 aa, Mycobacterium
QDSSEASLRWAGSSMTTNGESVK

SEQ ID NO: 713835 - protein, 23 aa, Mycobacterium
QDSWKLSKDPLFVAKVRDLVGLY

SEQ ID NO: 713836 - protein, 19 aa, Mycobacterium
QDSYLRWAAVDLSTVRDTK

SEQ ID NO: 713837 - protein, 19 aa, Mycobacterium
QDSYLRWSAVDLSTVRDTK

SEQ ID NO: 713838 - protein, 19 aa, Mycobacterium
QDSYTSFCRLARHSRTGVN

SEQ ID NO: 713839 - protein, 23 aa, Mycobacterium
QDTERRGRFLAGRVRDDVHGSTW

SEQ ID NO: 713840 - protein, 17 aa, Mycobacterium
QDTESWTKMSILNTARS

SEQ ID NO: 713841 - protein, 20 aa, Mycobacterium
QDTESWTRKSILNSAYSGKF

SEQ ID NO: 713842 - protein, 21 aa, Mycobacterium
QDTEWLRARVTTVQQDAHGVT

SEQ ID NO: 713843 - protein, 24 aa, Mycobacterium
QDTFTAGYNWPLLQASGLTTITNT

SEQ ID NO: 713844 - protein, 17 aa, Mycobacterium
QDTRLTWEERRMRREVR

SEQ ID NO: 713845 - protein, 22 aa, Mycobacterium
QDTRYPVQIVWGVRDTMLSWRR

SEQ ID NO: 713846 - protein, 18 aa, Mycobacterium
QDVFPMTLLGTFSPYMVV

SEQ ID NO: 713847 - protein, 17 aa, Mycobacterium
QDVKIAFQMLVYPMLDD

SEQ ID NO: 713848 - protein, 26 aa, Mycobacterium
QDVSLPELGGFRWLTVGPPGQEDVSI

SEQ ID NO: 713849 - protein, 20 aa, Mycobacterium
QDVSTAWQLDAYRFEIPVLA

SEQ ID NO: 713850 - protein, 22 aa, Mycobacterium
QDWGGLIGLRLAAEHPDRFANI

SEQ ID NO: 713851 - protein, 17 aa, Mycobacterium
QDWGSLIGLRIAAERGD

SEQ ID NO: 713852 - protein, 18 aa, Mycobacterium
QDWMAGRIGHHIHDPYDL

SEQ ID NO: 713853 - protein, 24 aa, Mycobacterium
QDWWPADFGNYGPMFIRMAWHAAG

SEQ ID NO: 713854 - protein, 32 aa, Mycobacterium
QDWWPADYGHYGGLFIRMSWHSAGTYRIHDGR

SEQ ID NO: 713855 - protein, 23 aa, Mycobacterium
QDYAWKRITRYIGENGHLRLPRE

SEQ ID NO: 713856 - protein, 26 aa, Mycobacterium
QDYGAPVGWRLALRDPAAITAIITQN

SEQ ID NO: 713857 - protein, 18 aa, Mycobacterium
QDYGDVGYGWAMEDTTGF

SEQ ID NO: 713858 - protein, 22 aa, Mycobacterium
QDYPRFHAVMGERSREVFDKAL

SEQ ID NO: 713859 - protein, 21 aa, Mycobacterium
QDYYQRVGVSFELPNHYLRLT

SEQ ID NO: 713860 - protein, 29 aa, Mycobacterium
QEACWAWRRLRIPVIALIHGRCYGGGLQL

SEQ ID NO: 713861 - protein, 22 aa, Mycobacterium
QEADFKAGLVIQEVMQTKPGRQ

SEQ ID NO: 713862 - protein, 27 aa, Mycobacterium
QEAEDFAALLLYRLGRLPSDRASIVQV

SEQ ID NO: 713863 - protein, 27 aa, Mycobacterium
QEAEDFAALLLYRLGRLPSDRSSIVQV

SEQ ID NO: 713864 - protein, 24 aa, Mycobacterium
QEAESLGVFAPIERLIGRPLFGNG

SEQ ID NO: 713865 - protein, 17 aa, Mycobacterium
QEAHGLGYCNITKCCTE

SEQ ID NO: 713866 - protein, 28 aa, Mycobacterium
QEAIRRYGLADAREAVHLALRTLLAEGG

SEQ ID NO: 713867 - protein, 25 aa, Mycobacterium
QEAKDRWSSAIPLGRPGAADEVSAV

SEQ ID NO: 713868 - protein, 17 aa, Mycobacterium
QEALAFGMTKRPNALRF

SEQ ID NO: 713869 - protein, 17 aa, Mycobacterium
QEALEALNASGFNAVHV

SEQ ID NO: 713870 - protein, 24 aa, Mycobacterium
QEALPRWRRIADGLMHTRTRDAEA

SEQ ID NO: 713871 - protein, 25 aa, Mycobacterium
QEALPRWRRMVEGFRHSKTRDSEAI

SEQ ID NO: 713872 - protein, 20 aa, Mycobacterium
QEALRPGAVEEVLRWASPVA

SEQ ID NO: 713873 - protein, 20 aa, Mycobacterium
QEAPEGLAEFASAAAQAAHG

SEQ ID NO: 713874 - protein, 22 aa, Mycobacterium
QEAPGGLAARAVLAGRAGPPTV

SEQ ID NO: 713875 - protein, 20 aa, Mycobacterium
QEAPLYYNAEFDFYAVSRYA

SEQ ID NO: 713876 - protein, 25 aa, Mycobacterium
QEAQALLGYQLWLGVHEQLSGDQGA

SEQ ID NO: 713877 - protein, 17 aa, Mycobacterium
QEARGALTTALPAPAVR

SEQ ID NO: 713878 - protein, 21 aa, Mycobacterium
QEARGRTGVLVGGRATWEDAY

SEQ ID NO: 713879 - protein, 22 aa, Mycobacterium
QEARLRGGVFGRLADANGLDGL

SEQ ID NO: 713880 - protein, 25 aa, Mycobacterium
QEAVDRWWWPALMMFGPPDADSPNT

SEQ ID NO: 713881 - protein, 19 aa, Mycobacterium
QEAWIRWAGQEAPIENLQA

SEQ ID NO: 713882 - protein, 20 aa, Mycobacterium
QEAWLRLNATTDRPQGAQEL

SEQ ID NO: 713883 - protein, 18 aa, Mycobacterium
QEAWLRWDTYDREIDDLR

SEQ ID NO: 713884 - protein, 18 aa, Mycobacterium
QEAWLRWEGQDAQITDLR

SEQ ID NO: 713885 - protein, 17 aa, Mycobacterium
QECPGAVASAARITGMT

SEQ ID NO: 713886 - protein, 18 aa, Mycobacterium
QECRSCDALIHPPQPICR

SEQ ID NO: 713887 - protein, 18 aa, Mycobacterium
QEDIPLPAVLAVYNVAAR

SEQ ID NO: 713888 - protein, 19 aa, Mycobacterium
QEDIVNRWTWIPFGAGRHR

SEQ ID NO: 713889 - protein, 18 aa, Mycobacterium
QEDKRWTPQWTDDQRAAG

SEQ ID NO: 713890 - protein, 18 aa, Mycobacterium
QEDKRWTPQWTDEQRAAG

SEQ ID NO: 713891 - protein, 20 aa, Mycobacterium
QEDSRLLVDVMHETGLIPGR

SEQ ID NO: 713892 - protein, 23 aa, Mycobacterium
QEEAGLRAGTWRVLVDLNSAPGF

SEQ ID NO: 713893 - protein, 18 aa, Mycobacterium
QEEFDFRHLVGVVSVMGD

SEQ ID NO: 713894 - protein, 24 aa, Mycobacterium
QEEFPRIDPAVICLVHDGHDRAVL

SEQ ID NO: 713895 - protein, 25 aa, Mycobacterium
QEELESLFLGYGYRPITVAGDDPAN

SEQ ID NO: 713896 - protein, 26 aa, Mycobacterium
QEELRRAGEAFADIARMYTDVDTTAA

SEQ ID NO: 713897 - protein, 26 aa, Mycobacterium
QEELTRAGAAFAEIAGIYNAVDAANA

SEQ ID NO: 713898 - protein, 23 aa, Mycobacterium
QEELVRTGAAFRQVAQSYTDVDE

SEQ ID NO: 713899 - protein, 18 aa, Mycobacterium
QEELWLLRGGDPDRPGML

SEQ ID NO: 713900 - protein, 21 aa, Mycobacterium
QEELWLLRGGDPQRPGLLSAE

SEQ ID NO: 713901 - protein, 25 aa, Mycobacterium
QEEMARTGVALTDIARMYAQVDGET

SEQ ID NO: 713902 - protein, 17 aa, Mycobacterium
QEFDFYEIHEAFASVVL

SEQ ID NO: 713903 - protein, 17 aa, Mycobacterium
QEFEGGVGRPARAQPGG

SEQ ID NO: 713904 - protein, 18 aa, Mycobacterium
QEFFQYLPTTSMSPQPRE

SEQ ID NO: 713905 - protein, 24 aa, Mycobacterium
QEFIERGWGAWGFAPYTDLMAATD

SEQ ID NO: 713906 - protein, 27 aa, Mycobacterium
QEFNRCPDCGRIYWAGSHHARLVRQVE

SEQ ID NO: 713907 - protein, 21 aa, Mycobacterium
QEFPPPLPYKGNRDPKVFQPY

SEQ ID NO: 713908 - protein, 23 aa, Mycobacterium
QEFRKCIECFLCQNVCHVVRDHE

SEQ ID NO: 713909 - protein, 17 aa, Mycobacterium
QEFSDWQSCVADRDATI

SEQ ID NO: 713910 - protein, 28 aa, Mycobacterium
QEGDFLALRAFCPQACYAGGPSNFRYLL

SEQ ID NO: 713911 - protein, 26 aa, Mycobacterium
QEGDRGVSWLPFFHDMGLITVLLTSV

SEQ ID NO: 713912 - protein, 22 aa, Mycobacterium
QEGMPLAGLILNRTHPTLSSLT

SEQ ID NO: 713913 - protein, 19 aa, Mycobacterium
QEGPFAKWLEHWDPDNDVF

SEQ ID NO: 713914 - protein, 17 aa, Mycobacterium
QEGRDDLALRIAVQPGG

SEQ ID NO: 713915 - protein, 22 aa, Mycobacterium
QEGRDDLALRIAVQPGGCAGLR

SEQ ID NO: 713916 - protein, 20 aa, Mycobacterium
QEGRSLPVPLIIGTNKHEAA

SEQ ID NO: 713917 - protein, 21 aa, Mycobacterium
QEGVLRLVIPVAERAKPRKIS

SEQ ID NO: 713918 - protein, 17 aa, Mycobacterium
QEHCWRVGVVAQSHATV

SEQ ID NO: 713919 - protein, 18 aa, Mycobacterium
QEHFFDFIVTARRGDDDS

SEQ ID NO: 713920 - protein, 19 aa, Mycobacterium
QEIADWSIVAELLRPEEDS

SEQ ID NO: 713921 - protein, 23 aa, Mycobacterium
QEIAKRLAAQIGDQIVLNTRVRQ

SEQ ID NO: 713922 - protein, 18 aa, Mycobacterium
QEIDGGAYAAFLADTPGC

SEQ ID NO: 713923 - protein, 25 aa, Mycobacterium
QEIDLRYADALSMADNVMTFRNVVK

SEQ ID NO: 713924 - protein, 24 aa, Mycobacterium
QEIDLRYADALSMADNVMTFRYLV

SEQ ID NO: 713925 - protein, 25 aa, Mycobacterium
QEIDLRYADALSMADNVMTFRYLVK

SEQ ID NO: 713926 - protein, 17 aa, Mycobacterium
QEIDPSRLRECVDAFSS

SEQ ID NO: 713927 - protein, 29 aa, Mycobacterium
QEIFDQLAALGIDLTDVFLVLENEGVEKF

SEQ ID NO: 713928 - protein, 17 aa, Mycobacterium
QEIGWWLFLQRHHTDGV

SEQ ID NO: 713929 - protein, 21 aa, Mycobacterium
QEILFKRYAELSASQPTPKST

SEQ ID NO: 713930 - protein, 20 aa, Mycobacterium
QEILFPALLPRAPYEATNRW

SEQ ID NO: 713931 - protein, 20 aa, Mycobacterium
QEILFPALLPRAPYETTNRW

SEQ ID NO: 713932 - protein, 17 aa, Mycobacterium
QEIRLHAPLPPAGKLSV

SEQ ID NO: 713933 - protein, 19 aa, Mycobacterium
QEIRQALLALQRVAERGAG

SEQ ID NO: 713934 - protein, 21 aa, Mycobacterium
QEITRELAERGVLVGERTSYC

SEQ ID NO: 713935 - protein, 24 aa, Mycobacterium
QEITRGRCAAIAVPHQGMEKLVVI

SEQ ID NO: 713936 - protein, 23 aa, Mycobacterium
QEITRGRCAAISVPSDRSTEKLV

SEQ ID NO: 713937 - protein, 23 aa, Mycobacterium
QEITRSRCAAISVPGDRSTEKLV

SEQ ID NO: 713938 - protein, 17 aa, Mycobacterium
QEIWRRMEAAGDIYLDS

SEQ ID NO: 713939 - protein, 19 aa, Mycobacterium
QEKHPAWTANLLADPRAKV

SEQ ID NO: 713940 - protein, 19 aa, Mycobacterium
QEKQIWFWLVQGHVDDPAL

SEQ ID NO: 713941 - protein, 24 aa, Mycobacterium
QEKSWKVKRLRNTPRVTIAECDRA

SEQ ID NO: 713942 - protein, 23 aa, Mycobacterium
QELADLLPGCGGLQVVESICGHD

SEQ ID NO: 713943 - protein, 20 aa, Mycobacterium
QELAEYDWRSAEAREKYDQI

SEQ ID NO: 713944 - protein, 19 aa, Mycobacterium
QELEPACAALAARRPDRAD

SEQ ID NO: 713945 - protein, 20 aa, Mycobacterium
QELEPACAALAARRPDRAET

SEQ ID NO: 713946 - protein, 23 aa, Mycobacterium
QELESAAALLAGVGSNVGAAGSA

SEQ ID NO: 713947 - protein, 36 aa, Mycobacterium
QELESFFRGAGWNVIKVVWGREWDVLLHADRDGALV

SEQ ID NO: 713948 - protein, 21 aa, Mycobacterium
QELIKADGFVRGFSSVTPDSN

SEQ ID NO: 713949 - protein, 36 aa, Mycobacterium
QELLEKLCDLFVYSALEADLSWFLMHRHVSTERAKA

SEQ ID NO: 713950 - protein, 19 aa, Mycobacterium
QELLGFGFWWEADVPDAGA

SEQ ID NO: 713951 - protein, 20 aa, Mycobacterium
QELLRRGHEVCMGAPPNLLG

SEQ ID NO: 713952 - protein, 24 aa, Mycobacterium
QELMATRGPAYWLKHNPYAEWYQN

SEQ ID NO: 713953 - protein, 25 aa, Mycobacterium
QELMATRGPAYWLKYNPYAEWYQNT

SEQ ID NO: 713954 - protein, 21 aa, Mycobacterium
QELNPRLIILSISGFGHDGPE

SEQ ID NO: 713955 - protein, 20 aa, Mycobacterium
QELPNRVAIQLNDTHPSIAV

SEQ ID NO: 713956 - protein, 23 aa, Mycobacterium
QELRDLLDVAFRSSNDFIDATIA

SEQ ID NO: 713957 - protein, 24 aa, Mycobacterium
QELREGPCVQSAWEHETVYAEDLA

SEQ ID NO: 713958 - protein, 17 aa, Mycobacterium
QELRFAARSAEFVVASG

SEQ ID NO: 713959 - protein, 20 aa, Mycobacterium
QELRGLSLLGVQTVLCVTGD

SEQ ID NO: 713960 - protein, 30 aa, Mycobacterium; identical to SEQ ID NO: 102427

SEQ ID NO: 713961 - protein, 30 aa, Mycobacterium
QELRKISIIEAKGYCYGWHFYQAGDADLVV

SEQ ID NO: 713962 - protein, 21 aa, Mycobacterium
QELTKLAGLPGMPDFLREDDV

SEQ ID NO: 713963 - protein, 18 aa, Mycobacterium
QELWEWLHYEEGIPISRR

SEQ ID NO: 713964 - protein, 21 aa, Mycobacterium
QELWMINGLVPPPMNSAAERE

SEQ ID NO: 713965 - protein, 19 aa, Mycobacterium
QELWWGREDFISELVNDHV

SEQ ID NO: 713966 - protein, 23 aa, Mycobacterium
QELYLPDVIAILRRDGQTVSARH

SEQ ID NO: 713967 - protein, 19 aa, Mycobacterium
QEMKERFLPATAALDIFWC

SEQ ID NO: 713968 - protein, 17 aa, Mycobacterium
QEMLWNRLCEALTPGNV

SEQ ID NO: 713969 - protein, 20 aa, Mycobacterium
QEMYRLVETFGYGWSDIQRF

SEQ ID NO: 713970 - protein, 23 aa, Mycobacterium
QENRLLRVIARMDGTAFPTTARL

SEQ ID NO: 713971 - protein, 25 aa, Mycobacterium
QENTFAYPSIEAFKKSGLGALPVPR

SEQ ID NO: 713972 - protein, 18 aa, Mycobacterium
QEPALTARTAHPAGTTNA

SEQ ID NO: 713973 - protein, 17 aa, Mycobacterium
QEPFAIDRVRMFFVNDP

SEQ ID NO: 713974 - protein, 23 aa, Mycobacterium
QEPFGQRPFRVHIDPADDGAEVG

SEQ ID NO: 713975 - protein, 20 aa, Mycobacterium
QEPGQFEWLGLDPTNDQLVD

SEQ ID NO: 713976 - protein, 22 aa, Mycobacterium
QEPRLIQAQRVWKNVVLSTSRS

SEQ ID NO: 713977 - protein, 18 aa, Mycobacterium
QEPWGLHEMHVLDPDGIT

SEQ ID NO: 713978 - protein, 19 aa, Mycobacterium
QEQAIKLYAEYQETSEKVL

SEQ ID NO: 713979 - protein, 27 aa, Mycobacterium
QEQFFARLQMVGLFSEPVVREGDNVTD

SEQ ID NO: 713980 - protein, 25 aa, Mycobacterium
QEQRRLMRIYALIRLAYRVLPDRLT

SEQ ID NO: 713981 - protein, 23 aa, Mycobacterium
QERAVLLLAEMHNWRRACFADDE

SEQ ID NO: 713982 - protein, 24 aa, Mycobacterium
QERELIKLATLAAAIAEALRDRGI

SEQ ID NO: 713983 - protein, 25 aa, Mycobacterium
QERGGPGAVCRWCGRAEPALRCARC

SEQ ID NO: 713984 - protein, 24 aa, Mycobacterium
QERGIPFARDIFRYYRSDAAAAIE

SEQ ID NO: 713985 - protein, 19 aa, Mycobacterium
QERGLRPGDRIVLACGEPT

SEQ ID NO: 713986 - protein, 20 aa, Mycobacterium
QERIPLSAIALHADTSALTA

SEQ ID NO: 713987 - protein, 19 aa, Mycobacterium
QERLGWRPVQPGLIADLEK

SEQ ID NO: 713988 - protein, 26 aa, Mycobacterium
QERLIADQVRWIWLLLDDTLRAEGIY

SEQ ID NO: 713989 - protein, 17 aa, Mycobacterium
QERLNISFDRFIRTTDP

SEQ ID NO: 713990 - protein, 25 aa, Mycobacterium
QERMVWHFLMCDDELGLRVGEGLGI

SEQ ID NO: 713991 - protein, 19 aa, Mycobacterium
QERPPSWIFNVRANPEVTV

SEQ ID NO: 713992 - protein, 24 aa, Mycobacterium
QERREFLTDLSLIGGLIIAAADTE

SEQ ID NO: 713993 - protein, 18 aa, Mycobacterium
QERRHFAKVMPRDFKRVL

SEQ ID NO: 713994 - protein, 23 aa, Mycobacterium
QERRKWLPVHPVGRRTWPNGRVT

SEQ ID NO: 713995 - protein, 24 aa, Mycobacterium
QERRTDWLNNFYFGGDHGVSDSVA

SEQ ID NO: 713996 - protein, 24 aa, Mycobacterium
QERRTDWLNNFYFGGEHGVADSVA

SEQ ID NO: 713997 - protein, 24 aa, Mycobacterium
QERRTDWLNRFYFGGDHGVADSVA

SEQ ID NO: 713998 - protein, 17 aa, Mycobacterium
QERSNGCSYADSPHHVP

SEQ ID NO: 713999 - protein, 20 aa, Mycobacterium
QERTRLAGIESLWDPGTQAL

SEQ ID NO: 714000 - protein, 17 aa, Mycobacterium
QERVKILSTGGMLDAAR

SEQ ID NO: 714001 - protein, 20 aa, Mycobacterium
QERYPIFFERAYDILPNDGR

SEQ ID NO: 714002 - protein, 23 aa, Mycobacterium
QESQALLGYQLWLATHEKVDRDL

SEQ ID NO: 714003 - protein, 23 aa, Mycobacterium
QESRAGKVLKRILALDDNEVRAT

SEQ ID NO: 714004 - protein, 21 aa, Mycobacterium
QESRLRLVLVRGGLPVPQTQI

SEQ ID NO: 714005 - protein, 25 aa, Mycobacterium
QESTLGLIFHWAKENSRPLVTLEDL

SEQ ID NO: 714006 - protein, 25 aa, Mycobacterium
QESTLGLIFHWAKESNYQLVTLANL

SEQ ID NO: 714007 - protein, 17 aa, Mycobacterium
QETAFRFTDGSGRDAAT

SEQ ID NO: 714008 - protein, 17 aa, Mycobacterium
QETAWQWSTEDHLVIAC

SEQ ID NO: 714009 - protein, 19 aa, Mycobacterium
QETEVCFRNKLQARLDEGS

SEQ ID NO: 714010 - protein, 19 aa, Mycobacterium
QETLLRAWRHPGVIADVDR

SEQ ID NO: 714011 - protein, 22 aa, Mycobacterium
QETRLRLCLVDGGLPEPETQIE

SEQ ID NO: 714012 - protein, 21 aa, Mycobacterium
QETRLRLLLTSAGMRPSHTQI

SEQ ID NO: 714013 - protein, 23 aa, Mycobacterium
QETRLRLVLVRAGLPRPVTQIPV

SEQ ID NO: 714014 - protein, 23 aa, Mycobacterium
QETRLRLVLVRRGLPRPVTQVPV

SEQ ID NO: 714015 - protein, 20 aa, Mycobacterium
QETRTRLLLVKSGFPPPQTQ

SEQ ID NO: 714016 - protein, 21 aa, Mycobacterium
QETRTRLVLITAGLPPEGTQI

SEQ ID NO: 714017 - protein, 26 aa, Mycobacterium
QETVDSWFKKVYDLGVPLNIHANGDA

SEQ ID NO: 714018 - protein, 21 aa, Mycobacterium
QEVAELVAPVLGWSAEDIVRE

SEQ ID NO: 714019 - protein, 18 aa, Mycobacterium
QEVAEQYLSIVLGGITVG

SEQ ID NO: 714020 - protein, 26 aa, Mycobacterium
QEVAVHRWDIGHAYRGWDVDPLDAAL

SEQ ID NO: 714021 - protein, 24 aa, Mycobacterium
QEVCALLAGGGYAEYVAVPAGQVM

SEQ ID NO: 714022 - protein, 22 aa, Mycobacterium
QEVDAEFALPSRRLVQIMVANA

SEQ ID NO: 714023 - protein, 22 aa, Mycobacterium
QEVDCRFCHGSVMVKKLGVNHT

SEQ ID NO: 714024 - protein, 26 aa, Mycobacterium
QEVEALLCREARDGVQKLHGNRLLAP

SEQ ID NO: 714025 - protein, 17 aa, Mycobacterium
QEVFAHHGAALAAGDLD

SEQ ID NO: 714026 - protein, 18 aa, Mycobacterium
QEVLDIAHRFGRREARNG

SEQ ID NO: 714027 - protein, 17 aa, Mycobacterium
QEVLKYGRTSGVELADY

SEQ ID NO: 714028 - protein, 17 aa, Mycobacterium
QEVLLDCYLALQRYQKA

SEQ ID NO: 714029 - protein, 20 aa, Mycobacterium
QEVLLRAWRHPTLVNQTEGS

SEQ ID NO: 714030 - protein, 18 aa, Mycobacterium
QEVLPRLADESYDLLVID

SEQ ID NO: 714031 - protein, 23 aa, Mycobacterium
QEVLRKARIAFEQGDYRWVAQVL

SEQ ID NO: 714032 - protein, 20 aa, Mycobacterium
QEVLSRWQLIIDTVVNGITG

SEQ ID NO: 714033 - protein, 23 aa, Mycobacterium
QEVNLCPNLTVGENILLGREPRR

SEQ ID NO: 714034 - protein, 23 aa, Mycobacterium
QEVPRDGLLRLLVDVQYNRNDVA

SEQ ID NO: 714035 - protein, 20 aa, Mycobacterium
QEVRPGDLFAALPGSTTHGA

SEQ ID NO: 714036 - protein, 24 aa, Mycobacterium
QEVTRGRCVAIAVPDDGGVEKLVV

SEQ ID NO: 714037 - protein, 21 aa, Mycobacterium
QEWAYRLYLNVAKRNLSINIF

SEQ ID NO: 714038 - protein, 17 aa, Mycobacterium
QEWEILLRLAGAVLGTA

SEQ ID NO: 714039 - protein, 20 aa, Mycobacterium
QEWIEGIPLSHIIREGTQEQ

SEQ ID NO: 714040 - protein, 22 aa, Mycobacterium
QEWPPHIKALADAASKRGDASQ

SEQ ID NO: 714041 - protein, 17 aa, Mycobacterium
QEWRSLPVRERITHALV

SEQ ID NO: 714042 - protein, 18 aa, Mycobacterium
QEYGDRGLTVIGVPCNQF

SEQ ID NO: 714043 - protein, 20 aa, Mycobacterium
QEYGLPIAIKAAFGGGGRGM

SEQ ID NO: 714044 - protein, 23 aa, Mycobacterium
QEYIFCPWHQWGFELATGTTAVK

SEQ ID NO: 714045 - protein, 20 aa, Mycobacterium
QEYPRWLHTYNHHRGHTALG

SEQ ID NO: 714046 - protein, 17 aa, Mycobacterium
QEYRISSAAVRSHDFVE

SEQ ID NO: 714047 - protein, 22 aa, Mycobacterium
QEYRPFRALIRAVLRHAGGVRI

SEQ ID NO: 714048 - protein, 24 aa, Mycobacterium
QEYRRKVQLCLDVFETMLNQSSFE

SEQ ID NO: 714049 - protein, 20 aa, Mycobacterium
QEYYHVPSLHPQQVPPDVRD

SEQ ID NO: 714050 - protein, 20 aa, Mycobacterium
QEYYHVPSLHSQQVPTEVRQ

SEQ ID NO: 714051 - protein, 22 aa, Mycobacterium
QFAAPRPGRRIGLVYRSSSGRD

SEQ ID NO: 714052 - protein, 28 aa, Mycobacterium
QFAGAFKPPLRWGMRMTGKKFLREYPYR

SEQ ID NO: 714053 - protein, 26 aa, Mycobacterium
QFAGSGLRTSVQFVGPLSVVDNLLAD

SEQ ID NO: 714054 - protein, 35 aa, Mycobacterium
QFAKGLAHRGVQLWIPQQVVLEWAVHTMGLLSDLR

SEQ ID NO: 714055 - protein, 24 aa, Mycobacterium
QFAPRELVELAVLAESAGMDSATV

SEQ ID NO: 714056 - protein, 19 aa, Mycobacterium
QFASEFEWIAPSGRGLLTH

SEQ ID NO: 714057 - protein, 26 aa, Mycobacterium
QFATYPILAVQGWAAFHDLKLRAVIG

SEQ ID NO: 714058 - protein, 18 aa, Mycobacterium
QFCGVFDAGAAVLGGLLR

SEQ ID NO: 714059 - protein, 20 aa, Mycobacterium
QFDEAYSFGGLPTGRGGKFT

SEQ ID NO: 714060 - protein, 21 aa, Mycobacterium
QFDKPYLLAMANAGPGTNGSQ

SEQ ID NO: 714061 - protein, 18 aa, Mycobacterium
QFDSGGWYLLRPDGLGCQ

SEQ ID NO: 714062 - protein, 18 aa, Mycobacterium
QFDYETFDAAGLRSFLTR

SEQ ID NO: 714063 - protein, 21 aa, Mycobacterium
QFECTFCWTNRAGDPVALTEA

SEQ ID NO: 714064 - protein, 21 aa, Mycobacterium
QFEGFPLLLLTSTGARSGAQR

SEQ ID NO: 714065 - protein, 23 aa, Mycobacterium
QFEGFPLMLLTSIGAKSGAERVN

SEQ ID NO: 714066 - protein, 22 aa, Mycobacterium
QFEISGPMPAVLGKSNNYPRSV

SEQ ID NO: 714067 - protein, 17 aa, Mycobacterium
QFEKDVQAAREYFLQHV

SEQ ID NO: 714068 - protein, 23 aa, Mycobacterium
QFEQHLRAVLDYPLGSTEPLAPV

SEQ ID NO: 714069 - protein, 17 aa, Mycobacterium
QFETNFWGVYNVSKAAL

SEQ ID NO: 714070 - protein, 20 aa, Mycobacterium
QFGGRIELGYDLHRVQVDAL

SEQ ID NO: 714071 - protein, 23 aa, Mycobacterium
QFGLPEVKRGLIAAAGGVFRIAQ

SEQ ID NO: 714072 - protein, 21 aa, Mycobacterium
QFGPYRLRRLVGRGGMGDVYE

SEQ ID NO: 714073 - protein, 22 aa, Mycobacterium
QFGQRLAAFVVPRPGSDVDAAV

SEQ ID NO: 714074 - protein, 18 aa, Mycobacterium
QFGRAIGSFQAIKHRCAD

SEQ ID NO: 714075 - protein, 25 aa, Mycobacterium
QFGTEVIAVGLVRIGEAAITQPGGL

SEQ ID NO: 714076 - protein, 17 aa, Mycobacterium
QFGYLEFHGETGAVKAA

SEQ ID NO: 714077 - protein, 18 aa, Mycobacterium
QFHIPPLPYMQGAPLTDP

SEQ ID NO: 714078 - protein, 19 aa, Mycobacterium
QFHPGVTYHHYRLGQAGKT

SEQ ID NO: 714079 - protein, 19 aa, Mycobacterium
QFIDRASVAGAFPEGGTDL

SEQ ID NO: 714080 - protein, 25 aa, Mycobacterium
QFILAEIFPGGWLPTIPTVEEHATT

SEQ ID NO: 714081 - protein, 26 aa, Mycobacterium
QFIPDIRRFGATYANYVGKPLSYILA

SEQ ID NO: 714082 - protein, 23 aa, Mycobacterium
QFISSGFPINMLSYLAQNTSAQA

SEQ ID NO: 714083 - protein, 28 aa, Mycobacterium
QFKSYRGMGSLGAMAGRGGAGGGAKSYS

SEQ ID NO: 714084 - protein, 33 aa, Mycobacterium
QFLGACFDAGLSWVHFPEGFGGLGVSRGLQAVA

SEQ ID NO: 714085 - protein, 28 aa, Mycobacterium
QFLSEVRPDIMAWKHRKLIMNLGNGVTA

SEQ ID NO: 714086 - protein, 27 aa, Mycobacterium
QFLSIAKFRAARVLWARVAEVAGAPDA

SEQ ID NO: 714087 - protein, 17 aa, Mycobacterium
QFLVDALDTHIRQWQSG

SEQ ID NO: 714088 - protein, 18 aa, Mycobacterium
QFLYREARYLDDREFEKW

SEQ ID NO: 714089 - protein, 39 aa, Mycobacterium
QFMERRVAPRWWPPVMKKYVWPWLAARRQIVVNCYPAHV

SEQ ID NO: 714090 - protein, 24 aa, Mycobacterium
QFNEWNHRCYGLWSGDGMVPPAHL

SEQ ID NO: 714091 - protein, 24 aa, Mycobacterium
QFNLSVGVTDEFLRAVGRGGSHRL

SEQ ID NO: 714092 - protein, 21 aa, Mycobacterium
QFPAYELTALIAGDLSKVDAK

SEQ ID NO: 714093 - protein, 21 aa, Mycobacterium
QFPAYELTALIPGDLSKVDAK

SEQ ID NO: 714094 - protein, 19 aa, Mycobacterium
QFPAYQLTALIGGDLSKVD

SEQ ID NO: 714095 - protein, 18 aa, Mycobacterium
QFPAYSLTALIGGDLSKV

SEQ ID NO: 714096 - protein, 25 aa, Mycobacterium
QFPDEFRIQLAWLRQSPPDSANPAW

SEQ ID NO: 714097 - protein, 18 aa, Mycobacterium
QFPEYDLTAVVGGDLSKV

SEQ ID NO: 714098 - protein, 20 aa, Mycobacterium
QFPGCAVVISHDRWFLDRTC

SEQ ID NO: 714099 - protein, 19 aa, Mycobacterium
QFPHLVERLILVAAGGVTK

SEQ ID NO: 714100 - protein, 23 aa, Mycobacterium
QFPISQMVEFGWISQPADWHEQI

SEQ ID NO: 714101 - protein, 21 aa, Mycobacterium
QFPLTEFQKGLDLVASGKESV

SEQ ID NO: 714102 - protein, 21 aa, Mycobacterium
QFPRVRLRATVTFAPVAAGTR

SEQ ID NO: 714103 - protein, 19 aa, Mycobacterium
QFQFRSAATTSEYAARGNA

SEQ ID NO: 714104 - protein, 18 aa, Mycobacterium
QFQRFRPLLQQLSTTTPT

SEQ ID NO: 714105 - protein, 18 aa, Mycobacterium
QFRACLDPFTALAVAAAA

SEQ ID NO: 714106 - protein, 21 aa, Mycobacterium
QFRELESFAAFASDLDATSKA

SEQ ID NO: 714107 - protein, 27 aa, Mycobacterium
QFRNLLCELDRATAMGIFTERLNALCA

SEQ ID NO: 714108 - protein, 18 aa, Mycobacterium
QFRPAELTKKVGTIEMFT

SEQ ID NO: 714109 - protein, 19 aa, Mycobacterium
QFRSRRFVRVLGRHEMVGS

SEQ ID NO: 714110 - protein, 22 aa, Mycobacterium
QFRTAGMPDDWINFGEFYQSVC

SEQ ID NO: 714111 - protein, 18 aa, Mycobacterium
QFRVPRKVVKGGSFLCAD

SEQ ID NO: 714112 - protein, 17 aa, Mycobacterium
QFRYYIKDAPIISDAEF

SEQ ID NO: 714113 - protein, 17 aa, Mycobacterium
QFSCAFGAARDGEHAAG

SEQ ID NO: 714114 - protein, 20 aa, Mycobacterium
QFSFPARGILTSRFGARWGT

SEQ ID NO: 714115 - protein, 18 aa, Mycobacterium
QFSIASGVKVYFADPKSP

SEQ ID NO: 714116 - protein, 21 aa, Mycobacterium
QFSSLMEPLMKAMEGAKGGGG

SEQ ID NO: 714117 - protein, 20 aa, Mycobacterium
QFTAMAWSLMKLATLHRTIR

SEQ ID NO: 714118 - protein, 19 aa, Mycobacterium
QFTAMAWSLMKLTTLHRTI

SEQ ID NO: 714119 - protein, 22 aa, Mycobacterium
QFTANPWLAGYMQQALGLLTTE

SEQ ID NO: 714120 - protein, 18 aa, Mycobacterium
QFTDGLHRLIAWLEQVGL

SEQ ID NO: 714121 - protein, 31 aa, Mycobacterium; identical to SEQ ID NO: 102444

SEQ ID NO: 714122 - protein, 24 aa, Mycobacterium
QFTLHPGDIFLLGTPAYRPAGDES

SEQ ID NO: 714123 - protein, 22 aa, Mycobacterium
QFTPESSWHVYAFADPELADTM

SEQ ID NO: 714124 - protein, 18 aa, Mycobacterium
QFTVAWPTGEIGGMGLEG

SEQ ID NO: 714125 - protein, 20 aa, Mycobacterium
QFTYPLGPGRSFRISHGADY

SEQ ID NO: 714126 - protein, 24 aa, Mycobacterium
QFVACPFGAAGSRMYRTGDLVCWG

SEQ ID NO: 714127 - protein, 25 aa, Mycobacterium
QFVALKGAAVLLTFQRVADHQPPQW

SEQ ID NO: 714128 - protein, 18 aa, Mycobacterium
QFVDLDLTVVVAGRDDPL

SEQ ID NO: 714129 - protein, 26 aa, Mycobacterium
QFVDSMATSAWQWADRARQGVETLID

SEQ ID NO: 714130 - protein, 19 aa, Mycobacterium
QFVERATIEPGDFDPAIAD

SEQ ID NO: 714131 - protein, 17 aa, Mycobacterium
QFVPAMFTRMLKLPESI

SEQ ID NO: 714132 - protein, 17 aa, Mycobacterium
QFVPAMFTRMLKLPESV

SEQ ID NO: 714133 - protein, 25 aa, Mycobacterium
QFVQALNAGANWYAGVESANSSTLQ

SEQ ID NO: 714134 - protein, 19 aa, Mycobacterium
QFVRFEGLIDHAAGITANT

SEQ ID NO: 714135 - protein, 18 aa, Mycobacterium
QFVSLVRSNLFGFNAPAI

SEQ ID NO: 714136 - protein, 22 aa, Mycobacterium
QFVSSPGYEHAWLNPDNTEVSI

SEQ ID NO: 714137 - protein, 24 aa, Mycobacterium
QFVSSPGYEHAWLNPDNTEVSIED

SEQ ID NO: 714138 - protein, 23 aa, Mycobacterium
QFVSSPGYEHAWLNPDNTEVSLE

SEQ ID NO: 714139 - protein, 24 aa, Mycobacterium
QFVSSPGYEHAWLNPDNTEVSVED

SEQ ID NO: 714140 - protein, 17 aa, Mycobacterium
QFWPAHSTVALSVGGVS

SEQ ID NO: 714141 - protein, 23 aa, Mycobacterium
QFYAEFLKGVGLEGADLPGQNDM

SEQ ID NO: 714142 - protein, 27 aa, Mycobacterium
QFYHPLDMFGEWNRAYGAAGFTQYQFV

SEQ ID NO: 714143 - protein, 27 aa, Mycobacterium
QFYHPLDMFGEWNRAYGSAGFLQYQFV

SEQ ID NO: 714144 - protein, 20 aa, Mycobacterium
QFYHRWYYSHALRLLQGPFL

SEQ ID NO: 714145 - protein, 21 aa, Mycobacterium
QGAAFLGRPASVWWVNQGASY

SEQ ID NO: 714146 - protein, 20 aa, Mycobacterium
QGAERLRLIGAVNYLGVVDL

SEQ ID NO: 714147 - protein, 17 aa, Mycobacterium
QGAEWERLADLLVADTA

SEQ ID NO: 714148 - protein, 26 aa, Mycobacterium
QGAFPYRNDGALGWAGTSPVGTFPAN

SEQ ID NO: 714149 - protein, 20 aa, Mycobacterium
QGAGYLPVLVLFDHEEVGSS

SEQ ID NO: 714150 - protein, 18 aa, Mycobacterium
QGALAITGIPAFKAPFEP

SEQ ID NO: 714151 - protein, 18 aa, Mycobacterium
QGALAITGLPAFKAPFEP

SEQ ID NO: 714152 - protein, 23 aa, Mycobacterium
QGALPPGMGVPGQRGPSHPGTGQ

SEQ ID NO: 714153 - protein, 18 aa, Mycobacterium
QGALSITGIPAFKAPFEP

SEQ ID NO: 714154 - protein, 29 aa, Mycobacterium
QGAPYWLPRNIEADLDLPSGGRVRYRKIR

SEQ ID NO: 714155 - protein, 18 aa, Mycobacterium
QGAQRFAPINSWPDNVSL

SEQ ID NO: 714156 - protein, 24 aa, Mycobacterium
QGARFCDSCGTAIVDGSKHAEYKQ

SEQ ID NO: 714157 - protein, 24 aa, Mycobacterium
QGARLQRWIELEAPDGMFDNHLLR

SEQ ID NO: 714158 - protein, 35 aa, Mycobacterium
QGARLRLLTELDRPDTVGFAFHFGDQPFGRVVTDA

SEQ ID NO: 714159 - protein, 24 aa, Mycobacterium
QGARVLLGKFVEFWERKLTEGGFN

SEQ ID NO: 714160 - protein, 17 aa, Mycobacterium
QGASLIRVGPRGYRELI

SEQ ID NO: 714161 - protein, 29 aa, Mycobacterium
QGAVPRLPAPPLPRVRMVPRRNAPTANPG

SEQ ID NO: 714162 - protein, 24 aa, Mycobacterium
QGAWMCGAAVTMLHQPTHRSDLQA

SEQ ID NO: 714163 - protein, 24 aa, Mycobacterium
QGAWPRFGLELPELLPEKLSGVKR

SEQ ID NO: 714164 - protein, 26 aa, Mycobacterium
QGDADAWRPVFARLAELGIFGVAIPE

SEQ ID NO: 714165 - protein, 22 aa, Mycobacterium
QGDHLWMIYLMRVVDAQVVLNK

SEQ ID NO: 714166 - protein, 20 aa, Mycobacterium
QGDIDFRIVTKIATRTELVD

SEQ ID NO: 714167 - protein, 26 aa, Mycobacterium
QGDLDGGAWERLNVKRAWSVCMRMTL

SEQ ID NO: 714168 - protein, 28 aa, Mycobacterium
QGDPGESRFYLSLGDELMRRFNGATLET

SEQ ID NO: 714169 - protein, 25 aa, Mycobacterium
QGDRNVVSVGFNWTMGNHVVPPKPL

SEQ ID NO: 714170 - protein, 17 aa, Mycobacterium
QGDTGMTYQAWQAQWNQ

SEQ ID NO: 714171 - protein, 19 aa, Mycobacterium
QGDTLLVPRLMPHAFGATG

SEQ ID NO: 714172 - protein, 18 aa, Mycobacterium
QGDVWRFVAYLADSGVAD

SEQ ID NO: 714173 - protein, 28 aa, Mycobacterium
QGDWIYIPKACTWRQIPDPGPTGTTTLL

SEQ ID NO: 714174 - protein, 17 aa, Mycobacterium
QGEAAAIERLRPDVAAL

SEQ ID NO: 714175 - protein, 30 aa, Mycobacterium
QGEALPWQDLRAAFTERGWLDLTHTRRDLE

SEQ ID NO: 714176 - protein, 32 aa, Mycobacterium
QGEAYLGGYLHKDIGPAWAFLGWARPGSDWER

SEQ ID NO: 714177 - protein, 18 aa, Mycobacterium
QGEFAATQGCPWYWDAEY

SEQ ID NO: 714178 - protein, 18 aa, Mycobacterium
QGELAWMFLQSISDGGDL

SEQ ID NO: 714179 - protein, 20 aa, Mycobacterium
QGELEGGAWENLNVKRAWSV

SEQ ID NO: 714180 - protein, 18 aa, Mycobacterium
QGENFAFLGGTDWDPSQV

SEQ ID NO: 714181 - protein, 24 aa, Mycobacterium
QGEPFWFPNWTRLVYAGDGLFSSE

SEQ ID NO: 714182 - protein, 25 aa, Mycobacterium
QGEPTLRFAKTMRDSLQAAGLTPAT

SEQ ID NO: 714183 - protein, 20 aa, Mycobacterium
QGESSVACLAELADVAPAVV

SEQ ID NO: 714184 - protein, 32 aa, Mycobacterium
QGEVAYGGEFLRWFSEEAVRINGRYTSSPTGA

SEQ ID NO: 714185 - protein, 24 aa, Mycobacterium
QGFADFYQRCRLVTERLWPTLLEP

SEQ ID NO: 714186 - protein, 18 aa, Mycobacterium
QGFIRKSGSWFTYEGEQL

SEQ ID NO: 714187 - protein, 18 aa, Mycobacterium
QGFLGMAVPEEYGGGGNP

SEQ ID NO: 714188 - protein, 18 aa, Mycobacterium
QGFLLSRPIDSAAMESLL

SEQ ID NO: 714189 - protein, 18 aa, Mycobacterium
QGFLLSRPIPTDAMETLL

SEQ ID NO: 714190 - protein, 17 aa, Mycobacterium
QGFNTLEQWGRFDEAFA

SEQ ID NO: 714191 - protein, 17 aa, Mycobacterium
QGFPPGPPYAGPAGKDF

SEQ ID NO: 714192 - protein, 17 aa, Mycobacterium
QGFSLLVVERGMQGFER

SEQ ID NO: 714193 - protein, 27 aa, Mycobacterium
QGGAGGRAGLLAGLGGAGGDGGLGGNG

SEQ ID NO: 714194 - protein, 22 aa, Mycobacterium
QGGARLHPLFAQLAERGLGLEN

SEQ ID NO: 714195 - protein, 18 aa, Mycobacterium
QGGCCAICGGATTWQGLP

SEQ ID NO: 714196 - protein, 20 aa, Mycobacterium
QGGDAGTFYGDGGVGGAGGA

SEQ ID NO: 714197 - protein, 26 aa, Mycobacterium
QGGFGGRGGNAWGFGNGGAGGAGGML

SEQ ID NO: 714198 - protein, 17 aa, Mycobacterium
QGGFLDFDAAIATPDQM

SEQ ID NO: 714199 - protein, 21 aa, Mycobacterium
QGGGIPSTTGVPGADGGKGGT

SEQ ID NO: 714200 - protein, 32 aa, Mycobacterium
QGGGVFPHLSVRENLRIGGYTLRDKKELDQRI

SEQ ID NO: 714201 - protein, 22 aa, Mycobacterium
QGGHGGNAYLFGDGGAGGQGGT

SEQ ID NO: 714202 - protein, 25 aa, Mycobacterium
QGGIALKPLIARALRMGDEVHSRNA

SEQ ID NO: 714203 - protein, 17 aa, Mycobacterium
QGGIGGFGETGAGDGGS

SEQ ID NO: 714204 - protein, 28 aa, Mycobacterium
QGGLKKAVFDWSIGVGLKVSASRQAGRQ

SEQ ID NO: 714205 - protein, 26 aa, Mycobacterium
QGGNGGKAGFFYGNGGNGGFGGNGAN

SEQ ID NO: 714206 - protein, 17 aa, Mycobacterium
QGGRCHFVQNSAEVYAE

SEQ ID NO: 714207 - protein, 22 aa, Mycobacterium
QGGRSKNWLKFKCVRDQEFVVG

SEQ ID NO: 714208 - protein, 26 aa, Mycobacterium
QGGSLVIRGELRAVPAAAQASLLVLP

SEQ ID NO: 714209 - protein, 25 aa, Mycobacterium
QGGTGGRAGLLIGNAGAGGAGGEGT

SEQ ID NO: 714210 - protein, 19 aa, Mycobacterium
QGGWLGMTIPVEYGGHGLG

SEQ ID NO: 714211 - protein, 17 aa, Mycobacterium
QGGYEGGGYGQGQPYGQ

SEQ ID NO: 714212 - protein, 24 aa, Mycobacterium
QGGYGLDPERIWATVYFDDDEAVQ

SEQ ID NO: 714213 - protein, 22 aa, Mycobacterium
QGHALEVTWSEFGVRLQAIGAH

SEQ ID NO: 714214 - protein, 26 aa, Mycobacterium
QGHASPGIYARAFLEGRLSQDRLDGF

SEQ ID NO: 714215 - protein, 26 aa, Mycobacterium
QGHCPPRQFERARVVVFAGDHGVARS

SEQ ID NO: 714216 - protein, 25 aa, Mycobacterium
QGHCPPRQFQRARVVVFAGDHGVAR

SEQ ID NO: 714217 - protein, 20 aa, Mycobacterium
QGHRCGACRIEIGRGELARI

SEQ ID NO: 714218 - protein, 25 aa, Mycobacterium
QGHRIALLACDFRFLGGSIGIAAGE

SEQ ID NO: 714219 - protein, 17 aa, Mycobacterium
QGHSVVVSINLMHDDPV

SEQ ID NO: 714220 - protein, 26 aa, Mycobacterium
QGIDLRACGLVAVGHRVVHGGNTFYR

SEQ ID NO: 714221 - protein, 21 aa, Mycobacterium
QGIDVTVCKPVQTGDDHDAGE

SEQ ID NO: 714222 - protein, 17 aa, Mycobacterium
QGIGTGISASDRATTMR

SEQ ID NO: 714223 - protein, 20 aa, Mycobacterium
QGIGVAVRFGPARVTRGDAY

SEQ ID NO: 714224 - protein, 18 aa, Mycobacterium
QGILPARRAVVTRYELVD

SEQ ID NO: 714225 - protein, 22 aa, Mycobacterium
QGILVEDWRGAAAKSLQANMSE

SEQ ID NO: 714226 - protein, 17 aa, Mycobacterium
QGIPLDYTRELAEYWAN

SEQ ID NO: 714227 - protein, 18 aa, Mycobacterium
QGIPLSYTRDLAAYWANE

SEQ ID NO: 714228 - protein, 22 aa, Mycobacterium
QGITRGRVAAISVPENSTEKLV

SEQ ID NO: 714229 - protein, 22 aa, Mycobacterium
QGIYQCRACGAELFRSTEKFES

SEQ ID NO: 714230 - protein, 31 aa, Mycobacterium
QGKCIAAGLMLCWPCDLIVAADNARFSDPVG

SEQ ID NO: 714231 - protein, 19 aa, Mycobacterium
QGKEEFDIELGPVVVNFLL

SEQ ID NO: 714232 - protein, 26 aa, Mycobacterium
QGKFPYRNDGALGWVGTSPVGTFPPN

SEQ ID NO: 714233 - protein, 17 aa, Mycobacterium
QGKGSQIFTQWSPEGWV

SEQ ID NO: 714234 - protein, 24 aa, Mycobacterium
QGKHLWMIYLMRIVDAQVVFDKPG

SEQ ID NO: 714235 - protein, 20 aa, Mycobacterium
QGKHLWMVYLMRVVDAQVVL

SEQ ID NO: 714236 - protein, 19 aa, Mycobacterium
QGKLADKVYAGFTSSNTVH

SEQ ID NO: 714237 - protein, 19 aa, Mycobacterium
QGKPIVGFVGRLAPEKHVE

SEQ ID NO: 714238 - protein, 20 aa, Mycobacterium
QGKSALPFRPHDDLIVITPF

SEQ ID NO: 714239 - protein, 21 aa, Mycobacterium
QGKSTLALDFMRSCSIKHGHA

SEQ ID NO: 714240 - protein, 17 aa, Mycobacterium
QGLAARCLSDIVSAATQ

SEQ ID NO: 714241 - protein, 17 aa, Mycobacterium
QGLAQGYALRLADRLVD

SEQ ID NO: 714242 - protein, 19 aa, Mycobacterium
QGLAQGYALRLAHRLVDAV

SEQ ID NO: 714243 - protein, 17 aa, Mycobacterium
QGLAQGYALRLTDRLVD

SEQ ID NO: 714244 - protein, 21 aa, Mycobacterium
QGLDLTRLDLVIIENVGNLVC

SEQ ID NO: 714245 - protein, 25 aa, Mycobacterium
QGLEAAKPFIAALCTAQQELADACG

SEQ ID NO: 714246 - protein, 25 aa, Mycobacterium
QGLEAAKPFIAALCTAQQELADASG

SEQ ID NO: 714247 - protein, 18 aa, Mycobacterium
QGLGACFTSWAAYQGEQI

SEQ ID NO: 714248 - protein, 18 aa, Mycobacterium
QGLGACFTSWASYDGEKI

SEQ ID NO: 714249 - protein, 17 aa, Mycobacterium
QGLGGVYSDIYLPLHGE

SEQ ID NO: 714250 - protein, 26 aa, Mycobacterium
QGLGGWFRLGLIANERKAWVHALLCG

SEQ ID NO: 714251 - protein, 19 aa, Mycobacterium
QGLGSLGQISVGWYDHGPG

SEQ ID NO: 714252 - protein, 25 aa, Mycobacterium
QGLGVREFLDYDLAEVREYIDWQPF

SEQ ID NO: 714253 - protein, 24 aa, Mycobacterium
QGLHRLWPPLIDFTHRAVADIGHP

SEQ ID NO: 714254 - protein, 22 aa, Mycobacterium
QGLHRQRIVVVLAVGERGDGQA

SEQ ID NO: 714255 - protein, 23 aa, Mycobacterium
QGLLELRPPALLVGREHPDMPSL

SEQ ID NO: 714256 - protein, 26 aa, Mycobacterium
QGLPISIDIIRFVKFIVTEIFPGGRL

SEQ ID NO: 714257 - protein, 20 aa, Mycobacterium
QGLPMLGHMVEMFRGGIDWV

SEQ ID NO: 714258 - protein, 25 aa, Mycobacterium
QGLQIKTIWAARAISVLFPQISTIY

SEQ ID NO: 714259 - protein, 17 aa, Mycobacterium
QGLRADDAMIMFTGGTT

SEQ ID NO: 714260 - protein, 24 aa, Mycobacterium
QGLRLAQELTPWPAVDGQRIGAVS

SEQ ID NO: 714261 - protein, 21 aa, Mycobacterium
QGLRLRLGVRAERIDRDGAGW

SEQ ID NO: 714262 - protein, 18 aa, Mycobacterium
QGLSNFWSATTASVNQFI

SEQ ID NO: 714263 - protein, 25 aa, Mycobacterium
QGLTDRLRRSFGRMPWTTTQKRLPR

SEQ ID NO: 714264 - protein, 17 aa, Mycobacterium
QGLVKRMLLGSVSTGLV

SEQ ID NO: 714265 - protein, 19 aa, Mycobacterium
QGLWAAHLRPELGGQGFGQ

SEQ ID NO: 714266 - protein, 29 aa, Mycobacterium
QGLYECAGAERWLAISVATDEQWRQLKRA

SEQ ID NO: 714267 - protein, 23 aa, Mycobacterium
QGMDFLHGRWLVLRRGKRNVAGV

SEQ ID NO: 714268 - protein, 18 aa, Mycobacterium
QGMQRFAPLNSWPDNVSL

SEQ ID NO: 714269 - protein, 24 aa, Mycobacterium
QGNKCGACRIELDRGELARISAAD

SEQ ID NO: 714270 - protein, 26 aa, Mycobacterium
QGNLDPAVLLAGWPVVESEVRRIVAE

SEQ ID NO: 714271 - protein, 23 aa, Mycobacterium
QGNQRYLGRWSMISEYIGSAMLN

SEQ ID NO: 714272 - protein, 22 aa, Mycobacterium
QGPAWELPHTDYVTFLVGDPSN

SEQ ID NO: 714273 - protein, 20 aa, Mycobacterium
QGPCAFVASTLEREGRAVWR

SEQ ID NO: 714274 - protein, 27 aa, Mycobacterium
QGPGIDLRPFWTLGVAALMRDLAADEV

SEQ ID NO: 714275 - protein, 18 aa, Mycobacterium
QGPNQWPAALPELPAVIA

SEQ ID NO: 714276 - protein, 17 aa, Mycobacterium
QGPRTYLGLSVDGFPNL

SEQ ID NO: 714277 - protein, 29 aa, Mycobacterium
QGPTATPCGVCDSCQALAPNAPGSIDVVE

SEQ ID NO: 714278 - protein, 24 aa, Mycobacterium
QGPVRFPGVPTWFSRTPGRVAGPA

SEQ ID NO: 714279 - protein, 26 aa, Mycobacterium
QGQCPPRQFQRARVVVFAGDHGVTRS

SEQ ID NO: 714280 - protein, 18 aa, Mycobacterium
QGQFDVLAGFIADEMEYV

SEQ ID NO: 714281 - protein, 17 aa, Mycobacterium
QGQICLNARKILVHRDI

SEQ ID NO: 714282 - protein, 23 aa, Mycobacterium
QGRAPVLYCRFHGWRYKLDGSLH

SEQ ID NO: 714283 - protein, 28 aa, Mycobacterium
QGRAVFTPGLAGLVLGEFRRIEQSSPAG

SEQ ID NO: 714284 - protein, 18 aa, Mycobacterium
QGRDGLDQYVFFLADSEH

SEQ ID NO: 714285 - protein, 26 aa, Mycobacterium
QGRFPYRNDGALGWHGTSPVGTFPAN

SEQ ID NO: 714286 - protein, 35 aa, Mycobacterium
QGRGLVRLARRVWPDGPWDTLGTRPHLAVAAGAVG

SEQ ID NO: 714287 - protein, 31 aa, Mycobacterium
QGRGLVRLARRVWPDHDWDAVGPTPHVAVAA

SEQ ID NO: 714288 - protein, 23 aa, Mycobacterium
QGRGRGGIRLGVAMEVTGEDPGT

SEQ ID NO: 714289 - protein, 23 aa, Mycobacterium
QGRKAEFAEHGWDADEIPDPQDP

SEQ ID NO: 714290 - protein, 24 aa, Mycobacterium
QGRLARWRHAVALSAAPSARDVVA

SEQ ID NO: 714291 - protein, 23 aa, Mycobacterium
QGRMYRRPFIILGQQYLADPSRS

SEQ ID NO: 714292 - protein, 19 aa, Mycobacterium
QGRPDHFYHPFGLLPSPQH

SEQ ID NO: 714293 - protein, 23 aa, Mycobacterium
QGRPEERPLWVGSIKSNMGHTQA

SEQ ID NO: 714294 - protein, 24 aa, Mycobacterium
QGRQLRFGIRLHVITRDTAGAAWA

SEQ ID NO: 714295 - protein, 23 aa, Mycobacterium
QGRQLRWFGLDGAEHTGGPLVDF

SEQ ID NO: 714296 - protein, 17 aa, Mycobacterium
QGRRILVTGGATGIGAA

SEQ ID NO: 714297 - protein, 19 aa, Mycobacterium
QGRRVHRLAVSHAFHSPLM

SEQ ID NO: 714298 - protein, 17 aa, Mycobacterium
QGRSIEEIFGWPDDLKL

SEQ ID NO: 714299 - protein, 24 aa, Mycobacterium
QGRSLDDFATWCVLAEKHGADWHQ

SEQ ID NO: 714300 - protein, 24 aa, Mycobacterium
QGRSSVSTWLFGIVKHTASRHRRR

SEQ ID NO: 714301 - protein, 27 aa, Mycobacterium
QGRTVIDINVRWKKGQTLEPDWQLDGD

SEQ ID NO: 714302 - protein, 19 aa, Mycobacterium
QGRTVLVSSHLLSEMANTA

SEQ ID NO: 714303 - protein, 21 aa, Mycobacterium
QGRVLASPFGMALVAATVAAG

SEQ ID NO: 714304 - protein, 18 aa, Mycobacterium
QGRVRPLALDRYGVQLRV

SEQ ID NO: 714305 - protein, 21 aa, Mycobacterium
QGRYTFPYLLSALPDLDRLLL

SEQ ID NO: 714306 - protein, 19 aa, Mycobacterium
QGSAASVTLPEGWLDDPDD

SEQ ID NO: 714307 - protein, 17 aa, Mycobacterium
QGSAFCAGADLSGDAFA

SEQ ID NO: 714308 - protein, 22 aa, Mycobacterium
QGSCDMGSFPHELPGYRHVSDD

SEQ ID NO: 714309 - protein, 22 aa, Mycobacterium
QGSEPRLAAGDIVVNCAAITNV

SEQ ID NO: 714310 - protein, 26 aa, Mycobacterium
QGSFPYRNDGALGWVGTSPVGTFAPN

SEQ ID NO: 714311 - protein, 22 aa, Mycobacterium
QGSKAFRDWMTEFSRQWGSFLD

SEQ ID NO: 714312 - protein, 25 aa, Mycobacterium
QGSKPPWRLSMNYYRDMWMARAQPV

SEQ ID NO: 714313 - protein, 24 aa, Mycobacterium
QGSKRPTFAAVHGRGATMVHASDL

SEQ ID NO: 714314 - protein, 18 aa, Mycobacterium
QGSQRFAPLNSWPDNANL

SEQ ID NO: 714315 - protein, 22 aa, Mycobacterium
QGSVGEMFGRKVAKLMEWVAMV

SEQ ID NO: 714316 - protein, 22 aa, Mycobacterium
QGSWTLRSLAAILWAESTDLPD

SEQ ID NO: 714317 - protein, 21 aa, Mycobacterium
QGTESQRAFFYGLVLDGALFA

SEQ ID NO: 714318 - protein, 31 aa, Mycobacterium
QGTGGGVSALFDRPDWQQGFSAPDDGGAQRR

SEQ ID NO: 714319 - protein, 23 aa, Mycobacterium
QGTGPWGAFDLTLGKAMYAGFTL

SEQ ID NO: 714320 - protein, 20 aa, Mycobacterium
QGTKRVWYWAAKSTGGDFSP

SEQ ID NO: 714321 - protein, 17 aa, Mycobacterium
QGTLVVAAHLSFTDTDM

SEQ ID NO: 714322 - protein, 25 aa, Mycobacterium
QGTPSRGAWQFIAPTFAAYHQLGTS

SEQ ID NO: 714323 - protein, 37 aa, Mycobacterium
QGTVGEMFGRKVARLMEWCAMIGCPIIGIQDSGGARI

SEQ ID NO: 714324 - protein, 27 aa, Mycobacterium
QGTVGEMFGRKVARLMEWCAMVACPII

SEQ ID NO: 714325 - protein, 26 aa, Mycobacterium
QGVEASRLFLTQMIQHHRGAITMAQD

SEQ ID NO: 714326 - protein, 29 aa, Mycobacterium
QGVKDYALWPALSLRRWRRTLKANVVANL

SEQ ID NO: 714327 - protein, 26 aa, Mycobacterium
QGVLCGSVVSGLRMRPGNWAGAYACW

SEQ ID NO: 714328 - protein, 20 aa, Mycobacterium
QGVLGGAVAVFPSWETLPHE

SEQ ID NO: 714329 - protein, 21 aa, Mycobacterium
QGVPISAILFGGRRKTTVPLI

SEQ ID NO: 714330 - protein, 22 aa, Mycobacterium
QGVPISAILFGGRRKTTVPLIT

SEQ ID NO: 714331 - protein, 22 aa, Mycobacterium
QGVPISGILFGARRKTTVPLVT

SEQ ID NO: 714332 - protein, 22 aa, Mycobacterium
QGVPISGILFGGRRKTTVPLVT

SEQ ID NO: 714333 - protein, 23 aa, Mycobacterium
QGVPKTGAFWHIDYMFMPEPFAF

SEQ ID NO: 714334 - protein, 20 aa, Mycobacterium
QGVQRFYVWFADFAAADTLA

SEQ ID NO: 714335 - protein, 25 aa, Mycobacterium
QGVRLTGTDAWSWDAPFSYTARRYA

SEQ ID NO: 714336 - protein, 27 aa, Mycobacterium
QGVRPRVWFGEGWITSVLDLYHENIRY

SEQ ID NO: 714337 - protein, 32 aa, Mycobacterium
QGVRRSVLAGVPWPHGWNRAYFTPVTVLDGRA

SEQ ID NO: 714338 - protein, 18 aa, Mycobacterium
QGVSYAWGGNKSVGGPTQ

SEQ ID NO: 714339 - protein, 27 aa, Mycobacterium
QGVVAKIDWSRFLPLYQQAGRRAFLSE

SEQ ID NO: 714340 - protein, 20 aa, Mycobacterium
QGVVFNAHYLTWFDEACTAF

SEQ ID NO: 714341 - protein, 22 aa, Mycobacterium
QGVYQCRACGAELFRSTEKFES

SEQ ID NO: 714342 - protein, 18 aa, Mycobacterium
QGWDMHPGHLVTRWLATF

SEQ ID NO: 714343 - protein, 18 aa, Mycobacterium
QGWGGNGGNGGRGFNGGD

SEQ ID NO: 714344 - protein, 17 aa, Mycobacterium
QGWNCQRALSARSNVVI

SEQ ID NO: 714345 - protein, 25 aa, Mycobacterium
QGWPHRCLPMLIANQSGWEVRNRNA

SEQ ID NO: 714346 - protein, 18 aa, Mycobacterium
QGWSPHWLRHTHATALLL

SEQ ID NO: 714347 - protein, 20 aa, Mycobacterium
QGWVLFPNYFMTIRAGECHV

SEQ ID NO: 714348 - protein, 23 aa, Mycobacterium
QGYARYPNWTAMDMSAFTQDKTP

SEQ ID NO: 714349 - protein, 21 aa, Mycobacterium
QGYLLYRFVDEDTTVVWVQLR

SEQ ID NO: 714350 - protein, 22 aa, Mycobacterium
QGYSRVRVDGVVYPLTDPPKLK

SEQ ID NO: 714351 - protein, 24 aa, Mycobacterium
QGYTRLSWAVLNWNADAITLYDGV

SEQ ID NO: 714352 - protein, 20 aa, Mycobacterium
QHAGPPWFAVSPLMHAAGMW

SEQ ID NO: 714353 - protein, 18 aa, Mycobacterium
QHAGRPFTRTRLMHEAWG

SEQ ID NO: 714354 - protein, 25 aa, Mycobacterium
QHAITVCREACGGAGYLDANQLTIL

SEQ ID NO: 714355 - protein, 19 aa, Mycobacterium
QHAKLWYQVVLGFLNLHVL

SEQ ID NO: 714356 - protein, 20 aa, Mycobacterium
QHAKLWYQVVTAFLDENLRN

SEQ ID NO: 714357 - protein, 19 aa, Mycobacterium
QHALAGLPERLALPTDRPY

SEQ ID NO: 714358 - protein, 18 aa, Mycobacterium
QHALWREAIALVQEGVCD

SEQ ID NO: 714359 - protein, 17 aa, Mycobacterium
QHALWREAMALVAEGVC

SEQ ID NO: 714360 - protein, 18 aa, Mycobacterium
QHAMPASIWSYVAGGAGD

SEQ ID NO: 714361 - protein, 26 aa, Mycobacterium
QHAMPGHLMIAMSAVRAIPYVLARPP

SEQ ID NO: 714362 - protein, 30 aa, Mycobacterium
QHAPAIAATEAHYERMWAQDVAAMADYRAG

SEQ ID NO: 714363 - protein, 22 aa, Mycobacterium
QHARGKGGLVRITWAEATELIA

SEQ ID NO: 714364 - protein, 24 aa, Mycobacterium
QHARKFVADFGIRRFYDVGRHGIS

SEQ ID NO: 714365 - protein, 25 aa, Mycobacterium
QHARTEALPKLFAMVNNGDLQLQTL

SEQ ID NO: 714366 - protein, 19 aa, Mycobacterium
QHAVEGWKQIGAPDVLDVV

SEQ ID NO: 714367 - protein, 22 aa, Mycobacterium
QHCADRMGLGFLANVGTAATAR

SEQ ID NO: 714368 - protein, 21 aa, Mycobacterium
QHCAGFLGSLGTYVLLQNIGE

SEQ ID NO: 714369 - protein, 26 aa, Mycobacterium
QHCGVWPGSHAREFDDLDAIQRTRRC

SEQ ID NO: 714370 - protein, 19 aa, Mycobacterium
QHCKSCRMVGMTEEMIAAI

SEQ ID NO: 714371 - protein, 18 aa, Mycobacterium
QHCMRVMIELGADGDVSR

SEQ ID NO: 714372 - protein, 19 aa, Mycobacterium
QHDIPDWIAKAYIESYRGP

SEQ ID NO: 714373 - protein, 19 aa, Mycobacterium
QHDLFNRDAVFGIQLYVKR

SEQ ID NO: 714374 - protein, 34 aa, Mycobacterium
QHEARRYLDYTLRWRNVPKPSIAAVQGRCISGGL

SEQ ID NO: 714375 - protein, 30 aa, Mycobacterium
QHEGPGDAIGGIGGKGGIGYSGGGNGGTGG

SEQ ID NO: 714376 - protein, 18 aa, Mycobacterium
QHELSERGAVLIHRTRTS

SEQ ID NO: 714377 - protein, 21 aa, Mycobacterium
QHFDHWQALEAIVGKTQSPSA

SEQ ID NO: 714378 - protein, 26 aa, Mycobacterium
QHFLLTEWFARWVGFLVPTHRPMDNM

SEQ ID NO: 714379 - protein, 25 aa, Mycobacterium
QHFPSKLELYLAVLHKHADNLVSSV

SEQ ID NO: 714380 - protein, 25 aa, Mycobacterium
QHFSDAALVLGFERRSWRTNSGPHG

SEQ ID NO: 714381 - protein, 17 aa, Mycobacterium
QHGHCEIVFNDVRVPAE

SEQ ID NO: 714382 - protein, 31 aa, Mycobacterium
QHGKTPAQVLIRWHIQLGNIVIPKSVNPERI

SEQ ID NO: 714383 - protein, 21 aa, Mycobacterium
QHGQLPFPLPGILGHEGSGTV

SEQ ID NO: 714384 - protein, 24 aa, Mycobacterium
QHGQLQRLIGLWEGKGSESANDFL

SEQ ID NO: 714385 - protein, 19 aa, Mycobacterium
QHGTELDKAMLDWGTRELH

SEQ ID NO: 714386 - protein, 21 aa, Mycobacterium
QHGVPAKGWLVGEVHNGIAQM

SEQ ID NO: 714387 - protein, 25 aa, Mycobacterium
QHGWDGALIGTGWGRPDTFTVATAI

SEQ ID NO: 714388 - protein, 27 aa, Mycobacterium
QHGWQWCAGCGTDAAPYFRVFDPTTQG

SEQ ID NO: 714389 - protein, 27 aa, Mycobacterium
QHGWQWCAGCGTDAAPYFRVFNPTSQA

SEQ ID NO: 714390 - protein, 27 aa, Mycobacterium
QHGWQWCAGCGTDAAPYFRVFNPTTQG

SEQ ID NO: 714391 - protein, 17 aa, Mycobacterium
QHHAIRVVFVLRHAWTV

SEQ ID NO: 714392 - protein, 21 aa, Mycobacterium
QHHFKTKAGLRRAVDELVADY

SEQ ID NO: 714393 - protein, 17 aa, Mycobacterium
QHHKWTAWVDGRPLIVF

SEQ ID NO: 714394 - protein, 25 aa, Mycobacterium
QHIAEAIDSPLIWTIAALLGQHPVP

SEQ ID NO: 714395 - protein, 24 aa, Mycobacterium
QHIARAEMRAVLRVLLTRLPDVHL

SEQ ID NO: 714396 - protein, 18 aa, Mycobacterium
QHICKAYVLPMQERLGPV

SEQ ID NO: 714397 - protein, 18 aa, Mycobacterium
QHKLRRAGDFNARSAALQ

SEQ ID NO: 714398 - protein, 24 aa, Mycobacterium
QHLAEELVRIIGVLRGMQLKKVPS

SEQ ID NO: 714399 - protein, 26 aa, Mycobacterium
QHLAKLRLAGLVKGRREGTFVYYSPA

SEQ ID NO: 714400 - protein, 22 aa, Mycobacterium
QHLAKLRMARLVRTRRDKTTIF

SEQ ID NO: 714401 - protein, 23 aa, Mycobacterium
QHLAKLRMARLVRTRREGTTIFY

SEQ ID NO: 714402 - protein, 25 aa, Mycobacterium
QHLCQGDRAILMWAAANRDPAMFEN

SEQ ID NO: 714403 - protein, 28 aa, Mycobacterium
QHLDVPLYWQCWKLDSAVVAQVTAAVDA

SEQ ID NO: 714404 - protein, 25 aa, Mycobacterium
QHLELPEGMGLVLLTDGLFEGHIGR

SEQ ID NO: 714405 - protein, 23 aa, Mycobacterium
QHLEPGDRVWLALGSANADPDTF

SEQ ID NO: 714406 - protein, 25 aa, Mycobacterium
QHLGFGHGIHACFGAPMARLETQIA

SEQ ID NO: 714407 - protein, 17 aa, Mycobacterium
QHLHSSFAPLFRPGGVG

SEQ ID NO: 714408 - protein, 17 aa, Mycobacterium
QHLKELQRHGVVHRESY

SEQ ID NO: 714409 - protein, 18 aa, Mycobacterium
QHLLRRKLVNAGFTRKRV

SEQ ID NO: 714410 - protein, 17 aa, Mycobacterium
QHLNVLHVVALYHRIKQ

SEQ ID NO: 714411 - protein, 24 aa, Mycobacterium
QHLPRIYLPPIAQKVMLTDLIITR

SEQ ID NO: 714412 - protein, 18 aa, Mycobacterium
QHLREIPELVDAFEGHAQ

SEQ ID NO: 714413 - protein, 17 aa, Mycobacterium
QHLRGVVTVCGQTYEIG

SEQ ID NO: 714414 - protein, 24 aa, Mycobacterium
QHLRRYSDHAARGLDMSRLMIFTW

SEQ ID NO: 714415 - protein, 28 aa, Mycobacterium
QHMKGVTFALRLAFGLPVDADTEHIQFV

SEQ ID NO: 714416 - protein, 22 aa, Mycobacterium
QHNCRLCNSLREGGALDAGGSE

SEQ ID NO: 714417 - protein, 18 aa, Mycobacterium
QHNRELLAGLGLSDAEIA

SEQ ID NO: 714418 - protein, 24 aa, Mycobacterium
QHNRELLTGLGLPAAEIAELEADG

SEQ ID NO: 714419 - protein, 17 aa, Mycobacterium
QHNRIPGNRGWQTPNPH

SEQ ID NO: 714420 - protein, 18 aa, Mycobacterium
QHPDRFLSGWQIVALQPY

SEQ ID NO: 714421 - protein, 23 aa, Mycobacterium
QHPEIAVAQALRIKALTRDSVGL

SEQ ID NO: 714422 - protein, 19 aa, Mycobacterium
QHPEVVSWADFFDKRRTRS

SEQ ID NO: 714423 - protein, 21 aa, Mycobacterium
QHPGYRLSVRATRSQGRLDLS

SEQ ID NO: 714424 - protein, 17 aa, Mycobacterium
QHPKVLVELGNMKNAQD

SEQ ID NO: 714425 - protein, 18 aa, Mycobacterium
QHPLARRVDDVLTAGLVK

SEQ ID NO: 714426 - protein, 20 aa, Mycobacterium
QHPLRAVVHTAGIVDDAVTT

SEQ ID NO: 714427 - protein, 20 aa, Mycobacterium
QHPRCRRHERTAAPAPRAPC

SEQ ID NO: 714428 - protein, 26 aa, Mycobacterium
QHQCAPFCAVQAWPALSRQRLSLASQ

SEQ ID NO: 714429 - protein, 17 aa, Mycobacterium
QHQMWAAQFIKYENPKT

SEQ ID NO: 714430 - protein, 17 aa, Mycobacterium
QHQMWAAQFIKYENPRT

SEQ ID NO: 714431 - protein, 31 aa, Mycobacterium
QHREAYQRIFARLGVRYVIVSAVSGAMGGSA

SEQ ID NO: 714432 - protein, 18 aa, Mycobacterium
QHRIGVAEWTQWWGDLPV

SEQ ID NO: 714433 - protein, 20 aa, Mycobacterium
QHRLAAWTYPAATGAELDLM

SEQ ID NO: 714434 - protein, 18 aa, Mycobacterium
QHRPELFDEFAARYQAEL

SEQ ID NO: 714435 - protein, 23 aa, Mycobacterium
QHRPGCRLEILDGVGHFPHVEKP

SEQ ID NO: 714436 - protein, 24 aa, Mycobacterium
QHRQIVLDFCDFLGGKTDRLAKDM

SEQ ID NO: 714437 - protein, 31 aa, Mycobacterium
QHRTREGWLYCCAVLDAFSRRIVGWSMDSRA

SEQ ID NO: 714438 - protein, 18 aa, Mycobacterium
QHRVRIGLPGGYNVANCL

SEQ ID NO: 714439 - protein, 24 aa, Mycobacterium
QHRWRDGVMKLVFMGVPLRGVSGL

SEQ ID NO: 714440 - protein, 20 aa, Mycobacterium
QHSLLPLLHAYRHPQHPHNG

SEQ ID NO: 714441 - protein, 18 aa, Mycobacterium
QHSQRWYRDIFGLTEAGG

SEQ ID NO: 714442 - protein, 18 aa, Mycobacterium
QHSVRWRPWRSYATQHLW

SEQ ID NO: 714443 - protein, 24 aa, Mycobacterium
QHTGRGRPAKRYRLTAAGRAKLGH

SEQ ID NO: 714444 - protein, 20 aa, Mycobacterium
QHTHDAWTLLIVDTGIIGYE

SEQ ID NO: 714445 - protein, 24 aa, Mycobacterium
QHTRLRKIISRGFTPGAVERLRDD

SEQ ID NO: 714446 - protein, 18 aa, Mycobacterium
QHTSEGWSTVFVGAQIGA

SEQ ID NO: 714447 - protein, 24 aa, Mycobacterium
QHTVWAGPLGFRDPALYAHLWKIV

SEQ ID NO: 714448 - protein, 17 aa, Mycobacterium
QHVALQLPHRPLAGDLF

SEQ ID NO: 714449 - protein, 28 aa, Mycobacterium
QHVKPGKGPAFVRTKLKNVLSGKVVDKT

SEQ ID NO: 714450 - protein, 29 aa, Mycobacterium
QHVKPGKGPAFVRTKLKNVLSGKVVDKTF

SEQ ID NO: 714451 - protein, 28 aa, Mycobacterium
QHVKPGKGPAFVRTKLKNVVSGKVVDKT

SEQ ID NO: 714452 - protein, 17 aa, Mycobacterium
QHVLAAPHRLHTVRILV

SEQ ID NO: 714453 - protein, 24 aa, Mycobacterium
QHVLDCLSGYLLLGRRLLAGDDSC

SEQ ID NO: 714454 - protein, 19 aa, Mycobacterium
QHVPDAGGMIIATDQTAAR

SEQ ID NO: 714455 - protein, 20 aa, Mycobacterium
QHVPDAGGMIIATNQTTARA

SEQ ID NO: 714456 - protein, 27 aa, Mycobacterium
QHVRGTFGIGLVDWVMRTEAGLLEDAL

SEQ ID NO: 714457 - protein, 21 aa, Mycobacterium
QHVSFPRRRTVFVEGEAGDDL

SEQ ID NO: 714458 - protein, 24 aa, Mycobacterium
QHVVACGEPPALVVPGDQRAADGV

SEQ ID NO: 714459 - protein, 25 aa, Mycobacterium
QHYHGKALGAFTGWQPHYPVTQWVM

SEQ ID NO: 714460 - protein, 20 aa, Mycobacterium
QHYQGEPLGGFTGWRPQMPV

SEQ ID NO: 714461 - protein, 27 aa, Mycobacterium
QIAAALAMGAQGAWSGSQWLMVEEAEN

SEQ ID NO: 714462 - protein, 18 aa, Mycobacterium
QIAAHLIRLLAARGDTAV

SEQ ID NO: 714463 - protein, 20 aa, Mycobacterium
QIAALRWVRDNIAAFGGDPG

SEQ ID NO: 714464 - protein, 29 aa, Mycobacterium
QIACGGRFTLGIGPSHHWIVNGQLGLAYD

SEQ ID NO: 714465 - protein, 30 aa, Mycobacterium
QIACGGRFTLGVGPSHHWIIDGQLGLPYER

SEQ ID NO: 714466 - protein, 20 aa, Mycobacterium
QIAEAVCAHKKMSRRQARDR

SEQ ID NO: 714467 - protein, 17 aa, Mycobacterium
QIAEDFRGAGLPLNTQS

SEQ ID NO: 714468 - protein, 17 aa, Mycobacterium
QIAELLSAAGLAVPADE

SEQ ID NO: 714469 - protein, 19 aa, Mycobacterium
QIAELLVRAVGRSHQVRVA

SEQ ID NO: 714470 - protein, 20 aa, Mycobacterium
QIAGAPVHYLPDLSTVAQQV

SEQ ID NO: 714471 - protein, 17 aa, Mycobacterium
QIAGIAYMDALVQPRTW

SEQ ID NO: 714472 - protein, 17 aa, Mycobacterium
QIAGVLYRPEGGAPPFP

SEQ ID NO: 714473 - protein, 18 aa, Mycobacterium
QIAHCRVTHIVLTHKHFD

SEQ ID NO: 714474 - protein, 23 aa, Mycobacterium
QIAPTIRYELRGVKPDTVSGKDI

SEQ ID NO: 714475 - protein, 23 aa, Mycobacterium
QIAQRLATVANYYINAEEINNAA

SEQ ID NO: 714476 - protein, 18 aa, Mycobacterium
QICGMPTPSSGGVAVAAT

SEQ ID NO: 714477 - protein, 21 aa, Mycobacterium
QICLNARKILVHRDIYDEFVA

SEQ ID NO: 714478 - protein, 20 aa, Mycobacterium
QICRPEVTAQLARWDGGVAL

SEQ ID NO: 714479 - protein, 24 aa, Mycobacterium
QICVLRAVLPPGVTVPLHSHNDFE

SEQ ID NO: 714480 - protein, 24 aa, Mycobacterium
QIDGPLPRRLLVLALTLSGEQPIV

SEQ ID NO: 714481 - protein, 25 aa, Mycobacterium
QIDKWHRARVIGGFEAEDYKQFLTE

SEQ ID NO: 714482 - protein, 24 aa, Mycobacterium
QIDLGGPVVRTLAFGDSIPGPVLR

SEQ ID NO: 714483 - protein, 24 aa, Mycobacterium
QIDPRWSKLADMFTPDGPEATGRG

SEQ ID NO: 714484 - protein, 19 aa, Mycobacterium
QIDSAAWRRTVDLNVNGTM

SEQ ID NO: 714485 - protein, 18 aa, Mycobacterium
QIDVVKIRGQYVVVGEDR

SEQ ID NO: 714486 - protein, 25 aa, Mycobacterium
QIDWLLAGGGLDWATKRTADSASRL

SEQ ID NO: 714487 - protein, 27 aa, Mycobacterium
QIDWLLGNGGLDWAVKRTADSSSRLYS

SEQ ID NO: 714488 - protein, 22 aa, Mycobacterium
QIEALGYGAVWVGGSPPAELDW

SEQ ID NO: 714489 - protein, 23 aa, Mycobacterium
QIEEARGALIEGIIEESEDESLM

SEQ ID NO: 714490 - protein, 25 aa, Mycobacterium
QIEGVARYRLDGVVQPARRPRGGID

SEQ ID NO: 714491 - protein, 23 aa, Mycobacterium
QIERCRQQGISLIRINDSVGTLV

SEQ ID NO: 714492 - protein, 25 aa, Mycobacterium
QIERLSRLGAIVGTAFQISDDIIDI

SEQ ID NO: 714493 - protein, 20 aa, Mycobacterium
QIESTVWIGAPIRDLALGAD

SEQ ID NO: 714494 - protein, 17 aa, Mycobacterium
QIFAGEPDFFWSPVNTL

SEQ ID NO: 714495 - protein, 17 aa, Mycobacterium
QIFEGDVLFLEWTADAG

SEQ ID NO: 714496 - protein, 20 aa, Mycobacterium
QIFGDRVVWVPWRRPGFQLG

SEQ ID NO: 714497 - protein, 18 aa, Mycobacterium
QIGCSWCVDFGSMLQRLD

SEQ ID NO: 714498 - protein, 25 aa, Mycobacterium
QIGDGRRSLALALRFRASDRTLTEE

SEQ ID NO: 714499 - protein, 38 aa, Mycobacterium
QIGDRVAVGWFGFYCGSCYRCRRGDFVHCERSKVTGAA

SEQ ID NO: 714500 - protein, 25 aa, Mycobacterium
QIGEAGWSDVRWRNLTGGIVALHAA

SEQ ID NO: 714501 - protein, 26 aa, Mycobacterium
QIGEARKSLTFALRFRAPDRTLTEDD

SEQ ID NO: 714502 - protein, 23 aa, Mycobacterium
QIGEGRALCALSGGVDSAVAAAL

SEQ ID NO: 714503 - protein, 26 aa, Mycobacterium
QIGEGRKSLTLALRFRATDRTLTEDE

SEQ ID NO: 714504 - protein, 21 aa, Mycobacterium
QIGGGFLNWEVTKAFHDRGLP

SEQ ID NO: 714505 - protein, 20 aa, Mycobacterium
QIGHAMFFQHGEIIDKPEDF

SEQ ID NO: 714506 - protein, 28 aa, Mycobacterium
QIGLRDRLCELDFEFPMAGGDLRGGRFA

SEQ ID NO: 714507 - protein, 20 aa, Mycobacterium
QIGLVPPYFVVAFDNKVTIN

SEQ ID NO: 714508 - protein, 23 aa, Mycobacterium
QIGPRQSSPWAQALRLALVDAAP

SEQ ID NO: 714509 - protein, 18 aa, Mycobacterium
QIGRWFAMSHRLRPNDFR

SEQ ID NO: 714510 - protein, 25 aa, Mycobacterium
QIGTRLGLWPSDVELLSKIVRYHLL

SEQ ID NO: 714511 - protein, 18 aa, Mycobacterium
QIHHAPRLTVNAAAATST

SEQ ID NO: 714512 - protein, 21 aa, Mycobacterium
QIHNFLWRGGLPGTYETCGFD

SEQ ID NO: 714513 - protein, 18 aa, Mycobacterium
QIHRSGCDVSIYTRSLDD

SEQ ID NO: 714514 - protein, 26 aa, Mycobacterium
QIIARMLAVMLRRRMAEVGMDTGGVE

SEQ ID NO: 714515 - protein, 25 aa, Mycobacterium
QIIEEMLRFPLPVIAAVNGPAVGLG

SEQ ID NO: 714516 - protein, 20 aa, Mycobacterium
QIISSIKWAPNETGIIPTSG

SEQ ID NO: 714517 - protein, 17 aa, Mycobacterium
QIKDWWAATGENIPNAI

SEQ ID NO: 714518 - protein, 18 aa, Mycobacterium
QIKIAIEKIFSVKVVSVN

SEQ ID NO: 714519 - protein, 25 aa, Mycobacterium
QIKSELRWSAPVPTFVELSQEADLV

SEQ ID NO: 714520 - protein, 33 aa, Mycobacterium
QILASSYIWFFLCPVAPEIAIRSRAQVKVFEAV

SEQ ID NO: 714521 - protein, 17 aa, Mycobacterium
QILDRVWSYDFGGRSNI

SEQ ID NO: 714522 - protein, 17 aa, Mycobacterium
QILDVAFVAREVLEDHG

SEQ ID NO: 714523 - protein, 18 aa, Mycobacterium
QILEGRCACCEGGFTALV

SEQ ID NO: 714524 - protein, 19 aa, Mycobacterium
QILGRDIVTAFGQRLAGEE

SEQ ID NO: 714525 - protein, 23 aa, Mycobacterium
QILGRVRFDVVIADLVWNHPELE

SEQ ID NO: 714526 - protein, 17 aa, Mycobacterium
QILGTLVDLTWRARLQP

SEQ ID NO: 714527 - protein, 22 aa, Mycobacterium
QILKFMPNYMFNPAEYPPIGTR

SEQ ID NO: 714528 - protein, 18 aa, Mycobacterium
QILLALELFGLYELDEQI

SEQ ID NO: 714529 - protein, 24 aa, Mycobacterium
QILLLELMGSTLLLLDEPTDNLDL

SEQ ID NO: 714530 - protein, 18 aa, Mycobacterium
QILPDPKYAPGYLNEFGG

SEQ ID NO: 714531 - protein, 24 aa, Mycobacterium
QILPRPKDFAALMSLVPPETVAES

SEQ ID NO: 714532 - protein, 25 aa, Mycobacterium
QILPSNTVSLGWSSWAIQWLSRIPA

SEQ ID NO: 714533 - protein, 18 aa, Mycobacterium
QILRALRINFSVRGYDVV

SEQ ID NO: 714534 - protein, 18 aa, Mycobacterium
QILRALRINLSVRGYEVI

SEQ ID NO: 714535 - protein, 18 aa, Mycobacterium
QILRALRINLSVRGYEVR

SEQ ID NO: 714536 - protein, 18 aa, Mycobacterium
QILRALRINLSVRGYEVV

SEQ ID NO: 714537 - protein, 17 aa, Mycobacterium
QILRPGAEFDPGKLQRT

SEQ ID NO: 714538 - protein, 24 aa, Mycobacterium
QILSESGWYSALFGMQHETSYPKR

SEQ ID NO: 714539 - protein, 17 aa, Mycobacterium
QILSLVPRRRFEQWLNT

SEQ ID NO: 714540 - protein, 22 aa, Mycobacterium
QIMTVFVAKGLQFPIVYVPFLF

SEQ ID NO: 714541 - protein, 23 aa, Mycobacterium
QINGRICINFTYSSILPAMKTLG

SEQ ID NO: 714542 - protein, 23 aa, Mycobacterium
QIPPADLLIQWRSTRNQLHAALR

SEQ ID NO: 714543 - protein, 19 aa, Mycobacterium
QIPRPTIRPRTRRTGEHSA

SEQ ID NO: 714544 - protein, 25 aa, Mycobacterium
QIPSERWVFPYAGADAHDTYAIGER

SEQ ID NO: 714545 - protein, 25 aa, Mycobacterium
QIPTGPRLGNVVVEVEHLDKGFEGR

SEQ ID NO: 714546 - protein, 25 aa, Mycobacterium
QIQEIRPGKPPSIGGLPAVNDGDVQ

SEQ ID NO: 714547 - protein, 20 aa, Mycobacterium
QIRAGWVVGSQFVFSQHCKA

SEQ ID NO: 714548 - protein, 29 aa, Mycobacterium
QIRALLERELPVYIVSIGRTFRTDELDAT

SEQ ID NO: 714549 - protein, 17 aa, Mycobacterium
QIRDELAEFMGLSGGSG

SEQ ID NO: 714550 - protein, 24 aa, Mycobacterium
QIRERWKRAVSLVEHLMGDAVGKL

SEQ ID NO: 714551 - protein, 23 aa, Mycobacterium
QIRKARAALVAGEIDAAEYEKRM

SEQ ID NO: 714552 - protein, 31 aa, Mycobacterium
QIRPDEWPEQVGLDWFPPGEEPIVPRPDPTA

SEQ ID NO: 714553 - protein, 22 aa, Mycobacterium
QIRPDGWWARCSRHGQVDSSEL

SEQ ID NO: 714554 - protein, 21 aa, Mycobacterium
QIRTLAGFSTMFPVAAGAVGI

SEQ ID NO: 714555 - protein, 24 aa, Mycobacterium
QISEITRFDAGLMNRNSEGRNNFD

SEQ ID NO: 714556 - protein, 18 aa, Mycobacterium
QISMEFFNRVGYHDYEGV

SEQ ID NO: 714557 - protein, 19 aa, Mycobacterium
QISRPPRWLAGFGSLSLES

SEQ ID NO: 714558 - protein, 22 aa, Mycobacterium
QITDLIIAPGDWVLVCNADGTP

SEQ ID NO: 714559 - protein, 20 aa, Mycobacterium
QITELLYRYAELVDAGDFDG

SEQ ID NO: 714560 - protein, 25 aa, Mycobacterium
QITLAEWNRFLAVNLTGTFLSLQAG

SEQ ID NO: 714561 - protein, 24 aa, Mycobacterium
QITVRRWLDRTSEIRLDEAVHGPA

SEQ ID NO: 714562 - protein, 20 aa, Mycobacterium
QIVASGRADWVGWLDLNPEP

SEQ ID NO: 714563 - protein, 17 aa, Mycobacterium
QIVGGLLGWGIEQSGVD

SEQ ID NO: 714564 - protein, 20 aa, Mycobacterium
QIVKKRQRRLTGIDEIVLSL

SEQ ID NO: 714565 - protein, 21 aa, Mycobacterium
QIVKKRQRRLTGIDEIVLSLT

SEQ ID NO: 714566 - protein, 28 aa, Mycobacterium
QIVKLCRLSSRVGGGIVRLLATEPGQSF

SEQ ID NO: 714567 - protein, 26 aa, Mycobacterium
QIVLARLRLGLTWQELADAIDRPVVW

SEQ ID NO: 714568 - protein, 19 aa, Mycobacterium
QIVLARLSKGLTWQELADA

SEQ ID NO: 714569 - protein, 25 aa, Mycobacterium
QIVPEPRPGPALGGRSVDEVLADCQ

SEQ ID NO: 714570 - protein, 20 aa, Mycobacterium
QIVRCPWHNWEFDITTGQSV

SEQ ID NO: 714571 - protein, 32 aa, Mycobacterium
QIVSSLLPPAVKWKAFFKRQLGNPKYLHDGDV

SEQ ID NO: 714572 - protein, 17 aa, Mycobacterium
QIVWTRADFTVLVQRAA

SEQ ID NO: 714573 - protein, 20 aa, Mycobacterium
QIWRGHFTTTEILLRECDQD

SEQ ID NO: 714574 - protein, 20 aa, Mycobacterium
QIYAELTLDVAFTIVVRPGH

SEQ ID NO: 714575 - protein, 24 aa, Mycobacterium
QIYAELTLDVSFTIAVRPGVTAAD

SEQ ID NO: 714576 - protein, 19 aa, Mycobacterium
QIYTLALPRAIRCEVTEVD

SEQ ID NO: 714577 - protein, 19 aa, Mycobacterium
QKAAEAWSGGYFAKSVVPV

SEQ ID NO: 714578 - protein, 19 aa, Mycobacterium
QKAGFRWRSGRYPGEDAEP

SEQ ID NO: 714579 - protein, 23 aa, Mycobacterium
QKAGRAFVDRWRKFGLDVDLAAL

SEQ ID NO: 714580 - protein, 20 aa, Mycobacterium
QKAKIFLALLGKQYGVQPKD

SEQ ID NO: 714581 - protein, 20 aa, Mycobacterium
QKARLLPGLIDGSVTAGVGL

SEQ ID NO: 714582 - protein, 19 aa, Mycobacterium
QKASRIRQITAIKTRESLQ

SEQ ID NO: 714583 - protein, 18 aa, Mycobacterium
QKDARLLVDLADRAGAGG

SEQ ID NO: 714584 - protein, 26 aa, Mycobacterium
QKDIDFAFGVGQLFATVPYAQLILEE

SEQ ID NO: 714585 - protein, 24 aa, Mycobacterium
QKEGPFFLLGWSFGGVVAHAIAAE

SEQ ID NO: 714586 - protein, 22 aa, Mycobacterium
QKEIFIPGGAMFRDLTRLSAAG

SEQ ID NO: 714587 - protein, 25 aa, Mycobacterium
QKEYRLKLGSKWTDSGYVVVDEFGV

SEQ ID NO: 714588 - protein, 34 aa, Mycobacterium
QKFKKMSGMTWRSMIKDGLAMRHGKELTWSQVVM

SEQ ID NO: 714589 - protein, 17 aa, Mycobacterium
QKFNPLVRLDTVNGKPV

SEQ ID NO: 714590 - protein, 18 aa, Mycobacterium
QKFWKLVTLTGMDVGNDI

SEQ ID NO: 714591 - protein, 19 aa, Mycobacterium
QKGAMSLHQYLIDLIEKKQ

SEQ ID NO: 714592 - protein, 18 aa, Mycobacterium
QKGAMSLHQYLINLVEEK

SEQ ID NO: 714593 - protein, 18 aa, Mycobacterium
QKGAWSLPGGRLRNDEDL

SEQ ID NO: 714594 - protein, 17 aa, Mycobacterium
QKGLARWQDELVGRVGN

SEQ ID NO: 714595 - protein, 19 aa, Mycobacterium
QKGLHSKGFDFMRLSNQIE

SEQ ID NO: 714596 - protein, 19 aa, Mycobacterium
QKGLHSKGFEYMRLSNQIE

SEQ ID NO: 714597 - protein, 21 aa, Mycobacterium
QKGLHSKGFEYMRLSSRIEGL

SEQ ID NO: 714598 - protein, 17 aa, Mycobacterium
QKIAERTKLLSQLEQAK

SEQ ID NO: 714599 - protein, 24 aa, Mycobacterium
QKIERRYANAMGEAELAQNSVQGR

SEQ ID NO: 714600 - protein, 19 aa, Mycobacterium
QKIPSKWIESGVIVKADTI

SEQ ID NO: 714601 - protein, 17 aa, Mycobacterium
QKISLPKRAEWHGFFKH

SEQ ID NO: 714602 - protein, 20 aa, Mycobacterium
QKITATMLVPSMIYALMDHP

SEQ ID NO: 714603 - protein, 18 aa, Mycobacterium
QKIWSSRAPFAEMGFGLF

SEQ ID NO: 714604 - protein, 31 aa, Mycobacterium
QKKARVSFIPDRGVVDYTQLFGATSLMPSHV

SEQ ID NO: 714605 - protein, 21 aa, Mycobacterium
QKKLAAAIDVWVHRYDPDAVR

SEQ ID NO: 714606 - protein, 30 aa, Mycobacterium
QKKRWLPGFVSGRLIAAIGMTEPGAGSDLS

SEQ ID NO: 714607 - protein, 25 aa, Mycobacterium
QKLAGAFARSGKFGAPQPVAEDAPA

SEQ ID NO: 714608 - protein, 21 aa, Mycobacterium
QKLDKKLAYRHSGYPGGLSSR

SEQ ID NO: 714609 - protein, 26 aa, Mycobacterium
QKLFAESGFAWAPDGRHIAWVQARSD

SEQ ID NO: 714610 - protein, 21 aa, Mycobacterium
QKLGEEMEDYLILGACNPALA

SEQ ID NO: 714611 - protein, 18 aa, Mycobacterium
QKLGEEMEDYVILGACNP

SEQ ID NO: 714612 - protein, 26 aa, Mycobacterium
QKLHRIGRIAFVWSDRHSAVTAAALL

SEQ ID NO: 714613 - protein, 21 aa, Mycobacterium
QKLKVLVSIFGRETPVELTFN

SEQ ID NO: 714614 - protein, 17 aa, Mycobacterium
QKLLRKHAAEFFRKEAT

SEQ ID NO: 714615 - protein, 26 aa, Mycobacterium
QKLQKRLKEELAWVRSGAKARQAKNK

SEQ ID NO: 714616 - protein, 19 aa, Mycobacterium
QKLRARLRRPFDVEELTAG

SEQ ID NO: 714617 - protein, 23 aa, Mycobacterium
QKLTPRYALGCKRPSFHNEYLAT

SEQ ID NO: 714618 - protein, 21 aa, Mycobacterium
QKLWASGGMHADWCLLLARTD

SEQ ID NO: 714619 - protein, 24 aa, Mycobacterium
QKPVGTVCFCVLVGDGRNVTRTLR

SEQ ID NO: 714620 - protein, 22 aa, Mycobacterium
QKQIDHFLAMELLYKNQDDYNA

SEQ ID NO: 714621 - protein, 17 aa, Mycobacterium
QKQRVVIAIAIACDPKV

SEQ ID NO: 714622 - protein, 30 aa, Mycobacterium
QKQRWLPKFCSGELITAIAMTEPGTGSDLQ

SEQ ID NO: 714623 - protein, 30 aa, Mycobacterium
QKQRWLPKFCSGEMITAIGMTEPSGGSDLA

SEQ ID NO: 714624 - protein, 30 aa, Mycobacterium
QKQRWLPKFCTGEFITAIAMTEPGTGSDLQ

SEQ ID NO: 714625 - protein, 30 aa, Mycobacterium
QKQRWLPKFCTGEIITAIAMTEPGTGSDLQ

SEQ ID NO: 714626 - protein, 30 aa, Mycobacterium; identical to SEQ ID NO: 90768

SEQ ID NO: 714627 - protein, 18 aa, Mycobacterium
QKRAHIAAALRGDEVLVQ

SEQ ID NO: 714628 - protein, 25 aa, Mycobacterium
QKRFVPSVRMFSRFTDRARRSVVGA

SEQ ID NO: 714629 - protein, 20 aa, Mycobacterium
QKRGRFRTRYPGTTLRESLR

SEQ ID NO: 714630 - protein, 25 aa, Mycobacterium
QKRLRQYRYEFLDADGYPTTVDPPA

SEQ ID NO: 714631 - protein, 23 aa, Mycobacterium
QKRLVSDLSVAGWAQILEQGQPE

SEQ ID NO: 714632 - protein, 24 aa, Mycobacterium
QKRREFLTDVSLLGGLIIASADTA

SEQ ID NO: 714633 - protein, 21 aa, Mycobacterium
QKRTLLPRMMRADDIWCQGMS

SEQ ID NO: 714634 - protein, 32 aa, Mycobacterium
QKSAFLPRIVRGECFFAIGMSEPDSGSDLASV

SEQ ID NO: 714635 - protein, 24 aa, Mycobacterium
QKSDRAKHLVLFDFSLAKASAATI

SEQ ID NO: 714636 - protein, 17 aa, Mycobacterium
QKSFLSKDVEAMQPHIR

SEQ ID NO: 714637 - protein, 27 aa, Mycobacterium
QKSGVLGIRARPTWSGPPEFAYADFKV

SEQ ID NO: 714638 - protein, 34 aa, Mycobacterium
QKSHMLFPEFSDFFSGFPSFAGIRSMFDTRLMRL

SEQ ID NO: 714639 - protein, 20 aa, Mycobacterium
QKSRLLPGLIDGTVTAGIGL

SEQ ID NO: 714640 - protein, 20 aa, Mycobacterium
QKSRLLPGLIDGTVTAGVGL

SEQ ID NO: 714641 - protein, 28 aa, Mycobacterium
QKSSRYPGGLALRFARVVRYRDDKGPAE

SEQ ID NO: 714642 - protein, 23 aa, Mycobacterium
QKTAEAFRGGWFHSGDLGHYDDN

SEQ ID NO: 714643 - protein, 24 aa, Mycobacterium
QKTGRFGALIPRLVRQAINGENLT

SEQ ID NO: 714644 - protein, 24 aa, Mycobacterium
QKTGRFGALIPRLVRQAINGKNLT

SEQ ID NO: 714645 - protein, 24 aa, Mycobacterium
QKVALTCRALFDRGHDSGLAGQIT

SEQ ID NO: 714646 - protein, 25 aa, Mycobacterium
QKVIDCFRAGGGVPYSDYPRFHTLM

SEQ ID NO: 714647 - protein, 31 aa, Mycobacterium
QKVILSRRLELPFAVDFPATYRVGRRNNTPA

SEQ ID NO: 714648 - protein, 26 aa, Mycobacterium
QKVKEIGFGLARPVWLDDVDFDITYH

SEQ ID NO: 714649 - protein, 23 aa, Mycobacterium
QKVMLKLSLPTVANHYKSLVDHP

SEQ ID NO: 714650 - protein, 21 aa, Mycobacterium
QKVRRIRRLAAIWLAAQDAHW

SEQ ID NO: 714651 - protein, 24 aa, Mycobacterium
QKVSELYDRVGFAAVGRFNEFDNL

SEQ ID NO: 714652 - protein, 24 aa, Mycobacterium
QKVSELYDRVGFAAVGRFNEFNNL

SEQ ID NO: 714653 - protein, 23 aa, Mycobacterium
QKVSEVYDRVGFAAVGKFNEFDR

SEQ ID NO: 714654 - protein, 27 aa, Mycobacterium
QKVTLYVRPAAWGMWTFYELSEEDKRQ

SEQ ID NO: 714655 - protein, 20 aa, Mycobacterium
QKVVLAKWMARGIDLLLLDE

SEQ ID NO: 714656 - protein, 20 aa, Mycobacterium
QKWMRGAREKISFQGLPARI

SEQ ID NO: 714657 - protein, 17 aa, Mycobacterium
QKWWDGTSQMYAESASG

SEQ ID NO: 714658 - protein, 19 aa, Mycobacterium
QKYFEGFGALADMTDDQRT

SEQ ID NO: 714659 - protein, 19 aa, Mycobacterium
QKYFGDMSVNGVLAHEFGH

SEQ ID NO: 714660 - protein, 24 aa, Mycobacterium
QKYLWNVLVDYWFRMEIDGWENIP

SEQ ID NO: 714661 - protein, 25 aa, Mycobacterium
QKYLWNVLVDYWFRMEIDGWENIPA

SEQ ID NO: 714662 - protein, 30 aa, Mycobacterium
QKYPDLKIVLAEGGIGWIPYLIERAEHVAA

SEQ ID NO: 714663 - protein, 20 aa, Mycobacterium
QLAAAIKAAAGGVPIPDAFQ

SEQ ID NO: 714664 - protein, 17 aa, Mycobacterium
QLAADGVAVAWLTVDDD

SEQ ID NO: 714665 - protein, 18 aa, Mycobacterium
QLAAFPLPADVAELAILS

SEQ ID NO: 714666 - protein, 17 aa, Mycobacterium
QLAAHPVASGLAHATIP

SEQ ID NO: 714667 - protein, 19 aa, Mycobacterium
QLAAKSLRPLPVAHKEMSE

SEQ ID NO: 714668 - protein, 21 aa, Mycobacterium
QLAAPARRGATADLLACGAAE

SEQ ID NO: 714669 - protein, 30 aa, Mycobacterium
QLAAPGFEGAKWVCSTPLRSHEEGHQEELW

SEQ ID NO: 714670 - protein, 23 aa, Mycobacterium
QLAAQPIDSWALPRKNGGDVNGY

SEQ ID NO: 714671 - protein, 17 aa, Mycobacterium
QLAARAYTASGLSRNLA

SEQ ID NO: 714672 - protein, 19 aa, Mycobacterium
QLADAAALFSNVLARLSAD

SEQ ID NO: 714673 - protein, 17 aa, Mycobacterium
QLADELYAAAGRFGTVV

SEQ ID NO: 714674 - protein, 18 aa, Mycobacterium
QLADIAICSARTAAQFGI

SEQ ID NO: 714675 - protein, 18 aa, Mycobacterium
QLADLAALGITWDGDATR

SEQ ID NO: 714676 - protein, 25 aa, Mycobacterium
QLADSDAAIWARFGVVAQPAFAFVG

SEQ ID NO: 714677 - protein, 19 aa, Mycobacterium
QLAEAAPAVFADFEISTLA

SEQ ID NO: 714678 - protein, 17 aa, Mycobacterium
QLAEAFHAAGRCSTAAQ

SEQ ID NO: 714679 - protein, 25 aa, Mycobacterium
QLAEAIKLARMAKGLSWTKIADAIG

SEQ ID NO: 714680 - protein, 29 aa, Mycobacterium
QLAEIRGGPHLKFQLLWYPGTTSDLSLPS

SEQ ID NO: 714681 - protein, 30 aa, Mycobacterium
QLAEIVGAYFPLGWPIACHVQGDAGVDTIL

SEQ ID NO: 714682 - protein, 18 aa, Mycobacterium
QLAEKMWQLRILDDEKSA

SEQ ID NO: 714683 - protein, 18 aa, Mycobacterium
QLAELVGPTGAFVSDGFG

SEQ ID NO: 714684 - protein, 18 aa, Mycobacterium
QLAELVSPGGAFVSDGFG

SEQ ID NO: 714685 - protein, 22 aa, Mycobacterium
QLAEVRKSGFAISRQESEEGVA

SEQ ID NO: 714686 - protein, 19 aa, Mycobacterium
QLAEWEWPEHPRFLMCTPL

SEQ ID NO: 714687 - protein, 22 aa, Mycobacterium
QLAGKARLRIALAAPTGKAAAR

SEQ ID NO: 714688 - protein, 21 aa, Mycobacterium
QLAGLRLEPMIEIEHVEAALK

SEQ ID NO: 714689 - protein, 25 aa, Mycobacterium
QLAHFKAPKAFLFVERIERLGNGKP

SEQ ID NO: 714690 - protein, 28 aa, Mycobacterium
QLAIKRMKPRGGGVIVNIASAAGKAGFP

SEQ ID NO: 714691 - protein, 29 aa, Mycobacterium
QLAKAMERKVWLPSGGTLVIDRTEAMTVV

SEQ ID NO: 714692 - protein, 17 aa, Mycobacterium
QLAKKLTGVRVIATASR

SEQ ID NO: 714693 - protein, 22 aa, Mycobacterium
QLAKLPWPGNIAQLRHVLTETV

SEQ ID NO: 714694 - protein, 21 aa, Mycobacterium
QLALKAMRSRRSGVIVNVVGL

SEQ ID NO: 714695 - protein, 24 aa, Mycobacterium
QLALRLAAELGVVGVLAVELFETT

SEQ ID NO: 714696 - protein, 21 aa, Mycobacterium
QLALTELWRSYGVTPDAVIGH

SEQ ID NO: 714697 - protein, 20 aa, Mycobacterium
QLALTQLWRSYGVEPDAVIG

SEQ ID NO: 714698 - protein, 23 aa, Mycobacterium
QLALVLRGKYLVDVQSVSKVQGV

SEQ ID NO: 714699 - protein, 23 aa, Mycobacterium
QLALVLRGKYLVDVQSVTKVKGV

SEQ ID NO: 714700 - protein, 22 aa, Mycobacterium
QLAPGFAMGIPFATTTTPPPPR

SEQ ID NO: 714701 - protein, 24 aa, Mycobacterium
QLAPHAVVAIGLLRAAAPPDPAHP

SEQ ID NO: 714702 - protein, 26 aa, Mycobacterium
QLAQARTGVFWVREMLPTHKIREILS

SEQ ID NO: 714703 - protein, 21 aa, Mycobacterium
QLAQWLVEWKAPPPPVASLPI

SEQ ID NO: 714704 - protein, 18 aa, Mycobacterium
QLARASVMALSYVAQSAR

SEQ ID NO: 714705 - protein, 29 aa, Mycobacterium
QLARGPLASGMFGDFAAADAFHEAVTTAH

SEQ ID NO: 714706 - protein, 24 aa, Mycobacterium
QLARSAGYPSVFAQGMFSAALLAG

SEQ ID NO: 714707 - protein, 24 aa, Mycobacterium
QLARSWPGARFMATKGLGRLAHYR

SEQ ID NO: 714708 - protein, 27 aa, Mycobacterium
QLARTFLMYRTQRWPDVLLAAAEELPP

SEQ ID NO: 714709 - protein, 25 aa, Mycobacterium
QLARTRTGVFWVRDILPTGKLREIL

SEQ ID NO: 714710 - protein, 17 aa, Mycobacterium
QLASGLSMPIGFKNGTD

SEQ ID NO: 714711 - protein, 24 aa, Mycobacterium
QLASTRSGVFWIRDILPVQKLREI

SEQ ID NO: 714712 - protein, 20 aa, Mycobacterium
QLATLMAHTKLGLKADLLAA

SEQ ID NO: 714713 - protein, 23 aa, Mycobacterium
QLATVLGICAGSYAATEAANSVL

SEQ ID NO: 714714 - protein, 27 aa, Mycobacterium
QLAVYRMAWAALRGCPESSVRTAFHYV

SEQ ID NO: 714715 - protein, 21 aa, Mycobacterium
QLCAGRWNLGALYLLPELRTD

SEQ ID NO: 714716 - protein, 19 aa, Mycobacterium
QLCGLKVLRKPLVVETSRA

SEQ ID NO: 714717 - protein, 21 aa, Mycobacterium
QLCLRQHGRVVLNRAIGHGWG

SEQ ID NO: 714718 - protein, 26 aa, Mycobacterium
QLCMPALRRLGVKFAGLDQPVGQLSG

SEQ ID NO: 714719 - protein, 19 aa, Mycobacterium
QLCSSHHVAAVLGFGASAV

SEQ ID NO: 714720 - protein, 17 aa, Mycobacterium
QLCVDPDLLASHGAVSP

SEQ ID NO: 714721 - protein, 23 aa, Mycobacterium
QLDDEQRLAIALHLAGAHVDWSR

SEQ ID NO: 714722 - protein, 17 aa, Mycobacterium
QLDDPYCLTGMHHWLAN

SEQ ID NO: 714723 - protein, 23 aa, Mycobacterium
QLDDVRFTHRWAGAIDTNTRFCA

SEQ ID NO: 714724 - protein, 18 aa, Mycobacterium
QLDEGVLVNAPQGELQFG

SEQ ID NO: 714725 - protein, 18 aa, Mycobacterium
QLDFHWTHQLRPRLDGLT

SEQ ID NO: 714726 - protein, 19 aa, Mycobacterium
QLDGMLAFDPDRFGISHRH

SEQ ID NO: 714727 - protein, 18 aa, Mycobacterium
QLDIPVVISSALDSAVGI

SEQ ID NO: 714728 - protein, 29 aa, Mycobacterium
QLDKKWLKPTAYMMAKFGMTLCALGIAEE

SEQ ID NO: 714729 - protein, 31 aa, Mycobacterium
QLDLFRPAVKWGGPIFEWARIPEVLRLAFRE

SEQ ID NO: 714730 - protein, 20 aa, Mycobacterium
QLDMLPVEAVARGYLTGSGL

SEQ ID NO: 714731 - protein, 23 aa, Mycobacterium
QLDSARCGPVLGVDGDDPASEWA

SEQ ID NO: 714732 - protein, 26 aa, Mycobacterium
QLDVRRRPRNILTFSHGAHFCLGAAA

SEQ ID NO: 714733 - protein, 26 aa, Mycobacterium
QLDWLLGNGGLEWAVKRTADSSQRLY

SEQ ID NO: 714734 - protein, 22 aa, Mycobacterium
QLEARIDSLAARNAKLMDTLKE

SEQ ID NO: 714735 - protein, 18 aa, Mycobacterium
QLEEARPWAQRHPATAVA

SEQ ID NO: 714736 - protein, 18 aa, Mycobacterium
QLEECVGLAADRGVRIVA

SEQ ID NO: 714737 - protein, 18 aa, Mycobacterium
QLEKIWGPPEYPATVVDH

SEQ ID NO: 714738 - protein, 22 aa, Mycobacterium
QLELAAASWLVGDHVTTERLVS

SEQ ID NO: 714739 - protein, 34 aa, Mycobacterium
QLELKEYFARWAYSGPLAAMLVPVFAFAPNVTTY

SEQ ID NO: 714740 - protein, 17 aa, Mycobacterium
QLELSRGEAAWVAADDG

SEQ ID NO: 714741 - protein, 23 aa, Mycobacterium
QLELVDGTLICLVRAGSDEEARR

SEQ ID NO: 714742 - protein, 25 aa, Mycobacterium
QLENRIVDLLMDFYPAAIAAFADPL

SEQ ID NO: 714743 - protein, 19 aa, Mycobacterium
QLEPLPDRVLMVGDRMHDV

SEQ ID NO: 714744 - protein, 18 aa, Mycobacterium
QLEQAGWFGKTFSSARDV

SEQ ID NO: 714745 - protein, 21 aa, Mycobacterium
QLERFAPGFSERVVATVSKGT

SEQ ID NO: 714746 - protein, 28 aa, Mycobacterium
QLERGGLRPGRRSALAAAARQVLAVMAR

SEQ ID NO: 714747 - protein, 22 aa, Mycobacterium
QLESIGILLCLCTKNNAADVDE

SEQ ID NO: 714748 - protein, 25 aa, Mycobacterium
QLESRSARLLACWGNNDGPALRARL

SEQ ID NO: 714749 - protein, 20 aa, Mycobacterium
QLEWLARALAQRPVSEPLFD

SEQ ID NO: 714750 - protein, 24 aa, Mycobacterium
QLFETIVMLALQFVIHRTLVLINL

SEQ ID NO: 714751 - protein, 23 aa, Mycobacterium
QLFKMAAELAYLEFGDLIDTLVE

SEQ ID NO: 714752 - protein, 17 aa, Mycobacterium
QLFPGEMFADLFPSRRG

SEQ ID NO: 714753 - protein, 18 aa, Mycobacterium
QLFPGRRFGGGALSVYVD

SEQ ID NO: 714754 - protein, 20 aa, Mycobacterium
QLFPTADGYLALFITHDGFW

SEQ ID NO: 714755 - protein, 24 aa, Mycobacterium
QLFQELPLRRWAVRQHADTSITVQ

SEQ ID NO: 714756 - protein, 27 aa, Mycobacterium
QLFRSTPIPVCLWFFDTDKGTRSGQVL

SEQ ID NO: 714757 - protein, 17 aa, Mycobacterium
QLFSLPEGYEVILGNGG

SEQ ID NO: 714758 - protein, 25 aa, Mycobacterium
QLFSTAEGFLALFITHDGFWASFAR

SEQ ID NO: 714759 - protein, 17 aa, Mycobacterium
QLFTEGVSMDWPKAFAG

SEQ ID NO: 714760 - protein, 25 aa, Mycobacterium
QLFTGDCLFPGGPGRTTRPEDFDSL

SEQ ID NO: 714761 - protein, 28 aa, Mycobacterium
QLFTGDCLFPGGVGKTWQPGDFTQLLTD

SEQ ID NO: 714762 - protein, 23 aa, Mycobacterium
QLFTRTGAGLAFTPGGLRLASRA

SEQ ID NO: 714763 - protein, 17 aa, Mycobacterium
QLFTTGVPVDWPAVFAG

SEQ ID NO: 714764 - protein, 20 aa, Mycobacterium
QLFVRGSRRLALTAAGQELL

SEQ ID NO: 714765 - protein, 20 aa, Mycobacterium
QLGANLRRAAEMTAISDERV

SEQ ID NO: 714766 - protein, 24 aa, Mycobacterium
QLGARCNIEHGCVVAEADHLHGAE

SEQ ID NO: 714767 - protein, 24 aa, Mycobacterium
QLGARCNIEHGCVVAQAETLRGAE

SEQ ID NO: 714768 - protein, 17 aa, Mycobacterium
QLGEALDAPVLLHPADE

SEQ ID NO: 714769 - protein, 25 aa, Mycobacterium
QLGEFKGVQSFKRWAAEHSGNDDPT

SEQ ID NO: 714770 - protein, 23 aa, Mycobacterium
QLGEIPVLLARTGYTGEDGFELY

SEQ ID NO: 714771 - protein, 20 aa, Mycobacterium
QLGERGEHTWRVPTYQLLKR

SEQ ID NO: 714772 - protein, 25 aa, Mycobacterium
QLGFPCGISAFGVLEQFVEQLLAGE

SEQ ID NO: 714773 - protein, 18 aa, Mycobacterium
QLGGFSIIDVPTLADAQR

SEQ ID NO: 714774 - protein, 19 aa, Mycobacterium
QLGGLPFSGPIGAVRVALI

SEQ ID NO: 714775 - protein, 24 aa, Mycobacterium
QLGHAHCAMRWFERNRAACGPPGL

SEQ ID NO: 714776 - protein, 19 aa, Mycobacterium
QLGKFSRRSLLEVIQKGAS

SEQ ID NO: 714777 - protein, 19 aa, Mycobacterium
QLGLAAPVEGDWLLLVELA

SEQ ID NO: 714778 - protein, 26 aa, Mycobacterium
QLGLEPPRFCAVCGRRMTVQVRPDGW

SEQ ID NO: 714779 - protein, 29 aa, Mycobacterium
QLGLRLALDRSFADWGMRLVFLRVGGVTI

SEQ ID NO: 714780 - protein, 27 aa, Mycobacterium
QLGLTLPEFVCLRILSAQPRQSNAELA

SEQ ID NO: 714781 - protein, 25 aa, Mycobacterium
QLGLVPMRAGNRWDISAPRNTYQTA

SEQ ID NO: 714782 - protein, 23 aa, Mycobacterium
QLGPEGVPVFLLPANPVSALVVF

SEQ ID NO: 714783 - protein, 31 aa, Mycobacterium
QLGPFLHWLLWAHRDLKVYLLKSNLRLLPAL

SEQ ID NO: 714784 - protein, 18 aa, Mycobacterium
QLGQLFTAPLAALAQPLQ

SEQ ID NO: 714785 - protein, 29 aa, Mycobacterium
QLGQLRPLYRPGLVHMYHALTWGPLVREI

SEQ ID NO: 714786 - protein, 18 aa, Mycobacterium
QLGSMWYVSLDYINHQTS

SEQ ID NO: 714787 - protein, 24 aa, Mycobacterium
QLGTEVIIVPGLWRDFDHTALAYQ

SEQ ID NO: 714788 - protein, 18 aa, Mycobacterium
QLGTGIAVAFARNPMTTA

SEQ ID NO: 714789 - protein, 20 aa, Mycobacterium
QLGVAAFELVVVNLYPFTQT

SEQ ID NO: 714790 - protein, 18 aa, Mycobacterium
QLGVAGRRVGYGADSSSQ

SEQ ID NO: 714791 - protein, 25 aa, Mycobacterium
QLGVPGDAAALWQAFDRHADGLDIL

SEQ ID NO: 714792 - protein, 17 aa, Mycobacterium
QLGYWGAQPPQNHGELV

SEQ ID NO: 714793 - protein, 20 aa, Mycobacterium
QLHAQFPIFAAAFDAVAGEL

SEQ ID NO: 714794 - protein, 30 aa, Mycobacterium
QLHCETMWCPSVSLSMWANAWLAGKAAPDD

SEQ ID NO: 714795 - protein, 20 aa, Mycobacterium
QLHDCFRDKYGVDGADTRRK

SEQ ID NO: 714796 - protein, 23 aa, Mycobacterium
QLHDCFYNERFLQMAKEYWNAEY

SEQ ID NO: 714797 - protein, 25 aa, Mycobacterium
QLHGCGRGGIRIAVAVTVTANHPGS

SEQ ID NO: 714798 - protein, 23 aa, Mycobacterium
QLHGELLPALGLSASDLDAVPVS

SEQ ID NO: 714799 - protein, 18 aa, Mycobacterium
QLHGGIGMTAEYPVGHYA

SEQ ID NO: 714800 - protein, 19 aa, Mycobacterium
QLHGGYGYMREYAVARAFV

SEQ ID NO: 714801 - protein, 19 aa, Mycobacterium
QLHKRGSSLLAQPVSSIMT

SEQ ID NO: 714802 - protein, 18 aa, Mycobacterium
QLHRRPGPGLGIEIDPDK

SEQ ID NO: 714803 - protein, 29 aa, Mycobacterium
QLHSGTLARLEWIKARGYAITDTVDEAIN

SEQ ID NO: 714804 - protein, 18 aa, Mycobacterium
QLIAEFLDSIGIDEFDLV

SEQ ID NO: 714805 - protein, 17 aa, Mycobacterium
QLIAGLLNLAPRWYIGS

SEQ ID NO: 714806 - protein, 18 aa, Mycobacterium
QLIARPGTRGLITANGGY

SEQ ID NO: 714807 - protein, 21 aa, Mycobacterium
QLIDIPLKFHHPMWREHCEVD

SEQ ID NO: 714808 - protein, 23 aa, Mycobacterium
QLIDRIGVDNVMWSSDYPHNEST

SEQ ID NO: 714809 - protein, 19 aa, Mycobacterium
QLIEFCLLAGHYDGLAATM

SEQ ID NO: 714810 - protein, 18 aa, Mycobacterium
QLIEGSAYSESFGGGTFV

SEQ ID NO: 714811 - protein, 28 aa, Mycobacterium
QLIGFALLRYVWKIEPIASMPADQVVSA

SEQ ID NO: 714812 - protein, 23 aa, Mycobacterium
QLIGVAMARYIVKMEPFASLPAE

SEQ ID NO: 714813 - protein, 19 aa, Mycobacterium
QLIKSLVWEAFRLEQVEDD

SEQ ID NO: 714814 - protein, 18 aa, Mycobacterium
QLIMEAGADIAILEPAAY

SEQ ID NO: 714815 - protein, 19 aa, Mycobacterium
QLIRARRAVILGSGGFEHN

SEQ ID NO: 714816 - protein, 29 aa, Mycobacterium
QLISTVPPLLKWFATRPLIAGVVTVEEGM

SEQ ID NO: 714817 - protein, 22 aa, Mycobacterium
QLKGAKDKAVYAVHDPEDEDFN

SEQ ID NO: 714818 - protein, 29 aa, Mycobacterium
QLKSARPAAGYLVEWDLPADLDMETYLAR

SEQ ID NO: 714819 - protein, 18 aa, Mycobacterium
QLKSIRNGYSATLQKSLG

SEQ ID NO: 714820 - protein, 24 aa, Mycobacterium
QLKTLRYVERFTFVGGDIDVLVVV

SEQ ID NO: 714821 - protein, 20 aa, Mycobacterium
QLLAGFPYPHLLTVAVRLAD

SEQ ID NO: 714822 - protein, 26 aa, Mycobacterium
QLLASDFRAGCPIAAVAVEAGEGPDS

SEQ ID NO: 714823 - protein, 25 aa, Mycobacterium
QLLASDFRAGCPVVAVAVEAGDPEK

SEQ ID NO: 714824 - protein, 19 aa, Mycobacterium
QLLASFPWPLNKTTTVDKC

SEQ ID NO: 714825 - protein, 19 aa, Mycobacterium
QLLAWLTGHHDVAFGTTVS

SEQ ID NO: 714826 - protein, 25 aa, Mycobacterium
QLLAWRARLGALVFGRTPTLEQSTR

SEQ ID NO: 714827 - protein, 22 aa, Mycobacterium
QLLCVQRLHGGLTIGDTHEYAE

SEQ ID NO: 714828 - protein, 17 aa, Mycobacterium
QLLDIGAQNIIVPMIDG

SEQ ID NO: 714829 - protein, 24 aa, Mycobacterium
QLLDIKGIGPWTADYVVMRQLADP

SEQ ID NO: 714830 - protein, 18 aa, Mycobacterium
QLLDMALTRPAGFAPGEK

SEQ ID NO: 714831 - protein, 19 aa, Mycobacterium
QLLDPLPRFDGMRPVLGAW

SEQ ID NO: 714832 - protein, 26 aa, Mycobacterium
QLLDRAGEVLGCYFLLEPGAPADTGG

SEQ ID NO: 714833 - protein, 17 aa, Mycobacterium
QLLDVPAEAAAVFEDAL

SEQ ID NO: 714834 - protein, 20 aa, Mycobacterium
QLLEGSAYSESFARGTFVHY

SEQ ID NO: 714835 - protein, 23 aa, Mycobacterium
QLLELPKAIPIHIDDYGVFASPR

SEQ ID NO: 714836 - protein, 19 aa, Mycobacterium
QLLETAWEAIEHAGLDPAS

SEQ ID NO: 714837 - protein, 24 aa, Mycobacterium
QLLEYHWGPDWMVWDAHKTAQQHG

SEQ ID NO: 714838 - protein, 25 aa, Mycobacterium
QLLFDAGARSVHWVVGSPPFISPSY

SEQ ID NO: 714839 - protein, 18 aa, Mycobacterium
QLLFWTWLAYGGRLLRGK

SEQ ID NO: 714840 - protein, 18 aa, Mycobacterium
QLLGGWKGASGSAYASAW

SEQ ID NO: 714841 - protein, 19 aa, Mycobacterium
QLLGMGVHVVAGRGELIDP

SEQ ID NO: 714842 - protein, 42 aa, Mycobacterium
QLLGSGWKGGAGSAYSEQWDKWHNGAGQVIRGLQAMSESLKA

SEQ ID NO: 714843 - protein, 17 aa, Mycobacterium
QLLGVVMARHIVKIEPF

SEQ ID NO: 714844 - protein, 18 aa, Mycobacterium
QLLIERAYLLGVTGPEMT

SEQ ID NO: 714845 - protein, 17 aa, Mycobacterium
QLLILPIIGVLDSQRAR

SEQ ID NO: 714846 - protein, 23 aa, Mycobacterium
QLLKETRQLLATEWVRQDQLAAG

SEQ ID NO: 714847 - protein, 24 aa, Mycobacterium
QLLLDAGGARRARHAFDRQLDVAH

SEQ ID NO: 714848 - protein, 27 aa, Mycobacterium
QLLLGGLPVRRLWGIGPVAEEKLHRLG

SEQ ID NO: 714849 - protein, 19 aa, Mycobacterium
QLLLNRPLIGNGTDGTAAN

SEQ ID NO: 714850 - protein, 21 aa, Mycobacterium
QLLLWRTGFCERLVAQGLRVI

SEQ ID NO: 714851 - protein, 23 aa, Mycobacterium
QLLNQRVTIIGGRGELVDDVAGM

SEQ ID NO: 714852 - protein, 30 aa, Mycobacterium
QLLPDAEPFRAWANFEFRDNRGRWHEVDLL

SEQ ID NO: 714853 - protein, 18 aa, Mycobacterium
QLLPDLAVLADDFTVELQ

SEQ ID NO: 714854 - protein, 19 aa, Mycobacterium
QLLPGRFSVALAQAEPLGD

SEQ ID NO: 714855 - protein, 18 aa, Mycobacterium
QLLPWALDGVELGAHTLE

SEQ ID NO: 714856 - protein, 18 aa, Mycobacterium
QLLPWALQGVELGADTLE

SEQ ID NO: 714857 - protein, 25 aa, Mycobacterium
QLLQFLLDCRAEGKLVVGYGAPGKG

SEQ ID NO: 714858 - protein, 24 aa, Mycobacterium
QLLQFRLMVLYTAWEIDKYNDYKK

SEQ ID NO: 714859 - protein, 24 aa, Mycobacterium
QLLQFRLMVLYTAWEIDKYNDYKL

SEQ ID NO: 714860 - protein, 23 aa, Mycobacterium
QLLQLRFAHKIPALHTTSTLDTL

SEQ ID NO: 714861 - protein, 18 aa, Mycobacterium
QLLQNIPGLSALSAVGNI

SEQ ID NO: 714862 - protein, 23 aa, Mycobacterium
QLLRIVDVAGRFSIIDLGCGYGA

SEQ ID NO: 714863 - protein, 25 aa, Mycobacterium
QLLSELPPFLTGGSMIETVTMESST

SEQ ID NO: 714864 - protein, 23 aa, Mycobacterium
QLLTAPSTRQWLFPSPLLRARQA

SEQ ID NO: 714865 - protein, 18 aa, Mycobacterium
QLLTRGNAILGIGVGERE

SEQ ID NO: 714866 - protein, 17 aa, Mycobacterium
QLLTRMRRAHVLTDDAG

SEQ ID NO: 714867 - protein, 26 aa, Mycobacterium
QLLTWLIAHGRLEIKLAVVSNKQGIG

SEQ ID NO: 714868 - protein, 25 aa, Mycobacterium
QLLVKAEAIGVNFIDTYFRSGQYPR

SEQ ID NO: 714869 - protein, 19 aa, Mycobacterium
QLLVLCMLASKPIDATIAM

SEQ ID NO: 714870 - protein, 19 aa, Mycobacterium
QLLVLCMLASKPIDATIAT

SEQ ID NO: 714871 - protein, 18 aa, Mycobacterium
QLLVRVRAAAVNFPDVLF

SEQ ID NO: 714872 - protein, 17 aa, Mycobacterium
QLLWALGSREMSVNDLA

SEQ ID NO: 714873 - protein, 18 aa, Mycobacterium
QLLYWTQVLMIARGLSLD

SEQ ID NO: 714874 - protein, 21 aa, Mycobacterium
QLLYWTQVLMISRGVSLDEVY

SEQ ID NO: 714875 - protein, 25 aa, Mycobacterium
QLLYYAAKGHGSWRVKDNGTPVQIF

SEQ ID NO: 714876 - protein, 21 aa, Mycobacterium
QLMALEIMERIEGRPQDVAAL

SEQ ID NO: 714877 - protein, 19 aa, Mycobacterium
QLMAPMLMHLFVRPTSANL

SEQ ID NO: 714878 - protein, 25 aa, Mycobacterium
QLMKAALPFGLWVPVLPGTRQVTVG

SEQ ID NO: 714879 - protein, 25 aa, Mycobacterium
QLMKAALPLGLWVPVLPGTRQVTIG

SEQ ID NO: 714880 - protein, 25 aa, Mycobacterium
QLMKAGPDWSHWPPRVLGHADPTTI

SEQ ID NO: 714881 - protein, 27 aa, Mycobacterium
QLMREYPDLAAFEWAIRAGNIVSSDWP

SEQ ID NO: 714882 - protein, 26 aa, Mycobacterium
QLMRNRIDLLIGHGRFVDPHTIEVED

SEQ ID NO: 714883 - protein, 26 aa, Mycobacterium
QLMRNRIDLLLGHGRFVDPHTIEVED

SEQ ID NO: 714884 - protein, 22 aa, Mycobacterium
QLMSVLARRHMHLYGTRREAFA

SEQ ID NO: 714885 - protein, 26 aa, Mycobacterium
QLNDFCVHLLRSAFATVLVARVDLDS

SEQ ID NO: 714886 - protein, 26 aa, Mycobacterium
QLNRLRRWYCDGALCIGDAAHAMSPV

SEQ ID NO: 714887 - protein, 18 aa, Mycobacterium
QLPAAKRGVGVGFESYAL

SEQ ID NO: 714888 - protein, 25 aa, Mycobacterium
QLPADWEPLGAIAIGYAQQPAELRD

SEQ ID NO: 714889 - protein, 24 aa, Mycobacterium
QLPADWEPLGAIAIGYPSEPPGPR

SEQ ID NO: 714890 - protein, 22 aa, Mycobacterium
QLPAEPPPGVAPIAEGHPMGEI

SEQ ID NO: 714891 - protein, 21 aa, Mycobacterium
QLPAGAWALPGIGLVHASAAL

SEQ ID NO: 714892 - protein, 18 aa, Mycobacterium
QLPAHKVYPWVAEVRHST

SEQ ID NO: 714893 - protein, 19 aa, Mycobacterium
QLPAPVPYRKFVAWLAAQD

SEQ ID NO: 714894 - protein, 24 aa, Mycobacterium
QLPARVQSLLARRAAGVARRRAAY

SEQ ID NO: 714895 - protein, 28 aa, Mycobacterium
QLPDGISRLRFRLRWRDFGVTVDANHSD

SEQ ID NO: 714896 - protein, 30 aa, Mycobacterium
QLPDGISRLRFRLRWRGYRLTVDANHSTVT

SEQ ID NO: 714897 - protein, 23 aa, Mycobacterium
QLPDGPLPVMFYIYGGGYFLGSS

SEQ ID NO: 714898 - protein, 19 aa, Mycobacterium
QLPDPSRAEPGSWLLLSAC

SEQ ID NO: 714899 - protein, 21 aa, Mycobacterium
QLPEAQLDRFLMKLNVTLPAR

SEQ ID NO: 714900 - protein, 31 aa, Mycobacterium
QLPEAVALQARWGDGWVKLVGDWIDRAVGDL

SEQ ID NO: 714901 - protein, 18 aa, Mycobacterium
QLPEEVRNRYDLSSLRLA

SEQ ID NO: 714902 - protein, 22 aa, Mycobacterium
QLPELLAELSARPITRILLNTN

SEQ ID NO: 714903 - protein, 19 aa, Mycobacterium
QLPEQSFGDIIAAIQGEVD

SEQ ID NO: 714904 - protein, 25 aa, Mycobacterium
QLPFLRINSEFYPREIPRASLAPVI

SEQ ID NO: 714905 - protein, 21 aa, Mycobacterium
QLPGHKVYPWVADVRHSTPGV

SEQ ID NO: 714906 - protein, 21 aa, Mycobacterium
QLPGHKVYPWVAEVRHSTPGV

SEQ ID NO: 714907 - protein, 17 aa, Mycobacterium
QLPGHKVYPWVAKVRHS

SEQ ID NO: 714908 - protein, 24 aa, Mycobacterium
QLPGREWAALCIGRGASRNRTARR

SEQ ID NO: 714909 - protein, 22 aa, Mycobacterium
QLPHYMVPAAIMSLERLPLTVN

SEQ ID NO: 714910 - protein, 18 aa, Mycobacterium
QLPKGFDYKTHFGPKYNP

SEQ ID NO: 714911 - protein, 22 aa, Mycobacterium
QLPKICLEAGRGIRGTIGHTQP

SEQ ID NO: 714912 - protein, 23 aa, Mycobacterium
QLPKICLELGRGIRGTIGHTQPR

SEQ ID NO: 714913 - protein, 24 aa, Mycobacterium
QLPKICLEMGRGIRGTIGHTQPRR

SEQ ID NO: 714914 - protein, 17 aa, Mycobacterium
QLPLPFLGLEARPYGSI

SEQ ID NO: 714915 - protein, 24 aa, Mycobacterium
QLPLRPDLLALFEIGELEKYFTPE

SEQ ID NO: 714916 - protein, 26 aa, Mycobacterium
QLPNTFMVFGPFAWSGSSWHVMVENA

SEQ ID NO: 714917 - protein, 22 aa, Mycobacterium
QLPQPRPAGYVIVGDTASLPAI

SEQ ID NO: 714918 - protein, 19 aa, Mycobacterium
QLPRGRRVGTQDVALKTHA

SEQ ID NO: 714919 - protein, 24 aa, Mycobacterium
QLPRLLKDAAVGLMRVRRRSRERG

SEQ ID NO: 714920 - protein, 19 aa, Mycobacterium
QLPRLTRLGVLSGAVGDTV

SEQ ID NO: 714921 - protein, 23 aa, Mycobacterium
QLPRPERQRVFTIANQKGGVGKT

SEQ ID NO: 714922 - protein, 18 aa, Mycobacterium
QLPSHVNAAVVMLALARM

SEQ ID NO: 714923 - protein, 19 aa, Mycobacterium
QLPVPGCWDDPDNPVNFIG

SEQ ID NO: 714924 - protein, 25 aa, Mycobacterium
QLPVVCTVRGWAVGLGCNLALAADF

SEQ ID NO: 714925 - protein, 25 aa, Mycobacterium
QLPVYRPPLDLGRLFGEPAIGAPGA

SEQ ID NO: 714926 - protein, 34 aa, Mycobacterium
QLQHALPITFGYRVACWTAPLLRHLDRLAELRPR

SEQ ID NO: 714927 - protein, 23 aa, Mycobacterium
QLQKVAHQCALWLNPDGKFSDAD

SEQ ID NO: 714928 - protein, 18 aa, Mycobacterium
QLQLPGGNTMDLYNLHAN

SEQ ID NO: 714929 - protein, 22 aa, Mycobacterium
QLQRLRDDLGLIPLATEEMIRW

SEQ ID NO: 714930 - protein, 25 aa, Mycobacterium
QLQRNRIDLISGIGRFADEHTVVVE

SEQ ID NO: 714931 - protein, 23 aa, Mycobacterium
QLQRPEEVAARRGLPIEDVAPAG

SEQ ID NO: 714932 - protein, 25 aa, Mycobacterium
QLQTRFPTIAALLDWVLPLHDNEIK

SEQ ID NO: 714933 - protein, 19 aa, Mycobacterium
QLQYRGAIRQNQFNTLKRR

SEQ ID NO: 714934 - protein, 25 aa, Mycobacterium
QLRADELSVRIPAALDRLGAADSDA

SEQ ID NO: 714935 - protein, 19 aa, Mycobacterium
QLRAEGMLVASGDGGNADP

SEQ ID NO: 714936 - protein, 23 aa, Mycobacterium
QLRAHCPQVRFLHLAGSPALIGV

SEQ ID NO: 714937 - protein, 20 aa, Mycobacterium
QLRAKRAWDEHRFDREISPI

SEQ ID NO: 714938 - protein, 21 aa, Mycobacterium
QLRAVTNWVGPVGTGARLANA

SEQ ID NO: 714939 - protein, 23 aa, Mycobacterium
QLREELGALLLQVLFQARIAQDA

SEQ ID NO: 714940 - protein, 25 aa, Mycobacterium
QLREFPFNVFARFLPGRDIRATAEQ

SEQ ID NO: 714941 - protein, 19 aa, Mycobacterium
QLRELAARTLAEFELSGVI

SEQ ID NO: 714942 - protein, 27 aa, Mycobacterium
QLRERLGFGELRWAISGAAPIPKETLG

SEQ ID NO: 714943 - protein, 21 aa, Mycobacterium
QLRFEAFLVGVGRRQPDDPER

SEQ ID NO: 714944 - protein, 18 aa, Mycobacterium
QLRFPKKQGMRIDFILGS

SEQ ID NO: 714945 - protein, 24 aa, Mycobacterium
QLRFPKRQGMRIDFILASPALADR

SEQ ID NO: 714946 - protein, 17 aa, Mycobacterium
QLRGESSGFAFTFADAE

SEQ ID NO: 714947 - protein, 26 aa, Mycobacterium
QLRGFHDQLVRLMRAGAAAYASVEAT

SEQ ID NO: 714948 - protein, 23 aa, Mycobacterium
QLRGMGARVLRWVDGERHMTDLA

SEQ ID NO: 714949 - protein, 21 aa, Mycobacterium
QLRHAIDMSLMYAPTVNSYKR

SEQ ID NO: 714950 - protein, 19 aa, Mycobacterium
QLRLERVVLVGVWTEGSAA

SEQ ID NO: 714951 - protein, 19 aa, Mycobacterium
QLRLERVVLVGVWTEGTAA

SEQ ID NO: 714952 - protein, 20 aa, Mycobacterium
QLRLKRLHPAAQYRATTSVV

SEQ ID NO: 714953 - protein, 19 aa, Mycobacterium
QLRLKRLYSGANYRATTST

SEQ ID NO: 714954 - protein, 21 aa, Mycobacterium
QLRLQRPIMFDPYRRNRTTGS

SEQ ID NO: 714955 - protein, 20 aa, Mycobacterium
QLRLRQVLQISGTTDLLQHL

SEQ ID NO: 714956 - protein, 25 aa, Mycobacterium
QLRLSSTCRVYLPFIGGKLEDLILY

SEQ ID NO: 714957 - protein, 22 aa, Mycobacterium
QLRMLCVFNPPVTGQEVHDETG

SEQ ID NO: 714958 - protein, 20 aa, Mycobacterium
QLRNRRRRVAGRPGQNRVVA

SEQ ID NO: 714959 - protein, 23 aa, Mycobacterium
QLRPCPVGQVGMLARGGAIPLGY

SEQ ID NO: 714960 - protein, 25 aa, Mycobacterium
QLRPDLEIWYTLPVLPSGLTADGLN

SEQ ID NO: 714961 - protein, 20 aa, Mycobacterium
QLRPRVLYHDVIEDITDQHA

SEQ ID NO: 714962 - protein, 19 aa, Mycobacterium
QLRRLPLVIVANGVLTRSV

SEQ ID NO: 714963 - protein, 17 aa, Mycobacterium
QLRRMVAEQVSLILRRT

SEQ ID NO: 714964 - protein, 17 aa, Mycobacterium
QLRRVRAAVDWDQEIGA

SEQ ID NO: 714965 - protein, 20 aa, Mycobacterium
QLRSPWSKRVCDALTVAGHR

SEQ ID NO: 714966 - protein, 25 aa, Mycobacterium
QLRSRSWWSGFDVVLLVDDWHMIVG

SEQ ID NO: 714967 - protein, 18 aa, Mycobacterium
QLRTLFVAKEDITPVPEV

SEQ ID NO: 714968 - protein, 19 aa, Mycobacterium
QLRTLPLVERGYRVDRTVA

SEQ ID NO: 714969 - protein, 21 aa, Mycobacterium
QLRVGHSLDPKADYGPLVTEA

SEQ ID NO: 714970 - protein, 18 aa, Mycobacterium
QLRVRGVERLRVADASVM

SEQ ID NO: 714971 - protein, 20 aa, Mycobacterium
QLRYDEVLARVARDGDLLAG

SEQ ID NO: 714972 - protein, 17 aa, Mycobacterium
QLSAAGWSDRVDHVVDV

SEQ ID NO: 714973 - protein, 26 aa, Mycobacterium
QLSADRGWVVLLARYQRPKAIRQTGI

SEQ ID NO: 714974 - protein, 24 aa, Mycobacterium
QLSAYKVPTRWVIACSDDIPTLPS

SEQ ID NO: 714975 - protein, 24 aa, Mycobacterium
QLSEARMLLIGAMFTNEYAIEGAA

SEQ ID NO: 714976 - protein, 24 aa, Mycobacterium
QLSEGRLHGFGFLYEAVLQLRHQA

SEQ ID NO: 714977 - protein, 20 aa, Mycobacterium
QLSEHFSRHFGVFREAQAGA

SEQ ID NO: 714978 - protein, 23 aa, Mycobacterium
QLSENGWRTFFRGLANDGVQGPS

SEQ ID NO: 714979 - protein, 19 aa, Mycobacterium
QLSEWEWPEDPRFLMITPL

SEQ ID NO: 714980 - protein, 18 aa, Mycobacterium
QLSFRGGNMTSRRLSTAL

SEQ ID NO: 714981 - protein, 19 aa, Mycobacterium
QLSGKRIVIDPGLGGGDRG

SEQ ID NO: 714982 - protein, 19 aa, Mycobacterium
QLSGLPFSGPIGGVRVALI

SEQ ID NO: 714983 - protein, 27 aa, Mycobacterium
QLSLAPCALLSCAIPTGYGSAANRAGV

SEQ ID NO: 714984 - protein, 24 aa, Mycobacterium
QLSLLQRRPELIGSAVEEVLRYTG

SEQ ID NO: 714985 - protein, 25 aa, Mycobacterium
QLSPPRPGMRVPVLYDPKDHSRVRL

SEQ ID NO: 714986 - protein, 18 aa, Mycobacterium
QLSQYKFQPPAAANPAPA

SEQ ID NO: 714987 - protein, 23 aa, Mycobacterium
QLSRARALLLGRDYVIPEDVKAL

SEQ ID NO: 714988 - protein, 20 aa, Mycobacterium
QLSTQIPRRGEYAIPARPPA

SEQ ID NO: 714989 - protein, 21 aa, Mycobacterium
QLSYFWPRVVGNTEWQLMDSK

SEQ ID NO: 714990 - protein, 28 aa, Mycobacterium
QLTADFNFAWPTARIAVIGAEGAAQLLM

SEQ ID NO: 714991 - protein, 29 aa, Mycobacterium
QLTADFNFAWPTARIAVIGAEGAAQLLMK

SEQ ID NO: 714992 - protein, 26 aa, Mycobacterium
QLTAPWANLIKFLGGINFAIANFNPL

SEQ ID NO: 714993 - protein, 26 aa, Mycobacterium
QLTEIVEAYLPLGWQMACHVQGDAGV

SEQ ID NO: 714994 - protein, 21 aa, Mycobacterium
QLTGRIKNIINRGGEKISPEH

SEQ ID NO: 714995 - protein, 23 aa, Mycobacterium
QLTILRRDIDVFTTFEGDNTVLT

SEQ ID NO: 714996 - protein, 23 aa, Mycobacterium
QLTKRIRLRVPLVSSAMDTVTES

SEQ ID NO: 714997 - protein, 18 aa, Mycobacterium
QLTLKVVPLFTLHRDDEL

SEQ ID NO: 714998 - protein, 19 aa, Mycobacterium
QLTLPFAAPHTMFNVKIGG

SEQ ID NO: 714999 - protein, 18 aa, Mycobacterium
QLTLPFATPRTMLNVAIG

SEQ ID NO: 715000 - protein, 20 aa, Mycobacterium
QLTLTQLWRSYGVQPDLVIG

SEQ ID NO: 715001 - protein, 18 aa, Mycobacterium
QLTMRVFTGLTMLDTIQG

SEQ ID NO: 715002 - protein, 24 aa, Mycobacterium
QLTPAGLIVADWATRLLDVAHEVD

SEQ ID NO: 715003 - protein, 24 aa, Mycobacterium
QLTPAGLIVSEWAARLLEVAQEID

SEQ ID NO: 715004 - protein, 23 aa, Mycobacterium
QLTPQFRPGCKRMLMTNDYYPAL

SEQ ID NO: 715005 - protein, 25 aa, Mycobacterium
QLTQAGWVGVRWRNLTGGIVALHAG

SEQ ID NO: 715006 - protein, 18 aa, Mycobacterium
QLTQAGWVVQDKKDLNLF

SEQ ID NO: 715007 - protein, 24 aa, Mycobacterium
QLTQPVRWDLCTATIREHSVTAIV

SEQ ID NO: 715008 - protein, 26 aa, Mycobacterium
QLTQPVRWDLCTATMRDREITAAVEF

SEQ ID NO: 715009 - protein, 25 aa, Mycobacterium
QLTQPVRWDLCTAYLRDHAESPVTA

SEQ ID NO: 715010 - protein, 27 aa, Mycobacterium
QLTRLLRAGAIAKRVRRAMDHLPLGNA

SEQ ID NO: 715011 - protein, 24 aa, Mycobacterium
QLTRLPFGEVYPFSMTNTYLTLDI

SEQ ID NO: 715012 - protein, 27 aa, Mycobacterium
QLTVRYALRRAGALRVWPQRARAYREI

SEQ ID NO: 715013 - protein, 25 aa, Mycobacterium
QLVADLLPQVFRWARAVDPSQPLTS

SEQ ID NO: 715014 - protein, 24 aa, Mycobacterium
QLVAQRLAAFGAHITAYDPYVSHA

SEQ ID NO: 715015 - protein, 25 aa, Mycobacterium
QLVAQRLAAFGAHIVAYDPYVSQAR

SEQ ID NO: 715016 - protein, 19 aa, Mycobacterium
QLVDEKWVWLPAVLAGRVF

SEQ ID NO: 715017 - protein, 25 aa, Mycobacterium
QLVDIPFKFHHPMWRENCDVDLEYH

SEQ ID NO: 715018 - protein, 25 aa, Mycobacterium
QLVDIPWKLHHPMWIQNAEIDVDYH

SEQ ID NO: 715019 - protein, 17 aa, Mycobacterium
QLVDWLVGAGYTHCFFV

SEQ ID NO: 715020 - protein, 17 aa, Mycobacterium
QLVFKVPAADAFVADPV

SEQ ID NO: 715021 - protein, 19 aa, Mycobacterium
QLVGDTRWELIDSKFTLVA

SEQ ID NO: 715022 - protein, 17 aa, Mycobacterium
QLVKAVVRAGGARRSAR

SEQ ID NO: 715023 - protein, 24 aa, Mycobacterium
QLVKEGRPPFAVVGVDGGSDSYWH

SEQ ID NO: 715024 - protein, 24 aa, Mycobacterium
QLVKVRPGYEAALAAVLGAAADAL

SEQ ID NO: 715025 - protein, 35 aa, Mycobacterium
QLVLPAERAEFGWEVIDTTGWPHARLGYAIEDAAR

SEQ ID NO: 715026 - protein, 19 aa, Mycobacterium
QLVNVPFYRVLELVPQLSW

SEQ ID NO: 715027 - protein, 20 aa, Mycobacterium
QLVRACAATHSVALVGAAVE

SEQ ID NO: 715028 - protein, 20 aa, Mycobacterium
QLVRCTRGAIAAVAVDIRPG

SEQ ID NO: 715029 - protein, 20 aa, Mycobacterium
QLVRHARDAYTLGVSDAGDP

SEQ ID NO: 715030 - protein, 20 aa, Mycobacterium
QLVRRCLRRNVPGPYQIQAA

SEQ ID NO: 715031 - protein, 24 aa, Mycobacterium
QLVSLKGGGFMLVGATNGGPVQGI

SEQ ID NO: 715032 - protein, 26 aa, Mycobacterium
QLVSVSGLVAIPWAQGDRSGVAFRAD

SEQ ID NO: 715033 - protein, 20 aa, Mycobacterium
QLVTACARLRPDPTNLLDPA

SEQ ID NO: 715034 - protein, 19 aa, Mycobacterium
QLWAETRIELFTQSTDTRP

SEQ ID NO: 715035 - protein, 19 aa, Mycobacterium
QLWARLSVFAGSFDLDLAH

SEQ ID NO: 715036 - protein, 17 aa, Mycobacterium
QLWDQVIGVLTSNFEQA

SEQ ID NO: 715037 - protein, 24 aa, Mycobacterium
QLWPFTSNLGSLTFGQSVAQGVAI

SEQ ID NO: 715038 - protein, 25 aa, Mycobacterium
QLWRSMAGRCGHLYTGHSVVRLTEQ

SEQ ID NO: 715039 - protein, 30 aa, Mycobacterium; identical to SEQ ID NO: 102536

SEQ ID NO: 715040 - protein, 26 aa, Mycobacterium
QLYDGFSFLTVMWLEAMGFCEHGKVG

SEQ ID NO: 715041 - protein, 18 aa, Mycobacterium
QLYTRTPTLLAMTAAGLD

SEQ ID NO: 715042 - protein, 22 aa, Mycobacterium
QMAAGEIKACWIICTNPVASVA

SEQ ID NO: 715043 - protein, 19 aa, Mycobacterium
QMAAMVLLIGQSVLQSARI

SEQ ID NO: 715044 - protein, 24 aa, Mycobacterium
QMAEAAKPYVAWMRTTAMQAEQAA

SEQ ID NO: 715045 - protein, 25 aa, Mycobacterium
QMALQPFLDYAFGFRRGQNAGQPPD

SEQ ID NO: 715046 - protein, 23 aa, Mycobacterium
QMARPRWQAKAALLHLKETEQVV

SEQ ID NO: 715047 - protein, 22 aa, Mycobacterium
QMAVALGDFVKMGFEQDVAIWK

SEQ ID NO: 715048 - protein, 21 aa, Mycobacterium
QMAVSDPHWLGADADARRIHE

SEQ ID NO: 715049 - protein, 19 aa, Mycobacterium
QMCEYFVHRSLYHLKEGDP

SEQ ID NO: 715050 - protein, 23 aa, Mycobacterium
QMCKTIPLEAPWEAKKAARWDRM

SEQ ID NO: 715051 - protein, 23 aa, Mycobacterium
QMCKTIPLEAPWEAKRAAKWDRM

SEQ ID NO: 715052 - protein, 21 aa, Mycobacterium
QMCVRDIVRLVALAGPAVLAV

SEQ ID NO: 715053 - protein, 23 aa, Mycobacterium
QMDGRAAFEVKIHRVAADGGAVL

SEQ ID NO: 715054 - protein, 24 aa, Mycobacterium
QMDGRMGFEVKIHRAAADGAAVLT

SEQ ID NO: 715055 - protein, 18 aa, Mycobacterium
QMDKEICNMMGLRQLGCS

SEQ ID NO: 715056 - protein, 22 aa, Mycobacterium
QMDLPAKLAIPMRVIASVAAIL

SEQ ID NO: 715057 - protein, 22 aa, Mycobacterium
QMDLPPKLAIPMRVIASVAAIL

SEQ ID NO: 715058 - protein, 17 aa, Mycobacterium
QMDWSFGEVISYASRGV

SEQ ID NO: 715059 - protein, 17 aa, Mycobacterium
QMENGHVVVCGRVKDVI

SEQ ID NO: 715060 - protein, 17 aa, Mycobacterium
QMESHFFGTLNVTRAFV

SEQ ID NO: 715061 - protein, 19 aa, Mycobacterium
QMFPHRRFGGGALAVYLNG

SEQ ID NO: 715062 - protein, 33 aa, Mycobacterium
QMFSAAEAWDGLAAELRLAASSFESVTANLVAG

SEQ ID NO: 715063 - protein, 19 aa, Mycobacterium
QMFWDRLGGNAVISRIKAR

SEQ ID NO: 715064 - protein, 26 aa, Mycobacterium
QMGAFRTAAALARLNQRNGFDCPGCA

SEQ ID NO: 715065 - protein, 22 aa, Mycobacterium
QMGALLLQPLIDAAWDRVQSGD

SEQ ID NO: 715066 - protein, 18 aa, Mycobacterium
QMGEWRAAAVERIVGLSP

SEQ ID NO: 715067 - protein, 26 aa, Mycobacterium
QMGIGAGWYEHEWRAYGYGFPSAKVR

SEQ ID NO: 715068 - protein, 26 aa, Mycobacterium
QMGIGGGWYEHEWRAYGYGFPSAGER

SEQ ID NO: 715069 - protein, 26 aa, Mycobacterium
QMGIGGGWYEHEWRAYGYGFPSAGIR

SEQ ID NO: 715070 - protein, 26 aa, Mycobacterium
QMGIGGGWYEHEWRAYGYGFPSAGVR

SEQ ID NO: 715071 - protein, 20 aa, Mycobacterium
QMGIGWKSAFGSGKGNDAIG

SEQ ID NO: 715072 - protein, 17 aa, Mycobacterium
QMGLDFAALQAIRADIV

SEQ ID NO: 715073 - protein, 17 aa, Mycobacterium
QMHCAYPIMLAGSDELQ

SEQ ID NO: 715074 - protein, 24 aa, Mycobacterium
QMHMPAISICYGMTETSPVSTQTR

SEQ ID NO: 715075 - protein, 25 aa, Mycobacterium
QMHYPSWRLSYRGIMTPETLDLFDW

SEQ ID NO: 715076 - protein, 23 aa, Mycobacterium
QMIADRELETWLVVDMSASLDFG

SEQ ID NO: 715077 - protein, 26 aa, Mycobacterium
QMIGFAVCRYILRLSPVIEMTHQDIV

SEQ ID NO: 715078 - protein, 25 aa, Mycobacterium
QMKAREFSGGNNLLFRRNSLSGAVE

SEQ ID NO: 715079 - protein, 26 aa, Mycobacterium
QMKPKLDVLDFWSVVKPELTGIRGLC

SEQ ID NO: 715080 - protein, 23 aa, Mycobacterium
QMKRMDPSFSERSLGFRSFSDFL

SEQ ID NO: 715081 - protein, 19 aa, Mycobacterium
QMLAYNLSPSFNWDTTGMT

SEQ ID NO: 715082 - protein, 24 aa, Mycobacterium
QMLIFRPAAGMGRAETPVEGLYLG

SEQ ID NO: 715083 - protein, 24 aa, Mycobacterium
QMLIFRPAPGMGRAETPVQGLYLG

SEQ ID NO: 715084 - protein, 23 aa, Mycobacterium
QMLKKAGERFGFKVDAVTLVTEH

SEQ ID NO: 715085 - protein, 18 aa, Mycobacterium
QMLLEFGVISRRYLHAAG

SEQ ID NO: 715086 - protein, 17 aa, Mycobacterium
QMLNAFWTNPFNALLQW

SEQ ID NO: 715087 - protein, 22 aa, Mycobacterium
QMLPPKGRRAMNKALGLDTVFL

SEQ ID NO: 715088 - protein, 29 aa, Mycobacterium
QMLTAAAADLAKIGAAIDTVSTAAAASTT

SEQ ID NO: 715089 - protein, 24 aa, Mycobacterium
QMMARLRTGQPLNALDLVEDAQTT

SEQ ID NO: 715090 - protein, 24 aa, Mycobacterium
QMMSTVLGRRVWENAGSPEVDSNR

SEQ ID NO: 715091 - protein, 20 aa, Mycobacterium
QMPAVFPRIDVNEIRLSVDK

SEQ ID NO: 715092 - protein, 24 aa, Mycobacterium
QMPGGIYAPMIHPWSSGRDLYFNL

SEQ ID NO: 715093 - protein, 22 aa, Mycobacterium
QMPIHMRLPKLKGFKNRFRTEY

SEQ ID NO: 715094 - protein, 25 aa, Mycobacterium
QMPIHMRLPKLKGFKNRFRTEYQVV

SEQ ID NO: 715095 - protein, 26 aa, Mycobacterium
QMPIHMRLPKLKGFRNRFRTEYGVVN

SEQ ID NO: 715096 - protein, 25 aa, Mycobacterium
QMQAPWLPQESWRAGLSTWRGAIDD

SEQ ID NO: 715097 - protein, 24 aa, Mycobacterium
QMQFTRLIGYRSRYVSGYSDSQPG

SEQ ID NO: 715098 - protein, 24 aa, Mycobacterium
QMRGPASGEAFTFADAEKLVDYLA

SEQ ID NO: 715099 - protein, 17 aa, Mycobacterium
QMRLRSMGVYSTDGQAN

SEQ ID NO: 715100 - protein, 24 aa, Mycobacterium
QMRQWRAAAVERIRGLGGTRLLEI

SEQ ID NO: 715101 - protein, 25 aa, Mycobacterium
QMRRRSCAAAKMLADLGVGRGDGVA

SEQ ID NO: 715102 - protein, 23 aa, Mycobacterium
QMRTVSCSIALTVNVAYNGTLQV

SEQ ID NO: 715103 - protein, 25 aa, Mycobacterium
QMSDHLPMWLELSIDDGQAYLEHQR

SEQ ID NO: 715104 - protein, 24 aa, Mycobacterium
QMSECYRVGIRYAGGGVGPASVVL

SEQ ID NO: 715105 - protein, 22 aa, Mycobacterium
QMSECYRVTLRYADGTDGPASV

SEQ ID NO: 715106 - protein, 25 aa, Mycobacterium
QMSETFPGAQILAAFGQTEMSPVTC

SEQ ID NO: 715107 - protein, 28 aa, Mycobacterium
QMSRAGWSAVRWRNLTGGIVALHAGYKP

SEQ ID NO: 715108 - protein, 19 aa, Mycobacterium
QMSRFGSLVSIELSSAEAV

SEQ ID NO: 715109 - protein, 26 aa, Mycobacterium
QMSRTPEWWASWTLDSEELQKESGKV

SEQ ID NO: 715110 - protein, 30 aa, Mycobacterium
QMSTCSEFFRYYAGWCSKINGVAYDVKTDG

SEQ ID NO: 715111 - protein, 30 aa, Mycobacterium
QMSTCSEFFRYYAGWCSKLNGVAYDVKTDG

SEQ ID NO: 715112 - protein, 24 aa, Mycobacterium
QMTELTWLIPAAIAAKFWNAPPGS

SEQ ID NO: 715113 - protein, 18 aa, Mycobacterium
QMTMRVFTGLTLLDTIQG

SEQ ID NO: 715114 - protein, 27 aa, Mycobacterium
QMTSPVRWDLCTEYFKTANDTPAATAV

SEQ ID NO: 715115 - protein, 23 aa, Mycobacterium
QMVDARAAGVVFTADPTSGRRDL

SEQ ID NO: 715116 - protein, 24 aa, Mycobacterium
QMVEIKGRITGLKGEYEALSNQKF

SEQ ID NO: 715117 - protein, 17 aa, Mycobacterium
QMVERVAGLVVRHTPQL

SEQ ID NO: 715118 - protein, 42 aa, Mycobacterium
QMVGPRPLIWHVMRYYAHFGHKEFILCLGYGADHIKNYFLTY

SEQ ID NO: 715119 - protein, 18 aa, Mycobacterium
QMVKIAAAVRLHKQAHLP

SEQ ID NO: 715120 - protein, 19 aa, Mycobacterium
QMVKIAAAVRLHKQAHLPY

SEQ ID NO: 715121 - protein, 17 aa, Mycobacterium
QMVKIAAAVRLHQQAHL

SEQ ID NO: 715122 - protein, 21 aa, Mycobacterium
QMVKIAAAVRLHTRAHLPYLV

SEQ ID NO: 715123 - protein, 21 aa, Mycobacterium
QMVLPPCHAFFQFYVADGRLS

SEQ ID NO: 715124 - protein, 17 aa, Mycobacterium
QMVRLLVAYAAWHLDRD

SEQ ID NO: 715125 - protein, 22 aa, Mycobacterium
QMWAQDVAAMFGYHSGASGVAA

SEQ ID NO: 715126 - protein, 22 aa, Mycobacterium
QMWAQDVAAMFGYHTGASAAVA

SEQ ID NO: 715127 - protein, 23 aa, Mycobacterium
QMYFPGDPLFAFDPIYQSITDAK

SEQ ID NO: 715128 - protein, 19 aa, Mycobacterium
QNAIVLRDWQVLRFTWLDL

SEQ ID NO: 715129 - protein, 23 aa, Mycobacterium
QNAPALLGLIGLWYSNFFGAQSR

SEQ ID NO: 715130 - protein, 37 aa, Mycobacterium
QNAQLDWPLAEALRYPARLIDEFEWERELDGGGLFGE

SEQ ID NO: 715131 - protein, 22 aa, Mycobacterium
QNDFCAGGALPVHNADLVARAI

SEQ ID NO: 715132 - protein, 20 aa, Mycobacterium
QNDFCAKGGWLDHIGVDIAP

SEQ ID NO: 715133 - protein, 18 aa, Mycobacterium
QNEASCDLLDALVDQSGG

SEQ ID NO: 715134 - protein, 19 aa, Mycobacterium
QNEEFMWRLADRQLDEFLG

SEQ ID NO: 715135 - protein, 26 aa, Mycobacterium
QNEEFMWRLADRQLDEFLGLGECEFI

SEQ ID NO: 715136 - protein, 30 aa, Mycobacterium
QNEFEYLQMWLRAATAMAMYEAVSQTAMTW

SEQ ID NO: 715137 - protein, 26 aa, Mycobacterium
QNELTLMGWLPLRFTWLDLTEYPQRV

SEQ ID NO: 715138 - protein, 19 aa, Mycobacterium
QNFAPARGFTACTRSTLAL

SEQ ID NO: 715139 - protein, 20 aa, Mycobacterium
QNFGPLRWRDGSAVTVVLAA

SEQ ID NO: 715140 - protein, 23 aa, Mycobacterium
QNFMTQSAFRWMVLGHREIADMI

SEQ ID NO: 715141 - protein, 18 aa, Mycobacterium
QNFRDGGPVEVVYDGTTT

SEQ ID NO: 715142 - protein, 20 aa, Mycobacterium
QNFRVCVAVAETHHALRRHM

SEQ ID NO: 715143 - protein, 17 aa, Mycobacterium
QNFVGLAAHVRGTVDET

SEQ ID NO: 715144 - protein, 24 aa, Mycobacterium
QNGAFNLGFGDITFGDKTSNTATD

SEQ ID NO: 715145 - protein, 21 aa, Mycobacterium
QNGDWTLSWDQWREGSALKPT

SEQ ID NO: 715146 - protein, 24 aa, Mycobacterium
QNGEPRTGLSMGEHAAITAKQAGV

SEQ ID NO: 715147 - protein, 19 aa, Mycobacterium
QNGFILPSFPSVATPEVFQ

SEQ ID NO: 715148 - protein, 19 aa, Mycobacterium
QNGVPWWYFHELQGPYRGR

SEQ ID NO: 715149 - protein, 19 aa, Mycobacterium
QNHLLQVLCLVAMEPPTHV

SEQ ID NO: 715150 - protein, 30 aa, Mycobacterium
QNIAFLFLPGWKWTLRWDTGKRKWDLVSER

SEQ ID NO: 715151 - protein, 18 aa, Mycobacterium
QNIAFPLTLAKMSKDDIN

SEQ ID NO: 715152 - protein, 29 aa, Mycobacterium
QNIASGMLLPLGVRRLRAYGSTRNVRYCL

SEQ ID NO: 715153 - protein, 17 aa, Mycobacterium
QNIFGVWPVTGEVSEQL

SEQ ID NO: 715154 - protein, 17 aa, Mycobacterium
QNIIVGFGRIDGRSVGI

SEQ ID NO: 715155 - protein, 18 aa, Mycobacterium
QNILALRFANQFWDPIWN

SEQ ID NO: 715156 - protein, 17 aa, Mycobacterium
QNIRVAVEHLRQRGVED

SEQ ID NO: 715157 - protein, 19 aa, Mycobacterium
QNKIRAMQVLGARLQAIAE

SEQ ID NO: 715158 - protein, 25 aa, Mycobacterium
QNLANFGVLALEFVDDADYDRIDQD

SEQ ID NO: 715159 - protein, 17 aa, Mycobacterium
QNLATIVGWVSSELPDD

SEQ ID NO: 715160 - protein, 17 aa, Mycobacterium
QNLDFLVAVARSCAGQA

SEQ ID NO: 715161 - protein, 17 aa, Mycobacterium
QNLDYLIAFFGALYAGR

SEQ ID NO: 715162 - protein, 18 aa, Mycobacterium
QNLEALALAEAWDNGKPI

SEQ ID NO: 715163 - protein, 17 aa, Mycobacterium
QNLPAHPAFDWYSERIS

SEQ ID NO: 715164 - protein, 24 aa, Mycobacterium
QNLPRLRRALSRVDTVVVHDPVWT

SEQ ID NO: 715165 - protein, 21 aa, Mycobacterium
QNLRGGGPVRLKSSGKDYFDL

SEQ ID NO: 715166 - protein, 21 aa, Mycobacterium
QNLRLYEEWCDLADLREGDRY

SEQ ID NO: 715167 - protein, 19 aa, Mycobacterium
QNLRNQWTVIAAHNQGHTA

SEQ ID NO: 715168 - protein, 20 aa, Mycobacterium
QNLTGRPLIGNGANGAPGTG

SEQ ID NO: 715169 - protein, 19 aa, Mycobacterium
QNMPAPMLAPGPQLPETSV

SEQ ID NO: 715170 - protein, 22 aa, Mycobacterium
QNNLRWRNLRKITIAQVHGDVF

SEQ ID NO: 715171 - protein, 21 aa, Mycobacterium
QNPEYCWTFLDPADHRHDTAP

SEQ ID NO: 715172 - protein, 21 aa, Mycobacterium
QNPRLLPWRRALANVTFALRD

SEQ ID NO: 715173 - protein, 21 aa, Mycobacterium
QNPRRCRRLVLVATGTGVVMV

SEQ ID NO: 715174 - protein, 18 aa, Mycobacterium
QNQIERILAEWVGELGVR

SEQ ID NO: 715175 - protein, 19 aa, Mycobacterium
QNRARLAAEVVEAVVAEIG

SEQ ID NO: 715176 - protein, 18 aa, Mycobacterium
QNRIWCAIVQLACELTAW

SEQ ID NO: 715177 - protein, 18 aa, Mycobacterium
QNRVRATRIEFWAFDLLF

SEQ ID NO: 715178 - protein, 18 aa, Mycobacterium
QNRVRATRIEFWAFDLLY

SEQ ID NO: 715179 - protein, 23 aa, Mycobacterium
QNSAEWLRFCEIVLERRDLVDEP

SEQ ID NO: 715180 - protein, 21 aa, Mycobacterium
QNSFRRFGIDIVVASVRRAQE

SEQ ID NO: 715181 - protein, 18 aa, Mycobacterium
QNSPVGFTFNEQLGTIDI

SEQ ID NO: 715182 - protein, 17 aa, Mycobacterium
QNTARWWRATVFEPEAL

SEQ ID NO: 715183 - protein, 24 aa, Mycobacterium
QNTWRFGIDRVLAGVAMSDDSRAW

SEQ ID NO: 715184 - protein, 19 aa, Mycobacterium
QNVAWQRFMVYAAQVVAPG

SEQ ID NO: 715185 - protein, 17 aa, Mycobacterium
QNVFPMTLLGTFSPYMV

SEQ ID NO: 715186 - protein, 20 aa, Mycobacterium
QNVPGSPGFVLVNNPQRLPL

SEQ ID NO: 715187 - protein, 19 aa, Mycobacterium
QNVPLHLPSTFAAWKALAD

SEQ ID NO: 715188 - protein, 17 aa, Mycobacterium
QNVQGYLLYRFVDEDTT

SEQ ID NO: 715189 - protein, 20 aa, Mycobacterium
QNVRLPWKVDDEDHVLHLID

SEQ ID NO: 715190 - protein, 25 aa, Mycobacterium
QNVRLPWKVGDEEFVLHLIDTPGHV

SEQ ID NO: 715191 - protein, 20 aa, Mycobacterium
QNVRLPWQLDGTEYVLHLID

SEQ ID NO: 715192 - protein, 19 aa, Mycobacterium
QNVRLPWQLNGQDHVLHLI

SEQ ID NO: 715193 - protein, 19 aa, Mycobacterium
QNVRLPWQVTGGTDAGKEF

SEQ ID NO: 715194 - protein, 19 aa, Mycobacterium
QNVRLPWVVNGEEFVLHLI

SEQ ID NO: 715195 - protein, 21 aa, Mycobacterium
QNWPWGHPHRYAFSPHPISGA

SEQ ID NO: 715196 - protein, 19 aa, Mycobacterium
QNWWEWHHLIGPLAADGYR

SEQ ID NO: 715197 - protein, 18 aa, Mycobacterium
QNYLLDLQLIRRGRVDDE

SEQ ID NO: 715198 - protein, 19 aa, Mycobacterium
QNYRCPFGVGGERGVDLAV

SEQ ID NO: 715199 - protein, 22 aa, Mycobacterium
QPAAEALQAWLADGRPALATAE

SEQ ID NO: 715200 - protein, 18 aa, Mycobacterium
QPAAVSWFRPTAHIVDTD

SEQ ID NO: 715201 - protein, 18 aa, Mycobacterium
QPAELAPLYVLLASDDAS

SEQ ID NO: 715202 - protein, 21 aa, Mycobacterium
QPAERVCVIDGGIRVVTTVQG

SEQ ID NO: 715203 - protein, 23 aa, Mycobacterium
QPAEVRASIGMAGQFAGMDPMLT

SEQ ID NO: 715204 - protein, 23 aa, Mycobacterium
QPAEVRASIGMAGQFTGMDPMLT

SEQ ID NO: 715205 - protein, 27 aa, Mycobacterium
QPAIPSCKASVFVPFSVELQGDATTLM

SEQ ID NO: 715206 - protein, 27 aa, Mycobacterium
QPAISLPLEWTPEGLPLGVQLVAAYGR

SEQ ID NO: 715207 - protein, 19 aa, Mycobacterium
QPAMTVGVHVPLRWGASPL

SEQ ID NO: 715208 - protein, 24 aa, Mycobacterium
QPAPGSFFAGFAFSFAQVPNHQLY

SEQ ID NO: 715209 - protein, 17 aa, Mycobacterium
QPAPLFHVHKLFFLCHE

SEQ ID NO: 715210 - protein, 18 aa, Mycobacterium
QPAPLLAAIGQQLGDLVA

SEQ ID NO: 715211 - protein, 19 aa, Mycobacterium
QPAPWRVRAPLVLTDFSCT

SEQ ID NO: 715212 - protein, 19 aa, Mycobacterium
QPATGFTHVFVRGRPALDD

SEQ ID NO: 715213 - protein, 26 aa, Mycobacterium
QPAWAYSRVALKWAERYYAAERDLAM

SEQ ID NO: 715214 - protein, 21 aa, Mycobacterium
QPAYRVMKANGGGRFVFISSS

SEQ ID NO: 715215 - protein, 21 aa, Mycobacterium
QPCSVRLAPPLLGEHSREILR

SEQ ID NO: 715216 - protein, 22 aa, Mycobacterium
QPCYDARGLTRMYDHLTAISTA

SEQ ID NO: 715217 - protein, 26 aa, Mycobacterium
QPDARLRAALLSAVLMVVASQRYLLR

SEQ ID NO: 715218 - protein, 19 aa, Mycobacterium
QPDDIGWAAAFLASDAASY

SEQ ID NO: 715219 - protein, 24 aa, Mycobacterium
QPDEIGALIAFLLSDVCAFVTGQT

SEQ ID NO: 715220 - protein, 29 aa, Mycobacterium
QPDIARLKARMGWRMPWFTLTDDFDADFG

SEQ ID NO: 715221 - protein, 27 aa, Mycobacterium
QPDKFWVGFCRRMGLAELADDERFVPS

SEQ ID NO: 715222 - protein, 18 aa, Mycobacterium
QPDLPWRRGRQIAPELTG

SEQ ID NO: 715223 - protein, 24 aa, Mycobacterium
QPDMIYQFLPIRWGTIGMAGVEFS

SEQ ID NO: 715224 - protein, 20 aa, Mycobacterium
QPDPSRLAFMMIGNINNPNG

SEQ ID NO: 715225 - protein, 19 aa, Mycobacterium
QPDRAQWRRLVERFFTAAR

SEQ ID NO: 715226 - protein, 22 aa, Mycobacterium
QPDSRVTLLYGNRRANTVMFAD

SEQ ID NO: 715227 - protein, 20 aa, Mycobacterium
QPDYLTAFASLWSGSSLEDW

SEQ ID NO: 715228 - protein, 29 aa, Mycobacterium
QPEAMTPHWGRGTLVGKLTVPPSWAAATP

SEQ ID NO: 715229 - protein, 29 aa, Mycobacterium
QPEEIAHAVLFLCSPRASFITGSTLHADG

SEQ ID NO: 715230 - protein, 30 aa, Mycobacterium
QPEETRWGLPVDRLRFAMSNYQRLTFQQMT

SEQ ID NO: 715231 - protein, 20 aa, Mycobacterium
QPELLVEGPIQYDAAVEPSV

SEQ ID NO: 715232 - protein, 18 aa, Mycobacterium
QPELRKGRYPDRKTARRV

SEQ ID NO: 715233 - protein, 27 aa, Mycobacterium
QPEQRRRWGIREVPLHVLVDGVDLRDG

SEQ ID NO: 715234 - protein, 26 aa, Mycobacterium
QPERLRSGWLNGIKHWQVDYHSDSSG

SEQ ID NO: 715235 - protein, 24 aa, Mycobacterium
QPFGRALPQYGFRPTFVARPPAAG

SEQ ID NO: 715236 - protein, 24 aa, Mycobacterium
QPFGRAVPQYGFRPTFVARPPAAG

SEQ ID NO: 715237 - protein, 19 aa, Mycobacterium
QPFHVARTFASLDHLSRGR

SEQ ID NO: 715238 - protein, 17 aa, Mycobacterium
QPFLLAVIVPNVDAVGG

SEQ ID NO: 715239 - protein, 23 aa, Mycobacterium
QPFMDFTPGYVLRALDELPKQGN

SEQ ID NO: 715240 - protein, 24 aa, Mycobacterium
QPFPLPALPCLLRSITLRMTTAPV

SEQ ID NO: 715241 - protein, 27 aa, Mycobacterium
QPFYNFLLTVLFEWGVAVHDTDVESLF

SEQ ID NO: 715242 - protein, 24 aa, Mycobacterium
QPGAEVTESLSFVLDGREIPLSEI

SEQ ID NO: 715243 - protein, 29 aa, Mycobacterium
QPGAFLSFPVTQWTRWRQPVIGMPTTPRF

SEQ ID NO: 715244 - protein, 25 aa, Mycobacterium
QPGCISYEPAFAIDVEWTLLASLAR

SEQ ID NO: 715245 - protein, 22 aa, Mycobacterium
QPGDVFPLDSFSWHVLSSLADH

SEQ ID NO: 715246 - protein, 18 aa, Mycobacterium
QPGEALLHCSVGQSRKAW

SEQ ID NO: 715247 - protein, 21 aa, Mycobacterium
QPGFAEAFLPGGRAPKPGELF

SEQ ID NO: 715248 - protein, 26 aa, Mycobacterium
QPGGCAGLRYNLFFDDRTLDGDLTAE

SEQ ID NO: 715249 - protein, 26 aa, Mycobacterium
QPGGCAGLRYQLFFDDRTLDGDLTVD

SEQ ID NO: 715250 - protein, 18 aa, Mycobacterium
QPGGRRSGSLIALRVPLP

SEQ ID NO: 715251 - protein, 20 aa, Mycobacterium
QPGIEIRPLVQITGDSHFNE

SEQ ID NO: 715252 - protein, 18 aa, Mycobacterium
QPGLRLAQVVATIMNGYA

SEQ ID NO: 715253 - protein, 24 aa, Mycobacterium
QPGLRRLVDLTGMRWPDLVVDAGG

SEQ ID NO: 715254 - protein, 18 aa, Mycobacterium
QPGNGGRCVVGDRPDGAE

SEQ ID NO: 715255 - protein, 21 aa, Mycobacterium
QPGPVSALFFDLDRLKAINDY

SEQ ID NO: 715256 - protein, 26 aa, Mycobacterium
QPGRYRLIVARACPWANRAIIVRRLL

SEQ ID NO: 715257 - protein, 25 aa, Mycobacterium
QPGSAEHWAAWLDKYGDDYATDDER

SEQ ID NO: 715258 - protein, 20 aa, Mycobacterium
QPGTGFKEARTVACDVLKPL

SEQ ID NO: 715259 - protein, 22 aa, Mycobacterium
QPGVEIRPIIQLTGDSEFNEVF

SEQ ID NO: 715260 - protein, 22 aa, Mycobacterium
QPGVEIRPIIQLTGTSEFNEVF

SEQ ID NO: 715261 - protein, 24 aa, Mycobacterium
QPHAKGGGAHGHFEVTHDVSKYTR

SEQ ID NO: 715262 - protein, 24 aa, Mycobacterium
QPHALPLIVLHGGPGMAHNYVANI

SEQ ID NO: 715263 - protein, 17 aa, Mycobacterium
QPHPFVAMVPQWDLLNL

SEQ ID NO: 715264 - protein, 17 aa, Mycobacterium
QPHYAKTLDIWAAALQA

SEQ ID NO: 715265 - protein, 18 aa, Mycobacterium
QPHYARTLALWAQALYAY

SEQ ID NO: 715266 - protein, 17 aa, Mycobacterium
QPICGLVQVAVGERPPA

SEQ ID NO: 715267 - protein, 21 aa, Mycobacterium
QPIFLALREVREWAQNTKDDG

SEQ ID NO: 715268 - protein, 26 aa, Mycobacterium
QPIMLITEYFLRTVFQDVPHEEADCR

SEQ ID NO: 715269 - protein, 22 aa, Mycobacterium
QPIRRYHVDAAILFSDIVVPLR

SEQ ID NO: 715270 - protein, 20 aa, Mycobacterium
QPITALGHWVHVYVDRTSRK

SEQ ID NO: 715271 - protein, 20 aa, Mycobacterium
QPIVRPGSWIGGDRDGNPNV

SEQ ID NO: 715272 - protein, 18 aa, Mycobacterium
QPKHKGITYFLLDMHQPG

SEQ ID NO: 715273 - protein, 23 aa, Mycobacterium
QPKHYYRALALAVRDRMQRRWIE

SEQ ID NO: 715274 - protein, 25 aa, Mycobacterium
QPKPVKFSALTGWEAPDPVWWTAHG

SEQ ID NO: 715275 - protein, 17 aa, Mycobacterium
QPLACVLYACAQLPDLA

SEQ ID NO: 715276 - protein, 18 aa, Mycobacterium
QPLAQIGDLARRTQAAGF

SEQ ID NO: 715277 - protein, 25 aa, Mycobacterium
QPLATRLVRSWLGLPSRAVYKLEDM

SEQ ID NO: 715278 - protein, 18 aa, Mycobacterium
QPLCLMLDAPTAGGVCAA

SEQ ID NO: 715279 - protein, 32 aa, Mycobacterium
QPLDGPWARAVRDIAARAGVVVVAGMFSPSDD

SEQ ID NO: 715280 - protein, 23 aa, Mycobacterium
QPLDRPFAWALIKLDGADTPLIH

SEQ ID NO: 715281 - protein, 23 aa, Mycobacterium
QPLDRPFAWALIKLDGADTPMMH

SEQ ID NO: 715282 - protein, 25 aa, Mycobacterium
QPLGEPRPGLGRVGGPGHVAHQPRG

SEQ ID NO: 715283 - protein, 18 aa, Mycobacterium
QPLGLPLQSMLCEPVIRR

SEQ ID NO: 715284 - protein, 20 aa, Mycobacterium
QPLHPRRLIEFLDSQPAGVY

SEQ ID NO: 715285 - protein, 21 aa, Mycobacterium
QPLIDRLDYVDGVLRDAPQSA

SEQ ID NO: 715286 - protein, 18 aa, Mycobacterium
QPLIFGLWHMVARYHAAR

SEQ ID NO: 715287 - protein, 25 aa, Mycobacterium
QPLIPAPLPFRFPFPSFATCIAEDE

SEQ ID NO: 715288 - protein, 27 aa, Mycobacterium
QPLLAPRLREFALREGLADAGQRLAHT

SEQ ID NO: 715289 - protein, 18 aa, Mycobacterium
QPLLGRVVADLARATAAQ

SEQ ID NO: 715290 - protein, 17 aa, Mycobacterium
QPLMPGQVLRLGVAAGT

SEQ ID NO: 715291 - protein, 17 aa, Mycobacterium
QPLPFGFASRSALGLER

SEQ ID NO: 715292 - protein, 25 aa, Mycobacterium
QPLQGCYKIALLSLKGGVGKTTVTA

SEQ ID NO: 715293 - protein, 21 aa, Mycobacterium
QPLQGCYRVAMLSQKGGVGKT

SEQ ID NO: 715294 - protein, 19 aa, Mycobacterium
QPLQLMRQRVLSVFPVPPI

SEQ ID NO: 715295 - protein, 20 aa, Mycobacterium
QPLRDFLGPDVIELLTPYHL

SEQ ID NO: 715296 - protein, 26 aa, Mycobacterium
QPLRNLLLAVIFEWGIALHGIHSERD

SEQ ID NO: 715297 - protein, 23 aa, Mycobacterium
QPLRPRSVAGWEARIRRLANERL

SEQ ID NO: 715298 - protein, 18 aa, Mycobacterium
QPLTSGVWHGEWADPARR

SEQ ID NO: 715299 - protein, 21 aa, Mycobacterium
QPLWALWRFGIDPSATRLTME

SEQ ID NO: 715300 - protein, 26 aa, Mycobacterium
QPLWALWRFGTDPAFTRISMEFMALA

SEQ ID NO: 715301 - protein, 18 aa, Mycobacterium
QPLYGFAGVDTRFLGDAY

SEQ ID NO: 715302 - protein, 23 aa, Mycobacterium
QPMAEIWWRFREAIQTAPKLDIG

SEQ ID NO: 715303 - protein, 17 aa, Mycobacterium
QPMVAILWGRDASTLKP

SEQ ID NO: 715304 - protein, 19 aa, Mycobacterium
QPNARRSAPGSAMQQLRTI

SEQ ID NO: 715305 - protein, 21 aa, Mycobacterium
QPNCKSNVLYKGALQGDPASQ

SEQ ID NO: 715306 - protein, 28 aa, Mycobacterium
QPNGRPRRAGVSSFGFTGTNAHVLIEEA

SEQ ID NO: 715307 - protein, 17 aa, Mycobacterium
QPPALRAICPWEGFTDA

SEQ ID NO: 715308 - protein, 26 aa, Mycobacterium
QPPEVLGYRVERLLKMATIHVLDGMQ

SEQ ID NO: 715309 - protein, 23 aa, Mycobacterium
QPPIACPRHSRVAPNMASPDTAV

SEQ ID NO: 715310 - protein, 17 aa, Mycobacterium
QPPLCWLASTTLCAGPD

SEQ ID NO: 715311 - protein, 18 aa, Mycobacterium
QPPLHWQDGSAVTVVVAA

SEQ ID NO: 715312 - protein, 17 aa, Mycobacterium
QPPLQRLLRILLGVDAK

SEQ ID NO: 715313 - protein, 25 aa, Mycobacterium
QPPPPLWSLVQSFVLEAWPDGDVAG

SEQ ID NO: 715314 - protein, 21 aa, Mycobacterium
QPPPQVFRMKGIVAVRERATV

SEQ ID NO: 715315 - protein, 23 aa, Mycobacterium
QPPRGRKAAVLGSPIAHSRSPQL

SEQ ID NO: 715316 - protein, 23 aa, Mycobacterium
QPPSPRIAAVLALEAPTVQDLLQ

SEQ ID NO: 715317 - protein, 20 aa, Mycobacterium
QPPWLQWYAGRPLLVTANDY

SEQ ID NO: 715318 - protein, 19 aa, Mycobacterium
QPPWQEWYSGAATAAAILE

SEQ ID NO: 715319 - protein, 17 aa, Mycobacterium
QPPWRPDRLDAEEYRPF

SEQ ID NO: 715320 - protein, 19 aa, Mycobacterium
QPQLRMSGYNFAAIAAGLP

SEQ ID NO: 715321 - protein, 17 aa, Mycobacterium
QPQRAAATWSNLRYRDS

SEQ ID NO: 715322 - protein, 17 aa, Mycobacterium
QPQVLAFKDGVYAQQGA

SEQ ID NO: 715323 - protein, 18 aa, Mycobacterium
QPRFPFVARRYAYTGRQK

SEQ ID NO: 715324 - protein, 17 aa, Mycobacterium
QPRHWVGHLNVIKSIQD

SEQ ID NO: 715325 - protein, 25 aa, Mycobacterium
QPRIDGYCRWLGRSAAVWHGDVSQE

SEQ ID NO: 715326 - protein, 18 aa, Mycobacterium
QPRIPRGPCDPLAGMHSA

SEQ ID NO: 715327 - protein, 21 aa, Mycobacterium
QPRLLADALIRMSAGGDLFRL

SEQ ID NO: 715328 - protein, 19 aa, Mycobacterium
QPRLSYPPYRSSLLRHPTK

SEQ ID NO: 715329 - protein, 29 aa, Mycobacterium
QPRMLALTARYAHEWNQWSSPGTFREVSG

SEQ ID NO: 715330 - protein, 20 aa, Mycobacterium
QPRMTKLVWKVTEIDPGVSW

SEQ ID NO: 715331 - protein, 20 aa, Mycobacterium
QPRNMVPLSTFLRRNRNLGL

SEQ ID NO: 715332 - protein, 21 aa, Mycobacterium
QPRPCPAPLNIGARGGFVTGA

SEQ ID NO: 715333 - protein, 17 aa, Mycobacterium
QPRRAAAEYDDLHERVR

SEQ ID NO: 715334 - protein, 22 aa, Mycobacterium
QPRREVPAALSIGGDQVEQGVD

SEQ ID NO: 715335 - protein, 23 aa, Mycobacterium
QPRSEIMTFLAAREAAHHRLFSH

SEQ ID NO: 715336 - protein, 17 aa, Mycobacterium
QPRTRFVLDGEVVAFEG

SEQ ID NO: 715337 - protein, 23 aa, Mycobacterium
QPRVAELLATVSLDESYAARRPH

SEQ ID NO: 715338 - protein, 27 aa, Mycobacterium
QPRVAQSFDATVCWMADSSVLEPGRDY

SEQ ID NO: 715339 - protein, 27 aa, Mycobacterium
QPRVTCFRVGLRLDEPDMPNLLVSQHR

SEQ ID NO: 715340 - protein, 28 aa, Mycobacterium
QPRVTCFRVGLRLNEPRMPNLLVSQRRP

SEQ ID NO: 715341 - protein, 18 aa, Mycobacterium
QPRWGKMVAPGIYGPNHQ

SEQ ID NO: 715342 - protein, 18 aa, Mycobacterium
QPRYGFRAARGREVLAAA

SEQ ID NO: 715343 - protein, 25 aa, Mycobacterium
QPSAARPGIPAAFDAVIARGMAKNP

SEQ ID NO: 715344 - protein, 18 aa, Mycobacterium
QPSAELLTGGSPRYQIYP

SEQ ID NO: 715345 - protein, 21 aa, Mycobacterium
QPSELAPVYVLLASDDASYIS

SEQ ID NO: 715346 - protein, 20 aa, Mycobacterium
QPSHIAAAFDVSRQTFRKEK

SEQ ID NO: 715347 - protein, 17 aa, Mycobacterium
QPSLLIAAIAELKEVAA

SEQ ID NO: 715348 - protein, 18 aa, Mycobacterium
QPSRLEGYRDSWRYSASL

SEQ ID NO: 715349 - protein, 23 aa, Mycobacterium
QPSTVTALAAREAAIAAGAAVPA

SEQ ID NO: 715350 - protein, 18 aa, Mycobacterium
QPSVGRRMQRTWLDFARA

SEQ ID NO: 715351 - protein, 28 aa, Mycobacterium
QPTAEGFPEWIPRTLAPGSRLSGVAPQA

SEQ ID NO: 715352 - protein, 25 aa, Mycobacterium
QPTAELWSGGLLHTGDVGYVADDGY

SEQ ID NO: 715353 - protein, 24 aa, Mycobacterium
QPTAKRIRACLGGEPVVDTCAAVL

SEQ ID NO: 715354 - protein, 20 aa, Mycobacterium
QPTFYRLVKRLAEGRHTFGS

SEQ ID NO: 715355 - protein, 19 aa, Mycobacterium
QPTGRWADYLLASRSTTIY

SEQ ID NO: 715356 - protein, 20 aa, Mycobacterium
QPTHIAAAFDVSRQTFRKDK

SEQ ID NO: 715357 - protein, 18 aa, Mycobacterium
QPTIAGAVPTIWNDVDRY

SEQ ID NO: 715358 - protein, 20 aa, Mycobacterium
QPTIPGWRAETLGDDIAWMR

SEQ ID NO: 715359 - protein, 19 aa, Mycobacterium
QPTIPGWRAETVGDDIAWM

SEQ ID NO: 715360 - protein, 22 aa, Mycobacterium
QPTKWRHVFASIQSLSAGRLAT

SEQ ID NO: 715361 - protein, 18 aa, Mycobacterium
QPTLGMMMFTLFQKRLLG

SEQ ID NO: 715362 - protein, 27 aa, Mycobacterium
QPTLGVAGLLTRLWDWLVDAAAGNFHA

SEQ ID NO: 715363 - protein, 31 aa, Mycobacterium
QPTRHTFGLALLQYRIERTLSEWVGEHGVPI

SEQ ID NO: 715364 - protein, 26 aa, Mycobacterium
QPTRYWPEFCRLMGLHEVAEDPRFTT

SEQ ID NO: 715365 - protein, 18 aa, Mycobacterium
QPVAMRWSDMAGMQRSLI

SEQ ID NO: 715366 - protein, 22 aa, Mycobacterium
QPVDVAEAIAFFASPASNAVTG

SEQ ID NO: 715367 - protein, 23 aa, Mycobacterium
QPVFPRPMFSAMHAVAAGLAVHF

SEQ ID NO: 715368 - protein, 26 aa, Mycobacterium
QPVPRFTLELKQLWNDLGRPAMPKRP

SEQ ID NO: 715369 - protein, 29 aa, Mycobacterium
QPVRSGADLQQCWRQYVAGEVTEYPVNCT

SEQ ID NO: 715370 - protein, 21 aa, Mycobacterium
QPVTGLMGFLGRRQHLVPNTG

SEQ ID NO: 715371 - protein, 18 aa, Mycobacterium
QPVTVLLKALGWTNEQIV

SEQ ID NO: 715372 - protein, 18 aa, Mycobacterium
QPVVLPFGIAPTGFTRLM

SEQ ID NO: 715373 - protein, 19 aa, Mycobacterium
QPVVPAMVYDGPTDRPTPT

SEQ ID NO: 715374 - protein, 24 aa, Mycobacterium
QPVYRVAAKLRLMADELIERDSGI

SEQ ID NO: 715375 - protein, 22 aa, Mycobacterium
QPWDRKGYKMPGGTPSSPALAS

SEQ ID NO: 715376 - protein, 19 aa, Mycobacterium
QPWFTGRFATLGLSYLGFT

SEQ ID NO: 715377 - protein, 30 aa, Mycobacterium
QPWLRDGEQLRLLLRDVFIAAGGTHDDWDE

SEQ ID NO: 715378 - protein, 33 aa, Mycobacterium
QPWLRDLAKRWARWRLSTGLGLEAGGGRPVVVL

SEQ ID NO: 715379 - protein, 23 aa, Mycobacterium
QPWLRRAEARAGARGWRLAGARA

SEQ ID NO: 715380 - protein, 18 aa, Mycobacterium
QPWSPCVETSFPVADVAG

SEQ ID NO: 715381 - protein, 18 aa, Mycobacterium
QPWTKKLWVYDLRTNQHF

SEQ ID NO: 715382 - protein, 22 aa, Mycobacterium
QPWVIRELSLHQLLHVTDGTKL

SEQ ID NO: 715383 - protein, 25 aa, Mycobacterium
QPYAVRVLCGFGTPMGPDDPVPMML

SEQ ID NO: 715384 - protein, 17 aa, Mycobacterium
QPYGEWLHSGLLELTTL

SEQ ID NO: 715385 - protein, 24 aa, Mycobacterium
QPYGGAWLNSWLDRDLGISGRLSV

SEQ ID NO: 715386 - protein, 23 aa, Mycobacterium
QPYKHGFGPFAPEVYRAPMAYPY

SEQ ID NO: 715387 - protein, 17 aa, Mycobacterium
QPYPEIMHALKVRKAIE

SEQ ID NO: 715388 - protein, 17 aa, Mycobacterium
QPYRFFVTATKELSIAV

SEQ ID NO: 715389 - protein, 23 aa, Mycobacterium
QPYSVCLPKSFAPGKSLPLTLLL

SEQ ID NO: 715390 - protein, 19 aa, Mycobacterium
QPYSVCLPSTYAPGQALPL

SEQ ID NO: 715391 - protein, 25 aa, Mycobacterium
QPYWGRPAPGFGSARPRILIVGLAP

SEQ ID NO: 715392 - protein, 29 aa, Mycobacterium
QPYWGRPVPGWGSERPWLLIVGLAPAAHG

SEQ ID NO: 715393 - protein, 29 aa, Mycobacterium
QQAAAILRRSRARVLVIPRRWRGNNILEQ

SEQ ID NO: 715394 - protein, 18 aa, Mycobacterium
QQAAGAMRAPEQLQADHE

SEQ ID NO: 715395 - protein, 17 aa, Mycobacterium
QQAAWNDTRVCYDAPDC

SEQ ID NO: 715396 - protein, 30 aa, Mycobacterium
QQADTMLRLAIATRYGRFVVASRTRDIFLV

SEQ ID NO: 715397 - protein, 17 aa, Mycobacterium
QQAEIDLGGPIAHTLAY

SEQ ID NO: 715398 - protein, 25 aa, Mycobacterium
QQAERCGYRRFWIAEHHFVAVASAA

SEQ ID NO: 715399 - protein, 19 aa, Mycobacterium
QQAFLARRDVTGAACSATA

SEQ ID NO: 715400 - protein, 24 aa, Mycobacterium
QQAFRIHGGYGYSKEYEIERLMRD

SEQ ID NO: 715401 - protein, 22 aa, Mycobacterium
QQAIEMSDMLLGKQGIDPRVVD

SEQ ID NO: 715402 - protein, 17 aa, Mycobacterium
QQAIRRRAFTKALRITG

SEQ ID NO: 715403 - protein, 18 aa, Mycobacterium
QQALDWGLLNRVVPREDL

SEQ ID NO: 715404 - protein, 25 aa, Mycobacterium
QQALQAFRKFGFQLVIVATVQNATT

SEQ ID NO: 715405 - protein, 23 aa, Mycobacterium
QQAPAATMLGRWMGIGDADEVSA

SEQ ID NO: 715406 - protein, 23 aa, Mycobacterium
QQARDAGALVMLNASPVGTAAHH

SEQ ID NO: 715407 - protein, 21 aa, Mycobacterium
QQARGKGGLVRVSWAEATELI

SEQ ID NO: 715408 - protein, 26 aa, Mycobacterium
QQAVLTGWWLRRMVAVRQPLREKLTL

SEQ ID NO: 715409 - protein, 17 aa, Mycobacterium
QQAVRFGLFHLLQASAR

SEQ ID NO: 715410 - protein, 18 aa, Mycobacterium
QQAYRVWNNPLDAMAQTS

SEQ ID NO: 715411 - protein, 23 aa, Mycobacterium
QQCGQRLAGIHLRRRDHQRAARS

SEQ ID NO: 715412 - protein, 23 aa, Mycobacterium
QQDCAEIFLKAAVDSVAAERPGL

SEQ ID NO: 715413 - protein, 22 aa, Mycobacterium
QQDCAIPVWPQEMTREQIDLQR

SEQ ID NO: 715414 - protein, 18 aa, Mycobacterium
QQDGRLCIHPVMISAAGE

SEQ ID NO: 715415 - protein, 18 aa, Mycobacterium
QQDRFLAGVPKGGVLTAA

SEQ ID NO: 715416 - protein, 18 aa, Mycobacterium
QQDSRFPLAPQRVVADTR

SEQ ID NO: 715417 - protein, 18 aa, Mycobacterium
QQEAIAWAKQHGHSPLVA

SEQ ID NO: 715418 - protein, 18 aa, Mycobacterium
QQEAIDWAKQQGHSPLVA

SEQ ID NO: 715419 - protein, 24 aa, Mycobacterium
QQEELWLLRGGDLARPSMLSPAVE

SEQ ID NO: 715420 - protein, 18 aa, Mycobacterium
QQEELWLLRGGDPRRPGM

SEQ ID NO: 715421 - protein, 18 aa, Mycobacterium
QQEIARAGATVIEASVAY

SEQ ID NO: 715422 - protein, 21 aa, Mycobacterium
QQELARRGPMFVGSLGENRFE

SEQ ID NO: 715423 - protein, 25 aa, Mycobacterium
QQELIRLGRYPLLVVDEVGYIPFEP

SEQ ID NO: 715424 - protein, 18 aa, Mycobacterium
QQEMPHGLLGFVADLHSA

SEQ ID NO: 715425 - protein, 23 aa, Mycobacterium
QQFAPLIDLRWWQERPAERSELY

SEQ ID NO: 715426 - protein, 22 aa, Mycobacterium
QQFESFLAMIGRLDLLDDDPAW

SEQ ID NO: 715427 - protein, 25 aa, Mycobacterium
QQFEVARQVLAHGLVPIIEPEVTIS

SEQ ID NO: 715428 - protein, 17 aa, Mycobacterium
QQFGVAIGTFQAVQHKA

SEQ ID NO: 715429 - protein, 25 aa, Mycobacterium
QQFNPRAAYRWSVETSVYMARDRVR

SEQ ID NO: 715430 - protein, 18 aa, Mycobacterium
QQFSRVRVFAFIDTTDEV

SEQ ID NO: 715431 - protein, 19 aa, Mycobacterium
QQFSRVRVFAFIDTTDEVT

SEQ ID NO: 715432 - protein, 22 aa, Mycobacterium
QQGAFNLGFGDITLGNKTTNTA

SEQ ID NO: 715433 - protein, 24 aa, Mycobacterium
QQGALRMRFNLAFYADPRHFDEQV

SEQ ID NO: 715434 - protein, 22 aa, Mycobacterium
QQGRLTHPMVLRPGDDHYRPIE

SEQ ID NO: 715435 - protein, 22 aa, Mycobacterium
QQGRLTHPMVLRPGDDHYRPIG

SEQ ID NO: 715436 - protein, 17 aa, Mycobacterium
QQHGVTIWDEWASETGD

SEQ ID NO: 715437 - protein, 25 aa, Mycobacterium
QQHRRARVGGGRWGHDERRRLVVAS

SEQ ID NO: 715438 - protein, 25 aa, Mycobacterium
QQIAARLSESFALLSRGYRGSPTHQ

SEQ ID NO: 715439 - protein, 19 aa, Mycobacterium
QQIPEVYKGFAALSGAAFA

SEQ ID NO: 715440 - protein, 20 aa, Mycobacterium
QQIPPGLAFDTVFAGDPTSR

SEQ ID NO: 715441 - protein, 24 aa, Mycobacterium
QQIRLPGFRPGKAPRKLLEARVGR

SEQ ID NO: 715442 - protein, 26 aa, Mycobacterium
QQIRYDLGCGFPLLTTKKVHFKSVVY

SEQ ID NO: 715443 - protein, 34 aa, Mycobacterium
QQISARVAEFHAQFERVLAAGAQAYSGAEAANAS

SEQ ID NO: 715444 - protein, 17 aa, Mycobacterium
QQIVKDYIGWPLVSAGA

SEQ ID NO: 715445 - protein, 22 aa, Mycobacterium
QQKEFLLRQQLAAIRKELGELD

SEQ ID NO: 715446 - protein, 21 aa, Mycobacterium
QQKLDVLDFWQIIKPEMPGIN

SEQ ID NO: 715447 - protein, 18 aa, Mycobacterium
QQKLFARQMEVFAGFSEN

SEQ ID NO: 715448 - protein, 21 aa, Mycobacterium
QQKRMSLGAAFQQEIDPNTLY

SEQ ID NO: 715449 - protein, 23 aa, Mycobacterium
QQLAAACDWAFDRISHIQQEARQ

SEQ ID NO: 715450 - protein, 19 aa, Mycobacterium
QQLAHCINFGPQHHYVVQA

SEQ ID NO: 715451 - protein, 24 aa, Mycobacterium
QQLDEWRPDVAIVGAPFDIATTNR

SEQ ID NO: 715452 - protein, 17 aa, Mycobacterium
QQLDHWARVGRAVSSQH

SEQ ID NO: 715453 - protein, 17 aa, Mycobacterium
QQLGVRSCLSIPLISEG

SEQ ID NO: 715454 - protein, 18 aa, Mycobacterium
QQLIFRPVPGFGTAETPV

SEQ ID NO: 715455 - protein, 19 aa, Mycobacterium
QQLLARYAVTITQEDIGGL

SEQ ID NO: 715456 - protein, 18 aa, Mycobacterium
QQLLARYAVTITQNDIEG

SEQ ID NO: 715457 - protein, 19 aa, Mycobacterium
QQLLARYAVTITREDIEGL

SEQ ID NO: 715458 - protein, 18 aa, Mycobacterium
QQLLGRYAVTITQQDIDG

SEQ ID NO: 715459 - protein, 18 aa, Mycobacterium
QQLLPRAGWVEHNPVEIW

SEQ ID NO: 715460 - protein, 23 aa, Mycobacterium
QQLLRGLPRIPIPPCGTPPTTTP

SEQ ID NO: 715461 - protein, 24 aa, Mycobacterium
QQLPAAADAFVWLRLYQQDLQAKL

SEQ ID NO: 715462 - protein, 25 aa, Mycobacterium
QQLQPGRVVVLPWDKHIAAGGEIHL

SEQ ID NO: 715463 - protein, 30 aa, Mycobacterium
QQLQPGRVVVLPWDRHIAAGTEIHLDQLGP

SEQ ID NO: 715464 - protein, 33 aa, Mycobacterium
QQLRLRTSMKWRAHPAAVLPLWVAEMDVRLAPT

SEQ ID NO: 715465 - protein, 17 aa, Mycobacterium
QQLRTSLIRALRSDCAA

SEQ ID NO: 715466 - protein, 23 aa, Mycobacterium
QQLTGRPLIGNGADGINGTGQSG

SEQ ID NO: 715467 - protein, 21 aa, Mycobacterium
QQLTLPFAAPHTMFNVKVGGA

SEQ ID NO: 715468 - protein, 24 aa, Mycobacterium
QQLTLPFGAPKTMLNVKIGGARRC

SEQ ID NO: 715469 - protein, 19 aa, Mycobacterium
QQLTLPFGTPRTMLNVAVG

SEQ ID NO: 715470 - protein, 25 aa, Mycobacterium
QQLTLPFQAPRSMFNVRIGGARRVA

SEQ ID NO: 715471 - protein, 19 aa, Mycobacterium
QQLTLPFRAPKTMFNVRIG

SEQ ID NO: 715472 - protein, 25 aa, Mycobacterium
QQLTMPFRAPRSMFNVRIGGARRVA

SEQ ID NO: 715473 - protein, 23 aa, Mycobacterium
QQLTPRWAALVSEVRAHPNDSLS

SEQ ID NO: 715474 - protein, 18 aa, Mycobacterium
QQLVPVMIERGGGAVVNV

SEQ ID NO: 715475 - protein, 25 aa, Mycobacterium
QQLVVRAPHGWSFAEAAAVPVVFLT

SEQ ID NO: 715476 - protein, 21 aa, Mycobacterium
QQLWARLSVFAGSFDLDAAQY

SEQ ID NO: 715477 - protein, 25 aa, Mycobacterium
QQMLDLKILLSHVFDGERLTEDHVS

SEQ ID NO: 715478 - protein, 24 aa, Mycobacterium
QQMPAAHFMTVFGPYAARIDQILD

SEQ ID NO: 715479 - protein, 24 aa, Mycobacterium
QQMTLPFQAPRTMLNVPIGGARRC

SEQ ID NO: 715480 - protein, 23 aa, Mycobacterium
QQNAWWWDVLRHGRSSDYATYFD

SEQ ID NO: 715481 - protein, 17 aa, Mycobacterium
QQNRFARRVNMQVASHT

SEQ ID NO: 715482 - protein, 24 aa, Mycobacterium
QQNWARLGTFNVPNPVGSLAPSDG

SEQ ID NO: 715483 - protein, 24 aa, Mycobacterium
QQPMGFWRAAWYVGTSYSTYVVVR

SEQ ID NO: 715484 - protein, 18 aa, Mycobacterium
QQQFLPSGRVEYFPMSDY

SEQ ID NO: 715485 - protein, 17 aa, Mycobacterium
QQQTVAPQAPQTVAPAP

SEQ ID NO: 715486 - protein, 17 aa, Mycobacterium
QQRAGSMATFDGQIQEV

SEQ ID NO: 715487 - protein, 32 aa, Mycobacterium
QQRAWLKLVKPLVIAEGFALLSVPTPFVQNEI

SEQ ID NO: 715488 - protein, 23 aa, Mycobacterium
QQRAWLNLVQPLTIVEGFALLSV

SEQ ID NO: 715489 - protein, 19 aa, Mycobacterium
QQRHLPRPAAVGVTVEVEL

SEQ ID NO: 715490 - protein, 19 aa, Mycobacterium
QQRIAEVVTLISATTARYN

SEQ ID NO: 715491 - protein, 21 aa, Mycobacterium
QQRLEAIEEWSILPDFASVNW

SEQ ID NO: 715492 - protein, 18 aa, Mycobacterium
QQRLRLQLGAEIEAPDRA

SEQ ID NO: 715493 - protein, 18 aa, Mycobacterium
QQRLRRIVDAVARQEPGL

SEQ ID NO: 715494 - protein, 26 aa, Mycobacterium
QQRLYRPGLELHPQYVLENGVDFAHF

SEQ ID NO: 715495 - protein, 17 aa, Mycobacterium
QQRRAVGAAGFNTRTGE

SEQ ID NO: 715496 - protein, 25 aa, Mycobacterium
QQRTPPAFYIWRAFARYSPVLPAGR

SEQ ID NO: 715497 - protein, 22 aa, Mycobacterium
QQRVLLEVCWEALENASIDPTS

SEQ ID NO: 715498 - protein, 18 aa, Mycobacterium
QQRVRVMSQLDAIAVDAA

SEQ ID NO: 715499 - protein, 19 aa, Mycobacterium
QQRVWKALLTIPYGETRSY

SEQ ID NO: 715500 - protein, 24 aa, Mycobacterium
QQSDRLGGAPVRIGSFLADDHALR

SEQ ID NO: 715501 - protein, 22 aa, Mycobacterium
QQSEITSAWSIWCPQCDSSDVE

SEQ ID NO: 715502 - protein, 23 aa, Mycobacterium
QQSFRIHGGYGYSKEYEIERLMR

SEQ ID NO: 715503 - protein, 23 aa, Mycobacterium
QQSGLDWTLFFRRLAGAARGDAE

SEQ ID NO: 715504 - protein, 20 aa, Mycobacterium
QQSRFEWLLAALRLADRLIP

SEQ ID NO: 715505 - protein, 23 aa, Mycobacterium
QQSWSQCHSYAFDVSVWEIFAAL

SEQ ID NO: 715506 - protein, 25 aa, Mycobacterium
QQTCRELGEAVALQYFHAAPWVAWS

SEQ ID NO: 715507 - protein, 17 aa, Mycobacterium
QQTFAAWQDEINRLAAE

SEQ ID NO: 715508 - protein, 24 aa, Mycobacterium
QQTTAFHDRFMQTVNAAAASYTTT

SEQ ID NO: 715509 - protein, 20 aa, Mycobacterium
QQTTWALRELVVLHELAHHL

SEQ ID NO: 715510 - protein, 23 aa, Mycobacterium
QQVAELLTAVGLDADIASRYPHE

SEQ ID NO: 715511 - protein, 26 aa, Mycobacterium
QQVAKRLPMWTIYEMLGLPEDERDEA

SEQ ID NO: 715512 - protein, 25 aa, Mycobacterium
QQVARPPLLKRIVLQTAARLSRRGR

SEQ ID NO: 715513 - protein, 24 aa, Mycobacterium
QQVCALLAGGGYAEYVAVPAGQVL

SEQ ID NO: 715514 - protein, 18 aa, Mycobacterium
QQVFKLAAELAYLEYGDL

SEQ ID NO: 715515 - protein, 24 aa, Mycobacterium
QQVFKMAAELAYLEFGDLIDKLVD

SEQ ID NO: 715516 - protein, 25 aa, Mycobacterium
QQVGPRVAARFGRSLLELGGNNAAI

SEQ ID NO: 715517 - protein, 17 aa, Mycobacterium
QQVIMLGRPTLHRPVSA

SEQ ID NO: 715518 - protein, 17 aa, Mycobacterium
QQVLGGIGFTAEHQLHR

SEQ ID NO: 715519 - protein, 18 aa, Mycobacterium
QQVLGRFLHEFAGIGAEW

SEQ ID NO: 715520 - protein, 17 aa, Mycobacterium
QQVLLPTLLDWLSDTPD

SEQ ID NO: 715521 - protein, 22 aa, Mycobacterium
QQVQARLGLPVDDMALEGGQGP

SEQ ID NO: 715522 - protein, 19 aa, Mycobacterium
QQVVTSWTRTTAVTNPALV

SEQ ID NO: 715523 - protein, 21 aa, Mycobacterium
QQWEDARRGIVPADPTVVLQI

SEQ ID NO: 715524 - protein, 19 aa, Mycobacterium
QQWEDSRRGVVPADPAIAL

SEQ ID NO: 715525 - protein, 18 aa, Mycobacterium
QQWFDLCAMVGHPEWIDE

SEQ ID NO: 715526 - protein, 24 aa, Mycobacterium
QQWLPRLPPPYVVAVVALAEDPSA

SEQ ID NO: 715527 - protein, 22 aa, Mycobacterium
QQWREWELELAPGADAELLDRL

SEQ ID NO: 715528 - protein, 17 aa, Mycobacterium
QQWREWELELSDPSQSA

SEQ ID NO: 715529 - protein, 19 aa, Mycobacterium
QQYCHLGGIVAPNQRSDNT

SEQ ID NO: 715530 - protein, 18 aa, Mycobacterium
QQYDWQATNALRGEKDSD

SEQ ID NO: 715531 - protein, 31 aa, Mycobacterium
QRAAALAWPGLEHQWLDGWFVRASDGHTRRA

SEQ ID NO: 715532 - protein, 33 aa, Mycobacterium
QRAAERGAPILAICAAIQVLGHWYETSAGERVE

SEQ ID NO: 715533 - protein, 17 aa, Mycobacterium
QRAAERGAPVLAICAAI

SEQ ID NO: 715534 - protein, 24 aa, Mycobacterium
QRAAGEMRARLRALGAAAQVGSGV

SEQ ID NO: 715535 - protein, 18 aa, Mycobacterium
QRAAGEMRARLRGLDAAA

SEQ ID NO: 715536 - protein, 19 aa, Mycobacterium
QRAAGEMRGRLRALDEGSG

SEQ ID NO: 715537 - protein, 23 aa, Mycobacterium
QRAAGEMRSRLRAIDAAAGTGPA

SEQ ID NO: 715538 - protein, 20 aa, Mycobacterium
QRAAIAFCRRRIAAGTTAAM

SEQ ID NO: 715539 - protein, 21 aa, Mycobacterium
QRAALELPYPGTLPESAEPAK

SEQ ID NO: 715540 - protein, 18 aa, Mycobacterium
QRAALVVNSRESAIELLG

SEQ ID NO: 715541 - protein, 24 aa, Mycobacterium
QRAARELRDGYYVNLGIGIPTLVA

SEQ ID NO: 715542 - protein, 20 aa, Mycobacterium
QRAASSFAVREVAPDVLLIG

SEQ ID NO: 715543 - protein, 31 aa, Mycobacterium
QRAASSVKERKGWSYEKWVKQVTRVLVAIEN

SEQ ID NO: 715544 - protein, 21 aa, Mycobacterium
QRAASSVKERNGWSYEKWAKQ

SEQ ID NO: 715545 - protein, 20 aa, Mycobacterium
QRADECWERVEKVIQQIGSL

SEQ ID NO: 715546 - protein, 29 aa, Mycobacterium
QRADGALRRSIKFATFLDGIDAVRRVAEH

SEQ ID NO: 715547 - protein, 23 aa, Mycobacterium
QRADIPFGGTVAVIGLGAVGLCS

SEQ ID NO: 715548 - protein, 24 aa, Mycobacterium
QRAEAILMRDGLLWASERPVAKAL

SEQ ID NO: 715549 - protein, 25 aa, Mycobacterium
QRAEGRYALMPGIIAALAESGTPLS

SEQ ID NO: 715550 - protein, 25 aa, Mycobacterium
QRAEGRYALMPGIIGALADSYTPFS

SEQ ID NO: 715551 - protein, 25 aa, Mycobacterium
QRAEGRYALMPGIIGALAESGTPLS

SEQ ID NO: 715552 - protein, 24 aa, Mycobacterium
QRAEGRYALMPGIIGALAGSGTPL

SEQ ID NO: 715553 - protein, 24 aa, Mycobacterium
QRAEGRYALMPGIIGALTDFGTPF

SEQ ID NO: 715554 - protein, 22 aa, Mycobacterium
QRAEHYLELVGLQAFADRYPHE

SEQ ID NO: 715555 - protein, 25 aa, Mycobacterium
QRAEKLLRYRLDGMHVAAVVWVDAA

SEQ ID NO: 715556 - protein, 24 aa, Mycobacterium
QRAGAWLREYFHGLIERRRSHPGD

SEQ ID NO: 715557 - protein, 19 aa, Mycobacterium
QRAGGLGVQLHEEVSGRGE

SEQ ID NO: 715558 - protein, 23 aa, Mycobacterium
QRAGLALLSFGGRFVEIGKRDIY

SEQ ID NO: 715559 - protein, 19 aa, Mycobacterium
QRAGLPLASTTYYFSSLED

SEQ ID NO: 715560 - protein, 18 aa, Mycobacterium
QRAGLRTLCLEANTYAGG

SEQ ID NO: 715561 - protein, 20 aa, Mycobacterium
QRAGLRTVCLEAKRYAGGMA

SEQ ID NO: 715562 - protein, 21 aa, Mycobacterium
QRAGLRTVCLEANTYAGGMAA

SEQ ID NO: 715563 - protein, 21 aa, Mycobacterium
QRAGLSVGDVALWEINEAFAS

SEQ ID NO: 715564 - protein, 28 aa, Mycobacterium
QRAKNMFALGLLSWMYGRELEASEAFIR

SEQ ID NO: 715565 - protein, 28 aa, Mycobacterium
QRAKNMFALGLLSWMYGRELEHSEAFIR

SEQ ID NO: 715566 - protein, 25 aa, Mycobacterium
QRAKQLWFNRILPFARNLQAGEPVA

SEQ ID NO: 715567 - protein, 22 aa, Mycobacterium
QRAKVATGFAKPAGIFTLTDAN

SEQ ID NO: 715568 - protein, 22 aa, Mycobacterium
QRAKVATGFGKPAGVHMLTDEN

SEQ ID NO: 715569 - protein, 23 aa, Mycobacterium
QRALDEWQLLTAAALVGLVEETM

SEQ ID NO: 715570 - protein, 25 aa, Mycobacterium
QRALDEWRLLTAAALVGLVEETMTI

SEQ ID NO: 715571 - protein, 24 aa, Mycobacterium
QRALDEWRVLSAAALVGLVEETMT

SEQ ID NO: 715572 - protein, 23 aa, Mycobacterium
QRALDGLIEFLPSATWFEHRDAA

SEQ ID NO: 715573 - protein, 19 aa, Mycobacterium
QRALGVWPIQEEIVGHRPA

SEQ ID NO: 715574 - protein, 19 aa, Mycobacterium
QRALIGWTAMLIVEGQADG

SEQ ID NO: 715575 - protein, 22 aa, Mycobacterium
QRALPRLHGCFSQHTPMNTEVA

SEQ ID NO: 715576 - protein, 24 aa, Mycobacterium
QRALRAGFQVLEVHAAHGYIQHQF

SEQ ID NO: 715577 - protein, 17 aa, Mycobacterium
QRALVLMVLAGGGGSTF

SEQ ID NO: 715578 - protein, 30 aa, Mycobacterium
QRANCAAFKRWGLYPRMGIAPEERDMSVEL

SEQ ID NO: 715579 - protein, 27 aa, Mycobacterium
QRAPGERFVLHPGEFVLGSTLELITLP

SEQ ID NO: 715580 - protein, 28 aa, Mycobacterium
QRAPLAPIRLRIGIHTGEIQLRDDANYA

SEQ ID NO: 715581 - protein, 23 aa, Mycobacterium
QRAPRLRLVQKLGAGVNTIDVAT

SEQ ID NO: 715582 - protein, 22 aa, Mycobacterium
QRAQEFNQRWATLGCDIDLSGL

SEQ ID NO: 715583 - protein, 20 aa, Mycobacterium
QRAQELLEQFDLVGAGDRAV

SEQ ID NO: 715584 - protein, 22 aa, Mycobacterium
QRAQRAAVEVVRPGVTAEQVDA

SEQ ID NO: 715585 - protein, 23 aa, Mycobacterium
QRAREIDTVYGLVAETMKERSTA

SEQ ID NO: 715586 - protein, 18 aa, Mycobacterium
QRARHLLAGTGIDILNGL

SEQ ID NO: 715587 - protein, 17 aa, Mycobacterium
QRARLTADPALMPLATE

SEQ ID NO: 715588 - protein, 39 aa, Mycobacterium
QRARMLMDATIFRDTLIMAYQWPADRQSLSWTLESSSLL

SEQ ID NO: 715589 - protein, 21 aa, Mycobacterium
QRARNELFLYAIDNELSIPIG

SEQ ID NO: 715590 - protein, 21 aa, Mycobacterium
QRARSAQYTLLLDTLAETPLQ

SEQ ID NO: 715591 - protein, 26 aa, Mycobacterium
QRASLMTRLLWRYAKRRFGEVPEPFT

SEQ ID NO: 715592 - protein, 29 aa, Mycobacterium
QRASREIRAGCVWINDHIPIISEMPHGGF

SEQ ID NO: 715593 - protein, 23 aa, Mycobacterium
QRAVDMAVRLGLRSYAQPGTARD

SEQ ID NO: 715594 - protein, 24 aa, Mycobacterium
QRAVIPRDHIKSVLDSADVVIWTT

SEQ ID NO: 715595 - protein, 19 aa, Mycobacterium
QRAVLLLRDVLQWKSAEVA

SEQ ID NO: 715596 - protein, 31 aa, Mycobacterium
QRAVRTIAWLPWLVCPLSAPAGAGKTTSMRA

SEQ ID NO: 715597 - protein, 17 aa, Mycobacterium
QRAWLNLVRPLTIVEGF

SEQ ID NO: 715598 - protein, 19 aa, Mycobacterium
QRAYAELVHDTPGFVDYFK

SEQ ID NO: 715599 - protein, 19 aa, Mycobacterium
QRAYRAGAGAAGFTDDASL

SEQ ID NO: 715600 - protein, 22 aa, Mycobacterium
QRCAAGGLTLRIPRPRLCTDNG

SEQ ID NO: 715601 - protein, 18 aa, Mycobacterium
QRCAGPGAAWLDELVSAR

SEQ ID NO: 715602 - protein, 19 aa, Mycobacterium
QRCAQRIRRFFAAGTTEQA

SEQ ID NO: 715603 - protein, 19 aa, Mycobacterium
QRCEACGLANFPPTEHCRQ

SEQ ID NO: 715604 - protein, 29 aa, Mycobacterium
QRCGGSPAWNLPVVFGPIAVTYNISGVSS

SEQ ID NO: 715605 - protein, 17 aa, Mycobacterium
QRCIDEFSWARIAEQTL

SEQ ID NO: 715606 - protein, 17 aa, Mycobacterium
QRCIEEFSWAQVAGQTL

SEQ ID NO: 715607 - protein, 28 aa, Mycobacterium
QRCLDLTVEWCRNRETFGRPLISRQSVQ

SEQ ID NO: 715608 - protein, 28 aa, Mycobacterium
QRCLDLTVQWCRDRETFGRPLISRQSVQ

SEQ ID NO: 715609 - protein, 19 aa, Mycobacterium
QRCPDRPGLVDELGTLTWR

SEQ ID NO: 715610 - protein, 20 aa, Mycobacterium
QRCRFCTIEESLRSGATTAV

SEQ ID NO: 715611 - protein, 32 aa, Mycobacterium
QRCSTELGLPFTVADLFEFLSIRELSRHLETS

SEQ ID NO: 715612 - protein, 28 aa, Mycobacterium
QRDDGRWIWRWDPAFITSNLEFLRGDRA

SEQ ID NO: 715613 - protein, 19 aa, Mycobacterium
QRDEFWPGARQGLTQRESE

SEQ ID NO: 715614 - protein, 23 aa, Mycobacterium
QRDEVLRSLKLLQDSATLVFGDP

SEQ ID NO: 715615 - protein, 21 aa, Mycobacterium
QRDFGAAVVWISHDLGVIGQV

SEQ ID NO: 715616 - protein, 22 aa, Mycobacterium
QRDFGTAVVWISHDLGVIGQVA

SEQ ID NO: 715617 - protein, 24 aa, Mycobacterium
QRDGRPGVRGMAVKFTLPDGSTTD

SEQ ID NO: 715618 - protein, 18 aa, Mycobacterium
QRDGRVALGAGVPLGVLS

SEQ ID NO: 715619 - protein, 20 aa, Mycobacterium
QRDKLCWRNAAQLYGIQSPA

SEQ ID NO: 715620 - protein, 19 aa, Mycobacterium
QRDKLLWRNAAELYGLQSA

SEQ ID NO: 715621 - protein, 19 aa, Mycobacterium
QRDKVLWRNAAELYGLKER

SEQ ID NO: 715622 - protein, 19 aa, Mycobacterium
QRDLNSLVYVLAGRGAVGP

SEQ ID NO: 715623 - protein, 26 aa, Mycobacterium
QRDLPRLSSLELFPQSPLMTLETYRS

SEQ ID NO: 715624 - protein, 22 aa, Mycobacterium
QRDQCRWFGGMVGNHVADIVAR

SEQ ID NO: 715625 - protein, 22 aa, Mycobacterium
QRDQCRWFGGMVGNHVADLVDR

SEQ ID NO: 715626 - protein, 29 aa, Mycobacterium
QRDRFGWPILRGTQRWCQLFSEPGAGSDL

SEQ ID NO: 715627 - protein, 20 aa, Mycobacterium
QRDRFLFKINVDYPTVEEER

SEQ ID NO: 715628 - protein, 20 aa, Mycobacterium
QRDRFLFKINVGYPSAEEER

SEQ ID NO: 715629 - protein, 21 aa, Mycobacterium
QRDRFLFKINVGYPSPEEERE

SEQ ID NO: 715630 - protein, 20 aa, Mycobacterium
QRDRFLFKINVGYPTPEEER

SEQ ID NO: 715631 - protein, 22 aa, Mycobacterium
QRDRFLFKLNVDYPSPEEEREI

SEQ ID NO: 715632 - protein, 22 aa, Mycobacterium
QRDSRLVQIYARRLALDLNQPH

SEQ ID NO: 715633 - protein, 20 aa, Mycobacterium
QRDSWAAAIVDELQPAAADI

SEQ ID NO: 715634 - protein, 26 aa, Mycobacterium
QRDVREGPCLSAAWEQHTIRIDDLTT

SEQ ID NO: 715635 - protein, 18 aa, Mycobacterium
QRDVWRLVAYLSDPACAD

SEQ ID NO: 715636 - protein, 18 aa, Mycobacterium
QRDWDFAHEFGLPIVEVI

SEQ ID NO: 715637 - protein, 30 aa, Mycobacterium
QRDWDFARAFGLPVVEVIAGGDISQSAHTG

SEQ ID NO: 715638 - protein, 29 aa, Mycobacterium
QRDWDFARALGLPVVEVIAGGDISQAAYT

SEQ ID NO: 715639 - protein, 18 aa, Mycobacterium
QREAFAWHIDLAKRTGKP

SEQ ID NO: 715640 - protein, 26 aa, Mycobacterium
QREALKAGLQYPALAGPVFDTLTVES

SEQ ID NO: 715641 - protein, 27 aa, Mycobacterium
QREALKSALQFPALAGPVFDSLTAESF

SEQ ID NO: 715642 - protein, 19 aa, Mycobacterium
QREARLRRPQFSFPARGIL

SEQ ID NO: 715643 - protein, 27 aa, Mycobacterium
QRECGPAICKLEMFYDATIAHRQELVL

SEQ ID NO: 715644 - protein, 20 aa, Mycobacterium
QREEIRWDLANQPGTVLQVD

SEQ ID NO: 715645 - protein, 18 aa, Mycobacterium
QREFELGSEFSIDQVAAN

SEQ ID NO: 715646 - protein, 23 aa, Mycobacterium
QREKDFWDRVVVITSKDANLTKA

SEQ ID NO: 715647 - protein, 23 aa, Mycobacterium
QREKEFADVIAWLTEVLGDHVKE

SEQ ID NO: 715648 - protein, 23 aa, Mycobacterium
QREKLCWRNAAGLYGIEIPVDVA

SEQ ID NO: 715649 - protein, 21 aa, Mycobacterium
QREKVCWRNAARLYGIDIPAG

SEQ ID NO: 715650 - protein, 20 aa, Mycobacterium
QRELRRRTGILVPIDAFDLS

SEQ ID NO: 715651 - protein, 27 aa, Mycobacterium
QRELVEFTLRIMLSFFVAPNEATRSRE

SEQ ID NO: 715652 - protein, 24 aa, Mycobacterium
QRENLNWSAPRLHLVDLQYSDVRL

SEQ ID NO: 715653 - protein, 23 aa, Mycobacterium
QRENLTWQAPRLHLVDLQYSDVR

SEQ ID NO: 715654 - protein, 27 aa, Mycobacterium
QREPLIFSIGAWLGVPTFVVLRDVAGE

SEQ ID NO: 715655 - protein, 23 aa, Mycobacterium
QRERKWTDRWEMGLLSQQRILLV

SEQ ID NO: 715656 - protein, 26 aa, Mycobacterium
QRESLRTLGLKKIRQSVVREDNAQTR

SEQ ID NO: 715657 - protein, 19 aa, Mycobacterium
QREVQNFLRLASPPAASSR

SEQ ID NO: 715658 - protein, 18 aa, Mycobacterium
QREVRFYRDIAPRLDGPL

SEQ ID NO: 715659 - protein, 20 aa, Mycobacterium
QREYLLGGRFIFAMTGSAPT

SEQ ID NO: 715660 - protein, 27 aa, Mycobacterium
QRFAGMLVAGVFLREFVADAVDWAHID

SEQ ID NO: 715661 - protein, 28 aa, Mycobacterium
QRFAGMLVAGVFLREFVADGVSWAHIDV

SEQ ID NO: 715662 - protein, 21 aa, Mycobacterium
QRFAQLGAWSGRIAVDGEEIA

SEQ ID NO: 715663 - protein, 27 aa, Mycobacterium
QRFDGARRCVWEPRRGTDWGIDLDTVL

SEQ ID NO: 715664 - protein, 18 aa, Mycobacterium
QRFGRLGFPAGFADAYLA

SEQ ID NO: 715665 - protein, 18 aa, Mycobacterium
QRFIDRFAPFNLRDTAIR

SEQ ID NO: 715666 - protein, 26 aa, Mycobacterium
QRFLAEFRAEIGPRLGNPTLLGLIER

SEQ ID NO: 715667 - protein, 21 aa, Mycobacterium
QRFLAEQGYGYIIRDADDLLG

SEQ ID NO: 715668 - protein, 17 aa, Mycobacterium
QRFLAEQGYGYRITDAD

SEQ ID NO: 715669 - protein, 19 aa, Mycobacterium
QRFLAEQGYGYVIKDADDL

SEQ ID NO: 715670 - protein, 18 aa, Mycobacterium
QRFLPGMINGTERWCQGF

SEQ ID NO: 715671 - protein, 27 aa, Mycobacterium
QRFLPPTFRGEMMWCQLFSEPGAGSDL

SEQ ID NO: 715672 - protein, 23 aa, Mycobacterium
QRFNELRLQLKVNGQLRQNMLVG

SEQ ID NO: 715673 - protein, 23 aa, Mycobacterium
QRFNSRFPDTFVVPDVLIPKITA

SEQ ID NO: 715674 - protein, 21 aa, Mycobacterium
QRFPEVQLLIVGRGDEDQLRS

SEQ ID NO: 715675 - protein, 23 aa, Mycobacterium
QRFPEVVVRPLIRFANPTRQLLV

SEQ ID NO: 715676 - protein, 22 aa, Mycobacterium
QRFPTAAWPTLPLEDYALGQDN

SEQ ID NO: 715677 - protein, 20 aa, Mycobacterium
QRFQAELDRSLAPGESNSEI

SEQ ID NO: 715678 - protein, 24 aa, Mycobacterium
QRFRDEMRLPWGPDHQRRFDRLMK

SEQ ID NO: 715679 - protein, 20 aa, Mycobacterium
QRFSEGRVLLNIVTGGDNVE

SEQ ID NO: 715680 - protein, 23 aa, Mycobacterium
QRFSWVGHWSGRPLLAIHEEWVL

SEQ ID NO: 715681 - protein, 20 aa, Mycobacterium
QRFTAEIGRQSGLAAEGLGP

SEQ ID NO: 715682 - protein, 20 aa, Mycobacterium
QRFTLLRPMLFTIAYEILGS

SEQ ID NO: 715683 - protein, 19 aa, Mycobacterium
QRFTSALVISQWCRMPHGT

SEQ ID NO: 715684 - protein, 23 aa, Mycobacterium
QRFYSKHGFTINGTKTFRLGAGI

SEQ ID NO: 715685 - protein, 23 aa, Mycobacterium
QRGDGWIKLVGDWIDRSVGDLAP

SEQ ID NO: 715686 - protein, 29 aa, Mycobacterium
QRGDRVLAVLPFFHIYGLVVLLNVQLKLG

SEQ ID NO: 715687 - protein, 18 aa, Mycobacterium
QRGEEIFAEVSLPEHAGL

SEQ ID NO: 715688 - protein, 22 aa, Mycobacterium
QRGESFDLVFIDADKENNVSYV

SEQ ID NO: 715689 - protein, 20 aa, Mycobacterium
QRGGAAGAFGRPGGAPRRGR

SEQ ID NO: 715690 - protein, 25 aa, Mycobacterium
QRGIEVIEFAIGIPHLLKGEFTENA

SEQ ID NO: 715691 - protein, 25 aa, Mycobacterium
QRGIEVIEFAIGIPHLLKGEYSEGA

SEQ ID NO: 715692 - protein, 19 aa, Mycobacterium
QRGISLLTLGFMQATPDGK

SEQ ID NO: 715693 - protein, 21 aa, Mycobacterium
QRGKWAYYRLDAAAFGQLAQL

SEQ ID NO: 715694 - protein, 18 aa, Mycobacterium
QRGLPLLDLKDLRAVITH

SEQ ID NO: 715695 - protein, 18 aa, Mycobacterium
QRGLRPEAITSFMKGLVT

SEQ ID NO: 715696 - protein, 23 aa, Mycobacterium
QRGLWFEEFEIGTTYLHRPGRTI

SEQ ID NO: 715697 - protein, 22 aa, Mycobacterium
QRGLWFEEFEIGVIYKHRPGRT

SEQ ID NO: 715698 - protein, 20 aa, Mycobacterium
QRGRIAPGWHADLVLFDPAT

SEQ ID NO: 715699 - protein, 21 aa, Mycobacterium
QRGRLLDGIRTLVKGTVAADR

SEQ ID NO: 715700 - protein, 20 aa, Mycobacterium
QRGRYPGGLIEQLSVRESQL

SEQ ID NO: 715701 - protein, 18 aa, Mycobacterium
QRGTVALMHGEREFPSFQ

SEQ ID NO: 715702 - protein, 18 aa, Mycobacterium
QRGVLKLSCPTTINFRTR

SEQ ID NO: 715703 - protein, 17 aa, Mycobacterium
QRGVPHVLLADALAEAV

SEQ ID NO: 715704 - protein, 18 aa, Mycobacterium
QRGYKCIFVCPDKVSEDK

SEQ ID NO: 715705 - protein, 18 aa, Mycobacterium
QRGYRPDELTEWFATAYV

SEQ ID NO: 715706 - protein, 24 aa, Mycobacterium
QRGYSFPVLSDFWPHGAVSQAYGV

SEQ ID NO: 715707 - protein, 24 aa, Mycobacterium
QRGYTRLSWAVLNWNTDAITLYDG

SEQ ID NO: 715708 - protein, 17 aa, Mycobacterium
QRHAGPVADLFGANWMS

SEQ ID NO: 715709 - protein, 27 aa, Mycobacterium
QRHDLPRGDLDRVVRQQVVMSSLAHSA

SEQ ID NO: 715710 - protein, 25 aa, Mycobacterium
QRHGREFASRFGLGFSAEDREENIR

SEQ ID NO: 715711 - protein, 27 aa, Mycobacterium
QRHLEGPCVHAAWTRKVVVIDDLGSDS

SEQ ID NO: 715712 - protein, 21 aa, Mycobacterium
QRHPATVIRWVTGTPTERTVP

SEQ ID NO: 715713 - protein, 17 aa, Mycobacterium
QRHPRLRTVVVEGDAGP

SEQ ID NO: 715714 - protein, 23 aa, Mycobacterium
QRHRLALWARRLLGEAVTQAQYV

SEQ ID NO: 715715 - protein, 22 aa, Mycobacterium
QRHRLALWSRRLLGEAITQAQF

SEQ ID NO: 715716 - protein, 20 aa, Mycobacterium
QRHSSLLPLLHNYRQPERPV

SEQ ID NO: 715717 - protein, 19 aa, Mycobacterium
QRHTLNLAIWDRADLPERN

SEQ ID NO: 715718 - protein, 18 aa, Mycobacterium
QRHVEWVVSWFEHLNLWD

SEQ ID NO: 715719 - protein, 25 aa, Mycobacterium
QRHWAAEGVERGWAATMVLTEPDAG

SEQ ID NO: 715720 - protein, 18 aa, Mycobacterium
QRIAAKYDLYRDACLQTD

SEQ ID NO: 715721 - protein, 26 aa, Mycobacterium
QRIARFAPRRLVGPRTLPLMRAGIAL

SEQ ID NO: 715722 - protein, 17 aa, Mycobacterium
QRIATRHARVFLDSVRP

SEQ ID NO: 715723 - protein, 32 aa, Mycobacterium
QRIDLMPPLRWRVREVPFGIDYPVLVQDDTFD

SEQ ID NO: 715724 - protein, 18 aa, Mycobacterium
QRIDLRWQHKETHGINPP

SEQ ID NO: 715725 - protein, 17 aa, Mycobacterium
QRIEILEQLMGVYRDLD

SEQ ID NO: 715726 - protein, 23 aa, Mycobacterium
QRIGLRFHPTRGSMDLGASAGGL

SEQ ID NO: 715727 - protein, 22 aa, Mycobacterium
QRIHPLKNVMILAGAGVGGGSL

SEQ ID NO: 715728 - protein, 19 aa, Mycobacterium
QRIKARRGFQTAIVATARK

SEQ ID NO: 715729 - protein, 18 aa, Mycobacterium
QRIPELAAAIGAASVHVS

SEQ ID NO: 715730 - protein, 24 aa, Mycobacterium
QRIPIEVSAAIVPYLEPRYAMERV

SEQ ID NO: 715731 - protein, 17 aa, Mycobacterium
QRIPLTGPQAFTNAELL

SEQ ID NO: 715732 - protein, 17 aa, Mycobacterium
QRIPRPVQVLLVSGRSD

SEQ ID NO: 715733 - protein, 19 aa, Mycobacterium
QRIQGVVPLCMKQLRNCYS

SEQ ID NO: 715734 - protein, 20 aa, Mycobacterium
QRIRELGFGLALSVGQHTND

SEQ ID NO: 715735 - protein, 20 aa, Mycobacterium
QRISGGRLLLNIVAGGDPVE

SEQ ID NO: 715736 - protein, 19 aa, Mycobacterium
QRITATMLVPSMLYALLDH

SEQ ID NO: 715737 - protein, 19 aa, Mycobacterium
QRITATMLVPSMLYALMDH

SEQ ID NO: 715738 - protein, 22 aa, Mycobacterium
QRKAMRHIAGIRLDAAAHHRFK

SEQ ID NO: 715739 - protein, 21 aa, Mycobacterium
QRKHVPPWCYVSIRDIADPTT

SEQ ID NO: 715740 - protein, 21 aa, Mycobacterium
QRKHVPPWCYVSIRDVTDASV

SEQ ID NO: 715741 - protein, 18 aa, Mycobacterium
QRKKLLVDYLRDVVAEVT

SEQ ID NO: 715742 - protein, 18 aa, Mycobacterium
QRKQRWNNAAAVLDKGAQ

SEQ ID NO: 715743 - protein, 18 aa, Mycobacterium
QRKVFGRDGMLLAVHEFM

SEQ ID NO: 715744 - protein, 24 aa, Mycobacterium
QRKVTRWETVYTIQTGIQGFRKRA

SEQ ID NO: 715745 - protein, 19 aa, Mycobacterium
QRLAAALTGCAGMPAEAVV

SEQ ID NO: 715746 - protein, 17 aa, Mycobacterium
QRLAAGLAQTTADIVRR

SEQ ID NO: 715747 - protein, 20 aa, Mycobacterium
QRLAAHRAQLRAAVEDRLAG

SEQ ID NO: 715748 - protein, 21 aa, Mycobacterium
QRLAAVCDRVVLVVAGQPVTV

SEQ ID NO: 715749 - protein, 26 aa, Mycobacterium
QRLAEARTGVFWVREMLPQPKIDEIL

SEQ ID NO: 715750 - protein, 22 aa, Mycobacterium
QRLAEKLWNLRILDDEKSACDI

SEQ ID NO: 715751 - protein, 23 aa, Mycobacterium
QRLALECAWEAFERGGIDPSSVR

SEQ ID NO: 715752 - protein, 25 aa, Mycobacterium
QRLALRLAGELGVVGVLAVELFETG

SEQ ID NO: 715753 - protein, 24 aa, Mycobacterium
QRLAPRTPLARVFWPGSRIVMTRT

SEQ ID NO: 715754 - protein, 20 aa, Mycobacterium
QRLAPRTPLARVFWPRTRIV

SEQ ID NO: 715755 - protein, 17 aa, Mycobacterium
QRLARAGWHVAALDVDE

SEQ ID NO: 715756 - protein, 17 aa, Mycobacterium
QRLARLVGRQQALGLLL

SEQ ID NO: 715757 - protein, 22 aa, Mycobacterium
QRLATKHLIRYPGLQQAISRGA

SEQ ID NO: 715758 - protein, 22 aa, Mycobacterium
QRLATLMLALSCVVEVAEDLIK

SEQ ID NO: 715759 - protein, 18 aa, Mycobacterium
QRLDGFLRHRGLVRLVED

SEQ ID NO: 715760 - protein, 32 aa, Mycobacterium
QRLDYLQWLGIDCIWLPPFYDSPLRDGGYDIR

SEQ ID NO: 715761 - protein, 20 aa, Mycobacterium
QRLESFTVIGQRGDDFADRL

SEQ ID NO: 715762 - protein, 18 aa, Mycobacterium
QRLETVFMLPTFACGVEE

SEQ ID NO: 715763 - protein, 26 aa, Mycobacterium
QRLFEARLGLITAIDHAWPPSEPEPE

SEQ ID NO: 715764 - protein, 26 aa, Mycobacterium
QRLFERLFLCVAFVNRFIPGFLRQGG

SEQ ID NO: 715765 - protein, 18 aa, Mycobacterium
QRLFSQWGGTTWGDIFMV

SEQ ID NO: 715766 - protein, 27 aa, Mycobacterium
QRLGALADELTCRFGVYAEALPADLAD

SEQ ID NO: 715767 - protein, 21 aa, Mycobacterium
QRLGDHKNVIADSWQLMSNDD

SEQ ID NO: 715768 - protein, 20 aa, Mycobacterium
QRLGDRIRRLFTDDEQFRAA

SEQ ID NO: 715769 - protein, 20 aa, Mycobacterium
QRLGFGITVSTTYESPYLLA

SEQ ID NO: 715770 - protein, 22 aa, Mycobacterium
QRLGGPGAWLLAVPPYHIAGLQ

SEQ ID NO: 715771 - protein, 19 aa, Mycobacterium
QRLGGPPATPARTLDEQAE

SEQ ID NO: 715772 - protein, 17 aa, Mycobacterium
QRLGGPVLLVLEDVDLW

SEQ ID NO: 715773 - protein, 25 aa, Mycobacterium
QRLGRGTPLWGGWITGPTWLGPEEF

SEQ ID NO: 715774 - protein, 20 aa, Mycobacterium
QRLICHARDRGCTRPNCLEP

SEQ ID NO: 715775 - protein, 20 aa, Mycobacterium
QRLIMEVAWEAADDAGVAGR

SEQ ID NO: 715776 - protein, 17 aa, Mycobacterium
QRLKLLGTLPANLGVEI

SEQ ID NO: 715777 - protein, 20 aa, Mycobacterium
QRLKRGWRPDQILDVLSADM

SEQ ID NO: 715778 - protein, 18 aa, Mycobacterium
QRLLFSATLDAAVDTLVK

SEQ ID NO: 715779 - protein, 17 aa, Mycobacterium
QRLLFSATLDNGVDKLV

SEQ ID NO: 715780 - protein, 19 aa, Mycobacterium
QRLLLECPKPVLAVKPHGF

SEQ ID NO: 715781 - protein, 22 aa, Mycobacterium
QRLLPARLFLKFLARMHGLKVR

SEQ ID NO: 715782 - protein, 19 aa, Mycobacterium
QRLLPGLAEGTSIATVAVT

SEQ ID NO: 715783 - protein, 18 aa, Mycobacterium
QRLLPRPLAHTSVHVAVA

SEQ ID NO: 715784 - protein, 18 aa, Mycobacterium
QRLLPRPLGRTSVEVAVA

SEQ ID NO: 715785 - protein, 25 aa, Mycobacterium
QRLLQTCPVCLYAGSIMPDDLLALC

SEQ ID NO: 715786 - protein, 22 aa, Mycobacterium
QRLLTLDAYVAAGFRVVALLNE

SEQ ID NO: 715787 - protein, 21 aa, Mycobacterium
QRLMLEVSWEALEHAGIDPLS

SEQ ID NO: 715788 - protein, 25 aa, Mycobacterium
QRLNVDLRHDVVWAARAAEAAGFAS

SEQ ID NO: 715789 - protein, 23 aa, Mycobacterium
QRLPAAAPYRSFVSWLAARDRDA

SEQ ID NO: 715790 - protein, 28 aa, Mycobacterium
QRLPAPPPYRRFVAWLAERDRDAAREAW

SEQ ID NO: 715791 - protein, 21 aa, Mycobacterium
QRLPDGRPHIVRLKVETSGMS

SEQ ID NO: 715792 - protein, 17 aa, Mycobacterium
QRLPGLLPQLSHEEALE

SEQ ID NO: 715793 - protein, 23 aa, Mycobacterium
QRLPGNAHFTFRGCEGDALLMLL

SEQ ID NO: 715794 - protein, 27 aa, Mycobacterium
QRLPSHAWPDRVLRITAIDVDTGESVV

SEQ ID NO: 715795 - protein, 25 aa, Mycobacterium
QRLQAACARHQVEWFWVKGHSGIGD

SEQ ID NO: 715796 - protein, 17 aa, Mycobacterium
QRLQDICDYHSSVEEAA

SEQ ID NO: 715797 - protein, 26 aa, Mycobacterium
QRLQKWVAACLFRYYLDQYTLLYGPL

SEQ ID NO: 715798 - protein, 19 aa, Mycobacterium
QRLQLEFAELADADTGESP

SEQ ID NO: 715799 - protein, 17 aa, Mycobacterium
QRLQRIVDAVARQESRL

SEQ ID NO: 715800 - protein, 17 aa, Mycobacterium
QRLQRLVDAVARQEPRL

SEQ ID NO: 715801 - protein, 18 aa, Mycobacterium
QRLQRLVDAVARQEPRLS

SEQ ID NO: 715802 - protein, 21 aa, Mycobacterium
QRLRALAALPELIAAAPDGGG

SEQ ID NO: 715803 - protein, 22 aa, Mycobacterium
QRLRALNFPKIVIGVSGGLDST

SEQ ID NO: 715804 - protein, 22 aa, Mycobacterium
QRLRHLLVLAERRLELAHGGPH

SEQ ID NO: 715805 - protein, 25 aa, Mycobacterium
QRLRSLIGAWCFIDHYGPASARMDV

SEQ ID NO: 715806 - protein, 22 aa, Mycobacterium
QRLSDFMTEYVFPAEADYDKYR

SEQ ID NO: 715807 - protein, 18 aa, Mycobacterium
QRLSEFLEHVDVVVSLHG

SEQ ID NO: 715808 - protein, 21 aa, Mycobacterium
QRLSPISGRAGIAVRAALSRL

SEQ ID NO: 715809 - protein, 17 aa, Mycobacterium
QRLSRERLLEIHPNRGV

SEQ ID NO: 715810 - protein, 17 aa, Mycobacterium
QRLSYQWVGDGWERTQL

SEQ ID NO: 715811 - protein, 20 aa, Mycobacterium
QRLTAALKRLGAPEPCVRFY

SEQ ID NO: 715812 - protein, 23 aa, Mycobacterium
QRLTDAGAFRMFVPRQYGGEEMT

SEQ ID NO: 715813 - protein, 21 aa, Mycobacterium
QRLTFRHDWEAVLTPVVDFAL

SEQ ID NO: 715814 - protein, 32 aa, Mycobacterium
QRLVDAVARQEPRLSWAAGLRDDGTTTLLVTD

SEQ ID NO: 715815 - protein, 25 aa, Mycobacterium
QRLVFEALDSVHWVEPARISAVNVP

SEQ ID NO: 715816 - protein, 21 aa, Mycobacterium
QRLVTPVPRGWSFAEAAGVPV

SEQ ID NO: 715817 - protein, 19 aa, Mycobacterium
QRLVVRGRIGTLLRYTQTL

SEQ ID NO: 715818 - protein, 20 aa, Mycobacterium
QRLVVRGRIGTVLRYTQTLT

SEQ ID NO: 715819 - protein, 17 aa, Mycobacterium
QRLWPTLLEPLRTREQA

SEQ ID NO: 715820 - protein, 22 aa, Mycobacterium
QRMAALCDRVVLVVAGQAVPIK

SEQ ID NO: 715821 - protein, 18 aa, Mycobacterium
QRMCLVPDGDLFAAIRDG

SEQ ID NO: 715822 - protein, 18 aa, Mycobacterium
QRMGDAIVDRAKRELPPG

SEQ ID NO: 715823 - protein, 23 aa, Mycobacterium
QRMIDYSGLRVCRFGRGNRRVLA

SEQ ID NO: 715824 - protein, 24 aa, Mycobacterium
QRMLPRRRGHVINIGSVGSMLPTE

SEQ ID NO: 715825 - protein, 19 aa, Mycobacterium
QRMPTWRAFWADGDPALPE

SEQ ID NO: 715826 - protein, 17 aa, Mycobacterium
QRMRARLIELARRQLPE

SEQ ID NO: 715827 - protein, 22 aa, Mycobacterium
QRMSARKFWVRYAAEATGSLTL

SEQ ID NO: 715828 - protein, 17 aa, Mycobacterium
QRMSFSVAGGDTTCTVA

SEQ ID NO: 715829 - protein, 17 aa, Mycobacterium
QRMTDMLAARTRYIDAF

SEQ ID NO: 715830 - protein, 21 aa, Mycobacterium
QRMTIAAAVRRARRARRPAAA

SEQ ID NO: 715831 - protein, 22 aa, Mycobacterium
QRMVDARLAARMYTREHGEDDP

SEQ ID NO: 715832 - protein, 17 aa, Mycobacterium
QRMVPRGRGHVINVASL

SEQ ID NO: 715833 - protein, 17 aa, Mycobacterium
QRNALGIEVSMRQLLES

SEQ ID NO: 715834 - protein, 21 aa, Mycobacterium
QRNFPATSVRFFASPRSEGKK

SEQ ID NO: 715835 - protein, 25 aa, Mycobacterium
QRNGFDCPGCAWPEEHGGRKLAEFC

SEQ ID NO: 715836 - protein, 18 aa, Mycobacterium
QRNGFDCPGCAWPEEPGG

SEQ ID NO: 715837 - protein, 18 aa, Mycobacterium
QRNIEGWVAQKRPGSDAA

SEQ ID NO: 715838 - protein, 19 aa, Mycobacterium
QRNIEGWVHRKRPGSAAAQ

SEQ ID NO: 715839 - protein, 21 aa, Mycobacterium
QRNIKGPGVVPVLSESPGTIR

SEQ ID NO: 715840 - protein, 21 aa, Mycobacterium
QRNYFGGAWIGCDGQTGLGLP

SEQ ID NO: 715841 - protein, 20 aa, Mycobacterium
QRPAGRRELLSLRLSSAKIA

SEQ ID NO: 715842 - protein, 21 aa, Mycobacterium
QRPAVAQLRTFLDTCKTVRET

SEQ ID NO: 715843 - protein, 20 aa, Mycobacterium
QRPAWDLSCLTFILNGGEPI

SEQ ID NO: 715844 - protein, 24 aa, Mycobacterium
QRPDARGVPFIFVRTDNAGNISKR

SEQ ID NO: 715845 - protein, 20 aa, Mycobacterium
QRPDGKWVLNGTKYYATGAL

SEQ ID NO: 715846 - protein, 22 aa, Mycobacterium
QRPDGTLEFLGRMDRQLKVHGV

SEQ ID NO: 715847 - protein, 22 aa, Mycobacterium
QRPDRFTFYASIDHLHADGQFV

SEQ ID NO: 715848 - protein, 19 aa, Mycobacterium
QRPELWPNAVEEILRLDSP

SEQ ID NO: 715849 - protein, 17 aa, Mycobacterium
QRPELWSLYNGRHAPGE

SEQ ID NO: 715850 - protein, 19 aa, Mycobacterium
QRPGAVAGRTATLARELGS

SEQ ID NO: 715851 - protein, 23 aa, Mycobacterium
QRPGDPTLRRLLPDFYKPGETDP

SEQ ID NO: 715852 - protein, 19 aa, Mycobacterium
QRPGEVLAIGQVLDTPVKV

SEQ ID NO: 715853 - protein, 19 aa, Mycobacterium
QRPGEVLAIGQVLDTQVRV

SEQ ID NO: 715854 - protein, 17 aa, Mycobacterium
QRPGSIRALNQGEVGQL

SEQ ID NO: 715855 - protein, 17 aa, Mycobacterium
QRPGSRVAMMVAEMVAD

SEQ ID NO: 715856 - protein, 21 aa, Mycobacterium
QRPHGVAALITILASAMVTGR

SEQ ID NO: 715857 - protein, 25 aa, Mycobacterium
QRPIVGPSWRMARNPARVARGAPDL

SEQ ID NO: 715858 - protein, 34 aa, Mycobacterium
QRPLPDELPAAALWWRLAAELTPAATVDAPHTGL

SEQ ID NO: 715859 - protein, 18 aa, Mycobacterium
QRPLPPIVLGRSGATSTF

SEQ ID NO: 715860 - protein, 24 aa, Mycobacterium
QRPNARGVPFIFVRTDSAGNISKR

SEQ ID NO: 715861 - protein, 19 aa, Mycobacterium
QRPPAGYGPPPGYPDQGYR

SEQ ID NO: 715862 - protein, 21 aa, Mycobacterium
QRPPAPGGYGAQGYDQGYRQA

SEQ ID NO: 715863 - protein, 18 aa, Mycobacterium
QRPPFGLYQITVPAADSL

SEQ ID NO: 715864 - protein, 20 aa, Mycobacterium
QRPPICVLGLGLIGGSLMRA

SEQ ID NO: 715865 - protein, 21 aa, Mycobacterium
QRPRSYTTYRAMLDKLDKCHT

SEQ ID NO: 715866 - protein, 20 aa, Mycobacterium
QRPSTQWASRARFRPRRLSG

SEQ ID NO: 715867 - protein, 17 aa, Mycobacterium
QRPSWRVGTRTVKIKAG

SEQ ID NO: 715868 - protein, 24 aa, Mycobacterium
QRPVRRPVLPVGRQHRLRLDGITE

SEQ ID NO: 715869 - protein, 20 aa, Mycobacterium
QRPVSAFLRALARDLNASTP

SEQ ID NO: 715870 - protein, 23 aa, Mycobacterium
QRQAAGLPVEFTGFISDRRTVAT

SEQ ID NO: 715871 - protein, 17 aa, Mycobacterium
QRQAIREFIYWQHVGQL

SEQ ID NO: 715872 - protein, 18 aa, Mycobacterium
QRQCRLKLSDVLRLSSQA

SEQ ID NO: 715873 - protein, 25 aa, Mycobacterium
QRQCVAIARAIFFGARVLILDEPTA

SEQ ID NO: 715874 - protein, 18 aa, Mycobacterium
QRQIGVGWAALRTLPPPA

SEQ ID NO: 715875 - protein, 20 aa, Mycobacterium
QRQRWFPGLAAGTLLTAIAM

SEQ ID NO: 715876 - protein, 21 aa, Mycobacterium
QRQYVEIWVSVLTRLRRDLPE

SEQ ID NO: 715877 - protein, 22 aa, Mycobacterium
QRRADAFGVIAVQGDRLVCLCG

SEQ ID NO: 715878 - protein, 18 aa, Mycobacterium
QRRADALGALGRYRDTLD

SEQ ID NO: 715879 - protein, 26 aa, Mycobacterium
QRRADARLLAGRRRLAAAIAGGTPMY

SEQ ID NO: 715880 - protein, 18 aa, Mycobacterium
QRRAEARLQGWEEFDEKV

SEQ ID NO: 715881 - protein, 22 aa, Mycobacterium
QRRAFDAAINRFLAGDPAAARQ

SEQ ID NO: 715882 - protein, 17 aa, Mycobacterium
QRRAPLYLMEYAHPVKS

SEQ ID NO: 715883 - protein, 17 aa, Mycobacterium
QRRAQVLARTGRELTDE

SEQ ID NO: 715884 - protein, 21 aa, Mycobacterium
QRRARVLMRFIELVNDHNDEL

SEQ ID NO: 715885 - protein, 17 aa, Mycobacterium
QRRATSYGKDDWVRIKA

SEQ ID NO: 715886 - protein, 19 aa, Mycobacterium
QRRAVLSTLGLRVSIDPTP

SEQ ID NO: 715887 - protein, 37 aa, Mycobacterium
QRRCRRRSITPTWEVRHGQHLRVCAVRNRAGSQCRPS

SEQ ID NO: 715888 - protein, 24 aa, Mycobacterium
QRREAALARREWLASERDRMAAER

SEQ ID NO: 715889 - protein, 20 aa, Mycobacterium
QRREELWTFGLIEQKSRARG

SEQ ID NO: 715890 - protein, 21 aa, Mycobacterium
QRREELWTYGLIDAHSRELGN

SEQ ID NO: 715891 - protein, 17 aa, Mycobacterium
QRREFRFDQRFRALTGL

SEQ ID NO: 715892 - protein, 19 aa, Mycobacterium
QRRFRDAFTATAHFQVNEA

SEQ ID NO: 715893 - protein, 17 aa, Mycobacterium
QRRGAAFVSACALVSGS

SEQ ID NO: 715894 - protein, 17 aa, Mycobacterium
QRRGASIDVIAQRGREN

SEQ ID NO: 715895 - protein, 23 aa, Mycobacterium
QRRGGPCPSTYPAPIVDHGTERA

SEQ ID NO: 715896 - protein, 25 aa, Mycobacterium
QRRGLTIDLGFAWTELDGRQLAFVD

SEQ ID NO: 715897 - protein, 24 aa, Mycobacterium
QRRGLTIDLGFAWTTLEGRDIAFV

SEQ ID NO: 715898 - protein, 19 aa, Mycobacterium
QRRHSVLQMLPLRDSERLR

SEQ ID NO: 715899 - protein, 19 aa, Mycobacterium
QRRIWELEKRRARVPWVTW

SEQ ID NO: 715900 - protein, 19 aa, Mycobacterium
QRRLAVVFGAGGDRDPGKR

SEQ ID NO: 715901 - protein, 22 aa, Mycobacterium
QRRLGELVGLFSTARFSRQGEH

SEQ ID NO: 715902 - protein, 23 aa, Mycobacterium
QRRLKTCAAPDCDAVLVDLSRNR

SEQ ID NO: 715903 - protein, 18 aa, Mycobacterium
QRRLPGVEAMVTSGDPGE

SEQ ID NO: 715904 - protein, 19 aa, Mycobacterium
QRRLPLLIASGADVQVISR

SEQ ID NO: 715905 - protein, 18 aa, Mycobacterium
QRRLWRRSPGHIVRGVTG

SEQ ID NO: 715906 - protein, 20 aa, Mycobacterium
QRRMRMVYSLAFSLPGTPVL

SEQ ID NO: 715907 - protein, 21 aa, Mycobacterium
QRRPLRLIAEKACALTDAEQA

SEQ ID NO: 715908 - protein, 17 aa, Mycobacterium
QRRPRRLLTSATKSNGI

SEQ ID NO: 715909 - protein, 22 aa, Mycobacterium
QRRPTLELLLLLAEAHQVPLDE

SEQ ID NO: 715910 - protein, 24 aa, Mycobacterium
QRRPYDLSSLFAIGTGGAATNQRH

SEQ ID NO: 715911 - protein, 24 aa, Mycobacterium
QRRQEMLVYIAMSRFGRRPRFSEL

SEQ ID NO: 715912 - protein, 24 aa, Mycobacterium
QRRRMSRQPVRGEHTGDTVTGTSK

SEQ ID NO: 715913 - protein, 17 aa, Mycobacterium
QRRSAAICGVDKLEFWD

SEQ ID NO: 715914 - protein, 17 aa, Mycobacterium
QRRSGGIAKLIGTTARL

SEQ ID NO: 715915 - protein, 17 aa, Mycobacterium
QRRTKPVLVVRESTCDA

SEQ ID NO: 715916 - protein, 17 aa, Mycobacterium
QRRTVPLPLSQKIFDSR

SEQ ID NO: 715917 - protein, 17 aa, Mycobacterium
QRRVAIEDIEIAGETIR

SEQ ID NO: 715918 - protein, 20 aa, Mycobacterium
QRSAFPDAYAKYEAQAAQIF

SEQ ID NO: 715919 - protein, 22 aa, Mycobacterium
QRSAYCGNLSGGQRTRASLACA

SEQ ID NO: 715920 - protein, 26 aa, Mycobacterium
QRSDEFICSCCYLVQHRSRLRSSIGQ

SEQ ID NO: 715921 - protein, 26 aa, Mycobacterium
QRSISLPMLYALSALGSLKARLTGKD

SEQ ID NO: 715922 - protein, 25 aa, Mycobacterium
QRSPEGLDAFLRRFLLPPLLTTTRS

SEQ ID NO: 715923 - protein, 17 aa, Mycobacterium
QRSPSGKADYRWAKDQV

SEQ ID NO: 715924 - protein, 22 aa, Mycobacterium
QRSRFVKRLGDRAFGVVVLMYI

SEQ ID NO: 715925 - protein, 20 aa, Mycobacterium
QRSRLRLVRRHHLGHRDRPH

SEQ ID NO: 715926 - protein, 22 aa, Mycobacterium
QRSRLSKHLGDRTFGVVVQMYI

SEQ ID NO: 715927 - protein, 22 aa, Mycobacterium
QRSRRVLLQGWEQWDEPVDRIV

SEQ ID NO: 715928 - protein, 20 aa, Mycobacterium
QRSSNFMLWQAAYAEYIFQD

SEQ ID NO: 715929 - protein, 27 aa, Mycobacterium
QRSSRYPAGMALRFVRVLRYRDDKSPA

SEQ ID NO: 715930 - protein, 18 aa, Mycobacterium
QRSTQEWLDLCRDNDIPA

SEQ ID NO: 715931 - protein, 25 aa, Mycobacterium
QRSTVESWARLAVAARPELTLGRAR

SEQ ID NO: 715932 - protein, 43 aa, Mycobacterium
QRSTVESWARLAVAARPGLTLGRARYAVHAAFALAVDIGQLVL

SEQ ID NO: 715933 - protein, 23 aa, Mycobacterium
QRSWFGRDHRVVWLAGESVETGG

SEQ ID NO: 715934 - protein, 19 aa, Mycobacterium
QRSWWAAVEDVARLRDALG

SEQ ID NO: 715935 - protein, 25 aa, Mycobacterium
QRTAPPFAVHRLWLDRPVSAERPAF

SEQ ID NO: 715936 - protein, 17 aa, Mycobacterium
QRTAPWVEALDGGIDHL

SEQ ID NO: 715937 - protein, 17 aa, Mycobacterium
QRTAPWVEQLGLEHLRE

SEQ ID NO: 715938 - protein, 17 aa, Mycobacterium
QRTAPWVESLDGGLEHV

SEQ ID NO: 715939 - protein, 17 aa, Mycobacterium
QRTAPWVESLEGGLDHV

SEQ ID NO: 715940 - protein, 17 aa, Mycobacterium
QRTAPWVESLGLDHVRE

SEQ ID NO: 715941 - protein, 18 aa, Mycobacterium
QRTARLVGSYDWVLMALG

SEQ ID NO: 715942 - protein, 24 aa, Mycobacterium
QRTCAVPGCGATRGLHAHHLRHWE

SEQ ID NO: 715943 - protein, 18 aa, Mycobacterium
QRTCRDVGEALALQYFHI

SEQ ID NO: 715944 - protein, 24 aa, Mycobacterium
QRTDRLGVVSLYFNADPTQNLQVQ

SEQ ID NO: 715945 - protein, 24 aa, Mycobacterium
QRTEVCVAHRGCAVVVDAVVLHPD

SEQ ID NO: 715946 - protein, 21 aa, Mycobacterium
QRTFGGWQLADLVSVDGSVVP

SEQ ID NO: 715947 - protein, 18 aa, Mycobacterium
QRTFLWQHCTAMVPGFTG

SEQ ID NO: 715948 - protein, 26 aa, Mycobacterium
QRTGFDCGGLVRYSTQQGAGYDVFQR

SEQ ID NO: 715949 - protein, 19 aa, Mycobacterium
QRTGVALLEYPVWMWHWAS

SEQ ID NO: 715950 - protein, 18 aa, Mycobacterium
QRTHEWAVRCLVEHRRLS

SEQ ID NO: 715951 - protein, 26 aa, Mycobacterium
QRTLELTGRILLAASKKRSAWWAGAV

SEQ ID NO: 715952 - protein, 17 aa, Mycobacterium
QRTLGRTLVKSVIAQAQ

SEQ ID NO: 715953 - protein, 20 aa, Mycobacterium
QRTLTYFGLRSEVLHAAAAM

SEQ ID NO: 715954 - protein, 22 aa, Mycobacterium
QRTPIWCFPKLDVPLPAAARWA

SEQ ID NO: 715955 - protein, 25 aa, Mycobacterium
QRTPLSSSHFVRWLTVWNDTVDEMF

SEQ ID NO: 715956 - protein, 21 aa, Mycobacterium
QRTRHIWQRIHASAYRDMGPT

SEQ ID NO: 715957 - protein, 21 aa, Mycobacterium
QRTRPVLDFIARRVETQLRLG

SEQ ID NO: 715958 - protein, 19 aa, Mycobacterium
QRTSGYIILGWRPGTGPRS

SEQ ID NO: 715959 - protein, 20 aa, Mycobacterium
QRTVGAWLWSGRRAVIAGPA

SEQ ID NO: 715960 - protein, 19 aa, Mycobacterium
QRTVRVCWRGHGPDRNLVG

SEQ ID NO: 715961 - protein, 20 aa, Mycobacterium
QRVAAVAGFLRQRLTGDYSV

SEQ ID NO: 715962 - protein, 20 aa, Mycobacterium
QRVAFVLHDGFAMPFAEVAG

SEQ ID NO: 715963 - protein, 20 aa, Mycobacterium
QRVAFVLHDGFAVPFAEVAD

SEQ ID NO: 715964 - protein, 19 aa, Mycobacterium
QRVAFVLHDGFDVPFAEVA

SEQ ID NO: 715965 - protein, 19 aa, Mycobacterium
QRVAFVLHDGFSVPFKQIA

SEQ ID NO: 715966 - protein, 21 aa, Mycobacterium
QRVAFVLYDGFGVPFPDIADV

SEQ ID NO: 715967 - protein, 27 aa, Mycobacterium
QRVAGRLAAAGWPLAGIEVSQVIPEDE

SEQ ID NO: 715968 - protein, 21 aa, Mycobacterium
QRVALGRVLVRPADIYLLDEP

SEQ ID NO: 715969 - protein, 24 aa, Mycobacterium
QRVAQRFGCPVVDLYSTTESGPVA

SEQ ID NO: 715970 - protein, 24 aa, Mycobacterium
QRVAQYLARNGFRPVNVTGGMLAW

SEQ ID NO: 715971 - protein, 25 aa, Mycobacterium
QRVDIGRLRGRICPAGGTQSLHKLL

SEQ ID NO: 715972 - protein, 18 aa, Mycobacterium
QRVDLAFGAIDRMLDQRP

SEQ ID NO: 715973 - protein, 30 aa, Mycobacterium
QRVEFRLLTEIVRILGRFREPLTTRAVKAF

SEQ ID NO: 715974 - protein, 18 aa, Mycobacterium
QRVEITARGRGPVVRGEA

SEQ ID NO: 715975 - protein, 21 aa, Mycobacterium
QRVERFYVWFADFAVPESLHE

SEQ ID NO: 715976 - protein, 35 aa, Mycobacterium
QRVGARLGVVLACGGFDHDLAWRKELLPVVDRDWS

SEQ ID NO: 715977 - protein, 22 aa, Mycobacterium
QRVGCGFITWSLARNPELLDLI

SEQ ID NO: 715978 - protein, 23 aa, Mycobacterium
QRVGLPAVELVPALLDGTGLQLR

SEQ ID NO: 715979 - protein, 21 aa, Mycobacterium
QRVGNRPVYLSIDIDVLDPAH

SEQ ID NO: 715980 - protein, 18 aa, Mycobacterium
QRVHLERFTVTPADPAVE

SEQ ID NO: 715981 - protein, 22 aa, Mycobacterium
QRVKELGFHMALGVGQHTNDRE

SEQ ID NO: 715982 - protein, 22 aa, Mycobacterium
QRVKFLCHWYLPASQRHKGRFT

SEQ ID NO: 715983 - protein, 21 aa, Mycobacterium
QRVLLEVCWEALEHAGIEPGT

SEQ ID NO: 715984 - protein, 18 aa, Mycobacterium
QRVLRAMPAAGVRVGTLT

SEQ ID NO: 715985 - protein, 17 aa, Mycobacterium
QRVMIAMAIALNPALII

SEQ ID NO: 715986 - protein, 17 aa, Mycobacterium
QRVPDNLAELGRLTKLA

SEQ ID NO: 715987 - protein, 17 aa, Mycobacterium
QRVPERYPEVIVQAVDA

SEQ ID NO: 715988 - protein, 19 aa, Mycobacterium
QRVPERYPEVIVQAVDAAD

SEQ ID NO: 715989 - protein, 24 aa, Mycobacterium
QRVREGLLEIGRKLGIPPLATNDC

SEQ ID NO: 715990 - protein, 18 aa, Mycobacterium
QRVRKIALELGYRPSVAA

SEQ ID NO: 715991 - protein, 19 aa, Mycobacterium
QRVRLRFINNSMMFHPMHL

SEQ ID NO: 715992 - protein, 17 aa, Mycobacterium
QRVVIAIAIACDPKVII

SEQ ID NO: 715993 - protein, 25 aa, Mycobacterium
QRVYEVPVLLRFGGRLVPDTQALEI

SEQ ID NO: 715994 - protein, 20 aa, Mycobacterium
QRWARERAQRAVAKANPAGA

SEQ ID NO: 715995 - protein, 20 aa, Mycobacterium
QRWARQRAQRAIAKASPAGA

SEQ ID NO: 715996 - protein, 25 aa, Mycobacterium
QRWDPDLRALFGLDAEEMPEIVASD

SEQ ID NO: 715997 - protein, 17 aa, Mycobacterium
QRWDSLRLLTPNWMTRL

SEQ ID NO: 715998 - protein, 21 aa, Mycobacterium
QRWDVKGYKIPGGTPATPALA

SEQ ID NO: 715999 - protein, 23 aa, Mycobacterium
QRWEGHPGALLTWATHQVPFLAA

SEQ ID NO: 716000 - protein, 24 aa, Mycobacterium
QRWFESFANISWPAARELGKPYRD

SEQ ID NO: 716001 - protein, 17 aa, Mycobacterium
QRWGHIDFLINNAGVGS

SEQ ID NO: 716002 - protein, 20 aa, Mycobacterium
QRWIAAGLFDPVVREKAGMR

SEQ ID NO: 716003 - protein, 20 aa, Mycobacterium
QRWIAAGLFEPAVREKAGMH

SEQ ID NO: 716004 - protein, 19 aa, Mycobacterium
QRWIKALSAQAGRAVTAAP

SEQ ID NO: 716005 - protein, 17 aa, Mycobacterium
QRWPEWTASVTSLTGRD

SEQ ID NO: 716006 - protein, 20 aa, Mycobacterium
QRWPGPRQIYRASGLSPVQY

SEQ ID NO: 716007 - protein, 21 aa, Mycobacterium
QRWPQAGSLGPLIRDPDGAIY

SEQ ID NO: 716008 - protein, 19 aa, Mycobacterium
QRWQSRPAERRDIVNVSSV

SEQ ID NO: 716009 - protein, 24 aa, Mycobacterium
QRWSTERHLVFACGRYEGIDQRVV

SEQ ID NO: 716010 - protein, 19 aa, Mycobacterium
QRWTADPIVGFAGAGAQDS

SEQ ID NO: 716011 - protein, 31 aa, Mycobacterium
QRWVDQRGRIRLAGFGYRVPIVLAGEPVEAV

SEQ ID NO: 716012 - protein, 20 aa, Mycobacterium
QRWVLSNALWVFGVDSAQSL

SEQ ID NO: 716013 - protein, 20 aa, Mycobacterium
QRYARLRVVHSLEASQRRVY

SEQ ID NO: 716014 - protein, 18 aa, Mycobacterium
QRYDIRRPDGDFEERFWS

SEQ ID NO: 716015 - protein, 20 aa, Mycobacterium
QRYDKRQIAVYMTGNELISL

SEQ ID NO: 716016 - protein, 17 aa, Mycobacterium
QRYGFRVHGPWDPESGH

SEQ ID NO: 716017 - protein, 26 aa, Mycobacterium
QRYGLSWRRPELDCVHPLDDGSAGVL

SEQ ID NO: 716018 - protein, 28 aa, Mycobacterium
QRYLDALMPMVWVACEREDFVVEVQAMR

SEQ ID NO: 716019 - protein, 24 aa, Mycobacterium
QRYLEGPCLTAAWEEQTVHVRDLQ

SEQ ID NO: 716020 - protein, 24 aa, Mycobacterium
QRYLRPLLDGELFSCYSMTEPHAG

SEQ ID NO: 716021 - protein, 17 aa, Mycobacterium
QRYMHDFSLTREHLGRI

SEQ ID NO: 716022 - protein, 17 aa, Mycobacterium
QRYPAWPASYDASLRVS

SEQ ID NO: 716023 - protein, 19 aa, Mycobacterium
QRYPRGIAETGFIQQDFAD

SEQ ID NO: 716024 - protein, 21 aa, Mycobacterium
QRYRAALDMAEYADHHGFTAV

SEQ ID NO: 716025 - protein, 18 aa, Mycobacterium
QRYRDRYIFAGLQPGQRI

SEQ ID NO: 716026 - protein, 17 aa, Mycobacterium
QRYTLAIMNSLNGEGAY

SEQ ID NO: 716027 - protein, 25 aa, Mycobacterium
QRYVAKYTICPAVAHGLDGEIGSVE

SEQ ID NO: 716028 - protein, 18 aa, Mycobacterium
QSAARAALFDVQRAVEAT

SEQ ID NO: 716029 - protein, 28 aa, Mycobacterium
QSACLEHPTWWGGLVDLPVSPAPQDFNR

SEQ ID NO: 716030 - protein, 19 aa, Mycobacterium
QSADGYLHFETRVRGAHVN

SEQ ID NO: 716031 - protein, 20 aa, Mycobacterium
QSAEIGSAFDLYTKNDLYGS

SEQ ID NO: 716032 - protein, 19 aa, Mycobacterium
QSAELPLFRYLGGPNAHIL

SEQ ID NO: 716033 - protein, 19 aa, Mycobacterium
QSAGGSLVMLAKGNRSDAV

SEQ ID NO: 716034 - protein, 24 aa, Mycobacterium
QSAGSWWPDYVSWLAERSGPEVDA

SEQ ID NO: 716035 - protein, 27 aa, Mycobacterium
QSAKATETWRYPAFFHGLLSRGVYPPA

SEQ ID NO: 716036 - protein, 25 aa, Mycobacterium
QSALDRWWKLRLEWAKGQDPLGGRF

SEQ ID NO: 716037 - protein, 25 aa, Mycobacterium
QSAYCSHPALLDACFQSVVVAPEVQ

SEQ ID NO: 716038 - protein, 26 aa, Mycobacterium
QSAYSEMWFTDAYWPEFRRVDFLRAL

SEQ ID NO: 716039 - protein, 20 aa, Mycobacterium
QSAYSEMWFTEAYWPAFRRV

SEQ ID NO: 716040 - protein, 21 aa, Mycobacterium
QSAYSEMWFTEAYWPEFRRVD

SEQ ID NO: 716041 - protein, 21 aa, Mycobacterium
QSCAGRRQLVRVGLGRLFAVQ

SEQ ID NO: 716042 - protein, 29 aa, Mycobacterium
QSCGGPCWHWKGSVWGYTCTDCIDRYLDE

SEQ ID NO: 716043 - protein, 18 aa, Mycobacterium
QSCPLRAQCTKSRRGRVI

SEQ ID NO: 716044 - protein, 35 aa, Mycobacterium
QSCRQCPNCLAGEYRRCERHGLADMYGFIPVDRAP

SEQ ID NO: 716045 - protein, 25 aa, Mycobacterium
QSCVAGSRFLVQRGIYDAFVDALSA

SEQ ID NO: 716046 - protein, 18 aa, Mycobacterium
QSDDYRADLAYWKETLDG

SEQ ID NO: 716047 - protein, 25 aa, Mycobacterium
QSDEIACLVLYGIHRARLRCPSDLA

SEQ ID NO: 716048 - protein, 25 aa, Mycobacterium
QSDPGLTVPWVLSARSERALTNQAR

SEQ ID NO: 716049 - protein, 19 aa, Mycobacterium
QSEAFLGAWNRHDVEEVVA

SEQ ID NO: 716050 - protein, 24 aa, Mycobacterium
QSEAIDWTFPLSVRDVVMTGRYGH

SEQ ID NO: 716051 - protein, 25 aa, Mycobacterium
QSEFDFRRLVGVISVMGDKDVAGIL

SEQ ID NO: 716052 - protein, 20 aa, Mycobacterium
QSEGDAFGRLILLHDPDGDE

SEQ ID NO: 716053 - protein, 22 aa, Mycobacterium
QSEGLRRFAALSGTSVGAEKLW

SEQ ID NO: 716054 - protein, 18 aa, Mycobacterium
QSEGQGFIQLMTQLPQER

SEQ ID NO: 716055 - protein, 24 aa, Mycobacterium
QSEKRPPPAPNWYGASSNNYGSPQ

SEQ ID NO: 716056 - protein, 21 aa, Mycobacterium
QSELFVHAGRIFRDLTELSSM

SEQ ID NO: 716057 - protein, 30 aa, Mycobacterium
QSEMLWEHWDRCALHWFPGNHILHVNQGDY

SEQ ID NO: 716058 - protein, 19 aa, Mycobacterium
QSEQEWSYVDFGPWPGNRS

SEQ ID NO: 716059 - protein, 18 aa, Mycobacterium
QSESACALGSVKTNIGHL

SEQ ID NO: 716060 - protein, 23 aa, Mycobacterium
QSEVMTAVLARLAAAAGDAGVAS

SEQ ID NO: 716061 - protein, 31 aa, Mycobacterium
QSEYLPRIVRGECFFGIGMSEPDSGSDLASV

SEQ ID NO: 716062 - protein, 18 aa, Mycobacterium
QSFLFATIGGFAATRSSG

SEQ ID NO: 716063 - protein, 17 aa, Mycobacterium
QSFQFATIGGFAATRSS

SEQ ID NO: 716064 - protein, 22 aa, Mycobacterium
QSFRIHGGYGYSTAYEIERLMR

SEQ ID NO: 716065 - protein, 19 aa, Mycobacterium
QSGACAALLAAMREHRIPT

SEQ ID NO: 716066 - protein, 29 aa, Mycobacterium
QSGAWCVAADFSVGMLKAGARRDVPKVAG

SEQ ID NO: 716067 - protein, 19 aa, Mycobacterium
QSGCGLGREATLWLCDQGV

SEQ ID NO: 716068 - protein, 18 aa, Mycobacterium
QSGETFVFVEQWEDPEAL

SEQ ID NO: 716069 - protein, 31 aa, Mycobacterium; identical to SEQ ID NO: 102677

SEQ ID NO: 716070 - protein, 25 aa, Mycobacterium
QSGKGKHVGFRWAADKQLRDTVCDF

SEQ ID NO: 716071 - protein, 25 aa, Mycobacterium
QSGKYRRVLAMAWEKQSESNAMWAL

SEQ ID NO: 716072 - protein, 31 aa, Mycobacterium
QSGLPGTGGTIGIAGVPGSLPSGSTGGAGGD

SEQ ID NO: 716073 - protein, 20 aa, Mycobacterium
QSGMLDRHRPLWETHVIEGL

SEQ ID NO: 716074 - protein, 22 aa, Mycobacterium
QSGMYELEFPAPQLSTSDGRGP

SEQ ID NO: 716075 - protein, 18 aa, Mycobacterium
QSGPPVVDGNGGAGGQGG

SEQ ID NO: 716076 - protein, 25 aa, Mycobacterium
QSGRFEFRAGPIFTNLLMADEINRT

SEQ ID NO: 716077 - protein, 25 aa, Mycobacterium
QSGRFEFRPGPIFTNLLLADEINRT

SEQ ID NO: 716078 - protein, 25 aa, Mycobacterium
QSGRFEFRPGPIFTNLLMADEINRT

SEQ ID NO: 716079 - protein, 23 aa, Mycobacterium
QSGVRRRLGIDLTDVEDQRADLA

SEQ ID NO: 716080 - protein, 23 aa, Mycobacterium
QSGYVDGAWWPRSDDLSAELPDL

SEQ ID NO: 716081 - protein, 24 aa, Mycobacterium
QSHATRIALLDAMKDKWRHDLAGD

SEQ ID NO: 716082 - protein, 25 aa, Mycobacterium
QSHAWIQGWAGGWWDYDPTNDSEIN

SEQ ID NO: 716083 - protein, 24 aa, Mycobacterium
QSHAWVQAWTGGWWDYDPTNDSEI

SEQ ID NO: 716084 - protein, 26 aa, Mycobacterium
QSHPAIRPGYCAAFTLEVDGEERLGV

SEQ ID NO: 716085 - protein, 17 aa, Mycobacterium
QSHSPAFVLGRRLDVLA

SEQ ID NO: 716086 - protein, 18 aa, Mycobacterium
QSHSRLGGQLRRFQHYHG

SEQ ID NO: 716087 - protein, 21 aa, Mycobacterium
QSIELRVCIVIKLDTEGLINR

SEQ ID NO: 716088 - protein, 17 aa, Mycobacterium
QSIHFAAAGVIAGHYDV

SEQ ID NO: 716089 - protein, 22 aa, Mycobacterium
QSIPRYFYALFAIDLTNKNYAK

SEQ ID NO: 716090 - protein, 17 aa, Mycobacterium
QSIQRWFLTVAADVRTM

SEQ ID NO: 716091 - protein, 17 aa, Mycobacterium
QSIRADDDWSVIMRHVA

SEQ ID NO: 716092 - protein, 22 aa, Mycobacterium
QSITLPSLRKISTRAVIDHHKE

SEQ ID NO: 716093 - protein, 19 aa, Mycobacterium
QSKEAIILYGMQRVTDLGA

SEQ ID NO: 716094 - protein, 20 aa, Mycobacterium
QSKIAFGLFGLELDRRSHAH

SEQ ID NO: 716095 - protein, 23 aa, Mycobacterium
QSLAARLRLAMKERDIALWLDSP

SEQ ID NO: 716096 - protein, 19 aa, Mycobacterium
QSLADAWLGVIARHGTLRT

SEQ ID NO: 716097 - protein, 17 aa, Mycobacterium
QSLCGDLRSVSELIERF

SEQ ID NO: 716098 - protein, 21 aa, Mycobacterium
QSLDASAAWAACGQLTRDDRY

SEQ ID NO: 716099 - protein, 22 aa, Mycobacterium
QSLDDLRLFAAIVDAARSYAAG

SEQ ID NO: 716100 - protein, 26 aa, Mycobacterium
QSLDFFFRKIVRDHGQALQFVTAQIT

SEQ ID NO: 716101 - protein, 17 aa, Mycobacterium
QSLDLTFAHGVAVAARL

SEQ ID NO: 716102 - protein, 17 aa, Mycobacterium
QSLEWVQRLNALRHSRS

SEQ ID NO: 716103 - protein, 20 aa, Mycobacterium
QSLGGGVAMQFVYQHPDYAK

SEQ ID NO: 716104 - protein, 25 aa, Mycobacterium
QSLGRERGGVCSTFLADRGSNARIF

SEQ ID NO: 716105 - protein, 19 aa, Mycobacterium
QSLHAYFVRGGRYDTDVEF

SEQ ID NO: 716106 - protein, 23 aa, Mycobacterium
QSLLHLQCHIGTDTVSWARLGAV

SEQ ID NO: 716107 - protein, 25 aa, Mycobacterium
QSLLVRSLVAWFWDEPLRAPLIRHG

SEQ ID NO: 716108 - protein, 23 aa, Mycobacterium
QSLLVRSLVAWFWEQPLRAPLIR

SEQ ID NO: 716109 - protein, 24 aa, Mycobacterium
QSLMVPTDLAGIFVGNPTPLPAAL

SEQ ID NO: 716110 - protein, 21 aa, Mycobacterium
QSLPGPDGWQVVGSAVRRPGG

SEQ ID NO: 716111 - protein, 18 aa, Mycobacterium
QSLPPASVGPVFGALTGG

SEQ ID NO: 716112 - protein, 21 aa, Mycobacterium
QSLQLHYARTLEIWAAALEAK

SEQ ID NO: 716113 - protein, 20 aa, Mycobacterium
QSLRSGECDLALAGGVTVMA

SEQ ID NO: 716114 - protein, 17 aa, Mycobacterium
QSLSFKPNYKAAYCLAV

SEQ ID NO: 716115 - protein, 25 aa, Mycobacterium
QSLVEIPIQWALDDWEQYCFLPDIS

SEQ ID NO: 716116 - protein, 29 aa, Mycobacterium
QSLVFRHGLQLFGAMGFTWENDLQFALKR

SEQ ID NO: 716117 - protein, 22 aa, Mycobacterium
QSLVPMLAMRLAYFDHLIDVSR

SEQ ID NO: 716118 - protein, 22 aa, Mycobacterium
QSLVPMLAMRLTHFDNLIDISR

SEQ ID NO: 716119 - protein, 21 aa, Mycobacterium
QSLVPMLAMRLTHFENLIDIS

SEQ ID NO: 716120 - protein, 26 aa, Mycobacterium
QSLVPMLSMRLAFFDHLIDISRLAEL

SEQ ID NO: 716121 - protein, 22 aa, Mycobacterium
QSLVPMLSMRLAYFDHLIDISR

SEQ ID NO: 716122 - protein, 21 aa, Mycobacterium
QSLWQTERFQAHNVIRRVIAE

SEQ ID NO: 716123 - protein, 18 aa, Mycobacterium
QSMLCEPVIRRIDVLASQ

SEQ ID NO: 716124 - protein, 18 aa, Mycobacterium
QSMLRNGRNLKYYFTELN

SEQ ID NO: 716125 - protein, 43 aa, Mycobacterium
QSMVSLGPMVRALREWRKELGDRSVVGQLRYQVGWRNVTPNTF

SEQ ID NO: 716126 - protein, 17 aa, Mycobacterium
QSNHAFGAEPGVPPMTD

SEQ ID NO: 716127 - protein, 18 aa, Mycobacterium
QSNIRWGFDQEHRKPYGV

SEQ ID NO: 716128 - protein, 23 aa, Mycobacterium
QSPCGLAELCERTGLPRATAYRL

SEQ ID NO: 716129 - protein, 26 aa, Mycobacterium
QSPEQLKRLVAQISEKPESVQHHNVD

SEQ ID NO: 716130 - protein, 25 aa, Mycobacterium
QSPEQLKRLVAQISEQPETVQHHSV

SEQ ID NO: 716131 - protein, 21 aa, Mycobacterium
QSPGTHVSTCFNWDHVTQPRF

SEQ ID NO: 716132 - protein, 24 aa, Mycobacterium
QSPKETWVRLLLIRAGLPRPQTQI

SEQ ID NO: 716133 - protein, 24 aa, Mycobacterium
QSPRETWLRLLLVDEWLDPLRTQV

SEQ ID NO: 716134 - protein, 24 aa, Mycobacterium
QSPSEWERWWLGVVKRAIAAEHLT

SEQ ID NO: 716135 - protein, 24 aa, Mycobacterium
QSPSVRCFLDVAVAESPRYLEDLS

SEQ ID NO: 716136 - protein, 20 aa, Mycobacterium
QSPTHFPVCITAELTDARLS

SEQ ID NO: 716137 - protein, 17 aa, Mycobacterium
QSQAAALNWDATAPATV

SEQ ID NO: 716138 - protein, 24 aa, Mycobacterium
QSQIRFDPLLGDWVTLASHRQTRT

SEQ ID NO: 716139 - protein, 22 aa, Mycobacterium
QSQKRSAVFDMLANPTDVTVDV

SEQ ID NO: 716140 - protein, 23 aa, Mycobacterium
QSRAAQFTARWDPSGTLITVDGE

SEQ ID NO: 716141 - protein, 22 aa, Mycobacterium
QSRAAVAIDEGRFVRSLVDVPT

SEQ ID NO: 716142 - protein, 17 aa, Mycobacterium
QSRAVAAPPDRETGEAA

SEQ ID NO: 716143 - protein, 26 aa, Mycobacterium
QSRAWKAIEATGRFCVNMLHENQQHV

SEQ ID NO: 716144 - protein, 19 aa, Mycobacterium
QSRCAEVAYSEPVIVSTES

SEQ ID NO: 716145 - protein, 18 aa, Mycobacterium
QSRCLRCQPQDGAGRTGA

SEQ ID NO: 716146 - protein, 24 aa, Mycobacterium
QSRGELLPIMFGERVVGAFEQMKA

SEQ ID NO: 716147 - protein, 23 aa, Mycobacterium
QSRGNCSTRWARLSVSAVSSTIR

SEQ ID NO: 716148 - protein, 18 aa, Mycobacterium
QSRLDIRLVDNVVHPVHD

SEQ ID NO: 716149 - protein, 17 aa, Mycobacterium
QSRRAARAAAYGVLERV

SEQ ID NO: 716150 - protein, 20 aa, Mycobacterium
QSRRLARHWYDSGLRKGDHV

SEQ ID NO: 716151 - protein, 20 aa, Mycobacterium
QSRSDWVITNSFIYANDPPS

SEQ ID NO: 716152 - protein, 23 aa, Mycobacterium
QSRTAQFTARWGPTGTLITVDGE

SEQ ID NO: 716153 - protein, 23 aa, Mycobacterium
QSRTGLSIAKVIKLLRPLRSATI

SEQ ID NO: 716154 - protein, 17 aa, Mycobacterium
QSRVVPEALALDLPPDV

SEQ ID NO: 716155 - protein, 25 aa, Mycobacterium
QSSGLSALVRRGPGWIGGADPRREG

SEQ ID NO: 716156 - protein, 22 aa, Mycobacterium
QSSIKKAASLLLQAHAELQAGL

SEQ ID NO: 716157 - protein, 26 aa, Mycobacterium
QSSSRADTHLVMFDFSMAGVSPDNVE

SEQ ID NO: 716158 - protein, 21 aa, Mycobacterium
QSTAALRAWHDAVRLGDIRAV

SEQ ID NO: 716159 - protein, 24 aa, Mycobacterium
QSTCAVPGCGATRGLHAHHIRHWE

SEQ ID NO: 716160 - protein, 18 aa, Mycobacterium
QSTGIAHRLIRIDEPILR

SEQ ID NO: 716161 - protein, 20 aa, Mycobacterium
QSTPARRGQQEWRGMEQRGF

SEQ ID NO: 716162 - protein, 18 aa, Mycobacterium
QSTSVFMQTLETWRDRLI

SEQ ID NO: 716163 - protein, 23 aa, Mycobacterium
QSTVPFTLVRLVVGVSAKVDDRA

SEQ ID NO: 716164 - protein, 21 aa, Mycobacterium
QSVAPTTVWLREHEPEVYART

SEQ ID NO: 716165 - protein, 24 aa, Mycobacterium
QSVFGGKLLSSWDESIFRPLAAKY

SEQ ID NO: 716166 - protein, 17 aa, Mycobacterium
QSVLAHPVVREMGNGGL

SEQ ID NO: 716167 - protein, 18 aa, Mycobacterium
QSVLDRWAADDFAMQPNH

SEQ ID NO: 716168 - protein, 22 aa, Mycobacterium
QSVRIGAALAHLFRENPHLPLL

SEQ ID NO: 716169 - protein, 23 aa, Mycobacterium
QSVSGWPVSAVLWAATPPTHVES

SEQ ID NO: 716170 - protein, 17 aa, Mycobacterium
QSWAVPLASHLGAFEAG

SEQ ID NO: 716171 - protein, 25 aa, Mycobacterium
QSWDIFRCVRQVLDVLDPVPDPLPA

SEQ ID NO: 716172 - protein, 26 aa, Mycobacterium
QSWDIYRCIRQVLAVLDPIPDPLPKS

SEQ ID NO: 716173 - protein, 17 aa, Mycobacterium
QSWGLPHTAMWTAAKVI

SEQ ID NO: 716174 - protein, 24 aa, Mycobacterium
QSWPFPIVPIVLIVAHPRNLPPLP

SEQ ID NO: 716175 - protein, 20 aa, Mycobacterium
QSWPTVADWVNWLSRDADKP

SEQ ID NO: 716176 - protein, 24 aa, Mycobacterium
QSWPTVAEWVRWLSAGGDKPTSIA

SEQ ID NO: 716177 - protein, 20 aa, Mycobacterium
QSYAGAGGFGGFGGTGGQGG

SEQ ID NO: 716178 - protein, 23 aa, Mycobacterium
QSYAPRRQKHCLLNADGWGVGFF

SEQ ID NO: 716179 - protein, 21 aa, Mycobacterium
QSYEIPRDFIVETVPFTVESG

SEQ ID NO: 716180 - protein, 21 aa, Mycobacterium
QSYEPAFAIEVEWMLLHALSR

SEQ ID NO: 716181 - protein, 20 aa, Mycobacterium
QSYEVPADFIVETEPFSAAN

SEQ ID NO: 716182 - protein, 22 aa, Mycobacterium
QSYEVPRDFLLETEPFTAANGL

SEQ ID NO: 716183 - protein, 25 aa, Mycobacterium
QSYGSRCVRPPILYGDVARPEPMTV

SEQ ID NO: 716184 - protein, 25 aa, Mycobacterium
QSYGSRCVRPPILYGDVARRKPMTV

SEQ ID NO: 716185 - protein, 25 aa, Mycobacterium
QSYGSRCVRPPILYGDVARSHPMTV

SEQ ID NO: 716186 - protein, 26 aa, Mycobacterium
QSYGSRCVRPPILYGDVIRQHPMTVE

SEQ ID NO: 716187 - protein, 25 aa, Mycobacterium
QSYGSRCVRPPILYGDVVRTHPMTV

SEQ ID NO: 716188 - protein, 27 aa, Mycobacterium
QTACQIARSVGYFGAGTVEFILDSDAP

SEQ ID NO: 716189 - protein, 17 aa, Mycobacterium
QTADGLPVFGAFWDRDA

SEQ ID NO: 716190 - protein, 31 aa, Mycobacterium
QTAEALRYDIRWKVACGRALTQTSFDPSTLV

SEQ ID NO: 716191 - protein, 21 aa, Mycobacterium
QTAFVELRQLLAVHETAEEMV

SEQ ID NO: 716192 - protein, 23 aa, Mycobacterium
QTAGRGRHGRSWGAPAHTQLSMS

SEQ ID NO: 716193 - protein, 18 aa, Mycobacterium
QTALDLINQPVLTLTGRP

SEQ ID NO: 716194 - protein, 20 aa, Mycobacterium
QTALECIDDQFAIVDDHFVT

SEQ ID NO: 716195 - protein, 20 aa, Mycobacterium
QTALERFGGLDIMVNNAGIT

SEQ ID NO: 716196 - protein, 19 aa, Mycobacterium
QTAPVHWGGIPAERSHLLA

SEQ ID NO: 716197 - protein, 22 aa, Mycobacterium
QTARLWGAAAISAALVTATVSG

SEQ ID NO: 716198 - protein, 18 aa, Mycobacterium
QTATKHLFVTGGVVSSLG

SEQ ID NO: 716199 - protein, 21 aa, Mycobacterium
QTATPEWLAAINRPVVLLNTS

SEQ ID NO: 716200 - protein, 28 aa, Mycobacterium
QTAVARARRAVAEFRIRGVATNIPFLQA

SEQ ID NO: 716201 - protein, 23 aa, Mycobacterium
QTCAVPGCGATRGLHAHHLRHWE

SEQ ID NO: 716202 - protein, 20 aa, Mycobacterium
QTCRTEVFLFPAASHVEKSG

SEQ ID NO: 716203 - protein, 26 aa, Mycobacterium
QTDHRPEILLSFGFVPKMESRVGLIN

SEQ ID NO: 716204 - protein, 21 aa, Mycobacterium
QTDKPWGVGFLSWAADVNTVK

SEQ ID NO: 716205 - protein, 18 aa, Mycobacterium
QTDPGGTVTARFLISACG

SEQ ID NO: 716206 - protein, 23 aa, Mycobacterium
QTDPGGVVTARFVINASGVLTVP

SEQ ID NO: 716207 - protein, 23 aa, Mycobacterium
QTDPWALRLAKRAVNQTMDTMGF

SEQ ID NO: 716208 - protein, 19 aa, Mycobacterium
QTDQAVWDFVEPLVRNDIR

SEQ ID NO: 716209 - protein, 23 aa, Mycobacterium
QTDRFLLKEIVRYPSPEQEVDMM

SEQ ID NO: 716210 - protein, 25 aa, Mycobacterium
QTDYIDLYWLHIWDANTPIEETMAA

SEQ ID NO: 716211 - protein, 25 aa, Mycobacterium
QTEGCVREVLVLAAALTIPDPRERP

SEQ ID NO: 716212 - protein, 18 aa, Mycobacterium
QTELDYWRDALAGLPDEI

SEQ ID NO: 716213 - protein, 17 aa, Mycobacterium
QTEMVLGGYSQGAAVAG

SEQ ID NO: 716214 - protein, 25 aa, Mycobacterium
QTEPELRSSAILGVCKNVLRAQELI

SEQ ID NO: 716215 - protein, 24 aa, Mycobacterium
QTERPDYLPLFVAPQPVSFEPAVV

SEQ ID NO: 716216 - protein, 25 aa, Mycobacterium
QTESYRGAVGLNWYLTDPTLRSTVA

SEQ ID NO: 716217 - protein, 17 aa, Mycobacterium
QTFATLVGLELRPRKLR

SEQ ID NO: 716218 - protein, 18 aa, Mycobacterium
QTFATLVGLELRPRKLRE

SEQ ID NO: 716219 - protein, 22 aa, Mycobacterium
QTFERLTALVLPAAGEPTIVVP

SEQ ID NO: 716220 - protein, 17 aa, Mycobacterium
QTFFPWDSWDHPNPDPA

SEQ ID NO: 716221 - protein, 31 aa, Mycobacterium
QTFIRIGEELARGCASTSWVTSIYNGGIYMS

SEQ ID NO: 716222 - protein, 26 aa, Mycobacterium
QTFLAGARTLLGWGQLGYGLDLSDIQ

SEQ ID NO: 716223 - protein, 19 aa, Mycobacterium
QTFRSERYPEYKANRSATP

SEQ ID NO: 716224 - protein, 19 aa, Mycobacterium
QTFRSERYPEYKANRSSTP

SEQ ID NO: 716225 - protein, 25 aa, Mycobacterium
QTGADWRRMIAINMMSPLVGSRLFV

SEQ ID NO: 716226 - protein, 31 aa, Mycobacterium; identical to SEQ ID NO: 204874

SEQ ID NO: 716227 - protein, 19 aa, Mycobacterium
QTGGGLWLEAMAARQFRTS

SEQ ID NO: 716228 - protein, 18 aa, Mycobacterium
QTGKAALYRRWASKHDLV

SEQ ID NO: 716229 - protein, 24 aa, Mycobacterium
QTGKPLRLAEEFDVPGSVDNIRFF

SEQ ID NO: 716230 - protein, 24 aa, Mycobacterium
QTGKRKWILGKLHKDRKFDGAMAG

SEQ ID NO: 716231 - protein, 17 aa, Mycobacterium
QTGLCRTGDWYAFEHDG

SEQ ID NO: 716232 - protein, 19 aa, Mycobacterium
QTGMGRTGAFYAHQHDGIT

SEQ ID NO: 716233 - protein, 19 aa, Mycobacterium
QTGMGRTGTFFAHQHDGIT

SEQ ID NO: 716234 - protein, 19 aa, Mycobacterium
QTGQCWRKVARPLAERYTV

SEQ ID NO: 716235 - protein, 24 aa, Mycobacterium
QTGRIGYATSYAFETARTGENGEE

SEQ ID NO: 716236 - protein, 17 aa, Mycobacterium
QTGRLPEAGPWLRRAEA

SEQ ID NO: 716237 - protein, 17 aa, Mycobacterium
QTGRVAIVTGANTGLGL

SEQ ID NO: 716238 - protein, 17 aa, Mycobacterium
QTGSCLWERGVNGDGID

SEQ ID NO: 716239 - protein, 24 aa, Mycobacterium
QTGTRIGFENVWAANGSNEILQQL

SEQ ID NO: 716240 - protein, 24 aa, Mycobacterium
QTGVGRTGAFFAHRHDGITPDVVT

SEQ ID NO: 716241 - protein, 21 aa, Mycobacterium
QTHKLPMPFIVLATDNPIEYE

SEQ ID NO: 716242 - protein, 25 aa, Mycobacterium
QTHKRMELVFARAVERGEITQGRDL

SEQ ID NO: 716243 - protein, 18 aa, Mycobacterium
QTHTGWVIVRDALVMGPW

SEQ ID NO: 716244 - protein, 19 aa, Mycobacterium
QTIARACGKAHVCHLEPED

SEQ ID NO: 716245 - protein, 19 aa, Mycobacterium
QTIARACGKSHVCHLEPDD

SEQ ID NO: 716246 - protein, 17 aa, Mycobacterium
QTIAWGNAVVGLRNPIA

SEQ ID NO: 716247 - protein, 24 aa, Mycobacterium
QTIDWPFRAVEALEAGALTFRELR

SEQ ID NO: 716248 - protein, 25 aa, Mycobacterium
QTIEIPRLIGNLNVTKIIQIDPDTG

SEQ ID NO: 716249 - protein, 26 aa, Mycobacterium
QTIGFALMRYVWRIEPVASMREDEVL

SEQ ID NO: 716250 - protein, 23 aa, Mycobacterium
QTIIDMWLPLSWSLNMVNRSMGH

SEQ ID NO: 716251 - protein, 19 aa, Mycobacterium
QTIRAGEKVGLFYCSANRD

SEQ ID NO: 716252 - protein, 22 aa, Mycobacterium
QTIRAGEKVVMFYASGNRDEDA

SEQ ID NO: 716253 - protein, 17 aa, Mycobacterium
QTIVFRTDLIVDLEVLR

SEQ ID NO: 716254 - protein, 17 aa, Mycobacterium
QTIWGGEILRLGSDSHR

SEQ ID NO: 716255 - protein, 26 aa, Mycobacterium
QTIYRLSGSRKIRWLIKATLPYAPRK

SEQ ID NO: 716256 - protein, 19 aa, Mycobacterium
QTKEGLCVRAEELSGSTDW

SEQ ID NO: 716257 - protein, 23 aa, Mycobacterium
QTKEILRNYAIRRPGVPEDITEL

SEQ ID NO: 716258 - protein, 26 aa, Mycobacterium
QTKQFWPDVVGFKYKMSNIQAAIGCA

SEQ ID NO: 716259 - protein, 17 aa, Mycobacterium
QTLAEYGADVLHVSSPR

SEQ ID NO: 716260 - protein, 26 aa, Mycobacterium
QTLAGEFDFRYLVGVLSVLADKDVDG

SEQ ID NO: 716261 - protein, 25 aa, Mycobacterium
QTLAKRGGAELHYLRKVIEAGMLKL

SEQ ID NO: 716262 - protein, 22 aa, Mycobacterium
QTLDLRGAVLTRELTFRDDAGR

SEQ ID NO: 716263 - protein, 22 aa, Mycobacterium
QTLDLRGAVLTRELTYRDDAGR

SEQ ID NO: 716264 - protein, 19 aa, Mycobacterium
QTLDPAWQMFADDVVGSLE

SEQ ID NO: 716265 - protein, 26 aa, Mycobacterium
QTLEACWGDVALMLTVPYQGLGNAAI

SEQ ID NO: 716266 - protein, 25 aa, Mycobacterium
QTLEACWGDVAMMLSVPYQGLGNAA

SEQ ID NO: 716267 - protein, 19 aa, Mycobacterium
QTLEDAGGWPARDTAQRFA

SEQ ID NO: 716268 - protein, 19 aa, Mycobacterium
QTLEIHGAHGYLIHQFLSP

SEQ ID NO: 716269 - protein, 18 aa, Mycobacterium
QTLEPDWKIDQDGWVIQV

SEQ ID NO: 716270 - protein, 20 aa, Mycobacterium
QTLESNVLGALNTPTQAIFG

SEQ ID NO: 716271 - protein, 18 aa, Mycobacterium
QTLGMTFVNLIWRNLASI

SEQ ID NO: 716272 - protein, 19 aa, Mycobacterium
QTLGPRFTFVAADVTDEAA

SEQ ID NO: 716273 - protein, 19 aa, Mycobacterium
QTLHAGRLVARRLRASGVD

SEQ ID NO: 716274 - protein, 24 aa, Mycobacterium
QTLLERLGNLSARTALLGHGLLAW

SEQ ID NO: 716275 - protein, 23 aa, Mycobacterium
QTLLGQLCTFVMVAKEADASHPA

SEQ ID NO: 716276 - protein, 20 aa, Mycobacterium
QTLLGRPLIGDGAAGTAANP

SEQ ID NO: 716277 - protein, 21 aa, Mycobacterium
QTLLGRPLIGDGAAGTATNPN

SEQ ID NO: 716278 - protein, 23 aa, Mycobacterium
QTLLGRPLIGNGADGAAGTGADG

SEQ ID NO: 716279 - protein, 23 aa, Mycobacterium
QTLLGRPLIGNGADGAPGQAGGD

SEQ ID NO: 716280 - protein, 23 aa, Mycobacterium
QTLLGRPLIGNGADGAPGQNGAA

SEQ ID NO: 716281 - protein, 17 aa, Mycobacterium
QTLPVVRYDNINGADVN

SEQ ID NO: 716282 - protein, 17 aa, Mycobacterium
QTLREIQEGNSIALINE

SEQ ID NO: 716283 - protein, 22 aa, Mycobacterium
QTLRLWRERFLQRQGELAQLGF

SEQ ID NO: 716284 - protein, 19 aa, Mycobacterium
QTLRVGWMALPQALVEPVI

SEQ ID NO: 716285 - protein, 22 aa, Mycobacterium
QTLSARAAAFHDEFVSVLKGSG

SEQ ID NO: 716286 - protein, 24 aa, Mycobacterium
QTLTDCPLRWLAERHGGTNPRDLR

SEQ ID NO: 716287 - protein, 24 aa, Mycobacterium
QTLTGRPLFGNGADATTPGANGGN

SEQ ID NO: 716288 - protein, 22 aa, Mycobacterium
QTLTGRPLIGNGANGAPGTGAN

SEQ ID NO: 716289 - protein, 21 aa, Mycobacterium
QTLTGRPLIGNGTPAAAGSGA

SEQ ID NO: 716290 - protein, 17 aa, Mycobacterium
QTLTLGYAGVYSSFLRH

SEQ ID NO: 716291 - protein, 17 aa, Mycobacterium
QTLWQAWNRSGLQKRWL

SEQ ID NO: 716292 - protein, 25 aa, Mycobacterium
QTMDSRGRFAMGMARPPERFTDGLV

SEQ ID NO: 716293 - protein, 17 aa, Mycobacterium
QTMIMPKGTTSRYMAFA

SEQ ID NO: 716294 - protein, 25 aa, Mycobacterium
QTMRDMADRVAVMKRVWAGEKLTES

SEQ ID NO: 716295 - protein, 25 aa, Mycobacterium
QTMVIPGLLTWRGLARVMSESPARI

SEQ ID NO: 716296 - protein, 23 aa, Mycobacterium
QTNVEFLRFLLADERVQSGDLDT

SEQ ID NO: 716297 - protein, 24 aa, Mycobacterium
QTNVEFLRFLLADERVRAGDLDTA

SEQ ID NO: 716298 - protein, 21 aa, Mycobacterium
QTNYQKIRWTVGAIPDVPSNG

SEQ ID NO: 716299 - protein, 25 aa, Mycobacterium
QTPAWRPGTRHGYHAITLGWYESEL

SEQ ID NO: 716300 - protein, 17 aa, Mycobacterium
QTPEAFAAQFIMRRTPR

SEQ ID NO: 716301 - protein, 18 aa, Mycobacterium
QTPGLRCQLDAAPLTNRL

SEQ ID NO: 716302 - protein, 26 aa, Mycobacterium
QTPGYGGGIGRAWLSRGGTFVQANIR

SEQ ID NO: 716303 - protein, 18 aa, Mycobacterium
QTPLAGAVFKGSDDIVQI

SEQ ID NO: 716304 - protein, 26 aa, Mycobacterium
QTPLGQALRIAWWSYVHRVDTDMEAA

SEQ ID NO: 716305 - protein, 27 aa, Mycobacterium
QTPLQWPCPPDSSGRNPIRYRNDGVSQ

SEQ ID NO: 716306 - protein, 18 aa, Mycobacterium
QTPLRVIALRAHTADEGH

SEQ ID NO: 716307 - protein, 19 aa, Mycobacterium
QTPNVCPALHMPLQSGSDR

SEQ ID NO: 716308 - protein, 22 aa, Mycobacterium
QTPNVCPQLHMPLQSGSDRILK

SEQ ID NO: 716309 - protein, 24 aa, Mycobacterium
QTPRCRLRRMAVDLADPQARDAFF

SEQ ID NO: 716310 - protein, 26 aa, Mycobacterium
QTPTLLFPFAAPRVAGDLSEAGSRSE

SEQ ID NO: 716311 - protein, 26 aa, Mycobacterium
QTPTLLFPFAAPRVAGDMSEVGSRAE

SEQ ID NO: 716312 - protein, 25 aa, Mycobacterium
QTPTLLFPFAAPRVVGDLSEAGSRA

SEQ ID NO: 716313 - protein, 18 aa, Mycobacterium
QTPVPLGYRDHALDAPWS

SEQ ID NO: 716314 - protein, 17 aa, Mycobacterium
QTQIAVRKEWGWAKPMW

SEQ ID NO: 716315 - protein, 27 aa, Mycobacterium
QTQIEVLNEWGAVLARIDMGWEEWKAG

SEQ ID NO: 716316 - protein, 27 aa, Mycobacterium
QTQLKMSFKAGALIGRGSGEAMQVAFH

SEQ ID NO: 716317 - protein, 25 aa, Mycobacterium
QTRAGWARRSQFVFSQHCKSCRMVG

SEQ ID NO: 716318 - protein, 19 aa, Mycobacterium
QTRELEWEAKLSGSTPDGV

SEQ ID NO: 716319 - protein, 25 aa, Mycobacterium
QTREYLRTRIESIAPQPLFDTVEAY

SEQ ID NO: 716320 - protein, 17 aa, Mycobacterium
QTRHPLILAQQALTTNA

SEQ ID NO: 716321 - protein, 24 aa, Mycobacterium
QTRILKVRAGDMTFHATADSWSYR

SEQ ID NO: 716322 - protein, 18 aa, Mycobacterium
QTRIRRIHDLLVRADVGE

SEQ ID NO: 716323 - protein, 24 aa, Mycobacterium
QTRLLLRKSMHLLRDKQLWWRVGR

SEQ ID NO: 716324 - protein, 21 aa, Mycobacterium
QTRLLMSFELMRVVEELSCGV

SEQ ID NO: 716325 - protein, 19 aa, Mycobacterium
QTRLLPGLIDGTVTAGIGL

SEQ ID NO: 716326 - protein, 22 aa, Mycobacterium
QTRLLVLHAAWLLDTVGIMGAL

SEQ ID NO: 716327 - protein, 25 aa, Mycobacterium
QTRLRNAGLLRWFGDDNLGRDAAEV

SEQ ID NO: 716328 - protein, 17 aa, Mycobacterium
QTRLRRRRQSALASQPS

SEQ ID NO: 716329 - protein, 19 aa, Mycobacterium
QTRSFCYVDDMTRGILDFA

SEQ ID NO: 716330 - protein, 26 aa, Mycobacterium
QTRTALRRTVCSAGGEAAWQAMIERP

SEQ ID NO: 716331 - protein, 21 aa, Mycobacterium
QTRVVAPWVMAEVLATDDRQS

SEQ ID NO: 716332 - protein, 28 aa, Mycobacterium
QTSALLPGGLNWPLDLTVSDGRLYVADG

SEQ ID NO: 716333 - protein, 18 aa, Mycobacterium
QTSPEAWLETANGLNQKS

SEQ ID NO: 716334 - protein, 18 aa, Mycobacterium
QTSRAVLILGAVLGAAED

SEQ ID NO: 716335 - protein, 23 aa, Mycobacterium
QTSRLGAPIGGFLADVSAFDAEF

SEQ ID NO: 716336 - protein, 28 aa, Mycobacterium
QTSTRYPGGMALRFARVVRYRDDKAATD

SEQ ID NO: 716337 - protein, 19 aa, Mycobacterium
QTTARRDGPDWVLDGEKIV

SEQ ID NO: 716338 - protein, 19 aa, Mycobacterium
QTTAVGWDAFHRAEVLLTQ

SEQ ID NO: 716339 - protein, 22 aa, Mycobacterium
QTTFSWPPQIYLPGYKPVTKPH

SEQ ID NO: 716340 - protein, 27 aa, Mycobacterium
QTTGRLGLLPLRWALACLLIDIESVTF

SEQ ID NO: 716341 - protein, 22 aa, Mycobacterium
QTTRTALRLGPGEYVVEIQRVR

SEQ ID NO: 716342 - protein, 25 aa, Mycobacterium
QTVAALLRLQARRTANAEGREALIE

SEQ ID NO: 716343 - protein, 24 aa, Mycobacterium
QTVAPAPQPPLGGGGSGSGGGSGS

SEQ ID NO: 716344 - protein, 19 aa, Mycobacterium
QTVDGAVFGRVMEVSQLIG

SEQ ID NO: 716345 - protein, 17 aa, Mycobacterium
QTVEFSGVGGITLVADE

SEQ ID NO: 716346 - protein, 31 aa, Mycobacterium; identical to SEQ ID NO: 204889

SEQ ID NO: 716347 - protein, 17 aa, Mycobacterium
QTVGCRLMFTCTPQHTF

SEQ ID NO: 716348 - protein, 20 aa, Mycobacterium
QTVGPFFGYALPFDRCNELV

SEQ ID NO: 716349 - protein, 25 aa, Mycobacterium
QTVHAWLRRYAREGAVLNLEDRSSR

SEQ ID NO: 716350 - protein, 23 aa, Mycobacterium
QTVKTSPLYRAWADASGDDLHAM

SEQ ID NO: 716351 - protein, 26 aa, Mycobacterium
QTVTDAWKQAHVELPPPGTPVTAPAD

SEQ ID NO: 716352 - protein, 23 aa, Mycobacterium
QTVVSLRNAHLITFTVVDADDSS

SEQ ID NO: 716353 - protein, 18 aa, Mycobacterium
QTVWGGWVVGPTILGPEE

SEQ ID NO: 716354 - protein, 23 aa, Mycobacterium
QTVWPPRLFSILAGFVEAGESFE

SEQ ID NO: 716355 - protein, 22 aa, Mycobacterium
QTWERRWPDLGLSVGAPADGTV

SEQ ID NO: 716356 - protein, 32 aa, Mycobacterium
QTWTQCHSLAFDYSVWEIWGPLLNGGRLLMVP

SEQ ID NO: 716357 - protein, 22 aa, Mycobacterium
QTWTWRAHLAAAARHAAALIGI

SEQ ID NO: 716358 - protein, 26 aa, Mycobacterium
QTYADFPGLRGRIYRTLVIGTRGHVL

SEQ ID NO: 716359 - protein, 23 aa, Mycobacterium
QTYGDIAYGWAMEDTEGLCKLIA

SEQ ID NO: 716360 - protein, 19 aa, Mycobacterium
QTYRLLPRDGRMEVQTIFT

SEQ ID NO: 716361 - protein, 23 aa, Mycobacterium
QVAAFHQQFLEGLRGASGAYAAA

SEQ ID NO: 716362 - protein, 17 aa, Mycobacterium
QVAALLMAIYLRGMNGA

SEQ ID NO: 716363 - protein, 19 aa, Mycobacterium
QVAAPVFAIVPIFQSLVGT

SEQ ID NO: 716364 - protein, 29 aa, Mycobacterium
QVADAARPTPPWPTPKYRWPDSPPSTPIS

SEQ ID NO: 716365 - protein, 23 aa, Mycobacterium
QVADHILAPWPRELNTPRWLLPH

SEQ ID NO: 716366 - protein, 30 aa, Mycobacterium
QVADLSAGIPVRLVCAGSAGSACAARAAVD

SEQ ID NO: 716367 - protein, 17 aa, Mycobacterium
QVAEWLTTRVTLGRTAY

SEQ ID NO: 716368 - protein, 24 aa, Mycobacterium
QVAHVPIAHGWCGVLAVPRDWEAS

SEQ ID NO: 716369 - protein, 17 aa, Mycobacterium
QVALCLFSRNTVSATSR

SEQ ID NO: 716370 - protein, 18 aa, Mycobacterium
QVALEIMPAWGGAERLVE

SEQ ID NO: 716371 - protein, 18 aa, Mycobacterium
QVALEIMPAWGGAERLVT

SEQ ID NO: 716372 - protein, 18 aa, Mycobacterium
QVALLRRRLTAAGLGGIR

SEQ ID NO: 716373 - protein, 18 aa, Mycobacterium
QVALPFPFHTGAELVRLA

SEQ ID NO: 716374 - protein, 18 aa, Mycobacterium
QVALPYLVFAQYLALFSS

SEQ ID NO: 716375 - protein, 23 aa, Mycobacterium
QVANRIRSAGAIFVGPYSPVSLG

SEQ ID NO: 716376 - protein, 17 aa, Mycobacterium
QVAPCVRAAVPAWPTGP

SEQ ID NO: 716377 - protein, 30 aa, Mycobacterium
QVAPWNYPMMMAIWKICPAVAAGNTVVIKP

SEQ ID NO: 716378 - protein, 27 aa, Mycobacterium
QVARIDTWDGFYCFAAELTSPMLEVPF

SEQ ID NO: 716379 - protein, 17 aa, Mycobacterium
QVARLGLMNAVNRFDPD

SEQ ID NO: 716380 - protein, 23 aa, Mycobacterium
QVARLKSSVAMAIRRQERGLAVA

SEQ ID NO: 716381 - protein, 27 aa, Mycobacterium
QVARLPEALARFPISRVVSSPQRRAIQ

SEQ ID NO: 716382 - protein, 23 aa, Mycobacterium
QVARLRPRPRISLTTNGIGLHRR

SEQ ID NO: 716383 - protein, 17 aa, Mycobacterium
QVARMDLVFSLAERWTE

SEQ ID NO: 716384 - protein, 26 aa, Mycobacterium
QVARRLARRPAWIRAIDHRMDTHYPG

SEQ ID NO: 716385 - protein, 17 aa, Mycobacterium
QVATALRAQPYRGTLDG

SEQ ID NO: 716386 - protein, 24 aa, Mycobacterium
QVATDLFPITAIPAQIQQNLVNIG

SEQ ID NO: 716387 - protein, 17 aa, Mycobacterium
QVATLFRLWLRDAVRRV

SEQ ID NO: 716388 - protein, 18 aa, Mycobacterium
QVCDIRFEEMLLLDDQTP

SEQ ID NO: 716389 - protein, 20 aa, Mycobacterium
QVCELIRQGARIVLNAPPEW

SEQ ID NO: 716390 - protein, 18 aa, Mycobacterium
QVCELTWQLKGQATGRQV

SEQ ID NO: 716391 - protein, 18 aa, Mycobacterium
QVCELTWQLRGRATGRQV

SEQ ID NO: 716392 - protein, 18 aa, Mycobacterium
QVCTLILPADASWSDGAE

SEQ ID NO: 716393 - protein, 25 aa, Mycobacterium
QVDEPNPFAMLFAHLYGFNAETVYL

SEQ ID NO: 716394 - protein, 19 aa, Mycobacterium
QVDGARWLSLEGRSKVNSD

SEQ ID NO: 716395 - protein, 23 aa, Mycobacterium
QVDGARWLSLEGSATVVTDKDAV

SEQ ID NO: 716396 - protein, 23 aa, Mycobacterium
QVDGVACEEFATSLRQEGMLALA

SEQ ID NO: 716397 - protein, 18 aa, Mycobacterium
QVDGVFKAVREELGPVSI

SEQ ID NO: 716398 - protein, 18 aa, Mycobacterium
QVDKIAVEGVDELGDTGP

SEQ ID NO: 716399 - protein, 18 aa, Mycobacterium
QVDLTWRSINAGFTVVEV

SEQ ID NO: 716400 - protein, 26 aa, Mycobacterium
QVDQFVCAAGLLAHYVGDASQPLHGS

SEQ ID NO: 716401 - protein, 24 aa, Mycobacterium
QVDQKFLFHRPIKDGDRLRGVMTI

SEQ ID NO: 716402 - protein, 18 aa, Mycobacterium
QVDVLIHLVLGYLAAPAT

SEQ ID NO: 716403 - protein, 27 aa, Mycobacterium
QVDWMLGNGGLDWAVKRTADSSGRLYS

SEQ ID NO: 716404 - protein, 23 aa, Mycobacterium
QVDWVPGAALGFGYRTSVLKQAD

SEQ ID NO: 716405 - protein, 24 aa, Mycobacterium
QVDYAGKCPVAASAPSAVAGGVSS

SEQ ID NO: 716406 - protein, 27 aa, Mycobacterium
QVEEMKTLFAALRKGYKATDANNANSF

SEQ ID NO: 716407 - protein, 19 aa, Mycobacterium
QVEGARRFGTLNFGGSTAT

SEQ ID NO: 716408 - protein, 25 aa, Mycobacterium
QVEGGWRLTGTKVWTSGAHRAHAFI

SEQ ID NO: 716409 - protein, 18 aa, Mycobacterium
QVELEIMPAWGGAERLAA

SEQ ID NO: 716410 - protein, 22 aa, Mycobacterium
QVELLDLFAMLNREHGRTVVAV

SEQ ID NO: 716411 - protein, 17 aa, Mycobacterium
QVERRLGPIDVLINNAG

SEQ ID NO: 716412 - protein, 27 aa, Mycobacterium
QVERYFAWHYLAEIWARQCEAAARSKG

SEQ ID NO: 716413 - protein, 18 aa, Mycobacterium
QVFAETTLDVAFSIVVRP

SEQ ID NO: 716414 - protein, 31 aa, Mycobacterium
QVFEPWGTNGWRFRHELLREVAAELAPPSVR

SEQ ID NO: 716415 - protein, 18 aa, Mycobacterium
QVFKRAQTDWEFRQLCLS

SEQ ID NO: 716416 - protein, 24 aa, Mycobacterium
QVFQRLQIWYLRTIGHKKAATIEG

SEQ ID NO: 716417 - protein, 24 aa, Mycobacterium
QVGAENFFLFGLTVQEVQRVLGQG

SEQ ID NO: 716418 - protein, 17 aa, Mycobacterium
QVGASLIHLSTDYVFSG

SEQ ID NO: 716419 - protein, 17 aa, Mycobacterium
QVGAVMTTRAWSRAVQE

SEQ ID NO: 716420 - protein, 23 aa, Mycobacterium
QVGDARAGRLLAFEIDPTDSTSD

SEQ ID NO: 716421 - protein, 37 aa, Mycobacterium
QVGDRVGIAWLRHTCGVCKYCLRGDENLCPKSRYTGW

SEQ ID NO: 716422 - protein, 26 aa, Mycobacterium
QVGEGRKSLTFALRFRAPDRTLTEDD

SEQ ID NO: 716423 - protein, 17 aa, Mycobacterium
QVGEHGYALVYKDLGDD

SEQ ID NO: 716424 - protein, 22 aa, Mycobacterium
QVGFHWATPHGRPTTLRHLVAA

SEQ ID NO: 716425 - protein, 33 aa, Mycobacterium
QVGGDFYDLFGLGDDRWAFFIGDVLGHGVDAAV

SEQ ID NO: 716426 - protein, 20 aa, Mycobacterium
QVGLRHCPFLELAENRSSVV

SEQ ID NO: 716427 - protein, 20 aa, Mycobacterium
QVGLRHCPFLELAENRTAVV

SEQ ID NO: 716428 - protein, 18 aa, Mycobacterium
QVGLWTFRVEGWGDPIHT

SEQ ID NO: 716429 - protein, 18 aa, Mycobacterium
QVGMPRAVVITKLDHARA

SEQ ID NO: 716430 - protein, 18 aa, Mycobacterium
QVGMPRAVVITKLDHTRA

SEQ ID NO: 716431 - protein, 20 aa, Mycobacterium
QVGNFPGLWTEWNGKFRDTV

SEQ ID NO: 716432 - protein, 19 aa, Mycobacterium
QVGNFPGLWTEWNGKYRDT

SEQ ID NO: 716433 - protein, 24 aa, Mycobacterium
QVGNLRPGATVTIVGMTKNSTGGS

SEQ ID NO: 716434 - protein, 22 aa, Mycobacterium
QVGNVDAVFLFDVLLHQVSPDW

SEQ ID NO: 716435 - protein, 27 aa, Mycobacterium
QVGRIAARVPQEWLLPYVHQRYDDAAL

SEQ ID NO: 716436 - protein, 28 aa, Mycobacterium
QVGRIATRVPQEWLLPYVHQRYDEPHDA

SEQ ID NO: 716437 - protein, 24 aa, Mycobacterium
QVGRLRVGPRFAVDGVGDQNVGAA

SEQ ID NO: 716438 - protein, 21 aa, Mycobacterium
QVGTCTALPPAGFTIVDPDAV

SEQ ID NO: 716439 - protein, 20 aa, Mycobacterium
QVGVLLARLGLPEDTDDLTL

SEQ ID NO: 716440 - protein, 31 aa, Mycobacterium
QVGVSRPTVIKWRDRFAAFGIEGLDDEPRSG

SEQ ID NO: 716441 - protein, 26 aa, Mycobacterium
QVHARIGESFTLVYDAVVSRAGQGGA

SEQ ID NO: 716442 - protein, 17 aa, Mycobacterium
QVHPCARITKLSERIDF

SEQ ID NO: 716443 - protein, 17 aa, Mycobacterium
QVHPCARITKLSERLDF

SEQ ID NO: 716444 - protein, 25 aa, Mycobacterium
QVHRFLKLLGGYTFSRHSYSLGATG

SEQ ID NO: 716445 - protein, 25 aa, Mycobacterium
QVHRFLKMLGGYTFSRHSYSLGATG

SEQ ID NO: 716446 - protein, 20 aa, Mycobacterium
QVHTLLDFHFHPHLQAPNGT

SEQ ID NO: 716447 - protein, 19 aa, Mycobacterium
QVHTLLDFHFHPHVVAPSG

SEQ ID NO: 716448 - protein, 18 aa, Mycobacterium
QVHVGRWDQLDGLVDATY

SEQ ID NO: 716449 - protein, 18 aa, Mycobacterium
QVHVGRWDQLDGLVEATY

SEQ ID NO: 716450 - protein, 17 aa, Mycobacterium
QVIANGLAILGVTAPER

SEQ ID NO: 716451 - protein, 22 aa, Mycobacterium
QVIEAVNLFRAKVVDVSTESLT

SEQ ID NO: 716452 - protein, 18 aa, Mycobacterium
QVIEHLWDQGQFIRECAR

SEQ ID NO: 716453 - protein, 24 aa, Mycobacterium
QVILPAAFFAMWATRRMHEVGTTV

SEQ ID NO: 716454 - protein, 18 aa, Mycobacterium
QVIMLGRPTLHRPVSTLL

SEQ ID NO: 716455 - protein, 17 aa, Mycobacterium
QVIPADPQMAWRYVELD

SEQ ID NO: 716456 - protein, 17 aa, Mycobacterium
QVIPADPVMAWRYIQLG

SEQ ID NO: 716457 - protein, 17 aa, Mycobacterium
QVISALLDVAGWAQPWD

SEQ ID NO: 716458 - protein, 19 aa, Mycobacterium
QVISIPTMILFKDGQPVKR

SEQ ID NO: 716459 - protein, 17 aa, Mycobacterium
QVITLGLILGALESRTP

SEQ ID NO: 716460 - protein, 22 aa, Mycobacterium
QVIWAEFEFHRLLNHVADRPKL

SEQ ID NO: 716461 - protein, 18 aa, Mycobacterium
QVIWSAHESSVWSDEYHP

SEQ ID NO: 716462 - protein, 18 aa, Mycobacterium
QVLAGLPGDISIALDHTR

SEQ ID NO: 716463 - protein, 24 aa, Mycobacterium
QVLAMAALRTGFYAEGLDQTGLSQ

SEQ ID NO: 716464 - protein, 17 aa, Mycobacterium
QVLATVTAWCARMDVLT

SEQ ID NO: 716465 - protein, 25 aa, Mycobacterium
QVLCTELRISAATLRRDLSELEEQG

SEQ ID NO: 716466 - protein, 17 aa, Mycobacterium
QVLEEIAARWAAVAVAV

SEQ ID NO: 716467 - protein, 20 aa, Mycobacterium
QVLEFKARVLQRHGVEPKAR

SEQ ID NO: 716468 - protein, 25 aa, Mycobacterium
QVLKGEQLKSFMAVTDPAKFAGEDG

SEQ ID NO: 716469 - protein, 30 aa, Mycobacterium
QVLLDRERCVLCARCTRFSSQIAGDPFIDL

SEQ ID NO: 716470 - protein, 19 aa, Mycobacterium
QVLLMLERLLDRWAGFDGV

SEQ ID NO: 716471 - protein, 17 aa, Mycobacterium
QVLLPLWNAYTFLALYA

SEQ ID NO: 716472 - protein, 17 aa, Mycobacterium
QVLLRFLAAGVCGSDLP

SEQ ID NO: 716473 - protein, 24 aa, Mycobacterium
QVLNRLIEWVSFTPLHNVTGEPAI

SEQ ID NO: 716474 - protein, 17 aa, Mycobacterium
QVLRAGTDVTLIAYGPS

SEQ ID NO: 716475 - protein, 25 aa, Mycobacterium
QVLRLWQTALIRLFRLQISDEIEVG

SEQ ID NO: 716476 - protein, 25 aa, Mycobacterium
QVLRRYPVRVSRDLRDEFDMVGGVR

SEQ ID NO: 716477 - protein, 26 aa, Mycobacterium
QVLRTPESWVLIDFEGEPGQPLRERR

SEQ ID NO: 716478 - protein, 18 aa, Mycobacterium
QVLSRPEPDLAIVGMGRR

SEQ ID NO: 716479 - protein, 17 aa, Mycobacterium
QVLSVDPEIGWQFVEFD

SEQ ID NO: 716480 - protein, 17 aa, Mycobacterium
QVLTFAWPAGAAAVSIY

SEQ ID NO: 716481 - protein, 21 aa, Mycobacterium
QVLTRFTKFDVETAAPTAQYA

SEQ ID NO: 716482 - protein, 17 aa, Mycobacterium
QVLVKVLACGICGSDLH

SEQ ID NO: 716483 - protein, 26 aa, Mycobacterium
QVMFAPRPEYAFRHPLIRMVALESQL

SEQ ID NO: 716484 - protein, 21 aa, Mycobacterium
QVMGGAALHFGNVAEMKTGEG

SEQ ID NO: 716485 - protein, 23 aa, Mycobacterium
QVMPRSREAGVWTTHGDLALPLL

SEQ ID NO: 716486 - protein, 19 aa, Mycobacterium
QVMRERLTALGVSRFDSSL

SEQ ID NO: 716487 - protein, 18 aa, Mycobacterium
QVMVVSLHVGRALTDSEI

SEQ ID NO: 716488 - protein, 26 aa, Mycobacterium
QVNGRYVFHKDLRRAVIFGRNDLVKD

SEQ ID NO: 716489 - protein, 22 aa, Mycobacterium
QVNPSGRLPITFPADLGQTPRP

SEQ ID NO: 716490 - protein, 31 aa, Mycobacterium
QVNRPLRGCYRIALLSLKGGVGKTTIAATMG

SEQ ID NO: 716491 - protein, 30 aa, Mycobacterium
QVNRPLRGCYRIALLSLKGGVGKTTITATL

SEQ ID NO: 716492 - protein, 25 aa, Mycobacterium
QVNRPLRGSYRVAFLSLKGGVGKTT

SEQ ID NO: 716493 - protein, 21 aa, Mycobacterium
QVPAAVRFLSCEPLLGPLNGL

SEQ ID NO: 716494 - protein, 20 aa, Mycobacterium
QVPALIPRDEIASVLDGADV

SEQ ID NO: 716495 - protein, 25 aa, Mycobacterium
QVPAWRPGTRHGYHAITLGWYESEL

SEQ ID NO: 716496 - protein, 32 aa, Mycobacterium
QVPDEFFRAVCGFDLPEPGSFATGIAFLPQSA

SEQ ID NO: 716497 - protein, 24 aa, Mycobacterium
QVPDYLMQIIARFARYLRESNSVD

SEQ ID NO: 716498 - protein, 24 aa, Mycobacterium
QVPDYLMQVIARFARYLRESHSID

SEQ ID NO: 716499 - protein, 24 aa, Mycobacterium
QVPDYLMQVIARFARYLRESNSVD

SEQ ID NO: 716500 - protein, 19 aa, Mycobacterium
QVPELSAPAGRVIDLPGLG

SEQ ID NO: 716501 - protein, 23 aa, Mycobacterium
QVPEYLLQVIARFARYLRESSSV

SEQ ID NO: 716502 - protein, 19 aa, Mycobacterium
QVPFDARFDGTVIGGLSAL

SEQ ID NO: 716503 - protein, 18 aa, Mycobacterium
QVPFLRGPYPTMYVNQPW

SEQ ID NO: 716504 - protein, 19 aa, Mycobacterium
QVPFPKRMGRSTEYAQLAQ

SEQ ID NO: 716505 - protein, 23 aa, Mycobacterium
QVPGEPKVGFAQLYGAPGTAGAT

SEQ ID NO: 716506 - protein, 23 aa, Mycobacterium
QVPGGAWVLGWRRPQAYPLMSNL

SEQ ID NO: 716507 - protein, 22 aa, Mycobacterium
QVPGGAWVMGWRRPQAYPLMAH

SEQ ID NO: 716508 - protein, 24 aa, Mycobacterium
QVPIDRLWHAVPCFPTVSELWLRL

SEQ ID NO: 716509 - protein, 34 aa, Mycobacterium
QVPIERLWHAVPCFPTVSEVWLKLLEGYRDRHAT

SEQ ID NO: 716510 - protein, 17 aa, Mycobacterium
QVPLHMLGCEVKAMYPL

SEQ ID NO: 716511 - protein, 18 aa, Mycobacterium
QVPLYFLGAQVIGMYPLG

SEQ ID NO: 716512 - protein, 24 aa, Mycobacterium
QVPPSQANFVWLPLGERSTEFAQA

SEQ ID NO: 716513 - protein, 22 aa, Mycobacterium
QVQGISSAHSWAVTQHPTVAQL

SEQ ID NO: 716514 - protein, 19 aa, Mycobacterium
QVQLPAAMRNRFPHQLSGG

SEQ ID NO: 716515 - protein, 23 aa, Mycobacterium
QVQNCSLICPFVVQGAVQIPASV

SEQ ID NO: 716516 - protein, 27 aa, Mycobacterium
QVQQRWLEWQKLFLSIIPFPEISAARA

SEQ ID NO: 716517 - protein, 30 aa, Mycobacterium
QVQRLLFDAGWMRWGWPTRIGGLGGSPMLR

SEQ ID NO: 716518 - protein, 17 aa, Mycobacterium
QVREALANPRFREHIPL

SEQ ID NO: 716519 - protein, 23 aa, Mycobacterium
QVREDRLHQQLGIGTVPDSQVLP

SEQ ID NO: 716520 - protein, 17 aa, Mycobacterium
QVRGEWQPLYEFGTRTA

SEQ ID NO: 716521 - protein, 40 aa, Mycobacterium
QVRGGFDGLTRWLTGMFDRDGWRPGGVVVVGAHNDIDGFS

SEQ ID NO: 716522 - protein, 25 aa, Mycobacterium
QVRGVPWRRAEFRAVDSVSFRLRRG

SEQ ID NO: 716523 - protein, 23 aa, Mycobacterium
QVRMADLLTHGWDLARATGASAD

SEQ ID NO: 716524 - protein, 18 aa, Mycobacterium
QVRMEFADDVLRLSAGAD

SEQ ID NO: 716525 - protein, 17 aa, Mycobacterium
QVRNKFVALGFSPGFAD

SEQ ID NO: 716526 - protein, 22 aa, Mycobacterium
QVRPAVRREGFGLIYETPADEF

SEQ ID NO: 716527 - protein, 23 aa, Mycobacterium
QVRPGETMGLLGPNGAGKTTMVR

SEQ ID NO: 716528 - protein, 20 aa, Mycobacterium
QVRPGQHVRLQWARPRTQVR

SEQ ID NO: 716529 - protein, 27 aa, Mycobacterium
QVRPGQSVRLHWSRPRVLVGAGPRSTD

SEQ ID NO: 716530 - protein, 21 aa, Mycobacterium
QVRRIKHEVAHEVVTEVAARP

SEQ ID NO: 716531 - protein, 17 aa, Mycobacterium
QVRSGEFSWKESADAMR

SEQ ID NO: 716532 - protein, 18 aa, Mycobacterium
QVRWRWTPNSVAIWDNRS

SEQ ID NO: 716533 - protein, 19 aa, Mycobacterium
QVSCGQVARSQWAVIVNPN

SEQ ID NO: 716534 - protein, 25 aa, Mycobacterium
QVSEPRPGQRFAFVMDTRLCDAVYA

SEQ ID NO: 716535 - protein, 28 aa, Mycobacterium
QVSERGKYRLGFAIPRLAHVAGGQNDLV

SEQ ID NO: 716536 - protein, 19 aa, Mycobacterium
QVSEWPRYSGHAIAGVSGF

SEQ ID NO: 716537 - protein, 22 aa, Mycobacterium
QVSFKDGWHVQGLRGTGSYDYA

SEQ ID NO: 716538 - protein, 27 aa, Mycobacterium
QVSFLPELLRWIPFTKGDYWVLKIDDA

SEQ ID NO: 716539 - protein, 27 aa, Mycobacterium
QVSLRPEPFGALLYHFGTRKLSFLKNR

SEQ ID NO: 716540 - protein, 19 aa, Mycobacterium
QVSQARYGGTPGRVIVQEG

SEQ ID NO: 716541 - protein, 23 aa, Mycobacterium
QVSRLKSSVAMELVRKQRGLTVA

SEQ ID NO: 716542 - protein, 29 aa, Mycobacterium
QVSSLIKVKGFRNVIHWRVTRYDEPKEIE

SEQ ID NO: 716543 - protein, 18 aa, Mycobacterium
QVTEAFWNAIRHAKPIAV

SEQ ID NO: 716544 - protein, 19 aa, Mycobacterium
QVTEAFWNAIRHAKPIAVG

SEQ ID NO: 716545 - protein, 18 aa, Mycobacterium
QVTEAFWNAIRHAKPLAV

SEQ ID NO: 716546 - protein, 18 aa, Mycobacterium
QVTEAFWNAIRHARPIAV

SEQ ID NO: 716547 - protein, 18 aa, Mycobacterium
QVTEAFWNSIRHAKPIAV

SEQ ID NO: 716548 - protein, 18 aa, Mycobacterium
QVTEAFWNSIRHAQPLAV

SEQ ID NO: 716549 - protein, 19 aa, Mycobacterium
QVTEALCKRWQPGARLLPA

SEQ ID NO: 716550 - protein, 34 aa, Mycobacterium
QVTEAQAWPVLRRHLALLAIEGHDPIAALHDAAA

SEQ ID NO: 716551 - protein, 17 aa, Mycobacterium
QVTELDGGVLVNWDVRE

SEQ ID NO: 716552 - protein, 18 aa, Mycobacterium
QVTKGALYFHFRSKHALA

SEQ ID NO: 716553 - protein, 27 aa, Mycobacterium
QVTPWNYPFMMAIWKIGPALAAGNTVV

SEQ ID NO: 716554 - protein, 24 aa, Mycobacterium
QVTRFPLLAALTGRRSRRFPAGGR

SEQ ID NO: 716555 - protein, 23 aa, Mycobacterium
QVTRLTVEHPIRTPNTITATTTV

SEQ ID NO: 716556 - protein, 18 aa, Mycobacterium
QVTRRYLSEVSMAELRKV

SEQ ID NO: 716557 - protein, 24 aa, Mycobacterium
QVTVDARFGWEFLSDKEFGSGPGA

SEQ ID NO: 716558 - protein, 26 aa, Mycobacterium
QVVANRPKIGWRRLEAQAVMSRLLNA

SEQ ID NO: 716559 - protein, 26 aa, Mycobacterium
QVVARARAAGILFRPRDVFVEQSVAR

SEQ ID NO: 716560 - protein, 25 aa, Mycobacterium
QVVARARAAGLLLRPRDIFVEQTVS

SEQ ID NO: 716561 - protein, 24 aa, Mycobacterium
QVVARARAAGVMCRPRDVFVEQTA

SEQ ID NO: 716562 - protein, 24 aa, Mycobacterium
QVVARARAAGVMCRPRDVFVEQTV

SEQ ID NO: 716563 - protein, 24 aa, Mycobacterium
QVVARARAAGVVFRPRDVFVEQTV

SEQ ID NO: 716564 - protein, 18 aa, Mycobacterium
QVVDCIDYTAALDTLSIA

SEQ ID NO: 716565 - protein, 20 aa, Mycobacterium
QVVEGSWGMAAAVFDANQNP

SEQ ID NO: 716566 - protein, 17 aa, Mycobacterium
QVVEGWYGQKFPKPLAR

SEQ ID NO: 716567 - protein, 21 aa, Mycobacterium
QVVGFSDLFYPGDVAVDPAGN

SEQ ID NO: 716568 - protein, 19 aa, Mycobacterium
QVVIRRRLTLGVLVCCPAD

SEQ ID NO: 716569 - protein, 18 aa, Mycobacterium
QVVIRSGHEPQLFRTKAR

SEQ ID NO: 716570 - protein, 18 aa, Mycobacterium
QVVLCAGAPDTPEIADEI

SEQ ID NO: 716571 - protein, 25 aa, Mycobacterium
QVVLDRPGSVVLWTNCHHPFYDHNP

SEQ ID NO: 716572 - protein, 20 aa, Mycobacterium
QVVLQRRLPVVVVDQPKDLA

SEQ ID NO: 716573 - protein, 21 aa, Mycobacterium
QVVLQRRLPVVVVDQPKDLAG

SEQ ID NO: 716574 - protein, 22 aa, Mycobacterium
QVVLQRRLPVVVVDQPKELAGV

SEQ ID NO: 716575 - protein, 20 aa, Mycobacterium
QVVLQRRLPVVVVDQPKGLA

SEQ ID NO: 716576 - protein, 18 aa, Mycobacterium
QVVLRKPIKGTGWTVRDL

SEQ ID NO: 716577 - protein, 18 aa, Mycobacterium
QVVLSWKVSNLQPSSDET

SEQ ID NO: 716578 - protein, 27 aa, Mycobacterium
QVVLWCMGESHAGVVLDALANRYGVTV

SEQ ID NO: 716579 - protein, 18 aa, Mycobacterium
QVVPEVLDALAGIVRIPD

SEQ ID NO: 716580 - protein, 17 aa, Mycobacterium
QVVPGPRDDWFVDPDIL

SEQ ID NO: 716581 - protein, 35 aa, Mycobacterium
QVVPPPFVMRQFVKTGVFLPERLSFAFVGAAEMAG

SEQ ID NO: 716582 - protein, 35 aa, Mycobacterium
QVVPPPFVMRQFVKTSVFLPERLGFLFVGAAEMAG

SEQ ID NO: 716583 - protein, 26 aa, Mycobacterium
QVVRLPRIPMRFPMYLPGPNRVMVVD

SEQ ID NO: 716584 - protein, 23 aa, Mycobacterium
QVVRLWEHWGRPNIEWYHGGHTG

SEQ ID NO: 716585 - protein, 19 aa, Mycobacterium
QVVSIPTMILFKDGAPVKR

SEQ ID NO: 716586 - protein, 19 aa, Mycobacterium
QVVSIPTMILFKDGEPVKR

SEQ ID NO: 716587 - protein, 21 aa, Mycobacterium
QVVSIPTMILFKDGQPVKRIV

SEQ ID NO: 716588 - protein, 20 aa, Mycobacterium
QVVVCGKPSFYTGRGTFSLR

SEQ ID NO: 716589 - protein, 24 aa, Mycobacterium
QVVVCGKPSFYTGRGTFSLRLNEI

SEQ ID NO: 716590 - protein, 19 aa, Mycobacterium
QVVVCGKPTFYTGRGSFSL

SEQ ID NO: 716591 - protein, 20 aa, Mycobacterium
QVVYRSGVRHVPRLRRHSLA

SEQ ID NO: 716592 - protein, 25 aa, Mycobacterium
QVWAMRYTLERVIRGQDTIAVTGNI

SEQ ID NO: 716593 - protein, 17 aa, Mycobacterium
QVWRQADKYDVPRICFV

SEQ ID NO: 716594 - protein, 18 aa, Mycobacterium
QVWRRERLEYQGKHYTIP

SEQ ID NO: 716595 - protein, 18 aa, Mycobacterium
QVYGRACIIAEELKLYGS

SEQ ID NO: 716596 - protein, 26 aa, Mycobacterium
QVYNQEAWYYNSLKAQLERQLDAANA

SEQ ID NO: 716597 - protein, 17 aa, Mycobacterium
QVYPLGFVGVHPADTAP

SEQ ID NO: 716598 - protein, 18 aa, Mycobacterium
QVYPRIGKWLTADVAVVA

SEQ ID NO: 716599 - protein, 26 aa, Mycobacterium
QVYWARGVLELAGRERGVFQFEGVMV

SEQ ID NO: 716600 - protein, 22 aa, Mycobacterium
QVYWDHMCCNVLENNFAARAVL

SEQ ID NO: 716601 - protein, 24 aa, Mycobacterium
QVYWEQAAAFGRKYLAGAEGLDRL

SEQ ID NO: 716602 - protein, 18 aa, Mycobacterium
QWAAEVRRLARLRGATIL

SEQ ID NO: 716603 - protein, 24 aa, Mycobacterium
QWAEAAGLDSAWMPQVPDDFDCLS

SEQ ID NO: 716604 - protein, 19 aa, Mycobacterium
QWAFEGKWDGYRLLVDADH

SEQ ID NO: 716605 - protein, 17 aa, Mycobacterium
QWAHPDAIAAFAAQGVT

SEQ ID NO: 716606 - protein, 18 aa, Mycobacterium
QWAKPIVLRSSWAREGDP

SEQ ID NO: 716607 - protein, 18 aa, Mycobacterium
QWALPGGRVDPGETVEEA

SEQ ID NO: 716608 - protein, 28 aa, Mycobacterium
QWANRVAPRLGRQWLLPVCAETWDGYLN

SEQ ID NO: 716609 - protein, 18 aa, Mycobacterium
QWAPEVTKVLEAVENALW

SEQ ID NO: 716610 - protein, 17 aa, Mycobacterium
QWATPQYRRPFVGSLTL

SEQ ID NO: 716611 - protein, 19 aa, Mycobacterium
QWCAVWSDVHYRVSARRVS

SEQ ID NO: 716612 - protein, 21 aa, Mycobacterium
QWDGPFMLKGVMRIDDAKRAV

SEQ ID NO: 716613 - protein, 18 aa, Mycobacterium
QWEEALEVAIRCMIEEPF

SEQ ID NO: 716614 - protein, 36 aa, Mycobacterium
QWELFKAQRLKTAADEIIRWATPITAFQRTAREDTE

SEQ ID NO: 716615 - protein, 23 aa, Mycobacterium
QWEVPLMLFVIATPEILTAASSD

SEQ ID NO: 716616 - protein, 29 aa, Mycobacterium
QWFADGARFWYRIGTRYVAVDPGVKTRRA

SEQ ID NO: 716617 - protein, 25 aa, Mycobacterium
QWFDLCAMTGHVEWIDEDSPLSITQ

SEQ ID NO: 716618 - protein, 19 aa, Mycobacterium
QWFSAFLADRAVRKPSTHT

SEQ ID NO: 716619 - protein, 19 aa, Mycobacterium
QWFVRAHLESAGGQLTHEG

SEQ ID NO: 716620 - protein, 20 aa, Mycobacterium
QWGAYLARREKLVEDLAGEI

SEQ ID NO: 716621 - protein, 25 aa, Mycobacterium
QWGELKPLIFCDGYGSTRRIYGRPR

SEQ ID NO: 716622 - protein, 18 aa, Mycobacterium
QWGIPRLSILFWSMGDVP

SEQ ID NO: 716623 - protein, 18 aa, Mycobacterium
QWGMPWSPAPASARSARV

SEQ ID NO: 716624 - protein, 26 aa, Mycobacterium
QWHTYFPPIGGFRFSMFTIPPRGSAA

SEQ ID NO: 716625 - protein, 21 aa, Mycobacterium
QWIHPRIGHRTVLEHFGYTTE

SEQ ID NO: 716626 - protein, 26 aa, Mycobacterium
QWIREYQDRLEILGQRAQYVQQTVGL

SEQ ID NO: 716627 - protein, 21 aa, Mycobacterium
QWITECLKAAYPLGHGHGPVS

SEQ ID NO: 716628 - protein, 24 aa, Mycobacterium
QWITPRWDLPATYELGYRIETLLK

SEQ ID NO: 716629 - protein, 18 aa, Mycobacterium
QWKAEATGLVSVTVAGQP

SEQ ID NO: 716630 - protein, 25 aa, Mycobacterium
QWKPVGGFPVTLGWVHATRRGQARL

SEQ ID NO: 716631 - protein, 18 aa, Mycobacterium
QWKRELVARTSLTDDEIG

SEQ ID NO: 716632 - protein, 18 aa, Mycobacterium
QWKRELVARTSLTEDEIG

SEQ ID NO: 716633 - protein, 18 aa, Mycobacterium
QWKRELVARTSLTEDEVG

SEQ ID NO: 716634 - protein, 18 aa, Mycobacterium
QWKRELVARTSLTEEEIG

SEQ ID NO: 716635 - protein, 26 aa, Mycobacterium
QWLAAHAGDGRRCGLTVVGTHLPHGG

SEQ ID NO: 716636 - protein, 20 aa, Mycobacterium
QWLAARGWAVEPVRSTLELQ

SEQ ID NO: 716637 - protein, 20 aa, Mycobacterium
QWLAARGWVVEPVRNTLELE

SEQ ID NO: 716638 - protein, 22 aa, Mycobacterium
QWLDIPSWEWHKSGAEPVRMRT

SEQ ID NO: 716639 - protein, 18 aa, Mycobacterium
QWLDLCAGPGGKTALLGA

SEQ ID NO: 716640 - protein, 22 aa, Mycobacterium
QWLDVLHWSQLVIELADGDPTK

SEQ ID NO: 716641 - protein, 20 aa, Mycobacterium
QWLEEFDRATLAAAPPIAEN

SEQ ID NO: 716642 - protein, 29 aa, Mycobacterium
QWLEGCAVQRIMFRDGLVLNFEDYNELVI

SEQ ID NO: 716643 - protein, 18 aa, Mycobacterium
QWLELRFVGSRGAVLRGV

SEQ ID NO: 716644 - protein, 19 aa, Mycobacterium
QWLLWPSLDRRWHSHHNSD

SEQ ID NO: 716645 - protein, 20 aa, Mycobacterium
QWLNEHGWRANAQNACDEMH

SEQ ID NO: 716646 - protein, 24 aa, Mycobacterium
QWLPDYGDYLGVCVELPYMRREAP

SEQ ID NO: 716647 - protein, 24 aa, Mycobacterium
QWLPEARHLLDLALEHFADPEQPG

SEQ ID NO: 716648 - protein, 25 aa, Mycobacterium
QWLTYSLIEPFVWAGVEVLDIDALT

SEQ ID NO: 716649 - protein, 24 aa, Mycobacterium
QWLTYSLLEPFEWAGERITGLDEL

SEQ ID NO: 716650 - protein, 21 aa, Mycobacterium
QWNTDFQKLFDWEMSASGACS

SEQ ID NO: 716651 - protein, 20 aa, Mycobacterium
QWPAVAAQLTGTVGVAAPAT

SEQ ID NO: 716652 - protein, 25 aa, Mycobacterium
QWPLADVRLLAPILASKVVCMGKNY

SEQ ID NO: 716653 - protein, 28 aa, Mycobacterium
QWPRSARDFWALTRWFRAGDYVFEAPSA

SEQ ID NO: 716654 - protein, 17 aa, Mycobacterium
QWQDLRAQLAAGATPPA

SEQ ID NO: 716655 - protein, 23 aa, Mycobacterium
QWQDVDGAVFARVMQVSQLIGKA

SEQ ID NO: 716656 - protein, 29 aa, Mycobacterium
QWQPLPTWFERLTWAGISTRAVLPEWFIG

SEQ ID NO: 716657 - protein, 23 aa, Mycobacterium
QWQRRRALVGSRIRALRLERGLS

SEQ ID NO: 716658 - protein, 25 aa, Mycobacterium
QWRGAAERVLRGFALSLLVPPQHYD

SEQ ID NO: 716659 - protein, 19 aa, Mycobacterium
QWRGDGRGLVLDRAAHEAA

SEQ ID NO: 716660 - protein, 18 aa, Mycobacterium
QWRLRPTSNGQLVIREVY

SEQ ID NO: 716661 - protein, 23 aa, Mycobacterium
QWRPCPVGQVGMLARSGPIPLGY

SEQ ID NO: 716662 - protein, 18 aa, Mycobacterium
QWRPVEGFGDLTDITYHR

SEQ ID NO: 716663 - protein, 17 aa, Mycobacterium
QWRRGRGQATVEPLLAI

SEQ ID NO: 716664 - protein, 29 aa, Mycobacterium
QWRRLLHGWPGLRTRGLTALADRTVNKGR

SEQ ID NO: 716665 - protein, 24 aa, Mycobacterium
QWRSATCRVLVAATGARSANAGPV

SEQ ID NO: 716666 - protein, 27 aa, Mycobacterium
QWRTRKYKGACIFLNRPGFAGGIGCAL

SEQ ID NO: 716667 - protein, 22 aa, Mycobacterium
QWRVTIPWRGIGRMIGQTIEPT

SEQ ID NO: 716668 - protein, 18 aa, Mycobacterium
QWSMGRPVREVGYDEIQA

SEQ ID NO: 716669 - protein, 25 aa, Mycobacterium
QWSPNELFRAVGLDYWDEVGKRFAT

SEQ ID NO: 716670 - protein, 19 aa, Mycobacterium
QWSTPSLCAGWTVRDVAVH

SEQ ID NO: 716671 - protein, 18 aa, Mycobacterium
QWSWADWSSRIRRAAGAL

SEQ ID NO: 716672 - protein, 22 aa, Mycobacterium
QWTESFETLWEVRMDSLGTFLD

SEQ ID NO: 716673 - protein, 30 aa, Mycobacterium
QWTFEEVVECGRLLALLASILSDLGHGLAV

SEQ ID NO: 716674 - protein, 18 aa, Mycobacterium
QWTGRYQQRCWLRQLTPY

SEQ ID NO: 716675 - protein, 25 aa, Mycobacterium
QWTQRYGQRCWLRQLTPHPTREQEN

SEQ ID NO: 716676 - protein, 20 aa, Mycobacterium
QWVRLGVGPWFYIDDVVTDY

SEQ ID NO: 716677 - protein, 22 aa, Mycobacterium
QWWAMGRDLLNAGGIFAAEAAR

SEQ ID NO: 716678 - protein, 24 aa, Mycobacterium
QWYTARLRPGPLRPAERRTTFVDH

SEQ ID NO: 716679 - protein, 18 aa, Mycobacterium
QYAAMSFDAVNTVFRDGK

SEQ ID NO: 716680 - protein, 24 aa, Mycobacterium
QYADGACQLAFWRHDEHLVCEARD

SEQ ID NO: 716681 - protein, 17 aa, Mycobacterium
QYAEMWAQDAAAMYGYA

SEQ ID NO: 716682 - protein, 19 aa, Mycobacterium
QYAFSRPIVGHMFTNYDGV

SEQ ID NO: 716683 - protein, 18 aa, Mycobacterium
QYAFTRPVAAHMFSNYDG

SEQ ID NO: 716684 - protein, 19 aa, Mycobacterium
QYAGLTPEYRREFEDKANR

SEQ ID NO: 716685 - protein, 20 aa, Mycobacterium
QYAHARLCALARNAADLGVS

SEQ ID NO: 716686 - protein, 27 aa, Mycobacterium
QYAIKGCIAHGGLGWIYLAVDRNVNDR

SEQ ID NO: 716687 - protein, 18 aa, Mycobacterium
QYAKAWRTIAKLSLPDKY

SEQ ID NO: 716688 - protein, 18 aa, Mycobacterium
QYAKTWRTIAKLSLPDRF

SEQ ID NO: 716689 - protein, 18 aa, Mycobacterium
QYAKTWRTLAKLSLPNSY

SEQ ID NO: 716690 - protein, 18 aa, Mycobacterium
QYALEVCNAVGDIVEPTP

SEQ ID NO: 716691 - protein, 26 aa, Mycobacterium
QYARPPKRWVLKGFHGRRLGALFDTY

SEQ ID NO: 716692 - protein, 22 aa, Mycobacterium
QYASAHSLDIFSKVIGINLIGS

SEQ ID NO: 716693 - protein, 20 aa, Mycobacterium
QYATVHWARHVDTFATFGIT

SEQ ID NO: 716694 - protein, 21 aa, Mycobacterium
QYDAGLAWVHLPRGFGGLDLP

SEQ ID NO: 716695 - protein, 24 aa, Mycobacterium
QYDDLRAGLRMNIIANPGVDKANF

SEQ ID NO: 716696 - protein, 24 aa, Mycobacterium
QYDDLRPGLRMNVIGNPGVAKADF

SEQ ID NO: 716697 - protein, 19 aa, Mycobacterium
QYDPLMSPLVWDLAHIGQQ

SEQ ID NO: 716698 - protein, 22 aa, Mycobacterium
QYEDRCGPIITEWLTQRGFSAG

SEQ ID NO: 716699 - protein, 25 aa, Mycobacterium
QYEQMWAADVAAMVGYHGGASAAAA

SEQ ID NO: 716700 - protein, 20 aa, Mycobacterium
QYERYTGVVADWCREAASRA

SEQ ID NO: 716701 - protein, 23 aa, Mycobacterium
QYFAAISGVWARRSSEVAQTVVI

SEQ ID NO: 716702 - protein, 17 aa, Mycobacterium
QYFSRFGGVRDYLMAVV

SEQ ID NO: 716703 - protein, 18 aa, Mycobacterium
QYFSRFGGVRDYLRAVVD

SEQ ID NO: 716704 - protein, 24 aa, Mycobacterium
QYFYKGAYWRRGPVTMTAIAAVDI

SEQ ID NO: 716705 - protein, 19 aa, Mycobacterium
QYGAQGIRCNAVAPGVIQT

SEQ ID NO: 716706 - protein, 20 aa, Mycobacterium
QYGAQGIRCNAVAPGVIQTA

SEQ ID NO: 716707 - protein, 19 aa, Mycobacterium
QYGEMWAQDAAAMYGYAAQ

SEQ ID NO: 716708 - protein, 18 aa, Mycobacterium
QYGEMWAQDAATMYGYAG

SEQ ID NO: 716709 - protein, 19 aa, Mycobacterium
QYGGHGRSHFERFVVTEEL

SEQ ID NO: 716710 - protein, 20 aa, Mycobacterium
QYGGIRPHYDIGDSTPTSDY

SEQ ID NO: 716711 - protein, 18 aa, Mycobacterium
QYGKTWRTIAKLSLPDKF

SEQ ID NO: 716712 - protein, 18 aa, Mycobacterium
QYGKTWRTLAKLSLPNKY

SEQ ID NO: 716713 - protein, 25 aa, Mycobacterium
QYGPVRFPGVPTWFSKTPGRVRGFA

SEQ ID NO: 716714 - protein, 18 aa, Mycobacterium
QYGSAGIRCNAVAPGVTL

SEQ ID NO: 716715 - protein, 24 aa, Mycobacterium
QYHRLRLATLVIVAGTAKAVTSWL

SEQ ID NO: 716716 - protein, 20 aa, Mycobacterium
QYHVDVAKRFGVYERVRFNT

SEQ ID NO: 716717 - protein, 18 aa, Mycobacterium
QYIDYALWQRACLGDPAD

SEQ ID NO: 716718 - protein, 27 aa, Mycobacterium
QYIGIGVFLDGRWRWRSYSLTSSPVTA

SEQ ID NO: 716719 - protein, 18 aa, Mycobacterium
QYIIGHAGARILIATREF

SEQ ID NO: 716720 - protein, 19 aa, Mycobacterium
QYIPRADVVADRLTSTDTS

SEQ ID NO: 716721 - protein, 20 aa, Mycobacterium
QYKDMERWGNAMFVTPGVVV

SEQ ID NO: 716722 - protein, 20 aa, Mycobacterium
QYKVAVGDVVKVEKLDSEPG

SEQ ID NO: 716723 - protein, 24 aa, Mycobacterium
QYLAQLYAAIGIRASDAAQQLLGK

SEQ ID NO: 716724 - protein, 23 aa, Mycobacterium
QYLAQLYATIGIRASDAAQQLLG

SEQ ID NO: 716725 - protein, 25 aa, Mycobacterium
QYLATAEEFLRLVVARGDDLTEFAV

SEQ ID NO: 716726 - protein, 22 aa, Mycobacterium
QYLEMWAQDAAAMYAYAGTAAA

SEQ ID NO: 716727 - protein, 24 aa, Mycobacterium
QYLGEIVCAAIVFKGKPVAAAELN

SEQ ID NO: 716728 - protein, 24 aa, Mycobacterium
QYLPPRQRAVLLLRDVLQWRSAEV

SEQ ID NO: 716729 - protein, 18 aa, Mycobacterium
QYLWSKQVSRLFAAALAA

SEQ ID NO: 716730 - protein, 19 aa, Mycobacterium
QYPAIGNFYGMEGAYLETG

SEQ ID NO: 716731 - protein, 18 aa, Mycobacterium
QYPAIRPGQVVAIDATRA

SEQ ID NO: 716732 - protein, 22 aa, Mycobacterium
QYPAPNKYVAPIAFNIVPLAGN

SEQ ID NO: 716733 - protein, 29 aa, Mycobacterium
QYPAVSPALLLKCMLMAATEGIASGDRVS

SEQ ID NO: 716734 - protein, 19 aa, Mycobacterium
QYPEWEFGVQLVPESDEFN

SEQ ID NO: 716735 - protein, 19 aa, Mycobacterium
QYPEWELGVQLVPEEDEFS

SEQ ID NO: 716736 - protein, 25 aa, Mycobacterium
QYPGGWGDQRWGGWNQRDSIDIYDT

SEQ ID NO: 716737 - protein, 19 aa, Mycobacterium
QYPPVAISMLIAQTARSLC

SEQ ID NO: 716738 - protein, 22 aa, Mycobacterium
QYPQYAGTFARVITHSTAYAQS

SEQ ID NO: 716739 - protein, 17 aa, Mycobacterium
QYPYPVALDQLLAGNSG

SEQ ID NO: 716740 - protein, 18 aa, Mycobacterium
QYRAEFVNVTGLETNDFV

SEQ ID NO: 716741 - protein, 24 aa, Mycobacterium
QYRCSECQHVAPKWVGRCANCGTW

SEQ ID NO: 716742 - protein, 25 aa, Mycobacterium
QYRCSECQHVTAKWVGRCLECGTWG

SEQ ID NO: 716743 - protein, 21 aa, Mycobacterium
QYRDRGCPEPQPLSIDLIREM

SEQ ID NO: 716744 - protein, 20 aa, Mycobacterium
QYRGTGYRAFDLIEAGPDRI

SEQ ID NO: 716745 - protein, 20 aa, Mycobacterium
QYRHAFGRRLLELPAGLRDA

SEQ ID NO: 716746 - protein, 18 aa, Mycobacterium
QYRLGLPHAGTWREVLNT

SEQ ID NO: 716747 - protein, 24 aa, Mycobacterium
QYRLPSYYRWLLYEADHRGAYRFH

SEQ ID NO: 716748 - protein, 21 aa, Mycobacterium
QYRWDLGLRRDYQRAAFEAGW

SEQ ID NO: 716749 - protein, 28 aa, Mycobacterium
QYSEPFTRFPMRSVWPDMFSVYKAQGRG

SEQ ID NO: 716750 - protein, 17 aa, Mycobacterium
QYTAGWQGGEKVVGLLD

SEQ ID NO: 716751 - protein, 18 aa, Mycobacterium
QYTAGWQGGEKVVGLLDE

SEQ ID NO: 716752 - protein, 32 aa, Mycobacterium
QYTDRTGPIIVEWLGAQGFRVDEPVVVPDGEA

SEQ ID NO: 716753 - protein, 17 aa, Mycobacterium
QYTGRSISRAEFNDKAE

SEQ ID NO: 716754 - protein, 27 aa, Mycobacterium
QYTPEQWWPFIGHLSLDQSIAQGVTLL

SEQ ID NO: 716755 - protein, 25 aa, Mycobacterium
QYVAAHLPYVAWLMQASVDTTQAAA

SEQ ID NO: 716756 - protein, 26 aa, Mycobacterium
QYVAAVCPRTKIVLGGMSQGAGVIDL

SEQ ID NO: 716757 - protein, 26 aa, Mycobacterium
QYVDLVCSWGPMILGHAHPAVVEAVQ

SEQ ID NO: 716758 - protein, 18 aa, Mycobacterium
QYVDPIKVDVFHYNRKWL

SEQ ID NO: 716759 - protein, 22 aa, Mycobacterium
QYVEEFAELRLDGITAGSTLLT

SEQ ID NO: 716760 - protein, 26 aa, Mycobacterium
QYVGIGVLIDGRWRWRSYSLTSAPAM

SEQ ID NO: 716761 - protein, 25 aa, Mycobacterium
QYVVGRLVWNAGLLAPVEGQLRQVA

SEQ ID NO: 716762 - protein, 23 aa, Mycobacterium
QYWVDRFTPAPAIVGFPVTAQSS

SEQ ID NO: 716763 - protein, 18 aa, Mycobacterium
RAAAAAFDQAFAMTVPPP

SEQ ID NO: 716764 - protein, 19 aa, Mycobacterium
RAAAAAFEAAFAMTVPPPV

SEQ ID NO: 716765 - protein, 24 aa, Mycobacterium
RAAAAEFGAPVAVGADNLLMTGGT

SEQ ID NO: 716766 - protein, 20 aa, Mycobacterium
RAAAAGTPWLSFFAPEEMLS

SEQ ID NO: 716767 - protein, 23 aa, Mycobacterium
RAAAAQRWRPYGFRTNAEVNGAL

SEQ ID NO: 716768 - protein, 19 aa, Mycobacterium
RAAAARAFELGIRDVAKEY

SEQ ID NO: 716769 - protein, 20 aa, Mycobacterium
RAAAEFPDVRMEFSTFNSTP

SEQ ID NO: 716770 - protein, 25 aa, Mycobacterium
RAAAELFGLRAGTPVAVGGADTQCA

SEQ ID NO: 716771 - protein, 24 aa, Mycobacterium
RAAAELGFRTAFVARPLEFGPGGD

SEQ ID NO: 716772 - protein, 19 aa, Mycobacterium
RAAAELISLRGYSATSTRE

SEQ ID NO: 716773 - protein, 25 aa, Mycobacterium
RAAAELLCEGGFDAVRHRAVARRAG

SEQ ID NO: 716774 - protein, 18 aa, Mycobacterium
RAAAEMVGLSDVARAGGV

SEQ ID NO: 716775 - protein, 25 aa, Mycobacterium
RAAAEPIELWAWVAAYDHVALCQLW

SEQ ID NO: 716776 - protein, 19 aa, Mycobacterium
RAAAESFSAQGYHAVSMET

SEQ ID NO: 716777 - protein, 20 aa, Mycobacterium
RAAAFTGIKPFLALYMGGMG

SEQ ID NO: 716778 - protein, 20 aa, Mycobacterium
RAAAHGLALTPAMVFAHLTI

SEQ ID NO: 716779 - protein, 18 aa, Mycobacterium
RAAAIAYEAALAGIVHPE

SEQ ID NO: 716780 - protein, 19 aa, Mycobacterium
RAAAILAALPQPFTVSDAR

SEQ ID NO: 716781 - protein, 20 aa, Mycobacterium
RAAALPGVVDIVGASRTVLV

SEQ ID NO: 716782 - protein, 21 aa, Mycobacterium
RAAAMNLRRLVTMGITHNGTT

SEQ ID NO: 716783 - protein, 19 aa, Mycobacterium
RAAANKGLALFPRRINGRY

SEQ ID NO: 716784 - protein, 18 aa, Mycobacterium
RAAAPKVSFGGRISAQRR

SEQ ID NO: 716785 - protein, 18 aa, Mycobacterium
RAAAPVYDFRPFIIADAD

SEQ ID NO: 716786 - protein, 17 aa, Mycobacterium
RAAAQLRHGDFVEQVAC

SEQ ID NO: 716787 - protein, 20 aa, Mycobacterium
RAAARAMAGEGFGDPAPAGL

SEQ ID NO: 716788 - protein, 17 aa, Mycobacterium
RAAARAMVKRGQGGVII

SEQ ID NO: 716789 - protein, 22 aa, Mycobacterium
RAAARIPWQLADIGQHTDGHRL

SEQ ID NO: 716790 - protein, 21 aa, Mycobacterium
RAAARIPWQLADITAHTDGYR

SEQ ID NO: 716791 - protein, 17 aa, Mycobacterium
RAAARLMAAQGHGAIVN

SEQ ID NO: 716792 - protein, 18 aa, Mycobacterium
RAAARPGQHIRRAGEDVT

SEQ ID NO: 716793 - protein, 25 aa, Mycobacterium
RAAARRCPDATFLPSDPEAYDAASD

SEQ ID NO: 716794 - protein, 18 aa, Mycobacterium
RAAARRGTPVLLKGPTGC

SEQ ID NO: 716795 - protein, 26 aa, Mycobacterium
RAAASFELVHAFALLQDDVMDGSDVR

SEQ ID NO: 716796 - protein, 18 aa, Mycobacterium
RAAATEWTANAARLTEAA

SEQ ID NO: 716797 - protein, 17 aa, Mycobacterium
RAAATRPGLLLLDEPFS

SEQ ID NO: 716798 - protein, 26 aa, Mycobacterium
RAAAVAELRLPAFRAKQLAHQYYGRL

SEQ ID NO: 716799 - protein, 18 aa, Mycobacterium
RAAAVAYETTFAAMVPPP

SEQ ID NO: 716800 - protein, 18 aa, Mycobacterium
RAAAVGAMSFGWDRLPCL

SEQ ID NO: 716801 - protein, 18 aa, Mycobacterium
RAAAVLADALARARIHGV

SEQ ID NO: 716802 - protein, 25 aa, Mycobacterium
RAAAVRAGRGPRCVNPAGTAQALDV

SEQ ID NO: 716803 - protein, 21 aa, Mycobacterium
RAAAVRLAIRCARDSMPPLRL

SEQ ID NO: 716804 - protein, 19 aa, Mycobacterium
RAAAVRVFVNRHGWRSLPQ

SEQ ID NO: 716805 - protein, 20 aa, Mycobacterium
RAAAVRYLDWLGGTAAQAEQ

SEQ ID NO: 716806 - protein, 18 aa, Mycobacterium
RAAAVWLQALADLVETLL

SEQ ID NO: 716807 - protein, 17 aa, Mycobacterium
RAACAAGARIVVLTNAA

SEQ ID NO: 716808 - protein, 19 aa, Mycobacterium
RAACAAGVRAVVLTNAAGG

SEQ ID NO: 716809 - protein, 21 aa, Mycobacterium
RAACGPPGLFCEEYDIRQRQL

SEQ ID NO: 716810 - protein, 19 aa, Mycobacterium
RAACRSDQALAKGLSTHDG

SEQ ID NO: 716811 - protein, 25 aa, Mycobacterium
RAACSRPVTCPSIVAAFTAQVDLAP

SEQ ID NO: 716812 - protein, 17 aa, Mycobacterium
RAADAGAKLVVFPEATM

SEQ ID NO: 716813 - protein, 19 aa, Mycobacterium
RAADDAVQMLGWRGYVENH

SEQ ID NO: 716814 - protein, 25 aa, Mycobacterium
RAADGSLRFVGRADAQVKIRGYRVE

SEQ ID NO: 716815 - protein, 19 aa, Mycobacterium
RAADLAHRLSLRGYDAVHA

SEQ ID NO: 716816 - protein, 19 aa, Mycobacterium
RAADLGVTCSIFVDQIHYW

SEQ ID NO: 716817 - protein, 24 aa, Mycobacterium
RAADLPPAVGVLVEYEGSDSEAAH

SEQ ID NO: 716818 - protein, 24 aa, Mycobacterium
RAADLPPAVGVLVEYESASGDATG

SEQ ID NO: 716819 - protein, 25 aa, Mycobacterium
RAADLPPAVGVLVEYQAGDADKGKE

SEQ ID NO: 716820 - protein, 21 aa, Mycobacterium
RAADNSKLWFAIAAALMASGS

SEQ ID NO: 716821 - protein, 17 aa, Mycobacterium
RAADPVFMLTGPIPATR

SEQ ID NO: 716822 - protein, 21 aa, Mycobacterium
RAADRAVQVFGGRGYMRENVA

SEQ ID NO: 716823 - protein, 17 aa, Mycobacterium
RAADVGGTWYWNRYPGI

SEQ ID NO: 716824 - protein, 23 aa, Mycobacterium
RAADVGGTWYWNRYPGIACDVES

SEQ ID NO: 716825 - protein, 26 aa, Mycobacterium
RAADVTACLRTLVRRRLAVAHPGYDS

SEQ ID NO: 716826 - protein, 17 aa, Mycobacterium
RAAEAFGGLDVLVNNAG

SEQ ID NO: 716827 - protein, 18 aa, Mycobacterium
RAAEAGAQIICFQELFHG

SEQ ID NO: 716828 - protein, 22 aa, Mycobacterium
RAAEARYQRSFGIVDGYGGHGI

SEQ ID NO: 716829 - protein, 31 aa, Mycobacterium
RAAEATGVRWASDRVGVRWSTESAAETEEVR

SEQ ID NO: 716830 - protein, 19 aa, Mycobacterium
RAAEAVSLVAEWTAGATIV

SEQ ID NO: 716831 - protein, 20 aa, Mycobacterium
RAAEAVSRCERHRCFPVLAG

SEQ ID NO: 716832 - protein, 18 aa, Mycobacterium
RAAECAFSHAGLRREDVD

SEQ ID NO: 716833 - protein, 26 aa, Mycobacterium
RAAEDPRVAGLIARVQIDAAAPGAVQ

SEQ ID NO: 716834 - protein, 17 aa, Mycobacterium
RAAEECEQWLGTAAGLS

SEQ ID NO: 716835 - protein, 25 aa, Mycobacterium
RAAEHPRPDYVLLHISDTHLVGGDD

SEQ ID NO: 716836 - protein, 17 aa, Mycobacterium
RAAEILVQMSRRDDIPY

SEQ ID NO: 716837 - protein, 21 aa, Mycobacterium
RAAELADRFAAIAAGALGPGD

SEQ ID NO: 716838 - protein, 19 aa, Mycobacterium
RAAELCLGDPPALPTTGAS

SEQ ID NO: 716839 - protein, 17 aa, Mycobacterium
RAAELGVSVAAELFDLG

SEQ ID NO: 716840 - protein, 25 aa, Mycobacterium
RAAELGVTCSIFVDQIHYWGDVVVD

SEQ ID NO: 716841 - protein, 18 aa, Mycobacterium
RAAELGWTALLVPEDLGG

SEQ ID NO: 716842 - protein, 18 aa, Mycobacterium
RAAELIAELIREEGKTTA

SEQ ID NO: 716843 - protein, 17 aa, Mycobacterium
RAAELLADRRARGPVKR

SEQ ID NO: 716844 - protein, 19 aa, Mycobacterium
RAAELLNGLGARYVPQRVV

SEQ ID NO: 716845 - protein, 30 aa, Mycobacterium
RAAELMGIQIPRFCDHPLLDPVGACRQCLV

SEQ ID NO: 716846 - protein, 41 aa, Mycobacterium
RAAELMGIQIPRFCDHPLLDPVGACRQCLVEVEGQRKPLAS

SEQ ID NO: 716847 - protein, 41 aa, Mycobacterium; identical to SEQ ID NO: 204938

SEQ ID NO: 716848 - protein, 41 aa, Mycobacterium; identical to SEQ ID NO: 83726

SEQ ID NO: 716849 - protein, 17 aa, Mycobacterium
RAAELTLGLAGRLALEQ

SEQ ID NO: 716850 - protein, 18 aa, Mycobacterium
RAAEMTRAIGFDGKCLRQ

SEQ ID NO: 716851 - protein, 31 aa, Mycobacterium
RAAEPRFQILAVFDFLYEWFSQPDFRGCMFI

SEQ ID NO: 716852 - protein, 25 aa, Mycobacterium
RAAEPWEVAATIAFLASDYSSYLTG

SEQ ID NO: 716853 - protein, 19 aa, Mycobacterium
RAAESAGFESFWMPQVPGY

SEQ ID NO: 716854 - protein, 28 aa, Mycobacterium
RAAESLRAFPRPLLYAGAAADAGAELIR

SEQ ID NO: 716855 - protein, 24 aa, Mycobacterium
RAAETPSGAALRTFLDRHGHRGYR

SEQ ID NO: 716856 - protein, 24 aa, Mycobacterium
RAAEVPAAVIARLGVDPTELEQLH

SEQ ID NO: 716857 - protein, 17 aa, Mycobacterium
RAAEVVEAELLRLDGRL

SEQ ID NO: 716858 - protein, 17 aa, Mycobacterium
RAAEVVEAELLRLENRL

SEQ ID NO: 716859 - protein, 19 aa, Mycobacterium
RAAEYFSPFGTARHAELGL

SEQ ID NO: 716860 - protein, 18 aa, Mycobacterium
RAAEYGRTVVVLTIDPAK

SEQ ID NO: 716861 - protein, 18 aa, Mycobacterium
RAAFAAATRGGWRAAGDR

SEQ ID NO: 716862 - protein, 25 aa, Mycobacterium
RAAFAAATRGGWRAAGVHDGMTGTL

SEQ ID NO: 716863 - protein, 25 aa, Mycobacterium
RAAFAAATRGGWRAAGVRDGKTGTL

SEQ ID NO: 716864 - protein, 18 aa, Mycobacterium
RAAFAQGKGVAWPKSGTF

SEQ ID NO: 716865 - protein, 26 aa, Mycobacterium
RAAFERRWELGGVLFSKTFSDQMIDP

SEQ ID NO: 716866 - protein, 20 aa, Mycobacterium
RAAFEYARDYACEREQFGRK

SEQ ID NO: 716867 - protein, 18 aa, Mycobacterium
RAAFPAWAGATPAERSAV

SEQ ID NO: 716868 - protein, 18 aa, Mycobacterium
RAAFRPLAGILAGRGAAV

SEQ ID NO: 716869 - protein, 18 aa, Mycobacterium
RAAFRTVRRAVFFPPAPG

SEQ ID NO: 716870 - protein, 17 aa, Mycobacterium
RAAGAKAGFSVKPGTPL

SEQ ID NO: 716871 - protein, 17 aa, Mycobacterium
RAAGAKAGLSIKPGTPI

SEQ ID NO: 716872 - protein, 17 aa, Mycobacterium
RAAGAKAGLSIKPGTPL

SEQ ID NO: 716873 - protein, 20 aa, Mycobacterium
RAAGCSRATLYRYFDSREAL

SEQ ID NO: 716874 - protein, 20 aa, Mycobacterium
RAAGCSRATLYRYFESREAL

SEQ ID NO: 716875 - protein, 19 aa, Mycobacterium
RAAGFSGLVFTEAGRTAYL

SEQ ID NO: 716876 - protein, 17 aa, Mycobacterium
RAAGGRGPARGMNLPTG

SEQ ID NO: 716877 - protein, 23 aa, Mycobacterium
RAAGIACFGPSAAAARIEGSKAF

SEQ ID NO: 716878 - protein, 22 aa, Mycobacterium
RAAGIARRSLFRYYASKNAIPW

SEQ ID NO: 716879 - protein, 19 aa, Mycobacterium
RAAGIEDVRILDGGLAAWA

SEQ ID NO: 716880 - protein, 20 aa, Mycobacterium
RAAGISQEWIEAAQRSPVYA

SEQ ID NO: 716881 - protein, 17 aa, Mycobacterium
RAAGKIVVMLGAVGNPG

SEQ ID NO: 716882 - protein, 25 aa, Mycobacterium
RAAGKRIVPVCSMVVTVLDKHPEYD

SEQ ID NO: 716883 - protein, 19 aa, Mycobacterium
RAAGLAMAYKLIDAAAARW

SEQ ID NO: 716884 - protein, 18 aa, Mycobacterium
RAAGLAVRTRDIFTEQTV

SEQ ID NO: 716885 - protein, 25 aa, Mycobacterium
RAAGLGVTCSIFVDQIHYWGDIIVD

SEQ ID NO: 716886 - protein, 18 aa, Mycobacterium
RAAGLPAATINWGPWSEV

SEQ ID NO: 716887 - protein, 25 aa, Mycobacterium
RAAGLPASAINWGLWKSLADAQTGF

SEQ ID NO: 716888 - protein, 18 aa, Mycobacterium
RAAGLPVSPRLVFENPTV

SEQ ID NO: 716889 - protein, 18 aa, Mycobacterium
RAAGLRIVPTCWMVAEFI

SEQ ID NO: 716890 - protein, 25 aa, Mycobacterium
RAAGLRPALSKVLSAWCPSRARHDP

SEQ ID NO: 716891 - protein, 19 aa, Mycobacterium
RAAGLTVALVERELVGGEC

SEQ ID NO: 716892 - protein, 27 aa, Mycobacterium
RAAGNPWAVPTGWRVGGAPAPVRTEMQ

SEQ ID NO: 716893 - protein, 25 aa, Mycobacterium
RAAGPCGFASLLVEAARRAGVSGYV

SEQ ID NO: 716894 - protein, 18 aa, Mycobacterium
RAAGPYAALGSRAPDAVD

SEQ ID NO: 716895 - protein, 20 aa, Mycobacterium
RAAGQGRIVLVSSASGVRGQ

SEQ ID NO: 716896 - protein, 20 aa, Mycobacterium
RAAGTPAAMLDRLALNPQRI

SEQ ID NO: 716897 - protein, 17 aa, Mycobacterium
RAAGVACRQRDVFVEQT

SEQ ID NO: 716898 - protein, 19 aa, Mycobacterium
RAAGVRHVLLAGPEKSVPA

SEQ ID NO: 716899 - protein, 25 aa, Mycobacterium
RAAGVRRIVYLGGFVPDAPEDEALS

SEQ ID NO: 716900 - protein, 20 aa, Mycobacterium
RAAGVTGYLGGAVLATGVLN

SEQ ID NO: 716901 - protein, 18 aa, Mycobacterium
RAAGWQIPQPWVVDTKDA

SEQ ID NO: 716902 - protein, 18 aa, Mycobacterium
RAAGWRILLADEVGADRG

SEQ ID NO: 716903 - protein, 18 aa, Mycobacterium
RAAGYGMPGVRVDGNDPL

SEQ ID NO: 716904 - protein, 21 aa, Mycobacterium
RAAHAFPGELIGVATGPLTNL

SEQ ID NO: 716905 - protein, 20 aa, Mycobacterium
RAAHFGLPFSPPMAMPELEA

SEQ ID NO: 716906 - protein, 30 aa, Mycobacterium
RAAHLPRWPLIVLRTPKGWTGPKMVEGVPV

SEQ ID NO: 716907 - protein, 22 aa, Mycobacterium
RAAHNIGHFRFVECSRLVNGRP

SEQ ID NO: 716908 - protein, 18 aa, Mycobacterium
RAAHPFGVAAPRIAASAL

SEQ ID NO: 716909 - protein, 21 aa, Mycobacterium
RAAICGSDLHLYHGLMPDTRV

SEQ ID NO: 716910 - protein, 28 aa, Mycobacterium
RAAIEAGVARFLPWQFGVDYDLIGRGSP

SEQ ID NO: 716911 - protein, 21 aa, Mycobacterium
RAAIIREVRDALGVLRADELT

SEQ ID NO: 716912 - protein, 17 aa, Mycobacterium
RAAIRARYVPPARPLPM

SEQ ID NO: 716913 - protein, 22 aa, Mycobacterium
RAAIRPTTRLIWVETPTNPLLS

SEQ ID NO: 716914 - protein, 19 aa, Mycobacterium
RAAIRTVVARRMFAEQYKR

SEQ ID NO: 716915 - protein, 17 aa, Mycobacterium
RAAISAFWDKAIEPTTR

SEQ ID NO: 716916 - protein, 18 aa, Mycobacterium
RAAITARLLGAGTVGVVR

SEQ ID NO: 716917 - protein, 20 aa, Mycobacterium
RAAITDRTRLVWIETPTNPL

SEQ ID NO: 716918 - protein, 18 aa, Mycobacterium
RAAIWAPNSVEWIVAAFG

SEQ ID NO: 716919 - protein, 21 aa, Mycobacterium
RAAKEPDRHGFGLPKISLNPL

SEQ ID NO: 716920 - protein, 20 aa, Mycobacterium
RAAKLASLPAGIAGRAALGV

SEQ ID NO: 716921 - protein, 19 aa, Mycobacterium
RAAKPAGEYPVFPDYEADV

SEQ ID NO: 716922 - protein, 25 aa, Mycobacterium
RAAKPALPAVSSRSAVSSGAASPAA

SEQ ID NO: 716923 - protein, 17 aa, Mycobacterium
RAAKRVAAVSRLRVPGP

SEQ ID NO: 716924 - protein, 20 aa, Mycobacterium
RAAKVWRGAPLQVRVDDFLA

SEQ ID NO: 716925 - protein, 25 aa, Mycobacterium
RAAKWKRTLSLLVFEQEELDWETYS

SEQ ID NO: 716926 - protein, 20 aa, Mycobacterium
RAALAGKFLDRFGVSTECGL

SEQ ID NO: 716927 - protein, 19 aa, Mycobacterium
RAALALWSGVLGYAEQHGY

SEQ ID NO: 716928 - protein, 20 aa, Mycobacterium
RAALANRCELLLIDMTVETP

SEQ ID NO: 716929 - protein, 18 aa, Mycobacterium
RAALARELVRAGTAFPTD

SEQ ID NO: 716930 - protein, 24 aa, Mycobacterium
RAALAWRGEFGSVRSWDERVTTAA

SEQ ID NO: 716931 - protein, 26 aa, Mycobacterium
RAALAWRSEFGSVHYWDEQVTKAALH

SEQ ID NO: 716932 - protein, 26 aa, Mycobacterium
RAALAWRSEFGSVRYWDERLTDAAMH

SEQ ID NO: 716933 - protein, 26 aa, Mycobacterium
RAALDALGYRGFWMGYFAARSAPLGM

SEQ ID NO: 716934 - protein, 23 aa, Mycobacterium
RAALDAVGRWRARAEHPLNDPFT

SEQ ID NO: 716935 - protein, 20 aa, Mycobacterium
RAALDSGPWGKADPAERIAA

SEQ ID NO: 716936 - protein, 20 aa, Mycobacterium
RAALELLHRVPRSAGRELSY

SEQ ID NO: 716937 - protein, 22 aa, Mycobacterium
RAALERWGRIDFLINAAGVGSP

SEQ ID NO: 716938 - protein, 19 aa, Mycobacterium
RAALETLAVVAYRQPVTRA

SEQ ID NO: 716939 - protein, 20 aa, Mycobacterium
RAALGQGISRAAALVQDGRA

SEQ ID NO: 716940 - protein, 18 aa, Mycobacterium
RAALGVLKAEQWRPDAVL

SEQ ID NO: 716941 - protein, 19 aa, Mycobacterium
RAALHPLPITPELRGRLVF

SEQ ID NO: 716942 - protein, 18 aa, Mycobacterium
RAALIGCGVTTGYGSAVR

SEQ ID NO: 716943 - protein, 17 aa, Mycobacterium
RAALIGYLPTGYPDVNT

SEQ ID NO: 716944 - protein, 19 aa, Mycobacterium
RAALLDALEVARLDPSVTG

SEQ ID NO: 716945 - protein, 34 aa, Mycobacterium
RAALLDRFGMFGLRISIAVLRAGVRDSVALAEEL

SEQ ID NO: 716946 - protein, 19 aa, Mycobacterium
RAALLEAGRTAFSAQRYDE

SEQ ID NO: 716947 - protein, 20 aa, Mycobacterium
RAALLEALEVARLDPSVDEV

SEQ ID NO: 716948 - protein, 18 aa, Mycobacterium
RAALLGMCPQGCISAGGA

SEQ ID NO: 716949 - protein, 26 aa, Mycobacterium
RAALPMLRAAEWARIVTLSAHSIQRQ

SEQ ID NO: 716950 - protein, 24 aa, Mycobacterium
RAALREVAHEVGFFYLTGHGVSPQ

SEQ ID NO: 716951 - protein, 24 aa, Mycobacterium
RAALRGKRFGVPRMYVNADPEAGT

SEQ ID NO: 716952 - protein, 25 aa, Mycobacterium
RAALSRLGCPYVWGATGPGQFDCSG

SEQ ID NO: 716953 - protein, 25 aa, Mycobacterium
RAALTAYCELWSRWVTATRDIVANG

SEQ ID NO: 716954 - protein, 18 aa, Mycobacterium
RAALTRAIHKLPIKARII

SEQ ID NO: 716955 - protein, 20 aa, Mycobacterium
RAALTVTFGGLKPVHALGEC

SEQ ID NO: 716956 - protein, 17 aa, Mycobacterium
RAALVTMLRSVDPVVDF

SEQ ID NO: 716957 - protein, 32 aa, Mycobacterium
RAAMGLPLPGAIAWHAVPRWFARRKDRRQSLA

SEQ ID NO: 716958 - protein, 24 aa, Mycobacterium
RAAMPKTVWTTGCSSWYLNDDGVP

SEQ ID NO: 716959 - protein, 22 aa, Mycobacterium
RAAMPNICLQMLLRGRNTVGYT

SEQ ID NO: 716960 - protein, 18 aa, Mycobacterium
RAAMPVTAPPSVARRLRL

SEQ ID NO: 716961 - protein, 19 aa, Mycobacterium
RAAMPYQVHVGRWDQLDGL

SEQ ID NO: 716962 - protein, 20 aa, Mycobacterium
RAAMRPGETVLVLGGAGGVG

SEQ ID NO: 716963 - protein, 18 aa, Mycobacterium
RAAMRPGNTVLVLGAAGG

SEQ ID NO: 716964 - protein, 32 aa, Mycobacterium
RAAMTGWQRLHFRFGIPAPLLEPLAVERLYLD

SEQ ID NO: 716965 - protein, 17 aa, Mycobacterium
RAAMTSLARGRVHIAAL

SEQ ID NO: 716966 - protein, 17 aa, Mycobacterium
RAAMWLEHIRRRGWQGA

SEQ ID NO: 716967 - protein, 18 aa, Mycobacterium
RAANLAWGCGDAETATRV

SEQ ID NO: 716968 - protein, 20 aa, Mycobacterium
RAANLIAGFSEKPGGMPLSE

SEQ ID NO: 716969 - protein, 21 aa, Mycobacterium
RAANVVIRWLADAGISIAGTR

SEQ ID NO: 716970 - protein, 24 aa, Mycobacterium
RAAPAGRTIPEWFGVQAGRSPSAV

SEQ ID NO: 716971 - protein, 24 aa, Mycobacterium
RAAPIGMARPCTKRIIASWTACRR

SEQ ID NO: 716972 - protein, 19 aa, Mycobacterium
RAAPISIRLIEPIITRTIG

SEQ ID NO: 716973 - protein, 20 aa, Mycobacterium
RAAPLGDPRLDLCDLYVFQS

SEQ ID NO: 716974 - protein, 17 aa, Mycobacterium
RAAPPVRKLAKELMVDL

SEQ ID NO: 716975 - protein, 24 aa, Mycobacterium
RAAPTLTLHLSWPAPAALKDREDD

SEQ ID NO: 716976 - protein, 25 aa, Mycobacterium
RAAQEACSFCELTIVPQFGTMPYEE

SEQ ID NO: 716977 - protein, 17 aa, Mycobacterium
RAAQHTFMMESMNELAG

SEQ ID NO: 716978 - protein, 17 aa, Mycobacterium
RAAQRVFDRTGGLHAAA

SEQ ID NO: 716979 - protein, 23 aa, Mycobacterium
RAAQYADRVFIKFGDERLTYKTA

SEQ ID NO: 716980 - protein, 17 aa, Mycobacterium
RAARAAARAAAWAAGAA

SEQ ID NO: 716981 - protein, 19 aa, Mycobacterium
RAARAGLSAARSFEESAIQ

SEQ ID NO: 716982 - protein, 17 aa, Mycobacterium
RAARDAVAAGFTTRGKD

SEQ ID NO: 716983 - protein, 18 aa, Mycobacterium
RAAREAFETDGIFAPLDS

SEQ ID NO: 716984 - protein, 24 aa, Mycobacterium
RAARELGFDPALLRARNLPATQTR

SEQ ID NO: 716985 - protein, 17 aa, Mycobacterium
RAAREVFSELGYDAATF

SEQ ID NO: 716986 - protein, 23 aa, Mycobacterium
RAARGRPAPTWDSLHSEPADLLP

SEQ ID NO: 716987 - protein, 17 aa, Mycobacterium
RAARGSIVLVSSVHAMF

SEQ ID NO: 716988 - protein, 18 aa, Mycobacterium
RAARIIVVPGEVDRVITV

SEQ ID NO: 716989 - protein, 20 aa, Mycobacterium
RAARKLRRPRGIPTLASLAT

SEQ ID NO: 716990 - protein, 19 aa, Mycobacterium
RAARLEMLPKTNAHVARDL

SEQ ID NO: 716991 - protein, 21 aa, Mycobacterium
RAARLLAERAADFDVVHDNQS

SEQ ID NO: 716992 - protein, 18 aa, Mycobacterium
RAARLMVEAVRRHHPGSL

SEQ ID NO: 716993 - protein, 22 aa, Mycobacterium
RAARLTPVDWFARRTALVDANT

SEQ ID NO: 716994 - protein, 32 aa, Mycobacterium
RAARRGARIFVELSAHPALLFNMGELLESTRG

SEQ ID NO: 716995 - protein, 19 aa, Mycobacterium
RAARRLVHVPVGRFADPGE

SEQ ID NO: 716996 - protein, 23 aa, Mycobacterium
RAARSAGIGSVYLAGPRAALGDS

SEQ ID NO: 716997 - protein, 20 aa, Mycobacterium
RAARSRAVMRAMTIAALEAG

SEQ ID NO: 716998 - protein, 23 aa, Mycobacterium
RAARVIEVLGHISLLVADEPQFA

SEQ ID NO: 716999 - protein, 17 aa, Mycobacterium
RAARYALLRSFRRDGTP

SEQ ID NO: 717000 - protein, 19 aa, Mycobacterium
RAASGIVALVQRFPQSTRF

SEQ ID NO: 717001 - protein, 19 aa, Mycobacterium
RAASHSFAAAPTRELPCRD

SEQ ID NO: 717002 - protein, 24 aa, Mycobacterium
RAASLEHPQIWGGLADLGGGTSDE

SEQ ID NO: 717003 - protein, 19 aa, Mycobacterium
RAASRESRRARQLPATKPA

SEQ ID NO: 717004 - protein, 19 aa, Mycobacterium
RAASRESRRSRSLPATKPS

SEQ ID NO: 717005 - protein, 18 aa, Mycobacterium
RAASRLGREFQVRDGKPE

SEQ ID NO: 717006 - protein, 18 aa, Mycobacterium
RAASSVKEKNDWSYKQWA

SEQ ID NO: 717007 - protein, 18 aa, Mycobacterium
RAATALCEALLAWGAGRG

SEQ ID NO: 717008 - protein, 19 aa, Mycobacterium
RAATAPAEHGLPVDPDALF

SEQ ID NO: 717009 - protein, 28 aa, Mycobacterium
RAATEFTLQAWAGSPGFRGDPAGPPLSI

SEQ ID NO: 717010 - protein, 24 aa, Mycobacterium
RAATLAALAPRPGQLLWDVGAGSG

SEQ ID NO: 717011 - protein, 19 aa, Mycobacterium
RAATLGPWTLVLDECHHLL

SEQ ID NO: 717012 - protein, 19 aa, Mycobacterium
RAAVARFAQRVVETRGKVG

SEQ ID NO: 717013 - protein, 19 aa, Mycobacterium
RAAVATAVERFGRLDVLVN

SEQ ID NO: 717014 - protein, 17 aa, Mycobacterium
RAAVDGCTHVIHLAAIV

SEQ ID NO: 717015 - protein, 24 aa, Mycobacterium
RAAVDQCRPGRPAAGHATMACSAN

SEQ ID NO: 717016 - protein, 19 aa, Mycobacterium
RAAVELLRRDLDYLERLIT

SEQ ID NO: 717017 - protein, 17 aa, Mycobacterium
RAAVERVLKAAGVADVD

SEQ ID NO: 717018 - protein, 26 aa, Mycobacterium
RAAVGADFIICYRMSMADYVEHGQSW

SEQ ID NO: 717019 - protein, 27 aa, Mycobacterium
RAAVGARRGAAVNARATGPTGPTSAGV

SEQ ID NO: 717020 - protein, 19 aa, Mycobacterium
RAAVGLLERQGWLVRRQGL

SEQ ID NO: 717021 - protein, 20 aa, Mycobacterium
RAAVGPDFIICYRMSMADYV

SEQ ID NO: 717022 - protein, 19 aa, Mycobacterium
RAAVIARLRTPLGTLTVAN

SEQ ID NO: 717023 - protein, 23 aa, Mycobacterium
RAAVLALRARKGMVLDPTDHDTW

SEQ ID NO: 717024 - protein, 18 aa, Mycobacterium
RAAVLLKIADRMEADLEK

SEQ ID NO: 717025 - protein, 24 aa, Mycobacterium
RAAVPGRRVLRCSGVEAEAAFVLA

SEQ ID NO: 717026 - protein, 19 aa, Mycobacterium
RAAVSAALQVGYRSIDTAK

SEQ ID NO: 717027 - protein, 23 aa, Mycobacterium
RAAVTDWLYWLYITAQLDSAQAI

SEQ ID NO: 717028 - protein, 24 aa, Mycobacterium
RAAVTRAKVLAGFDEDADARVVAY

SEQ ID NO: 717029 - protein, 19 aa, Mycobacterium
RAAVVAYEAAFLATVPPPV

SEQ ID NO: 717030 - protein, 18 aa, Mycobacterium
RAAVVFADALGLDRVDII

SEQ ID NO: 717031 - protein, 21 aa, Mycobacterium
RAAVVGAGLMGRRIAGVLASA

SEQ ID NO: 717032 - protein, 22 aa, Mycobacterium
RAAVVKPDVVLMDMRLADGNGV

SEQ ID NO: 717033 - protein, 20 aa, Mycobacterium
RAAVYGRLGTCVGRHGTLTT

SEQ ID NO: 717034 - protein, 20 aa, Mycobacterium
RAAVYGRLGTCVGRYGTLTS

SEQ ID NO: 717035 - protein, 17 aa, Mycobacterium
RAAWADINSEIGKYNAR

SEQ ID NO: 717036 - protein, 19 aa, Mycobacterium
RAAWDRELLPGAQVVLAPT

SEQ ID NO: 717037 - protein, 19 aa, Mycobacterium
RAAYELAGIGPEDVDVAQL

SEQ ID NO: 717038 - protein, 18 aa, Mycobacterium
RAAYFEKYPGVWCHGDWI

SEQ ID NO: 717039 - protein, 17 aa, Mycobacterium
RAAYGLATVILRELSAR

SEQ ID NO: 717040 - protein, 20 aa, Mycobacterium
RAAYVAGAWGAVASLSPELF

SEQ ID NO: 717041 - protein, 24 aa, Mycobacterium
RACADALAPYVDWSLDAVLRGGVA

SEQ ID NO: 717042 - protein, 22 aa, Mycobacterium
RACFRCELCMEELRRRDDLLLV

SEQ ID NO: 717043 - protein, 24 aa, Mycobacterium
RACISGESLGGWVAARAAIDHPDV

SEQ ID NO: 717044 - protein, 23 aa, Mycobacterium
RACISGESLGGWVAARAAVDHPD

SEQ ID NO: 717045 - protein, 21 aa, Mycobacterium
RACQAGHRVLFATASQWVARL

SEQ ID NO: 717046 - protein, 19 aa, Mycobacterium
RACRALCDQYMQWTDIDTD

SEQ ID NO: 717047 - protein, 19 aa, Mycobacterium
RACSEAGGTLFFGVPTVWS

SEQ ID NO: 717048 - protein, 21 aa, Mycobacterium
RACSVLAELRAGSADTVVADR

SEQ ID NO: 717049 - protein, 19 aa, Mycobacterium
RACVAREFAALALNKQRPV

SEQ ID NO: 717050 - protein, 21 aa, Mycobacterium
RACVDECPVDCIYEGARMLYI

SEQ ID NO: 717051 - protein, 19 aa, Mycobacterium
RADAALGLELTSPRGITYL

SEQ ID NO: 717052 - protein, 18 aa, Mycobacterium
RADAALPLPELAPARAGA

SEQ ID NO: 717053 - protein, 18 aa, Mycobacterium
RADAFALTSISLRALAAN

SEQ ID NO: 717054 - protein, 19 aa, Mycobacterium
RADALAWSVKLVGEHTEEW

SEQ ID NO: 717055 - protein, 22 aa, Mycobacterium
RADALDCGRALSAVLLECTLAG

SEQ ID NO: 717056 - protein, 22 aa, Mycobacterium
RADALGRAFIDQGITFSLSGQE

SEQ ID NO: 717057 - protein, 20 aa, Mycobacterium
RADALGRAFTDQGITFSLSG

SEQ ID NO: 717058 - protein, 20 aa, Mycobacterium
RADAMAALVRQRATGVRVTV

SEQ ID NO: 717059 - protein, 24 aa, Mycobacterium
RADAPFLLEWGNHGAALLDIGMTW

SEQ ID NO: 717060 - protein, 20 aa, Mycobacterium
RADAPKWWITIGGEVRKGER

SEQ ID NO: 717061 - protein, 18 aa, Mycobacterium
RADATRYPAEFSGGQKQR

SEQ ID NO: 717062 - protein, 19 aa, Mycobacterium
RADAVLAVARRAGELGWHT

SEQ ID NO: 717063 - protein, 20 aa, Mycobacterium
RADAYAKIEAIRLPGSHFRS

SEQ ID NO: 717064 - protein, 17 aa, Mycobacterium
RADCQLVLADSKSSETL

SEQ ID NO: 717065 - protein, 21 aa, Mycobacterium
RADCSEAMLFHYFGDKRGIFE

SEQ ID NO: 717066 - protein, 22 aa, Mycobacterium
RADDRGRLVAAFRKVAQAVLTG

SEQ ID NO: 717067 - protein, 22 aa, Mycobacterium
RADEFLARFPQVEFTDVRGAGH

SEQ ID NO: 717068 - protein, 22 aa, Mycobacterium
RADELRALLVGQRVSVLTQTPS

SEQ ID NO: 717069 - protein, 24 aa, Mycobacterium
RADELVLLLVVHHICWDDDSWEVF

SEQ ID NO: 717070 - protein, 21 aa, Mycobacterium
RADENPWWWDVLTHGRSSRYA

SEQ ID NO: 717071 - protein, 19 aa, Mycobacterium
RADEQVKIRGYRIELGEVH

SEQ ID NO: 717072 - protein, 18 aa, Mycobacterium
RADERAKTAIEWLDSKHS

SEQ ID NO: 717073 - protein, 24 aa, Mycobacterium
RADETLPFISIRLWQPISENETEV

SEQ ID NO: 717074 - protein, 20 aa, Mycobacterium
RADFESRQPIGRMVTPVEVA

SEQ ID NO: 717075 - protein, 25 aa, Mycobacterium
RADFGSRLYAALGIARDQTDLLQGY

SEQ ID NO: 717076 - protein, 18 aa, Mycobacterium
RADFGWDVVDATGLPAGE

SEQ ID NO: 717077 - protein, 17 aa, Mycobacterium
RADFISVHLPKTKETAG

SEQ ID NO: 717078 - protein, 20 aa, Mycobacterium
RADFLRLFRRALGGVPPAPT

SEQ ID NO: 717079 - protein, 17 aa, Mycobacterium
RADFPGLGTVLQAYLKR

SEQ ID NO: 717080 - protein, 29 aa, Mycobacterium
RADGALRRSIKFGSFLAGIDAVRRVAEHA

SEQ ID NO: 717081 - protein, 20 aa, Mycobacterium
RADGAVARVGGWGYLLGDDG

SEQ ID NO: 717082 - protein, 21 aa, Mycobacterium
RADGCPDVQLIFARGTAEPPG

SEQ ID NO: 717083 - protein, 24 aa, Mycobacterium
RADGEKWVWAGAAVIYPEYTRALV

SEQ ID NO: 717084 - protein, 19 aa, Mycobacterium
RADGGWLLSGSKVWTSGAH

SEQ ID NO: 717085 - protein, 27 aa, Mycobacterium
RADGRIMAGEIIYSYPISRAVEKGYVK

SEQ ID NO: 717086 - protein, 21 aa, Mycobacterium
RADGRIVGYAMLVRADTDDCD

SEQ ID NO: 717087 - protein, 25 aa, Mycobacterium
RADGRRPPEKGSRVRLHPEPGHLHF

SEQ ID NO: 717088 - protein, 20 aa, Mycobacterium
RADGTVLWMADERAIGEHVV

SEQ ID NO: 717089 - protein, 21 aa, Mycobacterium
RADGYWPQLAAHLAQAATSRP

SEQ ID NO: 717090 - protein, 22 aa, Mycobacterium
RADGYWPQLAARLTEAAMSRPD

SEQ ID NO: 717091 - protein, 18 aa, Mycobacterium
RADHERWNAEDLADAGAG

SEQ ID NO: 717092 - protein, 23 aa, Mycobacterium
RADHLRLALEAAVRGGGDTDTVA

SEQ ID NO: 717093 - protein, 18 aa, Mycobacterium
RADHVVELIGRIGELAVE

SEQ ID NO: 717094 - protein, 27 aa, Mycobacterium
RADIAFVVADAGWKYLSTGAYAGSLDD

SEQ ID NO: 717095 - protein, 27 aa, Mycobacterium
RADIAFVVADAGWKYLSTGAYAGTVDD

SEQ ID NO: 717096 - protein, 24 aa, Mycobacterium
RADIEFPAPAVIYGYGAYEMCEDP

SEQ ID NO: 717097 - protein, 18 aa, Mycobacterium
RADIPIMLGAEGPRNVAL

SEQ ID NO: 717098 - protein, 24 aa, Mycobacterium
RADIPRLVSLYRSGKLLLDEAVTT

SEQ ID NO: 717099 - protein, 21 aa, Mycobacterium
RADIRVGALIDEVADGLVAAP

SEQ ID NO: 717100 - protein, 18 aa, Mycobacterium
RADITAALAANRTAFALH

SEQ ID NO: 717101 - protein, 17 aa, Mycobacterium
RADIVILDIEDAVAPKD

SEQ ID NO: 717102 - protein, 21 aa, Mycobacterium
RADIVKFWIDDRHGTKSKLPP

SEQ ID NO: 717103 - protein, 17 aa, Mycobacterium
RADIVLNNLVGHGFLTG

SEQ ID NO: 717104 - protein, 26 aa, Mycobacterium
RADKAGWLRYGLPASLGGRDGSNVDM

SEQ ID NO: 717105 - protein, 25 aa, Mycobacterium
RADKAGWLRYGLPASLGGRDGTNVD

SEQ ID NO: 717106 - protein, 29 aa, Mycobacterium
RADLGGTWDLFKYPGIRSDSDMFTLGFRF

SEQ ID NO: 717107 - protein, 24 aa, Mycobacterium
RADLGIGPHQVWWLSELTADPAVT

SEQ ID NO: 717108 - protein, 19 aa, Mycobacterium
RADLGKARRDIEADGQESR

SEQ ID NO: 717109 - protein, 22 aa, Mycobacterium
RADLKHGSTFLARNLSVTAAAV

SEQ ID NO: 717110 - protein, 20 aa, Mycobacterium
RADLLRPWANWITPEAEPRR

SEQ ID NO: 717111 - protein, 20 aa, Mycobacterium
RADLPSTPWLIPESTGLDLL

SEQ ID NO: 717112 - protein, 20 aa, Mycobacterium
RADLRGLPIRTTLVELGPIP

SEQ ID NO: 717113 - protein, 23 aa, Mycobacterium
RADLRHGRLRFRLAGTDRGGPGS

SEQ ID NO: 717114 - protein, 17 aa, Mycobacterium
RADLRRVRDLTDRPVGA

SEQ ID NO: 717115 - protein, 24 aa, Mycobacterium
RADMARPRFGSWLRNPTRGSLAMD

SEQ ID NO: 717116 - protein, 23 aa, Mycobacterium
RADPEMFELWDAPTSAPGWPAVT

SEQ ID NO: 717117 - protein, 20 aa, Mycobacterium
RADPQVPVFALGRYAGARRH

SEQ ID NO: 717118 - protein, 23 aa, Mycobacterium
RADPRLPHWRSVTAQALARRDEL

SEQ ID NO: 717119 - protein, 24 aa, Mycobacterium
RADQAGWLRYGLPARFGGRDGTNL

SEQ ID NO: 717120 - protein, 24 aa, Mycobacterium
RADQAGWLRYGLPSRFGGRDGTNV

SEQ ID NO: 717121 - protein, 28 aa, Mycobacterium
RADQDDYLRWAVGAFRLATSGVADSTQI

SEQ ID NO: 717122 - protein, 28 aa, Mycobacterium
RADQEDYLRWAVGSFRLATSGVDDSTQI

SEQ ID NO: 717123 - protein, 20 aa, Mycobacterium
RADRAAAINPRLERLSAEDR

SEQ ID NO: 717124 - protein, 24 aa, Mycobacterium
RADRAALHLACRAEIAGDADAVGE

SEQ ID NO: 717125 - protein, 33 aa, Mycobacterium
RADRDAWEFVLLKGALARELPVFGICRGVQLLN

SEQ ID NO: 717126 - protein, 20 aa, Mycobacterium
RADRDIVDFWLTELGLDDLR

SEQ ID NO: 717127 - protein, 24 aa, Mycobacterium
RADRELRDALEFRLQSLTPEELEV

SEQ ID NO: 717128 - protein, 21 aa, Mycobacterium
RADRFPRIEFAADAIEKTADG

SEQ ID NO: 717129 - protein, 21 aa, Mycobacterium
RADRIVYDFIKRESAKRGIPM

SEQ ID NO: 717130 - protein, 18 aa, Mycobacterium
RADRLGVGDSVIFDATYR

SEQ ID NO: 717131 - protein, 19 aa, Mycobacterium
RADRSVRVVLFSSAGPDFF

SEQ ID NO: 717132 - protein, 24 aa, Mycobacterium
RADRTLECRWWRRDAGGKMIRFVV

SEQ ID NO: 717133 - protein, 20 aa, Mycobacterium
RADRVFLNVGGRAVVPDIPG

SEQ ID NO: 717134 - protein, 19 aa, Mycobacterium
RADSAIGPRLELLADVMTR

SEQ ID NO: 717135 - protein, 20 aa, Mycobacterium
RADSGIEFLDPLPAGGGTPT

SEQ ID NO: 717136 - protein, 18 aa, Mycobacterium
RADSVLGVAGLVNAARAG

SEQ ID NO: 717137 - protein, 23 aa, Mycobacterium
RADTASGRWRLNGTADYVADADV

SEQ ID NO: 717138 - protein, 19 aa, Mycobacterium
RADTEWRSALATFGPHHES

SEQ ID NO: 717139 - protein, 17 aa, Mycobacterium
RADVAAVVAELLGAPNT

SEQ ID NO: 717140 - protein, 23 aa, Mycobacterium
RADVDPALVYHYFGSKEGLLDAA

SEQ ID NO: 717141 - protein, 20 aa, Mycobacterium
RADVHGVITFYHDFRSEPAG

SEQ ID NO: 717142 - protein, 23 aa, Mycobacterium
RADWLADRDKFRNALVNSLQEGF

SEQ ID NO: 717143 - protein, 17 aa, Mycobacterium
RADYGRWPESVGLSVWG

SEQ ID NO: 717144 - protein, 21 aa, Mycobacterium
RAEAAGRRWAERIAKDDTRED

SEQ ID NO: 717145 - protein, 17 aa, Mycobacterium
RAEAGATMEWVDGNIGS

SEQ ID NO: 717146 - protein, 20 aa, Mycobacterium
RAEAGAVWDDVVRKAIDHRL

SEQ ID NO: 717147 - protein, 17 aa, Mycobacterium
RAEAGMYRSCPDITTLV

SEQ ID NO: 717148 - protein, 20 aa, Mycobacterium
RAEALGRAFTDQGITFSLSG

SEQ ID NO: 717149 - protein, 22 aa, Mycobacterium
RAEALRMARGHDVAHDVALVER

SEQ ID NO: 717150 - protein, 22 aa, Mycobacterium
RAEAPPLPWSLVDLGLSSAAPQ

SEQ ID NO: 717151 - protein, 20 aa, Mycobacterium
RAEARLHPKDFGPIETLFND

SEQ ID NO: 717152 - protein, 19 aa, Mycobacterium
RAEARLHPQDFGPIETLFD

SEQ ID NO: 717153 - protein, 17 aa, Mycobacterium
RAEDAGRDPATLDLTVM

SEQ ID NO: 717154 - protein, 18 aa, Mycobacterium
RAEDFTWHRAAAGMLASM

SEQ ID NO: 717155 - protein, 26 aa, Mycobacterium
RAEDGNLWFEWSRSLDNPAEYVLVEA

SEQ ID NO: 717156 - protein, 22 aa, Mycobacterium
RAEDVRQRYKLLLAASTRAAAG

SEQ ID NO: 717157 - protein, 26 aa, Mycobacterium
RAEEGNLWFEWSRSLDDPNEYVLVEA

SEQ ID NO: 717158 - protein, 17 aa, Mycobacterium
RAEFDRIGATNVMTVPL

SEQ ID NO: 717159 - protein, 22 aa, Mycobacterium
RAEFPDAEIVDLEGAFVAPAFV

SEQ ID NO: 717160 - protein, 28 aa, Mycobacterium
RAEGALRRSVKFPAFLDGIDAVRRVAEH

SEQ ID NO: 717161 - protein, 18 aa, Mycobacterium
RAEGCTDEAAAVLKEIED

SEQ ID NO: 717162 - protein, 19 aa, Mycobacterium
RAEGIRPPAIIVIGPVAAF

SEQ ID NO: 717163 - protein, 24 aa, Mycobacterium
RAEGLRAAMVAPIVRAHRLYGLLY

SEQ ID NO: 717164 - protein, 20 aa, Mycobacterium
RAEGRFYLPDGRRLGFAEFG

SEQ ID NO: 717165 - protein, 30 aa, Mycobacterium
RAEGTFEYQALLFIPSHAPFDLFQQNATVG

SEQ ID NO: 717166 - protein, 21 aa, Mycobacterium
RAEGVPYRYVLGLADLGLAGS

SEQ ID NO: 717167 - protein, 18 aa, Mycobacterium
RAEGYVLTPGRYVGTGAS

SEQ ID NO: 717168 - protein, 28 aa, Mycobacterium
RAEHESKLWIRKMEMAIANKELDVTLKQ

SEQ ID NO: 717169 - protein, 18 aa, Mycobacterium
RAEHPEIGFTCVIVGECA

SEQ ID NO: 717170 - protein, 18 aa, Mycobacterium
RAEHRFGATLAFERSAEK

SEQ ID NO: 717171 - protein, 21 aa, Mycobacterium
RAEIAERWSVWRTEKARRATK

SEQ ID NO: 717172 - protein, 20 aa, Mycobacterium
RAEIDALLARLPEPGAGDTP

SEQ ID NO: 717173 - protein, 20 aa, Mycobacterium
RAEIDALLARLPRPGDQEDP

SEQ ID NO: 717174 - protein, 18 aa, Mycobacterium
RAEIKGFTSSFVFDEDGA

SEQ ID NO: 717175 - protein, 24 aa, Mycobacterium
RAEKDLRAPFAPRGWFEGLTIEQL

SEQ ID NO: 717176 - protein, 20 aa, Mycobacterium
RAELAAGLSALTRGEEHPLV

SEQ ID NO: 717177 - protein, 21 aa, Mycobacterium
RAELAFKLAAGGRRVAVVSSG

SEQ ID NO: 717178 - protein, 20 aa, Mycobacterium
RAELAQMCRGLACRVKPGGR

SEQ ID NO: 717179 - protein, 18 aa, Mycobacterium
RAELARVRADAEAEVAAA

SEQ ID NO: 717180 - protein, 21 aa, Mycobacterium
RAELESVLAAGARRATEVSAK

SEQ ID NO: 717181 - protein, 23 aa, Mycobacterium
RAELIAWLLERGFSLEHIQASAA

SEQ ID NO: 717182 - protein, 17 aa, Mycobacterium
RAELKDRLKRGGTNLKQ

SEQ ID NO: 717183 - protein, 22 aa, Mycobacterium
RAELKMPLILLGGITNRETMDL

SEQ ID NO: 717184 - protein, 18 aa, Mycobacterium
RAELLAALSVAIDLGLGQ

SEQ ID NO: 717185 - protein, 17 aa, Mycobacterium
RAELQRLGRPVFGPTFE

SEQ ID NO: 717186 - protein, 18 aa, Mycobacterium
RAELRYRAVPDRYLSFPD

SEQ ID NO: 717187 - protein, 23 aa, Mycobacterium
RAEMEMKVLLWAVQRLIAGLSHI

SEQ ID NO: 717188 - protein, 23 aa, Mycobacterium
RAEMEMKVLLWAVQRLIGGLSAI

SEQ ID NO: 717189 - protein, 23 aa, Mycobacterium
RAEMEMKVLLWAVQRLIGGLSTI

SEQ ID NO: 717190 - protein, 23 aa, Mycobacterium
RAEMEMKVLLWAVQRLISGLSKI

SEQ ID NO: 717191 - protein, 17 aa, Mycobacterium
RAEMITLPMVYVNVPEM

SEQ ID NO: 717192 - protein, 20 aa, Mycobacterium
RAEMLRRGRTPVPAELEAEF

SEQ ID NO: 717193 - protein, 22 aa, Mycobacterium
RAEMSRLRRVIGSNYIASRPYR

SEQ ID NO: 717194 - protein, 20 aa, Mycobacterium
RAEMSRLRRVVGEQLIASRP

SEQ ID NO: 717195 - protein, 17 aa, Mycobacterium
RAEPGCVFNADPAVAAR

SEQ ID NO: 717196 - protein, 25 aa, Mycobacterium
RAEPGYRPSTALAEFVRFRDLTCRF

SEQ ID NO: 717197 - protein, 23 aa, Mycobacterium
RAEPNRRDWRVLSIMHLSDTRDQ

SEQ ID NO: 717198 - protein, 24 aa, Mycobacterium
RAEPWGVWGGEIFDRGSVLSFKRP

SEQ ID NO: 717199 - protein, 24 aa, Mycobacterium
RAEPWGVWGGEIFERGAIVSRKRP

SEQ ID NO: 717200 - protein, 30 aa, Mycobacterium
RAEQPIVIVAPMFHAWGFSQLVLAASLACT

SEQ ID NO: 717201 - protein, 30 aa, Mycobacterium
RAEQPVVIVAPMFHAWGFSQLAFAASMSCT

SEQ ID NO: 717202 - protein, 23 aa, Mycobacterium
RAERARAGGGFEPVAELTTASGS

SEQ ID NO: 717203 - protein, 25 aa, Mycobacterium
RAERDCTYYTALIMWIGCHADSHEY

SEQ ID NO: 717204 - protein, 22 aa, Mycobacterium
RAERDLAQRAVRRSGVDPMETA

SEQ ID NO: 717205 - protein, 23 aa, Mycobacterium
RAEREAFDLLALQQPVAGELRVV

SEQ ID NO: 717206 - protein, 26 aa, Mycobacterium
RAEREARLSRPLFVMPTKGVWTSGFG

SEQ ID NO: 717207 - protein, 22 aa, Mycobacterium
RAEREGLEWLAEIGAHGVVAGP

SEQ ID NO: 717208 - protein, 20 aa, Mycobacterium
RAERGESHLGFISAASKCLA

SEQ ID NO: 717209 - protein, 24 aa, Mycobacterium
RAERGGPRFGSWLRNSTRGALAMD

SEQ ID NO: 717210 - protein, 21 aa, Mycobacterium
RAERLGLPAVVAFTGTTSVGL

SEQ ID NO: 717211 - protein, 20 aa, Mycobacterium
RAERYLGIIDRVRAAMPNAA

SEQ ID NO: 717212 - protein, 25 aa, Mycobacterium
RAESGKRGALLLALGSPGGSVIIQF

SEQ ID NO: 717213 - protein, 23 aa, Mycobacterium
RAESYWRDWAQTLTLPERKPGLM

SEQ ID NO: 717214 - protein, 19 aa, Mycobacterium
RAETHLTVIEPRREQLSGD

SEQ ID NO: 717215 - protein, 17 aa, Mycobacterium
RAETLGDDIAWMRFGKD

SEQ ID NO: 717216 - protein, 25 aa, Mycobacterium
RAETPLRLVSLVSIDPIPGGDDDQS

SEQ ID NO: 717217 - protein, 21 aa, Mycobacterium
RAEVIDCARELSAAPQLGSAE

SEQ ID NO: 717218 - protein, 22 aa, Mycobacterium
RAEVLKCAKGFRYYAENTEALL

SEQ ID NO: 717219 - protein, 20 aa, Mycobacterium
RAEVVLCLRDPGPVTGIARS

SEQ ID NO: 717220 - protein, 18 aa, Mycobacterium
RAEWYLRQMLGTANFKAG

SEQ ID NO: 717221 - protein, 20 aa, Mycobacterium
RAFAALCGNASGAVDDGPIV

SEQ ID NO: 717222 - protein, 17 aa, Mycobacterium
RAFAARHAEVIFTSHGN

SEQ ID NO: 717223 - protein, 20 aa, Mycobacterium
RAFAPILARNGGGAILNVLS

SEQ ID NO: 717224 - protein, 20 aa, Mycobacterium
RAFARARLAAPTADAYLAEI

SEQ ID NO: 717225 - protein, 19 aa, Mycobacterium
RAFATAGIDVETWRIHRSI

SEQ ID NO: 717226 - protein, 24 aa, Mycobacterium
RAFCAACLAPLIGGDRFDFTLDLG

SEQ ID NO: 717227 - protein, 25 aa, Mycobacterium
RAFCTACLDPLVGGERFDFVQDLGA

SEQ ID NO: 717228 - protein, 26 aa, Mycobacterium
RAFDDGVFCALALPPAVGENEALMRC

SEQ ID NO: 717229 - protein, 25 aa, Mycobacterium
RAFDGAREEVDWLVPDFIARGQSYA

SEQ ID NO: 717230 - protein, 20 aa, Mycobacterium
RAFDGFRAGQHINVSVEIDG

SEQ ID NO: 717231 - protein, 26 aa, Mycobacterium
RAFDLAARRRLPVVLFAEGGGGRPGD

SEQ ID NO: 717232 - protein, 21 aa, Mycobacterium
RAFDSCCQVLGSVDLAFLNAG

SEQ ID NO: 717233 - protein, 17 aa, Mycobacterium
RAFEGVDVRLSRYSYLV

SEQ ID NO: 717234 - protein, 30 aa, Mycobacterium
RAFEPEPAPFVPMVAPWASVPEPVRSPAPE

SEQ ID NO: 717235 - protein, 25 aa, Mycobacterium
RAFHERFVQALAFGGSQYASAEAAN

SEQ ID NO: 717236 - protein, 21 aa, Mycobacterium
RAFHNVCRRRGHTVAAPDFRA

SEQ ID NO: 717237 - protein, 24 aa, Mycobacterium
RAFIKNRLSKFHVPRDVYFVEALP

SEQ ID NO: 717238 - protein, 24 aa, Mycobacterium
RAFPIEVPAGVGFIRNAGLVTEGT

SEQ ID NO: 717239 - protein, 23 aa, Mycobacterium
RAFPKGLAAFIGIRDRTCRTPYC

SEQ ID NO: 717240 - protein, 19 aa, Mycobacterium
RAFPSRMVHMLAGNAPSGC

SEQ ID NO: 717241 - protein, 25 aa, Mycobacterium
RAFPTEVPTGVGFMKRSGLVTDGRP

SEQ ID NO: 717242 - protein, 20 aa, Mycobacterium
RAFQNVCRHRGNSLCAGSGS

SEQ ID NO: 717243 - protein, 22 aa, Mycobacterium
RAFRHLDLPPVVLDEAAASAAL

SEQ ID NO: 717244 - protein, 29 aa, Mycobacterium
RAFRNRLWPGASLRWITANGHSAVLVVHD

SEQ ID NO: 717245 - protein, 17 aa, Mycobacterium
RAFRPGRLPFPVMHVDT

SEQ ID NO: 717246 - protein, 17 aa, Mycobacterium
RAFSEVMDLAIAMGGTI

SEQ ID NO: 717247 - protein, 17 aa, Mycobacterium
RAFSGVKIACVGESTAD

SEQ ID NO: 717248 - protein, 17 aa, Mycobacterium
RAFTFPLEKVRVLIVGQ

SEQ ID NO: 717249 - protein, 23 aa, Mycobacterium
RAFVDDLLLRYGVAQPAEPQRRT

SEQ ID NO: 717250 - protein, 19 aa, Mycobacterium
RAFVEDVRRAGLHDKIEGL

SEQ ID NO: 717251 - protein, 19 aa, Mycobacterium
RAFVTGGSRGIGAGIVRRL

SEQ ID NO: 717252 - protein, 18 aa, Mycobacterium
RAFWPGALSLVVVQAPSL

SEQ ID NO: 717253 - protein, 20 aa, Mycobacterium
RAFYGPQFALTFPVLTHHGV

SEQ ID NO: 717254 - protein, 18 aa, Mycobacterium
RAGAAARFGSVRIAAEDA

SEQ ID NO: 717255 - protein, 18 aa, Mycobacterium
RAGAAYAEGLVAHVADRL

SEQ ID NO: 717256 - protein, 20 aa, Mycobacterium
RAGADAIYPGYGFLSENPEL

SEQ ID NO: 717257 - protein, 21 aa, Mycobacterium
RAGADTTRWRQLTATLDPHIA

SEQ ID NO: 717258 - protein, 20 aa, Mycobacterium
RAGAGIPLVHATPMPYDNYF

SEQ ID NO: 717259 - protein, 26 aa, Mycobacterium
RAGAGPLRLFGHRGVSNAHLRAAIGA

SEQ ID NO: 717260 - protein, 25 aa, Mycobacterium
RAGALDGFVPFPADRAAAYRAAGYW

SEQ ID NO: 717261 - protein, 27 aa, Mycobacterium
RAGALRLAPGLKRNSLIGGIRYYDTVV

SEQ ID NO: 717262 - protein, 31 aa, Mycobacterium
RAGALRLSPGLKRGALIGGIRYYDTVVDDAR

SEQ ID NO: 717263 - protein, 20 aa, Mycobacterium
RAGALYAHPFHPIYTERVRS

SEQ ID NO: 717264 - protein, 18 aa, Mycobacterium
RAGANVAVAGRSTADIDA

SEQ ID NO: 717265 - protein, 19 aa, Mycobacterium
RAGAQHWSQSCAEQQLFSQ

SEQ ID NO: 717266 - protein, 18 aa, Mycobacterium
RAGARILLSPDGPDLRVQ

SEQ ID NO: 717267 - protein, 18 aa, Mycobacterium
RAGARILLSPEGPDLRVQ

SEQ ID NO: 717268 - protein, 18 aa, Mycobacterium
RAGARLGAIGAEGDSGDG

SEQ ID NO: 717269 - protein, 21 aa, Mycobacterium
RAGASIGMVRACAAEQTPLLG

SEQ ID NO: 717270 - protein, 21 aa, Mycobacterium
RAGASLAVLNHVPFPGMVADF

SEQ ID NO: 717271 - protein, 18 aa, Mycobacterium
RAGATVIEASVAYEATDA

SEQ ID NO: 717272 - protein, 18 aa, Mycobacterium
RAGAVPFAERAAAELRAA

SEQ ID NO: 717273 - protein, 25 aa, Mycobacterium
RAGDGVSYGHTWLAPRDTTLALIPA

SEQ ID NO: 717274 - protein, 17 aa, Mycobacterium
RAGDGWITADAQIVRTI

SEQ ID NO: 717275 - protein, 23 aa, Mycobacterium
RAGDPEFLPLVRRLARFLPADLR

SEQ ID NO: 717276 - protein, 20 aa, Mycobacterium
RAGDRSRLVAAFRKLAEAHL

SEQ ID NO: 717277 - protein, 23 aa, Mycobacterium
RAGDSRLATVLAELDDADTRAAV

SEQ ID NO: 717278 - protein, 24 aa, Mycobacterium
RAGDTRLAAVLAELDDADTRASVT

SEQ ID NO: 717279 - protein, 19 aa, Mycobacterium
RAGEGVGLLVADVDRAVID

SEQ ID NO: 717280 - protein, 22 aa, Mycobacterium
RAGEHCQGWLPAKLGPDEIASG

SEQ ID NO: 717281 - protein, 21 aa, Mycobacterium
RAGEITAEMAYIAAREDMPAE

SEQ ID NO: 717282 - protein, 25 aa, Mycobacterium
RAGELMGGAVARWAEETDRDPPRLQ

SEQ ID NO: 717283 - protein, 28 aa, Mycobacterium
RAGELRRLKLCAAPDCEASLIDLSRNRS

SEQ ID NO: 717284 - protein, 23 aa, Mycobacterium
RAGEPCRRCGTLIQTDRGGERVT

SEQ ID NO: 717285 - protein, 22 aa, Mycobacterium
RAGEPFVGPAGRLLARALEDAG

SEQ ID NO: 717286 - protein, 20 aa, Mycobacterium
RAGEPVDVFIARAVAARIAV

SEQ ID NO: 717287 - protein, 19 aa, Mycobacterium
RAGESFAPSDFWTGYTPSK

SEQ ID NO: 717288 - protein, 20 aa, Mycobacterium
RAGESSGFWSGQLDADIGAT

SEQ ID NO: 717289 - protein, 17 aa, Mycobacterium
RAGEVRAAVPINAPTAP

SEQ ID NO: 717290 - protein, 17 aa, Mycobacterium
RAGFDAAALLEVVIGSA

SEQ ID NO: 717291 - protein, 23 aa, Mycobacterium
RAGFRACKRCRPDASPGSPEWNV

SEQ ID NO: 717292 - protein, 24 aa, Mycobacterium
RAGFRACKRCRPDASPGSPEWNVR

SEQ ID NO: 717293 - protein, 19 aa, Mycobacterium
RAGGAHRVAVVNAQVKVSK

SEQ ID NO: 717294 - protein, 21 aa, Mycobacterium
RAGGELAWELAATKLGRFVGL

SEQ ID NO: 717295 - protein, 19 aa, Mycobacterium
RAGGEPLLLPTALGHARSA

SEQ ID NO: 717296 - protein, 26 aa, Mycobacterium
RAGGFKHRAKVEISWVGSDDCQTDGG

SEQ ID NO: 717297 - protein, 20 aa, Mycobacterium
RAGGGAAHVYPCDLSDMDAI

SEQ ID NO: 717298 - protein, 20 aa, Mycobacterium
RAGGIDFRLFRTIVFRTDLI

SEQ ID NO: 717299 - protein, 17 aa, Mycobacterium
RAGGILISGSAAGNSPI

SEQ ID NO: 717300 - protein, 19 aa, Mycobacterium
RAGGINELLARCTDVLVWG

SEQ ID NO: 717301 - protein, 19 aa, Mycobacterium
RAGGLTFAGMMAIPPLGAD

SEQ ID NO: 717302 - protein, 25 aa, Mycobacterium
RAGGPSGSTAPCWPSATHRRPCSGC

SEQ ID NO: 717303 - protein, 19 aa, Mycobacterium
RAGGTILWMADERAIGDHV

SEQ ID NO: 717304 - protein, 24 aa, Mycobacterium
RAGGYRGAVAYARTKRMQVAFTPL

SEQ ID NO: 717305 - protein, 32 aa, Mycobacterium
RAGHEMINFLIRKGVRLIRCAGWSDYYPNHKG

SEQ ID NO: 717306 - protein, 31 aa, Mycobacterium
RAGHLRAGAAVSRPGPRHVRRLDRRDARRTA

SEQ ID NO: 717307 - protein, 27 aa, Mycobacterium
RAGHMLERARWAAAAYGEYDAATVEGI

SEQ ID NO: 717308 - protein, 17 aa, Mycobacterium
RAGHTVWTYELAEPTSP

SEQ ID NO: 717309 - protein, 33 aa, Mycobacterium
RAGIARLAAELGLTRFQLLLAAFTWSLYGVTGR

SEQ ID NO: 717310 - protein, 18 aa, Mycobacterium
RAGIARQLGDLGVKSIDV

SEQ ID NO: 717311 - protein, 17 aa, Mycobacterium
RAGIAVRAALSRLGRPY

SEQ ID NO: 717312 - protein, 20 aa, Mycobacterium
RAGIELLALGGRFIELGKRD

SEQ ID NO: 717313 - protein, 18 aa, Mycobacterium
RAGIERILADAGHDVIAG

SEQ ID NO: 717314 - protein, 17 aa, Mycobacterium
RAGIERILTDAGHQVVA

SEQ ID NO: 717315 - protein, 17 aa, Mycobacterium
RAGIGVGVVAADRAHVV

SEQ ID NO: 717316 - protein, 19 aa, Mycobacterium
RAGIKDVVLESAVTTIMDF

SEQ ID NO: 717317 - protein, 22 aa, Mycobacterium
RAGIPPFYVMDVWLAAAERQRT

SEQ ID NO: 717318 - protein, 24 aa, Mycobacterium
RAGIPTLILWLWLDQPVWAVGVNQ

SEQ ID NO: 717319 - protein, 18 aa, Mycobacterium
RAGIPVWTGSPLVRLEGD

SEQ ID NO: 717320 - protein, 18 aa, Mycobacterium
RAGKAGLVPPHLRDGHYS

SEQ ID NO: 717321 - protein, 24 aa, Mycobacterium
RAGKAGLVPPHLRDGHYSGAAKLG

SEQ ID NO: 717322 - protein, 18 aa, Mycobacterium
RAGKAGQVPAHLRDGHYS

SEQ ID NO: 717323 - protein, 17 aa, Mycobacterium
RAGKHRPVHLLGFGEGH

SEQ ID NO: 717324 - protein, 18 aa, Mycobacterium
RAGKHRPVHLLGFGEGHT

SEQ ID NO: 717325 - protein, 19 aa, Mycobacterium
RAGLATVFIPSRNEPDLDD

SEQ ID NO: 717326 - protein, 19 aa, Mycobacterium
RAGLDADLVVLDRDLRVAA

SEQ ID NO: 717327 - protein, 17 aa, Mycobacterium
RAGLGPFDDAWRTQMSF

SEQ ID NO: 717328 - protein, 17 aa, Mycobacterium
RAGLGSDVRAFWGDELK

SEQ ID NO: 717329 - protein, 17 aa, Mycobacterium
RAGLGSSVPDFWEGELQ

SEQ ID NO: 717330 - protein, 19 aa, Mycobacterium
RAGLGWGMYPEDLVDASFV

SEQ ID NO: 717331 - protein, 19 aa, Mycobacterium
RAGLGYLLKDRVAHVRHFL

SEQ ID NO: 717332 - protein, 20 aa, Mycobacterium
RAGLIAPMRPDRYVRIAAAM

SEQ ID NO: 717333 - protein, 27 aa, Mycobacterium
RAGLIESWTPIPGRFPSYLVEHMTGVE

SEQ ID NO: 717334 - protein, 20 aa, Mycobacterium
RAGLIQVMRDMLAAPDQFDW

SEQ ID NO: 717335 - protein, 20 aa, Mycobacterium
RAGLKPSDVALWEINEAFAS

SEQ ID NO: 717336 - protein, 18 aa, Mycobacterium
RAGLKTRVLVDLTAATTA

SEQ ID NO: 717337 - protein, 18 aa, Mycobacterium
RAGLPLASTTYYFSSLDD

SEQ ID NO: 717338 - protein, 18 aa, Mycobacterium
RAGLPPTLAVAGSYLDGI

SEQ ID NO: 717339 - protein, 17 aa, Mycobacterium
RAGLPVLVAPPSVPFSV

SEQ ID NO: 717340 - protein, 19 aa, Mycobacterium
RAGLPVTILDVRWQLGEPD

SEQ ID NO: 717341 - protein, 22 aa, Mycobacterium
RAGLQRRLERRIGMPLEDTNMV

SEQ ID NO: 717342 - protein, 24 aa, Mycobacterium
RAGLRLAEVVDIYLSGYADRPALG

SEQ ID NO: 717343 - protein, 19 aa, Mycobacterium
RAGLSTVFIPARNEPDLDD

SEQ ID NO: 717344 - protein, 20 aa, Mycobacterium
RAGLTASRFVACPFGAAGAR

SEQ ID NO: 717345 - protein, 17 aa, Mycobacterium
RAGLWVHCETVSPLSGT

SEQ ID NO: 717346 - protein, 26 aa, Mycobacterium
RAGMCKRKELSVRTVAGDVWTWTDHE

SEQ ID NO: 717347 - protein, 19 aa, Mycobacterium
RAGMPCLGCTEPEFPHFDL

SEQ ID NO: 717348 - protein, 17 aa, Mycobacterium
RAGNCKFHAAARNFNPP

SEQ ID NO: 717349 - protein, 18 aa, Mycobacterium
RAGNCVFHAAARNFNPPA

SEQ ID NO: 717350 - protein, 20 aa, Mycobacterium
RAGNDGMQWGMLRGAGLRVE

SEQ ID NO: 717351 - protein, 18 aa, Mycobacterium
RAGPAIGEIQVADVPGRC

SEQ ID NO: 717352 - protein, 17 aa, Mycobacterium
RAGPAIVEDALRCAAGL

SEQ ID NO: 717353 - protein, 20 aa, Mycobacterium
RAGPEIGVAATKTFLAQVTA

SEQ ID NO: 717354 - protein, 18 aa, Mycobacterium
RAGPGDGVAEAMLDALNQ

SEQ ID NO: 717355 - protein, 17 aa, Mycobacterium
RAGPLSCPADYQLLLAL

SEQ ID NO: 717356 - protein, 17 aa, Mycobacterium
RAGPRPPTGLQVGMMVE

SEQ ID NO: 717357 - protein, 17 aa, Mycobacterium
RAGQAAWLSVMYAIVEA

SEQ ID NO: 717358 - protein, 22 aa, Mycobacterium
RAGQARPIWYLVPDGVVQYVAK

SEQ ID NO: 717359 - protein, 23 aa, Mycobacterium
RAGQKTGEFCYFPVDSTAIALQA

SEQ ID NO: 717360 - protein, 21 aa, Mycobacterium
RAGQPCRRCATGIERQGPDGS

SEQ ID NO: 717361 - protein, 19 aa, Mycobacterium
RAGQYLTHCFDVDGVTVKR

SEQ ID NO: 717362 - protein, 18 aa, Mycobacterium
RAGRAVVAHHVFRADATA

SEQ ID NO: 717363 - protein, 24 aa, Mycobacterium
RAGRCGRVAPGICIRLYSEDDFAA

SEQ ID NO: 717364 - protein, 24 aa, Mycobacterium
RAGRDIKAGRVWTNCYHAYPAHAA

SEQ ID NO: 717365 - protein, 18 aa, Mycobacterium
RAGRDIQAGRVWVNCYHA

SEQ ID NO: 717366 - protein, 18 aa, Mycobacterium
RAGRDIQAGRVWVNCYHV

SEQ ID NO: 717367 - protein, 18 aa, Mycobacterium
RAGRELSRRIPGSHGHRA

SEQ ID NO: 717368 - protein, 21 aa, Mycobacterium
RAGRFGDRVFVKFGEQQLTYR

SEQ ID NO: 717369 - protein, 21 aa, Mycobacterium
RAGRIDVLVCTTVIEVGVDVP

SEQ ID NO: 717370 - protein, 17 aa, Mycobacterium
RAGRPADALTWYRAALE

SEQ ID NO: 717371 - protein, 17 aa, Mycobacterium
RAGRPSLSYAVAPRLDY

SEQ ID NO: 717372 - protein, 18 aa, Mycobacterium
RAGRRARLGASPELAGAR

SEQ ID NO: 717373 - protein, 17 aa, Mycobacterium
RAGRRFLNEAGEYNSMA

SEQ ID NO: 717374 - protein, 27 aa, Mycobacterium
RAGRRKLLGRRVVLPGVGLYLDGGFGV

SEQ ID NO: 717375 - protein, 17 aa, Mycobacterium
RAGRTKTWEKFEVPDEG

SEQ ID NO: 717376 - protein, 24 aa, Mycobacterium
RAGRWPVDGMFPLTRDVSNSTVGI

SEQ ID NO: 717377 - protein, 24 aa, Mycobacterium
RAGRWSGCIRTEIDLPTLADRICQ

SEQ ID NO: 717378 - protein, 20 aa, Mycobacterium
RAGSAIARFAGPTAGSLTCK

SEQ ID NO: 717379 - protein, 21 aa, Mycobacterium
RAGSALFDRLFRLSRTTLDAM

SEQ ID NO: 717380 - protein, 20 aa, Mycobacterium
RAGSALINMEFIQFHPTGMV

SEQ ID NO: 717381 - protein, 19 aa, Mycobacterium
RAGSAMKRAMETAGLSPKD

SEQ ID NO: 717382 - protein, 25 aa, Mycobacterium
RAGSGEVRPGDLVAFAAGALANGYV

SEQ ID NO: 717383 - protein, 20 aa, Mycobacterium
RAGSGLINMEFIQFHPTGMV

SEQ ID NO: 717384 - protein, 21 aa, Mycobacterium
RAGSIGPLSVPASWTAPSTGP

SEQ ID NO: 717385 - protein, 27 aa, Mycobacterium
RAGSILCDPWVNPAYFASWFPFPDNSQ

SEQ ID NO: 717386 - protein, 18 aa, Mycobacterium
RAGSLSWDLSWKDAAAPL

SEQ ID NO: 717387 - protein, 18 aa, Mycobacterium
RAGSMPMAKASARLQVHP

SEQ ID NO: 717388 - protein, 20 aa, Mycobacterium
RAGSRLGRGAGFYDRTLALV

SEQ ID NO: 717389 - protein, 18 aa, Mycobacterium
RAGSSSVVLPPQQVPVFR

SEQ ID NO: 717390 - protein, 17 aa, Mycobacterium
RAGSVAWDLAWTDAGAP

SEQ ID NO: 717391 - protein, 23 aa, Mycobacterium
RAGSVPLLGRFSLSGGLPDQADA

SEQ ID NO: 717392 - protein, 20 aa, Mycobacterium
RAGTDELRAWFDGASGATAE

SEQ ID NO: 717393 - protein, 19 aa, Mycobacterium
RAGTMEKFGLGYQSLKQLN

SEQ ID NO: 717394 - protein, 21 aa, Mycobacterium
RAGTVSGLYVCEMVTARALVE

SEQ ID NO: 717395 - protein, 19 aa, Mycobacterium
RAGVAFTPINYRLSADAIQ

SEQ ID NO: 717396 - protein, 24 aa, Mycobacterium
RAGVARSGFYFYFDSKYAVLAQIL

SEQ ID NO: 717397 - protein, 24 aa, Mycobacterium
RAGVARSGFYFYFDSKYAVLAVII

SEQ ID NO: 717398 - protein, 24 aa, Mycobacterium
RAGVARSGFYFYFDSKYSVLAQLM

SEQ ID NO: 717399 - protein, 20 aa, Mycobacterium
RAGVGILILTHYVPAIAPGT

SEQ ID NO: 717400 - protein, 20 aa, Mycobacterium
RAGVGKAAIYRRWSSKAALI

SEQ ID NO: 717401 - protein, 24 aa, Mycobacterium
RAGVGKAAIYRRWSSKAALTADAI

SEQ ID NO: 717402 - protein, 24 aa, Mycobacterium
RAGVGRSGFYFYFDSKYSVLAQMV

SEQ ID NO: 717403 - protein, 18 aa, Mycobacterium
RAGVKFSVVMPTFVNTEL

SEQ ID NO: 717404 - protein, 18 aa, Mycobacterium
RAGVPIEVVVRGICALRP

SEQ ID NO: 717405 - protein, 18 aa, Mycobacterium
RAGVPIVQVDPAYTSQRC

SEQ ID NO: 717406 - protein, 18 aa, Mycobacterium
RAGVPTLILWTVGDQPFW

SEQ ID NO: 717407 - protein, 18 aa, Mycobacterium
RAGVPTLTLWTAGDQPFW

SEQ ID NO: 717408 - protein, 20 aa, Mycobacterium
RAGVQAGDHVGLWMPASLDM

SEQ ID NO: 717409 - protein, 18 aa, Mycobacterium
RAGVQVLVNNAGFGTSGE

SEQ ID NO: 717410 - protein, 19 aa, Mycobacterium
RAGVSPADIDVCQLYDSFT

SEQ ID NO: 717411 - protein, 19 aa, Mycobacterium
RAGVSRPSVYRRWPDVRTL

SEQ ID NO: 717412 - protein, 19 aa, Mycobacterium
RAGVSRPTVYRRWPDTHSV

SEQ ID NO: 717413 - protein, 17 aa, Mycobacterium
RAGVVLIAGAETWRTRT

SEQ ID NO: 717414 - protein, 19 aa, Mycobacterium
RAGWADRVRLAHALGPTMI

SEQ ID NO: 717415 - protein, 17 aa, Mycobacterium
RAGWLALMSDDVVIEDP

SEQ ID NO: 717416 - protein, 17 aa, Mycobacterium
RAGWLRWSDKLAAAPLR

SEQ ID NO: 717417 - protein, 17 aa, Mycobacterium
RAGYAVGDPELLRRLAR

SEQ ID NO: 717418 - protein, 25 aa, Mycobacterium
RAGYGSLIQMIWIYDRAVDVEGLRR

SEQ ID NO: 717419 - protein, 20 aa, Mycobacterium
RAHAAQWALPGGRVDPGETA

SEQ ID NO: 717420 - protein, 34 aa, Mycobacterium
RAHACPQLRMRVHARSALTYPQWVAAGVEPEQVV

SEQ ID NO: 717421 - protein, 22 aa, Mycobacterium
RAHAVAVPPMFADLVNAPTRRR

SEQ ID NO: 717422 - protein, 22 aa, Mycobacterium
RAHAVAVPPMFSDLVSAPTRRQ

SEQ ID NO: 717423 - protein, 17 aa, Mycobacterium
RAHAVAVVGRDPRASGE

SEQ ID NO: 717424 - protein, 24 aa, Mycobacterium
RAHAVLYIHLLGSIQLAHHLRDSG

SEQ ID NO: 717425 - protein, 19 aa, Mycobacterium
RAHAVVLFRAGLLTEEQRD

SEQ ID NO: 717426 - protein, 24 aa, Mycobacterium
RAHCARGLGIWDWASNAPNEPDVV

SEQ ID NO: 717427 - protein, 21 aa, Mycobacterium
RAHCPQLRFLHLSGSADVIGR

SEQ ID NO: 717428 - protein, 19 aa, Mycobacterium
RAHDLGVTCSIFVDQIHYW

SEQ ID NO: 717429 - protein, 25 aa, Mycobacterium
RAHDLWDNRILPFAHNLSAREVARA

SEQ ID NO: 717430 - protein, 30 aa, Mycobacterium
RAHDVSRSWLYFGLIRFRVGALDEADECWG

SEQ ID NO: 717431 - protein, 26 aa, Mycobacterium
RAHDVSRSWLYFGLIRLGIGRLQEAN

SEQ ID NO: 717432 - protein, 19 aa, Mycobacterium
RAHGADMLLLIVAALDQSA

SEQ ID NO: 717433 - protein, 20 aa, Mycobacterium
RAHGADMLLLIVAALEQSAL

SEQ ID NO: 717434 - protein, 23 aa, Mycobacterium
RAHGASLRAVHPLLGAHVHLREE

SEQ ID NO: 717435 - protein, 24 aa, Mycobacterium
RAHGFSSRVIRCLYPVAEGGAGLR

SEQ ID NO: 717436 - protein, 19 aa, Mycobacterium
RAHGGRLLVRLAGVADRNG

SEQ ID NO: 717437 - protein, 17 aa, Mycobacterium
RAHGIAFETSWLDPFTE

SEQ ID NO: 717438 - protein, 18 aa, Mycobacterium
RAHGSAHLLGTPQQLLAR

SEQ ID NO: 717439 - protein, 19 aa, Mycobacterium
RAHGSALFQRGETQILGVT

SEQ ID NO: 717440 - protein, 18 aa, Mycobacterium
RAHGSTHLLASPPELLRR

SEQ ID NO: 717441 - protein, 17 aa, Mycobacterium
RAHGSTHLLDSPRNLLR

SEQ ID NO: 717442 - protein, 19 aa, Mycobacterium
RAHHAFIYVRGEVLPVLRR

SEQ ID NO: 717443 - protein, 23 aa, Mycobacterium
RAHHCPQRENCVLAYRAPGPRLL

SEQ ID NO: 717444 - protein, 18 aa, Mycobacterium
RAHIKEVAEHGGMAQAIS

SEQ ID NO: 717445 - protein, 18 aa, Mycobacterium
RAHISPRLQAYVEPSTNV

SEQ ID NO: 717446 - protein, 21 aa, Mycobacterium
RAHLADLTRYLLAIRRRLDGL

SEQ ID NO: 717447 - protein, 18 aa, Mycobacterium
RAHLLLRFDGAKWIAIDN

SEQ ID NO: 717448 - protein, 24 aa, Mycobacterium
RAHLQEWQEFTAPTARDAANAAVE

SEQ ID NO: 717449 - protein, 19 aa, Mycobacterium
RAHPACALTGPAEAEIAVI

SEQ ID NO: 717450 - protein, 19 aa, Mycobacterium
RAHPAKVLLERAGSLVHST

SEQ ID NO: 717451 - protein, 17 aa, Mycobacterium
RAHQARCAALIGGYART

SEQ ID NO: 717452 - protein, 19 aa, Mycobacterium
RAHQLLRLPLRALHATSSG

SEQ ID NO: 717453 - protein, 28 aa, Mycobacterium
RAHREGIKHLKFIFYDWNRLGDGEAQRY

SEQ ID NO: 717454 - protein, 19 aa, Mycobacterium
RAHRGLQVVGGRGSGAVMV

SEQ ID NO: 717455 - protein, 22 aa, Mycobacterium
RAHRLPWPTGTVVYEIDQPQVM

SEQ ID NO: 717456 - protein, 17 aa, Mycobacterium
RAHRPDTIELWRKISTV

SEQ ID NO: 717457 - protein, 19 aa, Mycobacterium
RAHRPVRTVVCANTFDELS

SEQ ID NO: 717458 - protein, 24 aa, Mycobacterium
RAHSAAEHRAHLAGRAAGQAAQSG

SEQ ID NO: 717459 - protein, 18 aa, Mycobacterium
RAHSAVAVGQAWNPLSVR

SEQ ID NO: 717460 - protein, 17 aa, Mycobacterium
RAHVEAFARYYRYPFRP

SEQ ID NO: 717461 - protein, 22 aa, Mycobacterium
RAHVPSRLRVLATRDTAVDLKA

SEQ ID NO: 717462 - protein, 20 aa, Mycobacterium
RAHWKAHRLDLDPVLHEPES

SEQ ID NO: 717463 - protein, 17 aa, Mycobacterium
RAHWRNEMPTAAALLDA

SEQ ID NO: 717464 - protein, 18 aa, Mycobacterium
RAIAALNYANARRNPNAQ

SEQ ID NO: 717465 - protein, 27 aa, Mycobacterium
RAIAEAAQAFSVWRTTPAPVRGALVAR

SEQ ID NO: 717466 - protein, 18 aa, Mycobacterium
RAIAEKWGVIALPDKPGL

SEQ ID NO: 717467 - protein, 19 aa, Mycobacterium
RAIAELVAIVGNGQPLTPE

SEQ ID NO: 717468 - protein, 17 aa, Mycobacterium
RAIALGFAARGDRVVAA

SEQ ID NO: 717469 - protein, 23 aa, Mycobacterium
RAIAQGRAVYCWNVDEYDDIDFC

SEQ ID NO: 717470 - protein, 23 aa, Mycobacterium
RAIAQGRAVYCWNVDEYEDLDFC

SEQ ID NO: 717471 - protein, 22 aa, Mycobacterium
RAICDRHDVLLIFDEIATGFGR

SEQ ID NO: 717472 - protein, 24 aa, Mycobacterium
RAICERFIREPGYRFVELPDPERA

SEQ ID NO: 717473 - protein, 17 aa, Mycobacterium
RAIDALSHVGVKTNVKM

SEQ ID NO: 717474 - protein, 17 aa, Mycobacterium
RAIDELGMYGASITTSV

SEQ ID NO: 717475 - protein, 19 aa, Mycobacterium
RAIDGAWWPRADRITNELP

SEQ ID NO: 717476 - protein, 26 aa, Mycobacterium
RAIDVPALRLHPFLAGVAIRDTDRAR

SEQ ID NO: 717477 - protein, 24 aa, Mycobacterium
RAIEMMARRAKSRFTQGSSLADKQ

SEQ ID NO: 717478 - protein, 20 aa, Mycobacterium
RAIEPFNYRLSWLGRNVARW

SEQ ID NO: 717479 - protein, 26 aa, Mycobacterium
RAIESWFVRRRLKAIDDAAERFGAEI

SEQ ID NO: 717480 - protein, 27 aa, Mycobacterium
RAIEVYPHPATVVLFDLDRTLKYKRGP

SEQ ID NO: 717481 - protein, 28 aa, Mycobacterium
RAIEVYPHPATVVLFRLARTLKYKAKPG

SEQ ID NO: 717482 - protein, 24 aa, Mycobacterium
RAIGDCLPWADGWLPGDAAYRDLP

SEQ ID NO: 717483 - protein, 24 aa, Mycobacterium
RAIGEVLLAHVLIVKGEFGAAAAM

SEQ ID NO: 717484 - protein, 36 aa, Mycobacterium
RAIGFPTRMFTVLFALGRLPGWIAHWREMHSEPGKI

SEQ ID NO: 717485 - protein, 22 aa, Mycobacterium
RAIGVNPFLTISMFAERTAELM

SEQ ID NO: 717486 - protein, 17 aa, Mycobacterium
RAIGYGMPGIRVDGNDV

SEQ ID NO: 717487 - protein, 22 aa, Mycobacterium
RAIHFQEWWVRYRAKVPTHSFA

SEQ ID NO: 717488 - protein, 17 aa, Mycobacterium
RAIHGIATFPKLGGAAG

SEQ ID NO: 717489 - protein, 23 aa, Mycobacterium
RAIHPINVRLGGFYSVPTRSDFA

SEQ ID NO: 717490 - protein, 20 aa, Mycobacterium
RAIHPVNVRLGGFYSAPKPG

SEQ ID NO: 717491 - protein, 23 aa, Mycobacterium
RAIHPVNVRLGGFYSVPTRSEFK

SEQ ID NO: 717492 - protein, 17 aa, Mycobacterium
RAIIAACPLTWPWNLLG

SEQ ID NO: 717493 - protein, 18 aa, Mycobacterium
RAIIGPQVARLAAQRAHQ

SEQ ID NO: 717494 - protein, 24 aa, Mycobacterium
RAILDEWKTINGLDRKVDDALWKR

SEQ ID NO: 717495 - protein, 24 aa, Mycobacterium
RAILDEWKTISGLDRKVDDALWKR

SEQ ID NO: 717496 - protein, 37 aa, Mycobacterium
RAILIRPAPVPGFRGPRSFALPEFDPFWERVVHHDIF

SEQ ID NO: 717497 - protein, 37 aa, Mycobacterium
RAILIRPAPVPGFRGPRSFALPEFDPFWERVVHHDVF

SEQ ID NO: 717498 - protein, 33 aa, Mycobacterium
RAILIRPAPVPGFRGPRSFAVPEFDPFWERVVE

SEQ ID NO: 717499 - protein, 19 aa, Mycobacterium
RAILIRPAPVPGLHGPRSF

SEQ ID NO: 717500 - protein, 17 aa, Mycobacterium
RAILLTRIADLIDQNHE

SEQ ID NO: 717501 - protein, 24 aa, Mycobacterium
RAILRRQLDRLARRGWSADAATEL

SEQ ID NO: 717502 - protein, 25 aa, Mycobacterium
RAIMPRLLSVGPWATLALAKPALQR

SEQ ID NO: 717503 - protein, 25 aa, Mycobacterium
RAIMRRIYPLIGRMFARQTAEISLL

SEQ ID NO: 717504 - protein, 23 aa, Mycobacterium
RAIPDEVYPLFADMAQVATELGE

SEQ ID NO: 717505 - protein, 19 aa, Mycobacterium
RAIPDPNCHADLRIADGKL

SEQ ID NO: 717506 - protein, 21 aa, Mycobacterium
RAIPEMFRKAFKLAETERPAA

SEQ ID NO: 717507 - protein, 20 aa, Mycobacterium
RAIPEMFRKAFKVAETERPA

SEQ ID NO: 717508 - protein, 23 aa, Mycobacterium
RAIPEMVRKAFKLAESERPAAVY

SEQ ID NO: 717509 - protein, 19 aa, Mycobacterium
RAIPGIGTGWFELEHDQLG

SEQ ID NO: 717510 - protein, 19 aa, Mycobacterium
RAIPGRLAADVAVCRGLIR

SEQ ID NO: 717511 - protein, 17 aa, Mycobacterium
RAIPGVRAVRELPAPAG

SEQ ID NO: 717512 - protein, 24 aa, Mycobacterium
RAIPRADRRLFEFHGDTTKEAANV

SEQ ID NO: 717513 - protein, 24 aa, Mycobacterium
RAIPRIGKGWLTREDRKAWEHLRA

SEQ ID NO: 717514 - protein, 18 aa, Mycobacterium
RAIRENRFDAAFGGARRD

SEQ ID NO: 717515 - protein, 18 aa, Mycobacterium
RAIRGRGLGLTIITPSLL

SEQ ID NO: 717516 - protein, 19 aa, Mycobacterium
RAIRSMLEVNLYGVINGCQ

SEQ ID NO: 717517 - protein, 20 aa, Mycobacterium
RAISELVAIVAGGQSLTPEV

SEQ ID NO: 717518 - protein, 22 aa, Mycobacterium
RAISGLQMLLHQAFAQVEQFTG

SEQ ID NO: 717519 - protein, 17 aa, Mycobacterium
RAISSFARMDAVVITVV

SEQ ID NO: 717520 - protein, 17 aa, Mycobacterium
RAITAIVRRDAKTPDTD

SEQ ID NO: 717521 - protein, 21 aa, Mycobacterium
RAITLRPRRPAGCTAADYREV

SEQ ID NO: 717522 - protein, 25 aa, Mycobacterium
RAIVGGPGLRRLRTAVVEQMAKTPR

SEQ ID NO: 717523 - protein, 20 aa, Mycobacterium
RAIVGTALSAWGRVDIVINN

SEQ ID NO: 717524 - protein, 18 aa, Mycobacterium
RAIVSELTGGPWEGASSG

SEQ ID NO: 717525 - protein, 23 aa, Mycobacterium
RAIWVGGRVPPAGAIRELLSHIT

SEQ ID NO: 717526 - protein, 21 aa, Mycobacterium
RAIYIGHDWGALVGNALARSG

SEQ ID NO: 717527 - protein, 20 aa, Mycobacterium
RAKAALRYADGLIWTPAHLA

SEQ ID NO: 717528 - protein, 18 aa, Mycobacterium
RAKAAVVNQLLGVLDDLD

SEQ ID NO: 717529 - protein, 27 aa, Mycobacterium
RAKALAAELRQSWNVDFDDAGAIGRRY

SEQ ID NO: 717530 - protein, 21 aa, Mycobacterium
RAKCRAELLSVASGVDGQGSG

SEQ ID NO: 717531 - protein, 23 aa, Mycobacterium
RAKDLKNRPVIIEAAAQGSGEDQ

SEQ ID NO: 717532 - protein, 23 aa, Mycobacterium
RAKDLKQRPAIIEAAAQGSSPDQ

SEQ ID NO: 717533 - protein, 20 aa, Mycobacterium
RAKDVFFYEPIILPEKSSRE

SEQ ID NO: 717534 - protein, 18 aa, Mycobacterium
RAKEHGYGLVLGTHAAGD

SEQ ID NO: 717535 - protein, 21 aa, Mycobacterium
RAKEMIKVRGFQVAPAEVEAV

SEQ ID NO: 717536 - protein, 26 aa, Mycobacterium
RAKFGLPEVKRGLIAAAGGVFRIVNQ

SEQ ID NO: 717537 - protein, 20 aa, Mycobacterium
RAKFTPDYDCGCKRPTLSNT

SEQ ID NO: 717538 - protein, 21 aa, Mycobacterium
RAKGAPGLNRYHAFVTVEPDS

SEQ ID NO: 717539 - protein, 24 aa, Mycobacterium
RAKGEQPFGFYARAWLDAQAVRVA

SEQ ID NO: 717540 - protein, 18 aa, Mycobacterium
RAKHLCERLLSFASPLHL

SEQ ID NO: 717541 - protein, 24 aa, Mycobacterium
RAKIIKFSGCYHGHVDALLADAGS

SEQ ID NO: 717542 - protein, 18 aa, Mycobacterium
RAKLADAVAEHMSPPLPL

SEQ ID NO: 717543 - protein, 20 aa, Mycobacterium
RAKLAHLIRTYLVYEGDSVP

SEQ ID NO: 717544 - protein, 20 aa, Mycobacterium
RAKLGELCRELGITEFMLLQ

SEQ ID NO: 717545 - protein, 18 aa, Mycobacterium
RAKLTRKGCDLLVVNAVG

SEQ ID NO: 717546 - protein, 24 aa, Mycobacterium
RAKMLDECLSRFVAADPSAVVVDL

SEQ ID NO: 717547 - protein, 31 aa, Mycobacterium; identical to SEQ ID NO: 83766

SEQ ID NO: 717548 - protein, 29 aa, Mycobacterium
RAKMSGLRQGFVKVFCRRSTGVVIGGVVV

SEQ ID NO: 717549 - protein, 28 aa, Mycobacterium
RAKNMFALGLLSWMYGRPIRTSENFIRE

SEQ ID NO: 717550 - protein, 27 aa, Mycobacterium
RAKNMFALGLVSWMYGRPIQTSETFIR

SEQ ID NO: 717551 - protein, 20 aa, Mycobacterium
RAKPAVPFGGAYRLIDFVLS

SEQ ID NO: 717552 - protein, 27 aa, Mycobacterium
RAKQAGLRLSARMVFEHPVVHDLAVAL

SEQ ID NO: 717553 - protein, 23 aa, Mycobacterium
RAKQAWDEGRFDREISPIEAPAL

SEQ ID NO: 717554 - protein, 21 aa, Mycobacterium
RAKQRMELRLFTLLSAEAQGR

SEQ ID NO: 717555 - protein, 17 aa, Mycobacterium
RAKRLLFTGDCITGAQA

SEQ ID NO: 717556 - protein, 24 aa, Mycobacterium
RAKRTGEKFVPFDAAADYRTYVDG

SEQ ID NO: 717557 - protein, 17 aa, Mycobacterium
RAKTILHGREIVLGMTR

SEQ ID NO: 717558 - protein, 23 aa, Mycobacterium
RAKTIRDGREIVLGMARCRIPVV

SEQ ID NO: 717559 - protein, 26 aa, Mycobacterium
RAKVAGWLNEHGWRATARNAGDEMRR

SEQ ID NO: 717560 - protein, 24 aa, Mycobacterium
RAKVIKFSGCYHGHVDALLADAGS

SEQ ID NO: 717561 - protein, 19 aa, Mycobacterium
RAKVMWRIADLIDEHADEF

SEQ ID NO: 717562 - protein, 18 aa, Mycobacterium
RAKVSRLAAVIPVHTHID

SEQ ID NO: 717563 - protein, 17 aa, Mycobacterium
RAKYGWTDVSRFAALGI

SEQ ID NO: 717564 - protein, 18 aa, Mycobacterium
RALAAALRLEFKRVQFTP

SEQ ID NO: 717565 - protein, 18 aa, Mycobacterium
RALAACFCDEGVLEFTGG

SEQ ID NO: 717566 - protein, 18 aa, Mycobacterium
RALAALPGVDQARIWEPE

SEQ ID NO: 717567 - protein, 21 aa, Mycobacterium
RALAAPMARPAVGTERAGQLL

SEQ ID NO: 717568 - protein, 27 aa, Mycobacterium
RALADLRVARLLAYRAVALRDDPTAGA

SEQ ID NO: 717569 - protein, 20 aa, Mycobacterium
RALADLTWKATVQAMKLPGL

SEQ ID NO: 717570 - protein, 20 aa, Mycobacterium
RALADNGFTPLNFEATDLAW

SEQ ID NO: 717571 - protein, 17 aa, Mycobacterium
RALADYGVEPRHLRAFR

SEQ ID NO: 717572 - protein, 25 aa, Mycobacterium
RALAELCQRRDILLIVDDVQMGCGR

SEQ ID NO: 717573 - protein, 19 aa, Mycobacterium
RALAERPGDVVARNDLLRV

SEQ ID NO: 717574 - protein, 18 aa, Mycobacterium
RALAGAGRTWLRVLANHV

SEQ ID NO: 717575 - protein, 19 aa, Mycobacterium
RALAGLWRSLTRKEVFPTQ

SEQ ID NO: 717576 - protein, 23 aa, Mycobacterium
RALAGRLGLSVAVAHVEGDDLLP

SEQ ID NO: 717577 - protein, 26 aa, Mycobacterium
RALAHRPGAVVSRFDLLGALPGSGTD

SEQ ID NO: 717578 - protein, 18 aa, Mycobacterium
RALAKLADRFDVVIIDCP

SEQ ID NO: 717579 - protein, 25 aa, Mycobacterium
RALAKRPGDVVARGDLLRALPGNSN

SEQ ID NO: 717580 - protein, 17 aa, Mycobacterium
RALALAGYHRVEVRTVL

SEQ ID NO: 717581 - protein, 17 aa, Mycobacterium
RALALGVSKDAILIDPT

SEQ ID NO: 717582 - protein, 21 aa, Mycobacterium
RALALMVDRVQTRIAFGKPLA

SEQ ID NO: 717583 - protein, 19 aa, Mycobacterium
RALALRPAVSWSGQTLTTL

SEQ ID NO: 717584 - protein, 18 aa, Mycobacterium
RALAMAPQVMFFDEATSA

SEQ ID NO: 717585 - protein, 19 aa, Mycobacterium
RALARRPGDVVGRDELLAV

SEQ ID NO: 717586 - protein, 19 aa, Mycobacterium
RALARRTVVAGSQCGELLA

SEQ ID NO: 717587 - protein, 17 aa, Mycobacterium
RALARVASWGDGWYGFN

SEQ ID NO: 717588 - protein, 20 aa, Mycobacterium
RALASLRAEVGMVFQSFNLF

SEQ ID NO: 717589 - protein, 20 aa, Mycobacterium
RALATAGEWGARRVWLGVNQ

SEQ ID NO: 717590 - protein, 17 aa, Mycobacterium
RALAVALDVTDTGQVAA

SEQ ID NO: 717591 - protein, 17 aa, Mycobacterium
RALAWFAAHGVRVRRLL

SEQ ID NO: 717592 - protein, 23 aa, Mycobacterium
RALCLRLLTARARTRAELRGRLT

SEQ ID NO: 717593 - protein, 26 aa, Mycobacterium
RALDAAAVGVRWVPLPFGRQAIDEFG

SEQ ID NO: 717594 - protein, 25 aa, Mycobacterium
RALDAHRGLPMPFELARTQLIVGQL

SEQ ID NO: 717595 - protein, 18 aa, Mycobacterium
RALDALLPPGGRLLDLGV

SEQ ID NO: 717596 - protein, 25 aa, Mycobacterium
RALDEWRLLMAAALVGLVEETMTIA

SEQ ID NO: 717597 - protein, 18 aa, Mycobacterium
RALDGFEAPTLVGSLATA

SEQ ID NO: 717598 - protein, 25 aa, Mycobacterium
RALDHGVDVIGLWGEAARDVDHAKA

SEQ ID NO: 717599 - protein, 18 aa, Mycobacterium
RALDLGVSLIDTAEIYGP

SEQ ID NO: 717600 - protein, 19 aa, Mycobacterium
RALDNQVFWVASNQSGSFG

SEQ ID NO: 717601 - protein, 17 aa, Mycobacterium
RALDVISRIAAGLKDPA

SEQ ID NO: 717602 - protein, 18 aa, Mycobacterium
RALDVLLDGLVIRLTEGY

SEQ ID NO: 717603 - protein, 17 aa, Mycobacterium
RALEFFQDGEEFWRLLF

SEQ ID NO: 717604 - protein, 24 aa, Mycobacterium
RALEFRPQVIIAGWSAYPRILDFA

SEQ ID NO: 717605 - protein, 18 aa, Mycobacterium
RALEGFTRSLAKEFSNGA

SEQ ID NO: 717606 - protein, 22 aa, Mycobacterium
RALEKHGAPVYVRHEIVHNRHV

SEQ ID NO: 717607 - protein, 22 aa, Mycobacterium
RALEKHGAPVYVRHEIVHNRYV

SEQ ID NO: 717608 - protein, 19 aa, Mycobacterium
RALELGGRVLLAASTKRAA

SEQ ID NO: 717609 - protein, 17 aa, Mycobacterium
RALEMAHQLAASSATAL

SEQ ID NO: 717610 - protein, 20 aa, Mycobacterium
RALEPLPFPGAVYHVDTGEN

SEQ ID NO: 717611 - protein, 24 aa, Mycobacterium
RALEPRPTILGSRTSISFRQGATR

SEQ ID NO: 717612 - protein, 18 aa, Mycobacterium
RALEPWSYGIYAGGQSIL

SEQ ID NO: 717613 - protein, 19 aa, Mycobacterium
RALETLTHKVLLRASQRAV

SEQ ID NO: 717614 - protein, 21 aa, Mycobacterium
RALEVTGRLLLAASSRRSAWW

SEQ ID NO: 717615 - protein, 19 aa, Mycobacterium
RALFWPTRDFTTAPIELDL

SEQ ID NO: 717616 - protein, 24 aa, Mycobacterium
RALGASFAEFGGWLMPVSYAGTVS

SEQ ID NO: 717617 - protein, 19 aa, Mycobacterium
RALGATCNGVRVWSLYVPN

SEQ ID NO: 717618 - protein, 25 aa, Mycobacterium
RALGDFSGKFTDFFESNLGKRMVKA

SEQ ID NO: 717619 - protein, 17 aa, Mycobacterium
RALGEIHSGVAADLGSM

SEQ ID NO: 717620 - protein, 18 aa, Mycobacterium
RALGEKDLSLALALGESL

SEQ ID NO: 717621 - protein, 25 aa, Mycobacterium
RALGERDIECPFAIQELTLPLALAG

SEQ ID NO: 717622 - protein, 36 aa, Mycobacterium; identical to SEQ ID NO: 204997

SEQ ID NO: 717623 - protein, 18 aa, Mycobacterium
RALGHPLSIVAIAEHLGV

SEQ ID NO: 717624 - protein, 17 aa, Mycobacterium
RALGIGVRVMVNIIEQA

SEQ ID NO: 717625 - protein, 24 aa, Mycobacterium
RALGIPAPIILHWSPDSTRILVAR

SEQ ID NO: 717626 - protein, 17 aa, Mycobacterium
RALGITRAALFSDSAVA

SEQ ID NO: 717627 - protein, 21 aa, Mycobacterium
RALGKRFGMEGMKVVLADVLA

SEQ ID NO: 717628 - protein, 18 aa, Mycobacterium
RALGLGLEIRPLRGNLDT

SEQ ID NO: 717629 - protein, 19 aa, Mycobacterium
RALGLRGGALAELGAALED

SEQ ID NO: 717630 - protein, 17 aa, Mycobacterium
RALGRAAAFIHHLPVDQ

SEQ ID NO: 717631 - protein, 26 aa, Mycobacterium
RALGRHLSCRAAECGVGRLGFESHVV

SEQ ID NO: 717632 - protein, 23 aa, Mycobacterium
RALGRKTVEFYLDLSNYVNNWRK

SEQ ID NO: 717633 - protein, 17 aa, Mycobacterium
RALGSVLGRGRPEESPL

SEQ ID NO: 717634 - protein, 26 aa, Mycobacterium
RALHGLGPRWVLVKGGHLRSSTRSCD

SEQ ID NO: 717635 - protein, 18 aa, Mycobacterium
RALHYPKVVLGLSGGLDS

SEQ ID NO: 717636 - protein, 19 aa, Mycobacterium
RALIARFLKAIGEYPGASL

SEQ ID NO: 717637 - protein, 17 aa, Mycobacterium
RALIARLGGDEFVVVPA

SEQ ID NO: 717638 - protein, 18 aa, Mycobacterium
RALIDLGMGLWLNEPTAK

SEQ ID NO: 717639 - protein, 20 aa, Mycobacterium
RALIICRGCRVVAECRGYAL

SEQ ID NO: 717640 - protein, 19 aa, Mycobacterium
RALIRRLPEPLVIADDRYG

SEQ ID NO: 717641 - protein, 20 aa, Mycobacterium
RALLDAGHTVTVWNRTESKA

SEQ ID NO: 717642 - protein, 17 aa, Mycobacterium
RALLDRLPDPLVVVDDE

SEQ ID NO: 717643 - protein, 22 aa, Mycobacterium
RALLEFFAHPGADRGTAAQYLR

SEQ ID NO: 717644 - protein, 17 aa, Mycobacterium
RALLEFLDTVPVAEAEG

SEQ ID NO: 717645 - protein, 24 aa, Mycobacterium
RALLGRPMIGNGFDGAPGTGQAGE

SEQ ID NO: 717646 - protein, 18 aa, Mycobacterium
RALLMPGVEDFGIVPVEA

SEQ ID NO: 717647 - protein, 19 aa, Mycobacterium
RALLNFPISGMPISRHPDL

SEQ ID NO: 717648 - protein, 19 aa, Mycobacterium
RALLRAAIDLFSRPAVHSA

SEQ ID NO: 717649 - protein, 23 aa, Mycobacterium
RALLRHWAVALGNPADVFDEAFA

SEQ ID NO: 717650 - protein, 19 aa, Mycobacterium
RALLRSRLLAPPSPLATLR

SEQ ID NO: 717651 - protein, 17 aa, Mycobacterium
RALLSARRVTPHVGAVY

SEQ ID NO: 717652 - protein, 17 aa, Mycobacterium
RALLTRVGDHARGLHEA

SEQ ID NO: 717653 - protein, 18 aa, Mycobacterium
RALMPALFEEEVTATYAG

SEQ ID NO: 717654 - protein, 24 aa, Mycobacterium
RALMPRSNVVIDMRVCDFGGSDQA

SEQ ID NO: 717655 - protein, 25 aa, Mycobacterium
RALMPRSNVVIDMRVCDFGGSDQAA

SEQ ID NO: 717656 - protein, 18 aa, Mycobacterium
RALMTGYLLHLLAGDKTY

SEQ ID NO: 717657 - protein, 20 aa, Mycobacterium
RALPADQWLDALARVPMGGG

SEQ ID NO: 717658 - protein, 23 aa, Mycobacterium
RALPAGDTMRFFGGVEPVALHER

SEQ ID NO: 717659 - protein, 24 aa, Mycobacterium
RALPAPDYRGAAPYRAPATATEEI

SEQ ID NO: 717660 - protein, 19 aa, Mycobacterium
RALPDAPLFTAEEGTDPLA

SEQ ID NO: 717661 - protein, 25 aa, Mycobacterium
RALPDDVRLDLGLAEHTIFDDGVVY

SEQ ID NO: 717662 - protein, 24 aa, Mycobacterium
RALPEAKAGAGLHTQALAALPGPV

SEQ ID NO: 717663 - protein, 17 aa, Mycobacterium
RALPGRVVNAVLDVLDF

SEQ ID NO: 717664 - protein, 19 aa, Mycobacterium
RALPHRRGLVVLSGDRTGG

SEQ ID NO: 717665 - protein, 17 aa, Mycobacterium
RALPLGRTAFPSEIAEA

SEQ ID NO: 717666 - protein, 23 aa, Mycobacterium
RALPRGAVTIVFDVGHRQQLDLY

SEQ ID NO: 717667 - protein, 26 aa, Mycobacterium
RALPRIPDPVKRLLLGRRTITLDGNT

SEQ ID NO: 717668 - protein, 23 aa, Mycobacterium
RALQARGELDCRAPDFVAPRTPA

SEQ ID NO: 717669 - protein, 18 aa, Mycobacterium
RALQCGMRPEQIRELATT

SEQ ID NO: 717670 - protein, 20 aa, Mycobacterium
RALQRACAAGALATTVAGAG

SEQ ID NO: 717671 - protein, 17 aa, Mycobacterium
RALQTWYEGHAHYVDGL

SEQ ID NO: 717672 - protein, 17 aa, Mycobacterium
RALRDGDSWLINGSKMF

SEQ ID NO: 717673 - protein, 20 aa, Mycobacterium
RALREARFDDGLAVVSFAPG

SEQ ID NO: 717674 - protein, 25 aa, Mycobacterium
RALREASYRLGARILSHQFGAPMYG

SEQ ID NO: 717675 - protein, 17 aa, Mycobacterium
RALRIWGRSAASIDGRS

SEQ ID NO: 717676 - protein, 17 aa, Mycobacterium
RALRLAASIRKQHAAGA

SEQ ID NO: 717677 - protein, 18 aa, Mycobacterium
RALRLRVYPVREQYDCVF

SEQ ID NO: 717678 - protein, 17 aa, Mycobacterium
RALRMSTPLALTEEELV

SEQ ID NO: 717679 - protein, 18 aa, Mycobacterium
RALRPHLILHTGDLFDAF

SEQ ID NO: 717680 - protein, 21 aa, Mycobacterium
RALRQRLGIHPVFKTVDTCAA

SEQ ID NO: 717681 - protein, 17 aa, Mycobacterium
RALRRAAGGQAFLELDD

SEQ ID NO: 717682 - protein, 18 aa, Mycobacterium
RALRSGHNIVSTAMTPWV

SEQ ID NO: 717683 - protein, 24 aa, Mycobacterium
RALRTNRTNQHWAVDLSQQGEVKT

SEQ ID NO: 717684 - protein, 18 aa, Mycobacterium
RALSARNNVVIDLELCGR

SEQ ID NO: 717685 - protein, 19 aa, Mycobacterium
RALSCGVPLVVAGKTEDKP

SEQ ID NO: 717686 - protein, 22 aa, Mycobacterium
RALSDAALHLMFKRGGLENVTR

SEQ ID NO: 717687 - protein, 18 aa, Mycobacterium
RALSEGKLLGGRTGAGGR

SEQ ID NO: 717688 - protein, 18 aa, Mycobacterium
RALSGLPGVEKARIWEPE

SEQ ID NO: 717689 - protein, 18 aa, Mycobacterium
RALSWLPLYHDMGLILGV

SEQ ID NO: 717690 - protein, 22 aa, Mycobacterium
RALTFLRGPRTWVLKSPQHCEQ

SEQ ID NO: 717691 - protein, 23 aa, Mycobacterium
RALTGITGGLGWEQAADTVVVSG

SEQ ID NO: 717692 - protein, 29 aa, Mycobacterium
RALTPGYPFRCKRVLLGDDFYRALQHDHV

SEQ ID NO: 717693 - protein, 20 aa, Mycobacterium
RALTPPSLVARVVNALRAGH

SEQ ID NO: 717694 - protein, 17 aa, Mycobacterium
RALTWAGTCEPGDGLGI

SEQ ID NO: 717695 - protein, 17 aa, Mycobacterium
RALVARSKPLVAILWGR

SEQ ID NO: 717696 - protein, 26 aa, Mycobacterium
RALVDLRVARLLAYRAVSLQDDPAAG

SEQ ID NO: 717697 - protein, 26 aa, Mycobacterium
RALVDLRVARLLAYRAVSLQEDPRAG

SEQ ID NO: 717698 - protein, 19 aa, Mycobacterium
RALVLAFNKWDLVDEDRRD

SEQ ID NO: 717699 - protein, 19 aa, Mycobacterium
RALVLAFNKWDLVDEDRRY

SEQ ID NO: 717700 - protein, 18 aa, Mycobacterium
RALVPRRDVNAIMDELAA

SEQ ID NO: 717701 - protein, 18 aa, Mycobacterium
RALVRMLREAGALEVHVR

SEQ ID NO: 717702 - protein, 17 aa, Mycobacterium
RALVRMLREAGAVEVHV

SEQ ID NO: 717703 - protein, 20 aa, Mycobacterium
RALVRTGVAVAIPFGMVGLV

SEQ ID NO: 717704 - protein, 20 aa, Mycobacterium
RALVTAPLRGPGLAKLQHLA

SEQ ID NO: 717705 - protein, 26 aa, Mycobacterium
RALVVRRLDMLPVECVARGYLTGSGL

SEQ ID NO: 717706 - protein, 21 aa, Mycobacterium
RALYDAGWMRYGWPVDVGGLG

SEQ ID NO: 717707 - protein, 19 aa, Mycobacterium
RALYELGMTGIPIVNVNNN

SEQ ID NO: 717708 - protein, 20 aa, Mycobacterium
RALYELGMTGIPVVNVNNNC

SEQ ID NO: 717709 - protein, 23 aa, Mycobacterium
RALYRHTLAPLKGAGRAVVRLDH

SEQ ID NO: 717710 - protein, 25 aa, Mycobacterium
RALYRRRDDLWDRLIEACRPGRATS

SEQ ID NO: 717711 - protein, 19 aa, Mycobacterium
RAMAAGGQAVFECSPAGTA

SEQ ID NO: 717712 - protein, 20 aa, Mycobacterium
RAMAGARAHNRWLAELCSHS

SEQ ID NO: 717713 - protein, 21 aa, Mycobacterium
RAMAVARRIRTGSLMINSGMY

SEQ ID NO: 717714 - protein, 19 aa, Mycobacterium
RAMFAPKLDAAALLHRLSL

SEQ ID NO: 717715 - protein, 18 aa, Mycobacterium
RAMGDLRALFAGLGDPRS

SEQ ID NO: 717716 - protein, 37 aa, Mycobacterium
RAMGFPTRMFTVLFALGRLPGWIAHWREMHGEPNKIG

SEQ ID NO: 717717 - protein, 37 aa, Mycobacterium
RAMGFPTRMFTVLFALGRLPGWIAHWREMHSEPNKIG

SEQ ID NO: 717718 - protein, 25 aa, Mycobacterium
RAMIAACPLTFPWNVLGWPSINVPA

SEQ ID NO: 717719 - protein, 24 aa, Mycobacterium
RAMIADLTSFQWLGPSSAAMIASV

SEQ ID NO: 717720 - protein, 24 aa, Mycobacterium
RAMIADLTSFQWLGPSSAAMVASV

SEQ ID NO: 717721 - protein, 24 aa, Mycobacterium
RAMIANRISYAFGLQGPSMTVDSG

SEQ ID NO: 717722 - protein, 25 aa, Mycobacterium
RAMIANRVSYAFALHGPSMTVDSGQ

SEQ ID NO: 717723 - protein, 20 aa, Mycobacterium
RAMIDLSTMVGRVISPTNRK

SEQ ID NO: 717724 - protein, 26 aa, Mycobacterium
RAMIEAIGPYLAWLRVTAQQCRQLGS

SEQ ID NO: 717725 - protein, 26 aa, Mycobacterium
RAMLYGAYRTGAPFGGRAADLVVESA

SEQ ID NO: 717726 - protein, 25 aa, Mycobacterium
RAMPGAEWFPGATLNYATEIFRHAT

SEQ ID NO: 717727 - protein, 25 aa, Mycobacterium
RAMQFLRGGRRWLLKSPQHLEQVPV

SEQ ID NO: 717728 - protein, 23 aa, Mycobacterium
RAMRPEVDELLGLDDPNRESLLT

SEQ ID NO: 717729 - protein, 17 aa, Mycobacterium
RAMRVIEWFIGATTQRR

SEQ ID NO: 717730 - protein, 17 aa, Mycobacterium
RAMRVPLAKVIRPSQFG

SEQ ID NO: 717731 - protein, 24 aa, Mycobacterium
RAMSGRLSLLWRGKGATLEAVAFA

SEQ ID NO: 717732 - protein, 17 aa, Mycobacterium
RAMSVGFPNVIAMSQRS

SEQ ID NO: 717733 - protein, 27 aa, Mycobacterium
RAMTAELRFPAGHSGRIQCSMWSSHLL

SEQ ID NO: 717734 - protein, 31 aa, Mycobacterium
RAMTGWQRLHFRFGLPAPLLEPLAVERLYLD

SEQ ID NO: 717735 - protein, 20 aa, Mycobacterium
RAMVDMCLDAGVTLFDTADV

SEQ ID NO: 717736 - protein, 17 aa, Mycobacterium
RAMVSAANYVVVVADSS

SEQ ID NO: 717737 - protein, 17 aa, Mycobacterium
RAMYRKKVADSRSALTS

SEQ ID NO: 717738 - protein, 22 aa, Mycobacterium
RANAICPGFIATPLAEGVFGMP

SEQ ID NO: 717739 - protein, 23 aa, Mycobacterium
RANAPGIDAVLCSTATRTRQTLA

SEQ ID NO: 717740 - protein, 22 aa, Mycobacterium
RANAPLISWDKAFGLVKINPLA

SEQ ID NO: 717741 - protein, 19 aa, Mycobacterium
RANDLPDFVIRHHETPAPH

SEQ ID NO: 717742 - protein, 18 aa, Mycobacterium
RANELWINEPRPMLNTKA

SEQ ID NO: 717743 - protein, 19 aa, Mycobacterium
RANFDLQVFRGGGHFYLED

SEQ ID NO: 717744 - protein, 18 aa, Mycobacterium
RANGCAHVLIYPREDVPR

SEQ ID NO: 717745 - protein, 21 aa, Mycobacterium
RANGYGVLFLSSLRPMRSTVS

SEQ ID NO: 717746 - protein, 19 aa, Mycobacterium
RANIEYPLEIAGWDRKKRW

SEQ ID NO: 717747 - protein, 18 aa, Mycobacterium
RANILVLCGPIWLGDNSS

SEQ ID NO: 717748 - protein, 19 aa, Mycobacterium
RANIPFLLVRNHKNRPILA

SEQ ID NO: 717749 - protein, 22 aa, Mycobacterium
RANIRMPAEMVVGSKFSTNMKM

SEQ ID NO: 717750 - protein, 24 aa, Mycobacterium
RANLEGWAPLLPDGATLVSLAKGI

SEQ ID NO: 717751 - protein, 20 aa, Mycobacterium
RANLLAGAGRDHWRQVRRLP

SEQ ID NO: 717752 - protein, 18 aa, Mycobacterium
RANMWVDLGRIKYCPGAV

SEQ ID NO: 717753 - protein, 23 aa, Mycobacterium
RANPRPGIVNGLLQMRIDGEPAP

SEQ ID NO: 717754 - protein, 28 aa, Mycobacterium
RANREAFDRWGLIPRMFVGAADRDLSVQ

SEQ ID NO: 717755 - protein, 29 aa, Mycobacterium
RANREAFDRWGLMPRMFVGAAERDLSVEL

SEQ ID NO: 717756 - protein, 25 aa, Mycobacterium
RANRLAHYFRRAGLAEGDAVAILME

SEQ ID NO: 717757 - protein, 22 aa, Mycobacterium
RANRTPIDWDGYTPPLPAQGLG

SEQ ID NO: 717758 - protein, 22 aa, Mycobacterium
RANRTPIDWDGYTPPVPAQGLG

SEQ ID NO: 717759 - protein, 19 aa, Mycobacterium
RANRYPGCRVDIANHYYAY

SEQ ID NO: 717760 - protein, 40 aa, Mycobacterium
RANSQILPIRLPRRIVEPMWAVAEWGYWQILKSAEDAQRR

SEQ ID NO: 717761 - protein, 24 aa, Mycobacterium
RANVPRVDGVLCSTATRTRETLAR

SEQ ID NO: 717762 - protein, 24 aa, Mycobacterium
RANVTQWLAWVLMILTGAMNRPGG

SEQ ID NO: 717763 - protein, 17 aa, Mycobacterium
RANWEAGGWGDVAQGMV

SEQ ID NO: 717764 - protein, 30 aa, Mycobacterium
RAPAAVRYEAWSFPDFETGAAALRAVTQNA

SEQ ID NO: 717765 - protein, 18 aa, Mycobacterium
RAPAAYDAVCERLHTASL

SEQ ID NO: 717766 - protein, 19 aa, Mycobacterium
RAPAAYDAVCERLHTASLR

SEQ ID NO: 717767 - protein, 20 aa, Mycobacterium
RAPADSGPGSARWIDPSEVP

SEQ ID NO: 717768 - protein, 18 aa, Mycobacterium
RAPAFAIALTDPVGDATV

SEQ ID NO: 717769 - protein, 19 aa, Mycobacterium
RAPALTDRLVWQCASLLLS

SEQ ID NO: 717770 - protein, 25 aa, Mycobacterium
RAPALYELPHGVAFTDVLALHGVSP

SEQ ID NO: 717771 - protein, 18 aa, Mycobacterium
RAPAPRWTATNSTPCTNS

SEQ ID NO: 717772 - protein, 21 aa, Mycobacterium
RAPARFALKGRHWFAIYRWVF

SEQ ID NO: 717773 - protein, 17 aa, Mycobacterium
RAPAWGATTIWIGSGER

SEQ ID NO: 717774 - protein, 23 aa, Mycobacterium
RAPDTRLRRLRGLVASELARGGD

SEQ ID NO: 717775 - protein, 20 aa, Mycobacterium
RAPEAVAITDGDRSWTYGEV

SEQ ID NO: 717776 - protein, 23 aa, Mycobacterium
RAPEISEGLFAALHLTSGAHLTQ

SEQ ID NO: 717777 - protein, 27 aa, Mycobacterium
RAPELAELIAQWHEWGIDGVRLRPAAN

SEQ ID NO: 717778 - protein, 23 aa, Mycobacterium
RAPELESALALADRLQELARRVG

SEQ ID NO: 717779 - protein, 20 aa, Mycobacterium
RAPFAEMGFGLFRSDPQAER

SEQ ID NO: 717780 - protein, 18 aa, Mycobacterium
RAPFAETAPEDWEPFLRV

SEQ ID NO: 717781 - protein, 18 aa, Mycobacterium
RAPFFVIAVFARGLLHRL

SEQ ID NO: 717782 - protein, 19 aa, Mycobacterium
RAPGAVVVVSIFVNPLQFG

SEQ ID NO: 717783 - protein, 24 aa, Mycobacterium
RAPGEILCLPYFLGEKSPVHDPDL

SEQ ID NO: 717784 - protein, 19 aa, Mycobacterium
RAPGIAVIAEVKRASPSRG

SEQ ID NO: 717785 - protein, 24 aa, Mycobacterium
RAPGRMTTKWGGFIDDVAGFDADF

SEQ ID NO: 717786 - protein, 24 aa, Mycobacterium
RAPHGRWIFGDALAHARQQWLRVL

SEQ ID NO: 717787 - protein, 18 aa, Mycobacterium
RAPHSVHTYFLRPGDSRH

SEQ ID NO: 717788 - protein, 19 aa, Mycobacterium
RAPIGWDMKDPTPVAKTVC

SEQ ID NO: 717789 - protein, 19 aa, Mycobacterium
RAPIGWNMKDPTPVAKTVC

SEQ ID NO: 717790 - protein, 17 aa, Mycobacterium
RAPKAVKEYARRHPHSM

SEQ ID NO: 717791 - protein, 25 aa, Mycobacterium
RAPKVLESDAWRRLSATRDDRVFAV

SEQ ID NO: 717792 - protein, 18 aa, Mycobacterium
RAPLEVADLLSAVESVQP

SEQ ID NO: 717793 - protein, 18 aa, Mycobacterium
RAPLGGIVCMHRELGYAD

SEQ ID NO: 717794 - protein, 21 aa, Mycobacterium
RAPLPGGLETAGGALLPDNIA

SEQ ID NO: 717795 - protein, 19 aa, Mycobacterium
RAPLRISFAGGGTDVPPFP

SEQ ID NO: 717796 - protein, 20 aa, Mycobacterium
RAPLVLWAVGPVRLDDAVER

SEQ ID NO: 717797 - protein, 27 aa, Mycobacterium
RAPMWDLSWHTPGLLAERNFLYDSSLM

SEQ ID NO: 717798 - protein, 30 aa, Mycobacterium
RAPMWDLSWRTPALLAERGFLYDSSLMDAD

SEQ ID NO: 717799 - protein, 19 aa, Mycobacterium
RAPNCHVAFGLGPHRCIGS

SEQ ID NO: 717800 - protein, 25 aa, Mycobacterium
RAPNERVFPVPDFQPHIAKLKLADG

SEQ ID NO: 717801 - protein, 19 aa, Mycobacterium
RAPQALRIPAKENRLNTGG

SEQ ID NO: 717802 - protein, 19 aa, Mycobacterium
RAPQAYRMPPSLDEAEVIN

SEQ ID NO: 717803 - protein, 25 aa, Mycobacterium
RAPRDFDARFSALCRHYVYRLSTAP

SEQ ID NO: 717804 - protein, 23 aa, Mycobacterium
RAPRGMLEVSYRCPNGEPAVVKT

SEQ ID NO: 717805 - protein, 19 aa, Mycobacterium
RAPRKVKRAISGMPMNSAA

SEQ ID NO: 717806 - protein, 22 aa, Mycobacterium
RAPRLRLVHKLGAGVNTIDVET

SEQ ID NO: 717807 - protein, 19 aa, Mycobacterium
RAPRLWLVTEGGLVVHDEP

SEQ ID NO: 717808 - protein, 33 aa, Mycobacterium
RAPRPALPWTGVRTCRAWGAASIQQHRYAIILP

SEQ ID NO: 717809 - protein, 25 aa, Mycobacterium
RAPRPGLIALPWDRPLADWAAPDVA

SEQ ID NO: 717810 - protein, 25 aa, Mycobacterium
RAPRRGVEGLQNFALSVTDLDATYR

SEQ ID NO: 717811 - protein, 19 aa, Mycobacterium
RAPRRRLLSLGETPMAITN

SEQ ID NO: 717812 - protein, 21 aa, Mycobacterium
RAPRRRWGSLLGIQPDGLEVF

SEQ ID NO: 717813 - protein, 34 aa, Mycobacterium
RAPRRVVTEVPLWSTRVARWLRRHTRPSASRPSV

SEQ ID NO: 717814 - protein, 19 aa, Mycobacterium
RAPRVVVGRDMRDSSPSLA

SEQ ID NO: 717815 - protein, 17 aa, Mycobacterium
RAPSLYNTQPWRWVADG

SEQ ID NO: 717816 - protein, 17 aa, Mycobacterium
RAPSVEFEVEMETLPQP

SEQ ID NO: 717817 - protein, 19 aa, Mycobacterium
RAPTALSVRLRVEPPEEQD

SEQ ID NO: 717818 - protein, 24 aa, Mycobacterium
RAPVLDVFGSWVITDLNVLDAAKD

SEQ ID NO: 717819 - protein, 22 aa, Mycobacterium
RAPVPFHLLPLVARELGKDTEI

SEQ ID NO: 717820 - protein, 22 aa, Mycobacterium
RAPVPFHLLPSVARELGKHTEI

SEQ ID NO: 717821 - protein, 22 aa, Mycobacterium
RAPVPFHLLPSVAREVGKHTEI

SEQ ID NO: 717822 - protein, 26 aa, Mycobacterium
RAPVPGAYVAGWIKRGPSGFIGTNKS

SEQ ID NO: 717823 - protein, 24 aa, Mycobacterium
RAPWRLKQNYFFDMRTIRRGKVDD

SEQ ID NO: 717824 - protein, 29 aa, Mycobacterium
RAPYRDLRFLARLCAAAAQIKRLGVSAAT

SEQ ID NO: 717825 - protein, 17 aa, Mycobacterium
RAQAIGLFRYQLICPAL

SEQ ID NO: 717826 - protein, 25 aa, Mycobacterium
RAQAKELFVPPALFPDYLRTARRLS

SEQ ID NO: 717827 - protein, 17 aa, Mycobacterium
RAQARLESARPYADQIT

SEQ ID NO: 717828 - protein, 23 aa, Mycobacterium
RAQASMPPSVWSYVAGGAGDENT

SEQ ID NO: 717829 - protein, 17 aa, Mycobacterium
RAQAVAGLRALAAGQHS

SEQ ID NO: 717830 - protein, 17 aa, Mycobacterium
RAQAVKVLDMLAQADRP

SEQ ID NO: 717831 - protein, 18 aa, Mycobacterium
RAQCRWFGGMVGNHVADI

SEQ ID NO: 717832 - protein, 23 aa, Mycobacterium
RAQEALPAYMVPTAFAVIPEIPL

SEQ ID NO: 717833 - protein, 20 aa, Mycobacterium
RAQEFLALKVEGIRECAELF

SEQ ID NO: 717834 - protein, 17 aa, Mycobacterium
RAQFGAVVSLDLRRLDR

SEQ ID NO: 717835 - protein, 17 aa, Mycobacterium
RAQFNSVGMRLFSLHSD

SEQ ID NO: 717836 - protein, 20 aa, Mycobacterium
RAQGIRLVYETPRRGTADSR

SEQ ID NO: 717837 - protein, 19 aa, Mycobacterium
RAQGLDGFGRPEGFHERQV

SEQ ID NO: 717838 - protein, 19 aa, Mycobacterium
RAQGLEGFGRPDGFHERQV

SEQ ID NO: 717839 - protein, 17 aa, Mycobacterium
RAQGVTAPAGFRAAGIA

SEQ ID NO: 717840 - protein, 19 aa, Mycobacterium
RAQHPDWAAGKNIPHPNEP

SEQ ID NO: 717841 - protein, 17 aa, Mycobacterium
RAQIEFDPGISPAEAAL

SEQ ID NO: 717842 - protein, 20 aa, Mycobacterium
RAQIHPWAWVVNNSTSAAHP

SEQ ID NO: 717843 - protein, 23 aa, Mycobacterium
RAQIWLKARTGPVAIPGPAGQHH

SEQ ID NO: 717844 - protein, 24 aa, Mycobacterium
RAQLCGFAQLFSGYESFICGPEPF

SEQ ID NO: 717845 - protein, 20 aa, Mycobacterium
RAQLCGLCLALRDDYGQAAR

SEQ ID NO: 717846 - protein, 17 aa, Mycobacterium
RAQLIVYHHMWSDGAEW

SEQ ID NO: 717847 - protein, 17 aa, Mycobacterium
RAQLIVYHHMWTDGAEW

SEQ ID NO: 717848 - protein, 22 aa, Mycobacterium
RAQLLSGSWAPRIEELVYIPPG

SEQ ID NO: 717849 - protein, 17 aa, Mycobacterium
RAQPGWQPRTLDHELSA

SEQ ID NO: 717850 - protein, 19 aa, Mycobacterium
RAQRACRRFDPDGKVPDSD

SEQ ID NO: 717851 - protein, 24 aa, Mycobacterium
RAQRELDGLIVLPATTRASIERKI

SEQ ID NO: 717852 - protein, 26 aa, Mycobacterium
RAQRFYLKHGFTRSGTKTFLVGERLE

SEQ ID NO: 717853 - protein, 26 aa, Mycobacterium
RAQRGMTVVGGRGSGAVMVLAGPPGV

SEQ ID NO: 717854 - protein, 23 aa, Mycobacterium
RAQRLAPRPVIVDLCTGSGALAV

SEQ ID NO: 717855 - protein, 26 aa, Mycobacterium
RAQRRVRPLPAGLFSRVEDFARKCSA

SEQ ID NO: 717856 - protein, 19 aa, Mycobacterium
RAQRVAVHLLDKLGVAASD

SEQ ID NO: 717857 - protein, 22 aa, Mycobacterium
RAQSLGLCGFGRFGDPERLARR

SEQ ID NO: 717858 - protein, 24 aa, Mycobacterium
RAQTLRSAWALTRRLLIVSSRLTW

SEQ ID NO: 717859 - protein, 24 aa, Mycobacterium
RAQTRLAVVSALFGLVRAGDRIPA

SEQ ID NO: 717860 - protein, 19 aa, Mycobacterium
RAQTVLPLLHAFRAPQAPL

SEQ ID NO: 717861 - protein, 19 aa, Mycobacterium
RAQVAALMLADAVTAPSLP

SEQ ID NO: 717862 - protein, 27 aa, Mycobacterium
RAQVGLPAFMMRAFCDLAERHPWQETR

SEQ ID NO: 717863 - protein, 17 aa, Mycobacterium
RAQVLTLALVLGALEAR

SEQ ID NO: 717864 - protein, 17 aa, Mycobacterium
RAQVLYSVFIAWHTCET

SEQ ID NO: 717865 - protein, 17 aa, Mycobacterium
RAQVWRHPGAVIGGSDA

SEQ ID NO: 717866 - protein, 23 aa, Mycobacterium
RAQWKAEAPGLVTVSVAGQQRKV

SEQ ID NO: 717867 - protein, 19 aa, Mycobacterium
RAQYAAVVVRSEILTQYLP

SEQ ID NO: 717868 - protein, 20 aa, Mycobacterium
RAQYERAWGTIEELKEKDEA

SEQ ID NO: 717869 - protein, 19 aa, Mycobacterium
RARAAGVVCRPRDVFVEQT

SEQ ID NO: 717870 - protein, 20 aa, Mycobacterium
RARAAKLLRSVMTRHRDTTR

SEQ ID NO: 717871 - protein, 20 aa, Mycobacterium
RARAFYRRLGYHAAHVGLKR

SEQ ID NO: 717872 - protein, 21 aa, Mycobacterium
RARAFYRRLGYHAAHVGLKRT

SEQ ID NO: 717873 - protein, 24 aa, Mycobacterium
RARAGEITAEMAFIAAREGMPAEL

SEQ ID NO: 717874 - protein, 24 aa, Mycobacterium
RARAGEITAEMAFIAAREGMSAEL

SEQ ID NO: 717875 - protein, 23 aa, Mycobacterium
RARAGEITAEMAFIAEREGVPAE

SEQ ID NO: 717876 - protein, 24 aa, Mycobacterium
RARAGEITAEMAFIASREGMPAEL

SEQ ID NO: 717877 - protein, 18 aa, Mycobacterium
RARAPGPPSDRCRAHRHR

SEQ ID NO: 717878 - protein, 19 aa, Mycobacterium
RARAPRPVDQVNLAAHVLL

SEQ ID NO: 717879 - protein, 17 aa, Mycobacterium
RARARHVVTENARVREV

SEQ ID NO: 717880 - protein, 23 aa, Mycobacterium
RARAVELLDLVGIAQPERRARSF

SEQ ID NO: 717881 - protein, 20 aa, Mycobacterium
RARCETHCRDRLALSPDPDA

SEQ ID NO: 717882 - protein, 18 aa, Mycobacterium
RARCGRSMARPFAAPPTA

SEQ ID NO: 717883 - protein, 20 aa, Mycobacterium
RARCKVSVDGVERLSDPVQA

SEQ ID NO: 717884 - protein, 22 aa, Mycobacterium
RARDAGAMAYLVKPFSITDLIP

SEQ ID NO: 717885 - protein, 22 aa, Mycobacterium
RARDAGAMAYLVKPFTASDLIP

SEQ ID NO: 717886 - protein, 23 aa, Mycobacterium
RARDAGAMAYLVKPFTVSDLVPA

SEQ ID NO: 717887 - protein, 18 aa, Mycobacterium
RARDAGVAMTARMVFEHP

SEQ ID NO: 717888 - protein, 29 aa, Mycobacterium
RARDIATAHWLTWRHQLAEMISVSQLAMI

SEQ ID NO: 717889 - protein, 21 aa, Mycobacterium
RARDVWNNRILPFAHNLSVGQ

SEQ ID NO: 717890 - protein, 20 aa, Mycobacterium
RAREFGWSPLPGHDDGTLVW

SEQ ID NO: 717891 - protein, 17 aa, Mycobacterium
RAREFVELAVRVAEESA

SEQ ID NO: 717892 - protein, 17 aa, Mycobacterium
RAREFVMKDSYSFDIDS

SEQ ID NO: 717893 - protein, 23 aa, Mycobacterium
RAREIRLRHCPFQNLAEEHGEVT

SEQ ID NO: 717894 - protein, 22 aa, Mycobacterium
RARELAGRADVVVENFRAGTME

SEQ ID NO: 717895 - protein, 21 aa, Mycobacterium
RARELATYFVGQVVGSLDRVR

SEQ ID NO: 717896 - protein, 22 aa, Mycobacterium
RARELLNWNPEIGLREGLGRTV

SEQ ID NO: 717897 - protein, 19 aa, Mycobacterium
RARELPDGFEVVLPADQPL

SEQ ID NO: 717898 - protein, 24 aa, Mycobacterium
RARELRENPAWISGIEHRVETPIL

SEQ ID NO: 717899 - protein, 24 aa, Mycobacterium
RARELRENPAWITGIEHRIDTPVL

SEQ ID NO: 717900 - protein, 24 aa, Mycobacterium
RARELRENPAWITGIEHRIETPSL

SEQ ID NO: 717901 - protein, 25 aa, Mycobacterium
RARELRESPAWITGFEHRIESPSLG

SEQ ID NO: 717902 - protein, 23 aa, Mycobacterium
RARESLDSAAGWLAPLGGSHLRS

SEQ ID NO: 717903 - protein, 21 aa, Mycobacterium
RARESWPGVQIALGNVIATLN

SEQ ID NO: 717904 - protein, 18 aa, Mycobacterium
RAREVLVATEVGMLHQLR

SEQ ID NO: 717905 - protein, 18 aa, Mycobacterium
RARFNGTVLVEWLNVSGG

SEQ ID NO: 717906 - protein, 23 aa, Mycobacterium
RARFVPGNENFQMGAFVKSNDGY

SEQ ID NO: 717907 - protein, 19 aa, Mycobacterium
RARGELMGIGMSFFTEAVG

SEQ ID NO: 717908 - protein, 19 aa, Mycobacterium
RARGFKEFVTENLDQLESR

SEQ ID NO: 717909 - protein, 21 aa, Mycobacterium
RARGIPVLVLAGQVTLPQQAL

SEQ ID NO: 717910 - protein, 17 aa, Mycobacterium
RARGMHRILCEGGPTVL

SEQ ID NO: 717911 - protein, 25 aa, Mycobacterium
RARGSLRRFVPFDVDASILSTAAAA

SEQ ID NO: 717912 - protein, 27 aa, Mycobacterium
RARGVFAMEAMWTRFQPAIVAAKDLVD

SEQ ID NO: 717913 - protein, 24 aa, Mycobacterium
RARHELIAEAFGGKGYHVATPDEL

SEQ ID NO: 717914 - protein, 24 aa, Mycobacterium
RARHELIAEAFSGKGYHVTTPAEL

SEQ ID NO: 717915 - protein, 19 aa, Mycobacterium
RARHGKFGAVVARDRAGAV

SEQ ID NO: 717916 - protein, 17 aa, Mycobacterium
RARHLCERLLSFASPLQ

SEQ ID NO: 717917 - protein, 17 aa, Mycobacterium
RARHRLTLDEGRELAVG

SEQ ID NO: 717918 - protein, 27 aa, Mycobacterium
RARIAEGMPCYGSCAGMILLATEIADA

SEQ ID NO: 717919 - protein, 21 aa, Mycobacterium
RARICEIEGLLSHAVVVGEGA

SEQ ID NO: 717920 - protein, 30 aa, Mycobacterium
RARILDLFGFAAAHPRLCRNVVPSTVHQHV

SEQ ID NO: 717921 - protein, 17 aa, Mycobacterium
RARIRTANFFAVDPRPE

SEQ ID NO: 717922 - protein, 28 aa, Mycobacterium
RARISRLRTAPPFAVHRFWLDRPVSARR

SEQ ID NO: 717923 - protein, 19 aa, Mycobacterium
RARITPLWVKGHRGEPLNE

SEQ ID NO: 717924 - protein, 23 aa, Mycobacterium
RARKGEITAEMAFIAEREGLPVE

SEQ ID NO: 717925 - protein, 19 aa, Mycobacterium
RARLACSLAEQGQAVAVVS

SEQ ID NO: 717926 - protein, 19 aa, Mycobacterium
RARLACSLAEQGRAVAVVS

SEQ ID NO: 717927 - protein, 18 aa, Mycobacterium
RARLARRMTSQRSTVNPV

SEQ ID NO: 717928 - protein, 22 aa, Mycobacterium
RARLDARFGAGVVKVPSQRTAY

SEQ ID NO: 717929 - protein, 20 aa, Mycobacterium
RARLDEMLLITFGRAASQEL

SEQ ID NO: 717930 - protein, 17 aa, Mycobacterium
RARLDRPPANAFLAEIL

SEQ ID NO: 717931 - protein, 26 aa, Mycobacterium
RARLFPRGLAAFIELRDQRCRTPYCD

SEQ ID NO: 717932 - protein, 18 aa, Mycobacterium
RARLIDRINNLRVGHSLD

SEQ ID NO: 717933 - protein, 17 aa, Mycobacterium
RARLIELGESFIAETVF

SEQ ID NO: 717934 - protein, 18 aa, Mycobacterium
RARLIERINNLRVGHSLD

SEQ ID NO: 717935 - protein, 19 aa, Mycobacterium
RARLREWLVQIGADSADIS

SEQ ID NO: 717936 - protein, 23 aa, Mycobacterium
RARLRNIEFRGAVSAAMVYDHKA

SEQ ID NO: 717937 - protein, 19 aa, Mycobacterium
RARLRQSWLERGASEAELG

SEQ ID NO: 717938 - protein, 18 aa, Mycobacterium
RARLRRRGQVAVYGVDKF

SEQ ID NO: 717939 - protein, 18 aa, Mycobacterium
RARLRRRHEAFGKSPRDA

SEQ ID NO: 717940 - protein, 17 aa, Mycobacterium
RARMWPLAMTTLTTHDT

SEQ ID NO: 717941 - protein, 19 aa, Mycobacterium
RARNPKIIYARGHGYGTRG

SEQ ID NO: 717942 - protein, 23 aa, Mycobacterium
RARNPKLIYARLSAFGGNGPHGT

SEQ ID NO: 717943 - protein, 18 aa, Mycobacterium
RARNVIVVAHNLAHDARN

SEQ ID NO: 717944 - protein, 17 aa, Mycobacterium
RARPGFVKSARPQRLPL

SEQ ID NO: 717945 - protein, 20 aa, Mycobacterium
RARQANGFELVRAHLELARR

SEQ ID NO: 717946 - protein, 26 aa, Mycobacterium
RARQRAQELLDQFGLTYAGKRLVRTY

SEQ ID NO: 717947 - protein, 22 aa, Mycobacterium
RARQRGFSWGVQRPDGMSVGKL

SEQ ID NO: 717948 - protein, 17 aa, Mycobacterium
RARRAANEEDRRFVAGM

SEQ ID NO: 717949 - protein, 25 aa, Mycobacterium
RARRFARALHRWGLGVRRERSELAP

SEQ ID NO: 717950 - protein, 18 aa, Mycobacterium
RARRFYERDGWNFDGTRR

SEQ ID NO: 717951 - protein, 23 aa, Mycobacterium
RARRFYERDGWRFDGTRRTEVFG

SEQ ID NO: 717952 - protein, 22 aa, Mycobacterium
RARRIPLQHLVGSAAFGPIEVR

SEQ ID NO: 717953 - protein, 19 aa, Mycobacterium
RARRLKALGLAREAATPSR

SEQ ID NO: 717954 - protein, 17 aa, Mycobacterium
RARRLRLESAREVGPWI

SEQ ID NO: 717955 - protein, 17 aa, Mycobacterium
RARRLRVAGAGLIRSWR

SEQ ID NO: 717956 - protein, 17 aa, Mycobacterium
RARRMFADYDALFDSRE

SEQ ID NO: 717957 - protein, 20 aa, Mycobacterium
RARRRGFGTALARAALTDTA

SEQ ID NO: 717958 - protein, 23 aa, Mycobacterium
RARRRLYLSRAIVRSSWGQPMLN

SEQ ID NO: 717959 - protein, 24 aa, Mycobacterium
RARRRRPRIAFVYTGQGSQYREMG

SEQ ID NO: 717960 - protein, 17 aa, Mycobacterium
RARRTGVVQGTRRTRPV

SEQ ID NO: 717961 - protein, 20 aa, Mycobacterium
RARSAWPVAGEGLIDAIVGL

SEQ ID NO: 717962 - protein, 31 aa, Mycobacterium
RARSGQMLLRRNGFRAAHPVVEKDAGGDVGP

SEQ ID NO: 717963 - protein, 18 aa, Mycobacterium
RARSIGVSNFQVAHLERL

SEQ ID NO: 717964 - protein, 18 aa, Mycobacterium
RARSIGVSNFQVAHLQRL

SEQ ID NO: 717965 - protein, 17 aa, Mycobacterium
RARSKAARKVWDSADKF

SEQ ID NO: 717966 - protein, 19 aa, Mycobacterium
RARSWWDGPDIVLLVDDWH

SEQ ID NO: 717967 - protein, 22 aa, Mycobacterium
RARTEALPKLLSMVDAGELRLH

SEQ ID NO: 717968 - protein, 18 aa, Mycobacterium
RARTELPRSPGTVTLARA

SEQ ID NO: 717969 - protein, 22 aa, Mycobacterium
RARTRTGASIVAIVRGDDVVAS

SEQ ID NO: 717970 - protein, 17 aa, Mycobacterium
RARTRVMITAVDSDTGD

SEQ ID NO: 717971 - protein, 20 aa, Mycobacterium
RARTSSVRGWARLPVKTVGA

SEQ ID NO: 717972 - protein, 19 aa, Mycobacterium
RARTVIDFAARRVYPPRYQ

SEQ ID NO: 717973 - protein, 25 aa, Mycobacterium
RARVFRNACRHRGFALVENAGCSHA

SEQ ID NO: 717974 - protein, 31 aa, Mycobacterium
RARVINPRWMAAMRRHGYKGAFEMAATVDYL

SEQ ID NO: 717975 - protein, 19 aa, Mycobacterium
RARVKARYSAALRGDVDTQ

SEQ ID NO: 717976 - protein, 17 aa, Mycobacterium
RARVLGEAVALLRDMLN

SEQ ID NO: 717977 - protein, 24 aa, Mycobacterium
RARVLHCAALRRLADKTQVVGPRD

SEQ ID NO: 717978 - protein, 24 aa, Mycobacterium
RARVLHCAALRRLADKTQVVGPRE

SEQ ID NO: 717979 - protein, 24 aa, Mycobacterium
RARVLHCAALRRLADKTQVVGPRH

SEQ ID NO: 717980 - protein, 19 aa, Mycobacterium
RARVNAMRYLLAKSDYDEK

SEQ ID NO: 717981 - protein, 20 aa, Mycobacterium
RARVPGALAATLREFAASPA

SEQ ID NO: 717982 - protein, 21 aa, Mycobacterium
RARVPTRIGARHGVILASGGF

SEQ ID NO: 717983 - protein, 28 aa, Mycobacterium
RARVQSVLLPRLLDWLSYAPDPDGGLLA

SEQ ID NO: 717984 - protein, 31 aa, Mycobacterium
RARVVNPRWINAMRRHGYKGAFEMAATVDYL

SEQ ID NO: 717985 - protein, 25 aa, Mycobacterium
RARVVNPRWLEAMRRHGYKGAFEMA

SEQ ID NO: 717986 - protein, 21 aa, Mycobacterium
RARVWAAAIGAELGPDGVGAF

SEQ ID NO: 717987 - protein, 23 aa, Mycobacterium
RARWALLDARVSDGWWYATSAGQ

SEQ ID NO: 717988 - protein, 22 aa, Mycobacterium
RARWEECLAELGVGELHAELAR

SEQ ID NO: 717989 - protein, 19 aa, Mycobacterium
RARWMPGIISGDLVLAIAM

SEQ ID NO: 717990 - protein, 18 aa, Mycobacterium
RARYACFDHTAADDGQAY

SEQ ID NO: 717991 - protein, 22 aa, Mycobacterium
RARYLGITGGGGFLLYLQMHET

SEQ ID NO: 717992 - protein, 18 aa, Mycobacterium
RARYRSRLAGAGRHLPPT

SEQ ID NO: 717993 - protein, 18 aa, Mycobacterium
RARYWPKLVDMYPSYEDY

SEQ ID NO: 717994 - protein, 19 aa, Mycobacterium
RASAELKAMLAQFDATDVT

SEQ ID NO: 717995 - protein, 20 aa, Mycobacterium
RASALAAYLLGRNDPVAQVP

SEQ ID NO: 717996 - protein, 17 aa, Mycobacterium
RASALDWTVLGPGRLTL

SEQ ID NO: 717997 - protein, 20 aa, Mycobacterium
RASALPVPTARPVMVVDGRS

SEQ ID NO: 717998 - protein, 19 aa, Mycobacterium
RASAPVWSSVALHRPAEFN

SEQ ID NO: 717999 - protein, 23 aa, Mycobacterium
RASARLATAFTQTWVATSDDDAN

SEQ ID NO: 718000 - protein, 17 aa, Mycobacterium
RASAVAVGAAWFNARVA

SEQ ID NO: 718001 - protein, 24 aa, Mycobacterium
RASAYRCGEAWSTLVHHRPSGRRL

SEQ ID NO: 718002 - protein, 23 aa, Mycobacterium
RASCERVAAALGVESLREVQDRG

SEQ ID NO: 718003 - protein, 17 aa, Mycobacterium
RASCPIFGFPTMTSGYP

SEQ ID NO: 718004 - protein, 24 aa, Mycobacterium
RASDAVACALALQRAPLAPLRLRI

SEQ ID NO: 718005 - protein, 26 aa, Mycobacterium
RASDEISRLFYGLREDLDQIDLHAHE

SEQ ID NO: 718006 - protein, 29 aa, Mycobacterium
RASDLAARLKAAWAPGGLIQRGQGRWYPG

SEQ ID NO: 718007 - protein, 19 aa, Mycobacterium
RASEEQRRALLAGLLDTDG

SEQ ID NO: 718008 - protein, 17 aa, Mycobacterium
RASEFATGLAFDEASRR

SEQ ID NO: 718009 - protein, 23 aa, Mycobacterium
RASEWLRRKLARKEKVMGFGHRV

SEQ ID NO: 718010 - protein, 25 aa, Mycobacterium
RASFAESFVALGIIPGDGGTWFLQR

SEQ ID NO: 718011 - protein, 20 aa, Mycobacterium
RASFDEGWQSIARSLARHPA

SEQ ID NO: 718012 - protein, 19 aa, Mycobacterium
RASFKRTYRDIDVLLVDDI

SEQ ID NO: 718013 - protein, 19 aa, Mycobacterium
RASFMPKPFGQHPGSAMHT

SEQ ID NO: 718014 - protein, 26 aa, Mycobacterium
RASGKRIVAICPFVAAYVDKHDDYDD

SEQ ID NO: 718015 - protein, 26 aa, Mycobacterium
RASGLDCTSIQWGQWTVHLDLGDAGI

SEQ ID NO: 718016 - protein, 19 aa, Mycobacterium
RASGLERRDEFVVGSLAGP

SEQ ID NO: 718017 - protein, 18 aa, Mycobacterium
RASGLPKPGRQTWHLDPE

SEQ ID NO: 718018 - protein, 17 aa, Mycobacterium
RASGRKALVGKRPMTKV

SEQ ID NO: 718019 - protein, 19 aa, Mycobacterium
RASGRLHYAIALRERLPRV

SEQ ID NO: 718020 - protein, 20 aa, Mycobacterium
RASGRSIGVPGILRMLEMVH

SEQ ID NO: 718021 - protein, 20 aa, Mycobacterium
RASGSSIWLARVSIESTHQT

SEQ ID NO: 718022 - protein, 19 aa, Mycobacterium
RASGWRLQTLDTRAVAHAA

SEQ ID NO: 718023 - protein, 19 aa, Mycobacterium
RASHDWARGKRDQLIGRAG

SEQ ID NO: 718024 - protein, 20 aa, Mycobacterium
RASIDLAVATGAQWVREIFT

SEQ ID NO: 718025 - protein, 18 aa, Mycobacterium
RASIEATADWFAASAART

SEQ ID NO: 718026 - protein, 25 aa, Mycobacterium
RASILVDADDGWSYAVAEGTAVLTP

SEQ ID NO: 718027 - protein, 20 aa, Mycobacterium
RASKAAIIHFTKCAAIELAH

SEQ ID NO: 718028 - protein, 18 aa, Mycobacterium
RASLCGSPGRATTTGSPE

SEQ ID NO: 718029 - protein, 18 aa, Mycobacterium
RASLERLGLDYVDLYLIH

SEQ ID NO: 718030 - protein, 20 aa, Mycobacterium
RASLGRKVRQGELLLIVDDA

SEQ ID NO: 718031 - protein, 20 aa, Mycobacterium
RASMADVRVEVVVRGICALR

SEQ ID NO: 718032 - protein, 18 aa, Mycobacterium
RASMTCHFEIHRGGEHLI

SEQ ID NO: 718033 - protein, 19 aa, Mycobacterium
RASMWLEHIRRHGWKAVAA

SEQ ID NO: 718034 - protein, 23 aa, Mycobacterium
RASNARFAVYLGDLGSDTAARAR

SEQ ID NO: 718035 - protein, 20 aa, Mycobacterium
RASNPSWRQWESGLAALEQA

SEQ ID NO: 718036 - protein, 24 aa, Mycobacterium
RASPAPIAVRGQCGTAVPDGALPA

SEQ ID NO: 718037 - protein, 18 aa, Mycobacterium
RASPHQCRVLATAVSDMV

SEQ ID NO: 718038 - protein, 20 aa, Mycobacterium
RASQNLIPRAFWLTYQNGRD

SEQ ID NO: 718039 - protein, 20 aa, Mycobacterium
RASRGITLMHRLADHCTIHA

SEQ ID NO: 718040 - protein, 17 aa, Mycobacterium
RASSLRMVRGVKNRFGA

SEQ ID NO: 718041 - protein, 19 aa, Mycobacterium
RASSMPVNRYRPFAEEVEH

SEQ ID NO: 718042 - protein, 17 aa, Mycobacterium
RASSWPTDLELLRDKGF

SEQ ID NO: 718043 - protein, 24 aa, Mycobacterium
RASTGGRRALGAFASGRTVTTNPA

SEQ ID NO: 718044 - protein, 18 aa, Mycobacterium
RASVDALAVVAAWRGGAS

SEQ ID NO: 718045 - protein, 17 aa, Mycobacterium
RASVGALGIPVLDTSAV

SEQ ID NO: 718046 - protein, 33 aa, Mycobacterium
RASVGKPALYRRWPSRAHLVFEAVFGWTAPTPE

SEQ ID NO: 718047 - protein, 18 aa, Mycobacterium
RASVIYRRYDGHYGLITP

SEQ ID NO: 718048 - protein, 18 aa, Mycobacterium
RASVKPSRPVDTWEQDNV

SEQ ID NO: 718049 - protein, 19 aa, Mycobacterium
RASVLPGDGLREFAFAPLR

SEQ ID NO: 718050 - protein, 20 aa, Mycobacterium
RASVMALSYVAQSARGNSLP

SEQ ID NO: 718051 - protein, 21 aa, Mycobacterium
RASVSSGEWPVGTKIPTEPEL

SEQ ID NO: 718052 - protein, 25 aa, Mycobacterium
RASYESKPYRGHLMRTYGGTVHPSP

SEQ ID NO: 718053 - protein, 17 aa, Mycobacterium
RASYFVWTYLKSTGDYD

SEQ ID NO: 718054 - protein, 24 aa, Mycobacterium
RATAEAGFRIDVRPILPTITVPTL

SEQ ID NO: 718055 - protein, 18 aa, Mycobacterium
RATAEKLPLLALPTSGGT

SEQ ID NO: 718056 - protein, 19 aa, Mycobacterium
RATAIAFDEACRRGVDLVA

SEQ ID NO: 718057 - protein, 17 aa, Mycobacterium
RATALAHAYQRLGVRQG

SEQ ID NO: 718058 - protein, 27 aa, Mycobacterium
RATALARRLEAGMVWVNNWHIIHPAYP

SEQ ID NO: 718059 - protein, 20 aa, Mycobacterium
RATALLFAGRGYRVGGYDLD

SEQ ID NO: 718060 - protein, 17 aa, Mycobacterium
RATALSYHSVLAALTGE

SEQ ID NO: 718061 - protein, 22 aa, Mycobacterium
RATASALGLVPVRELLQMRRTL

SEQ ID NO: 718062 - protein, 25 aa, Mycobacterium
RATAWRLTGLGLRVIAHDPYCADAR

SEQ ID NO: 718063 - protein, 17 aa, Mycobacterium
RATDVGFRLPAPNGVHF

SEQ ID NO: 718064 - protein, 21 aa, Mycobacterium
RATEAIAFGVGVVGLLNVQYA

SEQ ID NO: 718065 - protein, 24 aa, Mycobacterium
RATEAPAETAARSVVPAASEVPPV

SEQ ID NO: 718066 - protein, 23 aa, Mycobacterium
RATEGADGFALGKLLADTGYTTF

SEQ ID NO: 718067 - protein, 17 aa, Mycobacterium
RATELVLTNGLWRGTVD

SEQ ID NO: 718068 - protein, 24 aa, Mycobacterium
RATEMATLSQMVWIYERDIDTDRL

SEQ ID NO: 718069 - protein, 20 aa, Mycobacterium
RATFEAAFRIDVRPILPTIA

SEQ ID NO: 718070 - protein, 18 aa, Mycobacterium
RATFISCWAQASQAMADH

SEQ ID NO: 718071 - protein, 18 aa, Mycobacterium
RATFLLMQAVHPLMVREG

SEQ ID NO: 718072 - protein, 17 aa, Mycobacterium
RATFLLMQAVYPVMVEA

SEQ ID NO: 718073 - protein, 20 aa, Mycobacterium
RATGGVHILVHVAGGSSSPA

SEQ ID NO: 718074 - protein, 21 aa, Mycobacterium
RATGIVGWPAFTQRMREHPSF

SEQ ID NO: 718075 - protein, 19 aa, Mycobacterium
RATGLALHGGRWEVQTELG

SEQ ID NO: 718076 - protein, 26 aa, Mycobacterium
RATGLPWMADLAHEFGLSPPPPEQIG

SEQ ID NO: 718077 - protein, 20 aa, Mycobacterium
RATGMLARLLEPLYATSAIA

SEQ ID NO: 718078 - protein, 20 aa, Mycobacterium
RATGRRVFIASYLLAQGLFQ

SEQ ID NO: 718079 - protein, 20 aa, Mycobacterium
RATHAAGCAGARLIALGGAG

SEQ ID NO: 718080 - protein, 20 aa, Mycobacterium
RATITAAPAGTAFAAVTALA

SEQ ID NO: 718081 - protein, 19 aa, Mycobacterium
RATKPGARLYMFEFGAHDV

SEQ ID NO: 718082 - protein, 18 aa, Mycobacterium
RATLACVLFAEPAPQLLL

SEQ ID NO: 718083 - protein, 19 aa, Mycobacterium
RATLALPGGLRWIAVHQPD

SEQ ID NO: 718084 - protein, 24 aa, Mycobacterium
RATLALPGGLRWLAQHQPDSYDPP

SEQ ID NO: 718085 - protein, 19 aa, Mycobacterium
RATLALPGGLRWVAVHQAD

SEQ ID NO: 718086 - protein, 18 aa, Mycobacterium
RATLEAVLAKLAAPGMGN

SEQ ID NO: 718087 - protein, 17 aa, Mycobacterium
RATLELLATGPLAGLPP

SEQ ID NO: 718088 - protein, 18 aa, Mycobacterium
RATLFTRYGLPAPGHDDD

SEQ ID NO: 718089 - protein, 18 aa, Mycobacterium
RATLHHRAAALVGSLMRE

SEQ ID NO: 718090 - protein, 20 aa, Mycobacterium
RATLKEGWLYTGDMGSFDAR

SEQ ID NO: 718091 - protein, 18 aa, Mycobacterium
RATLLAKLPTGDIRQLTA

SEQ ID NO: 718092 - protein, 18 aa, Mycobacterium
RATLRARIATVPDAKDVG

SEQ ID NO: 718093 - protein, 18 aa, Mycobacterium
RATLSRLGITDVADLRAA

SEQ ID NO: 718094 - protein, 18 aa, Mycobacterium
RATPDCLHTATFYPERGA

SEQ ID NO: 718095 - protein, 18 aa, Mycobacterium
RATPDWSVDSALGLMDSI

SEQ ID NO: 718096 - protein, 20 aa, Mycobacterium
RATPETDFLVLEMSARHPGN

SEQ ID NO: 718097 - protein, 24 aa, Mycobacterium
RATPHAAEALECLGGNGYVEDSGM

SEQ ID NO: 718098 - protein, 28 aa, Mycobacterium
RATPPARLVGWTSRFLGMVLPGDEIEFR

SEQ ID NO: 718099 - protein, 23 aa, Mycobacterium
RATPVRLPARYVGTHTTLGYAST

SEQ ID NO: 718100 - protein, 28 aa, Mycobacterium
RATQHLPWHPGRCAEVLVGEAVVGHAGQ

SEQ ID NO: 718101 - protein, 19 aa, Mycobacterium
RATQLLIYHSAYFAPELIP

SEQ ID NO: 718102 - protein, 22 aa, Mycobacterium
RATQWLDLRFVSGPGDLLRGMV

SEQ ID NO: 718103 - protein, 26 aa, Mycobacterium
RATQWRLSGLGLRVIAHDPYNPDARH

SEQ ID NO: 718104 - protein, 20 aa, Mycobacterium
RATRAGRGWPTDPTLGDTVR

SEQ ID NO: 718105 - protein, 18 aa, Mycobacterium
RATSAVFRGAARDIADED

SEQ ID NO: 718106 - protein, 20 aa, Mycobacterium
RATSLLALSARRGRVDLAAI

SEQ ID NO: 718107 - protein, 24 aa, Mycobacterium
RATSVESPFRFLVFDDPIQAMDPS

SEQ ID NO: 718108 - protein, 18 aa, Mycobacterium
RATSVHWHGIALRNDMDG

SEQ ID NO: 718109 - protein, 18 aa, Mycobacterium
RATVPVAVIAEWAAVDGD

SEQ ID NO: 718110 - protein, 19 aa, Mycobacterium
RATVWGREPGAWGRNYYQR

SEQ ID NO: 718111 - protein, 29 aa, Mycobacterium
RAVAAGMPRPDWLVAPAIAYGASGEHQSF

SEQ ID NO: 718112 - protein, 20 aa, Mycobacterium
RAVAATMPMITWLQTTAAQA

SEQ ID NO: 718113 - protein, 24 aa, Mycobacterium
RAVAAYGAICERLHTASLRTVVIG

SEQ ID NO: 718114 - protein, 23 aa, Mycobacterium
RAVADAVLYEGYLLYPYRGTSSK

SEQ ID NO: 718115 - protein, 19 aa, Mycobacterium
RAVAELLGGLGAGVVVNGR

SEQ ID NO: 718116 - protein, 28 aa, Mycobacterium
RAVAIRVAGWIDRLGTVWVEGQLAQITI

SEQ ID NO: 718117 - protein, 19 aa, Mycobacterium
RAVAKHDPAGAVLVMASNG

SEQ ID NO: 718118 - protein, 19 aa, Mycobacterium
RAVALLGDLGHRVEEVPPP

SEQ ID NO: 718119 - protein, 24 aa, Mycobacterium
RAVALRRLAAQPGRDRDDALRELG

SEQ ID NO: 718120 - protein, 22 aa, Mycobacterium
RAVARDSLVKTALFGSDANWGR

SEQ ID NO: 718121 - protein, 18 aa, Mycobacterium
RAVARGELPADVDVAHVA

SEQ ID NO: 718122 - protein, 18 aa, Mycobacterium
RAVARLGVNIDLIRGVSD

SEQ ID NO: 718123 - protein, 18 aa, Mycobacterium
RAVATLFGAFGQEYQAVV

SEQ ID NO: 718124 - protein, 18 aa, Mycobacterium
RAVATRVAKWIDRLGQVW

SEQ ID NO: 718125 - protein, 28 aa, Mycobacterium
RAVAVNLLLPFVHRAHVAVCVDAGVDCV

SEQ ID NO: 718126 - protein, 17 aa, Mycobacterium
RAVAWGSLTKYSLEKAL

SEQ ID NO: 718127 - protein, 19 aa, Mycobacterium
RAVCDGRRLVRLDGPEVGA

SEQ ID NO: 718128 - protein, 18 aa, Mycobacterium
RAVCKAAGLTERYFYESF

SEQ ID NO: 718129 - protein, 19 aa, Mycobacterium
RAVCPDIDVVIVRENTEGF

SEQ ID NO: 718130 - protein, 18 aa, Mycobacterium
RAVDAGAAGYVFNLGHGV

SEQ ID NO: 718131 - protein, 17 aa, Mycobacterium
RAVDAGAGGHVFNLGHG

SEQ ID NO: 718132 - protein, 18 aa, Mycobacterium
RAVDAGATGHVFNLGHGV

SEQ ID NO: 718133 - protein, 19 aa, Mycobacterium
RAVDEGHTAFGGRHPINPS

SEQ ID NO: 718134 - protein, 26 aa, Mycobacterium
RAVECGLRAMGVRAGGLVVRCRNAIP

SEQ ID NO: 718135 - protein, 19 aa, Mycobacterium
RAVEELLRVYPIVQTARKA

SEQ ID NO: 718136 - protein, 25 aa, Mycobacterium
RAVEFASAILRRGIDVNFMVDIRLD

SEQ ID NO: 718137 - protein, 17 aa, Mycobacterium
RAVELFKPLATKATRPE

SEQ ID NO: 718138 - protein, 22 aa, Mycobacterium
RAVELFKPLATRATRPEVRGGL

SEQ ID NO: 718139 - protein, 20 aa, Mycobacterium
RAVEMFKPLATRATRPEVRG

SEQ ID NO: 718140 - protein, 17 aa, Mycobacterium
RAVFVLHDVFGFDYAEI

SEQ ID NO: 718141 - protein, 18 aa, Mycobacterium
RAVFVMREVFGFDYSEIA

SEQ ID NO: 718142 - protein, 25 aa, Mycobacterium
RAVGARCRAMLLAAHGDVAAAEQMA

SEQ ID NO: 718143 - protein, 18 aa, Mycobacterium
RAVGEKIAAHWISTREQR

SEQ ID NO: 718144 - protein, 20 aa, Mycobacterium
RAVGELSPLLSARAQLFLAE

SEQ ID NO: 718145 - protein, 25 aa, Mycobacterium
RAVGFDPPYPSWPLAPSAFEEAPSY

SEQ ID NO: 718146 - protein, 23 aa, Mycobacterium
RAVGGFFPNVVVLQGDLPALQTQ

SEQ ID NO: 718147 - protein, 17 aa, Mycobacterium
RAVGHPFFVRMLDGQIP

SEQ ID NO: 718148 - protein, 18 aa, Mycobacterium
RAVGRKALDVYFNLANYR

SEQ ID NO: 718149 - protein, 17 aa, Mycobacterium
RAVGVTFLTRWATGELS

SEQ ID NO: 718150 - protein, 17 aa, Mycobacterium
RAVHAFGAALAGSGKPF

SEQ ID NO: 718151 - protein, 21 aa, Mycobacterium
RAVHFQEWWVRHRAQVPTDSF

SEQ ID NO: 718152 - protein, 17 aa, Mycobacterium
RAVHLAKGCYRGQETVA

SEQ ID NO: 718153 - protein, 21 aa, Mycobacterium
RAVIIGTGFSGLGMAIALQKQ

SEQ ID NO: 718154 - protein, 17 aa, Mycobacterium
RAVILAMGAAPRYLGVP

SEQ ID NO: 718155 - protein, 17 aa, Mycobacterium
RAVIRPGHRNSRAALAL

SEQ ID NO: 718156 - protein, 19 aa, Mycobacterium
RAVIRYDDLIGGRYLALEE

SEQ ID NO: 718157 - protein, 19 aa, Mycobacterium
RAVITRWIEQPVYEGIRFA

SEQ ID NO: 718158 - protein, 19 aa, Mycobacterium
RAVLDLRPPIGRSGRGIVA

SEQ ID NO: 718159 - protein, 18 aa, Mycobacterium
RAVLDRATAVTPGLESPT

SEQ ID NO: 718160 - protein, 27 aa, Mycobacterium
RAVLDRKIPLFGICFGNQLLGRALGRS

SEQ ID NO: 718161 - protein, 17 aa, Mycobacterium
RAVLEALGIRVVINPTR

SEQ ID NO: 718162 - protein, 21 aa, Mycobacterium
RAVLECAGVHDILAKSLGSDN

SEQ ID NO: 718163 - protein, 23 aa, Mycobacterium
RAVLEYRSPIKFGETVTIRSEQR

SEQ ID NO: 718164 - protein, 18 aa, Mycobacterium
RAVLKERVALAPAPPPAL

SEQ ID NO: 718165 - protein, 25 aa, Mycobacterium
RAVLPEWFIGSGLTAAAYRGAQFHP

SEQ ID NO: 718166 - protein, 18 aa, Mycobacterium
RAVLQRFGEITAELTERF

SEQ ID NO: 718167 - protein, 24 aa, Mycobacterium
RAVLQRLGIDDIRGARIEYDAMIP

SEQ ID NO: 718168 - protein, 17 aa, Mycobacterium
RAVLVGRAYLWGLAANG

SEQ ID NO: 718169 - protein, 17 aa, Mycobacterium
RAVMIGRAYLWGLAANG

SEQ ID NO: 718170 - protein, 20 aa, Mycobacterium
RAVMLPVVVVMGFEADPESG

SEQ ID NO: 718171 - protein, 18 aa, Mycobacterium
RAVMRAMTIAALEAGNQC

SEQ ID NO: 718172 - protein, 18 aa, Mycobacterium
RAVNFVIDGILGKGVAYQ

SEQ ID NO: 718173 - protein, 25 aa, Mycobacterium
RAVPARPALELSKIYVLADRHGTGA

SEQ ID NO: 718174 - protein, 25 aa, Mycobacterium
RAVPEAPDGPGWRITGQKVWTSYAQ

SEQ ID NO: 718175 - protein, 23 aa, Mycobacterium
RAVPGRLGRRGRLDDDVRVGAAD

SEQ ID NO: 718176 - protein, 20 aa, Mycobacterium
RAVPIGRLSVPQNWVTASPA

SEQ ID NO: 718177 - protein, 23 aa, Mycobacterium
RAVPLCFGFHPYLHIPDVARGEW

SEQ ID NO: 718178 - protein, 19 aa, Mycobacterium
RAVPLRLISVIKTTHPSPE

SEQ ID NO: 718179 - protein, 19 aa, Mycobacterium
RAVPRTDVLLAHPKLAEAQ

SEQ ID NO: 718180 - protein, 26 aa, Mycobacterium
RAVQAWRGFSRWLMRAYDVLVDEDQI

SEQ ID NO: 718181 - protein, 20 aa, Mycobacterium
RAVQELPTGPGAVFADTTYL

SEQ ID NO: 718182 - protein, 21 aa, Mycobacterium
RAVQIRARRGVIVCAGGFIAN

SEQ ID NO: 718183 - protein, 19 aa, Mycobacterium
RAVQLAVLVDRGHRELPLR

SEQ ID NO: 718184 - protein, 19 aa, Mycobacterium
RAVQLAVLVDRGHRELPVR

SEQ ID NO: 718185 - protein, 22 aa, Mycobacterium
RAVRAPWLTRLRPLGEDASLVL

SEQ ID NO: 718186 - protein, 17 aa, Mycobacterium
RAVRIGPHVAVAGTTGN

SEQ ID NO: 718187 - protein, 18 aa, Mycobacterium
RAVRPGLVIAAEFRGPDE

SEQ ID NO: 718188 - protein, 18 aa, Mycobacterium
RAVRPWAPHDYVPWSRGR

SEQ ID NO: 718189 - protein, 19 aa, Mycobacterium
RAVRRQPRVLILDEPTSAL

SEQ ID NO: 718190 - protein, 20 aa, Mycobacterium
RAVSEIRAVVRWAQPQASAV

SEQ ID NO: 718191 - protein, 20 aa, Mycobacterium
RAVSELVAIVANGQPLTPEV

SEQ ID NO: 718192 - protein, 21 aa, Mycobacterium
RAVSLEDRFAGLLPEVMLGVD

SEQ ID NO: 718193 - protein, 19 aa, Mycobacterium
RAVSLEDRFTELLPEVMIG

SEQ ID NO: 718194 - protein, 19 aa, Mycobacterium
RAVSLEDRFTELLPEVMLG

SEQ ID NO: 718195 - protein, 19 aa, Mycobacterium
RAVSLLSRVILPRPGEPLD

SEQ ID NO: 718196 - protein, 20 aa, Mycobacterium
RAVSNSALFGGRAVHAERIA

SEQ ID NO: 718197 - protein, 22 aa, Mycobacterium
RAVSPVDCWQHPTINALVAFLT

SEQ ID NO: 718198 - protein, 21 aa, Mycobacterium
RAVSRAGDWFGSPVNAASRIT

SEQ ID NO: 718199 - protein, 17 aa, Mycobacterium
RAVSTPAAFCAHEVGLG

SEQ ID NO: 718200 - protein, 24 aa, Mycobacterium
RAVTLAALAPRPGERLWDVGAASG

SEQ ID NO: 718201 - protein, 23 aa, Mycobacterium
RAVTLAALGPRPGQRLWDVGAGS

SEQ ID NO: 718202 - protein, 19 aa, Mycobacterium
RAVTLDLRRPRGRELFLEL

SEQ ID NO: 718203 - protein, 20 aa, Mycobacterium
RAVTLPGYGGSTLWANTAAA

SEQ ID NO: 718204 - protein, 20 aa, Mycobacterium
RAVVAFGGLQDCCVQFVDAP

SEQ ID NO: 718205 - protein, 20 aa, Mycobacterium
RAVVEPAFWLGQPRTGPSSF

SEQ ID NO: 718206 - protein, 28 aa, Mycobacterium
RAVVIEPRLWVPDDFAFVRYLAVGLAAL

SEQ ID NO: 718207 - protein, 24 aa, Mycobacterium
RAVVKGAPHALVIGDLPFGSYEDG

SEQ ID NO: 718208 - protein, 24 aa, Mycobacterium
RAVVLKRMQRWLVDNADQVIATIC

SEQ ID NO: 718209 - protein, 28 aa, Mycobacterium
RAVVMSFSAAAVWRIRRAAPMLPTVLLG

SEQ ID NO: 718210 - protein, 27 aa, Mycobacterium
RAVVMSFSAGAVWRIRRAAPMLPTVLL

SEQ ID NO: 718211 - protein, 32 aa, Mycobacterium
RAVVSARAALPGWKGATPAERSAVLAKLAKLA

SEQ ID NO: 718212 - protein, 27 aa, Mycobacterium
RAVVTRYELVDGFPYLDVDDVFLGNGV

SEQ ID NO: 718213 - protein, 32 aa, Mycobacterium
RAVVTRYELVEGFPRFDVDDVYLGNGCSELIT

SEQ ID NO: 718214 - protein, 32 aa, Mycobacterium
RAVVTRYELVEGFPRFDVDDVYLGNGVSELIT

SEQ ID NO: 718215 - protein, 26 aa, Mycobacterium
RAVVVCPIGFVADHIEVVWDLDEELR

SEQ ID NO: 718216 - protein, 20 aa, Mycobacterium
RAVVVGAGFIGCEVAASLRK

SEQ ID NO: 718217 - protein, 20 aa, Mycobacterium
RAVVVGTLAVPRGWGAAAIA

SEQ ID NO: 718218 - protein, 25 aa, Mycobacterium
RAVWAEPTGRLALIVHHLAVDGVSW

SEQ ID NO: 718219 - protein, 20 aa, Mycobacterium
RAVWCPIEVRGLDRGCGELD

SEQ ID NO: 718220 - protein, 23 aa, Mycobacterium
RAVWIGHDWGAAVVWNAPLLHPD

SEQ ID NO: 718221 - protein, 24 aa, Mycobacterium
RAVWRRGAETFAEVELPQHAGVAT

SEQ ID NO: 718222 - protein, 19 aa, Mycobacterium
RAWDVANLDAAAKAIEDAS

SEQ ID NO: 718223 - protein, 22 aa, Mycobacterium
RAWKAKRAALETVYLVERSPGR

SEQ ID NO: 718224 - protein, 24 aa, Mycobacterium
RAWLDRDAWSRMSIRNTARSGKFS

SEQ ID NO: 718225 - protein, 19 aa, Mycobacterium
RAWLGREACEPIRYLTYDL

SEQ ID NO: 718226 - protein, 20 aa, Mycobacterium
RAWMSAPVWAPAYLPVLSLA

SEQ ID NO: 718227 - protein, 18 aa, Mycobacterium
RAWTARPLVGLGRSGNPG

SEQ ID NO: 718228 - protein, 19 aa, Mycobacterium
RAWVSGLLASGWVDAVRQL

SEQ ID NO: 718229 - protein, 23 aa, Mycobacterium
RAYADTRPLLFFEYYPELIRMAG

SEQ ID NO: 718230 - protein, 18 aa, Mycobacterium
RAYADWSAEINARYRGQL

SEQ ID NO: 718231 - protein, 26 aa, Mycobacterium
RAYCPAPQFCSRCLTELGSPYPLDGK

SEQ ID NO: 718232 - protein, 23 aa, Mycobacterium
RAYCVRCLDPLVGSDGFDIIANL

SEQ ID NO: 718233 - protein, 24 aa, Mycobacterium
RAYEPLLLVRCLQRHPALATRLRK

SEQ ID NO: 718234 - protein, 18 aa, Mycobacterium
RAYFDAVLSKLAAPGMCD

SEQ ID NO: 718235 - protein, 20 aa, Mycobacterium
RAYGDFWSYCMVAEGAVDIA

SEQ ID NO: 718236 - protein, 20 aa, Mycobacterium
RAYGGTFLQFADYMRPAVRL

SEQ ID NO: 718237 - protein, 17 aa, Mycobacterium
RAYGHSEYARMGSNGEL

SEQ ID NO: 718238 - protein, 19 aa, Mycobacterium
RAYGWRLGLNIGPTSKVVD

SEQ ID NO: 718239 - protein, 26 aa, Mycobacterium
RAYKPLNWMSPPCRLVEQADGETPVW

SEQ ID NO: 718240 - protein, 17 aa, Mycobacterium
RAYLECRQERSATATRL

SEQ ID NO: 718241 - protein, 17 aa, Mycobacterium
RAYLRTTARTVLAAHWR

SEQ ID NO: 718242 - protein, 19 aa, Mycobacterium
RAYLSTGLIALGKTRLSEY

SEQ ID NO: 718243 - protein, 20 aa, Mycobacterium
RAYNKFRRGPGAFKVDFAIE

SEQ ID NO: 718244 - protein, 22 aa, Mycobacterium
RAYNPVLRFLLERPVYAKISRD

SEQ ID NO: 718245 - protein, 25 aa, Mycobacterium
RAYPEDARLLLSLRSADILGAEANS

SEQ ID NO: 718246 - protein, 28 aa, Mycobacterium
RAYPRLLREAWAKVTRRSMMPPRSYAFI

SEQ ID NO: 718247 - protein, 25 aa, Mycobacterium
RAYPRSDRGAKVFGITGNHAPEWAA

SEQ ID NO: 718248 - protein, 19 aa, Mycobacterium
RAYQPRIVFVDADNKQIDV

SEQ ID NO: 718249 - protein, 25 aa, Mycobacterium
RAYRLERPLFFALQCMPLNRVRRKH

SEQ ID NO: 718250 - protein, 24 aa, Mycobacterium
RAYRREVLEAIDLDGVDSKGYCFQ

SEQ ID NO: 718251 - protein, 24 aa, Mycobacterium
RAYRREVLEAIGLEAVDSKGYCFQ

SEQ ID NO: 718252 - protein, 24 aa, Mycobacterium
RAYRREVLEALDLDTLESRGYCFQ

SEQ ID NO: 718253 - protein, 24 aa, Mycobacterium
RAYRREVLEKIDLAAVDSKGYGFQ

SEQ ID NO: 718254 - protein, 24 aa, Mycobacterium
RAYRREVLEKIDLASVDSKGYCFQ

SEQ ID NO: 718255 - protein, 21 aa, Mycobacterium
RAYRREVLEKIDLSAVDSKGY

SEQ ID NO: 718256 - protein, 22 aa, Mycobacterium
RAYRREVLEKLDLGAVESHGYC

SEQ ID NO: 718257 - protein, 23 aa, Mycobacterium
RAYRREVLETIDLDSVDSKGYCF

SEQ ID NO: 718258 - protein, 20 aa, Mycobacterium
RAYRTPLHLRSCAGRLDELI

SEQ ID NO: 718259 - protein, 18 aa, Mycobacterium
RAYRVVRYDAAREEAEVA

SEQ ID NO: 718260 - protein, 19 aa, Mycobacterium
RAYSRYLRQAGFPYSQSYI

SEQ ID NO: 718261 - protein, 20 aa, Mycobacterium
RAYVIRKRAEHELGTKGPGQ

SEQ ID NO: 718262 - protein, 20 aa, Mycobacterium
RAYVLDSWLRPVPSGAAGEL

SEQ ID NO: 718263 - protein, 18 aa, Mycobacterium
RAYVTRQARWVDFDNDYK

SEQ ID NO: 718264 - protein, 21 aa, Mycobacterium
RCAAAGLSLRIPRPRLCTDNG

SEQ ID NO: 718265 - protein, 18 aa, Mycobacterium
RCAAMSPKALATLSEAET

SEQ ID NO: 718266 - protein, 17 aa, Mycobacterium
RCAAPGPHRAFHVAAGG

SEQ ID NO: 718267 - protein, 21 aa, Mycobacterium
RCADCRYLTAKWVGRCPECSS

SEQ ID NO: 718268 - protein, 24 aa, Mycobacterium
RCADEAVSVTTGWHRALALTTRAR

SEQ ID NO: 718269 - protein, 17 aa, Mycobacterium
RCADLASEVAFLAMDLE

SEQ ID NO: 718270 - protein, 19 aa, Mycobacterium
RCADMLVALEGARSQILEA

SEQ ID NO: 718271 - protein, 31 aa, Mycobacterium
RCAEAIDGMLPRPLLEVLFDIDRGAGGGAAE

SEQ ID NO: 718272 - protein, 18 aa, Mycobacterium
RCAEQGADLVLAARTVER

SEQ ID NO: 718273 - protein, 18 aa, Mycobacterium
RCAGLIALVTGTSRGLGK

SEQ ID NO: 718274 - protein, 23 aa, Mycobacterium
RCAGYPCHVLGFALPQFGSAAFA

SEQ ID NO: 718275 - protein, 18 aa, Mycobacterium
RCAHRGVLLADGHIDGDT

SEQ ID NO: 718276 - protein, 19 aa, Mycobacterium
RCAMVPAPVETIWHNHLHA

SEQ ID NO: 718277 - protein, 24 aa, Mycobacterium
RCANEGLCAIGLRFSEDKTAPRER

SEQ ID NO: 718278 - protein, 21 aa, Mycobacterium
RCAQKLAGRRGRRLNPRPLID

SEQ ID NO: 718279 - protein, 26 aa, Mycobacterium
RCARARARLAGLLGYLKPAPDLAPPV

SEQ ID NO: 718280 - protein, 21 aa, Mycobacterium
RCARRTRPLLPHHPQHRAAGR

SEQ ID NO: 718281 - protein, 22 aa, Mycobacterium
RCATLRFDLIEDLGYNKQLASS

SEQ ID NO: 718282 - protein, 17 aa, Mycobacterium
RCATPGPHRAFHIAAGG

SEQ ID NO: 718283 - protein, 18 aa, Mycobacterium
RCATPGPHRAFHIAAGGS

SEQ ID NO: 718284 - protein, 17 aa, Mycobacterium
RCATPGPHRAFHVAAGG

SEQ ID NO: 718285 - protein, 24 aa, Mycobacterium
RCAVAIPTSSGWRMLSGDETGWLL

SEQ ID NO: 718286 - protein, 25 aa, Mycobacterium
RCAVGIDLRDDWPAALRRVGFDAAQ

SEQ ID NO: 718287 - protein, 24 aa, Mycobacterium
RCAVGIPTDSGWRMLSGDETGWLL

SEQ ID NO: 718288 - protein, 19 aa, Mycobacterium
RCAVSFERLARVLVAGIDG

SEQ ID NO: 718289 - protein, 30 aa, Mycobacterium
RCCAVKASFRRRWLSVAILRAAFGFHRGKV

SEQ ID NO: 718290 - protein, 18 aa, Mycobacterium
RCCGWAVTVTGSWCMWPV

SEQ ID NO: 718291 - protein, 25 aa, Mycobacterium
RCDCGPQLDAALAMVAREGRGIVLY

SEQ ID NO: 718292 - protein, 17 aa, Mycobacterium
RCDCRVLPLKHVPRAVV

SEQ ID NO: 718293 - protein, 19 aa, Mycobacterium
RCDGEEAVAHLLRIATEPP

SEQ ID NO: 718294 - protein, 20 aa, Mycobacterium
RCDGPRAVVLLLHGGGQSRH

SEQ ID NO: 718295 - protein, 25 aa, Mycobacterium
RCDKALGEYVPWSLLDVVRGAPGAP

SEQ ID NO: 718296 - protein, 18 aa, Mycobacterium
RCDLHLWDGQIHDFPLAA

SEQ ID NO: 718297 - protein, 24 aa, Mycobacterium
RCDLRVVAPEAFFQFPTSKYGLAL

SEQ ID NO: 718298 - protein, 25 aa, Mycobacterium
RCDRELKAGGLHQLRGSRDSVELTP

SEQ ID NO: 718299 - protein, 25 aa, Mycobacterium
RCDRVAGLALRHARLRGVDPADKRV

SEQ ID NO: 718300 - protein, 20 aa, Mycobacterium
RCDRVVYTVGFERRRLPETP

SEQ ID NO: 718301 - protein, 21 aa, Mycobacterium
RCDTCGSYVFPVQDHCPRCSS

SEQ ID NO: 718302 - protein, 19 aa, Mycobacterium
RCEAEGKFARKLQTKGAGH

SEQ ID NO: 718303 - protein, 17 aa, Mycobacterium
RCEGGCRTPYPATAPAG

SEQ ID NO: 718304 - protein, 21 aa, Mycobacterium
RCEHCAACATEGMTPCQPAGA

SEQ ID NO: 718305 - protein, 26 aa, Mycobacterium
RCENHYNVGWAWALDSPFQWMKQVAS

SEQ ID NO: 718306 - protein, 17 aa, Mycobacterium
RCEPVYPTPAGLVGAVR

SEQ ID NO: 718307 - protein, 25 aa, Mycobacterium
RCERHRCFPVLAGPDGTRDLMLVSP

SEQ ID NO: 718308 - protein, 27 aa, Mycobacterium
RCESGPHRYSLPLAEVLAGTLAGEFDD

SEQ ID NO: 718309 - protein, 18 aa, Mycobacterium
RCESRPAAVVGFSLGAQL

SEQ ID NO: 718310 - protein, 17 aa, Mycobacterium
RCFDRLMAVIGALNGMM

SEQ ID NO: 718311 - protein, 26 aa, Mycobacterium
RCFPSYALRRRAKGLGSLTQLELLLI

SEQ ID NO: 718312 - protein, 26 aa, Mycobacterium
RCFQHARGPMPRWYRPVGALYDQFLG

SEQ ID NO: 718313 - protein, 35 aa, Mycobacterium
RCGAAHNCTIPALFRVLFRGGWRGTVAEVLAGLAP

SEQ ID NO: 718314 - protein, 27 aa, Mycobacterium
RCGDVDRVTLFRAWYSRRNFGQLAGTA

SEQ ID NO: 718315 - protein, 22 aa, Mycobacterium
RCGEAMSAVLLECTMAGMATCT

SEQ ID NO: 718316 - protein, 28 aa, Mycobacterium
RCGGKAPDRPGWFYPPTVITDITKDMAL

SEQ ID NO: 718317 - protein, 21 aa, Mycobacterium
RCGHCAACATEGLTPCEPGSA

SEQ ID NO: 718318 - protein, 20 aa, Mycobacterium
RCGHRLEHLEMVSAAQAGQL

SEQ ID NO: 718319 - protein, 20 aa, Mycobacterium
RCGHRLEHLEMVTAAQAAQL

SEQ ID NO: 718320 - protein, 26 aa, Mycobacterium
RCGLSALPADYSGIVVVTAGDTPLLD

SEQ ID NO: 718321 - protein, 25 aa, Mycobacterium
RCGQCPLAECAWRRAGYPPATGPAR

SEQ ID NO: 718322 - protein, 26 aa, Mycobacterium
RCGQHRCFPVLAGPPGARDTLLISPI

SEQ ID NO: 718323 - protein, 17 aa, Mycobacterium
RCGRQGCTDVDALVRAL

SEQ ID NO: 718324 - protein, 18 aa, Mycobacterium
RCGSCPLSDCAWRTAGYP

SEQ ID NO: 718325 - protein, 25 aa, Mycobacterium
RCGSSFGEPEMKAFVGHTMSQANRL

SEQ ID NO: 718326 - protein, 20 aa, Mycobacterium
RCGTPVKWVRLDSAPFTDRL

SEQ ID NO: 718327 - protein, 21 aa, Mycobacterium
RCGTRLPAKHLSAARLRRKVR

SEQ ID NO: 718328 - protein, 31 aa, Mycobacterium
RCGTVSPAVFWPIPRVYSGLVRIDRYPTAPW

SEQ ID NO: 718329 - protein, 26 aa, Mycobacterium
RCHGLQCGFCTPGMMITARALLDRDP

SEQ ID NO: 718330 - protein, 26 aa, Mycobacterium
RCHGLQCGFCTPGMMITARALLDRNP

SEQ ID NO: 718331 - protein, 17 aa, Mycobacterium
RCHVRAVARATGTEIDW

SEQ ID NO: 718332 - protein, 25 aa, Mycobacterium
RCIDYARGRFDAIVPDAVLRELPYD

SEQ ID NO: 718333 - protein, 25 aa, Mycobacterium
RCIDYARGRFDAIVPVEDQRELPYD

SEQ ID NO: 718334 - protein, 24 aa, Mycobacterium
RCIEAEIVRRGWPIGASLGSEAAL

SEQ ID NO: 718335 - protein, 17 aa, Mycobacterium
RCIGVGLAQRGDQVALL

SEQ ID NO: 718336 - protein, 20 aa, Mycobacterium
RCITALRLTPVSTKAVDVAA

SEQ ID NO: 718337 - protein, 17 aa, Mycobacterium
RCLDAGASTGGFTDVLL

SEQ ID NO: 718338 - protein, 18 aa, Mycobacterium
RCLDAGASTGGFTEVLLD

SEQ ID NO: 718339 - protein, 18 aa, Mycobacterium
RCLDAGASTGGFTEVLLR

SEQ ID NO: 718340 - protein, 18 aa, Mycobacterium
RCLDAGASTGGFTEVLLS

SEQ ID NO: 718341 - protein, 21 aa, Mycobacterium
RCLDEGVDIPATRRAYILASS

SEQ ID NO: 718342 - protein, 20 aa, Mycobacterium
RCLDGARILADRLNQPDVAE

SEQ ID NO: 718343 - protein, 17 aa, Mycobacterium
RCLDGPVALLRLEPVEV

SEQ ID NO: 718344 - protein, 23 aa, Mycobacterium
RCLDLTLQWCRDRETFGRPLISR

SEQ ID NO: 718345 - protein, 25 aa, Mycobacterium
RCLDLTVEWCRNRDTFGRPLISRQA

SEQ ID NO: 718346 - protein, 26 aa, Mycobacterium
RCLDLTVEWCRNRQTFGKPLIARQTV

SEQ ID NO: 718347 - protein, 21 aa, Mycobacterium
RCLGATFAMVEFRVVLREILR

SEQ ID NO: 718348 - protein, 20 aa, Mycobacterium
RCLGATFAMVEIRVVLREIL

SEQ ID NO: 718349 - protein, 22 aa, Mycobacterium
RCLPELPKRVRAERMVMVRNLL

SEQ ID NO: 718350 - protein, 21 aa, Mycobacterium
RCLPLADNVARHFDRRGEDLE

SEQ ID NO: 718351 - protein, 20 aa, Mycobacterium
RCLPPEIMAVLCANLDSLEP

SEQ ID NO: 718352 - protein, 25 aa, Mycobacterium
RCLTCGNCTMVCPTCFCTSTEDVSD

SEQ ID NO: 718353 - protein, 17 aa, Mycobacterium
RCMEATVQMAARHLADA

SEQ ID NO: 718354 - protein, 26 aa, Mycobacterium
RCNERIKFSALASRALALGFDALATG

SEQ ID NO: 718355 - protein, 25 aa, Mycobacterium
RCNPSGRLPISFPVDLRQTPRPELP

SEQ ID NO: 718356 - protein, 18 aa, Mycobacterium
RCPDRPGLIDERGSLTWR

SEQ ID NO: 718357 - protein, 20 aa, Mycobacterium
RCQGHTLCAMIAPDSFRLSD

SEQ ID NO: 718358 - protein, 21 aa, Mycobacterium
RCQGHTLCAMIAPESFQLSDI

SEQ ID NO: 718359 - protein, 19 aa, Mycobacterium
RCQGHTLCSMIAPESFVLN

SEQ ID NO: 718360 - protein, 19 aa, Mycobacterium
RCQRRAPGQRQLRLLRCAH

SEQ ID NO: 718361 - protein, 24 aa, Mycobacterium
RCRAGRPGVVFVFSGRGSQWSGMG

SEQ ID NO: 718362 - protein, 26 aa, Mycobacterium
RCRASFLACLDCSNARAFPRHLPIQL

SEQ ID NO: 718363 - protein, 19 aa, Mycobacterium
RCRRLRRPEAQVSHRWTGI

SEQ ID NO: 718364 - protein, 34 aa, Mycobacterium
RCRSGRAANCGRCWVIRCARVTSRHSAATSTSGT

SEQ ID NO: 718365 - protein, 20 aa, Mycobacterium
RCSDRFAPHLDWIVANLDKP

SEQ ID NO: 718366 - protein, 27 aa, Mycobacterium
RCSEAPWWSRDLWDLRIDPRIPQREHE

SEQ ID NO: 718367 - protein, 29 aa, Mycobacterium
RCSECRHVTAKWVGRCLECGTWGTVDEVP

SEQ ID NO: 718368 - protein, 17 aa, Mycobacterium
RCSGLGMLASALAGRAV

SEQ ID NO: 718369 - protein, 19 aa, Mycobacterium
RCSHRPLLERIWALRRTVT

SEQ ID NO: 718370 - protein, 20 aa, Mycobacterium
RCSSCDAGLEQYCKNGATFT

SEQ ID NO: 718371 - protein, 25 aa, Mycobacterium
RCSVPLRLATIAEFISRAAQYQADK

SEQ ID NO: 718372 - protein, 28 aa, Mycobacterium
RCTAEADAAFDQARRRFEEAWNRQNSER

SEQ ID NO: 718373 - protein, 19 aa, Mycobacterium
RCTPGLSEADARLMAHGTF

SEQ ID NO: 718374 - protein, 20 aa, Mycobacterium
RCTYGGTPGRVFIEENGGMV

SEQ ID NO: 718375 - protein, 20 aa, Mycobacterium
RCVATIPVGGLRNPLTGEQT

SEQ ID NO: 718376 - protein, 24 aa, Mycobacterium
RCVEYARGRFDAIVPAQVHADLPY

SEQ ID NO: 718377 - protein, 24 aa, Mycobacterium
RCVEYARGRFDAIVPDEVLSELPY

SEQ ID NO: 718378 - protein, 23 aa, Mycobacterium
RCVPGDGTTAGWLTLERPDGLIR

SEQ ID NO: 718379 - protein, 21 aa, Mycobacterium
RCVRELGGLDILVNVAGSHQM

SEQ ID NO: 718380 - protein, 21 aa, Mycobacterium
RCVSPAPGVVYAFRHDEDRFA

SEQ ID NO: 718381 - protein, 20 aa, Mycobacterium
RCVTGLRLTPVSTKSIDAAA

SEQ ID NO: 718382 - protein, 19 aa, Mycobacterium
RCVTLDYDKMRGMDNDEYR

SEQ ID NO: 718383 - protein, 19 aa, Mycobacterium
RCVTLDYDKMRGMDSDEYR

SEQ ID NO: 718384 - protein, 20 aa, Mycobacterium
RCVTSINALRAGGSSPKLGG

SEQ ID NO: 718385 - protein, 17 aa, Mycobacterium
RCVWLCDSFAGVPPPDV

SEQ ID NO: 718386 - protein, 27 aa, Mycobacterium
RCYFDDRPIFLGRNGRISVFPSERALA

SEQ ID NO: 718387 - protein, 27 aa, Mycobacterium
RCYLDDRPIFLGRNGRISVFGSERALA

SEQ ID NO: 718388 - protein, 28 aa, Mycobacterium
RCYLNDEPIFLGRNGRISVFGSERALAR

SEQ ID NO: 718389 - protein, 21 aa, Mycobacterium
RDAAAPGWGCGRALVHRNNVI

SEQ ID NO: 718390 - protein, 18 aa, Mycobacterium
RDAAEIRAAESLAAQRRI

SEQ ID NO: 718391 - protein, 17 aa, Mycobacterium
RDAAGQAPFNLGLGNIG

SEQ ID NO: 718392 - protein, 19 aa, Mycobacterium
RDAAGVTIVDDWDGMGQRT

SEQ ID NO: 718393 - protein, 18 aa, Mycobacterium
RDAALALLRAEIQPGDVV

SEQ ID NO: 718394 - protein, 18 aa, Mycobacterium
RDAALLLAFDRATTGFGW

SEQ ID NO: 718395 - protein, 17 aa, Mycobacterium
RDAARDGGHGWWTLSQL

SEQ ID NO: 718396 - protein, 22 aa, Mycobacterium
RDAAVRLALERGFDKVTIEEIC

SEQ ID NO: 718397 - protein, 17 aa, Mycobacterium
RDAAWPAIAAQLSRTVG

SEQ ID NO: 718398 - protein, 19 aa, Mycobacterium
RDAAWPAICAQLRETVGVA

SEQ ID NO: 718399 - protein, 17 aa, Mycobacterium
RDACARSGMAAYNCYGP

SEQ ID NO: 718400 - protein, 26 aa, Mycobacterium
RDACGVTKGRWLGVAGRAKADDIPDA

SEQ ID NO: 718401 - protein, 23 aa, Mycobacterium
RDACGVTKGRWYGGSGRANAEDF

SEQ ID NO: 718402 - protein, 22 aa, Mycobacterium
RDACRADPALAKGLSTHEGALL

SEQ ID NO: 718403 - protein, 19 aa, Mycobacterium
RDACVQADVPFFFKQWGGR

SEQ ID NO: 718404 - protein, 19 aa, Mycobacterium
RDADAALKTAHRLWANEGL

SEQ ID NO: 718405 - protein, 26 aa, Mycobacterium
RDADGRWRLGPALTELAAHVNDPLLS

SEQ ID NO: 718406 - protein, 19 aa, Mycobacterium
RDADGWTVVLTDVDDDELG

SEQ ID NO: 718407 - protein, 17 aa, Mycobacterium
RDADKLLGVAYVGYQGQ

SEQ ID NO: 718408 - protein, 17 aa, Mycobacterium
RDADWFVWYEHGGLGYF

SEQ ID NO: 718409 - protein, 21 aa, Mycobacterium
RDAEAFAALQRGLRPEAITSF

SEQ ID NO: 718410 - protein, 19 aa, Mycobacterium
RDAELKRREYFADERDQVA

SEQ ID NO: 718411 - protein, 28 aa, Mycobacterium
RDAELLRRFIPFDVDAGVLRSAGAAIGA

SEQ ID NO: 718412 - protein, 22 aa, Mycobacterium
RDAELPLRFISAAPISANAYRE

SEQ ID NO: 718413 - protein, 19 aa, Mycobacterium
RDAELSYNLLRFADLEQTA

SEQ ID NO: 718414 - protein, 17 aa, Mycobacterium
RDAESFWELLADGRDAI

SEQ ID NO: 718415 - protein, 19 aa, Mycobacterium
RDAEWMGPFLERMGLTVGW

SEQ ID NO: 718416 - protein, 19 aa, Mycobacterium
RDAEYLFDTFIDLMNEGKG

SEQ ID NO: 718417 - protein, 17 aa, Mycobacterium
RDAFAWHIDLAKRCGKP

SEQ ID NO: 718418 - protein, 22 aa, Mycobacterium
RDAGALPVLLGIDGSPASENAT

SEQ ID NO: 718419 - protein, 27 aa, Mycobacterium
RDAGAPALRMQLLWYPATTWDTSLPSF

SEQ ID NO: 718420 - protein, 19 aa, Mycobacterium
RDAGDEWEAFLGKDDDLYV

SEQ ID NO: 718421 - protein, 18 aa, Mycobacterium
RDAGDEWEAFLGKDEDLF

SEQ ID NO: 718422 - protein, 17 aa, Mycobacterium
RDAGLIARRCPAPATTD

SEQ ID NO: 718423 - protein, 18 aa, Mycobacterium
RDAGRAYLDLSVAHDNGA

SEQ ID NO: 718424 - protein, 24 aa, Mycobacterium
RDAGVRRIVYLGGFVPADQVLSEH

SEQ ID NO: 718425 - protein, 25 aa, Mycobacterium
RDAGVRRIVYLGGFVPEDDTLSDHL

SEQ ID NO: 718426 - protein, 24 aa, Mycobacterium
RDAHLRSADFFDVENHPTATFVST

SEQ ID NO: 718427 - protein, 18 aa, Mycobacterium
RDAIAAVRRAIWVVLTER

SEQ ID NO: 718428 - protein, 23 aa, Mycobacterium
RDAIFKRAWLNVGRVEQLPRKGS

SEQ ID NO: 718429 - protein, 20 aa, Mycobacterium
RDAIFKVFRRVSGGINPDIE

SEQ ID NO: 718430 - protein, 29 aa, Mycobacterium
RDAIRWWLVLATLRWGVICLYQAERHLSG

SEQ ID NO: 718431 - protein, 17 aa, Mycobacterium
RDAISEVPADRWDAEEF

SEQ ID NO: 718432 - protein, 17 aa, Mycobacterium
RDAKERLGYRKVVLAGW

SEQ ID NO: 718433 - protein, 17 aa, Mycobacterium
RDAKFSPAREALDNPNY

SEQ ID NO: 718434 - protein, 28 aa, Mycobacterium
RDAKPLVRLRVPFTVARRDIDDVERGSQ

SEQ ID NO: 718435 - protein, 19 aa, Mycobacterium
RDALAAKLVTSGRATLGTP

SEQ ID NO: 718436 - protein, 20 aa, Mycobacterium
RDALGLALDLERSVTEQISR

SEQ ID NO: 718437 - protein, 25 aa, Mycobacterium
RDALISDPGRRWSVVLTNPPFGRKS

SEQ ID NO: 718438 - protein, 23 aa, Mycobacterium
RDALKRGHSVLVQVPRRGYVPAL

SEQ ID NO: 718439 - protein, 18 aa, Mycobacterium
RDALKRWYDRVLRRFYRS

SEQ ID NO: 718440 - protein, 17 aa, Mycobacterium
RDALLGASPEFLDPLVR

SEQ ID NO: 718441 - protein, 18 aa, Mycobacterium
RDALLRLLVDMQYNRNDM

SEQ ID NO: 718442 - protein, 19 aa, Mycobacterium
RDALREALLAAGFDPNQPA

SEQ ID NO: 718443 - protein, 18 aa, Mycobacterium
RDAMPLVPSMTVARSGEF

SEQ ID NO: 718444 - protein, 24 aa, Mycobacterium
RDAMPTFRQLFIAGASGIDLERRV

SEQ ID NO: 718445 - protein, 21 aa, Mycobacterium
RDAMPTFRQLFLGGASGMELE

SEQ ID NO: 718446 - protein, 25 aa, Mycobacterium
RDAMPTFRQVFMAGAEGMDLERRAY

SEQ ID NO: 718447 - protein, 18 aa, Mycobacterium
RDAPAPGASLLARLGDFG

SEQ ID NO: 718448 - protein, 18 aa, Mycobacterium
RDAPWPGSLDDWLATCHA

SEQ ID NO: 718449 - protein, 20 aa, Mycobacterium
RDAQLAFRRRVQPVFQNPYS

SEQ ID NO: 718450 - protein, 18 aa, Mycobacterium
RDARAAATLDELLDRAIR

SEQ ID NO: 718451 - protein, 21 aa, Mycobacterium
RDARAAGASWGHELCDDTVTT

SEQ ID NO: 718452 - protein, 18 aa, Mycobacterium
RDARGWKTVGDIGYLDEE

SEQ ID NO: 718453 - protein, 17 aa, Mycobacterium
RDARLGSVGKLLPGLEG

SEQ ID NO: 718454 - protein, 18 aa, Mycobacterium
RDARWRVTIERLYSGERV

SEQ ID NO: 718455 - protein, 27 aa, Mycobacterium
RDASFGIQLYVKRVFIMGDCDQLMPEY

SEQ ID NO: 718456 - protein, 17 aa, Mycobacterium
RDASGIAQVVFREADVL

SEQ ID NO: 718457 - protein, 18 aa, Mycobacterium
RDASVVDLLGAVVTAAAH

SEQ ID NO: 718458 - protein, 24 aa, Mycobacterium
RDATESMIARKGRASYLGQRSVGH

SEQ ID NO: 718459 - protein, 20 aa, Mycobacterium
RDAVEFDFPAKSGVRRTVEI

SEQ ID NO: 718460 - protein, 25 aa, Mycobacterium
RDAVERLGLLGLPFLFYIDAAEGRA

SEQ ID NO: 718461 - protein, 25 aa, Mycobacterium
RDAVLRALTARSWRAGLRQRAAARV

SEQ ID NO: 718462 - protein, 23 aa, Mycobacterium
RDAVLRKAPWVDVVFGTHNIGSL

SEQ ID NO: 718463 - protein, 24 aa, Mycobacterium
RDAVPATGTALIFGEAQRAEESLG

SEQ ID NO: 718464 - protein, 26 aa, Mycobacterium
RDAVPFSAYLFYKWAAHPGAEPDGWG

SEQ ID NO: 718465 - protein, 25 aa, Mycobacterium
RDAVYRAAKLLGYRPNLAARNLARG

SEQ ID NO: 718466 - protein, 20 aa, Mycobacterium
RDAYCRHIGVEYTHILDPEQ

SEQ ID NO: 718467 - protein, 20 aa, Mycobacterium
RDAYCRHIGVEYTHILEPEQ

SEQ ID NO: 718468 - protein, 18 aa, Mycobacterium
RDAYKPRQAVALVAAARW

SEQ ID NO: 718469 - protein, 21 aa, Mycobacterium
RDAYKQRPLLRIWDKHHRPIA

SEQ ID NO: 718470 - protein, 24 aa, Mycobacterium
RDAYLRDRFVQWAFRLRRVGRRAG

SEQ ID NO: 718471 - protein, 17 aa, Mycobacterium
RDAYVDAGLPWFDYYDA

SEQ ID NO: 718472 - protein, 23 aa, Mycobacterium
RDCADRLGAVVLIGRDRALIAEA

SEQ ID NO: 718473 - protein, 22 aa, Mycobacterium
RDCLIGVALPKPGVTTNVIVDT

SEQ ID NO: 718474 - protein, 32 aa, Mycobacterium
RDDDAGWASADWTLRRGRIVLLDGDSPAGLRL

SEQ ID NO: 718475 - protein, 29 aa, Mycobacterium
RDDDWRPQWRVDLIPSYKAHRVAEPEPDG

SEQ ID NO: 718476 - protein, 29 aa, Mycobacterium
RDDDWRPQWRVDLIPSYKAHRVLEENPAD

SEQ ID NO: 718477 - protein, 25 aa, Mycobacterium
RDDEGRWRLGPAVTELAAHVNDPLL

SEQ ID NO: 718478 - protein, 24 aa, Mycobacterium
RDDELRRAWSPKGKPIIGFVGRLA

SEQ ID NO: 718479 - protein, 17 aa, Mycobacterium
RDDFPLVFQQFQATPFR

SEQ ID NO: 718480 - protein, 19 aa, Mycobacterium
RDDFPTVSLTTVFRQLGDD

SEQ ID NO: 718481 - protein, 24 aa, Mycobacterium
RDDGRPGWRPLPELLATSDIVSLH

SEQ ID NO: 718482 - protein, 25 aa, Mycobacterium
RDDGRPGWRPLPQLLAGSDIVSLHV

SEQ ID NO: 718483 - protein, 24 aa, Mycobacterium
RDDGRSVLIISHFVADEHRFDRIV

SEQ ID NO: 718484 - protein, 24 aa, Mycobacterium
RDDGVRRLALRAAELSPEAQQDVL

SEQ ID NO: 718485 - protein, 18 aa, Mycobacterium
RDDGYRFLVLGRSIERVD

SEQ ID NO: 718486 - protein, 18 aa, Mycobacterium
RDDHGFILTGPDLRNVCG

SEQ ID NO: 718487 - protein, 27 aa, Mycobacterium
RDDIAPDWPQPRICIEPKDLGYGPASG

SEQ ID NO: 718488 - protein, 19 aa, Mycobacterium
RDDLDLFRRLSLDLISIPT

SEQ ID NO: 718489 - protein, 18 aa, Mycobacterium
RDDLILAALEYWVARHRY

SEQ ID NO: 718490 - protein, 17 aa, Mycobacterium
RDDLLLVAGMRVSQREK

SEQ ID NO: 718491 - protein, 18 aa, Mycobacterium
RDDLPMGRLTVIATGGTI

SEQ ID NO: 718492 - protein, 18 aa, Mycobacterium
RDDLSLRIAVQPGGCAGL

SEQ ID NO: 718493 - protein, 19 aa, Mycobacterium
RDDLSLRIAVQPGGCAGLR

SEQ ID NO: 718494 - protein, 20 aa, Mycobacterium
RDDLVAWEFERAGLGSLGDR

SEQ ID NO: 718495 - protein, 19 aa, Mycobacterium
RDDLWLRNAAHANAMAARL

SEQ ID NO: 718496 - protein, 20 aa, Mycobacterium
RDDNSLLMGYRVPKTAFAFQ

SEQ ID NO: 718497 - protein, 26 aa, Mycobacterium
RDDNTLLMGYRVPKTSFAFQKFSDAV

SEQ ID NO: 718498 - protein, 27 aa, Mycobacterium
RDDPDLRFELCLGVSGVHYPEDTGREL

SEQ ID NO: 718499 - protein, 26 aa, Mycobacterium
RDDPDLRFEMCLGVSGVHYPHETGRE

SEQ ID NO: 718500 - protein, 19 aa, Mycobacterium
RDDPEFGYRYLVEEARDAG

SEQ ID NO: 718501 - protein, 21 aa, Mycobacterium
RDDPQFATWLAVLQRSLNDGT

SEQ ID NO: 718502 - protein, 18 aa, Mycobacterium
RDDPRGGEADLILGKHRN

SEQ ID NO: 718503 - protein, 20 aa, Mycobacterium
RDDPRSWIAQPMMELSTVPT

SEQ ID NO: 718504 - protein, 18 aa, Mycobacterium
RDDPVIADWVWEHELGSL

SEQ ID NO: 718505 - protein, 19 aa, Mycobacterium
RDDRGWVLSVAHVAVVPLD

SEQ ID NO: 718506 - protein, 24 aa, Mycobacterium
RDDRGYFCFPEVDIRIPFNAGMAA

SEQ ID NO: 718507 - protein, 20 aa, Mycobacterium
RDDRWEWSDELARMHGYEPG

SEQ ID NO: 718508 - protein, 19 aa, Mycobacterium
RDDVIAMLAARKVTAPAAA

SEQ ID NO: 718509 - protein, 23 aa, Mycobacterium
RDDVRRYLWLNGTNDWDDVSYGN

SEQ ID NO: 718510 - protein, 23 aa, Mycobacterium
RDDWPPQRAVAGFDLPHDTPFEG

SEQ ID NO: 718511 - protein, 21 aa, Mycobacterium
RDDWPTVLKAAGFDPAQPTAW

SEQ ID NO: 718512 - protein, 19 aa, Mycobacterium
RDDWRALFQANLETAFFMS

SEQ ID NO: 718513 - protein, 17 aa, Mycobacterium
RDDYFWQRDELMIGVVD

SEQ ID NO: 718514 - protein, 24 aa, Mycobacterium
RDEADPPAAFGLLLSAPTDHLNEV

SEQ ID NO: 718515 - protein, 25 aa, Mycobacterium
RDEAGFLYFAGRRGDWIRVDGENTS

SEQ ID NO: 718516 - protein, 18 aa, Mycobacterium
RDEAIRSAHLLDVSSRPT

SEQ ID NO: 718517 - protein, 21 aa, Mycobacterium
RDEAKEAIIARGGKSASSVSK

SEQ ID NO: 718518 - protein, 24 aa, Mycobacterium
RDEALAMRGVRAIDEIPSDSAPPS

SEQ ID NO: 718519 - protein, 23 aa, Mycobacterium
RDEALRLFAERGPDAVTMRDIAT

SEQ ID NO: 718520 - protein, 19 aa, Mycobacterium
RDEALRLFAERGPDSVTLR

SEQ ID NO: 718521 - protein, 18 aa, Mycobacterium
RDEAPVYYNAKWDFWALT

SEQ ID NO: 718522 - protein, 20 aa, Mycobacterium
RDEARRFLAEHVTDEVRRHD

SEQ ID NO: 718523 - protein, 23 aa, Mycobacterium
RDEAWSTALAHWPNYRVAQERAG

SEQ ID NO: 718524 - protein, 25 aa, Mycobacterium
RDEEGRWRLGPAVSELAAHVNDSLL

SEQ ID NO: 718525 - protein, 22 aa, Mycobacterium
RDEEIRPRMQVLMYPVVDAVGE

SEQ ID NO: 718526 - protein, 17 aa, Mycobacterium
RDEFLLYAKLVAGDWPY

SEQ ID NO: 718527 - protein, 20 aa, Mycobacterium
RDEFRASKIMINRAQANDKI

SEQ ID NO: 718528 - protein, 20 aa, Mycobacterium
RDEFRASKIMLNRAQANDKI

SEQ ID NO: 718529 - protein, 26 aa, Mycobacterium
RDEGKRIVPVCSMIGTVLKKHPEFDD

SEQ ID NO: 718530 - protein, 25 aa, Mycobacterium
RDEGVTRLVVLSAINADDDFSVQPS

SEQ ID NO: 718531 - protein, 23 aa, Mycobacterium
RDEGWLAEHMLILKLTSPEGAAK

SEQ ID NO: 718532 - protein, 19 aa, Mycobacterium
RDEHGFILAGPDLRDVCGW

SEQ ID NO: 718533 - protein, 26 aa, Mycobacterium
RDEIAERGWPVFLVSSVARVGLQPLV

SEQ ID NO: 718534 - protein, 25 aa, Mycobacterium
RDEIAQRGWPVFLVSTVTRENLQPL

SEQ ID NO: 718535 - protein, 23 aa, Mycobacterium
RDEIGARLTRVFFEAWEQPDSRA

SEQ ID NO: 718536 - protein, 18 aa, Mycobacterium
RDEIGLAIAREYGGGTVF

SEQ ID NO: 718537 - protein, 21 aa, Mycobacterium
RDEIIQMVDLMISRVAGQLKS

SEQ ID NO: 718538 - protein, 30 aa, Mycobacterium
RDEKDPRWRFGVPPANNANYAWIQHILSKL

SEQ ID NO: 718539 - protein, 20 aa, Mycobacterium
RDELARMCRGVACRVRPGGR

SEQ ID NO: 718540 - protein, 25 aa, Mycobacterium
RDELGVACAVVRLYEPQDWVARGYV

SEQ ID NO: 718541 - protein, 24 aa, Mycobacterium
RDELKPGVPDRSWSQVSVSARECL

SEQ ID NO: 718542 - protein, 36 aa, Mycobacterium
RDELPDLPLLCAEEVDRACAPWGLMGEDKQAALVAG

SEQ ID NO: 718543 - protein, 22 aa, Mycobacterium
RDELPGLPIVLARLRSVRSTAR

SEQ ID NO: 718544 - protein, 17 aa, Mycobacterium
RDELPSVLADGFSAAVF

SEQ ID NO: 718545 - protein, 23 aa, Mycobacterium
RDELRAGSTTGVLRVRAISGGWL

SEQ ID NO: 718546 - protein, 18 aa, Mycobacterium
RDELSLPLEQWVKKLQLA

SEQ ID NO: 718547 - protein, 26 aa, Mycobacterium
RDELTLAWQRLRPWPDTVAGLTRLKR

SEQ ID NO: 718548 - protein, 26 aa, Mycobacterium
RDELTLAWQRLRPWPDVVAGLTRLKT

SEQ ID NO: 718549 - protein, 26 aa, Mycobacterium
RDELYRRWTGLLSYRYIGRKHSSMDL

SEQ ID NO: 718550 - protein, 26 aa, Mycobacterium
RDELYRRWTGLLSYRYIGRKHSSMNL

SEQ ID NO: 718551 - protein, 26 aa, Mycobacterium
RDEPELRFELCLGVNGVHYPHETGRE

SEQ ID NO: 718552 - protein, 26 aa, Mycobacterium
RDEPELRFEMCLGVNGVHYPHETGRE

SEQ ID NO: 718553 - protein, 26 aa, Mycobacterium
RDEPQLRFEMCLGVSGVHYPHEAGRE

SEQ ID NO: 718554 - protein, 23 aa, Mycobacterium
RDEPWFDPAGLFLAFDDSAGDQG

SEQ ID NO: 718555 - protein, 21 aa, Mycobacterium
RDEPYAFSFSGLKTAVARYVE

SEQ ID NO: 718556 - protein, 20 aa, Mycobacterium
RDERCISAIAIVHSRFSTNT

SEQ ID NO: 718557 - protein, 33 aa, Mycobacterium
RDERDPRWRFGVPPAGNANYAWIQHILSKLAPG

SEQ ID NO: 718558 - protein, 17 aa, Mycobacterium
RDERPRRDPVLAGVVTP

SEQ ID NO: 718559 - protein, 24 aa, Mycobacterium
RDESIRLGQFLKLAALIDTGADAK

SEQ ID NO: 718560 - protein, 25 aa, Mycobacterium
RDESVGFAWGTWVAALGTQPEALAE

SEQ ID NO: 718561 - protein, 37 aa, Mycobacterium
RDESWKIRNLFNIPFNFMLAAGFEWGIALQHLELRKI

SEQ ID NO: 718562 - protein, 19 aa, Mycobacterium
RDETIAAIAARAGDLQAPG

SEQ ID NO: 718563 - protein, 22 aa, Mycobacterium
RDEVAAQLVVRAVGYRGLPTPG

SEQ ID NO: 718564 - protein, 24 aa, Mycobacterium
RDEVAKAQAALRIEQLSEQVLEQF

SEQ ID NO: 718565 - protein, 17 aa, Mycobacterium
RDEVAMSPAAWRVRARL

SEQ ID NO: 718566 - protein, 19 aa, Mycobacterium
RDEVDGLAARVSRIDLTNR

SEQ ID NO: 718567 - protein, 24 aa, Mycobacterium
RDEVDPQRVCYVELPAQKASVGTI

SEQ ID NO: 718568 - protein, 25 aa, Mycobacterium
RDEVRESTVRFCLRGLGVAPDTIAQ

SEQ ID NO: 718569 - protein, 19 aa, Mycobacterium
RDEVRRAAAAMITLGVEPG

SEQ ID NO: 718570 - protein, 23 aa, Mycobacterium
RDEVTCGRMFIFIGAEPRTEWLD

SEQ ID NO: 718571 - protein, 21 aa, Mycobacterium
RDEWTEIFIGTDACVSPVLTW

SEQ ID NO: 718572 - protein, 25 aa, Mycobacterium
RDEWWQRAVEAFPPYAEYQTKTARQ

SEQ ID NO: 718573 - protein, 24 aa, Mycobacterium
RDFAAEAAFIFAMIAVDLSRLAED

SEQ ID NO: 718574 - protein, 23 aa, Mycobacterium
RDFAAEAAFIFAMIAVDTSRLAE

SEQ ID NO: 718575 - protein, 23 aa, Mycobacterium
RDFAAEAAFVFSMIGVDLSRLAE

SEQ ID NO: 718576 - protein, 20 aa, Mycobacterium
RDFADHAAIALTLATERRNA

SEQ ID NO: 718577 - protein, 30 aa, Mycobacterium
RDFATAAARAHRALAEFRVRGVSTNIPFLQ

SEQ ID NO: 718578 - protein, 22 aa, Mycobacterium
RDFAVGHALYLGFLFLDEDDDA

SEQ ID NO: 718579 - protein, 19 aa, Mycobacterium
RDFEVGRFIPVVSGHPSLW

SEQ ID NO: 718580 - protein, 17 aa, Mycobacterium
RDFGPTFVVGENGQLGA

SEQ ID NO: 718581 - protein, 29 aa, Mycobacterium
RDFLGARFDAGLAWVHFPVGFGGLDLPHT

SEQ ID NO: 718582 - protein, 20 aa, Mycobacterium
RDFLIRNAIRLTHQRADAED

SEQ ID NO: 718583 - protein, 19 aa, Mycobacterium
RDFPGVWQWGITDADLEAK

SEQ ID NO: 718584 - protein, 21 aa, Mycobacterium
RDFQFVNAFATALVEDKILAH

SEQ ID NO: 718585 - protein, 20 aa, Mycobacterium
RDFRGCLYANAATEYPGVEL

SEQ ID NO: 718586 - protein, 19 aa, Mycobacterium
RDFRPGDLEGAWYVIAATD

SEQ ID NO: 718587 - protein, 18 aa, Mycobacterium
RDFRSWAHADLELEPGRT

SEQ ID NO: 718588 - protein, 17 aa, Mycobacterium
RDFRSWAHADLELQPGR

SEQ ID NO: 718589 - protein, 17 aa, Mycobacterium
RDFRSWERVNLELEPGR

SEQ ID NO: 718590 - protein, 19 aa, Mycobacterium
RDFTHPGLDRILQWDLRFG

SEQ ID NO: 718591 - protein, 18 aa, Mycobacterium
RDFVDAAQFSKLLSERGI

SEQ ID NO: 718592 - protein, 21 aa, Mycobacterium
RDFVRRGAGWLAHAHETQSRG

SEQ ID NO: 718593 - protein, 17 aa, Mycobacterium
RDFYAAVLHHWPDSAWW

SEQ ID NO: 718594 - protein, 17 aa, Mycobacterium
RDGALLPGLAAGALGIH

SEQ ID NO: 718595 - protein, 24 aa, Mycobacterium
RDGALPLQFLFSGTIFVKSDRGFF

SEQ ID NO: 718596 - protein, 23 aa, Mycobacterium
RDGALPLQFLFSGTIFVKSERGF

SEQ ID NO: 718597 - protein, 24 aa, Mycobacterium
RDGARLMAERGRLFGSLPSGGRMA

SEQ ID NO: 718598 - protein, 18 aa, Mycobacterium
RDGARPMLTAALQAEVAA

SEQ ID NO: 718599 - protein, 22 aa, Mycobacterium
RDGAVDAIVKWIADRENAAPTA

SEQ ID NO: 718600 - protein, 19 aa, Mycobacterium
RDGCPSDCGLCPDHKQHAC

SEQ ID NO: 718601 - protein, 25 aa, Mycobacterium
RDGDAEPVEGWGLYEHGALGRHDPS

SEQ ID NO: 718602 - protein, 19 aa, Mycobacterium
RDGDEWVLDGSKIVVVNAL

SEQ ID NO: 718603 - protein, 24 aa, Mycobacterium
RDGDILFLQGLMFVVGSTDEEAFR

SEQ ID NO: 718604 - protein, 23 aa, Mycobacterium
RDGDILFLQGMMFVIGSTDEEAY

SEQ ID NO: 718605 - protein, 17 aa, Mycobacterium
RDGDKPPVEGWGLYEHG

SEQ ID NO: 718606 - protein, 18 aa, Mycobacterium
RDGDLCGLITGYHPPTRP

SEQ ID NO: 718607 - protein, 25 aa, Mycobacterium
RDGDRWIINGAKTWSTSAFAADYGL

SEQ ID NO: 718608 - protein, 22 aa, Mycobacterium
RDGDVLSLDFAVSIDGWVADAA

SEQ ID NO: 718609 - protein, 17 aa, Mycobacterium
RDGDVPLALMIAYLPPG

SEQ ID NO: 718610 - protein, 23 aa, Mycobacterium
RDGEAIGALLTRMGAQDTRLIWE

SEQ ID NO: 718611 - protein, 33 aa, Mycobacterium
RDGEAIGALLTRMGAQDTRLVWEERRMRREVRA

SEQ ID NO: 718612 - protein, 22 aa, Mycobacterium
RDGEIKVPVIFFSPEGPVVKHL

SEQ ID NO: 718613 - protein, 17 aa, Mycobacterium
RDGEVLMAQLLRIATES

SEQ ID NO: 718614 - protein, 19 aa, Mycobacterium
RDGFFGRHTIGPVTGALLH

SEQ ID NO: 718615 - protein, 26 aa, Mycobacterium
RDGGCTKPCCTVGAYGCQVHHAEADY

SEQ ID NO: 718616 - protein, 19 aa, Mycobacterium
RDGGDWILNGRKVFISGVN

SEQ ID NO: 718617 - protein, 27 aa, Mycobacterium
RDGGPAALRRAVGWYRRHDRLHIGDQV

SEQ ID NO: 718618 - protein, 34 aa, Mycobacterium
RDGGPAPVRRAIGWYRSHGRLHTGDQIAMASDAL

SEQ ID NO: 718619 - protein, 22 aa, Mycobacterium
RDGGPAPVRRAVEWYRTHDRLH

SEQ ID NO: 718620 - protein, 19 aa, Mycobacterium
RDGGSFATRRVNAIQHGEI

SEQ ID NO: 718621 - protein, 20 aa, Mycobacterium
RDGGSFATRRVNAIQHGEII

SEQ ID NO: 718622 - protein, 19 aa, Mycobacterium
RDGHIEWMGAMANRLPMMV

SEQ ID NO: 718623 - protein, 19 aa, Mycobacterium
RDGHLRPGVSATDLPLLAL

SEQ ID NO: 718624 - protein, 23 aa, Mycobacterium
RDGHPAGVFGWRAPADLVVALSD

SEQ ID NO: 718625 - protein, 25 aa, Mycobacterium
RDGHPCGVFSWRPPPSLITALSDLL

SEQ ID NO: 718626 - protein, 26 aa, Mycobacterium
RDGIDALELLTMWSAGFPEPRTFTMR

SEQ ID NO: 718627 - protein, 18 aa, Mycobacterium
RDGIGLAIAREYPGGTVF

SEQ ID NO: 718628 - protein, 26 aa, Mycobacterium
RDGILKATWLRGIERFQRRAMAADGA

SEQ ID NO: 718629 - protein, 19 aa, Mycobacterium
RDGKTFLQSFGRGYPGVFE

SEQ ID NO: 718630 - protein, 19 aa, Mycobacterium
RDGKVCALWDIANPDKFTG

SEQ ID NO: 718631 - protein, 27 aa, Mycobacterium
RDGKWPHIWRIVGEYANYSIFDVDSND

SEQ ID NO: 718632 - protein, 20 aa, Mycobacterium
RDGLDLPSYLTLPVGIPQEN

SEQ ID NO: 718633 - protein, 20 aa, Mycobacterium
RDGLLPGSLQVRRRAKSWYE

SEQ ID NO: 718634 - protein, 20 aa, Mycobacterium
RDGLLRAFLNVCRHRGAQLC

SEQ ID NO: 718635 - protein, 27 aa, Mycobacterium
RDGLPRIAQAIAAPAVRKTGVLDSEAE

SEQ ID NO: 718636 - protein, 30 aa, Mycobacterium
RDGLPRIAQAIAAPAVRRTGVLENETKMLR

SEQ ID NO: 718637 - protein, 24 aa, Mycobacterium
RDGLRHEHKLRRFGRPEEVASVAT

SEQ ID NO: 718638 - protein, 20 aa, Mycobacterium
RDGLTMARPFAAPRTVFNAS

SEQ ID NO: 718639 - protein, 17 aa, Mycobacterium
RDGMHAIGHRYDRGQVR

SEQ ID NO: 718640 - protein, 25 aa, Mycobacterium
RDGMRLRYVDPFRAELERLGRMVFG

SEQ ID NO: 718641 - protein, 21 aa, Mycobacterium
RDGNCLAFLLAWDSFDYDPET

SEQ ID NO: 718642 - protein, 17 aa, Mycobacterium
RDGPKYPGSKALRDVVS

SEQ ID NO: 718643 - protein, 20 aa, Mycobacterium
RDGQEFSVDITVWLDLDTAA

SEQ ID NO: 718644 - protein, 24 aa, Mycobacterium
RDGQPCLLEAHLARLTQSARMLDL

SEQ ID NO: 718645 - protein, 25 aa, Mycobacterium
RDGQQRLPLPVGIGHHRFVNDVTPE

SEQ ID NO: 718646 - protein, 20 aa, Mycobacterium
RDGRAIEVIGRYHPKEDPSI

SEQ ID NO: 718647 - protein, 23 aa, Mycobacterium
RDGRAIEVIGRYHPKEEPSLIQI

SEQ ID NO: 718648 - protein, 26 aa, Mycobacterium
RDGRDAGRRRPPILSEAEFLARREAV

SEQ ID NO: 718649 - protein, 27 aa, Mycobacterium
RDGRDAGRRRPPILSEAEFLARREAVE

SEQ ID NO: 718650 - protein, 24 aa, Mycobacterium
RDGRDAGRRRPPILTEAEFLARRE

SEQ ID NO: 718651 - protein, 27 aa, Mycobacterium
RDGRDAGRRRPPVLSEAEFLARREAVE

SEQ ID NO: 718652 - protein, 18 aa, Mycobacterium
RDGRFALTPVGDALRTDS

SEQ ID NO: 718653 - protein, 20 aa, Mycobacterium
RDGRIRLVMAHRDPGVHNWL

SEQ ID NO: 718654 - protein, 19 aa, Mycobacterium
RDGRLAVVFGAGGNRDRGK

SEQ ID NO: 718655 - protein, 18 aa, Mycobacterium
RDGRLVPFDVARIETAIG

SEQ ID NO: 718656 - protein, 25 aa, Mycobacterium
RDGRPCLLDAHLGRLAHSAQMVDLP

SEQ ID NO: 718657 - protein, 17 aa, Mycobacterium
RDGRPILSSGALDLGCG

SEQ ID NO: 718658 - protein, 26 aa, Mycobacterium
RDGRPWGSRFPMISVRDQVQADIAAL

SEQ ID NO: 718659 - protein, 26 aa, Mycobacterium
RDGRRWRALFERPARNFDLLTADIMG

SEQ ID NO: 718660 - protein, 25 aa, Mycobacterium
RDGRRYLDMFSFFASSALGMNHPAL

SEQ ID NO: 718661 - protein, 19 aa, Mycobacterium
RDGRSFVTRRVTAIQDGQA

SEQ ID NO: 718662 - protein, 18 aa, Mycobacterium
RDGRTWLRAGAGIIEEST

SEQ ID NO: 718663 - protein, 21 aa, Mycobacterium
RDGRVCAIGKAGNPDTMTGVH

SEQ ID NO: 718664 - protein, 29 aa, Mycobacterium
RDGRWMINGAKTWSTWAFAADYGLCLART

SEQ ID NO: 718665 - protein, 20 aa, Mycobacterium
RDGSDWILKGQKVFISGIDQ

SEQ ID NO: 718666 - protein, 21 aa, Mycobacterium
RDGSDWVLKGQKVFISGIDQA

SEQ ID NO: 718667 - protein, 19 aa, Mycobacterium
RDGSDWVLNGRKMWITNGS

SEQ ID NO: 718668 - protein, 26 aa, Mycobacterium
RDGSLRRLDLAFSRDQAKRIYVQHRM

SEQ ID NO: 718669 - protein, 18 aa, Mycobacterium
RDGSRLVERLSRAELPAV

SEQ ID NO: 718670 - protein, 26 aa, Mycobacterium
RDGSWWWELADDFDFGKHVTVVDLKD

SEQ ID NO: 718671 - protein, 30 aa, Mycobacterium
RDGTARPALEGGLNWPLDLTVGTDGDLYIA

SEQ ID NO: 718672 - protein, 20 aa, Mycobacterium
RDGTFHKMEFANWDAVLKVH

SEQ ID NO: 718673 - protein, 18 aa, Mycobacterium
RDGTQPAGLHDPGDKADK

SEQ ID NO: 718674 - protein, 18 aa, Mycobacterium
RDGVLRWWAGPWPVDERW

SEQ ID NO: 718675 - protein, 17 aa, Mycobacterium
RDGVPTFLLPANPVSAL

SEQ ID NO: 718676 - protein, 18 aa, Mycobacterium
RDGVRFCEVCGNVSDNER

SEQ ID NO: 718677 - protein, 25 aa, Mycobacterium
RDGVRFRPALTVTRAEIDAAMRAIR

SEQ ID NO: 718678 - protein, 22 aa, Mycobacterium
RDGVYRDIVWRDFSARNRAVGA

SEQ ID NO: 718679 - protein, 19 aa, Mycobacterium
RDGWAERVRLAHALGPTMI

SEQ ID NO: 718680 - protein, 20 aa, Mycobacterium
RDGWIDRFDLGLPPDDIGYG

SEQ ID NO: 718681 - protein, 19 aa, Mycobacterium
RDGYGWVQPRLSPIARSAL

SEQ ID NO: 718682 - protein, 21 aa, Mycobacterium
RDHDAGFSFGFPVDARVQDAV

SEQ ID NO: 718683 - protein, 30 aa, Mycobacterium
RDHDFRWWVCGYWRMQPCGPGNIERKLVYV

SEQ ID NO: 718684 - protein, 19 aa, Mycobacterium
RDHELRFILDDAASRMIFI

SEQ ID NO: 718685 - protein, 23 aa, Mycobacterium
RDHGARLLVRLVGVTDRDAADAL

SEQ ID NO: 718686 - protein, 22 aa, Mycobacterium
RDHGGVIFIDLRDASGVSQVVF

SEQ ID NO: 718687 - protein, 19 aa, Mycobacterium
RDHGVPIVQAWGMTETSPL

SEQ ID NO: 718688 - protein, 23 aa, Mycobacterium
RDHGWSLHVPRAIRDRHAQISRA

SEQ ID NO: 718689 - protein, 20 aa, Mycobacterium
RDHIATAVEVLWRGQRLRAL

SEQ ID NO: 718690 - protein, 22 aa, Mycobacterium
RDHLAPYLKVRRVEFFDLPKTI

SEQ ID NO: 718691 - protein, 17 aa, Mycobacterium
RDHLRDRGLFGTSILWF

SEQ ID NO: 718692 - protein, 22 aa, Mycobacterium
RDHLRHGAAIAAALRERLDPGR

SEQ ID NO: 718693 - protein, 27 aa, Mycobacterium
RDHPDFPAAAARLGDRLSIHDQPNLGG

SEQ ID NO: 718694 - protein, 23 aa, Mycobacterium
RDHPRTGGAYLHLAKNRHGQTRT

SEQ ID NO: 718695 - protein, 19 aa, Mycobacterium
RDHQHPLPFLLLVRGSVRA

SEQ ID NO: 718696 - protein, 22 aa, Mycobacterium
RDHRASFVQIHFALDGLPEFAA

SEQ ID NO: 718697 - protein, 22 aa, Mycobacterium
RDHRASFVQIHFALDGLPEFAP

SEQ ID NO: 718698 - protein, 29 aa, Mycobacterium
RDHSWAARDWWAMDWVWSAFHLEDGTHIH

SEQ ID NO: 718699 - protein, 18 aa, Mycobacterium
RDHWLIDPGDTFLVPSPI

SEQ ID NO: 718700 - protein, 22 aa, Mycobacterium
RDHWRQVRRLPKLVGETASGVS

SEQ ID NO: 718701 - protein, 19 aa, Mycobacterium
RDIAARAGCRAMQNEVDTL

SEQ ID NO: 718702 - protein, 19 aa, Mycobacterium
RDIAKRPGLTIGIEPLLEL

SEQ ID NO: 718703 - protein, 26 aa, Mycobacterium
RDIAPRLDGPLAPCYHAAVDVSSGAF

SEQ ID NO: 718704 - protein, 18 aa, Mycobacterium
RDIDGAWWPRSASVAKEL

SEQ ID NO: 718705 - protein, 23 aa, Mycobacterium
RDIEALGYGAVWVGGSPPAELAW

SEQ ID NO: 718706 - protein, 20 aa, Mycobacterium
RDIEGARVLALLGDSVTTDH

SEQ ID NO: 718707 - protein, 23 aa, Mycobacterium
RDIEKRYGCRIVTMYGLTEAFPI

SEQ ID NO: 718708 - protein, 26 aa, Mycobacterium
RDIERFARRFGCVVQDGFGSTEGGVA

SEQ ID NO: 718709 - protein, 23 aa, Mycobacterium
RDIFDLCNRWAAGGYDASVFREA

SEQ ID NO: 718710 - protein, 19 aa, Mycobacterium
RDIFPATTITVAFGSTMVL

SEQ ID NO: 718711 - protein, 19 aa, Mycobacterium
RDIGGAWVLTNHPFLSGRP

SEQ ID NO: 718712 - protein, 17 aa, Mycobacterium
RDIGMVFQRFNLFGHRT

SEQ ID NO: 718713 - protein, 21 aa, Mycobacterium
RDIKRAAMFFRYRQHNDSDGA

SEQ ID NO: 718714 - protein, 26 aa, Mycobacterium
RDILDLRIARLTGRVAVIRVGGATSV

SEQ ID NO: 718715 - protein, 21 aa, Mycobacterium
RDILITLGYDIDKPWRKLPKR

SEQ ID NO: 718716 - protein, 18 aa, Mycobacterium
RDILTRMPLPEPTDAELV

SEQ ID NO: 718717 - protein, 19 aa, Mycobacterium
RDINEIYCDHCALWSQDTT

SEQ ID NO: 718718 - protein, 22 aa, Mycobacterium
RDIPQVSAPIIVKYVTDLQKVG

SEQ ID NO: 718719 - protein, 26 aa, Mycobacterium
RDIPRFVELWRAGRLPVESLVSSTIA

SEQ ID NO: 718720 - protein, 27 aa, Mycobacterium
RDIPRFVELWRSGRLPVQSLVSSTIAL

SEQ ID NO: 718721 - protein, 22 aa, Mycobacterium
RDIPRFVSLWRSGRLPVESLVS

SEQ ID NO: 718722 - protein, 21 aa, Mycobacterium
RDIPVAPDITGLVRSGVLPEG

SEQ ID NO: 718723 - protein, 17 aa, Mycobacterium
RDIPVLAELALRGRLDI

SEQ ID NO: 718724 - protein, 22 aa, Mycobacterium
RDIRFVRLWFTDVLGYLKSVSI

SEQ ID NO: 718725 - protein, 24 aa, Mycobacterium
RDISAKKNEPDWMLQTRLKALRIF

SEQ ID NO: 718726 - protein, 25 aa, Mycobacterium
RDISAKKNEPEWMLDIRLKALRTFD

SEQ ID NO: 718727 - protein, 24 aa, Mycobacterium
RDISAKKNEPEWMLQNRLKALRIF

SEQ ID NO: 718728 - protein, 25 aa, Mycobacterium
RDISAKKNEPEWMLQTRLKALRIFE

SEQ ID NO: 718729 - protein, 25 aa, Mycobacterium
RDISAKKSEPEWMLDIRLKALRTFD

SEQ ID NO: 718730 - protein, 25 aa, Mycobacterium
RDISGKKNEPEWMLDIRLKALRTFD

SEQ ID NO: 718731 - protein, 27 aa, Mycobacterium
RDISRAGWAAVRWRNLTGGIVALHAGY

SEQ ID NO: 718732 - protein, 18 aa, Mycobacterium
RDISRLVALAGPAVLALD

SEQ ID NO: 718733 - protein, 17 aa, Mycobacterium
RDITDWRAELMSHYDQA

SEQ ID NO: 718734 - protein, 22 aa, Mycobacterium
RDITVPPVRFIKTIGDAVMFVC

SEQ ID NO: 718735 - protein, 17 aa, Mycobacterium
RDIVAGFGQPVMTSDEF

SEQ ID NO: 718736 - protein, 24 aa, Mycobacterium
RDIVDALLASLGWDGDSVVDTVVC

SEQ ID NO: 718737 - protein, 22 aa, Mycobacterium
RDIVLDIAHALTVYPEFLGASE

SEQ ID NO: 718738 - protein, 37 aa, Mycobacterium
RDIYRVTILHWVRRACALSMRKVRMGMDAEVEKNRFG

SEQ ID NO: 718739 - protein, 22 aa, Mycobacterium
RDKAGRPQYHWDNMDDVREGDV

SEQ ID NO: 718740 - protein, 22 aa, Mycobacterium
RDKARFAAELDRIGFDAIFITD

SEQ ID NO: 718741 - protein, 18 aa, Mycobacterium
RDKCGLTGTHLGCEHGAC

SEQ ID NO: 718742 - protein, 19 aa, Mycobacterium
RDKEAWLAVFADDAIVEDP

SEQ ID NO: 718743 - protein, 17 aa, Mycobacterium
RDKGQALAYVAGEIEQF

SEQ ID NO: 718744 - protein, 18 aa, Mycobacterium
RDKHYIVRNGEVFIVDEF

SEQ ID NO: 718745 - protein, 22 aa, Mycobacterium
RDKKVRKGVMYFAVLHDEGDLR

SEQ ID NO: 718746 - protein, 18 aa, Mycobacterium
RDKLFPTGIRRWGGGRSI

SEQ ID NO: 718747 - protein, 19 aa, Mycobacterium
RDKLSFGVSASRLAPHLQR

SEQ ID NO: 718748 - protein, 42 aa, Mycobacterium
RDKPSLMERLYKASWRFTPFFWQEIDEGILPALYAAAAPHAQ

SEQ ID NO: 718749 - protein, 22 aa, Mycobacterium
RDKRIPLELCPSSNVQTGAVAS

SEQ ID NO: 718750 - protein, 22 aa, Mycobacterium
RDKRIPLELCPSSNVQTGAVKS

SEQ ID NO: 718751 - protein, 23 aa, Mycobacterium
RDKRIPLELCPSSNVQTGAVKSI

SEQ ID NO: 718752 - protein, 23 aa, Mycobacterium
RDKRMEIALTYIYGVGRTRSNEI

SEQ ID NO: 718753 - protein, 23 aa, Mycobacterium
RDKRMEIALTYIYGVGRTRSQEI

SEQ ID NO: 718754 - protein, 17 aa, Mycobacterium
RDKRSGLTGKFVRTIFE

SEQ ID NO: 718755 - protein, 20 aa, Mycobacterium
RDKRSLVFPVKRLADLGFKI

SEQ ID NO: 718756 - protein, 20 aa, Mycobacterium
RDKRSLVFPVKRLADLGFTV

SEQ ID NO: 718757 - protein, 22 aa, Mycobacterium
RDKRVPLELCPSSNVQTGAVES

SEQ ID NO: 718758 - protein, 18 aa, Mycobacterium
RDKWYRAGWYSDRTCLDA

SEQ ID NO: 718759 - protein, 25 aa, Mycobacterium
RDLAAAIARCRRLLDLDADPEAVVE

SEQ ID NO: 718760 - protein, 24 aa, Mycobacterium
RDLAAELRQFWNIDFDDAGAIGRR

SEQ ID NO: 718761 - protein, 24 aa, Mycobacterium
RDLAAELRRNWNVEFDDAGAIGRR

SEQ ID NO: 718762 - protein, 26 aa, Mycobacterium
RDLAAELRTCWNIEFDDAGAIGRRYR

SEQ ID NO: 718763 - protein, 17 aa, Mycobacterium
RDLACAYDLNFVDPAAV

SEQ ID NO: 718764 - protein, 18 aa, Mycobacterium
RDLADIWPAIARDPDVRV

SEQ ID NO: 718765 - protein, 22 aa, Mycobacterium
RDLALKCVRAYNDFVIDEWCAA

SEQ ID NO: 718766 - protein, 19 aa, Mycobacterium
RDLAMKAYPLWLSGGCMPG

SEQ ID NO: 718767 - protein, 17 aa, Mycobacterium
RDLAPHLHREAYLHVLR

SEQ ID NO: 718768 - protein, 22 aa, Mycobacterium
RDLDLSLVRQVRDDWQFYRDRR

SEQ ID NO: 718769 - protein, 17 aa, Mycobacterium
RDLDWRVIARDAPLAVV

SEQ ID NO: 718770 - protein, 27 aa, Mycobacterium
RDLEFMGSCAYAVLAQESVRCRRRGVN

SEQ ID NO: 718771 - protein, 25 aa, Mycobacterium
RDLEGRLPFELQRAVLSNGSVILER

SEQ ID NO: 718772 - protein, 19 aa, Mycobacterium
RDLEKSWLLVLRGIAQPDR

SEQ ID NO: 718773 - protein, 19 aa, Mycobacterium
RDLERFIRDAAVSYWHQSG

SEQ ID NO: 718774 - protein, 26 aa, Mycobacterium
RDLEYGRLKLPVPTWQVLLDVPTELA

SEQ ID NO: 718775 - protein, 24 aa, Mycobacterium
RDLFPGYYKRPEVTAAVFDPDGFY

SEQ ID NO: 718776 - protein, 20 aa, Mycobacterium
RDLFPVFPPGKERVRDKAMG

SEQ ID NO: 718777 - protein, 31 aa, Mycobacterium
RDLGADLVRFLPWFSHPRLSVAQLSPPTAET

SEQ ID NO: 718778 - protein, 25 aa, Mycobacterium
RDLGASFAEFGGWLMPVSYAGTVSE

SEQ ID NO: 718779 - protein, 28 aa, Mycobacterium
RDLGGFPDVIGPFLGRAAAAVKALTEQA

SEQ ID NO: 718780 - protein, 17 aa, Mycobacterium
RDLGKWWRENKFQAYEG

SEQ ID NO: 718781 - protein, 18 aa, Mycobacterium
RDLGMLRHMWRFWYQVPM

SEQ ID NO: 718782 - protein, 17 aa, Mycobacterium
RDLGPMLVFLAGPGSGF

SEQ ID NO: 718783 - protein, 17 aa, Mycobacterium
RDLGPWWGQQAEFAEPF

SEQ ID NO: 718784 - protein, 20 aa, Mycobacterium
RDLGSMGIRVLAIAPSLFLT

SEQ ID NO: 718785 - protein, 19 aa, Mycobacterium
RDLGVSAFVLFSSIAGTVG

SEQ ID NO: 718786 - protein, 21 aa, Mycobacterium
RDLGYPLKAFITVVVDQHKLE

SEQ ID NO: 718787 - protein, 28 aa, Mycobacterium
RDLHQAAARLCARVGLHGLATVEFLFAG

SEQ ID NO: 718788 - protein, 17 aa, Mycobacterium
RDLIAGIGLRTFPLTSG

SEQ ID NO: 718789 - protein, 24 aa, Mycobacterium
RDLIARYGLEPALRLRNRVTGLSF

SEQ ID NO: 718790 - protein, 19 aa, Mycobacterium
RDLKQRPAVIEAAAQGSSP

SEQ ID NO: 718791 - protein, 26 aa, Mycobacterium
RDLLAAPEQYDWLATRLEIARKLRND

SEQ ID NO: 718792 - protein, 18 aa, Mycobacterium
RDLLAEWKAAGRAAKDVD

SEQ ID NO: 718793 - protein, 19 aa, Mycobacterium
RDLLAIVARVTWGCEPDDV

SEQ ID NO: 718794 - protein, 21 aa, Mycobacterium
RDLLDQQFEVVLAQIVAIVEA

SEQ ID NO: 718795 - protein, 18 aa, Mycobacterium
RDLLQRNGFEVLTHRTVP

SEQ ID NO: 718796 - protein, 18 aa, Mycobacterium
RDLLRPGTEDLFWLGTAE

SEQ ID NO: 718797 - protein, 21 aa, Mycobacterium
RDLLTCTARAGADGVSIRLPD

SEQ ID NO: 718798 - protein, 19 aa, Mycobacterium
RDLLTEWKNAGRASKDVDD

SEQ ID NO: 718799 - protein, 17 aa, Mycobacterium
RDLMDRLGCSLTPQYDE

SEQ ID NO: 718800 - protein, 24 aa, Mycobacterium
RDLMKTGGAQTFFMPLWMLAVALG

SEQ ID NO: 718801 - protein, 30 aa, Mycobacterium
RDLMSAWQWLHFRFGLPKPPLEPLAVERLY

SEQ ID NO: 718802 - protein, 17 aa, Mycobacterium
RDLNLSAFVMFSSMAGL

SEQ ID NO: 718803 - protein, 27 aa, Mycobacterium
RDLPAAPARWLLLRIPFATVGPEELAY

SEQ ID NO: 718804 - protein, 17 aa, Mycobacterium
RDLPARVWDEVEAADVV

SEQ ID NO: 718805 - protein, 17 aa, Mycobacterium
RDLPCHTGVRLLGGSSH

SEQ ID NO: 718806 - protein, 20 aa, Mycobacterium
RDLPCHTGVRLLGGTSSALG

SEQ ID NO: 718807 - protein, 17 aa, Mycobacterium
RDLPDEVPVPFDIPVLH

SEQ ID NO: 718808 - protein, 20 aa, Mycobacterium
RDLPELAVRWQAEVPPDARL

SEQ ID NO: 718809 - protein, 17 aa, Mycobacterium
RDLPGCHVYRTLDDLDA

SEQ ID NO: 718810 - protein, 17 aa, Mycobacterium
RDLPLIADAAQRVPLSV

SEQ ID NO: 718811 - protein, 23 aa, Mycobacterium
RDLPRPPIRFEAVGTQIIERLDW

SEQ ID NO: 718812 - protein, 24 aa, Mycobacterium
RDLPRRPLHPELRVEDRAIPGPAG

SEQ ID NO: 718813 - protein, 24 aa, Mycobacterium
RDLPRRPLHPELRVEDRTIAGPAG

SEQ ID NO: 718814 - protein, 18 aa, Mycobacterium
RDLQRFAERFGVHVVDGF

SEQ ID NO: 718815 - protein, 27 aa, Mycobacterium
RDLRCIGIAYLCCITGMMPLRQAAIVT

SEQ ID NO: 718816 - protein, 22 aa, Mycobacterium
RDLREAVPLIPLEHVLVETDAP

SEQ ID NO: 718817 - protein, 20 aa, Mycobacterium
RDLRELSEMFAAGTVRPYIG

SEQ ID NO: 718818 - protein, 17 aa, Mycobacterium
RDLRFRAPQPPQRWTEV

SEQ ID NO: 718819 - protein, 25 aa, Mycobacterium
RDLRGQIARLARFFSIDPASLRMDL

SEQ ID NO: 718820 - protein, 17 aa, Mycobacterium
RDLRLCTDFPREFQSVA

SEQ ID NO: 718821 - protein, 22 aa, Mycobacterium
RDLRLLAADIVFDMPMVGQAAR

SEQ ID NO: 718822 - protein, 21 aa, Mycobacterium
RDLRLPPKIEKVSFDLFAGEV

SEQ ID NO: 718823 - protein, 22 aa, Mycobacterium
RDLRLRVISWGAAPAPDALLRE

SEQ ID NO: 718824 - protein, 23 aa, Mycobacterium
RDLRTEMPIAQWITEYAGPLAQL

SEQ ID NO: 718825 - protein, 19 aa, Mycobacterium
RDLSDWGSQWLKTTGLNTL

SEQ ID NO: 718826 - protein, 17 aa, Mycobacterium
RDLSGASNLLFRRNSVT

SEQ ID NO: 718827 - protein, 17 aa, Mycobacterium
RDLSLSAGTVFEHLHQS

SEQ ID NO: 718828 - protein, 24 aa, Mycobacterium
RDLSPKAWPRYVWIAEDLPTTATN

SEQ ID NO: 718829 - protein, 22 aa, Mycobacterium
RDLSPRLAALLGPNPGATIDAL

SEQ ID NO: 718830 - protein, 18 aa, Mycobacterium
RDLSRFAERFAVRVVDGF

SEQ ID NO: 718831 - protein, 26 aa, Mycobacterium
RDLSTAIARCRRLLDLDADPEAIVSA

SEQ ID NO: 718832 - protein, 21 aa, Mycobacterium
RDLSVARLLGIDAPDAEIGKL

SEQ ID NO: 718833 - protein, 23 aa, Mycobacterium
RDLSVQLAGWMLMEAACVVTAGD

SEQ ID NO: 718834 - protein, 28 aa, Mycobacterium
RDLTCRWPGCDVPAIGCDIDHTIPHAAG

SEQ ID NO: 718835 - protein, 17 aa, Mycobacterium
RDLTGQAPLGWYTGRDS

SEQ ID NO: 718836 - protein, 19 aa, Mycobacterium
RDLTRFAVPYANGEPEPFR

SEQ ID NO: 718837 - protein, 24 aa, Mycobacterium
RDLTSRIYTDFTYRSGSTTISTQV

SEQ ID NO: 718838 - protein, 24 aa, Mycobacterium
RDLTTRIYNDFTYRSGSTTVSTRV

SEQ ID NO: 718839 - protein, 21 aa, Mycobacterium
RDLTTRRALLDALKQAWAADL

SEQ ID NO: 718840 - protein, 23 aa, Mycobacterium
RDLVEFTLRTMLSFFVAPNDPSR

SEQ ID NO: 718841 - protein, 19 aa, Mycobacterium
RDLVHHSGRVLQALTYQPT

SEQ ID NO: 718842 - protein, 26 aa, Mycobacterium
RDLVVKCAPGLDFADLREQTGFDGEI

SEQ ID NO: 718843 - protein, 18 aa, Mycobacterium
RDLYEAVSQLAFLPFPFD

SEQ ID NO: 718844 - protein, 23 aa, Mycobacterium
RDLYLDVIRRLLAAGEAYEAFST

SEQ ID NO: 718845 - protein, 23 aa, Mycobacterium
RDMADPGARHCLAPQPSHYRDYV

SEQ ID NO: 718846 - protein, 17 aa, Mycobacterium
RDMAGRFQVHAQTVEDE

SEQ ID NO: 718847 - protein, 25 aa, Mycobacterium
RDMLADPSQFDWLATRLEIARKLRN

SEQ ID NO: 718848 - protein, 25 aa, Mycobacterium
RDMLLKWSDDLVCGLSSHVDEAAIQ

SEQ ID NO: 718849 - protein, 17 aa, Mycobacterium
RDMLRQRVAPLVAKHRL

SEQ ID NO: 718850 - protein, 26 aa, Mycobacterium
RDMPELDAFLHYRMIDVSSIKELCRR

SEQ ID NO: 718851 - protein, 23 aa, Mycobacterium
RDMRRGSGELVLRVSAQEDGSAP

SEQ ID NO: 718852 - protein, 17 aa, Mycobacterium
RDMSKVPSAIWVVDTNK

SEQ ID NO: 718853 - protein, 32 aa, Mycobacterium
RDNGRIVLMFCSFDKRCRIIRLHGRARVVQFN

SEQ ID NO: 718854 - protein, 18 aa, Mycobacterium
RDNHPAWVHNIRAVPDVT

SEQ ID NO: 718855 - protein, 25 aa, Mycobacterium
RDNMALRLEDCVQRGHNFAIVDEVD

SEQ ID NO: 718856 - protein, 24 aa, Mycobacterium
RDNMLRPSYGLAEATVFVASGIYR

SEQ ID NO: 718857 - protein, 28 aa, Mycobacterium
RDNPERVWGWYLWRHYLVADVQPNTGHR

SEQ ID NO: 718858 - protein, 18 aa, Mycobacterium
RDNPRPGLVNALVQMRID

SEQ ID NO: 718859 - protein, 18 aa, Mycobacterium
RDNPRSWIAQPMMELSTV

SEQ ID NO: 718860 - protein, 25 aa, Mycobacterium
RDNRAVHALARIMLHGRIAQIQTSW

SEQ ID NO: 718861 - protein, 25 aa, Mycobacterium
RDNRAVHALARIMLHGRIDHIQTSW

SEQ ID NO: 718862 - protein, 25 aa, Mycobacterium
RDNRAVHALARIMLHGRIPHIQTSW

SEQ ID NO: 718863 - protein, 25 aa, Mycobacterium
RDNRAVHALARIMLHGRISNIQTSW

SEQ ID NO: 718864 - protein, 25 aa, Mycobacterium
RDNRAVHALARIMLHGRISQIQTSW

SEQ ID NO: 718865 - protein, 23 aa, Mycobacterium
RDNRFFGMIGLHPKLRDGITEYL

SEQ ID NO: 718866 - protein, 19 aa, Mycobacterium
RDNVVRWLGAGNGDWVRIN

SEQ ID NO: 718867 - protein, 18 aa, Mycobacterium
RDPAELGLAGLEIDTDLR

SEQ ID NO: 718868 - protein, 17 aa, Mycobacterium
RDPAERDASLAIRNGRG

SEQ ID NO: 718869 - protein, 25 aa, Mycobacterium
RDPAHATAVGWLASFVPLAIPTAGA

SEQ ID NO: 718870 - protein, 25 aa, Mycobacterium
RDPAKRLSAITSIGSDAWDRLFSGP

SEQ ID NO: 718871 - protein, 24 aa, Mycobacterium
RDPAKRLSVVTSIGSDAWDRLFSG

SEQ ID NO: 718872 - protein, 19 aa, Mycobacterium
RDPALPLLERVDEQELGYR

SEQ ID NO: 718873 - protein, 18 aa, Mycobacterium
RDPAPLFRTNVEGLRNVL

SEQ ID NO: 718874 - protein, 17 aa, Mycobacterium
RDPAPLFRTNVEGTRNV

SEQ ID NO: 718875 - protein, 19 aa, Mycobacterium
RDPAPRPTPPLPIPQDLSP

SEQ ID NO: 718876 - protein, 24 aa, Mycobacterium
RDPARRLSLVTAIGSEAWDRLFSG

SEQ ID NO: 718877 - protein, 40 aa, Mycobacterium
RDPASPHGWRCVVPIGLVKPRSRGALTLRLVGGELKTEVN

SEQ ID NO: 718878 - protein, 23 aa, Mycobacterium
RDPASVRVWSCFATVGDHLPEEL

SEQ ID NO: 718879 - protein, 18 aa, Mycobacterium
RDPAWRRRDPEGALRVSP

SEQ ID NO: 718880 - protein, 18 aa, Mycobacterium
RDPDAALKTAHRLWGNEG

SEQ ID NO: 718881 - protein, 26 aa, Mycobacterium
RDPDELRRHIGYVIQGAGLFPHYTVG

SEQ ID NO: 718882 - protein, 24 aa, Mycobacterium
RDPDGAWRRSAIKQVASGRFGVTS

SEQ ID NO: 718883 - protein, 17 aa, Mycobacterium
RDPDLWAALARLPDKQR

SEQ ID NO: 718884 - protein, 29 aa, Mycobacterium
RDPDYPAALYANFFPRYLRGISDDADAQA

SEQ ID NO: 718885 - protein, 19 aa, Mycobacterium
RDPEAWTAPDTFDINRDRS

SEQ ID NO: 718886 - protein, 17 aa, Mycobacterium
RDPEGFWSAAAEFLGVM

SEQ ID NO: 718887 - protein, 24 aa, Mycobacterium
RDPEGPCGCGRGFAGAASHRATTT

SEQ ID NO: 718888 - protein, 20 aa, Mycobacterium
RDPEKVLELFSGAQRQMPAS

SEQ ID NO: 718889 - protein, 26 aa, Mycobacterium
RDPELLPDLRAAHRAHEEAAWAVREW

SEQ ID NO: 718890 - protein, 25 aa, Mycobacterium
RDPETFRYSWGPAIAGLDTPTTAQL

SEQ ID NO: 718891 - protein, 22 aa, Mycobacterium
RDPEVIAMAVARVAESGGPNGR

SEQ ID NO: 718892 - protein, 24 aa, Mycobacterium
RDPEWAGWCSVLVNINDLSAMGAT

SEQ ID NO: 718893 - protein, 22 aa, Mycobacterium
RDPFDVCIGLLRDDRLGTGILQ

SEQ ID NO: 718894 - protein, 19 aa, Mycobacterium
RDPFVRLGPAAAMYHDALG

SEQ ID NO: 718895 - protein, 19 aa, Mycobacterium
RDPFVRLGPAAAMYYNALG

SEQ ID NO: 718896 - protein, 19 aa, Mycobacterium
RDPGRAHILLAQHVGSSPL

SEQ ID NO: 718897 - protein, 23 aa, Mycobacterium
RDPGRLRIGVRVPTVITPNPDPA

SEQ ID NO: 718898 - protein, 18 aa, Mycobacterium
RDPGSLKFITSVEIVTDS

SEQ ID NO: 718899 - protein, 18 aa, Mycobacterium
RDPGSPAQRLHALRRACA

SEQ ID NO: 718900 - protein, 18 aa, Mycobacterium
RDPIAAARANWERAGWGD

SEQ ID NO: 718901 - protein, 18 aa, Mycobacterium
RDPIAAARANWERSGWSD

SEQ ID NO: 718902 - protein, 17 aa, Mycobacterium
RDPIPAAESPTVPSDIG

SEQ ID NO: 718903 - protein, 20 aa, Mycobacterium
RDPKGLAEWIRLRRLGRREQ

SEQ ID NO: 718904 - protein, 17 aa, Mycobacterium
RDPKIAAGEFDIAVVGL

SEQ ID NO: 718905 - protein, 18 aa, Mycobacterium
RDPLAAATIWAIDDFTAD

SEQ ID NO: 718906 - protein, 20 aa, Mycobacterium
RDPLRLPGNAHFTFGGCEGD

SEQ ID NO: 718907 - protein, 21 aa, Mycobacterium
RDPMAMLPFLGYNVGDYFAHW

SEQ ID NO: 718908 - protein, 20 aa, Mycobacterium
RDPMAMLPFMGYHVGDYLNH

SEQ ID NO: 718909 - protein, 19 aa, Mycobacterium
RDPMAMLPFMGYNVGDYVQ

SEQ ID NO: 718910 - protein, 32 aa, Mycobacterium
RDPMECAEILDWPAKLRLLEGFRQRENLTWQA

SEQ ID NO: 718911 - protein, 35 aa, Mycobacterium
RDPNKHLAFGFGVHFCLGAALARMEVNSFFSALLP

SEQ ID NO: 718912 - protein, 19 aa, Mycobacterium
RDPPLLYLARYARATKPQV

SEQ ID NO: 718913 - protein, 25 aa, Mycobacterium
RDPQGRSLFAFKLHQFIGKGDTVYT

SEQ ID NO: 718914 - protein, 19 aa, Mycobacterium
RDPQLPALLARSVADALVG

SEQ ID NO: 718915 - protein, 19 aa, Mycobacterium
RDPQMRFNAPMTLHHSHVR

SEQ ID NO: 718916 - protein, 18 aa, Mycobacterium
RDPQTGLALIEFPLLGVI

SEQ ID NO: 718917 - protein, 21 aa, Mycobacterium
RDPRFGHVVTQDLATYHISAH

SEQ ID NO: 718918 - protein, 25 aa, Mycobacterium
RDPRPAARRDGEWLIGTGVAAATYP

SEQ ID NO: 718919 - protein, 19 aa, Mycobacterium
RDPRSIGPILTRGHGSLRD

SEQ ID NO: 718920 - protein, 21 aa, Mycobacterium
RDPRSIKVFTMVTPVVAETRD

SEQ ID NO: 718921 - protein, 23 aa, Mycobacterium
RDPRVGLLAARCRDLADEMGLQW

SEQ ID NO: 718922 - protein, 20 aa, Mycobacterium
RDPRVSFLIEDGHTYDTLRG

SEQ ID NO: 718923 - protein, 23 aa, Mycobacterium
RDPSLRAAVALADGRELTGLALQ

SEQ ID NO: 718924 - protein, 18 aa, Mycobacterium
RDPSPLFRTNVEGLRNVL

SEQ ID NO: 718925 - protein, 30 aa, Mycobacterium
RDPSVPLRLAELFLEAGLPAGVFQVVQGDK

SEQ ID NO: 718926 - protein, 18 aa, Mycobacterium
RDPTALGGYRTYTPALKA

SEQ ID NO: 718927 - protein, 22 aa, Mycobacterium
RDPTLRRLLPDFVHPDDDDSAG

SEQ ID NO: 718928 - protein, 18 aa, Mycobacterium
RDPTPLFRTNVEGLRHVL

SEQ ID NO: 718929 - protein, 29 aa, Mycobacterium
RDPVKGFFRALDFTLPWDVDGLDDAIPVD

SEQ ID NO: 718930 - protein, 20 aa, Mycobacterium
RDPVKLGWFVTPTCVVAGDA

SEQ ID NO: 718931 - protein, 25 aa, Mycobacterium
RDPVKLRLGIGYVIQHAGLMPHQRV

SEQ ID NO: 718932 - protein, 18 aa, Mycobacterium
RDQALKFGATHVYPDIMA

SEQ ID NO: 718933 - protein, 17 aa, Mycobacterium
RDQALKFGATHVYPDMN

SEQ ID NO: 718934 - protein, 17 aa, Mycobacterium
RDQALKFGATHVYPDVF

SEQ ID NO: 718935 - protein, 19 aa, Mycobacterium
RDQARAFARRTRRPALLAH

SEQ ID NO: 718936 - protein, 20 aa, Mycobacterium
RDQAVEAIVDWVNRRENATP

SEQ ID NO: 718937 - protein, 18 aa, Mycobacterium
RDQFLKRYGSLHRLECNF

SEQ ID NO: 718938 - protein, 29 aa, Mycobacterium
RDQGRALLPWMLGYQVPMWPERKLTRDDA

SEQ ID NO: 718939 - protein, 26 aa, Mycobacterium
RDQIRLWLDLLLERRPGEIATTAEGF

SEQ ID NO: 718940 - protein, 24 aa, Mycobacterium
RDQLCRFPGCEAVADRADIDHTVP

SEQ ID NO: 718941 - protein, 24 aa, Mycobacterium
RDQLILAGVYAFSGITATSTDAVQ

SEQ ID NO: 718942 - protein, 24 aa, Mycobacterium
RDQLNEFFLLLAIAGNETTRNTLS

SEQ ID NO: 718943 - protein, 25 aa, Mycobacterium
RDQLNEFFLLLAIAGNETTRNTLSH

SEQ ID NO: 718944 - protein, 17 aa, Mycobacterium
RDQMHVIDSAAESESLA

SEQ ID NO: 718945 - protein, 21 aa, Mycobacterium
RDQQELDRWLALDPIPRFRRY

SEQ ID NO: 718946 - protein, 22 aa, Mycobacterium
RDQRWARAKAMLLNIVESPAVG

SEQ ID NO: 718947 - protein, 25 aa, Mycobacterium
RDQRWKRYNIFNLVWNTLLALGFEW

SEQ ID NO: 718948 - protein, 17 aa, Mycobacterium
RDRAGAVEGLRALAAGQ

SEQ ID NO: 718949 - protein, 22 aa, Mycobacterium
RDRAIGGLMLLSGLRSAEVLGL

SEQ ID NO: 718950 - protein, 22 aa, Mycobacterium
RDRAKMFALLWQSLRRQRQLTR

SEQ ID NO: 718951 - protein, 19 aa, Mycobacterium
RDRALDQLVGFFVNTLVLR

SEQ ID NO: 718952 - protein, 22 aa, Mycobacterium
RDRAPSQWLLRMLATQNERAEL

SEQ ID NO: 718953 - protein, 22 aa, Mycobacterium
RDRASGALKWTATANDLVFGSN

SEQ ID NO: 718954 - protein, 20 aa, Mycobacterium
RDRCAAMVAALTGAGYRVVV

SEQ ID NO: 718955 - protein, 22 aa, Mycobacterium
RDRDDFYWGAGVHPDEWSLVRQ

SEQ ID NO: 718956 - protein, 23 aa, Mycobacterium
RDRDFSCFYFREGELIAADCVNR

SEQ ID NO: 718957 - protein, 24 aa, Mycobacterium
RDRDFTCFYLRAGELIAADCINRP

SEQ ID NO: 718958 - protein, 23 aa, Mycobacterium
RDRDGRPLPAWNTPDEAFEAWKR

SEQ ID NO: 718959 - protein, 23 aa, Mycobacterium
RDRERILWFLAEIARRYDPHDEQ

SEQ ID NO: 718960 - protein, 19 aa, Mycobacterium
RDREVVIDFARPNPVVLAG

SEQ ID NO: 718961 - protein, 17 aa, Mycobacterium
RDRFDFVVDLGAELPMR

SEQ ID NO: 718962 - protein, 21 aa, Mycobacterium
RDRFPGARCFLVNSGRIDEDM

SEQ ID NO: 718963 - protein, 26 aa, Mycobacterium
RDRGCTRPGCTANGYRCQAHHATTDY

SEQ ID NO: 718964 - protein, 27 aa, Mycobacterium
RDRGCTRPGCTANGYRCQAHHATTDYA

SEQ ID NO: 718965 - protein, 19 aa, Mycobacterium
RDRGELMGIGISFFTEAVG

SEQ ID NO: 718966 - protein, 17 aa, Mycobacterium
RDRGHGWATLRDLGPVL

SEQ ID NO: 718967 - protein, 26 aa, Mycobacterium
RDRGLLPPPLRVGRIALFNDTHLTRL

SEQ ID NO: 718968 - protein, 22 aa, Mycobacterium
RDRGPSQWLLRMLATQTERTEL

SEQ ID NO: 718969 - protein, 22 aa, Mycobacterium
RDRGPSQWLLRMLATQTERTML

SEQ ID NO: 718970 - protein, 26 aa, Mycobacterium
RDRGRTPVGLCAKVIRRDPRPHRGCT

SEQ ID NO: 718971 - protein, 26 aa, Mycobacterium
RDRGSLRRFVPFDVDAGVLSSAAKAL

SEQ ID NO: 718972 - protein, 19 aa, Mycobacterium
RDRGWPIDELLSLSRRDSW

SEQ ID NO: 718973 - protein, 19 aa, Mycobacterium
RDRGWPVDELLSLSNLDGW

SEQ ID NO: 718974 - protein, 18 aa, Mycobacterium
RDRGWQGSPERFGASAAI

SEQ ID NO: 718975 - protein, 18 aa, Mycobacterium
RDRGYCWFAGEAAESRAV

SEQ ID NO: 718976 - protein, 18 aa, Mycobacterium
RDRHVLGVRGSDGRVHVP

SEQ ID NO: 718977 - protein, 17 aa, Mycobacterium
RDRIKPAPLRAAVPGGF

SEQ ID NO: 718978 - protein, 24 aa, Mycobacterium
RDRIPEMQEAIGATAERHKDGLLF

SEQ ID NO: 718979 - protein, 20 aa, Mycobacterium
RDRITLISASIAENVDRKDF

SEQ ID NO: 718980 - protein, 20 aa, Mycobacterium
RDRKVLTFVLDKGMEGFTQS

SEQ ID NO: 718981 - protein, 23 aa, Mycobacterium
RDRLDHRFRLLVGSRRGLGRHQT

SEQ ID NO: 718982 - protein, 17 aa, Mycobacterium
RDRLEVFFNDRGVAVPD

SEQ ID NO: 718983 - protein, 19 aa, Mycobacterium
RDRLFPDLVDAYARGQAPR

SEQ ID NO: 718984 - protein, 17 aa, Mycobacterium
RDRLKIAGIEVTDTADG

SEQ ID NO: 718985 - protein, 22 aa, Mycobacterium
RDRLRARLAQMGAHIPESHANF

SEQ ID NO: 718986 - protein, 18 aa, Mycobacterium
RDRLREGSCLQECRRCAV

SEQ ID NO: 718987 - protein, 34 aa, Mycobacterium
RDRLRVGLEPGDVGRYILGVALSLLMNVIPGSDD

SEQ ID NO: 718988 - protein, 17 aa, Mycobacterium
RDRLVSSGRAEQPFVIH

SEQ ID NO: 718989 - protein, 21 aa, Mycobacterium
RDRMAAVAEAKRQNLMRKELA

SEQ ID NO: 718990 - protein, 25 aa, Mycobacterium
RDRMAFRSAGYWDLGAELDAGKDNP

SEQ ID NO: 718991 - protein, 25 aa, Mycobacterium
RDRMAFRSASYWDIVAQLDASVSDP

SEQ ID NO: 718992 - protein, 26 aa, Mycobacterium
RDRMAFRSASYWDIVAQLDASVSDPQ

SEQ ID NO: 718993 - protein, 18 aa, Mycobacterium
RDRMPIFPVPEGHDQASW

SEQ ID NO: 718994 - protein, 18 aa, Mycobacterium
RDRMPVFPVPDGHDPASW

SEQ ID NO: 718995 - protein, 26 aa, Mycobacterium
RDRPATMPLLEAWTALSALARDTTYI

SEQ ID NO: 718996 - protein, 21 aa, Mycobacterium
RDRPGQFGFVGANGGIMSKYS

SEQ ID NO: 718997 - protein, 24 aa, Mycobacterium
RDRPLLDLFWDYAMEGDEPSGEDV

SEQ ID NO: 718998 - protein, 24 aa, Mycobacterium
RDRPLLDLWWDYELDGDEPSGEDV

SEQ ID NO: 718999 - protein, 30 aa, Mycobacterium
RDRPMILKRFVKGIAQEAVFQKRVPEKRPD

SEQ ID NO: 719000 - protein, 17 aa, Mycobacterium
RDRPVPSARGWSAAPVR

SEQ ID NO: 719001 - protein, 24 aa, Mycobacterium
RDRQRPGTELAIRQRYPLGHARLE

SEQ ID NO: 719002 - protein, 23 aa, Mycobacterium
RDRRAHWKNIQFVYQNPDSALDP

SEQ ID NO: 719003 - protein, 34 aa, Mycobacterium
RDRRARFTPSLKLLWRMAFAFAGESERGKRMRLH

SEQ ID NO: 719004 - protein, 19 aa, Mycobacterium
RDRRHWVALGADAARAPAV

SEQ ID NO: 719005 - protein, 17 aa, Mycobacterium
RDRRLLVATARPRELAM

SEQ ID NO: 719006 - protein, 17 aa, Mycobacterium
RDRRPVIAHAQLVDDAD

SEQ ID NO: 719007 - protein, 24 aa, Mycobacterium
RDRSDPLYAMDWVTVYALAVNEEN

SEQ ID NO: 719008 - protein, 17 aa, Mycobacterium
RDRSWRQIRVERRGAVP

SEQ ID NO: 719009 - protein, 23 aa, Mycobacterium
RDRTPLLEWLRRRGVDEVDVVGI

SEQ ID NO: 719010 - protein, 26 aa, Mycobacterium
RDRTRIPIFIEEALRMDAPVKSQFRL

SEQ ID NO: 719011 - protein, 19 aa, Mycobacterium
RDRVAILTPQGVDYVAAFF

SEQ ID NO: 719012 - protein, 20 aa, Mycobacterium
RDRVEGFLRRARQDGATVLV

SEQ ID NO: 719013 - protein, 18 aa, Mycobacterium
RDRVLALALHLLDLGYFR

SEQ ID NO: 719014 - protein, 19 aa, Mycobacterium
RDRVLALGLRLLDLGYFRA

SEQ ID NO: 719015 - protein, 21 aa, Mycobacterium
RDRVLGWRGGERHMTDLAHVT

SEQ ID NO: 719016 - protein, 27 aa, Mycobacterium
RDRVLVHPRPRLSVISVGGELVDVDRT

SEQ ID NO: 719017 - protein, 19 aa, Mycobacterium
RDRVREVIDPAVVVDEKSR

SEQ ID NO: 719018 - protein, 25 aa, Mycobacterium
RDRVYELFELVGFTDVERRYRQYPH

SEQ ID NO: 719019 - protein, 26 aa, Mycobacterium
RDRWHSLARLAIRDDIYASLRSLCFD

SEQ ID NO: 719020 - protein, 17 aa, Mycobacterium
RDRWKRAVALVESLTGD

SEQ ID NO: 719021 - protein, 18 aa, Mycobacterium
RDRWQYTWDIRRRETLER

SEQ ID NO: 719022 - protein, 20 aa, Mycobacterium
RDRYGWQWNIVPLIKVPGVT

SEQ ID NO: 719023 - protein, 18 aa, Mycobacterium
RDRYLGIIDKVRAAIPHA

SEQ ID NO: 719024 - protein, 21 aa, Mycobacterium
RDRYPAWDSFAAVRDRLDPDR

SEQ ID NO: 719025 - protein, 19 aa, Mycobacterium
RDRYPDFFKMAYEALPADG

SEQ ID NO: 719026 - protein, 18 aa, Mycobacterium
RDRYTTVVRLEMQDILVR

SEQ ID NO: 719027 - protein, 19 aa, Mycobacterium
RDSAVDAIVKWIADRENAT

SEQ ID NO: 719028 - protein, 22 aa, Mycobacterium
RDSGDIVGLISCRSRARHSVEI

SEQ ID NO: 719029 - protein, 20 aa, Mycobacterium
RDSGGPAPIFQWLIYPRTDF

SEQ ID NO: 719030 - protein, 36 aa, Mycobacterium
RDSHKSVVAGLIFSGVMPRWITPRWDADRHLSHPPS

SEQ ID NO: 719031 - protein, 26 aa, Mycobacterium
RDSIDLLELFTMWTAGFPEPRTFSLR

SEQ ID NO: 719032 - protein, 19 aa, Mycobacterium
RDSIDLLELLTTWTAGFPE

SEQ ID NO: 719033 - protein, 25 aa, Mycobacterium
RDSIDLLELLTTWTAGFPEPRTFTL

SEQ ID NO: 719034 - protein, 17 aa, Mycobacterium
RDSMKLPPQLVGRPADG

SEQ ID NO: 719035 - protein, 18 aa, Mycobacterium
RDSMKLPPQLVGRPADGE

SEQ ID NO: 719036 - protein, 19 aa, Mycobacterium
RDSPRAGEADLILAKHRNG

SEQ ID NO: 719037 - protein, 19 aa, Mycobacterium
RDSRSLFGLDAEEATARHN

SEQ ID NO: 719038 - protein, 20 aa, Mycobacterium
RDSVMFRAPAFRHHVAPDET

SEQ ID NO: 719039 - protein, 24 aa, Mycobacterium
RDSVYRIVVERAPGFGEYQERTDR

SEQ ID NO: 719040 - protein, 30 aa, Mycobacterium
RDTAAGAGFEWSFAGPRRLKGIKNETKLFR

SEQ ID NO: 719041 - protein, 20 aa, Mycobacterium
RDTADWALRELVVLHEVAHH

SEQ ID NO: 719042 - protein, 21 aa, Mycobacterium
RDTAIVRFARWAATCRDTRIT

SEQ ID NO: 719043 - protein, 22 aa, Mycobacterium
RDTDADAALVFYLTKADPLLVL

SEQ ID NO: 719044 - protein, 20 aa, Mycobacterium
RDTEGRWRITVFAEETDAAY

SEQ ID NO: 719045 - protein, 17 aa, Mycobacterium
RDTEIDTVLGLTVGADD

SEQ ID NO: 719046 - protein, 20 aa, Mycobacterium
RDTEPLLYFRGAYGGLDASA

SEQ ID NO: 719047 - protein, 25 aa, Mycobacterium
RDTGAWPLICHTIGTGRLRLDVELA

SEQ ID NO: 719048 - protein, 18 aa, Mycobacterium
RDTGGGFGQKVVPMREDM

SEQ ID NO: 719049 - protein, 19 aa, Mycobacterium
RDTGGGFGQKVVPMREDMC

SEQ ID NO: 719050 - protein, 25 aa, Mycobacterium
RDTGGPFFIEFRTYRFRAHSMFDPE

SEQ ID NO: 719051 - protein, 23 aa, Mycobacterium
RDTGLTLPATVVFDHPTPTAVAE

SEQ ID NO: 719052 - protein, 26 aa, Mycobacterium
RDTGMSFPAYVRWARLIRTIEVARTG

SEQ ID NO: 719053 - protein, 25 aa, Mycobacterium
RDTGVRRIVYLGGFVPECEALSQHL

SEQ ID NO: 719054 - protein, 17 aa, Mycobacterium
RDTLARVGLTGSWLDRD

SEQ ID NO: 719055 - protein, 20 aa, Mycobacterium
RDTLASVLRLWTADAARLTQ

SEQ ID NO: 719056 - protein, 17 aa, Mycobacterium
RDTLFRIASMTKPVTVA

SEQ ID NO: 719057 - protein, 19 aa, Mycobacterium
RDTLGFSVLHVVRDNPTSL

SEQ ID NO: 719058 - protein, 21 aa, Mycobacterium
RDTLLWAKLIDKYGGTMTAAP

SEQ ID NO: 719059 - protein, 23 aa, Mycobacterium
RDTLRCFASLFGDQALKPLDYAD

SEQ ID NO: 719060 - protein, 25 aa, Mycobacterium
RDTMCAVPGCGATRGLHAHHIRHWE

SEQ ID NO: 719061 - protein, 18 aa, Mycobacterium
RDTMPKWAKQLLQHRDPN

SEQ ID NO: 719062 - protein, 18 aa, Mycobacterium
RDTMPSWAKGLIQHRDPN

SEQ ID NO: 719063 - protein, 20 aa, Mycobacterium
RDTMYPGLTRKLVTADDAEM

SEQ ID NO: 719064 - protein, 18 aa, Mycobacterium
RDTNCAGISPESRASTGG

SEQ ID NO: 719065 - protein, 25 aa, Mycobacterium
RDTPEGIKIFLMRRHSAMDFVAGVM

SEQ ID NO: 719066 - protein, 17 aa, Mycobacterium
RDTPGRYADPWGAIRAK

SEQ ID NO: 719067 - protein, 21 aa, Mycobacterium
RDTPWGFALRSHFHLGTDLPA

SEQ ID NO: 719068 - protein, 18 aa, Mycobacterium
RDTQFFWDGVNAHELRIQ

SEQ ID NO: 719069 - protein, 17 aa, Mycobacterium
RDTRRTLSETVADLMRR

SEQ ID NO: 719070 - protein, 21 aa, Mycobacterium
RDTSPEGYSWIDANDSANNVL

SEQ ID NO: 719071 - protein, 17 aa, Mycobacterium
RDTTCWIYGGLTLNPLF

SEQ ID NO: 719072 - protein, 24 aa, Mycobacterium
RDTTDWQALCGVIGRADLAADDAL

SEQ ID NO: 719073 - protein, 24 aa, Mycobacterium
RDTVLKFLAERAVAQPGDIAMVPT

SEQ ID NO: 719074 - protein, 19 aa, Mycobacterium
RDTVWAFAEGFGYAYERTV

SEQ ID NO: 719075 - protein, 22 aa, Mycobacterium
RDTWNNLALKWFRGINSVLGVQ

SEQ ID NO: 719076 - protein, 19 aa, Mycobacterium
RDTYWPAPDDTGLRKPFAH

SEQ ID NO: 719077 - protein, 21 aa, Mycobacterium
RDVALHVIGAIGLITLGRSDE

SEQ ID NO: 719078 - protein, 19 aa, Mycobacterium
RDVAQRYSLGMTEQLLTEA

SEQ ID NO: 719079 - protein, 17 aa, Mycobacterium
RDVELFFQAIYPSVTGK

SEQ ID NO: 719080 - protein, 25 aa, Mycobacterium
RDVELLLVIGRLIAGAMHQARLHRQ

SEQ ID NO: 719081 - protein, 18 aa, Mycobacterium
RDVELLVVIGRLIAGALH

SEQ ID NO: 719082 - protein, 19 aa, Mycobacterium
RDVFKQMGELGMLGMAIPE

SEQ ID NO: 719083 - protein, 28 aa, Mycobacterium
RDVGELFAAMGMPGRWSVRPRDVAITPR

SEQ ID NO: 719084 - protein, 20 aa, Mycobacterium
RDVGKRAGLVHARDTVLRGV

SEQ ID NO: 719085 - protein, 24 aa, Mycobacterium
RDVGNYDAFIPFRAAIRAMESAAE

SEQ ID NO: 719086 - protein, 18 aa, Mycobacterium
RDVGRWRFVTLHRQVDTS

SEQ ID NO: 719087 - protein, 17 aa, Mycobacterium
RDVGVDVVHHLPGVGAN

SEQ ID NO: 719088 - protein, 20 aa, Mycobacterium
RDVIPIAATVATVFVENVLD

SEQ ID NO: 719089 - protein, 18 aa, Mycobacterium
RDVIPMSLLGTFAPYAVV

SEQ ID NO: 719090 - protein, 21 aa, Mycobacterium
RDVKAGWKVADVYPVDGAATD

SEQ ID NO: 719091 - protein, 18 aa, Mycobacterium
RDVKRLSKVTGIDESRLG

SEQ ID NO: 719092 - protein, 17 aa, Mycobacterium
RDVKRVKQRFGVTVNDV

SEQ ID NO: 719093 - protein, 19 aa, Mycobacterium
RDVLDDAANRLAVRPGRCV

SEQ ID NO: 719094 - protein, 23 aa, Mycobacterium
RDVLDMVDFRLGVECEAAALAAA

SEQ ID NO: 719095 - protein, 20 aa, Mycobacterium
RDVLEITGLDRFIQQRVDGV

SEQ ID NO: 719096 - protein, 31 aa, Mycobacterium
RDVLEVTGLDRFVQKRVDGITLRQEHIAGKP

SEQ ID NO: 719097 - protein, 17 aa, Mycobacterium
RDVLLDMCENLLDVLDQ

SEQ ID NO: 719098 - protein, 23 aa, Mycobacterium
RDVLPHMRPGSAIINITSTFAVI

SEQ ID NO: 719099 - protein, 24 aa, Mycobacterium
RDVLQWKAAEVAAAIGTTTTAVNS

SEQ ID NO: 719100 - protein, 18 aa, Mycobacterium
RDVLSGLFATWFADHTAD

SEQ ID NO: 719101 - protein, 18 aa, Mycobacterium
RDVLTGLFATWFADHTAD

SEQ ID NO: 719102 - protein, 17 aa, Mycobacterium
RDVMAGFDAPTLVGTPG

SEQ ID NO: 719103 - protein, 25 aa, Mycobacterium
RDVNAMRYGMEWAEEIIDTGISEFS

SEQ ID NO: 719104 - protein, 17 aa, Mycobacterium
RDVPILLSIGYAACHWC

SEQ ID NO: 719105 - protein, 19 aa, Mycobacterium
RDVPLAPLVRAHRLGHARF

SEQ ID NO: 719106 - protein, 21 aa, Mycobacterium
RDVPPGLTLRFADALSANGQD

SEQ ID NO: 719107 - protein, 18 aa, Mycobacterium
RDVPSIDVATRLSGLEPL

SEQ ID NO: 719108 - protein, 20 aa, Mycobacterium
RDVPSRFAVLPRRGDTSQIM

SEQ ID NO: 719109 - protein, 26 aa, Mycobacterium
RDVQAGAVSFRFGDRTQLNGVPRDAA

SEQ ID NO: 719110 - protein, 20 aa, Mycobacterium
RDVRELLVNMGFIARDSTLT

SEQ ID NO: 719111 - protein, 23 aa, Mycobacterium
RDVRIGFKAIKIVRGDDGADSMV

SEQ ID NO: 719112 - protein, 20 aa, Mycobacterium
RDVSHGCINLSPTNAKWFFD

SEQ ID NO: 719113 - protein, 28 aa, Mycobacterium
RDVTEAVLWLAGPRSRYVTGVSIPVDAG

SEQ ID NO: 719114 - protein, 24 aa, Mycobacterium
RDVTKLSGRELAAMRGKDIAMVFQ

SEQ ID NO: 719115 - protein, 17 aa, Mycobacterium
RDVTLRDGLQLTAKTLP

SEQ ID NO: 719116 - protein, 25 aa, Mycobacterium
RDVVAGLVSDIAWRAKVSTLSGGQR

SEQ ID NO: 719117 - protein, 24 aa, Mycobacterium
RDVVAGLVSDIGWDATIATLSGGQ

SEQ ID NO: 719118 - protein, 17 aa, Mycobacterium
RDVVIGMGVARKQPRVI

SEQ ID NO: 719119 - protein, 31 aa, Mycobacterium
RDVVRRALSEPLRWIAFNAGFEGGDVVDVVA

SEQ ID NO: 719120 - protein, 20 aa, Mycobacterium
RDVVTGLVSDIAWDATVATL

SEQ ID NO: 719121 - protein, 17 aa, Mycobacterium
RDVVVCAAGSMPGDLHK

SEQ ID NO: 719122 - protein, 17 aa, Mycobacterium
RDVVWSSRFRVHHRVAD

SEQ ID NO: 719123 - protein, 25 aa, Mycobacterium
RDVYKLRQRVLLIWGREDRVNPLDG

SEQ ID NO: 719124 - protein, 17 aa, Mycobacterium
RDVYVSFTIRLYRVRTE

SEQ ID NO: 719125 - protein, 19 aa, Mycobacterium
RDWEAVKTFLSDDCLYVDM

SEQ ID NO: 719126 - protein, 21 aa, Mycobacterium
RDWFAAFAAQRGWELRVDSIG

SEQ ID NO: 719127 - protein, 19 aa, Mycobacterium
RDWQHGVFIGGTLGSEQTA

SEQ ID NO: 719128 - protein, 23 aa, Mycobacterium
RDWQRLCQKWDLASAPLDRQIEI

SEQ ID NO: 719129 - protein, 28 aa, Mycobacterium
RDWRQWWDWAPGASWRHPWGPDSDVDDR

SEQ ID NO: 719130 - protein, 27 aa, Mycobacterium
RDWRQWWEWTPGADWRHPFGPDSSVDD

SEQ ID NO: 719131 - protein, 18 aa, Mycobacterium
RDWSVSRNRYWGSPIPVW

SEQ ID NO: 719132 - protein, 25 aa, Mycobacterium
RDYAALRRWAHRFYPAAQTSTADFG

SEQ ID NO: 719133 - protein, 21 aa, Mycobacterium
RDYAPGFAVALMAKDLGLAAN

SEQ ID NO: 719134 - protein, 17 aa, Mycobacterium
RDYARALSIVAAKAPTL

SEQ ID NO: 719135 - protein, 24 aa, Mycobacterium
RDYASRPARPGHRRIVLRFLTSPI

SEQ ID NO: 719136 - protein, 21 aa, Mycobacterium
RDYAVCTPLPRVGEVEDVANL

SEQ ID NO: 719137 - protein, 24 aa, Mycobacterium
RDYCRELIRQLAFGIPGEALSPVA

SEQ ID NO: 719138 - protein, 30 aa, Mycobacterium
RDYDIKVLILKANGKGFCSGHAIGNNAVDY

SEQ ID NO: 719139 - protein, 22 aa, Mycobacterium
RDYEQRLGLSAGMSGDLEAAVR

SEQ ID NO: 719140 - protein, 23 aa, Mycobacterium
RDYGDVAYGWAMEDTTGIVKLIA

SEQ ID NO: 719141 - protein, 18 aa, Mycobacterium
RDYIRTVGRTPNGIWGGK

SEQ ID NO: 719142 - protein, 18 aa, Mycobacterium
RDYKRVLAAIAEAEAKGL

SEQ ID NO: 719143 - protein, 20 aa, Mycobacterium
RDYLGWVGAPIEWDHSTDPS

SEQ ID NO: 719144 - protein, 23 aa, Mycobacterium
RDYPAPPGAFWVPRRLGGGAPTP

SEQ ID NO: 719145 - protein, 24 aa, Mycobacterium
RDYPDCTVVPGFIDMHVHGGGGAS

SEQ ID NO: 719146 - protein, 25 aa, Mycobacterium
RDYPIYRFESGRLWKSACSIKVWDD

SEQ ID NO: 719147 - protein, 22 aa, Mycobacterium
RDYPVNFDVWWFKLPREGDADF

SEQ ID NO: 719148 - protein, 18 aa, Mycobacterium
RDYRDWFATLPAELTDAV

SEQ ID NO: 719149 - protein, 22 aa, Mycobacterium
RDYRLADLLTGFLAQLKTDLQR

SEQ ID NO: 719150 - protein, 20 aa, Mycobacterium
RDYSKPGKPDIDWDDAQAKQ

SEQ ID NO: 719151 - protein, 18 aa, Mycobacterium
RDYVRTVGRTPNGVWGGK

SEQ ID NO: 719152 - protein, 17 aa, Mycobacterium
RDYWNPLAIAGATGGVE

SEQ ID NO: 719153 - protein, 25 aa, Mycobacterium
REAAAPFSAFVFKVQAGMDSAHRDR

SEQ ID NO: 719154 - protein, 23 aa, Mycobacterium
REAAAQQRIGWIFNLADVVVAPT

SEQ ID NO: 719155 - protein, 17 aa, Mycobacterium
REAAGLPPAAANVAAAS

SEQ ID NO: 719156 - protein, 23 aa, Mycobacterium
REAAKPGSYFWLKGGKRPAQSPT

SEQ ID NO: 719157 - protein, 23 aa, Mycobacterium
REAAKPGSYFWLKGGSRPVQPSA

SEQ ID NO: 719158 - protein, 24 aa, Mycobacterium
REAALRAGVTLSNLASSWAAFTVH

SEQ ID NO: 719159 - protein, 21 aa, Mycobacterium
REAALYPGSWSEWSADPTRPI

SEQ ID NO: 719160 - protein, 22 aa, Mycobacterium
REAANMLRRNRISALRPVTDSD

SEQ ID NO: 719161 - protein, 32 aa, Mycobacterium
REAARAAWRKALEGFEAPTLVAPRSVPGSRGV

SEQ ID NO: 719162 - protein, 17 aa, Mycobacterium
REAARLVGRTLSPLTLT

SEQ ID NO: 719163 - protein, 19 aa, Mycobacterium
REAARYGIDARIERVRWDD

SEQ ID NO: 719164 - protein, 24 aa, Mycobacterium
REAAVKRREWMAGRRDRLADQRDR

SEQ ID NO: 719165 - protein, 18 aa, Mycobacterium
REACGGAGYMAENRLIAL

SEQ ID NO: 719166 - protein, 18 aa, Mycobacterium
REACGGAGYMAENRLIGL

SEQ ID NO: 719167 - protein, 30 aa, Mycobacterium
REACKASLDRLGLDYVDLYLIHWPAPAAGK

SEQ ID NO: 719168 - protein, 24 aa, Mycobacterium
REACTKLGTEHLVGTTIYVLAHPC

SEQ ID NO: 719169 - protein, 22 aa, Mycobacterium
REACVKLGTEHLVDTTIYVLAH

SEQ ID NO: 719170 - protein, 17 aa, Mycobacterium
READLIPPPVGKPTGEQ

SEQ ID NO: 719171 - protein, 17 aa, Mycobacterium
READQWLVPSPQLIETH

SEQ ID NO: 719172 - protein, 23 aa, Mycobacterium
READTALVNGLRTQVWDAVAASR

SEQ ID NO: 719173 - protein, 26 aa, Mycobacterium
READVEFARLYGFARPMGSRMMCGET

SEQ ID NO: 719174 - protein, 17 aa, Mycobacterium
READVRDGPALQQLVAD

SEQ ID NO: 719175 - protein, 19 aa, Mycobacterium
REAEFASRIGVSGSELSAY

SEQ ID NO: 719176 - protein, 17 aa, Mycobacterium
REAELRARDFVSLVSGG

SEQ ID NO: 719177 - protein, 25 aa, Mycobacterium
REAELRFTDLRWFEELPRGGHFAAM

SEQ ID NO: 719178 - protein, 20 aa, Mycobacterium
REAERLWRPPKLPPVGDVTS

SEQ ID NO: 719179 - protein, 17 aa, Mycobacterium
REAEVRRLLGIPDTYVQ

SEQ ID NO: 719180 - protein, 23 aa, Mycobacterium
REAFARGDFAAMFDAVTDDMIDV

SEQ ID NO: 719181 - protein, 20 aa, Mycobacterium
REAFGQFLAGFHIVDEHFRT

SEQ ID NO: 719182 - protein, 23 aa, Mycobacterium
REAFICGPGPFMAAAEEALTASG

SEQ ID NO: 719183 - protein, 21 aa, Mycobacterium
REAFRLPGMDLAAVGRQLHDS

SEQ ID NO: 719184 - protein, 19 aa, Mycobacterium
REAFRLPSMDLPALAGELD

SEQ ID NO: 719185 - protein, 20 aa, Mycobacterium
REAFSKLVLDPQRGHLQFTP

SEQ ID NO: 719186 - protein, 23 aa, Mycobacterium
REAFTRSDFQAMFNAVTDDMIDV

SEQ ID NO: 719187 - protein, 18 aa, Mycobacterium
REAGALGIGVEFDPRLLA

SEQ ID NO: 719188 - protein, 22 aa, Mycobacterium
REAGAMAWRMRSICDRIAGFPG

SEQ ID NO: 719189 - protein, 27 aa, Mycobacterium
REAGAVPSFLGYHGFPASICSSVNDQV

SEQ ID NO: 719190 - protein, 19 aa, Mycobacterium
REAGKFGVRSNLVAAGPIR

SEQ ID NO: 719191 - protein, 25 aa, Mycobacterium
REAGLDWPQIQLVAGADTIRNGYPG

SEQ ID NO: 719192 - protein, 18 aa, Mycobacterium
REAGMEVCCGGILGMGET

SEQ ID NO: 719193 - protein, 17 aa, Mycobacterium
REAGRAAAVADAEARQA

SEQ ID NO: 719194 - protein, 22 aa, Mycobacterium
REAGRAVGPRGIINVASAAAFG

SEQ ID NO: 719195 - protein, 23 aa, Mycobacterium
REAIAAFGRGECFVERYLDKPRH

SEQ ID NO: 719196 - protein, 23 aa, Mycobacterium
REAIFKRAWLNISRVEETPDAGS

SEQ ID NO: 719197 - protein, 32 aa, Mycobacterium
REAIPPNLTRYGPLRAGWAIIPAHANPRGLIR

SEQ ID NO: 719198 - protein, 27 aa, Mycobacterium
REAISDVPKDRWDIEEFFDPDPSTPGK

SEQ ID NO: 719199 - protein, 21 aa, Mycobacterium
REAIWTRIWQIAGRAEDIPKP

SEQ ID NO: 719200 - protein, 22 aa, Mycobacterium
REAKARLTDPVLAWADVVSDPD

SEQ ID NO: 719201 - protein, 22 aa, Mycobacterium
REAKKICLGCEVRHECLEYALE

SEQ ID NO: 719202 - protein, 18 aa, Mycobacterium
REALDGFEAPTLVAPPGK

SEQ ID NO: 719203 - protein, 23 aa, Mycobacterium
REALHPYAGLVIATKAGLLRTGP

SEQ ID NO: 719204 - protein, 17 aa, Mycobacterium
REALIKTEIFGTEADVE

SEQ ID NO: 719205 - protein, 24 aa, Mycobacterium
REALKRLSFEGLVEYDRRAVTIST

SEQ ID NO: 719206 - protein, 24 aa, Mycobacterium
REALKSALQYPALAGPVFDTLTVE

SEQ ID NO: 719207 - protein, 23 aa, Mycobacterium
REALLEWDSWTAPAKAYLNAKDE

SEQ ID NO: 719208 - protein, 20 aa, Mycobacterium
REALQRWECGQDRIALLMYN

SEQ ID NO: 719209 - protein, 17 aa, Mycobacterium
REALRALLVVNVGGPAP

SEQ ID NO: 719210 - protein, 26 aa, Mycobacterium
REALRCLKRRLSDAVYRQLLRDATTE

SEQ ID NO: 719211 - protein, 19 aa, Mycobacterium
REALRQAALVRFLAQGVAD

SEQ ID NO: 719212 - protein, 20 aa, Mycobacterium
REALRQAALVRFLAQGVEDT

SEQ ID NO: 719213 - protein, 18 aa, Mycobacterium
REALRRIGNPLGVGHMGE

SEQ ID NO: 719214 - protein, 23 aa, Mycobacterium
REAMLRQAPILALGGRPEELTET

SEQ ID NO: 719215 - protein, 18 aa, Mycobacterium
REAMSLGSSVVAPVAAAA

SEQ ID NO: 719216 - protein, 20 aa, Mycobacterium
REANIRWGFDPEHRAPYGVD

SEQ ID NO: 719217 - protein, 21 aa, Mycobacterium
REAPGLPLVRAAAGFGGAKPW

SEQ ID NO: 719218 - protein, 24 aa, Mycobacterium
REAPGRKGPWWDRSETKWIAEALF

SEQ ID NO: 719219 - protein, 25 aa, Mycobacterium
REAPLSFWPAIEMEGFEAGEGYWSL

SEQ ID NO: 719220 - protein, 18 aa, Mycobacterium
REAPLTGASRAWSVLPCT

SEQ ID NO: 719221 - protein, 20 aa, Mycobacterium
REAPPFFVLHGERDELVPSG

SEQ ID NO: 719222 - protein, 33 aa, Mycobacterium
REAPVWWNPQPRTVGGFADEGYWVISKHRDVRE

SEQ ID NO: 719223 - protein, 17 aa, Mycobacterium
REAQREWITLGVDQRRD

SEQ ID NO: 719224 - protein, 25 aa, Mycobacterium
REAQWASDTCYSWAVCEPTTGEMLA

SEQ ID NO: 719225 - protein, 35 aa, Mycobacterium
REARAGEVARFPANIDFAKSLGFKPEVGIWEGIDR

SEQ ID NO: 719226 - protein, 19 aa, Mycobacterium
REARAWACAHQGSVVELHS

SEQ ID NO: 719227 - protein, 17 aa, Mycobacterium
REARHLRTYPGRGELDI

SEQ ID NO: 719228 - protein, 17 aa, Mycobacterium
REARLEGAQERAAAEVR

SEQ ID NO: 719229 - protein, 23 aa, Mycobacterium
REARLRGAVIGLTLGTTKAELYR

SEQ ID NO: 719230 - protein, 21 aa, Mycobacterium
REARLWFSVWDDRAGDPSRLR

SEQ ID NO: 719231 - protein, 19 aa, Mycobacterium
REATIPAVQYIPIADVQQD

SEQ ID NO: 719232 - protein, 19 aa, Mycobacterium
REATLDIGLIGGRTRQNLA

SEQ ID NO: 719233 - protein, 19 aa, Mycobacterium
REATLPAVQYIPMGDVAQD

SEQ ID NO: 719234 - protein, 26 aa, Mycobacterium
REATRARPEIIAWLSEAEIDELLDPA

SEQ ID NO: 719235 - protein, 18 aa, Mycobacterium
REAVAAIPGVEFHTDAHG

SEQ ID NO: 719236 - protein, 28 aa, Mycobacterium
REAVALASLTPGLVVPFSRFMAIAPEDS

SEQ ID NO: 719237 - protein, 31 aa, Mycobacterium; identical to SEQ ID NO: 103039

SEQ ID NO: 719238 - protein, 30 aa, Mycobacterium
REAVGIAAYHCGDWGQALAELRAARRMGSK

SEQ ID NO: 719239 - protein, 28 aa, Mycobacterium
REAVGIAAYHCGDWSQALAEFRAARRMG

SEQ ID NO: 719240 - protein, 32 aa, Mycobacterium
REAVGIAAYQCGDWAQALAELRAARRMGSRSP

SEQ ID NO: 719241 - protein, 29 aa, Mycobacterium
REAVGIAAYRCGDWAQALAELRAARRMGS

SEQ ID NO: 719242 - protein, 25 aa, Mycobacterium
REAVGYRQLREWLTRLYRTEMDGFI

SEQ ID NO: 719243 - protein, 25 aa, Mycobacterium
REAVLRLDRHFAISVIDCGSTMDAP

SEQ ID NO: 719244 - protein, 22 aa, Mycobacterium
REAWRPVIGYEGWYEVSDQGRV

SEQ ID NO: 719245 - protein, 19 aa, Mycobacterium
REAYRRCRRINAAHGRTFF

SEQ ID NO: 719246 - protein, 18 aa, Mycobacterium
REAYRVSITDLEWMTPQT

SEQ ID NO: 719247 - protein, 23 aa, Mycobacterium
RECDAICQVVRVFADDDVTHVAG

SEQ ID NO: 719248 - protein, 19 aa, Mycobacterium
RECDAICQVVRVFHDDDVT

SEQ ID NO: 719249 - protein, 20 aa, Mycobacterium
RECDAICQVVRVFNDDDVVH

SEQ ID NO: 719250 - protein, 21 aa, Mycobacterium
RECDAICQVVRVFSDDDVTHV

SEQ ID NO: 719251 - protein, 17 aa, Mycobacterium
RECGAGLHHICMEAESP

SEQ ID NO: 719252 - protein, 24 aa, Mycobacterium
RECGLELAERGGIFTDLGCQTSDL

SEQ ID NO: 719253 - protein, 22 aa, Mycobacterium
RECIGVARCPYGSECFSERARS

SEQ ID NO: 719254 - protein, 18 aa, Mycobacterium
RECVDAFVASWHARGFSP

SEQ ID NO: 719255 - protein, 18 aa, Mycobacterium
REDALLCGDFYDVVQTPD

SEQ ID NO: 719256 - protein, 18 aa, Mycobacterium
REDARILYHAALAHASNH

SEQ ID NO: 719257 - protein, 25 aa, Mycobacterium
REDDIPWVRVRASAPIATQVDGDFL

SEQ ID NO: 719258 - protein, 25 aa, Mycobacterium
REDEIKRYLDLEGVALHALGDAGVD

SEQ ID NO: 719259 - protein, 26 aa, Mycobacterium
REDERGRALGKGGLWERVQPENRTPI

SEQ ID NO: 719260 - protein, 22 aa, Mycobacterium
REDEVRVAASLPVSVTDDVDAV

SEQ ID NO: 719261 - protein, 19 aa, Mycobacterium
REDFRLLAAEHRVVPVTRK

SEQ ID NO: 719262 - protein, 17 aa, Mycobacterium
REDFYKFALELNVGGAR

SEQ ID NO: 719263 - protein, 25 aa, Mycobacterium
REDGCPPGSIGKGFPGVAIYDPDTL

SEQ ID NO: 719264 - protein, 18 aa, Mycobacterium
REDHGFFGPDSPTWKVWT

SEQ ID NO: 719265 - protein, 20 aa, Mycobacterium
REDIDVFGFQSQLRAKRAWD

SEQ ID NO: 719266 - protein, 25 aa, Mycobacterium
REDKPFWWSHFDRLNYPIDEWSDST

SEQ ID NO: 719267 - protein, 20 aa, Mycobacterium
REDLDLFRRLSFDLISIPTD

SEQ ID NO: 719268 - protein, 26 aa, Mycobacterium
REDLGLSYPALRAIRADVILCTAQAY

SEQ ID NO: 719269 - protein, 17 aa, Mycobacterium
REDLPRVTVPALVIHGD

SEQ ID NO: 719270 - protein, 25 aa, Mycobacterium
REDLPSAIYHRFARVHSYAAVHRSM

SEQ ID NO: 719271 - protein, 24 aa, Mycobacterium
REDLPSAIYHRFARVHTYAPARRS

SEQ ID NO: 719272 - protein, 18 aa, Mycobacterium
REDLQIVRSYKLRGAYNL

SEQ ID NO: 719273 - protein, 18 aa, Mycobacterium
REDLSVWVVTGDGDALSI

SEQ ID NO: 719274 - protein, 17 aa, Mycobacterium
REDQDHWGVRSQNRAEE

SEQ ID NO: 719275 - protein, 18 aa, Mycobacterium
REDQDHWGVRSQNRAEEA

SEQ ID NO: 719276 - protein, 18 aa, Mycobacterium
REDQDHWGVRSQNRAEKA

SEQ ID NO: 719277 - protein, 18 aa, Mycobacterium
REDRAWRAFQHAHHQLDV

SEQ ID NO: 719278 - protein, 18 aa, Mycobacterium
REDRAWRAFQHAHHQLEV

SEQ ID NO: 719279 - protein, 22 aa, Mycobacterium
REDRFSFGLWTIGWNGNDPFGV

SEQ ID NO: 719280 - protein, 24 aa, Mycobacterium
REDRGFFCFPEVDIHIPFTPGMAA

SEQ ID NO: 719281 - protein, 17 aa, Mycobacterium
REDRPGYKRLVAYVTGT

SEQ ID NO: 719282 - protein, 20 aa, Mycobacterium
REDSEFAILGRQVAIGGQLL

SEQ ID NO: 719283 - protein, 20 aa, Mycobacterium
REDSEFAVLGRQVAVGGQLL

SEQ ID NO: 719284 - protein, 21 aa, Mycobacterium
REDTVIFPALRDVMPAGEFRD

SEQ ID NO: 719285 - protein, 24 aa, Mycobacterium
REDVEAWVAGYFDYLDRNGAFVIR

SEQ ID NO: 719286 - protein, 24 aa, Mycobacterium
REDVETRFGWPVFEISTVAREGLR

SEQ ID NO: 719287 - protein, 18 aa, Mycobacterium
REDVKRIPLFGLGCVAGA

SEQ ID NO: 719288 - protein, 20 aa, Mycobacterium
REDVLGGRGSRIGRPIPDLE

SEQ ID NO: 719289 - protein, 23 aa, Mycobacterium
REDWLRRLLDAQAFIRAEGPDYV

SEQ ID NO: 719290 - protein, 25 aa, Mycobacterium
REDWPEVIRFLLGHVLVRQRERNAT

SEQ ID NO: 719291 - protein, 18 aa, Mycobacterium
REDWRLFSQWAEDVVRVF

SEQ ID NO: 719292 - protein, 18 aa, Mycobacterium
REDYWLARIAAGAADTTL

SEQ ID NO: 719293 - protein, 20 aa, Mycobacterium
REEAARLAAAAKREYEASTG

SEQ ID NO: 719294 - protein, 21 aa, Mycobacterium
REEAARLGLAVADKADSHDIC

SEQ ID NO: 719295 - protein, 26 aa, Mycobacterium
REEADWPLARTHWRPLYLGGAATLAP

SEQ ID NO: 719296 - protein, 28 aa, Mycobacterium
REEAEWPLARTRWRPMYLAAAGMLTAER

SEQ ID NO: 719297 - protein, 21 aa, Mycobacterium
REEAIRIAAAAKREYEASMSR

SEQ ID NO: 719298 - protein, 17 aa, Mycobacterium
REECGVFGVWAPGEEVA

SEQ ID NO: 719299 - protein, 17 aa, Mycobacterium
REECGVFGVWAPGEEVS

SEQ ID NO: 719300 - protein, 21 aa, Mycobacterium
REEFDLIGAPWEKRGARADDA

SEQ ID NO: 719301 - protein, 20 aa, Mycobacterium
REEFDLLGAPFDDRGARADD

SEQ ID NO: 719302 - protein, 23 aa, Mycobacterium
REEFEALGVPFARRGARTAEYVE

SEQ ID NO: 719303 - protein, 18 aa, Mycobacterium
REEFGGRRSFILVPGIDV

SEQ ID NO: 719304 - protein, 30 aa, Mycobacterium
REEFTEPHIVRWEIADGFAHSADLPGVRLP

SEQ ID NO: 719305 - protein, 20 aa, Mycobacterium
REEIDRCIAHGLEAAPTIND

SEQ ID NO: 719306 - protein, 20 aa, Mycobacterium
REEIDRCISHGLEAAPTIND

SEQ ID NO: 719307 - protein, 22 aa, Mycobacterium
REEIIRMVDLMIQRVGNQLKSK

SEQ ID NO: 719308 - protein, 18 aa, Mycobacterium
REELALLAGVSVDYYTRL

SEQ ID NO: 719309 - protein, 22 aa, Mycobacterium
REELDAYVVRRLNLAFRDVDWT

SEQ ID NO: 719310 - protein, 17 aa, Mycobacterium
REELDAYVVRRLNLPFR

SEQ ID NO: 719311 - protein, 22 aa, Mycobacterium
REELDAYVVRRLNLPFRDVDWT

SEQ ID NO: 719312 - protein, 22 aa, Mycobacterium
REELDRLTLPFSEDAAPSDAEL

SEQ ID NO: 719313 - protein, 17 aa, Mycobacterium
REELGDLLLQVLFHARI

SEQ ID NO: 719314 - protein, 23 aa, Mycobacterium
REELGDLLLQVLFHARIAEDAAL

SEQ ID NO: 719315 - protein, 23 aa, Mycobacterium
REELINWLLSRGISVDQIGQAIT

SEQ ID NO: 719316 - protein, 21 aa, Mycobacterium
REELPVQLVVRSVGYRGVAIP

SEQ ID NO: 719317 - protein, 22 aa, Mycobacterium
REELRIAIVTWIERTYHRRRRQ

SEQ ID NO: 719318 - protein, 26 aa, Mycobacterium
REELRRFIRRWLGGALLAQPRATAAP

SEQ ID NO: 719319 - protein, 26 aa, Mycobacterium
REELRRFLRRWLGSAILAQASPSRIS

SEQ ID NO: 719320 - protein, 24 aa, Mycobacterium
REELSRAPVGVGWLTIDDDDNNVV

SEQ ID NO: 719321 - protein, 28 aa, Mycobacterium
REELTDLLWRMGIRTIGQFAALSRTDIA

SEQ ID NO: 719322 - protein, 21 aa, Mycobacterium
REELVRAGVAVAWLTIDDDDN

SEQ ID NO: 719323 - protein, 22 aa, Mycobacterium
REEMCALVPPALLHTTMLVDHP

SEQ ID NO: 719324 - protein, 18 aa, Mycobacterium
REEMDAWAARSHQRAIAA

SEQ ID NO: 719325 - protein, 19 aa, Mycobacterium
REEMDAWAARSHQRAIAAM

SEQ ID NO: 719326 - protein, 20 aa, Mycobacterium
REEMDAWALRSHRNAIAAID

SEQ ID NO: 719327 - protein, 23 aa, Mycobacterium
REERFEAAFGHLRRAVELDDTLP

SEQ ID NO: 719328 - protein, 29 aa, Mycobacterium
REEVEPLEVLFPGCEFLPLSDERRRIVDP

SEQ ID NO: 719329 - protein, 24 aa, Mycobacterium
REEVKGAAVGLPLEPVADDSAYEY

SEQ ID NO: 719330 - protein, 18 aa, Mycobacterium
REEWARRITEAELLTAMT

SEQ ID NO: 719331 - protein, 24 aa, Mycobacterium
REEWPTRLRKLVAEQVGLVLRRSI

SEQ ID NO: 719332 - protein, 21 aa, Mycobacterium
REEWTRFARHWEDLAPDPYAA

SEQ ID NO: 719333 - protein, 20 aa, Mycobacterium
REFAEKVAEPFGIDFRLTEA

SEQ ID NO: 719334 - protein, 24 aa, Mycobacterium
REFAESRLRYSRICEPVLTQQLGV

SEQ ID NO: 719335 - protein, 17 aa, Mycobacterium
REFARSHGVSKFYDVGR

SEQ ID NO: 719336 - protein, 24 aa, Mycobacterium
REFDASDVAAAWPVPGPADDKYTQ

SEQ ID NO: 719337 - protein, 18 aa, Mycobacterium
REFDLLAVLAENAGVVLS

SEQ ID NO: 719338 - protein, 26 aa, Mycobacterium
REFDRIKLGPSLWHRDFHDAVIVECP

SEQ ID NO: 719339 - protein, 26 aa, Mycobacterium
REFDRIKLGPTLWHRDFHDAVIVECP

SEQ ID NO: 719340 - protein, 21 aa, Mycobacterium
REFDTLLVMSVEPGFGGQKFI

SEQ ID NO: 719341 - protein, 18 aa, Mycobacterium
REFELGRVWSQCHSLAFD

SEQ ID NO: 719342 - protein, 19 aa, Mycobacterium
REFFESVEVLPDWVDLALL

SEQ ID NO: 719343 - protein, 17 aa, Mycobacterium
REFGDAGLRHVVLAPVS

SEQ ID NO: 719344 - protein, 17 aa, Mycobacterium
REFGRLDIVLANAGIIR

SEQ ID NO: 719345 - protein, 20 aa, Mycobacterium
REFGVRVSVVEPGFTKTSFG

SEQ ID NO: 719346 - protein, 32 aa, Mycobacterium
REFIRCRQIEALLCWDRYGGDLLNVVYAAWVA

SEQ ID NO: 719347 - protein, 17 aa, Mycobacterium
REFKTGAARMALDAQVP

SEQ ID NO: 719348 - protein, 19 aa, Mycobacterium
REFLDFAARHRIEVTTEQY

SEQ ID NO: 719349 - protein, 17 aa, Mycobacterium
REFLMKDSYSFDVDDDG

SEQ ID NO: 719350 - protein, 21 aa, Mycobacterium
REFLPTPKLREVLSAATVFVC

SEQ ID NO: 719351 - protein, 20 aa, Mycobacterium
REFNGWTVWEIAAPRRSGEY

SEQ ID NO: 719352 - protein, 20 aa, Mycobacterium
REFQIVFSSLFPGGEGRLRL

SEQ ID NO: 719353 - protein, 23 aa, Mycobacterium
REFRFDQRFRALTGLSRKQLMRQ

SEQ ID NO: 719354 - protein, 21 aa, Mycobacterium
REFSEDCLYLNVWTGPRGEQP

SEQ ID NO: 719355 - protein, 17 aa, Mycobacterium
REFTPRDVELLVVIGRL

SEQ ID NO: 719356 - protein, 18 aa, Mycobacterium
REFTVFNPAGSVGVTCNG

SEQ ID NO: 719357 - protein, 18 aa, Mycobacterium
REFYAHFNFEPSPTDPLH

SEQ ID NO: 719358 - protein, 23 aa, Mycobacterium
REGADYPLAAAILKMTEPPESGA

SEQ ID NO: 719359 - protein, 26 aa, Mycobacterium
REGAEAEWLFPPKTMEAFVKKFGEDL

SEQ ID NO: 719360 - protein, 24 aa, Mycobacterium
REGAKLFHAKGWRVAAVDRDGAGL

SEQ ID NO: 719361 - protein, 18 aa, Mycobacterium
REGCSRFVVTDVTKDGTL

SEQ ID NO: 719362 - protein, 34 aa, Mycobacterium
REGDESRPAWPMIVFRTPKGWTGPDYIDGKKTTG

SEQ ID NO: 719363 - protein, 17 aa, Mycobacterium
REGDTWELLGNARWLPF

SEQ ID NO: 719364 - protein, 31 aa, Mycobacterium
REGDTWKLLVNARWLPYVIAHGLLDELVPFP

SEQ ID NO: 719365 - protein, 25 aa, Mycobacterium
REGEKLGQPGLCWDEREQQHVDAAC

SEQ ID NO: 719366 - protein, 21 aa, Mycobacterium
REGEPCRRCGAIMRREKFMNR

SEQ ID NO: 719367 - protein, 24 aa, Mycobacterium
REGEPCRRCGRAMRREAFMNRSSY

SEQ ID NO: 719368 - protein, 17 aa, Mycobacterium
REGESLDERLAAEEPDV

SEQ ID NO: 719369 - protein, 17 aa, Mycobacterium
REGEVPGALVIERNVLE

SEQ ID NO: 719370 - protein, 24 aa, Mycobacterium
REGFDVAEPTAWLAEGLLMYLPTE

SEQ ID NO: 719371 - protein, 20 aa, Mycobacterium
REGFECGMTLGYSDLKEGDF

SEQ ID NO: 719372 - protein, 18 aa, Mycobacterium
REGFKRIHDRGGFLAGAA

SEQ ID NO: 719373 - protein, 23 aa, Mycobacterium
REGFRACKRCRPDASPGSPEWNV

SEQ ID NO: 719374 - protein, 25 aa, Mycobacterium
REGHARWRTALVDSLQEAFFVCDEH

SEQ ID NO: 719375 - protein, 23 aa, Mycobacterium
REGHCGSCVTTVTSGEVSMDTCD

SEQ ID NO: 719376 - protein, 20 aa, Mycobacterium
REGHDFAALTAEVVDATLAT

SEQ ID NO: 719377 - protein, 21 aa, Mycobacterium
REGHEKYTLAAILKEEMRVLD

SEQ ID NO: 719378 - protein, 20 aa, Mycobacterium
REGHEKYTLTAILNEEMRVL

SEQ ID NO: 719379 - protein, 24 aa, Mycobacterium
REGHHGVTMITGWDEACAVLNDAE

SEQ ID NO: 719380 - protein, 19 aa, Mycobacterium
REGHPFLWSLSDPRPDGLV

SEQ ID NO: 719381 - protein, 25 aa, Mycobacterium
REGHYGVTMVTGWDEAVAVLNDAET

SEQ ID NO: 719382 - protein, 25 aa, Mycobacterium
REGIACAVLRRPDHRDTYDAMFDLW

SEQ ID NO: 719383 - protein, 20 aa, Mycobacterium
REGICAVVIAPAPQLPEELA

SEQ ID NO: 719384 - protein, 26 aa, Mycobacterium
REGIELRRFITRWLGPAILYPRMMSL

SEQ ID NO: 719385 - protein, 17 aa, Mycobacterium
REGLAILDSALDVADEH

SEQ ID NO: 719386 - protein, 19 aa, Mycobacterium
REGLIRALISYRQASLGID

SEQ ID NO: 719387 - protein, 23 aa, Mycobacterium
REGLRHIADGPVFIAGGNAERAA

SEQ ID NO: 719388 - protein, 19 aa, Mycobacterium
REGLTMARPFTAPRTVFNA

SEQ ID NO: 719389 - protein, 19 aa, Mycobacterium
REGMDIPLLIGGATTSRAH

SEQ ID NO: 719390 - protein, 24 aa, Mycobacterium
REGPAEAPASFGAIQAKKVLAVRA

SEQ ID NO: 719391 - protein, 17 aa, Mycobacterium
REGPRYAMEEMTELKFI

SEQ ID NO: 719392 - protein, 24 aa, Mycobacterium
REGQGCRRCGAVMRREKFMNRSSF

SEQ ID NO: 719393 - protein, 25 aa, Mycobacterium
REGQKLRIVKYLAYGWSSMRSRPAL

SEQ ID NO: 719394 - protein, 19 aa, Mycobacterium
REGQTLFTYLHLAASKPCT

SEQ ID NO: 719395 - protein, 21 aa, Mycobacterium
REGQWGAPLLFYLDAGIPPLS

SEQ ID NO: 719396 - protein, 22 aa, Mycobacterium
REGRAIEVIGRYHPKEEPSLIE

SEQ ID NO: 719397 - protein, 25 aa, Mycobacterium
REGRALDDFATWCALAEKYGGDWHR

SEQ ID NO: 719398 - protein, 25 aa, Mycobacterium
REGRALDDFATWCALAEQYGDDWHR

SEQ ID NO: 719399 - protein, 17 aa, Mycobacterium
REGRLHPGATILEPTSG

SEQ ID NO: 719400 - protein, 25 aa, Mycobacterium
REGRSLDDFATWCALAERYGSDWHT

SEQ ID NO: 719401 - protein, 21 aa, Mycobacterium
REGRWWAVEIPELNGVTQAAR

SEQ ID NO: 719402 - protein, 20 aa, Mycobacterium
REGSPEWTCMPTPPDTPWPA

SEQ ID NO: 719403 - protein, 19 aa, Mycobacterium
REGSQFGPYRLRRLVGRGG

SEQ ID NO: 719404 - protein, 21 aa, Mycobacterium
REGTCVVCGEPDPTYEFAATQ

SEQ ID NO: 719405 - protein, 17 aa, Mycobacterium
REGVCQDFARLAIACLR

SEQ ID NO: 719406 - protein, 22 aa, Mycobacterium
REGVLRLRIPVAERAKPRKITV

SEQ ID NO: 719407 - protein, 33 aa, Mycobacterium
REGVNLTFLPFFARAVIDALKIHPNINASYNEQ

SEQ ID NO: 719408 - protein, 22 aa, Mycobacterium
REGVNLTFLPFIARAVIDALKI

SEQ ID NO: 719409 - protein, 29 aa, Mycobacterium
REGVNLTFLPFIARAVIDALKIHPNVNAS

SEQ ID NO: 719410 - protein, 22 aa, Mycobacterium
REGVNLTYLPFIARAVIDALKL

SEQ ID NO: 719411 - protein, 21 aa, Mycobacterium
REGVSVFGFHLCGLDMRQNSD

SEQ ID NO: 719412 - protein, 20 aa, Mycobacterium
REGWAARVRLAHALGPTMIA

SEQ ID NO: 719413 - protein, 22 aa, Mycobacterium
REGYDVWEPGAFTGTFRGNAMA

SEQ ID NO: 719414 - protein, 18 aa, Mycobacterium
REGYLQIALLIEKGTDAA

SEQ ID NO: 719415 - protein, 21 aa, Mycobacterium
REGYQQVLREERRLKSLRADQ

SEQ ID NO: 719416 - protein, 20 aa, Mycobacterium
REHAKRLIAGYKCPRSIEFV

SEQ ID NO: 719417 - protein, 27 aa, Mycobacterium
REHDILAFERQWWKFAGAKEEAIKELF

SEQ ID NO: 719418 - protein, 27 aa, Mycobacterium
REHDILAFERQWWKFAGVKEEAIKELF

SEQ ID NO: 719419 - protein, 24 aa, Mycobacterium
REHDRRLALEYGGDVLWLACTHGD

SEQ ID NO: 719420 - protein, 20 aa, Mycobacterium
REHELRFILEDAGSRMIFAP

SEQ ID NO: 719421 - protein, 23 aa, Mycobacterium
REHFRQALQFVLWEMASYRTEGL

SEQ ID NO: 719422 - protein, 20 aa, Mycobacterium
REHGARLLVRLAGVNDRDTA

SEQ ID NO: 719423 - protein, 19 aa, Mycobacterium
REHGFACLFISHDLAVVEL

SEQ ID NO: 719424 - protein, 28 aa, Mycobacterium
REHILTCARELFALNGLDRTSVRSVAAA

SEQ ID NO: 719425 - protein, 26 aa, Mycobacterium
REHIRFGTEVEALWWDEERGQWQIHT

SEQ ID NO: 719426 - protein, 17 aa, Mycobacterium
REHLADFTPDQRAVLRQ

SEQ ID NO: 719427 - protein, 23 aa, Mycobacterium
REHLPAVALRTGRGETRKVGHRD

SEQ ID NO: 719428 - protein, 21 aa, Mycobacterium
REHLRVPVVHAYGMTEAPMIC

SEQ ID NO: 719429 - protein, 21 aa, Mycobacterium
REHLVRSGIWIPDSPAVTVRR

SEQ ID NO: 719430 - protein, 20 aa, Mycobacterium
REHPDFPAAAAGLGDRLSIH

SEQ ID NO: 719431 - protein, 19 aa, Mycobacterium
REHPHRRRGLAQDGDLLGD

SEQ ID NO: 719432 - protein, 20 aa, Mycobacterium
REHPNVVVLRTFSKAYGLAG

SEQ ID NO: 719433 - protein, 25 aa, Mycobacterium
REHPSFPRRDLSSVPMLRSGPLDIA

SEQ ID NO: 719434 - protein, 20 aa, Mycobacterium
REHRLIMQQAFLRSRLAGYV

SEQ ID NO: 719435 - protein, 20 aa, Mycobacterium
REHRLKPKFVEVAERQSSQH

SEQ ID NO: 719436 - protein, 26 aa, Mycobacterium
REHTWKRSSFSGAEIFGKTVGVVGLG

SEQ ID NO: 719437 - protein, 24 aa, Mycobacterium
REHVFKKTWLYVGRVERVPKSGSY

SEQ ID NO: 719438 - protein, 18 aa, Mycobacterium
REHWPRARHSNFIERTFG

SEQ ID NO: 719439 - protein, 18 aa, Mycobacterium
REIAANNAFGVWQTKIGL

SEQ ID NO: 719440 - protein, 22 aa, Mycobacterium
REIADRLAYVVRLILTGAKDTS

SEQ ID NO: 719441 - protein, 22 aa, Mycobacterium
REIADRLAYVVRLILTGAKETS

SEQ ID NO: 719442 - protein, 22 aa, Mycobacterium
REIAEKGHLPAEVLDAAAVTIQ

SEQ ID NO: 719443 - protein, 21 aa, Mycobacterium
REIALDLKLGHGVEGHTVTRA

SEQ ID NO: 719444 - protein, 29 aa, Mycobacterium
REIAMNFTMDGPWGQWVNRWTAEEARHST

SEQ ID NO: 719445 - protein, 18 aa, Mycobacterium
REIAPTFGATHAAADIGA

SEQ ID NO: 719446 - protein, 21 aa, Mycobacterium
REIASELVALYAKRQSAPGHA

SEQ ID NO: 719447 - protein, 25 aa, Mycobacterium
REICARFIREPGYRFVELTDPKRST

SEQ ID NO: 719448 - protein, 21 aa, Mycobacterium
REICDRHGIVFIADEVMAGFG

SEQ ID NO: 719449 - protein, 20 aa, Mycobacterium
REICGVDGLTGIYVGPADLA

SEQ ID NO: 719450 - protein, 17 aa, Mycobacterium
REICTQRNVLMIADEIQ

SEQ ID NO: 719451 - protein, 20 aa, Mycobacterium
REIDADITLAAFGNTRSYGG

SEQ ID NO: 719452 - protein, 19 aa, Mycobacterium
REIECQRMALAPHLIGPQF

SEQ ID NO: 719453 - protein, 19 aa, Mycobacterium
REIEGAWKPDQYANPEGPA

SEQ ID NO: 719454 - protein, 19 aa, Mycobacterium
REIGARRGLIISGGAATGK

SEQ ID NO: 719455 - protein, 21 aa, Mycobacterium
REIGKAVGMLMLLHDITEEQA

SEQ ID NO: 719456 - protein, 21 aa, Mycobacterium
REIGKAVGMLMLLHDMSEDDA

SEQ ID NO: 719457 - protein, 21 aa, Mycobacterium
REIGKAVGMLMLLHDMTEDHA

SEQ ID NO: 719458 - protein, 23 aa, Mycobacterium
REIGKAVGMLMLLNGFTEEEAFD

SEQ ID NO: 719459 - protein, 21 aa, Mycobacterium
REIGLLLPCNVAVRRDPENAD

SEQ ID NO: 719460 - protein, 25 aa, Mycobacterium
REIHRAGESPHRIAPNPAEVSDGAA

SEQ ID NO: 719461 - protein, 21 aa, Mycobacterium
REIILEIGRRELIGGQEDMII

SEQ ID NO: 719462 - protein, 25 aa, Mycobacterium
REIITRLTHRGALHLPEAQLKQLEA

SEQ ID NO: 719463 - protein, 17 aa, Mycobacterium
REIIYRMGVKPPEPKGI

SEQ ID NO: 719464 - protein, 17 aa, Mycobacterium
REIIYRMGVTPPQPKQI

SEQ ID NO: 719465 - protein, 22 aa, Mycobacterium
REIKLGTGGLRDVEFAVQLLQL

SEQ ID NO: 719466 - protein, 23 aa, Mycobacterium
REIKLGTGGLRDVEFAVQLLQLV

SEQ ID NO: 719467 - protein, 26 aa, Mycobacterium
REILDEWRTITGLERKADDALWKRYS

SEQ ID NO: 719468 - protein, 23 aa, Mycobacterium
REILDYLRLAIAHVQRETDPRLE

SEQ ID NO: 719469 - protein, 22 aa, Mycobacterium
REILEPTLPLSRLVFSTPTQYY

SEQ ID NO: 719470 - protein, 20 aa, Mycobacterium
REILETEYLKRPLIDGPAPV

SEQ ID NO: 719471 - protein, 20 aa, Mycobacterium
REILRRVELDTTAAPAERQR

SEQ ID NO: 719472 - protein, 26 aa, Mycobacterium
REILRRYADELIFPAIEVYTEGLMTD

SEQ ID NO: 719473 - protein, 20 aa, Mycobacterium
REILSRPAAFLSVSQSNSLY

SEQ ID NO: 719474 - protein, 22 aa, Mycobacterium
REIPANRPGRAVSMEKHHLMIG

SEQ ID NO: 719475 - protein, 19 aa, Mycobacterium
REIPILIGGQGERKTLPLV

SEQ ID NO: 719476 - protein, 18 aa, Mycobacterium
REIPPCMAQGQAVGIAAA

SEQ ID NO: 719477 - protein, 21 aa, Mycobacterium
REIPRTDELWYFEEREDVGDW

SEQ ID NO: 719478 - protein, 28 aa, Mycobacterium
REIPVAAFGAVEIWPIVHFQAPTQPIGN

SEQ ID NO: 719479 - protein, 23 aa, Mycobacterium
REIQARGAVTIVIAEEGDETVRP

SEQ ID NO: 719480 - protein, 20 aa, Mycobacterium
REIQARGAVTVVIAEEDDDT

SEQ ID NO: 719481 - protein, 22 aa, Mycobacterium
REIQARIRAGATVQQVATAAGV

SEQ ID NO: 719482 - protein, 17 aa, Mycobacterium
REIRGEHIAMVFQDPMT

SEQ ID NO: 719483 - protein, 25 aa, Mycobacterium
REIRPAHPALHRWFEDRARVDPDAE

SEQ ID NO: 719484 - protein, 22 aa, Mycobacterium
REIRSAVAVALTSRFPIVLWVG

SEQ ID NO: 719485 - protein, 20 aa, Mycobacterium
REITARHGALLVLDEVQTGI

SEQ ID NO: 719486 - protein, 17 aa, Mycobacterium
REITGMGTLYSYTVARR

SEQ ID NO: 719487 - protein, 17 aa, Mycobacterium
REITKLRDEGHLNTEEY

SEQ ID NO: 719488 - protein, 20 aa, Mycobacterium
REITSAISRAHRVRVADVVL

SEQ ID NO: 719489 - protein, 26 aa, Mycobacterium
REIVGISVELMAAWSSRRLAIEARTA

SEQ ID NO: 719490 - protein, 18 aa, Mycobacterium
REIVLDFCDFLSGKTDRL

SEQ ID NO: 719491 - protein, 24 aa, Mycobacterium
REIVPFAATGARWRAGDDLEAFIA

SEQ ID NO: 719492 - protein, 25 aa, Mycobacterium
REKFAPEMVTAFARMAGRPVGILAN

SEQ ID NO: 719493 - protein, 19 aa, Mycobacterium
REKICSDAVAFARHIGYSC

SEQ ID NO: 719494 - protein, 20 aa, Mycobacterium
REKLCWRNAAQLYGIDIPAG

SEQ ID NO: 719495 - protein, 21 aa, Mycobacterium
REKRLLAPRFVMPTNGTFTSG

SEQ ID NO: 719496 - protein, 19 aa, Mycobacterium
REKRRVHATALLPGDADYE

SEQ ID NO: 719497 - protein, 18 aa, Mycobacterium
RELAAAAGIRSIPTIMAF

SEQ ID NO: 719498 - protein, 21 aa, Mycobacterium
RELAAAGLRQTHWWTDDADDF

SEQ ID NO: 719499 - protein, 26 aa, Mycobacterium
RELAAMAAARGWPVLRVENPGKGNHG

SEQ ID NO: 719500 - protein, 19 aa, Mycobacterium
RELAAPLWALVHGVASLAI

SEQ ID NO: 719501 - protein, 22 aa, Mycobacterium
RELADPISYISLWLADAGETPQ

SEQ ID NO: 719502 - protein, 17 aa, Mycobacterium
RELAEAAGVLNADGVAD

SEQ ID NO: 719503 - protein, 21 aa, Mycobacterium
RELAEAGHLVRLWTLPDGPDG

SEQ ID NO: 719504 - protein, 19 aa, Mycobacterium
RELAEALVVLTRRLAPPRR

SEQ ID NO: 719505 - protein, 28 aa, Mycobacterium
RELAEFKALFQMKFYAVALLRSREVMPS

SEQ ID NO: 719506 - protein, 17 aa, Mycobacterium
RELAEFVYDEIAERGWP

SEQ ID NO: 719507 - protein, 20 aa, Mycobacterium
RELAEICGHVAGLALDRDRP

SEQ ID NO: 719508 - protein, 19 aa, Mycobacterium
RELAERLWPIDAIAERHRR

SEQ ID NO: 719509 - protein, 19 aa, Mycobacterium
RELAETLAALDVTMLIVTH

SEQ ID NO: 719510 - protein, 19 aa, Mycobacterium
RELAETWHIKRYGFHGTSH

SEQ ID NO: 719511 - protein, 17 aa, Mycobacterium
RELAGLGIWTLGTAETA

SEQ ID NO: 719512 - protein, 21 aa, Mycobacterium
RELAGLVPPGAKIAVDELTGA

SEQ ID NO: 719513 - protein, 21 aa, Mycobacterium
RELAHRCPVAVLSGRDLADVT

SEQ ID NO: 719514 - protein, 26 aa, Mycobacterium
RELALCQLVGPLAFARMTGIRTITHN

SEQ ID NO: 719515 - protein, 18 aa, Mycobacterium
RELALKRLFVLTFETEFF

SEQ ID NO: 719516 - protein, 18 aa, Mycobacterium
RELALPVTGVFEVVDGQI

SEQ ID NO: 719517 - protein, 38 aa, Mycobacterium
RELALQVAEAFSRYGAHLSRLNVLPVYGGSSYAIQLAG

SEQ ID NO: 719518 - protein, 20 aa, Mycobacterium
RELAPRLKAAIAASTELQER

SEQ ID NO: 719519 - protein, 21 aa, Mycobacterium
RELAPRVAFHAWVQHRCEEQL

SEQ ID NO: 719520 - protein, 17 aa, Mycobacterium
RELAQQGTFGFATHALS

SEQ ID NO: 719521 - protein, 25 aa, Mycobacterium
RELARVAPVLARRQGWDYLRELGRL

SEQ ID NO: 719522 - protein, 21 aa, Mycobacterium
RELARVGAKVIVAVRNLDKGT

SEQ ID NO: 719523 - protein, 17 aa, Mycobacterium
RELATYFVGQVVGSLDR

SEQ ID NO: 719524 - protein, 22 aa, Mycobacterium
RELAVASYLRDHVCPQLIGRDA

SEQ ID NO: 719525 - protein, 18 aa, Mycobacterium
RELCARFRVAPIEFDGQR

SEQ ID NO: 719526 - protein, 20 aa, Mycobacterium
RELDCCARRPYDLTLLTKPD

SEQ ID NO: 719527 - protein, 21 aa, Mycobacterium
RELDFEFPLAGGDAVSAGPEI

SEQ ID NO: 719528 - protein, 25 aa, Mycobacterium
RELDGYRVPNEFPIHTETMRANPQY

SEQ ID NO: 719529 - protein, 27 aa, Mycobacterium
RELDLGWIIFLHRFFQDLAEVATLPGL

SEQ ID NO: 719530 - protein, 17 aa, Mycobacterium
RELDLWLHRASVALVAV

SEQ ID NO: 719531 - protein, 25 aa, Mycobacterium
RELDPLVGAGGFDFIADLGAMMPMR

SEQ ID NO: 719532 - protein, 25 aa, Mycobacterium
RELDPLVGSGGFDFIADLGAMMPMR

SEQ ID NO: 719533 - protein, 25 aa, Mycobacterium
RELDRAWDRFGLELPQLTVPTLAVH

SEQ ID NO: 719534 - protein, 18 aa, Mycobacterium
RELDRGWDRFGSDLPALS

SEQ ID NO: 719535 - protein, 22 aa, Mycobacterium
RELDVMPGRDWMDPGNLDDDAV

SEQ ID NO: 719536 - protein, 17 aa, Mycobacterium
RELDYLLANGVRAALIK

SEQ ID NO: 719537 - protein, 17 aa, Mycobacterium
RELEAFAAFASDLDAAS

SEQ ID NO: 719538 - protein, 24 aa, Mycobacterium
RELEREIYEAATIQGLSQRQISDL

SEQ ID NO: 719539 - protein, 24 aa, Mycobacterium
RELEWPAMRISHCRPPDSDRDVVL

SEQ ID NO: 719540 - protein, 20 aa, Mycobacterium
RELFAAIVVLMRWGDEHLPH

SEQ ID NO: 719541 - protein, 21 aa, Mycobacterium
RELFARKDYRATTTREIAEAA

SEQ ID NO: 719542 - protein, 25 aa, Mycobacterium
RELFCARDPFGIKPLFLATGAGGTA

SEQ ID NO: 719543 - protein, 24 aa, Mycobacterium
RELFCARDPFGIKPLFMATGAGGT

SEQ ID NO: 719544 - protein, 20 aa, Mycobacterium
RELFDPALLAHARLISAAGG

SEQ ID NO: 719545 - protein, 20 aa, Mycobacterium
RELFGMIAVNARRNAALNPS

SEQ ID NO: 719546 - protein, 19 aa, Mycobacterium
RELFQRLASLAPHAVLATN

SEQ ID NO: 719547 - protein, 19 aa, Mycobacterium
RELFTLAAAKHGLSPRDIG

SEQ ID NO: 719548 - protein, 24 aa, Mycobacterium
RELGAAFAEFGGWLMPVSYAGTVA

SEQ ID NO: 719549 - protein, 18 aa, Mycobacterium
RELGALVALTHCLVVDLD

SEQ ID NO: 719550 - protein, 24 aa, Mycobacterium
RELGASFAEFGGWLMPVSYAGTVS

SEQ ID NO: 719551 - protein, 28 aa, Mycobacterium
RELGDRVAALAAAWRSGLPGGLRPGDFV

SEQ ID NO: 719552 - protein, 23 aa, Mycobacterium
RELGEPFTTAGLCLYRDGDDSVA

SEQ ID NO: 719553 - protein, 21 aa, Mycobacterium
RELGGLYDWLARRYVADSGVP

SEQ ID NO: 719554 - protein, 18 aa, Mycobacterium
RELGIPCVMNTARGTSTL

SEQ ID NO: 719555 - protein, 25 aa, Mycobacterium
RELGMPLFHRVGRGVVLADAGKALV

SEQ ID NO: 719556 - protein, 21 aa, Mycobacterium
RELGQVIAMAVTINAWNRINA

SEQ ID NO: 719557 - protein, 19 aa, Mycobacterium
RELGRFGMEEFVNKKLIRT

SEQ ID NO: 719558 - protein, 21 aa, Mycobacterium
RELGWPPSRIHSERFGVDALD

SEQ ID NO: 719559 - protein, 25 aa, Mycobacterium
RELHCSRGTFNFLLSAHEPAPEVLG

SEQ ID NO: 719560 - protein, 22 aa, Mycobacterium
RELHEGPCITAMVTGRVSVSGS

SEQ ID NO: 719561 - protein, 24 aa, Mycobacterium
RELHSRYEVRLEQYALTIAVEAKL

SEQ ID NO: 719562 - protein, 18 aa, Mycobacterium
RELIAPKFALVAEILEDR

SEQ ID NO: 719563 - protein, 20 aa, Mycobacterium
RELIDGIGLTLFPLTSGSKG

SEQ ID NO: 719564 - protein, 20 aa, Mycobacterium
RELIDRYPLRGIKGPMGTAQ

SEQ ID NO: 719565 - protein, 21 aa, Mycobacterium
RELIIGAAYVCFREHGLQKAT

SEQ ID NO: 719566 - protein, 21 aa, Mycobacterium
RELIIGSAYVCFRRQGFQKTT

SEQ ID NO: 719567 - protein, 29 aa, Mycobacterium
RELITSPLLRCRRTLEPLADALCLAPFVE

SEQ ID NO: 719568 - protein, 21 aa, Mycobacterium
RELIVESAFTCFGKQGLDKAT

SEQ ID NO: 719569 - protein, 20 aa, Mycobacterium
RELKALAGLVLAAGFETTVN

SEQ ID NO: 719570 - protein, 21 aa, Mycobacterium
RELKATMALLLGAGFETTVNL

SEQ ID NO: 719571 - protein, 17 aa, Mycobacterium
RELKAYAEHCADKYGVR

SEQ ID NO: 719572 - protein, 23 aa, Mycobacterium
RELKLGSGGLRDVEFAAQLLQLV

SEQ ID NO: 719573 - protein, 23 aa, Mycobacterium
RELKLGTGGLRDVEFVAQLLQLV

SEQ ID NO: 719574 - protein, 25 aa, Mycobacterium
RELLAACRRHRALLVIDEAHGLGVR

SEQ ID NO: 719575 - protein, 19 aa, Mycobacterium
RELLAPVRYHHVVVAVRGE

SEQ ID NO: 719576 - protein, 20 aa, Mycobacterium
RELLATLIATNFFGQNSAAI

SEQ ID NO: 719577 - protein, 24 aa, Mycobacterium
RELLDTIAAVLARFHEHAERSPLI

SEQ ID NO: 719578 - protein, 17 aa, Mycobacterium
RELLEILFRQPLSAGEL

SEQ ID NO: 719579 - protein, 24 aa, Mycobacterium
RELLELTSRLHAHLLDRHRPLWET

SEQ ID NO: 719580 - protein, 21 aa, Mycobacterium
RELLLERGFDGLSIEAVAARA

SEQ ID NO: 719581 - protein, 21 aa, Mycobacterium
RELLLERGFDGLTIEAVAARA

SEQ ID NO: 719582 - protein, 21 aa, Mycobacterium
RELLPHSDLDLLLVHDGKPAE

SEQ ID NO: 719583 - protein, 21 aa, Mycobacterium
RELLQEFLFGLSLDDETRRRA

SEQ ID NO: 719584 - protein, 17 aa, Mycobacterium
RELLRLEHTPGFDDPTL

SEQ ID NO: 719585 - protein, 18 aa, Mycobacterium
RELLRVVLEAVGDRARVI

SEQ ID NO: 719586 - protein, 17 aa, Mycobacterium
RELLSRERITVLNQTPS

SEQ ID NO: 719587 - protein, 21 aa, Mycobacterium
RELLVPGMRGLVRVLGGPGTG

SEQ ID NO: 719588 - protein, 18 aa, Mycobacterium
RELMAFTQKAIRVIKKVS

SEQ ID NO: 719589 - protein, 17 aa, Mycobacterium
RELMTDPGLDFDTALAV

SEQ ID NO: 719590 - protein, 27 aa, Mycobacterium
RELNFGCVWVNCHIPLVAEMPHGGFKY

SEQ ID NO: 719591 - protein, 22 aa, Mycobacterium
RELNTPRWLLPHAAKTSYVGGI

SEQ ID NO: 719592 - protein, 21 aa, Mycobacterium
RELPDAEVIWHVLRPISGDDL

SEQ ID NO: 719593 - protein, 25 aa, Mycobacterium
RELPELDFADAGTWLLVSTTDVADL

SEQ ID NO: 719594 - protein, 17 aa, Mycobacterium
RELPGGALALVNDAGMR

SEQ ID NO: 719595 - protein, 17 aa, Mycobacterium
RELPHSPYLAAVAGRKP

SEQ ID NO: 719596 - protein, 17 aa, Mycobacterium
RELPKRRPVPLRLLDWK

SEQ ID NO: 719597 - protein, 19 aa, Mycobacterium
RELPLRVAVLHTADNPAEH

SEQ ID NO: 719598 - protein, 31 aa, Mycobacterium
RELPYDRALELGCGTGFFLLNLMQAGVARRG

SEQ ID NO: 719599 - protein, 21 aa, Mycobacterium
RELQALLGRPDWSPGDKAQLV

SEQ ID NO: 719600 - protein, 23 aa, Mycobacterium
RELQALLGRPGLSPADRAQLVAR

SEQ ID NO: 719601 - protein, 25 aa, Mycobacterium
RELQDLRKSTGLEVSDRIEVVLEVP

SEQ ID NO: 719602 - protein, 18 aa, Mycobacterium
RELQDWLSRKGFQDLNQV

SEQ ID NO: 719603 - protein, 25 aa, Mycobacterium
RELQELRKSSGLDVSDRISVVMSVP

SEQ ID NO: 719604 - protein, 24 aa, Mycobacterium
RELQELRKSTGLDVSDRIQVLISV

SEQ ID NO: 719605 - protein, 25 aa, Mycobacterium
RELQELRKSTGLDVSDRISVVIAVP

SEQ ID NO: 719606 - protein, 25 aa, Mycobacterium
RELQELRKSTGLDVSDRISVVMSVP

SEQ ID NO: 719607 - protein, 33 aa, Mycobacterium
RELQELRKSTGLEVSDRISVRISVPAEHEQWAR

SEQ ID NO: 719608 - protein, 26 aa, Mycobacterium
RELQELRKSTGLEVSDRISVVMSVPA

SEQ ID NO: 719609 - protein, 26 aa, Mycobacterium
RELQIAPDGSFEWRFRPTDPGQLVIR

SEQ ID NO: 719610 - protein, 29 aa, Mycobacterium
RELQIRGSEHFSRLVQPWNCTAVPVHDPS

SEQ ID NO: 719611 - protein, 18 aa, Mycobacterium
RELQPMWLRAVDTEPVRR

SEQ ID NO: 719612 - protein, 18 aa, Mycobacterium
RELQPMWQAAVAADAVQT

SEQ ID NO: 719613 - protein, 20 aa, Mycobacterium
RELQRRHGLPVDDMPIPIAP

SEQ ID NO: 719614 - protein, 17 aa, Mycobacterium
RELRAENGLSMDDFTIL

SEQ ID NO: 719615 - protein, 17 aa, Mycobacterium
RELRALVGEHVPEHFLG

SEQ ID NO: 719616 - protein, 19 aa, Mycobacterium
RELRAYFDKLLTPERREAL

SEQ ID NO: 719617 - protein, 20 aa, Mycobacterium
RELRECVGRPLVTEAEQLAA

SEQ ID NO: 719618 - protein, 17 aa, Mycobacterium
RELREEVGIELPEATVL

SEQ ID NO: 719619 - protein, 22 aa, Mycobacterium
RELRENPAWITGIEHRIESPSL

SEQ ID NO: 719620 - protein, 20 aa, Mycobacterium
RELRGVRDFVLRRHPASYRV

SEQ ID NO: 719621 - protein, 22 aa, Mycobacterium
RELRIGSLALPSPVVLAPMAGV

SEQ ID NO: 719622 - protein, 34 aa, Mycobacterium
RELRKKLTPEYGFGCKRPSVSNIYYRTFTQPHVD

SEQ ID NO: 719623 - protein, 19 aa, Mycobacterium
RELRLARPGLVDQLAEQVC

SEQ ID NO: 719624 - protein, 19 aa, Mycobacterium
RELRLDAYAARFAQAGYAA

SEQ ID NO: 719625 - protein, 17 aa, Mycobacterium
RELRMQRGMTLQEVGAI

SEQ ID NO: 719626 - protein, 26 aa, Mycobacterium
RELRQAFLRERAMLQLLDRSLSVSEI

SEQ ID NO: 719627 - protein, 24 aa, Mycobacterium
RELRRECTEMLTAGKLTPLPYTRF

SEQ ID NO: 719628 - protein, 18 aa, Mycobacterium
RELRRLKAQLRQRNRVLQ

SEQ ID NO: 719629 - protein, 23 aa, Mycobacterium
RELRRLNAILRRRDKILQSGPDI

SEQ ID NO: 719630 - protein, 20 aa, Mycobacterium
RELRSPLILVPVSLSTSNRG

SEQ ID NO: 719631 - protein, 17 aa, Mycobacterium
RELRTERGLTLEDVASR

SEQ ID NO: 719632 - protein, 17 aa, Mycobacterium
RELRYYRQTAFVAPPGP

SEQ ID NO: 719633 - protein, 19 aa, Mycobacterium
RELRYYRRAAFVPDPGPST

SEQ ID NO: 719634 - protein, 28 aa, Mycobacterium
RELSAMVARSPFGQGAAWPVVETVQREG

SEQ ID NO: 719635 - protein, 17 aa, Mycobacterium
RELSDGAAVIVTDRAGR

SEQ ID NO: 719636 - protein, 22 aa, Mycobacterium
RELSDLAALARRTGAADDPFIR

SEQ ID NO: 719637 - protein, 17 aa, Mycobacterium
RELSGFIARETRARTTA

SEQ ID NO: 719638 - protein, 17 aa, Mycobacterium
RELSGFIARNTRAKTTA

SEQ ID NO: 719639 - protein, 19 aa, Mycobacterium
RELSGGRRSFILVPGIDVP

SEQ ID NO: 719640 - protein, 17 aa, Mycobacterium
RELSGHSNLLFRRNSVT

SEQ ID NO: 719641 - protein, 22 aa, Mycobacterium
RELSLLVPPLFLQHFGSTSWVA

SEQ ID NO: 719642 - protein, 27 aa, Mycobacterium
RELSQPPARFGPISGMIETAENLATDY

SEQ ID NO: 719643 - protein, 23 aa, Mycobacterium
RELTAELALALGAAAARHLASPG

SEQ ID NO: 719644 - protein, 21 aa, Mycobacterium
RELTAELALALGAATAQHLAS

SEQ ID NO: 719645 - protein, 22 aa, Mycobacterium
RELTAELALALGSAAARRLASA

SEQ ID NO: 719646 - protein, 19 aa, Mycobacterium
RELTAFVTYDHRLLAGCLE

SEQ ID NO: 719647 - protein, 19 aa, Mycobacterium
RELTALIVEDGHDIREIYE

SEQ ID NO: 719648 - protein, 20 aa, Mycobacterium
RELTDGAGVEAVYDGVGAST

SEQ ID NO: 719649 - protein, 20 aa, Mycobacterium
RELTDLPLIVKGICHPDDAR

SEQ ID NO: 719650 - protein, 19 aa, Mycobacterium
RELTEALRIITQRMPGARR

SEQ ID NO: 719651 - protein, 19 aa, Mycobacterium
RELTGGRRSFILVPGIDVP

SEQ ID NO: 719652 - protein, 19 aa, Mycobacterium
RELTGLALQRVYLDRVAKL

SEQ ID NO: 719653 - protein, 17 aa, Mycobacterium
RELTHGVMADSVLVSPS

SEQ ID NO: 719654 - protein, 26 aa, Mycobacterium
RELTKCLRTGRALRKPRARVGARSGC

SEQ ID NO: 719655 - protein, 18 aa, Mycobacterium
RELTLRAATALGVATEAD

SEQ ID NO: 719656 - protein, 30 aa, Mycobacterium
RELTRRSGGIFGRRVCAVVGSGDNGGDALW

SEQ ID NO: 719657 - protein, 24 aa, Mycobacterium
RELTTRIYTDFTYRSGSTTVSTKV

SEQ ID NO: 719658 - protein, 17 aa, Mycobacterium
RELTVSVGDLYIDYSKH

SEQ ID NO: 719659 - protein, 20 aa, Mycobacterium
RELVAALQASGWDAGTVDSL

SEQ ID NO: 719660 - protein, 17 aa, Mycobacterium
RELVAHASLDVMRSRAA

SEQ ID NO: 719661 - protein, 18 aa, Mycobacterium
RELVARIRAMLRRPRLLQ

SEQ ID NO: 719662 - protein, 18 aa, Mycobacterium
RELVARIRAMLRRPRVLQ

SEQ ID NO: 719663 - protein, 18 aa, Mycobacterium
RELVDYGHKILLIERERS

SEQ ID NO: 719664 - protein, 20 aa, Mycobacterium
RELVGEGSLFLLKVVGESMV

SEQ ID NO: 719665 - protein, 25 aa, Mycobacterium
RELVGGECNFWGCVPSKSLLRPVLA

SEQ ID NO: 719666 - protein, 25 aa, Mycobacterium
RELVGGECTYWACVPSKALLRPVIA

SEQ ID NO: 719667 - protein, 21 aa, Mycobacterium
RELVRECFDKFVADGHADLVS

SEQ ID NO: 719668 - protein, 17 aa, Mycobacterium
RELWQLEFDALRRAGGC

SEQ ID NO: 719669 - protein, 20 aa, Mycobacterium
RELWRARRILAVTVAGHGVE

SEQ ID NO: 719670 - protein, 17 aa, Mycobacterium
RELYAAGDYMYQCAEAQ

SEQ ID NO: 719671 - protein, 18 aa, Mycobacterium
RELYFLKAGRERGLYLSQ

SEQ ID NO: 719672 - protein, 27 aa, Mycobacterium
RELYPECPRVYGVAVMGDLSRRRWWPL

SEQ ID NO: 719673 - protein, 22 aa, Mycobacterium
REMADTLLGYREKYGVTFITVQ

SEQ ID NO: 719674 - protein, 17 aa, Mycobacterium
REMAETFAVSRSTLRSA

SEQ ID NO: 719675 - protein, 25 aa, Mycobacterium
REMAFAVARCGADVVIASRNLDNCV

SEQ ID NO: 719676 - protein, 22 aa, Mycobacterium
REMARVKGGLVPDISRLRSGQF

SEQ ID NO: 719677 - protein, 20 aa, Mycobacterium
REMFSKYVFGGILDRHPGLR

SEQ ID NO: 719678 - protein, 18 aa, Mycobacterium
REMGLPIGSVIVNRNISS

SEQ ID NO: 719679 - protein, 17 aa, Mycobacterium
REMGRAGLEEFLESKTF

SEQ ID NO: 719680 - protein, 19 aa, Mycobacterium
REMGVAGFEEYLETKVIAT

SEQ ID NO: 719681 - protein, 17 aa, Mycobacterium
REMGVAGLEELLESKTF

SEQ ID NO: 719682 - protein, 21 aa, Mycobacterium
REMIKTGGFDAVCFTSSSTVR

SEQ ID NO: 719683 - protein, 27 aa, Mycobacterium
REMKVTLWNRGCEELWGLRADEAIGAS

SEQ ID NO: 719684 - protein, 17 aa, Mycobacterium
REMLARIEVPYRVIDVA

SEQ ID NO: 719685 - protein, 25 aa, Mycobacterium
REMLTELVCTQIAIALGHNNSSEIN

SEQ ID NO: 719686 - protein, 22 aa, Mycobacterium
REMMRRATAKWRDHGFELDWEE

SEQ ID NO: 719687 - protein, 18 aa, Mycobacterium
REMNRPALRVSPHVDVTA

SEQ ID NO: 719688 - protein, 20 aa, Mycobacterium
REMPNVTVLHGYTRVATDSD

SEQ ID NO: 719689 - protein, 19 aa, Mycobacterium
REMQIHGSEHFSRVVQPWS

SEQ ID NO: 719690 - protein, 21 aa, Mycobacterium
REMTYRVAAQRGWGPTWEDVE

SEQ ID NO: 719691 - protein, 25 aa, Mycobacterium
REMWLFMRDRCLSIAGGTTQILLSV

SEQ ID NO: 719692 - protein, 27 aa, Mycobacterium
REMYRECPRVYGVAVMGDLSRRRWWPL

SEQ ID NO: 719693 - protein, 24 aa, Mycobacterium
RENAELSAALGLIGSGAFSGGDPE

SEQ ID NO: 719694 - protein, 17 aa, Mycobacterium
RENCGLTGTHLGCEHGA

SEQ ID NO: 719695 - protein, 17 aa, Mycobacterium
RENCPQVAFLHLSGSAE

SEQ ID NO: 719696 - protein, 18 aa, Mycobacterium
RENEPVFRDRNGLAAAST

SEQ ID NO: 719697 - protein, 25 aa, Mycobacterium
RENFRRAFCGFDIEKVAGYTDADVQ

SEQ ID NO: 719698 - protein, 18 aa, Mycobacterium
RENGRWLLSKHITVKTGD

SEQ ID NO: 719699 - protein, 19 aa, Mycobacterium
RENIREVHRADLIGQHIGE

SEQ ID NO: 719700 - protein, 31 aa, Mycobacterium
RENLKTGAPIRLSAAVVASWARYAEGVDEQG

SEQ ID NO: 719701 - protein, 20 aa, Mycobacterium
RENLPLILGRLHKAQPDVHV

SEQ ID NO: 719702 - protein, 25 aa, Mycobacterium
RENLWTAAVQFDWDNARADADAVLE

SEQ ID NO: 719703 - protein, 21 aa, Mycobacterium
RENMKRAWGPVRVAIAAEQAH

SEQ ID NO: 719704 - protein, 17 aa, Mycobacterium
RENPGLMPLAVDEMIRW

SEQ ID NO: 719705 - protein, 23 aa, Mycobacterium
RENQKRFVAHVGVHGARGAAARD

SEQ ID NO: 719706 - protein, 17 aa, Mycobacterium
RENRIVIAYSPLEQGLL

SEQ ID NO: 719707 - protein, 17 aa, Mycobacterium
RENVVALTVLWLLNIGE

SEQ ID NO: 719708 - protein, 18 aa, Mycobacterium
RENYFRGLLGDRVTDVKT

SEQ ID NO: 719709 - protein, 25 aa, Mycobacterium
REPADYPPPAGYRGGYADEPRYGSV

SEQ ID NO: 719710 - protein, 17 aa, Mycobacterium
REPAQWEIGPSVEPKHA

SEQ ID NO: 719711 - protein, 17 aa, Mycobacterium
REPDARVALPTREDQAL

SEQ ID NO: 719712 - protein, 20 aa, Mycobacterium
REPEKFRGLVVAARDCAELD

SEQ ID NO: 719713 - protein, 20 aa, Mycobacterium
REPFSRRPLDGPRGVAVIFD

SEQ ID NO: 719714 - protein, 17 aa, Mycobacterium
REPGDVLQPQWLARAVR

SEQ ID NO: 719715 - protein, 22 aa, Mycobacterium
REPGEWYVIHSYAGYENKVKAN

SEQ ID NO: 719716 - protein, 18 aa, Mycobacterium
REPGLKYVLSRNEQAMVH

SEQ ID NO: 719717 - protein, 17 aa, Mycobacterium
REPGPAAARLAELLAGP

SEQ ID NO: 719718 - protein, 18 aa, Mycobacterium
REPGQLVEMAWDPITRIV

SEQ ID NO: 719719 - protein, 17 aa, Mycobacterium
REPGQLVEMSWDPITRI

SEQ ID NO: 719720 - protein, 20 aa, Mycobacterium
REPGRLRIALSTKIPTPLPV

SEQ ID NO: 719721 - protein, 18 aa, Mycobacterium
REPGRLRIALSTKVPTPL

SEQ ID NO: 719722 - protein, 19 aa, Mycobacterium
REPGRLRIALSTKVPTPLP

SEQ ID NO: 719723 - protein, 26 aa, Mycobacterium
REPGYHFLAVLTLSGHRGLERPMPSY

SEQ ID NO: 719724 - protein, 21 aa, Mycobacterium
REPGYRYLRARGNSIEGGTSE

SEQ ID NO: 719725 - protein, 24 aa, Mycobacterium
REPIGVSGEVTWRVPSLSFDDDAT

SEQ ID NO: 719726 - protein, 19 aa, Mycobacterium
REPILPFWLTKASRPRFQR

SEQ ID NO: 719727 - protein, 20 aa, Mycobacterium
REPKDLVICDLGMPRDVDAA

SEQ ID NO: 719728 - protein, 24 aa, Mycobacterium
REPKPMVYSGLYPVDGSDYPNLRD

SEQ ID NO: 719729 - protein, 24 aa, Mycobacterium
REPKPMVYSGLYPVDGSDYPNLRE

SEQ ID NO: 719730 - protein, 24 aa, Mycobacterium
REPKPMVYSGLYPVDGSDYPVLRE

SEQ ID NO: 719731 - protein, 17 aa, Mycobacterium
REPLADFGCEFPQIDQR

SEQ ID NO: 719732 - protein, 25 aa, Mycobacterium
REPLGVAGEAAWQVPSLSLADDAVE

SEQ ID NO: 719733 - protein, 17 aa, Mycobacterium
REPLPGLGHAVEIRAYR

SEQ ID NO: 719734 - protein, 23 aa, Mycobacterium
REPLPRLGTVPVQLADFAGHLIK

SEQ ID NO: 719735 - protein, 17 aa, Mycobacterium
REPMPPTAASPVAAAPA

SEQ ID NO: 719736 - protein, 20 aa, Mycobacterium
REPMPWNGPLFKFALFQVAS

SEQ ID NO: 719737 - protein, 19 aa, Mycobacterium
REPMRIRVALHTGEVELRD

SEQ ID NO: 719738 - protein, 25 aa, Mycobacterium
REPPKRLSAITSIGSDAWDRLFSGP

SEQ ID NO: 719739 - protein, 19 aa, Mycobacterium
REPPRPPVEAPRPAESAPS

SEQ ID NO: 719740 - protein, 25 aa, Mycobacterium
REPQKRLSAIASIGSDAWDRLFSGP

SEQ ID NO: 719741 - protein, 24 aa, Mycobacterium
REPRGAKRRIVFRFFTSPIELRGE

SEQ ID NO: 719742 - protein, 22 aa, Mycobacterium
REPRGPWGPGRAVEAADAFEAV

SEQ ID NO: 719743 - protein, 23 aa, Mycobacterium
REPRGPWGPGRAVEAADAFEAVR

SEQ ID NO: 719744 - protein, 23 aa, Mycobacterium
REPRPYPELVLAPRDSIFDYTYE

SEQ ID NO: 719745 - protein, 21 aa, Mycobacterium
REPSGPWGRGRTADVTDALEA

SEQ ID NO: 719746 - protein, 19 aa, Mycobacterium
REPVGDECIHAWRRLTRAG

SEQ ID NO: 719747 - protein, 24 aa, Mycobacterium
REPVWIVGELTDWVGHPPEQLAAM

SEQ ID NO: 719748 - protein, 18 aa, Mycobacterium
REPWPGGRAGRIDTGGYR

SEQ ID NO: 719749 - protein, 18 aa, Mycobacterium
REPWPGGRAGRLDIDGYR

SEQ ID NO: 719750 - protein, 19 aa, Mycobacterium
REPWPGGRAGRLDVGGYQI

SEQ ID NO: 719751 - protein, 17 aa, Mycobacterium
REPWRMALSQLWTADID

SEQ ID NO: 719752 - protein, 17 aa, Mycobacterium
REPYRKLINQGYIQAFA

SEQ ID NO: 719753 - protein, 18 aa, Mycobacterium
REPYRKLINQGYIQAFAY

SEQ ID NO: 719754 - protein, 24 aa, Mycobacterium
REQALRFGADLRMEDVDAVDLTGP

SEQ ID NO: 719755 - protein, 17 aa, Mycobacterium
REQARGFALGGPARPVL

SEQ ID NO: 719756 - protein, 19 aa, Mycobacterium
REQDIRTAARMIAEAGEWM

SEQ ID NO: 719757 - protein, 20 aa, Mycobacterium
REQELPLGKRNPSIAGNVVD

SEQ ID NO: 719758 - protein, 18 aa, Mycobacterium
REQFAYLSYGRVMDTTRM

SEQ ID NO: 719759 - protein, 25 aa, Mycobacterium
REQGITIDVAYRFFSTESRSYILAD

SEQ ID NO: 719760 - protein, 17 aa, Mycobacterium
REQGRFGFDVSADGAHI

SEQ ID NO: 719761 - protein, 17 aa, Mycobacterium
REQGVTAPAGFRAAGIA

SEQ ID NO: 719762 - protein, 23 aa, Mycobacterium
REQHPRVLIVWGPHDGYMPEASA

SEQ ID NO: 719763 - protein, 21 aa, Mycobacterium
REQIPGLPLLLLTAKDSVEDR

SEQ ID NO: 719764 - protein, 24 aa, Mycobacterium
REQLAELSGAWGVVQTPGELCDDP

SEQ ID NO: 719765 - protein, 18 aa, Mycobacterium
REQLDWAQLRRATAENPF

SEQ ID NO: 719766 - protein, 18 aa, Mycobacterium
REQLGWVALNGRRNAALN

SEQ ID NO: 719767 - protein, 26 aa, Mycobacterium
REQLPGLWLLASLYFRADVRGLDRIP

SEQ ID NO: 719768 - protein, 19 aa, Mycobacterium
REQPLPLGLRGLLTDLHSA

SEQ ID NO: 719769 - protein, 22 aa, Mycobacterium
REQPMPWGLRPVVIDLYSAGAA

SEQ ID NO: 719770 - protein, 24 aa, Mycobacterium
REQPRRLGPVVAFPAQQTRRGAVV

SEQ ID NO: 719771 - protein, 17 aa, Mycobacterium
REQPTCDARYWVDNLRH

SEQ ID NO: 719772 - protein, 17 aa, Mycobacterium
REQRGKWAYYRLDAAAF

SEQ ID NO: 719773 - protein, 17 aa, Mycobacterium
REQRPHVVVTYDPAGGY

SEQ ID NO: 719774 - protein, 22 aa, Mycobacterium
REQRRARRRRKTTEPQRQYADE

SEQ ID NO: 719775 - protein, 21 aa, Mycobacterium
REQVLLWKRERRQLAEEAQRQ

SEQ ID NO: 719776 - protein, 19 aa, Mycobacterium
REQVRHLVRIIRELAELEG

SEQ ID NO: 719777 - protein, 22 aa, Mycobacterium
REQVRLALGRRIHPELPELDYV

SEQ ID NO: 719778 - protein, 22 aa, Mycobacterium
REQWDGPFMLKGVIRVDDAKRA

SEQ ID NO: 719779 - protein, 23 aa, Mycobacterium
REQWGGPFLLKGLVRVDDAKRAV

SEQ ID NO: 719780 - protein, 17 aa, Mycobacterium
REQWPVAGPLVGRLGWW

SEQ ID NO: 719781 - protein, 23 aa, Mycobacterium
REQYGFPHWVVYDEAHLLGNGEE

SEQ ID NO: 719782 - protein, 18 aa, Mycobacterium
REQYRIVVYYADVEGLSY

SEQ ID NO: 719783 - protein, 23 aa, Mycobacterium
RERAAPAVAPWIHRGLTSQDVLD

SEQ ID NO: 719784 - protein, 32 aa, Mycobacterium
RERAEARLGYPLNRAHTAAIVWSDEIDGNHGD

SEQ ID NO: 719785 - protein, 41 aa, Mycobacterium
RERAEILRRAWELVIARRDDFALAMTLEMGKPLAESQGEVA

SEQ ID NO: 719786 - protein, 30 aa, Mycobacterium
RERAETRLGYSLIRAHTAAIIWSDDFDGDH

SEQ ID NO: 719787 - protein, 24 aa, Mycobacterium
RERALRFGATEAFADVAGAADAIA

SEQ ID NO: 719788 - protein, 17 aa, Mycobacterium
RERALRLAGSLRDLGPG

SEQ ID NO: 719789 - protein, 19 aa, Mycobacterium
RERARRKFAEYSRVDWQVI

SEQ ID NO: 719790 - protein, 19 aa, Mycobacterium
RERARRKFDEYSRVDWQVI

SEQ ID NO: 719791 - protein, 20 aa, Mycobacterium
RERARVGGALVTEIYSVGPL

SEQ ID NO: 719792 - protein, 23 aa, Mycobacterium
RERDELRAWIARHYADIPLTFDV

SEQ ID NO: 719793 - protein, 26 aa, Mycobacterium
RERDFTCFYLRAGELLAADCINRPRD

SEQ ID NO: 719794 - protein, 22 aa, Mycobacterium
RERFAPMRILTGIEVDILEDGS

SEQ ID NO: 719795 - protein, 18 aa, Mycobacterium
RERFERVATQLSLELTFY

SEQ ID NO: 719796 - protein, 21 aa, Mycobacterium
RERFPALSVVTLDAWGDGGPW

SEQ ID NO: 719797 - protein, 19 aa, Mycobacterium
RERGCMEGAVIDEIYSVGP

SEQ ID NO: 719798 - protein, 18 aa, Mycobacterium
RERGHFGGAAVSEIYSTG

SEQ ID NO: 719799 - protein, 22 aa, Mycobacterium
RERGLEMSRLLISSWDIPGICD

SEQ ID NO: 719800 - protein, 17 aa, Mycobacterium
RERGLHFVGAGISGGEE

SEQ ID NO: 719801 - protein, 17 aa, Mycobacterium
RERGRGWILNLTSVGGD

SEQ ID NO: 719802 - protein, 18 aa, Mycobacterium
RERGRRVGVLAVDPSSPF

SEQ ID NO: 719803 - protein, 17 aa, Mycobacterium
RERGWEIEDVTAYRTVR

SEQ ID NO: 719804 - protein, 23 aa, Mycobacterium
RERIARSGLRFSGTSPDGHLVEF

SEQ ID NO: 719805 - protein, 23 aa, Mycobacterium
RERILACARELFAHNGIDRTSIR

SEQ ID NO: 719806 - protein, 19 aa, Mycobacterium
RERIPHISFAAGEHTCLGL

SEQ ID NO: 719807 - protein, 18 aa, Mycobacterium
RERIPISIAALGPKNVEL

SEQ ID NO: 719808 - protein, 20 aa, Mycobacterium
RERIVALKLMSQTLSNDPVF

SEQ ID NO: 719809 - protein, 22 aa, Mycobacterium
RERKMGFNLAFGYGIHSCLGAA

SEQ ID NO: 719810 - protein, 19 aa, Mycobacterium
RERLAELGISPLDRDLGVV

SEQ ID NO: 719811 - protein, 20 aa, Mycobacterium
RERLALCGLFDELGPSAPTL

SEQ ID NO: 719812 - protein, 26 aa, Mycobacterium
RERLDWINALFPRLAERRHQPGGTLS

SEQ ID NO: 719813 - protein, 24 aa, Mycobacterium
RERLHAGAILGAFEAWLVTRSLGS

SEQ ID NO: 719814 - protein, 23 aa, Mycobacterium
RERLRGWRFYDGFRVDGGAPARH

SEQ ID NO: 719815 - protein, 19 aa, Mycobacterium
RERLSGWSADLGHHRPADC

SEQ ID NO: 719816 - protein, 27 aa, Mycobacterium
RERLVRSWAGLKAMRSYALATMDVEKP

SEQ ID NO: 719817 - protein, 24 aa, Mycobacterium
RERMAFRSAGYWDVTAELDASVSD

SEQ ID NO: 719818 - protein, 18 aa, Mycobacterium
RERMARLIFAPRILAQVV

SEQ ID NO: 719819 - protein, 34 aa, Mycobacterium
RERPETAIDEIIRWATPVHCFQRTALDDVEIGGV

SEQ ID NO: 719820 - protein, 19 aa, Mycobacterium
RERPRSRFTVGIDDDVSGT

SEQ ID NO: 719821 - protein, 20 aa, Mycobacterium
RERPTVAAPRTWDEIEDPDL

SEQ ID NO: 719822 - protein, 24 aa, Mycobacterium
RERPVPSARGWSAAPVRHGVSVVR

SEQ ID NO: 719823 - protein, 19 aa, Mycobacterium
RERQCCPFLHFDTEEDDDA

SEQ ID NO: 719824 - protein, 28 aa, Mycobacterium
RERRAAARESRRARGQHIGRPKALDNAK

SEQ ID NO: 719825 - protein, 17 aa, Mycobacterium
RERRELNRWECGQDRVA

SEQ ID NO: 719826 - protein, 23 aa, Mycobacterium
RERREYFADYGLVFPDDETSQLR

SEQ ID NO: 719827 - protein, 18 aa, Mycobacterium
RERRKRALGLARDAATPS

SEQ ID NO: 719828 - protein, 17 aa, Mycobacterium
RERRLRTGGRIIPEMSV

SEQ ID NO: 719829 - protein, 25 aa, Mycobacterium
RERSAEPTARWLHRGLTSQDVVDTA

SEQ ID NO: 719830 - protein, 22 aa, Mycobacterium
RERSLIGAWCFADHYGPHDVRG

SEQ ID NO: 719831 - protein, 23 aa, Mycobacterium
RERSSLPALRDWLRRQREERVGA

SEQ ID NO: 719832 - protein, 26 aa, Mycobacterium
RERTRARLEEILQWPPGTIAALRRGE

SEQ ID NO: 719833 - protein, 17 aa, Mycobacterium
RERTRRAILDAAMLVLA

SEQ ID NO: 719834 - protein, 18 aa, Mycobacterium
RERVEAIATAASSLLDGV

SEQ ID NO: 719835 - protein, 30 aa, Mycobacterium
RERVGAALTRLGFRVIPSDANFVLFGEFAD

SEQ ID NO: 719836 - protein, 29 aa, Mycobacterium
RERVRAGLHSLPWDGLKLSRGEPAIPTRM

SEQ ID NO: 719837 - protein, 18 aa, Mycobacterium
RERVYRLLDPGSPFLELA

SEQ ID NO: 719838 - protein, 20 aa, Mycobacterium
RERWKRGVALVETLIGDAVG

SEQ ID NO: 719839 - protein, 20 aa, Mycobacterium
RERWLPRLVSGDVVAGIGTN

SEQ ID NO: 719840 - protein, 24 aa, Mycobacterium
RERYGSAVVWAVEDCRHLSARLER

SEQ ID NO: 719841 - protein, 18 aa, Mycobacterium
RERYLRDATGYVRLAERV

SEQ ID NO: 719842 - protein, 23 aa, Mycobacterium
RERYPAWDRFTAVRDRLDPNRVF

SEQ ID NO: 719843 - protein, 29 aa, Mycobacterium
RESAEFLTELFGLPSPKPFGHFMVVELEH

SEQ ID NO: 719844 - protein, 29 aa, Mycobacterium
RESAELRWRWNAGFSLVFARHYATTADRT

SEQ ID NO: 719845 - protein, 18 aa, Mycobacterium
RESARPAKELAYVVNDIG

SEQ ID NO: 719846 - protein, 21 aa, Mycobacterium
RESDGGWLLKLVNGRTGEKRK

SEQ ID NO: 719847 - protein, 18 aa, Mycobacterium
RESFAKRGVQLGSAFSGL

SEQ ID NO: 719848 - protein, 17 aa, Mycobacterium
RESFPFAPAGAALLCKW

SEQ ID NO: 719849 - protein, 23 aa, Mycobacterium
RESGEALVPFVTAIVTSVSLDDG

SEQ ID NO: 719850 - protein, 30 aa, Mycobacterium
RESKPLVRLRVPFTISRSAIDDVERGAQDS

SEQ ID NO: 719851 - protein, 29 aa, Mycobacterium
RESKPLVRLRVPFTLSRYEIDNVERGAND

SEQ ID NO: 719852 - protein, 25 aa, Mycobacterium
RESLRTLGLRKIRQSVVREDNAQTR

SEQ ID NO: 719853 - protein, 26 aa, Mycobacterium
RESLRTLGLRRIRHSVVREDNPQTRG

SEQ ID NO: 719854 - protein, 25 aa, Mycobacterium
RESLRTLGLRRIRHTVVRDDNAQTR

SEQ ID NO: 719855 - protein, 23 aa, Mycobacterium
RESMARSGAPWRFGTDAPGELST

SEQ ID NO: 719856 - protein, 20 aa, Mycobacterium
RESPGLLRFLAIAREVSAGR

SEQ ID NO: 719857 - protein, 32 aa, Mycobacterium
RESPMLVALCDEWARRGFLAVRYNLPYRRRRP

SEQ ID NO: 719858 - protein, 18 aa, Mycobacterium
RESRARWAAQKCSEGKEE

SEQ ID NO: 719859 - protein, 19 aa, Mycobacterium
RESRFPISEILAQTPEIPD

SEQ ID NO: 719860 - protein, 19 aa, Mycobacterium
RESRFPISEILAQTPPIPD

SEQ ID NO: 719861 - protein, 24 aa, Mycobacterium
RESSRLTILTSREREVLALLASGA

SEQ ID NO: 719862 - protein, 26 aa, Mycobacterium
RESTDLRPARSFAVDYAGWVGLSQEG

SEQ ID NO: 719863 - protein, 18 aa, Mycobacterium
RESVRLAFVAALQHLSPR

SEQ ID NO: 719864 - protein, 18 aa, Mycobacterium
RESVRLMRELWRGDRVDF

SEQ ID NO: 719865 - protein, 20 aa, Mycobacterium
RESVSIALLSLMERLGPTER

SEQ ID NO: 719866 - protein, 18 aa, Mycobacterium
RESWFPTGDLGFIADGGL

SEQ ID NO: 719867 - protein, 21 aa, Mycobacterium
RESYLRLLLIDAGFPRPRSQI

SEQ ID NO: 719868 - protein, 21 aa, Mycobacterium
RESYLRLLLIDAGLARPQTQI

SEQ ID NO: 719869 - protein, 21 aa, Mycobacterium
RESYLRLLLIDAGLPRPQTQI

SEQ ID NO: 719870 - protein, 19 aa, Mycobacterium
RESYRAFLERHVAPYHDEW

SEQ ID NO: 719871 - protein, 19 aa, Mycobacterium
RESYRGFLERHVAPYHDEW

SEQ ID NO: 719872 - protein, 19 aa, Mycobacterium
RETARLFASQGHRVVLADI

SEQ ID NO: 719873 - protein, 25 aa, Mycobacterium
RETARRLGVHPGRCVVVAGGEAGVR

SEQ ID NO: 719874 - protein, 26 aa, Mycobacterium
RETCWRDYRLGVLQAPLISALGFAFA

SEQ ID NO: 719875 - protein, 28 aa, Mycobacterium
RETEREFAHPFIAMCPVSLRADDDTTIG

SEQ ID NO: 719876 - protein, 24 aa, Mycobacterium
RETFESGVWRKAPASHRANVLFRA

SEQ ID NO: 719877 - protein, 19 aa, Mycobacterium
RETFGATLRARLRDGTHSG

SEQ ID NO: 719878 - protein, 24 aa, Mycobacterium
RETFRAIGVDLMFTHIKQSLHDFG

SEQ ID NO: 719879 - protein, 22 aa, Mycobacterium
RETGRFQDILIREGGAVGPKAH

SEQ ID NO: 719880 - protein, 24 aa, Mycobacterium
RETGRWADPVIRNKVMRLWAQERV

SEQ ID NO: 719881 - protein, 20 aa, Mycobacterium
RETGYWRFVTDPADPHETQA

SEQ ID NO: 719882 - protein, 25 aa, Mycobacterium
RETIECLRPILAGERVDYAGRHVSS

SEQ ID NO: 719883 - protein, 22 aa, Mycobacterium
RETIWWPPVLTMSAVEGTGLTQ

SEQ ID NO: 719884 - protein, 21 aa, Mycobacterium
RETLARYAGLILEYEGVTVKD

SEQ ID NO: 719885 - protein, 20 aa, Mycobacterium
RETLCGVLALGSEHTTAESP

SEQ ID NO: 719886 - protein, 17 aa, Mycobacterium
RETLDWLGTHLGGAPAR

SEQ ID NO: 719887 - protein, 24 aa, Mycobacterium
RETLFPLICRYAEAYHVVSVPADE

SEQ ID NO: 719888 - protein, 17 aa, Mycobacterium
RETLGFEVLPLSGGAEP

SEQ ID NO: 719889 - protein, 25 aa, Mycobacterium
RETLGMSFVNLIWRNIASIPGGLRW

SEQ ID NO: 719890 - protein, 20 aa, Mycobacterium
RETLGRSGIQNMPIDELRAH

SEQ ID NO: 719891 - protein, 20 aa, Mycobacterium
RETLHMWTQIVGKVRMVRTP

SEQ ID NO: 719892 - protein, 20 aa, Mycobacterium
RETLLSGPHRAFWDDEKSAL

SEQ ID NO: 719893 - protein, 19 aa, Mycobacterium
RETLQRWECGQDRVALIMY

SEQ ID NO: 719894 - protein, 19 aa, Mycobacterium
RETLRAAVFDGQRSASPLI

SEQ ID NO: 719895 - protein, 18 aa, Mycobacterium
RETLREFLVRNRSYVTTA

SEQ ID NO: 719896 - protein, 24 aa, Mycobacterium
RETLRLLIELARAAGLEERRDQMF

SEQ ID NO: 719897 - protein, 23 aa, Mycobacterium
RETLRLLVDLARAANIEERRDQM

SEQ ID NO: 719898 - protein, 23 aa, Mycobacterium
RETMELFVRTGLFEDVQARQDLT

SEQ ID NO: 719899 - protein, 18 aa, Mycobacterium
RETMLALFAERGGDPDRP

SEQ ID NO: 719900 - protein, 19 aa, Mycobacterium
RETMMRRGMEMQDQAVNVV

SEQ ID NO: 719901 - protein, 25 aa, Mycobacterium
RETNAPIPVCLDIDAGWRPLGGPVH

SEQ ID NO: 719902 - protein, 22 aa, Mycobacterium
RETPFRSGATVSRIAQLAVVDC

SEQ ID NO: 719903 - protein, 24 aa, Mycobacterium
RETPHVPIPYCYAVDLRFLLSPPV

SEQ ID NO: 719904 - protein, 21 aa, Mycobacterium
RETPLPGALLVRVARSHLRVG

SEQ ID NO: 719905 - protein, 18 aa, Mycobacterium
RETPLQWPCPPTDVSGGG

SEQ ID NO: 719906 - protein, 20 aa, Mycobacterium
RETPLRNAVLAYLAILRGRA

SEQ ID NO: 719907 - protein, 23 aa, Mycobacterium
RETPRPGLIDALIRTRINGAPPP

SEQ ID NO: 719908 - protein, 17 aa, Mycobacterium
RETRRWLQVASQGVKTK

SEQ ID NO: 719909 - protein, 18 aa, Mycobacterium
RETRYWYYALQTCRLGDH

SEQ ID NO: 719910 - protein, 24 aa, Mycobacterium
RETSRLRLGTSVVQMSARTPTACA

SEQ ID NO: 719911 - protein, 19 aa, Mycobacterium
RETTEFFVRAQAVLAPLSN

SEQ ID NO: 719912 - protein, 26 aa, Mycobacterium
RETVEICRKVWRRERLEFEGKYFTVP

SEQ ID NO: 719913 - protein, 19 aa, Mycobacterium
RETVKEFLAREVVPHQHDW

SEQ ID NO: 719914 - protein, 23 aa, Mycobacterium
RETVSALLAPLGIEHTLQYRRGV

SEQ ID NO: 719915 - protein, 18 aa, Mycobacterium
RETWLIHLCTDWMGDDAW

SEQ ID NO: 719916 - protein, 21 aa, Mycobacterium
REVAARFAGEMERTGICQAVV

SEQ ID NO: 719917 - protein, 20 aa, Mycobacterium
REVAARTGLRDCRAHGRTWD

SEQ ID NO: 719918 - protein, 24 aa, Mycobacterium
REVAEMPLGTGWVVAIGLFALDGV

SEQ ID NO: 719919 - protein, 23 aa, Mycobacterium
REVAGEFERPVLLFSGGKDSTVL

SEQ ID NO: 719920 - protein, 28 aa, Mycobacterium
REVAIDLRQDWPSALRAAGFDPSARTAW

SEQ ID NO: 719921 - protein, 27 aa, Mycobacterium
REVALRDGLQIEAPIPLSAKLELLAAV

SEQ ID NO: 719922 - protein, 17 aa, Mycobacterium
REVANAVVFLSSPVASF

SEQ ID NO: 719923 - protein, 19 aa, Mycobacterium
REVANWDPHYHVGHLALPA

SEQ ID NO: 719924 - protein, 24 aa, Mycobacterium
REVARRIRAGWVTINHAFDMNAPF

SEQ ID NO: 719925 - protein, 18 aa, Mycobacterium
REVCIFSQDATVFGGSLG

SEQ ID NO: 719926 - protein, 27 aa, Mycobacterium
REVDAKWASSISGYWRRGRTEETFRQW

SEQ ID NO: 719927 - protein, 21 aa, Mycobacterium
REVDEIIGPDVEREWVQLLPA

SEQ ID NO: 719928 - protein, 22 aa, Mycobacterium
REVDELIGPDVKREWITNLPSY

SEQ ID NO: 719929 - protein, 30 aa, Mycobacterium
REVDELLAYLRPRAVIFHRSLGAKFADVLP

SEQ ID NO: 719930 - protein, 19 aa, Mycobacterium
REVEGLPKGSVKAVIDAYG

SEQ ID NO: 719931 - protein, 30 aa, Mycobacterium
REVEQGKPDAWRPVFSRLAELGIFGVAIPE

SEQ ID NO: 719932 - protein, 17 aa, Mycobacterium
REVFRWLARYNTTRRHS

SEQ ID NO: 719933 - protein, 20 aa, Mycobacterium
REVGTIAFPIAHIGGMVYLA

SEQ ID NO: 719934 - protein, 27 aa, Mycobacterium
REVHHMAALCGFGAAAINPYMAFESIE

SEQ ID NO: 719935 - protein, 20 aa, Mycobacterium
REVHHMAALVSFGAAAINPY

SEQ ID NO: 719936 - protein, 17 aa, Mycobacterium
REVHPFAVATQAHPELK

SEQ ID NO: 719937 - protein, 20 aa, Mycobacterium
REVIPHFKGQLTAARASHDW

SEQ ID NO: 719938 - protein, 19 aa, Mycobacterium
REVIRRWDEGGSFDLLLTV

SEQ ID NO: 719939 - protein, 17 aa, Mycobacterium
REVKPGELLCARVLPTG

SEQ ID NO: 719940 - protein, 18 aa, Mycobacterium
REVLAGIAAAAPHDAILA

SEQ ID NO: 719941 - protein, 23 aa, Mycobacterium
REVLDRIGDKWSLLVIGTLRDGP

SEQ ID NO: 719942 - protein, 26 aa, Mycobacterium
REVLEDHGLVAWPKTSGSRGFHIYAR

SEQ ID NO: 719943 - protein, 17 aa, Mycobacterium
REVLEDYGLTPWPKTSG

SEQ ID NO: 719944 - protein, 20 aa, Mycobacterium
REVLFCPDQFLGAHVKRVTG

SEQ ID NO: 719945 - protein, 19 aa, Mycobacterium
REVLFCPDQFLGAHVRRET

SEQ ID NO: 719946 - protein, 18 aa, Mycobacterium
REVLFCPDQFLGAHVRRV

SEQ ID NO: 719947 - protein, 19 aa, Mycobacterium
REVLFCPDQFLGAHVRRVT

SEQ ID NO: 719948 - protein, 24 aa, Mycobacterium
REVLFCPDQFLGAHVRRVTGRKNL

SEQ ID NO: 719949 - protein, 24 aa, Mycobacterium
REVLFCPDQFLGAHVRRVTGRTNM

SEQ ID NO: 719950 - protein, 18 aa, Mycobacterium
REVLGPGLRELAARHRSV

SEQ ID NO: 719951 - protein, 31 aa, Mycobacterium
REVLLELARRADVFLTSFLPGHREKFGIDVD

SEQ ID NO: 719952 - protein, 25 aa, Mycobacterium
REVLPHLRPGSAIINITSTFAVVGG

SEQ ID NO: 719953 - protein, 19 aa, Mycobacterium
REVLPHMPAGSGIVNITST

SEQ ID NO: 719954 - protein, 21 aa, Mycobacterium
REVLREIAHRPAVRAKDLESC

SEQ ID NO: 719955 - protein, 21 aa, Mycobacterium
REVLSSPAIFEWFDISGADDI

SEQ ID NO: 719956 - protein, 19 aa, Mycobacterium
REVMEQIAIDEWMLASPIY

SEQ ID NO: 719957 - protein, 19 aa, Mycobacterium
REVMQRELLRIWAGSGKTV

SEQ ID NO: 719958 - protein, 17 aa, Mycobacterium
REVMSGFFTLVSAQTAE

SEQ ID NO: 719959 - protein, 17 aa, Mycobacterium
REVNAKIAALVTAVESG

SEQ ID NO: 719960 - protein, 20 aa, Mycobacterium
REVPGGACSGWLVHQLSAGD

SEQ ID NO: 719961 - protein, 29 aa, Mycobacterium
REVPIDLRLDWPAALRAAGFDPTARTAWL

SEQ ID NO: 719962 - protein, 17 aa, Mycobacterium
REVQPPGYGAAIHDREK

SEQ ID NO: 719963 - protein, 17 aa, Mycobacterium
REVRFYGDIAPRLGGPI

SEQ ID NO: 719964 - protein, 17 aa, Mycobacterium
REVRWAVVVDGPVRIAI

SEQ ID NO: 719965 - protein, 21 aa, Mycobacterium
REVSPRLSALTDRYRDSVTVS

SEQ ID NO: 719966 - protein, 19 aa, Mycobacterium
REVTEAGGMAQAIDQGIPK

SEQ ID NO: 719967 - protein, 24 aa, Mycobacterium
REVTESWSGFSERPTYENAKEIAD

SEQ ID NO: 719968 - protein, 17 aa, Mycobacterium
REVTGFVVEGMPAMMSG

SEQ ID NO: 719969 - protein, 18 aa, Mycobacterium
REVTGFVVEGMPAMMSGM

SEQ ID NO: 719970 - protein, 22 aa, Mycobacterium
REVTGVPILFASAGEKLEDFDV

SEQ ID NO: 719971 - protein, 22 aa, Mycobacterium
REVTRLAIRRLIVVCTPPQAGL

SEQ ID NO: 719972 - protein, 23 aa, Mycobacterium
REVTWDGLCWGHIYDRRRKTRRF

SEQ ID NO: 719973 - protein, 21 aa, Mycobacterium
REVTYGQLLVQFWESHDPTQG

SEQ ID NO: 719974 - protein, 20 aa, Mycobacterium
REVVARTGLQDCRTHGRTWD

SEQ ID NO: 719975 - protein, 22 aa, Mycobacterium
REVVELYNLVVWNECNLELAGE

SEQ ID NO: 719976 - protein, 19 aa, Mycobacterium
REVVRRAVLAPGDEGSIST

SEQ ID NO: 719977 - protein, 20 aa, Mycobacterium
REVVWLHTYGQAFTEGHDGG

SEQ ID NO: 719978 - protein, 21 aa, Mycobacterium
REVVYDRLLFEPTFSADDYRK

SEQ ID NO: 719979 - protein, 31 aa, Mycobacterium; identical to SEQ ID NO: 91056

SEQ ID NO: 719980 - protein, 31 aa, Mycobacterium
REVYERIKPAFKHWAAVVIHAGGPGAGTRMK

SEQ ID NO: 719981 - protein, 20 aa, Mycobacterium
REVYPGPWLPEPVLTDDRTL

SEQ ID NO: 719982 - protein, 23 aa, Mycobacterium
REWAQRKPYSWLRQILPAPHYPP

SEQ ID NO: 719983 - protein, 21 aa, Mycobacterium
REWEECLHKAASIVGPVTDQS

SEQ ID NO: 719984 - protein, 20 aa, Mycobacterium
REWGDWATRAKMPTLRIPDF

SEQ ID NO: 719985 - protein, 18 aa, Mycobacterium
REWGDWATRSAMPTLRIP

SEQ ID NO: 719986 - protein, 19 aa, Mycobacterium
REWGNWATRAAMPSLRIPD

SEQ ID NO: 719987 - protein, 25 aa, Mycobacterium
REWGPTVAAIARWSGDLTVAEDAVQ

SEQ ID NO: 719988 - protein, 26 aa, Mycobacterium
REWGSAVAALARWSGDLTIAEDAVQE

SEQ ID NO: 719989 - protein, 21 aa, Mycobacterium
REWLRRPPPTLGEHNEEILRE

SEQ ID NO: 719990 - protein, 24 aa, Mycobacterium
REWLTARGIVALNITSSPGAGKTT

SEQ ID NO: 719991 - protein, 32 aa, Mycobacterium
REWRAGLRDGRRIRWRRRLPRKRAVPPAPAAS

SEQ ID NO: 719992 - protein, 19 aa, Mycobacterium
REWRAWRAIIDKTLVLVRQ

SEQ ID NO: 719993 - protein, 17 aa, Mycobacterium
REWSDWATRTAMPSLRI

SEQ ID NO: 719994 - protein, 19 aa, Mycobacterium
REWSEFGFHEYLEVKSTLG

SEQ ID NO: 719995 - protein, 21 aa, Mycobacterium
REYATRLCAEFIAGEEAVTKD

SEQ ID NO: 719996 - protein, 20 aa, Mycobacterium
REYESLWSAVRFDDPARPAA

SEQ ID NO: 719997 - protein, 21 aa, Mycobacterium
REYFVHRSVYHLKEGDPHAWA

SEQ ID NO: 719998 - protein, 17 aa, Mycobacterium
REYIDLAISEVKPGVLT

SEQ ID NO: 719999 - protein, 25 aa, Mycobacterium
REYIDWQPFFNAWEMKGRFPDILNN

SEQ ID NO: 720000 - protein, 19 aa, Mycobacterium
REYIPLLLEQGGFQPPQPV

SEQ ID NO: 720001 - protein, 22 aa, Mycobacterium
REYLDLLGGIAVNLLGHRHPAV

SEQ ID NO: 720002 - protein, 25 aa, Mycobacterium
REYLRKGMPTAWLIARLSDTALAGG

SEQ ID NO: 720003 - protein, 17 aa, Mycobacterium
REYLVGIGFDPALIHSE

SEQ ID NO: 720004 - protein, 18 aa, Mycobacterium
REYMAALVAGARRHPGDD

SEQ ID NO: 720005 - protein, 30 aa, Mycobacterium
REYPDPDSFIWDRRIERLLAFGRGQHFCLG

SEQ ID NO: 720006 - protein, 27 aa, Mycobacterium
REYPHYLRLLLWEGLDRNPLDGNPPAA

SEQ ID NO: 720007 - protein, 22 aa, Mycobacterium
REYPVPFDVGWFRIDRIKETAY

SEQ ID NO: 720008 - protein, 17 aa, Mycobacterium
REYQAIVNLLKAFQAEF

SEQ ID NO: 720009 - protein, 24 aa, Mycobacterium
REYRRKVQLCLDVFETMLAQASFD

SEQ ID NO: 720010 - protein, 24 aa, Mycobacterium
REYRRKVQVCLDVFETMLSQCSFD

SEQ ID NO: 720011 - protein, 24 aa, Mycobacterium
REYVQIFKGFHRFLQTRKAAEIEA

SEQ ID NO: 720012 - protein, 17 aa, Mycobacterium
REYVVGGTFTGTVTGAG

SEQ ID NO: 720013 - protein, 31 aa, Mycobacterium
REYYLDIFKRLGVRPRIRHFVSGYETVRSYV

SEQ ID NO: 720014 - protein, 19 aa, Mycobacterium
RFAALPTDPGFVLYDVQLM

SEQ ID NO: 720015 - protein, 40 aa, Mycobacterium
RFAALSAAERWHLLASSWLDLPSRPALIGTRGPDAKPYGA

SEQ ID NO: 720016 - protein, 23 aa, Mycobacterium
RFAATEVVPRLAGTASEIEQVLK

SEQ ID NO: 720017 - protein, 19 aa, Mycobacterium
RFAATRADDLFMLIFTSGT

SEQ ID NO: 720018 - protein, 18 aa, Mycobacterium
RFADEGADVIALDAPAVA

SEQ ID NO: 720019 - protein, 28 aa, Mycobacterium
RFADKLAVAGARVFRFRVGELDPGAPLG

SEQ ID NO: 720020 - protein, 19 aa, Mycobacterium
RFADLFATVRVRLSDAVDR

SEQ ID NO: 720021 - protein, 20 aa, Mycobacterium
RFADLPAEAPGFDWSGWVQG

SEQ ID NO: 720022 - protein, 19 aa, Mycobacterium
RFADQGWYFAGDSAYYDRD

SEQ ID NO: 720023 - protein, 27 aa, Mycobacterium
RFADTHARVGLLPTWGLSVRLPQKVGI

SEQ ID NO: 720024 - protein, 18 aa, Mycobacterium
RFAEAGVIVVDNSSAFRK

SEQ ID NO: 720025 - protein, 22 aa, Mycobacterium
RFAEALLPLLADDAEAGIAVAE

SEQ ID NO: 720026 - protein, 18 aa, Mycobacterium
RFAEAWVAAWNAHDVEAV

SEQ ID NO: 720027 - protein, 22 aa, Mycobacterium
RFAECARRVRAMPEMTRPRDTV

SEQ ID NO: 720028 - protein, 17 aa, Mycobacterium
RFAELPFSEVRKATLDT

SEQ ID NO: 720029 - protein, 17 aa, Mycobacterium
RFAEMGDPWAGIDDAVG

SEQ ID NO: 720030 - protein, 19 aa, Mycobacterium
RFAEQGWYFAGDSAYYDTD

SEQ ID NO: 720031 - protein, 25 aa, Mycobacterium
RFAERFAVRVVDGFGSSEGGVSIAR

SEQ ID NO: 720032 - protein, 25 aa, Mycobacterium
RFAERFGVHVVDGFGSTEGGVAVAR

SEQ ID NO: 720033 - protein, 27 aa, Mycobacterium
RFAFNGWKALSWMDANVWRHVAPKGWF

SEQ ID NO: 720034 - protein, 23 aa, Mycobacterium
RFAFSVRYTWFRNWVNSPAGTRL

SEQ ID NO: 720035 - protein, 21 aa, Mycobacterium
RFAGDELRRAAHIYTDVDDQN

SEQ ID NO: 720036 - protein, 29 aa, Mycobacterium
RFAGGWIYDRVMAGWDVTVLVGRDEDVRP

SEQ ID NO: 720037 - protein, 26 aa, Mycobacterium
RFAGHCRRSSWQRAVRANAILNEDCI

SEQ ID NO: 720038 - protein, 18 aa, Mycobacterium
RFAGLALEGELQFDQNTS

SEQ ID NO: 720039 - protein, 17 aa, Mycobacterium
RFAGLIRAFNALFPGRM

SEQ ID NO: 720040 - protein, 22 aa, Mycobacterium
RFAGMLVAGVFLREFVADSVDW

SEQ ID NO: 720041 - protein, 19 aa, Mycobacterium
RFAGPIVVIELDMRFGGLD

SEQ ID NO: 720042 - protein, 19 aa, Mycobacterium
RFAGPRRHGKWLVLPTDGP

SEQ ID NO: 720043 - protein, 18 aa, Mycobacterium
RFAIPVQSCVLCHVTTTM

SEQ ID NO: 720044 - protein, 24 aa, Mycobacterium
RFAKRGVPFAALVTYRDLGIEPVK

SEQ ID NO: 720045 - protein, 19 aa, Mycobacterium
RFALNGGEPVDCDGFELFL

SEQ ID NO: 720046 - protein, 33 aa, Mycobacterium
RFAMEFCAAESCGKCTPCRVGSVRGMEVIDRIT

SEQ ID NO: 720047 - protein, 21 aa, Mycobacterium
RFANAVVRFGNRQECIGELRS

SEQ ID NO: 720048 - protein, 18 aa, Mycobacterium
RFAPEGPMGRLCAETAER

SEQ ID NO: 720049 - protein, 19 aa, Mycobacterium
RFAPRPAAGLEPIRAQSSS

SEQ ID NO: 720050 - protein, 19 aa, Mycobacterium
RFAPRPDVDADGWRGRPVA

SEQ ID NO: 720051 - protein, 21 aa, Mycobacterium
RFAQFTKPVTLVWGMGDRCFK

SEQ ID NO: 720052 - protein, 20 aa, Mycobacterium
RFAQIAAIAFSPRPVPTVSV

SEQ ID NO: 720053 - protein, 17 aa, Mycobacterium
RFARFFAGGEHGSGAGA

SEQ ID NO: 720054 - protein, 19 aa, Mycobacterium
RFARPLTFGTAGLRGPVRG

SEQ ID NO: 720055 - protein, 19 aa, Mycobacterium
RFARTAGYRRVGLWTNDVL

SEQ ID NO: 720056 - protein, 24 aa, Mycobacterium
RFASILDPFGHRWTVMTRVENLTA

SEQ ID NO: 720057 - protein, 23 aa, Mycobacterium
RFATCCRALGIAVYDRRRPADLT

SEQ ID NO: 720058 - protein, 23 aa, Mycobacterium
RFATCCRALGISVYQRRRPADLV

SEQ ID NO: 720059 - protein, 22 aa, Mycobacterium
RFATCCRALGIVVYQRQRPADL

SEQ ID NO: 720060 - protein, 22 aa, Mycobacterium
RFATCCRALGLSVHERRRPADL

SEQ ID NO: 720061 - protein, 27 aa, Mycobacterium
RFATLLSNAETVFWNGPMGVFEFPAFA

SEQ ID NO: 720062 - protein, 18 aa, Mycobacterium
RFATLVLASVAYRDGQVA

SEQ ID NO: 720063 - protein, 27 aa, Mycobacterium
RFAVRAFDWLTWRLSKKLEDAQRGELG

SEQ ID NO: 720064 - protein, 18 aa, Mycobacterium
RFAVSRYTVREALRRLRD

SEQ ID NO: 720065 - protein, 18 aa, Mycobacterium
RFAVSRYTVREALRRLRE

SEQ ID NO: 720066 - protein, 18 aa, Mycobacterium
RFAYERDGLLGVVDGRHN

SEQ ID NO: 720067 - protein, 20 aa, Mycobacterium
RFCGHPDLRYSVIPSTSPVS

SEQ ID NO: 720068 - protein, 37 aa, Mycobacterium
RFCPQCLRVSNGRWQLSWRLPWIFTCQVHSCLLVDVC

SEQ ID NO: 720069 - protein, 19 aa, Mycobacterium
RFDAAPSYRTFHQLRRLVV

SEQ ID NO: 720070 - protein, 22 aa, Mycobacterium
RFDADGAHRWLRDCVRSAVRGP

SEQ ID NO: 720071 - protein, 19 aa, Mycobacterium
RFDAIVVGAGFSGLYALHH

SEQ ID NO: 720072 - protein, 18 aa, Mycobacterium
RFDALKIFLTLRALGERR

SEQ ID NO: 720073 - protein, 23 aa, Mycobacterium
RFDAMAASWGLPAREPAADSPTE

SEQ ID NO: 720074 - protein, 19 aa, Mycobacterium
RFDAMRFGLRVGDDGTHSA

SEQ ID NO: 720075 - protein, 18 aa, Mycobacterium
RFDAVLLISNLINYPDTQ

SEQ ID NO: 720076 - protein, 18 aa, Mycobacterium
RFDCAAAPGSALLAEEFT

SEQ ID NO: 720077 - protein, 17 aa, Mycobacterium
RFDDIELQFGFFQTSLD

SEQ ID NO: 720078 - protein, 20 aa, Mycobacterium
RFDDWMTIFGGWRGEVPSTI

SEQ ID NO: 720079 - protein, 20 aa, Mycobacterium
RFDEAMKWFHYIFDPTDTEQ

SEQ ID NO: 720080 - protein, 24 aa, Mycobacterium
RFDECVPEHMWAMHRRIPGSRFEF

SEQ ID NO: 720081 - protein, 23 aa, Mycobacterium
RFDEQANIRWARALEQAGVHVAY

SEQ ID NO: 720082 - protein, 24 aa, Mycobacterium
RFDEQANIRWARALEQAGVHVVYG

SEQ ID NO: 720083 - protein, 23 aa, Mycobacterium
RFDEQANIRWARQLEQAGVHVAY

SEQ ID NO: 720084 - protein, 21 aa, Mycobacterium
RFDEWMTIFAGWRGPVPDKIE

SEQ ID NO: 720085 - protein, 21 aa, Mycobacterium
RFDEWMTIFAGWRSPVPDTIE

SEQ ID NO: 720086 - protein, 21 aa, Mycobacterium
RFDFNEVFFTDVFVADDMLVG

SEQ ID NO: 720087 - protein, 29 aa, Mycobacterium
RFDFRGTDTTIAWKGDEAIELTSSTEERV

SEQ ID NO: 720088 - protein, 25 aa, Mycobacterium
RFDFRGTDTTIEWQGEEGIILVSST

SEQ ID NO: 720089 - protein, 24 aa, Mycobacterium
RFDGGLWWLRARLTTPIDGSGLSV

SEQ ID NO: 720090 - protein, 22 aa, Mycobacterium
RFDGLPRIVQRLADAAAADAMI

SEQ ID NO: 720091 - protein, 23 aa, Mycobacterium
RFDGRRWLLARRIILFDESVIRM

SEQ ID NO: 720092 - protein, 18 aa, Mycobacterium
RFDGRVAVVTGAGRGLGR

SEQ ID NO: 720093 - protein, 18 aa, Mycobacterium
RFDHSASVLAPFADFDQV

SEQ ID NO: 720094 - protein, 18 aa, Mycobacterium
RFDIPGATAEFHLPGHPG

SEQ ID NO: 720095 - protein, 23 aa, Mycobacterium
RFDLAAREFLLFPTVAHSHAERV

SEQ ID NO: 720096 - protein, 18 aa, Mycobacterium
RFDLARYRIGVSVVVPGA

SEQ ID NO: 720097 - protein, 21 aa, Mycobacterium
RFDLSTIRVLWHMAAPCPVWL

SEQ ID NO: 720098 - protein, 19 aa, Mycobacterium
RFDNDACELLARFLDTQTL

SEQ ID NO: 720099 - protein, 21 aa, Mycobacterium
RFDPAAAWAMAARERVMSLSI

SEQ ID NO: 720100 - protein, 23 aa, Mycobacterium
RFDPEAKPGISNLLTIQSAVTGT

SEQ ID NO: 720101 - protein, 18 aa, Mycobacterium
RFDPELSASLRASARRRD

SEQ ID NO: 720102 - protein, 19 aa, Mycobacterium
RFDRDVVLREAANLESAGG

SEQ ID NO: 720103 - protein, 18 aa, Mycobacterium
RFDRGGMIYAEFEPGRAL

SEQ ID NO: 720104 - protein, 17 aa, Mycobacterium
RFDRSTGQWVIIAALRQ

SEQ ID NO: 720105 - protein, 18 aa, Mycobacterium
RFDRWQRLLGVLDLFTPR

SEQ ID NO: 720106 - protein, 19 aa, Mycobacterium
RFDSETWDAAFALVESDVL

SEQ ID NO: 720107 - protein, 18 aa, Mycobacterium
RFDVDDVYLGNGVSELIT

SEQ ID NO: 720108 - protein, 18 aa, Mycobacterium
RFDVDWAEYGFADESARH

SEQ ID NO: 720109 - protein, 19 aa, Mycobacterium
RFDYMYKFVSTRKIQPGTS

SEQ ID NO: 720110 - protein, 19 aa, Mycobacterium
RFEALSAAAFDADWITSLS

SEQ ID NO: 720111 - protein, 24 aa, Mycobacterium
RFEARQGFRILLPDPREIADIVAI

SEQ ID NO: 720112 - protein, 25 aa, Mycobacterium
RFEDMMKIHMGVAMISSSIAEKVVA

SEQ ID NO: 720113 - protein, 22 aa, Mycobacterium
RFEEACQVLRGLLSQETTTSDG

SEQ ID NO: 720114 - protein, 35 aa, Mycobacterium
RFEGKSVRSAHAVFCRAVIVGPPLELVLDVVHEGR

SEQ ID NO: 720115 - protein, 26 aa, Mycobacterium
RFEGLSIDHLEMFNAADRFWARFQAD

SEQ ID NO: 720116 - protein, 18 aa, Mycobacterium
RFEGRYVSFDGVAFEPKP

SEQ ID NO: 720117 - protein, 19 aa, Mycobacterium
RFEHITYSWIPREQNSYAD

SEQ ID NO: 720118 - protein, 19 aa, Mycobacterium
RFEHVEVWWGRPMTGCSED

SEQ ID NO: 720119 - protein, 17 aa, Mycobacterium
RFEKRLRAPAAKMHADE

SEQ ID NO: 720120 - protein, 19 aa, Mycobacterium
RFELDTFLGSIANYRVDHV

SEQ ID NO: 720121 - protein, 18 aa, Mycobacterium
RFELTLNPVRLIRSAVDA

SEQ ID NO: 720122 - protein, 22 aa, Mycobacterium
RFENGEMRFAPDLRTNIENGDA

SEQ ID NO: 720123 - protein, 18 aa, Mycobacterium
RFEPAEFLRLVTSHRVTF

SEQ ID NO: 720124 - protein, 21 aa, Mycobacterium
RFEPPAPHMARYVTRDVSLYD

SEQ ID NO: 720125 - protein, 27 aa, Mycobacterium
RFEQAADAVMRWGMQRGAGLGVVASSD

SEQ ID NO: 720126 - protein, 20 aa, Mycobacterium
RFEQEIVDRVLAAGAEPTPV

SEQ ID NO: 720127 - protein, 19 aa, Mycobacterium
RFEQGIVWVNDHHRLDPCS

SEQ ID NO: 720128 - protein, 27 aa, Mycobacterium
RFERAADAVMRWGMQRGAGLGVRASSE

SEQ ID NO: 720129 - protein, 18 aa, Mycobacterium
RFERAGNDGMQWGMLRGA

SEQ ID NO: 720130 - protein, 23 aa, Mycobacterium
RFEREMADLYGIRSVGHPKARRL

SEQ ID NO: 720131 - protein, 17 aa, Mycobacterium
RFERLAAEWGERAKPLV

SEQ ID NO: 720132 - protein, 23 aa, Mycobacterium
RFESIGMDFDHDGLRDDALADLD

SEQ ID NO: 720133 - protein, 19 aa, Mycobacterium
RFESMLEVYSAYKGRTGRE

SEQ ID NO: 720134 - protein, 17 aa, Mycobacterium
RFETALRGLPEKQRHAS

SEQ ID NO: 720135 - protein, 19 aa, Mycobacterium
RFETGRLALQAAGAVVAYL

SEQ ID NO: 720136 - protein, 19 aa, Mycobacterium
RFETGRLALQAAGSVVAYL

SEQ ID NO: 720137 - protein, 18 aa, Mycobacterium
RFEVEIAGAHVAVLGRGV

SEQ ID NO: 720138 - protein, 18 aa, Mycobacterium
RFEVSRYTIREALRRLRD

SEQ ID NO: 720139 - protein, 19 aa, Mycobacterium
RFFAAPGSWTVRALSKAGN

SEQ ID NO: 720140 - protein, 19 aa, Mycobacterium
RFFAAPGSWTVRALSKVGN

SEQ ID NO: 720141 - protein, 20 aa, Mycobacterium
RFFAAPGTWTVRALSSAGNG

SEQ ID NO: 720142 - protein, 19 aa, Mycobacterium
RFFDDFFLDAARRGVRQSV

SEQ ID NO: 720143 - protein, 19 aa, Mycobacterium
RFFEGKPLRTGEQIRDIAW

SEQ ID NO: 720144 - protein, 25 aa, Mycobacterium
RFFFPAYLGPFGWLGLDLTAAAAVD

SEQ ID NO: 720145 - protein, 24 aa, Mycobacterium
RFFRALPEMAVRWQADTPPDARLL

SEQ ID NO: 720146 - protein, 17 aa, Mycobacterium
RFFTMIGTLIRGRVTVG

SEQ ID NO: 720147 - protein, 19 aa, Mycobacterium
RFGAALAELDGGYRVGDAP

SEQ ID NO: 720148 - protein, 24 aa, Mycobacterium
RFGADLPPLEGIYLAAFAGGPVLL

SEQ ID NO: 720149 - protein, 24 aa, Mycobacterium
RFGADLPPLEGIYLAAFAGQPVLL

SEQ ID NO: 720150 - protein, 18 aa, Mycobacterium
RFGAENLMLVSAGTGHRP

SEQ ID NO: 720151 - protein, 19 aa, Mycobacterium
RFGAVDALVNVAAKEDVFG

SEQ ID NO: 720152 - protein, 19 aa, Mycobacterium
RFGAYRVSIELTHHGHPLD

SEQ ID NO: 720153 - protein, 19 aa, Mycobacterium
RFGDAFIPMDECLAHAAVD

SEQ ID NO: 720154 - protein, 18 aa, Mycobacterium
RFGDAFIPMDETLAHAVV

SEQ ID NO: 720155 - protein, 18 aa, Mycobacterium
RFGDILVRGLTEFLESAV

SEQ ID NO: 720156 - protein, 17 aa, Mycobacterium
RFGDLVFDTVITRTVRF

SEQ ID NO: 720157 - protein, 19 aa, Mycobacterium
RFGDNLAELHRYAGTSFPD

SEQ ID NO: 720158 - protein, 20 aa, Mycobacterium
RFGDVGGELHRAATQFADDV

SEQ ID NO: 720159 - protein, 21 aa, Mycobacterium
RFGEIRVGFRTVKVGAFPISI

SEQ ID NO: 720160 - protein, 19 aa, Mycobacterium
RFGERIGALALAIRSGDAD

SEQ ID NO: 720161 - protein, 19 aa, Mycobacterium
RFGEVKSNVTAAVANAHGL

SEQ ID NO: 720162 - protein, 22 aa, Mycobacterium
RFGGLARHHVDIGWGDATKHRQ

SEQ ID NO: 720163 - protein, 21 aa, Mycobacterium
RFGGVRLRLGDHPYAAELASL

SEQ ID NO: 720164 - protein, 17 aa, Mycobacterium
RFGHLPCVVLGQDRRGQ

SEQ ID NO: 720165 - protein, 20 aa, Mycobacterium
RFGLDRIIVNSAADWGRSDP

SEQ ID NO: 720166 - protein, 21 aa, Mycobacterium
RFGLLHVYPLMPIPEGRAARA

SEQ ID NO: 720167 - protein, 25 aa, Mycobacterium
RFGLVARGGLRWSDRHDDYRTEVLG

SEQ ID NO: 720168 - protein, 27 aa, Mycobacterium
RFGNAGWSHFYCWAVPLNYPPDPSCVS

SEQ ID NO: 720169 - protein, 17 aa, Mycobacterium
RFGNCYLEPDAIEAHVR

SEQ ID NO: 720170 - protein, 18 aa, Mycobacterium
RFGNLYFGTSLPALCDLA

SEQ ID NO: 720171 - protein, 31 aa, Mycobacterium
RFGNRAAIMSATWLRAVERFHEHALRALHSA

SEQ ID NO: 720172 - protein, 17 aa, Mycobacterium
RFGPPPGRVQQREAPPD

SEQ ID NO: 720173 - protein, 20 aa, Mycobacterium
RFGPTQADGRYLLRTAAGDE

SEQ ID NO: 720174 - protein, 17 aa, Mycobacterium
RFGQPEITLGILPGLGG

SEQ ID NO: 720175 - protein, 18 aa, Mycobacterium
RFGRAMITALARLGGHPV

SEQ ID NO: 720176 - protein, 17 aa, Mycobacterium
RFGRLDALVLTALGGPR

SEQ ID NO: 720177 - protein, 17 aa, Mycobacterium
RFGRRPRFSELAKTLAA

SEQ ID NO: 720178 - protein, 23 aa, Mycobacterium
RFGRSKFGQFMARHIARRTDPIL

SEQ ID NO: 720179 - protein, 19 aa, Mycobacterium
RFGSDPHPRYRASAQSQLL

SEQ ID NO: 720180 - protein, 29 aa, Mycobacterium
RFGSDQQEFRWSRFKNEEPAVMFATVGEK

SEQ ID NO: 720181 - protein, 20 aa, Mycobacterium
RFGTEPDLAEALVCAAARET

SEQ ID NO: 720182 - protein, 19 aa, Mycobacterium
RFGVELVECTEFFKDTTFR

SEQ ID NO: 720183 - protein, 20 aa, Mycobacterium
RFGVERSWRSLASLRAWSAA

SEQ ID NO: 720184 - protein, 24 aa, Mycobacterium
RFGVGGSLERFVRLPFTQHDDQLL

SEQ ID NO: 720185 - protein, 26 aa, Mycobacterium
RFGVSRPTLREAFRVLESESLIQVQR

SEQ ID NO: 720186 - protein, 18 aa, Mycobacterium
RFGYHLGRVDMGWETWKV

SEQ ID NO: 720187 - protein, 20 aa, Mycobacterium
RFHETFCAVVYFGSDEHEWA

SEQ ID NO: 720188 - protein, 23 aa, Mycobacterium
RFHNHLYDVYGLDFLYKAFTTTD

SEQ ID NO: 720189 - protein, 17 aa, Mycobacterium
RFHNWKIVFQEQRCQGT

SEQ ID NO: 720190 - protein, 21 aa, Mycobacterium
RFHPFDVFRREITIKGSFAEM

SEQ ID NO: 720191 - protein, 17 aa, Mycobacterium
RFHPLFERALSRYVGAR

SEQ ID NO: 720192 - protein, 18 aa, Mycobacterium
RFHTLMAEMSGEVFDATL

SEQ ID NO: 720193 - protein, 18 aa, Mycobacterium
RFHTLMAEMSGEVFDSAL

SEQ ID NO: 720194 - protein, 24 aa, Mycobacterium
RFHTVYWPAFLMSAGIALPQRVFA

SEQ ID NO: 720195 - protein, 26 aa, Mycobacterium
RFHTVYWPAFLMSAGIDLPRRVFAHG

SEQ ID NO: 720196 - protein, 26 aa, Mycobacterium
RFHTVYWPAFLMSAGIELPRRVFAHG

SEQ ID NO: 720197 - protein, 23 aa, Mycobacterium
RFHTVYWPAFLMSAGLPLPKRIF

SEQ ID NO: 720198 - protein, 18 aa, Mycobacterium
RFHVVPVLAYSADPGPVN

SEQ ID NO: 720199 - protein, 18 aa, Mycobacterium
RFHVVPVLAYSPDPGPVA

SEQ ID NO: 720200 - protein, 18 aa, Mycobacterium
RFIAELPFSLDDFQRRAC

SEQ ID NO: 720201 - protein, 21 aa, Mycobacterium
RFIEMSGRRGARGYRAVVPTS

SEQ ID NO: 720202 - protein, 24 aa, Mycobacterium
RFIGGDPHGGVWLRTQAERLGLHQ

SEQ ID NO: 720203 - protein, 26 aa, Mycobacterium
RFIGGRPSTFGWIPFGGGTRRCVGAA

SEQ ID NO: 720204 - protein, 25 aa, Mycobacterium
RFIREADVASALWHPNIVRVNDRGE

SEQ ID NO: 720205 - protein, 27 aa, Mycobacterium
RFIRFCDAFNIPLVFVVDTPGFLPGAE

SEQ ID NO: 720206 - protein, 27 aa, Mycobacterium
RFIRFCDSFNIPLVFVVDTPGFLPGAE

SEQ ID NO: 720207 - protein, 24 aa, Mycobacterium
RFIVTDIFPGGRLPMIETVEEHAQ

SEQ ID NO: 720208 - protein, 24 aa, Mycobacterium
RFIVTEIYPGGRIPLIAMVEDRAT

SEQ ID NO: 720209 - protein, 24 aa, Mycobacterium
RFKDWLTIHRVWRSKLPEDIDKGT

SEQ ID NO: 720210 - protein, 23 aa, Mycobacterium
RFKFASELEFYLSCTPPRQAWDL

SEQ ID NO: 720211 - protein, 22 aa, Mycobacterium
RFKGHALAAAGIDCPAVYSTET

SEQ ID NO: 720212 - protein, 21 aa, Mycobacterium
RFKNMHVEGGRHYNPGWNLAI

SEQ ID NO: 720213 - protein, 26 aa, Mycobacterium
RFKQYERLWLSWAMANRDPAVFDEPN

SEQ ID NO: 720214 - protein, 26 aa, Mycobacterium
RFLANMPGYRGWQWAVVVAAYPGADR

SEQ ID NO: 720215 - protein, 20 aa, Mycobacterium
RFLATFALMLRRVSLSATEL

SEQ ID NO: 720216 - protein, 19 aa, Mycobacterium
RFLDEAGWDPRTRVLSLLA

SEQ ID NO: 720217 - protein, 26 aa, Mycobacterium
RFLDSEIPVVGALAPDFGWAPWQGEA

SEQ ID NO: 720218 - protein, 20 aa, Mycobacterium
RFLDSVWRPRRERADRILRR

SEQ ID NO: 720219 - protein, 19 aa, Mycobacterium
RFLEIAADVGVHVELTPGD

SEQ ID NO: 720220 - protein, 19 aa, Mycobacterium
RFLEREGWIAWSGPAISEL

SEQ ID NO: 720221 - protein, 17 aa, Mycobacterium
RFLEVGRRHPVGGYFAG

SEQ ID NO: 720222 - protein, 20 aa, Mycobacterium
RFLFFTGKGGVGKTSIACAA

SEQ ID NO: 720223 - protein, 25 aa, Mycobacterium
RFLFGLDLIDRVVFWMLPLDDPLPW

SEQ ID NO: 720224 - protein, 19 aa, Mycobacterium
RFLGLDVGVILAQMTPEER

SEQ ID NO: 720225 - protein, 18 aa, Mycobacterium
RFLGPALGSLHLFFHRLG

SEQ ID NO: 720226 - protein, 25 aa, Mycobacterium
RFLLGLDLVDRVLFWMLPLDDPLPW

SEQ ID NO: 720227 - protein, 18 aa, Mycobacterium
RFLLLDLAEQVMPEVGKK

SEQ ID NO: 720228 - protein, 21 aa, Mycobacterium
RFLLTAGAIGSLFKERASISG

SEQ ID NO: 720229 - protein, 20 aa, Mycobacterium
RFLPGDALMQRGYLRPSTVA

SEQ ID NO: 720230 - protein, 24 aa, Mycobacterium
RFLPPTFRGEMIWCQLFSEPGAGS

SEQ ID NO: 720231 - protein, 23 aa, Mycobacterium
RFLPRTVLLPAIRIGNRLRGGPG

SEQ ID NO: 720232 - protein, 27 aa, Mycobacterium
RFLPVEELIAAFLPVLFPGMEIVEHHA

SEQ ID NO: 720233 - protein, 21 aa, Mycobacterium
RFLQLCDAFGIPVVSLVDCPG

SEQ ID NO: 720234 - protein, 25 aa, Mycobacterium
RFLQLCDAFGLPVLSLVDCPGYMVG

SEQ ID NO: 720235 - protein, 24 aa, Mycobacterium
RFLQLCDAFGLPVVSLIDCPGYMV

SEQ ID NO: 720236 - protein, 18 aa, Mycobacterium
RFLRGVLGFKKSDEIYTF

SEQ ID NO: 720237 - protein, 22 aa, Mycobacterium
RFLRQMGIDEPVEWSPLPQNCC

SEQ ID NO: 720238 - protein, 19 aa, Mycobacterium
RFLTADPRRGRLLVESQAT

SEQ ID NO: 720239 - protein, 25 aa, Mycobacterium
RFLTGPGDRSGWSMIFEDLGRRRRP

SEQ ID NO: 720240 - protein, 17 aa, Mycobacterium
RFLTRNRLVAAVSGAAV

SEQ ID NO: 720241 - protein, 19 aa, Mycobacterium
RFLVGLAVVELMAAAAAAK

SEQ ID NO: 720242 - protein, 18 aa, Mycobacterium
RFLYYPAENHWVLTPQHA

SEQ ID NO: 720243 - protein, 24 aa, Mycobacterium
RFMEVLKPVLAFVDFGEYAAMKCT

SEQ ID NO: 720244 - protein, 19 aa, Mycobacterium
RFMIKAEMQQVRIVNFLIK

SEQ ID NO: 720245 - protein, 24 aa, Mycobacterium
RFMKSMCQRLSVPLLHLRGEADPY

SEQ ID NO: 720246 - protein, 20 aa, Mycobacterium
RFMKSMRRQLGVPLLHLRGD

SEQ ID NO: 720247 - protein, 19 aa, Mycobacterium
RFMLKDPIYGLGPRVAQLV

SEQ ID NO: 720248 - protein, 18 aa, Mycobacterium
RFNAVAVTNGHAWSNDAY

SEQ ID NO: 720249 - protein, 29 aa, Mycobacterium
RFNELVMRARLTWQQVVLLRAYAKYLRQA

SEQ ID NO: 720250 - protein, 19 aa, Mycobacterium
RFNIFVLKLPIRPPALVAK

SEQ ID NO: 720251 - protein, 19 aa, Mycobacterium
RFNLRGERLGLVAGGAVLK

SEQ ID NO: 720252 - protein, 19 aa, Mycobacterium
RFNLSELFYGYTGTSTDTL

SEQ ID NO: 720253 - protein, 24 aa, Mycobacterium
RFNRLSPTGDRWMNFPGNDGAVPG

SEQ ID NO: 720254 - protein, 19 aa, Mycobacterium
RFNRPSEVIAHQHLKDRDR

SEQ ID NO: 720255 - protein, 18 aa, Mycobacterium
RFPDAVKYSVKFGKPLVL

SEQ ID NO: 720256 - protein, 20 aa, Mycobacterium
RFPDKSIRSVYTVFARAVMV

SEQ ID NO: 720257 - protein, 26 aa, Mycobacterium
RFPDLKICLSEGGIGWVAGLLDRLDH

SEQ ID NO: 720258 - protein, 20 aa, Mycobacterium
RFPDLPVKLIDAGKDYEEVV

SEQ ID NO: 720259 - protein, 18 aa, Mycobacterium
RFPDLTVAEGFDIQRAQV

SEQ ID NO: 720260 - protein, 26 aa, Mycobacterium
RFPELKICLSEGGIGWVAGLLDRLDH

SEQ ID NO: 720261 - protein, 21 aa, Mycobacterium
RFPEVRAAGAGSRRETRVLRG

SEQ ID NO: 720262 - protein, 22 aa, Mycobacterium
RFPEYPKGITVPALVDIPTGAV

SEQ ID NO: 720263 - protein, 35 aa, Mycobacterium
RFPGAQMLFDLPPRWFSLFTRLGMRTSIRYKIPPM

SEQ ID NO: 720264 - protein, 18 aa, Mycobacterium
RFPGCTRPSTLTDIDHTI

SEQ ID NO: 720265 - protein, 17 aa, Mycobacterium
RFPGGSIGALAVHGTCN

SEQ ID NO: 720266 - protein, 19 aa, Mycobacterium
RFPHQKVFRQWSRDDAAAV

SEQ ID NO: 720267 - protein, 17 aa, Mycobacterium
RFPQIGWEITPGNSSPL

SEQ ID NO: 720268 - protein, 21 aa, Mycobacterium
RFPSAMARLQRAMWIPPARYQ

SEQ ID NO: 720269 - protein, 21 aa, Mycobacterium
RFPSSSFSFFHYVDMLGLTAK

SEQ ID NO: 720270 - protein, 18 aa, Mycobacterium
RFPSYLVEHMTGVEEKVR

SEQ ID NO: 720271 - protein, 24 aa, Mycobacterium
RFPTADDVVVDWPHRYLAAQAAAG

SEQ ID NO: 720272 - protein, 18 aa, Mycobacterium
RFPTKEKLFGQVVRREAE

SEQ ID NO: 720273 - protein, 20 aa, Mycobacterium
RFQAEIDRLFELAKERGKTN

SEQ ID NO: 720274 - protein, 21 aa, Mycobacterium
RFQDLIARPWSRLASGCEPNR

SEQ ID NO: 720275 - protein, 21 aa, Mycobacterium
RFQFGRAIGSFQALKHMAADL

SEQ ID NO: 720276 - protein, 17 aa, Mycobacterium
RFQIGRWQYRDLIREQI

SEQ ID NO: 720277 - protein, 28 aa, Mycobacterium
RFQREWGEPARYIWKLEFQRRGAPHIHL

SEQ ID NO: 720278 - protein, 40 aa, Mycobacterium
RFQREWGEPARYIWKLEFQRRGAPHIHLWMTPPPAVGRSG

SEQ ID NO: 720279 - protein, 21 aa, Mycobacterium
RFRAAVRQVKIGAGEGSRDIP

SEQ ID NO: 720280 - protein, 23 aa, Mycobacterium
RFRAELDIPLILLGGITGGESMD

SEQ ID NO: 720281 - protein, 22 aa, Mycobacterium
RFRAMCEARGLPAARVGVVDQA

SEQ ID NO: 720282 - protein, 25 aa, Mycobacterium
RFRAMCEARGLPAVRIGVVDQASEV

SEQ ID NO: 720283 - protein, 20 aa, Mycobacterium
RFRATKFRRADAVAKLSEIA

SEQ ID NO: 720284 - protein, 17 aa, Mycobacterium
RFRDDLDAWVAILTANG

SEQ ID NO: 720285 - protein, 23 aa, Mycobacterium
RFRDEMRLPWDATRQRRFDRLIG

SEQ ID NO: 720286 - protein, 20 aa, Mycobacterium
RFRDKFGVIVLNSYGQTELG

SEQ ID NO: 720287 - protein, 19 aa, Mycobacterium
RFRDMLSYAREEGVTFEVA

SEQ ID NO: 720288 - protein, 18 aa, Mycobacterium
RFRHMAQFNRWRPDRTPR

SEQ ID NO: 720289 - protein, 25 aa, Mycobacterium
RFRHRRVGFIFQFFNLLPTLSAWEN

SEQ ID NO: 720290 - protein, 21 aa, Mycobacterium
RFRKVPMVFGHEGAGTVIDAG

SEQ ID NO: 720291 - protein, 18 aa, Mycobacterium
RFRLVPIEDDPVWARVDI

SEQ ID NO: 720292 - protein, 18 aa, Mycobacterium
RFRNHLLEAGICGEDELS

SEQ ID NO: 720293 - protein, 21 aa, Mycobacterium
RFRQLCLVGWPTVLQRIDELL

SEQ ID NO: 720294 - protein, 21 aa, Mycobacterium
RFRQLGPINWVIAKLGARTVR

SEQ ID NO: 720295 - protein, 24 aa, Mycobacterium
RFRRAVPTGRVFRCGQGARVEFAV

SEQ ID NO: 720296 - protein, 21 aa, Mycobacterium
RFRRELRLLEDLHHPNVISVL

SEQ ID NO: 720297 - protein, 29 aa, Mycobacterium
RFRRMLSKPFTFKRVEGLRPTIQQITDDH

SEQ ID NO: 720298 - protein, 23 aa, Mycobacterium
RFRRRVFVYARDWPGESPLQASY

SEQ ID NO: 720299 - protein, 21 aa, Mycobacterium
RFRRRVYVYAREWPGESPLQS

SEQ ID NO: 720300 - protein, 19 aa, Mycobacterium
RFRRSPVALRRTRWKIWKF

SEQ ID NO: 720301 - protein, 22 aa, Mycobacterium
RFRSIRIDQSWRGIILAPEAGD

SEQ ID NO: 720302 - protein, 25 aa, Mycobacterium
RFRSMCEARGLPAVRIGVVDQASDE

SEQ ID NO: 720303 - protein, 20 aa, Mycobacterium
RFRVAGIAVHLLGKPAHTNL

SEQ ID NO: 720304 - protein, 19 aa, Mycobacterium
RFRVGELDPGAPLGACHCI

SEQ ID NO: 720305 - protein, 19 aa, Mycobacterium
RFRVLAFDLPWHGKSLPPD

SEQ ID NO: 720306 - protein, 21 aa, Mycobacterium
RFRVQRPIRVTSWPPKGTDRG

SEQ ID NO: 720307 - protein, 17 aa, Mycobacterium
RFRVRMTAYFVFDESET

SEQ ID NO: 720308 - protein, 19 aa, Mycobacterium
RFSAPPIEHGVPFQVQLGI

SEQ ID NO: 720309 - protein, 23 aa, Mycobacterium
RFSDDEYLRCWLAERGAQFPVWA

SEQ ID NO: 720310 - protein, 25 aa, Mycobacterium
RFSDEFGIQVANTFHGKGVMPDDHR

SEQ ID NO: 720311 - protein, 18 aa, Mycobacterium
RFSDMAGLVDTFAANVTA

SEQ ID NO: 720312 - protein, 18 aa, Mycobacterium
RFSDVLPLIQNAGAAAEL

SEQ ID NO: 720313 - protein, 20 aa, Mycobacterium
RFSEDLDLLVLGEFPNVRTA

SEQ ID NO: 720314 - protein, 30 aa, Mycobacterium
RFSEYKPRWGTSLATGWASIHGFPVGILAN

SEQ ID NO: 720315 - protein, 30 aa, Mycobacterium
RFSFNVKGGRCEACSGDGTIKIEMNFLPDV

SEQ ID NO: 720316 - protein, 28 aa, Mycobacterium
RFSFNVKGGRCEACTGDGTIKIEMNFLP

SEQ ID NO: 720317 - protein, 30 aa, Mycobacterium
RFSKKDADAWPKWNAWLEGIADVMGPLLTQ

SEQ ID NO: 720318 - protein, 21 aa, Mycobacterium
RFSLPGLPAPYVIAQVAIDED

SEQ ID NO: 720319 - protein, 19 aa, Mycobacterium
RFSNHLLFRSTLDPRLREL

SEQ ID NO: 720320 - protein, 23 aa, Mycobacterium
RFSNSRPPGFVLPGAPQISAEEQ

SEQ ID NO: 720321 - protein, 20 aa, Mycobacterium
RFSPFSGFGFFASGLSGFAE

SEQ ID NO: 720322 - protein, 26 aa, Mycobacterium
RFSRTSRTTWALRTWGLPEYAGIDHA

SEQ ID NO: 720323 - protein, 23 aa, Mycobacterium
RFSSDLLIGLGIEPCIDELLDAD

SEQ ID NO: 720324 - protein, 22 aa, Mycobacterium
RFSTELLIGLGIDPPIEELISA

SEQ ID NO: 720325 - protein, 20 aa, Mycobacterium
RFSTEWSDPVSRLGDYVNSL

SEQ ID NO: 720326 - protein, 19 aa, Mycobacterium
RFSTLKARLGDAFEVIEID

SEQ ID NO: 720327 - protein, 19 aa, Mycobacterium
RFSYEAAYTLRALTGLHLE

SEQ ID NO: 720328 - protein, 25 aa, Mycobacterium
RFTAACRRVPGLAGRALGGGRPACD

SEQ ID NO: 720329 - protein, 21 aa, Mycobacterium
RFTAHDGLRLTAFVTNTVRGQ

SEQ ID NO: 720330 - protein, 19 aa, Mycobacterium
RFTARCLGVPDCGHLLDEE

SEQ ID NO: 720331 - protein, 26 aa, Mycobacterium
RFTAYDCARLRFILTAQRDNYLPLKV

SEQ ID NO: 720332 - protein, 26 aa, Mycobacterium
RFTAYDCARLRFILTAQRDQYLPLKV

SEQ ID NO: 720333 - protein, 25 aa, Mycobacterium
RFTGPDDFTAWILAHLRADVVMARE

SEQ ID NO: 720334 - protein, 19 aa, Mycobacterium
RFTLLRPLLFTIAYEMLGS

SEQ ID NO: 720335 - protein, 18 aa, Mycobacterium
RFTLLRPLLFTIVYEILG

SEQ ID NO: 720336 - protein, 20 aa, Mycobacterium
RFTLTHFGLFGFAVMSCATL

SEQ ID NO: 720337 - protein, 19 aa, Mycobacterium
RFTPADAIDICYPAPGAES

SEQ ID NO: 720338 - protein, 18 aa, Mycobacterium
RFTPEAAERTAVPGVATG

SEQ ID NO: 720339 - protein, 18 aa, Mycobacterium
RFTPGASLRAKRSRDGGT

SEQ ID NO: 720340 - protein, 20 aa, Mycobacterium
RFTRQEFGTPISYVDFTIAF

SEQ ID NO: 720341 - protein, 19 aa, Mycobacterium
RFTTAGIRKTWVFQAFDDD

SEQ ID NO: 720342 - protein, 21 aa, Mycobacterium
RFTTKNLKKFIGGLRVSEATP

SEQ ID NO: 720343 - protein, 20 aa, Mycobacterium
RFTWERIAFDALNIYRQVSS

SEQ ID NO: 720344 - protein, 24 aa, Mycobacterium
RFVACPFGAAGARMYRTGDLVRWG

SEQ ID NO: 720345 - protein, 25 aa, Mycobacterium
RFVACPFGAAGLRMYRTGDLACWGA

SEQ ID NO: 720346 - protein, 24 aa, Mycobacterium
RFVACPFGAPGARMYRTGDLVCWG

SEQ ID NO: 720347 - protein, 24 aa, Mycobacterium
RFVACPFGGAGTRMYRTGDLVRWR

SEQ ID NO: 720348 - protein, 24 aa, Mycobacterium
RFVACPFGGAGTRMYRTGDLVWWD

SEQ ID NO: 720349 - protein, 29 aa, Mycobacterium
RFVACPFGGSGARMYRTGDLVRWGADGQL

SEQ ID NO: 720350 - protein, 21 aa, Mycobacterium
RFVACPFGMPGDRMYRTGDLV

SEQ ID NO: 720351 - protein, 24 aa, Mycobacterium
RFVAKGKCEIVFDYNFPFTLDAIT

SEQ ID NO: 720352 - protein, 25 aa, Mycobacterium
RFVDHLKGMFAFAIVERDSGRVLLG

SEQ ID NO: 720353 - protein, 21 aa, Mycobacterium
RFVEHRGPLNFYSLYRAHDLH

SEQ ID NO: 720354 - protein, 19 aa, Mycobacterium
RFVEVSAKVNALLDIAQLN

SEQ ID NO: 720355 - protein, 18 aa, Mycobacterium
RFVGFGIMGLPFASGHYL

SEQ ID NO: 720356 - protein, 23 aa, Mycobacterium
RFVGNRPGLGWLPYGGGTRRCVG

SEQ ID NO: 720357 - protein, 19 aa, Mycobacterium
RFVGQRVAAVVADSVAAAE

SEQ ID NO: 720358 - protein, 19 aa, Mycobacterium
RFVGSRLQPAVTRVPDGEP

SEQ ID NO: 720359 - protein, 20 aa, Mycobacterium
RFVHLSSIAAYGWDFPDHVT

SEQ ID NO: 720360 - protein, 25 aa, Mycobacterium
RFVKVYGDNAFRVVVAIFVADFLPR

SEQ ID NO: 720361 - protein, 21 aa, Mycobacterium
RFVLAEARLGAYARELGEEPE

SEQ ID NO: 720362 - protein, 19 aa, Mycobacterium
RFVPEVYHKPLVVAGFEPL

SEQ ID NO: 720363 - protein, 19 aa, Mycobacterium
RFVPHAAVLERATCAVTHG

SEQ ID NO: 720364 - protein, 18 aa, Mycobacterium
RFVREPDVELPLDAPPRV

SEQ ID NO: 720365 - protein, 18 aa, Mycobacterium
RFVREPDVELPLEALPHV

SEQ ID NO: 720366 - protein, 18 aa, Mycobacterium
RFVRSETIPEFLAALQTP

SEQ ID NO: 720367 - protein, 24 aa, Mycobacterium
RFVRVSPTKARRVIDLVRGKSVND

SEQ ID NO: 720368 - protein, 25 aa, Mycobacterium
RFVRVSPTKARRVIDLVRGRSVSDA

SEQ ID NO: 720369 - protein, 20 aa, Mycobacterium
RFWLVGLQGDRHWPALCAAV

SEQ ID NO: 720370 - protein, 17 aa, Mycobacterium
RFWPAHSTVALSVGGLR

SEQ ID NO: 720371 - protein, 19 aa, Mycobacterium
RFYDSCRVLPQGDEEPTQL

SEQ ID NO: 720372 - protein, 20 aa, Mycobacterium
RFYDSCRVLPQGDEQPTDLH

SEQ ID NO: 720373 - protein, 20 aa, Mycobacterium
RFYDSCRVLPQGDERPTDLH

SEQ ID NO: 720374 - protein, 20 aa, Mycobacterium
RFYDSCRVLPQGDETPGDLH

SEQ ID NO: 720375 - protein, 23 aa, Mycobacterium
RFYEGLLGFQFWWELDPPDSATS

SEQ ID NO: 720376 - protein, 24 aa, Mycobacterium
RFYERKEIRDIIAYLRVLDNPGDA

SEQ ID NO: 720377 - protein, 17 aa, Mycobacterium
RFYTEVLGFVVKHDVPM

SEQ ID NO: 720378 - protein, 18 aa, Mycobacterium
RFYTNVLKLGSRNPLLLA

SEQ ID NO: 720379 - protein, 33 aa, Mycobacterium
RFYTTSWRFAPFLWQEIEDGILPALYAAVTPQA

SEQ ID NO: 720380 - protein, 19 aa, Mycobacterium
RGAAAAFEMAFTATVPPPI

SEQ ID NO: 720381 - protein, 17 aa, Mycobacterium
RGAAAGLDELEWQMKAA

SEQ ID NO: 720382 - protein, 20 aa, Mycobacterium
RGAAAYLRRAQGVEVVDCGD

SEQ ID NO: 720383 - protein, 20 aa, Mycobacterium
RGAAELDTLFPGLLTDLVAA

SEQ ID NO: 720384 - protein, 21 aa, Mycobacterium
RGAAGIALLACMPARPGEREL

SEQ ID NO: 720385 - protein, 20 aa, Mycobacterium
RGAAGIALLASMPPRPQERD

SEQ ID NO: 720386 - protein, 18 aa, Mycobacterium
RGAALAAARSTEFSDDLL

SEQ ID NO: 720387 - protein, 20 aa, Mycobacterium
RGAAPEVRYISATVRVNFAK

SEQ ID NO: 720388 - protein, 24 aa, Mycobacterium
RGAARAEQGLPFAREAALARKLGA

SEQ ID NO: 720389 - protein, 19 aa, Mycobacterium
RGAARARKGPGIPGFGRPR

SEQ ID NO: 720390 - protein, 21 aa, Mycobacterium
RGAAVTACASTATVATKTGQI

SEQ ID NO: 720391 - protein, 17 aa, Mycobacterium
RGAAWGVGVGLAVGLFA

SEQ ID NO: 720392 - protein, 20 aa, Mycobacterium
RGADAAYVCRGRACDLPVTT

SEQ ID NO: 720393 - protein, 21 aa, Mycobacterium
RGADGALFRFLAGSKRSVVAD

SEQ ID NO: 720394 - protein, 18 aa, Mycobacterium
RGADGRVIVACFASNVDR

SEQ ID NO: 720395 - protein, 25 aa, Mycobacterium
RGADGWRLDAAYAVPQQFWAKVLPR

SEQ ID NO: 720396 - protein, 19 aa, Mycobacterium
RGADLIAMALEYPLRAIYE

SEQ ID NO: 720397 - protein, 17 aa, Mycobacterium
RGADLLGIELAGTGRHY

SEQ ID NO: 720398 - protein, 21 aa, Mycobacterium
RGADLRANFTIKGVGDPVPLP

SEQ ID NO: 720399 - protein, 18 aa, Mycobacterium
RGADPVFMLTGPIPATRY

SEQ ID NO: 720400 - protein, 19 aa, Mycobacterium
RGADPVFMLTGPIPATRYA

SEQ ID NO: 720401 - protein, 26 aa, Mycobacterium
RGADRCLRVAWTLADLAGRTSPTVED

SEQ ID NO: 720402 - protein, 21 aa, Mycobacterium
RGADTIWVLHVGRLEEELRVP

SEQ ID NO: 720403 - protein, 24 aa, Mycobacterium
RGAEAALDFCAEFDGVRPGTVRVP

SEQ ID NO: 720404 - protein, 19 aa, Mycobacterium
RGAEALGFAGTAPAKSATT

SEQ ID NO: 720405 - protein, 19 aa, Mycobacterium
RGAELGFPTANIAPPMYSA

SEQ ID NO: 720406 - protein, 18 aa, Mycobacterium
RGAELGFPTANVAPPMYS

SEQ ID NO: 720407 - protein, 20 aa, Mycobacterium
RGAEMWSAYSSLSDGETRQS

SEQ ID NO: 720408 - protein, 21 aa, Mycobacterium
RGAEVLSALGDALVAARTSAP

SEQ ID NO: 720409 - protein, 26 aa, Mycobacterium
RGAEYSVDFVPKVRIEVVVDDSVVDK

SEQ ID NO: 720410 - protein, 26 aa, Mycobacterium
RGAEYSVDFVPKVRVEVVVDDAAVDK

SEQ ID NO: 720411 - protein, 25 aa, Mycobacterium
RGAEYSVDFVPKVRVEVVVDDSIVD

SEQ ID NO: 720412 - protein, 19 aa, Mycobacterium
RGAFHGRSGYTLSLTNTDP

SEQ ID NO: 720413 - protein, 27 aa, Mycobacterium
RGAFHWWLVLATLRWGVICQYQAWRHL

SEQ ID NO: 720414 - protein, 21 aa, Mycobacterium
RGAFLVRSWRPYVSGDVLAYA

SEQ ID NO: 720415 - protein, 20 aa, Mycobacterium
RGAGALAVLPHALVYRAGVH

SEQ ID NO: 720416 - protein, 19 aa, Mycobacterium
RGAGEVHLGLTILAEAIAE

SEQ ID NO: 720417 - protein, 21 aa, Mycobacterium
RGAGLLADIRRSDCQLLLVDP

SEQ ID NO: 720418 - protein, 26 aa, Mycobacterium
RGAGRRADFLLGMVVSTGVGGGLVLG

SEQ ID NO: 720419 - protein, 18 aa, Mycobacterium
RGAGWSGPSFASVHVPRA

SEQ ID NO: 720420 - protein, 18 aa, Mycobacterium
RGAHKGFDPEGFQIVLFD

SEQ ID NO: 720421 - protein, 18 aa, Mycobacterium
RGAHQEWQRLIKQRDELE

SEQ ID NO: 720422 - protein, 17 aa, Mycobacterium
RGAHVVLCGAGERERTA

SEQ ID NO: 720423 - protein, 17 aa, Mycobacterium
RGAIFHHFRDKDALFFA

SEQ ID NO: 720424 - protein, 17 aa, Mycobacterium
RGAIGRVSTMFDRPEPT

SEQ ID NO: 720425 - protein, 19 aa, Mycobacterium
RGALHCWANPDGTQRIEDT

SEQ ID NO: 720426 - protein, 20 aa, Mycobacterium
RGALIFRRPAGLVCALNAGD

SEQ ID NO: 720427 - protein, 18 aa, Mycobacterium
RGALKRELVTCLRTGRAL

SEQ ID NO: 720428 - protein, 17 aa, Mycobacterium
RGALLQIALGERPPLER

SEQ ID NO: 720429 - protein, 21 aa, Mycobacterium
RGALPGSVVTPVLKARGRAKV

SEQ ID NO: 720430 - protein, 28 aa, Mycobacterium
RGALPVKLSYAGPFFRYERPQAGRYRQL

SEQ ID NO: 720431 - protein, 19 aa, Mycobacterium
RGALTTALPTPAAREVYLL

SEQ ID NO: 720432 - protein, 24 aa, Mycobacterium
RGALVKLAGLWFDALAAISAHVDA

SEQ ID NO: 720433 - protein, 17 aa, Mycobacterium
RGAMVHALRHEFATQLA

SEQ ID NO: 720434 - protein, 19 aa, Mycobacterium
RGANHPLLRRSVGRRQAVR

SEQ ID NO: 720435 - protein, 24 aa, Mycobacterium
RGANRPTISLALPVPGDVRGLPAG

SEQ ID NO: 720436 - protein, 19 aa, Mycobacterium
RGAPCSDPPLSPAEMLYPA

SEQ ID NO: 720437 - protein, 17 aa, Mycobacterium
RGAPGHGGDACQRIPSV

SEQ ID NO: 720438 - protein, 20 aa, Mycobacterium
RGAPILPCREMEAVPIGEDV

SEQ ID NO: 720439 - protein, 20 aa, Mycobacterium
RGAPKVKIQGFSFWGGVGIK

SEQ ID NO: 720440 - protein, 18 aa, Mycobacterium
RGAPPCTFKETARILAGF

SEQ ID NO: 720441 - protein, 17 aa, Mycobacterium
RGAPRLTAYVATTDTAG

SEQ ID NO: 720442 - protein, 24 aa, Mycobacterium
RGAPRPRPAEMRGRLDMRRTTRHS

SEQ ID NO: 720443 - protein, 22 aa, Mycobacterium
RGAPRSRYSTALPSGVAEASSW

SEQ ID NO: 720444 - protein, 20 aa, Mycobacterium
RGAPTPGFGRISAVRLQVSG

SEQ ID NO: 720445 - protein, 28 aa, Mycobacterium
RGAPVLAICAAIQVLGHWYETSSGERVE

SEQ ID NO: 720446 - protein, 28 aa, Mycobacterium
RGAPVLAICAAVQVLGHWYETSAGERVD

SEQ ID NO: 720447 - protein, 27 aa, Mycobacterium
RGAPVLAICAAVQVLGQWYETSAGERV

SEQ ID NO: 720448 - protein, 27 aa, Mycobacterium
RGAPVPGVYVAGWIKRGPSGFIGTNKS

SEQ ID NO: 720449 - protein, 21 aa, Mycobacterium
RGAQAALEFCESFDGVRPAAV

SEQ ID NO: 720450 - protein, 25 aa, Mycobacterium
RGARAHGAAVRRGRQLGGREHLPEV

SEQ ID NO: 720451 - protein, 18 aa, Mycobacterium
RGAREFESLFPGLLDDMV

SEQ ID NO: 720452 - protein, 23 aa, Mycobacterium
RGARGVRRLRLILEYVDGGAESP

SEQ ID NO: 720453 - protein, 17 aa, Mycobacterium
RGARIVVVAPYEGPLRD

SEQ ID NO: 720454 - protein, 21 aa, Mycobacterium
RGARLAFGDRVLWDHLDLSVS

SEQ ID NO: 720455 - protein, 23 aa, Mycobacterium
RGARLAFGDRVLWDHLDLSVSRG

SEQ ID NO: 720456 - protein, 23 aa, Mycobacterium
RGARLGTGLLRRSRRLCSRTIGR

SEQ ID NO: 720457 - protein, 21 aa, Mycobacterium
RGARLSRSWAPYASGHIAVHA

SEQ ID NO: 720458 - protein, 19 aa, Mycobacterium
RGARNIPCETVPGKRAPTV

SEQ ID NO: 720459 - protein, 20 aa, Mycobacterium
RGARVASGTFIRTAKNGRAA

SEQ ID NO: 720460 - protein, 20 aa, Mycobacterium
RGASLRWVEANAQALPFDTD

SEQ ID NO: 720461 - protein, 20 aa, Mycobacterium
RGASRFEPIGATIYGIDILA

SEQ ID NO: 720462 - protein, 19 aa, Mycobacterium
RGASTYTYDGNWKVQAENG

SEQ ID NO: 720463 - protein, 17 aa, Mycobacterium
RGASVIILERFDGGGAS

SEQ ID NO: 720464 - protein, 23 aa, Mycobacterium
RGATALRGIWGFHGDRRTHGDKL

SEQ ID NO: 720465 - protein, 23 aa, Mycobacterium
RGATALRGVWGFHGDHKPHGDKL

SEQ ID NO: 720466 - protein, 19 aa, Mycobacterium
RGATMHRLEIEDVHGSPGG

SEQ ID NO: 720467 - protein, 17 aa, Mycobacterium
RGATVSVQWPAELQQRV

SEQ ID NO: 720468 - protein, 25 aa, Mycobacterium
RGAVEVPRPEFGVIRAAKVVTAASR

SEQ ID NO: 720469 - protein, 30 aa, Mycobacterium
RGAVMAFERVTLYGLPLVPRRRVGYAQVDP

SEQ ID NO: 720470 - protein, 25 aa, Mycobacterium
RGCPFAPRCPLVIDECRSDEPELIE

SEQ ID NO: 720471 - protein, 19 aa, Mycobacterium
RGCTHPDCHVPGYLCQAHH

SEQ ID NO: 720472 - protein, 20 aa, Mycobacterium
RGDAAYDWIRSELENLGVTT

SEQ ID NO: 720473 - protein, 19 aa, Mycobacterium
RGDAGRRLLATEVEALTRR

SEQ ID NO: 720474 - protein, 17 aa, Mycobacterium
RGDAVLVVGTEALAAEV

SEQ ID NO: 720475 - protein, 25 aa, Mycobacterium
RGDDAWRPTLRRVMRAKMDPRKNPL

SEQ ID NO: 720476 - protein, 21 aa, Mycobacterium
RGDDGGFLWPGFGENSRVLKW

SEQ ID NO: 720477 - protein, 19 aa, Mycobacterium
RGDDHPAHHLVLLGEQLGG

SEQ ID NO: 720478 - protein, 18 aa, Mycobacterium
RGDEALPRLDYPPYRGTA

SEQ ID NO: 720479 - protein, 20 aa, Mycobacterium
RGDEGQFLWPGFGENSRVLK

SEQ ID NO: 720480 - protein, 22 aa, Mycobacterium
RGDEMFMALIARHCQHVLDTDA

SEQ ID NO: 720481 - protein, 22 aa, Mycobacterium
RGDENLCPKSRYTGWDADGGYA

SEQ ID NO: 720482 - protein, 22 aa, Mycobacterium
RGDGEAMMLLWEERLLYERRFA

SEQ ID NO: 720483 - protein, 18 aa, Mycobacterium
RGDGGWLLTGQKVWTSAA

SEQ ID NO: 720484 - protein, 19 aa, Mycobacterium
RGDGGWLLTGQKVWTSAAH

SEQ ID NO: 720485 - protein, 17 aa, Mycobacterium
RGDGIDMRQACNCYHTY

SEQ ID NO: 720486 - protein, 22 aa, Mycobacterium
RGDGVACARDLAVPALVIGNLA

SEQ ID NO: 720487 - protein, 19 aa, Mycobacterium
RGDGVPAYNLAVVVDDAAS

SEQ ID NO: 720488 - protein, 22 aa, Mycobacterium
RGDGWLPAVFVPGAVSIDALRA

SEQ ID NO: 720489 - protein, 18 aa, Mycobacterium
RGDIVVVHTGWWTRFLSA

SEQ ID NO: 720490 - protein, 20 aa, Mycobacterium
RGDLAISRDELIDYISRMGR

SEQ ID NO: 720491 - protein, 26 aa, Mycobacterium
RGDLALKMGLPVLAVVAFAQSFGDGV

SEQ ID NO: 720492 - protein, 24 aa, Mycobacterium
RGDLALKMGLPVLAVVAYAQSFGD

SEQ ID NO: 720493 - protein, 24 aa, Mycobacterium
RGDLALKMGLPVLAVVGYAQSFAD

SEQ ID NO: 720494 - protein, 29 aa, Mycobacterium
RGDLDIRSATEWFARMLFSLFTTPSPYLD

SEQ ID NO: 720495 - protein, 20 aa, Mycobacterium
RGDLKTSVFALYQPPAPPSM

SEQ ID NO: 720496 - protein, 18 aa, Mycobacterium
RGDLSLVREEIWTPISNR

SEQ ID NO: 720497 - protein, 17 aa, Mycobacterium
RGDLTWNQGAERFCEMV

SEQ ID NO: 720498 - protein, 23 aa, Mycobacterium
RGDPAGDVNAEWVPHPGGLTYAE

SEQ ID NO: 720499 - protein, 18 aa, Mycobacterium
RGDPVIPQAAHFGDPHKF

SEQ ID NO: 720500 - protein, 17 aa, Mycobacterium
RGDQMFMTMLRRHCDHV

SEQ ID NO: 720501 - protein, 18 aa, Mycobacterium
RGDQMWAQMFTNSASIVA

SEQ ID NO: 720502 - protein, 17 aa, Mycobacterium
RGDRAAVAALWSEDVRV

SEQ ID NO: 720503 - protein, 17 aa, Mycobacterium
RGDRAWVTAWSPEQIAH

SEQ ID NO: 720504 - protein, 23 aa, Mycobacterium
RGDRDAWEFALLRGALDRGLPVL

SEQ ID NO: 720505 - protein, 17 aa, Mycobacterium
RGDRLFLGRTRFFGPEQ

SEQ ID NO: 720506 - protein, 17 aa, Mycobacterium
RGDRMFMTMLRRHCDHV

SEQ ID NO: 720507 - protein, 36 aa, Mycobacterium
RGDRMWEFLDRLISIALPRIRDFRGLSPKQFDGTGN

SEQ ID NO: 720508 - protein, 36 aa, Mycobacterium
RGDRMWEFLDRLVSIALPRIRDFRGLSPKQFDGKGN

SEQ ID NO: 720509 - protein, 17 aa, Mycobacterium
RGDRPVTGLIYTHSHVD

SEQ ID NO: 720510 - protein, 17 aa, Mycobacterium
RGDRRVTAVIYTHSHVD

SEQ ID NO: 720511 - protein, 21 aa, Mycobacterium
RGDRVAVRYPAGMDWVLAFWG

SEQ ID NO: 720512 - protein, 19 aa, Mycobacterium
RGDRWVLDGAKTWSTSAFA

SEQ ID NO: 720513 - protein, 33 aa, Mycobacterium
RGDSADGVWARLKFEGGVHRVQRVPVTESQGRV

SEQ ID NO: 720514 - protein, 28 aa, Mycobacterium
RGDSNVRWLQERGVTIWDEWASPTGDLG

SEQ ID NO: 720515 - protein, 17 aa, Mycobacterium
RGDSPGVVRFLPMEELI

SEQ ID NO: 720516 - protein, 32 aa, Mycobacterium
RGDTPMPVRTPLPIQLPEPMAAQLRAAAAAQA

SEQ ID NO: 720517 - protein, 17 aa, Mycobacterium
RGDVAAVGAMWSDDIAV

SEQ ID NO: 720518 - protein, 21 aa, Mycobacterium
RGDVDWAALAAAPGPLILHAT

SEQ ID NO: 720519 - protein, 17 aa, Mycobacterium
RGDVLELIDDIKDAIPG

SEQ ID NO: 720520 - protein, 19 aa, Mycobacterium
RGDVMYRDHEQVLVLGDGE

SEQ ID NO: 720521 - protein, 17 aa, Mycobacterium
RGDVPVKEFAQVMPQPM

SEQ ID NO: 720522 - protein, 24 aa, Mycobacterium
RGDWRPKVHGAWNLHEATADQPLD

SEQ ID NO: 720523 - protein, 19 aa, Mycobacterium
RGDYMNQFIVFDFTIPRLK

SEQ ID NO: 720524 - protein, 20 aa, Mycobacterium
RGEAFVHNFIKPRDDDRLTV

SEQ ID NO: 720525 - protein, 20 aa, Mycobacterium
RGEALAKRCEEHLAGARQRV

SEQ ID NO: 720526 - protein, 23 aa, Mycobacterium
RGEALESFLRKMVFWSDVAIESS

SEQ ID NO: 720527 - protein, 27 aa, Mycobacterium
RGEAPLDPGEWFPTGDLGYLTDDGLVI

SEQ ID NO: 720528 - protein, 20 aa, Mycobacterium
RGECDWCATQAGLASVLAEQ

SEQ ID NO: 720529 - protein, 24 aa, Mycobacterium
RGEEPRRDSLRTLVPVSVRSDDAR

SEQ ID NO: 720530 - protein, 21 aa, Mycobacterium
RGEFGAVISLDLRRFNELHFL

SEQ ID NO: 720531 - protein, 30 aa, Mycobacterium
RGEGDIVVELFKPLPSMVVAHYLGVPEEDR

SEQ ID NO: 720532 - protein, 22 aa, Mycobacterium
RGEGFLCLMPSGPHGVGYFSRL

SEQ ID NO: 720533 - protein, 25 aa, Mycobacterium
RGEGKRIVPVCSMIGTVLKKHPEYD

SEQ ID NO: 720534 - protein, 22 aa, Mycobacterium
RGEGNGLTVAWWAEAVLHNGFG

SEQ ID NO: 720535 - protein, 19 aa, Mycobacterium
RGEGRIMYAGRYNRTLAQL

SEQ ID NO: 720536 - protein, 37 aa, Mycobacterium
RGEGTFVKFHWKPRLGVHSLIWDECQKIAGKDPDYNR

SEQ ID NO: 720537 - protein, 19 aa, Mycobacterium
RGEGYFYGIELVKDKAAKT

SEQ ID NO: 720538 - protein, 29 aa, Mycobacterium
RGEIARRVFATCRKLGLGTVAVYSDADAD

SEQ ID NO: 720539 - protein, 27 aa, Mycobacterium
RGEIARRVFATCRRLGIGTVAVYTDPD

SEQ ID NO: 720540 - protein, 28 aa, Mycobacterium
RGEIARRVFATCRRLGLGTVAVYTEPDA

SEQ ID NO: 720541 - protein, 21 aa, Mycobacterium
RGEIPQLPVLLLTAKDAVEDR

SEQ ID NO: 720542 - protein, 24 aa, Mycobacterium
RGEKDFRAPFAPSGRFEGLSIDHL

SEQ ID NO: 720543 - protein, 17 aa, Mycobacterium
RGEKLIVALPLATPGVA

SEQ ID NO: 720544 - protein, 19 aa, Mycobacterium
RGELLLKTDGMFLGYYKRP

SEQ ID NO: 720545 - protein, 21 aa, Mycobacterium
RGELLVKTRDLFPGYYKRPEV

SEQ ID NO: 720546 - protein, 24 aa, Mycobacterium
RGELRLKSETMFPGYYKRPETTAD

SEQ ID NO: 720547 - protein, 20 aa, Mycobacterium
RGELVFRHPLVRAAVIQTST

SEQ ID NO: 720548 - protein, 22 aa, Mycobacterium
RGEMLERMGWIVIRVVAEDRRV

SEQ ID NO: 720549 - protein, 19 aa, Mycobacterium
RGEMLRYAANRWGSERVAQ

SEQ ID NO: 720550 - protein, 19 aa, Mycobacterium
RGENFAFLGGRDWDPSDAT

SEQ ID NO: 720551 - protein, 21 aa, Mycobacterium
RGENFAFLGGRDWDPSQATLP

SEQ ID NO: 720552 - protein, 24 aa, Mycobacterium
RGENFAFLGGRDWDPSSMTLPRPL

SEQ ID NO: 720553 - protein, 26 aa, Mycobacterium
RGEPLPWQDLRAAFTERGWLDLTHTR

SEQ ID NO: 720554 - protein, 22 aa, Mycobacterium
RGERHLAAFVAYAAHAQEHALY

SEQ ID NO: 720555 - protein, 24 aa, Mycobacterium
RGERLALSLIRSFNPDLERGEFAV

SEQ ID NO: 720556 - protein, 21 aa, Mycobacterium
RGERNWDYRYAWVRDSTFALW

SEQ ID NO: 720557 - protein, 27 aa, Mycobacterium
RGESNVRWLQERGVTIWDEWASEAGEL

SEQ ID NO: 720558 - protein, 23 aa, Mycobacterium
RGESRIEYKLRDWLFARQRYWGE

SEQ ID NO: 720559 - protein, 25 aa, Mycobacterium
RGETLREIGRMAGLSEKAVRDLIRE

SEQ ID NO: 720560 - protein, 25 aa, Mycobacterium
RGETPIRLAYDFVNIQAANLVKDKG

SEQ ID NO: 720561 - protein, 21 aa, Mycobacterium
RGETRKVLWRAVDKTTFESVL

SEQ ID NO: 720562 - protein, 36 aa, Mycobacterium
RGETWLPRYGGLISSEWEFAKGLQILEEDPEIYAAI

SEQ ID NO: 720563 - protein, 24 aa, Mycobacterium
RGEVDLRLARRIGRTLAKLHGRTE

SEQ ID NO: 720564 - protein, 21 aa, Mycobacterium
RGEVPLVSIVSGRCFAGNAAL

SEQ ID NO: 720565 - protein, 21 aa, Mycobacterium
RGEWPGSIAREPRGHGGFGYD

SEQ ID NO: 720566 - protein, 21 aa, Mycobacterium
RGEYPSWTLAVQIMPFDDAKT

SEQ ID NO: 720567 - protein, 24 aa, Mycobacterium
RGFDEMARLGAQITIFRLGSDPGL

SEQ ID NO: 720568 - protein, 19 aa, Mycobacterium
RGFDILGIIAPSVAHDDAF

SEQ ID NO: 720569 - protein, 32 aa, Mycobacterium
RGFDIPNLCRRGVCGECRIPVSGSVITHRDLY

SEQ ID NO: 720570 - protein, 26 aa, Mycobacterium
RGFDISPRLAAALLDAAPQLRLDPEA

SEQ ID NO: 720571 - protein, 24 aa, Mycobacterium
RGFFGRLSAKLGFGAKALPFMLGA

SEQ ID NO: 720572 - protein, 20 aa, Mycobacterium
RGFFSLVAVLERGAMLPTAE

SEQ ID NO: 720573 - protein, 19 aa, Mycobacterium
RGFFTSRVIGTFVNEAVAM

SEQ ID NO: 720574 - protein, 24 aa, Mycobacterium
RGFGRAWASAALERGDRVAATARD

SEQ ID NO: 720575 - protein, 21 aa, Mycobacterium
RGFGRDKAVLVLEDGRVFTGK

SEQ ID NO: 720576 - protein, 27 aa, Mycobacterium
RGFHVYARIAPQWSFSQVRLAAQTVAR

SEQ ID NO: 720577 - protein, 32 aa, Mycobacterium
RGFHVYARIAPRWPFSKVRLAAQTVAREVERR

SEQ ID NO: 720578 - protein, 22 aa, Mycobacterium
RGFKGADRLYGFAHHSVSTTFL

SEQ ID NO: 720579 - protein, 19 aa, Mycobacterium
RGFLDWLFNRYREIVDTEP

SEQ ID NO: 720580 - protein, 17 aa, Mycobacterium
RGFLSYASRVIADLAEA

SEQ ID NO: 720581 - protein, 27 aa, Mycobacterium
RGFPEKGIAVALDWSVLHRSEWDQTLS

SEQ ID NO: 720582 - protein, 23 aa, Mycobacterium
RGFPNAPMRSVHLWALPQPLPAP

SEQ ID NO: 720583 - protein, 25 aa, Mycobacterium
RGFRVEFNSALGPFKGGLRFHPSVY

SEQ ID NO: 720584 - protein, 17 aa, Mycobacterium
RGFSESWLDERLVFCAD

SEQ ID NO: 720585 - protein, 18 aa, Mycobacterium
RGFSRPGIELTKRTLWSG

SEQ ID NO: 720586 - protein, 19 aa, Mycobacterium
RGFTACTRSTLALSSQARK

SEQ ID NO: 720587 - protein, 19 aa, Mycobacterium
RGFTVARYAQDVYVDSASG

SEQ ID NO: 720588 - protein, 17 aa, Mycobacterium
RGFYMCPVTPLTDEFEL

SEQ ID NO: 720589 - protein, 20 aa, Mycobacterium
RGGAAFPLAVKLRAVRDNGR

SEQ ID NO: 720590 - protein, 19 aa, Mycobacterium
RGGAELDTARAEWWYSRAA

SEQ ID NO: 720591 - protein, 25 aa, Mycobacterium
RGGAGFPAGIKWKTVLDCADALKFV

SEQ ID NO: 720592 - protein, 19 aa, Mycobacterium
RGGAGLIEAVVRDAQVPTI

SEQ ID NO: 720593 - protein, 17 aa, Mycobacterium
RGGAIVFTSSTAGLRGF

SEQ ID NO: 720594 - protein, 18 aa, Mycobacterium
RGGALIALNHTSYVDWIP

SEQ ID NO: 720595 - protein, 25 aa, Mycobacterium
RGGAPRLSGPMTFDITRLGRRPGAM

SEQ ID NO: 720596 - protein, 17 aa, Mycobacterium
RGGAQGVVICIGGSMGG

SEQ ID NO: 720597 - protein, 18 aa, Mycobacterium
RGGDARLIGNGGDGGAGA

SEQ ID NO: 720598 - protein, 19 aa, Mycobacterium
RGGDAYGGNAGWGGDGGNG

SEQ ID NO: 720599 - protein, 27 aa, Mycobacterium
RGGDGNTRYTPRGNVGGHGGNGGAGGA

SEQ ID NO: 720600 - protein, 20 aa, Mycobacterium
RGGDGWAVVGPMLREYVVSE

SEQ ID NO: 720601 - protein, 25 aa, Mycobacterium
RGGDIPWRVPEDLARFKQVTMGHTV

SEQ ID NO: 720602 - protein, 25 aa, Mycobacterium
RGGDIPWRVPEDLSHFKRITMGHTV

SEQ ID NO: 720603 - protein, 21 aa, Mycobacterium
RGGDRPRTVIWVGGRGPAETA

SEQ ID NO: 720604 - protein, 20 aa, Mycobacterium
RGGEAPSWAPLRVQYADYAA

SEQ ID NO: 720605 - protein, 25 aa, Mycobacterium
RGGEWKFAITKDGRHSLTHYDTVEA

SEQ ID NO: 720606 - protein, 20 aa, Mycobacterium
RGGEWLEWFTEQDIAGIGMG

SEQ ID NO: 720607 - protein, 17 aa, Mycobacterium
RGGFTSMLVGSTSNAVL

SEQ ID NO: 720608 - protein, 23 aa, Mycobacterium
RGGGAALPFKRRLFGQIVAAAVR

SEQ ID NO: 720609 - protein, 23 aa, Mycobacterium
RGGGAALPFKRRLFGRIVAAAVR

SEQ ID NO: 720610 - protein, 22 aa, Mycobacterium
RGGGARCRVCNAALSTPAAVLL

SEQ ID NO: 720611 - protein, 26 aa, Mycobacterium
RGGGCEFAMAFDMRYAALGTTVLGHP

SEQ ID NO: 720612 - protein, 20 aa, Mycobacterium
RGGGDLIEFAMSAVAATYAD

SEQ ID NO: 720613 - protein, 19 aa, Mycobacterium
RGGGELIELSMAGVAAEYA

SEQ ID NO: 720614 - protein, 17 aa, Mycobacterium
RGGGGASVFATAVAQSA

SEQ ID NO: 720615 - protein, 19 aa, Mycobacterium
RGGGHAFTLTVTDIATGWT

SEQ ID NO: 720616 - protein, 23 aa, Mycobacterium
RGGGLPAALVLAEAVSWQGRGEE

SEQ ID NO: 720617 - protein, 19 aa, Mycobacterium
RGGGRKALVARLYAQRYLA

SEQ ID NO: 720618 - protein, 17 aa, Mycobacterium
RGGGVVHPGLRRDGRPI

SEQ ID NO: 720619 - protein, 18 aa, Mycobacterium
RGGHFAAFEQPSSFVDDV

SEQ ID NO: 720620 - protein, 24 aa, Mycobacterium
RGGHIPTAVSIPWAKAAAEDSRFR

SEQ ID NO: 720621 - protein, 24 aa, Mycobacterium
RGGHIPTAVSIPWAKAALDNGKFR

SEQ ID NO: 720622 - protein, 19 aa, Mycobacterium
RGGIAPGWLAGRLRAPLNR

SEQ ID NO: 720623 - protein, 19 aa, Mycobacterium
RGGIDIVVACPGRLEDLMQ

SEQ ID NO: 720624 - protein, 21 aa, Mycobacterium
RGGIPGLLRRAIQRFPQTFYP

SEQ ID NO: 720625 - protein, 23 aa, Mycobacterium
RGGIVRSGLGYNFCDVGAVLNVA

SEQ ID NO: 720626 - protein, 26 aa, Mycobacterium
RGGKISFTHLLGYAIVQAIKDFPNMN

SEQ ID NO: 720627 - protein, 21 aa, Mycobacterium
RGGKISFTHLLGYALVQAIKK

SEQ ID NO: 720628 - protein, 21 aa, Mycobacterium
RGGKISFTHLLGYALVQATKQ

SEQ ID NO: 720629 - protein, 21 aa, Mycobacterium
RGGKISFTHLLGYALVQAVKK

SEQ ID NO: 720630 - protein, 21 aa, Mycobacterium
RGGKISFTHLLGYALVQAVKQ

SEQ ID NO: 720631 - protein, 18 aa, Mycobacterium
RGGKIWVAGYAVRDPSNR

SEQ ID NO: 720632 - protein, 24 aa, Mycobacterium
RGGLADCVLALGFEKMQPGSLGGG

SEQ ID NO: 720633 - protein, 18 aa, Mycobacterium
RGGLGGSATLFANGAGSS

SEQ ID NO: 720634 - protein, 19 aa, Mycobacterium
RGGLPSWGSLLDVAPERDV

SEQ ID NO: 720635 - protein, 17 aa, Mycobacterium
RGGLSAQRWREIGDDYF

SEQ ID NO: 720636 - protein, 17 aa, Mycobacterium
RGGLSRAGNLRWEINGT

SEQ ID NO: 720637 - protein, 30 aa, Mycobacterium
RGGLTAERFVACPFGPAGSRMYRSGDLVRW

SEQ ID NO: 720638 - protein, 20 aa, Mycobacterium
RGGMLGWRVASTMATSMVLD

SEQ ID NO: 720639 - protein, 23 aa, Mycobacterium
RGGMLRPAWEQVKAANFPYRYPW

SEQ ID NO: 720640 - protein, 24 aa, Mycobacterium
RGGMLRPAWEQVKAANFPYRYPWR

SEQ ID NO: 720641 - protein, 23 aa, Mycobacterium
RGGNAGLLFSSAGAGGFGGYGTT

SEQ ID NO: 720642 - protein, 21 aa, Mycobacterium
RGGNISAWAAATLTRIVFEEA

SEQ ID NO: 720643 - protein, 17 aa, Mycobacterium
RGGNVMLGYWNKPDETA

SEQ ID NO: 720644 - protein, 29 aa, Mycobacterium
RGGPLALGFFTGWLFTEFPPHVVTGHALS

SEQ ID NO: 720645 - protein, 18 aa, Mycobacterium
RGGPPVVLLHGWPGTRRD

SEQ ID NO: 720646 - protein, 19 aa, Mycobacterium
RGGPQFPRFVAGVRVARAA

SEQ ID NO: 720647 - protein, 17 aa, Mycobacterium
RGGPQMCRREKWRRIRR

SEQ ID NO: 720648 - protein, 20 aa, Mycobacterium
RGGPRASCLDRLLQTDRLEY

SEQ ID NO: 720649 - protein, 24 aa, Mycobacterium
RGGQLRWFGLDGVEHTGGPLVDFD

SEQ ID NO: 720650 - protein, 19 aa, Mycobacterium
RGGQPVSMDNIQPGDLVTY

SEQ ID NO: 720651 - protein, 17 aa, Mycobacterium
RGGRPALRISGRRRLSR

SEQ ID NO: 720652 - protein, 18 aa, Mycobacterium
RGGRPGIGVSAFSPSFDP

SEQ ID NO: 720653 - protein, 25 aa, Mycobacterium
RGGRPRIAGVSSFGFAGTNAHVILE

SEQ ID NO: 720654 - protein, 22 aa, Mycobacterium
RGGRPTLLTWGLLGPGKGIERG

SEQ ID NO: 720655 - protein, 19 aa, Mycobacterium
RGGRVRGQRGWIVEKPGDP

SEQ ID NO: 720656 - protein, 19 aa, Mycobacterium
RGGRVRGQRGWIVEKSADP

SEQ ID NO: 720657 - protein, 19 aa, Mycobacterium
RGGRVRGQRGWIVEKSGDP

SEQ ID NO: 720658 - protein, 20 aa, Mycobacterium
RGGRVRGQRGWIVEKTGDPG

SEQ ID NO: 720659 - protein, 17 aa, Mycobacterium
RGGSAPVGFGVNRNLLV

SEQ ID NO: 720660 - protein, 19 aa, Mycobacterium
RGGSAVGLIGNGGAGGVGG

SEQ ID NO: 720661 - protein, 27 aa, Mycobacterium
RGGSGGAGGDAWLFGSGGSGGGGGAGA

SEQ ID NO: 720662 - protein, 22 aa, Mycobacterium
RGGSLKSSWYGDCLPERDFPTL

SEQ ID NO: 720663 - protein, 19 aa, Mycobacterium
RGGSSIGVTRVSSWDDLAA

SEQ ID NO: 720664 - protein, 18 aa, Mycobacterium
RGGTILLPAVGKVESLLP

SEQ ID NO: 720665 - protein, 21 aa, Mycobacterium
RGGTLKLMRPLFGAGLGGRLG

SEQ ID NO: 720666 - protein, 19 aa, Mycobacterium
RGGTRGEVAQLILTASGGP

SEQ ID NO: 720667 - protein, 25 aa, Mycobacterium
RGGTRIRFSLMPGETSRLVDIRTSG

SEQ ID NO: 720668 - protein, 20 aa, Mycobacterium
RGGTTICVRLPRRSAPVRPS

SEQ ID NO: 720669 - protein, 25 aa, Mycobacterium
RGGTVLRLPDIRALLTRHLAGRPTR

SEQ ID NO: 720670 - protein, 17 aa, Mycobacterium
RGGVAAALRGCPVPVVV

SEQ ID NO: 720671 - protein, 29 aa, Mycobacterium
RGGVAKALRGCPVPAVVGGITSDRLYPLR

SEQ ID NO: 720672 - protein, 20 aa, Mycobacterium
RGGVRLCYDGKVFEDASAEQ

SEQ ID NO: 720673 - protein, 17 aa, Mycobacterium
RGGVSLHGVDKTFGTAA

SEQ ID NO: 720674 - protein, 23 aa, Mycobacterium
RGGWRLDGRGRLRLRDGGRLAKL

SEQ ID NO: 720675 - protein, 17 aa, Mycobacterium
RGGWRSRHSALHLAVAA

SEQ ID NO: 720676 - protein, 21 aa, Mycobacterium
RGGWYFTSRALQWDSVPSRHP

SEQ ID NO: 720677 - protein, 17 aa, Mycobacterium
RGGWYVRQLLGAANIEG

SEQ ID NO: 720678 - protein, 17 aa, Mycobacterium
RGHADDMVIARNLAERK

SEQ ID NO: 720679 - protein, 17 aa, Mycobacterium
RGHAPQARHIPMGDVPA

SEQ ID NO: 720680 - protein, 17 aa, Mycobacterium
RGHDAILLGAIGDPAVP

SEQ ID NO: 720681 - protein, 24 aa, Mycobacterium
RGHDWKFAVVEDGRHSITHYDTLE

SEQ ID NO: 720682 - protein, 17 aa, Mycobacterium
RGHFGPYGGRYVAEALM

SEQ ID NO: 720683 - protein, 19 aa, Mycobacterium
RGHFLLTRNAATYWRGASK

SEQ ID NO: 720684 - protein, 24 aa, Mycobacterium
RGHGMSVDLGRLGLPHEVAAVIAF

SEQ ID NO: 720685 - protein, 29 aa, Mycobacterium
RGHGYGVDAIKVFDAFPLTHHVECVALLT

SEQ ID NO: 720686 - protein, 18 aa, Mycobacterium
RGHHGPVRRRPIADVVFH

SEQ ID NO: 720687 - protein, 17 aa, Mycobacterium
RGHICPKGASLGALHDD

SEQ ID NO: 720688 - protein, 19 aa, Mycobacterium
RGHIREIAEHGGMAQAISD

SEQ ID NO: 720689 - protein, 23 aa, Mycobacterium
RGHLAQFRYPVIEPHHAHVPIEL

SEQ ID NO: 720690 - protein, 19 aa, Mycobacterium
RGHLAWAMADMTRRNRSTF

SEQ ID NO: 720691 - protein, 18 aa, Mycobacterium
RGHLCPKGTSLAALHDDP

SEQ ID NO: 720692 - protein, 22 aa, Mycobacterium
RGHLDAVAFGAGLIFGDAPGGS

SEQ ID NO: 720693 - protein, 23 aa, Mycobacterium
RGHLRIAMTPTFTAYFIGPLVHR

SEQ ID NO: 720694 - protein, 23 aa, Mycobacterium
RGHLRKFGLSRVRVRELAHAGQL

SEQ ID NO: 720695 - protein, 27 aa, Mycobacterium
RGHTARLFRRSPWVGWSELFRVLVRLL

SEQ ID NO: 720696 - protein, 21 aa, Mycobacterium
RGHVRGFPLGPGYLLEGRPVI

SEQ ID NO: 720697 - protein, 17 aa, Mycobacterium
RGHWIEGMMTIADHESQ

SEQ ID NO: 720698 - protein, 17 aa, Mycobacterium
RGHYDYRLAAVGDSAAE

SEQ ID NO: 720699 - protein, 20 aa, Mycobacterium
RGIAAMYGAFGIPSVTTAQM

SEQ ID NO: 720700 - protein, 25 aa, Mycobacterium
RGIAARAGVSSGLLRHHFGSKQELR

SEQ ID NO: 720701 - protein, 17 aa, Mycobacterium
RGIAASERARWATYPVM

SEQ ID NO: 720702 - protein, 20 aa, Mycobacterium
RGIADAWAAEGIETHVFSRT

SEQ ID NO: 720703 - protein, 26 aa, Mycobacterium
RGIAEGLAAFGARVAIWERDPETCEA

SEQ ID NO: 720704 - protein, 18 aa, Mycobacterium
RGIAETGFIQQDFADSLP

SEQ ID NO: 720705 - protein, 17 aa, Mycobacterium
RGIAKGLAERDAADRAE

SEQ ID NO: 720706 - protein, 28 aa, Mycobacterium
RGIAMLHPHSRPCVGAALTLYSEILDRI

SEQ ID NO: 720707 - protein, 17 aa, Mycobacterium
RGIATTTAEEWARANLD

SEQ ID NO: 720708 - protein, 21 aa, Mycobacterium
RGIDEAMTFFAKVGQAIEIVE

SEQ ID NO: 720709 - protein, 19 aa, Mycobacterium
RGIDLDVIFQAYRRGQNVA

SEQ ID NO: 720710 - protein, 17 aa, Mycobacterium
RGIDMVVALVGIMKASA

SEQ ID NO: 720711 - protein, 17 aa, Mycobacterium
RGIECSEQLSAVLATMA

SEQ ID NO: 720712 - protein, 24 aa, Mycobacterium
RGIEVIEFAIGIPHLLKGEYTEGA

SEQ ID NO: 720713 - protein, 25 aa, Mycobacterium
RGIEVIEFAVGIPHLLKGEFTEGAG

SEQ ID NO: 720714 - protein, 20 aa, Mycobacterium
RGIFGGTCVNTGCVPSKALI

SEQ ID NO: 720715 - protein, 27 aa, Mycobacterium
RGIGATIAEVFARDGARVVAIDVESAA

SEQ ID NO: 720716 - protein, 25 aa, Mycobacterium
RGIGATIAEVFARDGARVVTIDVES

SEQ ID NO: 720717 - protein, 23 aa, Mycobacterium
RGIGATIAEVFARDGATVVAIDV

SEQ ID NO: 720718 - protein, 25 aa, Mycobacterium
RGIGATIAQVFARDGAKVIAVDVEG

SEQ ID NO: 720719 - protein, 29 aa, Mycobacterium
RGIGEAGFNIAGLFVGGPLSKGGTVAKGV

SEQ ID NO: 720720 - protein, 17 aa, Mycobacterium
RGIGGSDVTAWLRTINT

SEQ ID NO: 720721 - protein, 19 aa, Mycobacterium
RGIGKIDRAALVRRFAGAG

SEQ ID NO: 720722 - protein, 20 aa, Mycobacterium
RGIGKIDRRALVRRFAAATD

SEQ ID NO: 720723 - protein, 17 aa, Mycobacterium
RGIGLAIAQRLAADGHK

SEQ ID NO: 720724 - protein, 17 aa, Mycobacterium
RGIGRAIARRLAAEGAT

SEQ ID NO: 720725 - protein, 25 aa, Mycobacterium
RGIGREHALLFAKEGASVVVNDLGG

SEQ ID NO: 720726 - protein, 25 aa, Mycobacterium
RGIGREHALLFAREGASVVVNDLGG

SEQ ID NO: 720727 - protein, 19 aa, Mycobacterium
RGIHVAALHVGYMDTDMVP

SEQ ID NO: 720728 - protein, 20 aa, Mycobacterium
RGIITWGIRDARRLAAWHPR

SEQ ID NO: 720729 - protein, 27 aa, Mycobacterium
RGIKDGRAVTVLEHFTRLREDLAPNWP

SEQ ID NO: 720730 - protein, 20 aa, Mycobacterium
RGIKLGTLFERAARRHPDNT

SEQ ID NO: 720731 - protein, 27 aa, Mycobacterium
RGILRDNRFRLPPGVTLAAQGITSGPL

SEQ ID NO: 720732 - protein, 19 aa, Mycobacterium
RGIMPDRHLGSALHAAHNE

SEQ ID NO: 720733 - protein, 20 aa, Mycobacterium
RGIMPDRHLGTAIASAHNEM

SEQ ID NO: 720734 - protein, 20 aa, Mycobacterium
RGIMPDRHLGTALANAHNEM

SEQ ID NO: 720735 - protein, 22 aa, Mycobacterium
RGIPAETVRFMQPREFGVAMPA

SEQ ID NO: 720736 - protein, 19 aa, Mycobacterium
RGIPAYRLDGDNLRHGLNA

SEQ ID NO: 720737 - protein, 28 aa, Mycobacterium
RGIPGRLSWAMLRPLYTAALRALAADVI

SEQ ID NO: 720738 - protein, 22 aa, Mycobacterium
RGIPQLSSAPVWSSDIRAGAGL

SEQ ID NO: 720739 - protein, 23 aa, Mycobacterium
RGIPQLSSAPVWSSDIRAGAGLV

SEQ ID NO: 720740 - protein, 17 aa, Mycobacterium
RGIPYLLVTGRRGGSAM

SEQ ID NO: 720741 - protein, 22 aa, Mycobacterium
RGIRCLTLDYDAMRGMDSDEFR

SEQ ID NO: 720742 - protein, 18 aa, Mycobacterium
RGIRFGRDLPEQERELLL

SEQ ID NO: 720743 - protein, 17 aa, Mycobacterium
RGIRSFGPLRASLGRDT

SEQ ID NO: 720744 - protein, 19 aa, Mycobacterium
RGITREDIDVFGFQSQLRA

SEQ ID NO: 720745 - protein, 19 aa, Mycobacterium
RGIVHRESFQIILVDTPGL

SEQ ID NO: 720746 - protein, 33 aa, Mycobacterium
RGIVIGPRGDCCWMCLPRWDSPAVFGSLLGGNG

SEQ ID NO: 720747 - protein, 18 aa, Mycobacterium
RGIVNARVLSAMRPTARL

SEQ ID NO: 720748 - protein, 20 aa, Mycobacterium
RGIWHKGWFANTVHAATPSG

SEQ ID NO: 720749 - protein, 19 aa, Mycobacterium
RGIYCGTVGLASPVAGCEL

SEQ ID NO: 720750 - protein, 32 aa, Mycobacterium
RGIYPFGGATIRFPRTAGWGNAMRWMLTADTF

SEQ ID NO: 720751 - protein, 23 aa, Mycobacterium
RGIYRLPGRDLLEYRYHVCKRCG

SEQ ID NO: 720752 - protein, 25 aa, Mycobacterium
RGKDEFFKVWRYLNGSFELDTDLAD

SEQ ID NO: 720753 - protein, 17 aa, Mycobacterium
RGKEMANHVAIAAATDL

SEQ ID NO: 720754 - protein, 23 aa, Mycobacterium
RGKGCDICKPVVASILASTGSDH

SEQ ID NO: 720755 - protein, 18 aa, Mycobacterium
RGKGFAYYGPDGELLADP

SEQ ID NO: 720756 - protein, 24 aa, Mycobacterium
RGKHGRIRYDLHRHFGISAERLRE

SEQ ID NO: 720757 - protein, 20 aa, Mycobacterium
RGKHPAVAWGTWAVNPTPQM

SEQ ID NO: 720758 - protein, 20 aa, Mycobacterium
RGKMFAKLIKNIEVAARVGG

SEQ ID NO: 720759 - protein, 18 aa, Mycobacterium
RGKMFARLIKNIEVAARV

SEQ ID NO: 720760 - protein, 17 aa, Mycobacterium
RGKMIGYEGLEKGTRAA

SEQ ID NO: 720761 - protein, 20 aa, Mycobacterium
RGKPAIPAWEDVLLGVRSGG

SEQ ID NO: 720762 - protein, 19 aa, Mycobacterium
RGKPCAKLVPVEAIDMLAT

SEQ ID NO: 720763 - protein, 19 aa, Mycobacterium
RGKPCAKLVPVEAVDQLAT

SEQ ID NO: 720764 - protein, 18 aa, Mycobacterium
RGKRCTYLDLARESDAER

SEQ ID NO: 720765 - protein, 21 aa, Mycobacterium
RGKRMDECIDIIRGLTTGEYF

SEQ ID NO: 720766 - protein, 24 aa, Mycobacterium
RGKRQPESRFRAGLDVIIAGIKAR

SEQ ID NO: 720767 - protein, 17 aa, Mycobacterium
RGKRRLADAMPYAPGVY

SEQ ID NO: 720768 - protein, 25 aa, Mycobacterium
RGKSAAQVVLRWHVQRGDIVFPKSV

SEQ ID NO: 720769 - protein, 20 aa, Mycobacterium
RGKSARAFRALVRELVSAGV

SEQ ID NO: 720770 - protein, 19 aa, Mycobacterium
RGKVGPFRVEGTAHPGAPG

SEQ ID NO: 720771 - protein, 25 aa, Mycobacterium
RGKVLRWAAPLLYALPGLDRWRAPH

SEQ ID NO: 720772 - protein, 28 aa, Mycobacterium
RGKVTKMMFDWAIGVGIKVSQARQAGKK

SEQ ID NO: 720773 - protein, 21 aa, Mycobacterium
RGKWPEIWVAAHGPRMLRATG

SEQ ID NO: 720774 - protein, 18 aa, Mycobacterium
RGLAALGQPVSRDPADPL

SEQ ID NO: 720775 - protein, 28 aa, Mycobacterium
RGLAAVDEICRVDGLTGIYVGPADLAIS

SEQ ID NO: 720776 - protein, 20 aa, Mycobacterium
RGLACPLLVISDGARGLIAA

SEQ ID NO: 720777 - protein, 24 aa, Mycobacterium
RGLAEKDLTLALGLGESVGVELPL

SEQ ID NO: 720778 - protein, 18 aa, Mycobacterium
RGLAERGVNVVLVARRQA

SEQ ID NO: 720779 - protein, 19 aa, Mycobacterium
RGLAKATLFGPAEVADHYG

SEQ ID NO: 720780 - protein, 19 aa, Mycobacterium
RGLALFDMFTYFNELTASR

SEQ ID NO: 720781 - protein, 17 aa, Mycobacterium
RGLALRSTLLPSRQRRD

SEQ ID NO: 720782 - protein, 19 aa, Mycobacterium
RGLAPQVHRLRAAEHPRPE

SEQ ID NO: 720783 - protein, 17 aa, Mycobacterium
RGLARAMLSRHGIDTHR

SEQ ID NO: 720784 - protein, 25 aa, Mycobacterium
RGLAREIACAFDLDFVDPADVAPLP

SEQ ID NO: 720785 - protein, 20 aa, Mycobacterium
RGLARGGTFITLGYAAGTIP

SEQ ID NO: 720786 - protein, 18 aa, Mycobacterium
RGLARRGVASIAVDLPGH

SEQ ID NO: 720787 - protein, 19 aa, Mycobacterium
RGLATIMIAEALRSTRAAG

SEQ ID NO: 720788 - protein, 19 aa, Mycobacterium
RGLAYRSMLRRGFTAESYG

SEQ ID NO: 720789 - protein, 23 aa, Mycobacterium
RGLDAPICLTWELTYACNLSCVH

SEQ ID NO: 720790 - protein, 17 aa, Mycobacterium
RGLDIPVYFGNRNWEPY

SEQ ID NO: 720791 - protein, 19 aa, Mycobacterium
RGLDMSRLMIFTWDVPGRC

SEQ ID NO: 720792 - protein, 19 aa, Mycobacterium
RGLESFPPTGGVLLVSNHS

SEQ ID NO: 720793 - protein, 19 aa, Mycobacterium
RGLESFPPTGGVLVVSNHS

SEQ ID NO: 720794 - protein, 19 aa, Mycobacterium
RGLFELAAQCLVPGGRLVF

SEQ ID NO: 720795 - protein, 24 aa, Mycobacterium
RGLFFEWFTDAGFTEFAGHQFDMR

SEQ ID NO: 720796 - protein, 17 aa, Mycobacterium
RGLGAVVAEHFERRGAH

SEQ ID NO: 720797 - protein, 18 aa, Mycobacterium
RGLGEAMVGINVEDIAQP

SEQ ID NO: 720798 - protein, 18 aa, Mycobacterium
RGLGEAMVGINVEEIAQP

SEQ ID NO: 720799 - protein, 18 aa, Mycobacterium
RGLGEAMVGINVEQIAQP

SEQ ID NO: 720800 - protein, 18 aa, Mycobacterium
RGLGEKDLSLALALGEEQ

SEQ ID NO: 720801 - protein, 23 aa, Mycobacterium
RGLGGRLGRAGEHGHAGTAVRPA

SEQ ID NO: 720802 - protein, 20 aa, Mycobacterium
RGLGGVRVLHGGMKRQRQTA

SEQ ID NO: 720803 - protein, 19 aa, Mycobacterium
RGLGIWQWASTASGEPDVV

SEQ ID NO: 720804 - protein, 19 aa, Mycobacterium
RGLGLVGMADRVTAMGGEL

SEQ ID NO: 720805 - protein, 20 aa, Mycobacterium
RGLGRLYALDLARRGAAVVV

SEQ ID NO: 720806 - protein, 20 aa, Mycobacterium
RGLGRLYALDLARRGATVVV

SEQ ID NO: 720807 - protein, 21 aa, Mycobacterium
RGLGRLYALELARRGAAVVVN

SEQ ID NO: 720808 - protein, 25 aa, Mycobacterium
RGLGTGDRVLLCLPDSPELVQLLLA

SEQ ID NO: 720809 - protein, 22 aa, Mycobacterium
RGLHELAKFTVCRPESLPTAIR

SEQ ID NO: 720810 - protein, 17 aa, Mycobacterium
RGLHLFATLLSAAENAT

SEQ ID NO: 720811 - protein, 30 aa, Mycobacterium
RGLHVCPGAPLARMEFRVVLEELFRGTAHI

SEQ ID NO: 720812 - protein, 32 aa, Mycobacterium
RGLIAEYGISWILPRIVGWGAAQDLLLSGRTF

SEQ ID NO: 720813 - protein, 20 aa, Mycobacterium
RGLICHARILIARGLCDDDM

SEQ ID NO: 720814 - protein, 21 aa, Mycobacterium
RGLKAAITAVRAWRRAKPGKA

SEQ ID NO: 720815 - protein, 19 aa, Mycobacterium
RGLKGFRRSYLEATYAHRV

SEQ ID NO: 720816 - protein, 26 aa, Mycobacterium
RGLKSAIAAVRGWRRGKRAAVARSVD

SEQ ID NO: 720817 - protein, 26 aa, Mycobacterium
RGLKTAIATVRGWRRGRTASRPADLA

SEQ ID NO: 720818 - protein, 17 aa, Mycobacterium
RGLKYGVKQVFSTAGAT

SEQ ID NO: 720819 - protein, 25 aa, Mycobacterium
RGLLDVLGALRWVRDNIAAFGGDPG

SEQ ID NO: 720820 - protein, 19 aa, Mycobacterium
RGLLGKFMPVKRTTFVIDT

SEQ ID NO: 720821 - protein, 17 aa, Mycobacterium
RGLLLTTLWYIREVDPT

SEQ ID NO: 720822 - protein, 19 aa, Mycobacterium
RGLLLTTLWYIRVVDPTTL

SEQ ID NO: 720823 - protein, 18 aa, Mycobacterium
RGLLPLTLGSGVRIAVIG

SEQ ID NO: 720824 - protein, 24 aa, Mycobacterium
RGLLPPSFALVGFARRDWADEDFG

SEQ ID NO: 720825 - protein, 21 aa, Mycobacterium
RGLLPPSFSLVGFARRDWETQ

SEQ ID NO: 720826 - protein, 24 aa, Mycobacterium
RGLLPPSFSLVGFARRDWSTQDFG

SEQ ID NO: 720827 - protein, 19 aa, Mycobacterium
RGLMSLGVAAGDRVGIWAP

SEQ ID NO: 720828 - protein, 18 aa, Mycobacterium
RGLNEAVVRDISAKKNEP

SEQ ID NO: 720829 - protein, 24 aa, Mycobacterium
RGLPEVFRALIACIMLVLERDSSA

SEQ ID NO: 720830 - protein, 25 aa, Mycobacterium
RGLPEVFRALLALILIVLRRDTGAA

SEQ ID NO: 720831 - protein, 18 aa, Mycobacterium
RGLPFSGVVWRSTAPNGK

SEQ ID NO: 720832 - protein, 22 aa, Mycobacterium
RGLPGRAWIPSLGMCDVEALPD

SEQ ID NO: 720833 - protein, 23 aa, Mycobacterium
RGLPITMTKLRFMKFIMDEIFPG

SEQ ID NO: 720834 - protein, 27 aa, Mycobacterium
RGLPLPIIAGNLFRFELLRTRHDLRQR

SEQ ID NO: 720835 - protein, 27 aa, Mycobacterium
RGLPLTMRKLRFFKFIMDEIFPGGELP

SEQ ID NO: 720836 - protein, 17 aa, Mycobacterium
RGLPRRIDLTLRQKAIV

SEQ ID NO: 720837 - protein, 24 aa, Mycobacterium
RGLPSKRRYEVFKALDDERLADIL

SEQ ID NO: 720838 - protein, 21 aa, Mycobacterium
RGLPTLLCLPDRLIHPPDDLA

SEQ ID NO: 720839 - protein, 17 aa, Mycobacterium
RGLPVQVHVGFGDRDLD

SEQ ID NO: 720840 - protein, 19 aa, Mycobacterium
RGLQAAWELFVPYLQPLIA

SEQ ID NO: 720841 - protein, 23 aa, Mycobacterium
RGLQRLRTALPLVDGGAESPRET

SEQ ID NO: 720842 - protein, 24 aa, Mycobacterium
RGLQVCAALDRIVALSIAHTTDRT

SEQ ID NO: 720843 - protein, 18 aa, Mycobacterium
RGLRAAALFVADGHIGAS

SEQ ID NO: 720844 - protein, 17 aa, Mycobacterium
RGLRAKGGKLEWTVQDD

SEQ ID NO: 720845 - protein, 22 aa, Mycobacterium
RGLRANDLVKVLGAAVNGRGGG

SEQ ID NO: 720846 - protein, 18 aa, Mycobacterium
RGLRAQGGKLVWTEQDRS

SEQ ID NO: 720847 - protein, 17 aa, Mycobacterium
RGLRDAGVLPVLKHFPG

SEQ ID NO: 720848 - protein, 20 aa, Mycobacterium
RGLRELLWEPARLYPPDVLG

SEQ ID NO: 720849 - protein, 26 aa, Mycobacterium
RGLRMVGRGVLRPGLTVLAGETPVGV

SEQ ID NO: 720850 - protein, 26 aa, Mycobacterium
RGLRMVGRGVLRPGLTVLNGSTPVGV

SEQ ID NO: 720851 - protein, 18 aa, Mycobacterium
RGLRRAEMGKSRRPFEDQ

SEQ ID NO: 720852 - protein, 27 aa, Mycobacterium
RGLRRLAGIAWPHIDWSPHGRHPHLAV

SEQ ID NO: 720853 - protein, 17 aa, Mycobacterium
RGLRTAIETVRGWRRTK

SEQ ID NO: 720854 - protein, 17 aa, Mycobacterium
RGLRTARQLLLDIIDIG

SEQ ID NO: 720855 - protein, 17 aa, Mycobacterium
RGLRVADATAFSLCMDN

SEQ ID NO: 720856 - protein, 20 aa, Mycobacterium
RGLRVGRDVSLIGFNNIALT

SEQ ID NO: 720857 - protein, 29 aa, Mycobacterium
RGLRWFVRATAWAPLRHWLIRLTERGGQG

SEQ ID NO: 720858 - protein, 17 aa, Mycobacterium
RGLRYSYPDGHVALDGI

SEQ ID NO: 720859 - protein, 17 aa, Mycobacterium
RGLSFDMWVYGHQLPDA

SEQ ID NO: 720860 - protein, 23 aa, Mycobacterium
RGLSGRNAVMFGPPGRLYTYRSH

SEQ ID NO: 720861 - protein, 27 aa, Mycobacterium
RGLSIDLGGSWLLPKLVGLQQAKRLAL

SEQ ID NO: 720862 - protein, 18 aa, Mycobacterium
RGLSLGRQGLDGMSRISG

SEQ ID NO: 720863 - protein, 19 aa, Mycobacterium
RGLSMLRPELGLAAMQQLL

SEQ ID NO: 720864 - protein, 18 aa, Mycobacterium
RGLSQMAVYNCYGPTEMT

SEQ ID NO: 720865 - protein, 27 aa, Mycobacterium
RGLSRRRAKARADELLEQFDLAAAADR

SEQ ID NO: 720866 - protein, 23 aa, Mycobacterium
RGLSRYFRDYALRMRAYQIDSQS

SEQ ID NO: 720867 - protein, 24 aa, Mycobacterium
RGLTPMLALKSWAVTGCAPEKMGI

SEQ ID NO: 720868 - protein, 23 aa, Mycobacterium
RGLVAVAGLRPIAAGYLLMSCKN

SEQ ID NO: 720869 - protein, 18 aa, Mycobacterium
RGLVEGHVRISLDAPDLV

SEQ ID NO: 720870 - protein, 20 aa, Mycobacterium
RGLVHGDFRLDNMLFGQDGS

SEQ ID NO: 720871 - protein, 18 aa, Mycobacterium
RGLVPGPFQFLRVIGAYY

SEQ ID NO: 720872 - protein, 24 aa, Mycobacterium
RGLVSKAFAPRVIKRLEPEITALV

SEQ ID NO: 720873 - protein, 20 aa, Mycobacterium
RGLWGAPYEPGYRVLDGIRA

SEQ ID NO: 720874 - protein, 17 aa, Mycobacterium
RGLYAWSGLERSDVREV

SEQ ID NO: 720875 - protein, 25 aa, Mycobacterium
RGLYQYRPQLPFVLGAEIAGVVRSA

SEQ ID NO: 720876 - protein, 26 aa, Mycobacterium
RGLYQYRPQLPFVLGAEIAGVVRSAP

SEQ ID NO: 720877 - protein, 19 aa, Mycobacterium
RGLYRVEIEGSPSMRCEFE

SEQ ID NO: 720878 - protein, 20 aa, Mycobacterium
RGLYRVEIEGSPSMRCEFEM

SEQ ID NO: 720879 - protein, 24 aa, Mycobacterium
RGMADECLRVIGVEVSSQGVGEHF

SEQ ID NO: 720880 - protein, 21 aa, Mycobacterium
RGMALRARLILDCTNIRELAE

SEQ ID NO: 720881 - protein, 24 aa, Mycobacterium
RGMELFCAGAHPFAQWTTQKLTAG

SEQ ID NO: 720882 - protein, 17 aa, Mycobacterium
RGMEYLLVRGRRGGSAM

SEQ ID NO: 720883 - protein, 17 aa, Mycobacterium
RGMGLAAAHCFADDGAR

SEQ ID NO: 720884 - protein, 25 aa, Mycobacterium
RGMIANRVSYGFALHGPSMTVDCGQ

SEQ ID NO: 720885 - protein, 37 aa, Mycobacterium
RGMPLTFELARFIKFMVTEIFPGGRLPSIEKVEEHSS

SEQ ID NO: 720886 - protein, 24 aa, Mycobacterium
RGMRPGLDVRLAFLELSAPNFADV

SEQ ID NO: 720887 - protein, 23 aa, Mycobacterium
RGMSLRSPARFLAVAERLVQLWK

SEQ ID NO: 720888 - protein, 20 aa, Mycobacterium
RGMSNLCVLGAAIIAGPQLD

SEQ ID NO: 720889 - protein, 22 aa, Mycobacterium
RGMSYARLRQGPVQWPCPPESE

SEQ ID NO: 720890 - protein, 24 aa, Mycobacterium
RGMTDFPMALSYVLDPTAAADDTL

SEQ ID NO: 720891 - protein, 20 aa, Mycobacterium
RGMVPWTRLGGKLIAIPPNT

SEQ ID NO: 720892 - protein, 27 aa, Mycobacterium
RGMWAFDPWKNAACHIGAALSISERRA

SEQ ID NO: 720893 - protein, 18 aa, Mycobacterium
RGMYRYRAATKQCAHKAQ

SEQ ID NO: 720894 - protein, 17 aa, Mycobacterium
RGNDRPALWIVEEDGAE

SEQ ID NO: 720895 - protein, 22 aa, Mycobacterium
RGNELWQIGLLELWLQRHGITG

SEQ ID NO: 720896 - protein, 20 aa, Mycobacterium
RGNGHLRLRSDDTGDRAWTL

SEQ ID NO: 720897 - protein, 27 aa, Mycobacterium
RGNGLNCMSVRWGLWQGTTIAGADDVA

SEQ ID NO: 720898 - protein, 26 aa, Mycobacterium
RGNHTQLPLGFMVEWEATGATVEAEH

SEQ ID NO: 720899 - protein, 22 aa, Mycobacterium
RGNHVFIEMNPRIQVEHTVTEE

SEQ ID NO: 720900 - protein, 20 aa, Mycobacterium
RGNIPGGFASMYKVLTTMED

SEQ ID NO: 720901 - protein, 18 aa, Mycobacterium
RGNPAPMLLASRRVIGDD

SEQ ID NO: 720902 - protein, 24 aa, Mycobacterium
RGNQPRPALLRVLDKTDPQIATRL

SEQ ID NO: 720903 - protein, 19 aa, Mycobacterium
RGNVADFLLHSALEDTFIR

SEQ ID NO: 720904 - protein, 17 aa, Mycobacterium
RGNVLTIPMSARRGDDG

SEQ ID NO: 720905 - protein, 27 aa, Mycobacterium
RGPAGGLPITYSRKVFIPVTRLCRDTC

SEQ ID NO: 720906 - protein, 20 aa, Mycobacterium
RGPAHSAFTLPELVGLTAAS

SEQ ID NO: 720907 - protein, 18 aa, Mycobacterium
RGPALQVMADMGVLAELE

SEQ ID NO: 720908 - protein, 18 aa, Mycobacterium
RGPCLGRPAYRPRPRQPV

SEQ ID NO: 720909 - protein, 18 aa, Mycobacterium
RGPDFSAMLEPVFGRDAL

SEQ ID NO: 720910 - protein, 18 aa, Mycobacterium
RGPDFSAMLEPVFGRDGL

SEQ ID NO: 720911 - protein, 19 aa, Mycobacterium
RGPDLSGMLEPLFGADGLR

SEQ ID NO: 720912 - protein, 24 aa, Mycobacterium
RGPDPASQVEFMLAEYRRFPELPG

SEQ ID NO: 720913 - protein, 19 aa, Mycobacterium
RGPEIGWAKYVISATTPFS

SEQ ID NO: 720914 - protein, 22 aa, Mycobacterium
RGPELLAYIAEYRRRAGVTPAT

SEQ ID NO: 720915 - protein, 17 aa, Mycobacterium
RGPFLLDVAHLADDIER

SEQ ID NO: 720916 - protein, 18 aa, Mycobacterium
RGPGRIPQLLERIAEHLE

SEQ ID NO: 720917 - protein, 18 aa, Mycobacterium
RGPGRKSTFTDFRERYEA

SEQ ID NO: 720918 - protein, 23 aa, Mycobacterium
RGPGRPPLMFRAVQQMDRGGARH

SEQ ID NO: 720919 - protein, 18 aa, Mycobacterium
RGPGRWSLQQQIVHFPGQ

SEQ ID NO: 720920 - protein, 18 aa, Mycobacterium
RGPGWRLAVHPFVGGGAG

SEQ ID NO: 720921 - protein, 19 aa, Mycobacterium
RGPGYRYLRARGNSIEGGT

SEQ ID NO: 720922 - protein, 21 aa, Mycobacterium
RGPGYRYLRARGNSIEGGTSE

SEQ ID NO: 720923 - protein, 19 aa, Mycobacterium
RGPHRVLRGDLAFAGLPGV

SEQ ID NO: 720924 - protein, 26 aa, Mycobacterium
RGPIDRFHRRLLWPIRSSAGEVIGFG

SEQ ID NO: 720925 - protein, 26 aa, Mycobacterium
RGPIDRFHRRLLWPIRTAAGEVIGFG

SEQ ID NO: 720926 - protein, 21 aa, Mycobacterium
RGPIPAGVPVVRGRQGGGVEL

SEQ ID NO: 720927 - protein, 32 aa, Mycobacterium
RGPLAEVRARRAIALCTPREAIARDAGVAIAN

SEQ ID NO: 720928 - protein, 17 aa, Mycobacterium
RGPLCVLAGAGTGKTRT

SEQ ID NO: 720929 - protein, 19 aa, Mycobacterium
RGPLDIAVTALRAAGAPDA

SEQ ID NO: 720930 - protein, 27 aa, Mycobacterium
RGPLLDLSFGDLQFGNRDTTAIGDGAV

SEQ ID NO: 720931 - protein, 18 aa, Mycobacterium
RGPLPPHIQHFLDALEGY

SEQ ID NO: 720932 - protein, 18 aa, Mycobacterium
RGPLRRRRVPVVIHEANA

SEQ ID NO: 720933 - protein, 20 aa, Mycobacterium
RGPLTVPIWYQYSPGGELWF

SEQ ID NO: 720934 - protein, 26 aa, Mycobacterium
RGPMDRFHRRLLWPIRASGGEVIGFG

SEQ ID NO: 720935 - protein, 25 aa, Mycobacterium
RGPMDRFHRRLLWPIRASSGEVIGF

SEQ ID NO: 720936 - protein, 26 aa, Mycobacterium
RGPMDRFHRRLLWPIRSSAGEVIGFG

SEQ ID NO: 720937 - protein, 25 aa, Mycobacterium
RGPMDRFHRRLLWPIRVSSGETIGF

SEQ ID NO: 720938 - protein, 17 aa, Mycobacterium
RGPMVVQVNLRVGELPA

SEQ ID NO: 720939 - protein, 20 aa, Mycobacterium
RGPNAGSRFLLDQATTSAGR

SEQ ID NO: 720940 - protein, 18 aa, Mycobacterium
RGPNAGSRFLLDQPTTSA

SEQ ID NO: 720941 - protein, 19 aa, Mycobacterium
RGPNAGSRFLLDQPTTSAG

SEQ ID NO: 720942 - protein, 25 aa, Mycobacterium
RGPNAGSRFLLDRPVTSAGRHADND

SEQ ID NO: 720943 - protein, 25 aa, Mycobacterium
RGPNGRLPVSYSRKVFIPVTHLCRD

SEQ ID NO: 720944 - protein, 17 aa, Mycobacterium
RGPNVFVGYWMKPATTA

SEQ ID NO: 720945 - protein, 20 aa, Mycobacterium
RGPQPGSCWQYSNLGFVTLG

SEQ ID NO: 720946 - protein, 19 aa, Mycobacterium
RGPRAEVVLSLRNPEPTSG

SEQ ID NO: 720947 - protein, 17 aa, Mycobacterium
RGPRISRGMRTPFVAPI

SEQ ID NO: 720948 - protein, 20 aa, Mycobacterium
RGPRTASCGVDHQIGGQDSF

SEQ ID NO: 720949 - protein, 19 aa, Mycobacterium
RGPSADAFVAAYGPYLAWL

SEQ ID NO: 720950 - protein, 18 aa, Mycobacterium
RGPSKFLAELKLLPQEEW

SEQ ID NO: 720951 - protein, 19 aa, Mycobacterium
RGPSPWTIGERELFAAFVS

SEQ ID NO: 720952 - protein, 22 aa, Mycobacterium
RGPSQWLLRLLATQTQRAELVP

SEQ ID NO: 720953 - protein, 19 aa, Mycobacterium
RGPTSPAIAPGEHALAAKA

SEQ ID NO: 720954 - protein, 25 aa, Mycobacterium
RGPTVPMLPNGWAPETGGSAAGGPV

SEQ ID NO: 720955 - protein, 21 aa, Mycobacterium
RGPVATVLIQRGTLRVGDSIV

SEQ ID NO: 720956 - protein, 20 aa, Mycobacterium
RGPVATVLVQRGTLRVGDSV

SEQ ID NO: 720957 - protein, 19 aa, Mycobacterium
RGPVGLRRQVRTLAGLGSI

SEQ ID NO: 720958 - protein, 18 aa, Mycobacterium
RGPVHLVALPRFPEPGSA

SEQ ID NO: 720959 - protein, 17 aa, Mycobacterium
RGPVKRAKKAPAKAAKK

SEQ ID NO: 720960 - protein, 18 aa, Mycobacterium
RGPVLDRIVEMTVAALAV

SEQ ID NO: 720961 - protein, 23 aa, Mycobacterium
RGPWADHEWRGWWGDEPPFHTPV

SEQ ID NO: 720962 - protein, 20 aa, Mycobacterium
RGPYPTMYVNQPWTIRQYAG

SEQ ID NO: 720963 - protein, 21 aa, Mycobacterium
RGPYPTMYVNQPWTIRQYAGF

SEQ ID NO: 720964 - protein, 26 aa, Mycobacterium
RGQAPEGGWPVIAWAHGTVGLGDDCA

SEQ ID NO: 720965 - protein, 18 aa, Mycobacterium
RGQDDARTLLNCVGALHS

SEQ ID NO: 720966 - protein, 20 aa, Mycobacterium
RGQEGLPDIAWFTPDGAEMT

SEQ ID NO: 720967 - protein, 17 aa, Mycobacterium
RGQERIAKTLLLSAIAP

SEQ ID NO: 720968 - protein, 18 aa, Mycobacterium
RGQISCAPNFGFELAVRR

SEQ ID NO: 720969 - protein, 21 aa, Mycobacterium
RGQLLHSWYMLLFQIPRLPEW

SEQ ID NO: 720970 - protein, 18 aa, Mycobacterium
RGQLPAGWATDMSDEYEW

SEQ ID NO: 720971 - protein, 28 aa, Mycobacterium
RGQLPVKLCYSGPFFRYERPQAGRYRQL

SEQ ID NO: 720972 - protein, 20 aa, Mycobacterium
RGQLVDWTWQMVRDTVLDRL

SEQ ID NO: 720973 - protein, 25 aa, Mycobacterium
RGQMAICDFPLFGVEIETMFRHLQI

SEQ ID NO: 720974 - protein, 17 aa, Mycobacterium
RGQMRTEILRLQRKLGV

SEQ ID NO: 720975 - protein, 17 aa, Mycobacterium
RGQPIALVPATGTVTEK

SEQ ID NO: 720976 - protein, 28 aa, Mycobacterium
RGQRILRQCSVCLYAGSIMPDDLLAECP

SEQ ID NO: 720977 - protein, 28 aa, Mycobacterium
RGQRLLERCPVCLYAGSIMPKDLLAHCP

SEQ ID NO: 720978 - protein, 24 aa, Mycobacterium
RGQTLAQLALAWVLRDPAVSSTLI

SEQ ID NO: 720979 - protein, 18 aa, Mycobacterium
RGQTRTMGFLTEARELLR

SEQ ID NO: 720980 - protein, 20 aa, Mycobacterium
RGQYFKSGFGPVIKEAAKFY

SEQ ID NO: 720981 - protein, 17 aa, Mycobacterium
RGQYWIHPALPEVIENA

SEQ ID NO: 720982 - protein, 19 aa, Mycobacterium
RGRAAELIGAMTSASSVVA

SEQ ID NO: 720983 - protein, 17 aa, Mycobacterium
RGRADLIKYLDGLGFTV

SEQ ID NO: 720984 - protein, 18 aa, Mycobacterium
RGRAKHTSTLVSRENGMP

SEQ ID NO: 720985 - protein, 24 aa, Mycobacterium
RGRAPRARPHMTLELTGVARLTVD

SEQ ID NO: 720986 - protein, 36 aa, Mycobacterium
RGRARVEYKLRDWLFARQRYWGEPFPVVYDSEGRAH

SEQ ID NO: 720987 - protein, 19 aa, Mycobacterium
RGRDCCFHRSVFLPRPAVK

SEQ ID NO: 720988 - protein, 25 aa, Mycobacterium
RGRDDRLRWWAGPWPVDERWWDDRP

SEQ ID NO: 720989 - protein, 25 aa, Mycobacterium
RGRDGMSLAEFWSSKGALSYLGLAV

SEQ ID NO: 720990 - protein, 20 aa, Mycobacterium
RGRDMPVGVLVGSWHTIDGL

SEQ ID NO: 720991 - protein, 20 aa, Mycobacterium
RGRDMPVGVLVGSWTTIDGL

SEQ ID NO: 720992 - protein, 21 aa, Mycobacterium
RGRDMPVPVLVGSWHTISGLV

SEQ ID NO: 720993 - protein, 21 aa, Mycobacterium
RGRDTPAWQYVRACRQRDRLR

SEQ ID NO: 720994 - protein, 31 aa, Mycobacterium
RGREGGYELARPGDEISIADVLRCIDGPLAS

SEQ ID NO: 720995 - protein, 36 aa, Mycobacterium
RGREGGYELARPGSEISIADVLRCIDGPLASVRDIG

SEQ ID NO: 720996 - protein, 30 aa, Mycobacterium
RGREGGYELARSGSDISIADVLRCIDGPLA

SEQ ID NO: 720997 - protein, 26 aa, Mycobacterium
RGREGRALDDFATWCALAEKYGDDWH

SEQ ID NO: 720998 - protein, 20 aa, Mycobacterium
RGRELCPGGRLVVMTQGVGE

SEQ ID NO: 720999 - protein, 19 aa, Mycobacterium
RGRELLRRLIATCDVVVEN

SEQ ID NO: 721000 - protein, 23 aa, Mycobacterium
RGREMPMAALAGMRRQQSLPHGL

SEQ ID NO: 721001 - protein, 17 aa, Mycobacterium
RGREVLHRLIATCDVIA

SEQ ID NO: 721002 - protein, 19 aa, Mycobacterium
RGREVSVEREVFPALLADS

SEQ ID NO: 721003 - protein, 19 aa, Mycobacterium
RGREVSVEREVFPALLSDP

SEQ ID NO: 721004 - protein, 21 aa, Mycobacterium
RGRFFPPLFPPEGMMAEAVAR

SEQ ID NO: 721005 - protein, 18 aa, Mycobacterium
RGRFGRLVVGMQASGAKR

SEQ ID NO: 721006 - protein, 26 aa, Mycobacterium
RGRFLRWALPVAYRLPGLGRLRAPVT

SEQ ID NO: 721007 - protein, 21 aa, Mycobacterium
RGRGAMIAVELVKSGTLEPDP

SEQ ID NO: 721008 - protein, 19 aa, Mycobacterium
RGRGCDRHLLGLFIEALRE

SEQ ID NO: 721009 - protein, 20 aa, Mycobacterium
RGRGGFAGMVVGSVAESVAQ

SEQ ID NO: 721010 - protein, 23 aa, Mycobacterium
RGRGGFPGMLLGSVGSAVAHSAK

SEQ ID NO: 721011 - protein, 22 aa, Mycobacterium
RGRGGFPGMLLGSVSSAVAQSA

SEQ ID NO: 721012 - protein, 21 aa, Mycobacterium
RGRGGFTGMLLGSVSSAVAQE

SEQ ID NO: 721013 - protein, 23 aa, Mycobacterium
RGRGGLLRLGLTGTAAFSHLPRI

SEQ ID NO: 721014 - protein, 33 aa, Mycobacterium
RGRGIPRERLESVAEHYLHFGGVSPINGINRDL

SEQ ID NO: 721015 - protein, 25 aa, Mycobacterium
RGRGIRPGLPLARDIWDLGYHCFPA

SEQ ID NO: 721016 - protein, 19 aa, Mycobacterium
RGRGLALMRTLMDDVTIQA

SEQ ID NO: 721017 - protein, 18 aa, Mycobacterium
RGRGMNAIIGPFSYTSRE

SEQ ID NO: 721018 - protein, 22 aa, Mycobacterium
RGRHAEALGHCSAVLAKDAANA

SEQ ID NO: 721019 - protein, 20 aa, Mycobacterium
RGRHGRPLELYVCDGKGCIG

SEQ ID NO: 721020 - protein, 20 aa, Mycobacterium
RGRHPLPSGVALQAAARRWG

SEQ ID NO: 721021 - protein, 20 aa, Mycobacterium
RGRIAALQRWPDGLQAAVEA

SEQ ID NO: 721022 - protein, 26 aa, Mycobacterium
RGRIALAAGSAARWASRISGRGAGSM

SEQ ID NO: 721023 - protein, 26 aa, Mycobacterium
RGRIGRGEHPSLCLLATNLPESSKAG

SEQ ID NO: 721024 - protein, 18 aa, Mycobacterium
RGRIKELINRGGEKISPE

SEQ ID NO: 721025 - protein, 18 aa, Mycobacterium
RGRIRSAGSIKKITKAQE

SEQ ID NO: 721026 - protein, 18 aa, Mycobacterium
RGRLALLGDSGFEGIAFV

SEQ ID NO: 721027 - protein, 18 aa, Mycobacterium
RGRLCPKGSASKQLVTGA

SEQ ID NO: 721028 - protein, 22 aa, Mycobacterium
RGRLINALLWTAQRVPLLDPIR

SEQ ID NO: 721029 - protein, 17 aa, Mycobacterium
RGRLNMMSQTYASGHRN

SEQ ID NO: 721030 - protein, 20 aa, Mycobacterium
RGRLQRGETVLVHGAAGGIG

SEQ ID NO: 721031 - protein, 18 aa, Mycobacterium
RGRLRRWGAAAGRLLRRK

SEQ ID NO: 721032 - protein, 22 aa, Mycobacterium
RGRLSVEVMARGTAWLDTGTFD

SEQ ID NO: 721033 - protein, 20 aa, Mycobacterium
RGRNGVLYAGEVNWDAAGLG

SEQ ID NO: 721034 - protein, 19 aa, Mycobacterium
RGRPDDEFCFVVHGTMADP

SEQ ID NO: 721035 - protein, 19 aa, Mycobacterium
RGRPGWHTECVAMCEAYLG

SEQ ID NO: 721036 - protein, 18 aa, Mycobacterium
RGRPHLCFDTFNAAQKMT

SEQ ID NO: 721037 - protein, 18 aa, Mycobacterium
RGRPHYCFDTFNAEQKMT

SEQ ID NO: 721038 - protein, 19 aa, Mycobacterium
RGRPLRKALQIGAACGALN

SEQ ID NO: 721039 - protein, 21 aa, Mycobacterium
RGRPRWAMTAFGEMQPRYENR

SEQ ID NO: 721040 - protein, 25 aa, Mycobacterium
RGRQLPLRLVYVIPAADVPGGSAQN

SEQ ID NO: 721041 - protein, 19 aa, Mycobacterium
RGRRAEIFGLHPATDSGDA

SEQ ID NO: 721042 - protein, 18 aa, Mycobacterium
RGRRCVTGLADVTDLGAV

SEQ ID NO: 721043 - protein, 18 aa, Mycobacterium
RGRRCVTGVADVSDLQAV

SEQ ID NO: 721044 - protein, 17 aa, Mycobacterium
RGRRFEVIGFTPGKVDM

SEQ ID NO: 721045 - protein, 22 aa, Mycobacterium
RGRRKTRIGYVVSDKMQKTIVV

SEQ ID NO: 721046 - protein, 23 aa, Mycobacterium
RGRRLGWSDTWVRAADGANPYAG

SEQ ID NO: 721047 - protein, 24 aa, Mycobacterium
RGRRPAVIGTAGWKAIDEAEIARG

SEQ ID NO: 721048 - protein, 25 aa, Mycobacterium
RGRRRCGRCGRRRGGCRGRGRGGGS

SEQ ID NO: 721049 - protein, 22 aa, Mycobacterium
RGRSRYVPMLAGVGRRPRRDRP

SEQ ID NO: 721050 - protein, 27 aa, Mycobacterium
RGRTGVFSLDAGEWFRSFPAAQASSLF

SEQ ID NO: 721051 - protein, 20 aa, Mycobacterium
RGRTLRFGIRLHTISRDTSE

SEQ ID NO: 721052 - protein, 18 aa, Mycobacterium
RGRTMYPPEVGLHAEALV

SEQ ID NO: 721053 - protein, 17 aa, Mycobacterium
RGRTMYPPEVGLHAESS

SEQ ID NO: 721054 - protein, 28 aa, Mycobacterium
RGRVERMHRACLILTFGGGTNEVQRDII

SEQ ID NO: 721055 - protein, 17 aa, Mycobacterium
RGRVHIAAIAVGAAQRA

SEQ ID NO: 721056 - protein, 20 aa, Mycobacterium
RGRVHIAAIAVGTAQRALDE

SEQ ID NO: 721057 - protein, 17 aa, Mycobacterium
RGRVIAMDTNLARAVDG

SEQ ID NO: 721058 - protein, 27 aa, Mycobacterium
RGRVKQLLLKIGWPAEDLAGYVDGEAH

SEQ ID NO: 721059 - protein, 30 aa, Mycobacterium
RGRVQSVLLPRLLDWLSYAPDPDRGLLAYR

SEQ ID NO: 721060 - protein, 28 aa, Mycobacterium
RGRVQSVLLPRLLHWMSYAPDPDGGLLA

SEQ ID NO: 721061 - protein, 21 aa, Mycobacterium
RGRVVLNYRKSHLFGDTERNV

SEQ ID NO: 721062 - protein, 19 aa, Mycobacterium
RGRWGCVLGGDPDRRITAM

SEQ ID NO: 721063 - protein, 19 aa, Mycobacterium
RGRWGCVLGGDPTRRVTAM

SEQ ID NO: 721064 - protein, 20 aa, Mycobacterium
RGRWGCVLGGDVDRRVTAMR

SEQ ID NO: 721065 - protein, 19 aa, Mycobacterium
RGRYEYAINNSFGFGGHNV

SEQ ID NO: 721066 - protein, 18 aa, Mycobacterium
RGRYRISVGSAEFGNGTT

SEQ ID NO: 721067 - protein, 17 aa, Mycobacterium
RGRYRVVLLDEYQDTGH

SEQ ID NO: 721068 - protein, 17 aa, Mycobacterium
RGSALVGAFNEAHILAI

SEQ ID NO: 721069 - protein, 19 aa, Mycobacterium
RGSAMGARTTCPARTAVTA

SEQ ID NO: 721070 - protein, 19 aa, Mycobacterium
RGSAMPVNRYRSFADEVEP

SEQ ID NO: 721071 - protein, 21 aa, Mycobacterium
RGSATPGAFQLVLCDLGTPRP

SEQ ID NO: 721072 - protein, 25 aa, Mycobacterium
RGSDRYPLVTGYVVDMGGRTVFISA

SEQ ID NO: 721073 - protein, 17 aa, Mycobacterium
RGSEIAPELAGYWTGAF

SEQ ID NO: 721074 - protein, 20 aa, Mycobacterium
RGSFRGARVPIVIDDDDRAA

SEQ ID NO: 721075 - protein, 18 aa, Mycobacterium
RGSFSLDLGYFLQGALTI

SEQ ID NO: 721076 - protein, 22 aa, Mycobacterium
RGSGCGLSGAARPCEDGLLISF

SEQ ID NO: 721077 - protein, 21 aa, Mycobacterium
RGSGEPVVFIAGHGGAGRTWH

SEQ ID NO: 721078 - protein, 20 aa, Mycobacterium
RGSGEPVVFISGHGGAGRTW

SEQ ID NO: 721079 - protein, 17 aa, Mycobacterium
RGSGVVLQLDDGSTIDA

SEQ ID NO: 721080 - protein, 19 aa, Mycobacterium
RGSGYAVAALCGAGGQGDA

SEQ ID NO: 721081 - protein, 21 aa, Mycobacterium
RGSGYAVAALCGAGGQGDALV

SEQ ID NO: 721082 - protein, 18 aa, Mycobacterium
RGSGYGVAALCGGGGQGD

SEQ ID NO: 721083 - protein, 27 aa, Mycobacterium
RGSHHLGHNCVLAFLDVDGLKKVNDEL

SEQ ID NO: 721084 - protein, 19 aa, Mycobacterium
RGSISLPLLVTDMPDRVAW

SEQ ID NO: 721085 - protein, 18 aa, Mycobacterium
RGSLGYTAAKHGIVGLMR

SEQ ID NO: 721086 - protein, 19 aa, Mycobacterium
RGSLKGFLISGRWPDSTKE

SEQ ID NO: 721087 - protein, 21 aa, Mycobacterium
RGSLKGFVISGRWPDSTKEWA

SEQ ID NO: 721088 - protein, 21 aa, Mycobacterium
RGSLKGFVVSGRWPDSTKEWA

SEQ ID NO: 721089 - protein, 18 aa, Mycobacterium
RGSLKGLRLSYFGDGANN

SEQ ID NO: 721090 - protein, 21 aa, Mycobacterium
RGSLPARLRLVYLADHQILDY

SEQ ID NO: 721091 - protein, 18 aa, Mycobacterium
RGSLPGSVAAPVLKVRGR

SEQ ID NO: 721092 - protein, 18 aa, Mycobacterium
RGSLVAAALAARLGTGVL

SEQ ID NO: 721093 - protein, 19 aa, Mycobacterium
RGSMKAGIFSGTVADAPTD

SEQ ID NO: 721094 - protein, 17 aa, Mycobacterium
RGSMKAGVFSGDALADP

SEQ ID NO: 721095 - protein, 18 aa, Mycobacterium
RGSMKAGVFSGDALADVD

SEQ ID NO: 721096 - protein, 26 aa, Mycobacterium
RGSMRGRTLWVVPFCMGPLNAEDPKL

SEQ ID NO: 721097 - protein, 18 aa, Mycobacterium
RGSNPTWRQLESALAELE

SEQ ID NO: 721098 - protein, 25 aa, Mycobacterium
RGSPFALGCLAGWLSTEFPPHVLTG

SEQ ID NO: 721099 - protein, 21 aa, Mycobacterium
RGSPFALGWVAGWVSTEFPLH

SEQ ID NO: 721100 - protein, 23 aa, Mycobacterium
RGSPRAVLRVAPLSVAGLLAATV

SEQ ID NO: 721101 - protein, 17 aa, Mycobacterium
RGSPRLRAALANYLGRV

SEQ ID NO: 721102 - protein, 20 aa, Mycobacterium
RGSQWAGMGRQLLADEPAFA

SEQ ID NO: 721103 - protein, 21 aa, Mycobacterium
RGSQWSGMGHRLFSEEPAFRE

SEQ ID NO: 721104 - protein, 25 aa, Mycobacterium
RGSRGVSLAEGWKTQAYAYLGITVP

SEQ ID NO: 721105 - protein, 25 aa, Mycobacterium
RGSRGVSLAEVWKTQAYAYLGITVP

SEQ ID NO: 721106 - protein, 17 aa, Mycobacterium
RGSRIGRPIPDLECLLT

SEQ ID NO: 721107 - protein, 25 aa, Mycobacterium
RGSRLLPRMEPFVGELVGRGLAEAG

SEQ ID NO: 721108 - protein, 18 aa, Mycobacterium
RGSRLPVWLEEWGFERPR

SEQ ID NO: 721109 - protein, 22 aa, Mycobacterium
RGSRVSLRVPVRGDKRALAETV

SEQ ID NO: 721110 - protein, 18 aa, Mycobacterium
RGSSFLWGVWHDAKYIAD

SEQ ID NO: 721111 - protein, 25 aa, Mycobacterium
RGSSYIKGRVAPVFDLGVGMDPEIS

SEQ ID NO: 721112 - protein, 21 aa, Mycobacterium
RGSTCGDVFRSGEPLISEAFS

SEQ ID NO: 721113 - protein, 19 aa, Mycobacterium
RGSTRPDGVVAWAGDPAAG

SEQ ID NO: 721114 - protein, 18 aa, Mycobacterium
RGSTVVCTVTGNGLKDPD

SEQ ID NO: 721115 - protein, 17 aa, Mycobacterium
RGSVPLSVVITRIGSGA

SEQ ID NO: 721116 - protein, 18 aa, Mycobacterium
RGSWQPWNGTGWGQAGGV

SEQ ID NO: 721117 - protein, 17 aa, Mycobacterium
RGTAGFLTGFRRAGARR

SEQ ID NO: 721118 - protein, 18 aa, Mycobacterium
RGTAKGPAGQNFTFLPGT

SEQ ID NO: 721119 - protein, 34 aa, Mycobacterium
RGTALLCPFDPLIFFRPRVERLFEFHYRIEIYTP

SEQ ID NO: 721120 - protein, 24 aa, Mycobacterium
RGTDVCTGEARISRSDSRVTHDRG

SEQ ID NO: 721121 - protein, 21 aa, Mycobacterium
RGTEHFSRIVHPWSCTAVPVH

SEQ ID NO: 721122 - protein, 19 aa, Mycobacterium
RGTELVRWADTALRLADRE

SEQ ID NO: 721123 - protein, 23 aa, Mycobacterium
RGTEMDGLLGGFAKRATDVGARH

SEQ ID NO: 721124 - protein, 18 aa, Mycobacterium
RGTEVIHIDPRFTRTSAL

SEQ ID NO: 721125 - protein, 23 aa, Mycobacterium
RGTGARGLRAIMEEVLLPVMYDI

SEQ ID NO: 721126 - protein, 21 aa, Mycobacterium
RGTGARGLRAIMEEVLQPVMY

SEQ ID NO: 721127 - protein, 18 aa, Mycobacterium
RGTGRPVAAPHLYSRGFS

SEQ ID NO: 721128 - protein, 17 aa, Mycobacterium
RGTHLVFDAAMFGNPTA

SEQ ID NO: 721129 - protein, 20 aa, Mycobacterium
RGTHLVFRAASFGGLSAALT

SEQ ID NO: 721130 - protein, 20 aa, Mycobacterium
RGTIVHRVEIDAGRISRAKI

SEQ ID NO: 721131 - protein, 20 aa, Mycobacterium
RGTLKITIGAGYPLEQAAQA

SEQ ID NO: 721132 - protein, 19 aa, Mycobacterium
RGTMDHWDPAFLDRLAATH

SEQ ID NO: 721133 - protein, 23 aa, Mycobacterium
RGTPGEFCTRGYSVMLGYWREDE

SEQ ID NO: 721134 - protein, 22 aa, Mycobacterium
RGTRADEVIGLFQEKASFGTVE

SEQ ID NO: 721135 - protein, 23 aa, Mycobacterium
RGTRAHSARSWLGDNAIHKLAAV

SEQ ID NO: 721136 - protein, 22 aa, Mycobacterium
RGTRLPVWLTQWGYQRPPEETV

SEQ ID NO: 721137 - protein, 17 aa, Mycobacterium
RGTSSKNQSRWQFGVLG

SEQ ID NO: 721138 - protein, 19 aa, Mycobacterium
RGTSWPAALRKAGTALSEF

SEQ ID NO: 721139 - protein, 17 aa, Mycobacterium
RGTTAFMQPGGKIEPGE

SEQ ID NO: 721140 - protein, 19 aa, Mycobacterium
RGTTLSRLDAVTVDVPAAG

SEQ ID NO: 721141 - protein, 30 aa, Mycobacterium
RGTTWPRQLPWLIRHGRVYTYDAPWHRGRE

SEQ ID NO: 721142 - protein, 19 aa, Mycobacterium
RGTVIALPHSGNWDMAGVW

SEQ ID NO: 721143 - protein, 19 aa, Mycobacterium
RGTWSAAIQHGGPVSGLLV

SEQ ID NO: 721144 - protein, 19 aa, Mycobacterium
RGVAELVAAIPGDPIDYGL

SEQ ID NO: 721145 - protein, 18 aa, Mycobacterium
RGVAIPVAAQYFGQMGVV

SEQ ID NO: 721146 - protein, 33 aa, Mycobacterium
RGVAPGQCVALLFPRCAEAIMAMLAVLKTGAAY

SEQ ID NO: 721147 - protein, 27 aa, Mycobacterium
RGVAPKWAASISGYWRRGRTEETFRVW

SEQ ID NO: 721148 - protein, 17 aa, Mycobacterium
RGVARIGLANYFAGALL

SEQ ID NO: 721149 - protein, 23 aa, Mycobacterium
RGVARLRVLLPLLDGGAESPQES

SEQ ID NO: 721150 - protein, 19 aa, Mycobacterium
RGVATVEFLVAGDKFVFLE

SEQ ID NO: 721151 - protein, 24 aa, Mycobacterium
RGVCPALGCDGVLERFVPPPLDRD

SEQ ID NO: 721152 - protein, 20 aa, Mycobacterium
RGVDAMSMFGMQARRKKLMQ

SEQ ID NO: 721153 - protein, 23 aa, Mycobacterium
RGVDGSVCRWARILVYEPPHRVV

SEQ ID NO: 721154 - protein, 23 aa, Mycobacterium
RGVDGSVCRWARILVYEPPRRLV

SEQ ID NO: 721155 - protein, 17 aa, Mycobacterium
RGVDLILGGFLHFQEEI

SEQ ID NO: 721156 - protein, 17 aa, Mycobacterium
RGVDVLRFAPSARDEGL

SEQ ID NO: 721157 - protein, 22 aa, Mycobacterium
RGVECVRHLVRITRELPEIMGE

SEQ ID NO: 721158 - protein, 20 aa, Mycobacterium
RGVEGQWLYALGDVNRRALL

SEQ ID NO: 721159 - protein, 24 aa, Mycobacterium
RGVELKAVHAWSDLEVVDLPGLDW

SEQ ID NO: 721160 - protein, 20 aa, Mycobacterium
RGVENWPVTVSYDLDAELPA

SEQ ID NO: 721161 - protein, 19 aa, Mycobacterium
RGVFTALATQGWRMLAAAL

SEQ ID NO: 721162 - protein, 17 aa, Mycobacterium
RGVGGEFHGGVGEGVER

SEQ ID NO: 721163 - protein, 23 aa, Mycobacterium
RGVGLVAVHAWWSPGAFEMPGFD

SEQ ID NO: 721164 - protein, 18 aa, Mycobacterium
RGVGQGSLHFAITTPDLT

SEQ ID NO: 721165 - protein, 17 aa, Mycobacterium
RGVGVGQVLAITFTNKA

SEQ ID NO: 721166 - protein, 19 aa, Mycobacterium
RGVGVIELRGDPVTSGYLT

SEQ ID NO: 721167 - protein, 17 aa, Mycobacterium
RGVGVIELRGESVTPGY

SEQ ID NO: 721168 - protein, 18 aa, Mycobacterium
RGVGVIFQSAPLLRRRTV

SEQ ID NO: 721169 - protein, 19 aa, Mycobacterium
RGVGVRRVAADRGVPVELL

SEQ ID NO: 721170 - protein, 19 aa, Mycobacterium
RGVGVRRVAPDRGVPVELL

SEQ ID NO: 721171 - protein, 22 aa, Mycobacterium
RGVGYLLKTRVTAVAELIDAMH

SEQ ID NO: 721172 - protein, 19 aa, Mycobacterium
RGVHGFDLTFCAPKSVSLI

SEQ ID NO: 721173 - protein, 18 aa, Mycobacterium
RGVHVLMEHPVRADLLRE

SEQ ID NO: 721174 - protein, 26 aa, Mycobacterium
RGVIADCMSHWTLPHLVGSAAAADIH

SEQ ID NO: 721175 - protein, 26 aa, Mycobacterium
RGVIGDCMSHWTLLRLVGLATAADLL

SEQ ID NO: 721176 - protein, 25 aa, Mycobacterium
RGVIKPGHVAAVRFTINGVYQGETR

SEQ ID NO: 721177 - protein, 26 aa, Mycobacterium
RGVILATGGFEWDPVLVRAFLRGPMH

SEQ ID NO: 721178 - protein, 17 aa, Mycobacterium
RGVIPMRDGEQGTPLVW

SEQ ID NO: 721179 - protein, 20 aa, Mycobacterium
RGVIWPTIPADILGQAGTAW

SEQ ID NO: 721180 - protein, 21 aa, Mycobacterium
RGVIWPTIPPDILGQAGTAWQ

SEQ ID NO: 721181 - protein, 17 aa, Mycobacterium
RGVKLVGATAHYVTEDL

SEQ ID NO: 721182 - protein, 27 aa, Mycobacterium
RGVLGDCMSHWTLPHLVGGAVAADLLL

SEQ ID NO: 721183 - protein, 28 aa, Mycobacterium
RGVLGRGMPLVWRNFLSWGTSSAGKHRC

SEQ ID NO: 721184 - protein, 20 aa, Mycobacterium
RGVLGRMYRRTVWPLRVAAL

SEQ ID NO: 721185 - protein, 26 aa, Mycobacterium
RGVLKRLGIVDCLYSLGVAHPGAVTL

SEQ ID NO: 721186 - protein, 19 aa, Mycobacterium
RGVLPSRLRLIYLADGQVL

SEQ ID NO: 721187 - protein, 17 aa, Mycobacterium
RGVLRVFTDFRYVREIG

SEQ ID NO: 721188 - protein, 18 aa, Mycobacterium
RGVLVEMYREAKARIGDP

SEQ ID NO: 721189 - protein, 17 aa, Mycobacterium
RGVLVEMYREAKARLTD

SEQ ID NO: 721190 - protein, 17 aa, Mycobacterium
RGVLVEMYREAKGRLGD

SEQ ID NO: 721191 - protein, 19 aa, Mycobacterium
RGVLYFRTGRWPDVLNQFP

SEQ ID NO: 721192 - protein, 20 aa, Mycobacterium
RGVMGDEMFHEAITSAAHSS

SEQ ID NO: 721193 - protein, 17 aa, Mycobacterium
RGVPAVGAAAVRGPAGY

SEQ ID NO: 721194 - protein, 20 aa, Mycobacterium
RGVPPTRLRLIYLADGQVLD

SEQ ID NO: 721195 - protein, 19 aa, Mycobacterium
RGVPVIPHGVALSLGSVEP

SEQ ID NO: 721196 - protein, 22 aa, Mycobacterium
RGVPVWCTLIALLDDGVPRVGV

SEQ ID NO: 721197 - protein, 23 aa, Mycobacterium
RGVPYRCGEVLVAADGEHAATII

SEQ ID NO: 721198 - protein, 17 aa, Mycobacterium
RGVQICQHHCPVSHVAE

SEQ ID NO: 721199 - protein, 17 aa, Mycobacterium
RGVRACLMLAVQADGTR

SEQ ID NO: 721200 - protein, 17 aa, Mycobacterium
RGVRALEAFAYTPALTE

SEQ ID NO: 721201 - protein, 18 aa, Mycobacterium
RGVRIVMMGGLGPAPFCG

SEQ ID NO: 721202 - protein, 24 aa, Mycobacterium
RGVRLHDLRHTFAVLQLSAGTHFM

SEQ ID NO: 721203 - protein, 25 aa, Mycobacterium
RGVRLQCPLLLLWGAEGALASADVL

SEQ ID NO: 721204 - protein, 18 aa, Mycobacterium
RGVRSARPRAVPSARKLA

SEQ ID NO: 721205 - protein, 23 aa, Mycobacterium
RGVRVRDGARLIAPASQSSDGAF

SEQ ID NO: 721206 - protein, 19 aa, Mycobacterium
RGVSDQVLFTDQGVILEQG

SEQ ID NO: 721207 - protein, 27 aa, Mycobacterium
RGVSIGALTTPHAWLAAPATAAVTSAP

SEQ ID NO: 721208 - protein, 24 aa, Mycobacterium
RGVSKAAAQVDLWFKDIAPSPDLR

SEQ ID NO: 721209 - protein, 25 aa, Mycobacterium
RGVSSCATCDGFFFKDQDIAVIGGG

SEQ ID NO: 721210 - protein, 25 aa, Mycobacterium
RGVSSCATCDGFFFRDQDIAVIGGG

SEQ ID NO: 721211 - protein, 25 aa, Mycobacterium
RGVTCVVVAEGIPCLGPVTHAGCGA

SEQ ID NO: 721212 - protein, 26 aa, Mycobacterium
RGVTDFSLAMIDPWPAGYYGAQDHYD

SEQ ID NO: 721213 - protein, 17 aa, Mycobacterium
RGVTPYVRSRVQAEELV

SEQ ID NO: 721214 - protein, 19 aa, Mycobacterium
RGVTVNTLFQMAWAAILSA

SEQ ID NO: 721215 - protein, 25 aa, Mycobacterium
RGVTVPEVCRQVIGVFVAQQEGELS

SEQ ID NO: 721216 - protein, 20 aa, Mycobacterium
RGVVELRPDVDWDKGTALAW

SEQ ID NO: 721217 - protein, 20 aa, Mycobacterium
RGVVNIRELLPLASPLAESP

SEQ ID NO: 721218 - protein, 30 aa, Mycobacterium
RGVVRVFAFAFTRYRVGGGAACVYVDGEPV

SEQ ID NO: 721219 - protein, 21 aa, Mycobacterium
RGVVVGARFHPGGFTARFGRD

SEQ ID NO: 721220 - protein, 21 aa, Mycobacterium
RGVVYCLLGRNGAGKTTTIRM

SEQ ID NO: 721221 - protein, 24 aa, Mycobacterium
RGVYEGAPRPDLILLDLNLPKYDG

SEQ ID NO: 721222 - protein, 27 aa, Mycobacterium
RGWAGSLKRHGEWMVPTRLALVRRLGS

SEQ ID NO: 721223 - protein, 25 aa, Mycobacterium
RGWAGSLKRHGEWTVPTRLALVRRL

SEQ ID NO: 721224 - protein, 25 aa, Mycobacterium
RGWAGSLKRQGEWTVPTRLALVRRL

SEQ ID NO: 721225 - protein, 20 aa, Mycobacterium
RGWALPGTFLHPGETLADAV

SEQ ID NO: 721226 - protein, 21 aa, Mycobacterium
RGWANGVVELRDRFGGQTREL

SEQ ID NO: 721227 - protein, 25 aa, Mycobacterium
RGWEAVGGDGVWDWSAELREIPELL

SEQ ID NO: 721228 - protein, 18 aa, Mycobacterium
RGWEGPGERGVRVVPVMV

SEQ ID NO: 721229 - protein, 19 aa, Mycobacterium
RGWEHRWALSVLHTALGGG

SEQ ID NO: 721230 - protein, 19 aa, Mycobacterium
RGWELAFARTQLERAAARW

SEQ ID NO: 721231 - protein, 23 aa, Mycobacterium
RGWFKENWQRAKMVAAGLPDFGP

SEQ ID NO: 721232 - protein, 20 aa, Mycobacterium
RGWHDARVIPYGPIELDPSA

SEQ ID NO: 721233 - protein, 18 aa, Mycobacterium
RGWHLLAVLERLERLAGH

SEQ ID NO: 721234 - protein, 17 aa, Mycobacterium
RGWHLLAVLERLSRVAG

SEQ ID NO: 721235 - protein, 19 aa, Mycobacterium
RGWQHRWALSVLNSALGGG

SEQ ID NO: 721236 - protein, 17 aa, Mycobacterium
RGWRSLGDMGYVDRDGY

SEQ ID NO: 721237 - protein, 23 aa, Mycobacterium
RGWSDALWDTGIEFGTIGVGKGD

SEQ ID NO: 721238 - protein, 19 aa, Mycobacterium
RGWSISAIARHTGFDRKTV

SEQ ID NO: 721239 - protein, 25 aa, Mycobacterium
RGWVQYEPYGTVLIIGAWNYPFYLT

SEQ ID NO: 721240 - protein, 24 aa, Mycobacterium
RGYADYLLRLRIVYQALEDAVRCR

SEQ ID NO: 721241 - protein, 17 aa, Mycobacterium
RGYAHIGVIQMLRERGY

SEQ ID NO: 721242 - protein, 18 aa, Mycobacterium
RGYALPFQYRVLRQPARV

SEQ ID NO: 721243 - protein, 19 aa, Mycobacterium
RGYCSDFGRTWIVGRDPAP

SEQ ID NO: 721244 - protein, 26 aa, Mycobacterium
RGYEGEGFPVVRAFAGVSAADLDPFV

SEQ ID NO: 721245 - protein, 22 aa, Mycobacterium
RGYEVSVYYLPNGTLFAMCENA

SEQ ID NO: 721246 - protein, 20 aa, Mycobacterium
RGYKGISIPTASRVSAVRGG

SEQ ID NO: 721247 - protein, 19 aa, Mycobacterium
RGYLRTGDLGFLHDGELYV

SEQ ID NO: 721248 - protein, 25 aa, Mycobacterium
RGYRVEFNSALGPYKGGLRFHPSVS

SEQ ID NO: 721249 - protein, 20 aa, Mycobacterium
RGYTCPKGRALPQLHHHPDR

SEQ ID NO: 721250 - protein, 18 aa, Mycobacterium
RGYTGWDVTSPAYVLENP

SEQ ID NO: 721251 - protein, 24 aa, Mycobacterium
RGYTRLGGEVTRGEVDWREQIDIG

SEQ ID NO: 721252 - protein, 37 aa, Mycobacterium
RGYVPALSCAKCRAVARCRHCTGPLSLPARDAPGVVC

SEQ ID NO: 721253 - protein, 34 aa, Mycobacterium
RGYVPSLACARCRTIARCRHCTGPLSLTESPQRG

SEQ ID NO: 721254 - protein, 24 aa, Mycobacterium
RGYWEPRASLLLNRSILERRGSAW

SEQ ID NO: 721255 - protein, 24 aa, Mycobacterium
RGYWEPRTAIMLNETIMRRHGSNW

SEQ ID NO: 721256 - protein, 24 aa, Mycobacterium
RGYWKRPALTATRFVANPYGGEPG

SEQ ID NO: 721257 - protein, 25 aa, Mycobacterium
RGYWKRPGLTAARFVANPYAAEPGA

SEQ ID NO: 721258 - protein, 18 aa, Mycobacterium
RGYWPPQDTFEWMLEQKM

SEQ ID NO: 721259 - protein, 25 aa, Mycobacterium
RGYWRRAALTASRFVACPFGGPGDR

SEQ ID NO: 721260 - protein, 17 aa, Mycobacterium
RHAAVRYDVLLHVVADD

SEQ ID NO: 721261 - protein, 18 aa, Mycobacterium
RHAEGWSHYLDRLVAAAL

SEQ ID NO: 721262 - protein, 24 aa, Mycobacterium
RHAETLGFHRVWYAEHHNMRSIAS

SEQ ID NO: 721263 - protein, 24 aa, Mycobacterium
RHAFEPGCSIGVLTERLVARCDHV

SEQ ID NO: 721264 - protein, 21 aa, Mycobacterium
RHAGRPRWALRDLDVTIEPGE

SEQ ID NO: 721265 - protein, 20 aa, Mycobacterium
RHAGSLPVAIAVSCAADRHI

SEQ ID NO: 721266 - protein, 30 aa, Mycobacterium
RHAGWLRAPLRWALRASLAVRSRLMVRSAV

SEQ ID NO: 721267 - protein, 30 aa, Mycobacterium
RHAGWWRAPLRWTLRGSLAVRSRLMVRSSR

SEQ ID NO: 721268 - protein, 21 aa, Mycobacterium
RHAHWLLPAVHWLERDDLLAF

SEQ ID NO: 721269 - protein, 19 aa, Mycobacterium
RHAHWPQDWHPMRRDAGDP

SEQ ID NO: 721270 - protein, 21 aa, Mycobacterium
RHALDPGAPVIRTDLDGKTDN

SEQ ID NO: 721271 - protein, 31 aa, Mycobacterium
RHAMSMIGGSAFRKGTIFERLYRDSAASMFQ

SEQ ID NO: 721272 - protein, 19 aa, Mycobacterium
RHAPAPVHRVLPPVMGSMI

SEQ ID NO: 721273 - protein, 20 aa, Mycobacterium
RHAPGLKVVVIGGGPAGMEA

SEQ ID NO: 721274 - protein, 18 aa, Mycobacterium
RHAPPGIVAHSWTLAPGE

SEQ ID NO: 721275 - protein, 17 aa, Mycobacterium
RHARAAVATAVERFGRL

SEQ ID NO: 721276 - protein, 18 aa, Mycobacterium
RHAREMLDEFGRHTATAP

SEQ ID NO: 721277 - protein, 17 aa, Mycobacterium
RHARISIDAGIDIYFCD

SEQ ID NO: 721278 - protein, 23 aa, Mycobacterium
RHARVLSALGLPVSYDADALGQL

SEQ ID NO: 721279 - protein, 21 aa, Mycobacterium
RHARVPLRLGGAGTDEVVESM

SEQ ID NO: 721280 - protein, 17 aa, Mycobacterium
RHASLLAGLDCPVHPVT

SEQ ID NO: 721281 - protein, 18 aa, Mycobacterium
RHASVTFERAGRAAEPLH

SEQ ID NO: 721282 - protein, 31 aa, Mycobacterium
RHAVFDLPPYKGRWPEIWVAAHGPRMLRATG

SEQ ID NO: 721283 - protein, 28 aa, Mycobacterium
RHAVNLLRLKAFFSRQWQQMPAAHFMTV

SEQ ID NO: 721284 - protein, 18 aa, Mycobacterium
RHAVTLPAGMALEDAAAV

SEQ ID NO: 721285 - protein, 21 aa, Mycobacterium
RHCQQVLGGIGFTAEHELHTH

SEQ ID NO: 721286 - protein, 26 aa, Mycobacterium
RHCRARSAGVSGEWSLPENFRSKLST

SEQ ID NO: 721287 - protein, 23 aa, Mycobacterium
RHCVKELLQRLASATVAVGSGGE

SEQ ID NO: 721288 - protein, 19 aa, Mycobacterium
RHDACLRALAAENRQLRRA

SEQ ID NO: 721289 - protein, 20 aa, Mycobacterium
RHDADLMASVYFKDGVDEHG

SEQ ID NO: 721290 - protein, 30 aa, Mycobacterium
RHDDGPRPTLCVIHGFFGSPYLLNGAFFAL

SEQ ID NO: 721291 - protein, 24 aa, Mycobacterium
RHDDGPRPWLVWVHGAGQGGTEDL

SEQ ID NO: 721292 - protein, 23 aa, Mycobacterium
RHDELPDRLRVHSLARTLGTTSK

SEQ ID NO: 721293 - protein, 18 aa, Mycobacterium
RHDGEWFELIWPLWRSGR

SEQ ID NO: 721294 - protein, 18 aa, Mycobacterium
RHDIDLERLVDALLDTLP

SEQ ID NO: 721295 - protein, 22 aa, Mycobacterium
RHDIEYRIAHHADLNAPPAVEV

SEQ ID NO: 721296 - protein, 19 aa, Mycobacterium
RHDLPRGDLDRVARQQAAM

SEQ ID NO: 721297 - protein, 18 aa, Mycobacterium
RHDPRFENERQWKPDDPA

SEQ ID NO: 721298 - protein, 18 aa, Mycobacterium
RHDTASDMLTEWRSALAG

SEQ ID NO: 721299 - protein, 21 aa, Mycobacterium
RHELGSILSFGIYVETGLSAM

SEQ ID NO: 721300 - protein, 21 aa, Mycobacterium
RHELLPYSDLDLMLLHDNKSD

SEQ ID NO: 721301 - protein, 18 aa, Mycobacterium
RHELPAVDWVIADHRRAT

SEQ ID NO: 721302 - protein, 19 aa, Mycobacterium
RHEPEVFERATGWYGSNSY

SEQ ID NO: 721303 - protein, 19 aa, Mycobacterium
RHEVVSLNHGIGFDTAAIE

SEQ ID NO: 721304 - protein, 18 aa, Mycobacterium
RHEYTRRLLAAVPQPDPG

SEQ ID NO: 721305 - protein, 19 aa, Mycobacterium
RHEYTRRLLEAIPRAPAPP

SEQ ID NO: 721306 - protein, 29 aa, Mycobacterium
RHFAGNPWAAPTGWRVGGSAAPVRTDMRT

SEQ ID NO: 721307 - protein, 19 aa, Mycobacterium
RHFDAWWKKQRHKTPDLLT

SEQ ID NO: 721308 - protein, 17 aa, Mycobacterium
RHFDYKPSRTEDIDGVW

SEQ ID NO: 721309 - protein, 22 aa, Mycobacterium
RHFELSWAIPGIAAVMLQMNLR

SEQ ID NO: 721310 - protein, 19 aa, Mycobacterium
RHFGLELSASALVEMQKMN

SEQ ID NO: 721311 - protein, 17 aa, Mycobacterium
RHFPDARIVNVSATPGR

SEQ ID NO: 721312 - protein, 24 aa, Mycobacterium
RHFPEGWRNYGLAGAELVFNPSAT

SEQ ID NO: 721313 - protein, 22 aa, Mycobacterium
RHFRPEFFAAMRRLCDEHDALL

SEQ ID NO: 721314 - protein, 25 aa, Mycobacterium
RHFRRISYGWVPRSRNAYADRLANE

SEQ ID NO: 721315 - protein, 19 aa, Mycobacterium
RHFSFGLGVHRCAGSNVAR

SEQ ID NO: 721316 - protein, 18 aa, Mycobacterium
RHFVQRPGEVLAIGQVLD

SEQ ID NO: 721317 - protein, 18 aa, Mycobacterium
RHGARFIVMVPGPVTTEV

SEQ ID NO: 721318 - protein, 27 aa, Mycobacterium
RHGARPGERVALLFPRSAQAIVAIVAA

SEQ ID NO: 721319 - protein, 18 aa, Mycobacterium
RHGAWWALGASWETDLPG

SEQ ID NO: 721320 - protein, 22 aa, Mycobacterium
RHGCHRAQGFLLSRPIPTDAME

SEQ ID NO: 721321 - protein, 24 aa, Mycobacterium
RHGDDLRLLLVVLGVEHVVRDATL

SEQ ID NO: 721322 - protein, 24 aa, Mycobacterium
RHGFDLDMAALMYFDGRTDAGTYL

SEQ ID NO: 721323 - protein, 20 aa, Mycobacterium
RHGGSPLLRRLIDAGTVELL

SEQ ID NO: 721324 - protein, 17 aa, Mycobacterium
RHGIALRDYLVVTRAVD

SEQ ID NO: 721325 - protein, 17 aa, Mycobacterium
RHGIALRDYLVVTRNVD

SEQ ID NO: 721326 - protein, 19 aa, Mycobacterium
RHGITLGGPIAIEIGNTEW

SEQ ID NO: 721327 - protein, 20 aa, Mycobacterium
RHGLKSMLFAPELALARAWT

SEQ ID NO: 721328 - protein, 25 aa, Mycobacterium
RHGLKSMLFAPELALARAWTCFARK

SEQ ID NO: 721329 - protein, 21 aa, Mycobacterium
RHGLSWLLPDIDCVHPLDDGS

SEQ ID NO: 721330 - protein, 17 aa, Mycobacterium
RHGPEYAAVLLRELQDW

SEQ ID NO: 721331 - protein, 22 aa, Mycobacterium
RHGPGAVGWYMGNPGAFSYAHV

SEQ ID NO: 721332 - protein, 19 aa, Mycobacterium
RHGRDLKLLFVAHRKEILM

SEQ ID NO: 721333 - protein, 24 aa, Mycobacterium
RHGRLDALVNCAGIAEPPGSSILN

SEQ ID NO: 721334 - protein, 20 aa, Mycobacterium
RHGRRSSCGRRCARRARSTP

SEQ ID NO: 721335 - protein, 18 aa, Mycobacterium
RHGWVAIKVVKEHSPEFI

SEQ ID NO: 721336 - protein, 18 aa, Mycobacterium
RHGYNYNDIAVFYRTNNS

SEQ ID NO: 721337 - protein, 19 aa, Mycobacterium
RHHCGLEPGDRAILAYPSG

SEQ ID NO: 721338 - protein, 19 aa, Mycobacterium
RHHFSSFFVDYFITPLVAA

SEQ ID NO: 721339 - protein, 28 aa, Mycobacterium
RHHHELGWFARQALRMFDDMRLEHGRLD

SEQ ID NO: 721340 - protein, 20 aa, Mycobacterium
RHHHELGWFARQSLRLFDDL

SEQ ID NO: 721341 - protein, 21 aa, Mycobacterium
RHHLDAAMVYRYWGDRRQLIV

SEQ ID NO: 721342 - protein, 19 aa, Mycobacterium
RHHTWRRIGLIDCGERWAV

SEQ ID NO: 721343 - protein, 19 aa, Mycobacterium
RHHVRAEALRMARGHDVAH

SEQ ID NO: 721344 - protein, 23 aa, Mycobacterium
RHIDETIVLPPLVTLMDTLAARG

SEQ ID NO: 721345 - protein, 19 aa, Mycobacterium
RHIDVCLNGDVNFAGVTTG

SEQ ID NO: 721346 - protein, 21 aa, Mycobacterium
RHIDVCLSEPVGYAGVSTGLD

SEQ ID NO: 721347 - protein, 25 aa, Mycobacterium
RHIHDFPALWYVPAAGAVYVAAAGE

SEQ ID NO: 721348 - protein, 20 aa, Mycobacterium
RHIHDVKAAIAWARANVDKF

SEQ ID NO: 721349 - protein, 19 aa, Mycobacterium
RHIIKLRKERAEFDGDGID

SEQ ID NO: 721350 - protein, 23 aa, Mycobacterium
RHIKARHPKTRILALSGTDDLAL

SEQ ID NO: 721351 - protein, 23 aa, Mycobacterium
RHIKGFHCVIDLNTMELLDIEEG

SEQ ID NO: 721352 - protein, 17 aa, Mycobacterium
RHIKRIPVSSSIFRAIG

SEQ ID NO: 721353 - protein, 23 aa, Mycobacterium
RHILADSAAVAWLGESPDESEGL

SEQ ID NO: 721354 - protein, 23 aa, Mycobacterium
RHILTDSGAQGWLGELPDDADGL

SEQ ID NO: 721355 - protein, 18 aa, Mycobacterium
RHIMTWKERAGLAEVEQR

SEQ ID NO: 721356 - protein, 24 aa, Mycobacterium
RHIPNPYRWGAGLIGRLMPTAVEA

SEQ ID NO: 721357 - protein, 20 aa, Mycobacterium
RHIQARIAAITESRSAVRSI

SEQ ID NO: 721358 - protein, 19 aa, Mycobacterium
RHIRFGVTVEGARWDEDAT

SEQ ID NO: 721359 - protein, 24 aa, Mycobacterium
RHIVDVKTAIAWARANVDKFGGDR

SEQ ID NO: 721360 - protein, 24 aa, Mycobacterium
RHIVRCLRRARALGANLVEVKKEA

SEQ ID NO: 721361 - protein, 24 aa, Mycobacterium
RHIVRCLRRARTLKADYVEVRQQA

SEQ ID NO: 721362 - protein, 28 aa, Mycobacterium
RHIWLHEGFACYAEWLWSEHCGERTAQQ

SEQ ID NO: 721363 - protein, 18 aa, Mycobacterium
RHIYTEWAGALNFSVPSF

SEQ ID NO: 721364 - protein, 25 aa, Mycobacterium
RHIYVEEVFLFPPIRQAGMVMPILV

SEQ ID NO: 721365 - protein, 17 aa, Mycobacterium
RHKCYVNAGGFVDGVAD

SEQ ID NO: 721366 - protein, 24 aa, Mycobacterium
RHKGGHAPFSLSWMTAVGERTKRV

SEQ ID NO: 721367 - protein, 21 aa, Mycobacterium
RHLAASYGHWVYSIRAGGGAI

SEQ ID NO: 721368 - protein, 17 aa, Mycobacterium
RHLADLGADVIKIERPG

SEQ ID NO: 721369 - protein, 24 aa, Mycobacterium
RHLAFSGGRHFCLGAALARAEGEV

SEQ ID NO: 721370 - protein, 17 aa, Mycobacterium
RHLARAGTLVRQRRRSD

SEQ ID NO: 721371 - protein, 20 aa, Mycobacterium
RHLEIRWDGQVALLSDLNST

SEQ ID NO: 721372 - protein, 21 aa, Mycobacterium
RHLEIRWDGQVALLSDLNSTN

SEQ ID NO: 721373 - protein, 22 aa, Mycobacterium
RHLEIRWDGQVALLSDLNSTNG

SEQ ID NO: 721374 - protein, 17 aa, Mycobacterium
RHLEVIALTPARLLMVV

SEQ ID NO: 721375 - protein, 19 aa, Mycobacterium
RHLGFGAGVHRCLGSNLAR

SEQ ID NO: 721376 - protein, 25 aa, Mycobacterium
RHLILPMFVADGIDEPRPINSMPGV

SEQ ID NO: 721377 - protein, 20 aa, Mycobacterium
RHLKTMKGQWAPFQSLVDLA

SEQ ID NO: 721378 - protein, 20 aa, Mycobacterium
RHLKTMKGQWAPFQSLVDLG

SEQ ID NO: 721379 - protein, 24 aa, Mycobacterium
RHLLDMRSGIAFSENYLDPAAEIH

SEQ ID NO: 721380 - protein, 23 aa, Mycobacterium
RHLLDMRSGIKFSENYDDPAAEI

SEQ ID NO: 721381 - protein, 24 aa, Mycobacterium
RHLLDMRSGVGFSENYDDPAAEIH

SEQ ID NO: 721382 - protein, 18 aa, Mycobacterium
RHLLPRLMGFSVNGSLED

SEQ ID NO: 721383 - protein, 24 aa, Mycobacterium
RHLPEIRAGRQLWCQLFSEPGAGS

SEQ ID NO: 721384 - protein, 24 aa, Mycobacterium
RHLPGVVQCGVWGNVLVALVQDCD

SEQ ID NO: 721385 - protein, 24 aa, Mycobacterium
RHLPRIGDVVVICRGETAVLATGH

SEQ ID NO: 721386 - protein, 18 aa, Mycobacterium
RHLPRIVRPLSNILGPVL

SEQ ID NO: 721387 - protein, 29 aa, Mycobacterium
RHLPYYGRWLRFVTWWPIADGAAHLTVID

SEQ ID NO: 721388 - protein, 17 aa, Mycobacterium
RHLRAPITDALSRRLGQ

SEQ ID NO: 721389 - protein, 20 aa, Mycobacterium
RHLRCVGVPTPGGRAEVAEV

SEQ ID NO: 721390 - protein, 18 aa, Mycobacterium
RHLRGVRVKGFSRLGSHV

SEQ ID NO: 721391 - protein, 25 aa, Mycobacterium
RHLRRGLYWRGLKTPLGMAPPQPDL

SEQ ID NO: 721392 - protein, 22 aa, Mycobacterium
RHLRTPITAALSRRLGQQIQLG

SEQ ID NO: 721393 - protein, 25 aa, Mycobacterium
RHLRTRLDALIGHGVTEVRSLGLWA

SEQ ID NO: 721394 - protein, 17 aa, Mycobacterium
RHLSRTSIRAEIIGDPG

SEQ ID NO: 721395 - protein, 22 aa, Mycobacterium
RHLTEIGSALGLAGTGCGLLTA

SEQ ID NO: 721396 - protein, 19 aa, Mycobacterium
RHLTYRYGQFTAVDDVTLQ

SEQ ID NO: 721397 - protein, 18 aa, Mycobacterium
RHLVGRVAAFAFVHLLNG

SEQ ID NO: 721398 - protein, 25 aa, Mycobacterium
RHLVLPMFVADGIEEPRPIASMPGV

SEQ ID NO: 721399 - protein, 20 aa, Mycobacterium
RHLVPEPPYRQGVAAAAAGA

SEQ ID NO: 721400 - protein, 20 aa, Mycobacterium
RHLVPRPPYGHGVAAADAGA

SEQ ID NO: 721401 - protein, 19 aa, Mycobacterium
RHMADTLPNAGHRALAALE

SEQ ID NO: 721402 - protein, 19 aa, Mycobacterium
RHMDDTLPNAGHRALAALE

SEQ ID NO: 721403 - protein, 24 aa, Mycobacterium
RHMLADSGAVAWLGPAPAQDAEPD

SEQ ID NO: 721404 - protein, 20 aa, Mycobacterium
RHMNGFPGGPPPRLALSLGD

SEQ ID NO: 721405 - protein, 21 aa, Mycobacterium
RHNAMFAELRRWRLDQLPRIP

SEQ ID NO: 721406 - protein, 25 aa, Mycobacterium
RHNEKLCGMRNLDEGFVPELYDPTL

SEQ ID NO: 721407 - protein, 19 aa, Mycobacterium
RHNFEAVVEFGRIVEVGKA

SEQ ID NO: 721408 - protein, 18 aa, Mycobacterium
RHNPGWRLSSGEVQFVSS

SEQ ID NO: 721409 - protein, 31 aa, Mycobacterium
RHNSEGWRLYTRSRFAPYVEKLLLDGARTKL

SEQ ID NO: 721410 - protein, 17 aa, Mycobacterium
RHPAPLFRTNVEGTRHV

SEQ ID NO: 721411 - protein, 18 aa, Mycobacterium
RHPARRDRLTIATKFSGN

SEQ ID NO: 721412 - protein, 24 aa, Mycobacterium
RHPCDRAGTEFMTFDYWRDLARVA

SEQ ID NO: 721413 - protein, 19 aa, Mycobacterium
RHPDAVVLHLGCGLDGRAF

SEQ ID NO: 721414 - protein, 18 aa, Mycobacterium
RHPDEYRGFLDRIVTDWI

SEQ ID NO: 721415 - protein, 20 aa, Mycobacterium
RHPDVVFCSITPFGGDAPAE

SEQ ID NO: 721416 - protein, 17 aa, Mycobacterium
RHPEFYAKVQAELDDLY

SEQ ID NO: 721417 - protein, 24 aa, Mycobacterium
RHPELADWGIPTARAVVEVREALP

SEQ ID NO: 721418 - protein, 27 aa, Mycobacterium
RHPEMARAFLTFNGFLLRRGELSPRLR

SEQ ID NO: 721419 - protein, 21 aa, Mycobacterium
RHPEMLKTYFRVRSSPNGGKL

SEQ ID NO: 721420 - protein, 22 aa, Mycobacterium
RHPEQWKLLGQNADRAPLVVEE

SEQ ID NO: 721421 - protein, 26 aa, Mycobacterium
RHPETLWEIASRVGATVLGTSPGYVL

SEQ ID NO: 721422 - protein, 24 aa, Mycobacterium
RHPEVFRAASPIARVHRNAPPFLV

SEQ ID NO: 721423 - protein, 25 aa, Mycobacterium
RHPFDSELVSYVRGVLYFRTKRWPD

SEQ ID NO: 721424 - protein, 19 aa, Mycobacterium
RHPGARASWNYLVTPGTEH

SEQ ID NO: 721425 - protein, 22 aa, Mycobacterium
RHPGPEWKFAVTTNGRHSVTHY

SEQ ID NO: 721426 - protein, 22 aa, Mycobacterium
RHPGTRIGVVVNDFGDINIDAS

SEQ ID NO: 721427 - protein, 19 aa, Mycobacterium
RHPGVDHVDDWDGIGQRQT

SEQ ID NO: 721428 - protein, 24 aa, Mycobacterium
RHPGWACYHTEMWVVEVDGLEIGV

SEQ ID NO: 721429 - protein, 21 aa, Mycobacterium
RHPHCAWTVTIDESFPEVDFI

SEQ ID NO: 721430 - protein, 19 aa, Mycobacterium
RHPHSMGEWSPASRTHVAT

SEQ ID NO: 721431 - protein, 21 aa, Mycobacterium
RHPKWSAAHRAVRLMRHPIQN

SEQ ID NO: 721432 - protein, 23 aa, Mycobacterium
RHPLKVLGKRVVAIFPVPPLAMH

SEQ ID NO: 721433 - protein, 21 aa, Mycobacterium
RHPLVIGVSMSSFLFAVPDEL

SEQ ID NO: 721434 - protein, 19 aa, Mycobacterium
RHPMLRVRFLPDGTQRIAP

SEQ ID NO: 721435 - protein, 19 aa, Mycobacterium
RHPMRVIPMRLDILSELPT

SEQ ID NO: 721436 - protein, 19 aa, Mycobacterium
RHPNLAAQFVWGEPLDEPV

SEQ ID NO: 721437 - protein, 25 aa, Mycobacterium
RHPNLAARFCTQFGDPVQVILADPV

SEQ ID NO: 721438 - protein, 22 aa, Mycobacterium
RHPNLRAGFFQGDLKRPVQVIP

SEQ ID NO: 721439 - protein, 17 aa, Mycobacterium
RHPNLRARFIYGDLPHP

SEQ ID NO: 721440 - protein, 24 aa, Mycobacterium
RHPRARAGWDRALGRIPADAPLPQ

SEQ ID NO: 721441 - protein, 21 aa, Mycobacterium
RHPRARALLGRLLTAERLACA

SEQ ID NO: 721442 - protein, 26 aa, Mycobacterium
RHPRLAKRYLAIEGHRALLDNSALLP

SEQ ID NO: 721443 - protein, 23 aa, Mycobacterium
RHPRLDFKRHMRRAWAAESAAVP

SEQ ID NO: 721444 - protein, 21 aa, Mycobacterium
RHPRPAPRPSYSALAATKSTA

SEQ ID NO: 721445 - protein, 17 aa, Mycobacterium
RHPRTEAVSAFAQKHSK

SEQ ID NO: 721446 - protein, 25 aa, Mycobacterium
RHPSMVPVEAVALLAGDLQYTEELP

SEQ ID NO: 721447 - protein, 27 aa, Mycobacterium
RHPTLAWLEPFEPWDGMQWAPLPAALE

SEQ ID NO: 721448 - protein, 19 aa, Mycobacterium
RHPVRLASFGPRALLPATT

SEQ ID NO: 721449 - protein, 17 aa, Mycobacterium
RHPWMPAALGATMHSCF

SEQ ID NO: 721450 - protein, 20 aa, Mycobacterium
RHPYARGVLVEMYREAKARL

SEQ ID NO: 721451 - protein, 18 aa, Mycobacterium
RHPYRPAHIHVIADADGH

SEQ ID NO: 721452 - protein, 19 aa, Mycobacterium
RHQFGRPIGSFQAVKHACA

SEQ ID NO: 721453 - protein, 20 aa, Mycobacterium
RHQHCELAAHPSVPGAPVNS

SEQ ID NO: 721454 - protein, 17 aa, Mycobacterium
RHQLAHALGQARDDTRK

SEQ ID NO: 721455 - protein, 17 aa, Mycobacterium
RHQLFLHGCDISRGDDG

SEQ ID NO: 721456 - protein, 25 aa, Mycobacterium
RHRAMIEAFLEWRAQTRGALTEVGV

SEQ ID NO: 721457 - protein, 19 aa, Mycobacterium
RHRAMIQAFVEWRGQTRSE

SEQ ID NO: 721458 - protein, 18 aa, Mycobacterium
RHRAMIQSFVEWRARTRG

SEQ ID NO: 721459 - protein, 24 aa, Mycobacterium
RHRAMLEAFVEWRSQSRGALTEVG

SEQ ID NO: 721460 - protein, 24 aa, Mycobacterium
RHRDGPRPWLVWVHGAGQGGTEDL

SEQ ID NO: 721461 - protein, 23 aa, Mycobacterium
RHREALGGLYAEWFSAHTGAEIS

SEQ ID NO: 721462 - protein, 22 aa, Mycobacterium
RHRELLRLMTFIEGLDDATPRL

SEQ ID NO: 721463 - protein, 26 aa, Mycobacterium
RHRENLSWSAPRLHLVDLQYSDVRLD

SEQ ID NO: 721464 - protein, 24 aa, Mycobacterium
RHRFDELKMLILMDPPEHELLRKL

SEQ ID NO: 721465 - protein, 23 aa, Mycobacterium
RHRFNRMRLGTCVTDTGRRNPAV

SEQ ID NO: 721466 - protein, 17 aa, Mycobacterium
RHRGLHARWLSWDDPET

SEQ ID NO: 721467 - protein, 18 aa, Mycobacterium
RHRGRGAARVRGKINALR

SEQ ID NO: 721468 - protein, 20 aa, Mycobacterium
RHRIGVSLVVPGAVNTPLVG

SEQ ID NO: 721469 - protein, 19 aa, Mycobacterium
RHRITCPTLGLDIVGEPVV

SEQ ID NO: 721470 - protein, 18 aa, Mycobacterium
RHRKAIGPFSARSDAVET

SEQ ID NO: 721471 - protein, 18 aa, Mycobacterium
RHRLCQDPALAASAAEEM

SEQ ID NO: 721472 - protein, 18 aa, Mycobacterium
RHRLGGELTAVWRAQLCG

SEQ ID NO: 721473 - protein, 25 aa, Mycobacterium
RHRLNPPGFCVEAMADLNSGVEIIV

SEQ ID NO: 721474 - protein, 19 aa, Mycobacterium
RHRLQRCVAALRRMVDDGW

SEQ ID NO: 721475 - protein, 20 aa, Mycobacterium
RHRMAADGLGVMGGARQRSR

SEQ ID NO: 721476 - protein, 19 aa, Mycobacterium
RHRNCTPLQRLQRVRLEHV

SEQ ID NO: 721477 - protein, 21 aa, Mycobacterium
RHRPEGLIRLGAVAVGDEVKL

SEQ ID NO: 721478 - protein, 18 aa, Mycobacterium
RHRPGWLPIPLRSIARLT

SEQ ID NO: 721479 - protein, 17 aa, Mycobacterium
RHRPHYFLAPDGVCRPF

SEQ ID NO: 721480 - protein, 25 aa, Mycobacterium
RHRRFRFYLNVEIGRKLSHADLLAH

SEQ ID NO: 721481 - protein, 23 aa, Mycobacterium
RHRRGRHRFGGALHLRRNVDAVA

SEQ ID NO: 721482 - protein, 22 aa, Mycobacterium
RHRRKLLAPKFHGKAMVQYEQI

SEQ ID NO: 721483 - protein, 26 aa, Mycobacterium
RHRSPEGLDAFLRRFLLPALLTNTQP

SEQ ID NO: 721484 - protein, 20 aa, Mycobacterium
RHRTLRAAVTVRRPPEEVYR

SEQ ID NO: 721485 - protein, 18 aa, Mycobacterium
RHRWLLEQVSFIAAIEHY

SEQ ID NO: 721486 - protein, 22 aa, Mycobacterium
RHSDKLWGFTGHRLCLDLSSAP

SEQ ID NO: 721487 - protein, 18 aa, Mycobacterium
RHSEAFCDVVRVRLMHAL

SEQ ID NO: 721488 - protein, 25 aa, Mycobacterium
RHSFDLASRLPLLVRLYRRADDQYL

SEQ ID NO: 721489 - protein, 27 aa, Mycobacterium
RHSGAIELTGAWPGLRCDIDTAEDLRT

SEQ ID NO: 721490 - protein, 24 aa, Mycobacterium
RHSKRTGARHVIVFEGRDAAGKGG

SEQ ID NO: 721491 - protein, 19 aa, Mycobacterium
RHSLINLVKLLPVLTGLRM

SEQ ID NO: 721492 - protein, 23 aa, Mycobacterium
RHSQPYAWPGRVIGKIAGEIPLE

SEQ ID NO: 721493 - protein, 33 aa, Mycobacterium
RHSQQWAQKGFVRMARDYGLGALIEKRTGVNPL

SEQ ID NO: 721494 - protein, 28 aa, Mycobacterium
RHSRIKLPKLGWVKFRASRSLDGETIRS

SEQ ID NO: 721495 - protein, 23 aa, Mycobacterium
RHSRRPEVSGCCPAPGGDPSIHQ

SEQ ID NO: 721496 - protein, 24 aa, Mycobacterium
RHSSAVVPPVRWYCDDTAVLGGEF

SEQ ID NO: 721497 - protein, 31 aa, Mycobacterium
RHSSEGWRLYTRARFAPYVEKLLLDGARTKL

SEQ ID NO: 721498 - protein, 18 aa, Mycobacterium
RHSVWIWEIRLFGYHIAL

SEQ ID NO: 721499 - protein, 24 aa, Mycobacterium
RHSWREVADRLGYRSVGAAQTAVA

SEQ ID NO: 721500 - protein, 18 aa, Mycobacterium
RHTAEYDVAVASWMGSTL

SEQ ID NO: 721501 - protein, 22 aa, Mycobacterium
RHTEICTGHLLLGLVDAADPTI

SEQ ID NO: 721502 - protein, 20 aa, Mycobacterium
RHTFTVSYEGVWRRPSDGAA

SEQ ID NO: 721503 - protein, 28 aa, Mycobacterium
RHTGEIRVPRMLGVFSIGRAINPRTLRS

SEQ ID NO: 721504 - protein, 26 aa, Mycobacterium
RHTGPALSAFNAWILLKGLETLAIRV

SEQ ID NO: 721505 - protein, 26 aa, Mycobacterium
RHTGPALSAFNAWVLVKGLETLAIRV

SEQ ID NO: 721506 - protein, 25 aa, Mycobacterium
RHTGPALSPFNAWTLLKGLETMALR

SEQ ID NO: 721507 - protein, 22 aa, Mycobacterium
RHTHLRKIISRGFTPRAVERLR

SEQ ID NO: 721508 - protein, 19 aa, Mycobacterium
RHTKGRFAGQRFDPDIWQV

SEQ ID NO: 721509 - protein, 19 aa, Mycobacterium
RHTKIRRLLASAFTPKQMR

SEQ ID NO: 721510 - protein, 18 aa, Mycobacterium
RHTLRAGGAPADGEIPYT

SEQ ID NO: 721511 - protein, 17 aa, Mycobacterium
RHTPWGARVSIHRGEVG

SEQ ID NO: 721512 - protein, 18 aa, Mycobacterium
RHTQVFWQDSCAGANSYY

SEQ ID NO: 721513 - protein, 23 aa, Mycobacterium
RHTRCRPSHACRRRWQQNGLMTL

SEQ ID NO: 721514 - protein, 25 aa, Mycobacterium
RHTRFRFFYRVGFTPWEGHPIGQGL

SEQ ID NO: 721515 - protein, 34 aa, Mycobacterium
RHTVDLFTRLAIRAEAALGFRPFNHHLLHGEIDA

SEQ ID NO: 721516 - protein, 26 aa, Mycobacterium
RHVALRAGSDIAFLGGVINYILSNGL

SEQ ID NO: 721517 - protein, 18 aa, Mycobacterium
RHVARFCQQLGVDSAHFI

SEQ ID NO: 721518 - protein, 23 aa, Mycobacterium
RHVAWVIAWALRHGVTEVEATAE

SEQ ID NO: 721519 - protein, 18 aa, Mycobacterium
RHVDKWYGNRHVLKDVSV

SEQ ID NO: 721520 - protein, 19 aa, Mycobacterium
RHVERFFAQSWDRLAAGRA

SEQ ID NO: 721521 - protein, 29 aa, Mycobacterium
RHVGRGKLLPRDRVDGLLDPGSPFLELAP

SEQ ID NO: 721522 - protein, 19 aa, Mycobacterium
RHVGRWRFVTMHRQIDTRR

SEQ ID NO: 721523 - protein, 23 aa, Mycobacterium
RHVGSGWRGDNLVLIGGPLDAGP

SEQ ID NO: 721524 - protein, 18 aa, Mycobacterium
RHVHEVFTELTMRRATLG

SEQ ID NO: 721525 - protein, 20 aa, Mycobacterium
RHVHPSTLYPGGVGTVATIQ

SEQ ID NO: 721526 - protein, 19 aa, Mycobacterium
RHVHPSTLYPGGVGTVATV

SEQ ID NO: 721527 - protein, 31 aa, Mycobacterium
RHVITALDGLGWRLVLATGRGELGGLGTVPD

SEQ ID NO: 721528 - protein, 20 aa, Mycobacterium
RHVLELHGWHDLHTELHRLS

SEQ ID NO: 721529 - protein, 19 aa, Mycobacterium
RHVPDRFIAIDAVPKTLSG

SEQ ID NO: 721530 - protein, 26 aa, Mycobacterium
RHVPLRAGSDIAFLGGVINYILSNDL

SEQ ID NO: 721531 - protein, 26 aa, Mycobacterium
RHVPLRAGSDIAFLGGVINYILSNEL

SEQ ID NO: 721532 - protein, 27 aa, Mycobacterium
RHVPLRAGSDIAFLGGVINYILSNELD

SEQ ID NO: 721533 - protein, 25 aa, Mycobacterium
RHVPVVLRSRADWLRGPRRADATPP

SEQ ID NO: 721534 - protein, 19 aa, Mycobacterium
RHVQVTGDLAGGVLEDSVY

SEQ ID NO: 721535 - protein, 24 aa, Mycobacterium
RHVSRGKLLPRERVYRLLDPGSPF

SEQ ID NO: 721536 - protein, 18 aa, Mycobacterium
RHVVQRLLAQFGGDDAAE

SEQ ID NO: 721537 - protein, 21 aa, Mycobacterium
RHWPQGRLSKAYAAYSTPFWR

SEQ ID NO: 721538 - protein, 23 aa, Mycobacterium
RHWPTSRGFERFYGFLGGETDQW

SEQ ID NO: 721539 - protein, 21 aa, Mycobacterium
RHYHEMGVLVPAHIDAHTGYR

SEQ ID NO: 721540 - protein, 25 aa, Mycobacterium
RHYLPDGPGAVFAFGVKGGRAAGEK

SEQ ID NO: 721541 - protein, 20 aa, Mycobacterium
RHYLRLHFSAPALLAERRLQ

SEQ ID NO: 721542 - protein, 25 aa, Mycobacterium
RHYPGMKPKYLFVGMVHQHQGQRAR

SEQ ID NO: 721543 - protein, 18 aa, Mycobacterium
RHYQRLDKASALRMGAPH

SEQ ID NO: 721544 - protein, 20 aa, Mycobacterium
RHYRDCRILGIGGGTNEIMN

SEQ ID NO: 721545 - protein, 22 aa, Mycobacterium
RHYWDTHMCASFMVDGLGLAQI

SEQ ID NO: 721546 - protein, 19 aa, Mycobacterium
RHYWGLPFGGWKSSGVGSE

SEQ ID NO: 721547 - protein, 19 aa, Mycobacterium
RHYYRIGPDILDWLYEEHV

SEQ ID NO: 721548 - protein, 21 aa, Mycobacterium
RIAAACAHGDATIFGSGINPG

SEQ ID NO: 721549 - protein, 20 aa, Mycobacterium
RIAAALNRMYRETADQMTQL

SEQ ID NO: 721550 - protein, 24 aa, Mycobacterium
RIAACGVLRLAGVAGYEGALAHDA

SEQ ID NO: 721551 - protein, 19 aa, Mycobacterium
RIAAGMGAHVTVFDVNLGK

SEQ ID NO: 721552 - protein, 17 aa, Mycobacterium
RIAAILRRLTAGRNLSE

SEQ ID NO: 721553 - protein, 19 aa, Mycobacterium
RIAALCGEQLKRVSLELGG

SEQ ID NO: 721554 - protein, 18 aa, Mycobacterium
RIAALPLPTIAAVEGNAL

SEQ ID NO: 721555 - protein, 19 aa, Mycobacterium
RIAALPVNQLVMIKLALNS

SEQ ID NO: 721556 - protein, 18 aa, Mycobacterium
RIAANFDVFGFELSTDEV

SEQ ID NO: 721557 - protein, 17 aa, Mycobacterium
RIAAPRPLAPVTTREAV

SEQ ID NO: 721558 - protein, 24 aa, Mycobacterium
RIAARADGWLPLLTEPGQAGATRL

SEQ ID NO: 721559 - protein, 17 aa, Mycobacterium
RIAASWIDRLDDMLSAL

SEQ ID NO: 721560 - protein, 19 aa, Mycobacterium
RIADACGFAVPYYDLIDER

SEQ ID NO: 721561 - protein, 22 aa, Mycobacterium
RIADALAALGHRVTAVDDSPEM

SEQ ID NO: 721562 - protein, 19 aa, Mycobacterium
RIADARLLLNQALENDEAV

SEQ ID NO: 721563 - protein, 23 aa, Mycobacterium
RIADARQLLARVVLPDAELRRIA

SEQ ID NO: 721564 - protein, 20 aa, Mycobacterium
RIADEVPEILVGAGTVVDSA

SEQ ID NO: 721565 - protein, 23 aa, Mycobacterium
RIADSRTGVFMGLTHGDYQLLAA

SEQ ID NO: 721566 - protein, 19 aa, Mycobacterium
RIADVLGRLPGAYQVDGRE

SEQ ID NO: 721567 - protein, 19 aa, Mycobacterium
RIAEEMRARFGRDIDPEGV

SEQ ID NO: 721568 - protein, 17 aa, Mycobacterium
RIAEETAKAEGKPEQAL

SEQ ID NO: 721569 - protein, 19 aa, Mycobacterium
RIAEFGRRLCVDAPPLARV

SEQ ID NO: 721570 - protein, 25 aa, Mycobacterium
RIAEHEMPGLMSLRREYAEVQPLKG

SEQ ID NO: 721571 - protein, 17 aa, Mycobacterium
RIAELDPYLAVDVLDTG

SEQ ID NO: 721572 - protein, 25 aa, Mycobacterium
RIAELPKHLVIVGSGFVAAEFAHVF

SEQ ID NO: 721573 - protein, 17 aa, Mycobacterium
RIAELTAALQLLGVSGP

SEQ ID NO: 721574 - protein, 27 aa, Mycobacterium
RIAELVPLGRPILCTEYMARPLGSTVQ

SEQ ID NO: 721575 - protein, 20 aa, Mycobacterium
RIAEMLAELMRLFAAGVLKP

SEQ ID NO: 721576 - protein, 18 aa, Mycobacterium
RIAERARTLLAVEGPGQA

SEQ ID NO: 721577 - protein, 19 aa, Mycobacterium
RIAERAVLAEGLRRLTTNS

SEQ ID NO: 721578 - protein, 18 aa, Mycobacterium
RIAERIVRQRAHTPFTST

SEQ ID NO: 721579 - protein, 22 aa, Mycobacterium
RIAERSGLPPGVINVVPGEGPE

SEQ ID NO: 721580 - protein, 28 aa, Mycobacterium
RIAEVCASARLAAVLTHGGPALRLPSLE

SEQ ID NO: 721581 - protein, 19 aa, Mycobacterium
RIAFDASKAGKSLMSTATA

SEQ ID NO: 721582 - protein, 20 aa, Mycobacterium
RIAGGALFWTDFLYDDHGAT

SEQ ID NO: 721583 - protein, 20 aa, Mycobacterium
RIAGLDDIYLVTAEDATQDP

SEQ ID NO: 721584 - protein, 17 aa, Mycobacterium
RIAGLLLDAPGPKPRYA

SEQ ID NO: 721585 - protein, 18 aa, Mycobacterium
RIAGPGMVLTIRYDATGE

SEQ ID NO: 721586 - protein, 25 aa, Mycobacterium
RIAGQRAKFGTAFTGIGLAADSALS

SEQ ID NO: 721587 - protein, 18 aa, Mycobacterium
RIAGRRVLELAGADIDAI

SEQ ID NO: 721588 - protein, 18 aa, Mycobacterium
RIAGVLASAGLEVAITDT

SEQ ID NO: 721589 - protein, 24 aa, Mycobacterium
RIAHDQCDAWTGLAAAGDTSLRVL

SEQ ID NO: 721590 - protein, 26 aa, Mycobacterium
RIAIPELPLELFIESLRQLIAVDAEW

SEQ ID NO: 721591 - protein, 18 aa, Mycobacterium
RIALGALLDLLPEYEVDR

SEQ ID NO: 721592 - protein, 18 aa, Mycobacterium
RIALHVRTLYGRDPHHIT

SEQ ID NO: 721593 - protein, 26 aa, Mycobacterium
RIALPDLRPTTNLARPVTPVALKAAQ

SEQ ID NO: 721594 - protein, 20 aa, Mycobacterium
RIALSRGLDRTRFIQEVRQY

SEQ ID NO: 721595 - protein, 17 aa, Mycobacterium
RIALTYRTPVMILSDGA

SEQ ID NO: 721596 - protein, 22 aa, Mycobacterium
RIANPLAKLGYRVTAVDDSAAL

SEQ ID NO: 721597 - protein, 26 aa, Mycobacterium
RIAPDEIKAAGYGGVVNYVSESRPGA

SEQ ID NO: 721598 - protein, 20 aa, Mycobacterium
RIAPENELEAAFYRNSLIHA

SEQ ID NO: 721599 - protein, 26 aa, Mycobacterium
RIAPEVARLSEELGRAIDVAVQDQQL

SEQ ID NO: 721600 - protein, 27 aa, Mycobacterium
RIAPGGFRYGPAFGVELQFWVFDETVI

SEQ ID NO: 721601 - protein, 27 aa, Mycobacterium
RIAPRTMLCAIAWRVHEQVAGARFEEM

SEQ ID NO: 721602 - protein, 27 aa, Mycobacterium
RIAPRTMLCGIAFRIHIDVAGARFEEL

SEQ ID NO: 721603 - protein, 21 aa, Mycobacterium
RIAPSRLAFIGALGPWGPLAT

SEQ ID NO: 721604 - protein, 19 aa, Mycobacterium
RIAQLLVQRVELVELVEVA

SEQ ID NO: 721605 - protein, 23 aa, Mycobacterium
RIARAGYPLAVLTASEGGIYGRF

SEQ ID NO: 721606 - protein, 23 aa, Mycobacterium
RIARDVPNLIGLVELPGGHCSML

SEQ ID NO: 721607 - protein, 27 aa, Mycobacterium
RIARFKIPRYVRIVDEFPMTVTGKVRK

SEQ ID NO: 721608 - protein, 17 aa, Mycobacterium
RIARLGAGWIAISPSPQ

SEQ ID NO: 721609 - protein, 20 aa, Mycobacterium
RIARTLRRCGADLPDADLAD

SEQ ID NO: 721610 - protein, 24 aa, Mycobacterium
RIASDQCDAWTGLAAAGDVTPQVI

SEQ ID NO: 721611 - protein, 21 aa, Mycobacterium
RIASFTVRPVTMFSGAIETSA

SEQ ID NO: 721612 - protein, 20 aa, Mycobacterium
RIASHPDLELAGLHCYSPEK

SEQ ID NO: 721613 - protein, 22 aa, Mycobacterium
RIASICAGAFTLAEAGILDGKR

SEQ ID NO: 721614 - protein, 22 aa, Mycobacterium
RIASICSGAFTLAAAGILDGKR

SEQ ID NO: 721615 - protein, 24 aa, Mycobacterium
RIASTLLLDRDWLLIKTDFLMHAA

SEQ ID NO: 721616 - protein, 25 aa, Mycobacterium
RIATDWAGPASRVIRRRMRLTGSIY

SEQ ID NO: 721617 - protein, 33 aa, Mycobacterium
RIATESALTWAGRCHPGDGLGIAGDEVLIVAAD

SEQ ID NO: 721618 - protein, 24 aa, Mycobacterium
RIATESALTWAGRCQPGDGLGIAG

SEQ ID NO: 721619 - protein, 20 aa, Mycobacterium
RIATRLGQALPVLGTAVFTS

SEQ ID NO: 721620 - protein, 18 aa, Mycobacterium
RIAVRRIPEGGGGSVEIH

SEQ ID NO: 721621 - protein, 17 aa, Mycobacterium
RIAVSYHTPVIVLSDGA

SEQ ID NO: 721622 - protein, 22 aa, Mycobacterium
RIAVWKDYWDFNSLVSFAPPNH

SEQ ID NO: 721623 - protein, 25 aa, Mycobacterium
RICALLRCAYEWGGQAAFWGPIAGV

SEQ ID NO: 721624 - protein, 25 aa, Mycobacterium
RICALLRCAYEWGGQAAFWGPLAGV

SEQ ID NO: 721625 - protein, 19 aa, Mycobacterium
RICFFDERVDVIIDGQRQN

SEQ ID NO: 721626 - protein, 20 aa, Mycobacterium
RICSQQQLWSVFGKKRGKNG

SEQ ID NO: 721627 - protein, 17 aa, Mycobacterium
RIDAIRYALRAQIEVTQ

SEQ ID NO: 721628 - protein, 19 aa, Mycobacterium
RIDALAWTRRVTVDDVAAL

SEQ ID NO: 721629 - protein, 22 aa, Mycobacterium
RIDAPLERFGLRAPDGRLIARA

SEQ ID NO: 721630 - protein, 22 aa, Mycobacterium
RIDAVLRSKIDAAWNLHELTRD

SEQ ID NO: 721631 - protein, 18 aa, Mycobacterium
RIDCVWESHEALAPRNNG

SEQ ID NO: 721632 - protein, 19 aa, Mycobacterium
RIDDEFLDPMVFKPDSVLG

SEQ ID NO: 721633 - protein, 19 aa, Mycobacterium
RIDDEHLLFVASDRISAYD

SEQ ID NO: 721634 - protein, 23 aa, Mycobacterium
RIDDGKLVLAQRVRTISHATEAM

SEQ ID NO: 721635 - protein, 24 aa, Mycobacterium
RIDDRLAGLHARYSVAAGDHGWVR

SEQ ID NO: 721636 - protein, 26 aa, Mycobacterium
RIDDYTRWRLLEGLDDIGLTLRKLDQ

SEQ ID NO: 721637 - protein, 19 aa, Mycobacterium
RIDEAKRALGERATVVAGG

SEQ ID NO: 721638 - protein, 24 aa, Mycobacterium
RIDEAKTAAGMRTVALPSFAVTAL

SEQ ID NO: 721639 - protein, 26 aa, Mycobacterium
RIDEEYRRYFTLTGKPTGEWAAATKR

SEQ ID NO: 721640 - protein, 18 aa, Mycobacterium
RIDEGLLRYPDLLTETTR

SEQ ID NO: 721641 - protein, 25 aa, Mycobacterium
RIDELAPRLIGVVERLEGIVSRVEA

SEQ ID NO: 721642 - protein, 22 aa, Mycobacterium
RIDELRRLVGPWGEVHETASID

SEQ ID NO: 721643 - protein, 20 aa, Mycobacterium
RIDGAYGDRNLVCSCPPVEA

SEQ ID NO: 721644 - protein, 27 aa, Mycobacterium
RIDGFPLLRAGICAGPVVKRRGDVFGS

SEQ ID NO: 721645 - protein, 24 aa, Mycobacterium
RIDGPRGGLDVMIIALRAPADGPI

SEQ ID NO: 721646 - protein, 23 aa, Mycobacterium
RIDHIIGLFRLWWIPAGAAPTHG

SEQ ID NO: 721647 - protein, 23 aa, Mycobacterium
RIDHIIGLFRLWWIPEGAAPTEG

SEQ ID NO: 721648 - protein, 26 aa, Mycobacterium
RIDHIIGLFRLWWIPRGAPPTEGTYV

SEQ ID NO: 721649 - protein, 23 aa, Mycobacterium
RIDHSEAGLYLWATRGDSCDDAL

SEQ ID NO: 721650 - protein, 33 aa, Mycobacterium
RIDPATCRVVMCSRTRPALPTAQLVMTGRLAHL

SEQ ID NO: 721651 - protein, 24 aa, Mycobacterium
RIDPEGYPRISADDANRLLELGSY

SEQ ID NO: 721652 - protein, 24 aa, Mycobacterium
RIDPEMFTPALANWGYDDRGTSAR

SEQ ID NO: 721653 - protein, 25 aa, Mycobacterium
RIDPIAAAGLRYRVEDCPNITVFQQ

SEQ ID NO: 721654 - protein, 24 aa, Mycobacterium
RIDPRTRWLLRELVYALLVKKDHA

SEQ ID NO: 721655 - protein, 19 aa, Mycobacterium
RIDPVLLDLLRLGTYQLLR

SEQ ID NO: 721656 - protein, 17 aa, Mycobacterium
RIDQCILRLDPDGQRVT

SEQ ID NO: 721657 - protein, 23 aa, Mycobacterium
RIDVPVYLGCDWQNVPLHLPSTF

SEQ ID NO: 721658 - protein, 17 aa, Mycobacterium
RIEAGDYTAAVGISASA

SEQ ID NO: 721659 - protein, 19 aa, Mycobacterium
RIEAGMVFVNGVGADGAEL

SEQ ID NO: 721660 - protein, 18 aa, Mycobacterium
RIECGEVAAALTALDGVQ

SEQ ID NO: 721661 - protein, 17 aa, Mycobacterium
RIECGEVAAALTTLDPI

SEQ ID NO: 721662 - protein, 19 aa, Mycobacterium
RIEDACRRGNSTIFGSGAH

SEQ ID NO: 721663 - protein, 18 aa, Mycobacterium
RIEEDVVRAALADHDGVL

SEQ ID NO: 721664 - protein, 17 aa, Mycobacterium
RIEESVIRQALDQQDGV

SEQ ID NO: 721665 - protein, 24 aa, Mycobacterium
RIEGDRGFYAGAIGWCDRNGDGRW

SEQ ID NO: 721666 - protein, 18 aa, Mycobacterium
RIEIDGFIGANFDSPLSL

SEQ ID NO: 721667 - protein, 27 aa, Mycobacterium
RIEILPITIGLPFGLTMFFPANFPLPA

SEQ ID NO: 721668 - protein, 25 aa, Mycobacterium
RIEILPVTIGLPFGLTVFFPANMPL

SEQ ID NO: 721669 - protein, 27 aa, Mycobacterium
RIEKAHPGRFLLGIGAGHPELIAQYKK

SEQ ID NO: 721670 - protein, 18 aa, Mycobacterium
RIEKAQKQARRWTRDAVA

SEQ ID NO: 721671 - protein, 20 aa, Mycobacterium
RIELEPVAPFVALRHIRFRS

SEQ ID NO: 721672 - protein, 20 aa, Mycobacterium
RIELEPVAPFVALRHVRFRS

SEQ ID NO: 721673 - protein, 22 aa, Mycobacterium
RIELEPVHPFVALRHLRFHSIT

SEQ ID NO: 721674 - protein, 23 aa, Mycobacterium
RIELEPVKPFVALRHIRFHSLAE

SEQ ID NO: 721675 - protein, 20 aa, Mycobacterium
RIELGEIQLALAALDGVEQA

SEQ ID NO: 721676 - protein, 25 aa, Mycobacterium
RIELGEVRAALAWLDGVEQAVVVAR

SEQ ID NO: 721677 - protein, 25 aa, Mycobacterium
RIELGLRHFLADGFGAFTTNFEDLG

SEQ ID NO: 721678 - protein, 20 aa, Mycobacterium
RIELSTATLANWAAKTGNLL

SEQ ID NO: 721679 - protein, 24 aa, Mycobacterium
RIELWPELRAAFTPPDEQPSVLRV

SEQ ID NO: 721680 - protein, 19 aa, Mycobacterium
RIENYLGFPDGVSGGQLAD

SEQ ID NO: 721681 - protein, 18 aa, Mycobacterium
RIEPVHAVTYFAPEARSA

SEQ ID NO: 721682 - protein, 21 aa, Mycobacterium
RIEQLADWGYPFPTGDDGRQL

SEQ ID NO: 721683 - protein, 25 aa, Mycobacterium
RIERELPEWLAADVAILGEPSGGYI

SEQ ID NO: 721684 - protein, 18 aa, Mycobacterium
RIERELRDWLTADVAILG

SEQ ID NO: 721685 - protein, 21 aa, Mycobacterium
RIERGLWLTALLRATLTAVRR

SEQ ID NO: 721686 - protein, 21 aa, Mycobacterium
RIERGWRHFLMSTSGRCYLDM

SEQ ID NO: 721687 - protein, 23 aa, Mycobacterium
RIERIETRLAMSIPAGAGATSAP

SEQ ID NO: 721688 - protein, 24 aa, Mycobacterium
RIFDAAKRLGYPGPDPVARSLRTR

SEQ ID NO: 721689 - protein, 19 aa, Mycobacterium
RIFEAKWNEGGFHFANECF

SEQ ID NO: 721690 - protein, 23 aa, Mycobacterium
RIFEELSLRGCVAALDGSDVIRA

SEQ ID NO: 721691 - protein, 28 aa, Mycobacterium
RIFELEIGRAHTPWFHWPTTAMVANAVD

SEQ ID NO: 721692 - protein, 17 aa, Mycobacterium
RIFEPRYSALVRHCLDT

SEQ ID NO: 721693 - protein, 27 aa, Mycobacterium
RIFGRRVAVVACEFGFLAGSIGVAAAE

SEQ ID NO: 721694 - protein, 20 aa, Mycobacterium
RIFHPSGVLARGFIERIAPA

SEQ ID NO: 721695 - protein, 19 aa, Mycobacterium
RIFKGLAGVVVDTTSISEV

SEQ ID NO: 721696 - protein, 17 aa, Mycobacterium
RIGALALAIRSGDADAT

SEQ ID NO: 721697 - protein, 19 aa, Mycobacterium
RIGALSLGARQRLSIAGAL

SEQ ID NO: 721698 - protein, 25 aa, Mycobacterium
RIGAPFTAAEHGFWAKLEGFNPGGM

SEQ ID NO: 721699 - protein, 20 aa, Mycobacterium
RIGASLVVRAIRPVANPALF

SEQ ID NO: 721700 - protein, 20 aa, Mycobacterium
RIGASLVVRMIRPVANPALY

SEQ ID NO: 721701 - protein, 21 aa, Mycobacterium
RIGATGWQITRTGARVAANIF

SEQ ID NO: 721702 - protein, 20 aa, Mycobacterium
RIGDLPVRAVVSSPLLRCRT

SEQ ID NO: 721703 - protein, 23 aa, Mycobacterium
RIGEARPDWLDWAQLSAPGPREL

SEQ ID NO: 721704 - protein, 26 aa, Mycobacterium
RIGEFELPELLKRGSDVLLKTRTAGL

SEQ ID NO: 721705 - protein, 24 aa, Mycobacterium
RIGELLRARGLRRMASRIQVLAVL

SEQ ID NO: 721706 - protein, 20 aa, Mycobacterium
RIGGAKAWLGTALALKPLLR

SEQ ID NO: 721707 - protein, 21 aa, Mycobacterium
RIGGDHVKLLFNIVPESAVYL

SEQ ID NO: 721708 - protein, 17 aa, Mycobacterium
RIGGFNYEFFRTISSPV

SEQ ID NO: 721709 - protein, 24 aa, Mycobacterium
RIGGIDCAVLFAGSASVPAKFDGR

SEQ ID NO: 721710 - protein, 20 aa, Mycobacterium
RIGGVIGFSGAAKVEGRFDD

SEQ ID NO: 721711 - protein, 18 aa, Mycobacterium
RIGHLIEVGLALPHGAES

SEQ ID NO: 721712 - protein, 25 aa, Mycobacterium
RIGHLPEGLGVIGLLIDEPKPLRLE

SEQ ID NO: 721713 - protein, 18 aa, Mycobacterium
RIGIFGLAVPEEYGGSPV

SEQ ID NO: 721714 - protein, 18 aa, Mycobacterium
RIGIFGLAVSEEYGGSPV

SEQ ID NO: 721715 - protein, 17 aa, Mycobacterium
RIGKPGRAFLRKFLPGH

SEQ ID NO: 721716 - protein, 18 aa, Mycobacterium
RIGLALNCEIVPWCRFAR

SEQ ID NO: 721717 - protein, 24 aa, Mycobacterium
RIGLHAWPTVPRDIEWKHGICQAL

SEQ ID NO: 721718 - protein, 19 aa, Mycobacterium
RIGLHQLYPLLAHVVLFGG

SEQ ID NO: 721719 - protein, 25 aa, Mycobacterium
RIGLIPRVRFEFDRSAVKGVLVGPS

SEQ ID NO: 721720 - protein, 20 aa, Mycobacterium
RIGMPATRFLGPALGSLHLF

SEQ ID NO: 721721 - protein, 20 aa, Mycobacterium
RIGMPATRFLGPALGSLHMF

SEQ ID NO: 721722 - protein, 18 aa, Mycobacterium
RIGMTTGSLYHHFGSGAA

SEQ ID NO: 721723 - protein, 20 aa, Mycobacterium
RIGNKVFKSNVKFQHMPLPF

SEQ ID NO: 721724 - protein, 24 aa, Mycobacterium
RIGPAPWKSVLGMTGPTTLEIEFD

SEQ ID NO: 721725 - protein, 18 aa, Mycobacterium
RIGPEYQDAIIAAYPGYP

SEQ ID NO: 721726 - protein, 26 aa, Mycobacterium
RIGQFAAVRRGLWLTGGRRPWVALKL

SEQ ID NO: 721727 - protein, 19 aa, Mycobacterium
RIGQLACWEHYNPLARYAL

SEQ ID NO: 721728 - protein, 26 aa, Mycobacterium
RIGRKPRGSYQIAILGLKGGAGKTTT

SEQ ID NO: 721729 - protein, 22 aa, Mycobacterium
RIGRLAVRLDVSRLVVVGTGRS

SEQ ID NO: 721730 - protein, 17 aa, Mycobacterium
RIGRPAHVIAAFDTELF

SEQ ID NO: 721731 - protein, 24 aa, Mycobacterium
RIGRPEELTGLYLYLASEASSYMT

SEQ ID NO: 721732 - protein, 24 aa, Mycobacterium
RIGRPRLATAGVVRRIVLDRNAGL

SEQ ID NO: 721733 - protein, 17 aa, Mycobacterium
RIGRRFLNAGLGFGGGC

SEQ ID NO: 721734 - protein, 18 aa, Mycobacterium
RIGSALSAANLTAAAPTT

SEQ ID NO: 721735 - protein, 18 aa, Mycobacterium
RIGSDFAGVLPRAHSAVA

SEQ ID NO: 721736 - protein, 37 aa, Mycobacterium
RIGSEASLRLRFRGVDVVKAGFWSSGPVLLQALGILD

SEQ ID NO: 721737 - protein, 20 aa, Mycobacterium
RIGSEPVREFTIAQRQTAHV

SEQ ID NO: 721738 - protein, 21 aa, Mycobacterium
RIGSFPDLQGIRVLRTYDESM

SEQ ID NO: 721739 - protein, 18 aa, Mycobacterium
RIGTAVFDGVELELRGAI

SEQ ID NO: 721740 - protein, 19 aa, Mycobacterium
RIGTGTAVVGGRRFPGLAV

SEQ ID NO: 721741 - protein, 19 aa, Mycobacterium
RIGVAPSIISLTVLPKMSL

SEQ ID NO: 721742 - protein, 20 aa, Mycobacterium
RIGVDEVCYRHPHRYLTIIG

SEQ ID NO: 721743 - protein, 19 aa, Mycobacterium
RIGYHEISGHRPAGDTTMT

SEQ ID NO: 721744 - protein, 26 aa, Mycobacterium
RIHAIGVTWTCDASVLATRVMGALES

SEQ ID NO: 721745 - protein, 24 aa, Mycobacterium
RIHGEARASVPLRHRGSDGAPSTR

SEQ ID NO: 721746 - protein, 25 aa, Mycobacterium
RIHGVNLSLGYPFDAEWYACGQSPL

SEQ ID NO: 721747 - protein, 23 aa, Mycobacterium
RIHIRRIGLVEARRHTRSQHWDP

SEQ ID NO: 721748 - protein, 19 aa, Mycobacterium
RIHLLRNVMILAGAGVGGG

SEQ ID NO: 721749 - protein, 17 aa, Mycobacterium
RIHPGGAAAHFGVTPDI

SEQ ID NO: 721750 - protein, 19 aa, Mycobacterium
RIHPLRNVLILAGAGVGGG

SEQ ID NO: 721751 - protein, 19 aa, Mycobacterium
RIHPLRNVMILAGAGVGGG

SEQ ID NO: 721752 - protein, 21 aa, Mycobacterium
RIHRLSAGVSLDWELLAQGAQ

SEQ ID NO: 721753 - protein, 24 aa, Mycobacterium
RIIAPRAASLLDHAQRVAEGRLLD

SEQ ID NO: 721754 - protein, 21 aa, Mycobacterium
RIIARMIAVMLRRRMQEVGMD

SEQ ID NO: 721755 - protein, 27 aa, Mycobacterium
RIIARMLALMLRRRMHEAGMDTHGVEP

SEQ ID NO: 721756 - protein, 26 aa, Mycobacterium
RIIARMLAVMLRRRMAEAGMDTGGVE

SEQ ID NO: 721757 - protein, 36 aa, Mycobacterium
RIIATLCGRLGFDLRLDRLQSWGVHQLFFRGAGLVV

SEQ ID NO: 721758 - protein, 25 aa, Mycobacterium
RIIEQLPRKVALELVYTGDPISAAD

SEQ ID NO: 721759 - protein, 20 aa, Mycobacterium
RIIFIGSVSGMWGIGNQANY

SEQ ID NO: 721760 - protein, 26 aa, Mycobacterium
RIIGELLPDISVPYGVNVLWDARASI

SEQ ID NO: 721761 - protein, 17 aa, Mycobacterium
RIIGYAMLIRGVDDEAA

SEQ ID NO: 721762 - protein, 24 aa, Mycobacterium
RIIKAPRLIKAYGVRFRPNAPMKL

SEQ ID NO: 721763 - protein, 18 aa, Mycobacterium
RIIKRFSEDLDLLVLGEF

SEQ ID NO: 721764 - protein, 19 aa, Mycobacterium
RIINVSTRFTHGGRMPELM

SEQ ID NO: 721765 - protein, 19 aa, Mycobacterium
RIIQIGGGLALQPAADQPH

SEQ ID NO: 721766 - protein, 25 aa, Mycobacterium
RIIRANETFSRWVGYRSEHLTGRQF

SEQ ID NO: 721767 - protein, 19 aa, Mycobacterium
RIITAPSFTGDRVLAAILF

SEQ ID NO: 721768 - protein, 19 aa, Mycobacterium
RIITEFAAQGMAVVMASSD

SEQ ID NO: 721769 - protein, 17 aa, Mycobacterium
RIKAGADVLPWWPVLGV

SEQ ID NO: 721770 - protein, 20 aa, Mycobacterium
RIKAMPEFREKLADSRFNLD

SEQ ID NO: 721771 - protein, 20 aa, Mycobacterium
RIKAMPEFREKLANSALNLD

SEQ ID NO: 721772 - protein, 20 aa, Mycobacterium
RIKAMPQFREKLADSRLNLD

SEQ ID NO: 721773 - protein, 25 aa, Mycobacterium
RIKELSKKLAIRRFSVTTAACALLV

SEQ ID NO: 721774 - protein, 25 aa, Mycobacterium
RIKELSKKLGIRRFSVTTAACALLV

SEQ ID NO: 721775 - protein, 19 aa, Mycobacterium
RIKEMKVLGELTVEATYSG

SEQ ID NO: 721776 - protein, 26 aa, Mycobacterium
RIKEPFRRWASLVIHAGEPGAGTRMK

SEQ ID NO: 721777 - protein, 18 aa, Mycobacterium
RIKKGQRVVMMYRSANFD

SEQ ID NO: 721778 - protein, 25 aa, Mycobacterium
RIKLDRPAFVYPMFEQALRIAAGET

SEQ ID NO: 721779 - protein, 26 aa, Mycobacterium
RIKQCAHPQCVLFFYDTSKNGARRWH

SEQ ID NO: 721780 - protein, 23 aa, Mycobacterium
RIKSAVGKKDWDAIEEIFDEAGV

SEQ ID NO: 721781 - protein, 26 aa, Mycobacterium
RIKSDLRFASTFTWNTLPLPAVPTKR

SEQ ID NO: 721782 - protein, 18 aa, Mycobacterium
RIKTELFVPQANTPWPTD

SEQ ID NO: 721783 - protein, 17 aa, Mycobacterium
RIKWLMADKSKGYDDLV

SEQ ID NO: 721784 - protein, 26 aa, Mycobacterium
RILAAAASCVVDFGVDRVTLAEIARR

SEQ ID NO: 721785 - protein, 20 aa, Mycobacterium
RILACALNLAAEGKLVTLVS

SEQ ID NO: 721786 - protein, 17 aa, Mycobacterium
RILADWSGEQVHFKKVM

SEQ ID NO: 721787 - protein, 17 aa, Mycobacterium
RILDINVTGVFLGIRAA

SEQ ID NO: 721788 - protein, 23 aa, Mycobacterium
RILDRTGLSLAEIIGDAGALRSL

SEQ ID NO: 721789 - protein, 17 aa, Mycobacterium
RILELPERVRARNPVPH

SEQ ID NO: 721790 - protein, 26 aa, Mycobacterium
RILELRFLQCCSIKESAARIGTTVAN

SEQ ID NO: 721791 - protein, 20 aa, Mycobacterium
RILEREGIALGAVDYSWYTQ

SEQ ID NO: 721792 - protein, 17 aa, Mycobacterium
RILEVPLPVIAAIDGHV

SEQ ID NO: 721793 - protein, 19 aa, Mycobacterium
RILGDWPQERRHFAKVMPR

SEQ ID NO: 721794 - protein, 17 aa, Mycobacterium
RILGPQFLSRFSGRILN

SEQ ID NO: 721795 - protein, 18 aa, Mycobacterium
RILGPRYEDIMASFYRTG

SEQ ID NO: 721796 - protein, 18 aa, Mycobacterium
RILGRLIKVTPSSKVVGD

SEQ ID NO: 721797 - protein, 17 aa, Mycobacterium
RILGRLVKVTPSSKVVG

SEQ ID NO: 721798 - protein, 21 aa, Mycobacterium
RILHERGWAAPAWPVEHGGCD

SEQ ID NO: 721799 - protein, 17 aa, Mycobacterium
RILHFRAIDEFWIGSAD

SEQ ID NO: 721800 - protein, 18 aa, Mycobacterium
RILHLRYADFITDHVGAV

SEQ ID NO: 721801 - protein, 18 aa, Mycobacterium
RILISGIITDSSIAFHIA

SEQ ID NO: 721802 - protein, 33 aa, Mycobacterium
RILLHAGMPTYCLRDYFRILAWKRGSTPGLTPE

SEQ ID NO: 721803 - protein, 29 aa, Mycobacterium
RILLLDGLPNYQRIGSLRVGQTLREQFES

SEQ ID NO: 721804 - protein, 19 aa, Mycobacterium
RILLLDGLPNYQRLFSLRV

SEQ ID NO: 721805 - protein, 24 aa, Mycobacterium
RILPHPEYGGAKWVCVVNPSEDTF

SEQ ID NO: 721806 - protein, 27 aa, Mycobacterium
RILPNGVCLLPPLKSCDKGNACLSCGH

SEQ ID NO: 721807 - protein, 26 aa, Mycobacterium
RILPRRWRVPAVLSRFKVVRNAMIAA

SEQ ID NO: 721808 - protein, 22 aa, Mycobacterium
RILRGRTGALIVLGHDENVEAI

SEQ ID NO: 721809 - protein, 19 aa, Mycobacterium
RILRGRTGALIVLGNDENV

SEQ ID NO: 721810 - protein, 20 aa, Mycobacterium
RILRGRTGALIVLGNDENVE

SEQ ID NO: 721811 - protein, 22 aa, Mycobacterium
RILRGRTGALIVLGYDDSVEAI

SEQ ID NO: 721812 - protein, 19 aa, Mycobacterium
RILRRRHAPVDITIISPVD

SEQ ID NO: 721813 - protein, 21 aa, Mycobacterium
RILRSMFAVGIDRAEAAPEPD

SEQ ID NO: 721814 - protein, 21 aa, Mycobacterium
RILRVRGRGVPKRAGGHGDLL

SEQ ID NO: 721815 - protein, 21 aa, Mycobacterium
RILRVRGRGVPKRSGGHGDLL

SEQ ID NO: 721816 - protein, 17 aa, Mycobacterium
RILRYVAKLTINPARLF

SEQ ID NO: 721817 - protein, 24 aa, Mycobacterium
RILSMRGEFGYWVFEGDGQPAQRP

SEQ ID NO: 721818 - protein, 20 aa, Mycobacterium
RILTAMSVFFFGLVDTPNHL

SEQ ID NO: 721819 - protein, 26 aa, Mycobacterium
RILVGAICGGVGRYAVSKAADYAKER

SEQ ID NO: 721820 - protein, 22 aa, Mycobacterium
RIMKSRRPIGALLMDQTVMAGV

SEQ ID NO: 721821 - protein, 22 aa, Mycobacterium
RIMLAGIKLARAIAAQAPLTPW

SEQ ID NO: 721822 - protein, 25 aa, Mycobacterium
RIMRAGRGPRRYVCGGQLLTFDEMI

SEQ ID NO: 721823 - protein, 17 aa, Mycobacterium
RIMREARDLVLNMVNFD

SEQ ID NO: 721824 - protein, 19 aa, Mycobacterium
RINDAIAYCDRYPLDDLPD

SEQ ID NO: 721825 - protein, 24 aa, Mycobacterium
RINEKTWHGRRFYFTFSAYAQSKM

SEQ ID NO: 721826 - protein, 22 aa, Mycobacterium
RINGVNRLACKVLMRDLLPKKA

SEQ ID NO: 721827 - protein, 22 aa, Mycobacterium
RINGVNRLACKVLMRDMLPKNP

SEQ ID NO: 721828 - protein, 19 aa, Mycobacterium
RINLTGTFLVTREAIGALL

SEQ ID NO: 721829 - protein, 17 aa, Mycobacterium
RINNLRVGHSLDPKADY

SEQ ID NO: 721830 - protein, 20 aa, Mycobacterium
RINPAIIYVVGSGFGLKGPD

SEQ ID NO: 721831 - protein, 17 aa, Mycobacterium
RINRGRALGKLAAGQAV

SEQ ID NO: 721832 - protein, 22 aa, Mycobacterium
RINVNCAGIGNAIKTLSKNGPF

SEQ ID NO: 721833 - protein, 24 aa, Mycobacterium
RINVPAQLLAPVPHELSAVAAASI

SEQ ID NO: 721834 - protein, 25 aa, Mycobacterium
RIPAAACGLVGLKPSRGRLLGDPSS

SEQ ID NO: 721835 - protein, 27 aa, Mycobacterium
RIPAACCGLVGLKPGRGLTPMGPALSE

SEQ ID NO: 721836 - protein, 24 aa, Mycobacterium
RIPAACCGLVGLKPGRGLTPSGPA

SEQ ID NO: 721837 - protein, 26 aa, Mycobacterium
RIPAALCGIVGLKPTYGLVPYTGAFP

SEQ ID NO: 721838 - protein, 18 aa, Mycobacterium
RIPAALCGVTGHKPTFGL

SEQ ID NO: 721839 - protein, 18 aa, Mycobacterium
RIPAALNGVVGFKPSLGR

SEQ ID NO: 721840 - protein, 22 aa, Mycobacterium
RIPADNGRAVFFVVEPDRAGLV

SEQ ID NO: 721841 - protein, 22 aa, Mycobacterium
RIPAEASMCKLFGLEAVGRVTD

SEQ ID NO: 721842 - protein, 27 aa, Mycobacterium
RIPAGCCGLVGLKPGRGITPMGPTAGE

SEQ ID NO: 721843 - protein, 19 aa, Mycobacterium
RIPAMKALVRQRATGVRDA

SEQ ID NO: 721844 - protein, 18 aa, Mycobacterium
RIPAVEHRAIAALSQQTT

SEQ ID NO: 721845 - protein, 18 aa, Mycobacterium
RIPCDAVVLTTELPTTYR

SEQ ID NO: 721846 - protein, 28 aa, Mycobacterium
RIPDFVKLAEALGCVGLRCERAEDVEDV

SEQ ID NO: 721847 - protein, 22 aa, Mycobacterium
RIPEKLPLEVGDTWTETGPDGS

SEQ ID NO: 721848 - protein, 17 aa, Mycobacterium
RIPERIDAYLALNIAHP

SEQ ID NO: 721849 - protein, 24 aa, Mycobacterium
RIPEVLRLAFREMHNGRPGPVHVE

SEQ ID NO: 721850 - protein, 20 aa, Mycobacterium
RIPFPLTAWAVRLLTQLPQR

SEQ ID NO: 721851 - protein, 17 aa, Mycobacterium
RIPLLPIVTRGSHQSAL

SEQ ID NO: 721852 - protein, 31 aa, Mycobacterium
RIPPTQRWADLRADWNYRRRVAPEIAARAVE

SEQ ID NO: 721853 - protein, 18 aa, Mycobacterium
RIPPVAQHVPEFGRVGGS

SEQ ID NO: 721854 - protein, 20 aa, Mycobacterium
RIPQAGNHDVEWVILCQEGY

SEQ ID NO: 721855 - protein, 25 aa, Mycobacterium
RIPQPEGWNRITVLDSQMIRFVMRA

SEQ ID NO: 721856 - protein, 24 aa, Mycobacterium
RIPREGRRLVAFLGSTIGNLTAEP

SEQ ID NO: 721857 - protein, 24 aa, Mycobacterium
RIPSAGPDGVRWKALGGAGGDWVD

SEQ ID NO: 721858 - protein, 22 aa, Mycobacterium
RIPSERTGSVARCYSLASSPHT

SEQ ID NO: 721859 - protein, 20 aa, Mycobacterium
RIPSSWRLQTDGFRGMMEGL

SEQ ID NO: 721860 - protein, 29 aa, Mycobacterium
RIPTHGTPPRVGVAFAAGPSSGALKNNPA

SEQ ID NO: 721861 - protein, 26 aa, Mycobacterium
RIPVNASGGLACFGEAIPAQAIAQVC

SEQ ID NO: 721862 - protein, 18 aa, Mycobacterium
RIPVYALTTGPRWPDVSG

SEQ ID NO: 721863 - protein, 27 aa, Mycobacterium
RIPYVRRRGEYLYNFWRDEANPKGVWR

SEQ ID NO: 721864 - protein, 21 aa, Mycobacterium
RIQADYPDWFVGIRQNGVVIG

SEQ ID NO: 721865 - protein, 18 aa, Mycobacterium
RIQAEAFLNVGRKKAGSI

SEQ ID NO: 721866 - protein, 26 aa, Mycobacterium
RIQALLSEAARTWADRLIGAASDASV

SEQ ID NO: 721867 - protein, 35 aa, Mycobacterium
RIQAMLGALLELFQARALHPLPIKTWDVRCTPAAY

SEQ ID NO: 721868 - protein, 19 aa, Mycobacterium
RIQARIGLEDTVCLPDGSV

SEQ ID NO: 721869 - protein, 18 aa, Mycobacterium
RIQCSMWSSHLLNMSARV

SEQ ID NO: 721870 - protein, 18 aa, Mycobacterium
RIQDAFGGLDVFFANAGI

SEQ ID NO: 721871 - protein, 19 aa, Mycobacterium
RIQDLLTEAARTWGDRLMG

SEQ ID NO: 721872 - protein, 28 aa, Mycobacterium
RIQDVKWQRPGAETVWFEIHVNPLVDAE

SEQ ID NO: 721873 - protein, 24 aa, Mycobacterium
RIQEGVVSLGLYGQIFHRNVIASG

SEQ ID NO: 721874 - protein, 24 aa, Mycobacterium
RIQEGVVSLGLYSKIFHNNIKASG

SEQ ID NO: 721875 - protein, 24 aa, Mycobacterium
RIQEGVVSLGLYSKIFRNNILASG

SEQ ID NO: 721876 - protein, 23 aa, Mycobacterium
RIQEGVVSLGLYSRIFHNNIKAS

SEQ ID NO: 721877 - protein, 25 aa, Mycobacterium
RIQERCFHHLAAPVLRVSGYDIPYP

SEQ ID NO: 721878 - protein, 23 aa, Mycobacterium
RIQFGRAIGSFQALKHMAADLLV

SEQ ID NO: 721879 - protein, 18 aa, Mycobacterium
RIQGSLCYTGADFESVIA

SEQ ID NO: 721880 - protein, 27 aa, Mycobacterium
RIQLPAMRVLVAPDCYGESLSAVEAAA

SEQ ID NO: 721881 - protein, 34 aa, Mycobacterium
RIQLSYADGDIWDWAVDWDEWKSMSALSDTRAPS

SEQ ID NO: 721882 - protein, 18 aa, Mycobacterium
RIQMRVRTAMSALAQDTN

SEQ ID NO: 721883 - protein, 24 aa, Mycobacterium
RIQQILLPTLLDWLSDTPDPDAGL

SEQ ID NO: 721884 - protein, 25 aa, Mycobacterium
RIQSILLPTLLDWLADTPDPDAGLL

SEQ ID NO: 721885 - protein, 21 aa, Mycobacterium
RIRAAMDRLLRGEISPGGNCD

SEQ ID NO: 721886 - protein, 24 aa, Mycobacterium
RIRAGDKVTLWWASANRDDAVFAD

SEQ ID NO: 721887 - protein, 19 aa, Mycobacterium
RIRAGFMGVNGGAPYGADT

SEQ ID NO: 721888 - protein, 18 aa, Mycobacterium
RIRARFEPRFPHVHPHRL

SEQ ID NO: 721889 - protein, 25 aa, Mycobacterium
RIRARSAGLLTAWVATGFDVLASRV

SEQ ID NO: 721890 - protein, 25 aa, Mycobacterium
RIRARVAAALPDYMTPAAYVPLDEI

SEQ ID NO: 721891 - protein, 24 aa, Mycobacterium
RIRASRPLLELALQSEDRDPQDVE

SEQ ID NO: 721892 - protein, 20 aa, Mycobacterium
RIRDEFGWLDSCFANAGVRG

SEQ ID NO: 721893 - protein, 26 aa, Mycobacterium
RIRDLELVQWVAGLVLVLNGKGQGDV

SEQ ID NO: 721894 - protein, 18 aa, Mycobacterium
RIRDVVISISIVRQQPRV

SEQ ID NO: 721895 - protein, 17 aa, Mycobacterium
RIRELIREGARIALNPG

SEQ ID NO: 721896 - protein, 19 aa, Mycobacterium
RIRELLKHQRFPAHTLEGD

SEQ ID NO: 721897 - protein, 17 aa, Mycobacterium
RIRELMTDPGLDFDTAL

SEQ ID NO: 721898 - protein, 24 aa, Mycobacterium
RIRELMTGAALDFDTALAVVRSST

SEQ ID NO: 721899 - protein, 23 aa, Mycobacterium
RIREVALLRAVHVRPCDYLWDHH

SEQ ID NO: 721900 - protein, 27 aa, Mycobacterium
RIREVSDIPVGVGLGVRSGEQAAQIGS

SEQ ID NO: 721901 - protein, 22 aa, Mycobacterium
RIRFASALPALLAGGGVDTRID

SEQ ID NO: 721902 - protein, 20 aa, Mycobacterium
RIRGLLAQRIDLMPPLRWRV

SEQ ID NO: 721903 - protein, 20 aa, Mycobacterium
RIRGRWHAALPVGRLDTAVA

SEQ ID NO: 721904 - protein, 17 aa, Mycobacterium
RIRGYEVDEANAVRVHS

SEQ ID NO: 721905 - protein, 21 aa, Mycobacterium
RIRHIARFCAQMGVKSAHFVG

SEQ ID NO: 721906 - protein, 19 aa, Mycobacterium
RIRICAPNSTIARLGGDEF

SEQ ID NO: 721907 - protein, 20 aa, Mycobacterium
RIRIMREARDLVHNMINCDT

SEQ ID NO: 721908 - protein, 18 aa, Mycobacterium
RIRKITCSITHALEDEFD

SEQ ID NO: 721909 - protein, 20 aa, Mycobacterium
RIRLRRLGFHLSRVQQQLHV

SEQ ID NO: 721910 - protein, 21 aa, Mycobacterium
RIRMLAGRSEDEFVAGTDRIG

SEQ ID NO: 721911 - protein, 19 aa, Mycobacterium
RIRNCVAIYAGMPGGAGTA

SEQ ID NO: 721912 - protein, 21 aa, Mycobacterium
RIRPSMLEFMDSTAINAVEDK

SEQ ID NO: 721913 - protein, 21 aa, Mycobacterium
RIRPSMLEFMDSVAINAVEDT

SEQ ID NO: 721914 - protein, 19 aa, Mycobacterium
RIRRGELGLGTALPSESQL

SEQ ID NO: 721915 - protein, 18 aa, Mycobacterium
RIRRLVVLNIPPVWQQPG

SEQ ID NO: 721916 - protein, 25 aa, Mycobacterium
RIRRNARDSYQIGVFGLKGGVGKTA

SEQ ID NO: 721917 - protein, 27 aa, Mycobacterium
RIRRRPRPGYELVPLVRQVRRRPTSNS

SEQ ID NO: 721918 - protein, 24 aa, Mycobacterium
RIRRSPKVTVAVCTQRGRVISPTA

SEQ ID NO: 721919 - protein, 22 aa, Mycobacterium
RIRSDLLALYGIHGPAVGELQR

SEQ ID NO: 721920 - protein, 17 aa, Mycobacterium
RIRVNAVALGSIKTPMH

SEQ ID NO: 721921 - protein, 20 aa, Mycobacterium
RIRVPEELTIIGFDNIGAAG

SEQ ID NO: 721922 - protein, 19 aa, Mycobacterium
RIRVPRLPGNLVVDDITSS

SEQ ID NO: 721923 - protein, 20 aa, Mycobacterium
RIRYHGGEFIDLIVGGETYD

SEQ ID NO: 721924 - protein, 29 aa, Mycobacterium
RISAHLARAHLIYGEWLRRCNRRSDARTE

SEQ ID NO: 721925 - protein, 26 aa, Mycobacterium
RISAIWEDRFRPVLTEVIAQGVAEGV

SEQ ID NO: 721926 - protein, 26 aa, Mycobacterium
RISALRWGGRAPRVIFLHGGGQNAHT

SEQ ID NO: 721927 - protein, 24 aa, Mycobacterium
RISALRWGGSAPRVVFLHGGGQNA

SEQ ID NO: 721928 - protein, 25 aa, Mycobacterium
RISARAEWAPEFALHEFASADDVLA

SEQ ID NO: 721929 - protein, 24 aa, Mycobacterium
RISARPASPLAEWIARGSVDDISF

SEQ ID NO: 721930 - protein, 17 aa, Mycobacterium
RISFGRFGDDLAERVSD

SEQ ID NO: 721931 - protein, 17 aa, Mycobacterium
RISGNRFTGVLVGLPTD

SEQ ID NO: 721932 - protein, 18 aa, Mycobacterium
RISGVLINLRPDRPADKA

SEQ ID NO: 721933 - protein, 18 aa, Mycobacterium
RISHAFNLRGPSIAVQTA

SEQ ID NO: 721934 - protein, 25 aa, Mycobacterium
RISLDRPAYVYPLFEQALRVARGES

SEQ ID NO: 721935 - protein, 20 aa, Mycobacterium
RISLERWVEVCATTPARMFG

SEQ ID NO: 721936 - protein, 27 aa, Mycobacterium
RISLGHCGERWFIFNAGMGLDGEVVAA

SEQ ID NO: 721937 - protein, 20 aa, Mycobacterium
RISLPPELIYLVRFPLGVRS

SEQ ID NO: 721938 - protein, 18 aa, Mycobacterium
RISPGAVRLFARLDIRQT

SEQ ID NO: 721939 - protein, 18 aa, Mycobacterium
RISQALAASRVRYARALR

SEQ ID NO: 721940 - protein, 21 aa, Mycobacterium
RISTLPWPASKWTSSRDLPEP

SEQ ID NO: 721941 - protein, 18 aa, Mycobacterium
RISVTFISGYTCSQIFAP

SEQ ID NO: 721942 - protein, 18 aa, Mycobacterium
RISWTQADLTAWQPNRQF

SEQ ID NO: 721943 - protein, 18 aa, Mycobacterium
RITAPRLLAAFTTREAVK

SEQ ID NO: 721944 - protein, 19 aa, Mycobacterium
RITAPWCDVWPALRAPEPG

SEQ ID NO: 721945 - protein, 24 aa, Mycobacterium
RITDWKIALCDTIADNASSAGFVL

SEQ ID NO: 721946 - protein, 23 aa, Mycobacterium
RITELRSGALVNLEAAFSTQRAP

SEQ ID NO: 721947 - protein, 34 aa, Mycobacterium
RITERCFYHLEAPVLRVGGFALPYPANKVEHHYL

SEQ ID NO: 721948 - protein, 19 aa, Mycobacterium
RITERFGFSEIMMSTLEKD

SEQ ID NO: 721949 - protein, 17 aa, Mycobacterium
RITFPYRNIERLRDRPE

SEQ ID NO: 721950 - protein, 18 aa, Mycobacterium
RITGHFPSGVVAFNDYGR

SEQ ID NO: 721951 - protein, 25 aa, Mycobacterium
RITGIPAERVLVIIGNSPARFAIEG

SEQ ID NO: 721952 - protein, 18 aa, Mycobacterium
RITILEVMAEAIDEPDEM

SEQ ID NO: 721953 - protein, 17 aa, Mycobacterium
RITLSPLGFVAEGRSLI

SEQ ID NO: 721954 - protein, 17 aa, Mycobacterium
RITLTLPAIARSREVWL

SEQ ID NO: 721955 - protein, 21 aa, Mycobacterium
RITLWKDYWDMAALAGKAPPT

SEQ ID NO: 721956 - protein, 18 aa, Mycobacterium
RITMGHTVIMGRKTWESL

SEQ ID NO: 721957 - protein, 24 aa, Mycobacterium
RITMLCIPPSLLALMDAERPELRC

SEQ ID NO: 721958 - protein, 24 aa, Mycobacterium
RITNWQIKICDTIADNASSAGFVV

SEQ ID NO: 721959 - protein, 23 aa, Mycobacterium
RITNWQIKLCDTIADNASSAGWV

SEQ ID NO: 721960 - protein, 24 aa, Mycobacterium
RITNWQIKLCDTIADNASSAGWVL

SEQ ID NO: 721961 - protein, 20 aa, Mycobacterium
RITPFKDLKDATSPDKLKRL

SEQ ID NO: 721962 - protein, 17 aa, Mycobacterium
RITPQRSTQEWLDLCRD

SEQ ID NO: 721963 - protein, 19 aa, Mycobacterium
RITPTWLRLDARFGSVYRR

SEQ ID NO: 721964 - protein, 17 aa, Mycobacterium
RITREIFERGGVVSSVC

SEQ ID NO: 721965 - protein, 17 aa, Mycobacterium
RITRPEAVLTIDDIDRL

SEQ ID NO: 721966 - protein, 18 aa, Mycobacterium
RITTVGGTGFRITDTSRA

SEQ ID NO: 721967 - protein, 21 aa, Mycobacterium
RITWDDFAHCIGDFSDDKFFG

SEQ ID NO: 721968 - protein, 24 aa, Mycobacterium
RIVAAHQRAGVTIIDPGSTWIDID

SEQ ID NO: 721969 - protein, 35 aa, Mycobacterium
RIVAAVPELIGWRVGYEVAEWAERVIAVADPDHPL

SEQ ID NO: 721970 - protein, 19 aa, Mycobacterium
RIVAGLAEIIEEVTGIEPS

SEQ ID NO: 721971 - protein, 21 aa, Mycobacterium
RIVAIKGIGGFHLACVATDTT

SEQ ID NO: 721972 - protein, 20 aa, Mycobacterium
RIVAQLAGGFAVGRPAWPMW

SEQ ID NO: 721973 - protein, 17 aa, Mycobacterium
RIVASAFSAEPRCRRIM

SEQ ID NO: 721974 - protein, 26 aa, Mycobacterium
RIVATDLRGGVWGSYADHRMATAGAL

SEQ ID NO: 721975 - protein, 20 aa, Mycobacterium
RIVAVCSMVANYIEKHPEYH

SEQ ID NO: 721976 - protein, 20 aa, Mycobacterium
RIVCPFHGWEWNRDGRNVCI

SEQ ID NO: 721977 - protein, 17 aa, Mycobacterium
RIVDAMNAFGIDRRREP

SEQ ID NO: 721978 - protein, 23 aa, Mycobacterium
RIVDEVKLAFGLNRALLDELADH

SEQ ID NO: 721979 - protein, 21 aa, Mycobacterium
RIVDGDLHVCFGVTEPGAGLD

SEQ ID NO: 721980 - protein, 22 aa, Mycobacterium
RIVDGDLHVCFGVTEPGAGLDT

SEQ ID NO: 721981 - protein, 27 aa, Mycobacterium
RIVDLAVSRWGRIDFLINNAGVGSPKP

SEQ ID NO: 721982 - protein, 20 aa, Mycobacterium
RIVDLCTGSGALALALAQGF

SEQ ID NO: 721983 - protein, 25 aa, Mycobacterium
RIVDTLLFERDWLLIKIDFLLHAAR

SEQ ID NO: 721984 - protein, 22 aa, Mycobacterium
RIVEAAARLMFERGVANTSIEQ

SEQ ID NO: 721985 - protein, 17 aa, Mycobacterium
RIVESGHAWFLRADGIP

SEQ ID NO: 721986 - protein, 17 aa, Mycobacterium
RIVGAGVAADWMLTGRT

SEQ ID NO: 721987 - protein, 18 aa, Mycobacterium
RIVGCRAIGIAGGEQKCR

SEQ ID NO: 721988 - protein, 27 aa, Mycobacterium
RIVGDQLLKCGWRPGDSVILAAAGTSD

SEQ ID NO: 721989 - protein, 17 aa, Mycobacterium
RIVGLNVRSLLFAVQSA

SEQ ID NO: 721990 - protein, 17 aa, Mycobacterium
RIVGMGFDRDVLLRAGI

SEQ ID NO: 721991 - protein, 21 aa, Mycobacterium
RIVGSVWPRTSPEAWSETANG

SEQ ID NO: 721992 - protein, 17 aa, Mycobacterium
RIVIEYIEEMSLQLAPR

SEQ ID NO: 721993 - protein, 23 aa, Mycobacterium
RIVKALGGCGVFGVELMVNGDEV

SEQ ID NO: 721994 - protein, 17 aa, Mycobacterium
RIVKRLQAGSVQVNCQL

SEQ ID NO: 721995 - protein, 19 aa, Mycobacterium
RIVLLASEVKFPGTGALRL

SEQ ID NO: 721996 - protein, 26 aa, Mycobacterium
RIVLLEALAVLGWERWSAIGHRYNIG

SEQ ID NO: 721997 - protein, 20 aa, Mycobacterium
RIVLLPGDSPAGLRLPLDSI

SEQ ID NO: 721998 - protein, 23 aa, Mycobacterium
RIVLRNRGLAGLRGEIAGPDAIR

SEQ ID NO: 721999 - protein, 18 aa, Mycobacterium
RIVMRLHDLPDGGCRVEM

SEQ ID NO: 722000 - protein, 26 aa, Mycobacterium
RIVNQLPRKVAMEMLLTGEPITASDA

SEQ ID NO: 722001 - protein, 28 aa, Mycobacterium
RIVRQMFAKRPKFEFKHLITDDDVACVR

SEQ ID NO: 722002 - protein, 24 aa, Mycobacterium
RIVRRMLAAVGFPVQALVRIDIGG

SEQ ID NO: 722003 - protein, 19 aa, Mycobacterium
RIVSIGAFEHFGHDRYDDF

SEQ ID NO: 722004 - protein, 19 aa, Mycobacterium
RIVSIGAFEHFGHERYDDF

SEQ ID NO: 722005 - protein, 23 aa, Mycobacterium
RIVSRGFTPPRIKEMADAIAKIV

SEQ ID NO: 722006 - protein, 20 aa, Mycobacterium
RIVTAFCGTAPLAAEMRGFV

SEQ ID NO: 722007 - protein, 25 aa, Mycobacterium
RIVTAFPFRLIDVWQSHRAPIEEDL

SEQ ID NO: 722008 - protein, 26 aa, Mycobacterium
RIVTAFPYRLLDVWRDHRAPVEDDFE

SEQ ID NO: 722009 - protein, 20 aa, Mycobacterium
RIVTIEALEHFGFHRYDDFF

SEQ ID NO: 722010 - protein, 19 aa, Mycobacterium
RIVTIGAFEAFKMERYPAF

SEQ ID NO: 722011 - protein, 18 aa, Mycobacterium
RIVTIGAFEAFKQERYPI

SEQ ID NO: 722012 - protein, 19 aa, Mycobacterium
RIVTIGAFEAFRMERYAAF

SEQ ID NO: 722013 - protein, 25 aa, Mycobacterium
RIVVLADAWDLLKFLNDDEYAIDPK

SEQ ID NO: 722014 - protein, 26 aa, Mycobacterium
RIVVLGDAWDLLKFLDESSFALDEKS

SEQ ID NO: 722015 - protein, 25 aa, Mycobacterium
RIVVLGDAWDLLKFLNDDEYAIDPK

SEQ ID NO: 722016 - protein, 25 aa, Mycobacterium
RIVVLGDAWDLLKFLSDDQYAIDPK

SEQ ID NO: 722017 - protein, 26 aa, Mycobacterium
RIVVLGDAWGLLKFLNDDAYAIDPGA

SEQ ID NO: 722018 - protein, 19 aa, Mycobacterium
RIWAAIKREALMVVQEGVA

SEQ ID NO: 722019 - protein, 18 aa, Mycobacterium
RIWDEARDSLGHLPFTQG

SEQ ID NO: 722020 - protein, 18 aa, Mycobacterium
RIWRRERLHYAGKHYQIP

SEQ ID NO: 722021 - protein, 17 aa, Mycobacterium
RIWRTRVGPMTLDDAEI

SEQ ID NO: 722022 - protein, 19 aa, Mycobacterium
RIWTALGLPGIVDVHTHFM

SEQ ID NO: 722023 - protein, 18 aa, Mycobacterium
RIWYRTGDLVRYWPDGTL

SEQ ID NO: 722024 - protein, 17 aa, Mycobacterium
RIYGRMPGVQDVPVSGT

SEQ ID NO: 722025 - protein, 19 aa, Mycobacterium
RIYRDFEYRSGSTTISTKV

SEQ ID NO: 722026 - protein, 17 aa, Mycobacterium
RIYRDVRLLRLYEGTSE

SEQ ID NO: 722027 - protein, 23 aa, Mycobacterium
RKAAEIEAAFGARLVCPVDEFNA

SEQ ID NO: 722028 - protein, 17 aa, Mycobacterium
RKAARKHGLPVYAVAPF

SEQ ID NO: 722029 - protein, 19 aa, Mycobacterium
RKAARVCTTSAFNDVANVE

SEQ ID NO: 722030 - protein, 19 aa, Mycobacterium
RKAAVLSLTRWAAEPDARD

SEQ ID NO: 722031 - protein, 25 aa, Mycobacterium
RKADELGCRSLALVAFGTGVGGFPL

SEQ ID NO: 722032 - protein, 25 aa, Mycobacterium
RKADELGCRSLALVAFGTGVGGFPV

SEQ ID NO: 722033 - protein, 25 aa, Mycobacterium
RKADELGCRSLGLVAFGTGVGGFPL

SEQ ID NO: 722034 - protein, 24 aa, Mycobacterium
RKADELGCRTLGLVAFGTGVGGFP

SEQ ID NO: 722035 - protein, 18 aa, Mycobacterium
RKADPGRISFSWYPQLER

SEQ ID NO: 722036 - protein, 22 aa, Mycobacterium
RKAEMVEGLLVDRVGRTEDIAA

SEQ ID NO: 722037 - protein, 19 aa, Mycobacterium
RKAGCDLEKGWALNEVSLE

SEQ ID NO: 722038 - protein, 27 aa, Mycobacterium
RKAGELPFGYFARGWLDAQALKVAQGK

SEQ ID NO: 722039 - protein, 20 aa, Mycobacterium
RKAGRQVFKDYVAFPALTSV

SEQ ID NO: 722040 - protein, 21 aa, Mycobacterium
RKAHVWPGHHYQPQGVELARD

SEQ ID NO: 722041 - protein, 18 aa, Mycobacterium
RKAKGITHEQAREIMNDA

SEQ ID NO: 722042 - protein, 30 aa, Mycobacterium
RKAKQAWDEGRFDREISPISAPVLDENKQP

SEQ ID NO: 722043 - protein, 33 aa, Mycobacterium
RKALGLRPAPEFEAWLSGLGMVGADGRVLPVDL

SEQ ID NO: 722044 - protein, 18 aa, Mycobacterium
RKALLAFLELVAKRRRRY

SEQ ID NO: 722045 - protein, 18 aa, Mycobacterium
RKALQWFQPHGVLISQGP

SEQ ID NO: 722046 - protein, 28 aa, Mycobacterium
RKALRKRAIELLELVGLGHRINHQPTRM

SEQ ID NO: 722047 - protein, 20 aa, Mycobacterium
RKALTAWGAYGEKKMYGKTV

SEQ ID NO: 722048 - protein, 18 aa, Mycobacterium
RKALVGKRPMTRVGRAVE

SEQ ID NO: 722049 - protein, 19 aa, Mycobacterium
RKAMEELSRIKKDGEAGED

SEQ ID NO: 722050 - protein, 24 aa, Mycobacterium
RKAMSQEVLLAWQMNSEPLPPAHG

SEQ ID NO: 722051 - protein, 20 aa, Mycobacterium
RKAMWAPALGCYGPQRLTVL

SEQ ID NO: 722052 - protein, 19 aa, Mycobacterium
RKAPASHRANVLFRAARII

SEQ ID NO: 722053 - protein, 21 aa, Mycobacterium
RKAPGLVRWLLRRKAISSLPE

SEQ ID NO: 722054 - protein, 17 aa, Mycobacterium
RKATARWREHGFELEFG

SEQ ID NO: 722055 - protein, 26 aa, Mycobacterium
RKAVREIAGELVALYAARQAAPGHAF

SEQ ID NO: 722056 - protein, 25 aa, Mycobacterium
RKAVREIAGELVALYAKRQASPGHA

SEQ ID NO: 722057 - protein, 20 aa, Mycobacterium
RKAVTFFLHAARRAEIPLSP

SEQ ID NO: 722058 - protein, 20 aa, Mycobacterium
RKCIECFLCQNVCHVIRDHE

SEQ ID NO: 722059 - protein, 20 aa, Mycobacterium
RKCIECFLCQNVCHVVRDHE

SEQ ID NO: 722060 - protein, 17 aa, Mycobacterium
RKCLKRQEKNFLFTDVC

SEQ ID NO: 722061 - protein, 17 aa, Mycobacterium
RKCLKRQEKNFLFTPTC

SEQ ID NO: 722062 - protein, 17 aa, Mycobacterium
RKCREELEINSATLDIL

SEQ ID NO: 722063 - protein, 25 aa, Mycobacterium
RKDFKGPSPWIMISDFHIKIDGCVG

SEQ ID NO: 722064 - protein, 22 aa, Mycobacterium
RKDFRVVLGADRMGRVGALDHE

SEQ ID NO: 722065 - protein, 18 aa, Mycobacterium
RKDGFVIVAECADGDEVP

SEQ ID NO: 722066 - protein, 19 aa, Mycobacterium
RKDIDLADEVVRVRRAVVR

SEQ ID NO: 722067 - protein, 23 aa, Mycobacterium
RKDKVRGGAIFSPVFDPVDVEVG

SEQ ID NO: 722068 - protein, 19 aa, Mycobacterium
RKDRERDLLLASIRQPILG

SEQ ID NO: 722069 - protein, 21 aa, Mycobacterium
RKDTHAHAWALRMSPDGNVWG

SEQ ID NO: 722070 - protein, 24 aa, Mycobacterium
RKDYDAKFGMRVWHRDFFDAEIVA

SEQ ID NO: 722071 - protein, 17 aa, Mycobacterium
RKEAGLVRIGEQAEQTI

SEQ ID NO: 722072 - protein, 19 aa, Mycobacterium
RKEDPRFIRGRGNYVDDVA

SEQ ID NO: 722073 - protein, 20 aa, Mycobacterium
RKEDPRFIRGRGNYVDDVKL

SEQ ID NO: 722074 - protein, 20 aa, Mycobacterium
RKEDPRFIRGRGTYVDDVAL

SEQ ID NO: 722075 - protein, 20 aa, Mycobacterium
RKEDPRFIRGRGTYVDDVTL

SEQ ID NO: 722076 - protein, 17 aa, Mycobacterium
RKEDVLFEVGVLSTKAA

SEQ ID NO: 722077 - protein, 18 aa, Mycobacterium
RKEDVLFEVGVMSTRSAQ

SEQ ID NO: 722078 - protein, 19 aa, Mycobacterium
RKEFDVWEPGAFTGTFRGN

SEQ ID NO: 722079 - protein, 22 aa, Mycobacterium
RKEFPIRGRAPMVAVDNVSLQL

SEQ ID NO: 722080 - protein, 18 aa, Mycobacterium
RKEFWGFKPDEHLDNDAL

SEQ ID NO: 722081 - protein, 17 aa, Mycobacterium
RKEGWGLAVTEAAQHGV

SEQ ID NO: 722082 - protein, 19 aa, Mycobacterium
RKEILPMRGLFTQTVALRL

SEQ ID NO: 722083 - protein, 22 aa, Mycobacterium
RKEIMRGLTAVLIDYARTVHDV

SEQ ID NO: 722084 - protein, 17 aa, Mycobacterium
RKEKRFRRFAALVRALN

SEQ ID NO: 722085 - protein, 20 aa, Mycobacterium
RKEPVREYRDFLQIDDRLGH

SEQ ID NO: 722086 - protein, 19 aa, Mycobacterium
RKEPVVWGATGSGPLAPPA

SEQ ID NO: 722087 - protein, 27 aa, Mycobacterium
RKEWVPRLAGMDVIASYCLTEPGAGSD

SEQ ID NO: 722088 - protein, 21 aa, Mycobacterium
RKFAPEALMDKGIRKANKVTS

SEQ ID NO: 722089 - protein, 21 aa, Mycobacterium
RKFFAAVEGWPEASAHDHRAI

SEQ ID NO: 722090 - protein, 29 aa, Mycobacterium
RKFLADKVARWWLPERWAVAEEIPRTSVG

SEQ ID NO: 722091 - protein, 24 aa, Mycobacterium
RKFLPRCAAGALSAFLLTEPDVGS

SEQ ID NO: 722092 - protein, 18 aa, Mycobacterium
RKFLPRMATGETRGAFSM

SEQ ID NO: 722093 - protein, 26 aa, Mycobacterium
RKFLSDGRASIRLVAFTDTDGGNHSI

SEQ ID NO: 722094 - protein, 19 aa, Mycobacterium
RKFQYCLSASDAHNKANIG

SEQ ID NO: 722095 - protein, 17 aa, Mycobacterium
RKFWMRYAAESAGALTL

SEQ ID NO: 722096 - protein, 20 aa, Mycobacterium
RKGADIGGAVGLGRKRIGIA

SEQ ID NO: 722097 - protein, 20 aa, Mycobacterium
RKGAEFGREVIRQFEQDIEI

SEQ ID NO: 722098 - protein, 18 aa, Mycobacterium
RKGARPPAGLTLNPLSWA

SEQ ID NO: 722099 - protein, 25 aa, Mycobacterium
RKGEGPGVVLIPELPGLHPGVLGLG

SEQ ID NO: 722100 - protein, 19 aa, Mycobacterium
RKGGHVLRDLDGHIFGVDH

SEQ ID NO: 722101 - protein, 18 aa, Mycobacterium
RKGGHVLRDVEGHIYGVD

SEQ ID NO: 722102 - protein, 19 aa, Mycobacterium
RKGGHVLSGVDGGVYGVDH

SEQ ID NO: 722103 - protein, 24 aa, Mycobacterium
RKGGKARSYPDWTVPELKKRAKEL

SEQ ID NO: 722104 - protein, 20 aa, Mycobacterium
RKGGTCVLTGMPKITDLMVP

SEQ ID NO: 722105 - protein, 22 aa, Mycobacterium
RKGGTLRGLFELKTGVRPPVPL

SEQ ID NO: 722106 - protein, 18 aa, Mycobacterium
RKGHVRQALSQGPDAAGR

SEQ ID NO: 722107 - protein, 19 aa, Mycobacterium
RKGIARGKSVVALAYSGGV

SEQ ID NO: 722108 - protein, 26 aa, Mycobacterium
RKGIPGPRKLPALIWRILSAPLNAYA

SEQ ID NO: 722109 - protein, 19 aa, Mycobacterium
RKGIRVNALAPGFFESEMT

SEQ ID NO: 722110 - protein, 18 aa, Mycobacterium
RKGISRGRSVVALTYTDG

SEQ ID NO: 722111 - protein, 18 aa, Mycobacterium
RKGLPDGDFFGVVAQLPG

SEQ ID NO: 722112 - protein, 18 aa, Mycobacterium
RKGLTLAALELKNVSDDL

SEQ ID NO: 722113 - protein, 18 aa, Mycobacterium
RKGLTLAALKLRHVSQDL

SEQ ID NO: 722114 - protein, 28 aa, Mycobacterium
RKGNRHFSFGIGVHRCVGSNVARTVFKS

SEQ ID NO: 722115 - protein, 17 aa, Mycobacterium
RKGPKPRVVPLINGADR

SEQ ID NO: 722116 - protein, 22 aa, Mycobacterium
RKGPYERYLPYAVGDGSEHTLN

SEQ ID NO: 722117 - protein, 30 aa, Mycobacterium
RKGQRPVLGPSWRMAHNPARIARGAPDLGE

SEQ ID NO: 722118 - protein, 24 aa, Mycobacterium
RKGRMIPCAIELNGQFVGQLTIGN

SEQ ID NO: 722119 - protein, 21 aa, Mycobacterium
RKGRMLPYVIELDGQFAGQLT

SEQ ID NO: 722120 - protein, 32 aa, Mycobacterium
RKGRPELSDELLIEVAEAYIGEAARGRGAIGR

SEQ ID NO: 722121 - protein, 21 aa, Mycobacterium
RKGSLRGLRLSYFGDGANNMA

SEQ ID NO: 722122 - protein, 19 aa, Mycobacterium
RKGVPRAKLTGTIQNDILK

SEQ ID NO: 722123 - protein, 23 aa, Mycobacterium
RKGWTLKEGERWLSSNLAYNPED

SEQ ID NO: 722124 - protein, 23 aa, Mycobacterium
RKHAARMTWLQTLAHEMRTCVFF

SEQ ID NO: 722125 - protein, 19 aa, Mycobacterium
RKHDEPVLLAVLGDDEADE

SEQ ID NO: 722126 - protein, 24 aa, Mycobacterium
RKHFSDALPVRVCEVRTDPWNVES

SEQ ID NO: 722127 - protein, 18 aa, Mycobacterium
RKHGWAAVRSRIGDAPPP

SEQ ID NO: 722128 - protein, 25 aa, Mycobacterium
RKHHLLKTFWGWRDVQYPDGTVLWT

SEQ ID NO: 722129 - protein, 23 aa, Mycobacterium
RKHKVPVYAIAPFATRGLQKMSG

SEQ ID NO: 722130 - protein, 18 aa, Mycobacterium
RKHPHSMGEWSQASRTHV

SEQ ID NO: 722131 - protein, 23 aa, Mycobacterium
RKHPRARAGLDRASRRIPADAPL

SEQ ID NO: 722132 - protein, 18 aa, Mycobacterium
RKHPRGRAGWDRAKGRIP

SEQ ID NO: 722133 - protein, 23 aa, Mycobacterium
RKHRSAGLALSYAEARALIADEV

SEQ ID NO: 722134 - protein, 26 aa, Mycobacterium
RKHVRLPRRAAVFSMLAEAPRRTAEL

SEQ ID NO: 722135 - protein, 17 aa, Mycobacterium
RKIAAIGIRVARATTLH

SEQ ID NO: 722136 - protein, 20 aa, Mycobacterium
RKIAARAGERLIPHSVELGG

SEQ ID NO: 722137 - protein, 25 aa, Mycobacterium
RKIADRAGIAMSVVLYHFGTKDGLI

SEQ ID NO: 722138 - protein, 23 aa, Mycobacterium
RKIALELGYRPSVAARSLRNGRT

SEQ ID NO: 722139 - protein, 18 aa, Mycobacterium
RKIFDLLEHAPIGVAVVT

SEQ ID NO: 722140 - protein, 20 aa, Mycobacterium
RKIGRFPFVGTEPEFTGYMA

SEQ ID NO: 722141 - protein, 22 aa, Mycobacterium
RKIHGRPGFHAETSAGTIDARY

SEQ ID NO: 722142 - protein, 26 aa, Mycobacterium
RKIHNRFMAVNEMLRSGGATYHNSDQ

SEQ ID NO: 722143 - protein, 24 aa, Mycobacterium
RKIIELNLLSALLVSQRANAVMQK

SEQ ID NO: 722144 - protein, 19 aa, Mycobacterium
RKILNPLFTRTFLTKFEPE

SEQ ID NO: 722145 - protein, 24 aa, Mycobacterium
RKIMDRLGAVWVREDLGVVMTEVD

SEQ ID NO: 722146 - protein, 23 aa, Mycobacterium
RKINAALYWIALCQIKHGAPGEA

SEQ ID NO: 722147 - protein, 19 aa, Mycobacterium
RKIPPAWLESGVVKQAMTW

SEQ ID NO: 722148 - protein, 23 aa, Mycobacterium
RKIRRLLGERVVRLTVKPFMDMS

SEQ ID NO: 722149 - protein, 20 aa, Mycobacterium
RKIVMEKLDLVGMPNDGHKF

SEQ ID NO: 722150 - protein, 20 aa, Mycobacterium
RKKADTRRALSDAALALAFE

SEQ ID NO: 722151 - protein, 21 aa, Mycobacterium
RKKDMFIVGGFNAYPAEIEGF

SEQ ID NO: 722152 - protein, 22 aa, Mycobacterium
RKKDMFIVGGFNAYPAEIEGFL

SEQ ID NO: 722153 - protein, 17 aa, Mycobacterium
RKKDMVVSGGFNVFPRQ

SEQ ID NO: 722154 - protein, 19 aa, Mycobacterium
RKKELAFSLGGMGSASTNY

SEQ ID NO: 722155 - protein, 19 aa, Mycobacterium
RKKELAFSLGGMGSSSTNF

SEQ ID NO: 722156 - protein, 19 aa, Mycobacterium
RKKELAFSLGGMGSSSTNY

SEQ ID NO: 722157 - protein, 19 aa, Mycobacterium
RKKELITVAGRNIFPTEIE

SEQ ID NO: 722158 - protein, 19 aa, Mycobacterium
RKKFGRLIFIGSVSGSWGI

SEQ ID NO: 722159 - protein, 19 aa, Mycobacterium
RKKLAALAFQHTAEYDIAV

SEQ ID NO: 722160 - protein, 17 aa, Mycobacterium
RKKLASLAFQHTAEYDI

SEQ ID NO: 722161 - protein, 21 aa, Mycobacterium
RKKLASVAFRHTAEYDVAVAS

SEQ ID NO: 722162 - protein, 19 aa, Mycobacterium
RKKLNLEIFRPHYTPNTVI

SEQ ID NO: 722163 - protein, 33 aa, Mycobacterium
RKKLNPSVLRALTWLPVASFLYVLPRVVLGSRT

SEQ ID NO: 722164 - protein, 41 aa, Mycobacterium; identical to SEQ ID NO: 211654

SEQ ID NO: 722165 - protein, 39 aa, Mycobacterium
RKKLPSVQVGDPFMEKVLIECCLELYSAGLVVGIQDLGG

SEQ ID NO: 722166 - protein, 19 aa, Mycobacterium
RKKLPSVQVGDPFTEKVLI

SEQ ID NO: 722167 - protein, 20 aa, Mycobacterium
RKKVSVPRVPGETLLETARR

SEQ ID NO: 722168 - protein, 20 aa, Mycobacterium
RKKYLRAMSRLLALTAGVSG

SEQ ID NO: 722169 - protein, 21 aa, Mycobacterium
RKLAAELGVALELINGTGIGG

SEQ ID NO: 722170 - protein, 17 aa, Mycobacterium
RKLAAIAELHRRATEGQ

SEQ ID NO: 722171 - protein, 17 aa, Mycobacterium
RKLAATCDVFLTSYLPT

SEQ ID NO: 722172 - protein, 21 aa, Mycobacterium
RKLAHRNARRCSMFTCGALSM

SEQ ID NO: 722173 - protein, 18 aa, Mycobacterium
RKLAPILVDSGWRVVAPF

SEQ ID NO: 722174 - protein, 22 aa, Mycobacterium
RKLAPKGTGAVLAFELSGGLEA

SEQ ID NO: 722175 - protein, 24 aa, Mycobacterium
RKLARNTFYGMARWQAKLEQKQGF

SEQ ID NO: 722176 - protein, 21 aa, Mycobacterium
RKLARRVAGSRGHLSCTGTPE

SEQ ID NO: 722177 - protein, 17 aa, Mycobacterium
RKLAVMAELFTRRVDLA

SEQ ID NO: 722178 - protein, 19 aa, Mycobacterium
RKLDAMSANLARLTDLTTE

SEQ ID NO: 722179 - protein, 29 aa, Mycobacterium
RKLDLPMGRVPRMDTYRGFVFGSFAADGP

SEQ ID NO: 722180 - protein, 17 aa, Mycobacterium
RKLDPRGVIVVVEAEHL

SEQ ID NO: 722181 - protein, 25 aa, Mycobacterium
RKLDRKATLAFAFSHRSYLDGLLLP

SEQ ID NO: 722182 - protein, 25 aa, Mycobacterium
RKLDRKATLAFAFSHRSYLDGMLLP

SEQ ID NO: 722183 - protein, 19 aa, Mycobacterium
RKLDWPAGYDARALGNAFL

SEQ ID NO: 722184 - protein, 25 aa, Mycobacterium
RKLEEGRKLVAPSRFYELRYEDLIA

SEQ ID NO: 722185 - protein, 20 aa, Mycobacterium
RKLESMAANLARLTDLTTEL

SEQ ID NO: 722186 - protein, 22 aa, Mycobacterium
RKLFIRQGFDRWDELPAQLRIE

SEQ ID NO: 722187 - protein, 21 aa, Mycobacterium
RKLFMRQGFDSWTERSAQFSI

SEQ ID NO: 722188 - protein, 17 aa, Mycobacterium
RKLFRPHPHLDPDTLAP

SEQ ID NO: 722189 - protein, 22 aa, Mycobacterium
RKLFRRDVVVAGHCVPTTVGFT

SEQ ID NO: 722190 - protein, 26 aa, Mycobacterium
RKLGELRPLYPPGLVHIYHALTWGPL

SEQ ID NO: 722191 - protein, 37 aa, Mycobacterium
RKLGELRPLYRPGLFHMYHALTWGPLVREIVYAATGK

SEQ ID NO: 722192 - protein, 24 aa, Mycobacterium
RKLGERGWIAAGWPIAEGGAGLDP

SEQ ID NO: 722193 - protein, 17 aa, Mycobacterium
RKLGIKASDTAVIRFEN

SEQ ID NO: 722194 - protein, 17 aa, Mycobacterium
RKLGLPFAADPSQQLPR

SEQ ID NO: 722195 - protein, 19 aa, Mycobacterium
RKLGVRRIFGPCAVGSLQP

SEQ ID NO: 722196 - protein, 19 aa, Mycobacterium
RKLHPCWEREDPGVVTTTL

SEQ ID NO: 722197 - protein, 20 aa, Mycobacterium
RKLHPLDAFLDVLVENGERN

SEQ ID NO: 722198 - protein, 20 aa, Mycobacterium
RKLIDSQLTQAGWVVQDKKD

SEQ ID NO: 722199 - protein, 24 aa, Mycobacterium
RKLIKVLRKRGRILQSAPNLQNPI

SEQ ID NO: 722200 - protein, 20 aa, Mycobacterium
RKLIMCRPAEAVYDEAKAEA

SEQ ID NO: 722201 - protein, 19 aa, Mycobacterium
RKLIPNYRVGCKRILNSST

SEQ ID NO: 722202 - protein, 20 aa, Mycobacterium
RKLISVLRKRGRILQSAPDL

SEQ ID NO: 722203 - protein, 26 aa, Mycobacterium
RKLLDVCQELGRWRAIAESTDFSTSP

SEQ ID NO: 722204 - protein, 20 aa, Mycobacterium
RKLLEARVGRGAVLEQVVND

SEQ ID NO: 722205 - protein, 18 aa, Mycobacterium
RKLLEILTGQPLSAGELS

SEQ ID NO: 722206 - protein, 19 aa, Mycobacterium
RKLLLPPFNGKNMRAYEDI

SEQ ID NO: 722207 - protein, 26 aa, Mycobacterium
RKLLSAFKVPTAWLLLDSDDDVPRGG

SEQ ID NO: 722208 - protein, 20 aa, Mycobacterium
RKLPAKARKAILEGADEQVH

SEQ ID NO: 722209 - protein, 21 aa, Mycobacterium
RKLPAKARKAILEGCDEQVHV

SEQ ID NO: 722210 - protein, 27 aa, Mycobacterium
RKLPIFGGPFRWDDLEWLRSQTDLPLM

SEQ ID NO: 722211 - protein, 19 aa, Mycobacterium
RKLPSGRYQVRFTDPDGNY

SEQ ID NO: 722212 - protein, 17 aa, Mycobacterium
RKLQAIITKTHQGTAEL

SEQ ID NO: 722213 - protein, 18 aa, Mycobacterium
RKLQAVMTMTHQGAAEIM

SEQ ID NO: 722214 - protein, 17 aa, Mycobacterium
RKLQAVVEKGHQGAAEM

SEQ ID NO: 722215 - protein, 22 aa, Mycobacterium
RKLRARRKPLTFSSENWEKSAG

SEQ ID NO: 722216 - protein, 22 aa, Mycobacterium
RKLRDAWLTARHDLSDRRNRMR

SEQ ID NO: 722217 - protein, 21 aa, Mycobacterium
RKLRGLLRFLEKAKRNQVYTD

SEQ ID NO: 722218 - protein, 17 aa, Mycobacterium
RKLRPGDSLLVDTKAGY

SEQ ID NO: 722219 - protein, 24 aa, Mycobacterium
RKLRRLPVDRARDLALTQLDRVGL

SEQ ID NO: 722220 - protein, 24 aa, Mycobacterium
RKLRSPRDLRFVPTDHGVQTCDQW

SEQ ID NO: 722221 - protein, 19 aa, Mycobacterium
RKLSGLLRRSVVVLNDSDG

SEQ ID NO: 722222 - protein, 22 aa, Mycobacterium
RKLSGYDTLRLVLAKSTILVEG

SEQ ID NO: 722223 - protein, 20 aa, Mycobacterium
RKLSPELTRPFTPPPSFINH

SEQ ID NO: 722224 - protein, 20 aa, Mycobacterium
RKLSVEGGKVTGERETDDGV

SEQ ID NO: 722225 - protein, 20 aa, Mycobacterium
RKLTDRYLYLHLAVIGNVEH

SEQ ID NO: 722226 - protein, 34 aa, Mycobacterium
RKLTLIAFEAMNHWRADGGFGLHVFHKNNELAGY

SEQ ID NO: 722227 - protein, 18 aa, Mycobacterium
RKLVAAGHRFRQPDLTQA

SEQ ID NO: 722228 - protein, 21 aa, Mycobacterium
RKLVEVCAALAAFYPTQDDRS

SEQ ID NO: 722229 - protein, 17 aa, Mycobacterium
RKLVMPFFTAPAVAAME

SEQ ID NO: 722230 - protein, 19 aa, Mycobacterium
RKLWVPKLASMDAIASYCL

SEQ ID NO: 722231 - protein, 21 aa, Mycobacterium
RKMAAHWDRRLVGVIEVSDRG

SEQ ID NO: 722232 - protein, 18 aa, Mycobacterium
RKMAKRGGGAIVNQSSTA

SEQ ID NO: 722233 - protein, 19 aa, Mycobacterium
RKMAKRGGGAIVNQSSTAA

SEQ ID NO: 722234 - protein, 19 aa, Mycobacterium
RKMDALTRILEVETFEAMI

SEQ ID NO: 722235 - protein, 21 aa, Mycobacterium
RKMEELGWIVVRVIAEDKPQD

SEQ ID NO: 722236 - protein, 18 aa, Mycobacterium
RKMIPILVADGHRVVCPD

SEQ ID NO: 722237 - protein, 23 aa, Mycobacterium
RKMLRVRLGEPFMARQGSMVAYQ

SEQ ID NO: 722238 - protein, 19 aa, Mycobacterium
RKMLSQTWFSWIGGHRPGD

SEQ ID NO: 722239 - protein, 24 aa, Mycobacterium
RKMPASMGKPKFPTPRGTFTALAK

SEQ ID NO: 722240 - protein, 18 aa, Mycobacterium
RKMVFWAAVTPEAADLAV

SEQ ID NO: 722241 - protein, 19 aa, Mycobacterium
RKMWASSMNIAGAGWSGQA

SEQ ID NO: 722242 - protein, 33 aa, Mycobacterium
RKNARWLRTAQRGKWVKNGHRWIIRTVHEDGSL

SEQ ID NO: 722243 - protein, 20 aa, Mycobacterium
RKNCEEFGIRLHPMGDAEQG

SEQ ID NO: 722244 - protein, 21 aa, Mycobacterium
RKNGLPVYALAPFATRGLQKM

SEQ ID NO: 722245 - protein, 22 aa, Mycobacterium
RKNKLRGGDVFAPVFDPVQVEV

SEQ ID NO: 722246 - protein, 22 aa, Mycobacterium
RKNKLRGGDVFSPVFDPVQVEV

SEQ ID NO: 722247 - protein, 28 aa, Mycobacterium
RKNKTRGGAIFRPVFNQLSVEVGFHTPR

SEQ ID NO: 722248 - protein, 20 aa, Mycobacterium
RKNLMLFAGRAHPELADQVA

SEQ ID NO: 722249 - protein, 17 aa, Mycobacterium
RKNLMLFSGRAHPELAE

SEQ ID NO: 722250 - protein, 17 aa, Mycobacterium
RKNMHVWAGECHVHAGI

SEQ ID NO: 722251 - protein, 29 aa, Mycobacterium
RKNPRWCQLCFEKAPGGGVTLPIGVLFAD

SEQ ID NO: 722252 - protein, 20 aa, Mycobacterium
RKNQGLHLGLPISTNIELAS

SEQ ID NO: 722253 - protein, 19 aa, Mycobacterium
RKNRVVVCCGAGGVGKTTT

SEQ ID NO: 722254 - protein, 22 aa, Mycobacterium
RKPACGVCVLAKDCPSFGLGPT

SEQ ID NO: 722255 - protein, 21 aa, Mycobacterium
RKPACGVCVLAKDCPSYGIGP

SEQ ID NO: 722256 - protein, 21 aa, Mycobacterium
RKPACGVCVLAKDCPSYGLGP

SEQ ID NO: 722257 - protein, 21 aa, Mycobacterium
RKPACGVCVLAKDCPSYGTGP

SEQ ID NO: 722258 - protein, 19 aa, Mycobacterium
RKPADWSYAEAAGISAVFT

SEQ ID NO: 722259 - protein, 23 aa, Mycobacterium
RKPALTCPAGIRCGVSQSIVAAR

SEQ ID NO: 722260 - protein, 17 aa, Mycobacterium
RKPEAAARLEAARAALS

SEQ ID NO: 722261 - protein, 18 aa, Mycobacterium
RKPEAAARLEAARAALSE

SEQ ID NO: 722262 - protein, 18 aa, Mycobacterium
RKPEAAARLEAARAGLAE

SEQ ID NO: 722263 - protein, 17 aa, Mycobacterium
RKPEAAVRLEAARAELT

SEQ ID NO: 722264 - protein, 26 aa, Mycobacterium
RKPEAGLKIARRFAHLTYRGETELDN

SEQ ID NO: 722265 - protein, 27 aa, Mycobacterium
RKPEPKLPVPSGWPFGEEFPRTCGAAR

SEQ ID NO: 722266 - protein, 20 aa, Mycobacterium
RKPGGVAMIADLAQRVAEQL

SEQ ID NO: 722267 - protein, 19 aa, Mycobacterium
RKPGLMKRSALTLRGLVHA

SEQ ID NO: 722268 - protein, 18 aa, Mycobacterium
RKPGTGMLVRAAAEHGID

SEQ ID NO: 722269 - protein, 18 aa, Mycobacterium
RKPHWLNEYRRYRPMVER

SEQ ID NO: 722270 - protein, 18 aa, Mycobacterium
RKPKGRELFLELVDRSDI

SEQ ID NO: 722271 - protein, 18 aa, Mycobacterium
RKPMAFVRAILRSDITDL

SEQ ID NO: 722272 - protein, 19 aa, Mycobacterium
RKPMAFVRAMLRSDVTDLT

SEQ ID NO: 722273 - protein, 20 aa, Mycobacterium
RKPMAFVRAMLRTDVKDLTV

SEQ ID NO: 722274 - protein, 18 aa, Mycobacterium
RKPMPTWGSNLGGIDFDN

SEQ ID NO: 722275 - protein, 19 aa, Mycobacterium
RKPPLPDVVKPPSVKPPAE

SEQ ID NO: 722276 - protein, 18 aa, Mycobacterium
RKPPPPALPLEVLPTRRT

SEQ ID NO: 722277 - protein, 24 aa, Mycobacterium
RKPQRRLELRGELARGDLKSDVFA

SEQ ID NO: 722278 - protein, 29 aa, Mycobacterium
RKPRSEVTVPRWLAPFGTIEEVTPEPLLQ

SEQ ID NO: 722279 - protein, 20 aa, Mycobacterium
RKPWPRPQIASYLFDQHCSA

SEQ ID NO: 722280 - protein, 18 aa, Mycobacterium
RKPWRLNQNYLRDIHLIR

SEQ ID NO: 722281 - protein, 19 aa, Mycobacterium
RKPYGVDFVHNTWRFGIDR

SEQ ID NO: 722282 - protein, 20 aa, Mycobacterium
RKQAVVAFDYAYHGRTNLTM

SEQ ID NO: 722283 - protein, 18 aa, Mycobacterium
RKQAWLRDLARLEPDLVV

SEQ ID NO: 722284 - protein, 24 aa, Mycobacterium
RKQGGRCVLMAPPGSPAHHVLSLV

SEQ ID NO: 722285 - protein, 28 aa, Mycobacterium
RKQHPVFRRRRFFAGRPIREGEEVRDIA

SEQ ID NO: 722286 - protein, 18 aa, Mycobacterium
RKQIKAWEAAGVTMMVVS

SEQ ID NO: 722287 - protein, 20 aa, Mycobacterium
RKQMERHGVLVVGPTPAFLD

SEQ ID NO: 722288 - protein, 19 aa, Mycobacterium
RKQPGAQIFATFDADGQHR

SEQ ID NO: 722289 - protein, 24 aa, Mycobacterium
RKRAEELLTRVHLAERMKHRPGDL

SEQ ID NO: 722290 - protein, 22 aa, Mycobacterium
RKRAESSALFAMLSGQHAGNAL

SEQ ID NO: 722291 - protein, 23 aa, Mycobacterium
RKRAETPLLLAVDGKLVGLISLR

SEQ ID NO: 722292 - protein, 21 aa, Mycobacterium
RKRCLVPMDGWYEWQANPDAV

SEQ ID NO: 722293 - protein, 17 aa, Mycobacterium
RKRFHKKPETELTVVAP

SEQ ID NO: 722294 - protein, 17 aa, Mycobacterium
RKRFRSMREDLRRARRD

SEQ ID NO: 722295 - protein, 25 aa, Mycobacterium
RKRGIPVILRPVVLAKLMTGYTTLM

SEQ ID NO: 722296 - protein, 26 aa, Mycobacterium
RKRGMLPPRRTRVVINESVCEGCGDC

SEQ ID NO: 722297 - protein, 20 aa, Mycobacterium
RKRGRRIGVVDVELTQGERT

SEQ ID NO: 722298 - protein, 18 aa, Mycobacterium
RKRILTLRRAELDEAFPG

SEQ ID NO: 722299 - protein, 20 aa, Mycobacterium
RKRLAAAVERAEMICRGVDL

SEQ ID NO: 722300 - protein, 22 aa, Mycobacterium
RKRLDEVSGIRLERERIQRRFA

SEQ ID NO: 722301 - protein, 18 aa, Mycobacterium
RKRLRALKYSKQMVEDIS

SEQ ID NO: 722302 - protein, 17 aa, Mycobacterium
RKRLVEFETSGGDGRLV

SEQ ID NO: 722303 - protein, 17 aa, Mycobacterium
RKRLVEFETTGSEGRLV

SEQ ID NO: 722304 - protein, 18 aa, Mycobacterium
RKRLVGTYGSMTHPNNPG

SEQ ID NO: 722305 - protein, 21 aa, Mycobacterium
RKRMERHGVLVVGPNAAFLGH

SEQ ID NO: 722306 - protein, 18 aa, Mycobacterium
RKRRLRFMIKAEMQEVRS

SEQ ID NO: 722307 - protein, 17 aa, Mycobacterium
RKRSVIRALEWTGETFG

SEQ ID NO: 722308 - protein, 17 aa, Mycobacterium
RKRVIGMRKTFQRYRRS

SEQ ID NO: 722309 - protein, 17 aa, Mycobacterium
RKRVLTMRRTFRRHRKQ

SEQ ID NO: 722310 - protein, 23 aa, Mycobacterium
RKRVPRKSLADWAPRPDRPDPVR

SEQ ID NO: 722311 - protein, 21 aa, Mycobacterium
RKRWNIASRFLSQVRMGQTKI

SEQ ID NO: 722312 - protein, 20 aa, Mycobacterium
RKRYPAIIVKAPLWVQRTPK

SEQ ID NO: 722313 - protein, 20 aa, Mycobacterium
RKRYPALGVGTRFRRVIRDS

SEQ ID NO: 722314 - protein, 21 aa, Mycobacterium
RKRYSCKSLRFAAASGSRMRP

SEQ ID NO: 722315 - protein, 18 aa, Mycobacterium
RKRYYRASGADAYTMQRL

SEQ ID NO: 722316 - protein, 21 aa, Mycobacterium
RKRYYRVSGADAYTMKREKRE

SEQ ID NO: 722317 - protein, 21 aa, Mycobacterium
RKSAALRAGRRVLAEVRATAV

SEQ ID NO: 722318 - protein, 17 aa, Mycobacterium
RKSAPLEGARLGQHERI

SEQ ID NO: 722319 - protein, 18 aa, Mycobacterium
RKSEARWQNLPAGSVGHL

SEQ ID NO: 722320 - protein, 18 aa, Mycobacterium
RKSFSPRILHSGIDEQPD

SEQ ID NO: 722321 - protein, 25 aa, Mycobacterium
RKSGEPRESPLLFLREGDRIVLVAS

SEQ ID NO: 722322 - protein, 24 aa, Mycobacterium
RKSGRPRVSPLLYLHDGDRIALVG

SEQ ID NO: 722323 - protein, 21 aa, Mycobacterium
RKSKGAIAYREFADALLRHWK

SEQ ID NO: 722324 - protein, 19 aa, Mycobacterium
RKSNELLGRLDSRSDQISN

SEQ ID NO: 722325 - protein, 17 aa, Mycobacterium
RKSQGLFLEQSILRNAG

SEQ ID NO: 722326 - protein, 21 aa, Mycobacterium
RKSRHPLVIIPGGPGVASVQM

SEQ ID NO: 722327 - protein, 21 aa, Mycobacterium
RKSRHPVVLIPGGPGVASIQQ

SEQ ID NO: 722328 - protein, 26 aa, Mycobacterium
RKTCAPWLDAEWRLVSHDVRVIVALG

SEQ ID NO: 722329 - protein, 20 aa, Mycobacterium
RKTFGENFFYILYFQEPGVA

SEQ ID NO: 722330 - protein, 20 aa, Mycobacterium
RKTFRSDRYPEYKATRSATP

SEQ ID NO: 722331 - protein, 19 aa, Mycobacterium
RKTLRAVAVKSPYFGDRRK

SEQ ID NO: 722332 - protein, 18 aa, Mycobacterium
RKTLRLVAEYADIWHSFT

SEQ ID NO: 722333 - protein, 21 aa, Mycobacterium
RKTPPKGAAIFVGRVLARDSY

SEQ ID NO: 722334 - protein, 25 aa, Mycobacterium
RKTRRFSVEILSRMSGQRSLISDVR

SEQ ID NO: 722335 - protein, 17 aa, Mycobacterium
RKTSRNAFAEWAGGGNE

SEQ ID NO: 722336 - protein, 17 aa, Mycobacterium
RKTSRNAFAEWAGSGNE

SEQ ID NO: 722337 - protein, 19 aa, Mycobacterium
RKTTEWGLLGGKVAFEPTI

SEQ ID NO: 722338 - protein, 18 aa, Mycobacterium
RKTVRAFAEREVLPHAHE

SEQ ID NO: 722339 - protein, 18 aa, Mycobacterium
RKVAFKRSYRDVDVLLVD

SEQ ID NO: 722340 - protein, 17 aa, Mycobacterium
RKVALELIYTGEPISSA

SEQ ID NO: 722341 - protein, 19 aa, Mycobacterium
RKVDAIIFGTGFHVTDSYK

SEQ ID NO: 722342 - protein, 19 aa, Mycobacterium
RKVDALSMFGMQARKKSLL

SEQ ID NO: 722343 - protein, 26 aa, Mycobacterium
RKVDGGWRLSGQKIWSSRAPFADRAF

SEQ ID NO: 722344 - protein, 19 aa, Mycobacterium
RKVFIPVTHLCRDKCHYCT

SEQ ID NO: 722345 - protein, 19 aa, Mycobacterium
RKVFIPVTHLCRDTCHYCT

SEQ ID NO: 722346 - protein, 17 aa, Mycobacterium
RKVFRRDGMLLAVDKNM

SEQ ID NO: 722347 - protein, 17 aa, Mycobacterium
RKVGGAWSDIVRTDSTT

SEQ ID NO: 722348 - protein, 22 aa, Mycobacterium
RKVGRRRADFTISYPGLIASGS

SEQ ID NO: 722349 - protein, 19 aa, Mycobacterium
RKVHGGAVSRHHRGEEPGS

SEQ ID NO: 722350 - protein, 17 aa, Mycobacterium
RKVIALTNPVSGHGAAI

SEQ ID NO: 722351 - protein, 18 aa, Mycobacterium
RKVKKWIAEGDFDVLHIH

SEQ ID NO: 722352 - protein, 17 aa, Mycobacterium
RKVKKWLAEGDFDVLHL

SEQ ID NO: 722353 - protein, 17 aa, Mycobacterium
RKVKMSATLGRHVNDKM

SEQ ID NO: 722354 - protein, 18 aa, Mycobacterium
RKVKMSATLGRHVNDKML

SEQ ID NO: 722355 - protein, 20 aa, Mycobacterium
RKVLDCDDVISAMTSSRDVD

SEQ ID NO: 722356 - protein, 21 aa, Mycobacterium
RKVLELHGWGDLHTELHRLSL

SEQ ID NO: 722357 - protein, 25 aa, Mycobacterium
RKVLNPYFSPARMKALRHEIAAETD

SEQ ID NO: 722358 - protein, 24 aa, Mycobacterium
RKVLNPYFSPGRMKDLEPQVRAVT

SEQ ID NO: 722359 - protein, 24 aa, Mycobacterium
RKVLPRKPAHLVVRMYSALTEAVF

SEQ ID NO: 722360 - protein, 19 aa, Mycobacterium
RKVLRRFAKQPANTKTVLV

SEQ ID NO: 722361 - protein, 19 aa, Mycobacterium
RKVLRRFVKRPVDTKTVLV

SEQ ID NO: 722362 - protein, 19 aa, Mycobacterium
RKVMPRLLNVGPWETLALA

SEQ ID NO: 722363 - protein, 20 aa, Mycobacterium
RKVPAALKWIEDRRENLMSA

SEQ ID NO: 722364 - protein, 17 aa, Mycobacterium
RKVPQAWLESGVVQEGR

SEQ ID NO: 722365 - protein, 17 aa, Mycobacterium
RKVRDRASYAFALVSVA

SEQ ID NO: 722366 - protein, 19 aa, Mycobacterium
RKVRFLPYGIAVSVLDDDS

SEQ ID NO: 722367 - protein, 18 aa, Mycobacterium
RKVRFLPYGIAVSVLDDP

SEQ ID NO: 722368 - protein, 21 aa, Mycobacterium
RKVRYRGVAKNDHWLHHRTAA

SEQ ID NO: 722369 - protein, 22 aa, Mycobacterium
RKVVDDEFPGRVLLAEANQWPA

SEQ ID NO: 722370 - protein, 27 aa, Mycobacterium
RKVVELRASLDWDKGRTLRGILEQIEG

SEQ ID NO: 722371 - protein, 19 aa, Mycobacterium
RKVVPRLLYMKPWETPAIT

SEQ ID NO: 722372 - protein, 18 aa, Mycobacterium
RKVVRPALHASVEELFHD

SEQ ID NO: 722373 - protein, 18 aa, Mycobacterium
RKVVRPALNGSIEELLHE

SEQ ID NO: 722374 - protein, 30 aa, Mycobacterium
RKWGDDLYLKFGEPIPVTSLLGFGSGMLLG

SEQ ID NO: 722375 - protein, 18 aa, Mycobacterium
RKWGLPVRPDQWWVADFT

SEQ ID NO: 722376 - protein, 19 aa, Mycobacterium
RKWLLEYGDAGAREAMLKK

SEQ ID NO: 722377 - protein, 27 aa, Mycobacterium
RKWWSTGVGHPDCKVIIFMGLTDPNAH

SEQ ID NO: 722378 - protein, 24 aa, Mycobacterium
RKYAADIDGVIGWAQESRQRLAQL

SEQ ID NO: 722379 - protein, 25 aa, Mycobacterium
RKYAADLNGVIAWAKEARTRLAEVD

SEQ ID NO: 722380 - protein, 20 aa, Mycobacterium
RKYECPTGPEFSKIKTDPEL

SEQ ID NO: 722381 - protein, 17 aa, Mycobacterium
RKYGAAVVVMAFDEKGQ

SEQ ID NO: 722382 - protein, 17 aa, Mycobacterium
RKYGCSLQIGGSDQWGN

SEQ ID NO: 722383 - protein, 18 aa, Mycobacterium
RKYIGAYIATLGGADVIS

SEQ ID NO: 722384 - protein, 19 aa, Mycobacterium
RKYIGAYLAVLGHTDALTF

SEQ ID NO: 722385 - protein, 19 aa, Mycobacterium
RKYIGAYLAVLGHTDVITF

SEQ ID NO: 722386 - protein, 19 aa, Mycobacterium
RKYIGAYMAVLGRTDVISF

SEQ ID NO: 722387 - protein, 19 aa, Mycobacterium
RKYLIAAARIAYVEIGVAD

SEQ ID NO: 722388 - protein, 17 aa, Mycobacterium
RKYPVVPGIDLTGEVVE

SEQ ID NO: 722389 - protein, 19 aa, Mycobacterium
RKYRSVFGGGTRGDGWYSF

SEQ ID NO: 722390 - protein, 19 aa, Mycobacterium
RLAAAGVTWLTIAPSGSDR

SEQ ID NO: 722391 - protein, 25 aa, Mycobacterium
RLAAAKTRLAPVFSARTRENVVLAM

SEQ ID NO: 722392 - protein, 17 aa, Mycobacterium
RLAAALDPAEYVFLDDD

SEQ ID NO: 722393 - protein, 24 aa, Mycobacterium
RLAAAVSAMLASVVVVDELGAAID

SEQ ID NO: 722394 - protein, 20 aa, Mycobacterium
RLAACPEALTGEPSRQALIA

SEQ ID NO: 722395 - protein, 18 aa, Mycobacterium
RLAADLAQAERSRQPITP

SEQ ID NO: 722396 - protein, 18 aa, Mycobacterium
RLAADPRTGVSLRPAVFY

SEQ ID NO: 722397 - protein, 19 aa, Mycobacterium
RLAAEAGLPDGVLNVVTGL

SEQ ID NO: 722398 - protein, 19 aa, Mycobacterium
RLAAEAGPVDILVNNAGIY

SEQ ID NO: 722399 - protein, 18 aa, Mycobacterium
RLAAEFEDALRPHLEPSG

SEQ ID NO: 722400 - protein, 19 aa, Mycobacterium
RLAAELCALLPDDRDAHAL

SEQ ID NO: 722401 - protein, 19 aa, Mycobacterium
RLAAEWGERAKPLVGELPE

SEQ ID NO: 722402 - protein, 21 aa, Mycobacterium
RLAAGLPAYGACAGMIMLASE

SEQ ID NO: 722403 - protein, 17 aa, Mycobacterium
RLAAGRRGAWRARRGSA

SEQ ID NO: 722404 - protein, 19 aa, Mycobacterium
RLAAHGWVVEPVRNTLDLQ

SEQ ID NO: 722405 - protein, 19 aa, Mycobacterium
RLAALGTSCPDHFLRTKVK

SEQ ID NO: 722406 - protein, 19 aa, Mycobacterium
RLAALKRLGLCPPDVEAHP

SEQ ID NO: 722407 - protein, 19 aa, Mycobacterium
RLAALKRLGLCPPDVTAHP

SEQ ID NO: 722408 - protein, 19 aa, Mycobacterium
RLAALYKSGLLNIDDMVTR

SEQ ID NO: 722409 - protein, 24 aa, Mycobacterium
RLAATAVLISPAWKRDEVDHALAL

SEQ ID NO: 722410 - protein, 19 aa, Mycobacterium
RLAAVAALLRHRVATADGA

SEQ ID NO: 722411 - protein, 19 aa, Mycobacterium
RLAAVAPNLLNTVTHTRGL

SEQ ID NO: 722412 - protein, 19 aa, Mycobacterium
RLAAWVVELNSRFKGTAEF

SEQ ID NO: 722413 - protein, 19 aa, Mycobacterium
RLAAYAREFGEEPAVVATY

SEQ ID NO: 722414 - protein, 18 aa, Mycobacterium
RLADACAHTLLDSIARVP

SEQ ID NO: 722415 - protein, 20 aa, Mycobacterium
RLADATVWPKLFGGCHTHRH

SEQ ID NO: 722416 - protein, 19 aa, Mycobacterium
RLADERVAELLAAERAAER

SEQ ID NO: 722417 - protein, 20 aa, Mycobacterium
RLADESYDLLVIDAAPADQP

SEQ ID NO: 722418 - protein, 26 aa, Mycobacterium
RLADGVEIAGRWAAAAGLDVELTKSL

SEQ ID NO: 722419 - protein, 18 aa, Mycobacterium
RLADGWLGSFLTPVEAGA

SEQ ID NO: 722420 - protein, 21 aa, Mycobacterium
RLADGYIDIKGLRLTVTQAAW

SEQ ID NO: 722421 - protein, 20 aa, Mycobacterium
RLADGYIDVKGLRLTLTQAA

SEQ ID NO: 722422 - protein, 20 aa, Mycobacterium
RLADHLMKNWAADRSSLSRP

SEQ ID NO: 722423 - protein, 23 aa, Mycobacterium
RLADHPRVLAVLDRILMPNYLLS

SEQ ID NO: 722424 - protein, 17 aa, Mycobacterium
RLADRDIEVAFGTIKAG

SEQ ID NO: 722425 - protein, 21 aa, Mycobacterium
RLADRSWPDRVITHAPLWCAV

SEQ ID NO: 722426 - protein, 19 aa, Mycobacterium
RLADRYRTGRVLLAGDAAH

SEQ ID NO: 722427 - protein, 19 aa, Mycobacterium
RLADSIRHAVAEGCLEEYS

SEQ ID NO: 722428 - protein, 34 aa, Mycobacterium
RLADSLTDVLPRRPRFALLKGRGNYLCLNKVHNG

SEQ ID NO: 722429 - protein, 19 aa, Mycobacterium
RLADYRITVTVARQRVVLD

SEQ ID NO: 722430 - protein, 25 aa, Mycobacterium
RLAEAARLGFTVAVVPSGAVGAHAG

SEQ ID NO: 722431 - protein, 22 aa, Mycobacterium
RLAEAIRRFGKIFAQNYGQSEA

SEQ ID NO: 722432 - protein, 26 aa, Mycobacterium
RLAEAIRRFGPIFAQYYGQSEAPMVI

SEQ ID NO: 722433 - protein, 18 aa, Mycobacterium
RLAEALTPSLARKPRFAI

SEQ ID NO: 722434 - protein, 25 aa, Mycobacterium
RLAEEARMAPNLSGRINMAAMAAAE

SEQ ID NO: 722435 - protein, 18 aa, Mycobacterium
RLAEFRIGADEVKYPPIG

SEQ ID NO: 722436 - protein, 19 aa, Mycobacterium
RLAEFRIGPEEVKYPPLGS

SEQ ID NO: 722437 - protein, 26 aa, Mycobacterium
RLAEHAGRRLIGFSAELGGKNAMIVT

SEQ ID NO: 722438 - protein, 23 aa, Mycobacterium
RLAEILQTLFTGYGDRPALGYRA

SEQ ID NO: 722439 - protein, 17 aa, Mycobacterium
RLAELGIPAARRYLAQL

SEQ ID NO: 722440 - protein, 17 aa, Mycobacterium
RLAELGMPAARRYFAQL

SEQ ID NO: 722441 - protein, 21 aa, Mycobacterium
RLAELNRRVLLGASAAAVAAE

SEQ ID NO: 722442 - protein, 27 aa, Mycobacterium
RLAELRRGRGRVVEVLFRDGHRSTFAE

SEQ ID NO: 722443 - protein, 26 aa, Mycobacterium
RLAELRWAGIGAAWYWTVARPDINAL

SEQ ID NO: 722444 - protein, 17 aa, Mycobacterium
RLAELYCAAREVILSVP

SEQ ID NO: 722445 - protein, 23 aa, Mycobacterium
RLAEQRGATVLAHNYQLPAIQDV

SEQ ID NO: 722446 - protein, 19 aa, Mycobacterium
RLAERMAEMPVGRGTEDGV

SEQ ID NO: 722447 - protein, 17 aa, Mycobacterium
RLAETSGIVLVTPLLEW

SEQ ID NO: 722448 - protein, 17 aa, Mycobacterium
RLAEVILPPAGAGREAL

SEQ ID NO: 722449 - protein, 22 aa, Mycobacterium
RLAFATAHPRWIAQSFSDALGP

SEQ ID NO: 722450 - protein, 22 aa, Mycobacterium
RLAFDRPRYWDLFEGVLRNTID

SEQ ID NO: 722451 - protein, 24 aa, Mycobacterium
RLAFPLRRGLVWRRRVDELRTEAS

SEQ ID NO: 722452 - protein, 24 aa, Mycobacterium
RLAFYKQLYRDHARFDATLWVVPA

SEQ ID NO: 722453 - protein, 26 aa, Mycobacterium
RLAGAEIRVGYFLAEDHALRLLNLRR

SEQ ID NO: 722454 - protein, 26 aa, Mycobacterium
RLAGAEVRVGYFLAEDHALRLLNLRR

SEQ ID NO: 722455 - protein, 20 aa, Mycobacterium
RLAGCPDDFLAPPLIGDRGV

SEQ ID NO: 722456 - protein, 19 aa, Mycobacterium
RLAGDWGGAFGTLPTGLDL

SEQ ID NO: 722457 - protein, 20 aa, Mycobacterium
RLAGEAGLRRAEVALVHSDD

SEQ ID NO: 722458 - protein, 22 aa, Mycobacterium
RLAGELCALMPDELDAHALAAL

SEQ ID NO: 722459 - protein, 20 aa, Mycobacterium
RLAGERAGGTILWMADERAI

SEQ ID NO: 722460 - protein, 20 aa, Mycobacterium
RLAGERHPRVMRLAVPGRHM

SEQ ID NO: 722461 - protein, 19 aa, Mycobacterium
RLAGGHVRVGNYLAGETAL

SEQ ID NO: 722462 - protein, 18 aa, Mycobacterium
RLAGGVDLVNEWASRTGL

SEQ ID NO: 722463 - protein, 30 aa, Mycobacterium
RLAGHALKASIAWRTLRAHLLARGNDHDGA

SEQ ID NO: 722464 - protein, 27 aa, Mycobacterium
RLAGHALKASIAWRTLRARLLSRRGDD

SEQ ID NO: 722465 - protein, 19 aa, Mycobacterium
RLAGIVPPGARIAVDELTG

SEQ ID NO: 722466 - protein, 17 aa, Mycobacterium
RLAGLVAHQEVLFGTQG

SEQ ID NO: 722467 - protein, 20 aa, Mycobacterium
RLAGNYPLSIALDGQALNMT

SEQ ID NO: 722468 - protein, 19 aa, Mycobacterium
RLAGRPRRPARPTGLVLAP

SEQ ID NO: 722469 - protein, 24 aa, Mycobacterium
RLAGSRTGVFIGISANDYGSLQHG

SEQ ID NO: 722470 - protein, 19 aa, Mycobacterium
RLAGTDYWFCGPGCRAAFA

SEQ ID NO: 722471 - protein, 21 aa, Mycobacterium
RLAGVAPKAARWWLLVSEGEA

SEQ ID NO: 722472 - protein, 19 aa, Mycobacterium
RLAGWGNWAVMGRAAPAGR

SEQ ID NO: 722473 - protein, 17 aa, Mycobacterium
RLAHEGTTFAVLVDQVR

SEQ ID NO: 722474 - protein, 19 aa, Mycobacterium
RLAHHLGAPAVRLEQLHAD

SEQ ID NO: 722475 - protein, 17 aa, Mycobacterium
RLAHLMIRHGARPGERV

SEQ ID NO: 722476 - protein, 20 aa, Mycobacterium
RLAHLPKPRHSRACAVADAA

SEQ ID NO: 722477 - protein, 21 aa, Mycobacterium
RLAHPEGRALPSYPPGSHVVL

SEQ ID NO: 722478 - protein, 28 aa, Mycobacterium
RLAIPELPEELFMESLRQLIAVDNAWVP

SEQ ID NO: 722479 - protein, 20 aa, Mycobacterium
RLAKCGPWHQGGWDPIPERQ

SEQ ID NO: 722480 - protein, 21 aa, Mycobacterium
RLAKCGPWHRGGWDPIPERQR

SEQ ID NO: 722481 - protein, 23 aa, Mycobacterium
RLAKEAYVLHARRYLAGGEAIHP

SEQ ID NO: 722482 - protein, 26 aa, Mycobacterium
RLAKELEFRPRKSLGQNFVHDANTVR

SEQ ID NO: 722483 - protein, 19 aa, Mycobacterium
RLAKIAAKVVLGRRIHRRP

SEQ ID NO: 722484 - protein, 19 aa, Mycobacterium
RLAKLGGIVGTAFQISDDI

SEQ ID NO: 722485 - protein, 21 aa, Mycobacterium
RLAKMLRFAVDEVFQMQSEAR

SEQ ID NO: 722486 - protein, 22 aa, Mycobacterium
RLAKRIGAIVASAIEYEIKDPR

SEQ ID NO: 722487 - protein, 21 aa, Mycobacterium
RLAKSAGVRRFLYASTCSVYG

SEQ ID NO: 722488 - protein, 19 aa, Mycobacterium
RLAKVAGLLPGRDPYHPNP

SEQ ID NO: 722489 - protein, 29 aa, Mycobacterium
RLALARELAELVSPGGAFVSDGFGVVHRK

SEQ ID NO: 722490 - protein, 20 aa, Mycobacterium
RLALEKASAGTRLHGVADEG

SEQ ID NO: 722491 - protein, 19 aa, Mycobacterium
RLALEVATRVADEFPDGVW

SEQ ID NO: 722492 - protein, 23 aa, Mycobacterium
RLALQLRGAGLIDDAETLRRITP

SEQ ID NO: 722493 - protein, 26 aa, Mycobacterium
RLALRRACAAGALATLVPGAGDCAPD

SEQ ID NO: 722494 - protein, 26 aa, Mycobacterium
RLAMPELPDELFMGSLCQLIAVDKPW

SEQ ID NO: 722495 - protein, 25 aa, Mycobacterium
RLANALRSWPVLRFEVTEDPSEGVD

SEQ ID NO: 722496 - protein, 26 aa, Mycobacterium
RLANQIWRTNVLGAYHVAQSAWRHGV

SEQ ID NO: 722497 - protein, 27 aa, Mycobacterium
RLANSLGIKSIRVWRRLRADRAAQQIE

SEQ ID NO: 722498 - protein, 19 aa, Mycobacterium
RLAPAGLPVQPASPRGAER

SEQ ID NO: 722499 - protein, 18 aa, Mycobacterium
RLAPAPPLLALPAEEAWR

SEQ ID NO: 722500 - protein, 18 aa, Mycobacterium
RLAPDTPAYFAVKAHEVV

SEQ ID NO: 722501 - protein, 20 aa, Mycobacterium
RLAPEAQVDFCRLLGEVDHS

SEQ ID NO: 722502 - protein, 31 aa, Mycobacterium
RLAPETPLARVFWPRGRIVVSREAIRLFDAS

SEQ ID NO: 722503 - protein, 18 aa, Mycobacterium
RLAPFDVNLHYTDTRRLA

SEQ ID NO: 722504 - protein, 26 aa, Mycobacterium
RLAPTAVEEIVRWASPVVYMRRTLTR

SEQ ID NO: 722505 - protein, 20 aa, Mycobacterium
RLAPTIAEVFTRRHADTRNL

SEQ ID NO: 722506 - protein, 18 aa, Mycobacterium
RLAPVPDRVDPALMRLMA

SEQ ID NO: 722507 - protein, 18 aa, Mycobacterium
RLAPVSAHQIAAVIDDVL

SEQ ID NO: 722508 - protein, 25 aa, Mycobacterium
RLAQASGLRYIGFRHESDAGHAAAA

SEQ ID NO: 722509 - protein, 18 aa, Mycobacterium
RLAQCPAHVSQLDTTIDQ

SEQ ID NO: 722510 - protein, 19 aa, Mycobacterium
RLAQCPAQIATLDGTVDQL

SEQ ID NO: 722511 - protein, 19 aa, Mycobacterium
RLAQIPQRVAGYADSLRSA

SEQ ID NO: 722512 - protein, 40 aa, Mycobacterium
RLAQLGYRYGPAFRGIEAIWRRGTEVYAEVAIPADAELGI

SEQ ID NO: 722513 - protein, 18 aa, Mycobacterium
RLARCVVEERWPLRRTAE

SEQ ID NO: 722514 - protein, 17 aa, Mycobacterium
RLARECHDDGVAVAVFP

SEQ ID NO: 722515 - protein, 17 aa, Mycobacterium
RLARLGVEDELLKLGAE

SEQ ID NO: 722516 - protein, 17 aa, Mycobacterium
RLARLGVEDELLKLGAR

SEQ ID NO: 722517 - protein, 17 aa, Mycobacterium
RLARLGVEDELLKRGAK

SEQ ID NO: 722518 - protein, 17 aa, Mycobacterium
RLARLHTPLPVLAFTPL

SEQ ID NO: 722519 - protein, 17 aa, Mycobacterium
RLARLHTPLPVLAFTSL

SEQ ID NO: 722520 - protein, 26 aa, Mycobacterium
RLARLLRLLGLDVWWSSAADDPTLVD

SEQ ID NO: 722521 - protein, 27 aa, Mycobacterium
RLARRQGIEILGPVGLAGRSAATVAEA

SEQ ID NO: 722522 - protein, 20 aa, Mycobacterium
RLARRYLAVEGHRALVSNAD

SEQ ID NO: 722523 - protein, 25 aa, Mycobacterium
RLARSERARLLLGIADAIEADSERL

SEQ ID NO: 722524 - protein, 18 aa, Mycobacterium
RLARTGTGIAHCPTSNGR

SEQ ID NO: 722525 - protein, 25 aa, Mycobacterium
RLARTVWPEAGWDDLGLRPHLAVAA

SEQ ID NO: 722526 - protein, 20 aa, Mycobacterium
RLARVPWGLLAVPKSGPSKE

SEQ ID NO: 722527 - protein, 21 aa, Mycobacterium
RLARVPWGLLAVPKSGPSKEE

SEQ ID NO: 722528 - protein, 20 aa, Mycobacterium
RLARWTRLYPDVKVESTIIR

SEQ ID NO: 722529 - protein, 23 aa, Mycobacterium
RLASACATCSVRGAGGARSAPHP

SEQ ID NO: 722530 - protein, 20 aa, Mycobacterium
RLASASAPGRRVAVIGRDPR

SEQ ID NO: 722531 - protein, 19 aa, Mycobacterium
RLASEAGLPDGVLNVVTGS

SEQ ID NO: 722532 - protein, 22 aa, Mycobacterium
RLASELEVLLALGAAHGTDALV

SEQ ID NO: 722533 - protein, 21 aa, Mycobacterium
RLASHANHYLALFDHGKALAL

SEQ ID NO: 722534 - protein, 27 aa, Mycobacterium
RLASRRRLVEILSHFDLLKDDTEPPIR

SEQ ID NO: 722535 - protein, 20 aa, Mycobacterium
RLASVLRRCTVIGAQLRGTE

SEQ ID NO: 722536 - protein, 19 aa, Mycobacterium
RLASWFGTQIDRFIGWPRL

SEQ ID NO: 722537 - protein, 19 aa, Mycobacterium
RLATAIGLGPDRVVWMNQV

SEQ ID NO: 722538 - protein, 27 aa, Mycobacterium
RLATEAGISRASFYIYFEDKGHLLRRL

SEQ ID NO: 722539 - protein, 20 aa, Mycobacterium
RLATRHLIAHPGLQRAAERG

SEQ ID NO: 722540 - protein, 20 aa, Mycobacterium
RLATRHLIQYPGLQRAAARG

SEQ ID NO: 722541 - protein, 20 aa, Mycobacterium
RLATRWTAIDDHHWRFVLRR

SEQ ID NO: 722542 - protein, 20 aa, Mycobacterium
RLATVRILGALALGRLQRSP

SEQ ID NO: 722543 - protein, 19 aa, Mycobacterium
RLATVRIPTALALGRLQRS

SEQ ID NO: 722544 - protein, 17 aa, Mycobacterium
RLATWLKARGCRNSATV

SEQ ID NO: 722545 - protein, 24 aa, Mycobacterium
RLATYRPGDFLGWTSDFTPTTPSP

SEQ ID NO: 722546 - protein, 18 aa, Mycobacterium
RLAVDLPTAAGFDPDRPL

SEQ ID NO: 722547 - protein, 24 aa, Mycobacterium
RLAVEAMTALIARHVDVEAVLAAA

SEQ ID NO: 722548 - protein, 18 aa, Mycobacterium
RLAVEPKRSGYDPQKYFK

SEQ ID NO: 722549 - protein, 20 aa, Mycobacterium
RLAVEPQLREPLPRLGTVPV

SEQ ID NO: 722550 - protein, 25 aa, Mycobacterium
RLAVGGVLMTINWWSASRTMTQDDL

SEQ ID NO: 722551 - protein, 19 aa, Mycobacterium
RLAVGSALFGLVRADDRIP

SEQ ID NO: 722552 - protein, 19 aa, Mycobacterium
RLAVHPDAYIRPSPTSGTL

SEQ ID NO: 722553 - protein, 19 aa, Mycobacterium
RLAVLPSLTPILLPDTGRT

SEQ ID NO: 722554 - protein, 24 aa, Mycobacterium
RLAVPADLLLPIPRDVSWEQAGGF

SEQ ID NO: 722555 - protein, 19 aa, Mycobacterium
RLAVRDWHADVEFSVEPGV

SEQ ID NO: 722556 - protein, 19 aa, Mycobacterium
RLAVRELTWSAGAAGVEAA

SEQ ID NO: 722557 - protein, 17 aa, Mycobacterium
RLAVYLCTRDCYATNAV

SEQ ID NO: 722558 - protein, 20 aa, Mycobacterium
RLAYSGIRLTDFHSAPACSP

SEQ ID NO: 722559 - protein, 22 aa, Mycobacterium
RLCAAERAAVCGLADKPTFRAA

SEQ ID NO: 722560 - protein, 24 aa, Mycobacterium
RLCALARNAADLGLQHSTEHLELL

SEQ ID NO: 722561 - protein, 22 aa, Mycobacterium
RLCALARNAADLGVSVNTDHLD

SEQ ID NO: 722562 - protein, 18 aa, Mycobacterium
RLCARRMVDAGIRGQIIN

SEQ ID NO: 722563 - protein, 20 aa, Mycobacterium
RLCDPMAQQISTVWAASLPE

SEQ ID NO: 722564 - protein, 20 aa, Mycobacterium
RLCNWCPHQQHCPAYGGTPP

SEQ ID NO: 722565 - protein, 24 aa, Mycobacterium
RLCPHAVVVPPRFDAYSAASKLVF

SEQ ID NO: 722566 - protein, 24 aa, Mycobacterium
RLCPQAVVVPPRMRAYMRASDAVF

SEQ ID NO: 722567 - protein, 25 aa, Mycobacterium
RLCRDTCHYCTFVTVPGKLRASGAG

SEQ ID NO: 722568 - protein, 17 aa, Mycobacterium
RLCRSHVGIDAEAGPTE

SEQ ID NO: 722569 - protein, 17 aa, Mycobacterium
RLCRSQVGIDAEAGPTE

SEQ ID NO: 722570 - protein, 20 aa, Mycobacterium
RLCSACFDGKYPIELPGETA

SEQ ID NO: 722571 - protein, 22 aa, Mycobacterium
RLCSETLELLLRSTGYNDDITL

SEQ ID NO: 722572 - protein, 19 aa, Mycobacterium
RLCTACFDGKYPIELPGET

SEQ ID NO: 722573 - protein, 20 aa, Mycobacterium
RLDAAPGILIPAFADYTERV

SEQ ID NO: 722574 - protein, 17 aa, Mycobacterium
RLDAELVGNVSIRVLDI

SEQ ID NO: 722575 - protein, 22 aa, Mycobacterium
RLDAESAFQVLAKWSQKSNTKL

SEQ ID NO: 722576 - protein, 27 aa, Mycobacterium
RLDAIGFWQRLHHTFAAVLRARAAAAG

SEQ ID NO: 722577 - protein, 26 aa, Mycobacterium
RLDALLRLEGFRDWADIDVDEAQSRA

SEQ ID NO: 722578 - protein, 26 aa, Mycobacterium
RLDALVRIEGFRSWTELDADEAVSRA

SEQ ID NO: 722579 - protein, 24 aa, Mycobacterium
RLDAPPDRRVIGLSLTQYREEHLS

SEQ ID NO: 722580 - protein, 18 aa, Mycobacterium
RLDAPRVVWVMVPSGTVT

SEQ ID NO: 722581 - protein, 18 aa, Mycobacterium
RLDARIPVLALPRELAAG

SEQ ID NO: 722582 - protein, 25 aa, Mycobacterium
RLDAVAEHYLHFGGVSPINGINRAL

SEQ ID NO: 722583 - protein, 20 aa, Mycobacterium
RLDAVPGQRDHSWGVRDWWS

SEQ ID NO: 722584 - protein, 21 aa, Mycobacterium
RLDAYYEHGLKVWDRAAGALI

SEQ ID NO: 722585 - protein, 21 aa, Mycobacterium
RLDCTVWGGIMSRVAAARGIA

SEQ ID NO: 722586 - protein, 20 aa, Mycobacterium
RLDDARCATVAAALVKAAKE

SEQ ID NO: 722587 - protein, 20 aa, Mycobacterium
RLDDEALLFVELGKRLAPGP

SEQ ID NO: 722588 - protein, 19 aa, Mycobacterium
RLDDLPVLYELAAEEEGAG

SEQ ID NO: 722589 - protein, 19 aa, Mycobacterium
RLDDLPVLYELAAEEEGEA

SEQ ID NO: 722590 - protein, 19 aa, Mycobacterium
RLDDLPVLYELAAEEGEGA

SEQ ID NO: 722591 - protein, 31 aa, Mycobacterium
RLDDMHLRRNRWTPLGAYGRAKLAVMLWGLE

SEQ ID NO: 722592 - protein, 21 aa, Mycobacterium
RLDDPRIPVSVNRPTTKFEGK

SEQ ID NO: 722593 - protein, 17 aa, Mycobacterium
RLDEASAQETLRMFKDL

SEQ ID NO: 722594 - protein, 20 aa, Mycobacterium
RLDFCPSCKTSYESARQSEF

SEQ ID NO: 722595 - protein, 23 aa, Mycobacterium
RLDFKRRSCCLFYRLPGRAVCGD

SEQ ID NO: 722596 - protein, 19 aa, Mycobacterium
RLDFRGEFYTHTVMAPNFN

SEQ ID NO: 722597 - protein, 24 aa, Mycobacterium
RLDFRPKHRLAVLVVSVQPLAEPV

SEQ ID NO: 722598 - protein, 24 aa, Mycobacterium
RLDFRPKHRLTVLVVQVSPLAEPV

SEQ ID NO: 722599 - protein, 27 aa, Mycobacterium
RLDGCAEPAVQREAFAWHIDLAKRCGK

SEQ ID NO: 722600 - protein, 22 aa, Mycobacterium
RLDGGLQIDWWYDAQRFDPYSI

SEQ ID NO: 722601 - protein, 19 aa, Mycobacterium
RLDGIPLAIELAASRMASM

SEQ ID NO: 722602 - protein, 19 aa, Mycobacterium
RLDGLEVCRQLRSTGDDLP

SEQ ID NO: 722603 - protein, 18 aa, Mycobacterium
RLDGLVITGGPDVDPARY

SEQ ID NO: 722604 - protein, 18 aa, Mycobacterium
RLDGMPLAIELAAARVRA

SEQ ID NO: 722605 - protein, 19 aa, Mycobacterium
RLDGMPLAIELAAARVRAL

SEQ ID NO: 722606 - protein, 19 aa, Mycobacterium
RLDGMPLAIELAAARVRTM

SEQ ID NO: 722607 - protein, 17 aa, Mycobacterium
RLDGVKSLVPAATAAEL

SEQ ID NO: 722608 - protein, 18 aa, Mycobacterium
RLDGVTFRDASRLGRRLK

SEQ ID NO: 722609 - protein, 19 aa, Mycobacterium
RLDGYRLQPINTIDVLGLD

SEQ ID NO: 722610 - protein, 18 aa, Mycobacterium
RLDHMLSYHQMYGTWQSM

SEQ ID NO: 722611 - protein, 18 aa, Mycobacterium
RLDHPGVLVIEGGPGTGK

SEQ ID NO: 722612 - protein, 18 aa, Mycobacterium
RLDHVVLWTKDVRAAMDF

SEQ ID NO: 722613 - protein, 18 aa, Mycobacterium
RLDIPAGTAVRFEPGVAQ

SEQ ID NO: 722614 - protein, 21 aa, Mycobacterium
RLDIPSEFLADARDAGERSAS

SEQ ID NO: 722615 - protein, 27 aa, Mycobacterium
RLDIPSWMARAGFQMMDPLKTAKARVD

SEQ ID NO: 722616 - protein, 18 aa, Mycobacterium
RLDKLAELFGSERIVPAP

SEQ ID NO: 722617 - protein, 27 aa, Mycobacterium
RLDKLEIYPNLWAGVGLVRGGAGTALV

SEQ ID NO: 722618 - protein, 22 aa, Mycobacterium
RLDKTRFRSHPDLDVCSHGLTL

SEQ ID NO: 722619 - protein, 18 aa, Mycobacterium
RLDLLAGTVCPADPRSKT

SEQ ID NO: 722620 - protein, 19 aa, Mycobacterium
RLDLLKAVIRHRGEIDRIP

SEQ ID NO: 722621 - protein, 18 aa, Mycobacterium
RLDLRRMSYVQRLAKLLS

SEQ ID NO: 722622 - protein, 19 aa, Mycobacterium
RLDMSPFFGPGWVRDPDYL

SEQ ID NO: 722623 - protein, 26 aa, Mycobacterium
RLDPERGTLLAAVWLRPPAGESVLLL

SEQ ID NO: 722624 - protein, 18 aa, Mycobacterium
RLDPEVHHIHDDDQLVLD

SEQ ID NO: 722625 - protein, 19 aa, Mycobacterium
RLDPGLPLPARAHQGDAGV

SEQ ID NO: 722626 - protein, 19 aa, Mycobacterium
RLDPGLPLPSRAHHGDAGV

SEQ ID NO: 722627 - protein, 20 aa, Mycobacterium
RLDPQVARRLLDRVEQVGAV

SEQ ID NO: 722628 - protein, 20 aa, Mycobacterium
RLDPSAGVMVSALWVTSSAQ

SEQ ID NO: 722629 - protein, 19 aa, Mycobacterium
RLDPVIRLAAARAQASAGV

SEQ ID NO: 722630 - protein, 18 aa, Mycobacterium
RLDRAVLMNCTASKAGVA

SEQ ID NO: 722631 - protein, 20 aa, Mycobacterium
RLDRDIRSGNGWPTDQSLGE

SEQ ID NO: 722632 - protein, 17 aa, Mycobacterium
RLDRFLGVMPADIPVAV

SEQ ID NO: 722633 - protein, 18 aa, Mycobacterium
RLDRGIATNVAYLVPHGV

SEQ ID NO: 722634 - protein, 26 aa, Mycobacterium
RLDRSRPLWECWIIEGLPSDRWAILM

SEQ ID NO: 722635 - protein, 20 aa, Mycobacterium
RLDRVTRTLVPHGPRDVLTE

SEQ ID NO: 722636 - protein, 19 aa, Mycobacterium
RLDSFLDPRNVAGGKPPAA

SEQ ID NO: 722637 - protein, 23 aa, Mycobacterium
RLDTELIGNVSIRVVDIGRPDAW

SEQ ID NO: 722638 - protein, 26 aa, Mycobacterium
RLDVDRSTIILAMWQYLLHRYTSQDT

SEQ ID NO: 722639 - protein, 24 aa, Mycobacterium
RLDVIRLPIDVMLDANTVLTKVRE

SEQ ID NO: 722640 - protein, 17 aa, Mycobacterium
RLDVLGIDHEIVPGVPA

SEQ ID NO: 722641 - protein, 20 aa, Mycobacterium
RLDVSNWPVLGGMGNASWVQ

SEQ ID NO: 722642 - protein, 17 aa, Mycobacterium
RLDWQLRHYPPRTDDVR

SEQ ID NO: 722643 - protein, 27 aa, Mycobacterium
RLEAALPAGVTVCWREPGDSRILDDLP

SEQ ID NO: 722644 - protein, 17 aa, Mycobacterium
RLEAALTIEDLRRVAKR

SEQ ID NO: 722645 - protein, 19 aa, Mycobacterium
RLEAEGHRILKLNIGNPAP

SEQ ID NO: 722646 - protein, 18 aa, Mycobacterium
RLEAEIAELLGAVHTVQG

SEQ ID NO: 722647 - protein, 18 aa, Mycobacterium
RLEAEITNLLSAVHAAQG

SEQ ID NO: 722648 - protein, 17 aa, Mycobacterium
RLEAHGVVEVRRGRGLF

SEQ ID NO: 722649 - protein, 26 aa, Mycobacterium
RLEAHLGERLALRFADVASEGRGKRP

SEQ ID NO: 722650 - protein, 27 aa, Mycobacterium
RLEAHLIARLGVRFAEQSRGRGKRPVR

SEQ ID NO: 722651 - protein, 17 aa, Mycobacterium
RLEALELVPANRNAVGQ

SEQ ID NO: 722652 - protein, 20 aa, Mycobacterium
RLEASGVRCDLHLWDGQIHD

SEQ ID NO: 722653 - protein, 20 aa, Mycobacterium
RLEASSGRRRLQYLGDSLRQ

SEQ ID NO: 722654 - protein, 22 aa, Mycobacterium
RLEASVALAAVAARFPNARLDG

SEQ ID NO: 722655 - protein, 22 aa, Mycobacterium
RLEASVALSAIAARFPQARLDG

SEQ ID NO: 722656 - protein, 19 aa, Mycobacterium
RLECGTAFVNTHAALLPTV

SEQ ID NO: 722657 - protein, 17 aa, Mycobacterium
RLEDGSVRTGLRQLENN

SEQ ID NO: 722658 - protein, 20 aa, Mycobacterium
RLEDIWSTFTKLAPKQLIVD

SEQ ID NO: 722659 - protein, 19 aa, Mycobacterium
RLEDLPVLYELAAEEEGAA

SEQ ID NO: 722660 - protein, 20 aa, Mycobacterium
RLEEALQIILPMIKGERPTF

SEQ ID NO: 722661 - protein, 24 aa, Mycobacterium
RLEEALQIIRLCLSARGPITFCGE

SEQ ID NO: 722662 - protein, 19 aa, Mycobacterium
RLEEIWTTFTKLAPKQLIV

SEQ ID NO: 722663 - protein, 26 aa, Mycobacterium
RLEELKALWFSEADKYNGLPLGDLSI

SEQ ID NO: 722664 - protein, 20 aa, Mycobacterium
RLEGELPQWCSAKDVILEML

SEQ ID NO: 722665 - protein, 22 aa, Mycobacterium
RLEGVAAEFIAVRLPYGVQADE

SEQ ID NO: 722666 - protein, 19 aa, Mycobacterium
RLEGYRRLAAAPDDAAVDA

SEQ ID NO: 722667 - protein, 20 aa, Mycobacterium
RLEHCAAEWVRAPGVSGDRA

SEQ ID NO: 722668 - protein, 26 aa, Mycobacterium
RLEIASPRLGFRIQLDPLELESLSWQ

SEQ ID NO: 722669 - protein, 18 aa, Mycobacterium
RLEIETMKLGFAPGMDER

SEQ ID NO: 722670 - protein, 19 aa, Mycobacterium
RLEIGHTWYTAAARGTGVN

SEQ ID NO: 722671 - protein, 19 aa, Mycobacterium
RLEIKKFCPNCGSHQPHKE

SEQ ID NO: 722672 - protein, 19 aa, Mycobacterium
RLEIPHLLVELVQPTSPDG

SEQ ID NO: 722673 - protein, 20 aa, Mycobacterium
RLEKDWGDEFYLHPGQMVLA

SEQ ID NO: 722674 - protein, 24 aa, Mycobacterium
RLELARSFAEWQSYLSAGFAAMRD

SEQ ID NO: 722675 - protein, 20 aa, Mycobacterium
RLELKKFCPNCGKHQAHRET

SEQ ID NO: 722676 - protein, 18 aa, Mycobacterium
RLELKKFCRNCGSHQAHR

SEQ ID NO: 722677 - protein, 21 aa, Mycobacterium
RLELKLIVGEWLRRIPEFSVK

SEQ ID NO: 722678 - protein, 19 aa, Mycobacterium
RLELLFAQRVRILAAMERL

SEQ ID NO: 722679 - protein, 21 aa, Mycobacterium
RLELLLAEFRRRQADVARSGV

SEQ ID NO: 722680 - protein, 18 aa, Mycobacterium
RLELRLMTERVLRRLPDL

SEQ ID NO: 722681 - protein, 18 aa, Mycobacterium
RLELSLMTARVVQRLPDL

SEQ ID NO: 722682 - protein, 23 aa, Mycobacterium
RLENGRCLLDLRTVAPEDDGKLV

SEQ ID NO: 722683 - protein, 18 aa, Mycobacterium
RLEPAEMQRVLELGRDII

SEQ ID NO: 722684 - protein, 19 aa, Mycobacterium
RLEPFGLHVPRWMDDAKRH

SEQ ID NO: 722685 - protein, 23 aa, Mycobacterium
RLEPGSYGLLVGRYRDLVLDIVN

SEQ ID NO: 722686 - protein, 21 aa, Mycobacterium
RLEPLLAKRPAAVVITPSRPV

SEQ ID NO: 722687 - protein, 18 aa, Mycobacterium
RLEQDARLTTPMMVAALG

SEQ ID NO: 722688 - protein, 18 aa, Mycobacterium
RLEQLLAALFGEVLGLSR

SEQ ID NO: 722689 - protein, 17 aa, Mycobacterium
RLERLGLVSSRVDAGAR

SEQ ID NO: 722690 - protein, 19 aa, Mycobacterium
RLERLRSSPTVFIDAAHNP

SEQ ID NO: 722691 - protein, 19 aa, Mycobacterium
RLESPVQLTARMARGDVEI

SEQ ID NO: 722692 - protein, 20 aa, Mycobacterium
RLESVPGQRDHSWGVRDWWS

SEQ ID NO: 722693 - protein, 21 aa, Mycobacterium
RLETEIANLLSAVHTVQRGEV

SEQ ID NO: 722694 - protein, 20 aa, Mycobacterium
RLETSCYNPAYGSDRQSRVF

SEQ ID NO: 722695 - protein, 20 aa, Mycobacterium
RLETSCYNPVFGANREARVF

SEQ ID NO: 722696 - protein, 17 aa, Mycobacterium
RLETTGVILGYRAVLAA

SEQ ID NO: 722697 - protein, 18 aa, Mycobacterium
RLEVALDLVDPGAQSPRE

SEQ ID NO: 722698 - protein, 18 aa, Mycobacterium
RLEVGRVAVRQGPITSAA

SEQ ID NO: 722699 - protein, 24 aa, Mycobacterium
RLEVLTYDGLRMWVGRTGEDELER

SEQ ID NO: 722700 - protein, 18 aa, Mycobacterium
RLEVRFGAHPAVRAVDLS

SEQ ID NO: 722701 - protein, 17 aa, Mycobacterium
RLEVRRRAGLPITVGIA

SEQ ID NO: 722702 - protein, 17 aa, Mycobacterium
RLEWDLRNGVIIRKARA

SEQ ID NO: 722703 - protein, 18 aa, Mycobacterium
RLEWDLRNGVIIRKARAH

SEQ ID NO: 722704 - protein, 17 aa, Mycobacterium
RLFAAGLDIGWPAALAG

SEQ ID NO: 722705 - protein, 18 aa, Mycobacterium
RLFAYSGDADGFWASLGW

SEQ ID NO: 722706 - protein, 17 aa, Mycobacterium
RLFCRGVAYTPKNGGRI

SEQ ID NO: 722707 - protein, 23 aa, Mycobacterium
RLFDRVRAGARWTDASREISTAL

SEQ ID NO: 722708 - protein, 24 aa, Mycobacterium
RLFDVPRPPVPVGALDHAPLPEEP

SEQ ID NO: 722709 - protein, 18 aa, Mycobacterium
RLFEAGYVGADWPVEFGG

SEQ ID NO: 722710 - protein, 24 aa, Mycobacterium
RLFEDACAVIPGGVNSPVRAFTAV

SEQ ID NO: 722711 - protein, 29 aa, Mycobacterium
RLFEFEERFDFGLGLLVGGMRRLLEAVPS

SEQ ID NO: 722712 - protein, 22 aa, Mycobacterium
RLFELPGSSWADYAPHAISAGG

SEQ ID NO: 722713 - protein, 19 aa, Mycobacterium
RLFESVVVGYDMYLQTEEV

SEQ ID NO: 722714 - protein, 17 aa, Mycobacterium
RLFGESRLGAGPGADGA

SEQ ID NO: 722715 - protein, 20 aa, Mycobacterium
RLFGHVPWLAGQLLGAVEAY

SEQ ID NO: 722716 - protein, 22 aa, Mycobacterium
RLFIGECREGGRLLELDLAGGP

SEQ ID NO: 722717 - protein, 27 aa, Mycobacterium
RLFIVAFRPRGRFGVAGVEPEEMESRF

SEQ ID NO: 722718 - protein, 19 aa, Mycobacterium
RLFKALAVVMGTRGYNKTS

SEQ ID NO: 722719 - protein, 19 aa, Mycobacterium
RLFMLGEPAWSEFLSVLDR

SEQ ID NO: 722720 - protein, 17 aa, Mycobacterium
RLFPLIRRYALAYHVVF

SEQ ID NO: 722721 - protein, 17 aa, Mycobacterium
RLFPLIRRYAVAFHVVF

SEQ ID NO: 722722 - protein, 24 aa, Mycobacterium
RLFPQGLAAFIGLRDQHCRTPYCD

SEQ ID NO: 722723 - protein, 25 aa, Mycobacterium
RLFPTEVPTGVGFMKRAGFVTEGRP

SEQ ID NO: 722724 - protein, 24 aa, Mycobacterium
RLFQFMPRRVLLPLLKNQHPSLRR

SEQ ID NO: 722725 - protein, 18 aa, Mycobacterium
RLFRLSRTTLDAMVAAGT

SEQ ID NO: 722726 - protein, 18 aa, Mycobacterium
RLFSGPKPAELHPFVPLT

SEQ ID NO: 722727 - protein, 19 aa, Mycobacterium
RLFSGPRPAELHPFREIDG

SEQ ID NO: 722728 - protein, 19 aa, Mycobacterium
RLFSGPRPAELHPFVELKG

SEQ ID NO: 722729 - protein, 20 aa, Mycobacterium
RLFSHVPWLSSQVLGAVEAY

SEQ ID NO: 722730 - protein, 23 aa, Mycobacterium
RLFTETKQGFGFYHANFGVPYAF

SEQ ID NO: 722731 - protein, 23 aa, Mycobacterium
RLFTETKQGFGFYHKNFGTPYAF

SEQ ID NO: 722732 - protein, 23 aa, Mycobacterium
RLFTETKQGFGFYHNNFGVPYAF

SEQ ID NO: 722733 - protein, 17 aa, Mycobacterium
RLFVLTFETEFFARHGF

SEQ ID NO: 722734 - protein, 17 aa, Mycobacterium
RLFVLTFETEFFGKHGF

SEQ ID NO: 722735 - protein, 21 aa, Mycobacterium
RLFVRMAEVYAGFVSYTDEQI

SEQ ID NO: 722736 - protein, 20 aa, Mycobacterium
RLGAAALPVAGFERLDADTL

SEQ ID NO: 722737 - protein, 21 aa, Mycobacterium
RLGAAAVLISPAWKRDEVDHA

SEQ ID NO: 722738 - protein, 19 aa, Mycobacterium
RLGAAGTGITGWVLRGVPE

SEQ ID NO: 722739 - protein, 25 aa, Mycobacterium
RLGAAKTRLAPVFSAAARESVVLAM

SEQ ID NO: 722740 - protein, 19 aa, Mycobacterium
RLGADRAFRSVLARVPFDL

SEQ ID NO: 722741 - protein, 24 aa, Mycobacterium
RLGAGCSMSKIGARHLITVDTVGH

SEQ ID NO: 722742 - protein, 19 aa, Mycobacterium
RLGAPREIAHAICALLDED

SEQ ID NO: 722743 - protein, 25 aa, Mycobacterium
RLGAQRAMIADSWQLMSNPNISFPK

SEQ ID NO: 722744 - protein, 20 aa, Mycobacterium
RLGARKCCGRFNVSELGSKR

SEQ ID NO: 722745 - protein, 20 aa, Mycobacterium
RLGARPTVVCVSRLVPRKGQ

SEQ ID NO: 722746 - protein, 32 aa, Mycobacterium
RLGAVAGIHLEGPWLSRARCGAHDPTQLRAPD

SEQ ID NO: 722747 - protein, 20 aa, Mycobacterium
RLGAVPIDVEAGVARVRGTS

SEQ ID NO: 722748 - protein, 18 aa, Mycobacterium
RLGAVVISVGYRLAPEHR

SEQ ID NO: 722749 - protein, 21 aa, Mycobacterium
RLGCRCGRTDCAAGTRRVTSP

SEQ ID NO: 722750 - protein, 17 aa, Mycobacterium
RLGDAFEVIEIDSGPGN

SEQ ID NO: 722751 - protein, 19 aa, Mycobacterium
RLGDELSIRLPAGDRYAYQ

SEQ ID NO: 722752 - protein, 23 aa, Mycobacterium
RLGDGIDIVGSWAEKVGLDIALA

SEQ ID NO: 722753 - protein, 24 aa, Mycobacterium
RLGDLLFKDFLALHFSQTRPRVDE

SEQ ID NO: 722754 - protein, 19 aa, Mycobacterium
RLGDLPVGDGLRVDDLSAD

SEQ ID NO: 722755 - protein, 24 aa, Mycobacterium
RLGDMCGLAGIAMERATQALLQAD

SEQ ID NO: 722756 - protein, 18 aa, Mycobacterium
RLGDPRLSDIDTHALVNG

SEQ ID NO: 722757 - protein, 24 aa, Mycobacterium
RLGDRLPAYMVPAAVVALDALPLT

SEQ ID NO: 722758 - protein, 26 aa, Mycobacterium
RLGDTRAADALARIDLTCTFADVTRA

SEQ ID NO: 722759 - protein, 23 aa, Mycobacterium
RLGDVGYPFSRSMPRQAEIYAKE

SEQ ID NO: 722760 - protein, 24 aa, Mycobacterium
RLGDVRLAERLARAALDRTAGLDA

SEQ ID NO: 722761 - protein, 17 aa, Mycobacterium
RLGEAVAVISDVTAELG

SEQ ID NO: 722762 - protein, 17 aa, Mycobacterium
RLGEFTHLLPWEIPALP

SEQ ID NO: 722763 - protein, 20 aa, Mycobacterium
RLGELSVIYRDAWADAARRG

SEQ ID NO: 722764 - protein, 24 aa, Mycobacterium
RLGEMCGLAGIAMERATQALLQAD

SEQ ID NO: 722765 - protein, 23 aa, Mycobacterium
RLGEMCGMAGLAMKRATQALLEA

SEQ ID NO: 722766 - protein, 19 aa, Mycobacterium
RLGERVCAVLVTKSGCPEL

SEQ ID NO: 722767 - protein, 24 aa, Mycobacterium
RLGEVAEALEAFPQRSYVLPEEPL

SEQ ID NO: 722768 - protein, 17 aa, Mycobacterium
RLGEVNGGWSVVREPLD

SEQ ID NO: 722769 - protein, 24 aa, Mycobacterium
RLGFARLAIQHGYPIVPFASVGAE

SEQ ID NO: 722770 - protein, 24 aa, Mycobacterium
RLGFARSALRERIGVTPACGLAGA

SEQ ID NO: 722771 - protein, 23 aa, Mycobacterium
RLGFDGPYWCGEDGNWKEIWPDT

SEQ ID NO: 722772 - protein, 31 aa, Mycobacterium
RLGFDGRAGVLARRLGMLDARTFAEQPDAAV

SEQ ID NO: 722773 - protein, 18 aa, Mycobacterium
RLGFNIALIPPGREEVPA

SEQ ID NO: 722774 - protein, 19 aa, Mycobacterium
RLGFPAGFADAYLAMQAAT

SEQ ID NO: 722775 - protein, 19 aa, Mycobacterium
RLGGDGAVLTVRYLTPHSK

SEQ ID NO: 722776 - protein, 19 aa, Mycobacterium
RLGGELAWELAATRLDKFV

SEQ ID NO: 722777 - protein, 19 aa, Mycobacterium
RLGGELCALLPAEPEAHAL

SEQ ID NO: 722778 - protein, 28 aa, Mycobacterium
RLGGKPVDGPGWFYPPTVVTDITKDMAL

SEQ ID NO: 722779 - protein, 30 aa, Mycobacterium
RLGGKWRVGAAFPWGIPVLLLTTTGRKTGQ

SEQ ID NO: 722780 - protein, 24 aa, Mycobacterium
RLGGLKLDNRFAVAPMTRVSATAD

SEQ ID NO: 722781 - protein, 27 aa, Mycobacterium
RLGHARLTRFLIRYSRGAWREAQATLV

SEQ ID NO: 722782 - protein, 24 aa, Mycobacterium
RLGHFYRGVGLTIYEGYGLTETSA

SEQ ID NO: 722783 - protein, 25 aa, Mycobacterium
RLGHFYRGVGLTIYEGYGLTETSAA

SEQ ID NO: 722784 - protein, 18 aa, Mycobacterium
RLGIPALLMSDAGLGVTN

SEQ ID NO: 722785 - protein, 18 aa, Mycobacterium
RLGITLDVGHCVMTEPAG

SEQ ID NO: 722786 - protein, 24 aa, Mycobacterium
RLGITTDWKSRWYADKQYAEYVKE

SEQ ID NO: 722787 - protein, 19 aa, Mycobacterium
RLGKAEFVVAGGFDDLTLE

SEQ ID NO: 722788 - protein, 23 aa, Mycobacterium
RLGKDVWAAMAITEPGFGSDSAA

SEQ ID NO: 722789 - protein, 23 aa, Mycobacterium
RLGKRVAAAYALYLTLRRDEPVR

SEQ ID NO: 722790 - protein, 22 aa, Mycobacterium
RLGKSFEGWVAVLVPTLAPDHA

SEQ ID NO: 722791 - protein, 19 aa, Mycobacterium
RLGLAGWPRAAEESIVARD

SEQ ID NO: 722792 - protein, 18 aa, Mycobacterium
RLGLDRIPLYQIHQPNPV

SEQ ID NO: 722793 - protein, 26 aa, Mycobacterium
RLGLEQTVRPSFAFYNTFDEIDVFID

SEQ ID NO: 722794 - protein, 24 aa, Mycobacterium
RLGLKGRIAKYWTLNPHPTLIPAI

SEQ ID NO: 722795 - protein, 33 aa, Mycobacterium
RLGLKRLLRSDILPLSFGFPFGFSAAIPPNLPL

SEQ ID NO: 722796 - protein, 18 aa, Mycobacterium
RLGLLPMFAVNQDKHGTA

SEQ ID NO: 722797 - protein, 18 aa, Mycobacterium
RLGLPAGDGAVPWAEAVG

SEQ ID NO: 722798 - protein, 25 aa, Mycobacterium
RLGLSIPGDVAFVCYDDFEWSDLFE

SEQ ID NO: 722799 - protein, 19 aa, Mycobacterium
RLGLVSSRVDAGARSRRMY

SEQ ID NO: 722800 - protein, 24 aa, Mycobacterium
RLGNGRWYMPWISLEDHIRALEFA

SEQ ID NO: 722801 - protein, 20 aa, Mycobacterium
RLGNRPVVACVSRLVPRKGQ

SEQ ID NO: 722802 - protein, 19 aa, Mycobacterium
RLGPATHVLLVLVHHIVTD

SEQ ID NO: 722803 - protein, 25 aa, Mycobacterium
RLGPCPEHRYSFINVRRVADGSDVR

SEQ ID NO: 722804 - protein, 24 aa, Mycobacterium
RLGPCPEHRYSFINVRRVANGSGT

SEQ ID NO: 722805 - protein, 20 aa, Mycobacterium
RLGPDSLIWKFYGDHRTQIF

SEQ ID NO: 722806 - protein, 21 aa, Mycobacterium
RLGPDSLIWKFYGDNRTQLFG

SEQ ID NO: 722807 - protein, 25 aa, Mycobacterium
RLGPKAFEQCAGFLRIRGGDDPLDA

SEQ ID NO: 722808 - protein, 17 aa, Mycobacterium
RLGPLAGGLGDLGGGLG

SEQ ID NO: 722809 - protein, 20 aa, Mycobacterium
RLGPLPPLRMDPAGDQIMRG

SEQ ID NO: 722810 - protein, 20 aa, Mycobacterium
RLGPLPPLRMQPDAPPILSH

SEQ ID NO: 722811 - protein, 20 aa, Mycobacterium
RLGPLPPLRMQPGAEPILSR

SEQ ID NO: 722812 - protein, 21 aa, Mycobacterium
RLGPTSLIWKFYGDVRTQLFG

SEQ ID NO: 722813 - protein, 18 aa, Mycobacterium
RLGPVEYRQATWRALVGQ

SEQ ID NO: 722814 - protein, 18 aa, Mycobacterium
RLGQALMADAVARDRLLG

SEQ ID NO: 722815 - protein, 19 aa, Mycobacterium
RLGQFLKLANLIDSGADAK

SEQ ID NO: 722816 - protein, 20 aa, Mycobacterium
RLGQRRLRVLGAGRQPGEHG

SEQ ID NO: 722817 - protein, 19 aa, Mycobacterium
RLGQWGVIASVQPNFDALW

SEQ ID NO: 722818 - protein, 17 aa, Mycobacterium
RLGRGWSATARAQITMS

SEQ ID NO: 722819 - protein, 34 aa, Mycobacterium
RLGRMILQAGVEGCLREVLVLAAALTIPDPRERP

SEQ ID NO: 722820 - protein, 23 aa, Mycobacterium
RLGRNAIVAAFDFDRARPVLETF

SEQ ID NO: 722821 - protein, 32 aa, Mycobacterium
RLGRPLRIAHAWSFGFDAAWQPLVALLDGHGV

SEQ ID NO: 722822 - protein, 18 aa, Mycobacterium
RLGRPWRAVVGRLRTPSA

SEQ ID NO: 722823 - protein, 24 aa, Mycobacterium
RLGRRVTEIALIFKRAPHLPFDAT

SEQ ID NO: 722824 - protein, 19 aa, Mycobacterium
RLGRSAMKAGEWLAWQNAK

SEQ ID NO: 722825 - protein, 24 aa, Mycobacterium
RLGRTPAQVALAWTLGVAPNVLLI

SEQ ID NO: 722826 - protein, 19 aa, Mycobacterium
RLGRTRLIDNIAIDIGASA

SEQ ID NO: 722827 - protein, 21 aa, Mycobacterium
RLGRTRLIDNIAIDVGASAGI

SEQ ID NO: 722828 - protein, 17 aa, Mycobacterium
RLGRYVVGIGVAGASSG

SEQ ID NO: 722829 - protein, 17 aa, Mycobacterium
RLGRYVVGIGVAGASSR

SEQ ID NO: 722830 - protein, 22 aa, Mycobacterium
RLGSELEVLLALGAAHGTDALV

SEQ ID NO: 722831 - protein, 19 aa, Mycobacterium
RLGSGLKAVAWADDGVIEA

SEQ ID NO: 722832 - protein, 19 aa, Mycobacterium
RLGSLAFPIAAGTGTGTGA

SEQ ID NO: 722833 - protein, 24 aa, Mycobacterium
RLGSRLFKDFLALHFSTRRPPSEE

SEQ ID NO: 722834 - protein, 17 aa, Mycobacterium
RLGSVLATSFTATLTER

SEQ ID NO: 722835 - protein, 19 aa, Mycobacterium
RLGTAWPQTPAGWRRGDDA

SEQ ID NO: 722836 - protein, 17 aa, Mycobacterium
RLGTGILQHVGHEENVR

SEQ ID NO: 722837 - protein, 25 aa, Mycobacterium
RLGVEEELLRLGARAGCEVTIGDMT

SEQ ID NO: 722838 - protein, 20 aa, Mycobacterium
RLGVGRGDCVAAYLPDVPDA

SEQ ID NO: 722839 - protein, 18 aa, Mycobacterium
RLGVIAWRRQHPEIATKA

SEQ ID NO: 722840 - protein, 25 aa, Mycobacterium
RLGVPDEFGLCRYLAAGLAVVHAVD

SEQ ID NO: 722841 - protein, 24 aa, Mycobacterium
RLGVPYAAIMTPVFQVNRDPNGDL

SEQ ID NO: 722842 - protein, 20 aa, Mycobacterium
RLGVTDLDFRPQVSDGLFLQ

SEQ ID NO: 722843 - protein, 19 aa, Mycobacterium
RLGVTKGSFYWHFADMEGY

SEQ ID NO: 722844 - protein, 19 aa, Mycobacterium
RLGVTSVRFTGGEPLLARH

SEQ ID NO: 722845 - protein, 23 aa, Mycobacterium
RLGVTVPAAPGFQLVISYNPGYQ

SEQ ID NO: 722846 - protein, 26 aa, Mycobacterium
RLGWAQRRVELPAGRYETIMPPSTVA

SEQ ID NO: 722847 - protein, 20 aa, Mycobacterium
RLGWVRELGRIIGRDSDPVR

SEQ ID NO: 722848 - protein, 18 aa, Mycobacterium
RLGWVRELGRIIGSDGDG

SEQ ID NO: 722849 - protein, 21 aa, Mycobacterium
RLGYHCGVVSGGFRQVIQPLA

SEQ ID NO: 722850 - protein, 20 aa, Mycobacterium
RLHAKLFYQPLLESVGHTAL

SEQ ID NO: 722851 - protein, 24 aa, Mycobacterium
RLHARGIAPFRCVDPIRWVTSGFG

SEQ ID NO: 722852 - protein, 18 aa, Mycobacterium
RLHCSVVGGVALRRLTRL

SEQ ID NO: 722853 - protein, 24 aa, Mycobacterium
RLHDELRDAGAFRLLTPRELGGWA

SEQ ID NO: 722854 - protein, 20 aa, Mycobacterium
RLHEEVDLALTLFKNDFEIA

SEQ ID NO: 722855 - protein, 26 aa, Mycobacterium
RLHEIIAGACFNTWLVWAQHAPTVGR

SEQ ID NO: 722856 - protein, 21 aa, Mycobacterium
RLHHLIKTFWPGFSDAQHPDG

SEQ ID NO: 722857 - protein, 18 aa, Mycobacterium
RLHHRGVEVIEIVGENAE

SEQ ID NO: 722858 - protein, 21 aa, Mycobacterium
RLHHRGVEVVEIIGDDAQDAR

SEQ ID NO: 722859 - protein, 21 aa, Mycobacterium
RLHKPVIRYDLPAGGRRLDQT

SEQ ID NO: 722860 - protein, 17 aa, Mycobacterium
RLHLARSTIKTHVHSLY

SEQ ID NO: 722861 - protein, 19 aa, Mycobacterium
RLHLLHLLQTVSYNSADLD

SEQ ID NO: 722862 - protein, 26 aa, Mycobacterium
RLHLSRPTLYTKLAIVQRLLGVDLDD

SEQ ID NO: 722863 - protein, 25 aa, Mycobacterium
RLHLVDFPVALGIRPNIPQDDLREI

SEQ ID NO: 722864 - protein, 17 aa, Mycobacterium
RLHMRRHQQILAPKFAV

SEQ ID NO: 722865 - protein, 26 aa, Mycobacterium
RLHNGTVYRWNRPVYDVADGRPHLRL

SEQ ID NO: 722866 - protein, 26 aa, Mycobacterium
RLHNGTVYRWNRPVYDVVDGRPHLRL

SEQ ID NO: 722867 - protein, 27 aa, Mycobacterium
RLHNGTVYRWNRPVYDVVHGRPHLRLE

SEQ ID NO: 722868 - protein, 19 aa, Mycobacterium
RLHNLVAFGEPLCDSEAVL

SEQ ID NO: 722869 - protein, 19 aa, Mycobacterium
RLHPGLAYANLAIRGRRIR

SEQ ID NO: 722870 - protein, 18 aa, Mycobacterium
RLHPNLVVLRTFSKAYGL

SEQ ID NO: 722871 - protein, 24 aa, Mycobacterium
RLHQRWQREAPALGARELVAKALD

SEQ ID NO: 722872 - protein, 25 aa, Mycobacterium
RLHRDLPSRFAVVPRRGGDIKWFEA

SEQ ID NO: 722873 - protein, 19 aa, Mycobacterium
RLHRGRRQLRASLRQVAEQ

SEQ ID NO: 722874 - protein, 21 aa, Mycobacterium
RLHRRGVEVVEIIGDDAQDAR

SEQ ID NO: 722875 - protein, 19 aa, Mycobacterium
RLHRWRFNLKTGAVREEHL

SEQ ID NO: 722876 - protein, 23 aa, Mycobacterium
RLHRWRFNLVTGETREEQLSDSL

SEQ ID NO: 722877 - protein, 25 aa, Mycobacterium
RLHSTPSRVGRAWLEITTRSRDGGG

SEQ ID NO: 722878 - protein, 27 aa, Mycobacterium
RLHTALTHLRATVPVSWVEVPDYRPFW

SEQ ID NO: 722879 - protein, 20 aa, Mycobacterium
RLHTPLPVLAFTPLPEVRSQ

SEQ ID NO: 722880 - protein, 17 aa, Mycobacterium
RLHYARTLDTWAAALEA

SEQ ID NO: 722881 - protein, 25 aa, Mycobacterium
RLHYDFRLERDGVLVSWAVPKNLPD

SEQ ID NO: 722882 - protein, 34 aa, Mycobacterium
RLIAAGSKLADLVFPTLPAPIAATGSDPVSAAIN

SEQ ID NO: 722883 - protein, 25 aa, Mycobacterium
RLIAALRPGGWLVVEDFNWSTFAFE

SEQ ID NO: 722884 - protein, 22 aa, Mycobacterium
RLIAELCELKLPIVGRDLDPQF

SEQ ID NO: 722885 - protein, 18 aa, Mycobacterium
RLIAGAMHQARLHRQLVA

SEQ ID NO: 722886 - protein, 24 aa, Mycobacterium
RLIAMKLFSDRAIDYFRSAGPHDR

SEQ ID NO: 722887 - protein, 18 aa, Mycobacterium
RLIAQINSVVRWDLCAAT

SEQ ID NO: 722888 - protein, 17 aa, Mycobacterium
RLIDAMVPRGARILDAG

SEQ ID NO: 722889 - protein, 20 aa, Mycobacterium
RLIDCANAYCTVGEMVCALK

SEQ ID NO: 722890 - protein, 20 aa, Mycobacterium
RLIDCANAYCTVGEMVSALK

SEQ ID NO: 722891 - protein, 20 aa, Mycobacterium
RLIDRASRWLLNYRPQPLAV

SEQ ID NO: 722892 - protein, 17 aa, Mycobacterium
RLIEAAGRLTLMVDRER

SEQ ID NO: 722893 - protein, 19 aa, Mycobacterium
RLIEAHSATVDWLTTVLAE

SEQ ID NO: 722894 - protein, 23 aa, Mycobacterium
RLIEAYMQAVSWVRDQAPDEAPD

SEQ ID NO: 722895 - protein, 22 aa, Mycobacterium
RLIELGESFIAETVFSHPSKLE

SEQ ID NO: 722896 - protein, 17 aa, Mycobacterium
RLIELIGGATMLRMLLR

SEQ ID NO: 722897 - protein, 19 aa, Mycobacterium
RLIGARRAAAAYLRNTPIT

SEQ ID NO: 722898 - protein, 22 aa, Mycobacterium
RLIGDKAVKMIFVEGETKNTTR

SEQ ID NO: 722899 - protein, 20 aa, Mycobacterium
RLIGMPLERSKPLWEMWVIE

SEQ ID NO: 722900 - protein, 20 aa, Mycobacterium
RLIHDYPHLAAFLRAVRIES

SEQ ID NO: 722901 - protein, 17 aa, Mycobacterium
RLIKELWAHDGNRIAVR

SEQ ID NO: 722902 - protein, 20 aa, Mycobacterium
RLILEVSWEALEHAGIDPLA

SEQ ID NO: 722903 - protein, 17 aa, Mycobacterium
RLILGMNYHHIVADFWA

SEQ ID NO: 722904 - protein, 18 aa, Mycobacterium
RLIQRPFVVTAKGTRMAR

SEQ ID NO: 722905 - protein, 24 aa, Mycobacterium
RLIRDARRPLIMVGGGTRANRPAV

SEQ ID NO: 722906 - protein, 20 aa, Mycobacterium
RLIRELAEKMLARSGEVAGD

SEQ ID NO: 722907 - protein, 17 aa, Mycobacterium
RLIRLQCYEGLDDNRVL

SEQ ID NO: 722908 - protein, 25 aa, Mycobacterium
RLIRSRSCAKWLASEDFSESIRHLR

SEQ ID NO: 722909 - protein, 22 aa, Mycobacterium
RLITELQGWLAAITGYDEVSLQ

SEQ ID NO: 722910 - protein, 20 aa, Mycobacterium
RLKAAFAADMVFLRNCGIHP

SEQ ID NO: 722911 - protein, 24 aa, Mycobacterium
RLKACANEDCRWAFYDRSRNHGGS

SEQ ID NO: 722912 - protein, 38 aa, Mycobacterium
RLKAFRCSIAYHNRHRVTDCPYPYFASPVELAASVDVL

SEQ ID NO: 722913 - protein, 21 aa, Mycobacterium
RLKAGQWAFEGKWDGYRLLVE

SEQ ID NO: 722914 - protein, 21 aa, Mycobacterium
RLKAVAAALGYDADSVEVLIG

SEQ ID NO: 722915 - protein, 24 aa, Mycobacterium
RLKCPSHVLWLDALDAVFPDARFV

SEQ ID NO: 722916 - protein, 19 aa, Mycobacterium
RLKDVAGLSLTKLFVGSEG

SEQ ID NO: 722917 - protein, 21 aa, Mycobacterium
RLKEMIKVRGFQVAPAEIEAV

SEQ ID NO: 722918 - protein, 24 aa, Mycobacterium
RLKESVCTQCAFLGACDTSPIARH

SEQ ID NO: 722919 - protein, 18 aa, Mycobacterium
RLKESVQAHGIYNQNLQA

SEQ ID NO: 722920 - protein, 22 aa, Mycobacterium
RLKGEYRGNIFAILDSDHSMDH

SEQ ID NO: 722921 - protein, 17 aa, Mycobacterium
RLKGLFMASFEAIEHRH

SEQ ID NO: 722922 - protein, 23 aa, Mycobacterium
RLKHFPSPVSAFVSAISSPSAAM

SEQ ID NO: 722923 - protein, 23 aa, Mycobacterium
RLKLIELGESFIAETVFSHPSKL

SEQ ID NO: 722924 - protein, 24 aa, Mycobacterium
RLKLLGKLPAALGVDIPQNGEPRT

SEQ ID NO: 722925 - protein, 41 aa, Mycobacterium
RLKRSGLQVTCFEAGEGVGGAWYWNRYPGARVDFESMQYSY

SEQ ID NO: 722926 - protein, 19 aa, Mycobacterium
RLKSARRIAVPGCYPTAAL

SEQ ID NO: 722927 - protein, 20 aa, Mycobacterium
RLKTIEFGEPELLHSSFVHG

SEQ ID NO: 722928 - protein, 21 aa, Mycobacterium
RLKVAAALHHGLVPLLCIGES

SEQ ID NO: 722929 - protein, 20 aa, Mycobacterium
RLLAAPGCFVEIARRDIREA

SEQ ID NO: 722930 - protein, 28 aa, Mycobacterium
RLLACYDGAAGCWRIEAGTYTVAVGASA

SEQ ID NO: 722931 - protein, 18 aa, Mycobacterium
RLLADCGRGEVIASLARE

SEQ ID NO: 722932 - protein, 18 aa, Mycobacterium
RLLADCGRGEVIGSFARE

SEQ ID NO: 722933 - protein, 18 aa, Mycobacterium
RLLADCGRGEVIGSLARE

SEQ ID NO: 722934 - protein, 19 aa, Mycobacterium
RLLADSAIMESHRGPDCTV

SEQ ID NO: 722935 - protein, 19 aa, Mycobacterium
RLLAEACEKGGATFYGTGM

SEQ ID NO: 722936 - protein, 25 aa, Mycobacterium
RLLAEGVPCLHFMTLNFARATSEVL

SEQ ID NO: 722937 - protein, 24 aa, Mycobacterium
RLLAEHRDLLAADVIVIADSDNWS

SEQ ID NO: 722938 - protein, 24 aa, Mycobacterium
RLLAEKLRMFELLFGQVTTILGEL

SEQ ID NO: 722939 - protein, 19 aa, Mycobacterium
RLLAERLGVRQTIGLGTVP

SEQ ID NO: 722940 - protein, 22 aa, Mycobacterium
RLLAGPILGAFEAWLVLRSLGS

SEQ ID NO: 722941 - protein, 17 aa, Mycobacterium
RLLAHGKPADLVRDGEY

SEQ ID NO: 722942 - protein, 18 aa, Mycobacterium
RLLALYAERPDFIEPEVR

SEQ ID NO: 722943 - protein, 17 aa, Mycobacterium
RLLASADAVVWSAGSAV

SEQ ID NO: 722944 - protein, 19 aa, Mycobacterium
RLLASVPIGRFVTTIGTRL

SEQ ID NO: 722945 - protein, 26 aa, Mycobacterium
RLLCGPQRPIVLIPRRSETLVCPEVS

SEQ ID NO: 722946 - protein, 21 aa, Mycobacterium
RLLDCCQETDGAVAIVVTSAE

SEQ ID NO: 722947 - protein, 21 aa, Mycobacterium
RLLDCCQETDGAVAIVVTSPE

SEQ ID NO: 722948 - protein, 21 aa, Mycobacterium
RLLDCCQETDGAVAIVVTSVE

SEQ ID NO: 722949 - protein, 19 aa, Mycobacterium
RLLDDIRERFAIPVQSCVL

SEQ ID NO: 722950 - protein, 24 aa, Mycobacterium
RLLDEARSAGLVEIRIVHPQARRT

SEQ ID NO: 722951 - protein, 21 aa, Mycobacterium
RLLDFMPRYEVDWDGCKRVNM

SEQ ID NO: 722952 - protein, 21 aa, Mycobacterium
RLLDFMPRYEVKWDGLQRVHM

SEQ ID NO: 722953 - protein, 17 aa, Mycobacterium
RLLDPAIYREAALRLDR

SEQ ID NO: 722954 - protein, 23 aa, Mycobacterium
RLLDPLVPRGRHYEMRTVNVDTL

SEQ ID NO: 722955 - protein, 22 aa, Mycobacterium
RLLDRAGLRMTRILPTAGPHSL

SEQ ID NO: 722956 - protein, 25 aa, Mycobacterium
RLLDTAQAWELLPRIYAENRPARPG

SEQ ID NO: 722957 - protein, 22 aa, Mycobacterium
RLLEALPQFTFDDEACRSLGQF

SEQ ID NO: 722958 - protein, 23 aa, Mycobacterium
RLLEARFGREAMLDQIVNDALPS

SEQ ID NO: 722959 - protein, 21 aa, Mycobacterium
RLLEHVEIKGATTIAMIQRAR

SEQ ID NO: 722960 - protein, 24 aa, Mycobacterium
RLLELALDIGCVFSIDTDAHAPGQ

SEQ ID NO: 722961 - protein, 19 aa, Mycobacterium
RLLERTARDGHRIGNHSFR

SEQ ID NO: 722962 - protein, 19 aa, Mycobacterium
RLLFEGCTMHAGQACILNS

SEQ ID NO: 722963 - protein, 20 aa, Mycobacterium
RLLFPGGRKPTIWDNTGGSS

SEQ ID NO: 722964 - protein, 22 aa, Mycobacterium
RLLFPTLCKPTATLWTGNPPQN

SEQ ID NO: 722965 - protein, 17 aa, Mycobacterium
RLLGAALQIIGERADIQ

SEQ ID NO: 722966 - protein, 19 aa, Mycobacterium
RLLGADAWASDARTAADLL

SEQ ID NO: 722967 - protein, 19 aa, Mycobacterium
RLLGAGAPWFESWLEHPDR

SEQ ID NO: 722968 - protein, 17 aa, Mycobacterium
RLLGEAVTQAQYVLADH

SEQ ID NO: 722969 - protein, 19 aa, Mycobacterium
RLLGGELRQGALAGIMADA

SEQ ID NO: 722970 - protein, 19 aa, Mycobacterium
RLLGIPAQHVRVIMRDTGG

SEQ ID NO: 722971 - protein, 25 aa, Mycobacterium
RLLGKPAYHALTFGWLMSGLARAVT

SEQ ID NO: 722972 - protein, 25 aa, Mycobacterium
RLLGKSAYHALTFGWLMSGLARAVT

SEQ ID NO: 722973 - protein, 32 aa, Mycobacterium
RLLGLGLETRGVFWLPPYHDFGLISVILSTLT

SEQ ID NO: 722974 - protein, 24 aa, Mycobacterium
RLLGLKAACAFADEPDCVRELAAM

SEQ ID NO: 722975 - protein, 21 aa, Mycobacterium
RLLGRSGLRVSPLALGSATFG

SEQ ID NO: 722976 - protein, 23 aa, Mycobacterium
RLLGRTEIRRLAKELEFRPRKSL

SEQ ID NO: 722977 - protein, 19 aa, Mycobacterium
RLLGSAALARTARGEDDVA

SEQ ID NO: 722978 - protein, 19 aa, Mycobacterium
RLLGSAALGRAARGDVDVA

SEQ ID NO: 722979 - protein, 19 aa, Mycobacterium
RLLGSAALSRAARGEEDVP

SEQ ID NO: 722980 - protein, 27 aa, Mycobacterium
RLLGVDEVWAIGGAQAVALLAYGGTDT

SEQ ID NO: 722981 - protein, 26 aa, Mycobacterium
RLLHELWARRHMAVLHVTHDVDEAIL

SEQ ID NO: 722982 - protein, 20 aa, Mycobacterium
RLLHPPPRPWPHGASRQHQR

SEQ ID NO: 722983 - protein, 21 aa, Mycobacterium
RLLHSAPMFHMADFSAVLAGN

SEQ ID NO: 722984 - protein, 24 aa, Mycobacterium
RLLIKPSHLAGGYAQHSYAFNYLG

SEQ ID NO: 722985 - protein, 18 aa, Mycobacterium
RLLIKPSHLAGGYAQNAF

SEQ ID NO: 722986 - protein, 23 aa, Mycobacterium
RLLKLPIPVQRRVAAGVLSAGHA

SEQ ID NO: 722987 - protein, 18 aa, Mycobacterium
RLLKTYARISGRWHTGLP

SEQ ID NO: 722988 - protein, 17 aa, Mycobacterium
RLLKYVAQVDVARYRSL

SEQ ID NO: 722989 - protein, 19 aa, Mycobacterium
RLLLDGARTKLTRAALETL

SEQ ID NO: 722990 - protein, 19 aa, Mycobacterium
RLLLERLGELGGDVVRPKV

SEQ ID NO: 722991 - protein, 18 aa, Mycobacterium
RLLLGGLVEPGQYDTDLN

SEQ ID NO: 722992 - protein, 17 aa, Mycobacterium
RLLLGRRTITLDGNTLD

SEQ ID NO: 722993 - protein, 19 aa, Mycobacterium
RLLLPLPMFHVAALTTVIM

SEQ ID NO: 722994 - protein, 25 aa, Mycobacterium
RLLLRNASLIGVAWGEFLRTHADYL

SEQ ID NO: 722995 - protein, 17 aa, Mycobacterium
RLLMVARERYHLFRHHQ

SEQ ID NO: 722996 - protein, 17 aa, Mycobacterium
RLLNDAGPHTEVSLAGR

SEQ ID NO: 722997 - protein, 18 aa, Mycobacterium
RLLNGVMKRSTPQPSRAA

SEQ ID NO: 722998 - protein, 19 aa, Mycobacterium
RLLNGYVFSHLTLPGDDDP

SEQ ID NO: 722999 - protein, 25 aa, Mycobacterium
RLLNLALEIGCLFSIDTDAHAPGQL

SEQ ID NO: 723000 - protein, 25 aa, Mycobacterium
RLLNLALEIGCVFSIDTDAHAPGQL

SEQ ID NO: 723001 - protein, 25 aa, Mycobacterium
RLLNLALEIGCVFSIDTDSHAPGQL

SEQ ID NO: 723002 - protein, 25 aa, Mycobacterium
RLLNLAMEIGCVFSIDTDSHAPGQL

SEQ ID NO: 723003 - protein, 25 aa, Mycobacterium
RLLNPRTAGPVPWKPMVSLSGPRSL

SEQ ID NO: 723004 - protein, 19 aa, Mycobacterium
RLLNVGPWETLALAKPDLL

SEQ ID NO: 723005 - protein, 17 aa, Mycobacterium
RLLPAARAASVHVVHCL

SEQ ID NO: 723006 - protein, 17 aa, Mycobacterium
RLLPARFADALARAEPV

SEQ ID NO: 723007 - protein, 20 aa, Mycobacterium
RLLPCQPTPCTVVATFSSVH

SEQ ID NO: 723008 - protein, 23 aa, Mycobacterium
RLLPDALDGRGFVYAVVPHDEWS

SEQ ID NO: 723009 - protein, 21 aa, Mycobacterium
RLLPIARDWWAKLGRDAPWPD

SEQ ID NO: 723010 - protein, 17 aa, Mycobacterium
RLLPKIVAGQLFSSIGM

SEQ ID NO: 723011 - protein, 18 aa, Mycobacterium
RLLPLFSGPATRPMDGVT

SEQ ID NO: 723012 - protein, 24 aa, Mycobacterium
RLLPPRTMRGLIGRICEQEGVVVD

SEQ ID NO: 723013 - protein, 26 aa, Mycobacterium
RLLPVKCFYLPTAVRGFEREGIDPRN

SEQ ID NO: 723014 - protein, 25 aa, Mycobacterium
RLLQPKIEAEIAFRLGEDLDNGDLG

SEQ ID NO: 723015 - protein, 27 aa, Mycobacterium
RLLQPLALAPRGIWLGPKELRTFYRIR

SEQ ID NO: 723016 - protein, 18 aa, Mycobacterium
RLLQRKPADWSYAEAAGI

SEQ ID NO: 723017 - protein, 24 aa, Mycobacterium
RLLQRLGADVAEYGFVETAPKQDG

SEQ ID NO: 723018 - protein, 20 aa, Mycobacterium
RLLRALIDWFEQRGKARLLR

SEQ ID NO: 723019 - protein, 23 aa, Mycobacterium
RLLRALIGRGIFRRCRDGRYALT

SEQ ID NO: 723020 - protein, 23 aa, Mycobacterium
RLLRAVKDLQEWELHGVAELLDR

SEQ ID NO: 723021 - protein, 29 aa, Mycobacterium
RLLRFPGAYSPLVARLVAEIGFDGVYVSG

SEQ ID NO: 723022 - protein, 17 aa, Mycobacterium
RLLRGEIPPGGNCDIKT

SEQ ID NO: 723023 - protein, 25 aa, Mycobacterium
RLLRGFLSAALWDAGLYCRADDRGD

SEQ ID NO: 723024 - protein, 28 aa, Mycobacterium
RLLRLKVFPLAISLPWGIAPAALPQLPL

SEQ ID NO: 723025 - protein, 27 aa, Mycobacterium
RLLRLRWPCPVPGALPVSEVGDAVIGR

SEQ ID NO: 723026 - protein, 20 aa, Mycobacterium
RLLRSDVALAVMSGVLLMRQ

SEQ ID NO: 723027 - protein, 26 aa, Mycobacterium
RLLRSEGRDVAWWACAVEGGDAHAGH

SEQ ID NO: 723028 - protein, 19 aa, Mycobacterium
RLLSALVERGVSIAATSNT

SEQ ID NO: 723029 - protein, 17 aa, Mycobacterium
RLLSAWMDLGMAIYDTN

SEQ ID NO: 723030 - protein, 19 aa, Mycobacterium
RLLSGELRQGALTGIMTDA

SEQ ID NO: 723031 - protein, 19 aa, Mycobacterium
RLLSGYAVDTVFGLLGDAN

SEQ ID NO: 723032 - protein, 20 aa, Mycobacterium
RLLSHLPQRAVVGLATNVPG

SEQ ID NO: 723033 - protein, 23 aa, Mycobacterium
RLLSIPLRHVYAALWRAGVIEVV

SEQ ID NO: 723034 - protein, 18 aa, Mycobacterium
RLLSIPLRHVYAALWRVG

SEQ ID NO: 723035 - protein, 23 aa, Mycobacterium
RLLSLAEHRVFIEAARDFCNQAY

SEQ ID NO: 723036 - protein, 18 aa, Mycobacterium
RLLSLPMHYRDARTARGV

SEQ ID NO: 723037 - protein, 17 aa, Mycobacterium
RLLSRLLAIVADRRTPI

SEQ ID NO: 723038 - protein, 23 aa, Mycobacterium
RLLSVPVRHVYAALWRVGLLEVQ

SEQ ID NO: 723039 - protein, 17 aa, Mycobacterium
RLLTALARRDGRGAPAD

SEQ ID NO: 723040 - protein, 17 aa, Mycobacterium
RLLTAMCAAVLTITLDG

SEQ ID NO: 723041 - protein, 23 aa, Mycobacterium
RLLTCGPGLVALAVPKVGDLVAW

SEQ ID NO: 723042 - protein, 25 aa, Mycobacterium
RLLTEPALMKLWWAEGQVAAVVGHT

SEQ ID NO: 723043 - protein, 21 aa, Mycobacterium
RLLTGELRQGALVGVMADAVA

SEQ ID NO: 723044 - protein, 17 aa, Mycobacterium
RLLTLAWQQRNLPEATQ

SEQ ID NO: 723045 - protein, 20 aa, Mycobacterium
RLLVATARPRELAMVFVAGH

SEQ ID NO: 723046 - protein, 22 aa, Mycobacterium
RLLVDTMIRLARLLWDRKDAAA

SEQ ID NO: 723047 - protein, 18 aa, Mycobacterium
RLLWPVKQKYGSKISWAD

SEQ ID NO: 723048 - protein, 20 aa, Mycobacterium
RLLWSRASVIVRDFGVTVPQ

SEQ ID NO: 723049 - protein, 19 aa, Mycobacterium
RLLYMKPWETPAITNPGLR

SEQ ID NO: 723050 - protein, 19 aa, Mycobacterium
RLMAERGRLFGSLPDGGRM

SEQ ID NO: 723051 - protein, 18 aa, Mycobacterium
RLMARLAGEAGLRRAEVA

SEQ ID NO: 723052 - protein, 17 aa, Mycobacterium
RLMEVYAGFLAHTDAQI

SEQ ID NO: 723053 - protein, 20 aa, Mycobacterium
RLMEWCAMVACPIIGIQDSG

SEQ ID NO: 723054 - protein, 20 aa, Mycobacterium
RLMFLKFRYRLGYESLCREV

SEQ ID NO: 723055 - protein, 22 aa, Mycobacterium
RLMIDGVPVGRLLPPPPTPVIM

SEQ ID NO: 723056 - protein, 20 aa, Mycobacterium
RLMPNLVTVLGWEHCDHTGP

SEQ ID NO: 723057 - protein, 19 aa, Mycobacterium
RLMPPVFAELSIELFEPQW

SEQ ID NO: 723058 - protein, 18 aa, Mycobacterium
RLMQRGADILHFENQNHD

SEQ ID NO: 723059 - protein, 19 aa, Mycobacterium
RLMQSCTPGAMMAISASEP

SEQ ID NO: 723060 - protein, 23 aa, Mycobacterium
RLMRALIGIGVFRRGSDGRYALT

SEQ ID NO: 723061 - protein, 19 aa, Mycobacterium
RLMRALVSRVVFAQRRDGR

SEQ ID NO: 723062 - protein, 18 aa, Mycobacterium
RLMRARALVLGCGTFPAM

SEQ ID NO: 723063 - protein, 22 aa, Mycobacterium
RLMRDYPYLAGFLRAVRAENAD

SEQ ID NO: 723064 - protein, 26 aa, Mycobacterium
RLMREYPDLAAFEWVIRAEGAAGPDA

SEQ ID NO: 723065 - protein, 19 aa, Mycobacterium
RLMSLPSRVTRQIRRLEVQ

SEQ ID NO: 723066 - protein, 24 aa, Mycobacterium
RLMTIPGVDAIAGISIVAAVGDFS

SEQ ID NO: 723067 - protein, 19 aa, Mycobacterium
RLMTWRGGYHGDTFAPMSV

SEQ ID NO: 723068 - protein, 18 aa, Mycobacterium
RLMVYRGDLGRRWAGPAF

SEQ ID NO: 723069 - protein, 19 aa, Mycobacterium
RLMVYRGDLGRRWAGPAFL

SEQ ID NO: 723070 - protein, 24 aa, Mycobacterium
RLNADAAFDVLKWRSQENNVKLRA

SEQ ID NO: 723071 - protein, 17 aa, Mycobacterium
RLNEHRLALTAELVPRV

SEQ ID NO: 723072 - protein, 31 aa, Mycobacterium
RLNELMIASAPFYCVTVIRVAKLGEAPLPNI

SEQ ID NO: 723073 - protein, 17 aa, Mycobacterium
RLNGGPVLAELDARFGT

SEQ ID NO: 723074 - protein, 19 aa, Mycobacterium
RLNGMPRYLIAGLTHPKVL

SEQ ID NO: 723075 - protein, 20 aa, Mycobacterium
RLNGRRFLIDVVMQTPRRFS

SEQ ID NO: 723076 - protein, 19 aa, Mycobacterium
RLNGRRYLIDVVMQTPQRF

SEQ ID NO: 723077 - protein, 29 aa, Mycobacterium
RLNGVSVEFLRHFARGHADDMVIARNLAE

SEQ ID NO: 723078 - protein, 18 aa, Mycobacterium
RLNLSPSLLHAFNPAGTG

SEQ ID NO: 723079 - protein, 27 aa, Mycobacterium
RLNNGQIRARLDAILADGVSRGDAAER

SEQ ID NO: 723080 - protein, 25 aa, Mycobacterium
RLNRGELRGVRFGRTWRMRTRDIDY

SEQ ID NO: 723081 - protein, 21 aa, Mycobacterium
RLNRLGGIVGTAFQIADDIID

SEQ ID NO: 723082 - protein, 17 aa, Mycobacterium
RLNRSYGARGWAPQGYY

SEQ ID NO: 723083 - protein, 21 aa, Mycobacterium
RLNRVCRVFVAHDLDADNRRL

SEQ ID NO: 723084 - protein, 24 aa, Mycobacterium
RLNSPGWRSAMAARHRIDDLVNTV

SEQ ID NO: 723085 - protein, 28 aa, Mycobacterium
RLNTARFQLDIMKVPGIIVARTDAEAAN

SEQ ID NO: 723086 - protein, 26 aa, Mycobacterium
RLNVAISRAQFTAVIVRAGSLTEYLP

SEQ ID NO: 723087 - protein, 25 aa, Mycobacterium
RLNVEMLARGTAWLDTGTFDSLLDA

SEQ ID NO: 723088 - protein, 19 aa, Mycobacterium
RLPAALGELDGAWSVGDAP

SEQ ID NO: 723089 - protein, 25 aa, Mycobacterium
RLPAAPSYRSFVSWLDRQDRSAAQA

SEQ ID NO: 723090 - protein, 24 aa, Mycobacterium
RLPAAPSYRSFVTWLTNQDRAAAQ

SEQ ID NO: 723091 - protein, 18 aa, Mycobacterium
RLPAGRRYGVVAGTGRLL

SEQ ID NO: 723092 - protein, 19 aa, Mycobacterium
RLPAMPVAHGLGLGFDPPV

SEQ ID NO: 723093 - protein, 22 aa, Mycobacterium
RLPAPSSYRSFVSWLADQDLDA

SEQ ID NO: 723094 - protein, 17 aa, Mycobacterium
RLPAWAAGAHLPITLPS

SEQ ID NO: 723095 - protein, 17 aa, Mycobacterium
RLPDFINQQSFFPTRQE

SEQ ID NO: 723096 - protein, 26 aa, Mycobacterium
RLPDIEVCGPPSYTVSTFFHGVNHLP

SEQ ID NO: 723097 - protein, 17 aa, Mycobacterium
RLPDLIGLRQAVYRRED

SEQ ID NO: 723098 - protein, 18 aa, Mycobacterium
RLPDLRLADQDSRLPLRP

SEQ ID NO: 723099 - protein, 24 aa, Mycobacterium
RLPDSPFRLWAFGDAHVGTDKRYG

SEQ ID NO: 723100 - protein, 22 aa, Mycobacterium
RLPEFDKPALIAWSADDKFFAL

SEQ ID NO: 723101 - protein, 24 aa, Mycobacterium
RLPEFSKPALIAWSADDKFFALED

SEQ ID NO: 723102 - protein, 23 aa, Mycobacterium
RLPEGPSGWRLIPGGAGTLDDVQ

SEQ ID NO: 723103 - protein, 24 aa, Mycobacterium
RLPEIPQLRWRVTGAPLGLDRPWF

SEQ ID NO: 723104 - protein, 27 aa, Mycobacterium
RLPELPQLRWRVVGAPLGLDRPYFVED

SEQ ID NO: 723105 - protein, 21 aa, Mycobacterium
RLPEPPSVWRLAAGDAGTLED

SEQ ID NO: 723106 - protein, 19 aa, Mycobacterium
RLPERFGIDPSEHAEAAEL

SEQ ID NO: 723107 - protein, 25 aa, Mycobacterium
RLPERRGTGPLGWLYSASEDSASLL

SEQ ID NO: 723108 - protein, 27 aa, Mycobacterium
RLPESLGGAGFTVPQLFSAVIDVAQAD

SEQ ID NO: 723109 - protein, 27 aa, Mycobacterium
RLPEVKARFGDRFRLEDSINTYYFWMN

SEQ ID NO: 723110 - protein, 20 aa, Mycobacterium
RLPEVLAAGARRIVVVRAIT

SEQ ID NO: 723111 - protein, 18 aa, Mycobacterium
RLPFCDVTVGLVIGRDDA

SEQ ID NO: 723112 - protein, 22 aa, Mycobacterium
RLPFGDRLPVGLTVTMDGRQGA

SEQ ID NO: 723113 - protein, 18 aa, Mycobacterium
RLPFGLTVTMDGRQGAEL

SEQ ID NO: 723114 - protein, 20 aa, Mycobacterium
RLPGFPHWNAGMLSTVHKRP

SEQ ID NO: 723115 - protein, 17 aa, Mycobacterium
RLPGLPGPQGRIRLAQF

SEQ ID NO: 723116 - protein, 17 aa, Mycobacterium
RLPGVAIQTEVLALAAI

SEQ ID NO: 723117 - protein, 17 aa, Mycobacterium
RLPGYLLSFRRGSRSNI

SEQ ID NO: 723118 - protein, 22 aa, Mycobacterium
RLPHLQRLAVYTGDALAELEAA

SEQ ID NO: 723119 - protein, 25 aa, Mycobacterium
RLPHWDTDHVWHLFTVEVTKHDRDK

SEQ ID NO: 723120 - protein, 18 aa, Mycobacterium
RLPIDDFHRLPGDEPQRD

SEQ ID NO: 723121 - protein, 20 aa, Mycobacterium
RLPIEDSWTPITLREGGTPL

SEQ ID NO: 723122 - protein, 20 aa, Mycobacterium
RLPIGDDWTTVTLLEGGTPL

SEQ ID NO: 723123 - protein, 21 aa, Mycobacterium
RLPIGENWQPVTLREGGTPLL

SEQ ID NO: 723124 - protein, 25 aa, Mycobacterium
RLPKGLARFPISRVVSSPQRRAIQT

SEQ ID NO: 723125 - protein, 19 aa, Mycobacterium
RLPLDAVLRRMPVGVVVNG

SEQ ID NO: 723126 - protein, 23 aa, Mycobacterium
RLPLDPRIGRMILQADAEGCVEE

SEQ ID NO: 723127 - protein, 17 aa, Mycobacterium
RLPLDRAALDAALADKA

SEQ ID NO: 723128 - protein, 22 aa, Mycobacterium
RLPLGCLVGAPVLFGRGSAVFA

SEQ ID NO: 723129 - protein, 25 aa, Mycobacterium
RLPLPDRKFGGVMGRTMGESVGDWT

SEQ ID NO: 723130 - protein, 22 aa, Mycobacterium
RLPLTKRLGGIAPEREVPAFAE

SEQ ID NO: 723131 - protein, 17 aa, Mycobacterium
RLPLWAPPFRGYRPARR

SEQ ID NO: 723132 - protein, 18 aa, Mycobacterium
RLPNLKLITIVGRSLPNL

SEQ ID NO: 723133 - protein, 17 aa, Mycobacterium
RLPPDVTRLSASIRLSI

SEQ ID NO: 723134 - protein, 29 aa, Mycobacterium
RLPPQVFGALFSHEWFVDPALPTGTLRRD

SEQ ID NO: 723135 - protein, 18 aa, Mycobacterium
RLPPRPPVIDPYLPQNGN

SEQ ID NO: 723136 - protein, 24 aa, Mycobacterium
RLPPSTPAHLLWQHVLGRPIDDLP

SEQ ID NO: 723137 - protein, 23 aa, Mycobacterium
RLPQKVGVGLARRMSLTGDYLSA

SEQ ID NO: 723138 - protein, 18 aa, Mycobacterium
RLPRATKPSPWRITERRA

SEQ ID NO: 723139 - protein, 17 aa, Mycobacterium
RLPRGGRLPSERELIDS

SEQ ID NO: 723140 - protein, 26 aa, Mycobacterium
RLPRIAGPCSLVIFGVTGDLARKKLM

SEQ ID NO: 723141 - protein, 25 aa, Mycobacterium
RLPRIEATGGLAGRCTQPDTVHLVS

SEQ ID NO: 723142 - protein, 24 aa, Mycobacterium
RLPRIPARFPMYLPGPDKVMIVDE

SEQ ID NO: 723143 - protein, 19 aa, Mycobacterium
RLPSDIRALLLRAEGKVFC

SEQ ID NO: 723144 - protein, 19 aa, Mycobacterium
RLPSIALHAARSSLQAGAP

SEQ ID NO: 723145 - protein, 23 aa, Mycobacterium
RLPSSMASPAFPAADVLAARQKL

SEQ ID NO: 723146 - protein, 18 aa, Mycobacterium
RLPTEIEWEKACAWDPVT

SEQ ID NO: 723147 - protein, 20 aa, Mycobacterium
RLPTVRDLAGQLGVAANTVA

SEQ ID NO: 723148 - protein, 20 aa, Mycobacterium
RLPTVRDLAGQLGVAVNTVA

SEQ ID NO: 723149 - protein, 18 aa, Mycobacterium
RLPWGDRIRKGIDRLIEF

SEQ ID NO: 723150 - protein, 26 aa, Mycobacterium
RLQAELAELLPGCDALDVVESAYGHD

SEQ ID NO: 723151 - protein, 19 aa, Mycobacterium
RLQDCPAFLNFPSENGHTV

SEQ ID NO: 723152 - protein, 23 aa, Mycobacterium
RLQDRLRHAVLWAPAVTDAALRR

SEQ ID NO: 723153 - protein, 27 aa, Mycobacterium
RLQDRPRWQLTASVEFDDWAGAVTATR

SEQ ID NO: 723154 - protein, 21 aa, Mycobacterium
RLQECQNCDSLIHPPAPVCRY

SEQ ID NO: 723155 - protein, 18 aa, Mycobacterium
RLQEIGVIRGFYTDIDPA

SEQ ID NO: 723156 - protein, 19 aa, Mycobacterium
RLQELGVIRGFYADIDPAA

SEQ ID NO: 723157 - protein, 18 aa, Mycobacterium
RLQEMDARHGGSIIDAQI

SEQ ID NO: 723158 - protein, 17 aa, Mycobacterium
RLQERWRQIEAKATEIT

SEQ ID NO: 723159 - protein, 17 aa, Mycobacterium
RLQFAHADLLVRSFGTL

SEQ ID NO: 723160 - protein, 18 aa, Mycobacterium
RLQHEYEALFCVVDLHAI

SEQ ID NO: 723161 - protein, 19 aa, Mycobacterium
RLQKRIPYQKALELALTGD

SEQ ID NO: 723162 - protein, 19 aa, Mycobacterium
RLQLAWPRYDAMRTELAVG

SEQ ID NO: 723163 - protein, 19 aa, Mycobacterium
RLQLRGCSSGFAFTFADAE

SEQ ID NO: 723164 - protein, 19 aa, Mycobacterium
RLQMILGHLGEMLPFAAHR

SEQ ID NO: 723165 - protein, 18 aa, Mycobacterium
RLQPGKMLLVDTAAGRIV

SEQ ID NO: 723166 - protein, 29 aa, Mycobacterium
RLQQELAELLPGCAGLRVVDSACGHDGFL

SEQ ID NO: 723167 - protein, 20 aa, Mycobacterium
RLQQLWPRYDAMRIELAVGQ

SEQ ID NO: 723168 - protein, 18 aa, Mycobacterium
RLQRCLVDSPEFPELLES

SEQ ID NO: 723169 - protein, 23 aa, Mycobacterium
RLQRCRKELRAAKRRNEAVPASL

SEQ ID NO: 723170 - protein, 18 aa, Mycobacterium
RLQRERQKVLGLLDDIQR

SEQ ID NO: 723171 - protein, 23 aa, Mycobacterium
RLQRFPGAFSPLVAKLVAELGFD

SEQ ID NO: 723172 - protein, 19 aa, Mycobacterium
RLQRGHVLNIKWENLDAVL

SEQ ID NO: 723173 - protein, 25 aa, Mycobacterium
RLQRSRRPYPHWHLSASDRLRVVSP

SEQ ID NO: 723174 - protein, 17 aa, Mycobacterium
RLQRTFDPPGFAGDPAL

SEQ ID NO: 723175 - protein, 33 aa, Mycobacterium
RLQRTRIAVELARTHLRYGEWLRRVNRRPDARR

SEQ ID NO: 723176 - protein, 19 aa, Mycobacterium
RLQSAVQFFPSRSATADIE

SEQ ID NO: 723177 - protein, 19 aa, Mycobacterium
RLQSAVQFFPSRSATDEIE

SEQ ID NO: 723178 - protein, 18 aa, Mycobacterium
RLQSELRKTIVFVTHDID

SEQ ID NO: 723179 - protein, 19 aa, Mycobacterium
RLQTEFVRLQEWVRHAGAR

SEQ ID NO: 723180 - protein, 19 aa, Mycobacterium
RLQVINWGVFDGYHDIPFS

SEQ ID NO: 723181 - protein, 18 aa, Mycobacterium
RLQVINWGVFDGYHSIPF

SEQ ID NO: 723182 - protein, 27 aa, Mycobacterium
RLQVLQDLYRRWPFFATVLSNMAQVLA

SEQ ID NO: 723183 - protein, 19 aa, Mycobacterium
RLQVRAGITSVVRAVSADR

SEQ ID NO: 723184 - protein, 20 aa, Mycobacterium
RLQYFVSCLVYLPRDRYTTQ

SEQ ID NO: 723185 - protein, 18 aa, Mycobacterium
RLRAAAAKLVDAEITDFD

SEQ ID NO: 723186 - protein, 23 aa, Mycobacterium
RLRAAAVSALARRYGITGLAESA

SEQ ID NO: 723187 - protein, 20 aa, Mycobacterium
RLRAALPRGGADVEAVLPKV

SEQ ID NO: 723188 - protein, 21 aa, Mycobacterium
RLRAAVEAFFDFIEHDSQGYR

SEQ ID NO: 723189 - protein, 19 aa, Mycobacterium
RLRAEAFIVGQNCAYQDLD

SEQ ID NO: 723190 - protein, 21 aa, Mycobacterium
RLRAEGVLARDGRVPLTQYRH

SEQ ID NO: 723191 - protein, 22 aa, Mycobacterium
RLRAELRALAPTGDRRMSANPH

SEQ ID NO: 723192 - protein, 18 aa, Mycobacterium
RLRAELREAVFGASDFDV

SEQ ID NO: 723193 - protein, 18 aa, Mycobacterium
RLRAENRLNHLLAQQIPP

SEQ ID NO: 723194 - protein, 19 aa, Mycobacterium
RLRAGQARVLLMAALATGS

SEQ ID NO: 723195 - protein, 23 aa, Mycobacterium
RLRAHCPGVEFLHLSGSAELIAG

SEQ ID NO: 723196 - protein, 20 aa, Mycobacterium
RLRAIAAEWTRGAVKTVPPR

SEQ ID NO: 723197 - protein, 20 aa, Mycobacterium
RLRAKLGPEYEALIGTVRNV

SEQ ID NO: 723198 - protein, 20 aa, Mycobacterium
RLRAKLGPEYESLIGTVRNV

SEQ ID NO: 723199 - protein, 19 aa, Mycobacterium
RLRAKLGTRHEFMIGTVRG

SEQ ID NO: 723200 - protein, 22 aa, Mycobacterium
RLRALDFPKIVIGISGGLDSTH

SEQ ID NO: 723201 - protein, 24 aa, Mycobacterium
RLRALLDTRELIVAPGVFDGISAH

SEQ ID NO: 723202 - protein, 18 aa, Mycobacterium
RLRALLRRTGVTTVDSGA

SEQ ID NO: 723203 - protein, 17 aa, Mycobacterium
RLRAPRPALPWTGVRTC

SEQ ID NO: 723204 - protein, 26 aa, Mycobacterium
RLRARGDGRVVIWAATQFDVLACRAV

SEQ ID NO: 723205 - protein, 17 aa, Mycobacterium
RLRARRALVRVQGLLGP

SEQ ID NO: 723206 - protein, 19 aa, Mycobacterium
RLRARYVIAADGGSSPTRG

SEQ ID NO: 723207 - protein, 23 aa, Mycobacterium
RLRASSASAWTVFNSARWHVSVW

SEQ ID NO: 723208 - protein, 21 aa, Mycobacterium
RLRAVGVAQAVLWVLDGNAAA

SEQ ID NO: 723209 - protein, 19 aa, Mycobacterium
RLRAVLVPHALRLREAALL

SEQ ID NO: 723210 - protein, 18 aa, Mycobacterium
RLRAVVCAPDGAVDDDAR

SEQ ID NO: 723211 - protein, 20 aa, Mycobacterium
RLRAVVLHRPGDELKRLTPR

SEQ ID NO: 723212 - protein, 20 aa, Mycobacterium
RLRCAHPFLLGTRRPPFEQL

SEQ ID NO: 723213 - protein, 17 aa, Mycobacterium
RLRCGDIVSLPHAPYLH

SEQ ID NO: 723214 - protein, 19 aa, Mycobacterium
RLRCGTGDYIDFSWFDAVV

SEQ ID NO: 723215 - protein, 20 aa, Mycobacterium
RLRCRLRGSKTPVVIRDALP

SEQ ID NO: 723216 - protein, 27 aa, Mycobacterium
RLRCSVAMGASYLRYAMAMRDRLPLVG

SEQ ID NO: 723217 - protein, 19 aa, Mycobacterium
RLRDALRDGDRILAVLRGT

SEQ ID NO: 723218 - protein, 19 aa, Mycobacterium
RLRDGAVRLVIVGGGPGSG

SEQ ID NO: 723219 - protein, 19 aa, Mycobacterium
RLRDGFADYFSRYDALLAP

SEQ ID NO: 723220 - protein, 19 aa, Mycobacterium
RLRDGRLLDAVALVDDALL

SEQ ID NO: 723221 - protein, 24 aa, Mycobacterium
RLRDHEGWPLYPMRPDHTYVNVGF

SEQ ID NO: 723222 - protein, 19 aa, Mycobacterium
RLRDHPALLAAAEAHEVLA

SEQ ID NO: 723223 - protein, 26 aa, Mycobacterium
RLRDLPRRPVHPELRVEDRAIDGPGG

SEQ ID NO: 723224 - protein, 20 aa, Mycobacterium
RLRDNRWWRPGRTPTGAPSV

SEQ ID NO: 723225 - protein, 23 aa, Mycobacterium
RLRDRFLLALLYDAGMRIGEALG

SEQ ID NO: 723226 - protein, 22 aa, Mycobacterium
RLRDSIKITVSKAVTPWLRLGL

SEQ ID NO: 723227 - protein, 21 aa, Mycobacterium
RLRDVNAFLEMLSRVERELGT

SEQ ID NO: 723228 - protein, 20 aa, Mycobacterium
RLRDVPGVTVLIYDQHCAAD

SEQ ID NO: 723229 - protein, 17 aa, Mycobacterium
RLRDVRNGMSIPPALTL

SEQ ID NO: 723230 - protein, 17 aa, Mycobacterium
RLRDWLTGIGVAPKREH

SEQ ID NO: 723231 - protein, 26 aa, Mycobacterium
RLRDYVLAVKACFAAFRTGTLDHHGE

SEQ ID NO: 723232 - protein, 25 aa, Mycobacterium
RLRDYVLAVKACFGAFRTGTLDHHG

SEQ ID NO: 723233 - protein, 19 aa, Mycobacterium
RLREAAVAALARRFGVTGL

SEQ ID NO: 723234 - protein, 17 aa, Mycobacterium
RLREAGHEVIGYDPRPE

SEQ ID NO: 723235 - protein, 29 aa, Mycobacterium
RLREAPILALGIWRWGLGEIPYRQLEHRL

SEQ ID NO: 723236 - protein, 22 aa, Mycobacterium
RLREARARHRVMLGNPFTEVRA

SEQ ID NO: 723237 - protein, 21 aa, Mycobacterium
RLREAVRVFGFHLSGLDMRQN

SEQ ID NO: 723238 - protein, 21 aa, Mycobacterium
RLREDLCPDWPQPAQPGGSYR

SEQ ID NO: 723239 - protein, 19 aa, Mycobacterium
RLREFSGKAGRQLAKDYVA

SEQ ID NO: 723240 - protein, 21 aa, Mycobacterium
RLREGYRRCRELNAAHGRTFF

SEQ ID NO: 723241 - protein, 28 aa, Mycobacterium
RLRELAAAFRIFGTFGFSEGVAGHITVR

SEQ ID NO: 723242 - protein, 18 aa, Mycobacterium
RLRELAALTLKDFGLAGV

SEQ ID NO: 723243 - protein, 19 aa, Mycobacterium
RLRELAGEAVPRMRLRLYE

SEQ ID NO: 723244 - protein, 17 aa, Mycobacterium
RLRELDFEFPLAGGDAV

SEQ ID NO: 723245 - protein, 17 aa, Mycobacterium
RLRELIDRYPLRGIKGP

SEQ ID NO: 723246 - protein, 22 aa, Mycobacterium
RLRELIDRYPLRGIKGPMGTAQ

SEQ ID NO: 723247 - protein, 22 aa, Mycobacterium
RLRELIDRYPLRGIKGPMGTSQ

SEQ ID NO: 723248 - protein, 22 aa, Mycobacterium
RLRELIDRYPLRGVKGPMGTAQ

SEQ ID NO: 723249 - protein, 24 aa, Mycobacterium
RLRELSKMDGAVVLSTDGSRIVRA

SEQ ID NO: 723250 - protein, 19 aa, Mycobacterium
RLRELTGAGMLACKNALAE

SEQ ID NO: 723251 - protein, 24 aa, Mycobacterium
RLRELTGAGMLDCKNALAESDGDF

SEQ ID NO: 723252 - protein, 20 aa, Mycobacterium
RLRELTGSGMLDCKNALAEA

SEQ ID NO: 723253 - protein, 18 aa, Mycobacterium
RLREMDARHGGSIIDAQI

SEQ ID NO: 723254 - protein, 19 aa, Mycobacterium
RLREMDARHGGSIIDAQIA

SEQ ID NO: 723255 - protein, 21 aa, Mycobacterium
RLREMEFEFPLAGGDRRDDTP

SEQ ID NO: 723256 - protein, 19 aa, Mycobacterium
RLREVIESVGALAAAEQRI

SEQ ID NO: 723257 - protein, 17 aa, Mycobacterium
RLRFDGVQLDFVETYYV

SEQ ID NO: 723258 - protein, 24 aa, Mycobacterium
RLRFPKRQGMRIDFILGSPALASR

SEQ ID NO: 723259 - protein, 25 aa, Mycobacterium
RLRFPRAVRPWQHVLDCLNGYLTLA

SEQ ID NO: 723260 - protein, 20 aa, Mycobacterium
RLRGAGLTVAIVERHLFGGT

SEQ ID NO: 723261 - protein, 17 aa, Mycobacterium
RLRGCGLEVEWAGAGGV

SEQ ID NO: 723262 - protein, 19 aa, Mycobacterium
RLRGLMSRVFTPRRMAELE

SEQ ID NO: 723263 - protein, 19 aa, Mycobacterium
RLRGTVSFVPDDGGTRITE

SEQ ID NO: 723264 - protein, 19 aa, Mycobacterium
RLRGVGVGAAAAFGPVGAP

SEQ ID NO: 723265 - protein, 18 aa, Mycobacterium
RLRHLVVVEEAHRLLGSE

SEQ ID NO: 723266 - protein, 19 aa, Mycobacterium
RLRHPLPGVQLADDVGVAR

SEQ ID NO: 723267 - protein, 19 aa, Mycobacterium
RLRHSIGHVNPRHQLQYSL

SEQ ID NO: 723268 - protein, 27 aa, Mycobacterium
RLRHTYPMPCPRCGARVGRDDGQTIIT

SEQ ID NO: 723269 - protein, 18 aa, Mycobacterium
RLRHVMAAMTADPAQRLS

SEQ ID NO: 723270 - protein, 21 aa, Mycobacterium
RLRIGHMVLCNQFRHPVTLAK

SEQ ID NO: 723271 - protein, 20 aa, Mycobacterium
RLRIHARVLCAAALCDDDLQ

SEQ ID NO: 723272 - protein, 23 aa, Mycobacterium
RLRKDIFDLYGYNAVVHVLSAGG

SEQ ID NO: 723273 - protein, 23 aa, Mycobacterium
RLRKDIFDLYGYSAVVHVLSASG

SEQ ID NO: 723274 - protein, 23 aa, Mycobacterium
RLRKDIFELYGYTAVVHVLSASG

SEQ ID NO: 723275 - protein, 22 aa, Mycobacterium
RLRKDIYDLYGYNAVVHVLSAS

SEQ ID NO: 723276 - protein, 25 aa, Mycobacterium
RLRKPDKHPMIFARYAALPTGGSFV

SEQ ID NO: 723277 - protein, 21 aa, Mycobacterium
RLRKSRMRRAGGNGAAAAPPA

SEQ ID NO: 723278 - protein, 27 aa, Mycobacterium
RLRLAMKELGVALWLDAPLVELLTDAG

SEQ ID NO: 723279 - protein, 28 aa, Mycobacterium
RLRLATQLRAGLFGVLYVLDEPSAGLHP

SEQ ID NO: 723280 - protein, 19 aa, Mycobacterium
RLRLDRAAAAFPEIQQIGF

SEQ ID NO: 723281 - protein, 20 aa, Mycobacterium
RLRLESAREVGPWIRRASVG

SEQ ID NO: 723282 - protein, 20 aa, Mycobacterium
RLRLFHGRGGTVGRGGGPSY

SEQ ID NO: 723283 - protein, 19 aa, Mycobacterium
RLRLIFTCCHPALSQEAQV

SEQ ID NO: 723284 - protein, 33 aa, Mycobacterium
RLRLKPKAPRIGFVDGAWWPRGNDLSAELPDLL

SEQ ID NO: 723285 - protein, 29 aa, Mycobacterium
RLRLLEGAPACFGTASGMSAVFTSLGALL

SEQ ID NO: 723286 - protein, 23 aa, Mycobacterium
RLRLLEISYGVVVTVDVADGLSL

SEQ ID NO: 723287 - protein, 19 aa, Mycobacterium
RLRLLRLSPTVYKGTHVDL

SEQ ID NO: 723288 - protein, 18 aa, Mycobacterium
RLRLQAIEVVSAEALQLP

SEQ ID NO: 723289 - protein, 20 aa, Mycobacterium
RLRLRGRWHRGIAHLLPEDD

SEQ ID NO: 723290 - protein, 25 aa, Mycobacterium
RLRLRSGRIADRFLVQGVLPDRRAR

SEQ ID NO: 723291 - protein, 21 aa, Mycobacterium
RLRLVGGLPANLGVEIPANSE

SEQ ID NO: 723292 - protein, 17 aa, Mycobacterium
RLRMFLEQYWGGPRTYS

SEQ ID NO: 723293 - protein, 18 aa, Mycobacterium
RLRMRHAPFRIGPIERDA

SEQ ID NO: 723294 - protein, 19 aa, Mycobacterium
RLRMTCVATGAAGPTIPAG

SEQ ID NO: 723295 - protein, 19 aa, Mycobacterium
RLRMVEIFTDQSLPAFEEL

SEQ ID NO: 723296 - protein, 21 aa, Mycobacterium
RLRNPRIAGPAPWKPMGTLSG

SEQ ID NO: 723297 - protein, 21 aa, Mycobacterium
RLRPAPHCRTPIDAYSLTVEP

SEQ ID NO: 723298 - protein, 26 aa, Mycobacterium
RLRPEECQRLGLPVFVKPARGGSSIG

SEQ ID NO: 723299 - protein, 18 aa, Mycobacterium
RLRPELADLPAYTPGRTV

SEQ ID NO: 723300 - protein, 20 aa, Mycobacterium
RLRPELRALAPSGDRRMSAN

SEQ ID NO: 723301 - protein, 20 aa, Mycobacterium
RLRPGFMRHDGPMHVQPGVG

SEQ ID NO: 723302 - protein, 18 aa, Mycobacterium
RLRPLQFPRVFRAAEAVS

SEQ ID NO: 723303 - protein, 22 aa, Mycobacterium
RLRPLRPGHLAYVIYTSGSTGR

SEQ ID NO: 723304 - protein, 21 aa, Mycobacterium
RLRPLVAISAAVEWSSAQDVD

SEQ ID NO: 723305 - protein, 18 aa, Mycobacterium
RLRPRGVVVVATRDEPPL

SEQ ID NO: 723306 - protein, 23 aa, Mycobacterium
RLRPSARVHRGLAYVPQGQQSFG

SEQ ID NO: 723307 - protein, 19 aa, Mycobacterium
RLRPSGRGADVWDDLHPTA

SEQ ID NO: 723308 - protein, 18 aa, Mycobacterium
RLRPSGRGADVWDELHPT

SEQ ID NO: 723309 - protein, 19 aa, Mycobacterium
RLRPSGRGADVWEDLHPTA

SEQ ID NO: 723310 - protein, 19 aa, Mycobacterium
RLRPSGRGADVWEELHPTA

SEQ ID NO: 723311 - protein, 20 aa, Mycobacterium
RLRPSGRGADVWEELHPTAD

SEQ ID NO: 723312 - protein, 18 aa, Mycobacterium
RLRPVDGDGPYMAIYEIE

SEQ ID NO: 723313 - protein, 18 aa, Mycobacterium
RLRPVEVVSSAALQLPLW

SEQ ID NO: 723314 - protein, 19 aa, Mycobacterium
RLRPVPAGVVGELYVAGAG

SEQ ID NO: 723315 - protein, 18 aa, Mycobacterium
RLRPVPDGAVGELYLAGA

SEQ ID NO: 723316 - protein, 24 aa, Mycobacterium
RLRPVPLRHPRFVVDVNLGRLARM

SEQ ID NO: 723317 - protein, 24 aa, Mycobacterium
RLRPVPLRNPRFVVDVNLGRLARL

SEQ ID NO: 723318 - protein, 25 aa, Mycobacterium
RLRPYAELLVDGFGIPENLRYAEML

SEQ ID NO: 723319 - protein, 17 aa, Mycobacterium
RLRQALIQTSRLSVALR

SEQ ID NO: 723320 - protein, 19 aa, Mycobacterium
RLRQLGVQSVRLIDRAADV

SEQ ID NO: 723321 - protein, 27 aa, Mycobacterium
RLRQSCLRYGMSVALLDRVSVVAGDIE

SEQ ID NO: 723322 - protein, 20 aa, Mycobacterium
RLRQVWPRYDAMRIELAVGQ

SEQ ID NO: 723323 - protein, 19 aa, Mycobacterium
RLRRALGRVDTIVVHDPYW

SEQ ID NO: 723324 - protein, 17 aa, Mycobacterium
RLRRALKSEERRLSRRP

SEQ ID NO: 723325 - protein, 20 aa, Mycobacterium
RLRRAWIACESHGRRVGTSY

SEQ ID NO: 723326 - protein, 18 aa, Mycobacterium
RLRRDEIDSAMLPFGGGA

SEQ ID NO: 723327 - protein, 19 aa, Mycobacterium
RLRRHARLRKRIAGTQQRP

SEQ ID NO: 723328 - protein, 28 aa, Mycobacterium
RLRRLEVELDQCWDLLRQRRALRDSGGD

SEQ ID NO: 723329 - protein, 21 aa, Mycobacterium
RLRRLLADAGLDAMLVSDLVN

SEQ ID NO: 723330 - protein, 19 aa, Mycobacterium
RLRRLPAATVDEFRETELF

SEQ ID NO: 723331 - protein, 29 aa, Mycobacterium
RLRRMMTSNFTFRRCESMRPHIQEMVDHY

SEQ ID NO: 723332 - protein, 23 aa, Mycobacterium
RLRRRDMGVGELLSMVQAGLNHT

SEQ ID NO: 723333 - protein, 34 aa, Mycobacterium
RLRRRGRLAYTYAMGQCIVAVWVADVVGSELDGV

SEQ ID NO: 723334 - protein, 17 aa, Mycobacterium
RLRRRRLGAHGGVGGLV

SEQ ID NO: 723335 - protein, 20 aa, Mycobacterium
RLRRSGLIATQLIGFALLRY

SEQ ID NO: 723336 - protein, 18 aa, Mycobacterium
RLRRSIAATAGRDHPLLG

SEQ ID NO: 723337 - protein, 17 aa, Mycobacterium
RLRRWSVVLRGRGACAT

SEQ ID NO: 723338 - protein, 17 aa, Mycobacterium
RLRSFGALREYIEVPDV

SEQ ID NO: 723339 - protein, 20 aa, Mycobacterium
RLRSIAHLGVRTRDYAFFVN

SEQ ID NO: 723340 - protein, 20 aa, Mycobacterium
RLRSIAHLGVRTRDYAFSVH

SEQ ID NO: 723341 - protein, 20 aa, Mycobacterium
RLRSIAHLGVRTRDYAYFVN

SEQ ID NO: 723342 - protein, 29 aa, Mycobacterium
RLRSIGVGKLRSSLLNAFSITVDEQKYEH

SEQ ID NO: 723343 - protein, 18 aa, Mycobacterium
RLRSTVVTVLMLDRTPDW

SEQ ID NO: 723344 - protein, 18 aa, Mycobacterium
RLRSTVVTVVLLDRSPDW

SEQ ID NO: 723345 - protein, 20 aa, Mycobacterium
RLRSWLAVHAGEFSGSGDEY

SEQ ID NO: 723346 - protein, 23 aa, Mycobacterium
RLRTFPRPALIVHGGRDTGVPVA

SEQ ID NO: 723347 - protein, 22 aa, Mycobacterium
RLRTLAQLGWLVIRVIAEDRSE

SEQ ID NO: 723348 - protein, 18 aa, Mycobacterium
RLRTVHAQMHLGRQNGPD

SEQ ID NO: 723349 - protein, 18 aa, Mycobacterium
RLRTVVVEGDAGPFASWT

SEQ ID NO: 723350 - protein, 19 aa, Mycobacterium
RLRVAEVVAAPGASRDEVL

SEQ ID NO: 723351 - protein, 26 aa, Mycobacterium
RLRVAFLEAGAGWVPFFMDRLHEHYE

SEQ ID NO: 723352 - protein, 21 aa, Mycobacterium
RLRVILRRAGKGGAEPRSARL

SEQ ID NO: 723353 - protein, 19 aa, Mycobacterium
RLRVILRRSGRGVEETRNA

SEQ ID NO: 723354 - protein, 19 aa, Mycobacterium
RLRVSAVGFGCGGLMQSPS

SEQ ID NO: 723355 - protein, 18 aa, Mycobacterium
RLRWKGYLKPGGRDDATE

SEQ ID NO: 723356 - protein, 19 aa, Mycobacterium
RLRWKGYLKPGSRDDAAEI

SEQ ID NO: 723357 - protein, 19 aa, Mycobacterium
RLRWKGYLKPGSRDDATEI

SEQ ID NO: 723358 - protein, 19 aa, Mycobacterium
RLRWKPYLKGGSREDAASV

SEQ ID NO: 723359 - protein, 20 aa, Mycobacterium
RLRWKSYLKPGSRDDAVEIH

SEQ ID NO: 723360 - protein, 20 aa, Mycobacterium
RLRYRVGVRLDVRWDAADVG

SEQ ID NO: 723361 - protein, 18 aa, Mycobacterium
RLSAEAIRDLDISEHIRA

SEQ ID NO: 723362 - protein, 19 aa, Mycobacterium
RLSAEGIQALIERLPEPLV

SEQ ID NO: 723363 - protein, 22 aa, Mycobacterium
RLSALARNAAELGLIADTGNLG

SEQ ID NO: 723364 - protein, 24 aa, Mycobacterium
RLSALARNAAELGLIPDTDHLELL

SEQ ID NO: 723365 - protein, 21 aa, Mycobacterium
RLSALARNAAELGVVPDTGHL

SEQ ID NO: 723366 - protein, 24 aa, Mycobacterium
RLSALELLADIPLERVRRQRDVLR

SEQ ID NO: 723367 - protein, 19 aa, Mycobacterium
RLSALVCAENGKSQADARA

SEQ ID NO: 723368 - protein, 17 aa, Mycobacterium
RLSAMRKLLKVQRKGSS

SEQ ID NO: 723369 - protein, 19 aa, Mycobacterium
RLSASLLIRAARPVASPAL

SEQ ID NO: 723370 - protein, 23 aa, Mycobacterium
RLSAVTVQQCRDAAEAVLGTASA

SEQ ID NO: 723371 - protein, 21 aa, Mycobacterium
RLSAWLRTRLPGSDDVHVEGL

SEQ ID NO: 723372 - protein, 18 aa, Mycobacterium
RLSDAMGVLGHYGDRLTC

SEQ ID NO: 723373 - protein, 23 aa, Mycobacterium
RLSDIKGPMALLVGQVVGAWIFT

SEQ ID NO: 723374 - protein, 18 aa, Mycobacterium
RLSDSGYDWAQRFDEAAA

SEQ ID NO: 723375 - protein, 17 aa, Mycobacterium
RLSDVRHIIVTHFDADH

SEQ ID NO: 723376 - protein, 17 aa, Mycobacterium
RLSEAHVPVAVLTRPDG

SEQ ID NO: 723377 - protein, 33 aa, Mycobacterium
RLSECQSLRYVFCGGEPLSLATARRFAEILPHA

SEQ ID NO: 723378 - protein, 25 aa, Mycobacterium
RLSERHARTLLDMLDDAVVVKEHHY

SEQ ID NO: 723379 - protein, 22 aa, Mycobacterium
RLSERLPGYMVPSAVVVLDVLP

SEQ ID NO: 723380 - protein, 18 aa, Mycobacterium
RLSETVCMWVNRMHDKTQ

SEQ ID NO: 723381 - protein, 18 aa, Mycobacterium
RLSEVWRMTDPAERSASL

SEQ ID NO: 723382 - protein, 21 aa, Mycobacterium
RLSGASSRFFAHNDLDALERN

SEQ ID NO: 723383 - protein, 24 aa, Mycobacterium
RLSGEIDLGRVIAAYVDNQAAEAA

SEQ ID NO: 723384 - protein, 25 aa, Mycobacterium
RLSGGRFTLGIGRGIAAMYGAFGIP

SEQ ID NO: 723385 - protein, 25 aa, Mycobacterium
RLSGGRFTLGIGRGIGAIYNAFGIP

SEQ ID NO: 723386 - protein, 31 aa, Mycobacterium
RLSGGRLTLGVGVGWSREEFAALGVPFQDRA

SEQ ID NO: 723387 - protein, 19 aa, Mycobacterium
RLSGMPVRDIETIQAAQVI

SEQ ID NO: 723388 - protein, 17 aa, Mycobacterium
RLSGPKGELDIMIIALR

SEQ ID NO: 723389 - protein, 19 aa, Mycobacterium
RLSGPVVFDQLWTDLTFVH

SEQ ID NO: 723390 - protein, 21 aa, Mycobacterium
RLSGSLAGPVRRVAGRRDFED

SEQ ID NO: 723391 - protein, 17 aa, Mycobacterium
RLSGVAWREYGVRVNTV

SEQ ID NO: 723392 - protein, 25 aa, Mycobacterium
RLSGYEIPTQISIVAEIPRTASGKP

SEQ ID NO: 723393 - protein, 19 aa, Mycobacterium
RLSIEFSVALLRDDTGEIV

SEQ ID NO: 723394 - protein, 25 aa, Mycobacterium
RLSIPDSTCDLGRFIAEKTAGVHAA

SEQ ID NO: 723395 - protein, 18 aa, Mycobacterium
RLSIPFTTGLLVGIGENL

SEQ ID NO: 723396 - protein, 19 aa, Mycobacterium
RLSKVTGIDESRLGLILEV

SEQ ID NO: 723397 - protein, 17 aa, Mycobacterium
RLSLGFGNSTFRYAAPA

SEQ ID NO: 723398 - protein, 30 aa, Mycobacterium
RLSMFPRHPLVCLVIEPFGVAVTMAGIQQL

SEQ ID NO: 723399 - protein, 29 aa, Mycobacterium
RLSPDFPGERILGMGFDRDVLVRAGIEEA

SEQ ID NO: 723400 - protein, 18 aa, Mycobacterium
RLSPGAVRAGDKVLLSGS

SEQ ID NO: 723401 - protein, 20 aa, Mycobacterium
RLSPLAYLTIDGRMIIVGSY

SEQ ID NO: 723402 - protein, 20 aa, Mycobacterium
RLSQFPRAWATVTTDDGRTG

SEQ ID NO: 723403 - protein, 21 aa, Mycobacterium
RLSQYAPFSLCAKAIQALTRI

SEQ ID NO: 723404 - protein, 17 aa, Mycobacterium
RLSRARVVVELDTSGTI

SEQ ID NO: 723405 - protein, 30 aa, Mycobacterium
RLSRIVFVPDIPRLPSGKVLRRALKELYGC

SEQ ID NO: 723406 - protein, 17 aa, Mycobacterium
RLSRLNGSPAYPRSEEE

SEQ ID NO: 723407 - protein, 17 aa, Mycobacterium
RLSRLTDPVAMRRADQQ

SEQ ID NO: 723408 - protein, 20 aa, Mycobacterium
RLSRPFFVWLTVGLYHPAVR

SEQ ID NO: 723409 - protein, 18 aa, Mycobacterium
RLSRRGRRLGLTDTNNGL

SEQ ID NO: 723410 - protein, 20 aa, Mycobacterium
RLSSLVGHGRARAMLLAAEK

SEQ ID NO: 723411 - protein, 23 aa, Mycobacterium
RLSSPRKCRIGLKPPTASNADLR

SEQ ID NO: 723412 - protein, 20 aa, Mycobacterium
RLSSPRWPIIVGGVRDESTL

SEQ ID NO: 723413 - protein, 20 aa, Mycobacterium
RLSSRIEGLISNFERVIDGF

SEQ ID NO: 723414 - protein, 25 aa, Mycobacterium
RLSTIPVDTTVIWGLHDAVAPLRVA

SEQ ID NO: 723415 - protein, 27 aa, Mycobacterium
RLSTLQRPGVRGIPFIFVRTDSAGNIS

SEQ ID NO: 723416 - protein, 20 aa, Mycobacterium
RLSTRVIDLIMPIGKGQRAL

SEQ ID NO: 723417 - protein, 19 aa, Mycobacterium
RLSTYSGGMFRRVDLASAL

SEQ ID NO: 723418 - protein, 20 aa, Mycobacterium
RLSVPESWTAATQVVNHAGA

SEQ ID NO: 723419 - protein, 20 aa, Mycobacterium
RLSWLGRNVARWEIVEPDMR

SEQ ID NO: 723420 - protein, 20 aa, Mycobacterium
RLSWRSGGGSPHITAPKPTM

SEQ ID NO: 723421 - protein, 20 aa, Mycobacterium
RLSYFLDLRGPSVAVDTACS

SEQ ID NO: 723422 - protein, 18 aa, Mycobacterium
RLSYGRFGDDLARSTGDD

SEQ ID NO: 723423 - protein, 25 aa, Mycobacterium
RLTAAKTRLAPIFSAATREEVVLAM

SEQ ID NO: 723424 - protein, 25 aa, Mycobacterium
RLTAEFKASLMTRLMPGASAIVVLT

SEQ ID NO: 723425 - protein, 19 aa, Mycobacterium
RLTAGVLMFTARREVRGAF

SEQ ID NO: 723426 - protein, 17 aa, Mycobacterium
RLTALQFEFGSTDHHIT

SEQ ID NO: 723427 - protein, 23 aa, Mycobacterium
RLTATDAPQPWVLDRALRHLLTD

SEQ ID NO: 723428 - protein, 19 aa, Mycobacterium
RLTAWVGLANIRSFRIRFT

SEQ ID NO: 723429 - protein, 23 aa, Mycobacterium
RLTCAGHPPPLIVRHDGQVEEAN

SEQ ID NO: 723430 - protein, 21 aa, Mycobacterium
RLTCVFVDHGLLRAGERAQVE

SEQ ID NO: 723431 - protein, 22 aa, Mycobacterium
RLTCVFVDHGLLRAGERAQVQR

SEQ ID NO: 723432 - protein, 20 aa, Mycobacterium
RLTCVFVDHGLLRAGEREQV

SEQ ID NO: 723433 - protein, 17 aa, Mycobacterium
RLTCVFVDHGLLREGER

SEQ ID NO: 723434 - protein, 19 aa, Mycobacterium
RLTCVFVDHGLLRSGERAQ

SEQ ID NO: 723435 - protein, 24 aa, Mycobacterium
RLTEAAIPFEVRMQNWEGVAAEAA

SEQ ID NO: 723436 - protein, 27 aa, Mycobacterium
RLTECLRSGATAFGWSRRNPVPRSVRE

SEQ ID NO: 723437 - protein, 22 aa, Mycobacterium
RLTEESWNYGQFHFGKDRRMNR

SEQ ID NO: 723438 - protein, 17 aa, Mycobacterium
RLTEFAEPNALWKLVPR

SEQ ID NO: 723439 - protein, 22 aa, Mycobacterium
RLTELPVGMPVAVVVRQLTEHV

SEQ ID NO: 723440 - protein, 21 aa, Mycobacterium
RLTERFDAIIVPGVTSVSAAS

SEQ ID NO: 723441 - protein, 20 aa, Mycobacterium
RLTERIRITAPRLLAAFTTR

SEQ ID NO: 723442 - protein, 24 aa, Mycobacterium
RLTEVRKDGLLPYLRPDGKTQVTI

SEQ ID NO: 723443 - protein, 30 aa, Mycobacterium
RLTEVVRMCVPLPWAAVAFERLFLFIRDRR

SEQ ID NO: 723444 - protein, 22 aa, Mycobacterium
RLTFAGDAVFAPGFDNPQWHNG

SEQ ID NO: 723445 - protein, 20 aa, Mycobacterium
RLTGELADWYHLDAGHLRMG

SEQ ID NO: 723446 - protein, 20 aa, Mycobacterium
RLTGELAEWFGIDAGTLRVG

SEQ ID NO: 723447 - protein, 20 aa, Mycobacterium
RLTGELGEWYGLDAGRLRIG

SEQ ID NO: 723448 - protein, 19 aa, Mycobacterium
RLTGGAWLQVRLPEAPPPV

SEQ ID NO: 723449 - protein, 20 aa, Mycobacterium
RLTGGAWLQVRLPEPPAPLQ

SEQ ID NO: 723450 - protein, 25 aa, Mycobacterium
RLTKSGFWPARFEPSPVWDPNIPEP

SEQ ID NO: 723451 - protein, 18 aa, Mycobacterium
RLTKVFGLAGPHRRTQRT

SEQ ID NO: 723452 - protein, 25 aa, Mycobacterium
RLTLIGSRSKAGWALGTAALAAAKC

SEQ ID NO: 723453 - protein, 21 aa, Mycobacterium
RLTLLRDWLGPGYGHPTSQGT

SEQ ID NO: 723454 - protein, 22 aa, Mycobacterium
RLTLPERFRPAANASVDRMGSV

SEQ ID NO: 723455 - protein, 18 aa, Mycobacterium
RLTLRIYAYNSCCNDSYP

SEQ ID NO: 723456 - protein, 21 aa, Mycobacterium
RLTLSQLRLRELLVEVQERVE

SEQ ID NO: 723457 - protein, 17 aa, Mycobacterium
RLTMEFMGLANHRKALR

SEQ ID NO: 723458 - protein, 19 aa, Mycobacterium
RLTMGHTVVMGRRTWDSLP

SEQ ID NO: 723459 - protein, 18 aa, Mycobacterium
RLTPARPAGGDAMTCTPG

SEQ ID NO: 723460 - protein, 18 aa, Mycobacterium
RLTPDYDFGCKRPTFSNS

SEQ ID NO: 723461 - protein, 18 aa, Mycobacterium
RLTPGERPYPVAHRVRGV

SEQ ID NO: 723462 - protein, 18 aa, Mycobacterium
RLTPGTRVWYSIKAHEVA

SEQ ID NO: 723463 - protein, 23 aa, Mycobacterium
RLTPRPEQIPAWADYDDRYKPVA

SEQ ID NO: 723464 - protein, 26 aa, Mycobacterium
RLTPTAVEEIVRWASPVIYMRRTLTR

SEQ ID NO: 723465 - protein, 19 aa, Mycobacterium
RLTPWQQLMDGLSTTGAGP

SEQ ID NO: 723466 - protein, 19 aa, Mycobacterium
RLTPYRVPVRIVFVEQLPR

SEQ ID NO: 723467 - protein, 18 aa, Mycobacterium
RLTQALAEAPMRRGRHKN

SEQ ID NO: 723468 - protein, 18 aa, Mycobacterium
RLTQALQAWAERLPADAL

SEQ ID NO: 723469 - protein, 19 aa, Mycobacterium
RLTQIGADVVVEGELLTAT

SEQ ID NO: 723470 - protein, 25 aa, Mycobacterium
RLTQLTWRVMPFMWLDVDEGIKPTL

SEQ ID NO: 723471 - protein, 28 aa, Mycobacterium
RLTQRLHAPLRVVTFAVRGRTMLTAGVG

SEQ ID NO: 723472 - protein, 17 aa, Mycobacterium
RLTQRVAAALAQSKGAV

SEQ ID NO: 723473 - protein, 18 aa, Mycobacterium
RLTRDWRIPMVDVALATS

SEQ ID NO: 723474 - protein, 19 aa, Mycobacterium
RLTRGNVLYLRNIVEQEVA

SEQ ID NO: 723475 - protein, 23 aa, Mycobacterium
RLTRGRTVWFTGLSGSGKSSVAM

SEQ ID NO: 723476 - protein, 23 aa, Mycobacterium
RLTRWRRDREEILSHISDNDVRS

SEQ ID NO: 723477 - protein, 23 aa, Mycobacterium
RLTRWTRLYPDVRVESAIIAGHA

SEQ ID NO: 723478 - protein, 25 aa, Mycobacterium
RLTSCGRPTLFAKVALLGEDGQPVP

SEQ ID NO: 723479 - protein, 25 aa, Mycobacterium
RLTSCGRPTLFARVALLGEDGKPVP

SEQ ID NO: 723480 - protein, 25 aa, Mycobacterium
RLTSCGRPTLFARVALLGEDGQPVP

SEQ ID NO: 723481 - protein, 20 aa, Mycobacterium
RLTSLVGYGRARGMLLAAEK

SEQ ID NO: 723482 - protein, 18 aa, Mycobacterium
RLTSPLRWEPGLPSDPDG

SEQ ID NO: 723483 - protein, 18 aa, Mycobacterium
RLTTIDVLIIDDFALRPL

SEQ ID NO: 723484 - protein, 17 aa, Mycobacterium
RLTTKHGICSTRQAISQ

SEQ ID NO: 723485 - protein, 20 aa, Mycobacterium
RLTTPEAWLSTWSGLSANAS

SEQ ID NO: 723486 - protein, 18 aa, Mycobacterium
RLTVPISATYPLDEAAAA

SEQ ID NO: 723487 - protein, 18 aa, Mycobacterium
RLTVYLCTRDCYATNAIF

SEQ ID NO: 723488 - protein, 30 aa, Mycobacterium
RLVAACAEAGLPVSCLPGPSAVTTALAVSG

SEQ ID NO: 723489 - protein, 22 aa, Mycobacterium
RLVAAVARTAAQYGARILTYVG

SEQ ID NO: 723490 - protein, 19 aa, Mycobacterium
RLVACSGSPLNASLVQRFT

SEQ ID NO: 723491 - protein, 20 aa, Mycobacterium
RLVAEIAPDHFGRLAAAMGE

SEQ ID NO: 723492 - protein, 25 aa, Mycobacterium
RLVAFGRERIRFVHAHHELLSAANR

SEQ ID NO: 723493 - protein, 26 aa, Mycobacterium
RLVAGFDPTEHWPRYCYSTNQVKAGG

SEQ ID NO: 723494 - protein, 18 aa, Mycobacterium
RLVAHYGARHLLLVSRSG

SEQ ID NO: 723495 - protein, 18 aa, Mycobacterium
RLVAKGLSAKQIATRLSL

SEQ ID NO: 723496 - protein, 17 aa, Mycobacterium
RLVAMRLVATRACDYMR

SEQ ID NO: 723497 - protein, 20 aa, Mycobacterium
RLVARTTLRLPAQRIRAANF

SEQ ID NO: 723498 - protein, 26 aa, Mycobacterium
RLVASTRPPVEWLRIPPGGTVLDIGC

SEQ ID NO: 723499 - protein, 17 aa, Mycobacterium
RLVDALVPRGARILDAG

SEQ ID NO: 723500 - protein, 31 aa, Mycobacterium
RLVDAVARQEPRLSWAAGLRDDGTTTLLVTD

SEQ ID NO: 723501 - protein, 21 aa, Mycobacterium
RLVDCIKQGSTDFGWHRRNSI

SEQ ID NO: 723502 - protein, 18 aa, Mycobacterium
RLVDEGFFGRILSMRGEF

SEQ ID NO: 723503 - protein, 26 aa, Mycobacterium
RLVDGDIIWAPAIDGAFVLSTRGGDF

SEQ ID NO: 723504 - protein, 26 aa, Mycobacterium
RLVDGDIIWAPAIDGAFVLTTRGGDF

SEQ ID NO: 723505 - protein, 27 aa, Mycobacterium
RLVDGDIIWAPAIDGAFVLTTRGGDFD

SEQ ID NO: 723506 - protein, 27 aa, Mycobacterium
RLVDGEIIWAPAIDGAFVLSTRGGDFD

SEQ ID NO: 723507 - protein, 18 aa, Mycobacterium
RLVDLGVIRGFYTDIDPV

SEQ ID NO: 723508 - protein, 17 aa, Mycobacterium
RLVDLLTSIALPPPEIL

SEQ ID NO: 723509 - protein, 18 aa, Mycobacterium
RLVDRVAATPSIRAIEIK

SEQ ID NO: 723510 - protein, 17 aa, Mycobacterium
RLVDTAQAWDLLPRVYA

SEQ ID NO: 723511 - protein, 17 aa, Mycobacterium
RLVDVPFLGPVLADDLA

SEQ ID NO: 723512 - protein, 17 aa, Mycobacterium
RLVDYRLSPLLASAQST

SEQ ID NO: 723513 - protein, 26 aa, Mycobacterium
RLVEARGAAKLAGYRGAMYPWQSGSD

SEQ ID NO: 723514 - protein, 19 aa, Mycobacterium
RLVEAYLRGPMRGAVSPPN

SEQ ID NO: 723515 - protein, 19 aa, Mycobacterium
RLVERADVVIVNMPAAGMR

SEQ ID NO: 723516 - protein, 21 aa, Mycobacterium
RLVERFRNVVVVRTFSKAYGL

SEQ ID NO: 723517 - protein, 18 aa, Mycobacterium
RLVEVLIQRGYRVIGPTL

SEQ ID NO: 723518 - protein, 19 aa, Mycobacterium
RLVFPNRARELTVTVGLIA

SEQ ID NO: 723519 - protein, 20 aa, Mycobacterium
RLVGEFLAGLGHQRIGALHG

SEQ ID NO: 723520 - protein, 21 aa, Mycobacterium
RLVGEFYTRWFAADLTARDLF

SEQ ID NO: 723521 - protein, 21 aa, Mycobacterium
RLVGFYEMVTQIAAVWGNELF

SEQ ID NO: 723522 - protein, 20 aa, Mycobacterium
RLVGLTGITFTNVFNACATS

SEQ ID NO: 723523 - protein, 28 aa, Mycobacterium
RLVGSDATHAWAAVWVPPDGWIAFDPTN

SEQ ID NO: 723524 - protein, 19 aa, Mycobacterium
RLVGSVPRLVRKKAGTEVL

SEQ ID NO: 723525 - protein, 19 aa, Mycobacterium
RLVGTLAHIWVSSIYGTPR

SEQ ID NO: 723526 - protein, 24 aa, Mycobacterium
RLVGWLMQVIDAFAGDVDQRLRDV

SEQ ID NO: 723527 - protein, 25 aa, Mycobacterium
RLVIAPNLWAGVGLVRGGAGTALVG

SEQ ID NO: 723528 - protein, 19 aa, Mycobacterium
RLVILARWRHTIVGELLRD

SEQ ID NO: 723529 - protein, 25 aa, Mycobacterium
RLVIPRPDGLRDIGYLTDLLYREGI

SEQ ID NO: 723530 - protein, 18 aa, Mycobacterium
RLVIPRPGGLTDVAYLTA

SEQ ID NO: 723531 - protein, 18 aa, Mycobacterium
RLVIRLARTSEAARHYVL

SEQ ID NO: 723532 - protein, 18 aa, Mycobacterium
RLVKEAGINVPRVRLASF

SEQ ID NO: 723533 - protein, 26 aa, Mycobacterium
RLVKESFAEAVSWVAKNLPTRPAVPV

SEQ ID NO: 723534 - protein, 19 aa, Mycobacterium
RLVKPEILESTRFRAGLQK

SEQ ID NO: 723535 - protein, 17 aa, Mycobacterium
RLVKPEMLASARFRAGL

SEQ ID NO: 723536 - protein, 24 aa, Mycobacterium
RLVLDFYRCAMLPLSSDDVQTGHD

SEQ ID NO: 723537 - protein, 24 aa, Mycobacterium
RLVLDFYRCGMLPAGPDWRPERAP

SEQ ID NO: 723538 - protein, 29 aa, Mycobacterium
RLVLGPCWPEALGVLSFRMYYRGHNLHLR

SEQ ID NO: 723539 - protein, 17 aa, Mycobacterium
RLVLTPGSVTRLFDVPG

SEQ ID NO: 723540 - protein, 19 aa, Mycobacterium
RLVPEVRRTVQLVFQDPYS

SEQ ID NO: 723541 - protein, 22 aa, Mycobacterium
RLVPILVDLAHLIAFERDDAAE

SEQ ID NO: 723542 - protein, 17 aa, Mycobacterium
RLVPLVAAGRRGEAVEL

SEQ ID NO: 723543 - protein, 18 aa, Mycobacterium
RLVPRKGQDMLIRALPEL

SEQ ID NO: 723544 - protein, 17 aa, Mycobacterium
RLVQEALELAMCAPSNS

SEQ ID NO: 723545 - protein, 27 aa, Mycobacterium
RLVRAGLRPAGIWAYEAHRVAALRPRL

SEQ ID NO: 723546 - protein, 18 aa, Mycobacterium
RLVREIDGAWKPDQYANP

SEQ ID NO: 723547 - protein, 23 aa, Mycobacterium
RLVREIEGAWKPDQYSNPNGPAS

SEQ ID NO: 723548 - protein, 24 aa, Mycobacterium
RLVRELRAALPAVDLRVRGEMLAP

SEQ ID NO: 723549 - protein, 19 aa, Mycobacterium
RLVRGLDYYTKTTFEFVHD

SEQ ID NO: 723550 - protein, 20 aa, Mycobacterium
RLVRHAAGIGERMCDAMRAE

SEQ ID NO: 723551 - protein, 24 aa, Mycobacterium
RLVRIARQRLAAFITPIPVQVRTG

SEQ ID NO: 723552 - protein, 17 aa, Mycobacterium
RLVRLGVAAPLKAVERQ

SEQ ID NO: 723553 - protein, 24 aa, Mycobacterium
RLVRMLDMGWEEFMVAAEYDGDQH

SEQ ID NO: 723554 - protein, 25 aa, Mycobacterium
RLVRSRSCAKWLASEDFSETIGHLR

SEQ ID NO: 723555 - protein, 19 aa, Mycobacterium
RLVSAGGVLVIYVATVTQL

SEQ ID NO: 723556 - protein, 19 aa, Mycobacterium
RLVSELKLTGTDVPALRFI

SEQ ID NO: 723557 - protein, 17 aa, Mycobacterium
RLVSGLLTELGRRIVAW

SEQ ID NO: 723558 - protein, 18 aa, Mycobacterium
RLVSLLVFDGPQLPGPLA

SEQ ID NO: 723559 - protein, 26 aa, Mycobacterium
RLVTALAIAILRGFPVVVLVDDAPER

SEQ ID NO: 723560 - protein, 17 aa, Mycobacterium
RLVTPGGAFLEMGKTDI

SEQ ID NO: 723561 - protein, 17 aa, Mycobacterium
RLVTSCEHFHREAAGIV

SEQ ID NO: 723562 - protein, 17 aa, Mycobacterium
RLVVLDMSRRYGGDFGF

SEQ ID NO: 723563 - protein, 17 aa, Mycobacterium
RLVVLRSPFLRDLTEME

SEQ ID NO: 723564 - protein, 20 aa, Mycobacterium
RLVYGGRTRASMAFLDRLAG

SEQ ID NO: 723565 - protein, 18 aa, Mycobacterium
RLWADYLDMPPLRVDPAT

SEQ ID NO: 723566 - protein, 20 aa, Mycobacterium
RLWDSWEPGWLVADKQSGRY

SEQ ID NO: 723567 - protein, 19 aa, Mycobacterium
RLWHGELIFNHDGPMGKYP

SEQ ID NO: 723568 - protein, 17 aa, Mycobacterium
RLWKLERAMREWARSDK

SEQ ID NO: 723569 - protein, 19 aa, Mycobacterium
RLWLRSEANISVIEHGSDK

SEQ ID NO: 723570 - protein, 18 aa, Mycobacterium
RLWLRSESNIAVIEHGSE

SEQ ID NO: 723571 - protein, 19 aa, Mycobacterium
RLWLRSESNISVIEHGSDK

SEQ ID NO: 723572 - protein, 19 aa, Mycobacterium
RLWRLRSGGSIVIRGCPAG

SEQ ID NO: 723573 - protein, 17 aa, Mycobacterium
RLWYELLTESALPADDN

SEQ ID NO: 723574 - protein, 17 aa, Mycobacterium
RLYDAIDQWAFCALTSS

SEQ ID NO: 723575 - protein, 22 aa, Mycobacterium
RLYDRFEPIHAVTYFAPEARAA

SEQ ID NO: 723576 - protein, 23 aa, Mycobacterium
RLYDRFEPVHAVTYFAPEARAAL

SEQ ID NO: 723577 - protein, 17 aa, Mycobacterium
RLYIKAETAGARERVLR

SEQ ID NO: 723578 - protein, 23 aa, Mycobacterium
RLYPESLDIMGWDVGSHGLQLRL

SEQ ID NO: 723579 - protein, 22 aa, Mycobacterium
RLYPESLHVMAWNVSSAGLHLV

SEQ ID NO: 723580 - protein, 17 aa, Mycobacterium
RLYPGLIDPPAHIHPPK

SEQ ID NO: 723581 - protein, 19 aa, Mycobacterium
RLYQCALDFLCGSVAGGTE

SEQ ID NO: 723582 - protein, 18 aa, Mycobacterium
RLYQRVGDRLTLISVGGI

SEQ ID NO: 723583 - protein, 19 aa, Mycobacterium
RLYREAPLMGIWEGSGNVS

SEQ ID NO: 723584 - protein, 24 aa, Mycobacterium
RLYRPFPAEALLAALPPTVRAIAV

SEQ ID NO: 723585 - protein, 17 aa, Mycobacterium
RMAADGLGVMVRDSGHV

SEQ ID NO: 723586 - protein, 19 aa, Mycobacterium
RMAAEVKNAAGVVSSGRQG

SEQ ID NO: 723587 - protein, 19 aa, Mycobacterium
RMAAGELVGCFGLTEPDAG

SEQ ID NO: 723588 - protein, 23 aa, Mycobacterium
RMACLKGGVVANVVIPTAEYVRL

SEQ ID NO: 723589 - protein, 22 aa, Mycobacterium
RMADGEIKACWIICSNPVATVA

SEQ ID NO: 723590 - protein, 20 aa, Mycobacterium
RMAIEPEPGCVIGSCRDAIG

SEQ ID NO: 723591 - protein, 24 aa, Mycobacterium
RMAIPELPEELFIESLTQLIAVDN

SEQ ID NO: 723592 - protein, 20 aa, Mycobacterium
RMALPNARVLIHQPALSGVI

SEQ ID NO: 723593 - protein, 22 aa, Mycobacterium
RMALRRAREGSGPTLIEAVTYR

SEQ ID NO: 723594 - protein, 22 aa, Mycobacterium
RMALSQLWLAHIDWTPDLAPVT

SEQ ID NO: 723595 - protein, 20 aa, Mycobacterium
RMALSQLWSAGIDWTPDLAP

SEQ ID NO: 723596 - protein, 20 aa, Mycobacterium
RMALSQLWTADIDWTPDLAP

SEQ ID NO: 723597 - protein, 22 aa, Mycobacterium
RMASICTGSFVLAAAGLLDERR

SEQ ID NO: 723598 - protein, 24 aa, Mycobacterium
RMASLRGLLKFRAGVREPIPLEEV

SEQ ID NO: 723599 - protein, 23 aa, Mycobacterium
RMASLRGLLKFRAGVRPPIPLDE

SEQ ID NO: 723600 - protein, 23 aa, Mycobacterium
RMASLRGLLKFRAGVRPPVPLEE

SEQ ID NO: 723601 - protein, 21 aa, Mycobacterium
RMASLRGLLKFRDGERPSVPL

SEQ ID NO: 723602 - protein, 22 aa, Mycobacterium
RMASLRGLLKFRGGVRPPVPLD

SEQ ID NO: 723603 - protein, 24 aa, Mycobacterium
RMATGELRATMALTEPGGGSDLQA

SEQ ID NO: 723604 - protein, 24 aa, Mycobacterium
RMATGETRGAFSMSEPELGSDVAA

SEQ ID NO: 723605 - protein, 17 aa, Mycobacterium
RMDDGLIDVRILETGKR

SEQ ID NO: 723606 - protein, 35 aa, Mycobacterium
RMDILPVSFGFPFGLSVIFPPNLPLPAKIVTEVLE

SEQ ID NO: 723607 - protein, 35 aa, Mycobacterium
RMDILPVSVGFPFGLSVIFPPNLPLPAKVVTEVLE

SEQ ID NO: 723608 - protein, 18 aa, Mycobacterium
RMDIPPLLGELAQSASAA

SEQ ID NO: 723609 - protein, 18 aa, Mycobacterium
RMDLALFLEENFTASGAP

SEQ ID NO: 723610 - protein, 20 aa, Mycobacterium
RMDLVDGKLICLVRAKSDTE

SEQ ID NO: 723611 - protein, 20 aa, Mycobacterium
RMDLVDGKVICLVRARSDDE

SEQ ID NO: 723612 - protein, 26 aa, Mycobacterium
RMDPRQRLLLEVAWEALEDAGQVPER

SEQ ID NO: 723613 - protein, 17 aa, Mycobacterium
RMDRIAALMAEVDPDRQ

SEQ ID NO: 723614 - protein, 24 aa, Mycobacterium
RMEAARWLRGYLRELISQRRRDPG

SEQ ID NO: 723615 - protein, 29 aa, Mycobacterium
RMEADWEAAYLLALRAAWQADNKIPNSKE

SEQ ID NO: 723616 - protein, 20 aa, Mycobacterium
RMEADWEAGYLLTVRSAWQA

SEQ ID NO: 723617 - protein, 32 aa, Mycobacterium
RMEADWESGYLLTLRSAWQADNRIPNSKEASM

SEQ ID NO: 723618 - protein, 29 aa, Mycobacterium
RMEAEIGFDRLLSRFEVMELVDSGPPRYR

SEQ ID NO: 723619 - protein, 18 aa, Mycobacterium
RMEARVALTELFKRIRGY

SEQ ID NO: 723620 - protein, 23 aa, Mycobacterium
RMEETQIFGAEWIHSLGVIPNEY

SEQ ID NO: 723621 - protein, 20 aa, Mycobacterium
RMEIKLMFEAIADRLPDISK

SEQ ID NO: 723622 - protein, 31 aa, Mycobacterium
RMEILPISIGFPFGLSVIFPPNLPLPSKIVT

SEQ ID NO: 723623 - protein, 18 aa, Mycobacterium
RMEQWSRGERPPRDRPRT

SEQ ID NO: 723624 - protein, 19 aa, Mycobacterium
RMERHLPLMTSHDAEPAVT

SEQ ID NO: 723625 - protein, 20 aa, Mycobacterium
RMESELLALVATRPPQNAIS

SEQ ID NO: 723626 - protein, 21 aa, Mycobacterium
RMEVNSFFSALLPRLESIEVD

SEQ ID NO: 723627 - protein, 20 aa, Mycobacterium
RMFEMYPGYLQSFSQTLVDN

SEQ ID NO: 723628 - protein, 17 aa, Mycobacterium
RMFRDLTRLSAAGIPTI

SEQ ID NO: 723629 - protein, 19 aa, Mycobacterium
RMFRDLTRLSAAGIPTIAL

SEQ ID NO: 723630 - protein, 22 aa, Mycobacterium
RMFRELRVERIWEGASEIQRLI

SEQ ID NO: 723631 - protein, 17 aa, Mycobacterium
RMFTPRRIAALEPMIRD

SEQ ID NO: 723632 - protein, 17 aa, Mycobacterium
RMGAELLAREPMFAATI

SEQ ID NO: 723633 - protein, 19 aa, Mycobacterium
RMGALALHVAKIARRRHPQ

SEQ ID NO: 723634 - protein, 17 aa, Mycobacterium
RMGCSRTPVREAFLRLE

SEQ ID NO: 723635 - protein, 18 aa, Mycobacterium
RMGDGLMAVFGDPTVAVR

SEQ ID NO: 723636 - protein, 19 aa, Mycobacterium
RMGDVGYRTRWGCIHLLDR

SEQ ID NO: 723637 - protein, 17 aa, Mycobacterium
RMGEGFSQMMKGLETGR

SEQ ID NO: 723638 - protein, 17 aa, Mycobacterium
RMGKHLLTHPGLLGRLP

SEQ ID NO: 723639 - protein, 24 aa, Mycobacterium
RMGLLDWQLIRRGSWSHDVGYALI

SEQ ID NO: 723640 - protein, 23 aa, Mycobacterium
RMGLPVPDWQVLLAVPADLAAQR

SEQ ID NO: 723641 - protein, 28 aa, Mycobacterium
RMGQDGWLGVGWPKEYGGHGFGPLEQQI

SEQ ID NO: 723642 - protein, 22 aa, Mycobacterium
RMGRLGVPVVAEFSCPEARTIV

SEQ ID NO: 723643 - protein, 24 aa, Mycobacterium
RMGRPEELTGLYLYLASAASSYMT

SEQ ID NO: 723644 - protein, 17 aa, Mycobacterium
RMGRRPGARWAADLVAA

SEQ ID NO: 723645 - protein, 18 aa, Mycobacterium
RMGWAVNDIEIISLVNAP

SEQ ID NO: 723646 - protein, 19 aa, Mycobacterium
RMHGAVFSSIGWTKPRVIP

SEQ ID NO: 723647 - protein, 26 aa, Mycobacterium
RMHPAVCAAVSRLSYDNRLRSVDDVT

SEQ ID NO: 723648 - protein, 27 aa, Mycobacterium
RMHPGNWAGAYACWGTENREAAVRFIT

SEQ ID NO: 723649 - protein, 17 aa, Mycobacterium
RMHRLLHMLEAAWNVTE

SEQ ID NO: 723650 - protein, 21 aa, Mycobacterium
RMIAEPLCLYDFCQETDGAVA

SEQ ID NO: 723651 - protein, 23 aa, Mycobacterium
RMIAEPYPRLLVARDQVNQGAAA

SEQ ID NO: 723652 - protein, 27 aa, Mycobacterium
RMIALPEWLRRDLGPWSPWGKIQAARS

SEQ ID NO: 723653 - protein, 17 aa, Mycobacterium
RMIEPTPVLGRLPGMSA

SEQ ID NO: 723654 - protein, 19 aa, Mycobacterium
RMIPRTLMRAVTKRVGGGR

SEQ ID NO: 723655 - protein, 19 aa, Mycobacterium
RMIRFSWQSFLVDTDQFVG

SEQ ID NO: 723656 - protein, 18 aa, Mycobacterium
RMKADFFKTLGHPVRIRV

SEQ ID NO: 723657 - protein, 23 aa, Mycobacterium
RMKARAALLDHLPLITFEQQVGI

SEQ ID NO: 723658 - protein, 24 aa, Mycobacterium
RMKGNNVLHALGFDSFGLPAEQYA

SEQ ID NO: 723659 - protein, 22 aa, Mycobacterium
RMKLARNMLTFIGFAASCEAMK

SEQ ID NO: 723660 - protein, 20 aa, Mycobacterium
RMKLARNMLTFIGFTAACEA

SEQ ID NO: 723661 - protein, 23 aa, Mycobacterium
RMKQRIREGARLVVVDPRRIDLV

SEQ ID NO: 723662 - protein, 22 aa, Mycobacterium
RMKSRLATAALRNAVGRRGVVA

SEQ ID NO: 723663 - protein, 21 aa, Mycobacterium
RMKTHRPVLRVGRIGGQYAKP

SEQ ID NO: 723664 - protein, 19 aa, Mycobacterium
RMLAATLFWGTERVLHIAG

SEQ ID NO: 723665 - protein, 19 aa, Mycobacterium
RMLAEHRLPGLLVTDGSGR

SEQ ID NO: 723666 - protein, 19 aa, Mycobacterium
RMLAERGPADPIRVWSAGC

SEQ ID NO: 723667 - protein, 20 aa, Mycobacterium
RMLAERGPDDPIRVWSAGCA

SEQ ID NO: 723668 - protein, 21 aa, Mycobacterium
RMLASRFRPLALLGTDRRLSE

SEQ ID NO: 723669 - protein, 24 aa, Mycobacterium
RMLDEIYSLLDLRNATCHQTIDRF

SEQ ID NO: 723670 - protein, 25 aa, Mycobacterium
RMLDRIDAKLGYPTRDPHGDPIPAA

SEQ ID NO: 723671 - protein, 32 aa, Mycobacterium
RMLEAGRRWSRTRILAALALGRLERSPLYHEL

SEQ ID NO: 723672 - protein, 19 aa, Mycobacterium
RMLERLAFPAMLRAFSQPV

SEQ ID NO: 723673 - protein, 24 aa, Mycobacterium
RMLGRNVLHALGFDAFGLPAEQYA

SEQ ID NO: 723674 - protein, 20 aa, Mycobacterium
RMLIVPGSMRVRAQAEKEGL

SEQ ID NO: 723675 - protein, 20 aa, Mycobacterium
RMLLPSIRRSEHVWCQLLSE

SEQ ID NO: 723676 - protein, 18 aa, Mycobacterium
RMLLRDRLAAWVVELNSR

SEQ ID NO: 723677 - protein, 18 aa, Mycobacterium
RMLLRPEDELDDAWVEQT

SEQ ID NO: 723678 - protein, 17 aa, Mycobacterium
RMLRAMALLADQDQSVQ

SEQ ID NO: 723679 - protein, 19 aa, Mycobacterium
RMLRLRPASDFNDLTDNPV

SEQ ID NO: 723680 - protein, 22 aa, Mycobacterium
RMLRSGRRAMVMQVDIYGEADD

SEQ ID NO: 723681 - protein, 19 aa, Mycobacterium
RMLSAPVIDRCRVILRHSR

SEQ ID NO: 723682 - protein, 20 aa, Mycobacterium
RMLTANGLRQLISFISRMTT

SEQ ID NO: 723683 - protein, 36 aa, Mycobacterium
RMLTLPATFALYLERAWPRHRRLSSADDARTAVVVG

SEQ ID NO: 723684 - protein, 17 aa, Mycobacterium
RMLVGLLAKGHVLLEGV

SEQ ID NO: 723685 - protein, 20 aa, Mycobacterium
RMLVVPGSMRVRAQAEAEGL

SEQ ID NO: 723686 - protein, 24 aa, Mycobacterium
RMMGACDGCPAASSTLRDVFEREL

SEQ ID NO: 723687 - protein, 20 aa, Mycobacterium
RMMHHVAWHDTCYDVEARPV

SEQ ID NO: 723688 - protein, 26 aa, Mycobacterium
RMMIRACPVTWPWNLLGWPSINVPAG

SEQ ID NO: 723689 - protein, 20 aa, Mycobacterium
RMMTGGFAIRGDLVTLSDID

SEQ ID NO: 723690 - protein, 17 aa, Mycobacterium
RMMVFPFVLGAGDRLFG

SEQ ID NO: 723691 - protein, 19 aa, Mycobacterium
RMNGGFFPSSREYSVRYGL

SEQ ID NO: 723692 - protein, 20 aa, Mycobacterium
RMNGGFFPSVREYSSRFGLS

SEQ ID NO: 723693 - protein, 20 aa, Mycobacterium
RMNGGFFPSVREYSTLYGLS

SEQ ID NO: 723694 - protein, 19 aa, Mycobacterium
RMNGSFFPSAREYSVRYGL

SEQ ID NO: 723695 - protein, 17 aa, Mycobacterium
RMNPHRVLLHMPTGSGK

SEQ ID NO: 723696 - protein, 26 aa, Mycobacterium
RMNQCPVKREWPRLLSHIKNGYLKPN

SEQ ID NO: 723697 - protein, 18 aa, Mycobacterium
RMNSMAFDVMVPLLELLG

SEQ ID NO: 723698 - protein, 18 aa, Mycobacterium
RMPAFGLDGPWRDRVGFA

SEQ ID NO: 723699 - protein, 19 aa, Mycobacterium
RMPAFGLDGPWRDRVGFAP

SEQ ID NO: 723700 - protein, 19 aa, Mycobacterium
RMPAFGLDGPWRERVGFAP

SEQ ID NO: 723701 - protein, 19 aa, Mycobacterium
RMPAGPAKLAIETGAALFP

SEQ ID NO: 723702 - protein, 19 aa, Mycobacterium
RMPAHELCNTLGWEKSRLS

SEQ ID NO: 723703 - protein, 26 aa, Mycobacterium
RMPDAEFEAILGLKRRALVVGRDPGG

SEQ ID NO: 723704 - protein, 25 aa, Mycobacterium
RMPELMSELLWSRIGARYDATIGVD

SEQ ID NO: 723705 - protein, 19 aa, Mycobacterium
RMPGFGLQGPWRDYVGWAL

SEQ ID NO: 723706 - protein, 24 aa, Mycobacterium
RMPKPKPLATRIALVTGAASGIGK

SEQ ID NO: 723707 - protein, 19 aa, Mycobacterium
RMPLHPVAIELLRQVGPMA

SEQ ID NO: 723708 - protein, 19 aa, Mycobacterium
RMPMHPVAIELLRAVGPMA

SEQ ID NO: 723709 - protein, 28 aa, Mycobacterium
RMPQWSPQCRWTHQFGPLRRGARTLNLN

SEQ ID NO: 723710 - protein, 24 aa, Mycobacterium
RMPRIAGPCSVIIFGVTGDLARKK

SEQ ID NO: 723711 - protein, 18 aa, Mycobacterium
RMQARRGPGRVCSRESTV

SEQ ID NO: 723712 - protein, 24 aa, Mycobacterium
RMQGYEVLWLPGMDHAGIATQTVV

SEQ ID NO: 723713 - protein, 20 aa, Mycobacterium
RMQQRWPVVMVDEFQDTDAV

SEQ ID NO: 723714 - protein, 18 aa, Mycobacterium
RMQRSWLDFARDNAEVDE

SEQ ID NO: 723715 - protein, 23 aa, Mycobacterium
RMRAEFFDIGAIVYFLRKVIWSV

SEQ ID NO: 723716 - protein, 18 aa, Mycobacterium
RMRAETGARLRAAMAEHG

SEQ ID NO: 723717 - protein, 23 aa, Mycobacterium
RMRAKARIKFLVKDWGVQKFREV

SEQ ID NO: 723718 - protein, 18 aa, Mycobacterium
RMREEAPVYYSERYDFYA

SEQ ID NO: 723719 - protein, 17 aa, Mycobacterium
RMREIMFGEWIDVDKEV

SEQ ID NO: 723720 - protein, 24 aa, Mycobacterium
RMRGANVLHALGFDAFGLPAEQYA

SEQ ID NO: 723721 - protein, 23 aa, Mycobacterium
RMRGEIAAALGLTAKDLPYVCEL

SEQ ID NO: 723722 - protein, 20 aa, Mycobacterium
RMRGLVPVVRRSAARISSAM

SEQ ID NO: 723723 - protein, 21 aa, Mycobacterium
RMRHGMYWSGDLAYRDSQGWI

SEQ ID NO: 723724 - protein, 21 aa, Mycobacterium
RMRHGMYWSGDLGYRDTQGWI

SEQ ID NO: 723725 - protein, 17 aa, Mycobacterium
RMRKVYRDALPMLTSTQ

SEQ ID NO: 723726 - protein, 17 aa, Mycobacterium
RMRLGALARHIAEELPL

SEQ ID NO: 723727 - protein, 19 aa, Mycobacterium
RMRLTRAAFQRAISMAAVF

SEQ ID NO: 723728 - protein, 20 aa, Mycobacterium
RMRMADLQARVDMLRYGLAG

SEQ ID NO: 723729 - protein, 22 aa, Mycobacterium
RMRMTLRVYAYNSCCNASYPNN

SEQ ID NO: 723730 - protein, 26 aa, Mycobacterium
RMRPGNWAGAYACWGTENREAAVRFV

SEQ ID NO: 723731 - protein, 21 aa, Mycobacterium
RMRQEILAGIGGVRAIRAYTA

SEQ ID NO: 723732 - protein, 23 aa, Mycobacterium
RMRQELLAGIGGVRAIRAFTAIA

SEQ ID NO: 723733 - protein, 25 aa, Mycobacterium
RMRQSMLVQFGRFLRINLKMLRIIY

SEQ ID NO: 723734 - protein, 17 aa, Mycobacterium
RMRRLIAEYGIDTVWFG

SEQ ID NO: 723735 - protein, 17 aa, Mycobacterium
RMRTRWINFATQDNPAG

SEQ ID NO: 723736 - protein, 19 aa, Mycobacterium
RMRTTLGLEHWQLEGRIGG

SEQ ID NO: 723737 - protein, 27 aa, Mycobacterium
RMRWPHGRLRYYLAMLAELSQLRLLPF

SEQ ID NO: 723738 - protein, 19 aa, Mycobacterium
RMRWPHGRMRYNLAMVAEI

SEQ ID NO: 723739 - protein, 25 aa, Mycobacterium
RMSAALDAASAWGLDPFGAAVPPDD

SEQ ID NO: 723740 - protein, 23 aa, Mycobacterium
RMSENAAELWAWLQDGAYVYVCG

SEQ ID NO: 723741 - protein, 17 aa, Mycobacterium
RMSKRAGTVITLDDLVD

SEQ ID NO: 723742 - protein, 17 aa, Mycobacterium
RMSKRAGTVLTLDDLVE

SEQ ID NO: 723743 - protein, 26 aa, Mycobacterium
RMSLLRAPLFPDPDCDQGRHRLQFSV

SEQ ID NO: 723744 - protein, 18 aa, Mycobacterium
RMSPDPSCTLGRHEPGLL

SEQ ID NO: 723745 - protein, 21 aa, Mycobacterium
RMSRMGLAYLRRQVKDPVVRE

SEQ ID NO: 723746 - protein, 20 aa, Mycobacterium
RMSWPHGRMRYNLAMVAELS

SEQ ID NO: 723747 - protein, 25 aa, Mycobacterium
RMSYVQRMAKFLSGQLWESAGSPEV

SEQ ID NO: 723748 - protein, 18 aa, Mycobacterium
RMTARGVTMIEAIQGPPR

SEQ ID NO: 723749 - protein, 19 aa, Mycobacterium
RMTDLGIRVGPWGDDLGRR

SEQ ID NO: 723750 - protein, 18 aa, Mycobacterium
RMTGGFFPSAREYSVLYG

SEQ ID NO: 723751 - protein, 19 aa, Mycobacterium
RMVDVFAKMRGVETAIAHA

SEQ ID NO: 723752 - protein, 23 aa, Mycobacterium
RMVFDSDWRHLFVSLRSRSISVE

SEQ ID NO: 723753 - protein, 19 aa, Mycobacterium
RMVFHEITEPAILEAAENP

SEQ ID NO: 723754 - protein, 18 aa, Mycobacterium
RMVKRLKGVSDYVNTLSD

SEQ ID NO: 723755 - protein, 20 aa, Mycobacterium
RMVLPEPPAHRMERSDLTAA

SEQ ID NO: 723756 - protein, 23 aa, Mycobacterium
RMVPMRRAGHVDEMASAAVFLAS

SEQ ID NO: 723757 - protein, 19 aa, Mycobacterium
RMVRQLCYEHDVAGVDVVE

SEQ ID NO: 723758 - protein, 21 aa, Mycobacterium
RMVRVQEEILPGGVQPARGTK

SEQ ID NO: 723759 - protein, 24 aa, Mycobacterium
RMVRWPRQVLAEFGLYLPDDVAIR

SEQ ID NO: 723760 - protein, 25 aa, Mycobacterium
RMVRWPRQVLSEFGLSLPEGVDVRV

SEQ ID NO: 723761 - protein, 25 aa, Mycobacterium
RMVWKMCSISQWWCAFGKKRRGRKG

SEQ ID NO: 723762 - protein, 18 aa, Mycobacterium
RMWAASGVDYPTLLATMV

SEQ ID NO: 723763 - protein, 19 aa, Mycobacterium
RMWENAAEIFGWLEEGAHV

SEQ ID NO: 723764 - protein, 19 aa, Mycobacterium
RMWFLSRLEPGSHYYNVPI

SEQ ID NO: 723765 - protein, 17 aa, Mycobacterium
RMWPHQLLTAFAARRMQ

SEQ ID NO: 723766 - protein, 18 aa, Mycobacterium
RMYAGPGPFSLMAAAVAW

SEQ ID NO: 723767 - protein, 18 aa, Mycobacterium
RMYLLLKQRAEAFRADPA

SEQ ID NO: 723768 - protein, 22 aa, Mycobacterium
RMYPDSLDIMGWSVNHNGFQLV

SEQ ID NO: 723769 - protein, 17 aa, Mycobacterium
RMYRTGDLVCWGEDGQL

SEQ ID NO: 723770 - protein, 25 aa, Mycobacterium
RMYTMAGEGFAHWLGLDDEDVLLTT

SEQ ID NO: 723771 - protein, 23 aa, Mycobacterium
RNAAELVGLPARLHSGGHTSTSR

SEQ ID NO: 723772 - protein, 21 aa, Mycobacterium
RNAAFEFAQLTLPAPSVGGAT

SEQ ID NO: 723773 - protein, 35 aa, Mycobacterium
RNAAKFKKMSRMSWRSMIRDGLAMRHGKELTWSQV

SEQ ID NO: 723774 - protein, 25 aa, Mycobacterium
RNAAKFKKMTGMSWASMVKDGLAMR

SEQ ID NO: 723775 - protein, 18 aa, Mycobacterium
RNAATYWRSKAKEADGKV

SEQ ID NO: 723776 - protein, 18 aa, Mycobacterium
RNAATYWRSKAKEGDGTI

SEQ ID NO: 723777 - protein, 20 aa, Mycobacterium
RNACLRTDVREIRWEADESR

SEQ ID NO: 723778 - protein, 27 aa, Mycobacterium
RNAFRPSARLARPYVVVSADVVVAEDS

SEQ ID NO: 723779 - protein, 17 aa, Mycobacterium
RNAGGKLLKGRLREQVR

SEQ ID NO: 723780 - protein, 17 aa, Mycobacterium
RNAGGLVTDDAIRSAML

SEQ ID NO: 723781 - protein, 18 aa, Mycobacterium
RNAGLHFVCRDVWLEVAS

SEQ ID NO: 723782 - protein, 21 aa, Mycobacterium
RNAIARWVRRHGLIGIDGKPL

SEQ ID NO: 723783 - protein, 20 aa, Mycobacterium
RNAIELCRALGVTFAEIDIR

SEQ ID NO: 723784 - protein, 20 aa, Mycobacterium
RNAIELCRALGVTFSEIDIT

SEQ ID NO: 723785 - protein, 27 aa, Mycobacterium
RNAILFRPSPYAVRCCEQSIEILRTAA

SEQ ID NO: 723786 - protein, 29 aa, Mycobacterium
RNAILFRPSPYAVRCCERSLEILRAAAEA

SEQ ID NO: 723787 - protein, 26 aa, Mycobacterium
RNAILFRPSPYAVRSCERSLAVLRTA

SEQ ID NO: 723788 - protein, 20 aa, Mycobacterium
RNAKARLLRDNIVVAENLSI

SEQ ID NO: 723789 - protein, 20 aa, Mycobacterium
RNAKARLLRDNIVVAETVTI

SEQ ID NO: 723790 - protein, 23 aa, Mycobacterium
RNAKLASIPVGFAGRAALGFGKR

SEQ ID NO: 723791 - protein, 23 aa, Mycobacterium
RNAKLASIPVGFAGRAALGVGKR

SEQ ID NO: 723792 - protein, 20 aa, Mycobacterium
RNALARSAYQLGVVERALEL

SEQ ID NO: 723793 - protein, 30 aa, Mycobacterium
RNALKAVPAERLWVNPDCGLKTRKTDEVTE

SEQ ID NO: 723794 - protein, 25 aa, Mycobacterium
RNALPKRVFDEWLAVIAERTGTDPE

SEQ ID NO: 723795 - protein, 18 aa, Mycobacterium
RNALPPAGHIGVFDRSHY

SEQ ID NO: 723796 - protein, 23 aa, Mycobacterium
RNALRKWLARVRVGPEEALNVLV

SEQ ID NO: 723797 - protein, 19 aa, Mycobacterium
RNALSSGLVRQLREGLQRA

SEQ ID NO: 723798 - protein, 18 aa, Mycobacterium
RNAPHAFGNLGLVNIAIW

SEQ ID NO: 723799 - protein, 21 aa, Mycobacterium
RNAPLLWRFWPALSAGCDDLE

SEQ ID NO: 723800 - protein, 24 aa, Mycobacterium
RNARLRRHARLRKKVAGTAEVPRL

SEQ ID NO: 723801 - protein, 19 aa, Mycobacterium
RNAVVRRTAHRIVDSVRTA

SEQ ID NO: 723802 - protein, 17 aa, Mycobacterium
RNAYTAEMGRLLNAAYR

SEQ ID NO: 723803 - protein, 20 aa, Mycobacterium
RNCEYEWAHHAFIGKAEGLT

SEQ ID NO: 723804 - protein, 19 aa, Mycobacterium
RNCGIHPVVVHGGGPQITA

SEQ ID NO: 723805 - protein, 25 aa, Mycobacterium
RNDEARAKWNAWVERRARQLERGGA

SEQ ID NO: 723806 - protein, 19 aa, Mycobacterium
RNDHELRALLSARRVTPHV

SEQ ID NO: 723807 - protein, 20 aa, Mycobacterium
RNDHGRWPQSVGLSVWGTSA

SEQ ID NO: 723808 - protein, 22 aa, Mycobacterium
RNDPRAWIAQPVMQLSTVPTQI

SEQ ID NO: 723809 - protein, 39 aa, Mycobacterium
RNEAIIVVPRWWKALWYLERLSPALSMRTAAVALKRTRE

SEQ ID NO: 723810 - protein, 26 aa, Mycobacterium
RNEDGRWTVQLAWKAGRSDNLAHFRF

SEQ ID NO: 723811 - protein, 24 aa, Mycobacterium
RNEDGRWTVQLAWQAGHSDNLAHF

SEQ ID NO: 723812 - protein, 26 aa, Mycobacterium
RNEDNRWTVQLAWKVGRSDNLAHFCF

SEQ ID NO: 723813 - protein, 20 aa, Mycobacterium
RNEDPACPAGSYVDAKAIKN

SEQ ID NO: 723814 - protein, 20 aa, Mycobacterium
RNEDPACPAGSYVGPKAIKN

SEQ ID NO: 723815 - protein, 25 aa, Mycobacterium
RNEDSRWTVQLAWKAGLSDNVAHFR

SEQ ID NO: 723816 - protein, 26 aa, Mycobacterium
RNEDSRWTVQLAWKAGRSDNIAHFCF

SEQ ID NO: 723817 - protein, 25 aa, Mycobacterium
RNEDSRWTVQLAWKAGRSDNVAHFR

SEQ ID NO: 723818 - protein, 19 aa, Mycobacterium
RNEGQWALGNREPLNANEE

SEQ ID NO: 723819 - protein, 21 aa, Mycobacterium
RNEGVLGWLHSVARSHVEVAL

SEQ ID NO: 723820 - protein, 23 aa, Mycobacterium
RNEHKRHRYAFSPFGGGAHKCIG

SEQ ID NO: 723821 - protein, 23 aa, Mycobacterium
RNEHKRHRYAFTPFGGGAHKCLG

SEQ ID NO: 723822 - protein, 20 aa, Mycobacterium
RNEKNWSRERLAGQMHKSVS

SEQ ID NO: 723823 - protein, 21 aa, Mycobacterium
RNELFPIASLVTPNLDEVRLI

SEQ ID NO: 723824 - protein, 25 aa, Mycobacterium
RNELGIPVAYKLVPKDVVPVMVQEG

SEQ ID NO: 723825 - protein, 23 aa, Mycobacterium
RNELVALVISNLFGQNAPAIAAT

SEQ ID NO: 723826 - protein, 30 aa, Mycobacterium
RNEVAADLRTDWPATLHAAGFEPGQPSAWS

SEQ ID NO: 723827 - protein, 17 aa, Mycobacterium
RNEVFWWDHEIGDLEKV

SEQ ID NO: 723828 - protein, 18 aa, Mycobacterium
RNEWLFGQSWGIDVAVST

SEQ ID NO: 723829 - protein, 18 aa, Mycobacterium
RNFHAWTFEGMALGQPDL

SEQ ID NO: 723830 - protein, 19 aa, Mycobacterium
RNFIRRLGVSPDQYRKTSA

SEQ ID NO: 723831 - protein, 21 aa, Mycobacterium
RNFLLPRGLAIMASRGAQRQA

SEQ ID NO: 723832 - protein, 23 aa, Mycobacterium
RNFYALDRLWRDCPIVPVDLDSP

SEQ ID NO: 723833 - protein, 20 aa, Mycobacterium
RNGAPVATPLEWDELDAGRL

SEQ ID NO: 723834 - protein, 19 aa, Mycobacterium
RNGAPVLGVCVGMQILFER

SEQ ID NO: 723835 - protein, 18 aa, Mycobacterium
RNGARIAVDGAQLAPHRR

SEQ ID NO: 723836 - protein, 21 aa, Mycobacterium
RNGDGRWAVTIRCAELSADGT

SEQ ID NO: 723837 - protein, 21 aa, Mycobacterium
RNGERYQFLRWGQGAFDDFKV

SEQ ID NO: 723838 - protein, 30 aa, Mycobacterium
RNGERYQFLRWGQGAFQDFKVVPPGTGIVH

SEQ ID NO: 723839 - protein, 20 aa, Mycobacterium
RNGEVLVRMAVAGICHSDDH

SEQ ID NO: 723840 - protein, 18 aa, Mycobacterium
RNGFGPAALRDWLRTQCS

SEQ ID NO: 723841 - protein, 24 aa, Mycobacterium
RNGGLRYAQRADLATREEQIAIAE

SEQ ID NO: 723842 - protein, 26 aa, Mycobacterium
RNGGQTWLKDLGCAIYHEHASFLSPT

SEQ ID NO: 723843 - protein, 22 aa, Mycobacterium
RNGHGGALRYCGADAVVTDLRD

SEQ ID NO: 723844 - protein, 26 aa, Mycobacterium
RNGIDTEVWFPAGPVGTASVLAELGV

SEQ ID NO: 723845 - protein, 26 aa, Mycobacterium
RNGILASMCFPTFTGFSARHLNMTRE

SEQ ID NO: 723846 - protein, 24 aa, Mycobacterium
RNGITAFVVDGRWDGVGHGTPFEK

SEQ ID NO: 723847 - protein, 19 aa, Mycobacterium
RNGKGFGIADPRVVTKAEA

SEQ ID NO: 723848 - protein, 25 aa, Mycobacterium
RNGKPRIAGVSSFGFAGTNAHVILE

SEQ ID NO: 723849 - protein, 21 aa, Mycobacterium
RNGLAISWPRGMTAAGEQRGQ

SEQ ID NO: 723850 - protein, 30 aa, Mycobacterium
RNGLPVPLKPYFEADWRFHQTILDHCGNGF

SEQ ID NO: 723851 - protein, 17 aa, Mycobacterium
RNGQRWQVLAVDREHDR

SEQ ID NO: 723852 - protein, 22 aa, Mycobacterium
RNGRGNPSFAARLDVIRLPIDV

SEQ ID NO: 723853 - protein, 21 aa, Mycobacterium
RNGRPRSVIGVRVNPQTGAGT

SEQ ID NO: 723854 - protein, 26 aa, Mycobacterium
RNGSGPVIWLRADFDALPVQEQTGLP

SEQ ID NO: 723855 - protein, 24 aa, Mycobacterium
RNGSIYLPLSRRPGGIQCFKQIIP

SEQ ID NO: 723856 - protein, 29 aa, Mycobacterium
RNGVRRPDLDAVRPCPPVVIWSLSPPDLR

SEQ ID NO: 723857 - protein, 18 aa, Mycobacterium
RNGWWLVARTKIIDDAIA

SEQ ID NO: 723858 - protein, 21 aa, Mycobacterium
RNGYESVRWWHELERDLAQPI

SEQ ID NO: 723859 - protein, 18 aa, Mycobacterium
RNGYGIVGADTLRKSVTF

SEQ ID NO: 723860 - protein, 28 aa, Mycobacterium
RNHAMMIVRYLIDRRVSVEIPPVGAVTN

SEQ ID NO: 723861 - protein, 18 aa, Mycobacterium
RNHARILADLGVEPDRLR

SEQ ID NO: 723862 - protein, 24 aa, Mycobacterium
RNHARKALKAALVPTVVTSRNPRP

SEQ ID NO: 723863 - protein, 21 aa, Mycobacterium
RNHARLMRKTFMGNPILCDLI

SEQ ID NO: 723864 - protein, 22 aa, Mycobacterium
RNHDGLRACLRSTLASGKLGAH

SEQ ID NO: 723865 - protein, 19 aa, Mycobacterium
RNHKGSTWVLSLSAGRLVA

SEQ ID NO: 723866 - protein, 17 aa, Mycobacterium
RNHLRMLHQLGVDEERV

SEQ ID NO: 723867 - protein, 17 aa, Mycobacterium
RNHLRMLQHMGVPAERL

SEQ ID NO: 723868 - protein, 20 aa, Mycobacterium
RNHMRDMLFLFKGDRSTSPF

SEQ ID NO: 723869 - protein, 19 aa, Mycobacterium
RNHMRDMLFLFKGTPSTSP

SEQ ID NO: 723870 - protein, 25 aa, Mycobacterium
RNHQNAWRPAHIHFSVFGTAFTQRM

SEQ ID NO: 723871 - protein, 18 aa, Mycobacterium
RNHVSRILASFDHTLGVQ

SEQ ID NO: 723872 - protein, 19 aa, Mycobacterium
RNIFPADIERLAASVHGIR

SEQ ID NO: 723873 - protein, 24 aa, Mycobacterium
RNIFPTEIERIAARVKGVREGAVV

SEQ ID NO: 723874 - protein, 23 aa, Mycobacterium
RNILESFKLLTNVSKLFAERCIT

SEQ ID NO: 723875 - protein, 23 aa, Mycobacterium
RNILESFKLLTNVSKLFAQRCIT

SEQ ID NO: 723876 - protein, 21 aa, Mycobacterium
RNILESFTLLTNVSKLFAQRC

SEQ ID NO: 723877 - protein, 20 aa, Mycobacterium
RNIRPRVVFMEASDDMLVRR

SEQ ID NO: 723878 - protein, 25 aa, Mycobacterium
RNIWSNAVIFCGHFPDGAEKFTKQD

SEQ ID NO: 723879 - protein, 25 aa, Mycobacterium
RNLARFAAGSARVLVATDIAARGVH

SEQ ID NO: 723880 - protein, 24 aa, Mycobacterium
RNLAWRAAELMAEHVGRAPDVAIS

SEQ ID NO: 723881 - protein, 26 aa, Mycobacterium
RNLCARAAECGELSYTRSYRPTPPDD

SEQ ID NO: 723882 - protein, 17 aa, Mycobacterium
RNLCLYPNVYVMDQFST

SEQ ID NO: 723883 - protein, 22 aa, Mycobacterium
RNLCVYPNVYVMDQFSTQIRHF

SEQ ID NO: 723884 - protein, 18 aa, Mycobacterium
RNLEAMFFMSQAIAAELK

SEQ ID NO: 723885 - protein, 17 aa, Mycobacterium
RNLETMFFMSQAVAAEL

SEQ ID NO: 723886 - protein, 17 aa, Mycobacterium
RNLGAIVRSVAAFGGHG

SEQ ID NO: 723887 - protein, 17 aa, Mycobacterium
RNLGGHLCHLRWNLCCH

SEQ ID NO: 723888 - protein, 17 aa, Mycobacterium
RNLGKWWRDYGFQAYQG

SEQ ID NO: 723889 - protein, 24 aa, Mycobacterium
RNLKLFPSDAVGISGMKAWRAVLP

SEQ ID NO: 723890 - protein, 24 aa, Mycobacterium
RNLKTRHPRSLKVCTLLRKPDAKG

SEQ ID NO: 723891 - protein, 17 aa, Mycobacterium
RNLLWRAASALDANHPD

SEQ ID NO: 723892 - protein, 17 aa, Mycobacterium
RNLLYWHAIEELEHKSV

SEQ ID NO: 723893 - protein, 23 aa, Mycobacterium
RNLMHCSWISFTEQGKFPAPLTT

SEQ ID NO: 723894 - protein, 24 aa, Mycobacterium
RNLPRMLVPLANILGPALFQSAQM

SEQ ID NO: 723895 - protein, 17 aa, Mycobacterium
RNLPSRPTVPVLAGVLL

SEQ ID NO: 723896 - protein, 19 aa, Mycobacterium
RNLPTPGGNTFEWDQDSTY

SEQ ID NO: 723897 - protein, 18 aa, Mycobacterium
RNLPVFGYQDREGHAEID

SEQ ID NO: 723898 - protein, 17 aa, Mycobacterium
RNLREGVLLSHPEAVAL

SEQ ID NO: 723899 - protein, 17 aa, Mycobacterium
RNLRLAMAAGQITYDDH

SEQ ID NO: 723900 - protein, 17 aa, Mycobacterium
RNLRQSWHDGMEPFCGV

SEQ ID NO: 723901 - protein, 23 aa, Mycobacterium
RNLVCSCPSPAAFESTLPPKSAS

SEQ ID NO: 723902 - protein, 17 aa, Mycobacterium
RNMAFYNFPLRLLKRTW

SEQ ID NO: 723903 - protein, 24 aa, Mycobacterium
RNMIKKRFGRLIFMGSVAGQIGLP

SEQ ID NO: 723904 - protein, 21 aa, Mycobacterium
RNMPRLIALWPAHDTYVKRTG

SEQ ID NO: 723905 - protein, 23 aa, Mycobacterium
RNMRLVLGVYAYKSCCGDSYPDN

SEQ ID NO: 723906 - protein, 19 aa, Mycobacterium
RNNGAEAMVLWKSDALLEA

SEQ ID NO: 723907 - protein, 24 aa, Mycobacterium
RNNGAEVTVFWKSHPKLATPDLQI

SEQ ID NO: 723908 - protein, 17 aa, Mycobacterium
RNNHIRSLASFHQTFDC

SEQ ID NO: 723909 - protein, 23 aa, Mycobacterium
RNNLPVPPAFCITSEVGVRYLAD

SEQ ID NO: 723910 - protein, 18 aa, Mycobacterium
RNNPGVCYQNVYPPEMLD

SEQ ID NO: 723911 - protein, 23 aa, Mycobacterium
RNNPLMRRLRVMRSNAERRETVG

SEQ ID NO: 723912 - protein, 26 aa, Mycobacterium
RNNPLYERFGFKVVEEIKPTTHGPSL

SEQ ID NO: 723913 - protein, 19 aa, Mycobacterium
RNPAALCYALLAYGFTFRD

SEQ ID NO: 723914 - protein, 26 aa, Mycobacterium
RNPAGKADYRWAKEVSETEKVDLVNS

SEQ ID NO: 723915 - protein, 24 aa, Mycobacterium
RNPDELRRHIGYVVQGAGLFPHLT

SEQ ID NO: 723916 - protein, 26 aa, Mycobacterium
RNPDLPGLHTGLWAQYLLDQAATVEE

SEQ ID NO: 723917 - protein, 19 aa, Mycobacterium
RNPELMKAFKMSARGGLLL

SEQ ID NO: 723918 - protein, 27 aa, Mycobacterium
RNPERVWGWYLWRHYLVADVAPNPGHQ

SEQ ID NO: 723919 - protein, 29 aa, Mycobacterium
RNPFDVDSPRRWTHVRLTMYPDGGVARLR

SEQ ID NO: 723920 - protein, 18 aa, Mycobacterium
RNPFRVFTSMLATGDSRF

SEQ ID NO: 723921 - protein, 18 aa, Mycobacterium
RNPFRVFTSMLTVADGRF

SEQ ID NO: 723922 - protein, 28 aa, Mycobacterium
RNPGGYTCHWVRPEWILDPEADPETASD

SEQ ID NO: 723923 - protein, 17 aa, Mycobacterium
RNPHSWHDFCAKGRTAA

SEQ ID NO: 723924 - protein, 17 aa, Mycobacterium
RNPHTWLGTASCGGRIA

SEQ ID NO: 723925 - protein, 22 aa, Mycobacterium
RNPHVGFGMGVHRCIGMHLARQ

SEQ ID NO: 723926 - protein, 19 aa, Mycobacterium
RNPIAIIVPCHRVIGASGK

SEQ ID NO: 723927 - protein, 17 aa, Mycobacterium
RNPMLLATIGWDLQAYS

SEQ ID NO: 723928 - protein, 17 aa, Mycobacterium
RNPMVAVLFAMQSPPPV

SEQ ID NO: 723929 - protein, 20 aa, Mycobacterium
RNPRALAAVRELWTTRDNIA

SEQ ID NO: 723930 - protein, 19 aa, Mycobacterium
RNPRAWIAYDDPFGDWHED

SEQ ID NO: 723931 - protein, 20 aa, Mycobacterium
RNPRLVYARLSAYGGNGPHG

SEQ ID NO: 723932 - protein, 18 aa, Mycobacterium
RNPWRMALSQLWTAHIEW

SEQ ID NO: 723933 - protein, 20 aa, Mycobacterium
RNQGAFGFSEPCTDCRGSGS

SEQ ID NO: 723934 - protein, 21 aa, Mycobacterium
RNQKGPVYWTVCRVVECERGR

SEQ ID NO: 723935 - protein, 25 aa, Mycobacterium
RNQLLPRFANAYVRDTVARLCADSS

SEQ ID NO: 723936 - protein, 27 aa, Mycobacterium
RNQLPAYIRAGWDIGQNITTYVDAVHR

SEQ ID NO: 723937 - protein, 19 aa, Mycobacterium
RNQPRCFVSQILDVTAERM

SEQ ID NO: 723938 - protein, 24 aa, Mycobacterium
RNQRELLCRNQGKTAEDLIARYFE

SEQ ID NO: 723939 - protein, 24 aa, Mycobacterium
RNQRPADDVYLVFTTNEEIGGVGG

SEQ ID NO: 723940 - protein, 25 aa, Mycobacterium
RNQRPTSRMPYRWDDNYPARIGVMP

SEQ ID NO: 723941 - protein, 17 aa, Mycobacterium
RNQVPWPKPPVLCTVAL

SEQ ID NO: 723942 - protein, 21 aa, Mycobacterium
RNRADMFVHITLVGLLNSPRL

SEQ ID NO: 723943 - protein, 27 aa, Mycobacterium
RNRALGLLYRWVEHAFGGREHELTGAY

SEQ ID NO: 723944 - protein, 26 aa, Mycobacterium
RNRALGLLYRWVEQAFGGREHELTGA

SEQ ID NO: 723945 - protein, 20 aa, Mycobacterium
RNRAWLICRLDFKGRRRELM

SEQ ID NO: 723946 - protein, 24 aa, Mycobacterium
RNRDELRLSVALRCPQPCDVDALA

SEQ ID NO: 723947 - protein, 19 aa, Mycobacterium
RNRECTARLVALAERRPEP

SEQ ID NO: 723948 - protein, 25 aa, Mycobacterium
RNRENLGWNAPRLHLVDLQYSDVRL

SEQ ID NO: 723949 - protein, 20 aa, Mycobacterium
RNRFWAHGTLGPARATASAL

SEQ ID NO: 723950 - protein, 20 aa, Mycobacterium
RNRGPAARCRVCNKDLATAA

SEQ ID NO: 723951 - protein, 24 aa, Mycobacterium
RNRGREMVEFAAAYRESGVQPPRA

SEQ ID NO: 723952 - protein, 20 aa, Mycobacterium
RNRIELVAFGGAKLGRNGQD

SEQ ID NO: 723953 - protein, 19 aa, Mycobacterium
RNRIRAHLARHERRTVDDP

SEQ ID NO: 723954 - protein, 23 aa, Mycobacterium
RNRKELRIIAGLDVGPARSPGAE

SEQ ID NO: 723955 - protein, 18 aa, Mycobacterium
RNRKGSMWVLSMRGQKLL

SEQ ID NO: 723956 - protein, 21 aa, Mycobacterium
RNRLPGCRTVPDWDKVLHADL

SEQ ID NO: 723957 - protein, 18 aa, Mycobacterium
RNRMFWPTTCTIVEVIPE

SEQ ID NO: 723958 - protein, 22 aa, Mycobacterium
RNRMISWPYTKLMNSNNMVDQG

SEQ ID NO: 723959 - protein, 21 aa, Mycobacterium
RNRNNVVLSRRAWLEQTQSEV

SEQ ID NO: 723960 - protein, 22 aa, Mycobacterium
RNRPGRRPVLVGIDGSKTSLHA

SEQ ID NO: 723961 - protein, 19 aa, Mycobacterium
RNRPHLILDGLRLAAAMVG

SEQ ID NO: 723962 - protein, 25 aa, Mycobacterium
RNRRGELDMSIAMVISNHPDLADQV

SEQ ID NO: 723963 - protein, 23 aa, Mycobacterium
RNRRGELEMSVVMVIANHPELAD

SEQ ID NO: 723964 - protein, 18 aa, Mycobacterium
RNRSSWNTMFLYGSPSNI

SEQ ID NO: 723965 - protein, 25 aa, Mycobacterium
RNRVARLRLGIGVTDSGRRNPAVTA

SEQ ID NO: 723966 - protein, 29 aa, Mycobacterium
RNRVGLPGIWYAGSHGFDLMAPDGTRYQH

SEQ ID NO: 723967 - protein, 18 aa, Mycobacterium
RNRYRWRSSAAPDVTWDS

SEQ ID NO: 723968 - protein, 24 aa, Mycobacterium
RNSAKPYLALGLSFRDGGLAPETR

SEQ ID NO: 723969 - protein, 18 aa, Mycobacterium
RNSEFVIARMYRKFLSDG

SEQ ID NO: 723970 - protein, 19 aa, Mycobacterium
RNSEGLYLLQRVRDEAHRF

SEQ ID NO: 723971 - protein, 18 aa, Mycobacterium
RNSLIGGIRYYDTVVDDA

SEQ ID NO: 723972 - protein, 17 aa, Mycobacterium
RNSRALYRETRRIGQQD

SEQ ID NO: 723973 - protein, 17 aa, Mycobacterium
RNTENPLHLAFKTYHPF

SEQ ID NO: 723974 - protein, 23 aa, Mycobacterium
RNTGKEFWPLQLLATNKDGTPTG

SEQ ID NO: 723975 - protein, 26 aa, Mycobacterium
RNTHGCSWLPLYHDMGLSMIGFPTVY

SEQ ID NO: 723976 - protein, 28 aa, Mycobacterium
RNTHGMSWLPLYHDMGLSMIGFPAVYGG

SEQ ID NO: 723977 - protein, 27 aa, Mycobacterium
RNTHGVSWLPLYHDMGLSMIGFPAVYG

SEQ ID NO: 723978 - protein, 20 aa, Mycobacterium
RNTINPKRVAAMTMQTVMFI

SEQ ID NO: 723979 - protein, 19 aa, Mycobacterium
RNTPELSRRDAIRRAGLLG

SEQ ID NO: 723980 - protein, 18 aa, Mycobacterium
RNTRGCKLVTLGNYGKYV

SEQ ID NO: 723981 - protein, 23 aa, Mycobacterium
RNTRGHLGFGYGVHQCIGANLAR

SEQ ID NO: 723982 - protein, 17 aa, Mycobacterium
RNTRRWWSLEAGEQIGY

SEQ ID NO: 723983 - protein, 19 aa, Mycobacterium
RNTVRFDRAAAAAVRAGAN

SEQ ID NO: 723984 - protein, 29 aa, Mycobacterium
RNVALAAEICDGWLPIFYTPRMADTYNAW

SEQ ID NO: 723985 - protein, 35 aa, Mycobacterium
RNVDYAAFNEVHWVAPAEAVWACRNLAATHYASGG

SEQ ID NO: 723986 - protein, 36 aa, Mycobacterium
RNVDYSAFNEVHWVAPAEAVWACRSMAATHYASGGW

SEQ ID NO: 723987 - protein, 21 aa, Mycobacterium
RNVEVPDHFRTYVSEKLSRLE

SEQ ID NO: 723988 - protein, 26 aa, Mycobacterium
RNVIPEDHFRIGSCTKSFTATMILQA

SEQ ID NO: 723989 - protein, 24 aa, Mycobacterium
RNVKDPWLRRNLLPAYRAGSRRIL

SEQ ID NO: 723990 - protein, 19 aa, Mycobacterium
RNVKGPGVVPVLSETPGTI

SEQ ID NO: 723991 - protein, 25 aa, Mycobacterium
RNVKGRRVGGLSIGYRINHSTKTAA

SEQ ID NO: 723992 - protein, 24 aa, Mycobacterium
RNVLPRLSAQRAILQAVDLTAMDL

SEQ ID NO: 723993 - protein, 19 aa, Mycobacterium
RNVLRLEPRMRQVARDIVA

SEQ ID NO: 723994 - protein, 19 aa, Mycobacterium
RNVPFHALVTYRDLGIEPV

SEQ ID NO: 723995 - protein, 18 aa, Mycobacterium
RNVPLKVVHVFAPMVTPA

SEQ ID NO: 723996 - protein, 17 aa, Mycobacterium
RNVQFYCIDLGGGGLIY

SEQ ID NO: 723997 - protein, 19 aa, Mycobacterium
RNVRADVRAALWPLLVGNI

SEQ ID NO: 723998 - protein, 17 aa, Mycobacterium
RNVSRGLVDVALYALAQ

SEQ ID NO: 723999 - protein, 19 aa, Mycobacterium
RNVTPDGQHPLPTTDASGE

SEQ ID NO: 724000 - protein, 19 aa, Mycobacterium
RNVVFGRGIAILAGGDAAI

SEQ ID NO: 724001 - protein, 24 aa, Mycobacterium
RNVWAHAIIFCGHFPDQAYTFTQE

SEQ ID NO: 724002 - protein, 25 aa, Mycobacterium
RNVWSNAVIFCGHFPDGAEKFTKTD

SEQ ID NO: 724003 - protein, 25 aa, Mycobacterium
RNVWTNAVIFCGHFPDGAEKFTKTD

SEQ ID NO: 724004 - protein, 17 aa, Mycobacterium
RNWGRWGEDDERGTLNF

SEQ ID NO: 724005 - protein, 21 aa, Mycobacterium
RNWITRAGMGIQYLLLRSGPL

SEQ ID NO: 724006 - protein, 21 aa, Mycobacterium
RNWITRAGMGIQYLLLRSGPM

SEQ ID NO: 724007 - protein, 26 aa, Mycobacterium
RNWQGLRPLSVWQRPEVIAVASEIDS

SEQ ID NO: 724008 - protein, 17 aa, Mycobacterium
RNWREALELAAERHFDT

SEQ ID NO: 724009 - protein, 18 aa, Mycobacterium
RNWREALELPAERHVDTF

SEQ ID NO: 724010 - protein, 17 aa, Mycobacterium
RNWRRRARVLPHPHVLE

SEQ ID NO: 724011 - protein, 24 aa, Mycobacterium
RNYIKALCKGVVKVMSKMGISTVA

SEQ ID NO: 724012 - protein, 24 aa, Mycobacterium
RNYLLPRGLAIVASRGAERQAEEI

SEQ ID NO: 724013 - protein, 23 aa, Mycobacterium
RNYLLPRGLAIVASRGAQKQADD

SEQ ID NO: 724014 - protein, 24 aa, Mycobacterium
RNYLLPRGLAIVATRGAQRQADDI

SEQ ID NO: 724015 - protein, 18 aa, Mycobacterium
RNYLMAKLTKLMRTAFDL

SEQ ID NO: 724016 - protein, 23 aa, Mycobacterium
RNYLYPHWESFFGGIAPERIAEL

SEQ ID NO: 724017 - protein, 37 aa, Mycobacterium
RNYPRTAAELSSWQRSWALACQKAFAGLEVDPNRVRE

SEQ ID NO: 724018 - protein, 19 aa, Mycobacterium
RNYWGYNTFGFFAPHNQYA

SEQ ID NO: 724019 - protein, 20 aa, Mycobacterium
RNYWGYNTFGFFAPHNQYAA

SEQ ID NO: 724020 - protein, 17 aa, Mycobacterium
RNYYQRIGVSFELPNHY

SEQ ID NO: 724021 - protein, 20 aa, Mycobacterium
RPAAALCRLPGGGRLLTKMF

SEQ ID NO: 724022 - protein, 18 aa, Mycobacterium
RPAAELFAAPQHEYTRTL

SEQ ID NO: 724023 - protein, 32 aa, Mycobacterium
RPAAERTGLVAFSLHYPWSQGLAVHSLDGRDL

SEQ ID NO: 724024 - protein, 31 aa, Mycobacterium
RPAAERTGLVAFSLHYPWSQKLPVHSLDGAT

SEQ ID NO: 724025 - protein, 31 aa, Mycobacterium
RPAAGAPLTWPAGWSAWPPRGYGDTRLEMAE

SEQ ID NO: 724026 - protein, 19 aa, Mycobacterium
RPAAGLADHVLWLDDPDPR

SEQ ID NO: 724027 - protein, 20 aa, Mycobacterium
RPAALRRLGLDFAAVSDRNP

SEQ ID NO: 724028 - protein, 18 aa, Mycobacterium
RPAAQLLWAEHQAATPAV

SEQ ID NO: 724029 - protein, 17 aa, Mycobacterium
RPAARKRVIGMRKTFQR

SEQ ID NO: 724030 - protein, 24 aa, Mycobacterium
RPAARRRAGLFLAEGPNLVEAALR

SEQ ID NO: 724031 - protein, 19 aa, Mycobacterium
RPAATWDAGLWDRLGQLGL

SEQ ID NO: 724032 - protein, 21 aa, Mycobacterium
RPAAVMLSFGELQPFADRIRA

SEQ ID NO: 724033 - protein, 17 aa, Mycobacterium
RPAAVVITPSRPVNPPR

SEQ ID NO: 724034 - protein, 23 aa, Mycobacterium
RPADARAALKLVARLLREYGYEP

SEQ ID NO: 724035 - protein, 25 aa, Mycobacterium
RPADELETSFAWALIRIKGTTNSMF

SEQ ID NO: 724036 - protein, 23 aa, Mycobacterium
RPADEPGSGWAVVDVETTGFRPG

SEQ ID NO: 724037 - protein, 20 aa, Mycobacterium
RPADEVGPIRPARLAPGGAV

SEQ ID NO: 724038 - protein, 26 aa, Mycobacterium
RPADGAPAWLRFFGCNPRHHSLAFLP

SEQ ID NO: 724039 - protein, 26 aa, Mycobacterium
RPADGAPAWLRFLGVNPRHHSLAFMP

SEQ ID NO: 724040 - protein, 20 aa, Mycobacterium
RPADSGLIYLSLGSLGGADV

SEQ ID NO: 724041 - protein, 25 aa, Mycobacterium
RPAEAVAAAARWVREELDYLPGTTS

SEQ ID NO: 724042 - protein, 22 aa, Mycobacterium
RPAEEMLYLAMEDFRVDIVVGK

SEQ ID NO: 724043 - protein, 21 aa, Mycobacterium
RPAELHPFVELDGGRHRAPST

SEQ ID NO: 724044 - protein, 21 aa, Mycobacterium
RPAELHPFVELKGPRHTAPAT

SEQ ID NO: 724045 - protein, 19 aa, Mycobacterium
RPAELKIARSRRLVKVEYR

SEQ ID NO: 724046 - protein, 24 aa, Mycobacterium
RPAEVLRAGYWTDLIGAAEHGLID

SEQ ID NO: 724047 - protein, 22 aa, Mycobacterium
RPAFAYWGWRAITDDPDPWNPE

SEQ ID NO: 724048 - protein, 23 aa, Mycobacterium
RPAFDVAAFWARAGLAHLLTRPG

SEQ ID NO: 724049 - protein, 18 aa, Mycobacterium
RPAFEVNDFRGIDLADQR

SEQ ID NO: 724050 - protein, 21 aa, Mycobacterium
RPAFGDSYGGLAIAGGIAAAL

SEQ ID NO: 724051 - protein, 26 aa, Mycobacterium
RPAFPLMCGAGYGRIVLTSSIGGLYG

SEQ ID NO: 724052 - protein, 27 aa, Mycobacterium
RPAGIRRLFIRWSEWSGSGLWVNLTCR

SEQ ID NO: 724053 - protein, 26 aa, Mycobacterium
RPAGKRLAPMLTELVAVLRYFGELII

SEQ ID NO: 724054 - protein, 25 aa, Mycobacterium
RPAGKYRSTMTWAVFANSKGSGALG

SEQ ID NO: 724055 - protein, 19 aa, Mycobacterium
RPAGLARRGLGPDDVAPRP

SEQ ID NO: 724056 - protein, 18 aa, Mycobacterium
RPAGPRLGFQKVPDPTPG

SEQ ID NO: 724057 - protein, 32 aa, Mycobacterium
RPAGSAIAVVARRAGSGPGVTACPAGPAVTAG

SEQ ID NO: 724058 - protein, 22 aa, Mycobacterium
RPAIAGPLLRPFFEAYQIVADA

SEQ ID NO: 724059 - protein, 20 aa, Mycobacterium
RPAIVLPAFLSRGYHVRADL

SEQ ID NO: 724060 - protein, 17 aa, Mycobacterium
RPALAAWFASTRPPIGG

SEQ ID NO: 724061 - protein, 21 aa, Mycobacterium
RPALDPILLKVLDAVPFRLST

SEQ ID NO: 724062 - protein, 19 aa, Mycobacterium
RPALLKGIELLGRAYIKSQ

SEQ ID NO: 724063 - protein, 26 aa, Mycobacterium
RPALLSVSFGTDWSWVARAHDAGIPT

SEQ ID NO: 724064 - protein, 19 aa, Mycobacterium
RPALQPGTRDPLPLNRFQD

SEQ ID NO: 724065 - protein, 26 aa, Mycobacterium
RPALVRPSLNIAEWILPSVLAAAPQD

SEQ ID NO: 724066 - protein, 19 aa, Mycobacterium
RPAMHMVERARARGELAPG

SEQ ID NO: 724067 - protein, 20 aa, Mycobacterium
RPANDFVARFIGLGRGYRWL

SEQ ID NO: 724068 - protein, 21 aa, Mycobacterium
RPANLKSIVYGGGPMYVESLR

SEQ ID NO: 724069 - protein, 26 aa, Mycobacterium
RPAPAGEVGEVWLRGPTVVRGYLGDP

SEQ ID NO: 724070 - protein, 27 aa, Mycobacterium
RPAPALLIRPDGYLAWAATGSGADEHQ

SEQ ID NO: 724071 - protein, 19 aa, Mycobacterium
RPAPCPTVTLVHGDAKPGN

SEQ ID NO: 724072 - protein, 21 aa, Mycobacterium
RPAPEGWHRDGVTLVSSLLIG

SEQ ID NO: 724073 - protein, 19 aa, Mycobacterium
RPAPEPKPEPATAPAPKAE

SEQ ID NO: 724074 - protein, 19 aa, Mycobacterium
RPAPRELGTEVTLCVQAPA

SEQ ID NO: 724075 - protein, 28 aa, Mycobacterium
RPAPRIVAGIPVCLCANSEIDTAKERAN

SEQ ID NO: 724076 - protein, 27 aa, Mycobacterium
RPAPRIVAGIPVCLCAPAQIDEAKERA

SEQ ID NO: 724077 - protein, 18 aa, Mycobacterium
RPAPRVVAGLPVVVHDDP

SEQ ID NO: 724078 - protein, 26 aa, Mycobacterium
RPAPSGLWRRIFPVLLLAQKAFRRRY

SEQ ID NO: 724079 - protein, 19 aa, Mycobacterium
RPAPSGTRLLLSDATAALD

SEQ ID NO: 724080 - protein, 22 aa, Mycobacterium
RPAPTRKIRKLANVALNIDGTV

SEQ ID NO: 724081 - protein, 32 aa, Mycobacterium
RPAPVPGFKGSRSFGLPEFDPFWQACVKAELP

SEQ ID NO: 724082 - protein, 19 aa, Mycobacterium
RPAQARDLAAMFAAVGAAV

SEQ ID NO: 724083 - protein, 19 aa, Mycobacterium
RPAQLYLCNDCTTQLENML

SEQ ID NO: 724084 - protein, 18 aa, Mycobacterium
RPAQRLHDPLAIDDQRRA

SEQ ID NO: 724085 - protein, 17 aa, Mycobacterium
RPARAHAAAGLRSGGQA

SEQ ID NO: 724086 - protein, 17 aa, Mycobacterium
RPARHLTRRQLELLRAE

SEQ ID NO: 724087 - protein, 25 aa, Mycobacterium
RPARMSARRFWVRYAAEAAGALTLD

SEQ ID NO: 724088 - protein, 17 aa, Mycobacterium
RPARRKLVEVCAALAAF

SEQ ID NO: 724089 - protein, 21 aa, Mycobacterium
RPARVGTDLLVVVPLQDDEVT

SEQ ID NO: 724090 - protein, 17 aa, Mycobacterium
RPARVLLLGGTPFTEEL

SEQ ID NO: 724091 - protein, 19 aa, Mycobacterium
RPASPGMRLLGLAHRAALD

SEQ ID NO: 724092 - protein, 20 aa, Mycobacterium
RPATEFTLQAWSGGIVGLGR

SEQ ID NO: 724093 - protein, 27 aa, Mycobacterium
RPATTHWRWADELRRLHPKIAVDENVL

SEQ ID NO: 724094 - protein, 27 aa, Mycobacterium
RPATTMARFPMCERCAAEYHDPVDRRY

SEQ ID NO: 724095 - protein, 19 aa, Mycobacterium
RPATVLDIAGQIGYDDLPA

SEQ ID NO: 724096 - protein, 19 aa, Mycobacterium
RPAVAAGVVTVPRTEAAGA

SEQ ID NO: 724097 - protein, 17 aa, Mycobacterium
RPAVALLDYRMPGMDGA

SEQ ID NO: 724098 - protein, 29 aa, Mycobacterium
RPAVDHTRRYLRACQQLGYQDPVLAKGFD

SEQ ID NO: 724099 - protein, 17 aa, Mycobacterium
RPAVPDDVRQYFTEMGA

SEQ ID NO: 724100 - protein, 23 aa, Mycobacterium
RPAVPLFRAVVGYSRGILEHDAD

SEQ ID NO: 724101 - protein, 25 aa, Mycobacterium
RPAWHCVGANAMLRLEDLNLDEVIR

SEQ ID NO: 724102 - protein, 17 aa, Mycobacterium
RPAWSTDRWLRDFFGPA

SEQ ID NO: 724103 - protein, 18 aa, Mycobacterium
RPAYTGTLTLRYRRGTVL

SEQ ID NO: 724104 - protein, 29 aa, Mycobacterium
RPCGRPRPWRRARHAAAPPARVPRPGFCA

SEQ ID NO: 724105 - protein, 17 aa, Mycobacterium
RPCGWGVGCSLIIKHFR

SEQ ID NO: 724106 - protein, 36 aa, Mycobacterium
RPCHPQCMSAVCWGRPASEPDAGWAVIDVETSGFRP

SEQ ID NO: 724107 - protein, 17 aa, Mycobacterium
RPDAALRLAERERVMSI

SEQ ID NO: 724108 - protein, 25 aa, Mycobacterium
RPDAFRINAELEFERNAERYQLLRW

SEQ ID NO: 724109 - protein, 19 aa, Mycobacterium
RPDALILDVMMPRLDGLEV

SEQ ID NO: 724110 - protein, 19 aa, Mycobacterium
RPDALVLDVMMPKLDGLEV

SEQ ID NO: 724111 - protein, 23 aa, Mycobacterium
RPDAPEKRIAVILNGLGRTKYEE

SEQ ID NO: 724112 - protein, 21 aa, Mycobacterium
RPDARITVSPLGFVAEGRSLI

SEQ ID NO: 724113 - protein, 20 aa, Mycobacterium
RPDAVAIRYGERQWSWADWA

SEQ ID NO: 724114 - protein, 17 aa, Mycobacterium
RPDAVRALSRLVCGGEP

SEQ ID NO: 724115 - protein, 19 aa, Mycobacterium
RPDAVVLDVMMPRLDGLEV

SEQ ID NO: 724116 - protein, 17 aa, Mycobacterium
RPDCVLLDLHLPDASGM

SEQ ID NO: 724117 - protein, 22 aa, Mycobacterium
RPDDAWLARWSRAEAAVPHPID

SEQ ID NO: 724118 - protein, 23 aa, Mycobacterium
RPDDAWLASWSRAEAAVPHPIDP

SEQ ID NO: 724119 - protein, 18 aa, Mycobacterium
RPDDAWLSIFGPEVDVDV

SEQ ID NO: 724120 - protein, 25 aa, Mycobacterium
RPDDCPPGSIGKGFPGVAIYDPQTV

SEQ ID NO: 724121 - protein, 20 aa, Mycobacterium
RPDDEIVALIAALALTAVRS

SEQ ID NO: 724122 - protein, 21 aa, Mycobacterium
RPDDSWLASWSRAEAAVSHPI

SEQ ID NO: 724123 - protein, 26 aa, Mycobacterium
RPDELAEALSGFIAEFGLSLVGGCCG

SEQ ID NO: 724124 - protein, 21 aa, Mycobacterium
RPDELEMARAIGMINEATTLG

SEQ ID NO: 724125 - protein, 17 aa, Mycobacterium
RPDELRALLTVADVVIE

SEQ ID NO: 724126 - protein, 19 aa, Mycobacterium
RPDELTEWFATAYVDGFRW

SEQ ID NO: 724127 - protein, 18 aa, Mycobacterium
RPDEVLVLDEASAGALAS

SEQ ID NO: 724128 - protein, 24 aa, Mycobacterium
RPDFARLAESFGIPAHTATIDDVG

SEQ ID NO: 724129 - protein, 17 aa, Mycobacterium
RPDFEKFYADESLTAEG

SEQ ID NO: 724130 - protein, 18 aa, Mycobacterium
RPDFSKLTPLYPNQRLRL

SEQ ID NO: 724131 - protein, 18 aa, Mycobacterium
RPDFTKLTPLYPNQRLRL

SEQ ID NO: 724132 - protein, 28 aa, Mycobacterium
RPDGEWRAVAKVSAWLLATGDTSDVTTD

SEQ ID NO: 724133 - protein, 20 aa, Mycobacterium
RPDGFAHRLLSFDVKVTVLV

SEQ ID NO: 724134 - protein, 17 aa, Mycobacterium
RPDGGRGADGWTVPEYG

SEQ ID NO: 724135 - protein, 20 aa, Mycobacterium
RPDGKVSHRGLVEAIAAGDV

SEQ ID NO: 724136 - protein, 35 aa, Mycobacterium
RPDGWWKDRGRAMVVLVDRLDRWAATQSDSVTVVF

SEQ ID NO: 724137 - protein, 20 aa, Mycobacterium
RPDHRLRLEHVGAIRPEQLR

SEQ ID NO: 724138 - protein, 27 aa, Mycobacterium
RPDIDPAELIAVGWDRLHRQLDAYIDA

SEQ ID NO: 724139 - protein, 19 aa, Mycobacterium
RPDKALHITALVERTAQIV

SEQ ID NO: 724140 - protein, 19 aa, Mycobacterium
RPDLDARIAFCEQNSPNLR

SEQ ID NO: 724141 - protein, 22 aa, Mycobacterium
RPDLDGGMFTTLFARAVADGKL

SEQ ID NO: 724142 - protein, 17 aa, Mycobacterium
RPDLDRMSTNGLHQGLA

SEQ ID NO: 724143 - protein, 22 aa, Mycobacterium
RPDLDRRVDLVIANPPYVPDNA

SEQ ID NO: 724144 - protein, 23 aa, Mycobacterium
RPDLDVRLAFCELNSPGLVEVLN

SEQ ID NO: 724145 - protein, 18 aa, Mycobacterium
RPDLEVVLLEPLLRRSEF

SEQ ID NO: 724146 - protein, 17 aa, Mycobacterium
RPDLILLDLNLPKYDGR

SEQ ID NO: 724147 - protein, 19 aa, Mycobacterium
RPDLLELFDIAELEKYYTD

SEQ ID NO: 724148 - protein, 22 aa, Mycobacterium
RPDLPNPKRADAEVVFPVVQAM

SEQ ID NO: 724149 - protein, 26 aa, Mycobacterium
RPDLSMFPRAEWLRALRRVLEATPHA

SEQ ID NO: 724150 - protein, 20 aa, Mycobacterium
RPDLVASVGSLARVSGRLSA

SEQ ID NO: 724151 - protein, 26 aa, Mycobacterium
RPDLVRPILPYDGCRLLTKVRHSVFY

SEQ ID NO: 724152 - protein, 24 aa, Mycobacterium
RPDMARPRFGSWLRNSTRGALAMD

SEQ ID NO: 724153 - protein, 26 aa, Mycobacterium
RPDMATGGMPMRWGTGYMLGSKRFGP

SEQ ID NO: 724154 - protein, 18 aa, Mycobacterium
RPDNARRAAISGVGMGGV

SEQ ID NO: 724155 - protein, 21 aa, Mycobacterium
RPDNVFVAGFIGSPAMNMFIL

SEQ ID NO: 724156 - protein, 20 aa, Mycobacterium
RPDPALDELVGFFVNTLVLR

SEQ ID NO: 724157 - protein, 19 aa, Mycobacterium
RPDPALLTQGMWVQFRSVR

SEQ ID NO: 724158 - protein, 25 aa, Mycobacterium
RPDQAITLDQAWRAQTIDAARTLRR

SEQ ID NO: 724159 - protein, 18 aa, Mycobacterium
RPDQAMVITLPVTDAPYL

SEQ ID NO: 724160 - protein, 21 aa, Mycobacterium
RPDQLAKLAQRLMDCLNPDGT

SEQ ID NO: 724161 - protein, 18 aa, Mycobacterium
RPDQLRRAADLGVTASLF

SEQ ID NO: 724162 - protein, 20 aa, Mycobacterium
RPDQRAALSQFEFLLSRTMT

SEQ ID NO: 724163 - protein, 23 aa, Mycobacterium
RPDQRYLPATAFRSRRSALSDAQ

SEQ ID NO: 724164 - protein, 17 aa, Mycobacterium
RPDRAIETNVEFWAAVI

SEQ ID NO: 724165 - protein, 19 aa, Mycobacterium
RPDRRWGGDNTDCYYGYAV

SEQ ID NO: 724166 - protein, 29 aa, Mycobacterium
RPDRSTTLALRWLVNFSRQRREKTMVERL

SEQ ID NO: 724167 - protein, 30 aa, Mycobacterium
RPDRSTTLALRWLVTFSRARREKTMVERLA

SEQ ID NO: 724168 - protein, 20 aa, Mycobacterium
RPDRVRLLVIADVSLSVRPV

SEQ ID NO: 724169 - protein, 19 aa, Mycobacterium
RPDSGVALYQRFVAEMKAA

SEQ ID NO: 724170 - protein, 22 aa, Mycobacterium
RPDSIPAILDWYTQRGRTPRLA

SEQ ID NO: 724171 - protein, 19 aa, Mycobacterium
RPDSWDIDMPNQFEAAERI

SEQ ID NO: 724172 - protein, 28 aa, Mycobacterium
RPDTAPDEIVRWATPVTAFQRTALEDYE

SEQ ID NO: 724173 - protein, 21 aa, Mycobacterium
RPDTDVGLVLRVAAASADTGL

SEQ ID NO: 724174 - protein, 19 aa, Mycobacterium
RPDTIELWRKISTVEDPEW

SEQ ID NO: 724175 - protein, 19 aa, Mycobacterium
RPDVAGARGGVRRSALQGP

SEQ ID NO: 724176 - protein, 24 aa, Mycobacterium
RPDVDGILAPGARICFTGTAQDPD

SEQ ID NO: 724177 - protein, 25 aa, Mycobacterium
RPDVDWDKGTALAWIRDHVIESGVE

SEQ ID NO: 724178 - protein, 19 aa, Mycobacterium
RPDVFSVRVGNLGPGEQAT

SEQ ID NO: 724179 - protein, 20 aa, Mycobacterium
RPDVIARLTGEWVDMITEGV

SEQ ID NO: 724180 - protein, 19 aa, Mycobacterium
RPDVLTAWMDAAVVDENDP

SEQ ID NO: 724181 - protein, 21 aa, Mycobacterium
RPDYGITGWVILTLIQHGTPW

SEQ ID NO: 724182 - protein, 21 aa, Mycobacterium
RPDYSITGWVILTLIQHGTAW

SEQ ID NO: 724183 - protein, 21 aa, Mycobacterium
RPDYSITGWVILTLIQHGTDW

SEQ ID NO: 724184 - protein, 24 aa, Mycobacterium
RPEAGLDPKMLFLLATAKLNQAER

SEQ ID NO: 724185 - protein, 19 aa, Mycobacterium
RPEAITSFMKGLVTGTVTI

SEQ ID NO: 724186 - protein, 20 aa, Mycobacterium
RPEALGGLGGAAPDQLLPAV

SEQ ID NO: 724187 - protein, 20 aa, Mycobacterium
RPEALGGLGGAAPQQLLPAV

SEQ ID NO: 724188 - protein, 22 aa, Mycobacterium
RPEALNSFNRAMCREMRDAWHL

SEQ ID NO: 724189 - protein, 22 aa, Mycobacterium
RPEARIPVLSFAFHDVPADRVV

SEQ ID NO: 724190 - protein, 32 aa, Mycobacterium
RPEAWDRPPPGGLPELRDWFAAELGGGLGRQD

SEQ ID NO: 724191 - protein, 19 aa, Mycobacterium
RPEDGGSFYPPTVLVDVDH

SEQ ID NO: 724192 - protein, 21 aa, Mycobacterium
RPEDLRFLVRLARQQGERLGR

SEQ ID NO: 724193 - protein, 20 aa, Mycobacterium
RPEDVSGMLAAQGIVTEIGG

SEQ ID NO: 724194 - protein, 19 aa, Mycobacterium
RPEDVSGMLAAQGVVTEVG

SEQ ID NO: 724195 - protein, 21 aa, Mycobacterium
RPEEHRLRRLVDWFDHAIALG

SEQ ID NO: 724196 - protein, 20 aa, Mycobacterium
RPEEIAGLLCFLVSDGASFI

SEQ ID NO: 724197 - protein, 24 aa, Mycobacterium
RPEELAHAVAFLLDDLASYVTGAV

SEQ ID NO: 724198 - protein, 30 aa, Mycobacterium
RPEERWPEAGRWLGERGYDSTLSYVRAMAI

SEQ ID NO: 724199 - protein, 22 aa, Mycobacterium
RPEEVAAMAAFLVSPQASFVTG

SEQ ID NO: 724200 - protein, 19 aa, Mycobacterium
RPEFLNRIDDIIVFEQLTQ

SEQ ID NO: 724201 - protein, 19 aa, Mycobacterium
RPEFLNRIDDIIVFHQLTK

SEQ ID NO: 724202 - protein, 18 aa, Mycobacterium
RPEFRDNCYINLTTDLGS

SEQ ID NO: 724203 - protein, 19 aa, Mycobacterium
RPEFVAALQAIWRLGAAAV

SEQ ID NO: 724204 - protein, 23 aa, Mycobacterium
RPEFVELLARFVVKRKFRDHREV

SEQ ID NO: 724205 - protein, 20 aa, Mycobacterium
RPEGGWSPNIYGGRENLEAV

SEQ ID NO: 724206 - protein, 17 aa, Mycobacterium
RPEHLAHALVILMTVGG

SEQ ID NO: 724207 - protein, 25 aa, Mycobacterium
RPEHMKQWWPDEAEFARAPGATGEI

SEQ ID NO: 724208 - protein, 17 aa, Mycobacterium
RPEHVAHALVILLTVGG

SEQ ID NO: 724209 - protein, 22 aa, Mycobacterium
RPEKEPGQLGMLARTIVGMPRR

SEQ ID NO: 724210 - protein, 18 aa, Mycobacterium
RPELDGLPEMGLVGRQLW

SEQ ID NO: 724211 - protein, 19 aa, Mycobacterium
RPELGYRLLQRLGADVADY

SEQ ID NO: 724212 - protein, 17 aa, Mycobacterium
RPELMSLLVDRTPAAHV

SEQ ID NO: 724213 - protein, 22 aa, Mycobacterium
RPELPALRQLLVLGEDYDTALT

SEQ ID NO: 724214 - protein, 25 aa, Mycobacterium
RPELVRPSLGISEWILPTLISSAPR

SEQ ID NO: 724215 - protein, 19 aa, Mycobacterium
RPEMAELNQGVPVLAEVQP

SEQ ID NO: 724216 - protein, 24 aa, Mycobacterium
RPEMGRPRFGSWLRNSTRGALAMD

SEQ ID NO: 724217 - protein, 18 aa, Mycobacterium
RPENEFVAPWGMFTAAEF

SEQ ID NO: 724218 - protein, 18 aa, Mycobacterium
RPENEFVAPWGMFTTAEF

SEQ ID NO: 724219 - protein, 18 aa, Mycobacterium
RPEPGLCNCGYRLNDAPT

SEQ ID NO: 724220 - protein, 23 aa, Mycobacterium
RPEPGLDPKMLFLLATAKLNQAE

SEQ ID NO: 724221 - protein, 19 aa, Mycobacterium
RPEPGTTICNTWDVTDYRG

SEQ ID NO: 724222 - protein, 20 aa, Mycobacterium
RPEPPIGRAMVRRQGTDVTV

SEQ ID NO: 724223 - protein, 19 aa, Mycobacterium
RPEPPIGRAVVRRPGTDVT

SEQ ID NO: 724224 - protein, 20 aa, Mycobacterium
RPEPTIRDWIATARKRGFLA

SEQ ID NO: 724225 - protein, 19 aa, Mycobacterium
RPERDPGLILRVAAASATT

SEQ ID NO: 724226 - protein, 18 aa, Mycobacterium
RPERFGLVYHLTHGLLEQ

SEQ ID NO: 724227 - protein, 24 aa, Mycobacterium
RPERLLGGPVMRRVQQVVHRLMPK

SEQ ID NO: 724228 - protein, 22 aa, Mycobacterium
RPERRRGMAVIISDFLGPINWM

SEQ ID NO: 724229 - protein, 24 aa, Mycobacterium
RPESAERAKVAWGVDAYHDPRRLV

SEQ ID NO: 724230 - protein, 23 aa, Mycobacterium
RPETLDLPGVVPIPLDITDAESV

SEQ ID NO: 724231 - protein, 24 aa, Mycobacterium
RPETRPFGAPAFDENYSFGGLPTG

SEQ ID NO: 724232 - protein, 23 aa, Mycobacterium
RPEVIFCSFGDMLRVPGSEKDLF

SEQ ID NO: 724233 - protein, 19 aa, Mycobacterium
RPEVLDLLDELGLADRTLD

SEQ ID NO: 724234 - protein, 23 aa, Mycobacterium
RPEVYTPEGFAWVRSNSMRTVLL

SEQ ID NO: 724235 - protein, 19 aa, Mycobacterium
RPEYVESWLAINELGAIAI

SEQ ID NO: 724236 - protein, 22 aa, Mycobacterium
RPFDEACAGPWWALAANHPGLP

SEQ ID NO: 724237 - protein, 29 aa, Mycobacterium
RPFDKNRTGFVFGEGGALMVIETEEHAKA

SEQ ID NO: 724238 - protein, 17 aa, Mycobacterium
RPFDLSKDSPLRVTVAH

SEQ ID NO: 724239 - protein, 23 aa, Mycobacterium
RPFFLMDRVDGVVPPDVMPYTFG

SEQ ID NO: 724240 - protein, 20 aa, Mycobacterium
RPFGKARIVMRLHDLPDGGC

SEQ ID NO: 724241 - protein, 18 aa, Mycobacterium
RPFGVPFIHIPVTRDTRA

SEQ ID NO: 724242 - protein, 18 aa, Mycobacterium
RPFGVPFVHIPATRDTRA

SEQ ID NO: 724243 - protein, 18 aa, Mycobacterium
RPFHIDWDLSAAEKGGYE

SEQ ID NO: 724244 - protein, 28 aa, Mycobacterium
RPFPECDRRIAGINSFGFGGTNAHVVLA

SEQ ID NO: 724245 - protein, 21 aa, Mycobacterium
RPFRAPGDWESFEPVLRSSVD

SEQ ID NO: 724246 - protein, 19 aa, Mycobacterium
RPFRDYLGWLGGWDSQSGE

SEQ ID NO: 724247 - protein, 19 aa, Mycobacterium
RPFSLTGLISGFANIGSNL

SEQ ID NO: 724248 - protein, 19 aa, Mycobacterium
RPFVHRLATELGLSGFVGN

SEQ ID NO: 724249 - protein, 17 aa, Mycobacterium
RPFWAITKHADIMAIER

SEQ ID NO: 724250 - protein, 18 aa, Mycobacterium
RPFWKDVDPVTGRDTMSM

SEQ ID NO: 724251 - protein, 19 aa, Mycobacterium
RPGAAQGWHLHHLLTAGQI

SEQ ID NO: 724252 - protein, 19 aa, Mycobacterium
RPGADEIRPAAAERAEEFA

SEQ ID NO: 724253 - protein, 26 aa, Mycobacterium
RPGAEVDVTLYLPWGAVKGNIEPCWY

SEQ ID NO: 724254 - protein, 19 aa, Mycobacterium
RPGAGVAEGESLLPAEAVA

SEQ ID NO: 724255 - protein, 25 aa, Mycobacterium
RPGAHEVRPGLQIVAAPWRSKAPTT

SEQ ID NO: 724256 - protein, 19 aa, Mycobacterium
RPGALRPGVVMTPIADLLP

SEQ ID NO: 724257 - protein, 20 aa, Mycobacterium
RPGAQIGQAIVRRAGGDVSV

SEQ ID NO: 724258 - protein, 25 aa, Mycobacterium
RPGARRHLLSWGIGECGVCGEKLRA

SEQ ID NO: 724259 - protein, 18 aa, Mycobacterium
RPGATLLISCFSDANGPD

SEQ ID NO: 724260 - protein, 18 aa, Mycobacterium
RPGCAVAVRLDAGRSRES

SEQ ID NO: 724261 - protein, 25 aa, Mycobacterium
RPGDGWRLAMDLLPYERSSCFWQRI

SEQ ID NO: 724262 - protein, 24 aa, Mycobacterium
RPGDGWRVAMATLTFERGVSTLGQ

SEQ ID NO: 724263 - protein, 24 aa, Mycobacterium
RPGDIAAACAFLISEEAGYITGQI

SEQ ID NO: 724264 - protein, 19 aa, Mycobacterium
RPGDKRLVGYITESTAGTL

SEQ ID NO: 724265 - protein, 25 aa, Mycobacterium
RPGDPGVLPTVWDAWSARLAVDAGF

SEQ ID NO: 724266 - protein, 17 aa, Mycobacterium
RPGDPTLRRLLPDFYKL

SEQ ID NO: 724267 - protein, 19 aa, Mycobacterium
RPGDTVAVTGVLGRSAAGY

SEQ ID NO: 724268 - protein, 20 aa, Mycobacterium
RPGDVLAVACTGAYHHSMAS

SEQ ID NO: 724269 - protein, 25 aa, Mycobacterium
RPGDYRYAINNSFGFGGHNVAIAFG

SEQ ID NO: 724270 - protein, 18 aa, Mycobacterium
RPGEAHYRPIDWDDAYAL

SEQ ID NO: 724271 - protein, 18 aa, Mycobacterium
RPGEHTGNFIATRTPDGT

SEQ ID NO: 724272 - protein, 19 aa, Mycobacterium
RPGEPSWEASFGPGRPGWH

SEQ ID NO: 724273 - protein, 18 aa, Mycobacterium
RPGERPTRIEVVLIAAYR

SEQ ID NO: 724274 - protein, 18 aa, Mycobacterium
RPGESDGSCGRGEPQAGH

SEQ ID NO: 724275 - protein, 19 aa, Mycobacterium
RPGEVRPSTDLLLQHKHPE

SEQ ID NO: 724276 - protein, 17 aa, Mycobacterium
RPGFGFEVKIHRTTTNG

SEQ ID NO: 724277 - protein, 30 aa, Mycobacterium
RPGFHPDDWDSAAVLERWSKELFDQDGSQR

SEQ ID NO: 724278 - protein, 21 aa, Mycobacterium
RPGFRRGRVLSKIGQRGQDTS

SEQ ID NO: 724279 - protein, 25 aa, Mycobacterium
RPGGAMPARVLVVGRDRPGRHRLGA

SEQ ID NO: 724280 - protein, 20 aa, Mycobacterium
RPGGEAVPMRLSTRPQHPIP

SEQ ID NO: 724281 - protein, 19 aa, Mycobacterium
RPGGELRYLEHVASAGARG

SEQ ID NO: 724282 - protein, 33 aa, Mycobacterium
RPGGERRLNVAVTRARREVVLYASFDPADLRAE

SEQ ID NO: 724283 - protein, 19 aa, Mycobacterium
RPGGGLFALATPITNLFGL

SEQ ID NO: 724284 - protein, 21 aa, Mycobacterium
RPGGHLTFGRGAHFCLGAPLA

SEQ ID NO: 724285 - protein, 22 aa, Mycobacterium
RPGGKEWTYTPAVTFDQPLEID

SEQ ID NO: 724286 - protein, 18 aa, Mycobacterium
RPGGLAIPAEETDLFHRG

SEQ ID NO: 724287 - protein, 18 aa, Mycobacterium
RPGGLVCALNCGAQPVPL

SEQ ID NO: 724288 - protein, 17 aa, Mycobacterium
RPGGLVEGRRLTKVFGL

SEQ ID NO: 724289 - protein, 20 aa, Mycobacterium
RPGGPEFRPSEVARLGYLAG

SEQ ID NO: 724290 - protein, 18 aa, Mycobacterium
RPGGRIAILTSYAGQAAP

SEQ ID NO: 724291 - protein, 21 aa, Mycobacterium
RPGGRIYAGFSPLYYSPFGDH

SEQ ID NO: 724292 - protein, 19 aa, Mycobacterium
RPGGRLAVMVPTVGPAARL

SEQ ID NO: 724293 - protein, 26 aa, Mycobacterium
RPGGSEAAFLFAITIGNAMRIEPIEV

SEQ ID NO: 724294 - protein, 19 aa, Mycobacterium
RPGGTWFHPGFAYQLETFG

SEQ ID NO: 724295 - protein, 19 aa, Mycobacterium
RPGGVWAYEAHRVAAVRPR

SEQ ID NO: 724296 - protein, 25 aa, Mycobacterium
RPGIPYPEWNMWTQRFMHDHVAVVE

SEQ ID NO: 724297 - protein, 24 aa, Mycobacterium
RPGKAKGAVEIAVIHRPRYDDWSL

SEQ ID NO: 724298 - protein, 25 aa, Mycobacterium
RPGKPCASAAFAGDRARAGRSGVAG

SEQ ID NO: 724299 - protein, 23 aa, Mycobacterium
RPGKQRLRIAVCTQSIVRDAAPE

SEQ ID NO: 724300 - protein, 18 aa, Mycobacterium
RPGLAALLDYARPGDGIV

SEQ ID NO: 724301 - protein, 24 aa, Mycobacterium
RPGLDRRSRSLITLTALIARGHHA

SEQ ID NO: 724302 - protein, 20 aa, Mycobacterium
RPGLIDELGTLTWRQLDERI

SEQ ID NO: 724303 - protein, 17 aa, Mycobacterium
RPGLPAARDEFHVALAQ

SEQ ID NO: 724304 - protein, 21 aa, Mycobacterium
RPGLSATRFVACPYVGAEAPG

SEQ ID NO: 724305 - protein, 19 aa, Mycobacterium
RPGMRLAVIYDPKDHNRIE

SEQ ID NO: 724306 - protein, 17 aa, Mycobacterium
RPGNFVMSFLDASIAPL

SEQ ID NO: 724307 - protein, 35 aa, Mycobacterium
RPGNPVILPTVWDAWSARLAVGAGFAALTVGSHPM

SEQ ID NO: 724308 - protein, 20 aa, Mycobacterium
RPGPALLWIHGGGYILGDAA

SEQ ID NO: 724309 - protein, 35 aa, Mycobacterium
RPGPEARVDCGLAGTVLRFVPPLAALSAAPITFDG

SEQ ID NO: 724310 - protein, 17 aa, Mycobacterium
RPGPLLRAKHALFDRLV

SEQ ID NO: 724311 - protein, 21 aa, Mycobacterium
RPGPRPSPRPVAHPVVVSAPS

SEQ ID NO: 724312 - protein, 20 aa, Mycobacterium
RPGPSELLVAVRACGVCRTD

SEQ ID NO: 724313 - protein, 17 aa, Mycobacterium
RPGQVALDIPVDLPRTG

SEQ ID NO: 724314 - protein, 18 aa, Mycobacterium
RPGQVRTRMSAHVKEAPL

SEQ ID NO: 724315 - protein, 19 aa, Mycobacterium
RPGQYEAPLGITLRELLEY

SEQ ID NO: 724316 - protein, 19 aa, Mycobacterium
RPGRFIRDYSRGFADQAIR

SEQ ID NO: 724317 - protein, 18 aa, Mycobacterium
RPGRGFCEADEITVRALA

SEQ ID NO: 724318 - protein, 18 aa, Mycobacterium
RPGRPLGASTAEFADLAA

SEQ ID NO: 724319 - protein, 17 aa, Mycobacterium
RPGRPLGASTAEFAELA

SEQ ID NO: 724320 - protein, 17 aa, Mycobacterium
RPGRPRAAPPVRKLAKE

SEQ ID NO: 724321 - protein, 19 aa, Mycobacterium
RPGRRGRIGPSPQRGGGEH

SEQ ID NO: 724322 - protein, 23 aa, Mycobacterium
RPGSRISLAVAEMAAARPDGEWR

SEQ ID NO: 724323 - protein, 22 aa, Mycobacterium
RPGSRPSLAELDGFVRSAIAGY

SEQ ID NO: 724324 - protein, 24 aa, Mycobacterium
RPGSRVCLMVAELHADREGGPARA

SEQ ID NO: 724325 - protein, 26 aa, Mycobacterium
RPGSWDPACIPLRYLVTEDGAEADDT

SEQ ID NO: 724326 - protein, 20 aa, Mycobacterium
RPGSYPIVLATYEIVCSKYP

SEQ ID NO: 724327 - protein, 20 aa, Mycobacterium
RPGTELRRLTPRNTDQLLFD

SEQ ID NO: 724328 - protein, 19 aa, Mycobacterium
RPGTPLSLTKPLGIGVLNS

SEQ ID NO: 724329 - protein, 20 aa, Mycobacterium
RPGTRRMYSNYGFTALAEAV

SEQ ID NO: 724330 - protein, 18 aa, Mycobacterium
RPGTVSAITRWAQRHDVP

SEQ ID NO: 724331 - protein, 29 aa, Mycobacterium
RPGVLARVAALFSRRGFNIASLAVGPTEL

SEQ ID NO: 724332 - protein, 32 aa, Mycobacterium
RPGVTKPSLGIAEWIFPTILDRGSDLQRDRFG

SEQ ID NO: 724333 - protein, 19 aa, Mycobacterium
RPGWDEIAGVLGSLPELPG

SEQ ID NO: 724334 - protein, 18 aa, Mycobacterium
RPGYFDGLLPGPSAVDAL

SEQ ID NO: 724335 - protein, 20 aa, Mycobacterium
RPGYLPRIIGGAVHHGLPQR

SEQ ID NO: 724336 - protein, 21 aa, Mycobacterium
RPGYLRFDFNWQGPLTEEQRG

SEQ ID NO: 724337 - protein, 18 aa, Mycobacterium
RPGYNFPDAATALAYGNG

SEQ ID NO: 724338 - protein, 20 aa, Mycobacterium
RPHAPPAPGGLVSRLVAPLR

SEQ ID NO: 724339 - protein, 18 aa, Mycobacterium
RPHAVIKGGGIVWAAMGD

SEQ ID NO: 724340 - protein, 20 aa, Mycobacterium
RPHAVVKGGMIAWAAMGDAN

SEQ ID NO: 724341 - protein, 26 aa, Mycobacterium
RPHDWPAWAEPDVVKAFADRGIAAPW

SEQ ID NO: 724342 - protein, 28 aa, Mycobacterium
RPHGLTPLGLEALEMVRIEAGLAAGGHE

SEQ ID NO: 724343 - protein, 25 aa, Mycobacterium
RPHGMSSTFCSFVAGLLATLREFTV

SEQ ID NO: 724344 - protein, 17 aa, Mycobacterium
RPHGRLAVMAYQSLEDR

SEQ ID NO: 724345 - protein, 19 aa, Mycobacterium
RPHHVRATVKIMGLSDQEM

SEQ ID NO: 724346 - protein, 26 aa, Mycobacterium
RPHIEKRFSMPWSHPVRRMREYIAAL

SEQ ID NO: 724347 - protein, 19 aa, Mycobacterium
RPHLLCAATELPLTEDDVR

SEQ ID NO: 724348 - protein, 21 aa, Mycobacterium
RPHRFQVTASRFGRRGGTSDT

SEQ ID NO: 724349 - protein, 26 aa, Mycobacterium
RPHRVRRRGGLVLSFRPMPGTYAEQT

SEQ ID NO: 724350 - protein, 19 aa, Mycobacterium
RPHSAVARVFLGSRATKIV

SEQ ID NO: 724351 - protein, 19 aa, Mycobacterium
RPHVTWKYGASVDGRSAAN

SEQ ID NO: 724352 - protein, 20 aa, Mycobacterium
RPHYIKTLHIWGDNLEANKD

SEQ ID NO: 724353 - protein, 20 aa, Mycobacterium
RPHYIKTLHIWGDTLESNRD

SEQ ID NO: 724354 - protein, 19 aa, Mycobacterium
RPHYIKTLRIWGDNLEANK

SEQ ID NO: 724355 - protein, 18 aa, Mycobacterium
RPHYMPLFVAPQPIEAEE

SEQ ID NO: 724356 - protein, 18 aa, Mycobacterium
RPIALVLEDLHWAQLPTL

SEQ ID NO: 724357 - protein, 28 aa, Mycobacterium
RPIDAFVVRKAAKVHGMQRLIEGSEVSG

SEQ ID NO: 724358 - protein, 19 aa, Mycobacterium
RPIDFWPANTTVNIDASGT

SEQ ID NO: 724359 - protein, 24 aa, Mycobacterium
RPIDGRCTGWLLTTAPSGLLPFTS

SEQ ID NO: 724360 - protein, 26 aa, Mycobacterium
RPIDPWAGSYYVEWLTHQLAQKARAH

SEQ ID NO: 724361 - protein, 17 aa, Mycobacterium
RPIESVEGFGLLHSRVG

SEQ ID NO: 724362 - protein, 25 aa, Mycobacterium
RPIEWDDAYRLIADELRALDDPNRA

SEQ ID NO: 724363 - protein, 17 aa, Mycobacterium
RPIGLLGAILAWHGTDN

SEQ ID NO: 724364 - protein, 17 aa, Mycobacterium
RPIGLVLGLELSGNPFV

SEQ ID NO: 724365 - protein, 18 aa, Mycobacterium
RPIGPAKWIGPVATESDL

SEQ ID NO: 724366 - protein, 17 aa, Mycobacterium
RPILAVDIQLRPALERA

SEQ ID NO: 724367 - protein, 27 aa, Mycobacterium
RPILGLEFFSSAPFRHGDHVAKYRFAP

SEQ ID NO: 724368 - protein, 17 aa, Mycobacterium
RPILHGLCTYGMTCKAL

SEQ ID NO: 724369 - protein, 17 aa, Mycobacterium
RPILRLVADTSPGVHDM

SEQ ID NO: 724370 - protein, 20 aa, Mycobacterium
RPIPEYDVSAGPFSHLAAER

SEQ ID NO: 724371 - protein, 26 aa, Mycobacterium
RPIPGPLKWDLTLGVATDTRESLINS

SEQ ID NO: 724372 - protein, 27 aa, Mycobacterium
RPIPGPLKWDLTMGVATDTRESLINSG

SEQ ID NO: 724373 - protein, 21 aa, Mycobacterium
RPIPIMIELNLGFQPTAQAAR

SEQ ID NO: 724374 - protein, 18 aa, Mycobacterium
RPIPPGPIGLPFIGSAIP

SEQ ID NO: 724375 - protein, 23 aa, Mycobacterium
RPIPRDELIAFFVAADVMLVTPL

SEQ ID NO: 724376 - protein, 28 aa, Mycobacterium
RPIPYALLPRRARTVYGSAMQKWCDLGK

SEQ ID NO: 724377 - protein, 22 aa, Mycobacterium
RPIRLMGIDAMLPLYDALDDAL

SEQ ID NO: 724378 - protein, 23 aa, Mycobacterium
RPIRSSTLFLRDADGVAVGCLCV

SEQ ID NO: 724379 - protein, 18 aa, Mycobacterium
RPITDVDAWLDGLDYDVR

SEQ ID NO: 724380 - protein, 20 aa, Mycobacterium
RPITVPVLLTLTERFDLPSQ

SEQ ID NO: 724381 - protein, 19 aa, Mycobacterium
RPIVRYLFDRPMLPRVNAI

SEQ ID NO: 724382 - protein, 17 aa, Mycobacterium
RPIVSMNGAHHFNEVIL

SEQ ID NO: 724383 - protein, 23 aa, Mycobacterium
RPIVVRYCRARVGTVDRGGLSAD

SEQ ID NO: 724384 - protein, 25 aa, Mycobacterium
RPIYEARLAQMAKLKAHPKAVGKFP

SEQ ID NO: 724385 - protein, 20 aa, Mycobacterium
RPIYKWMRENEPVFRDRNGL

SEQ ID NO: 724386 - protein, 17 aa, Mycobacterium
RPIYSRALTAAMRRADG

SEQ ID NO: 724387 - protein, 20 aa, Mycobacterium
RPKDFYRPNHQQIYDAILDL

SEQ ID NO: 724388 - protein, 19 aa, Mycobacterium
RPKGVLWRQSDIYVSSMVG

SEQ ID NO: 724389 - protein, 18 aa, Mycobacterium
RPKGVLWRQSDIYVTSMV

SEQ ID NO: 724390 - protein, 18 aa, Mycobacterium
RPKGVLWRQSDMYVSSMV

SEQ ID NO: 724391 - protein, 24 aa, Mycobacterium
RPKIELPDLGALKISVDPVEVSDE

SEQ ID NO: 724392 - protein, 27 aa, Mycobacterium
RPKLGFPVPIRHWLRAGELLEWAYQMV

SEQ ID NO: 724393 - protein, 23 aa, Mycobacterium
RPKLGFPVPIRHWLRTGELLEWA

SEQ ID NO: 724394 - protein, 20 aa, Mycobacterium
RPKLHPEILAATRAVGNQLE

SEQ ID NO: 724395 - protein, 20 aa, Mycobacterium
RPKLIEAFNEIRGYGVEFDK

SEQ ID NO: 724396 - protein, 19 aa, Mycobacterium
RPKLVVPLVTFLASSACTF

SEQ ID NO: 724397 - protein, 25 aa, Mycobacterium
RPKNLYRPKVPIFIAVGEPIAPTLP

SEQ ID NO: 724398 - protein, 20 aa, Mycobacterium
RPKPLALYVFGSGRASRGLV

SEQ ID NO: 724399 - protein, 17 aa, Mycobacterium
RPKRTQVSIERPPGQSS

SEQ ID NO: 724400 - protein, 19 aa, Mycobacterium
RPKRYEFVDELPKNSYGKV

SEQ ID NO: 724401 - protein, 22 aa, Mycobacterium
RPKRYLPGVPIDIEDESQLPAV

SEQ ID NO: 724402 - protein, 27 aa, Mycobacterium
RPKVTATFFNPKWLKKTLVEGTKVMLS

SEQ ID NO: 724403 - protein, 18 aa, Mycobacterium
RPLADRGVMMPKRRRTRQ

SEQ ID NO: 724404 - protein, 19 aa, Mycobacterium
RPLADVVPVEWARMENRSV

SEQ ID NO: 724405 - protein, 19 aa, Mycobacterium
RPLAGAVFDELRTALHEYK

SEQ ID NO: 724406 - protein, 19 aa, Mycobacterium
RPLALRDIARRAASSERTL

SEQ ID NO: 724407 - protein, 20 aa, Mycobacterium
RPLALSGLTLLLACAHRLLE

SEQ ID NO: 724408 - protein, 24 aa, Mycobacterium
RPLARAQWAAAVDCVGGATLADVL

SEQ ID NO: 724409 - protein, 30 aa, Mycobacterium
RPLARFSSWYEFFPRSTGGWDPAGNPVHGT

SEQ ID NO: 724410 - protein, 30 aa, Mycobacterium
RPLARFSSWYEMFPRSTGGWDENGHPVHGT

SEQ ID NO: 724411 - protein, 19 aa, Mycobacterium
RPLAVFPGGTFNHFAKDIG

SEQ ID NO: 724412 - protein, 23 aa, Mycobacterium
RPLDPARAAAFEVLRAVSERDAY

SEQ ID NO: 724413 - protein, 17 aa, Mycobacterium
RPLDVANVIAFLASDAA

SEQ ID NO: 724414 - protein, 25 aa, Mycobacterium
RPLDVGALHMAHWLEGMGLVVMGLA

SEQ ID NO: 724415 - protein, 25 aa, Mycobacterium
RPLDVGGLHMAHWLEGTGLIVMGLA

SEQ ID NO: 724416 - protein, 21 aa, Mycobacterium
RPLDWFCSFSSAAALVGSPGQ

SEQ ID NO: 724417 - protein, 25 aa, Mycobacterium
RPLDWRFKGVPADWWGRTEAQIIAA

SEQ ID NO: 724418 - protein, 31 aa, Mycobacterium
RPLDYQPWISFPGAIAGEWQGQIRLIADALG

SEQ ID NO: 724419 - protein, 20 aa, Mycobacterium
RPLEGRAAWRERLAVEAATR

SEQ ID NO: 724420 - protein, 17 aa, Mycobacterium
RPLEIGATLAGCDERQL

SEQ ID NO: 724421 - protein, 17 aa, Mycobacterium
RPLEMGAAMADCDDRTL

SEQ ID NO: 724422 - protein, 22 aa, Mycobacterium
RPLERVACRAWNGLWRVAPQLV

SEQ ID NO: 724423 - protein, 19 aa, Mycobacterium
RPLERVYAAVFIDALHVKI

SEQ ID NO: 724424 - protein, 17 aa, Mycobacterium
RPLFAANRALDWPDEPV

SEQ ID NO: 724425 - protein, 18 aa, Mycobacterium
RPLFDRALHGGIASVPDA

SEQ ID NO: 724426 - protein, 19 aa, Mycobacterium
RPLFERALRDGIASVPDAP

SEQ ID NO: 724427 - protein, 18 aa, Mycobacterium
RPLFGICSGIVPDGIADL

SEQ ID NO: 724428 - protein, 18 aa, Mycobacterium
RPLFKIGNLMLVRRRPFD

SEQ ID NO: 724429 - protein, 19 aa, Mycobacterium
RPLFSAGLGGRLGDGRQWL

SEQ ID NO: 724430 - protein, 19 aa, Mycobacterium
RPLGIPVIVLAGQVDLDKS

SEQ ID NO: 724431 - protein, 19 aa, Mycobacterium
RPLGKLVAYVLEPGSVGKP

SEQ ID NO: 724432 - protein, 20 aa, Mycobacterium
RPLGLDRYGVRFRVEGRDRD

SEQ ID NO: 724433 - protein, 18 aa, Mycobacterium
RPLGLVIGADACYKHLPL

SEQ ID NO: 724434 - protein, 24 aa, Mycobacterium
RPLGRARAAMTLDRYGLLLNDDLS

SEQ ID NO: 724435 - protein, 19 aa, Mycobacterium
RPLGVCGIITPFNHPMLIL

SEQ ID NO: 724436 - protein, 33 aa, Mycobacterium
RPLHLHRILLQRSWIAIFWGRFAQAVEMIAQAR

SEQ ID NO: 724437 - protein, 18 aa, Mycobacterium
RPLIGDGTAGAPGQNGGD

SEQ ID NO: 724438 - protein, 17 aa, Mycobacterium
RPLITPVDAEFRVGTMG

SEQ ID NO: 724439 - protein, 23 aa, Mycobacterium
RPLLDFTPGYVLRALDHLPKAGS

SEQ ID NO: 724440 - protein, 20 aa, Mycobacterium
RPLLEITAGYVKRAAAAFPH

SEQ ID NO: 724441 - protein, 25 aa, Mycobacterium
RPLLREFPILVPTGVGFMKNAGLVT

SEQ ID NO: 724442 - protein, 23 aa, Mycobacterium
RPLLRFFSRSWFRVEVSGIENLP

SEQ ID NO: 724443 - protein, 17 aa, Mycobacterium
RPLLRFPHHPLMLARFG

SEQ ID NO: 724444 - protein, 20 aa, Mycobacterium
RPLPAEWLNYAALDVELLIE

SEQ ID NO: 724445 - protein, 19 aa, Mycobacterium
RPLPDEWLNYAALDVEVLL

SEQ ID NO: 724446 - protein, 20 aa, Mycobacterium
RPLPDEWLNYAALDVEVLTD

SEQ ID NO: 724447 - protein, 17 aa, Mycobacterium
RPLPDPFIVAATQNPIE

SEQ ID NO: 724448 - protein, 18 aa, Mycobacterium
RPLPDPFIVAATQNPIEY

SEQ ID NO: 724449 - protein, 22 aa, Mycobacterium
RPLPEDGNGSWAQAVLELALIH

SEQ ID NO: 724450 - protein, 20 aa, Mycobacterium
RPLPEEWLNYAALDVELLIE

SEQ ID NO: 724451 - protein, 20 aa, Mycobacterium
RPLPEGPVNLGLSLDYDGGG

SEQ ID NO: 724452 - protein, 25 aa, Mycobacterium
RPLPHPRTGVLTDFLFTRHGRRLGY

SEQ ID NO: 724453 - protein, 20 aa, Mycobacterium
RPLPPAAERFAQFVIRTTHD

SEQ ID NO: 724454 - protein, 19 aa, Mycobacterium
RPLPPAWLNYAALDVELLI

SEQ ID NO: 724455 - protein, 19 aa, Mycobacterium
RPLPVMFFIHGGAYFLGSS

SEQ ID NO: 724456 - protein, 19 aa, Mycobacterium
RPLQSWPSAARVSPGSPDG

SEQ ID NO: 724457 - protein, 19 aa, Mycobacterium
RPLRGRLFGVLGASLALGD

SEQ ID NO: 724458 - protein, 18 aa, Mycobacterium
RPLRIGVQLQPQHASHYG

SEQ ID NO: 724459 - protein, 21 aa, Mycobacterium
RPLRPGEVVPVDIPLGPSSTL

SEQ ID NO: 724460 - protein, 29 aa, Mycobacterium
RPLRPQLRLEIGYALQCRVDLNRTRTTPR

SEQ ID NO: 724461 - protein, 17 aa, Mycobacterium
RPLRVAVDAGNGMAGHT

SEQ ID NO: 724462 - protein, 17 aa, Mycobacterium
RPLRVGLGIMDEPRRHR

SEQ ID NO: 724463 - protein, 24 aa, Mycobacterium
RPLSCAIAAVSVGVVDGRIRVDLP

SEQ ID NO: 724464 - protein, 23 aa, Mycobacterium
RPLSCAIAAVSVGVVDGRVRVDL

SEQ ID NO: 724465 - protein, 26 aa, Mycobacterium
RPLSHDTMEVWSWFLVEKDADEEFKQ

SEQ ID NO: 724466 - protein, 23 aa, Mycobacterium
RPLSLGRLDRGWVVASETAALDI

SEQ ID NO: 724467 - protein, 20 aa, Mycobacterium
RPLTPGGPGLMWGGGTLAAA

SEQ ID NO: 724468 - protein, 31 aa, Mycobacterium
RPLTTVAHFRRAHLRLAQIRLTNGEDLLGRI

SEQ ID NO: 724469 - protein, 21 aa, Mycobacterium
RPLVQGMRVALAAEVGRTHEE

SEQ ID NO: 724470 - protein, 20 aa, Mycobacterium
RPLVVACCDLDIAVVHGRAP

SEQ ID NO: 724471 - protein, 21 aa, Mycobacterium
RPLWEMWVIEGLHGGDAVSVV

SEQ ID NO: 724472 - protein, 19 aa, Mycobacterium
RPLWEMYVVEGLEKNRIAL

SEQ ID NO: 724473 - protein, 22 aa, Mycobacterium
RPLWLRGGRTLEGIAGLDSILN

SEQ ID NO: 724474 - protein, 19 aa, Mycobacterium
RPLYGRDALFERLCLEAFQ

SEQ ID NO: 724475 - protein, 20 aa, Mycobacterium
RPLYRFPVFGFFALSIGAAA

SEQ ID NO: 724476 - protein, 19 aa, Mycobacterium
RPLYTLAHYGVFMGPLGDL

SEQ ID NO: 724477 - protein, 27 aa, Mycobacterium
RPLYYLEMPPSLFAPIVENLAKADLLE

SEQ ID NO: 724478 - protein, 19 aa, Mycobacterium
RPMAPDFDSNIAFQAAKEL

SEQ ID NO: 724479 - protein, 18 aa, Mycobacterium
RPMCGVEIRLRDDHKKTV

SEQ ID NO: 724480 - protein, 18 aa, Mycobacterium
RPMCPKCRCLHWDTVESG

SEQ ID NO: 724481 - protein, 20 aa, Mycobacterium
RPMDAGVFAQKALRGVLRNE

SEQ ID NO: 724482 - protein, 18 aa, Mycobacterium
RPMEAYTLSISREIARAV

SEQ ID NO: 724483 - protein, 18 aa, Mycobacterium
RPMEAYTLSVSRDIARTV

SEQ ID NO: 724484 - protein, 28 aa, Mycobacterium
RPMELFEIFADLELAWGPTWSGSLKSLW

SEQ ID NO: 724485 - protein, 19 aa, Mycobacterium
RPMFAQLMLDEAFSKSDPQ

SEQ ID NO: 724486 - protein, 18 aa, Mycobacterium
RPMHEKIVGRIAVSDLAR

SEQ ID NO: 724487 - protein, 26 aa, Mycobacterium
RPMILKRFVKGISEEAVFQKRAPANR

SEQ ID NO: 724488 - protein, 28 aa, Mycobacterium
RPMILKRFVKGITQEAVFQKRAPKNRPD

SEQ ID NO: 724489 - protein, 25 aa, Mycobacterium
RPMLERFRAMEPWLVGGRVHAPFWE

SEQ ID NO: 724490 - protein, 18 aa, Mycobacterium
RPMMLKRFVKGIDVEAVF

SEQ ID NO: 724491 - protein, 18 aa, Mycobacterium
RPMMQLVVTNGTAKDLKG

SEQ ID NO: 724492 - protein, 23 aa, Mycobacterium
RPMPTAELLSWFDGARRALVAAF

SEQ ID NO: 724493 - protein, 20 aa, Mycobacterium
RPMRARRRGGIVLVGSTAAT

SEQ ID NO: 724494 - protein, 24 aa, Mycobacterium
RPMTCPSLPAGFDFTDPDIYARRL

SEQ ID NO: 724495 - protein, 23 aa, Mycobacterium
RPNARGVPFIFVRTDSAGNISKR

SEQ ID NO: 724496 - protein, 19 aa, Mycobacterium
RPNASRLCNWCPHQQHCPA

SEQ ID NO: 724497 - protein, 26 aa, Mycobacterium
RPNAYRFGTVGWPFPATDVRIAEDGE

SEQ ID NO: 724498 - protein, 26 aa, Mycobacterium
RPNAYRFGTVGWPFPATEAKIATDGE

SEQ ID NO: 724499 - protein, 17 aa, Mycobacterium
RPNCGRSDVQFHGQSES

SEQ ID NO: 724500 - protein, 21 aa, Mycobacterium
RPNDAGAFIVIAWGVTDFEEA

SEQ ID NO: 724501 - protein, 19 aa, Mycobacterium
RPNGAWSSSSVRRIQLSPW

SEQ ID NO: 724502 - protein, 18 aa, Mycobacterium
RPNGHWSKAPAFEHDPER

SEQ ID NO: 724503 - protein, 19 aa, Mycobacterium
RPNGPEPAAEMFFAALATG

SEQ ID NO: 724504 - protein, 20 aa, Mycobacterium
RPNHLSVPLTRRSRRVPTSS

SEQ ID NO: 724505 - protein, 26 aa, Mycobacterium
RPNHPLWSSWLMKRPQCRVNIGGRES

SEQ ID NO: 724506 - protein, 22 aa, Mycobacterium
RPNKPRIVTFRGNFSGKTIATL

SEQ ID NO: 724507 - protein, 20 aa, Mycobacterium
RPNLVRFLLGVQYANATSLI

SEQ ID NO: 724508 - protein, 18 aa, Mycobacterium
RPNPALLMQGMWVRFRAA

SEQ ID NO: 724509 - protein, 23 aa, Mycobacterium
RPNRPGWFLSPAVVAATNDMEIA

SEQ ID NO: 724510 - protein, 23 aa, Mycobacterium
RPPAEAFRRLYFDTITHGVPQLE

SEQ ID NO: 724511 - protein, 21 aa, Mycobacterium
RPPAILYHVSRTLAIQPVAIG

SEQ ID NO: 724512 - protein, 19 aa, Mycobacterium
RPPAPGGYGGQGYDQGYRP

SEQ ID NO: 724513 - protein, 24 aa, Mycobacterium
RPPARARGAAALRDRAKAEAKPDD

SEQ ID NO: 724514 - protein, 27 aa, Mycobacterium
RPPEAPWVRPPLRSMKWMETFLDTLIS

SEQ ID NO: 724515 - protein, 23 aa, Mycobacterium
RPPELPWFGTDGTQDFGGTPVPD

SEQ ID NO: 724516 - protein, 18 aa, Mycobacterium
RPPEPAGERCEMCATEIA

SEQ ID NO: 724517 - protein, 20 aa, Mycobacterium
RPPFACGIDDVYSACAPLVD

SEQ ID NO: 724518 - protein, 19 aa, Mycobacterium
RPPFGSAVFSVTARHGERR

SEQ ID NO: 724519 - protein, 24 aa, Mycobacterium
RPPFLLDSHRPRLALADYRDRELR

SEQ ID NO: 724520 - protein, 18 aa, Mycobacterium
RPPFNVCISNVPGSRNPL

SEQ ID NO: 724521 - protein, 18 aa, Mycobacterium
RPPFPVMHVDTGHNFDEV

SEQ ID NO: 724522 - protein, 20 aa, Mycobacterium
RPPFSCPIDDVYAVCAPLVD

SEQ ID NO: 724523 - protein, 24 aa, Mycobacterium
RPPFWQQLVELGWLGLHIGEEHGG

SEQ ID NO: 724524 - protein, 19 aa, Mycobacterium
RPPGRKDPAAFVLENFSAA

SEQ ID NO: 724525 - protein, 19 aa, Mycobacterium
RPPGRKDPAAFVLENFTTA

SEQ ID NO: 724526 - protein, 24 aa, Mycobacterium
RPPHERIMWLSVPLCGPSRTGDLP

SEQ ID NO: 724527 - protein, 19 aa, Mycobacterium
RPPHEVIRDIVTVYWTTYR

SEQ ID NO: 724528 - protein, 24 aa, Mycobacterium
RPPHLKAIFPVAATTDLYEAAVHH

SEQ ID NO: 724529 - protein, 24 aa, Mycobacterium
RPPHLKAIFPVAVTTDLYEGANHH

SEQ ID NO: 724530 - protein, 22 aa, Mycobacterium
RPPHLRAIVPWEGMTDPYRDLL

SEQ ID NO: 724531 - protein, 21 aa, Mycobacterium
RPPIDLKVGSWFVSTHPSSHF

SEQ ID NO: 724532 - protein, 21 aa, Mycobacterium
RPPLLKRLVLQTAARLSRRGR

SEQ ID NO: 724533 - protein, 18 aa, Mycobacterium
RPPLMALIGPRLFARRKV

SEQ ID NO: 724534 - protein, 24 aa, Mycobacterium
RPPLNKDTRVCISLSGRPSNIGTR

SEQ ID NO: 724535 - protein, 20 aa, Mycobacterium
RPPNGRGRICRECTRITNRA

SEQ ID NO: 724536 - protein, 18 aa, Mycobacterium
RPPRETWETNPFYRQLDA

SEQ ID NO: 724537 - protein, 19 aa, Mycobacterium
RPPRMLVLLHLDGSSDRPA

SEQ ID NO: 724538 - protein, 19 aa, Mycobacterium
RPPRMLVLLHLDGSVERPS

SEQ ID NO: 724539 - protein, 19 aa, Mycobacterium
RPPRSSGPGRARPAQPESA

SEQ ID NO: 724540 - protein, 19 aa, Mycobacterium
RPPRVVIIGAGFGGIAAAV

SEQ ID NO: 724541 - protein, 26 aa, Mycobacterium
RPPSSCSIVVRRLCRPPPFADSGSVG

SEQ ID NO: 724542 - protein, 20 aa, Mycobacterium
RPPVLCTVKLARRVLTRDEA

SEQ ID NO: 724543 - protein, 23 aa, Mycobacterium
RPPWAGSCYATLEGRAREIDTVY

SEQ ID NO: 724544 - protein, 17 aa, Mycobacterium
RPPYGASTVAWAGPAAR

SEQ ID NO: 724545 - protein, 24 aa, Mycobacterium
RPPYYIYCRAIDSGKFREVSATGS

SEQ ID NO: 724546 - protein, 17 aa, Mycobacterium
RPQCLAAALERAEPWGV

SEQ ID NO: 724547 - protein, 19 aa, Mycobacterium
RPQDNWLASWSRAEAVVPR

SEQ ID NO: 724548 - protein, 19 aa, Mycobacterium
RPQDWPAYDDPFGDWHEDP

SEQ ID NO: 724549 - protein, 17 aa, Mycobacterium
RPQELALLRLLEGPRFC

SEQ ID NO: 724550 - protein, 17 aa, Mycobacterium
RPQELRRDPDLVVTVDS

SEQ ID NO: 724551 - protein, 19 aa, Mycobacterium
RPQEQPLRGKVAVITGASA

SEQ ID NO: 724552 - protein, 23 aa, Mycobacterium
RPQESRILLANGLELLSSERGLA

SEQ ID NO: 724553 - protein, 25 aa, Mycobacterium
RPQFYRPPGRPEVITALDDAGLLPA

SEQ ID NO: 724554 - protein, 19 aa, Mycobacterium
RPQGASFHGEFFSFDNVMS

SEQ ID NO: 724555 - protein, 21 aa, Mycobacterium
RPQGPWMTVFGGFEVVDGTGS

SEQ ID NO: 724556 - protein, 26 aa, Mycobacterium
RPQHPARFAGGLGHLARLAAAAPRAV

SEQ ID NO: 724557 - protein, 19 aa, Mycobacterium
RPQLGELGGRVLTGQQIQG

SEQ ID NO: 724558 - protein, 18 aa, Mycobacterium
RPQLILLDVYLPDMTGLE

SEQ ID NO: 724559 - protein, 19 aa, Mycobacterium
RPQPRVTAMVPVVLSDDAE

SEQ ID NO: 724560 - protein, 19 aa, Mycobacterium
RPQPVAVYDRIGGREAIEV

SEQ ID NO: 724561 - protein, 35 aa, Mycobacterium
RPQRDRFANLLLRWLPRTVALPVIRAKNISLMTFS

SEQ ID NO: 724562 - protein, 36 aa, Mycobacterium
RPQRRPVLHLPTHWPWTDQWLMLWRNTIGYSPPATP

SEQ ID NO: 724563 - protein, 24 aa, Mycobacterium
RPQRVCGKCGRTRRIARRARDGQP

SEQ ID NO: 724564 - protein, 21 aa, Mycobacterium
RPQTLRKWGLDYESLRAVNER

SEQ ID NO: 724565 - protein, 23 aa, Mycobacterium
RPRAGLIGCAFADLAEVMAGVFA

SEQ ID NO: 724566 - protein, 25 aa, Mycobacterium
RPRAMCAAEISELVKELGGLSVILG

SEQ ID NO: 724567 - protein, 21 aa, Mycobacterium
RPRATLVLRKDADHSINRLRL

SEQ ID NO: 724568 - protein, 17 aa, Mycobacterium
RPRCLKPALLFEFGGET

SEQ ID NO: 724569 - protein, 18 aa, Mycobacterium
RPRDELAVAAGLTRAERG

SEQ ID NO: 724570 - protein, 20 aa, Mycobacterium
RPRDVGWSLATTRAALEHRA

SEQ ID NO: 724571 - protein, 25 aa, Mycobacterium
RPRELTLDDAVVWRRLQIVDTEAGG

SEQ ID NO: 724572 - protein, 24 aa, Mycobacterium
RPREYWRGPVWPVMTWLFSWCFAR

SEQ ID NO: 724573 - protein, 19 aa, Mycobacterium
RPRFARYVDSARRWTRHPK

SEQ ID NO: 724574 - protein, 26 aa, Mycobacterium
RPRGEARRLLLDAARELFARKDYRAT

SEQ ID NO: 724575 - protein, 24 aa, Mycobacterium
RPRGEPRRLLLDAARELFARQDYR

SEQ ID NO: 724576 - protein, 19 aa, Mycobacterium
RPRGIIYHRSLGARFADVL

SEQ ID NO: 724577 - protein, 19 aa, Mycobacterium
RPRGKTVWFTGLSGSGKSS

SEQ ID NO: 724578 - protein, 28 aa, Mycobacterium
RPRGLEIVSCPSCGRAQVDVYTLANAVS

SEQ ID NO: 724579 - protein, 28 aa, Mycobacterium
RPRGLEIVSCPSCGRAQVDVYTLANEVT

SEQ ID NO: 724580 - protein, 20 aa, Mycobacterium
RPRGMSYLVVGGRRGGSAMA

SEQ ID NO: 724581 - protein, 20 aa, Mycobacterium
RPRGRTVWLTGLSGAGKSSV

SEQ ID NO: 724582 - protein, 19 aa, Mycobacterium
RPRHVMPVHGTWRMLRANS

SEQ ID NO: 724583 - protein, 22 aa, Mycobacterium
RPRINLSQPRFEAIVEGDVRQR

SEQ ID NO: 724584 - protein, 23 aa, Mycobacterium
RPRIPQDVCMRAAYIQQRGPAEN

SEQ ID NO: 724585 - protein, 21 aa, Mycobacterium
RPRIVQLAVLVDRGHRELPIR

SEQ ID NO: 724586 - protein, 22 aa, Mycobacterium
RPRKMREAADLWVRLTDAVGAD

SEQ ID NO: 724587 - protein, 24 aa, Mycobacterium
RPRKPESLSWAELREQWRGDGRGL

SEQ ID NO: 724588 - protein, 21 aa, Mycobacterium
RPRLAKPGVVRRIVMDRNAGL

SEQ ID NO: 724589 - protein, 19 aa, Mycobacterium
RPRLDSVDSKERFRQLVDL

SEQ ID NO: 724590 - protein, 20 aa, Mycobacterium
RPRLGDRSVDVYPVNYPATD

SEQ ID NO: 724591 - protein, 19 aa, Mycobacterium
RPRLGEFAGVVADVDDPVI

SEQ ID NO: 724592 - protein, 17 aa, Mycobacterium
RPRLLSVAHRILGSRHD

SEQ ID NO: 724593 - protein, 19 aa, Mycobacterium
RPRLVVHRSARHIHVQLVN

SEQ ID NO: 724594 - protein, 20 aa, Mycobacterium
RPRLWRQRSSAWRRWPQAIS

SEQ ID NO: 724595 - protein, 18 aa, Mycobacterium
RPRMPVTVRADGPATIET

SEQ ID NO: 724596 - protein, 20 aa, Mycobacterium
RPRPDAWTDADWPGRSIEGR

SEQ ID NO: 724597 - protein, 21 aa, Mycobacterium
RPRPGSLRTLVPVSVRSTDAF

SEQ ID NO: 724598 - protein, 18 aa, Mycobacterium
RPRPPREIFVYSPEVEGV

SEQ ID NO: 724599 - protein, 22 aa, Mycobacterium
RPRPRVIAGVAVVVTSEPERVR

SEQ ID NO: 724600 - protein, 18 aa, Mycobacterium
RPRQDLFTDYGRVFPDAD

SEQ ID NO: 724601 - protein, 27 aa, Mycobacterium
RPRQFGVPIDIWWFRLPKHPDDPQGPR

SEQ ID NO: 724602 - protein, 21 aa, Mycobacterium
RPRRAAVLGSPIAHSRSPQLH

SEQ ID NO: 724603 - protein, 19 aa, Mycobacterium
RPRRCAGIHPAGRHERRRA

SEQ ID NO: 724604 - protein, 21 aa, Mycobacterium
RPRRFAYPPNLFVVDGGAPQV

SEQ ID NO: 724605 - protein, 26 aa, Mycobacterium
RPRRRRRGRRGRGRGRGEQNDDATSD

SEQ ID NO: 724606 - protein, 24 aa, Mycobacterium
RPRRWIRRVPPLYGQHTQEVLTDI

SEQ ID NO: 724607 - protein, 25 aa, Mycobacterium
RPRSCSHVPEWARRWQRLLFDNGWL

SEQ ID NO: 724608 - protein, 25 aa, Mycobacterium
RPRSGPFAEWLVCDLRSADEIEGAL

SEQ ID NO: 724609 - protein, 28 aa, Mycobacterium
RPRSLEIVSCPSCGRAQVDVYTLANAVS

SEQ ID NO: 724610 - protein, 28 aa, Mycobacterium
RPRSLEIVSCPSCGRAQVDVYTLANEVT

SEQ ID NO: 724611 - protein, 19 aa, Mycobacterium
RPRSNGCSYADSPHHVPIQ

SEQ ID NO: 724612 - protein, 20 aa, Mycobacterium
RPRSRCFIAMSVILRHAARR

SEQ ID NO: 724613 - protein, 24 aa, Mycobacterium
RPRSSSDIPAWARRWQRLLFDSGW

SEQ ID NO: 724614 - protein, 24 aa, Mycobacterium
RPRSSSHVPEWARRWQRLLFDSGW

SEQ ID NO: 724615 - protein, 26 aa, Mycobacterium
RPRSYSYLILRSFPPLIHQGGTLTFT

SEQ ID NO: 724616 - protein, 28 aa, Mycobacterium
RPRTLEIVSCPSCGRAQVDVYTLANEVT

SEQ ID NO: 724617 - protein, 20 aa, Mycobacterium
RPRTPCRTFAAFLEINGLMK

SEQ ID NO: 724618 - protein, 17 aa, Mycobacterium
RPRTRHLVLNPIIDIDG

SEQ ID NO: 724619 - protein, 17 aa, Mycobacterium
RPRTRRAVWKPEEIRTF

SEQ ID NO: 724620 - protein, 22 aa, Mycobacterium
RPRVAAPGRIVLLTSGTTGKPK

SEQ ID NO: 724621 - protein, 19 aa, Mycobacterium
RPRVLRWPTGSMEILHEGD

SEQ ID NO: 724622 - protein, 20 aa, Mycobacterium
RPRVVLVDGVPMSALAVQVP

SEQ ID NO: 724623 - protein, 18 aa, Mycobacterium
RPRWGWRRAAKMARRAGW

SEQ ID NO: 724624 - protein, 18 aa, Mycobacterium
RPRYVTAIDAETGTVRVG

SEQ ID NO: 724625 - protein, 17 aa, Mycobacterium
RPSAKLAEFIRIRDLTC

SEQ ID NO: 724626 - protein, 19 aa, Mycobacterium
RPSDAEWLVPFDGDGHWDL

SEQ ID NO: 724627 - protein, 18 aa, Mycobacterium
RPSERWGEEVVALVATDP

SEQ ID NO: 724628 - protein, 20 aa, Mycobacterium
RPSERWGSEVVAIVQFAEGA

SEQ ID NO: 724629 - protein, 20 aa, Mycobacterium
RPSETAFTFIDYERDWAGIA

SEQ ID NO: 724630 - protein, 20 aa, Mycobacterium
RPSEVARLGYLAGIVATLVR

SEQ ID NO: 724631 - protein, 26 aa, Mycobacterium
RPSEVKASAPARVRLGEGWISDPVDL

SEQ ID NO: 724632 - protein, 18 aa, Mycobacterium
RPSFHNEYLATFNRDNVH

SEQ ID NO: 724633 - protein, 18 aa, Mycobacterium
RPSGAWRTILDVLTGDPG

SEQ ID NO: 724634 - protein, 18 aa, Mycobacterium
RPSGNGFSPPAVKRPGIG

SEQ ID NO: 724635 - protein, 25 aa, Mycobacterium
RPSGTEPKVKCYIEVREPVITDPTV

SEQ ID NO: 724636 - protein, 28 aa, Mycobacterium
RPSHDPALCKAGLAFRSGPVDYDRRDPA

SEQ ID NO: 724637 - protein, 20 aa, Mycobacterium
RPSIPAEVMASVITLQALHG

SEQ ID NO: 724638 - protein, 19 aa, Mycobacterium
RPSLGRAIAEHGLSLSDYL

SEQ ID NO: 724639 - protein, 25 aa, Mycobacterium
RPSLSAALPPSALWGREAYARGLFG

SEQ ID NO: 724640 - protein, 20 aa, Mycobacterium
RPSLSAALPPSALWGRENYF

SEQ ID NO: 724641 - protein, 18 aa, Mycobacterium
RPSLVPVEAIEHLGGEVQ

SEQ ID NO: 724642 - protein, 17 aa, Mycobacterium
RPSMSNDYLRTFNRDDV

SEQ ID NO: 724643 - protein, 17 aa, Mycobacterium
RPSMSNDYLRTFNREDV

SEQ ID NO: 724644 - protein, 19 aa, Mycobacterium
RPSPAGLFTSGYYGQLKVP

SEQ ID NO: 724645 - protein, 17 aa, Mycobacterium
RPSPHLGTIEVRIFDGV

SEQ ID NO: 724646 - protein, 20 aa, Mycobacterium
RPSPHLGTIEVRVCDGVSNL

SEQ ID NO: 724647 - protein, 27 aa, Mycobacterium
RPSPHLGTLEMRICDGVSNLRELGALV

SEQ ID NO: 724648 - protein, 20 aa, Mycobacterium
RPSQSRLCDWCPHQQHCPLF

SEQ ID NO: 724649 - protein, 18 aa, Mycobacterium
RPSRADRDIVDFWLTELG

SEQ ID NO: 724650 - protein, 19 aa, Mycobacterium
RPSRRLSRIAPAFQPNPAA

SEQ ID NO: 724651 - protein, 21 aa, Mycobacterium
RPSRRPQRWRWRAINGGNHRV

SEQ ID NO: 724652 - protein, 18 aa, Mycobacterium
RPSRVVVVDEIPRLPSGK

SEQ ID NO: 724653 - protein, 28 aa, Mycobacterium
RPSTAADEIIRWASPIIAFQRTALQDVE

SEQ ID NO: 724654 - protein, 17 aa, Mycobacterium
RPSTTVDEIVRYTSPLI

SEQ ID NO: 724655 - protein, 21 aa, Mycobacterium
RPSVDPVLRRYSTVRVPIADV

SEQ ID NO: 724656 - protein, 19 aa, Mycobacterium
RPSWDELSAVIADVPPLPG

SEQ ID NO: 724657 - protein, 23 aa, Mycobacterium
RPSWSRDSAYFWEGVAAHELRLQ

SEQ ID NO: 724658 - protein, 22 aa, Mycobacterium
RPSYGLAEATLFVATRETGHPP

SEQ ID NO: 724659 - protein, 31 aa, Mycobacterium
RPSYSLKEIRHWLQVFAQRFYSFSQFKRSAL

SEQ ID NO: 724660 - protein, 27 aa, Mycobacterium
RPSYVDWDIRVCREVRRGGRRHGADVR

SEQ ID NO: 724661 - protein, 17 aa, Mycobacterium
RPTAFKPSYGIAEATLF

SEQ ID NO: 724662 - protein, 18 aa, Mycobacterium
RPTAIAERVTKTWELGPG

SEQ ID NO: 724663 - protein, 25 aa, Mycobacterium
RPTAQLPPKSLRRLLEVNVEGPFAI

SEQ ID NO: 724664 - protein, 19 aa, Mycobacterium
RPTARAVLGRFGGTTAESD

SEQ ID NO: 724665 - protein, 23 aa, Mycobacterium
RPTARRIAQRWVRQGTDAGNALG

SEQ ID NO: 724666 - protein, 31 aa, Mycobacterium
RPTAWLAEGLLHYLPAWAHGVLFERVHALSP

SEQ ID NO: 724667 - protein, 18 aa, Mycobacterium
RPTAWLFGPESRGLPSDV

SEQ ID NO: 724668 - protein, 30 aa, Mycobacterium
RPTDLPGLSGLGDRGVDLFLVDSTNSEVPG

SEQ ID NO: 724669 - protein, 25 aa, Mycobacterium
RPTELCSRELFAPVATIYQVESTSE

SEQ ID NO: 724670 - protein, 20 aa, Mycobacterium
RPTFQKGLAHHVAAWRAARL

SEQ ID NO: 724671 - protein, 17 aa, Mycobacterium
RPTGAGIGRVVDAEDAL

SEQ ID NO: 724672 - protein, 17 aa, Mycobacterium
RPTGAMLAAGDFVKIDF

SEQ ID NO: 724673 - protein, 24 aa, Mycobacterium
RPTGRRNTRQWIWDNLDPRRCAPV

SEQ ID NO: 724674 - protein, 21 aa, Mycobacterium
RPTHPHWYLATIGAAVPGRGI

SEQ ID NO: 724675 - protein, 18 aa, Mycobacterium
RPTHRSCAARSRQVTASS

SEQ ID NO: 724676 - protein, 19 aa, Mycobacterium
RPTITGLVRGLLTAAAGFS

SEQ ID NO: 724677 - protein, 20 aa, Mycobacterium
RPTLAGAVPTIWNDVDRYLD

SEQ ID NO: 724678 - protein, 20 aa, Mycobacterium
RPTLAGAVPTIWNDVLNCLE

SEQ ID NO: 724679 - protein, 33 aa, Mycobacterium; identical to SEQ ID NO: 84267

SEQ ID NO: 724680 - protein, 18 aa, Mycobacterium
RPTPATPRRAVIQQAVDY

SEQ ID NO: 724681 - protein, 19 aa, Mycobacterium
RPTPCAEFDVAQLTDHLLK

SEQ ID NO: 724682 - protein, 20 aa, Mycobacterium
RPTPELGITMDAFIALRAEY

SEQ ID NO: 724683 - protein, 29 aa, Mycobacterium
RPTPLPRGEVAWWLFPAGRAGAVTDAGRE

SEQ ID NO: 724684 - protein, 21 aa, Mycobacterium
RPTSPGQLVIREVYGDWSQQR

SEQ ID NO: 724685 - protein, 19 aa, Mycobacterium
RPTSVHWHGIALRNDMDGV

SEQ ID NO: 724686 - protein, 21 aa, Mycobacterium
RPTSWSAEGLLMYLPPQAQDR

SEQ ID NO: 724687 - protein, 18 aa, Mycobacterium
RPTTHVQFATLHRDRGWQ

SEQ ID NO: 724688 - protein, 24 aa, Mycobacterium
RPTTVVEFGMSFGISTIHLAAAVR

SEQ ID NO: 724689 - protein, 20 aa, Mycobacterium
RPTVAFECVGVPGLIQQLIA

SEQ ID NO: 724690 - protein, 25 aa, Mycobacterium
RPTVFASNFLGMWGTQLQAGDVVRG

SEQ ID NO: 724691 - protein, 20 aa, Mycobacterium
RPTVPARVVATVMLLQAYEG

SEQ ID NO: 724692 - protein, 18 aa, Mycobacterium
RPTYRRLKAECGREELAQ

SEQ ID NO: 724693 - protein, 17 aa, Mycobacterium
RPTYSGWLGSREIALAY

SEQ ID NO: 724694 - protein, 23 aa, Mycobacterium
RPVAARELLPERALLGDVTAATA

SEQ ID NO: 724695 - protein, 29 aa, Mycobacterium
RPVAARLPLPCRLGATLIFGRSAGVLARL

SEQ ID NO: 724696 - protein, 19 aa, Mycobacterium
RPVAELVAGGVLLVAPGDP

SEQ ID NO: 724697 - protein, 21 aa, Mycobacterium
RPVAGLRWPWHARLGTAAVCW

SEQ ID NO: 724698 - protein, 30 aa, Mycobacterium
RPVARFGAWYEMFPRSTGGWDDEGKPVHGT

SEQ ID NO: 724699 - protein, 20 aa, Mycobacterium
RPVARPEWQDALNADTSAAL

SEQ ID NO: 724700 - protein, 19 aa, Mycobacterium
RPVASPALDVYALLSPQAD

SEQ ID NO: 724701 - protein, 20 aa, Mycobacterium
RPVASPALDVYGLMSPQADR

SEQ ID NO: 724702 - protein, 25 aa, Mycobacterium
RPVAVDLRDDWPAALREAGFDPAQP

SEQ ID NO: 724703 - protein, 27 aa, Mycobacterium
RPVDLDGRAALIGDLRVGPVGGQLKPL

SEQ ID NO: 724704 - protein, 21 aa, Mycobacterium
RPVDLHRGAALVGHQRVGPVG

SEQ ID NO: 724705 - protein, 22 aa, Mycobacterium
RPVDMGNALPVQAIDADDVANA

SEQ ID NO: 724706 - protein, 20 aa, Mycobacterium
RPVFTGAPCTGPVARSGKSS

SEQ ID NO: 724707 - protein, 24 aa, Mycobacterium
RPVGCGTCGARVLVRKASWEQTSV

SEQ ID NO: 724708 - protein, 19 aa, Mycobacterium
RPVGELVAVLLHAAKPATP

SEQ ID NO: 724709 - protein, 22 aa, Mycobacterium
RPVGGLPRAAARVGDSEVARER

SEQ ID NO: 724710 - protein, 17 aa, Mycobacterium
RPVGRDVILECIRLAMQ

SEQ ID NO: 724711 - protein, 19 aa, Mycobacterium
RPVGRLLRRERVVADTRRA

SEQ ID NO: 724712 - protein, 19 aa, Mycobacterium
RPVGVPAIVVRPDGGVDSA

SEQ ID NO: 724713 - protein, 20 aa, Mycobacterium
RPVHDPARYDRIWKEHVLPL

SEQ ID NO: 724714 - protein, 28 aa, Mycobacterium
RPVIDAVAARAPRGYGLSGPEGNHDDDV

SEQ ID NO: 724715 - protein, 19 aa, Mycobacterium
RPVILAGGGVRRSPGGPAA

SEQ ID NO: 724716 - protein, 19 aa, Mycobacterium
RPVIPPAILACGVRYHTSD

SEQ ID NO: 724717 - protein, 29 aa, Mycobacterium
RPVKSPPTEGWRRLVYVLSGQLINLGESP

SEQ ID NO: 724718 - protein, 21 aa, Mycobacterium
RPVLEVHGWGDLQPELNALSK

SEQ ID NO: 724719 - protein, 25 aa, Mycobacterium
RPVLGICGGFQMLGRVIRDPHGVEG

SEQ ID NO: 724720 - protein, 19 aa, Mycobacterium
RPVLPLTIGLDHRFVDGYQ

SEQ ID NO: 724721 - protein, 26 aa, Mycobacterium
RPVLREVEWRIGPGERTGIVGANGAG

SEQ ID NO: 724722 - protein, 18 aa, Mycobacterium
RPVLSARWDRAAVEPLFA

SEQ ID NO: 724723 - protein, 18 aa, Mycobacterium
RPVLVVDFGAQYAQLIAR

SEQ ID NO: 724724 - protein, 17 aa, Mycobacterium
RPVNALRGFLDAVSTVI

SEQ ID NO: 724725 - protein, 17 aa, Mycobacterium
RPVNPPVGVGRQFSCEP

SEQ ID NO: 724726 - protein, 26 aa, Mycobacterium
RPVNPRGRLAVMAAEQGWPVLRLEDP

SEQ ID NO: 724727 - protein, 22 aa, Mycobacterium
RPVPASLVLLSFAPDASLSNPA

SEQ ID NO: 724728 - protein, 19 aa, Mycobacterium
RPVPDSSDWEVIRKAGTEI

SEQ ID NO: 724729 - protein, 20 aa, Mycobacterium
RPVPGFAIALTDLRPGERAT

SEQ ID NO: 724730 - protein, 23 aa, Mycobacterium
RPVPGTCRIDWAAADREAHRGGV

SEQ ID NO: 724731 - protein, 17 aa, Mycobacterium
RPVPHGAAGELYVAGAQ

SEQ ID NO: 724732 - protein, 21 aa, Mycobacterium
RPVPLGLIRECLEIAVQAPTS

SEQ ID NO: 724733 - protein, 26 aa, Mycobacterium
RPVPPWREIDGVVIPSPFDLSTLMRN

SEQ ID NO: 724734 - protein, 19 aa, Mycobacterium
RPVPQWRAVTVPADGTLAV

SEQ ID NO: 724735 - protein, 17 aa, Mycobacterium
RPVPREDLIAFFVAADV

SEQ ID NO: 724736 - protein, 23 aa, Mycobacterium
RPVPSARGWSAAPVRHGISVVHS

SEQ ID NO: 724737 - protein, 17 aa, Mycobacterium
RPVPVRRIARYVKRFLG

SEQ ID NO: 724738 - protein, 19 aa, Mycobacterium
RPVQIAPRVAVGARALNAV

SEQ ID NO: 724739 - protein, 27 aa, Mycobacterium
RPVQPPPSDGWRLLLYKMSGGLINLGE

SEQ ID NO: 724740 - protein, 25 aa, Mycobacterium
RPVQPWPGVRYCHGFGACAPQQRMY

SEQ ID NO: 724741 - protein, 27 aa, Mycobacterium
RPVQRRLRIGLCMDSPFTPATDNPTRQ

SEQ ID NO: 724742 - protein, 30 aa, Mycobacterium
RPVQVIPEKVEVLWRHVRCDGTEVEPLERE

SEQ ID NO: 724743 - protein, 24 aa, Mycobacterium
RPVRAHARLAAAHIVHESRAVIGE

SEQ ID NO: 724744 - protein, 21 aa, Mycobacterium
RPVRISRFDVLAVRGSGEDLI

SEQ ID NO: 724745 - protein, 20 aa, Mycobacterium
RPVRLCLDLDAGYWRAGGRV

SEQ ID NO: 724746 - protein, 20 aa, Mycobacterium
RPVRLLPGIAGPLAGRKPGD

SEQ ID NO: 724747 - protein, 20 aa, Mycobacterium
RPVRLLPGIASPLAGVSDEA

SEQ ID NO: 724748 - protein, 19 aa, Mycobacterium
RPVRLTVDLFRAARNAPTT

SEQ ID NO: 724749 - protein, 25 aa, Mycobacterium
RPVRMSARRFWVRYAAEVAGALTLD

SEQ ID NO: 724750 - protein, 17 aa, Mycobacterium
RPVRWVHVSDVADLSGL

SEQ ID NO: 724751 - protein, 19 aa, Mycobacterium
RPVSEYGFEPVRFDEMRRG

SEQ ID NO: 724752 - protein, 19 aa, Mycobacterium
RPVSGYCARVEHSGEIAEA

SEQ ID NO: 724753 - protein, 19 aa, Mycobacterium
RPVSIPELFTAQVSAEPDA

SEQ ID NO: 724754 - protein, 20 aa, Mycobacterium
RPVSRSVLCKAVDEAGITFF

SEQ ID NO: 724755 - protein, 21 aa, Mycobacterium
RPVSWCRELLSATARSSDYAT

SEQ ID NO: 724756 - protein, 22 aa, Mycobacterium
RPVTLPSYGGATTWASTVAAYE

SEQ ID NO: 724757 - protein, 19 aa, Mycobacterium
RPVTRTVLCKSVDESGISF

SEQ ID NO: 724758 - protein, 28 aa, Mycobacterium
RPVTTADEIVRWATPVTSFQRTALADTE

SEQ ID NO: 724759 - protein, 27 aa, Mycobacterium
RPVTTADEIVRWATPVTSFQRTALQDY

SEQ ID NO: 724760 - protein, 20 aa, Mycobacterium
RPVTVPVLLSLSERFDLPTH

SEQ ID NO: 724761 - protein, 18 aa, Mycobacterium
RPVTWGNPAVGLRNAISP

SEQ ID NO: 724762 - protein, 18 aa, Mycobacterium
RPVVLAGHGAARADATKA

SEQ ID NO: 724763 - protein, 21 aa, Mycobacterium
RPVVLEWADYVAADDDHAAGQ

SEQ ID NO: 724764 - protein, 22 aa, Mycobacterium
RPVVLRAWDYHTFWVNSAALQR

SEQ ID NO: 724765 - protein, 21 aa, Mycobacterium
RPVVVPLSFAQSRLWFIDQLN

SEQ ID NO: 724766 - protein, 19 aa, Mycobacterium
RPVYTLGHYGIFMGPLDGW

SEQ ID NO: 724767 - protein, 33 aa, Mycobacterium
RPWATKDVVGAYRFLQRVWRLVVDENTGETLAT

SEQ ID NO: 724768 - protein, 20 aa, Mycobacterium
RPWDQLWLSAAVEHPTRDEW

SEQ ID NO: 724769 - protein, 17 aa, Mycobacterium
RPWGRNGRPRIAGVSSF

SEQ ID NO: 724770 - protein, 24 aa, Mycobacterium
RPWIATLKLHYVRIIPTEITGRHF

SEQ ID NO: 724771 - protein, 24 aa, Mycobacterium
RPWLPHFYLGHGIGVNAAEMPMIG

SEQ ID NO: 724772 - protein, 17 aa, Mycobacterium
RPWMSELRNGWPNRCLP

SEQ ID NO: 724773 - protein, 20 aa, Mycobacterium
RPWPIRALNRVGNPLTGIGA

SEQ ID NO: 724774 - protein, 20 aa, Mycobacterium
RPWQPVPACVRAQPATPGDV

SEQ ID NO: 724775 - protein, 18 aa, Mycobacterium
RPWRLWLPGRPEVSAYRR

SEQ ID NO: 724776 - protein, 18 aa, Mycobacterium
RPWSVDDLHKMIGAAQPA

SEQ ID NO: 724777 - protein, 24 aa, Mycobacterium
RPWVPGMYRTLGADGFGISDTRPA

SEQ ID NO: 724778 - protein, 21 aa, Mycobacterium
RPYAHLRAEFEHRLQQLQQAG

SEQ ID NO: 724779 - protein, 19 aa, Mycobacterium
RPYARSRPISIADVDLAPP

SEQ ID NO: 724780 - protein, 17 aa, Mycobacterium
RPYAVVLGGSKVSDKLG

SEQ ID NO: 724781 - protein, 22 aa, Mycobacterium
RPYDLPWGRPLLGVRRDTTHRA

SEQ ID NO: 724782 - protein, 17 aa, Mycobacterium
RPYEYLGTSVLSAEQRE

SEQ ID NO: 724783 - protein, 18 aa, Mycobacterium
RPYGRRVSVLGDQSAPCR

SEQ ID NO: 724784 - protein, 17 aa, Mycobacterium
RPYLLAVIVPTVDALDR

SEQ ID NO: 724785 - protein, 18 aa, Mycobacterium
RPYLVEGVGEDFWPSAYD

SEQ ID NO: 724786 - protein, 21 aa, Mycobacterium
RPYPIPVICALFGAPREDWEL

SEQ ID NO: 724787 - protein, 20 aa, Mycobacterium
RPYPVPIICALLGAPREDWQ

SEQ ID NO: 724788 - protein, 26 aa, Mycobacterium
RPYSPRIAAPAWPQTSPEAWLETANG

SEQ ID NO: 724789 - protein, 18 aa, Mycobacterium
RPYVMFGPYATFSTKLLK

SEQ ID NO: 724790 - protein, 19 aa, Mycobacterium
RPYYNAIVWQDTRTDRIAA

SEQ ID NO: 724791 - protein, 19 aa, Mycobacterium
RPYYNAIVWQDTRTDRIAS

SEQ ID NO: 724792 - protein, 18 aa, Mycobacterium
RQAAAAWEHVGIRRMALV

SEQ ID NO: 724793 - protein, 19 aa, Mycobacterium
RQAAARWPDRVGVVDAGAS

SEQ ID NO: 724794 - protein, 17 aa, Mycobacterium
RQAAGIARDGASGISAA

SEQ ID NO: 724795 - protein, 18 aa, Mycobacterium
RQAAPFLSYGQFTGLAPR

SEQ ID NO: 724796 - protein, 18 aa, Mycobacterium
RQAAVAAGIGWDVPALTI

SEQ ID NO: 724797 - protein, 26 aa, Mycobacterium
RQAAWPPRMFSLLAGFVEAGESFEVC

SEQ ID NO: 724798 - protein, 17 aa, Mycobacterium
RQADGLGILQGEVGTPQ

SEQ ID NO: 724799 - protein, 17 aa, Mycobacterium
RQAEGLGILHGEVGTAE

SEQ ID NO: 724800 - protein, 23 aa, Mycobacterium
RQAEPRPVPAPAPEAKPVTPEPD

SEQ ID NO: 724801 - protein, 17 aa, Mycobacterium
RQAEWRRGTLPPGQLGW

SEQ ID NO: 724802 - protein, 18 aa, Mycobacterium
RQAFRDIEFHPTILRDVT

SEQ ID NO: 724803 - protein, 19 aa, Mycobacterium
RQAFSARGGLQCGFCTPGF

SEQ ID NO: 724804 - protein, 23 aa, Mycobacterium
RQAGLAARYLAQRGGIAAVVSSP

SEQ ID NO: 724805 - protein, 25 aa, Mycobacterium
RQAIEDHLRYSLGRPATLLQPKHYY

SEQ ID NO: 724806 - protein, 26 aa, Mycobacterium
RQAIFKRAWLNVGRVELLPRKGSYFT

SEQ ID NO: 724807 - protein, 19 aa, Mycobacterium
RQALADGIIDCVATDHAPH

SEQ ID NO: 724808 - protein, 19 aa, Mycobacterium
RQALAEGIIDCVATDHAPH

SEQ ID NO: 724809 - protein, 24 aa, Mycobacterium
RQALEAWPNTDFMQAYGLTELCGV

SEQ ID NO: 724810 - protein, 23 aa, Mycobacterium
RQALKDFLALVAKRRRRHPNMHI

SEQ ID NO: 724811 - protein, 17 aa, Mycobacterium
RQALPAVPLVASGGIRT

SEQ ID NO: 724812 - protein, 20 aa, Mycobacterium
RQALRMRPDRIVVGEVRGAE

SEQ ID NO: 724813 - protein, 30 aa, Mycobacterium
RQALRPRYLLMLAEILRFHRAASRLLRAEA

SEQ ID NO: 724814 - protein, 18 aa, Mycobacterium
RQAMKRDLNAAGIPEDTV

SEQ ID NO: 724815 - protein, 20 aa, Mycobacterium
RQAMLKALRDMWVQTTGQSE

SEQ ID NO: 724816 - protein, 25 aa, Mycobacterium
RQAMRDQGKCLIRVTPQQWGPIATG

SEQ ID NO: 724817 - protein, 19 aa, Mycobacterium
RQANIRWGLDQEHRRPYHV

SEQ ID NO: 724818 - protein, 23 aa, Mycobacterium
RQAPEAMGVLLAQTVRADAAVAR

SEQ ID NO: 724819 - protein, 22 aa, Mycobacterium
RQAPELAAWPRSPEWTGAEEVH

SEQ ID NO: 724820 - protein, 28 aa, Mycobacterium
RQAPELSGWPRSPGWTGAAAVTATEAVP

SEQ ID NO: 724821 - protein, 18 aa, Mycobacterium
RQAPEYWLSQQGRLTHPM

SEQ ID NO: 724822 - protein, 18 aa, Mycobacterium
RQAPGAGVGVHVGARRGQ

SEQ ID NO: 724823 - protein, 22 aa, Mycobacterium
RQAQLFADWAVYLLVGYEQATL

SEQ ID NO: 724824 - protein, 23 aa, Mycobacterium
RQARALCPQAIVVAPRMRAYSDA

SEQ ID NO: 724825 - protein, 19 aa, Mycobacterium
RQAREALRDSCPVDIPSSL

SEQ ID NO: 724826 - protein, 26 aa, Mycobacterium
RQAREILGMVCDLYALSVIEEDKAWF

SEQ ID NO: 724827 - protein, 17 aa, Mycobacterium
RQARWVDFDNDYKTLDL

SEQ ID NO: 724828 - protein, 17 aa, Mycobacterium
RQASRPSGLVLAPTREL

SEQ ID NO: 724829 - protein, 18 aa, Mycobacterium
RQASVVRREIGVPTVFNL

SEQ ID NO: 724830 - protein, 18 aa, Mycobacterium
RQATCAMPDYAEVCDKVV

SEQ ID NO: 724831 - protein, 18 aa, Mycobacterium
RQAVLAALVERFGAKAAK

SEQ ID NO: 724832 - protein, 19 aa, Mycobacterium
RQAVRELVDQVALPSSLLD

SEQ ID NO: 724833 - protein, 25 aa, Mycobacterium
RQCAAEAQLGFGDPALFAEVLLEDA

SEQ ID NO: 724834 - protein, 25 aa, Mycobacterium
RQCAAEAQLGFGNPALFAEALLHNA

SEQ ID NO: 724835 - protein, 20 aa, Mycobacterium
RQCGRWGAIAIVARRSDWLN

SEQ ID NO: 724836 - protein, 32 aa, Mycobacterium
RQCPVPVIARMAGWCLGGGLEIAACCDLRIAE

SEQ ID NO: 724837 - protein, 18 aa, Mycobacterium
RQDHRTVRALHVDDSALV

SEQ ID NO: 724838 - protein, 19 aa, Mycobacterium
RQDIEDIFWLQASIAKELA

SEQ ID NO: 724839 - protein, 19 aa, Mycobacterium
RQDIEDIFWLQATIARELA

SEQ ID NO: 724840 - protein, 22 aa, Mycobacterium
RQDLYDVVEWVAAQPWCDGNVG

SEQ ID NO: 724841 - protein, 31 aa, Mycobacterium
RQDPNKAIARFIVRFNDAFRKYGTSDNVLAA

SEQ ID NO: 724842 - protein, 19 aa, Mycobacterium
RQDQLPSTHPVAADIPDLA

SEQ ID NO: 724843 - protein, 17 aa, Mycobacterium
RQEAGLVPREFSVGTDI

SEQ ID NO: 724844 - protein, 23 aa, Mycobacterium
RQEAIASLGWRLVRVSRDQLSQR

SEQ ID NO: 724845 - protein, 33 aa, Mycobacterium
RQEDIYNPLRFLRAGMKWCRKAQELGTLDEDAA

SEQ ID NO: 724846 - protein, 21 aa, Mycobacterium
RQEGRWRLVRAVAGQPAATPR

SEQ ID NO: 724847 - protein, 25 aa, Mycobacterium
RQELAAAGGRAFVSLPWPVPPGADV

SEQ ID NO: 724848 - protein, 19 aa, Mycobacterium
RQELAGWCARHRARAGEPD

SEQ ID NO: 724849 - protein, 29 aa, Mycobacterium
RQELDVVWRNGLRLNKLVNTLLDFSRIEA

SEQ ID NO: 724850 - protein, 19 aa, Mycobacterium
RQELSYTFELNMLGDSSKA

SEQ ID NO: 724851 - protein, 18 aa, Mycobacterium
RQEPWGVWGGEILDRGSI

SEQ ID NO: 724852 - protein, 28 aa, Mycobacterium
RQEVAALLRWLGNGNFLLLGYQPCRVDE

SEQ ID NO: 724853 - protein, 17 aa, Mycobacterium
RQEWKFFVDEAALPTGA

SEQ ID NO: 724854 - protein, 17 aa, Mycobacterium
RQFAAEFAETIGTAVDL

SEQ ID NO: 724855 - protein, 31 aa, Mycobacterium
RQFFARAYQPGWRVTGLTSRSAVSHRRCEAG

SEQ ID NO: 724856 - protein, 22 aa, Mycobacterium
RQFPATSFSPGYRSVWHRDPHG

SEQ ID NO: 724857 - protein, 22 aa, Mycobacterium
RQFPATTFAPAYTSVWHRDPSC

SEQ ID NO: 724858 - protein, 22 aa, Mycobacterium
RQFPDLLAAGSRIHYETHFVSM

SEQ ID NO: 724859 - protein, 27 aa, Mycobacterium
RQFPLLGRRAAEEFGLRVVVVERPGSG

SEQ ID NO: 724860 - protein, 19 aa, Mycobacterium
RQFRAVWRPGAPPTGAARA

SEQ ID NO: 724861 - protein, 23 aa, Mycobacterium
RQFRCIPTSSMGRLFDAVSSLLG

SEQ ID NO: 724862 - protein, 19 aa, Mycobacterium
RQFRNMKGTIPLDAMHPKA

SEQ ID NO: 724863 - protein, 18 aa, Mycobacterium
RQFRRGYWAADKGTVTAV

SEQ ID NO: 724864 - protein, 17 aa, Mycobacterium
RQFRYNMVGAYDAVVEV

SEQ ID NO: 724865 - protein, 18 aa, Mycobacterium
RQFSAVLGSGSLLGYNRR

SEQ ID NO: 724866 - protein, 18 aa, Mycobacterium
RQFTCKYHAWRYDLDGDL

SEQ ID NO: 724867 - protein, 18 aa, Mycobacterium
RQFTCKYHAWRYDLDGNL

SEQ ID NO: 724868 - protein, 17 aa, Mycobacterium
RQFTCKYHGWRYDLDGN

SEQ ID NO: 724869 - protein, 21 aa, Mycobacterium
RQGADVAMLVRRLRSAINAEK

SEQ ID NO: 724870 - protein, 20 aa, Mycobacterium
RQGAELVAMLGLPKAIPVHF

SEQ ID NO: 724871 - protein, 24 aa, Mycobacterium
RQGAQLAELTRWFTPAEVLQQATI

SEQ ID NO: 724872 - protein, 20 aa, Mycobacterium
RQGAQLAKLTRWFTPAEVLQ

SEQ ID NO: 724873 - protein, 22 aa, Mycobacterium
RQGAVLRWAQVFGQPLCWDDLS

SEQ ID NO: 724874 - protein, 19 aa, Mycobacterium
RQGDRWVINGAKTWSTSAF

SEQ ID NO: 724875 - protein, 24 aa, Mycobacterium
RQGDWKALHLPAPYGPGDWQLYDL

SEQ ID NO: 724876 - protein, 25 aa, Mycobacterium
RQGDWKAVHLPAPYGPDGWQLYDLA

SEQ ID NO: 724877 - protein, 25 aa, Mycobacterium
RQGEFRPDLAAGWLTEAFYSLVSGA

SEQ ID NO: 724878 - protein, 20 aa, Mycobacterium
RQGELALWAPLLGQEAAQVG

SEQ ID NO: 724879 - protein, 29 aa, Mycobacterium
RQGERIPFRYAWSEVRAALDTHRHSSGSP

SEQ ID NO: 724880 - protein, 24 aa, Mycobacterium
RQGFCGTCKVKVLAGRPDHRDSLL

SEQ ID NO: 724881 - protein, 17 aa, Mycobacterium
RQGHPVIFQAGSSTTGR

SEQ ID NO: 724882 - protein, 18 aa, Mycobacterium
RQGIPLALALRSAADAAA

SEQ ID NO: 724883 - protein, 21 aa, Mycobacterium
RQGLKVSVPEEVAWQQGWITD

SEQ ID NO: 724884 - protein, 31 aa, Mycobacterium
RQGLKVSVPEEVAWRLGWIDDEQLMRRARSL

SEQ ID NO: 724885 - protein, 20 aa, Mycobacterium
RQGQLLSWGLPATHALVETL

SEQ ID NO: 724886 - protein, 17 aa, Mycobacterium
RQGRRGRRFRDRRRRGE

SEQ ID NO: 724887 - protein, 24 aa, Mycobacterium
RQGSKRPTFAVIHGRDALEVHASD

SEQ ID NO: 724888 - protein, 28 aa, Mycobacterium
RQGSMRGGAWPLTWAQKAMVLAARVLPQ

SEQ ID NO: 724889 - protein, 18 aa, Mycobacterium
RQGVPRAKLTGTIQNDIL

SEQ ID NO: 724890 - protein, 27 aa, Mycobacterium
RQGVRRLAQFWGHAWQSAVFPSGKAFG

SEQ ID NO: 724891 - protein, 17 aa, Mycobacterium
RQGVVGLFQPGLVGEQA

SEQ ID NO: 724892 - protein, 17 aa, Mycobacterium
RQGWGAWPTCSGRIGAS

SEQ ID NO: 724893 - protein, 25 aa, Mycobacterium
RQHARTPFRQEVWDRLAEGIRFVQG

SEQ ID NO: 724894 - protein, 18 aa, Mycobacterium
RQHGRYVVALGMGGMGYA

SEQ ID NO: 724895 - protein, 25 aa, Mycobacterium
RQHHKWTAWVEGRPLIVFHEIYTMD

SEQ ID NO: 724896 - protein, 25 aa, Mycobacterium
RQHHLVKTFWGWRDKQLPDGTVIWT

SEQ ID NO: 724897 - protein, 26 aa, Mycobacterium
RQHIAFCRAGDGVRLAYAVVGEGPPL

SEQ ID NO: 724898 - protein, 20 aa, Mycobacterium
RQHLKTMKGQWAPFQSLLDL

SEQ ID NO: 724899 - protein, 18 aa, Mycobacterium
RQHLMVLHIIALYQRLKN

SEQ ID NO: 724900 - protein, 20 aa, Mycobacterium
RQHQRSFVADRCGTGTAALC

SEQ ID NO: 724901 - protein, 20 aa, Mycobacterium
RQHRDALRKKGWKNVVAHQT

SEQ ID NO: 724902 - protein, 26 aa, Mycobacterium
RQHVRLEPRREGWRAFDTSTNGIFVD

SEQ ID NO: 724903 - protein, 22 aa, Mycobacterium
RQHWQRFWLVDPLDGTKEFIKG

SEQ ID NO: 724904 - protein, 30 aa, Mycobacterium
RQHYRLVGWRNGVCGYRRFFSITSLAGLRQ

SEQ ID NO: 724905 - protein, 31 aa, Mycobacterium
RQHYRLVGWRRGLCGYRRFFSITSLAGLRQE

SEQ ID NO: 724906 - protein, 17 aa, Mycobacterium
RQIAAAVTFRMPRHIDT

SEQ ID NO: 724907 - protein, 17 aa, Mycobacterium
RQIAGKLSAVVAAAARS

SEQ ID NO: 724908 - protein, 18 aa, Mycobacterium
RQIAVLVLRDVLGFRTDE

SEQ ID NO: 724909 - protein, 18 aa, Mycobacterium
RQIAWLRQMADLCSTMAS

SEQ ID NO: 724910 - protein, 17 aa, Mycobacterium
RQIERWLAERTGQSIWS

SEQ ID NO: 724911 - protein, 29 aa, Mycobacterium
RQIIRLALELGYTGPFCCEHYGSDSLGVC

SEQ ID NO: 724912 - protein, 17 aa, Mycobacterium
RQIKDLAHAGAPLHAEC

SEQ ID NO: 724913 - protein, 25 aa, Mycobacterium
RQIKSANLIYAIRITGHFAELHTRT

SEQ ID NO: 724914 - protein, 25 aa, Mycobacterium
RQILDRIADKWSLLIIALLDDGSMR

SEQ ID NO: 724915 - protein, 17 aa, Mycobacterium
RQILGLAAAEVYNFDLG

SEQ ID NO: 724916 - protein, 17 aa, Mycobacterium
RQIPYTKAMEMILTGEP

SEQ ID NO: 724917 - protein, 17 aa, Mycobacterium
RQITGWVAALGATAGDR

SEQ ID NO: 724918 - protein, 19 aa, Mycobacterium
RQITQCFHFGVARQVITGP

SEQ ID NO: 724919 - protein, 24 aa, Mycobacterium
RQKARAAQHAFMLQGMDEVDDEEQ

SEQ ID NO: 724920 - protein, 19 aa, Mycobacterium
RQKARAAQHTFMMESMNEL

SEQ ID NO: 724921 - protein, 17 aa, Mycobacterium
RQKARAAQHTFMVEAMA

SEQ ID NO: 724922 - protein, 17 aa, Mycobacterium
RQKHCLMNADGWGAGFF

SEQ ID NO: 724923 - protein, 19 aa, Mycobacterium
RQKIEVVVLTGIHLDWCIE

SEQ ID NO: 724924 - protein, 19 aa, Mycobacterium
RQKLTPDYEPLCKRQVLSG

SEQ ID NO: 724925 - protein, 33 aa, Mycobacterium
RQKQEFLPRIAAGQCFFGIGMSEPDSGSDLASV

SEQ ID NO: 724926 - protein, 30 aa, Mycobacterium
RQKRLMTLIHLWLVHRFKADAVYYVTPTED

SEQ ID NO: 724927 - protein, 18 aa, Mycobacterium
RQKVAIIAAFSCEADLYI

SEQ ID NO: 724928 - protein, 18 aa, Mycobacterium
RQKVALIAAFCSDADLFI

SEQ ID NO: 724929 - protein, 23 aa, Mycobacterium
RQKVALTCRVLFDAGHDSGLAGQ

SEQ ID NO: 724930 - protein, 18 aa, Mycobacterium
RQKVSLISAFSSHARLLL

SEQ ID NO: 724931 - protein, 29 aa, Mycobacterium
RQLADLAAIGVRWELPVVWQSDRAPAYDE

SEQ ID NO: 724932 - protein, 21 aa, Mycobacterium
RQLADLGARVIKVERPQGGDF

SEQ ID NO: 724933 - protein, 19 aa, Mycobacterium
RQLAPELAYLIPDNQNPTG

SEQ ID NO: 724934 - protein, 26 aa, Mycobacterium
RQLAPRLGAGGGRAARVVAGARPAVV

SEQ ID NO: 724935 - protein, 25 aa, Mycobacterium
RQLAQEWTYRFLAAAHDWALTEHAA

SEQ ID NO: 724936 - protein, 17 aa, Mycobacterium
RQLARGWHTTDLAPSKD

SEQ ID NO: 724937 - protein, 17 aa, Mycobacterium
RQLARLADRIADKHREL

SEQ ID NO: 724938 - protein, 20 aa, Mycobacterium
RQLATAGAFHTHFMAPAQEA

SEQ ID NO: 724939 - protein, 21 aa, Mycobacterium
RQLDDIAWQFLRSEFTGDIYA

SEQ ID NO: 724940 - protein, 28 aa, Mycobacterium
RQLDLLLQRRKLLWWTLSRFTTLSNLPF

SEQ ID NO: 724941 - protein, 23 aa, Mycobacterium
RQLDWMVCRTVATLLRSKVSAQP

SEQ ID NO: 724942 - protein, 23 aa, Mycobacterium
RQLDWMVCRTVATLLRTKVSAQP

SEQ ID NO: 724943 - protein, 22 aa, Mycobacterium
RQLDWMVCRTVATLMRSKVSAR

SEQ ID NO: 724944 - protein, 20 aa, Mycobacterium
RQLEASRASHDWARGKRDQL

SEQ ID NO: 724945 - protein, 19 aa, Mycobacterium
RQLEESLGLALDKGVKIVA

SEQ ID NO: 724946 - protein, 18 aa, Mycobacterium
RQLEQDIGRLIRELAEAT

SEQ ID NO: 724947 - protein, 25 aa, Mycobacterium
RQLERELGCTLLTRTTRSVELTPAG

SEQ ID NO: 724948 - protein, 20 aa, Mycobacterium
RQLEVDAGISFADFEVLALL

SEQ ID NO: 724949 - protein, 25 aa, Mycobacterium
RQLFADRCPPELVVRSYDALPQDFS

SEQ ID NO: 724950 - protein, 17 aa, Mycobacterium
RQLFLVLHDEIERGVLA

SEQ ID NO: 724951 - protein, 20 aa, Mycobacterium
RQLFRSWYIMYFQLPVAPEH

SEQ ID NO: 724952 - protein, 18 aa, Mycobacterium
RQLGAPAVRLEQLHADSL

SEQ ID NO: 724953 - protein, 19 aa, Mycobacterium
RQLHIPAHLAYGDRGAGGV

SEQ ID NO: 724954 - protein, 30 aa, Mycobacterium
RQLHQAAARLCARVGLRGVATVEFLVAGDK

SEQ ID NO: 724955 - protein, 18 aa, Mycobacterium
RQLIGFAAGNGMTTMFGH

SEQ ID NO: 724956 - protein, 18 aa, Mycobacterium
RQLILLDAPSVLGWAGFR

SEQ ID NO: 724957 - protein, 17 aa, Mycobacterium
RQLKALLDYLLDGDIDA

SEQ ID NO: 724958 - protein, 17 aa, Mycobacterium
RQLKLQLDELVGDNDVD

SEQ ID NO: 724959 - protein, 17 aa, Mycobacterium
RQLKLQLDELVGDNETA

SEQ ID NO: 724960 - protein, 17 aa, Mycobacterium
RQLKPLGRQAEVARRAA

SEQ ID NO: 724961 - protein, 17 aa, Mycobacterium
RQLKPLGRQAEVARRAQ

SEQ ID NO: 724962 - protein, 20 aa, Mycobacterium
RQLLFARFGQMITRHLEHTA

SEQ ID NO: 724963 - protein, 18 aa, Mycobacterium
RQLLNPFFHPKRLAASDE

SEQ ID NO: 724964 - protein, 17 aa, Mycobacterium
RQLLPGLVAKFVTGEVK

SEQ ID NO: 724965 - protein, 23 aa, Mycobacterium
RQLLRPGEEDLFWLGTAEALDMG

SEQ ID NO: 724966 - protein, 19 aa, Mycobacterium
RQLLTTLMDRDWKHGVKSA

SEQ ID NO: 724967 - protein, 18 aa, Mycobacterium
RQLLWAAAIECRMHGLPE

SEQ ID NO: 724968 - protein, 18 aa, Mycobacterium
RQLLYVALTRGRVENHIY

SEQ ID NO: 724969 - protein, 19 aa, Mycobacterium
RQLNAVALAAGWGSDDGGE

SEQ ID NO: 724970 - protein, 20 aa, Mycobacterium
RQLNAVAVAAGWPSDDGGEF

SEQ ID NO: 724971 - protein, 20 aa, Mycobacterium
RQLNAVAVAAGWPTDEGGEF

SEQ ID NO: 724972 - protein, 21 aa, Mycobacterium
RQLPDGNAWLMVQLDGDDQEE

SEQ ID NO: 724973 - protein, 17 aa, Mycobacterium
RQLPGRLVGVSVDADGS

SEQ ID NO: 724974 - protein, 17 aa, Mycobacterium
RQLPGRLVGVSVDSDGS

SEQ ID NO: 724975 - protein, 25 aa, Mycobacterium
RQLPWLRRLGVVYTYDAPWHRGRDV

SEQ ID NO: 724976 - protein, 24 aa, Mycobacterium
RQLRDLYPGLPLLLLTAKDSLEDR

SEQ ID NO: 724977 - protein, 18 aa, Mycobacterium
RQLRELLAGVARDRGFIR

SEQ ID NO: 724978 - protein, 20 aa, Mycobacterium
RQLRLERVVLVGVWTEGSAA

SEQ ID NO: 724979 - protein, 20 aa, Mycobacterium
RQLRLERVVLVGVWTEGTSQ

SEQ ID NO: 724980 - protein, 27 aa, Mycobacterium
RQLRLRDIGGIVVIDFIDMVLESNRDL

SEQ ID NO: 724981 - protein, 20 aa, Mycobacterium
RQLRMPAPRTCRPEEAADAL

SEQ ID NO: 724982 - protein, 17 aa, Mycobacterium
RQLRPAVALLDYKMPEL

SEQ ID NO: 724983 - protein, 17 aa, Mycobacterium
RQLRRRRLLTAKNKGRP

SEQ ID NO: 724984 - protein, 27 aa, Mycobacterium
RQLRSELKMLPALPVAELRAQADELAR

SEQ ID NO: 724985 - protein, 22 aa, Mycobacterium
RQLRTLAGFSTMFPVAAGAVGL

SEQ ID NO: 724986 - protein, 21 aa, Mycobacterium
RQLRYDEVLSRVARDGDLLAE

SEQ ID NO: 724987 - protein, 17 aa, Mycobacterium
RQLSDWQRRYPGVPVEL

SEQ ID NO: 724988 - protein, 21 aa, Mycobacterium
RQLSSLARWGFTLQGGYAAAA

SEQ ID NO: 724989 - protein, 30 aa, Mycobacterium
RQLTADFNFAWPTARIAVIGAEGAAQLLMK

SEQ ID NO: 724990 - protein, 19 aa, Mycobacterium
RQLTAWLCADGELDPVSQS

SEQ ID NO: 724991 - protein, 20 aa, Mycobacterium
RQLVLPMFVADGLTEPKAIS

SEQ ID NO: 724992 - protein, 17 aa, Mycobacterium
RQLWSTLMQRWISLTTA

SEQ ID NO: 724993 - protein, 21 aa, Mycobacterium
RQLYKLMAYKDEYEVARLSLS

SEQ ID NO: 724994 - protein, 25 aa, Mycobacterium
RQMDIPPKLAIPMRVIASIVAISCQ

SEQ ID NO: 724995 - protein, 23 aa, Mycobacterium
RQMDLPPKLAIPMRVIASVAAIL

SEQ ID NO: 724996 - protein, 24 aa, Mycobacterium
RQMEGRAAFEVKIHRIAADGGAVL

SEQ ID NO: 724997 - protein, 18 aa, Mycobacterium
RQMIADRELETWMVVDMS

SEQ ID NO: 724998 - protein, 17 aa, Mycobacterium
RQMKGPDDRPVYEHLTS

SEQ ID NO: 724999 - protein, 17 aa, Mycobacterium
RQMLGLAAAELYNFDLG

SEQ ID NO: 725000 - protein, 19 aa, Mycobacterium
RQMLPEIRPSSSPQPYGVT

SEQ ID NO: 725001 - protein, 25 aa, Mycobacterium
RQMLRFLSSPLWRAYTSTYIEGYRL

SEQ ID NO: 725002 - protein, 24 aa, Mycobacterium
RQMLRFLSSPLWRAYTSTYVEGYR

SEQ ID NO: 725003 - protein, 26 aa, Mycobacterium
RQMSEVFPGTQILAAFGQTEMSPVTC

SEQ ID NO: 725004 - protein, 23 aa, Mycobacterium
RQMSEVFPGTQIMAAFGQTEMSP

SEQ ID NO: 725005 - protein, 18 aa, Mycobacterium
RQNAWAMLQEQSEDALEA

SEQ ID NO: 725006 - protein, 18 aa, Mycobacterium
RQNERWNRHGFDLDMAAL

SEQ ID NO: 725007 - protein, 19 aa, Mycobacterium
RQNPWWWDVLRNGRSSPYA

SEQ ID NO: 725008 - protein, 20 aa, Mycobacterium
RQPDGRYLLRTDAGDEFTAD

SEQ ID NO: 725009 - protein, 21 aa, Mycobacterium
RQPDYLTAFAGLWASEDLEDW

SEQ ID NO: 725010 - protein, 24 aa, Mycobacterium
RQPDYLTTFGRLWATEPLSDWKLW

SEQ ID NO: 725011 - protein, 22 aa, Mycobacterium
RQPELAQLVARGFFEVIDHPVN

SEQ ID NO: 725012 - protein, 17 aa, Mycobacterium
RQPEVYGSTTLAEIEAK

SEQ ID NO: 725013 - protein, 19 aa, Mycobacterium
RQPFAGGLEAHVWHLAKAL

SEQ ID NO: 725014 - protein, 17 aa, Mycobacterium
RQPGGAITAGAALTADA

SEQ ID NO: 725015 - protein, 18 aa, Mycobacterium
RQPGGRLGLPADFLIAPD

SEQ ID NO: 725016 - protein, 26 aa, Mycobacterium
RQPHAKGGGAFGHFEVTNDVSRYTRA

SEQ ID NO: 725017 - protein, 24 aa, Mycobacterium
RQPHAKGGGAFGQFEVTHDVSRYT

SEQ ID NO: 725018 - protein, 23 aa, Mycobacterium
RQPHAKGGGAFGTFEVTNDVSKY

SEQ ID NO: 725019 - protein, 26 aa, Mycobacterium
RQPHAKGSGAFGHFEVTGDVSRYTSA

SEQ ID NO: 725020 - protein, 19 aa, Mycobacterium
RQPHEIAMATYRNGDDAGL

SEQ ID NO: 725021 - protein, 20 aa, Mycobacterium
RQPKSLRVCTLLRKPEAVGA

SEQ ID NO: 725022 - protein, 25 aa, Mycobacterium
RQPLPAERWREFCLSAVTTHDLPPT

SEQ ID NO: 725023 - protein, 17 aa, Mycobacterium
RQPLSLVGAREFPASGV

SEQ ID NO: 725024 - protein, 25 aa, Mycobacterium
RQPMAWAGPLFRFALFRTSPNQFFL

SEQ ID NO: 725025 - protein, 23 aa, Mycobacterium
RQPMVVPSPYARRSAKSVGSAVV

SEQ ID NO: 725026 - protein, 17 aa, Mycobacterium
RQPRAEDWAGLALSVFG

SEQ ID NO: 725027 - protein, 18 aa, Mycobacterium
RQPRICLISNVSGDPAGP

SEQ ID NO: 725028 - protein, 17 aa, Mycobacterium
RQPRLVRRYSRTVLTED

SEQ ID NO: 725029 - protein, 25 aa, Mycobacterium
RQPRPVTFSALTGWEAPDPAWWTAR

SEQ ID NO: 725030 - protein, 22 aa, Mycobacterium
RQPSAWSVEGLLMYLTGDAQNL

SEQ ID NO: 725031 - protein, 22 aa, Mycobacterium
RQPSGLVSLAICNSPASMRLWS

SEQ ID NO: 725032 - protein, 18 aa, Mycobacterium
RQPVGFAELSGFFRAADG

SEQ ID NO: 725033 - protein, 18 aa, Mycobacterium
RQPVHTVYIPGNRYSATT

SEQ ID NO: 725034 - protein, 20 aa, Mycobacterium
RQQAATLRRALTAAGVDHTI

SEQ ID NO: 725035 - protein, 18 aa, Mycobacterium
RQQALLKLADAIEAHTDE

SEQ ID NO: 725036 - protein, 25 aa, Mycobacterium
RQQAQFDRWFEIMSAVLGVAKAGVT

SEQ ID NO: 725037 - protein, 18 aa, Mycobacterium
RQQFPRELIEHLGARGVF

SEQ ID NO: 725038 - protein, 20 aa, Mycobacterium
RQQFSRVRVFAFIDTTDEVT

SEQ ID NO: 725039 - protein, 19 aa, Mycobacterium
RQQICADAVAFARQIGYSC

SEQ ID NO: 725040 - protein, 24 aa, Mycobacterium
RQQKRLLAKWPDMTVPAAIEDSIE

SEQ ID NO: 725041 - protein, 18 aa, Mycobacterium
RQQLGLRNSRLDHMSLVK

SEQ ID NO: 725042 - protein, 26 aa, Mycobacterium
RQQRESALRWLAKVGAEQLVDRRPRQ

SEQ ID NO: 725043 - protein, 21 aa, Mycobacterium
RQQRGRFLCIADFVRSREHAR

SEQ ID NO: 725044 - protein, 17 aa, Mycobacterium
RQQRRLGRRSNVYVVEW

SEQ ID NO: 725045 - protein, 24 aa, Mycobacterium
RQQRVPLGVVGIVYEGRPNVTVDA

SEQ ID NO: 725046 - protein, 24 aa, Mycobacterium
RQQRVPLGVVGMVYEGRPNVTVDA

SEQ ID NO: 725047 - protein, 17 aa, Mycobacterium
RQQVRLWIDESLHREPG

SEQ ID NO: 725048 - protein, 18 aa, Mycobacterium
RQRAAAALDRAIQQRVGA

SEQ ID NO: 725049 - protein, 19 aa, Mycobacterium
RQRAAPMAPVLSAREREVL

SEQ ID NO: 725050 - protein, 17 aa, Mycobacterium
RQRAAVGRGDWPEFLDA

SEQ ID NO: 725051 - protein, 33 aa, Mycobacterium
RQRAEARLGYALNRAHIGAVIWSDEPDGDLSQL

SEQ ID NO: 725052 - protein, 24 aa, Mycobacterium
RQRAEARLLAGQRRLVSAIAGGAP

SEQ ID NO: 725053 - protein, 23 aa, Mycobacterium
RQRAERRLPDTAILPVHDVARRA

SEQ ID NO: 725054 - protein, 18 aa, Mycobacterium
RQRAIMLLGGLRELTATT

SEQ ID NO: 725055 - protein, 17 aa, Mycobacterium
RQRCFDRLMAVIGALNG

SEQ ID NO: 725056 - protein, 29 aa, Mycobacterium
RQRDDGRWIWRWDPAFITSNFQFLQGDPA

SEQ ID NO: 725057 - protein, 30 aa, Mycobacterium
RQRDDGRWIWRWDPAFITSNFQFLQGDPAT

SEQ ID NO: 725058 - protein, 22 aa, Mycobacterium
RQRDLSVLLLLDISGSAAEPGT

SEQ ID NO: 725059 - protein, 18 aa, Mycobacterium
RQRELAKLDELRAAGHDV

SEQ ID NO: 725060 - protein, 18 aa, Mycobacterium
RQRERIHRVAQWLSSGAP

SEQ ID NO: 725061 - protein, 17 aa, Mycobacterium
RQRFDLISREMPMFRQR

SEQ ID NO: 725062 - protein, 21 aa, Mycobacterium
RQRFIAIELDFPPPHVETEIV

SEQ ID NO: 725063 - protein, 21 aa, Mycobacterium
RQRFLAEQGYGYIIKDADDLL

SEQ ID NO: 725064 - protein, 24 aa, Mycobacterium
RQRFNEMYRRIVLGGNPEVEVPAD

SEQ ID NO: 725065 - protein, 18 aa, Mycobacterium
RQRFVAIELDFPPVEAET

SEQ ID NO: 725066 - protein, 19 aa, Mycobacterium
RQRGEAMLAPVVFTSALDL

SEQ ID NO: 725067 - protein, 19 aa, Mycobacterium
RQRHAMTFWDHVVDGADSI

SEQ ID NO: 725068 - protein, 18 aa, Mycobacterium
RQRHRNCATFVGHSTLRR

SEQ ID NO: 725069 - protein, 24 aa, Mycobacterium
RQRHWVEPKHMVWSQVPAGSNGSP

SEQ ID NO: 725070 - protein, 21 aa, Mycobacterium
RQRICADAVSFARQIDYFCAG

SEQ ID NO: 725071 - protein, 19 aa, Mycobacterium
RQRIIAAAMRCVAEVGYSQ

SEQ ID NO: 725072 - protein, 26 aa, Mycobacterium
RQRILNNLCRYGLWDVSFESRVDVVL

SEQ ID NO: 725073 - protein, 18 aa, Mycobacterium
RQRITLLSWEWGISLAYI

SEQ ID NO: 725074 - protein, 25 aa, Mycobacterium
RQRIVGVVENMSWLVLPDGTRMEVF

SEQ ID NO: 725075 - protein, 19 aa, Mycobacterium
RQRLATLIRLFLLGTDEPR

SEQ ID NO: 725076 - protein, 25 aa, Mycobacterium
RQRLDASEALSFVRQRHGLENGDLD

SEQ ID NO: 725077 - protein, 18 aa, Mycobacterium
RQRLKEAGFQVADQASYV

SEQ ID NO: 725078 - protein, 19 aa, Mycobacterium
RQRLLELVWGYDFDVDTNV

SEQ ID NO: 725079 - protein, 21 aa, Mycobacterium
RQRLLELVWGYDFDVDTNVAD

SEQ ID NO: 725080 - protein, 25 aa, Mycobacterium
RQRLPILCGLDLTRKVAMTPEHLAR

SEQ ID NO: 725081 - protein, 24 aa, Mycobacterium
RQRLRSAGLDGIRVGTVDKFQGGQ

SEQ ID NO: 725082 - protein, 20 aa, Mycobacterium
RQRLVDWLKSMVYDQALITE

SEQ ID NO: 725083 - protein, 18 aa, Mycobacterium
RQRLYGIATDRILGLPDG

SEQ ID NO: 725084 - protein, 22 aa, Mycobacterium
RQRMVAIEFDFPAADVEEGIVA

SEQ ID NO: 725085 - protein, 23 aa, Mycobacterium
RQRPEIDWFPWLAQQLRGASPGA

SEQ ID NO: 725086 - protein, 23 aa, Mycobacterium
RQRPEVMEVLLGQAVRADAAVAR

SEQ ID NO: 725087 - protein, 21 aa, Mycobacterium
RQRPQLDWQRLARIVEELPVA

SEQ ID NO: 725088 - protein, 23 aa, Mycobacterium
RQRRAELRAGKALLGVRDELKLS

SEQ ID NO: 725089 - protein, 24 aa, Mycobacterium
RQRREAGLRRSLRPRPAVATELDL

SEQ ID NO: 725090 - protein, 18 aa, Mycobacterium
RQRRSGGAGAGFLQGNKC

SEQ ID NO: 725091 - protein, 17 aa, Mycobacterium
RQRSDFFQTLRDIAGED

SEQ ID NO: 725092 - protein, 26 aa, Mycobacterium
RQRSLIGAWCFLDHYGPVTGRAARMD

SEQ ID NO: 725093 - protein, 19 aa, Mycobacterium
RQRSRVGAELAQLTVTRPS

SEQ ID NO: 725094 - protein, 24 aa, Mycobacterium
RQRSWFRRDHRVHWCDAGATGPSD

SEQ ID NO: 725095 - protein, 17 aa, Mycobacterium
RQRSWFRRDHRVRWLDV

SEQ ID NO: 725096 - protein, 18 aa, Mycobacterium
RQRVADLPDGEWVTEDFL

SEQ ID NO: 725097 - protein, 18 aa, Mycobacterium
RQRVAPLVAKHRLGGTPR

SEQ ID NO: 725098 - protein, 18 aa, Mycobacterium
RQRVAVVRAVRSALERRG

SEQ ID NO: 725099 - protein, 17 aa, Mycobacterium
RQRVLVISTGSELVTPG

SEQ ID NO: 725100 - protein, 18 aa, Mycobacterium
RQRVQLARTLACEPHVML

SEQ ID NO: 725101 - protein, 17 aa, Mycobacterium
RQRVRLLADRCNYPPGM

SEQ ID NO: 725102 - protein, 17 aa, Mycobacterium
RQRVRRALDAIGATTAL

SEQ ID NO: 725103 - protein, 17 aa, Mycobacterium
RQRVWSVLADGWTYSQW

SEQ ID NO: 725104 - protein, 23 aa, Mycobacterium
RQRYGLPALRDWLRRQCDDTTRA

SEQ ID NO: 725105 - protein, 17 aa, Mycobacterium
RQSAVARYGRYGFEAAA

SEQ ID NO: 725106 - protein, 24 aa, Mycobacterium
RQSLDGSAAWAECGQVSSTDRYLC

SEQ ID NO: 725107 - protein, 18 aa, Mycobacterium
RQSNIRWGFDRRHRRPYG

SEQ ID NO: 725108 - protein, 18 aa, Mycobacterium
RQSPRLVAYTATKSALSS

SEQ ID NO: 725109 - protein, 32 aa, Mycobacterium
RQSSEWKDGEALFLRCNIWREAAENVAESLTR

SEQ ID NO: 725110 - protein, 18 aa, Mycobacterium
RQTDQRWAELVYDGLWYS

SEQ ID NO: 725111 - protein, 20 aa, Mycobacterium
RQTFASGRTRNVQWRKQQLL

SEQ ID NO: 725112 - protein, 20 aa, Mycobacterium
RQTFATGRTRDVDWRKRQLL

SEQ ID NO: 725113 - protein, 31 aa, Mycobacterium
RQTGEGWRLYTRARFAPYVEKLLLDGARSKL

SEQ ID NO: 725114 - protein, 25 aa, Mycobacterium
RQTLDASQALAFVRQRHGLENGDLD

SEQ ID NO: 725115 - protein, 20 aa, Mycobacterium
RQTLERWARRPKSSQALAQR

SEQ ID NO: 725116 - protein, 19 aa, Mycobacterium
RQTLHRWLARYEAQGLDGL

SEQ ID NO: 725117 - protein, 20 aa, Mycobacterium
RQTLREFLGPMITALDDYPF

SEQ ID NO: 725118 - protein, 24 aa, Mycobacterium
RQTLWPERLFSILAGFVEAGESFE

SEQ ID NO: 725119 - protein, 32 aa, Mycobacterium
RQTNEWKDGEALFLRCNIWREAAENVAESLVR

SEQ ID NO: 725120 - protein, 18 aa, Mycobacterium
RQTRGWLRVAAEGVKTKR

SEQ ID NO: 725121 - protein, 21 aa, Mycobacterium
RQTRLKGVVPRGTLHHQSFPL

SEQ ID NO: 725122 - protein, 20 aa, Mycobacterium
RQTVDGLPLFSAFWDRNAEI

SEQ ID NO: 725123 - protein, 18 aa, Mycobacterium
RQTVLALLADHDLSEHDS

SEQ ID NO: 725124 - protein, 17 aa, Mycobacterium
RQTVLALLADHNLGEHD

SEQ ID NO: 725125 - protein, 18 aa, Mycobacterium
RQTVLALLAGHELAEHDS

SEQ ID NO: 725126 - protein, 19 aa, Mycobacterium
RQTWACGPAAMLNQAEKVW

SEQ ID NO: 725127 - protein, 26 aa, Mycobacterium
RQTWACGPEGLLTAAERVWSAAGIAE

SEQ ID NO: 725128 - protein, 18 aa, Mycobacterium
RQTWACGPESMLNQAEKV

SEQ ID NO: 725129 - protein, 24 aa, Mycobacterium
RQVAPAGRRHAWRAHVFATKGIDT

SEQ ID NO: 725130 - protein, 25 aa, Mycobacterium
RQVDALAQFVPWPQLVIYRNQGRLL

SEQ ID NO: 725131 - protein, 18 aa, Mycobacterium
RQVFELVDIAFAQRRKTS

SEQ ID NO: 725132 - protein, 21 aa, Mycobacterium
RQVGGELYGSFLPGTEQNLQR

SEQ ID NO: 725133 - protein, 17 aa, Mycobacterium
RQVGPLAKFYSIAPTDV

SEQ ID NO: 725134 - protein, 25 aa, Mycobacterium
RQVGPRVAARFGRALLELGGNNAAV

SEQ ID NO: 725135 - protein, 19 aa, Mycobacterium
RQVHLPWGTVSLPRVDIQM

SEQ ID NO: 725136 - protein, 22 aa, Mycobacterium
RQVIVPWAKWGSRLSTLPLPNR

SEQ ID NO: 725137 - protein, 17 aa, Mycobacterium
RQVKAMFIGAGNPVLSV

SEQ ID NO: 725138 - protein, 22 aa, Mycobacterium
RQVLDLIFTVGCYQMLGAAVNA

SEQ ID NO: 725139 - protein, 18 aa, Mycobacterium
RQVLLPLWNAYSFLALYA

SEQ ID NO: 725140 - protein, 19 aa, Mycobacterium
RQVLLPLWNAYSFLALYAP

SEQ ID NO: 725141 - protein, 24 aa, Mycobacterium
RQVLRCLHADPALYSSRLPLEDST

SEQ ID NO: 725142 - protein, 29 aa, Mycobacterium
RQVLTRSELPGIVRKVIPVDMVIERHQHF

SEQ ID NO: 725143 - protein, 19 aa, Mycobacterium
RQVPKGSVMMMLIGAANRD

SEQ ID NO: 725144 - protein, 17 aa, Mycobacterium
RQVQAHAPIPVLMLTAR

SEQ ID NO: 725145 - protein, 18 aa, Mycobacterium
RQVRAGALTKAREEVNEL

SEQ ID NO: 725146 - protein, 22 aa, Mycobacterium
RQVRDYAVGLCVGFQLEALAAL

SEQ ID NO: 725147 - protein, 25 aa, Mycobacterium
RQVRERPELLGAFLEEVLRYEPPFR

SEQ ID NO: 725148 - protein, 26 aa, Mycobacterium
RQVRFGRTEPVAAPILFRTADTEHAW

SEQ ID NO: 725149 - protein, 27 aa, Mycobacterium
RQVSGRFGIGLVDWVMRSEAGLLEDAL

SEQ ID NO: 725150 - protein, 27 aa, Mycobacterium
RQVTGRFGIGLVDWVMRDEVGLLEDAL

SEQ ID NO: 725151 - protein, 23 aa, Mycobacterium
RQVVPDTLTFCWNIVRDQADLAD

SEQ ID NO: 725152 - protein, 23 aa, Mycobacterium
RQVVPESLSFCWTLVRDAENMPG

SEQ ID NO: 725153 - protein, 25 aa, Mycobacterium
RQVWACGPEGMLADAERVWKAAGVG

SEQ ID NO: 725154 - protein, 19 aa, Mycobacterium
RQVWEYDFGGRTSIVDLYV

SEQ ID NO: 725155 - protein, 20 aa, Mycobacterium
RQWAAMGVERGWQATMVLTE

SEQ ID NO: 725156 - protein, 23 aa, Mycobacterium
RQWADPRLVVVVLHNNDLNQVTW

SEQ ID NO: 725157 - protein, 19 aa, Mycobacterium
RQWEDARRGVVPADPTVVL

SEQ ID NO: 725158 - protein, 20 aa, Mycobacterium
RQWGEAALELLERHADLLTE

SEQ ID NO: 725159 - protein, 26 aa, Mycobacterium
RQWISAWQLPLEWLQIPPGGIALDVG

SEQ ID NO: 725160 - protein, 19 aa, Mycobacterium
RQWLPKMASGELIGAIAMT

SEQ ID NO: 725161 - protein, 19 aa, Mycobacterium
RQWNVTHIFGYPGDGINGL

SEQ ID NO: 725162 - protein, 17 aa, Mycobacterium
RQWPVDRFAAVAAALSD

SEQ ID NO: 725163 - protein, 23 aa, Mycobacterium
RQWRELSSTWTGVAASAYQPPWQ

SEQ ID NO: 725164 - protein, 22 aa, Mycobacterium
RQWRKVIPLLPGCRCITPTLPM

SEQ ID NO: 725165 - protein, 22 aa, Mycobacterium
RQWSGEFCFRPGEPRVSLIDRK

SEQ ID NO: 725166 - protein, 18 aa, Mycobacterium
RQWSRAATEIAVALRASA

SEQ ID NO: 725167 - protein, 22 aa, Mycobacterium
RQWWQRRLPEMAGAPQLPTVAV

SEQ ID NO: 725168 - protein, 22 aa, Mycobacterium
RQWWQRRLPQMPGAPELPTVPV

SEQ ID NO: 725169 - protein, 23 aa, Mycobacterium
RQYCVRCLDPLVGSGGFDIIAEL

SEQ ID NO: 725170 - protein, 23 aa, Mycobacterium
RQYCVRCLDPLVGSSGFDIIAEL

SEQ ID NO: 725171 - protein, 24 aa, Mycobacterium
RQYFARMRPALCTSERAQRAMHYL

SEQ ID NO: 725172 - protein, 23 aa, Mycobacterium
RQYGIEPQQLFAYLQENNQLPSM

SEQ ID NO: 725173 - protein, 24 aa, Mycobacterium
RQYGVEPQQLFAYLQENNQLPSMF

SEQ ID NO: 725174 - protein, 17 aa, Mycobacterium
RQYLAQVGATWVVPSAG

SEQ ID NO: 725175 - protein, 25 aa, Mycobacterium
RQYLRSRAAWPIFGKQFVIRARKER

SEQ ID NO: 725176 - protein, 17 aa, Mycobacterium
RQYMAWISLEDEVRALL

SEQ ID NO: 725177 - protein, 26 aa, Mycobacterium
RQYPCGKKRPSFCPAAHWDFNDDFIY

SEQ ID NO: 725178 - protein, 19 aa, Mycobacterium
RQYRPRSAVRRHYTVSTDL

SEQ ID NO: 725179 - protein, 19 aa, Mycobacterium
RQYYPRPGWVEHDPTEIWE

SEQ ID NO: 725180 - protein, 19 aa, Mycobacterium
RRAAAAWEALIEEPVGEAI

SEQ ID NO: 725181 - protein, 21 aa, Mycobacterium
RRAAAELGYRPNLAARNLASG

SEQ ID NO: 725182 - protein, 17 aa, Mycobacterium
RRAAARAEKRMLIDGEL

SEQ ID NO: 725183 - protein, 20 aa, Mycobacterium
RRAAAVAARSLDNVEILVTT

SEQ ID NO: 725184 - protein, 22 aa, Mycobacterium
RRAAAYACRPVAARARLRRARP

SEQ ID NO: 725185 - protein, 25 aa, Mycobacterium
RRAADLPPAVGVLVEYQGSDKEAAH

SEQ ID NO: 725186 - protein, 25 aa, Mycobacterium
RRAADLPPAVGVLVEYTGAGAEAAH

SEQ ID NO: 725187 - protein, 20 aa, Mycobacterium
RRAAEKLGGLGAEIPVSDWL

SEQ ID NO: 725188 - protein, 19 aa, Mycobacterium
RRAAELAQSLQIVAAQTVA

SEQ ID NO: 725189 - protein, 19 aa, Mycobacterium
RRAAELGVNFIDTADSYGP

SEQ ID NO: 725190 - protein, 20 aa, Mycobacterium
RRAAELGWTSLLIPEQLGGG

SEQ ID NO: 725191 - protein, 26 aa, Mycobacterium
RRAAEWRPSMDPTRRQRELDDWHRAV

SEQ ID NO: 725192 - protein, 19 aa, Mycobacterium
RRAAFGLATEIGRELTRRS

SEQ ID NO: 725193 - protein, 24 aa, Mycobacterium
RRAAHAFGLSATWLQMELGLITPE

SEQ ID NO: 725194 - protein, 24 aa, Mycobacterium
RRAAHGRPLWYLMPDGVVQYVSKR

SEQ ID NO: 725195 - protein, 18 aa, Mycobacterium
RRAAIKARTAELAKQFQA

SEQ ID NO: 725196 - protein, 19 aa, Mycobacterium
RRAALMSGIEEFDADFFGF

SEQ ID NO: 725197 - protein, 20 aa, Mycobacterium
RRAALRAGVTLSGLASSWAA

SEQ ID NO: 725198 - protein, 25 aa, Mycobacterium
RRAALRVSNQVQRRWRAFSRTGVPG

SEQ ID NO: 725199 - protein, 24 aa, Mycobacterium
RRAALRVSNQVQRRWRSFSRSGAP

SEQ ID NO: 725200 - protein, 18 aa, Mycobacterium
RRAAPMEVEYVGEVETGP

SEQ ID NO: 725201 - protein, 18 aa, Mycobacterium
RRAARFGLGFLPMVPDLV

SEQ ID NO: 725202 - protein, 19 aa, Mycobacterium
RRAARKAALEKVRQIDRTG

SEQ ID NO: 725203 - protein, 35 aa, Mycobacterium
RRAASMGYQSWWRRAESVGFCAHPIQLIGTDEYGR

SEQ ID NO: 725204 - protein, 18 aa, Mycobacterium
RRAATALAERHPMLRVEF

SEQ ID NO: 725205 - protein, 19 aa, Mycobacterium
RRAAVLGSITPGLAPLRLP

SEQ ID NO: 725206 - protein, 26 aa, Mycobacterium
RRACLPVWRAAAARARVTPGGLYFAG

SEQ ID NO: 725207 - protein, 22 aa, Mycobacterium
RRADGAEAWGGWEDAAVPPQRL

SEQ ID NO: 725208 - protein, 17 aa, Mycobacterium
RRADGGLDWALVESVCV

SEQ ID NO: 725209 - protein, 20 aa, Mycobacterium
RRADGRILALFIDEVSVLAR

SEQ ID NO: 725210 - protein, 21 aa, Mycobacterium
RRADILFGATVAVIGLGAVGL

SEQ ID NO: 725211 - protein, 22 aa, Mycobacterium
RRADIPFGGTVVVIGLGAVGLC

SEQ ID NO: 725212 - protein, 30 aa, Mycobacterium
RRADLGGTWDLFKYPGIRSDSDMCTFGFRF

SEQ ID NO: 725213 - protein, 18 aa, Mycobacterium
RRADLVAAVEVIRARSGH

SEQ ID NO: 725214 - protein, 19 aa, Mycobacterium
RRADVAVVFAIRAEGEGFD

SEQ ID NO: 725215 - protein, 20 aa, Mycobacterium
RRAEAAGRRWAGRISGDSTS

SEQ ID NO: 725216 - protein, 18 aa, Mycobacterium
RRAEAGGITGIITMPWMF

SEQ ID NO: 725217 - protein, 19 aa, Mycobacterium
RRAEAGGVVNVFRPDEVRP

SEQ ID NO: 725218 - protein, 19 aa, Mycobacterium
RRAEFTGPITIVSSETHLP

SEQ ID NO: 725219 - protein, 21 aa, Mycobacterium
RRAEHLPVGTVVRLPDADAAP

SEQ ID NO: 725220 - protein, 20 aa, Mycobacterium
RRAEIGMVFQHFNLFPHMTV

SEQ ID NO: 725221 - protein, 25 aa, Mycobacterium
RRAEKLERLGLWGLMPRPVYDALIW

SEQ ID NO: 725222 - protein, 17 aa, Mycobacterium
RRAELLALGAEVFGKRP

SEQ ID NO: 725223 - protein, 19 aa, Mycobacterium
RRAEMAGVITAEIGAPIAF

SEQ ID NO: 725224 - protein, 17 aa, Mycobacterium
RRAEMRQHFQAWQLSQF

SEQ ID NO: 725225 - protein, 18 aa, Mycobacterium
RRAERAVIDTALKALKAR

SEQ ID NO: 725226 - protein, 23 aa, Mycobacterium
RRAETVGSLGWIVIRVINEDRPR

SEQ ID NO: 725227 - protein, 23 aa, Mycobacterium
RRAFADLMWDYQFGDRHNAMTVL

SEQ ID NO: 725228 - protein, 19 aa, Mycobacterium
RRAFDFVRNLARGDAPSSP

SEQ ID NO: 725229 - protein, 19 aa, Mycobacterium
RRAFSGWAQSTREQRLDLL

SEQ ID NO: 725230 - protein, 19 aa, Mycobacterium
RRAFSWLPAQFASQSDAPV

SEQ ID NO: 725231 - protein, 21 aa, Mycobacterium
RRAGARAARAWTARPLVGLGR

SEQ ID NO: 725232 - protein, 25 aa, Mycobacterium
RRAGCGRSPVFISDWPRLADGILQL

SEQ ID NO: 725233 - protein, 22 aa, Mycobacterium
RRAGCRSAGLGGRGRRRAVTAL

SEQ ID NO: 725234 - protein, 21 aa, Mycobacterium
RRAGEAAARIADRAGVVDERD

SEQ ID NO: 725235 - protein, 21 aa, Mycobacterium
RRAGEAPAWAPLRVQYADYAA

SEQ ID NO: 725236 - protein, 19 aa, Mycobacterium
RRAGHGFPAGRAVVGDEPV

SEQ ID NO: 725237 - protein, 19 aa, Mycobacterium
RRAGIALAREVERRAPDAV

SEQ ID NO: 725238 - protein, 19 aa, Mycobacterium
RRAGIGVALVSGDRGHAVD

SEQ ID NO: 725239 - protein, 17 aa, Mycobacterium
RRAGIGVATVSGDRSHA

SEQ ID NO: 725240 - protein, 17 aa, Mycobacterium
RRAGINPRGRKREVRVI

SEQ ID NO: 725241 - protein, 21 aa, Mycobacterium
RRAGPRLLASRSRTYPDTEDV

SEQ ID NO: 725242 - protein, 24 aa, Mycobacterium
RRAGRLALPVPRSALVAVDSLWRA

SEQ ID NO: 725243 - protein, 18 aa, Mycobacterium
RRAGRLVAPDQGFGPDID

SEQ ID NO: 725244 - protein, 17 aa, Mycobacterium
RRAGSAIDRVHARVPEL

SEQ ID NO: 725245 - protein, 17 aa, Mycobacterium
RRAGSMLALSKPLQSGR

SEQ ID NO: 725246 - protein, 20 aa, Mycobacterium
RRAGVCLGPAVGGQAPVPAE

SEQ ID NO: 725247 - protein, 20 aa, Mycobacterium
RRAGVRRLVYLGGLHPEGRK

SEQ ID NO: 725248 - protein, 18 aa, Mycobacterium
RRAHDRFGSLLWGVRAVF

SEQ ID NO: 725249 - protein, 25 aa, Mycobacterium
RRAHGLPGLSVAWGMWAEESAMTGH

SEQ ID NO: 725250 - protein, 19 aa, Mycobacterium
RRAHLRKLVNAFVVPGEAQ

SEQ ID NO: 725251 - protein, 26 aa, Mycobacterium
RRAIAIDLRDDWPAALREGGFDVTRP

SEQ ID NO: 725252 - protein, 19 aa, Mycobacterium
RRAIMKPWMGEVFDTAYIP

SEQ ID NO: 725253 - protein, 18 aa, Mycobacterium
RRAIQGFLESGVDLDDVL

SEQ ID NO: 725254 - protein, 18 aa, Mycobacterium
RRAKAPAWSGPVGATVRA

SEQ ID NO: 725255 - protein, 19 aa, Mycobacterium
RRAKLLARRLRRLHYPQRR

SEQ ID NO: 725256 - protein, 18 aa, Mycobacterium
RRAKRLCERLLSYASPLH

SEQ ID NO: 725257 - protein, 18 aa, Mycobacterium
RRAKSRFTQGSLLADKQL

SEQ ID NO: 725258 - protein, 17 aa, Mycobacterium
RRAKSRFTQGSSLADKQ

SEQ ID NO: 725259 - protein, 17 aa, Mycobacterium
RRALAVAAIRRAQERGQ

SEQ ID NO: 725260 - protein, 19 aa, Mycobacterium
RRALDCFLSCQVRLLIVDD

SEQ ID NO: 725261 - protein, 18 aa, Mycobacterium
RRALEACATEPAVAAGVG

SEQ ID NO: 725262 - protein, 18 aa, Mycobacterium
RRALEYATGLGVLVAQHA

SEQ ID NO: 725263 - protein, 19 aa, Mycobacterium
RRALGAWVVSDPGEGFHYS

SEQ ID NO: 725264 - protein, 31 aa, Mycobacterium
RRALHQAAVRLCARVGLRGLATVEFLVTGED

SEQ ID NO: 725265 - protein, 23 aa, Mycobacterium
RRALLPRVRFVPGLRDKISDSTT

SEQ ID NO: 725266 - protein, 18 aa, Mycobacterium
RRALPQWAGVTPAERSAV

SEQ ID NO: 725267 - protein, 17 aa, Mycobacterium
RRALPRWIGQGQAAAIP

SEQ ID NO: 725268 - protein, 25 aa, Mycobacterium
RRALSDAALRLAFERGLDNVTREDV

SEQ ID NO: 725269 - protein, 17 aa, Mycobacterium
RRALSELLRRGTKNMTG

SEQ ID NO: 725270 - protein, 28 aa, Mycobacterium
RRALSVSPASLWPTVPMLLEAAVADCWD

SEQ ID NO: 725271 - protein, 25 aa, Mycobacterium
RRALTVLCAAALVSSGCARFNDAQS

SEQ ID NO: 725272 - protein, 21 aa, Mycobacterium
RRALVRTGVAVAIPFGMVGLV

SEQ ID NO: 725273 - protein, 21 aa, Mycobacterium
RRAMNKALGLDTVFLDVDTDK

SEQ ID NO: 725274 - protein, 21 aa, Mycobacterium
RRAPIPSAEPRRRGFLPRVAA

SEQ ID NO: 725275 - protein, 18 aa, Mycobacterium
RRAPKAALKRIANAYIDF

SEQ ID NO: 725276 - protein, 19 aa, Mycobacterium
RRAPLPLAPMQANLWYLQQ

SEQ ID NO: 725277 - protein, 19 aa, Mycobacterium
RRAPNLGFDIDVEHAKISL

SEQ ID NO: 725278 - protein, 24 aa, Mycobacterium
RRAPRSRVLFVDYLTLLPPAGVPA

SEQ ID NO: 725279 - protein, 19 aa, Mycobacterium
RRAPTAVVIPSDLQEQPYE

SEQ ID NO: 725280 - protein, 17 aa, Mycobacterium
RRAQEITTRSAALAAAA

SEQ ID NO: 725281 - protein, 27 aa, Mycobacterium
RRAQRGMAVVGGRGSGAVMVLAGPPGV

SEQ ID NO: 725282 - protein, 25 aa, Mycobacterium
RRAQRPRITALIAERISTRTAAEWV

SEQ ID NO: 725283 - protein, 18 aa, Mycobacterium
RRAQVRGGDIAVVIGAGG

SEQ ID NO: 725284 - protein, 19 aa, Mycobacterium
RRARCAVVSVDYRLAPEHP

SEQ ID NO: 725285 - protein, 25 aa, Mycobacterium
RRARDCLRYARMLDLVVEDEGRWKL

SEQ ID NO: 725286 - protein, 17 aa, Mycobacterium
RRAREAKEIRGVEHANE

SEQ ID NO: 725287 - protein, 20 aa, Mycobacterium
RRAREPVAFLAQLGRDHRKY

SEQ ID NO: 725288 - protein, 21 aa, Mycobacterium
RRARERLTFDEAVGLQWALVA

SEQ ID NO: 725289 - protein, 22 aa, Mycobacterium
RRARGYGGPVIVHVITRKGMGY

SEQ ID NO: 725290 - protein, 25 aa, Mycobacterium
RRARKGEFRKLWIARINAAARANDI

SEQ ID NO: 725291 - protein, 20 aa, Mycobacterium
RRARLARRHHLIPGDHRADS

SEQ ID NO: 725292 - protein, 17 aa, Mycobacterium
RRARNRIIAEHGASTVL

SEQ ID NO: 725293 - protein, 17 aa, Mycobacterium
RRARNRIIAEYGGATVL

SEQ ID NO: 725294 - protein, 19 aa, Mycobacterium
RRARQEWLAERLATLDGDK

SEQ ID NO: 725295 - protein, 25 aa, Mycobacterium
RRARRDLYEALGFERYAGTRADRLS

SEQ ID NO: 725296 - protein, 27 aa, Mycobacterium
RRARRLARALHQWGFGASRERSQLAPY

SEQ ID NO: 725297 - protein, 19 aa, Mycobacterium
RRARTRFQQSAARSTDVTG

SEQ ID NO: 725298 - protein, 20 aa, Mycobacterium
RRARVFMKFIQLVNDHVDEL

SEQ ID NO: 725299 - protein, 20 aa, Mycobacterium
RRARVLMRFIELVNQNTDEL

SEQ ID NO: 725300 - protein, 18 aa, Mycobacterium
RRASDRVVFMSDGAIVED

SEQ ID NO: 725301 - protein, 24 aa, Mycobacterium
RRASGLPAAVINWGPWSEVGVAQA

SEQ ID NO: 725302 - protein, 20 aa, Mycobacterium
RRASSVGFESWWRRAESVGF

SEQ ID NO: 725303 - protein, 23 aa, Mycobacterium
RRATLPPLMRGYLRLGAQVCGEP

SEQ ID NO: 725304 - protein, 19 aa, Mycobacterium
RRATLRPGVGRGGGVRLTD

SEQ ID NO: 725305 - protein, 21 aa, Mycobacterium
RRATRPGARLYMFEFGEHNIN

SEQ ID NO: 725306 - protein, 28 aa, Mycobacterium
RRAVAALKPRRIAVLSVHTSPLAQPGTG

SEQ ID NO: 725307 - protein, 21 aa, Mycobacterium
RRAVACLGTAAALYGFDTENT

SEQ ID NO: 725308 - protein, 20 aa, Mycobacterium
RRAVEFDFPAKSGVRRTVEI

SEQ ID NO: 725309 - protein, 28 aa, Mycobacterium
RRAVFTRYELVEGFPKFDVDDVYLGNGV

SEQ ID NO: 725310 - protein, 35 aa, Mycobacterium
RRAVFTRYELVEGFPRFDIDDVFLGNGVSELIQMT

SEQ ID NO: 725311 - protein, 17 aa, Mycobacterium
RRAVGAAGFNTRTGEFV

SEQ ID NO: 725312 - protein, 19 aa, Mycobacterium
RRAVGWWLVGTGRAMLALA

SEQ ID NO: 725313 - protein, 21 aa, Mycobacterium
RRAVIDRAWRAIGPGVEVLSS

SEQ ID NO: 725314 - protein, 17 aa, Mycobacterium
RRAVLLPALTSAGFSVD

SEQ ID NO: 725315 - protein, 17 aa, Mycobacterium
RRAVREIASELVALYAK

SEQ ID NO: 725316 - protein, 30 aa, Mycobacterium; identical to SEQ ID NO: 84320

SEQ ID NO: 725317 - protein, 33 aa, Mycobacterium
RRAVVTRYELVDGFPRFDVDDVYLGNGVSELIT

SEQ ID NO: 725318 - protein, 27 aa, Mycobacterium
RRAWDALQIPVGVAFFFTNSALGRTVA

SEQ ID NO: 725319 - protein, 26 aa, Mycobacterium
RRAYDLDRRHVFHSWSAQAQITPMTV

SEQ ID NO: 725320 - protein, 26 aa, Mycobacterium
RRAYLGDLRLLFAFLADRGSALETLS

SEQ ID NO: 725321 - protein, 20 aa, Mycobacterium
RRCAEAGADLVLAARTVERL

SEQ ID NO: 725322 - protein, 26 aa, Mycobacterium
RRCDEALAEFVSWSLLDVVTGVAGAP

SEQ ID NO: 725323 - protein, 20 aa, Mycobacterium
RRCFLKFPWFFSSRDRLPAY

SEQ ID NO: 725324 - protein, 18 aa, Mycobacterium
RRCGDWPYASMLGAGLCF

SEQ ID NO: 725325 - protein, 26 aa, Mycobacterium
RRCLIPMDGWYEWRPNPAADGKKASK

SEQ ID NO: 725326 - protein, 24 aa, Mycobacterium
RRCPHGKQLWCSMSHDHGDERVGQ

SEQ ID NO: 725327 - protein, 23 aa, Mycobacterium
RRCSCGNLGCWKTIATSTWLRQE

SEQ ID NO: 725328 - protein, 17 aa, Mycobacterium
RRCVLVLTDVGRKALSE

SEQ ID NO: 725329 - protein, 21 aa, Mycobacterium
RRDADGYFYIAGRYKDMYKSG

SEQ ID NO: 725330 - protein, 29 aa, Mycobacterium
RRDAGGKMIRFVVCRKGGRHVVAARDNDL

SEQ ID NO: 725331 - protein, 28 aa, Mycobacterium
RRDAIRHAVAWAGPGDVVLIAGKGHETG

SEQ ID NO: 725332 - protein, 25 aa, Mycobacterium
RRDAIRHAVAWAGPGDVVLVAGKGH

SEQ ID NO: 725333 - protein, 17 aa, Mycobacterium
RRDAIRRAGLLGIGASG

SEQ ID NO: 725334 - protein, 19 aa, Mycobacterium
RRDARDLADYPLGFAEAQL

SEQ ID NO: 725335 - protein, 21 aa, Mycobacterium
RRDARIFGVGLSLPGTVDPVR

SEQ ID NO: 725336 - protein, 24 aa, Mycobacterium
RRDDFPRHPLNVIANMDAPRAIQF

SEQ ID NO: 725337 - protein, 26 aa, Mycobacterium
RRDDGKLVCVAQCRPNTAPTVLVTDS

SEQ ID NO: 725338 - protein, 18 aa, Mycobacterium
RRDDGVLVCVAQCRPNTA

SEQ ID NO: 725339 - protein, 19 aa, Mycobacterium
RRDDGVLVCVAQIRPNTAP

SEQ ID NO: 725340 - protein, 23 aa, Mycobacterium
RRDDIPYHLPIGVHSVEGCLQQD

SEQ ID NO: 725341 - protein, 22 aa, Mycobacterium
RRDEFRASKIMLERAQQNEKIT

SEQ ID NO: 725342 - protein, 23 aa, Mycobacterium
RRDEFRASKIMLERARANEKITF

SEQ ID NO: 725343 - protein, 24 aa, Mycobacterium
RRDEFRASKIMLERAYADPKITVL

SEQ ID NO: 725344 - protein, 17 aa, Mycobacterium
RRDELLASGGYRPRDRV

SEQ ID NO: 725345 - protein, 22 aa, Mycobacterium
RRDEPPLAPFVIVLFGATGDLA

SEQ ID NO: 725346 - protein, 21 aa, Mycobacterium
RRDEPWFDPAGLFLALDESEA

SEQ ID NO: 725347 - protein, 24 aa, Mycobacterium
RRDFNIVGGMCPRCEGRGSVNDID

SEQ ID NO: 725348 - protein, 19 aa, Mycobacterium
RRDGARPGDTVAVTGVLGR

SEQ ID NO: 725349 - protein, 24 aa, Mycobacterium
RRDGDKLSFAKGVLMRRDPDREET

SEQ ID NO: 725350 - protein, 22 aa, Mycobacterium
RRDGKIPAVLYGHGADPQHLEL

SEQ ID NO: 725351 - protein, 27 aa, Mycobacterium
RRDGLPRIAQAVAAPAVRKTGVLESEI

SEQ ID NO: 725352 - protein, 26 aa, Mycobacterium
RRDGLPRVAQVVAVAAARNYGVPDNE

SEQ ID NO: 725353 - protein, 20 aa, Mycobacterium
RRDGPDWVLDGEKIVVSDAP

SEQ ID NO: 725354 - protein, 22 aa, Mycobacterium
RRDGPGGGEMIAIRRGQQAAQH

SEQ ID NO: 725355 - protein, 26 aa, Mycobacterium
RRDGQGAVELDAWWESLRGIQATFPL

SEQ ID NO: 725356 - protein, 20 aa, Mycobacterium
RRDGQVPAVLYGHGTTPEHL

SEQ ID NO: 725357 - protein, 23 aa, Mycobacterium
RRDGRIPAVLYGHGAEPQHLELP

SEQ ID NO: 725358 - protein, 20 aa, Mycobacterium
RRDGSDWVLTGRKLWITNGS

SEQ ID NO: 725359 - protein, 27 aa, Mycobacterium
RRDGVACYPARFQLVLAANLCPCAPAD

SEQ ID NO: 725360 - protein, 27 aa, Mycobacterium
RRDGVACYPARFQLVLAANPCPCAPAD

SEQ ID NO: 725361 - protein, 27 aa, Mycobacterium
RRDGVACYPARFQLVLAANPCPCAPPN

SEQ ID NO: 725362 - protein, 18 aa, Mycobacterium
RRDGVPYPCLVHAVCAAR

SEQ ID NO: 725363 - protein, 25 aa, Mycobacterium
RRDGWTRLHFEFVCPQYSEVVADRA

SEQ ID NO: 725364 - protein, 20 aa, Mycobacterium
RRDGWWKGLDSYDLVLDALG

SEQ ID NO: 725365 - protein, 24 aa, Mycobacterium
RRDHGGVIFIDLRDASGIAQVVFR

SEQ ID NO: 725366 - protein, 24 aa, Mycobacterium
RRDHGGVIFIDLRDASGITQVVFR

SEQ ID NO: 725367 - protein, 23 aa, Mycobacterium
RRDHGGVIFIDLRDASGVSQVVF

SEQ ID NO: 725368 - protein, 18 aa, Mycobacterium
RRDIEPFGKLVATLAAGW

SEQ ID NO: 725369 - protein, 18 aa, Mycobacterium
RRDKRKGGVLEFGTTVVG

SEQ ID NO: 725370 - protein, 21 aa, Mycobacterium
RRDLEHFAWDPPVVKVNYALR

SEQ ID NO: 725371 - protein, 20 aa, Mycobacterium
RRDLGLLAMDIIRGLLVSSL

SEQ ID NO: 725372 - protein, 19 aa, Mycobacterium
RRDLGLVVMMGVPGREPTR

SEQ ID NO: 725373 - protein, 17 aa, Mycobacterium
RRDLPAMFAAVTDDMID

SEQ ID NO: 725374 - protein, 23 aa, Mycobacterium
RRDLPIMYPLEVRFSAPDDAFLS

SEQ ID NO: 725375 - protein, 17 aa, Mycobacterium
RRDLPLSPYLVAAAGGV

SEQ ID NO: 725376 - protein, 24 aa, Mycobacterium
RRDLPTLWLNQAFFSLVAGAGRSA

SEQ ID NO: 725377 - protein, 19 aa, Mycobacterium
RRDLPWRRPDVGAWQILVS

SEQ ID NO: 725378 - protein, 17 aa, Mycobacterium
RRDLRLRDHPALVAAAQ

SEQ ID NO: 725379 - protein, 19 aa, Mycobacterium
RRDLVKQAKHKGEEARVSV

SEQ ID NO: 725380 - protein, 20 aa, Mycobacterium
RRDMGVGELLGMVQAGLSHT

SEQ ID NO: 725381 - protein, 20 aa, Mycobacterium
RRDPGWSVLRSFKRLLNDAG

SEQ ID NO: 725382 - protein, 23 aa, Mycobacterium
RRDPNNLLAMLWTWQNGNVGNTP

SEQ ID NO: 725383 - protein, 22 aa, Mycobacterium
RRDPRTWARGLWRASVATTSTA

SEQ ID NO: 725384 - protein, 18 aa, Mycobacterium
RRDPRVSILLSPPDEPYT

SEQ ID NO: 725385 - protein, 24 aa, Mycobacterium
RRDPWAGVPVFAAWVSEPAEVGSV

SEQ ID NO: 725386 - protein, 20 aa, Mycobacterium
RRDRELARRLLAEAGHPQGL

SEQ ID NO: 725387 - protein, 22 aa, Mycobacterium
RRDRMSAAFRRLLAVLPPDTSL

SEQ ID NO: 725388 - protein, 23 aa, Mycobacterium
RRDRSRLRLALAEGERLEPPALF

SEQ ID NO: 725389 - protein, 26 aa, Mycobacterium
RRDSEWMGRVHRFLGLDVGVILSGMT

SEQ ID NO: 725390 - protein, 20 aa, Mycobacterium
RRDVDGWIHVAVKGPPMARG

SEQ ID NO: 725391 - protein, 18 aa, Mycobacterium
RRDVDLSRTVGWFTSKYP

SEQ ID NO: 725392 - protein, 28 aa, Mycobacterium
RRDVGGKMVRFVVCRKGDRHVVAARDDD

SEQ ID NO: 725393 - protein, 18 aa, Mycobacterium
RRDVGGVMVRFVVCRKDD

SEQ ID NO: 725394 - protein, 19 aa, Mycobacterium
RRDVGLPLEGLRVLDLGVI

SEQ ID NO: 725395 - protein, 23 aa, Mycobacterium
RRDVGRNDLCWCGSGRKYKKCHL

SEQ ID NO: 725396 - protein, 23 aa, Mycobacterium
RRDVLRCFATLFGDDALKPLDYV

SEQ ID NO: 725397 - protein, 26 aa, Mycobacterium
RRDWACLYCFFGRVGCMIQPVARHKT

SEQ ID NO: 725398 - protein, 17 aa, Mycobacterium
RRDWAVAEDGARIPVSV

SEQ ID NO: 725399 - protein, 23 aa, Mycobacterium
RRDWLELFPFLLTRRPESYGALT

SEQ ID NO: 725400 - protein, 20 aa, Mycobacterium
RRDWQRWAAATGDHNPLYFD

SEQ ID NO: 725401 - protein, 20 aa, Mycobacterium
RRDWQRWAAAVGEDNPLYFD

SEQ ID NO: 725402 - protein, 25 aa, Mycobacterium
RRDYRWAEADRHLWIADERGTWQIR

SEQ ID NO: 725403 - protein, 18 aa, Mycobacterium
RREAFRLFEDQGYANTTV

SEQ ID NO: 725404 - protein, 24 aa, Mycobacterium
RREALPRLQVWDIDPGGGYGEPEE

SEQ ID NO: 725405 - protein, 20 aa, Mycobacterium
RREALTWLCNAVSRMANNPT

SEQ ID NO: 725406 - protein, 28 aa, Mycobacterium
RREDGRWSWRWDPAFVTSNFQFLQGDPD

SEQ ID NO: 725407 - protein, 27 aa, Mycobacterium
RREDKPFWWAHFDRLNFPLEEWADNTD

SEQ ID NO: 725408 - protein, 26 aa, Mycobacterium
RREDKPFWWAHFDRLNFPVDEWADNT

SEQ ID NO: 725409 - protein, 26 aa, Mycobacterium
RREDKPFWWGHFDRLNYPLDEWSDST

SEQ ID NO: 725410 - protein, 25 aa, Mycobacterium
RREDKPFWWSHFDRLNHPVEEWSDG

SEQ ID NO: 725411 - protein, 24 aa, Mycobacterium
RREEARMATEFVRYLRRSHDLTAA

SEQ ID NO: 725412 - protein, 17 aa, Mycobacterium
RREETWQPVRDGRTSGK

SEQ ID NO: 725413 - protein, 19 aa, Mycobacterium
RREFCRPDHPVVQVAYPDA

SEQ ID NO: 725414 - protein, 17 aa, Mycobacterium
RREFDFPGDDRVVAKCF

SEQ ID NO: 725415 - protein, 28 aa, Mycobacterium
RREFDRIKLGPSLWHRDFHDAVIVECPD

SEQ ID NO: 725416 - protein, 18 aa, Mycobacterium
RREFKLPAHVTGDAVTAS

SEQ ID NO: 725417 - protein, 18 aa, Mycobacterium
RREFPAMAPDCTTVDHRR

SEQ ID NO: 725418 - protein, 19 aa, Mycobacterium
RREGMELLERVGLADRADA

SEQ ID NO: 725419 - protein, 18 aa, Mycobacterium
RREGRKPGASVWFKSRPR

SEQ ID NO: 725420 - protein, 18 aa, Mycobacterium
RREGRKPGATSWLKNGDT

SEQ ID NO: 725421 - protein, 20 aa, Mycobacterium
RREGWDYPDMARESGTNALN

SEQ ID NO: 725422 - protein, 25 aa, Mycobacterium
RREIADALTSAFERRHEVLDLIVEA

SEQ ID NO: 725423 - protein, 26 aa, Mycobacterium
RREICARFIREPGYRFVELADPRRAD

SEQ ID NO: 725424 - protein, 17 aa, Mycobacterium
RREIEVLRAIAGGATNR

SEQ ID NO: 725425 - protein, 17 aa, Mycobacterium
RREIRVVFDELRREIPD

SEQ ID NO: 725426 - protein, 21 aa, Mycobacterium
RRELADDGFVYRFRHDERDLG

SEQ ID NO: 725427 - protein, 17 aa, Mycobacterium
RRELILILDTVMRPRAV

SEQ ID NO: 725428 - protein, 20 aa, Mycobacterium
RRELLAVLTKRGRDLVRRVT

SEQ ID NO: 725429 - protein, 28 aa, Mycobacterium
RRELLQRLLPLVLPIVLAYLGNQLRPGG

SEQ ID NO: 725430 - protein, 23 aa, Mycobacterium
RRELPARVIQAIQVFAQDRVIAP

SEQ ID NO: 725431 - protein, 18 aa, Mycobacterium
RRELVSALAGSYFGSFAE

SEQ ID NO: 725432 - protein, 33 aa, Mycobacterium
RREMAYEGRIDWAFAELLALGSLIAEGKLVRLS

SEQ ID NO: 725433 - protein, 20 aa, Mycobacterium
RREPACPTVPTLSAGATAPE

SEQ ID NO: 725434 - protein, 23 aa, Mycobacterium
RREPHPVWDFLFTYYSLRPRQLR

SEQ ID NO: 725435 - protein, 23 aa, Mycobacterium
RREPLQLIAQRACTLTDAEQAIV

SEQ ID NO: 725436 - protein, 23 aa, Mycobacterium
RREPPGSVVRIRLRSVPTADHEM

SEQ ID NO: 725437 - protein, 24 aa, Mycobacterium
RREPRPYPKLSLSQRDSIFDYTYE

SEQ ID NO: 725438 - protein, 24 aa, Mycobacterium
RREPRPYPKLVLVQRDSIFDYAYE

SEQ ID NO: 725439 - protein, 23 aa, Mycobacterium
RREPVAVLGMGLRLPAGIETASQ

SEQ ID NO: 725440 - protein, 18 aa, Mycobacterium
RREQREALAHGRYLGLGL

SEQ ID NO: 725441 - protein, 18 aa, Mycobacterium
RRERANSIVKLWTSSETI

SEQ ID NO: 725442 - protein, 17 aa, Mycobacterium
RRERIGGTWDLFRYPGI

SEQ ID NO: 725443 - protein, 19 aa, Mycobacterium
RRERYEWRHGAAVSVGLVF

SEQ ID NO: 725444 - protein, 20 aa, Mycobacterium
RRESRFPISEILAKTPPIPD

SEQ ID NO: 725445 - protein, 20 aa, Mycobacterium
RRESRFPISEILAQTPPIPD

SEQ ID NO: 725446 - protein, 23 aa, Mycobacterium
RRETLERLGWIVIRVVVNDRPAD

SEQ ID NO: 725447 - protein, 25 aa, Mycobacterium
RRETRLSPLTVRLMHVMSPMDHGKA

SEQ ID NO: 725448 - protein, 28 aa, Mycobacterium
RREVPVDLRFDWPTALHDAGFDASLPTA

SEQ ID NO: 725449 - protein, 26 aa, Mycobacterium
RREWGPAVAAIARWSGDLTIAEDAVQ

SEQ ID NO: 725450 - protein, 26 aa, Mycobacterium
RREWGPTVATIARWSGDLALAEDAVQ

SEQ ID NO: 725451 - protein, 25 aa, Mycobacterium
RREYRRKLQLCLDVFETMLVQSRFD

SEQ ID NO: 725452 - protein, 24 aa, Mycobacterium
RREYRRKLQLCVDVVETMLAQSGF

SEQ ID NO: 725453 - protein, 18 aa, Mycobacterium
RRFACGSGTSNAVCAGDL

SEQ ID NO: 725454 - protein, 17 aa, Mycobacterium
RRFADFQSRLGIGADML

SEQ ID NO: 725455 - protein, 24 aa, Mycobacterium
RRFAEATSRAAARGATVWVQDYQL

SEQ ID NO: 725456 - protein, 20 aa, Mycobacterium
RRFAELLAQHLPKGVLEILD

SEQ ID NO: 725457 - protein, 18 aa, Mycobacterium
RRFAELLVQVATEAGAAD

SEQ ID NO: 725458 - protein, 22 aa, Mycobacterium
RRFAETELRALLAHDAGAEPSN

SEQ ID NO: 725459 - protein, 20 aa, Mycobacterium
RRFAEVLAHTAPDARCPTCP

SEQ ID NO: 725460 - protein, 22 aa, Mycobacterium
RRFAEYRRRAVPAAAVAHDGED

SEQ ID NO: 725461 - protein, 24 aa, Mycobacterium
RRFAGCPICNLHLQSIVRRHDEIA

SEQ ID NO: 725462 - protein, 25 aa, Mycobacterium
RRFAGCPICNLHLRSFVARHDELER

SEQ ID NO: 725463 - protein, 22 aa, Mycobacterium
RRFAGCPICNLHLRSISGRHDE

SEQ ID NO: 725464 - protein, 26 aa, Mycobacterium
RRFAGCPICSLHLHGFADRHEQLTDA

SEQ ID NO: 725465 - protein, 22 aa, Mycobacterium
RRFANPLALRVEDLGAYPRADA

SEQ ID NO: 725466 - protein, 35 aa, Mycobacterium
RRFAPESKTLYLARWLHPGQRAFQLATQIALLTQA

SEQ ID NO: 725467 - protein, 20 aa, Mycobacterium
RRFAPFNLPEAVIRPTYGLA

SEQ ID NO: 725468 - protein, 25 aa, Mycobacterium
RRFAQVSPIVACYRKLEAARGDLEA

SEQ ID NO: 725469 - protein, 26 aa, Mycobacterium
RRFARARLAVPPADAFLAELLAAESD

SEQ ID NO: 725470 - protein, 21 aa, Mycobacterium
RRFARHYVHAGMIGWDGHKMS

SEQ ID NO: 725471 - protein, 21 aa, Mycobacterium
RRFARHYVHTGMIGWDGHKMS

SEQ ID NO: 725472 - protein, 19 aa, Mycobacterium
RRFARNDYDILLIGHEGHE

SEQ ID NO: 725473 - protein, 27 aa, Mycobacterium
RRFCIPAVEAKGSLLLEDVGVPLPALG

SEQ ID NO: 725474 - protein, 27 aa, Mycobacterium
RRFCIPAVEAKGSLLLEDVGVPLPNLG

SEQ ID NO: 725475 - protein, 27 aa, Mycobacterium
RRFCIPAVETKGSLLLEDVGVPLPALG

SEQ ID NO: 725476 - protein, 20 aa, Mycobacterium
RRFCYSCGVAALSSSDVVGP

SEQ ID NO: 725477 - protein, 17 aa, Mycobacterium
RRFDMASAVPWLAAMPN

SEQ ID NO: 725478 - protein, 19 aa, Mycobacterium
RRFDVPIAGAHVVVIGRGV

SEQ ID NO: 725479 - protein, 21 aa, Mycobacterium
RRFEQRPSEALVLGQVLDTTV

SEQ ID NO: 725480 - protein, 20 aa, Mycobacterium
RRFETSWNRENGAHPINDSP

SEQ ID NO: 725481 - protein, 19 aa, Mycobacterium
RRFGDAFIPMDEALAHAAV

SEQ ID NO: 725482 - protein, 17 aa, Mycobacterium
RRFGEFQKSLGLAKNIL

SEQ ID NO: 725483 - protein, 19 aa, Mycobacterium
RRFGGPRWSTSQHLCGTAP

SEQ ID NO: 725484 - protein, 19 aa, Mycobacterium
RRFGLNAALTFVHVPYPPL

SEQ ID NO: 725485 - protein, 17 aa, Mycobacterium
RRFGRMFLAGARLTVPL

SEQ ID NO: 725486 - protein, 20 aa, Mycobacterium
RRFGVPVCGVATGLASRVSA

SEQ ID NO: 725487 - protein, 19 aa, Mycobacterium
RRFHNPRTGYDLRGVTYER

SEQ ID NO: 725488 - protein, 23 aa, Mycobacterium
RRFLAAFAPFGLRPDALRPGYGL

SEQ ID NO: 725489 - protein, 20 aa, Mycobacterium
RRFLEAFAVTGLRPEAFCPA

SEQ ID NO: 725490 - protein, 18 aa, Mycobacterium
RRFLEGDAQAWARGATLE

SEQ ID NO: 725491 - protein, 20 aa, Mycobacterium
RRFLESEGWIAWSGPAISEL

SEQ ID NO: 725492 - protein, 19 aa, Mycobacterium
RRFLFYPAVKELTLDIASV

SEQ ID NO: 725493 - protein, 20 aa, Mycobacterium
RRFMLGMVVSTGIGGGLVLD

SEQ ID NO: 725494 - protein, 20 aa, Mycobacterium
RRFNERFAQFNLPDFTVRPS

SEQ ID NO: 725495 - protein, 20 aa, Mycobacterium
RRFPDAAVVRLERDYRSTPQ

SEQ ID NO: 725496 - protein, 19 aa, Mycobacterium
RRFPEVTLVRLERDYRSTP

SEQ ID NO: 725497 - protein, 17 aa, Mycobacterium
RRFPTKIELVYEAVFPN

SEQ ID NO: 725498 - protein, 20 aa, Mycobacterium
RRFRDLDGIAALELIDARAG

SEQ ID NO: 725499 - protein, 19 aa, Mycobacterium
RRFRDLPRSPVHPDVETQD

SEQ ID NO: 725500 - protein, 17 aa, Mycobacterium
RRFRELWAVLPELADVT

SEQ ID NO: 725501 - protein, 19 aa, Mycobacterium
RRFRGGPVPEEYTTRAEYE

SEQ ID NO: 725502 - protein, 25 aa, Mycobacterium
RRFRHAVKFLRWRPDRDPQSCTFDQ

SEQ ID NO: 725503 - protein, 25 aa, Mycobacterium
RRFRHAVKFLRWRPDREPSSCTFDQ

SEQ ID NO: 725504 - protein, 20 aa, Mycobacterium
RRFRHKRNLVRLTIMDESLR

SEQ ID NO: 725505 - protein, 19 aa, Mycobacterium
RRFRREAHAAARLNTPHAI

SEQ ID NO: 725506 - protein, 17 aa, Mycobacterium
RRFRYVPTYILHGLTDL

SEQ ID NO: 725507 - protein, 20 aa, Mycobacterium
RRFSEKLACPNGHPLAVDDL

SEQ ID NO: 725508 - protein, 17 aa, Mycobacterium
RRFSESETHAVPPPPAR

SEQ ID NO: 725509 - protein, 19 aa, Mycobacterium
RRFSMPWSAPAERMSEYVN

SEQ ID NO: 725510 - protein, 22 aa, Mycobacterium
RRFTHTVLLRLPPRIDRSTVEM

SEQ ID NO: 725511 - protein, 17 aa, Mycobacterium
RRFTRTRLRQEVLPLLE

SEQ ID NO: 725512 - protein, 29 aa, Mycobacterium
RRFVEAAGFQCGFCTAGMITTASTFTEEQ

SEQ ID NO: 725513 - protein, 23 aa, Mycobacterium
RRFVEATGIPFLPMSMAKGLLPD

SEQ ID NO: 725514 - protein, 26 aa, Mycobacterium
RRFVEETGRTPMQWITDQRVLYARRM

SEQ ID NO: 725515 - protein, 18 aa, Mycobacterium
RRFVEYRESLGFEVLPLT

SEQ ID NO: 725516 - protein, 21 aa, Mycobacterium
RRFVLAEARVPAYAREFGEEP

SEQ ID NO: 725517 - protein, 24 aa, Mycobacterium
RRFVPELLARFGIAGPAVGELHRA

SEQ ID NO: 725518 - protein, 24 aa, Mycobacterium
RRFVRLRAPLILDLRRVEYLGSAG

SEQ ID NO: 725519 - protein, 17 aa, Mycobacterium
RRFYEEKVRAVIDDPAV

SEQ ID NO: 725520 - protein, 19 aa, Mycobacterium
RRGACMAVLDASHPDICDF

SEQ ID NO: 725521 - protein, 18 aa, Mycobacterium
RRGAELIVVSASWGSGPG

SEQ ID NO: 725522 - protein, 17 aa, Mycobacterium
RRGAPTANVRWGNNVAI

SEQ ID NO: 725523 - protein, 21 aa, Mycobacterium
RRGAQRAEWLAAARTVTAGMA

SEQ ID NO: 725524 - protein, 19 aa, Mycobacterium
RRGAQVIAVCASWGAGPGK

SEQ ID NO: 725525 - protein, 17 aa, Mycobacterium
RRGARRALITLCVGGGM

SEQ ID NO: 725526 - protein, 22 aa, Mycobacterium
RRGARRYVGRWSLISEYIGSAM

SEQ ID NO: 725527 - protein, 18 aa, Mycobacterium
RRGASLIAVCASWGSGPG

SEQ ID NO: 725528 - protein, 21 aa, Mycobacterium
RRGATELSLRELAREAGVSHA

SEQ ID NO: 725529 - protein, 26 aa, Mycobacterium
RRGAVYWDPLSTLGFLAAHTRRIRLA

SEQ ID NO: 725530 - protein, 19 aa, Mycobacterium
RRGDERLGRGGVPTDRVAA

SEQ ID NO: 725531 - protein, 21 aa, Mycobacterium
RRGDGPGVVLIPEMPGLHPGV

SEQ ID NO: 725532 - protein, 21 aa, Mycobacterium
RRGDGVLYWQVPRTATLDSAI

SEQ ID NO: 725533 - protein, 19 aa, Mycobacterium
RRGDGWVKLVGDWIDRQVG

SEQ ID NO: 725534 - protein, 20 aa, Mycobacterium
RRGDHRWEFESMPAAMRFLT

SEQ ID NO: 725535 - protein, 24 aa, Mycobacterium
RRGDLVDVRFNWHTMYFRYKTVDP

SEQ ID NO: 725536 - protein, 20 aa, Mycobacterium
RRGDRWVIDGAKTWSTSAFA

SEQ ID NO: 725537 - protein, 21 aa, Mycobacterium
RRGEFRPRVRFLAPGKKILHD

SEQ ID NO: 725538 - protein, 17 aa, Mycobacterium
RRGEGIGLTTVYRTLQA

SEQ ID NO: 725539 - protein, 18 aa, Mycobacterium
RRGEGIGLTTVYRTLQQM

SEQ ID NO: 725540 - protein, 26 aa, Mycobacterium
RRGEGIGSSVLRWQEQRGLQHLAESD

SEQ ID NO: 725541 - protein, 20 aa, Mycobacterium
RRGEGLARDIARVDCQLLIT

SEQ ID NO: 725542 - protein, 23 aa, Mycobacterium
RRGEGLLRDIRKSDVQVLLVDAE

SEQ ID NO: 725543 - protein, 21 aa, Mycobacterium
RRGEHRCVLRMPPPGAPPDRD

SEQ ID NO: 725544 - protein, 17 aa, Mycobacterium
RRGEILDAVMAHLLEHG

SEQ ID NO: 725545 - protein, 18 aa, Mycobacterium
RRGEILGLVGPNGAGKTT

SEQ ID NO: 725546 - protein, 17 aa, Mycobacterium
RRGELLTILGRHVGYSI

SEQ ID NO: 725547 - protein, 22 aa, Mycobacterium
RRGELPMSVVMVIANHPDLAEQ

SEQ ID NO: 725548 - protein, 21 aa, Mycobacterium
RRGELPWTRIDDLHRGRLVEL

SEQ ID NO: 725549 - protein, 17 aa, Mycobacterium
RRGELVMVFPGGAREVN

SEQ ID NO: 725550 - protein, 19 aa, Mycobacterium
RRGFAALRRPVRRPLDEGV

SEQ ID NO: 725551 - protein, 17 aa, Mycobacterium
RRGFAYGTLPGHAEAGE

SEQ ID NO: 725552 - protein, 17 aa, Mycobacterium
RRGFAYGTLPGHPVSGE

SEQ ID NO: 725553 - protein, 18 aa, Mycobacterium
RRGFAYGTLQGHPETGEE

SEQ ID NO: 725554 - protein, 17 aa, Mycobacterium
RRGFMVLPVTGRDVTDV

SEQ ID NO: 725555 - protein, 20 aa, Mycobacterium
RRGFRAARSERIFGGYNTSS

SEQ ID NO: 725556 - protein, 20 aa, Mycobacterium
RRGGGIGLAAMCAGGGMGSA

SEQ ID NO: 725557 - protein, 17 aa, Mycobacterium
RRGGLPVSPPSGVSTQI

SEQ ID NO: 725558 - protein, 21 aa, Mycobacterium
RRGGLYPWIATQKERFVRITP

SEQ ID NO: 725559 - protein, 17 aa, Mycobacterium
RRGGRIAPELTGLWTAG

SEQ ID NO: 725560 - protein, 20 aa, Mycobacterium
RRGGVFPGTVMDYSKTPASL

SEQ ID NO: 725561 - protein, 20 aa, Mycobacterium
RRGGYCYEHNGLLGYVLEDL

SEQ ID NO: 725562 - protein, 19 aa, Mycobacterium
RRGGYCYEQNGLMGYVLAE

SEQ ID NO: 725563 - protein, 17 aa, Mycobacterium
RRGHYVFAMPPGQTLGN

SEQ ID NO: 725564 - protein, 27 aa, Mycobacterium
RRGILVAPGRFYGPRGREHVRVALTAT

SEQ ID NO: 725565 - protein, 21 aa, Mycobacterium
RRGIPVLLRPVVLADLMAGYR

SEQ ID NO: 725566 - protein, 18 aa, Mycobacterium
RRGIPVLLRPVVLAKLMA

SEQ ID NO: 725567 - protein, 19 aa, Mycobacterium
RRGISALRRTVRRPIDEGV

SEQ ID NO: 725568 - protein, 19 aa, Mycobacterium
RRGKPRPSPVAQLALEHGI

SEQ ID NO: 725569 - protein, 17 aa, Mycobacterium
RRGKVLRRLAGDDPEVN

SEQ ID NO: 725570 - protein, 17 aa, Mycobacterium
RRGKYLWLVLDGPGQPD

SEQ ID NO: 725571 - protein, 26 aa, Mycobacterium
RRGLARTLCEGMLTWAHERGATRAYV

SEQ ID NO: 725572 - protein, 18 aa, Mycobacterium
RRGLDSELAPLYAQALVG

SEQ ID NO: 725573 - protein, 37 aa, Mycobacterium
RRGLEPFTFRPALTVGWRLWMDIGFKLASDPDELREL

SEQ ID NO: 725574 - protein, 29 aa, Mycobacterium
RRGLIAEFGISWILPRLTTWGVALDLLLS

SEQ ID NO: 725575 - protein, 17 aa, Mycobacterium
RRGLMLLDFEEHMFHRR

SEQ ID NO: 725576 - protein, 24 aa, Mycobacterium
RRGLNLSPRMVFTAPTIRQLAATI

SEQ ID NO: 725577 - protein, 19 aa, Mycobacterium
RRGLRRDRVLALGLRLLDL

SEQ ID NO: 725578 - protein, 17 aa, Mycobacterium
RRGLRWALEAIVCQHLT

SEQ ID NO: 725579 - protein, 17 aa, Mycobacterium
RRGLRWALEAIVCRHLS

SEQ ID NO: 725580 - protein, 26 aa, Mycobacterium
RRGLTPGPWRLIRVVGDYYKPGFHPS

SEQ ID NO: 725581 - protein, 19 aa, Mycobacterium
RRGLVPGPFQFLRVIGAYY

SEQ ID NO: 725582 - protein, 24 aa, Mycobacterium
RRGMSVYHRVRRDSLSALCMVLDP

SEQ ID NO: 725583 - protein, 23 aa, Mycobacterium
RRGNGRWELSWWAGPWPIDERWW

SEQ ID NO: 725584 - protein, 22 aa, Mycobacterium
RRGNWSLDLGYFLQGALTVEDR

SEQ ID NO: 725585 - protein, 18 aa, Mycobacterium
RRGNWTYDCAGAHIRAHC

SEQ ID NO: 725586 - protein, 21 aa, Mycobacterium
RRGPAAAAFTLPELIGLTSSC

SEQ ID NO: 725587 - protein, 18 aa, Mycobacterium
RRGPDLVELSHAIHAEPE

SEQ ID NO: 725588 - protein, 21 aa, Mycobacterium
RRGPHKVLRGDLAFAGQPGVL

SEQ ID NO: 725589 - protein, 17 aa, Mycobacterium
RRGPRAPAVLAVSPLMR

SEQ ID NO: 725590 - protein, 19 aa, Mycobacterium
RRGQQEWRGMEQRGFGDPN

SEQ ID NO: 725591 - protein, 21 aa, Mycobacterium
RRGRHHPLGGVLNAQGAPAPK

SEQ ID NO: 725592 - protein, 20 aa, Mycobacterium
RRGRIFVRNGAPFSGHTDGR

SEQ ID NO: 725593 - protein, 22 aa, Mycobacterium
RRGRPTAHRAFANWHHANGLSG

SEQ ID NO: 725594 - protein, 20 aa, Mycobacterium
RRGRPVLTTPAWPVTIKDGA

SEQ ID NO: 725595 - protein, 20 aa, Mycobacterium
RRGRQVCLVDVELSQDSRTA

SEQ ID NO: 725596 - protein, 21 aa, Mycobacterium
RRGRRRPGRCGGVGAGAVGAG

SEQ ID NO: 725597 - protein, 17 aa, Mycobacterium
RRGRSRWFTVHDDALPA

SEQ ID NO: 725598 - protein, 29 aa, Mycobacterium
RRGRVQSVLLPRLLNWMSYTPDPDGGLLA

SEQ ID NO: 725599 - protein, 18 aa, Mycobacterium
RRGSCTLTAAGHVIDIRG

SEQ ID NO: 725600 - protein, 19 aa, Mycobacterium
RRGSHFAELDRSRVSARQA

SEQ ID NO: 725601 - protein, 24 aa, Mycobacterium
RRGSKRPTFAAVHGRDATEVRAAD

SEQ ID NO: 725602 - protein, 20 aa, Mycobacterium
RRGSTTVVRMSLLRAPLFPD

SEQ ID NO: 725603 - protein, 17 aa, Mycobacterium
RRGTCATCHTRRRLVHP

SEQ ID NO: 725604 - protein, 19 aa, Mycobacterium
RRGTWRAAWHEHTRTQQSR

SEQ ID NO: 725605 - protein, 26 aa, Mycobacterium
RRGVDAADRLCEACVTLLDVDAAAIS

SEQ ID NO: 725606 - protein, 24 aa, Mycobacterium
RRGVFPVFVPKMFGGMYRTMSVLP

SEQ ID NO: 725607 - protein, 19 aa, Mycobacterium
RRGVGLVAVHTWMNSADFY

SEQ ID NO: 725608 - protein, 29 aa, Mycobacterium
RRGVGVVALHAWMDLRVADVKEPFQDGNW

SEQ ID NO: 725609 - protein, 26 aa, Mycobacterium
RRGVILGTGGFEWDPALTQAFLRGPM

SEQ ID NO: 725610 - protein, 23 aa, Mycobacterium
RRGVIPDCMAHWTLTQLTTLGVA

SEQ ID NO: 725611 - protein, 19 aa, Mycobacterium
RRGVKAIAVTAGYMCPAPR

SEQ ID NO: 725612 - protein, 19 aa, Mycobacterium
RRGVRLGKGLGFYDRSLAG

SEQ ID NO: 725613 - protein, 18 aa, Mycobacterium
RRGVRLGRGRGFYDRSLG

SEQ ID NO: 725614 - protein, 19 aa, Mycobacterium
RRGVVLATGGFEWDPVLVR

SEQ ID NO: 725615 - protein, 18 aa, Mycobacterium
RRGVVPADPAIALQIPSA

SEQ ID NO: 725616 - protein, 18 aa, Mycobacterium
RRGYRCVFVCPDKVSEDK

SEQ ID NO: 725617 - protein, 24 aa, Mycobacterium
RRGYVPALACARCRTVTRCRHCTG

SEQ ID NO: 725618 - protein, 38 aa, Mycobacterium
RRGYVPALACTKCRTVARCRHCTGPLAWEGPGGASHSA

SEQ ID NO: 725619 - protein, 17 aa, Mycobacterium
RRHAIEALEQMGISVEF

SEQ ID NO: 725620 - protein, 17 aa, Mycobacterium
RRHALPVPPAFCITTEV

SEQ ID NO: 725621 - protein, 17 aa, Mycobacterium
RRHAPAIVRDARNDPRV

SEQ ID NO: 725622 - protein, 20 aa, Mycobacterium
RRHAPVDITIISPVDYMLYT

SEQ ID NO: 725623 - protein, 24 aa, Mycobacterium
RRHARIAKLLGIKHFVAAVNKIDL

SEQ ID NO: 725624 - protein, 17 aa, Mycobacterium
RRHAVGLTVGRVDVGAL

SEQ ID NO: 725625 - protein, 20 aa, Mycobacterium
RRHAVSRRNFLRGSAAAAAV

SEQ ID NO: 725626 - protein, 21 aa, Mycobacterium
RRHCFELDRELPLRVAVLHTA

SEQ ID NO: 725627 - protein, 19 aa, Mycobacterium
RRHEAFAIGSFEELGGSNP

SEQ ID NO: 725628 - protein, 17 aa, Mycobacterium
RRHEIGVSNMLWGNDFP

SEQ ID NO: 725629 - protein, 23 aa, Mycobacterium
RRHESSTAPGAWEAIAAARFRRP

SEQ ID NO: 725630 - protein, 22 aa, Mycobacterium
RRHGKTSLARLVQRMAAEAGAV

SEQ ID NO: 725631 - protein, 17 aa, Mycobacterium
RRHGLPVPPAFCITTEV

SEQ ID NO: 725632 - protein, 18 aa, Mycobacterium
RRHGLRISLSPAPFAGAV

SEQ ID NO: 725633 - protein, 20 aa, Mycobacterium
RRHGVPFAEVEAARRTNTAQ

SEQ ID NO: 725634 - protein, 18 aa, Mycobacterium
RRHGWEVTVTPSAQLMAG

SEQ ID NO: 725635 - protein, 24 aa, Mycobacterium
RRHHLDEFVDFYLSGKPRDERVES

SEQ ID NO: 725636 - protein, 19 aa, Mycobacterium
RRHIHRYPELGRQEFATTQ

SEQ ID NO: 725637 - protein, 17 aa, Mycobacterium
RRHLAEIGLLYRAGGGS

SEQ ID NO: 725638 - protein, 18 aa, Mycobacterium
RRHLAVGPGARASLDDGA

SEQ ID NO: 725639 - protein, 18 aa, Mycobacterium
RRHLEMTPMEYLRRVRMD

SEQ ID NO: 725640 - protein, 21 aa, Mycobacterium
RRHLGGVLYLFVRGMCGAGTP

SEQ ID NO: 725641 - protein, 28 aa, Mycobacterium
RRHLNPPPPLSEWVEAIAREESRDTAHN

SEQ ID NO: 725642 - protein, 25 aa, Mycobacterium
RRHLVAGLMKIHLDIDAAVAVIRGS

SEQ ID NO: 725643 - protein, 20 aa, Mycobacterium
RRHLVAGLMTIHLDIDTAVA

SEQ ID NO: 725644 - protein, 25 aa, Mycobacterium
RRHMLADSGAQAWLGPVPAETEGLP

SEQ ID NO: 725645 - protein, 25 aa, Mycobacterium
RRHNRPEWIAVAGLAREYEEVMLLR

SEQ ID NO: 725646 - protein, 20 aa, Mycobacterium
RRHPDAVVLHLGCGLDSRAY

SEQ ID NO: 725647 - protein, 25 aa, Mycobacterium
RRHPDGLVWGHGWDESGWPERTPPG

SEQ ID NO: 725648 - protein, 17 aa, Mycobacterium
RRHPEVIAAAVYGVPDP

SEQ ID NO: 725649 - protein, 17 aa, Mycobacterium
RRHPILRTTFHADENGE

SEQ ID NO: 725650 - protein, 25 aa, Mycobacterium
RRHPNRIALRLDEIEIPYGALDAAS

SEQ ID NO: 725651 - protein, 25 aa, Mycobacterium
RRHPNRRTLLAAALETLGERPSVPA

SEQ ID NO: 725652 - protein, 19 aa, Mycobacterium
RRHPVCAVDTRPLFEPVDG

SEQ ID NO: 725653 - protein, 26 aa, Mycobacterium
RRHRSGPRLVAYVVTDASLADAAGEL

SEQ ID NO: 725654 - protein, 25 aa, Mycobacterium
RRHRWIRRAGLLAAAACAGFFRHPP

SEQ ID NO: 725655 - protein, 23 aa, Mycobacterium
RRHSDLLILPAATFVLGDTDAEA

SEQ ID NO: 725656 - protein, 20 aa, Mycobacterium
RRHSLEWIWMQSPLFRQFRG

SEQ ID NO: 725657 - protein, 20 aa, Mycobacterium
RRHSRAELLRHGVPAALVDS

SEQ ID NO: 725658 - protein, 18 aa, Mycobacterium
RRHTGLVAAHSWSDVDVS

SEQ ID NO: 725659 - protein, 25 aa, Mycobacterium
RRHVGGNGWRGDDLLLIGGPFDARA

SEQ ID NO: 725660 - protein, 19 aa, Mycobacterium
RRIAAAGDREAHRHIGTRA

SEQ ID NO: 725661 - protein, 17 aa, Mycobacterium
RRIAALEPMIRDFCAQL

SEQ ID NO: 725662 - protein, 18 aa, Mycobacterium
RRIAEALNAPGWSGQLLS

SEQ ID NO: 725663 - protein, 19 aa, Mycobacterium
RRIAEETAKAEGKPEAALP

SEQ ID NO: 725664 - protein, 19 aa, Mycobacterium
RRIAELAAQIGDDYRDVST

SEQ ID NO: 725665 - protein, 19 aa, Mycobacterium
RRIAFAYTGVDRWRPLGDY

SEQ ID NO: 725666 - protein, 25 aa, Mycobacterium
RRIAKATGKLGTWMPRAVAGAVARG

SEQ ID NO: 725667 - protein, 19 aa, Mycobacterium
RRIALMFASRGGTVRMYAR

SEQ ID NO: 725668 - protein, 21 aa, Mycobacterium
RRIAPSAAKLFCTEMAGNVAD

SEQ ID NO: 725669 - protein, 21 aa, Mycobacterium
RRIASRVNETFVIPAESPSGK

SEQ ID NO: 725670 - protein, 19 aa, Mycobacterium
RRIAYVGGPVTAACNQARL

SEQ ID NO: 725671 - protein, 19 aa, Mycobacterium
RRIAYVPGDVMLWPNLTGM

SEQ ID NO: 725672 - protein, 20 aa, Mycobacterium
RRIDAMPVGIAAWRLGAGRS

SEQ ID NO: 725673 - protein, 21 aa, Mycobacterium
RRIDDQWFRYHQLFRDFLRHR

SEQ ID NO: 725674 - protein, 19 aa, Mycobacterium
RRIDFAFIEGLATRIARPP

SEQ ID NO: 725675 - protein, 17 aa, Mycobacterium
RRIDLASGDSMGYDYVV

SEQ ID NO: 725676 - protein, 17 aa, Mycobacterium
RRIDLTLRQKAIVDASA

SEQ ID NO: 725677 - protein, 25 aa, Mycobacterium
RRIDPRNCTVLVWGAVNAGVAANAI

SEQ ID NO: 725678 - protein, 21 aa, Mycobacterium
RRIDPTLADEMRTVWTQFAHH

SEQ ID NO: 725679 - protein, 21 aa, Mycobacterium
RRIDTELGWARATGLNAVRVF

SEQ ID NO: 725680 - protein, 26 aa, Mycobacterium
RRIEAAGWSDVRWRNLTGGIVALHAA

SEQ ID NO: 725681 - protein, 19 aa, Mycobacterium
RRIEEEVIRSALQTHDGVL

SEQ ID NO: 725682 - protein, 19 aa, Mycobacterium
RRIEEEVVRAALADHDGVL

SEQ ID NO: 725683 - protein, 18 aa, Mycobacterium
RRIEELPRVLAHVHRELV

SEQ ID NO: 725684 - protein, 18 aa, Mycobacterium
RRIEGIPAGAFLEVEVEG

SEQ ID NO: 725685 - protein, 17 aa, Mycobacterium
RRIEMARTVLIELLAWQ

SEQ ID NO: 725686 - protein, 29 aa, Mycobacterium
RRIERSRLPFGRHRWVSCPGPQTELAVAT

SEQ ID NO: 725687 - protein, 31 aa, Mycobacterium
RRIESHLGPSGFMLFGLVDHGGWITKAGIER

SEQ ID NO: 725688 - protein, 17 aa, Mycobacterium
RRIEVIAADVSDPDGRA

SEQ ID NO: 725689 - protein, 19 aa, Mycobacterium
RRIGAALGPGWPRSVKSTL

SEQ ID NO: 725690 - protein, 19 aa, Mycobacterium
RRIGFPVIVKTVADVLHAA

SEQ ID NO: 725691 - protein, 25 aa, Mycobacterium
RRIGHYRWFAAIFKRVGTPVDRALI

SEQ ID NO: 725692 - protein, 27 aa, Mycobacterium
RRIGLAASKYWVCKRATPHAAEALECL

SEQ ID NO: 725693 - protein, 22 aa, Mycobacterium
RRIGLAASKYWVCKRATPHAGE

SEQ ID NO: 725694 - protein, 21 aa, Mycobacterium
RRIGLAASKYWVCKRSTPHAA

SEQ ID NO: 725695 - protein, 19 aa, Mycobacterium
RRIGMDGSTLVRTLSDDAP

SEQ ID NO: 725696 - protein, 25 aa, Mycobacterium
RRIGPAPWKSLLGMTGPTTLPIEVT

SEQ ID NO: 725697 - protein, 25 aa, Mycobacterium
RRIGPPWRDGQSVIWQSVNRNKRSL

SEQ ID NO: 725698 - protein, 23 aa, Mycobacterium
RRIHAEGGVLVLADRSELVKELA

SEQ ID NO: 725699 - protein, 25 aa, Mycobacterium
RRIHAELTLGMGITVCSRTVSVLMT

SEQ ID NO: 725700 - protein, 17 aa, Mycobacterium
RRIHLEVFQSLSGDPFA

SEQ ID NO: 725701 - protein, 24 aa, Mycobacterium
RRIIGVRVTRRWGPARIAYLLRLN

SEQ ID NO: 725702 - protein, 19 aa, Mycobacterium
RRIIPPWTTLGSRLASMPK

SEQ ID NO: 725703 - protein, 18 aa, Mycobacterium
RRIIRAAKLLGVEQPIMG

SEQ ID NO: 725704 - protein, 18 aa, Mycobacterium
RRIIRAAKLLGVEQPVMG

SEQ ID NO: 725705 - protein, 18 aa, Mycobacterium
RRIKELKVGTTRRFSSTT

SEQ ID NO: 725706 - protein, 18 aa, Mycobacterium
RRIKGAVVANQLSRLGGY

SEQ ID NO: 725707 - protein, 42 aa, Mycobacterium
RRIKPLPPRLCQALWMGPCVEYARLWLARSADFDMLAAAPVL

SEQ ID NO: 725708 - protein, 19 aa, Mycobacterium
RRILAEANHPLVIQAETMD

SEQ ID NO: 725709 - protein, 20 aa, Mycobacterium
RRILDAAGRCIVHRGNTQFR

SEQ ID NO: 725710 - protein, 20 aa, Mycobacterium
RRILDAAGRCIVRRGNTQFR

SEQ ID NO: 725711 - protein, 20 aa, Mycobacterium
RRILDARLMWVWLATHEYFM

SEQ ID NO: 725712 - protein, 26 aa, Mycobacterium
RRILFSLPCYHMFGYIEGLLSAMFVG

SEQ ID NO: 725713 - protein, 17 aa, Mycobacterium
RRILPRVRARVEAPNGN

SEQ ID NO: 725714 - protein, 25 aa, Mycobacterium
RRINILRGDEMPFFNPNGMPYDNCA

SEQ ID NO: 725715 - protein, 21 aa, Mycobacterium
RRINSCLTLAVMHEGAQITTI

SEQ ID NO: 725716 - protein, 29 aa, Mycobacterium
RRINVAAAPLLKRVALELGGNNASIVLAD

SEQ ID NO: 725717 - protein, 28 aa, Mycobacterium
RRIPLPTYAFVRRRFWLSSDSVGSANIA

SEQ ID NO: 725718 - protein, 20 aa, Mycobacterium
RRIPRNPCEGIKLPKRKHAD

SEQ ID NO: 725719 - protein, 19 aa, Mycobacterium
RRIPTLRLAIPLEEVPFKH

SEQ ID NO: 725720 - protein, 17 aa, Mycobacterium
RRIPWFGPDMSVASCAT

SEQ ID NO: 725721 - protein, 21 aa, Mycobacterium
RRIQIGTSIAVAFARNPMTVA

SEQ ID NO: 725722 - protein, 18 aa, Mycobacterium
RRIRAFLNSCRHRGARVC

SEQ ID NO: 725723 - protein, 23 aa, Mycobacterium
RRIRLAIEPEPGCVIGSCRDAIE

SEQ ID NO: 725724 - protein, 19 aa, Mycobacterium
RRIRLKVPLVSSAMDTVTE

SEQ ID NO: 725725 - protein, 17 aa, Mycobacterium
RRIRSHGLVTASIAAAV

SEQ ID NO: 725726 - protein, 18 aa, Mycobacterium
RRIRVNVLTPGQVATPIQ

SEQ ID NO: 725727 - protein, 17 aa, Mycobacterium
RRISHVDARTSYAELSE

SEQ ID NO: 725728 - protein, 20 aa, Mycobacterium
RRITEAELLTAMTPEEIFSE

SEQ ID NO: 725729 - protein, 19 aa, Mycobacterium
RRITGWVAALGSSVAETEI

SEQ ID NO: 725730 - protein, 20 aa, Mycobacterium
RRITNSPARPAGPLTQDQIK

SEQ ID NO: 725731 - protein, 19 aa, Mycobacterium
RRIVDDLGARVQLARRRWS

SEQ ID NO: 725732 - protein, 26 aa, Mycobacterium
RRIVRWPRQVLAEFGLILPEDVEIRV

SEQ ID NO: 725733 - protein, 19 aa, Mycobacterium
RRIWEQCMGVSSIDRNANF

SEQ ID NO: 725734 - protein, 17 aa, Mycobacterium
RRIWLLDRMSGGGKELC

SEQ ID NO: 725735 - protein, 18 aa, Mycobacterium
RRIYACYDAGRVINPKLA

SEQ ID NO: 725736 - protein, 26 aa, Mycobacterium
RRIYRIGFGAARRARRGRAQRVPLIR

SEQ ID NO: 725737 - protein, 21 aa, Mycobacterium
RRKALPESRWVIVENAVDESS

SEQ ID NO: 725738 - protein, 19 aa, Mycobacterium
RRKAMEELHRIRKDGEAGE

SEQ ID NO: 725739 - protein, 28 aa, Mycobacterium
RRKARVRGWRPFGMIPFNSSAKKCLELA

SEQ ID NO: 725740 - protein, 20 aa, Mycobacterium
RRKAVELMERVGIPQPESRL

SEQ ID NO: 725741 - protein, 22 aa, Mycobacterium
RRKDLLPLISFLTRSHAEIITE

SEQ ID NO: 725742 - protein, 28 aa, Mycobacterium
RRKDRRQSLAQSWRCHIGPPRQLSADSP

SEQ ID NO: 725743 - protein, 21 aa, Mycobacterium
RRKEMLHNSALRGEHMKGHAA

SEQ ID NO: 725744 - protein, 21 aa, Mycobacterium
RRKEMLHNSALRGEHMKGHAT

SEQ ID NO: 725745 - protein, 18 aa, Mycobacterium
RRKGIRIVAEAAIAQTAQ

SEQ ID NO: 725746 - protein, 22 aa, Mycobacterium
RRKGRFGFATIYPARAVMGPGD

SEQ ID NO: 725747 - protein, 19 aa, Mycobacterium
RRKIAERGLARPAAGAPAA

SEQ ID NO: 725748 - protein, 18 aa, Mycobacterium
RRKLGDLPAAPLTETSMA

SEQ ID NO: 725749 - protein, 19 aa, Mycobacterium
RRKLLVPPFHGRRMAGYET

SEQ ID NO: 725750 - protein, 25 aa, Mycobacterium
RRKLTPHYRIGCKRILNSSSYYPAV

SEQ ID NO: 725751 - protein, 25 aa, Mycobacterium
RRKLTPHYRIGCKRILNSSTYYPAV

SEQ ID NO: 725752 - protein, 26 aa, Mycobacterium
RRKLTPHYRIGCKRILNSTTYYRAVA

SEQ ID NO: 725753 - protein, 19 aa, Mycobacterium
RRKLVNAGFTRKRVKDKER

SEQ ID NO: 725754 - protein, 18 aa, Mycobacterium
RRKLVNAGFTRKRVKDRE

SEQ ID NO: 725755 - protein, 19 aa, Mycobacterium
RRKLVNAGFTRKRVKDREA

SEQ ID NO: 725756 - protein, 19 aa, Mycobacterium
RRKLVNAGFTRKRVMDKVD

SEQ ID NO: 725757 - protein, 19 aa, Mycobacterium
RRKPFPVGPGYLIDGKPVI

SEQ ID NO: 725758 - protein, 20 aa, Mycobacterium
RRKPHSWLRQVLPDPQYAPG

SEQ ID NO: 725759 - protein, 18 aa, Mycobacterium
RRKQICGRAYKTLTEEVG

SEQ ID NO: 725760 - protein, 17 aa, Mycobacterium
RRKRPGSIVSLSSISGL

SEQ ID NO: 725761 - protein, 19 aa, Mycobacterium
RRKRWTVPRLYRALRQPKP

SEQ ID NO: 725762 - protein, 20 aa, Mycobacterium
RRKVDPCGVFASDMARRLEL

SEQ ID NO: 725763 - protein, 27 aa, Mycobacterium
RRKWGPAVAALARWSGDLTVAEDAVQE

SEQ ID NO: 725764 - protein, 18 aa, Mycobacterium
RRKYPVFRPNRCEPKDAR

SEQ ID NO: 725765 - protein, 18 aa, Mycobacterium
RRLAARGAPTIAVAAHPG

SEQ ID NO: 725766 - protein, 21 aa, Mycobacterium
RRLAARVDETFVIPAENPSGR

SEQ ID NO: 725767 - protein, 24 aa, Mycobacterium
RRLAAWCRSSASGDWAQFESRLAR

SEQ ID NO: 725768 - protein, 20 aa, Mycobacterium
RRLADAHGLVIDRAAFAPTP

SEQ ID NO: 725769 - protein, 22 aa, Mycobacterium
RRLAEKLWNLRILAEERSAADA

SEQ ID NO: 725770 - protein, 22 aa, Mycobacterium
RRLAEKLWYLRILTDEKSASDL

SEQ ID NO: 725771 - protein, 18 aa, Mycobacterium
RRLAELAGDLAGRAVPFY

SEQ ID NO: 725772 - protein, 17 aa, Mycobacterium
RRLAELLGRGADGPRVL

SEQ ID NO: 725773 - protein, 18 aa, Mycobacterium
RRLAELPSALTPDLHRQL

SEQ ID NO: 725774 - protein, 17 aa, Mycobacterium
RRLAEPGPYSMAEVLAP

SEQ ID NO: 725775 - protein, 17 aa, Mycobacterium
RRLAEPGPYSMVEVLAP

SEQ ID NO: 725776 - protein, 21 aa, Mycobacterium
RRLAERPANLTFFLRALAQRG

SEQ ID NO: 725777 - protein, 18 aa, Mycobacterium
RRLAEVLGVSRPVVREAL

SEQ ID NO: 725778 - protein, 19 aa, Mycobacterium
RRLAGRPVSHIVLTHKHFD

SEQ ID NO: 725779 - protein, 18 aa, Mycobacterium
RRLAGVGHHMRVYVPFGE

SEQ ID NO: 725780 - protein, 27 aa, Mycobacterium
RRLAIPELPDELFIESLCQLIAVDNAW

SEQ ID NO: 725781 - protein, 26 aa, Mycobacterium
RRLAIPELPDELFIESLRQLIAVDEK

SEQ ID NO: 725782 - protein, 21 aa, Mycobacterium
RRLAIPELPEEVFIESLRQLI

SEQ ID NO: 725783 - protein, 17 aa, Mycobacterium
RRLALTGTPFRSDDSPI

SEQ ID NO: 725784 - protein, 19 aa, Mycobacterium
RRLANLGVRTLLPTYNNAN

SEQ ID NO: 725785 - protein, 21 aa, Mycobacterium
RRLAPEPILHAALAPGALIAE

SEQ ID NO: 725786 - protein, 19 aa, Mycobacterium
RRLAPRARITVGPDRLELA

SEQ ID NO: 725787 - protein, 25 aa, Mycobacterium
RRLAPRLDGGGARLARVVAGARPEV

SEQ ID NO: 725788 - protein, 21 aa, Mycobacterium
RRLARECPVDADLVIGVPESG

SEQ ID NO: 725789 - protein, 17 aa, Mycobacterium
RRLAREEALLVGGSCGM

SEQ ID NO: 725790 - protein, 18 aa, Mycobacterium
RRLAREEGLLVGISSGAA

SEQ ID NO: 725791 - protein, 17 aa, Mycobacterium
RRLARILRRRHAPVDIT

SEQ ID NO: 725792 - protein, 24 aa, Mycobacterium
RRLARLHTPLPVLAFTALPEVRSQ

SEQ ID NO: 725793 - protein, 25 aa, Mycobacterium
RRLARLRGATLLAHNYQLPAIQDVA

SEQ ID NO: 725794 - protein, 22 aa, Mycobacterium
RRLASICTGTFILATAGLLAGR

SEQ ID NO: 725795 - protein, 17 aa, Mycobacterium
RRLAVTYLDALSAATGL

SEQ ID NO: 725796 - protein, 26 aa, Mycobacterium
RRLAYPRLQFSPLHSWVTDEDFDFDY

SEQ ID NO: 725797 - protein, 24 aa, Mycobacterium
RRLCPHAVVVPPRMSAYSRASDAV

SEQ ID NO: 725798 - protein, 20 aa, Mycobacterium
RRLDAELGLEPGPELRDLQT

SEQ ID NO: 725799 - protein, 19 aa, Mycobacterium
RRLDGHFTLVFANADDPGT

SEQ ID NO: 725800 - protein, 24 aa, Mycobacterium
RRLDRKATLAFAFSHRSYLDGLLL

SEQ ID NO: 725801 - protein, 23 aa, Mycobacterium
RRLDRSAGELIGLVVDALVAVAV

SEQ ID NO: 725802 - protein, 19 aa, Mycobacterium
RRLEESRELIAAKLGARPS

SEQ ID NO: 725803 - protein, 24 aa, Mycobacterium
RRLEFLRGHHVVVLGLPRGGVPVA

SEQ ID NO: 725804 - protein, 23 aa, Mycobacterium
RRLELLAELGWIVIRVVAEDGTA

SEQ ID NO: 725805 - protein, 17 aa, Mycobacterium
RRLELPLDEIARLLDEG

SEQ ID NO: 725806 - protein, 17 aa, Mycobacterium
RRLEPFVDLIADELNVK

SEQ ID NO: 725807 - protein, 20 aa, Mycobacterium
RRLEVVALTPARLLLIVITD

SEQ ID NO: 725808 - protein, 31 aa, Mycobacterium
RRLFAAAYRPGWRLSGFTGHCAVSHRRRDTG

SEQ ID NO: 725809 - protein, 21 aa, Mycobacterium
RRLFAGGGFGRGRYSGGGGGF

SEQ ID NO: 725810 - protein, 21 aa, Mycobacterium
RRLFRQFSFPGGIPSHVAAQT

SEQ ID NO: 725811 - protein, 20 aa, Mycobacterium
RRLGAPLAQELSAYLRTLEA

SEQ ID NO: 725812 - protein, 26 aa, Mycobacterium
RRLGEVPEPFSVVAHHRRLLVANAVH

SEQ ID NO: 725813 - protein, 24 aa, Mycobacterium
RRLGHERSNGCSYADSPHHVPIQR

SEQ ID NO: 725814 - protein, 21 aa, Mycobacterium
RRLGIPLAQELSAYLRGLDPV

SEQ ID NO: 725815 - protein, 21 aa, Mycobacterium
RRLGLDRIPLYQIHQSNPVVP

SEQ ID NO: 725816 - protein, 19 aa, Mycobacterium
RRLGLPLAQQLSAYLRSLD

SEQ ID NO: 725817 - protein, 28 aa, Mycobacterium
RRLGPKRARLLNPLALLASQGVPLAFGS

SEQ ID NO: 725818 - protein, 26 aa, Mycobacterium
RRLGRRSNVYVVEWQNVHGLTPSGLA

SEQ ID NO: 725819 - protein, 18 aa, Mycobacterium
RRLGRTGLDLTLEAVLRA

SEQ ID NO: 725820 - protein, 19 aa, Mycobacterium
RRLGTLVERVGAQRISISE

SEQ ID NO: 725821 - protein, 19 aa, Mycobacterium
RRLGTNWYDPSLRFLDDVS

SEQ ID NO: 725822 - protein, 17 aa, Mycobacterium
RRLGVLVDHLVAGSKEA

SEQ ID NO: 725823 - protein, 19 aa, Mycobacterium
RRLHEMRDLLAYMEKVLAG

SEQ ID NO: 725824 - protein, 23 aa, Mycobacterium
RRLHKRLRRRGRILQSAPDAETQ

SEQ ID NO: 725825 - protein, 19 aa, Mycobacterium
RRLHLRRLRHLELGTHHRE

SEQ ID NO: 725826 - protein, 21 aa, Mycobacterium
RRLIAEFKASLMTRLMPGASV

SEQ ID NO: 725827 - protein, 24 aa, Mycobacterium
RRLIDGRWVRWDADRAAGAYAHRW

SEQ ID NO: 725828 - protein, 24 aa, Mycobacterium
RRLIECGRLPGGAKLTLASLSDEL

SEQ ID NO: 725829 - protein, 26 aa, Mycobacterium
RRLIGWLHRIIDAFATDADTTLRDIA

SEQ ID NO: 725830 - protein, 24 aa, Mycobacterium
RRLIKVLRKRGRILQSAPDVAKPS

SEQ ID NO: 725831 - protein, 24 aa, Mycobacterium
RRLIKVLRKRGRILQSAPNVAKAQ

SEQ ID NO: 725832 - protein, 24 aa, Mycobacterium
RRLIKVLRKRGRILQSAPNVDKPA

SEQ ID NO: 725833 - protein, 17 aa, Mycobacterium
RRLILIYAPSGYGKSTL

SEQ ID NO: 725834 - protein, 21 aa, Mycobacterium
RRLIPGYVVTPAIKLLSDELV

SEQ ID NO: 725835 - protein, 24 aa, Mycobacterium
RRLKDACPHVHLLIVDDSSPDGTG

SEQ ID NO: 725836 - protein, 19 aa, Mycobacterium
RRLKEAGAVIVGKTNTCEL

SEQ ID NO: 725837 - protein, 22 aa, Mycobacterium
RRLKQKTDLRMVVVDYLQLMTS

SEQ ID NO: 725838 - protein, 17 aa, Mycobacterium
RRLKTNTILSVGEHSVR

SEQ ID NO: 725839 - protein, 21 aa, Mycobacterium
RRLLADDGWLSIEVHHALNLV

SEQ ID NO: 725840 - protein, 20 aa, Mycobacterium
RRLLDLALNIGCDFSIDTDA

SEQ ID NO: 725841 - protein, 21 aa, Mycobacterium
RRLLERFCRDADRFGLSMGGS

SEQ ID NO: 725842 - protein, 19 aa, Mycobacterium
RRLLFERFGQLITRHLEHT

SEQ ID NO: 725843 - protein, 23 aa, Mycobacterium
RRLLKRVHGGAVPLETAAFESGV

SEQ ID NO: 725844 - protein, 18 aa, Mycobacterium
RRLLKYVAQVDVARYRSL

SEQ ID NO: 725845 - protein, 20 aa, Mycobacterium
RRLLLATADARRHGCANSVA

SEQ ID NO: 725846 - protein, 17 aa, Mycobacterium
RRLLLGMLAELPAGAGV

SEQ ID NO: 725847 - protein, 17 aa, Mycobacterium
RRLLMMIGKDLGLDTKR

SEQ ID NO: 725848 - protein, 20 aa, Mycobacterium
RRLLMPAFHRDAVARQATQM

SEQ ID NO: 725849 - protein, 20 aa, Mycobacterium
RRLLNGEVIDFVELDMPEQV

SEQ ID NO: 725850 - protein, 19 aa, Mycobacterium
RRLLRLCERYSANGATPTV

SEQ ID NO: 725851 - protein, 18 aa, Mycobacterium
RRLLTGDVADAWSIAHPF

SEQ ID NO: 725852 - protein, 19 aa, Mycobacterium
RRLLVKRYGAAVLGPYTSK

SEQ ID NO: 725853 - protein, 20 aa, Mycobacterium
RRLNAQHGKTFFLATRLLTP

SEQ ID NO: 725854 - protein, 19 aa, Mycobacterium
RRLNPRPLIDGMIRMADGG

SEQ ID NO: 725855 - protein, 20 aa, Mycobacterium
RRLNRKGVHHIVRTTNQRGG

SEQ ID NO: 725856 - protein, 18 aa, Mycobacterium
RRLNWNLAASPTRTFDIS

SEQ ID NO: 725857 - protein, 19 aa, Mycobacterium
RRLPAERRQALIATRDDIG

SEQ ID NO: 725858 - protein, 19 aa, Mycobacterium
RRLPAGDIFVFGENLTDFQ

SEQ ID NO: 725859 - protein, 17 aa, Mycobacterium
RRLPALVSDAHHETRVH

SEQ ID NO: 725860 - protein, 23 aa, Mycobacterium
RRLPDGEPVEWWIVGGRLSADPV

SEQ ID NO: 725861 - protein, 20 aa, Mycobacterium
RRLPDLRLASSDALPLRPAN

SEQ ID NO: 725862 - protein, 23 aa, Mycobacterium
RRLPEGLAGIGRLHELIAEHAED

SEQ ID NO: 725863 - protein, 24 aa, Mycobacterium
RRLPEGRRYGVVAGTARFLEALTQ

SEQ ID NO: 725864 - protein, 20 aa, Mycobacterium
RRLPEPGGEQCRLAHLGGDD

SEQ ID NO: 725865 - protein, 17 aa, Mycobacterium
RRLPETVGVAAVPVSAF

SEQ ID NO: 725866 - protein, 18 aa, Mycobacterium
RRLPGLKLAVPPEELRFK

SEQ ID NO: 725867 - protein, 18 aa, Mycobacterium
RRLPGMLTGGGLRPRDVV

SEQ ID NO: 725868 - protein, 20 aa, Mycobacterium
RRLPGYMVPAAVVVLDALPL

SEQ ID NO: 725869 - protein, 23 aa, Mycobacterium
RRLPKNLPWDIPGRDQLEQALQN

SEQ ID NO: 725870 - protein, 18 aa, Mycobacterium
RRLPLVMRPLAWLPQPDP

SEQ ID NO: 725871 - protein, 17 aa, Mycobacterium
RRLPPDFVDSGAVQRGD

SEQ ID NO: 725872 - protein, 20 aa, Mycobacterium
RRLPPGALRAAYWKAAHDGL

SEQ ID NO: 725873 - protein, 20 aa, Mycobacterium
RRLPPGRRYGVVAGTGRLLE

SEQ ID NO: 725874 - protein, 18 aa, Mycobacterium
RRLPRSRALAHLDALAGI

SEQ ID NO: 725875 - protein, 17 aa, Mycobacterium
RRLPSMYHQFMELAGVD

SEQ ID NO: 725876 - protein, 19 aa, Mycobacterium
RRLQLRLMRGANFAIARKA

SEQ ID NO: 725877 - protein, 20 aa, Mycobacterium
RRLQNKAARVFEEEWSHFAA

SEQ ID NO: 725878 - protein, 24 aa, Mycobacterium
RRLQPTMCVRGWFPDGQQLHQRGY

SEQ ID NO: 725879 - protein, 20 aa, Mycobacterium
RRLQSGSVWINQGSRISPQG

SEQ ID NO: 725880 - protein, 20 aa, Mycobacterium
RRLRAFGARVLVFDPYVDAE

SEQ ID NO: 725881 - protein, 24 aa, Mycobacterium
RRLRAKARLKFLVKDWGVEKFREV

SEQ ID NO: 725882 - protein, 22 aa, Mycobacterium
RRLRAKLGPEYEALIGTVRNVG

SEQ ID NO: 725883 - protein, 21 aa, Mycobacterium
RRLRATPAIRRLVAETTLAPR

SEQ ID NO: 725884 - protein, 17 aa, Mycobacterium
RRLRCCRSRCPRCRRAI

SEQ ID NO: 725885 - protein, 23 aa, Mycobacterium
RRLRDACPHVHLLIVDDSSPDGT

SEQ ID NO: 725886 - protein, 19 aa, Mycobacterium
RRLRGLVSRAFTPRASARM

SEQ ID NO: 725887 - protein, 23 aa, Mycobacterium
RRLRGWVNGCCRVVHPRHDRPLH

SEQ ID NO: 725888 - protein, 22 aa, Mycobacterium
RRLRLDVLAQRDFRRPFDLSKD

SEQ ID NO: 725889 - protein, 22 aa, Mycobacterium
RRLRLPAPDWQVLLAVPADLAG

SEQ ID NO: 725890 - protein, 17 aa, Mycobacterium
RRLRPPTRDPARRARTD

SEQ ID NO: 725891 - protein, 21 aa, Mycobacterium
RRLRRQLACALGQLRDDTGRH

SEQ ID NO: 725892 - protein, 26 aa, Mycobacterium
RRLRSKARLKFLIKDWGVEKFREVLE

SEQ ID NO: 725893 - protein, 26 aa, Mycobacterium
RRLRSKARLKFLVKDWGVAKFREILE

SEQ ID NO: 725894 - protein, 25 aa, Mycobacterium
RRLRSKARLKFLVKDWGVEKFREVL

SEQ ID NO: 725895 - protein, 25 aa, Mycobacterium
RRLRSMRWGLIPPWVKATEDGSPEN

SEQ ID NO: 725896 - protein, 24 aa, Mycobacterium
RRLRSTPALRRLVAQTSLEPRHLV

SEQ ID NO: 725897 - protein, 19 aa, Mycobacterium
RRLRTGGRIIPEMSVRLFD

SEQ ID NO: 725898 - protein, 24 aa, Mycobacterium
RRLRTTPAMRRLVAQTSLEPRHLI

SEQ ID NO: 725899 - protein, 23 aa, Mycobacterium
RRLRTTPAMRRLVSETSLEPRHL

SEQ ID NO: 725900 - protein, 19 aa, Mycobacterium
RRLSASGAEVVMAIRNRAK

SEQ ID NO: 725901 - protein, 17 aa, Mycobacterium
RRLSDLAARGEVLDSCL

SEQ ID NO: 725902 - protein, 21 aa, Mycobacterium
RRLSGVTALHGGWRYPEPLAP

SEQ ID NO: 725903 - protein, 22 aa, Mycobacterium
RRLSHHRGRVRLAVRTSDGDAD

SEQ ID NO: 725904 - protein, 29 aa, Mycobacterium
RRLSSLVGHGRASAMLLTAEKLTPEVALQ

SEQ ID NO: 725905 - protein, 22 aa, Mycobacterium
RRLSTALAGFAIITGAAAGCGT

SEQ ID NO: 725906 - protein, 23 aa, Mycobacterium
RRLSTEELLVFLGVIANAGTETV

SEQ ID NO: 725907 - protein, 20 aa, Mycobacterium
RRLTFSGSRVTGVEFSHANA

SEQ ID NO: 725908 - protein, 20 aa, Mycobacterium
RRLTGRVVVFGGDMSTQIAQ

SEQ ID NO: 725909 - protein, 17 aa, Mycobacterium
RRLTGTVAQVFGDRLVS

SEQ ID NO: 725910 - protein, 17 aa, Mycobacterium
RRLTGTVSPVFGDRLVS

SEQ ID NO: 725911 - protein, 19 aa, Mycobacterium
RRLTNKWSAHFVLTPQERA

SEQ ID NO: 725912 - protein, 23 aa, Mycobacterium
RRLTSELPLPVNAIAVPDVDDPA

SEQ ID NO: 725913 - protein, 24 aa, Mycobacterium
RRLVAELPSAPGFSEQRPLTGDAH

SEQ ID NO: 725914 - protein, 23 aa, Mycobacterium
RRLVEQYSQWPAWTSLTPEVAGD

SEQ ID NO: 725915 - protein, 17 aa, Mycobacterium
RRLVEYYLAVGRGPMLA

SEQ ID NO: 725916 - protein, 17 aa, Mycobacterium
RRLVFEVTPTLDRAISA

SEQ ID NO: 725917 - protein, 18 aa, Mycobacterium
RRLVGLFCQQGHFDRTKA

SEQ ID NO: 725918 - protein, 19 aa, Mycobacterium
RRLVGLFCQQGHFDRTKAE

SEQ ID NO: 725919 - protein, 35 aa, Mycobacterium
RRLVKRLRGRPAIARRYLALEGHRVLAELAPTVAL

SEQ ID NO: 725920 - protein, 21 aa, Mycobacterium
RRLVLAEARLAAYTRELGEEP

SEQ ID NO: 725921 - protein, 19 aa, Mycobacterium
RRLVLGIGNGTKRMMSDWH

SEQ ID NO: 725922 - protein, 19 aa, Mycobacterium
RRLVLPWALQGIEPVGEVL

SEQ ID NO: 725923 - protein, 25 aa, Mycobacterium
RRLVLSFEYRTLWAEAVPGRVWRRG

SEQ ID NO: 725924 - protein, 19 aa, Mycobacterium
RRLVPPWVTLGLRIALLPR

SEQ ID NO: 725925 - protein, 26 aa, Mycobacterium
RRLVRWPRQVLAEFGLYLPDDVEVRV

SEQ ID NO: 725926 - protein, 27 aa, Mycobacterium
RRLVTGEILWAPAIDGAFVLTCRGGDF

SEQ ID NO: 725927 - protein, 17 aa, Mycobacterium
RRLVTRVPRGWSMAQAA

SEQ ID NO: 725928 - protein, 22 aa, Mycobacterium
RRLYALAPRLGHLLTVGVHPVE

SEQ ID NO: 725929 - protein, 24 aa, Mycobacterium
RRLYERFEPVHGIVYFAPEARAAV

SEQ ID NO: 725930 - protein, 20 aa, Mycobacterium
RRLYGVPVVVSLAQAEGVAH

SEQ ID NO: 725931 - protein, 24 aa, Mycobacterium
RRLYGVSDVEEFARTSAKHLRAAV

SEQ ID NO: 725932 - protein, 19 aa, Mycobacterium
RRLYPGGMSEYLRRFTAAL

SEQ ID NO: 725933 - protein, 17 aa, Mycobacterium
RRMAQLFPDASIIEVPG

SEQ ID NO: 725934 - protein, 25 aa, Mycobacterium
RRMEKEIADVIALQEKLGLDVLVHG

SEQ ID NO: 725935 - protein, 33 aa, Mycobacterium
RRMGKDGKLGVGWPKEFGGLGFGPIEQQIFVNE

SEQ ID NO: 725936 - protein, 17 aa, Mycobacterium
RRMGRAEFVRADIRNPF

SEQ ID NO: 725937 - protein, 19 aa, Mycobacterium
RRMGRAEFVRADIRNPFIA

SEQ ID NO: 725938 - protein, 34 aa, Mycobacterium
RRMGRDRKLGVGWPKEFGGLGFGPIEQSIFVNEA

SEQ ID NO: 725939 - protein, 17 aa, Mycobacterium
RRMGSGLMHLHLCDGSG

SEQ ID NO: 725940 - protein, 19 aa, Mycobacterium
RRMGVPVVPNTVFVAFGEV

SEQ ID NO: 725941 - protein, 24 aa, Mycobacterium
RRMLAADCWLVLGERHVAEYASRL

SEQ ID NO: 725942 - protein, 19 aa, Mycobacterium
RRMLPEIKPSSYPESYGIT

SEQ ID NO: 725943 - protein, 18 aa, Mycobacterium
RRMLRLIRRYGPIMTMPI

SEQ ID NO: 725944 - protein, 19 aa, Mycobacterium
RRMMPEIRPTNGPFPSTVD

SEQ ID NO: 725945 - protein, 19 aa, Mycobacterium
RRMPSRIQVLAVLEPVNGH

SEQ ID NO: 725946 - protein, 22 aa, Mycobacterium
RRMPWTEVDTSYRFEGPDGAVS

SEQ ID NO: 725947 - protein, 17 aa, Mycobacterium
RRMPYTVGLLGSVPRLN

SEQ ID NO: 725948 - protein, 20 aa, Mycobacterium
RRMRARNVWTPVLMLTAKDG

SEQ ID NO: 725949 - protein, 21 aa, Mycobacterium
RRMSRVLPLMRERLERLCTGP

SEQ ID NO: 725950 - protein, 18 aa, Mycobacterium
RRMSWIFNLVDVIIAPTT

SEQ ID NO: 725951 - protein, 19 aa, Mycobacterium
RRMTIHFYSQMFDDILEAS

SEQ ID NO: 725952 - protein, 19 aa, Mycobacterium
RRMTTGIVTPGREDAMAAD

SEQ ID NO: 725953 - protein, 25 aa, Mycobacterium
RRMVFGTCIANIWARPAQTMHAAAA

SEQ ID NO: 725954 - protein, 17 aa, Mycobacterium
RRMWRNEIASAIVEFTS

SEQ ID NO: 725955 - protein, 19 aa, Mycobacterium
RRMYRDIYIPAGYTPTLID

SEQ ID NO: 725956 - protein, 18 aa, Mycobacterium
RRMYRSGDLVRWLPDGQL

SEQ ID NO: 725957 - protein, 18 aa, Mycobacterium
RRNAEEFRAKAGVTNVEF

SEQ ID NO: 725958 - protein, 19 aa, Mycobacterium
RRNAFDAIGGFDERYFMYM

SEQ ID NO: 725959 - protein, 20 aa, Mycobacterium
RRNARGELEFVGRADEQVKV

SEQ ID NO: 725960 - protein, 26 aa, Mycobacterium
RRNEVRAGAPARVRLGDRWVDGPVEL

SEQ ID NO: 725961 - protein, 21 aa, Mycobacterium
RRNGDKLALAKAMVLRRDPDR

SEQ ID NO: 725962 - protein, 21 aa, Mycobacterium
RRNGDKLSFAKGMVMRRDPDR

SEQ ID NO: 725963 - protein, 17 aa, Mycobacterium
RRNGFVIALTYGTSSDW

SEQ ID NO: 725964 - protein, 21 aa, Mycobacterium
RRNGGLYADWYFSNGKDFDGF

SEQ ID NO: 725965 - protein, 21 aa, Mycobacterium
RRNGGLYSDWYFSNGKDFAGI

SEQ ID NO: 725966 - protein, 18 aa, Mycobacterium
RRNGICRDMREVLAGIRA

SEQ ID NO: 725967 - protein, 17 aa, Mycobacterium
RRNGRVLVGPVTWAVEL

SEQ ID NO: 725968 - protein, 17 aa, Mycobacterium
RRNGWKGFGPVPYSHEP

SEQ ID NO: 725969 - protein, 22 aa, Mycobacterium
RRNIRFGTAVTRAEWVDEPGQS

SEQ ID NO: 725970 - protein, 19 aa, Mycobacterium
RRNMICRDMRQVLAGIRSL

SEQ ID NO: 725971 - protein, 22 aa, Mycobacterium
RRNPGAVVRYIMSRLDDPTPNT

SEQ ID NO: 725972 - protein, 21 aa, Mycobacterium
RRNRGPVRCRICNKELTTPAA

SEQ ID NO: 725973 - protein, 19 aa, Mycobacterium
RRNRHPVLAVIRGSAVNQD

SEQ ID NO: 725974 - protein, 19 aa, Mycobacterium
RRNVGVLGVAWGEYLNRVP

SEQ ID NO: 725975 - protein, 17 aa, Mycobacterium
RRNVKIIGLSTDPLDSH

SEQ ID NO: 725976 - protein, 17 aa, Mycobacterium
RRNVTEITGRFRREDVD

SEQ ID NO: 725977 - protein, 18 aa, Mycobacterium
RRPAEALVGEFLDTYAET

SEQ ID NO: 725978 - protein, 18 aa, Mycobacterium
RRPAEPRARTMFLEVRAQ

SEQ ID NO: 725979 - protein, 21 aa, Mycobacterium
RRPAHDAARYDQVWKEHVLPL

SEQ ID NO: 725980 - protein, 18 aa, Mycobacterium
RRPAIVAGASSGIGEATA

SEQ ID NO: 725981 - protein, 21 aa, Mycobacterium
RRPAKGVAVHDCSCRRARQQG

SEQ ID NO: 725982 - protein, 18 aa, Mycobacterium
RRPALVAGASSGIGEATA

SEQ ID NO: 725983 - protein, 18 aa, Mycobacterium
RRPALVAHSVARRAAQTA

SEQ ID NO: 725984 - protein, 19 aa, Mycobacterium
RRPALVPVDAVEFLTGDVQ

SEQ ID NO: 725985 - protein, 19 aa, Mycobacterium
RRPARVELPGYPFERQRYW

SEQ ID NO: 725986 - protein, 21 aa, Mycobacterium
RRPASLHGFVPFPPDRETAYR

SEQ ID NO: 725987 - protein, 24 aa, Mycobacterium
RRPAVWEPGEYLVIDWAQAAPGLF

SEQ ID NO: 725988 - protein, 21 aa, Mycobacterium
RRPDAAYALHVFSTLGPAGTF

SEQ ID NO: 725989 - protein, 21 aa, Mycobacterium
RRPDADRGWLARACEHEPSRM

SEQ ID NO: 725990 - protein, 17 aa, Mycobacterium
RRPDAVVLHLGCGLDGR

SEQ ID NO: 725991 - protein, 17 aa, Mycobacterium
RRPDPALLKQLFGTIWG

SEQ ID NO: 725992 - protein, 21 aa, Mycobacterium
RRPDPRSPVLVGIDGSPASED

SEQ ID NO: 725993 - protein, 25 aa, Mycobacterium
RRPDRPGVEHLLRYGATDRVLLSGT

SEQ ID NO: 725994 - protein, 21 aa, Mycobacterium
RRPDVAVTILRLANLIGPGMD

SEQ ID NO: 725995 - protein, 24 aa, Mycobacterium
RRPEHYYRALALAVRDRMQDRRVV

SEQ ID NO: 725996 - protein, 20 aa, Mycobacterium
RRPELIKSMLRKAATKQLPP

SEQ ID NO: 725997 - protein, 22 aa, Mycobacterium
RRPELVDVPGAHVLRLDITDQW

SEQ ID NO: 725998 - protein, 20 aa, Mycobacterium
RRPEMPALLAELGLSGLQRS

SEQ ID NO: 725999 - protein, 24 aa, Mycobacterium
RRPEPGLDPKMLFLLATAKLNQAE

SEQ ID NO: 726000 - protein, 17 aa, Mycobacterium
RRPERRRGMAVVISDFL

SEQ ID NO: 726001 - protein, 19 aa, Mycobacterium
RRPESRWRRQPGDVAALTR

SEQ ID NO: 726002 - protein, 21 aa, Mycobacterium
RRPESTDALAMHKLVADTEVL

SEQ ID NO: 726003 - protein, 18 aa, Mycobacterium
RRPFSGWLPLVFRADGTA

SEQ ID NO: 726004 - protein, 23 aa, Mycobacterium
RRPGDAPYEFHSCDVRDEESVDT

SEQ ID NO: 726005 - protein, 25 aa, Mycobacterium
RRPGEPRLPDIGWYAPDGSEMTDED

SEQ ID NO: 726006 - protein, 19 aa, Mycobacterium
RRPGFGFEGCVGPPANSTR

SEQ ID NO: 726007 - protein, 17 aa, Mycobacterium
RRPGGPGVIQGRDIMRK

SEQ ID NO: 726008 - protein, 22 aa, Mycobacterium
RRPGPVGVQAWAVRGVDGGRVE

SEQ ID NO: 726009 - protein, 17 aa, Mycobacterium
RRPGWFRKVAGKATGVS

SEQ ID NO: 726010 - protein, 24 aa, Mycobacterium
RRPHARGGVSLNLSRKHPAVQHAE

SEQ ID NO: 726011 - protein, 18 aa, Mycobacterium
RRPHPRSRRELVAELTAH

SEQ ID NO: 726012 - protein, 19 aa, Mycobacterium
RRPIPAFEGRRLRDWAARC

SEQ ID NO: 726013 - protein, 19 aa, Mycobacterium
RRPIPGLHWPWVARIGTVV

SEQ ID NO: 726014 - protein, 18 aa, Mycobacterium
RRPLEMGAAMADCDERTL

SEQ ID NO: 726015 - protein, 20 aa, Mycobacterium
RRPLIREGAELSELAQKELG

SEQ ID NO: 726016 - protein, 23 aa, Mycobacterium
RRPLQLMGRRVLSVFPVPPIAMQ

SEQ ID NO: 726017 - protein, 20 aa, Mycobacterium
RRPLRTSLLTAMDFKSNPML

SEQ ID NO: 726018 - protein, 20 aa, Mycobacterium
RRPLSRLGMGLHRRHRQSQG

SEQ ID NO: 726019 - protein, 28 aa, Mycobacterium
RRPPDLDAATWLHRWHVDHTPVAIETQA

SEQ ID NO: 726020 - protein, 20 aa, Mycobacterium
RRPPNFTARVSRDWVPLPEP

SEQ ID NO: 726021 - protein, 18 aa, Mycobacterium
RRPPPFPEDIWIPERDPG

SEQ ID NO: 726022 - protein, 21 aa, Mycobacterium
RRPPWEMHFIEGLEGGRFAIY

SEQ ID NO: 726023 - protein, 17 aa, Mycobacterium
RRPRERFIATLMHESGL

SEQ ID NO: 726024 - protein, 21 aa, Mycobacterium
RRPRMLYDYFHQLFAQVTNPP

SEQ ID NO: 726025 - protein, 21 aa, Mycobacterium
RRPRMLYDYFQQLFAQVTNPP

SEQ ID NO: 726026 - protein, 25 aa, Mycobacterium
RRPRSVIDPGYRYEFIEADDDSGAV

SEQ ID NO: 726027 - protein, 17 aa, Mycobacterium
RRPSGLVRPDDTEMVTA

SEQ ID NO: 726028 - protein, 18 aa, Mycobacterium
RRPSLLYVGRRGGYKNFA

SEQ ID NO: 726029 - protein, 20 aa, Mycobacterium
RRPSLVPVEAIELLGGPVQY

SEQ ID NO: 726030 - protein, 20 aa, Mycobacterium
RRPSLVPVEAIELLGGTVQY

SEQ ID NO: 726031 - protein, 28 aa, Mycobacterium
RRPSNWLLAARCVRGLLSMSSGEPDRAL

SEQ ID NO: 726032 - protein, 21 aa, Mycobacterium
RRPSVAYALTKLAIVLFTREL

SEQ ID NO: 726033 - protein, 24 aa, Mycobacterium
RRPTELRLTVKMISGPQSGPRQWT

SEQ ID NO: 726034 - protein, 20 aa, Mycobacterium
RRPTEPGAFGTVGEDVTPEQ

SEQ ID NO: 726035 - protein, 29 aa, Mycobacterium
RRPTFVLRVLRHCWRRHETSTAPAPQRQL

SEQ ID NO: 726036 - protein, 18 aa, Mycobacterium
RRPTISVAIYEKPLTTPL

SEQ ID NO: 726037 - protein, 19 aa, Mycobacterium
RRPTSLGLPDAFQHLRSQL

SEQ ID NO: 726038 - protein, 19 aa, Mycobacterium
RRPVGVVGLITAWNAPVHI

SEQ ID NO: 726039 - protein, 17 aa, Mycobacterium
RRPVIAFVGDGAMQMNG

SEQ ID NO: 726040 - protein, 25 aa, Mycobacterium
RRPVRFSDSVACARAQGATHFVEAG

SEQ ID NO: 726041 - protein, 18 aa, Mycobacterium
RRPVSLTAAGAVFVEHAR

SEQ ID NO: 726042 - protein, 29 aa, Mycobacterium
RRPWARPLSHWSMGWLPLSARLAAKAPRL

SEQ ID NO: 726043 - protein, 23 aa, Mycobacterium
RRPWLRRVGRWLADHPGGGVISC

SEQ ID NO: 726044 - protein, 23 aa, Mycobacterium
RRQAETPLLLAVDGKLIGLISLR

SEQ ID NO: 726045 - protein, 24 aa, Mycobacterium
RRQAETPLLLAVDGKLVGLISLRD

SEQ ID NO: 726046 - protein, 17 aa, Mycobacterium
RRQALTRMAEQRGVTEF

SEQ ID NO: 726047 - protein, 25 aa, Mycobacterium
RRQFDWIVDLLIKLGREADAYDACA

SEQ ID NO: 726048 - protein, 19 aa, Mycobacterium
RRQGKIRAWGVSQDEGLDV

SEQ ID NO: 726049 - protein, 28 aa, Mycobacterium
RRQGLKISVPEEVAWRVGFIDDATLEAR

SEQ ID NO: 726050 - protein, 31 aa, Mycobacterium
RRQGLKVSIPEEVAWRLGWIDDEQLARHARS

SEQ ID NO: 726051 - protein, 21 aa, Mycobacterium
RRQGLPVPPAFCITTSVCAEF

SEQ ID NO: 726052 - protein, 23 aa, Mycobacterium
RRQGRRVGFPRFATARRDPGRVR

SEQ ID NO: 726053 - protein, 19 aa, Mycobacterium
RRQIEFARVGGTIQSILVD

SEQ ID NO: 726054 - protein, 17 aa, Mycobacterium
RRQIFAGVRLAWSIEDA

SEQ ID NO: 726055 - protein, 17 aa, Mycobacterium
RRQLEEWLRSYRPDELF

SEQ ID NO: 726056 - protein, 20 aa, Mycobacterium
RRQLKPLGRQAEMARRAQTI

SEQ ID NO: 726057 - protein, 27 aa, Mycobacterium
RRQLPIVGRRAAERLGLRVVLVERAGA

SEQ ID NO: 726058 - protein, 24 aa, Mycobacterium
RRQLPRLVSSIGQRVLMITDSRMA

SEQ ID NO: 726059 - protein, 21 aa, Mycobacterium
RRQLPYLGEQVVIFPSTAGTL

SEQ ID NO: 726060 - protein, 18 aa, Mycobacterium
RRQLRDLGALVCEYTDMR

SEQ ID NO: 726061 - protein, 20 aa, Mycobacterium
RRQLREWGAIAGESGVLDAG

SEQ ID NO: 726062 - protein, 22 aa, Mycobacterium
RRQLRLKPATSFEEISGGDQAT

SEQ ID NO: 726063 - protein, 24 aa, Mycobacterium
RRQLRRLLGERVLRITVKPFMDMS

SEQ ID NO: 726064 - protein, 21 aa, Mycobacterium
RRQMGELFAPFTKVAAKNPFA

SEQ ID NO: 726065 - protein, 17 aa, Mycobacterium
RRQPHIGPFRVPGIPAF

SEQ ID NO: 726066 - protein, 25 aa, Mycobacterium
RRQQTLRASVDWSHALLTDTERSLF

SEQ ID NO: 726067 - protein, 24 aa, Mycobacterium
RRQQTLRASVDWSHALLTEPERIL

SEQ ID NO: 726068 - protein, 25 aa, Mycobacterium
RRQQTLRASVDWSHALLTEPERILF

SEQ ID NO: 726069 - protein, 24 aa, Mycobacterium
RRQQTLRASVDWSHALLTEPERVL

SEQ ID NO: 726070 - protein, 20 aa, Mycobacterium
RRQRALGGFATFFGDAARDP

SEQ ID NO: 726071 - protein, 24 aa, Mycobacterium
RRQRARKAIELVGLDGFEKSYPSM

SEQ ID NO: 726072 - protein, 27 aa, Mycobacterium
RRQRGPAPRCRICNAALSTPQAIMLRR

SEQ ID NO: 726073 - protein, 24 aa, Mycobacterium
RRQRGRLAAISSFGMAGTNAHVIL

SEQ ID NO: 726074 - protein, 18 aa, Mycobacterium
RRQRPCGRPRPWRRARHA

SEQ ID NO: 726075 - protein, 20 aa, Mycobacterium
RRQRQLLSRFDEMRRVYRDA

SEQ ID NO: 726076 - protein, 23 aa, Mycobacterium
RRQRSWFRRDHRITWLDGAAPGN

SEQ ID NO: 726077 - protein, 20 aa, Mycobacterium
RRQRSWFRRDHRVHWLDAGK

SEQ ID NO: 726078 - protein, 20 aa, Mycobacterium
RRQRSWFRRDHRVQWLNADD

SEQ ID NO: 726079 - protein, 26 aa, Mycobacterium
RRQRSWFRRDHRVVWLDGASEGLVDD

SEQ ID NO: 726080 - protein, 24 aa, Mycobacterium
RRQRYGGPVADHFGADWVSAVYEA

SEQ ID NO: 726081 - protein, 23 aa, Mycobacterium
RRQSLRLHYARTLDLWAEALQAH

SEQ ID NO: 726082 - protein, 32 aa, Mycobacterium
RRQTLERLKYLPLAPFRVSYAYTNYGVTAAAE

SEQ ID NO: 726083 - protein, 19 aa, Mycobacterium
RRQTWACGPEGMLDDAQRT

SEQ ID NO: 726084 - protein, 41 aa, Mycobacterium
RRQVVLTSDRGRSWVPAEAFLPADVITPWSHEQSSRWGGLL

SEQ ID NO: 726085 - protein, 22 aa, Mycobacterium
RRQWPSPMLPALQTLRDRHTDD

SEQ ID NO: 726086 - protein, 20 aa, Mycobacterium
RRRAAHAVAEMRQVAADMLQ

SEQ ID NO: 726087 - protein, 30 aa, Mycobacterium
RRRAALLPALRAAGFAVDYSEAGLYLWVTR

SEQ ID NO: 726088 - protein, 18 aa, Mycobacterium
RRRAEIIAAVSDDAVVVE

SEQ ID NO: 726089 - protein, 19 aa, Mycobacterium
RRRAEQRLPESQILPAQEV

SEQ ID NO: 726090 - protein, 22 aa, Mycobacterium
RRRAERVLKLTGRLTRVSTLPR

SEQ ID NO: 726091 - protein, 25 aa, Mycobacterium
RRRAPCVPALRAQRRLSRVALAAHH

SEQ ID NO: 726092 - protein, 17 aa, Mycobacterium
RRRAPWLQESAHRQIEH

SEQ ID NO: 726093 - protein, 24 aa, Mycobacterium
RRRARAPDRRRLRLALRARGRDPR

SEQ ID NO: 726094 - protein, 23 aa, Mycobacterium
RRRARKGTLEFGDLAIHPDSCTV

SEQ ID NO: 726095 - protein, 19 aa, Mycobacterium
RRRASIRIGSEPVREFTIA

SEQ ID NO: 726096 - protein, 22 aa, Mycobacterium
RRRATELLDAVGLADRAGSFPG

SEQ ID NO: 726097 - protein, 18 aa, Mycobacterium
RRRDAVGVGDALRASGCQ

SEQ ID NO: 726098 - protein, 22 aa, Mycobacterium
RRRDDLLAVRYCRGATEDGVNT

SEQ ID NO: 726099 - protein, 17 aa, Mycobacterium
RRRDFVMFGRLNPYKNV

SEQ ID NO: 726100 - protein, 19 aa, Mycobacterium
RRRDLLFALADVVRDHFAE

SEQ ID NO: 726101 - protein, 20 aa, Mycobacterium
RRRECLAAGLAGLHDGPVLV

SEQ ID NO: 726102 - protein, 24 aa, Mycobacterium
RRRELAVELLRLVAVDSANGSGNR

SEQ ID NO: 726103 - protein, 21 aa, Mycobacterium
RRRELVKQAKHKGEEARVSVR

SEQ ID NO: 726104 - protein, 23 aa, Mycobacterium
RRREWPSPMLPALEALPVDDDIH

SEQ ID NO: 726105 - protein, 19 aa, Mycobacterium
RRRFGAELLEGYGSSEGGG

SEQ ID NO: 726106 - protein, 17 aa, Mycobacterium
RRRFPVTVSVGAPLEPA

SEQ ID NO: 726107 - protein, 17 aa, Mycobacterium
RRRFRHILVDEYQDTNH

SEQ ID NO: 726108 - protein, 21 aa, Mycobacterium
RRRFSTVIEFFSYTPDELVAL

SEQ ID NO: 726109 - protein, 21 aa, Mycobacterium
RRRFSTVIEFFSYTPEELIAL

SEQ ID NO: 726110 - protein, 21 aa, Mycobacterium
RRRFSTVIEFFSYTPQELIAL

SEQ ID NO: 726111 - protein, 24 aa, Mycobacterium
RRRFVEPWIGWLIAAGVSPGDIVV

SEQ ID NO: 726112 - protein, 17 aa, Mycobacterium
RRRGAESTAEILVDLLV

SEQ ID NO: 726113 - protein, 17 aa, Mycobacterium
RRRGCTLDAASNTLDAA

SEQ ID NO: 726114 - protein, 23 aa, Mycobacterium
RRRGDARARAAALATGRVTPPVC

SEQ ID NO: 726115 - protein, 24 aa, Mycobacterium
RRRGDRLPLEYVIRKQSRDTAQLF

SEQ ID NO: 726116 - protein, 23 aa, Mycobacterium
RRRGDRWYWHWDPQFISGTAAFP

SEQ ID NO: 726117 - protein, 27 aa, Mycobacterium
RRRGDRWYWHWDPRFISGTAAFPPIEV

SEQ ID NO: 726118 - protein, 17 aa, Mycobacterium
RRRGELRPDADPRHLAV

SEQ ID NO: 726119 - protein, 17 aa, Mycobacterium
RRRGFRLSEHYTAPPMP

SEQ ID NO: 726120 - protein, 17 aa, Mycobacterium
RRRGGGELIELSMAGVA

SEQ ID NO: 726121 - protein, 21 aa, Mycobacterium
RRRGHEVGMAVPPNLVALVES

SEQ ID NO: 726122 - protein, 18 aa, Mycobacterium
RRRGIGAALIRAALAKTG

SEQ ID NO: 726123 - protein, 26 aa, Mycobacterium
RRRGILRLRVLLCLRALAAGARAQTK

SEQ ID NO: 726124 - protein, 26 aa, Mycobacterium
RRRGIPVILRPAVLAKLMDGRTTLMV

SEQ ID NO: 726125 - protein, 27 aa, Mycobacterium
RRRGIPVILRPAVLARLMDDRTSLLVT

SEQ ID NO: 726126 - protein, 26 aa, Mycobacterium
RRRGIPVILRPAVLARLMEGRTTLMV

SEQ ID NO: 726127 - protein, 19 aa, Mycobacterium
RRRGIYCGTVGLASPIAGC

SEQ ID NO: 726128 - protein, 18 aa, Mycobacterium
RRRGLRVVADGAPAEHIR

SEQ ID NO: 726129 - protein, 19 aa, Mycobacterium
RRRGSHFAELDRERAGAKQ

SEQ ID NO: 726130 - protein, 19 aa, Mycobacterium
RRRGSHFAELDRERLGVRQ

SEQ ID NO: 726131 - protein, 19 aa, Mycobacterium
RRRGSHFAELDRERSGVRQ

SEQ ID NO: 726132 - protein, 21 aa, Mycobacterium
RRRGSQPTLWRALNPGTEATA

SEQ ID NO: 726133 - protein, 20 aa, Mycobacterium
RRRGWAGLDSQQTWTPDDAD

SEQ ID NO: 726134 - protein, 19 aa, Mycobacterium
RRRHAFGGALIDKPLIRRK

SEQ ID NO: 726135 - protein, 17 aa, Mycobacterium
RRRHGLAAVSLAWGLWG

SEQ ID NO: 726136 - protein, 25 aa, Mycobacterium
RRRHGLAGMFALRFDQFALSLLSRE

SEQ ID NO: 726137 - protein, 26 aa, Mycobacterium
RRRHGLAGVFALRFDQFALALLSRAD

SEQ ID NO: 726138 - protein, 18 aa, Mycobacterium
RRRIENFQILTAGGESDE

SEQ ID NO: 726139 - protein, 18 aa, Mycobacterium
RRRIENFQILTAGGQADE

SEQ ID NO: 726140 - protein, 18 aa, Mycobacterium
RRRIEQIDRDRGHQPEFL

SEQ ID NO: 726141 - protein, 18 aa, Mycobacterium
RRRIIVATMRCVAEVGYS

SEQ ID NO: 726142 - protein, 18 aa, Mycobacterium
RRRIPGLGSIDVAQFVAE

SEQ ID NO: 726143 - protein, 18 aa, Mycobacterium
RRRIPVVIHEANARAGLA

SEQ ID NO: 726144 - protein, 25 aa, Mycobacterium
RRRIRLRPATELTRMTRYRGGTYSH

SEQ ID NO: 726145 - protein, 18 aa, Mycobacterium
RRRIRTHGLVAGSIAAAV

SEQ ID NO: 726146 - protein, 18 aa, Mycobacterium
RRRISALYTNAWTVMYDI

SEQ ID NO: 726147 - protein, 20 aa, Mycobacterium
RRRIYHCFNPQGVGIIAASL

SEQ ID NO: 726148 - protein, 24 aa, Mycobacterium
RRRIYWLSLPLDYGLSGTTAAGGW

SEQ ID NO: 726149 - protein, 18 aa, Mycobacterium
RRRKSWRSGGGSPHVAHP

SEQ ID NO: 726150 - protein, 18 aa, Mycobacterium
RRRLASLRPDDAILGEED

SEQ ID NO: 726151 - protein, 17 aa, Mycobacterium
RRRLDYPALAALCDIFY

SEQ ID NO: 726152 - protein, 26 aa, Mycobacterium
RRRLEALPVAHLLPGHGRPVHARETV

SEQ ID NO: 726153 - protein, 17 aa, Mycobacterium
RRRLFVRGASSVQHTDE

SEQ ID NO: 726154 - protein, 18 aa, Mycobacterium
RRRLHLLHEVEWVQLDRS

SEQ ID NO: 726155 - protein, 18 aa, Mycobacterium
RRRLKTSLLSAADIKAIP

SEQ ID NO: 726156 - protein, 18 aa, Mycobacterium
RRRLRLSAEEILLAALGR

SEQ ID NO: 726157 - protein, 18 aa, Mycobacterium
RRRLRMICHGLGHTEGFR

SEQ ID NO: 726158 - protein, 18 aa, Mycobacterium
RRRLRMICHGLGHTQGFR

SEQ ID NO: 726159 - protein, 17 aa, Mycobacterium
RRRLRMICHGLGHVESS

SEQ ID NO: 726160 - protein, 18 aa, Mycobacterium
RRRLRMICHGLGRAEGFS

SEQ ID NO: 726161 - protein, 20 aa, Mycobacterium
RRRLRRARLLDAAMDAMCAN

SEQ ID NO: 726162 - protein, 18 aa, Mycobacterium
RRRLRRLPAAEVPDALRR

SEQ ID NO: 726163 - protein, 18 aa, Mycobacterium
RRRLRTRSAAEPEIDLAS

SEQ ID NO: 726164 - protein, 21 aa, Mycobacterium
RRRLSGEVIDFVELDMPEHVL

SEQ ID NO: 726165 - protein, 21 aa, Mycobacterium
RRRLTDGATFAEFFSDASLNP

SEQ ID NO: 726166 - protein, 19 aa, Mycobacterium
RRRMAQWLTAIGVDPVRKG

SEQ ID NO: 726167 - protein, 29 aa, Mycobacterium
RRRMPAPDSECRLLAAVGMLLVERALNQW

SEQ ID NO: 726168 - protein, 20 aa, Mycobacterium
RRRMPWLAVDDGYAFEGPEG

SEQ ID NO: 726169 - protein, 17 aa, Mycobacterium
RRRNDILAFFDHHASTA

SEQ ID NO: 726170 - protein, 23 aa, Mycobacterium
RRRPDIAVTILRLANMIGPAMDT

SEQ ID NO: 726171 - protein, 23 aa, Mycobacterium
RRRPDIAVTILRLANMIGPATDT

SEQ ID NO: 726172 - protein, 21 aa, Mycobacterium
RRRPDLWPNTVEEILRLDSPV

SEQ ID NO: 726173 - protein, 18 aa, Mycobacterium
RRRPEARWRRQPGDIPEL

SEQ ID NO: 726174 - protein, 18 aa, Mycobacterium
RRRPEARWRRQPGDVPAL

SEQ ID NO: 726175 - protein, 18 aa, Mycobacterium
RRRPEARWRRQPSDVPTL

SEQ ID NO: 726176 - protein, 32 aa, Mycobacterium
RRRPEIDPRWLAGRPDAVLVAARVAPLTRHIG

SEQ ID NO: 726177 - protein, 17 aa, Mycobacterium
RRRPIWFRRSGFQPAAV

SEQ ID NO: 726178 - protein, 24 aa, Mycobacterium
RRRPLDPARGAAFNALRAVSERNA

SEQ ID NO: 726179 - protein, 18 aa, Mycobacterium
RRRPPWRRTGKNGKNGSA

SEQ ID NO: 726180 - protein, 18 aa, Mycobacterium
RRRQAEGIAEIYTQLVRD

SEQ ID NO: 726181 - protein, 19 aa, Mycobacterium
RRRQFHSLGRRLLDFTDEV

SEQ ID NO: 726182 - protein, 20 aa, Mycobacterium
RRRRAEVFGAAGATPTSAGD

SEQ ID NO: 726183 - protein, 20 aa, Mycobacterium
RRRRAEVFGAAPAGATGPDS

SEQ ID NO: 726184 - protein, 19 aa, Mycobacterium
RRRRAFCNQGGLAGGYALV

SEQ ID NO: 726185 - protein, 18 aa, Mycobacterium
RRRRALISAAADLLRDNG

SEQ ID NO: 726186 - protein, 20 aa, Mycobacterium
RRRRDLSVLLLLDVSGSAGE

SEQ ID NO: 726187 - protein, 24 aa, Mycobacterium
RRRREFREGIPYWGAAVQVDIDDM

SEQ ID NO: 726188 - protein, 23 aa, Mycobacterium
RRRREIGFVFQHFNLFPHMTAAE

SEQ ID NO: 726189 - protein, 17 aa, Mycobacterium
RRRRGPETIAEVLADLL

SEQ ID NO: 726190 - protein, 21 aa, Mycobacterium
RRRRGSGPLVAYLIATVDLPE

SEQ ID NO: 726191 - protein, 22 aa, Mycobacterium
RRRRLIKYISQIDVERYRSLIE

SEQ ID NO: 726192 - protein, 22 aa, Mycobacterium
RRRRLIKYISQIDVQRYRSLIE

SEQ ID NO: 726193 - protein, 19 aa, Mycobacterium
RRRRPYRWLRQILPDPKYP

SEQ ID NO: 726194 - protein, 22 aa, Mycobacterium
RRRRRSVWRRAPLSLTASPSTE

SEQ ID NO: 726195 - protein, 24 aa, Mycobacterium
RRRRSGWKPFLYHLSSGQPERRRT

SEQ ID NO: 726196 - protein, 18 aa, Mycobacterium
RRRRSRGLLLNHPEAIAI

SEQ ID NO: 726197 - protein, 19 aa, Mycobacterium
RRRRVPVVQTFLGLTAASR

SEQ ID NO: 726198 - protein, 24 aa, Mycobacterium
RRRSALLPALRAAGFTVDHSEAGL

SEQ ID NO: 726199 - protein, 21 aa, Mycobacterium
RRRSAQALRNWVSREQRALAQ

SEQ ID NO: 726200 - protein, 19 aa, Mycobacterium
RRRSRKAAARAVRAAAGGP

SEQ ID NO: 726201 - protein, 24 aa, Mycobacterium
RRRSTRLTTLMSMADQLEVPADIK

SEQ ID NO: 726202 - protein, 24 aa, Mycobacterium
RRRTAIDFDPHWLRHTAATRMLRD

SEQ ID NO: 726203 - protein, 21 aa, Mycobacterium
RRRTGRTVGEWIMERRMAEAR

SEQ ID NO: 726204 - protein, 18 aa, Mycobacterium
RRRTLLFLRADHLAHFVS

SEQ ID NO: 726205 - protein, 17 aa, Mycobacterium
RRRTMLREYIEAMRELW

SEQ ID NO: 726206 - protein, 25 aa, Mycobacterium
RRRTMLREYLEAMRALWTEEEASYD

SEQ ID NO: 726207 - protein, 25 aa, Mycobacterium
RRRTMLREYLEAMRALWTQEEAAYD

SEQ ID NO: 726208 - protein, 25 aa, Mycobacterium
RRRTMLREYLEAMRALWTQEEAEYD

SEQ ID NO: 726209 - protein, 25 aa, Mycobacterium
RRRTMLREYLEAMRALWTQEEASYD

SEQ ID NO: 726210 - protein, 19 aa, Mycobacterium
RRRTRCYSPASAEGAEAIE

SEQ ID NO: 726211 - protein, 20 aa, Mycobacterium
RRRTVLPVSLVTRSSCAMPG

SEQ ID NO: 726212 - protein, 23 aa, Mycobacterium
RRRTYDLSSLFAIGTGGAATNLK

SEQ ID NO: 726213 - protein, 23 aa, Mycobacterium
RRRVAMLRDWLDAELADSSLAVL

SEQ ID NO: 726214 - protein, 17 aa, Mycobacterium
RRRVGGVAGARRISERL

SEQ ID NO: 726215 - protein, 38 aa, Mycobacterium
RRRVGITVLPADRWNLFDPVVIRWRLEVGDRTAQLVSL

SEQ ID NO: 726216 - protein, 17 aa, Mycobacterium
RRRVKVIGRLPGEYSCL

SEQ ID NO: 726217 - protein, 24 aa, Mycobacterium
RRRVLRVLLVWDAPNLDMGLGAIL

SEQ ID NO: 726218 - protein, 17 aa, Mycobacterium
RRRVPPLTEPMGEPGSR

SEQ ID NO: 726219 - protein, 23 aa, Mycobacterium
RRRVQLAALLIGDWDVIALDEPT

SEQ ID NO: 726220 - protein, 17 aa, Mycobacterium
RRRVRALLDNPVMPGPN

SEQ ID NO: 726221 - protein, 24 aa, Mycobacterium
RRRVRLASVLRRCVVVDARLVGGE

SEQ ID NO: 726222 - protein, 21 aa, Mycobacterium
RRRVSPKTRYVLVHPGVVNTG

SEQ ID NO: 726223 - protein, 17 aa, Mycobacterium
RRRVTILGREVIRLLPV

SEQ ID NO: 726224 - protein, 19 aa, Mycobacterium
RRRVVELAAALSDDFDRLE

SEQ ID NO: 726225 - protein, 18 aa, Mycobacterium
RRRVVRFTPPGRIAAGYR

SEQ ID NO: 726226 - protein, 26 aa, Mycobacterium
RRRWSPHGKPIVGFVGRLAPEKHVER

SEQ ID NO: 726227 - protein, 24 aa, Mycobacterium
RRRYESSIAPGAWEALAAARFRRP

SEQ ID NO: 726228 - protein, 24 aa, Mycobacterium
RRRYESSIAPGAWESLAAARFRRP

SEQ ID NO: 726229 - protein, 18 aa, Mycobacterium
RRRYPWGAQEPCDALANL

SEQ ID NO: 726230 - protein, 18 aa, Mycobacterium
RRRYWARNHVGWRHMDDT

SEQ ID NO: 726231 - protein, 20 aa, Mycobacterium
RRRYYRVSGADAYTMRREAR

SEQ ID NO: 726232 - protein, 22 aa, Mycobacterium
RRSAESLYDFNLATYDEGDSFD

SEQ ID NO: 726233 - protein, 18 aa, Mycobacterium
RRSALLPLLHLVQSEDGY

SEQ ID NO: 726234 - protein, 19 aa, Mycobacterium
RRSARRCPDKVAIIDGDVT

SEQ ID NO: 726235 - protein, 18 aa, Mycobacterium
RRSAVRAEIIARLRAAEP

SEQ ID NO: 726236 - protein, 20 aa, Mycobacterium
RRSAWWAGAVTLGVAKIIEN

SEQ ID NO: 726237 - protein, 17 aa, Mycobacterium
RRSCAVGAIVRGQDHLP

SEQ ID NO: 726238 - protein, 17 aa, Mycobacterium
RRSCPECGKRFTTVETA

SEQ ID NO: 726239 - protein, 18 aa, Mycobacterium
RRSCPECGRRFTTVETAV

SEQ ID NO: 726240 - protein, 27 aa, Mycobacterium
RRSEALERLGWLVVRVVATDSPADIIR

SEQ ID NO: 726241 - protein, 28 aa, Mycobacterium
RRSEARSQLRIAYDMFAQMGAAGFAERA

SEQ ID NO: 726242 - protein, 19 aa, Mycobacterium
RRSELAAALDLARRQGTPL

SEQ ID NO: 726243 - protein, 17 aa, Mycobacterium
RRSEPERALALFDDSAR

SEQ ID NO: 726244 - protein, 18 aa, Mycobacterium
RRSFILVPGIDVPFHSKV

SEQ ID NO: 726245 - protein, 17 aa, Mycobacterium
RRSFWELTADQYLETFA

SEQ ID NO: 726246 - protein, 27 aa, Mycobacterium
RRSGAIELTGAWPGLRCDVDTPDDLAA

SEQ ID NO: 726247 - protein, 19 aa, Mycobacterium
RRSGARRRLDVCVEVGMDG

SEQ ID NO: 726248 - protein, 21 aa, Mycobacterium
RRSGASWTEIGKCMGVTKQAA

SEQ ID NO: 726249 - protein, 22 aa, Mycobacterium
RRSGASWTEIGKCMGVTKQAAQ

SEQ ID NO: 726250 - protein, 20 aa, Mycobacterium
RRSGDAGALQKHWNAAMEVL

SEQ ID NO: 726251 - protein, 26 aa, Mycobacterium
RRSGDSGAIQRHWFAAMEVLAEYSID

SEQ ID NO: 726252 - protein, 22 aa, Mycobacterium
RRSGEAVVEMLRRGITARDILT

SEQ ID NO: 726253 - protein, 24 aa, Mycobacterium
RRSGFKEIHDRGGFLSGATMFDPE

SEQ ID NO: 726254 - protein, 21 aa, Mycobacterium
RRSGKYFPAPGLEPHAAVDIR

SEQ ID NO: 726255 - protein, 19 aa, Mycobacterium
RRSGLIALLCKTDPDATPK

SEQ ID NO: 726256 - protein, 18 aa, Mycobacterium
RRSGLIALLCKTDPHATP

SEQ ID NO: 726257 - protein, 19 aa, Mycobacterium
RRSGLIALLCKTDPKATPR

SEQ ID NO: 726258 - protein, 19 aa, Mycobacterium
RRSGLIALLCKTDPNTKPR

SEQ ID NO: 726259 - protein, 18 aa, Mycobacterium
RRSGLIALLCKTDPQAQP

SEQ ID NO: 726260 - protein, 19 aa, Mycobacterium
RRSGLPKVPTSVLSRGVCG

SEQ ID NO: 726261 - protein, 20 aa, Mycobacterium
RRSGLPKVPTSVLSRGVCGV

SEQ ID NO: 726262 - protein, 23 aa, Mycobacterium
RRSGPRLSGKRVIIDPGRGGSDH

SEQ ID NO: 726263 - protein, 17 aa, Mycobacterium
RRSGQRWRVAERSATTL

SEQ ID NO: 726264 - protein, 18 aa, Mycobacterium
RRSGRIGTAASWLGTALA

SEQ ID NO: 726265 - protein, 17 aa, Mycobacterium
RRSHPIPLVLGGTGPRM

SEQ ID NO: 726266 - protein, 19 aa, Mycobacterium
RRSIARLLGVTPREVVLTS

SEQ ID NO: 726267 - protein, 24 aa, Mycobacterium
RRSIPVPVLYTLGALGSLRARLTG

SEQ ID NO: 726268 - protein, 25 aa, Mycobacterium
RRSISVPVLYALGALGSLRARLTGK

SEQ ID NO: 726269 - protein, 25 aa, Mycobacterium
RRSIVCPYHAWSYRLDGSVRNAPGF

SEQ ID NO: 726270 - protein, 20 aa, Mycobacterium
RRSKAPKRWWWVALTDEPFP

SEQ ID NO: 726271 - protein, 19 aa, Mycobacterium
RRSKDLASIIAFGSPVDTL

SEQ ID NO: 726272 - protein, 18 aa, Mycobacterium
RRSKDLASIVAFGAPVDT

SEQ ID NO: 726273 - protein, 24 aa, Mycobacterium
RRSKFPHRWWWVTLTDEPFPRFST

SEQ ID NO: 726274 - protein, 25 aa, Mycobacterium
RRSKSDPLRLARRIAAALNAPDVHD

SEQ ID NO: 726275 - protein, 18 aa, Mycobacterium
RRSKSSGRDTHWLAASEH

SEQ ID NO: 726276 - protein, 18 aa, Mycobacterium
RRSLAAAVLDQVRRTPEA

SEQ ID NO: 726277 - protein, 33 aa, Mycobacterium
RRSLIRTSSGWVLLAGFARRDLWSYLGSLPAED

SEQ ID NO: 726278 - protein, 17 aa, Mycobacterium
RRSLLFFAGAVAGDTET

SEQ ID NO: 726279 - protein, 20 aa, Mycobacterium
RRSLLPAGITAVSGRFFGGD

SEQ ID NO: 726280 - protein, 18 aa, Mycobacterium
RRSLRLPFGGAVVSLTPA

SEQ ID NO: 726281 - protein, 22 aa, Mycobacterium
RRSLRRLPRLTRLAVRCTSDGM

SEQ ID NO: 726282 - protein, 19 aa, Mycobacterium
RRSLSPAQVHAILRAQIDD

SEQ ID NO: 726283 - protein, 20 aa, Mycobacterium
RRSPSLFGRVGRTAGSALAL

SEQ ID NO: 726284 - protein, 25 aa, Mycobacterium
RRSRELVTDWLLNWSLTKYIPVTCV

SEQ ID NO: 726285 - protein, 19 aa, Mycobacterium
RRSRIIGIIAARLGAYFDE

SEQ ID NO: 726286 - protein, 18 aa, Mycobacterium
RRSRVLLICRDEPTNEVW

SEQ ID NO: 726287 - protein, 17 aa, Mycobacterium
RRSRVTEGMRFGRKKTA

SEQ ID NO: 726288 - protein, 24 aa, Mycobacterium
RRSSDDVGWCRGGGLPAHPRAQQR

SEQ ID NO: 726289 - protein, 23 aa, Mycobacterium
RRSSDSYPVYQFGWFPDFPDPDN

SEQ ID NO: 726290 - protein, 29 aa, Mycobacterium
RRSSGAVKFPAERPELFDGDSDIQQDIEP

SEQ ID NO: 726291 - protein, 17 aa, Mycobacterium
RRSSLMGYTGKWAIHPD

SEQ ID NO: 726292 - protein, 19 aa, Mycobacterium
RRSTGGYLLGRRTVELGSA

SEQ ID NO: 726293 - protein, 18 aa, Mycobacterium
RRSTGIDFDPHWYRHTYA

SEQ ID NO: 726294 - protein, 20 aa, Mycobacterium
RRSTLSGGQQGTWDRLWPKL

SEQ ID NO: 726295 - protein, 25 aa, Mycobacterium
RRSTRAQAALSWRHFESESIEGTPV

SEQ ID NO: 726296 - protein, 17 aa, Mycobacterium
RRSTRPPARSKRNMDQD

SEQ ID NO: 726297 - protein, 25 aa, Mycobacterium
RRSVDLLALHVCKDADTGGPHDHRM

SEQ ID NO: 726298 - protein, 19 aa, Mycobacterium
RRSVLCGNIGDPVLDVLDR

SEQ ID NO: 726299 - protein, 19 aa, Mycobacterium
RRSVPHLQRLLGHLETSLK

SEQ ID NO: 726300 - protein, 24 aa, Mycobacterium
RRSVPRLQRMLGHLETSLKELERA

SEQ ID NO: 726301 - protein, 19 aa, Mycobacterium
RRSVVKALRKLGVTIVSGP

SEQ ID NO: 726302 - protein, 25 aa, Mycobacterium
RRSWSAWWPRPIKRSPAAAWPGWPS

SEQ ID NO: 726303 - protein, 29 aa, Mycobacterium
RRSYDAGLGRRGIPEQFDAELWRNLEDTG

SEQ ID NO: 726304 - protein, 17 aa, Mycobacterium
RRSYRRDRYLGIIDKVR

SEQ ID NO: 726305 - protein, 17 aa, Mycobacterium
RRTADGLVFEFDGEPQL

SEQ ID NO: 726306 - protein, 21 aa, Mycobacterium
RRTAEELGRAFPGTAVVTSSG

SEQ ID NO: 726307 - protein, 21 aa, Mycobacterium
RRTAEELGRALPGVPVVTSGG

SEQ ID NO: 726308 - protein, 17 aa, Mycobacterium
RRTAIEALGARTLDPTA

SEQ ID NO: 726309 - protein, 19 aa, Mycobacterium
RRTAPVWWNAQQESIFDDG

SEQ ID NO: 726310 - protein, 25 aa, Mycobacterium
RRTARLQALPGWVWNSDAPGRQVNA

SEQ ID NO: 726311 - protein, 26 aa, Mycobacterium
RRTASAGQRLAIWARDRGCTRPGCTA

SEQ ID NO: 726312 - protein, 27 aa, Mycobacterium
RRTASAGQRLAIWARDRGCTRPGCTAN

SEQ ID NO: 726313 - protein, 20 aa, Mycobacterium
RRTDPLPGRIATGAGGYGGG

SEQ ID NO: 726314 - protein, 21 aa, Mycobacterium
RRTDQKWAELVYDGLWYSPLK

SEQ ID NO: 726315 - protein, 26 aa, Mycobacterium
RRTDRLPFVAPMNWEAFEPSLRGAID

SEQ ID NO: 726316 - protein, 25 aa, Mycobacterium
RRTDRLPLSAPRDWDVPGETGAAGA

SEQ ID NO: 726317 - protein, 21 aa, Mycobacterium
RRTEAPVTLVLDNKPVMTTSR

SEQ ID NO: 726318 - protein, 17 aa, Mycobacterium
RRTEETLHPVGEAAVDK

SEQ ID NO: 726319 - protein, 20 aa, Mycobacterium
RRTEGRFALYSVSDPAESRE

SEQ ID NO: 726320 - protein, 24 aa, Mycobacterium
RRTELPYATAVQWLDHRKEIDCDA

SEQ ID NO: 726321 - protein, 27 aa, Mycobacterium
RRTFGLRPAPEFNDWLERMGMLERDGG

SEQ ID NO: 726322 - protein, 32 aa, Mycobacterium
RRTFVCPFHGWCWAIDGRNIYVARPEVFGEHN

SEQ ID NO: 726323 - protein, 31 aa, Mycobacterium
RRTFVCPFHGWCWGIDGRNTFVLRPEEFDVH

SEQ ID NO: 726324 - protein, 23 aa, Mycobacterium
RRTGATLRWFGVTDDGRIDVDSL

SEQ ID NO: 726325 - protein, 23 aa, Mycobacterium
RRTGATLRWYGVTDDGRIDLDSL

SEQ ID NO: 726326 - protein, 25 aa, Mycobacterium
RRTGATLRWYGVTDEGRIDLDSLEL

SEQ ID NO: 726327 - protein, 21 aa, Mycobacterium
RRTGGSVVRPLLAGPDRAEKY

SEQ ID NO: 726328 - protein, 20 aa, Mycobacterium
RRTGIDVSWNDERDLWWHDV

SEQ ID NO: 726329 - protein, 18 aa, Mycobacterium
RRTGPEFIDGFFDSATTR

SEQ ID NO: 726330 - protein, 20 aa, Mycobacterium
RRTGRCVVLHEGPRSLGYGA

SEQ ID NO: 726331 - protein, 17 aa, Mycobacterium
RRTGRRLAHLAEGSEER

SEQ ID NO: 726332 - protein, 20 aa, Mycobacterium
RRTGVDVAWNDDRDLWWHDV

SEQ ID NO: 726333 - protein, 30 aa, Mycobacterium
RRTGVRKLAGFWGHCWQSAVFGSGRAFGYI

SEQ ID NO: 726334 - protein, 20 aa, Mycobacterium
RRTGVRRIVYLSGLHPEGGK

SEQ ID NO: 726335 - protein, 19 aa, Mycobacterium
RRTGVRRIVYLSGLHPENA

SEQ ID NO: 726336 - protein, 18 aa, Mycobacterium
RRTIPPIFRTVYGTEEDN

SEQ ID NO: 726337 - protein, 20 aa, Mycobacterium
RRTLAEWTEVFAAHPDLFWS

SEQ ID NO: 726338 - protein, 21 aa, Mycobacterium
RRTLDGWQEWAKQRGHRGLAY

SEQ ID NO: 726339 - protein, 17 aa, Mycobacterium
RRTLGWQGVDAVDATAG

SEQ ID NO: 726340 - protein, 19 aa, Mycobacterium
RRTLPGATILKASVGPIDN

SEQ ID NO: 726341 - protein, 19 aa, Mycobacterium
RRTLSRRWAGPAFLLNQML

SEQ ID NO: 726342 - protein, 20 aa, Mycobacterium
RRTPGGLVRPDALWDDLLAD

SEQ ID NO: 726343 - protein, 26 aa, Mycobacterium
RRTPLSGRHFVRWLTAWNETVDAMFQ

SEQ ID NO: 726344 - protein, 25 aa, Mycobacterium
RRTQQVEWTWSMVRDAVLDRVMNHP

SEQ ID NO: 726345 - protein, 23 aa, Mycobacterium
RRTQQVEWTWSMVRDTVLDRVMS

SEQ ID NO: 726346 - protein, 29 aa, Mycobacterium
RRTQVRAVWRAVSAVDEIFARSGGNAARM

SEQ ID NO: 726347 - protein, 25 aa, Mycobacterium
RRTRFGTEVEALWWDDERQQWQIHA

SEQ ID NO: 726348 - protein, 20 aa, Mycobacterium
RRTRIPYLYNQMVDAHGVFG

SEQ ID NO: 726349 - protein, 18 aa, Mycobacterium
RRTRISIEVADRGVAAAR

SEQ ID NO: 726350 - protein, 18 aa, Mycobacterium
RRTRPGLVDPGRRYEYLD

SEQ ID NO: 726351 - protein, 32 aa, Mycobacterium
RRTRVYCPRWVALFRWVKPVLSSAVGEAPLHK

SEQ ID NO: 726352 - protein, 20 aa, Mycobacterium
RRTSAAGVRLHLDDRPAQLE

SEQ ID NO: 726353 - protein, 25 aa, Mycobacterium
RRTSAVKAFTAWAARRGLLAADPGA

SEQ ID NO: 726354 - protein, 25 aa, Mycobacterium
RRTSAVKAFTAWAVRRGLLATDPAA

SEQ ID NO: 726355 - protein, 26 aa, Mycobacterium
RRTSAVKAFTAWAVRRGLLTGDPAAR

SEQ ID NO: 726356 - protein, 25 aa, Mycobacterium
RRTSAVKIFTAWATRRGLLPTDPAI

SEQ ID NO: 726357 - protein, 25 aa, Mycobacterium
RRTSSVKTFTAWAVRRGLIGDDPAS

SEQ ID NO: 726358 - protein, 28 aa, Mycobacterium
RRTSVNLKACIKAAADRVVFINTGFLDR

SEQ ID NO: 726359 - protein, 19 aa, Mycobacterium
RRTTALGRASAPVWSSVAL

SEQ ID NO: 726360 - protein, 24 aa, Mycobacterium
RRTTEGLSMPEIIRCQKRYLAREI

SEQ ID NO: 726361 - protein, 19 aa, Mycobacterium
RRTTWNSGCSSWYLTEDGY

SEQ ID NO: 726362 - protein, 32 aa, Mycobacterium
RRTVAIDLRDDWPAALLEAGFDPHARTAWSAE

SEQ ID NO: 726363 - protein, 24 aa, Mycobacterium
RRTVALEMAYRPGGVLAAKLHLKH

SEQ ID NO: 726364 - protein, 17 aa, Mycobacterium
RRTVLKASKGYRGQRSR

SEQ ID NO: 726365 - protein, 22 aa, Mycobacterium
RRTVPVVACLPAVWEHIQDRAA

SEQ ID NO: 726366 - protein, 18 aa, Mycobacterium
RRTVRMRVIDDIISMLNR

SEQ ID NO: 726367 - protein, 17 aa, Mycobacterium
RRTVRMRVVGDIIDMLN

SEQ ID NO: 726368 - protein, 17 aa, Mycobacterium
RRTVSIDLRDDWPAALR

SEQ ID NO: 726369 - protein, 18 aa, Mycobacterium
RRTVVGVLGPHAFRAVRL

SEQ ID NO: 726370 - protein, 22 aa, Mycobacterium
RRTWEELIYLFAEIADAGTAVV

SEQ ID NO: 726371 - protein, 24 aa, Mycobacterium
RRTWRARVSDRFGDYGFVGLVSAV

SEQ ID NO: 726372 - protein, 25 aa, Mycobacterium
RRTWSPDGRPIVGFVGRLAPEKHVE

SEQ ID NO: 726373 - protein, 21 aa, Mycobacterium
RRTYYLVGLRQFCRYAVRRRV

SEQ ID NO: 726374 - protein, 27 aa, Mycobacterium
RRVAADWPPKRVGAVTGIPEARIRLLA

SEQ ID NO: 726375 - protein, 26 aa, Mycobacterium
RRVAAHGDGWCPFPAPAPLAQTAGTA

SEQ ID NO: 726376 - protein, 25 aa, Mycobacterium
RRVAAVFAALGALAWSNVVRTQQFR

SEQ ID NO: 726377 - protein, 17 aa, Mycobacterium
RRVADLGLQVVLASSAP

SEQ ID NO: 726378 - protein, 21 aa, Mycobacterium
RRVADVLGIPFYVWDFADRFK

SEQ ID NO: 726379 - protein, 21 aa, Mycobacterium
RRVAEELSFEPAFRAAEAAKT

SEQ ID NO: 726380 - protein, 18 aa, Mycobacterium
RRVAELKRETGIKYRTAY

SEQ ID NO: 726381 - protein, 21 aa, Mycobacterium
RRVAGLLPHMGGVPNVWSVYL

SEQ ID NO: 726382 - protein, 21 aa, Mycobacterium
RRVAMLRDWLESELVDAAKQV

SEQ ID NO: 726383 - protein, 17 aa, Mycobacterium
RRVAPIWWNAQPIGAGG

SEQ ID NO: 726384 - protein, 28 aa, Mycobacterium
RRVAPSIVFCAAEFVPVIGDLIADMPSP

SEQ ID NO: 726385 - protein, 20 aa, Mycobacterium
RRVASILVERVDGIPVLQPG

SEQ ID NO: 726386 - protein, 19 aa, Mycobacterium
RRVASPAQRVMLIARDGGC

SEQ ID NO: 726387 - protein, 17 aa, Mycobacterium
RRVCAVVGSGDNGGDAL

SEQ ID NO: 726388 - protein, 24 aa, Mycobacterium
RRVDLAEAVARVFSGDIVNSIAVA

SEQ ID NO: 726389 - protein, 22 aa, Mycobacterium
RRVDPEYDRHGGFPVFEAADPG

SEQ ID NO: 726390 - protein, 24 aa, Mycobacterium
RRVDPRNSTVLVWGAVNAGVAANA

SEQ ID NO: 726391 - protein, 18 aa, Mycobacterium
RRVEDLPRVLAHVHRELV

SEQ ID NO: 726392 - protein, 20 aa, Mycobacterium
RRVEGGYVINGRKYYSTGGL

SEQ ID NO: 726393 - protein, 22 aa, Mycobacterium
RRVEILGCDVIRLAPDGRVASN

SEQ ID NO: 726394 - protein, 18 aa, Mycobacterium
RRVEPRLADAPVIETITG

SEQ ID NO: 726395 - protein, 19 aa, Mycobacterium
RRVEPRMAALQIIGMCNWV

SEQ ID NO: 726396 - protein, 21 aa, Mycobacterium
RRVESVGYCAHPIQLVGADLG

SEQ ID NO: 726397 - protein, 26 aa, Mycobacterium
RRVETTAAGLLLAWRGDAGHAAQAAI

SEQ ID NO: 726398 - protein, 24 aa, Mycobacterium
RRVFVHLCSAAQWTAITGEVPPPT

SEQ ID NO: 726399 - protein, 21 aa, Mycobacterium
RRVGAQAGRRSGHRAQGIVDL

SEQ ID NO: 726400 - protein, 20 aa, Mycobacterium
RRVGDLIALVRPLVGDTPLG

SEQ ID NO: 726401 - protein, 19 aa, Mycobacterium
RRVGGRRCGTTSAVHVDTA

SEQ ID NO: 726402 - protein, 21 aa, Mycobacterium
RRVGHYRWFALFMKHAGSQAD

SEQ ID NO: 726403 - protein, 19 aa, Mycobacterium
RRVGIAHPVVVTFNEPVAD

SEQ ID NO: 726404 - protein, 19 aa, Mycobacterium
RRVGITVQDPEKWNVFDPV

SEQ ID NO: 726405 - protein, 20 aa, Mycobacterium
RRVGRLMAGIQCELGQQGLR

SEQ ID NO: 726406 - protein, 20 aa, Mycobacterium
RRVGTASARKLRGRIAKILR

SEQ ID NO: 726407 - protein, 25 aa, Mycobacterium
RRVGVPRGLADLGVRAEDVPVLARN

SEQ ID NO: 726408 - protein, 22 aa, Mycobacterium
RRVGVWRFMSLRHAVDDNRDIA

SEQ ID NO: 726409 - protein, 25 aa, Mycobacterium
RRVHAELTLGMGITGCPRTVSVLMT

SEQ ID NO: 726410 - protein, 25 aa, Mycobacterium
RRVHLPARPVVRGHVVGEQAAARRR

SEQ ID NO: 726411 - protein, 20 aa, Mycobacterium
RRVIDARLAFLISGGTGAGK

SEQ ID NO: 726412 - protein, 18 aa, Mycobacterium
RRVIRSWLLAGGAIGLTD

SEQ ID NO: 726413 - protein, 18 aa, Mycobacterium
RRVKEIDDSIWAPGSGKH

SEQ ID NO: 726414 - protein, 17 aa, Mycobacterium
RRVKGEWVYGPRTPTSE

SEQ ID NO: 726415 - protein, 18 aa, Mycobacterium
RRVLEFGELAAPSLDIGL

SEQ ID NO: 726416 - protein, 18 aa, Mycobacterium
RRVLEFGELAAPSLDIGV

SEQ ID NO: 726417 - protein, 17 aa, Mycobacterium
RRVLEMLPIPPIALQLR

SEQ ID NO: 726418 - protein, 18 aa, Mycobacterium
RRVLEPLAALAARAPGTV

SEQ ID NO: 726419 - protein, 19 aa, Mycobacterium
RRVLFDGIRAVGVEYVRDG

SEQ ID NO: 726420 - protein, 19 aa, Mycobacterium
RRVLGLDCDVRAAATASGA

SEQ ID NO: 726421 - protein, 19 aa, Mycobacterium
RRVLLRGWEQFDEPVDRIV

SEQ ID NO: 726422 - protein, 21 aa, Mycobacterium
RRVLLSRFGPDRVRDTPISEQ

SEQ ID NO: 726423 - protein, 21 aa, Mycobacterium
RRVLRCADEFAAAHPGLLDRY

SEQ ID NO: 726424 - protein, 21 aa, Mycobacterium
RRVLREFALQVPVGVRFAKSA

SEQ ID NO: 726425 - protein, 21 aa, Mycobacterium
RRVLRRWLHEATEAPAEVRDD

SEQ ID NO: 726426 - protein, 17 aa, Mycobacterium
RRVLSVFPVPPIAMQLR

SEQ ID NO: 726427 - protein, 21 aa, Mycobacterium
RRVPAEVLAALTAASTTAAVT

SEQ ID NO: 726428 - protein, 18 aa, Mycobacterium
RRVPGTVLTPQWFADGAR

SEQ ID NO: 726429 - protein, 20 aa, Mycobacterium
RRVPTLRLAVPLDELPFKHD

SEQ ID NO: 726430 - protein, 18 aa, Mycobacterium
RRVPTLRLAVPLEELPFK

SEQ ID NO: 726431 - protein, 22 aa, Mycobacterium
RRVPTWPVIEWLAMRPGSRELW

SEQ ID NO: 726432 - protein, 21 aa, Mycobacterium
RRVQVKSSRVPSGMNPLRYSD

SEQ ID NO: 726433 - protein, 19 aa, Mycobacterium
RRVRARFVLAGVTPTVLAG

SEQ ID NO: 726434 - protein, 21 aa, Mycobacterium
RRVRARLARRMTAQRSAINPV

SEQ ID NO: 726435 - protein, 18 aa, Mycobacterium
RRVRAVLRALPIRADDAA

SEQ ID NO: 726436 - protein, 18 aa, Mycobacterium
RRVRGVSTAEYFSAATAP

SEQ ID NO: 726437 - protein, 19 aa, Mycobacterium
RRVRLRAAAGPTRGTDAGY

SEQ ID NO: 726438 - protein, 18 aa, Mycobacterium
RRVRVLEQMWLNALWGGP

SEQ ID NO: 726439 - protein, 22 aa, Mycobacterium
RRVSGIWRRVLGSDHFGVTDSF

SEQ ID NO: 726440 - protein, 20 aa, Mycobacterium
RRVSTESGVEFFEVFCDTPL

SEQ ID NO: 726441 - protein, 22 aa, Mycobacterium
RRVTAPPGPFWGPLSSADYCAL

SEQ ID NO: 726442 - protein, 17 aa, Mycobacterium
RRVTRVVARRGEPYRSG

SEQ ID NO: 726443 - protein, 22 aa, Mycobacterium
RRVTTCLTFAVAADGARITTAA

SEQ ID NO: 726444 - protein, 20 aa, Mycobacterium
RRVTVAGGGLAMWDITIGEP

SEQ ID NO: 726445 - protein, 20 aa, Mycobacterium
RRVVAALGPRVLKLSAERSA

SEQ ID NO: 726446 - protein, 28 aa, Mycobacterium
RRVVAVDLRDDWPAALRAAGFDPAQPTA

SEQ ID NO: 726447 - protein, 20 aa, Mycobacterium
RRVVVPCVSRRELSGAELLA

SEQ ID NO: 726448 - protein, 22 aa, Mycobacterium
RRVWSHLSGSFGADGRVRRVLT

SEQ ID NO: 726449 - protein, 20 aa, Mycobacterium
RRWADNLWDTGIEFGTVGVG

SEQ ID NO: 726450 - protein, 19 aa, Mycobacterium
RRWDVEGPLATVLDAPDVL

SEQ ID NO: 726451 - protein, 17 aa, Mycobacterium
RRWEFPQGTAPGLADTD

SEQ ID NO: 726452 - protein, 23 aa, Mycobacterium
RRWFGTVVATGFDSLVSDRANRM

SEQ ID NO: 726453 - protein, 23 aa, Mycobacterium
RRWGEWPMEGWLSTFEDRGLITR

SEQ ID NO: 726454 - protein, 17 aa, Mycobacterium
RRWGLREGVPTVVYDDW

SEQ ID NO: 726455 - protein, 24 aa, Mycobacterium
RRWIKEATRWVGAEGAYAAMHRTK

SEQ ID NO: 726456 - protein, 18 aa, Mycobacterium
RRWLEMVINRRRLSPAHR

SEQ ID NO: 726457 - protein, 22 aa, Mycobacterium
RRWLRRLPAAHLERIYQGGTRQ

SEQ ID NO: 726458 - protein, 20 aa, Mycobacterium
RRWLTERDIVAFNMTSSPGS

SEQ ID NO: 726459 - protein, 19 aa, Mycobacterium
RRWNRRGAMVTDRYQRLCH

SEQ ID NO: 726460 - protein, 17 aa, Mycobacterium
RRWPDTRSIISALLTSH

SEQ ID NO: 726461 - protein, 26 aa, Mycobacterium
RRWPSKAELVLAAFIEGVRQVAVAPN

SEQ ID NO: 726462 - protein, 26 aa, Mycobacterium
RRWPSKAELVLAAFVEGIRQVVVPPD

SEQ ID NO: 726463 - protein, 26 aa, Mycobacterium
RRWQRLQFDHGWLLPGNPPEFGGRNA

SEQ ID NO: 726464 - protein, 31 aa, Mycobacterium
RRWRDIWLHEGFACYAEWLWSEESGGPTADA

SEQ ID NO: 726465 - protein, 30 aa, Mycobacterium
RRWRDIWLHEGFACYAEWLWSENSGGRGAA

SEQ ID NO: 726466 - protein, 18 aa, Mycobacterium
RRWRIPRVIRHGARSLFL

SEQ ID NO: 726467 - protein, 18 aa, Mycobacterium
RRWSDMVRWHRWLAESRD

SEQ ID NO: 726468 - protein, 22 aa, Mycobacterium
RRWSERTMIALVMQHLDNSITT

SEQ ID NO: 726469 - protein, 23 aa, Mycobacterium
RRWSNKTDLVLAVLMREAQAIFT

SEQ ID NO: 726470 - protein, 19 aa, Mycobacterium
RRWSRAKHMLELRLRAPSP

SEQ ID NO: 726471 - protein, 21 aa, Mycobacterium
RRWSRDWPVRELAPAPAGSGL

SEQ ID NO: 726472 - protein, 22 aa, Mycobacterium
RRWTNGSPWLFAAPKMNPDGRR

SEQ ID NO: 726473 - protein, 26 aa, Mycobacterium
RRWWPRRYRRSSAYWKLVELDQRFGI

SEQ ID NO: 726474 - protein, 19 aa, Mycobacterium
RRWYRTGDLARYWPDGTLE

SEQ ID NO: 726475 - protein, 23 aa, Mycobacterium
RRYAERGYHYWDVAVVHADDRAG

SEQ ID NO: 726476 - protein, 20 aa, Mycobacterium
RRYAEVIPEPDVVMLADDIG

SEQ ID NO: 726477 - protein, 17 aa, Mycobacterium
RRYAGRRGIARAREAVD

SEQ ID NO: 726478 - protein, 17 aa, Mycobacterium
RRYAIFVVSPLRINPWA

SEQ ID NO: 726479 - protein, 19 aa, Mycobacterium
RRYANVTVEGGRVFNPGWH

SEQ ID NO: 726480 - protein, 17 aa, Mycobacterium
RRYATALGQAELAQSSV

SEQ ID NO: 726481 - protein, 23 aa, Mycobacterium
RRYCVNCLDPLVGSDGFDVIAEL

SEQ ID NO: 726482 - protein, 21 aa, Mycobacterium
RRYDEMDGFPEGLLVIGDAVC

SEQ ID NO: 726483 - protein, 18 aa, Mycobacterium
RRYDGLERLMGWVPGVSG

SEQ ID NO: 726484 - protein, 20 aa, Mycobacterium
RRYEIGVSNILWGNDFPHPE

SEQ ID NO: 726485 - protein, 20 aa, Mycobacterium
RRYEIGVSNLLWGNDFPHPE

SEQ ID NO: 726486 - protein, 17 aa, Mycobacterium
RRYEIGVSNMLWGNDFP

SEQ ID NO: 726487 - protein, 23 aa, Mycobacterium
RRYESSTAPGAWEAVAAARFRRP

SEQ ID NO: 726488 - protein, 19 aa, Mycobacterium
RRYFDLPSIVMPKPGDEAA

SEQ ID NO: 726489 - protein, 18 aa, Mycobacterium
RRYFDNFAEVLSGANEVG

SEQ ID NO: 726490 - protein, 19 aa, Mycobacterium
RRYFDNFAEVMASAASVGA

SEQ ID NO: 726491 - protein, 17 aa, Mycobacterium
RRYGMTPPAFFAVEYAI

SEQ ID NO: 726492 - protein, 26 aa, Mycobacterium
RRYGNVFTLRLPMWGRVIMVSDPQLA

SEQ ID NO: 726493 - protein, 21 aa, Mycobacterium
RRYGPERIGLLTGDQAINGDA

SEQ ID NO: 726494 - protein, 17 aa, Mycobacterium
RRYGPIMTMPILSLGDV

SEQ ID NO: 726495 - protein, 19 aa, Mycobacterium
RRYGVAFERPGPRLRDYLF

SEQ ID NO: 726496 - protein, 21 aa, Mycobacterium
RRYGVAMGTPLVPVLGNLAVI

SEQ ID NO: 726497 - protein, 28 aa, Mycobacterium
RRYILPAYVDPRWVRWLRVLPLDRGLAI

SEQ ID NO: 726498 - protein, 20 aa, Mycobacterium
RRYISLVATQLVKALGDAEA

SEQ ID NO: 726499 - protein, 17 aa, Mycobacterium
RRYKAPTLFLTKRDARS

SEQ ID NO: 726500 - protein, 20 aa, Mycobacterium
RRYLERDGLEVSTAHDGNEA

SEQ ID NO: 726501 - protein, 19 aa, Mycobacterium
RRYLHRRAVHYGDHPAQVL

SEQ ID NO: 726502 - protein, 23 aa, Mycobacterium
RRYLLAEARLGAYARELGEEPKV

SEQ ID NO: 726503 - protein, 24 aa, Mycobacterium
RRYLRPCFSGEEIWCQLFSEPGAG

SEQ ID NO: 726504 - protein, 19 aa, Mycobacterium
RRYLSKLFDLWEMTWSVRE

SEQ ID NO: 726505 - protein, 18 aa, Mycobacterium
RRYLSYFPPSAWSYPAQL

SEQ ID NO: 726506 - protein, 18 aa, Mycobacterium
RRYLSYFPPSAWSYPSPQ

SEQ ID NO: 726507 - protein, 25 aa, Mycobacterium
RRYNPWSAYGESKLANLLFVRELVA

SEQ ID NO: 726508 - protein, 27 aa, Mycobacterium
RRYPHRGVDTGGMWVWRHADSVDVSRH

SEQ ID NO: 726509 - protein, 28 aa, Mycobacterium
RRYPHRGVDTGGVWVWRDAQAVDIGYHC

SEQ ID NO: 726510 - protein, 19 aa, Mycobacterium
RRYPIPIICALLGAPAGDW

SEQ ID NO: 726511 - protein, 20 aa, Mycobacterium
RRYQSSIAPGAWEAVAAARF

SEQ ID NO: 726512 - protein, 24 aa, Mycobacterium
RRYRLTVDLPPDFALNQPLSTFAL

SEQ ID NO: 726513 - protein, 19 aa, Mycobacterium
RRYRNARVVLRAAAEIFAG

SEQ ID NO: 726514 - protein, 19 aa, Mycobacterium
RRYSTAFERPGPRLRDYLL

SEQ ID NO: 726515 - protein, 17 aa, Mycobacterium
RRYSVARRLAGLFASYA

SEQ ID NO: 726516 - protein, 25 aa, Mycobacterium
RRYSYSDRLRYYWADAEVDAARRTL

SEQ ID NO: 726517 - protein, 20 aa, Mycobacterium
RRYVAECLAVARAEGARLGD

SEQ ID NO: 726518 - protein, 26 aa, Mycobacterium
RRYVAKYTICPAITHGIDHEIGSVEV

SEQ ID NO: 726519 - protein, 25 aa, Mycobacterium
RRYVAKYTICPAVAHGLDHEIGSVE

SEQ ID NO: 726520 - protein, 25 aa, Mycobacterium
RRYVAKYTICPAVAHGLDHEVGSVE

SEQ ID NO: 726521 - protein, 25 aa, Mycobacterium
RRYVAKYTICPAVAHGMDHEIGSIE

SEQ ID NO: 726522 - protein, 17 aa, Mycobacterium
RRYVAVLAAAFADTPTP

SEQ ID NO: 726523 - protein, 29 aa, Mycobacterium
RRYVGVPVKWVLCRYRLQNAALEIETDPG

SEQ ID NO: 726524 - protein, 23 aa, Mycobacterium
RRYVLAEARLAAYAREFGEEPAV

SEQ ID NO: 726525 - protein, 18 aa, Mycobacterium
RRYVRTFVLPAILADPPA

SEQ ID NO: 726526 - protein, 29 aa, Mycobacterium
RRYVTRSGFTPRYNVAVVDWFNEEGSRFK

SEQ ID NO: 726527 - protein, 20 aa, Mycobacterium
RRYWFCCKGCGPRFDRDPDK

SEQ ID NO: 726528 - protein, 19 aa, Mycobacterium
RRYWMVIPRELRQVGRVRA

SEQ ID NO: 726529 - protein, 17 aa, Mycobacterium
RRYYMRYSGPGGMTEQD

SEQ ID NO: 726530 - protein, 17 aa, Mycobacterium
RRYYRVSGADAYTMRRD

SEQ ID NO: 726531 - protein, 18 aa, Mycobacterium
RSAAAWGGGPGRCRGRRR

SEQ ID NO: 726532 - protein, 19 aa, Mycobacterium
RSAADWLAGRDIVYLVASP

SEQ ID NO: 726533 - protein, 20 aa, Mycobacterium
RSAAEVRTLAAFPVAAAQVR

SEQ ID NO: 726534 - protein, 19 aa, Mycobacterium
RSAAEWLGPEFRRVVRVTG

SEQ ID NO: 726535 - protein, 19 aa, Mycobacterium
RSAAHPLQGPELLAAAVLE

SEQ ID NO: 726536 - protein, 18 aa, Mycobacterium
RSAAIAIAPGPFVIDIRD

SEQ ID NO: 726537 - protein, 18 aa, Mycobacterium
RSAAIRTAIREALQQGVV

SEQ ID NO: 726538 - protein, 21 aa, Mycobacterium
RSAALRLSREVGYACSVVERF

SEQ ID NO: 726539 - protein, 19 aa, Mycobacterium
RSAARLAGSAARQASLEGR

SEQ ID NO: 726540 - protein, 24 aa, Mycobacterium
RSAARRFCGWHVTPVREDDEVTLD

SEQ ID NO: 726541 - protein, 26 aa, Mycobacterium
RSAAWLPTLLWRRWSPGYYAEEDLRH

SEQ ID NO: 726542 - protein, 22 aa, Mycobacterium
RSACARAGGALLAVERDGPVAT

SEQ ID NO: 726543 - protein, 19 aa, Mycobacterium
RSACARGGGAMLAVEGIEP

SEQ ID NO: 726544 - protein, 20 aa, Mycobacterium
RSADDFPRSEHLAWKIAEVA

SEQ ID NO: 726545 - protein, 19 aa, Mycobacterium
RSADFRASVDIAVEIAKRL

SEQ ID NO: 726546 - protein, 24 aa, Mycobacterium
RSADLPPAVGVLVEYQGGDKDAAH

SEQ ID NO: 726547 - protein, 23 aa, Mycobacterium
RSADRLEALAGRLGPHAHPLPAD

SEQ ID NO: 726548 - protein, 23 aa, Mycobacterium
RSADRLEALAGRLGSDTHPLPAD

SEQ ID NO: 726549 - protein, 23 aa, Mycobacterium
RSADVLDGLGLPTGMDYMGYADA

SEQ ID NO: 726550 - protein, 27 aa, Mycobacterium
RSAEAFPRDQHLAWKIAEIASDPVAVP

SEQ ID NO: 726551 - protein, 20 aa, Mycobacterium
RSAEAVWRDGFNQLGRGQKV

SEQ ID NO: 726552 - protein, 20 aa, Mycobacterium
RSAEELRRPIELANARLEDY

SEQ ID NO: 726553 - protein, 17 aa, Mycobacterium
RSAEIMAATVDFFESRG

SEQ ID NO: 726554 - protein, 21 aa, Mycobacterium
RSAELPRAPDLVLNGLAANFI

SEQ ID NO: 726555 - protein, 22 aa, Mycobacterium
RSAELRRGDFTAGRQSPPQRRD

SEQ ID NO: 726556 - protein, 23 aa, Mycobacterium
RSAELTPGYIIDLFSSYYPMTVA

SEQ ID NO: 726557 - protein, 20 aa, Mycobacterium
RSAEMWLYHRGSPLLLEVGA

SEQ ID NO: 726558 - protein, 19 aa, Mycobacterium
RSAETDWLGIGLRRGAVYG

SEQ ID NO: 726559 - protein, 19 aa, Mycobacterium
RSAETFLLQQTWMPDIVDI

SEQ ID NO: 726560 - protein, 18 aa, Mycobacterium
RSAFCHRNAAFSLAVIGV

SEQ ID NO: 726561 - protein, 19 aa, Mycobacterium
RSAFSRFAKYLGDARAAEG

SEQ ID NO: 726562 - protein, 23 aa, Mycobacterium
RSAFVCALLARFPDVHVRQQRPT

SEQ ID NO: 726563 - protein, 19 aa, Mycobacterium
RSAGCPFAPPPGVMALAAA

SEQ ID NO: 726564 - protein, 23 aa, Mycobacterium
RSAGEMRKYLGYFDTERARLAQS

SEQ ID NO: 726565 - protein, 24 aa, Mycobacterium
RSAGLPLTVKVGGCEAMRDLLEAK

SEQ ID NO: 726566 - protein, 27 aa, Mycobacterium
RSAGRIVSFDAAGGWNIEEEGYQAVGS

SEQ ID NO: 726567 - protein, 19 aa, Mycobacterium
RSAHPRIDLLINNAGVMYP

SEQ ID NO: 726568 - protein, 19 aa, Mycobacterium
RSAHVVAIGGGVIQDIATF

SEQ ID NO: 726569 - protein, 19 aa, Mycobacterium
RSAIAAAIDYTRNRKAFGT

SEQ ID NO: 726570 - protein, 29 aa, Mycobacterium
RSAIGKRGGWLAGLHPAELLGSIQRSVIA

SEQ ID NO: 726571 - protein, 18 aa, Mycobacterium
RSAIPAALQALRPHGRLA

SEQ ID NO: 726572 - protein, 17 aa, Mycobacterium
RSAIPGLYAAGACACNI

SEQ ID NO: 726573 - protein, 19 aa, Mycobacterium
RSAIRDMARALGFSQGQQD

SEQ ID NO: 726574 - protein, 20 aa, Mycobacterium
RSAIVMPLIVDDAVLGVIAV

SEQ ID NO: 726575 - protein, 17 aa, Mycobacterium
RSAIVVRAAIRANRRRD

SEQ ID NO: 726576 - protein, 18 aa, Mycobacterium
RSALDVSPTIDPAAEVSR

SEQ ID NO: 726577 - protein, 19 aa, Mycobacterium
RSALELKIAQRSRDLWQGI

SEQ ID NO: 726578 - protein, 18 aa, Mycobacterium
RSALGLDVPEGARDLSTG

SEQ ID NO: 726579 - protein, 27 aa, Mycobacterium
RSALKTQRLLAERGFEIVTGQGGMDTA

SEQ ID NO: 726580 - protein, 20 aa, Mycobacterium
RSALTSALLRSSRIGSGRSA

SEQ ID NO: 726581 - protein, 17 aa, Mycobacterium
RSAMITTVFERMGFDPE

SEQ ID NO: 726582 - protein, 20 aa, Mycobacterium
RSAMPHLQRMLAHLETSLKD

SEQ ID NO: 726583 - protein, 19 aa, Mycobacterium
RSAMPYQVHVGRWDQLDGL

SEQ ID NO: 726584 - protein, 25 aa, Mycobacterium
RSAPARSGFRVGERVSAFGVLGGYA

SEQ ID NO: 726585 - protein, 20 aa, Mycobacterium
RSAPGPGGGAWCHPMDGPPP

SEQ ID NO: 726586 - protein, 18 aa, Mycobacterium
RSAPKLVHRGRTVSRSLI

SEQ ID NO: 726587 - protein, 20 aa, Mycobacterium
RSAPRLGVDPERLGVIGDSA

SEQ ID NO: 726588 - protein, 17 aa, Mycobacterium
RSARGHGLCQGHHQRWA

SEQ ID NO: 726589 - protein, 24 aa, Mycobacterium
RSARKHFASLRVPAAVSYAGTPEG

SEQ ID NO: 726590 - protein, 25 aa, Mycobacterium
RSARKIACPILFCVCETDSVAPAGP

SEQ ID NO: 726591 - protein, 22 aa, Mycobacterium
RSARLAARRHVPLLTSAAEVPE

SEQ ID NO: 726592 - protein, 17 aa, Mycobacterium
RSARRGLTPGPWRLIRV

SEQ ID NO: 726593 - protein, 20 aa, Mycobacterium
RSARSFWGMTRKFKPGDFEF

SEQ ID NO: 726594 - protein, 20 aa, Mycobacterium
RSARSFWGMTRRFKPADFSF

SEQ ID NO: 726595 - protein, 20 aa, Mycobacterium
RSARTFWGMTRRFRPADFRF

SEQ ID NO: 726596 - protein, 19 aa, Mycobacterium
RSASDAVVFMDHGKVVESG

SEQ ID NO: 726597 - protein, 18 aa, Mycobacterium
RSATAQSRAFVLAMMDPT

SEQ ID NO: 726598 - protein, 18 aa, Mycobacterium
RSATPRVVVLSRLVPHKQ

SEQ ID NO: 726599 - protein, 18 aa, Mycobacterium
RSAVDLSAVAATFDGGGH

SEQ ID NO: 726600 - protein, 17 aa, Mycobacterium
RSAVFDPVLHVADLSFC

SEQ ID NO: 726601 - protein, 28 aa, Mycobacterium
RSAVKMPSQRGWRHWLYVTTRINLGLSP

SEQ ID NO: 726602 - protein, 17 aa, Mycobacterium
RSAVLALVDGLLVVGGA

SEQ ID NO: 726603 - protein, 19 aa, Mycobacterium
RSAVREVLLGSVAVAAVNR

SEQ ID NO: 726604 - protein, 20 aa, Mycobacterium
RSAVRHALSLSDRGDAPDAL

SEQ ID NO: 726605 - protein, 21 aa, Mycobacterium
RSAVSAAWGRAVVVGTLAVPR

SEQ ID NO: 726606 - protein, 28 aa, Mycobacterium
RSAVTFKVKNMWGLLAVKGEFTKFVGRG

SEQ ID NO: 726607 - protein, 18 aa, Mycobacterium
RSAWIGYWVASSRTGGGI

SEQ ID NO: 726608 - protein, 20 aa, Mycobacterium
RSAWLEIRRDSALTPEETEL

SEQ ID NO: 726609 - protein, 29 aa, Mycobacterium
RSCGACTNCRARRPAYCRKAVRLNQFGQR

SEQ ID NO: 726610 - protein, 17 aa, Mycobacterium
RSCIGEHFARLETTLAL

SEQ ID NO: 726611 - protein, 23 aa, Mycobacterium
RSCILTGAGGAFCAGMDLKKADS

SEQ ID NO: 726612 - protein, 17 aa, Mycobacterium
RSCIPPVGNCFRCVGPS

SEQ ID NO: 726613 - protein, 21 aa, Mycobacterium
RSDAELIGWIKAVAGAARRVV

SEQ ID NO: 726614 - protein, 23 aa, Mycobacterium
RSDAEPPCLGYVFYAPPRAVPRA

SEQ ID NO: 726615 - protein, 20 aa, Mycobacterium
RSDAFLARTGARPQALLLPL

SEQ ID NO: 726616 - protein, 28 aa, Mycobacterium
RSDAGFDVLPLLLAYGGDVDRRTLASVI

SEQ ID NO: 726617 - protein, 21 aa, Mycobacterium
RSDALWRGKLVGLVRRVLNTP

SEQ ID NO: 726618 - protein, 24 aa, Mycobacterium
RSDASYRWLVHTLTVDVLRDLLPE

SEQ ID NO: 726619 - protein, 24 aa, Mycobacterium
RSDELWFWHAGGPLEMVVNESGPA

SEQ ID NO: 726620 - protein, 32 aa, Mycobacterium
RSDEVPVVVLLWSPRSDVCVDLLDTLSGLAAA

SEQ ID NO: 726621 - protein, 18 aa, Mycobacterium
RSDFDIFLDYARRMDFRD

SEQ ID NO: 726622 - protein, 18 aa, Mycobacterium
RSDFEAFGAIARAFSALA

SEQ ID NO: 726623 - protein, 18 aa, Mycobacterium
RSDFEAFGAIARAFSTLA

SEQ ID NO: 726624 - protein, 18 aa, Mycobacterium
RSDGAGMVAHYPRGPLTG

SEQ ID NO: 726625 - protein, 21 aa, Mycobacterium
RSDGDAFGRLILLYDPEGADA

SEQ ID NO: 726626 - protein, 20 aa, Mycobacterium
RSDGLPIFNTIIPKRTAAER

SEQ ID NO: 726627 - protein, 19 aa, Mycobacterium
RSDGLPVWIYQFKISPHPT

SEQ ID NO: 726628 - protein, 21 aa, Mycobacterium
RSDIAVAILRLANMIGPAMDT

SEQ ID NO: 726629 - protein, 18 aa, Mycobacterium
RSDIGGAVQRLIRRLPAG

SEQ ID NO: 726630 - protein, 17 aa, Mycobacterium
RSDILAFTLPGFATGDR

SEQ ID NO: 726631 - protein, 21 aa, Mycobacterium
RSDIPVRFTVTMMCAPGQPML

SEQ ID NO: 726632 - protein, 21 aa, Mycobacterium
RSDKLWRSKPVGLARRVLNSP

SEQ ID NO: 726633 - protein, 18 aa, Mycobacterium
RSDLDIFLDYARRMDFRD

SEQ ID NO: 726634 - protein, 19 aa, Mycobacterium
RSDLEVIDTWFTSGLRGTG

SEQ ID NO: 726635 - protein, 18 aa, Mycobacterium
RSDLRMVYQPIVNCETNT

SEQ ID NO: 726636 - protein, 17 aa, Mycobacterium
RSDLTIWAGGFGVPDLA

SEQ ID NO: 726637 - protein, 28 aa, Mycobacterium
RSDMSEALPLLARRLRDPHELPGATWLP

SEQ ID NO: 726638 - protein, 20 aa, Mycobacterium
RSDPELLLTYIVQRLGTSQR

SEQ ID NO: 726639 - protein, 24 aa, Mycobacterium
RSDPHLYGRFDLRYDGQRPPVLLE

SEQ ID NO: 726640 - protein, 21 aa, Mycobacterium
RSDPNTAIAEFFNRLDEKRAS

SEQ ID NO: 726641 - protein, 26 aa, Mycobacterium
RSDSDMPSFGYGFKPWIHRKAIADGH

SEQ ID NO: 726642 - protein, 19 aa, Mycobacterium
RSDTLPFAGLRVVDMTTFW

SEQ ID NO: 726643 - protein, 20 aa, Mycobacterium
RSDVCADAQLGLALLARSAS

SEQ ID NO: 726644 - protein, 19 aa, Mycobacterium
RSDVFPIRQFADGIAHTLR

SEQ ID NO: 726645 - protein, 28 aa, Mycobacterium
RSDVKWLTPQAFRLWRNLGLRGFTGAGM

SEQ ID NO: 726646 - protein, 26 aa, Mycobacterium
RSDWARPEARLTIPARATLLLYTDGL

SEQ ID NO: 726647 - protein, 17 aa, Mycobacterium
RSDWPRTDSHFAVSLPV

SEQ ID NO: 726648 - protein, 21 aa, Mycobacterium
RSEALYGAWLAGMTLGATTMS

SEQ ID NO: 726649 - protein, 22 aa, Mycobacterium
RSEARWPQYAPAAAEIGVLSGL

SEQ ID NO: 726650 - protein, 20 aa, Mycobacterium
RSEFAGPITTVRCFEDNALL

SEQ ID NO: 726651 - protein, 22 aa, Mycobacterium
RSEFPPAGIAVIIAAIGRMLIL

SEQ ID NO: 726652 - protein, 18 aa, Mycobacterium
RSEGAGVVVLKRLSDAQR

SEQ ID NO: 726653 - protein, 17 aa, Mycobacterium
RSEGCGILVLKRLSDAV

SEQ ID NO: 726654 - protein, 20 aa, Mycobacterium
RSEGDAFGRLILLHDPDGAE

SEQ ID NO: 726655 - protein, 21 aa, Mycobacterium
RSEGDAFGRLILLYDPDGSDA

SEQ ID NO: 726656 - protein, 22 aa, Mycobacterium
RSEGDAFGRLILLYDPEGSDAW

SEQ ID NO: 726657 - protein, 21 aa, Mycobacterium
RSEGDSWDIVSSVGFTALGVA

SEQ ID NO: 726658 - protein, 19 aa, Mycobacterium
RSEGIRYGEFVGAQLADTD

SEQ ID NO: 726659 - protein, 22 aa, Mycobacterium
RSEGLGVASLHAFCDGLFSSDP

SEQ ID NO: 726660 - protein, 22 aa, Mycobacterium
RSEGRPGRWRRWDWASDAPDGW

SEQ ID NO: 726661 - protein, 28 aa, Mycobacterium
RSEGRRCTAVRWGLWPGAGIIDADEITR

SEQ ID NO: 726662 - protein, 21 aa, Mycobacterium
RSEGTLLFGRFAFSVRYTWFR

SEQ ID NO: 726663 - protein, 20 aa, Mycobacterium
RSEHLAWKIAEVAADPVAVP

SEQ ID NO: 726664 - protein, 23 aa, Mycobacterium
RSEHLAWKIAQVAADPVAVDADV

SEQ ID NO: 726665 - protein, 18 aa, Mycobacterium
RSEHLLREAELWAATAAV

SEQ ID NO: 726666 - protein, 23 aa, Mycobacterium
RSEHLRLSTAVTLAANLDPIRVA

SEQ ID NO: 726667 - protein, 26 aa, Mycobacterium
RSEHYRYALSNSFGLGGNNVVLAFGA

SEQ ID NO: 726668 - protein, 23 aa, Mycobacterium
RSEIDRAELARMFSGIDIHRAIP

SEQ ID NO: 726669 - protein, 34 aa, Mycobacterium
RSEIDRAELARMFYRIDIHQAIPVIRAFSHFALL

SEQ ID NO: 726670 - protein, 22 aa, Mycobacterium
RSEIGIELARLLAPGATVVLAA

SEQ ID NO: 726671 - protein, 21 aa, Mycobacterium
RSEIKHLAFGHGPHFCLGAPL

SEQ ID NO: 726672 - protein, 19 aa, Mycobacterium
RSEIYRIITEFAAQGMAVV

SEQ ID NO: 726673 - protein, 32 aa, Mycobacterium
RSELAALPREEWPTHLRRLIAEQVGLLLRRTV

SEQ ID NO: 726674 - protein, 29 aa, Mycobacterium
RSELARFGMAPTYPFEFMADVKANRLPQV

SEQ ID NO: 726675 - protein, 18 aa, Mycobacterium
RSELARKGIARGRSVIAL

SEQ ID NO: 726676 - protein, 18 aa, Mycobacterium
RSELEFMRPGVLLEDLPT

SEQ ID NO: 726677 - protein, 24 aa, Mycobacterium
RSELLRLMELIAGLRHADVPLDVS

SEQ ID NO: 726678 - protein, 24 aa, Mycobacterium
RSELSELPALVGADEIRTLRTLLS

SEQ ID NO: 726679 - protein, 18 aa, Mycobacterium
RSELSGYGYRFFSHSDTE

SEQ ID NO: 726680 - protein, 18 aa, Mycobacterium
RSEQDVVDVLDWCTREQI

SEQ ID NO: 726681 - protein, 22 aa, Mycobacterium
RSESTVEGFVLPGYAVGDNAGS

SEQ ID NO: 726682 - protein, 19 aa, Mycobacterium
RSEVESWETADLDAAASRW

SEQ ID NO: 726683 - protein, 27 aa, Mycobacterium
RSEVVRWSKLHSQYEYWSQIDTDSAEA

SEQ ID NO: 726684 - protein, 25 aa, Mycobacterium
RSEYIYRFAPLVGIYGGTLEVFRNM

SEQ ID NO: 726685 - protein, 23 aa, Mycobacterium
RSFAAALGLKFTRVQFTPDLLPA

SEQ ID NO: 726686 - protein, 25 aa, Mycobacterium
RSFDPCLPCGVHMYLGGGKTLDLLH

SEQ ID NO: 726687 - protein, 25 aa, Mycobacterium
RSFDPCLPCGVHMYLGKGKTLERLH

SEQ ID NO: 726688 - protein, 24 aa, Mycobacterium
RSFDSCLVCTVHAYDGKTGKELNR

SEQ ID NO: 726689 - protein, 19 aa, Mycobacterium
RSFETYPLVVRVAGATPVQ

SEQ ID NO: 726690 - protein, 24 aa, Mycobacterium
RSFGAPMDVWWFRLPRRPDDPTGL

SEQ ID NO: 726691 - protein, 17 aa, Mycobacterium
RSFTVIPQRGDDFADRL

SEQ ID NO: 726692 - protein, 20 aa, Mycobacterium
RSGAALCRALQSAGVPVHAE

SEQ ID NO: 726693 - protein, 26 aa, Mycobacterium
RSGADLRRYLTRWIGPAIAYPQLVRT

SEQ ID NO: 726694 - protein, 26 aa, Mycobacterium
RSGADLRRYLTRWLGPAIAYPQLVRA

SEQ ID NO: 726695 - protein, 20 aa, Mycobacterium
RSGAEWYLAEHLRQGIKDVE

SEQ ID NO: 726696 - protein, 18 aa, Mycobacterium
RSGAGFRLTGTRTQVGYG

SEQ ID NO: 726697 - protein, 21 aa, Mycobacterium
RSGAINPVLEPLVAVHREIYP

SEQ ID NO: 726698 - protein, 20 aa, Mycobacterium
RSGAPGDDWPAYTTADRAVM

SEQ ID NO: 726699 - protein, 24 aa, Mycobacterium
RSGAPRGSVYYHFPDGRNQILTEA

SEQ ID NO: 726700 - protein, 20 aa, Mycobacterium
RSGARIALVVGDRDIEAAMV

SEQ ID NO: 726701 - protein, 19 aa, Mycobacterium
RSGARLGRGAGFYDRTLHH

SEQ ID NO: 726702 - protein, 20 aa, Mycobacterium
RSGARVALVLGDRDIEAGTV

SEQ ID NO: 726703 - protein, 21 aa, Mycobacterium
RSGARVALVLGDRDIEAGTVG

SEQ ID NO: 726704 - protein, 20 aa, Mycobacterium
RSGASAYLGTELANAQQNLL

SEQ ID NO: 726705 - protein, 22 aa, Mycobacterium
RSGASLADVMGYLGVPPAAQNV

SEQ ID NO: 726706 - protein, 23 aa, Mycobacterium
RSGAYRTALVVGVELEKTVPGDT

SEQ ID NO: 726707 - protein, 19 aa, Mycobacterium
RSGCGGGFELVEQVGVVFV

SEQ ID NO: 726708 - protein, 18 aa, Mycobacterium
RSGDAVALISAHAALSGE

SEQ ID NO: 726709 - protein, 19 aa, Mycobacterium
RSGDDWVSRRVCANGIVCV

SEQ ID NO: 726710 - protein, 19 aa, Mycobacterium
RSGDMVMTSFLAYGAGKAA

SEQ ID NO: 726711 - protein, 17 aa, Mycobacterium
RSGEAIIGLLAILKTGA

SEQ ID NO: 726712 - protein, 19 aa, Mycobacterium
RSGEAVVDMLRRGITARDI

SEQ ID NO: 726713 - protein, 17 aa, Mycobacterium
RSGEFSWKESADAMRTV

SEQ ID NO: 726714 - protein, 18 aa, Mycobacterium
RSGEVALWGDEWPWGLNR

SEQ ID NO: 726715 - protein, 22 aa, Mycobacterium
RSGEVTCIFGPNGCGKSTLLKA

SEQ ID NO: 726716 - protein, 20 aa, Mycobacterium
RSGFASVIIPGRLERVRSAP

SEQ ID NO: 726717 - protein, 19 aa, Mycobacterium
RSGFVTGLTAALVTDDARW

SEQ ID NO: 726718 - protein, 31 aa, Mycobacterium
RSGGAMVYGNFVGRVGALAAALGIGIAIASL

SEQ ID NO: 726719 - protein, 17 aa, Mycobacterium
RSGGIGVDLGGLDHHTP

SEQ ID NO: 726720 - protein, 17 aa, Mycobacterium
RSGGNAMRLDKPLQRYW

SEQ ID NO: 726721 - protein, 21 aa, Mycobacterium
RSGGRPAALYRFTDSRLRVTD

SEQ ID NO: 726722 - protein, 20 aa, Mycobacterium
RSGGRPAAMYRFTDSQLRVT

SEQ ID NO: 726723 - protein, 18 aa, Mycobacterium
RSGIAHFMPVYSSQKAAM

SEQ ID NO: 726724 - protein, 18 aa, Mycobacterium
RSGIPRRGGYTLEHLASD

SEQ ID NO: 726725 - protein, 19 aa, Mycobacterium
RSGIPRRSSYTLKHLASDL

SEQ ID NO: 726726 - protein, 19 aa, Mycobacterium
RSGKFCDTGNCGNRQHVAA

SEQ ID NO: 726727 - protein, 23 aa, Mycobacterium
RSGKHLRRLVALAAELQAVEVVV

SEQ ID NO: 726728 - protein, 22 aa, Mycobacterium
RSGKWIGMRYPYELNLVGDAKD

SEQ ID NO: 726729 - protein, 17 aa, Mycobacterium
RSGLIALLCKTDPAARP

SEQ ID NO: 726730 - protein, 17 aa, Mycobacterium
RSGLIALLCKTDPHATP

SEQ ID NO: 726731 - protein, 17 aa, Mycobacterium
RSGLIALLCKTDPNATP

SEQ ID NO: 726732 - protein, 20 aa, Mycobacterium
RSGLPSGIAVAGSYLDGIGV

SEQ ID NO: 726733 - protein, 24 aa, Mycobacterium
RSGLPTDVPRTWILTTRDRALSVA

SEQ ID NO: 726734 - protein, 20 aa, Mycobacterium
RSGLSATRFVACPFGGSGAR

SEQ ID NO: 726735 - protein, 23 aa, Mycobacterium
RSGLSGLANRAAQSGGTFSVSAM

SEQ ID NO: 726736 - protein, 25 aa, Mycobacterium
RSGLTRKRVLALALRLLDRGYFRAG

SEQ ID NO: 726737 - protein, 17 aa, Mycobacterium
RSGLVARVPLAPDDTTQ

SEQ ID NO: 726738 - protein, 25 aa, Mycobacterium
RSGLYPRELPFVVGTEVCGTVAAIG

SEQ ID NO: 726739 - protein, 18 aa, Mycobacterium
RSGLYYALINTHLTAAEA

SEQ ID NO: 726740 - protein, 17 aa, Mycobacterium
RSGMLGLCGANDFREVH

SEQ ID NO: 726741 - protein, 20 aa, Mycobacterium
RSGMTIGIGGWGSRRKPMAF

SEQ ID NO: 726742 - protein, 21 aa, Mycobacterium
RSGNGREWGPFAFDEFLEVKA

SEQ ID NO: 726743 - protein, 21 aa, Mycobacterium
RSGPCRPAPSSMLLAILSGYE

SEQ ID NO: 726744 - protein, 25 aa, Mycobacterium
RSGPGRRATGCPIAVSRWATSAGSA

SEQ ID NO: 726745 - protein, 17 aa, Mycobacterium
RSGPLAFARAGVSPADI

SEQ ID NO: 726746 - protein, 23 aa, Mycobacterium
RSGQGRLAGKVALITGGARGQGE

SEQ ID NO: 726747 - protein, 25 aa, Mycobacterium
RSGQYPRPLPFIIGSEVCGTVVAIG

SEQ ID NO: 726748 - protein, 21 aa, Mycobacterium
RSGREVLYRLADHHLAHIVVD

SEQ ID NO: 726749 - protein, 21 aa, Mycobacterium
RSGREVLYRLVDHHLADIVVA

SEQ ID NO: 726750 - protein, 25 aa, Mycobacterium
RSGRLGRRRLRGCRGGRLCGRGRGR

SEQ ID NO: 726751 - protein, 17 aa, Mycobacterium
RSGRPRAAPPVRKLAKE

SEQ ID NO: 726752 - protein, 19 aa, Mycobacterium
RSGRRGVVVPPEQVEVFRG

SEQ ID NO: 726753 - protein, 25 aa, Mycobacterium
RSGRRSVCARRPWPTANSGSPTKRC

SEQ ID NO: 726754 - protein, 20 aa, Mycobacterium
RSGRTFRDWLSQEWANIVGH

SEQ ID NO: 726755 - protein, 17 aa, Mycobacterium
RSGRWQGLAKTECGLHA

SEQ ID NO: 726756 - protein, 17 aa, Mycobacterium
RSGRWQGLSKTECGLHA

SEQ ID NO: 726757 - protein, 21 aa, Mycobacterium
RSGRYRPDFDPVIKAVEILAF

SEQ ID NO: 726758 - protein, 18 aa, Mycobacterium
RSGSAPALALLDDGDVLE

SEQ ID NO: 726759 - protein, 18 aa, Mycobacterium
RSGSEWIAKIHRPDPSMT

SEQ ID NO: 726760 - protein, 28 aa, Mycobacterium
RSGSHVWDRLGLRGRFVKCVHSVGAPLA

SEQ ID NO: 726761 - protein, 19 aa, Mycobacterium
RSGSLIALRVPLPGTTFIN

SEQ ID NO: 726762 - protein, 19 aa, Mycobacterium
RSGSVDWLCLPRFDSPSVF

SEQ ID NO: 726763 - protein, 19 aa, Mycobacterium
RSGSYAALGKVPGAVTVDV

SEQ ID NO: 726764 - protein, 18 aa, Mycobacterium
RSGTDINGAVLAAEHQTA

SEQ ID NO: 726765 - protein, 47 aa, Mycobacterium
RSGTIGPREPMDWREITDWDAVCTRIAASEPWWPPGTAQGYQVVTFG

SEQ ID NO: 726766 - protein, 17 aa, Mycobacterium
RSGVDAKLFALEFSALL

SEQ ID NO: 726767 - protein, 30 aa, Mycobacterium
RSGVGAAPLQGRRCGACRIEIDRGESARIA

SEQ ID NO: 726768 - protein, 25 aa, Mycobacterium
RSGVLRFVVLDGLAKPGRLEGPDPS

SEQ ID NO: 726769 - protein, 19 aa, Mycobacterium
RSGVPALALDVWVAYELRR

SEQ ID NO: 726770 - protein, 17 aa, Mycobacterium
RSGWDEMQDGATKVWNA

SEQ ID NO: 726771 - protein, 26 aa, Mycobacterium
RSGYPLELLVRAAAAGWRVVELDVSY

SEQ ID NO: 726772 - protein, 27 aa, Mycobacterium
RSGYPLELLVRAAAAGWRVVELDVSYG

SEQ ID NO: 726773 - protein, 26 aa, Mycobacterium
RSGYPLELLVRAGAAGWRVVELDVSY

SEQ ID NO: 726774 - protein, 20 aa, Mycobacterium
RSHAEARGAQALARVAGYMG

SEQ ID NO: 726775 - protein, 23 aa, Mycobacterium
RSHAHLPGIQFVDALIDSAHQLA

SEQ ID NO: 726776 - protein, 25 aa, Mycobacterium
RSHAWIEAWTGAWWSYDPTNDTEIT

SEQ ID NO: 726777 - protein, 17 aa, Mycobacterium
RSHDRLHTGDQVSMAAD

SEQ ID NO: 726778 - protein, 20 aa, Mycobacterium
RSHFEYRAALVVDSVERARE

SEQ ID NO: 726779 - protein, 23 aa, Mycobacterium
RSHGESFLAFLAERDMERGLFIL

SEQ ID NO: 726780 - protein, 17 aa, Mycobacterium
RSHGGWFPEEWTGEVDG

SEQ ID NO: 726781 - protein, 23 aa, Mycobacterium
RSHLLEHFARLGVTAEPDQASVT

SEQ ID NO: 726782 - protein, 18 aa, Mycobacterium
RSHPCGAVSSGFSPTEIS

SEQ ID NO: 726783 - protein, 21 aa, Mycobacterium
RSHPRFVGAILTRADHIIVLS

SEQ ID NO: 726784 - protein, 22 aa, Mycobacterium
RSHRLADLLTGFLAQLKADLLG

SEQ ID NO: 726785 - protein, 19 aa, Mycobacterium
RSHVFPIGQFADGIAHTLR

SEQ ID NO: 726786 - protein, 18 aa, Mycobacterium
RSHVFPIGQFADRIARTL

SEQ ID NO: 726787 - protein, 20 aa, Mycobacterium
RSHYDLSNEFFRLWQDPTQT

SEQ ID NO: 726788 - protein, 19 aa, Mycobacterium
RSIAHLGVSTFAFSHRLNG

SEQ ID NO: 726789 - protein, 24 aa, Mycobacterium
RSIAVEAYGLFIFRDALAAMGIAT

SEQ ID NO: 726790 - protein, 17 aa, Mycobacterium
RSIEVIGRYHPKEDPSF

SEQ ID NO: 726791 - protein, 22 aa, Mycobacterium
RSIFAPEAWPLRVEVYDAHGRR

SEQ ID NO: 726792 - protein, 20 aa, Mycobacterium
RSIGCSWCVDFGSMLQRLDG

SEQ ID NO: 726793 - protein, 25 aa, Mycobacterium
RSIGEIRGLGVFWAIELVANPESRE

SEQ ID NO: 726794 - protein, 21 aa, Mycobacterium
RSIGVPGILRMLYDVHAEHGA

SEQ ID NO: 726795 - protein, 20 aa, Mycobacterium
RSIGVPGIVRLLDVVHREYG

SEQ ID NO: 726796 - protein, 20 aa, Mycobacterium
RSIGVTRGLGLTALSTGTAS

SEQ ID NO: 726797 - protein, 17 aa, Mycobacterium
RSIKWVRRNVLEYHQRT

SEQ ID NO: 726798 - protein, 21 aa, Mycobacterium
RSILARRYVDGLADLAESGLL

SEQ ID NO: 726799 - protein, 23 aa, Mycobacterium
RSIPDDQFLLYAFDGTADDLDEA

SEQ ID NO: 726800 - protein, 23 aa, Mycobacterium
RSIPEIEIDTVIAVPCRELLLTA

SEQ ID NO: 726801 - protein, 24 aa, Mycobacterium
RSIPELQVDSVLAMPCRELLLTDQ

SEQ ID NO: 726802 - protein, 22 aa, Mycobacterium
RSIPLGAFAHWVGATASRDPIA

SEQ ID NO: 726803 - protein, 18 aa, Mycobacterium
RSIPLSFLVSPRLKGKYR

SEQ ID NO: 726804 - protein, 18 aa, Mycobacterium
RSIRGDEIAMVFQDPMSS

SEQ ID NO: 726805 - protein, 22 aa, Mycobacterium
RSIRVPTVIRLRTFVRVPYRAR

SEQ ID NO: 726806 - protein, 27 aa, Mycobacterium
RSIRYGFVPRRFRLMLTASGVNRFAGP

SEQ ID NO: 726807 - protein, 18 aa, Mycobacterium
RSITANVVAPGFIDTDMT

SEQ ID NO: 726808 - protein, 19 aa, Mycobacterium
RSITLRLTIAPVQRTWSEL

SEQ ID NO: 726809 - protein, 24 aa, Mycobacterium
RSITWDQGIEMARHTDITADLGVP

SEQ ID NO: 726810 - protein, 22 aa, Mycobacterium
RSIYQDGWWACARLDKAPWDLS

SEQ ID NO: 726811 - protein, 24 aa, Mycobacterium
RSKCCGYTLCAAEGPDVYSIDDAG

SEQ ID NO: 726812 - protein, 17 aa, Mycobacterium
RSKCPVTQATPFNVLAV

SEQ ID NO: 726813 - protein, 25 aa, Mycobacterium
RSKGLDCVSVQWGQWHLASAAADTG

SEQ ID NO: 726814 - protein, 25 aa, Mycobacterium
RSKGVLCMHRQPLAASLAWATYGEF

SEQ ID NO: 726815 - protein, 19 aa, Mycobacterium
RSKHGWATVGDIGYVDDEG

SEQ ID NO: 726816 - protein, 24 aa, Mycobacterium
RSKIIKFSGCYHGHVDALLADAGS

SEQ ID NO: 726817 - protein, 18 aa, Mycobacterium
RSKIPAFLEETLRLESPV

SEQ ID NO: 726818 - protein, 22 aa, Mycobacterium
RSKLAVMLWGLELDRRLRAAGS

SEQ ID NO: 726819 - protein, 18 aa, Mycobacterium
RSKLPETLERGAVVESIV

SEQ ID NO: 726820 - protein, 23 aa, Mycobacterium
RSKLRPSDYIFVGGTEAKVAALQ

SEQ ID NO: 726821 - protein, 18 aa, Mycobacterium
RSKREFVDTPGFDGPATV

SEQ ID NO: 726822 - protein, 25 aa, Mycobacterium
RSKREIPHYYLADEIIMEKSLTWLT

SEQ ID NO: 726823 - protein, 28 aa, Mycobacterium
RSKREIPHYYLADEILMEKSLNWLTTRN

SEQ ID NO: 726824 - protein, 35 aa, Mycobacterium
RSKREIPHYYLAEEIMLEKSLSWLTTRNAQRSIDE

SEQ ID NO: 726825 - protein, 19 aa, Mycobacterium
RSKTKFWQMIGRGTRLRPD

SEQ ID NO: 726826 - protein, 24 aa, Mycobacterium
RSKVKRILLTSGKLYYDLLARKNS

SEQ ID NO: 726827 - protein, 24 aa, Mycobacterium
RSKVRRILLTSGKIYYELAARKAK

SEQ ID NO: 726828 - protein, 19 aa, Mycobacterium
RSKYAQAVVQGIVAYLSGT

SEQ ID NO: 726829 - protein, 25 aa, Mycobacterium
RSLAEVGIGFCFAPHFHPSYRYASA

SEQ ID NO: 726830 - protein, 21 aa, Mycobacterium
RSLAGLFWARIEAIAPGIDTL

SEQ ID NO: 726831 - protein, 20 aa, Mycobacterium
RSLAHAVLMMIPEAWERHAS

SEQ ID NO: 726832 - protein, 20 aa, Mycobacterium
RSLAHAVLMMIPEAWERHES

SEQ ID NO: 726833 - protein, 20 aa, Mycobacterium
RSLAHAVLMMIPEAWERNES

SEQ ID NO: 726834 - protein, 18 aa, Mycobacterium
RSLARRGVTRPISAISNG

SEQ ID NO: 726835 - protein, 17 aa, Mycobacterium
RSLARVAPTQAHRYALV

SEQ ID NO: 726836 - protein, 28 aa, Mycobacterium
RSLARYKLPKAIVFRAAIERSPSGKADY

SEQ ID NO: 726837 - protein, 19 aa, Mycobacterium
RSLCDRGAILLGGKAIADG

SEQ ID NO: 726838 - protein, 21 aa, Mycobacterium
RSLCRELLRQGGLALHGALEK

SEQ ID NO: 726839 - protein, 20 aa, Mycobacterium
RSLDFYGMYVLPELEGLDGF

SEQ ID NO: 726840 - protein, 23 aa, Mycobacterium
RSLDLPANLAIPLRVIASTVAIC

SEQ ID NO: 726841 - protein, 19 aa, Mycobacterium
RSLEHLVDVVLHFEGDKHS

SEQ ID NO: 726842 - protein, 19 aa, Mycobacterium
RSLEHLVDVVLHFEGDRAS

SEQ ID NO: 726843 - protein, 20 aa, Mycobacterium
RSLEHLVDVVLHFEGDRASA

SEQ ID NO: 726844 - protein, 27 aa, Mycobacterium
RSLFPEFSELFAAFPSFAGLRPAFDSR

SEQ ID NO: 726845 - protein, 28 aa, Mycobacterium
RSLGKELRRGATVSLVYLSADAKPGATG

SEQ ID NO: 726846 - protein, 19 aa, Mycobacterium
RSLGLSGFRLEITSLGDDT

SEQ ID NO: 726847 - protein, 22 aa, Mycobacterium
RSLGSSGVWELFWPDFPTNGLY

SEQ ID NO: 726848 - protein, 17 aa, Mycobacterium
RSLHIQGGYGFGMEGDI

SEQ ID NO: 726849 - protein, 20 aa, Mycobacterium
RSLIGAWCFADHYGPDDIGQ

SEQ ID NO: 726850 - protein, 17 aa, Mycobacterium
RSLKTTLLAAFDLKSNR

SEQ ID NO: 726851 - protein, 18 aa, Mycobacterium
RSLLAAGITAVSGRFYAG

SEQ ID NO: 726852 - protein, 20 aa, Mycobacterium
RSLLLPGIRIGNRFRGGPKH

SEQ ID NO: 726853 - protein, 20 aa, Mycobacterium
RSLLPAGISAVSGRFFGGDV

SEQ ID NO: 726854 - protein, 18 aa, Mycobacterium
RSLLPAGITAVSGKFFAG

SEQ ID NO: 726855 - protein, 20 aa, Mycobacterium
RSLLRADLPPGGRLGLYGFG

SEQ ID NO: 726856 - protein, 19 aa, Mycobacterium
RSLLRAELPPGGRLGLYGF

SEQ ID NO: 726857 - protein, 20 aa, Mycobacterium
RSLLRAELPPGGRLGLYGFG

SEQ ID NO: 726858 - protein, 17 aa, Mycobacterium
RSLLRARYRDRRKLLEM

SEQ ID NO: 726859 - protein, 17 aa, Mycobacterium
RSLLRARYRDRRKLLET

SEQ ID NO: 726860 - protein, 18 aa, Mycobacterium
RSLLRPGGQLRYLEHVAS

SEQ ID NO: 726861 - protein, 20 aa, Mycobacterium
RSLLRYPQWVPARVVSEQIV

SEQ ID NO: 726862 - protein, 18 aa, Mycobacterium
RSLLSRARELFGANPVEP

SEQ ID NO: 726863 - protein, 18 aa, Mycobacterium
RSLMAARLAAARLPTPQL

SEQ ID NO: 726864 - protein, 17 aa, Mycobacterium
RSLMFHMQALRAGARPA

SEQ ID NO: 726865 - protein, 22 aa, Mycobacterium
RSLNATKVFAWPEAEVAVMGAK

SEQ ID NO: 726866 - protein, 24 aa, Mycobacterium
RSLNEIGIGFCFAPQFHPSYRQAS

SEQ ID NO: 726867 - protein, 25 aa, Mycobacterium
RSLNGRSGYRFGHIEGPMQVQHHDQ

SEQ ID NO: 726868 - protein, 25 aa, Mycobacterium
RSLPAESVGEVWLHGPTVVRGYLGD

SEQ ID NO: 726869 - protein, 23 aa, Mycobacterium
RSLPKLSMHLLDAIAAGPVGIVG

SEQ ID NO: 726870 - protein, 19 aa, Mycobacterium
RSLPLSFSQHRAWSVEQLL

SEQ ID NO: 726871 - protein, 27 aa, Mycobacterium
RSLPYWESVEPFPLPAEQGVEPDPRIG

SEQ ID NO: 726872 - protein, 24 aa, Mycobacterium
RSLQHGVEVIGYWGEAVTTPTQAR

SEQ ID NO: 726873 - protein, 20 aa, Mycobacterium
RSLQKIGLRAAGLVAPAFRL

SEQ ID NO: 726874 - protein, 19 aa, Mycobacterium
RSLRACIDLAALGENTIAI

SEQ ID NO: 726875 - protein, 19 aa, Mycobacterium
RSLREGLKLCQVIDDPWSG

SEQ ID NO: 726876 - protein, 22 aa, Mycobacterium
RSLRKFTEFMISADVSPFAEND

SEQ ID NO: 726877 - protein, 18 aa, Mycobacterium
RSLRLMRAECELDHSKAV

SEQ ID NO: 726878 - protein, 25 aa, Mycobacterium
RSLRRALTLADGWCPYYVSIATAAQ

SEQ ID NO: 726879 - protein, 27 aa, Mycobacterium
RSLRRAVGLADGWMPFGLRTMQIADML

SEQ ID NO: 726880 - protein, 31 aa, Mycobacterium
RSLRRRLTALIQHGFEGIAFVGVPRTMTDGE

SEQ ID NO: 726881 - protein, 17 aa, Mycobacterium
RSLRYLAPQFFAIHSVE

SEQ ID NO: 726882 - protein, 17 aa, Mycobacterium
RSLSIATDVGFRMPSVW

SEQ ID NO: 726883 - protein, 25 aa, Mycobacterium
RSLTIKAMIEKVVDRMYAEIDDNRF

SEQ ID NO: 726884 - protein, 19 aa, Mycobacterium
RSLTKRRRFYALDLTPNST

SEQ ID NO: 726885 - protein, 24 aa, Mycobacterium
RSLVWARGRLREFHPAEVAGAVDL

SEQ ID NO: 726886 - protein, 23 aa, Mycobacterium
RSLVYLPCVQRLTPEVLEELADC

SEQ ID NO: 726887 - protein, 17 aa, Mycobacterium
RSMAIAYWMAERVSAAI

SEQ ID NO: 726888 - protein, 18 aa, Mycobacterium
RSMEVYAGMVDRMDYNVG

SEQ ID NO: 726889 - protein, 18 aa, Mycobacterium
RSMFNVRIGGARRVAAQS

SEQ ID NO: 726890 - protein, 19 aa, Mycobacterium
RSMFRLDNAVLAFRFTATV

SEQ ID NO: 726891 - protein, 19 aa, Mycobacterium
RSMGRRAFRRSVSDAAMGL

SEQ ID NO: 726892 - protein, 21 aa, Mycobacterium
RSMGVPARYVSGYLHPKRDAA

SEQ ID NO: 726893 - protein, 19 aa, Mycobacterium
RSMIHAFANFFPLGGGGAA

SEQ ID NO: 726894 - protein, 22 aa, Mycobacterium
RSMLHRYDIDWEHYGFDEAGLD

SEQ ID NO: 726895 - protein, 25 aa, Mycobacterium
RSMLLKWSDDLVCGLSSHIDPTSET

SEQ ID NO: 726896 - protein, 20 aa, Mycobacterium
RSMLPACGWGTPVRDSKLTV

SEQ ID NO: 726897 - protein, 17 aa, Mycobacterium
RSMMPPRSYAFIDGTGD

SEQ ID NO: 726898 - protein, 23 aa, Mycobacterium
RSMPAGLHWDRILFCAKEATYKA

SEQ ID NO: 726899 - protein, 18 aa, Mycobacterium
RSMPELNGTIAPRDARHS

SEQ ID NO: 726900 - protein, 18 aa, Mycobacterium
RSMSPVEWVRFAANAVGD

SEQ ID NO: 726901 - protein, 19 aa, Mycobacterium
RSMSPVEWVRFAANTVGER

SEQ ID NO: 726902 - protein, 19 aa, Mycobacterium
RSMSPVEWVRFAANTVGQR

SEQ ID NO: 726903 - protein, 31 aa, Mycobacterium
RSMTRLWARMWLLRFTWQRAIDSGDLTSPAF

SEQ ID NO: 726904 - protein, 18 aa, Mycobacterium
RSMVLQWGAADRGLVDAL

SEQ ID NO: 726905 - protein, 30 aa, Mycobacterium
RSNAVALAQAWPGAELRYIAKAKAGGLPEH

SEQ ID NO: 726906 - protein, 22 aa, Mycobacterium
RSNDLWRPSPGSVYPTLQLLDD

SEQ ID NO: 726907 - protein, 23 aa, Mycobacterium
RSNELPTRVLLISAHDESAIVYQ

SEQ ID NO: 726908 - protein, 17 aa, Mycobacterium
RSNGCSYADSPHHVPIQ

SEQ ID NO: 726909 - protein, 25 aa, Mycobacterium
RSNGLWRPSPGSVYPTLQLLDDEGL

SEQ ID NO: 726910 - protein, 24 aa, Mycobacterium
RSNGRPVGRPQLFSRGFSDDAKAL

SEQ ID NO: 726911 - protein, 18 aa, Mycobacterium
RSNIDVFGFELSEEQMST

SEQ ID NO: 726912 - protein, 21 aa, Mycobacterium
RSNMRAGDTLVVIGVGGIGTG

SEQ ID NO: 726913 - protein, 17 aa, Mycobacterium
RSNPTWRQLESALAQLE

SEQ ID NO: 726914 - protein, 19 aa, Mycobacterium
RSNRFARWLVAQGAGTEDV

SEQ ID NO: 726915 - protein, 20 aa, Mycobacterium
RSNWGGTLVALFQPAEETGE

SEQ ID NO: 726916 - protein, 19 aa, Mycobacterium
RSNYVYRAADLAQWRMLMG

SEQ ID NO: 726917 - protein, 17 aa, Mycobacterium
RSPAAPIAAALVTASNA

SEQ ID NO: 726918 - protein, 19 aa, Mycobacterium
RSPAELFTALLTSPDHQLL

SEQ ID NO: 726919 - protein, 20 aa, Mycobacterium
RSPAGARSWGAMLDSYVPGR

SEQ ID NO: 726920 - protein, 17 aa, Mycobacterium
RSPAGKADYRWAKQIAT

SEQ ID NO: 726921 - protein, 24 aa, Mycobacterium
RSPAKSGAESAHWIDPDQVAIPQC

SEQ ID NO: 726922 - protein, 22 aa, Mycobacterium
RSPAPHCVEWILAHPTGITEIL

SEQ ID NO: 726923 - protein, 20 aa, Mycobacterium
RSPDEFSGKILAPAHLPQEQ

SEQ ID NO: 726924 - protein, 24 aa, Mycobacterium
RSPDEFSGKILAPAHLPQEQSQRP

SEQ ID NO: 726925 - protein, 20 aa, Mycobacterium
RSPDGPWWLSVRRNGVDVMR

SEQ ID NO: 726926 - protein, 17 aa, Mycobacterium
RSPDRFVAGTVGEPGNR

SEQ ID NO: 726927 - protein, 19 aa, Mycobacterium
RSPEALVALTRRYQKWLTT

SEQ ID NO: 726928 - protein, 22 aa, Mycobacterium
RSPEEFHALLVREGATVLTQTP

SEQ ID NO: 726929 - protein, 19 aa, Mycobacterium
RSPEEWVGATVGRFGEPDR

SEQ ID NO: 726930 - protein, 17 aa, Mycobacterium
RSPEGIDAFLRRFLLPA

SEQ ID NO: 726931 - protein, 18 aa, Mycobacterium
RSPENLGMLPWFKETAAD

SEQ ID NO: 726932 - protein, 21 aa, Mycobacterium
RSPESLYDFNLATYDEGDSFD

SEQ ID NO: 726933 - protein, 19 aa, Mycobacterium
RSPFAEAFRSNGQSATGTS

SEQ ID NO: 726934 - protein, 17 aa, Mycobacterium
RSPFAHARINGIDTATA

SEQ ID NO: 726935 - protein, 24 aa, Mycobacterium
RSPFHAWSNFEFVDSNGTWSEVDL

SEQ ID NO: 726936 - protein, 17 aa, Mycobacterium
RSPFVTAATAWELQDAT

SEQ ID NO: 726937 - protein, 17 aa, Mycobacterium
RSPGGAGIRLDGGAVLG

SEQ ID NO: 726938 - protein, 17 aa, Mycobacterium
RSPGGAGIRLDGGTNLG

SEQ ID NO: 726939 - protein, 17 aa, Mycobacterium
RSPGGAGIRLDGGTTLG

SEQ ID NO: 726940 - protein, 19 aa, Mycobacterium
RSPGRLRIALSTKVPTPLP

SEQ ID NO: 726941 - protein, 27 aa, Mycobacterium
RSPHEPRLPYASLKAAVATFTRGIART

SEQ ID NO: 726942 - protein, 22 aa, Mycobacterium
RSPHWLCPYGATAVSRAALAEP

SEQ ID NO: 726943 - protein, 19 aa, Mycobacterium
RSPIALSVTLEAVRRAAAM

SEQ ID NO: 726944 - protein, 19 aa, Mycobacterium
RSPIALSVTLEAVRRAAKL

SEQ ID NO: 726945 - protein, 19 aa, Mycobacterium
RSPILHWPDEYGLEYESVS

SEQ ID NO: 726946 - protein, 26 aa, Mycobacterium
RSPKTVAMLMRFQRATSLLALSARRG

SEQ ID NO: 726947 - protein, 19 aa, Mycobacterium
RSPLAPSLRRALHHVRGVK

SEQ ID NO: 726948 - protein, 19 aa, Mycobacterium
RSPLGADFAPLVFEASAID

SEQ ID NO: 726949 - protein, 22 aa, Mycobacterium
RSPLPFARDRWVSAPVSQQIDF

SEQ ID NO: 726950 - protein, 23 aa, Mycobacterium
RSPLPFGRPRWVAYHDAPEIDIA

SEQ ID NO: 726951 - protein, 23 aa, Mycobacterium
RSPLPFGRPRWVAYHEAPDIDVA

SEQ ID NO: 726952 - protein, 18 aa, Mycobacterium
RSPQEWYNSGFAVIAGSV

SEQ ID NO: 726953 - protein, 17 aa, Mycobacterium
RSPQFAVARQWVLRAVG

SEQ ID NO: 726954 - protein, 27 aa, Mycobacterium
RSPRAFAVAARVFLRTAAARARRRQIL

SEQ ID NO: 726955 - protein, 24 aa, Mycobacterium
RSPRAFAVAARVFLRTRAARMRGR

SEQ ID NO: 726956 - protein, 20 aa, Mycobacterium
RSPRAFAVAVRVFARTRAAR

SEQ ID NO: 726957 - protein, 23 aa, Mycobacterium
RSPREVLGILHAVLFAPEDLSLV

SEQ ID NO: 726958 - protein, 23 aa, Mycobacterium
RSPSEHWEVVRIQVPATVARYVV

SEQ ID NO: 726959 - protein, 18 aa, Mycobacterium
RSPSGRIVTQWPYTELEY

SEQ ID NO: 726960 - protein, 18 aa, Mycobacterium
RSPVAVEVPFEMPIGETL

SEQ ID NO: 726961 - protein, 20 aa, Mycobacterium
RSPWARGFERSFALLPAGAS

SEQ ID NO: 726962 - protein, 23 aa, Mycobacterium
RSPWCSGPCRWSCWPARSAPTPT

SEQ ID NO: 726963 - protein, 21 aa, Mycobacterium
RSPYGAAKVYSYWVTRNYREA

SEQ ID NO: 726964 - protein, 18 aa, Mycobacterium
RSPYGVAKVYSYWATRNY

SEQ ID NO: 726965 - protein, 18 aa, Mycobacterium
RSQCLAAALDRAEPWGVW

SEQ ID NO: 726966 - protein, 20 aa, Mycobacterium
RSQEEVDHWLALDPISRYRS

SEQ ID NO: 726967 - protein, 25 aa, Mycobacterium
RSQFGVELVWAIEDCRHLSARLERD

SEQ ID NO: 726968 - protein, 19 aa, Mycobacterium
RSQGFGGRIVLIGRESNLP

SEQ ID NO: 726969 - protein, 29 aa, Mycobacterium
RSQGFIPHCFAAVKHWPIAPYVVEGNPRQ

SEQ ID NO: 726970 - protein, 21 aa, Mycobacterium
RSQGIRLIYDAPRRGTANSRI

SEQ ID NO: 726971 - protein, 19 aa, Mycobacterium
RSQHEIVQLLARVNSEYQV

SEQ ID NO: 726972 - protein, 25 aa, Mycobacterium
RSQKKDPLRLARRIAAALNAPDTYN

SEQ ID NO: 726973 - protein, 22 aa, Mycobacterium
RSQKRLQASNVRDHNMQWDFWT

SEQ ID NO: 726974 - protein, 18 aa, Mycobacterium
RSQLFGLHEFDLEGLSGD

SEQ ID NO: 726975 - protein, 17 aa, Mycobacterium
RSQLRSLLVDDVRRRLR

SEQ ID NO: 726976 - protein, 20 aa, Mycobacterium
RSQMAAALLIHQSGGRIEVR

SEQ ID NO: 726977 - protein, 28 aa, Mycobacterium
RSQRRLGRRGPVHVVDWQNVQGLTPSAL

SEQ ID NO: 726978 - protein, 17 aa, Mycobacterium
RSQRWEGVIAKKRDSTY

SEQ ID NO: 726979 - protein, 20 aa, Mycobacterium
RSQWAPIVFGCQAPDTGNAE

SEQ ID NO: 726980 - protein, 18 aa, Mycobacterium
RSQYGPWAVIAAGDTDTA

SEQ ID NO: 726981 - protein, 21 aa, Mycobacterium
RSRADALAWSVRLVGEHAEEW

SEQ ID NO: 726982 - protein, 21 aa, Mycobacterium
RSRADALAWSVRLVGEHTEEW

SEQ ID NO: 726983 - protein, 17 aa, Mycobacterium
RSRADIVILDIEDAVAP

SEQ ID NO: 726984 - protein, 21 aa, Mycobacterium
RSRAEAFAAVMTAESGKPLAE

SEQ ID NO: 726985 - protein, 29 aa, Mycobacterium
RSRAGVRACGRAFLPADLVTSVRDGLVPT

SEQ ID NO: 726986 - protein, 20 aa, Mycobacterium
RSRANWQVHLARVLRDRIPK

SEQ ID NO: 726987 - protein, 17 aa, Mycobacterium
RSRATWQRHHVLAEAQR

SEQ ID NO: 726988 - protein, 21 aa, Mycobacterium
RSRCPVGWSDNYGGFWTLTRY

SEQ ID NO: 726989 - protein, 24 aa, Mycobacterium
RSRDADGAEAHWRRHLDKTRELLL

SEQ ID NO: 726990 - protein, 18 aa, Mycobacterium
RSRDPSDLRAVLVDITPQ

SEQ ID NO: 726991 - protein, 17 aa, Mycobacterium
RSREELEELYGFLNPDD

SEQ ID NO: 726992 - protein, 20 aa, Mycobacterium
RSREIEVLEFVPASDVDPML

SEQ ID NO: 726993 - protein, 20 aa, Mycobacterium
RSREPVRIVGEVLDWEGPPP

SEQ ID NO: 726994 - protein, 21 aa, Mycobacterium
RSRERGVPRYNEFRRQLRLKP

SEQ ID NO: 726995 - protein, 19 aa, Mycobacterium
RSREVWLVVSGEGKADAVA

SEQ ID NO: 726996 - protein, 19 aa, Mycobacterium
RSRFAEAFRYDGVQRSERS

SEQ ID NO: 726997 - protein, 23 aa, Mycobacterium
RSRFFTDYGAYWPGAAVHESGGA

SEQ ID NO: 726998 - protein, 21 aa, Mycobacterium
RSRGIYVPGHMTVTGFDGVRD

SEQ ID NO: 726999 - protein, 20 aa, Mycobacterium
RSRGLPTMFPTIGGHEGSGI

SEQ ID NO: 727000 - protein, 31 aa, Mycobacterium
RSRGLQAAWELCVPHLQPLIANLVTEAIPRA

SEQ ID NO: 727001 - protein, 20 aa, Mycobacterium
RSRGRALLVDAWDAIRGLPE

SEQ ID NO: 727002 - protein, 22 aa, Mycobacterium
RSRGRVLLWPDTFINNFDPAVG

SEQ ID NO: 727003 - protein, 23 aa, Mycobacterium
RSRGSMKAGVFSGAALAEAPDVA

SEQ ID NO: 727004 - protein, 23 aa, Mycobacterium
RSRGSMKAGVFSGAALTAGTQVA

SEQ ID NO: 727005 - protein, 24 aa, Mycobacterium
RSRGWPINSGTAWNRCAPGYARPT

SEQ ID NO: 727006 - protein, 18 aa, Mycobacterium
RSRHACPHHLRGSAGHTG

SEQ ID NO: 727007 - protein, 24 aa, Mycobacterium
RSRIFPKGLATFIGLRDQTCRTPY

SEQ ID NO: 727008 - protein, 26 aa, Mycobacterium
RSRIFPRGLAAFIGLRDQRCRTPYCD

SEQ ID NO: 727009 - protein, 20 aa, Mycobacterium
RSRIPTFVEEALRMDAPVKS

SEQ ID NO: 727010 - protein, 19 aa, Mycobacterium
RSRKWKRWERGAPMELWQM

SEQ ID NO: 727011 - protein, 17 aa, Mycobacterium
RSRLEVVNPAAAARLSD

SEQ ID NO: 727012 - protein, 18 aa, Mycobacterium
RSRLILRRETVDDLLSLE

SEQ ID NO: 727013 - protein, 17 aa, Mycobacterium
RSRLQVVNPEAAQWLAD

SEQ ID NO: 727014 - protein, 20 aa, Mycobacterium
RSRLRARGVRPDWTRQDDTV

SEQ ID NO: 727015 - protein, 22 aa, Mycobacterium
RSRLRLPPLVPHRHHRCHRYRS

SEQ ID NO: 727016 - protein, 19 aa, Mycobacterium
RSRMLFDYFQQLFAQVTNP

SEQ ID NO: 727017 - protein, 23 aa, Mycobacterium
RSRNGVEVSNHFKFITSEFPVTL

SEQ ID NO: 727018 - protein, 18 aa, Mycobacterium
RSRPCVATAAALYAEILD

SEQ ID NO: 727019 - protein, 19 aa, Mycobacterium
RSRPGVVDVVLVHGSLQNS

SEQ ID NO: 727020 - protein, 19 aa, Mycobacterium
RSRPIAPLLDGLRRLGVRL

SEQ ID NO: 727021 - protein, 21 aa, Mycobacterium
RSRPLITNMIRLLKLPIAVQR

SEQ ID NO: 727022 - protein, 21 aa, Mycobacterium
RSRPLITNMIRLLKLPIPVQR

SEQ ID NO: 727023 - protein, 21 aa, Mycobacterium
RSRPLITNMIRLLRLPIPVQR

SEQ ID NO: 727024 - protein, 22 aa, Mycobacterium
RSRPLWEVYLIQGLQDDKVALL

SEQ ID NO: 727025 - protein, 18 aa, Mycobacterium
RSRQAIWDLVASFKKLGV

SEQ ID NO: 727026 - protein, 18 aa, Mycobacterium
RSRQAIWDLVTSFKKLGI

SEQ ID NO: 727027 - protein, 23 aa, Mycobacterium
RSRQGACVRATWLKVVPDQIERS

SEQ ID NO: 727028 - protein, 19 aa, Mycobacterium
RSRQLGRLFAAVTTKYGAD

SEQ ID NO: 727029 - protein, 25 aa, Mycobacterium
RSRQMWKPSPGSVYPTLQLLVDEGL

SEQ ID NO: 727030 - protein, 22 aa, Mycobacterium
RSRRARPCMIFVAARRSATVSW

SEQ ID NO: 727031 - protein, 18 aa, Mycobacterium
RSRRFALLDLLTGPHGVD

SEQ ID NO: 727032 - protein, 21 aa, Mycobacterium
RSRRINCPGWVGITRWLKPVL

SEQ ID NO: 727033 - protein, 18 aa, Mycobacterium
RSRRSWGIGDLTDLADLA

SEQ ID NO: 727034 - protein, 24 aa, Mycobacterium
RSRSEWGMGQLFVYGMQLVGRKRQ

SEQ ID NO: 727035 - protein, 19 aa, Mycobacterium
RSRSLEMLEGFLSHQEAAA

SEQ ID NO: 727036 - protein, 18 aa, Mycobacterium
RSRSMITLSALVACGHPD

SEQ ID NO: 727037 - protein, 17 aa, Mycobacterium
RSRTDVHADVRLEVAEE

SEQ ID NO: 727038 - protein, 19 aa, Mycobacterium
RSRTGKMLPPKLGLLSYVA

SEQ ID NO: 727039 - protein, 22 aa, Mycobacterium
RSRTGKMLPPKLGLMSYVADAY

SEQ ID NO: 727040 - protein, 18 aa, Mycobacterium
RSRVSWSNFLGAATTTSS

SEQ ID NO: 727041 - protein, 24 aa, Mycobacterium
RSRVTAPAVRRGWLENGPGPDTLL

SEQ ID NO: 727042 - protein, 21 aa, Mycobacterium
RSSAGSWGRERAVLAVVDGEG

SEQ ID NO: 727043 - protein, 17 aa, Mycobacterium
RSSAKWVASEDFSQTIG

SEQ ID NO: 727044 - protein, 23 aa, Mycobacterium
RSSARLTAGIVGYRIPEVLPAQV

SEQ ID NO: 727045 - protein, 20 aa, Mycobacterium
RSSDDFPRAEHLAAKIADVA

SEQ ID NO: 727046 - protein, 19 aa, Mycobacterium
RSSDQVCMWVNRFENETNL

SEQ ID NO: 727047 - protein, 18 aa, Mycobacterium
RSSEEFHALLVREQVSVL

SEQ ID NO: 727048 - protein, 17 aa, Mycobacterium
RSSEMIISGGVNIAPDE

SEQ ID NO: 727049 - protein, 24 aa, Mycobacterium
RSSESGRIAWSFRASGMTADTGKA

SEQ ID NO: 727050 - protein, 24 aa, Mycobacterium
RSSETLEAWTLHIYVRYESAIADL

SEQ ID NO: 727051 - protein, 23 aa, Mycobacterium
RSSFDMCTGRLFAASLLPGAPER

SEQ ID NO: 727052 - protein, 21 aa, Mycobacterium
RSSGGLYRWERRYLRGDDQAE

SEQ ID NO: 727053 - protein, 20 aa, Mycobacterium
RSSGNLLYLLLAHPDQFMAV

SEQ ID NO: 727054 - protein, 19 aa, Mycobacterium
RSSHTWFVLHELLGHKNVK

SEQ ID NO: 727055 - protein, 20 aa, Mycobacterium
RSSHTWFVLHELLGHKNVKN

SEQ ID NO: 727056 - protein, 20 aa, Mycobacterium
RSSHTWFVLQELLGHKNVKN

SEQ ID NO: 727057 - protein, 18 aa, Mycobacterium
RSSKNWFGPTAASITLNF

SEQ ID NO: 727058 - protein, 32 aa, Mycobacterium
RSSKVGLIAGCMITSGVVRRNAKARLLRDNIV

SEQ ID NO: 727059 - protein, 25 aa, Mycobacterium
RSSLTRTESRWGLYHDRADLPDRDD

SEQ ID NO: 727060 - protein, 19 aa, Mycobacterium
RSSLVALDFGNSWSDWAPV

SEQ ID NO: 727061 - protein, 18 aa, Mycobacterium
RSSNPSWRQLESALAELE

SEQ ID NO: 727062 - protein, 23 aa, Mycobacterium
RSSPGACVRVTWARVAHENVERA

SEQ ID NO: 727063 - protein, 24 aa, Mycobacterium
RSSPYATFFDIDWDLDQDGRIVLP

SEQ ID NO: 727064 - protein, 20 aa, Mycobacterium
RSSQTRVHHLQKWKAEGHKW

SEQ ID NO: 727065 - protein, 20 aa, Mycobacterium
RSSRASWRREPVAGIPAATN

SEQ ID NO: 727066 - protein, 20 aa, Mycobacterium
RSSRFTMLIHLPREAGYGLI

SEQ ID NO: 727067 - protein, 21 aa, Mycobacterium
RSSRGNPLFLRHLVEGSMQAG

SEQ ID NO: 727068 - protein, 22 aa, Mycobacterium
RSSRQWLRHIYETWSRTLDFDV

SEQ ID NO: 727069 - protein, 24 aa, Mycobacterium
RSSRTSRIALRFVDHTPPVKPGWH

SEQ ID NO: 727070 - protein, 23 aa, Mycobacterium
RSSRYADFFDIDWDLEVDGQSGR

SEQ ID NO: 727071 - protein, 21 aa, Mycobacterium
RSSTGLLGLIVHDIADPYFSS

SEQ ID NO: 727072 - protein, 17 aa, Mycobacterium
RSSVGFPTPTRHTTYHV

SEQ ID NO: 727073 - protein, 18 aa, Mycobacterium
RSSVGFPTPTRHTTYHVD

SEQ ID NO: 727074 - protein, 19 aa, Mycobacterium
RSSWAAPWTIEANIAAMAA

SEQ ID NO: 727075 - protein, 19 aa, Mycobacterium
RSTASVALMTEFGCENGLA

SEQ ID NO: 727076 - protein, 22 aa, Mycobacterium
RSTAWCRELLTATGRSSDFAAA

SEQ ID NO: 727077 - protein, 20 aa, Mycobacterium
RSTCRALEFHRAVEVIATGR

SEQ ID NO: 727078 - protein, 17 aa, Mycobacterium
RSTELGAHLHARLQDLI

SEQ ID NO: 727079 - protein, 25 aa, Mycobacterium
RSTEMCFYEAELLRLRAHTQDDPAT

SEQ ID NO: 727080 - protein, 18 aa, Mycobacterium
RSTEQWIAAAAYPKYGHP

SEQ ID NO: 727081 - protein, 24 aa, Mycobacterium
RSTEVHDALDLCLACKGCRSDCPV

SEQ ID NO: 727082 - protein, 24 aa, Mycobacterium
RSTEVRDALDLCLSCKGCLSDCPV

SEQ ID NO: 727083 - protein, 24 aa, Mycobacterium
RSTFRKHRDRMAAVAIVAYKPSAS

SEQ ID NO: 727084 - protein, 18 aa, Mycobacterium
RSTGAKVRALPCDVTDTA

SEQ ID NO: 727085 - protein, 23 aa, Mycobacterium
RSTGDPVGFCTWIRPEGPEVQLG

SEQ ID NO: 727086 - protein, 20 aa, Mycobacterium
RSTGVAPWARQVSDAELPSA

SEQ ID NO: 727087 - protein, 31 aa, Mycobacterium
RSTHAVSVEEAWKHVAGLTIANDVGARDIQR

SEQ ID NO: 727088 - protein, 23 aa, Mycobacterium
RSTIRKAAGIGFPGHDPSCSAML

SEQ ID NO: 727089 - protein, 26 aa, Mycobacterium
RSTITFKIKNMWGLLTVKGEFTNFGG

SEQ ID NO: 727090 - protein, 35 aa, Mycobacterium
RSTKRVCRDCGFFLPLAGSLGAMFGVCGNELAADG

SEQ ID NO: 727091 - protein, 17 aa, Mycobacterium
RSTLAGLLKQAGVGSPV

SEQ ID NO: 727092 - protein, 17 aa, Mycobacterium
RSTLGLRLLVLPISATD

SEQ ID NO: 727093 - protein, 17 aa, Mycobacterium
RSTLKIPGVDRLMLPVF

SEQ ID NO: 727094 - protein, 18 aa, Mycobacterium
RSTLPETLEKGAVVESIV

SEQ ID NO: 727095 - protein, 22 aa, Mycobacterium
RSTLYPDSLRTMGYDVGAAGFE

SEQ ID NO: 727096 - protein, 23 aa, Mycobacterium
RSTMFRLAMRMQRLAAPAMRRMH

SEQ ID NO: 727097 - protein, 18 aa, Mycobacterium
RSTMVCLLPAGRAAIEKA

SEQ ID NO: 727098 - protein, 20 aa, Mycobacterium
RSTPHAAEALECLGGNGYVE

SEQ ID NO: 727099 - protein, 24 aa, Mycobacterium
RSTPHAAEALECLGGNGYVEESGM

SEQ ID NO: 727100 - protein, 22 aa, Mycobacterium
RSTRLAAQLVRKGVAPETPVAI

SEQ ID NO: 727101 - protein, 18 aa, Mycobacterium
RSTTRLLDAEFPKFRQLL

SEQ ID NO: 727102 - protein, 17 aa, Mycobacterium
RSTTVAMHLLRRALSGG

SEQ ID NO: 727103 - protein, 17 aa, Mycobacterium
RSTVAVDLLCNVGLTTE

SEQ ID NO: 727104 - protein, 26 aa, Mycobacterium
RSTVYRHWPDKGALIADALAGLSRQP

SEQ ID NO: 727105 - protein, 18 aa, Mycobacterium
RSTYPLGERILELSDVPL

SEQ ID NO: 727106 - protein, 23 aa, Mycobacterium
RSVAALVAWKLGCSPANAHTITT

SEQ ID NO: 727107 - protein, 26 aa, Mycobacterium
RSVAFENSRLAFAFYQHPNWDVEVAE

SEQ ID NO: 727108 - protein, 21 aa, Mycobacterium
RSVAGAAHFLEHLLFKATPTR

SEQ ID NO: 727109 - protein, 18 aa, Mycobacterium
RSVAKFGSPELVEEVLPG

SEQ ID NO: 727110 - protein, 22 aa, Mycobacterium
RSVDGCERLEGLGVTDVIVGFR

SEQ ID NO: 727111 - protein, 24 aa, Mycobacterium
RSVELRIPPFAAVQCVAGPTHTRG

SEQ ID NO: 727112 - protein, 18 aa, Mycobacterium
RSVFGARIARAVHAAVLA

SEQ ID NO: 727113 - protein, 20 aa, Mycobacterium
RSVGLEHRDEFVVASLAGPR

SEQ ID NO: 727114 - protein, 22 aa, Mycobacterium
RSVHGGRIGFVFQDPGTSLNPL

SEQ ID NO: 727115 - protein, 30 aa, Mycobacterium
RSVHRAAAPGACYYVLVFAKGAFPAEFEAR

SEQ ID NO: 727116 - protein, 20 aa, Mycobacterium
RSVIALAYADGVLFVAENPS

SEQ ID NO: 727117 - protein, 19 aa, Mycobacterium
RSVIFAAELRELAARHAGR

SEQ ID NO: 727118 - protein, 17 aa, Mycobacterium
RSVITRWVELPLVEGSR

SEQ ID NO: 727119 - protein, 24 aa, Mycobacterium
RSVKGEVIASTFDRPPSDHTSVAE

SEQ ID NO: 727120 - protein, 21 aa, Mycobacterium
RSVKRHMGGDWSIEIDDKKYT

SEQ ID NO: 727121 - protein, 24 aa, Mycobacterium
RSVKRHMGSDWSIEIDGKKYTAPE

SEQ ID NO: 727122 - protein, 23 aa, Mycobacterium
RSVKRHMGTDWSIEIDDKKYTAQ

SEQ ID NO: 727123 - protein, 24 aa, Mycobacterium
RSVKRHMGTDWSIEIDDKKYTAQE

SEQ ID NO: 727124 - protein, 19 aa, Mycobacterium
RSVKRHMGTDWTVEIDGKN

SEQ ID NO: 727125 - protein, 17 aa, Mycobacterium
RSVKRIAPRTMLCGYAW

SEQ ID NO: 727126 - protein, 17 aa, Mycobacterium
RSVKRNQPAAAITAGMA

SEQ ID NO: 727127 - protein, 20 aa, Mycobacterium
RSVKVEALLQLAAYSETLSA

SEQ ID NO: 727128 - protein, 22 aa, Mycobacterium
RSVKVEALLQMAAYVETLTAAG

SEQ ID NO: 727129 - protein, 18 aa, Mycobacterium
RSVLAHAVHCTRDELARM

SEQ ID NO: 727130 - protein, 21 aa, Mycobacterium
RSVLDRIPGAVILAAHSYGGA

SEQ ID NO: 727131 - protein, 19 aa, Mycobacterium
RSVLRLEYSAHPTAQRTLE

SEQ ID NO: 727132 - protein, 20 aa, Mycobacterium
RSVMAAYFPAVPMVVRAPGV

SEQ ID NO: 727133 - protein, 19 aa, Mycobacterium
RSVNVPTMILSLTADPLHP

SEQ ID NO: 727134 - protein, 20 aa, Mycobacterium
RSVPAKSLASFTAGLLTVHG

SEQ ID NO: 727135 - protein, 22 aa, Mycobacterium
RSVPALVAWKLGCSSANAHTLA

SEQ ID NO: 727136 - protein, 19 aa, Mycobacterium
RSVPFPAALAPELAALMVG

SEQ ID NO: 727137 - protein, 18 aa, Mycobacterium
RSVPLLSRVGADRADQLR

SEQ ID NO: 727138 - protein, 30 aa, Mycobacterium
RSVPNYNEFDLGTVPMWRAFANSCNTTFAK

SEQ ID NO: 727139 - protein, 17 aa, Mycobacterium
RSVREFGDDTYLVTPTG

SEQ ID NO: 727140 - protein, 24 aa, Mycobacterium
RSVREGRQLIGLGVSAASFVTLVS

SEQ ID NO: 727141 - protein, 17 aa, Mycobacterium
RSVRGLVDIDLTDERSL

SEQ ID NO: 727142 - protein, 20 aa, Mycobacterium
RSVRSLVDIDVTDERSLAAA

SEQ ID NO: 727143 - protein, 17 aa, Mycobacterium
RSVRVGQLIAERAKAAG

SEQ ID NO: 727144 - protein, 23 aa, Mycobacterium
RSVSIPPRLPVPDDFALVRYFAA

SEQ ID NO: 727145 - protein, 36 aa, Mycobacterium
RSVTFVTCYETVMPFGGTLHRFEAPRTWHRRLKRII

SEQ ID NO: 727146 - protein, 20 aa, Mycobacterium
RSVTLSGFIDLLGDLPDDVS

SEQ ID NO: 727147 - protein, 25 aa, Mycobacterium
RSVVALAYSEGVLFVAENPSRSLQK

SEQ ID NO: 727148 - protein, 25 aa, Mycobacterium
RSVVISDGWDIMDFVSQLQNLAGGN

SEQ ID NO: 727149 - protein, 18 aa, Mycobacterium
RSVVLAAPVTPYMLNTAD

SEQ ID NO: 727150 - protein, 18 aa, Mycobacterium
RSVVRLHAVLAPIAAAGT

SEQ ID NO: 727151 - protein, 18 aa, Mycobacterium
RSVVSDLIAWHWVGPSSA

SEQ ID NO: 727152 - protein, 20 aa, Mycobacterium
RSVYEPAPRSPALGVGVPAP

SEQ ID NO: 727153 - protein, 24 aa, Mycobacterium
RSWADAVWDTGIDFGTIGVGKDAY

SEQ ID NO: 727154 - protein, 22 aa, Mycobacterium
RSWADAVWDTGIEFGTIGIAKN

SEQ ID NO: 727155 - protein, 18 aa, Mycobacterium
RSWCEPVYNITHWTAMER

SEQ ID NO: 727156 - protein, 18 aa, Mycobacterium
RSWCEPVYNITHWTDMPR

SEQ ID NO: 727157 - protein, 17 aa, Mycobacterium
RSWCPPRPRPPAAGWLR

SEQ ID NO: 727158 - protein, 20 aa, Mycobacterium
RSWFDRYARSFAATIAGGTS

SEQ ID NO: 727159 - protein, 19 aa, Mycobacterium
RSWQKRRAIDLIAPHGGVL

SEQ ID NO: 727160 - protein, 19 aa, Mycobacterium
RSWQKRRAIDLISPHGGVL

SEQ ID NO: 727161 - protein, 17 aa, Mycobacterium
RSWQKRRAIDLITPHGG

SEQ ID NO: 727162 - protein, 26 aa, Mycobacterium
RSWQVRDFLARNGLHYTWFRADDPDG

SEQ ID NO: 727163 - protein, 23 aa, Mycobacterium
RSWSRPEIQGAQFTHAVSLAEAW

SEQ ID NO: 727164 - protein, 17 aa, Mycobacterium
RSYCDFYEVDPPGDKLD

SEQ ID NO: 727165 - protein, 21 aa, Mycobacterium
RSYEISSRYLIGADGGRSLVR

SEQ ID NO: 727166 - protein, 18 aa, Mycobacterium
RSYEKFVPAQVFALPNDQ

SEQ ID NO: 727167 - protein, 20 aa, Mycobacterium
RSYEMPLILNVPTFTICAAT

SEQ ID NO: 727168 - protein, 21 aa, Mycobacterium
RSYFGDKVLRTVIPRSVKVSE

SEQ ID NO: 727169 - protein, 22 aa, Mycobacterium
RSYGGGMLICPGADPTDGLLDI

SEQ ID NO: 727170 - protein, 17 aa, Mycobacterium
RSYLRFAQLASDPGTGV

SEQ ID NO: 727171 - protein, 17 aa, Mycobacterium
RSYLVPIDACYEFVGRL

SEQ ID NO: 727172 - protein, 17 aa, Mycobacterium
RSYLWGSAYAVRHDISF

SEQ ID NO: 727173 - protein, 17 aa, Mycobacterium
RSYPRAVSLEDRYSDLL

SEQ ID NO: 727174 - protein, 25 aa, Mycobacterium
RSYPRAVSLEERFSDLLPPVHLGLD

SEQ ID NO: 727175 - protein, 19 aa, Mycobacterium
RSYQRLSFDSGYEPHPGEP

SEQ ID NO: 727176 - protein, 20 aa, Mycobacterium
RSYRDIDILLVDDIQFIEGK

SEQ ID NO: 727177 - protein, 20 aa, Mycobacterium
RSYRPGELFDAGGRLRAELR

SEQ ID NO: 727178 - protein, 20 aa, Mycobacterium
RSYRPRIVFVDADNKPIDLG

SEQ ID NO: 727179 - protein, 21 aa, Mycobacterium
RSYRRLLQFLRSRDADGAEAH

SEQ ID NO: 727180 - protein, 20 aa, Mycobacterium
RSYVLHPYQMVKDLRTEYEV

SEQ ID NO: 727181 - protein, 25 aa, Mycobacterium
RSYYADFEGVLAFLQRKMSQTESEQ

SEQ ID NO: 727182 - protein, 26 aa, Mycobacterium
RSYYAEFEGVLAFLQRRMEQTESEWA

SEQ ID NO: 727183 - protein, 18 aa, Mycobacterium
RSYYPAGVGRHFAAILGS

SEQ ID NO: 727184 - protein, 20 aa, Mycobacterium
RTAAAGIPIMTTWHGADRVP

SEQ ID NO: 727185 - protein, 20 aa, Mycobacterium
RTAAAYIPRIGALMDAAHRH

SEQ ID NO: 727186 - protein, 20 aa, Mycobacterium
RTAAGMGCRALTIRKPEDFE

SEQ ID NO: 727187 - protein, 18 aa, Mycobacterium
RTAAIIIGDGVSPGNEGR

SEQ ID NO: 727188 - protein, 17 aa, Mycobacterium
RTAALAFEQAYAMTVPP

SEQ ID NO: 727189 - protein, 24 aa, Mycobacterium
RTAARRVLPGASIVKASVGPMDNN

SEQ ID NO: 727190 - protein, 18 aa, Mycobacterium
RTAATFALACAQAGVNLQ

SEQ ID NO: 727191 - protein, 18 aa, Mycobacterium
RTAATILRRRDSRIEHEH

SEQ ID NO: 727192 - protein, 18 aa, Mycobacterium
RTAATLDFDPLTAVHTFA

SEQ ID NO: 727193 - protein, 17 aa, Mycobacterium
RTACAAGAHTIVLTNAA

SEQ ID NO: 727194 - protein, 18 aa, Mycobacterium
RTADEFFALPDEEKRLVA

SEQ ID NO: 727195 - protein, 20 aa, Mycobacterium
RTADGWSVNGQKTFITTGDR

SEQ ID NO: 727196 - protein, 19 aa, Mycobacterium
RTADGYASNWLCDHAHPGM

SEQ ID NO: 727197 - protein, 21 aa, Mycobacterium
RTADGYASNWLCDNAHAGMRI

SEQ ID NO: 727198 - protein, 21 aa, Mycobacterium
RTADGYASNWLCDNAHQGMRI

SEQ ID NO: 727199 - protein, 20 aa, Mycobacterium
RTADGYASNWLCEHARTGMR

SEQ ID NO: 727200 - protein, 21 aa, Mycobacterium
RTADGYGSNWICDNAHAGMHM

SEQ ID NO: 727201 - protein, 20 aa, Mycobacterium
RTADSSGRLYSWAQERPYTT

SEQ ID NO: 727202 - protein, 31 aa, Mycobacterium
RTAEALEDFYARRIAEWSGCVTDAIARGEAP

SEQ ID NO: 727203 - protein, 23 aa, Mycobacterium
RTAEARWTISPMLSGTFSKSATH

SEQ ID NO: 727204 - protein, 17 aa, Mycobacterium
RTAEAVVAILAVLKTGA

SEQ ID NO: 727205 - protein, 20 aa, Mycobacterium
RTAEDIAHIVAFLSTALYTD

SEQ ID NO: 727206 - protein, 20 aa, Mycobacterium
RTAEELGRAFPGTAVITSSG

SEQ ID NO: 727207 - protein, 19 aa, Mycobacterium
RTAEELGRAFPGTSVITSA

SEQ ID NO: 727208 - protein, 20 aa, Mycobacterium
RTAEELVLLASRYDEFAVHV

SEQ ID NO: 727209 - protein, 18 aa, Mycobacterium
RTAEELVMLATRFTEFAV

SEQ ID NO: 727210 - protein, 28 aa, Mycobacterium
RTAEEYSRLLGRAGFRMTRVVATASPYS

SEQ ID NO: 727211 - protein, 21 aa, Mycobacterium
RTAEGTKLFGAVVSDQVLFEA

SEQ ID NO: 727212 - protein, 17 aa, Mycobacterium
RTAEGTKLFSAVANHAV

SEQ ID NO: 727213 - protein, 17 aa, Mycobacterium
RTAELAKQFQVAHGREP

SEQ ID NO: 727214 - protein, 19 aa, Mycobacterium
RTAELMRRLSAEYFEPTEL

SEQ ID NO: 727215 - protein, 19 aa, Mycobacterium
RTAENRHRLVLTIHHVVLD

SEQ ID NO: 727216 - protein, 17 aa, Mycobacterium
RTAEPELLQRLSAADAM

SEQ ID NO: 727217 - protein, 19 aa, Mycobacterium
RTAEQMAEFYAGLLDSYPL

SEQ ID NO: 727218 - protein, 22 aa, Mycobacterium
RTAEQMTEFYAGLLKAYPLVSL

SEQ ID NO: 727219 - protein, 27 aa, Mycobacterium
RTAEYIISWLHRFARGEINTVEVSSEA

SEQ ID NO: 727220 - protein, 21 aa, Mycobacterium
RTAFCDGYAAASGIDPRDSAQ

SEQ ID NO: 727221 - protein, 19 aa, Mycobacterium
RTAFFDEFFLDATRAGIGQ

SEQ ID NO: 727222 - protein, 20 aa, Mycobacterium
RTAFFDEFFLGAADAGVRQV

SEQ ID NO: 727223 - protein, 20 aa, Mycobacterium
RTAFFDEFFLGAADTGVRQV

SEQ ID NO: 727224 - protein, 17 aa, Mycobacterium
RTAFFTTPYLVDGPDGQ

SEQ ID NO: 727225 - protein, 20 aa, Mycobacterium
RTAFLDEFFVKAAREGVRQI

SEQ ID NO: 727226 - protein, 18 aa, Mycobacterium
RTAFRGEGEREVGFRSAL

SEQ ID NO: 727227 - protein, 20 aa, Mycobacterium
RTAGARVVIFAGRVGDDAGV

SEQ ID NO: 727228 - protein, 19 aa, Mycobacterium
RTAGLPSPLPYLTGVRDRD

SEQ ID NO: 727229 - protein, 20 aa, Mycobacterium
RTAGLSLHYVGGVPTHDATT

SEQ ID NO: 727230 - protein, 21 aa, Mycobacterium
RTAGPARKSGSTYGTGVSCSV

SEQ ID NO: 727231 - protein, 19 aa, Mycobacterium
RTAGQSGRTADVFDPSTGS

SEQ ID NO: 727232 - protein, 18 aa, Mycobacterium
RTAGRHWPPEGVLPDDAF

SEQ ID NO: 727233 - protein, 21 aa, Mycobacterium
RTAGSGEAWLAICPATPQLVQ

SEQ ID NO: 727234 - protein, 23 aa, Mycobacterium
RTAHGITGPLFIGRDTHGLSEPA

SEQ ID NO: 727235 - protein, 20 aa, Mycobacterium
RTAHVCAALGEPAPSGLNPR

SEQ ID NO: 727236 - protein, 20 aa, Mycobacterium
RTAIELARKAAQMFAEDPDA

SEQ ID NO: 727237 - protein, 17 aa, Mycobacterium
RTAIQIPSAAHCALEYQ

SEQ ID NO: 727238 - protein, 20 aa, Mycobacterium
RTAIVSPVIINANRALTALL

SEQ ID NO: 727239 - protein, 22 aa, Mycobacterium
RTAKLPDDFRVAIIGAGIAGLT

SEQ ID NO: 727240 - protein, 25 aa, Mycobacterium
RTAKPDALLPLARRETGECLAEDLR

SEQ ID NO: 727241 - protein, 17 aa, Mycobacterium
RTALDAVTACFPAGTLS

SEQ ID NO: 727242 - protein, 25 aa, Mycobacterium
RTALDEWRLLTAAALVGLVEETMTI

SEQ ID NO: 727243 - protein, 20 aa, Mycobacterium
RTALGISLARLGMFAPAMSY

SEQ ID NO: 727244 - protein, 17 aa, Mycobacterium
RTALILPSLGRTDRDVQ

SEQ ID NO: 727245 - protein, 21 aa, Mycobacterium
RTALLEFRFIQRSCTTDTRED

SEQ ID NO: 727246 - protein, 24 aa, Mycobacterium
RTALLGHGLLAWTAAALQDRALLS

SEQ ID NO: 727247 - protein, 29 aa, Mycobacterium
RTALREKWARSITEARLLTAMTPDEIFSE

SEQ ID NO: 727248 - protein, 17 aa, Mycobacterium
RTALSEFSIEGVATNLA

SEQ ID NO: 727249 - protein, 25 aa, Mycobacterium
RTAMAHQVHVGRWDQLDGLVAAAYE

SEQ ID NO: 727250 - protein, 26 aa, Mycobacterium
RTAMEFFEEVLPLLARNDEQLVTLTE

SEQ ID NO: 727251 - protein, 23 aa, Mycobacterium
RTAMQGEAFAYAKYMRYADQARR

SEQ ID NO: 727252 - protein, 26 aa, Mycobacterium
RTAPARAAYLAGIWGAVASLSPELFL

SEQ ID NO: 727253 - protein, 19 aa, Mycobacterium
RTAPDFYFDEMSQIKMDRW

SEQ ID NO: 727254 - protein, 23 aa, Mycobacterium
RTAPLDICFSAGNLLEDSRSADE

SEQ ID NO: 727255 - protein, 25 aa, Mycobacterium
RTAQIKRWSEEAAEQFVDAPVQTFV

SEQ ID NO: 727256 - protein, 19 aa, Mycobacterium
RTARIALLHFLDGEKRYII

SEQ ID NO: 727257 - protein, 18 aa, Mycobacterium
RTARSRRAPTVVIVPSDL

SEQ ID NO: 727258 - protein, 17 aa, Mycobacterium
RTASLALRNGGPKPLRR

SEQ ID NO: 727259 - protein, 20 aa, Mycobacterium
RTATLIPLLRRDGMSDGDVE

SEQ ID NO: 727260 - protein, 19 aa, Mycobacterium
RTATLRMVLAAIQTEEVSG

SEQ ID NO: 727261 - protein, 24 aa, Mycobacterium
RTATVPPVIRIFRAEIGAATDVLS

SEQ ID NO: 727262 - protein, 19 aa, Mycobacterium
RTAVALVKRHGILVETLSS

SEQ ID NO: 727263 - protein, 20 aa, Mycobacterium
RTAVEKVLRGVGLRLMVPDQ

SEQ ID NO: 727264 - protein, 27 aa, Mycobacterium
RTAVGVACLPGGAPVEIELTVGIGVAD

SEQ ID NO: 727265 - protein, 27 aa, Mycobacterium
RTAWRICADNGWWSAFGKRRRGKNGKV

SEQ ID NO: 727266 - protein, 20 aa, Mycobacterium
RTAYDSALWDLGHEDDIESA

SEQ ID NO: 727267 - protein, 22 aa, Mycobacterium
RTAYFAFGRLYFDESLPLDAEL

SEQ ID NO: 727268 - protein, 21 aa, Mycobacterium
RTCDPRTRIWWGAYLGTPDEL

SEQ ID NO: 727269 - protein, 21 aa, Mycobacterium
RTCGREAAEIPVFPRGMTGPR

SEQ ID NO: 727270 - protein, 24 aa, Mycobacterium
RTCLPDPELVPFVTWTYDDNTTGW

SEQ ID NO: 727271 - protein, 17 aa, Mycobacterium
RTCREVGEALSVQYFHV

SEQ ID NO: 727272 - protein, 23 aa, Mycobacterium
RTCRGMWRIGQRALAVAVHRRTS

SEQ ID NO: 727273 - protein, 23 aa, Mycobacterium
RTCSELRDAGFLIEELREPRPTE

SEQ ID NO: 727274 - protein, 18 aa, Mycobacterium
RTCSWNHLVKSYVMGALP

SEQ ID NO: 727275 - protein, 24 aa, Mycobacterium
RTDAGWRIATRTSRVLNGNPDAHA

SEQ ID NO: 727276 - protein, 20 aa, Mycobacterium
RTDALILGPLRLQFWVCGVF

SEQ ID NO: 727277 - protein, 27 aa, Mycobacterium
RTDALSLKLTRLLGERRGYLATRWKNV

SEQ ID NO: 727278 - protein, 19 aa, Mycobacterium
RTDATFLRLAAMTPDAVAD

SEQ ID NO: 727279 - protein, 18 aa, Mycobacterium
RTDDELDEWLARDPIQRL

SEQ ID NO: 727280 - protein, 21 aa, Mycobacterium
RTDDGALRFSVDRDHLDRAVL

SEQ ID NO: 727281 - protein, 25 aa, Mycobacterium
RTDEAKLILGHKAMIVAGGANRTET

SEQ ID NO: 727282 - protein, 19 aa, Mycobacterium
RTDEAKLILGREATIVAGG

SEQ ID NO: 727283 - protein, 32 aa, Mycobacterium
RTDEIRWALDLLRKRFAKVIWIPGNHELWTTQ

SEQ ID NO: 727284 - protein, 30 aa, Mycobacterium
RTDEIRWALDLLRKRFAKVIWVPGNHELWT

SEQ ID NO: 727285 - protein, 31 aa, Mycobacterium
RTDEIRWALDLLRRRFAKVIWVPGNHELWTT

SEQ ID NO: 727286 - protein, 30 aa, Mycobacterium
RTDEIRWSLDLLRRRFAKVIWVPGNHELWT

SEQ ID NO: 727287 - protein, 31 aa, Mycobacterium
RTDEIRWTLDLLRRRFAKVIWVPGNHELWTT

SEQ ID NO: 727288 - protein, 20 aa, Mycobacterium
RTDEMLALMKRLWEPGWTEF

SEQ ID NO: 727289 - protein, 19 aa, Mycobacterium
RTDFPGGDVDDMFRSLQAL

SEQ ID NO: 727290 - protein, 19 aa, Mycobacterium
RTDFPGGNVDDMFRSLQAL

SEQ ID NO: 727291 - protein, 19 aa, Mycobacterium
RTDFWVPRGYVHVIANLRG

SEQ ID NO: 727292 - protein, 20 aa, Mycobacterium
RTDGAPAWLSLERSDNEPGG

SEQ ID NO: 727293 - protein, 17 aa, Mycobacterium
RTDHVWLTGAPGDATAT

SEQ ID NO: 727294 - protein, 23 aa, Mycobacterium
RTDLDPGGAFLRYASDVRTARPG

SEQ ID NO: 727295 - protein, 27 aa, Mycobacterium
RTDLPRPPRCLPRYLPVDSDRKLTAAL

SEQ ID NO: 727296 - protein, 22 aa, Mycobacterium
RTDLRYLLVLHIHRHGLTTVSE

SEQ ID NO: 727297 - protein, 18 aa, Mycobacterium
RTDPAIICLVHDGGDRAV

SEQ ID NO: 727298 - protein, 20 aa, Mycobacterium
RTDPLAVWAEEEFGLREDDE

SEQ ID NO: 727299 - protein, 25 aa, Mycobacterium
RTDPRVSPALAESLAGLAPALIAVA

SEQ ID NO: 727300 - protein, 23 aa, Mycobacterium
RTDRDAWEFALLRAALDRGLPVL

SEQ ID NO: 727301 - protein, 19 aa, Mycobacterium
RTDRERVFLLSTTHGPERG

SEQ ID NO: 727302 - protein, 25 aa, Mycobacterium
RTDRLPFLAPIDWESFEPLLRGGFD

SEQ ID NO: 727303 - protein, 25 aa, Mycobacterium
RTDRLPFLAPIDWESFEPLLRGRVG

SEQ ID NO: 727304 - protein, 19 aa, Mycobacterium
RTDRLPVAILAILKTGAAY

SEQ ID NO: 727305 - protein, 23 aa, Mycobacterium
RTDSELLAALAIHHELHLWLPHP

SEQ ID NO: 727306 - protein, 24 aa, Mycobacterium
RTDSWVRRYPDVHVELVAAGTGRQ

SEQ ID NO: 727307 - protein, 21 aa, Mycobacterium
RTDTADLAWREQIHESCRALR

SEQ ID NO: 727308 - protein, 24 aa, Mycobacterium
RTDTLLPRMEPFVGEHVRLGLAEA

SEQ ID NO: 727309 - protein, 24 aa, Mycobacterium
RTDVDAWILARCSVPLRLATIAEF

SEQ ID NO: 727310 - protein, 20 aa, Mycobacterium
RTDVEDIFWLQATIARELAA

SEQ ID NO: 727311 - protein, 23 aa, Mycobacterium
RTDVEGADGYVWFVADSRHPDYE

SEQ ID NO: 727312 - protein, 18 aa, Mycobacterium
RTDVLALLLAARYEDGSP

SEQ ID NO: 727313 - protein, 25 aa, Mycobacterium
RTDVPQWLAGRGWTVRAIPAEVEMA

SEQ ID NO: 727314 - protein, 21 aa, Mycobacterium
RTDWYVGRVHALFRRVLTFGL

SEQ ID NO: 727315 - protein, 30 aa, Mycobacterium
RTDYLDLLFLHVWDFATPVEEILRGMDDLV

SEQ ID NO: 727316 - protein, 25 aa, Mycobacterium
RTEAELDQLIGFFVNILVLRNDMDG

SEQ ID NO: 727317 - protein, 19 aa, Mycobacterium
RTEAGWKISGTGYDRTYDA

SEQ ID NO: 727318 - protein, 17 aa, Mycobacterium
RTECLRSATAQSRAFVL

SEQ ID NO: 727319 - protein, 23 aa, Mycobacterium
RTEDARVGKSLVVQLKYGPSRER

SEQ ID NO: 727320 - protein, 19 aa, Mycobacterium
RTEFASTWFDAWAEQDIKK

SEQ ID NO: 727321 - protein, 18 aa, Mycobacterium
RTEFDGFIGANFDSPLSL

SEQ ID NO: 727322 - protein, 19 aa, Mycobacterium
RTEHLAWKIAEVAADPVAV

SEQ ID NO: 727323 - protein, 24 aa, Mycobacterium
RTEHLPRITVPTVFTHGTADPFGT

SEQ ID NO: 727324 - protein, 23 aa, Mycobacterium
RTEKSLLFVIPWGSHWIVGTTDT

SEQ ID NO: 727325 - protein, 22 aa, Mycobacterium
RTEKSVLFVIPWGNHWIIGTTD

SEQ ID NO: 727326 - protein, 23 aa, Mycobacterium
RTEKSVLFVIPWGTHWIIGTTDT

SEQ ID NO: 727327 - protein, 18 aa, Mycobacterium
RTELIQLSDYVLGDRSLP

SEQ ID NO: 727328 - protein, 26 aa, Mycobacterium
RTELLRLQRRLGITSLYVTHDQEEAM

SEQ ID NO: 727329 - protein, 18 aa, Mycobacterium
RTELNAVLFNAAQTGVEY

SEQ ID NO: 727330 - protein, 17 aa, Mycobacterium
RTELPFAGHPTVGASWW

SEQ ID NO: 727331 - protein, 21 aa, Mycobacterium
RTELPPLAGVVHLAGVLDDAL

SEQ ID NO: 727332 - protein, 19 aa, Mycobacterium
RTELPSWDSIQLVTAQLAR

SEQ ID NO: 727333 - protein, 23 aa, Mycobacterium
RTENSVMFVIPWGSHWIIGTTDT

SEQ ID NO: 727334 - protein, 26 aa, Mycobacterium
RTENYSGAVGLNWYLTDPTLRFTMAY

SEQ ID NO: 727335 - protein, 25 aa, Mycobacterium
RTEPELDQLIGFFINILVLRNNLDG

SEQ ID NO: 727336 - protein, 22 aa, Mycobacterium
RTEPGSVLLCLTVESVVVADST

SEQ ID NO: 727337 - protein, 20 aa, Mycobacterium
RTEPRLEFDAAVPKDPEIDF

SEQ ID NO: 727338 - protein, 21 aa, Mycobacterium
RTERIRLGTNILLAALRPAAV

SEQ ID NO: 727339 - protein, 25 aa, Mycobacterium
RTESELDQLIGFFINILVLRNDLRD

SEQ ID NO: 727340 - protein, 17 aa, Mycobacterium
RTESGLRIRVGGPDAAA

SEQ ID NO: 727341 - protein, 21 aa, Mycobacterium
RTETFKVLKRQLAADGVDCGD

SEQ ID NO: 727342 - protein, 23 aa, Mycobacterium
RTETGLLAAWSWDDFLRANDDPA

SEQ ID NO: 727343 - protein, 18 aa, Mycobacterium
RTETSMMRYLRSLADKDI

SEQ ID NO: 727344 - protein, 17 aa, Mycobacterium
RTEVLRAVAGFDTPVSG

SEQ ID NO: 727345 - protein, 18 aa, Mycobacterium
RTFACADDAHLVVESAEL

SEQ ID NO: 727346 - protein, 20 aa, Mycobacterium
RTFAEGPHSTVFRVSSPRAE

SEQ ID NO: 727347 - protein, 18 aa, Mycobacterium
RTFALMGPTYVKLGQLIA

SEQ ID NO: 727348 - protein, 19 aa, Mycobacterium
RTFAMLGVHGCVAVAAVTV

SEQ ID NO: 727349 - protein, 19 aa, Mycobacterium
RTFARRFVEETGRTPMQWI

SEQ ID NO: 727350 - protein, 23 aa, Mycobacterium
RTFASAFPKFLWIESREVAEKGI

SEQ ID NO: 727351 - protein, 30 aa, Mycobacterium
RTFEASLPPGRLGWGWAKFAFTGWKTLSWV

SEQ ID NO: 727352 - protein, 17 aa, Mycobacterium
RTFGGLLVAQSFVASTR

SEQ ID NO: 727353 - protein, 17 aa, Mycobacterium
RTFGLMWWRLLVEPSRS

SEQ ID NO: 727354 - protein, 22 aa, Mycobacterium
RTFGRLRRGEWVVANARHTRST

SEQ ID NO: 727355 - protein, 22 aa, Mycobacterium
RTFHYPGGLVDFVKHINRTKNA

SEQ ID NO: 727356 - protein, 19 aa, Mycobacterium
RTFPLRSSFAPSYNMTINL

SEQ ID NO: 727357 - protein, 21 aa, Mycobacterium
RTFPLRSSFAPSYNMTINLVQ

SEQ ID NO: 727358 - protein, 19 aa, Mycobacterium
RTFPLRSSFAPTYNMTINL

SEQ ID NO: 727359 - protein, 22 aa, Mycobacterium
RTFPLRSSFVPSYNMTINLVHR

SEQ ID NO: 727360 - protein, 23 aa, Mycobacterium
RTFQCTGCAALLLEQDSLQQFVD

SEQ ID NO: 727361 - protein, 30 aa, Mycobacterium
RTFSKAYGLAGLRVGYAVADPEIVTALGKV

SEQ ID NO: 727362 - protein, 33 aa, Mycobacterium
RTFSKAYGLAGLRVGYGVGHPELITALDKVVMP

SEQ ID NO: 727363 - protein, 25 aa, Mycobacterium
RTFTSPAFICPVGVLGAVRDRGDLL

SEQ ID NO: 727364 - protein, 18 aa, Mycobacterium
RTFVPWLSTVVNVAVNDS

SEQ ID NO: 727365 - protein, 22 aa, Mycobacterium
RTFYRLHFDSGYAPHAGEPGAE

SEQ ID NO: 727366 - protein, 22 aa, Mycobacterium
RTFYRTEIPEDIRARHAKGGEL

SEQ ID NO: 727367 - protein, 24 aa, Mycobacterium
RTGAEPVARILIGMVAPADSQEIL

SEQ ID NO: 727368 - protein, 18 aa, Mycobacterium
RTGAFYAHQHDGITPDVV

SEQ ID NO: 727369 - protein, 22 aa, Mycobacterium
RTGATLRWYSVTDEGRIDLDSL

SEQ ID NO: 727370 - protein, 23 aa, Mycobacterium
RTGDIDAGIVFHLARHGMSIDEI

SEQ ID NO: 727371 - protein, 19 aa, Mycobacterium
RTGDLGFLHDGELYVCGRI

SEQ ID NO: 727372 - protein, 22 aa, Mycobacterium
RTGDLPAPLPLIGGHEGAGIVR

SEQ ID NO: 727373 - protein, 18 aa, Mycobacterium
RTGDLVCWGEDGQLQYFG

SEQ ID NO: 727374 - protein, 17 aa, Mycobacterium
RTGEARHRFVLTVHHIV

SEQ ID NO: 727375 - protein, 18 aa, Mycobacterium
RTGELLEWAYELVASSQA

SEQ ID NO: 727376 - protein, 19 aa, Mycobacterium
RTGEQPEQFAWSLVVTASD

SEQ ID NO: 727377 - protein, 22 aa, Mycobacterium
RTGEQPEQFAWSLVVTASDLSR

SEQ ID NO: 727378 - protein, 17 aa, Mycobacterium
RTGERVCAVVVPAPAAD

SEQ ID NO: 727379 - protein, 25 aa, Mycobacterium
RTGESLDRLQARLAEMIAPRDTVVD

SEQ ID NO: 727380 - protein, 30 aa, Mycobacterium
RTGEVLSVPVGDAFLGRVINPLGQPIDGQG

SEQ ID NO: 727381 - protein, 30 aa, Mycobacterium
RTGEVLSVPVGDAFLGRVVDPLGHPIDGRG

SEQ ID NO: 727382 - protein, 29 aa, Mycobacterium
RTGEVLSVPVGDAFLGRVVNPLGQPIDGR

SEQ ID NO: 727383 - protein, 30 aa, Mycobacterium
RTGEVYAALAAADWGGRWAIAGPDVDATAL

SEQ ID NO: 727384 - protein, 19 aa, Mycobacterium
RTGFEDGLFASWRSDPSFI

SEQ ID NO: 727385 - protein, 20 aa, Mycobacterium
RTGFEDGLFASWRSDPSFVL

SEQ ID NO: 727386 - protein, 19 aa, Mycobacterium
RTGGFAAVVILTGPDNGES

SEQ ID NO: 727387 - protein, 17 aa, Mycobacterium
RTGGIAIDDVMRTTVPG

SEQ ID NO: 727388 - protein, 20 aa, Mycobacterium
RTGGSRLTFQVTVHVRVPII

SEQ ID NO: 727389 - protein, 18 aa, Mycobacterium
RTGHAEVVLVVFDPREVT

SEQ ID NO: 727390 - protein, 19 aa, Mycobacterium
RTGHLCVAGTALIAGLLKG

SEQ ID NO: 727391 - protein, 18 aa, Mycobacterium
RTGHRIRDRLAGNEQKPE

SEQ ID NO: 727392 - protein, 20 aa, Mycobacterium
RTGHWMQWERAELFNQLVAE

SEQ ID NO: 727393 - protein, 18 aa, Mycobacterium
RTGIFLSYAGGFLEAVDE

SEQ ID NO: 727394 - protein, 17 aa, Mycobacterium
RTGIGPLEFQQQLRMSR

SEQ ID NO: 727395 - protein, 18 aa, Mycobacterium
RTGIKTRRFAAAEESAAS

SEQ ID NO: 727396 - protein, 18 aa, Mycobacterium
RTGIPRLERYGVSDDDAF

SEQ ID NO: 727397 - protein, 18 aa, Mycobacterium
RTGKGASRQARRDGKVPA

SEQ ID NO: 727398 - protein, 21 aa, Mycobacterium
RTGKPAALVPLARREAKECLA

SEQ ID NO: 727399 - protein, 19 aa, Mycobacterium
RTGKSVLVSQVFPVWQLSR

SEQ ID NO: 727400 - protein, 27 aa, Mycobacterium
RTGLFKLCGRLDYRLPDTPIVSAHTGT

SEQ ID NO: 727401 - protein, 24 aa, Mycobacterium
RTGLKSKGARLVWTRQDESVPLPE

SEQ ID NO: 727402 - protein, 22 aa, Mycobacterium
RTGLPLDRRLTILEAVAASIAA

SEQ ID NO: 727403 - protein, 17 aa, Mycobacterium
RTGLPVRVDRRLRETHI

SEQ ID NO: 727404 - protein, 22 aa, Mycobacterium
RTGLSWPDLDDAASVSLLQTLR

SEQ ID NO: 727405 - protein, 17 aa, Mycobacterium
RTGPGVLASPDLVMLRG

SEQ ID NO: 727406 - protein, 18 aa, Mycobacterium
RTGPMLYPTPPFARLAGQ

SEQ ID NO: 727407 - protein, 25 aa, Mycobacterium
RTGQAGPDSVEWTAKYGSVVATGYD

SEQ ID NO: 727408 - protein, 23 aa, Mycobacterium
RTGRANPGMFQRVVIDYYGTPTP

SEQ ID NO: 727409 - protein, 36 aa, Mycobacterium
RTGRDFPDYHALWAWSVEDVEEFWAALWDYFDLGER

SEQ ID NO: 727410 - protein, 18 aa, Mycobacterium
RTGRFVVVGGSGTGKTSL

SEQ ID NO: 727411 - protein, 23 aa, Mycobacterium
RTGRGYLDMFTFFASSALGMNHP

SEQ ID NO: 727412 - protein, 25 aa, Mycobacterium
RTGRGYRFYRLVVVADRGATVDLGD

SEQ ID NO: 727413 - protein, 19 aa, Mycobacterium
RTGRIPLGYFGDAEATERT

SEQ ID NO: 727414 - protein, 17 aa, Mycobacterium
RTGRLFAVSLLPGTPER

SEQ ID NO: 727415 - protein, 21 aa, Mycobacterium
RTGRLKPVVGRVVPLADAPSA

SEQ ID NO: 727416 - protein, 25 aa, Mycobacterium
RTGRMASICTGSFILAQAGLLDGRR

SEQ ID NO: 727417 - protein, 21 aa, Mycobacterium
RTGRMFACDHWNVVPDVYLLG

SEQ ID NO: 727418 - protein, 22 aa, Mycobacterium
RTGRPYYNAIVWQDTRTDSIAA

SEQ ID NO: 727419 - protein, 25 aa, Mycobacterium
RTGRRYLDMFTFFASSALGMNHPGL

SEQ ID NO: 727420 - protein, 25 aa, Mycobacterium
RTGRWARKDKRSFTATHVVLAAGTW

SEQ ID NO: 727421 - protein, 18 aa, Mycobacterium
RTGRWPDVLNQFPEGKVW

SEQ ID NO: 727422 - protein, 19 aa, Mycobacterium
RTGSALTNIARMYGDADDS

SEQ ID NO: 727423 - protein, 19 aa, Mycobacterium
RTGSDHDLKAAGRLSQGML

SEQ ID NO: 727424 - protein, 18 aa, Mycobacterium
RTGSGLQPDLAWTYHYPL

SEQ ID NO: 727425 - protein, 19 aa, Mycobacterium
RTGSRPQALLLPLGPLAEN

SEQ ID NO: 727426 - protein, 19 aa, Mycobacterium
RTGTALSDIARMYGDADDV

SEQ ID NO: 727427 - protein, 32 aa, Mycobacterium
RTGTARVKRGMAEMLKGGVIMDVVTPEQARIA

SEQ ID NO: 727428 - protein, 21 aa, Mycobacterium
RTGTFSINGGNYFSPDSPFGG

SEQ ID NO: 727429 - protein, 24 aa, Mycobacterium
RTGTFSINGGNYFSPDSPFGGYKQ

SEQ ID NO: 727430 - protein, 28 aa, Mycobacterium
RTGTGWTTPMGHRWVFGGGYVAGLGDTL

SEQ ID NO: 727431 - protein, 18 aa, Mycobacterium
RTGTRPLLITLIDGPNMP

SEQ ID NO: 727432 - protein, 20 aa, Mycobacterium
RTGTTIRFWADPDIFETTEY

SEQ ID NO: 727433 - protein, 22 aa, Mycobacterium
RTGTVVSCALPFNGDGPQAGGF

SEQ ID NO: 727434 - protein, 21 aa, Mycobacterium
RTGTYGINWYAFDPCCPFGGY

SEQ ID NO: 727435 - protein, 20 aa, Mycobacterium
RTGTYGINWYAFDPSCPFGG

SEQ ID NO: 727436 - protein, 22 aa, Mycobacterium
RTGVAGLRGLGGRLGRAGEHGH

SEQ ID NO: 727437 - protein, 18 aa, Mycobacterium
RTGVEYDYRGDVIDAHAP

SEQ ID NO: 727438 - protein, 17 aa, Mycobacterium
RTGVFGLGPLDQRHGYS

SEQ ID NO: 727439 - protein, 19 aa, Mycobacterium
RTGVMIEFGPPELRQSYAE

SEQ ID NO: 727440 - protein, 18 aa, Mycobacterium
RTGVPISTHTHAGLRRGL

SEQ ID NO: 727441 - protein, 17 aa, Mycobacterium
RTGVSLRPAVFYFTRPV

SEQ ID NO: 727442 - protein, 26 aa, Mycobacterium
RTGVYGGIDVCRWAAADGVIGNSRTA

SEQ ID NO: 727443 - protein, 21 aa, Mycobacterium
RTGWDVFGKPVALPFGIAPTG

SEQ ID NO: 727444 - protein, 17 aa, Mycobacterium
RTGWPADRYAAGSLDEA

SEQ ID NO: 727445 - protein, 18 aa, Mycobacterium
RTGWSVLFDEFSRGTRPR

SEQ ID NO: 727446 - protein, 19 aa, Mycobacterium
RTGYRAVRERLDYRILAEI

SEQ ID NO: 727447 - protein, 17 aa, Mycobacterium
RTGYSIYTFREKIAAGE

SEQ ID NO: 727448 - protein, 22 aa, Mycobacterium
RTGYTFACDHWGVVPDVYLLGK

SEQ ID NO: 727449 - protein, 17 aa, Mycobacterium
RTHAEAVAGLRALAAGQ

SEQ ID NO: 727450 - protein, 20 aa, Mycobacterium
RTHALQEFFAGHGASGFFEA

SEQ ID NO: 727451 - protein, 18 aa, Mycobacterium
RTHLAAVLADAVIDDPEA

SEQ ID NO: 727452 - protein, 20 aa, Mycobacterium
RTHLQFRRFAGCPICSLHLH

SEQ ID NO: 727453 - protein, 17 aa, Mycobacterium
RTHRGPQPGSCWQYSNL

SEQ ID NO: 727454 - protein, 22 aa, Mycobacterium
RTHTYCILNARTGAIVVGATFP

SEQ ID NO: 727455 - protein, 21 aa, Mycobacterium
RTHVGRLVARYGSRIDDEGGG

SEQ ID NO: 727456 - protein, 17 aa, Mycobacterium
RTIAALGNRLCAALDVK

SEQ ID NO: 727457 - protein, 23 aa, Mycobacterium
RTIADHRIPLWLTALRARHADVA

SEQ ID NO: 727458 - protein, 23 aa, Mycobacterium
RTIAELTVALAMDVATLGGQTRP

SEQ ID NO: 727459 - protein, 18 aa, Mycobacterium
RTIAGVYRDEVGKAPNIA

SEQ ID NO: 727460 - protein, 20 aa, Mycobacterium
RTIAKLSLPDKFLKDTADNA

SEQ ID NO: 727461 - protein, 20 aa, Mycobacterium
RTIAKLSLPDRFLHATADNA

SEQ ID NO: 727462 - protein, 24 aa, Mycobacterium
RTIALEHPEIWRGIIDLDESMPAE

SEQ ID NO: 727463 - protein, 21 aa, Mycobacterium
RTICARAGAGLLAVEPDQPIA

SEQ ID NO: 727464 - protein, 24 aa, Mycobacterium
RTICTLCNALALPVEGWMRPWPGS

SEQ ID NO: 727465 - protein, 19 aa, Mycobacterium
RTIEHVSRRFGIRVTAGPD

SEQ ID NO: 727466 - protein, 34 aa, Mycobacterium
RTIERRTGLKIGVPEEIAWRQGFLSDDELCDRAT

SEQ ID NO: 727467 - protein, 20 aa, Mycobacterium
RTIEVEAGVFVWCMPGDADE

SEQ ID NO: 727468 - protein, 17 aa, Mycobacterium
RTIFEPEHELFRESFKT

SEQ ID NO: 727469 - protein, 25 aa, Mycobacterium
RTIFKRLYDAGLIYRAERLVNWSPV

SEQ ID NO: 727470 - protein, 25 aa, Mycobacterium
RTIFKRLYDAGLIYRAERLVNWSTV

SEQ ID NO: 727471 - protein, 17 aa, Mycobacterium
RTILSALGLPVSYDADA

SEQ ID NO: 727472 - protein, 18 aa, Mycobacterium
RTIPELLEPSRAWDADRI

SEQ ID NO: 727473 - protein, 24 aa, Mycobacterium
RTIPGLDIENYWFRRHEVVYQRLA

SEQ ID NO: 727474 - protein, 19 aa, Mycobacterium
RTITFAGFLKAYVESLDEQ

SEQ ID NO: 727475 - protein, 25 aa, Mycobacterium
RTITFLDIPAAPGFGNTTAGPSSGF

SEQ ID NO: 727476 - protein, 21 aa, Mycobacterium
RTITFPGFLKAYVETVDELAG

SEQ ID NO: 727477 - protein, 21 aa, Mycobacterium
RTITFPGFLSAYVETVDELSG

SEQ ID NO: 727478 - protein, 29 aa, Mycobacterium
RTIWGYPKVMADFTIRHGRQFGFDVSIDG

SEQ ID NO: 727479 - protein, 21 aa, Mycobacterium
RTIWGYPKVMADFTVREARQF

SEQ ID NO: 727480 - protein, 19 aa, Mycobacterium
RTKAIGMGVARDIGFRMPT

SEQ ID NO: 727481 - protein, 21 aa, Mycobacterium
RTKARLAAIPTTRRAEARLQG

SEQ ID NO: 727482 - protein, 22 aa, Mycobacterium
RTKARLAAIPTTRRAEARLQGW

SEQ ID NO: 727483 - protein, 25 aa, Mycobacterium
RTKDGKRLTAELVYSADTGDTPPAD

SEQ ID NO: 727484 - protein, 17 aa, Mycobacterium
RTKDMIVTGGFNVFPRE

SEQ ID NO: 727485 - protein, 20 aa, Mycobacterium
RTKFFDEFFLNATRAGIKQA

SEQ ID NO: 727486 - protein, 17 aa, Mycobacterium
RTKGMERADLLSANAQI

SEQ ID NO: 727487 - protein, 22 aa, Mycobacterium
RTKHKELLADMAARQSALETEY

SEQ ID NO: 727488 - protein, 19 aa, Mycobacterium
RTKRCRIGSSILYGVGRSP

SEQ ID NO: 727489 - protein, 20 aa, Mycobacterium
RTKRCRIGSSILYGVGRSPL

SEQ ID NO: 727490 - protein, 17 aa, Mycobacterium
RTKRVLLGTSVLTPTFR

SEQ ID NO: 727491 - protein, 19 aa, Mycobacterium
RTKSGTVATRLSRTVDDLQ

SEQ ID NO: 727492 - protein, 18 aa, Mycobacterium
RTLACLPGEYGPNLSAMA

SEQ ID NO: 727493 - protein, 20 aa, Mycobacterium
RTLAEFAHLGVLDEEFADGF

SEQ ID NO: 727494 - protein, 19 aa, Mycobacterium
RTLAPPMGRGWEAVADADV

SEQ ID NO: 727495 - protein, 20 aa, Mycobacterium
RTLAPPMGRGWEAVGGDGVW

SEQ ID NO: 727496 - protein, 18 aa, Mycobacterium
RTLARPAAIVTHSIATRA

SEQ ID NO: 727497 - protein, 24 aa, Mycobacterium
RTLARRGPGLVCSRESIVPYALRG

SEQ ID NO: 727498 - protein, 20 aa, Mycobacterium
RTLAVLTLRMPTRKGRYKDG

SEQ ID NO: 727499 - protein, 19 aa, Mycobacterium
RTLCAQGWGAHGRVLTPAG

SEQ ID NO: 727500 - protein, 17 aa, Mycobacterium
RTLDMRGLYQAFTGDDQ

SEQ ID NO: 727501 - protein, 25 aa, Mycobacterium
RTLDSAYPTSDWDSAASDAYLSQNN

SEQ ID NO: 727502 - protein, 17 aa, Mycobacterium
RTLEAYCPVKWQPVVPG

SEQ ID NO: 727503 - protein, 22 aa, Mycobacterium
RTLEILEKFYSVVLTDCGTGLM

SEQ ID NO: 727504 - protein, 18 aa, Mycobacterium
RTLELLWRVPAEARSGRG

SEQ ID NO: 727505 - protein, 18 aa, Mycobacterium
RTLEMVGSIVGTRPPART

SEQ ID NO: 727506 - protein, 25 aa, Mycobacterium
RTLEPWGVVTDRGRWYVVGHDRDRD

SEQ ID NO: 727507 - protein, 17 aa, Mycobacterium
RTLFLARCRAVMTRHYD

SEQ ID NO: 727508 - protein, 21 aa, Mycobacterium
RTLFLPPYVAYGFQTQVDDTE

SEQ ID NO: 727509 - protein, 19 aa, Mycobacterium
RTLFPRPAAVDGVNARVGR

SEQ ID NO: 727510 - protein, 24 aa, Mycobacterium
RTLGEIMAPILYRVQWLVRQIPDP

SEQ ID NO: 727511 - protein, 18 aa, Mycobacterium
RTLGHLILAGVFERHPAL

SEQ ID NO: 727512 - protein, 18 aa, Mycobacterium
RTLGHLILAGVFERYPTL

SEQ ID NO: 727513 - protein, 27 aa, Mycobacterium
RTLGLPATVVDWGLWKSWADAQPQMKA

SEQ ID NO: 727514 - protein, 26 aa, Mycobacterium
RTLGLRPAPEFETWLRKVGMVDDAGR

SEQ ID NO: 727515 - protein, 19 aa, Mycobacterium
RTLGPFTWLKKPAVDGPPA

SEQ ID NO: 727516 - protein, 18 aa, Mycobacterium
RTLGRRTVVAGSQTAELL

SEQ ID NO: 727517 - protein, 23 aa, Mycobacterium
RTLHLPALRPGEVNRATSTMTEP

SEQ ID NO: 727518 - protein, 17 aa, Mycobacterium
RTLIALVMQHLDNSITT

SEQ ID NO: 727519 - protein, 17 aa, Mycobacterium
RTLIEDLNIAWVQHHNA

SEQ ID NO: 727520 - protein, 18 aa, Mycobacterium
RTLIPGVDAAGVLLVGTA

SEQ ID NO: 727521 - protein, 28 aa, Mycobacterium
RTLKDIKLRACDRIEPGPRQVEVRVETV

SEQ ID NO: 727522 - protein, 17 aa, Mycobacterium
RTLLPDRIDSLIAGPGR

SEQ ID NO: 727523 - protein, 19 aa, Mycobacterium
RTLLQELLLAYGPCGQEDA

SEQ ID NO: 727524 - protein, 17 aa, Mycobacterium
RTLLRPGATLAVHEYSV

SEQ ID NO: 727525 - protein, 25 aa, Mycobacterium
RTLMDTHPFGWLPLLSRVLASAQLV

SEQ ID NO: 727526 - protein, 19 aa, Mycobacterium
RTLMHLAFDRHGLEHHPDA

SEQ ID NO: 727527 - protein, 32 aa, Mycobacterium
RTLMRAPIWIYRARAGAVFGSRMLMLEHIGRK

SEQ ID NO: 727528 - protein, 17 aa, Mycobacterium
RTLPAGAVLRWRRVDLA

SEQ ID NO: 727529 - protein, 26 aa, Mycobacterium
RTLPDARLDALAKFTTAMVESRGLPT

SEQ ID NO: 727530 - protein, 24 aa, Mycobacterium
RTLPEGLSGLIWLNTDDASADRAD

SEQ ID NO: 727531 - protein, 25 aa, Mycobacterium
RTLPEILTGAGWYSALFGMQHETSY

SEQ ID NO: 727532 - protein, 17 aa, Mycobacterium
RTLPGATILKASVGPMD

SEQ ID NO: 727533 - protein, 29 aa, Mycobacterium
RTLPITARYAQHWNFAGGPPEEFARKRDV

SEQ ID NO: 727534 - protein, 17 aa, Mycobacterium
RTLPLGSLLIVDDDHAL

SEQ ID NO: 727535 - protein, 25 aa, Mycobacterium
RTLPQLLGEHGWHSALFGMQHETSQ

SEQ ID NO: 727536 - protein, 18 aa, Mycobacterium
RTLPQLLGEQGWYSALFG

SEQ ID NO: 727537 - protein, 19 aa, Mycobacterium
RTLPQQPFMLFGQMTTADP

SEQ ID NO: 727538 - protein, 18 aa, Mycobacterium
RTLPWPAYLTEAFQNLGP

SEQ ID NO: 727539 - protein, 24 aa, Mycobacterium
RTLQAGTDIALWVTTKEVPAVLDR

SEQ ID NO: 727540 - protein, 22 aa, Mycobacterium
RTLRCPYHSWTYALDGKLVAAP

SEQ ID NO: 727541 - protein, 17 aa, Mycobacterium
RTLRDWVEDCLNSIISR

SEQ ID NO: 727542 - protein, 17 aa, Mycobacterium
RTLRGMEPFDYIASQPE

SEQ ID NO: 727543 - protein, 25 aa, Mycobacterium
RTLRITAKYADHWNFVGGTPEEFAR

SEQ ID NO: 727544 - protein, 27 aa, Mycobacterium
RTLRITARYAQHWNFVGGPPDVFAHKR

SEQ ID NO: 727545 - protein, 26 aa, Mycobacterium
RTLRITARYAQHWNFVGGPPEEFARK

SEQ ID NO: 727546 - protein, 27 aa, Mycobacterium
RTLRITARYAQHWNFVGGPPEEFARKR

SEQ ID NO: 727547 - protein, 17 aa, Mycobacterium
RTLRLLIPADGVPRVDA

SEQ ID NO: 727548 - protein, 31 aa, Mycobacterium
RTLRRCGAPLLSLRTDRDWISDIVRFVSQQR

SEQ ID NO: 727549 - protein, 21 aa, Mycobacterium
RTLRRYRYGPGVAKVDFVLSG

SEQ ID NO: 727550 - protein, 17 aa, Mycobacterium
RTLRTLVPVSMRSASDF

SEQ ID NO: 727551 - protein, 23 aa, Mycobacterium
RTLSATEAYEWGLVTEVVPDADL

SEQ ID NO: 727552 - protein, 24 aa, Mycobacterium
RTLSLEMAYRPGGVLASKIHLKHC

SEQ ID NO: 727553 - protein, 17 aa, Mycobacterium
RTLSRRWAGPAFLLNHM

SEQ ID NO: 727554 - protein, 21 aa, Mycobacterium
RTLSYEAFIYFYPLVMMDVTR

SEQ ID NO: 727555 - protein, 26 aa, Mycobacterium
RTLTDWADRGLRVIGLDAGGDTTLDD

SEQ ID NO: 727556 - protein, 22 aa, Mycobacterium
RTLTFPGFLKAYVETVDELVGG

SEQ ID NO: 727557 - protein, 23 aa, Mycobacterium
RTLVERPVWSAAAGTVLAGAGER

SEQ ID NO: 727558 - protein, 24 aa, Mycobacterium
RTLVEVGDYLGCYFMDDRAVVTAL

SEQ ID NO: 727559 - protein, 19 aa, Mycobacterium
RTLVPVSMRSASDFDVTDN

SEQ ID NO: 727560 - protein, 19 aa, Mycobacterium
RTLVPVSVRAVDHFNVAGN

SEQ ID NO: 727561 - protein, 19 aa, Mycobacterium
RTLVRYCVGDLGHPMLWCT

SEQ ID NO: 727562 - protein, 20 aa, Mycobacterium
RTLVRYCVGDLGHPMLWCTS

SEQ ID NO: 727563 - protein, 18 aa, Mycobacterium
RTLVSYGPVADAYLVPAE

SEQ ID NO: 727564 - protein, 20 aa, Mycobacterium
RTLWGKEIAQFQLIQLKLAK

SEQ ID NO: 727565 - protein, 18 aa, Mycobacterium
RTLWGKNIGQFQLIQLKL

SEQ ID NO: 727566 - protein, 18 aa, Mycobacterium
RTLWRMDLTRDRRLRQLP

SEQ ID NO: 727567 - protein, 19 aa, Mycobacterium
RTLYRDQLLVLAALDLAAT

SEQ ID NO: 727568 - protein, 19 aa, Mycobacterium
RTMEGFGVHTFRLVNRKGE

SEQ ID NO: 727569 - protein, 18 aa, Mycobacterium
RTMFGVLFQDGALFGSMN

SEQ ID NO: 727570 - protein, 19 aa, Mycobacterium
RTMFLFIFRAPREGTIAAP

SEQ ID NO: 727571 - protein, 18 aa, Mycobacterium
RTMGPLAVVERDYGAIAQ

SEQ ID NO: 727572 - protein, 21 aa, Mycobacterium
RTMGRVYGWLLICDPPQQSLT

SEQ ID NO: 727573 - protein, 17 aa, Mycobacterium
RTMGYGRCTIVDADNPE

SEQ ID NO: 727574 - protein, 17 aa, Mycobacterium
RTMGYGRCTIVDADNPQ

SEQ ID NO: 727575 - protein, 18 aa, Mycobacterium
RTMLGERLPRYMVPQRIV

SEQ ID NO: 727576 - protein, 23 aa, Mycobacterium
RTMLREYLEAMRALWTQEEAAYD

SEQ ID NO: 727577 - protein, 19 aa, Mycobacterium
RTNGAALEGNWLRTSDLGV

SEQ ID NO: 727578 - protein, 29 aa, Mycobacterium
RTNILPVTFGFPFGLSIVAPVNMPLPTKI

SEQ ID NO: 727579 - protein, 26 aa, Mycobacterium
RTNILPVTFGIPFGFSVVAPVNVPLP

SEQ ID NO: 727580 - protein, 18 aa, Mycobacterium
RTNLVGVLVPRLTDVVLA

SEQ ID NO: 727581 - protein, 28 aa, Mycobacterium
RTNPSWVPEELFGQLLSWLLAGMPKLPA

SEQ ID NO: 727582 - protein, 19 aa, Mycobacterium
RTNRDFVEIDVLGSTLKAR

SEQ ID NO: 727583 - protein, 23 aa, Mycobacterium
RTNSGPHGVQFGPTRRAVGNDER

SEQ ID NO: 727584 - protein, 27 aa, Mycobacterium
RTPAEACYRGELRSHNGLRGVRVLHGY

SEQ ID NO: 727585 - protein, 30 aa, Mycobacterium
RTPALAARFATEFNLPFQPVDVITDQYARV

SEQ ID NO: 727586 - protein, 26 aa, Mycobacterium
RTPAPPGGWPVLAWAHGTVGLGDACT

SEQ ID NO: 727587 - protein, 17 aa, Mycobacterium
RTPAYDGVLGRLWLARG

SEQ ID NO: 727588 - protein, 24 aa, Mycobacterium
RTPDLIPLCHQLALTGVDVDFDVR

SEQ ID NO: 727589 - protein, 25 aa, Mycobacterium
RTPEHLCAAMALPAGVVDRYPHELS

SEQ ID NO: 727590 - protein, 20 aa, Mycobacterium
RTPFVRAFGEFTRMDTIALA

SEQ ID NO: 727591 - protein, 22 aa, Mycobacterium
RTPGGDGWDIITVTLSRADLTR

SEQ ID NO: 727592 - protein, 19 aa, Mycobacterium
RTPGRLDGTYALIGTSTGS

SEQ ID NO: 727593 - protein, 21 aa, Mycobacterium
RTPGRLYGLVNIAGGAAPATW

SEQ ID NO: 727594 - protein, 31 aa, Mycobacterium
RTPGYDGVMGRLWLSRGGTYVLANIRGGGEY

SEQ ID NO: 727595 - protein, 17 aa, Mycobacterium
RTPHFVNENLVFVITDA

SEQ ID NO: 727596 - protein, 24 aa, Mycobacterium
RTPHVLGCIYSVFTEGYWSTAGPS

SEQ ID NO: 727597 - protein, 24 aa, Mycobacterium
RTPIAVEVPFEMPIGETLVRGRID

SEQ ID NO: 727598 - protein, 20 aa, Mycobacterium
RTPIAVEVPFEMPVGDTVVR

SEQ ID NO: 727599 - protein, 19 aa, Mycobacterium
RTPIPKVYLCSAATPPGAG

SEQ ID NO: 727600 - protein, 19 aa, Mycobacterium
RTPIPKVYLCSAATPPGGG

SEQ ID NO: 727601 - protein, 22 aa, Mycobacterium
RTPKASARWFAEVTRRNGVPHV

SEQ ID NO: 727602 - protein, 25 aa, Mycobacterium
RTPKDAWRSSRPSWNHHVGSAEYLR

SEQ ID NO: 727603 - protein, 19 aa, Mycobacterium
RTPLDLMDKRILVVGLGNS

SEQ ID NO: 727604 - protein, 20 aa, Mycobacterium
RTPLFPFGFGLSYTTFSYSE

SEQ ID NO: 727605 - protein, 20 aa, Mycobacterium
RTPLGRPGAKIAVIMSTIDY

SEQ ID NO: 727606 - protein, 25 aa, Mycobacterium
RTPLSSRHFVRWLTVWNNTVDEMFQ

SEQ ID NO: 727607 - protein, 20 aa, Mycobacterium
RTPMGASLANGGRPYSQAFL

SEQ ID NO: 727608 - protein, 17 aa, Mycobacterium
RTPRALVDVARQILASS

SEQ ID NO: 727609 - protein, 24 aa, Mycobacterium
RTPRGRVATALAWTHLGMSPPAGV

SEQ ID NO: 727610 - protein, 24 aa, Mycobacterium
RTPRGRVATALAWTHLGMTPPAGA

SEQ ID NO: 727611 - protein, 25 aa, Mycobacterium
RTPRGRVATPLAWTHLGLQPPVTGI

SEQ ID NO: 727612 - protein, 24 aa, Mycobacterium
RTPRGRVATPLAWTHLGLTPPPQL

SEQ ID NO: 727613 - protein, 28 aa, Mycobacterium
RTPRLAAKYAAEFNVPFAPPDVTEKQYQ

SEQ ID NO: 727614 - protein, 26 aa, Mycobacterium
RTPRQGPVFLEVCLDTQAALPLAGQD

SEQ ID NO: 727615 - protein, 23 aa, Mycobacterium
RTPRSAIAHGFAFTSENRKDEGV

SEQ ID NO: 727616 - protein, 18 aa, Mycobacterium
RTPSGFDIEYGWDAVTVD

SEQ ID NO: 727617 - protein, 19 aa, Mycobacterium
RTPSGFRLNGTKSLVPAAA

SEQ ID NO: 727618 - protein, 24 aa, Mycobacterium
RTPSLWAPDLFLLRQIHRAPRLTV

SEQ ID NO: 727619 - protein, 28 aa, Mycobacterium
RTPSLWIPDLFMLRQIHHAPRLTVNAAA

SEQ ID NO: 727620 - protein, 18 aa, Mycobacterium
RTPTGLRDRVRWRGWSAG

SEQ ID NO: 727621 - protein, 21 aa, Mycobacterium
RTPVPAEFEATVPLGSTDMGN

SEQ ID NO: 727622 - protein, 18 aa, Mycobacterium
RTPVPGLYLSGGGTHPGP

SEQ ID NO: 727623 - protein, 21 aa, Mycobacterium
RTPVVPLYSSVSFDPRERPIM

SEQ ID NO: 727624 - protein, 22 aa, Mycobacterium
RTQARRGPGLVCSRESTVPYAL

SEQ ID NO: 727625 - protein, 26 aa, Mycobacterium
RTQEFPVGFDVWWFRLPRPETDEMYT

SEQ ID NO: 727626 - protein, 17 aa, Mycobacterium
RTQLERAAACWTAGQYA

SEQ ID NO: 727627 - protein, 19 aa, Mycobacterium
RTQLGWRPVHSSAETLAAL

SEQ ID NO: 727628 - protein, 17 aa, Mycobacterium
RTQLLCEAVDYAAEFMA

SEQ ID NO: 727629 - protein, 19 aa, Mycobacterium
RTQLLGGRFVSALTGSAPI

SEQ ID NO: 727630 - protein, 20 aa, Mycobacterium
RTQLPITAWQQHFAGATTGI

SEQ ID NO: 727631 - protein, 19 aa, Mycobacterium
RTQLPITTWQQHFADATTG

SEQ ID NO: 727632 - protein, 19 aa, Mycobacterium
RTQLPITTWQQHFGDATTG

SEQ ID NO: 727633 - protein, 18 aa, Mycobacterium
RTQMPLLLDEYTRNAATG

SEQ ID NO: 727634 - protein, 20 aa, Mycobacterium
RTQPSVRRTVSFLARNIAQL

SEQ ID NO: 727635 - protein, 30 aa, Mycobacterium
RTQPWLADHRIAGVMLFPGAGFVELAIRAG

SEQ ID NO: 727636 - protein, 19 aa, Mycobacterium
RTQQLLGWYTRVVTSLDEY

SEQ ID NO: 727637 - protein, 24 aa, Mycobacterium
RTQRGKWAYYRLVPAALDALGGVF

SEQ ID NO: 727638 - protein, 28 aa, Mycobacterium
RTQSFEWIDCPGFDLAHHVRWVAIPRPG

SEQ ID NO: 727639 - protein, 25 aa, Mycobacterium
RTQWWGRQMLIWGVHVHVGISSANK

SEQ ID NO: 727640 - protein, 24 aa, Mycobacterium
RTQWWGRQMLIWGVHVHVGVSSAN

SEQ ID NO: 727641 - protein, 19 aa, Mycobacterium
RTQWWGRQMTIWGVHVHVG

SEQ ID NO: 727642 - protein, 18 aa, Mycobacterium
RTRAMLWTPASFRRRGIY

SEQ ID NO: 727643 - protein, 23 aa, Mycobacterium
RTRARFPGDESRIPVVYVTAPPK

SEQ ID NO: 727644 - protein, 18 aa, Mycobacterium
RTRCGWIDESRLSPEDFT

SEQ ID NO: 727645 - protein, 18 aa, Mycobacterium
RTRCRDIAAAFGGGQYVH

SEQ ID NO: 727646 - protein, 26 aa, Mycobacterium
RTRDRKGYHVEYGFSCMGYEIAGGIG

SEQ ID NO: 727647 - protein, 24 aa, Mycobacterium
RTRDRLDWTILRPGLLTDTAPTGS

SEQ ID NO: 727648 - protein, 28 aa, Mycobacterium
RTRDTALYRYLWRSVLAFDGAARFRTRL

SEQ ID NO: 727649 - protein, 20 aa, Mycobacterium
RTRDVDWRKRQLLQLVKLME

SEQ ID NO: 727650 - protein, 25 aa, Mycobacterium
RTRDVEWRRRQLLQLAKLMEENEAA

SEQ ID NO: 727651 - protein, 19 aa, Mycobacterium
RTRELFTACDFFDEVVQRH

SEQ ID NO: 727652 - protein, 22 aa, Mycobacterium
RTRELVTREGIFAGISTGAVLH

SEQ ID NO: 727653 - protein, 17 aa, Mycobacterium
RTRERRRVGTLTTVTGD

SEQ ID NO: 727654 - protein, 26 aa, Mycobacterium
RTREYQWRKAQLVGLERLFKENEAAI

SEQ ID NO: 727655 - protein, 23 aa, Mycobacterium
RTRGEILRSVFEKITERADDIAA

SEQ ID NO: 727656 - protein, 28 aa, Mycobacterium
RTRGGKISFTHLLGYAIVQAVKKFPNMN

SEQ ID NO: 727657 - protein, 29 aa, Mycobacterium
RTRGGKISFTHLLGYAIVQAVKKFPNMNR

SEQ ID NO: 727658 - protein, 19 aa, Mycobacterium
RTRGIRYIVLTGITTDVCV

SEQ ID NO: 727659 - protein, 17 aa, Mycobacterium
RTRIEAYSFLKHIGDVT

SEQ ID NO: 727660 - protein, 31 aa, Mycobacterium
RTRILHPIWEWDGTDLFGWIATVPTPLKRAH

SEQ ID NO: 727661 - protein, 18 aa, Mycobacterium
RTRKNARGDTEWIPPAHL

SEQ ID NO: 727662 - protein, 25 aa, Mycobacterium
RTRKYKGACIFLNRPGFPTGIGCAL

SEQ ID NO: 727663 - protein, 18 aa, Mycobacterium
RTRLHGVRTNRDLLVNVL

SEQ ID NO: 727664 - protein, 18 aa, Mycobacterium
RTRLKLRGSVPLSVVITR

SEQ ID NO: 727665 - protein, 22 aa, Mycobacterium
RTRLLDRMKEQWRADLTADGLD

SEQ ID NO: 727666 - protein, 19 aa, Mycobacterium
RTRLLVVRAGFPAPQTQLV

SEQ ID NO: 727667 - protein, 18 aa, Mycobacterium
RTRLPRGTDIVADITVAV

SEQ ID NO: 727668 - protein, 39 aa, Mycobacterium
RTRLRTGCRNCVAVPMFHGFGLGQLMLTLALGGTVLTQR

SEQ ID NO: 727669 - protein, 21 aa, Mycobacterium
RTRLTAPLRRRADGSYEEIDW

SEQ ID NO: 727670 - protein, 30 aa, Mycobacterium
RTRLTRRGFMAAGIAGGLALTACSQTKPEP

SEQ ID NO: 727671 - protein, 20 aa, Mycobacterium
RTRMIEPTPMLGRLPGLEPD

SEQ ID NO: 727672 - protein, 17 aa, Mycobacterium
RTRMIYVRAADNHPIHE

SEQ ID NO: 727673 - protein, 17 aa, Mycobacterium
RTRNVQWRKQQLLQLQR

SEQ ID NO: 727674 - protein, 18 aa, Mycobacterium
RTRPFRVNYGLSERGVVD

SEQ ID NO: 727675 - protein, 21 aa, Mycobacterium
RTRPVRIAPRIALAAKALNTI

SEQ ID NO: 727676 - protein, 23 aa, Mycobacterium
RTRPWRADTIVNVWSSTKTVTAL

SEQ ID NO: 727677 - protein, 23 aa, Mycobacterium
RTRQRCARRIKRFVASGTLEESR

SEQ ID NO: 727678 - protein, 25 aa, Mycobacterium
RTRRRDAERFLRRKLGDLPAAPLTE

SEQ ID NO: 727679 - protein, 20 aa, Mycobacterium
RTRSKEILAATGISPEQRSK

SEQ ID NO: 727680 - protein, 25 aa, Mycobacterium
RTRSMPAIPILAGTTRDEWRIFDAA

SEQ ID NO: 727681 - protein, 18 aa, Mycobacterium
RTRSVEWRRNQLLQLQRL

SEQ ID NO: 727682 - protein, 19 aa, Mycobacterium
RTRSVIDFSGRRVRAPSFE

SEQ ID NO: 727683 - protein, 18 aa, Mycobacterium
RTRTLGIRDGVVATVSDA

SEQ ID NO: 727684 - protein, 26 aa, Mycobacterium
RTRTRLGDPPAWFGVIKPLQIAPVAA

SEQ ID NO: 727685 - protein, 18 aa, Mycobacterium
RTRVDVALVGTVKDTLQQ

SEQ ID NO: 727686 - protein, 18 aa, Mycobacterium
RTRVELVSGARSRLKRFR

SEQ ID NO: 727687 - protein, 18 aa, Mycobacterium
RTRVEPHAALSTTVDAVA

SEQ ID NO: 727688 - protein, 20 aa, Mycobacterium
RTRVPASILAAVAHGELLTL

SEQ ID NO: 727689 - protein, 24 aa, Mycobacterium
RTRVSFEVAGKWMSADVINVSASG

SEQ ID NO: 727690 - protein, 24 aa, Mycobacterium
RTRVSFEVAGKWMSADVVNVSAAG

SEQ ID NO: 727691 - protein, 23 aa, Mycobacterium
RTRVVRIAPRISVMSAATNAVAP

SEQ ID NO: 727692 - protein, 21 aa, Mycobacterium
RTRYASCGEIDIAYQVFGDGP

SEQ ID NO: 727693 - protein, 22 aa, Mycobacterium
RTRYASCGEIDIAYQVFGDGPI

SEQ ID NO: 727694 - protein, 17 aa, Mycobacterium
RTSAEWKWVGVPDLTEL

SEQ ID NO: 727695 - protein, 21 aa, Mycobacterium
RTSAPPAPRGVRGMWKTLRAA

SEQ ID NO: 727696 - protein, 18 aa, Mycobacterium
RTSDGWRIARRRFTSVRV

SEQ ID NO: 727697 - protein, 20 aa, Mycobacterium
RTSDGYVCILPYTDANWRGF

SEQ ID NO: 727698 - protein, 24 aa, Mycobacterium
RTSDLIPLCHQLALTGVDVDFTMA

SEQ ID NO: 727699 - protein, 23 aa, Mycobacterium
RTSDLIPLCHQLALTGVDVEFTV

SEQ ID NO: 727700 - protein, 24 aa, Mycobacterium
RTSDLVPLCHPLAITGVDIDFTVG

SEQ ID NO: 727701 - protein, 19 aa, Mycobacterium
RTSEALYLLQRVRDEAHRF

SEQ ID NO: 727702 - protein, 19 aa, Mycobacterium
RTSEAVGRFIFIDTAKPEI

SEQ ID NO: 727703 - protein, 25 aa, Mycobacterium
RTSECVPAMVVVHAWQRPQPGPPSS

SEQ ID NO: 727704 - protein, 22 aa, Mycobacterium
RTSEFLTHPAFHRYRTETEMMR

SEQ ID NO: 727705 - protein, 19 aa, Mycobacterium
RTSEFLTHPAFTQYRTETA

SEQ ID NO: 727706 - protein, 24 aa, Mycobacterium
RTSELIPLCHQLALTGVDIEFDVA

SEQ ID NO: 727707 - protein, 18 aa, Mycobacterium
RTSGAVDIVVCDTIGQAI

SEQ ID NO: 727708 - protein, 26 aa, Mycobacterium
RTSGELWVLIGPEARGAWVESNHYVT

SEQ ID NO: 727709 - protein, 28 aa, Mycobacterium
RTSGEQRLSGFLLWQSAYSEMWFTDAYW

SEQ ID NO: 727710 - protein, 21 aa, Mycobacterium
RTSGGPLMFGGPMQPPMLGAL

SEQ ID NO: 727711 - protein, 25 aa, Mycobacterium
RTSGLIKVAPYLARTMPQLLSVECW

SEQ ID NO: 727712 - protein, 20 aa, Mycobacterium
RTSGRPNPDFDVRIIDERGD

SEQ ID NO: 727713 - protein, 17 aa, Mycobacterium
RTSHQLLGALGFCDESD

SEQ ID NO: 727714 - protein, 32 aa, Mycobacterium
RTSIEPDWLLGYWSDRVHRLLGACVRDRDLVP

SEQ ID NO: 727715 - protein, 23 aa, Mycobacterium
RTSLRPFTAPGLKTAYTPGRVGI

SEQ ID NO: 727716 - protein, 18 aa, Mycobacterium
RTSMELGGNAPFIVFDDA

SEQ ID NO: 727717 - protein, 22 aa, Mycobacterium
RTSNEAAFCYQLLVRSLGTNNL

SEQ ID NO: 727718 - protein, 19 aa, Mycobacterium
RTSPEAWSETANGLQEKSA

SEQ ID NO: 727719 - protein, 29 aa, Mycobacterium
RTSPHLPLSWQRKAVQLIAPMLGTDPTMY

SEQ ID NO: 727720 - protein, 24 aa, Mycobacterium
RTSPRVRTLLSFLRKQLAQRCIPL

SEQ ID NO: 727721 - protein, 25 aa, Mycobacterium
RTSRLRRHARLRKKVSGTAERPRLV

SEQ ID NO: 727722 - protein, 19 aa, Mycobacterium
RTSRPVALIPLARRDIPDC

SEQ ID NO: 727723 - protein, 18 aa, Mycobacterium
RTSVELLAPHAGTPGLDI

SEQ ID NO: 727724 - protein, 18 aa, Mycobacterium
RTSVELLAPHAGTPGLEI

SEQ ID NO: 727725 - protein, 19 aa, Mycobacterium
RTSVPHLQRILAHLEDALT

SEQ ID NO: 727726 - protein, 23 aa, Mycobacterium
RTSVPPFTWWRGIRARQLLENYF

SEQ ID NO: 727727 - protein, 22 aa, Mycobacterium
RTSVPPFTWWRGLKARQLLEHY

SEQ ID NO: 727728 - protein, 20 aa, Mycobacterium
RTTAELLPRFETITYGELGE

SEQ ID NO: 727729 - protein, 21 aa, Mycobacterium
RTTAKLLPRFDTITYRQLAGR

SEQ ID NO: 727730 - protein, 17 aa, Mycobacterium
RTTALGRASSPVWSSVA

SEQ ID NO: 727731 - protein, 19 aa, Mycobacterium
RTTALGRVCTPVWSSVALH

SEQ ID NO: 727732 - protein, 17 aa, Mycobacterium
RTTALVYSVGWTQHTLG

SEQ ID NO: 727733 - protein, 24 aa, Mycobacterium
RTTARPGAVVRRARGFLDEDMDAL

SEQ ID NO: 727734 - protein, 20 aa, Mycobacterium
RTTCAPWLDAEYRLTGTDVR

SEQ ID NO: 727735 - protein, 24 aa, Mycobacterium
RTTDPSWVSLMFLASGLVVDIGGM

SEQ ID NO: 727736 - protein, 17 aa, Mycobacterium
RTTEPLRYEELFSGVDL

SEQ ID NO: 727737 - protein, 21 aa, Mycobacterium
RTTEVMLSGAIVRAVEGDTLV

SEQ ID NO: 727738 - protein, 17 aa, Mycobacterium
RTTFEVFARRLPEGRRY

SEQ ID NO: 727739 - protein, 22 aa, Mycobacterium
RTTFTLVPEVVDFVAERSPDTL

SEQ ID NO: 727740 - protein, 17 aa, Mycobacterium
RTTGDAVVLTWRQYADR

SEQ ID NO: 727741 - protein, 22 aa, Mycobacterium
RTTGEFAIRVFPGDHFYLNNNL

SEQ ID NO: 727742 - protein, 33 aa, Mycobacterium
RTTGKRDLRCIFIEANPAYFCSLREGLTEFAQD

SEQ ID NO: 727743 - protein, 17 aa, Mycobacterium
RTTGKVDSMLGISSADV

SEQ ID NO: 727744 - protein, 24 aa, Mycobacterium
RTTHELRGLFELAADCLAPDGRLV

SEQ ID NO: 727745 - protein, 27 aa, Mycobacterium
RTTHPEFRMATGLVESGGRLWLGSIGG

SEQ ID NO: 727746 - protein, 26 aa, Mycobacterium
RTTLTCPFHGWTFRNDGTLLKVKDPD

SEQ ID NO: 727747 - protein, 21 aa, Mycobacterium
RTTPMKFQWAKGYSDYHPERP

SEQ ID NO: 727748 - protein, 26 aa, Mycobacterium
RTTPVGPRLSALVDHTIWFHRAADFT

SEQ ID NO: 727749 - protein, 30 aa, Mycobacterium
RTTQAFSIERAERWGAWALGKLDDLNLLSR

SEQ ID NO: 727750 - protein, 18 aa, Mycobacterium
RTTQAGLVGTNWFGQNTP

SEQ ID NO: 727751 - protein, 24 aa, Mycobacterium
RTTSFSDRAAWALSTADLLEAEAD

SEQ ID NO: 727752 - protein, 19 aa, Mycobacterium
RTTTGWKGLINDPGMDGSF

SEQ ID NO: 727753 - protein, 19 aa, Mycobacterium
RTTVGKYWVVDDIRPAFIH

SEQ ID NO: 727754 - protein, 21 aa, Mycobacterium
RTTVHRDRVAAALGGRQSAII

SEQ ID NO: 727755 - protein, 18 aa, Mycobacterium
RTTWFADPWGVVFILVEK

SEQ ID NO: 727756 - protein, 25 aa, Mycobacterium
RTTWTPWLKAWRMLIDAKYHGDIYE

SEQ ID NO: 727757 - protein, 25 aa, Mycobacterium
RTVAAHLYKVFPKLGITRRNQLHAA

SEQ ID NO: 727758 - protein, 24 aa, Mycobacterium
RTVADAALLLGVLAGRDGLDPRQP

SEQ ID NO: 727759 - protein, 24 aa, Mycobacterium
RTVAVDLRQNWPKALIEAGLDTSQ

SEQ ID NO: 727760 - protein, 20 aa, Mycobacterium
RTVDLHWQRVQVLRSAVGSL

SEQ ID NO: 727761 - protein, 18 aa, Mycobacterium
RTVEEYGKIVDYLVDQIA

SEQ ID NO: 727762 - protein, 27 aa, Mycobacterium
RTVEHYLRIPFALTKSAVPHMRGQGAG

SEQ ID NO: 727763 - protein, 17 aa, Mycobacterium
RTVELLVDYLYGVLALP

SEQ ID NO: 727764 - protein, 18 aa, Mycobacterium
RTVFDRIAALPLPTIAAV

SEQ ID NO: 727765 - protein, 18 aa, Mycobacterium
RTVFRGEGEREVGFRSGL

SEQ ID NO: 727766 - protein, 17 aa, Mycobacterium
RTVFVSSHLLAEMANTA

SEQ ID NO: 727767 - protein, 27 aa, Mycobacterium
RTVGIDLRADWPTALKDAGFDTTAPTA

SEQ ID NO: 727768 - protein, 20 aa, Mycobacterium
RTVIATGILNLWMHDPGDVA

SEQ ID NO: 727769 - protein, 17 aa, Mycobacterium
RTVIHRLSPGSAEVACF

SEQ ID NO: 727770 - protein, 20 aa, Mycobacterium
RTVLEAELAKGFKASPRSDV

SEQ ID NO: 727771 - protein, 28 aa, Mycobacterium
RTVLETSGFPAVVRPVAAAYGQGQSVVL

SEQ ID NO: 727772 - protein, 18 aa, Mycobacterium
RTVLQHAWAEFEHDVRYK

SEQ ID NO: 727773 - protein, 28 aa, Mycobacterium
RTVLRLDARLAPVKAAVLPLSRHADLSP

SEQ ID NO: 727774 - protein, 28 aa, Mycobacterium
RTVLRLDPRLAPVKAAVLPLSRHADLSP

SEQ ID NO: 727775 - protein, 26 aa, Mycobacterium
RTVLRLDPRLAPVKVAVLPLSRNADL

SEQ ID NO: 727776 - protein, 17 aa, Mycobacterium
RTVLVSSHLLAEMAETA

SEQ ID NO: 727777 - protein, 22 aa, Mycobacterium
RTVPAIIGALVERFDEQNLSAD

SEQ ID NO: 727778 - protein, 26 aa, Mycobacterium
RTVPDNMGMLFRKHLVMFGPREVLLT

SEQ ID NO: 727779 - protein, 18 aa, Mycobacterium
RTVPEGTLRMVLDNPDPF

SEQ ID NO: 727780 - protein, 17 aa, Mycobacterium
RTVPPERIADLEVRATY

SEQ ID NO: 727781 - protein, 30 aa, Mycobacterium
RTVQGFWQREFDILVCTTIVETGLDISNAN

SEQ ID NO: 727782 - protein, 25 aa, Mycobacterium
RTVRLNHEFHRAINLAADSPRLSQL

SEQ ID NO: 727783 - protein, 21 aa, Mycobacterium
RTVRLPLSWDDPATREAIERY

SEQ ID NO: 727784 - protein, 20 aa, Mycobacterium
RTVSPVDFWQYPTVDSLAKF

SEQ ID NO: 727785 - protein, 31 aa, Mycobacterium
RTVSQLRAAHPVFRRRRFFSGEPLGRRGQEG

SEQ ID NO: 727786 - protein, 18 aa, Mycobacterium
RTVVLERLVKFNGEQHAA

SEQ ID NO: 727787 - protein, 18 aa, Mycobacterium
RTVVLERLVKFNGEQHLP

SEQ ID NO: 727788 - protein, 19 aa, Mycobacterium
RTVVLERLVKFNGEQHLPL

SEQ ID NO: 727789 - protein, 19 aa, Mycobacterium
RTVVLERLVKFNGEQHVAL

SEQ ID NO: 727790 - protein, 21 aa, Mycobacterium
RTVVLSQGWDVMDFIQQLQKL

SEQ ID NO: 727791 - protein, 19 aa, Mycobacterium
RTVVSCARRAASLERLTAL

SEQ ID NO: 727792 - protein, 24 aa, Mycobacterium
RTVYRQEMIRMFGLAESGLAETLR

SEQ ID NO: 727793 - protein, 20 aa, Mycobacterium
RTWAAPQWLQLGYELAGSDS

SEQ ID NO: 727794 - protein, 22 aa, Mycobacterium
RTWAEVFWREGYQLHAHTVGDL

SEQ ID NO: 727795 - protein, 20 aa, Mycobacterium
RTWDLLRLTRMPTVQVDIGY

SEQ ID NO: 727796 - protein, 25 aa, Mycobacterium
RTWLDFARAEIADWPFYDTERRLTR

SEQ ID NO: 727797 - protein, 33 aa, Mycobacterium
RTWMSGISRKGPWTVPPRLRLVTRMCSTTLDFT

SEQ ID NO: 727798 - protein, 19 aa, Mycobacterium
RTWPSPLLPALPSLMDDSG

SEQ ID NO: 727799 - protein, 27 aa, Mycobacterium
RTWRVRKKRIAWERPLRKADLAALGAD

SEQ ID NO: 727800 - protein, 19 aa, Mycobacterium
RTWVPWSVVAVDISVNDRW

SEQ ID NO: 727801 - protein, 18 aa, Mycobacterium
RTYAVFGGVINHFIPNPT

SEQ ID NO: 727802 - protein, 21 aa, Mycobacterium
RTYDRLGLVSPRRTSGGGRRY

SEQ ID NO: 727803 - protein, 23 aa, Mycobacterium
RTYEPLLDFCGFAKQGAVIREAF

SEQ ID NO: 727804 - protein, 19 aa, Mycobacterium
RTYEPLLLVRCLQRHPALA

SEQ ID NO: 727805 - protein, 20 aa, Mycobacterium
RTYEPLLLVRCLQRHPVLAS

SEQ ID NO: 727806 - protein, 26 aa, Mycobacterium
RTYGHFGQAGGFIWVDPEADLALVVL

SEQ ID NO: 727807 - protein, 17 aa, Mycobacterium
RTYGYKDLTHWMEKQTY

SEQ ID NO: 727808 - protein, 21 aa, Mycobacterium
RTYLLSGLLRCRRCGNRLYSQ

SEQ ID NO: 727809 - protein, 18 aa, Mycobacterium
RTYLSAKKHSFILPRPEQ

SEQ ID NO: 727810 - protein, 17 aa, Mycobacterium
RTYQMSDHLPMWLELSI

SEQ ID NO: 727811 - protein, 18 aa, Mycobacterium
RTYRGVLDAARVVEFMML

SEQ ID NO: 727812 - protein, 18 aa, Mycobacterium
RTYRGVLDAGRVVEFMML

SEQ ID NO: 727813 - protein, 18 aa, Mycobacterium
RTYRGVLDANRVVEFMLL

SEQ ID NO: 727814 - protein, 26 aa, Mycobacterium
RTYRRGRSRIGGFRAIIGSEPAAVMA

SEQ ID NO: 727815 - protein, 17 aa, Mycobacterium
RTYVEFYDRYSGCIEAW

SEQ ID NO: 727816 - protein, 17 aa, Mycobacterium
RTYVNLFALIAGANDVT

SEQ ID NO: 727817 - protein, 20 aa, Mycobacterium
RVAAALSVSGPAYRLPAADF

SEQ ID NO: 727818 - protein, 28 aa, Mycobacterium
RVAADMGCTRYVALLACYLMHRARSCAG

SEQ ID NO: 727819 - protein, 17 aa, Mycobacterium
RVAADWFAEHDHLNEAV

SEQ ID NO: 727820 - protein, 20 aa, Mycobacterium
RVAAEFAHRFATEHTALRDD

SEQ ID NO: 727821 - protein, 23 aa, Mycobacterium
RVAALCDRRRGLGADGVLRVTTA

SEQ ID NO: 727822 - protein, 17 aa, Mycobacterium
RVAALEDQVRDLGARVS

SEQ ID NO: 727823 - protein, 20 aa, Mycobacterium
RVAALEGSWERPQIDCDGPV

SEQ ID NO: 727824 - protein, 27 aa, Mycobacterium
RVAALRCSVVGPRAWLSKLPDQIRKRE

SEQ ID NO: 727825 - protein, 18 aa, Mycobacterium
RVAALVAELGEDAQVGFH

SEQ ID NO: 727826 - protein, 23 aa, Mycobacterium
RVAAMASALADWVDGPGGQTPLA

SEQ ID NO: 727827 - protein, 18 aa, Mycobacterium
RVAAQLLDLAQRFGTIEG

SEQ ID NO: 727828 - protein, 20 aa, Mycobacterium
RVAARLLAVLPRTVKDRALH

SEQ ID NO: 727829 - protein, 20 aa, Mycobacterium
RVAARLLAVVPTGVKDRALH

SEQ ID NO: 727830 - protein, 23 aa, Mycobacterium
RVAATHRTVWALGDYALMAEEVM

SEQ ID NO: 727831 - protein, 24 aa, Mycobacterium
RVAATLAAAGWPLAGIDVSEVVPD

SEQ ID NO: 727832 - protein, 18 aa, Mycobacterium
RVAAVAFETAFAATVPPP

SEQ ID NO: 727833 - protein, 20 aa, Mycobacterium
RVAAWADGWYGFNLDGIDAV

SEQ ID NO: 727834 - protein, 19 aa, Mycobacterium
RVAAYKYPRRIWFVDELPK

SEQ ID NO: 727835 - protein, 21 aa, Mycobacterium
RVACLGEPLVLVSEAGDPHPA

SEQ ID NO: 727836 - protein, 31 aa, Mycobacterium
RVACTPYKGALRVSGALEFRRRHQPHPRERV

SEQ ID NO: 727837 - protein, 24 aa, Mycobacterium
RVADGAQVARFLCELRDLIESPAT

SEQ ID NO: 727838 - protein, 19 aa, Mycobacterium
RVADGGLRTAEFGMDGLAD

SEQ ID NO: 727839 - protein, 26 aa, Mycobacterium
RVADGLRSLPWDGLKLSRGEAAVPSR

SEQ ID NO: 727840 - protein, 17 aa, Mycobacterium
RVADHGWGLGYMLNQRG

SEQ ID NO: 727841 - protein, 18 aa, Mycobacterium
RVADKIEAGMVFVNAVGA

SEQ ID NO: 727842 - protein, 26 aa, Mycobacterium
RVADLRAGLPRGLAVAGAYLDGIGVP

SEQ ID NO: 727843 - protein, 17 aa, Mycobacterium
RVADLVLVSPGSIPITT

SEQ ID NO: 727844 - protein, 22 aa, Mycobacterium
RVADRWRVGRVFLAGDAAHAMP

SEQ ID NO: 727845 - protein, 22 aa, Mycobacterium
RVAEAMFPRLLTAAADVACDAG

SEQ ID NO: 727846 - protein, 17 aa, Mycobacterium
RVAEDQYRLVLTIHHIV

SEQ ID NO: 727847 - protein, 19 aa, Mycobacterium
RVAELARMLAGLGDSDTGR

SEQ ID NO: 727848 - protein, 19 aa, Mycobacterium
RVAELARMLAGLGESDSGR

SEQ ID NO: 727849 - protein, 20 aa, Mycobacterium
RVAELARMLAGLGESDSGRA

SEQ ID NO: 727850 - protein, 22 aa, Mycobacterium
RVAELLEIVGLRRADAIRYPAE

SEQ ID NO: 727851 - protein, 23 aa, Mycobacterium
RVAELLELVGLPGDFASRYPHEL

SEQ ID NO: 727852 - protein, 24 aa, Mycobacterium
RVAETLMLEYARRYGVPVKIVRIF

SEQ ID NO: 727853 - protein, 19 aa, Mycobacterium
RVAEWGDGWYGFDLADVEE

SEQ ID NO: 727854 - protein, 25 aa, Mycobacterium
RVAFDGLLPVCADLLAMTRKQRAVL

SEQ ID NO: 727855 - protein, 17 aa, Mycobacterium
RVAFMIRFGNGYLPDAK

SEQ ID NO: 727856 - protein, 17 aa, Mycobacterium
RVAGAGLIQAWLARNSV

SEQ ID NO: 727857 - protein, 19 aa, Mycobacterium
RVAGELGLAKRAVKDCRIN

SEQ ID NO: 727858 - protein, 18 aa, Mycobacterium
RVAGGLRAAGLRPGDRVA

SEQ ID NO: 727859 - protein, 20 aa, Mycobacterium
RVAGTPGLVGLSCIDTFAEV

SEQ ID NO: 727860 - protein, 26 aa, Mycobacterium
RVAGVLAAAGWPLAGIDLSETEDGDA

SEQ ID NO: 727861 - protein, 17 aa, Mycobacterium
RVAGWGVSGRARLADVV

SEQ ID NO: 727862 - protein, 26 aa, Mycobacterium
RVAGWPNQQFALLFVDWLNADADVRE

SEQ ID NO: 727863 - protein, 19 aa, Mycobacterium
RVAGYGTPAGMRWTGPPPG

SEQ ID NO: 727864 - protein, 18 aa, Mycobacterium
RVAHAQWLLNRLAPTGLN

SEQ ID NO: 727865 - protein, 18 aa, Mycobacterium
RVAIDLMGGVPSEGDLWV

SEQ ID NO: 727866 - protein, 30 aa, Mycobacterium
RVAIGLTATHTWWRIDWNTLLDASVPIALF

SEQ ID NO: 727867 - protein, 18 aa, Mycobacterium
RVAILGGNRIPFARSDGA

SEQ ID NO: 727868 - protein, 20 aa, Mycobacterium
RVAKGEFEVGGFPIHDGDMV

SEQ ID NO: 727869 - protein, 26 aa, Mycobacterium
RVAKIYCARAAMTVCETSIQVHGGIG

SEQ ID NO: 727870 - protein, 17 aa, Mycobacterium
RVAKKGVHALTFTENPA

SEQ ID NO: 727871 - protein, 34 aa, Mycobacterium
RVAKLSEILGFYGLNYWYPWQVTVLGLGPVWQSA

SEQ ID NO: 727872 - protein, 18 aa, Mycobacterium
RVAKQILDLAMRFGTNSG

SEQ ID NO: 727873 - protein, 25 aa, Mycobacterium
RVAKTRRSAFFWGEHTKVAVESGVP

SEQ ID NO: 727874 - protein, 28 aa, Mycobacterium
RVAKYAQGWCPFRAPAMLAQTARTAALE

SEQ ID NO: 727875 - protein, 26 aa, Mycobacterium
RVALASATRYEWVLADFAIMCAGGAT

SEQ ID NO: 727876 - protein, 24 aa, Mycobacterium
RVALASSTRYEWVLTDFAVMCAGA

SEQ ID NO: 727877 - protein, 17 aa, Mycobacterium
RVALELTEESALALADA

SEQ ID NO: 727878 - protein, 18 aa, Mycobacterium
RVALITGAARGQGRAHAI

SEQ ID NO: 727879 - protein, 20 aa, Mycobacterium
RVALLSATRYEWPILDFAIL

SEQ ID NO: 727880 - protein, 18 aa, Mycobacterium
RVALRAGSNAEFVVGLLA

SEQ ID NO: 727881 - protein, 20 aa, Mycobacterium
RVALRNCAPERRHDMLHDQV

SEQ ID NO: 727882 - protein, 18 aa, Mycobacterium
RVALRSGSNLEFVVALLA

SEQ ID NO: 727883 - protein, 20 aa, Mycobacterium
RVALSALTMAEWFRDEAGQD

SEQ ID NO: 727884 - protein, 21 aa, Mycobacterium
RVALTRKTGWAVNPGQVVEGS

SEQ ID NO: 727885 - protein, 19 aa, Mycobacterium
RVALVYQYRHPLGHRLWEL

SEQ ID NO: 727886 - protein, 21 aa, Mycobacterium
RVAMAAAQWQPSISRFPTPSH

SEQ ID NO: 727887 - protein, 20 aa, Mycobacterium
RVANLACDWFLDHLSRAVTT

SEQ ID NO: 727888 - protein, 18 aa, Mycobacterium
RVANRIEAGMVFVNGVGA

SEQ ID NO: 727889 - protein, 18 aa, Mycobacterium
RVAPAHRDRLWLGLTQCG

SEQ ID NO: 727890 - protein, 17 aa, Mycobacterium
RVAPNHLCNAVNLVDSL

SEQ ID NO: 727891 - protein, 17 aa, Mycobacterium
RVAPVDRVRLVNSGTEA

SEQ ID NO: 727892 - protein, 24 aa, Mycobacterium
RVAQDFCRRRISVGTTTALVFGSA

SEQ ID NO: 727893 - protein, 25 aa, Mycobacterium
RVAQLKALGLGLEIRPLRGNLDTRL

SEQ ID NO: 727894 - protein, 26 aa, Mycobacterium
RVAQTRAAPHLARITCPALVINADAD

SEQ ID NO: 727895 - protein, 20 aa, Mycobacterium
RVARALRETRIHGVTTNRDL

SEQ ID NO: 727896 - protein, 23 aa, Mycobacterium
RVARDVSNWGRWGADDELGTLNF

SEQ ID NO: 727897 - protein, 17 aa, Mycobacterium
RVARFEKRYGKRKGAAA

SEQ ID NO: 727898 - protein, 19 aa, Mycobacterium
RVARFERRYGKRKAGADKD

SEQ ID NO: 727899 - protein, 19 aa, Mycobacterium
RVARFERRYGKRKVGADKD

SEQ ID NO: 727900 - protein, 24 aa, Mycobacterium
RVARIRRHARLRKKVSGTDARPRL

SEQ ID NO: 727901 - protein, 19 aa, Mycobacterium
RVARRFLHQLYLGYPDSAA

SEQ ID NO: 727902 - protein, 25 aa, Mycobacterium
RVARRLEAGSVWVNRHSDIAPQGPY

SEQ ID NO: 727903 - protein, 21 aa, Mycobacterium
RVASDLSNWGRWGDTDELGTL

SEQ ID NO: 727904 - protein, 18 aa, Mycobacterium
RVASHMRTTMVLDAIEMA

SEQ ID NO: 727905 - protein, 18 aa, Mycobacterium
RVASHMRTTMVLDALEMA

SEQ ID NO: 727906 - protein, 19 aa, Mycobacterium
RVASILVERIDGVPALQPR

SEQ ID NO: 727907 - protein, 21 aa, Mycobacterium
RVASIPFVRNILEYTKGDDDD

SEQ ID NO: 727908 - protein, 18 aa, Mycobacterium
RVASNSIGFVAPVPDTTN

SEQ ID NO: 727909 - protein, 17 aa, Mycobacterium
RVASPVAAWGYAESTTA

SEQ ID NO: 727910 - protein, 18 aa, Mycobacterium
RVASRLRVGTVNVNGGVW

SEQ ID NO: 727911 - protein, 19 aa, Mycobacterium
RVASTLDRMYAESKNQMSL

SEQ ID NO: 727912 - protein, 24 aa, Mycobacterium
RVASYGARFAGVVFPGETLSANIW

SEQ ID NO: 727913 - protein, 26 aa, Mycobacterium
RVATGRFPFYLGFSAEVVGIEDAARA

SEQ ID NO: 727914 - protein, 18 aa, Mycobacterium
RVATNSIGFVAPIPDTTH

SEQ ID NO: 727915 - protein, 19 aa, Mycobacterium
RVATQLGYSETVFVDRPAA

SEQ ID NO: 727916 - protein, 19 aa, Mycobacterium
RVATVATMCERGHAERMVL

SEQ ID NO: 727917 - protein, 22 aa, Mycobacterium
RVATVLRRMFIRGEITEGTMLP

SEQ ID NO: 727918 - protein, 20 aa, Mycobacterium
RVATWLPELADMRVLAEPRG

SEQ ID NO: 727919 - protein, 18 aa, Mycobacterium
RVAVPREHLLAERDSVAL

SEQ ID NO: 727920 - protein, 19 aa, Mycobacterium
RVAVRRIPDGGGGSVEVHD

SEQ ID NO: 727921 - protein, 18 aa, Mycobacterium
RVAVVFGGRSNEHAISCV

SEQ ID NO: 727922 - protein, 19 aa, Mycobacterium
RVAVYPADDPVGFGPALQV

SEQ ID NO: 727923 - protein, 18 aa, Mycobacterium
RVAYVLHDLFAVPFGDIA

SEQ ID NO: 727924 - protein, 18 aa, Mycobacterium
RVAYVLHDVFAVPFQEIA

SEQ ID NO: 727925 - protein, 17 aa, Mycobacterium
RVCCALTDERCWGFDET

SEQ ID NO: 727926 - protein, 27 aa, Mycobacterium
RVCDGGSAAGFLRLFADYVENPVAALG

SEQ ID NO: 727927 - protein, 19 aa, Mycobacterium
RVCDMLFQRYRNEVERRTG

SEQ ID NO: 727928 - protein, 28 aa, Mycobacterium
RVCDSCPSVDTIVLVAGLYRAAVAREAE

SEQ ID NO: 727929 - protein, 18 aa, Mycobacterium
RVCELARIDIPIIQAPMT

SEQ ID NO: 727930 - protein, 24 aa, Mycobacterium
RVCGVPADTFLQVARAWTENSGRE

SEQ ID NO: 727931 - protein, 24 aa, Mycobacterium
RVCGVPAQSFLQVARAWTENSGRE

SEQ ID NO: 727932 - protein, 19 aa, Mycobacterium
RVCHARKPACGVCVLAKDC

SEQ ID NO: 727933 - protein, 19 aa, Mycobacterium
RVCHARKPACGVCVVAKDC

SEQ ID NO: 727934 - protein, 26 aa, Mycobacterium
RVCPACPCTGTVWWAIAVDGLTLDML

SEQ ID NO: 727935 - protein, 18 aa, Mycobacterium
RVCTPVWSSVALHRPAEF

SEQ ID NO: 727936 - protein, 20 aa, Mycobacterium
RVCTSVCGILVDVEGDEVLR

SEQ ID NO: 727937 - protein, 19 aa, Mycobacterium
RVCVARGTTSLRRIREIAP

SEQ ID NO: 727938 - protein, 18 aa, Mycobacterium
RVCVLGFNSVDYATIDIA

SEQ ID NO: 727939 - protein, 25 aa, Mycobacterium
RVCVRFPELRLCMIHGADPWWDIAI

SEQ ID NO: 727940 - protein, 25 aa, Mycobacterium
RVCVRFPELRLCMIHGADPWWDVAI

SEQ ID NO: 727941 - protein, 20 aa, Mycobacterium
RVDAFLDLFGGGYVDLALNE

SEQ ID NO: 727942 - protein, 23 aa, Mycobacterium
RVDALRRCVPMVAKIKDPTLRDE

SEQ ID NO: 727943 - protein, 18 aa, Mycobacterium
RVDAPWVDRPTAFWRRKG

SEQ ID NO: 727944 - protein, 20 aa, Mycobacterium
RVDAVPEFRLKLADNQLNFD

SEQ ID NO: 727945 - protein, 19 aa, Mycobacterium
RVDCLPYYVDLFKQMEAQA

SEQ ID NO: 727946 - protein, 24 aa, Mycobacterium
RVDDDTAFELLRWRSQEANVKLRL

SEQ ID NO: 727947 - protein, 18 aa, Mycobacterium
RVDDPAVQQMFNITDDGG

SEQ ID NO: 727948 - protein, 19 aa, Mycobacterium
RVDFDLDRMRAEAESQAGV

SEQ ID NO: 727949 - protein, 28 aa, Mycobacterium
RVDGALRRSIKFPSFLAGIDAVRRVGEH

SEQ ID NO: 727950 - protein, 20 aa, Mycobacterium
RVDGGRAVLFASRRRSSGAV

SEQ ID NO: 727951 - protein, 26 aa, Mycobacterium
RVDGGWKLDGQKVWNSKAQIADWAIC

SEQ ID NO: 727952 - protein, 20 aa, Mycobacterium
RVDGGWQITGHKIWTSSAHR

SEQ ID NO: 727953 - protein, 25 aa, Mycobacterium
RVDGGWSLSGTKVWTSGAHLAHAFI

SEQ ID NO: 727954 - protein, 25 aa, Mycobacterium
RVDGGWSLTGTKVWTSGAHLAHAFI

SEQ ID NO: 727955 - protein, 18 aa, Mycobacterium
RVDGHPVGVIANQPLQMA

SEQ ID NO: 727956 - protein, 25 aa, Mycobacterium
RVDGPCIYHDVFSYLVDAPWDEIAF

SEQ ID NO: 727957 - protein, 18 aa, Mycobacterium
RVDGRLATAPAWTAVEVA

SEQ ID NO: 727958 - protein, 18 aa, Mycobacterium
RVDGSTLFGIMNGKRQRQ

SEQ ID NO: 727959 - protein, 18 aa, Mycobacterium
RVDKAVRTVEEWLAAEPF

SEQ ID NO: 727960 - protein, 17 aa, Mycobacterium
RVDKAVRTVEEWLTAEP

SEQ ID NO: 727961 - protein, 18 aa, Mycobacterium
RVDLDFIDRAPFRFVSTV

SEQ ID NO: 727962 - protein, 28 aa, Mycobacterium
RVDLDPMPGVGWRQILDVAFVAREVLED

SEQ ID NO: 727963 - protein, 24 aa, Mycobacterium
RVDLRPMLTHTFGLARWRDAFWAL

SEQ ID NO: 727964 - protein, 18 aa, Mycobacterium
RVDLYFEAAVAGAIPVIR

SEQ ID NO: 727965 - protein, 25 aa, Mycobacterium
RVDMLEMLPTPWGLVRSGVAPDHPK

SEQ ID NO: 727966 - protein, 25 aa, Mycobacterium
RVDNIGKLPMAWVDPAAADSRTVLA

SEQ ID NO: 727967 - protein, 25 aa, Mycobacterium
RVDPARLSACADLLMTTSPNVMVYA

SEQ ID NO: 727968 - protein, 21 aa, Mycobacterium
RVDQLAAWGYPFPAGSDGRPM

SEQ ID NO: 727969 - protein, 23 aa, Mycobacterium
RVDQLPEIWKRLVDGGMESGHAY

SEQ ID NO: 727970 - protein, 25 aa, Mycobacterium
RVDSEVLRRAVLYAIERKRAELTTV

SEQ ID NO: 727971 - protein, 30 aa, Mycobacterium
RVDSPLALRMARSFLGKRSPAVYTLEDMAD

SEQ ID NO: 727972 - protein, 22 aa, Mycobacterium
RVDTVLRAKVDAAWNLHELTRD

SEQ ID NO: 727973 - protein, 29 aa, Mycobacterium
RVDVANHFYCYSFEPNNDWTHFFAEQNEL

SEQ ID NO: 727974 - protein, 18 aa, Mycobacterium
RVDWRAQGLEGFGRPDGF

SEQ ID NO: 727975 - protein, 17 aa, Mycobacterium
RVDWRGQGLEGFGRPDG

SEQ ID NO: 727976 - protein, 20 aa, Mycobacterium
RVDWVAGIGATLVRGHGRLD

SEQ ID NO: 727977 - protein, 26 aa, Mycobacterium
RVDYRTGLATTVAWFRIACDDTAGDD

SEQ ID NO: 727978 - protein, 20 aa, Mycobacterium
RVEAAAIFRELITRTREIGL

SEQ ID NO: 727979 - protein, 22 aa, Mycobacterium
RVEAALCFPLPKFSDIRYDYSL

SEQ ID NO: 727980 - protein, 20 aa, Mycobacterium
RVEALPWDAVHSALKEHKDW

SEQ ID NO: 727981 - protein, 24 aa, Mycobacterium
RVEAVPRKHVIGALNEFQDWTDPE

SEQ ID NO: 727982 - protein, 21 aa, Mycobacterium
RVEAYVGLDAVRYLSKERALM

SEQ ID NO: 727983 - protein, 22 aa, Mycobacterium
RVEDMPEIWRRLDEVGLYTTQA

SEQ ID NO: 727984 - protein, 21 aa, Mycobacterium
RVEELVPLIRRIWNLHEGPVR

SEQ ID NO: 727985 - protein, 18 aa, Mycobacterium
RVEFEYRRGGTLAYFAAY

SEQ ID NO: 727986 - protein, 19 aa, Mycobacterium
RVEGAGLCTVGEPVAEPGG

SEQ ID NO: 727987 - protein, 30 aa, Mycobacterium
RVEGLLERVSRRFQREAGRTLTAGAVTVRA

SEQ ID NO: 727988 - protein, 28 aa, Mycobacterium
RVEGNLCFPLPKFSDIRYNYSLAGGATM

SEQ ID NO: 727989 - protein, 26 aa, Mycobacterium
RVEGWPNQQFALLFPDWLTADPDARA

SEQ ID NO: 727990 - protein, 24 aa, Mycobacterium
RVEHHAVLDAVDWLVEHEGAQVSW

SEQ ID NO: 727991 - protein, 24 aa, Mycobacterium
RVEHHAVLDTVDWLVEHEGAEVTW

SEQ ID NO: 727992 - protein, 26 aa, Mycobacterium
RVEILPVPGLPEFRPGDDLVGSLAEA

SEQ ID NO: 727993 - protein, 17 aa, Mycobacterium
RVEITARGRGPVVRGEA

SEQ ID NO: 727994 - protein, 26 aa, Mycobacterium
RVEKLLNRFGVLKVLFLLDEPFRGWT

SEQ ID NO: 727995 - protein, 25 aa, Mycobacterium
RVEKVVQAWSELQVALPTKAPAAQS

SEQ ID NO: 727996 - protein, 18 aa, Mycobacterium
RVELPTYGFARDRFWLGD

SEQ ID NO: 727997 - protein, 24 aa, Mycobacterium
RVENGPCLAAAWEQHVIRIDDMES

SEQ ID NO: 727998 - protein, 24 aa, Mycobacterium
RVEPESMTFTGLMVGTVPLTLIST

SEQ ID NO: 727999 - protein, 24 aa, Mycobacterium
RVEQIKRFIIIGTAWDPGGDELTP

SEQ ID NO: 728000 - protein, 17 aa, Mycobacterium
RVEQLPEIWRRLVEGGM

SEQ ID NO: 728001 - protein, 23 aa, Mycobacterium
RVEQLPLIWKRLIDAGMESGHAY

SEQ ID NO: 728002 - protein, 20 aa, Mycobacterium
RVERARAAGAAGLIVTTDWS

SEQ ID NO: 728003 - protein, 20 aa, Mycobacterium
RVERARAAGAVGLIVTTDWS

SEQ ID NO: 728004 - protein, 19 aa, Mycobacterium
RVERFPRRASYAYQLDAFT

SEQ ID NO: 728005 - protein, 18 aa, Mycobacterium
RVESGWVSTDFVDEKLPE

SEQ ID NO: 728006 - protein, 18 aa, Mycobacterium
RVESVAMQRGVSADDIVN

SEQ ID NO: 728007 - protein, 21 aa, Mycobacterium
RVETDTGEVLTARFVVMATGP

SEQ ID NO: 728008 - protein, 24 aa, Mycobacterium
RVEVAADLRTDWSRALEAAGFDVE

SEQ ID NO: 728009 - protein, 24 aa, Mycobacterium
RVEVFDPPIAIAWLPGEDTDDGTL

SEQ ID NO: 728010 - protein, 25 aa, Mycobacterium
RVEVKELLPPAVRTNLMPGQQESEF

SEQ ID NO: 728011 - protein, 21 aa, Mycobacterium
RVEVPQPTGWERINRFESGVV

SEQ ID NO: 728012 - protein, 31 aa, Mycobacterium
RVEWWQSCRLPVNWKLAAAAFMEGYHVPQTH

SEQ ID NO: 728013 - protein, 36 aa, Mycobacterium
RVEYKLRDWLFARQRYWGEPFPIVYDADGRAHPLPE

SEQ ID NO: 728014 - protein, 23 aa, Mycobacterium
RVFADEGFGLLVTEGLYIDDQTS

SEQ ID NO: 728015 - protein, 24 aa, Mycobacterium
RVFAPKVAGHWWLHTATAHLDLDW

SEQ ID NO: 728016 - protein, 21 aa, Mycobacterium
RVFATCRRLGIGTVAVYTDPD

SEQ ID NO: 728017 - protein, 17 aa, Mycobacterium
RVFDAEWLAAAADRQLQ

SEQ ID NO: 728018 - protein, 19 aa, Mycobacterium
RVFDAFPLTHHVECVALLT

SEQ ID NO: 728019 - protein, 25 aa, Mycobacterium
RVFDLPPPVCDFVVHRELRVPMRDR

SEQ ID NO: 728020 - protein, 19 aa, Mycobacterium
RVFDSFPLTHHIECVAVLN

SEQ ID NO: 728021 - protein, 17 aa, Mycobacterium
RVFDVAAGLPWPARYPS

SEQ ID NO: 728022 - protein, 23 aa, Mycobacterium
RVFDVADGLPWPQRFPSRVLTND

SEQ ID NO: 728023 - protein, 22 aa, Mycobacterium
RVFEELSLRGCVATLDGSDVIR

SEQ ID NO: 728024 - protein, 19 aa, Mycobacterium
RVFFCNSGTEANEVAFKIT

SEQ ID NO: 728025 - protein, 18 aa, Mycobacterium
RVFFCNSGTEANEVAFKL

SEQ ID NO: 728026 - protein, 24 aa, Mycobacterium
RVFHWSHPEWSKLNSILGTAEVDD

SEQ ID NO: 728027 - protein, 18 aa, Mycobacterium
RVFHYPGGLVDYVKHINR

SEQ ID NO: 728028 - protein, 17 aa, Mycobacterium
RVFMLFIGGFGVYLDIC

SEQ ID NO: 728029 - protein, 24 aa, Mycobacterium
RVFNDRGACLAGVVLDDRVRPQVV

SEQ ID NO: 728030 - protein, 17 aa, Mycobacterium
RVFNRYGDFIARIDMGW

SEQ ID NO: 728031 - protein, 18 aa, Mycobacterium
RVFPGSIVVFTHRDPVPV

SEQ ID NO: 728032 - protein, 24 aa, Mycobacterium
RVFPNARFTQAYGMTEVSPVATLL

SEQ ID NO: 728033 - protein, 23 aa, Mycobacterium
RVFPNLFATHRVRAVDDYPAHLL

SEQ ID NO: 728034 - protein, 17 aa, Mycobacterium
RVFPPDVVVELDLAGGA

SEQ ID NO: 728035 - protein, 18 aa, Mycobacterium
RVFRFPAWAFDRVLMPVI

SEQ ID NO: 728036 - protein, 23 aa, Mycobacterium
RVFTDFRYVREIGDPNGRDHALI

SEQ ID NO: 728037 - protein, 19 aa, Mycobacterium
RVFYECYRNHDAFEAHEAA

SEQ ID NO: 728038 - protein, 27 aa, Mycobacterium
RVFYLACAPALFGPICGALGAQGLVTE

SEQ ID NO: 728039 - protein, 17 aa, Mycobacterium
RVGAAVADRSSWSRWWP

SEQ ID NO: 728040 - protein, 18 aa, Mycobacterium
RVGACRKLADAFGATVLL

SEQ ID NO: 728041 - protein, 18 aa, Mycobacterium
RVGAEAGRLDLLVNNAAA

SEQ ID NO: 728042 - protein, 19 aa, Mycobacterium
RVGAFEVLLLVSMVSSIHR

SEQ ID NO: 728043 - protein, 18 aa, Mycobacterium
RVGAGSFITPVRIYDIDL

SEQ ID NO: 728044 - protein, 20 aa, Mycobacterium
RVGAHGWWRCYDGCGAGGPV

SEQ ID NO: 728045 - protein, 17 aa, Mycobacterium
RVGARLIHVSTDYVFNG

SEQ ID NO: 728046 - protein, 20 aa, Mycobacterium
RVGAVAGCEYQLVQHKSEAL

SEQ ID NO: 728047 - protein, 17 aa, Mycobacterium
RVGAWFTGRNELPERTW

SEQ ID NO: 728048 - protein, 18 aa, Mycobacterium
RVGDPLSERTQMGAQISA

SEQ ID NO: 728049 - protein, 18 aa, Mycobacterium
RVGDVVYHHGWWQPQRPL

SEQ ID NO: 728050 - protein, 18 aa, Mycobacterium
RVGEEIDDDVALVVTTSG

SEQ ID NO: 728051 - protein, 22 aa, Mycobacterium
RVGELAEALAAMAPDAVAAELA

SEQ ID NO: 728052 - protein, 20 aa, Mycobacterium
RVGELIDRYPLRGIKGPMGT

SEQ ID NO: 728053 - protein, 23 aa, Mycobacterium
RVGELLDLVGLPAEFAQRYPHEL

SEQ ID NO: 728054 - protein, 24 aa, Mycobacterium
RVGELLELIGMTALADRYPNQLSG

SEQ ID NO: 728055 - protein, 21 aa, Mycobacterium
RVGELPARVLAVTPGIDDLTP

SEQ ID NO: 728056 - protein, 17 aa, Mycobacterium
RVGELVCLLDAARLGER

SEQ ID NO: 728057 - protein, 18 aa, Mycobacterium
RVGEVAADTAGRWRALAL

SEQ ID NO: 728058 - protein, 17 aa, Mycobacterium
RVGFSGFAPGFAYLVDG

SEQ ID NO: 728059 - protein, 18 aa, Mycobacterium
RVGFSGFAPGFAYLVDGD

SEQ ID NO: 728060 - protein, 23 aa, Mycobacterium
RVGFSHPLLPHIIYSQARPGERR

SEQ ID NO: 728061 - protein, 19 aa, Mycobacterium
RVGGGVFNGACAMGADSFA

SEQ ID NO: 728062 - protein, 18 aa, Mycobacterium
RVGGSAAPVRTDMRTPLR

SEQ ID NO: 728063 - protein, 23 aa, Mycobacterium
RVGGVTLTIGFAVAKDLAAGRLT

SEQ ID NO: 728064 - protein, 23 aa, Mycobacterium
RVGGVTLTIGFAVAKDLAAGRLV

SEQ ID NO: 728065 - protein, 22 aa, Mycobacterium
RVGGVTPTIGFAVAKDLAGGRL

SEQ ID NO: 728066 - protein, 31 aa, Mycobacterium
RVGHPLRVAHAWSFTFDAAWQPLVALLDGHA

SEQ ID NO: 728067 - protein, 19 aa, Mycobacterium
RVGHSLDPKADYGPLVTGA

SEQ ID NO: 728068 - protein, 17 aa, Mycobacterium
RVGHYYQMEDTYLVGRE

SEQ ID NO: 728069 - protein, 28 aa, Mycobacterium
RVGIAGFCMGGGFALILSPRGFGASAPF

SEQ ID NO: 728070 - protein, 20 aa, Mycobacterium
RVGILPGGGMTARLPQVVGA

SEQ ID NO: 728071 - protein, 21 aa, Mycobacterium
RVGINFIPMRLTLDLAGSPAT

SEQ ID NO: 728072 - protein, 24 aa, Mycobacterium
RVGIWAPNRWEWVLVQYATAEIGA

SEQ ID NO: 728073 - protein, 24 aa, Mycobacterium
RVGIWCKGVAPSTELRQWYHHQPE

SEQ ID NO: 728074 - protein, 20 aa, Mycobacterium
RVGKKPLAWERPLRKSDLAA

SEQ ID NO: 728075 - protein, 32 aa, Mycobacterium
RVGLAGSDIGCSWLPLYHDMGLTFLLSAAVGG

SEQ ID NO: 728076 - protein, 24 aa, Mycobacterium
RVGLCTVESYIGGEFFEPNYLDTS

SEQ ID NO: 728077 - protein, 32 aa, Mycobacterium
RVGLDHARSWYRPDPAAQWQLLITDLSGLPAT

SEQ ID NO: 728078 - protein, 26 aa, Mycobacterium
RVGLLMPNCLEFIPIQQAIWAAGAVL

SEQ ID NO: 728079 - protein, 18 aa, Mycobacterium
RVGLPDRGPQTWQEFDEW

SEQ ID NO: 728080 - protein, 29 aa, Mycobacterium
RVGLYPGAPKLPAVIGFEVAGTISAVGAG

SEQ ID NO: 728081 - protein, 19 aa, Mycobacterium
RVGMASSFVRCEDPALLAQ

SEQ ID NO: 728082 - protein, 20 aa, Mycobacterium
RVGMASSFVRCEDTALLAQA

SEQ ID NO: 728083 - protein, 21 aa, Mycobacterium
RVGMPEAIFCLNKTTSQLRAI

SEQ ID NO: 728084 - protein, 29 aa, Mycobacterium
RVGMPYVNQRWLGGMLTNFSTVHKRLQRL

SEQ ID NO: 728085 - protein, 26 aa, Mycobacterium
RVGNEVPRDGLLRLLVDVQYTRNDLS

SEQ ID NO: 728086 - protein, 25 aa, Mycobacterium
RVGPACGKPPLLLLHGHPESHLMWH

SEQ ID NO: 728087 - protein, 19 aa, Mycobacterium
RVGQYVPYQQVWNLTGQPA

SEQ ID NO: 728088 - protein, 23 aa, Mycobacterium
RVGRALISAILRRRGLTARVTVP

SEQ ID NO: 728089 - protein, 23 aa, Mycobacterium
RVGRLAVRLDVSRLVVVGTGRSV

SEQ ID NO: 728090 - protein, 17 aa, Mycobacterium
RVGRMIASPYGFLRGTA

SEQ ID NO: 728091 - protein, 31 aa, Mycobacterium
RVGRPLRIAHAWSFTFDAAWQPLAALLDGHS

SEQ ID NO: 728092 - protein, 19 aa, Mycobacterium
RVGRRAGPHHGARPVRRRG

SEQ ID NO: 728093 - protein, 27 aa, Mycobacterium
RVGRSIMKLSEWLGWPLFKKLEDPQRR

SEQ ID NO: 728094 - protein, 25 aa, Mycobacterium
RVGSAAIAVCLFRLETEVTAVPGAT

SEQ ID NO: 728095 - protein, 17 aa, Mycobacterium
RVGSFQYAYQYATAAKD

SEQ ID NO: 728096 - protein, 24 aa, Mycobacterium
RVGSRARAARLLRSVMTRHRDTTR

SEQ ID NO: 728097 - protein, 26 aa, Mycobacterium
RVGSVHRFRSADAFASYTGTAPIAAS

SEQ ID NO: 728098 - protein, 19 aa, Mycobacterium
RVGSYLTKEIEVVGSSVIL

SEQ ID NO: 728099 - protein, 21 aa, Mycobacterium
RVGVAEFRRSLERVLPMDGDP

SEQ ID NO: 728100 - protein, 18 aa, Mycobacterium
RVGVPVDLRQDWPKALRQ

SEQ ID NO: 728101 - protein, 20 aa, Mycobacterium
RVGVRRLLQRTGIVEESTTP

SEQ ID NO: 728102 - protein, 25 aa, Mycobacterium
RVGYVHARAGGFLDGVADFDAGFFG

SEQ ID NO: 728103 - protein, 17 aa, Mycobacterium
RVHAGLLSLPWEGLGLS

SEQ ID NO: 728104 - protein, 22 aa, Mycobacterium
RVHAQIVLYDGFDPFDVIAPFE

SEQ ID NO: 728105 - protein, 24 aa, Mycobacterium
RVHARTGLPCPVCGDTVREVSFAD

SEQ ID NO: 728106 - protein, 25 aa, Mycobacterium
RVHARTGLPCPVCGDTVREVSFADK

SEQ ID NO: 728107 - protein, 22 aa, Mycobacterium
RVHAVALGRLGVRKGSYDLIDA

SEQ ID NO: 728108 - protein, 17 aa, Mycobacterium
RVHCPASGPGTIAGLPA

SEQ ID NO: 728109 - protein, 21 aa, Mycobacterium
RVHGPLALAVGRRLRERYGID

SEQ ID NO: 728110 - protein, 20 aa, Mycobacterium
RVHGWARFARFHLGRNGAVH

SEQ ID NO: 728111 - protein, 17 aa, Mycobacterium
RVHIAAIAVGAAQRALD

SEQ ID NO: 728112 - protein, 25 aa, Mycobacterium
RVHIPDWTEFLALFDQAVQRRIKKA

SEQ ID NO: 728113 - protein, 18 aa, Mycobacterium
RVHLFVRNALAASFDATD

SEQ ID NO: 728114 - protein, 19 aa, Mycobacterium
RVHLGGLFNAARACLPDML

SEQ ID NO: 728115 - protein, 25 aa, Mycobacterium
RVHLPRSDPFWSYADRLTSPGLGGQ

SEQ ID NO: 728116 - protein, 19 aa, Mycobacterium
RVHPGHARKMIAALEAAGH

SEQ ID NO: 728117 - protein, 20 aa, Mycobacterium
RVHQSRVGKQEARRRAVELL

SEQ ID NO: 728118 - protein, 20 aa, Mycobacterium
RVHRAAGAFAAMGIDKGDRV

SEQ ID NO: 728119 - protein, 21 aa, Mycobacterium
RVHRIAAGVSLDWELLAQGAQ

SEQ ID NO: 728120 - protein, 17 aa, Mycobacterium
RVHRRHIVNLNRIREVE

SEQ ID NO: 728121 - protein, 24 aa, Mycobacterium
RVHRVELRNGVLVHYDLPETANAP

SEQ ID NO: 728122 - protein, 23 aa, Mycobacterium
RVHRVPSRMFPKITSLPLGVPRP

SEQ ID NO: 728123 - protein, 24 aa, Mycobacterium
RVHVDTWGGWLFINMDPDPEPLAD

SEQ ID NO: 728124 - protein, 17 aa, Mycobacterium
RVHVGGLAHVCRAVLPD

SEQ ID NO: 728125 - protein, 17 aa, Mycobacterium
RVHVTILRRAATGPMEV

SEQ ID NO: 728126 - protein, 24 aa, Mycobacterium
RVIACGDCAIDRGVFGDAYGVAGA

SEQ ID NO: 728127 - protein, 17 aa, Mycobacterium
RVIAEAFHIARSGRPGA

SEQ ID NO: 728128 - protein, 18 aa, Mycobacterium
RVIAEAGHFPWIEQPVAV

SEQ ID NO: 728129 - protein, 19 aa, Mycobacterium
RVIARDSLVKTALFGSDPN

SEQ ID NO: 728130 - protein, 17 aa, Mycobacterium
RVIAVELGFDFLPGTTV

SEQ ID NO: 728131 - protein, 17 aa, Mycobacterium
RVICSRAHLMGEGEAML

SEQ ID NO: 728132 - protein, 21 aa, Mycobacterium
RVIDGRLPAVIPDTSADKTAS

SEQ ID NO: 728133 - protein, 22 aa, Mycobacterium
RVIDLIMPIGKGQRALIVSPPK

SEQ ID NO: 728134 - protein, 17 aa, Mycobacterium
RVIDRAPLWCAVDLRDG

SEQ ID NO: 728135 - protein, 17 aa, Mycobacterium
RVIEACNDLHCAGKSLA

SEQ ID NO: 728136 - protein, 19 aa, Mycobacterium
RVIEGVAELGFPLSIHLEA

SEQ ID NO: 728137 - protein, 31 aa, Mycobacterium
RVIEMAGDFGGVWYWNRFPGIQCDNDAYCYI

SEQ ID NO: 728138 - protein, 17 aa, Mycobacterium
RVIEPFDVDAYRQFITD

SEQ ID NO: 728139 - protein, 18 aa, Mycobacterium
RVIEPLDIDAYREFLTEI

SEQ ID NO: 728140 - protein, 20 aa, Mycobacterium
RVIGGHMVRLLRHVYNVSGI

SEQ ID NO: 728141 - protein, 21 aa, Mycobacterium
RVIGRSGGIFISHGQVERNLS

SEQ ID NO: 728142 - protein, 17 aa, Mycobacterium
RVIKKVSRPHGFNVGLN

SEQ ID NO: 728143 - protein, 26 aa, Mycobacterium
RVIKRLVVEHSWRIGVVAQSHAAVEN

SEQ ID NO: 728144 - protein, 17 aa, Mycobacterium
RVIKVERPQGGDFARGY

SEQ ID NO: 728145 - protein, 25 aa, Mycobacterium
RVILHGWLALTFEICRQRIIDPTTD

SEQ ID NO: 728146 - protein, 17 aa, Mycobacterium
RVILRFGAAYGSSVLAD

SEQ ID NO: 728147 - protein, 21 aa, Mycobacterium
RVINGRGRLVIGLADPDVMAK

SEQ ID NO: 728148 - protein, 17 aa, Mycobacterium
RVIPALGESGLREDPAA

SEQ ID NO: 728149 - protein, 17 aa, Mycobacterium
RVIPSDSNFVLFGEFAD

SEQ ID NO: 728150 - protein, 18 aa, Mycobacterium
RVIRHDAGWISNPLPVDF

SEQ ID NO: 728151 - protein, 17 aa, Mycobacterium
RVIRKMAELIGALMEMP

SEQ ID NO: 728152 - protein, 19 aa, Mycobacterium
RVISDVWLSNLLAWLTRRA

SEQ ID NO: 728153 - protein, 19 aa, Mycobacterium
RVISELIAIVAGGQPLTPE

SEQ ID NO: 728154 - protein, 19 aa, Mycobacterium
RVISRRSKLMLRISGAGAM

SEQ ID NO: 728155 - protein, 19 aa, Mycobacterium
RVISSGLMNTGYVPFDQQP

SEQ ID NO: 728156 - protein, 19 aa, Mycobacterium
RVITDACEILLILKDNLAG

SEQ ID NO: 728157 - protein, 19 aa, Mycobacterium
RVITFAVRGRTMYPPEVGL

SEQ ID NO: 728158 - protein, 22 aa, Mycobacterium
RVITLRYLLSMIAAERGMVATF

SEQ ID NO: 728159 - protein, 21 aa, Mycobacterium
RVITLRYLLSMIADERGMIAT

SEQ ID NO: 728160 - protein, 18 aa, Mycobacterium
RVIVACFASNVDRVQQII

SEQ ID NO: 728161 - protein, 17 aa, Mycobacterium
RVIVALGGFAWQVVLAM

SEQ ID NO: 728162 - protein, 19 aa, Mycobacterium
RVIVEIGAGLDLNATLHRI

SEQ ID NO: 728163 - protein, 24 aa, Mycobacterium
RVIVPDFQLSLAIGKEGQNARLAA

SEQ ID NO: 728164 - protein, 19 aa, Mycobacterium
RVIWKLIKDKLILPHLDIN

SEQ ID NO: 728165 - protein, 19 aa, Mycobacterium
RVIWVAGGLLKGASVDAEV

SEQ ID NO: 728166 - protein, 21 aa, Mycobacterium
RVKATGFGRVGLDVRDTVKTI

SEQ ID NO: 728167 - protein, 20 aa, Mycobacterium
RVKDVFFYEPIILPEKSSRE

SEQ ID NO: 728168 - protein, 25 aa, Mycobacterium
RVKEPFSCWASLVVHAGPPGAGTRM

SEQ ID NO: 728169 - protein, 20 aa, Mycobacterium
RVKFGWGFNAEIPLASIKDA

SEQ ID NO: 728170 - protein, 25 aa, Mycobacterium
RVKGPDFPTSGLIVGTQGISDAYKT

SEQ ID NO: 728171 - protein, 17 aa, Mycobacterium
RVKHCVLVELFTNEGTG

SEQ ID NO: 728172 - protein, 21 aa, Mycobacterium
RVKLAELSRELGITEFMLLQT

SEQ ID NO: 728173 - protein, 25 aa, Mycobacterium
RVKLAGFKIPQYWYSVTELPLNSAG

SEQ ID NO: 728174 - protein, 20 aa, Mycobacterium
RVKQHPDRLVAGWQVVALEP

SEQ ID NO: 728175 - protein, 22 aa, Mycobacterium
RVKQHPDRVVAGWRVVALEPYG

SEQ ID NO: 728176 - protein, 17 aa, Mycobacterium
RVKQLRVGHSLDPKADY

SEQ ID NO: 728177 - protein, 19 aa, Mycobacterium
RVKVLRAVRSGDYVRRTGD

SEQ ID NO: 728178 - protein, 18 aa, Mycobacterium
RVLAAEWGPHGVTVNCAS

SEQ ID NO: 728179 - protein, 18 aa, Mycobacterium
RVLAALGDKVLKLSAARS

SEQ ID NO: 728180 - protein, 17 aa, Mycobacterium
RVLAALGPKMLALAAIR

SEQ ID NO: 728181 - protein, 20 aa, Mycobacterium
RVLAAVGMAPVKLDADRISV

SEQ ID NO: 728182 - protein, 21 aa, Mycobacterium
RVLADPGWLLLGFQTDAPPLV

SEQ ID NO: 728183 - protein, 18 aa, Mycobacterium
RVLADWPQQQRHFVKVMP

SEQ ID NO: 728184 - protein, 19 aa, Mycobacterium
RVLAGLRRIYGKMPGVDDV

SEQ ID NO: 728185 - protein, 23 aa, Mycobacterium
RVLALHRFAKTPMLIGGQMLNLQ

SEQ ID NO: 728186 - protein, 19 aa, Mycobacterium
RVLAPLFRLGLGGRVGDGA

SEQ ID NO: 728187 - protein, 23 aa, Mycobacterium
RVLARQSGALAQFAAPNSAAQEA

SEQ ID NO: 728188 - protein, 17 aa, Mycobacterium
RVLATWSGWGAVPQVFD

SEQ ID NO: 728189 - protein, 19 aa, Mycobacterium
RVLCAAALCDDDLQVRSVP

SEQ ID NO: 728190 - protein, 17 aa, Mycobacterium
RVLDDSFLLCFNAHHEP

SEQ ID NO: 728191 - protein, 24 aa, Mycobacterium
RVLDEVPGCFVALGALPPGADPDK

SEQ ID NO: 728192 - protein, 18 aa, Mycobacterium
RVLDGGGLSGVTLVSLDD

SEQ ID NO: 728193 - protein, 19 aa, Mycobacterium
RVLDGRVAVVGLDDARAAA

SEQ ID NO: 728194 - protein, 17 aa, Mycobacterium
RVLDPAIYREAALRLDR

SEQ ID NO: 728195 - protein, 25 aa, Mycobacterium
RVLDVGCGLGALSIEMAQAGASVLG

SEQ ID NO: 728196 - protein, 17 aa, Mycobacterium
RVLDVNVLGVFHTVRAT

SEQ ID NO: 728197 - protein, 22 aa, Mycobacterium
RVLDVPRLVSFHNLLDGNAPHP

SEQ ID NO: 728198 - protein, 17 aa, Mycobacterium
RVLELGTLIAGPFAGRL

SEQ ID NO: 728199 - protein, 20 aa, Mycobacterium
RVLELHGWGDLQTELHRLSL

SEQ ID NO: 728200 - protein, 17 aa, Mycobacterium
RVLEMVASIQGARPPKR

SEQ ID NO: 728201 - protein, 17 aa, Mycobacterium
RVLEMVASIQGTRPPTR

SEQ ID NO: 728202 - protein, 17 aa, Mycobacterium
RVLEMVASIQGVRKPAR

SEQ ID NO: 728203 - protein, 23 aa, Mycobacterium
RVLEPGGWLVIAVRADYLDQHRT

SEQ ID NO: 728204 - protein, 19 aa, Mycobacterium
RVLEVAQFTFVPAAGAILA

SEQ ID NO: 728205 - protein, 20 aa, Mycobacterium
RVLFDAGLSVITWPKRYGGR

SEQ ID NO: 728206 - protein, 17 aa, Mycobacterium
RVLGAFDAIGVTASLGE

SEQ ID NO: 728207 - protein, 17 aa, Mycobacterium
RVLGAWPITTSFPGGND

SEQ ID NO: 728208 - protein, 19 aa, Mycobacterium
RVLGEAVALLRDMLNPDDL

SEQ ID NO: 728209 - protein, 20 aa, Mycobacterium
RVLGEAVALLRDMLNPDELV

SEQ ID NO: 728210 - protein, 17 aa, Mycobacterium
RVLGEKVAAHLMLTGTR

SEQ ID NO: 728211 - protein, 18 aa, Mycobacterium
RVLGHRLILGFEASSAKI

SEQ ID NO: 728212 - protein, 20 aa, Mycobacterium
RVLGMARARVTGDYLQTAAI

SEQ ID NO: 728213 - protein, 21 aa, Mycobacterium
RVLGPAGLQAFVGMFLDQQDR

SEQ ID NO: 728214 - protein, 27 aa, Mycobacterium
RVLGRDGVFPLAAFRKVVDINLVGTFN

SEQ ID NO: 728215 - protein, 25 aa, Mycobacterium
RVLGRPAFQVLAGLCGAGPRSATEL

SEQ ID NO: 728216 - protein, 18 aa, Mycobacterium
RVLGRRVGPSTGTNVWGA

SEQ ID NO: 728217 - protein, 18 aa, Mycobacterium
RVLGRYVREQPTISLEEA

SEQ ID NO: 728218 - protein, 18 aa, Mycobacterium
RVLGTPVPGVFGVGGPDL

SEQ ID NO: 728219 - protein, 26 aa, Mycobacterium
RVLGVKGRVLPMCPIALQIEADVSGL

SEQ ID NO: 728220 - protein, 30 aa, Mycobacterium
RVLGVKGRVLPMCPVGLSIEADVVGLESDP

SEQ ID NO: 728221 - protein, 17 aa, Mycobacterium
RVLHLFTDVMDACRHQQ

SEQ ID NO: 728222 - protein, 18 aa, Mycobacterium
RVLHVEDLVRFLVSSLNV

SEQ ID NO: 728223 - protein, 26 aa, Mycobacterium
RVLIAGSWFPRYAANLGTGEPALTGQ

SEQ ID NO: 728224 - protein, 24 aa, Mycobacterium
RVLIAGSWFPRYARHLGTDEPTLT

SEQ ID NO: 728225 - protein, 24 aa, Mycobacterium
RVLIAGSWFPRYARNLGTDEPILT

SEQ ID NO: 728226 - protein, 18 aa, Mycobacterium
RVLICSRDKLLALDPASG

SEQ ID NO: 728227 - protein, 26 aa, Mycobacterium
RVLINCAGVGWPGRTIGKDGQYASAH

SEQ ID NO: 728228 - protein, 17 aa, Mycobacterium
RVLISAMAAGAAAAAAH

SEQ ID NO: 728229 - protein, 17 aa, Mycobacterium
RVLITGAARGMGRSHAV

SEQ ID NO: 728230 - protein, 17 aa, Mycobacterium
RVLKAAGVVSGERQGRE

SEQ ID NO: 728231 - protein, 17 aa, Mycobacterium
RVLKTAASLREPHRVCR

SEQ ID NO: 728232 - protein, 18 aa, Mycobacterium
RVLKTAASLREPHRVCRY

SEQ ID NO: 728233 - protein, 23 aa, Mycobacterium
RVLKTASVGKIFLLAEVARRFEN

SEQ ID NO: 728234 - protein, 19 aa, Mycobacterium
RVLLDDLNTGWAQYRRAGA

SEQ ID NO: 728235 - protein, 17 aa, Mycobacterium
RVLLEGWEKFDEPVDRI

SEQ ID NO: 728236 - protein, 26 aa, Mycobacterium
RVLLGASSRRWAWWTGSVALAAAKII

SEQ ID NO: 728237 - protein, 17 aa, Mycobacterium
RVLLMAALAAQRPVREV

SEQ ID NO: 728238 - protein, 17 aa, Mycobacterium
RVLLQGWEQFDEPVDRI

SEQ ID NO: 728239 - protein, 23 aa, Mycobacterium
RVLMPVIVRWGIYRGVRAGGSRR

SEQ ID NO: 728240 - protein, 24 aa, Mycobacterium
RVLMRRCPSRSFTVVGDLAQRRSA

SEQ ID NO: 728241 - protein, 24 aa, Mycobacterium
RVLNACPHRSIWLHVEGHSLEQIG

SEQ ID NO: 728242 - protein, 19 aa, Mycobacterium
RVLNHILWRDDPPHDEWQP

SEQ ID NO: 728243 - protein, 17 aa, Mycobacterium
RVLNSGNFGPWFSDPKW

SEQ ID NO: 728244 - protein, 19 aa, Mycobacterium
RVLPALAVGHCYHPDPTIA

SEQ ID NO: 728245 - protein, 37 aa, Mycobacterium
RVLPDPVALLRCCGGADLAAMAGFCAQAAVRRTPLLL

SEQ ID NO: 728246 - protein, 24 aa, Mycobacterium
RVLPIWSDWVRRWPTPSATAAASA

SEQ ID NO: 728247 - protein, 18 aa, Mycobacterium
RVLPLDRGLAIPMVHADD

SEQ ID NO: 728248 - protein, 24 aa, Mycobacterium
RVLPLLGGLAVMYGELPPLPTTTR

SEQ ID NO: 728249 - protein, 25 aa, Mycobacterium
RVLPLLGGLAVVFGQLPPMPTVTRF

SEQ ID NO: 728250 - protein, 17 aa, Mycobacterium
RVLPLPYSLALRLRDAG

SEQ ID NO: 728251 - protein, 26 aa, Mycobacterium
RVLPNGVCLLPPLKQCDKGNACLGCG

SEQ ID NO: 728252 - protein, 26 aa, Mycobacterium
RVLPNGVCLLPPLKSCDKGNACLSCG

SEQ ID NO: 728253 - protein, 18 aa, Mycobacterium
RVLPVIKELAARGIKVSI

SEQ ID NO: 728254 - protein, 18 aa, Mycobacterium
RVLQIAAAARDRGADRLS

SEQ ID NO: 728255 - protein, 17 aa, Mycobacterium
RVLQYVNSVDCHVCDGS

SEQ ID NO: 728256 - protein, 19 aa, Mycobacterium
RVLREWFGQLIQYSMTITL

SEQ ID NO: 728257 - protein, 19 aa, Mycobacterium
RVLRGRWDVTPAIHIHTEL

SEQ ID NO: 728258 - protein, 17 aa, Mycobacterium
RVLRGWSSLPAALGPAR

SEQ ID NO: 728259 - protein, 17 aa, Mycobacterium
RVLRGWSTLPITLGKAP

SEQ ID NO: 728260 - protein, 19 aa, Mycobacterium
RVLRPRIAGAPTHPTPTRR

SEQ ID NO: 728261 - protein, 24 aa, Mycobacterium
RVLRRARDGVALNIDEAAVAMSAR

SEQ ID NO: 728262 - protein, 24 aa, Mycobacterium
RVLRRARDGVALNVDEAAIALTAR

SEQ ID NO: 728263 - protein, 24 aa, Mycobacterium
RVLRRARDGVALNVDEAALAMTAR

SEQ ID NO: 728264 - protein, 24 aa, Mycobacterium
RVLRRARDGVALNVDEAAVAMTAR

SEQ ID NO: 728265 - protein, 23 aa, Mycobacterium
RVLRRAVELGVNFIDTADSYGPY

SEQ ID NO: 728266 - protein, 23 aa, Mycobacterium
RVLRSEPPVRVSLATAPDPIVAR

SEQ ID NO: 728267 - protein, 17 aa, Mycobacterium
RVLRVSWCTVLRSADGA

SEQ ID NO: 728268 - protein, 17 aa, Mycobacterium
RVLSGLRLLNYVESAAY

SEQ ID NO: 728269 - protein, 25 aa, Mycobacterium
RVLSIWPDWVRRWPTASATAAATAA

SEQ ID NO: 728270 - protein, 25 aa, Mycobacterium
RVLSIWPDWVRRWPTASATATATAA

SEQ ID NO: 728271 - protein, 27 aa, Mycobacterium
RVLSRDGVFPLAAFRKIVDINLVGSFN

SEQ ID NO: 728272 - protein, 19 aa, Mycobacterium
RVLSTFVFDLLDEAYARAV

SEQ ID NO: 728273 - protein, 19 aa, Mycobacterium
RVLTAVAGLASRTPFVRRP

SEQ ID NO: 728274 - protein, 20 aa, Mycobacterium
RVLTAVDCAVMLIDAAKGLE

SEQ ID NO: 728275 - protein, 17 aa, Mycobacterium
RVLTAWHEPTEWLNLPV

SEQ ID NO: 728276 - protein, 19 aa, Mycobacterium
RVLTEAGMGEAFVHRTGHG

SEQ ID NO: 728277 - protein, 19 aa, Mycobacterium
RVLTMTYVDGIDWTEAQQA

SEQ ID NO: 728278 - protein, 20 aa, Mycobacterium
RVLTNPKVRKMRADIERQVK

SEQ ID NO: 728279 - protein, 18 aa, Mycobacterium
RVLVIRPGQVRTRMSAHV

SEQ ID NO: 728280 - protein, 17 aa, Mycobacterium
RVMALDKDHVWLNGQVT

SEQ ID NO: 728281 - protein, 19 aa, Mycobacterium
RVMCTTVQIGEDWFDEDHT

SEQ ID NO: 728282 - protein, 17 aa, Mycobacterium
RVMEYARRLQFIGCTTL

SEQ ID NO: 728283 - protein, 26 aa, Mycobacterium
RVMFKIKHERTADCVVAGYRVHKSSG

SEQ ID NO: 728284 - protein, 27 aa, Mycobacterium
RVMFKIKPERTADCVVAGYRVHKSGDD

SEQ ID NO: 728285 - protein, 26 aa, Mycobacterium
RVMGLPATVVDWGLWKSLADAEHQAG

SEQ ID NO: 728286 - protein, 20 aa, Mycobacterium
RVMHAAAPCPVDIKKQMIDW

SEQ ID NO: 728287 - protein, 20 aa, Mycobacterium
RVMHAAAPCPVEIKKQMMDW

SEQ ID NO: 728288 - protein, 24 aa, Mycobacterium
RVMKKAVAYLLPFIEAEKAQSGST

SEQ ID NO: 728289 - protein, 23 aa, Mycobacterium
RVMKKAVAYLLPFIEAEKEDNGT

SEQ ID NO: 728290 - protein, 23 aa, Mycobacterium
RVMKKAVAYLLPFIEAEKEQNGA

SEQ ID NO: 728291 - protein, 23 aa, Mycobacterium
RVMKKAVAYLLPFIEKEKEQNGT

SEQ ID NO: 728292 - protein, 17 aa, Mycobacterium
RVMKKAVAYLLPYIEAE

SEQ ID NO: 728293 - protein, 23 aa, Mycobacterium
RVMKKAVAYLLPYIEAEKADAGT

SEQ ID NO: 728294 - protein, 17 aa, Mycobacterium
RVMLAAAAHGHRTQLEL

SEQ ID NO: 728295 - protein, 21 aa, Mycobacterium
RVMPESSPLFGVYNASKAALS

SEQ ID NO: 728296 - protein, 21 aa, Mycobacterium
RVMSANVARIFELIADPSRQP

SEQ ID NO: 728297 - protein, 27 aa, Mycobacterium
RVNGAALRPVHDWVAAFERAWNERLDR

SEQ ID NO: 728298 - protein, 19 aa, Mycobacterium
RVNGPKAWDERFVSDWRFT

SEQ ID NO: 728299 - protein, 18 aa, Mycobacterium
RVNLLNRYGDVATDGTYS

SEQ ID NO: 728300 - protein, 22 aa, Mycobacterium
RVNMPATEIFAAYTEFEARDIP

SEQ ID NO: 728301 - protein, 19 aa, Mycobacterium
RVNPVYIPRNHLVEEALTA

SEQ ID NO: 728302 - protein, 22 aa, Mycobacterium
RVNRLARFLIAAGVGPEAVVGL

SEQ ID NO: 728303 - protein, 17 aa, Mycobacterium
RVNRPIVDFSLTHSYVA

SEQ ID NO: 728304 - protein, 27 aa, Mycobacterium
RVNRRPRGSYQIAVLGLKGGAGKTTTT

SEQ ID NO: 728305 - protein, 17 aa, Mycobacterium
RVNSLGPFLGIQAALPH

SEQ ID NO: 728306 - protein, 17 aa, Mycobacterium
RVNSVAPGYIWGETLQG

SEQ ID NO: 728307 - protein, 26 aa, Mycobacterium
RVNSVLPGYIWGGTLESYFSHQAGKY

SEQ ID NO: 728308 - protein, 18 aa, Mycobacterium
RVNVKFNVPAGMDRNAYF

SEQ ID NO: 728309 - protein, 24 aa, Mycobacterium
RVPADRLVRVLGLLPGNPRIGAGR

SEQ ID NO: 728310 - protein, 22 aa, Mycobacterium
RVPAEALWRAQTQRAVENFPIS

SEQ ID NO: 728311 - protein, 23 aa, Mycobacterium
RVPAESKAAIGQSIELAFDTTKL

SEQ ID NO: 728312 - protein, 20 aa, Mycobacterium
RVPAIPEFRTKLADNDLNFD

SEQ ID NO: 728313 - protein, 26 aa, Mycobacterium
RVPALPRLADDAALPRCRQTVHRGVV

SEQ ID NO: 728314 - protein, 26 aa, Mycobacterium
RVPALPRLGPDDALPRCRRTVHRGAV

SEQ ID NO: 728315 - protein, 26 aa, Mycobacterium
RVPALPRLGPQDALPRCRQTVHRGAV

SEQ ID NO: 728316 - protein, 24 aa, Mycobacterium
RVPAPDRVEWVLAHPTGITEIQEG

SEQ ID NO: 728317 - protein, 18 aa, Mycobacterium
RVPATLQAAVAARIDRLP

SEQ ID NO: 728318 - protein, 26 aa, Mycobacterium
RVPCLPSDRLINLLIYIKGYLDGTLT

SEQ ID NO: 728319 - protein, 19 aa, Mycobacterium
RVPCLPSDRLLNLLHYVKW

SEQ ID NO: 728320 - protein, 26 aa, Mycobacterium
RVPCLPSDRLLNLLIYIKGYLDGTLT

SEQ ID NO: 728321 - protein, 26 aa, Mycobacterium
RVPCLPSDRLLNLLIYIKSYLDGTLT

SEQ ID NO: 728322 - protein, 25 aa, Mycobacterium
RVPCLPTDRLLNLLLYVKGYLDGTL

SEQ ID NO: 728323 - protein, 33 aa, Mycobacterium
RVPDAAAVWAERGWRFPDRLDRVYVNTRARQEL

SEQ ID NO: 728324 - protein, 26 aa, Mycobacterium
RVPDALECLACLAVDAGNHPHAARLL

SEQ ID NO: 728325 - protein, 17 aa, Mycobacterium
RVPEDLSVVGFDDTQLA

SEQ ID NO: 728326 - protein, 17 aa, Mycobacterium
RVPELPGAGSLLAPPWT

SEQ ID NO: 728327 - protein, 17 aa, Mycobacterium
RVPEVLARFPGARTAKV

SEQ ID NO: 728328 - protein, 25 aa, Mycobacterium
RVPGADAFRSWRLLVSRYGSPAPGP

SEQ ID NO: 728329 - protein, 25 aa, Mycobacterium
RVPGAEAFRSWRLLVTRYGTPAPGP

SEQ ID NO: 728330 - protein, 23 aa, Mycobacterium
RVPGDELLAVCERLVKMTRKQRA

SEQ ID NO: 728331 - protein, 22 aa, Mycobacterium
RVPGIGKRGAERMVLELRDKVG

SEQ ID NO: 728332 - protein, 25 aa, Mycobacterium
RVPIRRFGPELYLDAPTGVIPLDLS

SEQ ID NO: 728333 - protein, 19 aa, Mycobacterium
RVPLPRDLLRDNYILKATP

SEQ ID NO: 728334 - protein, 21 aa, Mycobacterium
RVPNRKGFGSLHMPDFPLLPV

SEQ ID NO: 728335 - protein, 26 aa, Mycobacterium
RVPNRKGFGSLRMSDFPLIPARVETW

SEQ ID NO: 728336 - protein, 24 aa, Mycobacterium
RVPPDRHPHCAWTVVIDESHPAAR

SEQ ID NO: 728337 - protein, 17 aa, Mycobacterium
RVPPFVAVQCIAGPTHT

SEQ ID NO: 728338 - protein, 17 aa, Mycobacterium
RVPQIWVGGHGPRMLRL

SEQ ID NO: 728339 - protein, 24 aa, Mycobacterium
RVPQRVAAAMSFHGGGLVTDDAES

SEQ ID NO: 728340 - protein, 20 aa, Mycobacterium
RVPRKGLPTIAKRLGQGVGG

SEQ ID NO: 728341 - protein, 21 aa, Mycobacterium
RVPRRPEPRTAVPAGSVALAG

SEQ ID NO: 728342 - protein, 24 aa, Mycobacterium
RVPSDRLPAALALPAVTRDLAATA

SEQ ID NO: 728343 - protein, 21 aa, Mycobacterium
RVPSEGLELDVLVARETLDDW

SEQ ID NO: 728344 - protein, 18 aa, Mycobacterium
RVPSVAVRCVEVDNAAHL

SEQ ID NO: 728345 - protein, 20 aa, Mycobacterium
RVPTEKGYREFVDRIDNVKP

SEQ ID NO: 728346 - protein, 19 aa, Mycobacterium
RVPTEKGYREFVDRLDDVK

SEQ ID NO: 728347 - protein, 20 aa, Mycobacterium
RVPTEKGYREFVDRLHDVKP

SEQ ID NO: 728348 - protein, 20 aa, Mycobacterium
RVPTEKGYREFVNRLEDVKP

SEQ ID NO: 728349 - protein, 25 aa, Mycobacterium
RVPVESVRPGFSLAIDDGGDFRLFR

SEQ ID NO: 728350 - protein, 21 aa, Mycobacterium
RVPVPSWPPGLSFEASEGAGE

SEQ ID NO: 728351 - protein, 28 aa, Mycobacterium
RVPVWSEFVEVHWSRWGEAYVTPVEPDL

SEQ ID NO: 728352 - protein, 19 aa, Mycobacterium
RVPWVTWGTTAMVARSVTK

SEQ ID NO: 728353 - protein, 17 aa, Mycobacterium
RVPYDVHEVILRLVDGS

SEQ ID NO: 728354 - protein, 37 aa, Mycobacterium
RVPYYRVLELAPWLKWPEPNFPVSNFFHGGAAPLNAI

SEQ ID NO: 728355 - protein, 19 aa, Mycobacterium
RVQAFAEVELRGVLENRAR

SEQ ID NO: 728356 - protein, 20 aa, Mycobacterium
RVQELFEARIPRNRAPIADV

SEQ ID NO: 728357 - protein, 19 aa, Mycobacterium
RVQELFEARVPRNKAPIAD

SEQ ID NO: 728358 - protein, 17 aa, Mycobacterium
RVQELTAALAARDIPTV

SEQ ID NO: 728359 - protein, 24 aa, Mycobacterium
RVQFGPRWLVPPLVAVFSPEGIRD

SEQ ID NO: 728360 - protein, 24 aa, Mycobacterium
RVQGRLRLGPGWVSHLLQDLAVTR

SEQ ID NO: 728361 - protein, 29 aa, Mycobacterium
RVQLKGSNLEFALGYSHPVVIEAPDGITF

SEQ ID NO: 728362 - protein, 26 aa, Mycobacterium
RVQLPATPWHHAHHWIHIAKPDTVAH

SEQ ID NO: 728363 - protein, 17 aa, Mycobacterium
RVQLTIIDTGSWKAPDD

SEQ ID NO: 728364 - protein, 26 aa, Mycobacterium
RVQMEIFTKFSIPINIARVFHRDQKF

SEQ ID NO: 728365 - protein, 18 aa, Mycobacterium
RVQNRIGRQVWLIDITTD

SEQ ID NO: 728366 - protein, 23 aa, Mycobacterium
RVQPDVVRRALLYAIERKRAELM

SEQ ID NO: 728367 - protein, 22 aa, Mycobacterium
RVQPESLTFTGLMVGTVPLTLA

SEQ ID NO: 728368 - protein, 28 aa, Mycobacterium
RVQRIVRYGCGWIPWGPAADDIQTGIGE

SEQ ID NO: 728369 - protein, 23 aa, Mycobacterium
RVQSLRLHYARTLDLWAEALEAN

SEQ ID NO: 728370 - protein, 33 aa, Mycobacterium
RVQTAGGFFFLVELLDATSFWQSARAGILESLG

SEQ ID NO: 728371 - protein, 24 aa, Mycobacterium
RVQVLERFGMFGIRISIALLAAGI

SEQ ID NO: 728372 - protein, 18 aa, Mycobacterium
RVQVPVLLIGGWQDLFIR

SEQ ID NO: 728373 - protein, 19 aa, Mycobacterium
RVRAFELASEIAARRPNGV

SEQ ID NO: 728374 - protein, 17 aa, Mycobacterium
RVRAFYLDIAQWAVDDP

SEQ ID NO: 728375 - protein, 21 aa, Mycobacterium
RVRAGLDFGAVLAINGDYFGN

SEQ ID NO: 728376 - protein, 24 aa, Mycobacterium
RVRAPRAGLTFEFVVAEPGWTMYM

SEQ ID NO: 728377 - protein, 28 aa, Mycobacterium
RVRAPSFELGEYVIPEGYSIVVSISRCH

SEQ ID NO: 728378 - protein, 17 aa, Mycobacterium
RVRARKAVILGTGGFEW

SEQ ID NO: 728379 - protein, 17 aa, Mycobacterium
RVRARRGVILGTGGFEW

SEQ ID NO: 728380 - protein, 20 aa, Mycobacterium
RVRATFPLPARETITYEVVT

SEQ ID NO: 728381 - protein, 31 aa, Mycobacterium
RVRATREIWVLLGPDLRGAWVHSNDYVTEDD

SEQ ID NO: 728382 - protein, 23 aa, Mycobacterium
RVRAVKRWMGIDVTIDDGRLLIA

SEQ ID NO: 728383 - protein, 19 aa, Mycobacterium
RVRAVTVWRADGGATDDAG

SEQ ID NO: 728384 - protein, 18 aa, Mycobacterium
RVRAWACKPGADGVATID

SEQ ID NO: 728385 - protein, 29 aa, Mycobacterium
RVRAWIERPGRRIALAVAEMEARANGGYR

SEQ ID NO: 728386 - protein, 23 aa, Mycobacterium
RVRCSMWSPRLLQISARVIGERG

SEQ ID NO: 728387 - protein, 17 aa, Mycobacterium
RVRCYVVGVTRGAREPL

SEQ ID NO: 728388 - protein, 17 aa, Mycobacterium
RVRDAGAVAAQLGTAFL

SEQ ID NO: 728389 - protein, 18 aa, Mycobacterium
RVRDCVRLNTPVTKVVIE

SEQ ID NO: 728390 - protein, 18 aa, Mycobacterium
RVRDDGFVGLRVVPWLWN

SEQ ID NO: 728391 - protein, 23 aa, Mycobacterium
RVRDGLLEIGRKLGIPPLATNDC

SEQ ID NO: 728392 - protein, 24 aa, Mycobacterium
RVRDLPARGWILLGEWPGTELVLG

SEQ ID NO: 728393 - protein, 23 aa, Mycobacterium
RVREGELTPALAAQQILDAAADT

SEQ ID NO: 728394 - protein, 20 aa, Mycobacterium
RVREGLRQLFSLPEGYEVIL

SEQ ID NO: 728395 - protein, 23 aa, Mycobacterium
RVREITGGVGVPVVYDGIGKATY

SEQ ID NO: 728396 - protein, 22 aa, Mycobacterium
RVRELIDRYPLRGIKGPMGTAQ

SEQ ID NO: 728397 - protein, 17 aa, Mycobacterium
RVRELLAELGVDLTVAH

SEQ ID NO: 728398 - protein, 22 aa, Mycobacterium
RVRELLRFVTWSGSNPGIVYVT

SEQ ID NO: 728399 - protein, 22 aa, Mycobacterium
RVRELYMAMGIDLFTNLMEIRD

SEQ ID NO: 728400 - protein, 18 aa, Mycobacterium
RVRERWEALTALAELVDD

SEQ ID NO: 728401 - protein, 22 aa, Mycobacterium
RVREVAALIPGAMRGLVSERQL

SEQ ID NO: 728402 - protein, 19 aa, Mycobacterium
RVREVCDKYDLPYTTGSFL

SEQ ID NO: 728403 - protein, 18 aa, Mycobacterium
RVRFRFKDFQIVEDMVAH

SEQ ID NO: 728404 - protein, 22 aa, Mycobacterium
RVRGACHSWLIGNPRRGADSIR

SEQ ID NO: 728405 - protein, 24 aa, Mycobacterium
RVRHVPVLDGQKLIGIVSIGDVVK

SEQ ID NO: 728406 - protein, 25 aa, Mycobacterium
RVRIPEFPLNVYVFTPIHVGDVGPI

SEQ ID NO: 728407 - protein, 28 aa, Mycobacterium
RVRIRSDAAWCFRRSREAIEVIRQAAGA

SEQ ID NO: 728408 - protein, 22 aa, Mycobacterium
RVRKLATAGAFHTHYMASALDG

SEQ ID NO: 728409 - protein, 19 aa, Mycobacterium
RVRLAMGVVTSIDPEILLL

SEQ ID NO: 728410 - protein, 23 aa, Mycobacterium
RVRLCKRDGELLGRPQQLPPTDD

SEQ ID NO: 728411 - protein, 26 aa, Mycobacterium
RVRLEEVGRFVAWLRLPAAGRVGNVS

SEQ ID NO: 728412 - protein, 17 aa, Mycobacterium
RVRLEHVHRELAMADPQ

SEQ ID NO: 728413 - protein, 17 aa, Mycobacterium
RVRLEVGPYCRVGFHRY

SEQ ID NO: 728414 - protein, 25 aa, Mycobacterium
RVRLHPVPHLATGVLMFPWEQAADV

SEQ ID NO: 728415 - protein, 26 aa, Mycobacterium
RVRLLAEAAPVLWAEMPTLPLCRQQR

SEQ ID NO: 728416 - protein, 25 aa, Mycobacterium
RVRLLAETAPILWGDMPTLPLYRQQ

SEQ ID NO: 728417 - protein, 17 aa, Mycobacterium
RVRLPLLKLTVAVQDPG

SEQ ID NO: 728418 - protein, 25 aa, Mycobacterium
RVRLRGGPVLAELTGRFGASARSKV

SEQ ID NO: 728419 - protein, 17 aa, Mycobacterium
RVRLTGGLARGDLKTSV

SEQ ID NO: 728420 - protein, 17 aa, Mycobacterium
RVRNGSLVRVWHGVYAA

SEQ ID NO: 728421 - protein, 19 aa, Mycobacterium
RVRNRWGGEDFVRVLSPIN

SEQ ID NO: 728422 - protein, 18 aa, Mycobacterium
RVRPEHRDLLPAAAADST

SEQ ID NO: 728423 - protein, 27 aa, Mycobacterium
RVRPGTDAWCLAALAAVLVQENLCDEA

SEQ ID NO: 728424 - protein, 22 aa, Mycobacterium
RVRPLRPGWRNRIGLHQLFPLL

SEQ ID NO: 728425 - protein, 20 aa, Mycobacterium
RVRPPWWLKATNKVMMIVSR

SEQ ID NO: 728426 - protein, 25 aa, Mycobacterium
RVRQRPELFLGVFERRAQRGPAGDD

SEQ ID NO: 728427 - protein, 17 aa, Mycobacterium
RVRRADAGGQVFGPRDV

SEQ ID NO: 728428 - protein, 17 aa, Mycobacterium
RVRRARRHAENAAAASD

SEQ ID NO: 728429 - protein, 21 aa, Mycobacterium
RVRREGLAALTLERGLAADGI

SEQ ID NO: 728430 - protein, 24 aa, Mycobacterium
RVRRELTERFPVLADVEIDAAWSG

SEQ ID NO: 728431 - protein, 21 aa, Mycobacterium
RVRRGPLPALERLHRALRERR

SEQ ID NO: 728432 - protein, 17 aa, Mycobacterium
RVRRLGSSLPKTEYEMR

SEQ ID NO: 728433 - protein, 21 aa, Mycobacterium
RVRRRIWELEKRRAHVPWVTW

SEQ ID NO: 728434 - protein, 18 aa, Mycobacterium
RVRRRVRHGGHDVPEGKI

SEQ ID NO: 728435 - protein, 17 aa, Mycobacterium
RVRRSWLERGAADAELG

SEQ ID NO: 728436 - protein, 26 aa, Mycobacterium
RVRSDMRAEEFVRVMSPINLRDLVRA

SEQ ID NO: 728437 - protein, 20 aa, Mycobacterium
RVRSRLEGLAARLTTDRLTD

SEQ ID NO: 728438 - protein, 19 aa, Mycobacterium
RVRSRRASPLTEWAAGGAV

SEQ ID NO: 728439 - protein, 24 aa, Mycobacterium
RVRTRLIELFELFDPADPEVIAGR

SEQ ID NO: 728440 - protein, 18 aa, Mycobacterium
RVRTVLVGICGSDLHAAC

SEQ ID NO: 728441 - protein, 18 aa, Mycobacterium
RVRVCKRDGELLGRPHAL

SEQ ID NO: 728442 - protein, 24 aa, Mycobacterium
RVRVEHRVHLGFGVATTRGLLVPV

SEQ ID NO: 728443 - protein, 17 aa, Mycobacterium
RVRVHSLLSWVAAALTK

SEQ ID NO: 728444 - protein, 17 aa, Mycobacterium
RVRVKSRAPAIVDTHNA

SEQ ID NO: 728445 - protein, 20 aa, Mycobacterium
RVRVPTPRCFYCEITEDAMD

SEQ ID NO: 728446 - protein, 17 aa, Mycobacterium
RVRVWDGLRRYVDGFLQ

SEQ ID NO: 728447 - protein, 18 aa, Mycobacterium
RVRWVRALADLRVARLLA

SEQ ID NO: 728448 - protein, 19 aa, Mycobacterium
RVSAATAFLKPALGRPNLT

SEQ ID NO: 728449 - protein, 19 aa, Mycobacterium
RVSACTGSPGCARSVADVR

SEQ ID NO: 728450 - protein, 28 aa, Mycobacterium
RVSAELRAAGFTVPPSQANFVWLPLEDR

SEQ ID NO: 728451 - protein, 26 aa, Mycobacterium
RVSAGCDSCYALALAARLKAMGSPKY

SEQ ID NO: 728452 - protein, 17 aa, Mycobacterium
RVSAIFRPTIERVARAT

SEQ ID NO: 728453 - protein, 17 aa, Mycobacterium
RVSARPGGLTPREIEVL

SEQ ID NO: 728454 - protein, 24 aa, Mycobacterium
RVSDAIKLSVPFLTLEGNPPADNS

SEQ ID NO: 728455 - protein, 23 aa, Mycobacterium
RVSDAPPALARIVGKHCESGDIV

SEQ ID NO: 728456 - protein, 20 aa, Mycobacterium
RVSDIGVLWNSFVAQCSPGA

SEQ ID NO: 728457 - protein, 34 aa, Mycobacterium
RVSEALSASGFRVIPSDANFILFGRFADAAASWR

SEQ ID NO: 728458 - protein, 24 aa, Mycobacterium
RVSEAWALLVSKLRAAHLREPIND

SEQ ID NO: 728459 - protein, 27 aa, Mycobacterium
RVSECECGPETSCYGCLRSYQNQRDHD

SEQ ID NO: 728460 - protein, 17 aa, Mycobacterium
RVSELPYLVPILEQSFD

SEQ ID NO: 728461 - protein, 20 aa, Mycobacterium
RVSEWHSIFDSLGLRVVDTD

SEQ ID NO: 728462 - protein, 18 aa, Mycobacterium
RVSFMIRFGAGLLPEAKT

SEQ ID NO: 728463 - protein, 27 aa, Mycobacterium
RVSGFSLLGAWAERVALPVGSVVPTNA

SEQ ID NO: 728464 - protein, 18 aa, Mycobacterium
RVSHLVIYNSLYGAADGH

SEQ ID NO: 728465 - protein, 23 aa, Mycobacterium
RVSIFLWGAWNGVLSLNLRPDRL

SEQ ID NO: 728466 - protein, 27 aa, Mycobacterium
RVSKFVAAPGARPGWSSFFEDLSRRPR

SEQ ID NO: 728467 - protein, 17 aa, Mycobacterium
RVSKKGVHALTFTENPA

SEQ ID NO: 728468 - protein, 24 aa, Mycobacterium
RVSKKLAGMGFRVIPSDANFVLFG

SEQ ID NO: 728469 - protein, 23 aa, Mycobacterium
RVSKLVLCGAYARGRAVRAVGEE

SEQ ID NO: 728470 - protein, 39 aa, Mycobacterium
RVSLERNMQCGIGWCGHCQLGPLLLCRDGPVVGYDVADP

SEQ ID NO: 728471 - protein, 35 aa, Mycobacterium
RVSLERNMQCGVGWCGHCQLGPLLVCRDGPVVGYD

SEQ ID NO: 728472 - protein, 19 aa, Mycobacterium
RVSLRANGYGVLFLSSLRP

SEQ ID NO: 728473 - protein, 22 aa, Mycobacterium
RVSPGLIRRYAVVGGDHNPIHT

SEQ ID NO: 728474 - protein, 20 aa, Mycobacterium
RVSQFPRAWVAVSTHDGRSG

SEQ ID NO: 728475 - protein, 26 aa, Mycobacterium
RVSRAGELVSAWAGRLNIAAVNGVSA

SEQ ID NO: 728476 - protein, 17 aa, Mycobacterium
RVSRALIYREWVETGAY

SEQ ID NO: 728477 - protein, 18 aa, Mycobacterium
RVSRAMFNELWPGFDHDD

SEQ ID NO: 728478 - protein, 18 aa, Mycobacterium
RVSRAMFNELWPGFDPGE

SEQ ID NO: 728479 - protein, 17 aa, Mycobacterium
RVSRIIGSPGYPAPLDR

SEQ ID NO: 728480 - protein, 19 aa, Mycobacterium
RVSRSGWYGLDPVDADLFT

SEQ ID NO: 728481 - protein, 18 aa, Mycobacterium
RVSRSVRADARMAAARTV

SEQ ID NO: 728482 - protein, 23 aa, Mycobacterium
RVSRVVPIGSPIRDLGYAAGALY

SEQ ID NO: 728483 - protein, 28 aa, Mycobacterium
RVSSLIKVKGFRNVVHWTVTEYDEPTSI

SEQ ID NO: 728484 - protein, 21 aa, Mycobacterium
RVSSRPANPVAEWVAHGRVEN

SEQ ID NO: 728485 - protein, 19 aa, Mycobacterium
RVSVLGCYEDGTLATRVVV

SEQ ID NO: 728486 - protein, 21 aa, Mycobacterium
RVSVRSVIHRHYLEVLRPLVR

SEQ ID NO: 728487 - protein, 19 aa, Mycobacterium
RVSWMTGPLLDGLVMDEDC

SEQ ID NO: 728488 - protein, 20 aa, Mycobacterium
RVTAAGLNPMDWIITADADT

SEQ ID NO: 728489 - protein, 19 aa, Mycobacterium
RVTAAPVLDARGRARIVRN

SEQ ID NO: 728490 - protein, 17 aa, Mycobacterium
RVTALSRRRRGPETIAE

SEQ ID NO: 728491 - protein, 21 aa, Mycobacterium
RVTAMPVRLVDGGAGGMRIIG

SEQ ID NO: 728492 - protein, 19 aa, Mycobacterium
RVTCRPFAGSAPRAADPDV

SEQ ID NO: 728493 - protein, 21 aa, Mycobacterium
RVTDVRNWFVFSASERDVDTG

SEQ ID NO: 728494 - protein, 21 aa, Mycobacterium
RVTDVRNWFVFSASERDVETG

SEQ ID NO: 728495 - protein, 27 aa, Mycobacterium
RVTEAHGWPDVFALVARYLVEARRRRE

SEQ ID NO: 728496 - protein, 27 aa, Mycobacterium
RVTELFDRMAAQRGFTFYLNVEVGKHL

SEQ ID NO: 728497 - protein, 17 aa, Mycobacterium
RVTELGIAHPGVILSAV

SEQ ID NO: 728498 - protein, 21 aa, Mycobacterium
RVTELRRARTPFVHATVVRAQ

SEQ ID NO: 728499 - protein, 19 aa, Mycobacterium
RVTFGRGCIAEVGDRARAL

SEQ ID NO: 728500 - protein, 19 aa, Mycobacterium
RVTGLVLVDVVPRYEKEGS

SEQ ID NO: 728501 - protein, 21 aa, Mycobacterium
RVTGRKNLHVWAGECHVHAGI

SEQ ID NO: 728502 - protein, 24 aa, Mycobacterium
RVTGYDSATAWVRAAHAFPGELIG

SEQ ID NO: 728503 - protein, 24 aa, Mycobacterium
RVTKALSGMGFRVIPSDANFVLFG

SEQ ID NO: 728504 - protein, 19 aa, Mycobacterium
RVTLELGGKSANIVFDDCD

SEQ ID NO: 728505 - protein, 19 aa, Mycobacterium
RVTLGRGWLQLIRDDVDGA

SEQ ID NO: 728506 - protein, 18 aa, Mycobacterium
RVTLGRTAYQLGVLERAL

SEQ ID NO: 728507 - protein, 25 aa, Mycobacterium
RVTLICGTQLLPSVGEPARRAAAKR

SEQ ID NO: 728508 - protein, 26 aa, Mycobacterium
RVTLVIRGGCMLRHCDDTLCERFTRI

SEQ ID NO: 728509 - protein, 18 aa, Mycobacterium
RVTLYGLPLAARRRVGYS

SEQ ID NO: 728510 - protein, 19 aa, Mycobacterium
RVTMPARATLLLYTDGLVE

SEQ ID NO: 728511 - protein, 22 aa, Mycobacterium
RVTNMLLVPAVIQFLLDTTGLD

SEQ ID NO: 728512 - protein, 19 aa, Mycobacterium
RVTPPVCARAKDLRAMGFE

SEQ ID NO: 728513 - protein, 17 aa, Mycobacterium
RVTPRMVRFAGRAERIV

SEQ ID NO: 728514 - protein, 17 aa, Mycobacterium
RVTQAFAPILARQPDSA

SEQ ID NO: 728515 - protein, 19 aa, Mycobacterium
RVTQDFDATVCWMADDASL

SEQ ID NO: 728516 - protein, 24 aa, Mycobacterium
RVTQDFDATVCWMADGATLEPGRE

SEQ ID NO: 728517 - protein, 18 aa, Mycobacterium
RVTQPYIDRLEKWCDTYN

SEQ ID NO: 728518 - protein, 20 aa, Mycobacterium
RVTRKLGDLITFVIHIPLSI

SEQ ID NO: 728519 - protein, 23 aa, Mycobacterium
RVTRLAREFPLYAGLEDWSLAGR

SEQ ID NO: 728520 - protein, 22 aa, Mycobacterium
RVTRPRVAVLEVVDANPHADTE

SEQ ID NO: 728521 - protein, 20 aa, Mycobacterium
RVTRRLGDSITFVIHIPLSI

SEQ ID NO: 728522 - protein, 24 aa, Mycobacterium
RVTSRYEIPCTVSGTVTVDGTVHR

SEQ ID NO: 728523 - protein, 22 aa, Mycobacterium
RVTTGWLRASMRALDESRSRPF

SEQ ID NO: 728524 - protein, 19 aa, Mycobacterium
RVTVIAAGFDAAGPGRKPV

SEQ ID NO: 728525 - protein, 19 aa, Mycobacterium
RVTVIAAGFDATGPGRKPV

SEQ ID NO: 728526 - protein, 18 aa, Mycobacterium
RVTYSRFDPSIPLHRQWR

SEQ ID NO: 728527 - protein, 23 aa, Mycobacterium
RVVAACRTLPVGDPCDPATLIGP

SEQ ID NO: 728528 - protein, 18 aa, Mycobacterium
RVVAALGPRVLKLSAERA

SEQ ID NO: 728529 - protein, 20 aa, Mycobacterium
RVVACAPSPAGGLFLIQNSD

SEQ ID NO: 728530 - protein, 18 aa, Mycobacterium
RVVAEHVQLPGGGQIGAQ

SEQ ID NO: 728531 - protein, 19 aa, Mycobacterium
RVVAELVLGPLLRHVGECD

SEQ ID NO: 728532 - protein, 20 aa, Mycobacterium
RVVAGWRVVALEPYGGAWLN

SEQ ID NO: 728533 - protein, 20 aa, Mycobacterium
RVVAHWDPERVADHTGVTAV

SEQ ID NO: 728534 - protein, 22 aa, Mycobacterium
RVVAKIYCGLGLLKKETVREVH

SEQ ID NO: 728535 - protein, 22 aa, Mycobacterium
RVVAKRARRPMFASKLTGIPPD

SEQ ID NO: 728536 - protein, 22 aa, Mycobacterium
RVVARDSLVKTALFGSDPNWGR

SEQ ID NO: 728537 - protein, 24 aa, Mycobacterium
RVVARRLWRDSGLEPADIQTAFIY

SEQ ID NO: 728538 - protein, 24 aa, Mycobacterium
RVVAVDLRDDWPTALKDAGFDPAQ

SEQ ID NO: 728539 - protein, 27 aa, Mycobacterium
RVVAVDLREDWPAALRAAGFDPNQPTA

SEQ ID NO: 728540 - protein, 25 aa, Mycobacterium
RVVDIGGPFSLELCGGTHVAHSSQI

SEQ ID NO: 728541 - protein, 22 aa, Mycobacterium
RVVDRPAWIRAATRSMRVMTTG

SEQ ID NO: 728542 - protein, 17 aa, Mycobacterium
RVVDSLLGRKVDGMIVA

SEQ ID NO: 728543 - protein, 19 aa, Mycobacterium
RVVDTHWDPPVTASVRLIS

SEQ ID NO: 728544 - protein, 28 aa, Mycobacterium
RVVEIGGPFSIELCGGTHVATSAQIGPV

SEQ ID NO: 728545 - protein, 25 aa, Mycobacterium
RVVEIGGPFSIELCGGTHVRSSAQI

SEQ ID NO: 728546 - protein, 25 aa, Mycobacterium
RVVEIGGPFSLELCGGTHVESSAQI

SEQ ID NO: 728547 - protein, 21 aa, Mycobacterium
RVVEISDRIAGSYCGKLLLDA

SEQ ID NO: 728548 - protein, 20 aa, Mycobacterium
RVVELAAWTFVPAAGAVLAD

SEQ ID NO: 728549 - protein, 21 aa, Mycobacterium
RVVEVPRLVSFHDLMIEKPPH

SEQ ID NO: 728550 - protein, 27 aa, Mycobacterium
RVVFVPDIPRLPSGKVLRRVLKERYGR

SEQ ID NO: 728551 - protein, 27 aa, Mycobacterium
RVVGAARGRPVVDFGARRAHGADAALK

SEQ ID NO: 728552 - protein, 19 aa, Mycobacterium
RVVGDTGWQLLDSKFAVVA

SEQ ID NO: 728553 - protein, 19 aa, Mycobacterium
RVVGDTGWQLLDTKFAVVA

SEQ ID NO: 728554 - protein, 18 aa, Mycobacterium
RVVGHKVGLSSPVMQQMM

SEQ ID NO: 728555 - protein, 18 aa, Mycobacterium
RVVGRGRDADKPALLGSA

SEQ ID NO: 728556 - protein, 25 aa, Mycobacterium
RVVHARGAGAYGYFEPYDAWLSDFT

SEQ ID NO: 728557 - protein, 24 aa, Mycobacterium
RVVHARGAGAYGYFEPYDDALAQY

SEQ ID NO: 728558 - protein, 25 aa, Mycobacterium
RVVHARGAGAYGYFEPYDDWLAEYT

SEQ ID NO: 728559 - protein, 25 aa, Mycobacterium
RVVHARGAVAFGYFEATGRWGDEPI

SEQ ID NO: 728560 - protein, 17 aa, Mycobacterium
RVVHQWTDYGALRERLG

SEQ ID NO: 728561 - protein, 18 aa, Mycobacterium
RVVLDVTQAAGWKHLDLG

SEQ ID NO: 728562 - protein, 24 aa, Mycobacterium
RVVLSVPVSATWIDIPFTLPPNTI

SEQ ID NO: 728563 - protein, 25 aa, Mycobacterium
RVVLSVPVSGVWVEIPFTLPPNTVD

SEQ ID NO: 728564 - protein, 36 aa, Mycobacterium
RVVLVAGNGLDFVRAWLGLILCGAVTVSINPKAVAS

SEQ ID NO: 728565 - protein, 20 aa, Mycobacterium
RVVNELDLGMALTGELDLDP

SEQ ID NO: 728566 - protein, 20 aa, Mycobacterium
RVVNELDLGMALTGEMELDP

SEQ ID NO: 728567 - protein, 20 aa, Mycobacterium
RVVNIAEGLDLVSLTQILAW

SEQ ID NO: 728568 - protein, 17 aa, Mycobacterium
RVVNPRWMAAMRRHGYK

SEQ ID NO: 728569 - protein, 19 aa, Mycobacterium
RVVPARDGVHFGLGGFELA

SEQ ID NO: 728570 - protein, 17 aa, Mycobacterium
RVVPEALALDLPPDVLD

SEQ ID NO: 728571 - protein, 22 aa, Mycobacterium
RVVPEHPFMLLGQTTTADPSRS

SEQ ID NO: 728572 - protein, 23 aa, Mycobacterium
RVVPEVLETVGLSGKANRLPDEL

SEQ ID NO: 728573 - protein, 23 aa, Mycobacterium
RVVPEVLETVGLSGKANRLPHEL

SEQ ID NO: 728574 - protein, 25 aa, Mycobacterium
RVVPLDFLVVQAFDVYEFERMRVPA

SEQ ID NO: 728575 - protein, 17 aa, Mycobacterium
RVVPRPDLLKRLESSAG

SEQ ID NO: 728576 - protein, 27 aa, Mycobacterium
RVVPSAEVWRRIPSWEFHRANVDPGRA

SEQ ID NO: 728577 - protein, 27 aa, Mycobacterium
RVVPSDFRMWVCLHEVTHRVQFSANPW

SEQ ID NO: 728578 - protein, 17 aa, Mycobacterium
RVVPTESALQFVGAATF

SEQ ID NO: 728579 - protein, 18 aa, Mycobacterium
RVVQHWISHGVKIFRVDN

SEQ ID NO: 728580 - protein, 26 aa, Mycobacterium
RVVQQVWMPYHWGGAGLVDGDVVNDL

SEQ ID NO: 728581 - protein, 21 aa, Mycobacterium
RVVRAPGRIGLLVFVATTDLP

SEQ ID NO: 728582 - protein, 17 aa, Mycobacterium
RVVRCSWNPGDDSLTGS

SEQ ID NO: 728583 - protein, 21 aa, Mycobacterium
RVVREDFADAVAWVARSLPTR

SEQ ID NO: 728584 - protein, 27 aa, Mycobacterium
RVVRLVGARARYMWVSTFHSTCVRILR

SEQ ID NO: 728585 - protein, 25 aa, Mycobacterium
RVVRPGKRGGWVAADLSWGRLSALR

SEQ ID NO: 728586 - protein, 19 aa, Mycobacterium
RVVRPSGRIGLLAFVANRE

SEQ ID NO: 728587 - protein, 21 aa, Mycobacterium
RVVRVPPHLMARTRASARTPG

SEQ ID NO: 728588 - protein, 18 aa, Mycobacterium
RVVSAPFLLREQKVTLGF

SEQ ID NO: 728589 - protein, 25 aa, Mycobacterium
RVVSEVRALVRWLRPQATAIAVAGV

SEQ ID NO: 728590 - protein, 23 aa, Mycobacterium
RVVSLSSLAARRGRIHFDDLQFE

SEQ ID NO: 728591 - protein, 20 aa, Mycobacterium
RVVSVRRVPSVAVRCVEVDN

SEQ ID NO: 728592 - protein, 18 aa, Mycobacterium
RVVTGIGYGRFCVQTGRL

SEQ ID NO: 728593 - protein, 24 aa, Mycobacterium
RVVTTLARRHERVVAVDIDEVAIK

SEQ ID NO: 728594 - protein, 22 aa, Mycobacterium
RVVVAAVVCPRIVASGPSTDEQ

SEQ ID NO: 728595 - protein, 25 aa, Mycobacterium
RVVVLGDAWGLLKFFNDDAYEIDEK

SEQ ID NO: 728596 - protein, 21 aa, Mycobacterium
RVVVPEAYFQFPVAKYGLALD

SEQ ID NO: 728597 - protein, 24 aa, Mycobacterium
RVVVPFPIACGACSACRRDLYSLC

SEQ ID NO: 728598 - protein, 21 aa, Mycobacterium
RVVVVADRFGIDPASMVTDVL

SEQ ID NO: 728599 - protein, 20 aa, Mycobacterium
RVVWVAGGLLKGASVDAEVA

SEQ ID NO: 728600 - protein, 17 aa, Mycobacterium
RVVYCVLNGMGSYGPYT

SEQ ID NO: 728601 - protein, 22 aa, Mycobacterium
RVWAWTLPDGGFGWSNAGLVAG

SEQ ID NO: 728602 - protein, 26 aa, Mycobacterium
RVWEIRLAPGERWHAHRHVLDYFWTA

SEQ ID NO: 728603 - protein, 18 aa, Mycobacterium
RVWELLWEQCAIGLTDGP

SEQ ID NO: 728604 - protein, 23 aa, Mycobacterium
RVWERPYIAAGIFLYDQLGGAKS

SEQ ID NO: 728605 - protein, 21 aa, Mycobacterium
RVWFGEQWITSILDLFKENAR

SEQ ID NO: 728606 - protein, 24 aa, Mycobacterium
RVWFPIPGKYAFHVELQRGGLEVK

SEQ ID NO: 728607 - protein, 22 aa, Mycobacterium
RVWNPPMPLLFQRAIGNEHRPF

SEQ ID NO: 728608 - protein, 17 aa, Mycobacterium
RVWRCAEPLTEDGTADR

SEQ ID NO: 728609 - protein, 18 aa, Mycobacterium
RVWRYWYPLMTRGLGADK

SEQ ID NO: 728610 - protein, 22 aa, Mycobacterium
RVWTPVGVPLPFVISELDQGRT

SEQ ID NO: 728611 - protein, 25 aa, Mycobacterium
RVWVNCYHVYPAHAAFGGYKQSGIG

SEQ ID NO: 728612 - protein, 19 aa, Mycobacterium
RVYGPGEGDINEWTIEGEP

SEQ ID NO: 728613 - protein, 21 aa, Mycobacterium
RVYGTLPWHPDIWLDSEDALE

SEQ ID NO: 728614 - protein, 17 aa, Mycobacterium
RVYLKREDLQIVRSYKL

SEQ ID NO: 728615 - protein, 18 aa, Mycobacterium
RVYVPFGTQWYGYFMRRL

SEQ ID NO: 728616 - protein, 25 aa, Mycobacterium
RVYVRCGMVPAPVDVIWRNHTENPA

SEQ ID NO: 728617 - protein, 17 aa, Mycobacterium
RVYYGFVSLDSPPFYDP

SEQ ID NO: 728618 - protein, 17 aa, Mycobacterium
RWACSALSPDAPRGRHT

SEQ ID NO: 728619 - protein, 25 aa, Mycobacterium
RWADAEEVAGAFVFLASDAASYITG

SEQ ID NO: 728620 - protein, 23 aa, Mycobacterium
RWADALAPYGLRWYEEPGDPLDY

SEQ ID NO: 728621 - protein, 20 aa, Mycobacterium
RWADDMPLSLLGTVIPMLEV

SEQ ID NO: 728622 - protein, 21 aa, Mycobacterium
RWADVPDEWCCPDCAVREKVD

SEQ ID NO: 728623 - protein, 25 aa, Mycobacterium
RWAHVYGQRCWLRQLSPRVSREQED

SEQ ID NO: 728624 - protein, 18 aa, Mycobacterium
RWALLTKVHHCIADGIAT

SEQ ID NO: 728625 - protein, 20 aa, Mycobacterium
RWAPELRDIRVLDDPHGPLD

SEQ ID NO: 728626 - protein, 19 aa, Mycobacterium
RWASAQLNLANSLVYSPTK

SEQ ID NO: 728627 - protein, 19 aa, Mycobacterium
RWATELWCTPPVLESSLRM

SEQ ID NO: 728628 - protein, 20 aa, Mycobacterium
RWAVRWKPALNAFAVTFANR

SEQ ID NO: 728629 - protein, 21 aa, Mycobacterium
RWAYVPALEQVAAWYWSMTHP

SEQ ID NO: 728630 - protein, 19 aa, Mycobacterium
RWAYYPWRRAVVAVLGPRG

SEQ ID NO: 728631 - protein, 18 aa, Mycobacterium
RWCEGAGIGDVARLVEEA

SEQ ID NO: 728632 - protein, 20 aa, Mycobacterium
RWDDEIKRWRVGTNRDDDLR

SEQ ID NO: 728633 - protein, 23 aa, Mycobacterium
RWDDPFRALEMLGSLWSSTGLQS

SEQ ID NO: 728634 - protein, 20 aa, Mycobacterium
RWDEARQWLDERGYDSTLDY

SEQ ID NO: 728635 - protein, 21 aa, Mycobacterium
RWDEGGSFDLLLTVFKSADIH

SEQ ID NO: 728636 - protein, 19 aa, Mycobacterium
RWDELPAQLRIERIDMDSP

SEQ ID NO: 728637 - protein, 19 aa, Mycobacterium
RWDELPAQLRIERVDMAGP

SEQ ID NO: 728638 - protein, 18 aa, Mycobacterium
RWDHGYDLGGKRVAVIGT

SEQ ID NO: 728639 - protein, 20 aa, Mycobacterium
RWDHSVPLAGARIAVLGTGS

SEQ ID NO: 728640 - protein, 18 aa, Mycobacterium
RWDLGAIQKVFETANGRA

SEQ ID NO: 728641 - protein, 18 aa, Mycobacterium
RWDMPYLGMQVLIEGLAL

SEQ ID NO: 728642 - protein, 18 aa, Mycobacterium
RWDNDAHIGRFVGQLAGV

SEQ ID NO: 728643 - protein, 18 aa, Mycobacterium
RWEDVQSVVDAEPTRKLA

SEQ ID NO: 728644 - protein, 21 aa, Mycobacterium
RWEEMKRLRHVTSAENPELEV

SEQ ID NO: 728645 - protein, 18 aa, Mycobacterium
RWEFPQGTAPDLSDVEPA

SEQ ID NO: 728646 - protein, 18 aa, Mycobacterium
RWEPAVRTLLSAMPIYSD

SEQ ID NO: 728647 - protein, 21 aa, Mycobacterium
RWEPPALQIARYVTRDVEYYG

SEQ ID NO: 728648 - protein, 23 aa, Mycobacterium
RWEPPALQIARYVTRDVEYYGKT

SEQ ID NO: 728649 - protein, 17 aa, Mycobacterium
RWERGAPMELWQMDVVG

SEQ ID NO: 728650 - protein, 20 aa, Mycobacterium
RWFEELPRGGHFAAMEQPES

SEQ ID NO: 728651 - protein, 23 aa, Mycobacterium
RWFLDAVCTGMWEVHDGVVDAYE

SEQ ID NO: 728652 - protein, 25 aa, Mycobacterium
RWFLDEIPIEPVWVCPLRLRDSEGW

SEQ ID NO: 728653 - protein, 21 aa, Mycobacterium
RWFLDRTCTHILAWEGDADNE

SEQ ID NO: 728654 - protein, 20 aa, Mycobacterium
RWFLDRTCTHILAWEGDADS

SEQ ID NO: 728655 - protein, 21 aa, Mycobacterium
RWFLDRTCTHILAWEGDEDNE

SEQ ID NO: 728656 - protein, 21 aa, Mycobacterium
RWFLDRTCTHILAWEGDSDNE

SEQ ID NO: 728657 - protein, 21 aa, Mycobacterium
RWFLDRTCTHILAWEGSDDNP

SEQ ID NO: 728658 - protein, 19 aa, Mycobacterium
RWFLMASPILRGGNLIVTE

SEQ ID NO: 728659 - protein, 17 aa, Mycobacterium
RWFSLCRVDGVTVTTAD

SEQ ID NO: 728660 - protein, 22 aa, Mycobacterium
RWFTAPEALEYGFVDKIITRGN

SEQ ID NO: 728661 - protein, 19 aa, Mycobacterium
RWFVGRPELIGSDGVHPND

SEQ ID NO: 728662 - protein, 18 aa, Mycobacterium
RWGCALDRDPDRVVTAMR

SEQ ID NO: 728663 - protein, 20 aa, Mycobacterium
RWGKYLGLQAGELFLITHLS

SEQ ID NO: 728664 - protein, 20 aa, Mycobacterium
RWGKYLGVQAGPLWLIAHLS

SEQ ID NO: 728665 - protein, 19 aa, Mycobacterium
RWGPPDAPGRYVLVFNGEI

SEQ ID NO: 728666 - protein, 26 aa, Mycobacterium
RWGSVEWTNLCTLYLRACESRSPAPI

SEQ ID NO: 728667 - protein, 20 aa, Mycobacterium
RWHPVHELPPMAFDHAPMVE

SEQ ID NO: 728668 - protein, 24 aa, Mycobacterium
RWHRGDRVLLRMAWTRDDPGDVDA

SEQ ID NO: 728669 - protein, 19 aa, Mycobacterium
RWHRGELHVPLPGGESGED

SEQ ID NO: 728670 - protein, 24 aa, Mycobacterium
RWHSLARLAIRDDIYGSLRALCFD

SEQ ID NO: 728671 - protein, 18 aa, Mycobacterium
RWIAAGLFDPAVREKAGM

SEQ ID NO: 728672 - protein, 26 aa, Mycobacterium
RWIEQPVYEGIRFAMPAASIAVCGFE

SEQ ID NO: 728673 - protein, 26 aa, Mycobacterium
RWIGEAANWMSCWTMGLNQSTHGTWN

SEQ ID NO: 728674 - protein, 26 aa, Mycobacterium
RWIGTAANWMSCWTMGLNQSTHGTWN

SEQ ID NO: 728675 - protein, 19 aa, Mycobacterium
RWILFDVGSGLHFQYQGIF

SEQ ID NO: 728676 - protein, 23 aa, Mycobacterium
RWIREEHYRRMYLAINRTSHVQA

SEQ ID NO: 728677 - protein, 23 aa, Mycobacterium
RWISMSWRRCGVFPPSSAASAAI

SEQ ID NO: 728678 - protein, 20 aa, Mycobacterium
RWIVVDLINPLLVQQDARLI

SEQ ID NO: 728679 - protein, 18 aa, Mycobacterium
RWKAHKLDLTPVLHEPDS

SEQ ID NO: 728680 - protein, 25 aa, Mycobacterium
RWKGKSVVWSQTWRNLHSGEPAEIR

SEQ ID NO: 728681 - protein, 21 aa, Mycobacterium
RWLAALRGGARLVIGTRSAVF

SEQ ID NO: 728682 - protein, 18 aa, Mycobacterium
RWLADNDYPLAPVEEVVT

SEQ ID NO: 728683 - protein, 23 aa, Mycobacterium
RWLAEHYDEMVAWRRHIHAHPEL

SEQ ID NO: 728684 - protein, 24 aa, Mycobacterium
RWLDEVPRTPAFYFDAITQLEMTT

SEQ ID NO: 728685 - protein, 17 aa, Mycobacterium
RWLDPRAPAELIHDNRR

SEQ ID NO: 728686 - protein, 18 aa, Mycobacterium
RWLGLDIGRRQFYRVLDA

SEQ ID NO: 728687 - protein, 22 aa, Mycobacterium
RWLIKATLPYAPRKFFAAVEGW

SEQ ID NO: 728688 - protein, 18 aa, Mycobacterium
RWLLANGAGKGTRVGLFF

SEQ ID NO: 728689 - protein, 18 aa, Mycobacterium
RWLMDAMHAPYMRMNSVF

SEQ ID NO: 728690 - protein, 22 aa, Mycobacterium
RWLNRGQRAFQLATQIALLTQA

SEQ ID NO: 728691 - protein, 30 aa, Mycobacterium
RWLPENLAYFAVRWKNVLRQAAVYGACQKW

SEQ ID NO: 728692 - protein, 25 aa, Mycobacterium
RWLPRVISGDAVLAIAMTEPGAGSD

SEQ ID NO: 728693 - protein, 18 aa, Mycobacterium
RWLQGPNQWPAALPELPG

SEQ ID NO: 728694 - protein, 21 aa, Mycobacterium
RWLREEQYRRMYLAINKTAQV

SEQ ID NO: 728695 - protein, 19 aa, Mycobacterium
RWLRERPREAARPPYGLEN

SEQ ID NO: 728696 - protein, 21 aa, Mycobacterium
RWLRMRERLGLDVNVQALTYH

SEQ ID NO: 728697 - protein, 18 aa, Mycobacterium
RWLSLEGKSAVLTDIEDV

SEQ ID NO: 728698 - protein, 29 aa, Mycobacterium
RWLSQRLSDRLGVCAGVRFRSPRSLIAEI

SEQ ID NO: 728699 - protein, 18 aa, Mycobacterium
RWLSSGGLLATKIPATPY

SEQ ID NO: 728700 - protein, 19 aa, Mycobacterium
RWLSSGGVLATKIPATPYP

SEQ ID NO: 728701 - protein, 25 aa, Mycobacterium
RWLTDHSWNRPSWTVADLEAAKAGR

SEQ ID NO: 728702 - protein, 21 aa, Mycobacterium
RWLTDYAEAAHGMFASLSTEE

SEQ ID NO: 728703 - protein, 25 aa, Mycobacterium
RWLVRVMTSLMLFPGHDEADERAML

SEQ ID NO: 728704 - protein, 23 aa, Mycobacterium
RWMAAMRRHGYKGAFEMAATVDY

SEQ ID NO: 728705 - protein, 19 aa, Mycobacterium
RWMDFSDKADLVMYGSSYP

SEQ ID NO: 728706 - protein, 19 aa, Mycobacterium
RWNALCDALGAPDLSSDAR

SEQ ID NO: 728707 - protein, 24 aa, Mycobacterium
RWNCKAGKCGSCSAEINGYPKLMC

SEQ ID NO: 728708 - protein, 19 aa, Mycobacterium
RWNEPGAQRRSQLLFEAYA

SEQ ID NO: 728709 - protein, 17 aa, Mycobacterium
RWNGLRPTQAAAVEPVL

SEQ ID NO: 728710 - protein, 19 aa, Mycobacterium
RWNNAAAVLDKGAQQMGLL

SEQ ID NO: 728711 - protein, 24 aa, Mycobacterium
RWNPRLRFVEEFNLVDAPEIELFP

SEQ ID NO: 728712 - protein, 21 aa, Mycobacterium
RWPEERTTWTAAAMILAADAL

SEQ ID NO: 728713 - protein, 20 aa, Mycobacterium
RWPEGGVEYAGKRVGVIGTG

SEQ ID NO: 728714 - protein, 22 aa, Mycobacterium
RWPKRHALEFATGQARFVDDIR

SEQ ID NO: 728715 - protein, 20 aa, Mycobacterium
RWPLPAAITPRQLWLRAVAA

SEQ ID NO: 728716 - protein, 33 aa, Mycobacterium
RWPNDRGNSGIVHFNGPFLYRSSFYAETEEQES

SEQ ID NO: 728717 - protein, 20 aa, Mycobacterium
RWPQAGALGPLIRDPDGSVY

SEQ ID NO: 728718 - protein, 25 aa, Mycobacterium
RWPSKAELVLAAFIEGMRAQLVRPN

SEQ ID NO: 728719 - protein, 24 aa, Mycobacterium
RWPSKAELVLAAFIEGVRQVALPP

SEQ ID NO: 728720 - protein, 24 aa, Mycobacterium
RWPSKAELVLAAFIEGVRQVAVPP

SEQ ID NO: 728721 - protein, 19 aa, Mycobacterium
RWPSLRVDDWTPTRETLHM

SEQ ID NO: 728722 - protein, 32 aa, Mycobacterium
RWQAPRPLLDIGLTDVEAWAFLQELVRTLRQQ

SEQ ID NO: 728723 - protein, 18 aa, Mycobacterium
RWQFEGEVLYPIETGRPA

SEQ ID NO: 728724 - protein, 35 aa, Mycobacterium
RWQGWAGGPGGGWGRPPTPLWPDAVGEMCVRQIDG

SEQ ID NO: 728725 - protein, 25 aa, Mycobacterium
RWQHWASCYEFDFTYVHGGGSVRRS

SEQ ID NO: 728726 - protein, 21 aa, Mycobacterium
RWQLDGWLARRRCLDGPVALL

SEQ ID NO: 728727 - protein, 18 aa, Mycobacterium
RWQLGGVLFSKTFSDQMI

SEQ ID NO: 728728 - protein, 20 aa, Mycobacterium
RWQLLAGPHVRRLLRVCDPQ

SEQ ID NO: 728729 - protein, 21 aa, Mycobacterium
RWQNWASCFEPDFTYIHGGGS

SEQ ID NO: 728730 - protein, 19 aa, Mycobacterium
RWQPELWRALVSRVAADPP

SEQ ID NO: 728731 - protein, 19 aa, Mycobacterium
RWQTPLAYMRRIAKADTML

SEQ ID NO: 728732 - protein, 19 aa, Mycobacterium
RWQVNPGPVAARSWNIEPD

SEQ ID NO: 728733 - protein, 17 aa, Mycobacterium
RWRDNVNAPLAFQYLEY

SEQ ID NO: 728734 - protein, 20 aa, Mycobacterium
RWREMAPAMGEWHANDVQQA

SEQ ID NO: 728735 - protein, 17 aa, Mycobacterium
RWREYCLSSVTTHDLPP

SEQ ID NO: 728736 - protein, 17 aa, Mycobacterium
RWRGLDVGSPFQHAKAG

SEQ ID NO: 728737 - protein, 17 aa, Mycobacterium
RWRGSRLRDPRQARFLT

SEQ ID NO: 728738 - protein, 20 aa, Mycobacterium
RWRHGAAVSVGLVFAAELGR

SEQ ID NO: 728739 - protein, 21 aa, Mycobacterium
RWRIDPQPIPAHQWVIEPDLS

SEQ ID NO: 728740 - protein, 20 aa, Mycobacterium
RWRLGGSDVAALWRRAVALV

SEQ ID NO: 728741 - protein, 19 aa, Mycobacterium
RWRLHAGSTSLLFRTLGRN

SEQ ID NO: 728742 - protein, 18 aa, Mycobacterium
RWRPHGFATNAEVSGPLL

SEQ ID NO: 728743 - protein, 18 aa, Mycobacterium
RWRRTSGIHKVRDPRALA

SEQ ID NO: 728744 - protein, 18 aa, Mycobacterium
RWRRTSGIHRVRDQRGLA

SEQ ID NO: 728745 - protein, 19 aa, Mycobacterium
RWRTAYLVLSGRSIDAATA

SEQ ID NO: 728746 - protein, 19 aa, Mycobacterium
RWRTAYLVLSGRTIDPTTA

SEQ ID NO: 728747 - protein, 24 aa, Mycobacterium
RWRTRGAEILSHIADPDVRAIATE

SEQ ID NO: 728748 - protein, 19 aa, Mycobacterium
RWRVAGHRGGMLAGGILSS

SEQ ID NO: 728749 - protein, 23 aa, Mycobacterium
RWSAEQHLVFACGRYEGIDQRVA

SEQ ID NO: 728750 - protein, 34 aa, Mycobacterium
RWSARSWQVRDFLARNGLYYTWFMADEPAGERLL

SEQ ID NO: 728751 - protein, 18 aa, Mycobacterium
RWSELGWPSPARTGRDCA

SEQ ID NO: 728752 - protein, 21 aa, Mycobacterium
RWSGPLYSFGLFRTEASQFYL

SEQ ID NO: 728753 - protein, 17 aa, Mycobacterium
RWSNAIGSLGIEDPDYA

SEQ ID NO: 728754 - protein, 26 aa, Mycobacterium
RWSPESGSLLDEWSHKVVWAAQSLPD

SEQ ID NO: 728755 - protein, 18 aa, Mycobacterium
RWSPGLRAGIKLMHNPHW

SEQ ID NO: 728756 - protein, 17 aa, Mycobacterium
RWSRGRVLLIGDAAGCI

SEQ ID NO: 728757 - protein, 21 aa, Mycobacterium
RWSTADGYLKPGLRRRNLNVV

SEQ ID NO: 728758 - protein, 22 aa, Mycobacterium
RWSTEQHLVFACGRYEGIDQRV

SEQ ID NO: 728759 - protein, 19 aa, Mycobacterium
RWSTVPARPAVTVVQALPK

SEQ ID NO: 728760 - protein, 24 aa, Mycobacterium
RWTEETRDFWGRRAAYAKQQATRP

SEQ ID NO: 728761 - protein, 24 aa, Mycobacterium
RWTEPRSWETLQRGWNVVGLAVRP

SEQ ID NO: 728762 - protein, 18 aa, Mycobacterium
RWTILILREALLGTRRFA

SEQ ID NO: 728763 - protein, 17 aa, Mycobacterium
RWTLLDYRDIVVHIQHQ

SEQ ID NO: 728764 - protein, 17 aa, Mycobacterium
RWTLLDYRDIVVHVQHQ

SEQ ID NO: 728765 - protein, 24 aa, Mycobacterium
RWTPGDEVLLRIFGKAVELAFLAV

SEQ ID NO: 728766 - protein, 24 aa, Mycobacterium
RWTPGDEVLLRLFGKIVEVAFLAV

SEQ ID NO: 728767 - protein, 24 aa, Mycobacterium
RWTPGDEVLLRLFGKLVEVAFLAV

SEQ ID NO: 728768 - protein, 19 aa, Mycobacterium
RWTQDGRLEFVGRTDHQVK

SEQ ID NO: 728769 - protein, 35 aa, Mycobacterium
RWTVEEAIRLRVPVPGIAASLFARFLSRQDESPTM

SEQ ID NO: 728770 - protein, 20 aa, Mycobacterium
RWVAEGGALRLFVDRHRAIP

SEQ ID NO: 728771 - protein, 22 aa, Mycobacterium
RWVARRLVGMAAGGPTLPVTCS

SEQ ID NO: 728772 - protein, 19 aa, Mycobacterium
RWVELPVTHGIRISMVPAS

SEQ ID NO: 728773 - protein, 25 aa, Mycobacterium
RWVKCKRATFKYGLGSEFIDVLKTL

SEQ ID NO: 728774 - protein, 18 aa, Mycobacterium
RWVLSAWGRAGAAERWHN

SEQ ID NO: 728775 - protein, 20 aa, Mycobacterium
RWVLTKGKLPTSLWVEIVTT

SEQ ID NO: 728776 - protein, 19 aa, Mycobacterium
RWVPDILSLPIAVENSLKN

SEQ ID NO: 728777 - protein, 24 aa, Mycobacterium
RWVTEGNYPLAHKVSGSRVGIIGL

SEQ ID NO: 728778 - protein, 22 aa, Mycobacterium
RWVTPVKEFMRTAAEDTTVRGV

SEQ ID NO: 728779 - protein, 18 aa, Mycobacterium
RWWDDLWLNESFATFASV

SEQ ID NO: 728780 - protein, 17 aa, Mycobacterium
RWWSLEAGEQIGYHPQD

SEQ ID NO: 728781 - protein, 25 aa, Mycobacterium
RWYADAHLPYLAWLVETSVDGARLA

SEQ ID NO: 728782 - protein, 18 aa, Mycobacterium
RWYRAEVRNLGNIPSSGG

SEQ ID NO: 728783 - protein, 27 aa, Mycobacterium
RWYYLPIARPRGHDAWSEHAELIKAIA

SEQ ID NO: 728784 - protein, 17 aa, Mycobacterium
RYAAADRMLGRLVKVTP

SEQ ID NO: 728785 - protein, 18 aa, Mycobacterium
RYADADADLAARIADARA

SEQ ID NO: 728786 - protein, 21 aa, Mycobacterium
RYADGWVPFVISRPADYARAL

SEQ ID NO: 728787 - protein, 26 aa, Mycobacterium
RYADLVCSWGPMILGHAHPAVVEAVS

SEQ ID NO: 728788 - protein, 24 aa, Mycobacterium
RYAEHRAAGAIRARFAATTWAQHM

SEQ ID NO: 728789 - protein, 20 aa, Mycobacterium
RYAEQGWYFAGDGARYDSDG

SEQ ID NO: 728790 - protein, 19 aa, Mycobacterium
RYAGGKAKIRDVVIARAAA

SEQ ID NO: 728791 - protein, 19 aa, Mycobacterium
RYAGGWSDPEVMGDDPVIP

SEQ ID NO: 728792 - protein, 19 aa, Mycobacterium
RYAGWAMRSYLRFAQLASD

SEQ ID NO: 728793 - protein, 19 aa, Mycobacterium
RYAHGVTIVDDWSGFGQRT

SEQ ID NO: 728794 - protein, 22 aa, Mycobacterium
RYAKEVMPFLEAVGATIEYAGE

SEQ ID NO: 728795 - protein, 17 aa, Mycobacterium
RYAKRLASSMVEMKAFY

SEQ ID NO: 728796 - protein, 18 aa, Mycobacterium
RYAKRLASTMAEMQEFYD

SEQ ID NO: 728797 - protein, 18 aa, Mycobacterium
RYALLRLEIESVVVTDAT

SEQ ID NO: 728798 - protein, 20 aa, Mycobacterium
RYALSHGLADMSLRPLASAI

SEQ ID NO: 728799 - protein, 20 aa, Mycobacterium
RYAMERVLVDLWRVVLKVPR

SEQ ID NO: 728800 - protein, 18 aa, Mycobacterium
RYAPELSDEEILAMHAVL

SEQ ID NO: 728801 - protein, 18 aa, Mycobacterium
RYAPELSDEQILALHSVL

SEQ ID NO: 728802 - protein, 26 aa, Mycobacterium
RYAPTRLRELCKMDGAVVLSTDCSRI

SEQ ID NO: 728803 - protein, 24 aa, Mycobacterium
RYAQRRNLLLPAFREAGFTVDHSE

SEQ ID NO: 728804 - protein, 18 aa, Mycobacterium
RYARAVQIRARRGVIVCA

SEQ ID NO: 728805 - protein, 21 aa, Mycobacterium
RYARRFCRVHAGLHSVTSPLG

SEQ ID NO: 728806 - protein, 28 aa, Mycobacterium
RYASEIGVPLCSSWGMTETSPLVCSARI

SEQ ID NO: 728807 - protein, 23 aa, Mycobacterium
RYASENLAALGINVITATSDQIV

SEQ ID NO: 728808 - protein, 21 aa, Mycobacterium
RYATCGDLSAAAYAALAEPDR

SEQ ID NO: 728809 - protein, 26 aa, Mycobacterium
RYAVPLDWSQPLAMGTFYDTIVKPAL

SEQ ID NO: 728810 - protein, 18 aa, Mycobacterium
RYAVRPAKSIGVLYDHRD

SEQ ID NO: 728811 - protein, 22 aa, Mycobacterium
RYCEDNALLSPRWIGGADADHR

SEQ ID NO: 728812 - protein, 21 aa, Mycobacterium
RYCGTSFIIPWSAYEVPPELT

SEQ ID NO: 728813 - protein, 19 aa, Mycobacterium
RYDERGCGLSDWEAADFSF

SEQ ID NO: 728814 - protein, 20 aa, Mycobacterium
RYDGRRAVVTGCASGIGELV

SEQ ID NO: 728815 - protein, 21 aa, Mycobacterium
RYDGRRAVVTGCASGIGERAV

SEQ ID NO: 728816 - protein, 20 aa, Mycobacterium
RYDGRRAVVTGCASGIGEYV

SEQ ID NO: 728817 - protein, 25 aa, Mycobacterium
RYDGTLEHLASWGIVAAAPNTETGL

SEQ ID NO: 728818 - protein, 19 aa, Mycobacterium
RYDHVAARFAESGLITYAL

SEQ ID NO: 728819 - protein, 18 aa, Mycobacterium
RYDIPEWERALADAPLQM

SEQ ID NO: 728820 - protein, 24 aa, Mycobacterium
RYDKIHLYDAFGFLESKTVAPGRE

SEQ ID NO: 728821 - protein, 20 aa, Mycobacterium
RYDKLSRFPAGIVALGDAVA

SEQ ID NO: 728822 - protein, 20 aa, Mycobacterium
RYDLEGALTFVQQQAEFFDL

SEQ ID NO: 728823 - protein, 21 aa, Mycobacterium
RYDPELLYISSLFHDIALTRQ

SEQ ID NO: 728824 - protein, 18 aa, Mycobacterium
RYDQVWKEHVLPLNGAYE

SEQ ID NO: 728825 - protein, 18 aa, Mycobacterium
RYDSPFVCIFECHDGQIV

SEQ ID NO: 728826 - protein, 21 aa, Mycobacterium
RYDSSIAPGAWEAVAAARFRR

SEQ ID NO: 728827 - protein, 18 aa, Mycobacterium
RYDTFFFVAALPAGQDAD

SEQ ID NO: 728828 - protein, 18 aa, Mycobacterium
RYDTTSWQRTTLWERMHM

SEQ ID NO: 728829 - protein, 20 aa, Mycobacterium
RYDVELERALAVIAEESAAR

SEQ ID NO: 728830 - protein, 20 aa, Mycobacterium
RYDVIVPLGATWAVYDQTLL

SEQ ID NO: 728831 - protein, 18 aa, Mycobacterium
RYDVPIAGAHVVVIGRGV

SEQ ID NO: 728832 - protein, 17 aa, Mycobacterium
RYDWSVVASQIMRVYET

SEQ ID NO: 728833 - protein, 17 aa, Mycobacterium
RYDYLVNMCDEMGVVTP

SEQ ID NO: 728834 - protein, 19 aa, Mycobacterium
RYEAYGWHVQTVVSGENVT

SEQ ID NO: 728835 - protein, 25 aa, Mycobacterium
RYEHRGVGMIGGLVCRHDGTQEPHN

SEQ ID NO: 728836 - protein, 21 aa, Mycobacterium
RYEKPGMALARSFFTPLGAEL

SEQ ID NO: 728837 - protein, 20 aa, Mycobacterium
RYELRAGDSVIRVEPQVFDV

SEQ ID NO: 728838 - protein, 17 aa, Mycobacterium
RYEMRRQAAVLKAGGSI

SEQ ID NO: 728839 - protein, 18 aa, Mycobacterium
RYENWELADPAGRGVDDV

SEQ ID NO: 728840 - protein, 25 aa, Mycobacterium
RYERAESFLAAAHTLFDSWRGDEII

SEQ ID NO: 728841 - protein, 22 aa, Mycobacterium
RYERMRARIAAYVRGRQVDGTV

SEQ ID NO: 728842 - protein, 19 aa, Mycobacterium
RYERSVALNWSHRDFPELA

SEQ ID NO: 728843 - protein, 25 aa, Mycobacterium
RYERWKESAFQLAWLLDILGAQGET

SEQ ID NO: 728844 - protein, 24 aa, Mycobacterium
RYESGEGPDVFAVHRIDEQLAKAL

SEQ ID NO: 728845 - protein, 18 aa, Mycobacterium
RYEVANCHSSRGHYERGV

SEQ ID NO: 728846 - protein, 19 aa, Mycobacterium
RYEVDWANCNRVHMQNVLG

SEQ ID NO: 728847 - protein, 19 aa, Mycobacterium
RYEVDWDGCKRVNMQNVAG

SEQ ID NO: 728848 - protein, 20 aa, Mycobacterium
RYEVHFACDPRFNKLLGPIP

SEQ ID NO: 728849 - protein, 19 aa, Mycobacterium
RYEVRLEQYALTIAVEARL

SEQ ID NO: 728850 - protein, 20 aa, Mycobacterium
RYFAFWNKWDPGAISSQHGH

SEQ ID NO: 728851 - protein, 23 aa, Mycobacterium
RYFPGRDEVLLGLILSRVDDALG

SEQ ID NO: 728852 - protein, 21 aa, Mycobacterium
RYFPTKRHLFVSALVRESERL

SEQ ID NO: 728853 - protein, 17 aa, Mycobacterium
RYFRDAPLMIVGEGTNE

SEQ ID NO: 728854 - protein, 18 aa, Mycobacterium
RYFRESRLMKIAPVSQEM

SEQ ID NO: 728855 - protein, 26 aa, Mycobacterium
RYFRLLPQRLVERIAPKPGTGPSAAT

SEQ ID NO: 728856 - protein, 22 aa, Mycobacterium
RYFTVRAGSLVAWNSAGADGPF

SEQ ID NO: 728857 - protein, 17 aa, Mycobacterium
RYFVPRFAATPIARGSE

SEQ ID NO: 728858 - protein, 17 aa, Mycobacterium
RYFVPRFAATPITRDTE

SEQ ID NO: 728859 - protein, 21 aa, Mycobacterium
RYGAFRRSFQLPAHVTGDAIT

SEQ ID NO: 728860 - protein, 19 aa, Mycobacterium
RYGDDDGWEQKLEVVADVR

SEQ ID NO: 728861 - protein, 18 aa, Mycobacterium
RYGDGWYPTAVVSPREYA

SEQ ID NO: 728862 - protein, 17 aa, Mycobacterium
RYGDLLSALSPIATDVL

SEQ ID NO: 728863 - protein, 25 aa, Mycobacterium
RYGDLLVKTGGEWRFQTMVQGGWGE

SEQ ID NO: 728864 - protein, 19 aa, Mycobacterium
RYGDVFTMTLPVFGKTVLV

SEQ ID NO: 728865 - protein, 32 aa, Mycobacterium
RYGELRYPHLADWGIPTARAIVEVREVLPGIP

SEQ ID NO: 728866 - protein, 20 aa, Mycobacterium
RYGFARPPLLGSTSRTLATG

SEQ ID NO: 728867 - protein, 17 aa, Mycobacterium
RYGFPLGNVGHIQNIPA

SEQ ID NO: 728868 - protein, 19 aa, Mycobacterium
RYGGTFLADALPAPRADGT

SEQ ID NO: 728869 - protein, 19 aa, Mycobacterium
RYGGTPGRVIVQEGGGAVV

SEQ ID NO: 728870 - protein, 18 aa, Mycobacterium
RYGLKPGDTLLIVDGLFF

SEQ ID NO: 728871 - protein, 22 aa, Mycobacterium
RYGLSSGRFAVLITLGAAPEGR

SEQ ID NO: 728872 - protein, 24 aa, Mycobacterium
RYGNERGVGLGISRSGVCREEVFV

SEQ ID NO: 728873 - protein, 31 aa, Mycobacterium
RYGPLPLPVQRLVAVASLRLLCREMGITDLS

SEQ ID NO: 728874 - protein, 23 aa, Mycobacterium
RYGRPKRWVVVTGTNGKTTTTAM

SEQ ID NO: 728875 - protein, 26 aa, Mycobacterium
RYGSFHRSFRLPSHVSGDAVSAGYEA

SEQ ID NO: 728876 - protein, 26 aa, Mycobacterium
RYGSSVVGFLDGWRGLLEDRRVQLKN

SEQ ID NO: 728877 - protein, 29 aa, Mycobacterium
RYGTVWRVDFLWRSARLIGEYDSDEWHSG

SEQ ID NO: 728878 - protein, 24 aa, Mycobacterium
RYGVDELRAFDLLRRLSQESQVKL

SEQ ID NO: 728879 - protein, 25 aa, Mycobacterium
RYGVKVNAIAPVARTRLTLATPGMG

SEQ ID NO: 728880 - protein, 20 aa, Mycobacterium
RYGYRFEYHDIPAFAAEMNR

SEQ ID NO: 728881 - protein, 19 aa, Mycobacterium
RYHARAVALVALERDACEP

SEQ ID NO: 728882 - protein, 19 aa, Mycobacterium
RYHEWLSIHRAWRSKLPET

SEQ ID NO: 728883 - protein, 17 aa, Mycobacterium
RYHKVILSRSLEVPFAL

SEQ ID NO: 728884 - protein, 19 aa, Mycobacterium
RYHLLLAGASWVAEYGDPD

SEQ ID NO: 728885 - protein, 18 aa, Mycobacterium
RYHPLTLRIEQILASGEL

SEQ ID NO: 728886 - protein, 21 aa, Mycobacterium
RYHQRCWLRQLTPYASREQEN

SEQ ID NO: 728887 - protein, 18 aa, Mycobacterium
RYHYVPTYILRGLTELHL

SEQ ID NO: 728888 - protein, 18 aa, Mycobacterium
RYIAESLAQIGLPDDDEL

SEQ ID NO: 728889 - protein, 26 aa, Mycobacterium
RYIDLVCSWGPMLLGHAHPAVVEAVR

SEQ ID NO: 728890 - protein, 21 aa, Mycobacterium
RYIDRFLMYYVRTADRLQRTA

SEQ ID NO: 728891 - protein, 18 aa, Mycobacterium
RYIDYWGTAVTAFDLHAP

SEQ ID NO: 728892 - protein, 24 aa, Mycobacterium
RYIPRCVRPAFAKRISIIGPASTG

SEQ ID NO: 728893 - protein, 18 aa, Mycobacterium
RYITEAINLYARDSDVVF

SEQ ID NO: 728894 - protein, 18 aa, Mycobacterium
RYIVAGFGRDYADVPPLR

SEQ ID NO: 728895 - protein, 25 aa, Mycobacterium
RYKDWLTIHRVWRSALPDEIEKGSV

SEQ ID NO: 728896 - protein, 17 aa, Mycobacterium
RYKGARGVARLKALLPF

SEQ ID NO: 728897 - protein, 18 aa, Mycobacterium
RYKTGVLAKYTKLVQSAA

SEQ ID NO: 728898 - protein, 17 aa, Mycobacterium
RYLAARWAAKEAVIKAW

SEQ ID NO: 728899 - protein, 26 aa, Mycobacterium
RYLASKPSAFAWIPFGGGTRRCVGAA

SEQ ID NO: 728900 - protein, 18 aa, Mycobacterium
RYLDCIPAAVEELLKLEE

SEQ ID NO: 728901 - protein, 17 aa, Mycobacterium
RYLDCLAAYSAVNFGHR

SEQ ID NO: 728902 - protein, 19 aa, Mycobacterium
RYLDCLSAYSAVNFGHCNP

SEQ ID NO: 728903 - protein, 18 aa, Mycobacterium
RYLEHFLSTGALELRLQY

SEQ ID NO: 728904 - protein, 19 aa, Mycobacterium
RYLEIWNLVFMQNERGEGT

SEQ ID NO: 728905 - protein, 19 aa, Mycobacterium
RYLERDGLDVTIAHDGSEA

SEQ ID NO: 728906 - protein, 18 aa, Mycobacterium
RYLESRLIELAKRAGRVK

SEQ ID NO: 728907 - protein, 18 aa, Mycobacterium
RYLGPWVPAEQEIWQDPV

SEQ ID NO: 728908 - protein, 23 aa, Mycobacterium
RYLGTEFPRLASGPGTTPPAVPL

SEQ ID NO: 728909 - protein, 23 aa, Mycobacterium
RYLHLPAELIGGGTREIQLNIIA

SEQ ID NO: 728910 - protein, 19 aa, Mycobacterium
RYLIGDKPAAMPLPEIQVI

SEQ ID NO: 728911 - protein, 17 aa, Mycobacterium
RYLIGRKILTPPVGRFA

SEQ ID NO: 728912 - protein, 24 aa, Mycobacterium
RYLIVDECHYYRGVFGSNVAMVLR

SEQ ID NO: 728913 - protein, 23 aa, Mycobacterium
RYLKIAAAMRREGMGFTAGFAAA

SEQ ID NO: 728914 - protein, 23 aa, Mycobacterium
RYLKIAAAMRREGMGFTAGFAGA

SEQ ID NO: 728915 - protein, 20 aa, Mycobacterium
RYLLEETYELFDAVRSGNAD

SEQ ID NO: 728916 - protein, 20 aa, Mycobacterium
RYLLEETYELFDAVRTGDAD

SEQ ID NO: 728917 - protein, 23 aa, Mycobacterium
RYLLERRRALGGFVPSRRTKSKP

SEQ ID NO: 728918 - protein, 27 aa, Mycobacterium
RYLLGTADLHLGYAVCNQFTDLHKEAF

SEQ ID NO: 728919 - protein, 18 aa, Mycobacterium
RYLLHMGQSGIGLPDESY

SEQ ID NO: 728920 - protein, 19 aa, Mycobacterium
RYLMFSVFAVRPGELGEQR

SEQ ID NO: 728921 - protein, 18 aa, Mycobacterium
RYLNYRKTSIYGGSNEVQ

SEQ ID NO: 728922 - protein, 19 aa, Mycobacterium
RYLPAVADLRLRHLENDAS

SEQ ID NO: 728923 - protein, 27 aa, Mycobacterium
RYLPLEELIAAFLPLLFPGMEIVEHHA

SEQ ID NO: 728924 - protein, 23 aa, Mycobacterium
RYLPRSVLLPAIRIGNKLRGGPS

SEQ ID NO: 728925 - protein, 17 aa, Mycobacterium
RYLRALDTKHWDDFADT

SEQ ID NO: 728926 - protein, 18 aa, Mycobacterium
RYLSIGVENCRRIRDGEP

SEQ ID NO: 728927 - protein, 26 aa, Mycobacterium
RYLSRWHRRRPLWVGVAAGGVVDSAT

SEQ ID NO: 728928 - protein, 24 aa, Mycobacterium
RYLTDWAGPAARIRSIGLRLGVPW

SEQ ID NO: 728929 - protein, 18 aa, Mycobacterium
RYLTEAVRNCRRLRDGQP

SEQ ID NO: 728930 - protein, 27 aa, Mycobacterium
RYLTRAELLWRWPPFSATADCASVKPA

SEQ ID NO: 728931 - protein, 24 aa, Mycobacterium
RYLVVDECHYYRGVFGSNVALILQ

SEQ ID NO: 728932 - protein, 23 aa, Mycobacterium
RYMLDRRRALGGFLPERRTKTKA

SEQ ID NO: 728933 - protein, 23 aa, Mycobacterium
RYMLDRRRALGGFVPSRRTTSRP

SEQ ID NO: 728934 - protein, 24 aa, Mycobacterium
RYMLDRRRTLGGFLPERPTKAKTL

SEQ ID NO: 728935 - protein, 23 aa, Mycobacterium
RYMLDRRRTLGGFLPERRTKAKA

SEQ ID NO: 728936 - protein, 23 aa, Mycobacterium
RYMLDRRRTLGGFVPERRTKAKA

SEQ ID NO: 728937 - protein, 22 aa, Mycobacterium
RYNAACSVYGHLHIPRTTWYDD

SEQ ID NO: 728938 - protein, 22 aa, Mycobacterium
RYNAVCSVYGHLHIPRTTWHDE

SEQ ID NO: 728939 - protein, 22 aa, Mycobacterium
RYNAVCSVYGHLHIPRTTWYDD

SEQ ID NO: 728940 - protein, 24 aa, Mycobacterium
RYNPWDERLCLAPNGDLFKTIRAG

SEQ ID NO: 728941 - protein, 18 aa, Mycobacterium
RYNYEPTFILRGLTDINI

SEQ ID NO: 728942 - protein, 17 aa, Mycobacterium
RYPADYLVKLANLSTAD

SEQ ID NO: 728943 - protein, 27 aa, Mycobacterium
RYPARVKCALLGWMAFKDALVQAIEHH

SEQ ID NO: 728944 - protein, 25 aa, Mycobacterium
RYPDIKFVLSHAGGFVPYASHRLAL

SEQ ID NO: 728945 - protein, 24 aa, Mycobacterium
RYPDKRSALLPLLHLVQAEDSYLT

SEQ ID NO: 728946 - protein, 17 aa, Mycobacterium
RYPESHNLYILDRRNGA

SEQ ID NO: 728947 - protein, 28 aa, Mycobacterium
RYPEVKKWLAEVLPNFPVYAHMLGNFSV

SEQ ID NO: 728948 - protein, 17 aa, Mycobacterium
RYPEWDVARKSYRPAWC

SEQ ID NO: 728949 - protein, 18 aa, Mycobacterium
RYPGAQWSVRGRDAQQAR

SEQ ID NO: 728950 - protein, 19 aa, Mycobacterium
RYPGLCHVEIVGYDGDLEE

SEQ ID NO: 728951 - protein, 19 aa, Mycobacterium
RYPGLGVVEAYAIQQVNLF

SEQ ID NO: 728952 - protein, 19 aa, Mycobacterium
RYPINVALHTDHCPQDKLD

SEQ ID NO: 728953 - protein, 23 aa, Mycobacterium
RYPNNHLAFGFGTHFCLGNQLAR

SEQ ID NO: 728954 - protein, 20 aa, Mycobacterium
RYPVHVALHTDHCPKDKLDS

SEQ ID NO: 728955 - protein, 18 aa, Mycobacterium
RYPWLRRVGEWLAAHRDG

SEQ ID NO: 728956 - protein, 24 aa, Mycobacterium
RYQAELRGSPALEEVCQLAKRGVV

SEQ ID NO: 728957 - protein, 20 aa, Mycobacterium
RYQDVITMHECRSAKQLASV

SEQ ID NO: 728958 - protein, 19 aa, Mycobacterium
RYQEVIAMHECRSAKQLAA

SEQ ID NO: 728959 - protein, 19 aa, Mycobacterium
RYQEVIAMHECRSAKQLAT

SEQ ID NO: 728960 - protein, 21 aa, Mycobacterium
RYQGTVPWTLSPWASLNLGAA

SEQ ID NO: 728961 - protein, 18 aa, Mycobacterium
RYQKAAVVAHQFTLEMPY

SEQ ID NO: 728962 - protein, 18 aa, Mycobacterium
RYQLMPGVIGALADSGTP

SEQ ID NO: 728963 - protein, 24 aa, Mycobacterium
RYQMPPFCSSGWAMTNDEVAQGAA

SEQ ID NO: 728964 - protein, 18 aa, Mycobacterium
RYQNVVVEGGRIFNPGWH

SEQ ID NO: 728965 - protein, 23 aa, Mycobacterium
RYQPMFTALGWDPLGDVEIAARP

SEQ ID NO: 728966 - protein, 25 aa, Mycobacterium
RYQQRCWLRQLTPYANRQQENELLR

SEQ ID NO: 728967 - protein, 23 aa, Mycobacterium
RYQRARGKGGLVRVTWAEATELI

SEQ ID NO: 728968 - protein, 17 aa, Mycobacterium
RYQTKMMWWDRSTFANH

SEQ ID NO: 728969 - protein, 23 aa, Mycobacterium
RYQVHSLHGYFLRPGDAKERTVF

SEQ ID NO: 728970 - protein, 23 aa, Mycobacterium
RYQVHSLHGYFLRPGDANEPTVF

SEQ ID NO: 728971 - protein, 23 aa, Mycobacterium
RYQVHSLHGYFLRSGDAQEPTVF

SEQ ID NO: 728972 - protein, 18 aa, Mycobacterium
RYQVPLWPERLLTRDDAA

SEQ ID NO: 728973 - protein, 27 aa, Mycobacterium
RYRAAYFEMFPGVWRHGDWITLTEHGS

SEQ ID NO: 728974 - protein, 18 aa, Mycobacterium
RYRAQRTVEEYGAIVEHL

SEQ ID NO: 728975 - protein, 24 aa, Mycobacterium
RYRDRGRPFLAFLYGIAAHKVADA

SEQ ID NO: 728976 - protein, 22 aa, Mycobacterium
RYRDRIPILIGGGGEKKTFRIA

SEQ ID NO: 728977 - protein, 19 aa, Mycobacterium
RYRDRRKLLEMLAAGSRLI

SEQ ID NO: 728978 - protein, 21 aa, Mycobacterium
RYRELATALGVEPGERTDPLR

SEQ ID NO: 728979 - protein, 21 aa, Mycobacterium
RYREWLTIHRVWRSKLPETLE

SEQ ID NO: 728980 - protein, 17 aa, Mycobacterium
RYRGARGLQRLRTALPL

SEQ ID NO: 728981 - protein, 20 aa, Mycobacterium
RYRHPFKFLSKITPYPGTPL

SEQ ID NO: 728982 - protein, 21 aa, Mycobacterium
RYRIGPVNGGWGVLREALNAE

SEQ ID NO: 728983 - protein, 19 aa, Mycobacterium
RYRISGNRGDSVYFSMTAY

SEQ ID NO: 728984 - protein, 18 aa, Mycobacterium
RYRIYRPAVVVGDSRTGE

SEQ ID NO: 728985 - protein, 20 aa, Mycobacterium
RYRKELDQRAGDGLTAEQRD

SEQ ID NO: 728986 - protein, 23 aa, Mycobacterium
RYRLGEVNGGWTVVREPLNAEHG

SEQ ID NO: 728987 - protein, 19 aa, Mycobacterium
RYRPEEMLPGPHLVSDDDL

SEQ ID NO: 728988 - protein, 24 aa, Mycobacterium
RYRPSREHALLCGDFYDVIQTPDR

SEQ ID NO: 728989 - protein, 24 aa, Mycobacterium
RYRRAWEFLDVVTRLWDSWEPGWL

SEQ ID NO: 728990 - protein, 17 aa, Mycobacterium
RYRREDRAALVIDKQDK

SEQ ID NO: 728991 - protein, 18 aa, Mycobacterium
RYRRYRVYWSPRRTSPAG

SEQ ID NO: 728992 - protein, 18 aa, Mycobacterium
RYRVGIVPRPVSPGLAPK

SEQ ID NO: 728993 - protein, 23 aa, Mycobacterium
RYRWKEVTGRPGSKYKIQHDYTI

SEQ ID NO: 728994 - protein, 25 aa, Mycobacterium
RYRYFYETRIKEIVKSLGNVALDDI

SEQ ID NO: 728995 - protein, 30 aa, Mycobacterium
RYSAGDWVYLPKACTWRQVPDGPTTMLMVE

SEQ ID NO: 728996 - protein, 25 aa, Mycobacterium
RYSALNPEVWTWVAVSGLNLLYQGY

SEQ ID NO: 728997 - protein, 21 aa, Mycobacterium
RYSDCCAVGGDLPAKQGERES

SEQ ID NO: 728998 - protein, 19 aa, Mycobacterium
RYSEPGLATARSFFTPLGM

SEQ ID NO: 728999 - protein, 32 aa, Mycobacterium
RYSLVAANLEMRWEMVGSPLLSKLLKGDFTFF

SEQ ID NO: 729000 - protein, 18 aa, Mycobacterium
RYSPWLAYGQSKLANLLF

SEQ ID NO: 729001 - protein, 19 aa, Mycobacterium
RYTAEHEWVRRSGDDTLRV

SEQ ID NO: 729002 - protein, 18 aa, Mycobacterium
RYTDEWRAYVTRQARWVD

SEQ ID NO: 729003 - protein, 24 aa, Mycobacterium
RYTDRPVWVRGVGLGMDRVMHQHK

SEQ ID NO: 729004 - protein, 18 aa, Mycobacterium
RYTFDLAAEIPLRAELFR

SEQ ID NO: 729005 - protein, 19 aa, Mycobacterium
RYTFGVNWRSDRVLVESLQ

SEQ ID NO: 729006 - protein, 19 aa, Mycobacterium
RYTLERVVRGKDTIAATGN

SEQ ID NO: 729007 - protein, 31 aa, Mycobacterium
RYTLPAYVDPRWVRWLPLLPLDRSLSVSIVH

SEQ ID NO: 729008 - protein, 20 aa, Mycobacterium
RYTLWAAWHRSGLQRRWLSV

SEQ ID NO: 729009 - protein, 25 aa, Mycobacterium
RYTPTVFRPLVNVFFSVIAQDAAMG

SEQ ID NO: 729010 - protein, 18 aa, Mycobacterium
RYTREMFCLMEGRHVHPS

SEQ ID NO: 729011 - protein, 23 aa, Mycobacterium
RYTSGYLCVPLAGEDCDRLGLLP

SEQ ID NO: 729012 - protein, 35 aa, Mycobacterium
RYTSGYLCVPLAGEICDRLGLLPMYAVNQDKHGTA

SEQ ID NO: 729013 - protein, 19 aa, Mycobacterium
RYVAALIREFVRVIDTTPD

SEQ ID NO: 729014 - protein, 17 aa, Mycobacterium
RYVAAWNAAFLPSKDLT

SEQ ID NO: 729015 - protein, 19 aa, Mycobacterium
RYVAVGAPLWSRAEGYHRL

SEQ ID NO: 729016 - protein, 26 aa, Mycobacterium
RYVDLVCSWGPMILGHAHPAVVDAVA

SEQ ID NO: 729017 - protein, 26 aa, Mycobacterium
RYVDLVCSWGPMILGHAHPAVVEAVT

SEQ ID NO: 729018 - protein, 21 aa, Mycobacterium
RYVDRFLMYYIRTADRLQRTA

SEQ ID NO: 729019 - protein, 19 aa, Mycobacterium
RYVIPTAFAPQARELEEMG

SEQ ID NO: 729020 - protein, 18 aa, Mycobacterium
RYVIPTAFSPQARDLEEM

SEQ ID NO: 729021 - protein, 18 aa, Mycobacterium
RYVIPTAFSPQARELEQM

SEQ ID NO: 729022 - protein, 21 aa, Mycobacterium
RYVKDIRVWPKLRELGWDVIR

SEQ ID NO: 729023 - protein, 27 aa, Mycobacterium
RYVPGGTVVNWPWRRLVLSRSANVYAR

SEQ ID NO: 729024 - protein, 22 aa, Mycobacterium
RYVPVEHGRYLAAHIAGSRFIE

SEQ ID NO: 729025 - protein, 18 aa, Mycobacterium
RYVRPPWLRRWVRDGYGW

SEQ ID NO: 729026 - protein, 22 aa, Mycobacterium
RYVRSELTHFLGAEVGNPLATV

SEQ ID NO: 729027 - protein, 25 aa, Mycobacterium
RYVYAATGKPGWFLFDGLVKHDLRT

SEQ ID NO: 729028 - protein, 24 aa, Mycobacterium
RYWENRSAPLLAAYVVADAAHAAD

SEQ ID NO: 729029 - protein, 29 aa, Mycobacterium
RYWRATGPFIGWIRPAVMRALDRQLGRSP

SEQ ID NO: 729030 - protein, 27 aa, Mycobacterium
RYWSEWKDPRLIIAILHNNDLNQVTWE

SEQ ID NO: 729031 - protein, 21 aa, Mycobacterium
RYYELIRLGSSVATWDDTSTE

SEQ ID NO: 729032 - protein, 19 aa, Mycobacterium
RYYFDSVINPSVIWVDLDK

SEQ ID NO: 729033 - protein, 18 aa, Mycobacterium
RYYIAVHAVSVPKLELPE

SEQ ID NO: 729034 - protein, 17 aa, Mycobacterium
RYYRCSWHLISTLPVIG

SEQ ID NO: 729035 - protein, 19 aa, Mycobacterium
SAAAAALFRAYAHDCQAVL

SEQ ID NO: 729036 - protein, 18 aa, Mycobacterium
SAAAACWAELAKTEADQS

SEQ ID NO: 729037 - protein, 17 aa, Mycobacterium
SAAAAIDSYEDWIVGLA

SEQ ID NO: 729038 - protein, 17 aa, Mycobacterium
SAAAAILQRGKPVGTVE

SEQ ID NO: 729039 - protein, 19 aa, Mycobacterium
SAAAARAAGAAGQAQAVAS

SEQ ID NO: 729040 - protein, 20 aa, Mycobacterium
SAAAARLALRHGTPRISLQV

SEQ ID NO: 729041 - protein, 26 aa, Mycobacterium
SAAAARLLPAQSLQDLLAALPNLGIG

SEQ ID NO: 729042 - protein, 18 aa, Mycobacterium
SAAAAWEALAAELSSAAA

SEQ ID NO: 729043 - protein, 31 aa, Mycobacterium
SAAADEISMQIAALFGAHGQSFQAVSSQAAL

SEQ ID NO: 729044 - protein, 19 aa, Mycobacterium
SAAAFQASHARFVEAAAKV

SEQ ID NO: 729045 - protein, 25 aa, Mycobacterium
SAAAFQSAHARFVAAVAQVNALLDI

SEQ ID NO: 729046 - protein, 25 aa, Mycobacterium
SAAAGLKAMTSWHAQHAITVCREAC

SEQ ID NO: 729047 - protein, 20 aa, Mycobacterium
SAAAMGWSPFFPQFDRSSLD

SEQ ID NO: 729048 - protein, 20 aa, Mycobacterium
SAAAMVWRAAAAVELGICDA

SEQ ID NO: 729049 - protein, 23 aa, Mycobacterium
SAAARAFKAQALAAADAGAEGVS

SEQ ID NO: 729050 - protein, 26 aa, Mycobacterium
SAAARLRAALALLVWERRGESVRATV

SEQ ID NO: 729051 - protein, 18 aa, Mycobacterium
SAAASAWDALAAQLESHA

SEQ ID NO: 729052 - protein, 28 aa, Mycobacterium
SAAASRARRALAEFRIRGVSTNIPFLQA

SEQ ID NO: 729053 - protein, 21 aa, Mycobacterium
SAAATRLTPFAAPKQTTNTNG

SEQ ID NO: 729054 - protein, 20 aa, Mycobacterium
SAAATRLTPFAAPQQTTNQS

SEQ ID NO: 729055 - protein, 21 aa, Mycobacterium
SAAAVPYADWLSASAAHAQRA

SEQ ID NO: 729056 - protein, 22 aa, Mycobacterium
SAACARTGTTLLEYPVLMWHWA

SEQ ID NO: 729057 - protein, 24 aa, Mycobacterium
SAACASTAMVLLVNWAGTCTVIHQ

SEQ ID NO: 729058 - protein, 22 aa, Mycobacterium
SAADAHRSAIMALTATWQGCAS

SEQ ID NO: 729059 - protein, 24 aa, Mycobacterium
SAADFNLKGGHVYVGAASTDPVSW

SEQ ID NO: 729060 - protein, 24 aa, Mycobacterium
SAADIRWALVPSRAVSRLLEICDP

SEQ ID NO: 729061 - protein, 17 aa, Mycobacterium
SAADRWFAAGFRDREPA

SEQ ID NO: 729062 - protein, 18 aa, Mycobacterium
SAADSFASVTSGLVGQAW

SEQ ID NO: 729063 - protein, 19 aa, Mycobacterium
SAADWEAVELLNATSGATD

SEQ ID NO: 729064 - protein, 18 aa, Mycobacterium
SAAEAFLPAPSGWRNLAS

SEQ ID NO: 729065 - protein, 30 aa, Mycobacterium
SAAEALTMLPTRAWSGLVILDPGEDSTEVL

SEQ ID NO: 729066 - protein, 24 aa, Mycobacterium
SAAEARGQLRLVEMNQQVLGNLDT

SEQ ID NO: 729067 - protein, 22 aa, Mycobacterium
SAAEILDLGTIVSHDILHLSGP

SEQ ID NO: 729068 - protein, 17 aa, Mycobacterium
SAAEMRDYFPGSTLLKE

SEQ ID NO: 729069 - protein, 22 aa, Mycobacterium
SAAETCHGCALFEDATQTVFGN

SEQ ID NO: 729070 - protein, 25 aa, Mycobacterium
SAAEWEVLEAGLVQRSRLLDAVLAD

SEQ ID NO: 729071 - protein, 20 aa, Mycobacterium
SAAFDRLIALIKRTAGDDRT

SEQ ID NO: 729072 - protein, 18 aa, Mycobacterium
SAAFRLSDAPPWPLAEVD

SEQ ID NO: 729073 - protein, 25 aa, Mycobacterium
SAAFRRQREAIIARCLPLADHIARR

SEQ ID NO: 729074 - protein, 18 aa, Mycobacterium
SAAGALALFGGWTGVDLA

SEQ ID NO: 729075 - protein, 20 aa, Mycobacterium
SAAGMVWRAAAAIELGICDV

SEQ ID NO: 729076 - protein, 19 aa, Mycobacterium
SAAGQRLVQRLVLEGDGVV

SEQ ID NO: 729077 - protein, 17 aa, Mycobacterium
SAAGRLVAIGELFVLRC

SEQ ID NO: 729078 - protein, 19 aa, Mycobacterium
SAAGSRAAVMSGDLVNEHR

SEQ ID NO: 729079 - protein, 18 aa, Mycobacterium
SAAGYELWHNGIDGFDEL

SEQ ID NO: 729080 - protein, 19 aa, Mycobacterium
SAAGYRRIVALAGELKLLR

SEQ ID NO: 729081 - protein, 20 aa, Mycobacterium
SAAHEDRAWIALTGPAETRP

SEQ ID NO: 729082 - protein, 24 aa, Mycobacterium
SAAHPMAVGSPFWEEIDLPSYGLT

SEQ ID NO: 729083 - protein, 20 aa, Mycobacterium
SAAIADVFSVFGEDYQAFAR

SEQ ID NO: 729084 - protein, 19 aa, Mycobacterium
SAAIAKLFGTYGQELQAAL

SEQ ID NO: 729085 - protein, 21 aa, Mycobacterium
SAAIANLFGAYGREYQAIVNL

SEQ ID NO: 729086 - protein, 18 aa, Mycobacterium
SAAIASLFSECAQAYRVL

SEQ ID NO: 729087 - protein, 18 aa, Mycobacterium
SAAIASLFSEEAQAYQAL

SEQ ID NO: 729088 - protein, 21 aa, Mycobacterium
SAAIDRIWQAARHWYRAGFQP

SEQ ID NO: 729089 - protein, 20 aa, Mycobacterium
SAAIPGIFPPVSINGRELID

SEQ ID NO: 729090 - protein, 18 aa, Mycobacterium
SAAIVNLCQMVKYLSAEG

SEQ ID NO: 729091 - protein, 23 aa, Mycobacterium
SAAKLATNLMKWTGVSAESVARK

SEQ ID NO: 729092 - protein, 22 aa, Mycobacterium
SAAKLATNLMRWTGISPDQVAR

SEQ ID NO: 729093 - protein, 24 aa, Mycobacterium
SAAKLPSFEGRTVIITGANSGLGL

SEQ ID NO: 729094 - protein, 28 aa, Mycobacterium
SAALAEFDRAGADIVLLDLMLPGMSGTD

SEQ ID NO: 729095 - protein, 17 aa, Mycobacterium
SAALAGAMGLPFVASYH

SEQ ID NO: 729096 - protein, 18 aa, Mycobacterium
SAALAGWMDYLRGVSEPL

SEQ ID NO: 729097 - protein, 26 aa, Mycobacterium
SAALAQKAVDRFGRLDVVVNNVGGTM

SEQ ID NO: 729098 - protein, 19 aa, Mycobacterium
SAALARLAATEAFSKTAAE

SEQ ID NO: 729099 - protein, 25 aa, Mycobacterium
SAALASSMSIHFDIVAPYLVELTTD

SEQ ID NO: 729100 - protein, 23 aa, Mycobacterium
SAALASSVGITWTSELLTVTAAD

SEQ ID NO: 729101 - protein, 22 aa, Mycobacterium
SAALDFYARAFGAVEMARLPGP

SEQ ID NO: 729102 - protein, 20 aa, Mycobacterium
SAALDRWGRIDFLVNNAGIG

SEQ ID NO: 729103 - protein, 23 aa, Mycobacterium
SAALGRLATEWWVTSSKTPGDRR

SEQ ID NO: 729104 - protein, 24 aa, Mycobacterium
SAALKRIPEALAVLNQQRPRIVTA

SEQ ID NO: 729105 - protein, 24 aa, Mycobacterium
SAALLGCAVPTGFGSSTNIAEVKP

SEQ ID NO: 729106 - protein, 26 aa, Mycobacterium
SAALLRLPVSNWPALGGMGNASWVQL

SEQ ID NO: 729107 - protein, 26 aa, Mycobacterium
SAALPAGQTWCDFSAPVLAEANKKLG

SEQ ID NO: 729108 - protein, 18 aa, Mycobacterium
SAALPVPVFDKLVAVSGH

SEQ ID NO: 729109 - protein, 20 aa, Mycobacterium
SAALQELQDALGLEQAPLRI

SEQ ID NO: 729110 - protein, 18 aa, Mycobacterium
SAALRLPVVSLELVDPRF

SEQ ID NO: 729111 - protein, 21 aa, Mycobacterium
SAALRPFLLVASFVNPHDIVL

SEQ ID NO: 729112 - protein, 26 aa, Mycobacterium
SAALRPRYLMMLAEILRFHRAASRLL

SEQ ID NO: 729113 - protein, 18 aa, Mycobacterium
SAALRRVELARPRSVVGK

SEQ ID NO: 729114 - protein, 18 aa, Mycobacterium
SAALRRVELSRPRSVVGK

SEQ ID NO: 729115 - protein, 17 aa, Mycobacterium
SAALVAWFHDHFADLDS

SEQ ID NO: 729116 - protein, 18 aa, Mycobacterium
SAAMGRGMTVGALSVPHS

SEQ ID NO: 729117 - protein, 24 aa, Mycobacterium
SAAMIASVLPYVGWLEATAVQAGH

SEQ ID NO: 729118 - protein, 24 aa, Mycobacterium
SAAPAGRVLLVWDAPNLDMGLGSI

SEQ ID NO: 729119 - protein, 20 aa, Mycobacterium
SAAPLLLVRAFLGLEPDVPH

SEQ ID NO: 729120 - protein, 20 aa, Mycobacterium
SAAPPRYGFHPRVMTRPPAA

SEQ ID NO: 729121 - protein, 24 aa, Mycobacterium
SAAPTPIIHWLREAGGATDEFNQT

SEQ ID NO: 729122 - protein, 23 aa, Mycobacterium
SAAPWWPTSCVVVDVSPLMHELL

SEQ ID NO: 729123 - protein, 24 aa, Mycobacterium
SAAQAIRVAREFAHSAEESGGRSM

SEQ ID NO: 729124 - protein, 24 aa, Mycobacterium
SAAQAIRVAREFARSAEESGGRSM

SEQ ID NO: 729125 - protein, 25 aa, Mycobacterium
SAAQLRQWFQYRIEGPGPVNNVPFA

SEQ ID NO: 729126 - protein, 25 aa, Mycobacterium
SAAQNAHWGVCLARTDPDAPKHKGI

SEQ ID NO: 729127 - protein, 17 aa, Mycobacterium
SAAQRCPDRPGLVDELG

SEQ ID NO: 729128 - protein, 17 aa, Mycobacterium
SAAQVGAVMPVVAESVA

SEQ ID NO: 729129 - protein, 25 aa, Mycobacterium
SAARAKEIGLVWKLVEPADLQEEAR

SEQ ID NO: 729130 - protein, 27 aa, Mycobacterium
SAAREDGRLALLLKVHHAAVDGVSAAD

SEQ ID NO: 729131 - protein, 24 aa, Mycobacterium
SAARGRLRGFGFANYLEANGGLQV

SEQ ID NO: 729132 - protein, 19 aa, Mycobacterium
SAARGYEIGEKIAAQREIT

SEQ ID NO: 729133 - protein, 18 aa, Mycobacterium
SAARGYTAALAQLQGESW

SEQ ID NO: 729134 - protein, 17 aa, Mycobacterium
SAARIQLFAAMVRDGNR

SEQ ID NO: 729135 - protein, 21 aa, Mycobacterium
SAARLAASFPQVGRELRNQFR

SEQ ID NO: 729136 - protein, 22 aa, Mycobacterium
SAARRAGVRGGDTVVVIGTGGI

SEQ ID NO: 729137 - protein, 17 aa, Mycobacterium
SAARRLLLDPVEIGPIR

SEQ ID NO: 729138 - protein, 29 aa, Mycobacterium
SAARYLRRWHRRRPLWVGVAIGGTVDGAT

SEQ ID NO: 729139 - protein, 24 aa, Mycobacterium
SAASFPGWDSFGAMVTHLRFIRDH

SEQ ID NO: 729140 - protein, 25 aa, Mycobacterium
SAASFQAAHARFVAAAAKVNTLLDI

SEQ ID NO: 729141 - protein, 27 aa, Mycobacterium
SAASGPRIRLAYQLTPRSVRGEQRVSG

SEQ ID NO: 729142 - protein, 17 aa, Mycobacterium
SAASGYAPRAIVAPIVG

SEQ ID NO: 729143 - protein, 25 aa, Mycobacterium
SAASRAFVPHSVWRRIGDDFLGETA

SEQ ID NO: 729144 - protein, 24 aa, Mycobacterium
SAASRAFVPRSVWDQMGDEFLDAT

SEQ ID NO: 729145 - protein, 18 aa, Mycobacterium
SAASRVAVDWAARDAALR

SEQ ID NO: 729146 - protein, 17 aa, Mycobacterium
SAASWVTGVVLRVDGGT

SEQ ID NO: 729147 - protein, 24 aa, Mycobacterium
SAATEGFGALDIMVNNAGITRDAT

SEQ ID NO: 729148 - protein, 18 aa, Mycobacterium
SAATLYNWRRQYGGMDTD

SEQ ID NO: 729149 - protein, 34 aa, Mycobacterium
SAATTRWVWVRDVDVFDCSRIRQVMRELPHVRIA

SEQ ID NO: 729150 - protein, 28 aa, Mycobacterium
SAATVRRFNEAFGPFGFPPKAIKPSYGL

SEQ ID NO: 729151 - protein, 20 aa, Mycobacterium
SAAVAAVVERFGRIDVLVNN

SEQ ID NO: 729152 - protein, 21 aa, Mycobacterium
SAAVASLFAGHAQAYQSLGGQ

SEQ ID NO: 729153 - protein, 24 aa, Mycobacterium
SAAVGCGFITWTLKGNEHVLEHAL

SEQ ID NO: 729154 - protein, 21 aa, Mycobacterium
SAAVGRISYLLGLRGPAVAVD

SEQ ID NO: 729155 - protein, 21 aa, Mycobacterium
SAAVSEVRWNAVVLADDTVLA

SEQ ID NO: 729156 - protein, 20 aa, Mycobacterium
SAAVTCFWNQNQINIIDTPG

SEQ ID NO: 729157 - protein, 32 aa, Mycobacterium
SAAYKARYVQFLSGAFPNWIRFRDNGTTRYFE

SEQ ID NO: 729158 - protein, 25 aa, Mycobacterium
SAAYLKATFDWHIDGCTPLGDECPQ

SEQ ID NO: 729159 - protein, 18 aa, Mycobacterium
SAAYLPLIRVLRTLAAEN

SEQ ID NO: 729160 - protein, 26 aa, Mycobacterium
SAAYTISALWTMAREQLDVTVVILNN

SEQ ID NO: 729161 - protein, 17 aa, Mycobacterium
SACAELVALLVAHAPER

SEQ ID NO: 729162 - protein, 17 aa, Mycobacterium
SACAELVSLLVGTAPDR

SEQ ID NO: 729163 - protein, 17 aa, Mycobacterium
SACDRAVAAWLWSGRRA

SEQ ID NO: 729164 - protein, 30 aa, Mycobacterium
SACGEAFVKGIERRARRINCPGWVEAFRWL

SEQ ID NO: 729165 - protein, 17 aa, Mycobacterium
SACLKQMSEMFTKDVWS

SEQ ID NO: 729166 - protein, 23 aa, Mycobacterium
SACVRAGGALLALETVHPRQDPV

SEQ ID NO: 729167 - protein, 23 aa, Mycobacterium
SADAAPRIELVGVRKVFGDGRRE

SEQ ID NO: 729168 - protein, 20 aa, Mycobacterium
SADAAQRWYALALVATSADL

SEQ ID NO: 729169 - protein, 24 aa, Mycobacterium
SADACSDVSVVFARGTHQEPGLGN

SEQ ID NO: 729170 - protein, 19 aa, Mycobacterium
SADALRWGLINQVVPDGTV

SEQ ID NO: 729171 - protein, 22 aa, Mycobacterium
SADAPAALAFLHRLGVAAGLAM

SEQ ID NO: 729172 - protein, 17 aa, Mycobacterium
SADAPALDGVRYTVLGI

SEQ ID NO: 729173 - protein, 18 aa, Mycobacterium
SADARLVVFPELSLSGYR

SEQ ID NO: 729174 - protein, 21 aa, Mycobacterium
SADAVVWSAGSAVAARFRPEE

SEQ ID NO: 729175 - protein, 18 aa, Mycobacterium
SADAWLLTDVLRGQWGFR

SEQ ID NO: 729176 - protein, 19 aa, Mycobacterium
SADDFPRTEHLAWKIAEVA

SEQ ID NO: 729177 - protein, 21 aa, Mycobacterium
SADDLPRGWGVDVAPGHYRLR

SEQ ID NO: 729178 - protein, 24 aa, Mycobacterium
SADEACYRAELAVIAREMPNVTVL

SEQ ID NO: 729179 - protein, 18 aa, Mycobacterium
SADEARAAVDGCTHVIHL

SEQ ID NO: 729180 - protein, 17 aa, Mycobacterium
SADEAREGLAILDSALD

SEQ ID NO: 729181 - protein, 25 aa, Mycobacterium
SADELLRLAPNVWPRNIARDDTGVA

SEQ ID NO: 729182 - protein, 28 aa, Mycobacterium
SADFHALKYRHGRVYGHDSQSGTVMVSL

SEQ ID NO: 729183 - protein, 21 aa, Mycobacterium
SADFMLRFLNTHFGDGGQYAV

SEQ ID NO: 729184 - protein, 25 aa, Mycobacterium
SADGAGFDDIRWRLDVWNASAQVTN

SEQ ID NO: 729185 - protein, 22 aa, Mycobacterium
SADGDLRFTVTLADGRSITARR

SEQ ID NO: 729186 - protein, 19 aa, Mycobacterium
SADGEGFIEVTFRGANSLG

SEQ ID NO: 729187 - protein, 19 aa, Mycobacterium
SADGRCKAFAASADGTGFG

SEQ ID NO: 729188 - protein, 24 aa, Mycobacterium
SADGRRFGCDFAVLALPYLTLRRL

SEQ ID NO: 729189 - protein, 19 aa, Mycobacterium
SADKARWLLANGAGKGTRV

SEQ ID NO: 729190 - protein, 23 aa, Mycobacterium
SADKHVPEWLWQSPAAVKRAFLQ

SEQ ID NO: 729191 - protein, 24 aa, Mycobacterium
SADLALRLAEHGLRDADLASILRR

SEQ ID NO: 729192 - protein, 19 aa, Mycobacterium
SADLCRRELFDAYTGTGTA

SEQ ID NO: 729193 - protein, 20 aa, Mycobacterium
SADLLKPRTVQSLLPGIGKT

SEQ ID NO: 729194 - protein, 22 aa, Mycobacterium
SADLLRQSALLARERGVRLHTH

SEQ ID NO: 729195 - protein, 18 aa, Mycobacterium
SADLVGRFLLKGGETVWV

SEQ ID NO: 729196 - protein, 19 aa, Mycobacterium
SADPEVRQLILLDAPSVLG

SEQ ID NO: 729197 - protein, 25 aa, Mycobacterium
SADPFSRFSLLEAQLRQMSLDESIT

SEQ ID NO: 729198 - protein, 19 aa, Mycobacterium
SADPISWLLQLGADLATAY

SEQ ID NO: 729199 - protein, 20 aa, Mycobacterium
SADQRFLLNVPLFGREQRHP

SEQ ID NO: 729200 - protein, 24 aa, Mycobacterium
SADRARTGVFILDARQWFQSFPAA

SEQ ID NO: 729201 - protein, 17 aa, Mycobacterium
SADRFVRPDSPLPVDAA

SEQ ID NO: 729202 - protein, 26 aa, Mycobacterium
SADTAGKPSLGWRGRRAAERLSERVS

SEQ ID NO: 729203 - protein, 23 aa, Mycobacterium
SADWKLGCIVAVDGVIEPRLLEM

SEQ ID NO: 729204 - protein, 22 aa, Mycobacterium
SADYKTLFREFGFTAQAVAAAA

SEQ ID NO: 729205 - protein, 24 aa, Mycobacterium
SAEAARFAPELSVAAISDTLRRAG

SEQ ID NO: 729206 - protein, 27 aa, Mycobacterium
SAEAASAAALAQVWGATAGPTAVLSGA

SEQ ID NO: 729207 - protein, 28 aa, Mycobacterium
SAEAGLAGRIRHVMIPGMIEEDGDRPIE

SEQ ID NO: 729208 - protein, 30 aa, Mycobacterium
SAEALGEGWFWPAAAAHPSLPRGALLQIAV

SEQ ID NO: 729209 - protein, 22 aa, Mycobacterium
SAEALGNGWFWPAAAAHPSLPR

SEQ ID NO: 729210 - protein, 19 aa, Mycobacterium
SAEAMTWPLLEVIDGSLEQ

SEQ ID NO: 729211 - protein, 25 aa, Mycobacterium
SAEARIKLADMRAGRMSDDDWTRMA

SEQ ID NO: 729212 - protein, 24 aa, Mycobacterium
SAEATFWRYCIADVTNVQQELSAV

SEQ ID NO: 729213 - protein, 24 aa, Mycobacterium
SAEDFPRREHLAYQIAEVAADPVA

SEQ ID NO: 729214 - protein, 19 aa, Mycobacterium
SAEDFPRSEHLAWKIAQVA

SEQ ID NO: 729215 - protein, 18 aa, Mycobacterium
SAEDLHWIDPTQPPEQTA

SEQ ID NO: 729216 - protein, 19 aa, Mycobacterium
SAEDYCGFMGRLIGVDPIF

SEQ ID NO: 729217 - protein, 32 aa, Mycobacterium
SAEDYSTLVLCPKNLELMWTKHLDEYEINGRV

SEQ ID NO: 729218 - protein, 18 aa, Mycobacterium
SAEEFVFLEVNPRIQVEH

SEQ ID NO: 729219 - protein, 19 aa, Mycobacterium
SAEELLRWTDEHFGGNYVV

SEQ ID NO: 729220 - protein, 20 aa, Mycobacterium
SAEEWREFAATASLYSARAK

SEQ ID NO: 729221 - protein, 17 aa, Mycobacterium
SAEFGRAAAEVFAAQGF

SEQ ID NO: 729222 - protein, 20 aa, Mycobacterium
SAEFTELWSRHDARGKSATV

SEQ ID NO: 729223 - protein, 25 aa, Mycobacterium
SAEFTFRPGPVFTNLLLADEINRTP

SEQ ID NO: 729224 - protein, 24 aa, Mycobacterium
SAEGAAVGGGWFGYLSYPDPGACE

SEQ ID NO: 729225 - protein, 27 aa, Mycobacterium
SAEGRVAALRRCVPMVGQIKDPMLRDE

SEQ ID NO: 729226 - protein, 26 aa, Mycobacterium
SAEGRVAALRRCVPMVGQIKDPTLRD

SEQ ID NO: 729227 - protein, 27 aa, Mycobacterium
SAEGRVAALRRCVPMVGQIKDPTLRDE

SEQ ID NO: 729228 - protein, 26 aa, Mycobacterium
SAEGRVGALRRCVPMVGQIKDPTLRD

SEQ ID NO: 729229 - protein, 19 aa, Mycobacterium
SAEGSRFAADYGTVTGTSP

SEQ ID NO: 729230 - protein, 20 aa, Mycobacterium
SAEGSRLACEAIPDMSEVDT

SEQ ID NO: 729231 - protein, 25 aa, Mycobacterium
SAEKLAKLKPVFGVKAGDATMTAGN

SEQ ID NO: 729232 - protein, 24 aa, Mycobacterium
SAEKLAKLKPVFGVRNGDATMTAG

SEQ ID NO: 729233 - protein, 25 aa, Mycobacterium
SAEKLAKLRPVFGVKAGDATMTAGN

SEQ ID NO: 729234 - protein, 22 aa, Mycobacterium
SAELAGAGVCRTVRVASGPVHG

SEQ ID NO: 729235 - protein, 20 aa, Mycobacterium
SAELCRRLPETVGVAAVPVS

SEQ ID NO: 729236 - protein, 22 aa, Mycobacterium
SAELDAAGLRRIQWWTDEAGDF

SEQ ID NO: 729237 - protein, 17 aa, Mycobacterium
SAELERFIRCRDMTCRF

SEQ ID NO: 729238 - protein, 21 aa, Mycobacterium
SAELLAERGAQVAIFDREGSD

SEQ ID NO: 729239 - protein, 21 aa, Mycobacterium
SAELLARWNAREGALIATDPN

SEQ ID NO: 729240 - protein, 19 aa, Mycobacterium
SAELLEIGLPGLVLNIRDA

SEQ ID NO: 729241 - protein, 24 aa, Mycobacterium
SAELPDLLAVLSVRLGHVERVLYR

SEQ ID NO: 729242 - protein, 23 aa, Mycobacterium
SAELRNRISAAVFERCAGVAIRE

SEQ ID NO: 729243 - protein, 24 aa, Mycobacterium
SAELRRRCRVVALLDALVEGRALA

SEQ ID NO: 729244 - protein, 18 aa, Mycobacterium
SAELRWVAEAEVVDFPLH

SEQ ID NO: 729245 - protein, 19 aa, Mycobacterium
SAELVPGYTSDLFSAFYPL

SEQ ID NO: 729246 - protein, 17 aa, Mycobacterium
SAEMRWVAEDEVANLPL

SEQ ID NO: 729247 - protein, 21 aa, Mycobacterium
SAENRPRFDALGRWLLERTAA

SEQ ID NO: 729248 - protein, 26 aa, Mycobacterium
SAENVALRLVCISEFEGQYKRFAYGL

SEQ ID NO: 729249 - protein, 22 aa, Mycobacterium
SAEPCPDVDVVFARGTGEPPGV

SEQ ID NO: 729250 - protein, 18 aa, Mycobacterium
SAEQVRWVLQNSEAVLAF

SEQ ID NO: 729251 - protein, 21 aa, Mycobacterium
SAERAELGVSHIVVSGESGGG

SEQ ID NO: 729252 - protein, 23 aa, Mycobacterium
SAERPRGVFSRQLFLGENLDTDK

SEQ ID NO: 729253 - protein, 24 aa, Mycobacterium
SAERPRRAGVSSFGISGTNAHVII

SEQ ID NO: 729254 - protein, 26 aa, Mycobacterium
SAERRYGGAEGWPARYAGHLLAGLDA

SEQ ID NO: 729255 - protein, 23 aa, Mycobacterium
SAERWKVRFNARLEEAIKSKSAP

SEQ ID NO: 729256 - protein, 21 aa, Mycobacterium
SAESAHAWFIHSIGGNTDLGW

SEQ ID NO: 729257 - protein, 23 aa, Mycobacterium
SAESFALAAGCRAFVRNAVRVWA

SEQ ID NO: 729258 - protein, 24 aa, Mycobacterium
SAESFWKGKAFQSAYDQASNEQSS

SEQ ID NO: 729259 - protein, 19 aa, Mycobacterium
SAETTRWWSSCSSRRSISS

SEQ ID NO: 729260 - protein, 17 aa, Mycobacterium
SAEVFVSVLAYQPGRSN

SEQ ID NO: 729261 - protein, 18 aa, Mycobacterium
SAEVLAWIEVVRGADLPG

SEQ ID NO: 729262 - protein, 25 aa, Mycobacterium
SAEWKVFLELCRKGYEQSKDKWTKI

SEQ ID NO: 729263 - protein, 23 aa, Mycobacterium
SAEWKVFLNLLRNRFESDKGKWT

SEQ ID NO: 729264 - protein, 25 aa, Mycobacterium
SAEYAYRFAPLVGIYGGTLEVFRNM

SEQ ID NO: 729265 - protein, 22 aa, Mycobacterium
SAEYFTRMLAGLGEEMGFDVNT

SEQ ID NO: 729266 - protein, 17 aa, Mycobacterium
SAEYGWGITPGDLATIW

SEQ ID NO: 729267 - protein, 17 aa, Mycobacterium
SAEYNWNLTPGDLATIW

SEQ ID NO: 729268 - protein, 18 aa, Mycobacterium
SAFDEFKPLYGTSLVTGW

SEQ ID NO: 729269 - protein, 19 aa, Mycobacterium
SAFDGALDVDMVFSPFFNA

SEQ ID NO: 729270 - protein, 19 aa, Mycobacterium
SAFDGALDVDVVFSPFFNA

SEQ ID NO: 729271 - protein, 19 aa, Mycobacterium
SAFEAARAATVLPAAVAAN

SEQ ID NO: 729272 - protein, 20 aa, Mycobacterium
SAFEAARSAMVHPLAVAANR

SEQ ID NO: 729273 - protein, 18 aa, Mycobacterium
SAFEAARSAMVHPLEVAA

SEQ ID NO: 729274 - protein, 17 aa, Mycobacterium
SAFGPFWSVTRHADIVA

SEQ ID NO: 729275 - protein, 18 aa, Mycobacterium
SAFGRLDTLINCAGIAEP

SEQ ID NO: 729276 - protein, 20 aa, Mycobacterium
SAFHTEFTRALAAAGAAYAQ

SEQ ID NO: 729277 - protein, 22 aa, Mycobacterium
SAFKSVNPWAADGSFSPDYGAL

SEQ ID NO: 729278 - protein, 18 aa, Mycobacterium
SAFLKLVQSNWLGLNAPA

SEQ ID NO: 729279 - protein, 19 aa, Mycobacterium
SAFPAGLVDAMFTRFAQAV

SEQ ID NO: 729280 - protein, 20 aa, Mycobacterium
SAFPAKVSVQLADLRGYTYV

SEQ ID NO: 729281 - protein, 25 aa, Mycobacterium
SAFQPEIKGAPLLGEHTDEVLAGLG

SEQ ID NO: 729282 - protein, 23 aa, Mycobacterium
SAFQTEFTRLLATAGDSYAITEA

SEQ ID NO: 729283 - protein, 27 aa, Mycobacterium
SAFRRMCRSEFLHYLRIREWQDLVGQL

SEQ ID NO: 729284 - protein, 17 aa, Mycobacterium
SAFTAPHVTEFLTVDMT

SEQ ID NO: 729285 - protein, 24 aa, Mycobacterium
SAFTLPELIGLTGSCEVVLSAADH

SEQ ID NO: 729286 - protein, 22 aa, Mycobacterium
SAFTLPELIGLTGSSEVVLSAA

SEQ ID NO: 729287 - protein, 23 aa, Mycobacterium
SAFTLPELIGLTSTCDVVLDSAD

SEQ ID NO: 729288 - protein, 19 aa, Mycobacterium
SAGAGGFGGFGVANGGGSG

SEQ ID NO: 729289 - protein, 18 aa, Mycobacterium
SAGARFCGGVLAMSAVAE

SEQ ID NO: 729290 - protein, 20 aa, Mycobacterium
SAGARPWLAGAAEPAIFAIQ

SEQ ID NO: 729291 - protein, 19 aa, Mycobacterium
SAGATRLGLSGTRAVLEGL

SEQ ID NO: 729292 - protein, 21 aa, Mycobacterium
SAGAVSVNFMPSVTLAPFGGA

SEQ ID NO: 729293 - protein, 24 aa, Mycobacterium
SAGCPLGNLIPEWNDLVRRGRWDA

SEQ ID NO: 729294 - protein, 19 aa, Mycobacterium
SAGCVWINDHIPIVSEMPH

SEQ ID NO: 729295 - protein, 19 aa, Mycobacterium
SAGEAFGRAAEPWEVAATI

SEQ ID NO: 729296 - protein, 19 aa, Mycobacterium
SAGEFPGDRGGSGGDGARG

SEQ ID NO: 729297 - protein, 31 aa, Mycobacterium
SAGELAVALRAEFPPERIALHGNNKSEAELA

SEQ ID NO: 729298 - protein, 19 aa, Mycobacterium
SAGELPLVLYYHGGGFALG

SEQ ID NO: 729299 - protein, 26 aa, Mycobacterium
SAGFGDGGYDIWAWIVDYGTDESDER

SEQ ID NO: 729300 - protein, 18 aa, Mycobacterium
SAGFPVLAGGAAFGRDGR

SEQ ID NO: 729301 - protein, 25 aa, Mycobacterium
SAGFSPTELMRWVHPSLVASTQGTG

SEQ ID NO: 729302 - protein, 24 aa, Mycobacterium
SAGFTPTELMRWVHPSQVANTQGT

SEQ ID NO: 729303 - protein, 20 aa, Mycobacterium
SAGGPVLWPDLEAILVVPNN

SEQ ID NO: 729304 - protein, 27 aa, Mycobacterium
SAGGWLCDRVRAGWQVTVLVAAGADTG

SEQ ID NO: 729305 - protein, 18 aa, Mycobacterium
SAGHAWRTVDDRWSGAGA

SEQ ID NO: 729306 - protein, 24 aa, Mycobacterium
SAGHFYGAGLINWWDPDGARRTLE

SEQ ID NO: 729307 - protein, 18 aa, Mycobacterium
SAGHPLPVFFGNRNWHPM

SEQ ID NO: 729308 - protein, 18 aa, Mycobacterium
SAGIPLAGLQKHNVVVVD

SEQ ID NO: 729309 - protein, 22 aa, Mycobacterium
SAGIPVLYGYAGAKDKHGNELQ

SEQ ID NO: 729310 - protein, 20 aa, Mycobacterium
SAGIRAGDTLVFAIKVLNAT

SEQ ID NO: 729311 - protein, 25 aa, Mycobacterium
SAGKWASIVPHTWLWTSPLGPEVRA

SEQ ID NO: 729312 - protein, 19 aa, Mycobacterium
SAGLGRGVSIGALTTPHAW

SEQ ID NO: 729313 - protein, 21 aa, Mycobacterium
SAGLKPGVDVALALDAAANEF

SEQ ID NO: 729314 - protein, 23 aa, Mycobacterium
SAGLLPAITFVFSRAGCDAAVQQ

SEQ ID NO: 729315 - protein, 20 aa, Mycobacterium
SAGLNVVGIFTFPGHGYTPG

SEQ ID NO: 729316 - protein, 23 aa, Mycobacterium
SAGLPCQSSAAAVNAAHAAITIA

SEQ ID NO: 729317 - protein, 17 aa, Mycobacterium
SAGLWREIAGELAESLR

SEQ ID NO: 729318 - protein, 17 aa, Mycobacterium
SAGLWREVASELADSLR

SEQ ID NO: 729319 - protein, 25 aa, Mycobacterium
SAGNSFGAFVPRGITLRVYGDANDY

SEQ ID NO: 729320 - protein, 18 aa, Mycobacterium
SAGPFFGHALPFQRCNEL

SEQ ID NO: 729321 - protein, 18 aa, Mycobacterium
SAGPGRTGLVGSNGSGKS

SEQ ID NO: 729322 - protein, 20 aa, Mycobacterium
SAGPPCFLDPELRHLNDDGS

SEQ ID NO: 729323 - protein, 22 aa, Mycobacterium
SAGPPCFLDPELRHLNDDHADP

SEQ ID NO: 729324 - protein, 20 aa, Mycobacterium
SAGPPCFLDPELRHLNDDHG

SEQ ID NO: 729325 - protein, 18 aa, Mycobacterium
SAGPPCFLDTGLRDLNDD

SEQ ID NO: 729326 - protein, 26 aa, Mycobacterium
SAGPPPWYLYRFVARGAVGVATAEPH

SEQ ID NO: 729327 - protein, 23 aa, Mycobacterium
SAGPYRFVYRKRFHKKPETELTV

SEQ ID NO: 729328 - protein, 24 aa, Mycobacterium
SAGQAIRVAREFARNAEESGGRSM

SEQ ID NO: 729329 - protein, 19 aa, Mycobacterium
SAGQHRIWFAHGVTPVLMN

SEQ ID NO: 729330 - protein, 19 aa, Mycobacterium
SAGQPLVWLEAMKMEHTVA

SEQ ID NO: 729331 - protein, 24 aa, Mycobacterium
SAGRARLRVRPGLPRAAGDVAAGR

SEQ ID NO: 729332 - protein, 17 aa, Mycobacterium
SAGRAVIVTGDFNALYS

SEQ ID NO: 729333 - protein, 24 aa, Mycobacterium
SAGRDGLDRLVRLGFSMRKSVDGF

SEQ ID NO: 729334 - protein, 26 aa, Mycobacterium
SAGRDLPRLKVRFIGSAVSPEAVADE

SEQ ID NO: 729335 - protein, 21 aa, Mycobacterium
SAGRKARYLMPTRDLIVNDVE

SEQ ID NO: 729336 - protein, 18 aa, Mycobacterium
SAGRLHMSDALQFDPPPV

SEQ ID NO: 729337 - protein, 23 aa, Mycobacterium
SAGRLLLGVGVGFRAELEVSRSI

SEQ ID NO: 729338 - protein, 24 aa, Mycobacterium
SAGRPCDYTGLSYAKLRGGSGIQW

SEQ ID NO: 729339 - protein, 22 aa, Mycobacterium
SAGRPCDYTGLSYDKLRGGSGI

SEQ ID NO: 729340 - protein, 22 aa, Mycobacterium
SAGRPCDYTGLSYEKLRGSGGI

SEQ ID NO: 729341 - protein, 19 aa, Mycobacterium
SAGRWWTWAGTKANRTLQA

SEQ ID NO: 729342 - protein, 18 aa, Mycobacterium
SAGSGAKVLLAHSDPGTQ

SEQ ID NO: 729343 - protein, 19 aa, Mycobacterium
SAGSSLRIGRLNLDILGAI

SEQ ID NO: 729344 - protein, 18 aa, Mycobacterium
SAGSYVWDGGGRRLLDFS

SEQ ID NO: 729345 - protein, 17 aa, Mycobacterium
SAGTAQRRGRAFRAPNH

SEQ ID NO: 729346 - protein, 20 aa, Mycobacterium
SAGTGWRAADQEMMRPLRAL

SEQ ID NO: 729347 - protein, 21 aa, Mycobacterium
SAGTSRWLVAVRMVSEGVDVP

SEQ ID NO: 729348 - protein, 17 aa, Mycobacterium
SAGVEWPGAANDPRRRA

SEQ ID NO: 729349 - protein, 26 aa, Mycobacterium
SAGVGRAGLVGGLSVPQGWASAAPEI

SEQ ID NO: 729350 - protein, 17 aa, Mycobacterium
SAGVHRANWAKLEGTGV

SEQ ID NO: 729351 - protein, 31 aa, Mycobacterium
SAGVIGMIVADLWGGSVSNWLTAQRVVINSS

SEQ ID NO: 729352 - protein, 25 aa, Mycobacterium
SAGVLDLWALWRRAGNESAVITSRV

SEQ ID NO: 729353 - protein, 17 aa, Mycobacterium
SAGVLFADVMTAYRARR

SEQ ID NO: 729354 - protein, 24 aa, Mycobacterium
SAGVLRPLPTTSYGLLQATQALRH

SEQ ID NO: 729355 - protein, 18 aa, Mycobacterium
SAGWNCLELGAGGGSLVE

SEQ ID NO: 729356 - protein, 24 aa, Mycobacterium
SAGYRWIELGPYGYLPTDPDKLAD

SEQ ID NO: 729357 - protein, 19 aa, Mycobacterium
SAHAGSWPYGLPELPGARE

SEQ ID NO: 729358 - protein, 19 aa, Mycobacterium
SAHAGTWPYGLPELPGGRE

SEQ ID NO: 729359 - protein, 24 aa, Mycobacterium
SAHEARTAWAAVAHAIIDFEPVSM

SEQ ID NO: 729360 - protein, 17 aa, Mycobacterium
SAHEIRTWIAAFAALAT

SEQ ID NO: 729361 - protein, 17 aa, Mycobacterium
SAHEIRTWISAFAAMAV

SEQ ID NO: 729362 - protein, 20 aa, Mycobacterium
SAHEVRTWIAAFAALAAQGE

SEQ ID NO: 729363 - protein, 29 aa, Mycobacterium
SAHGRLQRLGMANLDWLVVRDLVMIESAT

SEQ ID NO: 729364 - protein, 25 aa, Mycobacterium
SAHLRAAHHLSMCAECALEIDAQRQ

SEQ ID NO: 729365 - protein, 20 aa, Mycobacterium
SAHLRLVMPISRHTVASAIH

SEQ ID NO: 729366 - protein, 17 aa, Mycobacterium
SAHMLRIGLSGGIGAGK

SEQ ID NO: 729367 - protein, 18 aa, Mycobacterium
SAHPAGHFFTRWQLPTGT

SEQ ID NO: 729368 - protein, 17 aa, Mycobacterium
SAHPLVIIPGGPGVASM

SEQ ID NO: 729369 - protein, 24 aa, Mycobacterium
SAHQVAWLFGDRGIPRTWRHMNGY

SEQ ID NO: 729370 - protein, 25 aa, Mycobacterium
SAHRFPAPAPPRWSTGRRAVIASLS

SEQ ID NO: 729371 - protein, 19 aa, Mycobacterium
SAHSGSWPYGLPELPGARE

SEQ ID NO: 729372 - protein, 19 aa, Mycobacterium
SAHVIDGRVKHCVLVELFT

SEQ ID NO: 729373 - protein, 21 aa, Mycobacterium
SAHVPSAMLFVRNHTGVSHSP

SEQ ID NO: 729374 - protein, 17 aa, Mycobacterium
SAHVRLGADLDVDKVIA

SEQ ID NO: 729375 - protein, 22 aa, Mycobacterium
SAHYRDPGLLLGQRIGAAGFTT

SEQ ID NO: 729376 - protein, 17 aa, Mycobacterium
SAIALAVLASVRRPVSA

SEQ ID NO: 729377 - protein, 22 aa, Mycobacterium
SAIAVLRFDGPWDELALGGAQL

SEQ ID NO: 729378 - protein, 22 aa, Mycobacterium
SAIEVAKLPNVVGFKDGTGDFD

SEQ ID NO: 729379 - protein, 22 aa, Mycobacterium
SAIGALSVPPSWAGQATLVSST

SEQ ID NO: 729380 - protein, 18 aa, Mycobacterium
SAIGQHWMYNGKHVLIVF

SEQ ID NO: 729381 - protein, 27 aa, Mycobacterium
SAIGRVIAETGVWVFAERARLLGLPVG

SEQ ID NO: 729382 - protein, 18 aa, Mycobacterium
SAIGRWMRRHGIVGDDGQ

SEQ ID NO: 729383 - protein, 17 aa, Mycobacterium
SAIKIAGKRAYQMVRDG

SEQ ID NO: 729384 - protein, 20 aa, Mycobacterium
SAILMPLRAHDHVAGVIAIA

SEQ ID NO: 729385 - protein, 17 aa, Mycobacterium
SAILSRLRRAQGQLNGV

SEQ ID NO: 729386 - protein, 22 aa, Mycobacterium
SAIPAPDRPGAYADIKVPSLVI

SEQ ID NO: 729387 - protein, 17 aa, Mycobacterium
SAIPGLYAAGACASNIA

SEQ ID NO: 729388 - protein, 18 aa, Mycobacterium
SAIPHHRPTGAMLAAGDF

SEQ ID NO: 729389 - protein, 20 aa, Mycobacterium
SAIPLLRAAGGGDIMNISSE

SEQ ID NO: 729390 - protein, 19 aa, Mycobacterium
SAIPTVQALIRWDPVGHAE

SEQ ID NO: 729391 - protein, 26 aa, Mycobacterium
SAIQRPWDTLTLFQAVRCRSVTGACP

SEQ ID NO: 729392 - protein, 17 aa, Mycobacterium
SAIRLGKSFEGWVAVLV

SEQ ID NO: 729393 - protein, 28 aa, Mycobacterium
SAIRRAPARWPVPWPNSNAIRTSTPATS

SEQ ID NO: 729394 - protein, 19 aa, Mycobacterium
SAISAAREVTLGKLLPGQT

SEQ ID NO: 729395 - protein, 23 aa, Mycobacterium
SAISDSVVWIWNAVERHTTNVQT

SEQ ID NO: 729396 - protein, 27 aa, Mycobacterium
SAISFLRDIGKYFSVNVMLDRETVRRR

SEQ ID NO: 729397 - protein, 28 aa, Mycobacterium
SAIVGHDRLRLALVLSAVRPDIGGVLIR

SEQ ID NO: 729398 - protein, 26 aa, Mycobacterium
SAIVRPLLRVFFRSWFRVEVSGIENL

SEQ ID NO: 729399 - protein, 24 aa, Mycobacterium
SAIVRRLRVAGFDNIVGKTSAELD

SEQ ID NO: 729400 - protein, 25 aa, Mycobacterium
SAIVSLDPWGAMVAEAFTTELAAGF

SEQ ID NO: 729401 - protein, 25 aa, Mycobacterium
SAIWFCPTHITLLKRFADYYKGGRE

SEQ ID NO: 729402 - protein, 32 aa, Mycobacterium
SAKAATPWLAATVRFAWRTRLMSSAAVDARIR

SEQ ID NO: 729403 - protein, 18 aa, Mycobacterium
SAKAHGLQRLIEGSEVSG

SEQ ID NO: 729404 - protein, 21 aa, Mycobacterium
SAKAPWELARPVGGEAALAAE

SEQ ID NO: 729405 - protein, 20 aa, Mycobacterium
SAKDYRRWFATLPSELTDAV

SEQ ID NO: 729406 - protein, 19 aa, Mycobacterium
SAKELGLDGTEVFDITGIE

SEQ ID NO: 729407 - protein, 28 aa, Mycobacterium
SAKELYEIRTLFGVLFQDGALFGSMNIY

SEQ ID NO: 729408 - protein, 27 aa, Mycobacterium
SAKELYEIRTLFGVMFQDGALFGSMSL

SEQ ID NO: 729409 - protein, 28 aa, Mycobacterium
SAKGTFRLAFGIGDFRRDTGFGEDATTL

SEQ ID NO: 729410 - protein, 28 aa, Mycobacterium
SAKGTFRLAFGIGDFRRDTGFGEDPTTL

SEQ ID NO: 729411 - protein, 19 aa, Mycobacterium
SAKMCGWIDGAIRSGERAA

SEQ ID NO: 729412 - protein, 19 aa, Mycobacterium
SAKMQSWDIYRCIRQVLAV

SEQ ID NO: 729413 - protein, 17 aa, Mycobacterium
SAKNPRLWRDLLTCTAR

SEQ ID NO: 729414 - protein, 27 aa, Mycobacterium
SAKPLARPGARRMYSNYGFTVLAEAVQ

SEQ ID NO: 729415 - protein, 19 aa, Mycobacterium
SAKPSTWPRTTARVSEESP

SEQ ID NO: 729416 - protein, 17 aa, Mycobacterium
SAKREYEASISRAKSEC

SEQ ID NO: 729417 - protein, 25 aa, Mycobacterium
SAKRFTCPYHAWTYDNTGRLVGLPG

SEQ ID NO: 729418 - protein, 19 aa, Mycobacterium
SAKTGDGVEEWYDWISQRS

SEQ ID NO: 729419 - protein, 25 aa, Mycobacterium
SAKTISFAGAEAFRDDANGSGKDAT

SEQ ID NO: 729420 - protein, 34 aa, Mycobacterium
SAKTYFGAIIGRYGNRIAGGVFALDGHEYHLPIN

SEQ ID NO: 729421 - protein, 22 aa, Mycobacterium
SAKVPMAYAFDYVSDAHNLTDW

SEQ ID NO: 729422 - protein, 18 aa, Mycobacterium
SAKVTALLQLAAYADSLA

SEQ ID NO: 729423 - protein, 21 aa, Mycobacterium
SAKYRNCVADGQVISVGDVTL

SEQ ID NO: 729424 - protein, 26 aa, Mycobacterium
SALAAGRRALGWWLVGTGRGMLSLAR

SEQ ID NO: 729425 - protein, 24 aa, Mycobacterium
SALAALYGAWGVRVHDVRATADAL

SEQ ID NO: 729426 - protein, 25 aa, Mycobacterium
SALAPDCCAVVAYGALLRDGLLGVP

SEQ ID NO: 729427 - protein, 22 aa, Mycobacterium
SALAPRYVDLRPFAVNDGNDVW

SEQ ID NO: 729428 - protein, 17 aa, Mycobacterium
SALARASRWNRISDYLV

SEQ ID NO: 729429 - protein, 26 aa, Mycobacterium
SALARQFRAAMSMPLILLGGINRLDT

SEQ ID NO: 729430 - protein, 17 aa, Mycobacterium
SALASSVGITWTSELLT

SEQ ID NO: 729431 - protein, 19 aa, Mycobacterium
SALCAGLPVVLYDDRNKLD

SEQ ID NO: 729432 - protein, 20 aa, Mycobacterium
SALDLNWLRRVALANLHRPS

SEQ ID NO: 729433 - protein, 24 aa, Mycobacterium
SALDPATRCWELGPDGQWTASPQE

SEQ ID NO: 729434 - protein, 24 aa, Mycobacterium
SALDPRLWNWIAVSGLLLVMNSFT

SEQ ID NO: 729435 - protein, 17 aa, Mycobacterium
SALEGMLARGGPGHRDR

SEQ ID NO: 729436 - protein, 24 aa, Mycobacterium
SALELATSLHPVWMTRGQGREGLA

SEQ ID NO: 729437 - protein, 18 aa, Mycobacterium
SALELRGALSAQSGVDLP

SEQ ID NO: 729438 - protein, 19 aa, Mycobacterium
SALEQLRTAVAHRIAALPR

SEQ ID NO: 729439 - protein, 22 aa, Mycobacterium
SALESHPAVLLFSHRSYIDGAV

SEQ ID NO: 729440 - protein, 27 aa, Mycobacterium
SALETLSLPLLRAWLASASGAGVARTT

SEQ ID NO: 729441 - protein, 21 aa, Mycobacterium
SALFAPELMLARAWTKAAARD

SEQ ID NO: 729442 - protein, 21 aa, Mycobacterium
SALFKAERPDNVVVLDRPGAH

SEQ ID NO: 729443 - protein, 20 aa, Mycobacterium
SALGEAYIGLAPRTSGGPVY

SEQ ID NO: 729444 - protein, 26 aa, Mycobacterium
SALGGCLRRDGALGVMLYAKYGRFGV

SEQ ID NO: 729445 - protein, 25 aa, Mycobacterium
SALGGRAGLFIGEPGTGWVADPGNG

SEQ ID NO: 729446 - protein, 18 aa, Mycobacterium
SALGIPTWYARFAAQAMA

SEQ ID NO: 729447 - protein, 24 aa, Mycobacterium
SALGKLSVPPSWAGSGLDVPPSVS

SEQ ID NO: 729448 - protein, 19 aa, Mycobacterium
SALGKLSVPPTWSANPGPG

SEQ ID NO: 729449 - protein, 20 aa, Mycobacterium
SALGRLPVRGTVPDGGGTLM

SEQ ID NO: 729450 - protein, 19 aa, Mycobacterium
SALGSSLNNAGIDLAKNLR

SEQ ID NO: 729451 - protein, 20 aa, Mycobacterium
SALHAWSVRDPEGFWSAAAE

SEQ ID NO: 729452 - protein, 22 aa, Mycobacterium
SALHHPCCGDLTYGADPTLAKR

SEQ ID NO: 729453 - protein, 18 aa, Mycobacterium
SALHLAVRAARTLDTSLT

SEQ ID NO: 729454 - protein, 29 aa, Mycobacterium
SALIKSIGLRLGVPWYAYDTVIFSGEVTT

SEQ ID NO: 729455 - protein, 28 aa, Mycobacterium
SALIKSIGLRLGVPWYAYDTVTFAGEVT

SEQ ID NO: 729456 - protein, 28 aa, Mycobacterium
SALIKSIGLRLGVPWYAYDTVTFSGEVT

SEQ ID NO: 729457 - protein, 17 aa, Mycobacterium
SALKDAVGFAVKALQAG

SEQ ID NO: 729458 - protein, 18 aa, Mycobacterium
SALKKEYRDRLRAHCPGV

SEQ ID NO: 729459 - protein, 25 aa, Mycobacterium
SALKRRCLHYHLGFPTPQREREIVG

SEQ ID NO: 729460 - protein, 23 aa, Mycobacterium
SALLFPGLCRATGAIATPEADAS

SEQ ID NO: 729461 - protein, 19 aa, Mycobacterium
SALLHVARTVARRAERSAW

SEQ ID NO: 729462 - protein, 18 aa, Mycobacterium
SALLPASVHQRLLGKLRG

SEQ ID NO: 729463 - protein, 19 aa, Mycobacterium
SALLPEWRMELPLRHLEDL

SEQ ID NO: 729464 - protein, 17 aa, Mycobacterium
SALLRLGSAGGPIGLAL

SEQ ID NO: 729465 - protein, 19 aa, Mycobacterium
SALLSCAIPTGYGSAANRA

SEQ ID NO: 729466 - protein, 19 aa, Mycobacterium
SALLSCAIPTGYGSVANRS

SEQ ID NO: 729467 - protein, 18 aa, Mycobacterium
SALLSLNVPYFFMASDGV

SEQ ID NO: 729468 - protein, 19 aa, Mycobacterium
SALLSRLTDHWVTDEALVV

SEQ ID NO: 729469 - protein, 25 aa, Mycobacterium
SALLSRPSVNNVLRVAPRQFKMPRP

SEQ ID NO: 729470 - protein, 18 aa, Mycobacterium
SALLSRRDVVVVASVSCI

SEQ ID NO: 729471 - protein, 17 aa, Mycobacterium
SALMSMVAANVFGLNAP

SEQ ID NO: 729472 - protein, 20 aa, Mycobacterium
SALNRLSLREDLPVMAIWGE

SEQ ID NO: 729473 - protein, 25 aa, Mycobacterium
SALNRPDQAAVWGFVRSARAEAPGI

SEQ ID NO: 729474 - protein, 17 aa, Mycobacterium
SALPDEIEKGSVVESIV

SEQ ID NO: 729475 - protein, 23 aa, Mycobacterium
SALPDLDRLLLFGTHPDGIAAVR

SEQ ID NO: 729476 - protein, 24 aa, Mycobacterium
SALPHGVEVIGYWGEAVTTAAQAR

SEQ ID NO: 729477 - protein, 25 aa, Mycobacterium
SALPMVESFAAYGLFSHQRDACKQS

SEQ ID NO: 729478 - protein, 23 aa, Mycobacterium
SALPPAIVVAAEFDPLRDEGIEY

SEQ ID NO: 729479 - protein, 18 aa, Mycobacterium
SALPRTETFKVLKRQLAA

SEQ ID NO: 729480 - protein, 20 aa, Mycobacterium
SALQASLFTAYGTLYQQVSA

SEQ ID NO: 729481 - protein, 21 aa, Mycobacterium
SALQNAASIAALFLTTEAVVA

SEQ ID NO: 729482 - protein, 17 aa, Mycobacterium
SALQPLWHTRGRILEGC

SEQ ID NO: 729483 - protein, 17 aa, Mycobacterium
SALRAIVGDALFTAENE

SEQ ID NO: 729484 - protein, 22 aa, Mycobacterium
SALRAVPLVPGYGAAKAGIICV

SEQ ID NO: 729485 - protein, 22 aa, Mycobacterium
SALRAVPLVPGYGAAKAGIISI

SEQ ID NO: 729486 - protein, 23 aa, Mycobacterium
SALRGWLARAMVRPGQAQDVLIA

SEQ ID NO: 729487 - protein, 22 aa, Mycobacterium
SALRHLPVYEVLSNVTDQPATW

SEQ ID NO: 729488 - protein, 17 aa, Mycobacterium
SALRKALELCRASDYPF

SEQ ID NO: 729489 - protein, 25 aa, Mycobacterium
SALRKDRPEPVILVNAVAQGFVAGM

SEQ ID NO: 729490 - protein, 18 aa, Mycobacterium
SALRLGNIETTYALITKD

SEQ ID NO: 729491 - protein, 21 aa, Mycobacterium
SALRLPRAIPDRRGQRHAPMS

SEQ ID NO: 729492 - protein, 18 aa, Mycobacterium
SALRQGAVETLIIGDIGD

SEQ ID NO: 729493 - protein, 21 aa, Mycobacterium
SALTAARFSAHAQVYQVVSAQ

SEQ ID NO: 729494 - protein, 23 aa, Mycobacterium
SALTARVRWRTPFEGYPRVRGET

SEQ ID NO: 729495 - protein, 20 aa, Mycobacterium
SALTREWFTTAFAAPTPAQA

SEQ ID NO: 729496 - protein, 17 aa, Mycobacterium
SALTRLRLREDLPVMAI

SEQ ID NO: 729497 - protein, 25 aa, Mycobacterium
SALTRRGPHRVLRGDLAFAGLPGVI

SEQ ID NO: 729498 - protein, 18 aa, Mycobacterium
SALTYSFLWQMLGGRTQS

SEQ ID NO: 729499 - protein, 21 aa, Mycobacterium
SALVAEFVRRIPSFTVASSHI

SEQ ID NO: 729500 - protein, 26 aa, Mycobacterium
SALVNVHSVFSWLGGTGAYGASKAAL

SEQ ID NO: 729501 - protein, 20 aa, Mycobacterium
SALVRLLGEVGLRVATAWEF

SEQ ID NO: 729502 - protein, 19 aa, Mycobacterium
SALVRRATSAGARIECNQD

SEQ ID NO: 729503 - protein, 18 aa, Mycobacterium
SALYCLLHGDGFAMYRVH

SEQ ID NO: 729504 - protein, 18 aa, Mycobacterium
SALYRVGYAYAPFHCPDC

SEQ ID NO: 729505 - protein, 18 aa, Mycobacterium
SAMARTYLGPEFDIHCGG

SEQ ID NO: 729506 - protein, 17 aa, Mycobacterium
SAMEAVWITAQHLGLAV

SEQ ID NO: 729507 - protein, 22 aa, Mycobacterium
SAMESRVGHYYRLDETYRVGRE

SEQ ID NO: 729508 - protein, 21 aa, Mycobacterium
SAMHCMSVSLGLDGDGLGTCW

SEQ ID NO: 729509 - protein, 18 aa, Mycobacterium
SAMLDSFVARSIRDRPAD

SEQ ID NO: 729510 - protein, 19 aa, Mycobacterium
SAMLGRGIDVNFMIDIRLD

SEQ ID NO: 729511 - protein, 25 aa, Mycobacterium
SAMLKRLGIEGDFKGGFRVTTPEVL

SEQ ID NO: 729512 - protein, 23 aa, Mycobacterium
SAMLRRLGIQGDFKGGFRVTTPE

SEQ ID NO: 729513 - protein, 17 aa, Mycobacterium
SAMLWRQVVEQNGGATD

SEQ ID NO: 729514 - protein, 25 aa, Mycobacterium
SAMMLEAITPYVTWMRSTAVQAEQA

SEQ ID NO: 729515 - protein, 22 aa, Mycobacterium
SAMMRRRVLQFVDTVECPVCDG

SEQ ID NO: 729516 - protein, 19 aa, Mycobacterium
SAMPHKRNPVLATMIRSAA

SEQ ID NO: 729517 - protein, 19 aa, Mycobacterium
SAMQKWCDLGKHPPQSLLT

SEQ ID NO: 729518 - protein, 26 aa, Mycobacterium
SAMSAFKGLFPAAAAVGAQVAAAAEA

SEQ ID NO: 729519 - protein, 18 aa, Mycobacterium
SAMSFAFFYLGTHASERD

SEQ ID NO: 729520 - protein, 19 aa, Mycobacterium
SAMTDIWLGRHGDAARLAE

SEQ ID NO: 729521 - protein, 24 aa, Mycobacterium
SANEILVYEALGFCEPGAAGKLID

SEQ ID NO: 729522 - protein, 19 aa, Mycobacterium
SANFFCLGPLMAQALYIEG

SEQ ID NO: 729523 - protein, 19 aa, Mycobacterium
SANFFCLGPLMAQALYVEG

SEQ ID NO: 729524 - protein, 19 aa, Mycobacterium
SANGITFHDGRLFIGECRE

SEQ ID NO: 729525 - protein, 19 aa, Mycobacterium
SANGITFHEGRLFIGECRE

SEQ ID NO: 729526 - protein, 19 aa, Mycobacterium
SANGITFHQGRLFVGECRD

SEQ ID NO: 729527 - protein, 24 aa, Mycobacterium
SANGITFHRGRLFIGECREGGRLL

SEQ ID NO: 729528 - protein, 23 aa, Mycobacterium
SANGKARLAELVADSHALLVNMK

SEQ ID NO: 729529 - protein, 29 aa, Mycobacterium
SANIRRLRRPDPYKGKGIRYEGEQIRRKV

SEQ ID NO: 729530 - protein, 27 aa, Mycobacterium
SANIRRLRRPDPYKGKGVRYEGEQIRR

SEQ ID NO: 729531 - protein, 20 aa, Mycobacterium
SANLDSCFVVTSAVLPRMKA

SEQ ID NO: 729532 - protein, 18 aa, Mycobacterium
SANPFVLYPSYREIAHLP

SEQ ID NO: 729533 - protein, 19 aa, Mycobacterium
SANPFVLYPSYREIAHLPL

SEQ ID NO: 729534 - protein, 18 aa, Mycobacterium
SANPFVLYPSYREIMHLP

SEQ ID NO: 729535 - protein, 22 aa, Mycobacterium
SANRGSFNFGGGNFGSSNVGSG

SEQ ID NO: 729536 - protein, 22 aa, Mycobacterium
SANTVAVPYFWSDQYDVKIQSL

SEQ ID NO: 729537 - protein, 28 aa, Mycobacterium
SANVGLWVRTDEQWRWLANTLTVELLKE

SEQ ID NO: 729538 - protein, 20 aa, Mycobacterium
SANVGVWVRTDDQWRWLANT

SEQ ID NO: 729539 - protein, 24 aa, Mycobacterium
SANVRSNALLPAFVDTPMQQSAMA

SEQ ID NO: 729540 - protein, 17 aa, Mycobacterium
SAPAGWTDLAARCAVGM

SEQ ID NO: 729541 - protein, 19 aa, Mycobacterium
SAPAIKLLIRKAGAASADM

SEQ ID NO: 729542 - protein, 25 aa, Mycobacterium
SAPAIKLLIRRAGARSSDMAAELAK

SEQ ID NO: 729543 - protein, 25 aa, Mycobacterium
SAPAIKLLIRRSGARSADMAAELAR

SEQ ID NO: 729544 - protein, 18 aa, Mycobacterium
SAPARTGKFEWLDDNVVQ

SEQ ID NO: 729545 - protein, 19 aa, Mycobacterium
SAPAVKLLIRKAGAQSADM

SEQ ID NO: 729546 - protein, 29 aa, Mycobacterium
SAPCRASRAGACSVPGHPCLDGIKDAELL

SEQ ID NO: 729547 - protein, 25 aa, Mycobacterium
SAPCRASRARVCPVAGHPCLDGITD

SEQ ID NO: 729548 - protein, 26 aa, Mycobacterium
SAPDFELPDGTRLGALLHDGKGLLLD

SEQ ID NO: 729549 - protein, 20 aa, Mycobacterium
SAPDPAAVWHRHFPATDAEM

SEQ ID NO: 729550 - protein, 20 aa, Mycobacterium
SAPDRFGFWATLTLPDVDSA

SEQ ID NO: 729551 - protein, 35 aa, Mycobacterium
SAPDYQALWRWSVEDPGAFWAAVWDYFDLGERPDQ

SEQ ID NO: 729552 - protein, 25 aa, Mycobacterium
SAPEVADHLAALGFTAAAGDVVTSA

SEQ ID NO: 729553 - protein, 18 aa, Mycobacterium
SAPFPVMTAVAMATTSLR

SEQ ID NO: 729554 - protein, 19 aa, Mycobacterium
SAPGPKVGAFFDLDGTLVA

SEQ ID NO: 729555 - protein, 23 aa, Mycobacterium
SAPHIAMTVSMLRDAGVEVDDSA

SEQ ID NO: 729556 - protein, 23 aa, Mycobacterium
SAPHVAMTVAMLRDAGVEVDDSV

SEQ ID NO: 729557 - protein, 24 aa, Mycobacterium
SAPIPGRLFAAPALAQPSGVSPAD

SEQ ID NO: 729558 - protein, 18 aa, Mycobacterium
SAPITIGLVGGREVAFLP

SEQ ID NO: 729559 - protein, 28 aa, Mycobacterium
SAPITRPRIRFAYQLTPRRVLGENQVTA

SEQ ID NO: 729560 - protein, 22 aa, Mycobacterium
SAPKAEFLNAIRGSYRGDPAVL

SEQ ID NO: 729561 - protein, 28 aa, Mycobacterium
SAPKGIFPWYVPGADGFLGQFPLSQDET

SEQ ID NO: 729562 - protein, 18 aa, Mycobacterium
SAPKHKSLTMFLVPLDTP

SEQ ID NO: 729563 - protein, 19 aa, Mycobacterium
SAPKHSGITYFLLDMKSEG

SEQ ID NO: 729564 - protein, 17 aa, Mycobacterium
SAPLAKRLCEQRNADVI

SEQ ID NO: 729565 - protein, 24 aa, Mycobacterium
SAPLDRGSPLLAELASRCEGPVGV

SEQ ID NO: 729566 - protein, 25 aa, Mycobacterium
SAPLFGAEPPRWAAAQIAEMTSVVC

SEQ ID NO: 729567 - protein, 25 aa, Mycobacterium
SAPLPVPVFDRLAALTGHQPVERYG

SEQ ID NO: 729568 - protein, 23 aa, Mycobacterium
SAPLRLLLVNGVPVVADDELRTA

SEQ ID NO: 729569 - protein, 21 aa, Mycobacterium
SAPLRPRLLAVPHDGPAPMSA

SEQ ID NO: 729570 - protein, 18 aa, Mycobacterium
SAPLVLLAAIAQHTSRIR

SEQ ID NO: 729571 - protein, 24 aa, Mycobacterium
SAPMSPELRNWVEALLEIPLLDGY

SEQ ID NO: 729572 - protein, 17 aa, Mycobacterium
SAPMVAAAAAWNGLADE

SEQ ID NO: 729573 - protein, 27 aa, Mycobacterium
SAPNEVMRSLGLPTMFPTIGGHEGAGI

SEQ ID NO: 729574 - protein, 25 aa, Mycobacterium
SAPNWGVPLFVGWRAMPLAEDSPAR

SEQ ID NO: 729575 - protein, 20 aa, Mycobacterium
SAPPPSLLNAWRTHRGPQPG

SEQ ID NO: 729576 - protein, 24 aa, Mycobacterium
SAPPRSQISMSFGVDTTGVPPAGW

SEQ ID NO: 729577 - protein, 22 aa, Mycobacterium
SAPQHGLPIMLWAYDPLTFGGK

SEQ ID NO: 729578 - protein, 27 aa, Mycobacterium
SAPQRLRSGWLNGIKHWQVDYAGKCPV

SEQ ID NO: 729579 - protein, 18 aa, Mycobacterium
SAPRKGTALVRYQVPQSP

SEQ ID NO: 729580 - protein, 25 aa, Mycobacterium
SAPRPAGDAEWYWPERRLTYNNAAL

SEQ ID NO: 729581 - protein, 17 aa, Mycobacterium
SAPRPNATGSLPMTLDA

SEQ ID NO: 729582 - protein, 17 aa, Mycobacterium
SAPRVLSAAALVGRLRG

SEQ ID NO: 729583 - protein, 24 aa, Mycobacterium
SAPRVRRAIIAAGVARYVPVHPSR

SEQ ID NO: 729584 - protein, 20 aa, Mycobacterium
SAPSGPGFFYPPTVLSGVPR

SEQ ID NO: 729585 - protein, 17 aa, Mycobacterium
SAPSRGGTTVFFDPVNN

SEQ ID NO: 729586 - protein, 17 aa, Mycobacterium
SAPTHWNKNVFDMGEVG

SEQ ID NO: 729587 - protein, 18 aa, Mycobacterium
SAPVHHLHGSLFEFRCAR

SEQ ID NO: 729588 - protein, 19 aa, Mycobacterium
SAPWRRWSSVIAFAVDAAD

SEQ ID NO: 729589 - protein, 18 aa, Mycobacterium
SAPYLGAAIDAWDENGKS

SEQ ID NO: 729590 - protein, 23 aa, Mycobacterium
SAQAAAIHEMFVNTLATSSGSYA

SEQ ID NO: 729591 - protein, 18 aa, Mycobacterium
SAQAAAIHQAFVAALTAS

SEQ ID NO: 729592 - protein, 25 aa, Mycobacterium
SAQAAEFHERFVLTLAADANTYLTT

SEQ ID NO: 729593 - protein, 24 aa, Mycobacterium
SAQAAQFHQGFMQLLNSAGGAYAG

SEQ ID NO: 729594 - protein, 24 aa, Mycobacterium
SAQAETFHAQFVQALSAGASAYTQ

SEQ ID NO: 729595 - protein, 18 aa, Mycobacterium
SAQAGAYHLMRTHGGRGV

SEQ ID NO: 729596 - protein, 18 aa, Mycobacterium
SAQARLRYRGKLSGPLVD

SEQ ID NO: 729597 - protein, 19 aa, Mycobacterium
SAQATRFQAQFERALSEAG

SEQ ID NO: 729598 - protein, 17 aa, Mycobacterium
SAQEIAEAVLSLIQGTF

SEQ ID NO: 729599 - protein, 18 aa, Mycobacterium
SAQGGFGTAGGDGGAGGV

SEQ ID NO: 729600 - protein, 26 aa, Mycobacterium
SAQLDWPLAEALRYPAGLIDDFEWER

SEQ ID NO: 729601 - protein, 18 aa, Mycobacterium
SAQLGWNIVPYTVIRDGP

SEQ ID NO: 729602 - protein, 19 aa, Mycobacterium
SAQMAATFARHAPGRLLLN

SEQ ID NO: 729603 - protein, 23 aa, Mycobacterium
SAQMAGVHQRFVQALTASGSSYA

SEQ ID NO: 729604 - protein, 21 aa, Mycobacterium
SAQMAQFHRQFAQALSAANRS

SEQ ID NO: 729605 - protein, 19 aa, Mycobacterium
SAQNLMRWTSARSIKETFV

SEQ ID NO: 729606 - protein, 20 aa, Mycobacterium
SAQPAILVPAFLSRGYHVRT

SEQ ID NO: 729607 - protein, 26 aa, Mycobacterium
SAQPFDAVVCSLVLCSVDDPEQVVGQ

SEQ ID NO: 729608 - protein, 28 aa, Mycobacterium
SAQPLWALWRFGTEPGFAKMTMEFMALA

SEQ ID NO: 729609 - protein, 18 aa, Mycobacterium
SAQPVLLRRAMAFIEENA

SEQ ID NO: 729610 - protein, 18 aa, Mycobacterium
SAQQWAWLVHTLTVDTVR

SEQ ID NO: 729611 - protein, 19 aa, Mycobacterium
SAQQWQEWADAAVAAVKSR

SEQ ID NO: 729612 - protein, 24 aa, Mycobacterium
SAQRFLTLDAFVAAGFQVVALLNE

SEQ ID NO: 729613 - protein, 22 aa, Mycobacterium
SAQRGLSEAVVRDISAKKNEPE

SEQ ID NO: 729614 - protein, 19 aa, Mycobacterium
SAQRGSPFAAHYAASKGGV

SEQ ID NO: 729615 - protein, 23 aa, Mycobacterium
SAQRGSPGMAHYAASKGALISLT

SEQ ID NO: 729616 - protein, 17 aa, Mycobacterium
SAQRLGKLLAESGLATG

SEQ ID NO: 729617 - protein, 25 aa, Mycobacterium
SAQRRFAFGSLPLDQIKAAKFAVPG

SEQ ID NO: 729618 - protein, 19 aa, Mycobacterium
SAQRWRADTEALPGPEALR

SEQ ID NO: 729619 - protein, 21 aa, Mycobacterium
SAQVAAFHRQLVAGLHSGAAA

SEQ ID NO: 729620 - protein, 26 aa, Mycobacterium
SAQVAARRGLPFVANYHVTPWSTVEA

SEQ ID NO: 729621 - protein, 21 aa, Mycobacterium
SARALALVRGRDYVIPQDVIE

SEQ ID NO: 729622 - protein, 27 aa, Mycobacterium
SARALGCTIKLLSICERITDGDGQERV

SEQ ID NO: 729623 - protein, 21 aa, Mycobacterium
SARANLKWTPQPAMPGQLRAV

SEQ ID NO: 729624 - protein, 22 aa, Mycobacterium
SARAYWRVGGFRTLASGEDVDL

SEQ ID NO: 729625 - protein, 22 aa, Mycobacterium
SARDACYCYGSFVLDDDEALVI

SEQ ID NO: 729626 - protein, 19 aa, Mycobacterium
SARDLNARLRAVLDEDQIL

SEQ ID NO: 729627 - protein, 25 aa, Mycobacterium
SAREFKPLVLVAGYSAYPRRVNFAK

SEQ ID NO: 729628 - protein, 21 aa, Mycobacterium
SARELIARIRAVLRRGSDSEE

SEQ ID NO: 729629 - protein, 19 aa, Mycobacterium
SAREPRIALVSNLTGQLAG

SEQ ID NO: 729630 - protein, 24 aa, Mycobacterium
SARERAGALARAWGLDEVSDTDLG

SEQ ID NO: 729631 - protein, 21 aa, Mycobacterium
SARFAGIIRLYTARQVVEQRG

SEQ ID NO: 729632 - protein, 17 aa, Mycobacterium
SARFVRYHMIPAVGEKF

SEQ ID NO: 729633 - protein, 17 aa, Mycobacterium
SARFVRYHMVPAATESY

SEQ ID NO: 729634 - protein, 29 aa, Mycobacterium
SARGGLQCGFCTPGFLVSAVELLRDPDTE

SEQ ID NO: 729635 - protein, 19 aa, Mycobacterium
SARGKGGLVRVSWAEATEM

SEQ ID NO: 729636 - protein, 20 aa, Mycobacterium
SARGPITFCGEYFRLDRATV

SEQ ID NO: 729637 - protein, 31 aa, Mycobacterium
SARGRLGLLELRGFEMPPHFQMAMVQSLLVR

SEQ ID NO: 729638 - protein, 25 aa, Mycobacterium
SARGRLGLLELRGFEMPPHPQMAMV

SEQ ID NO: 729639 - protein, 23 aa, Mycobacterium
SARGRPLAEIDLDYSPLQLEDTF

SEQ ID NO: 729640 - protein, 23 aa, Mycobacterium
SARGRPVGEIDLDYTPVQLEDTF

SEQ ID NO: 729641 - protein, 24 aa, Mycobacterium
SARKTARPRLSGVTSAHRHVIDTV

SEQ ID NO: 729642 - protein, 22 aa, Mycobacterium
SARLLATLICRPKAFEQHDLDA

SEQ ID NO: 729643 - protein, 31 aa, Mycobacterium
SARLPADIRERWAIREVPLHILLDGVDLRDG

SEQ ID NO: 729644 - protein, 20 aa, Mycobacterium
SARLRLAMKQQDIPLWLNSP

SEQ ID NO: 729645 - protein, 18 aa, Mycobacterium
SARMAAAVDAAEAARPHS

SEQ ID NO: 729646 - protein, 33 aa, Mycobacterium
SARMHLGAGPGPMLAAATAWDGLAAELFAAASA

SEQ ID NO: 729647 - protein, 19 aa, Mycobacterium
SARNYPHLVADALGLDLVD

SEQ ID NO: 729648 - protein, 22 aa, Mycobacterium
SARPELQLSAGKAVLGCEIRIV

SEQ ID NO: 729649 - protein, 23 aa, Mycobacterium
SARPVWPMIVLRTPKGWTGPKVV

SEQ ID NO: 729650 - protein, 20 aa, Mycobacterium
SARQRCLFHELAIEPDAADS

SEQ ID NO: 729651 - protein, 24 aa, Mycobacterium
SARQRIAALAARHDFHIIEDATYA

SEQ ID NO: 729652 - protein, 23 aa, Mycobacterium
SARQRLEQVVIRFAGDSGDGMQL

SEQ ID NO: 729653 - protein, 30 aa, Mycobacterium
SARRGLLPGPWRLLRVVGHYYRPGFHPSQL

SEQ ID NO: 729654 - protein, 23 aa, Mycobacterium
SARRHIAGVLYLFVRGMCGPDTP

SEQ ID NO: 729655 - protein, 24 aa, Mycobacterium
SARRLSAIAALTCRRTASDQRADW

SEQ ID NO: 729656 - protein, 23 aa, Mycobacterium
SARRLSEEFRIRDEVDRRLRMRD

SEQ ID NO: 729657 - protein, 17 aa, Mycobacterium
SARRYLSRWHRRRPLWV

SEQ ID NO: 729658 - protein, 25 aa, Mycobacterium
SARSAWPRHLLPALTTAGFATELRN

SEQ ID NO: 729659 - protein, 17 aa, Mycobacterium
SARSEARLAAAADALAG

SEQ ID NO: 729660 - protein, 25 aa, Mycobacterium
SARSGELPDRLRVHSLARTLGTTSK

SEQ ID NO: 729661 - protein, 20 aa, Mycobacterium
SARSKRVLLQGWEQFDDKVD

SEQ ID NO: 729662 - protein, 23 aa, Mycobacterium
SARSRAAADLAAIPPADWEPGRK

SEQ ID NO: 729663 - protein, 26 aa, Mycobacterium
SARTARVQFWPALKDLSMYSLRVRED

SEQ ID NO: 729664 - protein, 21 aa, Mycobacterium
SARTRFVLIGRPARPPARTGA

SEQ ID NO: 729665 - protein, 23 aa, Mycobacterium
SARVPLGLPLPGCEVRVVTEDRQ

SEQ ID NO: 729666 - protein, 21 aa, Mycobacterium
SARVWATFPRHLVGRVAAFAF

SEQ ID NO: 729667 - protein, 18 aa, Mycobacterium
SARYRPWMPAAGNHENEW

SEQ ID NO: 729668 - protein, 18 aa, Mycobacterium
SASALVDLHKAWVDQRAT

SEQ ID NO: 729669 - protein, 17 aa, Mycobacterium
SASASWAANGKITADDR

SEQ ID NO: 729670 - protein, 20 aa, Mycobacterium
SASATLDWLDAHGHRELVRR

SEQ ID NO: 729671 - protein, 25 aa, Mycobacterium
SASDLGAIAIRAALEKAFPGVENPA

SEQ ID NO: 729672 - protein, 24 aa, Mycobacterium
SASDRGAGTLGFAGAEHSEGLVEP

SEQ ID NO: 729673 - protein, 19 aa, Mycobacterium
SASELARFRRSPVALRRTR

SEQ ID NO: 729674 - protein, 17 aa, Mycobacterium
SASELATAFAFDEAARR

SEQ ID NO: 729675 - protein, 20 aa, Mycobacterium
SASESWKKLTSLYTNHLGMA

SEQ ID NO: 729676 - protein, 18 aa, Mycobacterium
SASFASAVGRSFYTQILP

SEQ ID NO: 729677 - protein, 18 aa, Mycobacterium
SASFTMAYTKVGLSPDGS

SEQ ID NO: 729678 - protein, 17 aa, Mycobacterium
SASFWGSLLPAVWSFML

SEQ ID NO: 729679 - protein, 18 aa, Mycobacterium
SASGCDVTGYFCEVHHVV

SEQ ID NO: 729680 - protein, 23 aa, Mycobacterium
SASHKGHFVRCFDLTNEHYVNAL

SEQ ID NO: 729681 - protein, 19 aa, Mycobacterium
SASKAWNLCGIKAAVAIAG

SEQ ID NO: 729682 - protein, 27 aa, Mycobacterium
SASLPLPRRETRDCLAEDLRRLDPDEI

SEQ ID NO: 729683 - protein, 24 aa, Mycobacterium
SASLSFSSLSGWADRGKRDRFIDL

SEQ ID NO: 729684 - protein, 26 aa, Mycobacterium
SASMLSAVMPYVNWLGVLAAQAEETA

SEQ ID NO: 729685 - protein, 20 aa, Mycobacterium
SASNLRRLLADSAIMESHRG

SEQ ID NO: 729686 - protein, 23 aa, Mycobacterium
SASPRMRSLVFGPADFMASLGMR

SEQ ID NO: 729687 - protein, 23 aa, Mycobacterium
SASPRSSIIISFNAPVGPTLNYE

SEQ ID NO: 729688 - protein, 23 aa, Mycobacterium
SASQPLCRGRVLASEGDVVVVTV

SEQ ID NO: 729689 - protein, 26 aa, Mycobacterium
SASRAVEVAESWRLERVTAPSRLFGA

SEQ ID NO: 729690 - protein, 19 aa, Mycobacterium
SASRFELRASVVPRSPAAG

SEQ ID NO: 729691 - protein, 21 aa, Mycobacterium
SASRGLRFGFITGSAPSTVIA

SEQ ID NO: 729692 - protein, 25 aa, Mycobacterium
SASSLGLDGTEVFDITGIAALNDGK

SEQ ID NO: 729693 - protein, 30 aa, Mycobacterium
SASTLGGFQAWQLGGTYQKDGNTRVRAQKT

SEQ ID NO: 729694 - protein, 25 aa, Mycobacterium
SASTPLFFAQAIGRFVRSRRPGEIA

SEQ ID NO: 729695 - protein, 25 aa, Mycobacterium
SASTPLFFAQAIGRFVRSRRPGETA

SEQ ID NO: 729696 - protein, 25 aa, Mycobacterium
SASTPLFFAQAIGRFVRSRRQGETA

SEQ ID NO: 729697 - protein, 19 aa, Mycobacterium
SASVIRYTQLRPFVLHVNH

SEQ ID NO: 729698 - protein, 17 aa, Mycobacterium
SASVLPYGALDRDHLVK

SEQ ID NO: 729699 - protein, 25 aa, Mycobacterium
SASVRRPRGAPRKLLLDTARARFAR

SEQ ID NO: 729700 - protein, 20 aa, Mycobacterium
SASWRAMFRRAVLATVGEFV

SEQ ID NO: 729701 - protein, 20 aa, Mycobacterium
SASYRLKVGVTMAARAWTQA

SEQ ID NO: 729702 - protein, 22 aa, Mycobacterium
SASYYLPRLIGIAKTKQLMLTN

SEQ ID NO: 729703 - protein, 32 aa, Mycobacterium
SATAKARFVRVSPRKARRVIDLVRGRSVSDAL

SEQ ID NO: 729704 - protein, 19 aa, Mycobacterium
SATAKARFVRVSPTKARRV

SEQ ID NO: 729705 - protein, 19 aa, Mycobacterium
SATAMGWSPFYPQFDRSSL

SEQ ID NO: 729706 - protein, 25 aa, Mycobacterium
SATEPAELLAVFLLDAGDGPRTTDD

SEQ ID NO: 729707 - protein, 21 aa, Mycobacterium
SATEPRWVYFTSGTTGRPKAV

SEQ ID NO: 729708 - protein, 17 aa, Mycobacterium
SATEWWLGPDPDSPLRM

SEQ ID NO: 729709 - protein, 19 aa, Mycobacterium
SATFPGAQILAAFGQTEMS

SEQ ID NO: 729710 - protein, 23 aa, Mycobacterium
SATFRYPGPLAISVAQVDEMSGG

SEQ ID NO: 729711 - protein, 17 aa, Mycobacterium
SATIRRFNERFAQFNLP

SEQ ID NO: 729712 - protein, 24 aa, Mycobacterium
SATLARTTRWGSFLGDIDGFDAEF

SEQ ID NO: 729713 - protein, 25 aa, Mycobacterium
SATLEIKPGWGFHFDYHPGQYVGIG

SEQ ID NO: 729714 - protein, 25 aa, Mycobacterium
SATLFPAEVPSFWQIYITVDDVAGT

SEQ ID NO: 729715 - protein, 24 aa, Mycobacterium
SATLRFGHPYAVVAVAGGRRRRDP

SEQ ID NO: 729716 - protein, 26 aa, Mycobacterium
SATLRPETQIAISAWGLLSPEGRCAT

SEQ ID NO: 729717 - protein, 30 aa, Mycobacterium
SATLRVAPSASWMFEYYPIRELRQLADGSC

SEQ ID NO: 729718 - protein, 29 aa, Mycobacterium
SATLWDPRERPSFSAGYWAENLRHTVRFA

SEQ ID NO: 729719 - protein, 23 aa, Mycobacterium
SATMPGPIITLARTFMNQPTHIR

SEQ ID NO: 729720 - protein, 21 aa, Mycobacterium
SATNRAEWAASFGALHGAVHR

SEQ ID NO: 729721 - protein, 24 aa, Mycobacterium
SATPAPRYAGTRVQRVEDSRLLTG

SEQ ID NO: 729722 - protein, 23 aa, Mycobacterium
SATPDEFRGQIDITKEVLGALGI

SEQ ID NO: 729723 - protein, 24 aa, Mycobacterium
SATPDEFRGQIDITKEVLGALGIT

SEQ ID NO: 729724 - protein, 18 aa, Mycobacterium
SATPKLAIIGGRLEDDNA

SEQ ID NO: 729725 - protein, 25 aa, Mycobacterium
SATPRYDVTLTKAWGSDPFGSTTVP

SEQ ID NO: 729726 - protein, 17 aa, Mycobacterium
SATPVTHRRQPPGRRER

SEQ ID NO: 729727 - protein, 24 aa, Mycobacterium
SATQLCAAAAWFDVLKAERRKLRI

SEQ ID NO: 729728 - protein, 20 aa, Mycobacterium
SATRPGVGGAGGYGGTGGTG

SEQ ID NO: 729729 - protein, 24 aa, Mycobacterium
SATRPYMPAARMRGLVPVVRRSAA

SEQ ID NO: 729730 - protein, 17 aa, Mycobacterium
SATSRLALSDVPAELAA

SEQ ID NO: 729731 - protein, 26 aa, Mycobacterium
SATSRPIKLMGIDSVLALYSSLDDAL

SEQ ID NO: 729732 - protein, 26 aa, Mycobacterium
SATSRPIKLMGIDSVLALYSSLDGAL

SEQ ID NO: 729733 - protein, 17 aa, Mycobacterium
SATTILLEQNYRSTQTI

SEQ ID NO: 729734 - protein, 29 aa, Mycobacterium
SATVFENWLTGLARWFGQLDVDEATSRRL

SEQ ID NO: 729735 - protein, 21 aa, Mycobacterium
SATVTEVRWDAVVLGDGAVLP

SEQ ID NO: 729736 - protein, 24 aa, Mycobacterium
SATWRFRLTPRDGGTVLTYRTQMG

SEQ ID NO: 729737 - protein, 23 aa, Mycobacterium
SAVAAAEWWCRTGTMPREALVEH

SEQ ID NO: 729738 - protein, 17 aa, Mycobacterium
SAVAALGIREWDAVALT

SEQ ID NO: 729739 - protein, 19 aa, Mycobacterium
SAVAARLTPFQRMLQSLPG

SEQ ID NO: 729740 - protein, 32 aa, Mycobacterium
SAVAEGLAAMGFRCILPTWPLGSHTIPANEGA

SEQ ID NO: 729741 - protein, 19 aa, Mycobacterium
SAVAERGQALIVLTGGGNG

SEQ ID NO: 729742 - protein, 20 aa, Mycobacterium
SAVAERRQQLGISQRSLDRD

SEQ ID NO: 729743 - protein, 27 aa, Mycobacterium
SAVAKARFVRVSPRKARRVIDLVRGRS

SEQ ID NO: 729744 - protein, 18 aa, Mycobacterium
SAVAMGWSPYYPQFDRSS

SEQ ID NO: 729745 - protein, 19 aa, Mycobacterium
SAVASRLTPWQQLMDGLST

SEQ ID NO: 729746 - protein, 21 aa, Mycobacterium
SAVAVGAAWFNARVAAAKHGV

SEQ ID NO: 729747 - protein, 17 aa, Mycobacterium
SAVAVGQAWNPLSVRGL

SEQ ID NO: 729748 - protein, 17 aa, Mycobacterium
SAVCAQIGAAHAVTSGV

SEQ ID NO: 729749 - protein, 19 aa, Mycobacterium
SAVCRSCRLPAKPAPRAHA

SEQ ID NO: 729750 - protein, 23 aa, Mycobacterium
SAVDFRTGYRADLAALRDVIGDR

SEQ ID NO: 729751 - protein, 25 aa, Mycobacterium
SAVEEILRFASPVQMTARTPNCDVE

SEQ ID NO: 729752 - protein, 26 aa, Mycobacterium
SAVEEVLRWASPVAYWTRTAKVDVEM

SEQ ID NO: 729753 - protein, 19 aa, Mycobacterium
SAVEGFVLVGFAVGDNAGN

SEQ ID NO: 729754 - protein, 21 aa, Mycobacterium
SAVFNIPWVLQLRGILHTEAL

SEQ ID NO: 729755 - protein, 26 aa, Mycobacterium
SAVFRIKAGYLLAARAEDGLPLPSGP

SEQ ID NO: 729756 - protein, 17 aa, Mycobacterium
SAVGISWTSELLTVTGV

SEQ ID NO: 729757 - protein, 25 aa, Mycobacterium
SAVGMGRFAIHKAVDYVKTRQVWKV

SEQ ID NO: 729758 - protein, 25 aa, Mycobacterium
SAVGMGRFALAKAVEYVKGRQVWKT

SEQ ID NO: 729759 - protein, 25 aa, Mycobacterium
SAVGMGRFALGKAVDYVKTRQVWST

SEQ ID NO: 729760 - protein, 25 aa, Mycobacterium
SAVGMGRFALNRAVDYVKTRQVWST

SEQ ID NO: 729761 - protein, 23 aa, Mycobacterium
SAVGPKLPELWGGSADLAGSNNT

SEQ ID NO: 729762 - protein, 17 aa, Mycobacterium
SAVGTVIPTKGAVIPAA

SEQ ID NO: 729763 - protein, 19 aa, Mycobacterium
SAVIKRSPIGVLLGIMPWN

SEQ ID NO: 729764 - protein, 20 aa, Mycobacterium
SAVIRFARENGLRGQVTARG

SEQ ID NO: 729765 - protein, 26 aa, Mycobacterium
SAVIRRLCEPERQIIFRVPWIDDNGV

SEQ ID NO: 729766 - protein, 34 aa, Mycobacterium
SAVISGLTADEWRGPSALSMAAAAAPYVTWMRAT

SEQ ID NO: 729767 - protein, 19 aa, Mycobacterium
SAVLCTPWRELLAEVDPSR

SEQ ID NO: 729768 - protein, 25 aa, Mycobacterium
SAVLLRECIDFFAPYLAAAKLTGEV

SEQ ID NO: 729769 - protein, 20 aa, Mycobacterium
SAVMATLFAEYGRQYQALAG

SEQ ID NO: 729770 - protein, 18 aa, Mycobacterium
SAVMPWRAAEECEQWLGT

SEQ ID NO: 729771 - protein, 20 aa, Mycobacterium
SAVPLDGGFVRRMPGTPAGS

SEQ ID NO: 729772 - protein, 21 aa, Mycobacterium
SAVPPDIALFLDLKQTPAQPV

SEQ ID NO: 729773 - protein, 19 aa, Mycobacterium
SAVPRERFAALKERLGNAF

SEQ ID NO: 729774 - protein, 19 aa, Mycobacterium
SAVPSRWASKWGSSGLAYL

SEQ ID NO: 729775 - protein, 26 aa, Mycobacterium
SAVQRVPFARALRAAQRHDYLGAYVD

SEQ ID NO: 729776 - protein, 19 aa, Mycobacterium
SAVQWLRDQMHVIDSAAES

SEQ ID NO: 729777 - protein, 17 aa, Mycobacterium
SAVRAGMDLGIMHDLAV

SEQ ID NO: 729778 - protein, 20 aa, Mycobacterium
SAVRARIAPVGPSRVSIELA

SEQ ID NO: 729779 - protein, 24 aa, Mycobacterium
SAVRGRFGDTLPFLVKVLAADEPL

SEQ ID NO: 729780 - protein, 17 aa, Mycobacterium
SAVRLVRQIPYTVACDI

SEQ ID NO: 729781 - protein, 21 aa, Mycobacterium
SAVSRLARRGGYLDVRPEAER

SEQ ID NO: 729782 - protein, 20 aa, Mycobacterium
SAVSYCGRMLVSINGCPAVL

SEQ ID NO: 729783 - protein, 20 aa, Mycobacterium
SAVTAAACEWAYRAGAEEVV

SEQ ID NO: 729784 - protein, 21 aa, Mycobacterium
SAVTCSFLFLCSGYYNYDQGY

SEQ ID NO: 729785 - protein, 20 aa, Mycobacterium
SAVTGMAPWDGTSFWDQART

SEQ ID NO: 729786 - protein, 20 aa, Mycobacterium
SAVTGVYSPQSWSTIPGGPF

SEQ ID NO: 729787 - protein, 18 aa, Mycobacterium
SAVTLRPGATITAADLTE

SEQ ID NO: 729788 - protein, 26 aa, Mycobacterium
SAVTTFIAGVFLRFVAGDQTFNDPDK

SEQ ID NO: 729789 - protein, 20 aa, Mycobacterium
SAVVHSWVLARGHREQAMEF

SEQ ID NO: 729790 - protein, 25 aa, Mycobacterium
SAVYRCKVPVIAAVNGFCLGGGIGL

SEQ ID NO: 729791 - protein, 25 aa, Mycobacterium
SAWALLRKRAWFEAGSAITAPPLGR

SEQ ID NO: 729792 - protein, 19 aa, Mycobacterium
SAWDHNWAATSVVIGADIA

SEQ ID NO: 729793 - protein, 19 aa, Mycobacterium
SAWFPRGDVEQMIRSGVIV

SEQ ID NO: 729794 - protein, 17 aa, Mycobacterium
SAWFRACEAQAEGQFTS

SEQ ID NO: 729795 - protein, 17 aa, Mycobacterium
SAWGTSEWHRARVLEAL

SEQ ID NO: 729796 - protein, 21 aa, Mycobacterium
SAWHRHPWPEVHGLAESVAAW

SEQ ID NO: 729797 - protein, 24 aa, Mycobacterium
SAWIFPGQLWVAWQAKSAAEPDSS

SEQ ID NO: 729798 - protein, 24 aa, Mycobacterium
SAWIKDKIWNTQEVVIGGWRQGEG

SEQ ID NO: 729799 - protein, 25 aa, Mycobacterium
SAWILCAAIAHNLLRAAGVLAGGAH

SEQ ID NO: 729800 - protein, 21 aa, Mycobacterium
SAWLKASRADFRAVDNLSGWF

SEQ ID NO: 729801 - protein, 20 aa, Mycobacterium
SAWPMLDLAAARGVAARIGL

SEQ ID NO: 729802 - protein, 18 aa, Mycobacterium
SAWQSALDYATHRTQFGR

SEQ ID NO: 729803 - protein, 25 aa, Mycobacterium
SAWRAKRKALELIYRVPRSAGRELA

SEQ ID NO: 729804 - protein, 18 aa, Mycobacterium
SAWRDHLLVAITIEEVDG

SEQ ID NO: 729805 - protein, 19 aa, Mycobacterium
SAWSEFCARLQRAGEQAFK

SEQ ID NO: 729806 - protein, 20 aa, Mycobacterium
SAWYLSRAAAKPMIAAGKGA

SEQ ID NO: 729807 - protein, 19 aa, Mycobacterium
SAWYLSRAAAKPMIAQGSG

SEQ ID NO: 729808 - protein, 19 aa, Mycobacterium
SAWYLSRAAAKPMIEQGKG

SEQ ID NO: 729809 - protein, 29 aa, Mycobacterium
SAYACANAWLDALVTWRAAAGLPATTVNW

SEQ ID NO: 729810 - protein, 19 aa, Mycobacterium
SAYAEGLGFAGVLAGPLVR

SEQ ID NO: 729811 - protein, 17 aa, Mycobacterium
SAYEHWLADETACLQSS

SEQ ID NO: 729812 - protein, 27 aa, Mycobacterium
SAYIDTWLLRACAKLGVRLVHSTPHRP

SEQ ID NO: 729813 - protein, 17 aa, Mycobacterium
SAYSEMWFTEAHWPAFR

SEQ ID NO: 729814 - protein, 21 aa, Mycobacterium
SAYTWLKLPVVDEMERVMDAT

SEQ ID NO: 729815 - protein, 21 aa, Mycobacterium
SAYTWMKLPVVDEMDRVMEST

SEQ ID NO: 729816 - protein, 26 aa, Mycobacterium
SAYVPKHWDKLCEIIGRPDMRDDERF

SEQ ID NO: 729817 - protein, 26 aa, Mycobacterium
SAYVPKHWQRLCEIIGRPDLLDDERF

SEQ ID NO: 729818 - protein, 21 aa, Mycobacterium
SCAAASMLTGLGVGRGDTVAL

SEQ ID NO: 729819 - protein, 19 aa, Mycobacterium
SCAEGGVLGIICASIASVM

SEQ ID NO: 729820 - protein, 20 aa, Mycobacterium
SCAEGGVLGILCASIASVMG

SEQ ID NO: 729821 - protein, 22 aa, Mycobacterium
SCAELVPAIVADAVEHLNKASS

SEQ ID NO: 729822 - protein, 19 aa, Mycobacterium
SCAELVPAIVAEAVEHLQK

SEQ ID NO: 729823 - protein, 26 aa, Mycobacterium
SCAFSREGATWFWEVATQWDDPSDDA

SEQ ID NO: 729824 - protein, 20 aa, Mycobacterium
SCDFSTASSWEFEPLDNDVF

SEQ ID NO: 729825 - protein, 45 aa, Mycobacterium
SCDLVYTGIGALCWLPDIRRWATVVAQLLRPGGRLFMREGHPMLD

SEQ ID NO: 729826 - protein, 41 aa, Mycobacterium
SCEDPRFSIARLSLLDRGMVFAIAHVRGGGELGRSWYEHGK

SEQ ID NO: 729827 - protein, 27 aa, Mycobacterium
SCEDPRFSIARLSLLDRGMVFAVAHVR

SEQ ID NO: 729828 - protein, 18 aa, Mycobacterium
SCEFLKQYAKPFSLLVIA

SEQ ID NO: 729829 - protein, 25 aa, Mycobacterium
SCELYDLPMLWQIAAHNPWLSVSPV

SEQ ID NO: 729830 - protein, 19 aa, Mycobacterium
SCEVGPWFRWATVGVDSAA

SEQ ID NO: 729831 - protein, 22 aa, Mycobacterium
SCFASGRISYAMRLHGPAVTVD

SEQ ID NO: 729832 - protein, 19 aa, Mycobacterium
SCFFLPRILPDGTRNRMFL

SEQ ID NO: 729833 - protein, 19 aa, Mycobacterium
SCFMLPRILPDGTRNRMFL

SEQ ID NO: 729834 - protein, 17 aa, Mycobacterium
SCFPVKVHEASAGWTRA

SEQ ID NO: 729835 - protein, 19 aa, Mycobacterium
SCGAIKAALGAIEEGSIPG

SEQ ID NO: 729836 - protein, 20 aa, Mycobacterium
SCGAVKAALGAIDDGAIPSG

SEQ ID NO: 729837 - protein, 19 aa, Mycobacterium
SCGGCRPRPAWPTGATVAA

SEQ ID NO: 729838 - protein, 24 aa, Mycobacterium
SCGKCTPCREGTYWLAQIYARLEN

SEQ ID NO: 729839 - protein, 25 aa, Mycobacterium
SCGKCTPCREGTYWLAQIYERLETG

SEQ ID NO: 729840 - protein, 25 aa, Mycobacterium
SCGKCTPCREGTYWLVRILQRLESG

SEQ ID NO: 729841 - protein, 20 aa, Mycobacterium
SCGPELIRARLTELGGIART

SEQ ID NO: 729842 - protein, 25 aa, Mycobacterium
SCGPTRRSCWCWSTRAPPARTTPTR

SEQ ID NO: 729843 - protein, 20 aa, Mycobacterium
SCGQCPTCQAGMRNLCDLGA

SEQ ID NO: 729844 - protein, 22 aa, Mycobacterium
SCGSTSRLLLHEAIADEVIDLV

SEQ ID NO: 729845 - protein, 21 aa, Mycobacterium
SCICLGAAIESWIGPNHPVIG

SEQ ID NO: 729846 - protein, 19 aa, Mycobacterium
SCIGVPGAVPAGIRAVAAE

SEQ ID NO: 729847 - protein, 20 aa, Mycobacterium
SCITAAGWAGLLVTVVPFTV

SEQ ID NO: 729848 - protein, 24 aa, Mycobacterium
SCITGAGCTGVFVTLVPFAVDGGT

SEQ ID NO: 729849 - protein, 17 aa, Mycobacterium
SCLGDHFAMLEASLALA

SEQ ID NO: 729850 - protein, 20 aa, Mycobacterium
SCLLAEFGRTSVLFDPGTFA

SEQ ID NO: 729851 - protein, 20 aa, Mycobacterium
SCLRGVNTLTGFALAVEIGD

SEQ ID NO: 729852 - protein, 21 aa, Mycobacterium
SCNAPSRMLVPNSRMAEAITI

SEQ ID NO: 729853 - protein, 21 aa, Mycobacterium
SCNAPSRMLVPNSRMDEAIAV

SEQ ID NO: 729854 - protein, 20 aa, Mycobacterium
SCNAPSRMLVPNSRMDEAIT

SEQ ID NO: 729855 - protein, 21 aa, Mycobacterium
SCNAPSRMLVPNSRMGEAITI

SEQ ID NO: 729856 - protein, 17 aa, Mycobacterium
SCNTTFAELASRMPPRG

SEQ ID NO: 729857 - protein, 20 aa, Mycobacterium
SCPDCGTKGQWTEPRDFNMM

SEQ ID NO: 729858 - protein, 20 aa, Mycobacterium
SCPHCSGRGILLHADPVDSA

SEQ ID NO: 729859 - protein, 17 aa, Mycobacterium
SCPIFGFPTMTSGYPLP

SEQ ID NO: 729860 - protein, 22 aa, Mycobacterium
SCPLSDCAWRTAGYPAATGPAR

SEQ ID NO: 729861 - protein, 25 aa, Mycobacterium
SCPNCRRGDVVNCLSIQLMAFAYDG

SEQ ID NO: 729862 - protein, 29 aa, Mycobacterium
SCPPENKLSCPIYTFIGSKDWIATREDME

SEQ ID NO: 729863 - protein, 20 aa, Mycobacterium
SCPQMAWSQVRTTVAEAVSP

SEQ ID NO: 729864 - protein, 20 aa, Mycobacterium
SCQAIWRLDDGYVAASDPRR

SEQ ID NO: 729865 - protein, 24 aa, Mycobacterium
SCQLRSRFGFLAIHGGGLEEMTDV

SEQ ID NO: 729866 - protein, 26 aa, Mycobacterium
SCQVVTYRFWAERLGIQVDSLSASAE

SEQ ID NO: 729867 - protein, 19 aa, Mycobacterium
SCRAEDRAALIGYLPTGFP

SEQ ID NO: 729868 - protein, 25 aa, Mycobacterium
SCRAEGRSGLIGYLPTGFPDVDTSI

SEQ ID NO: 729869 - protein, 20 aa, Mycobacterium
SCRAENRAALIGYLPTGYPD

SEQ ID NO: 729870 - protein, 21 aa, Mycobacterium
SCRAGVCGSCETAVLEGVPDH

SEQ ID NO: 729871 - protein, 25 aa, Mycobacterium
SCRDAIEWFGRANLDPRYLGLCLDT

SEQ ID NO: 729872 - protein, 18 aa, Mycobacterium
SCRDCPECRRGEYRRCAV

SEQ ID NO: 729873 - protein, 22 aa, Mycobacterium
SCRDTAWLLVSILRQKGLAARF

SEQ ID NO: 729874 - protein, 26 aa, Mycobacterium
SCREGHCGACAATLRSGKVNMEVNDV

SEQ ID NO: 729875 - protein, 23 aa, Mycobacterium
SCREGSCGSCAATVLDGEIERGD

SEQ ID NO: 729876 - protein, 17 aa, Mycobacterium
SCRGGCMAAKFFTGLPL

SEQ ID NO: 729877 - protein, 22 aa, Mycobacterium
SCRQGFCGTCRVKVLAGQVDHR

SEQ ID NO: 729878 - protein, 19 aa, Mycobacterium
SCRRLVALAALKQRPLHRN

SEQ ID NO: 729879 - protein, 27 aa, Mycobacterium
SCSAEINGRPRLMCMTRMSTFGEDEVV

SEQ ID NO: 729880 - protein, 17 aa, Mycobacterium
SCSDLYARDTWQLVHAG

SEQ ID NO: 729881 - protein, 22 aa, Mycobacterium
SCSGDRASYGWQRDGGHARYVL

SEQ ID NO: 729882 - protein, 18 aa, Mycobacterium
SCSPDFGTRAVIDRFAQI

SEQ ID NO: 729883 - protein, 21 aa, Mycobacterium
SCTEGDIALSARINIEALLWA

SEQ ID NO: 729884 - protein, 17 aa, Mycobacterium
SCTFPDRALDEVFADGA

SEQ ID NO: 729885 - protein, 24 aa, Mycobacterium
SCTGIELDPDWLFDIQVKRIHEYK

SEQ ID NO: 729886 - protein, 18 aa, Mycobacterium
SCVEPVLALSAKRFIGLA

SEQ ID NO: 729887 - protein, 20 aa, Mycobacterium
SCVFFLGTLWHGGGANQSDS

SEQ ID NO: 729888 - protein, 18 aa, Mycobacterium
SCVPLLKQLLEAQGVEQS

SEQ ID NO: 729889 - protein, 18 aa, Mycobacterium
SCVQECPADCIYEGDRAM

SEQ ID NO: 729890 - protein, 33 aa, Mycobacterium
SCVVDLPTALLLRRDRLGSATARAHLRAAVRAV

SEQ ID NO: 729891 - protein, 24 aa, Mycobacterium
SCVVREIAEEIGLTVTDVEYLGSQ

SEQ ID NO: 729892 - protein, 25 aa, Mycobacterium
SDAAEDWLCLLEAFDQPHRPGMVRA

SEQ ID NO: 729893 - protein, 20 aa, Mycobacterium
SDAALKWAVQEATMRNVALT

SEQ ID NO: 729894 - protein, 32 aa, Mycobacterium
SDAAMTFCLSIFRRLDVDWALHGFDDTALTEL

SEQ ID NO: 729895 - protein, 22 aa, Mycobacterium
SDAARLFWRQLLQAHRVMSQFR

SEQ ID NO: 729896 - protein, 23 aa, Mycobacterium
SDAASWPRWAKVITKVTWTSPEP

SEQ ID NO: 729897 - protein, 17 aa, Mycobacterium
SDAASWVDNDWAGVVGD

SEQ ID NO: 729898 - protein, 29 aa, Mycobacterium
SDADVALMLRRLEHVPIATVVRLPDAAPA

SEQ ID NO: 729899 - protein, 20 aa, Mycobacterium
SDADVSLAGMARFVGAPAHR

SEQ ID NO: 729900 - protein, 18 aa, Mycobacterium
SDAEASVVYLDRRALGDG

SEQ ID NO: 729901 - protein, 21 aa, Mycobacterium
SDAEIIAGFPQWESVMEVREQ

SEQ ID NO: 729902 - protein, 19 aa, Mycobacterium
SDAELGWIATAFDPEVLTI

SEQ ID NO: 729903 - protein, 23 aa, Mycobacterium
SDAELRAVAALAVEHDLLVITDE

SEQ ID NO: 729904 - protein, 19 aa, Mycobacterium
SDAENRWELTVDHDGEQKQ

SEQ ID NO: 729905 - protein, 17 aa, Mycobacterium
SDAFFPFPDGLQVLTEA

SEQ ID NO: 729906 - protein, 26 aa, Mycobacterium
SDAFKAADGYLVISAYVPKHWDKLCE

SEQ ID NO: 729907 - protein, 23 aa, Mycobacterium
SDAFYREMMTGVFSADGVLTISE

SEQ ID NO: 729908 - protein, 32 aa, Mycobacterium
SDAGLPGPLVWSWYGSWTLKGWENRYAIMSDL

SEQ ID NO: 729909 - protein, 20 aa, Mycobacterium
SDAGMRRWAGEVFAIYREGL

SEQ ID NO: 729910 - protein, 20 aa, Mycobacterium
SDAIADWPLLNALTATSSGA

SEQ ID NO: 729911 - protein, 23 aa, Mycobacterium
SDAIARMKRGVILINTSRGALVD

SEQ ID NO: 729912 - protein, 17 aa, Mycobacterium
SDAIVKFLTEFADSTDH

SEQ ID NO: 729913 - protein, 25 aa, Mycobacterium
SDAKDSRGLIALRARGAQVRIGHDP

SEQ ID NO: 729914 - protein, 25 aa, Mycobacterium
SDAKESRGVLALRARGALVNIGHDG

SEQ ID NO: 729915 - protein, 24 aa, Mycobacterium
SDAKESRGVVALRARGAEIRIGHD

SEQ ID NO: 729916 - protein, 20 aa, Mycobacterium
SDALELTWRSLGEIGNLSSA

SEQ ID NO: 729917 - protein, 17 aa, Mycobacterium
SDALLARITPTGDPADL

SEQ ID NO: 729918 - protein, 19 aa, Mycobacterium
SDALPRRKTDLAALGDRLT

SEQ ID NO: 729919 - protein, 20 aa, Mycobacterium
SDALQIVAFGRYARTVTAAE

SEQ ID NO: 729920 - protein, 22 aa, Mycobacterium
SDALRAVAAFRLALPRTMLRFA

SEQ ID NO: 729921 - protein, 19 aa, Mycobacterium
SDALRCARLAVTGKSAGDS

SEQ ID NO: 729922 - protein, 23 aa, Mycobacterium
SDALRQRFLPGIIDGTERWCQGF

SEQ ID NO: 729923 - protein, 19 aa, Mycobacterium
SDAMALRQALADGIIDCVA

SEQ ID NO: 729924 - protein, 19 aa, Mycobacterium
SDAMFAAPMWAFADAYSAF

SEQ ID NO: 729925 - protein, 19 aa, Mycobacterium
SDAMSFDFGALPPEINSLR

SEQ ID NO: 729926 - protein, 17 aa, Mycobacterium
SDANLWCREHQIHADPF

SEQ ID NO: 729927 - protein, 23 aa, Mycobacterium
SDAPAASWRARYDGFRLNTCGFW

SEQ ID NO: 729928 - protein, 19 aa, Mycobacterium
SDAPATLARIVGKHCETGD

SEQ ID NO: 729929 - protein, 21 aa, Mycobacterium
SDAPDVLKDWYLSEEHRDNPA

SEQ ID NO: 729930 - protein, 19 aa, Mycobacterium
SDAPGCKRVLFSNDYYPAI

SEQ ID NO: 729931 - protein, 19 aa, Mycobacterium
SDAPIAFGDDLRKVLLGLR

SEQ ID NO: 729932 - protein, 21 aa, Mycobacterium
SDAPSALGYLAARTERILLGS

SEQ ID NO: 729933 - protein, 23 aa, Mycobacterium
SDAPTTLNPLAWANAAVGAVFLT

SEQ ID NO: 729934 - protein, 19 aa, Mycobacterium
SDARFANHVARGRNQDDLD

SEQ ID NO: 729935 - protein, 23 aa, Mycobacterium
SDARGREALVRRIVAVAERLRHD

SEQ ID NO: 729936 - protein, 24 aa, Mycobacterium
SDARIKAHAAFGLMNSTPYSAGRS

SEQ ID NO: 729937 - protein, 19 aa, Mycobacterium
SDARPVLVFNRASRVDNDP

SEQ ID NO: 729938 - protein, 22 aa, Mycobacterium
SDARRAGDRAGRRARLGGDTEL

SEQ ID NO: 729939 - protein, 24 aa, Mycobacterium
SDARSRPVMLWPYDPLAFNGKGRA

SEQ ID NO: 729940 - protein, 17 aa, Mycobacterium
SDASRYPAEFSGGQKQR

SEQ ID NO: 729941 - protein, 18 aa, Mycobacterium
SDASRYPAEFSGGQKQRI

SEQ ID NO: 729942 - protein, 23 aa, Mycobacterium
SDATRAALWDLVWAGQVTGDTFA

SEQ ID NO: 729943 - protein, 19 aa, Mycobacterium
SDATRTEWLEGVRADDFSL

SEQ ID NO: 729944 - protein, 17 aa, Mycobacterium
SDAVACALAVQRAPLAP

SEQ ID NO: 729945 - protein, 25 aa, Mycobacterium
SDAVAEVRRRGCRRVVVASYLLSEG

SEQ ID NO: 729946 - protein, 26 aa, Mycobacterium
SDAVRRLSDRFGEFKAAEIADLLEEA

SEQ ID NO: 729947 - protein, 17 aa, Mycobacterium
SDAYEWGLINQVVKQGA

SEQ ID NO: 729948 - protein, 18 aa, Mycobacterium
SDAYGCRLERLPQVSYAA

SEQ ID NO: 729949 - protein, 23 aa, Mycobacterium
SDCFDIAIEAVRIALTYRTPVMI

SEQ ID NO: 729950 - protein, 18 aa, Mycobacterium
SDCGLCPDHKQHACLGLI

SEQ ID NO: 729951 - protein, 18 aa, Mycobacterium
SDCLGVYAPMPAWADGSA

SEQ ID NO: 729952 - protein, 18 aa, Mycobacterium
SDCRRVIIGRHFGDEEVY

SEQ ID NO: 729953 - protein, 20 aa, Mycobacterium
SDDARALLEYVWALMGMPCG

SEQ ID NO: 729954 - protein, 20 aa, Mycobacterium
SDDEFWDYLASLTVSVLPYR

SEQ ID NO: 729955 - protein, 20 aa, Mycobacterium
SDDELLAWALGDVATVFGLD

SEQ ID NO: 729956 - protein, 26 aa, Mycobacterium
SDDELPELLSGVSIVVVRILGGYRAW

SEQ ID NO: 729957 - protein, 22 aa, Mycobacterium
SDDELRVGVLYGEGKGFTSGLD

SEQ ID NO: 729958 - protein, 22 aa, Mycobacterium
SDDEWRARIALRQQQIAARMLG

SEQ ID NO: 729959 - protein, 28 aa, Mycobacterium
SDDFAQYWAEICELPISLITDMIKHAQR

SEQ ID NO: 729960 - protein, 18 aa, Mycobacterium
SDDFFALFLDPSRTYSCA

SEQ ID NO: 729961 - protein, 21 aa, Mycobacterium
SDDFFRLFLDPTMTYSCAYWD

SEQ ID NO: 729962 - protein, 28 aa, Mycobacterium
SDDFPLARLYSWHRAMRLFDGPDEVHMR

SEQ ID NO: 729963 - protein, 27 aa, Mycobacterium
SDDGTPLPLQWGRYVPGKLVAAPYGLR

SEQ ID NO: 729964 - protein, 24 aa, Mycobacterium
SDDHLRRLEGIAGQVAGHRSARPE

SEQ ID NO: 729965 - protein, 26 aa, Mycobacterium
SDDIRAALDLLRRRFTKVIWVPGNHE

SEQ ID NO: 729966 - protein, 20 aa, Mycobacterium
SDDKFPAMPFVELGYEVAYH

SEQ ID NO: 729967 - protein, 28 aa, Mycobacterium
SDDKLGSLLIRRGWVPVHIHFEDLSDMW

SEQ ID NO: 729968 - protein, 18 aa, Mycobacterium
SDDLCFITGAAPAQVRAH

SEQ ID NO: 729969 - protein, 33 aa, Mycobacterium
SDDLELGLAVLRAWNDWHLEVWAGAYPQRIIPL

SEQ ID NO: 729970 - protein, 18 aa, Mycobacterium
SDDLKARTLPAVATGEVH

SEQ ID NO: 729971 - protein, 17 aa, Mycobacterium
SDDLLAVHPGEPAAAPP

SEQ ID NO: 729972 - protein, 18 aa, Mycobacterium
SDDLLVVHYPYFETAGSP

SEQ ID NO: 729973 - protein, 23 aa, Mycobacterium
SDDLRWWPADALPDGTDHALAYL

SEQ ID NO: 729974 - protein, 19 aa, Mycobacterium
SDDLWWAIDGGFLSITDTK

SEQ ID NO: 729975 - protein, 33 aa, Mycobacterium
SDDPALTWLQLRDWLRTRLPEHLVPPTGTILDT

SEQ ID NO: 729976 - protein, 25 aa, Mycobacterium
SDDPGVKLVDDWRGFGQRATASGSV

SEQ ID NO: 729977 - protein, 25 aa, Mycobacterium
SDDQLRLLLRDVFTAAGGTHDDWDS

SEQ ID NO: 729978 - protein, 19 aa, Mycobacterium
SDDRATRRWSHGGGTSPNR

SEQ ID NO: 729979 - protein, 17 aa, Mycobacterium
SDDRWLVADTVEYPIQV

SEQ ID NO: 729980 - protein, 33 aa, Mycobacterium
SDDRWTMFHSVAFDFSVWELWGALLHGACVVVV

SEQ ID NO: 729981 - protein, 17 aa, Mycobacterium
SDDRYLCINPFFHNFGY

SEQ ID NO: 729982 - protein, 22 aa, Mycobacterium
SDDSDRALAMATRIHTGTVGVN

SEQ ID NO: 729983 - protein, 26 aa, Mycobacterium
SDDSFWCAADPGWAYGLYTAIAAPMA

SEQ ID NO: 729984 - protein, 23 aa, Mycobacterium
SDDSLRAGVLFAHGDHFTAGLDL

SEQ ID NO: 729985 - protein, 17 aa, Mycobacterium
SDDTVAAALAWVRALGK

SEQ ID NO: 729986 - protein, 21 aa, Mycobacterium
SDDTVRRWINQGALEVSHDAA

SEQ ID NO: 729987 - protein, 23 aa, Mycobacterium
SDDVLPFITLRQWQPISEDETEV

SEQ ID NO: 729988 - protein, 32 aa, Mycobacterium
SDDVPAYRRWLGTRLPYYANWIRLKSYWGTSD

SEQ ID NO: 729989 - protein, 24 aa, Mycobacterium
SDDVPWAGAAERIVIVWQTGDGYR

SEQ ID NO: 729990 - protein, 17 aa, Mycobacterium
SDEAFGRAAEPWEVAAT

SEQ ID NO: 729991 - protein, 17 aa, Mycobacterium
SDEALYRPLGMTSTSSR

SEQ ID NO: 729992 - protein, 19 aa, Mycobacterium
SDEAVRLLLDAGADVNAKN

SEQ ID NO: 729993 - protein, 19 aa, Mycobacterium
SDEDLRWLDSRRSPEQIAK

SEQ ID NO: 729994 - protein, 18 aa, Mycobacterium
SDEFFALFLDPTRTYSCA

SEQ ID NO: 729995 - protein, 22 aa, Mycobacterium
SDEFRAGWERHDIRGFESRERV

SEQ ID NO: 729996 - protein, 21 aa, Mycobacterium
SDEGVPWPPGLAADVAAVTCD

SEQ ID NO: 729997 - protein, 28 aa, Mycobacterium
SDEKKTALGTGFFLTWLTTYTDQNGEVL

SEQ ID NO: 729998 - protein, 26 aa, Mycobacterium
SDEKPRPLPVWKRRINDYAENAALSL

SEQ ID NO: 729999 - protein, 21 aa, Mycobacterium
SDEKVDWARRVLAAARTERGV

SEQ ID NO: 730000 - protein, 28 aa, Mycobacterium
SDELLARMLFESCLLHAGQACILHSRLL

SEQ ID NO: 730001 - protein, 18 aa, Mycobacterium
SDELTAWAARISSETGDA

SEQ ID NO: 730002 - protein, 23 aa, Mycobacterium
SDEPRVTFHGRFRDVDGLPITPK

SEQ ID NO: 730003 - protein, 29 aa, Mycobacterium
SDEQWRRTFAVNIDSFFHVTKAALSHLPD

SEQ ID NO: 730004 - protein, 24 aa, Mycobacterium
SDERGRRFLIHTSKIAYVEIGVAD

SEQ ID NO: 730005 - protein, 23 aa, Mycobacterium
SDERLQRIFTFQSLYAGVAPRDA

SEQ ID NO: 730006 - protein, 23 aa, Mycobacterium
SDERMAPIPALLAVAGVHHHLVR

SEQ ID NO: 730007 - protein, 17 aa, Mycobacterium
SDERSALREFLAFHQSA

SEQ ID NO: 730008 - protein, 22 aa, Mycobacterium
SDESLILILRVFRGPRPSAPSR

SEQ ID NO: 730009 - protein, 18 aa, Mycobacterium
SDESRYVTGLQFKVDAGA

SEQ ID NO: 730010 - protein, 17 aa, Mycobacterium
SDETWAEFVTTYLSGSE

SEQ ID NO: 730011 - protein, 28 aa, Mycobacterium
SDEVICAFGRIGSMFACDDFGYVPDMIT

SEQ ID NO: 730012 - protein, 29 aa, Mycobacterium
SDEVICAYGRIGSMFACNDFGYVPDIITS

SEQ ID NO: 730013 - protein, 31 aa, Mycobacterium
SDEVPVVVVLWSPRSDVCVELVDTLSGLAAA

SEQ ID NO: 730014 - protein, 22 aa, Mycobacterium
SDEVVDVVLLWWRDNDGDLVDR

SEQ ID NO: 730015 - protein, 24 aa, Mycobacterium
SDEWTDWRWNSILIEGSNCRDIID

SEQ ID NO: 730016 - protein, 25 aa, Mycobacterium
SDEYFANTEVVVWTPRRATGRPLSF

SEQ ID NO: 730017 - protein, 21 aa, Mycobacterium
SDFALSERFSRNFGVFREAEA

SEQ ID NO: 730018 - protein, 24 aa, Mycobacterium
SDFDYVLNFAVAKSGHWDKDLSAN

SEQ ID NO: 730019 - protein, 19 aa, Mycobacterium
SDFERLRREFDFPGDDRVV

SEQ ID NO: 730020 - protein, 23 aa, Mycobacterium
SDFHPAGDTMAWFYDPPWTLPFR

SEQ ID NO: 730021 - protein, 19 aa, Mycobacterium
SDFLIEFIQRTAIPDMSTS

SEQ ID NO: 730022 - protein, 19 aa, Mycobacterium
SDFLLKEYWNRPDATRDAF

SEQ ID NO: 730023 - protein, 20 aa, Mycobacterium
SDFMSYLNLWRYLRERRSAL

SEQ ID NO: 730024 - protein, 23 aa, Mycobacterium
SDFPTDRGWDLADLFDPDPDTPH

SEQ ID NO: 730025 - protein, 23 aa, Mycobacterium
SDFPTDRGWDLAGVYNPDPDVPG

SEQ ID NO: 730026 - protein, 17 aa, Mycobacterium
SDFQRLRDPAAAPSMLA

SEQ ID NO: 730027 - protein, 20 aa, Mycobacterium
SDFRLWVCLHEVTHRVQFTA

SEQ ID NO: 730028 - protein, 22 aa, Mycobacterium
SDFRLWVCLHEVTHRVQFTANP

SEQ ID NO: 730029 - protein, 20 aa, Mycobacterium
SDGAEALRCATEHRPDAIVL

SEQ ID NO: 730030 - protein, 18 aa, Mycobacterium
SDGALLAGLAARMLGIRD

SEQ ID NO: 730031 - protein, 37 aa, Mycobacterium
SDGARWATRHLPYYGRWLRFVSWWPIADALDEQITID

SEQ ID NO: 730032 - protein, 21 aa, Mycobacterium
SDGDAFGRLILLYDPEGADAW

SEQ ID NO: 730033 - protein, 18 aa, Mycobacterium
SDGGLFLDRDRAVAHGVE

SEQ ID NO: 730034 - protein, 25 aa, Mycobacterium
SDGGRAAIVFGDWPAHTGARPAVTL

SEQ ID NO: 730035 - protein, 24 aa, Mycobacterium
SDGGRAAIVLGDWNAIGSSPQAAL

SEQ ID NO: 730036 - protein, 25 aa, Mycobacterium
SDGGRAALVLGDWPAQEAVTGQLPA

SEQ ID NO: 730037 - protein, 19 aa, Mycobacterium
SDGHPPLWTNAAMADLVVE

SEQ ID NO: 730038 - protein, 25 aa, Mycobacterium
SDGIEFCRQRHNVAGLKFVQGDAEN

SEQ ID NO: 730039 - protein, 24 aa, Mycobacterium
SDGIKDLRFGALLDDDWAESDPDE

SEQ ID NO: 730040 - protein, 25 aa, Mycobacterium
SDGINFCRRRHNIAGLEFVQGDAQD

SEQ ID NO: 730041 - protein, 19 aa, Mycobacterium
SDGKNFYALDGQDWEPGQS

SEQ ID NO: 730042 - protein, 19 aa, Mycobacterium
SDGKNFYALGGQDWHPEES

SEQ ID NO: 730043 - protein, 23 aa, Mycobacterium
SDGKPARVGYRLDEETGKRVRIS

SEQ ID NO: 730044 - protein, 22 aa, Mycobacterium
SDGKPTRIGYRVDEETGKRVRI

SEQ ID NO: 730045 - protein, 23 aa, Mycobacterium
SDGKPTRVGYRIDDETGKKVRIA

SEQ ID NO: 730046 - protein, 22 aa, Mycobacterium
SDGKPTRVGYRVDEETGKRVRI

SEQ ID NO: 730047 - protein, 21 aa, Mycobacterium
SDGKRSWALMGDRINHFIPNV

SEQ ID NO: 730048 - protein, 20 aa, Mycobacterium
SDGKRTWAVIGDRVNHFIPN

SEQ ID NO: 730049 - protein, 27 aa, Mycobacterium
SDGKTKREAMRCLKRYYARHLFRLLET

SEQ ID NO: 730050 - protein, 18 aa, Mycobacterium
SDGLNFAAHNAYADDGAV

SEQ ID NO: 730051 - protein, 18 aa, Mycobacterium
SDGLPAYGACAGMILLAS

SEQ ID NO: 730052 - protein, 24 aa, Mycobacterium
SDGLRIVRDGTIEKRDWSGHPGAA

SEQ ID NO: 730053 - protein, 23 aa, Mycobacterium
SDGLYTTALQRIWSLLDDDPLIV

SEQ ID NO: 730054 - protein, 25 aa, Mycobacterium
SDGMWDEARRCGGGIAGGDLVRAPL

SEQ ID NO: 730055 - protein, 22 aa, Mycobacterium
SDGNPTRIGYRVDEETGKRVRI

SEQ ID NO: 730056 - protein, 24 aa, Mycobacterium
SDGQRRMWFVQGFDPSGVLLNVSL

SEQ ID NO: 730057 - protein, 26 aa, Mycobacterium
SDGRAAVLCCLHHALTDGVGAVQIAM

SEQ ID NO: 730058 - protein, 19 aa, Mycobacterium
SDGRAAWNMVTSSDAFTGE

SEQ ID NO: 730059 - protein, 23 aa, Mycobacterium
SDGRAAWNVVTSWDAFTGENFRR

SEQ ID NO: 730060 - protein, 19 aa, Mycobacterium
SDGRFVLGLGTQIQAHIER

SEQ ID NO: 730061 - protein, 20 aa, Mycobacterium
SDGRGPVLIHALEGFSDAGH

SEQ ID NO: 730062 - protein, 23 aa, Mycobacterium
SDGRIHGVQLWLGAPDETAPERP

SEQ ID NO: 730063 - protein, 25 aa, Mycobacterium
SDGRIKFTTGNGLPFKIRDIPVAPD

SEQ ID NO: 730064 - protein, 19 aa, Mycobacterium
SDGRLDLDLAIPKEMGGSG

SEQ ID NO: 730065 - protein, 22 aa, Mycobacterium
SDGRLPRGPLHAMLKERLELTG

SEQ ID NO: 730066 - protein, 37 aa, Mycobacterium
SDGRRRARLTGVTWPSEWSRAYFTPVTLMGERAMLGR

SEQ ID NO: 730067 - protein, 19 aa, Mycobacterium
SDGRVGWHRAGADVRRAGE

SEQ ID NO: 730068 - protein, 17 aa, Mycobacterium
SDGSAWYTTDHYGTFHR

SEQ ID NO: 730069 - protein, 22 aa, Mycobacterium
SDGSLLQYRPNLIIVTNIEADH

SEQ ID NO: 730070 - protein, 23 aa, Mycobacterium
SDGTIRFLLWAAALSSPRAPSLM

SEQ ID NO: 730071 - protein, 19 aa, Mycobacterium
SDGTLAWDSTTFVLVSVRA

SEQ ID NO: 730072 - protein, 23 aa, Mycobacterium
SDGTLRFLLWAAALLSPDPPPLM

SEQ ID NO: 730073 - protein, 23 aa, Mycobacterium
SDGVWDKGIGKTFHGGVGQDADG

SEQ ID NO: 730074 - protein, 18 aa, Mycobacterium
SDGYRVLVDRLWPRGVSK

SEQ ID NO: 730075 - protein, 18 aa, Mycobacterium
SDHGCANPAHKAEQARKP

SEQ ID NO: 730076 - protein, 21 aa, Mycobacterium
SDHLISTIVCWAESHPTIRPN

SEQ ID NO: 730077 - protein, 18 aa, Mycobacterium
SDHRGHEDVSAALAASAT

SEQ ID NO: 730078 - protein, 19 aa, Mycobacterium
SDHRRILATLSMADDDHTA

SEQ ID NO: 730079 - protein, 28 aa, Mycobacterium
SDHSRRLWTLLIFMLWHAIFVDHSVVPE

SEQ ID NO: 730080 - protein, 31 aa, Mycobacterium
SDHYFPWLSSQGHAPYAWSVLGAVAHATERV

SEQ ID NO: 730081 - protein, 19 aa, Mycobacterium
SDIAAALGRDSRAISAARA

SEQ ID NO: 730082 - protein, 20 aa, Mycobacterium
SDIAAGWWQAALDAYDRLPA

SEQ ID NO: 730083 - protein, 21 aa, Mycobacterium
SDIAEFARRFDVTVYDGFGST

SEQ ID NO: 730084 - protein, 29 aa, Mycobacterium
SDIARPMYIARGWLSWEGPTSVLTPTEGI

SEQ ID NO: 730085 - protein, 21 aa, Mycobacterium
SDICTCRPYLTHAIEECIQGA

SEQ ID NO: 730086 - protein, 19 aa, Mycobacterium
SDIDAVVSLCRVADGHIPL

SEQ ID NO: 730087 - protein, 20 aa, Mycobacterium
SDIDRAVAIARRMRTGQVSV

SEQ ID NO: 730088 - protein, 26 aa, Mycobacterium
SDIDRLEFLAAPGWTIIRVSHEHLRY

SEQ ID NO: 730089 - protein, 20 aa, Mycobacterium
SDIDRLTAVLGRVRDGVRFC

SEQ ID NO: 730090 - protein, 17 aa, Mycobacterium
SDIDVWAGPVTLDELAR

SEQ ID NO: 730091 - protein, 18 aa, Mycobacterium
SDIESAVVQVEFNTPNPQ

SEQ ID NO: 730092 - protein, 24 aa, Mycobacterium
SDIFDEFLELAAIRTKAVRQGDPL

SEQ ID NO: 730093 - protein, 22 aa, Mycobacterium
SDIGAADLLGAVTISAVHQPHG

SEQ ID NO: 730094 - protein, 21 aa, Mycobacterium
SDIGMIFQQFNLFRSRTVAGN

SEQ ID NO: 730095 - protein, 17 aa, Mycobacterium
SDILARIGGDEFCVMIT

SEQ ID NO: 730096 - protein, 24 aa, Mycobacterium
SDILCVPTMAVALVESAARRDYDL

SEQ ID NO: 730097 - protein, 18 aa, Mycobacterium
SDILDWITAERCRELDGP

SEQ ID NO: 730098 - protein, 21 aa, Mycobacterium
SDILLWPKLIDKYRATMTAAP

SEQ ID NO: 730099 - protein, 17 aa, Mycobacterium
SDIPRFVPTGSSSLRSA

SEQ ID NO: 730100 - protein, 18 aa, Mycobacterium
SDIRLDFKPVVQTRYEPK

SEQ ID NO: 730101 - protein, 20 aa, Mycobacterium
SDIRNLLPLFAVFKPTVVVS

SEQ ID NO: 730102 - protein, 25 aa, Mycobacterium
SDISGPKGQLFAYIRDVAAAWDGSD

SEQ ID NO: 730103 - protein, 17 aa, Mycobacterium
SDISKAVGLGFSEGAAG

SEQ ID NO: 730104 - protein, 21 aa, Mycobacterium
SDISKAVGLGFSQGGSENNYE

SEQ ID NO: 730105 - protein, 21 aa, Mycobacterium
SDISKAVGLGFTQGGGENNYE

SEQ ID NO: 730106 - protein, 17 aa, Mycobacterium
SDISKPVGLGFTKGGGE

SEQ ID NO: 730107 - protein, 17 aa, Mycobacterium
SDKDSLQLLGWTEATAT

SEQ ID NO: 730108 - protein, 23 aa, Mycobacterium
SDKELRDAILLLIFGGFDTTRNQ

SEQ ID NO: 730109 - protein, 22 aa, Mycobacterium
SDKGLRVIGAAGRQQGVSYAWG

SEQ ID NO: 730110 - protein, 25 aa, Mycobacterium
SDKPDLRFGIELVECTEYFKDTTFR

SEQ ID NO: 730111 - protein, 21 aa, Mycobacterium
SDKPNTRWSRRYAEQPEILQY

SEQ ID NO: 730112 - protein, 21 aa, Mycobacterium
SDKPRSAQWAFETKQIHAGQS

SEQ ID NO: 730113 - protein, 25 aa, Mycobacterium
SDKVARFLLGLGAKYGPERLLAGSE

SEQ ID NO: 730114 - protein, 21 aa, Mycobacterium
SDLAAAARCEFAFLRHFDSKL

SEQ ID NO: 730115 - protein, 18 aa, Mycobacterium
SDLAAGWLAVTRDPRPLL

SEQ ID NO: 730116 - protein, 25 aa, Mycobacterium
SDLAAKRRSWAVLGEMAELGADAIA

SEQ ID NO: 730117 - protein, 26 aa, Mycobacterium
SDLAARLKAAWAPTGLVQRSQGKWYP

SEQ ID NO: 730118 - protein, 21 aa, Mycobacterium
SDLAFAAGVYVMMEPRRFASA

SEQ ID NO: 730119 - protein, 21 aa, Mycobacterium
SDLALAGGCAVLLEPHASVAA

SEQ ID NO: 730120 - protein, 23 aa, Mycobacterium
SDLALAGGCMVMLEPRIGASASA

SEQ ID NO: 730121 - protein, 24 aa, Mycobacterium
SDLANRPAFRAALIRTADNRHRFV

SEQ ID NO: 730122 - protein, 24 aa, Mycobacterium
SDLANRPAFRAALIRTADNRYRFV

SEQ ID NO: 730123 - protein, 26 aa, Mycobacterium
SDLARFAGDLLRPALVSQQMHDEATS

SEQ ID NO: 730124 - protein, 19 aa, Mycobacterium
SDLAVRWNCKAGKCGSCSA

SEQ ID NO: 730125 - protein, 17 aa, Mycobacterium
SDLCTRVTPYFELPRYP

SEQ ID NO: 730126 - protein, 18 aa, Mycobacterium
SDLDAAPGNARFSSAELT

SEQ ID NO: 730127 - protein, 19 aa, Mycobacterium
SDLDFSVTLERIVTAAREL

SEQ ID NO: 730128 - protein, 26 aa, Mycobacterium
SDLDLGVTLHRIVKGAMELTGSRYAA

SEQ ID NO: 730129 - protein, 22 aa, Mycobacterium
SDLEAAVQMLGVFIGGTETVPK

SEQ ID NO: 730130 - protein, 26 aa, Mycobacterium
SDLEHWRWMWETNVMGTLRVTRALLP

SEQ ID NO: 730131 - protein, 17 aa, Mycobacterium
SDLFVRYLRPVRQGSAF

SEQ ID NO: 730132 - protein, 19 aa, Mycobacterium
SDLGDWLVMHEGWRSDLPD

SEQ ID NO: 730133 - protein, 17 aa, Mycobacterium
SDLGGSLVLSEFTGAAA

SEQ ID NO: 730134 - protein, 19 aa, Mycobacterium
SDLGLRFLHMIDKTRYPAG

SEQ ID NO: 730135 - protein, 19 aa, Mycobacterium
SDLGLTIAWNGCIYNYEEL

SEQ ID NO: 730136 - protein, 17 aa, Mycobacterium
SDLGVAEHVVFTRGIPA

SEQ ID NO: 730137 - protein, 18 aa, Mycobacterium
SDLHLYEVLGAFMNEGDI

SEQ ID NO: 730138 - protein, 19 aa, Mycobacterium
SDLHLYEVLGAFMSEGDVL

SEQ ID NO: 730139 - protein, 25 aa, Mycobacterium
SDLHVAELYDPFSIVTLVLLDEYRL

SEQ ID NO: 730140 - protein, 20 aa, Mycobacterium
SDLIAWHWVGPSSAAMAAAA

SEQ ID NO: 730141 - protein, 18 aa, Mycobacterium
SDLIETWISYKRENEIEP

SEQ ID NO: 730142 - protein, 18 aa, Mycobacterium
SDLIPWIEAHGDSHPDLI

SEQ ID NO: 730143 - protein, 17 aa, Mycobacterium
SDLKRELAEAAGVLNAD

SEQ ID NO: 730144 - protein, 24 aa, Mycobacterium
SDLLLDWLTAHYGRGYVAARSALG

SEQ ID NO: 730145 - protein, 18 aa, Mycobacterium
SDLLRPVINVPRHPLRLA

SEQ ID NO: 730146 - protein, 36 aa, Mycobacterium
SDLLVAECLRTGAWADLKPAELAAVVSAVLYETRGG

SEQ ID NO: 730147 - protein, 31 aa, Mycobacterium
SDLLVAECLRTGAWAGLKPPELAAVVSAVLY

SEQ ID NO: 730148 - protein, 31 aa, Mycobacterium
SDLLVAECLRTGAWAGLKPPELAAVVSCVLY

SEQ ID NO: 730149 - protein, 31 aa, Mycobacterium; identical to SEQ ID NO: 91585

SEQ ID NO: 730150 - protein, 21 aa, Mycobacterium
SDLLVIFGITGDLARKMTFRA

SEQ ID NO: 730151 - protein, 19 aa, Mycobacterium
SDLNNVRYLSGFTGSNGAL

SEQ ID NO: 730152 - protein, 23 aa, Mycobacterium
SDLNPTWIWHALYGLILQGCEQA

SEQ ID NO: 730153 - protein, 18 aa, Mycobacterium
SDLPAFRGAKGRIPGDDG

SEQ ID NO: 730154 - protein, 25 aa, Mycobacterium
SDLPELRCLMLTSFTSDEAMLEAIL

SEQ ID NO: 730155 - protein, 25 aa, Mycobacterium
SDLPLCALLAGWVRGQVRPAATAKI

SEQ ID NO: 730156 - protein, 18 aa, Mycobacterium
SDLPLVVNQFSAFIRGEG

SEQ ID NO: 730157 - protein, 17 aa, Mycobacterium
SDLPWQVTSRGIGSRRT

SEQ ID NO: 730158 - protein, 17 aa, Mycobacterium
SDLQGSASYRSRVGAAM

SEQ ID NO: 730159 - protein, 19 aa, Mycobacterium
SDLQIALGHIDEVKPSLVV

SEQ ID NO: 730160 - protein, 20 aa, Mycobacterium
SDLRFLKFLRESIFPGGEVP

SEQ ID NO: 730161 - protein, 33 aa, Mycobacterium
SDLRFRFADQYAELRKAKGVTVEHAREIMRDAT

SEQ ID NO: 730162 - protein, 20 aa, Mycobacterium
SDLRQSGSVPPAMSSAPAAP

SEQ ID NO: 730163 - protein, 19 aa, Mycobacterium
SDLRRVLNYGHSFGHALEA

SEQ ID NO: 730164 - protein, 22 aa, Mycobacterium
SDLRWTERIVMYGFDRSGDINV

SEQ ID NO: 730165 - protein, 17 aa, Mycobacterium
SDLSFRYLFGLFGLFGE

SEQ ID NO: 730166 - protein, 17 aa, Mycobacterium
SDLSGKRVCVARGTTSL

SEQ ID NO: 730167 - protein, 23 aa, Mycobacterium
SDLSLAKSHSWWDPTSECTIVVA

SEQ ID NO: 730168 - protein, 41 aa, Mycobacterium
SDLSNIKLLGPVGDLLPILRIPGDTAFNVANVIRTPTDTTV

SEQ ID NO: 730169 - protein, 25 aa, Mycobacterium
SDLTFASGWIEFRSAGYSGVTDEIR

SEQ ID NO: 730170 - protein, 18 aa, Mycobacterium
SDLTNIGSTLGAANSAAL

SEQ ID NO: 730171 - protein, 22 aa, Mycobacterium
SDLVGLLCLRPAKTGGESKIVS

SEQ ID NO: 730172 - protein, 19 aa, Mycobacterium
SDLVPAGCEVHLLAAHSGA

SEQ ID NO: 730173 - protein, 19 aa, Mycobacterium
SDMARHYIGGILHHAPSLL

SEQ ID NO: 730174 - protein, 22 aa, Mycobacterium
SDMFQRRVYFLADLPFVEVYLA

SEQ ID NO: 730175 - protein, 17 aa, Mycobacterium
SDMGPLVTRAHRDKVAS

SEQ ID NO: 730176 - protein, 25 aa, Mycobacterium
SDMKFTRFIYKEIFPGGQLPSDDDM

SEQ ID NO: 730177 - protein, 20 aa, Mycobacterium
SDMKGGLAAALAAMAALRGA

SEQ ID NO: 730178 - protein, 21 aa, Mycobacterium
SDMLASLRRWTGGSIPDTEIP

SEQ ID NO: 730179 - protein, 24 aa, Mycobacterium
SDMPEVAMPLVFRLLGETGSHASV

SEQ ID NO: 730180 - protein, 19 aa, Mycobacterium
SDMVLRLAAGLERRTAHDG

SEQ ID NO: 730181 - protein, 19 aa, Mycobacterium
SDMVLRLAAGLERRVAHNG

SEQ ID NO: 730182 - protein, 24 aa, Mycobacterium
SDNEIAEIILLTGHYVMTALFLKT

SEQ ID NO: 730183 - protein, 18 aa, Mycobacterium
SDNPPPLMPLYLRRPDAK

SEQ ID NO: 730184 - protein, 19 aa, Mycobacterium
SDNRPLLQKAVGYVQNTLQ

SEQ ID NO: 730185 - protein, 17 aa, Mycobacterium
SDNRWPHFGGRVARMAV

SEQ ID NO: 730186 - protein, 19 aa, Mycobacterium
SDPAGLAGWWAEQFGGTTQ

SEQ ID NO: 730187 - protein, 35 aa, Mycobacterium
SDPALPLGWADVWMGCQFPSKIVADYADRLTKVVA

SEQ ID NO: 730188 - protein, 19 aa, Mycobacterium
SDPARLAIVRELANGPLAM

SEQ ID NO: 730189 - protein, 19 aa, Mycobacterium
SDPARPVFFDMCPPNRMIG

SEQ ID NO: 730190 - protein, 21 aa, Mycobacterium
SDPATSVANEWGELHDTPGVF

SEQ ID NO: 730191 - protein, 18 aa, Mycobacterium
SDPAWPGLVAAIGAADPR

SEQ ID NO: 730192 - protein, 19 aa, Mycobacterium
SDPDEFLRDRCREVPFLPG

SEQ ID NO: 730193 - protein, 25 aa, Mycobacterium
SDPDFVPRVTAILGDLRQLEAVASR

SEQ ID NO: 730194 - protein, 19 aa, Mycobacterium
SDPDLAFRQLIMEAGSDIA

SEQ ID NO: 730195 - protein, 24 aa, Mycobacterium
SDPEIGLLLPCNVVVRADTTHGND

SEQ ID NO: 730196 - protein, 21 aa, Mycobacterium
SDPEVPPALRRLVLEGQAGVQ

SEQ ID NO: 730197 - protein, 21 aa, Mycobacterium
SDPFAAFGMSGDFGMGDLGQI

SEQ ID NO: 730198 - protein, 18 aa, Mycobacterium
SDPFRGRFDQGWDVLREE

SEQ ID NO: 730199 - protein, 25 aa, Mycobacterium
SDPFRRPGWDELTAVIADLPRLPGG

SEQ ID NO: 730200 - protein, 28 aa, Mycobacterium
SDPHVLREWFGQLVMHSMALTLSGNYTD

SEQ ID NO: 730201 - protein, 17 aa, Mycobacterium
SDPHWGRRVHAVVQAAA

SEQ ID NO: 730202 - protein, 18 aa, Mycobacterium
SDPIPIKSLFTGASSTSA

SEQ ID NO: 730203 - protein, 26 aa, Mycobacterium
SDPLMSRLGMMGGPAMGALGSLPGAL

SEQ ID NO: 730204 - protein, 23 aa, Mycobacterium
SDPLRKSILFALGDAYAQRLAGA

SEQ ID NO: 730205 - protein, 18 aa, Mycobacterium
SDPPRKWWQPGPGEGYIG

SEQ ID NO: 730206 - protein, 22 aa, Mycobacterium
SDPQEWGAIVAKHIDECPPCLV

SEQ ID NO: 730207 - protein, 20 aa, Mycobacterium
SDPRHGSGILSGVYLTLISP

SEQ ID NO: 730208 - protein, 17 aa, Mycobacterium
SDPRILRTGPISAEDVA

SEQ ID NO: 730209 - protein, 26 aa, Mycobacterium
SDPRIRDRLAWCYSRTQIMRYRGYRS

SEQ ID NO: 730210 - protein, 27 aa, Mycobacterium
SDPRLPALLRWRQQLISSGAVSPHTFK

SEQ ID NO: 730211 - protein, 18 aa, Mycobacterium
SDPSFVLNLSPFDRGSVL

SEQ ID NO: 730212 - protein, 18 aa, Mycobacterium
SDPSWFGFPITLDPAHPV

SEQ ID NO: 730213 - protein, 19 aa, Mycobacterium
SDPSYRQDPAIKPFKNIGE

SEQ ID NO: 730214 - protein, 22 aa, Mycobacterium
SDPTAALAFLRRLHDETSRIDG

SEQ ID NO: 730215 - protein, 19 aa, Mycobacterium
SDPVRRWKLSPMDLESVYR

SEQ ID NO: 730216 - protein, 20 aa, Mycobacterium
SDPWPAAGDFFAVRAGSLIA

SEQ ID NO: 730217 - protein, 17 aa, Mycobacterium
SDQAKWVTGQIFNVDGG

SEQ ID NO: 730218 - protein, 17 aa, Mycobacterium
SDQARWITGQIFNVDGG

SEQ ID NO: 730219 - protein, 28 aa, Mycobacterium
SDQEVRWCPGCGDYVILNTIRNFLPELG

SEQ ID NO: 730220 - protein, 25 aa, Mycobacterium
SDQLPCRTTVFVGLPHEVMLVEIDA

SEQ ID NO: 730221 - protein, 20 aa, Mycobacterium
SDQLVDEWLSVTGLDAQTPV

SEQ ID NO: 730222 - protein, 18 aa, Mycobacterium
SDQPLAIVTCYLPADLPH

SEQ ID NO: 730223 - protein, 24 aa, Mycobacterium
SDQPRPLVPAMFSGVLSRLRRTHT

SEQ ID NO: 730224 - protein, 21 aa, Mycobacterium
SDQQVRLCIKRLVAEGRFTQE

SEQ ID NO: 730225 - protein, 25 aa, Mycobacterium
SDQQWPVRVAALAEYRGRGLDFDRV

SEQ ID NO: 730226 - protein, 17 aa, Mycobacterium
SDQTVGFTRRMQTYEAL

SEQ ID NO: 730227 - protein, 25 aa, Mycobacterium
SDRAGIVEAIEWCRGLVDGPLIAGG

SEQ ID NO: 730228 - protein, 21 aa, Mycobacterium
SDRALDCLAVTYAGLALLRLL

SEQ ID NO: 730229 - protein, 27 aa, Mycobacterium
SDRAQRTGDEFVPFDAAADYRKYVDGK

SEQ ID NO: 730230 - protein, 18 aa, Mycobacterium
SDRARFSPFQKLIILDVP

SEQ ID NO: 730231 - protein, 18 aa, Mycobacterium
SDRDFKAAGAEIVNTADQ

SEQ ID NO: 730232 - protein, 29 aa, Mycobacterium
SDREACDRLAFDLRWKAAAGLTVGAGAFH

SEQ ID NO: 730233 - protein, 17 aa, Mycobacterium
SDRELADLAQLVVTINL

SEQ ID NO: 730234 - protein, 24 aa, Mycobacterium
SDRELRGILGKEIGFVFQDPQSNL

SEQ ID NO: 730235 - protein, 20 aa, Mycobacterium
SDREVDEFVSAISDAGVQLT

SEQ ID NO: 730236 - protein, 17 aa, Mycobacterium
SDRFYTVDFTPQVYTPE

SEQ ID NO: 730237 - protein, 39 aa, Mycobacterium
SDRGAVSCYWDYSPSFGRGPFRNVICLSVNDAVLHGLPH

SEQ ID NO: 730238 - protein, 20 aa, Mycobacterium
SDRGLPMLCLGERGWQEGWF

SEQ ID NO: 730239 - protein, 17 aa, Mycobacterium
SDRGWQYRLSAGLTAPQ

SEQ ID NO: 730240 - protein, 25 aa, Mycobacterium
SDRHPRPAPRPSYTVLSSQRSAQAG

SEQ ID NO: 730241 - protein, 20 aa, Mycobacterium
SDRIPKWLLPVVRDNLRSTG

SEQ ID NO: 730242 - protein, 20 aa, Mycobacterium
SDRLDALIFGVGDFSLSQGA

SEQ ID NO: 730243 - protein, 28 aa, Mycobacterium
SDRLGLPALARIVSWASVGVDPAATGLA

SEQ ID NO: 730244 - protein, 28 aa, Mycobacterium
SDRLGRFCRDLARLCGKGMVLPMNTGAE

SEQ ID NO: 730245 - protein, 25 aa, Mycobacterium
SDRLTLRSLGPWGRRHGVSTVMISH

SEQ ID NO: 730246 - protein, 17 aa, Mycobacterium
SDRMAGSYCGKLLVDAG

SEQ ID NO: 730247 - protein, 20 aa, Mycobacterium
SDRPNLRFRVTECANDRERV

SEQ ID NO: 730248 - protein, 21 aa, Mycobacterium
SDRQLLLGAVGEWITRPTQQA

SEQ ID NO: 730249 - protein, 26 aa, Mycobacterium
SDRQRRGVVHIVDLSTAAVVGAIQIG

SEQ ID NO: 730250 - protein, 19 aa, Mycobacterium
SDRRLPFVADPIVDGAKVP

SEQ ID NO: 730251 - protein, 23 aa, Mycobacterium
SDRRQEISDGLAYTNAAAGSIAD

SEQ ID NO: 730252 - protein, 20 aa, Mycobacterium
SDRRSHVVLMGRPWGQVSSS

SEQ ID NO: 730253 - protein, 22 aa, Mycobacterium
SDRVFDALIAWGDEDAVRSRVQ

SEQ ID NO: 730254 - protein, 26 aa, Mycobacterium
SDRVGLRIVVVLKRDAVAKVVLNNLY

SEQ ID NO: 730255 - protein, 24 aa, Mycobacterium
SDRVWRLTHGNVLFMRQVVEQETR

SEQ ID NO: 730256 - protein, 26 aa, Mycobacterium
SDRYWRRYFVNFTEVMAPATQVGARE

SEQ ID NO: 730257 - protein, 20 aa, Mycobacterium
SDSALPPFLTPGLTGPGLVD

SEQ ID NO: 730258 - protein, 26 aa, Mycobacterium
SDSARLAALIGEHARLAEAIERRDVE

SEQ ID NO: 730259 - protein, 34 aa, Mycobacterium
SDSDCAPQWPAAEFASRLGVEPVYVPGTHLSMLT

SEQ ID NO: 730260 - protein, 20 aa, Mycobacterium
SDSELLDFTVLARVFGYPST

SEQ ID NO: 730261 - protein, 18 aa, Mycobacterium
SDSEWDREKLGERLAKLA

SEQ ID NO: 730262 - protein, 24 aa, Mycobacterium
SDSGRIPLQLKAMAEFADHMQKMA

SEQ ID NO: 730263 - protein, 17 aa, Mycobacterium
SDSIKRKDPSGVTHANI

SEQ ID NO: 730264 - protein, 21 aa, Mycobacterium
SDSILGWPAMVRVSNKEFVTN

SEQ ID NO: 730265 - protein, 21 aa, Mycobacterium
SDSLMDLGLGDLYSERAVAAG

SEQ ID NO: 730266 - protein, 17 aa, Mycobacterium
SDSLTAEARPSCVTQSA

SEQ ID NO: 730267 - protein, 26 aa, Mycobacterium
SDSPLAGTVRFEWNPLRWFEEDEPVY

SEQ ID NO: 730268 - protein, 21 aa, Mycobacterium
SDSRLVICGDTGLGHLAAATG

SEQ ID NO: 730269 - protein, 22 aa, Mycobacterium
SDSRWPKYQADALAYTPVRSVL

SEQ ID NO: 730270 - protein, 17 aa, Mycobacterium
SDSVEKLARDHGIPVHI

SEQ ID NO: 730271 - protein, 19 aa, Mycobacterium
SDSVFAFLAAHRSQLFPGE

SEQ ID NO: 730272 - protein, 25 aa, Mycobacterium
SDSVSCPRSGETIVRDGAHWYSTGC

SEQ ID NO: 730273 - protein, 19 aa, Mycobacterium
SDTAEFGGYLSGPRVIDAS

SEQ ID NO: 730274 - protein, 24 aa, Mycobacterium
SDTELDGGPSWHEGPPTNMFNGVP

SEQ ID NO: 730275 - protein, 22 aa, Mycobacterium
SDTEVRAMWNLPRPPRPESNGG

SEQ ID NO: 730276 - protein, 23 aa, Mycobacterium
SDTFPLAPIQHAMWVGRNDDQQL

SEQ ID NO: 730277 - protein, 24 aa, Mycobacterium
SDTGGKISSAFGVKRGLLGKLAPV

SEQ ID NO: 730278 - protein, 19 aa, Mycobacterium
SDTGSYDFDGDQDFAETEQ

SEQ ID NO: 730279 - protein, 25 aa, Mycobacterium
SDTHAKAKWYVRVIVSLLAHPEDSE

SEQ ID NO: 730280 - protein, 18 aa, Mycobacterium
SDTLAWIAAEMGRRRTVL

SEQ ID NO: 730281 - protein, 25 aa, Mycobacterium
SDTLEFFEVPGAFEIPLTAKRLAKT

SEQ ID NO: 730282 - protein, 22 aa, Mycobacterium
SDTLLMTGFGFAPPVATPSWGI

SEQ ID NO: 730283 - protein, 17 aa, Mycobacterium
SDTPAKSGQGWIYSITP

SEQ ID NO: 730284 - protein, 19 aa, Mycobacterium
SDTPAWKIAEANLLARFRG

SEQ ID NO: 730285 - protein, 18 aa, Mycobacterium
SDTPIIVFSHIPLFAMYP

SEQ ID NO: 730286 - protein, 22 aa, Mycobacterium
SDTRLRGLLALIRSDPRVQAFA

SEQ ID NO: 730287 - protein, 24 aa, Mycobacterium
SDTTVRVPWNLPRRESSRRAGSSS

SEQ ID NO: 730288 - protein, 21 aa, Mycobacterium
SDTVFVRCHVRAVARATGTEI

SEQ ID NO: 730289 - protein, 18 aa, Mycobacterium
SDTWRVALVTSSSNIGSS

SEQ ID NO: 730290 - protein, 19 aa, Mycobacterium
SDVAALWRRAVALVGGPQV

SEQ ID NO: 730291 - protein, 24 aa, Mycobacterium
SDVAAWPATLGRLLAVGGPDAIYV

SEQ ID NO: 730292 - protein, 17 aa, Mycobacterium
SDVAGSAGHAWRTVDDR

SEQ ID NO: 730293 - protein, 17 aa, Mycobacterium
SDVALHVLGAVGLITLG

SEQ ID NO: 730294 - protein, 19 aa, Mycobacterium
SDVAPLEMTKWFDTNYHYI

SEQ ID NO: 730295 - protein, 21 aa, Mycobacterium
SDVDAALHYLARMLTAGEDPR

SEQ ID NO: 730296 - protein, 20 aa, Mycobacterium
SDVDRAVGIARRMRTGQVAV

SEQ ID NO: 730297 - protein, 24 aa, Mycobacterium
SDVEELYRLGCREFGESRDQEAAA

SEQ ID NO: 730298 - protein, 22 aa, Mycobacterium
SDVELAQGFLLTEGIVRRREDI

SEQ ID NO: 730299 - protein, 18 aa, Mycobacterium
SDVELLSKIVRYHLLLPN

SEQ ID NO: 730300 - protein, 20 aa, Mycobacterium
SDVFWPAVVFTLVTLLDDPG

SEQ ID NO: 730301 - protein, 18 aa, Mycobacterium
SDVGMVFQSFNLFAHKTI

SEQ ID NO: 730302 - protein, 23 aa, Mycobacterium
SDVGRFDAFITYLALIHAVESAA

SEQ ID NO: 730303 - protein, 19 aa, Mycobacterium
SDVGYRWFAATGQDPMFAF

SEQ ID NO: 730304 - protein, 18 aa, Mycobacterium
SDVIPRMLAERGPDDPIR

SEQ ID NO: 730305 - protein, 24 aa, Mycobacterium
SDVIRGRYPPGYRLVERDVADAYG

SEQ ID NO: 730306 - protein, 19 aa, Mycobacterium
SDVIRLARHAHHYLAVFDR

SEQ ID NO: 730307 - protein, 19 aa, Mycobacterium
SDVLIEPRIDLWGRVLRRQ

SEQ ID NO: 730308 - protein, 30 aa, Mycobacterium
SDVLLAPTLREAWAVIAPMLAGATPVGPGV

SEQ ID NO: 730309 - protein, 20 aa, Mycobacterium
SDVLLPRRGTLVAWTTQGFP

SEQ ID NO: 730310 - protein, 17 aa, Mycobacterium
SDVMMWQAFTERGIPGA

SEQ ID NO: 730311 - protein, 20 aa, Mycobacterium
SDVNAVFGILTVHRTYPDLT

SEQ ID NO: 730312 - protein, 21 aa, Mycobacterium
SDVPFHVVVPLLREGFGVAGL

SEQ ID NO: 730313 - protein, 20 aa, Mycobacterium
SDVPHIKALVDIYAGRILLE

SEQ ID NO: 730314 - protein, 17 aa, Mycobacterium
SDVPWNSPDCEWKDRRS

SEQ ID NO: 730315 - protein, 18 aa, Mycobacterium
SDVRACAATAAIVPVLTA

SEQ ID NO: 730316 - protein, 17 aa, Mycobacterium
SDVRLRGLITLMSDDPR

SEQ ID NO: 730317 - protein, 17 aa, Mycobacterium
SDVTLWEINEAFASVPI

SEQ ID NO: 730318 - protein, 25 aa, Mycobacterium
SDVTRAIAILEHWNDNWLEKQWLGC

SEQ ID NO: 730319 - protein, 24 aa, Mycobacterium
SDVVCGWATVALHRFYQARERAGL

SEQ ID NO: 730320 - protein, 24 aa, Mycobacterium
SDVYLTWGEPLGAVGDKLDWIGGL

SEQ ID NO: 730321 - protein, 17 aa, Mycobacterium
SDWCRFNSAGSLFIDPG

SEQ ID NO: 730322 - protein, 23 aa, Mycobacterium
SDWDLGVYYRGSFDAALLARLGY

SEQ ID NO: 730323 - protein, 21 aa, Mycobacterium
SDWEGTLAINLWGVIHGCQVF

SEQ ID NO: 730324 - protein, 26 aa, Mycobacterium
SDWGATPSWECALGGLDQECGAQLDA

SEQ ID NO: 730325 - protein, 24 aa, Mycobacterium
SDWLPQQRWYAGRNRELTTAEAAV

SEQ ID NO: 730326 - protein, 19 aa, Mycobacterium
SDWNARNLFTGWVDVGLTE

SEQ ID NO: 730327 - protein, 29 aa, Mycobacterium
SDWPGGARVRPILRSGCYLAHDHGLYART

SEQ ID NO: 730328 - protein, 25 aa, Mycobacterium
SDWREQRGSLAIARVDTAGTAPAPL

SEQ ID NO: 730329 - protein, 25 aa, Mycobacterium
SDWRVSHFPRAWVAVVTTDGRSGVG

SEQ ID NO: 730330 - protein, 18 aa, Mycobacterium
SDWYQPLSRRYESTDAGD

SEQ ID NO: 730331 - protein, 22 aa, Mycobacterium
SDYAAGCPIVAAALGRTESPSA

SEQ ID NO: 730332 - protein, 26 aa, Mycobacterium
SDYAQRRFGVGIAVRAGVHRGLVYSD

SEQ ID NO: 730333 - protein, 26 aa, Mycobacterium
SDYGDWPRSVGLSIWGTSAMRTSGDD

SEQ ID NO: 730334 - protein, 25 aa, Mycobacterium
SDYILDWASPVPFFGDVDQAQVATV

SEQ ID NO: 730335 - protein, 18 aa, Mycobacterium
SDYKGVTVKGAISVVDDT

SEQ ID NO: 730336 - protein, 20 aa, Mycobacterium
SDYLPGHVFFVQGALDGPGD

SEQ ID NO: 730337 - protein, 22 aa, Mycobacterium
SDYMRMWVQAAITMTGYQAVSQ

SEQ ID NO: 730338 - protein, 21 aa, Mycobacterium
SDYRTRWEIPIGLRESDMEVA

SEQ ID NO: 730339 - protein, 21 aa, Mycobacterium
SDYRTRWEIPIGLRETDLSVA

SEQ ID NO: 730340 - protein, 18 aa, Mycobacterium
SDYWPDHVDDEWTQEKLE

SEQ ID NO: 730341 - protein, 20 aa, Mycobacterium
SEAAALKCLYMVTRSLDPKG

SEQ ID NO: 730342 - protein, 19 aa, Mycobacterium
SEAADLFGRVEAIPHEHVV

SEQ ID NO: 730343 - protein, 25 aa, Mycobacterium
SEAAKARFPQINWEITPGNSSPLSD

SEQ ID NO: 730344 - protein, 37 aa, Mycobacterium
SEAALVPSLERILRALGLIGWKWTPNGDGIVLSGALG

SEQ ID NO: 730345 - protein, 26 aa, Mycobacterium
SEAARICSSLGLPERILVQPLRTLSG

SEQ ID NO: 730346 - protein, 19 aa, Mycobacterium
SEAATWFRCHGWDSERTEL

SEQ ID NO: 730347 - protein, 20 aa, Mycobacterium
SEAAVRCHALLVQNEDQLEA

SEQ ID NO: 730348 - protein, 19 aa, Mycobacterium
SEAAYARHAGLAPVPHSSG

SEQ ID NO: 730349 - protein, 22 aa, Mycobacterium
SEACTNCIEHAYRGQSVGTMLL

SEQ ID NO: 730350 - protein, 21 aa, Mycobacterium
SEADARLMAHGTFGLLNSTAH

SEQ ID NO: 730351 - protein, 21 aa, Mycobacterium
SEADKAFYWSGRDVSGVGVGP

SEQ ID NO: 730352 - protein, 21 aa, Mycobacterium
SEADLHGLGPFLLQVGTHEML

SEQ ID NO: 730353 - protein, 17 aa, Mycobacterium
SEAEAFAAAPGTDRTAR

SEQ ID NO: 730354 - protein, 25 aa, Mycobacterium
SEAEPWLRRAGARAAANGWELASAR

SEQ ID NO: 730355 - protein, 23 aa, Mycobacterium
SEAEPWLRRAGARAQARGWELAF

SEQ ID NO: 730356 - protein, 19 aa, Mycobacterium
SEAEQRLALEDGAHTIVAA

SEQ ID NO: 730357 - protein, 17 aa, Mycobacterium
SEAETENIIGFCRANKL

SEQ ID NO: 730358 - protein, 19 aa, Mycobacterium
SEAFGRLANSLGIKSIRVW

SEQ ID NO: 730359 - protein, 24 aa, Mycobacterium
SEAGDLALRLAMAATGRRDVVAVG

SEQ ID NO: 730360 - protein, 24 aa, Mycobacterium
SEAGKRFVGTVLRNTPSGEDIARI

SEQ ID NO: 730361 - protein, 20 aa, Mycobacterium
SEAGLYLWATRDEPCEDSVA

SEQ ID NO: 730362 - protein, 21 aa, Mycobacterium
SEAGMSWYEVSNWSRPGGECR

SEQ ID NO: 730363 - protein, 19 aa, Mycobacterium
SEAGRELFGRLLANADVFL

SEQ ID NO: 730364 - protein, 25 aa, Mycobacterium
SEAGRICASLGLPDRVLTQPLRTLS

SEQ ID NO: 730365 - protein, 26 aa, Mycobacterium
SEAGRICASLGLPERVLTQPLHTLSG

SEQ ID NO: 730366 - protein, 26 aa, Mycobacterium
SEAGRICASLGLPERVLTQQLRTLSG

SEQ ID NO: 730367 - protein, 18 aa, Mycobacterium
SEAHASIQDGIRLSGASS

SEQ ID NO: 730368 - protein, 25 aa, Mycobacterium
SEAHRSWPRIDLERFAEARRYNAIR

SEQ ID NO: 730369 - protein, 17 aa, Mycobacterium
SEAHVPVAVLTRPDGTM

SEQ ID NO: 730370 - protein, 30 aa, Mycobacterium
SEAIIARMLAVMLRRRMAAAGMDASGAEPW

SEQ ID NO: 730371 - protein, 27 aa, Mycobacterium
SEAIPSLMIRSGLAWANLADAHGSTPP

SEQ ID NO: 730372 - protein, 33 aa, Mycobacterium; identical to SEQ ID NO: 91593

SEQ ID NO: 730373 - protein, 29 aa, Mycobacterium
SEAISGMNAVGGWRGAPRPVQARELLPER

SEQ ID NO: 730374 - protein, 28 aa, Mycobacterium
SEAITRNFFKLIAYKDEYEVARMLTDPV

SEQ ID NO: 730375 - protein, 20 aa, Mycobacterium
SEALAVVGIGYVHHRALGNP

SEQ ID NO: 730376 - protein, 18 aa, Mycobacterium
SEALGAAAIVVGGSGGGL

SEQ ID NO: 730377 - protein, 25 aa, Mycobacterium
SEALHAWYTSARGLVTTALKDPHTV

SEQ ID NO: 730378 - protein, 21 aa, Mycobacterium
SEALLLRWYCRYGGELRRYRV

SEQ ID NO: 730379 - protein, 18 aa, Mycobacterium
SEALPKIQLWPIDANGEY

SEQ ID NO: 730380 - protein, 25 aa, Mycobacterium
SEALRASGLAAGIVDAGLSRGLAGI

SEQ ID NO: 730381 - protein, 18 aa, Mycobacterium
SEALVGWADSVGVDGSDP

SEQ ID NO: 730382 - protein, 27 aa, Mycobacterium
SEAMANSIWPYVAWLRATAAATEQSAS

SEQ ID NO: 730383 - protein, 21 aa, Mycobacterium
SEAMMPFPPADRARLYDLGER

SEQ ID NO: 730384 - protein, 30 aa, Mycobacterium
SEAPAEMHFYFPRFRALCMAENATHNLHNL

SEQ ID NO: 730385 - protein, 37 aa, Mycobacterium
SEAPFYRPAGDEVEVFRAAARRGLPVLLKGPTGCGKT

SEQ ID NO: 730386 - protein, 20 aa, Mycobacterium
SEAPGYVHVPWDAVDTWVEE

SEQ ID NO: 730387 - protein, 18 aa, Mycobacterium
SEAPHLPGAVSLEDALAQ

SEQ ID NO: 730388 - protein, 22 aa, Mycobacterium
SEAPRGLLYHRYRIDDAGLVSA

SEQ ID NO: 730389 - protein, 22 aa, Mycobacterium
SEAPRGLLYHRYRIDEQGLVSD

SEQ ID NO: 730390 - protein, 24 aa, Mycobacterium
SEAQRWPSVPGRYFTVRAGSLVAW

SEQ ID NO: 730391 - protein, 17 aa, Mycobacterium
SEAQVAAPVLINLQYNP

SEQ ID NO: 730392 - protein, 21 aa, Mycobacterium
SEAREGGALVIVDLPRLAPAG

SEQ ID NO: 730393 - protein, 30 aa, Mycobacterium
SEARGFPPYHPRLMLKLLLYGYTSGVRSSR

SEQ ID NO: 730394 - protein, 32 aa, Mycobacterium
SEARGRARIEFKLRDWLFARQRYWGEPFPIVY

SEQ ID NO: 730395 - protein, 22 aa, Mycobacterium
SEARHAAFWIVMAVTNTEVSPY

SEQ ID NO: 730396 - protein, 17 aa, Mycobacterium
SEARPLLDELIRRSDVF

SEQ ID NO: 730397 - protein, 33 aa, Mycobacterium
SEARVWTFLGPRPAGWWIRRRANEVAVHRADAA

SEQ ID NO: 730398 - protein, 25 aa, Mycobacterium
SEASRICASLGLPDRVLTQKLRTLS

SEQ ID NO: 730399 - protein, 22 aa, Mycobacterium
SEASYFGPSFMINWLHNNYGGY

SEQ ID NO: 730400 - protein, 22 aa, Mycobacterium
SEASYFGPSFMINWLHNSYGGY

SEQ ID NO: 730401 - protein, 21 aa, Mycobacterium
SEATICRLLRDLADSGATVLI

SEQ ID NO: 730402 - protein, 21 aa, Mycobacterium
SEATRFFPMLTTAAGTVKPAT

SEQ ID NO: 730403 - protein, 17 aa, Mycobacterium
SEATWAGTSARAANARV

SEQ ID NO: 730404 - protein, 18 aa, Mycobacterium
SEAVEALAKFIVAGIDRL

SEQ ID NO: 730405 - protein, 19 aa, Mycobacterium
SEAVLRLSFDRLTKVSRRR

SEQ ID NO: 730406 - protein, 25 aa, Mycobacterium
SEAVMLAGLALKWRWRTKIGGTDGT

SEQ ID NO: 730407 - protein, 26 aa, Mycobacterium
SEAVMLAGLAMKWRWRAKAGDWKGRT

SEQ ID NO: 730408 - protein, 27 aa, Mycobacterium
SEAVMLAGLAMKWRWRDKFAGKDGDGW

SEQ ID NO: 730409 - protein, 36 aa, Mycobacterium
SEAVMLGGLAMKWRWRAKIGKDWKGRTPNLVMGSNV

SEQ ID NO: 730410 - protein, 35 aa, Mycobacterium
SEAVMLGGLAMKWRWRAKVGKGWEGRRPNLVMGSN

SEQ ID NO: 730411 - protein, 27 aa, Mycobacterium
SEAVMLGGLAMKWRWRARTKDWKGRTP

SEQ ID NO: 730412 - protein, 31 aa, Mycobacterium
SEAVMLGGLAMKWRWRQKVGKDWKGRTPNLV

SEQ ID NO: 730413 - protein, 22 aa, Mycobacterium
SEAWRFAVGHSSDWGIDPARIV

SEQ ID NO: 730414 - protein, 24 aa, Mycobacterium
SEAYLVLCGSAFKNKGVQPMLDAV

SEQ ID NO: 730415 - protein, 31 aa, Mycobacterium
SEAYMSHLLDPCGLPPKMLRSTRLADLVNTI

SEQ ID NO: 730416 - protein, 22 aa, Mycobacterium
SEAYPRLVVATITGWGSTGPFR

SEQ ID NO: 730417 - protein, 18 aa, Mycobacterium
SECFVRQRVPFFVDYVRR

SEQ ID NO: 730418 - protein, 17 aa, Mycobacterium
SECGAELGIRDVFELVT

SEQ ID NO: 730419 - protein, 26 aa, Mycobacterium
SECGRDPQVHCCPICDREVCSSCRVG

SEQ ID NO: 730420 - protein, 20 aa, Mycobacterium
SEDDWDGWATLTAAIGDRLQ

SEQ ID NO: 730421 - protein, 28 aa, Mycobacterium
SEDEKRLFARMAEVFAGFLSYTDAQIGR

SEQ ID NO: 730422 - protein, 19 aa, Mycobacterium
SEDELLAWALPTAANQFWM

SEQ ID NO: 730423 - protein, 24 aa, Mycobacterium
SEDGCRRYEVQLDDFRPADRDWVE

SEQ ID NO: 730424 - protein, 18 aa, Mycobacterium
SEDGPAWWDATVIEHIPA

SEQ ID NO: 730425 - protein, 20 aa, Mycobacterium
SEDHFTFFAAMDHVHGDATL

SEQ ID NO: 730426 - protein, 25 aa, Mycobacterium
SEDHYGVTMVTGWEEAVSVYNDEKS

SEQ ID NO: 730427 - protein, 23 aa, Mycobacterium
SEDLAVYRAHWLVARTAEHIGGW

SEQ ID NO: 730428 - protein, 29 aa, Mycobacterium
SEDLDDWKCWARWRLIRSRAPWLTRDLVD

SEQ ID NO: 730429 - protein, 18 aa, Mycobacterium
SEDLWYAHDYVPFDQGEN

SEQ ID NO: 730430 - protein, 25 aa, Mycobacterium
SEDPRIKVLLLEAGGSDRNPLFSIP

SEQ ID NO: 730431 - protein, 21 aa, Mycobacterium
SEDRAAAIYQRGRQRLLQSGR

SEQ ID NO: 730432 - protein, 21 aa, Mycobacterium
SEDRFRAALGAAERTGAELES

SEQ ID NO: 730433 - protein, 19 aa, Mycobacterium
SEDRGGWTFQVHSRPYGVR

SEQ ID NO: 730434 - protein, 18 aa, Mycobacterium
SEDRTVLAPSEIGELEIR

SEQ ID NO: 730435 - protein, 26 aa, Mycobacterium
SEDRVARRFARCLLVSPGETAQLEAR

SEQ ID NO: 730436 - protein, 18 aa, Mycobacterium
SEDVPALVPFDGRAKKAL

SEQ ID NO: 730437 - protein, 22 aa, Mycobacterium
SEDWMARLILGFGSAIRVLAPE

SEQ ID NO: 730438 - protein, 24 aa, Mycobacterium
SEEAFPRLAVVRAPRHGRVIGPYR

SEQ ID NO: 730439 - protein, 18 aa, Mycobacterium
SEEARDLIALTREVADKV

SEQ ID NO: 730440 - protein, 28 aa, Mycobacterium
SEEFFDLVWRLMRFDKHGPLDLVLYHDN

SEQ ID NO: 730441 - protein, 18 aa, Mycobacterium
SEEILRFERTLAKAQNRY

SEQ ID NO: 730442 - protein, 33 aa, Mycobacterium
SEEIYALALAEWGCSANERLIHVDGPAFMVGHA

SEQ ID NO: 730443 - protein, 28 aa, Mycobacterium
SEEKKTALGTGFFLTWLTTYTDQNGEVL

SEQ ID NO: 730444 - protein, 25 aa, Mycobacterium
SEEKKTALGTGFFLTWVTTYVDQHG

SEQ ID NO: 730445 - protein, 18 aa, Mycobacterium
SEELCALLSRHGAEVCSA

SEQ ID NO: 730446 - protein, 19 aa, Mycobacterium
SEEPIDLWVHDGVISIEPI

SEQ ID NO: 730447 - protein, 29 aa, Mycobacterium
SEEQKRRWAVPILRAEITASLGMSEPSAG

SEQ ID NO: 730448 - protein, 26 aa, Mycobacterium
SEEVAPWLEVVRKLGVLIGAVSEQLP

SEQ ID NO: 730449 - protein, 19 aa, Mycobacterium
SEEVRQWLVSHVPLGRAGR

SEQ ID NO: 730450 - protein, 25 aa, Mycobacterium
SEEYCKGRLGLDAALGSIDRSKLNV

SEQ ID NO: 730451 - protein, 19 aa, Mycobacterium
SEFAQLVVVGSHGRGGLGA

SEQ ID NO: 730452 - protein, 17 aa, Mycobacterium
SEFARRQWGGLLAPPAL

SEQ ID NO: 730453 - protein, 19 aa, Mycobacterium
SEFATGLAFDEASRRHTGL

SEQ ID NO: 730454 - protein, 23 aa, Mycobacterium
SEFDLANLFLPGGPISKAASKGR

SEQ ID NO: 730455 - protein, 17 aa, Mycobacterium
SEFKLRGLVKKYSDFIA

SEQ ID NO: 730456 - protein, 20 aa, Mycobacterium
SEFLQGGSIYPALQNFYLAA

SEQ ID NO: 730457 - protein, 17 aa, Mycobacterium
SEFLTHPAFTNYRTETS

SEQ ID NO: 730458 - protein, 19 aa, Mycobacterium
SEFNEVFLTDVFVPDDMLL

SEQ ID NO: 730459 - protein, 22 aa, Mycobacterium
SEFNVSLPWSKVVVLNPGVQTE

SEQ ID NO: 730460 - protein, 29 aa, Mycobacterium
SEFPKTTKAGMEFAVLLFAVRKGFTYPRG

SEQ ID NO: 730461 - protein, 17 aa, Mycobacterium
SEFPRTRMTAVDAATYN

SEQ ID NO: 730462 - protein, 20 aa, Mycobacterium
SEFPSLDLATTVSDSGLSWA

SEQ ID NO: 730463 - protein, 24 aa, Mycobacterium
SEFPTDRGWDLAGIYNPDPDVPGT

SEQ ID NO: 730464 - protein, 23 aa, Mycobacterium
SEFPTDRGWDLAGLFDPDPDTPH

SEQ ID NO: 730465 - protein, 32 aa, Mycobacterium
SEFPWCAQAAELLRGQFGPALPVTVSDVRTDP

SEQ ID NO: 730466 - protein, 26 aa, Mycobacterium
SEFPWCAQAAGVLRKHFSDALPVRVC

SEQ ID NO: 730467 - protein, 23 aa, Mycobacterium
SEFPWCGQAAEVLRSHFGEALPV

SEQ ID NO: 730468 - protein, 21 aa, Mycobacterium
SEFRARVAATLDRAQALANEH

SEQ ID NO: 730469 - protein, 19 aa, Mycobacterium
SEFRIECKEWTDGQIGNND

SEQ ID NO: 730470 - protein, 18 aa, Mycobacterium
SEFRRLEVAVSTKVASGP

SEQ ID NO: 730471 - protein, 17 aa, Mycobacterium
SEFSDSYVKLVIVPEGV

SEQ ID NO: 730472 - protein, 20 aa, Mycobacterium
SEFTDSYVKLVFVAHDVDVA

SEQ ID NO: 730473 - protein, 21 aa, Mycobacterium
SEFTRRIPAYHILRTHMSATI

SEQ ID NO: 730474 - protein, 17 aa, Mycobacterium
SEFWGPQGYPGVLFVAA

SEQ ID NO: 730475 - protein, 17 aa, Mycobacterium
SEFYTRSGSISMAAMAT

SEQ ID NO: 730476 - protein, 17 aa, Mycobacterium
SEFYVDWLRPNSIEDGL

SEQ ID NO: 730477 - protein, 23 aa, Mycobacterium
SEGAMGPAGFLIADDGEIGMRNQ

SEQ ID NO: 730478 - protein, 17 aa, Mycobacterium
SEGDRVIVAAGRPCMSC

SEQ ID NO: 730479 - protein, 26 aa, Mycobacterium
SEGFSAAARSARRGAATVSEHLKGEA

SEQ ID NO: 730480 - protein, 19 aa, Mycobacterium
SEGGFSRVQRRIWELEKRR

SEQ ID NO: 730481 - protein, 19 aa, Mycobacterium
SEGGKVWDLLRGVAEAIGC

SEQ ID NO: 730482 - protein, 21 aa, Mycobacterium
SEGGPACAARAAAAMSAGALN

SEQ ID NO: 730483 - protein, 20 aa, Mycobacterium
SEGIGELLALIDAHQRGDSR

SEQ ID NO: 730484 - protein, 17 aa, Mycobacterium
SEGIPYSSLISAAESHR

SEQ ID NO: 730485 - protein, 18 aa, Mycobacterium
SEGIRYAAFVGAQLADIN

SEQ ID NO: 730486 - protein, 26 aa, Mycobacterium
SEGKLYLCAIKDAFSNRVVGYSIDSR

SEQ ID NO: 730487 - protein, 22 aa, Mycobacterium
SEGLDFVRFAALDIVADPAGQS

SEQ ID NO: 730488 - protein, 19 aa, Mycobacterium
SEGLGVASWHGFVSGVFSG

SEQ ID NO: 730489 - protein, 23 aa, Mycobacterium
SEGLLPAITFVFSRAGCDAAVQQ

SEQ ID NO: 730490 - protein, 26 aa, Mycobacterium
SEGLPGLADNLVRFVASLAAAPLLGP

SEQ ID NO: 730491 - protein, 25 aa, Mycobacterium
SEGLPYRWPHPWLVDTKTAAEQIGL

SEQ ID NO: 730492 - protein, 26 aa, Mycobacterium
SEGLRRFAALSGRSVGAEKIWMGETH

SEQ ID NO: 730493 - protein, 21 aa, Mycobacterium
SEGNFRCQVGHAWTADALLAA

SEQ ID NO: 730494 - protein, 23 aa, Mycobacterium
SEGNFRCRVGHAWTADALLRARD

SEQ ID NO: 730495 - protein, 17 aa, Mycobacterium
SEGQPFLYPDNSLTLVE

SEQ ID NO: 730496 - protein, 18 aa, Mycobacterium
SEGQWALGELEPLNSNEQ

SEQ ID NO: 730497 - protein, 43 aa, Mycobacterium
SEGRGQARIEFKLRDWLFARQRYWGEPFPIVYDADGRAHALDE

SEQ ID NO: 730498 - protein, 20 aa, Mycobacterium
SEGRLEIGLGTGYVKEEFDA

SEQ ID NO: 730499 - protein, 17 aa, Mycobacterium
SEGRLRRAVDQDKDQSY

SEQ ID NO: 730500 - protein, 20 aa, Mycobacterium
SEGSRECARNIVAVLETFQQ

SEQ ID NO: 730501 - protein, 18 aa, Mycobacterium
SEGSRFAADFGAVAGTSP

SEQ ID NO: 730502 - protein, 26 aa, Mycobacterium
SEGTAVFDFFHPSRIVIGADDSRAAE

SEQ ID NO: 730503 - protein, 27 aa, Mycobacterium
SEGWCPHCGSAYSFLPQLNPGDIVADQ

SEQ ID NO: 730504 - protein, 26 aa, Mycobacterium
SEGWCPHCGSPYSFLPQLSPGDIVAD

SEQ ID NO: 730505 - protein, 23 aa, Mycobacterium
SEGYAKLLGLFAADLQRQSQRGY

SEQ ID NO: 730506 - protein, 23 aa, Mycobacterium
SEHAELIKAIAAHDVEQATDIMR

SEQ ID NO: 730507 - protein, 18 aa, Mycobacterium
SEHCSYKSSKVHLRYFGQ

SEQ ID NO: 730508 - protein, 19 aa, Mycobacterium
SEHGFEFLVSKGRALMPAL

SEQ ID NO: 730509 - protein, 18 aa, Mycobacterium
SEHGKWISVSSVYRRSLD

SEQ ID NO: 730510 - protein, 22 aa, Mycobacterium
SEHKAVAFDVFETVGGTERTRV

SEQ ID NO: 730511 - protein, 19 aa, Mycobacterium
SEHKKHRYAFAPFGGGAHK

SEQ ID NO: 730512 - protein, 17 aa, Mycobacterium
SEHKSYLHRSGRTARAG

SEQ ID NO: 730513 - protein, 17 aa, Mycobacterium
SEHLCQGWLEGYLLTGR

SEQ ID NO: 730514 - protein, 18 aa, Mycobacterium
SEHLCQGWLEGYLLTGRH

SEQ ID NO: 730515 - protein, 23 aa, Mycobacterium
SEHLLRIIQSFVLDPGRPPRRGD

SEQ ID NO: 730516 - protein, 24 aa, Mycobacterium
SEHPSSGVAFVLGERLGRVDVSEL

SEQ ID NO: 730517 - protein, 24 aa, Mycobacterium
SEHSDYRLGLPIAGRWREVLNTDA

SEQ ID NO: 730518 - protein, 20 aa, Mycobacterium
SEHWEVVRIEIPAEVARYVV

SEQ ID NO: 730519 - protein, 24 aa, Mycobacterium
SEIAAENIAGWPVGRTFAVAPKMA

SEQ ID NO: 730520 - protein, 21 aa, Mycobacterium
SEIADRVELCLIADDDSESRI

SEQ ID NO: 730521 - protein, 20 aa, Mycobacterium
SEIDDAFRWSEENPNLQRKA

SEQ ID NO: 730522 - protein, 18 aa, Mycobacterium
SEIDRADMAKLFDDVDVH

SEQ ID NO: 730523 - protein, 32 aa, Mycobacterium
SEIDRWPQQPGRYFTVRAGSLVAWDSGGVGTA

SEQ ID NO: 730524 - protein, 18 aa, Mycobacterium
SEIERIQRAVAIDTDAEE

SEQ ID NO: 730525 - protein, 18 aa, Mycobacterium
SEIFGSMTGMRYGFAEDF

SEQ ID NO: 730526 - protein, 19 aa, Mycobacterium
SEILRRAYELILADIDRLS

SEQ ID NO: 730527 - protein, 23 aa, Mycobacterium
SEINLGSWDFWALDDDIRDGAFA

SEQ ID NO: 730528 - protein, 17 aa, Mycobacterium
SEIPAALRSSVADAIES

SEQ ID NO: 730529 - protein, 19 aa, Mycobacterium
SEIRAVGIGELLARIERLR

SEQ ID NO: 730530 - protein, 19 aa, Mycobacterium
SEIRAVGVGELLARIDRLR

SEQ ID NO: 730531 - protein, 19 aa, Mycobacterium
SEIRIRLVTRGHGMTSPHE

SEQ ID NO: 730532 - protein, 19 aa, Mycobacterium
SEISGLDLARLGTTATAEE

SEQ ID NO: 730533 - protein, 23 aa, Mycobacterium
SEITRLLLSTGLIALGKTQMSEF

SEQ ID NO: 730534 - protein, 21 aa, Mycobacterium
SEIYAAICVAATLIVPGCDHA

SEQ ID NO: 730535 - protein, 21 aa, Mycobacterium
SEIYYDRGPEFGVEGGPIANE

SEQ ID NO: 730536 - protein, 24 aa, Mycobacterium
SEKDVKRQLLLDALADDLKVQVGQ

SEQ ID NO: 730537 - protein, 24 aa, Mycobacterium
SEKDVKRQLLLDALADELKVQVGQ

SEQ ID NO: 730538 - protein, 25 aa, Mycobacterium
SEKGSPTPVAWTRMRVPRSLMASIG

SEQ ID NO: 730539 - protein, 24 aa, Mycobacterium
SEKIRFELAKELRRLHKADADRVA

SEQ ID NO: 730540 - protein, 23 aa, Mycobacterium
SEKLQLCRDLGAQITINYRDEDF

SEQ ID NO: 730541 - protein, 18 aa, Mycobacterium
SEKNTNWEGAFRIPEMIR

SEQ ID NO: 730542 - protein, 25 aa, Mycobacterium
SEKPLSTGVAFAFAPGVTVEGMLFD

SEQ ID NO: 730543 - protein, 24 aa, Mycobacterium
SEKPSLAALWARKAELILEHSEDV

SEQ ID NO: 730544 - protein, 19 aa, Mycobacterium
SEKRGHWTAAQLLTAATAD

SEQ ID NO: 730545 - protein, 21 aa, Mycobacterium
SEKTGSVARCYSLCSSPFTGD

SEQ ID NO: 730546 - protein, 18 aa, Mycobacterium
SELAAAFEKFEDTVARAA

SEQ ID NO: 730547 - protein, 17 aa, Mycobacterium
SELAAAFEQFEATVDAA

SEQ ID NO: 730548 - protein, 17 aa, Mycobacterium
SELAAKVTPDFAPYGKR

SEQ ID NO: 730549 - protein, 19 aa, Mycobacterium
SELAGFFRDAAGQAPFNLG

SEQ ID NO: 730550 - protein, 21 aa, Mycobacterium
SELAKTAPRRGGQPANGTGSS

SEQ ID NO: 730551 - protein, 21 aa, Mycobacterium
SELALAGGCMLMLEPDVFSSA

SEQ ID NO: 730552 - protein, 18 aa, Mycobacterium
SELAPLLCAGIIGYRSLL

SEQ ID NO: 730553 - protein, 17 aa, Mycobacterium
SELARLFGASTTPTHRA

SEQ ID NO: 730554 - protein, 22 aa, Mycobacterium
SELARSAGVLAPIFALENRNNH

SEQ ID NO: 730555 - protein, 17 aa, Mycobacterium
SELDAMRVVAKRARRPM

SEQ ID NO: 730556 - protein, 19 aa, Mycobacterium
SELDGTVCWLADKPLKAGA

SEQ ID NO: 730557 - protein, 19 aa, Mycobacterium
SELDIVFSTTVTGLAVPTL

SEQ ID NO: 730558 - protein, 23 aa, Mycobacterium
SELDLRLRVFDDLEVAYAEPAPL

SEQ ID NO: 730559 - protein, 27 aa, Mycobacterium
SELDPALRSWLAFGFEKVTEVVALARG

SEQ ID NO: 730560 - protein, 25 aa, Mycobacterium
SELDRRFAEYRSRAVTAAALDPDGE

SEQ ID NO: 730561 - protein, 21 aa, Mycobacterium
SELEHKLGISAVDIYGLSELL

SEQ ID NO: 730562 - protein, 22 aa, Mycobacterium
SELEQLWRGRIARIDELIARDR

SEQ ID NO: 730563 - protein, 20 aa, Mycobacterium
SELERLGARAARDAAEAGAQ

SEQ ID NO: 730564 - protein, 24 aa, Mycobacterium
SELERRFLENIPMRRVGQPREIAH

SEQ ID NO: 730565 - protein, 20 aa, Mycobacterium
SELESAGATMVFENAADLLD

SEQ ID NO: 730566 - protein, 17 aa, Mycobacterium
SELFALSARGLLDMAMA

SEQ ID NO: 730567 - protein, 22 aa, Mycobacterium
SELGANMLAVFRSALTGADDGL

SEQ ID NO: 730568 - protein, 20 aa, Mycobacterium
SELGDWLVIHEGWRSELPDE

SEQ ID NO: 730569 - protein, 21 aa, Mycobacterium
SELGEWLVIHEGWRSELPEQL

SEQ ID NO: 730570 - protein, 21 aa, Mycobacterium
SELGLSIAWNGCIYNYKELRS

SEQ ID NO: 730571 - protein, 19 aa, Mycobacterium
SELGLSYLLPRAIGSSRAF

SEQ ID NO: 730572 - protein, 19 aa, Mycobacterium
SELGLSYLLPRAIGTSRAF

SEQ ID NO: 730573 - protein, 20 aa, Mycobacterium
SELGLSYLLPRAIGTSRASD

SEQ ID NO: 730574 - protein, 20 aa, Mycobacterium
SELGMPPWRIEKAQKQARRW

SEQ ID NO: 730575 - protein, 20 aa, Mycobacterium
SELIAAFLWAQFEDAERITR

SEQ ID NO: 730576 - protein, 27 aa, Mycobacterium
SELICVRWIINNEFRWSATRLGLATLA

SEQ ID NO: 730577 - protein, 20 aa, Mycobacterium
SELIGRRGFHAVSIADIGNA

SEQ ID NO: 730578 - protein, 21 aa, Mycobacterium
SELIRDLGFDSLAFASTVSEI

SEQ ID NO: 730579 - protein, 21 aa, Mycobacterium
SELLEAAGFQLTRVIPTVSPI

SEQ ID NO: 730580 - protein, 19 aa, Mycobacterium
SELLGRFPGSSFLTSVEEV

SEQ ID NO: 730581 - protein, 19 aa, Mycobacterium
SELLGRRIGAESSLLAEGI

SEQ ID NO: 730582 - protein, 20 aa, Mycobacterium
SELLHQATLAYERGDEQGGD

SEQ ID NO: 730583 - protein, 20 aa, Mycobacterium
SELLPELTLAQKWDLTATEL

SEQ ID NO: 730584 - protein, 24 aa, Mycobacterium
SELLRAGDVLVVIGTVAGIAGVGE

SEQ ID NO: 730585 - protein, 29 aa, Mycobacterium
SELLVDAMGALVFWRLIALFRPVTSEYLD

SEQ ID NO: 730586 - protein, 18 aa, Mycobacterium
SELLVLMDGIEKLADAAV

SEQ ID NO: 730587 - protein, 18 aa, Mycobacterium
SELLVLMDGLERLAQAPI

SEQ ID NO: 730588 - protein, 20 aa, Mycobacterium
SELNAAAVRTMWPTVRDKVR

SEQ ID NO: 730589 - protein, 17 aa, Mycobacterium
SELNWQQAALLAGMVQS

SEQ ID NO: 730590 - protein, 24 aa, Mycobacterium
SELPAAVAAQARRGDGWIKLVGDW

SEQ ID NO: 730591 - protein, 24 aa, Mycobacterium
SELPDALQALGRPDGLTVPRPAVF

SEQ ID NO: 730592 - protein, 25 aa, Mycobacterium
SELPDRACWALQHLLSRRYISKHNH

SEQ ID NO: 730593 - protein, 17 aa, Mycobacterium
SELPEPVAHIARDPLDE

SEQ ID NO: 730594 - protein, 21 aa, Mycobacterium
SELPGYLASKGVRRTRNAIVG

SEQ ID NO: 730595 - protein, 19 aa, Mycobacterium
SELPPRCVVDGEIVIATAG

SEQ ID NO: 730596 - protein, 22 aa, Mycobacterium
SELPQLMSVVPSALQGLASPAA

SEQ ID NO: 730597 - protein, 25 aa, Mycobacterium
SELQPKGVDVLGLILGKTDTPALRA

SEQ ID NO: 730598 - protein, 18 aa, Mycobacterium
SELQRAKRGHTLYVLDEP

SEQ ID NO: 730599 - protein, 19 aa, Mycobacterium
SELQRRLAAAGSPLRAIAV

SEQ ID NO: 730600 - protein, 20 aa, Mycobacterium
SELRADEVLFATGRAPLTDD

SEQ ID NO: 730601 - protein, 18 aa, Mycobacterium
SELREARRRIKLLEQENE

SEQ ID NO: 730602 - protein, 22 aa, Mycobacterium
SELREGLACAVLRRADHRPTFD

SEQ ID NO: 730603 - protein, 20 aa, Mycobacterium
SELRLLVAVRRAVVADGGTA

SEQ ID NO: 730604 - protein, 27 aa, Mycobacterium
SELRQRIAVLALDLLGPDGLLAHRSPA

SEQ ID NO: 730605 - protein, 22 aa, Mycobacterium
SELRRHAVDFVFGVDGANIEDL

SEQ ID NO: 730606 - protein, 20 aa, Mycobacterium
SELRSRIGLSSSALAQRIPT

SEQ ID NO: 730607 - protein, 20 aa, Mycobacterium
SELRSVFSAAQIIADTERMG

SEQ ID NO: 730608 - protein, 26 aa, Mycobacterium
SELSELTENCDLIWVMHEGRNIAAFD

SEQ ID NO: 730609 - protein, 21 aa, Mycobacterium
SELSMPLILLGGITNRETMDL

SEQ ID NO: 730610 - protein, 26 aa, Mycobacterium
SELTAEVLRDGWLRTGDVGVLGDDGN

SEQ ID NO: 730611 - protein, 20 aa, Mycobacterium
SELTGGPWVGAAASSMLAAV

SEQ ID NO: 730612 - protein, 21 aa, Mycobacterium
SELTRRFAVSAAETGSHDLHR

SEQ ID NO: 730613 - protein, 20 aa, Mycobacterium
SELWFAAAVASGMDPAQARE

SEQ ID NO: 730614 - protein, 23 aa, Mycobacterium
SELWKIVDRPNLFIKIPATTAGM

SEQ ID NO: 730615 - protein, 18 aa, Mycobacterium
SELWRQTIDLNINGTMYL

SEQ ID NO: 730616 - protein, 22 aa, Mycobacterium
SELYIPYSWYEPMWMENIGLAP

SEQ ID NO: 730617 - protein, 23 aa, Mycobacterium
SEMAARVALLTGVLGDVPLIADA

SEQ ID NO: 730618 - protein, 17 aa, Mycobacterium
SEMAFDPAFGPAVSRLS

SEQ ID NO: 730619 - protein, 23 aa, Mycobacterium
SEMAFDPMFRPLLANLHDHLTVR

SEQ ID NO: 730620 - protein, 21 aa, Mycobacterium
SEMAFKIAGSQVLKKAAQQAQ

SEQ ID NO: 730621 - protein, 17 aa, Mycobacterium
SEMARLKPVAPSMGMML

SEQ ID NO: 730622 - protein, 17 aa, Mycobacterium
SEMDWRLLMRRCPRRSF

SEQ ID NO: 730623 - protein, 22 aa, Mycobacterium
SEMEMKVLLWAVQRLIGGLSTI

SEQ ID NO: 730624 - protein, 20 aa, Mycobacterium
SEMFHRALAAIDEYDAGLID

SEQ ID NO: 730625 - protein, 18 aa, Mycobacterium
SEMGGFGFDVWARAGRVI

SEQ ID NO: 730626 - protein, 21 aa, Mycobacterium
SEMGLRLASRRVVLDHAVVGT

SEQ ID NO: 730627 - protein, 22 aa, Mycobacterium
SEMHARLAPRPPAWIHGTGWRT

SEQ ID NO: 730628 - protein, 20 aa, Mycobacterium
SEMIHKIVVHPFLLTTFRVS

SEQ ID NO: 730629 - protein, 24 aa, Mycobacterium
SEMIKRIATQPDLELVGVHCYSPD

SEQ ID NO: 730630 - protein, 19 aa, Mycobacterium
SEMIRRIATQPDLELIGVH

SEQ ID NO: 730631 - protein, 24 aa, Mycobacterium
SEMPDLRLTRRFLGHLTDEQLLRH

SEQ ID NO: 730632 - protein, 17 aa, Mycobacterium
SEMPVVAAVGKYDGTLA

SEQ ID NO: 730633 - protein, 20 aa, Mycobacterium
SEMRQHFQAWQFSQFLHGEQ

SEQ ID NO: 730634 - protein, 21 aa, Mycobacterium
SEMTCSFLFACTGYYNYDEGF

SEQ ID NO: 730635 - protein, 17 aa, Mycobacterium
SEMWAQDIVAMDGYAGT

SEQ ID NO: 730636 - protein, 17 aa, Mycobacterium
SEMWLAPTASFAASPFR

SEQ ID NO: 730637 - protein, 33 aa, Mycobacterium
SENDECRAKRRIGGYLSLRCVQIGSEPGKRFWR

SEQ ID NO: 730638 - protein, 25 aa, Mycobacterium
SENDFRDVLPLGGWEISYLGPTTYL

SEQ ID NO: 730639 - protein, 22 aa, Mycobacterium
SENDTCFAEWGLTSPLGSGAPL

SEQ ID NO: 730640 - protein, 22 aa, Mycobacterium
SENEQRMFLSLIIAAGSETTRN

SEQ ID NO: 730641 - protein, 19 aa, Mycobacterium
SENHRGRRPAVWEPGEYLV

SEQ ID NO: 730642 - protein, 23 aa, Mycobacterium
SENLPDYIYRGVAPVVANVLYDN

SEQ ID NO: 730643 - protein, 18 aa, Mycobacterium
SENLPSYIYRSVDPVVAE

SEQ ID NO: 730644 - protein, 23 aa, Mycobacterium
SENPRLLGVIGVMGHPAVEQVMR

SEQ ID NO: 730645 - protein, 25 aa, Mycobacterium
SENRPEIVELMFAIWAAECVFVPLN

SEQ ID NO: 730646 - protein, 20 aa, Mycobacterium
SENRRVVGLMPHPEHATEAL

SEQ ID NO: 730647 - protein, 17 aa, Mycobacterium
SEPAGIVALRTSFGGSR

SEQ ID NO: 730648 - protein, 20 aa, Mycobacterium
SEPARLAVLAALEDPAALSE

SEQ ID NO: 730649 - protein, 20 aa, Mycobacterium
SEPDERFWIGVGRTRSDRFV

SEQ ID NO: 730650 - protein, 26 aa, Mycobacterium
SEPDLPLRFAINIGSAVMTTPEGPQL

SEQ ID NO: 730651 - protein, 26 aa, Mycobacterium
SEPDYRGCAFINSFGELGGISPAVAD

SEQ ID NO: 730652 - protein, 30 aa, Mycobacterium
SEPEALWRFLWKGHCAIGEVPAERWRPFDD

SEQ ID NO: 730653 - protein, 24 aa, Mycobacterium
SEPFVSRLDFAPSLGNALYSVELV

SEQ ID NO: 730654 - protein, 26 aa, Mycobacterium
SEPGKRFWRTGAVSFWVLPPEINSLR

SEQ ID NO: 730655 - protein, 21 aa, Mycobacterium
SEPGVYFLGLPWQSRRGSSFL

SEQ ID NO: 730656 - protein, 25 aa, Mycobacterium
SEPIAARILEHFGLAEFFQVIAGAS

SEQ ID NO: 730657 - protein, 22 aa, Mycobacterium
SEPIAIVGMSCRFPGGVDTPEA

SEQ ID NO: 730658 - protein, 22 aa, Mycobacterium
SEPIDGVFRWIGRIRPNEQLTA

SEQ ID NO: 730659 - protein, 25 aa, Mycobacterium
SEPLARRYMAAGASFVLVGADVALL

SEQ ID NO: 730660 - protein, 21 aa, Mycobacterium
SEPLLPNWKHLPVGYHGRAGT

SEQ ID NO: 730661 - protein, 23 aa, Mycobacterium
SEPLMRFMHEIGFLDGKFTGRLL

SEQ ID NO: 730662 - protein, 29 aa, Mycobacterium
SEPLPPPDLRAGLTPGRRTDALANIALLR

SEQ ID NO: 730663 - protein, 18 aa, Mycobacterium
SEPMIIGKAFAVKVNANI

SEQ ID NO: 730664 - protein, 22 aa, Mycobacterium
SEPPFLPSLDKFVEFVGEGHFD

SEQ ID NO: 730665 - protein, 23 aa, Mycobacterium
SEPQRSPQRWTFFGSDERGLQHV

SEQ ID NO: 730666 - protein, 21 aa, Mycobacterium
SEPRGDVLVFLSGEREIRDTA

SEQ ID NO: 730667 - protein, 22 aa, Mycobacterium
SEPRPGPDLVDLFPAHQPQPGY

SEQ ID NO: 730668 - protein, 21 aa, Mycobacterium
SEPRRAWFPIDRSMVLYYCSL

SEQ ID NO: 730669 - protein, 23 aa, Mycobacterium
SEPRRIGFLGAPVFDGNGEVSVM

SEQ ID NO: 730670 - protein, 21 aa, Mycobacterium
SEPRTGMSMGEHAAVTAKAMG

SEQ ID NO: 730671 - protein, 21 aa, Mycobacterium
SEPRTGMSMGEHAAVTAKEMG

SEQ ID NO: 730672 - protein, 20 aa, Mycobacterium
SEPSDAYWLLRHAIDCPDPV

SEQ ID NO: 730673 - protein, 21 aa, Mycobacterium
SEPVAIVGMGCRYPGGVDSPE

SEQ ID NO: 730674 - protein, 21 aa, Mycobacterium
SEPVAVVGMACRYAGGVDTPD

SEQ ID NO: 730675 - protein, 20 aa, Mycobacterium
SEPVLQRVFEYWRNIDKLTG

SEQ ID NO: 730676 - protein, 20 aa, Mycobacterium
SEPWAIPDIASYPAIQHTFA

SEQ ID NO: 730677 - protein, 17 aa, Mycobacterium
SEPWAIPDISTYEPIEH

SEQ ID NO: 730678 - protein, 20 aa, Mycobacterium
SEPWRIPDITTYPRIEHTFA

SEQ ID NO: 730679 - protein, 20 aa, Mycobacterium
SEQAAHAVIPPAMAAPQAAA

SEQ ID NO: 730680 - protein, 27 aa, Mycobacterium
SEQDVYLRWAVAAFRLATSGVADSTQI

SEQ ID NO: 730681 - protein, 19 aa, Mycobacterium
SEQELPLGRRNPSIVGNVV

SEQ ID NO: 730682 - protein, 23 aa, Mycobacterium
SEQFLHWVPVPKGLTFYISVPHA

SEQ ID NO: 730683 - protein, 19 aa, Mycobacterium
SEQHVWCFLGDGEMDEPES

SEQ ID NO: 730684 - protein, 24 aa, Mycobacterium
SEQLGVAQWCFDTTLDYARQRRQF

SEQ ID NO: 730685 - protein, 18 aa, Mycobacterium
SEQNWADLYLPAGPQQVD

SEQ ID NO: 730686 - protein, 21 aa, Mycobacterium
SEQRGAGSLSEESTGTWQDML

SEQ ID NO: 730687 - protein, 20 aa, Mycobacterium
SEQRMAAMYALKRAVEAVYQ

SEQ ID NO: 730688 - protein, 23 aa, Mycobacterium
SEQSRSYLVPTINAFTAQLSAGV

SEQ ID NO: 730689 - protein, 19 aa, Mycobacterium
SERALKLDTVDFWHRQFDG

SEQ ID NO: 730690 - protein, 22 aa, Mycobacterium
SERARQRILNYVAIGVEEGATV

SEQ ID NO: 730691 - protein, 19 aa, Mycobacterium
SERARSRAGGADIVVTNHA

SEQ ID NO: 730692 - protein, 35 aa, Mycobacterium
SERAVTAAMPMVLWLRMLSLQAHKRALQASAQASS

SEQ ID NO: 730693 - protein, 24 aa, Mycobacterium
SERELGDRFGVSRVTVREALRGLE

SEQ ID NO: 730694 - protein, 26 aa, Mycobacterium
SERELLEGLRLIARVSSLCAQMSVEA

SEQ ID NO: 730695 - protein, 27 aa, Mycobacterium
SERESVFHFWRYVGLLMGIHPELVPTS

SEQ ID NO: 730696 - protein, 17 aa, Mycobacterium
SERFCFEGFAPRKQSAR

SEQ ID NO: 730697 - protein, 18 aa, Mycobacterium
SERFEFIAGNFFEEVPGS

SEQ ID NO: 730698 - protein, 18 aa, Mycobacterium
SERFRTLWASYDVKKHTR

SEQ ID NO: 730699 - protein, 25 aa, Mycobacterium
SERFSAGLTRPWYTVKLCSESAELR

SEQ ID NO: 730700 - protein, 25 aa, Mycobacterium
SERGKRMRLHWGPIEFRTLAEQASA

SEQ ID NO: 730701 - protein, 24 aa, Mycobacterium
SERHVEAVTGWLQRHHPGDRVRGR

SEQ ID NO: 730702 - protein, 31 aa, Mycobacterium
SERHYSFQLDREWPIRAAVLHTGDEHVVSLV

SEQ ID NO: 730703 - protein, 25 aa, Mycobacterium
SERIDFVRKEFRALRVKADEQTVTA

SEQ ID NO: 730704 - protein, 22 aa, Mycobacterium
SERILSAYLDRGGNFIDTANFY

SEQ ID NO: 730705 - protein, 21 aa, Mycobacterium
SERIPLAALHYFPHRANSQIL

SEQ ID NO: 730706 - protein, 20 aa, Mycobacterium
SERKFHWPLGRRPDDHPSLS

SEQ ID NO: 730707 - protein, 25 aa, Mycobacterium
SERLACKAVGLARSTYRRLPLGQTP

SEQ ID NO: 730708 - protein, 31 aa, Mycobacterium
SERLAKRGLRCFAPTWPLGAHPRALGPDADR

SEQ ID NO: 730709 - protein, 17 aa, Mycobacterium
SERLLTLAWQQRNLPEA

SEQ ID NO: 730710 - protein, 23 aa, Mycobacterium
SERMRCILGDPAVDMVVAVRRLE

SEQ ID NO: 730711 - protein, 29 aa, Mycobacterium
SERPGHRLLETWHPLGVVGVITAFNFPVA

SEQ ID NO: 730712 - protein, 21 aa, Mycobacterium
SERPLGQVMMGPWTLPPYNTG

SEQ ID NO: 730713 - protein, 24 aa, Mycobacterium
SERPYRLSASIGFVRAPVSDTANV

SEQ ID NO: 730714 - protein, 27 aa, Mycobacterium
SERQLKTLLPLIAVFGGAASGRIMSGL

SEQ ID NO: 730715 - protein, 24 aa, Mycobacterium
SERQRIEPLLARSAAWATGESSAE

SEQ ID NO: 730716 - protein, 25 aa, Mycobacterium
SERQWLLLELWTWKEATTKALGTGL

SEQ ID NO: 730717 - protein, 21 aa, Mycobacterium
SERRASWVYYQVVPEVLDALA

SEQ ID NO: 730718 - protein, 18 aa, Mycobacterium
SERRGLLMTHMLPTDLTT

SEQ ID NO: 730719 - protein, 28 aa, Mycobacterium
SERRRAELRLARLGYLFQDYNLLQSLTS

SEQ ID NO: 730720 - protein, 23 aa, Mycobacterium
SERRRLEQVVIRFAGDSGDGMQL

SEQ ID NO: 730721 - protein, 21 aa, Mycobacterium
SERVDLGWFCMEKDTIAAIRG

SEQ ID NO: 730722 - protein, 21 aa, Mycobacterium
SERVTAAAARRARSGRPSGDL

SEQ ID NO: 730723 - protein, 21 aa, Mycobacterium
SERVTAAAVRRARSGRPSGDL

SEQ ID NO: 730724 - protein, 24 aa, Mycobacterium
SERVTLYGLPLVPRRRVNYAQIDP

SEQ ID NO: 730725 - protein, 17 aa, Mycobacterium
SERWDLKEADVILAGIG

SEQ ID NO: 730726 - protein, 22 aa, Mycobacterium
SERWPDGTALLFPRPTKNIDGQ

SEQ ID NO: 730727 - protein, 19 aa, Mycobacterium
SERYPEWGTFQDIRARLDP

SEQ ID NO: 730728 - protein, 25 aa, Mycobacterium
SESAELPLFRYIGGPNAHILPVPMM

SEQ ID NO: 730729 - protein, 25 aa, Mycobacterium
SESDFATTHIFVRRLEQVLVAMTTE

SEQ ID NO: 730730 - protein, 19 aa, Mycobacterium
SESDWAIFLQHADATLKRF

SEQ ID NO: 730731 - protein, 21 aa, Mycobacterium
SESFARGTFVHYMLPVHAYHR

SEQ ID NO: 730732 - protein, 19 aa, Mycobacterium
SESGELLIAPRLEDRYPAY

SEQ ID NO: 730733 - protein, 26 aa, Mycobacterium
SESKAVIGLNMLRLWDDRGTLEPWIT

SEQ ID NO: 730734 - protein, 21 aa, Mycobacterium
SESKLRLPGSVSIARIIIESW

SEQ ID NO: 730735 - protein, 23 aa, Mycobacterium
SESKRRVAVLGGNRIPFARSDGA

SEQ ID NO: 730736 - protein, 19 aa, Mycobacterium
SESKWRFIVVDEAHVYDGT

SEQ ID NO: 730737 - protein, 22 aa, Mycobacterium
SESLADFVKRQNIGSFTLGPIE

SEQ ID NO: 730738 - protein, 17 aa, Mycobacterium
SESLGAMRYFGMASPEY

SEQ ID NO: 730739 - protein, 17 aa, Mycobacterium
SESLGPMSIHLKDAQTP

SEQ ID NO: 730740 - protein, 23 aa, Mycobacterium
SESMPSISQLAAHPVASGLAHAT

SEQ ID NO: 730741 - protein, 20 aa, Mycobacterium
SESNAMWALSIPVPFSVPVG

SEQ ID NO: 730742 - protein, 19 aa, Mycobacterium
SESNAMWALSIPVPFTKPV

SEQ ID NO: 730743 - protein, 20 aa, Mycobacterium
SESNAMWALSIPVPFTKPVG

SEQ ID NO: 730744 - protein, 25 aa, Mycobacterium
SESNSKWLVAVRMVSEGVDVPRLSV

SEQ ID NO: 730745 - protein, 20 aa, Mycobacterium
SESPWAVVHFTVRLPAGLRQ

SEQ ID NO: 730746 - protein, 23 aa, Mycobacterium
SESPWRALFGRRQWVEMEQQTAE

SEQ ID NO: 730747 - protein, 20 aa, Mycobacterium
SESQERMCAVVSPENVDAFM

SEQ ID NO: 730748 - protein, 20 aa, Mycobacterium
SESQERMCAVVTPENVDAFL

SEQ ID NO: 730749 - protein, 17 aa, Mycobacterium
SESRPGANFEAKPITRP

SEQ ID NO: 730750 - protein, 21 aa, Mycobacterium
SESTGKRWLGSFITTFRFNEV

SEQ ID NO: 730751 - protein, 24 aa, Mycobacterium
SESVRRLGLEPGVVAVAVVKATTV

SEQ ID NO: 730752 - protein, 24 aa, Mycobacterium
SESYLRGGWWRAHVVGPEPYSGID

SEQ ID NO: 730753 - protein, 25 aa, Mycobacterium
SETAANFWVGLAILHSLFMREHNTI

SEQ ID NO: 730754 - protein, 23 aa, Mycobacterium
SETARFQFPVAKYGIALDNWSIR

SEQ ID NO: 730755 - protein, 21 aa, Mycobacterium
SETASRVLASFGPAIPDRTDV

SEQ ID NO: 730756 - protein, 23 aa, Mycobacterium
SETCYWTDAVAFRGEYEGRETPN

SEQ ID NO: 730757 - protein, 25 aa, Mycobacterium
SETDRSLAFVMSRVLGPAGLQAFVG

SEQ ID NO: 730758 - protein, 17 aa, Mycobacterium
SETELWQLAFEVVNGYR

SEQ ID NO: 730759 - protein, 24 aa, Mycobacterium
SETFPDARILAAFGQTEMSPVTCM

SEQ ID NO: 730760 - protein, 20 aa, Mycobacterium
SETFVEFGVGCYQEANTRFL

SEQ ID NO: 730761 - protein, 19 aa, Mycobacterium
SETIPEFLAALQTPRRVLI

SEQ ID NO: 730762 - protein, 22 aa, Mycobacterium
SETLKKVFLELGGKSAAIILDD

SEQ ID NO: 730763 - protein, 17 aa, Mycobacterium
SETNLKTATVVGAAPGG

SEQ ID NO: 730764 - protein, 18 aa, Mycobacterium
SETPRLVVLSRLVPHKQI

SEQ ID NO: 730765 - protein, 17 aa, Mycobacterium
SETQAGKGSLRYDHPQS

SEQ ID NO: 730766 - protein, 20 aa, Mycobacterium
SETRLPVWFSAGRDTTAARG

SEQ ID NO: 730767 - protein, 21 aa, Mycobacterium
SETRLPVWFSAGRDTTAARGL

SEQ ID NO: 730768 - protein, 25 aa, Mycobacterium
SETRPGDAKPVLVWLHGGAYVLGSS

SEQ ID NO: 730769 - protein, 25 aa, Mycobacterium
SETTGLRFPLFVKAVAGGGGRGMRR

SEQ ID NO: 730770 - protein, 20 aa, Mycobacterium
SETVKRVFLELGGKSAAIIL

SEQ ID NO: 730771 - protein, 20 aa, Mycobacterium
SETYGLIVYQEQIMFIAQKV

SEQ ID NO: 730772 - protein, 29 aa, Mycobacterium
SEVAELPRILGPHGRHMFHLFEGTTSSVL

SEQ ID NO: 730773 - protein, 21 aa, Mycobacterium
SEVAGRLAAQVGAYHLMTPVG

SEQ ID NO: 730774 - protein, 19 aa, Mycobacterium
SEVAIVCQLARAVLGPEHR

SEQ ID NO: 730775 - protein, 25 aa, Mycobacterium
SEVALKDPRLAGIHFTGSTATFQHL

SEQ ID NO: 730776 - protein, 30 aa, Mycobacterium
SEVARLWPFADLTPFAAFGWEARGGYGDAY

SEQ ID NO: 730777 - protein, 17 aa, Mycobacterium
SEVEAAGILASGIAELT

SEQ ID NO: 730778 - protein, 21 aa, Mycobacterium
SEVFRDHFLTCFISDKVGVAL

SEQ ID NO: 730779 - protein, 26 aa, Mycobacterium
SEVGKLRKVLVCSPGLAHERLTPTNC

SEQ ID NO: 730780 - protein, 28 aa, Mycobacterium
SEVGKRPPGHLWRWELRPLDDDRTQVTH

SEQ ID NO: 730781 - protein, 19 aa, Mycobacterium
SEVGPALHRLMRGADGRVI

SEQ ID NO: 730782 - protein, 23 aa, Mycobacterium
SEVGPKPGGPRRVALVGKPNVGK

SEQ ID NO: 730783 - protein, 22 aa, Mycobacterium
SEVIEFHGLFTVSLAELRQTSE

SEQ ID NO: 730784 - protein, 17 aa, Mycobacterium
SEVKAAVTGSGRADKSQ

SEQ ID NO: 730785 - protein, 22 aa, Mycobacterium
SEVKELLRRNAVAPLGDVLERE

SEQ ID NO: 730786 - protein, 21 aa, Mycobacterium
SEVKFPGTGALRLCTLDEVDV

SEQ ID NO: 730787 - protein, 23 aa, Mycobacterium
SEVKRFVPGFVHDPALIDRHGVN

SEQ ID NO: 730788 - protein, 26 aa, Mycobacterium
SEVLPLRIPLLLAATGPKGAGVAKRV

SEQ ID NO: 730789 - protein, 20 aa, Mycobacterium
SEVLYRLHLDLASLSIAEFY

SEQ ID NO: 730790 - protein, 18 aa, Mycobacterium
SEVPWRQPIPSLNYLLTS

SEQ ID NO: 730791 - protein, 17 aa, Mycobacterium
SEVQVFGQLLVLERQDD

SEQ ID NO: 730792 - protein, 25 aa, Mycobacterium
SEVRHGFVKVFCRRSTGVVIGGVVV

SEQ ID NO: 730793 - protein, 18 aa, Mycobacterium
SEVRLSLGAGMGVGKDGL

SEQ ID NO: 730794 - protein, 34 aa, Mycobacterium
SEVRMGMRVEAVWKPKDEWGLGIDNISHFRPTGE

SEQ ID NO: 730795 - protein, 20 aa, Mycobacterium
SEVVIDFPVSRRVEPESMTF

SEQ ID NO: 730796 - protein, 17 aa, Mycobacterium
SEVWTFNGAIIPNIGLN

SEQ ID NO: 730797 - protein, 17 aa, Mycobacterium
SEVYGRADDPCALGSVK

SEQ ID NO: 730798 - protein, 19 aa, Mycobacterium
SEWFPLRNAIFTLPAVKGN

SEQ ID NO: 730799 - protein, 19 aa, Mycobacterium
SEWGICGVGLLANDRRMAE

SEQ ID NO: 730800 - protein, 21 aa, Mycobacterium
SEWPPAGAVRVEISDAYEQLA

SEQ ID NO: 730801 - protein, 24 aa, Mycobacterium
SEWTDIMMGAAFGFVDKGFAGRVG

SEQ ID NO: 730802 - protein, 25 aa, Mycobacterium
SEWTRACAYDFLIPGRGVAVLLADG

SEQ ID NO: 730803 - protein, 18 aa, Mycobacterium
SEYAKPFATLAIADLLGV

SEQ ID NO: 730804 - protein, 17 aa, Mycobacterium
SEYEKLGSAAGFYDDYQ

SEQ ID NO: 730805 - protein, 17 aa, Mycobacterium
SEYEVWQTSLLNPDFAA

SEQ ID NO: 730806 - protein, 23 aa, Mycobacterium
SEYKLYECMQCGFQYDEALGWPE

SEQ ID NO: 730807 - protein, 21 aa, Mycobacterium
SEYRGRYGLSVRALTKWHRPR

SEQ ID NO: 730808 - protein, 17 aa, Mycobacterium
SEYRPVTDILRTEGRFE

SEQ ID NO: 730809 - protein, 17 aa, Mycobacterium
SEYSFARLRELIIERLP

SEQ ID NO: 730810 - protein, 24 aa, Mycobacterium
SFAACQALLRKGRGQWAPVQDAWE

SEQ ID NO: 730811 - protein, 18 aa, Mycobacterium
SFAARVAPFNVNFRYVKN

SEQ ID NO: 730812 - protein, 17 aa, Mycobacterium
SFADFLRREDLVLRADL

SEQ ID NO: 730813 - protein, 20 aa, Mycobacterium
SFADGDWRGKSPIFTGEDYL

SEQ ID NO: 730814 - protein, 19 aa, Mycobacterium
SFADMAGAVLAARGDDRPV

SEQ ID NO: 730815 - protein, 18 aa, Mycobacterium
SFAEAAAVPVVFLTALFG

SEQ ID NO: 730816 - protein, 17 aa, Mycobacterium
SFAEVPAGWRVVFGEST

SEQ ID NO: 730817 - protein, 26 aa, Mycobacterium
SFAGADFELGMMWREVHRLRQPVLLI

SEQ ID NO: 730818 - protein, 33 aa, Mycobacterium
SFAGPCFHSARWDHSVPYIGKRVGLIGTGSSGV

SEQ ID NO: 730819 - protein, 25 aa, Mycobacterium
SFAGQAVGFGGWYSPIALHVESDSI

SEQ ID NO: 730820 - protein, 26 aa, Mycobacterium
SFAGQAVGFGGWYSPIALHVVGDTLE

SEQ ID NO: 730821 - protein, 25 aa, Mycobacterium
SFAGQGVGFGGWYAPVALHVDSASV

SEQ ID NO: 730822 - protein, 19 aa, Mycobacterium
SFAGRYVAFDGVRANPKPQ

SEQ ID NO: 730823 - protein, 20 aa, Mycobacterium
SFAICCATILDMGSEEQKQT

SEQ ID NO: 730824 - protein, 30 aa, Mycobacterium
SFAKKWVTECIRAAYPLGRGHGPVSPLFRL

SEQ ID NO: 730825 - protein, 17 aa, Mycobacterium
SFALRSGLTIRELIDRN

SEQ ID NO: 730826 - protein, 18 aa, Mycobacterium
SFALVGFARRDWANEDFG

SEQ ID NO: 730827 - protein, 24 aa, Mycobacterium
SFANNGGPGRDGADGGDGGAGGFI

SEQ ID NO: 730828 - protein, 19 aa, Mycobacterium
SFAPMPYQPVGEGAEGLST

SEQ ID NO: 730829 - protein, 34 aa, Mycobacterium
SFAPVYRPPWDSFPRSEPYVVVLVRLDEGPQLLA

SEQ ID NO: 730830 - protein, 23 aa, Mycobacterium
SFAQFCTRCILLTRTAPGHEGIT

SEQ ID NO: 730831 - protein, 24 aa, Mycobacterium
SFAREGGVASALWAGPEHLGGARR

SEQ ID NO: 730832 - protein, 24 aa, Mycobacterium
SFASGRIAYTLGLHGPAVTVDTAC

SEQ ID NO: 730833 - protein, 20 aa, Mycobacterium
SFASVTAGLAEQAWQGPAAA

SEQ ID NO: 730834 - protein, 20 aa, Mycobacterium
SFATRLAQLMGRVRATDGAV

SEQ ID NO: 730835 - protein, 18 aa, Mycobacterium
SFATWDCAVAGLLDLDPA

SEQ ID NO: 730836 - protein, 20 aa, Mycobacterium
SFAVLRPGGRLVTLSAPPPA

SEQ ID NO: 730837 - protein, 18 aa, Mycobacterium
SFAWTHRNNRGFGLDLRS

SEQ ID NO: 730838 - protein, 25 aa, Mycobacterium
SFDAAWCLGVLCTTPAQTELLEELH

SEQ ID NO: 730839 - protein, 19 aa, Mycobacterium
SFDALRRALPHRRGLVVLS

SEQ ID NO: 730840 - protein, 18 aa, Mycobacterium
SFDEAFKLVKVNPLAAWT

SEQ ID NO: 730841 - protein, 26 aa, Mycobacterium
SFDEIFRKAGFRFAGYLVDESIYTEY

SEQ ID NO: 730842 - protein, 29 aa, Mycobacterium
SFDEPHIWRSRGGGFVFFAGARGDASFAD

SEQ ID NO: 730843 - protein, 19 aa, Mycobacterium
SFDFSVWEIFGALLRGRRL

SEQ ID NO: 730844 - protein, 23 aa, Mycobacterium
SFDGERILGAILFEDTMDRQIEG

SEQ ID NO: 730845 - protein, 20 aa, Mycobacterium
SFDGVEAWPSLIAANAAGEI

SEQ ID NO: 730846 - protein, 18 aa, Mycobacterium
SFDHDLYQIHVFAVAVDP

SEQ ID NO: 730847 - protein, 21 aa, Mycobacterium
SFDHPDYFLVVVDHSGADITT

SEQ ID NO: 730848 - protein, 19 aa, Mycobacterium
SFDLPGITTQSIFVNNITT

SEQ ID NO: 730849 - protein, 23 aa, Mycobacterium
SFDPCLPCGVHMYLGKGKTLERL

SEQ ID NO: 730850 - protein, 24 aa, Mycobacterium
SFDPCLPCGVHMYLGKGKTLERLH

SEQ ID NO: 730851 - protein, 19 aa, Mycobacterium
SFDQLRVLKTIGLLNLVSS

SEQ ID NO: 730852 - protein, 23 aa, Mycobacterium
SFDRPSPRLLGYRDHHDTRPWSV

SEQ ID NO: 730853 - protein, 24 aa, Mycobacterium
SFEAADVRALWPAPGPHDDKYTQG

SEQ ID NO: 730854 - protein, 18 aa, Mycobacterium
SFEHPGLDRVLQWDPRFA

SEQ ID NO: 730855 - protein, 20 aa, Mycobacterium
SFEINDSWAAVAERSIAQLT

SEQ ID NO: 730856 - protein, 20 aa, Mycobacterium
SFEPKPDWKNPFSYQPEIWD

SEQ ID NO: 730857 - protein, 19 aa, Mycobacterium
SFEPNPGWTRTYSGSAEIL

SEQ ID NO: 730858 - protein, 23 aa, Mycobacterium
SFEPVAIVGMGCRYPGGLASGDA

SEQ ID NO: 730859 - protein, 18 aa, Mycobacterium
SFEPVTLAGYLAAHTERI

SEQ ID NO: 730860 - protein, 20 aa, Mycobacterium
SFEVRAGRTLAIVGESGSGK

SEQ ID NO: 730861 - protein, 22 aa, Mycobacterium
SFEWLIGAEDWFQRAVDRGDVD

SEQ ID NO: 730862 - protein, 18 aa, Mycobacterium
SFFARGFGTGVRHRSAAV

SEQ ID NO: 730863 - protein, 22 aa, Mycobacterium
SFFDSATSFAMIRGGHVDVAVL

SEQ ID NO: 730864 - protein, 18 aa, Mycobacterium
SFFGRRAGAHAARRAGGV

SEQ ID NO: 730865 - protein, 24 aa, Mycobacterium
SFFLREAQRPVLLLAGGTGLAPIL

SEQ ID NO: 730866 - protein, 20 aa, Mycobacterium
SFFPPMAGLWADDKTLADGV

SEQ ID NO: 730867 - protein, 19 aa, Mycobacterium
SFGAKGYRITAADQLLPTL

SEQ ID NO: 730868 - protein, 25 aa, Mycobacterium
SFGARGWAPQGFYFADPDGNVVEAR

SEQ ID NO: 730869 - protein, 20 aa, Mycobacterium
SFGARGWAPQGYYFADPDGN

SEQ ID NO: 730870 - protein, 23 aa, Mycobacterium
SFGASPRASLGIIAASRSLALVR

SEQ ID NO: 730871 - protein, 24 aa, Mycobacterium
SFGDERLDALIGFVGDLVAGITNA

SEQ ID NO: 730872 - protein, 20 aa, Mycobacterium
SFGDGIVWAVVDSGIEKRHP

SEQ ID NO: 730873 - protein, 19 aa, Mycobacterium
SFGEDRIAVRFQYESRDAT

SEQ ID NO: 730874 - protein, 18 aa, Mycobacterium
SFGELQPFADRIRAGGVP

SEQ ID NO: 730875 - protein, 24 aa, Mycobacterium
SFGGDRVLAAILFEQTMDRTIEGK

SEQ ID NO: 730876 - protein, 26 aa, Mycobacterium
SFGKWTRRAWMGAGYLVARTLDADGT

SEQ ID NO: 730877 - protein, 26 aa, Mycobacterium
SFGKWTRRAWMGAGYLVARTLDADGV

SEQ ID NO: 730878 - protein, 23 aa, Mycobacterium
SFGLPEVKRGLIAGAGGVFRIVE

SEQ ID NO: 730879 - protein, 23 aa, Mycobacterium
SFGRPIWKHQAVGHYLADMATKL

SEQ ID NO: 730880 - protein, 25 aa, Mycobacterium
SFGSGPFRNVICLSVNDAVLHGLPH

SEQ ID NO: 730881 - protein, 18 aa, Mycobacterium
SFGSIVTLFRLLDGPNRY

SEQ ID NO: 730882 - protein, 20 aa, Mycobacterium
SFGSQRIWEDVTFDLPAGEV

SEQ ID NO: 730883 - protein, 24 aa, Mycobacterium
SFHAPEFTIAWPTGEIGGMGLEGA

SEQ ID NO: 730884 - protein, 23 aa, Mycobacterium
SFHDLEYWRPLWQALVDTETVMN

SEQ ID NO: 730885 - protein, 24 aa, Mycobacterium
SFHELFIGGRWCKPTIAEPITVIS

SEQ ID NO: 730886 - protein, 23 aa, Mycobacterium
SFHGDFEFGQALYSYDLEADDLA

SEQ ID NO: 730887 - protein, 19 aa, Mycobacterium
SFHSSRWDYDYTGGDSNGG

SEQ ID NO: 730888 - protein, 21 aa, Mycobacterium
SFIDERPHLLAAHTPADRGSR

SEQ ID NO: 730889 - protein, 24 aa, Mycobacterium
SFIECAKAGVELSTFETGGAGLPP

SEQ ID NO: 730890 - protein, 23 aa, Mycobacterium
SFIEERPQLLTARSSADRGTKIL

SEQ ID NO: 730891 - protein, 23 aa, Mycobacterium
SFIEGRAAMFAGLADSTLSRDDG

SEQ ID NO: 730892 - protein, 18 aa, Mycobacterium
SFIGIQFLLDEAIPCPQT

SEQ ID NO: 730893 - protein, 18 aa, Mycobacterium
SFIGPRFTMFGPTVTTWR

SEQ ID NO: 730894 - protein, 19 aa, Mycobacterium
SFIKIPPDRRYPGDWRVIR

SEQ ID NO: 730895 - protein, 17 aa, Mycobacterium
SFINVLLELGADHPAGR

SEQ ID NO: 730896 - protein, 25 aa, Mycobacterium
SFIPACGSCRFCVNGQSYICDIGAS

SEQ ID NO: 730897 - protein, 24 aa, Mycobacterium
SFIPSLGWINSWINYGINWVNSLI

SEQ ID NO: 730898 - protein, 24 aa, Mycobacterium
SFIRELTDRGGLLVEGARVRRLSH

SEQ ID NO: 730899 - protein, 26 aa, Mycobacterium
SFIRFCDAYNLPLVFVVDTPGALPGV

SEQ ID NO: 730900 - protein, 38 aa, Mycobacterium
SFITATRTRAGWTFSGTISWVSGWGLNTVLTVAAVEPA

SEQ ID NO: 730901 - protein, 24 aa, Mycobacterium
SFITRRMGVALARDEDVDTARRNA

SEQ ID NO: 730902 - protein, 21 aa, Mycobacterium
SFIVPREHPGVIVERLEHKLG

SEQ ID NO: 730903 - protein, 18 aa, Mycobacterium
SFKARYAQTPNQGVGAEM

SEQ ID NO: 730904 - protein, 23 aa, Mycobacterium
SFKHITESGGRVFLELEERSQVG

SEQ ID NO: 730905 - protein, 26 aa, Mycobacterium
SFKVLLKELQSLCLNVEVLSSDGAAI

SEQ ID NO: 730906 - protein, 20 aa, Mycobacterium
SFLDARKIPVSAEWDRINGG

SEQ ID NO: 730907 - protein, 17 aa, Mycobacterium
SFLEKRPPQFPSLNSTD

SEQ ID NO: 730908 - protein, 24 aa, Mycobacterium
SFLLRLGGIRALGFSPELVTAVSP

SEQ ID NO: 730909 - protein, 23 aa, Mycobacterium
SFLLRLGGIRALGYSPELVTAVE

SEQ ID NO: 730910 - protein, 26 aa, Mycobacterium
SFLLRLSGIRALGFSPELVAAVHADG

SEQ ID NO: 730911 - protein, 17 aa, Mycobacterium
SFLNLWWYLTEQRKERS

SEQ ID NO: 730912 - protein, 25 aa, Mycobacterium
SFLPACGRCRFCSTGHQNLCDLGAM

SEQ ID NO: 730913 - protein, 27 aa, Mycobacterium
SFLPACGRCRWCATGRQNLCDYGAIIL

SEQ ID NO: 730914 - protein, 24 aa, Mycobacterium
SFLPDARQKFGIDVDDIRAVNPSI

SEQ ID NO: 730915 - protein, 17 aa, Mycobacterium
SFLQGFRAFFAESAADP

SEQ ID NO: 730916 - protein, 25 aa, Mycobacterium
SFLRDFPEDFTYVLSLQEASALAMA

SEQ ID NO: 730917 - protein, 17 aa, Mycobacterium
SFLRHGITTIKSVGDPT

SEQ ID NO: 730918 - protein, 26 aa, Mycobacterium
SFLRPWQATTPLVFVDRMPGRLVADS

SEQ ID NO: 730919 - protein, 27 aa, Mycobacterium
SFLRYGKDGSVMACVFNFAGAEHGGYR

SEQ ID NO: 730920 - protein, 35 aa, Mycobacterium
SFLSDPRVSLGLLDGAGGLLLWPLLTSLSAAKEHL

SEQ ID NO: 730921 - protein, 23 aa, Mycobacterium
SFLSTSRYAEWLFHDADMTSTYE

SEQ ID NO: 730922 - protein, 21 aa, Mycobacterium
SFLSWDRPPIPVVTSAEYRAE

SEQ ID NO: 730923 - protein, 18 aa, Mycobacterium
SFLTTLRDDGVRRLALRA

SEQ ID NO: 730924 - protein, 17 aa, Mycobacterium
SFMRHARAKVLGGCSSH

SEQ ID NO: 730925 - protein, 24 aa, Mycobacterium
SFNDAVGGLGSRVAGVLSGAVGGE

SEQ ID NO: 730926 - protein, 24 aa, Mycobacterium
SFNEQRLAANIAEYHGIPAAALHF

SEQ ID NO: 730927 - protein, 29 aa, Mycobacterium
SFNNELGHPWTVLRAGRDTDYLILEMSAR

SEQ ID NO: 730928 - protein, 24 aa, Mycobacterium
SFNNELGHPWTVLRATESTDYLVL

SEQ ID NO: 730929 - protein, 24 aa, Mycobacterium
SFNNELGHPWTVLRATESTKFLVL

SEQ ID NO: 730930 - protein, 26 aa, Mycobacterium
SFNNELGHPWTVLRATPETDFLVLEM

SEQ ID NO: 730931 - protein, 29 aa, Mycobacterium
SFNNELGHPWTVLRATRDTDFLVLEMSAR

SEQ ID NO: 730932 - protein, 30 aa, Mycobacterium
SFNNELGHPWTVLRATRRTDYLVLEMSARH

SEQ ID NO: 730933 - protein, 24 aa, Mycobacterium
SFNRGELPPTDWVMIDHRRGTPFT

SEQ ID NO: 730934 - protein, 17 aa, Mycobacterium
SFNRGGLSGSVFEMDDR

SEQ ID NO: 730935 - protein, 26 aa, Mycobacterium
SFNYLRSDDRWVWSDAVAAMHGYAPG

SEQ ID NO: 730936 - protein, 22 aa, Mycobacterium
SFPEETFPVIVALLTNVFDGAA

SEQ ID NO: 730937 - protein, 20 aa, Mycobacterium
SFPGWGVWLNGARVVDTEEL

SEQ ID NO: 730938 - protein, 24 aa, Mycobacterium
SFPHRGRGIALMRGLMHDVTISPD

SEQ ID NO: 730939 - protein, 17 aa, Mycobacterium
SFPMGCNVFYPEEMPER

SEQ ID NO: 730940 - protein, 18 aa, Mycobacterium
SFPQAGFDEGVRRFVTAL

SEQ ID NO: 730941 - protein, 23 aa, Mycobacterium
SFPRSEPYVVVLVRLDEGPQLLA

SEQ ID NO: 730942 - protein, 19 aa, Mycobacterium
SFPRTEWSRAVKRALANAP

SEQ ID NO: 730943 - protein, 25 aa, Mycobacterium
SFPVTDWPDISWRDSDQLIHLDALT

SEQ ID NO: 730944 - protein, 18 aa, Mycobacterium
SFQLYWAPSLRPEAGVVL

SEQ ID NO: 730945 - protein, 17 aa, Mycobacterium
SFQPSVTVPVDLEGARK

SEQ ID NO: 730946 - protein, 19 aa, Mycobacterium
SFRAIKHIRDLQRQKASGL

SEQ ID NO: 730947 - protein, 20 aa, Mycobacterium
SFRGEVLRILAGVDGEIRRF

SEQ ID NO: 730948 - protein, 20 aa, Mycobacterium
SFRGPGVRNSVMFGPPGHLY

SEQ ID NO: 730949 - protein, 19 aa, Mycobacterium
SFRPGCSPDRRCAGIADRT

SEQ ID NO: 730950 - protein, 23 aa, Mycobacterium
SFSDADWDAIAGIGPALNRTVEQ

SEQ ID NO: 730951 - protein, 18 aa, Mycobacterium
SFSEAVHVIGRFASTDAL

SEQ ID NO: 730952 - protein, 23 aa, Mycobacterium
SFSECGRGLVVDEVDGDMLAVLR

SEQ ID NO: 730953 - protein, 22 aa, Mycobacterium
SFSFEPRSTWDRLFSQQPEIFD

SEQ ID NO: 730954 - protein, 19 aa, Mycobacterium
SFSGRLWGAPERLYSPNGI

SEQ ID NO: 730955 - protein, 37 aa, Mycobacterium
SFSGSDFELGMMWREVYRLRQPVLLIWGREDRVNPLD

SEQ ID NO: 730956 - protein, 18 aa, Mycobacterium
SFSHGRDWGSPKIPEEMS

SEQ ID NO: 730957 - protein, 18 aa, Mycobacterium
SFSKEVREEWTWSQRYPA

SEQ ID NO: 730958 - protein, 24 aa, Mycobacterium
SFSLALLLATERLKVIAAVHPGLW

SEQ ID NO: 730959 - protein, 25 aa, Mycobacterium
SFTDPLRADWLWRVVGEQAHVAVVE

SEQ ID NO: 730960 - protein, 27 aa, Mycobacterium
SFTELCARAGLDLALDCAPALADVDPG

SEQ ID NO: 730961 - protein, 34 aa, Mycobacterium; identical to SEQ ID NO: 328902

SEQ ID NO: 730962 - protein, 23 aa, Mycobacterium
SFTYDSDHPLAFAAQDNGATPVE

SEQ ID NO: 730963 - protein, 18 aa, Mycobacterium
SFVAALADRCGLTAEPDT

SEQ ID NO: 730964 - protein, 18 aa, Mycobacterium
SFVAASFDEYLAQLVPTD

SEQ ID NO: 730965 - protein, 23 aa, Mycobacterium
SFVDDFVLYWGFLALAQVRGGRH

SEQ ID NO: 730966 - protein, 18 aa, Mycobacterium
SFVDRLLVDFDVVDLLTE

SEQ ID NO: 730967 - protein, 22 aa, Mycobacterium
SFVEGRAAMFAGLADSTLSRDD

SEQ ID NO: 730968 - protein, 29 aa, Mycobacterium
SFVLKHSPLKLCWVPGYSDYYPETPGGKP

SEQ ID NO: 730969 - protein, 25 aa, Mycobacterium
SFVNRRMGVALAFADDVDTARRNAA

SEQ ID NO: 730970 - protein, 26 aa, Mycobacterium
SFVNSRPKPLAAYLFTKAKAVRERVI

SEQ ID NO: 730971 - protein, 18 aa, Mycobacterium
SFVQKVCHEQLTHWLEAN

SEQ ID NO: 730972 - protein, 18 aa, Mycobacterium
SFVSWSEHITAGAQVGAA

SEQ ID NO: 730973 - protein, 18 aa, Mycobacterium
SFVVKPMVFPGGTIGDLA

SEQ ID NO: 730974 - protein, 23 aa, Mycobacterium
SFWGSLLPAVWSFMLALRSRGLG

SEQ ID NO: 730975 - protein, 18 aa, Mycobacterium
SFWIGRKFAITTLALPAR

SEQ ID NO: 730976 - protein, 19 aa, Mycobacterium
SFYARWRDLMNTKAWHEEH

SEQ ID NO: 730977 - protein, 23 aa, Mycobacterium
SFYLKLYPRPAVCGTSVYVYPFE

SEQ ID NO: 730978 - protein, 18 aa, Mycobacterium
SFYNAGLRLLKRVKEARE

SEQ ID NO: 730979 - protein, 25 aa, Mycobacterium
SGAAKLGHAVGYRYSHDHPDGVVAQ

SEQ ID NO: 730980 - protein, 23 aa, Mycobacterium
SGAAVLRGWQRRALVKYLAGQPR

SEQ ID NO: 730981 - protein, 20 aa, Mycobacterium
SGACRGCLAANSTLRDRLQR

SEQ ID NO: 730982 - protein, 24 aa, Mycobacterium
SGADGAAGGWLLGDGGAGGSAPLF

SEQ ID NO: 730983 - protein, 19 aa, Mycobacterium
SGADGAWALAATLFHDASR

SEQ ID NO: 730984 - protein, 25 aa, Mycobacterium
SGADGTPGGWLLGDGGAGGSGLAGR

SEQ ID NO: 730985 - protein, 19 aa, Mycobacterium
SGADGWRDVIDVNLTGVYH

SEQ ID NO: 730986 - protein, 18 aa, Mycobacterium
SGADIVLLDLMLPGMSGT

SEQ ID NO: 730987 - protein, 19 aa, Mycobacterium
SGADLDWAAAFAGLAAHRV

SEQ ID NO: 730988 - protein, 21 aa, Mycobacterium
SGADLPRGWGVDVGPGRYRLR

SEQ ID NO: 730989 - protein, 17 aa, Mycobacterium
SGADYRGWIDGIASDVG

SEQ ID NO: 730990 - protein, 17 aa, Mycobacterium
SGADYRSWIDGIAGGVG

SEQ ID NO: 730991 - protein, 17 aa, Mycobacterium
SGAEAANASFLQDPLQT

SEQ ID NO: 730992 - protein, 27 aa, Mycobacterium
SGAEMGMSYHLPRIVGAGVAADWMLTG

SEQ ID NO: 730993 - protein, 30 aa, Mycobacterium
SGAEMGMSYHLPRIVGTSVAADWMLTGRTV

SEQ ID NO: 730994 - protein, 31 aa, Mycobacterium
SGAEMGMSYHLPRIVGTSVAADWMLTGRTVS

SEQ ID NO: 730995 - protein, 19 aa, Mycobacterium
SGAEWRLQADFDGSGIDER

SEQ ID NO: 730996 - protein, 25 aa, Mycobacterium
SGAFLAKLGCSYVIVGHSERRTYHN

SEQ ID NO: 730997 - protein, 18 aa, Mycobacterium
SGAFLRALGSRYRSNALA

SEQ ID NO: 730998 - protein, 19 aa, Mycobacterium
SGAFPGLRITGSGVEILDA

SEQ ID NO: 730999 - protein, 17 aa, Mycobacterium
SGAGCGRIVLSSRSQPT

SEQ ID NO: 731000 - protein, 18 aa, Mycobacterium
SGAGKRDGVLRWWAGPWP

SEQ ID NO: 731001 - protein, 20 aa, Mycobacterium
SGAGRFGIRGLLPYSVAKGG

SEQ ID NO: 731002 - protein, 23 aa, Mycobacterium
SGAGRKAAAMNFVPGADWSERAV

SEQ ID NO: 731003 - protein, 24 aa, Mycobacterium
SGAGVCRDYAHLVVALLRAVKVPA

SEQ ID NO: 731004 - protein, 18 aa, Mycobacterium
SGAHGARMTGGGFGGSVI

SEQ ID NO: 731005 - protein, 20 aa, Mycobacterium
SGAHKWVRHIAIVDFENTQR

SEQ ID NO: 731006 - protein, 20 aa, Mycobacterium
SGAHYCARGLATVRTDPDAP

SEQ ID NO: 731007 - protein, 20 aa, Mycobacterium
SGAIANLFSVYGRECQAVLA

SEQ ID NO: 731008 - protein, 20 aa, Mycobacterium
SGAIGWYFGNPGAFSYSHVL

SEQ ID NO: 731009 - protein, 17 aa, Mycobacterium
SGAIPPHLGRRMGLRPS

SEQ ID NO: 731010 - protein, 24 aa, Mycobacterium
SGAKGLRLRGFRGSEFDFKLTERL

SEQ ID NO: 731011 - protein, 21 aa, Mycobacterium
SGALDEMRFMAGAQRALQGPL

SEQ ID NO: 731012 - protein, 17 aa, Mycobacterium
SGALLPGVTRKSLLQLA

SEQ ID NO: 731013 - protein, 18 aa, Mycobacterium
SGALPALVHTHPSETVRD

SEQ ID NO: 731014 - protein, 22 aa, Mycobacterium
SGALPVMVWIPGGAFVYGAGQL

SEQ ID NO: 731015 - protein, 19 aa, Mycobacterium
SGAMFKAPLAVPAKSDAQT

SEQ ID NO: 731016 - protein, 17 aa, Mycobacterium
SGAMLRAVWVPSTGQLA

SEQ ID NO: 731017 - protein, 23 aa, Mycobacterium
SGANGGLLYGNGGAGGVGGTGGT

SEQ ID NO: 731018 - protein, 20 aa, Mycobacterium
SGANLVAFARMDGAWLASNE

SEQ ID NO: 731019 - protein, 25 aa, Mycobacterium
SGAPADCGPLYTWSRSPGYNGPPPP

SEQ ID NO: 731020 - protein, 18 aa, Mycobacterium
SGAPEHRAAAIVKATTFY

SEQ ID NO: 731021 - protein, 20 aa, Mycobacterium
SGAPKFPALEAEVLQYWDSD

SEQ ID NO: 731022 - protein, 17 aa, Mycobacterium
SGAPLPTLDDVRAHFER

SEQ ID NO: 731023 - protein, 21 aa, Mycobacterium
SGAPMPGWLAAALAAPASPPR

SEQ ID NO: 731024 - protein, 24 aa, Mycobacterium
SGAPRLVAVAVEIGEPGNAGTLIR

SEQ ID NO: 731025 - protein, 19 aa, Mycobacterium
SGAQCAWLLGEGADVTGLD

SEQ ID NO: 731026 - protein, 20 aa, Mycobacterium
SGAQPVALTAGFILEEGLEI

SEQ ID NO: 731027 - protein, 26 aa, Mycobacterium
SGAQRFCPPRHWLEIGEFDDGTPTRV

SEQ ID NO: 731028 - protein, 17 aa, Mycobacterium
SGARIAALAALAMFAVL

SEQ ID NO: 731029 - protein, 17 aa, Mycobacterium
SGARIQLFAAMVRDGNR

SEQ ID NO: 731030 - protein, 17 aa, Mycobacterium
SGARPEAALADHLLWLD

SEQ ID NO: 731031 - protein, 26 aa, Mycobacterium
SGARPQWLSAGFVIEEGFPIAELREI

SEQ ID NO: 731032 - protein, 18 aa, Mycobacterium
SGARVALVAGDRDIEAGT

SEQ ID NO: 731033 - protein, 17 aa, Mycobacterium
SGARYAGLGIRAAGGNL

SEQ ID NO: 731034 - protein, 18 aa, Mycobacterium
SGASGKVPAAIHVTPEAA

SEQ ID NO: 731035 - protein, 25 aa, Mycobacterium
SGASGSPGGWLLGDGGAGGSGAAGS

SEQ ID NO: 731036 - protein, 17 aa, Mycobacterium
SGASIKLLNHSSHADRT

SEQ ID NO: 731037 - protein, 17 aa, Mycobacterium
SGASLVLIGTHLDGDTI

SEQ ID NO: 731038 - protein, 20 aa, Mycobacterium
SGASTLRWRSTTAANADAEV

SEQ ID NO: 731039 - protein, 17 aa, Mycobacterium
SGASWYEAAELLAAAVR

SEQ ID NO: 731040 - protein, 17 aa, Mycobacterium
SGATLVLHLAAAQVDAI

SEQ ID NO: 731041 - protein, 24 aa, Mycobacterium
SGATVLRAIWGFRAPGRPHGDRFI

SEQ ID NO: 731042 - protein, 20 aa, Mycobacterium
SGAVKDGFVWGRGAIDMKDM

SEQ ID NO: 731043 - protein, 17 aa, Mycobacterium
SGAVVFPGAGFVELAIR

SEQ ID NO: 731044 - protein, 24 aa, Mycobacterium
SGAWCVAADFSVGMLAAGAARNVP

SEQ ID NO: 731045 - protein, 39 aa, Mycobacterium
SGAWKDYTERGGRAFGEFAAFCYHQPFTKMAYKAHKQLA

SEQ ID NO: 731046 - protein, 21 aa, Mycobacterium
SGAWYPTPQFAHLGLGNIGSL

SEQ ID NO: 731047 - protein, 22 aa, Mycobacterium
SGAYVAGWIKRGPSGFIGTNKS

SEQ ID NO: 731048 - protein, 30 aa, Mycobacterium
SGCDIRELRARLGLDSGYLSRLLRALEGAG

SEQ ID NO: 731049 - protein, 17 aa, Mycobacterium
SGCPHNRSTVVPDGSLV

SEQ ID NO: 731050 - protein, 17 aa, Mycobacterium
SGCPIADQLLARVALDE

SEQ ID NO: 731051 - protein, 20 aa, Mycobacterium
SGDDGWRDVIDVNLTGVYNT

SEQ ID NO: 731052 - protein, 20 aa, Mycobacterium
SGDDLPVEWRHRSERYTEKL

SEQ ID NO: 731053 - protein, 21 aa, Mycobacterium
SGDDLRWLILGVHHAASINIA

SEQ ID NO: 731054 - protein, 17 aa, Mycobacterium
SGDEIEALWPMVIARAA

SEQ ID NO: 731055 - protein, 24 aa, Mycobacterium
SGDELDPRLGLSSLLSDVADTVYL

SEQ ID NO: 731056 - protein, 26 aa, Mycobacterium
SGDFDRLREQFGFAGDDVLLGKCLTL

SEQ ID NO: 731057 - protein, 25 aa, Mycobacterium
SGDFEIFRGRWLVEPSPTGSRVSFE

SEQ ID NO: 731058 - protein, 19 aa, Mycobacterium
SGDFFARYIDWRAEHPAND

SEQ ID NO: 731059 - protein, 18 aa, Mycobacterium
SGDFSVWPPSGAEAVRVS

SEQ ID NO: 731060 - protein, 17 aa, Mycobacterium
SGDGAAPQGTWLIGGFD

SEQ ID NO: 731061 - protein, 24 aa, Mycobacterium
SGDGARLCTYCGALGDDDASTCGA

SEQ ID NO: 731062 - protein, 20 aa, Mycobacterium
SGDGGALVRIIAGEIDGHPG

SEQ ID NO: 731063 - protein, 19 aa, Mycobacterium
SGDGHAGSGHTGDNGAPGE

SEQ ID NO: 731064 - protein, 20 aa, Mycobacterium
SGDIEPVGAFTARVDLADYL

SEQ ID NO: 731065 - protein, 21 aa, Mycobacterium
SGDIRPGDDVAIFGIGGVGMG

SEQ ID NO: 731066 - protein, 24 aa, Mycobacterium
SGDKLRHKMAYRHSGYPGGLRKRT

SEQ ID NO: 731067 - protein, 31 aa, Mycobacterium
SGDLAYRDADGWIYLAGRTADWMRVDGENLT

SEQ ID NO: 731068 - protein, 34 aa, Mycobacterium
SGDLAYRDADGWIYLAGRTPDWMRINGENLAAAP

SEQ ID NO: 731069 - protein, 33 aa, Mycobacterium
SGDLAYRDSDGWIYLAGRTADWMRVDGENLAAA

SEQ ID NO: 731070 - protein, 32 aa, Mycobacterium
SGDLAYRDSQGWIYLAGRTADWMRVDGENLAA

SEQ ID NO: 731071 - protein, 30 aa, Mycobacterium
SGDLGYRDTQGWIYLAGRTSDWLRVDGENL

SEQ ID NO: 731072 - protein, 18 aa, Mycobacterium
SGDLLFGTVDSWLLWNLT

SEQ ID NO: 731073 - protein, 20 aa, Mycobacterium
SGDLPAAVTAHAEKALESLD

SEQ ID NO: 731074 - protein, 31 aa, Mycobacterium
SGDLPSWQWESLITKPTRLVAVTAASSTLGT

SEQ ID NO: 731075 - protein, 20 aa, Mycobacterium
SGDLRIRREETWGPVTDGAA

SEQ ID NO: 731076 - protein, 20 aa, Mycobacterium
SGDNGFVYVAPLFTISFTSG

SEQ ID NO: 731077 - protein, 18 aa, Mycobacterium
SGDPEVRQLILLDAPAVL

SEQ ID NO: 731078 - protein, 20 aa, Mycobacterium
SGDPGWADIIFVRHVGSAVL

SEQ ID NO: 731079 - protein, 25 aa, Mycobacterium
SGDPYRLAAQLGMPPWRVQKAQKQA

SEQ ID NO: 731080 - protein, 26 aa, Mycobacterium
SGDPYRLAGELGMPPWRVQKAQKQAR

SEQ ID NO: 731081 - protein, 26 aa, Mycobacterium
SGDPYRLAGELGMPPWRVQKAQKQSR

SEQ ID NO: 731082 - protein, 26 aa, Mycobacterium
SGDPYRLASQLGMPPWRVQKAQKQAR

SEQ ID NO: 731083 - protein, 26 aa, Mycobacterium
SGDRAESLDPWWPELSKPVIGAINGA

SEQ ID NO: 731084 - protein, 27 aa, Mycobacterium
SGDRFPLDCGFRAQGYLMPCFSEAEVQ

SEQ ID NO: 731085 - protein, 29 aa, Mycobacterium
SGDRIVIAFPYRLVDFWRDHRAPAEEDLE

SEQ ID NO: 731086 - protein, 24 aa, Mycobacterium
SGDRPTLFTGVEWLGTASAVGIDA

SEQ ID NO: 731087 - protein, 23 aa, Mycobacterium
SGDVDPSIMWYLWRTANMGVDEI

SEQ ID NO: 731088 - protein, 19 aa, Mycobacterium
SGDVGLIIAVKRLAAAKTR

SEQ ID NO: 731089 - protein, 17 aa, Mycobacterium
SGDVLMVAWMDDAALAR

SEQ ID NO: 731090 - protein, 17 aa, Mycobacterium
SGDVLMVAWMDDDALDR

SEQ ID NO: 731091 - protein, 25 aa, Mycobacterium
SGDVPAMVASPRWSPTGKQVAFVDN

SEQ ID NO: 731092 - protein, 20 aa, Mycobacterium
SGDVVCWQTPNWWEAHVLGL

SEQ ID NO: 731093 - protein, 21 aa, Mycobacterium
SGDYRWAATLLDHAVFTDEHH

SEQ ID NO: 731094 - protein, 18 aa, Mycobacterium
SGEAHWFFRGLLGDSSLF

SEQ ID NO: 731095 - protein, 21 aa, Mycobacterium
SGEAVASWAVSEPGRGWDPVD

SEQ ID NO: 731096 - protein, 24 aa, Mycobacterium
SGEFWTADFARLRAQLDVNVTAVM

SEQ ID NO: 731097 - protein, 21 aa, Mycobacterium
SGEGCVVLLLKRLDDAQRDGD

SEQ ID NO: 731098 - protein, 23 aa, Mycobacterium
SGEGRAAAAERWHTGDYGPDSPM

SEQ ID NO: 731099 - protein, 22 aa, Mycobacterium
SGEGVAAFLERRPAKFANPEGP

SEQ ID NO: 731100 - protein, 18 aa, Mycobacterium
SGEHFRVHQALDLPPSPQ

SEQ ID NO: 731101 - protein, 30 aa, Mycobacterium
SGEIIGSLARQGGLQSAMWAGPESLNRARR

SEQ ID NO: 731102 - protein, 25 aa, Mycobacterium
SGEIPRIPLNLVLLKGVQVLGFQFQ

SEQ ID NO: 731103 - protein, 23 aa, Mycobacterium
SGEIRLVLHGGHIAVNGRRSSES

SEQ ID NO: 731104 - protein, 20 aa, Mycobacterium
SGEIYCLVFHTFAGPEHAVD

SEQ ID NO: 731105 - protein, 21 aa, Mycobacterium
SGELDAAALGAAFADVVGRHE

SEQ ID NO: 731106 - protein, 21 aa, Mycobacterium
SGELEKFQWFVRAHLENSGGQ

SEQ ID NO: 731107 - protein, 19 aa, Mycobacterium
SGELHAMMLDMRRTFDEMV

SEQ ID NO: 731108 - protein, 25 aa, Mycobacterium
SGELLRLPGAFSPLVAKLIQEIGFE

SEQ ID NO: 731109 - protein, 18 aa, Mycobacterium
SGELQFDAFNRLGIKSQW

SEQ ID NO: 731110 - protein, 20 aa, Mycobacterium
SGELQFDAFNTFGIRTQVIN

SEQ ID NO: 731111 - protein, 18 aa, Mycobacterium
SGELQFDVFNWLGIKSQW

SEQ ID NO: 731112 - protein, 24 aa, Mycobacterium
SGELRAELIAGGRSNLTFLVGDDA

SEQ ID NO: 731113 - protein, 18 aa, Mycobacterium
SGEMTLDLRQMWDVLGTG

SEQ ID NO: 731114 - protein, 19 aa, Mycobacterium
SGEPMKISWGPNWDDNLSG

SEQ ID NO: 731115 - protein, 22 aa, Mycobacterium
SGEQIELWAWVGAYDHVALCQL

SEQ ID NO: 731116 - protein, 24 aa, Mycobacterium
SGEQRASNFLLWQAAYAEYVFQDK

SEQ ID NO: 731117 - protein, 31 aa, Mycobacterium
SGEQWCDAQVLKILRRRSLAALRAQVEPVST

SEQ ID NO: 731118 - protein, 23 aa, Mycobacterium
SGEREDLRILLAARRILDQQRTA

SEQ ID NO: 731119 - protein, 25 aa, Mycobacterium
SGERLAVGVPKAFYQLDGQTLVERA

SEQ ID NO: 731120 - protein, 21 aa, Mycobacterium
SGERMPLAGLILNRTHPTLCD

SEQ ID NO: 731121 - protein, 23 aa, Mycobacterium
SGERTGLIDCWPLEVTDAATDPA

SEQ ID NO: 731122 - protein, 18 aa, Mycobacterium
SGESLDEVLDYLGIPVSA

SEQ ID NO: 731123 - protein, 18 aa, Mycobacterium
SGEVPGRRVLDLCTGSGV

SEQ ID NO: 731124 - protein, 25 aa, Mycobacterium
SGEVVKSLPGLLTILHDGGYRDTEI

SEQ ID NO: 731125 - protein, 21 aa, Mycobacterium
SGFACQSFAALSLDPPLVLFC

SEQ ID NO: 731126 - protein, 19 aa, Mycobacterium
SGFALPRRLGASMHQRLDL

SEQ ID NO: 731127 - protein, 19 aa, Mycobacterium
SGFDKNLWERLCAMGATTM

SEQ ID NO: 731128 - protein, 19 aa, Mycobacterium
SGFDVTRPTAWSAEGLLMY

SEQ ID NO: 731129 - protein, 19 aa, Mycobacterium
SGFFAAASLLKFADSQPDR

SEQ ID NO: 731130 - protein, 17 aa, Mycobacterium
SGFFMVPDRDFAMTVLT

SEQ ID NO: 731131 - protein, 19 aa, Mycobacterium
SGFFMVPERNFAMTLLTNS

SEQ ID NO: 731132 - protein, 21 aa, Mycobacterium
SGFGNTGFYNVGFFNTGDNNS

SEQ ID NO: 731133 - protein, 17 aa, Mycobacterium
SGFHVVPVLAYSADPGP

SEQ ID NO: 731134 - protein, 17 aa, Mycobacterium
SGFHVVPVLAYSPDPGP

SEQ ID NO: 731135 - protein, 29 aa, Mycobacterium
SGFLRAIRPELVVPLVTFLASRECTVTHH

SEQ ID NO: 731136 - protein, 20 aa, Mycobacterium
SGFMQAIRPKLVVPLVTFLA

SEQ ID NO: 731137 - protein, 25 aa, Mycobacterium
SGFNLPGVAFGHDWITKADNYAGTL

SEQ ID NO: 731138 - protein, 20 aa, Mycobacterium
SGFNMARVVAVELGYDFLPG

SEQ ID NO: 731139 - protein, 21 aa, Mycobacterium
SGFRSMYFPGVIATVQGETPM

SEQ ID NO: 731140 - protein, 21 aa, Mycobacterium
SGFSAELWLQPGVDQSEALRT

SEQ ID NO: 731141 - protein, 24 aa, Mycobacterium
SGFSLEAPEGVRFLSRGRVFTDEE

SEQ ID NO: 731142 - protein, 19 aa, Mycobacterium
SGFSRSGLIDQLEYDGFTP

SEQ ID NO: 731143 - protein, 24 aa, Mycobacterium
SGFTVYRLHGIFGAAGFSAISNGH

SEQ ID NO: 731144 - protein, 19 aa, Mycobacterium
SGFYSFLNVFKLFGPGNQA

SEQ ID NO: 731145 - protein, 33 aa, Mycobacterium
SGGAAGKCQQVWCPLCALAALVNGEQHPLTTVI

SEQ ID NO: 731146 - protein, 24 aa, Mycobacterium
SGGAGGNGGRLFGDAGAGGSGGAG

SEQ ID NO: 731147 - protein, 20 aa, Mycobacterium
SGGAGGWLSGAGGVGGVGGF

SEQ ID NO: 731148 - protein, 24 aa, Mycobacterium
SGGAIALGHPFGMTGARIATTLLN

SEQ ID NO: 731149 - protein, 23 aa, Mycobacterium
SGGAIALGHPFGMTGARITATLL

SEQ ID NO: 731150 - protein, 28 aa, Mycobacterium
SGGAKGCPKDTWCVINAGNYRGSMNVTD

SEQ ID NO: 731151 - protein, 29 aa, Mycobacterium
SGGANGLLGGGWGPFGGASGGAGGAGGAG

SEQ ID NO: 731152 - protein, 17 aa, Mycobacterium
SGGDASSLIALGGTGGV

SEQ ID NO: 731153 - protein, 26 aa, Mycobacterium
SGGDAWQRADICLAFAQRYAAAFVDL

SEQ ID NO: 731154 - protein, 22 aa, Mycobacterium
SGGDGGSALLFGSGGDGGQGGT

SEQ ID NO: 731155 - protein, 19 aa, Mycobacterium
SGGDLLAADVNGLWVTHNG

SEQ ID NO: 731156 - protein, 21 aa, Mycobacterium
SGGDPEVFAPLIANLSERDPF

SEQ ID NO: 731157 - protein, 24 aa, Mycobacterium
SGGDTCSAWHFAADGVRRPVVVMA

SEQ ID NO: 731158 - protein, 17 aa, Mycobacterium
SGGELLGVGGAGGQGGQ

SEQ ID NO: 731159 - protein, 18 aa, Mycobacterium
SGGEVIRLGLARLLLRRP

SEQ ID NO: 731160 - protein, 22 aa, Mycobacterium
SGGFDHDLAWRKEHQPLVEQDW

SEQ ID NO: 731161 - protein, 20 aa, Mycobacterium
SGGFGTFLLLGHDWAPPAAT

SEQ ID NO: 731162 - protein, 25 aa, Mycobacterium
SGGFGTLLLLGHDWAAPKATFHSYE

SEQ ID NO: 731163 - protein, 22 aa, Mycobacterium
SGGFGTLLLLGHDWASPQATFH

SEQ ID NO: 731164 - protein, 25 aa, Mycobacterium
SGGFLLAFLACFDVGDRVAIASPGY

SEQ ID NO: 731165 - protein, 23 aa, Mycobacterium
SGGFLLTFLACFDAGDRVALASP

SEQ ID NO: 731166 - protein, 25 aa, Mycobacterium
SGGFLLTFLACFDVGDRVAITSPGY

SEQ ID NO: 731167 - protein, 25 aa, Mycobacterium
SGGFLLTFLACFDVGDRVALASPGY

SEQ ID NO: 731168 - protein, 25 aa, Mycobacterium
SGGFLLTFLACFDVGDRVAMASPGY

SEQ ID NO: 731169 - protein, 25 aa, Mycobacterium
SGGFTRIAPALAHRERQIHSGGAGV

SEQ ID NO: 731170 - protein, 25 aa, Mycobacterium
SGGGGLRSRRRWSLGGGGGVVRFRG

SEQ ID NO: 731171 - protein, 21 aa, Mycobacterium
SGGGGMWFPCNPVLLRAGTDD

SEQ ID NO: 731172 - protein, 26 aa, Mycobacterium
SGGGRRLQVCFERGYPAAQIFAPPGE

SEQ ID NO: 731173 - protein, 25 aa, Mycobacterium
SGGGRSEAILSHFVAQIDAEESADL

SEQ ID NO: 731174 - protein, 24 aa, Mycobacterium
SGGHFYGAGLINWWDPEGTRRTLA

SEQ ID NO: 731175 - protein, 25 aa, Mycobacterium
SGGHFYGAGLINWWDPQGARKTLAE

SEQ ID NO: 731176 - protein, 25 aa, Mycobacterium
SGGHFYGAGLINWWDPRGTRKTLEE

SEQ ID NO: 731177 - protein, 23 aa, Mycobacterium
SGGHGGNGGRLWGNGGDGGNGAP

SEQ ID NO: 731178 - protein, 18 aa, Mycobacterium
SGGHSFDGFPVRDDGVLL

SEQ ID NO: 731179 - protein, 25 aa, Mycobacterium
SGGIFRDCAVHDFDALRWITGQNAV

SEQ ID NO: 731180 - protein, 26 aa, Mycobacterium
SGGIFRDCAVHDFDVIRWVTGQNVVE

SEQ ID NO: 731181 - protein, 18 aa, Mycobacterium
SGGIGWGVPAAVGIALGD

SEQ ID NO: 731182 - protein, 19 aa, Mycobacterium
SGGIRFADTQGYAYSRRDV

SEQ ID NO: 731183 - protein, 30 aa, Mycobacterium
SGGIRGPIGLGYRVPCFVISPYSRGGLLAH

SEQ ID NO: 731184 - protein, 31 aa, Mycobacterium
SGGIRGPIGLGYRVPCFVISPYSRGGLMVHD

SEQ ID NO: 731185 - protein, 20 aa, Mycobacterium
SGGLDLFSIKALGGATPVGP

SEQ ID NO: 731186 - protein, 18 aa, Mycobacterium
SGGLFGGGGDGGHGGQGG

SEQ ID NO: 731187 - protein, 22 aa, Mycobacterium
SGGLLGGLFGAGGGNGGTGGGA

SEQ ID NO: 731188 - protein, 19 aa, Mycobacterium
SGGLPAAAFGGRAEVMQKL

SEQ ID NO: 731189 - protein, 19 aa, Mycobacterium
SGGLPAAAFGGRAQVMERL

SEQ ID NO: 731190 - protein, 19 aa, Mycobacterium
SGGLPAAAFGGRTEVMSRL

SEQ ID NO: 731191 - protein, 20 aa, Mycobacterium
SGGLPGHGDGADGVAGTGGK

SEQ ID NO: 731192 - protein, 18 aa, Mycobacterium
SGGLPLILVDGVTAMTGR

SEQ ID NO: 731193 - protein, 17 aa, Mycobacterium
SGGMIVGSGGAGGQGGF

SEQ ID NO: 731194 - protein, 25 aa, Mycobacterium
SGGMRQRVLIAIAFGLNPKLLVADE

SEQ ID NO: 731195 - protein, 30 aa, Mycobacterium
SGGMVRRLELAQALVNRPLLLILDEPTVGL

SEQ ID NO: 731196 - protein, 20 aa, Mycobacterium
SGGNGGWFAGNAGAGGNGGV

SEQ ID NO: 731197 - protein, 19 aa, Mycobacterium
SGGNWAINTGNGYYGGVQF

SEQ ID NO: 731198 - protein, 29 aa, Mycobacterium
SGGPLRYAGWSSCFRREAGSHGKDTRGII

SEQ ID NO: 731199 - protein, 28 aa, Mycobacterium
SGGPLRYAGWSSCFRREAGSYGKDTRGI

SEQ ID NO: 731200 - protein, 18 aa, Mycobacterium
SGGQLKRVGWVLDQTRQS

SEQ ID NO: 731201 - protein, 23 aa, Mycobacterium
SGGQLRLARQLDDIEGYDFVLMD

SEQ ID NO: 731202 - protein, 19 aa, Mycobacterium
SGGQLRLARQLDDTEGYDF

SEQ ID NO: 731203 - protein, 18 aa, Mycobacterium
SGGQRQQLAIARALITSP

SEQ ID NO: 731204 - protein, 33 aa, Mycobacterium
SGGRFAVNVVSGWFKDEFTHLGEPWLEHDERYR

SEQ ID NO: 731205 - protein, 18 aa, Mycobacterium
SGGRFRLGLGSQVKAHIE

SEQ ID NO: 731206 - protein, 25 aa, Mycobacterium
SGGRFVFGVGAGWNIEELRDHGTDP

SEQ ID NO: 731207 - protein, 25 aa, Mycobacterium
SGGRFVFGVGAGWNIEELRHHGTDP

SEQ ID NO: 731208 - protein, 18 aa, Mycobacterium
SGGRFWCRSSPRSSRRSL

SEQ ID NO: 731209 - protein, 17 aa, Mycobacterium
SGGRGGSAVGLIGNGGA

SEQ ID NO: 731210 - protein, 29 aa, Mycobacterium
SGGRMMVTFGVGWLKGEFDALGVPFRERG

SEQ ID NO: 731211 - protein, 19 aa, Mycobacterium
SGGRPAALYHFTDSRLRVT

SEQ ID NO: 731212 - protein, 21 aa, Mycobacterium
SGGRPAALYRFTDAALRVTDE

SEQ ID NO: 731213 - protein, 19 aa, Mycobacterium
SGGRPAALYRFTDDRYRVT

SEQ ID NO: 731214 - protein, 19 aa, Mycobacterium
SGGRPAALYRFTEAAYRVT

SEQ ID NO: 731215 - protein, 24 aa, Mycobacterium
SGGRVTVGVGYGWNTDELADHHVP

SEQ ID NO: 731216 - protein, 22 aa, Mycobacterium
SGGRYRYSLLLDGIEPGGDGTV

SEQ ID NO: 731217 - protein, 27 aa, Mycobacterium
SGGSLRGSFTPIRRLVSYNSDQSPGIE

SEQ ID NO: 731218 - protein, 22 aa, Mycobacterium
SGGTDIRWSGSFSEGVRGTGPV

SEQ ID NO: 731219 - protein, 23 aa, Mycobacterium
SGGTGGAGGWFYGTGGGGGAGGV

SEQ ID NO: 731220 - protein, 20 aa, Mycobacterium
SGGTIFAYWVANPTAYGVVE

SEQ ID NO: 731221 - protein, 21 aa, Mycobacterium
SGGTKLRWRSTTAANDSHEVA

SEQ ID NO: 731222 - protein, 30 aa, Mycobacterium
SGGTRPTLPTVWPGTPYPLGATYDGAGTNF

SEQ ID NO: 731223 - protein, 21 aa, Mycobacterium
SGGTSFARWATLLDERARTAD

SEQ ID NO: 731224 - protein, 24 aa, Mycobacterium
SGGTWCPPNPIAQVVDRNGNEVAV

SEQ ID NO: 731225 - protein, 24 aa, Mycobacterium
SGGYAEFASAPAFLTAHVPDGVSS

SEQ ID NO: 731226 - protein, 21 aa, Mycobacterium
SGGYRIGVRLWQVGSLAPQAR

SEQ ID NO: 731227 - protein, 22 aa, Mycobacterium
SGHAHSVVIPFLLPDIPVVVWW

SEQ ID NO: 731228 - protein, 18 aa, Mycobacterium
SGHAWFLRADGIPAESLL

SEQ ID NO: 731229 - protein, 17 aa, Mycobacterium
SGHCYVQVFAIRDGGPP

SEQ ID NO: 731230 - protein, 22 aa, Mycobacterium
SGHEPQLFRTKARYELTMQAAR

SEQ ID NO: 731231 - protein, 20 aa, Mycobacterium
SGHFTFYFSVDHLHLDATFA

SEQ ID NO: 731232 - protein, 26 aa, Mycobacterium
SGHGEGWALYAERLMAELGWLEDAGN

SEQ ID NO: 731233 - protein, 17 aa, Mycobacterium
SGHGNVGFWNAGSDNVG

SEQ ID NO: 731234 - protein, 20 aa, Mycobacterium
SGHLDWYADGMFPPMQIDAE

SEQ ID NO: 731235 - protein, 24 aa, Mycobacterium
SGHLSSRFWRLLGATTEKNQNRSL

SEQ ID NO: 731236 - protein, 19 aa, Mycobacterium
SGHRARLPDGVADPAYAAD

SEQ ID NO: 731237 - protein, 18 aa, Mycobacterium
SGHRGSALVGAFNEAHIL

SEQ ID NO: 731238 - protein, 20 aa, Mycobacterium
SGHSCWLPTVLCVVDGDHVG

SEQ ID NO: 731239 - protein, 19 aa, Mycobacterium
SGHTWCLDGHGAPRCTRLD

SEQ ID NO: 731240 - protein, 24 aa, Mycobacterium
SGHVSNLLLSRGWSGVGYELNEEA

SEQ ID NO: 731241 - protein, 21 aa, Mycobacterium
SGHYPAFCGTVGPGFADGAVV

SEQ ID NO: 731242 - protein, 21 aa, Mycobacterium
SGHYSFLNVFKLFGPGNQAPL

SEQ ID NO: 731243 - protein, 24 aa, Mycobacterium
SGIADGCVQAGCALLGGETAEHPG

SEQ ID NO: 731244 - protein, 18 aa, Mycobacterium
SGIAGGYCTKLLADGGAE

SEQ ID NO: 731245 - protein, 24 aa, Mycobacterium
SGIAPAVVVTAEFDRLRNEARTYA

SEQ ID NO: 731246 - protein, 20 aa, Mycobacterium
SGIDSGARLVTGGGIPENLP

SEQ ID NO: 731247 - protein, 17 aa, Mycobacterium
SGIDVALALLTPLVGQE

SEQ ID NO: 731248 - protein, 22 aa, Mycobacterium
SGIECFQINPLIKDYNGPACAY

SEQ ID NO: 731249 - protein, 20 aa, Mycobacterium
SGIGAALCRALDRAGAHVVC

SEQ ID NO: 731250 - protein, 26 aa, Mycobacterium
SGIGGAWFLTRIVGVAKAMELTLTSE

SEQ ID NO: 731251 - protein, 18 aa, Mycobacterium
SGIGGHGGAGGLGQVSGG

SEQ ID NO: 731252 - protein, 18 aa, Mycobacterium
SGIGQAVILASGLDARAY

SEQ ID NO: 731253 - protein, 18 aa, Mycobacterium
SGIGRAAAQLMIGEGARV

SEQ ID NO: 731254 - protein, 24 aa, Mycobacterium
SGIGRALALELWREGAKVAISDVD

SEQ ID NO: 731255 - protein, 23 aa, Mycobacterium
SGIGRIHRKLGFNIALPVQPGHG

SEQ ID NO: 731256 - protein, 18 aa, Mycobacterium
SGIGSLLMGIPVDGGLHF

SEQ ID NO: 731257 - protein, 18 aa, Mycobacterium
SGIGSLLMGIPVEGGLRY

SEQ ID NO: 731258 - protein, 18 aa, Mycobacterium
SGINPGFIQLFAVVTAGL

SEQ ID NO: 731259 - protein, 24 aa, Mycobacterium
SGINVCSSAAWITGGKQSPEDLDR

SEQ ID NO: 731260 - protein, 23 aa, Mycobacterium
SGIPGDGTFRVGVDIKAGTYRSA

SEQ ID NO: 731261 - protein, 20 aa, Mycobacterium
SGIPGMPGMAMTGTGRGGVA

SEQ ID NO: 731262 - protein, 23 aa, Mycobacterium
SGIPKAGGVEAILRLDEGPRGLY

SEQ ID NO: 731263 - protein, 25 aa, Mycobacterium
SGIPKAGGVEAIMRLDEGPRGLYSG

SEQ ID NO: 731264 - protein, 36 aa, Mycobacterium
SGIRVLDMTTFWAGPCATHFLAMLGAEVIHVESTRR

SEQ ID NO: 731265 - protein, 35 aa, Mycobacterium
SGIRVLDMTTFWAGPCCTHFLAMLGAEVIHIESTS

SEQ ID NO: 731266 - protein, 36 aa, Mycobacterium
SGIRVLDMTTFWAGPCCTHFLAMLGAEVIHVESTRR

SEQ ID NO: 731267 - protein, 17 aa, Mycobacterium
SGIRVNAVFPGPVETPM

SEQ ID NO: 731268 - protein, 22 aa, Mycobacterium
SGISLPMSLTLPGTANRGNATL

SEQ ID NO: 731269 - protein, 23 aa, Mycobacterium
SGITELPWTLSIFGDGPDRERLQ

SEQ ID NO: 731270 - protein, 24 aa, Mycobacterium
SGIVLVTPLLEWTAGQIAALRGDW

SEQ ID NO: 731271 - protein, 17 aa, Mycobacterium
SGIWAPECAYAPGMEIG

SEQ ID NO: 731272 - protein, 24 aa, Mycobacterium
SGIYPRESPGGWQLIGTTDTVIWD

SEQ ID NO: 731273 - protein, 27 aa, Mycobacterium
SGIYWRPGESGGLLWGMSNPEELPGAA

SEQ ID NO: 731274 - protein, 29 aa, Mycobacterium
SGKAARFVKRFADIGGELRRAAMQYAQEV

SEQ ID NO: 731275 - protein, 17 aa, Mycobacterium
SGKCEILATGLRRAADR

SEQ ID NO: 731276 - protein, 19 aa, Mycobacterium
SGKDWQVWAGDKVADLVQL

SEQ ID NO: 731277 - protein, 18 aa, Mycobacterium
SGKGKRALAAELRTKGVS

SEQ ID NO: 731278 - protein, 21 aa, Mycobacterium
SGKHLRRLAALAAELEAVEVV

SEQ ID NO: 731279 - protein, 21 aa, Mycobacterium
SGKHYRTPLSVFGTDEGVAIL

SEQ ID NO: 731280 - protein, 24 aa, Mycobacterium
SGKKPKDDGLAWVPYGPKDPAFPT

SEQ ID NO: 731281 - protein, 23 aa, Mycobacterium
SGKLVPRKFVAFSPDGNGRMIEM

SEQ ID NO: 731282 - protein, 19 aa, Mycobacterium
SGKMIGRSRLEVVNPAAAA

SEQ ID NO: 731283 - protein, 19 aa, Mycobacterium
SGKMRAVVVNLLIVDGTDY

SEQ ID NO: 731284 - protein, 18 aa, Mycobacterium
SGKMTGRSRLQVVNPEAA

SEQ ID NO: 731285 - protein, 17 aa, Mycobacterium
SGKNVVTPLGWFYPTEK

SEQ ID NO: 731286 - protein, 25 aa, Mycobacterium
SGKQRSRLALWSRRLLGEAITQAQL

SEQ ID NO: 731287 - protein, 18 aa, Mycobacterium
SGKRLVRVDLNEIDDAMQ

SEQ ID NO: 731288 - protein, 21 aa, Mycobacterium
SGKRPLPRRTPYTASKMAVIG

SEQ ID NO: 731289 - protein, 30 aa, Mycobacterium
SGKRRLALDHLPRLAGALSVSTDELLRAPE

SEQ ID NO: 731290 - protein, 28 aa, Mycobacterium
SGKRRLALDHLPRLATALSVTTDDLLRA

SEQ ID NO: 731291 - protein, 23 aa, Mycobacterium
SGKRVACGVIAPATSSSTASSST

SEQ ID NO: 731292 - protein, 24 aa, Mycobacterium
SGKTAKFVRRFGDVGGELHRAATQ

SEQ ID NO: 731293 - protein, 25 aa, Mycobacterium
SGKTQLAMRLGEWFGTDEHGRHRHV

SEQ ID NO: 731294 - protein, 23 aa, Mycobacterium
SGKVQRSRCRARFLDGTLQAQAL

SEQ ID NO: 731295 - protein, 24 aa, Mycobacterium
SGKVQRSRCRARWLDGSLEAQALL

SEQ ID NO: 731296 - protein, 23 aa, Mycobacterium
SGKYRRVLTMAWEKQSESNAMWA

SEQ ID NO: 731297 - protein, 17 aa, Mycobacterium
SGLAAADMGKWRLATVN

SEQ ID NO: 731298 - protein, 18 aa, Mycobacterium
SGLAGRDGGAGGAAGLWG

SEQ ID NO: 731299 - protein, 19 aa, Mycobacterium
SGLARQAAATANNSGTTVS

SEQ ID NO: 731300 - protein, 17 aa, Mycobacterium
SGLCDWIELGDDGRTGT

SEQ ID NO: 731301 - protein, 19 aa, Mycobacterium
SGLDAADFDDLVLAESMQG

SEQ ID NO: 731302 - protein, 26 aa, Mycobacterium
SGLDARAWRLDWPRDAVLFELDLPRV

SEQ ID NO: 731303 - protein, 28 aa, Mycobacterium
SGLDARAYRLAWPAGTVVYEVDMPEVIE

SEQ ID NO: 731304 - protein, 26 aa, Mycobacterium
SGLDARAYRLAWPAGTVVYEVDQPQV

SEQ ID NO: 731305 - protein, 27 aa, Mycobacterium
SGLDARAYRLAWPAGTVVYEVDQPQVI

SEQ ID NO: 731306 - protein, 29 aa, Mycobacterium
SGLDARGYRLSWPPGMTVYEIDQPDVLQF

SEQ ID NO: 731307 - protein, 20 aa, Mycobacterium
SGLDFKRFVNEVADGSARIL

SEQ ID NO: 731308 - protein, 23 aa, Mycobacterium
SGLDHARSAMVTAVLERHGRLPL

SEQ ID NO: 731309 - protein, 19 aa, Mycobacterium
SGLDLARLGTTATTEEITD

SEQ ID NO: 731310 - protein, 22 aa, Mycobacterium
SGLDLRPARSRAHCIQLLADYA

SEQ ID NO: 731311 - protein, 33 aa, Mycobacterium
SGLDSRAFRLPWPAGTVVYEIDQPLVLDYKSST

SEQ ID NO: 731312 - protein, 29 aa, Mycobacterium
SGLDSRAYRLPWPDGTVVYEIDQPRVIEF

SEQ ID NO: 731313 - protein, 27 aa, Mycobacterium
SGLDTRAYRLLWPAGTVVYEIDQPEVI

SEQ ID NO: 731314 - protein, 17 aa, Mycobacterium
SGLDWTIVRPSGLFDLP

SEQ ID NO: 731315 - protein, 23 aa, Mycobacterium
SGLEHTEVLPLYARLPTAEQQKV

SEQ ID NO: 731316 - protein, 20 aa, Mycobacterium
SGLELPAFQQMFWRGGPTPT

SEQ ID NO: 731317 - protein, 24 aa, Mycobacterium
SGLEQPRSAILTFLAAREAAHHRL

SEQ ID NO: 731318 - protein, 21 aa, Mycobacterium
SGLFMKYLRRGSGYYIDVGAC

SEQ ID NO: 731319 - protein, 19 aa, Mycobacterium
SGLGIRALVGVGQLISVLP

SEQ ID NO: 731320 - protein, 17 aa, Mycobacterium
SGLGKVRFHDWRKPFAD

SEQ ID NO: 731321 - protein, 25 aa, Mycobacterium
SGLGRCIGVGLARRGDHVALLARRR

SEQ ID NO: 731322 - protein, 17 aa, Mycobacterium
SGLGRGLASLIPTGPVE

SEQ ID NO: 731323 - protein, 25 aa, Mycobacterium
SGLHPAWPMAMAVAGRAEFADAEEE

SEQ ID NO: 731324 - protein, 18 aa, Mycobacterium
SGLIERFGTGKGCDICKP

SEQ ID NO: 731325 - protein, 23 aa, Mycobacterium
SGLKEIYTLGADPVITPALDAEQ

SEQ ID NO: 731326 - protein, 24 aa, Mycobacterium
SGLLDRLDLAFSRDQAEKVYVQNR

SEQ ID NO: 731327 - protein, 20 aa, Mycobacterium
SGLLDRMRFSGLDIERLEPD

SEQ ID NO: 731328 - protein, 18 aa, Mycobacterium
SGLLERVLPKPGTGPSEQ

SEQ ID NO: 731329 - protein, 17 aa, Mycobacterium
SGLLGAGLRPWRLAKVL

SEQ ID NO: 731330 - protein, 17 aa, Mycobacterium
SGLLLATVVQEGVLKYF

SEQ ID NO: 731331 - protein, 20 aa, Mycobacterium
SGLLNRGNTISGIFNTSTVD

SEQ ID NO: 731332 - protein, 25 aa, Mycobacterium
SGLLPGEAIAQVLRMTVFVASVPTF

SEQ ID NO: 731333 - protein, 18 aa, Mycobacterium
SGLLPSGVSSIFNIGFAN

SEQ ID NO: 731334 - protein, 22 aa, Mycobacterium
SGLLRLGLTGTAAFSHLPKIAR

SEQ ID NO: 731335 - protein, 26 aa, Mycobacterium
SGLLRTGEALAAIWENAAAQIGGALG

SEQ ID NO: 731336 - protein, 25 aa, Mycobacterium
SGLLSRPSVNNVLRVAPRQFKMPRP

SEQ ID NO: 731337 - protein, 20 aa, Mycobacterium
SGLNAGSGFNVGFGNSGINN

SEQ ID NO: 731338 - protein, 18 aa, Mycobacterium
SGLNRAILSKGWHQFALV

SEQ ID NO: 731339 - protein, 29 aa, Mycobacterium
SGLPAPLTFVCVFGYTAQTAFFKHANVAV

SEQ ID NO: 731340 - protein, 20 aa, Mycobacterium
SGLPDELFDAWFAPAVENPA

SEQ ID NO: 731341 - protein, 22 aa, Mycobacterium
SGLPGVWVVDMDRIQREPSARA

SEQ ID NO: 731342 - protein, 17 aa, Mycobacterium
SGLPLWQVEVLDGDPAA

SEQ ID NO: 731343 - protein, 23 aa, Mycobacterium
SGLPPALVVTAGFDPLRDEGRLY

SEQ ID NO: 731344 - protein, 20 aa, Mycobacterium
SGLPPARRGRSDMTMNPLHR

SEQ ID NO: 731345 - protein, 23 aa, Mycobacterium
SGLPPAVVVTARYDPPCSEGEAY

SEQ ID NO: 731346 - protein, 21 aa, Mycobacterium
SGLPPAYIAVAGYDPLRDDGI

SEQ ID NO: 731347 - protein, 17 aa, Mycobacterium
SGLPSLPSMPGGGSGGG

SEQ ID NO: 731348 - protein, 23 aa, Mycobacterium
SGLPTMRGTDAWVPRRAGTDSEI

SEQ ID NO: 731349 - protein, 17 aa, Mycobacterium
SGLQHPGVRVWVARDGS

SEQ ID NO: 731350 - protein, 21 aa, Mycobacterium
SGLQPDLAWTYHYPLPAVGQI

SEQ ID NO: 731351 - protein, 29 aa, Mycobacterium
SGLQVCRYLPGRAIVVLMLMHYLDGDLGR

SEQ ID NO: 731352 - protein, 24 aa, Mycobacterium
SGLQVKTIWAARAISVLFPQITTI

SEQ ID NO: 731353 - protein, 17 aa, Mycobacterium
SGLQYLMSHLPRERLGV

SEQ ID NO: 731354 - protein, 17 aa, Mycobacterium
SGLRAAIELAEHGIDVL

SEQ ID NO: 731355 - protein, 19 aa, Mycobacterium
SGLRAAVDILEDIDDIHIA

SEQ ID NO: 731356 - protein, 25 aa, Mycobacterium
SGLRGGIMIPARWAGYPPYHDRRYD

SEQ ID NO: 731357 - protein, 22 aa, Mycobacterium
SGLRIGAERALEAFKESADVLI

SEQ ID NO: 731358 - protein, 24 aa, Mycobacterium
SGLRLARQRHVYLPGWAWSSSTGE

SEQ ID NO: 731359 - protein, 30 aa, Mycobacterium
SGLRLRRRASRAGDLNWLFLPGGPGIGSES

SEQ ID NO: 731360 - protein, 19 aa, Mycobacterium
SGLRPEALAVTFAGRTIAD

SEQ ID NO: 731361 - protein, 17 aa, Mycobacterium
SGLRRLVPHLSEAAGFT

SEQ ID NO: 731362 - protein, 26 aa, Mycobacterium
SGLRTEPALDILAGWLASRIDGPVRR

SEQ ID NO: 731363 - protein, 23 aa, Mycobacterium
SGLSRVAPYLARTMPQLLSVECW

SEQ ID NO: 731364 - protein, 20 aa, Mycobacterium
SGLSVRELAEATGLPKSSVH

SEQ ID NO: 731365 - protein, 34 aa, Mycobacterium
SGLTASRFIACPFGGPGARMYRTGDLVRWGTDGQ

SEQ ID NO: 731366 - protein, 18 aa, Mycobacterium
SGLTRLDASLIFEAMATG

SEQ ID NO: 731367 - protein, 20 aa, Mycobacterium
SGLTSGGWLGPASLSMASAF

SEQ ID NO: 731368 - protein, 23 aa, Mycobacterium
SGLTVPESSIWTSALATAAFLDG

SEQ ID NO: 731369 - protein, 17 aa, Mycobacterium
SGLVDWVSSCAGPVQED

SEQ ID NO: 731370 - protein, 25 aa, Mycobacterium
SGLWTRGLELLRWLVERETGNGHLS

SEQ ID NO: 731371 - protein, 19 aa, Mycobacterium
SGLYHKVILSRRVEVPFAM

SEQ ID NO: 731372 - protein, 26 aa, Mycobacterium
SGLYIPPYVLRGARQVIPESGAFEPD

SEQ ID NO: 731373 - protein, 21 aa, Mycobacterium
SGMCPDAIVFTGDLADTGEAQ

SEQ ID NO: 731374 - protein, 17 aa, Mycobacterium
SGMETGHWLRPGDHLVL

SEQ ID NO: 731375 - protein, 19 aa, Mycobacterium
SGMFGDFAAADAFHNGVHS

SEQ ID NO: 731376 - protein, 19 aa, Mycobacterium
SGMHCNSCVMGVTEALTAL

SEQ ID NO: 731377 - protein, 18 aa, Mycobacterium
SGMHLAYDLLDDWDTLVL

SEQ ID NO: 731378 - protein, 20 aa, Mycobacterium
SGMLSRPVIELSRRLAETLP

SEQ ID NO: 731379 - protein, 22 aa, Mycobacterium
SGMNPRRMAAYLSDRELHCSRG

SEQ ID NO: 731380 - protein, 18 aa, Mycobacterium
SGMPRLFREAPLMGIWEG

SEQ ID NO: 731381 - protein, 23 aa, Mycobacterium
SGMPRLYREAPLMGIWEGSGNVS

SEQ ID NO: 731382 - protein, 21 aa, Mycobacterium
SGMSCAHCEAAVQGEVAGIPG

SEQ ID NO: 731383 - protein, 19 aa, Mycobacterium
SGMSFVIAVPEVVGSAASE

SEQ ID NO: 731384 - protein, 20 aa, Mycobacterium
SGMSGRPWGSAHVGQTIPTV

SEQ ID NO: 731385 - protein, 24 aa, Mycobacterium
SGMTCGHCVAAVREQVAAVPGVTG

SEQ ID NO: 731386 - protein, 17 aa, Mycobacterium
SGMTRGALYHHFANMTE

SEQ ID NO: 731387 - protein, 20 aa, Mycobacterium
SGMWRGPRVRKPWKMYDTLT

SEQ ID NO: 731388 - protein, 19 aa, Mycobacterium
SGMYFWLDYADGMQPYFTV

SEQ ID NO: 731389 - protein, 35 aa, Mycobacterium
SGNAFRRMCRDEFLHYLRIREWQDLVGQLRSIARD

SEQ ID NO: 731390 - protein, 23 aa, Mycobacterium
SGNARPAQVAAFAVAMKMKVPTA

SEQ ID NO: 731391 - protein, 26 aa, Mycobacterium
SGNCGVGFAPVRPGREQWLIELMEGV

SEQ ID NO: 731392 - protein, 26 aa, Mycobacterium
SGNERRTNWLNAFYFGGDHGVEGSVA

SEQ ID NO: 731393 - protein, 18 aa, Mycobacterium
SGNFCRCTGYQGIVAAAR

SEQ ID NO: 731394 - protein, 18 aa, Mycobacterium
SGNFCRCTGYQGIVAATR

SEQ ID NO: 731395 - protein, 18 aa, Mycobacterium
SGNFCRCTGYQGIVNAVK

SEQ ID NO: 731396 - protein, 25 aa, Mycobacterium
SGNGAEPIEILWNGATLGLRTPSTT

SEQ ID NO: 731397 - protein, 21 aa, Mycobacterium
SGNGGNAGFFVGNGGIGGTGG

SEQ ID NO: 731398 - protein, 25 aa, Mycobacterium
SGNGVKVSTFGLENIATLGTVIGDN

SEQ ID NO: 731399 - protein, 19 aa, Mycobacterium
SGNIGFGLTGDGQFGIGGF

SEQ ID NO: 731400 - protein, 29 aa, Mycobacterium
SGNLPLLEPFRIISRLVSLIPGVHIPTPL

SEQ ID NO: 731401 - protein, 27 aa, Mycobacterium
SGNPAALDWLVDRLELTPGESLLDSGA

SEQ ID NO: 731402 - protein, 25 aa, Mycobacterium
SGNPRAVSSNGLWVGPFQQDTSYPG

SEQ ID NO: 731403 - protein, 23 aa, Mycobacterium
SGNPVVVMAHGFGGTKDSGLQPF

SEQ ID NO: 731404 - protein, 28 aa, Mycobacterium
SGNRALALLYRWVEHAFGGREHELTASY

SEQ ID NO: 731405 - protein, 20 aa, Mycobacterium
SGNVDLVILARYMQILSPAF

SEQ ID NO: 731406 - protein, 24 aa, Mycobacterium
SGNVEFRTLPVVRYDNIDGQDVNI

SEQ ID NO: 731407 - protein, 20 aa, Mycobacterium
SGNYLPKFAPYLSAGSNPWG

SEQ ID NO: 731408 - protein, 19 aa, Mycobacterium
SGNYLPKFGPYLSSGSNPW

SEQ ID NO: 731409 - protein, 21 aa, Mycobacterium
SGNYLPRFGPYLSSASNPWGE

SEQ ID NO: 731410 - protein, 24 aa, Mycobacterium
SGNYLPRFGPYLSSASNPWGEGIN

SEQ ID NO: 731411 - protein, 31 aa, Mycobacterium
SGNYSLLGGSYGWLAAMPTLVVGPVDLGPIG

SEQ ID NO: 731412 - protein, 20 aa, Mycobacterium
SGPAAWRYVAEWLAVPVVWI

SEQ ID NO: 731413 - protein, 30 aa, Mycobacterium
SGPAGGPALLAFTGRRLFAVIVLTIRGSRI

SEQ ID NO: 731414 - protein, 23 aa, Mycobacterium
SGPAIEVNRLFPPGYEEQRAAAK

SEQ ID NO: 731415 - protein, 25 aa, Mycobacterium
SGPAPARSWAARWIAETGCEKYREA

SEQ ID NO: 731416 - protein, 23 aa, Mycobacterium
SGPARARYLMLRLLERAGEQRVA

SEQ ID NO: 731417 - protein, 26 aa, Mycobacterium
SGPARARYLMLRLLERANAGRVAIPA

SEQ ID NO: 731418 - protein, 23 aa, Mycobacterium
SGPARKVLELTFREALRLGHNYI

SEQ ID NO: 731419 - protein, 18 aa, Mycobacterium
SGPARWFLDHARVALSSG

SEQ ID NO: 731420 - protein, 18 aa, Mycobacterium
SGPARWFLEHARVALSSG

SEQ ID NO: 731421 - protein, 23 aa, Mycobacterium
SGPAVFLLHGWPQTWQEWLPILE

SEQ ID NO: 731422 - protein, 18 aa, Mycobacterium
SGPAVFPGYLRPGPDGPA

SEQ ID NO: 731423 - protein, 37 aa, Mycobacterium
SGPECPTELLCLPLLRARYGLTFKEFRVTDAGGPRTV

SEQ ID NO: 731424 - protein, 17 aa, Mycobacterium
SGPEGRMPDLRVAPPST

SEQ ID NO: 731425 - protein, 20 aa, Mycobacterium
SGPEHFKFMEVCGGHTHTIY

SEQ ID NO: 731426 - protein, 21 aa, Mycobacterium
SGPELPEWDGTGLSGVVPIVA

SEQ ID NO: 731427 - protein, 18 aa, Mycobacterium
SGPESIRKVLSWLPGRGT

SEQ ID NO: 731428 - protein, 29 aa, Mycobacterium
SGPFDNWPLGWGFDHFWGFPSGAAGQYDP

SEQ ID NO: 731429 - protein, 20 aa, Mycobacterium
SGPFGVSGLLNYGDLESGAL

SEQ ID NO: 731430 - protein, 18 aa, Mycobacterium
SGPFLVQYAKAWRTIAKL

SEQ ID NO: 731431 - protein, 20 aa, Mycobacterium
SGPFPSAWEAFGRDLNDRHR

SEQ ID NO: 731432 - protein, 19 aa, Mycobacterium
SGPGCGKYALVNEYLRYLA

SEQ ID NO: 731433 - protein, 23 aa, Mycobacterium
SGPGELCAAWVSNFTMPPGTATI

SEQ ID NO: 731434 - protein, 26 aa, Mycobacterium
SGPGGAGGRGGDAGWLGDGGAGGTGG

SEQ ID NO: 731435 - protein, 23 aa, Mycobacterium
SGPGLWASIACRKRYIDERLSDP

SEQ ID NO: 731436 - protein, 20 aa, Mycobacterium
SGPGPRPGPRPGPRPGPRPS

SEQ ID NO: 731437 - protein, 21 aa, Mycobacterium
SGPHLARWARAHGWEGADARE

SEQ ID NO: 731438 - protein, 25 aa, Mycobacterium
SGPIEFADRIAHIWTNTKNYLVAIH

SEQ ID NO: 731439 - protein, 18 aa, Mycobacterium
SGPIGGLVARVLRSDVQK

SEQ ID NO: 731440 - protein, 18 aa, Mycobacterium
SGPIPLTLAASRPLVRCP

SEQ ID NO: 731441 - protein, 22 aa, Mycobacterium
SGPKFRAANIVMRVVYTNPDCE

SEQ ID NO: 731442 - protein, 17 aa, Mycobacterium
SGPLAIVEDLGRAGLGH

SEQ ID NO: 731443 - protein, 17 aa, Mycobacterium
SGPLRHCGNGDLYGGNE

SEQ ID NO: 731444 - protein, 17 aa, Mycobacterium
SGPMLAAAAAWDGLAAE

SEQ ID NO: 731445 - protein, 17 aa, Mycobacterium
SGPMLAAAAAWDSLAAG

SEQ ID NO: 731446 - protein, 17 aa, Mycobacterium
SGPMLAAAASWEALAAD

SEQ ID NO: 731447 - protein, 23 aa, Mycobacterium
SGPMLVAASAWNGLAAELRSAAL

SEQ ID NO: 731448 - protein, 24 aa, Mycobacterium
SGPNGVAMAGHFSRSHVGGNNAVH

SEQ ID NO: 731449 - protein, 26 aa, Mycobacterium
SGPNMTRWARRQGWQAPADADAKELA

SEQ ID NO: 731450 - protein, 19 aa, Mycobacterium
SGPPAGLFRIGWVRGTHFG

SEQ ID NO: 731451 - protein, 19 aa, Mycobacterium
SGPPMYSPFKLLDPVANVA

SEQ ID NO: 731452 - protein, 24 aa, Mycobacterium
SGPPPDRFLIGLAVLSLLAAAAEH

SEQ ID NO: 731453 - protein, 23 aa, Mycobacterium
SGPRGRPAGGLARRHRRPGRAAR

SEQ ID NO: 731454 - protein, 25 aa, Mycobacterium
SGPRIDWSKIHLFWGDERYVSEEDD

SEQ ID NO: 731455 - protein, 29 aa, Mycobacterium
SGPRLQAGKCIRLDHSFSAKTISQVVGST

SEQ ID NO: 731456 - protein, 18 aa, Mycobacterium
SGPRMMRLVAQYADWWNL

SEQ ID NO: 731457 - protein, 19 aa, Mycobacterium
SGPRRAAVSSFGLSGTNAH

SEQ ID NO: 731458 - protein, 22 aa, Mycobacterium
SGPRVGLIIAKSVGTAVERHRV

SEQ ID NO: 731459 - protein, 29 aa, Mycobacterium
SGPSATQLLAWLGADVIKLEAPKTGDITR

SEQ ID NO: 731460 - protein, 23 aa, Mycobacterium
SGPSVTPPVRWQSGRRVHLDLDP

SEQ ID NO: 731461 - protein, 18 aa, Mycobacterium
SGPSYRLAVDRFDEVAKQ

SEQ ID NO: 731462 - protein, 31 aa, Mycobacterium
SGPTLTAAAAWGRLADELATAASSFNSATAT

SEQ ID NO: 731463 - protein, 24 aa, Mycobacterium
SGPVFLQYPWEVIPEELIKPIEDA

SEQ ID NO: 731464 - protein, 17 aa, Mycobacterium
SGPWRGPASTSMASAAA

SEQ ID NO: 731465 - protein, 19 aa, Mycobacterium
SGPYADRAASEFTLQAWAG

SEQ ID NO: 731466 - protein, 23 aa, Mycobacterium
SGQAELRTWAVLGIYSSVAPIRN

SEQ ID NO: 731467 - protein, 24 aa, Mycobacterium
SGQAKASFVAIEFDEFGGGHGNAL

SEQ ID NO: 731468 - protein, 22 aa, Mycobacterium
SGQFAKVIIKLEPFTGEDGATY

SEQ ID NO: 731469 - protein, 23 aa, Mycobacterium
SGQLRMRGICFHNLKDLDVDLPL

SEQ ID NO: 731470 - protein, 18 aa, Mycobacterium
SGQLRPGGTIVEPTSGNT

SEQ ID NO: 731471 - protein, 28 aa, Mycobacterium
SGQNPRPQWPASAALFVGRDGARITRGA

SEQ ID NO: 731472 - protein, 23 aa, Mycobacterium
SGQPAPDWFPLLGGHEGAGVVEE

SEQ ID NO: 731473 - protein, 18 aa, Mycobacterium
SGQPRLVAYYTTTSGTRL

SEQ ID NO: 731474 - protein, 27 aa, Mycobacterium
SGQSLRPVLFSTFLMWVLADLFTFLPE

SEQ ID NO: 731475 - protein, 18 aa, Mycobacterium
SGQTLLIHGGGSGIGTHA

SEQ ID NO: 731476 - protein, 24 aa, Mycobacterium
SGQTVRLPAHYVIKHVTLGYAATI

SEQ ID NO: 731477 - protein, 26 aa, Mycobacterium
SGQVPRIAVVKGRCFAGNAVIAGASD

SEQ ID NO: 731478 - protein, 30 aa, Mycobacterium
SGQVQALSQFVAWPGLLVFQNKAKLLYDGA

SEQ ID NO: 731479 - protein, 20 aa, Mycobacterium
SGQYPRELPFILGSELCGTV

SEQ ID NO: 731480 - protein, 22 aa, Mycobacterium
SGQYPRQLPFILGQETSGTVVD

SEQ ID NO: 731481 - protein, 24 aa, Mycobacterium
SGQYWGHANVSDWQEGSRWEHRRT

SEQ ID NO: 731482 - protein, 22 aa, Mycobacterium
SGRALEVLRALSGMPDTVHLVG

SEQ ID NO: 731483 - protein, 20 aa, Mycobacterium
SGRALPPVAAVAAAAAVATV

SEQ ID NO: 731484 - protein, 24 aa, Mycobacterium
SGRANYAKALRMFAVLPTIVAADM

SEQ ID NO: 731485 - protein, 17 aa, Mycobacterium
SGRAVNGYTELKADGST

SEQ ID NO: 731486 - protein, 18 aa, Mycobacterium
SGRCRIDTGWALDQLREV

SEQ ID NO: 731487 - protein, 26 aa, Mycobacterium
SGRDEIWRFTPLRRLRGLHDGSARAT

SEQ ID NO: 731488 - protein, 27 aa, Mycobacterium
SGRDLSGWGRQWLKTTGLNTLRPDFDV

SEQ ID NO: 731489 - protein, 19 aa, Mycobacterium
SGRDVCLIPSSAHGTNAAS

SEQ ID NO: 731490 - protein, 21 aa, Mycobacterium
SGREISWQPTLAFEGIGNDEP

SEQ ID NO: 731491 - protein, 19 aa, Mycobacterium
SGREVLYRLVDQHLAHIVV

SEQ ID NO: 731492 - protein, 19 aa, Mycobacterium
SGRFEFRRGPVFTNLLLGD

SEQ ID NO: 731493 - protein, 18 aa, Mycobacterium
SGRFRITIGPGVVRLGWT

SEQ ID NO: 731494 - protein, 20 aa, Mycobacterium
SGRGESGWYNTYFFNQPALE

SEQ ID NO: 731495 - protein, 18 aa, Mycobacterium
SGRGYRYNGRWVSKQADT

SEQ ID NO: 731496 - protein, 27 aa, Mycobacterium
SGRHIRRVPLSGGLFRALGRIADAVGD

SEQ ID NO: 731497 - protein, 22 aa, Mycobacterium
SGRIRRPPVTDYKLVDVPELGY

SEQ ID NO: 731498 - protein, 19 aa, Mycobacterium
SGRKPFRFTSFGDQSTPTL

SEQ ID NO: 731499 - protein, 19 aa, Mycobacterium
SGRLCRERVSAFWAAHPEL

SEQ ID NO: 731500 - protein, 24 aa, Mycobacterium
SGRLELGIGVGWCREEFELLGQQF

SEQ ID NO: 731501 - protein, 24 aa, Mycobacterium
SGRLHTGHCLLRLEGGTLTRRDVE

SEQ ID NO: 731502 - protein, 26 aa, Mycobacterium
SGRLPAEWTAGALLYQCCTAMLASAK

SEQ ID NO: 731503 - protein, 21 aa, Mycobacterium
SGRLPDPLPYASMINTAMDST

SEQ ID NO: 731504 - protein, 21 aa, Mycobacterium
SGRMMVTFGVGWLQREFELLG

SEQ ID NO: 731505 - protein, 20 aa, Mycobacterium
SGRPNTWGQRAANLLVQQAD

SEQ ID NO: 731506 - protein, 23 aa, Mycobacterium
SGRPSGDLGYGWAKQGLGAAATW

SEQ ID NO: 731507 - protein, 23 aa, Mycobacterium
SGRQRAIPLISFISRQMDLRKWF

SEQ ID NO: 731508 - protein, 25 aa, Mycobacterium
SGRRAALAMVRRHRLLETFLVNELG

SEQ ID NO: 731509 - protein, 26 aa, Mycobacterium
SGRRRRRGRRGRGRGRGEQGGSDGPG

SEQ ID NO: 731510 - protein, 19 aa, Mycobacterium
SGRRVALALAPAGTGKTTA

SEQ ID NO: 731511 - protein, 29 aa, Mycobacterium
SGRSAEYLFRLALPMGIYGGTLDVFRNMI

SEQ ID NO: 731512 - protein, 24 aa, Mycobacterium
SGRSELRLAAEAVLDALDDAGLTT

SEQ ID NO: 731513 - protein, 22 aa, Mycobacterium
SGRSGQPSGVRWVIDPIDGTVN

SEQ ID NO: 731514 - protein, 18 aa, Mycobacterium
SGRTGSRRRLVIVESPTK

SEQ ID NO: 731515 - protein, 23 aa, Mycobacterium
SGRTRLNALLAEERTRVDPAAMA

SEQ ID NO: 731516 - protein, 23 aa, Mycobacterium
SGRVARVALELGGKSANILLEDA

SEQ ID NO: 731517 - protein, 22 aa, Mycobacterium
SGRVDFGLGAGWFSEEHEAYAI

SEQ ID NO: 731518 - protein, 31 aa, Mycobacterium
SGRVKRPQMGIAAWIIPSIVAFGTDEQKERF

SEQ ID NO: 731519 - protein, 25 aa, Mycobacterium
SGRVKRPQTGIATWIVPSIVAFGTE

SEQ ID NO: 731520 - protein, 22 aa, Mycobacterium
SGRWLRCSRGVYFATDRPFTDQ

SEQ ID NO: 731521 - protein, 28 aa, Mycobacterium
SGRYLYPRVEVEVGFILSDDLPGAGCTE

SEQ ID NO: 731522 - protein, 22 aa, Mycobacterium
SGRYRGCYLLLYSDGTVKLSGY

SEQ ID NO: 731523 - protein, 23 aa, Mycobacterium
SGRYRLGPATLRLGNVYLDTLEL

SEQ ID NO: 731524 - protein, 22 aa, Mycobacterium
SGRYRLGPDLFHLGSTQLDLNE

SEQ ID NO: 731525 - protein, 19 aa, Mycobacterium
SGSAARPAVLFDVDGTLVD

SEQ ID NO: 731526 - protein, 35 aa, Mycobacterium
SGSAFRRMCRNEFLHYLRIREWQDLVGQLRSIARD

SEQ ID NO: 731527 - protein, 18 aa, Mycobacterium
SGSAGGWRVKQTGGDLDE

SEQ ID NO: 731528 - protein, 24 aa, Mycobacterium
SGSAKWNLLAPYAVKSEGGANSAA

SEQ ID NO: 731529 - protein, 25 aa, Mycobacterium
SGSAMKLHFLFTHFDQVEGVNLPTF

SEQ ID NO: 731530 - protein, 23 aa, Mycobacterium
SGSARLRFSDIVRELDLTQATAH

SEQ ID NO: 731531 - protein, 23 aa, Mycobacterium
SGSARLRFSDVVRELDLTQATAH

SEQ ID NO: 731532 - protein, 18 aa, Mycobacterium
SGSDALLALTQRPLTANG

SEQ ID NO: 731533 - protein, 23 aa, Mycobacterium
SGSEFEAAVGYSRAVRVGAHVFV

SEQ ID NO: 731534 - protein, 22 aa, Mycobacterium
SGSELRYDYLIYAVGSTAAMPA

SEQ ID NO: 731535 - protein, 22 aa, Mycobacterium
SGSEWRLQADFDGSGIEERFFD

SEQ ID NO: 731536 - protein, 24 aa, Mycobacterium
SGSFEFRTGPIFTNLLLADEINRT

SEQ ID NO: 731537 - protein, 28 aa, Mycobacterium
SGSFNRPKLPGIPGIKDFGGHIFHSSRW

SEQ ID NO: 731538 - protein, 28 aa, Mycobacterium
SGSGFRRMCRDEFLHYLRIREWQDLVGQ

SEQ ID NO: 731539 - protein, 24 aa, Mycobacterium
SGSGKSTFLRCINHLETVSAGRLY

SEQ ID NO: 731540 - protein, 23 aa, Mycobacterium
SGSGKSTFLRCLNKLEDITDGKV

SEQ ID NO: 731541 - protein, 24 aa, Mycobacterium
SGSGKSTFLRCLNKLEDITGGRVV

SEQ ID NO: 731542 - protein, 20 aa, Mycobacterium
SGSGPAYFFLLVEALVDAGV

SEQ ID NO: 731543 - protein, 20 aa, Mycobacterium
SGSGPAYFFLMVEALVDAGV

SEQ ID NO: 731544 - protein, 21 aa, Mycobacterium
SGSGPITFWSCHPGTSTAVER

SEQ ID NO: 731545 - protein, 31 aa, Mycobacterium
SGSIAVQWCRSWPGCTAVAFERDERRRANIE

SEQ ID NO: 731546 - protein, 19 aa, Mycobacterium
SGSIGQLSVPPSWSAPSAR

SEQ ID NO: 731547 - protein, 23 aa, Mycobacterium
SGSKARPPQCAMLADPGNGRGRS

SEQ ID NO: 731548 - protein, 18 aa, Mycobacterium
SGSLAIRAAVASGVNITY

SEQ ID NO: 731549 - protein, 25 aa, Mycobacterium
SGSLHRDGWTFTGWGRATTDEAGRY

SEQ ID NO: 731550 - protein, 17 aa, Mycobacterium
SGSLIAVGNGSADTDTP

SEQ ID NO: 731551 - protein, 20 aa, Mycobacterium
SGSLRGPGGILGLPANPVWW

SEQ ID NO: 731552 - protein, 18 aa, Mycobacterium
SGSLVIGICAEYDALPEI

SEQ ID NO: 731553 - protein, 19 aa, Mycobacterium
SGSNLEFVVALLAASRANL

SEQ ID NO: 731554 - protein, 22 aa, Mycobacterium
SGSPAIRGAIRFYEGQVDDARH

SEQ ID NO: 731555 - protein, 25 aa, Mycobacterium
SGSPLGNIGNSWFGKVASGFAGARP

SEQ ID NO: 731556 - protein, 25 aa, Mycobacterium
SGSPLLAGDFVRWCRQALDLLDQVR

SEQ ID NO: 731557 - protein, 17 aa, Mycobacterium
SGSRGADGVTGPNPNGG

SEQ ID NO: 731558 - protein, 20 aa, Mycobacterium
SGSRPNWWHATPMVADAPKS

SEQ ID NO: 731559 - protein, 19 aa, Mycobacterium
SGSRPPLCSEEMLAGIPEA

SEQ ID NO: 731560 - protein, 20 aa, Mycobacterium
SGSRRPTFATVHGREATEVR

SEQ ID NO: 731561 - protein, 21 aa, Mycobacterium
SGSRRPTFATVHGRGAAEVRA

SEQ ID NO: 731562 - protein, 23 aa, Mycobacterium
SGSRSRFLRLFPTVVKGTHVELD

SEQ ID NO: 731563 - protein, 19 aa, Mycobacterium
SGSSDYLAGRAFSFISAID

SEQ ID NO: 731564 - protein, 21 aa, Mycobacterium
SGSSDYLAGRAFSFISAIDSI

SEQ ID NO: 731565 - protein, 35 aa, Mycobacterium
SGSSFRRMCRDEFLHYLRIREWQDLVGQLRSICRD

SEQ ID NO: 731566 - protein, 17 aa, Mycobacterium
SGSSRDWAAKGTALLGV

SEQ ID NO: 731567 - protein, 26 aa, Mycobacterium
SGSSRDWAAKGTRLLGVKAVITESFE

SEQ ID NO: 731568 - protein, 17 aa, Mycobacterium
SGSSRDWAAKGTSLLGV

SEQ ID NO: 731569 - protein, 17 aa, Mycobacterium
SGSSRDWAAKGTVLLGV

SEQ ID NO: 731570 - protein, 24 aa, Mycobacterium
SGSSRPRPATRTLVLPELDETDPH

SEQ ID NO: 731571 - protein, 27 aa, Mycobacterium
SGSVPMIVGALPFDVSEPAALMVPTSV

SEQ ID NO: 731572 - protein, 24 aa, Mycobacterium
SGSVPQRLWAKPAITVIGIDTTPI

SEQ ID NO: 731573 - protein, 24 aa, Mycobacterium
SGSVPQRLWAKPAITVIGIDTTSI

SEQ ID NO: 731574 - protein, 18 aa, Mycobacterium
SGSVRVFGRAPGTQNDEI

SEQ ID NO: 731575 - protein, 23 aa, Mycobacterium
SGSWPQEFFRFGVDGGDDAAARV

SEQ ID NO: 731576 - protein, 27 aa, Mycobacterium
SGSYEHQWMMGSCIVLQQGAPVMTDAG

SEQ ID NO: 731577 - protein, 26 aa, Mycobacterium
SGSYPTEIPLPFVVGRDLVGRVVHGA

SEQ ID NO: 731578 - protein, 22 aa, Mycobacterium
SGTARAELFARFGRPLPQDADG

SEQ ID NO: 731579 - protein, 17 aa, Mycobacterium
SGTCFVEAVLYAHDGEV

SEQ ID NO: 731580 - protein, 29 aa, Mycobacterium
SGTCRPIDPWGGSYYVEWLTHQLASRARE

SEQ ID NO: 731581 - protein, 21 aa, Mycobacterium
SGTDACDWIILGAMVGDAKGV

SEQ ID NO: 731582 - protein, 25 aa, Mycobacterium
SGTDGTPGGWLLGDGGAGGSGGTGL

SEQ ID NO: 731583 - protein, 24 aa, Mycobacterium
SGTDHCDWIILGAMVGDADGTPLM

SEQ ID NO: 731584 - protein, 33 aa, Mycobacterium
SGTEPKLKCYIEVRCAVTGGLARARRRAGALRD

SEQ ID NO: 731585 - protein, 24 aa, Mycobacterium
SGTEPKLKCYIEVRCEVAGDLAAT

SEQ ID NO: 731586 - protein, 25 aa, Mycobacterium
SGTEPKLKCYLEIRCAPSDDLDSSR

SEQ ID NO: 731587 - protein, 18 aa, Mycobacterium
SGTEPLAVVCEFADACVP

SEQ ID NO: 731588 - protein, 26 aa, Mycobacterium
SGTFPGSNLLLGFFNSYPIQTFNSLS

SEQ ID NO: 731589 - protein, 24 aa, Mycobacterium
SGTGLRSTPQLSIRAIVVDESTNR

SEQ ID NO: 731590 - protein, 18 aa, Mycobacterium
SGTGNWGIGNSGSYNTGI

SEQ ID NO: 731591 - protein, 18 aa, Mycobacterium
SGTHHRSAITGKFVKGST

SEQ ID NO: 731592 - protein, 26 aa, Mycobacterium
SGTIAGIHLEGPWLSPARCGAHDHTQ

SEQ ID NO: 731593 - protein, 26 aa, Mycobacterium
SGTIGLRFPVQYVIRPRTAEYPDYRG

SEQ ID NO: 731594 - protein, 23 aa, Mycobacterium
SGTKAALRFIRSCSAPLTPETAQ

SEQ ID NO: 731595 - protein, 23 aa, Mycobacterium
SGTLDRLSCAFSRDRGPQGPKDY

SEQ ID NO: 731596 - protein, 19 aa, Mycobacterium
SGTLWGKPVTGFAFNERSL

SEQ ID NO: 731597 - protein, 23 aa, Mycobacterium
SGTMAAAVAPYVSWMNTTAAQAQ

SEQ ID NO: 731598 - protein, 26 aa, Mycobacterium
SGTMGRAALVGSMSVPQGWTQAAPAM

SEQ ID NO: 731599 - protein, 23 aa, Mycobacterium
SGTPCATCALFGLCGGTCVAKAI

SEQ ID NO: 731600 - protein, 22 aa, Mycobacterium
SGTPPIFFGFGSLPVESADQTF

SEQ ID NO: 731601 - protein, 20 aa, Mycobacterium
SGTPVAMSMNLVWDTDGTPY

SEQ ID NO: 731602 - protein, 19 aa, Mycobacterium
SGTRLHWDSAAERYAAAVT

SEQ ID NO: 731603 - protein, 17 aa, Mycobacterium
SGTRVHRHGAVRAAASI

SEQ ID NO: 731604 - protein, 17 aa, Mycobacterium
SGTSGPGAALWVQVEEV

SEQ ID NO: 731605 - protein, 21 aa, Mycobacterium
SGTSLAQWYAAHGLGPQALAD

SEQ ID NO: 731606 - protein, 27 aa, Mycobacterium
SGTSRFSVGHAVDWNLAATVGGKLARQ

SEQ ID NO: 731607 - protein, 21 aa, Mycobacterium
SGTTVHWKLNPNGTINTGGAS

SEQ ID NO: 731608 - protein, 20 aa, Mycobacterium
SGTVRRFDIPGATAEFHLPG

SEQ ID NO: 731609 - protein, 25 aa, Mycobacterium
SGTVYRQQMEYLHEGFDAKVTPAVR

SEQ ID NO: 731610 - protein, 18 aa, Mycobacterium
SGTWAVAMDRGGQLRWFG

SEQ ID NO: 731611 - protein, 23 aa, Mycobacterium
SGVACGFAVARYGPHAHDVYVDS

SEQ ID NO: 731612 - protein, 18 aa, Mycobacterium
SGVADAFRSAGVVGDPDD

SEQ ID NO: 731613 - protein, 18 aa, Mycobacterium
SGVAKRSAVKLSKICNDL

SEQ ID NO: 731614 - protein, 19 aa, Mycobacterium
SGVATWTLLDPMGHSETFD

SEQ ID NO: 731615 - protein, 17 aa, Mycobacterium
SGVDADFHRGESAYDRY

SEQ ID NO: 731616 - protein, 18 aa, Mycobacterium
SGVDEILRRVPGKPAGAV

SEQ ID NO: 731617 - protein, 17 aa, Mycobacterium
SGVDIVVACPGRLDDLM

SEQ ID NO: 731618 - protein, 17 aa, Mycobacterium
SGVEFVRDGVTFRVAAG

SEQ ID NO: 731619 - protein, 18 aa, Mycobacterium
SGVFERFPGLRWGATECG

SEQ ID NO: 731620 - protein, 18 aa, Mycobacterium
SGVFERFPGLRWGVTECG

SEQ ID NO: 731621 - protein, 19 aa, Mycobacterium
SGVGADWAYASGWLAVRAM

SEQ ID NO: 731622 - protein, 17 aa, Mycobacterium
SGVGRELGRFGFEEYLQ

SEQ ID NO: 731623 - protein, 26 aa, Mycobacterium
SGVIGPRRRMRWEDVADWDFVCTQLA

SEQ ID NO: 731624 - protein, 17 aa, Mycobacterium
SGVLRVTPRPYVMPRTP

SEQ ID NO: 731625 - protein, 24 aa, Mycobacterium
SGVLTRLDLAFSRDGANGEPKQYV

SEQ ID NO: 731626 - protein, 23 aa, Mycobacterium
SGVLTRLDLAFSRDNKDATKQYV

SEQ ID NO: 731627 - protein, 19 aa, Mycobacterium
SGVLTRYALQTSYRKLHRN

SEQ ID NO: 731628 - protein, 24 aa, Mycobacterium
SGVNVCSSAAWITGGKQTPEDRER

SEQ ID NO: 731629 - protein, 22 aa, Mycobacterium
SGVNVCTSAAWITGGKQTPQDR

SEQ ID NO: 731630 - protein, 23 aa, Mycobacterium
SGVNVCTSAAWITGGKQTPQDRK

SEQ ID NO: 731631 - protein, 23 aa, Mycobacterium
SGVNVCTSAAWITGGKQTPRDRE

SEQ ID NO: 731632 - protein, 19 aa, Mycobacterium
SGVPGDGWPTYGPPDRAVM

SEQ ID NO: 731633 - protein, 24 aa, Mycobacterium
SGVPGKSPSKWGAFLEDVGGFDAD

SEQ ID NO: 731634 - protein, 18 aa, Mycobacterium
SGVPGWDISGRALSDPDF

SEQ ID NO: 731635 - protein, 23 aa, Mycobacterium
SGVPRGCLRFVMSVRGIGEGHCS

SEQ ID NO: 731636 - protein, 17 aa, Mycobacterium
SGVPVERARTLWVALGF

SEQ ID NO: 731637 - protein, 18 aa, Mycobacterium
SGVPVVWVNWGNRPDRLN

SEQ ID NO: 731638 - protein, 21 aa, Mycobacterium
SGVPWTVLRATQFHDLIAFVL

SEQ ID NO: 731639 - protein, 22 aa, Mycobacterium
SGVQKRLFIDGKWVDATDGATF

SEQ ID NO: 731640 - protein, 23 aa, Mycobacterium
SGVQPRWITPRWDAAHHFSHPPS

SEQ ID NO: 731641 - protein, 17 aa, Mycobacterium
SGVQWTLNTAGLALVGK

SEQ ID NO: 731642 - protein, 20 aa, Mycobacterium
SGVRFRNRFVRTKHYLKSTA

SEQ ID NO: 731643 - protein, 18 aa, Mycobacterium
SGVRFVSIYPGFVATEAT

SEQ ID NO: 731644 - protein, 18 aa, Mycobacterium
SGVRHVPRLRRHSLAAQP

SEQ ID NO: 731645 - protein, 17 aa, Mycobacterium
SGVRLIRRIARAGDLNW

SEQ ID NO: 731646 - protein, 21 aa, Mycobacterium
SGVRYRAFDLFEAGPDRIAQM

SEQ ID NO: 731647 - protein, 25 aa, Mycobacterium
SGVSGFANTGVRPFSLTGLISGFAN

SEQ ID NO: 731648 - protein, 17 aa, Mycobacterium
SGVSLDLARAVYKNIGS

SEQ ID NO: 731649 - protein, 19 aa, Mycobacterium
SGVSPGFAELLAIVSAMVC

SEQ ID NO: 731650 - protein, 26 aa, Mycobacterium
SGVSSRFKAPFAFTGGTIAQVTVDLS

SEQ ID NO: 731651 - protein, 25 aa, Mycobacterium
SGVTLDRRRMLELAGKFAAEHPRLL

SEQ ID NO: 731652 - protein, 26 aa, Mycobacterium
SGVTLDRRRMLELASKFAAEHPWLLG

SEQ ID NO: 731653 - protein, 21 aa, Mycobacterium
SGVTSTGFWNSGSYDTGFGNA

SEQ ID NO: 731654 - protein, 17 aa, Mycobacterium
SGVTVVLAPPGTVGAVD

SEQ ID NO: 731655 - protein, 25 aa, Mycobacterium
SGVVHFHGPFLYRSVFNSANEEQET

SEQ ID NO: 731656 - protein, 19 aa, Mycobacterium
SGVVWRCATPGRKESGSAS

SEQ ID NO: 731657 - protein, 17 aa, Mycobacterium
SGWASRVRLAHALGPTM

SEQ ID NO: 731658 - protein, 23 aa, Mycobacterium
SGWEVADAPALQAVRERLAKAGV

SEQ ID NO: 731659 - protein, 24 aa, Mycobacterium
SGWEVAGDILLRFVSEGKCLRSTF

SEQ ID NO: 731660 - protein, 20 aa, Mycobacterium
SGWGPKAAWYRNVLAEPRVT

SEQ ID NO: 731661 - protein, 17 aa, Mycobacterium
SGWMGVDLARYGLDEPI

SEQ ID NO: 731662 - protein, 30 aa, Mycobacterium
SGWNGEEVWPGYGPAPVWNFPATLTNLSPG

SEQ ID NO: 731663 - protein, 19 aa, Mycobacterium
SGWRNLASGYQQRRYHDAS

SEQ ID NO: 731664 - protein, 34 aa, Mycobacterium
SGYASWRSVLWRRWPAAGAPPFFASPGEYDDAVR

SEQ ID NO: 731665 - protein, 20 aa, Mycobacterium
SGYCTISTRYDRASITDPGL

SEQ ID NO: 731666 - protein, 24 aa, Mycobacterium
SGYDIKKWINWAIQFFYSSPAYSQ

SEQ ID NO: 731667 - protein, 24 aa, Mycobacterium
SGYDIRKWIGWTMRFYYGSPAYSQ

SEQ ID NO: 731668 - protein, 17 aa, Mycobacterium
SGYEVLRRMRARNVWTP

SEQ ID NO: 731669 - protein, 21 aa, Mycobacterium
SGYGAAFAAVTARSAGAAGSA

SEQ ID NO: 731670 - protein, 18 aa, Mycobacterium
SGYICPDCNGSLSTVSEG

SEQ ID NO: 731671 - protein, 32 aa, Mycobacterium
SGYLCVPLDGEICDRLGLLPMYAVNQDKHGTA

SEQ ID NO: 731672 - protein, 21 aa, Mycobacterium
SGYLEFVRTFFANDLDVAATA

SEQ ID NO: 731673 - protein, 22 aa, Mycobacterium
SGYMRGVAVERIYRDVRLLRLY

SEQ ID NO: 731674 - protein, 24 aa, Mycobacterium
SGYNSGQALALWDCDADVEVVRED

SEQ ID NO: 731675 - protein, 26 aa, Mycobacterium
SGYPRLFAALADRGWSRADLAKLAGE

SEQ ID NO: 731676 - protein, 23 aa, Mycobacterium
SGYPRLVKRWKRGQSLDDAELVF

SEQ ID NO: 731677 - protein, 26 aa, Mycobacterium
SGYPRLVKRWRRGQALTDAETLFSGA

SEQ ID NO: 731678 - protein, 27 aa, Mycobacterium
SGYPRVVKRWRRGTPLAEAQTVFEGAR

SEQ ID NO: 731679 - protein, 26 aa, Mycobacterium
SGYQAHDWLREHAHLDMGMSDHRRIL

SEQ ID NO: 731680 - protein, 21 aa, Mycobacterium
SGYRLPQLVSDVGAVIDGLGV

SEQ ID NO: 731681 - protein, 18 aa, Mycobacterium
SGYRPEYRPAPLLGEHCR

SEQ ID NO: 731682 - protein, 24 aa, Mycobacterium
SGYTCPDCNGSLVSISEGNFRCQV

SEQ ID NO: 731683 - protein, 18 aa, Mycobacterium
SGYVAAFSIPGERGEELA

SEQ ID NO: 731684 - protein, 37 aa, Mycobacterium
SGYVRRPGLTASRFIACPFGAPGTRMYRTGDLVRWGV

SEQ ID NO: 731685 - protein, 26 aa, Mycobacterium
SGYWRRTALTGARFVACPFGMPGDRM

SEQ ID NO: 731686 - protein, 18 aa, Mycobacterium
SHAAMWNPAFEQLAEQRH

SEQ ID NO: 731687 - protein, 18 aa, Mycobacterium
SHAAQWALPGGRLDPGET

SEQ ID NO: 731688 - protein, 18 aa, Mycobacterium
SHAAQWALPGGRVDRGES

SEQ ID NO: 731689 - protein, 18 aa, Mycobacterium
SHAAVAPHLGVNAADAAT

SEQ ID NO: 731690 - protein, 19 aa, Mycobacterium
SHAAVAPHLGVNAADAVTV

SEQ ID NO: 731691 - protein, 18 aa, Mycobacterium
SHADFFVRNLIAILAEER

SEQ ID NO: 731692 - protein, 17 aa, Mycobacterium
SHADSWCGPATAQATPT

SEQ ID NO: 731693 - protein, 18 aa, Mycobacterium
SHAEGAPDDGMWVKTGDY

SEQ ID NO: 731694 - protein, 19 aa, Mycobacterium
SHAEWELTDNLSFAKASSA

SEQ ID NO: 731695 - protein, 21 aa, Mycobacterium
SHAGAAYFLPTLIKGGEMHVL

SEQ ID NO: 731696 - protein, 19 aa, Mycobacterium
SHAGAHGLAGSSPTTNAGH

SEQ ID NO: 731697 - protein, 24 aa, Mycobacterium
SHAHGMDGVHFFTRQKAITTRWLD

SEQ ID NO: 731698 - protein, 24 aa, Mycobacterium
SHAKEALAAFAAMGRDDIVMPTEP

SEQ ID NO: 731699 - protein, 25 aa, Mycobacterium
SHALHSPFWWLKCAVGTEKNDHPAV

SEQ ID NO: 731700 - protein, 18 aa, Mycobacterium
SHAPRPAAARVLDQHEAD

SEQ ID NO: 731701 - protein, 17 aa, Mycobacterium
SHARRIAERAVLAEGLR

SEQ ID NO: 731702 - protein, 22 aa, Mycobacterium
SHAVPMVATFDGEWTEPTVLPA

SEQ ID NO: 731703 - protein, 23 aa, Mycobacterium
SHCSWSVAGTGQFLPHDGASPAI

SEQ ID NO: 731704 - protein, 22 aa, Mycobacterium
SHCSWSVSGIGQFLPHEGATPA

SEQ ID NO: 731705 - protein, 22 aa, Mycobacterium
SHCSWSVTGIGQFLPLDGASPA

SEQ ID NO: 731706 - protein, 22 aa, Mycobacterium
SHCSWSVTGTGQFLALEGASPA

SEQ ID NO: 731707 - protein, 17 aa, Mycobacterium
SHCTGYDRFERYLLGAD

SEQ ID NO: 731708 - protein, 18 aa, Mycobacterium
SHDARFVLIGTMNPEEGE

SEQ ID NO: 731709 - protein, 19 aa, Mycobacterium
SHDARFVLIGTMNPEEGEL

SEQ ID NO: 731710 - protein, 21 aa, Mycobacterium
SHDEMRFVIGHELGHALSGHA

SEQ ID NO: 731711 - protein, 18 aa, Mycobacterium
SHDICSAVHPLALASPFF

SEQ ID NO: 731712 - protein, 17 aa, Mycobacterium
SHDKYGLGRVVEVTGVG

SEQ ID NO: 731713 - protein, 23 aa, Mycobacterium
SHDLRLWRQLEFPGTNGQVSALG

SEQ ID NO: 731714 - protein, 23 aa, Mycobacterium
SHDRLKAELDHLIANRPIIAAEI

SEQ ID NO: 731715 - protein, 24 aa, Mycobacterium
SHDRLKAELDQLIANRPIIAAEIN

SEQ ID NO: 731716 - protein, 24 aa, Mycobacterium
SHDRLRPGLISALIAAREAGQLTH

SEQ ID NO: 731717 - protein, 23 aa, Mycobacterium
SHEAPKTAWLFTGQGSQYPGMAR

SEQ ID NO: 731718 - protein, 20 aa, Mycobacterium
SHEARFVLIGTMNPEEGELR

SEQ ID NO: 731719 - protein, 21 aa, Mycobacterium
SHEQSSRWGGLLDPARVIVEY

SEQ ID NO: 731720 - protein, 24 aa, Mycobacterium
SHFELKMFFAVFLGAGFVTTTHLM

SEQ ID NO: 731721 - protein, 20 aa, Mycobacterium
SHFLRLLACGGTDPELDQLP

SEQ ID NO: 731722 - protein, 24 aa, Mycobacterium
SHFPYAAQIWKSMWTQQTGVDVDG

SEQ ID NO: 731723 - protein, 17 aa, Mycobacterium
SHFSRAVITRWVELPLV

SEQ ID NO: 731724 - protein, 20 aa, Mycobacterium
SHGAAGTGFEAQGHAQGHAS

SEQ ID NO: 731725 - protein, 18 aa, Mycobacterium
SHGEAILVLGTRKAESSG

SEQ ID NO: 731726 - protein, 18 aa, Mycobacterium
SHGGALSPRGDWRAPSDM

SEQ ID NO: 731727 - protein, 19 aa, Mycobacterium
SHGLRAVLEAVRLRRDNHD

SEQ ID NO: 731728 - protein, 21 aa, Mycobacterium
SHGPRGLGYAELPPADARVTG

SEQ ID NO: 731729 - protein, 19 aa, Mycobacterium
SHGRFGWNIVTSAENAAAQ

SEQ ID NO: 731730 - protein, 24 aa, Mycobacterium
SHHPPMRTFLGVPVRVRDVSLGTL

SEQ ID NO: 731731 - protein, 25 aa, Mycobacterium
SHHRRGRGIPLMRSLMHDVDIRPAH

SEQ ID NO: 731732 - protein, 22 aa, Mycobacterium
SHHYTSVIAWMGYEAPHGFGDI

SEQ ID NO: 731733 - protein, 19 aa, Mycobacterium
SHIAGFFKQIAGFEAAFGK

SEQ ID NO: 731734 - protein, 25 aa, Mycobacterium
SHIESRLAVTLSWIREFPSLGPISY

SEQ ID NO: 731735 - protein, 17 aa, Mycobacterium
SHILVALDEAYVEYVRD

SEQ ID NO: 731736 - protein, 17 aa, Mycobacterium
SHIPRIAVMAGQVEADL

SEQ ID NO: 731737 - protein, 31 aa, Mycobacterium
SHITWYTVLACFKLGIVIEGTLARACAGKAE

SEQ ID NO: 731738 - protein, 31 aa, Mycobacterium
SHITWYTVLACFKLGIVIEGTLARACAGQAE

SEQ ID NO: 731739 - protein, 24 aa, Mycobacterium
SHKSIVAGLIFAGMQPRWITPRWD

SEQ ID NO: 731740 - protein, 17 aa, Mycobacterium
SHLAGGYAQTAFAFNYL

SEQ ID NO: 731741 - protein, 22 aa, Mycobacterium
SHLDRCMWRTAKTIIRNSEFVI

SEQ ID NO: 731742 - protein, 18 aa, Mycobacterium
SHLDSSVRTVAPRKGSGR

SEQ ID NO: 731743 - protein, 19 aa, Mycobacterium
SHLFALDALMEVYPDALVI

SEQ ID NO: 731744 - protein, 19 aa, Mycobacterium
SHLGGLGCAQEIMGTMLQI

SEQ ID NO: 731745 - protein, 17 aa, Mycobacterium
SHLGWGHGVHVCLGMHL

SEQ ID NO: 731746 - protein, 18 aa, Mycobacterium
SHLHIEIVPGLAPTNAVP

SEQ ID NO: 731747 - protein, 23 aa, Mycobacterium
SHLISACPSIWIKDDGAYGNGGW

SEQ ID NO: 731748 - protein, 22 aa, Mycobacterium
SHLKMDGSWRVGDRPPRVDHHA

SEQ ID NO: 731749 - protein, 22 aa, Mycobacterium
SHLKMEGAWRIGHTKVAPHRIR

SEQ ID NO: 731750 - protein, 18 aa, Mycobacterium
SHLLLLWGAANRDPAQFE

SEQ ID NO: 731751 - protein, 19 aa, Mycobacterium
SHLLLMWGAANRDPAHFEA

SEQ ID NO: 731752 - protein, 18 aa, Mycobacterium
SHLLLMWGAANRDPVQFD

SEQ ID NO: 731753 - protein, 26 aa, Mycobacterium
SHLPGQRIPLSFGRWPTRDQMVEYFD

SEQ ID NO: 731754 - protein, 17 aa, Mycobacterium
SHLPRERLGVTAQAIAT

SEQ ID NO: 731755 - protein, 20 aa, Mycobacterium
SHLPRIARIVKREMPDVALE

SEQ ID NO: 731756 - protein, 17 aa, Mycobacterium
SHLPRLSPIPVAISAGA

SEQ ID NO: 731757 - protein, 22 aa, Mycobacterium
SHLQAARPGEDWSGSQRFSGDD

SEQ ID NO: 731758 - protein, 19 aa, Mycobacterium
SHLQRYGLSSGRFAVLITL

SEQ ID NO: 731759 - protein, 17 aa, Mycobacterium
SHLRGADAVIFAAGAGP

SEQ ID NO: 731760 - protein, 17 aa, Mycobacterium
SHLRLLEAEAIHIIREV

SEQ ID NO: 731761 - protein, 18 aa, Mycobacterium
SHLRPLLERARRAGRAVV

SEQ ID NO: 731762 - protein, 17 aa, Mycobacterium
SHLRPTGDLVVRTGGTA

SEQ ID NO: 731763 - protein, 20 aa, Mycobacterium
SHLRRLCAVDVHCMGAPRPG

SEQ ID NO: 731764 - protein, 23 aa, Mycobacterium
SHLRSGAEMARLFAGGPDVVTAA

SEQ ID NO: 731765 - protein, 17 aa, Mycobacterium
SHLRSGAEMARLFAQRP

SEQ ID NO: 731766 - protein, 17 aa, Mycobacterium
SHLRSLLAKELANAFDG

SEQ ID NO: 731767 - protein, 22 aa, Mycobacterium
SHLSDGRFILGLGAGERENLAP

SEQ ID NO: 731768 - protein, 20 aa, Mycobacterium
SHLSLLRRLMMDDNWYRGEL

SEQ ID NO: 731769 - protein, 21 aa, Mycobacterium
SHLSPTLWWFIRRSGMPKESV

SEQ ID NO: 731770 - protein, 17 aa, Mycobacterium
SHLTRLFADAGVVALAS

SEQ ID NO: 731771 - protein, 23 aa, Mycobacterium
SHLTVGGFRDWLLDVAAEDDSAA

SEQ ID NO: 731772 - protein, 22 aa, Mycobacterium
SHLVSNLGSLVIRPVTGGEPIV

SEQ ID NO: 731773 - protein, 18 aa, Mycobacterium
SHLYAIEYWTLMNTKNAK

SEQ ID NO: 731774 - protein, 23 aa, Mycobacterium
SHLYPAELARRAKVLGESVGLEV

SEQ ID NO: 731775 - protein, 25 aa, Mycobacterium
SHLYPDSLHAMGWDIGTKGFEIVLS

SEQ ID NO: 731776 - protein, 24 aa, Mycobacterium
SHLYPDSLRTMGFDVRSGGFELVL

SEQ ID NO: 731777 - protein, 22 aa, Mycobacterium
SHLYPDSLRTMGYDVGSAGFEL

SEQ ID NO: 731778 - protein, 22 aa, Mycobacterium
SHPAGSVLIEFGQTRVMCTASA

SEQ ID NO: 731779 - protein, 22 aa, Mycobacterium
SHPAGSVLVEFGQTRVMCTASV

SEQ ID NO: 731780 - protein, 24 aa, Mycobacterium
SHPDGYDGGFLYGSGGSGYNSATS

SEQ ID NO: 731781 - protein, 23 aa, Mycobacterium
SHPDKLAELVALWDRYVEETGVI

SEQ ID NO: 731782 - protein, 25 aa, Mycobacterium
SHPEKLAELLTLWDRYVEENGVILD

SEQ ID NO: 731783 - protein, 21 aa, Mycobacterium
SHPERICFRYEVPDELRERSA

SEQ ID NO: 731784 - protein, 23 aa, Mycobacterium
SHPGACVRATWLKVVPDQIERSL

SEQ ID NO: 731785 - protein, 22 aa, Mycobacterium
SHPGLPRMINMYGITETTVHAS

SEQ ID NO: 731786 - protein, 29 aa, Mycobacterium
SHPIDPSLLPAYLGVGPNNMFPFATPTNA

SEQ ID NO: 731787 - protein, 22 aa, Mycobacterium
SHPRVVVVGGGFIGSEVAATCR

SEQ ID NO: 731788 - protein, 25 aa, Mycobacterium
SHQALCYFGYLAGYRLVHDAASDPL

SEQ ID NO: 731789 - protein, 19 aa, Mycobacterium
SHRDICLIPSSAHGTNAAS

SEQ ID NO: 731790 - protein, 26 aa, Mycobacterium
SHRERYTLPALRDWLRGQREDRGGAT

SEQ ID NO: 731791 - protein, 20 aa, Mycobacterium
SHRPVSCPHQMPAEVEAAVV

SEQ ID NO: 731792 - protein, 23 aa, Mycobacterium
SHRWWVRPHWRQQAKGPNRSLRE

SEQ ID NO: 731793 - protein, 17 aa, Mycobacterium
SHSAQWALPGGRLDPGE

SEQ ID NO: 731794 - protein, 18 aa, Mycobacterium
SHSAQWALPGGRVDPGET

SEQ ID NO: 731795 - protein, 24 aa, Mycobacterium
SHSQKFAWARIFRPMVHGYPLTPF

SEQ ID NO: 731796 - protein, 23 aa, Mycobacterium
SHSRAEDAMSYVFATPEIIATAA

SEQ ID NO: 731797 - protein, 24 aa, Mycobacterium
SHSVASYPGALAFTHERVLGTLSS

SEQ ID NO: 731798 - protein, 22 aa, Mycobacterium
SHSVHIEALLKVFPDARLIWAH

SEQ ID NO: 731799 - protein, 27 aa, Mycobacterium
SHSWFAGYRGDLAFAALIVGGGSSEYA

SEQ ID NO: 731800 - protein, 26 aa, Mycobacterium
SHSWFAGYRGDLAFASLIVGGGSSEY

SEQ ID NO: 731801 - protein, 17 aa, Mycobacterium
SHSYLFGAIRHGRDAAT

SEQ ID NO: 731802 - protein, 17 aa, Mycobacterium
SHTESRGALELLQALMA

SEQ ID NO: 731803 - protein, 18 aa, Mycobacterium
SHTIPFDKVHDALELADT

SEQ ID NO: 731804 - protein, 24 aa, Mycobacterium
SHTPSKAWRPTGLPFGGVEGLSWQ

SEQ ID NO: 731805 - protein, 17 aa, Mycobacterium
SHTRGYIATSLRLLDRK

SEQ ID NO: 731806 - protein, 18 aa, Mycobacterium
SHTRWARELLGPDAVIVP

SEQ ID NO: 731807 - protein, 17 aa, Mycobacterium
SHTVEWHLRKVFAKRGI

SEQ ID NO: 731808 - protein, 20 aa, Mycobacterium
SHTYRLRFTDSMKAEDLSPA

SEQ ID NO: 731809 - protein, 26 aa, Mycobacterium
SHVDEWRATFAVNVFGPVELTLALLP

SEQ ID NO: 731810 - protein, 18 aa, Mycobacterium
SHVELYWTMPEFGSLMEK

SEQ ID NO: 731811 - protein, 17 aa, Mycobacterium
SHVFPIRQFADGIAHTL

SEQ ID NO: 731812 - protein, 18 aa, Mycobacterium
SHVGHIFSRRVQRITDRF

SEQ ID NO: 731813 - protein, 29 aa, Mycobacterium
SHVIDIPSPLEWGCFTFGIIQSENHFTFF

SEQ ID NO: 731814 - protein, 19 aa, Mycobacterium
SHVLWLLLLSMGFGSRLHL

SEQ ID NO: 731815 - protein, 33 aa, Mycobacterium
SHVMGRGSLVTALACGGLAYFAASSDMSTLFED

SEQ ID NO: 731816 - protein, 30 aa, Mycobacterium
SHVPNLPWPWGLIDLTARVLIPASATVRET

SEQ ID NO: 731817 - protein, 24 aa, Mycobacterium
SHWRNKLLVCKTVGGGDEPGDPII

SEQ ID NO: 731818 - protein, 20 aa, Mycobacterium
SHWWAHRALWHLIFSGVLDR

SEQ ID NO: 731819 - protein, 17 aa, Mycobacterium
SHYGRMCPIETPEGPNI

SEQ ID NO: 731820 - protein, 20 aa, Mycobacterium
SHYRTALTILERYADRLPFD

SEQ ID NO: 731821 - protein, 19 aa, Mycobacterium
SHYVLSQPGADEFLDTYHR

SEQ ID NO: 731822 - protein, 26 aa, Mycobacterium
SHYVPGIAGPAGWCVYLDNDDRSRHR

SEQ ID NO: 731823 - protein, 24 aa, Mycobacterium
SHYWPAHSTVALAVDGRSTEFKTG

SEQ ID NO: 731824 - protein, 23 aa, Mycobacterium
SIAACVGWSYDLCTESEQRLWCR

SEQ ID NO: 731825 - protein, 19 aa, Mycobacterium
SIAALRAEPVDSYGVGTSL

SEQ ID NO: 731826 - protein, 19 aa, Mycobacterium
SIAAYGWDFPDHVTEDYPT

SEQ ID NO: 731827 - protein, 19 aa, Mycobacterium
SIACNRDALVSRYADVAIE

SEQ ID NO: 731828 - protein, 20 aa, Mycobacterium
SIADAARWARTARVVEPDPA

SEQ ID NO: 731829 - protein, 18 aa, Mycobacterium
SIADGPWGREVVGAAQGG

SEQ ID NO: 731830 - protein, 25 aa, Mycobacterium
SIAETIDWGRTLLALGLDTIDDAVV

SEQ ID NO: 731831 - protein, 25 aa, Mycobacterium
SIAETIDWGRTLLALGLDTIDDSVV

SEQ ID NO: 731832 - protein, 17 aa, Mycobacterium
SIAGLRRVSKPGLRVYA

SEQ ID NO: 731833 - protein, 23 aa, Mycobacterium
SIAGREFGSRLILGTGGAANLAV

SEQ ID NO: 731834 - protein, 27 aa, Mycobacterium
SIAGYPRVVWIAGGLLKGAAVDDLVRD

SEQ ID NO: 731835 - protein, 24 aa, Mycobacterium
SIAHAFRIDVRYFIDSGYADELES

SEQ ID NO: 731836 - protein, 19 aa, Mycobacterium
SIAHALRWQFDSVEKVGPD

SEQ ID NO: 731837 - protein, 18 aa, Mycobacterium
SIAHGIRRFEFMIHADES

SEQ ID NO: 731838 - protein, 18 aa, Mycobacterium
SIAHGIRRFEFMIHADET

SEQ ID NO: 731839 - protein, 17 aa, Mycobacterium
SIAKRATAMAALLLQEA

SEQ ID NO: 731840 - protein, 21 aa, Mycobacterium
SIALCGPAYDALRALSEAQQV

SEQ ID NO: 731841 - protein, 18 aa, Mycobacterium
SIALPFGLSAGMLPAIGF

SEQ ID NO: 731842 - protein, 25 aa, Mycobacterium
SIALRRKFSASGFIEDVRRYGATYA

SEQ ID NO: 731843 - protein, 18 aa, Mycobacterium
SIAQFAGSVQRAMRDAAG

SEQ ID NO: 731844 - protein, 20 aa, Mycobacterium
SIARFRRRHLAALEALFLQA

SEQ ID NO: 731845 - protein, 18 aa, Mycobacterium
SIARRIGLTRARMEILPI

SEQ ID NO: 731846 - protein, 23 aa, Mycobacterium
SIATRRIAVLAADGVDIHGVELL

SEQ ID NO: 731847 - protein, 17 aa, Mycobacterium
SIATVLEPGCRAAAALL

SEQ ID NO: 731848 - protein, 18 aa, Mycobacterium
SIAVGGRTTGLAAAAADE

SEQ ID NO: 731849 - protein, 31 aa, Mycobacterium
SICAADRWAYLPALEQVASWYWIVTHPGDHG

SEQ ID NO: 731850 - protein, 25 aa, Mycobacterium
SIDALRWFEREGLFPRVPRDAGGRR

SEQ ID NO: 731851 - protein, 21 aa, Mycobacterium
SIDFLEIWDAQAWQEYQELHE

SEQ ID NO: 731852 - protein, 18 aa, Mycobacterium
SIDICRPLAHHVRMTIDG

SEQ ID NO: 731853 - protein, 25 aa, Mycobacterium
SIDLIREMMDWAACEHVPDDYLPLV

SEQ ID NO: 731854 - protein, 24 aa, Mycobacterium
SIDLRDDWPAALRAAGFDPSAPTA

SEQ ID NO: 731855 - protein, 23 aa, Mycobacterium
SIDLSVPLPGFIVKRTMKGGVET

SEQ ID NO: 731856 - protein, 18 aa, Mycobacterium
SIDPLRPVAHVRANAVEV

SEQ ID NO: 731857 - protein, 20 aa, Mycobacterium
SIDPNSGWFGLANTYANQFV

SEQ ID NO: 731858 - protein, 21 aa, Mycobacterium
SIEFPLRGLIQGWQDGIPGMK

SEQ ID NO: 731859 - protein, 22 aa, Mycobacterium
SIEGCLGATCLAISRTAWNAIG

SEQ ID NO: 731860 - protein, 25 aa, Mycobacterium
SIELMGSDVLPEFIERDAKAVAEKA

SEQ ID NO: 731861 - protein, 24 aa, Mycobacterium
SIELPLMEVRALLDLGDVAKATRK

SEQ ID NO: 731862 - protein, 32 aa, Mycobacterium
SIELRRLDADAGRALRLRLNMESGVVVEVLPD

SEQ ID NO: 731863 - protein, 27 aa, Mycobacterium
SIENESRLGYFAALYKRITVAVRTAVA

SEQ ID NO: 731864 - protein, 23 aa, Mycobacterium
SIERSRLPFGRHCWVSPRRSSGL

SEQ ID NO: 731865 - protein, 21 aa, Mycobacterium
SIEVGKCADLVLWDLSTLGHS

SEQ ID NO: 731866 - protein, 20 aa, Mycobacterium
SIEVSDRLDIEVVDNGRGIP

SEQ ID NO: 731867 - protein, 18 aa, Mycobacterium
SIFAALRGDNEFDINRLI

SEQ ID NO: 731868 - protein, 23 aa, Mycobacterium
SIFFKRDAPSYFVLAPRDGGRVR

SEQ ID NO: 731869 - protein, 17 aa, Mycobacterium
SIFPRNVDYSAFNEVHW

SEQ ID NO: 731870 - protein, 18 aa, Mycobacterium
SIFRRASDRIVLDLRRPT

SEQ ID NO: 731871 - protein, 18 aa, Mycobacterium
SIGDAWAADIVVKVAPPN

SEQ ID NO: 731872 - protein, 23 aa, Mycobacterium
SIGEKIGLRGFGDVEVSTQQLAD

SEQ ID NO: 731873 - protein, 23 aa, Mycobacterium
SIGELWLGVLVCQAVGAAAWGLR

SEQ ID NO: 731874 - protein, 21 aa, Mycobacterium
SIGGEVWRLSPAALGTFLAQL

SEQ ID NO: 731875 - protein, 26 aa, Mycobacterium
SIGGLPPHRGRMPLGHEPAGEVVAVG

SEQ ID NO: 731876 - protein, 17 aa, Mycobacterium
SIGHPFGATGARMVTTM

SEQ ID NO: 731877 - protein, 28 aa, Mycobacterium
SIGIRSVCYLPLTYDHRLIDGADAGRFL

SEQ ID NO: 731878 - protein, 21 aa, Mycobacterium
SIGLLMARCRGAKAFLHCSSA

SEQ ID NO: 731879 - protein, 17 aa, Mycobacterium
SIGMEFFDELAVMVDTF

SEQ ID NO: 731880 - protein, 18 aa, Mycobacterium
SIGMRYPTELNIVADAKA

SEQ ID NO: 731881 - protein, 18 aa, Mycobacterium
SIGPGLPEDADFSLFGKV

SEQ ID NO: 731882 - protein, 26 aa, Mycobacterium
SIGSDEEWRCAAGVFDHHEWADDPRF

SEQ ID NO: 731883 - protein, 17 aa, Mycobacterium
SIGSIYSGGYWLVPLLK

SEQ ID NO: 731884 - protein, 21 aa, Mycobacterium
SIGVPEPLKLAGTPEQKKKFL

SEQ ID NO: 731885 - protein, 19 aa, Mycobacterium
SIGVPGILRMLEMVHNEHG

SEQ ID NO: 731886 - protein, 25 aa, Mycobacterium
SIGYAACHWCHVMAHESFEDAEVAA

SEQ ID NO: 731887 - protein, 25 aa, Mycobacterium
SIGYAACHWCHVMAHESFSDDEVAA

SEQ ID NO: 731888 - protein, 25 aa, Mycobacterium
SIHAFNLWLDEDWGFDRPDGRIIAA

SEQ ID NO: 731889 - protein, 18 aa, Mycobacterium
SIHLKRAHLPLHRLPDKW

SEQ ID NO: 731890 - protein, 23 aa, Mycobacterium
SIHPINVRLGGFYSVPDRSQLAP

SEQ ID NO: 731891 - protein, 27 aa, Mycobacterium
SIHREWLLIELKSSWQVGDIEYSAGTL

SEQ ID NO: 731892 - protein, 27 aa, Mycobacterium
SIHREWLLIELRTDWFYGANSYPAGSL

SEQ ID NO: 731893 - protein, 28 aa, Mycobacterium
SIHRTGRCVVMHEGPRSLGFGAELAARI

SEQ ID NO: 731894 - protein, 27 aa, Mycobacterium
SIHRTGRCVVMHEGPRSLGYGAGLAAR

SEQ ID NO: 731895 - protein, 18 aa, Mycobacterium
SIHRVWRSKLPEVIEKGT

SEQ ID NO: 731896 - protein, 19 aa, Mycobacterium
SIHSAEWDPGLDLTGKKVA

SEQ ID NO: 731897 - protein, 18 aa, Mycobacterium
SIHSGAWDDFFAVVNETR

SEQ ID NO: 731898 - protein, 18 aa, Mycobacterium
SIHSHLKMEGSWRVGERP

SEQ ID NO: 731899 - protein, 20 aa, Mycobacterium
SIHVPAGTLAQVSIPAGSGF

SEQ ID NO: 731900 - protein, 18 aa, Mycobacterium
SIIDRVVAGLGRRLVEVP

SEQ ID NO: 731901 - protein, 17 aa, Mycobacterium
SIIGNGVDWFRSMGSEK

SEQ ID NO: 731902 - protein, 17 aa, Mycobacterium
SIIGSLVARCLPVPIDD

SEQ ID NO: 731903 - protein, 24 aa, Mycobacterium
SIILPRPDPELVLRTIERYAVTNY

SEQ ID NO: 731904 - protein, 25 aa, Mycobacterium
SIILPRPEPELVLRTIEKYGVTNYF

SEQ ID NO: 731905 - protein, 19 aa, Mycobacterium
SIIPAGWSFLLALRSRGLG

SEQ ID NO: 731906 - protein, 18 aa, Mycobacterium
SIIPCGITDAGVTSLTAE

SEQ ID NO: 731907 - protein, 32 aa, Mycobacterium
SIKDALWTRGWPTLRGSTLIDEAGPWDEDAPS

SEQ ID NO: 731908 - protein, 25 aa, Mycobacterium
SIKELCRRWYPRIYFGQPDKGLAHR

SEQ ID NO: 731909 - protein, 18 aa, Mycobacterium
SIKPLFAAMGLRPLRHSP

SEQ ID NO: 731910 - protein, 23 aa, Mycobacterium
SILAGEVHFAIGYTEPEAGTDLA

SEQ ID NO: 731911 - protein, 18 aa, Mycobacterium
SILAPEWRIVLLERSDAL

SEQ ID NO: 731912 - protein, 23 aa, Mycobacterium
SILARSIVRLAISYVSMPPESDH

SEQ ID NO: 731913 - protein, 25 aa, Mycobacterium
SILCDPWLNPAYFTSWFPFPDNSAL

SEQ ID NO: 731914 - protein, 23 aa, Mycobacterium
SILCDPWVNPAYFASWFPFPDNS

SEQ ID NO: 731915 - protein, 27 aa, Mycobacterium
SILDAAARWRGPIPGRDRVRIIVAGAP

SEQ ID NO: 731916 - protein, 19 aa, Mycobacterium
SILDRDWLHPGSIVVADNV

SEQ ID NO: 731917 - protein, 20 aa, Mycobacterium
SILDWLRAGYPSGVPGPDRV

SEQ ID NO: 731918 - protein, 20 aa, Mycobacterium
SILELIDRVAGWLASLQGNT

SEQ ID NO: 731919 - protein, 20 aa, Mycobacterium
SILGPRSFRALRLDRNRNLI

SEQ ID NO: 731920 - protein, 20 aa, Mycobacterium
SILIRGLMNYAFWVPNGSPE

SEQ ID NO: 731921 - protein, 19 aa, Mycobacterium
SILLRGGFSAESTWRTLSE

SEQ ID NO: 731922 - protein, 24 aa, Mycobacterium
SILQFAKFPLWKDLDESWEALSRN

SEQ ID NO: 731923 - protein, 19 aa, Mycobacterium
SILQRRVVFKADRAAVQAI

SEQ ID NO: 731924 - protein, 20 aa, Mycobacterium
SILQRRVVFRADRDAVKQIA

SEQ ID NO: 731925 - protein, 21 aa, Mycobacterium
SILQRRVVFRAEKAAVQDIAT

SEQ ID NO: 731926 - protein, 28 aa, Mycobacterium
SILRALALNRFAKVPTLVGGQMLNLQEP

SEQ ID NO: 731927 - protein, 23 aa, Mycobacterium
SILRKPRAGLSYETLLETVEKRL

SEQ ID NO: 731928 - protein, 21 aa, Mycobacterium
SILRVLAMHRFAKSPMLVGGQ

SEQ ID NO: 731929 - protein, 23 aa, Mycobacterium
SILSLFYRWAMDEGYAEAEPFTY

SEQ ID NO: 731930 - protein, 25 aa, Mycobacterium
SILTAARFSQHGQLFQEISAQAAAV

SEQ ID NO: 731931 - protein, 17 aa, Mycobacterium
SIMPGKVNPVIPEVVNQ

SEQ ID NO: 731932 - protein, 17 aa, Mycobacterium
SIMPGKVNPVLPEAVTQ

SEQ ID NO: 731933 - protein, 23 aa, Mycobacterium
SINEARMLYVLAHELLGRRPEHV

SEQ ID NO: 731934 - protein, 19 aa, Mycobacterium
SINLLRRLGFESISTFIQF

SEQ ID NO: 731935 - protein, 24 aa, Mycobacterium
SINPPRFLVGLSRKNYTFTVAQDA

SEQ ID NO: 731936 - protein, 23 aa, Mycobacterium
SIPAVIKNAIDWLSRPFGDGALK

SEQ ID NO: 731937 - protein, 20 aa, Mycobacterium
SIPAVTFPKVPATGKVDLAI

SEQ ID NO: 731938 - protein, 25 aa, Mycobacterium
SIPDRLRGSGALEVPGFGRIPFGHN

SEQ ID NO: 731939 - protein, 18 aa, Mycobacterium
SIPEAFAVQVARSPDAVA

SEQ ID NO: 731940 - protein, 22 aa, Mycobacterium
SIPERICGGLASALTDVPDGQA

SEQ ID NO: 731941 - protein, 17 aa, Mycobacterium
SIPERWSPDAGPEQLAI

SEQ ID NO: 731942 - protein, 22 aa, Mycobacterium
SIPEVADLVAMLRLVGDPTAGA

SEQ ID NO: 731943 - protein, 25 aa, Mycobacterium
SIPGMGFRLGAEFLAAVGDPELIGS

SEQ ID NO: 731944 - protein, 24 aa, Mycobacterium
SIPGPRIYPAGGFISQSGGHGDFR

SEQ ID NO: 731945 - protein, 24 aa, Mycobacterium
SIPILDLPTAPGFGNATDSPSSGF

SEQ ID NO: 731946 - protein, 21 aa, Mycobacterium
SIPNFLPLLAERFARQRLRAL

SEQ ID NO: 731947 - protein, 26 aa, Mycobacterium
SIPNRWLVRPGALRPRHWDVEPDLTN

SEQ ID NO: 731948 - protein, 18 aa, Mycobacterium
SIPPIAFGRGLRPEHVRT

SEQ ID NO: 731949 - protein, 27 aa, Mycobacterium
SIPRHPGIAALTYHWTALYPDPGAPRF

SEQ ID NO: 731950 - protein, 17 aa, Mycobacterium
SIPTVQSLIRWDPVGHA

SEQ ID NO: 731951 - protein, 21 aa, Mycobacterium
SIQKEWAWRTSRGESLKNLEA

SEQ ID NO: 731952 - protein, 17 aa, Mycobacterium
SIRCFERALDLDPGLAI

SEQ ID NO: 731953 - protein, 21 aa, Mycobacterium
SIRFGIIPTVAPYVLPTVLAG

SEQ ID NO: 731954 - protein, 26 aa, Mycobacterium
SIRHALDIGKTRGWMHTFFADHSKTP

SEQ ID NO: 731955 - protein, 20 aa, Mycobacterium
SIRLEARPDPALPGPDGAIV

SEQ ID NO: 731956 - protein, 21 aa, Mycobacterium
SIRLVTPVQWAMRQTVRDAEL

SEQ ID NO: 731957 - protein, 27 aa, Mycobacterium
SIRMPEDIIRCAFNRSYSITAVIDTPG

SEQ ID NO: 731958 - protein, 18 aa, Mycobacterium
SIRNGRRSVVITGTPEQL

SEQ ID NO: 731959 - protein, 20 aa, Mycobacterium
SIRRHRIAGLAYERVTFEHD

SEQ ID NO: 731960 - protein, 24 aa, Mycobacterium
SIRTGRANPGMFNRIHIDYYGAST

SEQ ID NO: 731961 - protein, 24 aa, Mycobacterium
SIRTRLPRVLDWLERADVDVLAIQ

SEQ ID NO: 731962 - protein, 22 aa, Mycobacterium
SIRYASNIPHWYVNPSETEECT

SEQ ID NO: 731963 - protein, 23 aa, Mycobacterium
SISAEPKVKMVIPVDPAGDGGLM

SEQ ID NO: 731964 - protein, 26 aa, Mycobacterium
SISALLEFVKRGSLATVLPDAIAHEH

SEQ ID NO: 731965 - protein, 24 aa, Mycobacterium
SISARSFLALGIPAKHAPWIAAGL

SEQ ID NO: 731966 - protein, 19 aa, Mycobacterium
SISEWRWVGLPEQLDLSNV

SEQ ID NO: 731967 - protein, 20 aa, Mycobacterium
SISFSVRHLVVSKVRGTFEK

SEQ ID NO: 731968 - protein, 24 aa, Mycobacterium
SISGDLRVDFGWLGTVVQAYLRRT

SEQ ID NO: 731969 - protein, 21 aa, Mycobacterium
SISGESLGGWVAARAAVDHPE

SEQ ID NO: 731970 - protein, 17 aa, Mycobacterium
SISHPVLVIGFADDVVL

SEQ ID NO: 731971 - protein, 18 aa, Mycobacterium
SISLLSWMLNPERGLAAS

SEQ ID NO: 731972 - protein, 26 aa, Mycobacterium
SISMISAIAPFISWLSAVAAQAEEAA

SEQ ID NO: 731973 - protein, 23 aa, Mycobacterium
SISRGELDAGLAFHSPLNYRPQL

SEQ ID NO: 731974 - protein, 18 aa, Mycobacterium
SISTFQAVQFMLADMAMK

SEQ ID NO: 731975 - protein, 26 aa, Mycobacterium
SITAALGRPGIELFRKLVEDYEREHD

SEQ ID NO: 731976 - protein, 19 aa, Mycobacterium
SITARRILVATGLTDVLPE

SEQ ID NO: 731977 - protein, 27 aa, Mycobacterium
SITDFKIGPITIPTIKGILPVIDINIG

SEQ ID NO: 731978 - protein, 30 aa, Mycobacterium
SITEVYTAVGLPRFYVITVFKQIEPADLYV

SEQ ID NO: 731979 - protein, 28 aa, Mycobacterium
SITGFPNRWIIVGPYSWTGNGGWHGLAD

SEQ ID NO: 731980 - protein, 18 aa, Mycobacterium
SITKVFWSDLDVALHQTA

SEQ ID NO: 731981 - protein, 18 aa, Mycobacterium
SITKVFWSELDVALHETA

SEQ ID NO: 731982 - protein, 35 aa, Mycobacterium
SITLRPETQIAISAWGLLSPQGRCATFDAAADGFV

SEQ ID NO: 731983 - protein, 24 aa, Mycobacterium
SITMSDIRFARFIGTEIFPGGQLP

SEQ ID NO: 731984 - protein, 26 aa, Mycobacterium
SITQRWAHRIAEAFPDVDGILYNSRF

SEQ ID NO: 731985 - protein, 22 aa, Mycobacterium
SITRAASLLGMAQPALSRQLQL

SEQ ID NO: 731986 - protein, 25 aa, Mycobacterium
SITRLGLGPEWCRKVLRDNAVRLFA

SEQ ID NO: 731987 - protein, 19 aa, Mycobacterium
SITRRMFRDGAGEYEINGQ

SEQ ID NO: 731988 - protein, 19 aa, Mycobacterium
SITVGGIDAGGFRTPAIST

SEQ ID NO: 731989 - protein, 37 aa, Mycobacterium
SIVAARSRRGAAIGHGQREAYMSFLIVATEALEAAAS

SEQ ID NO: 731990 - protein, 22 aa, Mycobacterium
SIVDTPGGRVCIESVISGQRRY

SEQ ID NO: 731991 - protein, 20 aa, Mycobacterium
SIVFAELGTGRVLRLDDGRV

SEQ ID NO: 731992 - protein, 17 aa, Mycobacterium
SIVGRRGLATGTLYNRS

SEQ ID NO: 731993 - protein, 27 aa, Mycobacterium
SIVLGALPFDVEWPAALLTPGAVRHTD

SEQ ID NO: 731994 - protein, 24 aa, Mycobacterium
SIVLLDIPAAPGFGNSTSAPSSGF

SEQ ID NO: 731995 - protein, 19 aa, Mycobacterium
SIVLLRLAEKAFRPAPLPF

SEQ ID NO: 731996 - protein, 24 aa, Mycobacterium
SIVLPGMVVPIELDDAARAAVDAA

SEQ ID NO: 731997 - protein, 18 aa, Mycobacterium
SIVLWPQVVKEIAPVPVL

SEQ ID NO: 731998 - protein, 35 aa, Mycobacterium
SIVPIGAGCKICDRPACPQRAFPYLGHPVYVDPHS

SEQ ID NO: 731999 - protein, 18 aa, Mycobacterium
SIVVPGFVDIHVHGGAGA

SEQ ID NO: 732000 - protein, 32 aa, Mycobacterium
SIVWAIGYRPDYRWIAASAFDGAGRPMQTRGI

SEQ ID NO: 732001 - protein, 17 aa, Mycobacterium
SIVYGGGPMYVESLRKA

SEQ ID NO: 732002 - protein, 20 aa, Mycobacterium
SIWEIFWPLIVGARLVIAEP

SEQ ID NO: 732003 - protein, 25 aa, Mycobacterium
SIWEPRRVLVTIGIRQARSIREVLS

SEQ ID NO: 732004 - protein, 23 aa, Mycobacterium
SIWGDFPAAVSWQRTSDEMRQDL

SEQ ID NO: 732005 - protein, 20 aa, Mycobacterium
SIWGFPKIMADFTVREQGRF

SEQ ID NO: 732006 - protein, 23 aa, Mycobacterium
SIWKGSIAFGLVNVPVKVYSATQ

SEQ ID NO: 732007 - protein, 18 aa, Mycobacterium
SIWSARRVVAATWPDEPD

SEQ ID NO: 732008 - protein, 22 aa, Mycobacterium
SIYEARLYVRGEVASLGADCIA

SEQ ID NO: 732009 - protein, 26 aa, Mycobacterium
SIYHGKRAGAMGCFGTFSFHGTKTIT

SEQ ID NO: 732010 - protein, 20 aa, Mycobacterium
SIYRFEGQVSIFWEDAPNGL

SEQ ID NO: 732011 - protein, 18 aa, Mycobacterium
SKAAAWSATNAMRAELTA

SEQ ID NO: 732012 - protein, 18 aa, Mycobacterium
SKAACSRVAVAAQDGLAR

SEQ ID NO: 732013 - protein, 24 aa, Mycobacterium
SKAAHALAALYAVDTRAGTTDDSP

SEQ ID NO: 732014 - protein, 22 aa, Mycobacterium
SKAAIRAALWAVDEAVSRGVPL

SEQ ID NO: 732015 - protein, 18 aa, Mycobacterium
SKAALWSMTNSLRAELEK

SEQ ID NO: 732016 - protein, 19 aa, Mycobacterium
SKAARKVWDSADKFTRETL

SEQ ID NO: 732017 - protein, 20 aa, Mycobacterium
SKAARKVWDTADKFTRETLG

SEQ ID NO: 732018 - protein, 35 aa, Mycobacterium
SKAEIIRCLKRFLAREIWASCIHCAPLHKPKNQPL

SEQ ID NO: 732019 - protein, 22 aa, Mycobacterium
SKAGGFGVLGAVGFSPEQLEIE

SEQ ID NO: 732020 - protein, 19 aa, Mycobacterium
SKAGLRLQGFEVGDPRLPQ

SEQ ID NO: 732021 - protein, 23 aa, Mycobacterium
SKAHARVLFRAGLLTEEQRDGLL

SEQ ID NO: 732022 - protein, 19 aa, Mycobacterium
SKAHARVLHRAGLLTDEQR

SEQ ID NO: 732023 - protein, 18 aa, Mycobacterium
SKAIICFEPMAAPTDALR

SEQ ID NO: 732024 - protein, 23 aa, Mycobacterium
SKAIRTGYVAAFSVPANQLPDEV

SEQ ID NO: 732025 - protein, 20 aa, Mycobacterium
SKAKAGGLVEGRRLTKVVGL

SEQ ID NO: 732026 - protein, 24 aa, Mycobacterium
SKALFYFYFPRKEDVLFEVGVLST

SEQ ID NO: 732027 - protein, 18 aa, Mycobacterium
SKALLRPVIAVSDARRVD

SEQ ID NO: 732028 - protein, 23 aa, Mycobacterium
SKAPKLRLVHKLGAGVNTVDVDT

SEQ ID NO: 732029 - protein, 22 aa, Mycobacterium
SKAQLLALHLGRLKDAGRISPE

SEQ ID NO: 732030 - protein, 18 aa, Mycobacterium
SKARAVMVQKGFLGQEYT

SEQ ID NO: 732031 - protein, 19 aa, Mycobacterium
SKARGMLFYRLLQQSVNTD

SEQ ID NO: 732032 - protein, 19 aa, Mycobacterium
SKARGTWRATSATAGYSSD

SEQ ID NO: 732033 - protein, 24 aa, Mycobacterium
SKAWRTSAVRQILCSGRIAGLREH

SEQ ID NO: 732034 - protein, 24 aa, Mycobacterium
SKAYARWMSAMGYRPVSTRHVNEG

SEQ ID NO: 732035 - protein, 23 aa, Mycobacterium
SKDALCQQLLRNHYEGWLSQVAL

SEQ ID NO: 732036 - protein, 19 aa, Mycobacterium
SKDDLMWLVCQRRWGPKQV

SEQ ID NO: 732037 - protein, 24 aa, Mycobacterium
SKDGPFPLDAFKKVIGVNLIGTFN

SEQ ID NO: 732038 - protein, 24 aa, Mycobacterium
SKDGPFPLDGFKKVIGVNLIGTFN

SEQ ID NO: 732039 - protein, 17 aa, Mycobacterium
SKDLPFAQKRFCGAEGI

SEQ ID NO: 732040 - protein, 26 aa, Mycobacterium
SKDPLWDCWKCALGDADGIITINVAG

SEQ ID NO: 732041 - protein, 29 aa, Mycobacterium
SKDQLRRYRAQSGFVFQAHNLFPHMTVLQ

SEQ ID NO: 732042 - protein, 23 aa, Mycobacterium
SKDSTRYLMHFSQSGIGLPDESY

SEQ ID NO: 732043 - protein, 19 aa, Mycobacterium
SKDTLIGEVYLRLLHDADT

SEQ ID NO: 732044 - protein, 19 aa, Mycobacterium
SKEAILIELIRRYQDDLDR

SEQ ID NO: 732045 - protein, 18 aa, Mycobacterium
SKEAVLLTLLDRVVNEAD

SEQ ID NO: 732046 - protein, 18 aa, Mycobacterium
SKEAVLLTLLDRVVTEAD

SEQ ID NO: 732047 - protein, 25 aa, Mycobacterium
SKEKAQELGLTWLVEIGAHGVAAGP

SEQ ID NO: 732048 - protein, 18 aa, Mycobacterium
SKELRWSALTTSGDGELW

SEQ ID NO: 732049 - protein, 24 aa, Mycobacterium
SKENLLGGGLCQPVGPGTNTRFLP

SEQ ID NO: 732050 - protein, 25 aa, Mycobacterium
SKFAAEHPWLLGAYLTHTFGVEQVQ

SEQ ID NO: 732051 - protein, 28 aa, Mycobacterium
SKFDLVGWLPAYLHWYGLAMRRPMLRWT

SEQ ID NO: 732052 - protein, 17 aa, Mycobacterium
SKGAFQFIAPTFAAYHQ

SEQ ID NO: 732053 - protein, 24 aa, Mycobacterium
SKGCAMLLMGWDSLFWGDVEKASD

SEQ ID NO: 732054 - protein, 19 aa, Mycobacterium
SKGCESEFVDPFAMVLPIR

SEQ ID NO: 732055 - protein, 17 aa, Mycobacterium
SKGGAPEAPGWYHNLKA

SEQ ID NO: 732056 - protein, 17 aa, Mycobacterium
SKGGDPRAPGWYHNLKA

SEQ ID NO: 732057 - protein, 25 aa, Mycobacterium
SKGHFYGVGLINWWDPSGTRSTLEQ

SEQ ID NO: 732058 - protein, 21 aa, Mycobacterium
SKGRGALGMCELAVAGTVVAT

SEQ ID NO: 732059 - protein, 20 aa, Mycobacterium
SKGRTSLVITELPYQVNHDN

SEQ ID NO: 732060 - protein, 21 aa, Mycobacterium
SKGTSEGWCPACGSPYSFLPQ

SEQ ID NO: 732061 - protein, 18 aa, Mycobacterium
SKGVLCAHRQSLAASASW

SEQ ID NO: 732062 - protein, 30 aa, Mycobacterium
SKGWREMRSLYELQLPYSGWFVDVTGAESI

SEQ ID NO: 732063 - protein, 18 aa, Mycobacterium
SKGYCFQIEMTWRTVNSG

SEQ ID NO: 732064 - protein, 20 aa, Mycobacterium
SKHFPFDWRPDGAVPTVSDE

SEQ ID NO: 732065 - protein, 23 aa, Mycobacterium
SKHLCARSSVVFASEPMDGDPRW

SEQ ID NO: 732066 - protein, 17 aa, Mycobacterium
SKHLRRAYVDGDDREAR

SEQ ID NO: 732067 - protein, 22 aa, Mycobacterium
SKIANGVGICLASPPEVWDCVE

SEQ ID NO: 732068 - protein, 28 aa, Mycobacterium
SKIASWTEPKGGYFISLDVMPGTARRTV

SEQ ID NO: 732069 - protein, 25 aa, Mycobacterium
SKIASWTEPQGGYFISLDVLPGTAR

SEQ ID NO: 732070 - protein, 19 aa, Mycobacterium
SKIAVFRYLLGDEDKAQHA

SEQ ID NO: 732071 - protein, 18 aa, Mycobacterium
SKIDAAWNLHELTRDLNL

SEQ ID NO: 732072 - protein, 20 aa, Mycobacterium
SKIHSVASFFVSRVDTEIDK

SEQ ID NO: 732073 - protein, 19 aa, Mycobacterium
SKIKANIAEILKREGYITD

SEQ ID NO: 732074 - protein, 20 aa, Mycobacterium
SKILPVVPFPAVVKQRAQAS

SEQ ID NO: 732075 - protein, 17 aa, Mycobacterium
SKIRVGDIIGTVRPTPQ

SEQ ID NO: 732076 - protein, 17 aa, Mycobacterium
SKIVRYHLLLPNTATRR

SEQ ID NO: 732077 - protein, 19 aa, Mycobacterium
SKKMFRAAIQTMRSPAARR

SEQ ID NO: 732078 - protein, 19 aa, Mycobacterium
SKKPLVTLGNKFSPTTTAG

SEQ ID NO: 732079 - protein, 22 aa, Mycobacterium
SKKRSAWWAGAVTLGVAKIVEN

SEQ ID NO: 732080 - protein, 27 aa, Mycobacterium
SKKSGRSELRLAAEAVLDALDDAGLSP

SEQ ID NO: 732081 - protein, 17 aa, Mycobacterium
SKLAELFAHYYNQVPDG

SEQ ID NO: 732082 - protein, 19 aa, Mycobacterium
SKLANLLFVRELVARGKTA

SEQ ID NO: 732083 - protein, 24 aa, Mycobacterium
SKLAPQCCAVVAYGALLGDALLAI

SEQ ID NO: 732084 - protein, 19 aa, Mycobacterium
SKLAVPIHVGGGYGGDSDW

SEQ ID NO: 732085 - protein, 23 aa, Mycobacterium
SKLDRFIGLVAIDRGHPRVADRA

SEQ ID NO: 732086 - protein, 18 aa, Mycobacterium
SKLGEYLLFAQAVANAVV

SEQ ID NO: 732087 - protein, 17 aa, Mycobacterium
SKLHAGKVLALSGILDQ

SEQ ID NO: 732088 - protein, 21 aa, Mycobacterium
SKLKANIAEILKREGYISDYR

SEQ ID NO: 732089 - protein, 19 aa, Mycobacterium
SKLLLWLPSFAPERTLKRM

SEQ ID NO: 732090 - protein, 18 aa, Mycobacterium
SKLMLRISGAGAMASVEL

SEQ ID NO: 732091 - protein, 17 aa, Mycobacterium
SKLMRGIRSRAGTDTSF

SEQ ID NO: 732092 - protein, 24 aa, Mycobacterium
SKLPKVFFVNWFRRGDEGQFLWPG

SEQ ID NO: 732093 - protein, 34 aa, Mycobacterium
SKLPKVFFVNWFRRGHDGHFLWPGFGENSRVLKW

SEQ ID NO: 732094 - protein, 22 aa, Mycobacterium
SKLPNLNCLMLTSFTDEHAMLD

SEQ ID NO: 732095 - protein, 22 aa, Mycobacterium
SKLPPDVLSAVFGVPTETFAKF

SEQ ID NO: 732096 - protein, 22 aa, Mycobacterium
SKLPQVFFVNWFRRGEDHRFLW

SEQ ID NO: 732097 - protein, 17 aa, Mycobacterium
SKLTGTIQNDILKEYAS

SEQ ID NO: 732098 - protein, 19 aa, Mycobacterium
SKLTSYFRAGKPILAATDE

SEQ ID NO: 732099 - protein, 19 aa, Mycobacterium
SKMPPRGLTQAAIRYGIGL

SEQ ID NO: 732100 - protein, 18 aa, Mycobacterium
SKMREGQTLFTYLHLAAS

SEQ ID NO: 732101 - protein, 20 aa, Mycobacterium
SKMTVYRLVHNGELPAVRVG

SEQ ID NO: 732102 - protein, 24 aa, Mycobacterium
SKNGPFPLDGFRKVVEVNLIGTFN

SEQ ID NO: 732103 - protein, 25 aa, Mycobacterium
SKNTARRGVLGWLLPLVSRFPTLSM

SEQ ID NO: 732104 - protein, 20 aa, Mycobacterium
SKNTFRPSIITLETIDGQEI

SEQ ID NO: 732105 - protein, 18 aa, Mycobacterium
SKNWLKFKCVRDQEFVVG

SEQ ID NO: 732106 - protein, 24 aa, Mycobacterium
SKPAAPYAKAVREWEQLERFVESR

SEQ ID NO: 732107 - protein, 23 aa, Mycobacterium
SKPFLDAELSEFGRVIDLNVTRM

SEQ ID NO: 732108 - protein, 21 aa, Mycobacterium
SKPHWRDYFSAARRGLVPGPF

SEQ ID NO: 732109 - protein, 19 aa, Mycobacterium
SKPLVAILWGRDASTLKPM

SEQ ID NO: 732110 - protein, 26 aa, Mycobacterium
SKPPPRSWRVIATIQRDGDRFKLSRA

SEQ ID NO: 732111 - protein, 22 aa, Mycobacterium
SKPQEFFDLVGMAEWSALGEKY

SEQ ID NO: 732112 - protein, 17 aa, Mycobacterium
SKPQRAASVGFASGQLG

SEQ ID NO: 732113 - protein, 23 aa, Mycobacterium
SKPRCKRCPLVLHKVRKAELNGI

SEQ ID NO: 732114 - protein, 20 aa, Mycobacterium
SKPYRGHLIRTYGGVVHSSP

SEQ ID NO: 732115 - protein, 30 aa, Mycobacterium
SKQLSADLNYVWPTARIAVIGAEGAAQLLV

SEQ ID NO: 732116 - protein, 18 aa, Mycobacterium
SKQVSRLFAAALAANPDL

SEQ ID NO: 732117 - protein, 21 aa, Mycobacterium
SKRASHGYVRYNHVRVPADHV

SEQ ID NO: 732118 - protein, 26 aa, Mycobacterium
SKRCLIPMDGYYEWRVNDPAAGKKSR

SEQ ID NO: 732119 - protein, 23 aa, Mycobacterium
SKRDRLGSALAEIGFEVHDSRGT

SEQ ID NO: 732120 - protein, 23 aa, Mycobacterium
SKRGRPAALYRPSAADPAIPAQD

SEQ ID NO: 732121 - protein, 21 aa, Mycobacterium
SKRVLDALSELDGRIRSAHST

SEQ ID NO: 732122 - protein, 20 aa, Mycobacterium
SKRVRAVDFTIGYEVRSVNA

SEQ ID NO: 732123 - protein, 23 aa, Mycobacterium
SKRVRTRWINFAAHGAPAGPTGE

SEQ ID NO: 732124 - protein, 20 aa, Mycobacterium
SKRWAQRWNAHDVDAVLDDF

SEQ ID NO: 732125 - protein, 23 aa, Mycobacterium
SKRYRIAELALRDKIPLVMLLEG

SEQ ID NO: 732126 - protein, 22 aa, Mycobacterium
SKRYRIAELAVRDKIPLVMLLE

SEQ ID NO: 732127 - protein, 21 aa, Mycobacterium
SKSAIPWGDFDSHLQHLQNLL

SEQ ID NO: 732128 - protein, 27 aa, Mycobacterium
SKSALVAAVYLRFLRDLPLHTDVNETT

SEQ ID NO: 732129 - protein, 30 aa, Mycobacterium
SKSALVAAVYLRFLRELPLHTDVNETTKTR

SEQ ID NO: 732130 - protein, 26 aa, Mycobacterium
SKSALVAAVYLRLLRDLPLHTDVNDT

SEQ ID NO: 732131 - protein, 17 aa, Mycobacterium
SKSEFRTSPAFDGEGAE

SEQ ID NO: 732132 - protein, 23 aa, Mycobacterium
SKSFYQTVFGFDVLREHTDGDKR

SEQ ID NO: 732133 - protein, 18 aa, Mycobacterium
SKSLLRPVLAVSDVRRVD

SEQ ID NO: 732134 - protein, 24 aa, Mycobacterium
SKSPEPHQRWVLEQIVTMADSVVV

SEQ ID NO: 732135 - protein, 18 aa, Mycobacterium
SKSPFYVGTRLRRWNAPG

SEQ ID NO: 732136 - protein, 24 aa, Mycobacterium
SKSPKEHFDFFPLTVDVEERMYAA

SEQ ID NO: 732137 - protein, 17 aa, Mycobacterium
SKSRISGLALRATDHDW

SEQ ID NO: 732138 - protein, 19 aa, Mycobacterium
SKSVVGLNLLGLWDDRGTL

SEQ ID NO: 732139 - protein, 23 aa, Mycobacterium
SKSWRAVAHRVSRHIATREPILV

SEQ ID NO: 732140 - protein, 18 aa, Mycobacterium
SKTGAAIRKQAPVVVENI

SEQ ID NO: 732141 - protein, 18 aa, Mycobacterium
SKTKIKGTQAIGVALRAR

SEQ ID NO: 732142 - protein, 17 aa, Mycobacterium
SKTKVKVTDRIKAKISE

SEQ ID NO: 732143 - protein, 20 aa, Mycobacterium
SKTLPAMLAGVAPLVLDAPP

SEQ ID NO: 732144 - protein, 24 aa, Mycobacterium
SKTLPAMLAGVVPLVLSTEPQTTV

SEQ ID NO: 732145 - protein, 24 aa, Mycobacterium
SKTLPGMLAGVVPLVLQTSPQTTV

SEQ ID NO: 732146 - protein, 29 aa, Mycobacterium
SKTLYLARWLHPGQRAFQLATQVALLTQA

SEQ ID NO: 732147 - protein, 24 aa, Mycobacterium
SKTVIGLNMLRLWDDRGTLEPWIT

SEQ ID NO: 732148 - protein, 17 aa, Mycobacterium
SKVDAAWNLHELTRDLD

SEQ ID NO: 732149 - protein, 18 aa, Mycobacterium
SKVIALGSIRGYKAESLG

SEQ ID NO: 732150 - protein, 24 aa, Mycobacterium
SKVLTRGIIKWGIRDARELESWNP

SEQ ID NO: 732151 - protein, 18 aa, Mycobacterium
SKVPRFAGPATFARLPRL

SEQ ID NO: 732152 - protein, 24 aa, Mycobacterium
SKVSELPAGHGLNAATLSYGDLVA

SEQ ID NO: 732153 - protein, 24 aa, Mycobacterium
SKVSELPAGHGLNASTLTYGDLAA

SEQ ID NO: 732154 - protein, 17 aa, Mycobacterium
SKVSLSFYGKRPGPGMK

SEQ ID NO: 732155 - protein, 19 aa, Mycobacterium
SKWHIEFGTPIPTDGYDEA

SEQ ID NO: 732156 - protein, 33 aa, Mycobacterium
SKYFSMTGWRLGWMLVPRRFLRAVDRLSSNFTI

SEQ ID NO: 732157 - protein, 18 aa, Mycobacterium
SKYGIEWYGSAEDICRVH

SEQ ID NO: 732158 - protein, 18 aa, Mycobacterium
SKYRCFTQELSFPIETAG

SEQ ID NO: 732159 - protein, 17 aa, Mycobacterium
SKYTNQQLYDWMVGQLA

SEQ ID NO: 732160 - protein, 19 aa, Mycobacterium
SKYVDSWGGLMKVKEDGIA

SEQ ID NO: 732161 - protein, 20 aa, Mycobacterium
SKYWVCKRATPHAGEAMECL

SEQ ID NO: 732162 - protein, 28 aa, Mycobacterium
SLAAELEAVCGWASKQPQPWWHQSADTP

SEQ ID NO: 732163 - protein, 29 aa, Mycobacterium
SLAAFAAVHRFEFDAANRLLAWAEPYQEM

SEQ ID NO: 732164 - protein, 17 aa, Mycobacterium
SLAAFGLTEPGGGTDIP

SEQ ID NO: 732165 - protein, 18 aa, Mycobacterium
SLAAILWAESTDLPDDLG

SEQ ID NO: 732166 - protein, 19 aa, Mycobacterium
SLAALRVIMRLRERMGVTL

SEQ ID NO: 732167 - protein, 18 aa, Mycobacterium
SLAAMSTGPWLRRRKGAE

SEQ ID NO: 732168 - protein, 24 aa, Mycobacterium
SLAAQRPALRHVIVDGEPGDQVSW

SEQ ID NO: 732169 - protein, 21 aa, Mycobacterium
SLAARASVWYGATLRAESEPI

SEQ ID NO: 732170 - protein, 27 aa, Mycobacterium
SLAARYRAAGFWRPRTLCQELQESVER

SEQ ID NO: 732171 - protein, 26 aa, Mycobacterium
SLAAVNVMSLFGLHRALRGAAIGHFA

SEQ ID NO: 732172 - protein, 21 aa, Mycobacterium
SLACLKPAFRKDGTVTAGSSS

SEQ ID NO: 732173 - protein, 17 aa, Mycobacterium
SLADFVKRQNIGSFTLG

SEQ ID NO: 732174 - protein, 18 aa, Mycobacterium
SLADLGFSSVHTVRLAGE

SEQ ID NO: 732175 - protein, 23 aa, Mycobacterium
SLADLRSEPFIGYTGQDSAVNDA

SEQ ID NO: 732176 - protein, 18 aa, Mycobacterium
SLADLVLDPPQGLLVQSY

SEQ ID NO: 732177 - protein, 25 aa, Mycobacterium
SLADYKGRRVVVYFYPAASTPGCTK

SEQ ID NO: 732178 - protein, 18 aa, Mycobacterium
SLAEELDDQWGLSQILSW

SEQ ID NO: 732179 - protein, 20 aa, Mycobacterium
SLAEGFLKRGARLVTGGTDN

SEQ ID NO: 732180 - protein, 18 aa, Mycobacterium
SLAEGRLVAADHLSSALP

SEQ ID NO: 732181 - protein, 25 aa, Mycobacterium
SLAGLARAIADIAARARSGDLKPDE

SEQ ID NO: 732182 - protein, 25 aa, Mycobacterium
SLAGLARAIADIAARARSGNLKPDE

SEQ ID NO: 732183 - protein, 19 aa, Mycobacterium
SLAGLKPAFRRDGTITAGS

SEQ ID NO: 732184 - protein, 21 aa, Mycobacterium
SLAGLPAVRPYRDYIAWLNAQ

SEQ ID NO: 732185 - protein, 17 aa, Mycobacterium
SLAGLRMSYFGDGANNM

SEQ ID NO: 732186 - protein, 20 aa, Mycobacterium
SLAGLRVGYALGAPDLLDRL

SEQ ID NO: 732187 - protein, 25 aa, Mycobacterium
SLAGPRPVRINSWSQLTADVTVDMG

SEQ ID NO: 732188 - protein, 37 aa, Mycobacterium
SLAGQSRWPEMMWLEFLFDRLGGPEVFEAAYEGEHNA

SEQ ID NO: 732189 - protein, 17 aa, Mycobacterium
SLAGRALGTGAFGSGGG

SEQ ID NO: 732190 - protein, 29 aa, Mycobacterium
SLAGRELAGGFGLPGAPRLSAAMEQSFRR

SEQ ID NO: 732191 - protein, 19 aa, Mycobacterium
SLAGYRAGFVLGDGSVVGE

SEQ ID NO: 732192 - protein, 25 aa, Mycobacterium
SLAHRAKWGLLLARTDPNMPKHKGL

SEQ ID NO: 732193 - protein, 31 aa, Mycobacterium
SLAHVPRSDWPARVDELLTMVGLDRHRDSIP

SEQ ID NO: 732194 - protein, 27 aa, Mycobacterium
SLAKASFLAGLIFRTALRKKYEDKAAS

SEQ ID NO: 732195 - protein, 18 aa, Mycobacterium
SLALAGAVDDVIRTDAGK

SEQ ID NO: 732196 - protein, 24 aa, Mycobacterium
SLALDGAGLGAAWGEQLATAMLGD

SEQ ID NO: 732197 - protein, 21 aa, Mycobacterium
SLALDGAGLGTAWGTQLAVAM

SEQ ID NO: 732198 - protein, 24 aa, Mycobacterium
SLALLGRPLIGNGADGAPGTGANG

SEQ ID NO: 732199 - protein, 17 aa, Mycobacterium
SLALPLALYRAVTAFGR

SEQ ID NO: 732200 - protein, 19 aa, Mycobacterium
SLALTDCLDRIMLAELAGV

SEQ ID NO: 732201 - protein, 25 aa, Mycobacterium
SLALTGRPLIGNGADGGPGQAGGAG

SEQ ID NO: 732202 - protein, 24 aa, Mycobacterium
SLALTLGCTLILRRKFKPENVLAD

SEQ ID NO: 732203 - protein, 24 aa, Mycobacterium
SLAMAAAVAPYVTWMGATAAQAAQ

SEQ ID NO: 732204 - protein, 28 aa, Mycobacterium
SLAMAAKLKGYRLICVIPENTSIERRRL

SEQ ID NO: 732205 - protein, 22 aa, Mycobacterium
SLANPCRGRVALIGDAAYGPSL

SEQ ID NO: 732206 - protein, 24 aa, Mycobacterium
SLAPEFRAAVVLCDIEGLSYEEIG

SEQ ID NO: 732207 - protein, 23 aa, Mycobacterium
SLAPGLRLAWMVLPADIVPDVLD

SEQ ID NO: 732208 - protein, 23 aa, Mycobacterium
SLAPGLRLGWLALPAALVDGVVE

SEQ ID NO: 732209 - protein, 29 aa, Mycobacterium
SLAPGLRLGWLVLPDRLVDAVLRQKGETE

SEQ ID NO: 732210 - protein, 17 aa, Mycobacterium
SLAPQWSTSFGYTVTVE

SEQ ID NO: 732211 - protein, 18 aa, Mycobacterium
SLAPVPWIDQVCAARLLA

SEQ ID NO: 732212 - protein, 17 aa, Mycobacterium
SLAPYGMMAERTVVYPA

SEQ ID NO: 732213 - protein, 23 aa, Mycobacterium
SLAQGIELWPWQRDFVDRAVSTP

SEQ ID NO: 732214 - protein, 17 aa, Mycobacterium
SLARAMVNLHRRYRITT

SEQ ID NO: 732215 - protein, 30 aa, Mycobacterium
SLARARAVIEWGMRCTCPSIDACTCGIHTA

SEQ ID NO: 732216 - protein, 26 aa, Mycobacterium
SLARARLTQMRDFYAFLLGEIPTLLE

SEQ ID NO: 732217 - protein, 22 aa, Mycobacterium
SLARGGGELIRLSMAAVAATYA

SEQ ID NO: 732218 - protein, 18 aa, Mycobacterium
SLARGMRELVAAQAPESE

SEQ ID NO: 732219 - protein, 28 aa, Mycobacterium
SLARKGCVFVSVNYRLGALGAVDLSSLS

SEQ ID NO: 732220 - protein, 21 aa, Mycobacterium
SLARKGCVYISVNYRLGALGC

SEQ ID NO: 732221 - protein, 17 aa, Mycobacterium
SLARLPLILNDGHLREL

SEQ ID NO: 732222 - protein, 24 aa, Mycobacterium
SLARRAKRLIVFDVDSTLIQGEVI

SEQ ID NO: 732223 - protein, 21 aa, Mycobacterium
SLARRGCVYVSVNYRLGGLGC

SEQ ID NO: 732224 - protein, 23 aa, Mycobacterium
SLARRPAAEVKRVINGTSPDEAI

SEQ ID NO: 732225 - protein, 22 aa, Mycobacterium
SLARRSAILFNFRELLNARKEE

SEQ ID NO: 732226 - protein, 25 aa, Mycobacterium
SLARVSLPLLRSWLAEQSASGAART

SEQ ID NO: 732227 - protein, 23 aa, Mycobacterium
SLARWEPEIARPICEALVDEFVD

SEQ ID NO: 732228 - protein, 17 aa, Mycobacterium
SLARYDAVELFVARARA

SEQ ID NO: 732229 - protein, 27 aa, Mycobacterium
SLARYKLPKAIVFRAGIQRSPSGKADY

SEQ ID NO: 732230 - protein, 17 aa, Mycobacterium
SLASALRHNDRPEVRTK

SEQ ID NO: 732231 - protein, 19 aa, Mycobacterium
SLASLPGCHLLVNPDAMRR

SEQ ID NO: 732232 - protein, 25 aa, Mycobacterium
SLASNGRFILGLGMTHAAVTEGMWG

SEQ ID NO: 732233 - protein, 17 aa, Mycobacterium
SLATCTMQGRPTSEAVE

SEQ ID NO: 732234 - protein, 18 aa, Mycobacterium
SLATRIEEAALWPVKPLL

SEQ ID NO: 732235 - protein, 22 aa, Mycobacterium
SLATRLAHFGRYLAAADPSLTS

SEQ ID NO: 732236 - protein, 20 aa, Mycobacterium
SLAVPTWHYGCEPLTPLATH

SEQ ID NO: 732237 - protein, 18 aa, Mycobacterium
SLAWLAAAGPDFRPSVSL

SEQ ID NO: 732238 - protein, 24 aa, Mycobacterium
SLCASQLVGLGIMRYGVRSEPLHS

SEQ ID NO: 732239 - protein, 24 aa, Mycobacterium
SLCDELRAVSPLIDRFKLARPDLG

SEQ ID NO: 732240 - protein, 21 aa, Mycobacterium
SLCNLWKLPKGMVLHPDAIDL

SEQ ID NO: 732241 - protein, 21 aa, Mycobacterium
SLCTASVLRRSRSHASTACRT

SEQ ID NO: 732242 - protein, 18 aa, Mycobacterium
SLCVPMVAAMLGVLKAGA

SEQ ID NO: 732243 - protein, 17 aa, Mycobacterium
SLDALVITGGYDLDPAA

SEQ ID NO: 732244 - protein, 33 aa, Mycobacterium
SLDARIAAKLGLRPDVRRVPLFGLGCVAGAAGI

SEQ ID NO: 732245 - protein, 28 aa, Mycobacterium
SLDARIAGRLGLRDDVRRVPLFGLGCVA

SEQ ID NO: 732246 - protein, 33 aa, Mycobacterium
SLDARIAGRLGLRPDVRRMPLFGLGCAAGAAGV

SEQ ID NO: 732247 - protein, 39 aa, Mycobacterium
SLDARIAGRLGLRPDVRRMPLFGLGCVAGAAGVARLHDY

SEQ ID NO: 732248 - protein, 33 aa, Mycobacterium
SLDARLIPRLGLRPDIRRVPILGLGCVAGAAGL

SEQ ID NO: 732249 - protein, 24 aa, Mycobacterium
SLDDLRAGGVPMIPLDAEKDSGAT

SEQ ID NO: 732250 - protein, 21 aa, Mycobacterium
SLDDVVKFLLPPAAAKKPGKA

SEQ ID NO: 732251 - protein, 22 aa, Mycobacterium
SLDERIHHLFARMPDAKVHMYG

SEQ ID NO: 732252 - protein, 25 aa, Mycobacterium
SLDHALWFLRPFRADEWMLYDETSP

SEQ ID NO: 732253 - protein, 20 aa, Mycobacterium
SLDHAMWFMRPFRADEWLLY

SEQ ID NO: 732254 - protein, 26 aa, Mycobacterium
SLDHVAARPYGVWVHGNNDTVGAAAA

SEQ ID NO: 732255 - protein, 20 aa, Mycobacterium
SLDIKVLVRHAARTQKVPVL

SEQ ID NO: 732256 - protein, 31 aa, Mycobacterium
SLDISPLQARCGWAIGWKKDAFFGREALLAE

SEQ ID NO: 732257 - protein, 36 aa, Mycobacterium
SLDISPLQARCGWAIGWKKDAFWGRDALLAEKEAGP

SEQ ID NO: 732258 - protein, 18 aa, Mycobacterium
SLDKARRLLWPIKQKYGN

SEQ ID NO: 732259 - protein, 17 aa, Mycobacterium
SLDKARRLLWPVKKKHG

SEQ ID NO: 732260 - protein, 17 aa, Mycobacterium
SLDKARRLLWPVKKKYG

SEQ ID NO: 732261 - protein, 18 aa, Mycobacterium
SLDKARRLLWPVKKKYGN

SEQ ID NO: 732262 - protein, 28 aa, Mycobacterium
SLDKLAKWSVPLLRMGGRMLAIKGERAT

SEQ ID NO: 732263 - protein, 20 aa, Mycobacterium
SLDLRWWPLDQIPEEDHSVV

SEQ ID NO: 732264 - protein, 25 aa, Mycobacterium
SLDMAGCSLTVMWLDEELERYWAAP

SEQ ID NO: 732265 - protein, 31 aa, Mycobacterium
SLDMKVGVRLAARARHIPVLMATSDRGLVDI

SEQ ID NO: 732266 - protein, 23 aa, Mycobacterium
SLDPKDLYDVLAINAASASTQIS

SEQ ID NO: 732267 - protein, 24 aa, Mycobacterium
SLDPKDLYDVLAINAASMSTQLAG

SEQ ID NO: 732268 - protein, 25 aa, Mycobacterium
SLDPLIGSGRFDFVADLGAQMPMRV

SEQ ID NO: 732269 - protein, 19 aa, Mycobacterium
SLDPLRPVAHVRANAVEVG

SEQ ID NO: 732270 - protein, 22 aa, Mycobacterium
SLDPRFPVFDLLAEPLLANDFG

SEQ ID NO: 732271 - protein, 23 aa, Mycobacterium
SLDPRILGKYGKATPEALVESAL

SEQ ID NO: 732272 - protein, 22 aa, Mycobacterium
SLDPRLPVFDILAEPLQDNGFD

SEQ ID NO: 732273 - protein, 27 aa, Mycobacterium
SLDPRLPVFDVLAEPLIANGFDKSARS

SEQ ID NO: 732274 - protein, 21 aa, Mycobacterium
SLDPRLPVFELLAEPLRANGF

SEQ ID NO: 732275 - protein, 22 aa, Mycobacterium
SLDRLRSALVADELAEGISPAL

SEQ ID NO: 732276 - protein, 25 aa, Mycobacterium
SLDRMGIDHVDIFYSHRIDPVTPLE

SEQ ID NO: 732277 - protein, 25 aa, Mycobacterium
SLDRRAKRLIVFDVDSTLIQGEVIE

SEQ ID NO: 732278 - protein, 20 aa, Mycobacterium
SLDSRLRVVARRDFAGMISV

SEQ ID NO: 732279 - protein, 20 aa, Mycobacterium
SLDSWPMNIVLLGKGNTVSA

SEQ ID NO: 732280 - protein, 18 aa, Mycobacterium
SLDVFLLHRGFRKLHDNG

SEQ ID NO: 732281 - protein, 20 aa, Mycobacterium
SLDVLRRALPAGIACVQNAY

SEQ ID NO: 732282 - protein, 19 aa, Mycobacterium
SLDWPDFVGQLRVENAADT

SEQ ID NO: 732283 - protein, 19 aa, Mycobacterium
SLDWPDYVSRLRADEPIGV

SEQ ID NO: 732284 - protein, 20 aa, Mycobacterium
SLEAAIGFSAHGVEHVAVTT

SEQ ID NO: 732285 - protein, 23 aa, Mycobacterium
SLEAFQSGLSWLIILRKRDNFRA

SEQ ID NO: 732286 - protein, 23 aa, Mycobacterium
SLEAFQSGLSWLIILRKRENFRR

SEQ ID NO: 732287 - protein, 25 aa, Mycobacterium
SLEDPEFAAGFARLYNEWIADYCAA

SEQ ID NO: 732288 - protein, 21 aa, Mycobacterium
SLEGFGVAVVREEGRWRVTSL

SEQ ID NO: 732289 - protein, 18 aa, Mycobacterium
SLEGRSRRPLPSGLGTPS

SEQ ID NO: 732290 - protein, 20 aa, Mycobacterium
SLELAHKFFMPLGDHMREAM

SEQ ID NO: 732291 - protein, 25 aa, Mycobacterium
SLENPDFAAGFARLYNQWIADFCAP

SEQ ID NO: 732292 - protein, 17 aa, Mycobacterium
SLEPLLTLRSWSVTGCA

SEQ ID NO: 732293 - protein, 22 aa, Mycobacterium
SLEPRELPPIGDLVRVLSETTR

SEQ ID NO: 732294 - protein, 27 aa, Mycobacterium
SLERLDAMLPKPAQRIGLSATVRPPEE

SEQ ID NO: 732295 - protein, 24 aa, Mycobacterium
SLERSLRVARRLRAGFIGLNGTVG

SEQ ID NO: 732296 - protein, 20 aa, Mycobacterium
SLERWHDIERTMTLNYYSPL

SEQ ID NO: 732297 - protein, 23 aa, Mycobacterium
SLETVPICVGYTVDGKRTDEMPM

SEQ ID NO: 732298 - protein, 18 aa, Mycobacterium
SLEVADGMLTVFVGPSGC

SEQ ID NO: 732299 - protein, 26 aa, Mycobacterium
SLEVIDLRSLIPLDFETIAASIRRTG

SEQ ID NO: 732300 - protein, 19 aa, Mycobacterium
SLEVSRQLATLSIFANSGG

SEQ ID NO: 732301 - protein, 23 aa, Mycobacterium
SLEYQPKCRDFALSIDDERSLLR

SEQ ID NO: 732302 - protein, 24 aa, Mycobacterium
SLEYQPKCRDFALSIDDERSLLRT

SEQ ID NO: 732303 - protein, 25 aa, Mycobacterium
SLFDALVEWMSQPLYYGRYGGKAPP

SEQ ID NO: 732304 - protein, 17 aa, Mycobacterium
SLFDSVMYVSFQELATR

SEQ ID NO: 732305 - protein, 22 aa, Mycobacterium
SLFERLKPGAAITIVSSTAGFG

SEQ ID NO: 732306 - protein, 22 aa, Mycobacterium
SLFGDPFACRFSLRDNDAQFEL

SEQ ID NO: 732307 - protein, 35 aa, Mycobacterium
SLFHVLRYGFRPSKIAFLAWHAWSDAERGNWPPGF

SEQ ID NO: 732308 - protein, 35 aa, Mycobacterium; identical to SEQ ID NO: 84770

SEQ ID NO: 732309 - protein, 35 aa, Mycobacterium
SLFHVLRYGFRPSKIAFLAWHAWSDSQRGNWPPGF

SEQ ID NO: 732310 - protein, 24 aa, Mycobacterium
SLFINVTCWGRLVTGVGAALGKGA

SEQ ID NO: 732311 - protein, 24 aa, Mycobacterium
SLFPGGEGRLRLTAPDDMLTTGIE

SEQ ID NO: 732312 - protein, 24 aa, Mycobacterium
SLFPGGEGRLRLTAPEDMLTTGIE

SEQ ID NO: 732313 - protein, 34 aa, Mycobacterium
SLFQVLRYGFRPSKVAFLAWHAWHDPERGDWPTG

SEQ ID NO: 732314 - protein, 21 aa, Mycobacterium
SLFRYPGIRSDSDMPSFGYGF

SEQ ID NO: 732315 - protein, 30 aa, Mycobacterium
SLFSDPGLDNAFRRRWFGWINPAQTMVAYA

SEQ ID NO: 732316 - protein, 20 aa, Mycobacterium
SLFSSMGLAGMLGSGLGSGA

SEQ ID NO: 732317 - protein, 21 aa, Mycobacterium
SLFSSMGMAGMLGSALGSGGP

SEQ ID NO: 732318 - protein, 22 aa, Mycobacterium
SLGAAPCIAFVFPGQGNQWQAM

SEQ ID NO: 732319 - protein, 19 aa, Mycobacterium
SLGAELWRYLGDATPLKFG

SEQ ID NO: 732320 - protein, 22 aa, Mycobacterium
SLGAEVRWASCNIFSTQDHAAA

SEQ ID NO: 732321 - protein, 25 aa, Mycobacterium
SLGAGWACGVTVVLPPPGTVAAVDC

SEQ ID NO: 732322 - protein, 19 aa, Mycobacterium
SLGAMPGGLPLPGVPGGDA

SEQ ID NO: 732323 - protein, 20 aa, Mycobacterium
SLGAVLAYACAVGLKEAGAE

SEQ ID NO: 732324 - protein, 19 aa, Mycobacterium
SLGDLCNYIAVLQSQDDLT

SEQ ID NO: 732325 - protein, 18 aa, Mycobacterium
SLGDWMPMHQGWRSDVPE

SEQ ID NO: 732326 - protein, 25 aa, Mycobacterium
SLGGLARAIADIAARARSGNLKPDE

SEQ ID NO: 732327 - protein, 22 aa, Mycobacterium
SLGGLARAISDIAGRARSGNLK

SEQ ID NO: 732328 - protein, 18 aa, Mycobacterium
SLGGWVAFELERRGRARS

SEQ ID NO: 732329 - protein, 24 aa, Mycobacterium
SLGHERTMLWLGYANLLGELATDF

SEQ ID NO: 732330 - protein, 26 aa, Mycobacterium
SLGHRIRAAIHFDDLQWERGYDRIAA

SEQ ID NO: 732331 - protein, 26 aa, Mycobacterium
SLGHRIRAAIHFDDLQWERSYNRVAA

SEQ ID NO: 732332 - protein, 26 aa, Mycobacterium
SLGHRLRAAIHFDDLQWEHRYDRIAA

SEQ ID NO: 732333 - protein, 18 aa, Mycobacterium
SLGHRRIAYVGGPVTAAC

SEQ ID NO: 732334 - protein, 19 aa, Mycobacterium
SLGIARAYRTLNLRYSQVA

SEQ ID NO: 732335 - protein, 17 aa, Mycobacterium
SLGKAALVGNMSVPQGW

SEQ ID NO: 732336 - protein, 24 aa, Mycobacterium
SLGKGLGKTTGWVHRASLKAKKVT

SEQ ID NO: 732337 - protein, 17 aa, Mycobacterium
SLGKRIIQRYGKATPEA

SEQ ID NO: 732338 - protein, 19 aa, Mycobacterium
SLGLEFLGFTGPDVQEGLA

SEQ ID NO: 732339 - protein, 20 aa, Mycobacterium
SLGLEFLSFSGPDVREGLAA

SEQ ID NO: 732340 - protein, 17 aa, Mycobacterium
SLGLEIAGYLAANGAGH

SEQ ID NO: 732341 - protein, 19 aa, Mycobacterium
SLGLGEPMPISAMHGRGVA

SEQ ID NO: 732342 - protein, 21 aa, Mycobacterium
SLGLPRWSQVTGRHLSEIRRS

SEQ ID NO: 732343 - protein, 20 aa, Mycobacterium
SLGLRPPPPQRFPLSEAQAA

SEQ ID NO: 732344 - protein, 19 aa, Mycobacterium
SLGMHGIVSSGLRNEDEGL

SEQ ID NO: 732345 - protein, 22 aa, Mycobacterium
SLGPSGRIAGMYDRVYEWASKP

SEQ ID NO: 732346 - protein, 18 aa, Mycobacterium
SLGPVDWTIFDIPAVTGL

SEQ ID NO: 732347 - protein, 17 aa, Mycobacterium
SLGRPMDPLGVLRGLVA

SEQ ID NO: 732348 - protein, 24 aa, Mycobacterium
SLGSSWEGGWRCGEVVLSMVADHA

SEQ ID NO: 732349 - protein, 24 aa, Mycobacterium
SLGTDWPAAGYFSTHKPLDAIEIA

SEQ ID NO: 732350 - protein, 22 aa, Mycobacterium
SLGTTLPAALVWAYPTITDLAG

SEQ ID NO: 732351 - protein, 19 aa, Mycobacterium
SLGVPTRHLDLQFLAHAPE

SEQ ID NO: 732352 - protein, 24 aa, Mycobacterium
SLGVTLRVLHHFLGAGYRPVSVHL

SEQ ID NO: 732353 - protein, 37 aa, Mycobacterium
SLGVTLRVLRLFLGAAYRPVAVHLPHPALGPADDYDT

SEQ ID NO: 732354 - protein, 25 aa, Mycobacterium
SLHAFNLWLDEDWGFDRPDHRIIAA

SEQ ID NO: 732355 - protein, 24 aa, Mycobacterium
SLHAFNLWLDEDWGFDRPDHRVLA

SEQ ID NO: 732356 - protein, 20 aa, Mycobacterium
SLHASCIGLALLAHLPDDQV

SEQ ID NO: 732357 - protein, 19 aa, Mycobacterium
SLHCPLTIETRHLIDAEAL

SEQ ID NO: 732358 - protein, 25 aa, Mycobacterium
SLHDAYRALGAWGLPVSEHTTKVST

SEQ ID NO: 732359 - protein, 19 aa, Mycobacterium
SLHGFSAYGGVVTKRELLR

SEQ ID NO: 732360 - protein, 25 aa, Mycobacterium
SLHGLRYGDWKVLLKTQDRWFNGIQ

SEQ ID NO: 732361 - protein, 18 aa, Mycobacterium
SLHKGRRAGELLLKPPRS

SEQ ID NO: 732362 - protein, 23 aa, Mycobacterium
SLHLEALAWFDHWLKSRDTGILA

SEQ ID NO: 732363 - protein, 19 aa, Mycobacterium
SLHLGRLKDGAGLRPEQVS

SEQ ID NO: 732364 - protein, 18 aa, Mycobacterium
SLHLPPSMHCFLVAEGIN

SEQ ID NO: 732365 - protein, 17 aa, Mycobacterium
SLHLRRRALPSISTLAA

SEQ ID NO: 732366 - protein, 20 aa, Mycobacterium
SLHNSQPWLWAAVDKTLHLF

SEQ ID NO: 732367 - protein, 24 aa, Mycobacterium
SLHPELLPALASLIATAAQRSQII

SEQ ID NO: 732368 - protein, 24 aa, Mycobacterium
SLHPELLPALASLIATASEHSQIV

SEQ ID NO: 732369 - protein, 25 aa, Mycobacterium
SLHQEWMLIALRTEWQVGEVTYPAG

SEQ ID NO: 732370 - protein, 21 aa, Mycobacterium
SLHRDGWTFTGWGRASTDDAG

SEQ ID NO: 732371 - protein, 19 aa, Mycobacterium
SLHRESRWQAPRPLLDIGL

SEQ ID NO: 732372 - protein, 23 aa, Mycobacterium
SLHREWLLIELRTEWQHLGHTYP

SEQ ID NO: 732373 - protein, 25 aa, Mycobacterium
SLHRLKGLGERVVLPGHGPELGDLS

SEQ ID NO: 732374 - protein, 17 aa, Mycobacterium
SLHTAVRGFREAVESGD

SEQ ID NO: 732375 - protein, 23 aa, Mycobacterium
SLIAAGRAWARFEHGEVIFKAEV

SEQ ID NO: 732376 - protein, 23 aa, Mycobacterium
SLIAAGRAWARFEHGEVVFKAEV

SEQ ID NO: 732377 - protein, 18 aa, Mycobacterium
SLIAAGRAWARFEQGQVV

SEQ ID NO: 732378 - protein, 20 aa, Mycobacterium
SLIAPILRAASFSDLQVSRS

SEQ ID NO: 732379 - protein, 20 aa, Mycobacterium
SLIESWDGSSSMAMLQAVQP

SEQ ID NO: 732380 - protein, 17 aa, Mycobacterium
SLIKALEDLGIGRPSTY

SEQ ID NO: 732381 - protein, 17 aa, Mycobacterium
SLIKALEELGIGRPSTY

SEQ ID NO: 732382 - protein, 18 aa, Mycobacterium
SLIKALEELGIGRPSTYS

SEQ ID NO: 732383 - protein, 19 aa, Mycobacterium
SLILAKLWMRGYRRMLLVR

SEQ ID NO: 732384 - protein, 18 aa, Mycobacterium
SLILRYGPGMGQALDANY

SEQ ID NO: 732385 - protein, 25 aa, Mycobacterium
SLIPDAYCTTVFLAILDTESGILDY

SEQ ID NO: 732386 - protein, 24 aa, Mycobacterium
SLIPDAYCTTVFLAILDTKSGILD

SEQ ID NO: 732387 - protein, 20 aa, Mycobacterium
SLIPFPDYLAESVFAPLNLG

SEQ ID NO: 732388 - protein, 17 aa, Mycobacterium
SLIPIAIEEGLRFETPL

SEQ ID NO: 732389 - protein, 19 aa, Mycobacterium
SLIPLPASLQQFLAGLPSV

SEQ ID NO: 732390 - protein, 25 aa, Mycobacterium
SLIPNAYCTTVFLAILDTETGLLQY

SEQ ID NO: 732391 - protein, 25 aa, Mycobacterium
SLIPNAYCTTVFLAVLDTESGVLQY

SEQ ID NO: 732392 - protein, 19 aa, Mycobacterium
SLIQEWTLRFEGLNVSISG

SEQ ID NO: 732393 - protein, 18 aa, Mycobacterium
SLIRALRSDCAAAIEKYW

SEQ ID NO: 732394 - protein, 26 aa, Mycobacterium
SLISMFLDFYRPLVEAGMVYVTLPPL

SEQ ID NO: 732395 - protein, 26 aa, Mycobacterium
SLISMFLDFYRPLVEAGMVYVTMPPL

SEQ ID NO: 732396 - protein, 25 aa, Mycobacterium
SLIYDLRIGPAWQGLAFGVGMITEA

SEQ ID NO: 732397 - protein, 24 aa, Mycobacterium
SLKAHTWKRSSFNGTEIFGKTVGV

SEQ ID NO: 732398 - protein, 20 aa, Mycobacterium
SLKALEPLYMGARLRAGEVT

SEQ ID NO: 732399 - protein, 23 aa, Mycobacterium
SLKHLRSGASIIVIGSNAAFMSS

SEQ ID NO: 732400 - protein, 18 aa, Mycobacterium
SLKKAGVEDVHIIEMGGD

SEQ ID NO: 732401 - protein, 18 aa, Mycobacterium
SLKLSALGQALPRDGERI

SEQ ID NO: 732402 - protein, 23 aa, Mycobacterium
SLKVPVRHFVLFSSISGLIGSRW

SEQ ID NO: 732403 - protein, 21 aa, Mycobacterium
SLLAAHCWFEGQGWGVAIHPA

SEQ ID NO: 732404 - protein, 17 aa, Mycobacterium
SLLALGLPGLSVNVRDG

SEQ ID NO: 732405 - protein, 21 aa, Mycobacterium
SLLALLPLVGVWRGEGEGRDA

SEQ ID NO: 732406 - protein, 19 aa, Mycobacterium
SLLAPWQQVLRNLGIDIGK

SEQ ID NO: 732407 - protein, 18 aa, Mycobacterium
SLLARLSDQALWLGSGLL

SEQ ID NO: 732408 - protein, 27 aa, Mycobacterium
SLLDACRRCFASLFTDRAIHYRIDQGF

SEQ ID NO: 732409 - protein, 27 aa, Mycobacterium
SLLDACRRCFASLFTDRAIHYRIDQNF

SEQ ID NO: 732410 - protein, 27 aa, Mycobacterium
SLLDACRRCFASLFTDRAIHYRVDQGF

SEQ ID NO: 732411 - protein, 19 aa, Mycobacterium
SLLDEWSGPTFDGVGIGHT

SEQ ID NO: 732412 - protein, 28 aa, Mycobacterium
SLLDNFEWAYGYAKRFGLIHVDYATQVR

SEQ ID NO: 732413 - protein, 28 aa, Mycobacterium
SLLDRGMVFAVAHVRGGGELGRPWYEHG

SEQ ID NO: 732414 - protein, 20 aa, Mycobacterium
SLLDRYRADYGRWPESVGLS

SEQ ID NO: 732415 - protein, 24 aa, Mycobacterium
SLLEAAILQWHWKTDVFPDDDQWN

SEQ ID NO: 732416 - protein, 22 aa, Mycobacterium
SLLEAWSGAGLAVLIDAAVATP

SEQ ID NO: 732417 - protein, 18 aa, Mycobacterium
SLLGPRLADQTILDALGV

SEQ ID NO: 732418 - protein, 19 aa, Mycobacterium
SLLGPRLADRAVLDVVGLD

SEQ ID NO: 732419 - protein, 19 aa, Mycobacterium
SLLGRLMVYDALDMTYRTI

SEQ ID NO: 732420 - protein, 20 aa, Mycobacterium
SLLGSAVWILATRPDIQQQV

SEQ ID NO: 732421 - protein, 18 aa, Mycobacterium
SLLGSMHIDLARPKDKPA

SEQ ID NO: 732422 - protein, 17 aa, Mycobacterium
SLLHTWFELLGPEKIVT

SEQ ID NO: 732423 - protein, 17 aa, Mycobacterium
SLLHTWFELLSPEQIVT

SEQ ID NO: 732424 - protein, 24 aa, Mycobacterium
SLLHWECLNPVPPATTDTLRSDPR

SEQ ID NO: 732425 - protein, 18 aa, Mycobacterium
SLLLRGKYLVDVQSVAKV

SEQ ID NO: 732426 - protein, 18 aa, Mycobacterium
SLLNRLPDATLWSVMERL

SEQ ID NO: 732427 - protein, 23 aa, Mycobacterium
SLLPAEDFIPPQLRRATQKLLDE

SEQ ID NO: 732428 - protein, 21 aa, Mycobacterium
SLLPGRDGLVHISKLGRGKRI

SEQ ID NO: 732429 - protein, 17 aa, Mycobacterium
SLLPMAIEEGLRFETPL

SEQ ID NO: 732430 - protein, 23 aa, Mycobacterium
SLLPMPDPIRMASHAHHYLAVFD

SEQ ID NO: 732431 - protein, 19 aa, Mycobacterium
SLLPPRIVDDLGAAVRVAR

SEQ ID NO: 732432 - protein, 17 aa, Mycobacterium
SLLQDWTQFAAPAVFGI

SEQ ID NO: 732433 - protein, 18 aa, Mycobacterium
SLLQRYRIEALRRSELWA

SEQ ID NO: 732434 - protein, 24 aa, Mycobacterium
SLLQVCRLAARRAGKRGPRFAVPM

SEQ ID NO: 732435 - protein, 19 aa, Mycobacterium
SLLREGFAAVAAGLPEPKA

SEQ ID NO: 732436 - protein, 26 aa, Mycobacterium
SLLRFILELLGDYGLEDFYLELSTKD

SEQ ID NO: 732437 - protein, 20 aa, Mycobacterium
SLLRFTRAVVAPAVVIHGRN

SEQ ID NO: 732438 - protein, 18 aa, Mycobacterium
SLLRRLVEAGTRVVQYGY

SEQ ID NO: 732439 - protein, 22 aa, Mycobacterium
SLLSDWPRRSAQFTKIMPTDYQ

SEQ ID NO: 732440 - protein, 26 aa, Mycobacterium
SLLTPRLAQLTAIGGFRRWDRMVKRH

SEQ ID NO: 732441 - protein, 22 aa, Mycobacterium
SLLTTAVARWAREEGLGIGVCS

SEQ ID NO: 732442 - protein, 19 aa, Mycobacterium
SLLVFPFDVAIDGGFPGTA

SEQ ID NO: 732443 - protein, 20 aa, Mycobacterium
SLLVGDRLGGELAWELAATR

SEQ ID NO: 732444 - protein, 23 aa, Mycobacterium
SLLVRSLVAWFWDEPLRAPLIRH

SEQ ID NO: 732445 - protein, 24 aa, Mycobacterium
SLLWRWAGDMRIAFTGGTAGLLQT

SEQ ID NO: 732446 - protein, 24 aa, Mycobacterium
SLLYPERWVRRTIRFRHNTLDPNN

SEQ ID NO: 732447 - protein, 20 aa, Mycobacterium
SLMALGIINECHRRCLDYAK

SEQ ID NO: 732448 - protein, 17 aa, Mycobacterium
SLMDIDTIYVWTHDSIG

SEQ ID NO: 732449 - protein, 28 aa, Mycobacterium
SLMDTHPFMWLPMLSRVLGSAQLLPEAV

SEQ ID NO: 732450 - protein, 21 aa, Mycobacterium
SLMHCMTVSLALDGAGLGAAW

SEQ ID NO: 732451 - protein, 21 aa, Mycobacterium
SLMHCMTVSLALDGAGLGTAW

SEQ ID NO: 732452 - protein, 25 aa, Mycobacterium
SLMPDLRCLMLTSFTSDEAMLDAIL

SEQ ID NO: 732453 - protein, 24 aa, Mycobacterium
SLMRLGIEPAEFALSVLDEDRAEQ

SEQ ID NO: 732454 - protein, 25 aa, Mycobacterium
SLMSFKPRYDNFIGGQWVAPTAGRY

SEQ ID NO: 732455 - protein, 23 aa, Mycobacterium
SLMVPTDLVGIFAGSGSLLPSAS

SEQ ID NO: 732456 - protein, 27 aa, Mycobacterium
SLNAQWRSATCRVLVAAKGSRSANAGP

SEQ ID NO: 732457 - protein, 18 aa, Mycobacterium
SLNCAQGPTATPCGVCDS

SEQ ID NO: 732458 - protein, 26 aa, Mycobacterium
SLNGIGGDGGDAFLIGNGGNGGAGAG

SEQ ID NO: 732459 - protein, 24 aa, Mycobacterium
SLNIPAQIWVRLTGVTGNQIIPPV

SEQ ID NO: 732460 - protein, 19 aa, Mycobacterium
SLNLGDWSATRLVQPKSSR

SEQ ID NO: 732461 - protein, 26 aa, Mycobacterium
SLNLPFPQYVCMRVLSKNPGWSNADL

SEQ ID NO: 732462 - protein, 23 aa, Mycobacterium
SLNLPRPAVWLLEQWLTHSAVLR

SEQ ID NO: 732463 - protein, 25 aa, Mycobacterium
SLNLVGGLRRSMAKAGYCDLKEFQK

SEQ ID NO: 732464 - protein, 21 aa, Mycobacterium
SLNMAALWKLPVLFLCENNLY

SEQ ID NO: 732465 - protein, 19 aa, Mycobacterium
SLNPLNWVTGIVRGALGAV

SEQ ID NO: 732466 - protein, 22 aa, Mycobacterium
SLNPRARVGTTIGEPLQVHGLA

SEQ ID NO: 732467 - protein, 18 aa, Mycobacterium
SLNPRLGPGTVVVPDQLV

SEQ ID NO: 732468 - protein, 24 aa, Mycobacterium
SLNRGKRSLCLDLASANGKARLAE

SEQ ID NO: 732469 - protein, 18 aa, Mycobacterium
SLNRPEVLLIIGAGQTRG

SEQ ID NO: 732470 - protein, 19 aa, Mycobacterium
SLNTWLIAHARRADISGVA

SEQ ID NO: 732471 - protein, 22 aa, Mycobacterium
SLNVPLPLRLGVNALGPAITTA

SEQ ID NO: 732472 - protein, 21 aa, Mycobacterium
SLNVTCPRDLILGAPVKLTEG

SEQ ID NO: 732473 - protein, 22 aa, Mycobacterium
SLPAELPALIADLYDTMDAAHG

SEQ ID NO: 732474 - protein, 23 aa, Mycobacterium
SLPAIGFRLSRGVIHQLTKENPA

SEQ ID NO: 732475 - protein, 22 aa, Mycobacterium
SLPDALGALLGRTIGGIVDNVE

SEQ ID NO: 732476 - protein, 23 aa, Mycobacterium
SLPDALGALLGRTVTSFLDNVER

SEQ ID NO: 732477 - protein, 19 aa, Mycobacterium
SLPDFPLPLGDHGVQCGTA

SEQ ID NO: 732478 - protein, 19 aa, Mycobacterium
SLPDLLPLLEKVAEAGKPL

SEQ ID NO: 732479 - protein, 19 aa, Mycobacterium
SLPDLLPLLEKVAESGKPL

SEQ ID NO: 732480 - protein, 19 aa, Mycobacterium
SLPDMISHVEAPYLGDVIV

SEQ ID NO: 732481 - protein, 17 aa, Mycobacterium
SLPDYRDPTSLSPTLTT

SEQ ID NO: 732482 - protein, 24 aa, Mycobacterium
SLPEELRRSLTWDRGKELSAHAQF

SEQ ID NO: 732483 - protein, 23 aa, Mycobacterium
SLPEFPLPLGNPLEPTRSDMITG

SEQ ID NO: 732484 - protein, 25 aa, Mycobacterium
SLPEIARAGTPLVLIDRGADIESDQ

SEQ ID NO: 732485 - protein, 23 aa, Mycobacterium
SLPEPPSLPSLPMDNLPAETPPA

SEQ ID NO: 732486 - protein, 22 aa, Mycobacterium
SLPEYRALRAQHDMLSACFDAE

SEQ ID NO: 732487 - protein, 21 aa, Mycobacterium
SLPEYRALRAQSDMLAACFDA

SEQ ID NO: 732488 - protein, 31 aa, Mycobacterium
SLPGMLMAAARLDLAAVFLYAGSILPGLAKL

SEQ ID NO: 732489 - protein, 31 aa, Mycobacterium
SLPGMLMAAARLDLAAVFLYAGSILPGVAKL

SEQ ID NO: 732490 - protein, 31 aa, Mycobacterium
SLPGMLMAAARLDLASVFLYAGSILPGVAKL

SEQ ID NO: 732491 - protein, 33 aa, Mycobacterium
SLPGSIFPLPALPPWLATDIDNWNIIMAALNGP

SEQ ID NO: 732492 - protein, 21 aa, Mycobacterium
SLPGYPFARQRHWVEPKHMVW

SEQ ID NO: 732493 - protein, 22 aa, Mycobacterium
SLPHRRFDAAVGNVPFSSARVH

SEQ ID NO: 732494 - protein, 17 aa, Mycobacterium
SLPKRGVSSSVLIVPVV

SEQ ID NO: 732495 - protein, 25 aa, Mycobacterium
SLPLGVPRPRMIGVLRGFDPDVVHL

SEQ ID NO: 732496 - protein, 25 aa, Mycobacterium
SLPLGVPRPRMVGVLRGFDPDVVHL

SEQ ID NO: 732497 - protein, 18 aa, Mycobacterium
SLPLTGAGCVDRIITDLA

SEQ ID NO: 732498 - protein, 18 aa, Mycobacterium
SLPLTVTEWDEWGNPLAD

SEQ ID NO: 732499 - protein, 18 aa, Mycobacterium
SLPLTVTEWDEWGNPLED

SEQ ID NO: 732500 - protein, 17 aa, Mycobacterium
SLPLTVTEWDEWGNPLS

SEQ ID NO: 732501 - protein, 19 aa, Mycobacterium
SLPLVAILWGRDASTLKPI

SEQ ID NO: 732502 - protein, 24 aa, Mycobacterium
SLPMGAEALALLRLPMVLPTVQLA

SEQ ID NO: 732503 - protein, 29 aa, Mycobacterium
SLPMGSEALALLRLPLVLPAVQLAGRIAG

SEQ ID NO: 732504 - protein, 27 aa, Mycobacterium
SLPMGSEALALLRLPLVLPSLQIAGKV

SEQ ID NO: 732505 - protein, 17 aa, Mycobacterium
SLPMGTEALALLRLPLL

SEQ ID NO: 732506 - protein, 24 aa, Mycobacterium
SLPPEFRAAVVLCDIEGLSYEEIG

SEQ ID NO: 732507 - protein, 24 aa, Mycobacterium
SLPPIARPEVRTAVLELVCTPFDL

SEQ ID NO: 732508 - protein, 22 aa, Mycobacterium
SLPRGDLAAAIYATIDGEVETI

SEQ ID NO: 732509 - protein, 21 aa, Mycobacterium
SLPRGDLAAAIYATIEDEVET

SEQ ID NO: 732510 - protein, 18 aa, Mycobacterium
SLPRRGVAEAVLVVGVVS

SEQ ID NO: 732511 - protein, 24 aa, Mycobacterium
SLPRWPITVSRDWAGSVSLAVAEV

SEQ ID NO: 732512 - protein, 27 aa, Mycobacterium
SLPSEVIPGIMGGVVGGLGGVLGGLTG

SEQ ID NO: 732513 - protein, 19 aa, Mycobacterium
SLPVRVVDTAMPWQPNGRP

SEQ ID NO: 732514 - protein, 22 aa, Mycobacterium
SLPVRVVDTAMPWRANGRPRRA

SEQ ID NO: 732515 - protein, 30 aa, Mycobacterium
SLPYAGRWVGHEGVERWLRAFGDTWSALEV

SEQ ID NO: 732516 - protein, 24 aa, Mycobacterium
SLPYASSLCGACFDVCPVRIDIPS

SEQ ID NO: 732517 - protein, 24 aa, Mycobacterium
SLPYASSLCGACFEACPVRIDIPS

SEQ ID NO: 732518 - protein, 18 aa, Mycobacterium
SLQAAYCLLHAWLQTPLT

SEQ ID NO: 732519 - protein, 19 aa, Mycobacterium
SLQAEGIEFLFGLPSPEID

SEQ ID NO: 732520 - protein, 27 aa, Mycobacterium
SLQAGRIGVPLSVPFPGVHDDRVTAVL

SEQ ID NO: 732521 - protein, 23 aa, Mycobacterium
SLQANAFQAQFIQAINGAGGAYA

SEQ ID NO: 732522 - protein, 23 aa, Mycobacterium
SLQDGYDAYFCVVDLHAITVAQD

SEQ ID NO: 732523 - protein, 19 aa, Mycobacterium
SLQEKLCQAAVFVTQSRQA

SEQ ID NO: 732524 - protein, 24 aa, Mycobacterium
SLQFRTIHGYKRAFRIAGSGPAIL

SEQ ID NO: 732525 - protein, 25 aa, Mycobacterium
SLQIPCDLALLAIGFDGVEHMPLLD

SEQ ID NO: 732526 - protein, 19 aa, Mycobacterium
SLQLATGIVNIWSAPAAAV

SEQ ID NO: 732527 - protein, 19 aa, Mycobacterium
SLQLATGIVNIWSAPADEV

SEQ ID NO: 732528 - protein, 19 aa, Mycobacterium
SLQLATGIVNIWTAPAPAV

SEQ ID NO: 732529 - protein, 18 aa, Mycobacterium
SLQLDFAKTLDFWAEALE

SEQ ID NO: 732530 - protein, 18 aa, Mycobacterium
SLQLDFAKTLDFWAEALQ

SEQ ID NO: 732531 - protein, 17 aa, Mycobacterium
SLQLRIGAPSVIRKVDR

SEQ ID NO: 732532 - protein, 19 aa, Mycobacterium
SLQLWVMIETPRAFLRAEE

SEQ ID NO: 732533 - protein, 19 aa, Mycobacterium
SLQNFYIAYRAVVRAKVDC

SEQ ID NO: 732534 - protein, 23 aa, Mycobacterium
SLQRLRDLGCEYVICYFPEAAYD

SEQ ID NO: 732535 - protein, 24 aa, Mycobacterium
SLQTLPLDVLNAVNAPFQAFTDRP

SEQ ID NO: 732536 - protein, 20 aa, Mycobacterium
SLQVRRRAKSWYERLNAEDP

SEQ ID NO: 732537 - protein, 18 aa, Mycobacterium
SLQVWRDVFVPDVDPEQA

SEQ ID NO: 732538 - protein, 19 aa, Mycobacterium
SLQYEGRMGDYAIQAAESV

SEQ ID NO: 732539 - protein, 24 aa, Mycobacterium
SLRAAGVATDLYYPVLTHRHRVPL

SEQ ID NO: 732540 - protein, 18 aa, Mycobacterium
SLRAEIDTLVLISNCPQI

SEQ ID NO: 732541 - protein, 23 aa, Mycobacterium
SLRAELFPLATLVTPNLDEVRLL

SEQ ID NO: 732542 - protein, 19 aa, Mycobacterium
SLRALAAHPGWSHTNLQGN

SEQ ID NO: 732543 - protein, 20 aa, Mycobacterium
SLRALTYTNICEAMKTETPG

SEQ ID NO: 732544 - protein, 32 aa, Mycobacterium
SLRDMVLFIGHPARWADWGSLEYSVRTGEPAA

SEQ ID NO: 732545 - protein, 22 aa, Mycobacterium
SLRECRAMVFVSTARCPMTYVL

SEQ ID NO: 732546 - protein, 24 aa, Mycobacterium
SLREPKWIGPHIKGPDDAPLIEKP

SEQ ID NO: 732547 - protein, 18 aa, Mycobacterium
SLRESRQLVREWLTSWSK

SEQ ID NO: 732548 - protein, 20 aa, Mycobacterium
SLRESTRLLGGITADRSRTM

SEQ ID NO: 732549 - protein, 18 aa, Mycobacterium
SLRGCAAALDGSDVIRAS

SEQ ID NO: 732550 - protein, 17 aa, Mycobacterium
SLRGEIYRDVVAKLVEA

SEQ ID NO: 732551 - protein, 19 aa, Mycobacterium
SLRGGECSMALAGGVMVMA

SEQ ID NO: 732552 - protein, 18 aa, Mycobacterium
SLRGRLFAVLGSSLSLGD

SEQ ID NO: 732553 - protein, 18 aa, Mycobacterium
SLRGRLFAVLGSSLTLGD

SEQ ID NO: 732554 - protein, 40 aa, Mycobacterium
SLRGSHPVRLFIGAGMPAGLWKRVVDVFAPANVVEFFATT

SEQ ID NO: 732555 - protein, 24 aa, Mycobacterium
SLRHAEILVALALSPQGRSAPQLA

SEQ ID NO: 732556 - protein, 17 aa, Mycobacterium
SLRHAWAALDAGADGLV

SEQ ID NO: 732557 - protein, 18 aa, Mycobacterium
SLRHGIEGLGHPLVDHVR

SEQ ID NO: 732558 - protein, 18 aa, Mycobacterium
SLRHRMGIRPVYKTVDTC

SEQ ID NO: 732559 - protein, 23 aa, Mycobacterium
SLRIVLAHELFHYAARADTVADA

SEQ ID NO: 732560 - protein, 24 aa, Mycobacterium
SLRLCPPAPTGTRMASRDVQVGGY

SEQ ID NO: 732561 - protein, 18 aa, Mycobacterium
SLRLCVSGGAAMPVEVMR

SEQ ID NO: 732562 - protein, 28 aa, Mycobacterium
SLRLRADIPLPGRLWLELSASPDGNGGS

SEQ ID NO: 732563 - protein, 21 aa, Mycobacterium
SLRLVACGGSAVPESLMRTFE

SEQ ID NO: 732564 - protein, 20 aa, Mycobacterium
SLRLWSRAAGSLACAGPPEG

SEQ ID NO: 732565 - protein, 26 aa, Mycobacterium
SLRMEPGELVALLGPSGCGKTTALRI

SEQ ID NO: 732566 - protein, 33 aa, Mycobacterium
SLRPRGVEEVVIIGRRGPLQAAFTTLELRELGE

SEQ ID NO: 732567 - protein, 26 aa, Mycobacterium
SLRQKVHAALEFKNQVLVKIYNRKAL

SEQ ID NO: 732568 - protein, 23 aa, Mycobacterium
SLRQLPEPVIPNGLQIRTYAGTE

SEQ ID NO: 732569 - protein, 20 aa, Mycobacterium
SLRQMRWANAMLKELSPQAL

SEQ ID NO: 732570 - protein, 24 aa, Mycobacterium
SLRRAATLADGWAPFNVSLRQARD

SEQ ID NO: 732571 - protein, 25 aa, Mycobacterium
SLRRAATLGDGWAPFAVGLEQARDW

SEQ ID NO: 732572 - protein, 22 aa, Mycobacterium
SLRRDGWTFTGWGRAATDGAGR

SEQ ID NO: 732573 - protein, 31 aa, Mycobacterium
SLRRELSALVARSPFGQGAAWPVVETVQRDG

SEQ ID NO: 732574 - protein, 17 aa, Mycobacterium
SLRRGGVAAVSPIGVLG

SEQ ID NO: 732575 - protein, 17 aa, Mycobacterium
SLRRGGVAAVSPVGVLG

SEQ ID NO: 732576 - protein, 17 aa, Mycobacterium
SLRRLALGHWLRRWWPA

SEQ ID NO: 732577 - protein, 24 aa, Mycobacterium
SLRRLGVDTIDLFQLHRIDRDFPL

SEQ ID NO: 732578 - protein, 23 aa, Mycobacterium
SLRRLGVDTIDLFQLHRIDRHVP

SEQ ID NO: 732579 - protein, 24 aa, Mycobacterium
SLRRLGVDTIDLFQLHRIDRNYPL

SEQ ID NO: 732580 - protein, 17 aa, Mycobacterium
SLRRMGYVHATRANAAE

SEQ ID NO: 732581 - protein, 21 aa, Mycobacterium
SLRRRMAVITGRTPGPASRPA

SEQ ID NO: 732582 - protein, 26 aa, Mycobacterium
SLRRSYDLLRPGGRLVGYGISNMQQG

SEQ ID NO: 732583 - protein, 25 aa, Mycobacterium
SLRSELKGDELLGVEVFASALSSPL

SEQ ID NO: 732584 - protein, 19 aa, Mycobacterium
SLRSGECDLALAGGATVNA

SEQ ID NO: 732585 - protein, 19 aa, Mycobacterium
SLRSGECDLALAGGVTVMA

SEQ ID NO: 732586 - protein, 19 aa, Mycobacterium
SLRSGECDLALAGGVTVNA

SEQ ID NO: 732587 - protein, 30 aa, Mycobacterium
SLRSIPTLFWREWSFRLTVGRGTLSVIRPV

SEQ ID NO: 732588 - protein, 33 aa, Mycobacterium
SLRSRWVRALVDLRVARLLAYRAVSLQDDPAAG

SEQ ID NO: 732589 - protein, 19 aa, Mycobacterium
SLRTAIRGLREAIAEGDKE

SEQ ID NO: 732590 - protein, 22 aa, Mycobacterium
SLRTLGLRRIRHSVIREDNPQT

SEQ ID NO: 732591 - protein, 22 aa, Mycobacterium
SLRVNFLRPFFAGNESRYEGTP

SEQ ID NO: 732592 - protein, 21 aa, Mycobacterium
SLRVPDLEALLAYEESTKARA

SEQ ID NO: 732593 - protein, 21 aa, Mycobacterium
SLRVRAGRLASLLPDAKAVDC

SEQ ID NO: 732594 - protein, 19 aa, Mycobacterium
SLRWGEAVLGVLAEAGYAG

SEQ ID NO: 732595 - protein, 18 aa, Mycobacterium
SLRYLRRELRAENPEQQQ

SEQ ID NO: 732596 - protein, 19 aa, Mycobacterium
SLRYLRRELRAETAEQQQL

SEQ ID NO: 732597 - protein, 21 aa, Mycobacterium
SLRYRLDRITAVAGLDLQSAA

SEQ ID NO: 732598 - protein, 20 aa, Mycobacterium
SLRYYPAFAGPALDALNATQ

SEQ ID NO: 732599 - protein, 19 aa, Mycobacterium
SLSAFSFATLLSEIFHIDV

SEQ ID NO: 732600 - protein, 17 aa, Mycobacterium
SLSDFGFANVDRNPSPE

SEQ ID NO: 732601 - protein, 18 aa, Mycobacterium
SLSDGIEATVAWYRENTD

SEQ ID NO: 732602 - protein, 24 aa, Mycobacterium
SLSDLQPGDVLTFYSDASHAGLYI

SEQ ID NO: 732603 - protein, 24 aa, Mycobacterium
SLSDYKGRQVVVYFYPAASTPGCT

SEQ ID NO: 732604 - protein, 25 aa, Mycobacterium
SLSEAEGLLGWLHRVLEHLPGPDRL

SEQ ID NO: 732605 - protein, 19 aa, Mycobacterium
SLSEIKAAAAAAPPPRDVM

SEQ ID NO: 732606 - protein, 25 aa, Mycobacterium
SLSELLSVPGLFVFGSNDYFGPRPK

SEQ ID NO: 732607 - protein, 24 aa, Mycobacterium
SLSELRLGFEPAAAALAARRASPH

SEQ ID NO: 732608 - protein, 23 aa, Mycobacterium
SLSEYTSAIAMCRCDDKRLTRRL

SEQ ID NO: 732609 - protein, 18 aa, Mycobacterium
SLSGRPSNIGTRFHNHLY

SEQ ID NO: 732610 - protein, 18 aa, Mycobacterium
SLSGRTFVYKGMLTTPQL

SEQ ID NO: 732611 - protein, 18 aa, Mycobacterium
SLSGSRWEIRVAAVNAAI

SEQ ID NO: 732612 - protein, 33 aa, Mycobacterium
SLSHPVPPAALWGRPGYVTALLGDRVGEITTAR

SEQ ID NO: 732613 - protein, 18 aa, Mycobacterium
SLSHPYLDTVLFLLGVTR

SEQ ID NO: 732614 - protein, 22 aa, Mycobacterium
SLSLKPSEFWARQCYVGASFMR

SEQ ID NO: 732615 - protein, 19 aa, Mycobacterium
SLSLLRDGERLFVSTEGHG

SEQ ID NO: 732616 - protein, 26 aa, Mycobacterium
SLSMASALGPYVAWTAGVAARAAETA

SEQ ID NO: 732617 - protein, 33 aa, Mycobacterium
SLSQAVPPAALWGRKGYVTGLLGRRVGRMTAVR

SEQ ID NO: 732618 - protein, 24 aa, Mycobacterium
SLSQIVWGALYLKSMPPSRGARPV

SEQ ID NO: 732619 - protein, 23 aa, Mycobacterium
SLSREFRGADRLYGYAHHSVSTT

SEQ ID NO: 732620 - protein, 17 aa, Mycobacterium
SLSREFRTLLDQVPPAD

SEQ ID NO: 732621 - protein, 18 aa, Mycobacterium
SLSRLARWLSGSDDVTVV

SEQ ID NO: 732622 - protein, 17 aa, Mycobacterium
SLSTVQALIRWDPVGHA

SEQ ID NO: 732623 - protein, 17 aa, Mycobacterium
SLSVMRIRRSVRRALTV

SEQ ID NO: 732624 - protein, 25 aa, Mycobacterium
SLSWAEPVPADFSGVIAHPTVHLTL

SEQ ID NO: 732625 - protein, 21 aa, Mycobacterium
SLSYTGVIAYVYFPGIMSGML

SEQ ID NO: 732626 - protein, 21 aa, Mycobacterium
SLTALRLRFEIQRRWQVDVPP

SEQ ID NO: 732627 - protein, 18 aa, Mycobacterium
SLTAMYWWGPASVSMLAT

SEQ ID NO: 732628 - protein, 17 aa, Mycobacterium
SLTAPQFHDAACATAAA

SEQ ID NO: 732629 - protein, 20 aa, Mycobacterium
SLTATPGYFKRPDVTANAFD

SEQ ID NO: 732630 - protein, 28 aa, Mycobacterium
SLTAVELRNRLKIATGLTLSPTLIFDHP

SEQ ID NO: 732631 - protein, 17 aa, Mycobacterium
SLTAVHLAAGALRAGEC

SEQ ID NO: 732632 - protein, 24 aa, Mycobacterium
SLTDESWSGPASMSMAAAVMPYIA

SEQ ID NO: 732633 - protein, 26 aa, Mycobacterium
SLTEDARSALAFVRRLRRADTVATGG

SEQ ID NO: 732634 - protein, 17 aa, Mycobacterium
SLTELKLDIPTIGRPFP

SEQ ID NO: 732635 - protein, 19 aa, Mycobacterium
SLTFPAVRPTVSGLVGTAM

SEQ ID NO: 732636 - protein, 17 aa, Mycobacterium
SLTGDMTSAFNFAAPPD

SEQ ID NO: 732637 - protein, 18 aa, Mycobacterium
SLTIGWPELAEAALAIRA

SEQ ID NO: 732638 - protein, 23 aa, Mycobacterium
SLTIPSIPGLPVPLPNTVPVPSD

SEQ ID NO: 732639 - protein, 18 aa, Mycobacterium
SLTKKLVRQRILKDQFRI

SEQ ID NO: 732640 - protein, 25 aa, Mycobacterium
SLTLRAIRMFMRWQRGIIQLLSGKL

SEQ ID NO: 732641 - protein, 26 aa, Mycobacterium
SLTMASAFAPYMAWTAGAAARAAEAA

SEQ ID NO: 732642 - protein, 27 aa, Mycobacterium
SLTPRELEVLRLLARGYTYREIAEDLV

SEQ ID NO: 732643 - protein, 18 aa, Mycobacterium
SLTRGGGDLIEFAMSAVA

SEQ ID NO: 732644 - protein, 17 aa, Mycobacterium
SLTRLGPLPPLRMQPGA

SEQ ID NO: 732645 - protein, 17 aa, Mycobacterium
SLTRLTAVLSHRSAEVA

SEQ ID NO: 732646 - protein, 23 aa, Mycobacterium
SLTRSRLSAYIDRVVARADRDAV

SEQ ID NO: 732647 - protein, 23 aa, Mycobacterium
SLTRWRTAYDIAMGEASAFVPAS

SEQ ID NO: 732648 - protein, 18 aa, Mycobacterium
SLTSEEWHGPASAAMVAA

SEQ ID NO: 732649 - protein, 22 aa, Mycobacterium
SLTSPRGKRQFRRAVLSDDASS

SEQ ID NO: 732650 - protein, 24 aa, Mycobacterium
SLTVPLRLGRLAVRAVAYPVIALW

SEQ ID NO: 732651 - protein, 18 aa, Mycobacterium
SLTVRYGPVLALDDASFT

SEQ ID NO: 732652 - protein, 21 aa, Mycobacterium
SLTVTCPRDLVLSAPVKLTEG

SEQ ID NO: 732653 - protein, 20 aa, Mycobacterium
SLTYPGYKPSLAGLVGSALF

SEQ ID NO: 732654 - protein, 28 aa, Mycobacterium
SLVAQENWEFVVLRLKADYDDRAERLPV

SEQ ID NO: 732655 - protein, 24 aa, Mycobacterium
SLVARCLPVPIDDYVEWAKTVSYR

SEQ ID NO: 732656 - protein, 17 aa, Mycobacterium
SLVATKLVTAIRAECGV

SEQ ID NO: 732657 - protein, 24 aa, Mycobacterium
SLVDARTIVTLSGFAPPTLHAMGI

SEQ ID NO: 732658 - protein, 18 aa, Mycobacterium
SLVDGIDVWGVRTLRQLQ

SEQ ID NO: 732659 - protein, 21 aa, Mycobacterium
SLVDGRIFGAGGFINISQSAK

SEQ ID NO: 732660 - protein, 18 aa, Mycobacterium
SLVDKGYFAPAWPVEFGG

SEQ ID NO: 732661 - protein, 20 aa, Mycobacterium
SLVENFLWMTFGLPAEPYHA

SEQ ID NO: 732662 - protein, 22 aa, Mycobacterium
SLVGDRPEHEWAGDAKVRDVMS

SEQ ID NO: 732663 - protein, 19 aa, Mycobacterium
SLVHLGLKHYFLVDFPQEP

SEQ ID NO: 732664 - protein, 25 aa, Mycobacterium
SLVHSRFRPGWLARSSMVAATLTGA

SEQ ID NO: 732665 - protein, 17 aa, Mycobacterium
SLVISHDVTERWWGVEV

SEQ ID NO: 732666 - protein, 20 aa, Mycobacterium
SLVKHLAMRRTLWVVRHEDL

SEQ ID NO: 732667 - protein, 26 aa, Mycobacterium
SLVKKYSDFIAWPIRMEVEKRTPPAS

SEQ ID NO: 732668 - protein, 24 aa, Mycobacterium
SLVNLPNWLALTFRFDDGPWLDVD

SEQ ID NO: 732669 - protein, 24 aa, Mycobacterium
SLVNLPNWLPVTFRVDGGAWFDID

SEQ ID NO: 732670 - protein, 18 aa, Mycobacterium
SLVPMCYPPAADQETVEL

SEQ ID NO: 732671 - protein, 20 aa, Mycobacterium
SLVREEIWTPISNRRSTARV

SEQ ID NO: 732672 - protein, 17 aa, Mycobacterium
SLVRSWCERVWTPKHVR

SEQ ID NO: 732673 - protein, 21 aa, Mycobacterium
SLVSLGEMWSGAGSDRALAAA

SEQ ID NO: 732674 - protein, 25 aa, Mycobacterium
SLVVIRLARHLRFRRADSPVSLTQL

SEQ ID NO: 732675 - protein, 31 aa, Mycobacterium
SLVVWLPEERICLCGNTFGPLFGHIPNLVTM

SEQ ID NO: 732676 - protein, 26 aa, Mycobacterium
SLVWIRGRLQRVPWGAVSSVLDTIAT

SEQ ID NO: 732677 - protein, 26 aa, Mycobacterium
SLVYDARTAAFAFRPGPVFTNLLLAD

SEQ ID NO: 732678 - protein, 17 aa, Mycobacterium
SLVYLALNKPRGMHSTM

SEQ ID NO: 732679 - protein, 19 aa, Mycobacterium
SLVYPHKPDMAAWLNQWAR

SEQ ID NO: 732680 - protein, 22 aa, Mycobacterium
SLWAVLRSKYAIELARTTAVLE

SEQ ID NO: 732681 - protein, 17 aa, Mycobacterium
SLWDWPTAAFSRCPGWA

SEQ ID NO: 732682 - protein, 23 aa, Mycobacterium
SLWPMLTSIWEWERRWVTDHAEP

SEQ ID NO: 732683 - protein, 22 aa, Mycobacterium
SLWPTFAEIPVGWRKVYGEASR

SEQ ID NO: 732684 - protein, 20 aa, Mycobacterium
SLWRQSRLAAKQGLFEVVPG

SEQ ID NO: 732685 - protein, 21 aa, Mycobacterium
SLYAFRIVVHPAIARTFDAEG

SEQ ID NO: 732686 - protein, 25 aa, Mycobacterium
SLYDLALLAGMYAMFAGFFHGAAMV

SEQ ID NO: 732687 - protein, 21 aa, Mycobacterium
SLYEWLSPALGPVSPAAVAPC

SEQ ID NO: 732688 - protein, 23 aa, Mycobacterium
SLYNHCLRCWYFGDFFAQLEGHR

SEQ ID NO: 732689 - protein, 22 aa, Mycobacterium
SLYPEVVVALDITGAKYHVPLL

SEQ ID NO: 732690 - protein, 17 aa, Mycobacterium
SLYRRWASKAPLVAEAV

SEQ ID NO: 732691 - protein, 17 aa, Mycobacterium
SLYTSLELMGGFDPERP

SEQ ID NO: 732692 - protein, 19 aa, Mycobacterium
SLYVYARETVGYALVIDGR

SEQ ID NO: 732693 - protein, 20 aa, Mycobacterium
SLYVYARETVGYALVIGGRV

SEQ ID NO: 732694 - protein, 24 aa, Mycobacterium
SMAAAAASYVGWLSSAAMQAEETA

SEQ ID NO: 732695 - protein, 19 aa, Mycobacterium
SMAAAVAPYMGWMSITGVQ

SEQ ID NO: 732696 - protein, 22 aa, Mycobacterium
SMAAGRISYLFGLEGPAMALDT

SEQ ID NO: 732697 - protein, 18 aa, Mycobacterium
SMAAWWLAVPAAIDLMLG

SEQ ID NO: 732698 - protein, 17 aa, Mycobacterium
SMADAWLGRVACGDNDL

SEQ ID NO: 732699 - protein, 23 aa, Mycobacterium
SMADEITELFGPGLAEITVICNG

SEQ ID NO: 732700 - protein, 26 aa, Mycobacterium
SMADEITELFGPGLAGITVIRNGIDA

SEQ ID NO: 732701 - protein, 24 aa, Mycobacterium
SMADLRAEPFVGYASRDSAVNDAV

SEQ ID NO: 732702 - protein, 25 aa, Mycobacterium
SMAGRIATGALWRDFGLPSFERLRV

SEQ ID NO: 732703 - protein, 17 aa, Mycobacterium
SMAGRIQALAQIIVDRY

SEQ ID NO: 732704 - protein, 23 aa, Mycobacterium
SMAHSKYIIVWGMNMTSTNLHGW

SEQ ID NO: 732705 - protein, 19 aa, Mycobacterium
SMAKLWWQAFMATDVRAVL

SEQ ID NO: 732706 - protein, 18 aa, Mycobacterium
SMAKSFVSEELFKVTDRC

SEQ ID NO: 732707 - protein, 20 aa, Mycobacterium
SMALRYEGWNITTAQDGASA

SEQ ID NO: 732708 - protein, 17 aa, Mycobacterium
SMARKLARDYARKHPRL

SEQ ID NO: 732709 - protein, 35 aa, Mycobacterium
SMARLAYNGHDGFPRVVPVGFYWTGERIVVSTAPT

SEQ ID NO: 732710 - protein, 25 aa, Mycobacterium
SMARRLRLNSRMGLLPDGSPVVEPL

SEQ ID NO: 732711 - protein, 25 aa, Mycobacterium
SMASVAAFTWLSTRGGGGGVVGVNN

SEQ ID NO: 732712 - protein, 18 aa, Mycobacterium
SMASWFTGVFRRLPDVLF

SEQ ID NO: 732713 - protein, 18 aa, Mycobacterium
SMAVAVQPYLAWLTYTAE

SEQ ID NO: 732714 - protein, 23 aa, Mycobacterium
SMAYSKYIIVWGMNMTSTNLHGW

SEQ ID NO: 732715 - protein, 19 aa, Mycobacterium
SMCNKIFAALGRRFNADEL

SEQ ID NO: 732716 - protein, 17 aa, Mycobacterium
SMDEAWSLVSDMTLGKL

SEQ ID NO: 732717 - protein, 26 aa, Mycobacterium
SMDHLKRALVRTGFLAGDALRMLAGT

SEQ ID NO: 732718 - protein, 19 aa, Mycobacterium
SMDLPRPGWAEVDAEKLWW

SEQ ID NO: 732719 - protein, 23 aa, Mycobacterium
SMDQGRLAAYHAFGEPAKGMTDL

SEQ ID NO: 732720 - protein, 23 aa, Mycobacterium
SMDQGRLAAYHAFGEPSKGMTDL

SEQ ID NO: 732721 - protein, 26 aa, Mycobacterium
SMEAAVFPYLAWMNITGMQAEQTARQ

SEQ ID NO: 732722 - protein, 30 aa, Mycobacterium
SMEKARARWHNAFASLKDDVDWNNIPKNPF

SEQ ID NO: 732723 - protein, 24 aa, Mycobacterium
SMEQGRLAAYHAFGEACDGITELQ

SEQ ID NO: 732724 - protein, 23 aa, Mycobacterium
SMEQGRLAAYHAFGEPTDGITDL

SEQ ID NO: 732725 - protein, 30 aa, Mycobacterium
SMESLYEYGSRAGLWRVLRVFEQRGIPLTI

SEQ ID NO: 732726 - protein, 35 aa, Mycobacterium
SMESLYEYGSRAGLWRVLRVFERRGLPLTIFAVAT

SEQ ID NO: 732727 - protein, 31 aa, Mycobacterium
SMESLYEYGSRAGVWRVLRVCEQSGVPLTIF

SEQ ID NO: 732728 - protein, 17 aa, Mycobacterium
SMEVYAAMVDRMDWNVG

SEQ ID NO: 732729 - protein, 17 aa, Mycobacterium
SMFDLAYGYARNQMTAY

SEQ ID NO: 732730 - protein, 17 aa, Mycobacterium
SMFKGGVALAGKDIEPI

SEQ ID NO: 732731 - protein, 26 aa, Mycobacterium
SMFLSRAETLIPMYAHNPAQLFETIV

SEQ ID NO: 732732 - protein, 22 aa, Mycobacterium
SMFRFGCVSGGASLYAPQAQNN

SEQ ID NO: 732733 - protein, 24 aa, Mycobacterium
SMFTCGALSMFARYLGEVQLPQDR

SEQ ID NO: 732734 - protein, 19 aa, Mycobacterium
SMGAMALFGENYGDRVRVV

SEQ ID NO: 732735 - protein, 23 aa, Mycobacterium
SMGCRTFGFAGGREDAWEADETY

SEQ ID NO: 732736 - protein, 25 aa, Mycobacterium
SMGDHGMAVMLARGDLAIEADIASD

SEQ ID NO: 732737 - protein, 24 aa, Mycobacterium
SMGDHGMAVMLARGDLAIEADIHS

SEQ ID NO: 732738 - protein, 25 aa, Mycobacterium
SMGDHGMAVMLARGDLAIEADISSD

SEQ ID NO: 732739 - protein, 19 aa, Mycobacterium
SMGDRRWALFKSEVALSAR

SEQ ID NO: 732740 - protein, 23 aa, Mycobacterium
SMGFKTFGFGFGREDIWEPEEIL

SEQ ID NO: 732741 - protein, 17 aa, Mycobacterium
SMGFKTFGFGFGREDVW

SEQ ID NO: 732742 - protein, 23 aa, Mycobacterium
SMGGCVVLPGLVSYSASKAALSH

SEQ ID NO: 732743 - protein, 19 aa, Mycobacterium
SMGGLVIRSACHYGQEQNR

SEQ ID NO: 732744 - protein, 20 aa, Mycobacterium
SMGGMLAFEVALRFEAAGYR

SEQ ID NO: 732745 - protein, 20 aa, Mycobacterium
SMGGMLAFEVALRFQSAGYR

SEQ ID NO: 732746 - protein, 17 aa, Mycobacterium
SMGGRVGGSPGIGSYQA

SEQ ID NO: 732747 - protein, 18 aa, Mycobacterium
SMGIAILVNGFWNKDKPA

SEQ ID NO: 732748 - protein, 17 aa, Mycobacterium
SMGKAALVGGMSVPQGW

SEQ ID NO: 732749 - protein, 19 aa, Mycobacterium
SMGLAPMVISQIFKIIAEI

SEQ ID NO: 732750 - protein, 30 aa, Mycobacterium
SMGLFGYAIPQEWGGLGLNLAQDVELAMEL

SEQ ID NO: 732751 - protein, 23 aa, Mycobacterium
SMGRNGGGWAHYVGQEKIRPLTG

SEQ ID NO: 732752 - protein, 21 aa, Mycobacterium
SMGRPGNVFAHVLLDRDASQS

SEQ ID NO: 732753 - protein, 17 aa, Mycobacterium
SMGRPMPGVPVVLVDPL

SEQ ID NO: 732754 - protein, 23 aa, Mycobacterium
SMGTGEVAAYCARKGTERLRSVV

SEQ ID NO: 732755 - protein, 19 aa, Mycobacterium
SMHGSDAWTPFDAPADSEF

SEQ ID NO: 732756 - protein, 17 aa, Mycobacterium
SMHKLRHRFATLGYSGT

SEQ ID NO: 732757 - protein, 19 aa, Mycobacterium
SMIDHTWGRVLTIVSDAGR

SEQ ID NO: 732758 - protein, 18 aa, Mycobacterium
SMIGRIFSPPEFKLIPID

SEQ ID NO: 732759 - protein, 24 aa, Mycobacterium
SMIHLALAAARDFPWAERRQGVLG

SEQ ID NO: 732760 - protein, 21 aa, Mycobacterium
SMILATGWLGSLAVAGGPRPL

SEQ ID NO: 732761 - protein, 21 aa, Mycobacterium
SMISAMAQLYVHGHDLDFRTL

SEQ ID NO: 732762 - protein, 25 aa, Mycobacterium
SMITALRATNEFDFNRLIGLLKVPS

SEQ ID NO: 732763 - protein, 19 aa, Mycobacterium
SMKMEIPVLAEIGGTVSKV

SEQ ID NO: 732764 - protein, 19 aa, Mycobacterium
SMKMEIPVLAEVGGTVSKV

SEQ ID NO: 732765 - protein, 17 aa, Mycobacterium
SMKRAGAGIPLVHATPM

SEQ ID NO: 732766 - protein, 20 aa, Mycobacterium
SMKSLLRMQHRVLGGTRRLF

SEQ ID NO: 732767 - protein, 23 aa, Mycobacterium
SMLAELELLWRDRIARIDELISS

SEQ ID NO: 732768 - protein, 19 aa, Mycobacterium
SMLFPHLYGTLPVAAVTRV

SEQ ID NO: 732769 - protein, 26 aa, Mycobacterium
SMLGGLPLSGFGGRGFSEVPRYGFKP

SEQ ID NO: 732770 - protein, 21 aa, Mycobacterium
SMLLSCLLTLGGVRPESAEAL

SEQ ID NO: 732771 - protein, 19 aa, Mycobacterium
SMLPRTAATILRRRDSRIE

SEQ ID NO: 732772 - protein, 17 aa, Mycobacterium
SMLQRLDGLDVDRLKAI

SEQ ID NO: 732773 - protein, 17 aa, Mycobacterium
SMLQRLDGLDVERLKDI

SEQ ID NO: 732774 - protein, 17 aa, Mycobacterium
SMLQRLDGLDVERLKEI

SEQ ID NO: 732775 - protein, 18 aa, Mycobacterium
SMLQRLDGLDVHRLEDID

SEQ ID NO: 732776 - protein, 25 aa, Mycobacterium
SMLSNLKGLFPAAAAAGAQIATSVA

SEQ ID NO: 732777 - protein, 19 aa, Mycobacterium
SMLVKRVEPDGALHVTQLG

SEQ ID NO: 732778 - protein, 24 aa, Mycobacterium
SMMAGLKALVSMARHGGEPRRSWA

SEQ ID NO: 732779 - protein, 19 aa, Mycobacterium
SMMHCMTVSLALEGVGLGT

SEQ ID NO: 732780 - protein, 18 aa, Mycobacterium
SMMIRLGTNHAYAVVETG

SEQ ID NO: 732781 - protein, 17 aa, Mycobacterium
SMMSQAAVAHRIAPLVV

SEQ ID NO: 732782 - protein, 20 aa, Mycobacterium
SMNARIAVNLGAPVVLAVKA

SEQ ID NO: 732783 - protein, 22 aa, Mycobacterium
SMNGRRRLLGSFNHGSMANAVP

SEQ ID NO: 732784 - protein, 23 aa, Mycobacterium
SMPAMIRAGGKMWGADGRPKDTK

SEQ ID NO: 732785 - protein, 22 aa, Mycobacterium
SMPAMIRAGGKMYGADGKLKDT

SEQ ID NO: 732786 - protein, 22 aa, Mycobacterium
SMPEEPVMLAAVMIGDGRSRIA

SEQ ID NO: 732787 - protein, 22 aa, Mycobacterium
SMPGDAGIALAMLPPELRDIVY

SEQ ID NO: 732788 - protein, 24 aa, Mycobacterium
SMPKAVVINPYFDWANDRPPDHHY

SEQ ID NO: 732789 - protein, 24 aa, Mycobacterium
SMPKAVVINPYFDWGTDRPPNHHY

SEQ ID NO: 732790 - protein, 18 aa, Mycobacterium
SMPLKCAGRGVGDNQSPD

SEQ ID NO: 732791 - protein, 24 aa, Mycobacterium
SMPQFDPAKAWSLIVDERVSLAGA

SEQ ID NO: 732792 - protein, 23 aa, Mycobacterium
SMPRAGFGAPVWDRKLQTDRLEY

SEQ ID NO: 732793 - protein, 21 aa, Mycobacterium
SMPVELRDGYQQSIVRAAAPG

SEQ ID NO: 732794 - protein, 21 aa, Mycobacterium
SMPVELREGYQQSIVRAAAPG

SEQ ID NO: 732795 - protein, 26 aa, Mycobacterium
SMQARLRLAGDMFFTSSVWRIAQAHQ

SEQ ID NO: 732796 - protein, 23 aa, Mycobacterium
SMQGRAGFEVKIHRSAADGAAVL

SEQ ID NO: 732797 - protein, 21 aa, Mycobacterium
SMQKKRFGRIIYIGSVSGSWG

SEQ ID NO: 732798 - protein, 22 aa, Mycobacterium
SMQRKRFGRIIFIGSVSGMWGI

SEQ ID NO: 732799 - protein, 18 aa, Mycobacterium
SMRARSAVDLSAVAATFD

SEQ ID NO: 732800 - protein, 19 aa, Mycobacterium
SMREKRLLTLASVTAVGNS

SEQ ID NO: 732801 - protein, 20 aa, Mycobacterium
SMRKFFNAFAPYGLPETAVK

SEQ ID NO: 732802 - protein, 25 aa, Mycobacterium
SMRKFYEAFAPYGLRETAVKPSYGL

SEQ ID NO: 732803 - protein, 26 aa, Mycobacterium
SMRKFYEAFSPYGLRETAIKPSYGLA

SEQ ID NO: 732804 - protein, 30 aa, Mycobacterium
SMRLARAVGHGRCRWLLLTGELLPASELAD

SEQ ID NO: 732805 - protein, 17 aa, Mycobacterium
SMRRPAPPEPKSAPERP

SEQ ID NO: 732806 - protein, 18 aa, Mycobacterium
SMRVPRKIQDTQLRMRHA

SEQ ID NO: 732807 - protein, 25 aa, Mycobacterium
SMSAYSGGLTYLFATYPTTVDFGNG

SEQ ID NO: 732808 - protein, 17 aa, Mycobacterium
SMSDWEGTLAINLWGVI

SEQ ID NO: 732809 - protein, 21 aa, Mycobacterium
SMSGRLVARYLAKYVTKSLVD

SEQ ID NO: 732810 - protein, 26 aa, Mycobacterium
SMSLSEQWKSSEFLPDPTLWPQEASD

SEQ ID NO: 732811 - protein, 25 aa, Mycobacterium
SMSMAAAVIPYVDWLTVTAEQAGHT

SEQ ID NO: 732812 - protein, 24 aa, Mycobacterium
SMSPETWAALSTHLNRAQLIEFCL

SEQ ID NO: 732813 - protein, 20 aa, Mycobacterium
SMSVPAHGLDAFGAEPQANV

SEQ ID NO: 732814 - protein, 23 aa, Mycobacterium
SMTGHAKGGAAVFQMMGLCQILR

SEQ ID NO: 732815 - protein, 22 aa, Mycobacterium
SMTIGGPAFRMGEDRAEELGLM

SEQ ID NO: 732816 - protein, 28 aa, Mycobacterium
SMTLVPRARPALRFVEIVAADPSVAAAA

SEQ ID NO: 732817 - protein, 34 aa, Mycobacterium
SMTPLTNWRIPGPELKFQEQWMPPTHVETPDAPS

SEQ ID NO: 732818 - protein, 26 aa, Mycobacterium
SMTTAASRYVDWLGRTAAQAEQSAAQ

SEQ ID NO: 732819 - protein, 24 aa, Mycobacterium
SMTTGSGWIRPPFNVTISNIPGSP

SEQ ID NO: 732820 - protein, 24 aa, Mycobacterium
SMVAAARPYIAWLSGASALAEQAG

SEQ ID NO: 732821 - protein, 19 aa, Mycobacterium
SMVDERAAGVVISVNGQVP

SEQ ID NO: 732822 - protein, 23 aa, Mycobacterium
SMVEAAICDGDWVVVRQQNVADN

SEQ ID NO: 732823 - protein, 17 aa, Mycobacterium
SMVEGRISAGVVVDDGS

SEQ ID NO: 732824 - protein, 25 aa, Mycobacterium
SMVPGLMHVRFGPYHVRDVKFVAAF

SEQ ID NO: 732825 - protein, 18 aa, Mycobacterium
SMVPREVGVIAGVDVALM

SEQ ID NO: 732826 - protein, 26 aa, Mycobacterium
SMVQRNCMVPVQLCHHYAKPMADRGR

SEQ ID NO: 732827 - protein, 19 aa, Mycobacterium
SMVSRVWRAFGLAPHKQDS

SEQ ID NO: 732828 - protein, 18 aa, Mycobacterium
SMVTGWWDLLLVGQLRDY

SEQ ID NO: 732829 - protein, 17 aa, Mycobacterium
SMVTRAGGVIAGVDIAL

SEQ ID NO: 732830 - protein, 17 aa, Mycobacterium
SMWANAWLAGKAAPDDL

SEQ ID NO: 732831 - protein, 26 aa, Mycobacterium
SMWIWRELATLLPMMSAVSVSETCSS

SEQ ID NO: 732832 - protein, 25 aa, Mycobacterium
SMWREMWDLSDQCWSQMSTTLVSVA

SEQ ID NO: 732833 - protein, 27 aa, Mycobacterium
SMWTAYRESPAWGFCMWAIAPDQMYSV

SEQ ID NO: 732834 - protein, 23 aa, Mycobacterium
SNAEAIRKFRILPVDFTEDTGEL

SEQ ID NO: 732835 - protein, 25 aa, Mycobacterium
SNAEDGRLRVCATFGQVDDCDSALL

SEQ ID NO: 732836 - protein, 18 aa, Mycobacterium
SNAFPGIDTNGGYAEYLK

SEQ ID NO: 732837 - protein, 22 aa, Mycobacterium
SNAFTLLLARMFALGVPGLPAE

SEQ ID NO: 732838 - protein, 22 aa, Mycobacterium
SNAGGLFLGWVDRVLAPGDPAD

SEQ ID NO: 732839 - protein, 17 aa, Mycobacterium
SNAHLRAAIGALTENAA

SEQ ID NO: 732840 - protein, 23 aa, Mycobacterium
SNALCAGAVALECGASVSQVAAA

SEQ ID NO: 732841 - protein, 19 aa, Mycobacterium
SNALLDYAYGRRFAYAEQM

SEQ ID NO: 732842 - protein, 19 aa, Mycobacterium
SNALLDYAYGRRFEYAELM

SEQ ID NO: 732843 - protein, 23 aa, Mycobacterium
SNANPPIVHSVGLGTVNGITLGF

SEQ ID NO: 732844 - protein, 25 aa, Mycobacterium
SNAPMVGVAYGYPGAPGQWWQQQVV

SEQ ID NO: 732845 - protein, 25 aa, Mycobacterium
SNARRLPIFRVLRYPIVNSTYFTDF

SEQ ID NO: 732846 - protein, 18 aa, Mycobacterium
SNATLWPLYHDLIVKPEY

SEQ ID NO: 732847 - protein, 18 aa, Mycobacterium
SNATLWPLYHDVIVKPIY

SEQ ID NO: 732848 - protein, 18 aa, Mycobacterium
SNATLWPLYHDVIVKPTY

SEQ ID NO: 732849 - protein, 18 aa, Mycobacterium
SNATLWPLYHDVIVRPIY

SEQ ID NO: 732850 - protein, 19 aa, Mycobacterium
SNAVALLIGSQVGTPGAMA

SEQ ID NO: 732851 - protein, 19 aa, Mycobacterium
SNAVALLIGSQVGVPGAMA

SEQ ID NO: 732852 - protein, 20 aa, Mycobacterium
SNDEVAGWISLHPNRFGGLA

SEQ ID NO: 732853 - protein, 19 aa, Mycobacterium
SNDLHLWRQLEFPGTNAQV

SEQ ID NO: 732854 - protein, 21 aa, Mycobacterium
SNDLILRVALQAVHDRELACA

SEQ ID NO: 732855 - protein, 20 aa, Mycobacterium
SNEAAFLYQLLVRSFGTNNL

SEQ ID NO: 732856 - protein, 19 aa, Mycobacterium
SNEAAFLYQLLVRSYGTNN

SEQ ID NO: 732857 - protein, 18 aa, Mycobacterium
SNEAIRWAAREATMRKVA

SEQ ID NO: 732858 - protein, 25 aa, Mycobacterium
SNEFFRLWLDPSMTYSCAYFERDDM

SEQ ID NO: 732859 - protein, 22 aa, Mycobacterium
SNEGRFGIEVAREMAKSVQEQL

SEQ ID NO: 732860 - protein, 24 aa, Mycobacterium
SNELCFLAGLLPTTAVGRLGDPAG

SEQ ID NO: 732861 - protein, 24 aa, Mycobacterium
SNELRRFARESSRWIFTNPDMIHV

SEQ ID NO: 732862 - protein, 18 aa, Mycobacterium
SNEPLPVMFFIYGGGYLL

SEQ ID NO: 732863 - protein, 17 aa, Mycobacterium
SNEWALEEICAVSPRYV

SEQ ID NO: 732864 - protein, 17 aa, Mycobacterium
SNFAGMWSAQLRAGDVV

SEQ ID NO: 732865 - protein, 24 aa, Mycobacterium
SNFAHPRFRAARDATAEFAWGLLI

SEQ ID NO: 732866 - protein, 17 aa, Mycobacterium
SNFDRLTPTAVEEIVRW

SEQ ID NO: 732867 - protein, 17 aa, Mycobacterium
SNFKGVKGYEAYAAREA

SEQ ID NO: 732868 - protein, 17 aa, Mycobacterium
SNFLRTAATAVRGEAPK

SEQ ID NO: 732869 - protein, 19 aa, Mycobacterium
SNFRLARRSTRIGDVDVRA

SEQ ID NO: 732870 - protein, 25 aa, Mycobacterium
SNFVTQIFLRGCKFQSAVEYPPRQP

SEQ ID NO: 732871 - protein, 23 aa, Mycobacterium
SNGDGIVVAGLFGDVVEGLTGSA

SEQ ID NO: 732872 - protein, 18 aa, Mycobacterium
SNGEMVWEKTIGDVRAGE

SEQ ID NO: 732873 - protein, 27 aa, Mycobacterium
SNGGDPVYTRLYFRVSDDESSYSFVEI

SEQ ID NO: 732874 - protein, 17 aa, Mycobacterium
SNGGLLMGIMLTKYPEK

SEQ ID NO: 732875 - protein, 19 aa, Mycobacterium
SNGGLLMGIMLTRYPERFG

SEQ ID NO: 732876 - protein, 18 aa, Mycobacterium
SNGGLLMGIMVTKYPEKF

SEQ ID NO: 732877 - protein, 19 aa, Mycobacterium
SNGGLLMGVMLTRYPDLFG

SEQ ID NO: 732878 - protein, 27 aa, Mycobacterium
SNGHKFRAAIHFDDLQWERGYSRVGAY

SEQ ID NO: 732879 - protein, 24 aa, Mycobacterium
SNGIAVSYCGKMFVDAGADVVKVE

SEQ ID NO: 732880 - protein, 19 aa, Mycobacterium
SNGIWKPSPGSVYPTLQLL

SEQ ID NO: 732881 - protein, 17 aa, Mycobacterium
SNGLFWQDDYQGLIDGS

SEQ ID NO: 732882 - protein, 24 aa, Mycobacterium
SNGLWKPSPGSVYPTLQLLDDEGL

SEQ ID NO: 732883 - protein, 18 aa, Mycobacterium
SNGPCWSPDGRTLYFCDT

SEQ ID NO: 732884 - protein, 23 aa, Mycobacterium
SNGPSVVEFNCRFGDPETQAVLA

SEQ ID NO: 732885 - protein, 22 aa, Mycobacterium
SNGQRPGSVVIPTLHRERPDLD

SEQ ID NO: 732886 - protein, 21 aa, Mycobacterium
SNGRCGWRMNLPAAVTAWSEL

SEQ ID NO: 732887 - protein, 33 aa, Mycobacterium
SNGRFAVNVVSGWFKDEFIHLGEPWLEHDERYR

SEQ ID NO: 732888 - protein, 21 aa, Mycobacterium
SNGRPAIVIEHITRLRPDLRP

SEQ ID NO: 732889 - protein, 23 aa, Mycobacterium
SNGSRRWPATKGTVDFGAVELGW

SEQ ID NO: 732890 - protein, 24 aa, Mycobacterium
SNGVLASRGRFCRRTTDWLEGIER

SEQ ID NO: 732891 - protein, 19 aa, Mycobacterium
SNGVLRMVRDINNIYRSHP

SEQ ID NO: 732892 - protein, 17 aa, Mycobacterium
SNGVRIRADIHVIGGRH

SEQ ID NO: 732893 - protein, 18 aa, Mycobacterium
SNIARNFARHGYTVALHN

SEQ ID NO: 732894 - protein, 23 aa, Mycobacterium
SNICTAQVLLAVIAAMYASYHGA

SEQ ID NO: 732895 - protein, 18 aa, Mycobacterium
SNICTAQVLLAVLAAMYA

SEQ ID NO: 732896 - protein, 23 aa, Mycobacterium
SNICTAQVLLAVMAAMYASYHGP

SEQ ID NO: 732897 - protein, 23 aa, Mycobacterium
SNIRPGVPVLFLDTGYHFAETLG

SEQ ID NO: 732898 - protein, 18 aa, Mycobacterium
SNIRWGFDRDHRRPYGVD

SEQ ID NO: 732899 - protein, 26 aa, Mycobacterium
SNISHEFRTPLTLIIGPVAELRRRTP

SEQ ID NO: 732900 - protein, 25 aa, Mycobacterium
SNISHEFRTPLTLILDPVSELRRAD

SEQ ID NO: 732901 - protein, 19 aa, Mycobacterium
SNITVCVGGGIGTPEQAAE

SEQ ID NO: 732902 - protein, 19 aa, Mycobacterium
SNITVCVGGGIGTPERAAD

SEQ ID NO: 732903 - protein, 24 aa, Mycobacterium
SNKDGGYLAANWALYRAELDLVES

SEQ ID NO: 732904 - protein, 24 aa, Mycobacterium
SNKDGGYLAANWALYRAELELVES

SEQ ID NO: 732905 - protein, 17 aa, Mycobacterium
SNKYLLNPLMLRLAGRK

SEQ ID NO: 732906 - protein, 21 aa, Mycobacterium
SNLACLCREHHLLKTFWPGWS

SEQ ID NO: 732907 - protein, 17 aa, Mycobacterium
SNLAELFAHYYNQVPDG

SEQ ID NO: 732908 - protein, 18 aa, Mycobacterium
SNLAGAFHRAGRCTAEAE

SEQ ID NO: 732909 - protein, 21 aa, Mycobacterium
SNLAKFDGMRYGLRAGDDGTH

SEQ ID NO: 732910 - protein, 23 aa, Mycobacterium
SNLASALPRPGTSEGRQLRRWLT

SEQ ID NO: 732911 - protein, 21 aa, Mycobacterium
SNLDLAGLMAIPPLDSDPDEA

SEQ ID NO: 732912 - protein, 25 aa, Mycobacterium
SNLDPGMCDAWLARLLAGERSIEVL

SEQ ID NO: 732913 - protein, 19 aa, Mycobacterium
SNLEFALGYSHPVLINAPE

SEQ ID NO: 732914 - protein, 20 aa, Mycobacterium
SNLELVESCTRRAADDGARL

SEQ ID NO: 732915 - protein, 23 aa, Mycobacterium
SNLFGFNAPAIAAVEAQYEQMWA

SEQ ID NO: 732916 - protein, 17 aa, Mycobacterium
SNLFHIEDFVAREMSAA

SEQ ID NO: 732917 - protein, 28 aa, Mycobacterium
SNLFLRDLVMALRWVKDNISAFGGDPDN

SEQ ID NO: 732918 - protein, 25 aa, Mycobacterium
SNLKCLCRKHHLLKTFWDWRDLQLP

SEQ ID NO: 732919 - protein, 32 aa, Mycobacterium
SNLKCLCRKHHLLKTFWGWHDKQLPDATVIWS

SEQ ID NO: 732920 - protein, 26 aa, Mycobacterium
SNLKCLCRKHHLLKTFWTGWRDEQRP

SEQ ID NO: 732921 - protein, 32 aa, Mycobacterium
SNLMHWPSVERVWMPEWLNYREATLERLRQAV

SEQ ID NO: 732922 - protein, 33 aa, Mycobacterium
SNLNDIRLLGPVADLFPILALPGQDVQGFSNLL

SEQ ID NO: 732923 - protein, 21 aa, Mycobacterium
SNLPRLVAHEAYPGHHTEHCR

SEQ ID NO: 732924 - protein, 19 aa, Mycobacterium
SNLQPWSVVAVRDPQRKAR

SEQ ID NO: 732925 - protein, 25 aa, Mycobacterium
SNLRLLPALDGFWFGVTPVALLNQI

SEQ ID NO: 732926 - protein, 24 aa, Mycobacterium
SNLRMGAALGQAILRSARRHEAAD

SEQ ID NO: 732927 - protein, 17 aa, Mycobacterium
SNLVNARFLRICVLTQY

SEQ ID NO: 732928 - protein, 22 aa, Mycobacterium
SNLYLRDLVLALQWVRENIAAF

SEQ ID NO: 732929 - protein, 33 aa, Mycobacterium
SNNLGWLNSGVGNWGGWNSGMGSTGFGNSGVTS

SEQ ID NO: 732930 - protein, 19 aa, Mycobacterium
SNPDRTAVVSGELRLTTQQ

SEQ ID NO: 732931 - protein, 20 aa, Mycobacterium
SNPFALLVGMLLDQQIPMET

SEQ ID NO: 732932 - protein, 20 aa, Mycobacterium
SNPGINFGLGNWGNGNFGIG

SEQ ID NO: 732933 - protein, 22 aa, Mycobacterium
SNPGMPAVVWGFGDEDGVWSYR

SEQ ID NO: 732934 - protein, 21 aa, Mycobacterium
SNPLAALGLVGHTWNSNGDGI

SEQ ID NO: 732935 - protein, 19 aa, Mycobacterium
SNPMLGFRGASRYAHPAYA

SEQ ID NO: 732936 - protein, 17 aa, Mycobacterium
SNPRFSVSRVDIDRGGA

SEQ ID NO: 732937 - protein, 17 aa, Mycobacterium
SNPRFSVSRVDIDRGGP

SEQ ID NO: 732938 - protein, 17 aa, Mycobacterium
SNPRVAEDLRHFSLSLR

SEQ ID NO: 732939 - protein, 25 aa, Mycobacterium
SNQGFLRCVAALARAADSIGETDEY

SEQ ID NO: 732940 - protein, 17 aa, Mycobacterium
SNQLAWVSQTAANLVIG

SEQ ID NO: 732941 - protein, 23 aa, Mycobacterium
SNQLRLLRTLGLVTGDRSGRNIV

SEQ ID NO: 732942 - protein, 17 aa, Mycobacterium
SNQRPRPVNALADPHDL

SEQ ID NO: 732943 - protein, 18 aa, Mycobacterium
SNRELMRLALPVIKADYH

SEQ ID NO: 732944 - protein, 31 aa, Mycobacterium
SNRGKLNWWESRALYGWTVLVPRTKDQAGEM

SEQ ID NO: 732945 - protein, 23 aa, Mycobacterium
SNRIRLGKLAPRDMDRVAVKQLQ

SEQ ID NO: 732946 - protein, 29 aa, Mycobacterium
SNRLARWLIGRGVGRRARVGLLMERSAEA

SEQ ID NO: 732947 - protein, 20 aa, Mycobacterium
SNRLPYAWNPAYPARIGVMP

SEQ ID NO: 732948 - protein, 21 aa, Mycobacterium
SNTCSYCLSAHTYTGQRLAGL

SEQ ID NO: 732949 - protein, 21 aa, Mycobacterium
SNTEPLLRLNVEARTAEEVTE

SEQ ID NO: 732950 - protein, 17 aa, Mycobacterium
SNTEPLLRLNVEARTTE

SEQ ID NO: 732951 - protein, 17 aa, Mycobacterium
SNTEPLLRLNVEGRTAE

SEQ ID NO: 732952 - protein, 21 aa, Mycobacterium
SNTGIAARLAVTVPAVERHVT

SEQ ID NO: 732953 - protein, 25 aa, Mycobacterium
SNTGYELNQYTLLYDGYADFPQYPL

SEQ ID NO: 732954 - protein, 19 aa, Mycobacterium
SNTIAAGILAEWRGLEFDV

SEQ ID NO: 732955 - protein, 32 aa, Mycobacterium
SNTKCLCRIHHLLKTFWLGWSDRQLPDGTVIW

SEQ ID NO: 732956 - protein, 19 aa, Mycobacterium
SNTLLLERLAAERPADAVL

SEQ ID NO: 732957 - protein, 18 aa, Mycobacterium
SNTLWPRTMVATAAVQNL

SEQ ID NO: 732958 - protein, 32 aa, Mycobacterium
SNTPGYSGVMGRLWLARGGTYVLANIRGGGEY

SEQ ID NO: 732959 - protein, 19 aa, Mycobacterium
SNTVPPWVNKVVRGVLRSP

SEQ ID NO: 732960 - protein, 27 aa, Mycobacterium
SNVAQALRPTFLVAHQIAARHDVPLRA

SEQ ID NO: 732961 - protein, 18 aa, Mycobacterium
SNVARTVFKSMLTAVLDR

SEQ ID NO: 732962 - protein, 23 aa, Mycobacterium
SNVARTVFKSMLTAVLDRMPDYV

SEQ ID NO: 732963 - protein, 26 aa, Mycobacterium
SNVDEWRTTFAVNVFGPVELTLALLP

SEQ ID NO: 732964 - protein, 19 aa, Mycobacterium
SNVDRLAHRIFRRKHGPPN

SEQ ID NO: 732965 - protein, 24 aa, Mycobacterium
SNVGHCLWAGIATDEHAARLVEKL

SEQ ID NO: 732966 - protein, 36 aa, Mycobacterium
SNVKAGGGACPIRFQCAGCGFYRPDPSYLPVIEEHI

SEQ ID NO: 732967 - protein, 21 aa, Mycobacterium
SNVLVAEWIPYSALLPNVDVM

SEQ ID NO: 732968 - protein, 17 aa, Mycobacterium
SNVMYATGISWPLADAG

SEQ ID NO: 732969 - protein, 17 aa, Mycobacterium
SNVRFDGLMTFTLAETL

SEQ ID NO: 732970 - protein, 18 aa, Mycobacterium
SNVSRTGGALTFTHLFSE

SEQ ID NO: 732971 - protein, 21 aa, Mycobacterium
SNVVDALTWVMGEQGAKALRG

SEQ ID NO: 732972 - protein, 19 aa, Mycobacterium
SNWFGLNAPAIAHIEGLYE

SEQ ID NO: 732973 - protein, 18 aa, Mycobacterium
SNYVYRAADLGQWRMLMG

SEQ ID NO: 732974 - protein, 19 aa, Mycobacterium
SPAACRRVAISAHDGLARS

SEQ ID NO: 732975 - protein, 20 aa, Mycobacterium
SPAAHFCIVLAKLGSTDRDA

SEQ ID NO: 732976 - protein, 30 aa, Mycobacterium
SPAARGLGVLVCFAGRVLQPLGLNKVATDD

SEQ ID NO: 732977 - protein, 19 aa, Mycobacterium
SPAARRRAYGDLAHADIDE

SEQ ID NO: 732978 - protein, 17 aa, Mycobacterium
SPAATGLGMRWTLEASE

SEQ ID NO: 732979 - protein, 18 aa, Mycobacterium
SPAAYYVWVHDFSASVDA

SEQ ID NO: 732980 - protein, 25 aa, Mycobacterium
SPADARLAALIRRTCAQTLSLPPLP

SEQ ID NO: 732981 - protein, 17 aa, Mycobacterium
SPAEMRALFEGAGFTIS

SEQ ID NO: 732982 - protein, 22 aa, Mycobacterium
SPAERLGQLWGLLLPGMTVETS

SEQ ID NO: 732983 - protein, 25 aa, Mycobacterium
SPAEVPARFEALAALGGLDRAALHS

SEQ ID NO: 732984 - protein, 24 aa, Mycobacterium
SPAGARRRVVRLIDAQVVRVGAVV

SEQ ID NO: 732985 - protein, 28 aa, Mycobacterium
SPAGAYFKGGIKPVSVWLSHEYVRASPG

SEQ ID NO: 732986 - protein, 18 aa, Mycobacterium
SPAGFSFHRGPCNHISPT

SEQ ID NO: 732987 - protein, 27 aa, Mycobacterium
SPAGGRWGGRWVGIPVRLGRSRRVRWD

SEQ ID NO: 732988 - protein, 30 aa, Mycobacterium
SPAGLLYLAGPMAWTFGLPIVPMLNPGSID

SEQ ID NO: 732989 - protein, 20 aa, Mycobacterium
SPAGWPSRPTYSGWAGSPEI

SEQ ID NO: 732990 - protein, 22 aa, Mycobacterium
SPAGWPSRPTYSGWLGSREIAL

SEQ ID NO: 732991 - protein, 19 aa, Mycobacterium
SPAGWSHFDDDRWELYHVD

SEQ ID NO: 732992 - protein, 18 aa, Mycobacterium
SPALAAWFAATRPPIGGE

SEQ ID NO: 732993 - protein, 19 aa, Mycobacterium
SPALPGLSYVVMDEVHFLA

SEQ ID NO: 732994 - protein, 17 aa, Mycobacterium
SPALYHRFARVHAYGPL

SEQ ID NO: 732995 - protein, 23 aa, Mycobacterium
SPAMLLLWIRGVRFLYSLDPYLP

SEQ ID NO: 732996 - protein, 17 aa, Mycobacterium
SPAMRVAAVIARGPVRE

SEQ ID NO: 732997 - protein, 24 aa, Mycobacterium
SPANGWTMVSWDGIPVAPATLPTQ

SEQ ID NO: 732998 - protein, 23 aa, Mycobacterium
SPAPAEDALAFFRDEPFFRCVRL

SEQ ID NO: 732999 - protein, 18 aa, Mycobacterium
SPAPCTTCHGSGARPGTS

SEQ ID NO: 733000 - protein, 25 aa, Mycobacterium
SPAPRPSKYSSLVILTSGTTGTPKG

SEQ ID NO: 733001 - protein, 17 aa, Mycobacterium
SPAQRIMLYAKDRGCSK

SEQ ID NO: 733002 - protein, 29 aa, Mycobacterium
SPAQRRFAAAYGHRGRIVGAVTFNHGKWL

SEQ ID NO: 733003 - protein, 23 aa, Mycobacterium
SPARAAYLAGPWGAVASLSPELF

SEQ ID NO: 733004 - protein, 18 aa, Mycobacterium
SPARLLREGDIEAVGPRI

SEQ ID NO: 733005 - protein, 19 aa, Mycobacterium
SPARTAFDVGRWLPQAGAV

SEQ ID NO: 733006 - protein, 31 aa, Mycobacterium
SPASGRPLAMPRLDMVTGLYFLTTEIEGDKG

SEQ ID NO: 733007 - protein, 32 aa, Mycobacterium
SPASGRPLAMPRLDMVTGLYFLTTEIPGDIGA

SEQ ID NO: 733008 - protein, 17 aa, Mycobacterium
SPASQVWRSRRQIRLDL

SEQ ID NO: 733009 - protein, 25 aa, Mycobacterium
SPATEIPMGFGYPIDHPDLQSITEK

SEQ ID NO: 733010 - protein, 20 aa, Mycobacterium
SPATLPTTQVQQGGDGGAGG

SEQ ID NO: 733011 - protein, 19 aa, Mycobacterium
SPATLYNWRRSYGGMDTDA

SEQ ID NO: 733012 - protein, 23 aa, Mycobacterium
SPAVKLAATVLEYTSAGAAPTVA

SEQ ID NO: 733013 - protein, 19 aa, Mycobacterium
SPAVRSGYVAAFSIPGERG

SEQ ID NO: 733014 - protein, 25 aa, Mycobacterium
SPAWLAAELTRSWAVQWPGLPHAME

SEQ ID NO: 733015 - protein, 25 aa, Mycobacterium
SPAYWKRHIREAVRFADSVRFAHSA

SEQ ID NO: 733016 - protein, 22 aa, Mycobacterium
SPCGLAELCDRTGLPRATAYRL

SEQ ID NO: 733017 - protein, 19 aa, Mycobacterium
SPCGNGKGIEWVLMAVDNL

SEQ ID NO: 733018 - protein, 22 aa, Mycobacterium
SPCVIRAADGRIVWDNDAYAFL

SEQ ID NO: 733019 - protein, 20 aa, Mycobacterium
SPCVIRAADGRVVWDNDAYS

SEQ ID NO: 733020 - protein, 17 aa, Mycobacterium
SPDAAAITCAGRTVTRA

SEQ ID NO: 733021 - protein, 19 aa, Mycobacterium
SPDAMAWPLLAVIDSSLDE

SEQ ID NO: 733022 - protein, 19 aa, Mycobacterium
SPDAPVHVLAHDWGSVGIW

SEQ ID NO: 733023 - protein, 26 aa, Mycobacterium
SPDARGLGVLVCFAGTVRAPLGLHKR

SEQ ID NO: 733024 - protein, 22 aa, Mycobacterium
SPDARIGVVINDFGELNVDAGL

SEQ ID NO: 733025 - protein, 24 aa, Mycobacterium
SPDDVKILPGVVVYLGETARAAQE

SEQ ID NO: 733026 - protein, 18 aa, Mycobacterium
SPDEFSGKILAPAHLPQE

SEQ ID NO: 733027 - protein, 23 aa, Mycobacterium
SPDEFSGKILAPAHLPQEQSQRA

SEQ ID NO: 733028 - protein, 17 aa, Mycobacterium
SPDELRDAVAVGVGRLV

SEQ ID NO: 733029 - protein, 23 aa, Mycobacterium
SPDEMYKYLVAVSRQPDHAKIRA

SEQ ID NO: 733030 - protein, 21 aa, Mycobacterium
SPDERWPAGEFVTQSKEDHGL

SEQ ID NO: 733031 - protein, 25 aa, Mycobacterium
SPDFIRLGLMLALERRPAEPRARTM

SEQ ID NO: 733032 - protein, 26 aa, Mycobacterium
SPDFSGERVLGMGFDRDVLVRAGIEN

SEQ ID NO: 733033 - protein, 18 aa, Mycobacterium
SPDGAFVVATWHVPAPGA

SEQ ID NO: 733034 - protein, 17 aa, Mycobacterium
SPDGAVEEVTWDRFGVR

SEQ ID NO: 733035 - protein, 27 aa, Mycobacterium
SPDGCGKLLRYGAEFEALRDRSDAYLS

SEQ ID NO: 733036 - protein, 22 aa, Mycobacterium
SPDGGALVRIIAGDIGPHHGPG

SEQ ID NO: 733037 - protein, 26 aa, Mycobacterium
SPDGKRVYAGRCVRDRVDVAVIDVTA

SEQ ID NO: 733038 - protein, 23 aa, Mycobacterium
SPDGLRWSTTEQLGYNRRYTLSV

SEQ ID NO: 733039 - protein, 22 aa, Mycobacterium
SPDGRLGYVAGITSSEVDIVDL

SEQ ID NO: 733040 - protein, 21 aa, Mycobacterium
SPDHPRFVWGGRYELGSLIWR

SEQ ID NO: 733041 - protein, 18 aa, Mycobacterium
SPDIGGALGAFSQAVYTK

SEQ ID NO: 733042 - protein, 26 aa, Mycobacterium
SPDLDWQSVWDRGWTLAAAAEDKPVE

SEQ ID NO: 733043 - protein, 26 aa, Mycobacterium
SPDLDWQSVWDRGWTLAAAAEEKPVE

SEQ ID NO: 733044 - protein, 19 aa, Mycobacterium
SPDLLRFVAQRTLDSNTAN

SEQ ID NO: 733045 - protein, 24 aa, Mycobacterium
SPDLPADLFGPVANLKDWEVANSA

SEQ ID NO: 733046 - protein, 24 aa, Mycobacterium
SPDLRGAYAHALKSVVVGDDGAVY

SEQ ID NO: 733047 - protein, 23 aa, Mycobacterium
SPDLRGAYSHVLKSVAVGPDGAV

SEQ ID NO: 733048 - protein, 19 aa, Mycobacterium
SPDLSHVVFVRKATAADYG

SEQ ID NO: 733049 - protein, 18 aa, Mycobacterium
SPDLYEWLDGNRDVAFLP

SEQ ID NO: 733050 - protein, 19 aa, Mycobacterium
SPDPAWLQRCAHAHHKALD

SEQ ID NO: 733051 - protein, 24 aa, Mycobacterium
SPDPRAELLAALQALAAGDPHPQL

SEQ ID NO: 733052 - protein, 25 aa, Mycobacterium
SPDQRPSHRLCVLETAAGLTVVIAA

SEQ ID NO: 733053 - protein, 18 aa, Mycobacterium
SPDSAAWTAAARHVEEAC

SEQ ID NO: 733054 - protein, 25 aa, Mycobacterium
SPDSGATWLLPRLAGLTRAKQMLLL

SEQ ID NO: 733055 - protein, 20 aa, Mycobacterium
SPDSSYRTAIAIWQDESTNS

SEQ ID NO: 733056 - protein, 17 aa, Mycobacterium
SPDYAWQTAALGSPRAR

SEQ ID NO: 733057 - protein, 24 aa, Mycobacterium
SPEAAEQWRALALVTTTADLVGVA

SEQ ID NO: 733058 - protein, 17 aa, Mycobacterium
SPEALAAITALFSASPR

SEQ ID NO: 733059 - protein, 19 aa, Mycobacterium
SPEAMAWPLLEAIDHSLDE

SEQ ID NO: 733060 - protein, 24 aa, Mycobacterium
SPEDIAFAEARIRPQTMVAEDLLH

SEQ ID NO: 733061 - protein, 18 aa, Mycobacterium
SPEDLGLPGLEIDTDLRW

SEQ ID NO: 733062 - protein, 25 aa, Mycobacterium
SPEDLKAALLEDAKKAYKAREAEID

SEQ ID NO: 733063 - protein, 22 aa, Mycobacterium
SPEELCSLFAGLSDPSQLLDDI

SEQ ID NO: 733064 - protein, 22 aa, Mycobacterium
SPEEMYKYLVAVSRQPDHDKIR

SEQ ID NO: 733065 - protein, 19 aa, Mycobacterium
SPEERRAALEEFLTANPQV

SEQ ID NO: 733066 - protein, 21 aa, Mycobacterium
SPEEWRRIAAGLDHLAAHLHE

SEQ ID NO: 733067 - protein, 20 aa, Mycobacterium
SPEFARAWAEHEVGRFTSRE

SEQ ID NO: 733068 - protein, 17 aa, Mycobacterium
SPEGARELGRWATGHGA

SEQ ID NO: 733069 - protein, 18 aa, Mycobacterium
SPEGDRRMLGRPEFKAMF

SEQ ID NO: 733070 - protein, 22 aa, Mycobacterium
SPEGLNNLTLVVAGEACPTEVV

SEQ ID NO: 733071 - protein, 25 aa, Mycobacterium
SPEGWPSRPTYSGWLDSPAIAAAYG

SEQ ID NO: 733072 - protein, 23 aa, Mycobacterium
SPEGYPQSPAYEWWDWHDQYGTH

SEQ ID NO: 733073 - protein, 19 aa, Mycobacterium
SPEIFEWFDKSGVQDIPPI

SEQ ID NO: 733074 - protein, 22 aa, Mycobacterium
SPEKLKRLVAQISEKPDSVQHH

SEQ ID NO: 733075 - protein, 18 aa, Mycobacterium
SPELGGALAAFSRAVYTS

SEQ ID NO: 733076 - protein, 25 aa, Mycobacterium
SPELIREMMDWAACEHVPDDYLSLV

SEQ ID NO: 733077 - protein, 21 aa, Mycobacterium
SPEMLRAFGVREYQTATAALD

SEQ ID NO: 733078 - protein, 32 aa, Mycobacterium
SPEMPVDQYWFWNLRNAVRFDRAVATAAAAHV

SEQ ID NO: 733079 - protein, 26 aa, Mycobacterium
SPESGWIRTWLDTVLDLPWNARTEDS

SEQ ID NO: 733080 - protein, 27 aa, Mycobacterium
SPESGWIRTWLDTVLDLPWNVKTEDST

SEQ ID NO: 733081 - protein, 17 aa, Mycobacterium
SPESLPWVAPHLAESDE

SEQ ID NO: 733082 - protein, 19 aa, Mycobacterium
SPETMLAAIAARTERITLA

SEQ ID NO: 733083 - protein, 22 aa, Mycobacterium
SPETWLPMPPEWATLTVERQTA

SEQ ID NO: 733084 - protein, 23 aa, Mycobacterium
SPEVLRLLSSQSFREVLRLPDAT

SEQ ID NO: 733085 - protein, 44 aa, Mycobacterium
SPEWKRTGYKFFPFAAWQAGAWWVLRFNFGFPEHDMYTLFVDGQ

SEQ ID NO: 733086 - protein, 18 aa, Mycobacterium
SPEYIKKHLEKFSDGATR

SEQ ID NO: 733087 - protein, 20 aa, Mycobacterium
SPEYRLGRDLGTALVNAGYA

SEQ ID NO: 733088 - protein, 21 aa, Mycobacterium
SPFAASLLFGYVGAFMYEGDT

SEQ ID NO: 733089 - protein, 21 aa, Mycobacterium
SPFAASLLFGYVGAFMYEGDV

SEQ ID NO: 733090 - protein, 23 aa, Mycobacterium
SPFATEWKQIFATSDPLRKSILF

SEQ ID NO: 733091 - protein, 26 aa, Mycobacterium
SPFGDGRPGWHVECAAIALSRIGSGL

SEQ ID NO: 733092 - protein, 26 aa, Mycobacterium
SPFGDGRPGWHVECAAIASSRIGSGL

SEQ ID NO: 733093 - protein, 26 aa, Mycobacterium
SPFGRGRPGWHVECSAIALTRIGTGL

SEQ ID NO: 733094 - protein, 23 aa, Mycobacterium
SPFGWTFPYAWPHTPILAANAVC

SEQ ID NO: 733095 - protein, 18 aa, Mycobacterium
SPFHLCATVARRLLDAGY

SEQ ID NO: 733096 - protein, 25 aa, Mycobacterium
SPFNFPAMVPLWFIPVALAAGNTVV

SEQ ID NO: 733097 - protein, 23 aa, Mycobacterium
SPFPADGRDPWRLDGPWRTPLIA

SEQ ID NO: 733098 - protein, 24 aa, Mycobacterium
SPFPPLGPMIRLLLKLGTADAVRL

SEQ ID NO: 733099 - protein, 17 aa, Mycobacterium
SPFPTYYAPLISRDGIR

SEQ ID NO: 733100 - protein, 19 aa, Mycobacterium
SPFRPGGFGEMYFHNKYFR

SEQ ID NO: 733101 - protein, 23 aa, Mycobacterium
SPFRPSTHGEMYWQNRYYNLDVY

SEQ ID NO: 733102 - protein, 17 aa, Mycobacterium
SPFRVAADTVDWPEGDG

SEQ ID NO: 733103 - protein, 18 aa, Mycobacterium
SPFVSRILARMVFNENDM

SEQ ID NO: 733104 - protein, 19 aa, Mycobacterium
SPGARLPLADAARQALEAA

SEQ ID NO: 733105 - protein, 19 aa, Mycobacterium
SPGAVLRGRIERMHRSCLI

SEQ ID NO: 733106 - protein, 24 aa, Mycobacterium
SPGDSLRRSVDFTATRSSLEPREL

SEQ ID NO: 733107 - protein, 20 aa, Mycobacterium
SPGFGSWWRRVESVGYCAHP

SEQ ID NO: 733108 - protein, 18 aa, Mycobacterium
SPGFTLYSLSGHVARPGQ

SEQ ID NO: 733109 - protein, 17 aa, Mycobacterium
SPGFTLYSLSGHVTTPG

SEQ ID NO: 733110 - protein, 17 aa, Mycobacterium
SPGGSFINGQTIVVDGG

SEQ ID NO: 733111 - protein, 18 aa, Mycobacterium
SPGGTPGAQGFRAGDAGN

SEQ ID NO: 733112 - protein, 26 aa, Mycobacterium
SPGHGGNGGNAFLFGDGGTGGQGGTG

SEQ ID NO: 733113 - protein, 18 aa, Mycobacterium
SPGLELYSPAQLGLEHGH

SEQ ID NO: 733114 - protein, 27 aa, Mycobacterium
SPGLLRFLPELARRLLGEEPLLPTAAV

SEQ ID NO: 733115 - protein, 20 aa, Mycobacterium
SPGLMLAMGPGFCSELVLLR

SEQ ID NO: 733116 - protein, 18 aa, Mycobacterium
SPGLVFVWHDLQEPLFQT

SEQ ID NO: 733117 - protein, 22 aa, Mycobacterium
SPGLYKAATWQRGVHFADDTVL

SEQ ID NO: 733118 - protein, 25 aa, Mycobacterium
SPGPTGAAVQCGRATHDTIAARPAA

SEQ ID NO: 733119 - protein, 21 aa, Mycobacterium
SPGQPFGLYVHVPFCVTRCGY

SEQ ID NO: 733120 - protein, 20 aa, Mycobacterium
SPGRAPEFDTEFAVAWRLGR

SEQ ID NO: 733121 - protein, 21 aa, Mycobacterium
SPGRRAVIVGGGYIGLEAAAS

SEQ ID NO: 733122 - protein, 19 aa, Mycobacterium
SPGSFSWHVLTSLADDVQT

SEQ ID NO: 733123 - protein, 22 aa, Mycobacterium
SPGSVCWYSHDLGVVFSGDTLF

SEQ ID NO: 733124 - protein, 18 aa, Mycobacterium
SPGTGVLIAPNFAIGAVL

SEQ ID NO: 733125 - protein, 24 aa, Mycobacterium
SPGTVCLRLPVRTPFAYEGVFGHL

SEQ ID NO: 733126 - protein, 25 aa, Mycobacterium
SPGVAESWAKFALGTADQMANPLGS

SEQ ID NO: 733127 - protein, 20 aa, Mycobacterium
SPGVCRLSWTIEDVGSHLDA

SEQ ID NO: 733128 - protein, 24 aa, Mycobacterium
SPGVEIRPLYAWSGYRTNEVAFRD

SEQ ID NO: 733129 - protein, 17 aa, Mycobacterium
SPGVGLYLDGGFGVGKT

SEQ ID NO: 733130 - protein, 24 aa, Mycobacterium
SPGVRLRGTVSFAPIAAGTRVTER

SEQ ID NO: 733131 - protein, 21 aa, Mycobacterium
SPGVVAFVRRARRLLPGDPEF

SEQ ID NO: 733132 - protein, 26 aa, Mycobacterium
SPGYPCYRNILSALGCEVVEIPCGPE

SEQ ID NO: 733133 - protein, 20 aa, Mycobacterium
SPHCQEMFEAVLAGATDPEI

SEQ ID NO: 733134 - protein, 19 aa, Mycobacterium
SPHDFRRIFVTDAIMSGLP

SEQ ID NO: 733135 - protein, 19 aa, Mycobacterium
SPHLCSRAFITEQYDRYVR

SEQ ID NO: 733136 - protein, 26 aa, Mycobacterium
SPHLEAFKAKGYEVLLLTDPVDEVWV

SEQ ID NO: 733137 - protein, 27 aa, Mycobacterium
SPHLEAFKAKGYEVLVLTDPVDEVWVG

SEQ ID NO: 733138 - protein, 20 aa, Mycobacterium
SPHLEAFRAKGYEVLLLTEP

SEQ ID NO: 733139 - protein, 18 aa, Mycobacterium
SPHLGTIEIRVCDGISNL

SEQ ID NO: 733140 - protein, 23 aa, Mycobacterium
SPHLRRYLWCYVAQAAEPGLDLL

SEQ ID NO: 733141 - protein, 19 aa, Mycobacterium
SPHMLRHSFATHLLEGGAD

SEQ ID NO: 733142 - protein, 20 aa, Mycobacterium
SPHMLRHSFATHLLEGGADV

SEQ ID NO: 733143 - protein, 28 aa, Mycobacterium
SPHNDRLFCIPATIDLAGAEIELVSMVA

SEQ ID NO: 733144 - protein, 27 aa, Mycobacterium
SPHNERLFCVPATIDLAGAEIELVSMV

SEQ ID NO: 733145 - protein, 28 aa, Mycobacterium
SPHNERLYCIPATIDLAGAEIELVSMVA

SEQ ID NO: 733146 - protein, 18 aa, Mycobacterium
SPHPLARVATVRQLLLVE

SEQ ID NO: 733147 - protein, 22 aa, Mycobacterium
SPHRFQVTASRFGRSVDVAAAH

SEQ ID NO: 733148 - protein, 17 aa, Mycobacterium
SPHSDWSPLPASFDTPG

SEQ ID NO: 733149 - protein, 17 aa, Mycobacterium
SPHVVAVGFTFDPHTHI

SEQ ID NO: 733150 - protein, 17 aa, Mycobacterium
SPHVVAVGFTFDPRTHI

SEQ ID NO: 733151 - protein, 21 aa, Mycobacterium
SPHWDRLALPASFVAPGPGGA

SEQ ID NO: 733152 - protein, 25 aa, Mycobacterium
SPHYTYKLKWLAALHNTAQGWLADD

SEQ ID NO: 733153 - protein, 24 aa, Mycobacterium
SPIAAAGRWAHWAATARSARLAAE

SEQ ID NO: 733154 - protein, 18 aa, Mycobacterium
SPIAIGPLGPEILSYEMA

SEQ ID NO: 733155 - protein, 18 aa, Mycobacterium
SPIALNWAIDSVRKGGTV

SEQ ID NO: 733156 - protein, 18 aa, Mycobacterium
SPIALSVTLAAVRRAREL

SEQ ID NO: 733157 - protein, 23 aa, Mycobacterium
SPIARPREVHVVPELPKTRSGKI

SEQ ID NO: 733158 - protein, 24 aa, Mycobacterium
SPIARPREVHVVPELPKTRSGKIM

SEQ ID NO: 733159 - protein, 17 aa, Mycobacterium
SPIAVVFRCADADTASE

SEQ ID NO: 733160 - protein, 26 aa, Mycobacterium
SPIEGWMPFRKVFDVVASGRRHVVMG

SEQ ID NO: 733161 - protein, 24 aa, Mycobacterium
SPIGKRNGWLSGLHATELLGAVQK

SEQ ID NO: 733162 - protein, 38 aa, Mycobacterium
SPIGMPLAHLGFFVLDAWLRPVPEGVTGELYIAGSGVA

SEQ ID NO: 733163 - protein, 17 aa, Mycobacterium
SPIHRDGFVMTFWELAD

SEQ ID NO: 733164 - protein, 19 aa, Mycobacterium
SPIQMGWAVVQGKAALTSM

SEQ ID NO: 733165 - protein, 18 aa, Mycobacterium
SPISLSVTLEAIRRAGKL

SEQ ID NO: 733166 - protein, 20 aa, Mycobacterium
SPITDGWMLPVFRAAASPNA

SEQ ID NO: 733167 - protein, 17 aa, Mycobacterium
SPIVFLRLRKAARKHGL

SEQ ID NO: 733168 - protein, 17 aa, Mycobacterium
SPIVRRGYVTAFAAPAN

SEQ ID NO: 733169 - protein, 18 aa, Mycobacterium
SPIVRRGYVTAFTVPGGG

SEQ ID NO: 733170 - protein, 19 aa, Mycobacterium
SPIWEGEDGVIAWLLGGPE

SEQ ID NO: 733171 - protein, 28 aa, Mycobacterium
SPKARFLPTRLAAIPALLADVLRPDVLL

SEQ ID NO: 733172 - protein, 21 aa, Mycobacterium
SPKAWPRYVWIADELPSTATN

SEQ ID NO: 733173 - protein, 18 aa, Mycobacterium
SPKGMGLLHSKLLSNIRE

SEQ ID NO: 733174 - protein, 21 aa, Mycobacterium
SPKRDRALLVERFSKGGQKVI

SEQ ID NO: 733175 - protein, 28 aa, Mycobacterium
SPKRHLAFGHGIHFCVGAALARIEARAV

SEQ ID NO: 733176 - protein, 19 aa, Mycobacterium
SPKRRQVLRDMGIEHVYDS

SEQ ID NO: 733177 - protein, 17 aa, Mycobacterium
SPKTVAMLMRFQHATAR

SEQ ID NO: 733178 - protein, 23 aa, Mycobacterium
SPKTVAMLMRFRHATVRIADSAR

SEQ ID NO: 733179 - protein, 34 aa, Mycobacterium
SPKYGWRGPEPYFYIVEILSHFDLIAVQEVRDGL

SEQ ID NO: 733180 - protein, 19 aa, Mycobacterium
SPLAGLLAAINAPVQSLTG

SEQ ID NO: 733181 - protein, 18 aa, Mycobacterium
SPLALARQALGRLPKEER

SEQ ID NO: 733182 - protein, 17 aa, Mycobacterium
SPLALARQALGSVAKDQ

SEQ ID NO: 733183 - protein, 18 aa, Mycobacterium
SPLARLAARLFPWRYDRQ

SEQ ID NO: 733184 - protein, 19 aa, Mycobacterium
SPLAVLAPRSPADCFETAL

SEQ ID NO: 733185 - protein, 19 aa, Mycobacterium
SPLDVSLLHVLRYVQAVGG

SEQ ID NO: 733186 - protein, 19 aa, Mycobacterium
SPLEFLYGLFSDYVRDRRR

SEQ ID NO: 733187 - protein, 19 aa, Mycobacterium
SPLEFLYGLFSDYVSDRRR

SEQ ID NO: 733188 - protein, 24 aa, Mycobacterium
SPLERAHCDDLYWMYSVASCVKWT

SEQ ID NO: 733189 - protein, 27 aa, Mycobacterium
SPLGEKVLDCPINWKLAVDTFSENYHF

SEQ ID NO: 733190 - protein, 18 aa, Mycobacterium
SPLGRGFLTGAIGSRDQL

SEQ ID NO: 733191 - protein, 19 aa, Mycobacterium
SPLGRGFLTGAIRSTEGLP

SEQ ID NO: 733192 - protein, 18 aa, Mycobacterium
SPLGRGFLTGTVRSAADL

SEQ ID NO: 733193 - protein, 18 aa, Mycobacterium
SPLGRGFLTGTVRSTEEL

SEQ ID NO: 733194 - protein, 19 aa, Mycobacterium
SPLGWKALIDTGGLSAVRG

SEQ ID NO: 733195 - protein, 17 aa, Mycobacterium
SPLHHWNAGPGKKIAVI

SEQ ID NO: 733196 - protein, 17 aa, Mycobacterium
SPLKRIAEEHGIALVVG

SEQ ID NO: 733197 - protein, 18 aa, Mycobacterium
SPLKYAVYLDDWILFDDT

SEQ ID NO: 733198 - protein, 29 aa, Mycobacterium
SPLLRRPDLLVSLLTYWQRHPALSYLFAG

SEQ ID NO: 733199 - protein, 28 aa, Mycobacterium
SPLLRRPDLLVSLLTYWQRHPSLSYLFA

SEQ ID NO: 733200 - protein, 28 aa, Mycobacterium
SPLLRRPDLLVSLLTYWQRHPSLSYVFA

SEQ ID NO: 733201 - protein, 29 aa, Mycobacterium
SPLLRRPDLLVSMLTYWQRHPALSYLFAG

SEQ ID NO: 733202 - protein, 21 aa, Mycobacterium
SPLNLLRWTSARTIKETFVPA

SEQ ID NO: 733203 - protein, 18 aa, Mycobacterium
SPLNPPSGCRFRTRCWKA

SEQ ID NO: 733204 - protein, 21 aa, Mycobacterium
SPLNWCNPDGRALGVAPTTAT

SEQ ID NO: 733205 - protein, 20 aa, Mycobacterium
SPLPAFTCYTLETAVGVLEA

SEQ ID NO: 733206 - protein, 17 aa, Mycobacterium
SPLPEHPQLEVLQGDIT

SEQ ID NO: 733207 - protein, 24 aa, Mycobacterium
SPLPRIFYTAAVSDLFINPVDPAF

SEQ ID NO: 733208 - protein, 26 aa, Mycobacterium
SPLQVLERDVLGLVNAPTQALLGRPI

SEQ ID NO: 733209 - protein, 20 aa, Mycobacterium
SPLRHWKAGPGTRLAIIGLG

SEQ ID NO: 733210 - protein, 24 aa, Mycobacterium
SPLRRLVEGSGMASVILYGPPGSG

SEQ ID NO: 733211 - protein, 19 aa, Mycobacterium
SPLRRTGEWEWEFETDPSL

SEQ ID NO: 733212 - protein, 17 aa, Mycobacterium
SPLRVYVMGQRGADREP

SEQ ID NO: 733213 - protein, 18 aa, Mycobacterium
SPLRVYVMGRRGVDREPA

SEQ ID NO: 733214 - protein, 22 aa, Mycobacterium
SPLSALLHVARTVARRAERSAW

SEQ ID NO: 733215 - protein, 20 aa, Mycobacterium
SPLSALLHVARTVVRRAERS

SEQ ID NO: 733216 - protein, 21 aa, Mycobacterium
SPLSCAIGMAVLDVLHEEGLQ

SEQ ID NO: 733217 - protein, 20 aa, Mycobacterium
SPLSCALGMTVLDVLGEERL

SEQ ID NO: 733218 - protein, 23 aa, Mycobacterium
SPLSLPPPVPMSGRFIYAGLADQ

SEQ ID NO: 733219 - protein, 22 aa, Mycobacterium
SPLSSQDVFDWLGSTVQDIRAP

SEQ ID NO: 733220 - protein, 19 aa, Mycobacterium
SPLTAAVARFAREEGLAIG

SEQ ID NO: 733221 - protein, 17 aa, Mycobacterium
SPLTPLAGLALAKVIDE

SEQ ID NO: 733222 - protein, 17 aa, Mycobacterium
SPLTPLAGLALARIIDE

SEQ ID NO: 733223 - protein, 23 aa, Mycobacterium
SPLVELLCTAPVDTAADRVRTRQ

SEQ ID NO: 733224 - protein, 19 aa, Mycobacterium
SPLVGPQFVDLVDAYSPRL

SEQ ID NO: 733225 - protein, 20 aa, Mycobacterium
SPLVNVYGWMQTRGPRRAVL

SEQ ID NO: 733226 - protein, 17 aa, Mycobacterium
SPLVRKLAADKGINLAQ

SEQ ID NO: 733227 - protein, 40 aa, Mycobacterium
SPMARSTKRVCRDCGFFLPLSGSLGAMFGVCGNELSADGH

SEQ ID NO: 733228 - protein, 19 aa, Mycobacterium
SPMCYPRGDFIVGDRDVLL

SEQ ID NO: 733229 - protein, 18 aa, Mycobacterium
SPMDPKLYLLWAQANATA

SEQ ID NO: 733230 - protein, 26 aa, Mycobacterium
SPMDVLWFRLNWRPGDPQELYGVARR

SEQ ID NO: 733231 - protein, 18 aa, Mycobacterium
SPMIGGLGYVLAPGPAAY

SEQ ID NO: 733232 - protein, 18 aa, Mycobacterium
SPMIRRGYVTAFSVPAEN

SEQ ID NO: 733233 - protein, 31 aa, Mycobacterium
SPMLCGGFTGWSSTRQWVWGQMDSARCGPVL

SEQ ID NO: 733234 - protein, 19 aa, Mycobacterium
SPMRRLGGGLVEIPRVPER

SEQ ID NO: 733235 - protein, 35 aa, Mycobacterium
SPMSLLRFIKFILTEIFPGGRLPRISQVDHYSSNA

SEQ ID NO: 733236 - protein, 17 aa, Mycobacterium
SPMSYAVLGSVAQHVMR

SEQ ID NO: 733237 - protein, 22 aa, Mycobacterium
SPMTPHAPGPVHGGGESPSPAA

SEQ ID NO: 733238 - protein, 18 aa, Mycobacterium
SPNFDVWPYNTFTSRVTP

SEQ ID NO: 733239 - protein, 17 aa, Mycobacterium
SPNHSWRKPKYIGDYIK

SEQ ID NO: 733240 - protein, 36 aa, Mycobacterium
SPNLRVGAIAARGPVMARLRAASVIDTMLVPAPLQY

SEQ ID NO: 733241 - protein, 31 aa, Mycobacterium
SPNPSELCSFPLRQCGSGNLFGGNEPARTWF

SEQ ID NO: 733242 - protein, 21 aa, Mycobacterium
SPNQFFLFFCLHHIVVDGFSS

SEQ ID NO: 733243 - protein, 27 aa, Mycobacterium
SPPAFADRVADGWIKAQAYRLQTFGTV

SEQ ID NO: 733244 - protein, 27 aa, Mycobacterium
SPPDMKLPISLALGWPDRVPGVAAACD

SEQ ID NO: 733245 - protein, 35 aa, Mycobacterium
SPPDMKLPISLALGWPRRVPGAARYCDFSQAQTWE

SEQ ID NO: 733246 - protein, 29 aa, Mycobacterium
SPPDMKLPISLALGWPRRVPGAATSCDFG

SEQ ID NO: 733247 - protein, 24 aa, Mycobacterium
SPPDPRTGLQITRTFTVNTDSEFV

SEQ ID NO: 733248 - protein, 27 aa, Mycobacterium
SPPEFANRVADAWIKAQAYRLQTFGTV

SEQ ID NO: 733249 - protein, 27 aa, Mycobacterium
SPPERLRSGWLNGIKHWQVDYGGAPGC

SEQ ID NO: 733250 - protein, 20 aa, Mycobacterium
SPPERPYAPGAFGPSETLDQ

SEQ ID NO: 733251 - protein, 27 aa, Mycobacterium
SPPESPRELGAWGLTEREARMHESLTR

SEQ ID NO: 733252 - protein, 17 aa, Mycobacterium
SPPEVHSALLSAGPGPG

SEQ ID NO: 733253 - protein, 18 aa, Mycobacterium
SPPLAICRAAHVVEADTR

SEQ ID NO: 733254 - protein, 25 aa, Mycobacterium
SPPPAPPRWEYDADFDLDYHMRRVA

SEQ ID NO: 733255 - protein, 18 aa, Mycobacterium
SPPPAYDMAVARAREMTA

SEQ ID NO: 733256 - protein, 20 aa, Mycobacterium
SPPPRPADCESMMDYGQGIV

SEQ ID NO: 733257 - protein, 19 aa, Mycobacterium
SPPSAFCDNNGWVVAALQA

SEQ ID NO: 733258 - protein, 20 aa, Mycobacterium
SPPSALWATSQSPPMPQTSA

SEQ ID NO: 733259 - protein, 18 aa, Mycobacterium
SPPSAYDMAVARAREMTT

SEQ ID NO: 733260 - protein, 20 aa, Mycobacterium
SPPSPTAWAAPPLPPLPPLP

SEQ ID NO: 733261 - protein, 18 aa, Mycobacterium
SPQARLALISAACEAGFQ

SEQ ID NO: 733262 - protein, 24 aa, Mycobacterium
SPQDRLSDVLARYGPEDPVHRAVD

SEQ ID NO: 733263 - protein, 20 aa, Mycobacterium
SPQRAYPCIHVAGTNGKTSV

SEQ ID NO: 733264 - protein, 26 aa, Mycobacterium
SPQRGGPALVCRWCGRIDPTRRCARC

SEQ ID NO: 733265 - protein, 27 aa, Mycobacterium
SPQSEHLFCVPATIDLAGAEIELVSMV

SEQ ID NO: 733266 - protein, 17 aa, Mycobacterium
SPQSVDVHWVYRGGRAD

SEQ ID NO: 733267 - protein, 17 aa, Mycobacterium
SPRAGLVDLVMDAFADG

SEQ ID NO: 733268 - protein, 20 aa, Mycobacterium
SPRATGRLLSLVEGERRDEV

SEQ ID NO: 733269 - protein, 30 aa, Mycobacterium
SPRATIALCRTARALALLRGRDHVVPDDIA

SEQ ID NO: 733270 - protein, 21 aa, Mycobacterium
SPRDIARLIETGRAGTGKQTW

SEQ ID NO: 733271 - protein, 25 aa, Mycobacterium
SPRDPEFELSDRFPLTDNDIPTTER

SEQ ID NO: 733272 - protein, 23 aa, Mycobacterium
SPREIAETLIAYRDKYGVSSFTV

SEQ ID NO: 733273 - protein, 21 aa, Mycobacterium
SPREREVLNLIAQGRSIPAMA

SEQ ID NO: 733274 - protein, 22 aa, Mycobacterium
SPREREVLVLIAAGSTIPAMAR

SEQ ID NO: 733275 - protein, 23 aa, Mycobacterium
SPRETWLRLLFVDAGLPYPTTQY

SEQ ID NO: 733276 - protein, 22 aa, Mycobacterium
SPRGAELWSAYSSLSDGETRQS

SEQ ID NO: 733277 - protein, 26 aa, Mycobacterium
SPRGQPRLLGFHWTKIHLDDPGLGEV

SEQ ID NO: 733278 - protein, 28 aa, Mycobacterium
SPRGRGGYRLGPEIARMASTVRLGVVMD

SEQ ID NO: 733279 - protein, 26 aa, Mycobacterium
SPRGRLGLLELRGFEMPPHLRMAMVQ

SEQ ID NO: 733280 - protein, 17 aa, Mycobacterium
SPRGRREIDAADFFAGV

SEQ ID NO: 733281 - protein, 33 aa, Mycobacterium
SPRIRNFLLRTSVMRRFNGALCDAVLQSSDSVS

SEQ ID NO: 733282 - protein, 21 aa, Mycobacterium
SPRLAEFLDHVDVAVSLHGYG

SEQ ID NO: 733283 - protein, 23 aa, Mycobacterium
SPRLDRLAAEGILFTRAHATAPL

SEQ ID NO: 733284 - protein, 23 aa, Mycobacterium
SPRLDRLAGEAILFTRAHATAPL

SEQ ID NO: 733285 - protein, 26 aa, Mycobacterium
SPRLPQWDPVGPDLRQLVLRDGSGTI

SEQ ID NO: 733286 - protein, 17 aa, Mycobacterium
SPRLVPYPIEPRAAVGI

SEQ ID NO: 733287 - protein, 25 aa, Mycobacterium
SPRMLRIAGTFADGVVLWMASAEAI

SEQ ID NO: 733288 - protein, 21 aa, Mycobacterium
SPRPGKPVAWQRAPAGSRRVR

SEQ ID NO: 733289 - protein, 21 aa, Mycobacterium
SPRPSNWRATGTLEDELIRQH

SEQ ID NO: 733290 - protein, 25 aa, Mycobacterium
SPRQAELFAAWAVYLLVGYEQAILP

SEQ ID NO: 733291 - protein, 23 aa, Mycobacterium
SPRRADLLSAVMYTEGRTFGVAV

SEQ ID NO: 733292 - protein, 21 aa, Mycobacterium
SPRRGTARSRRRWSGPGPDNR

SEQ ID NO: 733293 - protein, 17 aa, Mycobacterium
SPRRIAALRALEIQAYD

SEQ ID NO: 733294 - protein, 19 aa, Mycobacterium
SPRTKRVLLAGWEEFDEPV

SEQ ID NO: 733295 - protein, 27 aa, Mycobacterium
SPRTVYRRFMGVPGKRMITYLFEVDYL

SEQ ID NO: 733296 - protein, 21 aa, Mycobacterium
SPRVLISRGLVFDGGGAAGVV

SEQ ID NO: 733297 - protein, 24 aa, Mycobacterium
SPSARARIGLSRFLPGGGAEMDVS

SEQ ID NO: 733298 - protein, 26 aa, Mycobacterium
SPSAYRGGLVPGFPNLFISSAPNYSP

SEQ ID NO: 733299 - protein, 19 aa, Mycobacterium
SPSDEAFSRMFERDKNELR

SEQ ID NO: 733300 - protein, 20 aa, Mycobacterium
SPSDLWWAYATRCRPGDDSI

SEQ ID NO: 733301 - protein, 21 aa, Mycobacterium
SPSEPVHFVQMWVVPDESGID

SEQ ID NO: 733302 - protein, 22 aa, Mycobacterium
SPSGRWRCAILPHVQAGCQSAS

SEQ ID NO: 733303 - protein, 25 aa, Mycobacterium
SPSGVPLRMSCQAAGPLAARAVKTV

SEQ ID NO: 733304 - protein, 19 aa, Mycobacterium
SPSHLRAALPRGGTDVDAV

SEQ ID NO: 733305 - protein, 24 aa, Mycobacterium
SPSPAPAKPAWVRGSVASVSGNTI

SEQ ID NO: 733306 - protein, 21 aa, Mycobacterium
SPSPFHVCATVAARLNAAGYT

SEQ ID NO: 733307 - protein, 18 aa, Mycobacterium
SPSRRTGELDNRGSQFYL

SEQ ID NO: 733308 - protein, 17 aa, Mycobacterium
SPSRVVLTEGWQAGGAG

SEQ ID NO: 733309 - protein, 23 aa, Mycobacterium
SPSVLLYAAMDGWRRQMVQHGHE

SEQ ID NO: 733310 - protein, 23 aa, Mycobacterium
SPSVPARISLFVGKGGVGKSTLA

SEQ ID NO: 733311 - protein, 26 aa, Mycobacterium
SPSYRRSSPLRALRAGVALNEDCIEA

SEQ ID NO: 733312 - protein, 19 aa, Mycobacterium
SPTAEAFSRMFERDKNELR

SEQ ID NO: 733313 - protein, 17 aa, Mycobacterium
SPTAPGWTGRRGAATRL

SEQ ID NO: 733314 - protein, 17 aa, Mycobacterium
SPTAPYLAGRRGAGWLK

SEQ ID NO: 733315 - protein, 17 aa, Mycobacterium
SPTDARSPGFSLKSFVQ

SEQ ID NO: 733316 - protein, 20 aa, Mycobacterium
SPTECARLVAAHSLTPGAVV

SEQ ID NO: 733317 - protein, 25 aa, Mycobacterium
SPTETEVWRWYLIDKNAPDDVRDWL

SEQ ID NO: 733318 - protein, 25 aa, Mycobacterium
SPTGARLAGKHGIGLLSIGATLTIE

SEQ ID NO: 733319 - protein, 24 aa, Mycobacterium
SPTGARLAGRHGIGLLSIGATLTI

SEQ ID NO: 733320 - protein, 17 aa, Mycobacterium
SPTGPVWPEMGAGTLAE

SEQ ID NO: 733321 - protein, 22 aa, Mycobacterium
SPTIEMHAQPALLHGEAVNLDM

SEQ ID NO: 733322 - protein, 20 aa, Mycobacterium
SPTLGGFIRLLADLPEDVSD

SEQ ID NO: 733323 - protein, 25 aa, Mycobacterium
SPTNRKLILVIAVNRTFCGSKFIDR

SEQ ID NO: 733324 - protein, 25 aa, Mycobacterium
SPTRKRRMFDLLVRMGYKEIEVGFP

SEQ ID NO: 733325 - protein, 22 aa, Mycobacterium
SPTRRLGGGLVEIPRVPARDPL

SEQ ID NO: 733326 - protein, 23 aa, Mycobacterium
SPTRTAPPWPRCRCSRCCTTRRS

SEQ ID NO: 733327 - protein, 18 aa, Mycobacterium
SPTRVRIKVEVPFAELEP

SEQ ID NO: 733328 - protein, 19 aa, Mycobacterium
SPTTAWRWASRYRTLGAAG

SEQ ID NO: 733329 - protein, 18 aa, Mycobacterium
SPTTPMVRLARYAAGVAA

SEQ ID NO: 733330 - protein, 20 aa, Mycobacterium
SPTTQWRVGDDVAHTELGHG

SEQ ID NO: 733331 - protein, 26 aa, Mycobacterium
SPTVRSRILAALPHLLLLDAVGASES

SEQ ID NO: 733332 - protein, 25 aa, Mycobacterium
SPTWRAKVRKLPALDTEALRPAQIE

SEQ ID NO: 733333 - protein, 21 aa, Mycobacterium
SPVAAPALWSLVGSARPQDSG

SEQ ID NO: 733334 - protein, 20 aa, Mycobacterium
SPVADLTGCYDFTVVKQQGV

SEQ ID NO: 733335 - protein, 19 aa, Mycobacterium
SPVALNWAIDSVRKGGTVS

SEQ ID NO: 733336 - protein, 19 aa, Mycobacterium
SPVAPRPGLLSVFKAGARQ

SEQ ID NO: 733337 - protein, 19 aa, Mycobacterium
SPVCGPDCQGLCPDCGVAL

SEQ ID NO: 733338 - protein, 23 aa, Mycobacterium
SPVELPGSLVARFGAEAPNVIAR

SEQ ID NO: 733339 - protein, 17 aa, Mycobacterium
SPVFPGNGGAGGSGGAA

SEQ ID NO: 733340 - protein, 19 aa, Mycobacterium
SPVGDGMRAMIAMSGTGRI

SEQ ID NO: 733341 - protein, 18 aa, Mycobacterium
SPVGGGGVIGRWLQKLLS

SEQ ID NO: 733342 - protein, 23 aa, Mycobacterium
SPVGRCPIEKAMGLVGTKSAMLI

SEQ ID NO: 733343 - protein, 18 aa, Mycobacterium
SPVGRFLLAEAIRVKHTQ

SEQ ID NO: 733344 - protein, 18 aa, Mycobacterium
SPVGTLFVQPRVNTRTRR

SEQ ID NO: 733345 - protein, 24 aa, Mycobacterium
SPVGWPEQLWPALTTAGFATELRD

SEQ ID NO: 733346 - protein, 21 aa, Mycobacterium
SPVLACAIGHGVLPRLDDLQR

SEQ ID NO: 733347 - protein, 18 aa, Mycobacterium
SPVLPAGRIVGAGTVRRV

SEQ ID NO: 733348 - protein, 27 aa, Mycobacterium
SPVNIKGWRGFPLRERVAAAVPGVPVR

SEQ ID NO: 733349 - protein, 18 aa, Mycobacterium
SPVPLGLPSFHSDHWDGL

SEQ ID NO: 733350 - protein, 20 aa, Mycobacterium
SPVRGRATLTVFDRHLGQAE

SEQ ID NO: 733351 - protein, 23 aa, Mycobacterium
SPVRIHLSRRGWLNLPDWPPAMP

SEQ ID NO: 733352 - protein, 22 aa, Mycobacterium
SPVRPRKITVLNLFEPGESDDG

SEQ ID NO: 733353 - protein, 22 aa, Mycobacterium
SPVRRFELRAADGRLLAPEDTT

SEQ ID NO: 733354 - protein, 19 aa, Mycobacterium
SPVRYGGQVVAVLTHHQTA

SEQ ID NO: 733355 - protein, 18 aa, Mycobacterium
SPVRYGGQVVAVLTQHQT

SEQ ID NO: 733356 - protein, 19 aa, Mycobacterium
SPVRYGGQVVAVLTRHQTA

SEQ ID NO: 733357 - protein, 24 aa, Mycobacterium
SPVSSPMAPSRLQFGDVGQYTDHR

SEQ ID NO: 733358 - protein, 25 aa, Mycobacterium
SPVSSRYKAPFAFTGGTIAQVTIDL

SEQ ID NO: 733359 - protein, 20 aa, Mycobacterium
SPVTFNTGFFNWGDRNTGLW

SEQ ID NO: 733360 - protein, 18 aa, Mycobacterium
SPVVFLRLRKGVRKRGLK

SEQ ID NO: 733361 - protein, 17 aa, Mycobacterium
SPWIGNIDLSFPYLDTA

SEQ ID NO: 733362 - protein, 23 aa, Mycobacterium
SPWIGNIDLSFPYLDTEATRIIG

SEQ ID NO: 733363 - protein, 31 aa, Mycobacterium
SPWPEDYELMGVPFAKRGKRMDECIDIIRGL

SEQ ID NO: 733364 - protein, 20 aa, Mycobacterium
SPYELAQHVNFARKAGLTDH

SEQ ID NO: 733365 - protein, 24 aa, Mycobacterium
SPYPNQKWPIAYNVDDITKVYFRD

SEQ ID NO: 733366 - protein, 18 aa, Mycobacterium
SPYSFLPQLCAGDIIAGQ

SEQ ID NO: 733367 - protein, 18 aa, Mycobacterium
SPYTPAWQEPITGVSAGQ

SEQ ID NO: 733368 - protein, 24 aa, Mycobacterium
SPYVTPLVRKLAGEHGVDLASVKG

SEQ ID NO: 733369 - protein, 24 aa, Mycobacterium
SQAAQELTFRWGAMGHDGYQQDPA

SEQ ID NO: 733370 - protein, 23 aa, Mycobacterium
SQAFGAKARFDGDLSLGALVLLI

SEQ ID NO: 733371 - protein, 28 aa, Mycobacterium
SQAGCGMACPFCATGQGGLKRNLSTAEI

SEQ ID NO: 733372 - protein, 27 aa, Mycobacterium
SQAGCGMACPFCATGQGGLSRNLSTAE

SEQ ID NO: 733373 - protein, 19 aa, Mycobacterium
SQAGGLFGQVGSTFGQFTS

SEQ ID NO: 733374 - protein, 25 aa, Mycobacterium
SQAHARGAGFSGVVWRCATPGRKES

SEQ ID NO: 733375 - protein, 19 aa, Mycobacterium
SQALARGGQPVSMDNIQPG

SEQ ID NO: 733376 - protein, 20 aa, Mycobacterium
SQALGNIAVGGFDLPQITTP

SEQ ID NO: 733377 - protein, 20 aa, Mycobacterium
SQALIAQGLDRVMFTGGTEI

SEQ ID NO: 733378 - protein, 17 aa, Mycobacterium
SQALKDLLVLLAAGPAA

SEQ ID NO: 733379 - protein, 18 aa, Mycobacterium
SQALRDFLLIYIDDQESL

SEQ ID NO: 733380 - protein, 26 aa, Mycobacterium
SQALTARPLFGDGADGAPGTGQNGGD

SEQ ID NO: 733381 - protein, 21 aa, Mycobacterium
SQALVLRFFFAPRPSIRSRRR

SEQ ID NO: 733382 - protein, 21 aa, Mycobacterium
SQAPFGYPEVHYLTSPLRKAS

SEQ ID NO: 733383 - protein, 21 aa, Mycobacterium
SQARAERAFSEVMDLAIAMGG

SEQ ID NO: 733384 - protein, 27 aa, Mycobacterium
SQARIAFDLATRIPLRARLYRVNDEDN

SEQ ID NO: 733385 - protein, 21 aa, Mycobacterium
SQARQGIGFGKGQVAEARVGA

SEQ ID NO: 733386 - protein, 18 aa, Mycobacterium
SQARWKDDPDDWLITDTR

SEQ ID NO: 733387 - protein, 18 aa, Mycobacterium
SQASGLDLARLGTTAPTE

SEQ ID NO: 733388 - protein, 23 aa, Mycobacterium
SQCAKRFAGGQMFFDLPPTIVKR

SEQ ID NO: 733389 - protein, 27 aa, Mycobacterium
SQCGWCKDRFGLSWQIVPARLYELLTD

SEQ ID NO: 733390 - protein, 19 aa, Mycobacterium
SQCHSYAFDVSVREILGAL

SEQ ID NO: 733391 - protein, 19 aa, Mycobacterium
SQCHSYAFDYSVWEIFGAL

SEQ ID NO: 733392 - protein, 20 aa, Mycobacterium
SQCHSYAFDYSVWEIFGALL

SEQ ID NO: 733393 - protein, 24 aa, Mycobacterium
SQDDFRQVLPVGGWEITYMGPTTY

SEQ ID NO: 733394 - protein, 20 aa, Mycobacterium
SQDLALRLAEHGLHGERLAT

SEQ ID NO: 733395 - protein, 17 aa, Mycobacterium
SQDSFGLADKAWVLDEL

SEQ ID NO: 733396 - protein, 33 aa, Mycobacterium
SQDWWPADFGHYGPLFIRMAWHAAGTYRVSDGR

SEQ ID NO: 733397 - protein, 17 aa, Mycobacterium
SQEAGFAGTQWQLGLLV

SEQ ID NO: 733398 - protein, 19 aa, Mycobacterium
SQEGMPLAGLVLNRTHPTL

SEQ ID NO: 733399 - protein, 17 aa, Mycobacterium
SQEIDWLYGGLRLLFPV

SEQ ID NO: 733400 - protein, 17 aa, Mycobacterium
SQFGTNHLGHFALVAHL

SEQ ID NO: 733401 - protein, 19 aa, Mycobacterium
SQFRGSELIAEKWNLSREE

SEQ ID NO: 733402 - protein, 21 aa, Mycobacterium
SQFTHCIDIAPTVLQAIGLPE

SEQ ID NO: 733403 - protein, 19 aa, Mycobacterium
SQFTSIRYGERLAEIGAVP

SEQ ID NO: 733404 - protein, 19 aa, Mycobacterium
SQFVPHCRITGSDDIAVTD

SEQ ID NO: 733405 - protein, 24 aa, Mycobacterium
SQGGFDLAAYWARGGIGDAYSAGD

SEQ ID NO: 733406 - protein, 22 aa, Mycobacterium
SQGIGFIPWFPLAAGPLAAADG

SEQ ID NO: 733407 - protein, 18 aa, Mycobacterium
SQGMPLAYTRELAGYWAD

SEQ ID NO: 733408 - protein, 17 aa, Mycobacterium
SQGNPLYLRHLVDAALG

SEQ ID NO: 733409 - protein, 26 aa, Mycobacterium
SQGPQGPRIDFCAPIGHGGDGGDQES

SEQ ID NO: 733410 - protein, 19 aa, Mycobacterium
SQGRCCSLVVTPPHMTVSY

SEQ ID NO: 733411 - protein, 21 aa, Mycobacterium
SQGRCQPTYAVRVDDDTVYVD

SEQ ID NO: 733412 - protein, 27 aa, Mycobacterium
SQGRDERLCWWAGPWPVDERWWDDRPV

SEQ ID NO: 733413 - protein, 23 aa, Mycobacterium
SQGRFTLGLGAGWQENEHQRYGL

SEQ ID NO: 733414 - protein, 26 aa, Mycobacterium
SQGVLFPKHRTDLIGCAVSVQRMLAG

SEQ ID NO: 733415 - protein, 26 aa, Mycobacterium
SQGVLFPKHRTDLIGCAVTVQRMQTG

SEQ ID NO: 733416 - protein, 23 aa, Mycobacterium
SQGYSRIRVDGVVHSLTDPPKLK

SEQ ID NO: 733417 - protein, 23 aa, Mycobacterium
SQGYSRVRVDGVVYPLTDPPKLK

SEQ ID NO: 733418 - protein, 23 aa, Mycobacterium
SQHCKACRSAGLSEEKIAAIPSW

SEQ ID NO: 733419 - protein, 24 aa, Mycobacterium
SQHLAKLRMARLVRTRRDGTTIFY

SEQ ID NO: 733420 - protein, 24 aa, Mycobacterium
SQHLAKLRMARLVRTRRDGTTVYY

SEQ ID NO: 733421 - protein, 21 aa, Mycobacterium
SQHPDLFWALRGGGGNFGVAT

SEQ ID NO: 733422 - protein, 18 aa, Mycobacterium
SQHPGWPAPVGPLRVSAG

SEQ ID NO: 733423 - protein, 23 aa, Mycobacterium
SQHQFRGSAPILTGSTVTDQAGQ

SEQ ID NO: 733424 - protein, 19 aa, Mycobacterium
SQHRLRWDHVVVLPNTELP

SEQ ID NO: 733425 - protein, 27 aa, Mycobacterium
SQIAERFFAYFAACDWDSLATTLADNV

SEQ ID NO: 733426 - protein, 20 aa, Mycobacterium
SQIETLAFMAMWERAHAVFC

SEQ ID NO: 733427 - protein, 18 aa, Mycobacterium
SQIFTQWSPEGWVTIGGR

SEQ ID NO: 733428 - protein, 26 aa, Mycobacterium
SQILPRPKDFAALMSLVPPETVAESV

SEQ ID NO: 733429 - protein, 21 aa, Mycobacterium
SQILTGLGLRRSFVDVTDEAM

SEQ ID NO: 733430 - protein, 18 aa, Mycobacterium
SQINGCAFCLRMHVRDAL

SEQ ID NO: 733431 - protein, 27 aa, Mycobacterium
SQKFWPRRIAEGLNRMLGGDHVFTDDV

SEQ ID NO: 733432 - protein, 25 aa, Mycobacterium
SQKYLPRWLSEGLNRLLGGEHVFTD

SEQ ID NO: 733433 - protein, 19 aa, Mycobacterium
SQLAIAWTLAQPGVHTAIM

SEQ ID NO: 733434 - protein, 21 aa, Mycobacterium
SQLDLLVAIDFVQRESHRHAH

SEQ ID NO: 733435 - protein, 24 aa, Mycobacterium
SQLDSARCGPILGVDGDDPASDWA

SEQ ID NO: 733436 - protein, 18 aa, Mycobacterium
SQLFLGSGTMPWRRTVAS

SEQ ID NO: 733437 - protein, 31 aa, Mycobacterium
SQLGFKLVYKKDCGRFGRLRNFRNQAFIFTR

SEQ ID NO: 733438 - protein, 18 aa, Mycobacterium
SQLGIRLSAVAAQLQRHV

SEQ ID NO: 733439 - protein, 19 aa, Mycobacterium
SQLHAPFWGSRRLANGGDL

SEQ ID NO: 733440 - protein, 29 aa, Mycobacterium
SQLIGFALLRYVWKIEPIASMPDDEAVAA

SEQ ID NO: 733441 - protein, 17 aa, Mycobacterium
SQLIGGMTMGLSMALHE

SEQ ID NO: 733442 - protein, 17 aa, Mycobacterium
SQLKPVFRPNGTITAGN

SEQ ID NO: 733443 - protein, 18 aa, Mycobacterium
SQLLFWKRDGRPLLETAL

SEQ ID NO: 733444 - protein, 23 aa, Mycobacterium
SQLLGVVMARHIVKIEPFASLPA

SEQ ID NO: 733445 - protein, 31 aa, Mycobacterium
SQLLYLRVPALNALFPDYRGSVLDAVTSAFH

SEQ ID NO: 733446 - protein, 20 aa, Mycobacterium
SQLNHCAFCLDMHTHDARKQ

SEQ ID NO: 733447 - protein, 22 aa, Mycobacterium
SQLPKVFFVNWFRRGDDGRFLW

SEQ ID NO: 733448 - protein, 17 aa, Mycobacterium
SQLPPLLDVKLEEIIDF

SEQ ID NO: 733449 - protein, 17 aa, Mycobacterium
SQLPPRGPLSIVDAVPP

SEQ ID NO: 733450 - protein, 17 aa, Mycobacterium
SQLRCYRVVLADKARYE

SEQ ID NO: 733451 - protein, 17 aa, Mycobacterium
SQLRCYRVVLSDSARYE

SEQ ID NO: 733452 - protein, 27 aa, Mycobacterium
SQLRIARLDVWQGYYCFAAELISPTSS

SEQ ID NO: 733453 - protein, 17 aa, Mycobacterium
SQLRLGSGGVMLPNHAP

SEQ ID NO: 733454 - protein, 19 aa, Mycobacterium
SQLRWPGHDDPDVAVIGDR

SEQ ID NO: 733455 - protein, 18 aa, Mycobacterium
SQLRWRTTISNHRPKALR

SEQ ID NO: 733456 - protein, 20 aa, Mycobacterium
SQLVAIGFTRLAHRGSPVAC

SEQ ID NO: 733457 - protein, 17 aa, Mycobacterium
SQLWFEALAGICAHVKA

SEQ ID NO: 733458 - protein, 24 aa, Mycobacterium
SQLWFEALAGICAHVRAGGGGLTP

SEQ ID NO: 733459 - protein, 24 aa, Mycobacterium
SQLWFEALAGICAHVRSGGGGLTP

SEQ ID NO: 733460 - protein, 19 aa, Mycobacterium
SQMAAALLSRMAGGRIDVR

SEQ ID NO: 733461 - protein, 25 aa, Mycobacterium
SQMLTGRPLIGNGANGVDGTGAAGG

SEQ ID NO: 733462 - protein, 25 aa, Mycobacterium
SQMTWRSMIRDGMAMRHGKEMTWSQ

SEQ ID NO: 733463 - protein, 18 aa, Mycobacterium
SQPAFGLLPRPGHGTQVS

SEQ ID NO: 733464 - protein, 19 aa, Mycobacterium
SQPFWPAYLSAERIAKAPK

SEQ ID NO: 733465 - protein, 31 aa, Mycobacterium
SQPLPVMGLRISRPFADLFAYFGAKVHPDVR

SEQ ID NO: 733466 - protein, 21 aa, Mycobacterium
SQPQFPMTAWMFAAAAEEYMR

SEQ ID NO: 733467 - protein, 23 aa, Mycobacterium
SQPRARRGIGTTAAITGHAPAPA

SEQ ID NO: 733468 - protein, 17 aa, Mycobacterium
SQPRLAGSMAAEARQLA

SEQ ID NO: 733469 - protein, 24 aa, Mycobacterium
SQPRLPDIPGITGFEGKIVHTTAW

SEQ ID NO: 733470 - protein, 18 aa, Mycobacterium
SQPRPKSTALVVWQPRHQ

SEQ ID NO: 733471 - protein, 17 aa, Mycobacterium
SQPVLYKHFSGMEDIAA

SEQ ID NO: 733472 - protein, 28 aa, Mycobacterium
SQQAARRVRAGGAIINFSTSVTKIAAPT

SEQ ID NO: 733473 - protein, 19 aa, Mycobacterium
SQRALRWVTDIILEIIMVV

SEQ ID NO: 733474 - protein, 21 aa, Mycobacterium
SQRCVVEFRPSCPIAGSVAVR

SEQ ID NO: 733475 - protein, 20 aa, Mycobacterium
SQRDCIRTLSALALIDTDVL

SEQ ID NO: 733476 - protein, 18 aa, Mycobacterium
SQRFPKYMRKTLMTMAQR

SEQ ID NO: 733477 - protein, 29 aa, Mycobacterium
SQRGIPLPFAFVFDELWLAFQGLSTFLST

SEQ ID NO: 733478 - protein, 18 aa, Mycobacterium
SQRGRVFLATGITEGPHD

SEQ ID NO: 733479 - protein, 21 aa, Mycobacterium
SQRGVYCGAWRAFTGGKQKSY

SEQ ID NO: 733480 - protein, 21 aa, Mycobacterium
SQRGVYCGAWRAFTGQLQQQS

SEQ ID NO: 733481 - protein, 21 aa, Mycobacterium
SQRGVYCGAWSAYVPGEDKTY

SEQ ID NO: 733482 - protein, 20 aa, Mycobacterium
SQRGWPVFKVSTLTRDGLRP

SEQ ID NO: 733483 - protein, 25 aa, Mycobacterium
SQRKTEVQARLWGGKSGVAFDPNYH

SEQ ID NO: 733484 - protein, 24 aa, Mycobacterium
SQRKTEVQGRLWGGEAGVPFDPNY

SEQ ID NO: 733485 - protein, 18 aa, Mycobacterium
SQRLAWMRELFPFDRVIR

SEQ ID NO: 733486 - protein, 19 aa, Mycobacterium
SQRLYSWAESASFATPFVT

SEQ ID NO: 733487 - protein, 23 aa, Mycobacterium
SQRPVSVCTVLRTVQQVAHRSVR

SEQ ID NO: 733488 - protein, 19 aa, Mycobacterium
SQRRSDWPERDAALVLTAV

SEQ ID NO: 733489 - protein, 24 aa, Mycobacterium
SQRSAAKTVPNWLWNSTAAAKKAF

SEQ ID NO: 733490 - protein, 28 aa, Mycobacterium
SQRVGLPGIWYAGSHGFELTAPDGTHHQ

SEQ ID NO: 733491 - protein, 20 aa, Mycobacterium
SQRWLCPYGGAAVAGAELPA

SEQ ID NO: 733492 - protein, 27 aa, Mycobacterium
SQRYELPGSHPLIGRSAPDFELPDGTR

SEQ ID NO: 733493 - protein, 17 aa, Mycobacterium
SQRYLKTSIVITTNRGV

SEQ ID NO: 733494 - protein, 19 aa, Mycobacterium
SQSAMFLTTYINAVDPLAE

SEQ ID NO: 733495 - protein, 19 aa, Mycobacterium
SQSAMFLTTYINAVDPLAR

SEQ ID NO: 733496 - protein, 19 aa, Mycobacterium
SQSAMFLTTYVNAVDPLAE

SEQ ID NO: 733497 - protein, 18 aa, Mycobacterium
SQSAMIASLVMRALNPTN

SEQ ID NO: 733498 - protein, 26 aa, Mycobacterium
SQSLRPVLFSTFLMWVLADLFTYLPE

SEQ ID NO: 733499 - protein, 24 aa, Mycobacterium
SQSNAIRQDIDWMDFAAAPDPEGP

SEQ ID NO: 733500 - protein, 27 aa, Mycobacterium
SQSPKESWLRLLIIGAGLPRPTTQIPV

SEQ ID NO: 733501 - protein, 23 aa, Mycobacterium
SQSRAARHFRIFQRLHAERHELP

SEQ ID NO: 733502 - protein, 25 aa, Mycobacterium
SQSSWRCVQAHDRAGWLALMSDDVV

SEQ ID NO: 733503 - protein, 17 aa, Mycobacterium
SQTLEWIAETQGRMRTV

SEQ ID NO: 733504 - protein, 22 aa, Mycobacterium
SQTLRAQWTLFSAHNQGRTADD

SEQ ID NO: 733505 - protein, 24 aa, Mycobacterium
SQTRLATWVAIPGHTATPTGSVSK

SEQ ID NO: 733506 - protein, 22 aa, Mycobacterium
SQTRVGGDYTNVSGHGSADIDK

SEQ ID NO: 733507 - protein, 25 aa, Mycobacterium
SQTTTRLKFLVAFRPGFISPTLAAH

SEQ ID NO: 733508 - protein, 19 aa, Mycobacterium
SQVAALIGRLDRRGRMLWS

SEQ ID NO: 733509 - protein, 17 aa, Mycobacterium
SQVALRLTVASDCTDAP

SEQ ID NO: 733510 - protein, 17 aa, Mycobacterium
SQVAPLFHTRYEPLWAL

SEQ ID NO: 733511 - protein, 19 aa, Mycobacterium
SQVEWGCVTNERMMQIDGA

SEQ ID NO: 733512 - protein, 24 aa, Mycobacterium
SQVFDGDLLFLEWAADSAHHRVDD

SEQ ID NO: 733513 - protein, 20 aa, Mycobacterium
SQVIKRAHWRNEMPTAAALL

SEQ ID NO: 733514 - protein, 17 aa, Mycobacterium
SQVLKSIALRAIQVHGA

SEQ ID NO: 733515 - protein, 29 aa, Mycobacterium
SQVLPAKLPRWLSLPAQLVMQALIGHVRV

SEQ ID NO: 733516 - protein, 31 aa, Mycobacterium
SQVLWTQNMLLPWAWRHLRGRSSGDGRTPRR

SEQ ID NO: 733517 - protein, 19 aa, Mycobacterium
SQVPLLLDEYSRNAATGSF

SEQ ID NO: 733518 - protein, 18 aa, Mycobacterium
SQVRAAWHVSDLPTAPGR

SEQ ID NO: 733519 - protein, 22 aa, Mycobacterium
SQVRRTTLPGGLRVVTEYLPYV

SEQ ID NO: 733520 - protein, 19 aa, Mycobacterium
SQWHSLVFDVSVWEIWGAL

SEQ ID NO: 733521 - protein, 19 aa, Mycobacterium
SQWVPTMFVRMLKLPKEIR

SEQ ID NO: 733522 - protein, 23 aa, Mycobacterium
SQYKDVILGLLFLKYLSDADTEQ

SEQ ID NO: 733523 - protein, 27 aa, Mycobacterium
SQYNSDCGFFIRYCLDVGLDKYGQGVG

SEQ ID NO: 733524 - protein, 17 aa, Mycobacterium
SQYPILCAFGAGEPFGA

SEQ ID NO: 733525 - protein, 26 aa, Mycobacterium
SRAAELAKLPLFERLAQRIVDGERNG

SEQ ID NO: 733526 - protein, 18 aa, Mycobacterium
SRAAGVPARVAFQTLDSP

SEQ ID NO: 733527 - protein, 20 aa, Mycobacterium
SRAAIWAVLVRDFFQAWVRR

SEQ ID NO: 733528 - protein, 24 aa, Mycobacterium
SRAAKARFAVYIGDLGADTAAGAR

SEQ ID NO: 733529 - protein, 24 aa, Mycobacterium
SRAAKARFAVYIGPLGADTAATAR

SEQ ID NO: 733530 - protein, 20 aa, Mycobacterium
SRAATEIAVALRASADRYRD

SEQ ID NO: 733531 - protein, 19 aa, Mycobacterium
SRACYVCKTHHTVVDAFYH

SEQ ID NO: 733532 - protein, 20 aa, Mycobacterium
SRADALAWSVKLVGEHAEEW

SEQ ID NO: 733533 - protein, 20 aa, Mycobacterium
SRADCILGRLVTGEVPALGT

SEQ ID NO: 733534 - protein, 25 aa, Mycobacterium
SRADFRAVDNLSGWFTTITAREALD

SEQ ID NO: 733535 - protein, 18 aa, Mycobacterium
SRADFVFAAQLEKWAQDP

SEQ ID NO: 733536 - protein, 24 aa, Mycobacterium
SRADRTLDCRWWRRDVGGKMVRFV

SEQ ID NO: 733537 - protein, 25 aa, Mycobacterium
SRAEFNLSAEFFLWYTEQIAHLHGT

SEQ ID NO: 733538 - protein, 20 aa, Mycobacterium
SRAEPGSWLLLSACEATDPL

SEQ ID NO: 733539 - protein, 21 aa, Mycobacterium
SRAEQGLPFVREAALARKLAT

SEQ ID NO: 733540 - protein, 17 aa, Mycobacterium
SRAEWAAAYQAYLRAEA

SEQ ID NO: 733541 - protein, 18 aa, Mycobacterium
SRAFEWMECEKILLFSSD

SEQ ID NO: 733542 - protein, 19 aa, Mycobacterium
SRAFTPKKMRAIEDKVRAF

SEQ ID NO: 733543 - protein, 18 aa, Mycobacterium
SRAGDWFGSPVNVASRVT

SEQ ID NO: 733544 - protein, 20 aa, Mycobacterium
SRAGGLIFTDLALTREILRD

SEQ ID NO: 733545 - protein, 21 aa, Mycobacterium
SRAGIVSTLILPADVSWSDGE

SEQ ID NO: 733546 - protein, 26 aa, Mycobacterium
SRAGVLRFVVLDGLAKPGRLAGPDPS

SEQ ID NO: 733547 - protein, 26 aa, Mycobacterium
SRAGVLRFVVLDGLAKPGRLVGPDPS

SEQ ID NO: 733548 - protein, 18 aa, Mycobacterium
SRAGWLRWSDKLGAAPLR

SEQ ID NO: 733549 - protein, 18 aa, Mycobacterium
SRAGWVRVVDAVYAGDWE

SEQ ID NO: 733550 - protein, 20 aa, Mycobacterium
SRAHGRGGLHHPRRPQEGHD

SEQ ID NO: 733551 - protein, 19 aa, Mycobacterium
SRAIALLIGPLVLGRLSTL

SEQ ID NO: 733552 - protein, 33 aa, Mycobacterium
SRAIEEVFIRAGIPYKVVGGVRFYERREIRDIV

SEQ ID NO: 733553 - protein, 33 aa, Mycobacterium
SRALEEVFIRAGIPYKVVGGVRFYERREIRDIV

SEQ ID NO: 733554 - protein, 41 aa, Mycobacterium
SRALIYREWVETGAYPRLRDFLVRYATSFGHFQIVGTAETA

SEQ ID NO: 733555 - protein, 17 aa, Mycobacterium
SRALKKMGWLCSDTAEL

SEQ ID NO: 733556 - protein, 19 aa, Mycobacterium
SRALRDVCRQLPEELPSGL

SEQ ID NO: 733557 - protein, 23 aa, Mycobacterium
SRALRTGYVAAFSVPANELPQVV

SEQ ID NO: 733558 - protein, 32 aa, Mycobacterium
SRALRVSNALDFGCVWINTHIPLVAEMPHGGF

SEQ ID NO: 733559 - protein, 21 aa, Mycobacterium
SRALVSPSFRSALLERWRGEL

SEQ ID NO: 733560 - protein, 22 aa, Mycobacterium
SRAMALMLQDWLPAFDGGPSGA

SEQ ID NO: 733561 - protein, 22 aa, Mycobacterium
SRANARGLVVVRMGSETKASEG

SEQ ID NO: 733562 - protein, 23 aa, Mycobacterium
SRANARGLVVVRMGSETKASEGV

SEQ ID NO: 733563 - protein, 43 aa, Mycobacterium
SRANPRPAFFGRSGLRRNFRWDPLDSVYFAGYAMWNYLTTPYL

SEQ ID NO: 733564 - protein, 20 aa, Mycobacterium
SRANPSWAISDGVHLDAFEP

SEQ ID NO: 733565 - protein, 20 aa, Mycobacterium
SRAPELAARMGTTRSAAAVD

SEQ ID NO: 733566 - protein, 24 aa, Mycobacterium
SRAPGCPFAPPPKVLELNADKQLS

SEQ ID NO: 733567 - protein, 26 aa, Mycobacterium
SRAPHVGEAEFLPLLRRLGRFLPTDV

SEQ ID NO: 733568 - protein, 23 aa, Mycobacterium
SRAPRHGWFGLVRPDGEVDREDD

SEQ ID NO: 733569 - protein, 18 aa, Mycobacterium
SRAPRWAIAYKYPPEEAT

SEQ ID NO: 733570 - protein, 18 aa, Mycobacterium
SRAPRWAVAYKYPPEEAQ

SEQ ID NO: 733571 - protein, 18 aa, Mycobacterium
SRAPRWAVAYKYPPEEAT

SEQ ID NO: 733572 - protein, 29 aa, Mycobacterium
SRAPWRLKQNYFFDLRMIRYDKVDEESLH

SEQ ID NO: 733573 - protein, 26 aa, Mycobacterium
SRAPWRLKQNYLFDMRTIRRGKVADE

SEQ ID NO: 733574 - protein, 23 aa, Mycobacterium
SRAPWRLKQNYLLDLQLIRRGRV

SEQ ID NO: 733575 - protein, 20 aa, Mycobacterium
SRAQLALIRPGAEVTALREI

SEQ ID NO: 733576 - protein, 18 aa, Mycobacterium
SRAQQRWEHVMMNNYGTP

SEQ ID NO: 733577 - protein, 25 aa, Mycobacterium
SRAQSRFAWERIALDALNVYQSLGA

SEQ ID NO: 733578 - protein, 17 aa, Mycobacterium
SRAREIASWLPLVNLSS

SEQ ID NO: 733579 - protein, 20 aa, Mycobacterium
SRAREVGALTVLDACQSVPH

SEQ ID NO: 733580 - protein, 24 aa, Mycobacterium
SRAREVLLDRVIDVAVERRGAAST

SEQ ID NO: 733581 - protein, 20 aa, Mycobacterium
SRARFAARGIRVINTPVTEV

SEQ ID NO: 733582 - protein, 22 aa, Mycobacterium
SRARRAGLFDSLEKALRRGFYD

SEQ ID NO: 733583 - protein, 25 aa, Mycobacterium
SRARREGRRIYGRIAAIRTNHNGKG

SEQ ID NO: 733584 - protein, 21 aa, Mycobacterium
SRARSRYSWDRIATDAEVAYL

SEQ ID NO: 733585 - protein, 19 aa, Mycobacterium
SRASALLAQALDPFSTITG

SEQ ID NO: 733586 - protein, 24 aa, Mycobacterium
SRASHIRPAWEARQGERIPFRYAW

SEQ ID NO: 733587 - protein, 20 aa, Mycobacterium
SRASILAGIDTAVAQGATVL

SEQ ID NO: 733588 - protein, 25 aa, Mycobacterium
SRASKARFAIYLGDLGSDTAARARE

SEQ ID NO: 733589 - protein, 19 aa, Mycobacterium
SRASMDLVETLKIALTLPF

SEQ ID NO: 733590 - protein, 24 aa, Mycobacterium
SRASRARFAVYLGDLGDDTATRAR

SEQ ID NO: 733591 - protein, 20 aa, Mycobacterium
SRASSLPIRVAEPGASADKP

SEQ ID NO: 733592 - protein, 19 aa, Mycobacterium
SRASWRCVQAGDREGWLAL

SEQ ID NO: 733593 - protein, 19 aa, Mycobacterium
SRATLGRPIELAFDTTRLT

SEQ ID NO: 733594 - protein, 18 aa, Mycobacterium
SRAWAAMYLGTPRTPEGG

SEQ ID NO: 733595 - protein, 20 aa, Mycobacterium
SRAYKMWLPPLVDPTPLDEL

SEQ ID NO: 733596 - protein, 25 aa, Mycobacterium
SRCAGRAPGWAGLAVQYVDYTLWQR

SEQ ID NO: 733597 - protein, 19 aa, Mycobacterium
SRCARARAKLARTLQYFDG

SEQ ID NO: 733598 - protein, 26 aa, Mycobacterium
SRCARARARLAVALHYLDKAGSVEPE

SEQ ID NO: 733599 - protein, 19 aa, Mycobacterium
SRCNDGFAATHAHSVARRA

SEQ ID NO: 733600 - protein, 17 aa, Mycobacterium
SRCREIASAFGGGKNVH

SEQ ID NO: 733601 - protein, 21 aa, Mycobacterium
SRCSWAGAQASRLAADAKVAY

SEQ ID NO: 733602 - protein, 17 aa, Mycobacterium
SRCSWASTQAARLAADA

SEQ ID NO: 733603 - protein, 24 aa, Mycobacterium
SRCTSLAGLVLKRPVLPKDLKTDR

SEQ ID NO: 733604 - protein, 30 aa, Mycobacterium
SRDAAIRVSNRLRPWLHLLLALTANSAIYR

SEQ ID NO: 733605 - protein, 26 aa, Mycobacterium
SRDALASALERPDCPDVSDVAHTLTR

SEQ ID NO: 733606 - protein, 24 aa, Mycobacterium
SRDARWLVQIERLRDGQACGERVT

SEQ ID NO: 733607 - protein, 22 aa, Mycobacterium
SRDEAKEAIIARGGKAAGSVSK

SEQ ID NO: 733608 - protein, 26 aa, Mycobacterium
SRDELMARLWLRSIARYQDGVLTALA

SEQ ID NO: 733609 - protein, 20 aa, Mycobacterium
SRDETIAAIAARAADLEVVG

SEQ ID NO: 733610 - protein, 23 aa, Mycobacterium
SRDFAAEAAFVFAQIGVDLSRLA

SEQ ID NO: 733611 - protein, 26 aa, Mycobacterium
SRDFAAEAGFVFAMIGIDLSRLSEDI

SEQ ID NO: 733612 - protein, 21 aa, Mycobacterium
SRDGIRLEIARKYAALNGLNQ

SEQ ID NO: 733613 - protein, 20 aa, Mycobacterium
SRDGKPVWIRPRRGVRGGAP

SEQ ID NO: 733614 - protein, 24 aa, Mycobacterium
SRDGLRPLIFALWEMVKKYRDAQP

SEQ ID NO: 733615 - protein, 22 aa, Mycobacterium
SRDIPMRLVYVVDPRDAATPSA

SEQ ID NO: 733616 - protein, 21 aa, Mycobacterium
SRDIPRFVSLWQSGRLPVESL

SEQ ID NO: 733617 - protein, 17 aa, Mycobacterium
SRDLAVIRLQLDRPMDY

SEQ ID NO: 733618 - protein, 17 aa, Mycobacterium
SRDLAVVRLRLDQPLDY

SEQ ID NO: 733619 - protein, 18 aa, Mycobacterium
SRDLDFRYHCITQLHEAL

SEQ ID NO: 733620 - protein, 18 aa, Mycobacterium
SRDLDFRYHCLTQLHEAL

SEQ ID NO: 733621 - protein, 24 aa, Mycobacterium
SRDPSRLADFGWYHDVSTVTLDAH

SEQ ID NO: 733622 - protein, 23 aa, Mycobacterium
SRDPWRLGFPMAEMSADGTAVIS

SEQ ID NO: 733623 - protein, 22 aa, Mycobacterium
SRDRLKAGLSRYAEHRAAGAIR

SEQ ID NO: 733624 - protein, 22 aa, Mycobacterium
SRDRLKAGLSRYAEHRAAGPVR

SEQ ID NO: 733625 - protein, 18 aa, Mycobacterium
SRDSGAFILIDEASNDTV

SEQ ID NO: 733626 - protein, 20 aa, Mycobacterium
SRDSWTFADTELRLEQIMRR

SEQ ID NO: 733627 - protein, 20 aa, Mycobacterium
SRDVALRVHCIRQLRDGMKT

SEQ ID NO: 733628 - protein, 23 aa, Mycobacterium
SREAMNLLISWTMSSATQPTESS

SEQ ID NO: 733629 - protein, 18 aa, Mycobacterium
SREAVRLAERVYGQLVRR

SEQ ID NO: 733630 - protein, 19 aa, Mycobacterium
SREAYRWMRANQPVFRDRN

SEQ ID NO: 733631 - protein, 17 aa, Mycobacterium
SRECPPDAVGEIWVHGE

SEQ ID NO: 733632 - protein, 19 aa, Mycobacterium
SREDALLCGDFYDVVQTPD

SEQ ID NO: 733633 - protein, 27 aa, Mycobacterium
SREDLIRLGLQVGDFVAFIASPELTAD

SEQ ID NO: 733634 - protein, 21 aa, Mycobacterium
SREFACVDVDNFFTWLHTARP

SEQ ID NO: 733635 - protein, 18 aa, Mycobacterium
SREFGWTPLPSHDDGTLA

SEQ ID NO: 733636 - protein, 25 aa, Mycobacterium
SREFHVCVVDAPTLHNVAEALRNQF

SEQ ID NO: 733637 - protein, 30 aa, Mycobacterium
SREGAWSPVALRLAEWLQKAEASLAVVDQL

SEQ ID NO: 733638 - protein, 21 aa, Mycobacterium
SREHPCRVIVVVPGDRDAAAP

SEQ ID NO: 733639 - protein, 17 aa, Mycobacterium
SRELGEFIEAAVTQLFD

SEQ ID NO: 733640 - protein, 26 aa, Mycobacterium
SRELQALLARPGWDAGDKSALRARLH

SEQ ID NO: 733641 - protein, 28 aa, Mycobacterium
SRELTWIGSFRFVDEITDAVAALNDGLD

SEQ ID NO: 733642 - protein, 25 aa, Mycobacterium
SREMLRLVETFGYGWSDLQRFTINA

SEQ ID NO: 733643 - protein, 26 aa, Mycobacterium
SREPLGVPGEFGWRVPSLSLADESIE

SEQ ID NO: 733644 - protein, 23 aa, Mycobacterium
SREPRPYPELVLGERDSIFDYTY

SEQ ID NO: 733645 - protein, 19 aa, Mycobacterium
SREREVLALLASGATNAQL

SEQ ID NO: 733646 - protein, 17 aa, Mycobacterium
SRESPQWEEVASRCLTC

SEQ ID NO: 733647 - protein, 18 aa, Mycobacterium
SRESPQWEEVASRCLTCG

SEQ ID NO: 733648 - protein, 26 aa, Mycobacterium
SREVGYACSVVERFGDSLVVTAFEGE

SEQ ID NO: 733649 - protein, 21 aa, Mycobacterium
SREVLEGCILAGSRQIESTTN

SEQ ID NO: 733650 - protein, 23 aa, Mycobacterium
SREVMPSRLRLLYLADKQVLDYS

SEQ ID NO: 733651 - protein, 22 aa, Mycobacterium
SREVSLSVLQVWQAFTEAVSRR

SEQ ID NO: 733652 - protein, 22 aa, Mycobacterium
SREYPWYGSFIIESLPELGVED

SEQ ID NO: 733653 - protein, 27 aa, Mycobacterium
SRFDPSIPLHRQWRTMLFSGAGPILNS

SEQ ID NO: 733654 - protein, 21 aa, Mycobacterium
SRFENLEGYPFVAHYLDVTAS

SEQ ID NO: 733655 - protein, 21 aa, Mycobacterium
SRFENLEGYPFVANYLDVAAS

SEQ ID NO: 733656 - protein, 17 aa, Mycobacterium
SRFFDEFFLEAAASGIT

SEQ ID NO: 733657 - protein, 26 aa, Mycobacterium
SRFKEWLTIHRVWRSTLPETLEKGAV

SEQ ID NO: 733658 - protein, 18 aa, Mycobacterium
SRFKRTVFGWSMRVGLRV

SEQ ID NO: 733659 - protein, 17 aa, Mycobacterium
SRFLPDKAIDLVDEAAS

SEQ ID NO: 733660 - protein, 21 aa, Mycobacterium
SRFLVVMSSYYGRARVEDDAF

SEQ ID NO: 733661 - protein, 26 aa, Mycobacterium
SRFMACPFGAPGTRMYRTGDLVCWGT

SEQ ID NO: 733662 - protein, 20 aa, Mycobacterium
SRFMSMCEARQLPAVRIGVV

SEQ ID NO: 733663 - protein, 21 aa, Mycobacterium
SRFNSLYNYNGFMIGDAPGAG

SEQ ID NO: 733664 - protein, 21 aa, Mycobacterium
SRFNVPAQFLAPIPDGIGAVE

SEQ ID NO: 733665 - protein, 21 aa, Mycobacterium
SRFNVPAQFLAPIPDGISGVE

SEQ ID NO: 733666 - protein, 21 aa, Mycobacterium
SRFNVPAQFLAPIPDGVSAVE

SEQ ID NO: 733667 - protein, 22 aa, Mycobacterium
SRFNVPGQFLAPIPDGVSAVEA

SEQ ID NO: 733668 - protein, 26 aa, Mycobacterium
SRFNYEAVVAFSERLAGLLPDPLDTV

SEQ ID NO: 733669 - protein, 19 aa, Mycobacterium
SRFPPEWRLSKKSRAKDGT

SEQ ID NO: 733670 - protein, 26 aa, Mycobacterium
SRFRECAARALLLPRRHPGKRSPLWH

SEQ ID NO: 733671 - protein, 17 aa, Mycobacterium
SRFRGKTVGMVFQDPMS

SEQ ID NO: 733672 - protein, 21 aa, Mycobacterium
SRFRHSMTMRRLRGETGSSGV

SEQ ID NO: 733673 - protein, 17 aa, Mycobacterium
SRFRIAFTSQFRHPGIR

SEQ ID NO: 733674 - protein, 25 aa, Mycobacterium
SRFRSMCEARGLPVTRVGVVDQGSD

SEQ ID NO: 733675 - protein, 17 aa, Mycobacterium
SRFRSRFAGKVSPVHFF

SEQ ID NO: 733676 - protein, 22 aa, Mycobacterium
SRFSAARLVKPVEWTRSNRHTG

SEQ ID NO: 733677 - protein, 19 aa, Mycobacterium
SRFSNGRPPGFVVPGAPPV

SEQ ID NO: 733678 - protein, 21 aa, Mycobacterium
SRFSSELLEMVLSGAARARDV

SEQ ID NO: 733679 - protein, 20 aa, Mycobacterium
SRFTELFATVRIRLQEAVDR

SEQ ID NO: 733680 - protein, 25 aa, Mycobacterium
SRFVACPFGAPGARMYRTGDLACWG

SEQ ID NO: 733681 - protein, 26 aa, Mycobacterium
SRFVACPFGAPGARMYRTGDLVCWGA

SEQ ID NO: 733682 - protein, 25 aa, Mycobacterium
SRFVACPFGGPGDRMYRTGDLVCWG

SEQ ID NO: 733683 - protein, 24 aa, Mycobacterium
SRFVACPFGKPGTRMYRTGDLVLW

SEQ ID NO: 733684 - protein, 17 aa, Mycobacterium
SRFVNPTSFAYCRQITR

SEQ ID NO: 733685 - protein, 22 aa, Mycobacterium
SRFWMLAGSIAVCGFEHGVRQL

SEQ ID NO: 733686 - protein, 21 aa, Mycobacterium
SRGAAIADWLVREAPVSQPML

SEQ ID NO: 733687 - protein, 19 aa, Mycobacterium
SRGALELLQALMADTDAEA

SEQ ID NO: 733688 - protein, 18 aa, Mycobacterium
SRGALLIHGHLDVVPAEA

SEQ ID NO: 733689 - protein, 20 aa, Mycobacterium
SRGALMVHGHLDVVPAEPAD

SEQ ID NO: 733690 - protein, 17 aa, Mycobacterium
SRGARYAGADGEYSVPS

SEQ ID NO: 733691 - protein, 24 aa, Mycobacterium
SRGEPHRNICLIPSSAHGTNAASA

SEQ ID NO: 733692 - protein, 32 aa, Mycobacterium
SRGEVAYAAEFFRWFAGEAVRLDGSVMLAPDG

SEQ ID NO: 733693 - protein, 21 aa, Mycobacterium
SRGFAFYALDLHKCGRSHRDG

SEQ ID NO: 733694 - protein, 25 aa, Mycobacterium
SRGFHIYAPVARRWTYRELRLAAET

SEQ ID NO: 733695 - protein, 21 aa, Mycobacterium
SRGGACAAAAFLERATALTVD

SEQ ID NO: 733696 - protein, 25 aa, Mycobacterium
SRGGDVPPRIVAVARDFGAEQGLAD

SEQ ID NO: 733697 - protein, 18 aa, Mycobacterium
SRGGLLAHERFDHTSQLQ

SEQ ID NO: 733698 - protein, 18 aa, Mycobacterium
SRGGQLLATRDVAETARR

SEQ ID NO: 733699 - protein, 26 aa, Mycobacterium
SRGGRLAGCLRRIANGGGRRTSSSGS

SEQ ID NO: 733700 - protein, 20 aa, Mycobacterium
SRGGRLSRQSAWQVLADAAE

SEQ ID NO: 733701 - protein, 21 aa, Mycobacterium
SRGGSSIGVSRVTAWDELPAA

SEQ ID NO: 733702 - protein, 22 aa, Mycobacterium
SRGHEVAWDMVQPRAGAHPVKL

SEQ ID NO: 733703 - protein, 24 aa, Mycobacterium
SRGHLCPKGASLHQIHHDPDRLRL

SEQ ID NO: 733704 - protein, 18 aa, Mycobacterium
SRGIGAGIVRRLAEDGAR

SEQ ID NO: 733705 - protein, 22 aa, Mycobacterium
SRGKGLDGFCPLGVEMVAPRDM

SEQ ID NO: 733706 - protein, 23 aa, Mycobacterium
SRGKWDTLRAMGFDDAHIADSRT

SEQ ID NO: 733707 - protein, 22 aa, Mycobacterium
SRGKWDTLRAMGFDDDHIGDSR

SEQ ID NO: 733708 - protein, 22 aa, Mycobacterium
SRGKWDTLRAMGFDDDHISDSR

SEQ ID NO: 733709 - protein, 22 aa, Mycobacterium
SRGLEMSRLLISAWDIPGRCDI

SEQ ID NO: 733710 - protein, 18 aa, Mycobacterium
SRGLHAHHLWHWEDGGPT

SEQ ID NO: 733711 - protein, 20 aa, Mycobacterium
SRGMGKWERRVLGSVSSGLV

SEQ ID NO: 733712 - protein, 17 aa, Mycobacterium
SRGMKGQSWRGAAGIGE

SEQ ID NO: 733713 - protein, 20 aa, Mycobacterium
SRGPALRVVLLSAPGETSRR

SEQ ID NO: 733714 - protein, 19 aa, Mycobacterium
SRGPELERVLARCSFLHDG

SEQ ID NO: 733715 - protein, 19 aa, Mycobacterium
SRGPFGAGMTTAIANPAAQ

SEQ ID NO: 733716 - protein, 24 aa, Mycobacterium
SRGPFPGALWLQVRDLDAARAELA

SEQ ID NO: 733717 - protein, 20 aa, Mycobacterium
SRGPSKFRTELMSVPQDEWP

SEQ ID NO: 733718 - protein, 24 aa, Mycobacterium
SRGPWKAKQNYLFDVRQIRRGKID

SEQ ID NO: 733719 - protein, 17 aa, Mycobacterium
SRGQWYLRQMLGSANFE

SEQ ID NO: 733720 - protein, 21 aa, Mycobacterium
SRGRDFAFLGGEDWKPEDSPL

SEQ ID NO: 733721 - protein, 17 aa, Mycobacterium
SRGRFILGLGTQIQPHI

SEQ ID NO: 733722 - protein, 22 aa, Mycobacterium
SRGRGLDVIFANAGGGEFAALG

SEQ ID NO: 733723 - protein, 22 aa, Mycobacterium
SRGRLAMAMAAIRARNSIDTAA

SEQ ID NO: 733724 - protein, 22 aa, Mycobacterium
SRGRLAMAMGAIRARNSIDEAA

SEQ ID NO: 733725 - protein, 19 aa, Mycobacterium
SRGRLCPKGSASKQLVTGP

SEQ ID NO: 733726 - protein, 20 aa, Mycobacterium
SRGRLCPKGSASKQLVTGPQ

SEQ ID NO: 733727 - protein, 20 aa, Mycobacterium
SRGRLCPKGSASTQLVTGPQ

SEQ ID NO: 733728 - protein, 19 aa, Mycobacterium
SRGRRPLTVLDLDYRPMFW

SEQ ID NO: 733729 - protein, 17 aa, Mycobacterium
SRGRRSAPHSGDDRERA

SEQ ID NO: 733730 - protein, 21 aa, Mycobacterium
SRGRSAVHLPAIKRFDQRFTS

SEQ ID NO: 733731 - protein, 19 aa, Mycobacterium
SRGRTAYDVAMERHATTGR

SEQ ID NO: 733732 - protein, 19 aa, Mycobacterium
SRGTRRFCENGGCTFLGEH

SEQ ID NO: 733733 - protein, 21 aa, Mycobacterium
SRGVLPTRLRLIYLADSQVLD

SEQ ID NO: 733734 - protein, 22 aa, Mycobacterium
SRGVPPTRLRLIYLADGQVLDY

SEQ ID NO: 733735 - protein, 27 aa, Mycobacterium
SRGYKLDEPWSRRYLEEAIKLGIKNVH

SEQ ID NO: 733736 - protein, 18 aa, Mycobacterium
SRGYMEFWDQVLNTLTGS

SEQ ID NO: 733737 - protein, 20 aa, Mycobacterium
SRHAEAVVLHLGCGLDGRYF

SEQ ID NO: 733738 - protein, 21 aa, Mycobacterium
SRHAFSLFIYHGIRPPPDSPT

SEQ ID NO: 733739 - protein, 19 aa, Mycobacterium
SRHAPTYLYRYDFAPRTLQ

SEQ ID NO: 733740 - protein, 18 aa, Mycobacterium
SRHAPTYVYRYDYAPRAL

SEQ ID NO: 733741 - protein, 17 aa, Mycobacterium
SRHARGFDPRDLSFVQP

SEQ ID NO: 733742 - protein, 19 aa, Mycobacterium
SRHGVLRLGYAWAAVGRHT

SEQ ID NO: 733743 - protein, 35 aa, Mycobacterium
SRHLIARIVRRWSVPEVFWAWVSRMPVPAGTLRRA

SEQ ID NO: 733744 - protein, 23 aa, Mycobacterium
SRHPEIFSSALGITVGDQTPELA

SEQ ID NO: 733745 - protein, 20 aa, Mycobacterium
SRHPEVRFGERLEDDLVRRD

SEQ ID NO: 733746 - protein, 17 aa, Mycobacterium
SRHVPLKSTLLAAHLAV

SEQ ID NO: 733747 - protein, 17 aa, Mycobacterium
SRIAIGALGSRLDHDQL

SEQ ID NO: 733748 - protein, 20 aa, Mycobacterium
SRIAPDAAAPMLGGLPAAGR

SEQ ID NO: 733749 - protein, 29 aa, Mycobacterium
SRICHVDEGFEFLGFRIQRQIKRGTTKHY

SEQ ID NO: 733750 - protein, 20 aa, Mycobacterium
SRIDSALFTGTRFEGNLTEL

SEQ ID NO: 733751 - protein, 18 aa, Mycobacterium
SRIDWGIADRSAHRDGVL

SEQ ID NO: 733752 - protein, 18 aa, Mycobacterium
SRIEEIRQLYLDTLADWP

SEQ ID NO: 733753 - protein, 20 aa, Mycobacterium
SRIENYLGFPDGLSGAQLAE

SEQ ID NO: 733754 - protein, 17 aa, Mycobacterium
SRIENYLGFPTGISGAE

SEQ ID NO: 733755 - protein, 20 aa, Mycobacterium
SRIGAKRARRVVDLGCGPGN

SEQ ID NO: 733756 - protein, 18 aa, Mycobacterium
SRIGRIHHQLGFNVALPV

SEQ ID NO: 733757 - protein, 17 aa, Mycobacterium
SRIGSKVPHLADVKPFG

SEQ ID NO: 733758 - protein, 17 aa, Mycobacterium
SRIIARENIRAIRKDVL

SEQ ID NO: 733759 - protein, 20 aa, Mycobacterium
SRIIGSPGYPAPLDRLRTDA

SEQ ID NO: 733760 - protein, 22 aa, Mycobacterium
SRIKLGQMCTAMGYRNPVYLAK

SEQ ID NO: 733761 - protein, 17 aa, Mycobacterium
SRIKQSFDPAGILNPDV

SEQ ID NO: 733762 - protein, 20 aa, Mycobacterium
SRILAKLGVRDRVHAVVYAH

SEQ ID NO: 733763 - protein, 19 aa, Mycobacterium
SRILDRYGLAPSAEQTFSS

SEQ ID NO: 733764 - protein, 17 aa, Mycobacterium
SRILGMGDVLSLIEQAE

SEQ ID NO: 733765 - protein, 18 aa, Mycobacterium
SRILKLFEAPAFSSRALS

SEQ ID NO: 733766 - protein, 18 aa, Mycobacterium
SRILPGFEDSGAFVEMYP

SEQ ID NO: 733767 - protein, 17 aa, Mycobacterium
SRIPAPLFPGFDTLGTL

SEQ ID NO: 733768 - protein, 20 aa, Mycobacterium
SRIQGSLCYTSADFEAVIAL

SEQ ID NO: 733769 - protein, 19 aa, Mycobacterium
SRIRLMADQFVERWRSPVR

SEQ ID NO: 733770 - protein, 35 aa, Mycobacterium
SRIRLPAAEAIGFMLEILPALGYLHSLGLVYNDLK

SEQ ID NO: 733771 - protein, 19 aa, Mycobacterium
SRISGLALRATDHDWHHGQ

SEQ ID NO: 733772 - protein, 17 aa, Mycobacterium
SRISPPSHWGIADTRHV

SEQ ID NO: 733773 - protein, 25 aa, Mycobacterium
SRITPELIKALGAVRRYHDKLMTLS

SEQ ID NO: 733774 - protein, 18 aa, Mycobacterium
SRIVMTRTEICFIGAGAH

SEQ ID NO: 733775 - protein, 22 aa, Mycobacterium
SRKAGFEPLPPVYTTGVLAKYT

SEQ ID NO: 733776 - protein, 23 aa, Mycobacterium
SRKANELWTLMELQPGDTVIANR

SEQ ID NO: 733777 - protein, 19 aa, Mycobacterium
SRKEGWGLAVVEAAQHAVP

SEQ ID NO: 733778 - protein, 17 aa, Mycobacterium
SRKGGATLLGRRSILAH

SEQ ID NO: 733779 - protein, 20 aa, Mycobacterium
SRKGMWPDREIALVHRLHAG

SEQ ID NO: 733780 - protein, 20 aa, Mycobacterium
SRKIFTEIMVDLFVKNDHAA

SEQ ID NO: 733781 - protein, 26 aa, Mycobacterium
SRKLARNTFYGMARWQAKLEQRQGFL

SEQ ID NO: 733782 - protein, 18 aa, Mycobacterium
SRKLFTLSALHAATKALL

SEQ ID NO: 733783 - protein, 19 aa, Mycobacterium
SRKPWRLNQNYLRDIHLIR

SEQ ID NO: 733784 - protein, 17 aa, Mycobacterium
SRKQPPLQRIIRALIGM

SEQ ID NO: 733785 - protein, 24 aa, Mycobacterium
SRKRQAAAELADWIDSPEGRASSL

SEQ ID NO: 733786 - protein, 17 aa, Mycobacterium
SRKVLRLRQKVVTPTLP

SEQ ID NO: 733787 - protein, 25 aa, Mycobacterium
SRKWGRRGSAEMLRLSYGRFGDDLA

SEQ ID NO: 733788 - protein, 22 aa, Mycobacterium
SRKWRRRVTRHAFDLSGPAEST

SEQ ID NO: 733789 - protein, 17 aa, Mycobacterium
SRLADPATFVIQGLATV

SEQ ID NO: 733790 - protein, 21 aa, Mycobacterium
SRLAGAPAMSGFRAAADKVAP

SEQ ID NO: 733791 - protein, 22 aa, Mycobacterium
SRLAGGYCLRAPAQGSCPYANI

SEQ ID NO: 733792 - protein, 18 aa, Mycobacterium
SRLAKALFGPEPAVYGHI

SEQ ID NO: 733793 - protein, 19 aa, Mycobacterium
SRLAKYKVPADFLVVEPFE

SEQ ID NO: 733794 - protein, 17 aa, Mycobacterium
SRLALIDGMGHDLPEPL

SEQ ID NO: 733795 - protein, 19 aa, Mycobacterium
SRLAQLRPGDPIVGEEGGG

SEQ ID NO: 733796 - protein, 17 aa, Mycobacterium
SRLASYDGRNRVNPPLR

SEQ ID NO: 733797 - protein, 23 aa, Mycobacterium
SRLCTACFDGVYPIELPSESALG

SEQ ID NO: 733798 - protein, 32 aa, Mycobacterium
SRLDDSRLGFYRQLYRDNARFGAKLWVLPANM

SEQ ID NO: 733799 - protein, 27 aa, Mycobacterium
SRLDKGGLRLSRRSPLAAAAQSVLSLV

SEQ ID NO: 733800 - protein, 20 aa, Mycobacterium
SRLDPAIVLGEMSFVPNPTC

SEQ ID NO: 733801 - protein, 20 aa, Mycobacterium
SRLDRTGGIGLVVSQWHTDS

SEQ ID NO: 733802 - protein, 24 aa, Mycobacterium
SRLDWTIVRPSGLFDLPAPTHYLS

SEQ ID NO: 733803 - protein, 19 aa, Mycobacterium
SRLEPGELITGYRLRLRPD

SEQ ID NO: 733804 - protein, 18 aa, Mycobacterium
SRLERELKDSGSNSPDRR

SEQ ID NO: 733805 - protein, 28 aa, Mycobacterium
SRLETVVKQLLGVYIWYGDMAALLMTVK

SEQ ID NO: 733806 - protein, 18 aa, Mycobacterium
SRLEVLAPDVAIRLASVP

SEQ ID NO: 733807 - protein, 17 aa, Mycobacterium
SRLFGRIAARIEPEAVE

SEQ ID NO: 733808 - protein, 25 aa, Mycobacterium
SRLFPRGLAAFIELRDQRCRTPYCD

SEQ ID NO: 733809 - protein, 20 aa, Mycobacterium
SRLFTPRAIAGMEAKLADSA

SEQ ID NO: 733810 - protein, 25 aa, Mycobacterium
SRLGEPWPLVQDAYLRAWEYRPWRA

SEQ ID NO: 733811 - protein, 19 aa, Mycobacterium
SRLGLAQFAAPRPGRRIGL

SEQ ID NO: 733812 - protein, 25 aa, Mycobacterium
SRLGLWPSDIKILAQVVRYHLLLPH

SEQ ID NO: 733813 - protein, 20 aa, Mycobacterium
SRLGPIFDVCRDDGRAALIG

SEQ ID NO: 733814 - protein, 18 aa, Mycobacterium
SRLGPLFDSCRAENRAAL

SEQ ID NO: 733815 - protein, 18 aa, Mycobacterium
SRLGPRSTVGLDFSPAAL

SEQ ID NO: 733816 - protein, 20 aa, Mycobacterium
SRLGPVFDMCRTENRAALIG

SEQ ID NO: 733817 - protein, 20 aa, Mycobacterium
SRLGYGHLVLATGARNREIP

SEQ ID NO: 733818 - protein, 21 aa, Mycobacterium
SRLHAKLFYQPLLESIAPAGL

SEQ ID NO: 733819 - protein, 22 aa, Mycobacterium
SRLHAKLFYQPLLESIGPAGLE

SEQ ID NO: 733820 - protein, 21 aa, Mycobacterium
SRLHAKLFYQPLLESVGQASV

SEQ ID NO: 733821 - protein, 20 aa, Mycobacterium
SRLHPLATLDKMFIPPSGFH

SEQ ID NO: 733822 - protein, 18 aa, Mycobacterium
SRLHRWRFNLTTGAVHEE

SEQ ID NO: 733823 - protein, 20 aa, Mycobacterium
SRLIALGLRNYWGYNTFGYL

SEQ ID NO: 733824 - protein, 21 aa, Mycobacterium
SRLILEHANIPPARETQTERP

SEQ ID NO: 733825 - protein, 26 aa, Mycobacterium
SRLKMPMPAGLARWQQDRGRRLVDEA

SEQ ID NO: 733826 - protein, 28 aa, Mycobacterium
SRLLDRLPPLLGTWAFGFATRLSRRSEV

SEQ ID NO: 733827 - protein, 17 aa, Mycobacterium
SRLLFPALCAPTSEWPT

SEQ ID NO: 733828 - protein, 20 aa, Mycobacterium
SRLLGDVGLDIGIAFQLRDD

SEQ ID NO: 733829 - protein, 24 aa, Mycobacterium
SRLLPNLVTVLGWESCDHTGPVHE

SEQ ID NO: 733830 - protein, 26 aa, Mycobacterium
SRLLPNLVTVLGWRSCDHTGPVHEGD

SEQ ID NO: 733831 - protein, 30 aa, Mycobacterium
SRLLPPPWRAEALVLLGFSAYVRGDGPLAG

SEQ ID NO: 733832 - protein, 17 aa, Mycobacterium
SRLLRDRGYTIVEPEVG

SEQ ID NO: 733833 - protein, 21 aa, Mycobacterium
SRLLTRELFYTAVTRAKERVQ

SEQ ID NO: 733834 - protein, 20 aa, Mycobacterium
SRLLTRELFYTAVTRAKQRV

SEQ ID NO: 733835 - protein, 20 aa, Mycobacterium
SRLLTRELFYTAVTRAKTRV

SEQ ID NO: 733836 - protein, 19 aa, Mycobacterium
SRLMLPGSISIAREIVESW

SEQ ID NO: 733837 - protein, 18 aa, Mycobacterium
SRLMWRRAPAPDVEVLTL

SEQ ID NO: 733838 - protein, 17 aa, Mycobacterium
SRLPAPLRRGEVRPLGL

SEQ ID NO: 733839 - protein, 25 aa, Mycobacterium
SRLPDLRCLMLTSFTSDEATLDAIL

SEQ ID NO: 733840 - protein, 18 aa, Mycobacterium
SRLPERYRDIGPRIVRTR

SEQ ID NO: 733841 - protein, 17 aa, Mycobacterium
SRLPKSVYKSVVATIEK

SEQ ID NO: 733842 - protein, 24 aa, Mycobacterium
SRLPMPDLIRLAANAIHYLAVFDE

SEQ ID NO: 733843 - protein, 19 aa, Mycobacterium
SRLPPIYPGTTVSIPPTTT

SEQ ID NO: 733844 - protein, 19 aa, Mycobacterium
SRLQDWPDALWRIVRETEE

SEQ ID NO: 733845 - protein, 20 aa, Mycobacterium
SRLRCELFAAIQAAHPYEVP

SEQ ID NO: 733846 - protein, 18 aa, Mycobacterium
SRLRDRFEHDFGRQPQMM

SEQ ID NO: 733847 - protein, 23 aa, Mycobacterium
SRLREVVDSLGYPVMLKEVGHGI

SEQ ID NO: 733848 - protein, 18 aa, Mycobacterium
SRLRGRAVLADEVGLGKT

SEQ ID NO: 733849 - protein, 19 aa, Mycobacterium
SRLRMVELLRTGPLSVGEI

SEQ ID NO: 733850 - protein, 20 aa, Mycobacterium
SRLRQACALITDDLATPVTL

SEQ ID NO: 733851 - protein, 23 aa, Mycobacterium
SRLRVRGTDGLRVIDASVMPSLP

SEQ ID NO: 733852 - protein, 26 aa, Mycobacterium
SRLSPRRVAAYLAKYVTKSLHDFGIT

SEQ ID NO: 733853 - protein, 21 aa, Mycobacterium
SRLSRKAVREHAIRRCSATAM

SEQ ID NO: 733854 - protein, 21 aa, Mycobacterium
SRLTAEIALDLKIRLPGLLER

SEQ ID NO: 733855 - protein, 20 aa, Mycobacterium
SRLTDPVAMRRADQQMRQII

SEQ ID NO: 733856 - protein, 21 aa, Mycobacterium
SRLTFCGARAGRAHLQQGEAL

SEQ ID NO: 733857 - protein, 26 aa, Mycobacterium
SRLTRARIRLGPWVIPEHHAVLTSVA

SEQ ID NO: 733858 - protein, 19 aa, Mycobacterium
SRLTSPLRRRSDGTYEEID

SEQ ID NO: 733859 - protein, 24 aa, Mycobacterium
SRLVSRLGPAAVRIVADTFAALVT

SEQ ID NO: 733860 - protein, 17 aa, Mycobacterium
SRLVSRLGPTAVRIVAE

SEQ ID NO: 733861 - protein, 21 aa, Mycobacterium
SRLWEHWGKPEIHWYQGGHTG

SEQ ID NO: 733862 - protein, 17 aa, Mycobacterium
SRLWVDQRVQKIYAGTN

SEQ ID NO: 733863 - protein, 18 aa, Mycobacterium
SRLWVDQRVQKIYAGTNE

SEQ ID NO: 733864 - protein, 24 aa, Mycobacterium
SRLYPESLHIMGWDVGSHGLQLRL

SEQ ID NO: 733865 - protein, 24 aa, Mycobacterium
SRLYPESLHIMGWNVGSAGIQLVM

SEQ ID NO: 733866 - protein, 18 aa, Mycobacterium
SRLYSWAEASSFATPFVT

SEQ ID NO: 733867 - protein, 18 aa, Mycobacterium
SRLYSWAEATSYTTPFVA

SEQ ID NO: 733868 - protein, 20 aa, Mycobacterium
SRMAGMGRAWLSMTSASSLT

SEQ ID NO: 733869 - protein, 20 aa, Mycobacterium
SRMFTPRKVLALEPQIREFT

SEQ ID NO: 733870 - protein, 17 aa, Mycobacterium
SRMGAAVFTSGPYIEMV

SEQ ID NO: 733871 - protein, 20 aa, Mycobacterium
SRMGRIAWSLLRHPVKSREF

SEQ ID NO: 733872 - protein, 19 aa, Mycobacterium
SRMLGKPGDGWQLAMDLLP

SEQ ID NO: 733873 - protein, 18 aa, Mycobacterium
SRMLSALVARGVSVAATS

SEQ ID NO: 733874 - protein, 20 aa, Mycobacterium
SRMQFLFNGIHGWLTSDCAE

SEQ ID NO: 733875 - protein, 17 aa, Mycobacterium
SRMRPDVVTAFMDEFGD

SEQ ID NO: 733876 - protein, 22 aa, Mycobacterium
SRMRPDVVVAFMNRFGDVIYNN

SEQ ID NO: 733877 - protein, 17 aa, Mycobacterium
SRMVAINLMGPIHVIET

SEQ ID NO: 733878 - protein, 17 aa, Mycobacterium
SRMVHMLAGNAPSGCVA

SEQ ID NO: 733879 - protein, 18 aa, Mycobacterium
SRMYRTGDLVRWGADGRL

SEQ ID NO: 733880 - protein, 25 aa, Mycobacterium
SRNFRGCLYANAATEFPGLQLEPVR

SEQ ID NO: 733881 - protein, 19 aa, Mycobacterium
SRNGCSILEERGHTYYVRG

SEQ ID NO: 733882 - protein, 24 aa, Mycobacterium
SRNGGDILAHFRFTDETQWDQASE

SEQ ID NO: 733883 - protein, 19 aa, Mycobacterium
SRNGVFWIREMLPIGELRE

SEQ ID NO: 733884 - protein, 17 aa, Mycobacterium
SRNGWNTPFGVEVPQPL

SEQ ID NO: 733885 - protein, 23 aa, Mycobacterium
SRNLLRRYRFYRVPPRSAPNSLA

SEQ ID NO: 733886 - protein, 29 aa, Mycobacterium
SRNQATPRPCWRWKRTVAQTVSSMRRART

SEQ ID NO: 733887 - protein, 24 aa, Mycobacterium
SRNRRLAAFVGRHRFASISEAQGR

SEQ ID NO: 733888 - protein, 19 aa, Mycobacterium
SRNSIEFGELNAAAQLGGI

SEQ ID NO: 733889 - protein, 23 aa, Mycobacterium
SRPADFPNNGWVVAAFQAAWSAI

SEQ ID NO: 733890 - protein, 17 aa, Mycobacterium
SRPAFATADRVVFDEDG

SEQ ID NO: 733891 - protein, 19 aa, Mycobacterium
SRPAIDWLDGSGVAVDNGV

SEQ ID NO: 733892 - protein, 19 aa, Mycobacterium
SRPAIGMVKRWMDGEDVLP

SEQ ID NO: 733893 - protein, 20 aa, Mycobacterium
SRPALSLSVQPIGLRGRPAA

SEQ ID NO: 733894 - protein, 17 aa, Mycobacterium
SRPALWSRDTSPEGYSW

SEQ ID NO: 733895 - protein, 21 aa, Mycobacterium
SRPARVCDIDHTIPFNHTDPG

SEQ ID NO: 733896 - protein, 23 aa, Mycobacterium
SRPDLAFDMVRPGIAVYGLSPVP

SEQ ID NO: 733897 - protein, 19 aa, Mycobacterium
SRPDQARSLAIEKTPTFSP

SEQ ID NO: 733898 - protein, 18 aa, Mycobacterium
SRPDRWPLPAAITPRQLW

SEQ ID NO: 733899 - protein, 26 aa, Mycobacterium
SRPDVVARLTADWVDRVVAGTGDAAA

SEQ ID NO: 733900 - protein, 26 aa, Mycobacterium
SRPDVVARLTAEWVDRTVAGAPPAVE

SEQ ID NO: 733901 - protein, 24 aa, Mycobacterium
SRPEFLDAALAYVRFAVDHPGHYE

SEQ ID NO: 733902 - protein, 21 aa, Mycobacterium
SRPEKLNGLTIDMLNGLTAAA

SEQ ID NO: 733903 - protein, 21 aa, Mycobacterium
SRPELGFRLLQRLGADVADYG

SEQ ID NO: 733904 - protein, 23 aa, Mycobacterium
SRPELLLGGPVMSRLQQVVHRLL

SEQ ID NO: 733905 - protein, 17 aa, Mycobacterium
SRPEMFVTQSPVANAYT

SEQ ID NO: 733906 - protein, 21 aa, Mycobacterium
SRPEPDLAIVGMGRRDVSFDQ

SEQ ID NO: 733907 - protein, 36 aa, Mycobacterium
SRPGARRHLLSWGIGECGICGAKLRAVTKRGRHGRP

SEQ ID NO: 733908 - protein, 21 aa, Mycobacterium
SRPGRGMALLQPRLFVEVLDD

SEQ ID NO: 733909 - protein, 19 aa, Mycobacterium
SRPHLEWQLRSRVRALPNV

SEQ ID NO: 733910 - protein, 17 aa, Mycobacterium
SRPIAPLLDGLRTLGVD

SEQ ID NO: 733911 - protein, 17 aa, Mycobacterium
SRPKWPEIQGVRDFAGV

SEQ ID NO: 733912 - protein, 27 aa, Mycobacterium
SRPLDRARPLWELHVIHGLAGDRVALV

SEQ ID NO: 733913 - protein, 19 aa, Mycobacterium
SRPLITNMIRLLKLPIPVQ

SEQ ID NO: 733914 - protein, 20 aa, Mycobacterium
SRPLITNMIRLLKLPIPVQR

SEQ ID NO: 733915 - protein, 20 aa, Mycobacterium
SRPLKLVGIADVVDLFATLD

SEQ ID NO: 733916 - protein, 33 aa, Mycobacterium
SRPLRLPVGIEVLGDGGLRVSGRATLDRRDFGV

SEQ ID NO: 733917 - protein, 25 aa, Mycobacterium
SRPLRMMRIDEVIDLYATTDEAKAG

SEQ ID NO: 733918 - protein, 21 aa, Mycobacterium
SRPPLLKRIVLQTAARLSPRG

SEQ ID NO: 733919 - protein, 17 aa, Mycobacterium
SRPPTFVLFTSGFLEAG

SEQ ID NO: 733920 - protein, 20 aa, Mycobacterium
SRPRAGTLVVPRPTTNAYAQ

SEQ ID NO: 733921 - protein, 25 aa, Mycobacterium
SRPRKSRPAVPAWEDVLLGVRSSGG

SEQ ID NO: 733922 - protein, 20 aa, Mycobacterium
SRPSPLSLDDVVKFLLPPAA

SEQ ID NO: 733923 - protein, 25 aa, Mycobacterium
SRPSPLSLDDVVKFLLPQAPAKKPA

SEQ ID NO: 733924 - protein, 30 aa, Mycobacterium
SRPSPLSLDDVVKFLLPQGAAKKPGKAAAA

SEQ ID NO: 733925 - protein, 19 aa, Mycobacterium
SRPSQRRRLTVDRKTFGFY

SEQ ID NO: 733926 - protein, 22 aa, Mycobacterium
SRPTALVRRGLGPDVVASREGR

SEQ ID NO: 733927 - protein, 20 aa, Mycobacterium
SRPTPCADFDVAQLTGHLLN

SEQ ID NO: 733928 - protein, 17 aa, Mycobacterium
SRPVIDFAGRHVLAPHV

SEQ ID NO: 733929 - protein, 19 aa, Mycobacterium
SRPWTILPVEMIRSRQFVL

SEQ ID NO: 733930 - protein, 20 aa, Mycobacterium
SRPYAYLGITVPQFPNFFIV

SEQ ID NO: 733931 - protein, 20 aa, Mycobacterium
SRQATAYVRLLRFLPGDALM

SEQ ID NO: 733932 - protein, 24 aa, Mycobacterium
SRQDLPAILTFGGGAHYCLGANLA

SEQ ID NO: 733933 - protein, 22 aa, Mycobacterium
SRQGLAEGYAMRLADRLVDAVD

SEQ ID NO: 733934 - protein, 20 aa, Mycobacterium
SRQGLAQGYALRLADRLVDA

SEQ ID NO: 733935 - protein, 17 aa, Mycobacterium
SRQGLAQGYALRLTDRL

SEQ ID NO: 733936 - protein, 17 aa, Mycobacterium
SRQGLAQGYGLRLADRL

SEQ ID NO: 733937 - protein, 20 aa, Mycobacterium
SRQLPWLTGLGEVYTYDAPW

SEQ ID NO: 733938 - protein, 20 aa, Mycobacterium
SRQLRPVLQVVWPVLTTLAS

SEQ ID NO: 733939 - protein, 21 aa, Mycobacterium
SRQQFAFKRMAPEVVRKINRG

SEQ ID NO: 733940 - protein, 28 aa, Mycobacterium
SRQRAEARLGYALNRTHTAAVIWSDEPD

SEQ ID NO: 733941 - protein, 23 aa, Mycobacterium
SRQRIYRQPGFVAAMRDIMALQD

SEQ ID NO: 733942 - protein, 23 aa, Mycobacterium
SRQRVYRQPGFVDAMRDIMALQD

SEQ ID NO: 733943 - protein, 23 aa, Mycobacterium
SRQRVYRQPGFVSAMRDIMALQD

SEQ ID NO: 733944 - protein, 18 aa, Mycobacterium
SRQWSSIYARLIRLSDYL

SEQ ID NO: 733945 - protein, 23 aa, Mycobacterium
SRRAIHFQEWWVRYRAQVPTHSF

SEQ ID NO: 733946 - protein, 19 aa, Mycobacterium
SRRALRLRGISELTRARHL

SEQ ID NO: 733947 - protein, 19 aa, Mycobacterium
SRRAPAYDGSHMRFPGMSD

SEQ ID NO: 733948 - protein, 22 aa, Mycobacterium
SRREIPEATVWVDVDATELLAA

SEQ ID NO: 733949 - protein, 24 aa, Mycobacterium
SRREWPSPMLPALRQLPADGPDIH

SEQ ID NO: 733950 - protein, 26 aa, Mycobacterium
SRRFYEGLLGFEFWWELDAPDAGTDR

SEQ ID NO: 733951 - protein, 17 aa, Mycobacterium
SRRGALMDHCLSVLLQA

SEQ ID NO: 733952 - protein, 21 aa, Mycobacterium
SRRGAPLLAVHAWSDANVAGY

SEQ ID NO: 733953 - protein, 21 aa, Mycobacterium
SRRGFAFNCLTSYSDASKMRD

SEQ ID NO: 733954 - protein, 27 aa, Mycobacterium
SRRGIPVMLRPLVLAKLMDGRTTVMVT

SEQ ID NO: 733955 - protein, 18 aa, Mycobacterium
SRRGKVWSYTENRYAPPP

SEQ ID NO: 733956 - protein, 25 aa, Mycobacterium
SRRGVGLTALHAWSDVDVFELPGVD

SEQ ID NO: 733957 - protein, 20 aa, Mycobacterium
SRRIGAALGPGWPRAVKSTL

SEQ ID NO: 733958 - protein, 22 aa, Mycobacterium
SRRKLPEPPGWFGQIKPAALLR

SEQ ID NO: 733959 - protein, 17 aa, Mycobacterium
SRRLLRALIDWFEQRGK

SEQ ID NO: 733960 - protein, 22 aa, Mycobacterium
SRRLRRSVWALCASWYTTSSGA

SEQ ID NO: 733961 - protein, 26 aa, Mycobacterium
SRRLRRVMYMSALTAIRCDPASRAYY

SEQ ID NO: 733962 - protein, 17 aa, Mycobacterium
SRRMGRVAIDAHNSPLM

SEQ ID NO: 733963 - protein, 34 aa, Mycobacterium
SRRMIKAGLIAPRFTMRQGRRILIPVDFSELPTD

SEQ ID NO: 733964 - protein, 18 aa, Mycobacterium
SRRNLEWVSPHIDVSEVK

SEQ ID NO: 733965 - protein, 18 aa, Mycobacterium
SRRPRGAPRGLLLDAARA

SEQ ID NO: 733966 - protein, 18 aa, Mycobacterium
SRRPTVLLWHGMQTDARA

SEQ ID NO: 733967 - protein, 21 aa, Mycobacterium
SRRRLAMAMGAIRARESLDSA

SEQ ID NO: 733968 - protein, 21 aa, Mycobacterium
SRRRLAMAMGAIRARQSLDAA

SEQ ID NO: 733969 - protein, 24 aa, Mycobacterium
SRRRPELSWFPWLSRHLRDAEPGR

SEQ ID NO: 733970 - protein, 18 aa, Mycobacterium
SRRRPRAAKRVAAVSRLR

SEQ ID NO: 733971 - protein, 19 aa, Mycobacterium
SRRSAWWAGALTLGVAKIV

SEQ ID NO: 733972 - protein, 21 aa, Mycobacterium
SRRSAWWAGAVTLGVAKIIEN

SEQ ID NO: 733973 - protein, 20 aa, Mycobacterium
SRRSAWWAGTVTLGVAKIVE

SEQ ID NO: 733974 - protein, 18 aa, Mycobacterium
SRRSCTHLGPKFHDPNTL

SEQ ID NO: 733975 - protein, 17 aa, Mycobacterium
SRRSEVLGTVALSSLGH

SEQ ID NO: 733976 - protein, 25 aa, Mycobacterium
SRRSGFKEIHDRGGFLSGATTFDPE

SEQ ID NO: 733977 - protein, 20 aa, Mycobacterium
SRRSLARYAERLHEMNAVGH

SEQ ID NO: 733978 - protein, 25 aa, Mycobacterium
SRRVILDLRGLKFIGTAGFSALHRI

SEQ ID NO: 733979 - protein, 25 aa, Mycobacterium
SRRVILDLRGLKFIGTAGFSTLHRI

SEQ ID NO: 733980 - protein, 41 aa, Mycobacterium
SRRVIRALGARECGHGAALLAGPGRLVWTRVAGDVLDVALL

SEQ ID NO: 733981 - protein, 22 aa, Mycobacterium
SRRVLAALGQRVLRLAAERSAG

SEQ ID NO: 733982 - protein, 23 aa, Mycobacterium
SRRVRARLARRMTAQRGAVSPVL

SEQ ID NO: 733983 - protein, 22 aa, Mycobacterium
SRRVRARLARRMTAQRNALNPV

SEQ ID NO: 733984 - protein, 18 aa, Mycobacterium
SRRVRARLARRMTSQRST

SEQ ID NO: 733985 - protein, 20 aa, Mycobacterium
SRRVREALELAGSDPSHPGQ

SEQ ID NO: 733986 - protein, 26 aa, Mycobacterium
SRRVRLMRWGLVPPWAKAGPDGGLPD

SEQ ID NO: 733987 - protein, 20 aa, Mycobacterium
SRRYALGPRLIRLGESATQQ

SEQ ID NO: 733988 - protein, 18 aa, Mycobacterium
SRSAGCYLVDARTGRRYL

SEQ ID NO: 733989 - protein, 23 aa, Mycobacterium
SRSAGNINPIWAYAHVPFGYAGD

SEQ ID NO: 733990 - protein, 17 aa, Mycobacterium
SRSAGNVNPIWAYAHVP

SEQ ID NO: 733991 - protein, 17 aa, Mycobacterium
SRSAGSINPVWAYAHVP

SEQ ID NO: 733992 - protein, 22 aa, Mycobacterium
SRSANVYARLVLGVKPHDITAG

SEQ ID NO: 733993 - protein, 19 aa, Mycobacterium
SRSAWPVAAEGLIDAIVGL

SEQ ID NO: 733994 - protein, 20 aa, Mycobacterium
SRSDALAWAVRLVGEHTEEW

SEQ ID NO: 733995 - protein, 20 aa, Mycobacterium
SRSDALAWSVRLVGQHADEW

SEQ ID NO: 733996 - protein, 21 aa, Mycobacterium
SRSEAFPVVILEAMARAVPVA

SEQ ID NO: 733997 - protein, 29 aa, Mycobacterium
SRSEFVTSLQLLLTFPFPNFGIKQSVRGD

SEQ ID NO: 733998 - protein, 33 aa, Mycobacterium
SRSFEEVFIRAGIPYKVVGGVRFYERKEIRDIV

SEQ ID NO: 733999 - protein, 21 aa, Mycobacterium
SRSGAKAVLVHQGFLGVDYRA

SEQ ID NO: 734000 - protein, 25 aa, Mycobacterium
SRSGGRWIDKEWLRKHNIDRLTRWR

SEQ ID NO: 734001 - protein, 18 aa, Mycobacterium
SRSIPLGVFAHWIQASGS

SEQ ID NO: 734002 - protein, 33 aa, Mycobacterium
SRSLEEIFIRTGIPYKVVGGVRFYERKEIRDIV

SEQ ID NO: 734003 - protein, 33 aa, Mycobacterium
SRSLEEVFIRAGIPYKVVGGVRFYERKEIRDII

SEQ ID NO: 734004 - protein, 24 aa, Mycobacterium
SRSLEFAEKFFAATRGRGVDVVLN

SEQ ID NO: 734005 - protein, 18 aa, Mycobacterium
SRSLPPYRSVLAEYAHPH

SEQ ID NO: 734006 - protein, 26 aa, Mycobacterium
SRSNITICVGGGIGTPERSAEYLSGR

SEQ ID NO: 734007 - protein, 19 aa, Mycobacterium
SRSPLVLDVSRLGRRPGSM

SEQ ID NO: 734008 - protein, 17 aa, Mycobacterium
SRSPVPIRAALPERLRS

SEQ ID NO: 734009 - protein, 17 aa, Mycobacterium
SRSRFDRRLLTAHLRVS

SEQ ID NO: 734010 - protein, 21 aa, Mycobacterium
SRSRLGGSASRVTRTGKTLRF

SEQ ID NO: 734011 - protein, 21 aa, Mycobacterium
SRSRLIRLFPTVFKGTHVNLD

SEQ ID NO: 734012 - protein, 25 aa, Mycobacterium
SRSRLLYDYFVELFAQVTNPPLDAI

SEQ ID NO: 734013 - protein, 25 aa, Mycobacterium
SRSSKTRFAIYLGDLGNDTAARARE

SEQ ID NO: 734014 - protein, 18 aa, Mycobacterium
SRSSRIENYLGFPTGISG

SEQ ID NO: 734015 - protein, 43 aa, Mycobacterium
SRSTLEATWRLNAAMWRAGFPPRLIHSTGFRGLIDSQLYRQQP

SEQ ID NO: 734016 - protein, 27 aa, Mycobacterium
SRSTLRPDECERLGLPVFVKPARGGSS

SEQ ID NO: 734017 - protein, 21 aa, Mycobacterium
SRSTWQRHHVRAEALRMARGH

SEQ ID NO: 734018 - protein, 19 aa, Mycobacterium
SRSVLWKQILADVLGTPLI

SEQ ID NO: 734019 - protein, 25 aa, Mycobacterium
SRSWKAIEASGRFCVNMLTEHQKHV

SEQ ID NO: 734020 - protein, 25 aa, Mycobacterium
SRSWKAIEASGRFCVNVLTEKQKSV

SEQ ID NO: 734021 - protein, 24 aa, Mycobacterium
SRSWKAIEATGRFCVNVLTEKQKH

SEQ ID NO: 734022 - protein, 19 aa, Mycobacterium
SRTAAKLGPFLVPATLGAP

SEQ ID NO: 734023 - protein, 18 aa, Mycobacterium
SRTAFLHVNYRQVVPVGV

SEQ ID NO: 734024 - protein, 19 aa, Mycobacterium
SRTAGRWVETMLRLPDIRA

SEQ ID NO: 734025 - protein, 20 aa, Mycobacterium
SRTAGSWFRKMDRDPAVVAA

SEQ ID NO: 734026 - protein, 18 aa, Mycobacterium
SRTALKPADLEVAQLYDG

SEQ ID NO: 734027 - protein, 17 aa, Mycobacterium
SRTAWLSAPYSDATHTC

SEQ ID NO: 734028 - protein, 21 aa, Mycobacterium
SRTGGALTFTHLFSEPLIAVM

SEQ ID NO: 734029 - protein, 21 aa, Mycobacterium
SRTGKMLPPKLGLLAYVADAY

SEQ ID NO: 734030 - protein, 21 aa, Mycobacterium
SRTGKMLPPKLGLMSYVADAY

SEQ ID NO: 734031 - protein, 20 aa, Mycobacterium
SRTGVMMGLSSWDYTIVNIE

SEQ ID NO: 734032 - protein, 22 aa, Mycobacterium
SRTGWLPSPLILAAAVAGRTRS

SEQ ID NO: 734033 - protein, 22 aa, Mycobacterium
SRTIRLPVHLVEQVNKLARIKR

SEQ ID NO: 734034 - protein, 18 aa, Mycobacterium
SRTKAVVIGGGLLGLEAA

SEQ ID NO: 734035 - protein, 21 aa, Mycobacterium
SRTKFFDEFVLAAADAGIRQV

SEQ ID NO: 734036 - protein, 18 aa, Mycobacterium
SRTLARLGLANYFAAAAV

SEQ ID NO: 734037 - protein, 18 aa, Mycobacterium
SRTLARLGLANYFAAATV

SEQ ID NO: 734038 - protein, 24 aa, Mycobacterium
SRTLPGMMAGVVPLVLNAPPQSTV

SEQ ID NO: 734039 - protein, 18 aa, Mycobacterium
SRTMALGLLLPGFTSPVY

SEQ ID NO: 734040 - protein, 19 aa, Mycobacterium
SRTPDEVVFRDELPTTATG

SEQ ID NO: 734041 - protein, 17 aa, Mycobacterium
SRTQLMWEINAHATEAV

SEQ ID NO: 734042 - protein, 21 aa, Mycobacterium
SRTRLIRLFPTVFKGTHVNLD

SEQ ID NO: 734043 - protein, 23 aa, Mycobacterium
SRTSLYVYARETVGYALSIDGRV

SEQ ID NO: 734044 - protein, 26 aa, Mycobacterium
SRTSRPDALLPLARRETGECLAEDLR

SEQ ID NO: 734045 - protein, 18 aa, Mycobacterium
SRTVLLAGWEQFDEPVDR

SEQ ID NO: 734046 - protein, 26 aa, Mycobacterium
SRVAAYKYPRLVWLVDALPKGPTGKV

SEQ ID NO: 734047 - protein, 22 aa, Mycobacterium
SRVAEPAFAYPIAKQANQIRVR

SEQ ID NO: 734048 - protein, 19 aa, Mycobacterium
SRVALPAMRLHLKTNGCYS

SEQ ID NO: 734049 - protein, 22 aa, Mycobacterium
SRVAQLYGGYVLPGSRLDRTGG

SEQ ID NO: 734050 - protein, 19 aa, Mycobacterium
SRVAVDWAARDAALRQVPL

SEQ ID NO: 734051 - protein, 21 aa, Mycobacterium
SRVDAALPRTAWGVRASGDPD

SEQ ID NO: 734052 - protein, 25 aa, Mycobacterium
SRVEGRAPQDLAWAAVQAEMLRLHV

SEQ ID NO: 734053 - protein, 17 aa, Mycobacterium
SRVERARRTLNEIRECG

SEQ ID NO: 734054 - protein, 22 aa, Mycobacterium
SRVFAAGGHGMWGITLGPVTGR

SEQ ID NO: 734055 - protein, 18 aa, Mycobacterium
SRVFVRYPLLTLLCAVTK

SEQ ID NO: 734056 - protein, 21 aa, Mycobacterium
SRVGRMAWSWLRHPLKSREFP

SEQ ID NO: 734057 - protein, 17 aa, Mycobacterium
SRVHVHWVDEPVGAITD

SEQ ID NO: 734058 - protein, 23 aa, Mycobacterium
SRVLARAGARVVLADLPETDLAG

SEQ ID NO: 734059 - protein, 21 aa, Mycobacterium
SRVLFELTGPLARTMRVSVDG

SEQ ID NO: 734060 - protein, 25 aa, Mycobacterium
SRVLFPSLCRPTAPVAVDAGVRAPT

SEQ ID NO: 734061 - protein, 30 aa, Mycobacterium
SRVLHPIWEFDGPDLFGWIATVPSPVKRAH

SEQ ID NO: 734062 - protein, 18 aa, Mycobacterium
SRVLKWIVDRIEHKAGGQ

SEQ ID NO: 734063 - protein, 18 aa, Mycobacterium
SRVLKWIVDRIEHRANGV

SEQ ID NO: 734064 - protein, 17 aa, Mycobacterium
SRVLLAWNPELAERILS

SEQ ID NO: 734065 - protein, 18 aa, Mycobacterium
SRVLPMYVGDDLTDEDAF

SEQ ID NO: 734066 - protein, 18 aa, Mycobacterium
SRVLRAHGRYAIHELALT

SEQ ID NO: 734067 - protein, 31 aa, Mycobacterium
SRVLRPGGRLGLVWNVRDERLGWVKDLGNII

SEQ ID NO: 734068 - protein, 24 aa, Mycobacterium
SRVMLADAAANAWRTRVGDDLCGP

SEQ ID NO: 734069 - protein, 17 aa, Mycobacterium
SRVNRLQPFDGYTDPAA

SEQ ID NO: 734070 - protein, 24 aa, Mycobacterium
SRVPEWFRYNAGLLAAQRTAVLPG

SEQ ID NO: 734071 - protein, 18 aa, Mycobacterium
SRVPFDPREVIARIVDGS

SEQ ID NO: 734072 - protein, 17 aa, Mycobacterium
SRVQLLLVDDAQHLDPQ

SEQ ID NO: 734073 - protein, 23 aa, Mycobacterium
SRVRAALPATSWGVRAAGDPAAT

SEQ ID NO: 734074 - protein, 31 aa, Mycobacterium
SRVRAELARTHLLYGEWLRRGRRRTEARTQL

SEQ ID NO: 734075 - protein, 17 aa, Mycobacterium
SRVRAEQLVLRYHKDRG

SEQ ID NO: 734076 - protein, 19 aa, Mycobacterium
SRVRGKVIGTVFQDPMSAL

SEQ ID NO: 734077 - protein, 23 aa, Mycobacterium
SRVRRLEARGVIAGYSARVDPEA

SEQ ID NO: 734078 - protein, 19 aa, Mycobacterium
SRVSEIVLLPADAMAQLMA

SEQ ID NO: 734079 - protein, 17 aa, Mycobacterium
SRVSFIGPHVLTGVAVF

SEQ ID NO: 734080 - protein, 25 aa, Mycobacterium
SRVSIELADGLGLPVLSVASMLARP

SEQ ID NO: 734081 - protein, 23 aa, Mycobacterium
SRVSRVMAALAYVRELNAGSERV

SEQ ID NO: 734082 - protein, 21 aa, Mycobacterium
SRVTAWDELPAAVALARRHDP

SEQ ID NO: 734083 - protein, 17 aa, Mycobacterium
SRVTRQIHRLEVQGLVG

SEQ ID NO: 734084 - protein, 18 aa, Mycobacterium
SRVWPLLERRKAALADIG

SEQ ID NO: 734085 - protein, 19 aa, Mycobacterium
SRVWRFDRMATVCDPGSGR

SEQ ID NO: 734086 - protein, 18 aa, Mycobacterium
SRVYGMVMRVLRDSGYSE

SEQ ID NO: 734087 - protein, 21 aa, Mycobacterium
SRWGADMQLHVSAGIGTSPYA

SEQ ID NO: 734088 - protein, 25 aa, Mycobacterium
SRWGRAPMLHRLPCGLQQQPMLRVH

SEQ ID NO: 734089 - protein, 20 aa, Mycobacterium
SRWMPGKATVALDAYRAAWR

SEQ ID NO: 734090 - protein, 23 aa, Mycobacterium
SRWPETPSTYVLMRDDRAVGESW

SEQ ID NO: 734091 - protein, 18 aa, Mycobacterium
SRWSRRKPEAYARLEAAR

SEQ ID NO: 734092 - protein, 20 aa, Mycobacterium
SRWWKEERHGVFVDFNQNAK

SEQ ID NO: 734093 - protein, 20 aa, Mycobacterium
SRYAALGIRAPDGALASFVH

SEQ ID NO: 734094 - protein, 25 aa, Mycobacterium
SRYAEADKFFGFAAAEFGEHTDPAV

SEQ ID NO: 734095 - protein, 24 aa, Mycobacterium
SRYAEADKFFGFAGTEFGDIADSA

SEQ ID NO: 734096 - protein, 20 aa, Mycobacterium
SRYAGGWSDPEVMGEDPVIP

SEQ ID NO: 734097 - protein, 19 aa, Mycobacterium
SRYALAVQHERDLAMQSPW

SEQ ID NO: 734098 - protein, 24 aa, Mycobacterium
SRYAPEFLKISPLGTVGDDGTGIR

SEQ ID NO: 734099 - protein, 19 aa, Mycobacterium
SRYATALGAAELDAETSEG

SEQ ID NO: 734100 - protein, 19 aa, Mycobacterium
SRYATAMGAAELDAETTES

SEQ ID NO: 734101 - protein, 19 aa, Mycobacterium
SRYDYLVNMCDEMGIVTPE

SEQ ID NO: 734102 - protein, 18 aa, Mycobacterium
SRYEPVWKPETETTTLDL

SEQ ID NO: 734103 - protein, 24 aa, Mycobacterium
SRYFEAIPGVWARRSSEVAQSVVI

SEQ ID NO: 734104 - protein, 19 aa, Mycobacterium
SRYGAALGKEIVRTAGGVG

SEQ ID NO: 734105 - protein, 19 aa, Mycobacterium
SRYGAAVGKALVQDHNARA

SEQ ID NO: 734106 - protein, 23 aa, Mycobacterium
SRYGDSPAMRRIVIDADRILSDV

SEQ ID NO: 734107 - protein, 18 aa, Mycobacterium
SRYIPMLAGVGAARPAKD

SEQ ID NO: 734108 - protein, 20 aa, Mycobacterium
SRYKAAYFEHEWADGQAPGV

SEQ ID NO: 734109 - protein, 20 aa, Mycobacterium
SRYLAVLPFFHAAGLNSMTN

SEQ ID NO: 734110 - protein, 19 aa, Mycobacterium
SRYLTLIEGVRAVFVTGVH

SEQ ID NO: 734111 - protein, 22 aa, Mycobacterium
SRYMAFANVRGVAMVATSFDLR

SEQ ID NO: 734112 - protein, 19 aa, Mycobacterium
SRYRDGRALLLGDAAHVHS

SEQ ID NO: 734113 - protein, 20 aa, Mycobacterium
SRYRHWLTHKLATWHDQFGM

SEQ ID NO: 734114 - protein, 19 aa, Mycobacterium
SRYRHWLTHKLGTWHDQFD

SEQ ID NO: 734115 - protein, 20 aa, Mycobacterium
SRYRHWLTHKLGTWHDQFDM

SEQ ID NO: 734116 - protein, 20 aa, Mycobacterium
SRYTQARFAPAFGPGAALEY

SEQ ID NO: 734117 - protein, 20 aa, Mycobacterium
SRYVAVGAPLWSRAEGYHQL

SEQ ID NO: 734118 - protein, 24 aa, Mycobacterium
SRYWPADEYRPGVVQTSFDKQFVR

SEQ ID NO: 734119 - protein, 23 aa, Mycobacterium
SSAAGNFRLERAASVAAGATVAA

SEQ ID NO: 734120 - protein, 25 aa, Mycobacterium
SSAARAHGGWTVGVIPKMLVHRELA

SEQ ID NO: 734121 - protein, 32 aa, Mycobacterium
SSAAVALAWLRARPGTVVPIIGARRMEHLESN

SEQ ID NO: 734122 - protein, 21 aa, Mycobacterium
SSACALAATGMAAVMPTKRGG

SEQ ID NO: 734123 - protein, 28 aa, Mycobacterium
SSADNGLLEFTRLVSALRANHPVFRRRR

SEQ ID NO: 734124 - protein, 20 aa, Mycobacterium
SSADQVRWVLQDSAAVALFV

SEQ ID NO: 734125 - protein, 20 aa, Mycobacterium
SSADRPTALVSMNNAMTIGT

SEQ ID NO: 734126 - protein, 18 aa, Mycobacterium
SSAEAAAAAVLANPAQVV

SEQ ID NO: 734127 - protein, 17 aa, Mycobacterium
SSAEAYLQEALRWLPAD

SEQ ID NO: 734128 - protein, 26 aa, Mycobacterium
SSAEILKATFDWHIDGCTPLDDECPQ

SEQ ID NO: 734129 - protein, 21 aa, Mycobacterium
SSAEQVRWVLEDSGAVLAIAE

SEQ ID NO: 734130 - protein, 21 aa, Mycobacterium
SSAEQVRWVLEDSGAVLAVAE

SEQ ID NO: 734131 - protein, 20 aa, Mycobacterium
SSAEQVRWVLQDSGAVLAFA

SEQ ID NO: 734132 - protein, 24 aa, Mycobacterium
SSAFGPTGPWARRLGYGPLVRAAA

SEQ ID NO: 734133 - protein, 19 aa, Mycobacterium
SSAGARPAVLASTGNATAV

SEQ ID NO: 734134 - protein, 17 aa, Mycobacterium
SSAGLGIRETAGLVTDD

SEQ ID NO: 734135 - protein, 23 aa, Mycobacterium
SSAGQFAGWAIAKIMAGAAAMHS

SEQ ID NO: 734136 - protein, 21 aa, Mycobacterium
SSAGRAFKAAALGAAGITDVD

SEQ ID NO: 734137 - protein, 23 aa, Mycobacterium
SSAGRVAIAFGLAAPGDVDALYE

SEQ ID NO: 734138 - protein, 20 aa, Mycobacterium
SSAGSLRPSADIIPYAAAKA

SEQ ID NO: 734139 - protein, 18 aa, Mycobacterium
SSAIPFVFEPVRVRGATW

SEQ ID NO: 734140 - protein, 17 aa, Mycobacterium
SSAIPYVFEPVRVAGAT

SEQ ID NO: 734141 - protein, 21 aa, Mycobacterium
SSAKFNRKIIELNLIGALSVS

SEQ ID NO: 734142 - protein, 24 aa, Mycobacterium
SSAKRLVERARLIDVLRAQRDKKL

SEQ ID NO: 734143 - protein, 24 aa, Mycobacterium
SSALGIGMPSIYAAFGDKRQLFAE

SEQ ID NO: 734144 - protein, 18 aa, Mycobacterium
SSALRGRQLVDLEEIGER

SEQ ID NO: 734145 - protein, 17 aa, Mycobacterium
SSAPDWLDRGTIAHKSG

SEQ ID NO: 734146 - protein, 23 aa, Mycobacterium
SSAPDWLPRASVVHRSGTTTYPI

SEQ ID NO: 734147 - protein, 19 aa, Mycobacterium
SSAPDWLPRGSVTHRSGTT

SEQ ID NO: 734148 - protein, 28 aa, Mycobacterium
SSAPGWRSPRAAAWTRRWRRCGRSRSVR

SEQ ID NO: 734149 - protein, 20 aa, Mycobacterium
SSAPIRPAAATTRAAAKTGP

SEQ ID NO: 734150 - protein, 24 aa, Mycobacterium
SSAQRFMTLDAFLAAGFHVVAMLN

SEQ ID NO: 734151 - protein, 23 aa, Mycobacterium
SSAQRGSPFAAHYAASKGAVITL

SEQ ID NO: 734152 - protein, 24 aa, Mycobacterium
SSAQRLLTLDAFVAAGFHVVALLN

SEQ ID NO: 734153 - protein, 23 aa, Mycobacterium
SSARIGTAVAQHFSAQHWPIPQV

SEQ ID NO: 734154 - protein, 28 aa, Mycobacterium
SSARLPADLLDKWGIRVVPLHILLDGTD

SEQ ID NO: 734155 - protein, 21 aa, Mycobacterium
SSARLTGGIVGYRIPEIRPAQ

SEQ ID NO: 734156 - protein, 20 aa, Mycobacterium
SSARMAKLLSVLPEKQREIL

SEQ ID NO: 734157 - protein, 17 aa, Mycobacterium
SSARRLAIPELPDELFI

SEQ ID NO: 734158 - protein, 17 aa, Mycobacterium
SSARRLAIPELPEELFM

SEQ ID NO: 734159 - protein, 22 aa, Mycobacterium
SSARRYQCITVPTLVVEGRNDK

SEQ ID NO: 734160 - protein, 23 aa, Mycobacterium
SSASRLFYRNGIHATGVEALIQH

SEQ ID NO: 734161 - protein, 18 aa, Mycobacterium
SSATRVAVYFDFDNIVIS

SEQ ID NO: 734162 - protein, 27 aa, Mycobacterium
SSAVAGGRLGGFVIPGLSIGNRGLLNL

SEQ ID NO: 734163 - protein, 28 aa, Mycobacterium
SSAVAGLSGLVWSGPSSMLMTAAVTPYV

SEQ ID NO: 734164 - protein, 21 aa, Mycobacterium
SSAVFLQHPWQVLPAELISPI

SEQ ID NO: 734165 - protein, 17 aa, Mycobacterium
SSAVFLQYPWQVLPEEL

SEQ ID NO: 734166 - protein, 24 aa, Mycobacterium
SSAVLRYAHCPVVIVHDEDPSAAQ

SEQ ID NO: 734167 - protein, 17 aa, Mycobacterium
SSAVMRRELGDMFVDYL

SEQ ID NO: 734168 - protein, 22 aa, Mycobacterium
SSAYAMGLLFALDRRDARDELA

SEQ ID NO: 734169 - protein, 22 aa, Mycobacterium
SSCSYLGLEFHRALIDGMTDAG

SEQ ID NO: 734170 - protein, 24 aa, Mycobacterium
SSCTGLPGCGRSRTDVHADVRLEV

SEQ ID NO: 734171 - protein, 24 aa, Mycobacterium
SSDEHPHCRWTVIIDESYPEVPFI

SEQ ID NO: 734172 - protein, 25 aa, Mycobacterium
SSDENGVRWIVGFNHDRDPGATYLY

SEQ ID NO: 734173 - protein, 25 aa, Mycobacterium
SSDFERIRHEFGFPGDDQVLAKCFL

SEQ ID NO: 734174 - protein, 25 aa, Mycobacterium
SSDFERIRHEFGFPGDDRVVAKCFL

SEQ ID NO: 734175 - protein, 20 aa, Mycobacterium
SSDGGALVRIIAGEIGGEQG

SEQ ID NO: 734176 - protein, 19 aa, Mycobacterium
SSDGLQFWLDQLGGPDPAL

SEQ ID NO: 734177 - protein, 20 aa, Mycobacterium
SSDLQRWLPLDVNRPLKSTL

SEQ ID NO: 734178 - protein, 17 aa, Mycobacterium
SSDRARSASSPGADAEL

SEQ ID NO: 734179 - protein, 21 aa, Mycobacterium
SSDRIPKWLLPVVHDNLRTGG

SEQ ID NO: 734180 - protein, 24 aa, Mycobacterium
SSDRIPKWLVPVIRENLKTGAPIR

SEQ ID NO: 734181 - protein, 26 aa, Mycobacterium
SSDSRFRPEFCTSMTAFITAEYALLE

SEQ ID NO: 734182 - protein, 23 aa, Mycobacterium
SSDYATYFDIDWDLDEDGRIVLP

SEQ ID NO: 734183 - protein, 19 aa, Mycobacterium
SSEALVPWSIEYGTETFGI

SEQ ID NO: 734184 - protein, 25 aa, Mycobacterium
SSEARLLHVAPLFHLADLAAWAGQT

SEQ ID NO: 734185 - protein, 21 aa, Mycobacterium
SSEATATVMLGMYLSVQPINL

SEQ ID NO: 734186 - protein, 24 aa, Mycobacterium
SSEFAGRAIHEWSAQVFRDDEGTI

SEQ ID NO: 734187 - protein, 24 aa, Mycobacterium
SSEILHTGAIFALRRDRVRMPGDT

SEQ ID NO: 734188 - protein, 18 aa, Mycobacterium
SSEIMRLLIAREAVDAHL

SEQ ID NO: 734189 - protein, 19 aa, Mycobacterium
SSEIMRLLIAREAVDAHLA

SEQ ID NO: 734190 - protein, 19 aa, Mycobacterium
SSEIMRLLIAREAVDAHLT

SEQ ID NO: 734191 - protein, 18 aa, Mycobacterium
SSELCLRLINGLEVSMAY

SEQ ID NO: 734192 - protein, 32 aa, Mycobacterium
SSELPRHIAVLCDGNRRWARDAGYDDVSYGYR

SEQ ID NO: 734193 - protein, 25 aa, Mycobacterium
SSELRAVWLGFMQKWIDQTAALINA

SEQ ID NO: 734194 - protein, 23 aa, Mycobacterium
SSEMQLHLACYRAFDDIGSVIHS

SEQ ID NO: 734195 - protein, 20 aa, Mycobacterium
SSEPALRTAYLMVHDQMERG

SEQ ID NO: 734196 - protein, 24 aa, Mycobacterium
SSEPIAIVGMSCRFPGGVDSPEGL

SEQ ID NO: 734197 - protein, 25 aa, Mycobacterium
SSEPIAIVGMSCRFPGGVDSPESLW

SEQ ID NO: 734198 - protein, 27 aa, Mycobacterium
SSEQRLRIGEAWGKLPQEWIEQYEANH

SEQ ID NO: 734199 - protein, 23 aa, Mycobacterium
SSERRRVAILGGNRIPFARSDGA

SEQ ID NO: 734200 - protein, 19 aa, Mycobacterium
SSETIILTVRWQQDGQPTE

SEQ ID NO: 734201 - protein, 22 aa, Mycobacterium
SSEWLSGHGWLAKTTTGRELAD

SEQ ID NO: 734202 - protein, 39 aa, Mycobacterium
SSFAPRPRMLVFGAIDFAAALARQGSFLGYRVTVCDARA

SEQ ID NO: 734203 - protein, 23 aa, Mycobacterium
SSFESSFRYRSATLFGTFEVIAD

SEQ ID NO: 734204 - protein, 24 aa, Mycobacterium
SSFKEAHVRLVLRSGVTDIDEIRA

SEQ ID NO: 734205 - protein, 24 aa, Mycobacterium
SSFMFRDLIPLLARNHRVIAPDHL

SEQ ID NO: 734206 - protein, 23 aa, Mycobacterium
SSFPAALRKARTVLSDFSIEGIA

SEQ ID NO: 734207 - protein, 19 aa, Mycobacterium
SSFQLHWAPSVRPEAGVVL

SEQ ID NO: 734208 - protein, 19 aa, Mycobacterium
SSFQLHWAPSVRPVAGAVL

SEQ ID NO: 734209 - protein, 19 aa, Mycobacterium
SSFRQWATMLVDYAYDPAV

SEQ ID NO: 734210 - protein, 28 aa, Mycobacterium
SSFSELCARAGLDLVLDCHPVLADVDPD

SEQ ID NO: 734211 - protein, 23 aa, Mycobacterium
SSFSMNWKFTREFMPVRFEVDEP

SEQ ID NO: 734212 - protein, 24 aa, Mycobacterium
SSFTDDFVLYWGLMALAQVRSGRL

SEQ ID NO: 734213 - protein, 20 aa, Mycobacterium
SSFWIGPRVAITSLSMHARV

SEQ ID NO: 734214 - protein, 27 aa, Mycobacterium
SSGADGEWSRAAVLFRDAARLTAAPLL

SEQ ID NO: 734215 - protein, 26 aa, Mycobacterium
SSGAIELTGAWPGLRCDVDTPTDLAA

SEQ ID NO: 734216 - protein, 24 aa, Mycobacterium
SSGARPSALLLPLGPLAEHNVRTT

SEQ ID NO: 734217 - protein, 24 aa, Mycobacterium
SSGAYCLTCGAPLSDPGDIIRDVR

SEQ ID NO: 734218 - protein, 28 aa, Mycobacterium
SSGDFPVLWPVLTRWADNDMFGHLNNAV

SEQ ID NO: 734219 - protein, 23 aa, Mycobacterium
SSGDRLGLPLACGLDVTNRQSFT

SEQ ID NO: 734220 - protein, 19 aa, Mycobacterium
SSGEARVLVATDIAARGVH

SEQ ID NO: 734221 - protein, 23 aa, Mycobacterium
SSGEIPKAFVVRTDDDLTDEAVM

SEQ ID NO: 734222 - protein, 18 aa, Mycobacterium
SSGFPVNLLSYLAQNTSA

SEQ ID NO: 734223 - protein, 25 aa, Mycobacterium
SSGFTPTELMRWVHPGLVASTQGTG

SEQ ID NO: 734224 - protein, 24 aa, Mycobacterium
SSGFTPTELMRWVHPSQVASTQGT

SEQ ID NO: 734225 - protein, 17 aa, Mycobacterium
SSGGLALENAAEYAGTG

SEQ ID NO: 734226 - protein, 26 aa, Mycobacterium
SSGGPLAAGLLDWQAVRLGHPARDLA

SEQ ID NO: 734227 - protein, 18 aa, Mycobacterium
SSGIGFGCATKLAEAGMA

SEQ ID NO: 734228 - protein, 35 aa, Mycobacterium
SSGKAARFVKRFADLGGELRRAATQYAQEVAGGVF

SEQ ID NO: 734229 - protein, 23 aa, Mycobacterium
SSGKSIRAALAFGAASACGDARA

SEQ ID NO: 734230 - protein, 26 aa, Mycobacterium
SSGLGRCIGVGLARRGDDVALLARRL

SEQ ID NO: 734231 - protein, 20 aa, Mycobacterium
SSGLLTVHLACRSLHEGESD

SEQ ID NO: 734232 - protein, 25 aa, Mycobacterium
SSGLPQPRRVAVLSVHTSPLAQPGT

SEQ ID NO: 734233 - protein, 23 aa, Mycobacterium
SSGLTAIHLACRSLHERESDLAL

SEQ ID NO: 734234 - protein, 22 aa, Mycobacterium
SSGMAAADCALRAMLRPGDHVV

SEQ ID NO: 734235 - protein, 17 aa, Mycobacterium
SSGMAATDCVLRAVLRP

SEQ ID NO: 734236 - protein, 19 aa, Mycobacterium
SSGNLLYLLLTHRDQFDAV

SEQ ID NO: 734237 - protein, 17 aa, Mycobacterium
SSGPQGAFGFRHNPMLL

SEQ ID NO: 734238 - protein, 22 aa, Mycobacterium
SSGPRPSVRIEPNYLGSEHDRT

SEQ ID NO: 734239 - protein, 17 aa, Mycobacterium
SSGQRPGRIGADTEASS

SEQ ID NO: 734240 - protein, 17 aa, Mycobacterium
SSGRCVATATDGPTPKN

SEQ ID NO: 734241 - protein, 18 aa, Mycobacterium
SSGRLRSELDVVPPGDLR

SEQ ID NO: 734242 - protein, 17 aa, Mycobacterium
SSGRRFTLVKADIQAPE

SEQ ID NO: 734243 - protein, 25 aa, Mycobacterium
SSGRRVAVCLGTAAAIFGFDTEQPR

SEQ ID NO: 734244 - protein, 17 aa, Mycobacterium
SSGSSMHFGLTGCRTSV

SEQ ID NO: 734245 - protein, 19 aa, Mycobacterium
SSGYIGFFLCPVVPELFFR

SEQ ID NO: 734246 - protein, 17 aa, Mycobacterium
SSHFGYGILTWHLPMLF

SEQ ID NO: 734247 - protein, 37 aa, Mycobacterium
SSHGQGYQVLSARALEFHTRLAQALSAGAGAYSGAEA

SEQ ID NO: 734248 - protein, 26 aa, Mycobacterium
SSHGTTFSGLADFIGPVGNSVNINGW

SEQ ID NO: 734249 - protein, 17 aa, Mycobacterium
SSHGVVVVTGRRNAYQG

SEQ ID NO: 734250 - protein, 30 aa, Mycobacterium
SSHKEVLLHLSAEGWVRWSTTVSEKLAEPG

SEQ ID NO: 734251 - protein, 20 aa, Mycobacterium
SSHQPLLHRVWELQHVLTAY

SEQ ID NO: 734252 - protein, 25 aa, Mycobacterium
SSHRAFCNQLLWRRDEFGLGGDDAL

SEQ ID NO: 734253 - protein, 18 aa, Mycobacterium
SSHRARLAELLDMAGESG

SEQ ID NO: 734254 - protein, 20 aa, Mycobacterium
SSHRWTVGLVMSRCRAGSPC

SEQ ID NO: 734255 - protein, 17 aa, Mycobacterium
SSIAAVWGGYGQTAYSA

SEQ ID NO: 734256 - protein, 43 aa, Mycobacterium
SSIADLRAIPWVLAWSQSRVMLPGWYGAGTAFERWIAAGPEGE

SEQ ID NO: 734257 - protein, 18 aa, Mycobacterium
SSIAHCPTSQLFLGSGTM

SEQ ID NO: 734258 - protein, 19 aa, Mycobacterium
SSIARRFSDMAGLVDTFAA

SEQ ID NO: 734259 - protein, 20 aa, Mycobacterium
SSIDHWGRYAYANQPVVAGW

SEQ ID NO: 734260 - protein, 20 aa, Mycobacterium
SSIDHWGRYAYGNQPVVAGW

SEQ ID NO: 734261 - protein, 21 aa, Mycobacterium
SSIDILIDFTIANRRLIRYLA

SEQ ID NO: 734262 - protein, 20 aa, Mycobacterium
SSIDSWGRYAYGNQPSIALW

SEQ ID NO: 734263 - protein, 24 aa, Mycobacterium
SSIDVRLDCMFRVFNNTRYTHIDP

SEQ ID NO: 734264 - protein, 26 aa, Mycobacterium
SSIEGLRGAAWVHGYVTSKWAVRGLT

SEQ ID NO: 734265 - protein, 24 aa, Mycobacterium
SSIIADVRARFVLTTAEVQAKVKG

SEQ ID NO: 734266 - protein, 26 aa, Mycobacterium
SSIKELCRRWYPRIYFGQPEKGLAHR

SEQ ID NO: 734267 - protein, 23 aa, Mycobacterium
SSIKSIAVIGGRADVGVISGGGS

SEQ ID NO: 734268 - protein, 17 aa, Mycobacterium
SSIPIAIRSGLGPISIV

SEQ ID NO: 734269 - protein, 21 aa, Mycobacterium
SSIRHSIGIWPLVIDDATIVE

SEQ ID NO: 734270 - protein, 20 aa, Mycobacterium
SSIRSAAQVQGWNRRLRCVE

SEQ ID NO: 734271 - protein, 22 aa, Mycobacterium
SSISRACVAREFAAFATNKQRP

SEQ ID NO: 734272 - protein, 21 aa, Mycobacterium
SSITDAARWASIERVVEPRPE

SEQ ID NO: 734273 - protein, 17 aa, Mycobacterium
SSITQQRVRVMSQLDAI

SEQ ID NO: 734274 - protein, 20 aa, Mycobacterium
SSIVPEFGELQVLEGFDDGA

SEQ ID NO: 734275 - protein, 27 aa, Mycobacterium
SSKELYEIRKLFGVMFQDGALFGSMNL

SEQ ID NO: 734276 - protein, 26 aa, Mycobacterium
SSKEQLWYAAVDWGFQAIIDKVLADD

SEQ ID NO: 734277 - protein, 33 aa, Mycobacterium
SSKGGVVGLTLPVARDLAAVGIRVNTVAPGLID

SEQ ID NO: 734278 - protein, 30 aa, Mycobacterium
SSKGGVVGLTLPVARDLSAVGIRVNTVAPG

SEQ ID NO: 734279 - protein, 18 aa, Mycobacterium
SSKGKGSMIIGCDTLPIL

SEQ ID NO: 734280 - protein, 20 aa, Mycobacterium
SSKNQSRWQFGVLGPPGAAD

SEQ ID NO: 734281 - protein, 24 aa, Mycobacterium
SSKPSDGALDYVIMNAVVIDAVAG

SEQ ID NO: 734282 - protein, 24 aa, Mycobacterium
SSKVELYLAVLQRHVDNLVSGVRQ

SEQ ID NO: 734283 - protein, 31 aa, Mycobacterium
SSKVGIIAGCMISSGVVRRNAKARLLRDNVV

SEQ ID NO: 734284 - protein, 32 aa, Mycobacterium
SSKVGIIAGCMISSGVVRRNAKARLLRDNVVV

SEQ ID NO: 734285 - protein, 31 aa, Mycobacterium
SSKVGLIAGCMISSGVVRRNAKARLLRDNIV

SEQ ID NO: 734286 - protein, 27 aa, Mycobacterium
SSKVIARPGTRRVYSNYGFTVLAETIE

SEQ ID NO: 734287 - protein, 20 aa, Mycobacterium
SSLAFYRDILGFEVRLDVGK

SEQ ID NO: 734288 - protein, 18 aa, Mycobacterium
SSLAGRALAATTFGSAGS

SEQ ID NO: 734289 - protein, 19 aa, Mycobacterium
SSLAGRAMGASTFGSSSGG

SEQ ID NO: 734290 - protein, 23 aa, Mycobacterium
SSLAGRAVAAAATRPVGGAATAM

SEQ ID NO: 734291 - protein, 24 aa, Mycobacterium
SSLAPRAALGVGISLGHLTMPPAT

SEQ ID NO: 734292 - protein, 27 aa, Mycobacterium
SSLASFEGQLGKWARMDADLIAEHASG

SEQ ID NO: 734293 - protein, 23 aa, Mycobacterium
SSLDELAKRLIVLVEPVEAIVDR

SEQ ID NO: 734294 - protein, 29 aa, Mycobacterium
SSLDQGGPCARTVLDTALLHQVIAGHDHR

SEQ ID NO: 734295 - protein, 30 aa, Mycobacterium
SSLDQGGPCARTVLDTALLHQVIAGHDPRD

SEQ ID NO: 734296 - protein, 29 aa, Mycobacterium
SSLDQGGPCARTVLDTALLHQVIAGHDTR

SEQ ID NO: 734297 - protein, 25 aa, Mycobacterium
SSLDQGGPCARTVLDTAMLHQVIAG

SEQ ID NO: 734298 - protein, 17 aa, Mycobacterium
SSLFGDTHAHGMEGVNF

SEQ ID NO: 734299 - protein, 19 aa, Mycobacterium
SSLKPLSGLLHLHSDAAQP

SEQ ID NO: 734300 - protein, 23 aa, Mycobacterium
SSLLRLLAGLDRPDAGRVELDGR

SEQ ID NO: 734301 - protein, 18 aa, Mycobacterium
SSLLRRVRVLNRETGRVR

SEQ ID NO: 734302 - protein, 18 aa, Mycobacterium
SSLLRSGAAAGFTVVALD

SEQ ID NO: 734303 - protein, 22 aa, Mycobacterium
SSLNMHDLWTLRGVGHPADRLP

SEQ ID NO: 734304 - protein, 20 aa, Mycobacterium
SSLPDLLPLLEKVAESGKPL

SEQ ID NO: 734305 - protein, 21 aa, Mycobacterium
SSLPKLAGRAIDVRWDAPHSG

SEQ ID NO: 734306 - protein, 30 aa, Mycobacterium
SSLPRNGRWNALARLALREDLYRSLRDLAR

SEQ ID NO: 734307 - protein, 17 aa, Mycobacterium
SSLPTRPAASILGGVLV

SEQ ID NO: 734308 - protein, 25 aa, Mycobacterium
SSLPVPALRAAIERAFSSESVAHIS

SEQ ID NO: 734309 - protein, 25 aa, Mycobacterium
SSLQTLSECPLRWLTERHGGAKPRE

SEQ ID NO: 734310 - protein, 19 aa, Mycobacterium
SSLQTSRMAFHAIKAGEGD

SEQ ID NO: 734311 - protein, 19 aa, Mycobacterium
SSLRADWFARDSSAIEAGR

SEQ ID NO: 734312 - protein, 22 aa, Mycobacterium
SSLRDIVKVTVYLTDIRYRETV

SEQ ID NO: 734313 - protein, 19 aa, Mycobacterium
SSLREAFGHFPSGVVAIAA

SEQ ID NO: 734314 - protein, 22 aa, Mycobacterium
SSLRGEARLVFTAHSIPLAADR

SEQ ID NO: 734315 - protein, 27 aa, Mycobacterium
SSLRLVACGGSAVPLSLMRAFEEKYDV

SEQ ID NO: 734316 - protein, 27 aa, Mycobacterium
SSLRLVACGGSAVPLSLMRAFEEKYNV

SEQ ID NO: 734317 - protein, 22 aa, Mycobacterium
SSLRLVACGGSAVPRSLMEHFE

SEQ ID NO: 734318 - protein, 23 aa, Mycobacterium
SSLRLVVCGGSAVPVSLMRTFEE

SEQ ID NO: 734319 - protein, 25 aa, Mycobacterium
SSLRRIPLAELRRTGLLDKLLLLAG

SEQ ID NO: 734320 - protein, 18 aa, Mycobacterium
SSLSVRAAMMAVAGGEGS

SEQ ID NO: 734321 - protein, 23 aa, Mycobacterium
SSLTELFAQIGMRQEPSHDDGFA

SEQ ID NO: 734322 - protein, 27 aa, Mycobacterium
SSLTVFSGYRFLRHAAARGIPVAIINR

SEQ ID NO: 734323 - protein, 30 aa, Mycobacterium
SSLTVFSGYRFVRHAAALGIPVAIINRGST

SEQ ID NO: 734324 - protein, 34 aa, Mycobacterium
SSLTVFSGYRFVRHAAALGRPVAIVNRGRTRGDD

SEQ ID NO: 734325 - protein, 27 aa, Mycobacterium
SSLTVFSGYRFVRHAAARGIPVGIVNR

SEQ ID NO: 734326 - protein, 23 aa, Mycobacterium
SSLVAFHLACQGIANGDCDMALA

SEQ ID NO: 734327 - protein, 19 aa, Mycobacterium
SSLVALHLAVQALRSGECD

SEQ ID NO: 734328 - protein, 17 aa, Mycobacterium
SSLVATHLACQSLRNGE

SEQ ID NO: 734329 - protein, 17 aa, Mycobacterium
SSLVAVHLACLSLLSGE

SEQ ID NO: 734330 - protein, 21 aa, Mycobacterium
SSLVREAHVVLSASRPGSAGI

SEQ ID NO: 734331 - protein, 19 aa, Mycobacterium
SSLVSIHLACQSLRMRESD

SEQ ID NO: 734332 - protein, 20 aa, Mycobacterium
SSLVTLNFGDMWDRWTPVSA

SEQ ID NO: 734333 - protein, 27 aa, Mycobacterium
SSLYYPDFPRFLGEVARVLRPGGHFLY

SEQ ID NO: 734334 - protein, 20 aa, Mycobacterium
SSMFPGSFGGDLFARQMEIS

SEQ ID NO: 734335 - protein, 19 aa, Mycobacterium
SSMGLELVGSATLNRDPEG

SEQ ID NO: 734336 - protein, 21 aa, Mycobacterium
SSMNAMMWVRGFKADYDEWAR

SEQ ID NO: 734337 - protein, 17 aa, Mycobacterium
SSMPDPVKIILQALQGF

SEQ ID NO: 734338 - protein, 19 aa, Mycobacterium
SSMRSRPALRDQVAAALHG

SEQ ID NO: 734339 - protein, 18 aa, Mycobacterium
SSMRSVVMPVHLTSRPFH

SEQ ID NO: 734340 - protein, 25 aa, Mycobacterium
SSMSRVAGIFGTFADHLAKTLMTPQ

SEQ ID NO: 734341 - protein, 21 aa, Mycobacterium
SSMVLVSPWLDVGMTNPNIAL

SEQ ID NO: 734342 - protein, 18 aa, Mycobacterium
SSMWAGPLCGRLLSDAGA

SEQ ID NO: 734343 - protein, 19 aa, Mycobacterium
SSNCPARPGGAVAPTGAQV

SEQ ID NO: 734344 - protein, 17 aa, Mycobacterium
SSNFMLWQSAYAEYIFQ

SEQ ID NO: 734345 - protein, 18 aa, Mycobacterium
SSNGALFLVLRPLLVDYV

SEQ ID NO: 734346 - protein, 19 aa, Mycobacterium
SSNGAPFLVLRPLLVDYVM

SEQ ID NO: 734347 - protein, 17 aa, Mycobacterium
SSNLEWVILRLGGVISV

SEQ ID NO: 734348 - protein, 19 aa, Mycobacterium
SSNNFGFGNWGPMNMGSGN

SEQ ID NO: 734349 - protein, 26 aa, Mycobacterium
SSNTEGRTDVKLVLQDDRNLVLYSGA

SEQ ID NO: 734350 - protein, 18 aa, Mycobacterium
SSNTHRWFGAYGPSKAAL

SEQ ID NO: 734351 - protein, 20 aa, Mycobacterium
SSPAEYRAQVSLRSPSASTD

SEQ ID NO: 734352 - protein, 20 aa, Mycobacterium
SSPARARRAGVVGYMPQSEA

SEQ ID NO: 734353 - protein, 22 aa, Mycobacterium
SSPARCPRSMVSRSSRGRMSSA

SEQ ID NO: 734354 - protein, 24 aa, Mycobacterium
SSPDARIGFVLGDAEPVVALSTAA

SEQ ID NO: 734355 - protein, 19 aa, Mycobacterium
SSPDEALIFHRGQFVGTAT

SEQ ID NO: 734356 - protein, 21 aa, Mycobacterium
SSPDHLIGWTIARSDRDELVL

SEQ ID NO: 734357 - protein, 21 aa, Mycobacterium
SSPDRFLVGLAVLNLLADAAA

SEQ ID NO: 734358 - protein, 17 aa, Mycobacterium
SSPEEYEHDLAHAETSL

SEQ ID NO: 734359 - protein, 28 aa, Mycobacterium
SSPGAVWKNAGLEWDYYDMKNIPWSQLR

SEQ ID NO: 734360 - protein, 26 aa, Mycobacterium
SSPGFSWQPLHTMPGISTFYTFYDDV

SEQ ID NO: 734361 - protein, 24 aa, Mycobacterium
SSPHLDRLAAEGILFTRAHATAPL

SEQ ID NO: 734362 - protein, 30 aa, Mycobacterium
SSPIVVGALPFDLSRPAALMRPQSVRFTDV

SEQ ID NO: 734363 - protein, 19 aa, Mycobacterium
SSPLQSWRPHITGEIHCYA

SEQ ID NO: 734364 - protein, 24 aa, Mycobacterium
SSPLRARRVVVCVDDDAGRAMAAR

SEQ ID NO: 734365 - protein, 25 aa, Mycobacterium
SSPLRPWPGFVPMIYDRYSQPFFDG

SEQ ID NO: 734366 - protein, 19 aa, Mycobacterium
SSPMCYPAGDFIVGDRDVL

SEQ ID NO: 734367 - protein, 19 aa, Mycobacterium
SSPMDVLWFRLNRRPGDPN

SEQ ID NO: 734368 - protein, 30 aa, Mycobacterium
SSPNEIAHILVLRSKFDGGFTSEVRGVFTY

SEQ ID NO: 734369 - protein, 32 aa, Mycobacterium
SSPNEIAHILVLRSRFPGGFTSEVRGIFTYRV

SEQ ID NO: 734370 - protein, 26 aa, Mycobacterium
SSPPDCTPWVIGGLWPTELSRDAPET

SEQ ID NO: 734371 - protein, 20 aa, Mycobacterium
SSPPGRRLLERTARDGHRIG

SEQ ID NO: 734372 - protein, 23 aa, Mycobacterium
SSPRARLEACLAPVTSSLSRLGS

SEQ ID NO: 734373 - protein, 17 aa, Mycobacterium
SSPRRRALQTAELAGLT

SEQ ID NO: 734374 - protein, 23 aa, Mycobacterium
SSPRVLADLFWLGRYAERAESTA

SEQ ID NO: 734375 - protein, 23 aa, Mycobacterium
SSPRVLSDLFWIGRYAERAEHTA

SEQ ID NO: 734376 - protein, 17 aa, Mycobacterium
SSPRVLSDLFWMGRYGE

SEQ ID NO: 734377 - protein, 21 aa, Mycobacterium
SSPRVWRWDDYVLDLGRYELR

SEQ ID NO: 734378 - protein, 17 aa, Mycobacterium
SSPTHWNKNVFDMGEVG

SEQ ID NO: 734379 - protein, 26 aa, Mycobacterium
SSPTSWPALRAFAAPGHVVYGSDWPF

SEQ ID NO: 734380 - protein, 21 aa, Mycobacterium
SSPVPLAISPRGYRGSRAGTV

SEQ ID NO: 734381 - protein, 28 aa, Mycobacterium
SSQAGCGMACPFCATGQGGLTRNLSAAE

SEQ ID NO: 734382 - protein, 17 aa, Mycobacterium
SSQAGFDRSGIWRDGVY

SEQ ID NO: 734383 - protein, 23 aa, Mycobacterium
SSQGHAPNAWAVLGAVAQATERV

SEQ ID NO: 734384 - protein, 24 aa, Mycobacterium
SSQLANRLMRWTGFSPDKVARICL

SEQ ID NO: 734385 - protein, 25 aa, Mycobacterium
SSQLTGIRFERCYAQQLPYADGEFD

SEQ ID NO: 734386 - protein, 18 aa, Mycobacterium
SSQQGRWNTAPEYDRVAV

SEQ ID NO: 734387 - protein, 19 aa, Mycobacterium
SSQRGWVFLATELTEGDHE

SEQ ID NO: 734388 - protein, 17 aa, Mycobacterium
SSQRLARLVGRQQALGL

SEQ ID NO: 734389 - protein, 17 aa, Mycobacterium
SSQRWVLSNALWVFGVD

SEQ ID NO: 734390 - protein, 26 aa, Mycobacterium
SSREIEVLEFIPAAELDPLMYDKSYY

SEQ ID NO: 734391 - protein, 18 aa, Mycobacterium
SSRFPIRQPFAGGLEAHV

SEQ ID NO: 734392 - protein, 23 aa, Mycobacterium
SSRGKGVLVSPTIYGNVMVGPTS

SEQ ID NO: 734393 - protein, 21 aa, Mycobacterium
SSRGSRALRSIPVTEHATVVQ

SEQ ID NO: 734394 - protein, 21 aa, Mycobacterium
SSRGVANFLVLRTRRDGSRNG

SEQ ID NO: 734395 - protein, 23 aa, Mycobacterium
SSRHPRSLRVCTLLRKPDAKGAN

SEQ ID NO: 734396 - protein, 18 aa, Mycobacterium
SSRIDPRSTGSFWELTAD

SEQ ID NO: 734397 - protein, 25 aa, Mycobacterium
SSRLGLLKRREEVLPQLTHNDQLLV

SEQ ID NO: 734398 - protein, 22 aa, Mycobacterium
SSRLIRLPMWVGLQEADQNRVV

SEQ ID NO: 734399 - protein, 18 aa, Mycobacterium
SSRLIRYRLMNGQTTTLN

SEQ ID NO: 734400 - protein, 22 aa, Mycobacterium
SSRLKIAGIDLAELTLPTPPPP

SEQ ID NO: 734401 - protein, 18 aa, Mycobacterium
SSRPSCPSQPSSTPRTTT

SEQ ID NO: 734402 - protein, 24 aa, Mycobacterium
SSRRARAVPVYAALRSLGRAGLAD

SEQ ID NO: 734403 - protein, 20 aa, Mycobacterium
SSRVYAAPATAWGSSGDTTL

SEQ ID NO: 734404 - protein, 17 aa, Mycobacterium
SSRWRRATFYASRGRCG

SEQ ID NO: 734405 - protein, 19 aa, Mycobacterium
SSRYWPADEYRAGVVQNSF

SEQ ID NO: 734406 - protein, 18 aa, Mycobacterium
SSSANGWEKLEQDVKKGI

SEQ ID NO: 734407 - protein, 18 aa, Mycobacterium
SSSARSALIVNIQNAAGQ

SEQ ID NO: 734408 - protein, 23 aa, Mycobacterium
SSSCPQCSGRGILLHADPVDAAP

SEQ ID NO: 734409 - protein, 25 aa, Mycobacterium
SSSDPTAKCVQDFVSSTAASNMAAS

SEQ ID NO: 734410 - protein, 21 aa, Mycobacterium
SSSGHPWWTLSQLSEESATEL

SEQ ID NO: 734411 - protein, 31 aa, Mycobacterium
SSSGSARATCHRAGGADLALAAVPAVTTVAA

SEQ ID NO: 734412 - protein, 21 aa, Mycobacterium
SSSHKLIFRATVDDLENTASR

SEQ ID NO: 734413 - protein, 18 aa, Mycobacterium
SSSKGRYLKKVVVSTTTG

SEQ ID NO: 734414 - protein, 21 aa, Mycobacterium
SSSKPRADFHTRLKSMQDAIT

SEQ ID NO: 734415 - protein, 19 aa, Mycobacterium
SSSLLAVHMACRSLDGGES

SEQ ID NO: 734416 - protein, 18 aa, Mycobacterium
SSSLLNWTRNMLAVRSRH

SEQ ID NO: 734417 - protein, 24 aa, Mycobacterium
SSSLLPRWGAGTLVVATSATGGSV

SEQ ID NO: 734418 - protein, 22 aa, Mycobacterium
SSSLSAIHLACQSLRLRETDLA

SEQ ID NO: 734419 - protein, 20 aa, Mycobacterium
SSSLSAIHMACRSLHDGESD

SEQ ID NO: 734420 - protein, 20 aa, Mycobacterium
SSSLVAIHLACQSLRLRETD

SEQ ID NO: 734421 - protein, 20 aa, Mycobacterium
SSSLVAIHLACQSLRMGDSD

SEQ ID NO: 734422 - protein, 20 aa, Mycobacterium
SSSLVAIHLACQSLRMQDSN

SEQ ID NO: 734423 - protein, 21 aa, Mycobacterium
SSSLVAIHLACQSLRWRETDM

SEQ ID NO: 734424 - protein, 20 aa, Mycobacterium
SSSLVALHLACQSLRLRESD

SEQ ID NO: 734425 - protein, 25 aa, Mycobacterium
SSSLVALHLACRSLHDRECTLAVVA

SEQ ID NO: 734426 - protein, 24 aa, Mycobacterium
SSSLVCDRVRGGVRGADDSDVVSS

SEQ ID NO: 734427 - protein, 19 aa, Mycobacterium
SSSLVSIHLACQSLRRGES

SEQ ID NO: 734428 - protein, 24 aa, Mycobacterium
SSSPDEIAHILVLNSKFEGGLTSS

SEQ ID NO: 734429 - protein, 25 aa, Mycobacterium
SSSPDEIAHILVLQSKFEGGVTSKV

SEQ ID NO: 734430 - protein, 17 aa, Mycobacterium
SSSPLVNVYGWMQTRGP

SEQ ID NO: 734431 - protein, 22 aa, Mycobacterium
SSSRILGRRALEIQAYDELCFP

SEQ ID NO: 734432 - protein, 31 aa, Mycobacterium
SSSRLSRQLCERWGIRQVPLHILDGDNDLRD

SEQ ID NO: 734433 - protein, 17 aa, Mycobacterium
SSSRYLAVLPFFHAAGL

SEQ ID NO: 734434 - protein, 18 aa, Mycobacterium
SSSSPGYEGADGGNGGNG

SEQ ID NO: 734435 - protein, 19 aa, Mycobacterium
SSSWLNLVERWFAELTTKK

SEQ ID NO: 734436 - protein, 19 aa, Mycobacterium
SSTAGFGWPERLNLIRDLL

SEQ ID NO: 734437 - protein, 28 aa, Mycobacterium
SSTAHRLLAMLAYRGFVRQDPVSKAYLP

SEQ ID NO: 734438 - protein, 23 aa, Mycobacterium
SSTARLAAQAPWWEPGSASGYHA

SEQ ID NO: 734439 - protein, 20 aa, Mycobacterium
SSTDRYLCINPFFHNFGYKA

SEQ ID NO: 734440 - protein, 19 aa, Mycobacterium
SSTEAKALAALILAVLRGM

SEQ ID NO: 734441 - protein, 25 aa, Mycobacterium
SSTELAARLGLDLMLPSAFGNPEMF

SEQ ID NO: 734442 - protein, 25 aa, Mycobacterium
SSTEPIAVVGMGCRFPGAVDNPERF

SEQ ID NO: 734443 - protein, 22 aa, Mycobacterium
SSTFRYAAPAGQDWQIADLAGR

SEQ ID NO: 734444 - protein, 18 aa, Mycobacterium
SSTFVRPASSFSTPTAPT

SEQ ID NO: 734445 - protein, 17 aa, Mycobacterium
SSTGLADRVDRGSLQPS

SEQ ID NO: 734446 - protein, 19 aa, Mycobacterium
SSTHIPPLPGMSALELSAA

SEQ ID NO: 734447 - protein, 18 aa, Mycobacterium
SSTIAYEAIHEYIRRNAS

SEQ ID NO: 734448 - protein, 21 aa, Mycobacterium
SSTKATALVQIRYANDEKNGG

SEQ ID NO: 734449 - protein, 27 aa, Mycobacterium
SSTLHPGTPIDMFKEWVGPSRLFITIF

SEQ ID NO: 734450 - protein, 22 aa, Mycobacterium
SSTLPPLFSTLIKRPLRRLVDN

SEQ ID NO: 734451 - protein, 21 aa, Mycobacterium
SSTPGHRWAWQTRSWSHGERE

SEQ ID NO: 734452 - protein, 24 aa, Mycobacterium
SSTQRLRLGTSVIQLSARTPTACA

SEQ ID NO: 734453 - protein, 24 aa, Mycobacterium
SSTRRGRPTAHVHFAALHRERNWL

SEQ ID NO: 734454 - protein, 17 aa, Mycobacterium
SSTSRRSPPPGETTRTR

SEQ ID NO: 734455 - protein, 18 aa, Mycobacterium
SSVACFWLKQNSHNKGEG

SEQ ID NO: 734456 - protein, 19 aa, Mycobacterium
SSVAMGWSPYYPQFDRSSL

SEQ ID NO: 734457 - protein, 18 aa, Mycobacterium
SSVDICLSSNVAEHVRNP

SEQ ID NO: 734458 - protein, 23 aa, Mycobacterium
SSVDVRLDCLFRVFNNTRYTHID

SEQ ID NO: 734459 - protein, 17 aa, Mycobacterium
SSVDWPSDLPWQVTSRG

SEQ ID NO: 734460 - protein, 22 aa, Mycobacterium
SSVEPRQLPAIDDLARVLSQAT

SEQ ID NO: 734461 - protein, 17 aa, Mycobacterium
SSVFKPMYLFRGDVPVK

SEQ ID NO: 734462 - protein, 18 aa, Mycobacterium
SSVGITWTSELLTVTAVD

SEQ ID NO: 734463 - protein, 24 aa, Mycobacterium
SSVGMGRFALDRAAEYVKTRQVWG

SEQ ID NO: 734464 - protein, 23 aa, Mycobacterium
SSVKTFCAWALRRGLIGVDPAAR

SEQ ID NO: 734465 - protein, 23 aa, Mycobacterium
SSVLDLGAGVGRIANPLAKLGYR

SEQ ID NO: 734466 - protein, 23 aa, Mycobacterium
SSVLDLGSGVGRIANPLSELGHQ

SEQ ID NO: 734467 - protein, 29 aa, Mycobacterium
SSVLHCQRGRLSLQWGLVRLSVRDGTVLP

SEQ ID NO: 734468 - protein, 17 aa, Mycobacterium
SSVLSMMMWSFRGMGMW

SEQ ID NO: 734469 - protein, 17 aa, Mycobacterium
SSVLVKRFVSYRQQRIL

SEQ ID NO: 734470 - protein, 40 aa, Mycobacterium
SSVPAVPGKFYWMTPTQLRWRPLSFWPAHTAVTVDAGGTV

SEQ ID NO: 734471 - protein, 19 aa, Mycobacterium
SSVQLPVALVVDGATVTTD

SEQ ID NO: 734472 - protein, 20 aa, Mycobacterium
SSVRLTPGIVGYRIPEITPA

SEQ ID NO: 734473 - protein, 22 aa, Mycobacterium
SSVRVCREFLLRAVNDAIENGE

SEQ ID NO: 734474 - protein, 18 aa, Mycobacterium
SSVRYSTPFGGFKQSGLG

SEQ ID NO: 734475 - protein, 30 aa, Mycobacterium
SSVTGRAITRACAERGAKALLENGGNDALV

SEQ ID NO: 734476 - protein, 25 aa, Mycobacterium
SSVTSELLCQAWQGPASAAMASAAA

SEQ ID NO: 734477 - protein, 19 aa, Mycobacterium
SSVTSGLAGDAWQGAASAA

SEQ ID NO: 734478 - protein, 20 aa, Mycobacterium
SSVTSGLAGQAWQGPASQAM

SEQ ID NO: 734479 - protein, 24 aa, Mycobacterium
SSVVAELTNGSWLGPSSAAMMAVA

SEQ ID NO: 734480 - protein, 20 aa, Mycobacterium
SSVVQRLQTIVSRELSPFEP

SEQ ID NO: 734481 - protein, 18 aa, Mycobacterium
SSVYWKLIALDQRYDIAD

SEQ ID NO: 734482 - protein, 23 aa, Mycobacterium
SSWAGKLAPFGFIEELVDLAEPA

SEQ ID NO: 734483 - protein, 25 aa, Mycobacterium
SSWLLLELEGGWGPSAFLESPGSIE

SEQ ID NO: 734484 - protein, 33 aa, Mycobacterium
SSYAPRPRMLVFGAIDFAAAVAQQGAFLGYRVT

SEQ ID NO: 734485 - protein, 19 aa, Mycobacterium
SSYGFLRTRLDGSVEKTVG

SEQ ID NO: 734486 - protein, 20 aa, Mycobacterium
SSYGRLGLLSATAVQVHPGF

SEQ ID NO: 734487 - protein, 24 aa, Mycobacterium
SSYLNKMLWILTGNFAKRGGQHLH

SEQ ID NO: 734488 - protein, 17 aa, Mycobacterium
SSYLPTRTFELAVHSLD

SEQ ID NO: 734489 - protein, 22 aa, Mycobacterium
SSYRGAKNVLLVFFPLAFTGIC

SEQ ID NO: 734490 - protein, 17 aa, Mycobacterium
SSYRLAGDYSLPCILSV

SEQ ID NO: 734491 - protein, 17 aa, Mycobacterium
SSYTHWNVFDVKPESDV

SEQ ID NO: 734492 - protein, 22 aa, Mycobacterium
STAAAKFANWLSGVLDAADALA

SEQ ID NO: 734493 - protein, 18 aa, Mycobacterium
STACLRLRDGGVTVTPGA

SEQ ID NO: 734494 - protein, 43 aa, Mycobacterium
STADALRMLTLPATFGLYVERAWPRHRRLAIDDNRSAALVELL

SEQ ID NO: 734495 - protein, 36 aa, Mycobacterium
STADALRMLTLPATFGLYVERAWPRHRRLSVGGDDA

SEQ ID NO: 734496 - protein, 36 aa, Mycobacterium
STADALRMLTLPATFGLYVERAWPRHRRLSVTADDG

SEQ ID NO: 734497 - protein, 43 aa, Mycobacterium
STADALRMLTLPATFSLYVERAWPRHRRLSLAIEDGRSAALVE

SEQ ID NO: 734498 - protein, 18 aa, Mycobacterium
STADALRMLTLPETFGLY

SEQ ID NO: 734499 - protein, 43 aa, Mycobacterium
STADALRMLTLPGTFAMYLERAWPRHRRLGGVGTPRALILAEL

SEQ ID NO: 734500 - protein, 19 aa, Mycobacterium
STADHFLVVTGIDTNNEIV

SEQ ID NO: 734501 - protein, 17 aa, Mycobacterium
STADPAWAYGLYSTGAS

SEQ ID NO: 734502 - protein, 22 aa, Mycobacterium
STAEHFAKIGFKNHKHSVNNPF

SEQ ID NO: 734503 - protein, 25 aa, Mycobacterium
STAEPADYLPLFVAPQPVRFEDRYE

SEQ ID NO: 734504 - protein, 26 aa, Mycobacterium
STAFNQWWLRLEHIAREAGLKLVMVV

SEQ ID NO: 734505 - protein, 18 aa, Mycobacterium
STAGLPFLVRAVSEAARD

SEQ ID NO: 734506 - protein, 18 aa, Mycobacterium
STAGRADAALGLELTSPR

SEQ ID NO: 734507 - protein, 17 aa, Mycobacterium
STAGVLILLRTVGAIAF

SEQ ID NO: 734508 - protein, 25 aa, Mycobacterium
STAGWEAPGGLPFSGGDADDPALQD

SEQ ID NO: 734509 - protein, 24 aa, Mycobacterium
STAHALDALSYVLGDISSVTSTLG

SEQ ID NO: 734510 - protein, 23 aa, Mycobacterium
STAHRLLAMLSYRGLIRQDPKTR

SEQ ID NO: 734511 - protein, 25 aa, Mycobacterium
STAHRLLAMLTYRGFVRQDPVSKAY

SEQ ID NO: 734512 - protein, 19 aa, Mycobacterium
STAILLRYGAGDWNALHRD

SEQ ID NO: 734513 - protein, 22 aa, Mycobacterium
STAIPLHEWMSANIDMLHALNM

SEQ ID NO: 734514 - protein, 23 aa, Mycobacterium
STAKRPAAAMLIRPDGYVAWAAD

SEQ ID NO: 734515 - protein, 17 aa, Mycobacterium
STALFGILHLRQGGENG

SEQ ID NO: 734516 - protein, 23 aa, Mycobacterium
STALLGRPLIGNGADGAAPGQSG

SEQ ID NO: 734517 - protein, 19 aa, Mycobacterium
STALPAWFVDSEDAVAEFL

SEQ ID NO: 734518 - protein, 25 aa, Mycobacterium
STALRAAAVLACYRYHADAHGLVGP

SEQ ID NO: 734519 - protein, 24 aa, Mycobacterium
STALRRSTLPGGLRVVTEYLPSVR

SEQ ID NO: 734520 - protein, 23 aa, Mycobacterium
STALRVRGRRSGKLRSVVVNLMT

SEQ ID NO: 734521 - protein, 23 aa, Mycobacterium
STALYPPKRFLGAARNIENGGSL

SEQ ID NO: 734522 - protein, 26 aa, Mycobacterium
STAMLARCVIGLQWIPENILAEVGKR

SEQ ID NO: 734523 - protein, 24 aa, Mycobacterium
STANAAECLIVLTNRHGATARTVF

SEQ ID NO: 734524 - protein, 31 aa, Mycobacterium
STAPCVIVRRGNRSRFLGVAFAAVDGADLLR

SEQ ID NO: 734525 - protein, 18 aa, Mycobacterium
STAPWDAVSCMWTLHQLP

SEQ ID NO: 734526 - protein, 23 aa, Mycobacterium
STARFPFEQFMAAILEGRPTGRV

SEQ ID NO: 734527 - protein, 18 aa, Mycobacterium
STARGMLFYRLLQQSVNT

SEQ ID NO: 734528 - protein, 17 aa, Mycobacterium
STARLDAIAARDRARGR

SEQ ID NO: 734529 - protein, 23 aa, Mycobacterium
STARLPFAVTVVHAQPSPERRAA

SEQ ID NO: 734530 - protein, 25 aa, Mycobacterium
STARRLITELTEWGGLERLSSGGYR

SEQ ID NO: 734531 - protein, 23 aa, Mycobacterium
STASAICRRAFATFMRVPDPQTF

SEQ ID NO: 734532 - protein, 17 aa, Mycobacterium
STASARLPARRDVGVPV

SEQ ID NO: 734533 - protein, 17 aa, Mycobacterium
STASCRSGGDAGATEAA

SEQ ID NO: 734534 - protein, 19 aa, Mycobacterium
STATPFDWTYTRDDLNAFL

SEQ ID NO: 734535 - protein, 25 aa, Mycobacterium
STAWTAAFYALHNWMLALFDERAQS

SEQ ID NO: 734536 - protein, 25 aa, Mycobacterium
STAWTASFYTLHNWMLALFDERAQS

SEQ ID NO: 734537 - protein, 17 aa, Mycobacterium
STAYLAHPEHGYMGIAP

SEQ ID NO: 734538 - protein, 21 aa, Mycobacterium
STDDFPIPRRIIATSCDAEQV

SEQ ID NO: 734539 - protein, 20 aa, Mycobacterium
STDDFPIPRRMIATTCDAEQ

SEQ ID NO: 734540 - protein, 24 aa, Mycobacterium
STDEALKAFALHPLVDSVTVARQL

SEQ ID NO: 734541 - protein, 19 aa, Mycobacterium
STDEFRAAGARRADRGPLL

SEQ ID NO: 734542 - protein, 19 aa, Mycobacterium
STDFGDWWAQHRVYQRTHG

SEQ ID NO: 734543 - protein, 17 aa, Mycobacterium
STDGGFEPQQFGADAGV

SEQ ID NO: 734544 - protein, 18 aa, Mycobacterium
STDGSWDAKSAWPEIELV

SEQ ID NO: 734545 - protein, 26 aa, Mycobacterium
STDHRPELLLSFGFIPKVESRVGLIN

SEQ ID NO: 734546 - protein, 32 aa, Mycobacterium
STDLLYKLLRSEWLEPRWMIGIDPESEGLARA

SEQ ID NO: 734547 - protein, 21 aa, Mycobacterium
STDLPDDLGLALSQDRDVRVR

SEQ ID NO: 734548 - protein, 26 aa, Mycobacterium
STDLRDWVGALVRPLTDHLAALGNPT

SEQ ID NO: 734549 - protein, 25 aa, Mycobacterium
STDPSQIAQAGGQGGTGGTGGAAGS

SEQ ID NO: 734550 - protein, 18 aa, Mycobacterium
STDPVSWLGEGTGMPEEW

SEQ ID NO: 734551 - protein, 19 aa, Mycobacterium
STDVELRIRCLDQLHRALV

SEQ ID NO: 734552 - protein, 21 aa, Mycobacterium
STEAFRTGTMLSRSVPADLIT

SEQ ID NO: 734553 - protein, 24 aa, Mycobacterium
STEDLRLLGIHIFGSDATDLVHIG

SEQ ID NO: 734554 - protein, 23 aa, Mycobacterium
STEDLRLLGVHIFGTSATEMVHI

SEQ ID NO: 734555 - protein, 18 aa, Mycobacterium
STEEGWRQFVATYLAGGE

SEQ ID NO: 734556 - protein, 24 aa, Mycobacterium
STEFAELRPRIVYDRDNGMLTSRP

SEQ ID NO: 734557 - protein, 25 aa, Mycobacterium
STEFAELRPRLVYDRDTGTLTARPG

SEQ ID NO: 734558 - protein, 17 aa, Mycobacterium
STEHLIEAATYWSKTAD

SEQ ID NO: 734559 - protein, 24 aa, Mycobacterium
STEISRLSLFLTTPAARHITGQTL

SEQ ID NO: 734560 - protein, 19 aa, Mycobacterium
STELDPGQELVFIGVHIDR

SEQ ID NO: 734561 - protein, 19 aa, Mycobacterium
STELGRLTVPLGVAAATDD

SEQ ID NO: 734562 - protein, 24 aa, Mycobacterium
STEMKLHLACYQAFDDIGSVIHSH

SEQ ID NO: 734563 - protein, 19 aa, Mycobacterium
STEMPRPGPAELLVAVHAC

SEQ ID NO: 734564 - protein, 24 aa, Mycobacterium
STEMRDWVACLVRPLTDHLEELGN

SEQ ID NO: 734565 - protein, 18 aa, Mycobacterium
STEMWECLNTTFNALPDR

SEQ ID NO: 734566 - protein, 17 aa, Mycobacterium
STERALCEILEEQFNGV

SEQ ID NO: 734567 - protein, 24 aa, Mycobacterium
STERARELLAPYGSRVSIAAVNGR

SEQ ID NO: 734568 - protein, 20 aa, Mycobacterium
STETLRWAMQRGVPHVLLAD

SEQ ID NO: 734569 - protein, 23 aa, Mycobacterium
STETWPTVAAWVRWLDGGGSMPD

SEQ ID NO: 734570 - protein, 19 aa, Mycobacterium
STEVGRYLLAQCAPTVKRT

SEQ ID NO: 734571 - protein, 22 aa, Mycobacterium
STEVPVVVLLWSPRSDASVQLG

SEQ ID NO: 734572 - protein, 18 aa, Mycobacterium
STFARSTIDIAITGEGER

SEQ ID NO: 734573 - protein, 25 aa, Mycobacterium
STFDLYSCFPVPVFNFCDGTGLATD

SEQ ID NO: 734574 - protein, 24 aa, Mycobacterium
STFDLYSCFPVPVFNFCDGTQLAT

SEQ ID NO: 734575 - protein, 21 aa, Mycobacterium
STFIEVCYLLIYGELPNTDQL

SEQ ID NO: 734576 - protein, 17 aa, Mycobacterium
STFKLARAALFQQQLTL

SEQ ID NO: 734577 - protein, 28 aa, Mycobacterium
STFKRSTLRRLGVKYVYDSRTTDFADQI

SEQ ID NO: 734578 - protein, 17 aa, Mycobacterium
STFPRSGFVTGLTAALV

SEQ ID NO: 734579 - protein, 18 aa, Mycobacterium
STFQLPFGALGVVPDGIT

SEQ ID NO: 734580 - protein, 25 aa, Mycobacterium
STFQVLPWASPNGHHHSARMFCDIT

SEQ ID NO: 734581 - protein, 19 aa, Mycobacterium
STFQVLPWTTGSGHHHSAR

SEQ ID NO: 734582 - protein, 24 aa, Mycobacterium
STFRCPYHGWTYRNDGELVGFPFF

SEQ ID NO: 734583 - protein, 20 aa, Mycobacterium
STFSHAFKRWYGVAPSAYPQ

SEQ ID NO: 734584 - protein, 19 aa, Mycobacterium
STFTLRPAAIFALPVCRRP

SEQ ID NO: 734585 - protein, 18 aa, Mycobacterium
STFWAGAYLTCYLGAFGA

SEQ ID NO: 734586 - protein, 17 aa, Mycobacterium
STGALWCSVSTVADDLM

SEQ ID NO: 734587 - protein, 23 aa, Mycobacterium
STGAWRPGALPVQALDHATGYGV

SEQ ID NO: 734588 - protein, 18 aa, Mycobacterium
STGCAAVASAAPTNSAGA

SEQ ID NO: 734589 - protein, 18 aa, Mycobacterium
STGCFRDMVSTHLCQVLG

SEQ ID NO: 734590 - protein, 24 aa, Mycobacterium
STGCGQWPGAVVRLDAPVVPHMGW

SEQ ID NO: 734591 - protein, 25 aa, Mycobacterium
STGGDDGPDGWAFAGAGGAGEDGGF

SEQ ID NO: 734592 - protein, 25 aa, Mycobacterium
STGGFTEVLLRSGAREVVAADVGYG

SEQ ID NO: 734593 - protein, 25 aa, Mycobacterium
STGGGGLLLPLGVRSLRAYGPTRNA

SEQ ID NO: 734594 - protein, 24 aa, Mycobacterium
STGGPFFIEFRTYRFRAHSMFDPE

SEQ ID NO: 734595 - protein, 18 aa, Mycobacterium
STGGSWDAGPAWPEIEGV

SEQ ID NO: 734596 - protein, 26 aa, Mycobacterium
STGHTAEYFIRMMAGLGEALGFDVDT

SEQ ID NO: 734597 - protein, 25 aa, Mycobacterium
STGIPEERARFATVRQPNSLVSDGS

SEQ ID NO: 734598 - protein, 24 aa, Mycobacterium
STGKTVRHLLNWDGHRQANAAIYR

SEQ ID NO: 734599 - protein, 19 aa, Mycobacterium
STGLDLLYRMADFCRPDWM

SEQ ID NO: 734600 - protein, 18 aa, Mycobacterium
STGLPFLPMSMAKGLLPD

SEQ ID NO: 734601 - protein, 23 aa, Mycobacterium
STGNAAELCEFVARLHSGDIHGA

SEQ ID NO: 734602 - protein, 23 aa, Mycobacterium
STGNRGIPPYAWDENVDTERPEI

SEQ ID NO: 734603 - protein, 19 aa, Mycobacterium
STGQWVIIAALRQDRTYKP

SEQ ID NO: 734604 - protein, 19 aa, Mycobacterium
STGRARAVLEYSRTMHGLV

SEQ ID NO: 734605 - protein, 25 aa, Mycobacterium
STGSLRPGADIIPYAAAKAGLNAMT

SEQ ID NO: 734606 - protein, 30 aa, Mycobacterium
STGYADVPTRFGLFPSIDPVTFAGDMVGAA

SEQ ID NO: 734607 - protein, 17 aa, Mycobacterium
STHAAVWAVDEAVSRDI

SEQ ID NO: 734608 - protein, 19 aa, Mycobacterium
STHFDWVLAPYDIVASRAH

SEQ ID NO: 734609 - protein, 20 aa, Mycobacterium
STHILDWPRGKKLLDVLLDA

SEQ ID NO: 734610 - protein, 21 aa, Mycobacterium
STHLRAAAWVPDDVEDRPYED

SEQ ID NO: 734611 - protein, 17 aa, Mycobacterium
STHPLVIIPGGPGVASM

SEQ ID NO: 734612 - protein, 17 aa, Mycobacterium
STHRLHGDFGFTKGAGA

SEQ ID NO: 734613 - protein, 23 aa, Mycobacterium
STHRLRLGTSVIQLSARTPTATA

SEQ ID NO: 734614 - protein, 18 aa, Mycobacterium
STHSRRVLLRGWEQFDEP

SEQ ID NO: 734615 - protein, 19 aa, Mycobacterium
STHTVEWHLRKVFVKLGIG

SEQ ID NO: 734616 - protein, 19 aa, Mycobacterium
STIAAILTELGWRHANGIP

SEQ ID NO: 734617 - protein, 19 aa, Mycobacterium
STIALGILHRLAATVAKVG

SEQ ID NO: 734618 - protein, 19 aa, Mycobacterium
STIALGILHRLAATVARVG

SEQ ID NO: 734619 - protein, 19 aa, Mycobacterium
STIALGILHRLAATVPKVG

SEQ ID NO: 734620 - protein, 19 aa, Mycobacterium
STIALGLLHRLTATVAKVG

SEQ ID NO: 734621 - protein, 18 aa, Mycobacterium
STIDIAITGEGERIDLGD

SEQ ID NO: 734622 - protein, 30 aa, Mycobacterium
STIEPGAQLNLPWNRDFNALVYVLSGRGSV

SEQ ID NO: 734623 - protein, 18 aa, Mycobacterium
STIFGSGVSPGFAELLAI

SEQ ID NO: 734624 - protein, 26 aa, Mycobacterium
STIFGSGVSPGFAELLAIVSAMVCNR

SEQ ID NO: 734625 - protein, 17 aa, Mycobacterium
STIGRRLAKALGVGLLD

SEQ ID NO: 734626 - protein, 19 aa, Mycobacterium
STIGRRLAKALGVNVYDTD

SEQ ID NO: 734627 - protein, 19 aa, Mycobacterium
STIHVRLIHSFVRRHVSAM

SEQ ID NO: 734628 - protein, 21 aa, Mycobacterium
STIKVPLAIAALRHDRSRAKD

SEQ ID NO: 734629 - protein, 18 aa, Mycobacterium
STIMSRLAGQGAVALLNV

SEQ ID NO: 734630 - protein, 18 aa, Mycobacterium
STIPLYIHAPYLINVASA

SEQ ID NO: 734631 - protein, 23 aa, Mycobacterium
STIRAMVPMSVYRDGDLDVGGEG

SEQ ID NO: 734632 - protein, 17 aa, Mycobacterium
STISASVGSVFADLRKE

SEQ ID NO: 734633 - protein, 17 aa, Mycobacterium
STISDGQQATWDRLWPQ

SEQ ID NO: 734634 - protein, 23 aa, Mycobacterium
STITIASLFGIGGTGGDGGIGGH

SEQ ID NO: 734635 - protein, 27 aa, Mycobacterium
STITPRWLLHLLNWVPVEAGIYRVNRV

SEQ ID NO: 734636 - protein, 26 aa, Mycobacterium
STITPRWLLHLLSWVPVEAGIYRVNR

SEQ ID NO: 734637 - protein, 20 aa, Mycobacterium
STIVRRWLDAGLVIFGKTNT

SEQ ID NO: 734638 - protein, 29 aa, Mycobacterium
STKAVKVEGGWRLTGQKIWTSVAQFADWG

SEQ ID NO: 734639 - protein, 22 aa, Mycobacterium
STKDLKDAFTFNVGTAHALTVA

SEQ ID NO: 734640 - protein, 23 aa, Mycobacterium
STKDLRDAFTFNVSTAHALTSAA

SEQ ID NO: 734641 - protein, 23 aa, Mycobacterium
STKFELVRWLGRFKTEEAKELVV

SEQ ID NO: 734642 - protein, 18 aa, Mycobacterium
STKIKALAVREGPAALPW

SEQ ID NO: 734643 - protein, 36 aa, Mycobacterium
STKLLKHGRWTDFFSTVRWHNLHVIAAALLQNLALI

SEQ ID NO: 734644 - protein, 27 aa, Mycobacterium
STKNAADWLAARGFKQGLGSLGQISVG

SEQ ID NO: 734645 - protein, 22 aa, Mycobacterium
STKPLSGLIFPGWDTAAESPPP

SEQ ID NO: 734646 - protein, 17 aa, Mycobacterium
STKRLAVDADLFTQTAA

SEQ ID NO: 734647 - protein, 19 aa, Mycobacterium
STKVGMVFGELADGEVDVR

SEQ ID NO: 734648 - protein, 17 aa, Mycobacterium
STLALGLLHRLTATVAK

SEQ ID NO: 734649 - protein, 17 aa, Mycobacterium
STLALLVQQHFFMHVDV

SEQ ID NO: 734650 - protein, 19 aa, Mycobacterium
STLARPINFGRPAAGITEF

SEQ ID NO: 734651 - protein, 19 aa, Mycobacterium
STLAVEWAPKVRVNSVVVG

SEQ ID NO: 734652 - protein, 18 aa, Mycobacterium
STLDELRIFVSQWDTRAR

SEQ ID NO: 734653 - protein, 25 aa, Mycobacterium
STLDERLHHLFARMPDARVHLYGKE

SEQ ID NO: 734654 - protein, 19 aa, Mycobacterium
STLDFSNTVTRVHEDPRVT

SEQ ID NO: 734655 - protein, 30 aa, Mycobacterium; identical to SEQ ID NO: 104807

SEQ ID NO: 734656 - protein, 17 aa, Mycobacterium
STLELGESLGIPRAKLV

SEQ ID NO: 734657 - protein, 21 aa, Mycobacterium
STLEYKGFPKSCCTSLNEVIC

SEQ ID NO: 734658 - protein, 18 aa, Mycobacterium
STLFGSGVSPGFAELLAI

SEQ ID NO: 734659 - protein, 19 aa, Mycobacterium
STLFKAIMGLVRSDTGDVR

SEQ ID NO: 734660 - protein, 23 aa, Mycobacterium
STLFPGGEGRLLLTNPSDMLTTG

SEQ ID NO: 734661 - protein, 17 aa, Mycobacterium
STLGLDFLRSCSIKHRL

SEQ ID NO: 734662 - protein, 17 aa, Mycobacterium
STLGLDFLRSCSIKHRM

SEQ ID NO: 734663 - protein, 38 aa, Mycobacterium
STLGLDFMRSCSIKHQLPSVIFSLEMSKTEIVMRLLSA

SEQ ID NO: 734664 - protein, 17 aa, Mycobacterium
STLGLDFMRSCSIKHQM

SEQ ID NO: 734665 - protein, 21 aa, Mycobacterium
STLGLIFHWADQKGLPLLDIK

SEQ ID NO: 734666 - protein, 17 aa, Mycobacterium
STLGLIFHWADQQQLPL

SEQ ID NO: 734667 - protein, 20 aa, Mycobacterium
STLGLIFHWADQRGLPLLDL

SEQ ID NO: 734668 - protein, 21 aa, Mycobacterium
STLHCMTVSLALDGDGLGTVW

SEQ ID NO: 734669 - protein, 17 aa, Mycobacterium
STLHRVRPPVVDGRVQR

SEQ ID NO: 734670 - protein, 18 aa, Mycobacterium
STLIRRFMADTDRNVVVV

SEQ ID NO: 734671 - protein, 20 aa, Mycobacterium
STLLADPAVPVFALTTGPRW

SEQ ID NO: 734672 - protein, 19 aa, Mycobacterium
STLLDGLRRIGIDRLAPTD

SEQ ID NO: 734673 - protein, 19 aa, Mycobacterium
STLLGSLGIDGSHSYHHVV

SEQ ID NO: 734674 - protein, 19 aa, Mycobacterium
STLLLLDALMGWQPGSAAV

SEQ ID NO: 734675 - protein, 18 aa, Mycobacterium
STLLRCINHLETVSAGRL

SEQ ID NO: 734676 - protein, 21 aa, Mycobacterium
STLLRGHDVVFLALPHGSSAK

SEQ ID NO: 734677 - protein, 22 aa, Mycobacterium
STLLRLCNRLEVPTSGRVLFCG

SEQ ID NO: 734678 - protein, 18 aa, Mycobacterium
STLLRVGQYVPYQQVWNL

SEQ ID NO: 734679 - protein, 17 aa, Mycobacterium
STLPMHYIDAVDDRALP

SEQ ID NO: 734680 - protein, 25 aa, Mycobacterium
STLQAGAEFARWLDARGPARVPEIA

SEQ ID NO: 734681 - protein, 32 aa, Mycobacterium
STLQMLADCPLRWLLERHGGARGRDVRSTLGS

SEQ ID NO: 734682 - protein, 24 aa, Mycobacterium
STLQSGAEFARWLDERGPATVPQL

SEQ ID NO: 734683 - protein, 17 aa, Mycobacterium
STLRFNIFVLKLPIRPP

SEQ ID NO: 734684 - protein, 21 aa, Mycobacterium
STLRGDFLWCQLFSEPGAGSD

SEQ ID NO: 734685 - protein, 24 aa, Mycobacterium
STLRKLQLGNRVELTRYAIEHGLD

SEQ ID NO: 734686 - protein, 22 aa, Mycobacterium
STLRLIPNIVVLPYRNPFVVAK

SEQ ID NO: 734687 - protein, 17 aa, Mycobacterium
STLRLLDELGLFDRFDK

SEQ ID NO: 734688 - protein, 22 aa, Mycobacterium
STLRLRAREGVRAAVDALSNGH

SEQ ID NO: 734689 - protein, 22 aa, Mycobacterium
STLRRIPWLPGTALVIADVGWA

SEQ ID NO: 734690 - protein, 28 aa, Mycobacterium
STLRRIPWLPGTAMVMADLSWLDGNPVA

SEQ ID NO: 734691 - protein, 17 aa, Mycobacterium
STLRRLKQYSGRLATEA

SEQ ID NO: 734692 - protein, 19 aa, Mycobacterium
STLRRSNAKAQRTFAKAHD

SEQ ID NO: 734693 - protein, 23 aa, Mycobacterium
STLRRVPWLPATALVMADLSWTD

SEQ ID NO: 734694 - protein, 17 aa, Mycobacterium
STLRRWAHDAVAALISH

SEQ ID NO: 734695 - protein, 23 aa, Mycobacterium
STLRSRFGFMAIHGGGLEQMTDV

SEQ ID NO: 734696 - protein, 22 aa, Mycobacterium
STLSAAVHGWVLARANRDRALE

SEQ ID NO: 734697 - protein, 17 aa, Mycobacterium
STLTEFDYRAVAIAAVD

SEQ ID NO: 734698 - protein, 20 aa, Mycobacterium
STLTREWFAGTFVEPTPAQA

SEQ ID NO: 734699 - protein, 23 aa, Mycobacterium
STLTRFPFLAVDGSTFVMLRHQW

SEQ ID NO: 734700 - protein, 19 aa, Mycobacterium
STLVHRLTGMWPDRLAEEQ

SEQ ID NO: 734701 - protein, 23 aa, Mycobacterium
STLVKAIAGIHPIDSGTYLFEGK

SEQ ID NO: 734702 - protein, 20 aa, Mycobacterium
STLVNRLVPEAGRATGEVTG

SEQ ID NO: 734703 - protein, 18 aa, Mycobacterium
STLVWDLPSPHIADVPYR

SEQ ID NO: 734704 - protein, 19 aa, Mycobacterium
STLYSGYGQTFAWNQLGVT

SEQ ID NO: 734705 - protein, 19 aa, Mycobacterium
STMFITWQRTVGGRIKSDL

SEQ ID NO: 734706 - protein, 24 aa, Mycobacterium
STNAVELFSCYDLIVDGTDNFATR

SEQ ID NO: 734707 - protein, 19 aa, Mycobacterium
STNFEWLRDEGYHQLLSRT

SEQ ID NO: 734708 - protein, 18 aa, Mycobacterium
STNIPISIVGAVESRTIT

SEQ ID NO: 734709 - protein, 22 aa, Mycobacterium
STNLAGWLNKVGVWSAAERLDW

SEQ ID NO: 734710 - protein, 19 aa, Mycobacterium
STNLPRVLGGLGVAIISTS

SEQ ID NO: 734711 - protein, 20 aa, Mycobacterium
STNLPRVLGGLGVAIISTSS

SEQ ID NO: 734712 - protein, 20 aa, Mycobacterium
STNRLSFAISNVAEAVRGGH

SEQ ID NO: 734713 - protein, 18 aa, Mycobacterium
STNRWLVAVRMVSEGVDV

SEQ ID NO: 734714 - protein, 18 aa, Mycobacterium
STNTGWWNAGSVNDGLFN

SEQ ID NO: 734715 - protein, 24 aa, Mycobacterium
STPAELRPALQRAFASGLPSVVNV

SEQ ID NO: 734716 - protein, 17 aa, Mycobacterium
STPAVPGKFYWMSTTQL

SEQ ID NO: 734717 - protein, 20 aa, Mycobacterium
STPAWRVFAKYYYPFITRHG

SEQ ID NO: 734718 - protein, 20 aa, Mycobacterium
STPDLSGRRAVVIGNGNVAI

SEQ ID NO: 734719 - protein, 22 aa, Mycobacterium
STPEKSRLSLFVVPIDSPGLTY

SEQ ID NO: 734720 - protein, 26 aa, Mycobacterium
STPFAHAGYMFKLWDQLVWGSTLVVP

SEQ ID NO: 734721 - protein, 24 aa, Mycobacterium
STPGCTKQACDFRDNLAELNDAGL

SEQ ID NO: 734722 - protein, 23 aa, Mycobacterium
STPGCTKQACDFRDNLHELGDAG

SEQ ID NO: 734723 - protein, 24 aa, Mycobacterium
STPGCTKQACDFRDNLSELNEAGL

SEQ ID NO: 734724 - protein, 24 aa, Mycobacterium
STPGCTKQACDFRDSLAELNDAGL

SEQ ID NO: 734725 - protein, 24 aa, Mycobacterium
STPGCTKQACDFRDSLAELNGAGL

SEQ ID NO: 734726 - protein, 21 aa, Mycobacterium
STPGDEGWVPTMITVQEDGYI

SEQ ID NO: 734727 - protein, 18 aa, Mycobacterium
STPGGLCGTINVVLPVPG

SEQ ID NO: 734728 - protein, 18 aa, Mycobacterium
STPHAAEALECLGGNGYV

SEQ ID NO: 734729 - protein, 18 aa, Mycobacterium
STPIRVWSSDPLGKDMFF

SEQ ID NO: 734730 - protein, 17 aa, Mycobacterium
STPKALKLYGIAEDAYS

SEQ ID NO: 734731 - protein, 24 aa, Mycobacterium
STPKGRWSIGGVFAERAAKHADRV

SEQ ID NO: 734732 - protein, 18 aa, Mycobacterium
STPLAEWAAGAAAINLLT

SEQ ID NO: 734733 - protein, 20 aa, Mycobacterium
STPLAYRLAYIADLEATFTP

SEQ ID NO: 734734 - protein, 25 aa, Mycobacterium
STPLKRWQLCLDVNTTGVFLVTKAV

SEQ ID NO: 734735 - protein, 19 aa, Mycobacterium
STPLLKLLLVNAAHATELP

SEQ ID NO: 734736 - protein, 18 aa, Mycobacterium
STPLLRPIMDALLPTMPV

SEQ ID NO: 734737 - protein, 19 aa, Mycobacterium
STPLPAEWTAPTPPHGIPV

SEQ ID NO: 734738 - protein, 25 aa, Mycobacterium
STPNGLYPFTGIKDLTLDISLARGA

SEQ ID NO: 734739 - protein, 27 aa, Mycobacterium
STPRGCIRCAARVCGIRDGVLFVPFHY

SEQ ID NO: 734740 - protein, 19 aa, Mycobacterium
STPRHGWTLTIEGDPSMQT

SEQ ID NO: 734741 - protein, 17 aa, Mycobacterium
STPRSKLLAEVQRLQPV

SEQ ID NO: 734742 - protein, 24 aa, Mycobacterium
STPSPLDWDCFRFGVIQHDDHFTV

SEQ ID NO: 734743 - protein, 18 aa, Mycobacterium
STPVFGWQDQHGHCEVSY

SEQ ID NO: 734744 - protein, 20 aa, Mycobacterium
STPVGRRVMLAAAAHGHRTQ

SEQ ID NO: 734745 - protein, 23 aa, Mycobacterium
STPVPYLQAYWMYGARGGPSALT

SEQ ID NO: 734746 - protein, 23 aa, Mycobacterium
STPWPEQWPKPSRVEQGGMVFRV

SEQ ID NO: 734747 - protein, 23 aa, Mycobacterium
STPWPTYPLMFRVSSAHEEGGER

SEQ ID NO: 734748 - protein, 22 aa, Mycobacterium
STPWPTYPLMFRVTSAHEEGGE

SEQ ID NO: 734749 - protein, 24 aa, Mycobacterium
STQLAGLPFSGPVGGARIALIDGT

SEQ ID NO: 734750 - protein, 18 aa, Mycobacterium
STQLPHWRTVIAKDLARS

SEQ ID NO: 734751 - protein, 17 aa, Mycobacterium
STQPRLHLASLPPKNPT

SEQ ID NO: 734752 - protein, 23 aa, Mycobacterium
STRAELRLAIVTWIERTYHRRRR

SEQ ID NO: 734753 - protein, 27 aa, Mycobacterium
STRAESRWFAGAGFSLVNMTGYPEAVL

SEQ ID NO: 734754 - protein, 26 aa, Mycobacterium
STRAESRWYASQGFTLVNMTGYPEAV

SEQ ID NO: 734755 - protein, 17 aa, Mycobacterium
STRARIVLFRKPIERRV

SEQ ID NO: 734756 - protein, 24 aa, Mycobacterium
STREELRIAIVTWIERTYHRRRRQ

SEQ ID NO: 734757 - protein, 18 aa, Mycobacterium
STRGALAMDPRGMAELFE

SEQ ID NO: 734758 - protein, 24 aa, Mycobacterium
STRGKITHGVDCGFAVSGDVVNTA

SEQ ID NO: 734759 - protein, 18 aa, Mycobacterium
STRHVTNYFLFYGAGRNP

SEQ ID NO: 734760 - protein, 18 aa, Mycobacterium
STRKELAATLALALAIGD

SEQ ID NO: 734761 - protein, 19 aa, Mycobacterium
STRKFSPELTRPFEPPPTF

SEQ ID NO: 734762 - protein, 26 aa, Mycobacterium
STRKLRDWLLVRAFEHGITHLSSSSS

SEQ ID NO: 734763 - protein, 28 aa, Mycobacterium
STRLGWAERRVELPAGRYETIMPPSTVA

SEQ ID NO: 734764 - protein, 20 aa, Mycobacterium
STRLLREGSLVHGYISMTQI

SEQ ID NO: 734765 - protein, 21 aa, Mycobacterium
STRLLTAYLRGVSWEPPDAVA

SEQ ID NO: 734766 - protein, 27 aa, Mycobacterium
STRPEFAAAVLGIWRLAATAVLISPAW

SEQ ID NO: 734767 - protein, 23 aa, Mycobacterium
STRQRMIAIEFDFSAADVEEGIV

SEQ ID NO: 734768 - protein, 24 aa, Mycobacterium
STRQRMVAIEFGFPAPEVEVGIVA

SEQ ID NO: 734769 - protein, 17 aa, Mycobacterium
STRQRVWGQMDDGRCGP

SEQ ID NO: 734770 - protein, 25 aa, Mycobacterium
STRQSRKGLISSWKAFAPAWAGKVA

SEQ ID NO: 734771 - protein, 19 aa, Mycobacterium
STRRFPLILTTGRILSQYN

SEQ ID NO: 734772 - protein, 19 aa, Mycobacterium
STRRGRPTTHVQFATLHRD

SEQ ID NO: 734773 - protein, 19 aa, Mycobacterium
STRSGAWIVPKYVAGQPAD

SEQ ID NO: 734774 - protein, 19 aa, Mycobacterium
STRSGCALHLAHATLNFGP

SEQ ID NO: 734775 - protein, 22 aa, Mycobacterium
STRTSPRMVEWQTARGTRTYPL

SEQ ID NO: 734776 - protein, 24 aa, Mycobacterium
STRVEFWAFDILFLDGRLLTKATY

SEQ ID NO: 734777 - protein, 29 aa, Mycobacterium
STRVEFWAFDILWLDGRSLLRAKYSDRRK

SEQ ID NO: 734778 - protein, 20 aa, Mycobacterium
STSEFRKAFTEVFGHTPYQF

SEQ ID NO: 734779 - protein, 18 aa, Mycobacterium
STSEILAAGTDEISTAVA

SEQ ID NO: 734780 - protein, 22 aa, Mycobacterium
STSEIRISVLIKDTELDKAVSA

SEQ ID NO: 734781 - protein, 24 aa, Mycobacterium
STSEIRISVLIKDTELDRAVAALH

SEQ ID NO: 734782 - protein, 19 aa, Mycobacterium
STSEIRISVLVKDDELDAA

SEQ ID NO: 734783 - protein, 23 aa, Mycobacterium
STSFPRPDTGTFRGDLLAVLRAW

SEQ ID NO: 734784 - protein, 27 aa, Mycobacterium
STSGIPEWMDRLGHRVTWDSRTRSNAR

SEQ ID NO: 734785 - protein, 24 aa, Mycobacterium
STSKLYGDRLCRAFDRDRSGMVTA

SEQ ID NO: 734786 - protein, 23 aa, Mycobacterium
STSLKEKFLELLPNRVITDSIGS

SEQ ID NO: 734787 - protein, 17 aa, Mycobacterium
STSMPVVIAVRLALGST

SEQ ID NO: 734788 - protein, 24 aa, Mycobacterium
STSSRFADFVARPNHAVNHVKVGD

SEQ ID NO: 734789 - protein, 21 aa, Mycobacterium
STSVDTGWRFAKTLVGEPLPA

SEQ ID NO: 734790 - protein, 25 aa, Mycobacterium
STSYRAGVFEAEFGDGSKLGLQIEY

SEQ ID NO: 734791 - protein, 23 aa, Mycobacterium
STSYYLRTRVALLQACATRLGER

SEQ ID NO: 734792 - protein, 18 aa, Mycobacterium
STTARRALLEGADVVISD

SEQ ID NO: 734793 - protein, 18 aa, Mycobacterium
STTARRALLEGADVVVSD

SEQ ID NO: 734794 - protein, 20 aa, Mycobacterium
STTDFYRRPDVRAVPVEGLP

SEQ ID NO: 734795 - protein, 20 aa, Mycobacterium
STTDIGAWVTHPGGPKIINA

SEQ ID NO: 734796 - protein, 17 aa, Mycobacterium
STTEMRSALSIATLLIG

SEQ ID NO: 734797 - protein, 17 aa, Mycobacterium
STTEVAEAVLFLAGDAA

SEQ ID NO: 734798 - protein, 30 aa, Mycobacterium
STTFKLPFGELPGQVFVGIRTSDVLTHAWD

SEQ ID NO: 734799 - protein, 17 aa, Mycobacterium
STTHLRASGLPKPGRQT

SEQ ID NO: 734800 - protein, 17 aa, Mycobacterium
STTIGWPDLAEAALAIR

SEQ ID NO: 734801 - protein, 19 aa, Mycobacterium
STTLSRWGVDVRPVQVDLG

SEQ ID NO: 734802 - protein, 21 aa, Mycobacterium
STTNLAGWVNKVGVWSASERH

SEQ ID NO: 734803 - protein, 21 aa, Mycobacterium
STTNLGGWVNKVGVWSATERR

SEQ ID NO: 734804 - protein, 18 aa, Mycobacterium
STTRGWKISGRASFIAGH

SEQ ID NO: 734805 - protein, 17 aa, Mycobacterium
STTRLLDAEFPKFRQLL

SEQ ID NO: 734806 - protein, 24 aa, Mycobacterium
STTRREWADSLGIFDATIPAGPDA

SEQ ID NO: 734807 - protein, 26 aa, Mycobacterium
STTSAPFSEIWYLLTGQTTLPTSLGS

SEQ ID NO: 734808 - protein, 24 aa, Mycobacterium
STTSLCPWKGVAHYYTVVVDGRTN

SEQ ID NO: 734809 - protein, 26 aa, Mycobacterium
STTTRWPRRRPWRRLSKNAGDQPPCA

SEQ ID NO: 734810 - protein, 26 aa, Mycobacterium
STTWPKLKGAPMLGISVLGEAHDEAA

SEQ ID NO: 734811 - protein, 26 aa, Mycobacterium
STTWPRLKVAPMLGISVLGETHDEAA

SEQ ID NO: 734812 - protein, 17 aa, Mycobacterium
STVAQPWLADHAVAGTV

SEQ ID NO: 734813 - protein, 21 aa, Mycobacterium
STVDALARFIGEHQVLVVLDN

SEQ ID NO: 734814 - protein, 40 aa, Mycobacterium
STVELDIVGIGFKAVHVSAIKFPNLELGLPAIDINIGTGP

SEQ ID NO: 734815 - protein, 17 aa, Mycobacterium
STVGLDFSPAALQAARD

SEQ ID NO: 734816 - protein, 26 aa, Mycobacterium
STVGSAALWRAARSGLEGDLVDLTGP

SEQ ID NO: 734817 - protein, 24 aa, Mycobacterium
STVGWPGDLPWHITSRGIGGRRMR

SEQ ID NO: 734818 - protein, 18 aa, Mycobacterium
STVHGRGGAGGDGGAGGW

SEQ ID NO: 734819 - protein, 22 aa, Mycobacterium
STVHLAKLVLRDMANRDAGRVL

SEQ ID NO: 734820 - protein, 22 aa, Mycobacterium
STVHLAKLVLRNMTRSGAGRVL

SEQ ID NO: 734821 - protein, 24 aa, Mycobacterium
STVKGTGVGGRIRKQDVLAAAEKA

SEQ ID NO: 734822 - protein, 23 aa, Mycobacterium
STVLESGCVGMSAVAAVATGAAS

SEQ ID NO: 734823 - protein, 21 aa, Mycobacterium
STVLGRRLWETAGNPEVDTRR

SEQ ID NO: 734824 - protein, 20 aa, Mycobacterium
STVMVPFDIDADVSMIDLED

SEQ ID NO: 734825 - protein, 19 aa, Mycobacterium
STVNRLMRSVPFGSNVYEH

SEQ ID NO: 734826 - protein, 25 aa, Mycobacterium
STVPAIPWNIGVHSDIDIPITGAIN

SEQ ID NO: 734827 - protein, 29 aa, Mycobacterium
STVPYALRGLLFCAACGRRMQGAARAGKR

SEQ ID NO: 734828 - protein, 29 aa, Mycobacterium
STVPYALRGLLFCAACGRRMQGAARPGKQ

SEQ ID NO: 734829 - protein, 29 aa, Mycobacterium
STVPYALRGLLFCAACGRRMQGAARVGKR

SEQ ID NO: 734830 - protein, 23 aa, Mycobacterium
STVRGARNYPCQEFPGKRAPTVQ

SEQ ID NO: 734831 - protein, 19 aa, Mycobacterium
STVRLAAGGGRTQHGSQRG

SEQ ID NO: 734832 - protein, 27 aa, Mycobacterium
STVRLPRQIPYAFAMELLLTADLVDAE

SEQ ID NO: 734833 - protein, 27 aa, Mycobacterium
STVRLPRQMPYPLAMELLLTADMVDAE

SEQ ID NO: 734834 - protein, 29 aa, Mycobacterium
STVRRFGEQRLRPFVAEWFESGSVPVREL

SEQ ID NO: 734835 - protein, 23 aa, Mycobacterium
STVSSIFLMCLADEVLAYGDCAI

SEQ ID NO: 734836 - protein, 28 aa, Mycobacterium
STVSSIFLMCLPDRVLAYGDCAIIPNPT

SEQ ID NO: 734837 - protein, 23 aa, Mycobacterium
STVTAAHRWGKYLGMEVESGGAP

SEQ ID NO: 734838 - protein, 23 aa, Mycobacterium
STVTRCLVDLVDPSVVPLRKAPR

SEQ ID NO: 734839 - protein, 24 aa, Mycobacterium
STVTRLEIGYSFRTAEQARSEVAS

SEQ ID NO: 734840 - protein, 26 aa, Mycobacterium
STVVRRMRLQPGRMFLVDTAQGRIVS

SEQ ID NO: 734841 - protein, 18 aa, Mycobacterium
STVYRLVADGALPMPQSR

SEQ ID NO: 734842 - protein, 19 aa, Mycobacterium
STVYRRWGTVPALVADLLT

SEQ ID NO: 734843 - protein, 18 aa, Mycobacterium
STVYSFEVSDRFGNCGIT

SEQ ID NO: 734844 - protein, 25 aa, Mycobacterium
STWAPAEIALAWVPERVQGRLAEVE

SEQ ID NO: 734845 - protein, 24 aa, Mycobacterium
STWGQYPAAVSWPSVSGAARHTIV

SEQ ID NO: 734846 - protein, 25 aa, Mycobacterium
STWMPSTRVTRADWRTIFADNLETA

SEQ ID NO: 734847 - protein, 17 aa, Mycobacterium
STWPSANPLVNLAVGPL

SEQ ID NO: 734848 - protein, 19 aa, Mycobacterium
STWVLSLSGGRLVAADHLG

SEQ ID NO: 734849 - protein, 25 aa, Mycobacterium
STYAKRVGGDWILNGTKYYISGVDE

SEQ ID NO: 734850 - protein, 23 aa, Mycobacterium
STYEPLTALPLRRAVIMLMCGKA

SEQ ID NO: 734851 - protein, 17 aa, Mycobacterium
STYFCWIGGSGPEDPFY

SEQ ID NO: 734852 - protein, 32 aa, Mycobacterium
STYGTGVSCSVCARCTIAAATAAAAGATDTSA

SEQ ID NO: 734853 - protein, 19 aa, Mycobacterium
STYIRACVDAGDMVAAAEA

SEQ ID NO: 734854 - protein, 19 aa, Mycobacterium
STYIRSCVDAGDMVAAEEA

SEQ ID NO: 734855 - protein, 28 aa, Mycobacterium
STYKRATLRRLGVEYVYDSRTTDFADQI

SEQ ID NO: 734856 - protein, 29 aa, Mycobacterium
STYMASSMFRGCVSREFTVLATGKTSSVI

SEQ ID NO: 734857 - protein, 24 aa, Mycobacterium
SVAAEVARLALFLTSPSARHITGQ

SEQ ID NO: 734858 - protein, 21 aa, Mycobacterium
SVAAGDAWLSRELSSYANWAK

SEQ ID NO: 734859 - protein, 18 aa, Mycobacterium
SVAALIRSVVRPPLADAD

SEQ ID NO: 734860 - protein, 17 aa, Mycobacterium
SVAARRGIAVALPSSGG

SEQ ID NO: 734861 - protein, 18 aa, Mycobacterium
SVAAWPAVCSGLRSEARR

SEQ ID NO: 734862 - protein, 23 aa, Mycobacterium
SVADALDILRWAPQAASEPVAKV

SEQ ID NO: 734863 - protein, 25 aa, Mycobacterium
SVADKSELGWRMEVNDSGTWAFFDD

SEQ ID NO: 734864 - protein, 18 aa, Mycobacterium
SVADRLVVKGAREHNLRG

SEQ ID NO: 734865 - protein, 22 aa, Mycobacterium
SVAEAAWWFITMERSCQAQLLA

SEQ ID NO: 734866 - protein, 18 aa, Mycobacterium
SVAEALAEIGYRGTDPRP

SEQ ID NO: 734867 - protein, 24 aa, Mycobacterium
SVAEALGALDMLGERDVFTVGDHH

SEQ ID NO: 734868 - protein, 32 aa, Mycobacterium
SVAEALRAGGFKHRAKVEMRWVASDDCETEHG

SEQ ID NO: 734869 - protein, 19 aa, Mycobacterium
SVAEIAFTVADAYQGRGIG

SEQ ID NO: 734870 - protein, 19 aa, Mycobacterium
SVAELKPGGADGIVDLLVS

SEQ ID NO: 734871 - protein, 19 aa, Mycobacterium
SVAELKPGGPDGIVDLLVA

SEQ ID NO: 734872 - protein, 24 aa, Mycobacterium
SVAELPPELAALTGRDEDRDVDVV

SEQ ID NO: 734873 - protein, 21 aa, Mycobacterium
SVAEMPWAQVLSGDPALGAAL

SEQ ID NO: 734874 - protein, 17 aa, Mycobacterium
SVAEPRFDPARQRVTGA

SEQ ID NO: 734875 - protein, 24 aa, Mycobacterium
SVAERLLARNGWRNTSLAQIAKEA

SEQ ID NO: 734876 - protein, 18 aa, Mycobacterium
SVAEWRNFVAGWKGLHDD

SEQ ID NO: 734877 - protein, 24 aa, Mycobacterium
SVAGCGACPGCATRDPVTCSAGLQ

SEQ ID NO: 734878 - protein, 26 aa, Mycobacterium
SVAGCGGCEGCATGDPAMCRLGPQIF

SEQ ID NO: 734879 - protein, 23 aa, Mycobacterium
SVAGLMAVPGMAVYNASKFGVVG

SEQ ID NO: 734880 - protein, 21 aa, Mycobacterium
SVAGPVFERGLRVVASTRGDP

SEQ ID NO: 734881 - protein, 21 aa, Mycobacterium
SVAGRKGFLRGQLMRDQESGE

SEQ ID NO: 734882 - protein, 26 aa, Mycobacterium
SVAHYDWLVGCGVVFKPEFFDEPGWE

SEQ ID NO: 734883 - protein, 25 aa, Mycobacterium
SVAIRRLERDLGITIVQRGQRFEGF

SEQ ID NO: 734884 - protein, 17 aa, Mycobacterium
SVAKIAFTGAVIGGGGI

SEQ ID NO: 734885 - protein, 24 aa, Mycobacterium
SVAKIAFTGAVLGGGGIALAGHAA

SEQ ID NO: 734886 - protein, 24 aa, Mycobacterium
SVALEGFGLIALESLATGRPAVVT

SEQ ID NO: 734887 - protein, 20 aa, Mycobacterium
SVALGYRRVWAASPVGADLR

SEQ ID NO: 734888 - protein, 23 aa, Mycobacterium
SVALRAAEYGRTVVVLTIDPARR

SEQ ID NO: 734889 - protein, 18 aa, Mycobacterium
SVALRILVYSDNARTREQ

SEQ ID NO: 734890 - protein, 19 aa, Mycobacterium
SVALRILVYSSNAQTRERV

SEQ ID NO: 734891 - protein, 19 aa, Mycobacterium
SVALYRKYRPATFAEVVGQ

SEQ ID NO: 734892 - protein, 17 aa, Mycobacterium
SVAMARFVETFARVLGD

SEQ ID NO: 734893 - protein, 18 aa, Mycobacterium
SVANRIRLAAEVCGDVAA

SEQ ID NO: 734894 - protein, 23 aa, Mycobacterium
SVANRLGADPARVVLEPVGGQSP

SEQ ID NO: 734895 - protein, 19 aa, Mycobacterium
SVAPADAFVGWLPQEHERV

SEQ ID NO: 734896 - protein, 21 aa, Mycobacterium
SVAPADAFVGWLPQEHERVPG

SEQ ID NO: 734897 - protein, 25 aa, Mycobacterium
SVAPALRSRCVLAAVRSATIGMPIE

SEQ ID NO: 734898 - protein, 19 aa, Mycobacterium
SVAPGERVTLIGPSGSGKT

SEQ ID NO: 734899 - protein, 19 aa, Mycobacterium
SVAPGPIWTPLIPATMPAD

SEQ ID NO: 734900 - protein, 18 aa, Mycobacterium
SVAQIALNWLLRRTSVSS

SEQ ID NO: 734901 - protein, 24 aa, Mycobacterium
SVAQPGIGAAIWLHATDVQAIHDA

SEQ ID NO: 734902 - protein, 23 aa, Mycobacterium
SVAQRIGAAPARAILEPIGGQGP

SEQ ID NO: 734903 - protein, 23 aa, Mycobacterium
SVAQRIGAAPARAVLEPIGGQGP

SEQ ID NO: 734904 - protein, 23 aa, Mycobacterium
SVAQRIGADPARAILEIVGGQGP

SEQ ID NO: 734905 - protein, 25 aa, Mycobacterium
SVARLMRLLISRGVFRRRRDGRFAL

SEQ ID NO: 734906 - protein, 17 aa, Mycobacterium
SVARLRFGPATYAKTRR

SEQ ID NO: 734907 - protein, 22 aa, Mycobacterium
SVARLVGAPPGYIGYDQGGQLT

SEQ ID NO: 734908 - protein, 23 aa, Mycobacterium
SVARLVGAPPGYVGYDAGGQLTE

SEQ ID NO: 734909 - protein, 26 aa, Mycobacterium
SVARSVCPFCAVGCAQKVYVTDGKVV

SEQ ID NO: 734910 - protein, 25 aa, Mycobacterium
SVASGRISYCLGLAGPAISVDTACS

SEQ ID NO: 734911 - protein, 20 aa, Mycobacterium
SVATPEFLGLGARLVPKVDA

SEQ ID NO: 734912 - protein, 19 aa, Mycobacterium
SVATVLRFRAFTRDSVGLS

SEQ ID NO: 734913 - protein, 20 aa, Mycobacterium
SVAVATTWHNLVFVGPLDAI

SEQ ID NO: 734914 - protein, 17 aa, Mycobacterium
SVAVLRSSAPWEQWALR

SEQ ID NO: 734915 - protein, 19 aa, Mycobacterium
SVAVSYGLHAAPWADDRPG

SEQ ID NO: 734916 - protein, 22 aa, Mycobacterium
SVAWRKAMAALRIFQSARGSAE

SEQ ID NO: 734917 - protein, 24 aa, Mycobacterium
SVAYRLGRSVARMEAALSAPSIFG

SEQ ID NO: 734918 - protein, 23 aa, Mycobacterium
SVCGPMNRMAFERLAAPVRVTAM

SEQ ID NO: 734919 - protein, 24 aa, Mycobacterium
SVCRACPRLVAWREEVAVTKRKSF

SEQ ID NO: 734920 - protein, 24 aa, Mycobacterium
SVCRACPRLVDWREDVAVLKRRAF

SEQ ID NO: 734921 - protein, 23 aa, Mycobacterium
SVCRACPRLVDWREEVARVKRRA

SEQ ID NO: 734922 - protein, 24 aa, Mycobacterium
SVCRACPRLVGWREHVAAGKRRAF

SEQ ID NO: 734923 - protein, 19 aa, Mycobacterium
SVCTGSFILAQAGLLNGKR

SEQ ID NO: 734924 - protein, 19 aa, Mycobacterium
SVCVHCRPAGAVTPPQGVL

SEQ ID NO: 734925 - protein, 17 aa, Mycobacterium
SVCWYAPDLGPGTGVVF

SEQ ID NO: 734926 - protein, 22 aa, Mycobacterium
SVCYLPLTYDHRLIDGADAGRF

SEQ ID NO: 734927 - protein, 21 aa, Mycobacterium
SVCYLPLTYDHRLVDGADAGR

SEQ ID NO: 734928 - protein, 23 aa, Mycobacterium
SVDADGFLSIVGRKKEIIVTAGG

SEQ ID NO: 734929 - protein, 21 aa, Mycobacterium
SVDADHPHRVPGYRDVVAEVR

SEQ ID NO: 734930 - protein, 18 aa, Mycobacterium
SVDAEFPVDVPFTTVAKG

SEQ ID NO: 734931 - protein, 24 aa, Mycobacterium
SVDALRASGLLGLVLPADVGGIAA

SEQ ID NO: 734932 - protein, 19 aa, Mycobacterium
SVDAVLVAQAWHWFDETRA

SEQ ID NO: 734933 - protein, 24 aa, Mycobacterium
SVDAVLVAQAWHWVDPARAIPEVA

SEQ ID NO: 734934 - protein, 24 aa, Mycobacterium
SVDAVLVAQAWHWVDPTRAIPEVA

SEQ ID NO: 734935 - protein, 25 aa, Mycobacterium
SVDDVPRGISFLLNRNRLNVAVSRA

SEQ ID NO: 734936 - protein, 24 aa, Mycobacterium
SVDERLHHLFARMPDARVHLYGKQ

SEQ ID NO: 734937 - protein, 24 aa, Mycobacterium
SVDGFPNLFLISGPGAPAVLANMV

SEQ ID NO: 734938 - protein, 24 aa, Mycobacterium
SVDGRWEIVDGLDVNPFSRARIDA

SEQ ID NO: 734939 - protein, 18 aa, Mycobacterium
SVDICLSSNVAEHVPQPW

SEQ ID NO: 734940 - protein, 17 aa, Mycobacterium
SVDICLSSNVAEHVPRP

SEQ ID NO: 734941 - protein, 20 aa, Mycobacterium
SVDLAIPMIGMLKRKAERRL

SEQ ID NO: 734942 - protein, 24 aa, Mycobacterium
SVDLALRCVMLLEDRGSIEVGARQ

SEQ ID NO: 734943 - protein, 17 aa, Mycobacterium
SVDMVRTAMEFFEEVLP

SEQ ID NO: 734944 - protein, 17 aa, Mycobacterium
SVDPCQPLTSGVWDGEW

SEQ ID NO: 734945 - protein, 21 aa, Mycobacterium
SVDPSWHEFLVDYNPEPTGEP

SEQ ID NO: 734946 - protein, 17 aa, Mycobacterium
SVDRGRWGCVLGGDVDR

SEQ ID NO: 734947 - protein, 28 aa, Mycobacterium
SVDRRARWGDAVPDGFARISLGIEDTDD

SEQ ID NO: 734948 - protein, 20 aa, Mycobacterium
SVDSARYWLNNERPIDKDDA

SEQ ID NO: 734949 - protein, 20 aa, Mycobacterium
SVDTLNWLQGYGVPFEGSLA

SEQ ID NO: 734950 - protein, 20 aa, Mycobacterium
SVDVHWVYRGGRADLVPEDR

SEQ ID NO: 734951 - protein, 23 aa, Mycobacterium
SVDVRLDCMFRVFNNTRYTHIDP

SEQ ID NO: 734952 - protein, 24 aa, Mycobacterium
SVDWHRAIVDKWRAAGVRTADERD

SEQ ID NO: 734953 - protein, 25 aa, Mycobacterium
SVDYRPGTRVRLRIINAAGDSAFRV

SEQ ID NO: 734954 - protein, 19 aa, Mycobacterium
SVDYTGAGTVEFIVSADRP

SEQ ID NO: 734955 - protein, 23 aa, Mycobacterium
SVEARLLVAAAISFIEDVARTWH

SEQ ID NO: 734956 - protein, 19 aa, Mycobacterium
SVEGALYLRMDDFPARLVI

SEQ ID NO: 734957 - protein, 24 aa, Mycobacterium
SVEKLATLKPVFGVKHGDATMTAG

SEQ ID NO: 734958 - protein, 17 aa, Mycobacterium
SVELCRTQLALGRDTHT

SEQ ID NO: 734959 - protein, 19 aa, Mycobacterium
SVELLPYLRLHYQQAGLSA

SEQ ID NO: 734960 - protein, 22 aa, Mycobacterium
SVELPPAFRFNLIPDGMRDDRE

SEQ ID NO: 734961 - protein, 17 aa, Mycobacterium
SVEPVDLMLAAAQQAAD

SEQ ID NO: 734962 - protein, 18 aa, Mycobacterium
SVEQAGALKDMLAARNTK

SEQ ID NO: 734963 - protein, 19 aa, Mycobacterium
SVEQIWWHWNYTASRHSWQ

SEQ ID NO: 734964 - protein, 24 aa, Mycobacterium
SVEQVAIAWLLRVSPVMLPIPGTS

SEQ ID NO: 734965 - protein, 26 aa, Mycobacterium
SVESGPRLQAVWTWAPSLVDAIQVQR

SEQ ID NO: 734966 - protein, 24 aa, Mycobacterium
SVETFISAGLWYPPDGGDLVPVSG

SEQ ID NO: 734967 - protein, 17 aa, Mycobacterium
SVFAVGYYDQYGYQRPL

SEQ ID NO: 734968 - protein, 21 aa, Mycobacterium
SVFDREWPLRVGDINRTGRLR

SEQ ID NO: 734969 - protein, 25 aa, Mycobacterium
SVFELQARAILGFAVDTLMVSPGAA

SEQ ID NO: 734970 - protein, 23 aa, Mycobacterium
SVFGFLECIELLADYTVVCIDEF

SEQ ID NO: 734971 - protein, 26 aa, Mycobacterium
SVFGIPGNVRPLAIVAIGPVLDNYDG

SEQ ID NO: 734972 - protein, 23 aa, Mycobacterium
SVFHRHFRAVTAMSPLQFQKRIR

SEQ ID NO: 734973 - protein, 33 aa, Mycobacterium
SVFIPELLALHARGRFPIERLVTEFSHRDVTEA

SEQ ID NO: 734974 - protein, 18 aa, Mycobacterium
SVFLRGLARRLLLARQCP

SEQ ID NO: 734975 - protein, 32 aa, Mycobacterium
SVFQTRPAGLPGLRQKYGLDIAPANFMTINDG

SEQ ID NO: 734976 - protein, 19 aa, Mycobacterium
SVFRADFATELEAPAQAGA

SEQ ID NO: 734977 - protein, 17 aa, Mycobacterium
SVFSMIGADRINPAMDT

SEQ ID NO: 734978 - protein, 23 aa, Mycobacterium
SVFSRDLDRAWSVADQVRSGMVH

SEQ ID NO: 734979 - protein, 24 aa, Mycobacterium
SVFTTDRPIIFAYHGYPWLIHRLT

SEQ ID NO: 734980 - protein, 20 aa, Mycobacterium
SVGAGQFGIAGLRPRLARRV

SEQ ID NO: 734981 - protein, 19 aa, Mycobacterium
SVGAILAVPGIRAALRSAT

SEQ ID NO: 734982 - protein, 22 aa, Mycobacterium
SVGAVALVAGWVARTSDPGARI

SEQ ID NO: 734983 - protein, 18 aa, Mycobacterium
SVGDLVLAHGYEIGTGRH

SEQ ID NO: 734984 - protein, 18 aa, Mycobacterium
SVGDRNGNFIGMQAAFHD

SEQ ID NO: 734985 - protein, 30 aa, Mycobacterium
SVGEAAEFLRWTAAEAPGATGYWPAPAVAN

SEQ ID NO: 734986 - protein, 18 aa, Mycobacterium
SVGECIQYSTAVQLAGAP

SEQ ID NO: 734987 - protein, 24 aa, Mycobacterium
SVGENGWAMPLPEELRDDLKSRVA

SEQ ID NO: 734988 - protein, 23 aa, Mycobacterium
SVGEVRGLGVFWAVELVANQQTR

SEQ ID NO: 734989 - protein, 18 aa, Mycobacterium
SVGFEFPDQAFGHLDLER

SEQ ID NO: 734990 - protein, 17 aa, Mycobacterium
SVGGFGHALMVARANGI

SEQ ID NO: 734991 - protein, 23 aa, Mycobacterium
SVGGLKAYPHCGNYVAAKHGVVG

SEQ ID NO: 734992 - protein, 24 aa, Mycobacterium
SVGGLKAYPHCGNYVAAKHGVVGL

SEQ ID NO: 734993 - protein, 25 aa, Mycobacterium
SVGGRAVRGFPGFVDQGPHVDLRVF

SEQ ID NO: 734994 - protein, 26 aa, Mycobacterium
SVGGRTVWGVGIAPSITTASLRAVVS

SEQ ID NO: 734995 - protein, 18 aa, Mycobacterium
SVGGVRIGPNVTIRQAGG

SEQ ID NO: 734996 - protein, 17 aa, Mycobacterium
SVGGWALGPYTLLTPTA

SEQ ID NO: 734997 - protein, 19 aa, Mycobacterium
SVGKRCLLGANAGLGISLG

SEQ ID NO: 734998 - protein, 19 aa, Mycobacterium
SVGLARAAAHAGYRTYFTT

SEQ ID NO: 734999 - protein, 19 aa, Mycobacterium
SVGLEFLSFSGPDVQEGLA

SEQ ID NO: 735000 - protein, 21 aa, Mycobacterium
SVGLKPGFVVIVPVVRKDFKG

SEQ ID NO: 735001 - protein, 21 aa, Mycobacterium
SVGLKPGFVVVVPVVRKEFKG

SEQ ID NO: 735002 - protein, 22 aa, Mycobacterium
SVGLKPGLVIVVPVIKKQFKGA

SEQ ID NO: 735003 - protein, 25 aa, Mycobacterium
SVGLLGCYRDFFGISHGAGLFLCPS

SEQ ID NO: 735004 - protein, 17 aa, Mycobacterium
SVGPAPGLSGVFVNVNR

SEQ ID NO: 735005 - protein, 20 aa, Mycobacterium
SVGPRYGIVPTVMTRPPAAG

SEQ ID NO: 735006 - protein, 23 aa, Mycobacterium
SVGPVSGMSGVFVNVNRGKRSIV

SEQ ID NO: 735007 - protein, 25 aa, Mycobacterium
SVGQGGWIRKIVGGMMGQQFNSPNI

SEQ ID NO: 735008 - protein, 20 aa, Mycobacterium
SVGQVFDWAPALTLSAGLAA

SEQ ID NO: 735009 - protein, 20 aa, Mycobacterium
SVGSSLRKAKKLRVRLPLPK

SEQ ID NO: 735010 - protein, 26 aa, Mycobacterium
SVGTAIAYACLIRGSAGALALYDLNA

SEQ ID NO: 735011 - protein, 18 aa, Mycobacterium
SVGTKFLRQGIRYADLSE

SEQ ID NO: 735012 - protein, 20 aa, Mycobacterium
SVGTQWRSVPSRAFPQRDMD

SEQ ID NO: 735013 - protein, 25 aa, Mycobacterium
SVHAFNLWLDEDWGFDRPGHRIISA

SEQ ID NO: 735014 - protein, 18 aa, Mycobacterium
SVHGICAAYELGDGDATV

SEQ ID NO: 735015 - protein, 18 aa, Mycobacterium
SVHNCARITKAAERADFV

SEQ ID NO: 735016 - protein, 23 aa, Mycobacterium
SVHNSQPWRWRVDAASLHLYADD

SEQ ID NO: 735017 - protein, 18 aa, Mycobacterium
SVHPSLWRQSRLAAKQGL

SEQ ID NO: 735018 - protein, 26 aa, Mycobacterium
SVHPSLWRQSRLCAKQGLYEVVDGIY

SEQ ID NO: 735019 - protein, 24 aa, Mycobacterium
SVHRARVGANIARILQRELTVPAP

SEQ ID NO: 735020 - protein, 27 aa, Mycobacterium
SVHREWLLIELRTDWSPKAGADDAAKT

SEQ ID NO: 735021 - protein, 24 aa, Mycobacterium
SVHVPLRWVGPIKISGSEGQFSAH

SEQ ID NO: 735022 - protein, 22 aa, Mycobacterium
SVHVRGSVVLQRLYEKNQSSDE

SEQ ID NO: 735023 - protein, 24 aa, Mycobacterium
SVHVTRPSRFFVMDAPVFAQFMRD

SEQ ID NO: 735024 - protein, 19 aa, Mycobacterium
SVIAFRRVPIVNGVDLQIT

SEQ ID NO: 735025 - protein, 25 aa, Mycobacterium
SVIAGLKLESWLGPAAASMATAAAP

SEQ ID NO: 735026 - protein, 18 aa, Mycobacterium
SVIARHYLDVAALTDEEV

SEQ ID NO: 735027 - protein, 24 aa, Mycobacterium
SVIEMEHGYLLLMRVGDGSHLATL

SEQ ID NO: 735028 - protein, 32 aa, Mycobacterium
SVIFLVDYLMNFFQYHLPGVQAYHLDVTPDPG

SEQ ID NO: 735029 - protein, 28 aa, Mycobacterium
SVIFREWQRRGYGGKFFVSPDLVTPPIS

SEQ ID NO: 735030 - protein, 24 aa, Mycobacterium
SVIGDFHGLPAWVTMVRSNTPENG

SEQ ID NO: 735031 - protein, 26 aa, Mycobacterium
SVIGDRWAFAMLVAAFVGMRRFTDFQ

SEQ ID NO: 735032 - protein, 24 aa, Mycobacterium
SVIGPFTYLRPGTVTGESAKLGAF

SEQ ID NO: 735033 - protein, 27 aa, Mycobacterium
SVIMPAGSCIFFLGTLWHGGGANNTEA

SEQ ID NO: 735034 - protein, 17 aa, Mycobacterium
SVIMPLAATEQVIRGAL

SEQ ID NO: 735035 - protein, 18 aa, Mycobacterium
SVINYPASIGILSGSLAA

SEQ ID NO: 735036 - protein, 19 aa, Mycobacterium
SVIPHVLVPGLLTALQTTT

SEQ ID NO: 735037 - protein, 17 aa, Mycobacterium
SVIPRLANHYLVAHVLG

SEQ ID NO: 735038 - protein, 17 aa, Mycobacterium
SVIRKALPLLAARLTGT

SEQ ID NO: 735039 - protein, 25 aa, Mycobacterium
SVIRTRWSPEGWVQVAGRVVNDGTR

SEQ ID NO: 735040 - protein, 18 aa, Mycobacterium
SVISELTDAAWIGPAAAS

SEQ ID NO: 735041 - protein, 23 aa, Mycobacterium
SVISGRIAYTLGLAGPALTLDSS

SEQ ID NO: 735042 - protein, 23 aa, Mycobacterium
SVISTLSGMYWWGPASAAMLAAT

SEQ ID NO: 735043 - protein, 25 aa, Mycobacterium
SVITQPRLAGAMAAEARRIAPSMAW

SEQ ID NO: 735044 - protein, 26 aa, Mycobacterium
SVIWAVGFASDYGWLQVDAFDDAGKP

SEQ ID NO: 735045 - protein, 24 aa, Mycobacterium
SVKERKDWSYSRWSEEVTKVLITI

SEQ ID NO: 735046 - protein, 23 aa, Mycobacterium
SVKGEVIASTFDRPPSDHTQAAE

SEQ ID NO: 735047 - protein, 23 aa, Mycobacterium
SVKGEVISSTFDRPPSDHTQAAE

SEQ ID NO: 735048 - protein, 23 aa, Mycobacterium
SVKLPGRIFGSFFGLPEGELRDR

SEQ ID NO: 735049 - protein, 28 aa, Mycobacterium
SVKPLPKSGWRKAVHRLSGGAINPGESS

SEQ ID NO: 735050 - protein, 17 aa, Mycobacterium
SVKRFAALLSNAKTIFW

SEQ ID NO: 735051 - protein, 17 aa, Mycobacterium
SVKRLGALSDLAGPGQE

SEQ ID NO: 735052 - protein, 23 aa, Mycobacterium
SVKSSLRTAVRAFREATSAGDKE

SEQ ID NO: 735053 - protein, 25 aa, Mycobacterium
SVKYTLWRLQERVVGKGAFGQEAPV

SEQ ID NO: 735054 - protein, 17 aa, Mycobacterium
SVLAALEAGCRLIDTAA

SEQ ID NO: 735055 - protein, 23 aa, Mycobacterium
SVLAEYPLAMTVTALAMSPDGKR

SEQ ID NO: 735056 - protein, 17 aa, Mycobacterium
SVLCTNESVLIAEESIA

SEQ ID NO: 735057 - protein, 19 aa, Mycobacterium
SVLDCNKPVIAAVHGAATG

SEQ ID NO: 735058 - protein, 17 aa, Mycobacterium
SVLDYMRRILYAGVATF

SEQ ID NO: 735059 - protein, 24 aa, Mycobacterium
SVLEGRLAAWAVELDAAAGRAVSA

SEQ ID NO: 735060 - protein, 19 aa, Mycobacterium
SVLERGRIEAGGMRYYDHS

SEQ ID NO: 735061 - protein, 19 aa, Mycobacterium
SVLESELRVPTSQAYASFT

SEQ ID NO: 735062 - protein, 18 aa, Mycobacterium
SVLGMFLNTVPLRIRLNA

SEQ ID NO: 735063 - protein, 26 aa, Mycobacterium
SVLGMPFYVMRAIDGWSPMDGGWQAP

SEQ ID NO: 735064 - protein, 26 aa, Mycobacterium
SVLGRSWPAICDELLGHYAAVLSPSA

SEQ ID NO: 735065 - protein, 23 aa, Mycobacterium
SVLGRSWPVICDELLGHYEAVLS

SEQ ID NO: 735066 - protein, 19 aa, Mycobacterium
SVLGWRAQYGQSHYAAAKA

SEQ ID NO: 735067 - protein, 20 aa, Mycobacterium
SVLHEVRLMLDQYWPSVPHV

SEQ ID NO: 735068 - protein, 23 aa, Mycobacterium
SVLHPRAVNAIAVISSPHPVALR

SEQ ID NO: 735069 - protein, 18 aa, Mycobacterium
SVLIRRAALTAGPLGSIL

SEQ ID NO: 735070 - protein, 24 aa, Mycobacterium
SVLLDELDKVWGKLPFDAQWHSDN

SEQ ID NO: 735071 - protein, 17 aa, Mycobacterium
SVLLQAWGDDPFEYDGR

SEQ ID NO: 735072 - protein, 20 aa, Mycobacterium
SVLLSDPWAITRFAEHEVVV

SEQ ID NO: 735073 - protein, 18 aa, Mycobacterium
SVLPALGEEGIYIITWAD

SEQ ID NO: 735074 - protein, 17 aa, Mycobacterium
SVLPEIIETAGTEGGDV

SEQ ID NO: 735075 - protein, 17 aa, Mycobacterium
SVLPEMRDLDGFCSASL

SEQ ID NO: 735076 - protein, 22 aa, Mycobacterium
SVLPGIRAFHAVRPLSVDEAMV

SEQ ID NO: 735077 - protein, 21 aa, Mycobacterium
SVLPLNIFDSLLLSGFSAELW

SEQ ID NO: 735078 - protein, 25 aa, Mycobacterium
SVLPPEINSALIFAGAGSEPMLTAA

SEQ ID NO: 735079 - protein, 20 aa, Mycobacterium
SVLPPLAPEIMAESKRWAFY

SEQ ID NO: 735080 - protein, 20 aa, Mycobacterium
SVLPTVQALIRWDPVGHADA

SEQ ID NO: 735081 - protein, 17 aa, Mycobacterium
SVLPVVVFLHGGGWTVG

SEQ ID NO: 735082 - protein, 20 aa, Mycobacterium
SVLRAVDLVRARSHGRHRFY

SEQ ID NO: 735083 - protein, 18 aa, Mycobacterium
SVLRERLAELGISPLDRD

SEQ ID NO: 735084 - protein, 21 aa, Mycobacterium
SVLRGGRMWFVDQIESSHRLR

SEQ ID NO: 735085 - protein, 17 aa, Mycobacterium
SVLRPVTLPSYGGATTW

SEQ ID NO: 735086 - protein, 20 aa, Mycobacterium
SVLRRLAAMRSYMRDINLGR

SEQ ID NO: 735087 - protein, 19 aa, Mycobacterium
SVLRRLEGHFTLVFANADD

SEQ ID NO: 735088 - protein, 18 aa, Mycobacterium
SVLRRSDTTTYCPYKGEA

SEQ ID NO: 735089 - protein, 20 aa, Mycobacterium
SVLRSFKRLLNEAGPQTEVS

SEQ ID NO: 735090 - protein, 23 aa, Mycobacterium
SVLSGDYWADLAITAERGLLDFL

SEQ ID NO: 735091 - protein, 21 aa, Mycobacterium
SVLSRSCQRWFGASPASLRAQ

SEQ ID NO: 735092 - protein, 23 aa, Mycobacterium
SVLSRSVCGVAGRTLIVNLPGSP

SEQ ID NO: 735093 - protein, 24 aa, Mycobacterium
SVLTRSCKRWFGAGPAAYRNRTRL

SEQ ID NO: 735094 - protein, 25 aa, Mycobacterium
SVLTRSCKRWFGIGPAAYRAKTRVR

SEQ ID NO: 735095 - protein, 20 aa, Mycobacterium
SVLVAALFAGQTMKELVAAG

SEQ ID NO: 735096 - protein, 18 aa, Mycobacterium
SVLVARGELDPHWWHAVA

SEQ ID NO: 735097 - protein, 18 aa, Mycobacterium
SVLYRRFDGDYGVLTPAP

SEQ ID NO: 735098 - protein, 17 aa, Mycobacterium
SVMACIFNFAGSEHSDY

SEQ ID NO: 735099 - protein, 18 aa, Mycobacterium
SVMALCLFDAERLDDELL

SEQ ID NO: 735100 - protein, 17 aa, Mycobacterium
SVMLMLIGSACRDERQF

SEQ ID NO: 735101 - protein, 18 aa, Mycobacterium
SVMLRGTTGFGLKHELRS

SEQ ID NO: 735102 - protein, 24 aa, Mycobacterium
SVMPGDLAVWDGHVAMVIGNGMMV

SEQ ID NO: 735103 - protein, 18 aa, Mycobacterium
SVMPRVASFTSISGPHLQ

SEQ ID NO: 735104 - protein, 28 aa, Mycobacterium
SVMRRIRDGRTRMILPDNGLWIISRAAG

SEQ ID NO: 735105 - protein, 26 aa, Mycobacterium
SVNARIAANLGAPVVLAVKAKGRNPE

SEQ ID NO: 735106 - protein, 22 aa, Mycobacterium
SVNARIAVNLGAPVLLAVSAKG

SEQ ID NO: 735107 - protein, 21 aa, Mycobacterium
SVNARIAVNLGAPVLLTVSGR

SEQ ID NO: 735108 - protein, 24 aa, Mycobacterium
SVNARIAVNLGVPVLLAVNAKGRT

SEQ ID NO: 735109 - protein, 22 aa, Mycobacterium
SVNDAIDILRWAPQAASEPVAK

SEQ ID NO: 735110 - protein, 22 aa, Mycobacterium
SVNEIRGRIVLTQNAAAGTLHF

SEQ ID NO: 735111 - protein, 17 aa, Mycobacterium
SVNFRLSRLGFFAHPAL

SEQ ID NO: 735112 - protein, 36 aa, Mycobacterium
SVNINGWKPVKDVIYSAASALAWPSLSQQTVGSRFL

SEQ ID NO: 735113 - protein, 23 aa, Mycobacterium
SVNLDGALWCTRAVYKKMAKRGG

SEQ ID NO: 735114 - protein, 27 aa, Mycobacterium
SVNLDGALWCTRAVYKKMVKRGGGAIV

SEQ ID NO: 735115 - protein, 23 aa, Mycobacterium
SVNPEHLVIVLGHERERIATAVD

SEQ ID NO: 735116 - protein, 19 aa, Mycobacterium
SVPAGFTRIAAFRGGVAGN

SEQ ID NO: 735117 - protein, 25 aa, Mycobacterium
SVPAGRLGWGWAKFAFNGWKALSWA

SEQ ID NO: 735118 - protein, 22 aa, Mycobacterium
SVPALMRGYLRLGAQVCGEPAH

SEQ ID NO: 735119 - protein, 21 aa, Mycobacterium
SVPALVAWKLGCSSANAHTLA

SEQ ID NO: 735120 - protein, 23 aa, Mycobacterium
SVPDALRQISFRYAADDDQFNTI

SEQ ID NO: 735121 - protein, 25 aa, Mycobacterium
SVPDFPNLFTVFGPYGYVGSSYFAL

SEQ ID NO: 735122 - protein, 22 aa, Mycobacterium
SVPDLPGSSAITFEPGGAVELS

SEQ ID NO: 735123 - protein, 23 aa, Mycobacterium
SVPDLRGRFAVVTGANSGLGFGL

SEQ ID NO: 735124 - protein, 23 aa, Mycobacterium
SVPEDFWPALVFTLVALLDDPVA

SEQ ID NO: 735125 - protein, 22 aa, Mycobacterium
SVPEHLGGPGVDDFRYNAIVID

SEQ ID NO: 735126 - protein, 23 aa, Mycobacterium
SVPEHLVIIGGSYIALEFAQMYR

SEQ ID NO: 735127 - protein, 24 aa, Mycobacterium
SVPEVLRGPLLGALGRSRSSATSQ

SEQ ID NO: 735128 - protein, 17 aa, Mycobacterium
SVPGRRPKPTVAVINVD

SEQ ID NO: 735129 - protein, 22 aa, Mycobacterium
SVPHYGIGYGLLRYLYAPTGRV

SEQ ID NO: 735130 - protein, 23 aa, Mycobacterium
SVPHYGIGYGLLRYLYAPTGRVL

SEQ ID NO: 735131 - protein, 30 aa, Mycobacterium
SVPIAARLAAMPSISLQLLGGRVRGVTQAA

SEQ ID NO: 735132 - protein, 20 aa, Mycobacterium
SVPLPGFLLKRTMKGGVETA

SEQ ID NO: 735133 - protein, 18 aa, Mycobacterium
SVPMCRTEYYISRSFAAV

SEQ ID NO: 735134 - protein, 21 aa, Mycobacterium
SVPMYRLRRYFAPGAGTEDAG

SEQ ID NO: 735135 - protein, 24 aa, Mycobacterium
SVPPSWSAPSARMVSALSPSGLTT

SEQ ID NO: 735136 - protein, 17 aa, Mycobacterium
SVPQMRKQGAGWIVNIG

SEQ ID NO: 735137 - protein, 27 aa, Mycobacterium
SVPQWPDLEAGALKRIRGPRVGEPGDI

SEQ ID NO: 735138 - protein, 19 aa, Mycobacterium
SVPRAWRATVLDLHPDGLG

SEQ ID NO: 735139 - protein, 20 aa, Mycobacterium
SVPRPSWREAATGLIDAITG

SEQ ID NO: 735140 - protein, 20 aa, Mycobacterium
SVPSALRPSAAAGVRLPALA

SEQ ID NO: 735141 - protein, 20 aa, Mycobacterium
SVPTGLWIGGEEREAASTFN

SEQ ID NO: 735142 - protein, 20 aa, Mycobacterium
SVPTGLWIGGEEREGTSTFD

SEQ ID NO: 735143 - protein, 17 aa, Mycobacterium
SVPTSWMNSVGAAANPA

SEQ ID NO: 735144 - protein, 19 aa, Mycobacterium
SVPVGGLLAPTSVATLTLT

SEQ ID NO: 735145 - protein, 26 aa, Mycobacterium
SVPWHRRAIHVFNVIITDGATYQMLE

SEQ ID NO: 735146 - protein, 24 aa, Mycobacterium
SVPYRWRVAPGAVKARRWDVEPDL

SEQ ID NO: 735147 - protein, 24 aa, Mycobacterium
SVQACGQPFFGFISACVEQALAFL

SEQ ID NO: 735148 - protein, 21 aa, Mycobacterium
SVQAGDCLRTVDTLSDADLVE

SEQ ID NO: 735149 - protein, 18 aa, Mycobacterium
SVQLAVLVDRGHRELPVR

SEQ ID NO: 735150 - protein, 24 aa, Mycobacterium
SVQQRAAAVLSFYRYHAHAHNLDA

SEQ ID NO: 735151 - protein, 25 aa, Mycobacterium
SVQVNRYFGGNGHNGIDLNASINPK

SEQ ID NO: 735152 - protein, 20 aa, Mycobacterium
SVRAFPGRLTAAGIDDVDIL

SEQ ID NO: 735153 - protein, 28 aa, Mycobacterium
SVRAGHEITRAAGLKVLHLELGGNCPVI

SEQ ID NO: 735154 - protein, 19 aa, Mycobacterium
SVRAQRALGVWPIQEEIVG

SEQ ID NO: 735155 - protein, 31 aa, Mycobacterium
SVRDLTVGIGRREIVHGVSFDVHREQTVGIV

SEQ ID NO: 735156 - protein, 24 aa, Mycobacterium
SVRDQLRYARFHLGDGTAPDGSRL

SEQ ID NO: 735157 - protein, 22 aa, Mycobacterium
SVREEMLRAAVGLLDEHGPDAL

SEQ ID NO: 735158 - protein, 25 aa, Mycobacterium
SVREHSGRLLIRFAGVSDRDAADAL

SEQ ID NO: 735159 - protein, 18 aa, Mycobacterium
SVRFRHPLIRAAVYHSSS

SEQ ID NO: 735160 - protein, 17 aa, Mycobacterium
SVRGMEVIDRITAGDHR

SEQ ID NO: 735161 - protein, 19 aa, Mycobacterium
SVRGWSTQGLDMFDLAERY

SEQ ID NO: 735162 - protein, 24 aa, Mycobacterium
SVRIKYDAGNPFAPGFTADPNGPL

SEQ ID NO: 735163 - protein, 24 aa, Mycobacterium
SVRIRNVGGFSGMYSQGGDGNADM

SEQ ID NO: 735164 - protein, 21 aa, Mycobacterium
SVRKNILLQAEMRGMPRQVAA

SEQ ID NO: 735165 - protein, 23 aa, Mycobacterium
SVRLGDPSMMWTRVRKLTPQIVE

SEQ ID NO: 735166 - protein, 20 aa, Mycobacterium
SVRLWHWLDPETRDALFSRA

SEQ ID NO: 735167 - protein, 24 aa, Mycobacterium
SVRPEVAHAWHLLERSRGRILVAA

SEQ ID NO: 735168 - protein, 20 aa, Mycobacterium
SVRPGWRANRSSFEVFSDTD

SEQ ID NO: 735169 - protein, 19 aa, Mycobacterium
SVRSARDSWGITESVGATA

SEQ ID NO: 735170 - protein, 17 aa, Mycobacterium
SVRSASVGVWVGVGSRD

SEQ ID NO: 735171 - protein, 20 aa, Mycobacterium
SVRSQPWLSDHVIYGTVVVP

SEQ ID NO: 735172 - protein, 20 aa, Mycobacterium
SVRTLAEMNCKLLLEIGPRP

SEQ ID NO: 735173 - protein, 30 aa, Mycobacterium
SVSAAEQRTRFAIRQVDPVRQWKLSPMDLA

SEQ ID NO: 735174 - protein, 17 aa, Mycobacterium
SVSAFLIMLRSVSNPAA

SEQ ID NO: 735175 - protein, 35 aa, Mycobacterium
SVSAHKFGGPRGIGALLVRSGHRLLPVTRGGPQEN

SEQ ID NO: 735176 - protein, 18 aa, Mycobacterium
SVSALVYIAAFVPDEGES

SEQ ID NO: 735177 - protein, 24 aa, Mycobacterium
SVSAYRCGEAWSTLVRHRGTGRGL

SEQ ID NO: 735178 - protein, 17 aa, Mycobacterium
SVSDLPGVLAQVAEFGG

SEQ ID NO: 735179 - protein, 25 aa, Mycobacterium
SVSEADRLLAIVPMFHANAWGLIYA

SEQ ID NO: 735180 - protein, 27 aa, Mycobacterium
SVSEPIAVIGMGCRFPGGISEPEALWR

SEQ ID NO: 735181 - protein, 20 aa, Mycobacterium
SVSFKIARMQARAHTARLAY

SEQ ID NO: 735182 - protein, 24 aa, Mycobacterium
SVSGEMFVALAGRVARAVIAESPG

SEQ ID NO: 735183 - protein, 20 aa, Mycobacterium
SVSIDRMWSGLLLHPLETAE

SEQ ID NO: 735184 - protein, 18 aa, Mycobacterium
SVSKLGYYSQFRDQSITK

SEQ ID NO: 735185 - protein, 30 aa, Mycobacterium
SVSLGLDGDGLGTCWGREVATTMLADAGFG

SEQ ID NO: 735186 - protein, 20 aa, Mycobacterium
SVSLLLAHLGLDDAASRVDR

SEQ ID NO: 735187 - protein, 18 aa, Mycobacterium
SVSLLLAHMAEIDAAARV

SEQ ID NO: 735188 - protein, 28 aa, Mycobacterium
SVSMAGLQARFGLDSGKWTAEQMARVAL

SEQ ID NO: 735189 - protein, 22 aa, Mycobacterium
SVSMTAQWWLDVREPSKEVVAA

SEQ ID NO: 735190 - protein, 18 aa, Mycobacterium
SVSNPAAVRIVRAALARH

SEQ ID NO: 735191 - protein, 29 aa, Mycobacterium
SVSPAEQRTRFAIRLVDPVRQWKFSPMDI

SEQ ID NO: 735192 - protein, 25 aa, Mycobacterium
SVSPEKRTRLGVGHFVETLETYRRQ

SEQ ID NO: 735193 - protein, 18 aa, Mycobacterium
SVSPRGMVPWTRLGGKLI

SEQ ID NO: 735194 - protein, 20 aa, Mycobacterium
SVSRGEFIAVLGPNGTGKTS

SEQ ID NO: 735195 - protein, 23 aa, Mycobacterium
SVSRGYASVITRLHGESWSGGAA

SEQ ID NO: 735196 - protein, 21 aa, Mycobacterium
SVSRLRGIAHLRGHETDRLAA

SEQ ID NO: 735197 - protein, 25 aa, Mycobacterium
SVSSSLVRRASCPVAVIRDEDPMIP

SEQ ID NO: 735198 - protein, 18 aa, Mycobacterium
SVSTGMRVHAHWVDEPAG

SEQ ID NO: 735199 - protein, 23 aa, Mycobacterium
SVSYLPLTYDHRLIDGADAGRFV

SEQ ID NO: 735200 - protein, 17 aa, Mycobacterium
SVTAGAYEQLRWTQDSF

SEQ ID NO: 735201 - protein, 21 aa, Mycobacterium
SVTAMMGGIIQKITVTDKASR

SEQ ID NO: 735202 - protein, 23 aa, Mycobacterium
SVTASRLKNEFGTVFDEAAVSGA

SEQ ID NO: 735203 - protein, 17 aa, Mycobacterium
SVTAVLAGFDWESLGSR

SEQ ID NO: 735204 - protein, 17 aa, Mycobacterium
SVTETFAAITLEVDTRR

SEQ ID NO: 735205 - protein, 25 aa, Mycobacterium
SVTFLRPRFAREMVTALARIEGRPV

SEQ ID NO: 735206 - protein, 26 aa, Mycobacterium
SVTGFDPNASWFGWASTWGNQFISSG

SEQ ID NO: 735207 - protein, 21 aa, Mycobacterium
SVTGGFPFLVSAALSAIPDGA

SEQ ID NO: 735208 - protein, 28 aa, Mycobacterium
SVTHCLPALLAALAERSTACTFYVETWN

SEQ ID NO: 735209 - protein, 25 aa, Mycobacterium
SVTKHAAVGFAEWLSITYGGQGVGV

SEQ ID NO: 735210 - protein, 20 aa, Mycobacterium
SVTMPGKFAALQFADERTAR

SEQ ID NO: 735211 - protein, 17 aa, Mycobacterium
SVTPGWLRSEMMLDNYG

SEQ ID NO: 735212 - protein, 22 aa, Mycobacterium
SVTPGYLTMGGFIPAQDQLGWY

SEQ ID NO: 735213 - protein, 21 aa, Mycobacterium
SVTPTAVGWVLAEGHGADGTI

SEQ ID NO: 735214 - protein, 19 aa, Mycobacterium
SVTPWLLAEYDRFALLHGD

SEQ ID NO: 735215 - protein, 17 aa, Mycobacterium
SVTRLFDVPGLATCARG

SEQ ID NO: 735216 - protein, 24 aa, Mycobacterium
SVTRLLWSASRERLAVACVNGTEH

SEQ ID NO: 735217 - protein, 28 aa, Mycobacterium
SVTRQDLGLSWRSPRAAIVESFAAARVS

SEQ ID NO: 735218 - protein, 17 aa, Mycobacterium
SVTSGLTGQAWQGAAAA

SEQ ID NO: 735219 - protein, 18 aa, Mycobacterium
SVTVPWTALARIPDGLSF

SEQ ID NO: 735220 - protein, 18 aa, Mycobacterium
SVVADFYTLALFDLDTGE

SEQ ID NO: 735221 - protein, 20 aa, Mycobacterium
SVVATSIYGRLNCAIVNAQG

SEQ ID NO: 735222 - protein, 22 aa, Mycobacterium
SVVCAIQNLWLAATAEGLGVGW

SEQ ID NO: 735223 - protein, 24 aa, Mycobacterium
SVVGERCSPVFVVAAPGQALPALD

SEQ ID NO: 735224 - protein, 25 aa, Mycobacterium
SVVHWLPEYIGMGIDGVSIGSNDLT

SEQ ID NO: 735225 - protein, 24 aa, Mycobacterium
SVVHWLPEYVGMGIDGVSIGSNDL

SEQ ID NO: 735226 - protein, 22 aa, Mycobacterium
SVVINPFFDWGYDRAPMIPYHE

SEQ ID NO: 735227 - protein, 17 aa, Mycobacterium
SVVKHLAHDVAVMYKGS

SEQ ID NO: 735228 - protein, 22 aa, Mycobacterium
SVVKHLAHQVVVMYAGTIVEQG

SEQ ID NO: 735229 - protein, 26 aa, Mycobacterium
SVVLKPAPDTPWCAAVLGELIAEHTD

SEQ ID NO: 735230 - protein, 26 aa, Mycobacterium
SVVLRRIATRTGIPDYGYAFWPGRTL

SEQ ID NO: 735231 - protein, 18 aa, Mycobacterium
SVVLYHFGTKDGLIEAVI

SEQ ID NO: 735232 - protein, 18 aa, Mycobacterium
SVVMTADGTFVYTPTAGA

SEQ ID NO: 735233 - protein, 19 aa, Mycobacterium
SVVPARRPLDVSGPQELTI

SEQ ID NO: 735234 - protein, 29 aa, Mycobacterium
SVVPDALVGLCWPAVFAAIGDAKTTDGTG

SEQ ID NO: 735235 - protein, 18 aa, Mycobacterium
SVVPDGAGIVAAKVEYLN

SEQ ID NO: 735236 - protein, 17 aa, Mycobacterium
SVVPWVLSAQSRQALVA

SEQ ID NO: 735237 - protein, 32 aa, Mycobacterium
SVVPYQLIPRVVHGEQFFKFHRPIKPGDTLVA

SEQ ID NO: 735238 - protein, 20 aa, Mycobacterium
SVVRGARCPVAVVRDEDPLM

SEQ ID NO: 735239 - protein, 21 aa, Mycobacterium
SVVRHLAHRVAVMNKGVIVEQ

SEQ ID NO: 735240 - protein, 25 aa, Mycobacterium
SVVRHQPRVLGLVIELLSRRRIFVP

SEQ ID NO: 735241 - protein, 18 aa, Mycobacterium
SVVRLGRAIGVIYLPATE

SEQ ID NO: 735242 - protein, 23 aa, Mycobacterium
SVVRPDLIAALVLLDPAVGLDGS

SEQ ID NO: 735243 - protein, 33 aa, Mycobacterium
SVVSGLRMAPGHWSGAYACWGTENREAAVRYLT

SEQ ID NO: 735244 - protein, 24 aa, Mycobacterium
SVVSGRVAFTFGLEGPAVSVDTAC

SEQ ID NO: 735245 - protein, 21 aa, Mycobacterium
SVVSLPCVEWFESQPQEYRDS

SEQ ID NO: 735246 - protein, 21 aa, Mycobacterium
SVVSMPCVEWFESQPEEYRDS

SEQ ID NO: 735247 - protein, 18 aa, Mycobacterium
SVVSPLFSAFGPEPVATR

SEQ ID NO: 735248 - protein, 19 aa, Mycobacterium
SVVTPVLKARGRAKVLRNM

SEQ ID NO: 735249 - protein, 25 aa, Mycobacterium
SVVVAGLCRLLARRGVRVAPFKAQN

SEQ ID NO: 735250 - protein, 19 aa, Mycobacterium
SVWDWSEPTGPPGWPGPAK

SEQ ID NO: 735251 - protein, 19 aa, Mycobacterium
SVWEALDKAGYYGLSNFTV

SEQ ID NO: 735252 - protein, 23 aa, Mycobacterium
SVWEVFGSLLYGGRLVMVPDAVV

SEQ ID NO: 735253 - protein, 25 aa, Mycobacterium
SVWFHRPLRFDDWVLYATESPVASA

SEQ ID NO: 735254 - protein, 21 aa, Mycobacterium
SVWGESVAPPALVGGDTLIGE

SEQ ID NO: 735255 - protein, 24 aa, Mycobacterium
SVWLARRGLHVWGIDVSPVAITQA

SEQ ID NO: 735256 - protein, 21 aa, Mycobacterium
SVWPDTVRAAAAWFEGANDLG

SEQ ID NO: 735257 - protein, 17 aa, Mycobacterium
SVYAELAAAGWGGRWLV

SEQ ID NO: 735258 - protein, 18 aa, Mycobacterium
SVYAMAMLFALDRAGAVE

SEQ ID NO: 735259 - protein, 38 aa, Mycobacterium
SVYEPAPRPLLAEAPARPAPQFEVMYLLTGCDAAAADT

SEQ ID NO: 735260 - protein, 17 aa, Mycobacterium
SVYGQSLKGSFVPVGKM

SEQ ID NO: 735261 - protein, 24 aa, Mycobacterium
SVYHSIRCALALAAFVEDPQPEWE

SEQ ID NO: 735262 - protein, 19 aa, Mycobacterium
SVYLFSWGLNHLVSLGLRP

SEQ ID NO: 735263 - protein, 27 aa, Mycobacterium
SVYLTRPSLFHFIRTAEEFSWRASELF

SEQ ID NO: 735264 - protein, 17 aa, Mycobacterium
SVYPFVWNVLLAARNEG

SEQ ID NO: 735265 - protein, 17 aa, Mycobacterium
SVYRGFSSAEDFEREIA

SEQ ID NO: 735266 - protein, 19 aa, Mycobacterium
SVYWKLVAVDQRFGIADRI

SEQ ID NO: 735267 - protein, 21 aa, Mycobacterium
SWAAFTVHAALFLRPGGRMAL

SEQ ID NO: 735268 - protein, 22 aa, Mycobacterium
SWAAKIEYLVGVALSVDPEGDT

SEQ ID NO: 735269 - protein, 20 aa, Mycobacterium
SWADVAMMLSIPYQGLGNAA

SEQ ID NO: 735270 - protein, 19 aa, Mycobacterium
SWAGTLIVVSHDRYLLERV

SEQ ID NO: 735271 - protein, 19 aa, Mycobacterium
SWAQQTWYPVPGIIESAAA

SEQ ID NO: 735272 - protein, 25 aa, Mycobacterium
SWAVTGCAPEKMGIGPVAASDAALQ

SEQ ID NO: 735273 - protein, 26 aa, Mycobacterium
SWAVYRAELALVEVARKTGIRLRLFH

SEQ ID NO: 735274 - protein, 18 aa, Mycobacterium
SWDAMAAAERIYGAKDAP

SEQ ID NO: 735275 - protein, 18 aa, Mycobacterium
SWDDLLLRRLKTAARSGR

SEQ ID NO: 735276 - protein, 28 aa, Mycobacterium
SWDIGVRAPVLFRRTKLTAAMPTPLYGG

SEQ ID NO: 735277 - protein, 25 aa, Mycobacterium
SWDLRKFLWAPKLGCYGIQRIHPLK

SEQ ID NO: 735278 - protein, 18 aa, Mycobacterium
SWDLRKFLWAPMFKCFGI

SEQ ID NO: 735279 - protein, 23 aa, Mycobacterium
SWDPACIPLHHLVTADGEEADDD

SEQ ID NO: 735280 - protein, 26 aa, Mycobacterium
SWDPITRIVGSLGIYTKIDFENKEVV

SEQ ID NO: 735281 - protein, 26 aa, Mycobacterium
SWDPITRIVGSLGIYTKIDFENREVV

SEQ ID NO: 735282 - protein, 19 aa, Mycobacterium
SWEALSRNPLVKHLIETPT

SEQ ID NO: 735283 - protein, 27 aa, Mycobacterium
SWEASFGPGRPGWHVECSAIVLRELGA

SEQ ID NO: 735284 - protein, 19 aa, Mycobacterium
SWEKVNVSRAWSVVMRMTL

SEQ ID NO: 735285 - protein, 19 aa, Mycobacterium
SWERMLRVHVGGLAHVCRA

SEQ ID NO: 735286 - protein, 21 aa, Mycobacterium
SWETADLDAAASRWRTAGDVL

SEQ ID NO: 735287 - protein, 17 aa, Mycobacterium
SWFRLNDDLLIEWQRDF

SEQ ID NO: 735288 - protein, 23 aa, Mycobacterium
SWFRLNDQLLIEWQRDFFDFGHV

SEQ ID NO: 735289 - protein, 18 aa, Mycobacterium
SWGAGLHSGIVAHYILQY

SEQ ID NO: 735290 - protein, 17 aa, Mycobacterium
SWGEPYTEIAARMETAV

SEQ ID NO: 735291 - protein, 32 aa, Mycobacterium
SWGPRSWQAPWFCRWMHGCSNGFGFMVANFGE

SEQ ID NO: 735292 - protein, 22 aa, Mycobacterium
SWGSGKDWQVWSGDQVADLVQL

SEQ ID NO: 735293 - protein, 17 aa, Mycobacterium
SWGSGKDWQVWSGQKVA

SEQ ID NO: 735294 - protein, 28 aa, Mycobacterium
SWGVRDWWSMEWVWSALHLDDGTHLHGV

SEQ ID NO: 735295 - protein, 25 aa, Mycobacterium
SWHDFCAKGRTAAQLVEHPRRILNP

SEQ ID NO: 735296 - protein, 19 aa, Mycobacterium
SWIKPRDAWLIDRATLQPG

SEQ ID NO: 735297 - protein, 22 aa, Mycobacterium
SWIRREPVGVIGQVAPWNYPMM

SEQ ID NO: 735298 - protein, 20 aa, Mycobacterium
SWKAFAPAWAGKAAIEAVDR

SEQ ID NO: 735299 - protein, 30 aa, Mycobacterium
SWKGKAVLVKLIWRMFRARVFGDRMAAIGQ

SEQ ID NO: 735300 - protein, 20 aa, Mycobacterium
SWLAAHYDDLVAWRRHIHRY

SEQ ID NO: 735301 - protein, 20 aa, Mycobacterium
SWLAAHYDDLVGWRRHIHRY

SEQ ID NO: 735302 - protein, 27 aa, Mycobacterium
SWLDPFTEFRFPRIGTAVFDGVELELR

SEQ ID NO: 735303 - protein, 18 aa, Mycobacterium
SWLHRYGDQEISQFRGSE

SEQ ID NO: 735304 - protein, 17 aa, Mycobacterium
SWLLVGISETADRLTTR

SEQ ID NO: 735305 - protein, 21 aa, Mycobacterium
SWLPCFHDMGMVGFLTIPMFF

SEQ ID NO: 735306 - protein, 17 aa, Mycobacterium
SWLRGAGIHSPRGAEMW

SEQ ID NO: 735307 - protein, 26 aa, Mycobacterium
SWLSWDEAVECERSFGPLAFEDQPWR

SEQ ID NO: 735308 - protein, 26 aa, Mycobacterium
SWLVGRPAYHAFTFGWLLSGLARSVT

SEQ ID NO: 735309 - protein, 27 aa, Mycobacterium
SWLYWPHTEPIGAMLFLHGGPEGQARP

SEQ ID NO: 735310 - protein, 25 aa, Mycobacterium
SWMEIEAFRLLTLQTAWKIDQFNDY

SEQ ID NO: 735311 - protein, 26 aa, Mycobacterium
SWMEIEAFRLLTLQTAWKIDQFNDYH

SEQ ID NO: 735312 - protein, 27 aa, Mycobacterium
SWMYESEIYRRLSLSVLVRLPAGIDRP

SEQ ID NO: 735313 - protein, 24 aa, Mycobacterium
SWNDIQFGVGGSWTVANPDAIVGM

SEQ ID NO: 735314 - protein, 26 aa, Mycobacterium
SWNHHVGSAEYLRWLADNDYPLAAVE

SEQ ID NO: 735315 - protein, 22 aa, Mycobacterium
SWNLRKFLWAPQFGMYGIQRIH

SEQ ID NO: 735316 - protein, 18 aa, Mycobacterium
SWNNPGPAARRRIAQHVT

SEQ ID NO: 735317 - protein, 18 aa, Mycobacterium
SWPARITDRGGLRSQFHH

SEQ ID NO: 735318 - protein, 18 aa, Mycobacterium
SWPDPSVVADRWENDVLT

SEQ ID NO: 735319 - protein, 21 aa, Mycobacterium
SWPSICSGLRAEARHGRMLPF

SEQ ID NO: 735320 - protein, 17 aa, Mycobacterium
SWPVYRQITGADALGRG

SEQ ID NO: 735321 - protein, 19 aa, Mycobacterium
SWQKWRQGLAAIWESPEGQ

SEQ ID NO: 735322 - protein, 22 aa, Mycobacterium
SWRILLEDINIAWAQHHGGADI

SEQ ID NO: 735323 - protein, 22 aa, Mycobacterium
SWRILLEDLNIAWAQHHGGQPV

SEQ ID NO: 735324 - protein, 26 aa, Mycobacterium
SWRILLEDLNIAWAQHRSGQPVVLPT

SEQ ID NO: 735325 - protein, 22 aa, Mycobacterium
SWRMAAKSLRPLPVAHKEMSEE

SEQ ID NO: 735326 - protein, 18 aa, Mycobacterium
SWRNPPRALHLANAISAE

SEQ ID NO: 735327 - protein, 18 aa, Mycobacterium
SWRPDLRQPADLVEEVLR

SEQ ID NO: 735328 - protein, 27 aa, Mycobacterium
SWSFALALRLAAFDLLRADGTDPVLML

SEQ ID NO: 735329 - protein, 24 aa, Mycobacterium
SWTAAAPVRLLTAALRDAGLSAAP

SEQ ID NO: 735330 - protein, 19 aa, Mycobacterium
SWTPEGFFGRMLATIRPYR

SEQ ID NO: 735331 - protein, 25 aa, Mycobacterium
SWTPIPGRFPSYLVEHMTGVEEKVR

SEQ ID NO: 735332 - protein, 17 aa, Mycobacterium
SWVAIAVATDDQWAKLC

SEQ ID NO: 735333 - protein, 17 aa, Mycobacterium
SWVAIAVATDEQWHNLC

SEQ ID NO: 735334 - protein, 19 aa, Mycobacterium
SWVAIAVSTDEQWKALTEA

SEQ ID NO: 735335 - protein, 19 aa, Mycobacterium
SWVDIKRKPSEYVKDHIKF

SEQ ID NO: 735336 - protein, 19 aa, Mycobacterium
SWVELPLRAPLGPPVHDPG

SEQ ID NO: 735337 - protein, 19 aa, Mycobacterium
SWVELVAAVRPDWTPGEAR

SEQ ID NO: 735338 - protein, 17 aa, Mycobacterium
SWVPRLLWRRWSPTYYA

SEQ ID NO: 735339 - protein, 26 aa, Mycobacterium
SWVREGYGWLQPRLSPIARVALPPKL

SEQ ID NO: 735340 - protein, 19 aa, Mycobacterium
SWVRPALAGPPAWELLPHE

SEQ ID NO: 735341 - protein, 20 aa, Mycobacterium
SWVRRYPDVHVQTVAAGTGA

SEQ ID NO: 735342 - protein, 18 aa, Mycobacterium
SWWFPAVAPLPGKAPAVM

SEQ ID NO: 735343 - protein, 25 aa, Mycobacterium
SWWKEQRGARIFVDFNQNARDRTMA

SEQ ID NO: 735344 - protein, 26 aa, Mycobacterium
SWWRRAESVGFCAHPIQLRGTDEIGR

SEQ ID NO: 735345 - protein, 19 aa, Mycobacterium
SWWSDAVFYQVYPRSFADS

SEQ ID NO: 735346 - protein, 23 aa, Mycobacterium
SWYGSRAIIAPSLATRPVLPRQA

SEQ ID NO: 735347 - protein, 22 aa, Mycobacterium
SYAARFPQINWEITPGNSSPLS

SEQ ID NO: 735348 - protein, 18 aa, Mycobacterium
SYADVFKGDDRWRSLPTP

SEQ ID NO: 735349 - protein, 18 aa, Mycobacterium
SYAEAAAISAVFTTAYYA

SEQ ID NO: 735350 - protein, 18 aa, Mycobacterium
SYAEAAGISAVFTTAYMA

SEQ ID NO: 735351 - protein, 19 aa, Mycobacterium
SYAEARALIADEVVEAARA

SEQ ID NO: 735352 - protein, 23 aa, Mycobacterium
SYAERRRLFDLPRSSWDDYDKSL

SEQ ID NO: 735353 - protein, 25 aa, Mycobacterium
SYAFDFSVWEIWGALSGGGRLVVVP

SEQ ID NO: 735354 - protein, 18 aa, Mycobacterium
SYALRRGAQALGSFTQFE

SEQ ID NO: 735355 - protein, 28 aa, Mycobacterium
SYAPRPRMLVFGAIDFAAALAHQAAFLG

SEQ ID NO: 735356 - protein, 38 aa, Mycobacterium
SYAPRPRMLVFGAIDFAAALARQGSFLGYRVTVCDARA

SEQ ID NO: 735357 - protein, 31 aa, Mycobacterium
SYAPTRLRYPYARGVLIEMYREAKARLGDPV

SEQ ID NO: 735358 - protein, 25 aa, Mycobacterium
SYARQRPALLAGWLDGHLDGVDADL

SEQ ID NO: 735359 - protein, 25 aa, Mycobacterium
SYARQRPELLVSWLDGDPAEPDLAW

SEQ ID NO: 735360 - protein, 19 aa, Mycobacterium
SYARWMFLSPDARKLFADW

SEQ ID NO: 735361 - protein, 18 aa, Mycobacterium
SYAYLRISTTGAHSSYAI

SEQ ID NO: 735362 - protein, 17 aa, Mycobacterium
SYCRHMGGDLSQGEVKG

SEQ ID NO: 735363 - protein, 17 aa, Mycobacterium
SYCYIPLLEELDFMPSK

SEQ ID NO: 735364 - protein, 18 aa, Mycobacterium
SYDDWPEGWRFDDLLPYF

SEQ ID NO: 735365 - protein, 25 aa, Mycobacterium
SYDFITRPGVQHALATADTEFLRLT

SEQ ID NO: 735366 - protein, 25 aa, Mycobacterium
SYDGEIFFDGKLCEFKDIRSSERCG

SEQ ID NO: 735367 - protein, 23 aa, Mycobacterium
SYDLSSLRFIMWGATPVTASIAE

SEQ ID NO: 735368 - protein, 25 aa, Mycobacterium
SYDLSSLRYIMWGATPVSARVAETV

SEQ ID NO: 735369 - protein, 18 aa, Mycobacterium
SYDRRGLMRFVTTVKSGS

SEQ ID NO: 735370 - protein, 19 aa, Mycobacterium
SYDTWDLRIDPRIPQREHE

SEQ ID NO: 735371 - protein, 17 aa, Mycobacterium
SYEEIVDAIKAFGQTQQ

SEQ ID NO: 735372 - protein, 30 aa, Mycobacterium
SYEHPYPHCWRCRNPLIYRAVSSWFVTVTE

SEQ ID NO: 735373 - protein, 25 aa, Mycobacterium
SYEKLRGSGGIQWPCNAEHPDGVER

SEQ ID NO: 735374 - protein, 22 aa, Mycobacterium
SYELEMAELLGIDADHVVQAAL

SEQ ID NO: 735375 - protein, 23 aa, Mycobacterium
SYELFARKVIPYFKGQLEASRAS

SEQ ID NO: 735376 - protein, 18 aa, Mycobacterium
SYFDIDWDLDEDGRIVLP

SEQ ID NO: 735377 - protein, 19 aa, Mycobacterium
SYFGMGMGQFIASIAQQTI

SEQ ID NO: 735378 - protein, 31 aa, Mycobacterium
SYFGQRLPAPVPYRRFVSWLAEQDNDAARAA

SEQ ID NO: 735379 - protein, 25 aa, Mycobacterium
SYFLPRILTGEVFFCQGYSEPEAGS

SEQ ID NO: 735380 - protein, 27 aa, Mycobacterium
SYGAGFAARAAWRWTKHLHGRADRTLA

SEQ ID NO: 735381 - protein, 25 aa, Mycobacterium
SYGARGWAPQGYYFADPDGNVVEAR

SEQ ID NO: 735382 - protein, 23 aa, Mycobacterium
SYGASPRASLGIIASARALALVR

SEQ ID NO: 735383 - protein, 18 aa, Mycobacterium
SYGATGHRLDDPAKFRAI

SEQ ID NO: 735384 - protein, 23 aa, Mycobacterium
SYGDYCIRQHEFLSGLTPDSEPV

SEQ ID NO: 735385 - protein, 21 aa, Mycobacterium
SYGELWDRISALADVLSTEQT

SEQ ID NO: 735386 - protein, 17 aa, Mycobacterium
SYGGGILKIEPREADQW

SEQ ID NO: 735387 - protein, 17 aa, Mycobacterium
SYGNLRLDLRTRRAHVG

SEQ ID NO: 735388 - protein, 25 aa, Mycobacterium
SYGRAESAGAAVLQTVGADVLGAVN

SEQ ID NO: 735389 - protein, 24 aa, Mycobacterium
SYGRFMRIRAFDCWMHEQDIRHAL

SEQ ID NO: 735390 - protein, 20 aa, Mycobacterium
SYGRFMRVRVFDCWMHEQDI

SEQ ID NO: 735391 - protein, 23 aa, Mycobacterium
SYGSLEVFSGVDLAIDRGSRVVV

SEQ ID NO: 735392 - protein, 25 aa, Mycobacterium
SYHAELDWWTSPFVLTDGVPPLALA

SEQ ID NO: 735393 - protein, 24 aa, Mycobacterium
SYHAELYWWTGQFESIDGIPYSAL

SEQ ID NO: 735394 - protein, 19 aa, Mycobacterium
SYHFTRPGQDVTLFSRTMT

SEQ ID NO: 735395 - protein, 19 aa, Mycobacterium
SYHGVVFAELGAPAYALKA

SEQ ID NO: 735396 - protein, 18 aa, Mycobacterium
SYHGVVFAELGPPAYALK

SEQ ID NO: 735397 - protein, 22 aa, Mycobacterium
SYHPESFARIFATAGRPLGGVL

SEQ ID NO: 735398 - protein, 31 aa, Mycobacterium
SYHREIAMNFGLDGPWGQWVNRWTAEENRHG

SEQ ID NO: 735399 - protein, 32 aa, Mycobacterium
SYHREIAMNFSMDGPWGFWVNRWTAEENRHGI

SEQ ID NO: 735400 - protein, 33 aa, Mycobacterium
SYHREIAMNFSMDGPWGQWVNRWTAEENRHGIA

SEQ ID NO: 735401 - protein, 18 aa, Mycobacterium
SYHRFLRRAIDPDPSARF

SEQ ID NO: 735402 - protein, 21 aa, Mycobacterium
SYHRQAAKYFGLDGAWGTWVG

SEQ ID NO: 735403 - protein, 18 aa, Mycobacterium
SYHTVWFELHEELIVAVG

SEQ ID NO: 735404 - protein, 17 aa, Mycobacterium
SYIAVALDVPISSVDVR

SEQ ID NO: 735405 - protein, 19 aa, Mycobacterium
SYIGRYPKPYVAIMNGITM

SEQ ID NO: 735406 - protein, 20 aa, Mycobacterium
SYIRLDLAQELARQLGAPAV

SEQ ID NO: 735407 - protein, 22 aa, Mycobacterium
SYIYYPDCAEVGIGAGAEIRGR

SEQ ID NO: 735408 - protein, 28 aa, Mycobacterium
SYKACFLALLRRFYELGVKELNGHLLYA

SEQ ID NO: 735409 - protein, 27 aa, Mycobacterium
SYKACFLAMLRRFHELGVKELNGHLLY

SEQ ID NO: 735410 - protein, 21 aa, Mycobacterium
SYKPNPRWSRRYAEQPEILKY

SEQ ID NO: 735411 - protein, 29 aa, Mycobacterium
SYKSCFLAMLRRFYELGVKELNGHLLYAL

SEQ ID NO: 735412 - protein, 24 aa, Mycobacterium
SYLDKLLWILTGNFAKPGGQHLHS

SEQ ID NO: 735413 - protein, 28 aa, Mycobacterium
SYLEAWCRGSEGVRLFRFDRIEQAEVLD

SEQ ID NO: 735414 - protein, 29 aa, Mycobacterium
SYLEAWCRSAEAVRLFRFDRIVDAQLLDD

SEQ ID NO: 735415 - protein, 17 aa, Mycobacterium
SYLGDIDPMIGRPDGSD

SEQ ID NO: 735416 - protein, 25 aa, Mycobacterium
SYLKGRGLGKVCALVTDGRFSGGSS

SEQ ID NO: 735417 - protein, 23 aa, Mycobacterium
SYLNKLLWILTGNFAKKGGQHLH

SEQ ID NO: 735418 - protein, 28 aa, Mycobacterium
SYLPPVGIGEVMRAGGLGEVIASKNPRY

SEQ ID NO: 735419 - protein, 17 aa, Mycobacterium
SYLPVSFETLRVYSNPG

SEQ ID NO: 735420 - protein, 30 aa, Mycobacterium
SYLVGLMAERWLSAGYCVLVIDPEGDHLQL

SEQ ID NO: 735421 - protein, 17 aa, Mycobacterium
SYLVSLLPPRIVDDLGA

SEQ ID NO: 735422 - protein, 17 aa, Mycobacterium
SYLVSLLPQRIVDELGA

SEQ ID NO: 735423 - protein, 25 aa, Mycobacterium
SYLVSRPDVAASLGGIAAPLNELRT

SEQ ID NO: 735424 - protein, 18 aa, Mycobacterium
SYNDFEIVAANLLDDDPR

SEQ ID NO: 735425 - protein, 18 aa, Mycobacterium
SYNLNLFLDGIEQAVNGD

SEQ ID NO: 735426 - protein, 29 aa, Mycobacterium
SYNRPKLPGIPGIKDFRDAGGHVFHSARW

SEQ ID NO: 735427 - protein, 23 aa, Mycobacterium
SYPAALRLAREVVRNPATQLRPL

SEQ ID NO: 735428 - protein, 34 aa, Mycobacterium
SYPALAVTLNEEFPRLMVYRGPRRKGVRYFGPYS

SEQ ID NO: 735429 - protein, 20 aa, Mycobacterium
SYPDMVQRALPFCGSSKTSE

SEQ ID NO: 735430 - protein, 27 aa, Mycobacterium
SYPDRIIPCQLPWLLDPDVGAQMIYEN

SEQ ID NO: 735431 - protein, 25 aa, Mycobacterium
SYPERIIPCQLPWLLDPDLGARMIY

SEQ ID NO: 735432 - protein, 19 aa, Mycobacterium
SYPKQWWGREYPHKLASVI

SEQ ID NO: 735433 - protein, 21 aa, Mycobacterium
SYPPEAIDWLLPDGAHDVLDL

SEQ ID NO: 735434 - protein, 24 aa, Mycobacterium
SYPPEAIDWLLPRGARQVLDLGAG

SEQ ID NO: 735435 - protein, 24 aa, Mycobacterium
SYPPEAIDWLLPVGARQVLDLGAG

SEQ ID NO: 735436 - protein, 22 aa, Mycobacterium
SYPPHVRELFALEWTPEDEEML

SEQ ID NO: 735437 - protein, 23 aa, Mycobacterium
SYPQDRMSFVLSDSDPTLVIREP

SEQ ID NO: 735438 - protein, 24 aa, Mycobacterium
SYPSMEWYGFILVWHERHGRAPYW

SEQ ID NO: 735439 - protein, 17 aa, Mycobacterium
SYPTDDYYLYFSGSESS

SEQ ID NO: 735440 - protein, 18 aa, Mycobacterium
SYPTFLLTHWARDRHRGP

SEQ ID NO: 735441 - protein, 18 aa, Mycobacterium
SYPTFLLTHWARDRKRGE

SEQ ID NO: 735442 - protein, 18 aa, Mycobacterium
SYPTFLLTHWARDRRRGE

SEQ ID NO: 735443 - protein, 24 aa, Mycobacterium
SYPVGHLSTMAWIGVKPGDVHLAI

SEQ ID NO: 735444 - protein, 21 aa, Mycobacterium
SYPVIERFEHVWTCLGDPVFD

SEQ ID NO: 735445 - protein, 34 aa, Mycobacterium
SYPVLAVTLNEDFPRLMVYRGPRRKGVRYFGPYS

SEQ ID NO: 735446 - protein, 25 aa, Mycobacterium
SYPVVRRILDRAGVTLAELIGDTRT

SEQ ID NO: 735447 - protein, 34 aa, Mycobacterium
SYQALSAQMAAFHDRFMNALAGASGSYASAEAAN

SEQ ID NO: 735448 - protein, 18 aa, Mycobacterium
SYQCAIDAMSSRCFPSYA

SEQ ID NO: 735449 - protein, 25 aa, Mycobacterium
SYQFSFEKRPSWSRTYAPGIELKNY

SEQ ID NO: 735450 - protein, 24 aa, Mycobacterium
SYQFTRPRMDGLWPAPDELDGFRD

SEQ ID NO: 735451 - protein, 18 aa, Mycobacterium
SYQIYRLDAVPNTEKLPY

SEQ ID NO: 735452 - protein, 18 aa, Mycobacterium
SYQIYRLDAVPNTKKLPY

SEQ ID NO: 735453 - protein, 18 aa, Mycobacterium
SYQIYRLDAVPNTKRLPY

SEQ ID NO: 735454 - protein, 25 aa, Mycobacterium
SYQPEIWDYLKGVTEKYGLRRYIQF

SEQ ID NO: 735455 - protein, 24 aa, Mycobacterium
SYQPEIWDYLKGVTEKYGLRRYIR

SEQ ID NO: 735456 - protein, 24 aa, Mycobacterium
SYQPEIWDYLKGVTEKYGLRRYVE

SEQ ID NO: 735457 - protein, 23 aa, Mycobacterium
SYQPEIWDYLQGVTEKYGLRRYI

SEQ ID NO: 735458 - protein, 24 aa, Mycobacterium
SYQPTLAGLRAFVAVAEKQHFGSA

SEQ ID NO: 735459 - protein, 24 aa, Mycobacterium
SYQPTLAGLRAFVAVANKQHFSSA

SEQ ID NO: 735460 - protein, 18 aa, Mycobacterium
SYQRACLHAIDYLTKFGY

SEQ ID NO: 735461 - protein, 21 aa, Mycobacterium
SYQRLSFMVGKLNRAMQRNPL

SEQ ID NO: 735462 - protein, 18 aa, Mycobacterium
SYQVCDWLVPMAADPLVS

SEQ ID NO: 735463 - protein, 19 aa, Mycobacterium
SYRCIPATATVRLAKPTSN

SEQ ID NO: 735464 - protein, 24 aa, Mycobacterium
SYRDLAGFGRRFIDVAADDLAADL

SEQ ID NO: 735465 - protein, 25 aa, Mycobacterium
SYREARVALGIARRLHRTGATSYQQ

SEQ ID NO: 735466 - protein, 24 aa, Mycobacterium
SYRELPLRLFEFGSVYRYEKSGVI

SEQ ID NO: 735467 - protein, 24 aa, Mycobacterium
SYRELPLRLFEFGSVYRYEKSGVV

SEQ ID NO: 735468 - protein, 25 aa, Mycobacterium
SYRELPLRLFEFGSVYRYEKSGVVH

SEQ ID NO: 735469 - protein, 29 aa, Mycobacterium
SYRFADHVRYLDAWFEAVGITENVVLVVH

SEQ ID NO: 735470 - protein, 18 aa, Mycobacterium
SYRGSVREACLWSSGLAR

SEQ ID NO: 735471 - protein, 18 aa, Mycobacterium
SYRLFGHGFYNPEPALRW

SEQ ID NO: 735472 - protein, 20 aa, Mycobacterium
SYRPHELFDGTGALRPELRA

SEQ ID NO: 735473 - protein, 32 aa, Mycobacterium
SYRRCATGYFLTRAAMRWYWAQYVGAQTVFDP

SEQ ID NO: 735474 - protein, 26 aa, Mycobacterium
SYRREALPRLALWRVNSDGTYAEPEE

SEQ ID NO: 735475 - protein, 17 aa, Mycobacterium
SYRRRIESHLGPSGFML

SEQ ID NO: 735476 - protein, 20 aa, Mycobacterium
SYRRWCELMWHRASAPQVQD

SEQ ID NO: 735477 - protein, 25 aa, Mycobacterium
SYSGFTFPILSDFWPHGAVAEAYGV

SEQ ID NO: 735478 - protein, 18 aa, Mycobacterium
SYSGMALLGCTNRHVAPL

SEQ ID NO: 735479 - protein, 18 aa, Mycobacterium
SYSGQLWGAPKQLRSANG

SEQ ID NO: 735480 - protein, 25 aa, Mycobacterium
SYSLDTACLVGFPRRDLSAEETEDT

SEQ ID NO: 735481 - protein, 18 aa, Mycobacterium
SYSLPTCTVEEAALEMEQ

SEQ ID NO: 735482 - protein, 18 aa, Mycobacterium
SYSPVIAMAGCERRAVPL

SEQ ID NO: 735483 - protein, 18 aa, Mycobacterium
SYSPVIAMAGCHRRAVPL

SEQ ID NO: 735484 - protein, 22 aa, Mycobacterium
SYSQLAMWFHYRMRGANDVFNM

SEQ ID NO: 735485 - protein, 19 aa, Mycobacterium
SYSTYFLAHWARDRASGRF

SEQ ID NO: 735486 - protein, 18 aa, Mycobacterium
SYSTYFLTHWARDRASGR

SEQ ID NO: 735487 - protein, 21 aa, Mycobacterium
SYSTYFLTHWARDRKAGRFTV

SEQ ID NO: 735488 - protein, 28 aa, Mycobacterium
SYTDPQGALALWSGWLGTDLSRFDLDDP

SEQ ID NO: 735489 - protein, 26 aa, Mycobacterium
SYTDWNQFGGYGWGFADLLPYFMRSE

SEQ ID NO: 735490 - protein, 24 aa, Mycobacterium
SYTPLVQVSFAWEQARRFQGGAAD

SEQ ID NO: 735491 - protein, 17 aa, Mycobacterium
SYTQQLWEAIRAQDVQG

SEQ ID NO: 735492 - protein, 25 aa, Mycobacterium
SYTSFDAFGAFGGWQVKQTAGGITP

SEQ ID NO: 735493 - protein, 25 aa, Mycobacterium
SYTSFDSFELWNAWFRVWTIGTLYG

SEQ ID NO: 735494 - protein, 23 aa, Mycobacterium
SYVFDHIKLGAAVPTPPVLIVQA

SEQ ID NO: 735495 - protein, 19 aa, Mycobacterium
SYVGPWLPEPLLLDDRDAS

SEQ ID NO: 735496 - protein, 17 aa, Mycobacterium
SYVKLVFVADDVDVAEL

SEQ ID NO: 735497 - protein, 17 aa, Mycobacterium
SYVKLVFVADDVDVAGL

SEQ ID NO: 735498 - protein, 17 aa, Mycobacterium
SYVKLVFVADDVDVSSL

SEQ ID NO: 735499 - protein, 19 aa, Mycobacterium
SYVLHPYQMVKDLRTEYEV

SEQ ID NO: 735500 - protein, 17 aa, Mycobacterium
SYVRRAALMSGIEEFDA

SEQ ID NO: 735501 - protein, 17 aa, Mycobacterium
SYVRVSATLPRTMTFKV

SEQ ID NO: 735502 - protein, 29 aa, Mycobacterium
SYVWGGAAPGGFDCSGLVMWAFQQAGISL

SEQ ID NO: 735503 - protein, 21 aa, Mycobacterium
SYVYYPDCADVSIGAGAEIRG

SEQ ID NO: 735504 - protein, 18 aa, Mycobacterium
SYWYAEQVTILGLGPIWQ

SEQ ID NO: 735505 - protein, 19 aa, Mycobacterium
SYYELGHQLGLPAGIASDG

SEQ ID NO: 735506 - protein, 17 aa, Mycobacterium
SYYRWPRDTAFANWRSQ

SEQ ID NO: 735507 - protein, 59 aa, Mycobacterium
TAAADEVSTAIAAFFSAHAADYQRLAGQAAALHTQLERVLSAGAVAYAAAETTGTSPLQ

SEQ ID NO: 735508 - protein, 30 aa, Mycobacterium
TAAADYIRLFLAVRGPLGFTTGFNDIGLLV

SEQ ID NO: 735509 - protein, 24 aa, Mycobacterium
TAAAEAWGGMALSAVMIAAVRTGL

SEQ ID NO: 735510 - protein, 26 aa, Mycobacterium
TAAAELGGQCAFELALIAPQLPPFDV

SEQ ID NO: 735511 - protein, 19 aa, Mycobacterium
TAAAIALLFENFTTVFVGP

SEQ ID NO: 735512 - protein, 19 aa, Mycobacterium
TAAAIALLFENFTTVFVGR

SEQ ID NO: 735513 - protein, 23 aa, Mycobacterium
TAAAKARSWLALEPSAPVRYLTY

SEQ ID NO: 735514 - protein, 24 aa, Mycobacterium
TAAAKLFGGYALEYQSVIGHVTAF

SEQ ID NO: 735515 - protein, 26 aa, Mycobacterium
TAAALRLGFLAGHLHWKVDQHDDTLV

SEQ ID NO: 735516 - protein, 19 aa, Mycobacterium
TAAAPRGDFCLTEDRRPVV

SEQ ID NO: 735517 - protein, 21 aa, Mycobacterium
TAAAPWPGPEGDRRRAAVSSF

SEQ ID NO: 735518 - protein, 21 aa, Mycobacterium
TAAAPYAGWLSAAAAQAQQTA

SEQ ID NO: 735519 - protein, 18 aa, Mycobacterium
TAAAVLLGLEGDVAPFAV

SEQ ID NO: 735520 - protein, 33 aa, Mycobacterium
TAACALLVGKCCGHGSDIVLDFPVSRRVQPESL

SEQ ID NO: 735521 - protein, 26 aa, Mycobacterium
TAADDVRAGWDWLVDTCGLPPKHIVI

SEQ ID NO: 735522 - protein, 26 aa, Mycobacterium
TAADKPRPVVFLFPGQGSQFSGMGEQ

SEQ ID NO: 735523 - protein, 27 aa, Mycobacterium
TAADLGPLRWLPAIPDVLAADPTWATC

SEQ ID NO: 735524 - protein, 23 aa, Mycobacterium
TAADLPATFAVKLPAQDDAVRER

SEQ ID NO: 735525 - protein, 21 aa, Mycobacterium
TAADLRNSSGTALIIHQDPDN

SEQ ID NO: 735526 - protein, 17 aa, Mycobacterium
TAADVFCVTAASGGQAG

SEQ ID NO: 735527 - protein, 21 aa, Mycobacterium
TAADVRARWLVAADGLHSGVR

SEQ ID NO: 735528 - protein, 31 aa, Mycobacterium
TAAEELRRLWRARRVLAVTFPAYGSSTETAF

SEQ ID NO: 735529 - protein, 19 aa, Mycobacterium
TAAEFAHRFATDHVGLRED

SEQ ID NO: 735530 - protein, 17 aa, Mycobacterium
TAAEFTDAVKVAKAADR

SEQ ID NO: 735531 - protein, 25 aa, Mycobacterium
TAAEIAPEWHLRMQAAVQRHVDAAV

SEQ ID NO: 735532 - protein, 17 aa, Mycobacterium
TAAEIQQDWDTNPRWKG

SEQ ID NO: 735533 - protein, 25 aa, Mycobacterium
TAAELRLLPHLATHLSLQRIAEELV

SEQ ID NO: 735534 - protein, 24 aa, Mycobacterium
TAAEPGALIGFLGPRVYEHLYGEP

SEQ ID NO: 735535 - protein, 23 aa, Mycobacterium
TAAEPRGTVLVIHENKGLNDWVR

SEQ ID NO: 735536 - protein, 26 aa, Mycobacterium
TAAFEFRAGPVFTNLLLADEINRTPP

SEQ ID NO: 735537 - protein, 26 aa, Mycobacterium
TAAFPRYHPKWAWWITKIPALREVLV

SEQ ID NO: 735538 - protein, 19 aa, Mycobacterium
TAAGACLAGSDARNAGGAS

SEQ ID NO: 735539 - protein, 19 aa, Mycobacterium
TAAGFILDGYPRSVEQAKA

SEQ ID NO: 735540 - protein, 27 aa, Mycobacterium
TAAGHGGKGGDGFSPATSGQDGGSGGK

SEQ ID NO: 735541 - protein, 17 aa, Mycobacterium
TAAGIPVMAHIGFTPQS

SEQ ID NO: 735542 - protein, 25 aa, Mycobacterium
TAAGKTWFALACATAELLAGNPVVY

SEQ ID NO: 735543 - protein, 31 aa, Mycobacterium
TAAGLRAGIPMLIRWLWLDQPIWAAGIEELG

SEQ ID NO: 735544 - protein, 30 aa, Mycobacterium
TAAGLRAGVPMLILWLWLDQPMWAEAVSAL

SEQ ID NO: 735545 - protein, 17 aa, Mycobacterium
TAAGLRSVATWLRTMFA

SEQ ID NO: 735546 - protein, 26 aa, Mycobacterium
TAAGPELRANWSWAPSALDGAQADRL

SEQ ID NO: 735547 - protein, 20 aa, Mycobacterium
TAAGPGFRPSASVEVRLSGG

SEQ ID NO: 735548 - protein, 26 aa, Mycobacterium
TAAGRAVFTPGLAGLVLGEYRRIAQS

SEQ ID NO: 735549 - protein, 26 aa, Mycobacterium
TAAGRAVFTPSLAGLVLGEYRRIAQT

SEQ ID NO: 735550 - protein, 26 aa, Mycobacterium
TAAGRAVFTPSLAGLVLGEYRRIATS

SEQ ID NO: 735551 - protein, 18 aa, Mycobacterium
TAAGSGWVGQIVGNAFMK

SEQ ID NO: 735552 - protein, 21 aa, Mycobacterium
TAAGTIGWCVRAVTAHLRTRE

SEQ ID NO: 735553 - protein, 17 aa, Mycobacterium
TAAGWERRLRPLGVPAA

SEQ ID NO: 735554 - protein, 19 aa, Mycobacterium
TAAHARILGAWVEELVLVG

SEQ ID NO: 735555 - protein, 24 aa, Mycobacterium
TAAHGVAAMLIAKPYLPWGDTHEF

SEQ ID NO: 735556 - protein, 29 aa, Mycobacterium
TAAHSVEIGYCLGRRWWGKGLMSEVLGML

SEQ ID NO: 735557 - protein, 20 aa, Mycobacterium
TAAHTFKAQALAAAALPHGA

SEQ ID NO: 735558 - protein, 25 aa, Mycobacterium
TAAIARPDLLADMATQFGSQCIVLS

SEQ ID NO: 735559 - protein, 25 aa, Mycobacterium
TAAKAGIAGMCLTMARDLGSVGIRV

SEQ ID NO: 735560 - protein, 19 aa, Mycobacterium
TAAKRLCRSHVGIDAEAGP

SEQ ID NO: 735561 - protein, 23 aa, Mycobacterium
TAAKRLCRSRVGIDAEAGPTEIA

SEQ ID NO: 735562 - protein, 18 aa, Mycobacterium
TAAKVLEDLGWYVADNLP

SEQ ID NO: 735563 - protein, 22 aa, Mycobacterium
TAAKVLEDLGWYVADNLPPELI

SEQ ID NO: 735564 - protein, 19 aa, Mycobacterium
TAALAFRVVHDHVTSVFRH

SEQ ID NO: 735565 - protein, 22 aa, Mycobacterium
TAALCAFGSALDPQFGPDSSAR

SEQ ID NO: 735566 - protein, 23 aa, Mycobacterium
TAALDIFWCQGFSEPEAGSDLAS

SEQ ID NO: 735567 - protein, 18 aa, Mycobacterium
TAALDPAAGWIVGVVGVH

SEQ ID NO: 735568 - protein, 22 aa, Mycobacterium
TAALDPAAGWIVGVVGVHPYQL

SEQ ID NO: 735569 - protein, 17 aa, Mycobacterium
TAALFALESPARVAEFT

SEQ ID NO: 735570 - protein, 17 aa, Mycobacterium
TAALFDFDPASAYDERV

SEQ ID NO: 735571 - protein, 24 aa, Mycobacterium
TAALFGCAMLTGFGAVTHTASVRP

SEQ ID NO: 735572 - protein, 25 aa, Mycobacterium
TAALHFAIDMARRLNAHVHVVHIQD

SEQ ID NO: 735573 - protein, 18 aa, Mycobacterium
TAALKHGLTPIVCIGEQL

SEQ ID NO: 735574 - protein, 18 aa, Mycobacterium
TAALLARFTGVRTCTKRL

SEQ ID NO: 735575 - protein, 18 aa, Mycobacterium
TAALPGQRRAWLPMNSSM

SEQ ID NO: 735576 - protein, 18 aa, Mycobacterium
TAALPLACTYDFEVAAAK

SEQ ID NO: 735577 - protein, 25 aa, Mycobacterium
TAALRAEAAFLWSGRKAVVSGVSAA

SEQ ID NO: 735578 - protein, 22 aa, Mycobacterium
TAAMDPRLAPVLTAIHNNLEHP

SEQ ID NO: 735579 - protein, 19 aa, Mycobacterium
TAAMPIWQFWEMAYKDLIE

SEQ ID NO: 735580 - protein, 24 aa, Mycobacterium
TAAMSVQALIDWGLQPGSGSVVVT

SEQ ID NO: 735581 - protein, 23 aa, Mycobacterium
TAAMSVQALINWGVAPDAGPVVV

SEQ ID NO: 735582 - protein, 17 aa, Mycobacterium
TAANWLRAHQDGFAAPV

SEQ ID NO: 735583 - protein, 21 aa, Mycobacterium
TAAPARRVLSIDVLEVAERGR

SEQ ID NO: 735584 - protein, 18 aa, Mycobacterium
TAAPDDWELVPAGQRAQL

SEQ ID NO: 735585 - protein, 25 aa, Mycobacterium
TAAPGFVHVRWDAVDMWLEEGRRLV

SEQ ID NO: 735586 - protein, 22 aa, Mycobacterium
TAAPGSPWLADTWRDRFEEMLT

SEQ ID NO: 735587 - protein, 18 aa, Mycobacterium
TAAPLLRCLLFTELSGGP

SEQ ID NO: 735588 - protein, 17 aa, Mycobacterium
TAAPLPGLGFREPLPAA

SEQ ID NO: 735589 - protein, 27 aa, Mycobacterium
TAAPMREIARRAGISYGVVYKHFPSQS

SEQ ID NO: 735590 - protein, 25 aa, Mycobacterium
TAAPNLRPQPCIDLYEAVRRDDLEK

SEQ ID NO: 735591 - protein, 20 aa, Mycobacterium
TAAPPLRRLLREILREQRRT

SEQ ID NO: 735592 - protein, 17 aa, Mycobacterium
TAAQCDVIADALRSADV

SEQ ID NO: 735593 - protein, 18 aa, Mycobacterium
TAAQERIWMAFPPQGASV

SEQ ID NO: 735594 - protein, 21 aa, Mycobacterium
TAAQFCGYSSQLLSGTGGGTA

SEQ ID NO: 735595 - protein, 25 aa, Mycobacterium
TAAQHKLPIVFVVLRNGEYAILKSF

SEQ ID NO: 735596 - protein, 23 aa, Mycobacterium
TAAQLRAGMAALRTRADEAGAGV

SEQ ID NO: 735597 - protein, 25 aa, Mycobacterium
TAAQLSHWGALLARTDPSAPKHNGI

SEQ ID NO: 735598 - protein, 21 aa, Mycobacterium
TAAQLVGQWVVARGEAVLHES

SEQ ID NO: 735599 - protein, 19 aa, Mycobacterium
TAAQRWWRTLGDDMTVEGA

SEQ ID NO: 735600 - protein, 23 aa, Mycobacterium
TAARASAPFKVLGRAVRAVPPLR

SEQ ID NO: 735601 - protein, 17 aa, Mycobacterium
TAARDALGEAIAVVEEL

SEQ ID NO: 735602 - protein, 17 aa, Mycobacterium
TAARDWASIGAAACAPN

SEQ ID NO: 735603 - protein, 20 aa, Mycobacterium
TAARFQPLWERTLPDRLGQP

SEQ ID NO: 735604 - protein, 25 aa, Mycobacterium
TAARGGSGRARRGATAASAGTAGPA

SEQ ID NO: 735605 - protein, 36 aa, Mycobacterium
TAARPALMPMDAWRDGNEFIVEFDLPGISGESLDLD

SEQ ID NO: 735606 - protein, 33 aa, Mycobacterium
TAARPAVMPMDAWRDGEHFIIEFDLPGVQADSL

SEQ ID NO: 735607 - protein, 27 aa, Mycobacterium
TAARPAVMPMDAWRDGEKFVVEFDLPG

SEQ ID NO: 735608 - protein, 33 aa, Mycobacterium
TAARPAVMPMDAWRQGEEFVVEFDLPGIDANSL

SEQ ID NO: 735609 - protein, 20 aa, Mycobacterium
TAARRAGSLTSDISVSLNAA

SEQ ID NO: 735610 - protein, 23 aa, Mycobacterium
TAARTCFTERGFSNTTMQDIADT

SEQ ID NO: 735611 - protein, 17 aa, Mycobacterium
TAARWPDRAAIVDDDGV

SEQ ID NO: 735612 - protein, 19 aa, Mycobacterium
TAARWPNRAAVIDDDGTLS

SEQ ID NO: 735613 - protein, 29 aa, Mycobacterium
TAARWSAEKHLAFACGRYEGIDQRVIEDA

SEQ ID NO: 735614 - protein, 18 aa, Mycobacterium
TAASSWNALAAELNSAAL

SEQ ID NO: 735615 - protein, 24 aa, Mycobacterium
TAATAWGGMAVELESAADSFASVT

SEQ ID NO: 735616 - protein, 25 aa, Mycobacterium
TAATGPRAALSLLRQDVAYLERLLD

SEQ ID NO: 735617 - protein, 19 aa, Mycobacterium
TAATHAISAANVFETALAT

SEQ ID NO: 735618 - protein, 21 aa, Mycobacterium
TAATLKDGWLHTGDMGSFDAR

SEQ ID NO: 735619 - protein, 24 aa, Mycobacterium
TAATRSAAGLTRLAGGGFGGGPTV

SEQ ID NO: 735620 - protein, 25 aa, Mycobacterium
TAAVICARAGLAVRVIEAQTTPGGG

SEQ ID NO: 735621 - protein, 17 aa, Mycobacterium
TAAVPVLLLSARAGQEA

SEQ ID NO: 735622 - protein, 20 aa, Mycobacterium
TAAWGWLSLATGLAVIDAVT

SEQ ID NO: 735623 - protein, 23 aa, Mycobacterium
TAAYRTVILAVDMSPPAADSARL

SEQ ID NO: 735624 - protein, 26 aa, Mycobacterium
TAAYWKRHVREAVRFADSVRFVHAAG

SEQ ID NO: 735625 - protein, 17 aa, Mycobacterium
TACDPGREFGFTVLLGD

SEQ ID NO: 735626 - protein, 20 aa, Mycobacterium
TACGPPGLFCEEYDVQQRQL

SEQ ID NO: 735627 - protein, 18 aa, Mycobacterium
TACILCECNCGIVVQVAD

SEQ ID NO: 735628 - protein, 26 aa, Mycobacterium
TACIVDLPTALLLRRNRIDDPDARKR

SEQ ID NO: 735629 - protein, 17 aa, Mycobacterium
TACLFDLDGVLTDTASV

SEQ ID NO: 735630 - protein, 17 aa, Mycobacterium
TACLGGVFRECRPQNVI

SEQ ID NO: 735631 - protein, 24 aa, Mycobacterium
TACREAFQSLELMVVIDVAMTETA

SEQ ID NO: 735632 - protein, 21 aa, Mycobacterium
TACSSSLYATHLACNSLSEGE

SEQ ID NO: 735633 - protein, 21 aa, Mycobacterium
TADAGRPVFMVGVRDDLPMGR

SEQ ID NO: 735634 - protein, 33 aa, Mycobacterium
TADAGRYGLTLAHTVCLAGAFMAHDPISGADLT

SEQ ID NO: 735635 - protein, 19 aa, Mycobacterium
TADALVRLPFGQSVRIGDV

SEQ ID NO: 735636 - protein, 18 aa, Mycobacterium
TADAYRPLYAHLMDLSKV

SEQ ID NO: 735637 - protein, 22 aa, Mycobacterium
TADDSRMRWLRQGEVPTLGNWF

SEQ ID NO: 735638 - protein, 24 aa, Mycobacterium
TADEIIRWATPVSAFQRTANEDTE

SEQ ID NO: 735639 - protein, 23 aa, Mycobacterium
TADEIVRWATPVTAFQRTALTDT

SEQ ID NO: 735640 - protein, 17 aa, Mycobacterium
TADEVEECWQLLRQSLH

SEQ ID NO: 735641 - protein, 23 aa, Mycobacterium
TADEVEECWQLLRQSLHSVSYET

SEQ ID NO: 735642 - protein, 25 aa, Mycobacterium
TADGAPFHRLCFGLAAGGVGNRFYD

SEQ ID NO: 735643 - protein, 26 aa, Mycobacterium
TADGAPFHRLCFGLAAGGVGNRFYDM

SEQ ID NO: 735644 - protein, 22 aa, Mycobacterium
TADGARRWRELLADADILIENT

SEQ ID NO: 735645 - protein, 19 aa, Mycobacterium
TADGFSWTPVHTMAGPDTS

SEQ ID NO: 735646 - protein, 19 aa, Mycobacterium
TADGLRRGEVIAVVDVNTA

SEQ ID NO: 735647 - protein, 25 aa, Mycobacterium
TADGPRLHANWTWAPSALDEDLVRR

SEQ ID NO: 735648 - protein, 23 aa, Mycobacterium
TADGWRLKTRSMTFIRRNGDHDH

SEQ ID NO: 735649 - protein, 20 aa, Mycobacterium
TADGYASNWLCDNARAGMRI

SEQ ID NO: 735650 - protein, 23 aa, Mycobacterium
TADIGAAFARLMHAEGARQVVIG

SEQ ID NO: 735651 - protein, 18 aa, Mycobacterium
TADLALRIADHGVRDDRL

SEQ ID NO: 735652 - protein, 26 aa, Mycobacterium
TADLFIRYLRPIRQGSAFAVPRMLRS

SEQ ID NO: 735653 - protein, 23 aa, Mycobacterium
TADLKGAVVDILISKTFDSSVIC

SEQ ID NO: 735654 - protein, 21 aa, Mycobacterium
TADLWWDREHGYLIRDSPLRP

SEQ ID NO: 735655 - protein, 19 aa, Mycobacterium
TADMLDWHVLLAICGPDAV

SEQ ID NO: 735656 - protein, 19 aa, Mycobacterium
TADMNVHFVAPIVTGPARA

SEQ ID NO: 735657 - protein, 24 aa, Mycobacterium
TADPAHQGLEMWLAEFPQPRPPRE

SEQ ID NO: 735658 - protein, 19 aa, Mycobacterium
TADPARRLSSIDVLGPDEH

SEQ ID NO: 735659 - protein, 25 aa, Mycobacterium
TADPEWMAAFALHLERCGFESVVVV

SEQ ID NO: 735660 - protein, 22 aa, Mycobacterium
TADPGTVVLEWGVTGIVRATGK

SEQ ID NO: 735661 - protein, 19 aa, Mycobacterium
TADPPECAGIWAPGMAEVY

SEQ ID NO: 735662 - protein, 27 aa, Mycobacterium
TADQPLDWFCSFSSIAALVGSPGQGAY

SEQ ID NO: 735663 - protein, 21 aa, Mycobacterium
TADRFRQLRLCVSSYTAPHLV

SEQ ID NO: 735664 - protein, 23 aa, Mycobacterium
TADRLGYHRFWVAEHHNMPAVAA

SEQ ID NO: 735665 - protein, 18 aa, Mycobacterium
TADSASRLYSWAEATSYT

SEQ ID NO: 735666 - protein, 21 aa, Mycobacterium
TADSGHWVRLLREAGIPTGPV

SEQ ID NO: 735667 - protein, 20 aa, Mycobacterium
TADSLSFLLEDAVLTADSVL

SEQ ID NO: 735668 - protein, 19 aa, Mycobacterium
TADSLSFVLDDAVLTADTI

SEQ ID NO: 735669 - protein, 19 aa, Mycobacterium
TADSLSFVLEDAVLTADSV

SEQ ID NO: 735670 - protein, 18 aa, Mycobacterium
TADSSSRLYSWAEASSFA

SEQ ID NO: 735671 - protein, 23 aa, Mycobacterium
TADSWDVLAGIYARNRPSRPGTI

SEQ ID NO: 735672 - protein, 19 aa, Mycobacterium
TADTDFPRGHNVWQIKSGK

SEQ ID NO: 735673 - protein, 22 aa, Mycobacterium
TADTPRFTVAMITHEVPGDSFW

SEQ ID NO: 735674 - protein, 19 aa, Mycobacterium
TADVKRLVGFYEMVTQIAA

SEQ ID NO: 735675 - protein, 22 aa, Mycobacterium
TADVLTSFVALFGEGFVASAGG

SEQ ID NO: 735676 - protein, 18 aa, Mycobacterium
TADVRNGIDFKVADLSLA

SEQ ID NO: 735677 - protein, 24 aa, Mycobacterium
TADVSCLKALLEVRDEIIAAGHTP

SEQ ID NO: 735678 - protein, 18 aa, Mycobacterium
TADWECVQATLALGDLAE

SEQ ID NO: 735679 - protein, 26 aa, Mycobacterium
TAEAALREQFGYDAWVLVYDIDTVHA

SEQ ID NO: 735680 - protein, 25 aa, Mycobacterium
TAEADAAFEQARRRFDGAWNHQNGD

SEQ ID NO: 735681 - protein, 20 aa, Mycobacterium
TAEAIVNGWFHTGDLGSVDA

SEQ ID NO: 735682 - protein, 24 aa, Mycobacterium
TAEALKPWYGYFCKRPCFHDEYLQ

SEQ ID NO: 735683 - protein, 23 aa, Mycobacterium
TAEALRGPFWRWSPGLRAGIKLM

SEQ ID NO: 735684 - protein, 24 aa, Mycobacterium
TAEANYAKSLRMFAVLPTIVATDI

SEQ ID NO: 735685 - protein, 21 aa, Mycobacterium
TAEARPSCVTQSADGTRLYIA

SEQ ID NO: 735686 - protein, 28 aa, Mycobacterium
TAEAVAIKDGRIVAVGACDDVVQQHQGP

SEQ ID NO: 735687 - protein, 21 aa, Mycobacterium
TAEAVVDCRVLPGRQAAFEAE

SEQ ID NO: 735688 - protein, 17 aa, Mycobacterium
TAEELRKAAEGYLDAAT

SEQ ID NO: 735689 - protein, 18 aa, Mycobacterium
TAEELVLLATRYSEFAVH

SEQ ID NO: 735690 - protein, 17 aa, Mycobacterium
TAEELVMLATRFEEFAV

SEQ ID NO: 735691 - protein, 17 aa, Mycobacterium
TAEENRHGIAIRDYLVV

SEQ ID NO: 735692 - protein, 23 aa, Mycobacterium
TAEENRHGIAIRDYLVVTRSVDP

SEQ ID NO: 735693 - protein, 17 aa, Mycobacterium
TAEENRHSIAIRDYLVV

SEQ ID NO: 735694 - protein, 23 aa, Mycobacterium
TAEERLRRGFPAVRRVPNRQPVD

SEQ ID NO: 735695 - protein, 20 aa, Mycobacterium
TAEFAVALFGLLRAGAVPVM

SEQ ID NO: 735696 - protein, 21 aa, Mycobacterium
TAEFLDRWRAVTSVTGEQWEE

SEQ ID NO: 735697 - protein, 24 aa, Mycobacterium
TAEFPRPAPRPAYSALSGRESAAA

SEQ ID NO: 735698 - protein, 30 aa, Mycobacterium
TAEGMSLAGIGRWLHTLGYRGHITTKSRHY

SEQ ID NO: 735699 - protein, 26 aa, Mycobacterium
TAEGRAVFTPGLAGLVLGEYRRIAQQ

SEQ ID NO: 735700 - protein, 20 aa, Mycobacterium
TAEHIGGWAARPLPLPDMCY

SEQ ID NO: 735701 - protein, 19 aa, Mycobacterium
TAEIELLTTLFKGSAIPVS

SEQ ID NO: 735702 - protein, 25 aa, Mycobacterium
TAEIPVFYGHYWRQGSPKHRHDWTD

SEQ ID NO: 735703 - protein, 17 aa, Mycobacterium
TAEIVFKGRNVEIPDHF

SEQ ID NO: 735704 - protein, 24 aa, Mycobacterium
TAEKISAATAFEWGMISHITSADE

SEQ ID NO: 735705 - protein, 25 aa, Mycobacterium
TAELAREIMCDVSYFGTMLVYNSHV

SEQ ID NO: 735706 - protein, 18 aa, Mycobacterium
TAELIGWDGTWVAAILTG

SEQ ID NO: 735707 - protein, 18 aa, Mycobacterium
TAELIRFALTTKLKPYTY

SEQ ID NO: 735708 - protein, 21 aa, Mycobacterium
TAELIWHGRERLDAIDRNAHE

SEQ ID NO: 735709 - protein, 19 aa, Mycobacterium
TAELLEFAVGAGLTVVAVD

SEQ ID NO: 735710 - protein, 22 aa, Mycobacterium
TAELLPRLSASGVPVIDIDDPA

SEQ ID NO: 735711 - protein, 20 aa, Mycobacterium
TAELRRPDAVRVYVTGEGWR

SEQ ID NO: 735712 - protein, 18 aa, Mycobacterium
TAELTTAAAVVFDKINEQ

SEQ ID NO: 735713 - protein, 19 aa, Mycobacterium
TAEMLRRNGIPCDEVRKHY

SEQ ID NO: 735714 - protein, 21 aa, Mycobacterium
TAEPRRARARATDVVGVARHG

SEQ ID NO: 735715 - protein, 22 aa, Mycobacterium
TAEQMAEFYAGLLASYPLVSIE

SEQ ID NO: 735716 - protein, 26 aa, Mycobacterium
TAEQMKMFLTRLGFGSKIVVTGDVTQ

SEQ ID NO: 735717 - protein, 26 aa, Mycobacterium
TAEQMKMFLTRLGFGSKMVITGDITQ

SEQ ID NO: 735718 - protein, 21 aa, Mycobacterium
TAEQMTEFYAGLLGSYPLVSI

SEQ ID NO: 735719 - protein, 21 aa, Mycobacterium
TAEQVCIIPGTAAVAGITRVD

SEQ ID NO: 735720 - protein, 17 aa, Mycobacterium
TAEQWRLVVDVNLIGAW

SEQ ID NO: 735721 - protein, 17 aa, Mycobacterium
TAERARGTGARMSTHVL

SEQ ID NO: 735722 - protein, 23 aa, Mycobacterium
TAERGLFDFFFLAEGLRLREHRE

SEQ ID NO: 735723 - protein, 23 aa, Mycobacterium
TAERIRRVAERIVETKKNGNDVV

SEQ ID NO: 735724 - protein, 18 aa, Mycobacterium
TAERLGFEAVLTPTGTRW

SEQ ID NO: 735725 - protein, 23 aa, Mycobacterium
TAERLGFTRYWVAEHHNMASVGA

SEQ ID NO: 735726 - protein, 18 aa, Mycobacterium
TAERLGFTYEGTFRQAVV

SEQ ID NO: 735727 - protein, 23 aa, Mycobacterium
TAERLRMPVLMCVGDHDQQASPR

SEQ ID NO: 735728 - protein, 20 aa, Mycobacterium
TAERLVRCATAIRTADEAFH

SEQ ID NO: 735729 - protein, 18 aa, Mycobacterium
TAERRIGSRTEFSEAAAK

SEQ ID NO: 735730 - protein, 23 aa, Mycobacterium
TAESGFPMLPPLMPPPISAGSGW

SEQ ID NO: 735731 - protein, 24 aa, Mycobacterium
TAESLALGSIVEWPVAKRNRTIAD

SEQ ID NO: 735732 - protein, 25 aa, Mycobacterium
TAESYRWSTDLGIASPMGIKTRRTV

SEQ ID NO: 735733 - protein, 26 aa, Mycobacterium
TAETRWPEFTARAVAATPIRSMLELP

SEQ ID NO: 735734 - protein, 24 aa, Mycobacterium
TAETVLVVLTCRAVAINAYERAPN

SEQ ID NO: 735735 - protein, 18 aa, Mycobacterium
TAEVFLAALRPLRLTASV

SEQ ID NO: 735736 - protein, 19 aa, Mycobacterium
TAEVFLAALRPLRLTASVA

SEQ ID NO: 735737 - protein, 19 aa, Mycobacterium
TAEVFLAALRPLRLTVSVA

SEQ ID NO: 735738 - protein, 19 aa, Mycobacterium
TAEVMAILRPLGEDHAVKS

SEQ ID NO: 735739 - protein, 23 aa, Mycobacterium
TAEVMGRLAPLGPVYQAGTLSGN

SEQ ID NO: 735740 - protein, 25 aa, Mycobacterium
TAEVRDGAPLVVTWWDVVRAASAVE

SEQ ID NO: 735741 - protein, 24 aa, Mycobacterium
TAEVWRHIPSWEFHRANVDPRRAQ

SEQ ID NO: 735742 - protein, 17 aa, Mycobacterium
TAEWLALFDELGIPASP

SEQ ID NO: 735743 - protein, 24 aa, Mycobacterium
TAEYSLRGANLWDEVKDRLDRPGG

SEQ ID NO: 735744 - protein, 24 aa, Mycobacterium
TAEYSLRGANLWDEVKDRMDRPGG

SEQ ID NO: 735745 - protein, 19 aa, Mycobacterium
TAEYVRLAGHYGFAPDFCH

SEQ ID NO: 735746 - protein, 18 aa, Mycobacterium
TAFARKGFSGVTIKDITD

SEQ ID NO: 735747 - protein, 23 aa, Mycobacterium
TAFARVDGRPVGVIANQPMYMSG

SEQ ID NO: 735748 - protein, 40 aa, Mycobacterium
TAFASLWSGSSLEDWKDWLRWRVIHGRAFLLTDELIAEDF

SEQ ID NO: 735749 - protein, 24 aa, Mycobacterium
TAFCDLETWDSCALDLSGSSGSLF

SEQ ID NO: 735750 - protein, 20 aa, Mycobacterium
TAFDRWGLMPRMLVGTTERD

SEQ ID NO: 735751 - protein, 20 aa, Mycobacterium
TAFDVGRWLPQAGAVERIDA

SEQ ID NO: 735752 - protein, 18 aa, Mycobacterium
TAFFDEFFLAATGAGIRQ

SEQ ID NO: 735753 - protein, 19 aa, Mycobacterium
TAFFDRFFLDATAAGIRQA

SEQ ID NO: 735754 - protein, 19 aa, Mycobacterium
TAFFLLAFANIGLMPDGGS

SEQ ID NO: 735755 - protein, 25 aa, Mycobacterium
TAFFRDPEAWEFIRSDVIPRMLAER

SEQ ID NO: 735756 - protein, 25 aa, Mycobacterium
TAFGGKGRAAIAIGNPDTAKNTAVI

SEQ ID NO: 735757 - protein, 18 aa, Mycobacterium
TAFIYIGELCRYLLNQPP

SEQ ID NO: 735758 - protein, 22 aa, Mycobacterium
TAFLDPDFPAWVDNWDEVTDML

SEQ ID NO: 735759 - protein, 21 aa, Mycobacterium
TAFPRADWLASARRALNHAPH

SEQ ID NO: 735760 - protein, 18 aa, Mycobacterium
TAFPRLEDVIAYCDQFPL

SEQ ID NO: 735761 - protein, 24 aa, Mycobacterium
TAFPRLYGVQTRFFDDFFRSAAAA

SEQ ID NO: 735762 - protein, 24 aa, Mycobacterium
TAFPRLYGVQTRFFDDFFRSASEA

SEQ ID NO: 735763 - protein, 23 aa, Mycobacterium
TAFPRLYGVQTRFFDDFFVGAGQ

SEQ ID NO: 735764 - protein, 26 aa, Mycobacterium
TAFPSEIAEAVLFLSSPRSSFITGST

SEQ ID NO: 735765 - protein, 34 aa, Mycobacterium
TAFPTTARLTGRWFRGRIPTVNDWVRGIPVVDSK

SEQ ID NO: 735766 - protein, 18 aa, Mycobacterium
TAFRQAWGADPIDMGMGG

SEQ ID NO: 735767 - protein, 19 aa, Mycobacterium
TAGAAYLAITAYPSNSSGT

SEQ ID NO: 735768 - protein, 21 aa, Mycobacterium
TAGAIKSFLSIAATSGQAELS

SEQ ID NO: 735769 - protein, 18 aa, Mycobacterium
TAGARPALVLGHSLGELA

SEQ ID NO: 735770 - protein, 18 aa, Mycobacterium
TAGATIINSGFGWHEARI

SEQ ID NO: 735771 - protein, 17 aa, Mycobacterium
TAGATIVGVIPQFDTEC

SEQ ID NO: 735772 - protein, 19 aa, Mycobacterium
TAGAWTFGPTNAWDPLPAD

SEQ ID NO: 735773 - protein, 24 aa, Mycobacterium
TAGAWTFGSSAGWSHLPRGWRTDH

SEQ ID NO: 735774 - protein, 24 aa, Mycobacterium
TAGAWTFGSSAGWSHLPRGWRTDR

SEQ ID NO: 735775 - protein, 19 aa, Mycobacterium
TAGCLLAAHYDEFLAGTAQ

SEQ ID NO: 735776 - protein, 17 aa, Mycobacterium
TAGDALESFALGDLPGI

SEQ ID NO: 735777 - protein, 18 aa, Mycobacterium
TAGDGYLYLVRQVAAADS

SEQ ID NO: 735778 - protein, 30 aa, Mycobacterium
TAGDLGPGWSAWPIAPKAAAIPAGGMLDTL

SEQ ID NO: 735779 - protein, 28 aa, Mycobacterium
TAGDTDLAWSRITYWRALLTSAVDQPPH

SEQ ID NO: 735780 - protein, 21 aa, Mycobacterium
TAGELRARMGTSGAAITYLVE

SEQ ID NO: 735781 - protein, 32 aa, Mycobacterium
TAGERPAVVPLSFAQSRLWFLHQLSGPSPVYN

SEQ ID NO: 735782 - protein, 17 aa, Mycobacterium
TAGFARHSSGLSVQTFL

SEQ ID NO: 735783 - protein, 18 aa, Mycobacterium
TAGFPVKVAGLSRFTDPL

SEQ ID NO: 735784 - protein, 24 aa, Mycobacterium
TAGFRPEHRAALDWLNEHTDPDTR

SEQ ID NO: 735785 - protein, 25 aa, Mycobacterium
TAGFYPEVVIAFDLTDVDAHYHVPL

SEQ ID NO: 735786 - protein, 23 aa, Mycobacterium
TAGGCPNTKMVLGGYSQGAAVMG

SEQ ID NO: 735787 - protein, 18 aa, Mycobacterium
TAGGFAYTEMKIVDADGA

SEQ ID NO: 735788 - protein, 24 aa, Mycobacterium
TAGGPRPGWPTYFTKRPSGTADTV

SEQ ID NO: 735789 - protein, 24 aa, Mycobacterium
TAGHGRLVVFSSIAGARVRRANYV

SEQ ID NO: 735790 - protein, 17 aa, Mycobacterium
TAGHLHVPLLLSPYAYS

SEQ ID NO: 735791 - protein, 26 aa, Mycobacterium
TAGHSGSWWIFWPTLLLTLVSDFNAL

SEQ ID NO: 735792 - protein, 17 aa, Mycobacterium
TAGISSFGISGTNAHLI

SEQ ID NO: 735793 - protein, 19 aa, Mycobacterium
TAGLDDVYLLAAEDVPDGP

SEQ ID NO: 735794 - protein, 20 aa, Mycobacterium
TAGLDDVYLLAAEDVPDGPG

SEQ ID NO: 735795 - protein, 24 aa, Mycobacterium
TAGLKIVPEMGVYAGTKNAVRTIM

SEQ ID NO: 735796 - protein, 22 aa, Mycobacterium
TAGLLRQAWRAAPVAGDKALCP

SEQ ID NO: 735797 - protein, 18 aa, Mycobacterium
TAGLPYEQCVGVTYQYLH

SEQ ID NO: 735798 - protein, 20 aa, Mycobacterium
TAGLQYPGASYHNVGTGNIG

SEQ ID NO: 735799 - protein, 18 aa, Mycobacterium
TAGPARAAGAGVTAVSAV

SEQ ID NO: 735800 - protein, 21 aa, Mycobacterium
TAGPARSTVSADLSGRALPPV

SEQ ID NO: 735801 - protein, 18 aa, Mycobacterium
TAGPCPLRGMRRADVATG

SEQ ID NO: 735802 - protein, 27 aa, Mycobacterium
TAGPRCWPGRCVRRARGRTTTSTPSPG

SEQ ID NO: 735803 - protein, 19 aa, Mycobacterium
TAGPSYLGHTQWAVAPYIE

SEQ ID NO: 735804 - protein, 17 aa, Mycobacterium
TAGRGRHGRGWSATPRA

SEQ ID NO: 735805 - protein, 17 aa, Mycobacterium
TAGRGRHGRTWSAPPRS

SEQ ID NO: 735806 - protein, 22 aa, Mycobacterium
TAGRILADFGADVIKVERPGVG

SEQ ID NO: 735807 - protein, 23 aa, Mycobacterium
TAGRLIDALTLWRKAADDFEPPP

SEQ ID NO: 735808 - protein, 17 aa, Mycobacterium
TAGRLLAPLRRVLGDRL

SEQ ID NO: 735809 - protein, 24 aa, Mycobacterium
TAGRLLHALSLWRKAADDFAPPPP

SEQ ID NO: 735810 - protein, 20 aa, Mycobacterium
TAGRPQLLIRLGRSPANDQH

SEQ ID NO: 735811 - protein, 17 aa, Mycobacterium
TAGRYILHTADGDPETL

SEQ ID NO: 735812 - protein, 17 aa, Mycobacterium
TAGSGAKVLLAHSDAAT

SEQ ID NO: 735813 - protein, 18 aa, Mycobacterium
TAGSGAKVLLAHSDAATQ

SEQ ID NO: 735814 - protein, 18 aa, Mycobacterium
TAGSGAKVLLAHSDPATQ

SEQ ID NO: 735815 - protein, 27 aa, Mycobacterium
TAGSLGTRGRMLSLFRDHLGRIDRPRW

SEQ ID NO: 735816 - protein, 22 aa, Mycobacterium
TAGSRLFAPRVRMLEPDPKRSL

SEQ ID NO: 735817 - protein, 25 aa, Mycobacterium
TAGTFCRHPLAMAAARAVLRKLSDD

SEQ ID NO: 735818 - protein, 19 aa, Mycobacterium
TAGTGGYGGLLLGQNGSNG

SEQ ID NO: 735819 - protein, 35 aa, Mycobacterium
TAGVMRHWLGRGADGWRLDAAYAVPDRFWAQVLPI

SEQ ID NO: 735820 - protein, 23 aa, Mycobacterium
TAGVPGMPGVPIAGTAGQGMGGA

SEQ ID NO: 735821 - protein, 18 aa, Mycobacterium
TAGVRRMVMLTGDHPDAA

SEQ ID NO: 735822 - protein, 22 aa, Mycobacterium
TAGWLRASMRALDEAASRPGAP

SEQ ID NO: 735823 - protein, 24 aa, Mycobacterium
TAGYTYPIQHSWRITNQTNAFHNL

SEQ ID NO: 735824 - protein, 20 aa, Mycobacterium
TAGYVKRAAAAFPHQGTEGP

SEQ ID NO: 735825 - protein, 20 aa, Mycobacterium
TAHAHWGVFQRFPVVTRTMT

SEQ ID NO: 735826 - protein, 31 aa, Mycobacterium
TAHAPWYVIPCDRKWYSRLAVTALLDETLDG

SEQ ID NO: 735827 - protein, 17 aa, Mycobacterium
TAHELYHPQPLRGKKID

SEQ ID NO: 735828 - protein, 20 aa, Mycobacterium
TAHFDGHLSVLVRASRLAEI

SEQ ID NO: 735829 - protein, 22 aa, Mycobacterium
TAHGGWGRAPKFPPSALLEGLL

SEQ ID NO: 735830 - protein, 26 aa, Mycobacterium
TAHGPVRFPGVPTWFSRTPGRVSGPA

SEQ ID NO: 735831 - protein, 26 aa, Mycobacterium
TAHLDLDWWLSFSSAASMLGSPGQGA

SEQ ID NO: 735832 - protein, 17 aa, Mycobacterium
TAHLGRLSSLLRDKRVP

SEQ ID NO: 735833 - protein, 24 aa, Mycobacterium
TAHLPSVELHPAYSNADAARQVAE

SEQ ID NO: 735834 - protein, 23 aa, Mycobacterium
TAHLRAAHHLSLCSECAQEVDAQ

SEQ ID NO: 735835 - protein, 19 aa, Mycobacterium
TAHPLATVLQGLRLTGDLS

SEQ ID NO: 735836 - protein, 17 aa, Mycobacterium
TAHRRMGHVAAQAESAR

SEQ ID NO: 735837 - protein, 40 aa, Mycobacterium
TAHSTLMRPGETFTSIDIRAAFLRPVWADTLVATARPAHV

SEQ ID NO: 735838 - protein, 24 aa, Mycobacterium
TAHTIRPAFEIIRTAPGVSTVSSI

SEQ ID NO: 735839 - protein, 22 aa, Mycobacterium
TAHTRSGVIMGVRHTELPIHGV

SEQ ID NO: 735840 - protein, 19 aa, Mycobacterium
TAHVMKQRRGALEGDPSGR

SEQ ID NO: 735841 - protein, 24 aa, Mycobacterium
TAHWPRDGVDLAGKRVGLIGLGAS

SEQ ID NO: 735842 - protein, 22 aa, Mycobacterium
TAHWWKEEREGVFVDFNQNAKD

SEQ ID NO: 735843 - protein, 17 aa, Mycobacterium
TAIASLFAGHAQEYQLL

SEQ ID NO: 735844 - protein, 24 aa, Mycobacterium
TAICIAFGGVAGFGIYFQNNGHEL

SEQ ID NO: 735845 - protein, 24 aa, Mycobacterium
TAIEAELPPVVGLAHAAGVASPVP

SEQ ID NO: 735846 - protein, 17 aa, Mycobacterium
TAIEEFIRFAGSVHGLH

SEQ ID NO: 735847 - protein, 18 aa, Mycobacterium
TAIFEVRDGAIAHWREYW

SEQ ID NO: 735848 - protein, 17 aa, Mycobacterium
TAIGATGVFMGDESKPV

SEQ ID NO: 735849 - protein, 17 aa, Mycobacterium
TAIGAWLEVTRQDRVGL

SEQ ID NO: 735850 - protein, 18 aa, Mycobacterium
TAIGAWRMVASILHSLRV

SEQ ID NO: 735851 - protein, 19 aa, Mycobacterium
TAIGRYLIREQPGGARTLV

SEQ ID NO: 735852 - protein, 24 aa, Mycobacterium
TAILNEIREGVLLGHAQEQLNARA

SEQ ID NO: 735853 - protein, 21 aa, Mycobacterium
TAILRRSELLGGKGANQAVGL

SEQ ID NO: 735854 - protein, 24 aa, Mycobacterium
TAIPAATAGAWVAASNARRDAASG

SEQ ID NO: 735855 - protein, 26 aa, Mycobacterium
TAIPLAKACARIMLGANISQLRTEGM

SEQ ID NO: 735856 - protein, 23 aa, Mycobacterium
TAIRIGAPASWAAAVNAQQQSNG

SEQ ID NO: 735857 - protein, 17 aa, Mycobacterium
TAIRIGAPASWTAAVDA

SEQ ID NO: 735858 - protein, 19 aa, Mycobacterium
TAIRNFVHGIGFQRDVLGA

SEQ ID NO: 735859 - protein, 17 aa, Mycobacterium
TAIRTADEAFHFEPPST

SEQ ID NO: 735860 - protein, 29 aa, Mycobacterium
TAIRVGNRLRPWLPLLLGLTANSAIYRNA

SEQ ID NO: 735861 - protein, 17 aa, Mycobacterium
TAITRVVGLNCGTPCPA

SEQ ID NO: 735862 - protein, 17 aa, Mycobacterium
TAIVARVPVRAFINPEN

SEQ ID NO: 735863 - protein, 26 aa, Mycobacterium
TAIVKGLRTGTDFEYELQMAQMNKHV

SEQ ID NO: 735864 - protein, 19 aa, Mycobacterium
TAKAAATRADFVRPKTAQQ

SEQ ID NO: 735865 - protein, 18 aa, Mycobacterium
TAKAAIDMAMWDALGQSL

SEQ ID NO: 735866 - protein, 19 aa, Mycobacterium
TAKARLDFLRQLHDREALL

SEQ ID NO: 735867 - protein, 19 aa, Mycobacterium
TAKAVGWSPTDWVDNTMDV

SEQ ID NO: 735868 - protein, 19 aa, Mycobacterium
TAKAVGWTPADWVDNTLAT

SEQ ID NO: 735869 - protein, 22 aa, Mycobacterium
TAKDSRAFCDLADEYRRTINDE

SEQ ID NO: 735870 - protein, 19 aa, Mycobacterium
TAKGFAGTVFLTTDDCQAS

SEQ ID NO: 735871 - protein, 25 aa, Mycobacterium
TAKGLEFPVVFVTGWEDGMFPHMRS

SEQ ID NO: 735872 - protein, 24 aa, Mycobacterium
TAKGPAVVEFNCRFGDPETQAVLA

SEQ ID NO: 735873 - protein, 17 aa, Mycobacterium
TAKNGRAADFFRSSDFA

SEQ ID NO: 735874 - protein, 23 aa, Mycobacterium
TAKPDALVPLARRVVGECLAEDL

SEQ ID NO: 735875 - protein, 19 aa, Mycobacterium
TAKPGDFGLPTTIAAPVPE

SEQ ID NO: 735876 - protein, 23 aa, Mycobacterium
TAKPGDLALLIGYGAGLSYAAQV

SEQ ID NO: 735877 - protein, 18 aa, Mycobacterium
TAKPMFLVPAIPSAEGGH

SEQ ID NO: 735878 - protein, 23 aa, Mycobacterium
TAKREIRLLSRFTGANPHVPIIG

SEQ ID NO: 735879 - protein, 23 aa, Mycobacterium
TAKREIRLLSRFTGANPHVPVVG

SEQ ID NO: 735880 - protein, 23 aa, Mycobacterium
TAKREIRLLSRFTGANPHVSVIG

SEQ ID NO: 735881 - protein, 23 aa, Mycobacterium
TAKREIRLLSRFTSANPTVPIVG

SEQ ID NO: 735882 - protein, 23 aa, Mycobacterium
TAKREVRLLSRFTGANPHVAIVG

SEQ ID NO: 735883 - protein, 23 aa, Mycobacterium
TAKREVRLLSRFTGANPHVALVG

SEQ ID NO: 735884 - protein, 23 aa, Mycobacterium
TAKREVRLLSRFTGANPHVPVIG

SEQ ID NO: 735885 - protein, 25 aa, Mycobacterium
TAKRFTCPYHAWTYDNTGRLVGLPG

SEQ ID NO: 735886 - protein, 25 aa, Mycobacterium
TAKRLADGLYRYSLLDIIEVASETG

SEQ ID NO: 735887 - protein, 17 aa, Mycobacterium
TAKRPIRRALISVYDKT

SEQ ID NO: 735888 - protein, 25 aa, Mycobacterium
TAKSMPYKAGFGPFAPEVYRAPLSY

SEQ ID NO: 735889 - protein, 25 aa, Mycobacterium
TAKSMPYKSGFGPFAPEIYRAPLSY

SEQ ID NO: 735890 - protein, 20 aa, Mycobacterium
TAKTTFPVWMMNAIGDVTFH

SEQ ID NO: 735891 - protein, 25 aa, Mycobacterium
TAKVGRPAIYRLWRSKAHLIHEAAF

SEQ ID NO: 735892 - protein, 19 aa, Mycobacterium
TAKVLEDLGWYVADNLPPE

SEQ ID NO: 735893 - protein, 20 aa, Mycobacterium
TAKVSVCYMGVNGRDGSVFD

SEQ ID NO: 735894 - protein, 21 aa, Mycobacterium
TAKWVGRCLECGTWGTVDEVP

SEQ ID NO: 735895 - protein, 27 aa, Mycobacterium
TAKYPVSLRVGGLSWGQVIGGDAALGP

SEQ ID NO: 735896 - protein, 20 aa, Mycobacterium
TALAAHGWRVYGTGRGIAED

SEQ ID NO: 735897 - protein, 20 aa, Mycobacterium
TALADVAGWAVVEEVDEPSA

SEQ ID NO: 735898 - protein, 24 aa, Mycobacterium
TALALKPLLCLDVDGRLVLDQRIR

SEQ ID NO: 735899 - protein, 18 aa, Mycobacterium
TALARRVRRGEIAAPDDD

SEQ ID NO: 735900 - protein, 19 aa, Mycobacterium
TALARRVRRGEIARPDDDV

SEQ ID NO: 735901 - protein, 17 aa, Mycobacterium
TALARRVRRGELAAPDD

SEQ ID NO: 735902 - protein, 20 aa, Mycobacterium
TALARRVRRGELPNPDEDAL

SEQ ID NO: 735903 - protein, 20 aa, Mycobacterium
TALATAYARACHQFADSPPI

SEQ ID NO: 735904 - protein, 19 aa, Mycobacterium
TALATDVETTWKLLLDSQS

SEQ ID NO: 735905 - protein, 18 aa, Mycobacterium
TALCRLRGVDVEDFAPSK

SEQ ID NO: 735906 - protein, 24 aa, Mycobacterium
TALDAGRVLLIFRGRSDGFGLTIV

SEQ ID NO: 735907 - protein, 18 aa, Mycobacterium
TALDAGVDHFGRLDIVCA

SEQ ID NO: 735908 - protein, 26 aa, Mycobacterium
TALDLCPRIRVNAIAPGSILTSALDV

SEQ ID NO: 735909 - protein, 18 aa, Mycobacterium
TALDLPLSTVRDIALGRP

SEQ ID NO: 735910 - protein, 25 aa, Mycobacterium
TALDLRLYPVPTHRATAVCGFADLD

SEQ ID NO: 735911 - protein, 25 aa, Mycobacterium
TALEALKAITINAAYQYSEEQSKGS

SEQ ID NO: 735912 - protein, 18 aa, Mycobacterium
TALEFARQGAEVVLSDVN

SEQ ID NO: 735913 - protein, 23 aa, Mycobacterium
TALEIAERAGARFVLASTSEVYG

SEQ ID NO: 735914 - protein, 26 aa, Mycobacterium
TALEIAWKGAKAVYLSFDIDVIDAGF

SEQ ID NO: 735915 - protein, 17 aa, Mycobacterium
TALELATLGGARLLGRS

SEQ ID NO: 735916 - protein, 24 aa, Mycobacterium
TALEPRLYVSPALVRTDLLHRTDT

SEQ ID NO: 735917 - protein, 25 aa, Mycobacterium
TALFDRPAFRTCVSHGIVLGNDGQK

SEQ ID NO: 735918 - protein, 25 aa, Mycobacterium
TALFELPRLAPVYPSAAGLVAAVRD

SEQ ID NO: 735919 - protein, 25 aa, Mycobacterium
TALFRELRILPPFTQKTTRNLSDEA

SEQ ID NO: 735920 - protein, 18 aa, Mycobacterium
TALGAPGIDLFRKLVQDY

SEQ ID NO: 735921 - protein, 17 aa, Mycobacterium
TALGVALERAEHVVVGC

SEQ ID NO: 735922 - protein, 19 aa, Mycobacterium
TALIARWLAAPDVRIVRTA

SEQ ID NO: 735923 - protein, 20 aa, Mycobacterium
TALIARWLAAPRVRIVRVTG

SEQ ID NO: 735924 - protein, 24 aa, Mycobacterium
TALIHKRAHGVAVVVFEGRPMGLV

SEQ ID NO: 735925 - protein, 18 aa, Mycobacterium
TALILAGIGGRVSDVVSI

SEQ ID NO: 735926 - protein, 26 aa, Mycobacterium
TALIPPRVTHHLAMIGPLVSCYLDPA

SEQ ID NO: 735927 - protein, 26 aa, Mycobacterium
TALIYDLRLGPAWQGLAFGVGMVTEA

SEQ ID NO: 735928 - protein, 17 aa, Mycobacterium
TALIYHAAFAPRVAEIL

SEQ ID NO: 735929 - protein, 19 aa, Mycobacterium
TALKGPVEFEWKIPAKGSN

SEQ ID NO: 735930 - protein, 19 aa, Mycobacterium
TALLAPQRVRALALIGPTA

SEQ ID NO: 735931 - protein, 17 aa, Mycobacterium
TALLERFGDILVRGLTE

SEQ ID NO: 735932 - protein, 19 aa, Mycobacterium
TALLGGVQIGAWRGPSAEV

SEQ ID NO: 735933 - protein, 23 aa, Mycobacterium
TALLLERFLRHFAGYADKPHGTS

SEQ ID NO: 735934 - protein, 17 aa, Mycobacterium
TALLLTLAGRMKPQSGE

SEQ ID NO: 735935 - protein, 18 aa, Mycobacterium
TALLRLAGRYGEGEDEVD

SEQ ID NO: 735936 - protein, 19 aa, Mycobacterium
TALLRRGARVVIGDRDVEA

SEQ ID NO: 735937 - protein, 17 aa, Mycobacterium
TALLYHSAFAPRLAEVL

SEQ ID NO: 735938 - protein, 22 aa, Mycobacterium
TALMMCLRDALSAVHDEMATHV

SEQ ID NO: 735939 - protein, 26 aa, Mycobacterium
TALNPKMRVGDCIAEPMWVHRYGDRG

SEQ ID NO: 735940 - protein, 17 aa, Mycobacterium
TALPAIARRQAKKIAVF

SEQ ID NO: 735941 - protein, 17 aa, Mycobacterium
TALPGCIGALMHSGQGC

SEQ ID NO: 735942 - protein, 18 aa, Mycobacterium
TALPHLRRVDGAAVVNTC

SEQ ID NO: 735943 - protein, 23 aa, Mycobacterium
TALPLERYAELSGFTEANDAFVD

SEQ ID NO: 735944 - protein, 20 aa, Mycobacterium
TALPRNGFRLLADLHGITDL

SEQ ID NO: 735945 - protein, 24 aa, Mycobacterium
TALQRRYGLQHAYAVMTSPDSDPR

SEQ ID NO: 735946 - protein, 18 aa, Mycobacterium
TALRAVRCSPALSSWFAA

SEQ ID NO: 735947 - protein, 20 aa, Mycobacterium
TALRFTCPYHGWTYDNGGRL

SEQ ID NO: 735948 - protein, 17 aa, Mycobacterium
TALRIGLVSEVVASGQL

SEQ ID NO: 735949 - protein, 18 aa, Mycobacterium
TALRLPRDAELTVDGQNV

SEQ ID NO: 735950 - protein, 24 aa, Mycobacterium
TALRLPRDAELVVGGRNVVQDVHA

SEQ ID NO: 735951 - protein, 25 aa, Mycobacterium
TALRLPRYRELSGFTEANDAYLDVA

SEQ ID NO: 735952 - protein, 19 aa, Mycobacterium
TALRRTRVGDFGLDRARTL

SEQ ID NO: 735953 - protein, 25 aa, Mycobacterium
TALRYRLPQIAALYVQGRLSTRLIS

SEQ ID NO: 735954 - protein, 24 aa, Mycobacterium
TALSAARLRTALPRGGVDVDAVVP

SEQ ID NO: 735955 - protein, 18 aa, Mycobacterium
TALSADRPTVLDVHTDPD

SEQ ID NO: 735956 - protein, 24 aa, Mycobacterium
TALSDLFTPVPWWINTIANHFNRR

SEQ ID NO: 735957 - protein, 20 aa, Mycobacterium
TALSSEEWMGPASAAMAAAV

SEQ ID NO: 735958 - protein, 17 aa, Mycobacterium
TALSVSFGTEWDWVARA

SEQ ID NO: 735959 - protein, 18 aa, Mycobacterium
TALTDVWRALRASMRSVL

SEQ ID NO: 735960 - protein, 22 aa, Mycobacterium
TALTEGITWGWESYPEYLDAID

SEQ ID NO: 735961 - protein, 22 aa, Mycobacterium
TALTEGITWGWESYPQYLDTIG

SEQ ID NO: 735962 - protein, 22 aa, Mycobacterium
TALTWSQNVPWVGIAVDTGSGS

SEQ ID NO: 735963 - protein, 23 aa, Mycobacterium
TALVPGRPAPRLVTAAAVEAMKP

SEQ ID NO: 735964 - protein, 19 aa, Mycobacterium
TALVSGTRGARLFYANRNR

SEQ ID NO: 735965 - protein, 19 aa, Mycobacterium
TALVSRAGALVMAGDLAGA

SEQ ID NO: 735966 - protein, 20 aa, Mycobacterium
TALWEEWPPAGARASIHSYV

SEQ ID NO: 735967 - protein, 19 aa, Mycobacterium
TALWEEWPPSGARASIHSY

SEQ ID NO: 735968 - protein, 17 aa, Mycobacterium
TALYPDPGAPRFSVTAL

SEQ ID NO: 735969 - protein, 22 aa, Mycobacterium
TALYPPKRFLGAARNIEHGGSL

SEQ ID NO: 735970 - protein, 17 aa, Mycobacterium
TALYPVWQGIDADSLHV

SEQ ID NO: 735971 - protein, 22 aa, Mycobacterium
TAMAAAAASYVAWLKTTAAQAE

SEQ ID NO: 735972 - protein, 18 aa, Mycobacterium
TAMAPAVTGYAEIIDGGD

SEQ ID NO: 735973 - protein, 17 aa, Mycobacterium
TAMARRVRQGELPPVDN

SEQ ID NO: 735974 - protein, 17 aa, Mycobacterium
TAMDPVVKIARWAALSA

SEQ ID NO: 735975 - protein, 19 aa, Mycobacterium
TAMEEVLRPLGMSITHYSC

SEQ ID NO: 735976 - protein, 17 aa, Mycobacterium
TAMHNTLSALAITATLP

SEQ ID NO: 735977 - protein, 26 aa, Mycobacterium
TAMLARCVVGLQWIPENILRDVGKRA

SEQ ID NO: 735978 - protein, 20 aa, Mycobacterium
TAMMSLPGIGVWTAAETAQR

SEQ ID NO: 735979 - protein, 25 aa, Mycobacterium
TAMQHLKLHGSLYMMANRDRDLAEA

SEQ ID NO: 735980 - protein, 17 aa, Mycobacterium
TAMRPSALRRLGLDDAH

SEQ ID NO: 735981 - protein, 18 aa, Mycobacterium
TAMSGWVGGAASALDSES

SEQ ID NO: 735982 - protein, 24 aa, Mycobacterium
TAMTPWVWPKMHLNPPNWIEPITE

SEQ ID NO: 735983 - protein, 28 aa, Mycobacterium
TAMTPWVYPQVCPPEMLADIQHACEAGQ

SEQ ID NO: 735984 - protein, 19 aa, Mycobacterium
TAMVLRLAGQLSEHLVDTE

SEQ ID NO: 735985 - protein, 24 aa, Mycobacterium
TAMVLRLSGALAEHLVDTDQLRDT

SEQ ID NO: 735986 - protein, 21 aa, Mycobacterium
TAMVPPALVAANRSNLVSLVL

SEQ ID NO: 735987 - protein, 24 aa, Mycobacterium
TANAAECLIVLTSRHGFIARTVFD

SEQ ID NO: 735988 - protein, 24 aa, Mycobacterium
TANAVRFAFWGAEEISLDGSKAYL

SEQ ID NO: 735989 - protein, 20 aa, Mycobacterium
TANNRILLWDSLPDDPVGGR

SEQ ID NO: 735990 - protein, 17 aa, Mycobacterium
TANTVVFMDQGRVVESG

SEQ ID NO: 735991 - protein, 22 aa, Mycobacterium
TANTYSRFLLGVGIHDITAGYR

SEQ ID NO: 735992 - protein, 19 aa, Mycobacterium
TANVARVLARHGSAGDRAV

SEQ ID NO: 735993 - protein, 27 aa, Mycobacterium
TANVLLRLCKDAELRAKFTADPSLVKK

SEQ ID NO: 735994 - protein, 27 aa, Mycobacterium
TANYLYPRVEVEVGFILAADLPGADCT

SEQ ID NO: 735995 - protein, 24 aa, Mycobacterium
TAPAGTEPPGWEWLWELESQGPGE

SEQ ID NO: 735996 - protein, 24 aa, Mycobacterium
TAPAPVRVGFRIGAPAVGELGLRD

SEQ ID NO: 735997 - protein, 27 aa, Mycobacterium
TAPAQARIATVAAIAADRTRAGGGVCA

SEQ ID NO: 735998 - protein, 25 aa, Mycobacterium
TAPARAAYVAGDWGAVASLSPELFL

SEQ ID NO: 735999 - protein, 21 aa, Mycobacterium
TAPDASWMPAFEEMTRNNWLP

SEQ ID NO: 736000 - protein, 18 aa, Mycobacterium
TAPDISPIFASLEKLPPI

SEQ ID NO: 736001 - protein, 22 aa, Mycobacterium
TAPECTHYPLADAANAIRAMSN

SEQ ID NO: 736002 - protein, 23 aa, Mycobacterium
TAPELKAKGITLFAVEEGMPGFE

SEQ ID NO: 736003 - protein, 17 aa, Mycobacterium
TAPGPRPLSPGFSETVV

SEQ ID NO: 736004 - protein, 24 aa, Mycobacterium
TAPGSWNNFWCVADRNVNGNWKSV

SEQ ID NO: 736005 - protein, 24 aa, Mycobacterium
TAPKEHWTRIKALSRRLAEGWADE

SEQ ID NO: 736006 - protein, 23 aa, Mycobacterium
TAPKRPVIFECVGVPGMIDGVIT

SEQ ID NO: 736007 - protein, 19 aa, Mycobacterium
TAPLTEVWVPGADLRGVRA

SEQ ID NO: 736008 - protein, 24 aa, Mycobacterium
TAPMPEINQALGRDQPAAPPPPPP

SEQ ID NO: 736009 - protein, 30 aa, Mycobacterium
TAPMPVLPNGRWLYEYGEPRRLAQTEAIRL

SEQ ID NO: 736010 - protein, 26 aa, Mycobacterium
TAPNAECWIHLQLPPSIDAERLAFIE

SEQ ID NO: 736011 - protein, 26 aa, Mycobacterium
TAPPGRPVWVGDFWDMFGPGHLLELK

SEQ ID NO: 736012 - protein, 34 aa, Mycobacterium
TAPPKGSPRKLAMEFARFLGLPMLNPRMNVTDIS

SEQ ID NO: 736013 - protein, 33 aa, Mycobacterium
TAPPKGSPRKLAMEFARFLGLPTLNQRMNVTDI

SEQ ID NO: 736014 - protein, 19 aa, Mycobacterium
TAPPQPRGLINLHGYTRLP

SEQ ID NO: 736015 - protein, 23 aa, Mycobacterium
TAPPSLRAFYIAYRAVVRAKVDC

SEQ ID NO: 736016 - protein, 22 aa, Mycobacterium
TAPRLFCDMLPADAVPGGLLRE

SEQ ID NO: 736017 - protein, 21 aa, Mycobacterium
TAPRLFCDMLPADAVPPKVRR

SEQ ID NO: 736018 - protein, 17 aa, Mycobacterium
TAPRSRFAARIAGVNLV

SEQ ID NO: 736019 - protein, 17 aa, Mycobacterium
TAPSAGLLAKWNAREAA

SEQ ID NO: 736020 - protein, 17 aa, Mycobacterium
TAPSRGAFIKGVADDLH

SEQ ID NO: 736021 - protein, 25 aa, Mycobacterium
TAPSRLFGANGLRTGPDGRIYIAQV

SEQ ID NO: 736022 - protein, 25 aa, Mycobacterium
TAPSRLFGANGLRTGPDGRVYVAQV

SEQ ID NO: 736023 - protein, 21 aa, Mycobacterium
TAPTCARAFVVTGMADASDAP

SEQ ID NO: 736024 - protein, 21 aa, Mycobacterium
TAPTLPALRRYTGVLYDALDV

SEQ ID NO: 736025 - protein, 17 aa, Mycobacterium
TAPTRAYVLDSWLRPVP

SEQ ID NO: 736026 - protein, 25 aa, Mycobacterium
TAPTSLAGLCSADFLDRAGHARGKA

SEQ ID NO: 736027 - protein, 28 aa, Mycobacterium
TAPTYYYKTGIAFLSWLNGLQPGFTMVG

SEQ ID NO: 736028 - protein, 20 aa, Mycobacterium
TAPVAPVMTGGSWSGTAASV

SEQ ID NO: 736029 - protein, 18 aa, Mycobacterium
TAPVFPMLPGTPAQATHD

SEQ ID NO: 736030 - protein, 18 aa, Mycobacterium
TAPVLPMMPGLPERRTHD

SEQ ID NO: 736031 - protein, 17 aa, Mycobacterium
TAPVPWWDYCFPSDIYG

SEQ ID NO: 736032 - protein, 18 aa, Mycobacterium
TAPVWPVGDSGFYFVSRW

SEQ ID NO: 736033 - protein, 25 aa, Mycobacterium
TAQAAELFGWLGPHPDAVAGSAAAI

SEQ ID NO: 736034 - protein, 24 aa, Mycobacterium
TAQALKPWYGYFCKRPCFHDEYLQ

SEQ ID NO: 736035 - protein, 24 aa, Mycobacterium
TAQDPRFRFFGNIKVGEHVEAADL

SEQ ID NO: 736036 - protein, 22 aa, Mycobacterium
TAQDRLRFAAGNFYVNDKPTGA

SEQ ID NO: 736037 - protein, 26 aa, Mycobacterium
TAQEISARVLMKLKRDAEAYLGEDIT

SEQ ID NO: 736038 - protein, 26 aa, Mycobacterium
TAQEISARVLMKLKRDAEAYLGEDVT

SEQ ID NO: 736039 - protein, 24 aa, Mycobacterium
TAQELRAAVRIHPIAAVQSEWSIW

SEQ ID NO: 736040 - protein, 26 aa, Mycobacterium
TAQELRLAVLAQREYGTAFDLATEAP

SEQ ID NO: 736041 - protein, 29 aa, Mycobacterium
TAQFDMVDVLPLTPLQHGLLFHTGLSQDS

SEQ ID NO: 736042 - protein, 28 aa, Mycobacterium
TAQGLGGWFRLGLVANEQTAWVHVLLCG

SEQ ID NO: 736043 - protein, 18 aa, Mycobacterium
TAQGWRIARRRYTQVRLT

SEQ ID NO: 736044 - protein, 20 aa, Mycobacterium
TAQIKRWCEEAAAQFVDAPV

SEQ ID NO: 736045 - protein, 24 aa, Mycobacterium
TAQIRRWSEEAAEQFVDAPVQTFV

SEQ ID NO: 736046 - protein, 18 aa, Mycobacterium
TAQKARWAARSLLDATDE

SEQ ID NO: 736047 - protein, 18 aa, Mycobacterium
TAQKARWAGRSLLDAAEE

SEQ ID NO: 736048 - protein, 23 aa, Mycobacterium
TAQLDCAKHLVLAGAKSPVSFFA

SEQ ID NO: 736049 - protein, 23 aa, Mycobacterium
TAQLLARRARAIVEHAVDEAITR

SEQ ID NO: 736050 - protein, 21 aa, Mycobacterium
TAQLLARRVRTVVEHAVDEAI

SEQ ID NO: 736051 - protein, 22 aa, Mycobacterium
TAQLLARRVRTVVEHAVDEAIT

SEQ ID NO: 736052 - protein, 21 aa, Mycobacterium
TAQLPAVAALAWLTEAGDGFS

SEQ ID NO: 736053 - protein, 20 aa, Mycobacterium
TAQLPDWVAQVVRWQTEDFA

SEQ ID NO: 736054 - protein, 17 aa, Mycobacterium
TAQMWSRTQLRPADLDV

SEQ ID NO: 736055 - protein, 21 aa, Mycobacterium
TAQNGRYGPYLKRGTDSRSLA

SEQ ID NO: 736056 - protein, 22 aa, Mycobacterium
TAQQWFDLCAMVGHPEWIDEES

SEQ ID NO: 736057 - protein, 24 aa, Mycobacterium
TAQQWFDLCAMVGRPEWIDEDSPL

SEQ ID NO: 736058 - protein, 24 aa, Mycobacterium
TAQRMRHGMYWSGDLAYRDADGWI

SEQ ID NO: 736059 - protein, 19 aa, Mycobacterium
TAQRPAVFIFNHRNQADPL

SEQ ID NO: 736060 - protein, 20 aa, Mycobacterium
TAQRPAVFIFNHRNQVDPVI

SEQ ID NO: 736061 - protein, 18 aa, Mycobacterium
TAQRPGDVLTQYGGITVE

SEQ ID NO: 736062 - protein, 17 aa, Mycobacterium
TAQRPGDVLTQYGGTTV

SEQ ID NO: 736063 - protein, 17 aa, Mycobacterium
TAQRYGYRLGTPEENAA

SEQ ID NO: 736064 - protein, 24 aa, Mycobacterium
TAQYRTAALVPRPRPTGSANRLPL

SEQ ID NO: 736065 - protein, 21 aa, Mycobacterium
TARALLRSRLLTPAGPAALSR

SEQ ID NO: 736066 - protein, 20 aa, Mycobacterium
TARAPRAFLQGDPRIRRLWP

SEQ ID NO: 736067 - protein, 31 aa, Mycobacterium
TARAPRCGLCPLGQCAWRRAGYPAAQGPPRR

SEQ ID NO: 736068 - protein, 28 aa, Mycobacterium
TARAPRCGLCPLPACAWRDAGYPPAQGP

SEQ ID NO: 736069 - protein, 29 aa, Mycobacterium
TARAPRCGVCPLTHCAWRSRGFPAGTGPA

SEQ ID NO: 736070 - protein, 25 aa, Mycobacterium
TARAVCPLQCRLRRGAAADDQPEDR

SEQ ID NO: 736071 - protein, 27 aa, Mycobacterium
TARAVDAVTAWHGRLHGVVHCAGGSET

SEQ ID NO: 736072 - protein, 24 aa, Mycobacterium
TARDPATVPMRWRGTRWVLLGHDG

SEQ ID NO: 736073 - protein, 17 aa, Mycobacterium
TARELAAGDVLWTDISI

SEQ ID NO: 736074 - protein, 22 aa, Mycobacterium
TARELARVGAHVILAVRNTEKG

SEQ ID NO: 736075 - protein, 23 aa, Mycobacterium
TARELARVGARVVLAVRDTEKGK

SEQ ID NO: 736076 - protein, 30 aa, Mycobacterium
TAREPGPGLGTWWGSWRRFLPAGQDQPERR

SEQ ID NO: 736077 - protein, 17 aa, Mycobacterium
TAREQREGQSLDDRLAA

SEQ ID NO: 736078 - protein, 22 aa, Mycobacterium
TARFDVDAGFEHGLLVDTEAIE

SEQ ID NO: 736079 - protein, 23 aa, Mycobacterium
TARFKSPNPIHWANATHACTCEV

SEQ ID NO: 736080 - protein, 24 aa, Mycobacterium
TARFNSPNPIHWANATHACTCEVD

SEQ ID NO: 736081 - protein, 19 aa, Mycobacterium
TARGGCQEVMLGYSDSNKD

SEQ ID NO: 736082 - protein, 21 aa, Mycobacterium
TARGGVVHWARDADEANRIVT

SEQ ID NO: 736083 - protein, 22 aa, Mycobacterium
TARGRDGKLVLVASGEIDLTNV

SEQ ID NO: 736084 - protein, 21 aa, Mycobacterium
TARGRVACIAHHWDRRGDEIV

SEQ ID NO: 736085 - protein, 24 aa, Mycobacterium
TARHLTSTFGRWVHSIRSGHGAIP

SEQ ID NO: 736086 - protein, 18 aa, Mycobacterium
TARHPAPIWLPALTLTYL

SEQ ID NO: 736087 - protein, 22 aa, Mycobacterium
TARICGICPVAYQVSACNALEG

SEQ ID NO: 736088 - protein, 21 aa, Mycobacterium
TARLFSRQGATVFGIGRDTAR

SEQ ID NO: 736089 - protein, 22 aa, Mycobacterium
TARLRIPHQLRVGAPDQLEHDA

SEQ ID NO: 736090 - protein, 25 aa, Mycobacterium
TARLRWSRRPEWGGLEVDADVVGTT

SEQ ID NO: 736091 - protein, 21 aa, Mycobacterium
TARLYEDIGLLTAAPDIGADL

SEQ ID NO: 736092 - protein, 24 aa, Mycobacterium
TARMDLTFSLAERWSEAGEPAGIG

SEQ ID NO: 736093 - protein, 26 aa, Mycobacterium
TARMDRGRLGALIAETAQAATYRASD

SEQ ID NO: 736094 - protein, 20 aa, Mycobacterium
TARMVRGRLDAELVGNVSIR

SEQ ID NO: 736095 - protein, 25 aa, Mycobacterium
TARPDARLPLARRVTGECLAEDLRR

SEQ ID NO: 736096 - protein, 24 aa, Mycobacterium
TARQLKVFVERALGQWREYAPENR

SEQ ID NO: 736097 - protein, 23 aa, Mycobacterium
TARRGGDVPDEFDVAPLGEVSEQ

SEQ ID NO: 736098 - protein, 23 aa, Mycobacterium
TARSCAEWAHLVAGTTSIREGSR

SEQ ID NO: 736099 - protein, 18 aa, Mycobacterium
TARSPLVGPQFVDLVDAY

SEQ ID NO: 736100 - protein, 27 aa, Mycobacterium
TARSPRCGICPLSHCRWRSAGFPAGTV

SEQ ID NO: 736101 - protein, 19 aa, Mycobacterium
TARSWKAGLAQRAQARAGI

SEQ ID NO: 736102 - protein, 26 aa, Mycobacterium
TARTAGHPPTWVPLPVHYADYTLWHH

SEQ ID NO: 736103 - protein, 23 aa, Mycobacterium
TARTAGHPPVWTPLPVHYADYTL

SEQ ID NO: 736104 - protein, 26 aa, Mycobacterium
TARVLSRYVEAIVWRTFAHERLEAMA

SEQ ID NO: 736105 - protein, 19 aa, Mycobacterium
TARVQGVVFGQQYLMLDYD

SEQ ID NO: 736106 - protein, 21 aa, Mycobacterium
TARWWRATVFEPEALVGNSAV

SEQ ID NO: 736107 - protein, 20 aa, Mycobacterium
TASAACLRDARERYAPVPVI

SEQ ID NO: 736108 - protein, 18 aa, Mycobacterium
TASAACLRDARERYDVPV

SEQ ID NO: 736109 - protein, 17 aa, Mycobacterium
TASAARFAVRAGTGLPR

SEQ ID NO: 736110 - protein, 21 aa, Mycobacterium
TASADRPTAHFAEVQELADLE

SEQ ID NO: 736111 - protein, 20 aa, Mycobacterium
TASALTWMVERACQQNLPVK

SEQ ID NO: 736112 - protein, 18 aa, Mycobacterium
TASARGAEALGFAGTAPA

SEQ ID NO: 736113 - protein, 25 aa, Mycobacterium
TASARLGSVALSWDGGALTYRQLDE

SEQ ID NO: 736114 - protein, 22 aa, Mycobacterium
TASARSAERLRRHGADRIIDYI

SEQ ID NO: 736115 - protein, 26 aa, Mycobacterium
TASASELARLCFVTRQSLQDVLRGLR

SEQ ID NO: 736116 - protein, 26 aa, Mycobacterium
TASASVAKEPCRIAATAAGSAAVTAG

SEQ ID NO: 736117 - protein, 21 aa, Mycobacterium
TASDALRWGLINEVVPDGTVV

SEQ ID NO: 736118 - protein, 21 aa, Mycobacterium
TASDFRALLHVTVAEDDGAPL

SEQ ID NO: 736119 - protein, 21 aa, Mycobacterium
TASDMLTEWRSALAGSVATTP

SEQ ID NO: 736120 - protein, 18 aa, Mycobacterium
TASDRPAPTMGFAGTVPT

SEQ ID NO: 736121 - protein, 23 aa, Mycobacterium
TASEALYDWNYQRQLLAIRLAEA

SEQ ID NO: 736122 - protein, 17 aa, Mycobacterium
TASELDPPGGRREVGAL

SEQ ID NO: 736123 - protein, 18 aa, Mycobacterium
TASGRPARHLTRRQLELL

SEQ ID NO: 736124 - protein, 24 aa, Mycobacterium
TASIPRFADNVIRLKAELDPGTQA

SEQ ID NO: 736125 - protein, 18 aa, Mycobacterium
TASIPSLAVYPRLRRQSS

SEQ ID NO: 736126 - protein, 23 aa, Mycobacterium
TASIRYHAALGFVLQPGDKEVGG

SEQ ID NO: 736127 - protein, 21 aa, Mycobacterium
TASIWSRRRVLLLNSTYEPLT

SEQ ID NO: 736128 - protein, 25 aa, Mycobacterium
TASKGKWDILRAMGFDEDHISDSRS

SEQ ID NO: 736129 - protein, 24 aa, Mycobacterium
TASKGKWDTLRAMGFDDDHISDSR

SEQ ID NO: 736130 - protein, 24 aa, Mycobacterium
TASKGKWDTLRAMGFDEDHIGDSR

SEQ ID NO: 736131 - protein, 20 aa, Mycobacterium
TASLAMEYADAGIRVVATAP

SEQ ID NO: 736132 - protein, 19 aa, Mycobacterium
TASLARAARRPEAWDRPPP

SEQ ID NO: 736133 - protein, 26 aa, Mycobacterium
TASLERLGLDYVDLYLIHWPAPSLGN

SEQ ID NO: 736134 - protein, 21 aa, Mycobacterium
TASLLKYLIDHCGSPPPWAKE

SEQ ID NO: 736135 - protein, 18 aa, Mycobacterium
TASLLPALLRKSHATILN

SEQ ID NO: 736136 - protein, 20 aa, Mycobacterium
TASLRVNFLRPFHGGGEAHY

SEQ ID NO: 736137 - protein, 24 aa, Mycobacterium
TASNCPRTKMVLGGYSQGAAVAGF

SEQ ID NO: 736138 - protein, 22 aa, Mycobacterium
TASPGSPWLADTWRDRFQQMLQ

SEQ ID NO: 736139 - protein, 18 aa, Mycobacterium
TASPLYWASLATFAVDGA

SEQ ID NO: 736140 - protein, 20 aa, Mycobacterium
TASRGYSAVIAQLEGESWTG

SEQ ID NO: 736141 - protein, 24 aa, Mycobacterium
TASTFKRATLRKLGVKHVYDSRTT

SEQ ID NO: 736142 - protein, 18 aa, Mycobacterium
TASVAEVRAYLRVTARTV

SEQ ID NO: 736143 - protein, 19 aa, Mycobacterium
TASVGEVRAYLRATARTVL

SEQ ID NO: 736144 - protein, 20 aa, Mycobacterium
TASVYRCRLPFCDVTVGLVV

SEQ ID NO: 736145 - protein, 24 aa, Mycobacterium
TATAEAFAGGWFHSGDLVRQDEEG

SEQ ID NO: 736146 - protein, 24 aa, Mycobacterium
TATAERVADGLGIAVTAGSAITAG

SEQ ID NO: 736147 - protein, 24 aa, Mycobacterium
TATALGLAPRAPWHTARAPITGAA

SEQ ID NO: 736148 - protein, 17 aa, Mycobacterium
TATATGTPVDWTEEHSY

SEQ ID NO: 736149 - protein, 24 aa, Mycobacterium
TATDIPNLLAMVISGLQGTNLDRT

SEQ ID NO: 736150 - protein, 25 aa, Mycobacterium
TATDWLVLCDFDETFFAHDPAVRSR

SEQ ID NO: 736151 - protein, 19 aa, Mycobacterium
TATEFKLLAFLVQHAGRAF

SEQ ID NO: 736152 - protein, 17 aa, Mycobacterium
TATELVLASGRAAWDNR

SEQ ID NO: 736153 - protein, 19 aa, Mycobacterium
TATGAGWAGPGDVWAGPVS

SEQ ID NO: 736154 - protein, 18 aa, Mycobacterium
TATGFWRWMEATPDGAPI

SEQ ID NO: 736155 - protein, 17 aa, Mycobacterium
TATGIDIFRIFDALNNV

SEQ ID NO: 736156 - protein, 18 aa, Mycobacterium
TATGRWYLQDRVIVAEAN

SEQ ID NO: 736157 - protein, 23 aa, Mycobacterium
TATGVRYDSPFVCIFETKDGLIV

SEQ ID NO: 736158 - protein, 17 aa, Mycobacterium
TATHLPPSSAWTERAAA

SEQ ID NO: 736159 - protein, 17 aa, Mycobacterium
TATLDCADGKSLNVAGS

SEQ ID NO: 736160 - protein, 18 aa, Mycobacterium
TATLDCADGKSLNVAGSE

SEQ ID NO: 736161 - protein, 23 aa, Mycobacterium
TATLFHLSPVPGFGNSTGSPSSG

SEQ ID NO: 736162 - protein, 32 aa, Mycobacterium
TATLLIDRSAAWMFDYYPLRVRTEFPDGSCEA

SEQ ID NO: 736163 - protein, 28 aa, Mycobacterium
TATLLTARCPVLYAPAMHTEMWQHPATV

SEQ ID NO: 736164 - protein, 17 aa, Mycobacterium
TATLPWLGDHQVNSVAA

SEQ ID NO: 736165 - protein, 18 aa, Mycobacterium
TATMDWTFGEVISYVSRG

SEQ ID NO: 736166 - protein, 18 aa, Mycobacterium
TATPRLRRIIVLADDGYS

SEQ ID NO: 736167 - protein, 18 aa, Mycobacterium
TATPTRPALKEWSAAIHA

SEQ ID NO: 736168 - protein, 26 aa, Mycobacterium
TATPWLAAFAQRSPFAEAFRSNGQSA

SEQ ID NO: 736169 - protein, 23 aa, Mycobacterium
TATQCRAAAMAFEQAYAMTVPPP

SEQ ID NO: 736170 - protein, 28 aa, Mycobacterium
TATRCGDAWLLNGFKWFASNCAGEAFVV

SEQ ID NO: 736171 - protein, 25 aa, Mycobacterium
TATRELDWWLGFSSTASLLGSPGQT

SEQ ID NO: 736172 - protein, 23 aa, Mycobacterium
TATRLGGPGQWLLALPPHHIAGM

SEQ ID NO: 736173 - protein, 28 aa, Mycobacterium
TATRRACAAWLWSRRRGIVAGRSASALH

SEQ ID NO: 736174 - protein, 31 aa, Mycobacterium
TATRWFRLMSAWLMLAARPDLIGKRTSDDKP

SEQ ID NO: 736175 - protein, 18 aa, Mycobacterium
TATSRLIVTAGIADAFCD

SEQ ID NO: 736176 - protein, 18 aa, Mycobacterium
TATSRLIVTDGIADKFTE

SEQ ID NO: 736177 - protein, 29 aa, Mycobacterium
TATTGARVPLCFGFHPYLQLPGVPRSQWQ

SEQ ID NO: 736178 - protein, 20 aa, Mycobacterium
TATTPLPFAGSVGYTVRVLP

SEQ ID NO: 736179 - protein, 25 aa, Mycobacterium
TATTWRAGIEQTITWYRADPERIKY

SEQ ID NO: 736180 - protein, 17 aa, Mycobacterium
TATVEWLTTVLAEDALG

SEQ ID NO: 736181 - protein, 19 aa, Mycobacterium
TATVIERWVQEYLEATGRL

SEQ ID NO: 736182 - protein, 19 aa, Mycobacterium
TATVIERWVQEYLEATNRL

SEQ ID NO: 736183 - protein, 19 aa, Mycobacterium
TATVPLELVAANRSALMSM

SEQ ID NO: 736184 - protein, 24 aa, Mycobacterium
TATWTLPSAQAWWEMTWKGRPDPA

SEQ ID NO: 736185 - protein, 24 aa, Mycobacterium
TATYLVRMLRDFPGLTVTRLASGL

SEQ ID NO: 736186 - protein, 17 aa, Mycobacterium
TAVAAILRREHGVGEGW

SEQ ID NO: 736187 - protein, 23 aa, Mycobacterium
TAVACPRFVDFVERGITSGRQVL

SEQ ID NO: 736188 - protein, 24 aa, Mycobacterium
TAVADWIAMFSMWPVKQTPGLRCQ

SEQ ID NO: 736189 - protein, 18 aa, Mycobacterium
TAVADWLVERGWQVSAQT

SEQ ID NO: 736190 - protein, 18 aa, Mycobacterium
TAVAFVKKFTRLAHLEEL

SEQ ID NO: 736191 - protein, 18 aa, Mycobacterium
TAVAKRAEKAFADAGKNA

SEQ ID NO: 736192 - protein, 32 aa, Mycobacterium
TAVAPAAGNAFEIGGAPAFAAVTPNATSGGAV

SEQ ID NO: 736193 - protein, 26 aa, Mycobacterium
TAVAPELLPRITRYEPAGSPEAGTAP

SEQ ID NO: 736194 - protein, 24 aa, Mycobacterium
TAVATERLMLLWAQAEAARLTNVR

SEQ ID NO: 736195 - protein, 19 aa, Mycobacterium
TAVATLFAGFGQEYQAIST

SEQ ID NO: 736196 - protein, 17 aa, Mycobacterium
TAVDGRGGGKADLAQGS

SEQ ID NO: 736197 - protein, 23 aa, Mycobacterium
TAVDLACRYPLDTAVTLIDALGN

SEQ ID NO: 736198 - protein, 27 aa, Mycobacterium
TAVDLRYLGSLTHGFANMFQLGGDSMV

SEQ ID NO: 736199 - protein, 17 aa, Mycobacterium
TAVDVLTRILARNGAQV

SEQ ID NO: 736200 - protein, 21 aa, Mycobacterium
TAVEEIVRWASPVAYMRRTAT

SEQ ID NO: 736201 - protein, 20 aa, Mycobacterium
TAVEELMRYLSIIQTGQRRI

SEQ ID NO: 736202 - protein, 20 aa, Mycobacterium
TAVEEMVRWISPSPSKRRTA

SEQ ID NO: 736203 - protein, 22 aa, Mycobacterium
TAVEIGAVFSLLGDAIKPDDYP

SEQ ID NO: 736204 - protein, 25 aa, Mycobacterium
TAVELILHLPLIVAIANTAHPLDPA

SEQ ID NO: 736205 - protein, 26 aa, Mycobacterium
TAVELRNRLKIATGLTLSPTLIFDHP

SEQ ID NO: 736206 - protein, 17 aa, Mycobacterium
TAVEPYITWMHTTAAQL

SEQ ID NO: 736207 - protein, 18 aa, Mycobacterium
TAVERFGGLDIMVNNAGI

SEQ ID NO: 736208 - protein, 18 aa, Mycobacterium
TAVEVLWRGQRLRALVAL

SEQ ID NO: 736209 - protein, 25 aa, Mycobacterium
TAVGDWLDEHGHPRYADDTDSPAAK

SEQ ID NO: 736210 - protein, 23 aa, Mycobacterium
TAVGIRIAVRLGPVAVKSTIGTA

SEQ ID NO: 736211 - protein, 21 aa, Mycobacterium
TAVGPDLSRCIARVEKVQPSQ

SEQ ID NO: 736212 - protein, 32 aa, Mycobacterium
TAVIKRFPIGVLLGIMPWNFPYYQVARFACPN

SEQ ID NO: 736213 - protein, 22 aa, Mycobacterium
TAVIRIAPPVGRQLDWMVCRTV

SEQ ID NO: 736214 - protein, 26 aa, Mycobacterium
TAVKLVNLPVEWSVRGVDRAADALRS

SEQ ID NO: 736215 - protein, 18 aa, Mycobacterium
TAVKRFGAVDALVNVAAK

SEQ ID NO: 736216 - protein, 21 aa, Mycobacterium
TAVLAGFDWESLGSRESQRRR

SEQ ID NO: 736217 - protein, 26 aa, Mycobacterium
TAVLCIDWQVDFCGRGGYVDTMGYDL

SEQ ID NO: 736218 - protein, 20 aa, Mycobacterium
TAVLFAWAVVLSRLTDRRDV

SEQ ID NO: 736219 - protein, 21 aa, Mycobacterium
TAVLFAWAVVLSRLTDRRDVV

SEQ ID NO: 736220 - protein, 18 aa, Mycobacterium
TAVLGRVRDGVRFCAVCG

SEQ ID NO: 736221 - protein, 20 aa, Mycobacterium
TAVLQLVWLSLAGLPPEKLT

SEQ ID NO: 736222 - protein, 17 aa, Mycobacterium
TAVLSHRSAEVALQRAN

SEQ ID NO: 736223 - protein, 27 aa, Mycobacterium
TAVMCSESVWWRCHRRLIADVAELGRS

SEQ ID NO: 736224 - protein, 17 aa, Mycobacterium
TAVNDWLDENGDPKAAG

SEQ ID NO: 736225 - protein, 21 aa, Mycobacterium
TAVNELMLFDAHNPRSLVYQM

SEQ ID NO: 736226 - protein, 27 aa, Mycobacterium
TAVNFGPDWSFWPNRFLGSADPAVIGH

SEQ ID NO: 736227 - protein, 25 aa, Mycobacterium
TAVNYRLALRNGVLVHRKAAPDPAT

SEQ ID NO: 736228 - protein, 26 aa, Mycobacterium
TAVPAPIRLSPPIGIKGVTYAPNTFT

SEQ ID NO: 736229 - protein, 24 aa, Mycobacterium
TAVPLCFGFHPYLRLPDAARAEWV

SEQ ID NO: 736230 - protein, 20 aa, Mycobacterium
TAVPRLAKDRVVADEVAGVV

SEQ ID NO: 736231 - protein, 24 aa, Mycobacterium
TAVQYRLPITFLLFDNHAHAMCVT

SEQ ID NO: 736232 - protein, 23 aa, Mycobacterium
TAVQYRLPVTFVLFNNNAHAMCV

SEQ ID NO: 736233 - protein, 21 aa, Mycobacterium
TAVRCKVSLAGDADEATLNEI

SEQ ID NO: 736234 - protein, 25 aa, Mycobacterium
TAVRMDLGLRMGRFHQTYDLLLTPT

SEQ ID NO: 736235 - protein, 26 aa, Mycobacterium
TAVRRARRAVAEFRIRGVSTNIPFLQ

SEQ ID NO: 736236 - protein, 17 aa, Mycobacterium
TAVRYWLIQLAKAVTAL

SEQ ID NO: 736237 - protein, 27 aa, Mycobacterium
TAVSFPVWSGRCGFAVQEFARRHGDFA

SEQ ID NO: 736238 - protein, 25 aa, Mycobacterium
TAVTFPAPVKYVAPIAFNVIPLAGS

SEQ ID NO: 736239 - protein, 19 aa, Mycobacterium
TAVTGLPAPLAHPGLVCDV

SEQ ID NO: 736240 - protein, 18 aa, Mycobacterium
TAVTRAKALAGIDEDTKV

SEQ ID NO: 736241 - protein, 23 aa, Mycobacterium
TAVVIHRGRILGVVPKSYLPTYR

SEQ ID NO: 736242 - protein, 17 aa, Mycobacterium
TAVVLGRPGGPKFRPSE

SEQ ID NO: 736243 - protein, 18 aa, Mycobacterium
TAVVRYFVDLTVPPANLR

SEQ ID NO: 736244 - protein, 24 aa, Mycobacterium
TAVYVCGPSAMLEAVRIARDQYAG

SEQ ID NO: 736245 - protein, 23 aa, Mycobacterium
TAWAAEGLLGFLPPEAQDRLLDD

SEQ ID NO: 736246 - protein, 19 aa, Mycobacterium
TAWIAEGLLGYLPPDAQDR

SEQ ID NO: 736247 - protein, 20 aa, Mycobacterium
TAWIPVNYPGAVCDPDTGAW

SEQ ID NO: 736248 - protein, 20 aa, Mycobacterium
TAWLAEGLLMYLPADAQDRL

SEQ ID NO: 736249 - protein, 20 aa, Mycobacterium
TAWLAEGLLMYLPAEAQDRL

SEQ ID NO: 736250 - protein, 25 aa, Mycobacterium
TAWLAEGLLPFLPGAAQDLLFERIA

SEQ ID NO: 736251 - protein, 28 aa, Mycobacterium
TAWLRDRLSEVLPAYMVPAAFIEIDQLP

SEQ ID NO: 736252 - protein, 30 aa, Mycobacterium
TAWLRDRLSEVLPAYMVPAAFMVIDELPLT

SEQ ID NO: 736253 - protein, 29 aa, Mycobacterium
TAWLRDRLSEVLPAYMVPAAFVVIDELPL

SEQ ID NO: 736254 - protein, 29 aa, Mycobacterium
TAWLRDRLSEVLPAYMVPAAFVVIGELPL

SEQ ID NO: 736255 - protein, 29 aa, Mycobacterium
TAWLRDRLSEVLPPYMVPAAFIEIDQLPL

SEQ ID NO: 736256 - protein, 32 aa, Mycobacterium
TAWLRDRLSEVLPPYMVPAAFMLIDQLPLTVN

SEQ ID NO: 736257 - protein, 28 aa, Mycobacterium
TAWLRDRLSEVLPPYMVPAAFVVIDELP

SEQ ID NO: 736258 - protein, 20 aa, Mycobacterium
TAWQVFPNFQIGQGLTSALC

SEQ ID NO: 736259 - protein, 19 aa, Mycobacterium
TAWSMDTYGPFSVSEQVSM

SEQ ID NO: 736260 - protein, 17 aa, Mycobacterium
TAWTREANIRWGFDQEH

SEQ ID NO: 736261 - protein, 18 aa, Mycobacterium
TAWVDGRPLIVFHEIYTM

SEQ ID NO: 736262 - protein, 20 aa, Mycobacterium
TAWYLDRIATLDSIDNPDGP

SEQ ID NO: 736263 - protein, 25 aa, Mycobacterium
TAYAFSAGGPVVWPDLDAILVVPNN

SEQ ID NO: 736264 - protein, 18 aa, Mycobacterium
TAYASVAGHAVWVRMRTL

SEQ ID NO: 736265 - protein, 17 aa, Mycobacterium
TAYAWAYNMQKGGKTRI

SEQ ID NO: 736266 - protein, 19 aa, Mycobacterium
TAYDLGRRLPVETGAIRLD

SEQ ID NO: 736267 - protein, 17 aa, Mycobacterium
TAYFGERHRVVGTNRFL

SEQ ID NO: 736268 - protein, 17 aa, Mycobacterium
TAYFGERQRAVGTKRFL

SEQ ID NO: 736269 - protein, 22 aa, Mycobacterium
TAYGEWKGGWVDFDGTNLRVGA

SEQ ID NO: 736270 - protein, 17 aa, Mycobacterium
TAYGQGFLDDIPKPLGR

SEQ ID NO: 736271 - protein, 17 aa, Mycobacterium
TAYGQGYLDGIAKPLGR

SEQ ID NO: 736272 - protein, 24 aa, Mycobacterium
TAYLECAQACGLSLLGGPPSPETA

SEQ ID NO: 736273 - protein, 24 aa, Mycobacterium
TAYLECAQACGLSLLGGPPTTETA

SEQ ID NO: 736274 - protein, 18 aa, Mycobacterium
TAYQLGVLERALELTASY

SEQ ID NO: 736275 - protein, 20 aa, Mycobacterium
TAYQRLNIMVGKLNRAMQRN

SEQ ID NO: 736276 - protein, 24 aa, Mycobacterium
TAYSPEAAKFFGLEETRYEGPTGI

SEQ ID NO: 736277 - protein, 25 aa, Mycobacterium
TAYWKRHVREAVRFADSVRFAQSAG

SEQ ID NO: 736278 - protein, 25 aa, Mycobacterium
TCAAALPHLVERGGSVINISSAAGV

SEQ ID NO: 736279 - protein, 29 aa, Mycobacterium
TCAAHRLAWAHLWERVSIEFSNHTEELRV

SEQ ID NO: 736280 - protein, 19 aa, Mycobacterium
TCAFLCGSAGAAVDVGTEV

SEQ ID NO: 736281 - protein, 20 aa, Mycobacterium
TCAIEVWAHQIADLAGDYRV

SEQ ID NO: 736282 - protein, 20 aa, Mycobacterium
TCCPGCGTAVVVRDWYAMRH

SEQ ID NO: 736283 - protein, 18 aa, Mycobacterium
TCDVRFTVFIGRQPGDDS

SEQ ID NO: 736284 - protein, 17 aa, Mycobacterium
TCECRPFDTAVLGRELS

SEQ ID NO: 736285 - protein, 25 aa, Mycobacterium
TCEKYARRGLVQFLGDDVGNPVATV

SEQ ID NO: 736286 - protein, 25 aa, Mycobacterium
TCEPLRYRPQWAAFGRAPADVSVNF

SEQ ID NO: 736287 - protein, 23 aa, Mycobacterium
TCEVWFERHGRPIGAGRSTRTVN

SEQ ID NO: 736288 - protein, 17 aa, Mycobacterium
TCFHVERGLHGDIYQAT

SEQ ID NO: 736289 - protein, 24 aa, Mycobacterium
TCFPPAVALSQTWDPDLVERVGAA

SEQ ID NO: 736290 - protein, 18 aa, Mycobacterium
TCGGCVYDGVALDGVQLR

SEQ ID NO: 736291 - protein, 21 aa, Mycobacterium
TCGGVRLWSLYVPNGRALGDP

SEQ ID NO: 736292 - protein, 22 aa, Mycobacterium
TCGGVRVWSLYVPNGRALEDPH

SEQ ID NO: 736293 - protein, 19 aa, Mycobacterium
TCGLTLPGGAVVRHAAVTH

SEQ ID NO: 736294 - protein, 29 aa, Mycobacterium
TCGRMFIFIGAAPRTDWLDGVLARDDHGF

SEQ ID NO: 736295 - protein, 17 aa, Mycobacterium
TCGYRLVGRSGSVSCEQ

SEQ ID NO: 736296 - protein, 19 aa, Mycobacterium
TCHFIRPGWKLPHRAASSQ

SEQ ID NO: 736297 - protein, 18 aa, Mycobacterium
TCHYVMGGIEVDPDSGAA

SEQ ID NO: 736298 - protein, 18 aa, Mycobacterium
TCHYVMGGIEVDPDTGEA

SEQ ID NO: 736299 - protein, 20 aa, Mycobacterium
TCIQCGNCSFVCPHSVIRTT

SEQ ID NO: 736300 - protein, 24 aa, Mycobacterium
TCIVDLPTAILLHRNRIADPTARR

SEQ ID NO: 736301 - protein, 23 aa, Mycobacterium
TCLISSAGSVEWLCVPRPDSPSV

SEQ ID NO: 736302 - protein, 20 aa, Mycobacterium
TCLLTPPPWYPILRGTTQQA

SEQ ID NO: 736303 - protein, 26 aa, Mycobacterium
TCLNVGCLPTKMFVYAADVAKTIRGA

SEQ ID NO: 736304 - protein, 19 aa, Mycobacterium
TCLRRGEIEMVTRYEPDSA

SEQ ID NO: 736305 - protein, 19 aa, Mycobacterium
TCLRRGEIEMVTRYEPGAA

SEQ ID NO: 736306 - protein, 19 aa, Mycobacterium
TCLRRSEVEVVTRFDSSAR

SEQ ID NO: 736307 - protein, 25 aa, Mycobacterium
TCLSEARYGIVWGAMGAARSAWQCA

SEQ ID NO: 736308 - protein, 20 aa, Mycobacterium
TCNRTATDLGDFTRNLAHAA

SEQ ID NO: 736309 - protein, 18 aa, Mycobacterium
TCNTLTLWSARAIQSLAL

SEQ ID NO: 736310 - protein, 18 aa, Mycobacterium
TCPAQLRRRYLGKLSGPL

SEQ ID NO: 736311 - protein, 21 aa, Mycobacterium
TCPECGQTIDVEKNQRETAKS

SEQ ID NO: 736312 - protein, 24 aa, Mycobacterium
TCPESLFPDEARRALLTADATDTL

SEQ ID NO: 736313 - protein, 25 aa, Mycobacterium
TCPMAWSDTYGGHWVAAGSHEVFEL

SEQ ID NO: 736314 - protein, 19 aa, Mycobacterium
TCPNCRNGVQTSCVHGVLM

SEQ ID NO: 736315 - protein, 24 aa, Mycobacterium
TCPPETKLSCPIYAYIGDKDWITT

SEQ ID NO: 736316 - protein, 25 aa, Mycobacterium
TCPVGWSDQYGGFWLLATYDDVLEV

SEQ ID NO: 736317 - protein, 18 aa, Mycobacterium
TCPYCRFTFVNVRVTKHG

SEQ ID NO: 736318 - protein, 21 aa, Mycobacterium
TCQPKTRIWWGAYLGTDDELL

SEQ ID NO: 736319 - protein, 23 aa, Mycobacterium
TCQSHIRVAVALRNTVWRGDSPA

SEQ ID NO: 736320 - protein, 25 aa, Mycobacterium
TCRAAIPHLLERGGSLINVSSAAGI

SEQ ID NO: 736321 - protein, 17 aa, Mycobacterium
TCRECRRGMTGSCNSVP

SEQ ID NO: 736322 - protein, 17 aa, Mycobacterium
TCREFAGVVDDVVCASM

SEQ ID NO: 736323 - protein, 18 aa, Mycobacterium
TCRPEEFTIATVPDRFAE

SEQ ID NO: 736324 - protein, 18 aa, Mycobacterium
TCRSLEFHRAVEVIAAGR

SEQ ID NO: 736325 - protein, 24 aa, Mycobacterium
TCRVHGRSGVWVAGDGARPDRKVA

SEQ ID NO: 736326 - protein, 17 aa, Mycobacterium
TCRWCTDGQTNLCDLGA

SEQ ID NO: 736327 - protein, 22 aa, Mycobacterium
TCSAGSRLLVHDTIHDTLVEMV

SEQ ID NO: 736328 - protein, 18 aa, Mycobacterium
TCSDEGRLGEVVSAPADG

SEQ ID NO: 736329 - protein, 24 aa, Mycobacterium
TCSEMAFDPGFRPLVEQLRDELTV

SEQ ID NO: 736330 - protein, 22 aa, Mycobacterium
TCSPHLAETVGVLADALRRHPV

SEQ ID NO: 736331 - protein, 21 aa, Mycobacterium
TCSSCFLVQHQNRLALQRGNE

SEQ ID NO: 736332 - protein, 20 aa, Mycobacterium
TCTCPSRALIQADIYDEFLQ

SEQ ID NO: 736333 - protein, 22 aa, Mycobacterium
TCTECPDGTVGEIWVCGDNVAI

SEQ ID NO: 736334 - protein, 20 aa, Mycobacterium
TCTIEPGVVTGFLGPNGAGK

SEQ ID NO: 736335 - protein, 20 aa, Mycobacterium
TCTLSMEPSYMVQSFEGTMT

SEQ ID NO: 736336 - protein, 19 aa, Mycobacterium
TCVAGGFEMLSSTDIRVAV

SEQ ID NO: 736337 - protein, 20 aa, Mycobacterium
TCVGDARAAAEMVGLSDVAR

SEQ ID NO: 736338 - protein, 23 aa, Mycobacterium
TCVGRLRYLGLVLYDVDRVLQAA

SEQ ID NO: 736339 - protein, 24 aa, Mycobacterium
TCVGRLRYLGVVLYDADRVLEAAS

SEQ ID NO: 736340 - protein, 24 aa, Mycobacterium
TCVGRLRYLGVVLYDVDRVTEAAS

SEQ ID NO: 736341 - protein, 20 aa, Mycobacterium
TCVGVVRPTEKLRCSETRYD

SEQ ID NO: 736342 - protein, 19 aa, Mycobacterium
TCVQREIAEEIGLTVTDVQ

SEQ ID NO: 736343 - protein, 22 aa, Mycobacterium
TCVRVPVFTGHCLSINAEFARP

SEQ ID NO: 736344 - protein, 17 aa, Mycobacterium
TDAAAVCGCPVGTIRSR

SEQ ID NO: 736345 - protein, 17 aa, Mycobacterium
TDAALRRRIHALVDEER

SEQ ID NO: 736346 - protein, 17 aa, Mycobacterium
TDAARLTIRGPIVTADA

SEQ ID NO: 736347 - protein, 20 aa, Mycobacterium
TDAARQWPDRTAVRDAVGGT

SEQ ID NO: 736348 - protein, 21 aa, Mycobacterium
TDADGGPALVEFAGRACYQSW

SEQ ID NO: 736349 - protein, 22 aa, Mycobacterium
TDADLLNFSFLLLVAGNETTRN

SEQ ID NO: 736350 - protein, 19 aa, Mycobacterium
TDADVRAMFAPKLDAAALL

SEQ ID NO: 736351 - protein, 18 aa, Mycobacterium
TDADWMFRVLATAWDRVD

SEQ ID NO: 736352 - protein, 25 aa, Mycobacterium
TDAEARSLFDLNVFGLINVTRAVLP

SEQ ID NO: 736353 - protein, 25 aa, Mycobacterium
TDAEDKRTALLISEVLPREFGDEPT

SEQ ID NO: 736354 - protein, 22 aa, Mycobacterium
TDAEIFGAPFYLMERQDGEVIR

SEQ ID NO: 736355 - protein, 22 aa, Mycobacterium
TDAESAFEAWKKCSAGRPCDYT

SEQ ID NO: 736356 - protein, 23 aa, Mycobacterium
TDAGEFVDFEASFVLRAANGVMF

SEQ ID NO: 736357 - protein, 22 aa, Mycobacterium
TDAGFAVVEFVVSPLFGSPPEA

SEQ ID NO: 736358 - protein, 21 aa, Mycobacterium
TDAGMRRWAGEVFAVYRDGLV

SEQ ID NO: 736359 - protein, 18 aa, Mycobacterium
TDAGSGWSLHAEGVLRAG

SEQ ID NO: 736360 - protein, 26 aa, Mycobacterium
TDAGTYLGALGWRIAGVSNTDLFARH

SEQ ID NO: 736361 - protein, 24 aa, Mycobacterium
TDAGVEWKDIQFGFGGSHEVSNPD

SEQ ID NO: 736362 - protein, 17 aa, Mycobacterium
TDAGWKISGTGYDRTYD

SEQ ID NO: 736363 - protein, 27 aa, Mycobacterium
TDAKHFARLGIRCFGFAPLRLPPDLDF

SEQ ID NO: 736364 - protein, 17 aa, Mycobacterium
TDALCAQAVRLIFDALP

SEQ ID NO: 736365 - protein, 19 aa, Mycobacterium
TDALILGPLRIQFWVCGVF

SEQ ID NO: 736366 - protein, 20 aa, Mycobacterium
TDALKLWNVVMGMAELPHVY

SEQ ID NO: 736367 - protein, 18 aa, Mycobacterium
TDALPALARTPVEAIGVD

SEQ ID NO: 736368 - protein, 23 aa, Mycobacterium
TDALPARYGQAVAESEVHPLGQP

SEQ ID NO: 736369 - protein, 17 aa, Mycobacterium
TDALRAAGWDPPRYTTT

SEQ ID NO: 736370 - protein, 22 aa, Mycobacterium
TDALRRGGYRVARPGEPAIAQF

SEQ ID NO: 736371 - protein, 19 aa, Mycobacterium
TDALVSWADPEFLNGRPAM

SEQ ID NO: 736372 - protein, 25 aa, Mycobacterium
TDAPAGGCPAGFGRIKPPVAGGSNR

SEQ ID NO: 736373 - protein, 19 aa, Mycobacterium
TDAPFLTPHPFRGAPNEPY

SEQ ID NO: 736374 - protein, 24 aa, Mycobacterium
TDAPGFHVPFYWWTFNMPTDHGEV

SEQ ID NO: 736375 - protein, 24 aa, Mycobacterium
TDAPGLVKHRLPVGINLPEKQYTL

SEQ ID NO: 736376 - protein, 24 aa, Mycobacterium
TDAPQEWTDIEWFSALEPTADAFR

SEQ ID NO: 736377 - protein, 18 aa, Mycobacterium
TDAQAWLTALNDVRLALG

SEQ ID NO: 736378 - protein, 23 aa, Mycobacterium
TDARAETALRHYLEKVHEVHDLE

SEQ ID NO: 736379 - protein, 17 aa, Mycobacterium
TDARLAYLFEVDYVDHF

SEQ ID NO: 736380 - protein, 17 aa, Mycobacterium
TDARLEILPDVGHFAQV

SEQ ID NO: 736381 - protein, 22 aa, Mycobacterium
TDARNLATMLGLDAPSQPSPGV

SEQ ID NO: 736382 - protein, 23 aa, Mycobacterium
TDARRREVYWARYRDGVRTAGPA

SEQ ID NO: 736383 - protein, 18 aa, Mycobacterium
TDARSVQDVAGWKVALAN

SEQ ID NO: 736384 - protein, 29 aa, Mycobacterium
TDASKWGRRGVNMFLEWSSTLRKHQVLSA

SEQ ID NO: 736385 - protein, 18 aa, Mycobacterium
TDATFDYMLVIGTGRYSN

SEQ ID NO: 736386 - protein, 17 aa, Mycobacterium
TDAVGLCEAVADAACGR

SEQ ID NO: 736387 - protein, 18 aa, Mycobacterium
TDAWEPRAVRAHGDFARA

SEQ ID NO: 736388 - protein, 22 aa, Mycobacterium
TDAYARFLPSWQHVGSTNTTGI

SEQ ID NO: 736389 - protein, 17 aa, Mycobacterium
TDAYSRGGAGGAGGDAG

SEQ ID NO: 736390 - protein, 17 aa, Mycobacterium
TDCPVCGGSGLRAEALA

SEQ ID NO: 736391 - protein, 20 aa, Mycobacterium
TDCRTAIAAAAWTFDLTERE

SEQ ID NO: 736392 - protein, 31 aa, Mycobacterium
TDDDLIAGAAYRWLRSWPTAPADPWDVPSGW

SEQ ID NO: 736393 - protein, 24 aa, Mycobacterium
TDDILVELGLDWDRIIELKTAGAV

SEQ ID NO: 736394 - protein, 17 aa, Mycobacterium
TDDLDFLNLAVLDALLT

SEQ ID NO: 736395 - protein, 22 aa, Mycobacterium
TDDLKLLGVHIFGTSATEMVHI

SEQ ID NO: 736396 - protein, 17 aa, Mycobacterium
TDDLLLVAGMRVTQREK

SEQ ID NO: 736397 - protein, 18 aa, Mycobacterium
TDDLRPGGIAPINEVTNA

SEQ ID NO: 736398 - protein, 18 aa, Mycobacterium
TDDPELDAAFAFLQNGAG

SEQ ID NO: 736399 - protein, 18 aa, Mycobacterium
TDDQWRWLANTLTVELLK

SEQ ID NO: 736400 - protein, 24 aa, Mycobacterium
TDDRMRHGMFWSGDLAYRDADGWI

SEQ ID NO: 736401 - protein, 19 aa, Mycobacterium
TDDRVALAAALAVRALRGG

SEQ ID NO: 736402 - protein, 22 aa, Mycobacterium
TDDTKLDWARKFGATHTVNARQ

SEQ ID NO: 736403 - protein, 26 aa, Mycobacterium
TDEAGSCYRIKLPHHDAAKFDAALAS

SEQ ID NO: 736404 - protein, 26 aa, Mycobacterium
TDEAHLAVQLCWSFYQRLIAAYAHPD

SEQ ID NO: 736405 - protein, 19 aa, Mycobacterium
TDEALQWFIHAAEADVEGV

SEQ ID NO: 736406 - protein, 21 aa, Mycobacterium
TDEAMDFYAWGYDKKNHPVRV

SEQ ID NO: 736407 - protein, 22 aa, Mycobacterium
TDEAREALADTVVRRGDTPLPV

SEQ ID NO: 736408 - protein, 19 aa, Mycobacterium
TDEASCRAAIAAAAEALGG

SEQ ID NO: 736409 - protein, 19 aa, Mycobacterium
TDEASCRSALAAAADALGG

SEQ ID NO: 736410 - protein, 26 aa, Mycobacterium
TDEDFRHTFDWCVTSAFIMSQLAAPH

SEQ ID NO: 736411 - protein, 27 aa, Mycobacterium
TDEDFRHTFDWCVTSAFIMSQLVAPHM

SEQ ID NO: 736412 - protein, 27 aa, Mycobacterium
TDEDFRHTFDWCVTSAFIMSQLVAPQM

SEQ ID NO: 736413 - protein, 24 aa, Mycobacterium
TDEEGLDWEGEVVAWVGRELSCAT

SEQ ID NO: 736414 - protein, 23 aa, Mycobacterium
TDEFKAAAPTGGMLSKADIEAAL

SEQ ID NO: 736415 - protein, 24 aa, Mycobacterium
TDEFLRRPIVWAEMLSKFRANVTA

SEQ ID NO: 736416 - protein, 21 aa, Mycobacterium
TDEGRWLDLCSGPGGKTALLA

SEQ ID NO: 736417 - protein, 18 aa, Mycobacterium
TDEGWRGSASDSMAAAVA
